United States Patent 7,888,497 (BIOINFORMATICALLY DETECTABLE GROUP OF NOVEL REGULATORY OLIGONUCLEOTIDES AND USES THEREOF) - sequence listing, part 26

SEQ ID NO: 1072304 - DNA, 18 bp, Homo sapiens
ctcccctccacagctgca

SEQ ID NO: 1072305 - DNA, 14 bp, Homo sapiens
ctcccctccatccc

SEQ ID NO: 1072306 - DNA, 12 bp, Homo sapiens
ctcccctcccag

SEQ ID NO: 1072307 - DNA, 15 bp, Homo sapiens
ctcccctcccagtcc

SEQ ID NO: 1072308 - DNA, 19 bp, Homo sapiens
ctcccctccctcttccttc

SEQ ID NO: 1072309 - DNA, 20 bp, Homo sapiens
ctcccctccctcttccttcc

SEQ ID NO: 1072310 - DNA, 15 bp, Homo sapiens
ctcccctcctcttcc

SEQ ID NO: 1072311 - DNA, 23 bp, Homo sapiens
ctcccctcctcttcccttagcct

SEQ ID NO: 1072312 - DNA, 14 bp, Homo sapiens
ctcccctcctgcac

SEQ ID NO: 1072313 - DNA, 15 bp, Homo sapiens
ctcccctcctgctgg

SEQ ID NO: 1072314 - DNA, 16 bp, Homo sapiens
ctcccctccttgcctc

SEQ ID NO: 1072315 - DNA, 19 bp, Homo sapiens
ctcccctccttgcctcctg

SEQ ID NO: 1072316 - DNA, 20 bp, Homo sapiens
ctcccctcgtgtcagctcag

SEQ ID NO: 1072317 - DNA, 14 bp, Homo sapiens
ctcccctctcagaa

SEQ ID NO: 1072318 - DNA, 23 bp, Homo sapiens
ctcccctctcagaacatactgat

SEQ ID NO: 1072319 - DNA, 13 bp, Homo sapiens
ctcccctcttcct

SEQ ID NO: 1072320 - DNA, 16 bp, Homo sapiens
ctcccctcttcctctt

SEQ ID NO: 1072321 - DNA, 22 bp, Homo sapiens
ctcccctgacctgtgagcccag

SEQ ID NO: 1072322 - DNA, 13 bp, Homo sapiens
ctcccctgaggct

SEQ ID NO: 1072323 - DNA, 21 bp, Homo sapiens
ctcccctgatagaagattgtt

SEQ ID NO: 1072324 - DNA, 13 bp, Homo sapiens
ctcccctgccacc

SEQ ID NO: 1072325 - DNA, 23 bp, Homo sapiens
ctcccctgccaccaggccacctc

SEQ ID NO: 1072326 - DNA, 12 bp, Homo sapiens
ctcccctgccct

SEQ ID NO: 1072327 - DNA, 16 bp, Homo sapiens
ctcccctgccctgctg

SEQ ID NO: 1072328 - DNA, 18 bp, Homo sapiens
ctcccctgcgtcacactg

SEQ ID NO: 1072329 - DNA, 14 bp, Homo sapiens
ctcccctgtacctt

SEQ ID NO: 1072330 - DNA, 18 bp, Homo sapiens
ctcccctgttcccctctc

SEQ ID NO: 1072331 - DNA, 21 bp, Homo sapiens
ctcccctgttcccctctccct

SEQ ID NO: 1072332 - DNA, 15 bp, Homo sapiens
ctccccttccctggg

SEQ ID NO: 1072333 - DNA, 18 bp, Homo sapiens
ctccccttccctggggag

SEQ ID NO: 1072334 - DNA, 19 bp, Homo sapiens
ctccccttccctggggagc

SEQ ID NO: 1072335 - DNA, 12 bp, Homo sapiens
ctccccttcctg

SEQ ID NO: 1072336 - DNA, 18 bp, Homo sapiens
ctccccttcctggacaca

SEQ ID NO: 1072337 - DNA, 13 bp, Homo sapiens
ctccccttggacc

SEQ ID NO: 1072338 - DNA, 22 bp, Homo sapiens
ctccccttggacctccaggggc

SEQ ID NO: 1072339 - DNA, 13 bp, Homo sapiens
ctccccttgggcg

SEQ ID NO: 1072340 - DNA, 15 bp, Homo sapiens
ctccccttgggcggc

SEQ ID NO: 1072341 - DNA, 18 bp, Homo sapiens
ctccccttgggcggctga

SEQ ID NO: 1072342 - DNA, 17 bp, Homo sapiens
ctccccttttctatgtt

SEQ ID NO: 1072343 - DNA, 16 bp, Homo sapiens
ctcccctttttttccc

SEQ ID NO: 1072344 - DNA, 20 bp, Homo sapiens
ctcccgaaagcctttcctcg

SEQ ID NO: 1072345 - DNA, 16 bp, Homo sapiens
ctcccgacagcccatc

SEQ ID NO: 1072346 - DNA, 13 bp, Homo sapiens
ctcccgagaaatt

SEQ ID NO: 1072347 - DNA, 18 bp, Homo sapiens
ctcccgagaccgggccct

SEQ ID NO: 1072348 - DNA, 23 bp, Homo sapiens
ctcccgagaccgggccctgggtt

SEQ ID NO: 1072349 - DNA, 19 bp, Homo sapiens
ctcccgagctcctcttcca

SEQ ID NO: 1072350 - DNA, 24 bp, Homo sapiens
ctcccgagctcctcttccatgctg

SEQ ID NO: 1072351 - DNA, 16 bp, Homo sapiens
ctcccgagtagctggg

SEQ ID NO: 1072352 - DNA, 17 bp, Homo sapiens
ctcccgagtagctggga

SEQ ID NO: 1072353 - DNA, 21 bp, Homo sapiens
ctcccgccagactgttagaaa

SEQ ID NO: 1072354 - DNA, 21 bp, Homo sapiens
ctcccgccccccacacttccc

SEQ ID NO: 1072355 - DNA, 13 bp, Homo sapiens
ctcccgctcccag

SEQ ID NO: 1072356 - DNA, 19 bp, Homo sapiens
ctcccgctgcacacagacg

SEQ ID NO: 1072357 - DNA, 22 bp, Homo sapiens
ctcccgctgcacacagacggcc

SEQ ID NO: 1072358 - DNA, 14 bp, Homo sapiens
ctcccgctgctgct

SEQ ID NO: 1072359 - DNA, 15 bp, Homo sapiens
ctcccgctgctgctg

SEQ ID NO: 1072360 - DNA, 18 bp, Homo sapiens
ctcccggcactccatgct

SEQ ID NO: 1072361 - DNA, 16 bp, Homo sapiens
ctcccggctgccccca

SEQ ID NO: 1072362 - DNA, 14 bp, Homo sapiens
ctcccggctgcctg

SEQ ID NO: 1072363 - DNA, 15 bp, Homo sapiens
ctcccggctgcctgc

SEQ ID NO: 1072364 - DNA, 16 bp, Homo sapiens
ctcccggctgcctgcc

SEQ ID NO: 1072365 - DNA, 17 bp, Homo sapiens
ctcccggctgcctgccg

SEQ ID NO: 1072366 - DNA, 23 bp, Homo sapiens
ctcccgggccacgccccagcccg

SEQ ID NO: 1072367 - DNA, 20 bp, Homo sapiens
ctcccgggccctcccttgga

SEQ ID NO: 1072368 - DNA, 22 bp, Homo sapiens
ctcccgggccctcccttggaaa

SEQ ID NO: 1072369 - DNA, 14 bp, Homo sapiens
ctcccgggcctcag

SEQ ID NO: 1072370 - DNA, 17 bp, Homo sapiens
ctcccggggacgctttt

SEQ ID NO: 1072371 - DNA, 14 bp, Homo sapiens
ctcccggggactca

SEQ ID NO: 1072372 - DNA, 20 bp, Homo sapiens
ctcccggggactcaagagga

SEQ ID NO: 1072373 - DNA, 15 bp, Homo sapiens
ctcccggtgcccaag

SEQ ID NO: 1072374 - DNA, 21 bp, Homo sapiens
ctcccggttcttccagtggtt

SEQ ID NO: 1072375 - DNA, 17 bp, Homo sapiens
ctcccgtagtctcctgg

SEQ ID NO: 1072376 - DNA, 21 bp, Homo sapiens
ctcccgtcagggcccaagtcc

SEQ ID NO: 1072377 - DNA, 21 bp, Homo sapiens
ctcccgtgtgtggttggaaaa

SEQ ID NO: 1072378 - DNA, 17 bp, Homo sapiens
ctccctaagccagcctg

SEQ ID NO: 1072379 - DNA, 17 bp, Homo sapiens
ctccctaaggaatctga

SEQ ID NO: 1072380 - DNA, 19 bp, Homo sapiens
ctccctaaggaatctgaaa

SEQ ID NO: 1072381 - DNA, 20 bp, Homo sapiens
ctccctacctccctcctcag

SEQ ID NO: 1072382 - DNA, 22 bp, Homo sapiens
ctccctacctccctcctcaggg

SEQ ID NO: 1072383 - DNA, 15 bp, Homo sapiens
ctccctacttccaag

SEQ ID NO: 1072384 - DNA, 21 bp, Homo sapiens
ctccctagccagcacttgtat

SEQ ID NO: 1072385 - DNA, 16 bp, Homo sapiens
ctccctagcccttcca

SEQ ID NO: 1072386 - DNA, 22 bp, Homo sapiens
ctccctagtagctgggattaca

SEQ ID NO: 1072387 - DNA, 21 bp, Homo sapiens
ctccctcaaatgacagaccta

SEQ ID NO: 1072388 - DNA, 15 bp, Homo sapiens
ctccctcaactgaag

SEQ ID NO: 1072389 - DNA, 13 bp, Homo sapiens
ctccctcaccctg

SEQ ID NO: 1072390 - DNA, 12 bp, Homo sapiens
ctccctcagccc

SEQ ID NO: 1072391 - DNA, 16 bp, Homo sapiens
ctccctcccagctgca

SEQ ID NO: 1072392 - DNA, 18 bp, Homo sapiens
ctccctcccagctgcact

SEQ ID NO: 1072393 - DNA, 12 bp, Homo sapiens
ctccctccccac

SEQ ID NO: 1072394 - DNA, 22 bp, Homo sapiens
ctccctccccacacctccctac

SEQ ID NO: 1072395 - DNA, 13 bp, Homo sapiens
ctccctccccacc

SEQ ID NO: 1072396 - DNA, 20 bp, Homo sapiens
ctccctccccacccaagaga

SEQ ID NO: 1072397 - DNA, 19 bp, Homo sapiens
ctccctccccgctgccctt

SEQ ID NO: 1072398 - DNA, 19 bp, Homo sapiens
ctccctcccctctcagaac

SEQ ID NO: 1072399 - DNA, 16 bp, Homo sapiens
ctccctcccctgccct

SEQ ID NO: 1072400 - DNA, 19 bp, Homo sapiens
ctccctcccggctgccccc

SEQ ID NO: 1072401 - DNA, 23 bp, Homo sapiens
ctccctccctagcccttccagcc

SEQ ID NO: 1072402 - DNA, 20 bp, Homo sapiens
ctccctcccttccttgggca

SEQ ID NO: 1072403 - DNA, 16 bp, Homo sapiens
ctccctccgcctccca

SEQ ID NO: 1072404 - DNA, 11 bp, Homo sapiens
ctccctcctca

SEQ ID NO: 1072405 - DNA, 15 bp, Homo sapiens
ctccctcctcacctc

SEQ ID NO: 1072406 - DNA, 12 bp, Homo sapiens
ctccctcctcag

SEQ ID NO: 1072407 - DNA, 15 bp, Homo sapiens
ctccctcctcagggg

SEQ ID NO: 1072408 - DNA, 12 bp, Homo sapiens
ctccctcctctg

SEQ ID NO: 1072409 - DNA, 15 bp, Homo sapiens
ctccctcctctggca

SEQ ID NO: 1072410 - DNA, 16 bp, Homo sapiens
ctccctcctctggcag

SEQ ID NO: 1072411 - DNA, 17 bp, Homo sapiens
ctccctcctgccgactc

SEQ ID NO: 1072412 - DNA, 20 bp, Homo sapiens
ctccctcctggagctctgtg

SEQ ID NO: 1072413 - DNA, 21 bp, Homo sapiens
ctccctcctggagctctgtgg

SEQ ID NO: 1072414 - DNA, 15 bp, Homo sapiens
ctccctcgggggctc

SEQ ID NO: 1072415 - DNA, 14 bp, Homo sapiens
ctccctcgtgggct

SEQ ID NO: 1072416 - DNA, 15 bp, Homo sapiens
ctccctcgtgggctt

SEQ ID NO: 1072417 - DNA, 19 bp, Homo sapiens
ctccctcgtgggcttgtgc

SEQ ID NO: 1072418 - DNA, 20 bp, Homo sapiens
ctccctcgtgggcttgtgct

SEQ ID NO: 1072419 - DNA, 14 bp, Homo sapiens
ctccctctactctt

SEQ ID NO: 1072420 - DNA, 17 bp, Homo sapiens
ctccctctactcttcct

SEQ ID NO: 1072421 - DNA, 18 bp, Homo sapiens
ctccctctactcttcctg

SEQ ID NO: 1072422 - DNA, 19 bp, Homo sapiens
ctccctctactcttcctgt

SEQ ID NO: 1072423 - DNA, 20 bp, Homo sapiens
ctccctctctcttctgctcc

SEQ ID NO: 1072424 - DNA, 21 bp, Homo sapiens
ctccctctctcttctgctcca

SEQ ID NO: 1072425 - DNA, 22 bp, Homo sapiens
ctccctctctcttctgctccac

SEQ ID NO: 1072426 - DNA, 21 bp, Homo sapiens
ctccctctcttccgggagctg

SEQ ID NO: 1072427 - DNA, 17 bp, Homo sapiens
ctccctctgacctgcag

SEQ ID NO: 1072428 - DNA, 21 bp, Homo sapiens
ctccctctgccccaagcagcc

SEQ ID NO: 1072429 - DNA, 23 bp, Homo sapiens
ctccctctgcccctcccccagcc

SEQ ID NO: 1072430 - DNA, 14 bp, Homo sapiens
ctccctctggccct

SEQ ID NO: 1072431 - DNA, 17 bp, Homo sapiens
ctccctctggccctgcc

SEQ ID NO: 1072432 - DNA, 20 bp, Homo sapiens
ctccctctggccctgccttc

SEQ ID NO: 1072433 - DNA, 20 bp, Homo sapiens
ctccctctgggttccagcag

SEQ ID NO: 1072434 - DNA, 22 bp, Homo sapiens
ctccctctgggttccagcagag

SEQ ID NO: 1072435 - DNA, 15 bp, Homo sapiens
ctccctctggtccca

SEQ ID NO: 1072436 - DNA, 13 bp, Homo sapiens
ctccctctgtctt

SEQ ID NO: 1072437 - DNA, 12 bp, Homo sapiens
ctccctctgtta

SEQ ID NO: 1072438 - DNA, 22 bp, Homo sapiens
ctccctctgttaggtccatttt

SEQ ID NO: 1072439 - DNA, 23 bp, Homo sapiens
ctccctctgttaggtccattttc

SEQ ID NO: 1072440 - DNA, 12 bp, Homo sapiens
ctccctcttcct

SEQ ID NO: 1072441 - DNA, 22 bp, Homo sapiens
ctccctctttcccaccctccac

SEQ ID NO: 1072442 - DNA, 17 bp, Homo sapiens
ctccctgaaacactgct

SEQ ID NO: 1072443 - DNA, 19 bp, Homo sapiens
ctccctgaaacactgcttc

SEQ ID NO: 1072444 - DNA, 17 bp, Homo sapiens
ctccctgacatttctaa

SEQ ID NO: 1072445 - DNA, 16 bp, Homo sapiens
ctccctgacccgtcta

SEQ ID NO: 1072446 - DNA, 12 bp, Homo sapiens
ctccctgaccct

SEQ ID NO: 1072447 - DNA, 20 bp, Homo sapiens
ctccctgactccctgtgggg

SEQ ID NO: 1072448 - DNA, 14 bp, Homo sapiens
ctccctgacttctc

SEQ ID NO: 1072449 - DNA, 17 bp, Homo sapiens
ctccctgacttctcccc

SEQ ID NO: 1072450 - DNA, 18 bp, Homo sapiens
ctccctgacttctccccc

SEQ ID NO: 1072451 - DNA, 20 bp, Homo sapiens
ctccctgacttctcccccgc

SEQ ID NO: 1072452 - DNA, 14 bp, Homo sapiens
ctccctgagtctgg

SEQ ID NO: 1072453 - DNA, 21 bp, Homo sapiens
ctccctgagtctggacctcca

SEQ ID NO: 1072454 - DNA, 23 bp, Homo sapiens
ctccctgagtctggacctccatc

SEQ ID NO: 1072455 - DNA, 14 bp, Homo sapiens
ctccctgcaccgcc

SEQ ID NO: 1072456 - DNA, 16 bp, Homo sapiens
ctccctgcaccgccgc

SEQ ID NO: 1072457 - DNA, 22 bp, Homo sapiens
ctccctgcactccctcctggag

SEQ ID NO: 1072458 - DNA, 16 bp, Homo sapiens
ctccctgcagccacca

SEQ ID NO: 1072459 - DNA, 14 bp, Homo sapiens
ctccctgcagcctt

SEQ ID NO: 1072460 - DNA, 18 bp, Homo sapiens
ctccctgcagccttttct

SEQ ID NO: 1072461 - DNA, 13 bp, Homo sapiens
ctccctgcatcct

SEQ ID NO: 1072462 - DNA, 14 bp, Homo sapiens
ctccctgcatcctg

SEQ ID NO: 1072463 - DNA, 16 bp, Homo sapiens
ctccctgcatcctgag

SEQ ID NO: 1072464 - DNA, 17 bp, Homo sapiens
ctccctgcatcctgagg

SEQ ID NO: 1072465 - DNA, 18 bp, Homo sapiens
ctccctgcatcctgaggc

SEQ ID NO: 1072466 - DNA, 20 bp, Homo sapiens
ctccctgcatctgaccagca

SEQ ID NO: 1072467 - DNA, 23 bp, Homo sapiens
ctccctgcatctgaccagcagcg

SEQ ID NO: 1072468 - DNA, 23 bp, Homo sapiens
ctccctgccatccccctctcacg

SEQ ID NO: 1072469 - DNA, 12 bp, Homo sapiens
ctccctgcccaa

SEQ ID NO: 1072470 - DNA, 17 bp, Homo sapiens
ctccctgcccaaactcc

SEQ ID NO: 1072471 - DNA, 13 bp, Homo sapiens
ctccctgcccccc

SEQ ID NO: 1072472 - DNA, 23 bp, Homo sapiens
ctccctgccccccaaggttctgg

SEQ ID NO: 1072473 - DNA, 17 bp, Homo sapiens
ctccctgccccccagcc

SEQ ID NO: 1072474 - DNA, 23 bp, Homo sapiens
ctccctgccccccagccctcctt

SEQ ID NO: 1072475 - DNA, 13 bp, Homo sapiens
ctccctgcccctc

SEQ ID NO: 1072476 - DNA, 17 bp, Homo sapiens
ctccctgcccctccctt

SEQ ID NO: 1072477 - DNA, 16 bp, Homo sapiens
ctccctgccgcctcaa

SEQ ID NO: 1072478 - DNA, 21 bp, Homo sapiens
ctccctgcctacacacacagc

SEQ ID NO: 1072479 - DNA, 14 bp, Homo sapiens
ctccctgcctgctc

SEQ ID NO: 1072480 - DNA, 16 bp, Homo sapiens
ctccctgcctgctcct

SEQ ID NO: 1072481 - DNA, 13 bp, Homo sapiens
ctccctgcctggc

SEQ ID NO: 1072482 - DNA, 18 bp, Homo sapiens
ctccctgcctggccccca

SEQ ID NO: 1072483 - DNA, 12 bp, Homo sapiens
ctccctgccttt

SEQ ID NO: 1072484 - DNA, 16 bp, Homo sapiens
ctccctgctcagtgct

SEQ ID NO: 1072485 - DNA, 13 bp, Homo sapiens
ctccctgctcctc

SEQ ID NO: 1072486 - DNA, 14 bp, Homo sapiens
ctccctgctcctca

SEQ ID NO: 1072487 - DNA, 15 bp, Homo sapiens
ctccctgctcctcat

SEQ ID NO: 1072488 - DNA, 12 bp, Homo sapiens
ctccctgctttg

SEQ ID NO: 1072489 - DNA, 21 bp, Homo sapiens
ctccctggaccccattctgag

SEQ ID NO: 1072490 - DNA, 11 bp, Homo sapiens
ctccctggagc

SEQ ID NO: 1072491 - DNA, 15 bp, Homo sapiens
ctccctggagccctg

SEQ ID NO: 1072492 - DNA, 22 bp, Homo sapiens
ctccctggagtgcagtttccaa

SEQ ID NO: 1072493 - DNA, 14 bp, Homo sapiens
ctccctggctccca

SEQ ID NO: 1072494 - DNA, 16 bp, Homo sapiens
ctccctggctccctcc

SEQ ID NO: 1072495 - DNA, 17 bp, Homo sapiens
ctccctggctgccctgg

SEQ ID NO: 1072496 - DNA, 18 bp, Homo sapiens
ctccctggctgccctggc

SEQ ID NO: 1072497 - DNA, 20 bp, Homo sapiens
ctccctggctgccctggccc

SEQ ID NO: 1072498 - DNA, 22 bp, Homo sapiens
ctccctggctgccctggccctg

SEQ ID NO: 1072499 - DNA, 19 bp, Homo sapiens
ctccggaggactgagcccc

SEQ ID NO: 1072500 - DNA, 17 bp, Homo sapiens
ctccggaggagcagcct

SEQ ID NO: 1072501 - DNA, 19 bp, Homo sapiens
ctccggaggagcagcctcg

SEQ ID NO: 1072502 - DNA, 21 bp, Homo sapiens
ctccggaggagcagcctcgag

SEQ ID NO: 1072503 - DNA, 12 bp, Homo sapiens
ctccggagggga

SEQ ID NO: 1072504 - DNA, 21 bp, Homo sapiens
ctccggaggggacccagctcc

SEQ ID NO: 1072505 - DNA, 22 bp, Homo sapiens
ctccggaggggacccagctcct

SEQ ID NO: 1072506 - DNA, 24 bp, Homo sapiens
ctccggaggggacccagctcctct

SEQ ID NO: 1072507 - DNA, 17 bp, Homo sapiens
ctccggccatactgcct

SEQ ID NO: 1072508 - DNA, 23 bp, Homo sapiens
ctccggcgtcttgcccagcagct

SEQ ID NO: 1072509 - DNA, 22 bp, Homo sapiens
ctccgggaccattgacctcagc

SEQ ID NO: 1072510 - DNA, 19 bp, Homo sapiens
ctccgggcaggggagccag

SEQ ID NO: 1072511 - DNA, 20 bp, Homo sapiens
ctccgggcaggggagccagg

SEQ ID NO: 1072512 - DNA, 20 bp, Homo sapiens
ctccggggccccactggctg

SEQ ID NO: 1072513 - DNA, 16 bp, Homo sapiens
ctccggggtctgtgct

SEQ ID NO: 1072514 - DNA, 18 bp, Homo sapiens
ctccggggtggccacagg

SEQ ID NO: 1072515 - DNA, 15 bp, Homo sapiens
ctccgggtcactgct

SEQ ID NO: 1072516 - DNA, 16 bp, Homo sapiens
ctccgggtcactgctg

SEQ ID NO: 1072517 - DNA, 15 bp, Homo sapiens
ctccgggtcctccta

SEQ ID NO: 1072518 - DNA, 17 bp, Homo sapiens
ctccgggtgtggcctca

SEQ ID NO: 1072519 - DNA, 18 bp, Homo sapiens
ctccgggtgtggcctcag

SEQ ID NO: 1072520 - DNA, 19 bp, Homo sapiens
ctccgggtgtggcctcagc

SEQ ID NO: 1072521 - DNA, 22 bp, Homo sapiens
ctccgggtgtggcctcagccct

SEQ ID NO: 1072522 - DNA, 21 bp, Homo sapiens
ctccgtagggtctttcttggg

SEQ ID NO: 1072523 - DNA, 22 bp, Homo sapiens
ctccgtagggtctttcttggga

SEQ ID NO: 1072524 - DNA, 16 bp, Homo sapiens
ctccgtccacccaggc

SEQ ID NO: 1072525 - DNA, 15 bp, Homo sapiens
ctccgtccagccgcc

SEQ ID NO: 1072526 - DNA, 20 bp, Homo sapiens
ctccgtccaggagcctgtgc

SEQ ID NO: 1072527 - DNA, 22 bp, Homo sapiens
ctccgtccaggagcctgtgcct

SEQ ID NO: 1072528 - DNA, 17 bp, Homo sapiens
ctccgtcctgtcactga

SEQ ID NO: 1072529 - DNA, 16 bp, Homo sapiens
ctccgtctctgtcctc

SEQ ID NO: 1072530 - DNA, 13 bp, Homo sapiens
ctccgtctgaccc

SEQ ID NO: 1072531 - DNA, 14 bp, Homo sapiens
ctccgtctgaccct

SEQ ID NO: 1072532 - DNA, 13 bp, Homo sapiens
ctccgtgcctcca

SEQ ID NO: 1072533 - DNA, 16 bp, Homo sapiens
ctccgtggaacattct

SEQ ID NO: 1072534 - DNA, 12 bp, Homo sapiens
ctccgtggagga

SEQ ID NO: 1072535 - DNA, 22 bp, Homo sapiens
ctccgtggaggaggttgggagg

SEQ ID NO: 1072536 - DNA, 15 bp, Homo sapiens
ctccgtgtggagcac

SEQ ID NO: 1072537 - DNA, 15 bp, Homo sapiens
ctccgttagctcctg

SEQ ID NO: 1072538 - DNA, 16 bp, Homo sapiens
ctccgttagctcctgt

SEQ ID NO: 1072539 - DNA, 18 bp, Homo sapiens
ctccgttagctcctgtgg

SEQ ID NO: 1072540 - DNA, 12 bp, Homo sapiens
ctccgttggcca

SEQ ID NO: 1072541 - DNA, 20 bp, Homo sapiens
ctccgttggccactccgaga

SEQ ID NO: 1072542 - DNA, 12 bp, Homo sapiens
ctcctaaaacaa

SEQ ID NO: 1072543 - DNA, 20 bp, Homo sapiens
ctcctaaaacaacagatgta

SEQ ID NO: 1072544 - DNA, 16 bp, Homo sapiens
ctcctaaggctcccca

SEQ ID NO: 1072545 - DNA, 18 bp, Homo sapiens
ctcctaaggctccccacc

SEQ ID NO: 1072546 - DNA, 17 bp, Homo sapiens
ctcctacatccagctcc

SEQ ID NO: 1072547 - DNA, 20 bp, Homo sapiens
ctcctaccccttcctgtcct

SEQ ID NO: 1072548 - DNA, 22 bp, Homo sapiens
ctcctaccccttcctgtcctgc

SEQ ID NO: 1072549 - DNA, 18 bp, Homo sapiens
ctcctaccctcccaccag

SEQ ID NO: 1072550 - DNA, 18 bp, Homo sapiens
ctcctaccctgcgcccag

SEQ ID NO: 1072551 - DNA, 12 bp, Homo sapiens
ctcctacctcag

SEQ ID NO: 1072552 - DNA, 14 bp, Homo sapiens
ctcctacctcagcc

SEQ ID NO: 1072553 - DNA, 16 bp, Homo sapiens
ctcctacctcagccta

SEQ ID NO: 1072554 - DNA, 18 bp, Homo sapiens
ctcctacctcagcctaga

SEQ ID NO: 1072555 - DNA, 18 bp, Homo sapiens
ctcctacctcagcctcct

SEQ ID NO: 1072556 - DNA, 21 bp, Homo sapiens
ctcctacctcagcctcctggg

SEQ ID NO: 1072557 - DNA, 14 bp, Homo sapiens
ctcctacctgggga

SEQ ID NO: 1072558 - DNA, 19 bp, Homo sapiens
ctcctacctggggactcct

SEQ ID NO: 1072559 - DNA, 21 bp, Homo sapiens
ctcctacctggggactcctca

SEQ ID NO: 1072560 - DNA, 12 bp, Homo sapiens
ctcctactctgt

SEQ ID NO: 1072561 - DNA, 14 bp, Homo sapiens
ctcctactctgtgt

SEQ ID NO: 1072562 - DNA, 15 bp, Homo sapiens
ctcctactctgtgta

SEQ ID NO: 1072563 - DNA, 12 bp, Homo sapiens
ctcctagaagaa

SEQ ID NO: 1072564 - DNA, 13 bp, Homo sapiens
ctcctagagggag

SEQ ID NO: 1072565 - DNA, 15 bp, Homo sapiens
ctcctagagggaggg

SEQ ID NO: 1072566 - DNA, 19 bp, Homo sapiens
ctcctagagggaggggcct

SEQ ID NO: 1072567 - DNA, 22 bp, Homo sapiens
ctcctagaggtgggcagctggg

SEQ ID NO: 1072568 - DNA, 15 bp, Homo sapiens
ctcctagagtgcagg

SEQ ID NO: 1072569 - DNA, 18 bp, Homo sapiens
ctcctagagtgcagggat

SEQ ID NO: 1072570 - DNA, 16 bp, Homo sapiens
ctcctagcccctctct

SEQ ID NO: 1072571 - DNA, 18 bp, Homo sapiens
ctcctagcccctctctca

SEQ ID NO: 1072572 - DNA, 21 bp, Homo sapiens
ctcctagcccctctctcacac

SEQ ID NO: 1072573 - DNA, 22 bp, Homo sapiens
ctcctagcctgtgcctctggga

SEQ ID NO: 1072574 - DNA, 12 bp, Homo sapiens
ctcctaggctgg

SEQ ID NO: 1072575 - DNA, 13 bp, Homo sapiens
ctcctaggggaag

SEQ ID NO: 1072576 - DNA, 16 bp, Homo sapiens
ctcctaggggaagggg

SEQ ID NO: 1072577 - DNA, 17 bp, Homo sapiens
ctcctaggggaaggggg

SEQ ID NO: 1072578 - DNA, 16 bp, Homo sapiens
ctcctagggggtgtca

SEQ ID NO: 1072579 - DNA, 17 bp, Homo sapiens
ctcctagggggtgtcag

SEQ ID NO: 1072580 - DNA, 16 bp, Homo sapiens
ctcctataatctgtca

SEQ ID NO: 1072581 - DNA, 17 bp, Homo sapiens
ctcctataatctgtcaa

SEQ ID NO: 1072582 - DNA, 18 bp, Homo sapiens
ctcctataatctgtcaaa

SEQ ID NO: 1072583 - DNA, 17 bp, Homo sapiens
ctcctatatatttctat

SEQ ID NO: 1072584 - DNA, 14 bp, Homo sapiens
ctcctatccttgga

SEQ ID NO: 1072585 - DNA, 22 bp, Homo sapiens
ctcctatgggttgtcaccaagc

SEQ ID NO: 1072586 - DNA, 22 bp, Homo sapiens
ctcctatgtgtgcctcctagag

SEQ ID NO: 1072587 - DNA, 23 bp, Homo sapiens
ctcctattgaaagaccagatcct

SEQ ID NO: 1072588 - DNA, 22 bp, Homo sapiens
ctcctcaaaccacttgcctggg

SEQ ID NO: 1072589 - DNA, 14 bp, Homo sapiens
ctcctcaagcctgt

SEQ ID NO: 1072590 - DNA, 15 bp, Homo sapiens
ctcctcaagcctgtg

SEQ ID NO: 1072591 - DNA, 17 bp, Homo sapiens
ctcctcaagcctgtggg

SEQ ID NO: 1072592 - DNA, 20 bp, Homo sapiens
ctcctcaatttttgtctcag

SEQ ID NO: 1072593 - DNA, 15 bp, Homo sapiens
ctcctcacacaccct

SEQ ID NO: 1072594 - DNA, 14 bp, Homo sapiens
ctcctcacagacct

SEQ ID NO: 1072595 - DNA, 18 bp, Homo sapiens
ctcctcacagacctctgc

SEQ ID NO: 1072596 - DNA, 21 bp, Homo sapiens
ctcctcacccacctctgggtc

SEQ ID NO: 1072597 - DNA, 20 bp, Homo sapiens
ctcctcacccccagctttgc

SEQ ID NO: 1072598 - DNA, 15 bp, Homo sapiens
ctcctcaccccgtct

SEQ ID NO: 1072599 - DNA, 17 bp, Homo sapiens
ctcctcacctcatgccc

SEQ ID NO: 1072600 - DNA, 14 bp, Homo sapiens
ctcctcacctctgg

SEQ ID NO: 1072601 - DNA, 12 bp, Homo sapiens
ctcctcacctgt

SEQ ID NO: 1072602 - DNA, 15 bp, Homo sapiens
ctcctcacctgtcta

SEQ ID NO: 1072603 - DNA, 14 bp, Homo sapiens
ctcctcactctgtc

SEQ ID NO: 1072604 - DNA, 19 bp, Homo sapiens
ctcctcactgtatccaggt

SEQ ID NO: 1072605 - DNA, 23 bp, Homo sapiens
ctcctcagccatgggaacctcat

SEQ ID NO: 1072606 - DNA, 14 bp, Homo sapiens
ctcctcagccccca

SEQ ID NO: 1072607 - DNA, 19 bp, Homo sapiens
ctcctcagcccccaggcca

SEQ ID NO: 1072608 - DNA, 21 bp, Homo sapiens
ctcctcagcccccaggccagg

SEQ ID NO: 1072609 - DNA, 17 bp, Homo sapiens
ctcctcagcctctgcaa

SEQ ID NO: 1072610 - DNA, 23 bp, Homo sapiens
ctcctcagctgcatggagcctgg

SEQ ID NO: 1072611 - DNA, 20 bp, Homo sapiens
ctcctcaggaccctcagccc

SEQ ID NO: 1072612 - DNA, 12 bp, Homo sapiens
ctcctcaggagc

SEQ ID NO: 1072613 - DNA, 17 bp, Homo sapiens
ctcctcaggcacacagc

SEQ ID NO: 1072614 - DNA, 23 bp, Homo sapiens
ctcctcagggggtaggagagcac

SEQ ID NO: 1072615 - DNA, 16 bp, Homo sapiens
ctcctcatccatttct

SEQ ID NO: 1072616 - DNA, 11 bp, Homo sapiens
ctcctcatggg

SEQ ID NO: 1072617 - DNA, 20 bp, Homo sapiens
ctcctcatgtacataccctg

SEQ ID NO: 1072618 - DNA, 14 bp, Homo sapiens
ctcctccacagtgc

SEQ ID NO: 1072619 - DNA, 12 bp, Homo sapiens
ctcctccactca

SEQ ID NO: 1072620 - DNA, 13 bp, Homo sapiens
ctcctccactcac

SEQ ID NO: 1072621 - DNA, 17 bp, Homo sapiens
ctcctccactccacctc

SEQ ID NO: 1072622 - DNA, 20 bp, Homo sapiens
ctcctccagcccctgtccca

SEQ ID NO: 1072623 - DNA, 14 bp, Homo sapiens
ctcctccagccctt

SEQ ID NO: 1072624 - DNA, 23 bp, Homo sapiens
ctctcaattaaagtctattcaaa

SEQ ID NO: 1072625 - DNA, 13 bp, Homo sapiens
ctctcaatttttg

SEQ ID NO: 1072626 - DNA, 19 bp, Homo sapiens
ctctcaatttttggttgaa

SEQ ID NO: 1072627 - DNA, 19 bp, Homo sapiens
ctctcacactggttctcaa

SEQ ID NO: 1072628 - DNA, 19 bp, Homo sapiens
ctctcaccatgatgtgaag

SEQ ID NO: 1072629 - DNA, 15 bp, Homo sapiens
ctctcacccaccagc

SEQ ID NO: 1072630 - DNA, 22 bp, Homo sapiens
ctctcacccaccagctccacac

SEQ ID NO: 1072631 - DNA, 20 bp, Homo sapiens
ctctcaccccaagcggcctt

SEQ ID NO: 1072632 - DNA, 13 bp, Homo sapiens
ctctcacccccat

SEQ ID NO: 1072633 - DNA, 15 bp, Homo sapiens
ctctcacctctccct

SEQ ID NO: 1072634 - DNA, 16 bp, Homo sapiens
ctctcacctgtactct

SEQ ID NO: 1072635 - DNA, 15 bp, Homo sapiens
ctctcacgggccctg

SEQ ID NO: 1072636 - DNA, 17 bp, Homo sapiens
ctctcacgggccctgcc

SEQ ID NO: 1072637 - DNA, 16 bp, Homo sapiens
ctctcactagtgccaa

SEQ ID NO: 1072638 - DNA, 19 bp, Homo sapiens
ctctcactccacccagagt

SEQ ID NO: 1072639 - DNA, 21 bp, Homo sapiens
ctctcactccacccagagtag

SEQ ID NO: 1072640 - DNA, 12 bp, Homo sapiens
ctctcactccag

SEQ ID NO: 1072641 - DNA, 21 bp, Homo sapiens
ctctcactgtgttactgcttt

SEQ ID NO: 1072642 - DNA, 12 bp, Homo sapiens
ctctcagaacat

SEQ ID NO: 1072643 - DNA, 12 bp, Homo sapiens
ctctcagaccca

SEQ ID NO: 1072644 - DNA, 17 bp, Homo sapiens
ctctcagatacccagtg

SEQ ID NO: 1072645 - DNA, 11 bp, Homo sapiens
ctctcagccaa

SEQ ID NO: 1072646 - DNA, 17 bp, Homo sapiens
ctctcagccagctgttt

SEQ ID NO: 1072647 - DNA, 13 bp, Homo sapiens
ctctcagccccat

SEQ ID NO: 1072648 - DNA, 12 bp, Homo sapiens
ctctcagctcca

SEQ ID NO: 1072649 - DNA, 13 bp, Homo sapiens
ctctcagctccag

SEQ ID NO: 1072650 - DNA, 13 bp, Homo sapiens
ctctcaggagagt

SEQ ID NO: 1072651 - DNA, 16 bp, Homo sapiens
ctctcaggagcacagg

SEQ ID NO: 1072652 - DNA, 19 bp, Homo sapiens
ctctcaggcatgcctgtgt

SEQ ID NO: 1072653 - DNA, 20 bp, Homo sapiens
ctctcaggcatgcctgtgtg

SEQ ID NO: 1072654 - DNA, 18 bp, Homo sapiens
ctctcagtgttttggact

SEQ ID NO: 1072655 - DNA, 21 bp, Homo sapiens
ctctcagttctctcccttcct

SEQ ID NO: 1072656 - DNA, 18 bp, Homo sapiens
ctctcatcaactgaatga

SEQ ID NO: 1072657 - DNA, 14 bp, Homo sapiens
ctctcatccccctg

SEQ ID NO: 1072658 - DNA, 15 bp, Homo sapiens
ctctcatccccctgt

SEQ ID NO: 1072659 - DNA, 19 bp, Homo sapiens
ctctcatcctccagtacct

SEQ ID NO: 1072660 - DNA, 18 bp, Homo sapiens
ctctcatcgccagacaac

SEQ ID NO: 1072661 - DNA, 13 bp, Homo sapiens
ctctcatctcagg

SEQ ID NO: 1072662 - DNA, 16 bp, Homo sapiens
ctctcatctgatcact

SEQ ID NO: 1072663 - DNA, 15 bp, Homo sapiens
ctctcatgcgtgttt

SEQ ID NO: 1072664 - DNA, 12 bp, Homo sapiens
ctctcattgtct

SEQ ID NO: 1072665 - DNA, 16 bp, Homo sapiens
ctctccaaaggggctg

SEQ ID NO: 1072666 - DNA, 18 bp, Homo sapiens
ctctccaaaggggctgct

SEQ ID NO: 1072667 - DNA, 21 bp, Homo sapiens
ctctccaaatattattcaagt

SEQ ID NO: 1072668 - DNA, 19 bp, Homo sapiens
ctctccaaccactgtgcca

SEQ ID NO: 1072669 - DNA, 16 bp, Homo sapiens
ctctccaacctggaca

SEQ ID NO: 1072670 - DNA, 12 bp, Homo sapiens
ctctccaagggc

SEQ ID NO: 1072671 - DNA, 14 bp, Homo sapiens
ctctccaagggctt

SEQ ID NO: 1072672 - DNA, 20 bp, Homo sapiens
ctctccaagtctctctgtga

SEQ ID NO: 1072673 - DNA, 14 bp, Homo sapiens
ctctccacagtgtt

SEQ ID NO: 1072674 - DNA, 22 bp, Homo sapiens
ctctccacagtgttgtgcccct

SEQ ID NO: 1072675 - DNA, 22 bp, Homo sapiens
ctctccaccagacgccttcctc

SEQ ID NO: 1072676 - DNA, 13 bp, Homo sapiens
ctctccacctcag

SEQ ID NO: 1072677 - DNA, 18 bp, Homo sapiens
ctctccacctcagccttg

SEQ ID NO: 1072678 - DNA, 20 bp, Homo sapiens
ctctccacctcagccttgga

SEQ ID NO: 1072679 - DNA, 15 bp, Homo sapiens
ctctccactcttctc

SEQ ID NO: 1072680 - DNA, 13 bp, Homo sapiens
ctctccactgctg

SEQ ID NO: 1072681 - DNA, 22 bp, Homo sapiens
ctctccacttctggtcccctgt

SEQ ID NO: 1072682 - DNA, 19 bp, Homo sapiens
ctctccagaaacagctgct

SEQ ID NO: 1072683 - DNA, 23 bp, Homo sapiens
ctctccagaaacagctgcttctc

SEQ ID NO: 1072684 - DNA, 18 bp, Homo sapiens
ctctccaggcacccttct

SEQ ID NO: 1072685 - DNA, 14 bp, Homo sapiens
ctctccaggccagg

SEQ ID NO: 1072686 - DNA, 12 bp, Homo sapiens
ctctccaggccc

SEQ ID NO: 1072687 - DNA, 13 bp, Homo sapiens
ctctccaggcccc

SEQ ID NO: 1072688 - DNA, 17 bp, Homo sapiens
ctctccaggccccacca

SEQ ID NO: 1072689 - DNA, 14 bp, Homo sapiens
ctctccagggtgct

SEQ ID NO: 1072690 - DNA, 17 bp, Homo sapiens
ctctccagtttgcacct

SEQ ID NO: 1072691 - DNA, 19 bp, Homo sapiens
ctctccagtttgcacctgt

SEQ ID NO: 1072692 - DNA, 20 bp, Homo sapiens
ctctccagtttgcacctgtc

SEQ ID NO: 1072693 - DNA, 22 bp, Homo sapiens
ctctccatacctgcccctgcct

SEQ ID NO: 1072694 - DNA, 20 bp, Homo sapiens
ctctccatatcccttcctct

SEQ ID NO: 1072695 - DNA, 19 bp, Homo sapiens
ctctccattttagcccagt

SEQ ID NO: 1072696 - DNA, 13 bp, Homo sapiens
ctctcccacagag

SEQ ID NO: 1072697 - DNA, 23 bp, Homo sapiens
ctctcccacagagtgctggactg

SEQ ID NO: 1072698 - DNA, 13 bp, Homo sapiens
ctctcccaccccg

SEQ ID NO: 1072699 - DNA, 22 bp, Homo sapiens
ctctcccaccccggcctccact

SEQ ID NO: 1072700 - DNA, 19 bp, Homo sapiens
ctctcccacccggccacag

SEQ ID NO: 1072701 - DNA, 22 bp, Homo sapiens
ctctcccacccggccacagctg

SEQ ID NO: 1072702 - DNA, 15 bp, Homo sapiens
ctctcccacttcctc

SEQ ID NO: 1072703 - DNA, 21 bp, Homo sapiens
ctctcccacttcctcctacct

SEQ ID NO: 1072704 - DNA, 13 bp, Homo sapiens
ctctcccatcact

SEQ ID NO: 1072705 - DNA, 18 bp, Homo sapiens
ctctcccatcacttccct

SEQ ID NO: 1072706 - DNA, 18 bp, Homo sapiens
ctctccccaacccccatt

SEQ ID NO: 1072707 - DNA, 20 bp, Homo sapiens
ctctccccaacccccattct

SEQ ID NO: 1072708 - DNA, 18 bp, Homo sapiens
ctctccccacgagggctg

SEQ ID NO: 1072709 - DNA, 19 bp, Homo sapiens
ctctccccacgagggctgg

SEQ ID NO: 1072710 - DNA, 21 bp, Homo sapiens
ctctccccacgagggctggct

SEQ ID NO: 1072711 - DNA, 15 bp, Homo sapiens
ctctccccaggtcca

SEQ ID NO: 1072712 - DNA, 23 bp, Homo sapiens
ctctccccaggtccagctctgga

SEQ ID NO: 1072713 - DNA, 11 bp, Homo sapiens
ctctccccagt

SEQ ID NO: 1072714 - DNA, 14 bp, Homo sapiens
ctctccccagtgcc

SEQ ID NO: 1072715 - DNA, 19 bp, Homo sapiens
ctctccccagtgcctgcca

SEQ ID NO: 1072716 - DNA, 22 bp, Homo sapiens
ctctccccagtgcctgccactc

SEQ ID NO: 1072717 - DNA, 13 bp, Homo sapiens
ctctccccctctg

SEQ ID NO: 1072718 - DNA, 19 bp, Homo sapiens
ctctccccctctgtcttct

SEQ ID NO: 1072719 - DNA, 14 bp, Homo sapiens
ctctcccccttcag

SEQ ID NO: 1072720 - DNA, 20 bp, Homo sapiens
ctctcccccttcagctcctg

SEQ ID NO: 1072721 - DNA, 23 bp, Homo sapiens
ctctcccccttcagctcctgagt

SEQ ID NO: 1072722 - DNA, 16 bp, Homo sapiens
ctctcccccttggatt

SEQ ID NO: 1072723 - DNA, 14 bp, Homo sapiens
ctctccccctttca

SEQ ID NO: 1072724 - DNA, 19 bp, Homo sapiens
ctctccccctttcaaggaa

SEQ ID NO: 1072725 - DNA, 23 bp, Homo sapiens
ctctccccggcaggcctgagaat

SEQ ID NO: 1072726 - DNA, 18 bp, Homo sapiens
ctctcccctcacatcctc

SEQ ID NO: 1072727 - DNA, 19 bp, Homo sapiens
ctctcccctcacatcctcc

SEQ ID NO: 1072728 - DNA, 22 bp, Homo sapiens
ctctcccctcacatcctcctgc

SEQ ID NO: 1072729 - DNA, 21 bp, Homo sapiens
ctctcccctcagagtgcaagc

SEQ ID NO: 1072730 - DNA, 12 bp, Homo sapiens
ctctcccctccc

SEQ ID NO: 1072731 - DNA, 14 bp, Homo sapiens
ctctcccctccctt

SEQ ID NO: 1072732 - DNA, 17 bp, Homo sapiens
ctctcccctgacctgtg

SEQ ID NO: 1072733 - DNA, 17 bp, Homo sapiens
ctctcccctgccctgct

SEQ ID NO: 1072734 - DNA, 13 bp, Homo sapiens
ctctccccttggt

SEQ ID NO: 1072735 - DNA, 15 bp, Homo sapiens
ctctccccttggttc

SEQ ID NO: 1072736 - DNA, 23 bp, Homo sapiens
ctctcccggaggttgggtgggcc

SEQ ID NO: 1072737 - DNA, 16 bp, Homo sapiens
ctctcccggctgcctg

SEQ ID NO: 1072738 - DNA, 17 bp, Homo sapiens
ctctcccggctgcctgc

SEQ ID NO: 1072739 - DNA, 21 bp, Homo sapiens
ctctcccgtcagggcccaagt

SEQ ID NO: 1072740 - DNA, 21 bp, Homo sapiens
ctctccctacctccctcctca

SEQ ID NO: 1072741 - DNA, 22 bp, Homo sapiens
ctctccctacctccctcctcag

SEQ ID NO: 1072742 - DNA, 23 bp, Homo sapiens
ctctccctcaacaagggagagac

SEQ ID NO: 1072743 - DNA, 13 bp, Homo sapiens
ctctccctcaggg

SEQ ID NO: 1072744 - DNA, 14 bp, Homo sapiens
ctctccctcagggg

SEQ ID NO: 1072745 - DNA, 13 bp, Homo sapiens
ctctccctcccct

SEQ ID NO: 1072746 - DNA, 13 bp, Homo sapiens
ctctccctctggc

SEQ ID NO: 1072747 - DNA, 19 bp, Homo sapiens
ctctccctctggccctgcc

SEQ ID NO: 1072748 - DNA, 16 bp, Homo sapiens
ctctccctcttctcaa

SEQ ID NO: 1072749 - DNA, 14 bp, Homo sapiens
ctctaaagagcatc

SEQ ID NO: 1072750 - DNA, 15 bp, Homo sapiens
ctctaacagtggaca

SEQ ID NO: 1072751 - DNA, 19 bp, Homo sapiens
ctctaacagtggacaaagt

SEQ ID NO: 1072752 - DNA, 17 bp, Homo sapiens
ctctaaccattcaaatg

SEQ ID NO: 1072753 - DNA, 13 bp, Homo sapiens
ctctaaccctcat

SEQ ID NO: 1072754 - DNA, 19 bp, Homo sapiens
ctctaaccctcattgctgt

SEQ ID NO: 1072755 - DNA, 21 bp, Homo sapiens
ctctaaccctcattgctgtct

SEQ ID NO: 1072756 - DNA, 18 bp, Homo sapiens
ctctaactcactgcctag

SEQ ID NO: 1072757 - DNA, 16 bp, Homo sapiens
ctctaactgtatattt

SEQ ID NO: 1072758 - DNA, 16 bp, Homo sapiens
ctctaagcagccagga

SEQ ID NO: 1072759 - DNA, 14 bp, Homo sapiens
ctctaaggttgggc

SEQ ID NO: 1072760 - DNA, 16 bp, Homo sapiens
ctctaagtcatgtatg

SEQ ID NO: 1072761 - DNA, 21 bp, Homo sapiens
ctctaagtcatgtatgtttct

SEQ ID NO: 1072762 - DNA, 19 bp, Homo sapiens
ctctaagttccactgagct

SEQ ID NO: 1072763 - DNA, 21 bp, Homo sapiens
ctctaagttccactgagctcc

SEQ ID NO: 1072764 - DNA, 13 bp, Homo sapiens
ctctaataataaa

SEQ ID NO: 1072765 - DNA, 15 bp, Homo sapiens
ctctaatagaggcag

SEQ ID NO: 1072766 - DNA, 15 bp, Homo sapiens
ctctaatagtcctgt

SEQ ID NO: 1072767 - DNA, 18 bp, Homo sapiens
ctctaatctaatatataa

SEQ ID NO: 1072768 - DNA, 18 bp, Homo sapiens
ctctaatctggatgttaa

SEQ ID NO: 1072769 - DNA, 16 bp, Homo sapiens
ctctaattcacagtgc

SEQ ID NO: 1072770 - DNA, 20 bp, Homo sapiens
ctctaattcacagtgctctt

SEQ ID NO: 1072771 - DNA, 22 bp, Homo sapiens
ctctaattggaagaaattcctg

SEQ ID NO: 1072772 - DNA, 13 bp, Homo sapiens
ctctacaaaaagc

SEQ ID NO: 1072773 - DNA, 22 bp, Homo sapiens
ctctacaaaaagtaaaaattaa

SEQ ID NO: 1072774 - DNA, 23 bp, Homo sapiens
ctctacacggactgaggtgcctg

SEQ ID NO: 1072775 - DNA, 15 bp, Homo sapiens
ctctacactcttgta

SEQ ID NO: 1072776 - DNA, 20 bp, Homo sapiens
ctctacactgaaacgtattc

SEQ ID NO: 1072777 - DNA, 18 bp, Homo sapiens
ctctacagagcttccctg

SEQ ID NO: 1072778 - DNA, 21 bp, Homo sapiens
ctctacagctaatcagcattc

SEQ ID NO: 1072779 - DNA, 13 bp, Homo sapiens
ctctacagtgcca

SEQ ID NO: 1072780 - DNA, 14 bp, Homo sapiens
ctctaccagtctat

SEQ ID NO: 1072781 - DNA, 20 bp, Homo sapiens
ctctaccatcccctgtagag

SEQ ID NO: 1072782 - DNA, 22 bp, Homo sapiens
ctctaccatttgcagagtcctg

SEQ ID NO: 1072783 - DNA, 14 bp, Homo sapiens
ctctacccaaaccc

SEQ ID NO: 1072784 - DNA, 17 bp, Homo sapiens
ctctacccaaaccctag

SEQ ID NO: 1072785 - DNA, 21 bp, Homo sapiens
ctctacccatcttaaaaacaa

SEQ ID NO: 1072786 - DNA, 18 bp, Homo sapiens
ctctacccatgagcctgc

SEQ ID NO: 1072787 - DNA, 16 bp, Homo sapiens
ctctacccctgctccc

SEQ ID NO: 1072788 - DNA, 16 bp, Homo sapiens
ctctacccctttcttc

SEQ ID NO: 1072789 - DNA, 17 bp, Homo sapiens
ctctacccctttcttct

SEQ ID NO: 1072790 - DNA, 19 bp, Homo sapiens
ctctacccggcccagagac

SEQ ID NO: 1072791 - DNA, 16 bp, Homo sapiens
ctctacctccaccctg

SEQ ID NO: 1072792 - DNA, 20 bp, Homo sapiens
ctctacctctctcctctccg

SEQ ID NO: 1072793 - DNA, 13 bp, Homo sapiens
ctctacctctctt

SEQ ID NO: 1072794 - DNA, 22 bp, Homo sapiens
ctctacgccaaagtgcagccct

SEQ ID NO: 1072795 - DNA, 15 bp, Homo sapiens
ctctactaaaaagaa

SEQ ID NO: 1072796 - DNA, 16 bp, Homo sapiens
ctctactaaaaatgca

SEQ ID NO: 1072797 - DNA, 19 bp, Homo sapiens
ctctactcttacagagcct

SEQ ID NO: 1072798 - DNA, 17 bp, Homo sapiens
ctctactgaatgtcatt

SEQ ID NO: 1072799 - DNA, 17 bp, Homo sapiens
ctctactgttgcacagc

SEQ ID NO: 1072800 - DNA, 18 bp, Homo sapiens
ctctacttaatccaatgg

SEQ ID NO: 1072801 - DNA, 15 bp, Homo sapiens
ctctacttaatgaga

SEQ ID NO: 1072802 - DNA, 17 bp, Homo sapiens
ctctacttccccttctt

SEQ ID NO: 1072803 - DNA, 11 bp, Homo sapiens
ctctagaacat

SEQ ID NO: 1072804 - DNA, 22 bp, Homo sapiens
ctctagaagccaagggaaaggg

SEQ ID NO: 1072805 - DNA, 21 bp, Homo sapiens
ctctagacaagatattgtaca

SEQ ID NO: 1072806 - DNA, 16 bp, Homo sapiens
ctctagacactgccac

SEQ ID NO: 1072807 - DNA, 15 bp, Homo sapiens
ctctagagccttcag

SEQ ID NO: 1072808 - DNA, 22 bp, Homo sapiens
ctctagagggttgctgcctttc

SEQ ID NO: 1072809 - DNA, 14 bp, Homo sapiens
ctctagcaggccta

SEQ ID NO: 1072810 - DNA, 21 bp, Homo sapiens
ctctagccaggagtctgtgct

SEQ ID NO: 1072811 - DNA, 21 bp, Homo sapiens
ctctagccatcccttggggaa

SEQ ID NO: 1072812 - DNA, 22 bp, Homo sapiens
ctctagcctggcaacagagcga

SEQ ID NO: 1072813 - DNA, 14 bp, Homo sapiens
ctctagctggcagg

SEQ ID NO: 1072814 - DNA, 17 bp, Homo sapiens
ctctgagtggaggaagc

SEQ ID NO: 1072815 - DNA, 17 bp, Homo sapiens
ctctgagtttaccattt

SEQ ID NO: 1072816 - DNA, 20 bp, Homo sapiens
ctctgagtttaccatttgta

SEQ ID NO: 1072817 - DNA, 13 bp, Homo sapiens
ctctgagttttga

SEQ ID NO: 1072818 - DNA, 19 bp, Homo sapiens
ctctgagtttttgtatgta

SEQ ID NO: 1072819 - DNA, 20 bp, Homo sapiens
ctctgataatatattttcaa

SEQ ID NO: 1072820 - DNA, 15 bp, Homo sapiens
ctctgatacacagta

SEQ ID NO: 1072821 - DNA, 21 bp, Homo sapiens
ctctgatacacagtaattgtg

SEQ ID NO: 1072822 - DNA, 22 bp, Homo sapiens
ctctgatacacagtaattgtga

SEQ ID NO: 1072823 - DNA, 17 bp, Homo sapiens
ctctgatacccagagca

SEQ ID NO: 1072824 - DNA, 18 bp, Homo sapiens
ctctgatagactttgtga

SEQ ID NO: 1072825 - DNA, 23 bp, Homo sapiens
ctctgatagctgtttcaaatgtg

SEQ ID NO: 1072826 - DNA, 22 bp, Homo sapiens
ctctgatctccataaacatgaa

SEQ ID NO: 1072827 - DNA, 11 bp, Homo sapiens
ctctgatgcag

SEQ ID NO: 1072828 - DNA, 14 bp, Homo sapiens
ctctgatgcagaaa

SEQ ID NO: 1072829 - DNA, 18 bp, Homo sapiens
ctctgatgcagcttatac

SEQ ID NO: 1072830 - DNA, 19 bp, Homo sapiens
ctctgatggaatgtgccac

SEQ ID NO: 1072831 - DNA, 23 bp, Homo sapiens
ctctgatggaatgtgccacctgt

SEQ ID NO: 1072832 - DNA, 22 bp, Homo sapiens
ctctgatggttcttcacctcct

SEQ ID NO: 1072833 - DNA, 13 bp, Homo sapiens
ctctgattcacct

SEQ ID NO: 1072834 - DNA, 18 bp, Homo sapiens
ctctgattggaatttctg

SEQ ID NO: 1072835 - DNA, 20 bp, Homo sapiens
ctctgattggaatttctggc

SEQ ID NO: 1072836 - DNA, 18 bp, Homo sapiens
ctctgatttattttgtat

SEQ ID NO: 1072837 - DNA, 19 bp, Homo sapiens
ctctgattttcaaagcttt

SEQ ID NO: 1072838 - DNA, 22 bp, Homo sapiens
ctctgattttcaaagctttttc

SEQ ID NO: 1072839 - DNA, 14 bp, Homo sapiens
ctctgcaaaggcct

SEQ ID NO: 1072840 - DNA, 15 bp, Homo sapiens
ctctgcaaaggcctg

SEQ ID NO: 1072841 - DNA, 14 bp, Homo sapiens
ctctgcaacacttt

SEQ ID NO: 1072842 - DNA, 14 bp, Homo sapiens
ctctgcaactgctc

SEQ ID NO: 1072843 - DNA, 23 bp, Homo sapiens
ctctgcaatgggcactgggatga

SEQ ID NO: 1072844 - DNA, 16 bp, Homo sapiens
ctctgcaattcccctc

SEQ ID NO: 1072845 - DNA, 19 bp, Homo sapiens
ctctgcaattcccctctgc

SEQ ID NO: 1072846 - DNA, 20 bp, Homo sapiens
ctctctgcagccagcccagc

SEQ ID NO: 1072847 - DNA, 15 bp, Homo sapiens
ctctctgcagctgcc

SEQ ID NO: 1072848 - DNA, 14 bp, Homo sapiens
ctctctgccctctc

SEQ ID NO: 1072849 - DNA, 15 bp, Homo sapiens
ctctctgccctgtgt

SEQ ID NO: 1072850 - DNA, 16 bp, Homo sapiens
ctctctgcctgtaaat

SEQ ID NO: 1072851 - DNA, 12 bp, Homo sapiens
ctctctgctcat

SEQ ID NO: 1072852 - DNA, 12 bp, Homo sapiens
ctctctgctcct

SEQ ID NO: 1072853 - DNA, 13 bp, Homo sapiens
ctctctgctcctt

SEQ ID NO: 1072854 - DNA, 14 bp, Homo sapiens
ctctctgctctagc

SEQ ID NO: 1072855 - DNA, 17 bp, Homo sapiens
ctctctgctctagccag

SEQ ID NO: 1072856 - DNA, 18 bp, Homo sapiens
ctctctgctctagccagg

SEQ ID NO: 1072857 - DNA, 22 bp, Homo sapiens
ctctctgctctgcgtgtcacct

SEQ ID NO: 1072858 - DNA, 17 bp, Homo sapiens
ctctctgctgagctggg

SEQ ID NO: 1072859 - DNA, 17 bp, Homo sapiens
ctctctggaaagaggct

SEQ ID NO: 1072860 - DNA, 13 bp, Homo sapiens
ctctctggcctcc

SEQ ID NO: 1072861 - DNA, 17 bp, Homo sapiens
ctctctggcctcccacc

SEQ ID NO: 1072862 - DNA, 19 bp, Homo sapiens
ctctctggcctcccacccg

SEQ ID NO: 1072863 - DNA, 18 bp, Homo sapiens
ctctctggctggtcttca

SEQ ID NO: 1072864 - DNA, 13 bp, Homo sapiens
ctctctgggacct

SEQ ID NO: 1072865 - DNA, 12 bp, Homo sapiens
ctctctgggact

SEQ ID NO: 1072866 - DNA, 20 bp, Homo sapiens
ctctctgggcccaggggctg

SEQ ID NO: 1072867 - DNA, 22 bp, Homo sapiens
ctctctggggaagtcaggggag

SEQ ID NO: 1072868 - DNA, 22 bp, Homo sapiens
ctctctggggccctgggcctca

SEQ ID NO: 1072869 - DNA, 18 bp, Homo sapiens
ctctctgggggaggcagg

SEQ ID NO: 1072870 - DNA, 21 bp, Homo sapiens
ctctctgggggaggcagggct

SEQ ID NO: 1072871 - DNA, 23 bp, Homo sapiens
ctctctgtcccttgctgtatgct

SEQ ID NO: 1072872 - DNA, 15 bp, Homo sapiens
ctctctgtgaataca

SEQ ID NO: 1072873 - DNA, 19 bp, Homo sapiens
ctctcttatagaatattta

SEQ ID NO: 1072874 - DNA, 9 bp, Homo sapiens
ctctcttca

SEQ ID NO: 1072875 - DNA, 16 bp, Homo sapiens
ctctcttcaatctctg

SEQ ID NO: 1072876 - DNA, 18 bp, Homo sapiens
ctctcttcaatctctgga

SEQ ID NO: 1072877 - DNA, 12 bp, Homo sapiens
ctctcttccctc

SEQ ID NO: 1072878 - DNA, 15 bp, Homo sapiens
ctctcttccctcaga

SEQ ID NO: 1072879 - DNA, 18 bp, Homo sapiens
ctctcttcgtcctgatcc

SEQ ID NO: 1072880 - DNA, 15 bp, Homo sapiens
ctctcttctgctcca

SEQ ID NO: 1072881 - DNA, 13 bp, Homo sapiens
ctctcttgccagc

SEQ ID NO: 1072882 - DNA, 14 bp, Homo sapiens
ctctcttgcccctt

SEQ ID NO: 1072883 - DNA, 10 bp, Homo sapiens
ctctgtctca

SEQ ID NO: 1072884 - DNA, 14 bp, Homo sapiens
ctctgtctcatcct

SEQ ID NO: 1072885 - DNA, 21 bp, Homo sapiens
ctctgtctcatcctcctggaa

SEQ ID NO: 1072886 - DNA, 14 bp, Homo sapiens
ctctgtctcccagg

SEQ ID NO: 1072887 - DNA, 15 bp, Homo sapiens
ctctgtctcccaggc

SEQ ID NO: 1072888 - DNA, 18 bp, Homo sapiens
ctctgtctcccaggctgc

SEQ ID NO: 1072889 - DNA, 19 bp, Homo sapiens
ctctgtctcccaggctgga

SEQ ID NO: 1072890 - DNA, 20 bp, Homo sapiens
ctctgtctcccaggctggag

SEQ ID NO: 1072891 - DNA, 18 bp, Homo sapiens
ctctgtctctcctagccc

SEQ ID NO: 1072892 - DNA, 22 bp, Homo sapiens
ctctgtctctcctagcccctct

SEQ ID NO: 1072893 - DNA, 16 bp, Homo sapiens
ctctgtctctgtggaa

SEQ ID NO: 1072894 - DNA, 18 bp, Homo sapiens
ctctgtctgtctctcccc

SEQ ID NO: 1072895 - DNA, 23 bp, Homo sapiens
ctctgtctgtctctccccctctg

SEQ ID NO: 1072896 - DNA, 17 bp, Homo sapiens
ctctgtcttcaaggact

SEQ ID NO: 1072897 - DNA, 16 bp, Homo sapiens
ctctgtcttctctcca

SEQ ID NO: 1072898 - DNA, 18 bp, Homo sapiens
ctctgtcttctctccact

SEQ ID NO: 1072899 - DNA, 19 bp, Homo sapiens
ctctgtcttttctcctccg

SEQ ID NO: 1072900 - DNA, 23 bp, Homo sapiens
ctctgtgaacgatttagaaagaa

SEQ ID NO: 1072901 - DNA, 14 bp, Homo sapiens
ctctgtgaatacaa

SEQ ID NO: 1072902 - DNA, 19 bp, Homo sapiens
ctctgtgaatacaattaaa

SEQ ID NO: 1072903 - DNA, 14 bp, Homo sapiens
ctctgtgaccaatg

SEQ ID NO: 1072904 - DNA, 23 bp, Homo sapiens
ctctgtgacctgccccgcccagc

SEQ ID NO: 1072905 - DNA, 17 bp, Homo sapiens
ctctgtgagggtgctga

SEQ ID NO: 1072906 - DNA, 15 bp, Homo sapiens
ctctgtgattacata

SEQ ID NO: 1072907 - DNA, 14 bp, Homo sapiens
ctctgtgcacagtg

SEQ ID NO: 1072908 - DNA, 13 bp, Homo sapiens
ctctgtgctgtgt

SEQ ID NO: 1072909 - DNA, 20 bp, Homo sapiens
ctctgtggaaaagccatctc

SEQ ID NO: 1072910 - DNA, 22 bp, Homo sapiens
ctctgtggaaaagccatctcag

SEQ ID NO: 1072911 - DNA, 13 bp, Homo sapiens
ctctgtggcctgt

SEQ ID NO: 1072912 - DNA, 16 bp, Homo sapiens
ctctgtggcctgtctc

SEQ ID NO: 1072913 - DNA, 16 bp, Homo sapiens
ctctgtgggtctctgg

SEQ ID NO: 1072914 - DNA, 14 bp, Homo sapiens
ctctgtgtatttat

SEQ ID NO: 1072915 - DNA, 20 bp, Homo sapiens
ctctgtgtatttatataaaa

SEQ ID NO: 1072916 - DNA, 18 bp, Homo sapiens
ctctgtgtatttgctttt

SEQ ID NO: 1072917 - DNA, 19 bp, Homo sapiens
ctctgtgtatttgcttttt

SEQ ID NO: 1072918 - DNA, 15 bp, Homo sapiens
ctctgtgtgcacaaa

SEQ ID NO: 1072919 - DNA, 16 bp, Homo sapiens
ctctgtgttcccagag

SEQ ID NO: 1072920 - DNA, 22 bp, Homo sapiens
ctctgtgtttgaagtttcagtt

SEQ ID NO: 1072921 - DNA, 11 bp, Homo sapiens
ctctgttaaca

SEQ ID NO: 1072922 - DNA, 19 bp, Homo sapiens
ctctgttaacatctagcct

SEQ ID NO: 1072923 - DNA, 21 bp, Homo sapiens
ctctgttaggtccattttcta

SEQ ID NO: 1072924 - DNA, 19 bp, Homo sapiens
ctctgttatcagctgggca

SEQ ID NO: 1072925 - DNA, 16 bp, Homo sapiens
ctctgttcccccaccc

SEQ ID NO: 1072926 - DNA, 21 bp, Homo sapiens
ctctgttcccccaccctccat

SEQ ID NO: 1072927 - DNA, 15 bp, Homo sapiens
ctctgttcccttcct

SEQ ID NO: 1072928 - DNA, 19 bp, Homo sapiens
ctctgttcccttcctcacc

SEQ ID NO: 1072929 - DNA, 21 bp, Homo sapiens
ctctgttcctcaatggccttt

SEQ ID NO: 1072930 - DNA, 16 bp, Homo sapiens
ctctgttccttcacat

SEQ ID NO: 1072931 - DNA, 22 bp, Homo sapiens
ctctgttccttcacatcctgtg

SEQ ID NO: 1072932 - DNA, 19 bp, Homo sapiens
ctctgttctgcacacagca

SEQ ID NO: 1072933 - DNA, 21 bp, Homo sapiens
ctctgttctgcacacagcacg

SEQ ID NO: 1072934 - DNA, 17 bp, Homo sapiens
ctctgttgagtaaaaca

SEQ ID NO: 1072935 - DNA, 20 bp, Homo sapiens
ctctgttgatctacccgtgc

SEQ ID NO: 1072936 - DNA, 17 bp, Homo sapiens
ctctgttgcccaggctg

SEQ ID NO: 1072937 - DNA, 14 bp, Homo sapiens
ctctgttgcgctcc

SEQ ID NO: 1072938 - DNA, 19 bp, Homo sapiens
ctctgttggtccactgtgt

SEQ ID NO: 1072939 - DNA, 20 bp, Homo sapiens
ctctgttggtccactgtgtt

SEQ ID NO: 1072940 - DNA, 16 bp, Homo sapiens
ctctgtttctccttct

SEQ ID NO: 1072941 - DNA, 18 bp, Homo sapiens
ctctgtttgatgctattt

SEQ ID NO: 1072942 - DNA, 18 bp, Homo sapiens
ctctgtttgtgggactgg

SEQ ID NO: 1072943 - DNA, 18 bp, Homo sapiens
ctcttaaaaagacactta

SEQ ID NO: 1072944 - DNA, 13 bp, Homo sapiens
ctcttaaaaccca

SEQ ID NO: 1072945 - DNA, 14 bp, Homo sapiens
ctcttaaaatatct

SEQ ID NO: 1072946 - DNA, 15 bp, Homo sapiens
ctcttaaataaaaat

SEQ ID NO: 1072947 - DNA, 15 bp, Homo sapiens
ctcttaaatcatttg

SEQ ID NO: 1072948 - DNA, 17 bp, Homo sapiens
ctcttaacaatttctgt

SEQ ID NO: 1072949 - DNA, 16 bp, Homo sapiens
ctcttaatcactactg

SEQ ID NO: 1072950 - DNA, 18 bp, Homo sapiens
ctcttaatcactactgta

SEQ ID NO: 1072951 - DNA, 15 bp, Homo sapiens
ctcttaatctgtgtg

SEQ ID NO: 1072952 - DNA, 21 bp, Homo sapiens
ctcttaatctgtgtgtatatt

SEQ ID NO: 1072953 - DNA, 17 bp, Homo sapiens
ctcttaattgttcattt

SEQ ID NO: 1072954 - DNA, 22 bp, Homo sapiens
ctcttacaataagctaaacgca

SEQ ID NO: 1072955 - DNA, 14 bp, Homo sapiens
ctcttacagagcct

SEQ ID NO: 1072956 - DNA, 20 bp, Homo sapiens
ctcttacagctttgccttgt

SEQ ID NO: 1072957 - DNA, 21 bp, Homo sapiens
ctcttacctgttatttatcaa

SEQ ID NO: 1072958 - DNA, 14 bp, Homo sapiens
ctcttactctttcc

SEQ ID NO: 1072959 - DNA, 20 bp, Homo sapiens
ctcttactctttcctatttc

SEQ ID NO: 1072960 - DNA, 19 bp, Homo sapiens
ctcttagaagccatgggac

SEQ ID NO: 1072961 - DNA, 19 bp, Homo sapiens
ctcttaggaagagaaacca

SEQ ID NO: 1072962 - DNA, 12 bp, Homo sapiens
ctcttaggtcag

SEQ ID NO: 1072963 - DNA, 14 bp, Homo sapiens
ctcttagtcccaag

SEQ ID NO: 1072964 - DNA, 20 bp, Homo sapiens
ctcttagtgcccgcctagga

SEQ ID NO: 1072965 - DNA, 21 bp, Homo sapiens
ctcttatagaatatttattac

SEQ ID NO: 1072966 - DNA, 17 bp, Homo sapiens
ctcttatcctctctctc

SEQ ID NO: 1072967 - DNA, 18 bp, Homo sapiens
ctcttatctcatcctttc

SEQ ID NO: 1072968 - DNA, 16 bp, Homo sapiens
ctcttatgtgtgcctt

SEQ ID NO: 1072969 - DNA, 18 bp, Homo sapiens
ctcttattccaggagaag

SEQ ID NO: 1072970 - DNA, 12 bp, Homo sapiens
ctcttattctaa

SEQ ID NO: 1072971 - DNA, 17 bp, Homo sapiens
ctcttcaactgaccagc

SEQ ID NO: 1072972 - DNA, 15 bp, Homo sapiens
ctcttcaatctctgg

SEQ ID NO: 1072973 - DNA, 16 bp, Homo sapiens
ctcttcaccccccact

SEQ ID NO: 1072974 - DNA, 18 bp, Homo sapiens
ctcttcaccccccactca

SEQ ID NO: 1072975 - DNA, 20 bp, Homo sapiens
ctcttcactgtggccacagc

SEQ ID NO: 1072976 - DNA, 21 bp, Homo sapiens
ctcttcactgtggccacagcc

SEQ ID NO: 1072977 - DNA, 12 bp, Homo sapiens
ctcttcagaact

SEQ ID NO: 1072978 - DNA, 19 bp, Homo sapiens
ctcttcagatctctaactt

SEQ ID NO: 1072979 - DNA, 13 bp, Homo sapiens
ctcttcaggcctc

SEQ ID NO: 1072980 - DNA, 16 bp, Homo sapiens
ctcttcaggcctccct

SEQ ID NO: 1072981 - DNA, 18 bp, Homo sapiens
ctcttcaggcctccctct

SEQ ID NO: 1072982 - DNA, 19 bp, Homo sapiens
ctcttcaggcctccctctc

SEQ ID NO: 1072983 - DNA, 12 bp, Homo sapiens
ctcttcaggttc

SEQ ID NO: 1072984 - DNA, 18 bp, Homo sapiens
ctcttcagttaattctta

SEQ ID NO: 1072985 - DNA, 22 bp, Homo sapiens
ctcttcatgcttgacataccta

SEQ ID NO: 1072986 - DNA, 18 bp, Homo sapiens
ctcttcattattctctgc

SEQ ID NO: 1072987 - DNA, 13 bp, Homo sapiens
ctcttcatttctg

SEQ ID NO: 1072988 - DNA, 13 bp, Homo sapiens
ctcttcatttttt

SEQ ID NO: 1072989 - DNA, 21 bp, Homo sapiens
ctcttcatttttttttcaatc

SEQ ID NO: 1072990 - DNA, 22 bp, Homo sapiens
ctcttccagaagatgccctcca

SEQ ID NO: 1072991 - DNA, 16 bp, Homo sapiens
ctcttccagcttcttt

SEQ ID NO: 1072992 - DNA, 23 bp, Homo sapiens
ctctgtccccacgaggggaccca

SEQ ID NO: 1072993 - DNA, 14 bp, Homo sapiens
ctctgtccccaggc

SEQ ID NO: 1072994 - DNA, 18 bp, Homo sapiens
ctctgtccccaggcctgg

SEQ ID NO: 1072995 - DNA, 20 bp, Homo sapiens
ctctgtccccaggcctggct

SEQ ID NO: 1072996 - DNA, 14 bp, Homo sapiens
ctctgtccctgtcc

SEQ ID NO: 1072997 - DNA, 16 bp, Homo sapiens
ctctgtccctgtcctt

SEQ ID NO: 1072998 - DNA, 13 bp, Homo sapiens
ctctgtcctccca

SEQ ID NO: 1072999 - DNA, 14 bp, Homo sapiens
ctctgtcctcccat

SEQ ID NO: 1073000 - DNA, 17 bp, Homo sapiens
ctctgtcctcccatccc

SEQ ID NO: 1073001 - DNA, 20 bp, Homo sapiens
ctctgtctaggactgcagtg

SEQ ID NO: 1073002 - DNA, 23 bp, Homo sapiens
ctctgtctaggactgcagtgtgg

SEQ ID NO: 1073003 - DNA, 17 bp, Homo sapiens
ctgaaacactgcttctc

SEQ ID NO: 1073004 - DNA, 13 bp, Homo sapiens
ctgaaacactgga

SEQ ID NO: 1073005 - DNA, 18 bp, Homo sapiens
ctgaaacactggacctgg

SEQ ID NO: 1073006 - DNA, 20 bp, Homo sapiens
ctgaaacactggacctgggg

SEQ ID NO: 1073007 - DNA, 20 bp, Homo sapiens
ctgaaacattcacacagggc

SEQ ID NO: 1073008 - DNA, 16 bp, Homo sapiens
ctgaaaccaaaacata

SEQ ID NO: 1073009 - DNA, 23 bp, Homo sapiens
ctgaaacccaaagccctggtaaa

SEQ ID NO: 1073010 - DNA, 15 bp, Homo sapiens
ctgaaacccacagat

SEQ ID NO: 1073011 - DNA, 22 bp, Homo sapiens
ctgaaacccacagatgtctctg

SEQ ID NO: 1073012 - DNA, 23 bp, Homo sapiens
ctgaaaccttagtttcaagagtc

SEQ ID NO: 1073013 - DNA, 20 bp, Homo sapiens
ctgaaacgtattcagagtta

SEQ ID NO: 1073014 - DNA, 14 bp, Homo sapiens
ctgaaagaaacagt

SEQ ID NO: 1073015 - DNA, 15 bp, Homo sapiens
ctgaaagaaacagtt

SEQ ID NO: 1073016 - DNA, 19 bp, Homo sapiens
ctgaaagaaacagttaact

SEQ ID NO: 1073017 - DNA, 19 bp, Homo sapiens
ctgaaagaacatggacttg

SEQ ID NO: 1073018 - DNA, 23 bp, Homo sapiens
ctgaaagaagaaaacagtacaga

SEQ ID NO: 1073019 - DNA, 19 bp, Homo sapiens
ctgaaagaagaacagctgt

SEQ ID NO: 1073020 - DNA, 20 bp, Homo sapiens
ctgaaagaagaacagctgtt

SEQ ID NO: 1073021 - DNA, 23 bp, Homo sapiens
ctgaaagaagaacagctgttcct

SEQ ID NO: 1073022 - DNA, 16 bp, Homo sapiens
ctgaaagacagaatgt

SEQ ID NO: 1073023 - DNA, 21 bp, Homo sapiens
ctgaaagacagaatgtcacca

SEQ ID NO: 1073024 - DNA, 20 bp, Homo sapiens
ctgaaagacagtatgagaaa

SEQ ID NO: 1073025 - DNA, 21 bp, Homo sapiens
ctgaaagactgaagaaagtgt

SEQ ID NO: 1073026 - DNA, 14 bp, Homo sapiens
ctgaaagaggctga

SEQ ID NO: 1073027 - DNA, 20 bp, Homo sapiens
ctgaaagatctctgtcacat

SEQ ID NO: 1073028 - DNA, 13 bp, Homo sapiens
ctgaaagcagcag

SEQ ID NO: 1073029 - DNA, 18 bp, Homo sapiens
ctgaaagcagcagctagg

SEQ ID NO: 1073030 - DNA, 16 bp, Homo sapiens
ctgaaagccaaggcag

SEQ ID NO: 1073031 - DNA, 11 bp, Homo sapiens
ctgaaagccac

SEQ ID NO: 1073032 - DNA, 21 bp, Homo sapiens
ctgaaagccacgttccttact

SEQ ID NO: 1073033 - DNA, 23 bp, Homo sapiens
ctgaaagccagctgccgaccaga

SEQ ID NO: 1073034 - DNA, 16 bp, Homo sapiens
ctgaaagccctgagct

SEQ ID NO: 1073035 - DNA, 12 bp, Homo sapiens
ctgaaagcctgt

SEQ ID NO: 1073036 - DNA, 15 bp, Homo sapiens
ctgaaagcctgtctc

SEQ ID NO: 1073037 - DNA, 23 bp, Homo sapiens
ctgaaagcctgtctctttccact

SEQ ID NO: 1073038 - DNA, 16 bp, Homo sapiens
ctgaaaggaacactgg

SEQ ID NO: 1073039 - DNA, 18 bp, Homo sapiens
ctgaaaggaaggtttcta

SEQ ID NO: 1073040 - DNA, 22 bp, Homo sapiens
ctgaaagggcacttaatttgta

SEQ ID NO: 1073041 - DNA, 18 bp, Homo sapiens
ctgaaagtcctgctttcc

SEQ ID NO: 1073042 - DNA, 23 bp, Homo sapiens
ctgaaagtgaaagtccagaaact

SEQ ID NO: 1073043 - DNA, 13 bp, Homo sapiens
ctgaaagtgtttt

SEQ ID NO: 1073044 - DNA, 21 bp, Homo sapiens
ctgaaagtgttttactctttt

SEQ ID NO: 1073045 - DNA, 23 bp, Homo sapiens
ctgaaagtgttttactctttttc

SEQ ID NO: 1073046 - DNA, 12 bp, Homo sapiens
ctgaaagttggc

SEQ ID NO: 1073047 - DNA, 16 bp, Homo sapiens
ctgaaagttttgtaaa

SEQ ID NO: 1073048 - DNA, 17 bp, Homo sapiens
ctgaaagttttgtaaaa

SEQ ID NO: 1073049 - DNA, 23 bp, Homo sapiens
ctgaaagttttgtaaaagaaatc

SEQ ID NO: 1073050 - DNA, 15 bp, Homo sapiens
ctgaaataatatatt

SEQ ID NO: 1073051 - DNA, 18 bp, Homo sapiens
ctgaaatatccacccagc

SEQ ID NO: 1073052 - DNA, 22 bp, Homo sapiens
ctgaaatgaaacaaataatcac

SEQ ID NO: 1073053 - DNA, 21 bp, Homo sapiens
ctgaaatgccaagtgcctgct

SEQ ID NO: 1073054 - DNA, 22 bp, Homo sapiens
ctgaaatgccaagtgcctgctt

SEQ ID NO: 1073055 - DNA, 20 bp, Homo sapiens
ctgaaatgctgcattttaat

SEQ ID NO: 1073056 - DNA, 18 bp, Homo sapiens
ctgaaatgtcagttctga

SEQ ID NO: 1073057 - DNA, 19 bp, Homo sapiens
ctgaaatgtcagttctgat

SEQ ID NO: 1073058 - DNA, 15 bp, Homo sapiens
ctgaaatgttcttaa

SEQ ID NO: 1073059 - DNA, 11 bp, Homo sapiens
ctgaaattaaa

SEQ ID NO: 1073060 - DNA, 17 bp, Homo sapiens
ctgaaattaatttgtga

SEQ ID NO: 1073061 - DNA, 19 bp, Homo sapiens
ctgaaattatatatataca

SEQ ID NO: 1073062 - DNA, 18 bp, Homo sapiens
ctgaaattcaaaatgctc

SEQ ID NO: 1073063 - DNA, 14 bp, Homo sapiens
ctgaaattctcctg

SEQ ID NO: 1073064 - DNA, 19 bp, Homo sapiens
ctgaaattctcctggaggt

SEQ ID NO: 1073065 - DNA, 20 bp, Homo sapiens
ctgaaattctcctggaggtc

SEQ ID NO: 1073066 - DNA, 23 bp, Homo sapiens
ctgaaattgagaatccagtttct

SEQ ID NO: 1073067 - DNA, 18 bp, Homo sapiens
ctgaaatttattcacata

SEQ ID NO: 1073068 - DNA, 22 bp, Homo sapiens
ctgaaatttgttatacttcaaa

SEQ ID NO: 1073069 - DNA, 16 bp, Homo sapiens
ctgaaatttttcttct

SEQ ID NO: 1073070 - DNA, 16 bp, Homo sapiens
ctgaacaaaacctaca

SEQ ID NO: 1073071 - DNA, 17 bp, Homo sapiens
ctgaacaaaagctcagg

SEQ ID NO: 1073072 - DNA, 20 bp, Homo sapiens
ctgaacaaacactgaatcat

SEQ ID NO: 1073073 - DNA, 13 bp, Homo sapiens
ctgaacaagaatt

SEQ ID NO: 1073074 - DNA, 16 bp, Homo sapiens
ctgaacacacacgcca

SEQ ID NO: 1073075 - DNA, 21 bp, Homo sapiens
ctgaacacacacgccagctcc

SEQ ID NO: 1073076 - DNA, 17 bp, Homo sapiens
ctgaacacagtgtctgt

SEQ ID NO: 1073077 - DNA, 22 bp, Homo sapiens
ctgaacacagtgtctgttcagc

SEQ ID NO: 1073078 - DNA, 19 bp, Homo sapiens
ctgaacactttaggtagat

SEQ ID NO: 1073079 - DNA, 20 bp, Homo sapiens
ctgaacacttttgttgtaaa

SEQ ID NO: 1073080 - DNA, 13 bp, Homo sapiens
ctgaacagaagct

SEQ ID NO: 1073081 - DNA, 13 bp, Homo sapiens
ctgaacagctgta

SEQ ID NO: 1073082 - DNA, 17 bp, Homo sapiens
ctgaacaggctggggcc

SEQ ID NO: 1073083 - DNA, 13 bp, Homo sapiens
ctgaacaggttct

SEQ ID NO: 1073084 - DNA, 12 bp, Homo sapiens
ctgaacagtgga

SEQ ID NO: 1073085 - DNA, 20 bp, Homo sapiens
ctgaacatctgagtcctgga

SEQ ID NO: 1073086 - DNA, 23 bp, Homo sapiens
ctgaacatctgagtcctggatga

SEQ ID NO: 1073087 - DNA, 13 bp, Homo sapiens
ctgaacatgcctg

SEQ ID NO: 1073088 - DNA, 18 bp, Homo sapiens
ctgaacatgcctgccaaa

SEQ ID NO: 1073089 - DNA, 13 bp, Homo sapiens
ctgaacatgttta

SEQ ID NO: 1073090 - DNA, 15 bp, Homo sapiens
ctgaacatgtttaca

SEQ ID NO: 1073091 - DNA, 15 bp, Homo sapiens
ctgaacattccagag

SEQ ID NO: 1073092 - DNA, 21 bp, Homo sapiens
ctgaaccaacagaagcagact

SEQ ID NO: 1073093 - DNA, 13 bp, Homo sapiens
ctgaaccacagaa

SEQ ID NO: 1073094 - DNA, 14 bp, Homo sapiens
ctgaaccacagaaa

SEQ ID NO: 1073095 - DNA, 17 bp, Homo sapiens
ctgaaccacgaggctgc

SEQ ID NO: 1073096 - DNA, 18 bp, Homo sapiens
ctgaaccacgaggctgcc

SEQ ID NO: 1073097 - DNA, 19 bp, Homo sapiens
ctgaaccacgaggctgccc

SEQ ID NO: 1073098 - DNA, 20 bp, Homo sapiens
ctgaaccactgcttctcttt

SEQ ID NO: 1073099 - DNA, 21 bp, Homo sapiens
ctgaaccactgcttctctttt

SEQ ID NO: 1073100 - DNA, 21 bp, Homo sapiens
ctgaaccagccacgaacagcc

SEQ ID NO: 1073101 - DNA, 14 bp, Homo sapiens
ctgaacccacacct

SEQ ID NO: 1073102 - DNA, 18 bp, Homo sapiens
ctgaacccacacctgggc

SEQ ID NO: 1073103 - DNA, 18 bp, Homo sapiens
ctgaacccagctgtgccc

SEQ ID NO: 1073104 - DNA, 21 bp, Homo sapiens
ctgaacccagctgtgcccctc

SEQ ID NO: 1073105 - DNA, 22 bp, Homo sapiens
ctgaacccagctgtgcccctcc

SEQ ID NO: 1073106 - DNA, 19 bp, Homo sapiens
ctgaaccccatgggcttgg

SEQ ID NO: 1073107 - DNA, 16 bp, Homo sapiens
ctgaacccctccctcc

SEQ ID NO: 1073108 - DNA, 16 bp, Homo sapiens
ctgaacccgtccattc

SEQ ID NO: 1073109 - DNA, 17 bp, Homo sapiens
ctgaaccgactgaccct

SEQ ID NO: 1073110 - DNA, 21 bp, Homo sapiens
ctgaaccgactgaccctgagg

SEQ ID NO: 1073111 - DNA, 16 bp, Homo sapiens
ctgaaccgcaaggagc

SEQ ID NO: 1073112 - DNA, 17 bp, Homo sapiens
ctgaaccgcacagctca

SEQ ID NO: 1073113 - DNA, 19 bp, Homo sapiens
ctgaaccgcacagctcagg

SEQ ID NO: 1073114 - DNA, 23 bp, Homo sapiens
ctgaaccgcaccccatcccacca

SEQ ID NO: 1073115 - DNA, 16 bp, Homo sapiens
ctgaaccttgagcaaa

SEQ ID NO: 1073116 - DNA, 16 bp, Homo sapiens
ctgaacgttttcttct

SEQ ID NO: 1073117 - DNA, 17 bp, Homo sapiens
ctgaacgttttcttctt

SEQ ID NO: 1073118 - DNA, 23 bp, Homo sapiens
ctgaactaagttttgtgtgtata

SEQ ID NO: 1073119 - DNA, 23 bp, Homo sapiens
ctgaactacaagtgtaggccacc

SEQ ID NO: 1073120 - DNA, 13 bp, Homo sapiens
ctgaactccagag

SEQ ID NO: 1073121 - DNA, 21 bp, Homo sapiens
ctgaactccatacagcctcta

SEQ ID NO: 1073122 - DNA, 21 bp, Homo sapiens
ctgaactcctgccatagtctt

SEQ ID NO: 1073123 - DNA, 17 bp, Homo sapiens
ctgaactccttccccac

SEQ ID NO: 1073124 - DNA, 13 bp, Homo sapiens
ctgaactctcaaa

SEQ ID NO: 1073125 - DNA, 18 bp, Homo sapiens
ctgaactctcaaaagtct

SEQ ID NO: 1073126 - DNA, 23 bp, Homo sapiens
ctgaactcttcagaacacacaga

SEQ ID NO: 1073127 - DNA, 15 bp, Homo sapiens
ctgaactgacaatga

SEQ ID NO: 1073128 - DNA, 13 bp, Homo sapiens
ctgaactgagaag

SEQ ID NO: 1073129 - DNA, 14 bp, Homo sapiens
ctgaactgagaagg

SEQ ID NO: 1073130 - DNA, 23 bp, Homo sapiens
ctgaactgaggagatgaccaggg

SEQ ID NO: 1073131 - DNA, 16 bp, Homo sapiens
ctgaactgaggccttg

SEQ ID NO: 1073132 - DNA, 21 bp, Homo sapiens
ctgaactgctctactttgaga

SEQ ID NO: 1073133 - DNA, 15 bp, Homo sapiens
ctgaactgtgtgtaa

SEQ ID NO: 1073134 - DNA, 13 bp, Homo sapiens
ctgaactgtttgg

SEQ ID NO: 1073135 - DNA, 22 bp, Homo sapiens
ctgaacttcaggataataaagt

SEQ ID NO: 1073136 - DNA, 17 bp, Homo sapiens
ctgaactttctccctca

SEQ ID NO: 1073137 - DNA, 14 bp, Homo sapiens
ctgaagaaaaaatc

SEQ ID NO: 1073138 - DNA, 13 bp, Homo sapiens
ctgaagaaagtgt

SEQ ID NO: 1073139 - DNA, 19 bp, Homo sapiens
ctgaagaaatcctgggaat

SEQ ID NO: 1073140 - DNA, 17 bp, Homo sapiens
ctgaagaattaagatac

SEQ ID NO: 1073141 - DNA, 20 bp, Homo sapiens
ctgaagaattttgagtgaat

SEQ ID NO: 1073142 - DNA, 15 bp, Homo sapiens
ctgaagacctttaat

SEQ ID NO: 1073143 - DNA, 19 bp, Homo sapiens
ctgaagacgagcatccccc

SEQ ID NO: 1073144 - DNA, 18 bp, Homo sapiens
ctgaagactctgcagccc

SEQ ID NO: 1073145 - DNA, 20 bp, Homo sapiens
ctgaagactctgcagccctc

SEQ ID NO: 1073146 - DNA, 17 bp, Homo sapiens
ctgaagactgagaactt

SEQ ID NO: 1073147 - DNA, 21 bp, Homo sapiens
ctgaagactgagaactttttt

SEQ ID NO: 1073148 - DNA, 14 bp, Homo sapiens
ctgaagactgagga

SEQ ID NO: 1073149 - DNA, 16 bp, Homo sapiens
ctgaagactgcacagg

SEQ ID NO: 1073150 - DNA, 13 bp, Homo sapiens
ctgaagagcaagg

SEQ ID NO: 1073151 - DNA, 14 bp, Homo sapiens
ctgaagaggcgggc

SEQ ID NO: 1073152 - DNA, 23 bp, Homo sapiens
ctgaagaggcgggccagccaggc

SEQ ID NO: 1073153 - DNA, 14 bp, Homo sapiens
ctgaagagtcctct

SEQ ID NO: 1073154 - DNA, 16 bp, Homo sapiens
ctgaagagtcctctga

SEQ ID NO: 1073155 - DNA, 22 bp, Homo sapiens
ctgaagatgcccctgctccctc

SEQ ID NO: 1073156 - DNA, 15 bp, Homo sapiens
ctgaagatgccttga

SEQ ID NO: 1073157 - DNA, 11 bp, Homo sapiens
ctgaagatgtc

SEQ ID NO: 1073158 - DNA, 19 bp, Homo sapiens
ctgaagcaggttcccaagc

SEQ ID NO: 1073159 - DNA, 20 bp, Homo sapiens
ctgaagccacttggcccaga

SEQ ID NO: 1073160 - DNA, 14 bp, Homo sapiens
ctgaagccagctgc

SEQ ID NO: 1073161 - DNA, 21 bp, Homo sapiens
ctgaagccatgtagccaccca

SEQ ID NO: 1073162 - DNA, 13 bp, Homo sapiens
ctgaagcctctgc

SEQ ID NO: 1073163 - DNA, 17 bp, Homo sapiens
ctgaagcgactctcctg

SEQ ID NO: 1073164 - DNA, 15 bp, Homo sapiens
ctgaagcttgactcc

SEQ ID NO: 1073165 - DNA, 14 bp, Homo sapiens
ctgaaggaaaaaca

SEQ ID NO: 1073166 - DNA, 17 bp, Homo sapiens
ctgaaggaaaaacacaa

SEQ ID NO: 1073167 - DNA, 22 bp, Homo sapiens
ctgaaggaaaagcaagaaacag

SEQ ID NO: 1073168 - DNA, 14 bp, Homo sapiens
ctgaaggaagagaa

SEQ ID NO: 1073169 - DNA, 20 bp, Homo sapiens
ctgaaggaatagccagagag

SEQ ID NO: 1073170 - DNA, 23 bp, Homo sapiens
ctgaaggaatagccagagaggag

SEQ ID NO: 1073171 - DNA, 20 bp, Homo sapiens
ctgaaggaccccaggtaaga

SEQ ID NO: 1073172 - DNA, 12 bp, Homo sapiens
ctgaaggagaag

SEQ ID NO: 1073173 - DNA, 13 bp, Homo sapiens
ctgaaggagcccc

SEQ ID NO: 1073174 - DNA, 19 bp, Homo sapiens
ctgaaggctaaaaagcaac

SEQ ID NO: 1073175 - DNA, 17 bp, Homo sapiens
ctgaagggaactagagg

SEQ ID NO: 1073176 - DNA, 20 bp, Homo sapiens
ctgaagggaaggcaaaggca

SEQ ID NO: 1073177 - DNA, 16 bp, Homo sapiens
ctgaaggggcacacca

SEQ ID NO: 1073178 - DNA, 20 bp, Homo sapiens
ctgaaggggcacaccactgc

SEQ ID NO: 1073179 - DNA, 22 bp, Homo sapiens
ctgaaggggcacaccactgccc

SEQ ID NO: 1073180 - DNA, 20 bp, Homo sapiens
ctgaaggggcgtctgttccc

SEQ ID NO: 1073181 - DNA, 21 bp, Homo sapiens
ctgaaggggtgcacccacctg

SEQ ID NO: 1073182 - DNA, 22 bp, Homo sapiens
ctgaaggggtgcacccacctgt

SEQ ID NO: 1073183 - DNA, 19 bp, Homo sapiens
ctgaaggtattggcctgtt

SEQ ID NO: 1073184 - DNA, 21 bp, Homo sapiens
ctgaaggtattggcctgttca

SEQ ID NO: 1073185 - DNA, 16 bp, Homo sapiens
ctgaaggtccaggctt

SEQ ID NO: 1073186 - DNA, 21 bp, Homo sapiens
ctgaaggttttttttttaagt

SEQ ID NO: 1073187 - DNA, 17 bp, Homo sapiens
ctgaagtaaacagctgt

SEQ ID NO: 1073188 - DNA, 14 bp, Homo sapiens
ctgaagtacaaaca

SEQ ID NO: 1073189 - DNA, 16 bp, Homo sapiens
ctgaagtacaaacatg

SEQ ID NO: 1073190 - DNA, 19 bp, Homo sapiens
ctgaagtacaaacatgaaa

SEQ ID NO: 1073191 - DNA, 21 bp, Homo sapiens
ctgaagtcacatcacaggaca

SEQ ID NO: 1073192 - DNA, 22 bp, Homo sapiens
ctgaagtcactgcacagtgcat

SEQ ID NO: 1073193 - DNA, 21 bp, Homo sapiens
ctgaagtgcctactggggggc

SEQ ID NO: 1073194 - DNA, 16 bp, Homo sapiens
ctgaagtgcttagtgt

SEQ ID NO: 1073195 - DNA, 20 bp, Homo sapiens
ctgaagtgcttgcagatcat

SEQ ID NO: 1073196 - DNA, 17 bp, Homo sapiens
ctgaagtggccctccct

SEQ ID NO: 1073197 - DNA, 13 bp, Homo sapiens
ctgaagtggctgg

SEQ ID NO: 1073198 - DNA, 12 bp, Homo sapiens
ctgaagtgggaa

SEQ ID NO: 1073199 - DNA, 22 bp, Homo sapiens
ctgaagtgtgtccatcctgacc

SEQ ID NO: 1073200 - DNA, 23 bp, Homo sapiens
ctgaagtgtgtccatcctgacct

SEQ ID NO: 1073201 - DNA, 15 bp, Homo sapiens
ctgaagttctgagcc

SEQ ID NO: 1073202 - DNA, 18 bp, Homo sapiens
ctgaagttgctgctgtga

SEQ ID NO: 1073203 - DNA, 14 bp, Homo sapiens
ctgaagttggacag

SEQ ID NO: 1073204 - DNA, 15 bp, Homo sapiens
ctgaagttggacagc

SEQ ID NO: 1073205 - DNA, 15 bp, Homo sapiens
ctgaagttggccacc

SEQ ID NO: 1073206 - DNA, 17 bp, Homo sapiens
ctgaagtttttttgctg

SEQ ID NO: 1073207 - DNA, 23 bp, Homo sapiens
ctgaagtttttttgctgctgcct

SEQ ID NO: 1073208 - DNA, 15 bp, Homo sapiens
ctgaataaaaaagat

SEQ ID NO: 1073209 - DNA, 17 bp, Homo sapiens
ctgaataaaaaagattc

SEQ ID NO: 1073210 - DNA, 18 bp, Homo sapiens
ctgaataaagtgtaacaa

SEQ ID NO: 1073211 - DNA, 15 bp, Homo sapiens
ctgaataaatacctc

SEQ ID NO: 1073212 - DNA, 12 bp, Homo sapiens
ctgaataaatgg

SEQ ID NO: 1073213 - DNA, 14 bp, Homo sapiens
ctgaataacttgaa

SEQ ID NO: 1073214 - DNA, 14 bp, Homo sapiens
ctgaataatatcaa

SEQ ID NO: 1073215 - DNA, 16 bp, Homo sapiens
ctgaatacaaagtgat

SEQ ID NO: 1073216 - DNA, 18 bp, Homo sapiens
ctgaatacattctgcttt

SEQ ID NO: 1073217 - DNA, 15 bp, Homo sapiens
ctgaataccactctg

SEQ ID NO: 1073218 - DNA, 22 bp, Homo sapiens
ctgaataccactctgtaattgc

SEQ ID NO: 1073219 - DNA, 22 bp, Homo sapiens
ctgaatacgctaagcctggaag

SEQ ID NO: 1073220 - DNA, 15 bp, Homo sapiens
ctgaatatctgttca

SEQ ID NO: 1073221 - DNA, 18 bp, Homo sapiens
ctgaatattttggaaact

SEQ ID NO: 1073222 - DNA, 14 bp, Homo sapiens
ctgaatattttgta

SEQ ID NO: 1073223 - DNA, 18 bp, Homo sapiens
ctgaatcaagcacactgt

SEQ ID NO: 1073224 - DNA, 19 bp, Homo sapiens
ctgaatcaagcacactgta

SEQ ID NO: 1073225 - DNA, 11 bp, Homo sapiens
ctgaatcactg

SEQ ID NO: 1073226 - DNA, 16 bp, Homo sapiens
ctgaatcagaaaagct

SEQ ID NO: 1073227 - DNA, 12 bp, Homo sapiens
ctgaatcagctg

SEQ ID NO: 1073228 - DNA, 13 bp, Homo sapiens
ctgaatcagctgg

SEQ ID NO: 1073229 - DNA, 14 bp, Homo sapiens
ctgaatcagctgga

SEQ ID NO: 1073230 - DNA, 15 bp, Homo sapiens
ctgaatcagctggac

SEQ ID NO: 1073231 - DNA, 16 bp, Homo sapiens
ctgaatcagctggaca

SEQ ID NO: 1073232 - DNA, 21 bp, Homo sapiens
ctgaatcatgagcctgctgga

SEQ ID NO: 1073233 - DNA, 19 bp, Homo sapiens
ctgaatccaaactaatcca

SEQ ID NO: 1073234 - DNA, 20 bp, Homo sapiens
ctgaatccaaactaatccat

SEQ ID NO: 1073235 - DNA, 21 bp, Homo sapiens
ctgaatcctggtaattaaaag

SEQ ID NO: 1073236 - DNA, 17 bp, Homo sapiens
ctgaatctatggcttta

SEQ ID NO: 1073237 - DNA, 15 bp, Homo sapiens
ctgaatctgtacatg

SEQ ID NO: 1073238 - DNA, 23 bp, Homo sapiens
ctgaatcttaatcgatgaatgta

SEQ ID NO: 1073239 - DNA, 13 bp, Homo sapiens
ctgaatcttcacg

SEQ ID NO: 1073240 - DNA, 12 bp, Homo sapiens
ctgaatcttctg

SEQ ID NO: 1073241 - DNA, 14 bp, Homo sapiens
ctgaatgaagcagt

SEQ ID NO: 1073242 - DNA, 18 bp, Homo sapiens
ctgaatgaagctgccatc

SEQ ID NO: 1073243 - DNA, 20 bp, Homo sapiens
ctgaatgaggtcagcatgtc

SEQ ID NO: 1073244 - DNA, 21 bp, Homo sapiens
ctgaatgatcttgtgtaaggt

SEQ ID NO: 1073245 - DNA, 23 bp, Homo sapiens
ctgaatgcagggaatgcaatcct

SEQ ID NO: 1073246 - DNA, 22 bp, Homo sapiens
ctgaatgcctcaatgtgaccag

SEQ ID NO: 1073247 - DNA, 12 bp, Homo sapiens
ctgaatgctctg

SEQ ID NO: 1073248 - DNA, 14 bp, Homo sapiens
ctgaatgctgccac

SEQ ID NO: 1073249 - DNA, 14 bp, Homo sapiens
ctgaatgcttctaa

SEQ ID NO: 1073250 - DNA, 15 bp, Homo sapiens
ctgaatggtccaggg

SEQ ID NO: 1073251 - DNA, 16 bp, Homo sapiens
ctgaatggtccagggt

SEQ ID NO: 1073252 - DNA, 20 bp, Homo sapiens
ctgaatggttttcaaaataa

SEQ ID NO: 1073253 - DNA, 16 bp, Homo sapiens
ctgaatgtatgtaaat

SEQ ID NO: 1073254 - DNA, 22 bp, Homo sapiens
ctgaatgtgcctaatggagaag

SEQ ID NO: 1073255 - DNA, 19 bp, Homo sapiens
ctgaatgttctgacattaa

SEQ ID NO: 1073256 - DNA, 23 bp, Homo sapiens
ctgaatgttctgacattaacagt

SEQ ID NO: 1073257 - DNA, 16 bp, Homo sapiens
ctgaatgttgggactg

SEQ ID NO: 1073258 - DNA, 19 bp, Homo sapiens
ctgaatgtttgtttcagtg

SEQ ID NO: 1073259 - DNA, 19 bp, Homo sapiens
ctgaatgttttatttatca

SEQ ID NO: 1073260 - DNA, 12 bp, Homo sapiens
ctgaattaaaat

SEQ ID NO: 1073261 - DNA, 16 bp, Homo sapiens
ctgaattaaataaata

SEQ ID NO: 1073262 - DNA, 17 bp, Homo sapiens
ctgaattaatcatctat

SEQ ID NO: 1073263 - DNA, 19 bp, Homo sapiens
ctgaattaatgagaagata

SEQ ID NO: 1073264 - DNA, 16 bp, Homo sapiens
ctgaattctatttgct

SEQ ID NO: 1073265 - DNA, 17 bp, Homo sapiens
ctgaattctatttgctg

SEQ ID NO: 1073266 - DNA, 21 bp, Homo sapiens
ctgaattgagaataagaattt

SEQ ID NO: 1073267 - DNA, 15 bp, Homo sapiens
ctgaattgtccccag

SEQ ID NO: 1073268 - DNA, 20 bp, Homo sapiens
ctgaatttcaggcattttgt

SEQ ID NO: 1073269 - DNA, 12 bp, Homo sapiens
ctgaatttggag

SEQ ID NO: 1073270 - DNA, 21 bp, Homo sapiens
ctgaatttggcctgcactaat

SEQ ID NO: 1073271 - DNA, 14 bp, Homo sapiens
ctgaatttgggcct

SEQ ID NO: 1073272 - DNA, 11 bp, Homo sapiens
ctgaattttta

SEQ ID NO: 1073273 - DNA, 16 bp, Homo sapiens
ctgaatttttttgtaa

SEQ ID NO: 1073274 - DNA, 17 bp, Homo sapiens
ctgaatttttttgtaat

SEQ ID NO: 1073275 - DNA, 18 bp, Homo sapiens
ctgaatttttttgtaata

SEQ ID NO: 1073276 - DNA, 23 bp, Homo sapiens
ctgacaaaggagccttgataata

SEQ ID NO: 1073277 - DNA, 16 bp, Homo sapiens
ctgacaaagtcatccc

SEQ ID NO: 1073278 - DNA, 18 bp, Homo sapiens
ctgacaaagtcatcccct

SEQ ID NO: 1073279 - DNA, 20 bp, Homo sapiens
ctgacaaagtcatcccctct

SEQ ID NO: 1073280 - DNA, 22 bp, Homo sapiens
ctgacaaatattttagaagcta

SEQ ID NO: 1073281 - DNA, 22 bp, Homo sapiens
ctgacaacatttctatagccaa

SEQ ID NO: 1073282 - DNA, 21 bp, Homo sapiens
ctgacaaccaccgctccccag

SEQ ID NO: 1073283 - DNA, 18 bp, Homo sapiens
ctgacaaccactggtctg

SEQ ID NO: 1073284 - DNA, 18 bp, Homo sapiens
ctgacaaccattaaagtc

SEQ ID NO: 1073285 - DNA, 15 bp, Homo sapiens
ctgacaacgtctctt

SEQ ID NO: 1073286 - DNA, 17 bp, Homo sapiens
ctgacaacgtctcttca

SEQ ID NO: 1073287 - DNA, 18 bp, Homo sapiens
ctgacaacttagctcagg

SEQ ID NO: 1073288 - DNA, 13 bp, Homo sapiens
ctgacaacttgaa

SEQ ID NO: 1073289 - DNA, 14 bp, Homo sapiens
ctgacaagccatct

SEQ ID NO: 1073290 - DNA, 22 bp, Homo sapiens
ctgacaagggcccttctctact

SEQ ID NO: 1073291 - DNA, 13 bp, Homo sapiens
ctgacaatgaagg

SEQ ID NO: 1073292 - DNA, 17 bp, Homo sapiens
ctgacaatggcagctag

SEQ ID NO: 1073293 - DNA, 13 bp, Homo sapiens
ctgacacactaac

SEQ ID NO: 1073294 - DNA, 20 bp, Homo sapiens
ctgacacactaaccaagctg

SEQ ID NO: 1073295 - DNA, 18 bp, Homo sapiens
ctgacacattgctgatat

SEQ ID NO: 1073296 - DNA, 15 bp, Homo sapiens
ctgacaccccctccc

SEQ ID NO: 1073297 - DNA, 18 bp, Homo sapiens
ctgacaccgtccctcagt

SEQ ID NO: 1073298 - DNA, 19 bp, Homo sapiens
ctgacaccgtcgaccagga

SEQ ID NO: 1073299 - DNA, 19 bp, Homo sapiens
ctgacacctaccatgctgc

SEQ ID NO: 1073300 - DNA, 19 bp, Homo sapiens
ctgacacgcaagtgtgtga

SEQ ID NO: 1073301 - DNA, 16 bp, Homo sapiens
ctgacacgcagcctgc

SEQ ID NO: 1073302 - DNA, 19 bp, Homo sapiens
ctgacacgcagcctgctct

SEQ ID NO: 1073303 - DNA, 16 bp, Homo sapiens
ctgacactgagcccca

SEQ ID NO: 1073304 - DNA, 15 bp, Homo sapiens
ctgacacttcctgtc

SEQ ID NO: 1073305 - DNA, 16 bp, Homo sapiens
ctgacacttcctgtcc

SEQ ID NO: 1073306 - DNA, 19 bp, Homo sapiens
ctgacacttcctgtccttg

SEQ ID NO: 1073307 - DNA, 20 bp, Homo sapiens
ctgacacttcctgtccttgt

SEQ ID NO: 1073308 - DNA, 16 bp, Homo sapiens
ctgacagaaggtgcca

SEQ ID NO: 1073309 - DNA, 17 bp, Homo sapiens
ctgacagaagttatttc

SEQ ID NO: 1073310 - DNA, 15 bp, Homo sapiens
ctgacagactcactg

SEQ ID NO: 1073311 - DNA, 19 bp, Homo sapiens
ctgacagcagcctgtgagg

SEQ ID NO: 1073312 - DNA, 22 bp, Homo sapiens
ctgacagcatgtgccctcctga

SEQ ID NO: 1073313 - DNA, 21 bp, Homo sapiens
ctgacagcccaacttccagag

SEQ ID NO: 1073314 - DNA, 20 bp, Homo sapiens
ctgacagcctcccaccccca

SEQ ID NO: 1073315 - DNA, 14 bp, Homo sapiens
ctgacagccttccc

SEQ ID NO: 1073316 - DNA, 21 bp, Homo sapiens
ctgacagccttccccagctcc

SEQ ID NO: 1073317 - DNA, 17 bp, Homo sapiens
ctgacagctcttcacag

SEQ ID NO: 1073318 - DNA, 13 bp, Homo sapiens
ctgacagctgctc

SEQ ID NO: 1073319 - DNA, 14 bp, Homo sapiens
ctgacagctgctcc

SEQ ID NO: 1073320 - DNA, 22 bp, Homo sapiens
ctgacagggacatgccctgtgt

SEQ ID NO: 1073321 - DNA, 12 bp, Homo sapiens
ctgacagggagc

SEQ ID NO: 1073322 - DNA, 13 bp, Homo sapiens
ctgacagggagca

SEQ ID NO: 1073323 - DNA, 19 bp, Homo sapiens
ctgacaggtgatgctctgg

SEQ ID NO: 1073324 - DNA, 18 bp, Homo sapiens
ctgacagtattaagggta

SEQ ID NO: 1073325 - DNA, 13 bp, Homo sapiens
ctgacagtccaca

SEQ ID NO: 1073326 - DNA, 14 bp, Homo sapiens
ctgacagtttttct

SEQ ID NO: 1073327 - DNA, 20 bp, Homo sapiens
ctgacatcatcattcttgtg

SEQ ID NO: 1073328 - DNA, 19 bp, Homo sapiens
ctgacatgccctcccttct

SEQ ID NO: 1073329 - DNA, 13 bp, Homo sapiens
ctgacatgctaac

SEQ ID NO: 1073330 - DNA, 19 bp, Homo sapiens
ctgacatgtggggccaggt

SEQ ID NO: 1073331 - DNA, 20 bp, Homo sapiens
ctgacatgtttgtgctctgt

SEQ ID NO: 1073332 - DNA, 21 bp, Homo sapiens
ctgacattaacagttttccat

SEQ ID NO: 1073333 - DNA, 23 bp, Homo sapiens
ctgacattaacagttttccatga

SEQ ID NO: 1073334 - DNA, 22 bp, Homo sapiens
ctgacattcctaagagtggagg

SEQ ID NO: 1073335 - DNA, 14 bp, Homo sapiens
ctgacattgccaaa

SEQ ID NO: 1073336 - DNA, 17 bp, Homo sapiens
ctgacattgccaaaaag

SEQ ID NO: 1073337 - DNA, 14 bp, Homo sapiens
ctgacattgctcca

SEQ ID NO: 1073338 - DNA, 19 bp, Homo sapiens
ctgacatttctaacatatg

SEQ ID NO: 1073339 - DNA, 22 bp, Homo sapiens
ctgacatttctaacatatgtat

SEQ ID NO: 1073340 - DNA, 15 bp, Homo sapiens
ctgacattttttcct

SEQ ID NO: 1073341 - DNA, 14 bp, Homo sapiens
ctgaccaagagaga

SEQ ID NO: 1073342 - DNA, 23 bp, Homo sapiens
ctgaccaagcggctcaagaataa

SEQ ID NO: 1073343 - DNA, 14 bp, Homo sapiens
ctgaccaattgtgc

SEQ ID NO: 1073344 - DNA, 22 bp, Homo sapiens
ctgaccaattgtgctgccattt

SEQ ID NO: 1073345 - DNA, 16 bp, Homo sapiens
ctgaccacacttcctg

SEQ ID NO: 1073346 - DNA, 17 bp, Homo sapiens
ctgaccacacttcctgt

SEQ ID NO: 1073347 - DNA, 22 bp, Homo sapiens
ctgaccacggacgtttccatca

SEQ ID NO: 1073348 - DNA, 23 bp, Homo sapiens
ctgaccacggacgtttccatcag

SEQ ID NO: 1073349 - DNA, 21 bp, Homo sapiens
ctgaccagcagcgcctttccc

SEQ ID NO: 1073350 - DNA, 22 bp, Homo sapiens
ctgaccagcagcgcctttccca

SEQ ID NO: 1073351 - DNA, 17 bp, Homo sapiens
ctgaccagcctccatgc

SEQ ID NO: 1073352 - DNA, 21 bp, Homo sapiens
ctgaccagcctccatgctgcc

SEQ ID NO: 1073353 - DNA, 23 bp, Homo sapiens
ctgaccagcctccatgctgcctc

SEQ ID NO: 1073354 - DNA, 12 bp, Homo sapiens
ctgaccagctgg

SEQ ID NO: 1073355 - DNA, 17 bp, Homo sapiens
ctgaccagctggagtga

SEQ ID NO: 1073356 - DNA, 15 bp, Homo sapiens
ctgaccatccactct

SEQ ID NO: 1073357 - DNA, 14 bp, Homo sapiens
ctgaccatgcattt

SEQ ID NO: 1073358 - DNA, 20 bp, Homo sapiens
ctgaccatgctcatctgctg

SEQ ID NO: 1073359 - DNA, 18 bp, Homo sapiens
ctgaccatggttttggct

SEQ ID NO: 1073360 - DNA, 18 bp, Homo sapiens
ctgaccatttcaggggtc

SEQ ID NO: 1073361 - DNA, 14 bp, Homo sapiens
ctgacccaacaccc

SEQ ID NO: 1073362 - DNA, 19 bp, Homo sapiens
ctgacccaacacccccgac

SEQ ID NO: 1073363 - DNA, 14 bp, Homo sapiens
ctgacccaactggg

SEQ ID NO: 1073364 - DNA, 14 bp, Homo sapiens
ctgacccacggggc

SEQ ID NO: 1073365 - DNA, 16 bp, Homo sapiens
ctgacccacggggcag

SEQ ID NO: 1073366 - DNA, 16 bp, Homo sapiens
ctgacccagagtggag

SEQ ID NO: 1073367 - DNA, 14 bp, Homo sapiens
ctgacccagcatct

SEQ ID NO: 1073368 - DNA, 18 bp, Homo sapiens
ctgacccagcatctccca

SEQ ID NO: 1073369 - DNA, 15 bp, Homo sapiens
ctgacccaggccgca

SEQ ID NO: 1073370 - DNA, 18 bp, Homo sapiens
ctgacccaggccgcagct

SEQ ID NO: 1073371 - DNA, 14 bp, Homo sapiens
ctgacccagtccct

SEQ ID NO: 1073372 - DNA, 16 bp, Homo sapiens
ctgacccagtccctgg

SEQ ID NO: 1073373 - DNA, 13 bp, Homo sapiens
ctgacccagtgag

SEQ ID NO: 1073374 - DNA, 13 bp, Homo sapiens
ctgacccatccct

SEQ ID NO: 1073375 - DNA, 20 bp, Homo sapiens
ctgaccccacttatgctgct

SEQ ID NO: 1073376 - DNA, 21 bp, Homo sapiens
ctgaccccacttatgctgctg

SEQ ID NO: 1073377 - DNA, 22 bp, Homo sapiens
ctgaccccacttatgctgctgt

SEQ ID NO: 1073378 - DNA, 22 bp, Homo sapiens
ctgaccccaggtcagccctgtg

SEQ ID NO: 1073379 - DNA, 16 bp, Homo sapiens
ctgaccccctcccctg

SEQ ID NO: 1073380 - DNA, 20 bp, Homo sapiens
ctgaccccgagaagtgctct

SEQ ID NO: 1073381 - DNA, 23 bp, Homo sapiens
ctgaccccgagaagtgctcttgg

SEQ ID NO: 1073382 - DNA, 17 bp, Homo sapiens
ctgacccctccctgcag

SEQ ID NO: 1073383 - DNA, 22 bp, Homo sapiens
ctgacccctccctgcaggggct

SEQ ID NO: 1073384 - DNA, 14 bp, Homo sapiens
ctgacccctgctca

SEQ ID NO: 1073385 - DNA, 16 bp, Homo sapiens
ctgacccctgctcagt

SEQ ID NO: 1073386 - DNA, 14 bp, Homo sapiens
ctgaccccttgctc

SEQ ID NO: 1073387 - DNA, 20 bp, Homo sapiens
ctgacccggttgcagtcact

SEQ ID NO: 1073388 - DNA, 15 bp, Homo sapiens
ctgaccctcccactc

SEQ ID NO: 1073389 - DNA, 19 bp, Homo sapiens
ctgaccctcccactcccat

SEQ ID NO: 1073390 - DNA, 13 bp, Homo sapiens
ctgaccctcccag

SEQ ID NO: 1073391 - DNA, 14 bp, Homo sapiens
ctgaccctcccagt

SEQ ID NO: 1073392 - DNA, 22 bp, Homo sapiens
ctgaccctcctccactccacct

SEQ ID NO: 1073393 - DNA, 13 bp, Homo sapiens
ctgaccctccttc

SEQ ID NO: 1073394 - DNA, 16 bp, Homo sapiens
ctgaccctccttctat

SEQ ID NO: 1073395 - DNA, 17 bp, Homo sapiens
ctgaccctgaggaggcc

SEQ ID NO: 1073396 - DNA, 21 bp, Homo sapiens
ctgaccctgtatatagcccag

SEQ ID NO: 1073397 - DNA, 20 bp, Homo sapiens
ctgacccttacagcctctga

SEQ ID NO: 1073398 - DNA, 22 bp, Homo sapiens
ctgacccttacagcctctgact

SEQ ID NO: 1073399 - DNA, 20 bp, Homo sapiens
ctgaccgatgtgtctcccag

SEQ ID NO: 1073400 - DNA, 21 bp, Homo sapiens
ctgaccgatgtgtctcccaga

SEQ ID NO: 1073401 - DNA, 22 bp, Homo sapiens
ctgaccgatgtgtctcccagaa

SEQ ID NO: 1073402 - DNA, 20 bp, Homo sapiens
ctgaccgggatccagttcca

SEQ ID NO: 1073403 - DNA, 18 bp, Homo sapiens
ctgaccgggctcacttgc

SEQ ID NO: 1073404 - DNA, 18 bp, Homo sapiens
ctgaccgtgtacatagcc

SEQ ID NO: 1073405 - DNA, 20 bp, Homo sapiens
ctgacctagaccagtttgca

SEQ ID NO: 1073406 - DNA, 20 bp, Homo sapiens
ctgacctcaagcaaccatga

SEQ ID NO: 1073407 - DNA, 23 bp, Homo sapiens
ctgacctcccagccctatggatg

SEQ ID NO: 1073408 - DNA, 16 bp, Homo sapiens
ctgacctccgccatcc

SEQ ID NO: 1073409 - DNA, 17 bp, Homo sapiens
ctgacctccgccatcca

SEQ ID NO: 1073410 - DNA, 17 bp, Homo sapiens
ctgacctctgctgagtg

SEQ ID NO: 1073411 - DNA, 21 bp, Homo sapiens
ctgacctctgctgagtgctgg

SEQ ID NO: 1073412 - DNA, 24 bp, Homo sapiens
ctgacctctgctgagtgctgggca

SEQ ID NO: 1073413 - DNA, 16 bp, Homo sapiens
ctgacctcttgctgtc

SEQ ID NO: 1073414 - DNA, 18 bp, Homo sapiens
ctgacctcttgctgtctc

SEQ ID NO: 1073415 - DNA, 13 bp, Homo sapiens
ctgacctgcaggc

SEQ ID NO: 1073416 - DNA, 13 bp, Homo sapiens
ctgacctgctgaa

SEQ ID NO: 1073417 - DNA, 19 bp, Homo sapiens
ctgacctgctgacctgtgc

SEQ ID NO: 1073418 - DNA, 15 bp, Homo sapiens
ctgacctgtcatgcc

SEQ ID NO: 1073419 - DNA, 17 bp, Homo sapiens
ctgacctgtcatgcccc

SEQ ID NO: 1073420 - DNA, 22 bp, Homo sapiens
ctgacctgtcatgcccccctca

SEQ ID NO: 1073421 - DNA, 15 bp, Homo sapiens
ctgacctgtccaggt

SEQ ID NO: 1073422 - DNA, 18 bp, Homo sapiens
ctgacctgtgagcccagc

SEQ ID NO: 1073423 - DNA, 19 bp, Homo sapiens
ctgaccttaaatgcaacca

SEQ ID NO: 1073424 - DNA, 17 bp, Homo sapiens
ctgaccttagcgttctg

SEQ ID NO: 1073425 - DNA, 20 bp, Homo sapiens
ctgaccttagcgttctggac

SEQ ID NO: 1073426 - DNA, 15 bp, Homo sapiens
ctgaccttccttcct

SEQ ID NO: 1073427 - DNA, 16 bp, Homo sapiens
ctgaccttccttcctg

SEQ ID NO: 1073428 - DNA, 17 bp, Homo sapiens
ctgaccttgctgccaca

SEQ ID NO: 1073429 - DNA, 20 bp, Homo sapiens
ctgaccttggaggaatgaca

SEQ ID NO: 1073430 - DNA, 16 bp, Homo sapiens
ctgacgcaccactgcc

SEQ ID NO: 1073431 - DNA, 18 bp, Homo sapiens
ctgacgcaccactgccaa

SEQ ID NO: 1073432 - DNA, 18 bp, Homo sapiens
ctgacgcttgtgacagtg

SEQ ID NO: 1073433 - DNA, 20 bp, Homo sapiens
ctgacgcttgtgacagtgcc

SEQ ID NO: 1073434 - DNA, 16 bp, Homo sapiens
ctgacggagtcctgtg

SEQ ID NO: 1073435 - DNA, 15 bp, Homo sapiens
ctgacggctggggac

SEQ ID NO: 1073436 - DNA, 13 bp, Homo sapiens
ctgacgtccacct

SEQ ID NO: 1073437 - DNA, 14 bp, Homo sapiens
ctgacgtgcctttt

SEQ ID NO: 1073438 - DNA, 17 bp, Homo sapiens
ctgacgtgccttttgca

SEQ ID NO: 1073439 - DNA, 18 bp, Homo sapiens
ctgacgtgccttttgcac

SEQ ID NO: 1073440 - DNA, 22 bp, Homo sapiens
ctgacgtgccttttgcacccct

SEQ ID NO: 1073441 - DNA, 16 bp, Homo sapiens
ctgactaggctgatca

SEQ ID NO: 1073442 - DNA, 16 bp, Homo sapiens
ctgactagtagatttc

SEQ ID NO: 1073443 - DNA, 17 bp, Homo sapiens
ctgactagtagatttct

SEQ ID NO: 1073444 - DNA, 19 bp, Homo sapiens
ctgactcagggctcctggg

SEQ ID NO: 1073445 - DNA, 20 bp, Homo sapiens
ctgactccagagtctgagcc

SEQ ID NO: 1073446 - DNA, 16 bp, Homo sapiens
ctgactccctccccac

SEQ ID NO: 1073447 - DNA, 17 bp, Homo sapiens
ctgactccctccccacc

SEQ ID NO: 1073448 - DNA, 23 bp, Homo sapiens
ctgactccctccccacccaagag

SEQ ID NO: 1073449 - DNA, 17 bp, Homo sapiens
ctgactccctgtggggg

SEQ ID NO: 1073450 - DNA, 12 bp, Homo sapiens
ctgactcctctg

SEQ ID NO: 1073451 - DNA, 17 bp, Homo sapiens
ctgactcctctggcttt

SEQ ID NO: 1073452 - DNA, 21 bp, Homo sapiens
ctgactcctctggctttccca

SEQ ID NO: 1073453 - DNA, 14 bp, Homo sapiens
ctgactcctgggtg

SEQ ID NO: 1073454 - DNA, 18 bp, Homo sapiens
ctgactcggtttctccaa

SEQ ID NO: 1073455 - DNA, 16 bp, Homo sapiens
ctgactctctgagctg

SEQ ID NO: 1073456 - DNA, 23 bp, Homo sapiens
ctgactctctgagctggggaggt

SEQ ID NO: 1073457 - DNA, 16 bp, Homo sapiens
ctgactctctgtgacc

SEQ ID NO: 1073458 - DNA, 17 bp, Homo sapiens
ctgactctgaaatctga

SEQ ID NO: 1073459 - DNA, 19 bp, Homo sapiens
ctgactctgagtccactgc

SEQ ID NO: 1073460 - DNA, 15 bp, Homo sapiens
ctgactgaaggaaaa

SEQ ID NO: 1073461 - DNA, 18 bp, Homo sapiens
ctgactgagcaggctgtg

SEQ ID NO: 1073462 - DNA, 21 bp, Homo sapiens
ctgactgcaccagcgccccca

SEQ ID NO: 1073463 - DNA, 15 bp, Homo sapiens
ctgactgccaggacc

SEQ ID NO: 1073464 - DNA, 18 bp, Homo sapiens
ctgactgccaggacccca

SEQ ID NO: 1073465 - DNA, 19 bp, Homo sapiens
ctgactgccaggaccccag

SEQ ID NO: 1073466 - DNA, 20 bp, Homo sapiens
ctgactgccaggaccccagg

SEQ ID NO: 1073467 - DNA, 22 bp, Homo sapiens
ctgactgcccgctcctcgggaa

SEQ ID NO: 1073468 - DNA, 13 bp, Homo sapiens
ctgactgctcaga

SEQ ID NO: 1073469 - DNA, 16 bp, Homo sapiens
ctgactggttgtcaga

SEQ ID NO: 1073470 - DNA, 16 bp, Homo sapiens
ctgactgtcagggagg

SEQ ID NO: 1073471 - DNA, 17 bp, Homo sapiens
ctgactgtccaggagct

SEQ ID NO: 1073472 - DNA, 13 bp, Homo sapiens
ctgactgtccctg

SEQ ID NO: 1073473 - DNA, 12 bp, Homo sapiens
ctgactgtggcc

SEQ ID NO: 1073474 - DNA, 16 bp, Homo sapiens
ctgactgtggccccct

SEQ ID NO: 1073475 - DNA, 18 bp, Homo sapiens
ctgactgtttcattcact

SEQ ID NO: 1073476 - DNA, 19 bp, Homo sapiens
ctgactgttttttttgcag

SEQ ID NO: 1073477 - DNA, 18 bp, Homo sapiens
ctgacttaactttaactt

SEQ ID NO: 1073478 - DNA, 19 bp, Homo sapiens
ctgacttaagcaaaagaaa

SEQ ID NO: 1073479 - DNA, 20 bp, Homo sapiens
ctgacttaagcaaaagaaaa

SEQ ID NO: 1073480 - DNA, 20 bp, Homo sapiens
ctgacttcatggaatggaca

SEQ ID NO: 1073481 - DNA, 14 bp, Homo sapiens
ctgacttcatttgt

SEQ ID NO: 1073482 - DNA, 20 bp, Homo sapiens
ctgacttcatttgtgccaca

SEQ ID NO: 1073483 - DNA, 22 bp, Homo sapiens
ctgacttcatttgtgccacacg

SEQ ID NO: 1073484 - DNA, 22 bp, Homo sapiens
ctgacttccccaaacccagaaa

SEQ ID NO: 1073485 - DNA, 13 bp, Homo sapiens
ctgacttctcccc

SEQ ID NO: 1073486 - DNA, 20 bp, Homo sapiens
ctgacttctctgaatcagaa

SEQ ID NO: 1073487 - DNA, 22 bp, Homo sapiens
ctgacttctctgaatcagaaaa

SEQ ID NO: 1073488 - DNA, 14 bp, Homo sapiens
ctgacttgagccac

SEQ ID NO: 1073489 - DNA, 19 bp, Homo sapiens
ctgacttgagccactcctt

SEQ ID NO: 1073490 - DNA, 14 bp, Homo sapiens
ctgacttgagtgtt

SEQ ID NO: 1073491 - DNA, 22 bp, Homo sapiens
ctgacttgagtgttccttttta

SEQ ID NO: 1073492 - DNA, 17 bp, Homo sapiens
ctgacttggcacttaag

SEQ ID NO: 1073493 - DNA, 16 bp, Homo sapiens
ctgacttggttctgaa

SEQ ID NO: 1073494 - DNA, 15 bp, Homo sapiens
ctgactttacttgtg

SEQ ID NO: 1073495 - DNA, 16 bp, Homo sapiens
ctgactttgcttgctt

SEQ ID NO: 1073496 - DNA, 18 bp, Homo sapiens
ctgactttgcttgctttg

SEQ ID NO: 1073497 - DNA, 12 bp, Homo sapiens
ctgagaaaagta

SEQ ID NO: 1073498 - DNA, 20 bp, Homo sapiens
ctgagaaaagtattctcaaa

SEQ ID NO: 1073499 - DNA, 22 bp, Homo sapiens
ctgagctcggtggacccaggga

SEQ ID NO: 1073500 - DNA, 12 bp, Homo sapiens
ctgagctctcca

SEQ ID NO: 1073501 - DNA, 19 bp, Homo sapiens
ctgagctctccaggccagg

SEQ ID NO: 1073502 - DNA, 20 bp, Homo sapiens
ctgagctctccaggccaggt

SEQ ID NO: 1073503 - DNA, 18 bp, Homo sapiens
ctgagctgaggcagcagt

SEQ ID NO: 1073504 - DNA, 17 bp, Homo sapiens
ctgagctgagtggccag

SEQ ID NO: 1073505 - DNA, 23 bp, Homo sapiens
ctgagctgagtggccagccagtg

SEQ ID NO: 1073506 - DNA, 14 bp, Homo sapiens
ctgagctggaaggg

SEQ ID NO: 1073507 - DNA, 18 bp, Homo sapiens
ctgagctggaaggggcca

SEQ ID NO: 1073508 - DNA, 15 bp, Homo sapiens
ctgagctgggcccag

SEQ ID NO: 1073509 - DNA, 16 bp, Homo sapiens
ctgagctgggcccagc

SEQ ID NO: 1073510 - DNA, 12 bp, Homo sapiens
ctgagctgggga

SEQ ID NO: 1073511 - DNA, 13 bp, Homo sapiens
ctgagctggggag

SEQ ID NO: 1073512 - DNA, 16 bp, Homo sapiens
ctgagctggggccaca

SEQ ID NO: 1073513 - DNA, 16 bp, Homo sapiens
ctgagctggggggatg

SEQ ID NO: 1073514 - DNA, 19 bp, Homo sapiens
ctgagctgtatcttgatgt

SEQ ID NO: 1073515 - DNA, 19 bp, Homo sapiens
ctgagctgtgacattgctg

SEQ ID NO: 1073516 - DNA, 23 bp, Homo sapiens
ctgagctgtgacattgctggtca

SEQ ID NO: 1073517 - DNA, 15 bp, Homo sapiens
ctgagcttagccttg

SEQ ID NO: 1073518 - DNA, 19 bp, Homo sapiens
ctgagcttagccttgtgcc

SEQ ID NO: 1073519 - DNA, 22 bp, Homo sapiens
ctgagcttcagtataaaagaca

SEQ ID NO: 1073520 - DNA, 20 bp, Homo sapiens
ctgagcttcggttctccaga

SEQ ID NO: 1073521 - DNA, 22 bp, Homo sapiens
ctgagcttcggttctccagaat

SEQ ID NO: 1073522 - DNA, 16 bp, Homo sapiens
ctgagcttctgagaca

SEQ ID NO: 1073523 - DNA, 12 bp, Homo sapiens
ctgagcttggcc

SEQ ID NO: 1073524 - DNA, 15 bp, Homo sapiens
ctgagcttggccaga

SEQ ID NO: 1073525 - DNA, 17 bp, Homo sapiens
ctgagcttggccagaag

SEQ ID NO: 1073526 - DNA, 17 bp, Homo sapiens
ctgagctttagacagca

SEQ ID NO: 1073527 - DNA, 14 bp, Homo sapiens
ctgagctttctgct

SEQ ID NO: 1073528 - DNA, 15 bp, Homo sapiens
ctgagctttctgcta

SEQ ID NO: 1073529 - DNA, 14 bp, Homo sapiens
ctgagcttttcatg

SEQ ID NO: 1073530 - DNA, 19 bp, Homo sapiens
ctgagcttttcatggaagt

SEQ ID NO: 1073531 - DNA, 22 bp, Homo sapiens
ctgagcttttgatgccaggtgc

SEQ ID NO: 1073532 - DNA, 22 bp, Homo sapiens
ctgaggaacccttacagtagga

SEQ ID NO: 1073533 - DNA, 21 bp, Homo sapiens
ctgaggaagcagttggggccc

SEQ ID NO: 1073534 - DNA, 13 bp, Homo sapiens
ctgaggacagctg

SEQ ID NO: 1073535 - DNA, 22 bp, Homo sapiens
ctgaggacaggctctagagaga

SEQ ID NO: 1073536 - DNA, 14 bp, Homo sapiens
ctgaggacctctca

SEQ ID NO: 1073537 - DNA, 23 bp, Homo sapiens
ctgaggacctctcagcatagcct

SEQ ID NO: 1073538 - DNA, 14 bp, Homo sapiens
ctgaggactcctga

SEQ ID NO: 1073539 - DNA, 14 bp, Homo sapiens
ctgaggactgattt

SEQ ID NO: 1073540 - DNA, 22 bp, Homo sapiens
ctgaggactgatttcagagtga

SEQ ID NO: 1073541 - DNA, 15 bp, Homo sapiens
ctgaggactggagac

SEQ ID NO: 1073542 - DNA, 19 bp, Homo sapiens
ctgaggactgtcctcccac

SEQ ID NO: 1073543 - DNA, 22 bp, Homo sapiens
ctgaggagatgaccagggatgc

SEQ ID NO: 1073544 - DNA, 14 bp, Homo sapiens
ctgaggagcagcca

SEQ ID NO: 1073545 - DNA, 20 bp, Homo sapiens
ctgaggagcagccaggaccc

SEQ ID NO: 1073546 - DNA, 14 bp, Homo sapiens
ctgaggagccctga

SEQ ID NO: 1073547 - DNA, 20 bp, Homo sapiens
ctgaggagctgttactgaat

SEQ ID NO: 1073548 - DNA, 21 bp, Homo sapiens
ctgaggaggaggacacagcac

SEQ ID NO: 1073549 - DNA, 23 bp, Homo sapiens
ctgaggaggccgcttagtgctgc

SEQ ID NO: 1073550 - DNA, 17 bp, Homo sapiens
ctgaggagtctgaggac

SEQ ID NO: 1073551 - DNA, 15 bp, Homo sapiens
ctgaggagtgaggaa

SEQ ID NO: 1073552 - DNA, 17 bp, Homo sapiens
ctgaggatataagcttt

SEQ ID NO: 1073553 - DNA, 22 bp, Homo sapiens
ctgaggatattcagatgtatgt

SEQ ID NO: 1073554 - DNA, 14 bp, Homo sapiens
ctgaggatggcctg

SEQ ID NO: 1073555 - DNA, 20 bp, Homo sapiens
ctgaggatgggtcagagcta

SEQ ID NO: 1073556 - DNA, 22 bp, Homo sapiens
ctgaggatgtagagagaacagg

SEQ ID NO: 1073557 - DNA, 18 bp, Homo sapiens
ctgaggatttcaagcctg

SEQ ID NO: 1073558 - DNA, 14 bp, Homo sapiens
ctgaggatttcctg

SEQ ID NO: 1073559 - DNA, 20 bp, Homo sapiens
ctgaggatttcctggagtgc

SEQ ID NO: 1073560 - DNA, 22 bp, Homo sapiens
ctgaggatttcctggagtgccc

SEQ ID NO: 1073561 - DNA, 13 bp, Homo sapiens
ctgaggcagacag

SEQ ID NO: 1073562 - DNA, 17 bp, Homo sapiens
ctgaggcagacagcagc

SEQ ID NO: 1073563 - DNA, 18 bp, Homo sapiens
ctgaggcagacagcagct

SEQ ID NO: 1073564 - DNA, 23 bp, Homo sapiens
ctgaggcagcagtgtgaggccag

SEQ ID NO: 1073565 - DNA, 15 bp, Homo sapiens
ctgaggcaggaggat

SEQ ID NO: 1073566 - DNA, 12 bp, Homo sapiens
ctgaggccacac

SEQ ID NO: 1073567 - DNA, 14 bp, Homo sapiens
ctgaggccacactc

SEQ ID NO: 1073568 - DNA, 24 bp, Homo sapiens
ctgaggccacactcagcacaaggc

SEQ ID NO: 1073569 - DNA, 17 bp, Homo sapiens
ctgaggccagagtcacc

SEQ ID NO: 1073570 - DNA, 22 bp, Homo sapiens
ctgaggccatcagggccctgcc

SEQ ID NO: 1073571 - DNA, 13 bp, Homo sapiens
ctgaggcccagtg

SEQ ID NO: 1073572 - DNA, 17 bp, Homo sapiens
ctgaggccctcactgag

SEQ ID NO: 1073573 - DNA, 17 bp, Homo sapiens
ctgaggccctgggctgg

SEQ ID NO: 1073574 - DNA, 15 bp, Homo sapiens
ctgaggcctagactc

SEQ ID NO: 1073575 - DNA, 19 bp, Homo sapiens
ctgaggcctcgaggggcct

SEQ ID NO: 1073576 - DNA, 17 bp, Homo sapiens
ctgaggcctgccccctg

SEQ ID NO: 1073577 - DNA, 23 bp, Homo sapiens
ctgaggcctgccccctgggctgg

SEQ ID NO: 1073578 - DNA, 15 bp, Homo sapiens
ctgaggcctggactt

SEQ ID NO: 1073579 - DNA, 15 bp, Homo sapiens
ctgaggcctgggccg

SEQ ID NO: 1073580 - DNA, 19 bp, Homo sapiens
ctgaggcctgggccgctgc

SEQ ID NO: 1073581 - DNA, 22 bp, Homo sapiens
ctgaggcctgggccgctgccac

SEQ ID NO: 1073582 - DNA, 20 bp, Homo sapiens
ctgaggccttctcttgaggc

SEQ ID NO: 1073583 - DNA, 12 bp, Homo sapiens
ctgaggccttgt

SEQ ID NO: 1073584 - DNA, 22 bp, Homo sapiens
ctgaggccttgtgtgtcaggcc

SEQ ID NO: 1073585 - DNA, 17 bp, Homo sapiens
ctgaggcggaggctgtg

SEQ ID NO: 1073586 - DNA, 19 bp, Homo sapiens
ctgaggcggaggctgtgct

SEQ ID NO: 1073587 - DNA, 21 bp, Homo sapiens
ctgaggcggaggctgtgctcc

SEQ ID NO: 1073588 - DNA, 18 bp, Homo sapiens
ctgaggcgggtggatcac

SEQ ID NO: 1073589 - DNA, 16 bp, Homo sapiens
ctgaggctcagggaaa

SEQ ID NO: 1073590 - DNA, 22 bp, Homo sapiens
ctgaggctctgacccagtgaga

SEQ ID NO: 1073591 - DNA, 15 bp, Homo sapiens
ctgaggctgagactg

SEQ ID NO: 1073592 - DNA, 15 bp, Homo sapiens
ctgaggctggatcct

SEQ ID NO: 1073593 - DNA, 11 bp, Homo sapiens
ctgaggctggc

SEQ ID NO: 1073594 - DNA, 17 bp, Homo sapiens
ctgaggctggcacagga

SEQ ID NO: 1073595 - DNA, 18 bp, Homo sapiens
ctgaggctggcacaggac

SEQ ID NO: 1073596 - DNA, 19 bp, Homo sapiens
ctgaggctggcacaggaca

SEQ ID NO: 1073597 - DNA, 20 bp, Homo sapiens
ctgaggctgggggagagccg

SEQ ID NO: 1073598 - DNA, 13 bp, Homo sapiens
ctgaggctgtggt

SEQ ID NO: 1073599 - DNA, 18 bp, Homo sapiens
ctgaggcttagagagagg

SEQ ID NO: 1073600 - DNA, 19 bp, Homo sapiens
ctgaggcttagagagagga

SEQ ID NO: 1073601 - DNA, 20 bp, Homo sapiens
ctgaggcttagagagaggag

SEQ ID NO: 1073602 - DNA, 23 bp, Homo sapiens
ctgaggcttagagagaggaggca

SEQ ID NO: 1073603 - DNA, 14 bp, Homo sapiens
ctgaggcttccaga

SEQ ID NO: 1073604 - DNA, 14 bp, Homo sapiens
ctgaggctttggat

SEQ ID NO: 1073605 - DNA, 21 bp, Homo sapiens
ctgaggctttggtacccccaa

SEQ ID NO: 1073606 - DNA, 15 bp, Homo sapiens
ctgagggaggacctg

SEQ ID NO: 1073607 - DNA, 19 bp, Homo sapiens
ctgagggaggacctggggc

SEQ ID NO: 1073608 - DNA, 16 bp, Homo sapiens
ctgagggaggaggcca

SEQ ID NO: 1073609 - DNA, 18 bp, Homo sapiens
ctgagggaggaggccacc

SEQ ID NO: 1073610 - DNA, 19 bp, Homo sapiens
ctgagggaggaggccacct

SEQ ID NO: 1073611 - DNA, 20 bp, Homo sapiens
ctgagggaggaggccacctc

SEQ ID NO: 1073612 - DNA, 19 bp, Homo sapiens
ctgagggagggagccatgg

SEQ ID NO: 1073613 - DNA, 15 bp, Homo sapiens
ctgagggatctttac

SEQ ID NO: 1073614 - DNA, 23 bp, Homo sapiens
ctgagggattttagcctcttccc

SEQ ID NO: 1073615 - DNA, 15 bp, Homo sapiens
ctgagggccacacta

SEQ ID NO: 1073616 - DNA, 16 bp, Homo sapiens
ctgagggcccctctgc

SEQ ID NO: 1073617 - DNA, 19 bp, Homo sapiens
ctgagggcccctctgccca

SEQ ID NO: 1073618 - DNA, 20 bp, Homo sapiens
ctgagggcccctctgcccag

SEQ ID NO: 1073619 - DNA, 21 bp, Homo sapiens
ctgagggcccctctgcccagc

SEQ ID NO: 1073620 - DNA, 17 bp, Homo sapiens
ctgagggccctgtggag

SEQ ID NO: 1073621 - DNA, 18 bp, Homo sapiens
ctgagggctaattctggg

SEQ ID NO: 1073622 - DNA, 21 bp, Homo sapiens
ctgagggctaattctgggaag

SEQ ID NO: 1073623 - DNA, 15 bp, Homo sapiens
ctgagggctctgttt

SEQ ID NO: 1073624 - DNA, 22 bp, Homo sapiens
ctgagggctctgtttgtgggac

SEQ ID NO: 1073625 - DNA, 24 bp, Homo sapiens
ctgaggggacgggcaagtgagagg

SEQ ID NO: 1073626 - DNA, 16 bp, Homo sapiens
ctgaggggaggcacct

SEQ ID NO: 1073627 - DNA, 16 bp, Homo sapiens
ctgaggggattctcta

SEQ ID NO: 1073628 - DNA, 22 bp, Homo sapiens
ctgaggggcaacgaagaaaaaa

SEQ ID NO: 1073629 - DNA, 15 bp, Homo sapiens
ctgaggggcagggag

SEQ ID NO: 1073630 - DNA, 24 bp, Homo sapiens
ctgaggggcagggagagcgcctct

SEQ ID NO: 1073631 - DNA, 18 bp, Homo sapiens
ctgaggggcctgcgccca

SEQ ID NO: 1073632 - DNA, 20 bp, Homo sapiens
ctgaggggcctgcgcccaga

SEQ ID NO: 1073633 - DNA, 22 bp, Homo sapiens
ctgaggggcctgcgcccagagc

SEQ ID NO: 1073634 - DNA, 17 bp, Homo sapiens
ctgaggggctaccagga

SEQ ID NO: 1073635 - DNA, 18 bp, Homo sapiens
ctgaggggctaccaggaa

SEQ ID NO: 1073636 - DNA, 20 bp, Homo sapiens
ctgaggggctaccaggaaag

SEQ ID NO: 1073637 - DNA, 13 bp, Homo sapiens
ctgaggggtgtcc

SEQ ID NO: 1073638 - DNA, 20 bp, Homo sapiens
ctgaggggtgtccgagaggc

SEQ ID NO: 1073639 - DNA, 15 bp, Homo sapiens
ctgagggtccccacc

SEQ ID NO: 1073640 - DNA, 19 bp, Homo sapiens
ctgagggtccccacctggg

SEQ ID NO: 1073641 - DNA, 20 bp, Homo sapiens
ctgagggtccccacctggga

SEQ ID NO: 1073642 - DNA, 19 bp, Homo sapiens
ctgagggtggagactaagc

SEQ ID NO: 1073643 - DNA, 20 bp, Homo sapiens
ctgagggtggagactaagcc

SEQ ID NO: 1073644 - DNA, 16 bp, Homo sapiens
ctgaggtataaagaca

SEQ ID NO: 1073645 - DNA, 17 bp, Homo sapiens
ctgaggtataaagacaa

SEQ ID NO: 1073646 - DNA, 18 bp, Homo sapiens
ctgaggtataaagacaag

SEQ ID NO: 1073647 - DNA, 19 bp, Homo sapiens
ctgaggtatggccatgccc

SEQ ID NO: 1073648 - DNA, 16 bp, Homo sapiens
ctgaggtcaataaagc

SEQ ID NO: 1073649 - DNA, 21 bp, Homo sapiens
ctgaggtccaagattctggag

SEQ ID NO: 1073650 - DNA, 17 bp, Homo sapiens
ctgaggtccacagacct

SEQ ID NO: 1073651 - DNA, 22 bp, Homo sapiens
ctgaggtcccttcaaggcctcc

SEQ ID NO: 1073652 - DNA, 23 bp, Homo sapiens
ctgaggtcccttcaaggcctccc

SEQ ID NO: 1073653 - DNA, 17 bp, Homo sapiens
ctgaggtcgggagttcg

SEQ ID NO: 1073654 - DNA, 17 bp, Homo sapiens
ctgaggtgaaagggagc

SEQ ID NO: 1073655 - DNA, 14 bp, Homo sapiens
ctgaggtgcctgct

SEQ ID NO: 1073656 - DNA, 22 bp, Homo sapiens
ctgaggtgcctgctcaggtgct

SEQ ID NO: 1073657 - DNA, 19 bp, Homo sapiens
ctgaggtgcctgtcccacc

SEQ ID NO: 1073658 - DNA, 14 bp, Homo sapiens
ctgaggtgggccca

SEQ ID NO: 1073659 - DNA, 16 bp, Homo sapiens
ctgaggtgggcccagg

SEQ ID NO: 1073660 - DNA, 17 bp, Homo sapiens
ctgaggtgggcccagga

SEQ ID NO: 1073661 - DNA, 20 bp, Homo sapiens
ctgaggtgggcccaggacca

SEQ ID NO: 1073662 - DNA, 22 bp, Homo sapiens
ctgaggtgggcccaggaccagc

SEQ ID NO: 1073663 - DNA, 13 bp, Homo sapiens
ctgaggtggggaa

SEQ ID NO: 1073664 - DNA, 16 bp, Homo sapiens
ctgaggtggggaagga

SEQ ID NO: 1073665 - DNA, 14 bp, Homo sapiens
ctgaggtgtggggg

SEQ ID NO: 1073666 - DNA, 14 bp, Homo sapiens
ctgaggttcctctg

SEQ ID NO: 1073667 - DNA, 16 bp, Homo sapiens
ctgaggttcctctgcc

SEQ ID NO: 1073668 - DNA, 17 bp, Homo sapiens
ctgaggttcctctgcct

SEQ ID NO: 1073669 - DNA, 18 bp, Homo sapiens
ctgaggttcctctgcctg

SEQ ID NO: 1073670 - DNA, 20 bp, Homo sapiens
ctgaggttcctctgcctgcc

SEQ ID NO: 1073671 - DNA, 23 bp, Homo sapiens
ctgaggttcctctgcctgccccg

SEQ ID NO: 1073672 - DNA, 13 bp, Homo sapiens
ctgaggttttgaa

SEQ ID NO: 1073673 - DNA, 20 bp, Homo sapiens
ctgaggttttgaataaaaag

SEQ ID NO: 1073674 - DNA, 12 bp, Homo sapiens
ctgagtaaattg

SEQ ID NO: 1073675 - DNA, 19 bp, Homo sapiens
ctgagtaaattggaaacat

SEQ ID NO: 1073676 - DNA, 20 bp, Homo sapiens
ctgagtaaattggaaacatt

SEQ ID NO: 1073677 - DNA, 13 bp, Homo sapiens
ctgatgcttgaag

SEQ ID NO: 1073678 - DNA, 19 bp, Homo sapiens
ctgatgcttttgtctaatt

SEQ ID NO: 1073679 - DNA, 22 bp, Homo sapiens
ctgatggaacagaatagagaat

SEQ ID NO: 1073680 - DNA, 20 bp, Homo sapiens
ctgatggaactgtgtattta

SEQ ID NO: 1073681 - DNA, 15 bp, Homo sapiens
ctgatggaagatggt

SEQ ID NO: 1073682 - DNA, 16 bp, Homo sapiens
ctgatggaagatggtc

SEQ ID NO: 1073683 - DNA, 16 bp, Homo sapiens
ctgatggaatgtgcca

SEQ ID NO: 1073684 - DNA, 18 bp, Homo sapiens
ctgatggaatgtgccacc

SEQ ID NO: 1073685 - DNA, 20 bp, Homo sapiens
ctgatggaatgtgccacctg

SEQ ID NO: 1073686 - DNA, 20 bp, Homo sapiens
ctgatggaccgggtgggcct

SEQ ID NO: 1073687 - DNA, 15 bp, Homo sapiens
ctgatggacctgccc

SEQ ID NO: 1073688 - DNA, 15 bp, Homo sapiens
ctgatggagccttcc

SEQ ID NO: 1073689 - DNA, 15 bp, Homo sapiens
ctgatggaggaaaaa

SEQ ID NO: 1073690 - DNA, 16 bp, Homo sapiens
ctgatggagtgtgcag

SEQ ID NO: 1073691 - DNA, 17 bp, Homo sapiens
ctgatggcacagaagga

SEQ ID NO: 1073692 - DNA, 11 bp, Homo sapiens
ctgatggccaa

SEQ ID NO: 1073693 - DNA, 17 bp, Homo sapiens
ctgatggccaagggggt

SEQ ID NO: 1073694 - DNA, 14 bp, Homo sapiens
ctgatggccttaat

SEQ ID NO: 1073695 - DNA, 20 bp, Homo sapiens
ctgatggccttaatttcctt

SEQ ID NO: 1073696 - DNA, 20 bp, Homo sapiens
ctgatggcctttggacccag

SEQ ID NO: 1073697 - DNA, 19 bp, Homo sapiens
ctgatggctgctagatttt

SEQ ID NO: 1073698 - DNA, 13 bp, Homo sapiens
ctgatggcttgac

SEQ ID NO: 1073699 - DNA, 16 bp, Homo sapiens
ctgatggcttgacatg

SEQ ID NO: 1073700 - DNA, 20 bp, Homo sapiens
ctgatggcttgacatgtgca

SEQ ID NO: 1073701 - DNA, 23 bp, Homo sapiens
ctgatggcttgacatgtgcaatt

SEQ ID NO: 1073702 - DNA, 22 bp, Homo sapiens
ctgatgggaaaactgccaatat

SEQ ID NO: 1073703 - DNA, 17 bp, Homo sapiens
ctgatgggaaggagggg

SEQ ID NO: 1073704 - DNA, 21 bp, Homo sapiens
ctgatgggaaggaggggagcc

SEQ ID NO: 1073705 - DNA, 17 bp, Homo sapiens
ctgatgggctggggcag

SEQ ID NO: 1073706 - DNA, 16 bp, Homo sapiens
ctgatggtacaggaaa

SEQ ID NO: 1073707 - DNA, 19 bp, Homo sapiens
ctgatggtcagctcccttc

SEQ ID NO: 1073708 - DNA, 18 bp, Homo sapiens
ctgatggtcttaaatgct

SEQ ID NO: 1073709 - DNA, 15 bp, Homo sapiens
ctgatggtgagctgg

SEQ ID NO: 1073710 - DNA, 16 bp, Homo sapiens
ctgatggtgagctggg

SEQ ID NO: 1073711 - DNA, 17 bp, Homo sapiens
ctgatggtgagctggga

SEQ ID NO: 1073712 - DNA, 19 bp, Homo sapiens
ctgatggtgagctgggaag

SEQ ID NO: 1073713 - DNA, 16 bp, Homo sapiens
ctgatggtgctcacga

SEQ ID NO: 1073714 - DNA, 22 bp, Homo sapiens
ctgatggtgtcattctgcctgc

SEQ ID NO: 1073715 - DNA, 16 bp, Homo sapiens
ctgatgtaacaaggtg

SEQ ID NO: 1073716 - DNA, 13 bp, Homo sapiens
ctgatgtattaca

SEQ ID NO: 1073717 - DNA, 18 bp, Homo sapiens
ctgatgtcaatttctgtg

SEQ ID NO: 1073718 - DNA, 15 bp, Homo sapiens
ctgatgtcatatcat

SEQ ID NO: 1073719 - DNA, 16 bp, Homo sapiens
ctgatgtgatattctg

SEQ ID NO: 1073720 - DNA, 16 bp, Homo sapiens
ctgatgtggcaaaagg

SEQ ID NO: 1073721 - DNA, 20 bp, Homo sapiens
ctgatgttacatcacagtgt

SEQ ID NO: 1073722 - DNA, 15 bp, Homo sapiens
ctgatgttactagcc

SEQ ID NO: 1073723 - DNA, 17 bp, Homo sapiens
ctgatgttactagcctc

SEQ ID NO: 1073724 - DNA, 22 bp, Homo sapiens
ctgatgttcctttggaagaaaa

SEQ ID NO: 1073725 - DNA, 15 bp, Homo sapiens
ctgatgtttataaac

SEQ ID NO: 1073726 - DNA, 23 bp, Homo sapiens
ctgatgtttcctgggtgccctgg

SEQ ID NO: 1073727 - DNA, 22 bp, Homo sapiens
ctgattaaaaagggagaaagaa

SEQ ID NO: 1073728 - DNA, 20 bp, Homo sapiens
ctgattaaaaataccttcta

SEQ ID NO: 1073729 - DNA, 14 bp, Homo sapiens
ctgattaaaacaca

SEQ ID NO: 1073730 - DNA, 21 bp, Homo sapiens
ctgattaaaatgcttcctccc

SEQ ID NO: 1073731 - DNA, 15 bp, Homo sapiens
ctgattaatatattt

SEQ ID NO: 1073732 - DNA, 18 bp, Homo sapiens
ctgattaccagtctgatt

SEQ ID NO: 1073733 - DNA, 23 bp, Homo sapiens
ctgattactgtcaataaacagct

SEQ ID NO: 1073734 - DNA, 23 bp, Homo sapiens
ctgattagaaatgaccaatatta

SEQ ID NO: 1073735 - DNA, 21 bp, Homo sapiens
ctgattagaagtataaggtgc

SEQ ID NO: 1073736 - DNA, 20 bp, Homo sapiens
ctgattagagtggttattca

SEQ ID NO: 1073737 - DNA, 17 bp, Homo sapiens
ctgattattttcttcat

SEQ ID NO: 1073738 - DNA, 12 bp, Homo sapiens
ctgattcaaacc

SEQ ID NO: 1073739 - DNA, 18 bp, Homo sapiens
ctgattcaaaccaaagct

SEQ ID NO: 1073740 - DNA, 19 bp, Homo sapiens
ctgattcacctcttcctct

SEQ ID NO: 1073741 - DNA, 22 bp, Homo sapiens
ctgattcacctcttcctctggt

SEQ ID NO: 1073742 - DNA, 13 bp, Homo sapiens
ctgattcactgca

SEQ ID NO: 1073743 - DNA, 15 bp, Homo sapiens
ctgattcactgcatg

SEQ ID NO: 1073744 - DNA, 17 bp, Homo sapiens
ctgattcatactccttt

SEQ ID NO: 1073745 - DNA, 18 bp, Homo sapiens
ctgattcatactcctttt

SEQ ID NO: 1073746 - DNA, 12 bp, Homo sapiens
ctgattccaaat

SEQ ID NO: 1073747 - DNA, 13 bp, Homo sapiens
ctgattcctggag

SEQ ID NO: 1073748 - DNA, 15 bp, Homo sapiens
ctgattcctttaaaa

SEQ ID NO: 1073749 - DNA, 18 bp, Homo sapiens
ctgattcctttaaaatat

SEQ ID NO: 1073750 - DNA, 19 bp, Homo sapiens
ctgattctctttaactgtg

SEQ ID NO: 1073751 - DNA, 22 bp, Homo sapiens
ctgattcttgattcctggctct

SEQ ID NO: 1073752 - DNA, 20 bp, Homo sapiens
ctgattcttgtaaatctttt

SEQ ID NO: 1073753 - DNA, 17 bp, Homo sapiens
ctgattgatcacacagt

SEQ ID NO: 1073754 - DNA, 15 bp, Homo sapiens
ctgattggacatttt

SEQ ID NO: 1073755 - DNA, 17 bp, Homo sapiens
ctgattgggaggtgcgt

SEQ ID NO: 1073756 - DNA, 17 bp, Homo sapiens
ctgattgtgttgaagaa

SEQ ID NO: 1073757 - DNA, 14 bp, Homo sapiens
ctgattgtttacag

SEQ ID NO: 1073758 - DNA, 16 bp, Homo sapiens
ctgatttaatatgcaa

SEQ ID NO: 1073759 - DNA, 17 bp, Homo sapiens
ctgatttaatgttttct

SEQ ID NO: 1073760 - DNA, 16 bp, Homo sapiens
ctgatttagatatgca

SEQ ID NO: 1073761 - DNA, 16 bp, Homo sapiens
ctgatttcagaagaga

SEQ ID NO: 1073762 - DNA, 18 bp, Homo sapiens
ctgatttcagaagagact

SEQ ID NO: 1073763 - DNA, 17 bp, Homo sapiens
ctgatttcaggcagcag

SEQ ID NO: 1073764 - DNA, 22 bp, Homo sapiens
ctgatttcagtttttcatttgt

SEQ ID NO: 1073765 - DNA, 12 bp, Homo sapiens
ctgatttcataa

SEQ ID NO: 1073766 - DNA, 16 bp, Homo sapiens
ctgatttccaggcccc

SEQ ID NO: 1073767 - DNA, 14 bp, Homo sapiens
ctgatttcctttgg

SEQ ID NO: 1073768 - DNA, 23 bp, Homo sapiens
ctgatttctctgaacagaaaaca

SEQ ID NO: 1073769 - DNA, 13 bp, Homo sapiens
ctgatttgtcctg

SEQ ID NO: 1073770 - DNA, 19 bp, Homo sapiens
ctgatttgtcctgcagtgc

SEQ ID NO: 1073771 - DNA, 14 bp, Homo sapiens
ctgatttgttttca

SEQ ID NO: 1073772 - DNA, 23 bp, Homo sapiens
ctgatttgttttcattatagaca

SEQ ID NO: 1073773 - DNA, 18 bp, Homo sapiens
ctgattttaaaatgaata

SEQ ID NO: 1073774 - DNA, 14 bp, Homo sapiens
ctgattttaacaat

SEQ ID NO: 1073775 - DNA, 17 bp, Homo sapiens
ctgattttaacaataac

SEQ ID NO: 1073776 - DNA, 14 bp, Homo sapiens
ctgattttctcact

SEQ ID NO: 1073777 - DNA, 20 bp, Homo sapiens
ctgattttctcactgaactc

SEQ ID NO: 1073778 - DNA, 18 bp, Homo sapiens
ctgattttgtagttaatt

SEQ ID NO: 1073779 - DNA, 13 bp, Homo sapiens
ctgattttgtatg

SEQ ID NO: 1073780 - DNA, 13 bp, Homo sapiens
ctgatttttcctt

SEQ ID NO: 1073781 - DNA, 16 bp, Homo sapiens
ctgatttttcctttcg

SEQ ID NO: 1073782 - DNA, 19 bp, Homo sapiens
ctgattttttttcctttta

SEQ ID NO: 1073783 - DNA, 16 bp, Homo sapiens
ctgcaaaaaaagcctc

SEQ ID NO: 1073784 - DNA, 17 bp, Homo sapiens
ctgcaaaaaaagcctcc

SEQ ID NO: 1073785 - DNA, 20 bp, Homo sapiens
ctgcaaaaaaagcctccaag

SEQ ID NO: 1073786 - DNA, 22 bp, Homo sapiens
ctgcaaaaaaagcctccaaggg

SEQ ID NO: 1073787 - DNA, 23 bp, Homo sapiens
ctgcaaaaaatactttttctaat

SEQ ID NO: 1073788 - DNA, 21 bp, Homo sapiens
ctgcaaaaatatttataaaac

SEQ ID NO: 1073789 - DNA, 19 bp, Homo sapiens
ctgcaaaaggcctcttgta

SEQ ID NO: 1073790 - DNA, 11 bp, Homo sapiens
ctgcaaaattt

SEQ ID NO: 1073791 - DNA, 14 bp, Homo sapiens
ctgcaaacagaaat

SEQ ID NO: 1073792 - DNA, 15 bp, Homo sapiens
ctgcaaacagaaatc

SEQ ID NO: 1073793 - DNA, 16 bp, Homo sapiens
ctgcaaacagaacagg

SEQ ID NO: 1073794 - DNA, 19 bp, Homo sapiens
ctgcaaacagaacagggtc

SEQ ID NO: 1073795 - DNA, 20 bp, Homo sapiens
ctgcaaacagaacagggtca

SEQ ID NO: 1073796 - DNA, 18 bp, Homo sapiens
ctgcaaacctgacccctg

SEQ ID NO: 1073797 - DNA, 14 bp, Homo sapiens
ctgcaaaccttcct

SEQ ID NO: 1073798 - DNA, 17 bp, Homo sapiens
ctgcaaaccttcctggg

SEQ ID NO: 1073799 - DNA, 13 bp, Homo sapiens
ctgcaaagcccag

SEQ ID NO: 1073800 - DNA, 16 bp, Homo sapiens
ctgcaaagctttggct

SEQ ID NO: 1073801 - DNA, 13 bp, Homo sapiens
ctgcaaaggactg

SEQ ID NO: 1073802 - DNA, 21 bp, Homo sapiens
ctgcaccgccgcagaagcagc

SEQ ID NO: 1073803 - DNA, 14 bp, Homo sapiens
ctgcacctcccccc

SEQ ID NO: 1073804 - DNA, 14 bp, Homo sapiens
ctgcacctccgctt

SEQ ID NO: 1073805 - DNA, 18 bp, Homo sapiens
ctgcacctgcctgccgct

SEQ ID NO: 1073806 - DNA, 17 bp, Homo sapiens
ctgcacctgctgcgtcc

SEQ ID NO: 1073807 - DNA, 13 bp, Homo sapiens
ctgcacctggcct

SEQ ID NO: 1073808 - DNA, 16 bp, Homo sapiens
ctgcacctggcctggg

SEQ ID NO: 1073809 - DNA, 13 bp, Homo sapiens
ctgcacctgggca

SEQ ID NO: 1073810 - DNA, 16 bp, Homo sapiens
ctgcacctgggcagct

SEQ ID NO: 1073811 - DNA, 18 bp, Homo sapiens
ctgcacctgggcagctcc

SEQ ID NO: 1073812 - DNA, 13 bp, Homo sapiens
ctgcacctgtgca

SEQ ID NO: 1073813 - DNA, 17 bp, Homo sapiens
ctgcacgctcccctcca

SEQ ID NO: 1073814 - DNA, 14 bp, Homo sapiens
ctgcacgggatgcg

SEQ ID NO: 1073815 - DNA, 22 bp, Homo sapiens
ctgcacgggatgcgtgggaggc

SEQ ID NO: 1073816 - DNA, 18 bp, Homo sapiens
ctgcacgtaggttcccca

SEQ ID NO: 1073817 - DNA, 22 bp, Homo sapiens
ctgcacgtaggttccccagaga

SEQ ID NO: 1073818 - DNA, 21 bp, Homo sapiens
ctgcactaaaacccatcttcc

SEQ ID NO: 1073819 - DNA, 18 bp, Homo sapiens
ctgcactaaagccagcct

SEQ ID NO: 1073820 - DNA, 16 bp, Homo sapiens
ctgcactaatttgatg

SEQ ID NO: 1073821 - DNA, 20 bp, Homo sapiens
ctgcactccaatctgggtga

SEQ ID NO: 1073822 - DNA, 16 bp, Homo sapiens
ctgcactccagcctgg

SEQ ID NO: 1073823 - DNA, 14 bp, Homo sapiens
ctgcactccatggc

SEQ ID NO: 1073824 - DNA, 16 bp, Homo sapiens
ctgcactcccacctga

SEQ ID NO: 1073825 - DNA, 18 bp, Homo sapiens
ctgcactcccacctgaca

SEQ ID NO: 1073826 - DNA, 19 bp, Homo sapiens
ctgcactcccacctgacac

SEQ ID NO: 1073827 - DNA, 12 bp, Homo sapiens
ctgcactcccga

SEQ ID NO: 1073828 - DNA, 20 bp, Homo sapiens
ctgcactccctcctggagct

SEQ ID NO: 1073829 - DNA, 15 bp, Homo sapiens
ctgcactccctggcc

SEQ ID NO: 1073830 - DNA, 16 bp, Homo sapiens
ctgcactccctggcct

SEQ ID NO: 1073831 - DNA, 20 bp, Homo sapiens
ctgcactccggcctgatgac

SEQ ID NO: 1073832 - DNA, 18 bp, Homo sapiens
ctgcactcctttatctgt

SEQ ID NO: 1073833 - DNA, 17 bp, Homo sapiens
ctgcactctaaactgca

SEQ ID NO: 1073834 - DNA, 19 bp, Homo sapiens
ctgcactctaaactgcaaa

SEQ ID NO: 1073835 - DNA, 19 bp, Homo sapiens
ctgcactcttaagcttccg

SEQ ID NO: 1073836 - DNA, 16 bp, Homo sapiens
ctgcactggagccaca

SEQ ID NO: 1073837 - DNA, 20 bp, Homo sapiens
ctgcactggagccacaggca

SEQ ID NO: 1073838 - DNA, 19 bp, Homo sapiens
ctgcactgggaaggaaaca

SEQ ID NO: 1073839 - DNA, 11 bp, Homo sapiens
ctgcactgtga

SEQ ID NO: 1073840 - DNA, 12 bp, Homo sapiens
ctgcactgtgaa

SEQ ID NO: 1073841 - DNA, 23 bp, Homo sapiens
ctgcactgtgccccgcgggcttt

SEQ ID NO: 1073842 - DNA, 21 bp, Homo sapiens
ctgcactgtgtcatcttttca

SEQ ID NO: 1073843 - DNA, 16 bp, Homo sapiens
ctgcacttacttgctt

SEQ ID NO: 1073844 - DNA, 19 bp, Homo sapiens
ctgcacttatacccatgaa

SEQ ID NO: 1073845 - DNA, 13 bp, Homo sapiens
ctgcactttcccc

SEQ ID NO: 1073846 - DNA, 18 bp, Homo sapiens
ctgcactttgtttagaaa

SEQ ID NO: 1073847 - DNA, 20 bp, Homo sapiens
ctgcactttgtttagaaaaa

SEQ ID NO: 1073848 - DNA, 10 bp, Homo sapiens
ctgcactttt

SEQ ID NO: 1073849 - DNA, 11 bp, Homo sapiens
ctgcacttttt

SEQ ID NO: 1073850 - DNA, 16 bp, Homo sapiens
ctgcagaaactactga

SEQ ID NO: 1073851 - DNA, 21 bp, Homo sapiens
ctgcagaacagcatcatgtca

SEQ ID NO: 1073852 - DNA, 22 bp, Homo sapiens
ctgcagaacatcgatatgtata

SEQ ID NO: 1073853 - DNA, 12 bp, Homo sapiens
ctgcagaaccca

SEQ ID NO: 1073854 - DNA, 15 bp, Homo sapiens
ctgcagaacccacca

SEQ ID NO: 1073855 - DNA, 21 bp, Homo sapiens
ctgcagaacgtattggtccag

SEQ ID NO: 1073856 - DNA, 13 bp, Homo sapiens
ctgcagaagccag

SEQ ID NO: 1073857 - DNA, 15 bp, Homo sapiens
ctgcagaagccagaa

SEQ ID NO: 1073858 - DNA, 23 bp, Homo sapiens
ctgcagaagccagaaggtgcagg

SEQ ID NO: 1073859 - DNA, 14 bp, Homo sapiens
ctgcagaaggaaaa

SEQ ID NO: 1073860 - DNA, 21 bp, Homo sapiens
ctgcagaaggaaaaatgtgta

SEQ ID NO: 1073861 - DNA, 14 bp, Homo sapiens
ctgcagaaggccaa

SEQ ID NO: 1073862 - DNA, 15 bp, Homo sapiens
ctgcagaaggccaag

SEQ ID NO: 1073863 - DNA, 23 bp, Homo sapiens
ctgcagacaggctctgaggggca

SEQ ID NO: 1073864 - DNA, 14 bp, Homo sapiens
ctgcagacattctc

SEQ ID NO: 1073865 - DNA, 16 bp, Homo sapiens
ctgcagacattctcaa

SEQ ID NO: 1073866 - DNA, 15 bp, Homo sapiens
ctgcagaccatgcca

SEQ ID NO: 1073867 - DNA, 13 bp, Homo sapiens
ctgcagacctcaa

SEQ ID NO: 1073868 - DNA, 17 bp, Homo sapiens
ctgcagacctcaagcca

SEQ ID NO: 1073869 - DNA, 18 bp, Homo sapiens
ctgcagacgggaatgcct

SEQ ID NO: 1073870 - DNA, 21 bp, Homo sapiens
ctgcagacgggaatgcctagg

SEQ ID NO: 1073871 - DNA, 23 bp, Homo sapiens
ctgcagacgggaatgcctaggtc

SEQ ID NO: 1073872 - DNA, 21 bp, Homo sapiens
ctgcagagaaacttaagcaaa

SEQ ID NO: 1073873 - DNA, 23 bp, Homo sapiens
ctgcagagaaacttaagcaaagg

SEQ ID NO: 1073874 - DNA, 18 bp, Homo sapiens
ctgcagagcagcagcacc

SEQ ID NO: 1073875 - DNA, 22 bp, Homo sapiens
ctgcagagcagcagcacctttc

SEQ ID NO: 1073876 - DNA, 15 bp, Homo sapiens
ctgcagagcccggcc

SEQ ID NO: 1073877 - DNA, 15 bp, Homo sapiens
ctgcagagctatggt

SEQ ID NO: 1073878 - DNA, 21 bp, Homo sapiens
ctgcagagctatggtgaggtg

SEQ ID NO: 1073879 - DNA, 16 bp, Homo sapiens
ctgcagagctgaccca

SEQ ID NO: 1073880 - DNA, 21 bp, Homo sapiens
ctgcagaggaccacagtgggt

SEQ ID NO: 1073881 - DNA, 20 bp, Homo sapiens
ctgcagaggccagaggcccc

SEQ ID NO: 1073882 - DNA, 14 bp, Homo sapiens
ctgcagagggagac

SEQ ID NO: 1073883 - DNA, 15 bp, Homo sapiens
ctgcagagggagacg

SEQ ID NO: 1073884 - DNA, 17 bp, Homo sapiens
ctgcagaggtctgtgct

SEQ ID NO: 1073885 - DNA, 18 bp, Homo sapiens
ctgcagaggtctgtgctg

SEQ ID NO: 1073886 - DNA, 19 bp, Homo sapiens
ctgcagaggtctgtgctga

SEQ ID NO: 1073887 - DNA, 22 bp, Homo sapiens
ctgcagaggtctgtgctgaggc

SEQ ID NO: 1073888 - DNA, 19 bp, Homo sapiens
ctgcagatagcccaggagc

SEQ ID NO: 1073889 - DNA, 14 bp, Homo sapiens
ctgcagatgccacc

SEQ ID NO: 1073890 - DNA, 17 bp, Homo sapiens
ctgcagcaataaagcag

SEQ ID NO: 1073891 - DNA, 21 bp, Homo sapiens
ctgcagcacgcggccttgtct

SEQ ID NO: 1073892 - DNA, 22 bp, Homo sapiens
ctgcagcagagtgagcaagggg

SEQ ID NO: 1073893 - DNA, 15 bp, Homo sapiens
ctgcagcagccggaa

SEQ ID NO: 1073894 - DNA, 13 bp, Homo sapiens
ctgcagcaggagt

SEQ ID NO: 1073895 - DNA, 21 bp, Homo sapiens
ctgcagcagggcaggaagggg

SEQ ID NO: 1073896 - DNA, 23 bp, Homo sapiens
ctgcagcagggcaggaaggggaa

SEQ ID NO: 1073897 - DNA, 20 bp, Homo sapiens
ctgcagcaggtgctgggctg

SEQ ID NO: 1073898 - DNA, 23 bp, Homo sapiens
ctgcagcaggtgctgggctggac

SEQ ID NO: 1073899 - DNA, 11 bp, Homo sapiens
ctgcagcatga

SEQ ID NO: 1073900 - DNA, 18 bp, Homo sapiens
ctgcagcatgttgctgag

SEQ ID NO: 1073901 - DNA, 20 bp, Homo sapiens
ctgcagcatgttgctgagga

SEQ ID NO: 1073902 - DNA, 22 bp, Homo sapiens
ctgcagccaccagacttggcct

SEQ ID NO: 1073903 - DNA, 18 bp, Homo sapiens
ctgcagccagcccagccc

SEQ ID NO: 1073904 - DNA, 14 bp, Homo sapiens
ctgcagccagctca

SEQ ID NO: 1073905 - DNA, 20 bp, Homo sapiens
ctgcagcccaaaacccaggg

SEQ ID NO: 1073906 - DNA, 11 bp, Homo sapiens
ctgcagcccag

SEQ ID NO: 1073907 - DNA, 18 bp, Homo sapiens
ctgcagccccagaagaaa

SEQ ID NO: 1073908 - DNA, 15 bp, Homo sapiens
ctgcagccccccaga

SEQ ID NO: 1073909 - DNA, 18 bp, Homo sapiens
ctgcagcccttgggcagt

SEQ ID NO: 1073910 - DNA, 21 bp, Homo sapiens
ctgcagcctcaacctcctggg

SEQ ID NO: 1073911 - DNA, 18 bp, Homo sapiens
ctgcagcctcctcctgac

SEQ ID NO: 1073912 - DNA, 20 bp, Homo sapiens
ctgcagcctcctcctgacca

SEQ ID NO: 1073913 - DNA, 12 bp, Homo sapiens
ctgcagcctgct

SEQ ID NO: 1073914 - DNA, 15 bp, Homo sapiens
ctgcagcctgctggg

SEQ ID NO: 1073915 - DNA, 22 bp, Homo sapiens
ctgcagcctgctggggctaagc

SEQ ID NO: 1073916 - DNA, 13 bp, Homo sapiens
ctgcagcctgggc

SEQ ID NO: 1073917 - DNA, 20 bp, Homo sapiens
ctgcagcctgggtctggatg

SEQ ID NO: 1073918 - DNA, 14 bp, Homo sapiens
ctgcagccttttct

SEQ ID NO: 1073919 - DNA, 15 bp, Homo sapiens
ctgcagcgcctccct

SEQ ID NO: 1073920 - DNA, 14 bp, Homo sapiens
ctgcagcgcgctcc

SEQ ID NO: 1073921 - DNA, 20 bp, Homo sapiens
ctgcagctatgcgcaatgtg

SEQ ID NO: 1073922 - DNA, 21 bp, Homo sapiens
ctgcagctatgcgcaatgtgg

SEQ ID NO: 1073923 - DNA, 10 bp, Homo sapiens
ctgcagctgc

SEQ ID NO: 1073924 - DNA, 22 bp, Homo sapiens
ctgcagctgccgggcctgattt

SEQ ID NO: 1073925 - DNA, 13 bp, Homo sapiens
ctgcagctggaca

SEQ ID NO: 1073926 - DNA, 15 bp, Homo sapiens
ctgcagctggacaga

SEQ ID NO: 1073927 - DNA, 19 bp, Homo sapiens
ctgcagctgggccccatgc

SEQ ID NO: 1073928 - DNA, 21 bp, Homo sapiens
ctgcagctgggccccatgctc

SEQ ID NO: 1073929 - DNA, 23 bp, Homo sapiens
ctgcagctgggccccatgctctg

SEQ ID NO: 1073930 - DNA, 12 bp, Homo sapiens
ctgcagctgtga

SEQ ID NO: 1073931 - DNA, 13 bp, Homo sapiens
ctgcagctgtgag

SEQ ID NO: 1073932 - DNA, 22 bp, Homo sapiens
ctgcaggaaacatttctgacac

SEQ ID NO: 1073933 - DNA, 12 bp, Homo sapiens
ctgcaggaccct

SEQ ID NO: 1073934 - DNA, 21 bp, Homo sapiens
ctgcaggaccctgtcctgcag

SEQ ID NO: 1073935 - DNA, 16 bp, Homo sapiens
ctgcaggagcagggcg

SEQ ID NO: 1073936 - DNA, 20 bp, Homo sapiens
ctgcaggagtgtcctgccca

SEQ ID NO: 1073937 - DNA, 19 bp, Homo sapiens
ctgcaggcaacactttagc

SEQ ID NO: 1073938 - DNA, 22 bp, Homo sapiens
ctgcaggcaccgggctggctgc

SEQ ID NO: 1073939 - DNA, 14 bp, Homo sapiens
ctgcaggcagacac

SEQ ID NO: 1073940 - DNA, 14 bp, Homo sapiens
ctgcaggcaggaac

SEQ ID NO: 1073941 - DNA, 15 bp, Homo sapiens
ctgcaggcaggaaca

SEQ ID NO: 1073942 - DNA, 19 bp, Homo sapiens
ctgcaggcaggcggctcct

SEQ ID NO: 1073943 - DNA, 22 bp, Homo sapiens
ctgcaggcaggcggctcctcct

SEQ ID NO: 1073944 - DNA, 23 bp, Homo sapiens
ctgcaggccaagagcagaggcag

SEQ ID NO: 1073945 - DNA, 22 bp, Homo sapiens
ctgcaggccccgcttgtccagc

SEQ ID NO: 1073946 - DNA, 13 bp, Homo sapiens
ctgcaggccctgg

SEQ ID NO: 1073947 - DNA, 19 bp, Homo sapiens
ctgcaggccctggcctccc

SEQ ID NO: 1073948 - DNA, 13 bp, Homo sapiens
ctgcaggctgcag

SEQ ID NO: 1073949 - DNA, 20 bp, Homo sapiens
ctgcaggctgcaggagggca

SEQ ID NO: 1073950 - DNA, 12 bp, Homo sapiens
ctgcaggctggg

SEQ ID NO: 1073951 - DNA, 14 bp, Homo sapiens
ctgcaggctgggga

SEQ ID NO: 1073952 - DNA, 17 bp, Homo sapiens
ctgcaggctggggaggt

SEQ ID NO: 1073953 - DNA, 20 bp, Homo sapiens
ctgcaggctggggaggtgct

SEQ ID NO: 1073954 - DNA, 21 bp, Homo sapiens
ctgcaggctggggaggtgctg

SEQ ID NO: 1073955 - DNA, 15 bp, Homo sapiens
ctgcagggagcaact

SEQ ID NO: 1073956 - DNA, 23 bp, Homo sapiens
ctgcagggagcaactctccactc

SEQ ID NO: 1073957 - DNA, 17 bp, Homo sapiens
ctgcagggcacggggac

SEQ ID NO: 1073958 - DNA, 19 bp, Homo sapiens
ctgcagggcacggggacct

SEQ ID NO: 1073959 - DNA, 21 bp, Homo sapiens
ctgcagggcacggggacctgg

SEQ ID NO: 1073960 - DNA, 14 bp, Homo sapiens
ctgcagggctccca

SEQ ID NO: 1073961 - DNA, 12 bp, Homo sapiens
ctgcaggggagc

SEQ ID NO: 1073962 - DNA, 12 bp, Homo sapiens
ctgcaggggcct

SEQ ID NO: 1073963 - DNA, 17 bp, Homo sapiens
ctgcaggggcctggagg

SEQ ID NO: 1073964 - DNA, 12 bp, Homo sapiens
ctgcaggggcta

SEQ ID NO: 1073965 - DNA, 14 bp, Homo sapiens
ctgcagggggagga

SEQ ID NO: 1073966 - DNA, 21 bp, Homo sapiens
ctgcagggggaggaggacttg

SEQ ID NO: 1073967 - DNA, 17 bp, Homo sapiens
ctgcagggggtgtgtct

SEQ ID NO: 1073968 - DNA, 16 bp, Homo sapiens
ctgcagggtgacgcct

SEQ ID NO: 1073969 - DNA, 17 bp, Homo sapiens
ctgcagggtgacgcctg

SEQ ID NO: 1073970 - DNA, 21 bp, Homo sapiens
ctgcagggtgacgcctgagac

SEQ ID NO: 1073971 - DNA, 20 bp, Homo sapiens
ctgcagggtggtgctgggac

SEQ ID NO: 1073972 - DNA, 23 bp, Homo sapiens
ctgcagggtggtgctgggactga

SEQ ID NO: 1073973 - DNA, 15 bp, Homo sapiens
ctgcaggtacttcct

SEQ ID NO: 1073974 - DNA, 15 bp, Homo sapiens
ctgcaggtcagttgt

SEQ ID NO: 1073975 - DNA, 17 bp, Homo sapiens
ctgcaggtcagttgtaa

SEQ ID NO: 1073976 - DNA, 19 bp, Homo sapiens
ctgcaggtcagttgtaata

SEQ ID NO: 1073977 - DNA, 13 bp, Homo sapiens
ctgcaggtgggct

SEQ ID NO: 1073978 - DNA, 19 bp, Homo sapiens
ctgcaggtgggctgggccc

SEQ ID NO: 1073979 - DNA, 22 bp, Homo sapiens
ctgcaggtgggctgggcccacc

SEQ ID NO: 1073980 - DNA, 19 bp, Homo sapiens
ctgcaggttgaagccatgt

SEQ ID NO: 1073981 - DNA, 15 bp, Homo sapiens
ctgcagtaaaacaca

SEQ ID NO: 1073982 - DNA, 16 bp, Homo sapiens
ctgcagtaaaacacat

SEQ ID NO: 1073983 - DNA, 17 bp, Homo sapiens
ctgcagtaaaacacatt

SEQ ID NO: 1073984 - DNA, 14 bp, Homo sapiens
ctgcagtaaatctt

SEQ ID NO: 1073985 - DNA, 17 bp, Homo sapiens
ctgcagtaaatctttta

SEQ ID NO: 1073986 - DNA, 21 bp, Homo sapiens
ctgcagtacatacgtctgcca

SEQ ID NO: 1073987 - DNA, 15 bp, Homo sapiens
ctgcagtagtctctg

SEQ ID NO: 1073988 - DNA, 16 bp, Homo sapiens
ctgcagtagtctctgt

SEQ ID NO: 1073989 - DNA, 20 bp, Homo sapiens
ctgcagtagtctctgtgctt

SEQ ID NO: 1073990 - DNA, 22 bp, Homo sapiens
ctgcagtcctactcaagcgggt

SEQ ID NO: 1073991 - DNA, 23 bp, Homo sapiens
ctgcagtcctactcaagcgggtg

SEQ ID NO: 1073992 - DNA, 17 bp, Homo sapiens
ctgcagtcttatttcca

SEQ ID NO: 1073993 - DNA, 16 bp, Homo sapiens
ctgcagtgaggctgtg

SEQ ID NO: 1073994 - DNA, 15 bp, Homo sapiens
ctgcagtgaggggcc

SEQ ID NO: 1073995 - DNA, 20 bp, Homo sapiens
ctgcagtgaggggccctcca

SEQ ID NO: 1073996 - DNA, 17 bp, Homo sapiens
ctgcagtggagaagaca

SEQ ID NO: 1073997 - DNA, 14 bp, Homo sapiens
ctgcagtggtgtga

SEQ ID NO: 1073998 - DNA, 16 bp, Homo sapiens
ctgcagtgtggagttc

SEQ ID NO: 1073999 - DNA, 15 bp, Homo sapiens
ctgcagttaccacag

SEQ ID NO: 1074000 - DNA, 22 bp, Homo sapiens
ctgcagttaccacagcaactga

SEQ ID NO: 1074001 - DNA, 19 bp, Homo sapiens
ctgcagtttgagacaggag

SEQ ID NO: 1074002 - DNA, 21 bp, Homo sapiens
ctgcagtttgagacaggagac

SEQ ID NO: 1074003 - DNA, 20 bp, Homo sapiens
ctgcagtttggccctggagc

SEQ ID NO: 1074004 - DNA, 19 bp, Homo sapiens
ctgcagtttgggagacatg

SEQ ID NO: 1074005 - DNA, 20 bp, Homo sapiens
ctgcagtttgggagacatgg

SEQ ID NO: 1074006 - DNA, 21 bp, Homo sapiens
ctgcagttttgctatctgggc

SEQ ID NO: 1074007 - DNA, 15 bp, Homo sapiens
ctgcagtttttccca

SEQ ID NO: 1074008 - DNA, 22 bp, Homo sapiens
ctgcataatgtttctggatttc

SEQ ID NO: 1074009 - DNA, 13 bp, Homo sapiens
ctgccctctgctg

SEQ ID NO: 1074010 - DNA, 19 bp, Homo sapiens
ctgccctctgctgctgccc

SEQ ID NO: 1074011 - DNA, 11 bp, Homo sapiens
ctgccctgaga

SEQ ID NO: 1074012 - DNA, 15 bp, Homo sapiens
ctgccctgaggggct

SEQ ID NO: 1074013 - DNA, 23 bp, Homo sapiens
ctgccctgaggggctggggaggg

SEQ ID NO: 1074014 - DNA, 20 bp, Homo sapiens
ctgccctgcacgtcatggga

SEQ ID NO: 1074015 - DNA, 12 bp, Homo sapiens
ctgccctgcagc

SEQ ID NO: 1074016 - DNA, 12 bp, Homo sapiens
ctgccctgcatg

SEQ ID NO: 1074017 - DNA, 13 bp, Homo sapiens
ctgccctgccact

SEQ ID NO: 1074018 - DNA, 13 bp, Homo sapiens
ctgccctgcccaa

SEQ ID NO: 1074019 - DNA, 14 bp, Homo sapiens
ctgccctgccctca

SEQ ID NO: 1074020 - DNA, 13 bp, Homo sapiens
ctgccctgcctcc

SEQ ID NO: 1074021 - DNA, 13 bp, Homo sapiens
ctgccctgcctgc

SEQ ID NO: 1074022 - DNA, 12 bp, Homo sapiens
ctgccctgcctt

SEQ ID NO: 1074023 - DNA, 14 bp, Homo sapiens
ctgccctgccttgc

SEQ ID NO: 1074024 - DNA, 15 bp, Homo sapiens
ctgccctgccttgcc

SEQ ID NO: 1074025 - DNA, 12 bp, Homo sapiens
ctgccctgctcc

SEQ ID NO: 1074026 - DNA, 13 bp, Homo sapiens
ctgccctgctcct

SEQ ID NO: 1074027 - DNA, 14 bp, Homo sapiens
ctgccctgctccta

SEQ ID NO: 1074028 - DNA, 12 bp, Homo sapiens
ctgccctgctgc

SEQ ID NO: 1074029 - DNA, 19 bp, Homo sapiens
ctgccctgctgccacagca

SEQ ID NO: 1074030 - DNA, 17 bp, Homo sapiens
ctgccctggcagggtca

SEQ ID NO: 1074031 - DNA, 13 bp, Homo sapiens
ctgccctggccct

SEQ ID NO: 1074032 - DNA, 16 bp, Homo sapiens
ctgccctggccctgag

SEQ ID NO: 1074033 - DNA, 14 bp, Homo sapiens
ctgccctggctgct

SEQ ID NO: 1074034 - DNA, 21 bp, Homo sapiens
ctgccctggctgctgccccca

SEQ ID NO: 1074035 - DNA, 19 bp, Homo sapiens
ctgccctggtgctgccaca

SEQ ID NO: 1074036 - DNA, 21 bp, Homo sapiens
ctgccctggtgctgccacact

SEQ ID NO: 1074037 - DNA, 17 bp, Homo sapiens
ctgccctgtccaaaagc

SEQ ID NO: 1074038 - DNA, 14 bp, Homo sapiens
ctgccctgtccctg

SEQ ID NO: 1074039 - DNA, 21 bp, Homo sapiens
ctgccctgttgtgtatagatg

SEQ ID NO: 1074040 - DNA, 12 bp, Homo sapiens
ctgcccttccag

SEQ ID NO: 1074041 - DNA, 14 bp, Homo sapiens
ctgcccttccctct

SEQ ID NO: 1074042 - DNA, 18 bp, Homo sapiens
ctgcccttccctctgggc

SEQ ID NO: 1074043 - DNA, 15 bp, Homo sapiens
ctgcccttcctcagt

SEQ ID NO: 1074044 - DNA, 20 bp, Homo sapiens
ctgcccttcctcctgatgga

SEQ ID NO: 1074045 - DNA, 22 bp, Homo sapiens
ctgcccttcctcctgatggagt

SEQ ID NO: 1074046 - DNA, 10 bp, Homo sapiens
ctgcccttga

SEQ ID NO: 1074047 - DNA, 17 bp, Homo sapiens
ctgcccttgctgcccgc

SEQ ID NO: 1074048 - DNA, 15 bp, Homo sapiens
ctgcccttggcacca

SEQ ID NO: 1074049 - DNA, 21 bp, Homo sapiens
ctgcccttggcaccaccaggg

SEQ ID NO: 1074050 - DNA, 15 bp, Homo sapiens
ctgccctttcctagg

SEQ ID NO: 1074051 - DNA, 13 bp, Homo sapiens
ctgccctttggcc

SEQ ID NO: 1074052 - DNA, 14 bp, Homo sapiens
ctgccctttggcca

SEQ ID NO: 1074053 - DNA, 23 bp, Homo sapiens
ctgccctttggccaacagggtag

SEQ ID NO: 1074054 - DNA, 19 bp, Homo sapiens
ctgcccttttcaggaagct

SEQ ID NO: 1074055 - DNA, 13 bp, Homo sapiens
ctgccgaccagag

SEQ ID NO: 1074056 - DNA, 22 bp, Homo sapiens
ctgccgaccgaggctggagctg

SEQ ID NO: 1074057 - DNA, 13 bp, Homo sapiens
ctgccgactcccc

SEQ ID NO: 1074058 - DNA, 23 bp, Homo sapiens
ctgccgacttggagactcctggt

SEQ ID NO: 1074059 - DNA, 21 bp, Homo sapiens
ctgccgagacagaccctctgc

SEQ ID NO: 1074060 - DNA, 12 bp, Homo sapiens
ctgccgagccac

SEQ ID NO: 1074061 - DNA, 20 bp, Homo sapiens
ctgccgagccaccatgcttg

SEQ ID NO: 1074062 - DNA, 16 bp, Homo sapiens
ctgccgcaccccagag

SEQ ID NO: 1074063 - DNA, 17 bp, Homo sapiens
ctgccgcaccccagagt

SEQ ID NO: 1074064 - DNA, 16 bp, Homo sapiens
ctgccgcccacctcgc

SEQ ID NO: 1074065 - DNA, 17 bp, Homo sapiens
ctgccgcccacctcgct

SEQ ID NO: 1074066 - DNA, 20 bp, Homo sapiens
ctgccgcccacctcgctccc

SEQ ID NO: 1074067 - DNA, 18 bp, Homo sapiens
ctgccgccccctcctgaa

SEQ ID NO: 1074068 - DNA, 16 bp, Homo sapiens
ctgccgcctcccagcc

SEQ ID NO: 1074069 - DNA, 13 bp, Homo sapiens
ctgccgctacctc

SEQ ID NO: 1074070 - DNA, 17 bp, Homo sapiens
ctgccgctacctccctc

SEQ ID NO: 1074071 - DNA, 16 bp, Homo sapiens
ctgccgctgcaccacg

SEQ ID NO: 1074072 - DNA, 18 bp, Homo sapiens
ctgccgctgccgctgcac

SEQ ID NO: 1074073 - DNA, 19 bp, Homo sapiens
ctgccgctgccgctgcacc

SEQ ID NO: 1074074 - DNA, 20 bp, Homo sapiens
ctgccgctgccgctgcacca

SEQ ID NO: 1074075 - DNA, 22 bp, Homo sapiens
ctgccgctgcttccaggctggg

SEQ ID NO: 1074076 - DNA, 15 bp, Homo sapiens
ctgccggacacagca

SEQ ID NO: 1074077 - DNA, 21 bp, Homo sapiens
ctgccggcaggatgcagcgcc

SEQ ID NO: 1074078 - DNA, 22 bp, Homo sapiens
ctgccggctctttccttgctca

SEQ ID NO: 1074079 - DNA, 15 bp, Homo sapiens
ctgccgggctgaggg

SEQ ID NO: 1074080 - DNA, 18 bp, Homo sapiens
ctgccgggctgagggcct

SEQ ID NO: 1074081 - DNA, 22 bp, Homo sapiens
ctgccgggctgagggcctgctg

SEQ ID NO: 1074082 - DNA, 19 bp, Homo sapiens
ctgccgggttctagtctcc

SEQ ID NO: 1074083 - DNA, 23 bp, Homo sapiens
ctgccgggttctagtctcctttg

SEQ ID NO: 1074084 - DNA, 18 bp, Homo sapiens
ctgccggtcacccaggct

SEQ ID NO: 1074085 - DNA, 21 bp, Homo sapiens
ctgccggtcatttgaatgaga

SEQ ID NO: 1074086 - DNA, 20 bp, Homo sapiens
ctgccggtttgaaaatatgc

SEQ ID NO: 1074087 - DNA, 15 bp, Homo sapiens
ctgccgtaatttaac

SEQ ID NO: 1074088 - DNA, 19 bp, Homo sapiens
ctgccgtcaccaccacccc

SEQ ID NO: 1074089 - DNA, 17 bp, Homo sapiens
ctgccgtctctcctgct

SEQ ID NO: 1074090 - DNA, 14 bp, Homo sapiens
ctgccgtctctgga

SEQ ID NO: 1074091 - DNA, 15 bp, Homo sapiens
ctgccgtctctggag

SEQ ID NO: 1074092 - DNA, 14 bp, Homo sapiens
ctgccgtgcatggc

SEQ ID NO: 1074093 - DNA, 19 bp, Homo sapiens
ctgccgtgcatggctcctg

SEQ ID NO: 1074094 - DNA, 15 bp, Homo sapiens
ctgcctaagtggctg

SEQ ID NO: 1074095 - DNA, 20 bp, Homo sapiens
ctgcctaagtggctgctgac

SEQ ID NO: 1074096 - DNA, 16 bp, Homo sapiens
ctgcctacagccaggt

SEQ ID NO: 1074097 - DNA, 18 bp, Homo sapiens
ctgcctacgttctcttta

SEQ ID NO: 1074098 - DNA, 12 bp, Homo sapiens
ctgcctagaaaa

SEQ ID NO: 1074099 - DNA, 14 bp, Homo sapiens
ctgcctagagtgta

SEQ ID NO: 1074100 - DNA, 20 bp, Homo sapiens
ctgcctagatccacgtgtgg

SEQ ID NO: 1074101 - DNA, 22 bp, Homo sapiens
ctgcctagcatggggtcagccc

SEQ ID NO: 1074102 - DNA, 19 bp, Homo sapiens
ctgcctaggaattcccagc

SEQ ID NO: 1074103 - DNA, 17 bp, Homo sapiens
ctgcctagtgggagtta

SEQ ID NO: 1074104 - DNA, 17 bp, Homo sapiens
ctgcctattatctgtca

SEQ ID NO: 1074105 - DNA, 21 bp, Homo sapiens
ctgcctcaatgtgaatcagac

SEQ ID NO: 1074106 - DNA, 16 bp, Homo sapiens
ctgcctcacccacacc

SEQ ID NO: 1074107 - DNA, 13 bp, Homo sapiens
ctgcctcagccag

SEQ ID NO: 1074108 - DNA, 18 bp, Homo sapiens
ctgcctcagccaggccct

SEQ ID NO: 1074109 - DNA, 21 bp, Homo sapiens
ctgcctcagccagtggcacag

SEQ ID NO: 1074110 - DNA, 22 bp, Homo sapiens
ctgcctcagccagtggcacagg

SEQ ID NO: 1074111 - DNA, 23 bp, Homo sapiens
ctgcctcagccagtggcacagga

SEQ ID NO: 1074112 - DNA, 14 bp, Homo sapiens
ctgcctcagcccgc

SEQ ID NO: 1074113 - DNA, 22 bp, Homo sapiens
ctgcctcagccttctgagtagc

SEQ ID NO: 1074114 - DNA, 10 bp, Homo sapiens
ctgcctcagg

SEQ ID NO: 1074115 - DNA, 12 bp, Homo sapiens
ctgcctcaggac

SEQ ID NO: 1074116 - DNA, 18 bp, Homo sapiens
ctgcctcaggcactctcc

SEQ ID NO: 1074117 - DNA, 21 bp, Homo sapiens
ctgcctcaggcactctcctgt

SEQ ID NO: 1074118 - DNA, 12 bp, Homo sapiens
ctgcctccaccc

SEQ ID NO: 1074119 - DNA, 21 bp, Homo sapiens
ctgcctccacccgtcctccct

SEQ ID NO: 1074120 - DNA, 13 bp, Homo sapiens
ctgcctccaggaa

SEQ ID NO: 1074121 - DNA, 18 bp, Homo sapiens
ctgcctccattctgacca

SEQ ID NO: 1074122 - DNA, 15 bp, Homo sapiens
ctgcctcccacttca

SEQ ID NO: 1074123 - DNA, 16 bp, Homo sapiens
ctgcctcccatgcctg

SEQ ID NO: 1074124 - DNA, 16 bp, Homo sapiens
ctgcctcccattctgc

SEQ ID NO: 1074125 - DNA, 18 bp, Homo sapiens
ctgcctccccaaccctgc

SEQ ID NO: 1074126 - DNA, 17 bp, Homo sapiens
ctgcctccctctcttcc

SEQ ID NO: 1074127 - DNA, 19 bp, Homo sapiens
ctgcctccctctcttccgg

SEQ ID NO: 1074128 - DNA, 23 bp, Homo sapiens
ctgcctccctctcttccgggagc

SEQ ID NO: 1074129 - DNA, 21 bp, Homo sapiens
ctgcctcccttgtggcagcaa

SEQ ID NO: 1074130 - DNA, 15 bp, Homo sapiens
ctgcctccctttctg

SEQ ID NO: 1074131 - DNA, 14 bp, Homo sapiens
ctgcctcctaggct

SEQ ID NO: 1074132 - DNA, 17 bp, Homo sapiens
ctgcctcctaggctgga

SEQ ID NO: 1074133 - DNA, 12 bp, Homo sapiens
ctgcctcctcag

SEQ ID NO: 1074134 - DNA, 15 bp, Homo sapiens
ctgcctcctccctcc

SEQ ID NO: 1074135 - DNA, 23 bp, Homo sapiens
ctgccttcagtaggaacaagctg

SEQ ID NO: 1074136 - DNA, 11 bp, Homo sapiens
ctgccttccag

SEQ ID NO: 1074137 - DNA, 14 bp, Homo sapiens
ctgccttcccccaa

SEQ ID NO: 1074138 - DNA, 16 bp, Homo sapiens
ctgccttccctagctt

SEQ ID NO: 1074139 - DNA, 12 bp, Homo sapiens
ctgccttcctca

SEQ ID NO: 1074140 - DNA, 14 bp, Homo sapiens
ctgccttcctctga

SEQ ID NO: 1074141 - DNA, 18 bp, Homo sapiens
ctgccttcctctgaggac

SEQ ID NO: 1074142 - DNA, 16 bp, Homo sapiens
ctgccttcgcaccttg

SEQ ID NO: 1074143 - DNA, 13 bp, Homo sapiens
ctgccttcgcttc

SEQ ID NO: 1074144 - DNA, 20 bp, Homo sapiens
ctgccttcgcttcttgcctc

SEQ ID NO: 1074145 - DNA, 13 bp, Homo sapiens
ctgccttcgttaa

SEQ ID NO: 1074146 - DNA, 17 bp, Homo sapiens
ctgccttctcctctctg

SEQ ID NO: 1074147 - DNA, 18 bp, Homo sapiens
ctgccttctcctctctgg

SEQ ID NO: 1074148 - DNA, 20 bp, Homo sapiens
ctgccttctcctctctgggc

SEQ ID NO: 1074149 - DNA, 22 bp, Homo sapiens
ctgccttctcctctctgggcct

SEQ ID NO: 1074150 - DNA, 20 bp, Homo sapiens
ctgccttgaagccactgaag

SEQ ID NO: 1074151 - DNA, 15 bp, Homo sapiens
ctgccttgccgctcc

SEQ ID NO: 1074152 - DNA, 12 bp, Homo sapiens
ctgccttgctcc

SEQ ID NO: 1074153 - DNA, 13 bp, Homo sapiens
ctgccttgctgtt

SEQ ID NO: 1074154 - DNA, 16 bp, Homo sapiens
ctgccttgctgttggt

SEQ ID NO: 1074155 - DNA, 21 bp, Homo sapiens
ctgccttgctgttggtcatgt

SEQ ID NO: 1074156 - DNA, 21 bp, Homo sapiens
ctgccttggacaccatcccct

SEQ ID NO: 1074157 - DNA, 19 bp, Homo sapiens
ctgccttggcctcccaaag

SEQ ID NO: 1074158 - DNA, 15 bp, Homo sapiens
ctgccttggctcaga

SEQ ID NO: 1074159 - DNA, 23 bp, Homo sapiens
ctgcctttagcctggaccaaagg

SEQ ID NO: 1074160 - DNA, 15 bp, Homo sapiens
ctgcctttcccccct

SEQ ID NO: 1074161 - DNA, 18 bp, Homo sapiens
ctgcctttcccccctcac

SEQ ID NO: 1074162 - DNA, 17 bp, Homo sapiens
ctgcctttctcccccga

SEQ ID NO: 1074163 - DNA, 23 bp, Homo sapiens
ctgcctttctcccccgacactgc

SEQ ID NO: 1074164 - DNA, 18 bp, Homo sapiens
ctgcctttgatcacagga

SEQ ID NO: 1074165 - DNA, 21 bp, Homo sapiens
ctgcctttgatcacaggagca

SEQ ID NO: 1074166 - DNA, 18 bp, Homo sapiens
ctgcctttgatgttacag

SEQ ID NO: 1074167 - DNA, 15 bp, Homo sapiens
ctgcctttgtatgtg

SEQ ID NO: 1074168 - DNA, 18 bp, Homo sapiens
ctgcctttgtatgtggaa

SEQ ID NO: 1074169 - DNA, 19 bp, Homo sapiens
ctgcctttgtggtgggcgc

SEQ ID NO: 1074170 - DNA, 20 bp, Homo sapiens
ctgcctttgtggtgggcgct

SEQ ID NO: 1074171 - DNA, 22 bp, Homo sapiens
ctgcctttgtggtgggcgctgg

SEQ ID NO: 1074172 - DNA, 23 bp, Homo sapiens
ctgcctttgtggtgggcgctggg

SEQ ID NO: 1074173 - DNA, 17 bp, Homo sapiens
ctgccttttctggagtt

SEQ ID NO: 1074174 - DNA, 18 bp, Homo sapiens
ctgccttttttcacagcc

SEQ ID NO: 1074175 - DNA, 22 bp, Homo sapiens
ctgcgaccttgcaacctcacct

SEQ ID NO: 1074176 - DNA, 14 bp, Homo sapiens
ctgcgactttctgc

SEQ ID NO: 1074177 - DNA, 17 bp, Homo sapiens
ctgcgactttctgcctg

SEQ ID NO: 1074178 - DNA, 23 bp, Homo sapiens
ctgcgagacgcacacagctgagc

SEQ ID NO: 1074179 - DNA, 17 bp, Homo sapiens
ctgcgatcttcagagca

SEQ ID NO: 1074180 - DNA, 12 bp, Homo sapiens
ctgcgcactgtg

SEQ ID NO: 1074181 - DNA, 12 bp, Homo sapiens
ctgcgcagggtg

SEQ ID NO: 1074182 - DNA, 13 bp, Homo sapiens
ctgcgccaggcag

SEQ ID NO: 1074183 - DNA, 18 bp, Homo sapiens
ctgcgccaggcagagctg

SEQ ID NO: 1074184 - DNA, 20 bp, Homo sapiens
ctgcgccagtcctgctacct

SEQ ID NO: 1074185 - DNA, 18 bp, Homo sapiens
ctgcgcccagagctggcc

SEQ ID NO: 1074186 - DNA, 21 bp, Homo sapiens
ctgcgcccagagctggcctcc

SEQ ID NO: 1074187 - DNA, 23 bp, Homo sapiens
ctgcgcccagtccttccacctcg

SEQ ID NO: 1074188 - DNA, 14 bp, Homo sapiens
ctgcgcccccagct

SEQ ID NO: 1074189 - DNA, 16 bp, Homo sapiens
ctgcgcccccagcttc

SEQ ID NO: 1074190 - DNA, 19 bp, Homo sapiens
ctgcgcccccagcttctct

SEQ ID NO: 1074191 - DNA, 22 bp, Homo sapiens
ctgcgcccttaactgcatccag

SEQ ID NO: 1074192 - DNA, 18 bp, Homo sapiens
ctgcgcccttaccttccc

SEQ ID NO: 1074193 - DNA, 22 bp, Homo sapiens
ctgcgcccttgaggggccccag

SEQ ID NO: 1074194 - DNA, 16 bp, Homo sapiens
ctgctcagcttctcct

SEQ ID NO: 1074195 - DNA, 18 bp, Homo sapiens
ctgctcagcttctcctgt

SEQ ID NO: 1074196 - DNA, 17 bp, Homo sapiens
ctgctcaggaaacgaga

SEQ ID NO: 1074197 - DNA, 20 bp, Homo sapiens
ctgctcaggtgctatgtccc

SEQ ID NO: 1074198 - DNA, 20 bp, Homo sapiens
ctgctcagtgcttgggctcc

SEQ ID NO: 1074199 - DNA, 12 bp, Homo sapiens
ctgctcatcatt

SEQ ID NO: 1074200 - DNA, 17 bp, Homo sapiens
ctgctcatcattctctg

SEQ ID NO: 1074201 - DNA, 18 bp, Homo sapiens
ctgctcatcattctctgt

SEQ ID NO: 1074202 - DNA, 15 bp, Homo sapiens
ctgctcatgggtggc

SEQ ID NO: 1074203 - DNA, 21 bp, Homo sapiens
ctgctcattacagttctttcc

SEQ ID NO: 1074204 - DNA, 23 bp, Homo sapiens
ctgctcattactacactggtgtg

SEQ ID NO: 1074205 - DNA, 22 bp, Homo sapiens
ctgctcattttgacaaagtgcc

SEQ ID NO: 1074206 - DNA, 15 bp, Homo sapiens
ctgctccaccagcag

SEQ ID NO: 1074207 - DNA, 12 bp, Homo sapiens
ctgctccaccct

SEQ ID NO: 1074208 - DNA, 15 bp, Homo sapiens
ctgctccacccttgg

SEQ ID NO: 1074209 - DNA, 21 bp, Homo sapiens
ctgctccacgaagccttaagc

SEQ ID NO: 1074210 - DNA, 13 bp, Homo sapiens
ctgctccagaaga

SEQ ID NO: 1074211 - DNA, 20 bp, Homo sapiens
ctgctccagaagatgccagc

SEQ ID NO: 1074212 - DNA, 20 bp, Homo sapiens
ctgctccagaatttggaaat

SEQ ID NO: 1074213 - DNA, 21 bp, Homo sapiens
ctgctccagaatttggaaatc

SEQ ID NO: 1074214 - DNA, 16 bp, Homo sapiens
ctgctccagactcact

SEQ ID NO: 1074215 - DNA, 23 bp, Homo sapiens
ctgctccagcaactgcccttcca

SEQ ID NO: 1074216 - DNA, 23 bp, Homo sapiens
ctgctccagcccctttgcctctg

SEQ ID NO: 1074217 - DNA, 20 bp, Homo sapiens
ctgctccagctgttcagctg

SEQ ID NO: 1074218 - DNA, 12 bp, Homo sapiens
ctgctccaggcc

SEQ ID NO: 1074219 - DNA, 23 bp, Homo sapiens
ctgctccatttataaccccagcc

SEQ ID NO: 1074220 - DNA, 18 bp, Homo sapiens
ctgctcccacacttgtgc

SEQ ID NO: 1074221 - DNA, 23 bp, Homo sapiens
ctgctcccacacttgtgccagcc

SEQ ID NO: 1074222 - DNA, 23 bp, Homo sapiens
ctgctcccagatgccttctagat

SEQ ID NO: 1074223 - DNA, 17 bp, Homo sapiens
ctgctcccagcagccct

SEQ ID NO: 1074224 - DNA, 14 bp, Homo sapiens
ctgctcccattcct

SEQ ID NO: 1074225 - DNA, 15 bp, Homo sapiens
ctgctccccacccct

SEQ ID NO: 1074226 - DNA, 16 bp, Homo sapiens
ctgctccccagccctg

SEQ ID NO: 1074227 - DNA, 20 bp, Homo sapiens
ctgctccccagccctggctc

SEQ ID NO: 1074228 - DNA, 23 bp, Homo sapiens
ctgctcccctgagaccaccccca

SEQ ID NO: 1074229 - DNA, 13 bp, Homo sapiens
ctgctcccctgga

SEQ ID NO: 1074230 - DNA, 16 bp, Homo sapiens
ctgctcccctttgggg

SEQ ID NO: 1074231 - DNA, 13 bp, Homo sapiens
ctgctccctaagc

SEQ ID NO: 1074232 - DNA, 20 bp, Homo sapiens
ctgctccctgtggcactcag

SEQ ID NO: 1074233 - DNA, 15 bp, Homo sapiens
ctgctccgccaggaa

SEQ ID NO: 1074234 - DNA, 16 bp, Homo sapiens
ctgctccgctgctcct

SEQ ID NO: 1074235 - DNA, 21 bp, Homo sapiens
ctgctccgctgctccttggct

SEQ ID NO: 1074236 - DNA, 13 bp, Homo sapiens
ctgctcctcactg

SEQ ID NO: 1074237 - DNA, 18 bp, Homo sapiens
ctgctcctcactggagga

SEQ ID NO: 1074238 - DNA, 13 bp, Homo sapiens
ctgctcctccagc

SEQ ID NO: 1074239 - DNA, 16 bp, Homo sapiens
ctgctcctccagccct

SEQ ID NO: 1074240 - DNA, 16 bp, Homo sapiens
ctgctcctccagggcc

SEQ ID NO: 1074241 - DNA, 11 bp, Homo sapiens
ctgctcctccc

SEQ ID NO: 1074242 - DNA, 13 bp, Homo sapiens
ctgctcctccctg

SEQ ID NO: 1074243 - DNA, 16 bp, Homo sapiens
ctgctcctccctgccc

SEQ ID NO: 1074244 - DNA, 17 bp, Homo sapiens
ctgctcctccctggctg

SEQ ID NO: 1074245 - DNA, 19 bp, Homo sapiens
ctgctcctccctggctgcc

SEQ ID NO: 1074246 - DNA, 20 bp, Homo sapiens
ctgctcctccctggctgccc

SEQ ID NO: 1074247 - DNA, 21 bp, Homo sapiens
ctgctcctccctggctgccct

SEQ ID NO: 1074248 - DNA, 22 bp, Homo sapiens
ctgctcctccctggctgccctg

SEQ ID NO: 1074249 - DNA, 23 bp, Homo sapiens
ctgctcctccctggctgccctgg

SEQ ID NO: 1074250 - DNA, 15 bp, Homo sapiens
ctgctcctgcttttc

SEQ ID NO: 1074251 - DNA, 18 bp, Homo sapiens
ctgctcctgcttttctgt

SEQ ID NO: 1074252 - DNA, 15 bp, Homo sapiens
ctgctcctgtacttg

SEQ ID NO: 1074253 - DNA, 19 bp, Homo sapiens
ctgctccttcactgttccc

SEQ ID NO: 1074254 - DNA, 12 bp, Homo sapiens
ctgctccttgct

SEQ ID NO: 1074255 - DNA, 16 bp, Homo sapiens
ctgctccttggcaccc

SEQ ID NO: 1074256 - DNA, 21 bp, Homo sapiens
ctgctccttggcacccccatg

SEQ ID NO: 1074257 - DNA, 22 bp, Homo sapiens
ctgctccttggcacccccatgc

SEQ ID NO: 1074258 - DNA, 23 bp, Homo sapiens
ctgctccttggcacccccatgct

SEQ ID NO: 1074259 - DNA, 13 bp, Homo sapiens
ctgctccttggct

SEQ ID NO: 1074260 - DNA, 20 bp, Homo sapiens
ctgctccttggcttacctga

SEQ ID NO: 1074261 - DNA, 16 bp, Homo sapiens
ctgctcctttaccctc

SEQ ID NO: 1074262 - DNA, 19 bp, Homo sapiens
ctgctcctttaccctcttg

SEQ ID NO: 1074263 - DNA, 19 bp, Homo sapiens
ctgctcgtggactgtgctg

SEQ ID NO: 1074264 - DNA, 21 bp, Homo sapiens
ctgctctacccatgagcctgc

SEQ ID NO: 1074265 - DNA, 22 bp, Homo sapiens
ctgctctacccatgagcctgcc

SEQ ID NO: 1074266 - DNA, 13 bp, Homo sapiens
ctgctctagccag

SEQ ID NO: 1074267 - DNA, 16 bp, Homo sapiens
ctgctctagccaggag

SEQ ID NO: 1074268 - DNA, 17 bp, Homo sapiens
ctgctctagccaggagt

SEQ ID NO: 1074269 - DNA, 17 bp, Homo sapiens
ctgctctagctggcagg

SEQ ID NO: 1074270 - DNA, 22 bp, Homo sapiens
ctgctctagggaatctggatta

SEQ ID NO: 1074271 - DNA, 17 bp, Homo sapiens
ctgctctagtgggacag

SEQ ID NO: 1074272 - DNA, 23 bp, Homo sapiens
ctgctctagtgggacagcccaga

SEQ ID NO: 1074273 - DNA, 19 bp, Homo sapiens
ctgctctcagcctcccaca

SEQ ID NO: 1074274 - DNA, 20 bp, Homo sapiens
ctgctctcctcttgccactg

SEQ ID NO: 1074275 - DNA, 15 bp, Homo sapiens
ctgctctctgctcat

SEQ ID NO: 1074276 - DNA, 15 bp, Homo sapiens
ctgctctcttcagga

SEQ ID NO: 1074277 - DNA, 12 bp, Homo sapiens
ctgctggctgcc

SEQ ID NO: 1074278 - DNA, 13 bp, Homo sapiens
ctgctggctgcct

SEQ ID NO: 1074279 - DNA, 14 bp, Homo sapiens
ctgctggctgcggc

SEQ ID NO: 1074280 - DNA, 11 bp, Homo sapiens
ctgctgggaac

SEQ ID NO: 1074281 - DNA, 16 bp, Homo sapiens
ctgctgggaagagctc

SEQ ID NO: 1074282 - DNA, 19 bp, Homo sapiens
ctgctgggactggccaggt

SEQ ID NO: 1074283 - DNA, 15 bp, Homo sapiens
ctgctgggagcagaa

SEQ ID NO: 1074284 - DNA, 19 bp, Homo sapiens
ctgctgggagcagaacagt

SEQ ID NO: 1074285 - DNA, 18 bp, Homo sapiens
ctgctgggaggttaaaaa

SEQ ID NO: 1074286 - DNA, 19 bp, Homo sapiens
ctgctgggcgtgtgtgaca

SEQ ID NO: 1074287 - DNA, 16 bp, Homo sapiens
ctgctgggctctccac

SEQ ID NO: 1074288 - DNA, 14 bp, Homo sapiens
ctgctgggctgagt

SEQ ID NO: 1074289 - DNA, 22 bp, Homo sapiens
ctgctgggctgagtgacacaag

SEQ ID NO: 1074290 - DNA, 21 bp, Homo sapiens
ctgctggggaagggttttctt

SEQ ID NO: 1074291 - DNA, 13 bp, Homo sapiens
ctgctggggatcc

SEQ ID NO: 1074292 - DNA, 22 bp, Homo sapiens
ctgctggggatccccgcctggc

SEQ ID NO: 1074293 - DNA, 19 bp, Homo sapiens
ctgctgggttttcctccgg

SEQ ID NO: 1074294 - DNA, 14 bp, Homo sapiens
ctgctggtatttct

SEQ ID NO: 1074295 - DNA, 15 bp, Homo sapiens
ctgctggtatttcta

SEQ ID NO: 1074296 - DNA, 16 bp, Homo sapiens
ctgctggtatttctaa

SEQ ID NO: 1074297 - DNA, 15 bp, Homo sapiens
ctgctgtaactgctg

SEQ ID NO: 1074298 - DNA, 16 bp, Homo sapiens
ctgctgtaactgctga

SEQ ID NO: 1074299 - DNA, 18 bp, Homo sapiens
ctgctgtaactgctgagc

SEQ ID NO: 1074300 - DNA, 22 bp, Homo sapiens
ctgctgtaactgctgagccact

SEQ ID NO: 1074301 - DNA, 23 bp, Homo sapiens
ctgctgtaactgctgagccactc

SEQ ID NO: 1074302 - DNA, 18 bp, Homo sapiens
ctgctgtcaataaatgac

SEQ ID NO: 1074303 - DNA, 11 bp, Homo sapiens
ctgctgtccct

SEQ ID NO: 1074304 - DNA, 20 bp, Homo sapiens
ctgctgtccctcccccttgt

SEQ ID NO: 1074305 - DNA, 18 bp, Homo sapiens
ctgctgtcgctctcagtt

SEQ ID NO: 1074306 - DNA, 15 bp, Homo sapiens
ctgctgtctctctgg

SEQ ID NO: 1074307 - DNA, 19 bp, Homo sapiens
ctgctgtctctctgggctg

SEQ ID NO: 1074308 - DNA, 15 bp, Homo sapiens
ctgctgtcttccaag

SEQ ID NO: 1074309 - DNA, 14 bp, Homo sapiens
ctgctgtcttctgg

SEQ ID NO: 1074310 - DNA, 12 bp, Homo sapiens
ctgctgtcttgt

SEQ ID NO: 1074311 - DNA, 15 bp, Homo sapiens
ctgctgtgaaccctg

SEQ ID NO: 1074312 - DNA, 17 bp, Homo sapiens
ctgctgtgaatctgaaa

SEQ ID NO: 1074313 - DNA, 17 bp, Homo sapiens
ctgctgtgagtgcgcct

SEQ ID NO: 1074314 - DNA, 19 bp, Homo sapiens
ctgctgtgatgccgtcctg

SEQ ID NO: 1074315 - DNA, 21 bp, Homo sapiens
ctgctgtgatgccgtcctgct

SEQ ID NO: 1074316 - DNA, 22 bp, Homo sapiens
ctgctgtgattccactacacct

SEQ ID NO: 1074317 - DNA, 15 bp, Homo sapiens
ctgctgtgcccagcc

SEQ ID NO: 1074318 - DNA, 13 bp, Homo sapiens
ctgctgtgcccca

SEQ ID NO: 1074319 - DNA, 19 bp, Homo sapiens
ctgctgtgccccaccacgt

SEQ ID NO: 1074320 - DNA, 17 bp, Homo sapiens
ctgctgtgctctgggga

SEQ ID NO: 1074321 - DNA, 14 bp, Homo sapiens
ctgctgtgctgctc

SEQ ID NO: 1074322 - DNA, 16 bp, Homo sapiens
ctgctgtgctgctcaa

SEQ ID NO: 1074323 - DNA, 14 bp, Homo sapiens
ctgctgtgctggga

SEQ ID NO: 1074324 - DNA, 13 bp, Homo sapiens
ctgctgtggcccc

SEQ ID NO: 1074325 - DNA, 15 bp, Homo sapiens
ctgctgtggccccct

SEQ ID NO: 1074326 - DNA, 12 bp, Homo sapiens
ctgctgtggggc

SEQ ID NO: 1074327 - DNA, 17 bp, Homo sapiens
ctgctgtgtccttcctc

SEQ ID NO: 1074328 - DNA, 20 bp, Homo sapiens
ctgctgtgtccttcctccac

SEQ ID NO: 1074329 - DNA, 19 bp, Homo sapiens
ctgctgttctcaggacagc

SEQ ID NO: 1074330 - DNA, 20 bp, Homo sapiens
ctgctgttgccatagcccca

SEQ ID NO: 1074331 - DNA, 13 bp, Homo sapiens
ctgctgttgcctc

SEQ ID NO: 1074332 - DNA, 21 bp, Homo sapiens
ctgctgtttgacacctctttt

SEQ ID NO: 1074333 - DNA, 14 bp, Homo sapiens
ctgcttaaacaaag

SEQ ID NO: 1074334 - DNA, 19 bp, Homo sapiens
ctgcttaaacttgacccag

SEQ ID NO: 1074335 - DNA, 21 bp, Homo sapiens
ctgcttaaagcttccctctca

SEQ ID NO: 1074336 - DNA, 15 bp, Homo sapiens
ctgcttaacttcaca

SEQ ID NO: 1074337 - DNA, 23 bp, Homo sapiens
ctgcttaccagataatgctactt

SEQ ID NO: 1074338 - DNA, 18 bp, Homo sapiens
ctgcttacccttcacctt

SEQ ID NO: 1074339 - DNA, 20 bp, Homo sapiens
ctgcttagctgccttgagct

SEQ ID NO: 1074340 - DNA, 19 bp, Homo sapiens
ctgcttagcttgcaccttg

SEQ ID NO: 1074341 - DNA, 15 bp, Homo sapiens
ctgcttaggagagac

SEQ ID NO: 1074342 - DNA, 20 bp, Homo sapiens
ctgcttcaaagattatctga

SEQ ID NO: 1074343 - DNA, 14 bp, Homo sapiens
ctgcttcaaatatt

SEQ ID NO: 1074344 - DNA, 19 bp, Homo sapiens
ctgcttcaaggcttccact

SEQ ID NO: 1074345 - DNA, 19 bp, Homo sapiens
ctgcttcagtgtatggaaa

SEQ ID NO: 1074346 - DNA, 15 bp, Homo sapiens
ctgcttcattttgga

SEQ ID NO: 1074347 - DNA, 15 bp, Homo sapiens
ctgcttccaggctgg

SEQ ID NO: 1074348 - DNA, 13 bp, Homo sapiens
ctgcttccatggc

SEQ ID NO: 1074349 - DNA, 20 bp, Homo sapiens
ctgcttccatggcttcctga

SEQ ID NO: 1074350 - DNA, 18 bp, Homo sapiens
ctgcttcccatcctaccc

SEQ ID NO: 1074351 - DNA, 23 bp, Homo sapiens
ctgcttcccattgagtaatcata

SEQ ID NO: 1074352 - DNA, 11 bp, Homo sapiens
ctgcttcccct

SEQ ID NO: 1074353 - DNA, 13 bp, Homo sapiens
ctgcttcccctcc

SEQ ID NO: 1074354 - DNA, 15 bp, Homo sapiens
ctgcttcccctccct

SEQ ID NO: 1074355 - DNA, 15 bp, Homo sapiens
ctgcttccccttcct

SEQ ID NO: 1074356 - DNA, 17 bp, Homo sapiens
ctgcttccccttcctaa

SEQ ID NO: 1074357 - DNA, 18 bp, Homo sapiens
ctgcttccccttcctaag

SEQ ID NO: 1074358 - DNA, 22 bp, Homo sapiens
ctgcttccctctgcctgtccct

SEQ ID NO: 1074359 - DNA, 12 bp, Homo sapiens
ctgcttcctcct

SEQ ID NO: 1074360 - DNA, 14 bp, Homo sapiens
ctgcttccttcagt

SEQ ID NO: 1074361 - DNA, 23 bp, Homo sapiens
ctgcttctagaaactctggctca

SEQ ID NO: 1074362 - DNA, 24 bp, Homo sapiens
ctgcttctagaaactctggctcag

SEQ ID NO: 1074363 - DNA, 15 bp, Homo sapiens
ctgcttctcatccca

SEQ ID NO: 1074364 - DNA, 11 bp, Homo sapiens
ctgcttctccc

SEQ ID NO: 1074365 - DNA, 16 bp, Homo sapiens
ctgcttctccccccat

SEQ ID NO: 1074366 - DNA, 19 bp, Homo sapiens
ctgcttctcggccagcccg

SEQ ID NO: 1074367 - DNA, 16 bp, Homo sapiens
ctgcttctctcagcca

SEQ ID NO: 1074368 - DNA, 20 bp, Homo sapiens
ctgcttctctgacttctgcc

SEQ ID NO: 1074369 - DNA, 22 bp, Homo sapiens
ctgcttctctgacttctgcctg

SEQ ID NO: 1074370 - DNA, 22 bp, Homo sapiens
ctgcttctcttttcctcgcaga

SEQ ID NO: 1074371 - DNA, 14 bp, Homo sapiens
ctgcttctgctcca

SEQ ID NO: 1074372 - DNA, 16 bp, Homo sapiens
ctgcttctgctccagc

SEQ ID NO: 1074373 - DNA, 19 bp, Homo sapiens
ctgcttctgctccagcccc

SEQ ID NO: 1074374 - DNA, 15 bp, Homo sapiens
ctgcttcttggagct

SEQ ID NO: 1074375 - DNA, 13 bp, Homo sapiens
ctgcttgaggcaa

SEQ ID NO: 1074376 - DNA, 22 bp, Homo sapiens
ctgcttgaggcaactcatctta

SEQ ID NO: 1074377 - DNA, 17 bp, Homo sapiens
ctgcttgcacacttccc

SEQ ID NO: 1074378 - DNA, 22 bp, Homo sapiens
ctgcttgcacacttccccatct

SEQ ID NO: 1074379 - DNA, 22 bp, Homo sapiens
ctgctttgggatttaatttcca

SEQ ID NO: 1074380 - DNA, 18 bp, Homo sapiens
ctgctttgggctgccctg

SEQ ID NO: 1074381 - DNA, 19 bp, Homo sapiens
ctgctttgggctgccctgg

SEQ ID NO: 1074382 - DNA, 17 bp, Homo sapiens
ctgctttggtcttgccc

SEQ ID NO: 1074383 - DNA, 14 bp, Homo sapiens
ctgctttgtgcata

SEQ ID NO: 1074384 - DNA, 20 bp, Homo sapiens
ctgctttgtgcatatgttaa

SEQ ID NO: 1074385 - DNA, 22 bp, Homo sapiens
ctgcttttattaaatttgttga

SEQ ID NO: 1074386 - DNA, 13 bp, Homo sapiens
ctgcttttccagg

SEQ ID NO: 1074387 - DNA, 20 bp, Homo sapiens
ctgcttttccaggatcctgc

SEQ ID NO: 1074388 - DNA, 22 bp, Homo sapiens
ctgcttttccaggatcctgcag

SEQ ID NO: 1074389 - DNA, 24 bp, Homo sapiens
ctgcttttccaggatcctgcagga

SEQ ID NO: 1074390 - DNA, 18 bp, Homo sapiens
ctgcttttcctcaagcaa

SEQ ID NO: 1074391 - DNA, 18 bp, Homo sapiens
ctgcttttctgccctggc

SEQ ID NO: 1074392 - DNA, 19 bp, Homo sapiens
ctgcttttctgccctggct

SEQ ID NO: 1074393 - DNA, 16 bp, Homo sapiens
ctgcttttctgtcctg

SEQ ID NO: 1074394 - DNA, 19 bp, Homo sapiens
ctgcttttctgtcctgggc

SEQ ID NO: 1074395 - DNA, 19 bp, Homo sapiens
ctgctttttaaagaatgct

SEQ ID NO: 1074396 - DNA, 20 bp, Homo sapiens
ctgctttttggaaagtcaga

SEQ ID NO: 1074397 - DNA, 17 bp, Homo sapiens
ctgctttttggcacagt

SEQ ID NO: 1074398 - DNA, 17 bp, Homo sapiens
ctgcttttttttttcca

SEQ ID NO: 1074399 - DNA, 18 bp, Homo sapiens
ctgcttttttttttccag

SEQ ID NO: 1074400 - DNA, 20 bp, Homo sapiens
ctggaaaaaaaatatatata

SEQ ID NO: 1074401 - DNA, 18 bp, Homo sapiens
ctggaaaacagaacactt

SEQ ID NO: 1074402 - DNA, 22 bp, Homo sapiens
ctggaaaactattgagccttgc

SEQ ID NO: 1074403 - DNA, 18 bp, Homo sapiens
ctggaaaagaagaaactt

SEQ ID NO: 1074404 - DNA, 14 bp, Homo sapiens
ctggaaaagaggag

SEQ ID NO: 1074405 - DNA, 19 bp, Homo sapiens
ctggaaaagggtcttggga

SEQ ID NO: 1074406 - DNA, 19 bp, Homo sapiens
ctggaaaaggtgaaaatgt

SEQ ID NO: 1074407 - DNA, 22 bp, Homo sapiens
ctggaaaaggtgaaaatgtttt

SEQ ID NO: 1074408 - DNA, 22 bp, Homo sapiens
ctggaaaagtgatgtattttca

SEQ ID NO: 1074409 - DNA, 21 bp, Homo sapiens
ctggaaacaagtgaccccagg

SEQ ID NO: 1074410 - DNA, 15 bp, Homo sapiens
ctggaaacacagtca

SEQ ID NO: 1074411 - DNA, 22 bp, Homo sapiens
ctggaaacttttgttagggctg

SEQ ID NO: 1074412 - DNA, 14 bp, Homo sapiens
ctggaaaggctcag

SEQ ID NO: 1074413 - DNA, 20 bp, Homo sapiens
ctggaaaggctcagtctcag

SEQ ID NO: 1074414 - DNA, 15 bp, Homo sapiens
ctggaaaggggagag

SEQ ID NO: 1074415 - DNA, 16 bp, Homo sapiens
ctggaaaggggagagc

SEQ ID NO: 1074416 - DNA, 17 bp, Homo sapiens
ctggaaaggggagagcc

SEQ ID NO: 1074417 - DNA, 18 bp, Homo sapiens
ctggaaaggggagagcct

SEQ ID NO: 1074418 - DNA, 23 bp, Homo sapiens
ctggaaaggggagagcctgctgg

SEQ ID NO: 1074419 - DNA, 19 bp, Homo sapiens
ctggaaaggggggagctgg

SEQ ID NO: 1074420 - DNA, 23 bp, Homo sapiens
ctggaaatatcagttactcagcc

SEQ ID NO: 1074421 - DNA, 19 bp, Homo sapiens
ctggaaatctgttttgtat

SEQ ID NO: 1074422 - DNA, 20 bp, Homo sapiens
ctggaaatctgttttgtata

SEQ ID NO: 1074423 - DNA, 16 bp, Homo sapiens
ctggaacaaattattt

SEQ ID NO: 1074424 - DNA, 15 bp, Homo sapiens
ctggaacaacttgta

SEQ ID NO: 1074425 - DNA, 21 bp, Homo sapiens
ctggaacaacttgtagcagct

SEQ ID NO: 1074426 - DNA, 14 bp, Homo sapiens
ctggaacatggcta

SEQ ID NO: 1074427 - DNA, 23 bp, Homo sapiens
ctggaacatgggcattgggttct

SEQ ID NO: 1074428 - DNA, 15 bp, Homo sapiens
ctggaacatttgata

SEQ ID NO: 1074429 - DNA, 19 bp, Homo sapiens
ctggaacatttgatatttt

SEQ ID NO: 1074430 - DNA, 13 bp, Homo sapiens
ctggaacccagga

SEQ ID NO: 1074431 - DNA, 15 bp, Homo sapiens
ctggaaccccccagg

SEQ ID NO: 1074432 - DNA, 21 bp, Homo sapiens
ctggaacctgcaaaaaatact

SEQ ID NO: 1074433 - DNA, 14 bp, Homo sapiens
ctggaaccttctag

SEQ ID NO: 1074434 - DNA, 17 bp, Homo sapiens
ctggaaccttgctgtcc

SEQ ID NO: 1074435 - DNA, 18 bp, Homo sapiens
ctggaaccttgctgtcct

SEQ ID NO: 1074436 - DNA, 22 bp, Homo sapiens
ctggaacggtgaaggtgacagc

SEQ ID NO: 1074437 - DNA, 22 bp, Homo sapiens
ctggaactgaagtccaaattgt

SEQ ID NO: 1074438 - DNA, 19 bp, Homo sapiens
ctggaactggctgtgaaga

SEQ ID NO: 1074439 - DNA, 13 bp, Homo sapiens
ctggaactgtagg

SEQ ID NO: 1074440 - DNA, 14 bp, Homo sapiens
ctggaactttagtg

SEQ ID NO: 1074441 - DNA, 16 bp, Homo sapiens
ctggaactttagtgaa

SEQ ID NO: 1074442 - DNA, 12 bp, Homo sapiens
ctggaagaaaaa

SEQ ID NO: 1074443 - DNA, 14 bp, Homo sapiens
ctggaagaaaaaaa

SEQ ID NO: 1074444 - DNA, 20 bp, Homo sapiens
ctggaagaaactaaaaatat

SEQ ID NO: 1074445 - DNA, 16 bp, Homo sapiens
ctggaagaacaaatct

SEQ ID NO: 1074446 - DNA, 19 bp, Homo sapiens
ctggaagaacatcaagata

SEQ ID NO: 1074447 - DNA, 20 bp, Homo sapiens
ctggaagaacatcaagatac

SEQ ID NO: 1074448 - DNA, 18 bp, Homo sapiens
ctggaagacaacccaggc

SEQ ID NO: 1074449 - DNA, 16 bp, Homo sapiens
ctggaagacacttcag

SEQ ID NO: 1074450 - DNA, 20 bp, Homo sapiens
ctggaagacacttcagatct

SEQ ID NO: 1074451 - DNA, 13 bp, Homo sapiens
ctggaagagagga

SEQ ID NO: 1074452 - DNA, 11 bp, Homo sapiens
ctggaagagcc

SEQ ID NO: 1074453 - DNA, 15 bp, Homo sapiens
ctggaagagcccagt

SEQ ID NO: 1074454 - DNA, 20 bp, Homo sapiens
ctggaagagttggtctctgc

SEQ ID NO: 1074455 - DNA, 22 bp, Homo sapiens
ctggaagatcccctctcctgcc

SEQ ID NO: 1074456 - DNA, 18 bp, Homo sapiens
ctggaagcacagcctcgg

SEQ ID NO: 1074457 - DNA, 21 bp, Homo sapiens
ctggaagcacagcctcgggga

SEQ ID NO: 1074458 - DNA, 22 bp, Homo sapiens
ctggaagcatttgtttctactt

SEQ ID NO: 1074459 - DNA, 15 bp, Homo sapiens
ctggaagccagcttt

SEQ ID NO: 1074460 - DNA, 17 bp, Homo sapiens
ctggaagccagctttcc

SEQ ID NO: 1074461 - DNA, 17 bp, Homo sapiens
ctggaagccatcctgcc

SEQ ID NO: 1074462 - DNA, 22 bp, Homo sapiens
ctggacctatgcagggaggcca

SEQ ID NO: 1074463 - DNA, 19 bp, Homo sapiens
ctggacctatgtcctaagg

SEQ ID NO: 1074464 - DNA, 19 bp, Homo sapiens
ctggacctcaggagggcag

SEQ ID NO: 1074465 - DNA, 21 bp, Homo sapiens
ctggacctcaggagggcaggc

SEQ ID NO: 1074466 - DNA, 12 bp, Homo sapiens
ctggacctccat

SEQ ID NO: 1074467 - DNA, 16 bp, Homo sapiens
ctggacctccatccct

SEQ ID NO: 1074468 - DNA, 20 bp, Homo sapiens
ctggacctccatccctgctc

SEQ ID NO: 1074469 - DNA, 13 bp, Homo sapiens
ctggacctgagtc

SEQ ID NO: 1074470 - DNA, 15 bp, Homo sapiens
ctggacctgagtcgg

SEQ ID NO: 1074471 - DNA, 20 bp, Homo sapiens
ctggacctgcctcctgcctg

SEQ ID NO: 1074472 - DNA, 21 bp, Homo sapiens
ctggacctgcctcctgcctgc

SEQ ID NO: 1074473 - DNA, 12 bp, Homo sapiens
ctggacctggaa

SEQ ID NO: 1074474 - DNA, 13 bp, Homo sapiens
ctggaccttgaca

SEQ ID NO: 1074475 - DNA, 16 bp, Homo sapiens
ctggaccttgacagag

SEQ ID NO: 1074476 - DNA, 17 bp, Homo sapiens
ctggaccttgacagagc

SEQ ID NO: 1074477 - DNA, 21 bp, Homo sapiens
ctggaccttgacagagcagct

SEQ ID NO: 1074478 - DNA, 12 bp, Homo sapiens
ctggacgctgcc

SEQ ID NO: 1074479 - DNA, 24 bp, Homo sapiens
ctggacgctgccctgcatgctgcc

SEQ ID NO: 1074480 - DNA, 13 bp, Homo sapiens
ctggacggcaggc

SEQ ID NO: 1074481 - DNA, 14 bp, Homo sapiens
ctggacggcaggct

SEQ ID NO: 1074482 - DNA, 15 bp, Homo sapiens
ctggacggcattcct

SEQ ID NO: 1074483 - DNA, 17 bp, Homo sapiens
ctggacggcattcctgc

SEQ ID NO: 1074484 - DNA, 20 bp, Homo sapiens
ctggacggcattcctgctta

SEQ ID NO: 1074485 - DNA, 22 bp, Homo sapiens
ctggacggggtcggacggggca

SEQ ID NO: 1074486 - DNA, 16 bp, Homo sapiens
ctggactacacccaag

SEQ ID NO: 1074487 - DNA, 21 bp, Homo sapiens
ctggactagagggacctctcc

SEQ ID NO: 1074488 - DNA, 23 bp, Homo sapiens
ctggactagagggacctctccca

SEQ ID NO: 1074489 - DNA, 15 bp, Homo sapiens
ctggactagtgtcct

SEQ ID NO: 1074490 - DNA, 13 bp, Homo sapiens
ctggactcaggaa

SEQ ID NO: 1074491 - DNA, 21 bp, Homo sapiens
ctggactccggaggactgagc

SEQ ID NO: 1074492 - DNA, 19 bp, Homo sapiens
ctggactcctctgtccagg

SEQ ID NO: 1074493 - DNA, 20 bp, Homo sapiens
ctggactcctctgtccaggc

SEQ ID NO: 1074494 - DNA, 22 bp, Homo sapiens
ctggactctaagctggagctct

SEQ ID NO: 1074495 - DNA, 17 bp, Homo sapiens
ctggactctcagtctct

SEQ ID NO: 1074496 - DNA, 18 bp, Homo sapiens
ctggactctcagtctctg

SEQ ID NO: 1074497 - DNA, 20 bp, Homo sapiens
ctggactctcagtctctgag

SEQ ID NO: 1074498 - DNA, 21 bp, Homo sapiens
ctggactctcagtctctgagc

SEQ ID NO: 1074499 - DNA, 23 bp, Homo sapiens
ctggactctgcatcccagcacct

SEQ ID NO: 1074500 - DNA, 14 bp, Homo sapiens
ctggactctgcccc

SEQ ID NO: 1074501 - DNA, 18 bp, Homo sapiens
ctggactctgccccaatc

SEQ ID NO: 1074502 - DNA, 14 bp, Homo sapiens
ctggactctggact

SEQ ID NO: 1074503 - DNA, 23 bp, Homo sapiens
ctggactgaagcctgcaggagtt

SEQ ID NO: 1074504 - DNA, 21 bp, Homo sapiens
ctggactgacagcatgtgccc

SEQ ID NO: 1074505 - DNA, 15 bp, Homo sapiens
ctggactgaccctgc

SEQ ID NO: 1074506 - DNA, 19 bp, Homo sapiens
ctggactggaggtgggcat

SEQ ID NO: 1074507 - DNA, 14 bp, Homo sapiens
ctggactggcgttc

SEQ ID NO: 1074508 - DNA, 20 bp, Homo sapiens
ctggactggcgttcacctcc

SEQ ID NO: 1074509 - DNA, 23 bp, Homo sapiens
ctggactggcgttcacctccctg

SEQ ID NO: 1074510 - DNA, 15 bp, Homo sapiens
ctggactggctagag

SEQ ID NO: 1074511 - DNA, 21 bp, Homo sapiens
ctggactggctagagtcctca

SEQ ID NO: 1074512 - DNA, 13 bp, Homo sapiens
ctggactgttcca

SEQ ID NO: 1074513 - DNA, 21 bp, Homo sapiens
ctggactgttccaggccctcc

SEQ ID NO: 1074514 - DNA, 22 bp, Homo sapiens
ctggacttaagcatctggctct

SEQ ID NO: 1074515 - DNA, 18 bp, Homo sapiens
ctggacttcctataatac

SEQ ID NO: 1074516 - DNA, 18 bp, Homo sapiens
ctggacttctacctgccc

SEQ ID NO: 1074517 - DNA, 13 bp, Homo sapiens
ctggacttcttag

SEQ ID NO: 1074518 - DNA, 13 bp, Homo sapiens
ctggacttgagct

SEQ ID NO: 1074519 - DNA, 14 bp, Homo sapiens
ctgctggccgaccc

SEQ ID NO: 1074520 - DNA, 22 bp, Homo sapiens
ctgctggccgacccactgaccc

SEQ ID NO: 1074521 - DNA, 11 bp, Homo sapiens
ctgctggcctg

SEQ ID NO: 1074522 - DNA, 15 bp, Homo sapiens
ctgctggcctggatc

SEQ ID NO: 1074523 - DNA, 16 bp, Homo sapiens
ctgctggcctggatct

SEQ ID NO: 1074524 - DNA, 13 bp, Homo sapiens
ctgctggcctggc

SEQ ID NO: 1074525 - DNA, 16 bp, Homo sapiens
ctgctggcctggccgg

SEQ ID NO: 1074526 - DNA, 13 bp, Homo sapiens
ctgctggcctgtc

SEQ ID NO: 1074527 - DNA, 23 bp, Homo sapiens
ctgctggcctgtctccctaggga

SEQ ID NO: 1074528 - DNA, 20 bp, Homo sapiens
ctgctggctgacctgggccc

SEQ ID NO: 1074529 - DNA, 13 bp, Homo sapiens
ctggcttgcccca

SEQ ID NO: 1074530 - DNA, 15 bp, Homo sapiens
ctggcttgccccagg

SEQ ID NO: 1074531 - DNA, 16 bp, Homo sapiens
ctggcttgccccagga

SEQ ID NO: 1074532 - DNA, 14 bp, Homo sapiens
ctggcttgctccag

SEQ ID NO: 1074533 - DNA, 16 bp, Homo sapiens
ctggcttgctccaggg

SEQ ID NO: 1074534 - DNA, 14 bp, Homo sapiens
ctggctttcccagg

SEQ ID NO: 1074535 - DNA, 15 bp, Homo sapiens
ctggctttcccagga

SEQ ID NO: 1074536 - DNA, 19 bp, Homo sapiens
ctggctttcccaggagatg

SEQ ID NO: 1074537 - DNA, 13 bp, Homo sapiens
ctggctttgctct

SEQ ID NO: 1074538 - DNA, 14 bp, Homo sapiens
ctggctttggcttc

SEQ ID NO: 1074539 - DNA, 16 bp, Homo sapiens
ctggctttggtcccca

SEQ ID NO: 1074540 - DNA, 17 bp, Homo sapiens
ctggctttggtccccag

SEQ ID NO: 1074541 - DNA, 19 bp, Homo sapiens
ctggctttggtccccagca

SEQ ID NO: 1074542 - DNA, 14 bp, Homo sapiens
ctggcttttattaa

SEQ ID NO: 1074543 - DNA, 20 bp, Homo sapiens
ctggcttttcaccccagagg

SEQ ID NO: 1074544 - DNA, 15 bp, Homo sapiens
ctggcttttcactgc

SEQ ID NO: 1074545 - DNA, 18 bp, Homo sapiens
ctggctttttaaaatata

SEQ ID NO: 1074546 - DNA, 23 bp, Homo sapiens
ctgggaaaaaagttttgatgaaa

SEQ ID NO: 1074547 - DNA, 16 bp, Homo sapiens
ctgggaaacagaggct

SEQ ID NO: 1074548 - DNA, 15 bp, Homo sapiens
ctgggaaacctgcct

SEQ ID NO: 1074549 - DNA, 19 bp, Homo sapiens
ctgggaaagacatccataa

SEQ ID NO: 1074550 - DNA, 16 bp, Homo sapiens
ctgggaaatgcagaaa

SEQ ID NO: 1074551 - DNA, 14 bp, Homo sapiens
ctgggaacaggccc

SEQ ID NO: 1074552 - DNA, 21 bp, Homo sapiens
ctgggaacaggccccacgccc

SEQ ID NO: 1074553 - DNA, 19 bp, Homo sapiens
ctgggaacatgacccagcc

SEQ ID NO: 1074554 - DNA, 21 bp, Homo sapiens
ctgggaacatgacccagcctg

SEQ ID NO: 1074555 - DNA, 14 bp, Homo sapiens
ctgggaaccactcc

SEQ ID NO: 1074556 - DNA, 17 bp, Homo sapiens
ctgggaacctcccagag

SEQ ID NO: 1074557 - DNA, 21 bp, Homo sapiens
ctgggaacctcccagaggtcc

SEQ ID NO: 1074558 - DNA, 23 bp, Homo sapiens
ctgggaacgtgtgtccaggctct

SEQ ID NO: 1074559 - DNA, 19 bp, Homo sapiens
ctgggaagacgcctgagct

SEQ ID NO: 1074560 - DNA, 18 bp, Homo sapiens
ctgggaagataggctctg

SEQ ID NO: 1074561 - DNA, 24 bp, Homo sapiens
ctgggaagataggctctgcacaga

SEQ ID NO: 1074562 - DNA, 18 bp, Homo sapiens
ctgggaagcccacccaga

SEQ ID NO: 1074563 - DNA, 13 bp, Homo sapiens
ctgggaagccctt

SEQ ID NO: 1074564 - DNA, 20 bp, Homo sapiens
ctgggaagcctgtgccagca

SEQ ID NO: 1074565 - DNA, 13 bp, Homo sapiens
ctgggaagctgga

SEQ ID NO: 1074566 - DNA, 19 bp, Homo sapiens
ctgggaagctggagtgctg

SEQ ID NO: 1074567 - DNA, 21 bp, Homo sapiens
ctgggaagctgtactcagagc

SEQ ID NO: 1074568 - DNA, 15 bp, Homo sapiens
ctgggaaggaaacaa

SEQ ID NO: 1074569 - DNA, 15 bp, Homo sapiens
ctgggaagggagagt

SEQ ID NO: 1074570 - DNA, 15 bp, Homo sapiens
ctgggaatggaataa

SEQ ID NO: 1074571 - DNA, 17 bp, Homo sapiens
ctgggaatggaataact

SEQ ID NO: 1074572 - DNA, 18 bp, Homo sapiens
ctgggaatggaataacta

SEQ ID NO: 1074573 - DNA, 19 bp, Homo sapiens
ctgggatgggaccagggat

SEQ ID NO: 1074574 - DNA, 20 bp, Homo sapiens
ctgggatgggaccagggatg

SEQ ID NO: 1074575 - DNA, 15 bp, Homo sapiens
ctgggatgggctccc

SEQ ID NO: 1074576 - DNA, 18 bp, Homo sapiens
ctgggatgggctcccacc

SEQ ID NO: 1074577 - DNA, 17 bp, Homo sapiens
ctgggatgtcacagtcc

SEQ ID NO: 1074578 - DNA, 18 bp, Homo sapiens
ctgggatgtcacagtcca

SEQ ID NO: 1074579 - DNA, 15 bp, Homo sapiens
ctgggattaagggca

SEQ ID NO: 1074580 - DNA, 20 bp, Homo sapiens
ctgggattacaggcatgagc

SEQ ID NO: 1074581 - DNA, 21 bp, Homo sapiens
ctgggattacaggcatgagcc

SEQ ID NO: 1074582 - DNA, 22 bp, Homo sapiens
ctgggattacaggcatgtgcca

SEQ ID NO: 1074583 - DNA, 21 bp, Homo sapiens
ctgggattacaggcgtgagcc

SEQ ID NO: 1074584 - DNA, 21 bp, Homo sapiens
ctgggattataggcatgagcc

SEQ ID NO: 1074585 - DNA, 15 bp, Homo sapiens
ctgggattcccacca

SEQ ID NO: 1074586 - DNA, 20 bp, Homo sapiens
ctgggattcccaccaaggtc

SEQ ID NO: 1074587 - DNA, 14 bp, Homo sapiens
ctgggattcctccc

SEQ ID NO: 1074588 - DNA, 17 bp, Homo sapiens
ctgggattctactttaa

SEQ ID NO: 1074589 - DNA, 21 bp, Homo sapiens
ctgggatttcttcgctgctct

SEQ ID NO: 1074590 - DNA, 14 bp, Homo sapiens
ctgggatttgagat

SEQ ID NO: 1074591 - DNA, 13 bp, Homo sapiens
ctgggcaaagcca

SEQ ID NO: 1074592 - DNA, 21 bp, Homo sapiens
ctgggcaaagccacaaggctg

SEQ ID NO: 1074593 - DNA, 15 bp, Homo sapiens
ctgggcaaagcctag

SEQ ID NO: 1074594 - DNA, 15 bp, Homo sapiens
ctgggcaacactgca

SEQ ID NO: 1074595 - DNA, 19 bp, Homo sapiens
ctgggcaacagagcaagac

SEQ ID NO: 1074596 - DNA, 21 bp, Homo sapiens
ctgggcaagagatgggacaag

SEQ ID NO: 1074597 - DNA, 16 bp, Homo sapiens
ctgggcaagggctcct

SEQ ID NO: 1074598 - DNA, 15 bp, Homo sapiens
ctgggcaagtagcag

SEQ ID NO: 1074599 - DNA, 18 bp, Homo sapiens
ctgggcaagtagcaggac

SEQ ID NO: 1074600 - DNA, 21 bp, Homo sapiens
ctgggcaagtagcaggactag

SEQ ID NO: 1074601 - DNA, 22 bp, Homo sapiens
ctgggcaagtagcaggactagg

SEQ ID NO: 1074602 - DNA, 18 bp, Homo sapiens
ctgggcacagattgaaga

SEQ ID NO: 1074603 - DNA, 20 bp, Homo sapiens
ctgggcacagattgaagaat

SEQ ID NO: 1074604 - DNA, 17 bp, Homo sapiens
ctgggcacagtgctgcc

SEQ ID NO: 1074605 - DNA, 18 bp, Homo sapiens
ctgggcacagtgctgccc

SEQ ID NO: 1074606 - DNA, 17 bp, Homo sapiens
ctgggcaccagcatttg

SEQ ID NO: 1074607 - DNA, 14 bp, Homo sapiens
ctgggcaccgtgtc

SEQ ID NO: 1074608 - DNA, 21 bp, Homo sapiens
ctgggcacctgcgcacaggtg

SEQ ID NO: 1074609 - DNA, 16 bp, Homo sapiens
ctgggcacctggggag

SEQ ID NO: 1074610 - DNA, 19 bp, Homo sapiens
ctgggcacctggggagtgg

SEQ ID NO: 1074611 - DNA, 21 bp, Homo sapiens
ctgggcacgcctgctggccga

SEQ ID NO: 1074612 - DNA, 20 bp, Homo sapiens
ctgggcacggctccgagggc

SEQ ID NO: 1074613 - DNA, 21 bp, Homo sapiens
ctgggcacggctccgagggcg

SEQ ID NO: 1074614 - DNA, 14 bp, Homo sapiens
ctgggcactgctcc

SEQ ID NO: 1074615 - DNA, 17 bp, Homo sapiens
ctgggcactgctccaag

SEQ ID NO: 1074616 - DNA, 20 bp, Homo sapiens
ctgggcactgctccaaggga

SEQ ID NO: 1074617 - DNA, 23 bp, Homo sapiens
ctgggcactgctccaagggacag

SEQ ID NO: 1074618 - DNA, 18 bp, Homo sapiens
ctgggcagaagtgagccc

SEQ ID NO: 1074619 - DNA, 16 bp, Homo sapiens
ctgggcagagcctgtc

SEQ ID NO: 1074620 - DNA, 18 bp, Homo sapiens
ctgggcagagcctgtccc

SEQ ID NO: 1074621 - DNA, 13 bp, Homo sapiens
ctgggcagcaagg

SEQ ID NO: 1074622 - DNA, 14 bp, Homo sapiens
ctgggcagcaaggc

SEQ ID NO: 1074623 - DNA, 17 bp, Homo sapiens
ctgggcagcacctctgg

SEQ ID NO: 1074624 - DNA, 18 bp, Homo sapiens
ctgggcagcacctctggt

SEQ ID NO: 1074625 - DNA, 17 bp, Homo sapiens
ctgggcagcatagcaag

SEQ ID NO: 1074626 - DNA, 16 bp, Homo sapiens
ctgggcagccaggctg

SEQ ID NO: 1074627 - DNA, 23 bp, Homo sapiens
ctgggcagccgttttcctcatcc

SEQ ID NO: 1074628 - DNA, 23 bp, Homo sapiens
ctgggcagcctgctttggccttt

SEQ ID NO: 1074629 - DNA, 12 bp, Homo sapiens
ctgggcagcctt

SEQ ID NO: 1074630 - DNA, 23 bp, Homo sapiens
ctgggcagcttctgttggcagag

SEQ ID NO: 1074631 - DNA, 12 bp, Homo sapiens
ctgggcaggacc

SEQ ID NO: 1074632 - DNA, 20 bp, Homo sapiens
ctgggcaggaccctgctgac

SEQ ID NO: 1074633 - DNA, 21 bp, Homo sapiens
ctgggcaggcggtccccatcc

SEQ ID NO: 1074634 - DNA, 20 bp, Homo sapiens
ctgggcagggatgatggcag

SEQ ID NO: 1074635 - DNA, 14 bp, Homo sapiens
ctgggcagggcagg

SEQ ID NO: 1074636 - DNA, 23 bp, Homo sapiens
ctgggcagggcagggcagcctgt

SEQ ID NO: 1074637 - DNA, 12 bp, Homo sapiens
ctgggcaggtgg

SEQ ID NO: 1074638 - DNA, 19 bp, Homo sapiens
ctgggcaggtgggagctga

SEQ ID NO: 1074639 - DNA, 15 bp, Homo sapiens
ctgggcaggttcctg

SEQ ID NO: 1074640 - DNA, 18 bp, Homo sapiens
ctgggcaggttcctgggg

SEQ ID NO: 1074641 - DNA, 19 bp, Homo sapiens
ctgggcaggttcctggggc

SEQ ID NO: 1074642 - DNA, 22 bp, Homo sapiens
ctgggcaggttcctggggccgc

SEQ ID NO: 1074643 - DNA, 23 bp, Homo sapiens
ctgggcaggttcctggggccgcc

SEQ ID NO: 1074644 - DNA, 20 bp, Homo sapiens
ctgggcaggttggtgggggc

SEQ ID NO: 1074645 - DNA, 21 bp, Homo sapiens
ctgggcagtgagtgccatgct

SEQ ID NO: 1074646 - DNA, 22 bp, Homo sapiens
ctgggcagtgagtgccatgctt

SEQ ID NO: 1074647 - DNA, 13 bp, Homo sapiens
ctgggcagtgcca

SEQ ID NO: 1074648 - DNA, 16 bp, Homo sapiens
ctgggcagtgccacag

SEQ ID NO: 1074649 - DNA, 20 bp, Homo sapiens
ctgggcatactttctctcta

SEQ ID NO: 1074650 - DNA, 20 bp, Homo sapiens
ctgggcatcagggcctttct

SEQ ID NO: 1074651 - DNA, 14 bp, Homo sapiens
ctgggcatcccagc

SEQ ID NO: 1074652 - DNA, 16 bp, Homo sapiens
ctgggcatcccagctt

SEQ ID NO: 1074653 - DNA, 16 bp, Homo sapiens
ctgggcatcttctggc

SEQ ID NO: 1074654 - DNA, 17 bp, Homo sapiens
ctgggcatcttctggct

SEQ ID NO: 1074655 - DNA, 19 bp, Homo sapiens
ctgggcatcttctggcttg

SEQ ID NO: 1074656 - DNA, 22 bp, Homo sapiens
ctgggcatgggtccagggcctg

SEQ ID NO: 1074657 - DNA, 22 bp, Homo sapiens
ctgggcatttcacgaactgttc

SEQ ID NO: 1074658 - DNA, 18 bp, Homo sapiens
ctgggcatttggtgagag

SEQ ID NO: 1074659 - DNA, 17 bp, Homo sapiens
ctgggcattttcctcct

SEQ ID NO: 1074660 - DNA, 18 bp, Homo sapiens
ctgggcattttcctcctc

SEQ ID NO: 1074661 - DNA, 19 bp, Homo sapiens
ctgggcattttcctcctct

SEQ ID NO: 1074662 - DNA, 21 bp, Homo sapiens
ctgggcattttcctcctctgc

SEQ ID NO: 1074663 - DNA, 18 bp, Homo sapiens
ctgggccaagttcctcta

SEQ ID NO: 1074664 - DNA, 21 bp, Homo sapiens
ctgggccaagttcctctagtg

SEQ ID NO: 1074665 - DNA, 16 bp, Homo sapiens
ctgggccacacctgag

SEQ ID NO: 1074666 - DNA, 18 bp, Homo sapiens
ctgggccacagccccgat

SEQ ID NO: 1074667 - DNA, 13 bp, Homo sapiens
ctgggccacctcc

SEQ ID NO: 1074668 - DNA, 17 bp, Homo sapiens
ctgggccacctcctacc

SEQ ID NO: 1074669 - DNA, 18 bp, Homo sapiens
ctgggccacctcctaccc

SEQ ID NO: 1074670 - DNA, 12 bp, Homo sapiens
ctgggccactgg

SEQ ID NO: 1074671 - DNA, 15 bp, Homo sapiens
ctgggccactgggga

SEQ ID NO: 1074672 - DNA, 16 bp, Homo sapiens
ctgggccactggggac

SEQ ID NO: 1074673 - DNA, 19 bp, Homo sapiens
ctgggccagccctgcagcc

SEQ ID NO: 1074674 - DNA, 15 bp, Homo sapiens
ctgggccaggcaggc

SEQ ID NO: 1074675 - DNA, 14 bp, Homo sapiens
ctgggccagggtct

SEQ ID NO: 1074676 - DNA, 15 bp, Homo sapiens
ctgggccagggtctg

SEQ ID NO: 1074677 - DNA, 23 bp, Homo sapiens
ctgggccatgtccaaagaggctg

SEQ ID NO: 1074678 - DNA, 22 bp, Homo sapiens
ctgggccattctccacagcaac

SEQ ID NO: 1074679 - DNA, 19 bp, Homo sapiens
ctgggcccaaaggcccagg

SEQ ID NO: 1074680 - DNA, 22 bp, Homo sapiens
ctgggcccaaaggcccagggag

SEQ ID NO: 1074681 - DNA, 16 bp, Homo sapiens
ctgggcccacagagcc

SEQ ID NO: 1074682 - DNA, 18 bp, Homo sapiens
ctgggcccacagagcctg

SEQ ID NO: 1074683 - DNA, 20 bp, Homo sapiens
ctgggcccacagagcctggc

SEQ ID NO: 1074684 - DNA, 14 bp, Homo sapiens
ctgggcccaggcag

SEQ ID NO: 1074685 - DNA, 15 bp, Homo sapiens
ctgggcccaggggct

SEQ ID NO: 1074686 - DNA, 18 bp, Homo sapiens
ctgggcccatctccctgc

SEQ ID NO: 1074687 - DNA, 21 bp, Homo sapiens
ctgggcccatctccctgcttt

SEQ ID NO: 1074688 - DNA, 24 bp, Homo sapiens
ctgggccccaaacgggctgccctg

SEQ ID NO: 1074689 - DNA, 14 bp, Homo sapiens
ctgggccccaccta

SEQ ID NO: 1074690 - DNA, 16 bp, Homo sapiens
ctgggccccacctact

SEQ ID NO: 1074691 - DNA, 12 bp, Homo sapiens
ctgggccccact

SEQ ID NO: 1074692 - DNA, 14 bp, Homo sapiens
ctgggccccactgg

SEQ ID NO: 1074693 - DNA, 14 bp, Homo sapiens
ctgggccccatgct

SEQ ID NO: 1074694 - DNA, 22 bp, Homo sapiens
ctgggccccatgctctgcccca

SEQ ID NO: 1074695 - DNA, 15 bp, Homo sapiens
ctgggcccccagcct

SEQ ID NO: 1074696 - DNA, 17 bp, Homo sapiens
ctgggcccccagcctgg

SEQ ID NO: 1074697 - DNA, 18 bp, Homo sapiens
ctgggcccccagcctggc

SEQ ID NO: 1074698 - DNA, 19 bp, Homo sapiens
ctgggcccccagcctggcc

SEQ ID NO: 1074699 - DNA, 14 bp, Homo sapiens
ctgggcccctccac

SEQ ID NO: 1074700 - DNA, 19 bp, Homo sapiens
ctgggcccctccacgcctc

SEQ ID NO: 1074701 - DNA, 16 bp, Homo sapiens
ctgggcccctcccctc

SEQ ID NO: 1074702 - DNA, 18 bp, Homo sapiens
ctgggcccctcccctcag

SEQ ID NO: 1074703 - DNA, 21 bp, Homo sapiens
ctgggcccctcccctcagagc

SEQ ID NO: 1074704 - DNA, 16 bp, Homo sapiens
ctgggcccctgcacag

SEQ ID NO: 1074705 - DNA, 17 bp, Homo sapiens
ctgggcccctgggatgg

SEQ ID NO: 1074706 - DNA, 15 bp, Homo sapiens
ctgggcccctgggga

SEQ ID NO: 1074707 - DNA, 19 bp, Homo sapiens
ctgggcccctggggacaga

SEQ ID NO: 1074708 - DNA, 22 bp, Homo sapiens
ctgggcccggaagggctttggt

SEQ ID NO: 1074709 - DNA, 18 bp, Homo sapiens
ctgggcccgggcaggcca

SEQ ID NO: 1074710 - DNA, 16 bp, Homo sapiens
ctgggccctctttccc

SEQ ID NO: 1074711 - DNA, 23 bp, Homo sapiens
ctgggccctctttccctgcgaga

SEQ ID NO: 1074712 - DNA, 13 bp, Homo sapiens
ctgggccctgggc

SEQ ID NO: 1074713 - DNA, 18 bp, Homo sapiens
ctgggccctgggctgatg

SEQ ID NO: 1074714 - DNA, 16 bp, Homo sapiens
ctgggccctgggctgg

SEQ ID NO: 1074715 - DNA, 18 bp, Homo sapiens
ctgggccctgggctggaa

SEQ ID NO: 1074716 - DNA, 15 bp, Homo sapiens
ctgggcccttgtgct

SEQ ID NO: 1074717 - DNA, 16 bp, Homo sapiens
ctgggcccttgtgctc

SEQ ID NO: 1074718 - DNA, 20 bp, Homo sapiens
ctgggccgggcctggggctc

SEQ ID NO: 1074719 - DNA, 13 bp, Homo sapiens
ctgggccgggctg

SEQ ID NO: 1074720 - DNA, 19 bp, Homo sapiens
ctgggccgtggcacagctg

SEQ ID NO: 1074721 - DNA, 20 bp, Homo sapiens
ctgggccgtggcacagctgg

SEQ ID NO: 1074722 - DNA, 21 bp, Homo sapiens
ctgggcctcagttcaacctgg

SEQ ID NO: 1074723 - DNA, 15 bp, Homo sapiens
ctgggcctcccttgg

SEQ ID NO: 1074724 - DNA, 18 bp, Homo sapiens
ctgggcctcccttgggct

SEQ ID NO: 1074725 - DNA, 19 bp, Homo sapiens
ctgggcctcccttgggctg

SEQ ID NO: 1074726 - DNA, 20 bp, Homo sapiens
ctgggcctctgactctgagt

SEQ ID NO: 1074727 - DNA, 12 bp, Homo sapiens
ctgggcctgctt

SEQ ID NO: 1074728 - DNA, 13 bp, Homo sapiens
ctgggcctggggt

SEQ ID NO: 1074729 - DNA, 12 bp, Homo sapiens
ctgggcctgtgc

SEQ ID NO: 1074730 - DNA, 14 bp, Homo sapiens
ctgggcctgtgcac

SEQ ID NO: 1074731 - DNA, 18 bp, Homo sapiens
ctgggcctgtgcactggg

SEQ ID NO: 1074732 - DNA, 21 bp, Homo sapiens
ctgggcctgtgcactgggcag

SEQ ID NO: 1074733 - DNA, 22 bp, Homo sapiens
ctgggcctgtgcactgggcagg

SEQ ID NO: 1074734 - DNA, 23 bp, Homo sapiens
ctgggcctgtgcactgggcaggt

SEQ ID NO: 1074735 - DNA, 15 bp, Homo sapiens
ctgggcctgtgcagc

SEQ ID NO: 1074736 - DNA, 16 bp, Homo sapiens
ctgggcctgtgcagca

SEQ ID NO: 1074737 - DNA, 17 bp, Homo sapiens
ctgggcctgtgcagcag

SEQ ID NO: 1074738 - DNA, 18 bp, Homo sapiens
ctgggcctgtgcagcagc

SEQ ID NO: 1074739 - DNA, 22 bp, Homo sapiens
ctgggcctgtgcagcagcccag

SEQ ID NO: 1074740 - DNA, 20 bp, Homo sapiens
ctgggcctgtgtgtgggtgg

SEQ ID NO: 1074741 - DNA, 19 bp, Homo sapiens
ctgggccttggctgggcct

SEQ ID NO: 1074742 - DNA, 21 bp, Homo sapiens
ctgggcctttccagagaactg

SEQ ID NO: 1074743 - DNA, 14 bp, Homo sapiens
ctgggcctttcctg

SEQ ID NO: 1074744 - DNA, 16 bp, Homo sapiens
ctgggcctttgcaaga

SEQ ID NO: 1074745 - DNA, 17 bp, Homo sapiens
ctgggcctttgtttcct

SEQ ID NO: 1074746 - DNA, 21 bp, Homo sapiens
ctgggcgacagagcgagactc

SEQ ID NO: 1074747 - DNA, 16 bp, Homo sapiens
ctgggcgccctggaag

SEQ ID NO: 1074748 - DNA, 15 bp, Homo sapiens
ctgggcgcggtggct

SEQ ID NO: 1074749 - DNA, 22 bp, Homo sapiens
ctgggcggcccgtggacacccc

SEQ ID NO: 1074750 - DNA, 22 bp, Homo sapiens
ctgggcggcgggcggctgggtc

SEQ ID NO: 1074751 - DNA, 17 bp, Homo sapiens
ctgggcgtccagctcag

SEQ ID NO: 1074752 - DNA, 19 bp, Homo sapiens
ctgggcgtccagctcagcc

SEQ ID NO: 1074753 - DNA, 23 bp, Homo sapiens
ctgggcgtccagctcagccctgg

SEQ ID NO: 1074754 - DNA, 21 bp, Homo sapiens
ctgggcgtctgactccctccc

SEQ ID NO: 1074755 - DNA, 20 bp, Homo sapiens
ctgggctactgccactgtgt

SEQ ID NO: 1074756 - DNA, 18 bp, Homo sapiens
ctgggctatggacacagg

SEQ ID NO: 1074757 - DNA, 19 bp, Homo sapiens
ctgggctatggacacaggg

SEQ ID NO: 1074758 - DNA, 14 bp, Homo sapiens
ctgggctcagggct

SEQ ID NO: 1074759 - DNA, 15 bp, Homo sapiens
ctgggctcagggctg

SEQ ID NO: 1074760 - DNA, 16 bp, Homo sapiens
ctgggctcagggctgg

SEQ ID NO: 1074761 - DNA, 17 bp, Homo sapiens
ctgggctcagggctgga

SEQ ID NO: 1074762 - DNA, 20 bp, Homo sapiens
ctgggctcagggctggagtg

SEQ ID NO: 1074763 - DNA, 21 bp, Homo sapiens
ctgggctcagggctggagtgc

SEQ ID NO: 1074764 - DNA, 22 bp, Homo sapiens
ctgggctccggaggactcacca

SEQ ID NO: 1074765 - DNA, 14 bp, Homo sapiens
ctgggctctccacc

SEQ ID NO: 1074766 - DNA, 15 bp, Homo sapiens
ctgggctctccacct

SEQ ID NO: 1074767 - DNA, 23 bp, Homo sapiens
ctgggctctgcaattcccctctg

SEQ ID NO: 1074768 - DNA, 13 bp, Homo sapiens
ctgggctctgcca

SEQ ID NO: 1074769 - DNA, 21 bp, Homo sapiens
ctgggctctgccaccctacct

SEQ ID NO: 1074770 - DNA, 13 bp, Homo sapiens
ctgggctctgccc

SEQ ID NO: 1074771 - DNA, 20 bp, Homo sapiens
ctgggctctgcctgtctggt

SEQ ID NO: 1074772 - DNA, 14 bp, Homo sapiens
ctgggctctggacc

SEQ ID NO: 1074773 - DNA, 19 bp, Homo sapiens
ctgggctctggacctcagg

SEQ ID NO: 1074774 - DNA, 12 bp, Homo sapiens
ctgggctgagcc

SEQ ID NO: 1074775 - DNA, 14 bp, Homo sapiens
ctgggctgagcccc

SEQ ID NO: 1074776 - DNA, 19 bp, Homo sapiens
ctgggctgctacccagaaa

SEQ ID NO: 1074777 - DNA, 12 bp, Homo sapiens
ctgggctggact

SEQ ID NO: 1074778 - DNA, 15 bp, Homo sapiens
ctgggctggactgga

SEQ ID NO: 1074779 - DNA, 19 bp, Homo sapiens
ctgggctggactggaggtg

SEQ ID NO: 1074780 - DNA, 21 bp, Homo sapiens
ctgggctggactggaggtggg

SEQ ID NO: 1074781 - DNA, 17 bp, Homo sapiens
ctgggctggactggcca

SEQ ID NO: 1074782 - DNA, 18 bp, Homo sapiens
ctgggctggactggccat

SEQ ID NO: 1074783 - DNA, 16 bp, Homo sapiens
ctgggctgggcacctg

SEQ ID NO: 1074784 - DNA, 17 bp, Homo sapiens
ctgggctgggcacctga

SEQ ID NO: 1074785 - DNA, 14 bp, Homo sapiens
ctgggctgggcagc

SEQ ID NO: 1074786 - DNA, 15 bp, Homo sapiens
ctgggctgggcagcc

SEQ ID NO: 1074787 - DNA, 17 bp, Homo sapiens
ctgggctgggcagcctt

SEQ ID NO: 1074788 - DNA, 16 bp, Homo sapiens
ctgggctgggccctct

SEQ ID NO: 1074789 - DNA, 12 bp, Homo sapiens
ctgggctgggct

SEQ ID NO: 1074790 - DNA, 19 bp, Homo sapiens
ctgggctgggctgagcccc

SEQ ID NO: 1074791 - DNA, 14 bp, Homo sapiens
ctgggctgggctgg

SEQ ID NO: 1074792 - DNA, 15 bp, Homo sapiens
ctgggctggggagga

SEQ ID NO: 1074793 - DNA, 13 bp, Homo sapiens
ctgggctggggcc

SEQ ID NO: 1074794 - DNA, 18 bp, Homo sapiens
ctgggctggggcctcaga

SEQ ID NO: 1074795 - DNA, 19 bp, Homo sapiens
ctgggctgggtgctgggaa

SEQ ID NO: 1074796 - DNA, 22 bp, Homo sapiens
ctgggctgggtggcccctgtct

SEQ ID NO: 1074797 - DNA, 13 bp, Homo sapiens
ctgggctgtccag

SEQ ID NO: 1074798 - DNA, 12 bp, Homo sapiens
ctgggctgtctc

SEQ ID NO: 1074799 - DNA, 22 bp, Homo sapiens
ctgggctgtctctcccttccag

SEQ ID NO: 1074800 - DNA, 14 bp, Homo sapiens
ctgggctgtggggc

SEQ ID NO: 1074801 - DNA, 14 bp, Homo sapiens
ctgggctgttggca

SEQ ID NO: 1074802 - DNA, 17 bp, Homo sapiens
ctggtattgttctcaca

SEQ ID NO: 1074803 - DNA, 17 bp, Homo sapiens
ctggtcaaacaaactct

SEQ ID NO: 1074804 - DNA, 17 bp, Homo sapiens
ctggtcaacctcctgga

SEQ ID NO: 1074805 - DNA, 21 bp, Homo sapiens
ctggtcacaggactctgcctc

SEQ ID NO: 1074806 - DNA, 18 bp, Homo sapiens
ctggtcaccaaggcagtg

SEQ ID NO: 1074807 - DNA, 20 bp, Homo sapiens
ctggtcaccaaggcagtgca

SEQ ID NO: 1074808 - DNA, 22 bp, Homo sapiens
ctggtcaccaaggcagtgcatg

SEQ ID NO: 1074809 - DNA, 19 bp, Homo sapiens
ctggtcaccctggggctgc

SEQ ID NO: 1074810 - DNA, 19 bp, Homo sapiens
ctggtcaccttgcactcct

SEQ ID NO: 1074811 - DNA, 22 bp, Homo sapiens
ctggtcaccttgcactcctcac

SEQ ID NO: 1074812 - DNA, 18 bp, Homo sapiens
ctggtcactctgccctct

SEQ ID NO: 1074813 - DNA, 24 bp, Homo sapiens
ctggtcactctgccctctgctgct

SEQ ID NO: 1074814 - DNA, 18 bp, Homo sapiens
ctggtcagagagacctca

SEQ ID NO: 1074815 - DNA, 22 bp, Homo sapiens
ctggtcagagagacctcatcct

SEQ ID NO: 1074816 - DNA, 13 bp, Homo sapiens
ctggtcagagtgg

SEQ ID NO: 1074817 - DNA, 15 bp, Homo sapiens
ctggtcagggcagtg

SEQ ID NO: 1074818 - DNA, 17 bp, Homo sapiens
ctggtcagggcagtggc

SEQ ID NO: 1074819 - DNA, 18 bp, Homo sapiens
ctggtcagggcagtggcc

SEQ ID NO: 1074820 - DNA, 21 bp, Homo sapiens
ctggtcagggcagtggccaag

SEQ ID NO: 1074821 - DNA, 13 bp, Homo sapiens
ctggtcaggtccc

SEQ ID NO: 1074822 - DNA, 14 bp, Homo sapiens
ctggtcaggtcccc

SEQ ID NO: 1074823 - DNA, 18 bp, Homo sapiens
ctggtcaggtccccatgg

SEQ ID NO: 1074824 - DNA, 20 bp, Homo sapiens
ctggtcaggtccccatggct

SEQ ID NO: 1074825 - DNA, 12 bp, Homo sapiens
ctggtcagtctt

SEQ ID NO: 1074826 - DNA, 22 bp, Homo sapiens
ctggtcatccttggtgctcttg

SEQ ID NO: 1074827 - DNA, 12 bp, Homo sapiens
ctggtccagctc

SEQ ID NO: 1074828 - DNA, 13 bp, Homo sapiens
ctggtccagctct

SEQ ID NO: 1074829 - DNA, 21 bp, Homo sapiens
ctggtccagctctgacatccc

SEQ ID NO: 1074830 - DNA, 15 bp, Homo sapiens
ctggtccagggaagc

SEQ ID NO: 1074831 - DNA, 16 bp, Homo sapiens
ctggtccatgatggag

SEQ ID NO: 1074832 - DNA, 18 bp, Homo sapiens
ctggtccatgcagggggc

SEQ ID NO: 1074833 - DNA, 19 bp, Homo sapiens
ctggtcccacgagggtgcc

SEQ ID NO: 1074834 - DNA, 15 bp, Homo sapiens
ctggtccccactgct

SEQ ID NO: 1074835 - DNA, 20 bp, Homo sapiens
ctggtccccactgctgagct

SEQ ID NO: 1074836 - DNA, 14 bp, Homo sapiens
ctggtcccctgtgg

SEQ ID NO: 1074837 - DNA, 15 bp, Homo sapiens
ctggtcccctgtggt

SEQ ID NO: 1074838 - DNA, 20 bp, Homo sapiens
ctggtccctcttctctcctc

SEQ ID NO: 1074839 - DNA, 16 bp, Homo sapiens
ctggtccgtgggacgg

SEQ ID NO: 1074840 - DNA, 21 bp, Homo sapiens
ctggtccgtgggacggtgccc

SEQ ID NO: 1074841 - DNA, 21 bp, Homo sapiens
ctggtcctaggtcctctgagg

SEQ ID NO: 1074842 - DNA, 23 bp, Homo sapiens
ctggtcctaggtcctctgaggca

SEQ ID NO: 1074843 - DNA, 21 bp, Homo sapiens
ctggtcctccactttgctggt

SEQ ID NO: 1074844 - DNA, 12 bp, Homo sapiens
ctggtcctcgga

SEQ ID NO: 1074845 - DNA, 16 bp, Homo sapiens
ctggtcctcggagctg

SEQ ID NO: 1074846 - DNA, 21 bp, Homo sapiens
ctggtcctggacacctcccag

SEQ ID NO: 1074847 - DNA, 14 bp, Homo sapiens
ctggtcctggctgc

SEQ ID NO: 1074848 - DNA, 15 bp, Homo sapiens
ctggtcctggctgca

SEQ ID NO: 1074849 - DNA, 16 bp, Homo sapiens
ctggtcctggctgcac

SEQ ID NO: 1074850 - DNA, 17 bp, Homo sapiens
ctggtcctggctgcact

SEQ ID NO: 1074851 - DNA, 22 bp, Homo sapiens
ctggtcctggctgcactcttga

SEQ ID NO: 1074852 - DNA, 13 bp, Homo sapiens
ctggtccttattt

SEQ ID NO: 1074853 - DNA, 14 bp, Homo sapiens
ctggtccttattta

SEQ ID NO: 1074854 - DNA, 17 bp, Homo sapiens
ctggtccttccaggccc

SEQ ID NO: 1074855 - DNA, 19 bp, Homo sapiens
ctggtccttccaggccccc

SEQ ID NO: 1074856 - DNA, 15 bp, Homo sapiens
ctggtctaatgtttg

SEQ ID NO: 1074857 - DNA, 17 bp, Homo sapiens
ctggtctattttgattt

SEQ ID NO: 1074858 - DNA, 23 bp, Homo sapiens
ctggtctcaaactcctgacctca

SEQ ID NO: 1074859 - DNA, 22 bp, Homo sapiens
ctggtctcgaactcctgacctc

SEQ ID NO: 1074860 - DNA, 19 bp, Homo sapiens
ctggtctcttcaccactgt

SEQ ID NO: 1074861 - DNA, 18 bp, Homo sapiens
ctggtctgaggatgtaga

SEQ ID NO: 1074862 - DNA, 18 bp, Homo sapiens
ctggtctgccaggggctt

SEQ ID NO: 1074863 - DNA, 18 bp, Homo sapiens
ctggtctggagtcccacc

SEQ ID NO: 1074864 - DNA, 21 bp, Homo sapiens
ctggtctggagtcccacccgg

SEQ ID NO: 1074865 - DNA, 17 bp, Homo sapiens
ctggtctgtgaagagcc

SEQ ID NO: 1074866 - DNA, 19 bp, Homo sapiens
ctggtctgtggagatggac

SEQ ID NO: 1074867 - DNA, 23 bp, Homo sapiens
ctggtcttcactttcctcagttg

SEQ ID NO: 1074868 - DNA, 14 bp, Homo sapiens
ctggtcttgagatg

SEQ ID NO: 1074869 - DNA, 16 bp, Homo sapiens
ctggtcttttctccta

SEQ ID NO: 1074870 - DNA, 17 bp, Homo sapiens
ctggtgaacactgtgac

SEQ ID NO: 1074871 - DNA, 18 bp, Homo sapiens
ctggtgaacactgtgacc

SEQ ID NO: 1074872 - DNA, 19 bp, Homo sapiens
ctggtgaacactgtgacca

SEQ ID NO: 1074873 - DNA, 20 bp, Homo sapiens
ctggtgaagctcacttctgg

SEQ ID NO: 1074874 - DNA, 15 bp, Homo sapiens
ctggtgacagccttg

SEQ ID NO: 1074875 - DNA, 17 bp, Homo sapiens
ctggtgacagccttggg

SEQ ID NO: 1074876 - DNA, 13 bp, Homo sapiens
ctggtgacctcct

SEQ ID NO: 1074877 - DNA, 21 bp, Homo sapiens
ctggtgactgcgatcttcaga

SEQ ID NO: 1074878 - DNA, 22 bp, Homo sapiens
ctggtgactgcgatcttcagag

SEQ ID NO: 1074879 - DNA, 16 bp, Homo sapiens
ctggtgagaccccgca

SEQ ID NO: 1074880 - DNA, 14 bp, Homo sapiens
ctggtgaggcccag

SEQ ID NO: 1074881 - DNA, 16 bp, Homo sapiens
ctggtgaggcccagcc

SEQ ID NO: 1074882 - DNA, 17 bp, Homo sapiens
ctggtgaggcccagcct

SEQ ID NO: 1074883 - DNA, 19 bp, Homo sapiens
ctggtgaggcccagcctgt

SEQ ID NO: 1074884 - DNA, 14 bp, Homo sapiens
ctggtgaggtggcc

SEQ ID NO: 1074885 - DNA, 16 bp, Homo sapiens
ctggtgaggtggccca

SEQ ID NO: 1074886 - DNA, 19 bp, Homo sapiens
ctggtgaggtggcccaggc

SEQ ID NO: 1074887 - DNA, 17 bp, Homo sapiens
ctggtgatgttgaaata

SEQ ID NO: 1074888 - DNA, 17 bp, Homo sapiens
ctggtgcaaattcagaa

SEQ ID NO: 1074889 - DNA, 22 bp, Homo sapiens
ctggtgcaattacagcaaaaag

SEQ ID NO: 1074890 - DNA, 20 bp, Homo sapiens
ctggtgcacgcctgagcgtc

SEQ ID NO: 1074891 - DNA, 15 bp, Homo sapiens
ctggtgcattacaga

SEQ ID NO: 1074892 - DNA, 16 bp, Homo sapiens
ctggtgcattacagag

SEQ ID NO: 1074893 - DNA, 14 bp, Homo sapiens
ctggtgcattctgt

SEQ ID NO: 1074894 - DNA, 13 bp, Homo sapiens
ctggtgccagcct

SEQ ID NO: 1074895 - DNA, 17 bp, Homo sapiens
ctggtgccagccttcct

SEQ ID NO: 1074896 - DNA, 21 bp, Homo sapiens
ctggtgccagccttcctctgc

SEQ ID NO: 1074897 - DNA, 16 bp, Homo sapiens
ctggtgcccacagcag

SEQ ID NO: 1074898 - DNA, 17 bp, Homo sapiens
ctggtgcccacagcagg

SEQ ID NO: 1074899 - DNA, 16 bp, Homo sapiens
ctggtgccccacagct

SEQ ID NO: 1074900 - DNA, 20 bp, Homo sapiens
ctggtgccccacagctacct

SEQ ID NO: 1074901 - DNA, 12 bp, Homo sapiens
ctggtgcctcct

SEQ ID NO: 1074902 - DNA, 12 bp, Homo sapiens
ctggtgcctctg

SEQ ID NO: 1074903 - DNA, 15 bp, Homo sapiens
ctggtgcctctgtgc

SEQ ID NO: 1074904 - DNA, 18 bp, Homo sapiens
ctggtgctcctgcccagc

SEQ ID NO: 1074905 - DNA, 19 bp, Homo sapiens
ctggtgctcctgcccagcc

SEQ ID NO: 1074906 - DNA, 21 bp, Homo sapiens
ctggtgctcgggaagggaggg

SEQ ID NO: 1074907 - DNA, 18 bp, Homo sapiens
ctggtgctctctgccact

SEQ ID NO: 1074908 - DNA, 13 bp, Homo sapiens
ctggtgctgccac

SEQ ID NO: 1074909 - DNA, 14 bp, Homo sapiens
ctggtgctgcctct

SEQ ID NO: 1074910 - DNA, 12 bp, Homo sapiens
ctggtgctgctg

SEQ ID NO: 1074911 - DNA, 20 bp, Homo sapiens
ctggtgctggatattttcaa

SEQ ID NO: 1074912 - DNA, 16 bp, Homo sapiens
ctggtgctgtggccag

SEQ ID NO: 1074913 - DNA, 18 bp, Homo sapiens
ctggtgctgtggccaggg

SEQ ID NO: 1074914 - DNA, 21 bp, Homo sapiens
ctggtggagaaagcactgacc

SEQ ID NO: 1074915 - DNA, 16 bp, Homo sapiens
ctggtggaggagctga

SEQ ID NO: 1074916 - DNA, 23 bp, Homo sapiens
ctggtggaggagctgagggaggg

SEQ ID NO: 1074917 - DNA, 15 bp, Homo sapiens
ctgtagccacagctg

SEQ ID NO: 1074918 - DNA, 18 bp, Homo sapiens
ctgtagccacagctgctg

SEQ ID NO: 1074919 - DNA, 12 bp, Homo sapiens
ctgtagccatgg

SEQ ID NO: 1074920 - DNA, 20 bp, Homo sapiens
ctgtagccatggctcaggca

SEQ ID NO: 1074921 - DNA, 18 bp, Homo sapiens
ctgtagccccagtgacag

SEQ ID NO: 1074922 - DNA, 23 bp, Homo sapiens
ctgtagcctaaaacgaatggtct

SEQ ID NO: 1074923 - DNA, 21 bp, Homo sapiens
ctgtagctattagcggctcct

SEQ ID NO: 1074924 - DNA, 22 bp, Homo sapiens
ctgtagctattagcggctcctc

SEQ ID NO: 1074925 - DNA, 12 bp, Homo sapiens
ctgtagctcagt

SEQ ID NO: 1074926 - DNA, 16 bp, Homo sapiens
ctgtagctcagtcatc

SEQ ID NO: 1074927 - DNA, 22 bp, Homo sapiens
ctgtagctcagtcatcaaagca

SEQ ID NO: 1074928 - DNA, 15 bp, Homo sapiens
ctgtagctctgcctc

SEQ ID NO: 1074929 - DNA, 20 bp, Homo sapiens
ctgtagctctgcctccctct

SEQ ID NO: 1074930 - DNA, 22 bp, Homo sapiens
ctgtagctgatgaaactcctga

SEQ ID NO: 1074931 - DNA, 18 bp, Homo sapiens
ctgtagcttgttccctgt

SEQ ID NO: 1074932 - DNA, 14 bp, Homo sapiens
ctgtaggaaaccca

SEQ ID NO: 1074933 - DNA, 18 bp, Homo sapiens
ctgtaggaaggttaatgt

SEQ ID NO: 1074934 - DNA, 15 bp, Homo sapiens
ctgtaggcagaggct

SEQ ID NO: 1074935 - DNA, 22 bp, Homo sapiens
ctgtaggcctcaggtgaaactc

SEQ ID NO: 1074936 - DNA, 18 bp, Homo sapiens
ctgtagggaaaccttgga

SEQ ID NO: 1074937 - DNA, 21 bp, Homo sapiens
ctgtagggaattcttctgtta

SEQ ID NO: 1074938 - DNA, 18 bp, Homo sapiens
ctgtagggagaagcttta

SEQ ID NO: 1074939 - DNA, 16 bp, Homo sapiens
ctgtagggctggacct

SEQ ID NO: 1074940 - DNA, 17 bp, Homo sapiens
ctgtagggctggaccta

SEQ ID NO: 1074941 - DNA, 21 bp, Homo sapiens
ctgtagggctggacctatgtc

SEQ ID NO: 1074942 - DNA, 17 bp, Homo sapiens
ctgtaggtgtctctggg

SEQ ID NO: 1074943 - DNA, 21 bp, Homo sapiens
ctgtaggtgtctctgggcctg

SEQ ID NO: 1074944 - DNA, 18 bp, Homo sapiens
ctgtaggttatttaaaat

SEQ ID NO: 1074945 - DNA, 20 bp, Homo sapiens
ctgtaggttcatgcccaagc

SEQ ID NO: 1074946 - DNA, 21 bp, Homo sapiens
ctgtagtagccctttctgtgt

SEQ ID NO: 1074947 - DNA, 15 bp, Homo sapiens
ctgtagtcccagcca

SEQ ID NO: 1074948 - DNA, 22 bp, Homo sapiens
ctgtagtcccagctactcggga

SEQ ID NO: 1074949 - DNA, 14 bp, Homo sapiens
ctgtagtctcagtt

SEQ ID NO: 1074950 - DNA, 17 bp, Homo sapiens
ctgtagtgagaaactga

SEQ ID NO: 1074951 - DNA, 22 bp, Homo sapiens
ctgtagtgagatagcattgtga

SEQ ID NO: 1074952 - DNA, 16 bp, Homo sapiens
ctgtagtgtattaatc

SEQ ID NO: 1074953 - DNA, 21 bp, Homo sapiens
ctgtagtgtattaatctctgt

SEQ ID NO: 1074954 - DNA, 21 bp, Homo sapiens
ctgtagtttatggcagaaggg

SEQ ID NO: 1074955 - DNA, 21 bp, Homo sapiens
ctgtagtttttgaaaattatg

SEQ ID NO: 1074956 - DNA, 20 bp, Homo sapiens
ctgtataagacactttgcca

SEQ ID NO: 1074957 - DNA, 15 bp, Homo sapiens
ctgtataagcactga

SEQ ID NO: 1074958 - DNA, 16 bp, Homo sapiens
ctgtataagtaagaaa

SEQ ID NO: 1074959 - DNA, 22 bp, Homo sapiens
ctgtataagtggaggcacttta

SEQ ID NO: 1074960 - DNA, 13 bp, Homo sapiens
ctgtatacagtgc

SEQ ID NO: 1074961 - DNA, 21 bp, Homo sapiens
ctgtatacagtgcagagcctt

SEQ ID NO: 1074962 - DNA, 15 bp, Homo sapiens
ctgtatactgtaaaa

SEQ ID NO: 1074963 - DNA, 16 bp, Homo sapiens
ctgtatactgtaaaag

SEQ ID NO: 1074964 - DNA, 18 bp, Homo sapiens
ctgtatactgtaaaagtt

SEQ ID NO: 1074965 - DNA, 20 bp, Homo sapiens
ctgtatactgtaaaagttat

SEQ ID NO: 1074966 - DNA, 14 bp, Homo sapiens
ctgtatagacatgc

SEQ ID NO: 1074967 - DNA, 16 bp, Homo sapiens
ctgtatagttaggata

SEQ ID NO: 1074968 - DNA, 15 bp, Homo sapiens
ctgtatataaaataa

SEQ ID NO: 1074969 - DNA, 18 bp, Homo sapiens
ctgtatatacaataacat

SEQ ID NO: 1074970 - DNA, 19 bp, Homo sapiens
ctgtatatacaataacata

SEQ ID NO: 1074971 - DNA, 23 bp, Homo sapiens
ctgtatatacaataacataattt

SEQ ID NO: 1074972 - DNA, 13 bp, Homo sapiens
ctgtatatacttt

SEQ ID NO: 1074973 - DNA, 14 bp, Homo sapiens
ctgtatatactttt

SEQ ID NO: 1074974 - DNA, 19 bp, Homo sapiens
ctgtatatgattatggcct

SEQ ID NO: 1074975 - DNA, 18 bp, Homo sapiens
ctgtatatgattctctgt

SEQ ID NO: 1074976 - DNA, 22 bp, Homo sapiens
ctgtatattacagatatttgtc

SEQ ID NO: 1074977 - DNA, 19 bp, Homo sapiens
ctgtatattccatgtataa

SEQ ID NO: 1074978 - DNA, 14 bp, Homo sapiens
ctgtatatttgtca

SEQ ID NO: 1074979 - DNA, 16 bp, Homo sapiens
ctgtatatttgtcatg

SEQ ID NO: 1074980 - DNA, 17 bp, Homo sapiens
ctgtatatttgtcatga

SEQ ID NO: 1074981 - DNA, 16 bp, Homo sapiens
ctgtatcaggacccag

SEQ ID NO: 1074982 - DNA, 22 bp, Homo sapiens
ctgtatcaggacccagaggaag

SEQ ID NO: 1074983 - DNA, 17 bp, Homo sapiens
ctgtatcggagacagtg

SEQ ID NO: 1074984 - DNA, 14 bp, Homo sapiens
ctgtatctgtaatt

SEQ ID NO: 1074985 - DNA, 13 bp, Homo sapiens
ctgtatctgtgta

SEQ ID NO: 1074986 - DNA, 18 bp, Homo sapiens
ctgtatctgtgtagacta

SEQ ID NO: 1074987 - DNA, 12 bp, Homo sapiens
ctgtatgattta

SEQ ID NO: 1074988 - DNA, 16 bp, Homo sapiens
ctgtatgccttctgta

SEQ ID NO: 1074989 - DNA, 22 bp, Homo sapiens
ctgtatgctgatcatcgccaga

SEQ ID NO: 1074990 - DNA, 20 bp, Homo sapiens
ctgtatgtctcgtggtagga

SEQ ID NO: 1074991 - DNA, 23 bp, Homo sapiens
ctgtatgtgtgtaggttatcttt

SEQ ID NO: 1074992 - DNA, 13 bp, Homo sapiens
ctgtatgttgtcc

SEQ ID NO: 1074993 - DNA, 15 bp, Homo sapiens
ctgtattaaatctta

SEQ ID NO: 1074994 - DNA, 20 bp, Homo sapiens
ctgtattaaatcttaaacaa

SEQ ID NO: 1074995 - DNA, 15 bp, Homo sapiens
ctgtattaagccact

SEQ ID NO: 1074996 - DNA, 21 bp, Homo sapiens
ctgtattactgaataatatca

SEQ ID NO: 1074997 - DNA, 13 bp, Homo sapiens
ctgtattctagtg

SEQ ID NO: 1074998 - DNA, 18 bp, Homo sapiens
ctgtattctagtggctgt

SEQ ID NO: 1074999 - DNA, 22 bp, Homo sapiens
ctgtattctagtggctgttcat

SEQ ID NO: 1075000 - DNA, 23 bp, Homo sapiens
ctgtattctagtggctgttcatg

SEQ ID NO: 1075001 - DNA, 16 bp, Homo sapiens
ctgtattcttgtttga

SEQ ID NO: 1075002 - DNA, 15 bp, Homo sapiens
ctgtccacatgacct

SEQ ID NO: 1075003 - DNA, 18 bp, Homo sapiens
ctgtccacatgacctcca

SEQ ID NO: 1075004 - DNA, 19 bp, Homo sapiens
ctgtccacatgacctccat

SEQ ID NO: 1075005 - DNA, 15 bp, Homo sapiens
ctgtccaccagaccc

SEQ ID NO: 1075006 - DNA, 13 bp, Homo sapiens
ctgtccaccagtt

SEQ ID NO: 1075007 - DNA, 19 bp, Homo sapiens
ctgtccacctgtgctgctg

SEQ ID NO: 1075008 - DNA, 12 bp, Homo sapiens
ctgtccactctc

SEQ ID NO: 1075009 - DNA, 22 bp, Homo sapiens
ctgtccactctcggggcccttg

SEQ ID NO: 1075010 - DNA, 15 bp, Homo sapiens
ctgtccagcccccag

SEQ ID NO: 1075011 - DNA, 13 bp, Homo sapiens
ctgtccagcctgg

SEQ ID NO: 1075012 - DNA, 17 bp, Homo sapiens
ctgtccagcctgggcag

SEQ ID NO: 1075013 - DNA, 13 bp, Homo sapiens
ctgtccagcctta

SEQ ID NO: 1075014 - DNA, 13 bp, Homo sapiens
ctgtccagctggg

SEQ ID NO: 1075015 - DNA, 17 bp, Homo sapiens
ctgtccaggcactgctg

SEQ ID NO: 1075016 - DNA, 21 bp, Homo sapiens
ctgtccaggcactgctgccca

SEQ ID NO: 1075017 - DNA, 21 bp, Homo sapiens
ctgtccaggcagctccctcct

SEQ ID NO: 1075018 - DNA, 14 bp, Homo sapiens
ctgtccaggccact

SEQ ID NO: 1075019 - DNA, 15 bp, Homo sapiens
ctgtccaggccactg

SEQ ID NO: 1075020 - DNA, 18 bp, Homo sapiens
ctgtccagggccctgagc

SEQ ID NO: 1075021 - DNA, 20 bp, Homo sapiens
ctgtccagggccctgagctc

SEQ ID NO: 1075022 - DNA, 23 bp, Homo sapiens
ctgtccagggccctgagctcggt

SEQ ID NO: 1075023 - DNA, 20 bp, Homo sapiens
ctgtccaggtgagtgtgagg

SEQ ID NO: 1075024 - DNA, 18 bp, Homo sapiens
ctgtccatctgtctgtcc

SEQ ID NO: 1075025 - DNA, 18 bp, Homo sapiens
ctgtcccaccaactctgc

SEQ ID NO: 1075026 - DNA, 20 bp, Homo sapiens
ctgtcccaccaactctgcac

SEQ ID NO: 1075027 - DNA, 21 bp, Homo sapiens
ctgtcccaccaactctgcact

SEQ ID NO: 1075028 - DNA, 23 bp, Homo sapiens
ctgtcccacccacacagctgccc

SEQ ID NO: 1075029 - DNA, 19 bp, Homo sapiens
ctgtcccaccgggagcctc

SEQ ID NO: 1075030 - DNA, 13 bp, Homo sapiens
ctgtcccacctct

SEQ ID NO: 1075031 - DNA, 15 bp, Homo sapiens
ctgtcccacctcttc

SEQ ID NO: 1075032 - DNA, 21 bp, Homo sapiens
ctgtcccagagcttattggcc

SEQ ID NO: 1075033 - DNA, 23 bp, Homo sapiens
ctgtcccagagcttattggccac

SEQ ID NO: 1075034 - DNA, 13 bp, Homo sapiens
ctgtcccagaggt

SEQ ID NO: 1075035 - DNA, 13 bp, Homo sapiens
ctgtcccagcccc

SEQ ID NO: 1075036 - DNA, 22 bp, Homo sapiens
ctgtcccagccccggcaagcca

SEQ ID NO: 1075037 - DNA, 19 bp, Homo sapiens
ctgtcccaggcatgcagct

SEQ ID NO: 1075038 - DNA, 20 bp, Homo sapiens
ctgtcccaggcatgcagctg

SEQ ID NO: 1075039 - DNA, 22 bp, Homo sapiens
ctgtcccaggcatgcagctgcc

SEQ ID NO: 1075040 - DNA, 12 bp, Homo sapiens
ctgtcccaggcc

SEQ ID NO: 1075041 - DNA, 15 bp, Homo sapiens
ctgtcccatccccag

SEQ ID NO: 1075042 - DNA, 15 bp, Homo sapiens
ctgtcccatgcaggc

SEQ ID NO: 1075043 - DNA, 17 bp, Homo sapiens
ctgtcccatggacactc

SEQ ID NO: 1075044 - DNA, 23 bp, Homo sapiens
ctgtcccattccctgggatctgg

SEQ ID NO: 1075045 - DNA, 23 bp, Homo sapiens
ctgtccccaacaggaatttttaa

SEQ ID NO: 1075046 - DNA, 12 bp, Homo sapiens
ctgtccccaaga

SEQ ID NO: 1075047 - DNA, 23 bp, Homo sapiens
ctgtccccaagacacttcccctt

SEQ ID NO: 1075048 - DNA, 22 bp, Homo sapiens
ctgtccccacctaagcctggtg

SEQ ID NO: 1075049 - DNA, 15 bp, Homo sapiens
ctgtccccacgaggg

SEQ ID NO: 1075050 - DNA, 17 bp, Homo sapiens
ctgtccccacgagggga

SEQ ID NO: 1075051 - DNA, 22 bp, Homo sapiens
ctgtcctgcagtcccacactgt

SEQ ID NO: 1075052 - DNA, 12 bp, Homo sapiens
ctgtcctgcctc

SEQ ID NO: 1075053 - DNA, 14 bp, Homo sapiens
ctgtcctgcctcct

SEQ ID NO: 1075054 - DNA, 16 bp, Homo sapiens
ctgtcctgcctcctca

SEQ ID NO: 1075055 - DNA, 17 bp, Homo sapiens
ctgtcctgcctcctcat

SEQ ID NO: 1075056 - DNA, 14 bp, Homo sapiens
ctgtcctgcgttca

SEQ ID NO: 1075057 - DNA, 20 bp, Homo sapiens
ctgtcctgcgttcagcccct

SEQ ID NO: 1075058 - DNA, 21 bp, Homo sapiens
ctgtcctgcgttcagcccctg

SEQ ID NO: 1075059 - DNA, 21 bp, Homo sapiens
ctgtcctggaacctgtctcca

SEQ ID NO: 1075060 - DNA, 22 bp, Homo sapiens
ctgtcctgggcatgggtccagg

SEQ ID NO: 1075061 - DNA, 12 bp, Homo sapiens
ctgtcctgggcg

SEQ ID NO: 1075062 - DNA, 23 bp, Homo sapiens
ctgtcctgggcgccctggaagcc

SEQ ID NO: 1075063 - DNA, 19 bp, Homo sapiens
ctgtcctggtggtattttc

SEQ ID NO: 1075064 - DNA, 20 bp, Homo sapiens
ctgtcctggtggtattttca

SEQ ID NO: 1075065 - DNA, 21 bp, Homo sapiens
ctgtcctggtggtattttcaa

SEQ ID NO: 1075066 - DNA, 18 bp, Homo sapiens
ctgtcctgttttcttagg

SEQ ID NO: 1075067 - DNA, 17 bp, Homo sapiens
ctgtccttagactcctt

SEQ ID NO: 1075068 - DNA, 17 bp, Homo sapiens
ctgtccttcagatggaa

SEQ ID NO: 1075069 - DNA, 21 bp, Homo sapiens
ctgtccttccctgttctccct

SEQ ID NO: 1075070 - DNA, 22 bp, Homo sapiens
ctgtccttccctgttctccctt

SEQ ID NO: 1075071 - DNA, 17 bp, Homo sapiens
ctgtccttgaaaaacaa

SEQ ID NO: 1075072 - DNA, 14 bp, Homo sapiens
ctgtccttttagga

SEQ ID NO: 1075073 - DNA, 15 bp, Homo sapiens
ctgtccttttaggaa

SEQ ID NO: 1075074 - DNA, 14 bp, Homo sapiens
ctgtcgagacactt

SEQ ID NO: 1075075 - DNA, 18 bp, Homo sapiens
ctgtcgagacacttgcct

SEQ ID NO: 1075076 - DNA, 17 bp, Homo sapiens
ctgtcgattagactgga

SEQ ID NO: 1075077 - DNA, 19 bp, Homo sapiens
ctgtcgattagactggaca

SEQ ID NO: 1075078 - DNA, 23 bp, Homo sapiens
ctgtcgattagactggacagctt

SEQ ID NO: 1075079 - DNA, 17 bp, Homo sapiens
ctgtcgcccacccagct

SEQ ID NO: 1075080 - DNA, 18 bp, Homo sapiens
ctgtcgcccacccagctg

SEQ ID NO: 1075081 - DNA, 16 bp, Homo sapiens
ctgtcgccccaggccc

SEQ ID NO: 1075082 - DNA, 18 bp, Homo sapiens
ctgtcgccccaggccctc

SEQ ID NO: 1075083 - DNA, 22 bp, Homo sapiens
ctgtcgccccaggccctccctg

SEQ ID NO: 1075084 - DNA, 16 bp, Homo sapiens
ctgtcggagaggctgt

SEQ ID NO: 1075085 - DNA, 13 bp, Homo sapiens
ctgtcgggaccac

SEQ ID NO: 1075086 - DNA, 14 bp, Homo sapiens
ctgtcgggaccaca

SEQ ID NO: 1075087 - DNA, 18 bp, Homo sapiens
ctgtcgggaccacatctg

SEQ ID NO: 1075088 - DNA, 12 bp, Homo sapiens
ctgtcgtctgac

SEQ ID NO: 1075089 - DNA, 14 bp, Homo sapiens
ctgtcgtctgactc

SEQ ID NO: 1075090 - DNA, 16 bp, Homo sapiens
ctgtcgtctgactctg

SEQ ID NO: 1075091 - DNA, 19 bp, Homo sapiens
ctgtcgtctgactctgggt

SEQ ID NO: 1075092 - DNA, 19 bp, Homo sapiens
ctgtctaaagccttaacta

SEQ ID NO: 1075093 - DNA, 16 bp, Homo sapiens
ctgtctaacctgtgac

SEQ ID NO: 1075094 - DNA, 19 bp, Homo sapiens
ctgtctaatttgcaccttt

SEQ ID NO: 1075095 - DNA, 21 bp, Homo sapiens
ctgtctacagtagctgctacc

SEQ ID NO: 1075096 - DNA, 16 bp, Homo sapiens
ctgtctagaatgtgga

SEQ ID NO: 1075097 - DNA, 18 bp, Homo sapiens
ctgtctagagagggaggc

SEQ ID NO: 1075098 - DNA, 18 bp, Homo sapiens
ctgtctaggactgcagtg

SEQ ID NO: 1075099 - DNA, 23 bp, Homo sapiens
ctgtctaggttaaagctaaactg

SEQ ID NO: 1075100 - DNA, 22 bp, Homo sapiens
ctgtctcaagagggcactggtg

SEQ ID NO: 1075101 - DNA, 23 bp, Homo sapiens
ctgtctcaagagggcactggtgg

SEQ ID NO: 1075102 - DNA, 12 bp, Homo sapiens
ctgtctcacctg

SEQ ID NO: 1075103 - DNA, 14 bp, Homo sapiens
ctgtctcacctgga

SEQ ID NO: 1075104 - DNA, 23 bp, Homo sapiens
ctgtctcactttttacccagaac

SEQ ID NO: 1075105 - DNA, 16 bp, Homo sapiens
ctgtctcagcctccca

SEQ ID NO: 1075106 - DNA, 18 bp, Homo sapiens
ctgtctcatcacataaaa

SEQ ID NO: 1075107 - DNA, 17 bp, Homo sapiens
ctgtctcatccccaggg

SEQ ID NO: 1075108 - DNA, 21 bp, Homo sapiens
ctgtctcatccccaggggtcc

SEQ ID NO: 1075109 - DNA, 14 bp, Homo sapiens
ctgtctcatcctcc

SEQ ID NO: 1075110 - DNA, 17 bp, Homo sapiens
ctgtctcatcctcctgg

SEQ ID NO: 1075111 - DNA, 22 bp, Homo sapiens
ctgtctcatcctcctggaacct

SEQ ID NO: 1075112 - DNA, 12 bp, Homo sapiens
ctgtctccagac

SEQ ID NO: 1075113 - DNA, 22 bp, Homo sapiens
ctgtctccagacccccacccct

SEQ ID NO: 1075114 - DNA, 16 bp, Homo sapiens
ctgtctccagctgcct

SEQ ID NO: 1075115 - DNA, 21 bp, Homo sapiens
ctgtctccagctgcctgggcc

SEQ ID NO: 1075116 - DNA, 21 bp, Homo sapiens
ctgtctccagggcccccaccg

SEQ ID NO: 1075117 - DNA, 15 bp, Homo sapiens
ctgtctccatgctgg

SEQ ID NO: 1075118 - DNA, 20 bp, Homo sapiens
ctgtctccatggccctgcaa

SEQ ID NO: 1075119 - DNA, 16 bp, Homo sapiens
ctgtctcccaggctgg

SEQ ID NO: 1075120 - DNA, 19 bp, Homo sapiens
ctgtctccctccccaaatg

SEQ ID NO: 1075121 - DNA, 21 bp, Homo sapiens
ctgtctccctcccctctcaga

SEQ ID NO: 1075122 - DNA, 16 bp, Homo sapiens
ctgtctcctccctggg

SEQ ID NO: 1075123 - DNA, 14 bp, Homo sapiens
ctgtctcgatgcct

SEQ ID NO: 1075124 - DNA, 18 bp, Homo sapiens
ctgtctcgggctgaccct

SEQ ID NO: 1075125 - DNA, 21 bp, Homo sapiens
ctgtctcgggctgaccctttt

SEQ ID NO: 1075126 - DNA, 22 bp, Homo sapiens
ctgtctcgggctgacccttttc

SEQ ID NO: 1075127 - DNA, 19 bp, Homo sapiens
ctgtctctaaccattcaaa

SEQ ID NO: 1075128 - DNA, 14 bp, Homo sapiens
ctgtctctactaaa

SEQ ID NO: 1075129 - DNA, 20 bp, Homo sapiens
ctgtctctccccctctgtct

SEQ ID NO: 1075130 - DNA, 21 bp, Homo sapiens
ctgtctctcctagcccctctc

SEQ ID NO: 1075131 - DNA, 15 bp, Homo sapiens
ctgtctctgcacaga

SEQ ID NO: 1075132 - DNA, 16 bp, Homo sapiens
ctgtctctgcctccct

SEQ ID NO: 1075133 - DNA, 17 bp, Homo sapiens
ctgtctctgcctgcggc

SEQ ID NO: 1075134 - DNA, 13 bp, Homo sapiens
ctgtctctgctcg

SEQ ID NO: 1075135 - DNA, 14 bp, Homo sapiens
ctgtctctgtggaa

SEQ ID NO: 1075136 - DNA, 14 bp, Homo sapiens
ctgtctcttggctt

SEQ ID NO: 1075137 - DNA, 15 bp, Homo sapiens
ctgtctcttttctct

SEQ ID NO: 1075138 - DNA, 16 bp, Homo sapiens
ctgtctgaatgatctt

SEQ ID NO: 1075139 - DNA, 21 bp, Homo sapiens
ctgtctgaggagtaagtgtac

SEQ ID NO: 1075140 - DNA, 19 bp, Homo sapiens
ctgtctgcagtgcccggct

SEQ ID NO: 1075141 - DNA, 14 bp, Homo sapiens
ctgtctgccagcca

SEQ ID NO: 1075142 - DNA, 20 bp, Homo sapiens
ctgtctgccagccagcagcc

SEQ ID NO: 1075143 - DNA, 15 bp, Homo sapiens
ctgtctgccaggcac

SEQ ID NO: 1075144 - DNA, 13 bp, Homo sapiens
ctgtctgccccag

SEQ ID NO: 1075145 - DNA, 15 bp, Homo sapiens
ctgtctgccccagcc

SEQ ID NO: 1075146 - DNA, 21 bp, Homo sapiens
ctgtctgcgtctgctcttctg

SEQ ID NO: 1075147 - DNA, 20 bp, Homo sapiens
ctgtctggaagacgtggctc

SEQ ID NO: 1075148 - DNA, 22 bp, Homo sapiens
ctgtctggctcggacccacccc

SEQ ID NO: 1075149 - DNA, 23 bp, Homo sapiens
ctgtctggctcggacccacccca

SEQ ID NO: 1075150 - DNA, 13 bp, Homo sapiens
ctgtctgggatta

SEQ ID NO: 1075151 - DNA, 20 bp, Homo sapiens
ctgtctggggccccatcagc

SEQ ID NO: 1075152 - DNA, 22 bp, Homo sapiens
ctgtctggggccccatcagctg

SEQ ID NO: 1075153 - DNA, 13 bp, Homo sapiens
ctgtctggggcct

SEQ ID NO: 1075154 - DNA, 19 bp, Homo sapiens
ctgtgaccaccttctgtcc

SEQ ID NO: 1075155 - DNA, 22 bp, Homo sapiens
ctgtgaccaccttctgtcccca

SEQ ID NO: 1075156 - DNA, 23 bp, Homo sapiens
ctgtgaccaggaaggaagtcagc

SEQ ID NO: 1075157 - DNA, 14 bp, Homo sapiens
ctgtgaccctctca

SEQ ID NO: 1075158 - DNA, 22 bp, Homo sapiens
ctgtgacctgccccgcccagct

SEQ ID NO: 1075159 - DNA, 13 bp, Homo sapiens
ctgtgaccttggg

SEQ ID NO: 1075160 - DNA, 18 bp, Homo sapiens
ctgtgacgcagacagagg

SEQ ID NO: 1075161 - DNA, 22 bp, Homo sapiens
ctgtgactaggcatacactgta

SEQ ID NO: 1075162 - DNA, 17 bp, Homo sapiens
ctgtgactctgggcagg

SEQ ID NO: 1075163 - DNA, 19 bp, Homo sapiens
ctgtgactctgggcaggga

SEQ ID NO: 1075164 - DNA, 14 bp, Homo sapiens
ctgtgactcttttt

SEQ ID NO: 1075165 - DNA, 21 bp, Homo sapiens
ctgtgacttctccaggtctca

SEQ ID NO: 1075166 - DNA, 15 bp, Homo sapiens
ctgtgagacccccac

SEQ ID NO: 1075167 - DNA, 19 bp, Homo sapiens
ctgtgagacccccacacct

SEQ ID NO: 1075168 - DNA, 19 bp, Homo sapiens
ctgtgagagttgtctctgt

SEQ ID NO: 1075169 - DNA, 14 bp, Homo sapiens
ctgtgagcccagct

SEQ ID NO: 1075170 - DNA, 21 bp, Homo sapiens
ctgtgaggaatgctctgtgcc

SEQ ID NO: 1075171 - DNA, 13 bp, Homo sapiens
ctgtgaggcaggg

SEQ ID NO: 1075172 - DNA, 18 bp, Homo sapiens
ctgtgaggcaggggcgga

SEQ ID NO: 1075173 - DNA, 15 bp, Homo sapiens
ctgtgaggcccctgg

SEQ ID NO: 1075174 - DNA, 12 bp, Homo sapiens
ctgtgaggctgt

SEQ ID NO: 1075175 - DNA, 15 bp, Homo sapiens
ctgtgaggctgtcct

SEQ ID NO: 1075176 - DNA, 17 bp, Homo sapiens
ctgtgaggctgtcctgt

SEQ ID NO: 1075177 - DNA, 16 bp, Homo sapiens
ctgtgaggggaaggcc

SEQ ID NO: 1075178 - DNA, 14 bp, Homo sapiens
ctgtgagtaggctg

SEQ ID NO: 1075179 - DNA, 19 bp, Homo sapiens
ctgtgagtaggctgggcct

SEQ ID NO: 1075180 - DNA, 20 bp, Homo sapiens
ctgtgagtctccccttgcag

SEQ ID NO: 1075181 - DNA, 22 bp, Homo sapiens
ctgtgctgggtgagctcttcca

SEQ ID NO: 1075182 - DNA, 21 bp, Homo sapiens
ctgtgctggtgtcctgaccac

SEQ ID NO: 1075183 - DNA, 23 bp, Homo sapiens
ctgtgctggtgtcctgaccaccc

SEQ ID NO: 1075184 - DNA, 12 bp, Homo sapiens
ctgtgctgtgcc

SEQ ID NO: 1075185 - DNA, 15 bp, Homo sapiens
ctgtgctgtgcctgc

SEQ ID NO: 1075186 - DNA, 17 bp, Homo sapiens
ctgtgcttcaattaata

SEQ ID NO: 1075187 - DNA, 23 bp, Homo sapiens
ctgtgcttctcttctttattgca

SEQ ID NO: 1075188 - DNA, 17 bp, Homo sapiens
ctgtgcttgaaggccct

SEQ ID NO: 1075189 - DNA, 18 bp, Homo sapiens
ctgtgcttgaaggccctg

SEQ ID NO: 1075190 - DNA, 13 bp, Homo sapiens
ctgtgcttggcca

SEQ ID NO: 1075191 - DNA, 16 bp, Homo sapiens
ctgtgctttgagattt

SEQ ID NO: 1075192 - DNA, 17 bp, Homo sapiens
ctgtgcttttaaatgca

SEQ ID NO: 1075193 - DNA, 16 bp, Homo sapiens
ctgtggaaaagccatc

SEQ ID NO: 1075194 - DNA, 18 bp, Homo sapiens
ctgtggaaaagccatctc

SEQ ID NO: 1075195 - DNA, 14 bp, Homo sapiens
ctgtggaaagctag

SEQ ID NO: 1075196 - DNA, 15 bp, Homo sapiens
ctgtggaaatgccaa

SEQ ID NO: 1075197 - DNA, 18 bp, Homo sapiens
ctgtggaacataaaaagg

SEQ ID NO: 1075198 - DNA, 21 bp, Homo sapiens
ctgtggaacataaaaaggaca

SEQ ID NO: 1075199 - DNA, 20 bp, Homo sapiens
ctgtggaagcatggctgtct

SEQ ID NO: 1075200 - DNA, 19 bp, Homo sapiens
ctgtggaaggcctccctct

SEQ ID NO: 1075201 - DNA, 15 bp, Homo sapiens
ctgtggaatataaat

SEQ ID NO: 1075202 - DNA, 16 bp, Homo sapiens
ctgtggaatataaata

SEQ ID NO: 1075203 - DNA, 13 bp, Homo sapiens
ctgtggactgtcc

SEQ ID NO: 1075204 - DNA, 18 bp, Homo sapiens
ctgtggactgtcctgagg

SEQ ID NO: 1075205 - DNA, 13 bp, Homo sapiens
ctgtggagaaata

SEQ ID NO: 1075206 - DNA, 22 bp, Homo sapiens
ctgtggagagaagtgagcaagg

SEQ ID NO: 1075207 - DNA, 17 bp, Homo sapiens
ctgtggagatggactca

SEQ ID NO: 1075208 - DNA, 19 bp, Homo sapiens
ctgtggagcaaaaggcagc

SEQ ID NO: 1075209 - DNA, 22 bp, Homo sapiens
ctgtggagcaaaaggcagctca

SEQ ID NO: 1075210 - DNA, 22 bp, Homo sapiens
ctgtggagcccgcacccccacc

SEQ ID NO: 1075211 - DNA, 18 bp, Homo sapiens
ctgtggagctgccacaga

SEQ ID NO: 1075212 - DNA, 19 bp, Homo sapiens
ctgtggagctgccacagag

SEQ ID NO: 1075213 - DNA, 15 bp, Homo sapiens
ctgtggaggacagac

SEQ ID NO: 1075214 - DNA, 22 bp, Homo sapiens
ctgtggaggcctgatgctgccc

SEQ ID NO: 1075215 - DNA, 21 bp, Homo sapiens
ctgtggagggagggcagctgg

SEQ ID NO: 1075216 - DNA, 22 bp, Homo sapiens
ctgtggagggagtgttcaaaat

SEQ ID NO: 1075217 - DNA, 16 bp, Homo sapiens
ctgtggagtccagctc

SEQ ID NO: 1075218 - DNA, 16 bp, Homo sapiens
ctgtggagttcctgct

SEQ ID NO: 1075219 - DNA, 18 bp, Homo sapiens
ctgtggatacagtgccca

SEQ ID NO: 1075220 - DNA, 22 bp, Homo sapiens
ctgtggatacagtgcccaccgc

SEQ ID NO: 1075221 - DNA, 15 bp, Homo sapiens
ctgtggatcagagat

SEQ ID NO: 1075222 - DNA, 21 bp, Homo sapiens
ctgtggatgggatcctctcca

SEQ ID NO: 1075223 - DNA, 23 bp, Homo sapiens
ctgtggcacagacttctggaagg

SEQ ID NO: 1075224 - DNA, 13 bp, Homo sapiens
ctgtggcactggc

SEQ ID NO: 1075225 - DNA, 17 bp, Homo sapiens
ctgtggcatctttgcct

SEQ ID NO: 1075226 - DNA, 13 bp, Homo sapiens
ctgtggcatttcc

SEQ ID NO: 1075227 - DNA, 15 bp, Homo sapiens
ctgtggccacagccc

SEQ ID NO: 1075228 - DNA, 14 bp, Homo sapiens
ctgtggccagagct

SEQ ID NO: 1075229 - DNA, 18 bp, Homo sapiens
ctgtggccagagctggaa

SEQ ID NO: 1075230 - DNA, 23 bp, Homo sapiens
ctgtggccagcttgttatttata

SEQ ID NO: 1075231 - DNA, 15 bp, Homo sapiens
ctgtggccaggcctt

SEQ ID NO: 1075232 - DNA, 17 bp, Homo sapiens
ctgtggccatatatgct

SEQ ID NO: 1075233 - DNA, 17 bp, Homo sapiens
ctgtggccccaagaggg

SEQ ID NO: 1075234 - DNA, 17 bp, Homo sapiens
ctgtggccccaccctgg

SEQ ID NO: 1075235 - DNA, 20 bp, Homo sapiens
ctgtggccccaccctgggcc

SEQ ID NO: 1075236 - DNA, 22 bp, Homo sapiens
ctgtggccccatccaaccactg

SEQ ID NO: 1075237 - DNA, 10 bp, Homo sapiens
ctgtggccct

SEQ ID NO: 1075238 - DNA, 11 bp, Homo sapiens
ctgtggccctg

SEQ ID NO: 1075239 - DNA, 14 bp, Homo sapiens
ctgtggccctgccc

SEQ ID NO: 1075240 - DNA, 14 bp, Homo sapiens
ctgtggccctggag

SEQ ID NO: 1075241 - DNA, 22 bp, Homo sapiens
ctgtggccctggccactaaagc

SEQ ID NO: 1075242 - DNA, 15 bp, Homo sapiens
ctgtggccgcacgcc

SEQ ID NO: 1075243 - DNA, 22 bp, Homo sapiens
ctgtggccgcacgcctctccct

SEQ ID NO: 1075244 - DNA, 16 bp, Homo sapiens
ctgtggccgccatctg

SEQ ID NO: 1075245 - DNA, 21 bp, Homo sapiens
ctgtggccgttatctggaagt

SEQ ID NO: 1075246 - DNA, 11 bp, Homo sapiens
ctgtggcctgg

SEQ ID NO: 1075247 - DNA, 14 bp, Homo sapiens
ctgtggcctgtctc

SEQ ID NO: 1075248 - DNA, 21 bp, Homo sapiens
ctgtggcctgtgtccagcagc

SEQ ID NO: 1075249 - DNA, 22 bp, Homo sapiens
ctgtggcctgtgtccagcagct

SEQ ID NO: 1075250 - DNA, 24 bp, Homo sapiens
ctgtggcctgtgtccagcagctgc

SEQ ID NO: 1075251 - DNA, 20 bp, Homo sapiens
ctgtggcctgtgtcccatga

SEQ ID NO: 1075252 - DNA, 22 bp, Homo sapiens
ctgtggcctgtgtcccatgacc

SEQ ID NO: 1075253 - DNA, 19 bp, Homo sapiens
ctgtggcgctgcagcaggg

SEQ ID NO: 1075254 - DNA, 24 bp, Homo sapiens
ctgtggcgctgcagcagggcagga

SEQ ID NO: 1075255 - DNA, 14 bp, Homo sapiens
ctgtggcggtgcct

SEQ ID NO: 1075256 - DNA, 20 bp, Homo sapiens
ctgtggctaaacagatgtaa

SEQ ID NO: 1075257 - DNA, 14 bp, Homo sapiens
ctgtggctggctct

SEQ ID NO: 1075258 - DNA, 15 bp, Homo sapiens
ctgtggctggtgagc

SEQ ID NO: 1075259 - DNA, 16 bp, Homo sapiens
ctgtggcttggagtgg

SEQ ID NO: 1075260 - DNA, 20 bp, Homo sapiens
ctgtggcttggagtggccaa

SEQ ID NO: 1075261 - DNA, 21 bp, Homo sapiens
ctgtggctttttgttcagaat

SEQ ID NO: 1075262 - DNA, 18 bp, Homo sapiens
ctgtgggaaggccagctg

SEQ ID NO: 1075263 - DNA, 12 bp, Homo sapiens
ctgtgggaccgc

SEQ ID NO: 1075264 - DNA, 15 bp, Homo sapiens
ctgtgggaccgcctg

SEQ ID NO: 1075265 - DNA, 18 bp, Homo sapiens
ctgtgggaccgcctggcc

SEQ ID NO: 1075266 - DNA, 20 bp, Homo sapiens
ctgtgggaccgcctggccct

SEQ ID NO: 1075267 - DNA, 23 bp, Homo sapiens
ctgtgggaccgcctggccctccc

SEQ ID NO: 1075268 - DNA, 13 bp, Homo sapiens
ctgtgggaggggg

SEQ ID NO: 1075269 - DNA, 17 bp, Homo sapiens
ctgtgggcactggtggg

SEQ ID NO: 1075270 - DNA, 13 bp, Homo sapiens
ctgtgggcagcac

SEQ ID NO: 1075271 - DNA, 15 bp, Homo sapiens
ctgtgggcagcaccc

SEQ ID NO: 1075272 - DNA, 23 bp, Homo sapiens
ctgtgggcagcaccctcccccgc

SEQ ID NO: 1075273 - DNA, 16 bp, Homo sapiens
ctgtgggcagcatgcc

SEQ ID NO: 1075274 - DNA, 17 bp, Homo sapiens
ctgtgggcatggccgct

SEQ ID NO: 1075275 - DNA, 19 bp, Homo sapiens
ctgtgggcctcaaggactt

SEQ ID NO: 1075276 - DNA, 17 bp, Homo sapiens
ctgtgggcctcacctgc

SEQ ID NO: 1075277 - DNA, 15 bp, Homo sapiens
ctgtgggcttcccca

SEQ ID NO: 1075278 - DNA, 18 bp, Homo sapiens
ctgtgggcttggccttgt

SEQ ID NO: 1075279 - DNA, 19 bp, Homo sapiens
ctgtgggcttggccttgtg

SEQ ID NO: 1075280 - DNA, 14 bp, Homo sapiens
ctgtggggaaaggg

SEQ ID NO: 1075281 - DNA, 14 bp, Homo sapiens
cttaatctaaatgg

SEQ ID NO: 1075282 - DNA, 14 bp, Homo sapiens
cttaatctaagaaa

SEQ ID NO: 1075283 - DNA, 20 bp, Homo sapiens
cttaatctaagaaacaaagt

SEQ ID NO: 1075284 - DNA, 18 bp, Homo sapiens
cttaatgacattcccctc

SEQ ID NO: 1075285 - DNA, 19 bp, Homo sapiens
cttaatgagactttaaaag

SEQ ID NO: 1075286 - DNA, 12 bp, Homo sapiens
cttaatgagata

SEQ ID NO: 1075287 - DNA, 24 bp, Homo sapiens
cttaatggtaggtcaagtaataaa

SEQ ID NO: 1075288 - DNA, 19 bp, Homo sapiens
cttaatggtatcctactga

SEQ ID NO: 1075289 - DNA, 23 bp, Homo sapiens
cttaatggtatcctactgagcat

SEQ ID NO: 1075290 - DNA, 21 bp, Homo sapiens
cttaatgtatgttaccaaaaa

SEQ ID NO: 1075291 - DNA, 20 bp, Homo sapiens
cttaatgtgattactgctct

SEQ ID NO: 1075292 - DNA, 17 bp, Homo sapiens
cttaattattataaaaa

SEQ ID NO: 1075293 - DNA, 19 bp, Homo sapiens
cttaattattataaaaata

SEQ ID NO: 1075294 - DNA, 21 bp, Homo sapiens
cttaattattataaaaatatt

SEQ ID NO: 1075295 - DNA, 19 bp, Homo sapiens
cttaattctttgttctgtt

SEQ ID NO: 1075296 - DNA, 17 bp, Homo sapiens
cttaattgccagcaaat

SEQ ID NO: 1075297 - DNA, 18 bp, Homo sapiens
cttaattgccagcaaata

SEQ ID NO: 1075298 - DNA, 16 bp, Homo sapiens
cttaattgttcatttt

SEQ ID NO: 1075299 - DNA, 19 bp, Homo sapiens
cttaattgttcattttgag

SEQ ID NO: 1075300 - DNA, 18 bp, Homo sapiens
cttaatttaattgctttg

SEQ ID NO: 1075301 - DNA, 17 bp, Homo sapiens
cttaatttccttctgtt

SEQ ID NO: 1075302 - DNA, 23 bp, Homo sapiens
cttaatttctgcctttcccccct

SEQ ID NO: 1075303 - DNA, 15 bp, Homo sapiens
cttaatttgcacagt

SEQ ID NO: 1075304 - DNA, 22 bp, Homo sapiens
cttaatttggataataaaaatt

SEQ ID NO: 1075305 - DNA, 16 bp, Homo sapiens
cttaatttgtaaactt

SEQ ID NO: 1075306 - DNA, 20 bp, Homo sapiens
cttaatttgtaaacttctga

SEQ ID NO: 1075307 - DNA, 20 bp, Homo sapiens
cttaatttttttttcataga

SEQ ID NO: 1075308 - DNA, 14 bp, Homo sapiens
cttacaaaaacact

SEQ ID NO: 1075309 - DNA, 15 bp, Homo sapiens
cttacaaaaacactt

SEQ ID NO: 1075310 - DNA, 11 bp, Homo sapiens
cttacaaaatc

SEQ ID NO: 1075311 - DNA, 16 bp, Homo sapiens
cttacaagaaaggcct

SEQ ID NO: 1075312 - DNA, 18 bp, Homo sapiens
cttacaagaaaggcctga

SEQ ID NO: 1075313 - DNA, 17 bp, Homo sapiens
cttacaagcttaaagct

SEQ ID NO: 1075314 - DNA, 18 bp, Homo sapiens
cttacaaggccctttcct

SEQ ID NO: 1075315 - DNA, 22 bp, Homo sapiens
cttacaagtggtgaccaaaatt

SEQ ID NO: 1075316 - DNA, 14 bp, Homo sapiens
cttacaatcaaatc

SEQ ID NO: 1075317 - DNA, 17 bp, Homo sapiens
cttacaatcaaatctcc

SEQ ID NO: 1075318 - DNA, 14 bp, Homo sapiens
cttacaatgtaaac

SEQ ID NO: 1075319 - DNA, 19 bp, Homo sapiens
cttacaattccctgctgtc

SEQ ID NO: 1075320 - DNA, 20 bp, Homo sapiens
cttacaattgcactgctgtt

SEQ ID NO: 1075321 - DNA, 12 bp, Homo sapiens
cttacacttctt

SEQ ID NO: 1075322 - DNA, 23 bp, Homo sapiens
cttacacttggagcccgtgcagt

SEQ ID NO: 1075323 - DNA, 13 bp, Homo sapiens
cttacagaaatga

SEQ ID NO: 1075324 - DNA, 15 bp, Homo sapiens
cttacagcctctgac

SEQ ID NO: 1075325 - DNA, 23 bp, Homo sapiens
cttacaggggggtcggaagcctg

SEQ ID NO: 1075326 - DNA, 15 bp, Homo sapiens
cttacagtaactaat

SEQ ID NO: 1075327 - DNA, 23 bp, Homo sapiens
cttacagtaggagcccagctctg

SEQ ID NO: 1075328 - DNA, 15 bp, Homo sapiens
cttacagtgtgataa

SEQ ID NO: 1075329 - DNA, 19 bp, Homo sapiens
cttacataaagctcccttg

SEQ ID NO: 1075330 - DNA, 16 bp, Homo sapiens
cttacataatttttta

SEQ ID NO: 1075331 - DNA, 16 bp, Homo sapiens
cttacatctgtaaaga

SEQ ID NO: 1075332 - DNA, 16 bp, Homo sapiens
cttacatcttctgtga

SEQ ID NO: 1075333 - DNA, 16 bp, Homo sapiens
cttacatcttttctaa

SEQ ID NO: 1075334 - DNA, 14 bp, Homo sapiens
cttacatgcatttg

SEQ ID NO: 1075335 - DNA, 20 bp, Homo sapiens
cttacatgtgtaaaggtttc

SEQ ID NO: 1075336 - DNA, 14 bp, Homo sapiens
cttacatgttttct

SEQ ID NO: 1075337 - DNA, 20 bp, Homo sapiens
cttacattagcagtttgctt

SEQ ID NO: 1075338 - DNA, 21 bp, Homo sapiens
cttacattagcagtttgcttt

SEQ ID NO: 1075339 - DNA, 15 bp, Homo sapiens
cttacattgtgaaac

SEQ ID NO: 1075340 - DNA, 22 bp, Homo sapiens
cttacatttacaaactgaagag

SEQ ID NO: 1075341 - DNA, 11 bp, Homo sapiens
cttacatttca

SEQ ID NO: 1075342 - DNA, 22 bp, Homo sapiens
cttacatttcagacatatccaa

SEQ ID NO: 1075343 - DNA, 22 bp, Homo sapiens
cttacattttcgtcctgtagca

SEQ ID NO: 1075344 - DNA, 23 bp, Homo sapiens
cttaccaagttgtgcttttctgt

SEQ ID NO: 1075345 - DNA, 13 bp, Homo sapiens
cttaccagaagct

SEQ ID NO: 1075346 - DNA, 19 bp, Homo sapiens
cttaccattaacatttttt

SEQ ID NO: 1075347 - DNA, 20 bp, Homo sapiens
cttacccgaaagcatcactg

SEQ ID NO: 1075348 - DNA, 22 bp, Homo sapiens
cttacccgaaagcatcactgcc

SEQ ID NO: 1075349 - DNA, 16 bp, Homo sapiens
cttaccctcctctgct

SEQ ID NO: 1075350 - DNA, 18 bp, Homo sapiens
cttaccctcctctgctgg

SEQ ID NO: 1075351 - DNA, 20 bp, Homo sapiens
cttaccctcctctgctggga

SEQ ID NO: 1075352 - DNA, 15 bp, Homo sapiens
cttaccgtagcctcc

SEQ ID NO: 1075353 - DNA, 16 bp, Homo sapiens
cttaccgtagcctccg

SEQ ID NO: 1075354 - DNA, 18 bp, Homo sapiens
cttacctaacttgaacat

SEQ ID NO: 1075355 - DNA, 13 bp, Homo sapiens
cttacctcctgcc

SEQ ID NO: 1075356 - DNA, 16 bp, Homo sapiens
cttacctcctgcccag

SEQ ID NO: 1075357 - DNA, 20 bp, Homo sapiens
cttacctcctgcccaggaga

SEQ ID NO: 1075358 - DNA, 18 bp, Homo sapiens
cttacctcggggagaggg

SEQ ID NO: 1075359 - DNA, 21 bp, Homo sapiens
cttacctcggggagaggggga

SEQ ID NO: 1075360 - DNA, 17 bp, Homo sapiens
cttacctctcatgcgtg

SEQ ID NO: 1075361 - DNA, 13 bp, Homo sapiens
cttacctctctgg

SEQ ID NO: 1075362 - DNA, 14 bp, Homo sapiens
cttacctctggaac

SEQ ID NO: 1075363 - DNA, 17 bp, Homo sapiens
cttacctgacctcttgc

SEQ ID NO: 1075364 - DNA, 19 bp, Homo sapiens
cttacctgacctcttgctg

SEQ ID NO: 1075365 - DNA, 21 bp, Homo sapiens
cttacctgacctcttgctgtc

SEQ ID NO: 1075366 - DNA, 19 bp, Homo sapiens
cttacctgttcagtactct

SEQ ID NO: 1075367 - DNA, 15 bp, Homo sapiens
cttaccttctgctgt

SEQ ID NO: 1075368 - DNA, 23 bp, Homo sapiens
cttacgaatacttttgccctttg

SEQ ID NO: 1075369 - DNA, 14 bp, Homo sapiens
cttacgtaaaacat

SEQ ID NO: 1075370 - DNA, 21 bp, Homo sapiens
cttactaaaaagtataaaata

SEQ ID NO: 1075371 - DNA, 23 bp, Homo sapiens
cttactaagctttgccagctgct

SEQ ID NO: 1075372 - DNA, 12 bp, Homo sapiens
cttactatttaa

SEQ ID NO: 1075373 - DNA, 13 bp, Homo sapiens
cttactatttctg

SEQ ID NO: 1075374 - DNA, 24 bp, Homo sapiens
cttactcccccaccactcaggcca

SEQ ID NO: 1075375 - DNA, 22 bp, Homo sapiens
cttactcctcctctttctctcc

SEQ ID NO: 1075376 - DNA, 13 bp, Homo sapiens
cttactctgagcc

SEQ ID NO: 1075377 - DNA, 16 bp, Homo sapiens
cttactctgagcccag

SEQ ID NO: 1075378 - DNA, 18 bp, Homo sapiens
cttactctgagcccaggc

SEQ ID NO: 1075379 - DNA, 21 bp, Homo sapiens
cttactctgagcccaggccgt

SEQ ID NO: 1075380 - DNA, 22 bp, Homo sapiens
cttactctgagcccaggccgtt

SEQ ID NO: 1075381 - DNA, 17 bp, Homo sapiens
cttactctgtccattta

SEQ ID NO: 1075382 - DNA, 24 bp, Homo sapiens
cttactctgtctcccaggctgctg

SEQ ID NO: 1075383 - DNA, 15 bp, Homo sapiens
cttactctttcctat

SEQ ID NO: 1075384 - DNA, 16 bp, Homo sapiens
cttactctttcctatt

SEQ ID NO: 1075385 - DNA, 12 bp, Homo sapiens
cttactgatata

SEQ ID NO: 1075386 - DNA, 21 bp, Homo sapiens
cttactgatatattttacaat

SEQ ID NO: 1075387 - DNA, 14 bp, Homo sapiens
cttactgatattat

SEQ ID NO: 1075388 - DNA, 15 bp, Homo sapiens
cttactgatgatgtg

SEQ ID NO: 1075389 - DNA, 19 bp, Homo sapiens
cttactgggccctggggaa

SEQ ID NO: 1075390 - DNA, 19 bp, Homo sapiens
cttactgggtgaggaaatc

SEQ ID NO: 1075391 - DNA, 17 bp, Homo sapiens
cttactgtagcctcaga

SEQ ID NO: 1075392 - DNA, 13 bp, Homo sapiens
cttactgtatatg

SEQ ID NO: 1075393 - DNA, 17 bp, Homo sapiens
cttactgtccaccagtt

SEQ ID NO: 1075394 - DNA, 18 bp, Homo sapiens
cttactgtccaccagttt

SEQ ID NO: 1075395 - DNA, 21 bp, Homo sapiens
cttactgtccaccagtttata

SEQ ID NO: 1075396 - DNA, 21 bp, Homo sapiens
cttactttgcttgagaatcct

SEQ ID NO: 1075397 - DNA, 22 bp, Homo sapiens
cttacttttccagtctgtacag

SEQ ID NO: 1075398 - DNA, 17 bp, Homo sapiens
cttactttttaattttt

SEQ ID NO: 1075399 - DNA, 15 bp, Homo sapiens
cttagaaaattaaaa

SEQ ID NO: 1075400 - DNA, 15 bp, Homo sapiens
cttagaaaattcaag

SEQ ID NO: 1075401 - DNA, 20 bp, Homo sapiens
cttagaaatcattgtagaaa

SEQ ID NO: 1075402 - DNA, 23 bp, Homo sapiens
cttagaaatcattgtagaaacac

SEQ ID NO: 1075403 - DNA, 16 bp, Homo sapiens
cttagaaattgcattt

SEQ ID NO: 1075404 - DNA, 20 bp, Homo sapiens
cttagaacagtggaaactat

SEQ ID NO: 1075405 - DNA, 19 bp, Homo sapiens
cttagaacattttaattca

SEQ ID NO: 1075406 - DNA, 18 bp, Homo sapiens
cttagaagaaattaatat

SEQ ID NO: 1075407 - DNA, 17 bp, Homo sapiens
cttagaagaatattgta

SEQ ID NO: 1075408 - DNA, 16 bp, Homo sapiens
cttagaagagagccag

SEQ ID NO: 1075409 - DNA, 18 bp, Homo sapiens
cttagaagccatgggacc

SEQ ID NO: 1075410 - DNA, 22 bp, Homo sapiens
cttagaagccatgggacctcct

SEQ ID NO: 1075411 - DNA, 12 bp, Homo sapiens
cttagaatccaa

SEQ ID NO: 1075412 - DNA, 13 bp, Homo sapiens
cttagaatgccat

SEQ ID NO: 1075413 - DNA, 14 bp, Homo sapiens
cttagacctcagcc

SEQ ID NO: 1075414 - DNA, 15 bp, Homo sapiens
cttagacctcagcct

SEQ ID NO: 1075415 - DNA, 18 bp, Homo sapiens
cttagacctcagcctgtg

SEQ ID NO: 1075416 - DNA, 20 bp, Homo sapiens
cttagacctcagcctgtgct

SEQ ID NO: 1075417 - DNA, 22 bp, Homo sapiens
cttagacctcctaaatgcccca

SEQ ID NO: 1075418 - DNA, 15 bp, Homo sapiens
cttagactccttctc

SEQ ID NO: 1075419 - DNA, 18 bp, Homo sapiens
cttagactctagtattta

SEQ ID NO: 1075420 - DNA, 21 bp, Homo sapiens
cttagactctagtatttatgg

SEQ ID NO: 1075421 - DNA, 20 bp, Homo sapiens
cttagacttcgactcaggat

SEQ ID NO: 1075422 - DNA, 19 bp, Homo sapiens
cttagagcaacctctgtat

SEQ ID NO: 1075423 - DNA, 19 bp, Homo sapiens
cttagagccaagtgtcttt

SEQ ID NO: 1075424 - DNA, 22 bp, Homo sapiens
cttagagccttttatctgcaga

SEQ ID NO: 1075425 - DNA, 14 bp, Homo sapiens
cttagagtgcccag

SEQ ID NO: 1075426 - DNA, 15 bp, Homo sapiens
cttagagtgcccagc

SEQ ID NO: 1075427 - DNA, 17 bp, Homo sapiens
cttagagtgcccagcag

SEQ ID NO: 1075428 - DNA, 18 bp, Homo sapiens
cttagagtgtagctgtaa

SEQ ID NO: 1075429 - DNA, 15 bp, Homo sapiens
cttagagttcttctt

SEQ ID NO: 1075430 - DNA, 18 bp, Homo sapiens
cttagagtttctgtttga

SEQ ID NO: 1075431 - DNA, 22 bp, Homo sapiens
cttagagtttctgtttgattct

SEQ ID NO: 1075432 - DNA, 23 bp, Homo sapiens
cttagagtttctgtttgattctt

SEQ ID NO: 1075433 - DNA, 17 bp, Homo sapiens
cttagataatatttctg

SEQ ID NO: 1075434 - DNA, 20 bp, Homo sapiens
cttagatattaaaatttggt

SEQ ID NO: 1075435 - DNA, 21 bp, Homo sapiens
cttagatccaaggcagggaaa

SEQ ID NO: 1075436 - DNA, 18 bp, Homo sapiens
cttagatctctcctgcaa

SEQ ID NO: 1075437 - DNA, 18 bp, Homo sapiens
cttagatgttaaatgtta

SEQ ID NO: 1075438 - DNA, 20 bp, Homo sapiens
cttagatgttccagtaatct

SEQ ID NO: 1075439 - DNA, 14 bp, Homo sapiens
cttagatgttctaa

SEQ ID NO: 1075440 - DNA, 20 bp, Homo sapiens
cttagattaagattttactt

SEQ ID NO: 1075441 - DNA, 17 bp, Homo sapiens
cttagattagctctgga

SEQ ID NO: 1075442 - DNA, 20 bp, Homo sapiens
cttagattagctctggacca

SEQ ID NO: 1075443 - DNA, 22 bp, Homo sapiens
cttagattgtgttcctgaagaa

SEQ ID NO: 1075444 - DNA, 13 bp, Homo sapiens
cttagcacagaga

SEQ ID NO: 1075445 - DNA, 14 bp, Homo sapiens
cttagcacagagag

SEQ ID NO: 1075446 - DNA, 17 bp, Homo sapiens
cttagcacagagaggga

SEQ ID NO: 1075447 - DNA, 20 bp, Homo sapiens
cttagcacagagagggacac

SEQ ID NO: 1075448 - DNA, 17 bp, Homo sapiens
cttagcaccttcagggc

SEQ ID NO: 1075449 - DNA, 15 bp, Homo sapiens
cttagcagcttccag

SEQ ID NO: 1075450 - DNA, 17 bp, Homo sapiens
cttagcagcttccagat

SEQ ID NO: 1075451 - DNA, 12 bp, Homo sapiens
cttagcatgtga

SEQ ID NO: 1075452 - DNA, 20 bp, Homo sapiens
cttagccagttcaaagtgta

SEQ ID NO: 1075453 - DNA, 18 bp, Homo sapiens
cttagccgcaccctgcac

SEQ ID NO: 1075454 - DNA, 20 bp, Homo sapiens
cttagccgtccatggcacca

SEQ ID NO: 1075455 - DNA, 15 bp, Homo sapiens
cttagcctccctgaa

SEQ ID NO: 1075456 - DNA, 12 bp, Homo sapiens
cttagcctctcc

SEQ ID NO: 1075457 - DNA, 20 bp, Homo sapiens
cttagcctcttggaaatcag

SEQ ID NO: 1075458 - DNA, 22 bp, Homo sapiens
cttagcctcttggaaatcaggt

SEQ ID NO: 1075459 - DNA, 10 bp, Homo sapiens
cttagcctgc

SEQ ID NO: 1075460 - DNA, 13 bp, Homo sapiens
cttagcctgcctc

SEQ ID NO: 1075461 - DNA, 16 bp, Homo sapiens
cttagccttgtgccct

SEQ ID NO: 1075462 - DNA, 18 bp, Homo sapiens
cttagcgctctggacaga

SEQ ID NO: 1075463 - DNA, 17 bp, Homo sapiens
cttagcgtcaagacatt

SEQ ID NO: 1075464 - DNA, 23 bp, Homo sapiens
cttagcgtcaagacatttgctga

SEQ ID NO: 1075465 - DNA, 18 bp, Homo sapiens
cttagcgttctggactct

SEQ ID NO: 1075466 - DNA, 13 bp, Homo sapiens
cttagctatttat

SEQ ID NO: 1075467 - DNA, 12 bp, Homo sapiens
cttagctcaggt

SEQ ID NO: 1075468 - DNA, 22 bp, Homo sapiens
cttagctggatataatgtattt

SEQ ID NO: 1075469 - DNA, 13 bp, Homo sapiens
cttagctgtacta

SEQ ID NO: 1075470 - DNA, 18 bp, Homo sapiens
cttagctgtactataagt

SEQ ID NO: 1075471 - DNA, 15 bp, Homo sapiens
cttagcttacaggaa

SEQ ID NO: 1075472 - DNA, 17 bp, Homo sapiens
cttagcttacaggaagc

SEQ ID NO: 1075473 - DNA, 17 bp, Homo sapiens
cttagcttagacctcag

SEQ ID NO: 1075474 - DNA, 19 bp, Homo sapiens
cttagcttagacctcagcc

SEQ ID NO: 1075475 - DNA, 21 bp, Homo sapiens
cttagcttagacctcagcctg

SEQ ID NO: 1075476 - DNA, 19 bp, Homo sapiens
cttagcttattgatcccac

SEQ ID NO: 1075477 - DNA, 21 bp, Homo sapiens
cttagcttattgatcccacat

SEQ ID NO: 1075478 - DNA, 23 bp, Homo sapiens
cttaggaaccttctcccttcttg

SEQ ID NO: 1075479 - DNA, 22 bp, Homo sapiens
cttaggagacagatcactcctg

SEQ ID NO: 1075480 - DNA, 19 bp, Homo sapiens
cttaggagcaagaagaaaa

SEQ ID NO: 1075481 - DNA, 21 bp, Homo sapiens
cttaggatggggctcccagct

SEQ ID NO: 1075482 - DNA, 14 bp, Homo sapiens
cttaggatgtgtgc

SEQ ID NO: 1075483 - DNA, 13 bp, Homo sapiens
cttaggattctaa

SEQ ID NO: 1075484 - DNA, 21 bp, Homo sapiens
cttaggcactgagggatctga

SEQ ID NO: 1075485 - DNA, 13 bp, Homo sapiens
cttaggcatgtgc

SEQ ID NO: 1075486 - DNA, 22 bp, Homo sapiens
cttaggcattatttaatgtttg

SEQ ID NO: 1075487 - DNA, 12 bp, Homo sapiens
cttaggccttcc

SEQ ID NO: 1075488 - DNA, 15 bp, Homo sapiens
cttaggccttcctct

SEQ ID NO: 1075489 - DNA, 22 bp, Homo sapiens
cttagggaaagatgtagaaaga

SEQ ID NO: 1075490 - DNA, 15 bp, Homo sapiens
cttagggaagaaaaa

SEQ ID NO: 1075491 - DNA, 13 bp, Homo sapiens
cttagggaagctg

SEQ ID NO: 1075492 - DNA, 22 bp, Homo sapiens
cttagggaagttgtctccttcc

SEQ ID NO: 1075493 - DNA, 20 bp, Homo sapiens
cttagggacaggaccccagc

SEQ ID NO: 1075494 - DNA, 15 bp, Homo sapiens
cttagggcaccaggg

SEQ ID NO: 1075495 - DNA, 14 bp, Homo sapiens
cttagggccctgga

SEQ ID NO: 1075496 - DNA, 16 bp, Homo sapiens
cttagggccctggagg

SEQ ID NO: 1075497 - DNA, 18 bp, Homo sapiens
cttagggccctggaggcg

SEQ ID NO: 1075498 - DNA, 21 bp, Homo sapiens
cttagggtggctttaattgta

SEQ ID NO: 1075499 - DNA, 19 bp, Homo sapiens
cttaggtttttaggagtct

SEQ ID NO: 1075500 - DNA, 13 bp, Homo sapiens
cttagtaatagca

SEQ ID NO: 1075501 - DNA, 17 bp, Homo sapiens
cttagtagtttttacaa

SEQ ID NO: 1075502 - DNA, 13 bp, Homo sapiens
cttagtatgcagt

SEQ ID NO: 1075503 - DNA, 17 bp, Homo sapiens
cttagtatggttctcag

SEQ ID NO: 1075504 - DNA, 15 bp, Homo sapiens
cttagtcactgcctg

SEQ ID NO: 1075505 - DNA, 17 bp, Homo sapiens
cttagtcactgcctgca

SEQ ID NO: 1075506 - DNA, 23 bp, Homo sapiens
cttagtcactgcctgcagaggtc

SEQ ID NO: 1075507 - DNA, 13 bp, Homo sapiens
cttagtcccaagc

SEQ ID NO: 1075508 - DNA, 15 bp, Homo sapiens
cttagtcccaagcta

SEQ ID NO: 1075509 - DNA, 12 bp, Homo sapiens
cttagtccccca

SEQ ID NO: 1075510 - DNA, 23 bp, Homo sapiens
cttagtcgaatgttagattcctc

SEQ ID NO: 1075511 - DNA, 15 bp, Homo sapiens
cttagtctaggtcct

SEQ ID NO: 1075512 - DNA, 21 bp, Homo sapiens
cttagtctaggtccttgttgt

SEQ ID NO: 1075513 - DNA, 13 bp, Homo sapiens
cttagtctcagtt

SEQ ID NO: 1075514 - DNA, 18 bp, Homo sapiens
cttagtctcagtttgtgt

SEQ ID NO: 1075515 - DNA, 19 bp, Homo sapiens
cttagtctcagtttgtgtg

SEQ ID NO: 1075516 - DNA, 20 bp, Homo sapiens
cttagtctcagtttgtgtgt

SEQ ID NO: 1075517 - DNA, 20 bp, Homo sapiens
cttagtcttctcatagcatt

SEQ ID NO: 1075518 - DNA, 19 bp, Homo sapiens
cttagtgatcatttaaaaa

SEQ ID NO: 1075519 - DNA, 16 bp, Homo sapiens
cttagtgcaaaaaaca

SEQ ID NO: 1075520 - DNA, 18 bp, Homo sapiens
cttagtgcaaaaaacata

SEQ ID NO: 1075521 - DNA, 21 bp, Homo sapiens
cttagtgcccgcctaggagtt

SEQ ID NO: 1075522 - DNA, 19 bp, Homo sapiens
cttagtgcggacaagtttt

SEQ ID NO: 1075523 - DNA, 22 bp, Homo sapiens
cttagtgcggacaagttttaat

SEQ ID NO: 1075524 - DNA, 20 bp, Homo sapiens
cttagtgcttcagagtttgt

SEQ ID NO: 1075525 - DNA, 13 bp, Homo sapiens
cttagtgggccag

SEQ ID NO: 1075526 - DNA, 21 bp, Homo sapiens
cttagtgggccagggctgccc

SEQ ID NO: 1075527 - DNA, 21 bp, Homo sapiens
cttagtgttcaaaacaaaatg

SEQ ID NO: 1075528 - DNA, 12 bp, Homo sapiens
cttagttaaaaa

SEQ ID NO: 1075529 - DNA, 18 bp, Homo sapiens
cttataccttctgacagc

SEQ ID NO: 1075530 - DNA, 15 bp, Homo sapiens
cttatactgtacaat

SEQ ID NO: 1075531 - DNA, 19 bp, Homo sapiens
cttatactgtacaataaaa

SEQ ID NO: 1075532 - DNA, 17 bp, Homo sapiens
cttatagaataaaagct

SEQ ID NO: 1075533 - DNA, 21 bp, Homo sapiens
cttatagaataaaagctataa

SEQ ID NO: 1075534 - DNA, 13 bp, Homo sapiens
cttatagaatatt

SEQ ID NO: 1075535 - DNA, 20 bp, Homo sapiens
cttatagaatatttattacc

SEQ ID NO: 1075536 - DNA, 14 bp, Homo sapiens
cttataggtgttgg

SEQ ID NO: 1075537 - DNA, 13 bp, Homo sapiens
cttatagtacatg

SEQ ID NO: 1075538 - DNA, 17 bp, Homo sapiens
cttatagtacatgataa

SEQ ID NO: 1075539 - DNA, 19 bp, Homo sapiens
cttatagttaatattttgt

SEQ ID NO: 1075540 - DNA, 14 bp, Homo sapiens
cttatagttactgt

SEQ ID NO: 1075541 - DNA, 23 bp, Homo sapiens
cttatatatgcacttaatttgtt

SEQ ID NO: 1075542 - DNA, 22 bp, Homo sapiens
cttatatctggcctctgctttc

SEQ ID NO: 1075543 - DNA, 20 bp, Homo sapiens
cttatattaatagtaatttg

SEQ ID NO: 1075544 - DNA, 23 bp, Homo sapiens
cttatattgaagacaatttgata

SEQ ID NO: 1075545 - DNA, 22 bp, Homo sapiens
cttatatttctgtgtacacatc

SEQ ID NO: 1075546 - DNA, 16 bp, Homo sapiens
cttatattttatgaac

SEQ ID NO: 1075547 - DNA, 22 bp, Homo sapiens
cttatattttatgaacattgta

SEQ ID NO: 1075548 - DNA, 12 bp, Homo sapiens
cttatcaagtgt

SEQ ID NO: 1075549 - DNA, 19 bp, Homo sapiens
cttatcaagtgtcttccat

SEQ ID NO: 1075550 - DNA, 12 bp, Homo sapiens
cttatcagagct

SEQ ID NO: 1075551 - DNA, 15 bp, Homo sapiens
cttatcattcattct

SEQ ID NO: 1075552 - DNA, 15 bp, Homo sapiens
cttatccaggactct

SEQ ID NO: 1075553 - DNA, 19 bp, Homo sapiens
cttatccaggactctgtca

SEQ ID NO: 1075554 - DNA, 18 bp, Homo sapiens
cttatcctacagtacaat

SEQ ID NO: 1075555 - DNA, 22 bp, Homo sapiens
cttatcctctctctcttctagg

SEQ ID NO: 1075556 - DNA, 23 bp, Homo sapiens
cttatcctctctctcttctaggc

SEQ ID NO: 1075557 - DNA, 14 bp, Homo sapiens
cttatcctctgatc

SEQ ID NO: 1075558 - DNA, 18 bp, Homo sapiens
cttatcctctgatctcca

SEQ ID NO: 1075559 - DNA, 23 bp, Homo sapiens
cttatcctgctagcaggccccct

SEQ ID NO: 1075560 - DNA, 22 bp, Homo sapiens
cttatccttgggccataattat

SEQ ID NO: 1075561 - DNA, 13 bp, Homo sapiens
cttatctccaaga

SEQ ID NO: 1075562 - DNA, 16 bp, Homo sapiens
cttatctccaagacca

SEQ ID NO: 1075563 - DNA, 12 bp, Homo sapiens
cttatctctttt

SEQ ID NO: 1075564 - DNA, 19 bp, Homo sapiens
cttatctgtgcgtgaaaca

SEQ ID NO: 1075565 - DNA, 22 bp, Homo sapiens
cttatctttctaaaactgcctt

SEQ ID NO: 1075566 - DNA, 21 bp, Homo sapiens
cttatgaaatctcacagatgt

SEQ ID NO: 1075567 - DNA, 13 bp, Homo sapiens
cttatgagaaact

SEQ ID NO: 1075568 - DNA, 14 bp, Homo sapiens
cttatgaggagggg

SEQ ID NO: 1075569 - DNA, 22 bp, Homo sapiens
cttatgatgttttcccttaact

SEQ ID NO: 1075570 - DNA, 20 bp, Homo sapiens
cttatgattaaacttccttc

SEQ ID NO: 1075571 - DNA, 15 bp, Homo sapiens
cttatgattttatta

SEQ ID NO: 1075572 - DNA, 17 bp, Homo sapiens
cttatgattttattaca

SEQ ID NO: 1075573 - DNA, 14 bp, Homo sapiens
cttatgccacggga

SEQ ID NO: 1075574 - DNA, 18 bp, Homo sapiens
cttatgcggttaattttg

SEQ ID NO: 1075575 - DNA, 21 bp, Homo sapiens
cttatgctacacagacattaa

SEQ ID NO: 1075576 - DNA, 16 bp, Homo sapiens
cttatgctgctgtgaa

SEQ ID NO: 1075577 - DNA, 14 bp, Homo sapiens
cttatggaattgat

SEQ ID NO: 1075578 - DNA, 16 bp, Homo sapiens
cttatggaattgattt

SEQ ID NO: 1075579 - DNA, 18 bp, Homo sapiens
cttatgggatccttgtct

SEQ ID NO: 1075580 - DNA, 21 bp, Homo sapiens
cttatgggtccccctcagcaa

SEQ ID NO: 1075581 - DNA, 15 bp, Homo sapiens
cttatgggtggcttt

SEQ ID NO: 1075582 - DNA, 17 bp, Homo sapiens
cttatgggtggctttca

SEQ ID NO: 1075583 - DNA, 20 bp, Homo sapiens
cttatgtaaagtatgttttt

SEQ ID NO: 1075584 - DNA, 15 bp, Homo sapiens
cttatgtacagaaaa

SEQ ID NO: 1075585 - DNA, 14 bp, Homo sapiens
cttatgtgaaaaat

SEQ ID NO: 1075586 - DNA, 16 bp, Homo sapiens
cttatgtgaaaaatta

SEQ ID NO: 1075587 - DNA, 19 bp, Homo sapiens
cttatgtgaaaaattaact

SEQ ID NO: 1075588 - DNA, 13 bp, Homo sapiens
cttatgtgttaca

SEQ ID NO: 1075589 - DNA, 14 bp, Homo sapiens
cttatgtgttacat

SEQ ID NO: 1075590 - DNA, 15 bp, Homo sapiens
cttatgtgttacatt

SEQ ID NO: 1075591 - DNA, 21 bp, Homo sapiens
cttatgtgttacattattcca

SEQ ID NO: 1075592 - DNA, 19 bp, Homo sapiens
cttatgttaatagtaattc

SEQ ID NO: 1075593 - DNA, 13 bp, Homo sapiens
cttattaaaaaat

SEQ ID NO: 1075594 - DNA, 17 bp, Homo sapiens
cttattagagtgtcttt

SEQ ID NO: 1075595 - DNA, 18 bp, Homo sapiens
cttattaggataatacat

SEQ ID NO: 1075596 - DNA, 14 bp, Homo sapiens
cttattataaaatg

SEQ ID NO: 1075597 - DNA, 14 bp, Homo sapiens
cttattatcccagc

SEQ ID NO: 1075598 - DNA, 21 bp, Homo sapiens
cttattattaataatgaagta

SEQ ID NO: 1075599 - DNA, 17 bp, Homo sapiens
cttattcaaagagaaaa

SEQ ID NO: 1075600 - DNA, 16 bp, Homo sapiens
cttattccaggagaag

SEQ ID NO: 1075601 - DNA, 20 bp, Homo sapiens
cttattcccaaactacagaa

SEQ ID NO: 1075602 - DNA, 21 bp, Homo sapiens
cttattccgagaatgccgagg

SEQ ID NO: 1075603 - DNA, 20 bp, Homo sapiens
cttattccgagcattccagt

SEQ ID NO: 1075604 - DNA, 15 bp, Homo sapiens
cttattctgacataa

SEQ ID NO: 1075605 - DNA, 14 bp, Homo sapiens
cttattctgtagat

SEQ ID NO: 1075606 - DNA, 20 bp, Homo sapiens
cttattgaaaaaaaaaatgt

SEQ ID NO: 1075607 - DNA, 18 bp, Homo sapiens
cttattgaatttgttaga

SEQ ID NO: 1075608 - DNA, 18 bp, Homo sapiens
cttattgcctcccaggca

SEQ ID NO: 1075609 - DNA, 17 bp, Homo sapiens
cttattgcgctgctacc

SEQ ID NO: 1075610 - DNA, 14 bp, Homo sapiens
cttattgctgccaa

SEQ ID NO: 1075611 - DNA, 17 bp, Homo sapiens
cttattgctgccaaaac

SEQ ID NO: 1075612 - DNA, 20 bp, Homo sapiens
cttattgctgccaaaaccac

SEQ ID NO: 1075613 - DNA, 17 bp, Homo sapiens
cttattggaaatgtact

SEQ ID NO: 1075614 - DNA, 21 bp, Homo sapiens
cttattggaaatgtacttttg

SEQ ID NO: 1075615 - DNA, 17 bp, Homo sapiens
cttattggaactctgct

SEQ ID NO: 1075616 - DNA, 18 bp, Homo sapiens
cttattggaactctgctt

SEQ ID NO: 1075617 - DNA, 14 bp, Homo sapiens
cttattgttccaag

SEQ ID NO: 1075618 - DNA, 21 bp, Homo sapiens
cttattgttccaagacattgt

SEQ ID NO: 1075619 - DNA, 22 bp, Homo sapiens
cttattgttccaagacattgtc

SEQ ID NO: 1075620 - DNA, 13 bp, Homo sapiens
cttatttaaaaat

SEQ ID NO: 1075621 - DNA, 21 bp, Homo sapiens
cttatttaaaaatatttcaga

SEQ ID NO: 1075622 - DNA, 13 bp, Homo sapiens
cttatttaagtat

SEQ ID NO: 1075623 - DNA, 17 bp, Homo sapiens
cttatttaatgaaagac

SEQ ID NO: 1075624 - DNA, 18 bp, Homo sapiens
cttatttaatgaaagact

SEQ ID NO: 1075625 - DNA, 13 bp, Homo sapiens
cttatttcactaa

SEQ ID NO: 1075626 - DNA, 19 bp, Homo sapiens
cttatttccaagtaagagt

SEQ ID NO: 1075627 - DNA, 18 bp, Homo sapiens
cttatttctatgacaaat

SEQ ID NO: 1075628 - DNA, 12 bp, Homo sapiens
cttatttctcat

SEQ ID NO: 1075629 - DNA, 20 bp, Homo sapiens
cttatttctcattgcctctt

SEQ ID NO: 1075630 - DNA, 18 bp, Homo sapiens
cttatttctctctcctgg

SEQ ID NO: 1075631 - DNA, 11 bp, Homo sapiens
cttatttctgc

SEQ ID NO: 1075632 - DNA, 19 bp, Homo sapiens
cttatttctgctctggaat

SEQ ID NO: 1075633 - DNA, 20 bp, Homo sapiens
cttatttcttaaagcttttt

SEQ ID NO: 1075634 - DNA, 18 bp, Homo sapiens
cttatttgccagagccaa

SEQ ID NO: 1075635 - DNA, 14 bp, Homo sapiens
cttatttggaaatt

SEQ ID NO: 1075636 - DNA, 21 bp, Homo sapiens
cttattttcagtgcatcatta

SEQ ID NO: 1075637 - DNA, 16 bp, Homo sapiens
cttattttcatgtata

SEQ ID NO: 1075638 - DNA, 14 bp, Homo sapiens
cttattttctctgt

SEQ ID NO: 1075639 - DNA, 19 bp, Homo sapiens
cttattttgcattccagaa

SEQ ID NO: 1075640 - DNA, 15 bp, Homo sapiens
cttattttgtattac

SEQ ID NO: 1075641 - DNA, 16 bp, Homo sapiens
cttattttgtcttatt

SEQ ID NO: 1075642 - DNA, 18 bp, Homo sapiens
cttattttgtcttattct

SEQ ID NO: 1075643 - DNA, 21 bp, Homo sapiens
cttattttgtcttattcttaa

SEQ ID NO: 1075644 - DNA, 18 bp, Homo sapiens
cttatttttagccataat

SEQ ID NO: 1075645 - DNA, 19 bp, Homo sapiens
cttatttttataattaaag

SEQ ID NO: 1075646 - DNA, 15 bp, Homo sapiens
cttatttttatgtgg

SEQ ID NO: 1075647 - DNA, 17 bp, Homo sapiens
cttatttttgacagtgt

SEQ ID NO: 1075648 - DNA, 21 bp, Homo sapiens
cttatttttttaagaaaaaag

SEQ ID NO: 1075649 - DNA, 15 bp, Homo sapiens
cttcaaaaataatgt

SEQ ID NO: 1075650 - DNA, 22 bp, Homo sapiens
cttcaaaatattgagcagaatt

SEQ ID NO: 1075651 - DNA, 18 bp, Homo sapiens
cttcaaagattatctgat

SEQ ID NO: 1075652 - DNA, 12 bp, Homo sapiens
cttcaaagcaga

SEQ ID NO: 1075653 - DNA, 20 bp, Homo sapiens
cttcaaagcagagtgggact

SEQ ID NO: 1075654 - DNA, 15 bp, Homo sapiens
cttcaaagtttaata

SEQ ID NO: 1075655 - DNA, 15 bp, Homo sapiens
cttcaaataaagaaa

SEQ ID NO: 1075656 - DNA, 21 bp, Homo sapiens
cttcaaataaagaaatttggt

SEQ ID NO: 1075657 - DNA, 15 bp, Homo sapiens
cttcaaatatttccc

SEQ ID NO: 1075658 - DNA, 15 bp, Homo sapiens
cttcaaatctcagca

SEQ ID NO: 1075659 - DNA, 16 bp, Homo sapiens
cttcaaattatagaaa

SEQ ID NO: 1075660 - DNA, 16 bp, Homo sapiens
cttcaaattcaaggcc

SEQ ID NO: 1075661 - DNA, 24 bp, Homo sapiens
cttcaacagaccccctctagaaat

SEQ ID NO: 1075662 - DNA, 19 bp, Homo sapiens
cttcaacatcaatgttcat

SEQ ID NO: 1075663 - DNA, 14 bp, Homo sapiens
cttcaacccagtgg

SEQ ID NO: 1075664 - DNA, 15 bp, Homo sapiens
cttcaacccagtggg

SEQ ID NO: 1075665 - DNA, 13 bp, Homo sapiens
cttcaactcctgg

SEQ ID NO: 1075666 - DNA, 16 bp, Homo sapiens
cttcaactcctggctc

SEQ ID NO: 1075667 - DNA, 23 bp, Homo sapiens
cttcaactgaccagcctccatgc

SEQ ID NO: 1075668 - DNA, 18 bp, Homo sapiens
cttcaacttttctcttta

SEQ ID NO: 1075669 - DNA, 16 bp, Homo sapiens
cttcaagctctctgtt

SEQ ID NO: 1075670 - DNA, 21 bp, Homo sapiens
cttcaaggactgtttcagtgt

SEQ ID NO: 1075671 - DNA, 18 bp, Homo sapiens
cttcaagggaagaaacac

SEQ ID NO: 1075672 - DNA, 20 bp, Homo sapiens
cttcaagtgttgctcttgga

SEQ ID NO: 1075673 - DNA, 12 bp, Homo sapiens
cttcaagttgta

SEQ ID NO: 1075674 - DNA, 15 bp, Homo sapiens
cttcaataaatcttt

SEQ ID NO: 1075675 - DNA, 21 bp, Homo sapiens
cttcaatctctggaaaaataa

SEQ ID NO: 1075676 - DNA, 16 bp, Homo sapiens
cttcaatgacttctaa

SEQ ID NO: 1075677 - DNA, 16 bp, Homo sapiens
cttcaatgctagaaaa

SEQ ID NO: 1075678 - DNA, 18 bp, Homo sapiens
cttcaatgtgcataatga

SEQ ID NO: 1075679 - DNA, 20 bp, Homo sapiens
cttcaatgtgtcatttccgg

SEQ ID NO: 1075680 - DNA, 15 bp, Homo sapiens
cttcaattaataaaa

SEQ ID NO: 1075681 - DNA, 15 bp, Homo sapiens
cttcaattcctgggc

SEQ ID NO: 1075682 - DNA, 20 bp, Homo sapiens
cttcaatttattactgaaaa

SEQ ID NO: 1075683 - DNA, 12 bp, Homo sapiens
cttcaatttgga

SEQ ID NO: 1075684 - DNA, 22 bp, Homo sapiens
cttcacaaatgtcattgtctac

SEQ ID NO: 1075685 - DNA, 21 bp, Homo sapiens
cttcacacacaggcaactgag

SEQ ID NO: 1075686 - DNA, 13 bp, Homo sapiens
cttcacactgcaa

SEQ ID NO: 1075687 - DNA, 14 bp, Homo sapiens
cttcacagccacac

SEQ ID NO: 1075688 - DNA, 15 bp, Homo sapiens
cttcacaggcagtgc

SEQ ID NO: 1075689 - DNA, 21 bp, Homo sapiens
cttcacagtagagccagcttg

SEQ ID NO: 1075690 - DNA, 22 bp, Homo sapiens
cttcacagtgcagcttgcagtc

SEQ ID NO: 1075691 - DNA, 12 bp, Homo sapiens
cttcacagtgtt

SEQ ID NO: 1075692 - DNA, 14 bp, Homo sapiens
cttcacatattgat

SEQ ID NO: 1075693 - DNA, 14 bp, Homo sapiens
cttcacattaaaaa

SEQ ID NO: 1075694 - DNA, 23 bp, Homo sapiens
cttcaccagtctgtctactgtgg

SEQ ID NO: 1075695 - DNA, 18 bp, Homo sapiens
cttcaccatctacctgct

SEQ ID NO: 1075696 - DNA, 17 bp, Homo sapiens
cttcacccgagttcctc

SEQ ID NO: 1075697 - DNA, 20 bp, Homo sapiens
cttcaccgctccccacagct

SEQ ID NO: 1075698 - DNA, 18 bp, Homo sapiens
cttcacctaagtctctgt

SEQ ID NO: 1075699 - DNA, 19 bp, Homo sapiens
cttcacctaagtctctgtg

SEQ ID NO: 1075700 - DNA, 13 bp, Homo sapiens
cttcacctcagag

SEQ ID NO: 1075701 - DNA, 20 bp, Homo sapiens
cttcacctccaggttcaagt

SEQ ID NO: 1075702 - DNA, 11 bp, Homo sapiens
cttcacctcta

SEQ ID NO: 1075703 - DNA, 15 bp, Homo sapiens
cttcacctgttatgt

SEQ ID NO: 1075704 - DNA, 22 bp, Homo sapiens
cttcacctttcctctccctcag

SEQ ID NO: 1075705 - DNA, 13 bp, Homo sapiens
cttcacctttgta

SEQ ID NO: 1075706 - DNA, 19 bp, Homo sapiens
cttcacggaagagccttgc

SEQ ID NO: 1075707 - DNA, 15 bp, Homo sapiens
cttcactaccctgat

SEQ ID NO: 1075708 - DNA, 18 bp, Homo sapiens
cttcactactttaataaa

SEQ ID NO: 1075709 - DNA, 14 bp, Homo sapiens
cttcactccggtgt

SEQ ID NO: 1075710 - DNA, 24 bp, Homo sapiens
cttcactccggtgtgcctgcagcc

SEQ ID NO: 1075711 - DNA, 20 bp, Homo sapiens
cttcactgaacatgcctagt

SEQ ID NO: 1075712 - DNA, 14 bp, Homo sapiens
cttcactgccatga

SEQ ID NO: 1075713 - DNA, 17 bp, Homo sapiens
cttcactgtgaggggaa

SEQ ID NO: 1075714 - DNA, 23 bp, Homo sapiens
cttcactgtgaggggaaggcctt

SEQ ID NO: 1075715 - DNA, 16 bp, Homo sapiens
cttcactgtggccaca

SEQ ID NO: 1075716 - DNA, 17 bp, Homo sapiens
cttcactgtggccacag

SEQ ID NO: 1075717 - DNA, 18 bp, Homo sapiens
cttcactgtggccacagc

SEQ ID NO: 1075718 - DNA, 21 bp, Homo sapiens
cttcactgtggccacagcccc

SEQ ID NO: 1075719 - DNA, 18 bp, Homo sapiens
cttcactgttccctctgg

SEQ ID NO: 1075720 - DNA, 23 bp, Homo sapiens
cttcactgttccctctggcttcc

SEQ ID NO: 1075721 - DNA, 15 bp, Homo sapiens
cttcactgttgaaaa

SEQ ID NO: 1075722 - DNA, 18 bp, Homo sapiens
cttcactgttgaaaatta

SEQ ID NO: 1075723 - DNA, 19 bp, Homo sapiens
cttcactgttgaaaattat

SEQ ID NO: 1075724 - DNA, 18 bp, Homo sapiens
cttcacttaatccattta

SEQ ID NO: 1075725 - DNA, 19 bp, Homo sapiens
cttcacttgagttggctgt

SEQ ID NO: 1075726 - DNA, 17 bp, Homo sapiens
cttcactttcctcagtt

SEQ ID NO: 1075727 - DNA, 18 bp, Homo sapiens
cttcactttcctcagttg

SEQ ID NO: 1075728 - DNA, 17 bp, Homo sapiens
cttcagaaaaggagtgg

SEQ ID NO: 1075729 - DNA, 23 bp, Homo sapiens
cttcagaaacccggcttcctgtg

SEQ ID NO: 1075730 - DNA, 16 bp, Homo sapiens
cttcagaacacacaga

SEQ ID NO: 1075731 - DNA, 20 bp, Homo sapiens
cttcagaacacacagacttt

SEQ ID NO: 1075732 - DNA, 23 bp, Homo sapiens
cttcagaacacacagactttctg

SEQ ID NO: 1075733 - DNA, 16 bp, Homo sapiens
cttcagaacagaggca

SEQ ID NO: 1075734 - DNA, 19 bp, Homo sapiens
cttcagaacagaggcattt

SEQ ID NO: 1075735 - DNA, 15 bp, Homo sapiens
cttcagaactgccct

SEQ ID NO: 1075736 - DNA, 20 bp, Homo sapiens
cttcagaactgcccttgctg

SEQ ID NO: 1075737 - DNA, 17 bp, Homo sapiens
cttcagaagacactgca

SEQ ID NO: 1075738 - DNA, 14 bp, Homo sapiens
cttcagacccagag

SEQ ID NO: 1075739 - DNA, 16 bp, Homo sapiens
cttcagacccagagaa

SEQ ID NO: 1075740 - DNA, 14 bp, Homo sapiens
cttcagactttgct

SEQ ID NO: 1075741 - DNA, 19 bp, Homo sapiens
cttcagactttgcttccca

SEQ ID NO: 1075742 - DNA, 14 bp, Homo sapiens
cttcagagagctgg

SEQ ID NO: 1075743 - DNA, 12 bp, Homo sapiens
cttcagagggaa

SEQ ID NO: 1075744 - DNA, 19 bp, Homo sapiens
cttcagagtgaagaatctt

SEQ ID NO: 1075745 - DNA, 13 bp, Homo sapiens
cttcagagtttgt

SEQ ID NO: 1075746 - DNA, 21 bp, Homo sapiens
cttcagagtttgtgtgtattt

SEQ ID NO: 1075747 - DNA, 19 bp, Homo sapiens
cttcagatattattgcttt

SEQ ID NO: 1075748 - DNA, 16 bp, Homo sapiens
cttcagatgctcttgg

SEQ ID NO: 1075749 - DNA, 18 bp, Homo sapiens
cttcagatggaaactctt

SEQ ID NO: 1075750 - DNA, 13 bp, Homo sapiens
cttcagcacagga

SEQ ID NO: 1075751 - DNA, 13 bp, Homo sapiens
cttcagcacttta

SEQ ID NO: 1075752 - DNA, 21 bp, Homo sapiens
cttcagcagtacctataaagt

SEQ ID NO: 1075753 - DNA, 14 bp, Homo sapiens
cttcagccatcaac

SEQ ID NO: 1075754 - DNA, 12 bp, Homo sapiens
cttcagcccagg

SEQ ID NO: 1075755 - DNA, 16 bp, Homo sapiens
cttcagcccccaccag

SEQ ID NO: 1075756 - DNA, 21 bp, Homo sapiens
cttcagcccccaccaggggaa

SEQ ID NO: 1075757 - DNA, 19 bp, Homo sapiens
cttcagccctggccaagct

SEQ ID NO: 1075758 - DNA, 16 bp, Homo sapiens
cttcagccctggcccc

SEQ ID NO: 1075759 - DNA, 13 bp, Homo sapiens
cttcagcctagcc

SEQ ID NO: 1075760 - DNA, 16 bp, Homo sapiens
cttcagcctccctcag

SEQ ID NO: 1075761 - DNA, 17 bp, Homo sapiens
cttcagcctccctcagc

SEQ ID NO: 1075762 - DNA, 13 bp, Homo sapiens
cttcagccttaat

SEQ ID NO: 1075763 - DNA, 20 bp, Homo sapiens
cttcagctagcttttaggaa

SEQ ID NO: 1075764 - DNA, 21 bp, Homo sapiens
cttcagctcaactcacagctt

SEQ ID NO: 1075765 - DNA, 13 bp, Homo sapiens
cttcagctccagg

SEQ ID NO: 1075766 - DNA, 13 bp, Homo sapiens
cttcagctgactc

SEQ ID NO: 1075767 - DNA, 14 bp, Homo sapiens
cttcagctgcctga

SEQ ID NO: 1075768 - DNA, 14 bp, Homo sapiens
cttcccctccctgg

SEQ ID NO: 1075769 - DNA, 16 bp, Homo sapiens
cttcccctccctggct

SEQ ID NO: 1075770 - DNA, 18 bp, Homo sapiens
cttcccctccctggctcc

SEQ ID NO: 1075771 - DNA, 22 bp, Homo sapiens
cttcccctgagagtttcctcag

SEQ ID NO: 1075772 - DNA, 23 bp, Homo sapiens
cttcccctgagagtttcctcaga

SEQ ID NO: 1075773 - DNA, 12 bp, Homo sapiens
cttcccctgcac

SEQ ID NO: 1075774 - DNA, 17 bp, Homo sapiens
cttcccctgcacctggc

SEQ ID NO: 1075775 - DNA, 13 bp, Homo sapiens
cttcccctgctga

SEQ ID NO: 1075776 - DNA, 13 bp, Homo sapiens
cttcccctgggat

SEQ ID NO: 1075777 - DNA, 15 bp, Homo sapiens
cttcccctgggatgc

SEQ ID NO: 1075778 - DNA, 17 bp, Homo sapiens
cttccccttccccgtcc

SEQ ID NO: 1075779 - DNA, 15 bp, Homo sapiens
cttccccttcctaag

SEQ ID NO: 1075780 - DNA, 14 bp, Homo sapiens
cttccccttctgtg

SEQ ID NO: 1075781 - DNA, 17 bp, Homo sapiens
cttccccttcttgccat

SEQ ID NO: 1075782 - DNA, 23 bp, Homo sapiens
cttccccttgcccagggctcagc

SEQ ID NO: 1075783 - DNA, 17 bp, Homo sapiens
cttccccttgcccttgc

SEQ ID NO: 1075784 - DNA, 13 bp, Homo sapiens
cttcccctttccc

SEQ ID NO: 1075785 - DNA, 16 bp, Homo sapiens
cttcccctttgtcctg

SEQ ID NO: 1075786 - DNA, 18 bp, Homo sapiens
cttcccctttgtcctgcg

SEQ ID NO: 1075787 - DNA, 19 bp, Homo sapiens
cttcccctttgtcctgcgt

SEQ ID NO: 1075788 - DNA, 19 bp, Homo sapiens
cttcccgacccagccagct

SEQ ID NO: 1075789 - DNA, 16 bp, Homo sapiens
cttcccgccccacctc

SEQ ID NO: 1075790 - DNA, 19 bp, Homo sapiens
cttcccgccccacctccca

SEQ ID NO: 1075791 - DNA, 19 bp, Homo sapiens
cttcccgtcccatatcctg

SEQ ID NO: 1075792 - DNA, 20 bp, Homo sapiens
cttcccgtcccatatcctgc

SEQ ID NO: 1075793 - DNA, 21 bp, Homo sapiens
cttcccgtcccatatcctgcc

SEQ ID NO: 1075794 - DNA, 23 bp, Homo sapiens
cttcccgtcccatatcctgcctc

SEQ ID NO: 1075795 - DNA, 13 bp, Homo sapiens
cttcccgttctta

SEQ ID NO: 1075796 - DNA, 23 bp, Homo sapiens
cttccctagagggttcctgtaga

SEQ ID NO: 1075797 - DNA, 15 bp, Homo sapiens
cttccctcacaccgc

SEQ ID NO: 1075798 - DNA, 13 bp, Homo sapiens
cttccctcacccc

SEQ ID NO: 1075799 - DNA, 20 bp, Homo sapiens
cttccctcactcttcctcat

SEQ ID NO: 1075800 - DNA, 11 bp, Homo sapiens
cttccctcctc

SEQ ID NO: 1075801 - DNA, 17 bp, Homo sapiens
cttccctcctcccatgt

SEQ ID NO: 1075802 - DNA, 16 bp, Homo sapiens
cttccctcctgctttg

SEQ ID NO: 1075803 - DNA, 19 bp, Homo sapiens
cttccctcctgtgccccag

SEQ ID NO: 1075804 - DNA, 14 bp, Homo sapiens
cttccctctcagct

SEQ ID NO: 1075805 - DNA, 15 bp, Homo sapiens
cttccctctctgatg

SEQ ID NO: 1075806 - DNA, 20 bp, Homo sapiens
cttccctctctgatgtccca

SEQ ID NO: 1075807 - DNA, 21 bp, Homo sapiens
cttccctctctgatgtcccag

SEQ ID NO: 1075808 - DNA, 23 bp, Homo sapiens
cttccctctctgatgtcccagtg

SEQ ID NO: 1075809 - DNA, 19 bp, Homo sapiens
cttccctctgcctgtccct

SEQ ID NO: 1075810 - DNA, 16 bp, Homo sapiens
cttccctctgggcacg

SEQ ID NO: 1075811 - DNA, 17 bp, Homo sapiens
cttccctctgtttctct

SEQ ID NO: 1075812 - DNA, 17 bp, Homo sapiens
cttccctgacttgcttt

SEQ ID NO: 1075813 - DNA, 19 bp, Homo sapiens
cttccctgattgacctgct

SEQ ID NO: 1075814 - DNA, 20 bp, Homo sapiens
cttccctgattgacctgctc

SEQ ID NO: 1075815 - DNA, 13 bp, Homo sapiens
cttccctgcccca

SEQ ID NO: 1075816 - DNA, 18 bp, Homo sapiens
cttccctgcgcctgtgat

SEQ ID NO: 1075817 - DNA, 11 bp, Homo sapiens
cttccctggct

SEQ ID NO: 1075818 - DNA, 13 bp, Homo sapiens
cttccctgggcct

SEQ ID NO: 1075819 - DNA, 17 bp, Homo sapiens
cttccctgggctgtgct

SEQ ID NO: 1075820 - DNA, 18 bp, Homo sapiens
cttccctgggctgtgcta

SEQ ID NO: 1075821 - DNA, 11 bp, Homo sapiens
cttccctgggg

SEQ ID NO: 1075822 - DNA, 12 bp, Homo sapiens
cttccctgggga

SEQ ID NO: 1075823 - DNA, 21 bp, Homo sapiens
cttccctggggagccctcagg

SEQ ID NO: 1075824 - DNA, 22 bp, Homo sapiens
cttccctggggagccctcaggc

SEQ ID NO: 1075825 - DNA, 17 bp, Homo sapiens
cttccctgtcagcctga

SEQ ID NO: 1075826 - DNA, 12 bp, Homo sapiens
cttccctgtccc

SEQ ID NO: 1075827 - DNA, 17 bp, Homo sapiens
cttcccttagcctctcc

SEQ ID NO: 1075828 - DNA, 19 bp, Homo sapiens
cttcccttgagatgagttt

SEQ ID NO: 1075829 - DNA, 19 bp, Homo sapiens
cttcccttgccactttgca

SEQ ID NO: 1075830 - DNA, 13 bp, Homo sapiens
cttcccttggagg

SEQ ID NO: 1075831 - DNA, 14 bp, Homo sapiens
cttcccttggaggg

SEQ ID NO: 1075832 - DNA, 14 bp, Homo sapiens
cttcccttttacat

SEQ ID NO: 1075833 - DNA, 20 bp, Homo sapiens
cttccgaaaaatcctcttcc

SEQ ID NO: 1075834 - DNA, 23 bp, Homo sapiens
cttccgaaaaatcctcttcctct

SEQ ID NO: 1075835 - DNA, 13 bp, Homo sapiens
cttccgacatccc

SEQ ID NO: 1075836 - DNA, 17 bp, Homo sapiens
cttccgaccctctggga

SEQ ID NO: 1075837 - DNA, 19 bp, Homo sapiens
cttccgaccctctgggaac

SEQ ID NO: 1075838 - DNA, 22 bp, Homo sapiens
cttccgaccctctgggaacctc

SEQ ID NO: 1075839 - DNA, 23 bp, Homo sapiens
cttccgaccctctgggaacctcc

SEQ ID NO: 1075840 - DNA, 22 bp, Homo sapiens
cttccgagatccccagggcagc

SEQ ID NO: 1075841 - DNA, 19 bp, Homo sapiens
cttccgcagcccctttccc

SEQ ID NO: 1075842 - DNA, 14 bp, Homo sapiens
cttccgcagtgtgg

SEQ ID NO: 1075843 - DNA, 15 bp, Homo sapiens
cttccgcccctgcct

SEQ ID NO: 1075844 - DNA, 16 bp, Homo sapiens
cttccgcccctgcctg

SEQ ID NO: 1075845 - DNA, 17 bp, Homo sapiens
cttccgcccctgcctgc

SEQ ID NO: 1075846 - DNA, 20 bp, Homo sapiens
cttccgcccctgcctgccat

SEQ ID NO: 1075847 - DNA, 16 bp, Homo sapiens
cttccgctccctggat

SEQ ID NO: 1075848 - DNA, 13 bp, Homo sapiens
cttccgctgaggg

SEQ ID NO: 1075849 - DNA, 22 bp, Homo sapiens
cttccgctgaggggtctcggat

SEQ ID NO: 1075850 - DNA, 23 bp, Homo sapiens
cttccgggagctggtgacagcct

SEQ ID NO: 1075851 - DNA, 20 bp, Homo sapiens
cttccgggtctcgcagcctg

SEQ ID NO: 1075852 - DNA, 19 bp, Homo sapiens
cttccgggttcaagtgact

SEQ ID NO: 1075853 - DNA, 14 bp, Homo sapiens
cttccgtccatccc

SEQ ID NO: 1075854 - DNA, 13 bp, Homo sapiens
cttccgtctcccc

SEQ ID NO: 1075855 - DNA, 16 bp, Homo sapiens
cttccgtctcccccgt

SEQ ID NO: 1075856 - DNA, 18 bp, Homo sapiens
cttccgtgcatcccagat

SEQ ID NO: 1075857 - DNA, 18 bp, Homo sapiens
cttcctaattccacagct

SEQ ID NO: 1075858 - DNA, 17 bp, Homo sapiens
cttcctaccaagtcaaa

SEQ ID NO: 1075859 - DNA, 19 bp, Homo sapiens
cttcctaccctccttccac

SEQ ID NO: 1075860 - DNA, 18 bp, Homo sapiens
cttcctagaagcccctgt

SEQ ID NO: 1075861 - DNA, 15 bp, Homo sapiens
cttcctagttttctc

SEQ ID NO: 1075862 - DNA, 18 bp, Homo sapiens
cttcctatgcccaggtac

SEQ ID NO: 1075863 - DNA, 19 bp, Homo sapiens
cttcctattctcctgccat

SEQ ID NO: 1075864 - DNA, 17 bp, Homo sapiens
cttcctcacacccctgt

SEQ ID NO: 1075865 - DNA, 13 bp, Homo sapiens
cttcctcacactg

SEQ ID NO: 1075866 - DNA, 15 bp, Homo sapiens
cttcctcacactgct

SEQ ID NO: 1075867 - DNA, 16 bp, Homo sapiens
cttcctcacactgctg

SEQ ID NO: 1075868 - DNA, 16 bp, Homo sapiens
cttcctcactgcccaa

SEQ ID NO: 1075869 - DNA, 14 bp, Homo sapiens
cttcctcagcctcc

SEQ ID NO: 1075870 - DNA, 20 bp, Homo sapiens
cttcctcagtttaatccttc

SEQ ID NO: 1075871 - DNA, 13 bp, Homo sapiens
cttcctccacagt

SEQ ID NO: 1075872 - DNA, 14 bp, Homo sapiens
cttcctccacagtc

SEQ ID NO: 1075873 - DNA, 13 bp, Homo sapiens
cttcctccactgc

SEQ ID NO: 1075874 - DNA, 12 bp, Homo sapiens
cttcctccagag

SEQ ID NO: 1075875 - DNA, 17 bp, Homo sapiens
cttcctccagctgcacc

SEQ ID NO: 1075876 - DNA, 18 bp, Homo sapiens
cttcctccagctgcacca

SEQ ID NO: 1075877 - DNA, 15 bp, Homo sapiens
cttcctccccacact

SEQ ID NO: 1075878 - DNA, 21 bp, Homo sapiens
cttcctccccacactccactc

SEQ ID NO: 1075879 - DNA, 22 bp, Homo sapiens
cttcctccccacactccactct

SEQ ID NO: 1075880 - DNA, 12 bp, Homo sapiens
cttcctccccgc

SEQ ID NO: 1075881 - DNA, 12 bp, Homo sapiens
cttcctcccctc

SEQ ID NO: 1075882 - DNA, 15 bp, Homo sapiens
cttcctcccctctca

SEQ ID NO: 1075883 - DNA, 22 bp, Homo sapiens
cttcctcccctctcatccccct

SEQ ID NO: 1075884 - DNA, 18 bp, Homo sapiens
cttcctttgctctgaggt

SEQ ID NO: 1075885 - DNA, 19 bp, Homo sapiens
cttcctttggggaagttta

SEQ ID NO: 1075886 - DNA, 22 bp, Homo sapiens
cttcctttggggaagtttattt

SEQ ID NO: 1075887 - DNA, 14 bp, Homo sapiens
cttcgaaaatctag

SEQ ID NO: 1075888 - DNA, 15 bp, Homo sapiens
cttcgaaaggccttc

SEQ ID NO: 1075889 - DNA, 15 bp, Homo sapiens
cttcgaactccaggc

SEQ ID NO: 1075890 - DNA, 12 bp, Homo sapiens
cttcgaagtatt

SEQ ID NO: 1075891 - DNA, 19 bp, Homo sapiens
cttcgactactgctcctgt

SEQ ID NO: 1075892 - DNA, 20 bp, Homo sapiens
cttcgactactgctcctgtg

SEQ ID NO: 1075893 - DNA, 13 bp, Homo sapiens
cttcgactgtgac

SEQ ID NO: 1075894 - DNA, 17 bp, Homo sapiens
cttcgagcactgtccag

SEQ ID NO: 1075895 - DNA, 22 bp, Homo sapiens
cttcgaggaacccacccggctg

SEQ ID NO: 1075896 - DNA, 23 bp, Homo sapiens
cttcgaggtggatcacagaggct

SEQ ID NO: 1075897 - DNA, 16 bp, Homo sapiens
cttcgcaggcatgtcc

SEQ ID NO: 1075898 - DNA, 14 bp, Homo sapiens
cttcgccctctgaa

SEQ ID NO: 1075899 - DNA, 19 bp, Homo sapiens
cttcgctccatgtttttgg

SEQ ID NO: 1075900 - DNA, 22 bp, Homo sapiens
cttcggagatgaggagtaaaat

SEQ ID NO: 1075901 - DNA, 16 bp, Homo sapiens
cttcggccacaggcag

SEQ ID NO: 1075902 - DNA, 16 bp, Homo sapiens
cttcgggcccttccca

SEQ ID NO: 1075903 - DNA, 18 bp, Homo sapiens
cttcggggaactcctgga

SEQ ID NO: 1075904 - DNA, 19 bp, Homo sapiens
cttcggggaactcctggaa

SEQ ID NO: 1075905 - DNA, 13 bp, Homo sapiens
cttcggtcacctg

SEQ ID NO: 1075906 - DNA, 22 bp, Homo sapiens
cttcgtatcccgagtctgggac

SEQ ID NO: 1075907 - DNA, 13 bp, Homo sapiens
cttcgtcctgatc

SEQ ID NO: 1075908 - DNA, 14 bp, Homo sapiens
cttcgtcctgatcc

SEQ ID NO: 1075909 - DNA, 13 bp, Homo sapiens
cttcgtcttgtgt

SEQ ID NO: 1075910 - DNA, 15 bp, Homo sapiens
cttcgtgccccccct

SEQ ID NO: 1075911 - DNA, 14 bp, Homo sapiens
cttcgtgctggagg

SEQ ID NO: 1075912 - DNA, 18 bp, Homo sapiens
cttcgtgtgctgctgctg

SEQ ID NO: 1075913 - DNA, 17 bp, Homo sapiens
cttcgttaactgtgtat

SEQ ID NO: 1075914 - DNA, 17 bp, Homo sapiens
cttcgttaatagattat

SEQ ID NO: 1075915 - DNA, 13 bp, Homo sapiens
cttcgttcgcaga

SEQ ID NO: 1075916 - DNA, 13 bp, Homo sapiens
cttcgttcttttt

SEQ ID NO: 1075917 - DNA, 18 bp, Homo sapiens
cttcgttctttttaagtt

SEQ ID NO: 1075918 - DNA, 16 bp, Homo sapiens
cttcgtttattttcaa

SEQ ID NO: 1075919 - DNA, 12 bp, Homo sapiens
cttctaaaaact

SEQ ID NO: 1075920 - DNA, 16 bp, Homo sapiens
cttctaaaagccatta

SEQ ID NO: 1075921 - DNA, 18 bp, Homo sapiens
cttctaaaagttttctaa

SEQ ID NO: 1075922 - DNA, 19 bp, Homo sapiens
cttctaaaagttttctaat

SEQ ID NO: 1075923 - DNA, 18 bp, Homo sapiens
cttctaaacttccccatc

SEQ ID NO: 1075924 - DNA, 19 bp, Homo sapiens
cttctaaacttccccatct

SEQ ID NO: 1075925 - DNA, 15 bp, Homo sapiens
cttctaaaggtgttg

SEQ ID NO: 1075926 - DNA, 13 bp, Homo sapiens
cttctaaatgcat

SEQ ID NO: 1075927 - DNA, 12 bp, Homo sapiens
cttctaaatgcc

SEQ ID NO: 1075928 - DNA, 15 bp, Homo sapiens
cttctaaatgcccag

SEQ ID NO: 1075929 - DNA, 18 bp, Homo sapiens
cttctaaatgcccagttc

SEQ ID NO: 1075930 - DNA, 17 bp, Homo sapiens
cttctaactggtaaaaa

SEQ ID NO: 1075931 - DNA, 13 bp, Homo sapiens
cttctaagaagac

SEQ ID NO: 1075932 - DNA, 16 bp, Homo sapiens
cttctaagaagacatt

SEQ ID NO: 1075933 - DNA, 17 bp, Homo sapiens
cttctaagaagacattt

SEQ ID NO: 1075934 - DNA, 12 bp, Homo sapiens
cttctaagagcg

SEQ ID NO: 1075935 - DNA, 13 bp, Homo sapiens
cttctaagataaa

SEQ ID NO: 1075936 - DNA, 16 bp, Homo sapiens
cttctaataaagtcat

SEQ ID NO: 1075937 - DNA, 12 bp, Homo sapiens
cttctaatatat

SEQ ID NO: 1075938 - DNA, 14 bp, Homo sapiens
cttctaatatattt

SEQ ID NO: 1075939 - DNA, 15 bp, Homo sapiens
cttctaatatatttt

SEQ ID NO: 1075940 - DNA, 23 bp, Homo sapiens
cttctacaggcccggcccagcct

SEQ ID NO: 1075941 - DNA, 13 bp, Homo sapiens
cttctaccctctg

SEQ ID NO: 1075942 - DNA, 15 bp, Homo sapiens
cttctacctgccctc

SEQ ID NO: 1075943 - DNA, 17 bp, Homo sapiens
cttctaccttaaaatgt

SEQ ID NO: 1075944 - DNA, 17 bp, Homo sapiens
cttctacggccatgaga

SEQ ID NO: 1075945 - DNA, 19 bp, Homo sapiens
cttctactttcatcttaaa

SEQ ID NO: 1075946 - DNA, 13 bp, Homo sapiens
cttctacttttaa

SEQ ID NO: 1075947 - DNA, 21 bp, Homo sapiens
cttctagaaactctggctcag

SEQ ID NO: 1075948 - DNA, 20 bp, Homo sapiens
cttctagaacacctgccttc

SEQ ID NO: 1075949 - DNA, 22 bp, Homo sapiens
cttctagagatgtgcctgtggg

SEQ ID NO: 1075950 - DNA, 14 bp, Homo sapiens
cttctagcagagac

SEQ ID NO: 1075951 - DNA, 17 bp, Homo sapiens
cttctagctgacttgca

SEQ ID NO: 1075952 - DNA, 19 bp, Homo sapiens
cttctagctgtctgtgaat

SEQ ID NO: 1075953 - DNA, 21 bp, Homo sapiens
cttctaggagtcaactggctg

SEQ ID NO: 1075954 - DNA, 22 bp, Homo sapiens
cttctaggagtcaactggctgg

SEQ ID NO: 1075955 - DNA, 21 bp, Homo sapiens
cttctagggttattgcatttg

SEQ ID NO: 1075956 - DNA, 21 bp, Homo sapiens
cttctagtgagcctgggccag

SEQ ID NO: 1075957 - DNA, 13 bp, Homo sapiens
cttctagtgcttt

SEQ ID NO: 1075958 - DNA, 12 bp, Homo sapiens
cttctataaaat

SEQ ID NO: 1075959 - DNA, 21 bp, Homo sapiens
cttctataatatttccttttt

SEQ ID NO: 1075960 - DNA, 13 bp, Homo sapiens
cttctatatttta

SEQ ID NO: 1075961 - DNA, 15 bp, Homo sapiens
cttctatcccaggag

SEQ ID NO: 1075962 - DNA, 21 bp, Homo sapiens
cttctatgttggtttcagtgg

SEQ ID NO: 1075963 - DNA, 13 bp, Homo sapiens
cttctattctagc

SEQ ID NO: 1075964 - DNA, 20 bp, Homo sapiens
cttctattctagcctgcatt

SEQ ID NO: 1075965 - DNA, 12 bp, Homo sapiens
cttctattttta

SEQ ID NO: 1075966 - DNA, 20 bp, Homo sapiens
cttctcaagactttagcttt

SEQ ID NO: 1075967 - DNA, 17 bp, Homo sapiens
cttctcaatagagtgtt

SEQ ID NO: 1075968 - DNA, 18 bp, Homo sapiens
cttctcacatccatctac

SEQ ID NO: 1075969 - DNA, 16 bp, Homo sapiens
cttctcactgccatgc

SEQ ID NO: 1075970 - DNA, 22 bp, Homo sapiens
cttctgccctttcctaggccca

SEQ ID NO: 1075971 - DNA, 23 bp, Homo sapiens
cttctgccctttcctaggcccag

SEQ ID NO: 1075972 - DNA, 18 bp, Homo sapiens
cttctgcctaacttgtaa

SEQ ID NO: 1075973 - DNA, 14 bp, Homo sapiens
cttctgcctggaga

SEQ ID NO: 1075974 - DNA, 14 bp, Homo sapiens
cttctgccttctca

SEQ ID NO: 1075975 - DNA, 15 bp, Homo sapiens
cttctgcgcctcagg

SEQ ID NO: 1075976 - DNA, 16 bp, Homo sapiens
cttctgcgggctccct

SEQ ID NO: 1075977 - DNA, 22 bp, Homo sapiens
cttctgcgggctccctcctctg

SEQ ID NO: 1075978 - DNA, 14 bp, Homo sapiens
cttctgcgtccacc

SEQ ID NO: 1075979 - DNA, 15 bp, Homo sapiens
cttctgcgtccacca

SEQ ID NO: 1075980 - DNA, 16 bp, Homo sapiens
cttctgcgtccaccag

SEQ ID NO: 1075981 - DNA, 18 bp, Homo sapiens
cttctgcgtccaccaggc

SEQ ID NO: 1075982 - DNA, 11 bp, Homo sapiens
cttctgctact

SEQ ID NO: 1075983 - DNA, 16 bp, Homo sapiens
cttctgctcagctctg

SEQ ID NO: 1075984 - DNA, 15 bp, Homo sapiens
cttctgctggataaa

SEQ ID NO: 1075985 - DNA, 18 bp, Homo sapiens
cttctgctgttcttcact

SEQ ID NO: 1075986 - DNA, 18 bp, Homo sapiens
cttctgcttaggagagac

SEQ ID NO: 1075987 - DNA, 21 bp, Homo sapiens
cttctgcttcaaaccctcaag

SEQ ID NO: 1075988 - DNA, 12 bp, Homo sapiens
cttctgctttca

SEQ ID NO: 1075989 - DNA, 14 bp, Homo sapiens
cttctgcttttctg

SEQ ID NO: 1075990 - DNA, 19 bp, Homo sapiens
cttctgcttttctgccctg

SEQ ID NO: 1075991 - DNA, 14 bp, Homo sapiens
cttctggaaggctg

SEQ ID NO: 1075992 - DNA, 14 bp, Homo sapiens
cttctggaatattg

SEQ ID NO: 1075993 - DNA, 15 bp, Homo sapiens
cttctggaatattgt

SEQ ID NO: 1075994 - DNA, 18 bp, Homo sapiens
cttctggaatttgttcaa

SEQ ID NO: 1075995 - DNA, 17 bp, Homo sapiens
cttctggagatggatcc

SEQ ID NO: 1075996 - DNA, 23 bp, Homo sapiens
cttctggagatggatccttccat

SEQ ID NO: 1075997 - DNA, 16 bp, Homo sapiens
cttctggcatgggaca

SEQ ID NO: 1075998 - DNA, 17 bp, Homo sapiens
cttctggccacatcagc

SEQ ID NO: 1075999 - DNA, 16 bp, Homo sapiens
cttctggcctccagcc

SEQ ID NO: 1076000 - DNA, 15 bp, Homo sapiens
cttctggcctcccac

SEQ ID NO: 1076001 - DNA, 19 bp, Homo sapiens
cttctggcctcccacagac

SEQ ID NO: 1076002 - DNA, 15 bp, Homo sapiens
cttctggcctctgct

SEQ ID NO: 1076003 - DNA, 13 bp, Homo sapiens
cttctggccttgt

SEQ ID NO: 1076004 - DNA, 21 bp, Homo sapiens
cttctggcttagtctgttttc

SEQ ID NO: 1076005 - DNA, 16 bp, Homo sapiens
cttctggcttcagccc

SEQ ID NO: 1076006 - DNA, 14 bp, Homo sapiens
cttctggcttcctt

SEQ ID NO: 1076007 - DNA, 19 bp, Homo sapiens
cttctgggagggcagcagg

SEQ ID NO: 1076008 - DNA, 22 bp, Homo sapiens
cttctgggagggcagcagggct

SEQ ID NO: 1076009 - DNA, 23 bp, Homo sapiens
cttctgggagggcagcagggcta

SEQ ID NO: 1076010 - DNA, 20 bp, Homo sapiens
cttctgggcaagggctccta

SEQ ID NO: 1076011 - DNA, 16 bp, Homo sapiens
cttctgggcagagcct

SEQ ID NO: 1076012 - DNA, 21 bp, Homo sapiens
cttctgggcagagcctgtccc

SEQ ID NO: 1076013 - DNA, 22 bp, Homo sapiens
cttctgggcttcatctggcaac

SEQ ID NO: 1076014 - DNA, 18 bp, Homo sapiens
cttctgggtagtcccctg

SEQ ID NO: 1076015 - DNA, 20 bp, Homo sapiens
cttctgggtcatgcactgag

SEQ ID NO: 1076016 - DNA, 15 bp, Homo sapiens
cttctgggtgtgctt

SEQ ID NO: 1076017 - DNA, 16 bp, Homo sapiens
cttctgggttccttcc

SEQ ID NO: 1076018 - DNA, 20 bp, Homo sapiens
cttctggtactctcctagag

SEQ ID NO: 1076019 - DNA, 15 bp, Homo sapiens
cttctggtcccctgt

SEQ ID NO: 1076020 - DNA, 18 bp, Homo sapiens
cttctggtcccctgtggt

SEQ ID NO: 1076021 - DNA, 20 bp, Homo sapiens
cttctggtcccctgtggtga

SEQ ID NO: 1076022 - DNA, 20 bp, Homo sapiens
cttctggtctggtaaatatg

SEQ ID NO: 1076023 - DNA, 14 bp, Homo sapiens
cttctgtaatattt

SEQ ID NO: 1076024 - DNA, 15 bp, Homo sapiens
cttctgtatgcatca

SEQ ID NO: 1076025 - DNA, 19 bp, Homo sapiens
cttctgtatttcactcttt

SEQ ID NO: 1076026 - DNA, 12 bp, Homo sapiens
cttctgtctgtc

SEQ ID NO: 1076027 - DNA, 17 bp, Homo sapiens
cttctgtgaaatataat

SEQ ID NO: 1076028 - DNA, 19 bp, Homo sapiens
cttctgtgaaatataattg

SEQ ID NO: 1076029 - DNA, 19 bp, Homo sapiens
cttctgtgagacccccaca

SEQ ID NO: 1076030 - DNA, 16 bp, Homo sapiens
cttctgtgatgagctg

SEQ ID NO: 1076031 - DNA, 17 bp, Homo sapiens
cttctgtgatgagctga

SEQ ID NO: 1076032 - DNA, 23 bp, Homo sapiens
cttctgtgcactagcctgtgatt

SEQ ID NO: 1076033 - DNA, 15 bp, Homo sapiens
cttctgtggctcaca

SEQ ID NO: 1076034 - DNA, 13 bp, Homo sapiens
cttctgtgggcat

SEQ ID NO: 1076035 - DNA, 11 bp, Homo sapiens
cttctgtgggg

SEQ ID NO: 1076036 - DNA, 18 bp, Homo sapiens
cttctgtggggctgggca

SEQ ID NO: 1076037 - DNA, 19 bp, Homo sapiens
cttctgtggggctgggcac

SEQ ID NO: 1076038 - DNA, 21 bp, Homo sapiens
cttctgtgggtgacccaggtc

SEQ ID NO: 1076039 - DNA, 24 bp, Homo sapiens
cttctgtgtaccacttctgtgggc

SEQ ID NO: 1076040 - DNA, 13 bp, Homo sapiens
cttctgtgtatct

SEQ ID NO: 1076041 - DNA, 14 bp, Homo sapiens
cttctgtgttcatt

SEQ ID NO: 1076042 - DNA, 17 bp, Homo sapiens
cttctgttaagaaagga

SEQ ID NO: 1076043 - DNA, 18 bp, Homo sapiens
cttctgttaagaaaggat

SEQ ID NO: 1076044 - DNA, 14 bp, Homo sapiens
cttctgttcccaag

SEQ ID NO: 1076045 - DNA, 21 bp, Homo sapiens
cttctgttctctgctgagggc

SEQ ID NO: 1076046 - DNA, 17 bp, Homo sapiens
cttctgttctctggttt

SEQ ID NO: 1076047 - DNA, 16 bp, Homo sapiens
cttctgttggcagagc

SEQ ID NO: 1076048 - DNA, 13 bp, Homo sapiens
cttcttaaaaact

SEQ ID NO: 1076049 - DNA, 15 bp, Homo sapiens
cttcttaaaaactgt

SEQ ID NO: 1076050 - DNA, 16 bp, Homo sapiens
cttcttaaaaactgtg

SEQ ID NO: 1076051 - DNA, 18 bp, Homo sapiens
cttcttaaaaactgtgta

SEQ ID NO: 1076052 - DNA, 20 bp, Homo sapiens
cttcttaaaaactgtgtatc

SEQ ID NO: 1076053 - DNA, 18 bp, Homo sapiens
cttcttaaaagaaatctt

SEQ ID NO: 1076054 - DNA, 15 bp, Homo sapiens
cttcttaaaattcaa

SEQ ID NO: 1076055 - DNA, 16 bp, Homo sapiens
cttcttaaaattcaaa

SEQ ID NO: 1076056 - DNA, 19 bp, Homo sapiens
cttcttaaagtattcttct

SEQ ID NO: 1076057 - DNA, 15 bp, Homo sapiens
cttcttacacttctt

SEQ ID NO: 1076058 - DNA, 16 bp, Homo sapiens
cttcttacacttctta

SEQ ID NO: 1076059 - DNA, 17 bp, Homo sapiens
cttcttacagaagtatt

SEQ ID NO: 1076060 - DNA, 14 bp, Homo sapiens
cttcttattctcac

SEQ ID NO: 1076061 - DNA, 20 bp, Homo sapiens
cttcttattctcactccacc

SEQ ID NO: 1076062 - DNA, 22 bp, Homo sapiens
cttcttcacccagctaatctgt

SEQ ID NO: 1076063 - DNA, 13 bp, Homo sapiens
cttcttcacctct

SEQ ID NO: 1076064 - DNA, 18 bp, Homo sapiens
cttcttcacctcttccac

SEQ ID NO: 1076065 - DNA, 13 bp, Homo sapiens
cttcttcagctga

SEQ ID NO: 1076066 - DNA, 14 bp, Homo sapiens
cttcttcagctgac

SEQ ID NO: 1076067 - DNA, 19 bp, Homo sapiens
cttcttcataattttagta

SEQ ID NO: 1076068 - DNA, 19 bp, Homo sapiens
cttcttccaaggagcagag

SEQ ID NO: 1076069 - DNA, 14 bp, Homo sapiens
cttcttccacttct

SEQ ID NO: 1076070 - DNA, 17 bp, Homo sapiens
cttcttccacttctcca

SEQ ID NO: 1076071 - DNA, 19 bp, Homo sapiens
cttcttcccctctgcggct

SEQ ID NO: 1076072 - DNA, 22 bp, Homo sapiens
cttcttcccctttgtcctgcgt

SEQ ID NO: 1076073 - DNA, 21 bp, Homo sapiens
cttcttcccgccccacctccc

SEQ ID NO: 1076074 - DNA, 18 bp, Homo sapiens
cttcttccctgtcagcct

SEQ ID NO: 1076075 - DNA, 21 bp, Homo sapiens
cttcttcccttaactccaaga

SEQ ID NO: 1076076 - DNA, 18 bp, Homo sapiens
cttcttcctcacactgct

SEQ ID NO: 1076077 - DNA, 20 bp, Homo sapiens
cttcttcctcacactgctgt

SEQ ID NO: 1076078 - DNA, 23 bp, Homo sapiens
cttcttcctcacactgctgtcct

SEQ ID NO: 1076079 - DNA, 16 bp, Homo sapiens
cttcttcctcccctca

SEQ ID NO: 1076080 - DNA, 18 bp, Homo sapiens
cttcttcctcccctcaac

SEQ ID NO: 1076081 - DNA, 16 bp, Homo sapiens
cttcttcctcctccat

SEQ ID NO: 1076082 - DNA, 22 bp, Homo sapiens
cttcttcctcctccatcacctg

SEQ ID NO: 1076083 - DNA, 13 bp, Homo sapiens
cttcttccttctt

SEQ ID NO: 1076084 - DNA, 15 bp, Homo sapiens
cttcttcctttctct

SEQ ID NO: 1076085 - DNA, 20 bp, Homo sapiens
cttcttcgcaaactgatgga

SEQ ID NO: 1076086 - DNA, 20 bp, Homo sapiens
cttcttcggggaactcctgg

SEQ ID NO: 1076087 - DNA, 21 bp, Homo sapiens
cttcttcggggaactcctgga

SEQ ID NO: 1076088 - DNA, 12 bp, Homo sapiens
cttcttctccat

SEQ ID NO: 1076089 - DNA, 19 bp, Homo sapiens
cttcttctcctatgtgtaa

SEQ ID NO: 1076090 - DNA, 17 bp, Homo sapiens
cttcttctgccacttct

SEQ ID NO: 1076091 - DNA, 12 bp, Homo sapiens
cttcttctgtaa

SEQ ID NO: 1076092 - DNA, 15 bp, Homo sapiens
cttcttctgtaatat

SEQ ID NO: 1076093 - DNA, 18 bp, Homo sapiens
cttcttctgtaatattta

SEQ ID NO: 1076094 - DNA, 13 bp, Homo sapiens
cttcttgcatcta

SEQ ID NO: 1076095 - DNA, 21 bp, Homo sapiens
cttcttgccattattaaccca

SEQ ID NO: 1076096 - DNA, 13 bp, Homo sapiens
cttcttgcctctg

SEQ ID NO: 1076097 - DNA, 17 bp, Homo sapiens
cttcttgcctctgtgct

SEQ ID NO: 1076098 - DNA, 23 bp, Homo sapiens
cttcttgctacaccccttttcca

SEQ ID NO: 1076099 - DNA, 15 bp, Homo sapiens
cttcttgctgccctg

SEQ ID NO: 1076100 - DNA, 20 bp, Homo sapiens
cttcttgcttctttctagaa

SEQ ID NO: 1076101 - DNA, 22 bp, Homo sapiens
cttcttggagctttggaatatt

SEQ ID NO: 1076102 - DNA, 13 bp, Homo sapiens
cttcttggcttct

SEQ ID NO: 1076103 - DNA, 22 bp, Homo sapiens
cttcttgggagtatgttgtcat

SEQ ID NO: 1076104 - DNA, 13 bp, Homo sapiens
cttcttgggcccc

SEQ ID NO: 1076105 - DNA, 15 bp, Homo sapiens
cttcttgggccccag

SEQ ID NO: 1076106 - DNA, 12 bp, Homo sapiens
cttcttgggctg

SEQ ID NO: 1076107 - DNA, 16 bp, Homo sapiens
cttcttgggctgagtg

SEQ ID NO: 1076108 - DNA, 19 bp, Homo sapiens
cttcttgggctgagtgcag

SEQ ID NO: 1076109 - DNA, 18 bp, Homo sapiens
cttcttgggtagggcaga

SEQ ID NO: 1076110 - DNA, 13 bp, Homo sapiens
cttcttgggtctg

SEQ ID NO: 1076111 - DNA, 20 bp, Homo sapiens
cttcttggtcttatttatta

SEQ ID NO: 1076112 - DNA, 23 bp, Homo sapiens
cttcttggtgcttacacatctca

SEQ ID NO: 1076113 - DNA, 13 bp, Homo sapiens
cttcttggttcct

SEQ ID NO: 1076114 - DNA, 16 bp, Homo sapiens
cttcttggttcctggg

SEQ ID NO: 1076115 - DNA, 17 bp, Homo sapiens
cttcttggtttcagcca

SEQ ID NO: 1076116 - DNA, 19 bp, Homo sapiens
cttcttggtttggggagaa

SEQ ID NO: 1076117 - DNA, 21 bp, Homo sapiens
cttcttggttttctctctgga

SEQ ID NO: 1076118 - DNA, 15 bp, Homo sapiens
cttcttgttctgaga

SEQ ID NO: 1076119 - DNA, 18 bp, Homo sapiens
cttctttactaacactgg

SEQ ID NO: 1076120 - DNA, 14 bp, Homo sapiens
cttctttagaacag

SEQ ID NO: 1076121 - DNA, 17 bp, Homo sapiens
cttctttagatgccaaa

SEQ ID NO: 1076122 - DNA, 20 bp, Homo sapiens
cttctttagcatttttatgc

SEQ ID NO: 1076123 - DNA, 22 bp, Homo sapiens
cttctttataattctactttga

SEQ ID NO: 1076124 - DNA, 15 bp, Homo sapiens
cttctttattattcc

SEQ ID NO: 1076125 - DNA, 18 bp, Homo sapiens
cttctttccattcttctt

SEQ ID NO: 1076126 - DNA, 20 bp, Homo sapiens
cttctttccattcttcttgc

SEQ ID NO: 1076127 - DNA, 11 bp, Homo sapiens
cttctttcctc

SEQ ID NO: 1076128 - DNA, 15 bp, Homo sapiens
cttctttcctcttcc

SEQ ID NO: 1076129 - DNA, 18 bp, Homo sapiens
cttctttcctttactcct

SEQ ID NO: 1076130 - DNA, 13 bp, Homo sapiens
cttctttctggac

SEQ ID NO: 1076131 - DNA, 16 bp, Homo sapiens
cttctttgcagagcct

SEQ ID NO: 1076132 - DNA, 18 bp, Homo sapiens
cttctttgcctccctcag

SEQ ID NO: 1076133 - DNA, 22 bp, Homo sapiens
cttctttgctgctgcttcctgt

SEQ ID NO: 1076134 - DNA, 18 bp, Homo sapiens
cttctttgggtaaacgtg

SEQ ID NO: 1076135 - DNA, 13 bp, Homo sapiens
cttcttttactca

SEQ ID NO: 1076136 - DNA, 11 bp, Homo sapiens
cttcttttgaa

SEQ ID NO: 1076137 - DNA, 14 bp, Homo sapiens
cttcttttgaacat

SEQ ID NO: 1076138 - DNA, 14 bp, Homo sapiens
cttcttttgctctt

SEQ ID NO: 1076139 - DNA, 24 bp, Homo sapiens
cttcttttgtggtgtcttccatgt

SEQ ID NO: 1076140 - DNA, 15 bp, Homo sapiens
cttctttttattttc

SEQ ID NO: 1076141 - DNA, 16 bp, Homo sapiens
cttctttttctggact

SEQ ID NO: 1076142 - DNA, 21 bp, Homo sapiens
cttctttttctggactctgga

SEQ ID NO: 1076143 - DNA, 19 bp, Homo sapiens
cttcttttttcaaaagaaa

SEQ ID NO: 1076144 - DNA, 20 bp, Homo sapiens
cttcttttttcaaaagaaag

SEQ ID NO: 1076145 - DNA, 17 bp, Homo sapiens
cttctttttttgtgatg

SEQ ID NO: 1076146 - DNA, 14 bp, Homo sapiens
cttgaaaaaaaaca

SEQ ID NO: 1076147 - DNA, 18 bp, Homo sapiens
cttgaaaaaaaacagtgg

SEQ ID NO: 1076148 - DNA, 15 bp, Homo sapiens
cttgaaaaagatggc

SEQ ID NO: 1076149 - DNA, 20 bp, Homo sapiens
cttgaaaaagatggcttatg

SEQ ID NO: 1076150 - DNA, 20 bp, Homo sapiens
cttgaaaattttattaaaaa

SEQ ID NO: 1076151 - DNA, 13 bp, Homo sapiens
cttgaaagaaatg

SEQ ID NO: 1076152 - DNA, 19 bp, Homo sapiens
cttgaaagaagttttatgc

SEQ ID NO: 1076153 - DNA, 13 bp, Homo sapiens
cttgaaagctgtg

SEQ ID NO: 1076154 - DNA, 23 bp, Homo sapiens
cttgaaaggcaggaagggaagcg

SEQ ID NO: 1076155 - DNA, 16 bp, Homo sapiens
cttgaaagttttccag

SEQ ID NO: 1076156 - DNA, 23 bp, Homo sapiens
cttgaaagttttccagtattgaa

SEQ ID NO: 1076157 - DNA, 22 bp, Homo sapiens
cttgaaataccagtgaaccaaa

SEQ ID NO: 1076158 - DNA, 19 bp, Homo sapiens
cttgaaatataggaactta

SEQ ID NO: 1076159 - DNA, 17 bp, Homo sapiens
cttgaaatatataatat

SEQ ID NO: 1076160 - DNA, 16 bp, Homo sapiens
cttgaaatattcagaa

SEQ ID NO: 1076161 - DNA, 16 bp, Homo sapiens
cttgaaatgtagaatt

SEQ ID NO: 1076162 - DNA, 21 bp, Homo sapiens
cttgaaattaagaaggcaaaa

SEQ ID NO: 1076163 - DNA, 15 bp, Homo sapiens
cttgaaattactgtg

SEQ ID NO: 1076164 - DNA, 17 bp, Homo sapiens
cttgaaattactgtgta

SEQ ID NO: 1076165 - DNA, 18 bp, Homo sapiens
cttgaaattactgtgtaa

SEQ ID NO: 1076166 - DNA, 19 bp, Homo sapiens
cttgaaattttaaactata

SEQ ID NO: 1076167 - DNA, 14 bp, Homo sapiens
cttgaaattttaac

SEQ ID NO: 1076168 - DNA, 15 bp, Homo sapiens
cttgaacactggggg

SEQ ID NO: 1076169 - DNA, 16 bp, Homo sapiens
cttgaacccaacagtc

SEQ ID NO: 1076170 - DNA, 16 bp, Homo sapiens
cttgaaccccctccct

SEQ ID NO: 1076171 - DNA, 15 bp, Homo sapiens
cttgaacctgcttcc

SEQ ID NO: 1076172 - DNA, 18 bp, Homo sapiens
cttgaacctgcttcctgg

SEQ ID NO: 1076173 - DNA, 14 bp, Homo sapiens
cttgaactgaggcc

SEQ ID NO: 1076174 - DNA, 15 bp, Homo sapiens
cttgaactgaggccc

SEQ ID NO: 1076175 - DNA, 20 bp, Homo sapiens
cttgaactgaggccctgtga

SEQ ID NO: 1076176 - DNA, 22 bp, Homo sapiens
cttgaactgaggccctgtgata

SEQ ID NO: 1076177 - DNA, 14 bp, Homo sapiens
cttgaactgattca

SEQ ID NO: 1076178 - DNA, 15 bp, Homo sapiens
cttgaactttgacct

SEQ ID NO: 1076179 - DNA, 18 bp, Homo sapiens
cttgaagaaaatgacttt

SEQ ID NO: 1076180 - DNA, 19 bp, Homo sapiens
cttgaagaaaatgacttta

SEQ ID NO: 1076181 - DNA, 12 bp, Homo sapiens
cttgaagcaata

SEQ ID NO: 1076182 - DNA, 14 bp, Homo sapiens
cttgaagcaataac

SEQ ID NO: 1076183 - DNA, 20 bp, Homo sapiens
cttgaagcaataactccaag

SEQ ID NO: 1076184 - DNA, 21 bp, Homo sapiens
cttgaagcaataactccaagc

SEQ ID NO: 1076185 - DNA, 22 bp, Homo sapiens
cttgaagcaataactccaagca

SEQ ID NO: 1076186 - DNA, 13 bp, Homo sapiens
cttgaagccactg

SEQ ID NO: 1076187 - DNA, 20 bp, Homo sapiens
cttgaagctgggctgtctct

SEQ ID NO: 1076188 - DNA, 11 bp, Homo sapiens
cttgaagctgt

SEQ ID NO: 1076189 - DNA, 16 bp, Homo sapiens
cttgaaggattgcatc

SEQ ID NO: 1076190 - DNA, 19 bp, Homo sapiens
cttgaaggattgcatcctg

SEQ ID NO: 1076191 - DNA, 17 bp, Homo sapiens
cttgaaggccctgctga

SEQ ID NO: 1076192 - DNA, 15 bp, Homo sapiens
cttgaagtcagccac

SEQ ID NO: 1076193 - DNA, 21 bp, Homo sapiens
cttgaagtcagccacactggg

SEQ ID NO: 1076194 - DNA, 23 bp, Homo sapiens
cttgaagtcagccacactgggcc

SEQ ID NO: 1076195 - DNA, 19 bp, Homo sapiens
cttgaagtctaaaagcaga

SEQ ID NO: 1076196 - DNA, 22 bp, Homo sapiens
cttgaagttgttactaactaaa

SEQ ID NO: 1076197 - DNA, 21 bp, Homo sapiens
cttgaatagattttctctgga

SEQ ID NO: 1076198 - DNA, 15 bp, Homo sapiens
cttgaatagtattgt

SEQ ID NO: 1076199 - DNA, 17 bp, Homo sapiens
cttgaatagtattgtgt

SEQ ID NO: 1076200 - DNA, 24 bp, Homo sapiens
cttgaatatctgccccagtagtca

SEQ ID NO: 1076201 - DNA, 18 bp, Homo sapiens
cttgaatatggaacatat

SEQ ID NO: 1076202 - DNA, 16 bp, Homo sapiens
cttgaatattcctgga

SEQ ID NO: 1076203 - DNA, 15 bp, Homo sapiens
cttgaatctttttat

SEQ ID NO: 1076204 - DNA, 14 bp, Homo sapiens
cttgaatgctgcca

SEQ ID NO: 1076205 - DNA, 15 bp, Homo sapiens
cttgaatgctgccag

SEQ ID NO: 1076206 - DNA, 18 bp, Homo sapiens
cttgaatgtggtctcagg

SEQ ID NO: 1076207 - DNA, 15 bp, Homo sapiens
cttgaattgttatga

SEQ ID NO: 1076208 - DNA, 16 bp, Homo sapiens
cttgaatttctagaca

SEQ ID NO: 1076209 - DNA, 21 bp, Homo sapiens
cttgaattttttgaaatgggc

SEQ ID NO: 1076210 - DNA, 17 bp, Homo sapiens
cttgacaacagactgaa

SEQ ID NO: 1076211 - DNA, 23 bp, Homo sapiens
cttgacaagctgacttggcactt

SEQ ID NO: 1076212 - DNA, 15 bp, Homo sapiens
cttgacacctgctga

SEQ ID NO: 1076213 - DNA, 20 bp, Homo sapiens
cttgacagtggaactacatt

SEQ ID NO: 1076214 - DNA, 13 bp, Homo sapiens
cttgacatgtgca

SEQ ID NO: 1076215 - DNA, 17 bp, Homo sapiens
cttgaccaggcttggcc

SEQ ID NO: 1076216 - DNA, 13 bp, Homo sapiens
cttgacccatctc

SEQ ID NO: 1076217 - DNA, 23 bp, Homo sapiens
cttgaccctgaaaggaacactgg

SEQ ID NO: 1076218 - DNA, 13 bp, Homo sapiens
cttgaccctttcc

SEQ ID NO: 1076219 - DNA, 14 bp, Homo sapiens
cttgaccctttcct

SEQ ID NO: 1076220 - DNA, 15 bp, Homo sapiens
cttgaccctttcctc

SEQ ID NO: 1076221 - DNA, 19 bp, Homo sapiens
cttgaccctttcctccccc

SEQ ID NO: 1076222 - DNA, 23 bp, Homo sapiens
cttgaccgtactctcacatgtgg

SEQ ID NO: 1076223 - DNA, 21 bp, Homo sapiens
cttgaccgtttttatattact

SEQ ID NO: 1076224 - DNA, 22 bp, Homo sapiens
cttgaccgtttttatattactt

SEQ ID NO: 1076225 - DNA, 18 bp, Homo sapiens
cttgacctagctctttgg

SEQ ID NO: 1076226 - DNA, 15 bp, Homo sapiens
cttgacctctataaa

SEQ ID NO: 1076227 - DNA, 16 bp, Homo sapiens
cttgacctctgtgacc

SEQ ID NO: 1076228 - DNA, 19 bp, Homo sapiens
cttgacctctgtgaccaac

SEQ ID NO: 1076229 - DNA, 18 bp, Homo sapiens
cttgacctgcattgtaaa

SEQ ID NO: 1076230 - DNA, 20 bp, Homo sapiens
cttgacctgcattgtaaata

SEQ ID NO: 1076231 - DNA, 18 bp, Homo sapiens
cttgacctgtttctctgc

SEQ ID NO: 1076232 - DNA, 15 bp, Homo sapiens
cttgaccttgtagag

SEQ ID NO: 1076233 - DNA, 16 bp, Homo sapiens
cttgactcatggcagc

SEQ ID NO: 1076234 - DNA, 18 bp, Homo sapiens
cttgactcatggcagctg

SEQ ID NO: 1076235 - DNA, 17 bp, Homo sapiens
cttgactcttctaaatg

SEQ ID NO: 1076236 - DNA, 16 bp, Homo sapiens
cttgactgtacagaga

SEQ ID NO: 1076237 - DNA, 18 bp, Homo sapiens
cttgactgtacagagact

SEQ ID NO: 1076238 - DNA, 20 bp, Homo sapiens
cttgactgtctagccactcc

SEQ ID NO: 1076239 - DNA, 13 bp, Homo sapiens
cttgactttgctc

SEQ ID NO: 1076240 - DNA, 11 bp, Homo sapiens
cttgagaactt

SEQ ID NO: 1076241 - DNA, 19 bp, Homo sapiens
cttgagaatcctctccttt

SEQ ID NO: 1076242 - DNA, 12 bp, Homo sapiens
cttgagacaatg

SEQ ID NO: 1076243 - DNA, 21 bp, Homo sapiens
cttgagacaatgttttcttca

SEQ ID NO: 1076244 - DNA, 19 bp, Homo sapiens
cttgagaccaacttttcaa

SEQ ID NO: 1076245 - DNA, 19 bp, Homo sapiens
cttgagacctggaaccaga

SEQ ID NO: 1076246 - DNA, 16 bp, Homo sapiens
cttgagactccccaat

SEQ ID NO: 1076247 - DNA, 18 bp, Homo sapiens
cttgagagacccagctgc

SEQ ID NO: 1076248 - DNA, 15 bp, Homo sapiens
cttgagaggagactt

SEQ ID NO: 1076249 - DNA, 20 bp, Homo sapiens
cttgagagtagatggtttga

SEQ ID NO: 1076250 - DNA, 16 bp, Homo sapiens
cttgagatctgtataa

SEQ ID NO: 1076251 - DNA, 22 bp, Homo sapiens
cttgagatctgtataaataaga

SEQ ID NO: 1076252 - DNA, 16 bp, Homo sapiens
cttgagatgggaaagc

SEQ ID NO: 1076253 - DNA, 20 bp, Homo sapiens
cttgagcaagttccttctgg

SEQ ID NO: 1076254 - DNA, 13 bp, Homo sapiens
cttgagcagaccg

SEQ ID NO: 1076255 - DNA, 13 bp, Homo sapiens
cttgagcagtggc

SEQ ID NO: 1076256 - DNA, 14 bp, Homo sapiens
cttgagcagtggct

SEQ ID NO: 1076257 - DNA, 16 bp, Homo sapiens
cttgagcagtggctgg

SEQ ID NO: 1076258 - DNA, 21 bp, Homo sapiens
cttgagcagtggctggtccag

SEQ ID NO: 1076259 - DNA, 19 bp, Homo sapiens
cttgagcatcaatcttgtt

SEQ ID NO: 1076260 - DNA, 15 bp, Homo sapiens
cttgagccactcctt

SEQ ID NO: 1076261 - DNA, 18 bp, Homo sapiens
cttgagccactccttcct

SEQ ID NO: 1076262 - DNA, 10 bp, Homo sapiens
cttgagccca

SEQ ID NO: 1076263 - DNA, 23 bp, Homo sapiens
cttgagcccaggagttcaagacc

SEQ ID NO: 1076264 - DNA, 17 bp, Homo sapiens
cttgagcctggctgtcc

SEQ ID NO: 1076265 - DNA, 15 bp, Homo sapiens
cttgagccttgaact

SEQ ID NO: 1076266 - DNA, 17 bp, Homo sapiens
cttgagccttgaacttt

SEQ ID NO: 1076267 - DNA, 22 bp, Homo sapiens
cttgagccttgaactttgacct

SEQ ID NO: 1076268 - DNA, 21 bp, Homo sapiens
cttgagcggagcccgatattc

SEQ ID NO: 1076269 - DNA, 10 bp, Homo sapiens
cttgagctga

SEQ ID NO: 1076270 - DNA, 16 bp, Homo sapiens
cttgagctggcctctc

SEQ ID NO: 1076271 - DNA, 20 bp, Homo sapiens
cttgagctgttgtgagcttt

SEQ ID NO: 1076272 - DNA, 14 bp, Homo sapiens
cttgagcttgacct

SEQ ID NO: 1076273 - DNA, 21 bp, Homo sapiens
cttgaggaaacaacagcttta

SEQ ID NO: 1076274 - DNA, 22 bp, Homo sapiens
cttgaggaggggcaggtaaact

SEQ ID NO: 1076275 - DNA, 14 bp, Homo sapiens
cttgaggatgtaat

SEQ ID NO: 1076276 - DNA, 16 bp, Homo sapiens
cttgaggattgtggaa

SEQ ID NO: 1076277 - DNA, 14 bp, Homo sapiens
cttgaggccaggag

SEQ ID NO: 1076278 - DNA, 16 bp, Homo sapiens
cttgagggagcttagc

SEQ ID NO: 1076279 - DNA, 17 bp, Homo sapiens
cttgagggcccagagca

SEQ ID NO: 1076280 - DNA, 23 bp, Homo sapiens
cttgagggctgcagttctactca

SEQ ID NO: 1076281 - DNA, 19 bp, Homo sapiens
cttgaggggaagctagtct

SEQ ID NO: 1076282 - DNA, 21 bp, Homo sapiens
cttgaggggaagctagtcttt

SEQ ID NO: 1076283 - DNA, 15 bp, Homo sapiens
cttgaggggaagctg

SEQ ID NO: 1076284 - DNA, 15 bp, Homo sapiens
cttgaggggccccag

SEQ ID NO: 1076285 - DNA, 16 bp, Homo sapiens
cttgaggggccccagc

SEQ ID NO: 1076286 - DNA, 19 bp, Homo sapiens
cttgaggggccccagcgtc

SEQ ID NO: 1076287 - DNA, 15 bp, Homo sapiens
cttgagggtgggcca

SEQ ID NO: 1076288 - DNA, 23 bp, Homo sapiens
cttgaggtaccagttgtatttaa

SEQ ID NO: 1076289 - DNA, 18 bp, Homo sapiens
cttgaggtcttttgacat

SEQ ID NO: 1076290 - DNA, 19 bp, Homo sapiens
cttgagtcagaaaacagag

SEQ ID NO: 1076291 - DNA, 21 bp, Homo sapiens
cttgagtctcaagggtggcag

SEQ ID NO: 1076292 - DNA, 18 bp, Homo sapiens
cttgagtgacatgcggct

SEQ ID NO: 1076293 - DNA, 17 bp, Homo sapiens
cttgagtgagaagagct

SEQ ID NO: 1076294 - DNA, 23 bp, Homo sapiens
cttgagtgcttgttagagagaaa

SEQ ID NO: 1076295 - DNA, 21 bp, Homo sapiens
cttgagtggggttatctctgt

SEQ ID NO: 1076296 - DNA, 14 bp, Homo sapiens
cttgagtgttcctt

SEQ ID NO: 1076297 - DNA, 19 bp, Homo sapiens
cttgagtgttcctttttaa

SEQ ID NO: 1076298 - DNA, 23 bp, Homo sapiens
cttgagtgttcctttttaaatgt

SEQ ID NO: 1076299 - DNA, 15 bp, Homo sapiens
cttgagttcctctgc

SEQ ID NO: 1076300 - DNA, 18 bp, Homo sapiens
cttgagttgattcagctc

SEQ ID NO: 1076301 - DNA, 12 bp, Homo sapiens
cttgagtttgtc

SEQ ID NO: 1076302 - DNA, 13 bp, Homo sapiens
cttgagtttgtcg

SEQ ID NO: 1076303 - DNA, 16 bp, Homo sapiens
cttgagtttgtcgctc

SEQ ID NO: 1076304 - DNA, 16 bp, Homo sapiens
cttgataaatatatat

SEQ ID NO: 1076305 - DNA, 15 bp, Homo sapiens
cttgataatacttga

SEQ ID NO: 1076306 - DNA, 12 bp, Homo sapiens
cttgataatata

SEQ ID NO: 1076307 - DNA, 18 bp, Homo sapiens
cttgataatatataaaca

SEQ ID NO: 1076308 - DNA, 17 bp, Homo sapiens
cttgataatattagtga

SEQ ID NO: 1076309 - DNA, 17 bp, Homo sapiens
cttgatacccccctctg

SEQ ID NO: 1076310 - DNA, 23 bp, Homo sapiens
cttgatactaaaagttcttctcc

SEQ ID NO: 1076311 - DNA, 13 bp, Homo sapiens
cttgatcacagct

SEQ ID NO: 1076312 - DNA, 19 bp, Homo sapiens
cttgatcctccaatgtcta

SEQ ID NO: 1076313 - DNA, 18 bp, Homo sapiens
cttgatctcaaagcacaa

SEQ ID NO: 1076314 - DNA, 14 bp, Homo sapiens
cttgatctctaatg

SEQ ID NO: 1076315 - DNA, 15 bp, Homo sapiens
cttgatctgtatata

SEQ ID NO: 1076316 - DNA, 18 bp, Homo sapiens
cttgatctgtgatttctt

SEQ ID NO: 1076317 - DNA, 14 bp, Homo sapiens
cttgatctttgagc

SEQ ID NO: 1076318 - DNA, 17 bp, Homo sapiens
cttgatctttgagccca

SEQ ID NO: 1076319 - DNA, 19 bp, Homo sapiens
cttgatgcacagagaagct

SEQ ID NO: 1076320 - DNA, 21 bp, Homo sapiens
cttgatgcatgcactgttccc

SEQ ID NO: 1076321 - DNA, 21 bp, Homo sapiens
cttgatgccaaaatgacttta

SEQ ID NO: 1076322 - DNA, 16 bp, Homo sapiens
cttgatgccagagggc

SEQ ID NO: 1076323 - DNA, 17 bp, Homo sapiens
cttgatgtcatgtactt

SEQ ID NO: 1076324 - DNA, 12 bp, Homo sapiens
cttgatgtgaag

SEQ ID NO: 1076325 - DNA, 15 bp, Homo sapiens
cttgatgtgaagata

SEQ ID NO: 1076326 - DNA, 15 bp, Homo sapiens
cttgatgtgccattt

SEQ ID NO: 1076327 - DNA, 15 bp, Homo sapiens
cttgatgtgttatct

SEQ ID NO: 1076328 - DNA, 19 bp, Homo sapiens
cttgatgttccacctgcca

SEQ ID NO: 1076329 - DNA, 20 bp, Homo sapiens
cttgatgttccacctgccac

SEQ ID NO: 1076330 - DNA, 16 bp, Homo sapiens
cttgatgtttgttaga

SEQ ID NO: 1076331 - DNA, 16 bp, Homo sapiens
cttgattataaatgtt

SEQ ID NO: 1076332 - DNA, 15 bp, Homo sapiens
cttgattcatctctg

SEQ ID NO: 1076333 - DNA, 17 bp, Homo sapiens
cttgattctgcagtaaa

SEQ ID NO: 1076334 - DNA, 14 bp, Homo sapiens
cttgattgagaaag

SEQ ID NO: 1076335 - DNA, 19 bp, Homo sapiens
cttgattgtacttggagta

SEQ ID NO: 1076336 - DNA, 23 bp, Homo sapiens
cttgattgtacttggagtaattg

SEQ ID NO: 1076337 - DNA, 18 bp, Homo sapiens
cttgatttaaacacacag

SEQ ID NO: 1076338 - DNA, 12 bp, Homo sapiens
cttgatttgcat

SEQ ID NO: 1076339 - DNA, 17 bp, Homo sapiens
cttgatttgttcttaca

SEQ ID NO: 1076340 - DNA, 18 bp, Homo sapiens
cttgattttaatacattg

SEQ ID NO: 1076341 - DNA, 12 bp, Homo sapiens
cttgatttttgc

SEQ ID NO: 1076342 - DNA, 19 bp, Homo sapiens
cttgcaacacacagacaca

SEQ ID NO: 1076343 - DNA, 16 bp, Homo sapiens
cttgcaacagtgccat

SEQ ID NO: 1076344 - DNA, 14 bp, Homo sapiens
cttgcaaccaggca

SEQ ID NO: 1076345 - DNA, 16 bp, Homo sapiens
cttgcaaccaggcagc

SEQ ID NO: 1076346 - DNA, 17 bp, Homo sapiens
cttgcaaccaggcagct

SEQ ID NO: 1076347 - DNA, 19 bp, Homo sapiens
cttgcaacctcaccttcct

SEQ ID NO: 1076348 - DNA, 15 bp, Homo sapiens
cttgcaactaaggac

SEQ ID NO: 1076349 - DNA, 11 bp, Homo sapiens
cttgcaagcca

SEQ ID NO: 1076350 - DNA, 22 bp, Homo sapiens
cttgcaatctaatctgaactga

SEQ ID NO: 1076351 - DNA, 13 bp, Homo sapiens
cttgcacacccac

SEQ ID NO: 1076352 - DNA, 14 bp, Homo sapiens
cttgcacacccact

SEQ ID NO: 1076353 - DNA, 19 bp, Homo sapiens
cttgcacacccactgcccc

SEQ ID NO: 1076354 - DNA, 14 bp, Homo sapiens
cttgcacacttccc

SEQ ID NO: 1076355 - DNA, 18 bp, Homo sapiens
cttgcacagccaacgaga

SEQ ID NO: 1076356 - DNA, 22 bp, Homo sapiens
cttgcacagccaacgagacaca

SEQ ID NO: 1076357 - DNA, 23 bp, Homo sapiens
cttgcacagccaacgagacacat

SEQ ID NO: 1076358 - DNA, 14 bp, Homo sapiens
cttgcacagggatt

SEQ ID NO: 1076359 - DNA, 20 bp, Homo sapiens
cttgcacagggattctcaca

SEQ ID NO: 1076360 - DNA, 23 bp, Homo sapiens
cttgcaccccaaagctttcctgc

SEQ ID NO: 1076361 - DNA, 14 bp, Homo sapiens
cttgcacccctcac

SEQ ID NO: 1076362 - DNA, 16 bp, Homo sapiens
cttgcacccgcctctc

SEQ ID NO: 1076363 - DNA, 17 bp, Homo sapiens
cttgcacccgcctctcc

SEQ ID NO: 1076364 - DNA, 19 bp, Homo sapiens
cttgcacctcagcctccca

SEQ ID NO: 1076365 - DNA, 13 bp, Homo sapiens
cttgcacctgcat

SEQ ID NO: 1076366 - DNA, 13 bp, Homo sapiens
cttgcaccttttc

SEQ ID NO: 1076367 - DNA, 20 bp, Homo sapiens
cttgcacgaccgccccagtt

SEQ ID NO: 1076368 - DNA, 19 bp, Homo sapiens
cttgcacgcccatgtgtga

SEQ ID NO: 1076369 - DNA, 20 bp, Homo sapiens
cttgcacggctgctcggctt

SEQ ID NO: 1076370 - DNA, 12 bp, Homo sapiens
cttgcactgaat

SEQ ID NO: 1076371 - DNA, 16 bp, Homo sapiens
cttgcagaggagccca

SEQ ID NO: 1076372 - DNA, 18 bp, Homo sapiens
cttgcagaggagcccagt

SEQ ID NO: 1076373 - DNA, 23 bp, Homo sapiens
cttgcagaggagcccagtgggct

SEQ ID NO: 1076374 - DNA, 17 bp, Homo sapiens
cttgcagatcatctggg

SEQ ID NO: 1076375 - DNA, 16 bp, Homo sapiens
cttgcagattctattt

SEQ ID NO: 1076376 - DNA, 21 bp, Homo sapiens
cttgcagattttcttaaggaa

SEQ ID NO: 1076377 - DNA, 12 bp, Homo sapiens
cttgcagcaggg

SEQ ID NO: 1076378 - DNA, 22 bp, Homo sapiens
cttgcagcagggctgggcctgc

SEQ ID NO: 1076379 - DNA, 15 bp, Homo sapiens
cttgcagccaggaga

SEQ ID NO: 1076380 - DNA, 20 bp, Homo sapiens
cttgcagcgccaagtggcca

SEQ ID NO: 1076381 - DNA, 18 bp, Homo sapiens
cttgcagctaaggagggg

SEQ ID NO: 1076382 - DNA, 19 bp, Homo sapiens
cttgcaggggtcccccctc

SEQ ID NO: 1076383 - DNA, 16 bp, Homo sapiens
cttgcaggggtccctg

SEQ ID NO: 1076384 - DNA, 18 bp, Homo sapiens
cttgcaggggtccctgct

SEQ ID NO: 1076385 - DNA, 19 bp, Homo sapiens
cttgcaggggtccctgcta

SEQ ID NO: 1076386 - DNA, 22 bp, Homo sapiens
cttgcagtatgatggcaggaga

SEQ ID NO: 1076387 - DNA, 20 bp, Homo sapiens
cttgcagtcttgtagctaga

SEQ ID NO: 1076388 - DNA, 22 bp, Homo sapiens
cttgcagttcagcaccacccta

SEQ ID NO: 1076389 - DNA, 21 bp, Homo sapiens
cttgcagttttgtaagccctc

SEQ ID NO: 1076390 - DNA, 20 bp, Homo sapiens
cttgcataataagctaaaga

SEQ ID NO: 1076391 - DNA, 21 bp, Homo sapiens
cttgcataataagctaaagag

SEQ ID NO: 1076392 - DNA, 14 bp, Homo sapiens
cttgcatcctattt

SEQ ID NO: 1076393 - DNA, 23 bp, Homo sapiens
cttgcatctaatgaaaaacaaaa

SEQ ID NO: 1076394 - DNA, 14 bp, Homo sapiens
cttgcatgaagaga

SEQ ID NO: 1076395 - DNA, 13 bp, Homo sapiens
cttgcatgcttgc

SEQ ID NO: 1076396 - DNA, 18 bp, Homo sapiens
cttgcattgaatatatta

SEQ ID NO: 1076397 - DNA, 10 bp, Homo sapiens
cttgggaatg

SEQ ID NO: 1076398 - DNA, 19 bp, Homo sapiens
cttgggacccccactaaga

SEQ ID NO: 1076399 - DNA, 20 bp, Homo sapiens
cttgggacgtgtacagcaca

SEQ ID NO: 1076400 - DNA, 21 bp, Homo sapiens
cttgggacgtgtacagcacag

SEQ ID NO: 1076401 - DNA, 23 bp, Homo sapiens
cttgggacgtgtacagcacagaa

SEQ ID NO: 1076402 - DNA, 10 bp, Homo sapiens
cttgggactc

SEQ ID NO: 1076403 - DNA, 16 bp, Homo sapiens
cttgggactcaggtct

SEQ ID NO: 1076404 - DNA, 23 bp, Homo sapiens
cttgggactcaggtctgtaactg

SEQ ID NO: 1076405 - DNA, 17 bp, Homo sapiens
cttgggagcctgaggca

SEQ ID NO: 1076406 - DNA, 18 bp, Homo sapiens
cttgggagctgctgggct

SEQ ID NO: 1076407 - DNA, 16 bp, Homo sapiens
cttgggaggctgaggc

SEQ ID NO: 1076408 - DNA, 16 bp, Homo sapiens
cttgggaggcttcccc

SEQ ID NO: 1076409 - DNA, 21 bp, Homo sapiens
cttgggagtatgttgtcataa

SEQ ID NO: 1076410 - DNA, 19 bp, Homo sapiens
cttgggataattccttggt

SEQ ID NO: 1076411 - DNA, 22 bp, Homo sapiens
cttgggcactttttaattcacc

SEQ ID NO: 1076412 - DNA, 14 bp, Homo sapiens
cttgggcagagctg

SEQ ID NO: 1076413 - DNA, 13 bp, Homo sapiens
cttgggcaggcag

SEQ ID NO: 1076414 - DNA, 20 bp, Homo sapiens
cttgggcagtgccccaggga

SEQ ID NO: 1076415 - DNA, 21 bp, Homo sapiens
cttgggcagtgccccagggag

SEQ ID NO: 1076416 - DNA, 23 bp, Homo sapiens
cttgggcagttctcactcctagg

SEQ ID NO: 1076417 - DNA, 20 bp, Homo sapiens
cttgggccactgtgaagaga

SEQ ID NO: 1076418 - DNA, 15 bp, Homo sapiens
cttgggccagaagta

SEQ ID NO: 1076419 - DNA, 12 bp, Homo sapiens
cttgggccctcc

SEQ ID NO: 1076420 - DNA, 14 bp, Homo sapiens
cttgggccctcctg

SEQ ID NO: 1076421 - DNA, 17 bp, Homo sapiens
cttgggccctggaagag

SEQ ID NO: 1076422 - DNA, 14 bp, Homo sapiens
cttgggccctttga

SEQ ID NO: 1076423 - DNA, 17 bp, Homo sapiens
cttgggccctttgagtg

SEQ ID NO: 1076424 - DNA, 15 bp, Homo sapiens
cttgggccggtgctg

SEQ ID NO: 1076425 - DNA, 20 bp, Homo sapiens
cttgggcgccgtgctgggca

SEQ ID NO: 1076426 - DNA, 14 bp, Homo sapiens
cttgggcggctgag

SEQ ID NO: 1076427 - DNA, 18 bp, Homo sapiens
cttgggcggctgagagcc

SEQ ID NO: 1076428 - DNA, 17 bp, Homo sapiens
cttgggcgtctccccca

SEQ ID NO: 1076429 - DNA, 21 bp, Homo sapiens
cttgggctactggcagctcct

SEQ ID NO: 1076430 - DNA, 21 bp, Homo sapiens
cttgggctccctgtaacctct

SEQ ID NO: 1076431 - DNA, 13 bp, Homo sapiens
cttgggctcctgg

SEQ ID NO: 1076432 - DNA, 17 bp, Homo sapiens
cttgggctcctggctgc

SEQ ID NO: 1076433 - DNA, 23 bp, Homo sapiens
cttgggctctctctagctcccca

SEQ ID NO: 1076434 - DNA, 16 bp, Homo sapiens
cttgggctgacccagc

SEQ ID NO: 1076435 - DNA, 17 bp, Homo sapiens
cttgggctgacccagca

SEQ ID NO: 1076436 - DNA, 14 bp, Homo sapiens
cttgggctgagact

SEQ ID NO: 1076437 - DNA, 14 bp, Homo sapiens
cttgggctgctcct

SEQ ID NO: 1076438 - DNA, 15 bp, Homo sapiens
cttgggctggtcaga

SEQ ID NO: 1076439 - DNA, 23 bp, Homo sapiens
cttgggcttccatttgtgtgtgt

SEQ ID NO: 1076440 - DNA, 14 bp, Homo sapiens
cttgggcttcttcc

SEQ ID NO: 1076441 - DNA, 20 bp, Homo sapiens
cttggggaaaatggccatgc

SEQ ID NO: 1076442 - DNA, 23 bp, Homo sapiens
cttggggaaaatggccatgcagg

SEQ ID NO: 1076443 - DNA, 17 bp, Homo sapiens
cttggggaacccatgag

SEQ ID NO: 1076444 - DNA, 16 bp, Homo sapiens
cttggggaagggtggg

SEQ ID NO: 1076445 - DNA, 23 bp, Homo sapiens
cttggggaagggtggggagaaat

SEQ ID NO: 1076446 - DNA, 16 bp, Homo sapiens
cttggggaatttcctc

SEQ ID NO: 1076447 - DNA, 14 bp, Homo sapiens
cttggggagaaggc

SEQ ID NO: 1076448 - DNA, 13 bp, Homo sapiens
cttggggaggcaa

SEQ ID NO: 1076449 - DNA, 14 bp, Homo sapiens
cttggggcaagact

SEQ ID NO: 1076450 - DNA, 14 bp, Homo sapiens
cttggggccagcgc

SEQ ID NO: 1076451 - DNA, 15 bp, Homo sapiens
cttggggcctatgca

SEQ ID NO: 1076452 - DNA, 19 bp, Homo sapiens
cttggggcctggcttgctc

SEQ ID NO: 1076453 - DNA, 18 bp, Homo sapiens
cttggggctcacacacct

SEQ ID NO: 1076454 - DNA, 23 bp, Homo sapiens
cttggggctcagccacagcctga

SEQ ID NO: 1076455 - DNA, 15 bp, Homo sapiens
cttggggctcgcccc

SEQ ID NO: 1076456 - DNA, 16 bp, Homo sapiens
cttggggctggggaag

SEQ ID NO: 1076457 - DNA, 23 bp, Homo sapiens
cttggggggctgaggtgggagga

SEQ ID NO: 1076458 - DNA, 18 bp, Homo sapiens
cttgggggggctgccttt

SEQ ID NO: 1076459 - DNA, 23 bp, Homo sapiens
cttggggggtttttactccagtg

SEQ ID NO: 1076460 - DNA, 23 bp, Homo sapiens
cttgggggttcaggcccggcagg

SEQ ID NO: 1076461 - DNA, 20 bp, Homo sapiens
cttgggggttttcaatgtga

SEQ ID NO: 1076462 - DNA, 18 bp, Homo sapiens
cttggggtccctccaccc

SEQ ID NO: 1076463 - DNA, 14 bp, Homo sapiens
cttggggtgggggc

SEQ ID NO: 1076464 - DNA, 18 bp, Homo sapiens
cttggggtgggggccagg

SEQ ID NO: 1076465 - DNA, 21 bp, Homo sapiens
cttggggtgggggccaggcct

SEQ ID NO: 1076466 - DNA, 19 bp, Homo sapiens
cttggggtgtggggtgggg

SEQ ID NO: 1076467 - DNA, 19 bp, Homo sapiens
cttggggttcataggggca

SEQ ID NO: 1076468 - DNA, 20 bp, Homo sapiens
cttggggttcataggggcag

SEQ ID NO: 1076469 - DNA, 15 bp, Homo sapiens
cttgggtaggcggga

SEQ ID NO: 1076470 - DNA, 14 bp, Homo sapiens
cttgggtagggcag

SEQ ID NO: 1076471 - DNA, 20 bp, Homo sapiens
cttgggtcaggttcttgcct

SEQ ID NO: 1076472 - DNA, 14 bp, Homo sapiens
cttgggtccaccat

SEQ ID NO: 1076473 - DNA, 18 bp, Homo sapiens
cttgggtctgaatttatt

SEQ ID NO: 1076474 - DNA, 15 bp, Homo sapiens
cttgggtgaaggtgc

SEQ ID NO: 1076475 - DNA, 13 bp, Homo sapiens
cttgggtggttcc

SEQ ID NO: 1076476 - DNA, 14 bp, Homo sapiens
cttgggtggttttg

SEQ ID NO: 1076477 - DNA, 22 bp, Homo sapiens
cttgggtgtaacaggtctcctc

SEQ ID NO: 1076478 - DNA, 19 bp, Homo sapiens
cttgggtgtattctctgta

SEQ ID NO: 1076479 - DNA, 17 bp, Homo sapiens
cttgggttccaaccagg

SEQ ID NO: 1076480 - DNA, 16 bp, Homo sapiens
cttgggtttaacaagc

SEQ ID NO: 1076481 - DNA, 17 bp, Homo sapiens
cttgggtttttgttacc

SEQ ID NO: 1076482 - DNA, 15 bp, Homo sapiens
cttggtaagaagccg

SEQ ID NO: 1076483 - DNA, 20 bp, Homo sapiens
cttggtaagatgactctgag

SEQ ID NO: 1076484 - DNA, 21 bp, Homo sapiens
cttggtaagatgactctgaga

SEQ ID NO: 1076485 - DNA, 21 bp, Homo sapiens
cttggtaggtgtggtggcgtt

SEQ ID NO: 1076486 - DNA, 16 bp, Homo sapiens
cttggtagttctgtgc

SEQ ID NO: 1076487 - DNA, 21 bp, Homo sapiens
cttggtagttctgtgcctccc

SEQ ID NO: 1076488 - DNA, 15 bp, Homo sapiens
cttggtatgtgccag

SEQ ID NO: 1076489 - DNA, 16 bp, Homo sapiens
cttggtatgtgccagg

SEQ ID NO: 1076490 - DNA, 13 bp, Homo sapiens
cttggtcaaactt

SEQ ID NO: 1076491 - DNA, 14 bp, Homo sapiens
cttggtcaagaaag

SEQ ID NO: 1076492 - DNA, 19 bp, Homo sapiens
cttggtcccatggctgaag

SEQ ID NO: 1076493 - DNA, 13 bp, Homo sapiens
cttggtccctctc

SEQ ID NO: 1076494 - DNA, 16 bp, Homo sapiens
cttggtccctctcaga

SEQ ID NO: 1076495 - DNA, 17 bp, Homo sapiens
cttggtccctctcagat

SEQ ID NO: 1076496 - DNA, 16 bp, Homo sapiens
cttggtccctggtccc

SEQ ID NO: 1076497 - DNA, 20 bp, Homo sapiens
cttggtctatgtgctctgta

SEQ ID NO: 1076498 - DNA, 19 bp, Homo sapiens
cttggtctggctttaagaa

SEQ ID NO: 1076499 - DNA, 20 bp, Homo sapiens
cttggtgaatttttttttcc

SEQ ID NO: 1076500 - DNA, 15 bp, Homo sapiens
cttggtgactgtccc

SEQ ID NO: 1076501 - DNA, 22 bp, Homo sapiens
cttggtgcacagattgctgaaa

SEQ ID NO: 1076502 - DNA, 15 bp, Homo sapiens
cttggtgctcttgct

SEQ ID NO: 1076503 - DNA, 15 bp, Homo sapiens
cttggtggagcagcc

SEQ ID NO: 1076504 - DNA, 17 bp, Homo sapiens
cttggtggagcagccag

SEQ ID NO: 1076505 - DNA, 18 bp, Homo sapiens
cttggtggagcagccaga

SEQ ID NO: 1076506 - DNA, 19 bp, Homo sapiens
cttggtggagcagccagag

SEQ ID NO: 1076507 - DNA, 23 bp, Homo sapiens
cttggtgggtgtggccagcacac

SEQ ID NO: 1076508 - DNA, 22 bp, Homo sapiens
cttggtggttctatcaggggtg

SEQ ID NO: 1076509 - DNA, 22 bp, Homo sapiens
cttggtgtttcccttcctcggt

SEQ ID NO: 1076510 - DNA, 14 bp, Homo sapiens
cttggttcataaat

SEQ ID NO: 1076511 - DNA, 17 bp, Homo sapiens
cttggttcataaatgaa

SEQ ID NO: 1076512 - DNA, 22 bp, Homo sapiens
cttggttcataaatgaatttta

SEQ ID NO: 1076513 - DNA, 13 bp, Homo sapiens
cttggttccccca

SEQ ID NO: 1076514 - DNA, 19 bp, Homo sapiens
cttggttcccccactgatc

SEQ ID NO: 1076515 - DNA, 13 bp, Homo sapiens
cttggttcctgtt

SEQ ID NO: 1076516 - DNA, 15 bp, Homo sapiens
cttggttcctgtttg

SEQ ID NO: 1076517 - DNA, 13 bp, Homo sapiens
cttggttctaaag

SEQ ID NO: 1076518 - DNA, 14 bp, Homo sapiens
cttggttctgaagc

SEQ ID NO: 1076519 - DNA, 15 bp, Homo sapiens
cttggttctgaagcc

SEQ ID NO: 1076520 - DNA, 17 bp, Homo sapiens
cttggttctggccaccc

SEQ ID NO: 1076521 - DNA, 21 bp, Homo sapiens
cttggttggctggcagctgag

SEQ ID NO: 1076522 - DNA, 17 bp, Homo sapiens
cttgtattgtaaatgtg

SEQ ID NO: 1076523 - DNA, 18 bp, Homo sapiens
cttgtatttaaatattaa

SEQ ID NO: 1076524 - DNA, 15 bp, Homo sapiens
cttgtcaaagaaggt

SEQ ID NO: 1076525 - DNA, 18 bp, Homo sapiens
cttgtcaagcctgtgcaa

SEQ ID NO: 1076526 - DNA, 17 bp, Homo sapiens
cttgtcaatactgagcc

SEQ ID NO: 1076527 - DNA, 19 bp, Homo sapiens
cttgtcaatactgagccat

SEQ ID NO: 1076528 - DNA, 15 bp, Homo sapiens
cttgtcacaataaat

SEQ ID NO: 1076529 - DNA, 15 bp, Homo sapiens
cttgtcattccagag

SEQ ID NO: 1076530 - DNA, 15 bp, Homo sapiens
cttgtcattgccttc

SEQ ID NO: 1076531 - DNA, 13 bp, Homo sapiens
cttgtccaggaac

SEQ ID NO: 1076532 - DNA, 14 bp, Homo sapiens
cttgtccaggaact

SEQ ID NO: 1076533 - DNA, 22 bp, Homo sapiens
cttgtccagttcaaataagaaa

SEQ ID NO: 1076534 - DNA, 18 bp, Homo sapiens
cttgtcccaattaaaata

SEQ ID NO: 1076535 - DNA, 20 bp, Homo sapiens
cttgtcccaattaaaatact

SEQ ID NO: 1076536 - DNA, 14 bp, Homo sapiens
cttgtcccagccag

SEQ ID NO: 1076537 - DNA, 16 bp, Homo sapiens
cttgtcctatgtcaat

SEQ ID NO: 1076538 - DNA, 18 bp, Homo sapiens
cttgtcctgctctcttca

SEQ ID NO: 1076539 - DNA, 19 bp, Homo sapiens
cttgtcctgctctcttcag

SEQ ID NO: 1076540 - DNA, 22 bp, Homo sapiens
cttgtcctgctctcttcaggag

SEQ ID NO: 1076541 - DNA, 17 bp, Homo sapiens
cttgtcctgggcctgcc

SEQ ID NO: 1076542 - DNA, 12 bp, Homo sapiens
cttgtcctgtgc

SEQ ID NO: 1076543 - DNA, 14 bp, Homo sapiens
cttgtcctgtgctt

SEQ ID NO: 1076544 - DNA, 17 bp, Homo sapiens
cttgtcctgtgcttgct

SEQ ID NO: 1076545 - DNA, 23 bp, Homo sapiens
cttgtcctttatattttttgtct

SEQ ID NO: 1076546 - DNA, 14 bp, Homo sapiens
cttgtcctttccct

SEQ ID NO: 1076547 - DNA, 15 bp, Homo sapiens
cttgtcctttccctt

SEQ ID NO: 1076548 - DNA, 23 bp, Homo sapiens
cttgtccttttgtaccatggtgt

SEQ ID NO: 1076549 - DNA, 18 bp, Homo sapiens
cttgtcgcgcgtctccca

SEQ ID NO: 1076550 - DNA, 23 bp, Homo sapiens
cttgtcgtttgtgaacgctgtga

SEQ ID NO: 1076551 - DNA, 16 bp, Homo sapiens
cttgtctccctggttg

SEQ ID NO: 1076552 - DNA, 22 bp, Homo sapiens
cttgtctccctggttgcctctc

SEQ ID NO: 1076553 - DNA, 14 bp, Homo sapiens
cttgtctcctttct

SEQ ID NO: 1076554 - DNA, 15 bp, Homo sapiens
cttgtctcctttctg

SEQ ID NO: 1076555 - DNA, 19 bp, Homo sapiens
cttgtctcctttctgactg

SEQ ID NO: 1076556 - DNA, 15 bp, Homo sapiens
cttgtctctcactgc

SEQ ID NO: 1076557 - DNA, 13 bp, Homo sapiens
cttgtctctgggc

SEQ ID NO: 1076558 - DNA, 19 bp, Homo sapiens
cttgtctcttcatctaata

SEQ ID NO: 1076559 - DNA, 13 bp, Homo sapiens
cttgtctgaggcc

SEQ ID NO: 1076560 - DNA, 19 bp, Homo sapiens
cttgtctgaggcctcatcc

SEQ ID NO: 1076561 - DNA, 23 bp, Homo sapiens
cttgtctgggtgcagctgggctt

SEQ ID NO: 1076562 - DNA, 13 bp, Homo sapiens
cttgtcttccccc

SEQ ID NO: 1076563 - DNA, 19 bp, Homo sapiens
cttgtcttcccccctctcc

SEQ ID NO: 1076564 - DNA, 20 bp, Homo sapiens
cttgtcttcccccctctcct

SEQ ID NO: 1076565 - DNA, 13 bp, Homo sapiens
cttgtcttgaaaa

SEQ ID NO: 1076566 - DNA, 16 bp, Homo sapiens
cttgtcttttgagcta

SEQ ID NO: 1076567 - DNA, 14 bp, Homo sapiens
cttgtgacagtgcc

SEQ ID NO: 1076568 - DNA, 17 bp, Homo sapiens
cttgtgacagtgcctct

SEQ ID NO: 1076569 - DNA, 18 bp, Homo sapiens
cttgtgacagtgcctctt

SEQ ID NO: 1076570 - DNA, 22 bp, Homo sapiens
cttgtgacagtgcctcttccag

SEQ ID NO: 1076571 - DNA, 19 bp, Homo sapiens
cttgtgactcagcagaggc

SEQ ID NO: 1076572 - DNA, 19 bp, Homo sapiens
cttgtgagagcccattccc

SEQ ID NO: 1076573 - DNA, 19 bp, Homo sapiens
cttgtgagtggataatcag

SEQ ID NO: 1076574 - DNA, 21 bp, Homo sapiens
cttgtgagtggataatcagga

SEQ ID NO: 1076575 - DNA, 23 bp, Homo sapiens
cttgtgatccactcgcctcagcc

SEQ ID NO: 1076576 - DNA, 17 bp, Homo sapiens
cttgtgattatttatta

SEQ ID NO: 1076577 - DNA, 17 bp, Homo sapiens
cttgtgattcctacccc

SEQ ID NO: 1076578 - DNA, 21 bp, Homo sapiens
cttgtgattcctacccctctt

SEQ ID NO: 1076579 - DNA, 18 bp, Homo sapiens
cttgtgattgctgccata

SEQ ID NO: 1076580 - DNA, 19 bp, Homo sapiens
cttgtgcaaggtggccttt

SEQ ID NO: 1076581 - DNA, 20 bp, Homo sapiens
cttgtgcaccctctatccca

SEQ ID NO: 1076582 - DNA, 20 bp, Homo sapiens
cttgtgcataattcttccaa

SEQ ID NO: 1076583 - DNA, 19 bp, Homo sapiens
cttgtgcatgtttacttta

SEQ ID NO: 1076584 - DNA, 23 bp, Homo sapiens
cttgtgccaaacctactaggcca

SEQ ID NO: 1076585 - DNA, 15 bp, Homo sapiens
cttgtgccagcccgg

SEQ ID NO: 1076586 - DNA, 13 bp, Homo sapiens
cttgtgccctgcc

SEQ ID NO: 1076587 - DNA, 23 bp, Homo sapiens
cttgtgccctgcccccatctccc

SEQ ID NO: 1076588 - DNA, 17 bp, Homo sapiens
cttgtgccctgggccaa

SEQ ID NO: 1076589 - DNA, 16 bp, Homo sapiens
cttgtgcctgctcctg

SEQ ID NO: 1076590 - DNA, 17 bp, Homo sapiens
cttgtgcctgctcctgt

SEQ ID NO: 1076591 - DNA, 16 bp, Homo sapiens
cttgtgctcacgctcc

SEQ ID NO: 1076592 - DNA, 18 bp, Homo sapiens
cttgtgcttggtggggct

SEQ ID NO: 1076593 - DNA, 15 bp, Homo sapiens
ctttaagtaaaaatc

SEQ ID NO: 1076594 - DNA, 21 bp, Homo sapiens
ctttaagttcttctatttcaa

SEQ ID NO: 1076595 - DNA, 17 bp, Homo sapiens
ctttaagtttcaggata

SEQ ID NO: 1076596 - DNA, 22 bp, Homo sapiens
ctttaataaaggccacaggaga

SEQ ID NO: 1076597 - DNA, 17 bp, Homo sapiens
ctttaataaattgctta

SEQ ID NO: 1076598 - DNA, 20 bp, Homo sapiens
ctttaataacaaggagattt

SEQ ID NO: 1076599 - DNA, 23 bp, Homo sapiens
ctttaatagtcaccttcatgatt

SEQ ID NO: 1076600 - DNA, 13 bp, Homo sapiens
ctttaatatgagc

SEQ ID NO: 1076601 - DNA, 14 bp, Homo sapiens
ctttaatattttgt

SEQ ID NO: 1076602 - DNA, 17 bp, Homo sapiens
ctttaatcttcagtttt

SEQ ID NO: 1076603 - DNA, 22 bp, Homo sapiens
ctttaatcttcagttttatctt

SEQ ID NO: 1076604 - DNA, 14 bp, Homo sapiens
ctttaatgagaaaa

SEQ ID NO: 1076605 - DNA, 12 bp, Homo sapiens
ctttaatgcatc

SEQ ID NO: 1076606 - DNA, 20 bp, Homo sapiens
ctttaatgctgtctttgtgg

SEQ ID NO: 1076607 - DNA, 12 bp, Homo sapiens
ctttaatgcttt

SEQ ID NO: 1076608 - DNA, 18 bp, Homo sapiens
ctttaattaccaacctgt

SEQ ID NO: 1076609 - DNA, 22 bp, Homo sapiens
ctttaattatatattttcatcc

SEQ ID NO: 1076610 - DNA, 16 bp, Homo sapiens
ctttaattgaagaact

SEQ ID NO: 1076611 - DNA, 16 bp, Homo sapiens
ctttaattttcttgtt

SEQ ID NO: 1076612 - DNA, 20 bp, Homo sapiens
ctttaatttttttaaccaaa

SEQ ID NO: 1076613 - DNA, 23 bp, Homo sapiens
ctttacaaaacaaactcattcat

SEQ ID NO: 1076614 - DNA, 17 bp, Homo sapiens
ctttacaactaaataac

SEQ ID NO: 1076615 - DNA, 23 bp, Homo sapiens
ctttacaggaaaaaaaattctgt

SEQ ID NO: 1076616 - DNA, 21 bp, Homo sapiens
ctttacaggtatttataatat

SEQ ID NO: 1076617 - DNA, 18 bp, Homo sapiens
ctttacatactttatcaa

SEQ ID NO: 1076618 - DNA, 16 bp, Homo sapiens
ctttacatgctgtgct

SEQ ID NO: 1076619 - DNA, 21 bp, Homo sapiens
ctttacatggtggtgatgtcc

SEQ ID NO: 1076620 - DNA, 17 bp, Homo sapiens
ctttacattcaactttt

SEQ ID NO: 1076621 - DNA, 19 bp, Homo sapiens
ctttaccaaaaaccatgtt

SEQ ID NO: 1076622 - DNA, 20 bp, Homo sapiens
ctttaccaaaaaccatgttg

SEQ ID NO: 1076623 - DNA, 14 bp, Homo sapiens
ctttaccataaagc

SEQ ID NO: 1076624 - DNA, 17 bp, Homo sapiens
ctttaccataaagcctt

SEQ ID NO: 1076625 - DNA, 18 bp, Homo sapiens
ctttaccataaagccttt

SEQ ID NO: 1076626 - DNA, 21 bp, Homo sapiens
ctttaccataaagcctttaaa

SEQ ID NO: 1076627 - DNA, 18 bp, Homo sapiens
ctttacccacctagaaca

SEQ ID NO: 1076628 - DNA, 14 bp, Homo sapiens
ctttaccctctttg

SEQ ID NO: 1076629 - DNA, 19 bp, Homo sapiens
ctttaccctctttgctgca

SEQ ID NO: 1076630 - DNA, 16 bp, Homo sapiens
ctttacctctctgtca

SEQ ID NO: 1076631 - DNA, 14 bp, Homo sapiens
ctttacctgtatac

SEQ ID NO: 1076632 - DNA, 17 bp, Homo sapiens
ctttacctgtgaagtgt

SEQ ID NO: 1076633 - DNA, 17 bp, Homo sapiens
ctttaccttttcagggc

SEQ ID NO: 1076634 - DNA, 19 bp, Homo sapiens
ctttccctcaccccctccc

SEQ ID NO: 1076635 - DNA, 13 bp, Homo sapiens
ctttccctctccc

SEQ ID NO: 1076636 - DNA, 17 bp, Homo sapiens
ctttcccttccagttcc

SEQ ID NO: 1076637 - DNA, 16 bp, Homo sapiens
ctttcccttcctcttc

SEQ ID NO: 1076638 - DNA, 13 bp, Homo sapiens
ctttcccttgctt

SEQ ID NO: 1076639 - DNA, 21 bp, Homo sapiens
ctttcccttgcttttccctct

SEQ ID NO: 1076640 - DNA, 22 bp, Homo sapiens
ctttcccttgcttttccctctt

SEQ ID NO: 1076641 - DNA, 20 bp, Homo sapiens
ctttccgacacatttaccaa

SEQ ID NO: 1076642 - DNA, 15 bp, Homo sapiens
ctttccgctgtcgcc

SEQ ID NO: 1076643 - DNA, 18 bp, Homo sapiens
ctttcctaacttccttta

SEQ ID NO: 1076644 - DNA, 18 bp, Homo sapiens
ctttcctacatgccccct

SEQ ID NO: 1076645 - DNA, 20 bp, Homo sapiens
ctttcctactgtcctggaac

SEQ ID NO: 1076646 - DNA, 18 bp, Homo sapiens
ctttcctatcatggagtg

SEQ ID NO: 1076647 - DNA, 11 bp, Homo sapiens
ctttcctcccc

SEQ ID NO: 1076648 - DNA, 13 bp, Homo sapiens
ctttcctccccac

SEQ ID NO: 1076649 - DNA, 15 bp, Homo sapiens
ctttcctccccacct

SEQ ID NO: 1076650 - DNA, 20 bp, Homo sapiens
ctttcctccccatacacaca

SEQ ID NO: 1076651 - DNA, 21 bp, Homo sapiens
ctttcctccccatacacacac

SEQ ID NO: 1076652 - DNA, 16 bp, Homo sapiens
ctttcctccccctgca

SEQ ID NO: 1076653 - DNA, 12 bp, Homo sapiens
ctttcctccgga

SEQ ID NO: 1076654 - DNA, 14 bp, Homo sapiens
ctttcctcctacct

SEQ ID NO: 1076655 - DNA, 23 bp, Homo sapiens
ctttcctcctaccttttgtctct

SEQ ID NO: 1076656 - DNA, 22 bp, Homo sapiens
ctttcctcctcaggcacacagc

SEQ ID NO: 1076657 - DNA, 18 bp, Homo sapiens
ctttcctcggtctccctt

SEQ ID NO: 1076658 - DNA, 20 bp, Homo sapiens
ctttcctctaactcactgcc

SEQ ID NO: 1076659 - DNA, 15 bp, Homo sapiens
ctttctgcagaaaca

SEQ ID NO: 1076660 - DNA, 20 bp, Homo sapiens
ctttctgcagtttttcagga

SEQ ID NO: 1076661 - DNA, 21 bp, Homo sapiens
ctttctgcagtttttcaggag

SEQ ID NO: 1076662 - DNA, 15 bp, Homo sapiens
ctttctgccccccag

SEQ ID NO: 1076663 - DNA, 19 bp, Homo sapiens
ctttctgccccccagggct

SEQ ID NO: 1076664 - DNA, 21 bp, Homo sapiens
ctttctgccccccagggctag

SEQ ID NO: 1076665 - DNA, 14 bp, Homo sapiens
ctttctgcctggag

SEQ ID NO: 1076666 - DNA, 13 bp, Homo sapiens
ctttctgctcagc

SEQ ID NO: 1076667 - DNA, 16 bp, Homo sapiens
ctttctgctcagcttc

SEQ ID NO: 1076668 - DNA, 13 bp, Homo sapiens
ctttctgctctgc

SEQ ID NO: 1076669 - DNA, 22 bp, Homo sapiens
ctttctgctctgccatcttcag

SEQ ID NO: 1076670 - DNA, 19 bp, Homo sapiens
ctttctgctgggatccttg

SEQ ID NO: 1076671 - DNA, 12 bp, Homo sapiens
ctttctggactg

SEQ ID NO: 1076672 - DNA, 23 bp, Homo sapiens
ctttctggactggcgttcacctc

SEQ ID NO: 1076673 - DNA, 18 bp, Homo sapiens
ctttctggccccagccta

SEQ ID NO: 1076674 - DNA, 20 bp, Homo sapiens
ctttctggccccagcctagg

SEQ ID NO: 1076675 - DNA, 17 bp, Homo sapiens
ctttctggcctgccttc

SEQ ID NO: 1076676 - DNA, 12 bp, Homo sapiens
ctttctgggagg

SEQ ID NO: 1076677 - DNA, 12 bp, Homo sapiens
ctttctgggatg

SEQ ID NO: 1076678 - DNA, 18 bp, Homo sapiens
ctttctgggatgtcacag

SEQ ID NO: 1076679 - DNA, 21 bp, Homo sapiens
ctttctgggatgtcacagtcc

SEQ ID NO: 1076680 - DNA, 22 bp, Homo sapiens
ctttctgggatgtcacagtcca

SEQ ID NO: 1076681 - DNA, 14 bp, Homo sapiens
ctttctgggccaag

SEQ ID NO: 1076682 - DNA, 17 bp, Homo sapiens
ctttctgggctttctcc

SEQ ID NO: 1076683 - DNA, 20 bp, Homo sapiens
ctttctgggctttctcctgg

SEQ ID NO: 1076684 - DNA, 23 bp, Homo sapiens
ctttctggggggatatttcctaa

SEQ ID NO: 1076685 - DNA, 14 bp, Homo sapiens
ctttctgtaaacag

SEQ ID NO: 1076686 - DNA, 13 bp, Homo sapiens
ctttctgtatata

SEQ ID NO: 1076687 - DNA, 19 bp, Homo sapiens
ctttctgtccttttggcac

SEQ ID NO: 1076688 - DNA, 22 bp, Homo sapiens
ctttctgtctaggttaaagcta

SEQ ID NO: 1076689 - DNA, 18 bp, Homo sapiens
ctttctgtcttctacaga

SEQ ID NO: 1076690 - DNA, 13 bp, Homo sapiens
ctttctgtgccct

SEQ ID NO: 1076691 - DNA, 14 bp, Homo sapiens
ctttctgtgcccta

SEQ ID NO: 1076692 - DNA, 15 bp, Homo sapiens
ctttctgtgtgcacc

SEQ ID NO: 1076693 - DNA, 21 bp, Homo sapiens
ctttctgtgtgcaccttacca

SEQ ID NO: 1076694 - DNA, 15 bp, Homo sapiens
ctttctgttccaaat

SEQ ID NO: 1076695 - DNA, 22 bp, Homo sapiens
ctttctgttccaaattcagttt

SEQ ID NO: 1076696 - DNA, 23 bp, Homo sapiens
ctttctgttccaaattcagtttc

SEQ ID NO: 1076697 - DNA, 21 bp, Homo sapiens
ctttctgttgaaaagcacaca

SEQ ID NO: 1076698 - DNA, 15 bp, Homo sapiens
ctttcttaattttgt

SEQ ID NO: 1076699 - DNA, 14 bp, Homo sapiens
ctttcttcaccaag

SEQ ID NO: 1076700 - DNA, 11 bp, Homo sapiens
ctttcttcctc

SEQ ID NO: 1076701 - DNA, 13 bp, Homo sapiens
ctttcttcctctg

SEQ ID NO: 1076702 - DNA, 15 bp, Homo sapiens
ctttcttcctctgct

SEQ ID NO: 1076703 - DNA, 11 bp, Homo sapiens
ctttcttcctt

SEQ ID NO: 1076704 - DNA, 14 bp, Homo sapiens
ctttcttcctttct

SEQ ID NO: 1076705 - DNA, 15 bp, Homo sapiens
ctttcttcctttcta

SEQ ID NO: 1076706 - DNA, 12 bp, Homo sapiens
ctttcttctagt

SEQ ID NO: 1076707 - DNA, 15 bp, Homo sapiens
ctttcttctatttta

SEQ ID NO: 1076708 - DNA, 17 bp, Homo sapiens
ctttcttctgtgttaat

SEQ ID NO: 1076709 - DNA, 12 bp, Homo sapiens
ctttcttgacaa

SEQ ID NO: 1076710 - DNA, 20 bp, Homo sapiens
ctttcttgacaaaacctaac

SEQ ID NO: 1076711 - DNA, 17 bp, Homo sapiens
ctttcttgctggctctg

SEQ ID NO: 1076712 - DNA, 19 bp, Homo sapiens
ctttcttgctggctctgag

SEQ ID NO: 1076713 - DNA, 20 bp, Homo sapiens
ctttcttggttcataaatga

SEQ ID NO: 1076714 - DNA, 21 bp, Homo sapiens
ctttcttggttcataaatgaa

SEQ ID NO: 1076715 - DNA, 17 bp, Homo sapiens
ctttcttgtgccctggg

SEQ ID NO: 1076716 - DNA, 15 bp, Homo sapiens
ctttctttacctgag

SEQ ID NO: 1076717 - DNA, 15 bp, Homo sapiens
ctttctttcagatgt

SEQ ID NO: 1076718 - DNA, 16 bp, Homo sapiens
ctttctttcagatgtt

SEQ ID NO: 1076719 - DNA, 14 bp, Homo sapiens
ctttctttcttaag

SEQ ID NO: 1076720 - DNA, 23 bp, Homo sapiens
ctttctttggcctacattcttta

SEQ ID NO: 1076721 - DNA, 22 bp, Homo sapiens
ctttctttgtttctttcttcct

SEQ ID NO: 1076722 - DNA, 22 bp, Homo sapiens
ctttctttttctggaaattttg

SEQ ID NO: 1076723 - DNA, 14 bp, Homo sapiens
ctttctttttcttc

SEQ ID NO: 1076724 - DNA, 16 bp, Homo sapiens
ctttctttttcttctt

SEQ ID NO: 1076725 - DNA, 22 bp, Homo sapiens
ctttctttttcttttttgcttt

SEQ ID NO: 1076726 - DNA, 13 bp, Homo sapiens
ctttgaaaagttg

SEQ ID NO: 1076727 - DNA, 15 bp, Homo sapiens
ctttgaaaatatttc

SEQ ID NO: 1076728 - DNA, 21 bp, Homo sapiens
ctttgaaaatatttctatgta

SEQ ID NO: 1076729 - DNA, 14 bp, Homo sapiens
ctttgaaacctcag

SEQ ID NO: 1076730 - DNA, 15 bp, Homo sapiens
ctttgaaacctcagg

SEQ ID NO: 1076731 - DNA, 15 bp, Homo sapiens
ctttgaaataaaaaa

SEQ ID NO: 1076732 - DNA, 18 bp, Homo sapiens
ctttgaaatgtgtttctg

SEQ ID NO: 1076733 - DNA, 21 bp, Homo sapiens
ctttgaaatgtgtttctgtat

SEQ ID NO: 1076734 - DNA, 13 bp, Homo sapiens
ctttgaacatgaa

SEQ ID NO: 1076735 - DNA, 17 bp, Homo sapiens
ctttgaactttagtttg

SEQ ID NO: 1076736 - DNA, 23 bp, Homo sapiens
ctttgaagaaaagaaaaaacaac

SEQ ID NO: 1076737 - DNA, 14 bp, Homo sapiens
ctttgaagcagttg

SEQ ID NO: 1076738 - DNA, 17 bp, Homo sapiens
ctttgaagtagctcttt

SEQ ID NO: 1076739 - DNA, 16 bp, Homo sapiens
ctttgaataaatgtgt

SEQ ID NO: 1076740 - DNA, 12 bp, Homo sapiens
ctttgaatattt

SEQ ID NO: 1076741 - DNA, 14 bp, Homo sapiens
ctttgaatgttaat

SEQ ID NO: 1076742 - DNA, 14 bp, Homo sapiens
ctttgacaaaagta

SEQ ID NO: 1076743 - DNA, 15 bp, Homo sapiens
ctttgacaactaaaa

SEQ ID NO: 1076744 - DNA, 16 bp, Homo sapiens
ctttgacaattactca

SEQ ID NO: 1076745 - DNA, 21 bp, Homo sapiens
ctttgacaattcctagataaa

SEQ ID NO: 1076746 - DNA, 18 bp, Homo sapiens
ctttgacaattctgggtg

SEQ ID NO: 1076747 - DNA, 22 bp, Homo sapiens
ctttgacaattgggagctgcca

SEQ ID NO: 1076748 - DNA, 19 bp, Homo sapiens
ctttgacatggtgccttag

SEQ ID NO: 1076749 - DNA, 22 bp, Homo sapiens
ctttgaccagatctttctcttc

SEQ ID NO: 1076750 - DNA, 23 bp, Homo sapiens
ctttgaccagatctttctcttcc

SEQ ID NO: 1076751 - DNA, 22 bp, Homo sapiens
ctttgacctcaatggaggtttg

SEQ ID NO: 1076752 - DNA, 13 bp, Homo sapiens
ctttgacctctgc

SEQ ID NO: 1076753 - DNA, 15 bp, Homo sapiens
ctttgacctctgcag

SEQ ID NO: 1076754 - DNA, 16 bp, Homo sapiens
ctttgaccttccccaa

SEQ ID NO: 1076755 - DNA, 18 bp, Homo sapiens
ctttgacgtattatctgt

SEQ ID NO: 1076756 - DNA, 19 bp, Homo sapiens
ctttgactctataagcaaa

SEQ ID NO: 1076757 - DNA, 20 bp, Homo sapiens
ctttgactctataagcaaat

SEQ ID NO: 1076758 - DNA, 21 bp, Homo sapiens
ctttgactcttttgccattaa

SEQ ID NO: 1076759 - DNA, 20 bp, Homo sapiens
ctttgacttcagctgcctga

SEQ ID NO: 1076760 - DNA, 14 bp, Homo sapiens
ctttgactttcttc

SEQ ID NO: 1076761 - DNA, 17 bp, Homo sapiens
ctttgagaagccttcag

SEQ ID NO: 1076762 - DNA, 19 bp, Homo sapiens
ctttgagaagccttcagct

SEQ ID NO: 1076763 - DNA, 20 bp, Homo sapiens
ctttgagaatgtgattcctt

SEQ ID NO: 1076764 - DNA, 20 bp, Homo sapiens
ctttgagatagaagaactgc

SEQ ID NO: 1076765 - DNA, 17 bp, Homo sapiens
ctttgagatctggggag

SEQ ID NO: 1076766 - DNA, 19 bp, Homo sapiens
ctttgagatctggggaggc

SEQ ID NO: 1076767 - DNA, 21 bp, Homo sapiens
ctttgagatctggggaggcag

SEQ ID NO: 1076768 - DNA, 19 bp, Homo sapiens
ctttgagcccattcttctg

SEQ ID NO: 1076769 - DNA, 20 bp, Homo sapiens
ctttgagcccattcttctgg

SEQ ID NO: 1076770 - DNA, 22 bp, Homo sapiens
ctttgagcccattcttctgggt

SEQ ID NO: 1076771 - DNA, 16 bp, Homo sapiens
ctttgagccttggccc

SEQ ID NO: 1076772 - DNA, 18 bp, Homo sapiens
ctttgagggtggaaggat

SEQ ID NO: 1076773 - DNA, 22 bp, Homo sapiens
ctttgagggtggaaggatggga

SEQ ID NO: 1076774 - DNA, 22 bp, Homo sapiens
ctttgatattttcaacgcagcc

SEQ ID NO: 1076775 - DNA, 15 bp, Homo sapiens
ctttgatcccagaaa

SEQ ID NO: 1076776 - DNA, 15 bp, Homo sapiens
ctttgatccttctga

SEQ ID NO: 1076777 - DNA, 16 bp, Homo sapiens
ctttgatccttggaaa

SEQ ID NO: 1076778 - DNA, 17 bp, Homo sapiens
ctttgatgaattcttcc

SEQ ID NO: 1076779 - DNA, 23 bp, Homo sapiens
ctttgatgaattcttcctctcct

SEQ ID NO: 1076780 - DNA, 17 bp, Homo sapiens
ctttgatgagcatttgt

SEQ ID NO: 1076781 - DNA, 20 bp, Homo sapiens
ctttgattaaagactccagt

SEQ ID NO: 1076782 - DNA, 18 bp, Homo sapiens
ctttgattatttgcatgt

SEQ ID NO: 1076783 - DNA, 20 bp, Homo sapiens
ctttggaatattttatcctg

SEQ ID NO: 1076784 - DNA, 14 bp, Homo sapiens
ctttggacagtggc

SEQ ID NO: 1076785 - DNA, 15 bp, Homo sapiens
ctttggacccagggc

SEQ ID NO: 1076786 - DNA, 16 bp, Homo sapiens
ctttggacccagggcc

SEQ ID NO: 1076787 - DNA, 17 bp, Homo sapiens
ctttggacccagggcct

SEQ ID NO: 1076788 - DNA, 22 bp, Homo sapiens
ctttggacccagggcctgactt

SEQ ID NO: 1076789 - DNA, 17 bp, Homo sapiens
ctttggacctaatccaa

SEQ ID NO: 1076790 - DNA, 15 bp, Homo sapiens
ctttggacctattat

SEQ ID NO: 1076791 - DNA, 20 bp, Homo sapiens
ctttggagcaaagaaggagc

SEQ ID NO: 1076792 - DNA, 23 bp, Homo sapiens
ctttggagcaaagaaggagctga

SEQ ID NO: 1076793 - DNA, 13 bp, Homo sapiens
ctttggagctttt

SEQ ID NO: 1076794 - DNA, 23 bp, Homo sapiens
ctttggagcttttttctttaaga

SEQ ID NO: 1076795 - DNA, 14 bp, Homo sapiens
ctttggaggggaaa

SEQ ID NO: 1076796 - DNA, 14 bp, Homo sapiens
ctttggaggtgctg

SEQ ID NO: 1076797 - DNA, 18 bp, Homo sapiens
ctttggagtcccctcacc

SEQ ID NO: 1076798 - DNA, 13 bp, Homo sapiens
ctttggatttgac

SEQ ID NO: 1076799 - DNA, 15 bp, Homo sapiens
ctttggatttgacat

SEQ ID NO: 1076800 - DNA, 14 bp, Homo sapiens
ctttggcactggat

SEQ ID NO: 1076801 - DNA, 11 bp, Homo sapiens
ctttggcagtg

SEQ ID NO: 1076802 - DNA, 11 bp, Homo sapiens
ctttggcccaa

SEQ ID NO: 1076803 - DNA, 15 bp, Homo sapiens
ctttggcccaatgcc

SEQ ID NO: 1076804 - DNA, 11 bp, Homo sapiens
ctttggccttt

SEQ ID NO: 1076805 - DNA, 15 bp, Homo sapiens
ctttggcctttcctt

SEQ ID NO: 1076806 - DNA, 16 bp, Homo sapiens
ctttggcgttggagac

SEQ ID NO: 1076807 - DNA, 22 bp, Homo sapiens
ctttggctgagacctgggattt

SEQ ID NO: 1076808 - DNA, 17 bp, Homo sapiens
ctttggcttctcctgtg

SEQ ID NO: 1076809 - DNA, 18 bp, Homo sapiens
ctttggcttctcctgtga

SEQ ID NO: 1076810 - DNA, 12 bp, Homo sapiens
ctttggcttttt

SEQ ID NO: 1076811 - DNA, 19 bp, Homo sapiens
ctttgggaggccaaggcag

SEQ ID NO: 1076812 - DNA, 23 bp, Homo sapiens
ctttgggaggccaaggcaggtag

SEQ ID NO: 1076813 - DNA, 23 bp, Homo sapiens
ctttgggaggccaaggtgggagg

SEQ ID NO: 1076814 - DNA, 18 bp, Homo sapiens
ctttgggaggctgaggcg

SEQ ID NO: 1076815 - DNA, 16 bp, Homo sapiens
ctttgggatcagcctc

SEQ ID NO: 1076816 - DNA, 19 bp, Homo sapiens
ctttgggatttaatttcca

SEQ ID NO: 1076817 - DNA, 11 bp, Homo sapiens
ctttgggccca

SEQ ID NO: 1076818 - DNA, 14 bp, Homo sapiens
ctttgggctgccct

SEQ ID NO: 1076819 - DNA, 15 bp, Homo sapiens
ctttgggctgccctg

SEQ ID NO: 1076820 - DNA, 21 bp, Homo sapiens
ctttgggctgccctggtgctg

SEQ ID NO: 1076821 - DNA, 12 bp, Homo sapiens
ctttgggctttg

SEQ ID NO: 1076822 - DNA, 20 bp, Homo sapiens
ctttggggacagttggcaga

SEQ ID NO: 1076823 - DNA, 23 bp, Homo sapiens
ctttgggggaggagaacatgagt

SEQ ID NO: 1076824 - DNA, 18 bp, Homo sapiens
ctttggggggtgtgctga

SEQ ID NO: 1076825 - DNA, 18 bp, Homo sapiens
ctttgggggtggaaaagg

SEQ ID NO: 1076826 - DNA, 22 bp, Homo sapiens
ctttgggtcataaatcagaaag

SEQ ID NO: 1076827 - DNA, 18 bp, Homo sapiens
ctttgggtccattcagat

SEQ ID NO: 1076828 - DNA, 15 bp, Homo sapiens
ctttgtgttcatttc

SEQ ID NO: 1076829 - DNA, 20 bp, Homo sapiens
ctttgtgttgggagggatta

SEQ ID NO: 1076830 - DNA, 14 bp, Homo sapiens
ctttgtgtttactt

SEQ ID NO: 1076831 - DNA, 13 bp, Homo sapiens
ctttgttaacctt

SEQ ID NO: 1076832 - DNA, 21 bp, Homo sapiens
ctttgttaaccttaaatacac

SEQ ID NO: 1076833 - DNA, 15 bp, Homo sapiens
ctttgttacaggcac

SEQ ID NO: 1076834 - DNA, 23 bp, Homo sapiens
ctttgttaccatactgtctctgg

SEQ ID NO: 1076835 - DNA, 15 bp, Homo sapiens
ctttgttatgacagt

SEQ ID NO: 1076836 - DNA, 18 bp, Homo sapiens
ctttgttcatagcccagt

SEQ ID NO: 1076837 - DNA, 18 bp, Homo sapiens
ctttgttctaaagatgga

SEQ ID NO: 1076838 - DNA, 23 bp, Homo sapiens
ctttgttctgagcattcgctgta

SEQ ID NO: 1076839 - DNA, 13 bp, Homo sapiens
ctttgttctgttt

SEQ ID NO: 1076840 - DNA, 18 bp, Homo sapiens
ctttgttgcaagatgtga

SEQ ID NO: 1076841 - DNA, 17 bp, Homo sapiens
ctttgtttaaatgccaa

SEQ ID NO: 1076842 - DNA, 15 bp, Homo sapiens
ctttgtttatgcata

SEQ ID NO: 1076843 - DNA, 16 bp, Homo sapiens
ctttgtttatgcatat

SEQ ID NO: 1076844 - DNA, 17 bp, Homo sapiens
ctttgtttcaaccaagt

SEQ ID NO: 1076845 - DNA, 17 bp, Homo sapiens
ctttgtttcgtggggag

SEQ ID NO: 1076846 - DNA, 17 bp, Homo sapiens
ctttgtttctttcttcc

SEQ ID NO: 1076847 - DNA, 19 bp, Homo sapiens
ctttgtttctttttacagc

SEQ ID NO: 1076848 - DNA, 17 bp, Homo sapiens
ctttgttttaataaaca

SEQ ID NO: 1076849 - DNA, 20 bp, Homo sapiens
ctttgttttctgactaatta

SEQ ID NO: 1076850 - DNA, 19 bp, Homo sapiens
ctttgttttgatgtttgtg

SEQ ID NO: 1076851 - DNA, 13 bp, Homo sapiens
ctttgtttttaaa

SEQ ID NO: 1076852 - DNA, 15 bp, Homo sapiens
cttttaaaaaacaaa

SEQ ID NO: 1076853 - DNA, 19 bp, Homo sapiens
cttttaaaaaacaaaaaaa

SEQ ID NO: 1076854 - DNA, 14 bp, Homo sapiens
cttttaaaaaatat

SEQ ID NO: 1076855 - DNA, 15 bp, Homo sapiens
cttttaaaaaatatt

SEQ ID NO: 1076856 - DNA, 16 bp, Homo sapiens
cttttaaaaaatattt

SEQ ID NO: 1076857 - DNA, 14 bp, Homo sapiens
cttttaaaagacaa

SEQ ID NO: 1076858 - DNA, 16 bp, Homo sapiens
cttttaaaagacaaga

SEQ ID NO: 1076859 - DNA, 11 bp, Homo sapiens
cttttaaaata

SEQ ID NO: 1076860 - DNA, 23 bp, Homo sapiens
cttttaaaatttgtcttaaaaat

SEQ ID NO: 1076861 - DNA, 17 bp, Homo sapiens
cttttaaacaagtcatt

SEQ ID NO: 1076862 - DNA, 16 bp, Homo sapiens
cttttaaacattattt

SEQ ID NO: 1076863 - DNA, 17 bp, Homo sapiens
cttttaaacattatttt

SEQ ID NO: 1076864 - DNA, 13 bp, Homo sapiens
cttttaaactgtg

SEQ ID NO: 1076865 - DNA, 23 bp, Homo sapiens
cttttaaagaaaaaaattgaaat

SEQ ID NO: 1076866 - DNA, 12 bp, Homo sapiens
cttttaaagtat

SEQ ID NO: 1076867 - DNA, 21 bp, Homo sapiens
cttttaaagtatttataaaaa

SEQ ID NO: 1076868 - DNA, 17 bp, Homo sapiens
cttttaaatatttgtga

SEQ ID NO: 1076869 - DNA, 12 bp, Homo sapiens
cttttaaatcat

SEQ ID NO: 1076870 - DNA, 22 bp, Homo sapiens
cttttaaatgattgaattatat

SEQ ID NO: 1076871 - DNA, 16 bp, Homo sapiens
cttttaaatgctctct

SEQ ID NO: 1076872 - DNA, 17 bp, Homo sapiens
cttttaacttctttcta

SEQ ID NO: 1076873 - DNA, 17 bp, Homo sapiens
cttttaagaaaaacaaa

SEQ ID NO: 1076874 - DNA, 19 bp, Homo sapiens
cttttaagaaaaacaaagt

SEQ ID NO: 1076875 - DNA, 14 bp, Homo sapiens
cttttaagaatcaa

SEQ ID NO: 1076876 - DNA, 12 bp, Homo sapiens
cttttaagcaga

SEQ ID NO: 1076877 - DNA, 23 bp, Homo sapiens
cttttaaggataaatcataaagt

SEQ ID NO: 1076878 - DNA, 21 bp, Homo sapiens
cttttaagtttgaaactaact

SEQ ID NO: 1076879 - DNA, 14 bp, Homo sapiens
cttttaatcagaca

SEQ ID NO: 1076880 - DNA, 16 bp, Homo sapiens
cttttaatcagtgaag

SEQ ID NO: 1076881 - DNA, 16 bp, Homo sapiens
cttttaatgaaaagga

SEQ ID NO: 1076882 - DNA, 21 bp, Homo sapiens
cttttaatgaatttaaggcaa

SEQ ID NO: 1076883 - DNA, 11 bp, Homo sapiens
cttttaatggt

SEQ ID NO: 1076884 - DNA, 17 bp, Homo sapiens
cttttatctggtgcctc

SEQ ID NO: 1076885 - DNA, 18 bp, Homo sapiens
cttttatgatgtatattt

SEQ ID NO: 1076886 - DNA, 18 bp, Homo sapiens
cttttatgtagtaattga

SEQ ID NO: 1076887 - DNA, 23 bp, Homo sapiens
cttttatgtagtaattgacatgt

SEQ ID NO: 1076888 - DNA, 14 bp, Homo sapiens
cttttatgtgagat

SEQ ID NO: 1076889 - DNA, 16 bp, Homo sapiens
cttttatgtgagattt

SEQ ID NO: 1076890 - DNA, 19 bp, Homo sapiens
cttttattaatgcactttc

SEQ ID NO: 1076891 - DNA, 21 bp, Homo sapiens
cttttattattattattgctg

SEQ ID NO: 1076892 - DNA, 17 bp, Homo sapiens
cttttattcatttgagt

SEQ ID NO: 1076893 - DNA, 11 bp, Homo sapiens
cttttattctg

SEQ ID NO: 1076894 - DNA, 20 bp, Homo sapiens
cttttattctgttatatagt

SEQ ID NO: 1076895 - DNA, 18 bp, Homo sapiens
cttttattcttctttctt

SEQ ID NO: 1076896 - DNA, 22 bp, Homo sapiens
cttttatttaacaaaaaatgta

SEQ ID NO: 1076897 - DNA, 20 bp, Homo sapiens
cttttatttagggccttttc

SEQ ID NO: 1076898 - DNA, 23 bp, Homo sapiens
cttttatttagggccttttctgt

SEQ ID NO: 1076899 - DNA, 14 bp, Homo sapiens
cttttattttcatt

SEQ ID NO: 1076900 - DNA, 23 bp, Homo sapiens
cttttattttttaaatgtaaaat

SEQ ID NO: 1076901 - DNA, 18 bp, Homo sapiens
cttttcaaaagaagacat

SEQ ID NO: 1076902 - DNA, 23 bp, Homo sapiens
cttttcaacttggcttcctttct

SEQ ID NO: 1076903 - DNA, 15 bp, Homo sapiens
cttttcaatgacatt

SEQ ID NO: 1076904 - DNA, 20 bp, Homo sapiens
cttttcacaaaggctgatgt

SEQ ID NO: 1076905 - DNA, 13 bp, Homo sapiens
cttttcacactgt

SEQ ID NO: 1076906 - DNA, 15 bp, Homo sapiens
cttttcacactgtct

SEQ ID NO: 1076907 - DNA, 18 bp, Homo sapiens
cttttcacactgtcttcc

SEQ ID NO: 1076908 - DNA, 14 bp, Homo sapiens
cttttcaccaatga

SEQ ID NO: 1076909 - DNA, 18 bp, Homo sapiens
cttttcaccccagaggac

SEQ ID NO: 1076910 - DNA, 22 bp, Homo sapiens
cttttcacgttttctttacaca

SEQ ID NO: 1076911 - DNA, 18 bp, Homo sapiens
cttttcactgctggctgc

SEQ ID NO: 1076912 - DNA, 14 bp, Homo sapiens
cttttcacttgtct

SEQ ID NO: 1076913 - DNA, 19 bp, Homo sapiens
cttttcactttattgctat

SEQ ID NO: 1076914 - DNA, 15 bp, Homo sapiens
cttttcactttctgt

SEQ ID NO: 1076915 - DNA, 20 bp, Homo sapiens
cttttcagaagcaagccaga

SEQ ID NO: 1076916 - DNA, 21 bp, Homo sapiens
cttttcagaagcaagccagac

SEQ ID NO: 1076917 - DNA, 11 bp, Homo sapiens
cttttcagccc

SEQ ID NO: 1076918 - DNA, 23 bp, Homo sapiens
cttttcagcgatgtatgcagcta

SEQ ID NO: 1076919 - DNA, 14 bp, Homo sapiens
cttttcaggaaaat

SEQ ID NO: 1076920 - DNA, 20 bp, Homo sapiens
cttttcataaagggttgaaa

SEQ ID NO: 1076921 - DNA, 22 bp, Homo sapiens
cttttcataaagggttgaaaat

SEQ ID NO: 1076922 - DNA, 20 bp, Homo sapiens
cttttcataggtctgaaatt

SEQ ID NO: 1076923 - DNA, 16 bp, Homo sapiens
cttttcatccttcccc

SEQ ID NO: 1076924 - DNA, 15 bp, Homo sapiens
cttttcatggaagtg

SEQ ID NO: 1076925 - DNA, 19 bp, Homo sapiens
cttttcatgtagaactcag

SEQ ID NO: 1076926 - DNA, 14 bp, Homo sapiens
cttttcattccctg

SEQ ID NO: 1076927 - DNA, 17 bp, Homo sapiens
cttttcattctctttta

SEQ ID NO: 1076928 - DNA, 20 bp, Homo sapiens
cttttccagttgctgtggac

SEQ ID NO: 1076929 - DNA, 14 bp, Homo sapiens
cttttccattgtca

SEQ ID NO: 1076930 - DNA, 14 bp, Homo sapiens
cttttcccaggaat

SEQ ID NO: 1076931 - DNA, 19 bp, Homo sapiens
cttttccccaaccacagag

SEQ ID NO: 1076932 - DNA, 23 bp, Homo sapiens
cttttcccccattaatcagttca

SEQ ID NO: 1076933 - DNA, 16 bp, Homo sapiens
cttttcccctgttaaa

SEQ ID NO: 1076934 - DNA, 18 bp, Homo sapiens
cttttcccctgttaaaca

SEQ ID NO: 1076935 - DNA, 15 bp, Homo sapiens
cttttccctcttttc

SEQ ID NO: 1076936 - DNA, 13 bp, Homo sapiens
cttttccctgctt

SEQ ID NO: 1076937 - DNA, 14 bp, Homo sapiens
cttttccctgcttc

SEQ ID NO: 1076938 - DNA, 20 bp, Homo sapiens
cttttccctgcttccaggaa

SEQ ID NO: 1076939 - DNA, 20 bp, Homo sapiens
cttttcctattctgttgcca

SEQ ID NO: 1076940 - DNA, 22 bp, Homo sapiens
cttttcctcaagcaataattgt

SEQ ID NO: 1076941 - DNA, 15 bp, Homo sapiens
cttttcctcccttgg

SEQ ID NO: 1076942 - DNA, 23 bp, Homo sapiens
cttttcctcccttgggttctgat

SEQ ID NO: 1076943 - DNA, 15 bp, Homo sapiens
cttttcctcttagaa

SEQ ID NO: 1076944 - DNA, 18 bp, Homo sapiens
cttttcctggcagctgct

SEQ ID NO: 1076945 - DNA, 19 bp, Homo sapiens
cttttcctggcagctgctg

SEQ ID NO: 1076946 - DNA, 17 bp, Homo sapiens
cttttcctttctggccc

SEQ ID NO: 1076947 - DNA, 16 bp, Homo sapiens
cttttcctttcttcta

SEQ ID NO: 1076948 - DNA, 16 bp, Homo sapiens
cttttcgttaacattg

SEQ ID NO: 1076949 - DNA, 19 bp, Homo sapiens
cttttctaaaatctaaaat

SEQ ID NO: 1076950 - DNA, 20 bp, Homo sapiens
cttttctaagtggcgtgtgc

SEQ ID NO: 1076951 - DNA, 18 bp, Homo sapiens
cttttctaccctagccat

SEQ ID NO: 1076952 - DNA, 22 bp, Homo sapiens
cttttctaccctagccattcct

SEQ ID NO: 1076953 - DNA, 12 bp, Homo sapiens
cttttctatgtt

SEQ ID NO: 1076954 - DNA, 13 bp, Homo sapiens
cttttctcaggac

SEQ ID NO: 1076955 - DNA, 18 bp, Homo sapiens
cttttctcatgtgtttgc

SEQ ID NO: 1076956 - DNA, 14 bp, Homo sapiens
cttttctccccacg

SEQ ID NO: 1076957 - DNA, 17 bp, Homo sapiens
cttttctcctcactgta

SEQ ID NO: 1076958 - DNA, 18 bp, Homo sapiens
cttttctcctttaccagt

SEQ ID NO: 1076959 - DNA, 14 bp, Homo sapiens
cttttctctgctct

SEQ ID NO: 1076960 - DNA, 21 bp, Homo sapiens
cttttctctttaattttaact

SEQ ID NO: 1076961 - DNA, 13 bp, Homo sapiens
cttttctctttct

SEQ ID NO: 1076962 - DNA, 17 bp, Homo sapiens
cttttctcttttgcttt

SEQ ID NO: 1076963 - DNA, 22 bp, Homo sapiens
cttttctgagttcttgaagcat

SEQ ID NO: 1076964 - DNA, 15 bp, Homo sapiens
cttttctgatggtat

SEQ ID NO: 1076965 - DNA, 16 bp, Homo sapiens
cttttctgccactcca

SEQ ID NO: 1076966 - DNA, 17 bp, Homo sapiens
cttttctgccactccat

SEQ ID NO: 1076967 - DNA, 20 bp, Homo sapiens
cttttgtttccttttttccc

SEQ ID NO: 1076968 - DNA, 22 bp, Homo sapiens
cttttgttttctgatggccaaa

SEQ ID NO: 1076969 - DNA, 15 bp, Homo sapiens
cttttgtttttttcc

SEQ ID NO: 1076970 - DNA, 19 bp, Homo sapiens
cttttgtttttttcctcat

SEQ ID NO: 1076971 - DNA, 14 bp, Homo sapiens
ctttttaaaaaata

SEQ ID NO: 1076972 - DNA, 20 bp, Homo sapiens
ctttttaaaaaataccattg

SEQ ID NO: 1076973 - DNA, 18 bp, Homo sapiens
ctttttaaaaactcttca

SEQ ID NO: 1076974 - DNA, 21 bp, Homo sapiens
ctttttaaaaattgttattta

SEQ ID NO: 1076975 - DNA, 13 bp, Homo sapiens
ctttttaaaacta

SEQ ID NO: 1076976 - DNA, 22 bp, Homo sapiens
ctttttaaaaggtattttgaat

SEQ ID NO: 1076977 - DNA, 14 bp, Homo sapiens
ctttttaaaatact

SEQ ID NO: 1076978 - DNA, 15 bp, Homo sapiens
ctttttaaatgtgaa

SEQ ID NO: 1076979 - DNA, 23 bp, Homo sapiens
ctttttaaattcagtcctaagaa

SEQ ID NO: 1076980 - DNA, 15 bp, Homo sapiens
ctttttaagagatac

SEQ ID NO: 1076981 - DNA, 14 bp, Homo sapiens
ctttttaatatgct

SEQ ID NO: 1076982 - DNA, 15 bp, Homo sapiens
ctttttaatatgctt

SEQ ID NO: 1076983 - DNA, 22 bp, Homo sapiens
ctttttaatattgatatgctta

SEQ ID NO: 1076984 - DNA, 21 bp, Homo sapiens
ctttttaatcatgaatatgat

SEQ ID NO: 1076985 - DNA, 22 bp, Homo sapiens
ctttttaattattttaaaatat

SEQ ID NO: 1076986 - DNA, 17 bp, Homo sapiens
ctttttacagcattgtc

SEQ ID NO: 1076987 - DNA, 12 bp, Homo sapiens
ctttttacagtt

SEQ ID NO: 1076988 - DNA, 16 bp, Homo sapiens
ctttttagatgtattt

SEQ ID NO: 1076989 - DNA, 20 bp, Homo sapiens
ctttttagatgtatttttga

SEQ ID NO: 1076990 - DNA, 15 bp, Homo sapiens
ctttttataaaaaga

SEQ ID NO: 1076991 - DNA, 18 bp, Homo sapiens
ctttttataaaaagataa

SEQ ID NO: 1076992 - DNA, 20 bp, Homo sapiens
ctttttatatttaaaaaatt

SEQ ID NO: 1076993 - DNA, 15 bp, Homo sapiens
ctttttatgctattt

SEQ ID NO: 1076994 - DNA, 16 bp, Homo sapiens
ctttttattaaaatat

SEQ ID NO: 1076995 - DNA, 18 bp, Homo sapiens
ctttttattattttaagt

SEQ ID NO: 1076996 - DNA, 14 bp, Homo sapiens
ctttttattgaatc

SEQ ID NO: 1076997 - DNA, 17 bp, Homo sapiens
ctttttattgaatctat

SEQ ID NO: 1076998 - DNA, 19 bp, Homo sapiens
ctttttattgaatctattt

SEQ ID NO: 1076999 - DNA, 21 bp, Homo sapiens
ctttttatttaattaaatgta

SEQ ID NO: 1077000 - DNA, 13 bp, Homo sapiens
ctttttatttctg

SEQ ID NO: 1077001 - DNA, 15 bp, Homo sapiens
ctttttatttgcatg

SEQ ID NO: 1077002 - DNA, 22 bp, Homo sapiens
ctttttcaaaaaccagccaggc

SEQ ID NO: 1077003 - DNA, 12 bp, Homo sapiens
ctttttcaatgg

SEQ ID NO: 1077004 - DNA, 15 bp, Homo sapiens
ctttttcactttgaa

SEQ ID NO: 1077005 - DNA, 18 bp, Homo sapiens
ctttttcataaattattt

SEQ ID NO: 1077006 - DNA, 12 bp, Homo sapiens
ctttttcattta

SEQ ID NO: 1077007 - DNA, 13 bp, Homo sapiens
ctttttcatttat

SEQ ID NO: 1077008 - DNA, 13 bp, Homo sapiens
ctttttcattttg

SEQ ID NO: 1077009 - DNA, 17 bp, Homo sapiens
ctttttcattttgcaga

SEQ ID NO: 1077010 - DNA, 13 bp, Homo sapiens
ctttttccaatgt

SEQ ID NO: 1077011 - DNA, 22 bp, Homo sapiens
ctttttccagacacttttttga

SEQ ID NO: 1077012 - DNA, 20 bp, Homo sapiens
ctttttccatttcttcagag

SEQ ID NO: 1077013 - DNA, 22 bp, Homo sapiens
ctttttccatttcttcagaggg

SEQ ID NO: 1077014 - DNA, 16 bp, Homo sapiens
ctttttcccaataaat

SEQ ID NO: 1077015 - DNA, 17 bp, Homo sapiens
ctttttcccaataaatt

SEQ ID NO: 1077016 - DNA, 22 bp, Homo sapiens
ctttttcctactccgttcctgg

SEQ ID NO: 1077017 - DNA, 11 bp, Homo sapiens
ctttttcctcc

SEQ ID NO: 1077018 - DNA, 17 bp, Homo sapiens
ctttttctaaaaagcta

SEQ ID NO: 1077019 - DNA, 13 bp, Homo sapiens
ctttttctaatga

SEQ ID NO: 1077020 - DNA, 20 bp, Homo sapiens
ctttttctaatgaggagaga

SEQ ID NO: 1077021 - DNA, 11 bp, Homo sapiens
ctttttctacc

SEQ ID NO: 1077022 - DNA, 12 bp, Homo sapiens
ctttttctggac

SEQ ID NO: 1077023 - DNA, 16 bp, Homo sapiens
ctttttctggactctg

SEQ ID NO: 1077024 - DNA, 12 bp, Homo sapiens
ctttttctgtgg

SEQ ID NO: 1077025 - DNA, 22 bp, Homo sapiens
ctttttcttcacttacaagaaa

SEQ ID NO: 1077026 - DNA, 12 bp, Homo sapiens
ctttttcttccc

SEQ ID NO: 1077027 - DNA, 16 bp, Homo sapiens
ctttttcttgtattca

SEQ ID NO: 1077028 - DNA, 16 bp, Homo sapiens
ctttttctttataaac

SEQ ID NO: 1077029 - DNA, 13 bp, Homo sapiens
ctttttctttctt

SEQ ID NO: 1077030 - DNA, 17 bp, Homo sapiens
ctttttctttctttgtt

SEQ ID NO: 1077031 - DNA, 21 bp, Homo sapiens
ctttttctttttttctttggt

SEQ ID NO: 1077032 - DNA, 17 bp, Homo sapiens
ctttttctttttttggt

SEQ ID NO: 1077033 - DNA, 22 bp, Homo sapiens
ctttttgaacttttcattccct

SEQ ID NO: 1077034 - DNA, 23 bp, Homo sapiens
ctttttgaagtgtaggcagacac

SEQ ID NO: 1077035 - DNA, 11 bp, Homo sapiens
ctttttgaatg

SEQ ID NO: 1077036 - DNA, 19 bp, Homo sapiens
ctttttgaatgttatttgt

SEQ ID NO: 1077037 - DNA, 11 bp, Homo sapiens
ctttttggaat

SEQ ID NO: 1077038 - DNA, 22 bp, Homo sapiens
ctttttggaattcagcagtttt

SEQ ID NO: 1077039 - DNA, 17 bp, Homo sapiens
ctttttggaattgtctt

SEQ ID NO: 1077040 - DNA, 18 bp, Homo sapiens
ctttttggaattgtcttg

SEQ ID NO: 1077041 - DNA, 21 bp, Homo sapiens
ctttttggaggtgcttaagca

SEQ ID NO: 1077042 - DNA, 16 bp, Homo sapiens
ctttttggtaataaca

SEQ ID NO: 1077043 - DNA, 20 bp, Homo sapiens
ctttttgtattttttcctta

SEQ ID NO: 1077044 - DNA, 21 bp, Homo sapiens
ctttttgtattttttccttaa

SEQ ID NO: 1077045 - DNA, 15 bp, Homo sapiens
ctttttgtgtttttt

SEQ ID NO: 1077046 - DNA, 21 bp, Homo sapiens
ctttttgttctggtccttttt

SEQ ID NO: 1077047 - DNA, 22 bp, Homo sapiens
ctttttgttgttgttgttcttt

SEQ ID NO: 1077048 - DNA, 13 bp, Homo sapiens
cttttttaaacta

SEQ ID NO: 1077049 - DNA, 18 bp, Homo sapiens
cttttttaaagtaaactt

SEQ ID NO: 1077050 - DNA, 17 bp, Homo sapiens
cttttttaaatattttc

SEQ ID NO: 1077051 - DNA, 14 bp, Homo sapiens
cttttttaaattaa

SEQ ID NO: 1077052 - DNA, 13 bp, Homo sapiens
gaaaaaaaaagaa

SEQ ID NO: 1077053 - DNA, 15 bp, Homo sapiens
gaaaaaaaaagaaaa

SEQ ID NO: 1077054 - DNA, 16 bp, Homo sapiens
gaaaaaaaaagaaaaa

SEQ ID NO: 1077055 - DNA, 19 bp, Homo sapiens
gaaaaaaaaagtgaaaaaa

SEQ ID NO: 1077056 - DNA, 18 bp, Homo sapiens
gaaaaaaaaattcacatg

SEQ ID NO: 1077057 - DNA, 11 bp, Homo sapiens
gaaaaaaaaca

SEQ ID NO: 1077058 - DNA, 16 bp, Homo sapiens
gaaaaaaaacacaaaa

SEQ ID NO: 1077059 - DNA, 14 bp, Homo sapiens
gaaaaaaaaccttg

SEQ ID NO: 1077060 - DNA, 15 bp, Homo sapiens
gaaaaaaaagaaaaa

SEQ ID NO: 1077061 - DNA, 17 bp, Homo sapiens
gaaaaaaaagtgtctca

SEQ ID NO: 1077062 - DNA, 20 bp, Homo sapiens
gaaaaaaaagtgtctcaaag

SEQ ID NO: 1077063 - DNA, 22 bp, Homo sapiens
gaaaaaaaagtttcagagaagt

SEQ ID NO: 1077064 - DNA, 20 bp, Homo sapiens
gaaaaaaaatgttctttggg

SEQ ID NO: 1077065 - DNA, 13 bp, Homo sapiens
gaaaaaaaattat

SEQ ID NO: 1077066 - DNA, 18 bp, Homo sapiens
gaaaaaaacataaaaagc

SEQ ID NO: 1077067 - DNA, 13 bp, Homo sapiens
gaaaaaaactttt

SEQ ID NO: 1077068 - DNA, 17 bp, Homo sapiens
gaaaaaaacttttataa

SEQ ID NO: 1077069 - DNA, 23 bp, Homo sapiens
gaaaaaaacttttataaattaaa

SEQ ID NO: 1077070 - DNA, 10 bp, Homo sapiens
gaaaaaaaga

SEQ ID NO: 1077071 - DNA, 13 bp, Homo sapiens
gaaaaaaagaaaa

SEQ ID NO: 1077072 - DNA, 16 bp, Homo sapiens
gaaaaaaagaaaaaaa

SEQ ID NO: 1077073 - DNA, 20 bp, Homo sapiens
gaaaaaaagtttgccagaag

SEQ ID NO: 1077074 - DNA, 16 bp, Homo sapiens
gaaaaaaataactatt

SEQ ID NO: 1077075 - DNA, 21 bp, Homo sapiens
gaaaaaaatgttgtttcctaa

SEQ ID NO: 1077076 - DNA, 14 bp, Homo sapiens
gaaaaaaattgaaa

SEQ ID NO: 1077077 - DNA, 15 bp, Homo sapiens
gaaaaaaattgaaat

SEQ ID NO: 1077078 - DNA, 16 bp, Homo sapiens
gaaaaaaattgaaatg

SEQ ID NO: 1077079 - DNA, 19 bp, Homo sapiens
gaaaaaacacctagcttta

SEQ ID NO: 1077080 - DNA, 10 bp, Homo sapiens
gaaaaaagag

SEQ ID NO: 1077081 - DNA, 16 bp, Homo sapiens
gaaaaaagagaaaaga

SEQ ID NO: 1077082 - DNA, 18 bp, Homo sapiens
gaaaaaagagaaaagaaa

SEQ ID NO: 1077083 - DNA, 23 bp, Homo sapiens
gaaaaaagttgtaggcgaatcat

SEQ ID NO: 1077084 - DNA, 15 bp, Homo sapiens
gaaaaaataaaaaga

SEQ ID NO: 1077085 - DNA, 21 bp, Homo sapiens
gaaaaaataattgatttcaag

SEQ ID NO: 1077086 - DNA, 16 bp, Homo sapiens
gaaaaaatactaccta

SEQ ID NO: 1077087 - DNA, 21 bp, Homo sapiens
gaaaaaatatatgtatataca

SEQ ID NO: 1077088 - DNA, 14 bp, Homo sapiens
gaaaaaatcagaac

SEQ ID NO: 1077089 - DNA, 17 bp, Homo sapiens
gaaaaaatggtagcatt

SEQ ID NO: 1077090 - DNA, 13 bp, Homo sapiens
gaaaaaattgaaa

SEQ ID NO: 1077091 - DNA, 23 bp, Homo sapiens
gaaaaacaaactcgttttttaca

SEQ ID NO: 1077092 - DNA, 14 bp, Homo sapiens
gaaaaacacaagca

SEQ ID NO: 1077093 - DNA, 15 bp, Homo sapiens
gaaaaacacaagcaa

SEQ ID NO: 1077094 - DNA, 17 bp, Homo sapiens
gaaaaacacaagcaaaa

SEQ ID NO: 1077095 - DNA, 17 bp, Homo sapiens
gaaaaacacggcagctg

SEQ ID NO: 1077096 - DNA, 11 bp, Homo sapiens
gaaaaacaggt

SEQ ID NO: 1077097 - DNA, 20 bp, Homo sapiens
gaaaaacatcccaaacttta

SEQ ID NO: 1077098 - DNA, 21 bp, Homo sapiens
gaaaaacatttaaacttttta

SEQ ID NO: 1077099 - DNA, 22 bp, Homo sapiens
gaaaaaccgagataggggaggg

SEQ ID NO: 1077100 - DNA, 18 bp, Homo sapiens
gaaaaacgtgttgccttg

SEQ ID NO: 1077101 - DNA, 14 bp, Homo sapiens
gaaaaactggctct

SEQ ID NO: 1077102 - DNA, 13 bp, Homo sapiens
gaaaaactgttct

SEQ ID NO: 1077103 - DNA, 22 bp, Homo sapiens
gaaaaacttttaggttgttacc

SEQ ID NO: 1077104 - DNA, 9 bp, Homo sapiens
gaaaaagaa

SEQ ID NO: 1077105 - DNA, 11 bp, Homo sapiens
gaaaaagaaaa

SEQ ID NO: 1077106 - DNA, 16 bp, Homo sapiens
gaaaaagaaaaaatat

SEQ ID NO: 1077107 - DNA, 14 bp, Homo sapiens
gaaaaagaaacaca

SEQ ID NO: 1077108 - DNA, 14 bp, Homo sapiens
gaaaaagaaatgca

SEQ ID NO: 1077109 - DNA, 14 bp, Homo sapiens
gaaaaagaagaatc

SEQ ID NO: 1077110 - DNA, 14 bp, Homo sapiens
gaaaaagatgtaca

SEQ ID NO: 1077111 - DNA, 21 bp, Homo sapiens
gaaaatctttgttgaagtttg

SEQ ID NO: 1077112 - DNA, 13 bp, Homo sapiens
gaaaatgaaagct

SEQ ID NO: 1077113 - DNA, 14 bp, Homo sapiens
gaaaatgaagggat

SEQ ID NO: 1077114 - DNA, 22 bp, Homo sapiens
gaaaatgaatatctattaatat

SEQ ID NO: 1077115 - DNA, 13 bp, Homo sapiens
gaaaatgaatttg

SEQ ID NO: 1077116 - DNA, 15 bp, Homo sapiens
gaaaatgacttattt

SEQ ID NO: 1077117 - DNA, 20 bp, Homo sapiens
gaaaatgagaggagaacagt

SEQ ID NO: 1077118 - DNA, 18 bp, Homo sapiens
gaaaatgagccctggctc

SEQ ID NO: 1077119 - DNA, 14 bp, Homo sapiens
gaaaatgatctgag

SEQ ID NO: 1077120 - DNA, 22 bp, Homo sapiens
gaaaatgatctgagtcccagga

SEQ ID NO: 1077121 - DNA, 16 bp, Homo sapiens
gaaaatgcaaaatgaa

SEQ ID NO: 1077122 - DNA, 20 bp, Homo sapiens
gaaaatgcattagggaaaac

SEQ ID NO: 1077123 - DNA, 12 bp, Homo sapiens
gaaaatgcattt

SEQ ID NO: 1077124 - DNA, 16 bp, Homo sapiens
gaaaatgcattttctt

SEQ ID NO: 1077125 - DNA, 18 bp, Homo sapiens
gaaaatgcattttcttca

SEQ ID NO: 1077126 - DNA, 16 bp, Homo sapiens
gaaaatgctcttaaaa

SEQ ID NO: 1077127 - DNA, 22 bp, Homo sapiens
gaaaatggtccaattagtttcc

SEQ ID NO: 1077128 - DNA, 23 bp, Homo sapiens
gaaaatggtccaattagtttcct

SEQ ID NO: 1077129 - DNA, 18 bp, Homo sapiens
gaaaatggtccaggagaa

SEQ ID NO: 1077130 - DNA, 22 bp, Homo sapiens
gaaaatggtcgagaaagaggca

SEQ ID NO: 1077131 - DNA, 19 bp, Homo sapiens
gaaaatgtactgagatttt

SEQ ID NO: 1077132 - DNA, 17 bp, Homo sapiens
gaaaatgtatattttga

SEQ ID NO: 1077133 - DNA, 18 bp, Homo sapiens
gaaaatgtatattttgat

SEQ ID NO: 1077134 - DNA, 18 bp, Homo sapiens
gaaaatgtatccagagga

SEQ ID NO: 1077135 - DNA, 15 bp, Homo sapiens
gaaaatgtccaggaa

SEQ ID NO: 1077136 - DNA, 17 bp, Homo sapiens
gaaaatgtctgtaataa

SEQ ID NO: 1077137 - DNA, 18 bp, Homo sapiens
gaaaatgtgaccctccaa

SEQ ID NO: 1077138 - DNA, 22 bp, Homo sapiens
gaaaatgtgaccctccaaatgg

SEQ ID NO: 1077139 - DNA, 22 bp, Homo sapiens
gaaaatgtgtctctgctttcct

SEQ ID NO: 1077140 - DNA, 22 bp, Homo sapiens
gaaaatgttacggcatcacact

SEQ ID NO: 1077141 - DNA, 17 bp, Homo sapiens
gaaaatgttgagaatcc

SEQ ID NO: 1077142 - DNA, 20 bp, Homo sapiens
gaaaatgtttttctgccagg

SEQ ID NO: 1077143 - DNA, 21 bp, Homo sapiens
gaaaattaaaataggcatatt

SEQ ID NO: 1077144 - DNA, 18 bp, Homo sapiens
gaaaattagactgtgatt

SEQ ID NO: 1077145 - DNA, 22 bp, Homo sapiens
gaaaccttattttttcccaaag

SEQ ID NO: 1077146 - DNA, 18 bp, Homo sapiens
gaaaccttggagaggaga

SEQ ID NO: 1077147 - DNA, 19 bp, Homo sapiens
gaaaccttggagaggagag

SEQ ID NO: 1077148 - DNA, 17 bp, Homo sapiens
gaaacgactcaaaatga

SEQ ID NO: 1077149 - DNA, 13 bp, Homo sapiens
gaaacgctacctc

SEQ ID NO: 1077150 - DNA, 21 bp, Homo sapiens
gaaacgctacctctctgtccc

SEQ ID NO: 1077151 - DNA, 23 bp, Homo sapiens
gaaacgctacctctctgtccctt

SEQ ID NO: 1077152 - DNA, 13 bp, Homo sapiens
gaaacgtgttaaa

SEQ ID NO: 1077153 - DNA, 20 bp, Homo sapiens
gaaactaaaaatatagcaaa

SEQ ID NO: 1077154 - DNA, 17 bp, Homo sapiens
gaaactaagattctttt

SEQ ID NO: 1077155 - DNA, 19 bp, Homo sapiens
gaaactactgcctttagaa

SEQ ID NO: 1077156 - DNA, 20 bp, Homo sapiens
gaaactactgcctttagaaa

SEQ ID NO: 1077157 - DNA, 18 bp, Homo sapiens
gaaactaggtctgatatt

SEQ ID NO: 1077158 - DNA, 21 bp, Homo sapiens
gaaactatgtgtttttctcat

SEQ ID NO: 1077159 - DNA, 23 bp, Homo sapiens
gaaactatttaaaggcactatta

SEQ ID NO: 1077160 - DNA, 13 bp, Homo sapiens
gaaactatttttg

SEQ ID NO: 1077161 - DNA, 20 bp, Homo sapiens
gaaactcaccatgtaaaaga

SEQ ID NO: 1077162 - DNA, 21 bp, Homo sapiens
gaaactcacctgctggcccct

SEQ ID NO: 1077163 - DNA, 22 bp, Homo sapiens
gaaactcacctgctggcccctc

SEQ ID NO: 1077164 - DNA, 18 bp, Homo sapiens
gaaactcatagacactga

SEQ ID NO: 1077165 - DNA, 17 bp, Homo sapiens
gaaactccacatctgcc

SEQ ID NO: 1077166 - DNA, 18 bp, Homo sapiens
gaaactccacatctgcct

SEQ ID NO: 1077167 - DNA, 18 bp, Homo sapiens
gaaactccgaagaaaaga

SEQ ID NO: 1077168 - DNA, 20 bp, Homo sapiens
gaaactccgaagaaaagaat

SEQ ID NO: 1077169 - DNA, 18 bp, Homo sapiens
gaaactccgtcttagaag

SEQ ID NO: 1077170 - DNA, 22 bp, Homo sapiens
gaaactccgtcttagaagtgga

SEQ ID NO: 1077171 - DNA, 22 bp, Homo sapiens
gaaactcctgattttgtagtta

SEQ ID NO: 1077172 - DNA, 18 bp, Homo sapiens
gaaactccttttgctgtc

SEQ ID NO: 1077173 - DNA, 16 bp, Homo sapiens
gaaactgaaagtgttt

SEQ ID NO: 1077174 - DNA, 18 bp, Homo sapiens
gaaactgaaagtgtttta

SEQ ID NO: 1077175 - DNA, 12 bp, Homo sapiens
gaaactgaacca

SEQ ID NO: 1077176 - DNA, 18 bp, Homo sapiens
gaaactgaaccaacagaa

SEQ ID NO: 1077177 - DNA, 15 bp, Homo sapiens
gaaactgatttcttc

SEQ ID NO: 1077178 - DNA, 16 bp, Homo sapiens
gaaactgatttcttca

SEQ ID NO: 1077179 - DNA, 22 bp, Homo sapiens
gaaactgctcccatcattcctt

SEQ ID NO: 1077180 - DNA, 12 bp, Homo sapiens
gaaactggcccc

SEQ ID NO: 1077181 - DNA, 21 bp, Homo sapiens
gaaactgtaaaatgatactgt

SEQ ID NO: 1077182 - DNA, 19 bp, Homo sapiens
gaaacttaaatgttattat

SEQ ID NO: 1077183 - DNA, 21 bp, Homo sapiens
gaaacttcagttgatcttctt

SEQ ID NO: 1077184 - DNA, 14 bp, Homo sapiens
gaaacttggccagt

SEQ ID NO: 1077185 - DNA, 15 bp, Homo sapiens
gaaacttggctggaa

SEQ ID NO: 1077186 - DNA, 16 bp, Homo sapiens
gaaacttgttattgtg

SEQ ID NO: 1077187 - DNA, 17 bp, Homo sapiens
gaaacttgttattgtga

SEQ ID NO: 1077188 - DNA, 19 bp, Homo sapiens
gaaacttgttattgtgaat

SEQ ID NO: 1077189 - DNA, 21 bp, Homo sapiens
gaaactttatttaaatgcatg

SEQ ID NO: 1077190 - DNA, 18 bp, Homo sapiens
gaaactttgatctctgct

SEQ ID NO: 1077191 - DNA, 19 bp, Homo sapiens
gaaactttgatctctgctt

SEQ ID NO: 1077192 - DNA, 15 bp, Homo sapiens
gaaacttttctaaag

SEQ ID NO: 1077193 - DNA, 17 bp, Homo sapiens
gaaacttttttatttaa

SEQ ID NO: 1077194 - DNA, 12 bp, Homo sapiens
gaaagaaaagac

SEQ ID NO: 1077195 - DNA, 20 bp, Homo sapiens
gaaagaaaaggcaaaagact

SEQ ID NO: 1077196 - DNA, 23 bp, Homo sapiens
gaaagaaaaggcaaaagactggt

SEQ ID NO: 1077197 - DNA, 15 bp, Homo sapiens
gaaagaaagaaggaa

SEQ ID NO: 1077198 - DNA, 23 bp, Homo sapiens
gaaagaacatggacttgtatatt

SEQ ID NO: 1077199 - DNA, 21 bp, Homo sapiens
gaaagaactttaaagctcagg

SEQ ID NO: 1077200 - DNA, 23 bp, Homo sapiens
gaaagaactttaaagctcaggag

SEQ ID NO: 1077201 - DNA, 22 bp, Homo sapiens
gaaagaagaaactccgaagaaa

SEQ ID NO: 1077202 - DNA, 15 bp, Homo sapiens
gaaagaagtattaaa

SEQ ID NO: 1077203 - DNA, 12 bp, Homo sapiens
gaaagacaggaa

SEQ ID NO: 1077204 - DNA, 17 bp, Homo sapiens
gaaagacaggaagacca

SEQ ID NO: 1077205 - DNA, 22 bp, Homo sapiens
gaaagacatccataaagaagca

SEQ ID NO: 1077206 - DNA, 13 bp, Homo sapiens
gaaagacatctgc

SEQ ID NO: 1077207 - DNA, 15 bp, Homo sapiens
gaaagacatctgcct

SEQ ID NO: 1077208 - DNA, 21 bp, Homo sapiens
gaaagacatctgcctgtaatt

SEQ ID NO: 1077209 - DNA, 21 bp, Homo sapiens
gaaagacctacattccctctc

SEQ ID NO: 1077210 - DNA, 22 bp, Homo sapiens
gaaagacttctctacccatctt

SEQ ID NO: 1077211 - DNA, 18 bp, Homo sapiens
gaaagagaaacagttggt

SEQ ID NO: 1077212 - DNA, 15 bp, Homo sapiens
gaaagagaatgaact

SEQ ID NO: 1077213 - DNA, 16 bp, Homo sapiens
gaaagagaatgaactg

SEQ ID NO: 1077214 - DNA, 17 bp, Homo sapiens
gaaagagaatgaactgt

SEQ ID NO: 1077215 - DNA, 21 bp, Homo sapiens
gaaagagaatgaactgtggaa

SEQ ID NO: 1077216 - DNA, 21 bp, Homo sapiens
gaaagagatcacccactccta

SEQ ID NO: 1077217 - DNA, 19 bp, Homo sapiens
gaaagagcaccctcgagaa

SEQ ID NO: 1077218 - DNA, 19 bp, Homo sapiens
gaaagaggagtattttgtc

SEQ ID NO: 1077219 - DNA, 17 bp, Homo sapiens
gaaagaggagtgcttgt

SEQ ID NO: 1077220 - DNA, 17 bp, Homo sapiens
gaaagagggtcccaggg

SEQ ID NO: 1077221 - DNA, 16 bp, Homo sapiens
gaaagatcaaaaggtt

SEQ ID NO: 1077222 - DNA, 13 bp, Homo sapiens
gaaagatctctgt

SEQ ID NO: 1077223 - DNA, 17 bp, Homo sapiens
gaaagatctctgtcaca

SEQ ID NO: 1077224 - DNA, 18 bp, Homo sapiens
gaaagatctctgtcacat

SEQ ID NO: 1077225 - DNA, 22 bp, Homo sapiens
gaaagatggataaactgagcct

SEQ ID NO: 1077226 - DNA, 18 bp, Homo sapiens
gaaagatgttccagtgag

SEQ ID NO: 1077227 - DNA, 19 bp, Homo sapiens
gaaagatttgttactgtat

SEQ ID NO: 1077228 - DNA, 21 bp, Homo sapiens
gaaagatttgttactgtattt

SEQ ID NO: 1077229 - DNA, 12 bp, Homo sapiens
gaaagattttat

SEQ ID NO: 1077230 - DNA, 13 bp, Homo sapiens
gaaagattttatt

SEQ ID NO: 1077231 - DNA, 15 bp, Homo sapiens
gaaagcagaatcaac

SEQ ID NO: 1077232 - DNA, 16 bp, Homo sapiens
gaaagcagagcctcct

SEQ ID NO: 1077233 - DNA, 19 bp, Homo sapiens
gaaagcagagcctcctggg

SEQ ID NO: 1077234 - DNA, 20 bp, Homo sapiens
gaaagcagagcctcctggga

SEQ ID NO: 1077235 - DNA, 22 bp, Homo sapiens
gaaagcagcagctaggactgag

SEQ ID NO: 1077236 - DNA, 16 bp, Homo sapiens
gaaagcatcacctcag

SEQ ID NO: 1077237 - DNA, 17 bp, Homo sapiens
gaaagcatcacctcagg

SEQ ID NO: 1077238 - DNA, 16 bp, Homo sapiens
gaaagcatcactgcct

SEQ ID NO: 1077239 - DNA, 19 bp, Homo sapiens
gaaagcatgtctctgcttc

SEQ ID NO: 1077240 - DNA, 23 bp, Homo sapiens
gaaagccaaggagtcactgagac

SEQ ID NO: 1077241 - DNA, 18 bp, Homo sapiens
gaaagccacacggagagg

SEQ ID NO: 1077242 - DNA, 15 bp, Homo sapiens
gaaagcgggcagccc

SEQ ID NO: 1077243 - DNA, 18 bp, Homo sapiens
gaaagcgtttctgtgtag

SEQ ID NO: 1077244 - DNA, 16 bp, Homo sapiens
gaaagctagagatatg

SEQ ID NO: 1077245 - DNA, 13 bp, Homo sapiens
gaaagctgagaag

SEQ ID NO: 1077246 - DNA, 22 bp, Homo sapiens
gaaagctgattactgtcaataa

SEQ ID NO: 1077247 - DNA, 23 bp, Homo sapiens
gaaagctgattactgtcaataaa

SEQ ID NO: 1077248 - DNA, 18 bp, Homo sapiens
gaaagctgccagagccgg

SEQ ID NO: 1077249 - DNA, 17 bp, Homo sapiens
gaaagctgcctggtata

SEQ ID NO: 1077250 - DNA, 15 bp, Homo sapiens
gaaagctgtgtttat

SEQ ID NO: 1077251 - DNA, 21 bp, Homo sapiens
gaaagctgtttatttattcac

SEQ ID NO: 1077252 - DNA, 21 bp, Homo sapiens
gaaagcttcaaattatagaaa

SEQ ID NO: 1077253 - DNA, 20 bp, Homo sapiens
gaaagcttttattcctttga

SEQ ID NO: 1077254 - DNA, 14 bp, Homo sapiens
gaaaggaaaagaaa

SEQ ID NO: 1077255 - DNA, 14 bp, Homo sapiens
gaaaggaaaccttt

SEQ ID NO: 1077256 - DNA, 15 bp, Homo sapiens
gaaaggaaacctttt

SEQ ID NO: 1077257 - DNA, 14 bp, Homo sapiens
gaaaggaacactgg

SEQ ID NO: 1077258 - DNA, 14 bp, Homo sapiens
gaaaggaacatttt

SEQ ID NO: 1077259 - DNA, 19 bp, Homo sapiens
gaaaggaagccttgctcat

SEQ ID NO: 1077260 - DNA, 12 bp, Homo sapiens
gaaaggagacat

SEQ ID NO: 1077261 - DNA, 13 bp, Homo sapiens
gaaaggagactag

SEQ ID NO: 1077262 - DNA, 15 bp, Homo sapiens
gaaaggagagtactt

SEQ ID NO: 1077263 - DNA, 21 bp, Homo sapiens
gaaaggaggccctgttccctg

SEQ ID NO: 1077264 - DNA, 15 bp, Homo sapiens
gaaaggaggggagaa

SEQ ID NO: 1077265 - DNA, 21 bp, Homo sapiens
gaaaggatatttaagaaaata

SEQ ID NO: 1077266 - DNA, 20 bp, Homo sapiens
gaaaggatgtaaacagtgcc

SEQ ID NO: 1077267 - DNA, 20 bp, Homo sapiens
gaaaggatgtggaagagcat

SEQ ID NO: 1077268 - DNA, 14 bp, Homo sapiens
gaaaggattttacc

SEQ ID NO: 1077269 - DNA, 17 bp, Homo sapiens
gaaaggattttaccaaa

SEQ ID NO: 1077270 - DNA, 20 bp, Homo sapiens
gaaaggattttaccaaagca

SEQ ID NO: 1077271 - DNA, 21 bp, Homo sapiens
gaaaggcagccctcacctctg

SEQ ID NO: 1077272 - DNA, 20 bp, Homo sapiens
gaaaggcaggaagggaagcg

SEQ ID NO: 1077273 - DNA, 16 bp, Homo sapiens
gaaaggcattctctga

SEQ ID NO: 1077274 - DNA, 14 bp, Homo sapiens
gaaaggcctcaaga

SEQ ID NO: 1077275 - DNA, 14 bp, Homo sapiens
gaaaggccttcaga

SEQ ID NO: 1077276 - DNA, 19 bp, Homo sapiens
gaaaggccttcagacacat

SEQ ID NO: 1077277 - DNA, 21 bp, Homo sapiens
gaaaggccttcagacacatgc

SEQ ID NO: 1077278 - DNA, 21 bp, Homo sapiens
gaaaggcgcccccgccccagg

SEQ ID NO: 1077279 - DNA, 19 bp, Homo sapiens
gaaaggctatcctgctgaa

SEQ ID NO: 1077280 - DNA, 22 bp, Homo sapiens
gaaaggctcagtctcaggagca

SEQ ID NO: 1077281 - DNA, 17 bp, Homo sapiens
gaaaggctcatttaaaa

SEQ ID NO: 1077282 - DNA, 15 bp, Homo sapiens
gaaaggctgtggcat

SEQ ID NO: 1077283 - DNA, 14 bp, Homo sapiens
gaaagggaggaaga

SEQ ID NO: 1077284 - DNA, 12 bp, Homo sapiens
gaaagggcactt

SEQ ID NO: 1077285 - DNA, 13 bp, Homo sapiens
gaaagggccagga

SEQ ID NO: 1077286 - DNA, 17 bp, Homo sapiens
gaaagggcccttcccct

SEQ ID NO: 1077287 - DNA, 22 bp, Homo sapiens
gaaagggcccttcccctccccc

SEQ ID NO: 1077288 - DNA, 22 bp, Homo sapiens
gaaagggcctggccagtcctgg

SEQ ID NO: 1077289 - DNA, 14 bp, Homo sapiens
gaaagggctggctc

SEQ ID NO: 1077290 - DNA, 15 bp, Homo sapiens
gaaaggggagagcct

SEQ ID NO: 1077291 - DNA, 23 bp, Homo sapiens
gaaagggggtcccagtgggaggg

SEQ ID NO: 1077292 - DNA, 14 bp, Homo sapiens
gaaaggggtgcttt

SEQ ID NO: 1077293 - DNA, 14 bp, Homo sapiens
gaaaggggttgggg

SEQ ID NO: 1077294 - DNA, 16 bp, Homo sapiens
gaaaggggttggggtg

SEQ ID NO: 1077295 - DNA, 21 bp, Homo sapiens
gaaaggggttggggtgacagt

SEQ ID NO: 1077296 - DNA, 23 bp, Homo sapiens
gaaagggtgtttttctgttttat

SEQ ID NO: 1077297 - DNA, 18 bp, Homo sapiens
gaaaggtactatatttgc

SEQ ID NO: 1077298 - DNA, 22 bp, Homo sapiens
gaaaggtctgaaatccagcatc

SEQ ID NO: 1077299 - DNA, 13 bp, Homo sapiens
gaaaggtgcagga

SEQ ID NO: 1077300 - DNA, 16 bp, Homo sapiens
gaaaggttaaaaaagc

SEQ ID NO: 1077301 - DNA, 14 bp, Homo sapiens
gaaaggtttacatt

SEQ ID NO: 1077302 - DNA, 17 bp, Homo sapiens
gaaagtacactctgctg

SEQ ID NO: 1077303 - DNA, 18 bp, Homo sapiens
gaaagtacactctgctgt

SEQ ID NO: 1077304 - DNA, 20 bp, Homo sapiens
gaaagtacactctgctgttt

SEQ ID NO: 1077305 - DNA, 22 bp, Homo sapiens
gaaagtaccctcttttaccaac

SEQ ID NO: 1077306 - DNA, 15 bp, Homo sapiens
gaaagtattcagaaa

SEQ ID NO: 1077307 - DNA, 18 bp, Homo sapiens
gaaagtattcagaaatta

SEQ ID NO: 1077308 - DNA, 23 bp, Homo sapiens
gaaagtattcagaaattaaaata

SEQ ID NO: 1077309 - DNA, 17 bp, Homo sapiens
gaaagtcaaaaaattat

SEQ ID NO: 1077310 - DNA, 15 bp, Homo sapiens
gaaagtcaccaggac

SEQ ID NO: 1077311 - DNA, 17 bp, Homo sapiens
gaaagtcaccaggactt

SEQ ID NO: 1077312 - DNA, 18 bp, Homo sapiens
gaaagtcacccaaacact

SEQ ID NO: 1077313 - DNA, 20 bp, Homo sapiens
gaaagtcagatgcccagagg

SEQ ID NO: 1077314 - DNA, 20 bp, Homo sapiens
gaaagtcagccatatctcca

SEQ ID NO: 1077315 - DNA, 14 bp, Homo sapiens
gaaagtcctgaact

SEQ ID NO: 1077316 - DNA, 22 bp, Homo sapiens
gaaagtctgtcaggtttggttt

SEQ ID NO: 1077317 - DNA, 14 bp, Homo sapiens
gaaagtctgtcctt

SEQ ID NO: 1077318 - DNA, 23 bp, Homo sapiens
gaaagtgaatttgaatgaaaaat

SEQ ID NO: 1077319 - DNA, 22 bp, Homo sapiens
gaaagtgacatttgctttcggt

SEQ ID NO: 1077320 - DNA, 13 bp, Homo sapiens
gaaagtgcctgac

SEQ ID NO: 1077321 - DNA, 22 bp, Homo sapiens
gaaagtgcctttatctcagcca

SEQ ID NO: 1077322 - DNA, 21 bp, Homo sapiens
gaaagtgggaggtcaggaaac

SEQ ID NO: 1077323 - DNA, 21 bp, Homo sapiens
gaaagttgcaaggcaaatgtt

SEQ ID NO: 1077324 - DNA, 18 bp, Homo sapiens
gaaagttgtatccattaa

SEQ ID NO: 1077325 - DNA, 21 bp, Homo sapiens
gaaagttttccagtattgaaa

SEQ ID NO: 1077326 - DNA, 21 bp, Homo sapiens
gaaataaaaaaaaaaggatga

SEQ ID NO: 1077327 - DNA, 20 bp, Homo sapiens
gaaataaaaagtatgttgta

SEQ ID NO: 1077328 - DNA, 18 bp, Homo sapiens
gaaataaaaggaagccaa

SEQ ID NO: 1077329 - DNA, 14 bp, Homo sapiens
gaaataaaatttga

SEQ ID NO: 1077330 - DNA, 13 bp, Homo sapiens
gaaataaacatta

SEQ ID NO: 1077331 - DNA, 17 bp, Homo sapiens
gaaataaacctgcactg

SEQ ID NO: 1077332 - DNA, 18 bp, Homo sapiens
gaaataaaggtaaaatca

SEQ ID NO: 1077333 - DNA, 14 bp, Homo sapiens
gaaataaagtcaga

SEQ ID NO: 1077334 - DNA, 19 bp, Homo sapiens
gaaataaagtcagatggaa

SEQ ID NO: 1077335 - DNA, 17 bp, Homo sapiens
gaaataaagtttgctta

SEQ ID NO: 1077336 - DNA, 14 bp, Homo sapiens
gaaataaatagcta

SEQ ID NO: 1077337 - DNA, 23 bp, Homo sapiens
gaaataaatagctatatccatgt

SEQ ID NO: 1077338 - DNA, 12 bp, Homo sapiens
gaaataaatgta

SEQ ID NO: 1077339 - DNA, 21 bp, Homo sapiens
gaaataaatgtatcatagaaa

SEQ ID NO: 1077340 - DNA, 12 bp, Homo sapiens
gaaataaatgtt

SEQ ID NO: 1077341 - DNA, 14 bp, Homo sapiens
gaaataaatgtttc

SEQ ID NO: 1077342 - DNA, 16 bp, Homo sapiens
gaaataaatgtttcaa

SEQ ID NO: 1077343 - DNA, 18 bp, Homo sapiens
gaaataaattttgtttca

SEQ ID NO: 1077344 - DNA, 18 bp, Homo sapiens
gaaataacaagtcgatga

SEQ ID NO: 1077345 - DNA, 17 bp, Homo sapiens
gaaataacagaagaaaa

SEQ ID NO: 1077346 - DNA, 14 bp, Homo sapiens
gaaataagaaaaat

SEQ ID NO: 1077347 - DNA, 18 bp, Homo sapiens
gaaataagaaaaatcatg

SEQ ID NO: 1077348 - DNA, 20 bp, Homo sapiens
gaaataataaaatgcaaatg

SEQ ID NO: 1077349 - DNA, 13 bp, Homo sapiens
gaaataataaatc

SEQ ID NO: 1077350 - DNA, 14 bp, Homo sapiens
gaaataatatgcat

SEQ ID NO: 1077351 - DNA, 15 bp, Homo sapiens
gaaataattgttgtt

SEQ ID NO: 1077352 - DNA, 17 bp, Homo sapiens
gaaataatttgaatgta

SEQ ID NO: 1077353 - DNA, 14 bp, Homo sapiens
gaaataatttttaa

SEQ ID NO: 1077354 - DNA, 21 bp, Homo sapiens
gaaatacaattctacattgtc

SEQ ID NO: 1077355 - DNA, 19 bp, Homo sapiens
gaaatacacaagtaaacat

SEQ ID NO: 1077356 - DNA, 17 bp, Homo sapiens
gaaatacagactggatg

SEQ ID NO: 1077357 - DNA, 16 bp, Homo sapiens
gaaatacagctggcta

SEQ ID NO: 1077358 - DNA, 19 bp, Homo sapiens
gaaatacagttctgctctg

SEQ ID NO: 1077359 - DNA, 16 bp, Homo sapiens
gaaatactacttacca

SEQ ID NO: 1077360 - DNA, 21 bp, Homo sapiens
gaaatactacttaccatatgt

SEQ ID NO: 1077361 - DNA, 13 bp, Homo sapiens
gaaatactcatgt

SEQ ID NO: 1077362 - DNA, 23 bp, Homo sapiens
gaaatactgagatgctgggctgt

SEQ ID NO: 1077363 - DNA, 14 bp, Homo sapiens
gaaatactgctctg

SEQ ID NO: 1077364 - DNA, 16 bp, Homo sapiens
gaaatactgctctgaa

SEQ ID NO: 1077365 - DNA, 12 bp, Homo sapiens
gaaatacttttt

SEQ ID NO: 1077366 - DNA, 17 bp, Homo sapiens
gaaatagaaagaagcca

SEQ ID NO: 1077367 - DNA, 18 bp, Homo sapiens
gaaatagaaagaagccat

SEQ ID NO: 1077368 - DNA, 20 bp, Homo sapiens
gaaatagaaatttccagaga

SEQ ID NO: 1077369 - DNA, 13 bp, Homo sapiens
gaaatagacaaaa

SEQ ID NO: 1077370 - DNA, 19 bp, Homo sapiens
gaaatagacaaaaagtata

SEQ ID NO: 1077371 - DNA, 14 bp, Homo sapiens
gaaatagcagagcc

SEQ ID NO: 1077372 - DNA, 21 bp, Homo sapiens
gaaatagcatgacaggctgtt

SEQ ID NO: 1077373 - DNA, 21 bp, Homo sapiens
gaaatagctgaaaagggcact

SEQ ID NO: 1077374 - DNA, 22 bp, Homo sapiens
gaaatagctttactgtttctca

SEQ ID NO: 1077375 - DNA, 15 bp, Homo sapiens
gaaatagtctgtgtg

SEQ ID NO: 1077376 - DNA, 17 bp, Homo sapiens
gaaatagtctgtgtgaa

SEQ ID NO: 1077377 - DNA, 22 bp, Homo sapiens
gaaatagtgtggaaattaagaa

SEQ ID NO: 1077378 - DNA, 23 bp, Homo sapiens
gaaatatacttttacaagtaaca

SEQ ID NO: 1077379 - DNA, 17 bp, Homo sapiens
gaaatataggaacttaa

SEQ ID NO: 1077380 - DNA, 14 bp, Homo sapiens
gaaatatatatgtg

SEQ ID NO: 1077381 - DNA, 18 bp, Homo sapiens
gaaatatatattgtaaag

SEQ ID NO: 1077382 - DNA, 20 bp, Homo sapiens
gaaatatatattgtaaagaa

SEQ ID NO: 1077383 - DNA, 13 bp, Homo sapiens
gaaatatatgtga

SEQ ID NO: 1077384 - DNA, 14 bp, Homo sapiens
gaaatatatgtgaa

SEQ ID NO: 1077385 - DNA, 21 bp, Homo sapiens
gaaatatcatcacgtatgtta

SEQ ID NO: 1077386 - DNA, 12 bp, Homo sapiens
gaaatatcattt

SEQ ID NO: 1077387 - DNA, 19 bp, Homo sapiens
gaaatatctgaaaatgtat

SEQ ID NO: 1077388 - DNA, 21 bp, Homo sapiens
gaaatatctgaaaatgtatgt

SEQ ID NO: 1077389 - DNA, 15 bp, Homo sapiens
gaaatatctgtgaaa

SEQ ID NO: 1077390 - DNA, 13 bp, Homo sapiens
gaaatatctttct

SEQ ID NO: 1077391 - DNA, 14 bp, Homo sapiens
gaaatatgaatgcc

SEQ ID NO: 1077392 - DNA, 11 bp, Homo sapiens
gaaatattaaa

SEQ ID NO: 1077393 - DNA, 15 bp, Homo sapiens
gaaatattcagaaat

SEQ ID NO: 1077394 - DNA, 15 bp, Homo sapiens
gaaatatttagcaaa

SEQ ID NO: 1077395 - DNA, 16 bp, Homo sapiens
gaaatcaaccctctcc

SEQ ID NO: 1077396 - DNA, 23 bp, Homo sapiens
gaaatcaagtcatctatagttga

SEQ ID NO: 1077397 - DNA, 15 bp, Homo sapiens
gaaatcacagaatca

SEQ ID NO: 1077398 - DNA, 15 bp, Homo sapiens
gaaatcacaggggcg

SEQ ID NO: 1077399 - DNA, 16 bp, Homo sapiens
gaaatcacagtcaatg

SEQ ID NO: 1077400 - DNA, 18 bp, Homo sapiens
gaaatcacagtcaatgga

SEQ ID NO: 1077401 - DNA, 13 bp, Homo sapiens
gaaatcactgtga

SEQ ID NO: 1077402 - DNA, 16 bp, Homo sapiens
gaaatcactgtgaaat

SEQ ID NO: 1077403 - DNA, 17 bp, Homo sapiens
gaaatcactgtgaaatt

SEQ ID NO: 1077404 - DNA, 15 bp, Homo sapiens
gaaatcagcatgaca

SEQ ID NO: 1077405 - DNA, 22 bp, Homo sapiens
gaaatcagcatgacaaaaataa

SEQ ID NO: 1077406 - DNA, 23 bp, Homo sapiens
gaaatcagcatgacaaaaataac

SEQ ID NO: 1077407 - DNA, 15 bp, Homo sapiens
gaaatcagccaagtt

SEQ ID NO: 1077408 - DNA, 16 bp, Homo sapiens
gaaatcagcccccagc

SEQ ID NO: 1077409 - DNA, 17 bp, Homo sapiens
gaaatcagcccccagcc

SEQ ID NO: 1077410 - DNA, 18 bp, Homo sapiens
gaaatcagcccccagcct

SEQ ID NO: 1077411 - DNA, 23 bp, Homo sapiens
gaaatcattgttataaagacaca

SEQ ID NO: 1077412 - DNA, 15 bp, Homo sapiens
gaaatccaaatttct

SEQ ID NO: 1077413 - DNA, 21 bp, Homo sapiens
gaaatccaaatttctcatgtt

SEQ ID NO: 1077414 - DNA, 19 bp, Homo sapiens
gaaatccagtttcccacca

SEQ ID NO: 1077415 - DNA, 18 bp, Homo sapiens
gaaatcccatctctacaa

SEQ ID NO: 1077416 - DNA, 22 bp, Homo sapiens
gaaatccctgtttaatatttaa

SEQ ID NO: 1077417 - DNA, 19 bp, Homo sapiens
gaaatctcacttttctcca

SEQ ID NO: 1077418 - DNA, 17 bp, Homo sapiens
gaaatctgctagaaagt

SEQ ID NO: 1077419 - DNA, 16 bp, Homo sapiens
gaaatctgtaaagcca

SEQ ID NO: 1077420 - DNA, 12 bp, Homo sapiens
gaaatctgtatt

SEQ ID NO: 1077421 - DNA, 13 bp, Homo sapiens
gaaatcttgtctt

SEQ ID NO: 1077422 - DNA, 21 bp, Homo sapiens
gaaatgaaatattgtttccaa

SEQ ID NO: 1077423 - DNA, 16 bp, Homo sapiens
gaaatgaacaaaagat

SEQ ID NO: 1077424 - DNA, 19 bp, Homo sapiens
gaaatgactaaaaaacaaa

SEQ ID NO: 1077425 - DNA, 22 bp, Homo sapiens
gaaatgagcacctccattaaag

SEQ ID NO: 1077426 - DNA, 23 bp, Homo sapiens
gaaatgaggtctgtttaaagtgg

SEQ ID NO: 1077427 - DNA, 15 bp, Homo sapiens
gaaatgagtggccag

SEQ ID NO: 1077428 - DNA, 16 bp, Homo sapiens
gaaatgataaagactt

SEQ ID NO: 1077429 - DNA, 18 bp, Homo sapiens
gaaatgatggaatttttc

SEQ ID NO: 1077430 - DNA, 21 bp, Homo sapiens
gaaatgattcaaattgctgct

SEQ ID NO: 1077431 - DNA, 14 bp, Homo sapiens
gaaatgcactgtat

SEQ ID NO: 1077432 - DNA, 12 bp, Homo sapiens
gaaatgcagaaa

SEQ ID NO: 1077433 - DNA, 15 bp, Homo sapiens
gaaatgcagaaatca

SEQ ID NO: 1077434 - DNA, 21 bp, Homo sapiens
gaaatgcattttattctttaa

SEQ ID NO: 1077435 - DNA, 21 bp, Homo sapiens
gaaatgctattgttgtgggct

SEQ ID NO: 1077436 - DNA, 13 bp, Homo sapiens
gaaatgctgcctg

SEQ ID NO: 1077437 - DNA, 13 bp, Homo sapiens
gaaatgctgctgg

SEQ ID NO: 1077438 - DNA, 17 bp, Homo sapiens
gaaatgctgctggccaa

SEQ ID NO: 1077439 - DNA, 22 bp, Homo sapiens
gaaatgcttgtggattgagggt

SEQ ID NO: 1077440 - DNA, 16 bp, Homo sapiens
gaaatgcttttatatt

SEQ ID NO: 1077441 - DNA, 21 bp, Homo sapiens
gaaatgcttttatattctaat

SEQ ID NO: 1077442 - DNA, 19 bp, Homo sapiens
gaaatggaatgtgcccctg

SEQ ID NO: 1077443 - DNA, 21 bp, Homo sapiens
gaaatggatactacatcttta

SEQ ID NO: 1077444 - DNA, 17 bp, Homo sapiens
gaaatggcgtctgctct

SEQ ID NO: 1077445 - DNA, 18 bp, Homo sapiens
gaaatggctatgaacaga

SEQ ID NO: 1077446 - DNA, 18 bp, Homo sapiens
gaaatggcttgaagccaa

SEQ ID NO: 1077447 - DNA, 16 bp, Homo sapiens
gaaatgggcatttatt

SEQ ID NO: 1077448 - DNA, 17 bp, Homo sapiens
gaaatgggcctgcctgc

SEQ ID NO: 1077449 - DNA, 18 bp, Homo sapiens
gaaatgggcctgcctgcc

SEQ ID NO: 1077450 - DNA, 16 bp, Homo sapiens
gaaatgtaaactgcca

SEQ ID NO: 1077451 - DNA, 15 bp, Homo sapiens
gaaatgtaaatgtta

SEQ ID NO: 1077452 - DNA, 12 bp, Homo sapiens
gaaatgtaacat

SEQ ID NO: 1077453 - DNA, 18 bp, Homo sapiens
gaaatgtaacatgaagca

SEQ ID NO: 1077454 - DNA, 18 bp, Homo sapiens
gaaatgtaatactggaat

SEQ ID NO: 1077455 - DNA, 20 bp, Homo sapiens
gaaatgtacactaccaaaca

SEQ ID NO: 1077456 - DNA, 22 bp, Homo sapiens
gaaatgtacactaccaaacact

SEQ ID NO: 1077457 - DNA, 17 bp, Homo sapiens
gaaatgtacagcaagga

SEQ ID NO: 1077458 - DNA, 14 bp, Homo sapiens
gaaatgtacttttg

SEQ ID NO: 1077459 - DNA, 17 bp, Homo sapiens
gaaatgtacttttggat

SEQ ID NO: 1077460 - DNA, 22 bp, Homo sapiens
gaaatgtagaattgaaaatgca

SEQ ID NO: 1077461 - DNA, 15 bp, Homo sapiens
gaaatgtcctgcatg

SEQ ID NO: 1077462 - DNA, 14 bp, Homo sapiens
gaaatgtctctgct

SEQ ID NO: 1077463 - DNA, 14 bp, Homo sapiens
gaaatgtgagaaat

SEQ ID NO: 1077464 - DNA, 16 bp, Homo sapiens
gaaatgtgagaaatgt

SEQ ID NO: 1077465 - DNA, 23 bp, Homo sapiens
gaaatgtggtagcctcactttta

SEQ ID NO: 1077466 - DNA, 16 bp, Homo sapiens
gaaatgtggttttcct

SEQ ID NO: 1077467 - DNA, 13 bp, Homo sapiens
gaaattaaaatat

SEQ ID NO: 1077468 - DNA, 14 bp, Homo sapiens
gaaattaaaatatt

SEQ ID NO: 1077469 - DNA, 22 bp, Homo sapiens
gaaattaaaatattatttgata

SEQ ID NO: 1077470 - DNA, 23 bp, Homo sapiens
gaaattaaaatattatttgatat

SEQ ID NO: 1077471 - DNA, 17 bp, Homo sapiens
gaacagtttcatcagga

SEQ ID NO: 1077472 - DNA, 15 bp, Homo sapiens
gaacataaagcaaat

SEQ ID NO: 1077473 - DNA, 22 bp, Homo sapiens
gaacataaagcaaatagacaca

SEQ ID NO: 1077474 - DNA, 15 bp, Homo sapiens
gaacatacagacaca

SEQ ID NO: 1077475 - DNA, 17 bp, Homo sapiens
gaacatactgattggga

SEQ ID NO: 1077476 - DNA, 15 bp, Homo sapiens
gaacatacttcaaaa

SEQ ID NO: 1077477 - DNA, 12 bp, Homo sapiens
gaacatattgtt

SEQ ID NO: 1077478 - DNA, 23 bp, Homo sapiens
gaacatcaccgacgcgtctcctg

SEQ ID NO: 1077479 - DNA, 19 bp, Homo sapiens
gaacatccaaaatcttgat

SEQ ID NO: 1077480 - DNA, 17 bp, Homo sapiens
gaacatccaaccttccc

SEQ ID NO: 1077481 - DNA, 12 bp, Homo sapiens
gaacatccaagg

SEQ ID NO: 1077482 - DNA, 23 bp, Homo sapiens
gaacatccaaggagaaacagaga

SEQ ID NO: 1077483 - DNA, 17 bp, Homo sapiens
gaacatccctgggcaag

SEQ ID NO: 1077484 - DNA, 21 bp, Homo sapiens
gaacatcccttattagttaca

SEQ ID NO: 1077485 - DNA, 19 bp, Homo sapiens
gaacatccttccttcccac

SEQ ID NO: 1077486 - DNA, 19 bp, Homo sapiens
gaacatctaacccactaga

SEQ ID NO: 1077487 - DNA, 18 bp, Homo sapiens
gaacatctgagtcctgga

SEQ ID NO: 1077488 - DNA, 14 bp, Homo sapiens
gaacatgacccagc

SEQ ID NO: 1077489 - DNA, 17 bp, Homo sapiens
gaacatgacccagcctg

SEQ ID NO: 1077490 - DNA, 18 bp, Homo sapiens
gaacatgacccagcctga

SEQ ID NO: 1077491 - DNA, 15 bp, Homo sapiens
gaacatgattttaca

SEQ ID NO: 1077492 - DNA, 16 bp, Homo sapiens
gaacatgcacatttat

SEQ ID NO: 1077493 - DNA, 18 bp, Homo sapiens
gaacatgcacatttatat

SEQ ID NO: 1077494 - DNA, 23 bp, Homo sapiens
gaacatgcagttcattattttgt

SEQ ID NO: 1077495 - DNA, 14 bp, Homo sapiens
gaacatgcctgcca

SEQ ID NO: 1077496 - DNA, 22 bp, Homo sapiens
gaacatgtcctaattcttctgt

SEQ ID NO: 1077497 - DNA, 18 bp, Homo sapiens
gaacatgtgccttttctg

SEQ ID NO: 1077498 - DNA, 21 bp, Homo sapiens
gaacatgtgttttcatcattt

SEQ ID NO: 1077499 - DNA, 22 bp, Homo sapiens
gaacatgtgttttcatcatttc

SEQ ID NO: 1077500 - DNA, 23 bp, Homo sapiens
gaacatgtgttttcatcatttca

SEQ ID NO: 1077501 - DNA, 22 bp, Homo sapiens
gaacatgtttacaggtttgaat

SEQ ID NO: 1077502 - DNA, 13 bp, Homo sapiens
gaacattaaaata

SEQ ID NO: 1077503 - DNA, 21 bp, Homo sapiens
gaacattaaaatatagagaca

SEQ ID NO: 1077504 - DNA, 21 bp, Homo sapiens
gaacattaggaattgtttata

SEQ ID NO: 1077505 - DNA, 15 bp, Homo sapiens
gaacattcacttttg

SEQ ID NO: 1077506 - DNA, 19 bp, Homo sapiens
gaacattcgaggtgtcacc

SEQ ID NO: 1077507 - DNA, 21 bp, Homo sapiens
gaacattgcatataacttata

SEQ ID NO: 1077508 - DNA, 20 bp, Homo sapiens
gaacattggggattgaaaat

SEQ ID NO: 1077509 - DNA, 17 bp, Homo sapiens
gaacatttgatattttt

SEQ ID NO: 1077510 - DNA, 19 bp, Homo sapiens
gaacatttgatatttttcc

SEQ ID NO: 1077511 - DNA, 15 bp, Homo sapiens
gaacattttgtggag

SEQ ID NO: 1077512 - DNA, 13 bp, Homo sapiens
gaaccaaaaagag

SEQ ID NO: 1077513 - DNA, 20 bp, Homo sapiens
gaaccaaagagactggagca

SEQ ID NO: 1077514 - DNA, 21 bp, Homo sapiens
gaaccaaagagactggagcat

SEQ ID NO: 1077515 - DNA, 15 bp, Homo sapiens
gaaccaaagcctctt

SEQ ID NO: 1077516 - DNA, 24 bp, Homo sapiens
gaaccaacaacctcaactgcctac

SEQ ID NO: 1077517 - DNA, 16 bp, Homo sapiens
gaaccaagctattcct

SEQ ID NO: 1077518 - DNA, 17 bp, Homo sapiens
gaaccaaggcagcctcc

SEQ ID NO: 1077519 - DNA, 23 bp, Homo sapiens
gaaccaagtggaccttgagacca

SEQ ID NO: 1077520 - DNA, 14 bp, Homo sapiens
gaaccacaaaaaaa

SEQ ID NO: 1077521 - DNA, 22 bp, Homo sapiens
gaaccacaaaaaaaaaggctgg

SEQ ID NO: 1077522 - DNA, 18 bp, Homo sapiens
gaaccacaagtgaatctt

SEQ ID NO: 1077523 - DNA, 21 bp, Homo sapiens
gaaccacaagtgaatctttct

SEQ ID NO: 1077524 - DNA, 22 bp, Homo sapiens
gaaccaccagcgttcccttctc

SEQ ID NO: 1077525 - DNA, 15 bp, Homo sapiens
gaaccactcccacca

SEQ ID NO: 1077526 - DNA, 12 bp, Homo sapiens
gaaccactgctt

SEQ ID NO: 1077527 - DNA, 18 bp, Homo sapiens
gaaccactgcttctcttt

SEQ ID NO: 1077528 - DNA, 20 bp, Homo sapiens
gaaccactttcttatttttt

SEQ ID NO: 1077529 - DNA, 23 bp, Homo sapiens
gaaccagagccatggactctaca

SEQ ID NO: 1077530 - DNA, 22 bp, Homo sapiens
gaaccagcagaaatgcccccat

SEQ ID NO: 1077531 - DNA, 12 bp, Homo sapiens
gaaccagcccag

SEQ ID NO: 1077532 - DNA, 14 bp, Homo sapiens
gaaccagcccagcc

SEQ ID NO: 1077533 - DNA, 15 bp, Homo sapiens
gaaccagcccagcct

SEQ ID NO: 1077534 - DNA, 16 bp, Homo sapiens
gaaccagcccagcctg

SEQ ID NO: 1077535 - DNA, 17 bp, Homo sapiens
gaaccagccggggcctt

SEQ ID NO: 1077536 - DNA, 19 bp, Homo sapiens
gaaccagctcatctccaag

SEQ ID NO: 1077537 - DNA, 23 bp, Homo sapiens
gaaccaggagaagggctggggcc

SEQ ID NO: 1077538 - DNA, 16 bp, Homo sapiens
gaaccagggaggagag

SEQ ID NO: 1077539 - DNA, 17 bp, Homo sapiens
gaaccagttaagagaca

SEQ ID NO: 1077540 - DNA, 20 bp, Homo sapiens
gaaccatcattataaacgtg

SEQ ID NO: 1077541 - DNA, 18 bp, Homo sapiens
gaaccatggtgaagtgct

SEQ ID NO: 1077542 - DNA, 21 bp, Homo sapiens
gaaccatgtcagcaaaaagca

SEQ ID NO: 1077543 - DNA, 13 bp, Homo sapiens
gaaccattgttct

SEQ ID NO: 1077544 - DNA, 12 bp, Homo sapiens
gaacccacctgc

SEQ ID NO: 1077545 - DNA, 15 bp, Homo sapiens
gaacccagctgtgcc

SEQ ID NO: 1077546 - DNA, 20 bp, Homo sapiens
gaacccagctgtgcccctcc

SEQ ID NO: 1077547 - DNA, 13 bp, Homo sapiens
gaacccagggctc

SEQ ID NO: 1077548 - DNA, 20 bp, Homo sapiens
gaacccagggctctgcccca

SEQ ID NO: 1077549 - DNA, 18 bp, Homo sapiens
gaacccagggtggagagg

SEQ ID NO: 1077550 - DNA, 17 bp, Homo sapiens
gaactcctgccatagtc

SEQ ID NO: 1077551 - DNA, 14 bp, Homo sapiens
gaactcctggcctc

SEQ ID NO: 1077552 - DNA, 16 bp, Homo sapiens
gaactccttccccact

SEQ ID NO: 1077553 - DNA, 15 bp, Homo sapiens
gaactcgatgcactg

SEQ ID NO: 1077554 - DNA, 19 bp, Homo sapiens
gaactcgcgctcagtaaac

SEQ ID NO: 1077555 - DNA, 18 bp, Homo sapiens
gaactctaaaccttgtga

SEQ ID NO: 1077556 - DNA, 16 bp, Homo sapiens
gaactctccaaatatt

SEQ ID NO: 1077557 - DNA, 18 bp, Homo sapiens
gaactcttagaaatgaag

SEQ ID NO: 1077558 - DNA, 19 bp, Homo sapiens
gaactcttaggcacatcaa

SEQ ID NO: 1077559 - DNA, 23 bp, Homo sapiens
gaactcttcagaacacacagact

SEQ ID NO: 1077560 - DNA, 19 bp, Homo sapiens
gaactctttcaaattatat

SEQ ID NO: 1077561 - DNA, 22 bp, Homo sapiens
gaactctttctggcctgccttc

SEQ ID NO: 1077562 - DNA, 18 bp, Homo sapiens
gaactgaaacttttctaa

SEQ ID NO: 1077563 - DNA, 12 bp, Homo sapiens
gaactgaacacc

SEQ ID NO: 1077564 - DNA, 21 bp, Homo sapiens
gaactgaacaccattgaaggc

SEQ ID NO: 1077565 - DNA, 12 bp, Homo sapiens
gaactgaactca

SEQ ID NO: 1077566 - DNA, 17 bp, Homo sapiens
gaactgaagccacttgg

SEQ ID NO: 1077567 - DNA, 15 bp, Homo sapiens
gaactgactttctcc

SEQ ID NO: 1077568 - DNA, 17 bp, Homo sapiens
gaactgactttctcccc

SEQ ID NO: 1077569 - DNA, 15 bp, Homo sapiens
gaactgagaaggcag

SEQ ID NO: 1077570 - DNA, 19 bp, Homo sapiens
gaactgagaaggcaggcct

SEQ ID NO: 1077571 - DNA, 11 bp, Homo sapiens
gaactgaggcc

SEQ ID NO: 1077572 - DNA, 12 bp, Homo sapiens
gaactgaggccc

SEQ ID NO: 1077573 - DNA, 20 bp, Homo sapiens
gaactgatcatgtttatgag

SEQ ID NO: 1077574 - DNA, 14 bp, Homo sapiens
gaactgcaacactg

SEQ ID NO: 1077575 - DNA, 19 bp, Homo sapiens
gaactgcagacctcactgt

SEQ ID NO: 1077576 - DNA, 14 bp, Homo sapiens
gaactgcagatagc

SEQ ID NO: 1077577 - DNA, 20 bp, Homo sapiens
gaactgcagatagcccagga

SEQ ID NO: 1077578 - DNA, 21 bp, Homo sapiens
gaactgcagatagcccaggag

SEQ ID NO: 1077579 - DNA, 21 bp, Homo sapiens
gaactgcaggccctggcctcc

SEQ ID NO: 1077580 - DNA, 15 bp, Homo sapiens
gaactgcatggacct

SEQ ID NO: 1077581 - DNA, 23 bp, Homo sapiens
gaactgcatggacctaacattcg

SEQ ID NO: 1077582 - DNA, 18 bp, Homo sapiens
gaactgccattattttct

SEQ ID NO: 1077583 - DNA, 19 bp, Homo sapiens
gaactgccattattttctg

SEQ ID NO: 1077584 - DNA, 19 bp, Homo sapiens
gaactgcccttgctgcccg

SEQ ID NO: 1077585 - DNA, 16 bp, Homo sapiens
gaactgctttctttcg

SEQ ID NO: 1077586 - DNA, 16 bp, Homo sapiens
gaactggctgggcccc

SEQ ID NO: 1077587 - DNA, 20 bp, Homo sapiens
gaactggctgggcccctggg

SEQ ID NO: 1077588 - DNA, 22 bp, Homo sapiens
gaactggctgtgaagacccagg

SEQ ID NO: 1077589 - DNA, 21 bp, Homo sapiens
gaactgggctggcgcttggat

SEQ ID NO: 1077590 - DNA, 15 bp, Homo sapiens
gaactgggctgggcc

SEQ ID NO: 1077591 - DNA, 16 bp, Homo sapiens
gaactgtacattgtga

SEQ ID NO: 1077592 - DNA, 23 bp, Homo sapiens
gaactgtacattgtgagctctgg

SEQ ID NO: 1077593 - DNA, 21 bp, Homo sapiens
gaactgtattctagtggctgt

SEQ ID NO: 1077594 - DNA, 21 bp, Homo sapiens
gaactgtccacatctgcctcc

SEQ ID NO: 1077595 - DNA, 14 bp, Homo sapiens
gaactgtccggccc

SEQ ID NO: 1077596 - DNA, 18 bp, Homo sapiens
gaactgtgcatagtgctg

SEQ ID NO: 1077597 - DNA, 16 bp, Homo sapiens
gaactgtgccacaatg

SEQ ID NO: 1077598 - DNA, 14 bp, Homo sapiens
gaactgtggaattt

SEQ ID NO: 1077599 - DNA, 15 bp, Homo sapiens
gaactgtggaattta

SEQ ID NO: 1077600 - DNA, 18 bp, Homo sapiens
gaactgtgtgtaattgtt

SEQ ID NO: 1077601 - DNA, 20 bp, Homo sapiens
gaactgtgtttcaagttcaa

SEQ ID NO: 1077602 - DNA, 14 bp, Homo sapiens
gaactgttgtataa

SEQ ID NO: 1077603 - DNA, 15 bp, Homo sapiens
gaactgttgtataaa

SEQ ID NO: 1077604 - DNA, 16 bp, Homo sapiens
gaactgttgtataaat

SEQ ID NO: 1077605 - DNA, 21 bp, Homo sapiens
gaacttacacttggagcccgt

SEQ ID NO: 1077606 - DNA, 23 bp, Homo sapiens
gaacttacacttggagcccgtgc

SEQ ID NO: 1077607 - DNA, 21 bp, Homo sapiens
gaacttagatgttaaatgtta

SEQ ID NO: 1077608 - DNA, 16 bp, Homo sapiens
gaacttatgtacagaa

SEQ ID NO: 1077609 - DNA, 15 bp, Homo sapiens
gaacttattctgtag

SEQ ID NO: 1077610 - DNA, 18 bp, Homo sapiens
gaacttcagaaagacttg

SEQ ID NO: 1077611 - DNA, 23 bp, Homo sapiens
gaacttccaggtgttactgtaat

SEQ ID NO: 1077612 - DNA, 13 bp, Homo sapiens
gaacttctaatat

SEQ ID NO: 1077613 - DNA, 15 bp, Homo sapiens
gaacttctgcctcta

SEQ ID NO: 1077614 - DNA, 17 bp, Homo sapiens
gaacttgaaagttttct

SEQ ID NO: 1077615 - DNA, 21 bp, Homo sapiens
gaacttgaagggttactgacg

SEQ ID NO: 1077616 - DNA, 14 bp, Homo sapiens
gaacttgaatgtgt

SEQ ID NO: 1077617 - DNA, 15 bp, Homo sapiens
gaacttgactgggtg

SEQ ID NO: 1077618 - DNA, 15 bp, Homo sapiens
gaacttgagctctgt

SEQ ID NO: 1077619 - DNA, 13 bp, Homo sapiens
gaacttgattgcc

SEQ ID NO: 1077620 - DNA, 16 bp, Homo sapiens
gaacttgatttgcatg

SEQ ID NO: 1077621 - DNA, 17 bp, Homo sapiens
gaacttgatttgcatgg

SEQ ID NO: 1077622 - DNA, 18 bp, Homo sapiens
gaacttgatttgcatgga

SEQ ID NO: 1077623 - DNA, 21 bp, Homo sapiens
gaacttgcagctgatgttgga

SEQ ID NO: 1077624 - DNA, 23 bp, Homo sapiens
gaacttgcattgtgattggcctg

SEQ ID NO: 1077625 - DNA, 24 bp, Homo sapiens
gaacttgcgagaaattcgtgtgtt

SEQ ID NO: 1077626 - DNA, 15 bp, Homo sapiens
gaacttgctgctgtc

SEQ ID NO: 1077627 - DNA, 19 bp, Homo sapiens
gaacttggaaagaaatgcc

SEQ ID NO: 1077628 - DNA, 21 bp, Homo sapiens
gaacttggagagggggccgga

SEQ ID NO: 1077629 - DNA, 17 bp, Homo sapiens
gaacttgggccactgtg

SEQ ID NO: 1077630 - DNA, 20 bp, Homo sapiens
gaactttagtgaaacataat

SEQ ID NO: 1077631 - DNA, 23 bp, Homo sapiens
gaactttctcttcatactttttt

SEQ ID NO: 1077632 - DNA, 14 bp, Homo sapiens
gaacttttacagaa

SEQ ID NO: 1077633 - DNA, 20 bp, Homo sapiens
gaacttttacagaatgcatt

SEQ ID NO: 1077634 - DNA, 13 bp, Homo sapiens
gaacttttctctt

SEQ ID NO: 1077635 - DNA, 16 bp, Homo sapiens
gaacttttgtactgaa

SEQ ID NO: 1077636 - DNA, 15 bp, Homo sapiens
gaactttttttaagg

SEQ ID NO: 1077637 - DNA, 16 bp, Homo sapiens
gaagaaaaaaaataac

SEQ ID NO: 1077638 - DNA, 18 bp, Homo sapiens
gaagaaaaaaaataacac

SEQ ID NO: 1077639 - DNA, 14 bp, Homo sapiens
gaagaaaactatcc

SEQ ID NO: 1077640 - DNA, 22 bp, Homo sapiens
gaagaaaactatcctgcgggtt

SEQ ID NO: 1077641 - DNA, 13 bp, Homo sapiens
gaagaaaagaaaa

SEQ ID NO: 1077642 - DNA, 20 bp, Homo sapiens
gaagaaaagtgggccagtgt

SEQ ID NO: 1077643 - DNA, 15 bp, Homo sapiens
gaagaaaatagaatt

SEQ ID NO: 1077644 - DNA, 21 bp, Homo sapiens
gaagaaaatagaattgacatt

SEQ ID NO: 1077645 - DNA, 17 bp, Homo sapiens
gaagaaacactttctct

SEQ ID NO: 1077646 - DNA, 18 bp, Homo sapiens
gaagaaacactttctctt

SEQ ID NO: 1077647 - DNA, 20 bp, Homo sapiens
gaagaaactccgaagaaaag

SEQ ID NO: 1077648 - DNA, 12 bp, Homo sapiens
gaagaaagatgt

SEQ ID NO: 1077649 - DNA, 10 bp, Homo sapiens
gaagaaagcc

SEQ ID NO: 1077650 - DNA, 17 bp, Homo sapiens
gaagaaagggtgttttt

SEQ ID NO: 1077651 - DNA, 14 bp, Homo sapiens
gaagaaataaatga

SEQ ID NO: 1077652 - DNA, 16 bp, Homo sapiens
gaagaaataaatgaaa

SEQ ID NO: 1077653 - DNA, 13 bp, Homo sapiens
gaagaaatatgaa

SEQ ID NO: 1077654 - DNA, 15 bp, Homo sapiens
gaagaaatcacagaa

SEQ ID NO: 1077655 - DNA, 20 bp, Homo sapiens
gaagaaatctttctccctca

SEQ ID NO: 1077656 - DNA, 16 bp, Homo sapiens
gaagaaatgtcagatg

SEQ ID NO: 1077657 - DNA, 17 bp, Homo sapiens
gaagaaattcaggtaca

SEQ ID NO: 1077658 - DNA, 20 bp, Homo sapiens
gaagaaattcaggtacagaa

SEQ ID NO: 1077659 - DNA, 14 bp, Homo sapiens
gaagaacaaatcta

SEQ ID NO: 1077660 - DNA, 16 bp, Homo sapiens
gaagaacaagaaatgg

SEQ ID NO: 1077661 - DNA, 18 bp, Homo sapiens
gaagaacacagcatgtgc

SEQ ID NO: 1077662 - DNA, 21 bp, Homo sapiens
gaagaacacagcatgtgccaa

SEQ ID NO: 1077663 - DNA, 20 bp, Homo sapiens
gaatatatggcagagttgta

SEQ ID NO: 1077664 - DNA, 21 bp, Homo sapiens
gaatatcagaagtatatctgt

SEQ ID NO: 1077665 - DNA, 16 bp, Homo sapiens
gaatatccatgtactt

SEQ ID NO: 1077666 - DNA, 17 bp, Homo sapiens
gaatatctattaatata

SEQ ID NO: 1077667 - DNA, 20 bp, Homo sapiens
gacacacactcaccagtggc

SEQ ID NO: 1077668 - DNA, 17 bp, Homo sapiens
gacacacctcacgcagg

SEQ ID NO: 1077669 - DNA, 20 bp, Homo sapiens
gacacactaaactctggggc

SEQ ID NO: 1077670 - DNA, 15 bp, Homo sapiens
gacacactaaccaag

SEQ ID NO: 1077671 - DNA, 18 bp, Homo sapiens
gacacactaaccaagctg

SEQ ID NO: 1077672 - DNA, 17 bp, Homo sapiens
gacacactctcatgtcc

SEQ ID NO: 1077673 - DNA, 21 bp, Homo sapiens
gacacagaaaatgttgagaat

SEQ ID NO: 1077674 - DNA, 16 bp, Homo sapiens
gacacagacccaggac

SEQ ID NO: 1077675 - DNA, 17 bp, Homo sapiens
gacacagactggcaata

SEQ ID NO: 1077676 - DNA, 19 bp, Homo sapiens
gacacagactggcaataaa

SEQ ID NO: 1077677 - DNA, 21 bp, Homo sapiens
gacacagactggcaataaact

SEQ ID NO: 1077678 - DNA, 22 bp, Homo sapiens
gacacagactggcaataaactc

SEQ ID NO: 1077679 - DNA, 18 bp, Homo sapiens
gacacagaggctggcact

SEQ ID NO: 1077680 - DNA, 15 bp, Homo sapiens
gacacagattggcca

SEQ ID NO: 1077681 - DNA, 16 bp, Homo sapiens
gacacagatttttaca

SEQ ID NO: 1077682 - DNA, 13 bp, Homo sapiens
gacacagcacaag

SEQ ID NO: 1077683 - DNA, 22 bp, Homo sapiens
gacacagcagcttcaccagagc

SEQ ID NO: 1077684 - DNA, 14 bp, Homo sapiens
gacacagcagtatt

SEQ ID NO: 1077685 - DNA, 14 bp, Homo sapiens
gacacagcagtgag

SEQ ID NO: 1077686 - DNA, 13 bp, Homo sapiens
gacacaggaaaaa

SEQ ID NO: 1077687 - DNA, 20 bp, Homo sapiens
gacacagggacttgaagttg

SEQ ID NO: 1077688 - DNA, 12 bp, Homo sapiens
gacacaggtcag

SEQ ID NO: 1077689 - DNA, 13 bp, Homo sapiens
gacacaggtcagg

SEQ ID NO: 1077690 - DNA, 17 bp, Homo sapiens
gacacaggtctttccta

SEQ ID NO: 1077691 - DNA, 14 bp, Homo sapiens
gacacagttcctgg

SEQ ID NO: 1077692 - DNA, 15 bp, Homo sapiens
gacacagttcctggg

SEQ ID NO: 1077693 - DNA, 16 bp, Homo sapiens
gacacagttcctggga

SEQ ID NO: 1077694 - DNA, 15 bp, Homo sapiens
gacacatatgagggg

SEQ ID NO: 1077695 - DNA, 22 bp, Homo sapiens
gacacatcaagcttttctgtag

SEQ ID NO: 1077696 - DNA, 22 bp, Homo sapiens
gacacatccccttagaggacct

SEQ ID NO: 1077697 - DNA, 19 bp, Homo sapiens
gacacatgaaggtaaataa

SEQ ID NO: 1077698 - DNA, 19 bp, Homo sapiens
gacacatgcaaggtcattt

SEQ ID NO: 1077699 - DNA, 12 bp, Homo sapiens
gacacatgcccc

SEQ ID NO: 1077700 - DNA, 14 bp, Homo sapiens
gacacatgcccctc

SEQ ID NO: 1077701 - DNA, 17 bp, Homo sapiens
gacacatgcccctcccc

SEQ ID NO: 1077702 - DNA, 19 bp, Homo sapiens
gacacatgcccctccccca

SEQ ID NO: 1077703 - DNA, 14 bp, Homo sapiens
gacacatgctatgt

SEQ ID NO: 1077704 - DNA, 15 bp, Homo sapiens
gacacatgctatgtt

SEQ ID NO: 1077705 - DNA, 19 bp, Homo sapiens
gacacatgctatgttctgt

SEQ ID NO: 1077706 - DNA, 21 bp, Homo sapiens
gacacattgactcctttccaa

SEQ ID NO: 1077707 - DNA, 21 bp, Homo sapiens
gacacattgccttctggagct

SEQ ID NO: 1077708 - DNA, 20 bp, Homo sapiens
gacacattggaatgccttgg

SEQ ID NO: 1077709 - DNA, 13 bp, Homo sapiens
gacaccaataaat

SEQ ID NO: 1077710 - DNA, 16 bp, Homo sapiens
gacaccaataaatgtt

SEQ ID NO: 1077711 - DNA, 17 bp, Homo sapiens
gacaccaataaatgttt

SEQ ID NO: 1077712 - DNA, 18 bp, Homo sapiens
gacaccaataaatgtttg

SEQ ID NO: 1077713 - DNA, 22 bp, Homo sapiens
gacaccatcttttgtgagatgt

SEQ ID NO: 1077714 - DNA, 23 bp, Homo sapiens
gacaccattaccaaaataataaa

SEQ ID NO: 1077715 - DNA, 12 bp, Homo sapiens
gacacccccagc

SEQ ID NO: 1077716 - DNA, 21 bp, Homo sapiens
gacaccccctccccgcccctg

SEQ ID NO: 1077717 - DNA, 14 bp, Homo sapiens
gacacccctgctct

SEQ ID NO: 1077718 - DNA, 17 bp, Homo sapiens
gacaccccttatccagg

SEQ ID NO: 1077719 - DNA, 20 bp, Homo sapiens
gacaccccttatccaggact

SEQ ID NO: 1077720 - DNA, 16 bp, Homo sapiens
gacaccccttcctgct

SEQ ID NO: 1077721 - DNA, 16 bp, Homo sapiens
gacaccgctcagtatt

SEQ ID NO: 1077722 - DNA, 18 bp, Homo sapiens
gacaccgctcagtattac

SEQ ID NO: 1077723 - DNA, 22 bp, Homo sapiens
gacaccgggccagtatctatat

SEQ ID NO: 1077724 - DNA, 16 bp, Homo sapiens
gacaccgtcgaccagg

SEQ ID NO: 1077725 - DNA, 15 bp, Homo sapiens
gacaccgtggcctgg

SEQ ID NO: 1077726 - DNA, 16 bp, Homo sapiens
gacaccgtggcctggg

SEQ ID NO: 1077727 - DNA, 17 bp, Homo sapiens
gacaccgtggggaaggg

SEQ ID NO: 1077728 - DNA, 22 bp, Homo sapiens
gacaccgtggggaaggggtgca

SEQ ID NO: 1077729 - DNA, 15 bp, Homo sapiens
gacacctaccatgct

SEQ ID NO: 1077730 - DNA, 17 bp, Homo sapiens
gacacctcagtcatatt

SEQ ID NO: 1077731 - DNA, 16 bp, Homo sapiens
gacacctcccagggga

SEQ ID NO: 1077732 - DNA, 15 bp, Homo sapiens
gacacctccccctac

SEQ ID NO: 1077733 - DNA, 19 bp, Homo sapiens
gacacctccccctacccat

SEQ ID NO: 1077734 - DNA, 20 bp, Homo sapiens
gacacctccgagaggcagcc

SEQ ID NO: 1077735 - DNA, 20 bp, Homo sapiens
gacacctgcacctcccccca

SEQ ID NO: 1077736 - DNA, 12 bp, Homo sapiens
gacacctgggag

SEQ ID NO: 1077737 - DNA, 18 bp, Homo sapiens
gacaccttagagaagcta

SEQ ID NO: 1077738 - DNA, 21 bp, Homo sapiens
gacaccttctgagtattctca

SEQ ID NO: 1077739 - DNA, 14 bp, Homo sapiens
gacaccttggacat

SEQ ID NO: 1077740 - DNA, 14 bp, Homo sapiens
gacacgagccacaa

SEQ ID NO: 1077741 - DNA, 20 bp, Homo sapiens
gacacgagccacaagctgca

SEQ ID NO: 1077742 - DNA, 14 bp, Homo sapiens
gacacgcacggcag

SEQ ID NO: 1077743 - DNA, 19 bp, Homo sapiens
gacacgcacggcagccaca

SEQ ID NO: 1077744 - DNA, 14 bp, Homo sapiens
gacacgcgctctcc

SEQ ID NO: 1077745 - DNA, 22 bp, Homo sapiens
gacacgcgctctccaccaccca

SEQ ID NO: 1077746 - DNA, 23 bp, Homo sapiens
gacacgctcttctattttattcc

SEQ ID NO: 1077747 - DNA, 15 bp, Homo sapiens
gacacggggcagtgg

SEQ ID NO: 1077748 - DNA, 17 bp, Homo sapiens
gacactaaatgcagaca

SEQ ID NO: 1077749 - DNA, 15 bp, Homo sapiens
gacactacacccagc

SEQ ID NO: 1077750 - DNA, 16 bp, Homo sapiens
gacactacatatctaa

SEQ ID NO: 1077751 - DNA, 12 bp, Homo sapiens
gacactcagggc

SEQ ID NO: 1077752 - DNA, 15 bp, Homo sapiens
gacactcagggcagc

SEQ ID NO: 1077753 - DNA, 15 bp, Homo sapiens
gacactccagggaca

SEQ ID NO: 1077754 - DNA, 14 bp, Homo sapiens
gacactccagtgcc

SEQ ID NO: 1077755 - DNA, 19 bp, Homo sapiens
gacactccagtgccagcaa

SEQ ID NO: 1077756 - DNA, 22 bp, Homo sapiens
gacactctagtgacttcctggt

SEQ ID NO: 1077757 - DNA, 20 bp, Homo sapiens
gacactctataagattccaa

SEQ ID NO: 1077758 - DNA, 17 bp, Homo sapiens
gacactctatatgtagt

SEQ ID NO: 1077759 - DNA, 12 bp, Homo sapiens
gacactctgctc

SEQ ID NO: 1077760 - DNA, 13 bp, Homo sapiens
gacactctgctct

SEQ ID NO: 1077761 - DNA, 13 bp, Homo sapiens
gacactgaaataa

SEQ ID NO: 1077762 - DNA, 22 bp, Homo sapiens
gacactgagccccacctctcca

SEQ ID NO: 1077763 - DNA, 19 bp, Homo sapiens
gacactgagcttctgagac

SEQ ID NO: 1077764 - DNA, 14 bp, Homo sapiens
gacactgccaagag

SEQ ID NO: 1077765 - DNA, 16 bp, Homo sapiens
gacactgccacacagg

SEQ ID NO: 1077766 - DNA, 18 bp, Homo sapiens
gacactgccttagcctct

SEQ ID NO: 1077767 - DNA, 16 bp, Homo sapiens
gacactgctgcaccag

SEQ ID NO: 1077768 - DNA, 19 bp, Homo sapiens
gacactgctgcaccagagt

SEQ ID NO: 1077769 - DNA, 19 bp, Homo sapiens
gacactggacatggcccat

SEQ ID NO: 1077770 - DNA, 14 bp, Homo sapiens
gacactggccccac

SEQ ID NO: 1077771 - DNA, 13 bp, Homo sapiens
gacactggcccct

SEQ ID NO: 1077772 - DNA, 17 bp, Homo sapiens
gacactgggcagcaagg

SEQ ID NO: 1077773 - DNA, 23 bp, Homo sapiens
gacactggtttacactttatgcc

SEQ ID NO: 1077774 - DNA, 23 bp, Homo sapiens
gacactgtgagagttgtctctgt

SEQ ID NO: 1077775 - DNA, 20 bp, Homo sapiens
gacactgtgcccagcccgga

SEQ ID NO: 1077776 - DNA, 14 bp, Homo sapiens
gacactgttgcaaa

SEQ ID NO: 1077777 - DNA, 15 bp, Homo sapiens
gacacttcagagagc

SEQ ID NO: 1077778 - DNA, 14 bp, Homo sapiens
gacacttcagatct

SEQ ID NO: 1077779 - DNA, 18 bp, Homo sapiens
gacacttcagatctgagg

SEQ ID NO: 1077780 - DNA, 17 bp, Homo sapiens
gacacttccccttgtct

SEQ ID NO: 1077781 - DNA, 21 bp, Homo sapiens
gacacttccccttgtctccct

SEQ ID NO: 1077782 - DNA, 17 bp, Homo sapiens
gacacttccctgggcct

SEQ ID NO: 1077783 - DNA, 13 bp, Homo sapiens
gacaggagcctgg

SEQ ID NO: 1077784 - DNA, 20 bp, Homo sapiens
gacaggagggcaagggccat

SEQ ID NO: 1077785 - DNA, 18 bp, Homo sapiens
gacaggataataaaacat

SEQ ID NO: 1077786 - DNA, 23 bp, Homo sapiens
gacaggatgggggctggcctctg

SEQ ID NO: 1077787 - DNA, 22 bp, Homo sapiens
gacaggcactccaaacctgtct

SEQ ID NO: 1077788 - DNA, 18 bp, Homo sapiens
gacaggcagcccagcagt

SEQ ID NO: 1077789 - DNA, 15 bp, Homo sapiens
gacaggcagcctgga

SEQ ID NO: 1077790 - DNA, 23 bp, Homo sapiens
gacaggcaggccagatggcccct

SEQ ID NO: 1077791 - DNA, 15 bp, Homo sapiens
gacaggcagggaggg

SEQ ID NO: 1077792 - DNA, 11 bp, Homo sapiens
gacaggcccaa

SEQ ID NO: 1077793 - DNA, 15 bp, Homo sapiens
gacaggcccaagaga

SEQ ID NO: 1077794 - DNA, 19 bp, Homo sapiens
gacaggccctccctgtctc

SEQ ID NO: 1077795 - DNA, 11 bp, Homo sapiens
gacaggcctca

SEQ ID NO: 1077796 - DNA, 19 bp, Homo sapiens
gacaggcctcacctctacc

SEQ ID NO: 1077797 - DNA, 13 bp, Homo sapiens
gacaggctcttag

SEQ ID NO: 1077798 - DNA, 17 bp, Homo sapiens
gacaggctcttagcagc

SEQ ID NO: 1077799 - DNA, 19 bp, Homo sapiens
gacaggctgaagagaggga

SEQ ID NO: 1077800 - DNA, 14 bp, Homo sapiens
gacaggctggcatt

SEQ ID NO: 1077801 - DNA, 14 bp, Homo sapiens
gacaggctggctcc

SEQ ID NO: 1077802 - DNA, 21 bp, Homo sapiens
gacaggctggctccagatgca

SEQ ID NO: 1077803 - DNA, 18 bp, Homo sapiens
gacagggaatgctgaggc

SEQ ID NO: 1077804 - DNA, 23 bp, Homo sapiens
gacagggaatgctgaggcctcga

SEQ ID NO: 1077805 - DNA, 21 bp, Homo sapiens
gacagggacatgccctgtgtg

SEQ ID NO: 1077806 - DNA, 20 bp, Homo sapiens
gacagggagggccggcggct

SEQ ID NO: 1077807 - DNA, 19 bp, Homo sapiens
gacagggagggggacctgt

SEQ ID NO: 1077808 - DNA, 22 bp, Homo sapiens
gacagggagggggacctgtccc

SEQ ID NO: 1077809 - DNA, 23 bp, Homo sapiens
gacagggagggggacctgtcccc

SEQ ID NO: 1077810 - DNA, 15 bp, Homo sapiens
gacagggatgccaac

SEQ ID NO: 1077811 - DNA, 12 bp, Homo sapiens
gacagggcagag

SEQ ID NO: 1077812 - DNA, 18 bp, Homo sapiens
gacagggcaggcgggccc

SEQ ID NO: 1077813 - DNA, 20 bp, Homo sapiens
gacagggcatggccaggtgg

SEQ ID NO: 1077814 - DNA, 10 bp, Homo sapiens
gacagggcca

SEQ ID NO: 1077815 - DNA, 11 bp, Homo sapiens
gacagggccag

SEQ ID NO: 1077816 - DNA, 12 bp, Homo sapiens
gacagggccagt

SEQ ID NO: 1077817 - DNA, 16 bp, Homo sapiens
gacagggcctggagcc

SEQ ID NO: 1077818 - DNA, 15 bp, Homo sapiens
gacagggctgagcgt

SEQ ID NO: 1077819 - DNA, 17 bp, Homo sapiens
gacagggctgagcgtgg

SEQ ID NO: 1077820 - DNA, 12 bp, Homo sapiens
gacagggggtgg

SEQ ID NO: 1077821 - DNA, 13 bp, Homo sapiens
gacagggggtggg

SEQ ID NO: 1077822 - DNA, 14 bp, Homo sapiens
gacagggggtggga

SEQ ID NO: 1077823 - DNA, 23 bp, Homo sapiens
gacagggggtgggaaggggatgg

SEQ ID NO: 1077824 - DNA, 15 bp, Homo sapiens
gacagggtctcactc

SEQ ID NO: 1077825 - DNA, 20 bp, Homo sapiens
gacagggtcttgctctgtcc

SEQ ID NO: 1077826 - DNA, 22 bp, Homo sapiens
gacagggtgctgatgggaagga

SEQ ID NO: 1077827 - DNA, 21 bp, Homo sapiens
gacagggtgggcttcctgccc

SEQ ID NO: 1077828 - DNA, 17 bp, Homo sapiens
gacagggtttcaccatg

SEQ ID NO: 1077829 - DNA, 21 bp, Homo sapiens
gacagggtttggctgtgtcta

SEQ ID NO: 1077830 - DNA, 15 bp, Homo sapiens
gacaggtctagactt

SEQ ID NO: 1077831 - DNA, 19 bp, Homo sapiens
gacaggtgatgctctggct

SEQ ID NO: 1077832 - DNA, 14 bp, Homo sapiens
gacaggtgggcctg

SEQ ID NO: 1077833 - DNA, 17 bp, Homo sapiens
gacaggtgggcctggcg

SEQ ID NO: 1077834 - DNA, 18 bp, Homo sapiens
gacaggtgggcctggcgg

SEQ ID NO: 1077835 - DNA, 22 bp, Homo sapiens
gacaggtgggcctggcggcctg

SEQ ID NO: 1077836 - DNA, 12 bp, Homo sapiens
gacaggtggggc

SEQ ID NO: 1077837 - DNA, 15 bp, Homo sapiens
gacaggtggggcctc

SEQ ID NO: 1077838 - DNA, 15 bp, Homo sapiens
gacaggtgtgagcca

SEQ ID NO: 1077839 - DNA, 16 bp, Homo sapiens
gacaggtgtgagccac

SEQ ID NO: 1077840 - DNA, 20 bp, Homo sapiens
gacaggtgtgagccactgcg

SEQ ID NO: 1077841 - DNA, 19 bp, Homo sapiens
gacagtatatttgaaactg

SEQ ID NO: 1077842 - DNA, 15 bp, Homo sapiens
gacagtatcccacat

SEQ ID NO: 1077843 - DNA, 21 bp, Homo sapiens
gacagtatgagtcaatgtgca

SEQ ID NO: 1077844 - DNA, 14 bp, Homo sapiens
gacagtattaaggg

SEQ ID NO: 1077845 - DNA, 16 bp, Homo sapiens
gacagtattgccacct

SEQ ID NO: 1077846 - DNA, 18 bp, Homo sapiens
gacagtcataaatactgt

SEQ ID NO: 1077847 - DNA, 21 bp, Homo sapiens
gacagtcataaatactgtcaa

SEQ ID NO: 1077848 - DNA, 17 bp, Homo sapiens
gacagtcatcatcaggg

SEQ ID NO: 1077849 - DNA, 18 bp, Homo sapiens
gacagtcatcatcagggc

SEQ ID NO: 1077850 - DNA, 19 bp, Homo sapiens
gacagtcatcatcagggcc

SEQ ID NO: 1077851 - DNA, 23 bp, Homo sapiens
gacagtcatcatcagggcctggg

SEQ ID NO: 1077852 - DNA, 21 bp, Homo sapiens
gacagtccgtcaaaacagatt

SEQ ID NO: 1077853 - DNA, 21 bp, Homo sapiens
gacttggacatctctctggct

SEQ ID NO: 1077854 - DNA, 22 bp, Homo sapiens
gacttggacatctctctggctt

SEQ ID NO: 1077855 - DNA, 21 bp, Homo sapiens
gacttggagagaatcatgctg

SEQ ID NO: 1077856 - DNA, 15 bp, Homo sapiens
gacttggagagcaaa

SEQ ID NO: 1077857 - DNA, 19 bp, Homo sapiens
gacttggagagcaaaggcc

SEQ ID NO: 1077858 - DNA, 21 bp, Homo sapiens
gacttggagagcaaaggccca

SEQ ID NO: 1077859 - DNA, 22 bp, Homo sapiens
gacttggagagcaaaggcccat

SEQ ID NO: 1077860 - DNA, 23 bp, Homo sapiens
gacttggagagcaaaggcccatg

SEQ ID NO: 1077861 - DNA, 15 bp, Homo sapiens
gacttggagggtctg

SEQ ID NO: 1077862 - DNA, 19 bp, Homo sapiens
gacttggagggtctggggg

SEQ ID NO: 1077863 - DNA, 20 bp, Homo sapiens
gacttggagggtctgggggc

SEQ ID NO: 1077864 - DNA, 15 bp, Homo sapiens
gacttggatcccagg

SEQ ID NO: 1077865 - DNA, 17 bp, Homo sapiens
gacttggcaacagaagc

SEQ ID NO: 1077866 - DNA, 13 bp, Homo sapiens
gacttggcactta

SEQ ID NO: 1077867 - DNA, 22 bp, Homo sapiens
gacttggcacttaagtgcactt

SEQ ID NO: 1077868 - DNA, 14 bp, Homo sapiens
gacttggcaggtgc

SEQ ID NO: 1077869 - DNA, 13 bp, Homo sapiens
gacttggctgtcc

SEQ ID NO: 1077870 - DNA, 12 bp, Homo sapiens
gacttgggatgg

SEQ ID NO: 1077871 - DNA, 22 bp, Homo sapiens
gacttgggggaacgatgtgtct

SEQ ID NO: 1077872 - DNA, 16 bp, Homo sapiens
gacttggggtcaggaa

SEQ ID NO: 1077873 - DNA, 20 bp, Homo sapiens
gacttgggtctcatttagaa

SEQ ID NO: 1077874 - DNA, 20 bp, Homo sapiens
gacttgggttgatctcttag

SEQ ID NO: 1077875 - DNA, 20 bp, Homo sapiens
gacttggtaagatgactctg

SEQ ID NO: 1077876 - DNA, 19 bp, Homo sapiens
gacttggtcaccagctcct

SEQ ID NO: 1077877 - DNA, 17 bp, Homo sapiens
gacttggttctgaagcc

SEQ ID NO: 1077878 - DNA, 19 bp, Homo sapiens
gacttgtagggatgccttt

SEQ ID NO: 1077879 - DNA, 16 bp, Homo sapiens
gacttgtatatttgta

SEQ ID NO: 1077880 - DNA, 18 bp, Homo sapiens
gacttgtatatttgtaca

SEQ ID NO: 1077881 - DNA, 19 bp, Homo sapiens
gacttgtatatttgtacaa

SEQ ID NO: 1077882 - DNA, 19 bp, Homo sapiens
gacttgtatattttaagaa

SEQ ID NO: 1077883 - DNA, 18 bp, Homo sapiens
gacttgtttttgcacatg

SEQ ID NO: 1077884 - DNA, 15 bp, Homo sapiens
gactttaaaaaaaca

SEQ ID NO: 1077885 - DNA, 12 bp, Homo sapiens
gactttaattta

SEQ ID NO: 1077886 - DNA, 19 bp, Homo sapiens
gactttagaaagctgacat

SEQ ID NO: 1077887 - DNA, 16 bp, Homo sapiens
gactttagcttttcct

SEQ ID NO: 1077888 - DNA, 20 bp, Homo sapiens
gactttagttaccgagacat

SEQ ID NO: 1077889 - DNA, 22 bp, Homo sapiens
gactttagttaccgagacatga

SEQ ID NO: 1077890 - DNA, 16 bp, Homo sapiens
gactttatctcctgct

SEQ ID NO: 1077891 - DNA, 18 bp, Homo sapiens
gactttatctcctgctct

SEQ ID NO: 1077892 - DNA, 14 bp, Homo sapiens
gactttatttttct

SEQ ID NO: 1077893 - DNA, 17 bp, Homo sapiens
gactttccaccccctcc

SEQ ID NO: 1077894 - DNA, 16 bp, Homo sapiens
gactttcccaaatgta

SEQ ID NO: 1077895 - DNA, 22 bp, Homo sapiens
gactttccccaacaatgtgatt

SEQ ID NO: 1077896 - DNA, 16 bp, Homo sapiens
gactttcctaaatgtt

SEQ ID NO: 1077897 - DNA, 15 bp, Homo sapiens
gactttctgaaaaca

SEQ ID NO: 1077898 - DNA, 18 bp, Homo sapiens
gactttctgcctggagtg

SEQ ID NO: 1077899 - DNA, 17 bp, Homo sapiens
gactttctgttttctgt

SEQ ID NO: 1077900 - DNA, 23 bp, Homo sapiens
gactttctgttttctgtttgtaa

SEQ ID NO: 1077901 - DNA, 16 bp, Homo sapiens
gactttgatccttgga

SEQ ID NO: 1077902 - DNA, 20 bp, Homo sapiens
gactttgattgcacattgtt

SEQ ID NO: 1077903 - DNA, 21 bp, Homo sapiens
gactttgcagccggcacaggg

SEQ ID NO: 1077904 - DNA, 20 bp, Homo sapiens
gactttgcccccttgcccat

SEQ ID NO: 1077905 - DNA, 15 bp, Homo sapiens
gactttgctgcattt

SEQ ID NO: 1077906 - DNA, 21 bp, Homo sapiens
gactttgctgcattttacaca

SEQ ID NO: 1077907 - DNA, 18 bp, Homo sapiens
gactttggaaaactactt

SEQ ID NO: 1077908 - DNA, 16 bp, Homo sapiens
gactttggacagtggc

SEQ ID NO: 1077909 - DNA, 15 bp, Homo sapiens
gactttgtagatcct

SEQ ID NO: 1077910 - DNA, 17 bp, Homo sapiens
gactttgtttttaaaat

SEQ ID NO: 1077911 - DNA, 21 bp, Homo sapiens
gacttttaatgtcatttgtta

SEQ ID NO: 1077912 - DNA, 14 bp, Homo sapiens
gacttttacagatt

SEQ ID NO: 1077913 - DNA, 15 bp, Homo sapiens
gacttttatgtgaga

SEQ ID NO: 1077914 - DNA, 17 bp, Homo sapiens
gacttttccaagccctt

SEQ ID NO: 1077915 - DNA, 17 bp, Homo sapiens
gacttttcgttaacatt

SEQ ID NO: 1077916 - DNA, 18 bp, Homo sapiens
gacttttcgttaacattg

SEQ ID NO: 1077917 - DNA, 13 bp, Homo sapiens
gacttttctgcaa

SEQ ID NO: 1077918 - DNA, 14 bp, Homo sapiens
gacttttctgcaaa

SEQ ID NO: 1077919 - DNA, 21 bp, Homo sapiens
gacttttctgtccgagctttg

SEQ ID NO: 1077920 - DNA, 14 bp, Homo sapiens
gacttttcttaagt

SEQ ID NO: 1077921 - DNA, 20 bp, Homo sapiens
gacttttgtctgatcaagtg

SEQ ID NO: 1077922 - DNA, 16 bp, Homo sapiens
gactttttataaaatg

SEQ ID NO: 1077923 - DNA, 18 bp, Homo sapiens
gactttttggaattcagc

SEQ ID NO: 1077924 - DNA, 20 bp, Homo sapiens
gacttttttttttcttttct

SEQ ID NO: 1077925 - DNA, 10 bp, Homo sapiens
gagaaaaaaa

SEQ ID NO: 1077926 - DNA, 21 bp, Homo sapiens
gagaaaaaaaaagtgaaaaaa

SEQ ID NO: 1077927 - DNA, 14 bp, Homo sapiens
gagaaaaaaaacct

SEQ ID NO: 1077928 - DNA, 23 bp, Homo sapiens
gagaaaaaaaaccttgtaaaaaa

SEQ ID NO: 1077929 - DNA, 17 bp, Homo sapiens
gagaaaaaaatatataa

SEQ ID NO: 1077930 - DNA, 23 bp, Homo sapiens
gagaaaaaaatcaaccctgcaat

SEQ ID NO: 1077931 - DNA, 10 bp, Homo sapiens
gagaaaaaga

SEQ ID NO: 1077932 - DNA, 17 bp, Homo sapiens
gagaaaaagctcctgtc

SEQ ID NO: 1077933 - DNA, 17 bp, Homo sapiens
gagaaaaaggaaaaaaa

SEQ ID NO: 1077934 - DNA, 11 bp, Homo sapiens
gagaaaagaaa

SEQ ID NO: 1077935 - DNA, 12 bp, Homo sapiens
gagaaaagaaaa

SEQ ID NO: 1077936 - DNA, 15 bp, Homo sapiens
gagaaaagaaaaaaa

SEQ ID NO: 1077937 - DNA, 11 bp, Homo sapiens
gagaaaatata

SEQ ID NO: 1077938 - DNA, 18 bp, Homo sapiens
gagaaaatatatgtattt

SEQ ID NO: 1077939 - DNA, 15 bp, Homo sapiens
gagaaaatcatcaag

SEQ ID NO: 1077940 - DNA, 17 bp, Homo sapiens
gagaaaatccaggtcat

SEQ ID NO: 1077941 - DNA, 23 bp, Homo sapiens
gagaaaatgcctcaattcacata

SEQ ID NO: 1077942 - DNA, 13 bp, Homo sapiens
gagaaaattgaaa

SEQ ID NO: 1077943 - DNA, 21 bp, Homo sapiens
gagaaaattgttgcaaactat

SEQ ID NO: 1077944 - DNA, 18 bp, Homo sapiens
gagaaacagttggtaact

SEQ ID NO: 1077945 - DNA, 21 bp, Homo sapiens
gagaaacagttggtaactttt

SEQ ID NO: 1077946 - DNA, 12 bp, Homo sapiens
gagaaaccctgt

SEQ ID NO: 1077947 - DNA, 15 bp, Homo sapiens
gagaaaccgggagaa

SEQ ID NO: 1077948 - DNA, 12 bp, Homo sapiens
gagaaactcatc

SEQ ID NO: 1077949 - DNA, 17 bp, Homo sapiens
gagaaactgaaagtgtt

SEQ ID NO: 1077950 - DNA, 18 bp, Homo sapiens
gagaaactggcaaagcag

SEQ ID NO: 1077951 - DNA, 18 bp, Homo sapiens
gagaaacttaagcaaagg

SEQ ID NO: 1077952 - DNA, 14 bp, Homo sapiens
gagaaacttcaaag

SEQ ID NO: 1077953 - DNA, 19 bp, Homo sapiens
gagaaagaaaaggcaaaag

SEQ ID NO: 1077954 - DNA, 23 bp, Homo sapiens
gagaaagaaaaggcaaaagactg

SEQ ID NO: 1077955 - DNA, 15 bp, Homo sapiens
gagaaagaaagggaa

SEQ ID NO: 1077956 - DNA, 18 bp, Homo sapiens
gagaaagaagtaggcatg

SEQ ID NO: 1077957 - DNA, 18 bp, Homo sapiens
gagaaagaccatgcattt

SEQ ID NO: 1077958 - DNA, 19 bp, Homo sapiens
gagaaagagcacttaagag

SEQ ID NO: 1077959 - DNA, 16 bp, Homo sapiens
gagaaagaggggcctg

SEQ ID NO: 1077960 - DNA, 15 bp, Homo sapiens
gagaaagcccacctg

SEQ ID NO: 1077961 - DNA, 16 bp, Homo sapiens
gagaaagcccacctgg

SEQ ID NO: 1077962 - DNA, 17 bp, Homo sapiens
gagaaagcccacctggg

SEQ ID NO: 1077963 - DNA, 22 bp, Homo sapiens
gagaaagcccacctgggctggg

SEQ ID NO: 1077964 - DNA, 17 bp, Homo sapiens
gagaaagccgggggagg

SEQ ID NO: 1077965 - DNA, 22 bp, Homo sapiens
gagaaagctaaaatggtggtct

SEQ ID NO: 1077966 - DNA, 16 bp, Homo sapiens
gagaaagtaacacaaa

SEQ ID NO: 1077967 - DNA, 23 bp, Homo sapiens
gagaaataaattttgtttcagaa

SEQ ID NO: 1077968 - DNA, 13 bp, Homo sapiens
gagaaatacagct

SEQ ID NO: 1077969 - DNA, 23 bp, Homo sapiens
gagaaatcatcctgttttctctg

SEQ ID NO: 1077970 - DNA, 20 bp, Homo sapiens
gagaaatgcaaatcgaaaca

SEQ ID NO: 1077971 - DNA, 17 bp, Homo sapiens
gagaaatgcagagaaga

SEQ ID NO: 1077972 - DNA, 13 bp, Homo sapiens
gagaaatgggact

SEQ ID NO: 1077973 - DNA, 23 bp, Homo sapiens
gagaaatgtgtagctgcaaaaat

SEQ ID NO: 1077974 - DNA, 19 bp, Homo sapiens
gagaaattcgtgtgttttt

SEQ ID NO: 1077975 - DNA, 14 bp, Homo sapiens
gagaaattgacaga

SEQ ID NO: 1077976 - DNA, 14 bp, Homo sapiens
gagaacaaagctgt

SEQ ID NO: 1077977 - DNA, 16 bp, Homo sapiens
gagaagctgaggccta

SEQ ID NO: 1077978 - DNA, 23 bp, Homo sapiens
gagaagctgatgctttgcttcaa

SEQ ID NO: 1077979 - DNA, 12 bp, Homo sapiens
gagaagctgcag

SEQ ID NO: 1077980 - DNA, 12 bp, Homo sapiens
gagaagctgctc

SEQ ID NO: 1077981 - DNA, 20 bp, Homo sapiens
gagaagctgctccaggcctg

SEQ ID NO: 1077982 - DNA, 17 bp, Homo sapiens
gagaagctgctgaccaa

SEQ ID NO: 1077983 - DNA, 18 bp, Homo sapiens
gagaagctgctgaccaat

SEQ ID NO: 1077984 - DNA, 12 bp, Homo sapiens
gagaaggaaaac

SEQ ID NO: 1077985 - DNA, 12 bp, Homo sapiens
gagaaggaagcc

SEQ ID NO: 1077986 - DNA, 12 bp, Homo sapiens
gagaaggaaggg

SEQ ID NO: 1077987 - DNA, 17 bp, Homo sapiens
gagaaggatctagaatg

SEQ ID NO: 1077988 - DNA, 23 bp, Homo sapiens
gagaaggcaggaatgtgtggcag

SEQ ID NO: 1077989 - DNA, 15 bp, Homo sapiens
gagaagggatggagg

SEQ ID NO: 1077990 - DNA, 19 bp, Homo sapiens
gagaagggggattggaggg

SEQ ID NO: 1077991 - DNA, 17 bp, Homo sapiens
gagaagggggctctgcc

SEQ ID NO: 1077992 - DNA, 15 bp, Homo sapiens
gagaaggtccttaat

SEQ ID NO: 1077993 - DNA, 18 bp, Homo sapiens
gagaagtcaaacatttca

SEQ ID NO: 1077994 - DNA, 13 bp, Homo sapiens
gagaagtctcagc

SEQ ID NO: 1077995 - DNA, 15 bp, Homo sapiens
gagaagtgcccctgc

SEQ ID NO: 1077996 - DNA, 23 bp, Homo sapiens
gagaagtgcccctgctgcctccc

SEQ ID NO: 1077997 - DNA, 20 bp, Homo sapiens
gagaagtgggggcagcccag

SEQ ID NO: 1077998 - DNA, 21 bp, Homo sapiens
gagaagtgggggcagcccagg

SEQ ID NO: 1077999 - DNA, 20 bp, Homo sapiens
gagaagttcccattattatt

SEQ ID NO: 1078000 - DNA, 22 bp, Homo sapiens
gagaagttccttaggttttctt

SEQ ID NO: 1078001 - DNA, 17 bp, Homo sapiens
gagaagttctcaaagtt

SEQ ID NO: 1078002 - DNA, 19 bp, Homo sapiens
gagaagttctcaaagttaa

SEQ ID NO: 1078003 - DNA, 21 bp, Homo sapiens
gagaagttgctgcttgtgatc

SEQ ID NO: 1078004 - DNA, 21 bp, Homo sapiens
gagaagtttctggccctggct

SEQ ID NO: 1078005 - DNA, 19 bp, Homo sapiens
gagaagtttgtagccaggt

SEQ ID NO: 1078006 - DNA, 16 bp, Homo sapiens
gagaataaatttggga

SEQ ID NO: 1078007 - DNA, 19 bp, Homo sapiens
gagaataactcagaatatt

SEQ ID NO: 1078008 - DNA, 14 bp, Homo sapiens
gagaatagagctgc

SEQ ID NO: 1078009 - DNA, 18 bp, Homo sapiens
gagaatagagctgccact

SEQ ID NO: 1078010 - DNA, 20 bp, Homo sapiens
gagaatagagctgccactgg

SEQ ID NO: 1078011 - DNA, 17 bp, Homo sapiens
gagaatcacttttctag

SEQ ID NO: 1078012 - DNA, 14 bp, Homo sapiens
gagaatcagactga

SEQ ID NO: 1078013 - DNA, 21 bp, Homo sapiens
gagaatcatacttagcaaagt

SEQ ID NO: 1078014 - DNA, 20 bp, Homo sapiens
gagaatcccactttctatag

SEQ ID NO: 1078015 - DNA, 18 bp, Homo sapiens
gagaatcccttaaaatta

SEQ ID NO: 1078016 - DNA, 22 bp, Homo sapiens
gagaatcccttaaaattaccag

SEQ ID NO: 1078017 - DNA, 14 bp, Homo sapiens
gagaatcctgcctc

SEQ ID NO: 1078018 - DNA, 22 bp, Homo sapiens
gagaatctatatttaacaagat

SEQ ID NO: 1078019 - DNA, 14 bp, Homo sapiens
gagaatctcttggg

SEQ ID NO: 1078020 - DNA, 17 bp, Homo sapiens
gagaatctgagacatct

SEQ ID NO: 1078021 - DNA, 14 bp, Homo sapiens
gagaatctgggggt

SEQ ID NO: 1078022 - DNA, 19 bp, Homo sapiens
gagaatcttaaggtctaac

SEQ ID NO: 1078023 - DNA, 21 bp, Homo sapiens
gagaatcttaaggtctaactg

SEQ ID NO: 1078024 - DNA, 18 bp, Homo sapiens
gagaatgagagcgacaca

SEQ ID NO: 1078025 - DNA, 23 bp, Homo sapiens
gagaatgatagtaataggataca

SEQ ID NO: 1078026 - DNA, 14 bp, Homo sapiens
gagaatgcagccca

SEQ ID NO: 1078027 - DNA, 15 bp, Homo sapiens
gagaatgcagcccac

SEQ ID NO: 1078028 - DNA, 19 bp, Homo sapiens
gagaatggctgggtcaggg

SEQ ID NO: 1078029 - DNA, 16 bp, Homo sapiens
gagaatggggttcctg

SEQ ID NO: 1078030 - DNA, 20 bp, Homo sapiens
gagaatggtgtgaacccggg

SEQ ID NO: 1078031 - DNA, 21 bp, Homo sapiens
gagaatggtgtgaacccggga

SEQ ID NO: 1078032 - DNA, 21 bp, Homo sapiens
gagaatgtagatattgtgaag

SEQ ID NO: 1078033 - DNA, 20 bp, Homo sapiens
gagaatgtgattccttttga

SEQ ID NO: 1078034 - DNA, 16 bp, Homo sapiens
gagaattatgggaaac

SEQ ID NO: 1078035 - DNA, 18 bp, Homo sapiens
gagaattcttacatgttt

SEQ ID NO: 1078036 - DNA, 17 bp, Homo sapiens
gagaattgggattacat

SEQ ID NO: 1078037 - DNA, 21 bp, Homo sapiens
gagaatttctaccatttcaga

SEQ ID NO: 1078038 - DNA, 16 bp, Homo sapiens
gagaattttaaattat

SEQ ID NO: 1078039 - DNA, 15 bp, Homo sapiens
gagaattttgtttca

SEQ ID NO: 1078040 - DNA, 22 bp, Homo sapiens
gagacaaatcctttctgccccc

SEQ ID NO: 1078041 - DNA, 13 bp, Homo sapiens
gagacaagccctg

SEQ ID NO: 1078042 - DNA, 19 bp, Homo sapiens
gagacaagccctggcaaca

SEQ ID NO: 1078043 - DNA, 15 bp, Homo sapiens
gagacacattgcctt

SEQ ID NO: 1078044 - DNA, 14 bp, Homo sapiens
gagacacattggac

SEQ ID NO: 1078045 - DNA, 19 bp, Homo sapiens
gagacaccccttcctgctg

SEQ ID NO: 1078046 - DNA, 22 bp, Homo sapiens
gagacaccccttcctgctgaca

SEQ ID NO: 1078047 - DNA, 17 bp, Homo sapiens
gagacacctgcacctcc

SEQ ID NO: 1078048 - DNA, 17 bp, Homo sapiens
gagacacgctggcgaca

SEQ ID NO: 1078049 - DNA, 16 bp, Homo sapiens
gagacacggagcccag

SEQ ID NO: 1078050 - DNA, 19 bp, Homo sapiens
gagacacgtgtggcgggca

SEQ ID NO: 1078051 - DNA, 20 bp, Homo sapiens
gagacactaacgacttcagg

SEQ ID NO: 1078052 - DNA, 20 bp, Homo sapiens
gagacactgttgataaaaac

SEQ ID NO: 1078053 - DNA, 12 bp, Homo sapiens
gagacagaagca

SEQ ID NO: 1078054 - DNA, 16 bp, Homo sapiens
gagacagaagcaggct

SEQ ID NO: 1078055 - DNA, 15 bp, Homo sapiens
gagacagaagcctgg

SEQ ID NO: 1078056 - DNA, 16 bp, Homo sapiens
gagacagaatgtatct

SEQ ID NO: 1078057 - DNA, 21 bp, Homo sapiens
gagacagaatgtatctgtgaa

SEQ ID NO: 1078058 - DNA, 15 bp, Homo sapiens
gagacagactagaag

SEQ ID NO: 1078059 - DNA, 15 bp, Homo sapiens
gagacagagaatctt

SEQ ID NO: 1078060 - DNA, 15 bp, Homo sapiens
gagacagaggaaagg

SEQ ID NO: 1078061 - DNA, 20 bp, Homo sapiens
gagacagagtcttgctctgt

SEQ ID NO: 1078062 - DNA, 16 bp, Homo sapiens
gagagaccctggcctc

SEQ ID NO: 1078063 - DNA, 17 bp, Homo sapiens
gagagacctcatcagga

SEQ ID NO: 1078064 - DNA, 18 bp, Homo sapiens
gagagacctcatcaggat

SEQ ID NO: 1078065 - DNA, 21 bp, Homo sapiens
gagagacgcagtccgcccagg

SEQ ID NO: 1078066 - DNA, 15 bp, Homo sapiens
gagagactgagcagc

SEQ ID NO: 1078067 - DNA, 22 bp, Homo sapiens
gagagactgatggggtcgctct

SEQ ID NO: 1078068 - DNA, 16 bp, Homo sapiens
gagagacttggaagag

SEQ ID NO: 1078069 - DNA, 11 bp, Homo sapiens
gagagagaaaa

SEQ ID NO: 1078070 - DNA, 20 bp, Homo sapiens
gagagagaatagagctgcca

SEQ ID NO: 1078071 - DNA, 10 bp, Homo sapiens
gagagagaca

SEQ ID NO: 1078072 - DNA, 18 bp, Homo sapiens
gagagagacttggaagag

SEQ ID NO: 1078073 - DNA, 14 bp, Homo sapiens
gagagagagagagg

SEQ ID NO: 1078074 - DNA, 13 bp, Homo sapiens
gagagagagagga

SEQ ID NO: 1078075 - DNA, 14 bp, Homo sapiens
gagagagagaggac

SEQ ID NO: 1078076 - DNA, 11 bp, Homo sapiens
gagagagaggt

SEQ ID NO: 1078077 - DNA, 17 bp, Homo sapiens
gagagaggctgcctcag

SEQ ID NO: 1078078 - DNA, 12 bp, Homo sapiens
gagagaggggaa

SEQ ID NO: 1078079 - DNA, 13 bp, Homo sapiens
gagagaggggaag

SEQ ID NO: 1078080 - DNA, 17 bp, Homo sapiens
gagagcaaaggcccatg

SEQ ID NO: 1078081 - DNA, 20 bp, Homo sapiens
gagagcaaaggcccatgccc

SEQ ID NO: 1078082 - DNA, 23 bp, Homo sapiens
gagagcaaaggcccatgccccct

SEQ ID NO: 1078083 - DNA, 15 bp, Homo sapiens
gagagcaacatttta

SEQ ID NO: 1078084 - DNA, 14 bp, Homo sapiens
gagagcagcactcc

SEQ ID NO: 1078085 - DNA, 16 bp, Homo sapiens
gagagcagcaggtgct

SEQ ID NO: 1078086 - DNA, 17 bp, Homo sapiens
gagagcagcaggtgctg

SEQ ID NO: 1078087 - DNA, 15 bp, Homo sapiens
gagagcagcgcccag

SEQ ID NO: 1078088 - DNA, 22 bp, Homo sapiens
gagagcagctccctttctcagg

SEQ ID NO: 1078089 - DNA, 21 bp, Homo sapiens
gagagcaggcaggggcatctg

SEQ ID NO: 1078090 - DNA, 22 bp, Homo sapiens
gagagcaggcaggggcatctgt

SEQ ID NO: 1078091 - DNA, 21 bp, Homo sapiens
gagagcagtgggcaggtggcc

SEQ ID NO: 1078092 - DNA, 12 bp, Homo sapiens
gagagcataatt

SEQ ID NO: 1078093 - DNA, 16 bp, Homo sapiens
gagagcataatttaaa

SEQ ID NO: 1078094 - DNA, 16 bp, Homo sapiens
gagagccaccaagagg

SEQ ID NO: 1078095 - DNA, 15 bp, Homo sapiens
gagagccactgggcc

SEQ ID NO: 1078096 - DNA, 12 bp, Homo sapiens
gagagccagccc

SEQ ID NO: 1078097 - DNA, 14 bp, Homo sapiens
gagagccagctctc

SEQ ID NO: 1078098 - DNA, 13 bp, Homo sapiens
gagagcccagcca

SEQ ID NO: 1078099 - DNA, 13 bp, Homo sapiens
gagagccccagct

SEQ ID NO: 1078100 - DNA, 23 bp, Homo sapiens
gagagcccccaccagcagcacaa

SEQ ID NO: 1078101 - DNA, 19 bp, Homo sapiens
gagagccctgctgtgggag

SEQ ID NO: 1078102 - DNA, 16 bp, Homo sapiens
gagagcccttcatttg

SEQ ID NO: 1078103 - DNA, 20 bp, Homo sapiens
gagagccgtggtccctgagg

SEQ ID NO: 1078104 - DNA, 22 bp, Homo sapiens
gagagcctagaacatccctggg

SEQ ID NO: 1078105 - DNA, 23 bp, Homo sapiens
gagagcctccctgcagccaccag

SEQ ID NO: 1078106 - DNA, 12 bp, Homo sapiens
gagagcctgctg

SEQ ID NO: 1078107 - DNA, 13 bp, Homo sapiens
gagagcctgctgc

SEQ ID NO: 1078108 - DNA, 14 bp, Homo sapiens
gagagcctgctggc

SEQ ID NO: 1078109 - DNA, 15 bp, Homo sapiens
gagagcctgctggca

SEQ ID NO: 1078110 - DNA, 11 bp, Homo sapiens
gagagcctggc

SEQ ID NO: 1078111 - DNA, 16 bp, Homo sapiens
gagagcctggcaaggc

SEQ ID NO: 1078112 - DNA, 13 bp, Homo sapiens
gagagcctggggg

SEQ ID NO: 1078113 - DNA, 17 bp, Homo sapiens
gagagcctggtgctgct

SEQ ID NO: 1078114 - DNA, 14 bp, Homo sapiens
gagagcgacacaga

SEQ ID NO: 1078115 - DNA, 16 bp, Homo sapiens
gagagcgacacagacg

SEQ ID NO: 1078116 - DNA, 14 bp, Homo sapiens
gagagcgcctcttc

SEQ ID NO: 1078117 - DNA, 22 bp, Homo sapiens
gagagcgcctcttcctctgggc

SEQ ID NO: 1078118 - DNA, 15 bp, Homo sapiens
gagagctagcagcag

SEQ ID NO: 1078119 - DNA, 14 bp, Homo sapiens
gagagctggtgccc

SEQ ID NO: 1078120 - DNA, 20 bp, Homo sapiens
gagagctttctgccttagcc

SEQ ID NO: 1078121 - DNA, 19 bp, Homo sapiens
gagaggacaatactggggt

SEQ ID NO: 1078122 - DNA, 13 bp, Homo sapiens
gagaggacagagg

SEQ ID NO: 1078123 - DNA, 16 bp, Homo sapiens
gagaggactctgcctt

SEQ ID NO: 1078124 - DNA, 14 bp, Homo sapiens
gagaggagaaaaaa

SEQ ID NO: 1078125 - DNA, 17 bp, Homo sapiens
gagaggagaacagtagg

SEQ ID NO: 1078126 - DNA, 18 bp, Homo sapiens
gagaggagaacagtagga

SEQ ID NO: 1078127 - DNA, 18 bp, Homo sapiens
gagaggagacggagggga

SEQ ID NO: 1078128 - DNA, 13 bp, Homo sapiens
gagaggaggcagc

SEQ ID NO: 1078129 - DNA, 18 bp, Homo sapiens
gagaggaggtttgcctgt

SEQ ID NO: 1078130 - DNA, 15 bp, Homo sapiens
gagaggatacattta

SEQ ID NO: 1078131 - DNA, 16 bp, Homo sapiens
gagaggatacatttaa

SEQ ID NO: 1078132 - DNA, 16 bp, Homo sapiens
gagaggcacctgctgg

SEQ ID NO: 1078133 - DNA, 13 bp, Homo sapiens
gagaggcactcag

SEQ ID NO: 1078134 - DNA, 19 bp, Homo sapiens
gagaggcactcagtgagcc

SEQ ID NO: 1078135 - DNA, 20 bp, Homo sapiens
gagaggcagaagaaccctgg

SEQ ID NO: 1078136 - DNA, 14 bp, Homo sapiens
gagaggcaggaatg

SEQ ID NO: 1078137 - DNA, 15 bp, Homo sapiens
gagaggcaggcatag

SEQ ID NO: 1078138 - DNA, 21 bp, Homo sapiens
gagaggcaggcatagaggctt

SEQ ID NO: 1078139 - DNA, 17 bp, Homo sapiens
gagaggccaaaggctgg

SEQ ID NO: 1078140 - DNA, 18 bp, Homo sapiens
gagaggccttttgtttaa

SEQ ID NO: 1078141 - DNA, 16 bp, Homo sapiens
gagaggcgcgtctgcc

SEQ ID NO: 1078142 - DNA, 23 bp, Homo sapiens
gagaggcgcgtctgccccaccct

SEQ ID NO: 1078143 - DNA, 14 bp, Homo sapiens
gagaggctgggagg

SEQ ID NO: 1078144 - DNA, 12 bp, Homo sapiens
gagaggctggtg

SEQ ID NO: 1078145 - DNA, 22 bp, Homo sapiens
gagaggctggtgtatgcactgc

SEQ ID NO: 1078146 - DNA, 17 bp, Homo sapiens
gagagggaagagggaga

SEQ ID NO: 1078147 - DNA, 18 bp, Homo sapiens
gagagggaagagggagac

SEQ ID NO: 1078148 - DNA, 14 bp, Homo sapiens
gagagggacacatg

SEQ ID NO: 1078149 - DNA, 18 bp, Homo sapiens
gagagggacacatgcccc

SEQ ID NO: 1078150 - DNA, 20 bp, Homo sapiens
gagagggacacatgcccctc

SEQ ID NO: 1078151 - DNA, 18 bp, Homo sapiens
gagagggacaggcactcc

SEQ ID NO: 1078152 - DNA, 15 bp, Homo sapiens
gagagggagaagaag

SEQ ID NO: 1078153 - DNA, 14 bp, Homo sapiens
gagagggagagaga

SEQ ID NO: 1078154 - DNA, 21 bp, Homo sapiens
gagagggcatgcgcacaaggc

SEQ ID NO: 1078155 - DNA, 14 bp, Homo sapiens
gagagggcccagct

SEQ ID NO: 1078156 - DNA, 16 bp, Homo sapiens
gagagggcccagctgt

SEQ ID NO: 1078157 - DNA, 16 bp, Homo sapiens
gagagggctagccctg

SEQ ID NO: 1078158 - DNA, 20 bp, Homo sapiens
gagagggctcgaggggtggg

SEQ ID NO: 1078159 - DNA, 16 bp, Homo sapiens
gagaggggaagaattt

SEQ ID NO: 1078160 - DNA, 21 bp, Homo sapiens
gagaggggacaaaacccacct

SEQ ID NO: 1078161 - DNA, 22 bp, Homo sapiens
gagaggggacaaaacccacctt

SEQ ID NO: 1078162 - DNA, 15 bp, Homo sapiens
gagaggggagggctc

SEQ ID NO: 1078163 - DNA, 16 bp, Homo sapiens
gagaggggagggctcc

SEQ ID NO: 1078164 - DNA, 14 bp, Homo sapiens
gagaggggtttggg

SEQ ID NO: 1078165 - DNA, 16 bp, Homo sapiens
gagagggtgaaggagg

SEQ ID NO: 1078166 - DNA, 15 bp, Homo sapiens
gagaggtctcaggtt

SEQ ID NO: 1078167 - DNA, 19 bp, Homo sapiens
gagaggtgattctcagggc

SEQ ID NO: 1078168 - DNA, 22 bp, Homo sapiens
gagaggtgattctcagggctgg

SEQ ID NO: 1078169 - DNA, 21 bp, Homo sapiens
gagaggtgccagcaactgaat

SEQ ID NO: 1078170 - DNA, 15 bp, Homo sapiens
gagaggtggctgcgc

SEQ ID NO: 1078171 - DNA, 23 bp, Homo sapiens
gagaggtgggccagtctgtggat

SEQ ID NO: 1078172 - DNA, 16 bp, Homo sapiens
gagaggttaaggtgca

SEQ ID NO: 1078173 - DNA, 19 bp, Homo sapiens
gagcagtgtcttccataat

SEQ ID NO: 1078174 - DNA, 20 bp, Homo sapiens
gagcagttggccaagcagaa

SEQ ID NO: 1078175 - DNA, 16 bp, Homo sapiens
gagcagttttcccctg

SEQ ID NO: 1078176 - DNA, 22 bp, Homo sapiens
gagcagttttcccctggcctca

SEQ ID NO: 1078177 - DNA, 15 bp, Homo sapiens
gagcatagaagccac

SEQ ID NO: 1078178 - DNA, 15 bp, Homo sapiens
gaggaggccacctct

SEQ ID NO: 1078179 - DNA, 18 bp, Homo sapiens
gaggaggccacctctcca

SEQ ID NO: 1078180 - DNA, 13 bp, Homo sapiens
gaggaggcctcaa

SEQ ID NO: 1078181 - DNA, 16 bp, Homo sapiens
gaggaggcctggaccg

SEQ ID NO: 1078182 - DNA, 14 bp, Homo sapiens
gaggaggctgccct

SEQ ID NO: 1078183 - DNA, 22 bp, Homo sapiens
gaggaggctgccctgaggggct

SEQ ID NO: 1078184 - DNA, 11 bp, Homo sapiens
gaggagggaga

SEQ ID NO: 1078185 - DNA, 14 bp, Homo sapiens
gaggagggaggccg

SEQ ID NO: 1078186 - DNA, 18 bp, Homo sapiens
gaggaggggaagaaggaa

SEQ ID NO: 1078187 - DNA, 13 bp, Homo sapiens
gaggaggggaggg

SEQ ID NO: 1078188 - DNA, 16 bp, Homo sapiens
gaggaggggccgctgc

SEQ ID NO: 1078189 - DNA, 23 bp, Homo sapiens
gaggaggtgacaaaccatttcca

SEQ ID NO: 1078190 - DNA, 15 bp, Homo sapiens
gaggaggtggcagcc

SEQ ID NO: 1078191 - DNA, 22 bp, Homo sapiens
gaggaggtggcagccctgtagg

SEQ ID NO: 1078192 - DNA, 15 bp, Homo sapiens
gaggaggtgggggct

SEQ ID NO: 1078193 - DNA, 20 bp, Homo sapiens
gaggaggtgggggctggagg

SEQ ID NO: 1078194 - DNA, 21 bp, Homo sapiens
gaggaggtgtgaggaggaggc

SEQ ID NO: 1078195 - DNA, 18 bp, Homo sapiens
gaggaggttcactgagct

SEQ ID NO: 1078196 - DNA, 14 bp, Homo sapiens
gaggagtaaaattc

SEQ ID NO: 1078197 - DNA, 21 bp, Homo sapiens
gaggagtaaaattcagttttt

SEQ ID NO: 1078198 - DNA, 12 bp, Homo sapiens
gaggagtaacaa

SEQ ID NO: 1078199 - DNA, 22 bp, Homo sapiens
gaggagtaacaatacaaatgga

SEQ ID NO: 1078200 - DNA, 14 bp, Homo sapiens
gaggagtcaggggc

SEQ ID NO: 1078201 - DNA, 22 bp, Homo sapiens
gaggagtgaccgggcactggca

SEQ ID NO: 1078202 - DNA, 14 bp, Homo sapiens
gaggagtgcagcct

SEQ ID NO: 1078203 - DNA, 16 bp, Homo sapiens
gaggataaagaaaaga

SEQ ID NO: 1078204 - DNA, 18 bp, Homo sapiens
gaggatatattttcactt

SEQ ID NO: 1078205 - DNA, 19 bp, Homo sapiens
gaggatcactggagcccag

SEQ ID NO: 1078206 - DNA, 20 bp, Homo sapiens
gaggatcactggagcccagg

SEQ ID NO: 1078207 - DNA, 14 bp, Homo sapiens
gaggatcagttttt

SEQ ID NO: 1078208 - DNA, 16 bp, Homo sapiens
gaggatcctgagctgc

SEQ ID NO: 1078209 - DNA, 13 bp, Homo sapiens
gaggatctcttga

SEQ ID NO: 1078210 - DNA, 13 bp, Homo sapiens
gaggatgagcaga

SEQ ID NO: 1078211 - DNA, 22 bp, Homo sapiens
gaggatgatttcagaaggagaa

SEQ ID NO: 1078212 - DNA, 15 bp, Homo sapiens
gaggatgcattcgag

SEQ ID NO: 1078213 - DNA, 15 bp, Homo sapiens
gaggatgccttttct

SEQ ID NO: 1078214 - DNA, 16 bp, Homo sapiens
gaggatgccttttctg

SEQ ID NO: 1078215 - DNA, 14 bp, Homo sapiens
gaggatggagagag

SEQ ID NO: 1078216 - DNA, 17 bp, Homo sapiens
gaggatgggtcagagct

SEQ ID NO: 1078217 - DNA, 20 bp, Homo sapiens
gaggatgtccctgggccagg

SEQ ID NO: 1078218 - DNA, 14 bp, Homo sapiens
gaggattattgata

SEQ ID NO: 1078219 - DNA, 15 bp, Homo sapiens
gaggattgctatctg

SEQ ID NO: 1078220 - DNA, 22 bp, Homo sapiens
gaggattgcttgagcccaggag

SEQ ID NO: 1078221 - DNA, 18 bp, Homo sapiens
gaggatttaactgtgaac

SEQ ID NO: 1078222 - DNA, 14 bp, Homo sapiens
gaggattttccagt

SEQ ID NO: 1078223 - DNA, 23 bp, Homo sapiens
gaggcaaaaatgtccagccaccc

SEQ ID NO: 1078224 - DNA, 13 bp, Homo sapiens
gaggcaagaaaag

SEQ ID NO: 1078225 - DNA, 14 bp, Homo sapiens
gaggcaagaaaagg

SEQ ID NO: 1078226 - DNA, 15 bp, Homo sapiens
gaggcaagaaaagga

SEQ ID NO: 1078227 - DNA, 14 bp, Homo sapiens
gaggcaagagactg

SEQ ID NO: 1078228 - DNA, 21 bp, Homo sapiens
gaggcaagagggaggggacag

SEQ ID NO: 1078229 - DNA, 21 bp, Homo sapiens
gaggcaatcctaccttgcttt

SEQ ID NO: 1078230 - DNA, 22 bp, Homo sapiens
gaggcaatgggagctgaggcca

SEQ ID NO: 1078231 - DNA, 19 bp, Homo sapiens
gaggcaatgtcaggaacag

SEQ ID NO: 1078232 - DNA, 21 bp, Homo sapiens
gaggcaatgtcaggaacagaa

SEQ ID NO: 1078233 - DNA, 21 bp, Homo sapiens
gaggcaccagctctgtggcct

SEQ ID NO: 1078234 - DNA, 15 bp, Homo sapiens
gaggcaccggcgctg

SEQ ID NO: 1078235 - DNA, 19 bp, Homo sapiens
gaggcaccggcgctgcagg

SEQ ID NO: 1078236 - DNA, 16 bp, Homo sapiens
gaggcactagtcaccg

SEQ ID NO: 1078237 - DNA, 17 bp, Homo sapiens
gaggcactcagtgagcc

SEQ ID NO: 1078238 - DNA, 21 bp, Homo sapiens
gaggcactcagtgagcctcct

SEQ ID NO: 1078239 - DNA, 22 bp, Homo sapiens
gaggcagaaacctatctcaggg

SEQ ID NO: 1078240 - DNA, 19 bp, Homo sapiens
gaggcagacagcagctcag

SEQ ID NO: 1078241 - DNA, 21 bp, Homo sapiens
gaggcagagaatctcttggga

SEQ ID NO: 1078242 - DNA, 17 bp, Homo sapiens
gaggcagagcgggaggg

SEQ ID NO: 1078243 - DNA, 20 bp, Homo sapiens
gaggcagagcgggagggagt

SEQ ID NO: 1078244 - DNA, 19 bp, Homo sapiens
gaggcagaggttgcagtga

SEQ ID NO: 1078245 - DNA, 22 bp, Homo sapiens
gaggcagcagtgtgaggccagg

SEQ ID NO: 1078246 - DNA, 21 bp, Homo sapiens
gaggcagcatgcttgggctga

SEQ ID NO: 1078247 - DNA, 12 bp, Homo sapiens
gaggcagcccgc

SEQ ID NO: 1078248 - DNA, 16 bp, Homo sapiens
gaggcagcgtgggctc

SEQ ID NO: 1078249 - DNA, 20 bp, Homo sapiens
gaggcagcgtgggctctgcc

SEQ ID NO: 1078250 - DNA, 21 bp, Homo sapiens
gaggcagctatctgcactcta

SEQ ID NO: 1078251 - DNA, 12 bp, Homo sapiens
gaggcaggagaa

SEQ ID NO: 1078252 - DNA, 16 bp, Homo sapiens
gaggcaggagactggc

SEQ ID NO: 1078253 - DNA, 13 bp, Homo sapiens
gaggcaggctggg

SEQ ID NO: 1078254 - DNA, 14 bp, Homo sapiens
gaggcagggcagcc

SEQ ID NO: 1078255 - DNA, 17 bp, Homo sapiens
gaggcagggccttgccc

SEQ ID NO: 1078256 - DNA, 18 bp, Homo sapiens
gaggcagggccttgccca

SEQ ID NO: 1078257 - DNA, 20 bp, Homo sapiens
gaggcagggccttgcccaga

SEQ ID NO: 1078258 - DNA, 23 bp, Homo sapiens
gaggcagggccttgcccagagat

SEQ ID NO: 1078259 - DNA, 22 bp, Homo sapiens
gaggcagggctggaatgggaga

SEQ ID NO: 1078260 - DNA, 13 bp, Homo sapiens
gaggcagggtcag

SEQ ID NO: 1078261 - DNA, 15 bp, Homo sapiens
gaggcaggtgagaga

SEQ ID NO: 1078262 - DNA, 22 bp, Homo sapiens
gaggcaggtggatcacgaggtc

SEQ ID NO: 1078263 - DNA, 17 bp, Homo sapiens
gaggcaggttagaagaa

SEQ ID NO: 1078264 - DNA, 20 bp, Homo sapiens
gaggcagtgatgacttgctg

SEQ ID NO: 1078265 - DNA, 14 bp, Homo sapiens
gaggcataaagact

SEQ ID NO: 1078266 - DNA, 19 bp, Homo sapiens
gaggcatacacacagcagt

SEQ ID NO: 1078267 - DNA, 23 bp, Homo sapiens
gaggcatcacgctacccagcttc

SEQ ID NO: 1078268 - DNA, 14 bp, Homo sapiens
gaggcatcttttct

SEQ ID NO: 1078269 - DNA, 23 bp, Homo sapiens
gaggcatggcaattctggaagct

SEQ ID NO: 1078270 - DNA, 14 bp, Homo sapiens
gaggcatggccctg

SEQ ID NO: 1078271 - DNA, 15 bp, Homo sapiens
gaggcatggccctgg

SEQ ID NO: 1078272 - DNA, 17 bp, Homo sapiens
gaggcatggccctgggg

SEQ ID NO: 1078273 - DNA, 19 bp, Homo sapiens
gaggcatggggcatgtcct

SEQ ID NO: 1078274 - DNA, 22 bp, Homo sapiens
gaggcattacttgctttcaatt

SEQ ID NO: 1078275 - DNA, 14 bp, Homo sapiens
gaggcattcgggga

SEQ ID NO: 1078276 - DNA, 16 bp, Homo sapiens
gaggcattcggggaag

SEQ ID NO: 1078277 - DNA, 23 bp, Homo sapiens
gaggcattgttagtttagtgtgt

SEQ ID NO: 1078278 - DNA, 19 bp, Homo sapiens
gaggcatttgtttgaactg

SEQ ID NO: 1078279 - DNA, 21 bp, Homo sapiens
gaggcatttgtttgaactgat

SEQ ID NO: 1078280 - DNA, 14 bp, Homo sapiens
gaggccaaccagcc

SEQ ID NO: 1078281 - DNA, 16 bp, Homo sapiens
gaggccaaccagcccg

SEQ ID NO: 1078282 - DNA, 17 bp, Homo sapiens
gaggccaaccagcccga

SEQ ID NO: 1078283 - DNA, 14 bp, Homo sapiens
gaggccaaggcagg

SEQ ID NO: 1078284 - DNA, 16 bp, Homo sapiens
gaggccaaggcaggta

SEQ ID NO: 1078285 - DNA, 15 bp, Homo sapiens
gaggccaagtgcagg

SEQ ID NO: 1078286 - DNA, 17 bp, Homo sapiens
gaggccaagtgcaggct

SEQ ID NO: 1078287 - DNA, 15 bp, Homo sapiens
gaggccaataaaaag

SEQ ID NO: 1078288 - DNA, 17 bp, Homo sapiens
gaggccaataaaaagtt

SEQ ID NO: 1078289 - DNA, 18 bp, Homo sapiens
gaggccacactcagcaca

SEQ ID NO: 1078290 - DNA, 21 bp, Homo sapiens
gaggccacactcagcacaagg

SEQ ID NO: 1078291 - DNA, 14 bp, Homo sapiens
gaggccacctctcc

SEQ ID NO: 1078292 - DNA, 15 bp, Homo sapiens
gaggccacctctcca

SEQ ID NO: 1078293 - DNA, 17 bp, Homo sapiens
gaggccacgtcccaccc

SEQ ID NO: 1078294 - DNA, 18 bp, Homo sapiens
gaggccacgtcccacccc

SEQ ID NO: 1078295 - DNA, 22 bp, Homo sapiens
gaggccactcagaggcccccag

SEQ ID NO: 1078296 - DNA, 22 bp, Homo sapiens
gaggccaggagtttgagaccag

SEQ ID NO: 1078297 - DNA, 22 bp, Homo sapiens
gaggccaggcgagcctgactct

SEQ ID NO: 1078298 - DNA, 11 bp, Homo sapiens
gaggccaggga

SEQ ID NO: 1078299 - DNA, 12 bp, Homo sapiens
gaggccagggat

SEQ ID NO: 1078300 - DNA, 15 bp, Homo sapiens
gaggccagggcagag

SEQ ID NO: 1078301 - DNA, 19 bp, Homo sapiens
gaggccagggcagagtgag

SEQ ID NO: 1078302 - DNA, 15 bp, Homo sapiens
gaggccagggcagca

SEQ ID NO: 1078303 - DNA, 18 bp, Homo sapiens
gaggagcagccaggaccc

SEQ ID NO: 1078304 - DNA, 13 bp, Homo sapiens
gaggagcagcctc

SEQ ID NO: 1078305 - DNA, 21 bp, Homo sapiens
gaggagcagcctcgaggctgg

SEQ ID NO: 1078306 - DNA, 14 bp, Homo sapiens
gaggagcagcttcc

SEQ ID NO: 1078307 - DNA, 23 bp, Homo sapiens
gaggagcagcttccttctgggac

SEQ ID NO: 1078308 - DNA, 16 bp, Homo sapiens
gaggagccaccagttc

SEQ ID NO: 1078309 - DNA, 18 bp, Homo sapiens
gaggagccaccagttctc

SEQ ID NO: 1078310 - DNA, 14 bp, Homo sapiens
gaggagccctgagg

SEQ ID NO: 1078311 - DNA, 12 bp, Homo sapiens
gaggagcctctg

SEQ ID NO: 1078312 - DNA, 18 bp, Homo sapiens
gaggagcctctggcttcc

SEQ ID NO: 1078313 - DNA, 21 bp, Homo sapiens
gaggagccttgctgggccagg

SEQ ID NO: 1078314 - DNA, 22 bp, Homo sapiens
gaggagccttgctgggccaggg

SEQ ID NO: 1078315 - DNA, 13 bp, Homo sapiens
gaggagcgcaggc

SEQ ID NO: 1078316 - DNA, 17 bp, Homo sapiens
gaggagctgagggaggg

SEQ ID NO: 1078317 - DNA, 22 bp, Homo sapiens
gaggagctgcctcttctcttga

SEQ ID NO: 1078318 - DNA, 15 bp, Homo sapiens
gaggagcttggggga

SEQ ID NO: 1078319 - DNA, 16 bp, Homo sapiens
gaggaggaacgggcag

SEQ ID NO: 1078320 - DNA, 17 bp, Homo sapiens
gaggaggaacgggcagc

SEQ ID NO: 1078321 - DNA, 18 bp, Homo sapiens
gaggaggaacgggcagcc

SEQ ID NO: 1078322 - DNA, 16 bp, Homo sapiens
gaggaggacccctgcc

SEQ ID NO: 1078323 - DNA, 18 bp, Homo sapiens
gaggaggacccctgcctt

SEQ ID NO: 1078324 - DNA, 20 bp, Homo sapiens
gaggaggacccctgccttcc

SEQ ID NO: 1078325 - DNA, 12 bp, Homo sapiens
gaggaggagaag

SEQ ID NO: 1078326 - DNA, 13 bp, Homo sapiens
gaggaggagatgg

SEQ ID NO: 1078327 - DNA, 16 bp, Homo sapiens
gaggaggagatggcca

SEQ ID NO: 1078328 - DNA, 14 bp, Homo sapiens
gaggaggaggacac

SEQ ID NO: 1078329 - DNA, 13 bp, Homo sapiens
gaggaggaggagc

SEQ ID NO: 1078330 - DNA, 14 bp, Homo sapiens
gaggaggaggagcc

SEQ ID NO: 1078331 - DNA, 15 bp, Homo sapiens
gaggaggaggagcct

SEQ ID NO: 1078332 - DNA, 13 bp, Homo sapiens
gaggccagtggcc

SEQ ID NO: 1078333 - DNA, 15 bp, Homo sapiens
gaggccagtggcccc

SEQ ID NO: 1078334 - DNA, 16 bp, Homo sapiens
gaggccagtggccccc

SEQ ID NO: 1078335 - DNA, 23 bp, Homo sapiens
gaggccagtggcccccgggcctg

SEQ ID NO: 1078336 - DNA, 14 bp, Homo sapiens
gaggccagtgttgt

SEQ ID NO: 1078337 - DNA, 16 bp, Homo sapiens
gaggccatcagggccc

SEQ ID NO: 1078338 - DNA, 19 bp, Homo sapiens
gaggccatcagggccctgc

SEQ ID NO: 1078339 - DNA, 16 bp, Homo sapiens
gaggccatctcaggag

SEQ ID NO: 1078340 - DNA, 18 bp, Homo sapiens
gaggccatctcaggagat

SEQ ID NO: 1078341 - DNA, 20 bp, Homo sapiens
gaggccatgattcgcccaaa

SEQ ID NO: 1078342 - DNA, 23 bp, Homo sapiens
gaggccatgattcgcccaaagcc

SEQ ID NO: 1078343 - DNA, 12 bp, Homo sapiens
gaggcccaagga

SEQ ID NO: 1078344 - DNA, 13 bp, Homo sapiens
gaggcccaaggag

SEQ ID NO: 1078345 - DNA, 21 bp, Homo sapiens
gaggcccaaggagcttaccca

SEQ ID NO: 1078346 - DNA, 23 bp, Homo sapiens
gaggcccactagagggcccatca

SEQ ID NO: 1078347 - DNA, 19 bp, Homo sapiens
gaggcccagatccaaggcc

SEQ ID NO: 1078348 - DNA, 14 bp, Homo sapiens
gaggcccagcctgt

SEQ ID NO: 1078349 - DNA, 14 bp, Homo sapiens
gaggcccaggcacc

SEQ ID NO: 1078350 - DNA, 15 bp, Homo sapiens
gaggcccaggcacca

SEQ ID NO: 1078351 - DNA, 23 bp, Homo sapiens
gaggcccaggcaccaccaggagc

SEQ ID NO: 1078352 - DNA, 24 bp, Homo sapiens
gaggcccaggcaccaccaggagca

SEQ ID NO: 1078353 - DNA, 23 bp, Homo sapiens
gaggcccaggctgggaactcatc

SEQ ID NO: 1078354 - DNA, 13 bp, Homo sapiens
gaggcccagggag

SEQ ID NO: 1078355 - DNA, 15 bp, Homo sapiens
gaggccccaaccctg

SEQ ID NO: 1078356 - DNA, 14 bp, Homo sapiens
gaggcccccagccc

SEQ ID NO: 1078357 - DNA, 19 bp, Homo sapiens
gaggcccccagcccagggc

SEQ ID NO: 1078358 - DNA, 21 bp, Homo sapiens
gaggcccccagcccagggctc

SEQ ID NO: 1078359 - DNA, 13 bp, Homo sapiens
gaggcccccagtg

SEQ ID NO: 1078360 - DNA, 15 bp, Homo sapiens
gaggcccccagtggg

SEQ ID NO: 1078361 - DNA, 19 bp, Homo sapiens
gaggccctaggcgggatgg

SEQ ID NO: 1078362 - DNA, 14 bp, Homo sapiens
gaggccctgccacg

SEQ ID NO: 1078363 - DNA, 17 bp, Homo sapiens
gaggccctgccacgtcc

SEQ ID NO: 1078364 - DNA, 18 bp, Homo sapiens
gaggccctgcccaatgag

SEQ ID NO: 1078365 - DNA, 14 bp, Homo sapiens
gaggccctgcctga

SEQ ID NO: 1078366 - DNA, 14 bp, Homo sapiens
gaggccctgggctg

SEQ ID NO: 1078367 - DNA, 22 bp, Homo sapiens
gaggccctgtgatatggcggcc

SEQ ID NO: 1078368 - DNA, 17 bp, Homo sapiens
gaggccctgttccctgg

SEQ ID NO: 1078369 - DNA, 14 bp, Homo sapiens
gaggccgaggcagg

SEQ ID NO: 1078370 - DNA, 14 bp, Homo sapiens
gaggccgaggcggg

SEQ ID NO: 1078371 - DNA, 22 bp, Homo sapiens
gaggccgctagaggcctgagga

SEQ ID NO: 1078372 - DNA, 18 bp, Homo sapiens
gaggccgcttagtgctgc

SEQ ID NO: 1078373 - DNA, 18 bp, Homo sapiens
gaggccggagagctggtg

SEQ ID NO: 1078374 - DNA, 13 bp, Homo sapiens
gaggccgggccct

SEQ ID NO: 1078375 - DNA, 19 bp, Homo sapiens
gaggccggggtccaggccc

SEQ ID NO: 1078376 - DNA, 19 bp, Homo sapiens
gaggcctacagaggaggcc

SEQ ID NO: 1078377 - DNA, 18 bp, Homo sapiens
gaggcctaccccgcagac

SEQ ID NO: 1078378 - DNA, 15 bp, Homo sapiens
gaggcctagactctg

SEQ ID NO: 1078379 - DNA, 22 bp, Homo sapiens
gaggcctcaggtgctgtccatg

SEQ ID NO: 1078380 - DNA, 13 bp, Homo sapiens
gaggcctcatccc

SEQ ID NO: 1078381 - DNA, 12 bp, Homo sapiens
gaggcctctggc

SEQ ID NO: 1078382 - DNA, 14 bp, Homo sapiens
gaggcctctggccc

SEQ ID NO: 1078383 - DNA, 16 bp, Homo sapiens
gaggcctctggccctc

SEQ ID NO: 1078384 - DNA, 18 bp, Homo sapiens
gaggcctctggccctcgg

SEQ ID NO: 1078385 - DNA, 18 bp, Homo sapiens
gaggcctgaagccagctg

SEQ ID NO: 1078386 - DNA, 22 bp, Homo sapiens
gaggcctgaagccagctgccct

SEQ ID NO: 1078387 - DNA, 23 bp, Homo sapiens
gaggcctgaagccagctgcccta

SEQ ID NO: 1078388 - DNA, 20 bp, Homo sapiens
gaggcctgacgtgggcatca

SEQ ID NO: 1078389 - DNA, 13 bp, Homo sapiens
gaggcctgaggat

SEQ ID NO: 1078390 - DNA, 21 bp, Homo sapiens
gaggcctgaggatgagctgga

SEQ ID NO: 1078391 - DNA, 23 bp, Homo sapiens
gaggcctgccctcagggatcttg

SEQ ID NO: 1078392 - DNA, 20 bp, Homo sapiens
gaggcctggaccgagatgtg

SEQ ID NO: 1078393 - DNA, 13 bp, Homo sapiens
gaggcctggactt

SEQ ID NO: 1078394 - DNA, 18 bp, Homo sapiens
gaggcctggactttcctg

SEQ ID NO: 1078395 - DNA, 20 bp, Homo sapiens
gaggcctggactttcctgca

SEQ ID NO: 1078396 - DNA, 15 bp, Homo sapiens
gaggcctggccaggc

SEQ ID NO: 1078397 - DNA, 17 bp, Homo sapiens
gaggcctggccaggcac

SEQ ID NO: 1078398 - DNA, 20 bp, Homo sapiens
gaggcctgggccgctgccac

SEQ ID NO: 1078399 - DNA, 12 bp, Homo sapiens
gaggcctggggt

SEQ ID NO: 1078400 - DNA, 14 bp, Homo sapiens
gaggcctgtgctct

SEQ ID NO: 1078401 - DNA, 14 bp, Homo sapiens
gaggccttccagct

SEQ ID NO: 1078402 - DNA, 19 bp, Homo sapiens
gaggccttccagctgctgt

SEQ ID NO: 1078403 - DNA, 20 bp, Homo sapiens
gaggccttcccatggccatt

SEQ ID NO: 1078404 - DNA, 18 bp, Homo sapiens
gaggccttggggtggggg

SEQ ID NO: 1078405 - DNA, 21 bp, Homo sapiens
gaggccttgtgtgtcaggccc

SEQ ID NO: 1078406 - DNA, 14 bp, Homo sapiens
gaggcctttaacca

SEQ ID NO: 1078407 - DNA, 18 bp, Homo sapiens
gaggcgagtcaccctcct

SEQ ID NO: 1078408 - DNA, 14 bp, Homo sapiens
gaggcgcagggaca

SEQ ID NO: 1078409 - DNA, 19 bp, Homo sapiens
gaggcggagagtacagtga

SEQ ID NO: 1078410 - DNA, 19 bp, Homo sapiens
gaggcggaggctgtgctcc

SEQ ID NO: 1078411 - DNA, 15 bp, Homo sapiens
gaggcgggagaatca

SEQ ID NO: 1078412 - DNA, 13 bp, Homo sapiens
gaggcgggccagc

SEQ ID NO: 1078413 - DNA, 15 bp, Homo sapiens
gaggcggggaggagg

SEQ ID NO: 1078414 - DNA, 19 bp, Homo sapiens
gaggcgggtggatcacttg

SEQ ID NO: 1078415 - DNA, 14 bp, Homo sapiens
gaggcgtgcccccc

SEQ ID NO: 1078416 - DNA, 18 bp, Homo sapiens
gaggctgtgtctctgcca

SEQ ID NO: 1078417 - DNA, 21 bp, Homo sapiens
gaggctgtgtgcctgggggag

SEQ ID NO: 1078418 - DNA, 16 bp, Homo sapiens
gaggcttccagagagt

SEQ ID NO: 1078419 - DNA, 20 bp, Homo sapiens
gaggcttccaggctcttcct

SEQ ID NO: 1078420 - DNA, 13 bp, Homo sapiens
gaggcttcctgcg

SEQ ID NO: 1078421 - DNA, 21 bp, Homo sapiens
gaggcttctccgccagcctcc

SEQ ID NO: 1078422 - DNA, 22 bp, Homo sapiens
gaggcttctccgccagcctcct

SEQ ID NO: 1078423 - DNA, 15 bp, Homo sapiens
gaggcttggaaagca

SEQ ID NO: 1078424 - DNA, 16 bp, Homo sapiens
gagggaaaagggaagt

SEQ ID NO: 1078425 - DNA, 13 bp, Homo sapiens
gagggaaaccttt

SEQ ID NO: 1078426 - DNA, 20 bp, Homo sapiens
gagggaaatctgtaaagcca

SEQ ID NO: 1078427 - DNA, 18 bp, Homo sapiens
gagggaagagggagacca

SEQ ID NO: 1078428 - DNA, 20 bp, Homo sapiens
gagggaagagtggaggtgga

SEQ ID NO: 1078429 - DNA, 14 bp, Homo sapiens
gagggaagggccac

SEQ ID NO: 1078430 - DNA, 21 bp, Homo sapiens
gagggaaggggatggaggcca

SEQ ID NO: 1078431 - DNA, 19 bp, Homo sapiens
gagggaagggtttctctat

SEQ ID NO: 1078432 - DNA, 17 bp, Homo sapiens
gagggaaggttcttcat

SEQ ID NO: 1078433 - DNA, 15 bp, Homo sapiens
gagggaagtggaggt

SEQ ID NO: 1078434 - DNA, 19 bp, Homo sapiens
gagggaatgttccctgcac

SEQ ID NO: 1078435 - DNA, 21 bp, Homo sapiens
gagggaatgttccctgcaccc

SEQ ID NO: 1078436 - DNA, 13 bp, Homo sapiens
gagggacaggctg

SEQ ID NO: 1078437 - DNA, 14 bp, Homo sapiens
gagggacaggctga

SEQ ID NO: 1078438 - DNA, 18 bp, Homo sapiens
gagggacaggctgaagag

SEQ ID NO: 1078439 - DNA, 20 bp, Homo sapiens
gagggacaggctgaagagag

SEQ ID NO: 1078440 - DNA, 21 bp, Homo sapiens
gagggacaggctgaagagagg

SEQ ID NO: 1078441 - DNA, 16 bp, Homo sapiens
gagggacagggcaggc

SEQ ID NO: 1078442 - DNA, 18 bp, Homo sapiens
gagggaccaaattgcttc

SEQ ID NO: 1078443 - DNA, 20 bp, Homo sapiens
gagggaccaaattgcttcta

SEQ ID NO: 1078444 - DNA, 17 bp, Homo sapiens
gagggaccaactgggcc

SEQ ID NO: 1078445 - DNA, 18 bp, Homo sapiens
gagggaccaactgggccc

SEQ ID NO: 1078446 - DNA, 19 bp, Homo sapiens
gagggacccttcgagatca

SEQ ID NO: 1078447 - DNA, 13 bp, Homo sapiens
gagggacctctcc

SEQ ID NO: 1078448 - DNA, 15 bp, Homo sapiens
gagggacctctccca

SEQ ID NO: 1078449 - DNA, 15 bp, Homo sapiens
gagggacgcggagga

SEQ ID NO: 1078450 - DNA, 17 bp, Homo sapiens
gagggacgcggaggagg

SEQ ID NO: 1078451 - DNA, 18 bp, Homo sapiens
gagggacgcggaggagga

SEQ ID NO: 1078452 - DNA, 20 bp, Homo sapiens
gagggacgcggaggaggaag

SEQ ID NO: 1078453 - DNA, 12 bp, Homo sapiens
gagggagaaagg

SEQ ID NO: 1078454 - DNA, 16 bp, Homo sapiens
gagggagaacaagacc

SEQ ID NO: 1078455 - DNA, 15 bp, Homo sapiens
gagggagagagagag

SEQ ID NO: 1078456 - DNA, 16 bp, Homo sapiens
gagggagagagagaga

SEQ ID NO: 1078457 - DNA, 20 bp, Homo sapiens
gagggagcagacaggaggaa

SEQ ID NO: 1078458 - DNA, 13 bp, Homo sapiens
gagggagcgacac

SEQ ID NO: 1078459 - DNA, 22 bp, Homo sapiens
gagggagcgacacttgaatgta

SEQ ID NO: 1078460 - DNA, 16 bp, Homo sapiens
gagggagctgctggct

SEQ ID NO: 1078461 - DNA, 13 bp, Homo sapiens
gagggaggacctg

SEQ ID NO: 1078462 - DNA, 17 bp, Homo sapiens
gagggaggcaagccctg

SEQ ID NO: 1078463 - DNA, 15 bp, Homo sapiens
gagggaggcggggag

SEQ ID NO: 1078464 - DNA, 17 bp, Homo sapiens
gagggaggggaaatgta

SEQ ID NO: 1078465 - DNA, 14 bp, Homo sapiens
gagggaggggacag

SEQ ID NO: 1078466 - DNA, 18 bp, Homo sapiens
gagggaggggacagaggc

SEQ ID NO: 1078467 - DNA, 19 bp, Homo sapiens
gagggaggggacagaggcc

SEQ ID NO: 1078468 - DNA, 13 bp, Homo sapiens
gagggagggggct

SEQ ID NO: 1078469 - DNA, 18 bp, Homo sapiens
gagggaggtgtttaaaga

SEQ ID NO: 1078470 - DNA, 15 bp, Homo sapiens
gagggagtagaatac

SEQ ID NO: 1078471 - DNA, 14 bp, Homo sapiens
gagggagtcccaga

SEQ ID NO: 1078472 - DNA, 17 bp, Homo sapiens
gagggagtctcaggagg

SEQ ID NO: 1078473 - DNA, 22 bp, Homo sapiens
gagggagtctcaggaggaggct

SEQ ID NO: 1078474 - DNA, 19 bp, Homo sapiens
gagggagtgcagaacacct

SEQ ID NO: 1078475 - DNA, 20 bp, Homo sapiens
gagggagtggcacttctgcc

SEQ ID NO: 1078476 - DNA, 22 bp, Homo sapiens
gagggagtttaatacaggaaat

SEQ ID NO: 1078477 - DNA, 16 bp, Homo sapiens
gagggagttttgtctg

SEQ ID NO: 1078478 - DNA, 22 bp, Homo sapiens
gagggagttttgtctgtctccc

SEQ ID NO: 1078479 - DNA, 21 bp, Homo sapiens
gagggataaccccaggcactg

SEQ ID NO: 1078480 - DNA, 15 bp, Homo sapiens
gagggatacaagaga

SEQ ID NO: 1078481 - DNA, 13 bp, Homo sapiens
gagggatcagccc

SEQ ID NO: 1078482 - DNA, 15 bp, Homo sapiens
gagggatgcccccag

SEQ ID NO: 1078483 - DNA, 18 bp, Homo sapiens
gagggatgcccccaggca

SEQ ID NO: 1078484 - DNA, 17 bp, Homo sapiens
gagggatgctgcctgag

SEQ ID NO: 1078485 - DNA, 15 bp, Homo sapiens
gagggatggagaaag

SEQ ID NO: 1078486 - DNA, 18 bp, Homo sapiens
gagggatggagaaagaag

SEQ ID NO: 1078487 - DNA, 13 bp, Homo sapiens
gagggatggagag

SEQ ID NO: 1078488 - DNA, 18 bp, Homo sapiens
gagggattctggttccag

SEQ ID NO: 1078489 - DNA, 17 bp, Homo sapiens
gagggattggggtggac

SEQ ID NO: 1078490 - DNA, 21 bp, Homo sapiens
gagggattttagcctcttccc

SEQ ID NO: 1078491 - DNA, 13 bp, Homo sapiens
gagggcaagccac

SEQ ID NO: 1078492 - DNA, 22 bp, Homo sapiens
gagggcaagggccatgctgaag

SEQ ID NO: 1078493 - DNA, 16 bp, Homo sapiens
gagggcacatctccag

SEQ ID NO: 1078494 - DNA, 18 bp, Homo sapiens
gagggcactggtggcccg

SEQ ID NO: 1078495 - DNA, 14 bp, Homo sapiens
gagggcacttcagg

SEQ ID NO: 1078496 - DNA, 13 bp, Homo sapiens
gagggggtgagag

SEQ ID NO: 1078497 - DNA, 15 bp, Homo sapiens
gagggggtgagaggc

SEQ ID NO: 1078498 - DNA, 22 bp, Homo sapiens
gagggggtgagaggcaggaatg

SEQ ID NO: 1078499 - DNA, 14 bp, Homo sapiens
gaggggtctcggat

SEQ ID NO: 1078500 - DNA, 16 bp, Homo sapiens
gaggggtctcggatga

SEQ ID NO: 1078501 - DNA, 19 bp, Homo sapiens
gaggggtgcggcggtccca

SEQ ID NO: 1078502 - DNA, 23 bp, Homo sapiens
gaggggtgtccgagaggctggtg

SEQ ID NO: 1078503 - DNA, 13 bp, Homo sapiens
gagggtaactggg

SEQ ID NO: 1078504 - DNA, 20 bp, Homo sapiens
gagggtaactggggggccac

SEQ ID NO: 1078505 - DNA, 17 bp, Homo sapiens
gagggtcaccctggcct

SEQ ID NO: 1078506 - DNA, 19 bp, Homo sapiens
gagggtcaggactgtgact

SEQ ID NO: 1078507 - DNA, 12 bp, Homo sapiens
gagggtcccagg

SEQ ID NO: 1078508 - DNA, 15 bp, Homo sapiens
gagggtctcccctcc

SEQ ID NO: 1078509 - DNA, 17 bp, Homo sapiens
gagggtctcccctcctg

SEQ ID NO: 1078510 - DNA, 19 bp, Homo sapiens
gagggtctcccctcctgca

SEQ ID NO: 1078511 - DNA, 15 bp, Homo sapiens
gagggtctggagaag

SEQ ID NO: 1078512 - DNA, 24 bp, Homo sapiens
gagggtctggagaagcagtgagcc

SEQ ID NO: 1078513 - DNA, 16 bp, Homo sapiens
gagggtctgggggcag

SEQ ID NO: 1078514 - DNA, 19 bp, Homo sapiens
gagggtcttgaggggaagc

SEQ ID NO: 1078515 - DNA, 20 bp, Homo sapiens
gagggtgacccacagctctg

SEQ ID NO: 1078516 - DNA, 23 bp, Homo sapiens
gagggtgacccacagctctgggc

SEQ ID NO: 1078517 - DNA, 15 bp, Homo sapiens
gagggtgataaatct

SEQ ID NO: 1078518 - DNA, 18 bp, Homo sapiens
gagggtgatggggctgag

SEQ ID NO: 1078519 - DNA, 21 bp, Homo sapiens
gagggtgcagccctcttgccc

SEQ ID NO: 1078520 - DNA, 20 bp, Homo sapiens
gagggtggatcacacctcag

SEQ ID NO: 1078521 - DNA, 13 bp, Homo sapiens
gagggtgggaagg

SEQ ID NO: 1078522 - DNA, 18 bp, Homo sapiens
gagggtgggagagcccag

SEQ ID NO: 1078523 - DNA, 19 bp, Homo sapiens
gagggtgggagagcccagc

SEQ ID NO: 1078524 - DNA, 15 bp, Homo sapiens
gagggtgggccagca

SEQ ID NO: 1078525 - DNA, 22 bp, Homo sapiens
gagggtgggggccacctgcctg

SEQ ID NO: 1078526 - DNA, 22 bp, Homo sapiens
gagggtgtggctttccaggcac

SEQ ID NO: 1078527 - DNA, 19 bp, Homo sapiens
gagggttagcctgcaccgc

SEQ ID NO: 1078528 - DNA, 15 bp, Homo sapiens
gagggttctaagtgg

SEQ ID NO: 1078529 - DNA, 19 bp, Homo sapiens
gagggttgggaggtttctt

SEQ ID NO: 1078530 - DNA, 14 bp, Homo sapiens
gagggttggggagg

SEQ ID NO: 1078531 - DNA, 21 bp, Homo sapiens
gagggtttctgatctgtactt

SEQ ID NO: 1078532 - DNA, 16 bp, Homo sapiens
gaggtactgagacagg

SEQ ID NO: 1078533 - DNA, 18 bp, Homo sapiens
gaggtactgagacagggt

SEQ ID NO: 1078534 - DNA, 17 bp, Homo sapiens
gaggtactggtcccttc

SEQ ID NO: 1078535 - DNA, 12 bp, Homo sapiens
gaggtactgtaa

SEQ ID NO: 1078536 - DNA, 19 bp, Homo sapiens
gaggtagcgagctgctctg

SEQ ID NO: 1078537 - DNA, 21 bp, Homo sapiens
gaggtagcgagctgctctgct

SEQ ID NO: 1078538 - DNA, 20 bp, Homo sapiens
gaggtaggctgtggggtggg

SEQ ID NO: 1078539 - DNA, 17 bp, Homo sapiens
gaggtaggggtggggag

SEQ ID NO: 1078540 - DNA, 18 bp, Homo sapiens
gaggtatcttactttcct

SEQ ID NO: 1078541 - DNA, 15 bp, Homo sapiens
gaggtatggcagagg

SEQ ID NO: 1078542 - DNA, 17 bp, Homo sapiens
gaggtatggccatgccc

SEQ ID NO: 1078543 - DNA, 15 bp, Homo sapiens
gaggtcaacagagaa

SEQ ID NO: 1078544 - DNA, 17 bp, Homo sapiens
gaggtcaaggctgcagt

SEQ ID NO: 1078545 - DNA, 19 bp, Homo sapiens
gaggtcaaggctgcagtga

SEQ ID NO: 1078546 - DNA, 21 bp, Homo sapiens
gaggtcaataaagcagagcca

SEQ ID NO: 1078547 - DNA, 13 bp, Homo sapiens
gaggtcaccagct

SEQ ID NO: 1078548 - DNA, 15 bp, Homo sapiens
gaggtcaccagctgc

SEQ ID NO: 1078549 - DNA, 22 bp, Homo sapiens
gaggtcaccagctgctgtgccc

SEQ ID NO: 1078550 - DNA, 16 bp, Homo sapiens
gaggtcagaggagggc

SEQ ID NO: 1078551 - DNA, 23 bp, Homo sapiens
gaggtcagcatgtctattcagct

SEQ ID NO: 1078552 - DNA, 21 bp, Homo sapiens
gaggtcaggacggctcctcag

SEQ ID NO: 1078553 - DNA, 22 bp, Homo sapiens
gaggtcagggagtgctggctca

SEQ ID NO: 1078554 - DNA, 19 bp, Homo sapiens
gaggtccaagattctggag

SEQ ID NO: 1078555 - DNA, 12 bp, Homo sapiens
gaggtccaagca

SEQ ID NO: 1078556 - DNA, 14 bp, Homo sapiens
gaggtccaagcaga

SEQ ID NO: 1078557 - DNA, 19 bp, Homo sapiens
gaggtccaccggcccctgg

SEQ ID NO: 1078558 - DNA, 12 bp, Homo sapiens
gaggtccagccc

SEQ ID NO: 1078559 - DNA, 20 bp, Homo sapiens
gaggtccccggttgctggtc

SEQ ID NO: 1078560 - DNA, 23 bp, Homo sapiens
gaggtccccggttgctggtcagg

SEQ ID NO: 1078561 - DNA, 22 bp, Homo sapiens
gaggtcccctcgtcccatccag

SEQ ID NO: 1078562 - DNA, 13 bp, Homo sapiens
gaggtcccttcaa

SEQ ID NO: 1078563 - DNA, 19 bp, Homo sapiens
gaggtcccttcaaggcctc

SEQ ID NO: 1078564 - DNA, 13 bp, Homo sapiens
gaggtcctcaggt

SEQ ID NO: 1078565 - DNA, 17 bp, Homo sapiens
gaggtcctcaggtcagc

SEQ ID NO: 1078566 - DNA, 19 bp, Homo sapiens
gaggtcctcaggtcagctg

SEQ ID NO: 1078567 - DNA, 12 bp, Homo sapiens
gaggtccttggt

SEQ ID NO: 1078568 - DNA, 21 bp, Homo sapiens
gaggtcggtaggttcagccaa

SEQ ID NO: 1078569 - DNA, 21 bp, Homo sapiens
gaggtctcaggttctttccat

SEQ ID NO: 1078570 - DNA, 15 bp, Homo sapiens
gaggtctgagccctg

SEQ ID NO: 1078571 - DNA, 19 bp, Homo sapiens
gaggtctgtgctgaggcct

SEQ ID NO: 1078572 - DNA, 16 bp, Homo sapiens
gaggtctgttcctttt

SEQ ID NO: 1078573 - DNA, 13 bp, Homo sapiens
gaggtctgttctt

SEQ ID NO: 1078574 - DNA, 18 bp, Homo sapiens
gaggtctttctcctcagg

SEQ ID NO: 1078575 - DNA, 22 bp, Homo sapiens
gaggtctttctcctcaggacaa

SEQ ID NO: 1078576 - DNA, 19 bp, Homo sapiens
gaggtcttttgacatgtgg

SEQ ID NO: 1078577 - DNA, 22 bp, Homo sapiens
gaggtcttttgacatgtggaaa

SEQ ID NO: 1078578 - DNA, 15 bp, Homo sapiens
gaggtgaatttcatt

SEQ ID NO: 1078579 - DNA, 21 bp, Homo sapiens
gaggtgacaaaccatttccaa

SEQ ID NO: 1078580 - DNA, 16 bp, Homo sapiens
gaggtgaggagcagag

SEQ ID NO: 1078581 - DNA, 18 bp, Homo sapiens
gaggtgatgggtgcagga

SEQ ID NO: 1078582 - DNA, 15 bp, Homo sapiens
gaggtgcaaggagtg

SEQ ID NO: 1078583 - DNA, 20 bp, Homo sapiens
gaggtgccagcaactgaata

SEQ ID NO: 1078584 - DNA, 14 bp, Homo sapiens
gaggtgcctgctca

SEQ ID NO: 1078585 - DNA, 19 bp, Homo sapiens
gaggtgcctgctcaggtgc

SEQ ID NO: 1078586 - DNA, 15 bp, Homo sapiens
gaggtgcctgtccca

SEQ ID NO: 1078587 - DNA, 19 bp, Homo sapiens
gaggtgcgtgttcagcaga

SEQ ID NO: 1078588 - DNA, 24 bp, Homo sapiens
gaggtgcgtgttcagcagaacctg

SEQ ID NO: 1078589 - DNA, 20 bp, Homo sapiens
gaggtgctggtagctgaggg

SEQ ID NO: 1078590 - DNA, 20 bp, Homo sapiens
gaggtgcttaagcagaagca

SEQ ID NO: 1078591 - DNA, 16 bp, Homo sapiens
gaggtggaagaaggga

SEQ ID NO: 1078592 - DNA, 17 bp, Homo sapiens
gaggtggaagaagggag

SEQ ID NO: 1078593 - DNA, 20 bp, Homo sapiens
gaggtggaagccctccttcc

SEQ ID NO: 1078594 - DNA, 16 bp, Homo sapiens
gaggtggagggaggga

SEQ ID NO: 1078595 - DNA, 20 bp, Homo sapiens
gaggtggatcacagaggctt

SEQ ID NO: 1078596 - DNA, 22 bp, Homo sapiens
gaggtggatgttatgaacagct

SEQ ID NO: 1078597 - DNA, 21 bp, Homo sapiens
gaggtggattccgagtggtga

SEQ ID NO: 1078598 - DNA, 15 bp, Homo sapiens
gaggtggcagccctg

SEQ ID NO: 1078599 - DNA, 16 bp, Homo sapiens
gaggtggcagccctgt

SEQ ID NO: 1078600 - DNA, 22 bp, Homo sapiens
gaggtggccagagctgggaggc

SEQ ID NO: 1078601 - DNA, 21 bp, Homo sapiens
gaggtggccatgttatgctgg

SEQ ID NO: 1078602 - DNA, 20 bp, Homo sapiens
gaggtggcccaggcccccgg

SEQ ID NO: 1078603 - DNA, 13 bp, Homo sapiens
gaggtggcccttg

SEQ ID NO: 1078604 - DNA, 18 bp, Homo sapiens
gaggtggctgcgccccca

SEQ ID NO: 1078605 - DNA, 11 bp, Homo sapiens
gaggtgggagg

SEQ ID NO: 1078606 - DNA, 16 bp, Homo sapiens
gaggtgggaggccagg

SEQ ID NO: 1078607 - DNA, 13 bp, Homo sapiens
gaggtgggagggc

SEQ ID NO: 1078608 - DNA, 15 bp, Homo sapiens
gaggtgggaggtgga

SEQ ID NO: 1078609 - DNA, 17 bp, Homo sapiens
gaggtgggatcctccct

SEQ ID NO: 1078610 - DNA, 11 bp, Homo sapiens
gaggtgggcag

SEQ ID NO: 1078611 - DNA, 18 bp, Homo sapiens
gaggtgggcagctgggcc

SEQ ID NO: 1078612 - DNA, 19 bp, Homo sapiens
gaggtgggcagctgggccc

SEQ ID NO: 1078613 - DNA, 14 bp, Homo sapiens
gaggtgggcaggtg

SEQ ID NO: 1078614 - DNA, 21 bp, Homo sapiens
gaggtgggcaggtggtggcac

SEQ ID NO: 1078615 - DNA, 11 bp, Homo sapiens
gaggtgggcat

SEQ ID NO: 1078616 - DNA, 19 bp, Homo sapiens
gaggtgggcatgccaccct

SEQ ID NO: 1078617 - DNA, 20 bp, Homo sapiens
gaggtgggcatgccaccctc

SEQ ID NO: 1078618 - DNA, 22 bp, Homo sapiens
gaggtgggcccaggaccagctg

SEQ ID NO: 1078619 - DNA, 16 bp, Homo sapiens
gaggtgggctggggct

SEQ ID NO: 1078620 - DNA, 22 bp, Homo sapiens
gaggtgggggctggaggtgctg

SEQ ID NO: 1078621 - DNA, 23 bp, Homo sapiens
gaggtgggggttttggggtgggc

SEQ ID NO: 1078622 - DNA, 15 bp, Homo sapiens
gaggtggggttggga

SEQ ID NO: 1078623 - DNA, 20 bp, Homo sapiens
gaggtggtggagtggagtga

SEQ ID NO: 1078624 - DNA, 15 bp, Homo sapiens
gaggtgtcaccctgc

SEQ ID NO: 1078625 - DNA, 20 bp, Homo sapiens
gaggtgtcaccctgcagagc

SEQ ID NO: 1078626 - DNA, 21 bp, Homo sapiens
gaggtgtcaccctgcagagct

SEQ ID NO: 1078627 - DNA, 22 bp, Homo sapiens
gaggtgtcaccctgcagagcta

SEQ ID NO: 1078628 - DNA, 14 bp, Homo sapiens
gaggtgtcatgctt

SEQ ID NO: 1078629 - DNA, 16 bp, Homo sapiens
gaggtgtggagccgag

SEQ ID NO: 1078630 - DNA, 17 bp, Homo sapiens
gaggtgttacagaggac

SEQ ID NO: 1078631 - DNA, 16 bp, Homo sapiens
gaggttaaaaagaaaa

SEQ ID NO: 1078632 - DNA, 14 bp, Homo sapiens
gaggttaaggtggg

SEQ ID NO: 1078633 - DNA, 13 bp, Homo sapiens
gaggttataggtc

SEQ ID NO: 1078634 - DNA, 19 bp, Homo sapiens
gaggttcaaagatattttg

SEQ ID NO: 1078635 - DNA, 14 bp, Homo sapiens
gaggttcccagggc

SEQ ID NO: 1078636 - DNA, 19 bp, Homo sapiens
gaggttcctctgcctgccc

SEQ ID NO: 1078637 - DNA, 16 bp, Homo sapiens
gaggttctcagagcca

SEQ ID NO: 1078638 - DNA, 19 bp, Homo sapiens
gaggttctcagagccaagt

SEQ ID NO: 1078639 - DNA, 20 bp, Homo sapiens
gaggttctgtattttaagaa

SEQ ID NO: 1078640 - DNA, 13 bp, Homo sapiens
gaggttgaagcca

SEQ ID NO: 1078641 - DNA, 13 bp, Homo sapiens
gaggttgagtgag

SEQ ID NO: 1078642 - DNA, 15 bp, Homo sapiens
gaggttgcagcatga

SEQ ID NO: 1078643 - DNA, 13 bp, Homo sapiens
gaggttgcagtga

SEQ ID NO: 1078644 - DNA, 15 bp, Homo sapiens
gaggttgcagtgagc

SEQ ID NO: 1078645 - DNA, 19 bp, Homo sapiens
gaggttgggggaaccagca

SEQ ID NO: 1078646 - DNA, 17 bp, Homo sapiens
gaggttggggtgtacta

SEQ ID NO: 1078647 - DNA, 14 bp, Homo sapiens
gaggttgggtgggc

SEQ ID NO: 1078648 - DNA, 13 bp, Homo sapiens
gaggttgtgcatg

SEQ ID NO: 1078649 - DNA, 17 bp, Homo sapiens
gaggttgtggggaggct

SEQ ID NO: 1078650 - DNA, 19 bp, Homo sapiens
gaggtttagatgtgcaacc

SEQ ID NO: 1078651 - DNA, 16 bp, Homo sapiens
gaggtttcaaacctcc

SEQ ID NO: 1078652 - DNA, 11 bp, Homo sapiens
gaggtttctgg

SEQ ID NO: 1078653 - DNA, 23 bp, Homo sapiens
gaggtttgtcgggcaccagccag

SEQ ID NO: 1078654 - DNA, 18 bp, Homo sapiens
gaggttttaatgtctgtt

SEQ ID NO: 1078655 - DNA, 21 bp, Homo sapiens
gaggttttatttcatttttca

SEQ ID NO: 1078656 - DNA, 21 bp, Homo sapiens
gaggttttgaataaaaagtga

SEQ ID NO: 1078657 - DNA, 16 bp, Homo sapiens
gaggtttttcttggga

SEQ ID NO: 1078658 - DNA, 20 bp, Homo sapiens
gaggtttttcttgggaaaga

SEQ ID NO: 1078659 - DNA, 17 bp, Homo sapiens
gagtaaaacattttatt

SEQ ID NO: 1078660 - DNA, 21 bp, Homo sapiens
gagtaaaacattttatttctt

SEQ ID NO: 1078661 - DNA, 16 bp, Homo sapiens
gagtaaacagacagct

SEQ ID NO: 1078662 - DNA, 15 bp, Homo sapiens
gagtaaacttgaaaa

SEQ ID NO: 1078663 - DNA, 18 bp, Homo sapiens
gagtaaataattggaaaa

SEQ ID NO: 1078664 - DNA, 18 bp, Homo sapiens
gagtaaatatatatgtca

SEQ ID NO: 1078665 - DNA, 20 bp, Homo sapiens
gagtaacaatacaaatggat

SEQ ID NO: 1078666 - DNA, 17 bp, Homo sapiens
gagtaacatttgctgtt

SEQ ID NO: 1078667 - DNA, 22 bp, Homo sapiens
gataatgttctttaatgttgtc

SEQ ID NO: 1078668 - DNA, 23 bp, Homo sapiens
gataattacgtttaaagtgcagt

SEQ ID NO: 1078669 - DNA, 19 bp, Homo sapiens
gataattagatgattatat

SEQ ID NO: 1078670 - DNA, 21 bp, Homo sapiens
gataattagatgattatatat

SEQ ID NO: 1078671 - DNA, 16 bp, Homo sapiens
gataattcatttgtat

SEQ ID NO: 1078672 - DNA, 20 bp, Homo sapiens
gataattcatttgtattgct

SEQ ID NO: 1078673 - DNA, 14 bp, Homo sapiens
gataattccttggt

SEQ ID NO: 1078674 - DNA, 14 bp, Homo sapiens
gataattgctattt

SEQ ID NO: 1078675 - DNA, 14 bp, Homo sapiens
gataattgtgtatt

SEQ ID NO: 1078676 - DNA, 22 bp, Homo sapiens
gataattgtgtattttctttgg

SEQ ID NO: 1078677 - DNA, 14 bp, Homo sapiens
gataatttcaggga

SEQ ID NO: 1078678 - DNA, 22 bp, Homo sapiens
gataatttcagggaaattaatc

SEQ ID NO: 1078679 - DNA, 18 bp, Homo sapiens
gataattttaaattctct

SEQ ID NO: 1078680 - DNA, 13 bp, Homo sapiens
gataattttacaa

SEQ ID NO: 1078681 - DNA, 22 bp, Homo sapiens
gataattttatttataaactag

SEQ ID NO: 1078682 - DNA, 16 bp, Homo sapiens
gatacaaatgtctatc

SEQ ID NO: 1078683 - DNA, 19 bp, Homo sapiens
gatacaccgggcctggaga

SEQ ID NO: 1078684 - DNA, 23 bp, Homo sapiens
gatacactcaagcatgaagataa

SEQ ID NO: 1078685 - DNA, 22 bp, Homo sapiens
gatacagaagcccatgtcttct

SEQ ID NO: 1078686 - DNA, 13 bp, Homo sapiens
gatacagagccac

SEQ ID NO: 1078687 - DNA, 19 bp, Homo sapiens
gatacaggaaaaatgaaaa

SEQ ID NO: 1078688 - DNA, 19 bp, Homo sapiens
gatacagttttcagaaaaa

SEQ ID NO: 1078689 - DNA, 13 bp, Homo sapiens
gatacataataaa

SEQ ID NO: 1078690 - DNA, 17 bp, Homo sapiens
gatacatccaaagcaga

SEQ ID NO: 1078691 - DNA, 12 bp, Homo sapiens
gatacatctgct

SEQ ID NO: 1078692 - DNA, 14 bp, Homo sapiens
gatacatctgctgt

SEQ ID NO: 1078693 - DNA, 16 bp, Homo sapiens
gatacatctgctgtgt

SEQ ID NO: 1078694 - DNA, 14 bp, Homo sapiens
gatacatttaataa

SEQ ID NO: 1078695 - DNA, 16 bp, Homo sapiens
gatacatttaataaaa

SEQ ID NO: 1078696 - DNA, 12 bp, Homo sapiens
gatacatttctg

SEQ ID NO: 1078697 - DNA, 11 bp, Homo sapiens
gatacattttt

SEQ ID NO: 1078698 - DNA, 22 bp, Homo sapiens
gataccacaaaccctgctgaac

SEQ ID NO: 1078699 - DNA, 17 bp, Homo sapiens
gataccagacctcttct

SEQ ID NO: 1078700 - DNA, 16 bp, Homo sapiens
gataccagaggaagtt

SEQ ID NO: 1078701 - DNA, 15 bp, Homo sapiens
gataccagctcaggg

SEQ ID NO: 1078702 - DNA, 16 bp, Homo sapiens
gatacccaacagttta

SEQ ID NO: 1078703 - DNA, 18 bp, Homo sapiens
gatacccaggaccaagcc

SEQ ID NO: 1078704 - DNA, 21 bp, Homo sapiens
gatacccccctctgtcttgtg

SEQ ID NO: 1078705 - DNA, 20 bp, Homo sapiens
gatacctcatcatccacccg

SEQ ID NO: 1078706 - DNA, 20 bp, Homo sapiens
gatactaaaagttcttctcc

SEQ ID NO: 1078707 - DNA, 22 bp, Homo sapiens
gatactaaaagttcttctccaa

SEQ ID NO: 1078708 - DNA, 14 bp, Homo sapiens
gatactaaagcaaa

SEQ ID NO: 1078709 - DNA, 19 bp, Homo sapiens
gatactaaatctggggttc

SEQ ID NO: 1078710 - DNA, 13 bp, Homo sapiens
gatactaaggacg

SEQ ID NO: 1078711 - DNA, 18 bp, Homo sapiens
gatactacaacttttgtt

SEQ ID NO: 1078712 - DNA, 14 bp, Homo sapiens
gatactcatttctt

SEQ ID NO: 1078713 - DNA, 13 bp, Homo sapiens
gatactctgtcag

SEQ ID NO: 1078714 - DNA, 14 bp, Homo sapiens
gatactgcaaaggc

SEQ ID NO: 1078715 - DNA, 15 bp, Homo sapiens
gatactgcccggggc

SEQ ID NO: 1078716 - DNA, 19 bp, Homo sapiens
gatactgcgactttctgcc

SEQ ID NO: 1078717 - DNA, 21 bp, Homo sapiens
gatactgcgactttctgcctg

SEQ ID NO: 1078718 - DNA, 16 bp, Homo sapiens
gatactggaagttttg

SEQ ID NO: 1078719 - DNA, 23 bp, Homo sapiens
gatactgtttcttgcactgaata

SEQ ID NO: 1078720 - DNA, 22 bp, Homo sapiens
gatacttacatttccatttatt

SEQ ID NO: 1078721 - DNA, 22 bp, Homo sapiens
gatacttagtggtatgtctctt

SEQ ID NO: 1078722 - DNA, 20 bp, Homo sapiens
gatacttcaggtgcttttga

SEQ ID NO: 1078723 - DNA, 21 bp, Homo sapiens
gatacttcaggtgcttttgat

SEQ ID NO: 1078724 - DNA, 14 bp, Homo sapiens
gatagaaataaata

SEQ ID NO: 1078725 - DNA, 20 bp, Homo sapiens
gatagaaataaatagctata

SEQ ID NO: 1078726 - DNA, 22 bp, Homo sapiens
gatagaactttgccagtcttta

SEQ ID NO: 1078727 - DNA, 23 bp, Homo sapiens
gatagaactttgccagtctttaa

SEQ ID NO: 1078728 - DNA, 12 bp, Homo sapiens
gatagaatgaca

SEQ ID NO: 1078729 - DNA, 13 bp, Homo sapiens
gatagacactgga

SEQ ID NO: 1078730 - DNA, 16 bp, Homo sapiens
gatagacactggacat

SEQ ID NO: 1078731 - DNA, 19 bp, Homo sapiens
gatagacactggacatggc

SEQ ID NO: 1078732 - DNA, 15 bp, Homo sapiens
gatagacttgggatg

SEQ ID NO: 1078733 - DNA, 22 bp, Homo sapiens
gatagaggaaagggatggtaag

SEQ ID NO: 1078734 - DNA, 15 bp, Homo sapiens
gatagatttggaata

SEQ ID NO: 1078735 - DNA, 22 bp, Homo sapiens
gatagattttctgctactttgc

SEQ ID NO: 1078736 - DNA, 20 bp, Homo sapiens
gatagcactttctacaatgt

SEQ ID NO: 1078737 - DNA, 13 bp, Homo sapiens
gatagcattgctt

SEQ ID NO: 1078738 - DNA, 17 bp, Homo sapiens
gatagcatttttgattt

SEQ ID NO: 1078739 - DNA, 15 bp, Homo sapiens
gatagccctgtcctg

SEQ ID NO: 1078740 - DNA, 17 bp, Homo sapiens
gatagccctgtcctggt

SEQ ID NO: 1078741 - DNA, 18 bp, Homo sapiens
gatagctaacattttaaa

SEQ ID NO: 1078742 - DNA, 19 bp, Homo sapiens
gatagctaactgtaaatca

SEQ ID NO: 1078743 - DNA, 15 bp, Homo sapiens
gatagctattaagat

SEQ ID NO: 1078744 - DNA, 20 bp, Homo sapiens
gatagcttacactgaggact

SEQ ID NO: 1078745 - DNA, 23 bp, Homo sapiens
gatagcttcaccccaatcccagc

SEQ ID NO: 1078746 - DNA, 15 bp, Homo sapiens
gatagcttctcttct

SEQ ID NO: 1078747 - DNA, 22 bp, Homo sapiens
gatagcttctcttctttctgaa

SEQ ID NO: 1078748 - DNA, 20 bp, Homo sapiens
gatagctttattttttaagt

SEQ ID NO: 1078749 - DNA, 22 bp, Homo sapiens
gataggaactgtctcaaaagga

SEQ ID NO: 1078750 - DNA, 18 bp, Homo sapiens
gataggaccttgggccaa

SEQ ID NO: 1078751 - DNA, 14 bp, Homo sapiens
gataggagctgcag

SEQ ID NO: 1078752 - DNA, 14 bp, Homo sapiens
gataggagggggcg

SEQ ID NO: 1078753 - DNA, 19 bp, Homo sapiens
gataggcaggaacatacag

SEQ ID NO: 1078754 - DNA, 12 bp, Homo sapiens
gataggctctgc

SEQ ID NO: 1078755 - DNA, 17 bp, Homo sapiens
gataggctctgcacaga

SEQ ID NO: 1078756 - DNA, 14 bp, Homo sapiens
gataggggaggggg

SEQ ID NO: 1078757 - DNA, 20 bp, Homo sapiens
gataggttttctgctagcca

SEQ ID NO: 1078758 - DNA, 22 bp, Homo sapiens
gatagtcctgacctcatgatct

SEQ ID NO: 1078759 - DNA, 18 bp, Homo sapiens
gatagtccttcctggcat

SEQ ID NO: 1078760 - DNA, 19 bp, Homo sapiens
gatagtccttcctggcatc

SEQ ID NO: 1078761 - DNA, 19 bp, Homo sapiens
gatagtgccaggtggctca

SEQ ID NO: 1078762 - DNA, 23 bp, Homo sapiens
gatagtgggcaccccactgcaat

SEQ ID NO: 1078763 - DNA, 17 bp, Homo sapiens
gatagtgttctgctcct

SEQ ID NO: 1078764 - DNA, 21 bp, Homo sapiens
gatagtgttctgctcctgctt

SEQ ID NO: 1078765 - DNA, 21 bp, Homo sapiens
gatagttgaatgttgcaatgt

SEQ ID NO: 1078766 - DNA, 14 bp, Homo sapiens
gatagttttcatcc

SEQ ID NO: 1078767 - DNA, 18 bp, Homo sapiens
gatataaaaacagattct

SEQ ID NO: 1078768 - DNA, 14 bp, Homo sapiens
gatataaaaggatg

SEQ ID NO: 1078769 - DNA, 23 bp, Homo sapiens
gatataaaaggatgttacaagtt

SEQ ID NO: 1078770 - DNA, 21 bp, Homo sapiens
gatataaaggaccctgtttct

SEQ ID NO: 1078771 - DNA, 16 bp, Homo sapiens
gatataatctttcaaa

SEQ ID NO: 1078772 - DNA, 17 bp, Homo sapiens
gatataatgtattttca

SEQ ID NO: 1078773 - DNA, 13 bp, Homo sapiens
gatataatgtgtg

SEQ ID NO: 1078774 - DNA, 18 bp, Homo sapiens
gatatacacggatgactt

SEQ ID NO: 1078775 - DNA, 17 bp, Homo sapiens
gatatacatgaaaattt

SEQ ID NO: 1078776 - DNA, 13 bp, Homo sapiens
gatataccaaatt

SEQ ID NO: 1078777 - DNA, 16 bp, Homo sapiens
gatataccaaattaaa

SEQ ID NO: 1078778 - DNA, 24 bp, Homo sapiens
gatatacgccctctttcatctgta

SEQ ID NO: 1078779 - DNA, 15 bp, Homo sapiens
gatatactgcagctt

SEQ ID NO: 1078780 - DNA, 18 bp, Homo sapiens
gatatacttttttcttat

SEQ ID NO: 1078781 - DNA, 14 bp, Homo sapiens
gatatagggtgtgg

SEQ ID NO: 1078782 - DNA, 20 bp, Homo sapiens
gatatagtagttacttgtga

SEQ ID NO: 1078783 - DNA, 17 bp, Homo sapiens
gatatataagtgtacat

SEQ ID NO: 1078784 - DNA, 17 bp, Homo sapiens
gatatataatttcctca

SEQ ID NO: 1078785 - DNA, 18 bp, Homo sapiens
gatatataatttcctcac

SEQ ID NO: 1078786 - DNA, 21 bp, Homo sapiens
gatatataggctattttctaa

SEQ ID NO: 1078787 - DNA, 16 bp, Homo sapiens
gatatatgtgtataca

SEQ ID NO: 1078788 - DNA, 13 bp, Homo sapiens
gatatattaaaaa

SEQ ID NO: 1078789 - DNA, 21 bp, Homo sapiens
gatatattaaaaatataaaac

SEQ ID NO: 1078790 - DNA, 22 bp, Homo sapiens
gagtcatctgttagggccttgg

SEQ ID NO: 1078791 - DNA, 13 bp, Homo sapiens
gagtcatcttgtg

SEQ ID NO: 1078792 - DNA, 20 bp, Homo sapiens
gagtcatcttgtgagtggat

SEQ ID NO: 1078793 - DNA, 20 bp, Homo sapiens
gagtcatgatctccctgccg

SEQ ID NO: 1078794 - DNA, 20 bp, Homo sapiens
gagtcatgtgagcctcgtgt

SEQ ID NO: 1078795 - DNA, 15 bp, Homo sapiens
gagtcatttaaatgt

SEQ ID NO: 1078796 - DNA, 17 bp, Homo sapiens
gagtccaaggccagtcc

SEQ ID NO: 1078797 - DNA, 16 bp, Homo sapiens
gagtccaatttaagga

SEQ ID NO: 1078798 - DNA, 13 bp, Homo sapiens
gagtccactttgt

SEQ ID NO: 1078799 - DNA, 14 bp, Homo sapiens
gagtccagctcccc

SEQ ID NO: 1078800 - DNA, 15 bp, Homo sapiens
gagtccagctccccc

SEQ ID NO: 1078801 - DNA, 12 bp, Homo sapiens
gagtccagctct

SEQ ID NO: 1078802 - DNA, 15 bp, Homo sapiens
gagtccaggagctca

SEQ ID NO: 1078803 - DNA, 14 bp, Homo sapiens
gagtccaggcccca

SEQ ID NO: 1078804 - DNA, 18 bp, Homo sapiens
gagtccagggtttctctg

SEQ ID NO: 1078805 - DNA, 23 bp, Homo sapiens
gagtccagggtttctctgcagat

SEQ ID NO: 1078806 - DNA, 14 bp, Homo sapiens
gagtccagtgctct

SEQ ID NO: 1078807 - DNA, 12 bp, Homo sapiens
gagtcccacccg

SEQ ID NO: 1078808 - DNA, 18 bp, Homo sapiens
gagtcccacccggacagg

SEQ ID NO: 1078809 - DNA, 12 bp, Homo sapiens
gagtcccagagc

SEQ ID NO: 1078810 - DNA, 21 bp, Homo sapiens
gagtcccagagcaggaggccc

SEQ ID NO: 1078811 - DNA, 11 bp, Homo sapiens
gagtcccctca

SEQ ID NO: 1078812 - DNA, 19 bp, Homo sapiens
gagtcccctcacctcctct

SEQ ID NO: 1078813 - DNA, 24 bp, Homo sapiens
gagtccctatagtttcaccactcc

SEQ ID NO: 1078814 - DNA, 22 bp, Homo sapiens
gagtccctccatgcaaaagtgg

SEQ ID NO: 1078815 - DNA, 21 bp, Homo sapiens
gagtcccttaatcttatgggg

SEQ ID NO: 1078816 - DNA, 18 bp, Homo sapiens
gagtccctttgaagataa

SEQ ID NO: 1078817 - DNA, 17 bp, Homo sapiens
gagtccgcccatccctg

SEQ ID NO: 1078818 - DNA, 17 bp, Homo sapiens
gagtccggatttctaac

SEQ ID NO: 1078819 - DNA, 17 bp, Homo sapiens
gagtcctcactcccagt

SEQ ID NO: 1078820 - DNA, 11 bp, Homo sapiens
gagtcctcagg

SEQ ID NO: 1078821 - DNA, 12 bp, Homo sapiens
gagtcctcaggt

SEQ ID NO: 1078822 - DNA, 16 bp, Homo sapiens
gagtcctctagcaggc

SEQ ID NO: 1078823 - DNA, 19 bp, Homo sapiens
gagtcctctagcaggccta

SEQ ID NO: 1078824 - DNA, 13 bp, Homo sapiens
gagtcctctgaat

SEQ ID NO: 1078825 - DNA, 12 bp, Homo sapiens
gagtcctctgga

SEQ ID NO: 1078826 - DNA, 20 bp, Homo sapiens
gagtcctgtctctgcctgcg

SEQ ID NO: 1078827 - DNA, 14 bp, Homo sapiens
gagtccttacctcg

SEQ ID NO: 1078828 - DNA, 18 bp, Homo sapiens
gagtccttattcttctca

SEQ ID NO: 1078829 - DNA, 19 bp, Homo sapiens
gagtcgctggcatgtttca

SEQ ID NO: 1078830 - DNA, 13 bp, Homo sapiens
gagtcgctgtgcc

SEQ ID NO: 1078831 - DNA, 12 bp, Homo sapiens
gagtcggcccca

SEQ ID NO: 1078832 - DNA, 20 bp, Homo sapiens
gagtcggttagtcattgata

SEQ ID NO: 1078833 - DNA, 22 bp, Homo sapiens
gagtcgtacagaaagctgcctg

SEQ ID NO: 1078834 - DNA, 20 bp, Homo sapiens
gagtcgtcactctctattgt

SEQ ID NO: 1078835 - DNA, 18 bp, Homo sapiens
gagtcgtggggtgtgctg

SEQ ID NO: 1078836 - DNA, 19 bp, Homo sapiens
gagtctacctgagcattca

SEQ ID NO: 1078837 - DNA, 15 bp, Homo sapiens
gagtctagatacaga

SEQ ID NO: 1078838 - DNA, 20 bp, Homo sapiens
gagtctcaacatgtgtttct

SEQ ID NO: 1078839 - DNA, 22 bp, Homo sapiens
gagtctcaacatgtgtttctga

SEQ ID NO: 1078840 - DNA, 16 bp, Homo sapiens
gagtctcaggaggagg

SEQ ID NO: 1078841 - DNA, 22 bp, Homo sapiens
gagtctcccactgcaacttgtg

SEQ ID NO: 1078842 - DNA, 17 bp, Homo sapiens
gagtctctgccacccac

SEQ ID NO: 1078843 - DNA, 19 bp, Homo sapiens
gagtctctgccacccactc

SEQ ID NO: 1078844 - DNA, 20 bp, Homo sapiens
gagtctctgccacccactca

SEQ ID NO: 1078845 - DNA, 12 bp, Homo sapiens
gagtctgaggac

SEQ ID NO: 1078846 - DNA, 14 bp, Homo sapiens
gagtctgaggactg

SEQ ID NO: 1078847 - DNA, 14 bp, Homo sapiens
gagtctgagtcctg

SEQ ID NO: 1078848 - DNA, 14 bp, Homo sapiens
gagtctgagtctga

SEQ ID NO: 1078849 - DNA, 17 bp, Homo sapiens
gatcctgcaccccagca

SEQ ID NO: 1078850 - DNA, 12 bp, Homo sapiens
gatcctgcagga

SEQ ID NO: 1078851 - DNA, 20 bp, Homo sapiens
gatcctgcaggaacgagcac

SEQ ID NO: 1078852 - DNA, 23 bp, Homo sapiens
gatcctgcaggaacgagcactgg

SEQ ID NO: 1078853 - DNA, 21 bp, Homo sapiens
gatcctgccaatctaatgtga

SEQ ID NO: 1078854 - DNA, 12 bp, Homo sapiens
gatcctgccccc

SEQ ID NO: 1078855 - DNA, 14 bp, Homo sapiens
gatcctgcccccaa

SEQ ID NO: 1078856 - DNA, 16 bp, Homo sapiens
gatcctgcccccaagt

SEQ ID NO: 1078857 - DNA, 18 bp, Homo sapiens
gatcctgcgggtggggct

SEQ ID NO: 1078858 - DNA, 17 bp, Homo sapiens
gatcctggaggctgcct

SEQ ID NO: 1078859 - DNA, 15 bp, Homo sapiens
gatcctgtttcagct

SEQ ID NO: 1078860 - DNA, 21 bp, Homo sapiens
gatccttcaaagtctcaatga

SEQ ID NO: 1078861 - DNA, 23 bp, Homo sapiens
gatccttcaaagtctcaatgaaa

SEQ ID NO: 1078862 - DNA, 15 bp, Homo sapiens
gatccttcagcacag

SEQ ID NO: 1078863 - DNA, 17 bp, Homo sapiens
gatccttccacctcagt

SEQ ID NO: 1078864 - DNA, 19 bp, Homo sapiens
gatccttcccctcttttgg

SEQ ID NO: 1078865 - DNA, 12 bp, Homo sapiens
gatccttcctcc

SEQ ID NO: 1078866 - DNA, 17 bp, Homo sapiens
gatccttctgagctcca

SEQ ID NO: 1078867 - DNA, 21 bp, Homo sapiens
gatccttctgagctccacctc

SEQ ID NO: 1078868 - DNA, 21 bp, Homo sapiens
gatccttgtgttcagctcttt

SEQ ID NO: 1078869 - DNA, 22 bp, Homo sapiens
gatccttttcctaattcacaca

SEQ ID NO: 1078870 - DNA, 20 bp, Homo sapiens
gatccttttttgtcatttta

SEQ ID NO: 1078871 - DNA, 20 bp, Homo sapiens
gatcgagaccatcctggcca

SEQ ID NO: 1078872 - DNA, 23 bp, Homo sapiens
gatcgaggcatggggcatgtcct

SEQ ID NO: 1078873 - DNA, 23 bp, Homo sapiens
gatcgcatcattgcactctagcc

SEQ ID NO: 1078874 - DNA, 16 bp, Homo sapiens
gatcgcccgataaaga

SEQ ID NO: 1078875 - DNA, 18 bp, Homo sapiens
gatgccagagggccagca

SEQ ID NO: 1078876 - DNA, 21 bp, Homo sapiens
gatgccagcttctctctccag

SEQ ID NO: 1078877 - DNA, 13 bp, Homo sapiens
gatgccagtgaag

SEQ ID NO: 1078878 - DNA, 17 bp, Homo sapiens
gatgcccactgaggaat

SEQ ID NO: 1078879 - DNA, 16 bp, Homo sapiens
gatgccccagagctgt

SEQ ID NO: 1078880 - DNA, 13 bp, Homo sapiens
gatgcccccaggc

SEQ ID NO: 1078881 - DNA, 17 bp, Homo sapiens
gatgcccccaggcagcc

SEQ ID NO: 1078882 - DNA, 20 bp, Homo sapiens
gatgcccccaggcagccacc

SEQ ID NO: 1078883 - DNA, 16 bp, Homo sapiens
gatgccccctccagga

SEQ ID NO: 1078884 - DNA, 24 bp, Homo sapiens
gatgccccctccaggagagagcca

SEQ ID NO: 1078885 - DNA, 16 bp, Homo sapiens
gatgccccgtccccct

SEQ ID NO: 1078886 - DNA, 19 bp, Homo sapiens
gatgcccctgctccctctg

SEQ ID NO: 1078887 - DNA, 13 bp, Homo sapiens
gatgccccttccc

SEQ ID NO: 1078888 - DNA, 17 bp, Homo sapiens
gatgccccttccccaag

SEQ ID NO: 1078889 - DNA, 14 bp, Homo sapiens
gatgccccttctcc

SEQ ID NO: 1078890 - DNA, 13 bp, Homo sapiens
gatgccctcccct

SEQ ID NO: 1078891 - DNA, 14 bp, Homo sapiens
gattattatctaaa

SEQ ID NO: 1078892 - DNA, 19 bp, Homo sapiens
gattattatgtttattaca

SEQ ID NO: 1078893 - DNA, 22 bp, Homo sapiens
gattattatgtttattacaatt

SEQ ID NO: 1078894 - DNA, 16 bp, Homo sapiens
gcaatttatacaatat

SEQ ID NO: 1078895 - DNA, 16 bp, Homo sapiens
gcaatttccccctaaa

SEQ ID NO: 1078896 - DNA, 19 bp, Homo sapiens
gcaatttctaatttttaag

SEQ ID NO: 1078897 - DNA, 20 bp, Homo sapiens
gcaattttaatcccctgcac

SEQ ID NO: 1078898 - DNA, 15 bp, Homo sapiens
gcaattttagtgtat

SEQ ID NO: 1078899 - DNA, 13 bp, Homo sapiens
gcacaaaaaatga

SEQ ID NO: 1078900 - DNA, 14 bp, Homo sapiens
gcacaaaaaatgag

SEQ ID NO: 1078901 - DNA, 21 bp, Homo sapiens
gcacaaaactacttttctaaa

SEQ ID NO: 1078902 - DNA, 19 bp, Homo sapiens
gcacaaactgcagctgtga

SEQ ID NO: 1078903 - DNA, 15 bp, Homo sapiens
gcacaaatatttatt

SEQ ID NO: 1078904 - DNA, 14 bp, Homo sapiens
gcacaacagccctg

SEQ ID NO: 1078905 - DNA, 24 bp, Homo sapiens
gcacaacagccctgcctgagaagc

SEQ ID NO: 1078906 - DNA, 17 bp, Homo sapiens
gcacaaccggtcccttc

SEQ ID NO: 1078907 - DNA, 14 bp, Homo sapiens
gcacaagaatggat

SEQ ID NO: 1078908 - DNA, 14 bp, Homo sapiens
gcacaagctgcacc

SEQ ID NO: 1078909 - DNA, 22 bp, Homo sapiens
gcacaaggacattgtatgcagg

SEQ ID NO: 1078910 - DNA, 15 bp, Homo sapiens
gcacaaggagtgccc

SEQ ID NO: 1078911 - DNA, 13 bp, Homo sapiens
gcacaaggcctta

SEQ ID NO: 1078912 - DNA, 14 bp, Homo sapiens
gcacaagggcacat

SEQ ID NO: 1078913 - DNA, 19 bp, Homo sapiens
gcacaagggcacattgccc

SEQ ID NO: 1078914 - DNA, 21 bp, Homo sapiens
gcacaagggcacattgcccat

SEQ ID NO: 1078915 - DNA, 16 bp, Homo sapiens
gcacaataaaaatgtt

SEQ ID NO: 1078916 - DNA, 11 bp, Homo sapiens
gcacaataaat

SEQ ID NO: 1078917 - DNA, 18 bp, Homo sapiens
gcacaatcactaaacttt

SEQ ID NO: 1078918 - DNA, 20 bp, Homo sapiens
gcacaatcactaaactttat

SEQ ID NO: 1078919 - DNA, 14 bp, Homo sapiens
gcacaatgaatgta

SEQ ID NO: 1078920 - DNA, 17 bp, Homo sapiens
gcacaatgaatgtatat

SEQ ID NO: 1078921 - DNA, 21 bp, Homo sapiens
gcacaatgcatgtgctgtctc

SEQ ID NO: 1078922 - DNA, 14 bp, Homo sapiens
gcacaattctgtcc

SEQ ID NO: 1078923 - DNA, 17 bp, Homo sapiens
gcacaattctgtccctg

SEQ ID NO: 1078924 - DNA, 21 bp, Homo sapiens
gcacaattctgtccctgtccc

SEQ ID NO: 1078925 - DNA, 20 bp, Homo sapiens
gcacaatttgagactgaaat

SEQ ID NO: 1078926 - DNA, 18 bp, Homo sapiens
gcacacaattagatttct

SEQ ID NO: 1078927 - DNA, 10 bp, Homo sapiens
gcacacacac

SEQ ID NO: 1078928 - DNA, 17 bp, Homo sapiens
gcacacacacacacagg

SEQ ID NO: 1078929 - DNA, 19 bp, Homo sapiens
gcacacacacacacaggag

SEQ ID NO: 1078930 - DNA, 20 bp, Homo sapiens
gcacacacacacacaggagg

SEQ ID NO: 1078931 - DNA, 13 bp, Homo sapiens
gcacacacagctc

SEQ ID NO: 1078932 - DNA, 16 bp, Homo sapiens
gcacacacagctcctc

SEQ ID NO: 1078933 - DNA, 14 bp, Homo sapiens
gcacacacatctgg

SEQ ID NO: 1078934 - DNA, 17 bp, Homo sapiens
gcacacacatctggccc

SEQ ID NO: 1078935 - DNA, 20 bp, Homo sapiens
gcacacacatctggccctga

SEQ ID NO: 1078936 - DNA, 16 bp, Homo sapiens
gcacacacctcagagg

SEQ ID NO: 1078937 - DNA, 23 bp, Homo sapiens
gcacacacctgggtggacacaag

SEQ ID NO: 1078938 - DNA, 18 bp, Homo sapiens
gcacacagagattctgga

SEQ ID NO: 1078939 - DNA, 11 bp, Homo sapiens
gcacacagcac

SEQ ID NO: 1078940 - DNA, 13 bp, Homo sapiens
gcacacagcagcc

SEQ ID NO: 1078941 - DNA, 16 bp, Homo sapiens
gcacacagctgagcac

SEQ ID NO: 1078942 - DNA, 22 bp, Homo sapiens
gcacacagctgagcacttagca

SEQ ID NO: 1078943 - DNA, 12 bp, Homo sapiens
gcacacagggct

SEQ ID NO: 1078944 - DNA, 18 bp, Homo sapiens
gcacacagggctcacagg

SEQ ID NO: 1078945 - DNA, 21 bp, Homo sapiens
gcacacagggctcacagggca

SEQ ID NO: 1078946 - DNA, 22 bp, Homo sapiens
gcacacagggctcacagggcag

SEQ ID NO: 1078947 - DNA, 15 bp, Homo sapiens
gcacacatcaccagg

SEQ ID NO: 1078948 - DNA, 16 bp, Homo sapiens
gcacacatcaccaggt

SEQ ID NO: 1078949 - DNA, 22 bp, Homo sapiens
gcacgcccatgtgtgagtgtgt

SEQ ID NO: 1078950 - DNA, 23 bp, Homo sapiens
gcacgccctactccactgccctg

SEQ ID NO: 1078951 - DNA, 20 bp, Homo sapiens
gcacgcctgcaggctggaga

SEQ ID NO: 1078952 - DNA, 14 bp, Homo sapiens
gcacgcctgccatc

SEQ ID NO: 1078953 - DNA, 16 bp, Homo sapiens
gcacgcctgccatctt

SEQ ID NO: 1078954 - DNA, 20 bp, Homo sapiens
gcacgcggagtgagtttttt

SEQ ID NO: 1078955 - DNA, 15 bp, Homo sapiens
gcacgctcccctcca

SEQ ID NO: 1078956 - DNA, 16 bp, Homo sapiens
gcacgctcccctccat

SEQ ID NO: 1078957 - DNA, 17 bp, Homo sapiens
gcacgctcgctgccatc

SEQ ID NO: 1078958 - DNA, 18 bp, Homo sapiens
gcacgctgcccaggggct

SEQ ID NO: 1078959 - DNA, 19 bp, Homo sapiens
gcacgcttgcgtatgtctg

SEQ ID NO: 1078960 - DNA, 20 bp, Homo sapiens
gcacgcttgcgtatgtctgt

SEQ ID NO: 1078961 - DNA, 17 bp, Homo sapiens
gcacggcccggcccctc

SEQ ID NO: 1078962 - DNA, 23 bp, Homo sapiens
gcacggctccgagggcggccagg

SEQ ID NO: 1078963 - DNA, 19 bp, Homo sapiens
gcacgggccctccctccca

SEQ ID NO: 1078964 - DNA, 15 bp, Homo sapiens
gcacgggctgtctgg

SEQ ID NO: 1078965 - DNA, 13 bp, Homo sapiens
gcacggggacctg

SEQ ID NO: 1078966 - DNA, 14 bp, Homo sapiens
gcacgggtggtccc

SEQ ID NO: 1078967 - DNA, 15 bp, Homo sapiens
gcacgggtggtcccc

SEQ ID NO: 1078968 - DNA, 16 bp, Homo sapiens
gcacgggtggtccccg

SEQ ID NO: 1078969 - DNA, 13 bp, Homo sapiens
gcacgtcatggga

SEQ ID NO: 1078970 - DNA, 20 bp, Homo sapiens
gcacgtcgcccgctgagctg

SEQ ID NO: 1078971 - DNA, 17 bp, Homo sapiens
gcacgtcttgctatttg

SEQ ID NO: 1078972 - DNA, 15 bp, Homo sapiens
gcacgtgacaggctc

SEQ ID NO: 1078973 - DNA, 16 bp, Homo sapiens
gcacgtgacaggctcg

SEQ ID NO: 1078974 - DNA, 18 bp, Homo sapiens
gcacgtggcatgtggcct

SEQ ID NO: 1078975 - DNA, 17 bp, Homo sapiens
gcacgtggcctcttgag

SEQ ID NO: 1078976 - DNA, 19 bp, Homo sapiens
gcacgtggcctcttgagca

SEQ ID NO: 1078977 - DNA, 15 bp, Homo sapiens
gcacgttgcttcagg

SEQ ID NO: 1078978 - DNA, 18 bp, Homo sapiens
gcactaaactcagattga

SEQ ID NO: 1078979 - DNA, 18 bp, Homo sapiens
gcactaaagccagcctga

SEQ ID NO: 1078980 - DNA, 19 bp, Homo sapiens
gcactaaagccagcctgac

SEQ ID NO: 1078981 - DNA, 21 bp, Homo sapiens
gcactaaagccagcctgacct

SEQ ID NO: 1078982 - DNA, 23 bp, Homo sapiens
gcactaaagccagcctgaccttc

SEQ ID NO: 1078983 - DNA, 22 bp, Homo sapiens
gcactaaagtatgtaaagtatg

SEQ ID NO: 1078984 - DNA, 19 bp, Homo sapiens
gcactaaggccgtgtctct

SEQ ID NO: 1078985 - DNA, 20 bp, Homo sapiens
gcactaaggccgtgtctctg

SEQ ID NO: 1078986 - DNA, 14 bp, Homo sapiens
gcactaaggggccc

SEQ ID NO: 1078987 - DNA, 17 bp, Homo sapiens
gcactacaccttgcctt

SEQ ID NO: 1078988 - DNA, 15 bp, Homo sapiens
gcactacataaactg

SEQ ID NO: 1078989 - DNA, 15 bp, Homo sapiens
gcactactctgtgcc

SEQ ID NO: 1078990 - DNA, 12 bp, Homo sapiens
gcactactgggt

SEQ ID NO: 1078991 - DNA, 14 bp, Homo sapiens
gcactactgggtgt

SEQ ID NO: 1078992 - DNA, 17 bp, Homo sapiens
gcactactgggtgtcat

SEQ ID NO: 1078993 - DNA, 21 bp, Homo sapiens
gcactactgggtgtcatttca

SEQ ID NO: 1078994 - DNA, 20 bp, Homo sapiens
gcactagaagtggtttcctg

SEQ ID NO: 1078995 - DNA, 12 bp, Homo sapiens
gcactaggaatt

SEQ ID NO: 1078996 - DNA, 12 bp, Homo sapiens
gcactaggcagg

SEQ ID NO: 1078997 - DNA, 21 bp, Homo sapiens
gcactagtcaccgacagcggc

SEQ ID NO: 1078998 - DNA, 23 bp, Homo sapiens
gcactagtcaccgacagcggcct

SEQ ID NO: 1078999 - DNA, 14 bp, Homo sapiens
gcactataatgtaa

SEQ ID NO: 1079000 - DNA, 18 bp, Homo sapiens
gcactatatacatcacgt

SEQ ID NO: 1079001 - DNA, 22 bp, Homo sapiens
gcactatgaggaataattattt

SEQ ID NO: 1079002 - DNA, 22 bp, Homo sapiens
gcactcaaacctggagctgagg

SEQ ID NO: 1079003 - DNA, 17 bp, Homo sapiens
gcactcacccatgtgcc

SEQ ID NO: 1079004 - DNA, 13 bp, Homo sapiens
gcactcagcctca

SEQ ID NO: 1079005 - DNA, 18 bp, Homo sapiens
gcactcatagggtgctct

SEQ ID NO: 1079006 - DNA, 12 bp, Homo sapiens
gcactccagcct

SEQ ID NO: 1079007 - DNA, 15 bp, Homo sapiens
gcactccagcctggg

SEQ ID NO: 1079008 - DNA, 16 bp, Homo sapiens
gcactccagcctgggc

SEQ ID NO: 1079009 - DNA, 16 bp, Homo sapiens
gcactccatgagcacc

SEQ ID NO: 1079010 - DNA, 23 bp, Homo sapiens
gcactccatgcttagtcactgcc

SEQ ID NO: 1079011 - DNA, 18 bp, Homo sapiens
gcactccatggccacccc

SEQ ID NO: 1079012 - DNA, 13 bp, Homo sapiens
gcactcccaaccc

SEQ ID NO: 1079013 - DNA, 22 bp, Homo sapiens
gcactcccacctgacacaccag

SEQ ID NO: 1079014 - DNA, 18 bp, Homo sapiens
gcactccccagagctgtg

SEQ ID NO: 1079015 - DNA, 21 bp, Homo sapiens
gcactccccagagctgtgcca

SEQ ID NO: 1079016 - DNA, 17 bp, Homo sapiens
gcactcccgctgcacac

SEQ ID NO: 1079017 - DNA, 15 bp, Homo sapiens
gcactccctcctgga

SEQ ID NO: 1079018 - DNA, 17 bp, Homo sapiens
gcactccctggccttgc

SEQ ID NO: 1079019 - DNA, 20 bp, Homo sapiens
gcactcccttaggcattatt

SEQ ID NO: 1079020 - DNA, 21 bp, Homo sapiens
gcactccgcgccgatgccacc

SEQ ID NO: 1079021 - DNA, 14 bp, Homo sapiens
gcactccggaggta

SEQ ID NO: 1079022 - DNA, 17 bp, Homo sapiens
gcactcctcaagacttt

SEQ ID NO: 1079023 - DNA, 19 bp, Homo sapiens
gcactcctttatctgtaat

SEQ ID NO: 1079024 - DNA, 18 bp, Homo sapiens
gcactcgagaccatcctg

SEQ ID NO: 1079025 - DNA, 20 bp, Homo sapiens
gcactcgagaccatcctggc

SEQ ID NO: 1079026 - DNA, 14 bp, Homo sapiens
gcactctaaactgc

SEQ ID NO: 1079027 - DNA, 23 bp, Homo sapiens
gcactctaaactgcaaacagaaa

SEQ ID NO: 1079028 - DNA, 17 bp, Homo sapiens
gcactctaattagagaa

SEQ ID NO: 1079029 - DNA, 19 bp, Homo sapiens
gcactctcatcaccccaga

SEQ ID NO: 1079030 - DNA, 23 bp, Homo sapiens
gcactctcatcaccccagaggcc

SEQ ID NO: 1079031 - DNA, 16 bp, Homo sapiens
gcactctcctgtctga

SEQ ID NO: 1079032 - DNA, 18 bp, Homo sapiens
gcactctctgcagtcctc

SEQ ID NO: 1079033 - DNA, 23 bp, Homo sapiens
gcactctgagtttaccatttgta

SEQ ID NO: 1079034 - DNA, 14 bp, Homo sapiens
gcactctgttattt

SEQ ID NO: 1079035 - DNA, 19 bp, Homo sapiens
gcactgaacaggctggggc

SEQ ID NO: 1079036 - DNA, 18 bp, Homo sapiens
gcactgaagtggccctcc

SEQ ID NO: 1079037 - DNA, 16 bp, Homo sapiens
gcactgaccaggccca

SEQ ID NO: 1079038 - DNA, 23 bp, Homo sapiens
gcactgacctgctccgccaggaa

SEQ ID NO: 1079039 - DNA, 15 bp, Homo sapiens
gcactgactggaagg

SEQ ID NO: 1079040 - DNA, 16 bp, Homo sapiens
gcactgactgggcata

SEQ ID NO: 1079041 - DNA, 13 bp, Homo sapiens
gcactgagagggc

SEQ ID NO: 1079042 - DNA, 15 bp, Homo sapiens
gcactgagagggcaa

SEQ ID NO: 1079043 - DNA, 15 bp, Homo sapiens
gcactgagatattta

SEQ ID NO: 1079044 - DNA, 21 bp, Homo sapiens
gcactgagatatttattgttt

SEQ ID NO: 1079045 - DNA, 13 bp, Homo sapiens
gcactgagccccc

SEQ ID NO: 1079046 - DNA, 14 bp, Homo sapiens
gcactgagcccccc

SEQ ID NO: 1079047 - DNA, 19 bp, Homo sapiens
gcactgagctcacatggga

SEQ ID NO: 1079048 - DNA, 17 bp, Homo sapiens
gcactgaggaccagcca

SEQ ID NO: 1079049 - DNA, 13 bp, Homo sapiens
gcactgagggatc

SEQ ID NO: 1079050 - DNA, 12 bp, Homo sapiens
gcactgagggcc

SEQ ID NO: 1079051 - DNA, 14 bp, Homo sapiens
gcactgagggccac

SEQ ID NO: 1079052 - DNA, 15 bp, Homo sapiens
gcactgagggccaca

SEQ ID NO: 1079053 - DNA, 24 bp, Homo sapiens
gcactgagggccacactattacca

SEQ ID NO: 1079054 - DNA, 19 bp, Homo sapiens
gcactgagggtggcactca

SEQ ID NO: 1079055 - DNA, 13 bp, Homo sapiens
gcactgatagtcc

SEQ ID NO: 1079056 - DNA, 14 bp, Homo sapiens
gcactgatatttta

SEQ ID NO: 1079057 - DNA, 17 bp, Homo sapiens
gcactgatgttgtgttt

SEQ ID NO: 1079058 - DNA, 15 bp, Homo sapiens
gcactgcagacggga

SEQ ID NO: 1079059 - DNA, 18 bp, Homo sapiens
gcactgcattcctgtgcc

SEQ ID NO: 1079060 - DNA, 19 bp, Homo sapiens
gcactgcattcctgtgccc

SEQ ID NO: 1079061 - DNA, 22 bp, Homo sapiens
gcactgcattcctgtgccctag

SEQ ID NO: 1079062 - DNA, 23 bp, Homo sapiens
gcactgcctcctgttttctccct

SEQ ID NO: 1079063 - DNA, 17 bp, Homo sapiens
gcactgcctctatgccc

SEQ ID NO: 1079064 - DNA, 18 bp, Homo sapiens
gcactgcctctatgccct

SEQ ID NO: 1079065 - DNA, 21 bp, Homo sapiens
gcactgcctctatgccctgca

SEQ ID NO: 1079066 - DNA, 13 bp, Homo sapiens
gcactgccttctc

SEQ ID NO: 1079067 - DNA, 20 bp, Homo sapiens
gcactgctaggcgagtgcca

SEQ ID NO: 1079068 - DNA, 21 bp, Homo sapiens
gcactgctaggcgagtgccag

SEQ ID NO: 1079069 - DNA, 21 bp, Homo sapiens
gcactgctccaagggacaggt

SEQ ID NO: 1079070 - DNA, 14 bp, Homo sapiens
gcactgctgcccag

SEQ ID NO: 1079071 - DNA, 18 bp, Homo sapiens
gcactgctgcccagcctc

SEQ ID NO: 1079072 - DNA, 17 bp, Homo sapiens
gcactggagccacaggc

SEQ ID NO: 1079073 - DNA, 15 bp, Homo sapiens
gcactggccagagag

SEQ ID NO: 1079074 - DNA, 18 bp, Homo sapiens
gcactggccagagagggc

SEQ ID NO: 1079075 - DNA, 18 bp, Homo sapiens
gcactggctctctccagg

SEQ ID NO: 1079076 - DNA, 23 bp, Homo sapiens
gcactggctgaacttggagaggg

SEQ ID NO: 1079077 - DNA, 15 bp, Homo sapiens
gcactgggaaggaaa

SEQ ID NO: 1079078 - DNA, 16 bp, Homo sapiens
gcactgggaaggaaac

SEQ ID NO: 1079079 - DNA, 23 bp, Homo sapiens
gcactgggcaggttcctggggcc

SEQ ID NO: 1079080 - DNA, 22 bp, Homo sapiens
gcactgggcgtctgactccctc

SEQ ID NO: 1079081 - DNA, 16 bp, Homo sapiens
gcactggggaaaaata

SEQ ID NO: 1079082 - DNA, 17 bp, Homo sapiens
gcactggggaaacataa

SEQ ID NO: 1079083 - DNA, 20 bp, Homo sapiens
gcactgggtacccaagtgaa

SEQ ID NO: 1079084 - DNA, 14 bp, Homo sapiens
gcactggtggcccg

SEQ ID NO: 1079085 - DNA, 19 bp, Homo sapiens
gcactggtggcccgacagc

SEQ ID NO: 1079086 - DNA, 23 bp, Homo sapiens
gcactggtggcccgacagcctgg

SEQ ID NO: 1079087 - DNA, 11 bp, Homo sapiens
gcactggtggg

SEQ ID NO: 1079088 - DNA, 14 bp, Homo sapiens
gcactgtaaatatc

SEQ ID NO: 1079089 - DNA, 22 bp, Homo sapiens
gcactgtaaatatccctcccct

SEQ ID NO: 1079090 - DNA, 16 bp, Homo sapiens
gcactgtcactttgct

SEQ ID NO: 1079091 - DNA, 20 bp, Homo sapiens
gcactgtcactttgctctgg

SEQ ID NO: 1079092 - DNA, 17 bp, Homo sapiens
gcactgtcccttgcctc

SEQ ID NO: 1079093 - DNA, 23 bp, Homo sapiens
gcactgtcccttgcctcaatgcc

SEQ ID NO: 1079094 - DNA, 19 bp, Homo sapiens
gcactgtctcagtttcact

SEQ ID NO: 1079095 - DNA, 13 bp, Homo sapiens
gcactgtggccct

SEQ ID NO: 1079096 - DNA, 17 bp, Homo sapiens
gcactgtggtttcagat

SEQ ID NO: 1079097 - DNA, 22 bp, Homo sapiens
gcactgttaatacacagtactt

SEQ ID NO: 1079098 - DNA, 20 bp, Homo sapiens
gcactgttccccctgtgcag

SEQ ID NO: 1079099 - DNA, 18 bp, Homo sapiens
gcactgttgatgtatctg

SEQ ID NO: 1079100 - DNA, 19 bp, Homo sapiens
gcactgttgatgtatctga

SEQ ID NO: 1079101 - DNA, 15 bp, Homo sapiens
gcactgttgctgact

SEQ ID NO: 1079102 - DNA, 14 bp, Homo sapiens
gcacttaaagaagt

SEQ ID NO: 1079103 - DNA, 18 bp, Homo sapiens
gcacttaagagaatattt

SEQ ID NO: 1079104 - DNA, 16 bp, Homo sapiens
gcacttaagtgcactt

SEQ ID NO: 1079105 - DNA, 17 bp, Homo sapiens
gcacttaatttgtaaac

SEQ ID NO: 1079106 - DNA, 21 bp, Homo sapiens
gcacttaatttgtaaacttct

SEQ ID NO: 1079107 - DNA, 22 bp, Homo sapiens
gcacttaatttgtaaacttctg

SEQ ID NO: 1079108 - DNA, 21 bp, Homo sapiens
gcacttagcccaagaggtctg

SEQ ID NO: 1079109 - DNA, 21 bp, Homo sapiens
gcacttagtagtttttacaaa

SEQ ID NO: 1079110 - DNA, 23 bp, Homo sapiens
gcacttattatgaggctattaaa

SEQ ID NO: 1079111 - DNA, 17 bp, Homo sapiens
gcacttcacagctggac

SEQ ID NO: 1079112 - DNA, 14 bp, Homo sapiens
gcacttcaggtccg

SEQ ID NO: 1079113 - DNA, 15 bp, Homo sapiens
gcacttcctccacag

SEQ ID NO: 1079114 - DNA, 16 bp, Homo sapiens
gcacttcctccacagt

SEQ ID NO: 1079115 - DNA, 22 bp, Homo sapiens
gcacttcctctcgcggccctca

SEQ ID NO: 1079116 - DNA, 22 bp, Homo sapiens
gcacttcctgttttataatgaa

SEQ ID NO: 1079117 - DNA, 21 bp, Homo sapiens
gcacttccttttacctgccca

SEQ ID NO: 1079118 - DNA, 12 bp, Homo sapiens
gcacttctagaa

SEQ ID NO: 1079119 - DNA, 13 bp, Homo sapiens
gcacttctagaat

SEQ ID NO: 1079120 - DNA, 13 bp, Homo sapiens
gcacttctgcctt

SEQ ID NO: 1079121 - DNA, 22 bp, Homo sapiens
gcacttgagaaccagtctcctc

SEQ ID NO: 1079122 - DNA, 23 bp, Homo sapiens
gcacttgagaaccagtctcctca

SEQ ID NO: 1079123 - DNA, 20 bp, Homo sapiens
gcacttgcgtcctgcagagg

SEQ ID NO: 1079124 - DNA, 10 bp, Homo sapiens
gcacttgtat

SEQ ID NO: 1079125 - DNA, 17 bp, Homo sapiens
gcacttgttatattata

SEQ ID NO: 1079126 - DNA, 22 bp, Homo sapiens
gcactttaaagaggctgtgtgg

SEQ ID NO: 1079127 - DNA, 23 bp, Homo sapiens
gcactttaaccctctcttcccta

SEQ ID NO: 1079128 - DNA, 14 bp, Homo sapiens
gcactttaattgaa

SEQ ID NO: 1079129 - DNA, 21 bp, Homo sapiens
gcactttaattgaagaactgc

SEQ ID NO: 1079130 - DNA, 17 bp, Homo sapiens
gcactttagacattttt

SEQ ID NO: 1079131 - DNA, 20 bp, Homo sapiens
gcactttagggctgtaaaat

SEQ ID NO: 1079132 - DNA, 19 bp, Homo sapiens
gcactttccacttcttcct

SEQ ID NO: 1079133 - DNA, 13 bp, Homo sapiens
gcactttccccct

SEQ ID NO: 1079134 - DNA, 16 bp, Homo sapiens
gcactttcccccttcc

SEQ ID NO: 1079135 - DNA, 18 bp, Homo sapiens
gcactttcccccttcccg

SEQ ID NO: 1079136 - DNA, 21 bp, Homo sapiens
gcactttcccccttcccgcct

SEQ ID NO: 1079137 - DNA, 22 bp, Homo sapiens
gcactttccctagaaagccata

SEQ ID NO: 1079138 - DNA, 17 bp, Homo sapiens
gcactttctaatgtttc

SEQ ID NO: 1079139 - DNA, 21 bp, Homo sapiens
gcactttctacaatgtgaact

SEQ ID NO: 1079140 - DNA, 22 bp, Homo sapiens
gcactttctacaatgtgaactt

SEQ ID NO: 1079141 - DNA, 15 bp, Homo sapiens
gcactttgaaaatat

SEQ ID NO: 1079142 - DNA, 19 bp, Homo sapiens
gcactttgaaaatatttct

SEQ ID NO: 1079143 - DNA, 23 bp, Homo sapiens
gcactttgaaaatatttctatgt

SEQ ID NO: 1079144 - DNA, 13 bp, Homo sapiens
gcactttgcactt

SEQ ID NO: 1079145 - DNA, 18 bp, Homo sapiens
gcactttgggaggctgag

SEQ ID NO: 1079146 - DNA, 20 bp, Homo sapiens
gcactttgggaggctgaggc

SEQ ID NO: 1079147 - DNA, 21 bp, Homo sapiens
gcactttgggaggctgaggtg

SEQ ID NO: 1079148 - DNA, 17 bp, Homo sapiens
gcactttgtttagaaaa

SEQ ID NO: 1079149 - DNA, 21 bp, Homo sapiens
gcacttttttatgaagaaaaa

SEQ ID NO: 1079150 - DNA, 18 bp, Homo sapiens
gcagaaaaatgtcattga

SEQ ID NO: 1079151 - DNA, 16 bp, Homo sapiens
gcagaaaacccttggg

SEQ ID NO: 1079152 - DNA, 19 bp, Homo sapiens
gcagaaaagaggagaccct

SEQ ID NO: 1079153 - DNA, 21 bp, Homo sapiens
gcagaaaagaggagaccctgg

SEQ ID NO: 1079154 - DNA, 22 bp, Homo sapiens
gcagaaaagaggagaccctgga

SEQ ID NO: 1079155 - DNA, 20 bp, Homo sapiens
gcagaaaagcacctgccgac

SEQ ID NO: 1079156 - DNA, 21 bp, Homo sapiens
gcagaaaagcacctgccgacc

SEQ ID NO: 1079157 - DNA, 16 bp, Homo sapiens
gcagaaaagctcagag

SEQ ID NO: 1079158 - DNA, 20 bp, Homo sapiens
gcagaaacctatctcaggga

SEQ ID NO: 1079159 - DNA, 22 bp, Homo sapiens
gcagaaacctatctcagggagg

SEQ ID NO: 1079160 - DNA, 17 bp, Homo sapiens
gcagaaacgaagccatc

SEQ ID NO: 1079161 - DNA, 22 bp, Homo sapiens
gcagaaagtgcctttatctcag

SEQ ID NO: 1079162 - DNA, 16 bp, Homo sapiens
gcagaaatagacaaaa

SEQ ID NO: 1079163 - DNA, 19 bp, Homo sapiens
gcagaaatatagtgcaata

SEQ ID NO: 1079164 - DNA, 19 bp, Homo sapiens
gcagaaatcctgcaatgaa

SEQ ID NO: 1079165 - DNA, 14 bp, Homo sapiens
gcagaaatctagaa

SEQ ID NO: 1079166 - DNA, 15 bp, Homo sapiens
gcagaaatctagaag

SEQ ID NO: 1079167 - DNA, 22 bp, Homo sapiens
gcagaaatttgatttgaaaagt

SEQ ID NO: 1079168 - DNA, 17 bp, Homo sapiens
gcagaacaaatgtgttt

SEQ ID NO: 1079169 - DNA, 20 bp, Homo sapiens
gcagaacactgcagtcagat

SEQ ID NO: 1079170 - DNA, 18 bp, Homo sapiens
gcagaacatcgatatgta

SEQ ID NO: 1079171 - DNA, 13 bp, Homo sapiens
gcagaacggagcc

SEQ ID NO: 1079172 - DNA, 24 bp, Homo sapiens
gcagaacggagccccaggcctctg

SEQ ID NO: 1079173 - DNA, 19 bp, Homo sapiens
gcagaactaccaggtggca

SEQ ID NO: 1079174 - DNA, 18 bp, Homo sapiens
gcagaactgagctcctct

SEQ ID NO: 1079175 - DNA, 22 bp, Homo sapiens
gcagaagaatgggaatatttta

SEQ ID NO: 1079176 - DNA, 20 bp, Homo sapiens
gcagaagactagaggccagg

SEQ ID NO: 1079177 - DNA, 21 bp, Homo sapiens
gcagaagcaagggggtgatgt

SEQ ID NO: 1079178 - DNA, 14 bp, Homo sapiens
gcagaagcagcccc

SEQ ID NO: 1079179 - DNA, 15 bp, Homo sapiens
gcagaagcagcccct

SEQ ID NO: 1079180 - DNA, 22 bp, Homo sapiens
gcagaagcagcccctcgaggcc

SEQ ID NO: 1079181 - DNA, 20 bp, Homo sapiens
gcagaagcatattttgctgg

SEQ ID NO: 1079182 - DNA, 18 bp, Homo sapiens
gcagaagccccacagcct

SEQ ID NO: 1079183 - DNA, 15 bp, Homo sapiens
gcagaagccctgatg

SEQ ID NO: 1079184 - DNA, 11 bp, Homo sapiens
gcagaaggaaa

SEQ ID NO: 1079185 - DNA, 14 bp, Homo sapiens
gcagaaggaaatga

SEQ ID NO: 1079186 - DNA, 14 bp, Homo sapiens
gcagaaggccaaga

SEQ ID NO: 1079187 - DNA, 15 bp, Homo sapiens
gcagaaggccaagaa

SEQ ID NO: 1079188 - DNA, 15 bp, Homo sapiens
gcagaagggagaagg

SEQ ID NO: 1079189 - DNA, 23 bp, Homo sapiens
gcagaagtctggctttgctctat

SEQ ID NO: 1079190 - DNA, 18 bp, Homo sapiens
gcagaataatctttgggt

SEQ ID NO: 1079191 - DNA, 23 bp, Homo sapiens
gcagaatcctaggctccacccca

SEQ ID NO: 1079192 - DNA, 21 bp, Homo sapiens
gcatgactaatgctttttaga

SEQ ID NO: 1079193 - DNA, 13 bp, Homo sapiens
gcatgagactttc

SEQ ID NO: 1079194 - DNA, 17 bp, Homo sapiens
gcatgaggcaaaaatgt

SEQ ID NO: 1079195 - DNA, 15 bp, Homo sapiens
gcatgagttatctga

SEQ ID NO: 1079196 - DNA, 19 bp, Homo sapiens
gcatgatcttgttactgtg

SEQ ID NO: 1079197 - DNA, 20 bp, Homo sapiens
gcatgattcttctcttgtga

SEQ ID NO: 1079198 - DNA, 11 bp, Homo sapiens
gcatgatttat

SEQ ID NO: 1079199 - DNA, 23 bp, Homo sapiens
gcatgattttaagaggctttggc

SEQ ID NO: 1079200 - DNA, 24 bp, Homo sapiens
gcatgcacacggctggtcactctg

SEQ ID NO: 1079201 - DNA, 15 bp, Homo sapiens
gcatgcaccacgggc

SEQ ID NO: 1079202 - DNA, 13 bp, Homo sapiens
gcatgcacgggca

SEQ ID NO: 1079203 - DNA, 15 bp, Homo sapiens
gcatgcagctgcctg

SEQ ID NO: 1079204 - DNA, 16 bp, Homo sapiens
gcatgcagctgcctgg

SEQ ID NO: 1079205 - DNA, 21 bp, Homo sapiens
gcatgcagctgcctggggccc

SEQ ID NO: 1079206 - DNA, 20 bp, Homo sapiens
gcatgcatgggaggaattca

SEQ ID NO: 1079207 - DNA, 11 bp, Homo sapiens
gcatgccaccc

SEQ ID NO: 1079208 - DNA, 12 bp, Homo sapiens
gcatgccaccct

SEQ ID NO: 1079209 - DNA, 16 bp, Homo sapiens
gcatgccaccctcaca

SEQ ID NO: 1079210 - DNA, 19 bp, Homo sapiens
gcatgccaggacccgccag

SEQ ID NO: 1079211 - DNA, 22 bp, Homo sapiens
gcatgccaggacccgccagccc

SEQ ID NO: 1079212 - DNA, 17 bp, Homo sapiens
gcatgccaggctgggca

SEQ ID NO: 1079213 - DNA, 18 bp, Homo sapiens
gcatgccaggctgggcac

SEQ ID NO: 1079214 - DNA, 15 bp, Homo sapiens
gcatgccccttggct

SEQ ID NO: 1079215 - DNA, 14 bp, Homo sapiens
gcatgcgcaggctc

SEQ ID NO: 1079216 - DNA, 14 bp, Homo sapiens
gcatgctcagtgcc

SEQ ID NO: 1079217 - DNA, 18 bp, Homo sapiens
gcatgctcagtgcctttt

SEQ ID NO: 1079218 - DNA, 15 bp, Homo sapiens
gcatgctctctgcag

SEQ ID NO: 1079219 - DNA, 18 bp, Homo sapiens
gcatgctctctgcagcca

SEQ ID NO: 1079220 - DNA, 21 bp, Homo sapiens
gcatgctctctgcagccagcc

SEQ ID NO: 1079221 - DNA, 13 bp, Homo sapiens
gcatgctctggaa

SEQ ID NO: 1079222 - DNA, 18 bp, Homo sapiens
gcatgctctggaagcctg

SEQ ID NO: 1079223 - DNA, 13 bp, Homo sapiens
gcatgctggggca

SEQ ID NO: 1079224 - DNA, 15 bp, Homo sapiens
gcatgctggggcaag

SEQ ID NO: 1079225 - DNA, 15 bp, Homo sapiens
gcatgcttagagcat

SEQ ID NO: 1079226 - DNA, 17 bp, Homo sapiens
gcatgcttagagcatgt

SEQ ID NO: 1079227 - DNA, 15 bp, Homo sapiens
gcatgctttgctgct

SEQ ID NO: 1079228 - DNA, 12 bp, Homo sapiens
gcatggaaaaat

SEQ ID NO: 1079229 - DNA, 13 bp, Homo sapiens
gcatggaaaaatg

SEQ ID NO: 1079230 - DNA, 19 bp, Homo sapiens
gcatggaaatcagccaagt

SEQ ID NO: 1079231 - DNA, 16 bp, Homo sapiens
gcatggaacacttcga

SEQ ID NO: 1079232 - DNA, 18 bp, Homo sapiens
gcatggaagttggggcac

SEQ ID NO: 1079233 - DNA, 22 bp, Homo sapiens
gcatggacatttagaagaaaga

SEQ ID NO: 1079234 - DNA, 19 bp, Homo sapiens
gcatggaggaggagggagg

SEQ ID NO: 1079235 - DNA, 20 bp, Homo sapiens
gcatggagtatagtgcaaat

SEQ ID NO: 1079236 - DNA, 17 bp, Homo sapiens
gcatggagtgtgtattg

SEQ ID NO: 1079237 - DNA, 20 bp, Homo sapiens
gcatggagtgtgtattgttc

SEQ ID NO: 1079238 - DNA, 22 bp, Homo sapiens
gcatggagtgtgtattgttccc

SEQ ID NO: 1079239 - DNA, 18 bp, Homo sapiens
gcatggatttctttgaaa

SEQ ID NO: 1079240 - DNA, 20 bp, Homo sapiens
gcatggcaaggactgcaggg

SEQ ID NO: 1079241 - DNA, 15 bp, Homo sapiens
gcatggcaattctgg

SEQ ID NO: 1079242 - DNA, 14 bp, Homo sapiens
gcatggcagggcct

SEQ ID NO: 1079243 - DNA, 19 bp, Homo sapiens
gcatggcagggcctcatct

SEQ ID NO: 1079244 - DNA, 13 bp, Homo sapiens
gcatggccctggg

SEQ ID NO: 1079245 - DNA, 17 bp, Homo sapiens
gcatggctccagaaatg

SEQ ID NO: 1079246 - DNA, 18 bp, Homo sapiens
gcatggctccagaaatgt

SEQ ID NO: 1079247 - DNA, 22 bp, Homo sapiens
gcatggctccagtctgctgccc

SEQ ID NO: 1079248 - DNA, 15 bp, Homo sapiens
gcatggctcctgtct

SEQ ID NO: 1079249 - DNA, 17 bp, Homo sapiens
gcatggctcctgtctgg

SEQ ID NO: 1079250 - DNA, 15 bp, Homo sapiens
gcatggctgtctgca

SEQ ID NO: 1079251 - DNA, 18 bp, Homo sapiens
gcatgggaaagccacctc

SEQ ID NO: 1079252 - DNA, 17 bp, Homo sapiens
gcatgggcattgcagcc

SEQ ID NO: 1079253 - DNA, 19 bp, Homo sapiens
gcatgggcattgcagcctt

SEQ ID NO: 1079254 - DNA, 11 bp, Homo sapiens
gcatgggcctc

SEQ ID NO: 1079255 - DNA, 12 bp, Homo sapiens
gcatgggcctct

SEQ ID NO: 1079256 - DNA, 14 bp, Homo sapiens
gcatgggcctctct

SEQ ID NO: 1079257 - DNA, 15 bp, Homo sapiens
gcatgggcctctctg

SEQ ID NO: 1079258 - DNA, 17 bp, Homo sapiens
gcatggggaggcagcag

SEQ ID NO: 1079259 - DNA, 18 bp, Homo sapiens
gcatggggaggcagcaga

SEQ ID NO: 1079260 - DNA, 19 bp, Homo sapiens
gcatggggcagaggcttcc

SEQ ID NO: 1079261 - DNA, 21 bp, Homo sapiens
gcatggggcccctggcccaga

SEQ ID NO: 1079262 - DNA, 22 bp, Homo sapiens
gcatggggcccctggcccagag

SEQ ID NO: 1079263 - DNA, 16 bp, Homo sapiens
gcatgttatgtttaat

SEQ ID NO: 1079264 - DNA, 18 bp, Homo sapiens
gcatgttatgtttaataa

SEQ ID NO: 1079265 - DNA, 14 bp, Homo sapiens
gcatgttcctcctt

SEQ ID NO: 1079266 - DNA, 19 bp, Homo sapiens
gcatgttgggttgttacag

SEQ ID NO: 1079267 - DNA, 16 bp, Homo sapiens
gcatgtttcactcctg

SEQ ID NO: 1079268 - DNA, 15 bp, Homo sapiens
gcatgtttccagcag

SEQ ID NO: 1079269 - DNA, 23 bp, Homo sapiens
gcattaaaaaaaaaaaaaaactc

SEQ ID NO: 1079270 - DNA, 15 bp, Homo sapiens
gcattaaaagaaaat

SEQ ID NO: 1079271 - DNA, 13 bp, Homo sapiens
gcattaaaccaca

SEQ ID NO: 1079272 - DNA, 21 bp, Homo sapiens
gcattaaaccacatcatggac

SEQ ID NO: 1079273 - DNA, 15 bp, Homo sapiens
gcattaaacctgtct

SEQ ID NO: 1079274 - DNA, 18 bp, Homo sapiens
gcattaaattcacaaact

SEQ ID NO: 1079275 - DNA, 17 bp, Homo sapiens
gcattaactaaatgctc

SEQ ID NO: 1079276 - DNA, 14 bp, Homo sapiens
gcattaactaatct

SEQ ID NO: 1079277 - DNA, 22 bp, Homo sapiens
gcattaactaatctattgggtt

SEQ ID NO: 1079278 - DNA, 14 bp, Homo sapiens
gcattaagaggttt

SEQ ID NO: 1079279 - DNA, 17 bp, Homo sapiens
gcattaagcacacacat

SEQ ID NO: 1079280 - DNA, 13 bp, Homo sapiens
gcattaatgtttc

SEQ ID NO: 1079281 - DNA, 23 bp, Homo sapiens
gcattaccgcgttgtaaaatata

SEQ ID NO: 1079282 - DNA, 15 bp, Homo sapiens
gcattacgtgagcca

SEQ ID NO: 1079283 - DNA, 18 bp, Homo sapiens
gcattacgtgagccaggt

SEQ ID NO: 1079284 - DNA, 21 bp, Homo sapiens
gcattactgtccccttgatat

SEQ ID NO: 1079285 - DNA, 15 bp, Homo sapiens
gcattataaaaagaa

SEQ ID NO: 1079286 - DNA, 17 bp, Homo sapiens
gcattatctagatactg

SEQ ID NO: 1079287 - DNA, 24 bp, Homo sapiens
gcattatctagatactgtatcatg

SEQ ID NO: 1079288 - DNA, 14 bp, Homo sapiens
gcattattaaattg

SEQ ID NO: 1079289 - DNA, 18 bp, Homo sapiens
gcattcagaagaaaaaga

SEQ ID NO: 1079290 - DNA, 13 bp, Homo sapiens
gcattcagagagc

SEQ ID NO: 1079291 - DNA, 14 bp, Homo sapiens
gcattcatttttat

SEQ ID NO: 1079292 - DNA, 18 bp, Homo sapiens
gcattcatttttatagca

SEQ ID NO: 1079293 - DNA, 12 bp, Homo sapiens
gcattccagaat

SEQ ID NO: 1079294 - DNA, 14 bp, Homo sapiens
gcattccagaatct

SEQ ID NO: 1079295 - DNA, 12 bp, Homo sapiens
gcattccagccc

SEQ ID NO: 1079296 - DNA, 17 bp, Homo sapiens
gcattccagctctgccc

SEQ ID NO: 1079297 - DNA, 22 bp, Homo sapiens
gcattccagtaacttttttgtg

SEQ ID NO: 1079298 - DNA, 13 bp, Homo sapiens
gcattcccagtgg

SEQ ID NO: 1079299 - DNA, 16 bp, Homo sapiens
gcattccttacttgca

SEQ ID NO: 1079300 - DNA, 19 bp, Homo sapiens
gcattcgaagaaacccttg

SEQ ID NO: 1079301 - DNA, 23 bp, Homo sapiens
gcattcgctgtaccctttaagat

SEQ ID NO: 1079302 - DNA, 23 bp, Homo sapiens
gcattcgttgtgttttttaagat

SEQ ID NO: 1079303 - DNA, 13 bp, Homo sapiens
gcattctcactcc

SEQ ID NO: 1079304 - DNA, 15 bp, Homo sapiens
gcattctcactccta

SEQ ID NO: 1079305 - DNA, 18 bp, Homo sapiens
gcattctcactcctacct

SEQ ID NO: 1079306 - DNA, 20 bp, Homo sapiens
gcattctctcccatcctggg

SEQ ID NO: 1079307 - DNA, 21 bp, Homo sapiens
gcattctctcccatcctgggg

SEQ ID NO: 1079308 - DNA, 14 bp, Homo sapiens
gcattctctgaaga

SEQ ID NO: 1079309 - DNA, 16 bp, Homo sapiens
gcattctgagctgggc

SEQ ID NO: 1079310 - DNA, 17 bp, Homo sapiens
gcattctggccaagggg

SEQ ID NO: 1079311 - DNA, 16 bp, Homo sapiens
gcattctgtttcctct

SEQ ID NO: 1079312 - DNA, 22 bp, Homo sapiens
gcattcttaacaaactcttcag

SEQ ID NO: 1079313 - DNA, 14 bp, Homo sapiens
gcattcttctctgt

SEQ ID NO: 1079314 - DNA, 15 bp, Homo sapiens
gcattcttgtacagt

SEQ ID NO: 1079315 - DNA, 17 bp, Homo sapiens
gcattctttggtaattt

SEQ ID NO: 1079316 - DNA, 20 bp, Homo sapiens
gcattctttggtaatttttt

SEQ ID NO: 1079317 - DNA, 19 bp, Homo sapiens
gcattgaatggctatgttt

SEQ ID NO: 1079318 - DNA, 21 bp, Homo sapiens
gcattgaatggctatgttttt

SEQ ID NO: 1079319 - DNA, 23 bp, Homo sapiens
gcattgaccgcgactaatttcaa

SEQ ID NO: 1079320 - DNA, 20 bp, Homo sapiens
gcattgactcagatatagat

SEQ ID NO: 1079321 - DNA, 23 bp, Homo sapiens
gcattgactggtttacaggccct

SEQ ID NO: 1079322 - DNA, 15 bp, Homo sapiens
gcattgagcatattt

SEQ ID NO: 1079323 - DNA, 13 bp, Homo sapiens
gcattgataatct

SEQ ID NO: 1079324 - DNA, 17 bp, Homo sapiens
gcattgataatcttcag

SEQ ID NO: 1079325 - DNA, 13 bp, Homo sapiens
gcattgcagcctt

SEQ ID NO: 1079326 - DNA, 15 bp, Homo sapiens
gcattgcagccttgc

SEQ ID NO: 1079327 - DNA, 16 bp, Homo sapiens
gcattgccaagggctt

SEQ ID NO: 1079328 - DNA, 14 bp, Homo sapiens
gcattgctggacta

SEQ ID NO: 1079329 - DNA, 12 bp, Homo sapiens
gcattgctttcc

SEQ ID NO: 1079330 - DNA, 20 bp, Homo sapiens
gcattgctttctgaaattag

SEQ ID NO: 1079331 - DNA, 16 bp, Homo sapiens
gcattggaagagcccg

SEQ ID NO: 1079332 - DNA, 13 bp, Homo sapiens
gcattggaattct

SEQ ID NO: 1079333 - DNA, 22 bp, Homo sapiens
gcattggaattctactggaaaa

SEQ ID NO: 1079334 - DNA, 16 bp, Homo sapiens
gcattggcccctgagc

SEQ ID NO: 1079335 - DNA, 19 bp, Homo sapiens
gcattggcccctgagccca

SEQ ID NO: 1079336 - DNA, 22 bp, Homo sapiens
gcattggcccctgagcccagag

SEQ ID NO: 1079337 - DNA, 16 bp, Homo sapiens
gcattggcctctgtgt

SEQ ID NO: 1079338 - DNA, 16 bp, Homo sapiens
gcattggggggccggg

SEQ ID NO: 1079339 - DNA, 20 bp, Homo sapiens
gcattgtaaaagcattttgt

SEQ ID NO: 1079340 - DNA, 20 bp, Homo sapiens
gccaaccccacccagctcca

SEQ ID NO: 1079341 - DNA, 20 bp, Homo sapiens
gccaaccctgcctgccgctg

SEQ ID NO: 1079342 - DNA, 23 bp, Homo sapiens
gccaacccttctcctcttgtaaa

SEQ ID NO: 1079343 - DNA, 15 bp, Homo sapiens
gccaacgcctcctgt

SEQ ID NO: 1079344 - DNA, 18 bp, Homo sapiens
gccaacggcaacagcatg

SEQ ID NO: 1079345 - DNA, 15 bp, Homo sapiens
gccaactagcccctg

SEQ ID NO: 1079346 - DNA, 20 bp, Homo sapiens
gccaactagcccctggggtg

SEQ ID NO: 1079347 - DNA, 14 bp, Homo sapiens
gccaactgaagcct

SEQ ID NO: 1079348 - DNA, 21 bp, Homo sapiens
gccaactgcaaaaaaagcctc

SEQ ID NO: 1079349 - DNA, 13 bp, Homo sapiens
gccaactgccccg

SEQ ID NO: 1079350 - DNA, 13 bp, Homo sapiens
gccaacttctccc

SEQ ID NO: 1079351 - DNA, 15 bp, Homo sapiens
gccaacttctcccac

SEQ ID NO: 1079352 - DNA, 17 bp, Homo sapiens
gccaacttctcccaccc

SEQ ID NO: 1079353 - DNA, 15 bp, Homo sapiens
gccaacttgccatgt

SEQ ID NO: 1079354 - DNA, 21 bp, Homo sapiens
gccaactttccccacgttaaa

SEQ ID NO: 1079355 - DNA, 22 bp, Homo sapiens
gccaagaaacactgcctgccct

SEQ ID NO: 1079356 - DNA, 22 bp, Homo sapiens
gccaagaaacgtcttctaaact

SEQ ID NO: 1079357 - DNA, 15 bp, Homo sapiens
gccaagaagcagtgg

SEQ ID NO: 1079358 - DNA, 16 bp, Homo sapiens
gccaagaagcagtggc

SEQ ID NO: 1079359 - DNA, 14 bp, Homo sapiens
gccaagaatacttg

SEQ ID NO: 1079360 - DNA, 17 bp, Homo sapiens
gccaagacaaatcaaca

SEQ ID NO: 1079361 - DNA, 16 bp, Homo sapiens
gccaagacaaggaggt

SEQ ID NO: 1079362 - DNA, 14 bp, Homo sapiens
gccaagactcctca

SEQ ID NO: 1079363 - DNA, 12 bp, Homo sapiens
gccaagacttgg

SEQ ID NO: 1079364 - DNA, 22 bp, Homo sapiens
gccaagacttggcaacagaagc

SEQ ID NO: 1079365 - DNA, 18 bp, Homo sapiens
gccaagatcgcgccactg

SEQ ID NO: 1079366 - DNA, 13 bp, Homo sapiens
gccaagatggaag

SEQ ID NO: 1079367 - DNA, 22 bp, Homo sapiens
gccaagcccctgccctggggag

SEQ ID NO: 1079368 - DNA, 19 bp, Homo sapiens
gccaagccctaagcctgtc

SEQ ID NO: 1079369 - DNA, 15 bp, Homo sapiens
gccacagtgggatga

SEQ ID NO: 1079370 - DNA, 20 bp, Homo sapiens
gccacagtgggatgaaccag

SEQ ID NO: 1079371 - DNA, 21 bp, Homo sapiens
gccacagtgttatgctctgtg

SEQ ID NO: 1079372 - DNA, 16 bp, Homo sapiens
gccacatcagccccac

SEQ ID NO: 1079373 - DNA, 16 bp, Homo sapiens
gccacatcattctgtg

SEQ ID NO: 1079374 - DNA, 21 bp, Homo sapiens
gccacatcgttgagacatcag

SEQ ID NO: 1079375 - DNA, 16 bp, Homo sapiens
gccacatggtgtctcc

SEQ ID NO: 1079376 - DNA, 18 bp, Homo sapiens
gccacatggtgtctccca

SEQ ID NO: 1079377 - DNA, 22 bp, Homo sapiens
gccacatggtgtctcccaacat

SEQ ID NO: 1079378 - DNA, 12 bp, Homo sapiens
gccacatttaat

SEQ ID NO: 1079379 - DNA, 22 bp, Homo sapiens
gccaccaacataaaacaaaacc

SEQ ID NO: 1079380 - DNA, 21 bp, Homo sapiens
gccaccaccactctcactcca

SEQ ID NO: 1079381 - DNA, 21 bp, Homo sapiens
gccaccaccctcaggtgcctc

SEQ ID NO: 1079382 - DNA, 16 bp, Homo sapiens
gccaccacctctgtgg

SEQ ID NO: 1079383 - DNA, 15 bp, Homo sapiens
gccaccacgtccagc

SEQ ID NO: 1079384 - DNA, 15 bp, Homo sapiens
gccaccacgtctgcc

SEQ ID NO: 1079385 - DNA, 16 bp, Homo sapiens
gccaccacgtctgcca

SEQ ID NO: 1079386 - DNA, 18 bp, Homo sapiens
gccaccacgtctgccagg

SEQ ID NO: 1079387 - DNA, 20 bp, Homo sapiens
gccaccacgtctgccaggcc

SEQ ID NO: 1079388 - DNA, 13 bp, Homo sapiens
gccaccacttcca

SEQ ID NO: 1079389 - DNA, 14 bp, Homo sapiens
gccaccagcatcca

SEQ ID NO: 1079390 - DNA, 14 bp, Homo sapiens
gccaccagccatcc

SEQ ID NO: 1079391 - DNA, 22 bp, Homo sapiens
gccaccagcccccgccccagag

SEQ ID NO: 1079392 - DNA, 17 bp, Homo sapiens
gccaccagctctgccgt

SEQ ID NO: 1079393 - DNA, 12 bp, Homo sapiens
gccaccaggctg

SEQ ID NO: 1079394 - DNA, 14 bp, Homo sapiens
gccaccaggctggc

SEQ ID NO: 1079395 - DNA, 20 bp, Homo sapiens
gccaccaggctggcgcagcc

SEQ ID NO: 1079396 - DNA, 13 bp, Homo sapiens
gccaccagggagc

SEQ ID NO: 1079397 - DNA, 19 bp, Homo sapiens
gccaccagggagcttcctg

SEQ ID NO: 1079398 - DNA, 22 bp, Homo sapiens
gccaccagtggacctagcctgg

SEQ ID NO: 1079399 - DNA, 16 bp, Homo sapiens
gccaccatccccaccc

SEQ ID NO: 1079400 - DNA, 18 bp, Homo sapiens
gccaccatcctattgcaa

SEQ ID NO: 1079401 - DNA, 17 bp, Homo sapiens
gccaccatgaccccttc

SEQ ID NO: 1079402 - DNA, 14 bp, Homo sapiens
gccaccatgcttgc

SEQ ID NO: 1079403 - DNA, 17 bp, Homo sapiens
gccaccatgcttgcctg

SEQ ID NO: 1079404 - DNA, 18 bp, Homo sapiens
gccaccatggccagccaa

SEQ ID NO: 1079405 - DNA, 17 bp, Homo sapiens
gccacccaagcctgctg

SEQ ID NO: 1079406 - DNA, 21 bp, Homo sapiens
gccacccacctccctgcctcc

SEQ ID NO: 1079407 - DNA, 19 bp, Homo sapiens
gccacccatcgtccacccc

SEQ ID NO: 1079408 - DNA, 16 bp, Homo sapiens
gccaccccaaacccca

SEQ ID NO: 1079409 - DNA, 18 bp, Homo sapiens
gccaccccaaaccccagc

SEQ ID NO: 1079410 - DNA, 22 bp, Homo sapiens
gccaccccaaaccccagcccca

SEQ ID NO: 1079411 - DNA, 15 bp, Homo sapiens
gccaccccatgagct

SEQ ID NO: 1079412 - DNA, 16 bp, Homo sapiens
gccaccccatgtgcct

SEQ ID NO: 1079413 - DNA, 21 bp, Homo sapiens
gccacccccgcccccaccggg

SEQ ID NO: 1079414 - DNA, 23 bp, Homo sapiens
gccacccccgcccccaccgggct

SEQ ID NO: 1079415 - DNA, 19 bp, Homo sapiens
gccaccccgggctctctgc

SEQ ID NO: 1079416 - DNA, 20 bp, Homo sapiens
gccacccgtaggcagcctct

SEQ ID NO: 1079417 - DNA, 20 bp, Homo sapiens
gccacccgtggggtgctgcc

SEQ ID NO: 1079418 - DNA, 21 bp, Homo sapiens
gccacccgtggggtgctgccc

SEQ ID NO: 1079419 - DNA, 18 bp, Homo sapiens
gccacccgttctgctggc

SEQ ID NO: 1079420 - DNA, 23 bp, Homo sapiens
gccacccgttctgctggcctgga

SEQ ID NO: 1079421 - DNA, 15 bp, Homo sapiens
gccaccctcacacac

SEQ ID NO: 1079422 - DNA, 19 bp, Homo sapiens
gccaccctcacacacacag

SEQ ID NO: 1079423 - DNA, 10 bp, Homo sapiens
gccaccctgc

SEQ ID NO: 1079424 - DNA, 17 bp, Homo sapiens
gccaccctgcccctaag

SEQ ID NO: 1079425 - DNA, 12 bp, Homo sapiens
gccaccctgctg

SEQ ID NO: 1079426 - DNA, 13 bp, Homo sapiens
gccaccctgctgc

SEQ ID NO: 1079427 - DNA, 17 bp, Homo sapiens
gccaccctgctgcacta

SEQ ID NO: 1079428 - DNA, 13 bp, Homo sapiens
gccacccttggcc

SEQ ID NO: 1079429 - DNA, 18 bp, Homo sapiens
gccaccgactgcccagcc

SEQ ID NO: 1079430 - DNA, 19 bp, Homo sapiens
gccaccgactgcccagcca

SEQ ID NO: 1079431 - DNA, 19 bp, Homo sapiens
gccaccgcgccctcctgcc

SEQ ID NO: 1079432 - DNA, 22 bp, Homo sapiens
gccaccgcgggtgtgggaaagc

SEQ ID NO: 1079433 - DNA, 15 bp, Homo sapiens
gccaccgctgccagc

SEQ ID NO: 1079434 - DNA, 16 bp, Homo sapiens
gccaccgctgccagca

SEQ ID NO: 1079435 - DNA, 15 bp, Homo sapiens
gccaccggcctgtgg

SEQ ID NO: 1079436 - DNA, 19 bp, Homo sapiens
gccaccggcctgtgggtct

SEQ ID NO: 1079437 - DNA, 16 bp, Homo sapiens
gccaccgggcagcctg

SEQ ID NO: 1079438 - DNA, 14 bp, Homo sapiens
gccaccgtgcctgg

SEQ ID NO: 1079439 - DNA, 17 bp, Homo sapiens
gccaccgtgcctggcca

SEQ ID NO: 1079440 - DNA, 17 bp, Homo sapiens
gccaccgtgcctggcta

SEQ ID NO: 1079441 - DNA, 14 bp, Homo sapiens
gccaccgtggggga

SEQ ID NO: 1079442 - DNA, 24 bp, Homo sapiens
gccaccgtttcttcctgccagcag

SEQ ID NO: 1079443 - DNA, 20 bp, Homo sapiens
gccacctatgcctgtggtga

SEQ ID NO: 1079444 - DNA, 13 bp, Homo sapiens
gccacctcagggc

SEQ ID NO: 1079445 - DNA, 20 bp, Homo sapiens
gccacctcccctatccaccc

SEQ ID NO: 1079446 - DNA, 22 bp, Homo sapiens
gccacctcccctatccacccag

SEQ ID NO: 1079447 - DNA, 14 bp, Homo sapiens
gccacctcctcccc

SEQ ID NO: 1079448 - DNA, 13 bp, Homo sapiens
gccacctctccaa

SEQ ID NO: 1079449 - DNA, 14 bp, Homo sapiens
gccacctctccaag

SEQ ID NO: 1079450 - DNA, 22 bp, Homo sapiens
gccacctctccaagggcttctg

SEQ ID NO: 1079451 - DNA, 17 bp, Homo sapiens
gccacctctttaaaaac

SEQ ID NO: 1079452 - DNA, 15 bp, Homo sapiens
gccacctgaggtggg

SEQ ID NO: 1079453 - DNA, 19 bp, Homo sapiens
gccacctgaggtgggccca

SEQ ID NO: 1079454 - DNA, 21 bp, Homo sapiens
gccacctgaggtgggcccagg

SEQ ID NO: 1079455 - DNA, 10 bp, Homo sapiens
gccacctgca

SEQ ID NO: 1079456 - DNA, 13 bp, Homo sapiens
gccacctgcaaga

SEQ ID NO: 1079457 - DNA, 13 bp, Homo sapiens
gccacctgcagga

SEQ ID NO: 1079458 - DNA, 20 bp, Homo sapiens
gccacctgcccccttctccc

SEQ ID NO: 1079459 - DNA, 23 bp, Homo sapiens
gccacctgcccccttctcccaca

SEQ ID NO: 1079460 - DNA, 13 bp, Homo sapiens
gccacctggatct

SEQ ID NO: 1079461 - DNA, 20 bp, Homo sapiens
gccacctggcagggctcaca

SEQ ID NO: 1079462 - DNA, 15 bp, Homo sapiens
gccacctgtccggcc

SEQ ID NO: 1079463 - DNA, 16 bp, Homo sapiens
gccacctgtccggccc

SEQ ID NO: 1079464 - DNA, 21 bp, Homo sapiens
gccacctgtccggcccagtgc

SEQ ID NO: 1079465 - DNA, 12 bp, Homo sapiens
gccaccttccca

SEQ ID NO: 1079466 - DNA, 14 bp, Homo sapiens
gccaccttcccacc

SEQ ID NO: 1079467 - DNA, 13 bp, Homo sapiens
gcatttggtgcct

SEQ ID NO: 1079468 - DNA, 23 bp, Homo sapiens
gcatttggtggtttcagaaatgt

SEQ ID NO: 1079469 - DNA, 22 bp, Homo sapiens
gcatttgtaaaaatgagacttt

SEQ ID NO: 1079470 - DNA, 14 bp, Homo sapiens
gcatttgtatatta

SEQ ID NO: 1079471 - DNA, 16 bp, Homo sapiens
gcatttgtattttgtg

SEQ ID NO: 1079472 - DNA, 13 bp, Homo sapiens
gcatttgtcaatg

SEQ ID NO: 1079473 - DNA, 22 bp, Homo sapiens
gcatttgtttctttctctgagg

SEQ ID NO: 1079474 - DNA, 23 bp, Homo sapiens
gcattttaaacaaaatagaaagt

SEQ ID NO: 1079475 - DNA, 13 bp, Homo sapiens
gcattttaagtaa

SEQ ID NO: 1079476 - DNA, 17 bp, Homo sapiens
gcattttactgtacaga

SEQ ID NO: 1079477 - DNA, 16 bp, Homo sapiens
gcattttagaaactac

SEQ ID NO: 1079478 - DNA, 16 bp, Homo sapiens
gcattttattgcttga

SEQ ID NO: 1079479 - DNA, 22 bp, Homo sapiens
gcattttcacattttgcctttc

SEQ ID NO: 1079480 - DNA, 18 bp, Homo sapiens
gcattttcaccccaccct

SEQ ID NO: 1079481 - DNA, 12 bp, Homo sapiens
gcattttcctcc

SEQ ID NO: 1079482 - DNA, 16 bp, Homo sapiens
gcattttcctcctctg

SEQ ID NO: 1079483 - DNA, 20 bp, Homo sapiens
gcattttcctcttgtcctgg

SEQ ID NO: 1079484 - DNA, 17 bp, Homo sapiens
gcattttctgatgtatt

SEQ ID NO: 1079485 - DNA, 15 bp, Homo sapiens
gcattttgaaacaaa

SEQ ID NO: 1079486 - DNA, 22 bp, Homo sapiens
gcattttgctaaatgtgaatga

SEQ ID NO: 1079487 - DNA, 20 bp, Homo sapiens
gcatttttcaatatattgaa

SEQ ID NO: 1079488 - DNA, 16 bp, Homo sapiens
gcatttttccatctgt

SEQ ID NO: 1079489 - DNA, 13 bp, Homo sapiens
gcatttttcttat

SEQ ID NO: 1079490 - DNA, 20 bp, Homo sapiens
gcatttttgatttatgcatg

SEQ ID NO: 1079491 - DNA, 18 bp, Homo sapiens
gcatttttgtgaaatgaa

SEQ ID NO: 1079492 - DNA, 11 bp, Homo sapiens
gcatttttgtt

SEQ ID NO: 1079493 - DNA, 15 bp, Homo sapiens
gcatttttgttttga

SEQ ID NO: 1079494 - DNA, 19 bp, Homo sapiens
gcattttttaacctcctaa

SEQ ID NO: 1079495 - DNA, 14 bp, Homo sapiens
gccaaaaaaagaca

SEQ ID NO: 1079496 - DNA, 18 bp, Homo sapiens
gccaaaaccaatgctgat

SEQ ID NO: 1079497 - DNA, 20 bp, Homo sapiens
gccaaaaccaatgctgatga

SEQ ID NO: 1079498 - DNA, 14 bp, Homo sapiens
gccaaaaccacatg

SEQ ID NO: 1079499 - DNA, 16 bp, Homo sapiens
gccaaaaccacatggg

SEQ ID NO: 1079500 - DNA, 19 bp, Homo sapiens
gccaaaagtccctccctgc

SEQ ID NO: 1079501 - DNA, 17 bp, Homo sapiens
gccaaaatatttggaat

SEQ ID NO: 1079502 - DNA, 15 bp, Homo sapiens
gccaaaatcaagagt

SEQ ID NO: 1079503 - DNA, 21 bp, Homo sapiens
gccaaaatcctgaactttctc

SEQ ID NO: 1079504 - DNA, 20 bp, Homo sapiens
gccaaacatcagacctgtct

SEQ ID NO: 1079505 - DNA, 22 bp, Homo sapiens
gccaaacccatgaggcaatgtc

SEQ ID NO: 1079506 - DNA, 18 bp, Homo sapiens
gccaaacccttgtcagtg

SEQ ID NO: 1079507 - DNA, 18 bp, Homo sapiens
gccaaactctgccagcca

SEQ ID NO: 1079508 - DNA, 16 bp, Homo sapiens
gccaaagaaacaagct

SEQ ID NO: 1079509 - DNA, 18 bp, Homo sapiens
gccaaagaatatttaaat

SEQ ID NO: 1079510 - DNA, 20 bp, Homo sapiens
gccaaagatgtttgaaaatg

SEQ ID NO: 1079511 - DNA, 16 bp, Homo sapiens
gccaaagccaggcctg

SEQ ID NO: 1079512 - DNA, 20 bp, Homo sapiens
gccaaagctagggtggccct

SEQ ID NO: 1079513 - DNA, 15 bp, Homo sapiens
gccaaagctttacta

SEQ ID NO: 1079514 - DNA, 23 bp, Homo sapiens
gccaaagctttactactgtggaa

SEQ ID NO: 1079515 - DNA, 17 bp, Homo sapiens
gccaaaggatgtgatat

SEQ ID NO: 1079516 - DNA, 19 bp, Homo sapiens
gccaaagggaaatatcatt

SEQ ID NO: 1079517 - DNA, 13 bp, Homo sapiens
gccaaaggggagc

SEQ ID NO: 1079518 - DNA, 17 bp, Homo sapiens
gccaaagtacagaattt

SEQ ID NO: 1079519 - DNA, 17 bp, Homo sapiens
gccaaagtgcagccctt

SEQ ID NO: 1079520 - DNA, 20 bp, Homo sapiens
gccaaagtgcagcccttcct

SEQ ID NO: 1079521 - DNA, 16 bp, Homo sapiens
gccaaagtgcctggga

SEQ ID NO: 1079522 - DNA, 12 bp, Homo sapiens
gccaaagtgtta

SEQ ID NO: 1079523 - DNA, 17 bp, Homo sapiens
gccaaagtttctgttga

SEQ ID NO: 1079524 - DNA, 20 bp, Homo sapiens
gccaaataaatcatcctcat

SEQ ID NO: 1079525 - DNA, 17 bp, Homo sapiens
gccaaatagccccagac

SEQ ID NO: 1079526 - DNA, 18 bp, Homo sapiens
gccaaatagccccagact

SEQ ID NO: 1079527 - DNA, 19 bp, Homo sapiens
gccaaatagccccagactg

SEQ ID NO: 1079528 - DNA, 21 bp, Homo sapiens
gccaaatagccccagactggg

SEQ ID NO: 1079529 - DNA, 19 bp, Homo sapiens
gccaaataggagggagact

SEQ ID NO: 1079530 - DNA, 17 bp, Homo sapiens
gccaaatatgcactttc

SEQ ID NO: 1079531 - DNA, 22 bp, Homo sapiens
gccaaatccgctctcttcctgc

SEQ ID NO: 1079532 - DNA, 21 bp, Homo sapiens
gccaaatgcagggaggggagg

SEQ ID NO: 1079533 - DNA, 18 bp, Homo sapiens
gccaaatgttaactgcca

SEQ ID NO: 1079534 - DNA, 15 bp, Homo sapiens
gccaaattatttgtg

SEQ ID NO: 1079535 - DNA, 21 bp, Homo sapiens
gccaacaagaccgccccaggg

SEQ ID NO: 1079536 - DNA, 17 bp, Homo sapiens
gccaacacgcacctgcc

SEQ ID NO: 1079537 - DNA, 23 bp, Homo sapiens
gccaacacgcacctgcctcagga

SEQ ID NO: 1079538 - DNA, 19 bp, Homo sapiens
gccaacagaagcttccatt

SEQ ID NO: 1079539 - DNA, 22 bp, Homo sapiens
gccaacaggtggcaggaccagg

SEQ ID NO: 1079540 - DNA, 13 bp, Homo sapiens
gccaacagttgta

SEQ ID NO: 1079541 - DNA, 22 bp, Homo sapiens
gccaacatcgtgaaaccctgtc

SEQ ID NO: 1079542 - DNA, 23 bp, Homo sapiens
gccaacatcgtgaaaccctgtct

SEQ ID NO: 1079543 - DNA, 17 bp, Homo sapiens
gccaaccagcccgacag

SEQ ID NO: 1079544 - DNA, 13 bp, Homo sapiens
gccaaccagcctt

SEQ ID NO: 1079545 - DNA, 17 bp, Homo sapiens
gccaaccaggacccagg

SEQ ID NO: 1079546 - DNA, 18 bp, Homo sapiens
gccaaccaggacccaggg

SEQ ID NO: 1079547 - DNA, 20 bp, Homo sapiens
gccaaccaggacccagggtc

SEQ ID NO: 1079548 - DNA, 20 bp, Homo sapiens
gccagaccccgtggctctgg

SEQ ID NO: 1079549 - DNA, 22 bp, Homo sapiens
gccagaccccgtggctctggga

SEQ ID NO: 1079550 - DNA, 19 bp, Homo sapiens
gccagacgctgccgctgcc

SEQ ID NO: 1079551 - DNA, 21 bp, Homo sapiens
gccagactctaggttatacaa

SEQ ID NO: 1079552 - DNA, 12 bp, Homo sapiens
gccagagaaact

SEQ ID NO: 1079553 - DNA, 12 bp, Homo sapiens
gccagagacata

SEQ ID NO: 1079554 - DNA, 19 bp, Homo sapiens
gccagagagcaggggagct

SEQ ID NO: 1079555 - DNA, 20 bp, Homo sapiens
gccagagagcaggggagctt

SEQ ID NO: 1079556 - DNA, 13 bp, Homo sapiens
gccagagaggagc

SEQ ID NO: 1079557 - DNA, 15 bp, Homo sapiens
gccagagaggagcac

SEQ ID NO: 1079558 - DNA, 15 bp, Homo sapiens
gccagagagggccca

SEQ ID NO: 1079559 - DNA, 16 bp, Homo sapiens
gccagagagggcccag

SEQ ID NO: 1079560 - DNA, 20 bp, Homo sapiens
gccagagagggcccagctgt

SEQ ID NO: 1079561 - DNA, 16 bp, Homo sapiens
gccagagcaggagccc

SEQ ID NO: 1079562 - DNA, 19 bp, Homo sapiens
gccagagccatgccaggct

SEQ ID NO: 1079563 - DNA, 18 bp, Homo sapiens
gccagagcctctggcccc

SEQ ID NO: 1079564 - DNA, 22 bp, Homo sapiens
gccagagcctctggcccctcac

SEQ ID NO: 1079565 - DNA, 10 bp, Homo sapiens
gccagagcta

SEQ ID NO: 1079566 - DNA, 20 bp, Homo sapiens
gccagagctagggctgctgc

SEQ ID NO: 1079567 - DNA, 19 bp, Homo sapiens
gccagagctgaaccttgag

SEQ ID NO: 1079568 - DNA, 17 bp, Homo sapiens
gccagagctggaaggca

SEQ ID NO: 1079569 - DNA, 18 bp, Homo sapiens
gccagagctggaaggcag

SEQ ID NO: 1079570 - DNA, 21 bp, Homo sapiens
gccagagctgggtggggacag

SEQ ID NO: 1079571 - DNA, 16 bp, Homo sapiens
gccagagctgtgcctg

SEQ ID NO: 1079572 - DNA, 23 bp, Homo sapiens
gccagagctgtgcctgctcagca

SEQ ID NO: 1079573 - DNA, 18 bp, Homo sapiens
gccagaggaactgtccag

SEQ ID NO: 1079574 - DNA, 23 bp, Homo sapiens
gccagaggaactgtccagagagc

SEQ ID NO: 1079575 - DNA, 24 bp, Homo sapiens
gccagaggaactgtccagagagca

SEQ ID NO: 1079576 - DNA, 18 bp, Homo sapiens
gccagaggaatcctggca

SEQ ID NO: 1079577 - DNA, 19 bp, Homo sapiens
gccagaggaatcctggcag

SEQ ID NO: 1079578 - DNA, 20 bp, Homo sapiens
gccagaggaatcctggcagc

SEQ ID NO: 1079579 - DNA, 24 bp, Homo sapiens
gccagaggaatcctggcagcccag

SEQ ID NO: 1079580 - DNA, 14 bp, Homo sapiens
gccagaggccctcg

SEQ ID NO: 1079581 - DNA, 23 bp, Homo sapiens
gccagaggccctcggtcagcgac

SEQ ID NO: 1079582 - DNA, 16 bp, Homo sapiens
gccagaggctgggagt

SEQ ID NO: 1079583 - DNA, 11 bp, Homo sapiens
gccagagggcc

SEQ ID NO: 1079584 - DNA, 14 bp, Homo sapiens
gccagagggccagc

SEQ ID NO: 1079585 - DNA, 15 bp, Homo sapiens
gccagaggtgggcag

SEQ ID NO: 1079586 - DNA, 16 bp, Homo sapiens
gccagaggtgggcagg

SEQ ID NO: 1079587 - DNA, 15 bp, Homo sapiens
gccagagtctcccag

SEQ ID NO: 1079588 - DNA, 19 bp, Homo sapiens
gccagagtctcccagtggg

SEQ ID NO: 1079589 - DNA, 14 bp, Homo sapiens
gccagagtggcctg

SEQ ID NO: 1079590 - DNA, 18 bp, Homo sapiens
gccagagtggcctggcca

SEQ ID NO: 1079591 - DNA, 19 bp, Homo sapiens
gccagagtggcctggccag

SEQ ID NO: 1079592 - DNA, 22 bp, Homo sapiens
gccagagttcctgcggagtgaa

SEQ ID NO: 1079593 - DNA, 15 bp, Homo sapiens
gccagataaaatgtt

SEQ ID NO: 1079594 - DNA, 21 bp, Homo sapiens
gccagatataactgtcttgtt

SEQ ID NO: 1079595 - DNA, 13 bp, Homo sapiens
gccagatccaccc

SEQ ID NO: 1079596 - DNA, 14 bp, Homo sapiens
gccagatcttaggt

SEQ ID NO: 1079597 - DNA, 20 bp, Homo sapiens
gccagattctgcctctctgg

SEQ ID NO: 1079598 - DNA, 15 bp, Homo sapiens
gccagattgccatcc

SEQ ID NO: 1079599 - DNA, 20 bp, Homo sapiens
gccagattgtggggtgcagc

SEQ ID NO: 1079600 - DNA, 16 bp, Homo sapiens
gccagatttgtctttt

SEQ ID NO: 1079601 - DNA, 20 bp, Homo sapiens
gccagatttgtctttttgtt

SEQ ID NO: 1079602 - DNA, 16 bp, Homo sapiens
gccagattttttaaaa

SEQ ID NO: 1079603 - DNA, 16 bp, Homo sapiens
gccagcaaataaatac

SEQ ID NO: 1079604 - DNA, 18 bp, Homo sapiens
gccagcaacgcttgtaga

SEQ ID NO: 1079605 - DNA, 20 bp, Homo sapiens
gccagcaatgacatctcagg

SEQ ID NO: 1079606 - DNA, 17 bp, Homo sapiens
gccagcacacagggcag

SEQ ID NO: 1079607 - DNA, 18 bp, Homo sapiens
gccagcacacagggcagt

SEQ ID NO: 1079608 - DNA, 22 bp, Homo sapiens
gccagcacagaaacagaggaga

SEQ ID NO: 1079609 - DNA, 13 bp, Homo sapiens
gccagcacagagc

SEQ ID NO: 1079610 - DNA, 15 bp, Homo sapiens
gccagcacaggggcc

SEQ ID NO: 1079611 - DNA, 13 bp, Homo sapiens
gccagcaccacag

SEQ ID NO: 1079612 - DNA, 16 bp, Homo sapiens
gccagcaccacagccg

SEQ ID NO: 1079613 - DNA, 13 bp, Homo sapiens
gccagcaccacct

SEQ ID NO: 1079614 - DNA, 20 bp, Homo sapiens
gccagcaccacctacacagg

SEQ ID NO: 1079615 - DNA, 22 bp, Homo sapiens
gccagcaccacctacacaggag

SEQ ID NO: 1079616 - DNA, 12 bp, Homo sapiens
gccagcaccctc

SEQ ID NO: 1079617 - DNA, 14 bp, Homo sapiens
gccagcaccctctc

SEQ ID NO: 1079618 - DNA, 15 bp, Homo sapiens
gccagcaccctctcc

SEQ ID NO: 1079619 - DNA, 18 bp, Homo sapiens
gccagcaccctctcctgg

SEQ ID NO: 1079620 - DNA, 20 bp, Homo sapiens
gccagcaccctctcctgggg

SEQ ID NO: 1079621 - DNA, 15 bp, Homo sapiens
gccagcacttgtata

SEQ ID NO: 1079622 - DNA, 14 bp, Homo sapiens
gccagcacttgtcc

SEQ ID NO: 1079623 - DNA, 12 bp, Homo sapiens
gccagcagaggg

SEQ ID NO: 1079624 - DNA, 18 bp, Homo sapiens
gccagcagaggtcagagg

SEQ ID NO: 1079625 - DNA, 15 bp, Homo sapiens
gccagcagcagcagg

SEQ ID NO: 1079626 - DNA, 12 bp, Homo sapiens
gccagcagccag

SEQ ID NO: 1079627 - DNA, 16 bp, Homo sapiens
gccagcagccagctct

SEQ ID NO: 1079628 - DNA, 20 bp, Homo sapiens
gccagcagccagctctcagc

SEQ ID NO: 1079629 - DNA, 21 bp, Homo sapiens
gccagcagccagctctcagcc

SEQ ID NO: 1079630 - DNA, 16 bp, Homo sapiens
gccagcaggctcctgg

SEQ ID NO: 1079631 - DNA, 21 bp, Homo sapiens
gccagcaggggggctgtgcca

SEQ ID NO: 1079632 - DNA, 14 bp, Homo sapiens
gccagcataggggg

SEQ ID NO: 1079633 - DNA, 15 bp, Homo sapiens
gccagcatagggggg

SEQ ID NO: 1079634 - DNA, 18 bp, Homo sapiens
gccagcataggggggagg

SEQ ID NO: 1079635 - DNA, 16 bp, Homo sapiens
gccagccacccctgcc

SEQ ID NO: 1079636 - DNA, 17 bp, Homo sapiens
gccagccacccctgcca

SEQ ID NO: 1079637 - DNA, 12 bp, Homo sapiens
gccagccagcag

SEQ ID NO: 1079638 - DNA, 19 bp, Homo sapiens
gccagccagcagccagctc

SEQ ID NO: 1079639 - DNA, 11 bp, Homo sapiens
gccagccaggc

SEQ ID NO: 1079640 - DNA, 16 bp, Homo sapiens
gccagccaggccctgc

SEQ ID NO: 1079641 - DNA, 21 bp, Homo sapiens
gccagccagtgccattccact

SEQ ID NO: 1079642 - DNA, 13 bp, Homo sapiens
gccagccatgtct

SEQ ID NO: 1079643 - DNA, 18 bp, Homo sapiens
gccagcccaaaccttggg

SEQ ID NO: 1079644 - DNA, 21 bp, Homo sapiens
gccagcccaaaccttgggccc

SEQ ID NO: 1079645 - DNA, 12 bp, Homo sapiens
gccagcccactg

SEQ ID NO: 1079646 - DNA, 19 bp, Homo sapiens
gccagcccactgcctcctg

SEQ ID NO: 1079647 - DNA, 11 bp, Homo sapiens
gccagcccagc

SEQ ID NO: 1079648 - DNA, 12 bp, Homo sapiens
gccagcccagcc

SEQ ID NO: 1079649 - DNA, 13 bp, Homo sapiens
gccagcccagcca

SEQ ID NO: 1079650 - DNA, 13 bp, Homo sapiens
gccagcccagccc

SEQ ID NO: 1079651 - DNA, 17 bp, Homo sapiens
gccagcccatggccccc

SEQ ID NO: 1079652 - DNA, 18 bp, Homo sapiens
gccagcccatggccccca

SEQ ID NO: 1079653 - DNA, 13 bp, Homo sapiens
gccagccccaccc

SEQ ID NO: 1079654 - DNA, 14 bp, Homo sapiens
gccagccccaccca

SEQ ID NO: 1079655 - DNA, 18 bp, Homo sapiens
gccagccccacccaggag

SEQ ID NO: 1079656 - DNA, 19 bp, Homo sapiens
gccagccccacccaggagg

SEQ ID NO: 1079657 - DNA, 22 bp, Homo sapiens
gccagccccacccccagccagg

SEQ ID NO: 1079658 - DNA, 20 bp, Homo sapiens
gccagcccccccacccaccc

SEQ ID NO: 1079659 - DNA, 16 bp, Homo sapiens
gccagccccctccagc

SEQ ID NO: 1079660 - DNA, 19 bp, Homo sapiens
gccagccccctccagctca

SEQ ID NO: 1079661 - DNA, 12 bp, Homo sapiens
gccagcccctcc

SEQ ID NO: 1079662 - DNA, 16 bp, Homo sapiens
gccagcccctcccacc

SEQ ID NO: 1079663 - DNA, 20 bp, Homo sapiens
gccagcccctcccaccacag

SEQ ID NO: 1079664 - DNA, 11 bp, Homo sapiens
gccagcccctg

SEQ ID NO: 1079665 - DNA, 21 bp, Homo sapiens
gccagcccctggggcccagcc

SEQ ID NO: 1079666 - DNA, 23 bp, Homo sapiens
gccagcccgccgcccgcccctca

SEQ ID NO: 1079667 - DNA, 21 bp, Homo sapiens
gccagcccggaggggactggt

SEQ ID NO: 1079668 - DNA, 10 bp, Homo sapiens
gccagccctc

SEQ ID NO: 1079669 - DNA, 13 bp, Homo sapiens
gccagccctccct

SEQ ID NO: 1079670 - DNA, 15 bp, Homo sapiens
gccaggctgaccaca

SEQ ID NO: 1079671 - DNA, 22 bp, Homo sapiens
gccaggctgaccacagcacagc

SEQ ID NO: 1079672 - DNA, 14 bp, Homo sapiens
gccaggctgccaag

SEQ ID NO: 1079673 - DNA, 14 bp, Homo sapiens
gccaggctgcctgg

SEQ ID NO: 1079674 - DNA, 17 bp, Homo sapiens
gccatgctgggccactg

SEQ ID NO: 1079675 - DNA, 16 bp, Homo sapiens
gccatgctgtccctgc

SEQ ID NO: 1079676 - DNA, 16 bp, Homo sapiens
gccatgctttttggtg

SEQ ID NO: 1079677 - DNA, 15 bp, Homo sapiens
gccatggaaggtgcc

SEQ ID NO: 1079678 - DNA, 21 bp, Homo sapiens
gccatggaattccctcctgag

SEQ ID NO: 1079679 - DNA, 17 bp, Homo sapiens
gccatggagatctgaag

SEQ ID NO: 1079680 - DNA, 23 bp, Homo sapiens
gccatggatctgatctgtaccat

SEQ ID NO: 1079681 - DNA, 17 bp, Homo sapiens
gccatggccccccactc

SEQ ID NO: 1079682 - DNA, 22 bp, Homo sapiens
gccatggccccccactccccct

SEQ ID NO: 1079683 - DNA, 22 bp, Homo sapiens
gccatggcgtgtccctctcgga

SEQ ID NO: 1079684 - DNA, 18 bp, Homo sapiens
gccatggctcaggcaagc

SEQ ID NO: 1079685 - DNA, 21 bp, Homo sapiens
gccatggctcaggcaagcccc

SEQ ID NO: 1079686 - DNA, 17 bp, Homo sapiens
gccatggctttcatcct

SEQ ID NO: 1079687 - DNA, 18 bp, Homo sapiens
gccatggctttcatcctg

SEQ ID NO: 1079688 - DNA, 19 bp, Homo sapiens
gccatggctttcatcctgt

SEQ ID NO: 1079689 - DNA, 20 bp, Homo sapiens
gccatggctttcatcctgtg

SEQ ID NO: 1079690 - DNA, 15 bp, Homo sapiens
gccatgggacctcct

SEQ ID NO: 1079691 - DNA, 17 bp, Homo sapiens
gccatgggacctcctcc

SEQ ID NO: 1079692 - DNA, 18 bp, Homo sapiens
gccatgggacctcctccc

SEQ ID NO: 1079693 - DNA, 21 bp, Homo sapiens
gccatgggacctcctccctca

SEQ ID NO: 1079694 - DNA, 12 bp, Homo sapiens
gccatgggcctg

SEQ ID NO: 1079695 - DNA, 16 bp, Homo sapiens
gccatgggcctgctgc

SEQ ID NO: 1079696 - DNA, 16 bp, Homo sapiens
gccatgggcctgggcc

SEQ ID NO: 1079697 - DNA, 19 bp, Homo sapiens
gccatgggcctgggcctgc

SEQ ID NO: 1079698 - DNA, 14 bp, Homo sapiens
gccatgggtgcttg

SEQ ID NO: 1079699 - DNA, 24 bp, Homo sapiens
gccatggtcccgaagtgtagggca

SEQ ID NO: 1079700 - DNA, 15 bp, Homo sapiens
gccatggtggagggc

SEQ ID NO: 1079701 - DNA, 16 bp, Homo sapiens
gccatggtggagggca

SEQ ID NO: 1079702 - DNA, 17 bp, Homo sapiens
gccatggtggagggcac

SEQ ID NO: 1079703 - DNA, 18 bp, Homo sapiens
gccatggtggagggcact

SEQ ID NO: 1079704 - DNA, 21 bp, Homo sapiens
gccatggtggagggcacttca

SEQ ID NO: 1079705 - DNA, 23 bp, Homo sapiens
gccatggtggagggcacttcagg

SEQ ID NO: 1079706 - DNA, 15 bp, Homo sapiens
gccatgtaactatgt

SEQ ID NO: 1079707 - DNA, 14 bp, Homo sapiens
gccatgtaaggttg

SEQ ID NO: 1079708 - DNA, 15 bp, Homo sapiens
gccatgtactagttt

SEQ ID NO: 1079709 - DNA, 15 bp, Homo sapiens
gccatgtattatgaa

SEQ ID NO: 1079710 - DNA, 16 bp, Homo sapiens
gccatgtattatgaaa

SEQ ID NO: 1079711 - DNA, 20 bp, Homo sapiens
gccatgtattatgaaaaaga

SEQ ID NO: 1079712 - DNA, 18 bp, Homo sapiens
gccatgtatttcagggac

SEQ ID NO: 1079713 - DNA, 19 bp, Homo sapiens
gccatgtatttcagggacc

SEQ ID NO: 1079714 - DNA, 20 bp, Homo sapiens
gccatgtatttcagggacct

SEQ ID NO: 1079715 - DNA, 21 bp, Homo sapiens
gccatgtatttcagggacctc

SEQ ID NO: 1079716 - DNA, 17 bp, Homo sapiens
gccatgtcaaacaaata

SEQ ID NO: 1079717 - DNA, 18 bp, Homo sapiens
gccatgtcacctggctgc

SEQ ID NO: 1079718 - DNA, 16 bp, Homo sapiens
gccatgtcagacacag

SEQ ID NO: 1079719 - DNA, 14 bp, Homo sapiens
gccatgtccaaaga

SEQ ID NO: 1079720 - DNA, 21 bp, Homo sapiens
gccatgtggaccatattttgt

SEQ ID NO: 1079721 - DNA, 15 bp, Homo sapiens
gccatgtggcctgcc

SEQ ID NO: 1079722 - DNA, 17 bp, Homo sapiens
gccatgtggcctgccca

SEQ ID NO: 1079723 - DNA, 14 bp, Homo sapiens
gccatgttaaatga

SEQ ID NO: 1079724 - DNA, 19 bp, Homo sapiens
gccatgttggccaggctgg

SEQ ID NO: 1079725 - DNA, 18 bp, Homo sapiens
gccatgtttggttgtaaa

SEQ ID NO: 1079726 - DNA, 13 bp, Homo sapiens
gccattaaaataa

SEQ ID NO: 1079727 - DNA, 16 bp, Homo sapiens
gccattaaaataaaac

SEQ ID NO: 1079728 - DNA, 20 bp, Homo sapiens
gccattaaaataaaacaagc

SEQ ID NO: 1079729 - DNA, 22 bp, Homo sapiens
gccattaaaataaaacaagcct

SEQ ID NO: 1079730 - DNA, 22 bp, Homo sapiens
gccattagagcacagcttcttc

SEQ ID NO: 1079731 - DNA, 20 bp, Homo sapiens
gccattagccagatttgtct

SEQ ID NO: 1079732 - DNA, 18 bp, Homo sapiens
gccattattttctgtcag

SEQ ID NO: 1079733 - DNA, 14 bp, Homo sapiens
gccattccaacagc

SEQ ID NO: 1079734 - DNA, 22 bp, Homo sapiens
gccattccccaacggggtgggg

SEQ ID NO: 1079735 - DNA, 23 bp, Homo sapiens
gccattccccaacggggtgggga

SEQ ID NO: 1079736 - DNA, 20 bp, Homo sapiens
gccattcctggtacccagcc

SEQ ID NO: 1079737 - DNA, 12 bp, Homo sapiens
gccattcttcag

SEQ ID NO: 1079738 - DNA, 16 bp, Homo sapiens
gccattgaacagctgt

SEQ ID NO: 1079739 - DNA, 14 bp, Homo sapiens
gccattgaccaccc

SEQ ID NO: 1079740 - DNA, 17 bp, Homo sapiens
gccattgggtttggggc

SEQ ID NO: 1079741 - DNA, 17 bp, Homo sapiens
gccattggtccaccctt

SEQ ID NO: 1079742 - DNA, 15 bp, Homo sapiens
gccattgtaatttga

SEQ ID NO: 1079743 - DNA, 21 bp, Homo sapiens
gccattgtactccagcctggg

SEQ ID NO: 1079744 - DNA, 17 bp, Homo sapiens
gccattgtgaaccaatg

SEQ ID NO: 1079745 - DNA, 22 bp, Homo sapiens
gccatttaagtatcttgtgctt

SEQ ID NO: 1079746 - DNA, 13 bp, Homo sapiens
gccatttccccct

SEQ ID NO: 1079747 - DNA, 14 bp, Homo sapiens
gccatttccccctc

SEQ ID NO: 1079748 - DNA, 15 bp, Homo sapiens
gccatttcttctctc

SEQ ID NO: 1079749 - DNA, 17 bp, Homo sapiens
gccatttgatttttcta

SEQ ID NO: 1079750 - DNA, 19 bp, Homo sapiens
gccatttgctagttctgct

SEQ ID NO: 1079751 - DNA, 17 bp, Homo sapiens
gccatttttctataaat

SEQ ID NO: 1079752 - DNA, 17 bp, Homo sapiens
gccattttttgaggaga

SEQ ID NO: 1079753 - DNA, 22 bp, Homo sapiens
gcccaaaagaggtgtcatgctt

SEQ ID NO: 1079754 - DNA, 23 bp, Homo sapiens
gcccaaaatttattttataagaa

SEQ ID NO: 1079755 - DNA, 15 bp, Homo sapiens
gcccaaaccttgggc

SEQ ID NO: 1079756 - DNA, 14 bp, Homo sapiens
gcccaaactcccct

SEQ ID NO: 1079757 - DNA, 15 bp, Homo sapiens
gcccaaactcccctt

SEQ ID NO: 1079758 - DNA, 22 bp, Homo sapiens
gcccaaactccccttccctggg

SEQ ID NO: 1079759 - DNA, 18 bp, Homo sapiens
gcccaaaggcccagggag

SEQ ID NO: 1079760 - DNA, 19 bp, Homo sapiens
gcccaaaggggacaggcct

SEQ ID NO: 1079761 - DNA, 18 bp, Homo sapiens
gcccaaataggaggaaaa

SEQ ID NO: 1079762 - DNA, 16 bp, Homo sapiens
gcccaaccaggccctg

SEQ ID NO: 1079763 - DNA, 19 bp, Homo sapiens
gcccaaccatcggtccaca

SEQ ID NO: 1079764 - DNA, 15 bp, Homo sapiens
gcccaacccagccca

SEQ ID NO: 1079765 - DNA, 13 bp, Homo sapiens
gcccaacctcctg

SEQ ID NO: 1079766 - DNA, 21 bp, Homo sapiens
gcccaactaacagtcaagaaa

SEQ ID NO: 1079767 - DNA, 18 bp, Homo sapiens
gcccaacttccagaggac

SEQ ID NO: 1079768 - DNA, 12 bp, Homo sapiens
gcccaagaactg

SEQ ID NO: 1079769 - DNA, 15 bp, Homo sapiens
gcccaagaactgcag

SEQ ID NO: 1079770 - DNA, 17 bp, Homo sapiens
gcccaagagcagagtct

SEQ ID NO: 1079771 - DNA, 19 bp, Homo sapiens
gcccaagagcagagtctgg

SEQ ID NO: 1079772 - DNA, 23 bp, Homo sapiens
gcccaagagcagagtctgggcct

SEQ ID NO: 1079773 - DNA, 15 bp, Homo sapiens
gcccaagagccctgt

SEQ ID NO: 1079774 - DNA, 22 bp, Homo sapiens
gcccaagaggactgagactggc

SEQ ID NO: 1079775 - DNA, 14 bp, Homo sapiens
gcccaagaggtctg

SEQ ID NO: 1079776 - DNA, 17 bp, Homo sapiens
gcccaagaggtctgagc

SEQ ID NO: 1079777 - DNA, 19 bp, Homo sapiens
gcccaagaggtctgagccc

SEQ ID NO: 1079778 - DNA, 15 bp, Homo sapiens
gcccaagccagaggc

SEQ ID NO: 1079779 - DNA, 17 bp, Homo sapiens
gcccaagccagaggctg

SEQ ID NO: 1079780 - DNA, 13 bp, Homo sapiens
gcccaagccccat

SEQ ID NO: 1079781 - DNA, 20 bp, Homo sapiens
gcccaagcttaatagccctc

SEQ ID NO: 1079782 - DNA, 23 bp, Homo sapiens
gcccaagcttaatagccctcccc

SEQ ID NO: 1079783 - DNA, 21 bp, Homo sapiens
gcccaaggagcttacccaagc

SEQ ID NO: 1079784 - DNA, 14 bp, Homo sapiens
gcccaaggctcccg

SEQ ID NO: 1079785 - DNA, 20 bp, Homo sapiens
gcccaagggcctcccaccag

SEQ ID NO: 1079786 - DNA, 17 bp, Homo sapiens
gcccaaggtcagggagg

SEQ ID NO: 1079787 - DNA, 16 bp, Homo sapiens
gcccaagtcattgttt

SEQ ID NO: 1079788 - DNA, 13 bp, Homo sapiens
gcccaagtccctg

SEQ ID NO: 1079789 - DNA, 22 bp, Homo sapiens
gcccaagtgaccagggaagtgt

SEQ ID NO: 1079790 - DNA, 14 bp, Homo sapiens
gcccaagtgggcag

SEQ ID NO: 1079791 - DNA, 23 bp, Homo sapiens
gcccaagtgggcagtcaccaccc

SEQ ID NO: 1079792 - DNA, 19 bp, Homo sapiens
gcccaagttcatgcagctg

SEQ ID NO: 1079793 - DNA, 14 bp, Homo sapiens
gcccaagttgcagt

SEQ ID NO: 1079794 - DNA, 15 bp, Homo sapiens
gcccaagttgcagtg

SEQ ID NO: 1079795 - DNA, 21 bp, Homo sapiens
gcccaagttgcagtgagcagg

SEQ ID NO: 1079796 - DNA, 14 bp, Homo sapiens
gcccaatgaataat

SEQ ID NO: 1079797 - DNA, 18 bp, Homo sapiens
gcccacagagatgcatgc

SEQ ID NO: 1079798 - DNA, 13 bp, Homo sapiens
gcccacagagcct

SEQ ID NO: 1079799 - DNA, 14 bp, Homo sapiens
gcccacagagcctg

SEQ ID NO: 1079800 - DNA, 22 bp, Homo sapiens
gcccacagcaggggctggccca

SEQ ID NO: 1079801 - DNA, 13 bp, Homo sapiens
gcccacagcgagc

SEQ ID NO: 1079802 - DNA, 17 bp, Homo sapiens
gcccacagcgagcctgt

SEQ ID NO: 1079803 - DNA, 14 bp, Homo sapiens
gcccacagctccca

SEQ ID NO: 1079804 - DNA, 16 bp, Homo sapiens
gcccacagctcccacc

SEQ ID NO: 1079805 - DNA, 15 bp, Homo sapiens
gcccacagtatattt

SEQ ID NO: 1079806 - DNA, 16 bp, Homo sapiens
gcccacatgggacctg

SEQ ID NO: 1079807 - DNA, 17 bp, Homo sapiens
gcccacatgggacctgg

SEQ ID NO: 1079808 - DNA, 17 bp, Homo sapiens
gcccacatttgggctca

SEQ ID NO: 1079809 - DNA, 21 bp, Homo sapiens
gcccacatttgggctcagggt

SEQ ID NO: 1079810 - DNA, 16 bp, Homo sapiens
gcccaccaatctgccc

SEQ ID NO: 1079811 - DNA, 14 bp, Homo sapiens
gcccaccagacgtc

SEQ ID NO: 1079812 - DNA, 19 bp, Homo sapiens
gcccaccatcaccaccgcc

SEQ ID NO: 1079813 - DNA, 15 bp, Homo sapiens
gcccacccagctggt

SEQ ID NO: 1079814 - DNA, 19 bp, Homo sapiens
gcccacccagctggtcctg

SEQ ID NO: 1079815 - DNA, 14 bp, Homo sapiens
gcccaccccccagc

SEQ ID NO: 1079816 - DNA, 17 bp, Homo sapiens
gcccaccccccagcctc

SEQ ID NO: 1079817 - DNA, 21 bp, Homo sapiens
gcccaccccccagcctccaga

SEQ ID NO: 1079818 - DNA, 14 bp, Homo sapiens
gcccacccccctca

SEQ ID NO: 1079819 - DNA, 19 bp, Homo sapiens
gcccaccccctgccctgca

SEQ ID NO: 1079820 - DNA, 12 bp, Homo sapiens
gcccacccctca

SEQ ID NO: 1079821 - DNA, 13 bp, Homo sapiens
gcccacccctcac

SEQ ID NO: 1079822 - DNA, 22 bp, Homo sapiens
gcccacccctcactccccaggg

SEQ ID NO: 1079823 - DNA, 13 bp, Homo sapiens
gcccacccgcccg

SEQ ID NO: 1079824 - DNA, 20 bp, Homo sapiens
gcccacccgcccgagggatg

SEQ ID NO: 1079825 - DNA, 17 bp, Homo sapiens
gcccaccctaccagctc

SEQ ID NO: 1079826 - DNA, 21 bp, Homo sapiens
gcccaccctaccagctcctcc

SEQ ID NO: 1079827 - DNA, 17 bp, Homo sapiens
gcccaccctccctccac

SEQ ID NO: 1079828 - DNA, 13 bp, Homo sapiens
gcccaccgccctc

SEQ ID NO: 1079829 - DNA, 16 bp, Homo sapiens
gcccaccgccctcctc

SEQ ID NO: 1079830 - DNA, 14 bp, Homo sapiens
gcccacctcgctcc

SEQ ID NO: 1079831 - DNA, 11 bp, Homo sapiens
gcccacctctc

SEQ ID NO: 1079832 - DNA, 14 bp, Homo sapiens
gcccacctctccct

SEQ ID NO: 1079833 - DNA, 15 bp, Homo sapiens
gcccacctctccctg

SEQ ID NO: 1079834 - DNA, 20 bp, Homo sapiens
gcccacctctccctgcatcc

SEQ ID NO: 1079835 - DNA, 18 bp, Homo sapiens
gcccacctgaaagcctgt

SEQ ID NO: 1079836 - DNA, 20 bp, Homo sapiens
gcccacctgaaagcctgtct

SEQ ID NO: 1079837 - DNA, 21 bp, Homo sapiens
gcccacctgaaagcctgtctc

SEQ ID NO: 1079838 - DNA, 15 bp, Homo sapiens
gcccacctgcccatc

SEQ ID NO: 1079839 - DNA, 13 bp, Homo sapiens
gcccacctggcca

SEQ ID NO: 1079840 - DNA, 15 bp, Homo sapiens
gcccacctgggctgg

SEQ ID NO: 1079841 - DNA, 13 bp, Homo sapiens
gcccacctggggt

SEQ ID NO: 1079842 - DNA, 17 bp, Homo sapiens
gcccaccttggaccctg

SEQ ID NO: 1079843 - DNA, 22 bp, Homo sapiens
gcccaccttggaccctggtgac

SEQ ID NO: 1079844 - DNA, 19 bp, Homo sapiens
gcccacgaggagcagcagc

SEQ ID NO: 1079845 - DNA, 20 bp, Homo sapiens
gcccacgatcccctccccca

SEQ ID NO: 1079846 - DNA, 21 bp, Homo sapiens
gcccacgatcccctcccccaa

SEQ ID NO: 1079847 - DNA, 18 bp, Homo sapiens
gcccacgcagaggacgca

SEQ ID NO: 1079848 - DNA, 19 bp, Homo sapiens
gcccacgcagaggacgcac

SEQ ID NO: 1079849 - DNA, 16 bp, Homo sapiens
gcccacgccggcctct

SEQ ID NO: 1079850 - DNA, 19 bp, Homo sapiens
gcccacgccggcctctgct

SEQ ID NO: 1079851 - DNA, 19 bp, Homo sapiens
gcccacgcgcttccctggg

SEQ ID NO: 1079852 - DNA, 14 bp, Homo sapiens
gcccacgctcctgc

SEQ ID NO: 1079853 - DNA, 15 bp, Homo sapiens
gcccacgctcctgcc

SEQ ID NO: 1079854 - DNA, 17 bp, Homo sapiens
gcccacggtctgagcta

SEQ ID NO: 1079855 - DNA, 18 bp, Homo sapiens
gcccactagagggcccat

SEQ ID NO: 1079856 - DNA, 23 bp, Homo sapiens
gcccactagagggcccatcaggc

SEQ ID NO: 1079857 - DNA, 15 bp, Homo sapiens
gcccactccccagcc

SEQ ID NO: 1079858 - DNA, 19 bp, Homo sapiens
gcccactccccagccccag

SEQ ID NO: 1079859 - DNA, 18 bp, Homo sapiens
gcccactgcccaccccct

SEQ ID NO: 1079860 - DNA, 20 bp, Homo sapiens
gcccactgcccaccccctca

SEQ ID NO: 1079861 - DNA, 16 bp, Homo sapiens
gcccactgcctcctgc

SEQ ID NO: 1079862 - DNA, 16 bp, Homo sapiens
gcccactgtcctgggc

SEQ ID NO: 1079863 - DNA, 19 bp, Homo sapiens
gcccactgtcctgggcgcc

SEQ ID NO: 1079864 - DNA, 16 bp, Homo sapiens
gcccactgtgcctcag

SEQ ID NO: 1079865 - DNA, 14 bp, Homo sapiens
gcccacttggggcc

SEQ ID NO: 1079866 - DNA, 15 bp, Homo sapiens
gcccacttggggcct

SEQ ID NO: 1079867 - DNA, 17 bp, Homo sapiens
gcccacttggggccttc

SEQ ID NO: 1079868 - DNA, 12 bp, Homo sapiens
gcccagaaagcc

SEQ ID NO: 1079869 - DNA, 20 bp, Homo sapiens
gcccagaaagcctctctctc

SEQ ID NO: 1079870 - DNA, 22 bp, Homo sapiens
gcccagaaagctgcggattggg

SEQ ID NO: 1079871 - DNA, 11 bp, Homo sapiens
gcccagaactg

SEQ ID NO: 1079872 - DNA, 11 bp, Homo sapiens
gcccagaagag

SEQ ID NO: 1079873 - DNA, 16 bp, Homo sapiens
gcccagaatccccaag

SEQ ID NO: 1079874 - DNA, 21 bp, Homo sapiens
gcccagacaccatgtgcaata

SEQ ID NO: 1079875 - DNA, 21 bp, Homo sapiens
gcccagacccactctgcggcc

SEQ ID NO: 1079876 - DNA, 16 bp, Homo sapiens
gcccagacccccagtg

SEQ ID NO: 1079877 - DNA, 16 bp, Homo sapiens
gcccagaccggcttct

SEQ ID NO: 1079878 - DNA, 20 bp, Homo sapiens
gcccagaccggcttctcggc

SEQ ID NO: 1079879 - DNA, 14 bp, Homo sapiens
gcccagactacagg

SEQ ID NO: 1079880 - DNA, 15 bp, Homo sapiens
gcccagactacaggg

SEQ ID NO: 1079881 - DNA, 18 bp, Homo sapiens
gcccagactgatgagcac

SEQ ID NO: 1079882 - DNA, 18 bp, Homo sapiens
gcccagagaccccttcct

SEQ ID NO: 1079883 - DNA, 17 bp, Homo sapiens
gcccagagatgcctcca

SEQ ID NO: 1079884 - DNA, 18 bp, Homo sapiens
gcccagagatgcctccac

SEQ ID NO: 1079885 - DNA, 18 bp, Homo sapiens
gcccagagcaggaagcat

SEQ ID NO: 1079886 - DNA, 11 bp, Homo sapiens
gcccagagccc

SEQ ID NO: 1079887 - DNA, 14 bp, Homo sapiens
gcccagagcccttg

SEQ ID NO: 1079888 - DNA, 17 bp, Homo sapiens
gcccagagcccttgact

SEQ ID NO: 1079889 - DNA, 14 bp, Homo sapiens
gcccagagctggcc

SEQ ID NO: 1079890 - DNA, 14 bp, Homo sapiens
gcccagagttgctg

SEQ ID NO: 1079891 - DNA, 19 bp, Homo sapiens
gcccagagttgctgtgccg

SEQ ID NO: 1079892 - DNA, 17 bp, Homo sapiens
gcccagatacgggggct

SEQ ID NO: 1079893 - DNA, 15 bp, Homo sapiens
gcccagatccaaggc

SEQ ID NO: 1079894 - DNA, 21 bp, Homo sapiens
gcccagatgttttacgtctgg

SEQ ID NO: 1079895 - DNA, 15 bp, Homo sapiens
gcccagattcccaga

SEQ ID NO: 1079896 - DNA, 19 bp, Homo sapiens
gcccagattcccctgtgtc

SEQ ID NO: 1079897 - DNA, 21 bp, Homo sapiens
gcccagattcccctgtgtcat

SEQ ID NO: 1079898 - DNA, 21 bp, Homo sapiens
gcccagcacatggccatagag

SEQ ID NO: 1079899 - DNA, 19 bp, Homo sapiens
gcccagcacatgtgctgcc

SEQ ID NO: 1079900 - DNA, 23 bp, Homo sapiens
gcccagcaggagagactgagcag

SEQ ID NO: 1079901 - DNA, 23 bp, Homo sapiens
gcccatggacaggctggctccag

SEQ ID NO: 1079902 - DNA, 15 bp, Homo sapiens
gcccatggcccccaa

SEQ ID NO: 1079903 - DNA, 21 bp, Homo sapiens
gcccatggcccccaataaagg

SEQ ID NO: 1079904 - DNA, 21 bp, Homo sapiens
gcccatggttgagaaatgaat

SEQ ID NO: 1079905 - DNA, 19 bp, Homo sapiens
gcccatgtcgcgctcagca

SEQ ID NO: 1079906 - DNA, 18 bp, Homo sapiens
gcccatgtcttctgctgt

SEQ ID NO: 1079907 - DNA, 22 bp, Homo sapiens
gcccatgtcttctgctgttctt

SEQ ID NO: 1079908 - DNA, 18 bp, Homo sapiens
gcccatgtgtacattctg

SEQ ID NO: 1079909 - DNA, 16 bp, Homo sapiens
gcccatgtgtcccctc

SEQ ID NO: 1079910 - DNA, 17 bp, Homo sapiens
gcccatgtgtcccctca

SEQ ID NO: 1079911 - DNA, 13 bp, Homo sapiens
gcccatgtgtgag

SEQ ID NO: 1079912 - DNA, 15 bp, Homo sapiens
gcccatgtgtgagtg

SEQ ID NO: 1079913 - DNA, 17 bp, Homo sapiens
gcccatgtgttccctct

SEQ ID NO: 1079914 - DNA, 15 bp, Homo sapiens
gcccatgttctgccc

SEQ ID NO: 1079915 - DNA, 20 bp, Homo sapiens
gcccatgttctgcccccagc

SEQ ID NO: 1079916 - DNA, 14 bp, Homo sapiens
gcccattcccacca

SEQ ID NO: 1079917 - DNA, 23 bp, Homo sapiens
gcccattcgtctgtcccagagct

SEQ ID NO: 1079918 - DNA, 20 bp, Homo sapiens
gcccattctctctcctgtcc

SEQ ID NO: 1079919 - DNA, 12 bp, Homo sapiens
gcccattgctgc

SEQ ID NO: 1079920 - DNA, 17 bp, Homo sapiens
gcccattgctgccaagg

SEQ ID NO: 1079921 - DNA, 22 bp, Homo sapiens
gcccattggagcacctgggccc

SEQ ID NO: 1079922 - DNA, 22 bp, Homo sapiens
gcccattggccgagctcctggg

SEQ ID NO: 1079923 - DNA, 14 bp, Homo sapiens
gcccattgtcctcc

SEQ ID NO: 1079924 - DNA, 15 bp, Homo sapiens
gcccattgtcctcct

SEQ ID NO: 1079925 - DNA, 17 bp, Homo sapiens
gcccattgtcctccttt

SEQ ID NO: 1079926 - DNA, 23 bp, Homo sapiens
gcccatttagaggatgtggctgt

SEQ ID NO: 1079927 - DNA, 18 bp, Homo sapiens
gcccatttcaattctcaa

SEQ ID NO: 1079928 - DNA, 19 bp, Homo sapiens
gccccaaaaccacagccct

SEQ ID NO: 1079929 - DNA, 17 bp, Homo sapiens
gccccaaacaaatatgc

SEQ ID NO: 1079930 - DNA, 13 bp, Homo sapiens
gccccaacctgct

SEQ ID NO: 1079931 - DNA, 21 bp, Homo sapiens
gccccaactcgggctcccggg

SEQ ID NO: 1079932 - DNA, 21 bp, Homo sapiens
gccccaagaggggcgggctca

SEQ ID NO: 1079933 - DNA, 23 bp, Homo sapiens
gccccaagcagccagccagtctt

SEQ ID NO: 1079934 - DNA, 15 bp, Homo sapiens
gccccaagcaggacg

SEQ ID NO: 1079935 - DNA, 18 bp, Homo sapiens
gccccaagctgggccgag

SEQ ID NO: 1079936 - DNA, 13 bp, Homo sapiens
gccccaagcttct

SEQ ID NO: 1079937 - DNA, 19 bp, Homo sapiens
gccccaaggccccagggac

SEQ ID NO: 1079938 - DNA, 21 bp, Homo sapiens
gccccaaggccccagggacag

SEQ ID NO: 1079939 - DNA, 21 bp, Homo sapiens
gccccaagggctggggcggag

SEQ ID NO: 1079940 - DNA, 15 bp, Homo sapiens
gccccaagtcctgaa

SEQ ID NO: 1079941 - DNA, 20 bp, Homo sapiens
gccccaagtcctgaagaggc

SEQ ID NO: 1079942 - DNA, 23 bp, Homo sapiens
gccccaagttctaggccccccag

SEQ ID NO: 1079943 - DNA, 14 bp, Homo sapiens
gccccaatcttgcc

SEQ ID NO: 1079944 - DNA, 21 bp, Homo sapiens
gccccaatcttgcccactggc

SEQ ID NO: 1079945 - DNA, 22 bp, Homo sapiens
gccccacaaaacttcagtgtgg

SEQ ID NO: 1079946 - DNA, 16 bp, Homo sapiens
gccccacacctcctct

SEQ ID NO: 1079947 - DNA, 19 bp, Homo sapiens
gccccacagctacctgaga

SEQ ID NO: 1079948 - DNA, 20 bp, Homo sapiens
gccccacagctacctgagac

SEQ ID NO: 1079949 - DNA, 21 bp, Homo sapiens
gccccacagctacctgagacg

SEQ ID NO: 1079950 - DNA, 13 bp, Homo sapiens
gccccacaggact

SEQ ID NO: 1079951 - DNA, 13 bp, Homo sapiens
gccccacaggagt

SEQ ID NO: 1079952 - DNA, 21 bp, Homo sapiens
gccccacagggcaaggacaca

SEQ ID NO: 1079953 - DNA, 19 bp, Homo sapiens
gccccacagtcccattcct

SEQ ID NO: 1079954 - DNA, 13 bp, Homo sapiens
gccccaccaccta

SEQ ID NO: 1079955 - DNA, 20 bp, Homo sapiens
gccccaccacctaggccact

SEQ ID NO: 1079956 - DNA, 15 bp, Homo sapiens
gccccacccacccca

SEQ ID NO: 1079957 - DNA, 18 bp, Homo sapiens
gccccacccaccctctgg

SEQ ID NO: 1079958 - DNA, 22 bp, Homo sapiens
gccccaccccatccagccagac

SEQ ID NO: 1079959 - DNA, 16 bp, Homo sapiens
gccccacccccagcca

SEQ ID NO: 1079960 - DNA, 14 bp, Homo sapiens
gccccacccccctc

SEQ ID NO: 1079961 - DNA, 18 bp, Homo sapiens
gccccacccccctcctcc

SEQ ID NO: 1079962 - DNA, 20 bp, Homo sapiens
gccccacccccctcctcccc

SEQ ID NO: 1079963 - DNA, 23 bp, Homo sapiens
gccccacccccctcctccccctt

SEQ ID NO: 1079964 - DNA, 16 bp, Homo sapiens
gccccaccccctgggc

SEQ ID NO: 1079965 - DNA, 22 bp, Homo sapiens
gccccaccccctgggcagatgt

SEQ ID NO: 1079966 - DNA, 21 bp, Homo sapiens
gccccaccctcaaaccctgtg

SEQ ID NO: 1079967 - DNA, 22 bp, Homo sapiens
gccccaccctgggccctgggct

SEQ ID NO: 1079968 - DNA, 23 bp, Homo sapiens
gccccaccctgggccctgggctg

SEQ ID NO: 1079969 - DNA, 17 bp, Homo sapiens
gccccaccgccgtggag

SEQ ID NO: 1079970 - DNA, 14 bp, Homo sapiens
gccccacctaaccc

SEQ ID NO: 1079971 - DNA, 23 bp, Homo sapiens
gccccacctacttgtgactgaag

SEQ ID NO: 1079972 - DNA, 23 bp, Homo sapiens
gccccacctcccatttctgttgc

SEQ ID NO: 1079973 - DNA, 14 bp, Homo sapiens
gccccacctcccca

SEQ ID NO: 1079974 - DNA, 15 bp, Homo sapiens
gccccacctccccac

SEQ ID NO: 1079975 - DNA, 18 bp, Homo sapiens
gccccacctcccgccctc

SEQ ID NO: 1079976 - DNA, 14 bp, Homo sapiens
gccccacctcggca

SEQ ID NO: 1079977 - DNA, 19 bp, Homo sapiens
gccccacctcggcacacac

SEQ ID NO: 1079978 - DNA, 21 bp, Homo sapiens
gccccacctcggcacacactg

SEQ ID NO: 1079979 - DNA, 22 bp, Homo sapiens
gccccacctcggcacacactgt

SEQ ID NO: 1079980 - DNA, 22 bp, Homo sapiens
gccccaccttgccagggcaggg

SEQ ID NO: 1079981 - DNA, 23 bp, Homo sapiens
gccccacctttattaaaatctta

SEQ ID NO: 1079982 - DNA, 16 bp, Homo sapiens
gccccacgccctctcc

SEQ ID NO: 1079983 - DNA, 20 bp, Homo sapiens
gccccacggagacagaggaa

SEQ ID NO: 1079984 - DNA, 20 bp, Homo sapiens
gccccactgccagcagcagc

SEQ ID NO: 1079985 - DNA, 12 bp, Homo sapiens
gccccactggac

SEQ ID NO: 1079986 - DNA, 13 bp, Homo sapiens
gccccactggaca

SEQ ID NO: 1079987 - DNA, 14 bp, Homo sapiens
gccccactggacaa

SEQ ID NO: 1079988 - DNA, 18 bp, Homo sapiens
gccccactggctggagga

SEQ ID NO: 1079989 - DNA, 14 bp, Homo sapiens
gccccacttctggc

SEQ ID NO: 1079990 - DNA, 17 bp, Homo sapiens
gccccacttctggccac

SEQ ID NO: 1079991 - DNA, 17 bp, Homo sapiens
gccccagaaaggggaaa

SEQ ID NO: 1079992 - DNA, 15 bp, Homo sapiens
gccccagactgagct

SEQ ID NO: 1079993 - DNA, 17 bp, Homo sapiens
gccccagactgagctct

SEQ ID NO: 1079994 - DNA, 21 bp, Homo sapiens
gccccagactgagctctccag

SEQ ID NO: 1079995 - DNA, 22 bp, Homo sapiens
gccccagactgagctctccagg

SEQ ID NO: 1079996 - DNA, 11 bp, Homo sapiens
gccccagagac

SEQ ID NO: 1079997 - DNA, 15 bp, Homo sapiens
gccccagagagaccc

SEQ ID NO: 1079998 - DNA, 12 bp, Homo sapiens
gccccagaggac

SEQ ID NO: 1079999 - DNA, 13 bp, Homo sapiens
gccccagaggacc

SEQ ID NO: 1080000 - DNA, 16 bp, Homo sapiens
gccccagagtggccca

SEQ ID NO: 1080001 - DNA, 17 bp, Homo sapiens
gccccagagtggcccac

SEQ ID NO: 1080002 - DNA, 17 bp, Homo sapiens
gccccagataccagccc

SEQ ID NO: 1080003 - DNA, 19 bp, Homo sapiens
gccccagatcaccagcccg

SEQ ID NO: 1080004 - DNA, 22 bp, Homo sapiens
gccccagcacacgagttccaga

SEQ ID NO: 1080005 - DNA, 20 bp, Homo sapiens
gccccagcacagcttgacct

SEQ ID NO: 1080006 - DNA, 23 bp, Homo sapiens
gccccagcactaaagcagtggac

SEQ ID NO: 1080007 - DNA, 14 bp, Homo sapiens
gccccagccagagt

SEQ ID NO: 1080008 - DNA, 12 bp, Homo sapiens
gccccagcccag

SEQ ID NO: 1080009 - DNA, 14 bp, Homo sapiens
gccccagcccagat

SEQ ID NO: 1080010 - DNA, 19 bp, Homo sapiens
gccccagcccagccccact

SEQ ID NO: 1080011 - DNA, 12 bp, Homo sapiens
gccccagcccct

SEQ ID NO: 1080012 - DNA, 23 bp, Homo sapiens
gccccagccccttctcccagcac

SEQ ID NO: 1080013 - DNA, 12 bp, Homo sapiens
gccccagccctc

SEQ ID NO: 1080014 - DNA, 14 bp, Homo sapiens
gccccagccctgct

SEQ ID NO: 1080015 - DNA, 16 bp, Homo sapiens
gccccagccctgctgg

SEQ ID NO: 1080016 - DNA, 21 bp, Homo sapiens
gccccagcgtctgcagggtga

SEQ ID NO: 1080017 - DNA, 19 bp, Homo sapiens
gccccagctgactgtggcc

SEQ ID NO: 1080018 - DNA, 15 bp, Homo sapiens
gccccagctgccagg

SEQ ID NO: 1080019 - DNA, 18 bp, Homo sapiens
gccccagctgccaggcgg

SEQ ID NO: 1080020 - DNA, 23 bp, Homo sapiens
gccccagctgccaggcggccctg

SEQ ID NO: 1080021 - DNA, 17 bp, Homo sapiens
gccccaggactctggca

SEQ ID NO: 1080022 - DNA, 21 bp, Homo sapiens
gccccaggactctggcacttc

SEQ ID NO: 1080023 - DNA, 23 bp, Homo sapiens
gccccaggactctggcacttcca

SEQ ID NO: 1080024 - DNA, 18 bp, Homo sapiens
gcccagccggcctctctg

SEQ ID NO: 1080025 - DNA, 21 bp, Homo sapiens
gcccagccggcctctctggcc

SEQ ID NO: 1080026 - DNA, 15 bp, Homo sapiens
gcccagcctaggccc

SEQ ID NO: 1080027 - DNA, 16 bp, Homo sapiens
gcccagcctgtcctgg

SEQ ID NO: 1080028 - DNA, 18 bp, Homo sapiens
gcccagcctgtcctggta

SEQ ID NO: 1080029 - DNA, 15 bp, Homo sapiens
gcccagcgacacaga

SEQ ID NO: 1080030 - DNA, 14 bp, Homo sapiens
gcccagcgccaagt

SEQ ID NO: 1080031 - DNA, 17 bp, Homo sapiens
gcccagcgctcgccacg

SEQ ID NO: 1080032 - DNA, 22 bp, Homo sapiens
gcccagcgctcgccacgctcag

SEQ ID NO: 1080033 - DNA, 18 bp, Homo sapiens
gcccagcggcccctccca

SEQ ID NO: 1080034 - DNA, 23 bp, Homo sapiens
gcccagcggtccctgcagaagcc

SEQ ID NO: 1080035 - DNA, 16 bp, Homo sapiens
gcccagctccgcctgc

SEQ ID NO: 1080036 - DNA, 13 bp, Homo sapiens
gcccagctcctca

SEQ ID NO: 1080037 - DNA, 14 bp, Homo sapiens
gcccagctctctga

SEQ ID NO: 1080038 - DNA, 15 bp, Homo sapiens
gcccagctctctgac

SEQ ID NO: 1080039 - DNA, 15 bp, Homo sapiens
gcccagctctgggaa

SEQ ID NO: 1080040 - DNA, 12 bp, Homo sapiens
gcccagctcttg

SEQ ID NO: 1080041 - DNA, 13 bp, Homo sapiens
gcccagctcttgc

SEQ ID NO: 1080042 - DNA, 17 bp, Homo sapiens
gcccagctcttgctctc

SEQ ID NO: 1080043 - DNA, 18 bp, Homo sapiens
gcccagctcttgctctct

SEQ ID NO: 1080044 - DNA, 15 bp, Homo sapiens
gcccagctgcacctg

SEQ ID NO: 1080045 - DNA, 23 bp, Homo sapiens
gcccagctgcacctgccagcctg

SEQ ID NO: 1080046 - DNA, 13 bp, Homo sapiens
gcccagctgggct

SEQ ID NO: 1080047 - DNA, 14 bp, Homo sapiens
gcccagctgggctc

SEQ ID NO: 1080048 - DNA, 18 bp, Homo sapiens
gcccagctgggctctgcc

SEQ ID NO: 1080049 - DNA, 19 bp, Homo sapiens
gcccagctgggctctgcca

SEQ ID NO: 1080050 - DNA, 21 bp, Homo sapiens
gcccagctgggctctgccacc

SEQ ID NO: 1080051 - DNA, 13 bp, Homo sapiens
gcccagctgggtc

SEQ ID NO: 1080052 - DNA, 20 bp, Homo sapiens
gcccagctgggtcaggcagg

SEQ ID NO: 1080053 - DNA, 17 bp, Homo sapiens
gcccagctggtgggaag

SEQ ID NO: 1080054 - DNA, 17 bp, Homo sapiens
gcccagcttcctggtgt

SEQ ID NO: 1080055 - DNA, 14 bp, Homo sapiens
gcccagcttgggcc

SEQ ID NO: 1080056 - DNA, 18 bp, Homo sapiens
gcccagcttgggcccagc

SEQ ID NO: 1080057 - DNA, 20 bp, Homo sapiens
gcccagcttgggcccagctg

SEQ ID NO: 1080058 - DNA, 21 bp, Homo sapiens
gcccagcttgggcccagctgg

SEQ ID NO: 1080059 - DNA, 22 bp, Homo sapiens
gcccagcttgggcccagctggg

SEQ ID NO: 1080060 - DNA, 23 bp, Homo sapiens
gcccagcttgggcccagctgggc

SEQ ID NO: 1080061 - DNA, 20 bp, Homo sapiens
gcccaggaatttgaagctgc

SEQ ID NO: 1080062 - DNA, 15 bp, Homo sapiens
gcccaggacagctgg

SEQ ID NO: 1080063 - DNA, 18 bp, Homo sapiens
gcccaggagagccagccc

SEQ ID NO: 1080064 - DNA, 20 bp, Homo sapiens
gcccaggagagccagccctc

SEQ ID NO: 1080065 - DNA, 19 bp, Homo sapiens
gcccaggagagcccccacc

SEQ ID NO: 1080066 - DNA, 21 bp, Homo sapiens
gcccaggagagcccccaccag

SEQ ID NO: 1080067 - DNA, 14 bp, Homo sapiens
gcccaggagctctg

SEQ ID NO: 1080068 - DNA, 19 bp, Homo sapiens
gcccaggagctctgcgcca

SEQ ID NO: 1080069 - DNA, 22 bp, Homo sapiens
gcccaggagctgagtcacctcc

SEQ ID NO: 1080070 - DNA, 20 bp, Homo sapiens
gcccaggcaccaccaggagc

SEQ ID NO: 1080071 - DNA, 23 bp, Homo sapiens
gcccaggcaccaccaggagcagc

SEQ ID NO: 1080072 - DNA, 21 bp, Homo sapiens
gcccaggcagacaaccttgtc

SEQ ID NO: 1080073 - DNA, 13 bp, Homo sapiens
gcccaggcagcct

SEQ ID NO: 1080074 - DNA, 20 bp, Homo sapiens
gcccaggcagcctccgggcg

SEQ ID NO: 1080075 - DNA, 22 bp, Homo sapiens
gcccaggcagctatttcagcct

SEQ ID NO: 1080076 - DNA, 13 bp, Homo sapiens
gcccaggcaggtc

SEQ ID NO: 1080077 - DNA, 15 bp, Homo sapiens
gcccaggcaggtctg

SEQ ID NO: 1080078 - DNA, 19 bp, Homo sapiens
gcccaggcaggtctgcaag

SEQ ID NO: 1080079 - DNA, 14 bp, Homo sapiens
gcccaggccagccc

SEQ ID NO: 1080080 - DNA, 15 bp, Homo sapiens
gcccaggccagcccc

SEQ ID NO: 1080081 - DNA, 21 bp, Homo sapiens
gcccaggccagcccccccacc

SEQ ID NO: 1080082 - DNA, 16 bp, Homo sapiens
gcccaggccatgtggc

SEQ ID NO: 1080083 - DNA, 23 bp, Homo sapiens
gcccaggccatgtggcctgccca

SEQ ID NO: 1080084 - DNA, 21 bp, Homo sapiens
gcccaggcccccggctttcct

SEQ ID NO: 1080085 - DNA, 16 bp, Homo sapiens
gcccaggcccttggct

SEQ ID NO: 1080086 - DNA, 18 bp, Homo sapiens
gcccaggccgggaagagc

SEQ ID NO: 1080087 - DNA, 22 bp, Homo sapiens
gcccaggccggggtggagcatg

SEQ ID NO: 1080088 - DNA, 17 bp, Homo sapiens
gcccaggcctgcctgtt

SEQ ID NO: 1080089 - DNA, 15 bp, Homo sapiens
gcccaggcctggagc

SEQ ID NO: 1080090 - DNA, 19 bp, Homo sapiens
gcccaggctggagctggcc

SEQ ID NO: 1080091 - DNA, 19 bp, Homo sapiens
gcccaggctggagtgtagt

SEQ ID NO: 1080092 - DNA, 20 bp, Homo sapiens
gcccaggctggagtgtagtg

SEQ ID NO: 1080093 - DNA, 14 bp, Homo sapiens
gcccaggctggtct

SEQ ID NO: 1080094 - DNA, 15 bp, Homo sapiens
gcccagggaggcagc

SEQ ID NO: 1080095 - DNA, 23 bp, Homo sapiens
gcccagggaggcagcgtgggctc

SEQ ID NO: 1080096 - DNA, 18 bp, Homo sapiens
gcccagggcatcttgctg

SEQ ID NO: 1080097 - DNA, 20 bp, Homo sapiens
gcccagggcatcttgctggc

SEQ ID NO: 1080098 - DNA, 21 bp, Homo sapiens
gcccagggcatcttgctggct

SEQ ID NO: 1080099 - DNA, 14 bp, Homo sapiens
gcccagggctcctg

SEQ ID NO: 1080100 - DNA, 15 bp, Homo sapiens
gcccagggctcctgc

SEQ ID NO: 1080101 - DNA, 13 bp, Homo sapiens
gcccaggggagaa

SEQ ID NO: 1080102 - DNA, 20 bp, Homo sapiens
gcccaggggagaatgcagcc

SEQ ID NO: 1080103 - DNA, 23 bp, Homo sapiens
gcccaggggagaatgcagcccac

SEQ ID NO: 1080104 - DNA, 20 bp, Homo sapiens
gcccaggggcccacagggaa

SEQ ID NO: 1080105 - DNA, 12 bp, Homo sapiens
gcccaggggctg

SEQ ID NO: 1080106 - DNA, 19 bp, Homo sapiens
gcccaggggtgccccctcc

SEQ ID NO: 1080107 - DNA, 22 bp, Homo sapiens
gcccaggggtgccccctcctct

SEQ ID NO: 1080108 - DNA, 15 bp, Homo sapiens
gcccagggtcctgtg

SEQ ID NO: 1080109 - DNA, 17 bp, Homo sapiens
gcccagggtcctgtgcc

SEQ ID NO: 1080110 - DNA, 18 bp, Homo sapiens
gcccagggtcgtctttgt

SEQ ID NO: 1080111 - DNA, 16 bp, Homo sapiens
gcccaggtaccaccct

SEQ ID NO: 1080112 - DNA, 18 bp, Homo sapiens
gcccagtcctctcccaag

SEQ ID NO: 1080113 - DNA, 17 bp, Homo sapiens
gcccagtccttccacct

SEQ ID NO: 1080114 - DNA, 14 bp, Homo sapiens
gcccagtctgttga

SEQ ID NO: 1080115 - DNA, 20 bp, Homo sapiens
gcccagtgcatatgcaatgt

SEQ ID NO: 1080116 - DNA, 13 bp, Homo sapiens
gcccagtgccagc

SEQ ID NO: 1080117 - DNA, 15 bp, Homo sapiens
gcccagtgccagctc

SEQ ID NO: 1080118 - DNA, 16 bp, Homo sapiens
gcccagtgccagctcc

SEQ ID NO: 1080119 - DNA, 22 bp, Homo sapiens
gcccagtgccagctccagtgcc

SEQ ID NO: 1080120 - DNA, 16 bp, Homo sapiens
gccccaggccaggtag

SEQ ID NO: 1080121 - DNA, 17 bp, Homo sapiens
gccccaggccaggtagc

SEQ ID NO: 1080122 - DNA, 14 bp, Homo sapiens
gccccaggccccag

SEQ ID NO: 1080123 - DNA, 15 bp, Homo sapiens
gccccaggccccaga

SEQ ID NO: 1080124 - DNA, 18 bp, Homo sapiens
gccccaggccccagacag

SEQ ID NO: 1080125 - DNA, 17 bp, Homo sapiens
gccccaggccctactac

SEQ ID NO: 1080126 - DNA, 13 bp, Homo sapiens
gccccaggccctc

SEQ ID NO: 1080127 - DNA, 14 bp, Homo sapiens
gccccaggccggag

SEQ ID NO: 1080128 - DNA, 19 bp, Homo sapiens
gccccaggccggagcccag

SEQ ID NO: 1080129 - DNA, 14 bp, Homo sapiens
gccccaggcctgga

SEQ ID NO: 1080130 - DNA, 16 bp, Homo sapiens
gccccaggcctggacg

SEQ ID NO: 1080131 - DNA, 22 bp, Homo sapiens
gccccaggcctggacgggccct

SEQ ID NO: 1080132 - DNA, 15 bp, Homo sapiens
gccccaggcctggcc

SEQ ID NO: 1080133 - DNA, 12 bp, Homo sapiens
gccccaggcttc

SEQ ID NO: 1080134 - DNA, 21 bp, Homo sapiens
gccccaggcttccgcgcccag

SEQ ID NO: 1080135 - DNA, 19 bp, Homo sapiens
gccccagggacagaggcca

SEQ ID NO: 1080136 - DNA, 23 bp, Homo sapiens
gccccagggacagaggccaagga

SEQ ID NO: 1080137 - DNA, 17 bp, Homo sapiens
gccccagggagtccagg

SEQ ID NO: 1080138 - DNA, 12 bp, Homo sapiens
gccccagggcct

SEQ ID NO: 1080139 - DNA, 16 bp, Homo sapiens
gccccagggctaccct

SEQ ID NO: 1080140 - DNA, 13 bp, Homo sapiens
gccccaggggacg

SEQ ID NO: 1080141 - DNA, 17 bp, Homo sapiens
gccccaggggacgtggg

SEQ ID NO: 1080142 - DNA, 23 bp, Homo sapiens
gccccaggggacgtgggccctgc

SEQ ID NO: 1080143 - DNA, 13 bp, Homo sapiens
gccccaggggcag

SEQ ID NO: 1080144 - DNA, 18 bp, Homo sapiens
gccccaggggcagcaagg

SEQ ID NO: 1080145 - DNA, 21 bp, Homo sapiens
gccccagggtcttccctacct

SEQ ID NO: 1080146 - DNA, 23 bp, Homo sapiens
gccccagggtcttccctacctca

SEQ ID NO: 1080147 - DNA, 16 bp, Homo sapiens
gccccagtagtcagaa

SEQ ID NO: 1080148 - DNA, 19 bp, Homo sapiens
gccccagtgctggaaggga

SEQ ID NO: 1080149 - DNA, 17 bp, Homo sapiens
gccccagtttggggtgc

SEQ ID NO: 1080150 - DNA, 22 bp, Homo sapiens
gccccagtttggggtgccaaga

SEQ ID NO: 1080151 - DNA, 22 bp, Homo sapiens
gccccatcactgcgccactgct

SEQ ID NO: 1080152 - DNA, 20 bp, Homo sapiens
gccccatcctcatccctgac

SEQ ID NO: 1080153 - DNA, 18 bp, Homo sapiens
gccccatcctccagcagg

SEQ ID NO: 1080154 - DNA, 16 bp, Homo sapiens
gccccatcggccaaga

SEQ ID NO: 1080155 - DNA, 14 bp, Homo sapiens
gccccatctcatcc

SEQ ID NO: 1080156 - DNA, 23 bp, Homo sapiens
gccccatcttgatctttgagccc

SEQ ID NO: 1080157 - DNA, 17 bp, Homo sapiens
gccccatgcctgtccag

SEQ ID NO: 1080158 - DNA, 20 bp, Homo sapiens
gccccatgcctgtccagcct

SEQ ID NO: 1080159 - DNA, 20 bp, Homo sapiens
gccccatgctctgccccaag

SEQ ID NO: 1080160 - DNA, 22 bp, Homo sapiens
gccccatgctctgccccaagcc

SEQ ID NO: 1080161 - DNA, 22 bp, Homo sapiens
gccccatgtgccttgtccagga

SEQ ID NO: 1080162 - DNA, 23 bp, Homo sapiens
gccccatgtgccttgtccaggaa

SEQ ID NO: 1080163 - DNA, 16 bp, Homo sapiens
gccccattcctaagag

SEQ ID NO: 1080164 - DNA, 23 bp, Homo sapiens
gcccccaaccccgcggtgctctg

SEQ ID NO: 1080165 - DNA, 17 bp, Homo sapiens
gcccccaacctcagggc

SEQ ID NO: 1080166 - DNA, 13 bp, Homo sapiens
gcccccaataaag

SEQ ID NO: 1080167 - DNA, 14 bp, Homo sapiens
gcccccaataaagg

SEQ ID NO: 1080168 - DNA, 15 bp, Homo sapiens
gcccccaataaaggc

SEQ ID NO: 1080169 - DNA, 19 bp, Homo sapiens
gcccccaataaaggcagct

SEQ ID NO: 1080170 - DNA, 21 bp, Homo sapiens
gcccccaataaaggcagctgc

SEQ ID NO: 1080171 - DNA, 22 bp, Homo sapiens
gcccccaataaaggcagctgcc

SEQ ID NO: 1080172 - DNA, 24 bp, Homo sapiens
gcccccaataaaggcagctgcctc

SEQ ID NO: 1080173 - DNA, 14 bp, Homo sapiens
gcccccaccagcag

SEQ ID NO: 1080174 - DNA, 23 bp, Homo sapiens
gcccccaccagcagcacaattct

SEQ ID NO: 1080175 - DNA, 22 bp, Homo sapiens
gcccccaccagtgtagcatctt

SEQ ID NO: 1080176 - DNA, 22 bp, Homo sapiens
gcccccaccccggggaccctgt

SEQ ID NO: 1080177 - DNA, 20 bp, Homo sapiens
gcccccaccggaactgggct

SEQ ID NO: 1080178 - DNA, 20 bp, Homo sapiens
gcccccaccgtgggcaggga

SEQ ID NO: 1080179 - DNA, 23 bp, Homo sapiens
gcccccactccagtccactcctg

SEQ ID NO: 1080180 - DNA, 19 bp, Homo sapiens
gcccccagagtgtaggggg

SEQ ID NO: 1080181 - DNA, 18 bp, Homo sapiens
gcccccagatagagctgg

SEQ ID NO: 1080182 - DNA, 21 bp, Homo sapiens
gcccccagatagagctgggtg

SEQ ID NO: 1080183 - DNA, 14 bp, Homo sapiens
gcccccagcccaaa

SEQ ID NO: 1080184 - DNA, 18 bp, Homo sapiens
gcccccagcccagggctc

SEQ ID NO: 1080185 - DNA, 21 bp, Homo sapiens
gcccccagcccagggctcctg

SEQ ID NO: 1080186 - DNA, 14 bp, Homo sapiens
gcccccagccctgg

SEQ ID NO: 1080187 - DNA, 16 bp, Homo sapiens
gcccccagccctggga

SEQ ID NO: 1080188 - DNA, 17 bp, Homo sapiens
gcccccagccctgggaa

SEQ ID NO: 1080189 - DNA, 23 bp, Homo sapiens
gcccccagcctatgagcatcctg

SEQ ID NO: 1080190 - DNA, 12 bp, Homo sapiens
gcccccagcctc

SEQ ID NO: 1080191 - DNA, 17 bp, Homo sapiens
gcccccagcctcagccc

SEQ ID NO: 1080192 - DNA, 14 bp, Homo sapiens
gcccccagcctggc

SEQ ID NO: 1080193 - DNA, 12 bp, Homo sapiens
gcccccagcctt

SEQ ID NO: 1080194 - DNA, 13 bp, Homo sapiens
gcccccagccttg

SEQ ID NO: 1080195 - DNA, 14 bp, Homo sapiens
gcccccagctggcc

SEQ ID NO: 1080196 - DNA, 15 bp, Homo sapiens
gcccccagctggccc

SEQ ID NO: 1080197 - DNA, 19 bp, Homo sapiens
gcccccaggaacgctctcc

SEQ ID NO: 1080198 - DNA, 13 bp, Homo sapiens
gcccccaggaaga

SEQ ID NO: 1080199 - DNA, 14 bp, Homo sapiens
gcccccaggcagcc

SEQ ID NO: 1080200 - DNA, 13 bp, Homo sapiens
gcccccaggccag

SEQ ID NO: 1080201 - DNA, 17 bp, Homo sapiens
gcccccaggctgctgga

SEQ ID NO: 1080202 - DNA, 15 bp, Homo sapiens
gcccccagtccccac

SEQ ID NO: 1080203 - DNA, 14 bp, Homo sapiens
gcccccgccccgcc

SEQ ID NO: 1080204 - DNA, 16 bp, Homo sapiens
gcccccgccccgcccc

SEQ ID NO: 1080205 - DNA, 14 bp, Homo sapiens
gcccccgcctgcca

SEQ ID NO: 1080206 - DNA, 18 bp, Homo sapiens
gcccccgcgggttctaga

SEQ ID NO: 1080207 - DNA, 20 bp, Homo sapiens
gcccccgcgggttctagacg

SEQ ID NO: 1080208 - DNA, 15 bp, Homo sapiens
gcccccggcggcgcc

SEQ ID NO: 1080209 - DNA, 14 bp, Homo sapiens
gcccccggctttcc

SEQ ID NO: 1080210 - DNA, 20 bp, Homo sapiens
gcccccgggccgctggctgg

SEQ ID NO: 1080211 - DNA, 13 bp, Homo sapiens
gcccccgggcctg

SEQ ID NO: 1080212 - DNA, 15 bp, Homo sapiens
gcccccgggcctgca

SEQ ID NO: 1080213 - DNA, 19 bp, Homo sapiens
gccccctatcttgtcctgg

SEQ ID NO: 1080214 - DNA, 20 bp, Homo sapiens
gccccctatcttgtcctgga

SEQ ID NO: 1080215 - DNA, 15 bp, Homo sapiens
gccccctcaccccag

SEQ ID NO: 1080216 - DNA, 15 bp, Homo sapiens
gccccctccacacca

SEQ ID NO: 1080217 - DNA, 17 bp, Homo sapiens
gccccctccaggagaga

SEQ ID NO: 1080218 - DNA, 18 bp, Homo sapiens
gccccctcccccatgggc

SEQ ID NO: 1080219 - DNA, 20 bp, Homo sapiens
gccccctcccccatgggctg

SEQ ID NO: 1080220 - DNA, 22 bp, Homo sapiens
gccccctccgccctgccactca

SEQ ID NO: 1080221 - DNA, 21 bp, Homo sapiens
gccccctccgtgatccatcca

SEQ ID NO: 1080222 - DNA, 16 bp, Homo sapiens
gccccctcctctccca

SEQ ID NO: 1080223 - DNA, 17 bp, Homo sapiens
gccccctcctctcccat

SEQ ID NO: 1080224 - DNA, 20 bp, Homo sapiens
gccccctctcggccaggcat

SEQ ID NO: 1080225 - DNA, 23 bp, Homo sapiens
gccccctctgcagccggaggagg

SEQ ID NO: 1080226 - DNA, 13 bp, Homo sapiens
gccccctgcatct

SEQ ID NO: 1080227 - DNA, 14 bp, Homo sapiens
gccccctgccagtg

SEQ ID NO: 1080228 - DNA, 13 bp, Homo sapiens
gccccctgccccc

SEQ ID NO: 1080229 - DNA, 15 bp, Homo sapiens
gccccctgctgccat

SEQ ID NO: 1080230 - DNA, 13 bp, Homo sapiens
gccccctggatgg

SEQ ID NO: 1080231 - DNA, 11 bp, Homo sapiens
gccccctggca

SEQ ID NO: 1080232 - DNA, 12 bp, Homo sapiens
gccccctggcag

SEQ ID NO: 1080233 - DNA, 16 bp, Homo sapiens
gccccctggcagctgc

SEQ ID NO: 1080234 - DNA, 18 bp, Homo sapiens
gccccctggcagctgccc

SEQ ID NO: 1080235 - DNA, 15 bp, Homo sapiens
gccccctggcctctg

SEQ ID NO: 1080236 - DNA, 17 bp, Homo sapiens
gccccctggcctctgtg

SEQ ID NO: 1080237 - DNA, 13 bp, Homo sapiens
gccccctgggctg

SEQ ID NO: 1080238 - DNA, 18 bp, Homo sapiens
gccccctgggctggggcc

SEQ ID NO: 1080239 - DNA, 22 bp, Homo sapiens
gccccctggtggacagtcctgg

SEQ ID NO: 1080240 - DNA, 23 bp, Homo sapiens
gccccctggtggacagtcctggg

SEQ ID NO: 1080241 - DNA, 17 bp, Homo sapiens
gccccctgtccccaaga

SEQ ID NO: 1080242 - DNA, 18 bp, Homo sapiens
gccccctgtccccaagac

SEQ ID NO: 1080243 - DNA, 14 bp, Homo sapiens
gcccccttccccag

SEQ ID NO: 1080244 - DNA, 17 bp, Homo sapiens
gcccccttccccagccc

SEQ ID NO: 1080245 - DNA, 18 bp, Homo sapiens
gcccccttccccagccct

SEQ ID NO: 1080246 - DNA, 21 bp, Homo sapiens
gcccccttccccagcccttag

SEQ ID NO: 1080247 - DNA, 20 bp, Homo sapiens
gccccctttgaccttcccca

SEQ ID NO: 1080248 - DNA, 18 bp, Homo sapiens
gccccgacacacggggct

SEQ ID NO: 1080249 - DNA, 15 bp, Homo sapiens
gccccgactccagcc

SEQ ID NO: 1080250 - DNA, 17 bp, Homo sapiens
gccccgactccagccag

SEQ ID NO: 1080251 - DNA, 18 bp, Homo sapiens
gccccgagcccaggcagc

SEQ ID NO: 1080252 - DNA, 22 bp, Homo sapiens
gccccgcacccccgccaggcgc

SEQ ID NO: 1080253 - DNA, 23 bp, Homo sapiens
gccccgcacccccgccaggcgca

SEQ ID NO: 1080254 - DNA, 19 bp, Homo sapiens
gccccgcacgggctgtctg

SEQ ID NO: 1080255 - DNA, 20 bp, Homo sapiens
gccccgcagacggtctgtgt

SEQ ID NO: 1080256 - DNA, 20 bp, Homo sapiens
gccccgccagggctggggac

SEQ ID NO: 1080257 - DNA, 15 bp, Homo sapiens
gccccgccccacatt

SEQ ID NO: 1080258 - DNA, 14 bp, Homo sapiens
gccccgccccccag

SEQ ID NO: 1080259 - DNA, 18 bp, Homo sapiens
gccccgccccccagagcc

SEQ ID NO: 1080260 - DNA, 20 bp, Homo sapiens
gccccgccccccagagccag

SEQ ID NO: 1080261 - DNA, 22 bp, Homo sapiens
gccccgccccccagagccaggg

SEQ ID NO: 1080262 - DNA, 19 bp, Homo sapiens
gccccgcccccgccccgcg

SEQ ID NO: 1080263 - DNA, 22 bp, Homo sapiens
gccccgccctcttcctgacgaa

SEQ ID NO: 1080264 - DNA, 14 bp, Homo sapiens
gccccgcctccccg

SEQ ID NO: 1080265 - DNA, 18 bp, Homo sapiens
gccccgcctgcctgccac

SEQ ID NO: 1080266 - DNA, 20 bp, Homo sapiens
gccccgccttcgtgtgctgc

SEQ ID NO: 1080267 - DNA, 20 bp, Homo sapiens
gccccgcgcgccggtccggc

SEQ ID NO: 1080268 - DNA, 22 bp, Homo sapiens
gccccgcgggctttgttgctgg

SEQ ID NO: 1080269 - DNA, 12 bp, Homo sapiens
gccccgctgagc

SEQ ID NO: 1080270 - DNA, 18 bp, Homo sapiens
gccccgcttgtccagcgc

SEQ ID NO: 1080271 - DNA, 18 bp, Homo sapiens
gccccggacctacctccc

SEQ ID NO: 1080272 - DNA, 21 bp, Homo sapiens
gccccggacctacctccctcc

SEQ ID NO: 1080273 - DNA, 23 bp, Homo sapiens
gccccggacggacgttggttctg

SEQ ID NO: 1080274 - DNA, 16 bp, Homo sapiens
gccccggatcagagca

SEQ ID NO: 1080275 - DNA, 15 bp, Homo sapiens
gccccggcaagccac

SEQ ID NO: 1080276 - DNA, 14 bp, Homo sapiens
gccccggccccagc

SEQ ID NO: 1080277 - DNA, 16 bp, Homo sapiens
gccccgggctggccct

SEQ ID NO: 1080278 - DNA, 18 bp, Homo sapiens
gccccgggctggccctgt

SEQ ID NO: 1080279 - DNA, 20 bp, Homo sapiens
gccccgggctggccctgtgc

SEQ ID NO: 1080280 - DNA, 14 bp, Homo sapiens
gccccggggctggc

SEQ ID NO: 1080281 - DNA, 17 bp, Homo sapiens
gccccgggtgcctcaga

SEQ ID NO: 1080282 - DNA, 20 bp, Homo sapiens
gccccgggtgcctcagagca

SEQ ID NO: 1080283 - DNA, 17 bp, Homo sapiens
gccccgtcaccatctca

SEQ ID NO: 1080284 - DNA, 18 bp, Homo sapiens
gccccgtcaccatctcag

SEQ ID NO: 1080285 - DNA, 21 bp, Homo sapiens
gccccgtcaccatctcaggcc

SEQ ID NO: 1080286 - DNA, 22 bp, Homo sapiens
gccccgtcaccatctcaggcca

SEQ ID NO: 1080287 - DNA, 17 bp, Homo sapiens
gccccgtcccctaaccc

SEQ ID NO: 1080288 - DNA, 13 bp, Homo sapiens
gccccgtgaggca

SEQ ID NO: 1080289 - DNA, 18 bp, Homo sapiens
gccccgtgtgaatgtagc

SEQ ID NO: 1080290 - DNA, 13 bp, Homo sapiens
gccccgttccctg

SEQ ID NO: 1080291 - DNA, 15 bp, Homo sapiens
gccccgttccctgtc

SEQ ID NO: 1080292 - DNA, 18 bp, Homo sapiens
gccccgttgtgagctgga

SEQ ID NO: 1080293 - DNA, 17 bp, Homo sapiens
gcccctaatcacatgtg

SEQ ID NO: 1080294 - DNA, 13 bp, Homo sapiens
gcccctacccctg

SEQ ID NO: 1080295 - DNA, 18 bp, Homo sapiens
gcccctacccctgccctg

SEQ ID NO: 1080296 - DNA, 20 bp, Homo sapiens
gcccctacccctgccctgct

SEQ ID NO: 1080297 - DNA, 18 bp, Homo sapiens
gcccctaccctggacttg

SEQ ID NO: 1080298 - DNA, 14 bp, Homo sapiens
gcccctactgctgt

SEQ ID NO: 1080299 - DNA, 15 bp, Homo sapiens
gcccctactgctgtg

SEQ ID NO: 1080300 - DNA, 14 bp, Homo sapiens
gcccctactggagt

SEQ ID NO: 1080301 - DNA, 18 bp, Homo sapiens
gcccctagaaacccaagc

SEQ ID NO: 1080302 - DNA, 17 bp, Homo sapiens
gcccctagaatcagcct

SEQ ID NO: 1080303 - DNA, 17 bp, Homo sapiens
gcccctaggatgctgca

SEQ ID NO: 1080304 - DNA, 19 bp, Homo sapiens
gcccctatagcactgagct

SEQ ID NO: 1080305 - DNA, 13 bp, Homo sapiens
gcccctcacatcc

SEQ ID NO: 1080306 - DNA, 15 bp, Homo sapiens
gcccctcacatcctc

SEQ ID NO: 1080307 - DNA, 19 bp, Homo sapiens
gcccctcacatcctctcca

SEQ ID NO: 1080308 - DNA, 20 bp, Homo sapiens
gcccctcacatcctctccag

SEQ ID NO: 1080309 - DNA, 20 bp, Homo sapiens
gcccctcacccaccatggac

SEQ ID NO: 1080310 - DNA, 15 bp, Homo sapiens
gcccctcaccccaag

SEQ ID NO: 1080311 - DNA, 16 bp, Homo sapiens
gcccctcaccccaagg

SEQ ID NO: 1080312 - DNA, 15 bp, Homo sapiens
gcccctcaccctctg

SEQ ID NO: 1080313 - DNA, 18 bp, Homo sapiens
gcccctcaccctgcctta

SEQ ID NO: 1080314 - DNA, 15 bp, Homo sapiens
gcccctcacctgggc

SEQ ID NO: 1080315 - DNA, 13 bp, Homo sapiens
gcccctcagagcc

SEQ ID NO: 1080316 - DNA, 16 bp, Homo sapiens
gcccctcagcccttgc

SEQ ID NO: 1080317 - DNA, 18 bp, Homo sapiens
gcccctcagcccttgccc

SEQ ID NO: 1080318 - DNA, 14 bp, Homo sapiens
gcccctcagggggc

SEQ ID NO: 1080319 - DNA, 19 bp, Homo sapiens
gcccctccaaacctccagc

SEQ ID NO: 1080320 - DNA, 15 bp, Homo sapiens
gcccctccacgtgat

SEQ ID NO: 1080321 - DNA, 18 bp, Homo sapiens
gcccctccagaccctgcc

SEQ ID NO: 1080322 - DNA, 14 bp, Homo sapiens
gcccctccatccac

SEQ ID NO: 1080323 - DNA, 16 bp, Homo sapiens
gcccctccatccaccc

SEQ ID NO: 1080324 - DNA, 12 bp, Homo sapiens
gcccctcccacc

SEQ ID NO: 1080325 - DNA, 19 bp, Homo sapiens
gcccctccccaaaagaaac

SEQ ID NO: 1080326 - DNA, 20 bp, Homo sapiens
gcccctccccaaaagaaacc

SEQ ID NO: 1080327 - DNA, 16 bp, Homo sapiens
gcccctccccagccag

SEQ ID NO: 1080328 - DNA, 21 bp, Homo sapiens
gccctccctccctagcccttc

SEQ ID NO: 1080329 - DNA, 17 bp, Homo sapiens
gccctccctgactccct

SEQ ID NO: 1080330 - DNA, 19 bp, Homo sapiens
gccctccctgactccctgt

SEQ ID NO: 1080331 - DNA, 21 bp, Homo sapiens
gccctccctgcccctcccttc

SEQ ID NO: 1080332 - DNA, 18 bp, Homo sapiens
gccctccctgtcctcctc

SEQ ID NO: 1080333 - DNA, 21 bp, Homo sapiens
gccctccctgtcctcctcgga

SEQ ID NO: 1080334 - DNA, 19 bp, Homo sapiens
gccctccctgtctccaggg

SEQ ID NO: 1080335 - DNA, 17 bp, Homo sapiens
gccctcccttctccctg

SEQ ID NO: 1080336 - DNA, 20 bp, Homo sapiens
gccctcccttctccctggat

SEQ ID NO: 1080337 - DNA, 23 bp, Homo sapiens
gccctcccttggaaacctgccct

SEQ ID NO: 1080338 - DNA, 17 bp, Homo sapiens
gccctccgcctgggatc

SEQ ID NO: 1080339 - DNA, 16 bp, Homo sapiens
gccctccggaggagca

SEQ ID NO: 1080340 - DNA, 19 bp, Homo sapiens
gccctccggaggagcagcc

SEQ ID NO: 1080341 - DNA, 20 bp, Homo sapiens
gccctccggaggagcagcct

SEQ ID NO: 1080342 - DNA, 21 bp, Homo sapiens
gccctccggaggagcagcctc

SEQ ID NO: 1080343 - DNA, 17 bp, Homo sapiens
gccctcctaccctgcgc

SEQ ID NO: 1080344 - DNA, 19 bp, Homo sapiens
gccctcctaccctgcgccc

SEQ ID NO: 1080345 - DNA, 24 bp, Homo sapiens
gccctcctaccctgcgcccagtcc

SEQ ID NO: 1080346 - DNA, 21 bp, Homo sapiens
gccctcctcagcgagaggcag

SEQ ID NO: 1080347 - DNA, 12 bp, Homo sapiens
gccctcctctcc

SEQ ID NO: 1080348 - DNA, 14 bp, Homo sapiens
gccctcctctccca

SEQ ID NO: 1080349 - DNA, 13 bp, Homo sapiens
gccctcctgccca

SEQ ID NO: 1080350 - DNA, 14 bp, Homo sapiens
gccctcctgcccac

SEQ ID NO: 1080351 - DNA, 12 bp, Homo sapiens
gccctcctggac

SEQ ID NO: 1080352 - DNA, 13 bp, Homo sapiens
gccctcctggctg

SEQ ID NO: 1080353 - DNA, 15 bp, Homo sapiens
gccctccttccctcc

SEQ ID NO: 1080354 - DNA, 20 bp, Homo sapiens
gccctccttccctcctgtgc

SEQ ID NO: 1080355 - DNA, 22 bp, Homo sapiens
gccctccttccctcctgtgccc

SEQ ID NO: 1080356 - DNA, 13 bp, Homo sapiens
gccctcctttctg

SEQ ID NO: 1080357 - DNA, 17 bp, Homo sapiens
gccctcctttctgtgcc

SEQ ID NO: 1080358 - DNA, 20 bp, Homo sapiens
gccctcgaaccaaggcagcc

SEQ ID NO: 1080359 - DNA, 23 bp, Homo sapiens
gccctcgaaccaaggcagcctcc

SEQ ID NO: 1080360 - DNA, 23 bp, Homo sapiens
gccctcgacactcaccatgaagc

SEQ ID NO: 1080361 - DNA, 15 bp, Homo sapiens
gccctcgctgcttct

SEQ ID NO: 1080362 - DNA, 15 bp, Homo sapiens
gccctcggagctggc

SEQ ID NO: 1080363 - DNA, 22 bp, Homo sapiens
gccctcggagctggctgtgcct

SEQ ID NO: 1080364 - DNA, 18 bp, Homo sapiens
gccctcgggaccccactc

SEQ ID NO: 1080365 - DNA, 17 bp, Homo sapiens
gccctcgtctccctggc

SEQ ID NO: 1080366 - DNA, 19 bp, Homo sapiens
gccctcgtggccagcccgg

SEQ ID NO: 1080367 - DNA, 18 bp, Homo sapiens
gccctctagggcagggtg

SEQ ID NO: 1080368 - DNA, 19 bp, Homo sapiens
gccctctagggcagggtgg

SEQ ID NO: 1080369 - DNA, 19 bp, Homo sapiens
gccctctatcatggtgaaa

SEQ ID NO: 1080370 - DNA, 23 bp, Homo sapiens
gcccctcccccaacccccacccc

SEQ ID NO: 1080371 - DNA, 13 bp, Homo sapiens
gcccctcccccag

SEQ ID NO: 1080372 - DNA, 14 bp, Homo sapiens
gcccctcccccagg

SEQ ID NO: 1080373 - DNA, 13 bp, Homo sapiens
gcccctcccctca

SEQ ID NO: 1080374 - DNA, 15 bp, Homo sapiens
gcccctcccctcaga

SEQ ID NO: 1080375 - DNA, 17 bp, Homo sapiens
gcccctcccctcagagc

SEQ ID NO: 1080376 - DNA, 18 bp, Homo sapiens
gcccctcccctcagagcc

SEQ ID NO: 1080377 - DNA, 19 bp, Homo sapiens
gcccctcccctcagagccc

SEQ ID NO: 1080378 - DNA, 21 bp, Homo sapiens
gcccctcccctcagcctgccc

SEQ ID NO: 1080379 - DNA, 14 bp, Homo sapiens
gcccctccctctgc

SEQ ID NO: 1080380 - DNA, 15 bp, Homo sapiens
gcccctccctctgcc

SEQ ID NO: 1080381 - DNA, 17 bp, Homo sapiens
gcccctccctctgcccc

SEQ ID NO: 1080382 - DNA, 19 bp, Homo sapiens
gcccctccctctgccccaa

SEQ ID NO: 1080383 - DNA, 20 bp, Homo sapiens
gcccctccctctgccccaag

SEQ ID NO: 1080384 - DNA, 21 bp, Homo sapiens
gcccctccctctgccccaagc

SEQ ID NO: 1080385 - DNA, 13 bp, Homo sapiens
gcccctcctccag

SEQ ID NO: 1080386 - DNA, 17 bp, Homo sapiens
gcccctcctcccccggc

SEQ ID NO: 1080387 - DNA, 13 bp, Homo sapiens
gcccctcctctgc

SEQ ID NO: 1080388 - DNA, 14 bp, Homo sapiens
gcccctcctctgcc

SEQ ID NO: 1080389 - DNA, 18 bp, Homo sapiens
gcccctcctctgccacct

SEQ ID NO: 1080390 - DNA, 21 bp, Homo sapiens
gcccctcctctgccacctccc

SEQ ID NO: 1080391 - DNA, 14 bp, Homo sapiens
gcccctcctggagc

SEQ ID NO: 1080392 - DNA, 15 bp, Homo sapiens
gcccctcctggagca

SEQ ID NO: 1080393 - DNA, 17 bp, Homo sapiens
gcccctcgaggcctaca

SEQ ID NO: 1080394 - DNA, 13 bp, Homo sapiens
gcccctcggctct

SEQ ID NO: 1080395 - DNA, 12 bp, Homo sapiens
gcccctctgccc

SEQ ID NO: 1080396 - DNA, 14 bp, Homo sapiens
gcccctctgcccag

SEQ ID NO: 1080397 - DNA, 16 bp, Homo sapiens
gcccctctgcccagct

SEQ ID NO: 1080398 - DNA, 20 bp, Homo sapiens
gcccctctgcccagcttggg

SEQ ID NO: 1080399 - DNA, 19 bp, Homo sapiens
gcccctctggattcccttt

SEQ ID NO: 1080400 - DNA, 18 bp, Homo sapiens
gcccctctggtcgctcct

SEQ ID NO: 1080401 - DNA, 20 bp, Homo sapiens
gcccctctggtcgctcctgc

SEQ ID NO: 1080402 - DNA, 14 bp, Homo sapiens
gcccctcttcccca

SEQ ID NO: 1080403 - DNA, 18 bp, Homo sapiens
gcccctcttgccccccac

SEQ ID NO: 1080404 - DNA, 17 bp, Homo sapiens
gcccctctttctctttc

SEQ ID NO: 1080405 - DNA, 18 bp, Homo sapiens
gcccctgaggactggaga

SEQ ID NO: 1080406 - DNA, 19 bp, Homo sapiens
gcccctgaggactggagac

SEQ ID NO: 1080407 - DNA, 15 bp, Homo sapiens
gcccctgagtccgcc

SEQ ID NO: 1080408 - DNA, 17 bp, Homo sapiens
gcccctgagtccgcctg

SEQ ID NO: 1080409 - DNA, 19 bp, Homo sapiens
gcccctgagtccgcctgcg

SEQ ID NO: 1080410 - DNA, 15 bp, Homo sapiens
gcccctgcacaggca

SEQ ID NO: 1080411 - DNA, 23 bp, Homo sapiens
gcccctgcagtttggccctggag

SEQ ID NO: 1080412 - DNA, 14 bp, Homo sapiens
gcccctgcatcccc

SEQ ID NO: 1080413 - DNA, 18 bp, Homo sapiens
gcccctgccacctccctg

SEQ ID NO: 1080414 - DNA, 22 bp, Homo sapiens
gcccctgccccgtcaccatctc

SEQ ID NO: 1080415 - DNA, 14 bp, Homo sapiens
gcccctgcctgcca

SEQ ID NO: 1080416 - DNA, 19 bp, Homo sapiens
gcccctgcctgtgcccgca

SEQ ID NO: 1080417 - DNA, 17 bp, Homo sapiens
gcccctgctccctctgg

SEQ ID NO: 1080418 - DNA, 15 bp, Homo sapiens
gcccctgctgcctcc

SEQ ID NO: 1080419 - DNA, 16 bp, Homo sapiens
gcccctgctgcctccc

SEQ ID NO: 1080420 - DNA, 17 bp, Homo sapiens
gcccctgctgcctcccc

SEQ ID NO: 1080421 - DNA, 17 bp, Homo sapiens
gcccctgctgtctctct

SEQ ID NO: 1080422 - DNA, 19 bp, Homo sapiens
gcccctgctgtctctctgg

SEQ ID NO: 1080423 - DNA, 20 bp, Homo sapiens
gcccctgctgtgctgctcaa

SEQ ID NO: 1080424 - DNA, 13 bp, Homo sapiens
gcccctggagcca

SEQ ID NO: 1080425 - DNA, 15 bp, Homo sapiens
gcccctggagccaga

SEQ ID NO: 1080426 - DNA, 19 bp, Homo sapiens
gcccctggatctcctccct

SEQ ID NO: 1080427 - DNA, 16 bp, Homo sapiens
gcccctggcagcacag

SEQ ID NO: 1080428 - DNA, 17 bp, Homo sapiens
gcccctggcccagcggc

SEQ ID NO: 1080429 - DNA, 18 bp, Homo sapiens
gcccctggcccagcggcc

SEQ ID NO: 1080430 - DNA, 16 bp, Homo sapiens
gcccctggcccatctc

SEQ ID NO: 1080431 - DNA, 14 bp, Homo sapiens
gcccctggccccag

SEQ ID NO: 1080432 - DNA, 23 bp, Homo sapiens
gcccctggctgggacgtggctca

SEQ ID NO: 1080433 - DNA, 18 bp, Homo sapiens
gcccctgggaacaggccc

SEQ ID NO: 1080434 - DNA, 19 bp, Homo sapiens
gcccctgggaacaggcccc

SEQ ID NO: 1080435 - DNA, 19 bp, Homo sapiens
gcccttgaggggccccagc

SEQ ID NO: 1080436 - DNA, 19 bp, Homo sapiens
gcccttgcagttcagcacc

SEQ ID NO: 1080437 - DNA, 14 bp, Homo sapiens
gcccttgcctcccc

SEQ ID NO: 1080438 - DNA, 18 bp, Homo sapiens
gcccttgcttacctctca

SEQ ID NO: 1080439 - DNA, 16 bp, Homo sapiens
gcccttggccccagag

SEQ ID NO: 1080440 - DNA, 17 bp, Homo sapiens
gcccttggccccagagg

SEQ ID NO: 1080441 - DNA, 15 bp, Homo sapiens
gcccttggctgcagg

SEQ ID NO: 1080442 - DNA, 17 bp, Homo sapiens
gcccttggctgcaggca

SEQ ID NO: 1080443 - DNA, 17 bp, Homo sapiens
gcccttgggccacgctc

SEQ ID NO: 1080444 - DNA, 14 bp, Homo sapiens
gcccttggggcctg

SEQ ID NO: 1080445 - DNA, 17 bp, Homo sapiens
gcccttggggcctggct

SEQ ID NO: 1080446 - DNA, 18 bp, Homo sapiens
gcccttggggcctggctt

SEQ ID NO: 1080447 - DNA, 19 bp, Homo sapiens
gcccttggtagcagcctgg

SEQ ID NO: 1080448 - DNA, 20 bp, Homo sapiens
gcccttggtagcagcctggg

SEQ ID NO: 1080449 - DNA, 21 bp, Homo sapiens
gcccttgtcctgccagctgcc

SEQ ID NO: 1080450 - DNA, 13 bp, Homo sapiens
gcccttgtctttt

SEQ ID NO: 1080451 - DNA, 20 bp, Homo sapiens
gcccttgtgtgtgccctggg

SEQ ID NO: 1080452 - DNA, 17 bp, Homo sapiens
gcccttgtttacagtga

SEQ ID NO: 1080453 - DNA, 15 bp, Homo sapiens
gccctttcctaggcc

SEQ ID NO: 1080454 - DNA, 20 bp, Homo sapiens
gccctttcctaggcccaggc

SEQ ID NO: 1080455 - DNA, 22 bp, Homo sapiens
gccctttcctaggcccaggcct

SEQ ID NO: 1080456 - DNA, 12 bp, Homo sapiens
gccctttctgtg

SEQ ID NO: 1080457 - DNA, 16 bp, Homo sapiens
gccctttgaagcctca

SEQ ID NO: 1080458 - DNA, 17 bp, Homo sapiens
gccctttgaagcctcag

SEQ ID NO: 1080459 - DNA, 18 bp, Homo sapiens
gccctttgaagcctcagc

SEQ ID NO: 1080460 - DNA, 18 bp, Homo sapiens
gccctttgagtgcagtcc

SEQ ID NO: 1080461 - DNA, 15 bp, Homo sapiens
gccctttggccaaca

SEQ ID NO: 1080462 - DNA, 17 bp, Homo sapiens
gccctttgggaggctga

SEQ ID NO: 1080463 - DNA, 20 bp, Homo sapiens
gcccttttacagctcttggc

SEQ ID NO: 1080464 - DNA, 19 bp, Homo sapiens
gccgaacattaggaattgt

SEQ ID NO: 1080465 - DNA, 15 bp, Homo sapiens
gccgaaccaaaagaa

SEQ ID NO: 1080466 - DNA, 18 bp, Homo sapiens
gccgaagccccttggaga

SEQ ID NO: 1080467 - DNA, 19 bp, Homo sapiens
gccgaagctctggctgaac

SEQ ID NO: 1080468 - DNA, 15 bp, Homo sapiens
gccgaatgccctcag

SEQ ID NO: 1080469 - DNA, 17 bp, Homo sapiens
gccgacatccctccccc

SEQ ID NO: 1080470 - DNA, 21 bp, Homo sapiens
gccgacatccctcccccagca

SEQ ID NO: 1080471 - DNA, 14 bp, Homo sapiens
gccgaccagagccc

SEQ ID NO: 1080472 - DNA, 15 bp, Homo sapiens
gccgaccctcctggc

SEQ ID NO: 1080473 - DNA, 20 bp, Homo sapiens
gccgaccctcctggccttcc

SEQ ID NO: 1080474 - DNA, 11 bp, Homo sapiens
gccgacctcag

SEQ ID NO: 1080475 - DNA, 13 bp, Homo sapiens
gccgacctcagcc

SEQ ID NO: 1080476 - DNA, 21 bp, Homo sapiens
gccgacctcgtcctccccctg

SEQ ID NO: 1080477 - DNA, 15 bp, Homo sapiens
gccgactccctgagt

SEQ ID NO: 1080478 - DNA, 12 bp, Homo sapiens
gccgactctggc

SEQ ID NO: 1080479 - DNA, 15 bp, Homo sapiens
gccgactctggccct

SEQ ID NO: 1080480 - DNA, 17 bp, Homo sapiens
gccgactctggccctgg

SEQ ID NO: 1080481 - DNA, 15 bp, Homo sapiens
gccgacttggagact

SEQ ID NO: 1080482 - DNA, 18 bp, Homo sapiens
gccgacttggagactcct

SEQ ID NO: 1080483 - DNA, 13 bp, Homo sapiens
gccgagagaggcg

SEQ ID NO: 1080484 - DNA, 15 bp, Homo sapiens
gccgagagcctgctc

SEQ ID NO: 1080485 - DNA, 17 bp, Homo sapiens
gccgagagcctgctccc

SEQ ID NO: 1080486 - DNA, 19 bp, Homo sapiens
gccgagagcctgctccccc

SEQ ID NO: 1080487 - DNA, 22 bp, Homo sapiens
gccgagatcacgccactgcact

SEQ ID NO: 1080488 - DNA, 18 bp, Homo sapiens
gccgagattgcaccactg

SEQ ID NO: 1080489 - DNA, 19 bp, Homo sapiens
gccgagcctaatgaaaggg

SEQ ID NO: 1080490 - DNA, 14 bp, Homo sapiens
gccgagctcctggg

SEQ ID NO: 1080491 - DNA, 23 bp, Homo sapiens
gccgagctcctggggagctcctg

SEQ ID NO: 1080492 - DNA, 14 bp, Homo sapiens
gccgagctgcctgg

SEQ ID NO: 1080493 - DNA, 18 bp, Homo sapiens
gccgaggagttgtcgttt

SEQ ID NO: 1080494 - DNA, 14 bp, Homo sapiens
gccgagggccaggc

SEQ ID NO: 1080495 - DNA, 15 bp, Homo sapiens
gccgaggtgggcaga

SEQ ID NO: 1080496 - DNA, 20 bp, Homo sapiens
gccgaggtgggtggattgcc

SEQ ID NO: 1080497 - DNA, 22 bp, Homo sapiens
gccgatatactctagatgaagt

SEQ ID NO: 1080498 - DNA, 16 bp, Homo sapiens
gccgatgccaccggcc

SEQ ID NO: 1080499 - DNA, 18 bp, Homo sapiens
gccgatgggagtctccct

SEQ ID NO: 1080500 - DNA, 19 bp, Homo sapiens
gccgatgttgaactttttt

SEQ ID NO: 1080501 - DNA, 17 bp, Homo sapiens
gccgcaaaccacactgg

SEQ ID NO: 1080502 - DNA, 19 bp, Homo sapiens
gccgcaaaccacactggac

SEQ ID NO: 1080503 - DNA, 14 bp, Homo sapiens
gccgcaagggcctg

SEQ ID NO: 1080504 - DNA, 17 bp, Homo sapiens
gccgcaagggcctggac

SEQ ID NO: 1080505 - DNA, 13 bp, Homo sapiens
gccgcaccccaga

SEQ ID NO: 1080506 - DNA, 23 bp, Homo sapiens
gccgcaccccagagtgtgggaag

SEQ ID NO: 1080507 - DNA, 20 bp, Homo sapiens
gccgcaccctgcacctgctg

SEQ ID NO: 1080508 - DNA, 22 bp, Homo sapiens
gccgcaccctgcacctgctgcg

SEQ ID NO: 1080509 - DNA, 14 bp, Homo sapiens
gccgcacgcctctc

SEQ ID NO: 1080510 - DNA, 13 bp, Homo sapiens
gccgcactctggc

SEQ ID NO: 1080511 - DNA, 12 bp, Homo sapiens
gccgcagaagca

SEQ ID NO: 1080512 - DNA, 17 bp, Homo sapiens
gccgcagcctccctctg

SEQ ID NO: 1080513 - DNA, 14 bp, Homo sapiens
gccgcagcggtggg

SEQ ID NO: 1080514 - DNA, 13 bp, Homo sapiens
gccgcagctcttg

SEQ ID NO: 1080515 - DNA, 21 bp, Homo sapiens
gccgcaggaaggcagaataaa

SEQ ID NO: 1080516 - DNA, 13 bp, Homo sapiens
gccgcagggccca

SEQ ID NO: 1080517 - DNA, 16 bp, Homo sapiens
gccgcagggcccacct

SEQ ID NO: 1080518 - DNA, 19 bp, Homo sapiens
gccgcagggcccaccttgg

SEQ ID NO: 1080519 - DNA, 17 bp, Homo sapiens
gccgcattggtgactca

SEQ ID NO: 1080520 - DNA, 18 bp, Homo sapiens
gccgcattggtgactcac

SEQ ID NO: 1080521 - DNA, 12 bp, Homo sapiens
gccgccaccccc

SEQ ID NO: 1080522 - DNA, 15 bp, Homo sapiens
gccgccacctgaggt

SEQ ID NO: 1080523 - DNA, 14 bp, Homo sapiens
gccgccactaggtg

SEQ ID NO: 1080524 - DNA, 17 bp, Homo sapiens
gccgccagcgtgtggag

SEQ ID NO: 1080525 - DNA, 19 bp, Homo sapiens
gccgccagcgtgtggagca

SEQ ID NO: 1080526 - DNA, 15 bp, Homo sapiens
gccgccagctgggag

SEQ ID NO: 1080527 - DNA, 15 bp, Homo sapiens
gccgccatctgcgca

SEQ ID NO: 1080528 - DNA, 15 bp, Homo sapiens
gccgccatgctcctg

SEQ ID NO: 1080529 - DNA, 21 bp, Homo sapiens
gccgcccacccccacccccag

SEQ ID NO: 1080530 - DNA, 13 bp, Homo sapiens
gccgcccacctcg

SEQ ID NO: 1080531 - DNA, 20 bp, Homo sapiens
gccgcccacctcgctcccct

SEQ ID NO: 1080532 - DNA, 18 bp, Homo sapiens
gccgcccacgccggcctc

SEQ ID NO: 1080533 - DNA, 20 bp, Homo sapiens
gccgcccacgccggcctctg

SEQ ID NO: 1080534 - DNA, 14 bp, Homo sapiens
gccgccccagcccc

SEQ ID NO: 1080535 - DNA, 23 bp, Homo sapiens
gccgccccctgccccccagcctc

SEQ ID NO: 1080536 - DNA, 17 bp, Homo sapiens
gccgcccctccacccat

SEQ ID NO: 1080537 - DNA, 14 bp, Homo sapiens
gccgcccctgaggc

SEQ ID NO: 1080538 - DNA, 13 bp, Homo sapiens
gccgcccgctccc

SEQ ID NO: 1080539 - DNA, 23 bp, Homo sapiens
gccgcccgctcccttcctgccac

SEQ ID NO: 1080540 - DNA, 12 bp, Homo sapiens
gccgccctccat

SEQ ID NO: 1080541 - DNA, 15 bp, Homo sapiens
gccgccgcccacgcc

SEQ ID NO: 1080542 - DNA, 13 bp, Homo sapiens
gccgccgcctctt

SEQ ID NO: 1080543 - DNA, 18 bp, Homo sapiens
gccgccgtctctgtcccg

SEQ ID NO: 1080544 - DNA, 13 bp, Homo sapiens
gcctcagagcctg

SEQ ID NO: 1080545 - DNA, 22 bp, Homo sapiens
gcctcagagcctgacctgagag

SEQ ID NO: 1080546 - DNA, 17 bp, Homo sapiens
gcctcagatgatttccc

SEQ ID NO: 1080547 - DNA, 13 bp, Homo sapiens
gcctcagccaggc

SEQ ID NO: 1080548 - DNA, 15 bp, Homo sapiens
gcctcagccaggccc

SEQ ID NO: 1080549 - DNA, 15 bp, Homo sapiens
gcctcagccagtggc

SEQ ID NO: 1080550 - DNA, 21 bp, Homo sapiens
gcctcagccagtggcacagga

SEQ ID NO: 1080551 - DNA, 17 bp, Homo sapiens
gcctcagccattcactg

SEQ ID NO: 1080552 - DNA, 12 bp, Homo sapiens
gcctcagccctc

SEQ ID NO: 1080553 - DNA, 15 bp, Homo sapiens
gcctcagccctcagt

SEQ ID NO: 1080554 - DNA, 12 bp, Homo sapiens
gcctcagcctgg

SEQ ID NO: 1080555 - DNA, 15 bp, Homo sapiens
gcctcagcctggggc

SEQ ID NO: 1080556 - DNA, 19 bp, Homo sapiens
gcctcagcctggggctctc

SEQ ID NO: 1080557 - DNA, 22 bp, Homo sapiens
gcctcagcctggggctctctga

SEQ ID NO: 1080558 - DNA, 20 bp, Homo sapiens
gcctcagctacccactatcc

SEQ ID NO: 1080559 - DNA, 19 bp, Homo sapiens
gcctcagctgcctcacttc

SEQ ID NO: 1080560 - DNA, 13 bp, Homo sapiens
gcctcaggcactc

SEQ ID NO: 1080561 - DNA, 17 bp, Homo sapiens
gcctcaggccagggctc

SEQ ID NO: 1080562 - DNA, 19 bp, Homo sapiens
gcctcaggcttgagggagg

SEQ ID NO: 1080563 - DNA, 20 bp, Homo sapiens
gcctcaggcttgagggaggg

SEQ ID NO: 1080564 - DNA, 21 bp, Homo sapiens
gcctcagtatatttaaactca

SEQ ID NO: 1080565 - DNA, 22 bp, Homo sapiens
gcctcagtggactttccacccc

SEQ ID NO: 1080566 - DNA, 16 bp, Homo sapiens
gcctcagttacacagg

SEQ ID NO: 1080567 - DNA, 22 bp, Homo sapiens
gcctcagttcaacctggtggca

SEQ ID NO: 1080568 - DNA, 17 bp, Homo sapiens
gcctcagttttccttct

SEQ ID NO: 1080569 - DNA, 18 bp, Homo sapiens
gcctcagttttccttctg

SEQ ID NO: 1080570 - DNA, 20 bp, Homo sapiens
gcctcagttttccttctgtt

SEQ ID NO: 1080571 - DNA, 20 bp, Homo sapiens
gcctcatagcatagccagca

SEQ ID NO: 1080572 - DNA, 21 bp, Homo sapiens
gcctcatagcatagccagcat

SEQ ID NO: 1080573 - DNA, 12 bp, Homo sapiens
gcctcatccctc

SEQ ID NO: 1080574 - DNA, 16 bp, Homo sapiens
gcctcatccgaggcag

SEQ ID NO: 1080575 - DNA, 21 bp, Homo sapiens
gcctcatcctccccaggaccc

SEQ ID NO: 1080576 - DNA, 17 bp, Homo sapiens
gcctcatgccacacctt

SEQ ID NO: 1080577 - DNA, 18 bp, Homo sapiens
gcctcatgctggagggag

SEQ ID NO: 1080578 - DNA, 15 bp, Homo sapiens
gcctcatgtggctgg

SEQ ID NO: 1080579 - DNA, 17 bp, Homo sapiens
gcctcatgttctcttcc

SEQ ID NO: 1080580 - DNA, 18 bp, Homo sapiens
gcctcatgttctcttccc

SEQ ID NO: 1080581 - DNA, 23 bp, Homo sapiens
gcctcatgttctcttcccaggcc

SEQ ID NO: 1080582 - DNA, 20 bp, Homo sapiens
gcctcattgtgccaagcctt

SEQ ID NO: 1080583 - DNA, 21 bp, Homo sapiens
gcctcattgtgccaagccttc

SEQ ID NO: 1080584 - DNA, 19 bp, Homo sapiens
gcctcatttcttcctctgc

SEQ ID NO: 1080585 - DNA, 14 bp, Homo sapiens
gcctcatttctttg

SEQ ID NO: 1080586 - DNA, 18 bp, Homo sapiens
gcctccaaagtggagctg

SEQ ID NO: 1080587 - DNA, 20 bp, Homo sapiens
gcctccaaagtggagctggg

SEQ ID NO: 1080588 - DNA, 23 bp, Homo sapiens
gcctccaaagtggagctgggagg

SEQ ID NO: 1080589 - DNA, 16 bp, Homo sapiens
gcctccaaccctagca

SEQ ID NO: 1080590 - DNA, 16 bp, Homo sapiens
gcctccaacgcccctg

SEQ ID NO: 1080591 - DNA, 19 bp, Homo sapiens
gcctccaacgcccctgtgg

SEQ ID NO: 1080592 - DNA, 22 bp, Homo sapiens
gcctccaacgcccctgtggcca

SEQ ID NO: 1080593 - DNA, 23 bp, Homo sapiens
gcctccaacgcccctgtggccaa

SEQ ID NO: 1080594 - DNA, 16 bp, Homo sapiens
gcctccaagcacagag

SEQ ID NO: 1080595 - DNA, 20 bp, Homo sapiens
gcctccaagcacagagcctg

SEQ ID NO: 1080596 - DNA, 19 bp, Homo sapiens
gcctccaagggtttcgact

SEQ ID NO: 1080597 - DNA, 20 bp, Homo sapiens
gcctccaattggtgcttcag

SEQ ID NO: 1080598 - DNA, 22 bp, Homo sapiens
gcctccaattttttaagtgaaa

SEQ ID NO: 1080599 - DNA, 14 bp, Homo sapiens
gcctccacagcgag

SEQ ID NO: 1080600 - DNA, 23 bp, Homo sapiens
gcctccacagcgagggcagctgc

SEQ ID NO: 1080601 - DNA, 20 bp, Homo sapiens
gcctccacatgctgcctggc

SEQ ID NO: 1080602 - DNA, 21 bp, Homo sapiens
gcctccacatgctgcctggca

SEQ ID NO: 1080603 - DNA, 13 bp, Homo sapiens
gcctccactcccc

SEQ ID NO: 1080604 - DNA, 20 bp, Homo sapiens
gcctccactcccccacctga

SEQ ID NO: 1080605 - DNA, 23 bp, Homo sapiens
gcctccactcccccacctgacaa

SEQ ID NO: 1080606 - DNA, 12 bp, Homo sapiens
gcctccagaact

SEQ ID NO: 1080607 - DNA, 19 bp, Homo sapiens
gcctccagaactcactggg

SEQ ID NO: 1080608 - DNA, 18 bp, Homo sapiens
gcctccagaagctgctcc

SEQ ID NO: 1080609 - DNA, 19 bp, Homo sapiens
gcctccagagaagccccgc

SEQ ID NO: 1080610 - DNA, 13 bp, Homo sapiens
gcctccagagcca

SEQ ID NO: 1080611 - DNA, 17 bp, Homo sapiens
gcctccagagccagcct

SEQ ID NO: 1080612 - DNA, 23 bp, Homo sapiens
gcctccagagccagcctgggact

SEQ ID NO: 1080613 - DNA, 11 bp, Homo sapiens
gcctccagagg

SEQ ID NO: 1080614 - DNA, 15 bp, Homo sapiens
gcctccagcaccaag

SEQ ID NO: 1080615 - DNA, 12 bp, Homo sapiens
gcctccagcctc

SEQ ID NO: 1080616 - DNA, 14 bp, Homo sapiens
gcctccagcctctc

SEQ ID NO: 1080617 - DNA, 18 bp, Homo sapiens
gcctccagcctctcccgg

SEQ ID NO: 1080618 - DNA, 19 bp, Homo sapiens
gcctccagcctctcccggc

SEQ ID NO: 1080619 - DNA, 22 bp, Homo sapiens
gcctccagcctttgctccctcc

SEQ ID NO: 1080620 - DNA, 19 bp, Homo sapiens
gcctccaggaccaggggcc

SEQ ID NO: 1080621 - DNA, 15 bp, Homo sapiens
gcctccaggaggggc

SEQ ID NO: 1080622 - DNA, 17 bp, Homo sapiens
gcctccagtcatggtac

SEQ ID NO: 1080623 - DNA, 18 bp, Homo sapiens
gcctccagtcatggtact

SEQ ID NO: 1080624 - DNA, 18 bp, Homo sapiens
gcctccagttgtagcagg

SEQ ID NO: 1080625 - DNA, 15 bp, Homo sapiens
gcctccatccaaggc

SEQ ID NO: 1080626 - DNA, 13 bp, Homo sapiens
gcctccatccatc

SEQ ID NO: 1080627 - DNA, 18 bp, Homo sapiens
gcctccatccatctgtcc

SEQ ID NO: 1080628 - DNA, 15 bp, Homo sapiens
gcctccatgccccag

SEQ ID NO: 1080629 - DNA, 20 bp, Homo sapiens
gcctccatgccccagctctg

SEQ ID NO: 1080630 - DNA, 21 bp, Homo sapiens
gcctccatgtgggtgctaggg

SEQ ID NO: 1080631 - DNA, 16 bp, Homo sapiens
gcctccatgttttaat

SEQ ID NO: 1080632 - DNA, 14 bp, Homo sapiens
gcctccatttctgt

SEQ ID NO: 1080633 - DNA, 21 bp, Homo sapiens
gcctcccaaggtcctctcagt

SEQ ID NO: 1080634 - DNA, 21 bp, Homo sapiens
gcctcccaagtagctgggatt

SEQ ID NO: 1080635 - DNA, 22 bp, Homo sapiens
gcctcccacactgaaaccaaaa

SEQ ID NO: 1080636 - DNA, 16 bp, Homo sapiens
gcctcccacacttgct

SEQ ID NO: 1080637 - DNA, 19 bp, Homo sapiens
gcctcccacacttgctggg

SEQ ID NO: 1080638 - DNA, 21 bp, Homo sapiens
gcctcccacacttgctggggc

SEQ ID NO: 1080639 - DNA, 15 bp, Homo sapiens
gcctcccaccagagc

SEQ ID NO: 1080640 - DNA, 22 bp, Homo sapiens
gcctcccaccagagccgggagg

SEQ ID NO: 1080641 - DNA, 19 bp, Homo sapiens
gcctcccacccgatgctgc

SEQ ID NO: 1080642 - DNA, 21 bp, Homo sapiens
gcctcccacccgatgctgctt

SEQ ID NO: 1080643 - DNA, 23 bp, Homo sapiens
gcctcccacccgatgctgctttc

SEQ ID NO: 1080644 - DNA, 13 bp, Homo sapiens
gcctcccactggg

SEQ ID NO: 1080645 - DNA, 19 bp, Homo sapiens
gcctcccaggcaagcagct

SEQ ID NO: 1080646 - DNA, 22 bp, Homo sapiens
gcctcccatccagggcccccat

SEQ ID NO: 1080647 - DNA, 12 bp, Homo sapiens
gcctcccatgcc

SEQ ID NO: 1080648 - DNA, 14 bp, Homo sapiens
gcctcccattctgc

SEQ ID NO: 1080649 - DNA, 18 bp, Homo sapiens
gcctcccattctgcacca

SEQ ID NO: 1080650 - DNA, 17 bp, Homo sapiens
gcctccccaaccctgcc

SEQ ID NO: 1080651 - DNA, 20 bp, Homo sapiens
gcctccccaaccctgcccct

SEQ ID NO: 1080652 - DNA, 22 bp, Homo sapiens
gcctccccaccccagtgggaac

SEQ ID NO: 1080653 - DNA, 19 bp, Homo sapiens
gcctccccaccctcctctt

SEQ ID NO: 1080654 - DNA, 13 bp, Homo sapiens
gcctccccatctg

SEQ ID NO: 1080655 - DNA, 20 bp, Homo sapiens
gcctccccatctgtccagct

SEQ ID NO: 1080656 - DNA, 13 bp, Homo sapiens
gcctccccatttc

SEQ ID NO: 1080657 - DNA, 13 bp, Homo sapiens
gcctccccccaga

SEQ ID NO: 1080658 - DNA, 15 bp, Homo sapiens
gcctccccccagacc

SEQ ID NO: 1080659 - DNA, 20 bp, Homo sapiens
gcctccccccagaccccgcc

SEQ ID NO: 1080660 - DNA, 21 bp, Homo sapiens
gcctccccccagaccccgccc

SEQ ID NO: 1080661 - DNA, 15 bp, Homo sapiens
gcctccccctcagat

SEQ ID NO: 1080662 - DNA, 22 bp, Homo sapiens
gcctccccctcagatgatctct

SEQ ID NO: 1080663 - DNA, 12 bp, Homo sapiens
gcctcccctccc

SEQ ID NO: 1080664 - DNA, 13 bp, Homo sapiens
gcctcccctcccc

SEQ ID NO: 1080665 - DNA, 19 bp, Homo sapiens
gcctcccctcccctgggga

SEQ ID NO: 1080666 - DNA, 20 bp, Homo sapiens
gcctcccctcccctggggac

SEQ ID NO: 1080667 - DNA, 18 bp, Homo sapiens
gcctcccctctccttcct

SEQ ID NO: 1080668 - DNA, 22 bp, Homo sapiens
gcctgaccccttgctcccttca

SEQ ID NO: 1080669 - DNA, 23 bp, Homo sapiens
gcctgaccctacttcttttgctc

SEQ ID NO: 1080670 - DNA, 19 bp, Homo sapiens
gcctgacctcaagcaacca

SEQ ID NO: 1080671 - DNA, 16 bp, Homo sapiens
gcctgacctgagactg

SEQ ID NO: 1080672 - DNA, 14 bp, Homo sapiens
gcctgacctgagag

SEQ ID NO: 1080673 - DNA, 20 bp, Homo sapiens
gcctgacgtgggcatcattt

SEQ ID NO: 1080674 - DNA, 21 bp, Homo sapiens
gcctgactaatttttgtattt

SEQ ID NO: 1080675 - DNA, 15 bp, Homo sapiens
gcctgactcctgggt

SEQ ID NO: 1080676 - DNA, 14 bp, Homo sapiens
gcctgactctgttg

SEQ ID NO: 1080677 - DNA, 13 bp, Homo sapiens
gcctgactgctca

SEQ ID NO: 1080678 - DNA, 17 bp, Homo sapiens
gcctgactgttgccccc

SEQ ID NO: 1080679 - DNA, 16 bp, Homo sapiens
gcctgacttctgctgg

SEQ ID NO: 1080680 - DNA, 17 bp, Homo sapiens
gcctgacttgagccact

SEQ ID NO: 1080681 - DNA, 18 bp, Homo sapiens
gcctgagaatgagtggga

SEQ ID NO: 1080682 - DNA, 12 bp, Homo sapiens
gcctgagacagc

SEQ ID NO: 1080683 - DNA, 19 bp, Homo sapiens
gcctgagagaattggctca

SEQ ID NO: 1080684 - DNA, 18 bp, Homo sapiens
gcctgagaggcaggcata

SEQ ID NO: 1080685 - DNA, 19 bp, Homo sapiens
gcctgagaggcaggcatag

SEQ ID NO: 1080686 - DNA, 22 bp, Homo sapiens
gcctgagaggcaggcatagagg

SEQ ID NO: 1080687 - DNA, 16 bp, Homo sapiens
gcctgagaggggaagc

SEQ ID NO: 1080688 - DNA, 22 bp, Homo sapiens
gcctgagcaacagagtgagacc

SEQ ID NO: 1080689 - DNA, 21 bp, Homo sapiens
gcctgagcaacatctcgggag

SEQ ID NO: 1080690 - DNA, 23 bp, Homo sapiens
gcctgagctcactcggcaccctg

SEQ ID NO: 1080691 - DNA, 15 bp, Homo sapiens
gcctgagctggggaa

SEQ ID NO: 1080692 - DNA, 14 bp, Homo sapiens
gcctgagctggggc

SEQ ID NO: 1080693 - DNA, 19 bp, Homo sapiens
gcctgagctggggccacaa

SEQ ID NO: 1080694 - DNA, 10 bp, Homo sapiens
gcctgaggag

SEQ ID NO: 1080695 - DNA, 18 bp, Homo sapiens
gcctgaggaggaggacac

SEQ ID NO: 1080696 - DNA, 18 bp, Homo sapiens
gcctgaggatgagctgga

SEQ ID NO: 1080697 - DNA, 16 bp, Homo sapiens
gcctgaggcaggagaa

SEQ ID NO: 1080698 - DNA, 15 bp, Homo sapiens
gcctgaggctgagac

SEQ ID NO: 1080699 - DNA, 17 bp, Homo sapiens
gcctgaggctgagactg

SEQ ID NO: 1080700 - DNA, 13 bp, Homo sapiens
gcctgaggctggg

SEQ ID NO: 1080701 - DNA, 14 bp, Homo sapiens
gcctgaggctggga

SEQ ID NO: 1080702 - DNA, 13 bp, Homo sapiens
gcctgagggcagt

SEQ ID NO: 1080703 - DNA, 17 bp, Homo sapiens
gcctgagggcccctctg

SEQ ID NO: 1080704 - DNA, 22 bp, Homo sapiens
gcctgagggcccctctgcccag

SEQ ID NO: 1080705 - DNA, 12 bp, Homo sapiens
gcctgagggtgg

SEQ ID NO: 1080706 - DNA, 20 bp, Homo sapiens
gcctgaggtgggagaatcac

SEQ ID NO: 1080707 - DNA, 20 bp, Homo sapiens
gcctgagtcagtgctctcag

SEQ ID NO: 1080708 - DNA, 21 bp, Homo sapiens
gcctgagtgagtgtgtgtgct

SEQ ID NO: 1080709 - DNA, 13 bp, Homo sapiens
gcctgagtttcca

SEQ ID NO: 1080710 - DNA, 20 bp, Homo sapiens
gcctgataagcttcaaagct

SEQ ID NO: 1080711 - DNA, 14 bp, Homo sapiens
gcctgatactttag

SEQ ID NO: 1080712 - DNA, 14 bp, Homo sapiens
gcctgatataaatg

SEQ ID NO: 1080713 - DNA, 14 bp, Homo sapiens
gcctgatccagcct

SEQ ID NO: 1080714 - DNA, 12 bp, Homo sapiens
gcctgatccctg

SEQ ID NO: 1080715 - DNA, 14 bp, Homo sapiens
gcctgatctcttcc

SEQ ID NO: 1080716 - DNA, 15 bp, Homo sapiens
gcctgatcttgcctg

SEQ ID NO: 1080717 - DNA, 19 bp, Homo sapiens
gcctgatgagatttttaaa

SEQ ID NO: 1080718 - DNA, 20 bp, Homo sapiens
gcctgatgagatttttaaaa

SEQ ID NO: 1080719 - DNA, 16 bp, Homo sapiens
gcctgatgctccctcc

SEQ ID NO: 1080720 - DNA, 20 bp, Homo sapiens
gcctgatgctccctcccctg

SEQ ID NO: 1080721 - DNA, 13 bp, Homo sapiens
gcctgatgctgcc

SEQ ID NO: 1080722 - DNA, 15 bp, Homo sapiens
gcctgatgctgcccc

SEQ ID NO: 1080723 - DNA, 16 bp, Homo sapiens
gcctgatggccaaggg

SEQ ID NO: 1080724 - DNA, 17 bp, Homo sapiens
gcctgatggccaagggg

SEQ ID NO: 1080725 - DNA, 19 bp, Homo sapiens
gcctgatggtgctgctcag

SEQ ID NO: 1080726 - DNA, 21 bp, Homo sapiens
gcctgatttggggtttcttca

SEQ ID NO: 1080727 - DNA, 21 bp, Homo sapiens
gcctgcaaactcactgctcaa

SEQ ID NO: 1080728 - DNA, 12 bp, Homo sapiens
gcctgcacagat

SEQ ID NO: 1080729 - DNA, 20 bp, Homo sapiens
gcctgcaccgacccgaggcc

SEQ ID NO: 1080730 - DNA, 21 bp, Homo sapiens
gcctgcaccgacccgaggccc

SEQ ID NO: 1080731 - DNA, 22 bp, Homo sapiens
gcctgcaccgacccgaggccca

SEQ ID NO: 1080732 - DNA, 23 bp, Homo sapiens
gcctgcaccgacccgaggcccag

SEQ ID NO: 1080733 - DNA, 14 bp, Homo sapiens
gcctgcactccctg

SEQ ID NO: 1080734 - DNA, 21 bp, Homo sapiens
gcctgcactccctggccttgc

SEQ ID NO: 1080735 - DNA, 15 bp, Homo sapiens
gcctgcactgggaag

SEQ ID NO: 1080736 - DNA, 16 bp, Homo sapiens
gcctgcagagagaagc

SEQ ID NO: 1080737 - DNA, 18 bp, Homo sapiens
gcctgcagagagaagcct

SEQ ID NO: 1080738 - DNA, 13 bp, Homo sapiens
gcctgcagcgcct

SEQ ID NO: 1080739 - DNA, 13 bp, Homo sapiens
gcctgcaggacct

SEQ ID NO: 1080740 - DNA, 18 bp, Homo sapiens
gcctgcaggacctcgtgc

SEQ ID NO: 1080741 - DNA, 13 bp, Homo sapiens
gcctgcaggagaa

SEQ ID NO: 1080742 - DNA, 14 bp, Homo sapiens
gcctgcaggcagag

SEQ ID NO: 1080743 - DNA, 18 bp, Homo sapiens
gcctgcaggctggagact

SEQ ID NO: 1080744 - DNA, 19 bp, Homo sapiens
gcctgcagggaataacata

SEQ ID NO: 1080745 - DNA, 16 bp, Homo sapiens
gcctcgaggcaccggc

SEQ ID NO: 1080746 - DNA, 21 bp, Homo sapiens
gcctcgaggcaccggcgctgc

SEQ ID NO: 1080747 - DNA, 14 bp, Homo sapiens
gcctcgaggctggt

SEQ ID NO: 1080748 - DNA, 14 bp, Homo sapiens
gcctcgagggccgc

SEQ ID NO: 1080749 - DNA, 20 bp, Homo sapiens
gcctcgagggccgcctgcct

SEQ ID NO: 1080750 - DNA, 13 bp, Homo sapiens
gcctcgcacaggc

SEQ ID NO: 1080751 - DNA, 14 bp, Homo sapiens
gcctcgcacaggcc

SEQ ID NO: 1080752 - DNA, 17 bp, Homo sapiens
gcctcgcacttgcagag

SEQ ID NO: 1080753 - DNA, 20 bp, Homo sapiens
gcctcgcacttgcagaggag

SEQ ID NO: 1080754 - DNA, 23 bp, Homo sapiens
gcctcgcacttgcagaggagccc

SEQ ID NO: 1080755 - DNA, 13 bp, Homo sapiens
gcctcgcctgcct

SEQ ID NO: 1080756 - DNA, 14 bp, Homo sapiens
gcctcggagcctca

SEQ ID NO: 1080757 - DNA, 17 bp, Homo sapiens
gcctcggagcctcatcc

SEQ ID NO: 1080758 - DNA, 22 bp, Homo sapiens
gcctcggcagaactctctgtct

SEQ ID NO: 1080759 - DNA, 21 bp, Homo sapiens
gcctcgggacacctgccctgc

SEQ ID NO: 1080760 - DNA, 18 bp, Homo sapiens
gcctcggggatggggagg

SEQ ID NO: 1080761 - DNA, 13 bp, Homo sapiens
gcctcgtgccagc

SEQ ID NO: 1080762 - DNA, 22 bp, Homo sapiens
gcctcgtgccagcagcctcgca

SEQ ID NO: 1080763 - DNA, 13 bp, Homo sapiens
gcctcgtgtccag

SEQ ID NO: 1080764 - DNA, 14 bp, Homo sapiens
gcctcgtgtccaga

SEQ ID NO: 1080765 - DNA, 22 bp, Homo sapiens
gcctctaagcgtgctgacatca

SEQ ID NO: 1080766 - DNA, 16 bp, Homo sapiens
gcctctacagccgtcc

SEQ ID NO: 1080767 - DNA, 15 bp, Homo sapiens
gcctctatgccctgc

SEQ ID NO: 1080768 - DNA, 17 bp, Homo sapiens
gcctctatgccctgcag

SEQ ID NO: 1080769 - DNA, 18 bp, Homo sapiens
gcctctatgccctgcaga

SEQ ID NO: 1080770 - DNA, 19 bp, Homo sapiens
gcctctatgccctgcagag

SEQ ID NO: 1080771 - DNA, 20 bp, Homo sapiens
gcctctatgccctgcagagc

SEQ ID NO: 1080772 - DNA, 16 bp, Homo sapiens
gcctctcaccccactt

SEQ ID NO: 1080773 - DNA, 23 bp, Homo sapiens
gcctctcaccccacttcccatct

SEQ ID NO: 1080774 - DNA, 23 bp, Homo sapiens
gcctctcacctgtactcttccga

SEQ ID NO: 1080775 - DNA, 15 bp, Homo sapiens
gcctctcagtgccct

SEQ ID NO: 1080776 - DNA, 16 bp, Homo sapiens
gcctctcatcaactga

SEQ ID NO: 1080777 - DNA, 18 bp, Homo sapiens
gcctctcatcaactgaat

SEQ ID NO: 1080778 - DNA, 17 bp, Homo sapiens
gcctgcggcctgctgga

SEQ ID NO: 1080779 - DNA, 19 bp, Homo sapiens
gcctgcgttggtccagagc

SEQ ID NO: 1080780 - DNA, 20 bp, Homo sapiens
gcctgcgttttggaagctct

SEQ ID NO: 1080781 - DNA, 15 bp, Homo sapiens
gcctgctaatagctg

SEQ ID NO: 1080782 - DNA, 15 bp, Homo sapiens
gcctgctcagcagcc

SEQ ID NO: 1080783 - DNA, 23 bp, Homo sapiens
gcctgctcagcagccagtctcag

SEQ ID NO: 1080784 - DNA, 15 bp, Homo sapiens
gcctgctcaggtgct

SEQ ID NO: 1080785 - DNA, 18 bp, Homo sapiens
gcctgctccagctgttca

SEQ ID NO: 1080786 - DNA, 13 bp, Homo sapiens
gcctgctcccagc

SEQ ID NO: 1080787 - DNA, 15 bp, Homo sapiens
gcctgctcccagcag

SEQ ID NO: 1080788 - DNA, 20 bp, Homo sapiens
gcctgctcccagcagcccta

SEQ ID NO: 1080789 - DNA, 14 bp, Homo sapiens
gcctgctcccatcc

SEQ ID NO: 1080790 - DNA, 13 bp, Homo sapiens
gcctgctccccca

SEQ ID NO: 1080791 - DNA, 16 bp, Homo sapiens
gcctgctcctcactgg

SEQ ID NO: 1080792 - DNA, 14 bp, Homo sapiens
gcctgctccttggc

SEQ ID NO: 1080793 - DNA, 15 bp, Homo sapiens
gcctgctgaggcctt

SEQ ID NO: 1080794 - DNA, 17 bp, Homo sapiens
gcctgctgaggccttct

SEQ ID NO: 1080795 - DNA, 18 bp, Homo sapiens
gcctgctgaggccttctc

SEQ ID NO: 1080796 - DNA, 21 bp, Homo sapiens
gcctgctgaggccttctcttg

SEQ ID NO: 1080797 - DNA, 13 bp, Homo sapiens
gcctgctgcccag

SEQ ID NO: 1080798 - DNA, 17 bp, Homo sapiens
gcctgctggaagcccag

SEQ ID NO: 1080799 - DNA, 18 bp, Homo sapiens
gcctgctggaggcctcag

SEQ ID NO: 1080800 - DNA, 17 bp, Homo sapiens
gcctgctggcacccacc

SEQ ID NO: 1080801 - DNA, 14 bp, Homo sapiens
gcctgctggcaggg

SEQ ID NO: 1080802 - DNA, 16 bp, Homo sapiens
gcctgctggcagggcc

SEQ ID NO: 1080803 - DNA, 17 bp, Homo sapiens
gcctgctggcagggcca

SEQ ID NO: 1080804 - DNA, 20 bp, Homo sapiens
gcctgctggcagggccaggg

SEQ ID NO: 1080805 - DNA, 21 bp, Homo sapiens
gcctgctggcagggccagggc

SEQ ID NO: 1080806 - DNA, 22 bp, Homo sapiens
gcctgctggcagggccagggca

SEQ ID NO: 1080807 - DNA, 12 bp, Homo sapiens
gcctgctggctg

SEQ ID NO: 1080808 - DNA, 13 bp, Homo sapiens
gcctgctggctgc

SEQ ID NO: 1080809 - DNA, 19 bp, Homo sapiens
gcctgctggctgcggcccc

SEQ ID NO: 1080810 - DNA, 21 bp, Homo sapiens
gcctgctggctgcggccccct

SEQ ID NO: 1080811 - DNA, 17 bp, Homo sapiens
gcctgctgggctctcca

SEQ ID NO: 1080812 - DNA, 20 bp, Homo sapiens
gcctgctgggctctccacct

SEQ ID NO: 1080813 - DNA, 20 bp, Homo sapiens
gcctgctgttggtcctctct

SEQ ID NO: 1080814 - DNA, 20 bp, Homo sapiens
gcctgcttccccttcctaag

SEQ ID NO: 1080815 - DNA, 15 bp, Homo sapiens
gcctgctttggcctt

SEQ ID NO: 1080816 - DNA, 16 bp, Homo sapiens
gcctgctttggccttt

SEQ ID NO: 1080817 - DNA, 17 bp, Homo sapiens
gcctgctttggcctttc

SEQ ID NO: 1080818 - DNA, 18 bp, Homo sapiens
gcctgcttttccaggatc

SEQ ID NO: 1080819 - DNA, 23 bp, Homo sapiens
gcctgcttttccaggatcctgca

SEQ ID NO: 1080820 - DNA, 12 bp, Homo sapiens
gcctggaaccag

SEQ ID NO: 1080821 - DNA, 21 bp, Homo sapiens
gcctggaactggctgtgaaga

SEQ ID NO: 1080822 - DNA, 20 bp, Homo sapiens
gcctggacatttgccttgct

SEQ ID NO: 1080823 - DNA, 18 bp, Homo sapiens
gcctggaccgagatgtga

SEQ ID NO: 1080824 - DNA, 20 bp, Homo sapiens
gcctggaccgagatgtgagt

SEQ ID NO: 1080825 - DNA, 16 bp, Homo sapiens
gcctggacctatgcag

SEQ ID NO: 1080826 - DNA, 23 bp, Homo sapiens
gcctggacctatgcagggaggcc

SEQ ID NO: 1080827 - DNA, 15 bp, Homo sapiens
gcctggacctgcctc

SEQ ID NO: 1080828 - DNA, 16 bp, Homo sapiens
gcctggacctgcctcc

SEQ ID NO: 1080829 - DNA, 17 bp, Homo sapiens
gcctggacctgcctcct

SEQ ID NO: 1080830 - DNA, 15 bp, Homo sapiens
gcctggacgggccct

SEQ ID NO: 1080831 - DNA, 23 bp, Homo sapiens
gcctggacgggccctccttccct

SEQ ID NO: 1080832 - DNA, 19 bp, Homo sapiens
gcctggactctaagctgga

SEQ ID NO: 1080833 - DNA, 20 bp, Homo sapiens
gcctggactctgccccacgc

SEQ ID NO: 1080834 - DNA, 14 bp, Homo sapiens
gcctggactttcct

SEQ ID NO: 1080835 - DNA, 21 bp, Homo sapiens
gcctggagaggacggccctgc

SEQ ID NO: 1080836 - DNA, 23 bp, Homo sapiens
gcctggagaggacggccctgcct

SEQ ID NO: 1080837 - DNA, 17 bp, Homo sapiens
gcctggagaggcctggg

SEQ ID NO: 1080838 - DNA, 17 bp, Homo sapiens
gcctggagatcctcctg

SEQ ID NO: 1080839 - DNA, 19 bp, Homo sapiens
gcctggaggctcagcccac

SEQ ID NO: 1080840 - DNA, 14 bp, Homo sapiens
gcctggagggcact

SEQ ID NO: 1080841 - DNA, 20 bp, Homo sapiens
gcctggagggtaactggggg

SEQ ID NO: 1080842 - DNA, 22 bp, Homo sapiens
gcctggagggtaactggggggc

SEQ ID NO: 1080843 - DNA, 15 bp, Homo sapiens
gcctggagtgtcgga

SEQ ID NO: 1080844 - DNA, 19 bp, Homo sapiens
gcctggagttgactgactg

SEQ ID NO: 1080845 - DNA, 12 bp, Homo sapiens
gcctggatctcc

SEQ ID NO: 1080846 - DNA, 15 bp, Homo sapiens
gcctgggttgggggc

SEQ ID NO: 1080847 - DNA, 22 bp, Homo sapiens
gcctggtactctggcaaatgat

SEQ ID NO: 1080848 - DNA, 21 bp, Homo sapiens
gcctggtagaattgggaagct

SEQ ID NO: 1080849 - DNA, 14 bp, Homo sapiens
gcctggtattttca

SEQ ID NO: 1080850 - DNA, 13 bp, Homo sapiens
gcctggtccatgc

SEQ ID NO: 1080851 - DNA, 14 bp, Homo sapiens
gcctggtccctggg

SEQ ID NO: 1080852 - DNA, 20 bp, Homo sapiens
gcctggtgcccagcacatgt

SEQ ID NO: 1080853 - DNA, 15 bp, Homo sapiens
gcctggtgggcctcc

SEQ ID NO: 1080854 - DNA, 16 bp, Homo sapiens
gcctggtgggtcaggg

SEQ ID NO: 1080855 - DNA, 19 bp, Homo sapiens
gcctgtaacaagccagatt

SEQ ID NO: 1080856 - DNA, 21 bp, Homo sapiens
gcctgtaatcccagcactttg

SEQ ID NO: 1080857 - DNA, 19 bp, Homo sapiens
gcctgtaatcccagctact

SEQ ID NO: 1080858 - DNA, 15 bp, Homo sapiens
gcctgtaatcctagc

SEQ ID NO: 1080859 - DNA, 19 bp, Homo sapiens
gcctgtaatctttttctcc

SEQ ID NO: 1080860 - DNA, 20 bp, Homo sapiens
gcctgtaatctttttctcca

SEQ ID NO: 1080861 - DNA, 13 bp, Homo sapiens
gcctgtagagttg

SEQ ID NO: 1080862 - DNA, 22 bp, Homo sapiens
gcctgtagcaatggccagagcc

SEQ ID NO: 1080863 - DNA, 20 bp, Homo sapiens
gcctgtagccccagtgacag

SEQ ID NO: 1080864 - DNA, 13 bp, Homo sapiens
gcctgtcacaata

SEQ ID NO: 1080865 - DNA, 15 bp, Homo sapiens
gcctgtcaccagacc

SEQ ID NO: 1080866 - DNA, 20 bp, Homo sapiens
gcctgtccacctgtgctgct

SEQ ID NO: 1080867 - DNA, 21 bp, Homo sapiens
gcctgtccacctgtgctgctg

SEQ ID NO: 1080868 - DNA, 13 bp, Homo sapiens
gcctgtcccagga

SEQ ID NO: 1080869 - DNA, 23 bp, Homo sapiens
gcctgtcccaggactcaccctcc

SEQ ID NO: 1080870 - DNA, 21 bp, Homo sapiens
gcctgtcccatggacactcca

SEQ ID NO: 1080871 - DNA, 12 bp, Homo sapiens
gcctgtccccag

SEQ ID NO: 1080872 - DNA, 13 bp, Homo sapiens
gcctgtccccaga

SEQ ID NO: 1080873 - DNA, 23 bp, Homo sapiens
gcctgtccccagaccaaccctgg

SEQ ID NO: 1080874 - DNA, 16 bp, Homo sapiens
gcctgtcccccaaggt

SEQ ID NO: 1080875 - DNA, 13 bp, Homo sapiens
gcctgtccccgcc

SEQ ID NO: 1080876 - DNA, 19 bp, Homo sapiens
gcctgtccccgccttccct

SEQ ID NO: 1080877 - DNA, 18 bp, Homo sapiens
gcctgtccctctcaggca

SEQ ID NO: 1080878 - DNA, 17 bp, Homo sapiens
gcctgtcctcctggaag

SEQ ID NO: 1080879 - DNA, 12 bp, Homo sapiens
gcctgtcctggt

SEQ ID NO: 1080880 - DNA, 16 bp, Homo sapiens
gcctgtcctggtacag

SEQ ID NO: 1080881 - DNA, 19 bp, Homo sapiens
gcctgtctcatccccaggg

SEQ ID NO: 1080882 - DNA, 17 bp, Homo sapiens
gcctgtctccctaggga

SEQ ID NO: 1080883 - DNA, 23 bp, Homo sapiens
gcctgtctcccttcttgggtagg

SEQ ID NO: 1080884 - DNA, 23 bp, Homo sapiens
gcctgtctcgggctgaccctttt

SEQ ID NO: 1080885 - DNA, 21 bp, Homo sapiens
gcctgtctctgttcagatgtg

SEQ ID NO: 1080886 - DNA, 16 bp, Homo sapiens
gcctgtctggctcagg

SEQ ID NO: 1080887 - DNA, 12 bp, Homo sapiens
gcctgtctgtct

SEQ ID NO: 1080888 - DNA, 17 bp, Homo sapiens
gcctgtcttaattttct

SEQ ID NO: 1080889 - DNA, 11 bp, Homo sapiens
gcctgtgaatc

SEQ ID NO: 1080890 - DNA, 16 bp, Homo sapiens
gcctgtgaccttggga

SEQ ID NO: 1080891 - DNA, 14 bp, Homo sapiens
gcctgtgaggcagg

SEQ ID NO: 1080892 - DNA, 17 bp, Homo sapiens
gcctgtgcagcagccca

SEQ ID NO: 1080893 - DNA, 18 bp, Homo sapiens
gcctgtgcagcagcccag

SEQ ID NO: 1080894 - DNA, 19 bp, Homo sapiens
gcctgtgcagcagcccagc

SEQ ID NO: 1080895 - DNA, 20 bp, Homo sapiens
gcctgtgcagcagcccagct

SEQ ID NO: 1080896 - DNA, 17 bp, Homo sapiens
gcctgtgccatgcccaa

SEQ ID NO: 1080897 - DNA, 21 bp, Homo sapiens
gcctgtgcccgcatgtgtgcc

SEQ ID NO: 1080898 - DNA, 14 bp, Homo sapiens
gcctgtgccttcct

SEQ ID NO: 1080899 - DNA, 13 bp, Homo sapiens
gcctgtgctgtga

SEQ ID NO: 1080900 - DNA, 14 bp, Homo sapiens
gcctgtgctgtgac

SEQ ID NO: 1080901 - DNA, 16 bp, Homo sapiens
gcctgtggaatgagtg

SEQ ID NO: 1080902 - DNA, 22 bp, Homo sapiens
gcctgtggacggggaggctctc

SEQ ID NO: 1080903 - DNA, 13 bp, Homo sapiens
gccttctcctccc

SEQ ID NO: 1080904 - DNA, 20 bp, Homo sapiens
gccttctcctctctgggcct

SEQ ID NO: 1080905 - DNA, 21 bp, Homo sapiens
gccttctcctctctgggcctt

SEQ ID NO: 1080906 - DNA, 16 bp, Homo sapiens
gccttctgatgaaatg

SEQ ID NO: 1080907 - DNA, 22 bp, Homo sapiens
gccttctgccaacgcctcctgt

SEQ ID NO: 1080908 - DNA, 14 bp, Homo sapiens
gccttctggagctg

SEQ ID NO: 1080909 - DNA, 14 bp, Homo sapiens
gccttctggccttg

SEQ ID NO: 1080910 - DNA, 13 bp, Homo sapiens
gccttctgggctt

SEQ ID NO: 1080911 - DNA, 17 bp, Homo sapiens
gccttctggtttcttcc

SEQ ID NO: 1080912 - DNA, 23 bp, Homo sapiens
gccttctggtttcttccagccac

SEQ ID NO: 1080913 - DNA, 13 bp, Homo sapiens
gccttctgtgggg

SEQ ID NO: 1080914 - DNA, 17 bp, Homo sapiens
gccttctgtggggctgg

SEQ ID NO: 1080915 - DNA, 21 bp, Homo sapiens
gccttctgtggggctgggcac

SEQ ID NO: 1080916 - DNA, 22 bp, Homo sapiens
gccttctgtggggctgggcacc

SEQ ID NO: 1080917 - DNA, 17 bp, Homo sapiens
gccttcttcacccagct

SEQ ID NO: 1080918 - DNA, 22 bp, Homo sapiens
gccttcttcggggaactcctgg

SEQ ID NO: 1080919 - DNA, 15 bp, Homo sapiens
gccttctttttctgg

SEQ ID NO: 1080920 - DNA, 16 bp, Homo sapiens
gccttctttttctgga

SEQ ID NO: 1080921 - DNA, 18 bp, Homo sapiens
gccttgaaccacttccct

SEQ ID NO: 1080922 - DNA, 17 bp, Homo sapiens
gccttgaagacagagca

SEQ ID NO: 1080923 - DNA, 16 bp, Homo sapiens
gccttgacatcagttc

SEQ ID NO: 1080924 - DNA, 17 bp, Homo sapiens
gccttgcacacccactg

SEQ ID NO: 1080925 - DNA, 18 bp, Homo sapiens
gccttgcacggctgctcg

SEQ ID NO: 1080926 - DNA, 17 bp, Homo sapiens
gccttgcagaactgcca

SEQ ID NO: 1080927 - DNA, 20 bp, Homo sapiens
gccttgcagaactgccatta

SEQ ID NO: 1080928 - DNA, 19 bp, Homo sapiens
gccttgcatgtacttgaag

SEQ ID NO: 1080929 - DNA, 12 bp, Homo sapiens
gccttgcccaga

SEQ ID NO: 1080930 - DNA, 16 bp, Homo sapiens
gccttgcccagagatg

SEQ ID NO: 1080931 - DNA, 17 bp, Homo sapiens
gccttgcccgccagcct

SEQ ID NO: 1080932 - DNA, 20 bp, Homo sapiens
gccttgccgctccccttgga

SEQ ID NO: 1080933 - DNA, 21 bp, Homo sapiens
gccttgccgctccccttggac

SEQ ID NO: 1080934 - DNA, 15 bp, Homo sapiens
gccttgcctggcctg

SEQ ID NO: 1080935 - DNA, 15 bp, Homo sapiens
gccttgcgctgtccc

SEQ ID NO: 1080936 - DNA, 17 bp, Homo sapiens
gccttgcgctgtcccag

SEQ ID NO: 1080937 - DNA, 19 bp, Homo sapiens
gccttgcgctgtcccaggc

SEQ ID NO: 1080938 - DNA, 23 bp, Homo sapiens
gccttgctcactcactcactcca

SEQ ID NO: 1080939 - DNA, 13 bp, Homo sapiens
gccttgctcattc

SEQ ID NO: 1080940 - DNA, 21 bp, Homo sapiens
gccttgctcctagcagacaga

SEQ ID NO: 1080941 - DNA, 17 bp, Homo sapiens
gccttgctgactctctg

SEQ ID NO: 1080942 - DNA, 22 bp, Homo sapiens
gccttgctgatggcttgacatg

SEQ ID NO: 1080943 - DNA, 14 bp, Homo sapiens
gccttgctggacgg

SEQ ID NO: 1080944 - DNA, 16 bp, Homo sapiens
gccttgctgggccagg

SEQ ID NO: 1080945 - DNA, 14 bp, Homo sapiens
gccttgctggggtc

SEQ ID NO: 1080946 - DNA, 22 bp, Homo sapiens
gccttgctggggtccagggctg

SEQ ID NO: 1080947 - DNA, 19 bp, Homo sapiens
gccttgctgtttgtcctga

SEQ ID NO: 1080948 - DNA, 22 bp, Homo sapiens
gccttgctgtttgtcctgagat

SEQ ID NO: 1080949 - DNA, 16 bp, Homo sapiens
gccttgcttctcttct

SEQ ID NO: 1080950 - DNA, 13 bp, Homo sapiens
gccttgcttgtta

SEQ ID NO: 1080951 - DNA, 19 bp, Homo sapiens
gccttggaaatagaaagaa

SEQ ID NO: 1080952 - DNA, 17 bp, Homo sapiens
gccttggaaccagcccc

SEQ ID NO: 1080953 - DNA, 23 bp, Homo sapiens
gccttggcatgggcgcaggccca

SEQ ID NO: 1080954 - DNA, 24 bp, Homo sapiens
gccttggcatgggcgcaggcccag

SEQ ID NO: 1080955 - DNA, 12 bp, Homo sapiens
gccttggcctcc

SEQ ID NO: 1080956 - DNA, 14 bp, Homo sapiens
gccttggctcagac

SEQ ID NO: 1080957 - DNA, 12 bp, Homo sapiens
gcgagcctgtgc

SEQ ID NO: 1080958 - DNA, 19 bp, Homo sapiens
gcgaggagatgctccttgg

SEQ ID NO: 1080959 - DNA, 17 bp, Homo sapiens
gcgaggccggagagctg

SEQ ID NO: 1080960 - DNA, 19 bp, Homo sapiens
gcgaggccggagagctggt

SEQ ID NO: 1080961 - DNA, 12 bp, Homo sapiens
gcgagggcagct

SEQ ID NO: 1080962 - DNA, 18 bp, Homo sapiens
gcgaggggccagcagagg

SEQ ID NO: 1080963 - DNA, 17 bp, Homo sapiens
gcgaggtcaacagagaa

SEQ ID NO: 1080964 - DNA, 17 bp, Homo sapiens
gcgaggtcagaggaggg

SEQ ID NO: 1080965 - DNA, 15 bp, Homo sapiens
gcgagtcaccctcct

SEQ ID NO: 1080966 - DNA, 14 bp, Homo sapiens
gcgagtccaaggcc

SEQ ID NO: 1080967 - DNA, 14 bp, Homo sapiens
gcgagtcccctgcc

SEQ ID NO: 1080968 - DNA, 15 bp, Homo sapiens
gcgagtgccaggact

SEQ ID NO: 1080969 - DNA, 21 bp, Homo sapiens
gcgagtgccaggactccccag

SEQ ID NO: 1080970 - DNA, 22 bp, Homo sapiens
gcgagtgccaggactccccagg

SEQ ID NO: 1080971 - DNA, 22 bp, Homo sapiens
gcgagtgtgagagtgtgagcag

SEQ ID NO: 1080972 - DNA, 23 bp, Homo sapiens
gcgagtgtgctgtatggcccagg

SEQ ID NO: 1080973 - DNA, 17 bp, Homo sapiens
gcgagttgtggaaagcc

SEQ ID NO: 1080974 - DNA, 23 bp, Homo sapiens
gcgatcatttatttcatgattca

SEQ ID NO: 1080975 - DNA, 15 bp, Homo sapiens
gcgatccaggggaag

SEQ ID NO: 1080976 - DNA, 20 bp, Homo sapiens
gcgatcccacacaggctggc

SEQ ID NO: 1080977 - DNA, 16 bp, Homo sapiens
gcgatctctcctggcc

SEQ ID NO: 1080978 - DNA, 19 bp, Homo sapiens
gcgatgaatttggagactc

SEQ ID NO: 1080979 - DNA, 15 bp, Homo sapiens
gcgatggcaggcctg

SEQ ID NO: 1080980 - DNA, 19 bp, Homo sapiens
gcgatggcaggcctgaccc

SEQ ID NO: 1080981 - DNA, 20 bp, Homo sapiens
gcgatggcaggcctgaccca

SEQ ID NO: 1080982 - DNA, 23 bp, Homo sapiens
gcgatgtttcaggaggctggagg

SEQ ID NO: 1080983 - DNA, 14 bp, Homo sapiens
gcgattccctctca

SEQ ID NO: 1080984 - DNA, 14 bp, Homo sapiens
gcgcaaaggtgcct

SEQ ID NO: 1080985 - DNA, 13 bp, Homo sapiens
gcgcaagcctgta

SEQ ID NO: 1080986 - DNA, 23 bp, Homo sapiens
gcgcaagcctgtaatcccagcta

SEQ ID NO: 1080987 - DNA, 21 bp, Homo sapiens
gcgcaatctcggctcactgca

SEQ ID NO: 1080988 - DNA, 20 bp, Homo sapiens
gcgcacgcgcgagtgtgctg

SEQ ID NO: 1080989 - DNA, 22 bp, Homo sapiens
gcgcacttaccgccctgcgggc

SEQ ID NO: 1080990 - DNA, 23 bp, Homo sapiens
gcgcacttaccgccctgcgggcc

SEQ ID NO: 1080991 - DNA, 20 bp, Homo sapiens
gcgcagaggtcccagcccca

SEQ ID NO: 1080992 - DNA, 20 bp, Homo sapiens
gcgcagatctgtgcctggga

SEQ ID NO: 1080993 - DNA, 22 bp, Homo sapiens
gcgcagccgccgggcaggcctg

SEQ ID NO: 1080994 - DNA, 16 bp, Homo sapiens
gcgcaggcagcgcagg

SEQ ID NO: 1080995 - DNA, 17 bp, Homo sapiens
gcgcaggcagcgcaggg

SEQ ID NO: 1080996 - DNA, 18 bp, Homo sapiens
gcgcaggcagcgcagggc

SEQ ID NO: 1080997 - DNA, 17 bp, Homo sapiens
gcgcaggcagggagaag

SEQ ID NO: 1080998 - DNA, 13 bp, Homo sapiens
gcgcaggcccagt

SEQ ID NO: 1080999 - DNA, 15 bp, Homo sapiens
gcgcaggcccagtga

SEQ ID NO: 1081000 - DNA, 18 bp, Homo sapiens
gcgcagggacatggggca

SEQ ID NO: 1081001 - DNA, 22 bp, Homo sapiens
gcgcagggacatggggcaagcc

SEQ ID NO: 1081002 - DNA, 11 bp, Homo sapiens
gcgcatctaac

SEQ ID NO: 1081003 - DNA, 19 bp, Homo sapiens
gcgcatgagtatctgtggg

SEQ ID NO: 1081004 - DNA, 14 bp, Homo sapiens
gcgcatgtctgcac

SEQ ID NO: 1081005 - DNA, 21 bp, Homo sapiens
gcgccaaaacaagccaaagag

SEQ ID NO: 1081006 - DNA, 14 bp, Homo sapiens
gcgccaccatcctg

SEQ ID NO: 1081007 - DNA, 14 bp, Homo sapiens
gcgccaccatgccc

SEQ ID NO: 1081008 - DNA, 24 bp, Homo sapiens
gcgccactacactccagcctgagc

SEQ ID NO: 1081009 - DNA, 18 bp, Homo sapiens
gcgccactgctccgtgga

SEQ ID NO: 1081010 - DNA, 19 bp, Homo sapiens
gcgccactgctccgtggag

SEQ ID NO: 1081011 - DNA, 22 bp, Homo sapiens
gcgccactgtgctccagcctgg

SEQ ID NO: 1081012 - DNA, 14 bp, Homo sapiens
gcgccaggaagcca

SEQ ID NO: 1081013 - DNA, 16 bp, Homo sapiens
gcgccaggaagccaga

SEQ ID NO: 1081014 - DNA, 17 bp, Homo sapiens
gcgccaggaagccagag

SEQ ID NO: 1081015 - DNA, 18 bp, Homo sapiens
gcgccaggaagccagagc

SEQ ID NO: 1081016 - DNA, 12 bp, Homo sapiens
gcgccaggacag

SEQ ID NO: 1081017 - DNA, 21 bp, Homo sapiens
gcgccaggatggaacacggcc

SEQ ID NO: 1081018 - DNA, 13 bp, Homo sapiens
gcgccaggcagag

SEQ ID NO: 1081019 - DNA, 15 bp, Homo sapiens
gcgccaggcagagct

SEQ ID NO: 1081020 - DNA, 23 bp, Homo sapiens
gcgccaggcagagctgagggccc

SEQ ID NO: 1081021 - DNA, 15 bp, Homo sapiens
gcgccaggctggaga

SEQ ID NO: 1081022 - DNA, 16 bp, Homo sapiens
gcgccaggctggagat

SEQ ID NO: 1081023 - DNA, 13 bp, Homo sapiens
gcgccagggccca

SEQ ID NO: 1081024 - DNA, 14 bp, Homo sapiens
gcgccagggcccag

SEQ ID NO: 1081025 - DNA, 19 bp, Homo sapiens
gcgcccagagctggcctcc

SEQ ID NO: 1081026 - DNA, 17 bp, Homo sapiens
gcgcccagcgctcgcca

SEQ ID NO: 1081027 - DNA, 17 bp, Homo sapiens
gcgcccagtccttccac

SEQ ID NO: 1081028 - DNA, 19 bp, Homo sapiens
gcgccccaccgccgtggag

SEQ ID NO: 1081029 - DNA, 22 bp, Homo sapiens
gcgcccccgagccctgactcct

SEQ ID NO: 1081030 - DNA, 18 bp, Homo sapiens
gcgcccctgcctgtgccc

SEQ ID NO: 1081031 - DNA, 13 bp, Homo sapiens
gcgcccctgggag

SEQ ID NO: 1081032 - DNA, 13 bp, Homo sapiens
gcgccccttcccc

SEQ ID NO: 1081033 - DNA, 17 bp, Homo sapiens
gcgcccgcggcgcgacc

SEQ ID NO: 1081034 - DNA, 13 bp, Homo sapiens
gcgcccgctgggc

SEQ ID NO: 1081035 - DNA, 21 bp, Homo sapiens
gcgccctcactattcttggac

SEQ ID NO: 1081036 - DNA, 18 bp, Homo sapiens
gcgccctccctccgcctc

SEQ ID NO: 1081037 - DNA, 18 bp, Homo sapiens
gcgccctccgacctctct

SEQ ID NO: 1081038 - DNA, 22 bp, Homo sapiens
gcgcccttaactgcatccagcc

SEQ ID NO: 1081039 - DNA, 19 bp, Homo sapiens
gcgcccttgaggggcccca

SEQ ID NO: 1081040 - DNA, 21 bp, Homo sapiens
gcgcccttgaggggccccagc

SEQ ID NO: 1081041 - DNA, 16 bp, Homo sapiens
gcgcccttggcttctg

SEQ ID NO: 1081042 - DNA, 20 bp, Homo sapiens
gcgcccttggcttctgtgat

SEQ ID NO: 1081043 - DNA, 15 bp, Homo sapiens
gcgccgagaccgcag

SEQ ID NO: 1081044 - DNA, 13 bp, Homo sapiens
gcgccgatgccac

SEQ ID NO: 1081045 - DNA, 14 bp, Homo sapiens
gcgccgatgccacc

SEQ ID NO: 1081046 - DNA, 18 bp, Homo sapiens
gcgccgatgccaccggcc

SEQ ID NO: 1081047 - DNA, 21 bp, Homo sapiens
gcgccgcaaaccacactggac

SEQ ID NO: 1081048 - DNA, 16 bp, Homo sapiens
gcgccggtccggcgcc

SEQ ID NO: 1081049 - DNA, 13 bp, Homo sapiens
gcgccgtctccag

SEQ ID NO: 1081050 - DNA, 15 bp, Homo sapiens
gcgccgtctccaggg

SEQ ID NO: 1081051 - DNA, 14 bp, Homo sapiens
gcgccgtgctgggc

SEQ ID NO: 1081052 - DNA, 15 bp, Homo sapiens
gcgccgtgctgggca

SEQ ID NO: 1081053 - DNA, 16 bp, Homo sapiens
gcgccgtgctgggcag

SEQ ID NO: 1081054 - DNA, 14 bp, Homo sapiens
gcgcctcagccctc

SEQ ID NO: 1081055 - DNA, 15 bp, Homo sapiens
gcgcctcagccctca

SEQ ID NO: 1081056 - DNA, 20 bp, Homo sapiens
gcgcctcagttacacaggaa

SEQ ID NO: 1081057 - DNA, 13 bp, Homo sapiens
gcgcctccagagg

SEQ ID NO: 1081058 - DNA, 19 bp, Homo sapiens
gcgcctccatccaaggcca

SEQ ID NO: 1081059 - DNA, 12 bp, Homo sapiens
gcgcctccctcc

SEQ ID NO: 1081060 - DNA, 17 bp, Homo sapiens
gcgcctccctccacccc

SEQ ID NO: 1081061 - DNA, 20 bp, Homo sapiens
gcgcctcttcctctgggcag

SEQ ID NO: 1081062 - DNA, 23 bp, Homo sapiens
gcgcctcttcctctgggcagcgc

SEQ ID NO: 1081063 - DNA, 14 bp, Homo sapiens
gcgcctgcaggcag

SEQ ID NO: 1081064 - DNA, 17 bp, Homo sapiens
gcgcctgctgcctgctg

SEQ ID NO: 1081065 - DNA, 14 bp, Homo sapiens
gcgcctggctgctg

SEQ ID NO: 1081066 - DNA, 15 bp, Homo sapiens
gcgcctggctgctgc

SEQ ID NO: 1081067 - DNA, 12 bp, Homo sapiens
gcgcctgtgacc

SEQ ID NO: 1081068 - DNA, 14 bp, Homo sapiens
gcgcctttcccaac

SEQ ID NO: 1081069 - DNA, 20 bp, Homo sapiens
gcgccttttcagccctttgc

SEQ ID NO: 1081070 - DNA, 20 bp, Homo sapiens
gcgcgcaggcagggagaagg

SEQ ID NO: 1081071 - DNA, 16 bp, Homo sapiens
gctgcacaaagtcagc

SEQ ID NO: 1081072 - DNA, 21 bp, Homo sapiens
gctgcacaaagtcagcaggga

SEQ ID NO: 1081073 - DNA, 16 bp, Homo sapiens
gctgcacacagacggc

SEQ ID NO: 1081074 - DNA, 22 bp, Homo sapiens
gctgcacacagacggcctaggg

SEQ ID NO: 1081075 - DNA, 12 bp, Homo sapiens
gctgcacagcag

SEQ ID NO: 1081076 - DNA, 17 bp, Homo sapiens
gctgcacagcaggacct

SEQ ID NO: 1081077 - DNA, 12 bp, Homo sapiens
gctgcacaggct

SEQ ID NO: 1081078 - DNA, 17 bp, Homo sapiens
gctgcacatgtgccaca

SEQ ID NO: 1081079 - DNA, 14 bp, Homo sapiens
gctgcacattcctg

SEQ ID NO: 1081080 - DNA, 17 bp, Homo sapiens
gctgcacattcctggcc

SEQ ID NO: 1081081 - DNA, 20 bp, Homo sapiens
gctgcacattcctggccccg

SEQ ID NO: 1081082 - DNA, 22 bp, Homo sapiens
gctgcacattgcctgttctgct

SEQ ID NO: 1081083 - DNA, 22 bp, Homo sapiens
gctgcaccaacctcactgccct

SEQ ID NO: 1081084 - DNA, 14 bp, Homo sapiens
gctgcaccagagca

SEQ ID NO: 1081085 - DNA, 17 bp, Homo sapiens
gctgcaccagagcaacc

SEQ ID NO: 1081086 - DNA, 22 bp, Homo sapiens
gctgcaccagagcaacctctca

SEQ ID NO: 1081087 - DNA, 20 bp, Homo sapiens
gctgcaccccagcgtcaggc

SEQ ID NO: 1081088 - DNA, 16 bp, Homo sapiens
gctgcacccctgggcc

SEQ ID NO: 1081089 - DNA, 17 bp, Homo sapiens
gctgcacccctgggcca

SEQ ID NO: 1081090 - DNA, 13 bp, Homo sapiens
gctgcaccctcag

SEQ ID NO: 1081091 - DNA, 19 bp, Homo sapiens
gctgcaccctcaggcaggt

SEQ ID NO: 1081092 - DNA, 21 bp, Homo sapiens
gctgcaccctgcgcctccaga

SEQ ID NO: 1081093 - DNA, 23 bp, Homo sapiens
gctgcaccctgcgcctccagagg

SEQ ID NO: 1081094 - DNA, 20 bp, Homo sapiens
gctgcacctcctaccctccc

SEQ ID NO: 1081095 - DNA, 12 bp, Homo sapiens
gctgcacctgcc

SEQ ID NO: 1081096 - DNA, 18 bp, Homo sapiens
gctgcacctgccagcctg

SEQ ID NO: 1081097 - DNA, 21 bp, Homo sapiens
gctgcacctgccagcctggct

SEQ ID NO: 1081098 - DNA, 18 bp, Homo sapiens
gctgcccctcgcacacag

SEQ ID NO: 1081099 - DNA, 22 bp, Homo sapiens
gctgcccctcgcacacagggct

SEQ ID NO: 1081100 - DNA, 24 bp, Homo sapiens
gctgcccctcgcacacagggctca

SEQ ID NO: 1081101 - DNA, 15 bp, Homo sapiens
gctgcccctctcacc

SEQ ID NO: 1081102 - DNA, 13 bp, Homo sapiens
gctgcccctgtct

SEQ ID NO: 1081103 - DNA, 15 bp, Homo sapiens
gctgcccctgtctgg

SEQ ID NO: 1081104 - DNA, 18 bp, Homo sapiens
gctgcccctgtctggaag

SEQ ID NO: 1081105 - DNA, 19 bp, Homo sapiens
gctgcccctgtctggaaga

SEQ ID NO: 1081106 - DNA, 19 bp, Homo sapiens
gctgcccggcgcctgccct

SEQ ID NO: 1081107 - DNA, 15 bp, Homo sapiens
gctgcccggggtggg

SEQ ID NO: 1081108 - DNA, 23 bp, Homo sapiens
gctgcccggttgccatggagatc

SEQ ID NO: 1081109 - DNA, 18 bp, Homo sapiens
gctgccctagctgacccc

SEQ ID NO: 1081110 - DNA, 19 bp, Homo sapiens
gctgccctcttaagatctg

SEQ ID NO: 1081111 - DNA, 14 bp, Homo sapiens
gctgccctgaagaa

SEQ ID NO: 1081112 - DNA, 14 bp, Homo sapiens
gctgccctgagggg

SEQ ID NO: 1081113 - DNA, 15 bp, Homo sapiens
gctgccctgaggggc

SEQ ID NO: 1081114 - DNA, 17 bp, Homo sapiens
gctgccctgaggggctg

SEQ ID NO: 1081115 - DNA, 23 bp, Homo sapiens
gctgccctgaggggctggggagg

SEQ ID NO: 1081116 - DNA, 18 bp, Homo sapiens
gctgccctgcatgctgcc

SEQ ID NO: 1081117 - DNA, 14 bp, Homo sapiens
gctgccctgctgcc

SEQ ID NO: 1081118 - DNA, 15 bp, Homo sapiens
gctgccctgctgcca

SEQ ID NO: 1081119 - DNA, 15 bp, Homo sapiens
gctgccctggccctg

SEQ ID NO: 1081120 - DNA, 13 bp, Homo sapiens
gctgccctggtgc

SEQ ID NO: 1081121 - DNA, 20 bp, Homo sapiens
gctgccctggtgctgccaca

SEQ ID NO: 1081122 - DNA, 23 bp, Homo sapiens
gctgccctggtgctgccacactt

SEQ ID NO: 1081123 - DNA, 22 bp, Homo sapiens
gctgctctgcaggctggggagg

SEQ ID NO: 1081124 - DNA, 23 bp, Homo sapiens
gctgctctgcaggctggggaggt

SEQ ID NO: 1081125 - DNA, 15 bp, Homo sapiens
gctgctgaagatgaa

SEQ ID NO: 1081126 - DNA, 15 bp, Homo sapiens
gctgctgaaggctca

SEQ ID NO: 1081127 - DNA, 19 bp, Homo sapiens
gctgctgaagttctgagcc

SEQ ID NO: 1081128 - DNA, 20 bp, Homo sapiens
gctgctgaagttctgagccg

SEQ ID NO: 1081129 - DNA, 22 bp, Homo sapiens
gctgctgaccaattgtgctgcc

SEQ ID NO: 1081130 - DNA, 16 bp, Homo sapiens
gctgctgactgatgtt

SEQ ID NO: 1081131 - DNA, 14 bp, Homo sapiens
gctgctgcaccaac

SEQ ID NO: 1081132 - DNA, 17 bp, Homo sapiens
gctgctgcctggccact

SEQ ID NO: 1081133 - DNA, 15 bp, Homo sapiens
gctgctgctaccagc

SEQ ID NO: 1081134 - DNA, 14 bp, Homo sapiens
gctgctgctattgc

SEQ ID NO: 1081135 - DNA, 13 bp, Homo sapiens
gctgctgctgccc

SEQ ID NO: 1081136 - DNA, 15 bp, Homo sapiens
gctgctgctgcccca

SEQ ID NO: 1081137 - DNA, 12 bp, Homo sapiens
gctgctgctgct

SEQ ID NO: 1081138 - DNA, 15 bp, Homo sapiens
gctgctgcttctgct

SEQ ID NO: 1081139 - DNA, 21 bp, Homo sapiens
gctgctgcttctgctccagcc

SEQ ID NO: 1081140 - DNA, 22 bp, Homo sapiens
gctgctgcttctgctccagccc

SEQ ID NO: 1081141 - DNA, 16 bp, Homo sapiens
gctgctggagtgcagt

SEQ ID NO: 1081142 - DNA, 23 bp, Homo sapiens
gctgctggagtgcagtggcacaa

SEQ ID NO: 1081143 - DNA, 19 bp, Homo sapiens
gctggatcacagctgcttt

SEQ ID NO: 1081144 - DNA, 20 bp, Homo sapiens
gctggatgagaatttgagtg

SEQ ID NO: 1081145 - DNA, 20 bp, Homo sapiens
gctggatggcacctcaggct

SEQ ID NO: 1081146 - DNA, 16 bp, Homo sapiens
gctggattacaggcat

SEQ ID NO: 1081147 - DNA, 21 bp, Homo sapiens
gctggcaaaccctcccagaaa

SEQ ID NO: 1081148 - DNA, 19 bp, Homo sapiens
gctggcaacacagaggcag

SEQ ID NO: 1081149 - DNA, 15 bp, Homo sapiens
gctggcaagcaggga

SEQ ID NO: 1081150 - DNA, 16 bp, Homo sapiens
gctggcaagcagggaa

SEQ ID NO: 1081151 - DNA, 20 bp, Homo sapiens
gctggcaccatggtgactgc

SEQ ID NO: 1081152 - DNA, 18 bp, Homo sapiens
gctggcaccgccttctct

SEQ ID NO: 1081153 - DNA, 18 bp, Homo sapiens
gctggcacgtgacaggct

SEQ ID NO: 1081154 - DNA, 23 bp, Homo sapiens
gctggcagaaagggaacagaaag

SEQ ID NO: 1081155 - DNA, 16 bp, Homo sapiens
gctggcagctgagagc

SEQ ID NO: 1081156 - DNA, 20 bp, Homo sapiens
gctggcagctgagagccctg

SEQ ID NO: 1081157 - DNA, 14 bp, Homo sapiens
gctgggagcctggt

SEQ ID NO: 1081158 - DNA, 23 bp, Homo sapiens
gctgggagcctggttcagacaca

SEQ ID NO: 1081159 - DNA, 21 bp, Homo sapiens
gctgggagctccactctgctt

SEQ ID NO: 1081160 - DNA, 14 bp, Homo sapiens
gctgggaggaaggg

SEQ ID NO: 1081161 - DNA, 18 bp, Homo sapiens
gctgggaggagggagagg

SEQ ID NO: 1081162 - DNA, 22 bp, Homo sapiens
gctgggaggagggagagggagg

SEQ ID NO: 1081163 - DNA, 21 bp, Homo sapiens
gctgggaggtataggggtcct

SEQ ID NO: 1081164 - DNA, 18 bp, Homo sapiens
gctgggagtagttgtctt

SEQ ID NO: 1081165 - DNA, 18 bp, Homo sapiens
gctggtagcagcaggctc

SEQ ID NO: 1081166 - DNA, 20 bp, Homo sapiens
gctggtagcagcaggctcag

SEQ ID NO: 1081167 - DNA, 22 bp, Homo sapiens
gctggtagcataaataaaactg

SEQ ID NO: 1081168 - DNA, 18 bp, Homo sapiens
gctggtagctgaggggac

SEQ ID NO: 1081169 - DNA, 13 bp, Homo sapiens
gctggtagttagt

SEQ ID NO: 1081170 - DNA, 16 bp, Homo sapiens
gctggtattctctcta

SEQ ID NO: 1081171 - DNA, 14 bp, Homo sapiens
gctggtatttctaa

SEQ ID NO: 1081172 - DNA, 23 bp, Homo sapiens
gctggtcactaaccaacaaggtt

SEQ ID NO: 1081173 - DNA, 17 bp, Homo sapiens
gctggtcactctgccct

SEQ ID NO: 1081174 - DNA, 20 bp, Homo sapiens
gctggtcagtctttgctcag

SEQ ID NO: 1081175 - DNA, 21 bp, Homo sapiens
gctggtcatccttggtgctct

SEQ ID NO: 1081176 - DNA, 14 bp, Homo sapiens
gctggtccagggct

SEQ ID NO: 1081177 - DNA, 12 bp, Homo sapiens
gctggtccttat

SEQ ID NO: 1081178 - DNA, 16 bp, Homo sapiens
gctggtccttatttat

SEQ ID NO: 1081179 - DNA, 20 bp, Homo sapiens
gctggtctattttgattttg

SEQ ID NO: 1081180 - DNA, 22 bp, Homo sapiens
gctggtctcaaacttgtggcct

SEQ ID NO: 1081181 - DNA, 17 bp, Homo sapiens
gctggtctgccaggggc

SEQ ID NO: 1081182 - DNA, 19 bp, Homo sapiens
gctggtctggagtcccacc

SEQ ID NO: 1081183 - DNA, 21 bp, Homo sapiens
gctggtcttcactttcctcag

SEQ ID NO: 1081184 - DNA, 13 bp, Homo sapiens
gctggtcttttct

SEQ ID NO: 1081185 - DNA, 21 bp, Homo sapiens
gctggtgaacactgtgaccag

SEQ ID NO: 1081186 - DNA, 24 bp, Homo sapiens
gctggtgaacactgtgaccaggct

SEQ ID NO: 1081187 - DNA, 13 bp, Homo sapiens
gctggtgactttg

SEQ ID NO: 1081188 - DNA, 23 bp, Homo sapiens
gctggtgccaaatagccccagac

SEQ ID NO: 1081189 - DNA, 13 bp, Homo sapiens
gctggtgccagcc

SEQ ID NO: 1081190 - DNA, 22 bp, Homo sapiens
gctggtgccagccttcctctgc

SEQ ID NO: 1081191 - DNA, 23 bp, Homo sapiens
gctggtgccagccttcctctgca

SEQ ID NO: 1081192 - DNA, 15 bp, Homo sapiens
gctggtgcccatgaa

SEQ ID NO: 1081193 - DNA, 16 bp, Homo sapiens
gctggtgccccacagc

SEQ ID NO: 1081194 - DNA, 18 bp, Homo sapiens
gctggtgcggatggacac

SEQ ID NO: 1081195 - DNA, 19 bp, Homo sapiens
gctggtgctgtggccaggg

SEQ ID NO: 1081196 - DNA, 15 bp, Homo sapiens
gctggtggcccagga

SEQ ID NO: 1081197 - DNA, 20 bp, Homo sapiens
gctggtggccctgtgcctgg

SEQ ID NO: 1081198 - DNA, 13 bp, Homo sapiens
gctggtggccttg

SEQ ID NO: 1081199 - DNA, 14 bp, Homo sapiens
gctggtggctggtg

SEQ ID NO: 1081200 - DNA, 21 bp, Homo sapiens
gctggtgggaagcgtctgtcc

SEQ ID NO: 1081201 - DNA, 20 bp, Homo sapiens
gctggtgggtctgagctgga

SEQ ID NO: 1081202 - DNA, 17 bp, Homo sapiens
gctggtggttgtgcctt

SEQ ID NO: 1081203 - DNA, 18 bp, Homo sapiens
gctggtggttgtgccttt

SEQ ID NO: 1081204 - DNA, 15 bp, Homo sapiens
gctggtggtttgatc

SEQ ID NO: 1081205 - DNA, 21 bp, Homo sapiens
gctggtggtttgatcatttct

SEQ ID NO: 1081206 - DNA, 21 bp, Homo sapiens
gctggtggttttcagagcagg

SEQ ID NO: 1081207 - DNA, 22 bp, Homo sapiens
gctggtggttttcagagcagga

SEQ ID NO: 1081208 - DNA, 16 bp, Homo sapiens
gctggtgtcagcccct

SEQ ID NO: 1081209 - DNA, 18 bp, Homo sapiens
gctggtgtcagcccctct

SEQ ID NO: 1081210 - DNA, 13 bp, Homo sapiens
gctggtgtcccct

SEQ ID NO: 1081211 - DNA, 21 bp, Homo sapiens
gctggtgtccccttcccctgc

SEQ ID NO: 1081212 - DNA, 23 bp, Homo sapiens
gctggtgtccccttcccctgctg

SEQ ID NO: 1081213 - DNA, 16 bp, Homo sapiens
gctggtgtcctgacca

SEQ ID NO: 1081214 - DNA, 22 bp, Homo sapiens
gctggtgtcctgaccaccctcc

SEQ ID NO: 1081215 - DNA, 14 bp, Homo sapiens
gctggttagaaatg

SEQ ID NO: 1081216 - DNA, 23 bp, Homo sapiens
gctggttttcctaaatgcagtga

SEQ ID NO: 1081217 - DNA, 15 bp, Homo sapiens
gctggtttttcagtt

SEQ ID NO: 1081218 - DNA, 14 bp, Homo sapiens
gctgtaaaatcttg

SEQ ID NO: 1081219 - DNA, 20 bp, Homo sapiens
gctgtaaaatgcatgatttt

SEQ ID NO: 1081220 - DNA, 18 bp, Homo sapiens
gctgtaaaatttgtgtaa

SEQ ID NO: 1081221 - DNA, 14 bp, Homo sapiens
gctgtaaataaatg

SEQ ID NO: 1081222 - DNA, 15 bp, Homo sapiens
gctgtaaataaatgc

SEQ ID NO: 1081223 - DNA, 18 bp, Homo sapiens
gctgtaacgtggcactgg

SEQ ID NO: 1081224 - DNA, 21 bp, Homo sapiens
gctgtaactactttataacta

SEQ ID NO: 1081225 - DNA, 18 bp, Homo sapiens
gctgtaactgagagaaag

SEQ ID NO: 1081226 - DNA, 19 bp, Homo sapiens
gctgtaactgctgagccac

SEQ ID NO: 1081227 - DNA, 21 bp, Homo sapiens
gctgtaactgctgagccactc

SEQ ID NO: 1081228 - DNA, 22 bp, Homo sapiens
gctgtaactgctgagccactcg

SEQ ID NO: 1081229 - DNA, 24 bp, Homo sapiens
gctgtaagaagagactgggaagat

SEQ ID NO: 1081230 - DNA, 13 bp, Homo sapiens
gctgtaagcattc

SEQ ID NO: 1081231 - DNA, 18 bp, Homo sapiens
gctgtaaggcatgaagga

SEQ ID NO: 1081232 - DNA, 15 bp, Homo sapiens
gctgtaatattgtaa

SEQ ID NO: 1081233 - DNA, 15 bp, Homo sapiens
gctgtaatcatttgt

SEQ ID NO: 1081234 - DNA, 21 bp, Homo sapiens
gctgtaatgaaacaccttctc

SEQ ID NO: 1081235 - DNA, 12 bp, Homo sapiens
gctgtaatgttt

SEQ ID NO: 1081236 - DNA, 21 bp, Homo sapiens
gctgtaatttcgccttaaact

SEQ ID NO: 1081237 - DNA, 20 bp, Homo sapiens
gctgtacatctattttggat

SEQ ID NO: 1081238 - DNA, 15 bp, Homo sapiens
gctgtaccacatctg

SEQ ID NO: 1081239 - DNA, 14 bp, Homo sapiens
gctgtacccttcca

SEQ ID NO: 1081240 - DNA, 18 bp, Homo sapiens
gctgtacctgttcctccc

SEQ ID NO: 1081241 - DNA, 15 bp, Homo sapiens
gctgtactcagagca

SEQ ID NO: 1081242 - DNA, 16 bp, Homo sapiens
gctgtactcagagcag

SEQ ID NO: 1081243 - DNA, 17 bp, Homo sapiens
gctgtactcagagcaga

SEQ ID NO: 1081244 - DNA, 20 bp, Homo sapiens
gctgtactcagagcagagca

SEQ ID NO: 1081245 - DNA, 22 bp, Homo sapiens
gctgtactcttgctgatggctg

SEQ ID NO: 1081246 - DNA, 17 bp, Homo sapiens
gctgtactgctcaggct

SEQ ID NO: 1081247 - DNA, 20 bp, Homo sapiens
gctgtacttcgtcttctaat

SEQ ID NO: 1081248 - DNA, 18 bp, Homo sapiens
gctgtacttcttgaatat

SEQ ID NO: 1081249 - DNA, 13 bp, Homo sapiens
gctgtagaaaaaa

SEQ ID NO: 1081250 - DNA, 18 bp, Homo sapiens
gctgtagacatctgtcct

SEQ ID NO: 1081251 - DNA, 20 bp, Homo sapiens
gctgtagatggtgacctggg

SEQ ID NO: 1081252 - DNA, 14 bp, Homo sapiens
gctgtagccatggc

SEQ ID NO: 1081253 - DNA, 22 bp, Homo sapiens
gctgtagccatggctcaggcaa

SEQ ID NO: 1081254 - DNA, 15 bp, Homo sapiens
gctgtagctcccgag

SEQ ID NO: 1081255 - DNA, 13 bp, Homo sapiens
gctgtatctgtaa

SEQ ID NO: 1081256 - DNA, 14 bp, Homo sapiens
gctgtatcttgttt

SEQ ID NO: 1081257 - DNA, 12 bp, Homo sapiens
gctgtatgattt

SEQ ID NO: 1081258 - DNA, 20 bp, Homo sapiens
gctgtatggcccaggcagcc

SEQ ID NO: 1081259 - DNA, 21 bp, Homo sapiens
gctgtatggcccaggcagcct

SEQ ID NO: 1081260 - DNA, 13 bp, Homo sapiens
gctgtattcttct

SEQ ID NO: 1081261 - DNA, 12 bp, Homo sapiens
gctgtattgtct

SEQ ID NO: 1081262 - DNA, 14 bp, Homo sapiens
gctgtatttgctgt

SEQ ID NO: 1081263 - DNA, 17 bp, Homo sapiens
gctgtattttaacactt

SEQ ID NO: 1081264 - DNA, 20 bp, Homo sapiens
gctgtattttaacactttgt

SEQ ID NO: 1081265 - DNA, 23 bp, Homo sapiens
gctgtattttaacactttgtatt

SEQ ID NO: 1081266 - DNA, 20 bp, Homo sapiens
gctgtcaaaacaagtttttc

SEQ ID NO: 1081267 - DNA, 17 bp, Homo sapiens
gctgtcacaaccaagaa

SEQ ID NO: 1081268 - DNA, 16 bp, Homo sapiens
gctgtcaccaaggaaa

SEQ ID NO: 1081269 - DNA, 17 bp, Homo sapiens
gctgtcaccaaggaaac

SEQ ID NO: 1081270 - DNA, 22 bp, Homo sapiens
gctgtcacctgctcacagggat

SEQ ID NO: 1081271 - DNA, 12 bp, Homo sapiens
gctgtcactggc

SEQ ID NO: 1081272 - DNA, 14 bp, Homo sapiens
gctgtcactggcag

SEQ ID NO: 1081273 - DNA, 15 bp, Homo sapiens
gctgtcactggcaga

SEQ ID NO: 1081274 - DNA, 18 bp, Homo sapiens
gctgtcactggcagagca

SEQ ID NO: 1081275 - DNA, 19 bp, Homo sapiens
gctgtcactggcagagcac

SEQ ID NO: 1081276 - DNA, 22 bp, Homo sapiens
gctgtcatctgtgcactgccca

SEQ ID NO: 1081277 - DNA, 15 bp, Homo sapiens
gctgtccaaccagac

SEQ ID NO: 1081278 - DNA, 20 bp, Homo sapiens
gctgtccacatgacctccat

SEQ ID NO: 1081279 - DNA, 18 bp, Homo sapiens
gctgtccagaaaggtttg

SEQ ID NO: 1081280 - DNA, 21 bp, Homo sapiens
gctgtccaggcagctccctcc

SEQ ID NO: 1081281 - DNA, 13 bp, Homo sapiens
gctgtcccaggca

SEQ ID NO: 1081282 - DNA, 22 bp, Homo sapiens
gctgtcccaggcatgcagctgc

SEQ ID NO: 1081283 - DNA, 16 bp, Homo sapiens
gctgtcccctctgtca

SEQ ID NO: 1081284 - DNA, 15 bp, Homo sapiens
gctgtccctgcactg

SEQ ID NO: 1081285 - DNA, 18 bp, Homo sapiens
gctgtccctgcactgtgc

SEQ ID NO: 1081286 - DNA, 14 bp, Homo sapiens
gctgtccctgtcac

SEQ ID NO: 1081287 - DNA, 14 bp, Homo sapiens
gctgtcctaggcca

SEQ ID NO: 1081288 - DNA, 13 bp, Homo sapiens
gctgtcctcaggt

SEQ ID NO: 1081289 - DNA, 13 bp, Homo sapiens
gctgttctcagga

SEQ ID NO: 1081290 - DNA, 16 bp, Homo sapiens
gctgttctcaggacag

SEQ ID NO: 1081291 - DNA, 18 bp, Homo sapiens
gctgttctcgaactcctg

SEQ ID NO: 1081292 - DNA, 19 bp, Homo sapiens
gctgttctcgaactcctga

SEQ ID NO: 1081293 - DNA, 16 bp, Homo sapiens
gctgttcttgaagctg

SEQ ID NO: 1081294 - DNA, 16 bp, Homo sapiens
gctgttgaatcaaagt

SEQ ID NO: 1081295 - DNA, 14 bp, Homo sapiens
gctgttgccatagc

SEQ ID NO: 1081296 - DNA, 13 bp, Homo sapiens
gctgttgcctcat

SEQ ID NO: 1081297 - DNA, 15 bp, Homo sapiens
gctgttgcctcatct

SEQ ID NO: 1081298 - DNA, 14 bp, Homo sapiens
gctgttgctaggga

SEQ ID NO: 1081299 - DNA, 18 bp, Homo sapiens
gctgttgctagggagagg

SEQ ID NO: 1081300 - DNA, 18 bp, Homo sapiens
gctgttgggtttttgctg

SEQ ID NO: 1081301 - DNA, 19 bp, Homo sapiens
gctgttggtcctctctctg

SEQ ID NO: 1081302 - DNA, 15 bp, Homo sapiens
gctgttggtggcagt

SEQ ID NO: 1081303 - DNA, 17 bp, Homo sapiens
gctgttgtccctctgct

SEQ ID NO: 1081304 - DNA, 18 bp, Homo sapiens
gctgttgtccctctgcta

SEQ ID NO: 1081305 - DNA, 15 bp, Homo sapiens
gctgttgtgagcttt

SEQ ID NO: 1081306 - DNA, 19 bp, Homo sapiens
gctgttgtgagctttgaag

SEQ ID NO: 1081307 - DNA, 17 bp, Homo sapiens
gctgtttaaagtcacat

SEQ ID NO: 1081308 - DNA, 23 bp, Homo sapiens
gctgtttaaagtcacatccctgt

SEQ ID NO: 1081309 - DNA, 15 bp, Homo sapiens
gctgtttactaggga

SEQ ID NO: 1081310 - DNA, 20 bp, Homo sapiens
gctgtttactcccttctgta

SEQ ID NO: 1081311 - DNA, 21 bp, Homo sapiens
gctgtttactcccttctgtag

SEQ ID NO: 1081312 - DNA, 15 bp, Homo sapiens
gctgtttactgcttt

SEQ ID NO: 1081313 - DNA, 15 bp, Homo sapiens
gctgtttatggcctc

SEQ ID NO: 1081314 - DNA, 16 bp, Homo sapiens
gctgtttattaatctt

SEQ ID NO: 1081315 - DNA, 14 bp, Homo sapiens
gctgtttcaaatgt

SEQ ID NO: 1081316 - DNA, 15 bp, Homo sapiens
gctgtttctcatgaa

SEQ ID NO: 1081317 - DNA, 16 bp, Homo sapiens
gctgtttctcatgaag

SEQ ID NO: 1081318 - DNA, 19 bp, Homo sapiens
gctgtttctcatgaagcta

SEQ ID NO: 1081319 - DNA, 12 bp, Homo sapiens
gctgtttgtcat

SEQ ID NO: 1081320 - DNA, 15 bp, Homo sapiens
gctgttttagctgag

SEQ ID NO: 1081321 - DNA, 17 bp, Homo sapiens
gctgttttccctgacct

SEQ ID NO: 1081322 - DNA, 16 bp, Homo sapiens
gctgttttcctccctt

SEQ ID NO: 1081323 - DNA, 19 bp, Homo sapiens
gctgttttgttatataatt

SEQ ID NO: 1081324 - DNA, 20 bp, Homo sapiens
gcttaaaaaaattactgtga

SEQ ID NO: 1081325 - DNA, 13 bp, Homo sapiens
gcttaaaagacat

SEQ ID NO: 1081326 - DNA, 17 bp, Homo sapiens
gcttaaaataagcaggt

SEQ ID NO: 1081327 - DNA, 18 bp, Homo sapiens
gcttaaaatacaagactg

SEQ ID NO: 1081328 - DNA, 16 bp, Homo sapiens
gcttaaaatatgtatg

SEQ ID NO: 1081329 - DNA, 20 bp, Homo sapiens
gcttaaaatatgtgaagttt

SEQ ID NO: 1081330 - DNA, 23 bp, Homo sapiens
gcttaaaatatgtgaagttttcc

SEQ ID NO: 1081331 - DNA, 11 bp, Homo sapiens
gcttaaacaaa

SEQ ID NO: 1081332 - DNA, 13 bp, Homo sapiens
gcttaaacaaagt

SEQ ID NO: 1081333 - DNA, 14 bp, Homo sapiens
gcttaaacaaagtg

SEQ ID NO: 1081334 - DNA, 20 bp, Homo sapiens
gcttaaacccatacaatgta

SEQ ID NO: 1081335 - DNA, 21 bp, Homo sapiens
gcttaaacccatacaatgtat

SEQ ID NO: 1081336 - DNA, 23 bp, Homo sapiens
gcttaaacccatacaatgtatgt

SEQ ID NO: 1081337 - DNA, 16 bp, Homo sapiens
gcttaaactaaataat

SEQ ID NO: 1081338 - DNA, 20 bp, Homo sapiens
gcttaaacttgacccaggtg

SEQ ID NO: 1081339 - DNA, 21 bp, Homo sapiens
gcttaaagttggtattaataa

SEQ ID NO: 1081340 - DNA, 22 bp, Homo sapiens
gcttaaattgcttttgttgtga

SEQ ID NO: 1081341 - DNA, 15 bp, Homo sapiens
gcttaaatttcttat

SEQ ID NO: 1081342 - DNA, 21 bp, Homo sapiens
gcttaaatttcttatgtgaca

SEQ ID NO: 1081343 - DNA, 13 bp, Homo sapiens
gcttaaattttaa

SEQ ID NO: 1081344 - DNA, 21 bp, Homo sapiens
gcttaacattagatgtcatga

SEQ ID NO: 1081345 - DNA, 14 bp, Homo sapiens
gcttaacttcacat

SEQ ID NO: 1081346 - DNA, 17 bp, Homo sapiens
gcttaacttcacatatt

SEQ ID NO: 1081347 - DNA, 16 bp, Homo sapiens
gcttaagcagaagcat

SEQ ID NO: 1081348 - DNA, 15 bp, Homo sapiens
gcttaagccactgcc

SEQ ID NO: 1081349 - DNA, 20 bp, Homo sapiens
gcttaaggcctaaggaagcc

SEQ ID NO: 1081350 - DNA, 12 bp, Homo sapiens
gcttaataccaa

SEQ ID NO: 1081351 - DNA, 17 bp, Homo sapiens
gcttaatcagatagata

SEQ ID NO: 1081352 - DNA, 16 bp, Homo sapiens
gcttaatcattttcat

SEQ ID NO: 1081353 - DNA, 22 bp, Homo sapiens
gcttaatcctaccccctcttca

SEQ ID NO: 1081354 - DNA, 23 bp, Homo sapiens
gcttaatgtttattcctgataat

SEQ ID NO: 1081355 - DNA, 18 bp, Homo sapiens
gcttaatttccttctgtt

SEQ ID NO: 1081356 - DNA, 23 bp, Homo sapiens
gcttaatttccttctgttaagaa

SEQ ID NO: 1081357 - DNA, 19 bp, Homo sapiens
gcttacaagccagctggag

SEQ ID NO: 1081358 - DNA, 14 bp, Homo sapiens
gcttacaattccct

SEQ ID NO: 1081359 - DNA, 20 bp, Homo sapiens
gcttacaattccctgctgtc

SEQ ID NO: 1081360 - DNA, 17 bp, Homo sapiens
gcttacagtaactaatt

SEQ ID NO: 1081361 - DNA, 21 bp, Homo sapiens
gcttacctgacctcttgctgt

SEQ ID NO: 1081362 - DNA, 22 bp, Homo sapiens
gcttacctgacctcttgctgtc

SEQ ID NO: 1081363 - DNA, 15 bp, Homo sapiens
gcttaccttttccta

SEQ ID NO: 1081364 - DNA, 14 bp, Homo sapiens
gcttactcattaaa

SEQ ID NO: 1081365 - DNA, 12 bp, Homo sapiens
gcttactcctct

SEQ ID NO: 1081366 - DNA, 13 bp, Homo sapiens
gcttactcttgct

SEQ ID NO: 1081367 - DNA, 21 bp, Homo sapiens
gcttactgatatattttacaa

SEQ ID NO: 1081368 - DNA, 23 bp, Homo sapiens
gcttactgtttttgataaagtaa

SEQ ID NO: 1081369 - DNA, 15 bp, Homo sapiens
gcttactttttatat

SEQ ID NO: 1081370 - DNA, 19 bp, Homo sapiens
gcttagaacgttaaactat

SEQ ID NO: 1081371 - DNA, 13 bp, Homo sapiens
gcttagacctcag

SEQ ID NO: 1081372 - DNA, 18 bp, Homo sapiens
gcttagacctcagcctgt

SEQ ID NO: 1081373 - DNA, 23 bp, Homo sapiens
gcttagacctcagcctgtgctgc

SEQ ID NO: 1081374 - DNA, 16 bp, Homo sapiens
gcttagagaggacaat

SEQ ID NO: 1081375 - DNA, 14 bp, Homo sapiens
gcttagagtgccca

SEQ ID NO: 1081376 - DNA, 15 bp, Homo sapiens
gcttagagtgcccag

SEQ ID NO: 1081377 - DNA, 18 bp, Homo sapiens
gcttagagtgcccagcag

SEQ ID NO: 1081378 - DNA, 13 bp, Homo sapiens
gcttagatttcat

SEQ ID NO: 1081379 - DNA, 15 bp, Homo sapiens
gcttagatttcatag

SEQ ID NO: 1081380 - DNA, 18 bp, Homo sapiens
gcttagcaactgctgggg

SEQ ID NO: 1081381 - DNA, 13 bp, Homo sapiens
gcttagcctgcct

SEQ ID NO: 1081382 - DNA, 17 bp, Homo sapiens
gcttagcctgcctcacc

SEQ ID NO: 1081383 - DNA, 15 bp, Homo sapiens
gcttagcctgtgctg

SEQ ID NO: 1081384 - DNA, 12 bp, Homo sapiens
gcttagccttgt

SEQ ID NO: 1081385 - DNA, 13 bp, Homo sapiens
gcttagccttgtg

SEQ ID NO: 1081386 - DNA, 22 bp, Homo sapiens
gcttagcttatctttctttcca

SEQ ID NO: 1081387 - DNA, 23 bp, Homo sapiens
gcttagcttatctttctttccat

SEQ ID NO: 1081388 - DNA, 22 bp, Homo sapiens
gcttagggacaggaccccagct

SEQ ID NO: 1081389 - DNA, 23 bp, Homo sapiens
gcttagggacaggaccccagctc

SEQ ID NO: 1081390 - DNA, 12 bp, Homo sapiens
gcttagggccct

SEQ ID NO: 1081391 - DNA, 15 bp, Homo sapiens
gcttctccccccatc

SEQ ID NO: 1081392 - DNA, 19 bp, Homo sapiens
gcttctccccccatcccag

SEQ ID NO: 1081393 - DNA, 15 bp, Homo sapiens
gcttctcccggggac

SEQ ID NO: 1081394 - DNA, 14 bp, Homo sapiens
gcttctccgccagc

SEQ ID NO: 1081395 - DNA, 13 bp, Homo sapiens
gcttctcctgtga

SEQ ID NO: 1081396 - DNA, 20 bp, Homo sapiens
gcttctcggggtccagtgca

SEQ ID NO: 1081397 - DNA, 18 bp, Homo sapiens
gcttctctagctctctag

SEQ ID NO: 1081398 - DNA, 22 bp, Homo sapiens
gcttctctagctctctaggcct

SEQ ID NO: 1081399 - DNA, 14 bp, Homo sapiens
gcttctctcagcca

SEQ ID NO: 1081400 - DNA, 20 bp, Homo sapiens
gcttctctcagccagctgtt

SEQ ID NO: 1081401 - DNA, 13 bp, Homo sapiens
gcttctctccaca

SEQ ID NO: 1081402 - DNA, 17 bp, Homo sapiens
gcttctctccacagtgt

SEQ ID NO: 1081403 - DNA, 14 bp, Homo sapiens
gcttctctccttgc

SEQ ID NO: 1081404 - DNA, 13 bp, Homo sapiens
gcttctctctcca

SEQ ID NO: 1081405 - DNA, 15 bp, Homo sapiens
gcttctctctccagg

SEQ ID NO: 1081406 - DNA, 22 bp, Homo sapiens
gcttctctctccctgtcacaca

SEQ ID NO: 1081407 - DNA, 18 bp, Homo sapiens
gcttctctgacttctgcc

SEQ ID NO: 1081408 - DNA, 16 bp, Homo sapiens
gcttctctgcagtaaa

SEQ ID NO: 1081409 - DNA, 16 bp, Homo sapiens
gcttctcttctttcca

SEQ ID NO: 1081410 - DNA, 21 bp, Homo sapiens
gcttctctttgtgcagtgtta

SEQ ID NO: 1081411 - DNA, 13 bp, Homo sapiens
gcttctcttttcc

SEQ ID NO: 1081412 - DNA, 17 bp, Homo sapiens
gcttctcttttgaaagt

SEQ ID NO: 1081413 - DNA, 15 bp, Homo sapiens
gcttctgaagagcct

SEQ ID NO: 1081414 - DNA, 21 bp, Homo sapiens
gcttctgagtttatattctga

SEQ ID NO: 1081415 - DNA, 17 bp, Homo sapiens
gctttcctgccccaggc

SEQ ID NO: 1081416 - DNA, 12 bp, Homo sapiens
gctttcctgggc

SEQ ID NO: 1081417 - DNA, 23 bp, Homo sapiens
gctttccttttattttttaaatg

SEQ ID NO: 1081418 - DNA, 13 bp, Homo sapiens
gctttccttttct

SEQ ID NO: 1081419 - DNA, 22 bp, Homo sapiens
gctttcctttttcccaataaat

SEQ ID NO: 1081420 - DNA, 16 bp, Homo sapiens
gctttcggggagggcg

SEQ ID NO: 1081421 - DNA, 19 bp, Homo sapiens
gctttcgtgtaaattatgt

SEQ ID NO: 1081422 - DNA, 12 bp, Homo sapiens
gctttctcaatg

SEQ ID NO: 1081423 - DNA, 20 bp, Homo sapiens
gctttctcagaatgttggca

SEQ ID NO: 1081424 - DNA, 13 bp, Homo sapiens
gctttctccctca

SEQ ID NO: 1081425 - DNA, 18 bp, Homo sapiens
gctttctccggggtctgt

SEQ ID NO: 1081426 - DNA, 19 bp, Homo sapiens
gctttctcctttaattgta

SEQ ID NO: 1081427 - DNA, 11 bp, Homo sapiens
gctttctctcc

SEQ ID NO: 1081428 - DNA, 21 bp, Homo sapiens
gctttctctgcctctgggcag

SEQ ID NO: 1081429 - DNA, 21 bp, Homo sapiens
gctttctcttccccttcctgt

SEQ ID NO: 1081430 - DNA, 13 bp, Homo sapiens
gctttctgccacc

SEQ ID NO: 1081431 - DNA, 13 bp, Homo sapiens
gctttctgctcag

SEQ ID NO: 1081432 - DNA, 21 bp, Homo sapiens
gctttctgctcagcttctcct

SEQ ID NO: 1081433 - DNA, 21 bp, Homo sapiens
gctttctgggatgtcacagtc

SEQ ID NO: 1081434 - DNA, 22 bp, Homo sapiens
gctttctgttgtcattgctgtt

SEQ ID NO: 1081435 - DNA, 14 bp, Homo sapiens
gctttcttcctgca

SEQ ID NO: 1081436 - DNA, 19 bp, Homo sapiens
gctttctttagaattttta

SEQ ID NO: 1081437 - DNA, 21 bp, Homo sapiens
gctttctttcacaaaaaagaa

SEQ ID NO: 1081438 - DNA, 19 bp, Homo sapiens
gctttctttggcctacatt

SEQ ID NO: 1081439 - DNA, 23 bp, Homo sapiens
gctttctttggcctacattcttt

SEQ ID NO: 1081440 - DNA, 19 bp, Homo sapiens
gctttgactctataagcaa

SEQ ID NO: 1081441 - DNA, 20 bp, Homo sapiens
gctttgactctataagcaaa

SEQ ID NO: 1081442 - DNA, 14 bp, Homo sapiens
gctttgagaagcct

SEQ ID NO: 1081443 - DNA, 16 bp, Homo sapiens
gctttgagaagccttc

SEQ ID NO: 1081444 - DNA, 22 bp, Homo sapiens
gctttgagaagccttcagctcc

SEQ ID NO: 1081445 - DNA, 15 bp, Homo sapiens
gctttgagctacagg

SEQ ID NO: 1081446 - DNA, 12 bp, Homo sapiens
gctttgattcat

SEQ ID NO: 1081447 - DNA, 16 bp, Homo sapiens
gctttgcaggctctgg

SEQ ID NO: 1081448 - DNA, 12 bp, Homo sapiens
gctttgcagtga

SEQ ID NO: 1081449 - DNA, 19 bp, Homo sapiens
gctttgccaagttgctgtc

SEQ ID NO: 1081450 - DNA, 14 bp, Homo sapiens
gctttgccagagca

SEQ ID NO: 1081451 - DNA, 15 bp, Homo sapiens
gctttgccagctgct

SEQ ID NO: 1081452 - DNA, 18 bp, Homo sapiens
gctttgccagctgctgct

SEQ ID NO: 1081453 - DNA, 18 bp, Homo sapiens
gctttgcccacccctcac

SEQ ID NO: 1081454 - DNA, 22 bp, Homo sapiens
gctttgccctggagcagctatt

SEQ ID NO: 1081455 - DNA, 18 bp, Homo sapiens
gcttggacttcctggggc

SEQ ID NO: 1081456 - DNA, 22 bp, Homo sapiens
gcttggacttcctggggccccg

SEQ ID NO: 1081457 - DNA, 16 bp, Homo sapiens
gcttggagcagagggg

SEQ ID NO: 1081458 - DNA, 16 bp, Homo sapiens
gcttggagggatggag

SEQ ID NO: 1081459 - DNA, 15 bp, Homo sapiens
gcttggatctggggt

SEQ ID NO: 1081460 - DNA, 16 bp, Homo sapiens
gcttggatctggggtg

SEQ ID NO: 1081461 - DNA, 17 bp, Homo sapiens
gcttggattctctgaga

SEQ ID NO: 1081462 - DNA, 18 bp, Homo sapiens
gcttggcatgacctcatt

SEQ ID NO: 1081463 - DNA, 14 bp, Homo sapiens
gcttggcctgctgt

SEQ ID NO: 1081464 - DNA, 13 bp, Homo sapiens
gcttggcctggag

SEQ ID NO: 1081465 - DNA, 16 bp, Homo sapiens
gcttggcctggagagg

SEQ ID NO: 1081466 - DNA, 17 bp, Homo sapiens
gcttggctcttggcttc

SEQ ID NO: 1081467 - DNA, 21 bp, Homo sapiens
gcttggctcttggcttccaga

SEQ ID NO: 1081468 - DNA, 23 bp, Homo sapiens
gcttggctcttggcttccagaag

SEQ ID NO: 1081469 - DNA, 15 bp, Homo sapiens
gcttgggatttgctg

SEQ ID NO: 1081470 - DNA, 21 bp, Homo sapiens
gcttgggcagtgccccaggga

SEQ ID NO: 1081471 - DNA, 14 bp, Homo sapiens
gcttgggcccagct

SEQ ID NO: 1081472 - DNA, 16 bp, Homo sapiens
gcttgggcgccgtgct

SEQ ID NO: 1081473 - DNA, 14 bp, Homo sapiens
gcttgggctccacg

SEQ ID NO: 1081474 - DNA, 17 bp, Homo sapiens
gcttgggctgacccagc

SEQ ID NO: 1081475 - DNA, 18 bp, Homo sapiens
gcttgggctgacccagca

SEQ ID NO: 1081476 - DNA, 15 bp, Homo sapiens
gcttgggcttcttcc

SEQ ID NO: 1081477 - DNA, 20 bp, Homo sapiens
gcttggggtgtggggtgggg

SEQ ID NO: 1081478 - DNA, 19 bp, Homo sapiens
gcttgggtcaggttcttgc

SEQ ID NO: 1081479 - DNA, 20 bp, Homo sapiens
gcttgggtggtgggtgctgg

SEQ ID NO: 1081480 - DNA, 19 bp, Homo sapiens
gcttggtgcacagattgct

SEQ ID NO: 1081481 - DNA, 15 bp, Homo sapiens
gcttggttctgtgaa

SEQ ID NO: 1081482 - DNA, 13 bp, Homo sapiens
gcttggttggctg

SEQ ID NO: 1081483 - DNA, 16 bp, Homo sapiens
gcttgtaacaagaaaa

SEQ ID NO: 1081484 - DNA, 16 bp, Homo sapiens
gcttgtaactccacca

SEQ ID NO: 1081485 - DNA, 19 bp, Homo sapiens
gctttgcgtgcccggggca

SEQ ID NO: 1081486 - DNA, 13 bp, Homo sapiens
gctttgctacaaa

SEQ ID NO: 1081487 - DNA, 14 bp, Homo sapiens
gctttgctgctatg

SEQ ID NO: 1081488 - DNA, 18 bp, Homo sapiens
gctttgctgctgaaggct

SEQ ID NO: 1081489 - DNA, 12 bp, Homo sapiens
gctttggaaaca

SEQ ID NO: 1081490 - DNA, 14 bp, Homo sapiens
gctttggaagtttt

SEQ ID NO: 1081491 - DNA, 22 bp, Homo sapiens
gctttggaatattttatcctgt

SEQ ID NO: 1081492 - DNA, 17 bp, Homo sapiens
gctttggatttgacatt

SEQ ID NO: 1081493 - DNA, 12 bp, Homo sapiens
gctttggcccaa

SEQ ID NO: 1081494 - DNA, 16 bp, Homo sapiens
gctttggcccaatgcc

SEQ ID NO: 1081495 - DNA, 12 bp, Homo sapiens
gctttggccttt

SEQ ID NO: 1081496 - DNA, 22 bp, Homo sapiens
gctttgggaatgtttttagctg

SEQ ID NO: 1081497 - DNA, 19 bp, Homo sapiens
gctttgggaggccaaggca

SEQ ID NO: 1081498 - DNA, 21 bp, Homo sapiens
gctttgggaggccaaggcagg

SEQ ID NO: 1081499 - DNA, 21 bp, Homo sapiens
gctttggggaaaaagaatgat

SEQ ID NO: 1081500 - DNA, 21 bp, Homo sapiens
gctttggggtcctagcccagt

SEQ ID NO: 1081501 - DNA, 16 bp, Homo sapiens
gctttggtacccccaa

SEQ ID NO: 1081502 - DNA, 14 bp, Homo sapiens
gctttggtccccag

SEQ ID NO: 1081503 - DNA, 15 bp, Homo sapiens
gctttggttccttct

SEQ ID NO: 1081504 - DNA, 17 bp, Homo sapiens
gctttggttccttctct

SEQ ID NO: 1081505 - DNA, 18 bp, Homo sapiens
gctttggttccttctctg

SEQ ID NO: 1081506 - DNA, 13 bp, Homo sapiens
gctttgtcacttg

SEQ ID NO: 1081507 - DNA, 18 bp, Homo sapiens
gctttgtcacttgccaca

SEQ ID NO: 1081508 - DNA, 13 bp, Homo sapiens
gctttgtctctgt

SEQ ID NO: 1081509 - DNA, 15 bp, Homo sapiens
gctttgtgcatatgt

SEQ ID NO: 1081510 - DNA, 17 bp, Homo sapiens
gctttgtgcatatgtta

SEQ ID NO: 1081511 - DNA, 23 bp, Homo sapiens
gctttgtgcatatgttaaagctt

SEQ ID NO: 1081512 - DNA, 21 bp, Homo sapiens
gctttgtggttatcactttaa

SEQ ID NO: 1081513 - DNA, 15 bp, Homo sapiens
gctttgtgtttactt

SEQ ID NO: 1081514 - DNA, 21 bp, Homo sapiens
gctttgtttgttgtcagctga

SEQ ID NO: 1081515 - DNA, 22 bp, Homo sapiens
gctttgttttgggggtcaggca

SEQ ID NO: 1081516 - DNA, 14 bp, Homo sapiens
gcttttaagaaaaa

SEQ ID NO: 1081517 - DNA, 18 bp, Homo sapiens
gcttttaagaaaaacaaa

SEQ ID NO: 1081518 - DNA, 23 bp, Homo sapiens
gcttttaatgaatttaaggcaaa

SEQ ID NO: 1081519 - DNA, 15 bp, Homo sapiens
gcttttaattaaata

SEQ ID NO: 1081520 - DNA, 13 bp, Homo sapiens
gcttttactgttt

SEQ ID NO: 1081521 - DNA, 13 bp, Homo sapiens
gcttttagaaaag

SEQ ID NO: 1081522 - DNA, 17 bp, Homo sapiens
gcttttaggagaattca

SEQ ID NO: 1081523 - DNA, 19 bp, Homo sapiens
gcttttatagaggctagct

SEQ ID NO: 1081524 - DNA, 15 bp, Homo sapiens
gcttttattaaattt

SEQ ID NO: 1081525 - DNA, 15 bp, Homo sapiens
gcttttattaatgca

SEQ ID NO: 1081526 - DNA, 14 bp, Homo sapiens
gcttttattgcacc

SEQ ID NO: 1081527 - DNA, 15 bp, Homo sapiens
gcttttattgtataa

SEQ ID NO: 1081528 - DNA, 20 bp, Homo sapiens
gcttttattttttcttttgt

SEQ ID NO: 1081529 - DNA, 13 bp, Homo sapiens
gcttttcacccca

SEQ ID NO: 1081530 - DNA, 22 bp, Homo sapiens
gcttttcactgctggctgcctt

SEQ ID NO: 1081531 - DNA, 23 bp, Homo sapiens
gcttttcactgctggctgcctta

SEQ ID NO: 1081532 - DNA, 14 bp, Homo sapiens
gcttttcagccaat

SEQ ID NO: 1081533 - DNA, 22 bp, Homo sapiens
gcttttccccggtcccttgaga

SEQ ID NO: 1081534 - DNA, 14 bp, Homo sapiens
gcttttccctcttt

SEQ ID NO: 1081535 - DNA, 15 bp, Homo sapiens
gcttttccctctttt

SEQ ID NO: 1081536 - DNA, 22 bp, Homo sapiens
gcttttcctatttgttttcatg

SEQ ID NO: 1081537 - DNA, 17 bp, Homo sapiens
gcttttcctcaagcaat

SEQ ID NO: 1081538 - DNA, 14 bp, Homo sapiens
gcttttcctcaggg

SEQ ID NO: 1081539 - DNA, 15 bp, Homo sapiens
gcttttcctcccttg

SEQ ID NO: 1081540 - DNA, 20 bp, Homo sapiens
gcttttcctggacagctaga

SEQ ID NO: 1081541 - DNA, 17 bp, Homo sapiens
gcttttctgccactcca

SEQ ID NO: 1081542 - DNA, 21 bp, Homo sapiens
gcttttctgcctgctcctgct

SEQ ID NO: 1081543 - DNA, 12 bp, Homo sapiens
gcttttctgtcc

SEQ ID NO: 1081544 - DNA, 18 bp, Homo sapiens
gcttttgaaaatgtttat

SEQ ID NO: 1081545 - DNA, 13 bp, Homo sapiens
gcttttgaaatct

SEQ ID NO: 1081546 - DNA, 22 bp, Homo sapiens
gcttttgagtgggccctgcccg

SEQ ID NO: 1081547 - DNA, 15 bp, Homo sapiens
gcttttgatgatgtc

SEQ ID NO: 1081548 - DNA, 16 bp, Homo sapiens
gcttttgatgatgtct

SEQ ID NO: 1081549 - DNA, 22 bp, Homo sapiens
gcttttgccactttggcttctc

SEQ ID NO: 1081550 - DNA, 21 bp, Homo sapiens
gcttttgcccattttgaatca

SEQ ID NO: 1081551 - DNA, 17 bp, Homo sapiens
gcttttgcctctgccca

SEQ ID NO: 1081552 - DNA, 13 bp, Homo sapiens
gcttttgctagat

SEQ ID NO: 1081553 - DNA, 15 bp, Homo sapiens
gcttttgctagatgg

SEQ ID NO: 1081554 - DNA, 14 bp, Homo sapiens
gcttttgcttgcaa

SEQ ID NO: 1081555 - DNA, 18 bp, Homo sapiens
gcttttgttccaatgtca

SEQ ID NO: 1081556 - DNA, 16 bp, Homo sapiens
gcttttgttctgaggg

SEQ ID NO: 1081557 - DNA, 18 bp, Homo sapiens
gcttttgttgtgactttt

SEQ ID NO: 1081558 - DNA, 21 bp, Homo sapiens
gcttttgtttcctttttcaga

SEQ ID NO: 1081559 - DNA, 15 bp, Homo sapiens
gcttttgttttcata

SEQ ID NO: 1081560 - DNA, 13 bp, Homo sapiens
gcttttgtttttt

SEQ ID NO: 1081561 - DNA, 22 bp, Homo sapiens
gcttttgtttttttcctcatgt

SEQ ID NO: 1081562 - DNA, 13 bp, Homo sapiens
gctttttaaaata

SEQ ID NO: 1081563 - DNA, 15 bp, Homo sapiens
gctttttaatattga

SEQ ID NO: 1081564 - DNA, 13 bp, Homo sapiens
gctttttaattaa

SEQ ID NO: 1081565 - DNA, 14 bp, Homo sapiens
gctttttattccct

SEQ ID NO: 1081566 - DNA, 19 bp, Homo sapiens
gctttttattcctcctgct

SEQ ID NO: 1081567 - DNA, 16 bp, Homo sapiens
ggaagttgtctccttc

SEQ ID NO: 1081568 - DNA, 13 bp, Homo sapiens
ggaagtttagaga

SEQ ID NO: 1081569 - DNA, 18 bp, Homo sapiens
ggaagttttacagcaagg

SEQ ID NO: 1081570 - DNA, 11 bp, Homo sapiens
ggaagttttca

SEQ ID NO: 1081571 - DNA, 18 bp, Homo sapiens
ggaagttttgcatttatg

SEQ ID NO: 1081572 - DNA, 21 bp, Homo sapiens
ggaataaaatcctaagacaca

SEQ ID NO: 1081573 - DNA, 22 bp, Homo sapiens
ggaataaacagtgagcatatct

SEQ ID NO: 1081574 - DNA, 18 bp, Homo sapiens
ggaataacatgtaattaa

SEQ ID NO: 1081575 - DNA, 22 bp, Homo sapiens
ggaataaccttccatacatttt

SEQ ID NO: 1081576 - DNA, 13 bp, Homo sapiens
ggaataactatct

SEQ ID NO: 1081577 - DNA, 19 bp, Homo sapiens
ggaataaggtacaagaagc

SEQ ID NO: 1081578 - DNA, 15 bp, Homo sapiens
ggaataatagaagaa

SEQ ID NO: 1081579 - DNA, 13 bp, Homo sapiens
ggaataattattt

SEQ ID NO: 1081580 - DNA, 13 bp, Homo sapiens
ggaataatttgta

SEQ ID NO: 1081581 - DNA, 16 bp, Homo sapiens
ggaataatttgtaaat

SEQ ID NO: 1081582 - DNA, 18 bp, Homo sapiens
ggaataatttgtaaatga

SEQ ID NO: 1081583 - DNA, 19 bp, Homo sapiens
ggaataatttgtaaatgat

SEQ ID NO: 1081584 - DNA, 14 bp, Homo sapiens
ggaatacattttat

SEQ ID NO: 1081585 - DNA, 17 bp, Homo sapiens
ggaatacattttattct

SEQ ID NO: 1081586 - DNA, 18 bp, Homo sapiens
ggaatactatacagccat

SEQ ID NO: 1081587 - DNA, 15 bp, Homo sapiens
ggaatagccagagag

SEQ ID NO: 1081588 - DNA, 17 bp, Homo sapiens
ggaatagccagagagga

SEQ ID NO: 1081589 - DNA, 13 bp, Homo sapiens
ggaatagggagac

SEQ ID NO: 1081590 - DNA, 14 bp, Homo sapiens
ggaatagggagaca

SEQ ID NO: 1081591 - DNA, 16 bp, Homo sapiens
ggaatagggagacagg

SEQ ID NO: 1081592 - DNA, 14 bp, Homo sapiens
ggaatagtggacat

SEQ ID NO: 1081593 - DNA, 16 bp, Homo sapiens
ggaatagtggacatgg

SEQ ID NO: 1081594 - DNA, 16 bp, Homo sapiens
ggaatagttgagcccc

SEQ ID NO: 1081595 - DNA, 20 bp, Homo sapiens
ggaatagttgagccccaagt

SEQ ID NO: 1081596 - DNA, 14 bp, Homo sapiens
ggaatatcaatata

SEQ ID NO: 1081597 - DNA, 15 bp, Homo sapiens
ggaatattaaaaaac

SEQ ID NO: 1081598 - DNA, 22 bp, Homo sapiens
ggaatatttataggccagggca

SEQ ID NO: 1081599 - DNA, 13 bp, Homo sapiens
ggaatatttgaat

SEQ ID NO: 1081600 - DNA, 14 bp, Homo sapiens
ggaatatttgaata

SEQ ID NO: 1081601 - DNA, 19 bp, Homo sapiens
ggaatcatactgcctactg

SEQ ID NO: 1081602 - DNA, 22 bp, Homo sapiens
ggaatcattaatttcaaaattt

SEQ ID NO: 1081603 - DNA, 17 bp, Homo sapiens
ggaatcattccagtgct

SEQ ID NO: 1081604 - DNA, 19 bp, Homo sapiens
ggaatcgaggaaccagagc

SEQ ID NO: 1081605 - DNA, 20 bp, Homo sapiens
ggaatctgaaagtatatttt

SEQ ID NO: 1081606 - DNA, 15 bp, Homo sapiens
ggaatctgtttctct

SEQ ID NO: 1081607 - DNA, 21 bp, Homo sapiens
ggaatctgtttctctgctgtc

SEQ ID NO: 1081608 - DNA, 15 bp, Homo sapiens
ggaatcttcacctca

SEQ ID NO: 1081609 - DNA, 18 bp, Homo sapiens
ggaatcttccatctgcat

SEQ ID NO: 1081610 - DNA, 18 bp, Homo sapiens
ggaatgaaattcctcctt

SEQ ID NO: 1081611 - DNA, 14 bp, Homo sapiens
ggaatgactgggga

SEQ ID NO: 1081612 - DNA, 17 bp, Homo sapiens
ggaatgagcccagagaa

SEQ ID NO: 1081613 - DNA, 23 bp, Homo sapiens
ggaatgagccgcggggaagctgg

SEQ ID NO: 1081614 - DNA, 13 bp, Homo sapiens
ggaatgagggagg

SEQ ID NO: 1081615 - DNA, 20 bp, Homo sapiens
ggaatgagtcaatcagcctt

SEQ ID NO: 1081616 - DNA, 22 bp, Homo sapiens
ggaatgagtcaatcagccttta

SEQ ID NO: 1081617 - DNA, 18 bp, Homo sapiens
ggaatgatagcccagaac

SEQ ID NO: 1081618 - DNA, 22 bp, Homo sapiens
ggaatgattggttaaaatgtga

SEQ ID NO: 1081619 - DNA, 14 bp, Homo sapiens
ggaatgcacctccc

SEQ ID NO: 1081620 - DNA, 14 bp, Homo sapiens
ggaatgcagcagga

SEQ ID NO: 1081621 - DNA, 18 bp, Homo sapiens
ggaatgcagggaagaggg

SEQ ID NO: 1081622 - DNA, 20 bp, Homo sapiens
ggaatgcagggaagagggca

SEQ ID NO: 1081623 - DNA, 12 bp, Homo sapiens
ggaatgcctgga

SEQ ID NO: 1081624 - DNA, 13 bp, Homo sapiens
ggaatgcctggag

SEQ ID NO: 1081625 - DNA, 15 bp, Homo sapiens
ggaatgcctggaggg

SEQ ID NO: 1081626 - DNA, 22 bp, Homo sapiens
ggaatgcggccgcattccctga

SEQ ID NO: 1081627 - DNA, 23 bp, Homo sapiens
ggaatgctcccccatcctcccct

SEQ ID NO: 1081628 - DNA, 13 bp, Homo sapiens
ggaatgctgggcc

SEQ ID NO: 1081629 - DNA, 17 bp, Homo sapiens
ggaatggaactactgta

SEQ ID NO: 1081630 - DNA, 15 bp, Homo sapiens
ggaatggaaggcttt

SEQ ID NO: 1081631 - DNA, 19 bp, Homo sapiens
ggaatggaaggctttgcca

SEQ ID NO: 1081632 - DNA, 10 bp, Homo sapiens
ggaatggaat

SEQ ID NO: 1081633 - DNA, 12 bp, Homo sapiens
ggaatggaataa

SEQ ID NO: 1081634 - DNA, 16 bp, Homo sapiens
ggaatggaataactat

SEQ ID NO: 1081635 - DNA, 16 bp, Homo sapiens
ggaatggaggggcaga

SEQ ID NO: 1081636 - DNA, 19 bp, Homo sapiens
ggaatggatttttctttaa

SEQ ID NO: 1081637 - DNA, 20 bp, Homo sapiens
ggaatggatttttctttaac

SEQ ID NO: 1081638 - DNA, 14 bp, Homo sapiens
ggaatgggagacct

SEQ ID NO: 1081639 - DNA, 20 bp, Homo sapiens
ggaatggtaaccgagccagc

SEQ ID NO: 1081640 - DNA, 13 bp, Homo sapiens
ggacaactgcggt

SEQ ID NO: 1081641 - DNA, 22 bp, Homo sapiens
ggacaacttatttaaaaatatt

SEQ ID NO: 1081642 - DNA, 17 bp, Homo sapiens
ggacaagcaataactct

SEQ ID NO: 1081643 - DNA, 16 bp, Homo sapiens
ggacaagggaggcagt

SEQ ID NO: 1081644 - DNA, 15 bp, Homo sapiens
ggacaatatgtgcca

SEQ ID NO: 1081645 - DNA, 18 bp, Homo sapiens
ggacaatcagtcccctcc

SEQ ID NO: 1081646 - DNA, 22 bp, Homo sapiens
ggacaatcagtcccctcccatc

SEQ ID NO: 1081647 - DNA, 19 bp, Homo sapiens
ggacaatcatgaaatatgc

SEQ ID NO: 1081648 - DNA, 23 bp, Homo sapiens
ggacacaaaactccgcccccagc

SEQ ID NO: 1081649 - DNA, 16 bp, Homo sapiens
ggacacaatggcacct

SEQ ID NO: 1081650 - DNA, 13 bp, Homo sapiens
ggacacacactca

SEQ ID NO: 1081651 - DNA, 23 bp, Homo sapiens
ggacacacactcaccagtggcct

SEQ ID NO: 1081652 - DNA, 14 bp, Homo sapiens
ggacacacagccta

SEQ ID NO: 1081653 - DNA, 21 bp, Homo sapiens
ggacacacatggtgagcctag

SEQ ID NO: 1081654 - DNA, 22 bp, Homo sapiens
ggacacaccccacaccccagcc

SEQ ID NO: 1081655 - DNA, 18 bp, Homo sapiens
ggacacacctctgctcca

SEQ ID NO: 1081656 - DNA, 22 bp, Homo sapiens
ggacacactaaactctggggct

SEQ ID NO: 1081657 - DNA, 12 bp, Homo sapiens
ggacacactaat

SEQ ID NO: 1081658 - DNA, 10 bp, Homo sapiens
ggacacactc

SEQ ID NO: 1081659 - DNA, 18 bp, Homo sapiens
ggacacagttcctgggaa

SEQ ID NO: 1081660 - DNA, 14 bp, Homo sapiens
ggacacatcccggc

SEQ ID NO: 1081661 - DNA, 15 bp, Homo sapiens
ggacacatcccggcc

SEQ ID NO: 1081662 - DNA, 19 bp, Homo sapiens
ggacacatcccggcctctt

SEQ ID NO: 1081663 - DNA, 20 bp, Homo sapiens
ggacacatcccggcctcttc

SEQ ID NO: 1081664 - DNA, 17 bp, Homo sapiens
ggacacatgcccctccc

SEQ ID NO: 1081665 - DNA, 20 bp, Homo sapiens
ggacacatgcccctccccca

SEQ ID NO: 1081666 - DNA, 21 bp, Homo sapiens
ggacaccccccgccccccacc

SEQ ID NO: 1081667 - DNA, 17 bp, Homo sapiens
ggacacccctgctctac

SEQ ID NO: 1081668 - DNA, 18 bp, Homo sapiens
ggacaccgctcagtatta

SEQ ID NO: 1081669 - DNA, 14 bp, Homo sapiens
ggacaccgtggcct

SEQ ID NO: 1081670 - DNA, 17 bp, Homo sapiens
ggacacctgtacattct

SEQ ID NO: 1081671 - DNA, 14 bp, Homo sapiens
ggacacgagccaca

SEQ ID NO: 1081672 - DNA, 22 bp, Homo sapiens
ggacacggggcagtggcaacct

SEQ ID NO: 1081673 - DNA, 17 bp, Homo sapiens
ggacactacacccagca

SEQ ID NO: 1081674 - DNA, 21 bp, Homo sapiens
ggacactacacccagcaatag

SEQ ID NO: 1081675 - DNA, 22 bp, Homo sapiens
ggacactcaaaagctgggcagg

SEQ ID NO: 1081676 - DNA, 18 bp, Homo sapiens
ggacactccagggacaca

SEQ ID NO: 1081677 - DNA, 22 bp, Homo sapiens
ggacactccagggacacacagc

SEQ ID NO: 1081678 - DNA, 16 bp, Homo sapiens
ggacactccagtgcca

SEQ ID NO: 1081679 - DNA, 17 bp, Homo sapiens
ggacactgacaaagtca

SEQ ID NO: 1081680 - DNA, 14 bp, Homo sapiens
ggacactgccaaga

SEQ ID NO: 1081681 - DNA, 16 bp, Homo sapiens
ggacactgccaagagc

SEQ ID NO: 1081682 - DNA, 20 bp, Homo sapiens
ggacactgccaagagccgac

SEQ ID NO: 1081683 - DNA, 19 bp, Homo sapiens
ggacactgccttagcctct

SEQ ID NO: 1081684 - DNA, 21 bp, Homo sapiens
ggacacttccctctgtttctc

SEQ ID NO: 1081685 - DNA, 20 bp, Homo sapiens
ggacactttgaaatgtgttt

SEQ ID NO: 1081686 - DNA, 18 bp, Homo sapiens
ggacagaatgtgttcttt

SEQ ID NO: 1081687 - DNA, 12 bp, Homo sapiens
ggacagacacct

SEQ ID NO: 1081688 - DNA, 21 bp, Homo sapiens
ggacagacacctccccctacc

SEQ ID NO: 1081689 - DNA, 20 bp, Homo sapiens
ggacagagacacctgcacct

SEQ ID NO: 1081690 - DNA, 20 bp, Homo sapiens
ggacagagactcagatgagg

SEQ ID NO: 1081691 - DNA, 20 bp, Homo sapiens
ggacagagcaggggctccag

SEQ ID NO: 1081692 - DNA, 22 bp, Homo sapiens
ggacagagcaggggctccagca

SEQ ID NO: 1081693 - DNA, 21 bp, Homo sapiens
ggacagagccaccccatgagc

SEQ ID NO: 1081694 - DNA, 14 bp, Homo sapiens
ggacagagccatgc

SEQ ID NO: 1081695 - DNA, 19 bp, Homo sapiens
ggacagaggccaaggactg

SEQ ID NO: 1081696 - DNA, 18 bp, Homo sapiens
ggacagaggggactctgg

SEQ ID NO: 1081697 - DNA, 20 bp, Homo sapiens
ggacagatggacgcaggccc

SEQ ID NO: 1081698 - DNA, 22 bp, Homo sapiens
ggacagatggcccaagggatgg

SEQ ID NO: 1081699 - DNA, 20 bp, Homo sapiens
ggacagattcgcagcacaga

SEQ ID NO: 1081700 - DNA, 17 bp, Homo sapiens
ggacagcagaagcctcc

SEQ ID NO: 1081701 - DNA, 17 bp, Homo sapiens
ggacagcatcccttccc

SEQ ID NO: 1081702 - DNA, 18 bp, Homo sapiens
ggacagcatcccttccca

SEQ ID NO: 1081703 - DNA, 24 bp, Homo sapiens
ggacagcatcccttcccacatgcc

SEQ ID NO: 1081704 - DNA, 19 bp, Homo sapiens
ggacagccagagctgggtg

SEQ ID NO: 1081705 - DNA, 17 bp, Homo sapiens
ggacagcccagagcctg

SEQ ID NO: 1081706 - DNA, 21 bp, Homo sapiens
ggacagcccagagcctggctg

SEQ ID NO: 1081707 - DNA, 13 bp, Homo sapiens
ggacagccccctt

SEQ ID NO: 1081708 - DNA, 21 bp, Homo sapiens
ggacagcctgtggcggtgcct

SEQ ID NO: 1081709 - DNA, 21 bp, Homo sapiens
ggacagcggcagtgggcctgc

SEQ ID NO: 1081710 - DNA, 13 bp, Homo sapiens
ggaggactgagcc

SEQ ID NO: 1081711 - DNA, 15 bp, Homo sapiens
ggaggactgtgacag

SEQ ID NO: 1081712 - DNA, 19 bp, Homo sapiens
ggaggacttggagggtctg

SEQ ID NO: 1081713 - DNA, 21 bp, Homo sapiens
ggaggacttggagggtctggg

SEQ ID NO: 1081714 - DNA, 13 bp, Homo sapiens
ggaggagaccagc

SEQ ID NO: 1081715 - DNA, 17 bp, Homo sapiens
ggaggagagagtcccag

SEQ ID NO: 1081716 - DNA, 13 bp, Homo sapiens
ggaggagagccac

SEQ ID NO: 1081717 - DNA, 19 bp, Homo sapiens
ggaggagagccactgggcc

SEQ ID NO: 1081718 - DNA, 14 bp, Homo sapiens
ggaggagaggagac

SEQ ID NO: 1081719 - DNA, 14 bp, Homo sapiens
ggaggagcagcagc

SEQ ID NO: 1081720 - DNA, 15 bp, Homo sapiens
ggaggagcagcagct

SEQ ID NO: 1081721 - DNA, 13 bp, Homo sapiens
ggaggagcagcct

SEQ ID NO: 1081722 - DNA, 14 bp, Homo sapiens
ggaggagctgaggg

SEQ ID NO: 1081723 - DNA, 17 bp, Homo sapiens
ggaggagctgagggagg

SEQ ID NO: 1081724 - DNA, 22 bp, Homo sapiens
ggaggagctttgttttgggggt

SEQ ID NO: 1081725 - DNA, 10 bp, Homo sapiens
ggaggaggac

SEQ ID NO: 1081726 - DNA, 15 bp, Homo sapiens
ggaggaggagatggc

SEQ ID NO: 1081727 - DNA, 22 bp, Homo sapiens
ggaggaggccacctctccaagg

SEQ ID NO: 1081728 - DNA, 23 bp, Homo sapiens
ggaggaggctgccctgaggggct

SEQ ID NO: 1081729 - DNA, 13 bp, Homo sapiens
ggaggagggagag

SEQ ID NO: 1081730 - DNA, 20 bp, Homo sapiens
ggaggaggtggcagccctgt

SEQ ID NO: 1081731 - DNA, 13 bp, Homo sapiens
ggaggagtcaggg

SEQ ID NO: 1081732 - DNA, 15 bp, Homo sapiens
ggaggagtcaggggc

SEQ ID NO: 1081733 - DNA, 14 bp, Homo sapiens
ggaggatacagagg

SEQ ID NO: 1081734 - DNA, 16 bp, Homo sapiens
ggaggatcactggagc

SEQ ID NO: 1081735 - DNA, 17 bp, Homo sapiens
ggaggatcactggagcc

SEQ ID NO: 1081736 - DNA, 19 bp, Homo sapiens
ggaggatcactggagccca

SEQ ID NO: 1081737 - DNA, 23 bp, Homo sapiens
ggaggatcacttgagtccagaag

SEQ ID NO: 1081738 - DNA, 20 bp, Homo sapiens
ggaggatcctgagctgctgt

SEQ ID NO: 1081739 - DNA, 22 bp, Homo sapiens
ggaggatgccacgcacttcctc

SEQ ID NO: 1081740 - DNA, 20 bp, Homo sapiens
ggaggattgcctttaatatt

SEQ ID NO: 1081741 - DNA, 22 bp, Homo sapiens
ggaggattgcttgagcccagga

SEQ ID NO: 1081742 - DNA, 22 bp, Homo sapiens
ggaggatttcctacccccgtcc

SEQ ID NO: 1081743 - DNA, 16 bp, Homo sapiens
ggaggcaacactgctg

SEQ ID NO: 1081744 - DNA, 20 bp, Homo sapiens
ggaggcaagagactgggagc

SEQ ID NO: 1081745 - DNA, 17 bp, Homo sapiens
ggaggcaagagggaggg

SEQ ID NO: 1081746 - DNA, 19 bp, Homo sapiens
ggaggcaagaggggtggag

SEQ ID NO: 1081747 - DNA, 14 bp, Homo sapiens
ggaggcaccagctc

SEQ ID NO: 1081748 - DNA, 15 bp, Homo sapiens
ggaggcaccatgcaa

SEQ ID NO: 1081749 - DNA, 19 bp, Homo sapiens
ggaggcacctccaggcagg

SEQ ID NO: 1081750 - DNA, 22 bp, Homo sapiens
ggaggcagaaacctatctcagg

SEQ ID NO: 1081751 - DNA, 13 bp, Homo sapiens
ggaggcagatgga

SEQ ID NO: 1081752 - DNA, 12 bp, Homo sapiens
ggaggcagcgtg

SEQ ID NO: 1081753 - DNA, 17 bp, Homo sapiens
ggaggcagcgtgggctc

SEQ ID NO: 1081754 - DNA, 20 bp, Homo sapiens
ggaggcagcgtgggctctgc

SEQ ID NO: 1081755 - DNA, 15 bp, Homo sapiens
ggaggcagggcagcc

SEQ ID NO: 1081756 - DNA, 18 bp, Homo sapiens
ggaggcagggccttgccc

SEQ ID NO: 1081757 - DNA, 16 bp, Homo sapiens
ggaggcagggctctcc

SEQ ID NO: 1081758 - DNA, 15 bp, Homo sapiens
ggaggcagggctgga

SEQ ID NO: 1081759 - DNA, 14 bp, Homo sapiens
ggaggccaaccagc

SEQ ID NO: 1081760 - DNA, 18 bp, Homo sapiens
ggaggccaaccagcccga

SEQ ID NO: 1081761 - DNA, 20 bp, Homo sapiens
ggaggccaagtgcaggctgg

SEQ ID NO: 1081762 - DNA, 14 bp, Homo sapiens
ggaggccaataaaa

SEQ ID NO: 1081763 - DNA, 19 bp, Homo sapiens
ggaggccaataaaaagttc

SEQ ID NO: 1081764 - DNA, 13 bp, Homo sapiens
ggaggccacccca

SEQ ID NO: 1081765 - DNA, 22 bp, Homo sapiens
ggaggccaccccaaaccccagc

SEQ ID NO: 1081766 - DNA, 21 bp, Homo sapiens
ggaggccacctctccaagggc

SEQ ID NO: 1081767 - DNA, 11 bp, Homo sapiens
ggaggccaggc

SEQ ID NO: 1081768 - DNA, 20 bp, Homo sapiens
ggaggcccagccgcaggaag

SEQ ID NO: 1081769 - DNA, 14 bp, Homo sapiens
ggaggcccaggctg

SEQ ID NO: 1081770 - DNA, 18 bp, Homo sapiens
ggaggcccctggagccag

SEQ ID NO: 1081771 - DNA, 17 bp, Homo sapiens
ggaggcccctggcccag

SEQ ID NO: 1081772 - DNA, 18 bp, Homo sapiens
ggaggcccctggcccagc

SEQ ID NO: 1081773 - DNA, 23 bp, Homo sapiens
ggaggcccctggcccagcggccc

SEQ ID NO: 1081774 - DNA, 18 bp, Homo sapiens
ggaggccctaggggagca

SEQ ID NO: 1081775 - DNA, 15 bp, Homo sapiens
ggaggccctgcctga

SEQ ID NO: 1081776 - DNA, 19 bp, Homo sapiens
ggaggccctgcctgaccca

SEQ ID NO: 1081777 - DNA, 19 bp, Homo sapiens
ggaggccgcttagtgctgc

SEQ ID NO: 1081778 - DNA, 22 bp, Homo sapiens
ggaggcctcaaagcaacccgct

SEQ ID NO: 1081779 - DNA, 10 bp, Homo sapiens
ggaggcctgg

SEQ ID NO: 1081780 - DNA, 11 bp, Homo sapiens
ggaggcctgga

SEQ ID NO: 1081781 - DNA, 13 bp, Homo sapiens
ggaggcctgggga

SEQ ID NO: 1081782 - DNA, 19 bp, Homo sapiens
ggaggcctggggaggccct

SEQ ID NO: 1081783 - DNA, 17 bp, Homo sapiens
ggaggccttccagctgc

SEQ ID NO: 1081784 - DNA, 21 bp, Homo sapiens
ggaggccttggggtgggggcc

SEQ ID NO: 1081785 - DNA, 14 bp, Homo sapiens
ggaggcgcagggac

SEQ ID NO: 1081786 - DNA, 13 bp, Homo sapiens
ggaggcgcccttg

SEQ ID NO: 1081787 - DNA, 20 bp, Homo sapiens
ggaggcggaccttgtagtga

SEQ ID NO: 1081788 - DNA, 20 bp, Homo sapiens
ggaggcggagagtacagtga

SEQ ID NO: 1081789 - DNA, 14 bp, Homo sapiens
ggaggcggggagga

SEQ ID NO: 1081790 - DNA, 15 bp, Homo sapiens
ggaggcggggaggag

SEQ ID NO: 1081791 - DNA, 17 bp, Homo sapiens
ggaggcggggaggagga

SEQ ID NO: 1081792 - DNA, 20 bp, Homo sapiens
ggaggctacctcacctgggc

SEQ ID NO: 1081793 - DNA, 14 bp, Homo sapiens
ggaggctcagccca

SEQ ID NO: 1081794 - DNA, 15 bp, Homo sapiens
ggaggctcaggtccc

SEQ ID NO: 1081795 - DNA, 18 bp, Homo sapiens
ggaggctccagagggcac

SEQ ID NO: 1081796 - DNA, 20 bp, Homo sapiens
ggaggctcccgaggggaagg

SEQ ID NO: 1081797 - DNA, 18 bp, Homo sapiens
ggaggctgagacaggaga

SEQ ID NO: 1081798 - DNA, 14 bp, Homo sapiens
ggaggctgaggcag

SEQ ID NO: 1081799 - DNA, 20 bp, Homo sapiens
ggacccggaggggcctggca

SEQ ID NO: 1081800 - DNA, 20 bp, Homo sapiens
ggacccggggtctcctggac

SEQ ID NO: 1081801 - DNA, 21 bp, Homo sapiens
ggacccggggtctcctggacc

SEQ ID NO: 1081802 - DNA, 22 bp, Homo sapiens
ggacccggggtctcctggacct

SEQ ID NO: 1081803 - DNA, 21 bp, Homo sapiens
ggaccctcagccctggccttt

SEQ ID NO: 1081804 - DNA, 19 bp, Homo sapiens
ggaccctccactcactgct

SEQ ID NO: 1081805 - DNA, 20 bp, Homo sapiens
ggaccctccagaggtggagg

SEQ ID NO: 1081806 - DNA, 22 bp, Homo sapiens
ggaccctgacctccgcccctgc

SEQ ID NO: 1081807 - DNA, 14 bp, Homo sapiens
ggaccctgctgact

SEQ ID NO: 1081808 - DNA, 21 bp, Homo sapiens
ggaccctgtccggcccagtgc

SEQ ID NO: 1081809 - DNA, 15 bp, Homo sapiens
ggaccctgtcctgca

SEQ ID NO: 1081810 - DNA, 15 bp, Homo sapiens
ggacccttcaggtgt

SEQ ID NO: 1081811 - DNA, 17 bp, Homo sapiens
ggacccttcccagccct

SEQ ID NO: 1081812 - DNA, 12 bp, Homo sapiens
ggacccttgcct

SEQ ID NO: 1081813 - DNA, 17 bp, Homo sapiens
ggacccttgcctgcctc

SEQ ID NO: 1081814 - DNA, 18 bp, Homo sapiens
ggacccttgcctgcctcc

SEQ ID NO: 1081815 - DNA, 12 bp, Homo sapiens
ggaccctttcct

SEQ ID NO: 1081816 - DNA, 17 bp, Homo sapiens
ggaccctttccttcctt

SEQ ID NO: 1081817 - DNA, 12 bp, Homo sapiens
ggaccgcctggc

SEQ ID NO: 1081818 - DNA, 13 bp, Homo sapiens
ggaccgcctggcc

SEQ ID NO: 1081819 - DNA, 16 bp, Homo sapiens
ggaccgcctggccctc

SEQ ID NO: 1081820 - DNA, 15 bp, Homo sapiens
ggaccgggtgggcct

SEQ ID NO: 1081821 - DNA, 18 bp, Homo sapiens
ggaccgggtgggcctggc

SEQ ID NO: 1081822 - DNA, 20 bp, Homo sapiens
ggaccgggtgggcctggcct

SEQ ID NO: 1081823 - DNA, 17 bp, Homo sapiens
ggaccggtacagaaagg

SEQ ID NO: 1081824 - DNA, 14 bp, Homo sapiens
ggaccggtgctgca

SEQ ID NO: 1081825 - DNA, 17 bp, Homo sapiens
ggaccgtgcgagctgcc

SEQ ID NO: 1081826 - DNA, 14 bp, Homo sapiens
ggaccgttctctgt

SEQ ID NO: 1081827 - DNA, 17 bp, Homo sapiens
ggacctaaatggcctca

SEQ ID NO: 1081828 - DNA, 22 bp, Homo sapiens
ggacctaaatggcctcatgtgg

SEQ ID NO: 1081829 - DNA, 17 bp, Homo sapiens
ggacctacctccctccc

SEQ ID NO: 1081830 - DNA, 14 bp, Homo sapiens
ggacctagcctgga

SEQ ID NO: 1081831 - DNA, 15 bp, Homo sapiens
ggacctagcctggat

SEQ ID NO: 1081832 - DNA, 22 bp, Homo sapiens
ggacctagcctggatggcccct

SEQ ID NO: 1081833 - DNA, 21 bp, Homo sapiens
ggacctagggggacggggctg

SEQ ID NO: 1081834 - DNA, 18 bp, Homo sapiens
ggacctcaggagggcagg

SEQ ID NO: 1081835 - DNA, 21 bp, Homo sapiens
ggacctcaggagggcaggctg

SEQ ID NO: 1081836 - DNA, 15 bp, Homo sapiens
ggacctccaggggct

SEQ ID NO: 1081837 - DNA, 19 bp, Homo sapiens
ggacctccaggggctcctg

SEQ ID NO: 1081838 - DNA, 23 bp, Homo sapiens
ggacctccaggggctcctgggtt

SEQ ID NO: 1081839 - DNA, 18 bp, Homo sapiens
ggacctccatccctgctc

SEQ ID NO: 1081840 - DNA, 22 bp, Homo sapiens
ggacctcccaggacaagcacga

SEQ ID NO: 1081841 - DNA, 13 bp, Homo sapiens
ggacctcccttcc

SEQ ID NO: 1081842 - DNA, 20 bp, Homo sapiens
ggacctcccttccgaccctc

SEQ ID NO: 1081843 - DNA, 13 bp, Homo sapiens
ggacctcctccct

SEQ ID NO: 1081844 - DNA, 14 bp, Homo sapiens
ggacctcctccctc

SEQ ID NO: 1081845 - DNA, 15 bp, Homo sapiens
ggacctcctccctca

SEQ ID NO: 1081846 - DNA, 20 bp, Homo sapiens
ggacctcctccctcattcat

SEQ ID NO: 1081847 - DNA, 21 bp, Homo sapiens
ggacctccttagccctgtctg

SEQ ID NO: 1081848 - DNA, 13 bp, Homo sapiens
ggacctcgtgcca

SEQ ID NO: 1081849 - DNA, 16 bp, Homo sapiens
ggacctctgctctgag

SEQ ID NO: 1081850 - DNA, 17 bp, Homo sapiens
ggacctctgtaggcagc

SEQ ID NO: 1081851 - DNA, 16 bp, Homo sapiens
ggacctgagcccgcag

SEQ ID NO: 1081852 - DNA, 20 bp, Homo sapiens
ggacctgagcccgcagccca

SEQ ID NO: 1081853 - DNA, 23 bp, Homo sapiens
ggacctgcatctaagcatctggg

SEQ ID NO: 1081854 - DNA, 14 bp, Homo sapiens
ggacctgccaccag

SEQ ID NO: 1081855 - DNA, 14 bp, Homo sapiens
ggacctgccaggca

SEQ ID NO: 1081856 - DNA, 16 bp, Homo sapiens
ggacctgccaggcagg

SEQ ID NO: 1081857 - DNA, 18 bp, Homo sapiens
ggaggctgaggcagaaga

SEQ ID NO: 1081858 - DNA, 19 bp, Homo sapiens
ggaggctgaggcaggagga

SEQ ID NO: 1081859 - DNA, 19 bp, Homo sapiens
ggaggctgaggtgggcaga

SEQ ID NO: 1081860 - DNA, 18 bp, Homo sapiens
ggaggctgcactggagcc

SEQ ID NO: 1081861 - DNA, 19 bp, Homo sapiens
ggaggctgcactggagcca

SEQ ID NO: 1081862 - DNA, 21 bp, Homo sapiens
ggaggctgcagagctgaccca

SEQ ID NO: 1081863 - DNA, 23 bp, Homo sapiens
ggaggctgcatgctctggaagcc

SEQ ID NO: 1081864 - DNA, 17 bp, Homo sapiens
ggaggctgccctgaggg

SEQ ID NO: 1081865 - DNA, 20 bp, Homo sapiens
ggaggctggaggaagggggg

SEQ ID NO: 1081866 - DNA, 13 bp, Homo sapiens
ggaggctggcagg

SEQ ID NO: 1081867 - DNA, 16 bp, Homo sapiens
ggaggctgggcccctg

SEQ ID NO: 1081868 - DNA, 17 bp, Homo sapiens
ggaggctgggcccctgg

SEQ ID NO: 1081869 - DNA, 12 bp, Homo sapiens
ggaggctggggc

SEQ ID NO: 1081870 - DNA, 17 bp, Homo sapiens
ggaggcttgtcagagct

SEQ ID NO: 1081871 - DNA, 21 bp, Homo sapiens
ggaggctttaagctccagctt

SEQ ID NO: 1081872 - DNA, 14 bp, Homo sapiens
ggagggaagaccag

SEQ ID NO: 1081873 - DNA, 16 bp, Homo sapiens
ggagggaagctcttgg

SEQ ID NO: 1081874 - DNA, 16 bp, Homo sapiens
ggagggaaggggatgg

SEQ ID NO: 1081875 - DNA, 17 bp, Homo sapiens
ggagggaaggggatgga

SEQ ID NO: 1081876 - DNA, 19 bp, Homo sapiens
ggagtctctgccacccact

SEQ ID NO: 1081877 - DNA, 20 bp, Homo sapiens
ggagtctctgccacccactc

SEQ ID NO: 1081878 - DNA, 12 bp, Homo sapiens
ggagtctgagga

SEQ ID NO: 1081879 - DNA, 20 bp, Homo sapiens
ggagtctgaggcctgagtga

SEQ ID NO: 1081880 - DNA, 19 bp, Homo sapiens
ggagtcttcagacccagag

SEQ ID NO: 1081881 - DNA, 20 bp, Homo sapiens
ggagtcttcagacccagaga

SEQ ID NO: 1081882 - DNA, 21 bp, Homo sapiens
ggagtcttcagacccagagaa

SEQ ID NO: 1081883 - DNA, 21 bp, Homo sapiens
ggagtgaaacctttagggcag

SEQ ID NO: 1081884 - DNA, 16 bp, Homo sapiens
ggagtgaagaggggca

SEQ ID NO: 1081885 - DNA, 22 bp, Homo sapiens
ggagtgaagaggggcagccctt

SEQ ID NO: 1081886 - DNA, 23 bp, Homo sapiens
ggagtgaagaggggcagcccttg

SEQ ID NO: 1081887 - DNA, 13 bp, Homo sapiens
ggagtgaagccac

SEQ ID NO: 1081888 - DNA, 15 bp, Homo sapiens
ggagtgacccagcta

SEQ ID NO: 1081889 - DNA, 15 bp, Homo sapiens
ggagtgagagccttt

SEQ ID NO: 1081890 - DNA, 12 bp, Homo sapiens
ggagtgagcagc

SEQ ID NO: 1081891 - DNA, 18 bp, Homo sapiens
ggagtgagcagctactgt

SEQ ID NO: 1081892 - DNA, 19 bp, Homo sapiens
ggagtgaggcttccaggct

SEQ ID NO: 1081893 - DNA, 21 bp, Homo sapiens
ggagtgaggcttccaggctct

SEQ ID NO: 1081894 - DNA, 19 bp, Homo sapiens
ggagtgcagaacacctggc

SEQ ID NO: 1081895 - DNA, 17 bp, Homo sapiens
ggagtgcagccttctcc

SEQ ID NO: 1081896 - DNA, 12 bp, Homo sapiens
ggagtgcagtgg

SEQ ID NO: 1081897 - DNA, 17 bp, Homo sapiens
ggagtgcagtggcatga

SEQ ID NO: 1081898 - DNA, 17 bp, Homo sapiens
ggagtgccaggaccagc

SEQ ID NO: 1081899 - DNA, 18 bp, Homo sapiens
ggagtgccaggaccagcc

SEQ ID NO: 1081900 - DNA, 20 bp, Homo sapiens
ggagtgccaggaccagcctg

SEQ ID NO: 1081901 - DNA, 22 bp, Homo sapiens
ggagtgcggaccaccctcactg

SEQ ID NO: 1081902 - DNA, 17 bp, Homo sapiens
ggagtgctgcttgtgcc

SEQ ID NO: 1081903 - DNA, 22 bp, Homo sapiens
ggagtgctggctcacagtacag

SEQ ID NO: 1081904 - DNA, 23 bp, Homo sapiens
ggagtggaaaagcttaaaaaaat

SEQ ID NO: 1081905 - DNA, 18 bp, Homo sapiens
ggagtggaaggtctattg

SEQ ID NO: 1081906 - DNA, 22 bp, Homo sapiens
ggagtggacaccgctcagtatt

SEQ ID NO: 1081907 - DNA, 19 bp, Homo sapiens
ggagtggccacagcacccc

SEQ ID NO: 1081908 - DNA, 17 bp, Homo sapiens
ggagtgggacagagtct

SEQ ID NO: 1081909 - DNA, 18 bp, Homo sapiens
ggagtgggacagagtctg

SEQ ID NO: 1081910 - DNA, 15 bp, Homo sapiens
ggagtgggcacctca

SEQ ID NO: 1081911 - DNA, 19 bp, Homo sapiens
ggagtgggtgacaagagcc

SEQ ID NO: 1081912 - DNA, 17 bp, Homo sapiens
ggagtgggtggcaggtg

SEQ ID NO: 1081913 - DNA, 13 bp, Homo sapiens
ggagtggtgcaga

SEQ ID NO: 1081914 - DNA, 15 bp, Homo sapiens
ggagtggtgcagaca

SEQ ID NO: 1081915 - DNA, 20 bp, Homo sapiens
ggagtggtttaggctatttg

SEQ ID NO: 1081916 - DNA, 24 bp, Homo sapiens
ggagtgtcctcttccctctctgca

SEQ ID NO: 1081917 - DNA, 17 bp, Homo sapiens
ggagtgtcctgcccatg

SEQ ID NO: 1081918 - DNA, 14 bp, Homo sapiens
ggagtgtgcagaca

SEQ ID NO: 1081919 - DNA, 20 bp, Homo sapiens
ggagtgtgtcagagcccagg

SEQ ID NO: 1081920 - DNA, 22 bp, Homo sapiens
ggagtgtgtcagagcccagggg

SEQ ID NO: 1081921 - DNA, 21 bp, Homo sapiens
ggagttcaccttggaagggcg

SEQ ID NO: 1081922 - DNA, 15 bp, Homo sapiens
ggagttccatgaaga

SEQ ID NO: 1081923 - DNA, 22 bp, Homo sapiens
ggagttcctgctccgtggactg

SEQ ID NO: 1081924 - DNA, 20 bp, Homo sapiens
ggagttcgagaccagcctgg

SEQ ID NO: 1081925 - DNA, 15 bp, Homo sapiens
ggagttcgaggctgc

SEQ ID NO: 1081926 - DNA, 20 bp, Homo sapiens
ggagttcgaggctgcagtca

SEQ ID NO: 1081927 - DNA, 21 bp, Homo sapiens
ggagttcgaggctgcagtcag

SEQ ID NO: 1081928 - DNA, 14 bp, Homo sapiens
ggagttgagtacag

SEQ ID NO: 1081929 - DNA, 13 bp, Homo sapiens
ggagttgagtcac

SEQ ID NO: 1081930 - DNA, 23 bp, Homo sapiens
ggagttgatcgcctttcccaggt

SEQ ID NO: 1081931 - DNA, 13 bp, Homo sapiens
ggagttgcctgac

SEQ ID NO: 1081932 - DNA, 18 bp, Homo sapiens
ggagttggtaaagggtta

SEQ ID NO: 1081933 - DNA, 19 bp, Homo sapiens
ggagtttaatacaggaaat

SEQ ID NO: 1081934 - DNA, 19 bp, Homo sapiens
ggagtttattacaatgtat

SEQ ID NO: 1081935 - DNA, 12 bp, Homo sapiens
ggagtttctctg

SEQ ID NO: 1081936 - DNA, 18 bp, Homo sapiens
ggagtttgagacaagccc

SEQ ID NO: 1081937 - DNA, 21 bp, Homo sapiens
ggagtttgagacaagccctgg

SEQ ID NO: 1081938 - DNA, 13 bp, Homo sapiens
ggagtttgaggct

SEQ ID NO: 1081939 - DNA, 22 bp, Homo sapiens
ggagtttgctgttgaggtggct

SEQ ID NO: 1081940 - DNA, 16 bp, Homo sapiens
ggagttttactgcctg

SEQ ID NO: 1081941 - DNA, 19 bp, Homo sapiens
ggagttttatttttaagaa

SEQ ID NO: 1081942 - DNA, 20 bp, Homo sapiens
ggagttttgtctgtctccct

SEQ ID NO: 1081943 - DNA, 17 bp, Homo sapiens
ggagttttgtttcctct

SEQ ID NO: 1081944 - DNA, 11 bp, Homo sapiens
ggagtttttgt

SEQ ID NO: 1081945 - DNA, 19 bp, Homo sapiens
ggataaaaagccagggctg

SEQ ID NO: 1081946 - DNA, 18 bp, Homo sapiens
ggataaaactgtgtaaac

SEQ ID NO: 1081947 - DNA, 15 bp, Homo sapiens
ggataaaccaccctc

SEQ ID NO: 1081948 - DNA, 20 bp, Homo sapiens
ggataaaccaccctctgggg

SEQ ID NO: 1081949 - DNA, 12 bp, Homo sapiens
ggataaagacag

SEQ ID NO: 1081950 - DNA, 13 bp, Homo sapiens
ggataaagccact

SEQ ID NO: 1081951 - DNA, 18 bp, Homo sapiens
ggataaatcataaagtca

SEQ ID NO: 1081952 - DNA, 12 bp, Homo sapiens
ggataaatcatt

SEQ ID NO: 1081953 - DNA, 19 bp, Homo sapiens
ggataagaattgtctctgg

SEQ ID NO: 1081954 - DNA, 20 bp, Homo sapiens
ggataagccactctgtccct

SEQ ID NO: 1081955 - DNA, 23 bp, Homo sapiens
ggataagctatccgtgttgcagg

SEQ ID NO: 1081956 - DNA, 14 bp, Homo sapiens
ggataataggaatt

SEQ ID NO: 1081957 - DNA, 17 bp, Homo sapiens
ggataatataaaaagca

SEQ ID NO: 1081958 - DNA, 16 bp, Homo sapiens
ggataatgaaataatc

SEQ ID NO: 1081959 - DNA, 20 bp, Homo sapiens
ggataatgctgttgcctcat

SEQ ID NO: 1081960 - DNA, 15 bp, Homo sapiens
ggatacagctgcttt

SEQ ID NO: 1081961 - DNA, 23 bp, Homo sapiens
ggatacaggttactaccctcacc

SEQ ID NO: 1081962 - DNA, 16 bp, Homo sapiens
ggatacagtgcccacc

SEQ ID NO: 1081963 - DNA, 17 bp, Homo sapiens
ggatacagtgcccaccg

SEQ ID NO: 1081964 - DNA, 20 bp, Homo sapiens
ggatacagtgcccaccgccc

SEQ ID NO: 1081965 - DNA, 23 bp, Homo sapiens
ggatacagtgcccaccgccctcc

SEQ ID NO: 1081966 - DNA, 15 bp, Homo sapiens
ggatacatctgctgt

SEQ ID NO: 1081967 - DNA, 15 bp, Homo sapiens
ggataccagctcagg

SEQ ID NO: 1081968 - DNA, 17 bp, Homo sapiens
ggataccttcttattta

SEQ ID NO: 1081969 - DNA, 15 bp, Homo sapiens
ggatacgtgtcaatg

SEQ ID NO: 1081970 - DNA, 13 bp, Homo sapiens
ggatactaaagta

SEQ ID NO: 1081971 - DNA, 21 bp, Homo sapiens
ggatacttagtggtatgtctc

SEQ ID NO: 1081972 - DNA, 18 bp, Homo sapiens
ggatacttatatggaaat

SEQ ID NO: 1081973 - DNA, 19 bp, Homo sapiens
ggatagctaactgtaaatc

SEQ ID NO: 1081974 - DNA, 23 bp, Homo sapiens
ggatagtagttaaataactgtgt

SEQ ID NO: 1081975 - DNA, 18 bp, Homo sapiens
ggatagtgttctgctcct

SEQ ID NO: 1081976 - DNA, 13 bp, Homo sapiens
ggatataaaagga

SEQ ID NO: 1081977 - DNA, 14 bp, Homo sapiens
ggatataaaaggat

SEQ ID NO: 1081978 - DNA, 16 bp, Homo sapiens
ggatataatgtatttt

SEQ ID NO: 1081979 - DNA, 18 bp, Homo sapiens
ggatataatgtgtgcttt

SEQ ID NO: 1081980 - DNA, 15 bp, Homo sapiens
ggatataggagagga

SEQ ID NO: 1081981 - DNA, 16 bp, Homo sapiens
ggatatagttttactt

SEQ ID NO: 1081982 - DNA, 16 bp, Homo sapiens
ggatatgattggttca

SEQ ID NO: 1081983 - DNA, 20 bp, Homo sapiens
ggatatggcaggactcctgg

SEQ ID NO: 1081984 - DNA, 17 bp, Homo sapiens
ggatatggctgcccagg

SEQ ID NO: 1081985 - DNA, 16 bp, Homo sapiens
ggatatgggtcctctg

SEQ ID NO: 1081986 - DNA, 22 bp, Homo sapiens
ggatattgccttatttgtctgt

SEQ ID NO: 1081987 - DNA, 11 bp, Homo sapiens
ggatatttaag

SEQ ID NO: 1081988 - DNA, 12 bp, Homo sapiens
ggatatttccta

SEQ ID NO: 1081989 - DNA, 21 bp, Homo sapiens
ggatcaaacctttctggcctg

SEQ ID NO: 1081990 - DNA, 13 bp, Homo sapiens
ggatcaattttca

SEQ ID NO: 1081991 - DNA, 22 bp, Homo sapiens
ggatcaattttcattaaacttg

SEQ ID NO: 1081992 - DNA, 18 bp, Homo sapiens
ggatcacaaggtcaggag

SEQ ID NO: 1081993 - DNA, 18 bp, Homo sapiens
ggatcacacctcagtggg

SEQ ID NO: 1081994 - DNA, 16 bp, Homo sapiens
ggatcacagcgtttca

SEQ ID NO: 1081995 - DNA, 17 bp, Homo sapiens
ggatcacagggccccag

SEQ ID NO: 1081996 - DNA, 13 bp, Homo sapiens
ggatcactggagc

SEQ ID NO: 1081997 - DNA, 19 bp, Homo sapiens
ggatcactggagcccagga

SEQ ID NO: 1081998 - DNA, 17 bp, Homo sapiens
ggatcagaacagcagag

SEQ ID NO: 1081999 - DNA, 16 bp, Homo sapiens
ggatcagagcaggacc

SEQ ID NO: 1082000 - DNA, 21 bp, Homo sapiens
ggatcagatctggggcagcac

SEQ ID NO: 1082001 - DNA, 16 bp, Homo sapiens
ggatcagcattttaga

SEQ ID NO: 1082002 - DNA, 12 bp, Homo sapiens
ggatcagcctcc

SEQ ID NO: 1082003 - DNA, 22 bp, Homo sapiens
ggatcagcctccgccattccaa

SEQ ID NO: 1082004 - DNA, 13 bp, Homo sapiens
ggatcaggagccc

SEQ ID NO: 1082005 - DNA, 21 bp, Homo sapiens
ggatcagggaatccagctccc

SEQ ID NO: 1082006 - DNA, 12 bp, Homo sapiens
ggatcagttttt

SEQ ID NO: 1082007 - DNA, 14 bp, Homo sapiens
ggatcatatggagc

SEQ ID NO: 1082008 - DNA, 20 bp, Homo sapiens
ggatcatatggagctcatgt

SEQ ID NO: 1082009 - DNA, 14 bp, Homo sapiens
ggatcatttttcca

SEQ ID NO: 1082010 - DNA, 21 bp, Homo sapiens
ggatccaattgatgtatatgt

SEQ ID NO: 1082011 - DNA, 21 bp, Homo sapiens
ggatcccaagcctcctgctgc

SEQ ID NO: 1082012 - DNA, 16 bp, Homo sapiens
ggatccccgcctggcc

SEQ ID NO: 1082013 - DNA, 18 bp, Homo sapiens
ggatccctcatctgtccc

SEQ ID NO: 1082014 - DNA, 15 bp, Homo sapiens
ggatccgaaacggca

SEQ ID NO: 1082015 - DNA, 19 bp, Homo sapiens
ggatccgaaacggcagcct

SEQ ID NO: 1082016 - DNA, 14 bp, Homo sapiens
ggatccgctgccac

SEQ ID NO: 1082017 - DNA, 16 bp, Homo sapiens
ggatccgctgccacca

SEQ ID NO: 1082018 - DNA, 17 bp, Homo sapiens
ggatccgctgccaccac

SEQ ID NO: 1082019 - DNA, 17 bp, Homo sapiens
ggatcctcacactacag

SEQ ID NO: 1082020 - DNA, 17 bp, Homo sapiens
ggatcctccacagagag

SEQ ID NO: 1082021 - DNA, 17 bp, Homo sapiens
ggatcctccctcatggc

SEQ ID NO: 1082022 - DNA, 18 bp, Homo sapiens
ggatcctctccaccctcc

SEQ ID NO: 1082023 - DNA, 17 bp, Homo sapiens
ggatcctgcccccaagt

SEQ ID NO: 1082024 - DNA, 21 bp, Homo sapiens
ggatcgaagggtttttagaga

SEQ ID NO: 1082025 - DNA, 18 bp, Homo sapiens
ggatcgagtgtagctgtg

SEQ ID NO: 1082026 - DNA, 20 bp, Homo sapiens
ggatcgagtgtagctgtgaa

SEQ ID NO: 1082027 - DNA, 17 bp, Homo sapiens
ggatcggactctgcccc

SEQ ID NO: 1082028 - DNA, 19 bp, Homo sapiens
ggatcggaggcttgtcaga

SEQ ID NO: 1082029 - DNA, 18 bp, Homo sapiens
ggatctaccagcataaat

SEQ ID NO: 1082030 - DNA, 16 bp, Homo sapiens
ggatctataggcagct

SEQ ID NO: 1082031 - DNA, 15 bp, Homo sapiens
ggatctcaagccagc

SEQ ID NO: 1082032 - DNA, 16 bp, Homo sapiens
ggatctcagctttgag

SEQ ID NO: 1082033 - DNA, 17 bp, Homo sapiens
ggatctcagctttgaga

SEQ ID NO: 1082034 - DNA, 14 bp, Homo sapiens
ggatctccccactc

SEQ ID NO: 1082035 - DNA, 16 bp, Homo sapiens
ggatctcctgctgcct

SEQ ID NO: 1082036 - DNA, 13 bp, Homo sapiens
ggatctctcagga

SEQ ID NO: 1082037 - DNA, 16 bp, Homo sapiens
ggatctctcaggagca

SEQ ID NO: 1082038 - DNA, 18 bp, Homo sapiens
ggatctcttgagcctggg

SEQ ID NO: 1082039 - DNA, 14 bp, Homo sapiens
ggatctgagctccc

SEQ ID NO: 1082040 - DNA, 15 bp, Homo sapiens
ggatctgatctgtac

SEQ ID NO: 1082041 - DNA, 19 bp, Homo sapiens
ggatctgatgaaaaggtca

SEQ ID NO: 1082042 - DNA, 21 bp, Homo sapiens
ggatctgctgaggcccagtgc

SEQ ID NO: 1082043 - DNA, 17 bp, Homo sapiens
ggatctgctgggctctg

SEQ ID NO: 1082044 - DNA, 23 bp, Homo sapiens
ggatctgggaccctttccttcct

SEQ ID NO: 1082045 - DNA, 18 bp, Homo sapiens
ggatctggggctctggga

SEQ ID NO: 1082046 - DNA, 17 bp, Homo sapiens
ggatctggggggtgggg

SEQ ID NO: 1082047 - DNA, 19 bp, Homo sapiens
ggatctggggggtggggag

SEQ ID NO: 1082048 - DNA, 21 bp, Homo sapiens
ggatctggggggtggggagga

SEQ ID NO: 1082049 - DNA, 15 bp, Homo sapiens
ggatctgtccaagga

SEQ ID NO: 1082050 - DNA, 20 bp, Homo sapiens
ggatcttcagaactgccctt

SEQ ID NO: 1082051 - DNA, 20 bp, Homo sapiens
ggatcttgaatgtggtctca

SEQ ID NO: 1082052 - DNA, 22 bp, Homo sapiens
ggatcttgcattcccagtggtc

SEQ ID NO: 1082053 - DNA, 22 bp, Homo sapiens
ggatgaaaagagaggtttctgg

SEQ ID NO: 1082054 - DNA, 18 bp, Homo sapiens
ggatgaaataactccttc

SEQ ID NO: 1082055 - DNA, 17 bp, Homo sapiens
ggatgaaattttctaga

SEQ ID NO: 1082056 - DNA, 17 bp, Homo sapiens
ggatgaagagaaggcac

SEQ ID NO: 1082057 - DNA, 14 bp, Homo sapiens
ggatgaatgaggtc

SEQ ID NO: 1082058 - DNA, 17 bp, Homo sapiens
ggatgacaccctggcct

SEQ ID NO: 1082059 - DNA, 14 bp, Homo sapiens
ggatgacatagcca

SEQ ID NO: 1082060 - DNA, 21 bp, Homo sapiens
ggatgacatgcactcagctct

SEQ ID NO: 1082061 - DNA, 13 bp, Homo sapiens
ggatgaccacacc

SEQ ID NO: 1082062 - DNA, 19 bp, Homo sapiens
ggatgactagaggcaggga

SEQ ID NO: 1082063 - DNA, 23 bp, Homo sapiens
ggatgagaatttgagtgctctga

SEQ ID NO: 1082064 - DNA, 22 bp, Homo sapiens
ggatgagatacttatgcaagat

SEQ ID NO: 1082065 - DNA, 13 bp, Homo sapiens
ggatgagcagagg

SEQ ID NO: 1082066 - DNA, 16 bp, Homo sapiens
ggatgagggcatgtgc

SEQ ID NO: 1082067 - DNA, 21 bp, Homo sapiens
ggatgatagttgaagggaggt

SEQ ID NO: 1082068 - DNA, 17 bp, Homo sapiens
ggatgatggcagagcca

SEQ ID NO: 1082069 - DNA, 17 bp, Homo sapiens
ggatgattggattattc

SEQ ID NO: 1082070 - DNA, 14 bp, Homo sapiens
ggatgcacatttct

SEQ ID NO: 1082071 - DNA, 15 bp, Homo sapiens
ggatgcacatttctg

SEQ ID NO: 1082072 - DNA, 18 bp, Homo sapiens
ggatgcacatttctggat

SEQ ID NO: 1082073 - DNA, 19 bp, Homo sapiens
ggatgccaagaagtttaag

SEQ ID NO: 1082074 - DNA, 22 bp, Homo sapiens
ggatgccaatattaaatctgct

SEQ ID NO: 1082075 - DNA, 18 bp, Homo sapiens
ggatgccactcctccctc

SEQ ID NO: 1082076 - DNA, 16 bp, Homo sapiens
ggatgcccccaggcag

SEQ ID NO: 1082077 - DNA, 21 bp, Homo sapiens
ggatgcccccaggcagccacc

SEQ ID NO: 1082078 - DNA, 17 bp, Homo sapiens
ggatgccccgtccccct

SEQ ID NO: 1082079 - DNA, 18 bp, Homo sapiens
ggatgccctggaggtggc

SEQ ID NO: 1082080 - DNA, 21 bp, Homo sapiens
ggatgccctggaggtggctga

SEQ ID NO: 1082081 - DNA, 17 bp, Homo sapiens
ggatgcctcaccacacc

SEQ ID NO: 1082082 - DNA, 18 bp, Homo sapiens
ggatgcctcaccacaccc

SEQ ID NO: 1082083 - DNA, 18 bp, Homo sapiens
ggatgcgagcttggcctt

SEQ ID NO: 1082084 - DNA, 16 bp, Homo sapiens
ggatgcggctttctct

SEQ ID NO: 1082085 - DNA, 19 bp, Homo sapiens
ggatgctaaagatgatgat

SEQ ID NO: 1082086 - DNA, 15 bp, Homo sapiens
ggatgctccagggca

SEQ ID NO: 1082087 - DNA, 23 bp, Homo sapiens
ggatgctccgaggactggactgt

SEQ ID NO: 1082088 - DNA, 15 bp, Homo sapiens
ggatgctgacccagg

SEQ ID NO: 1082089 - DNA, 12 bp, Homo sapiens
ggatgctgagct

SEQ ID NO: 1082090 - DNA, 16 bp, Homo sapiens
ggatgctgagctgtga

SEQ ID NO: 1082091 - DNA, 12 bp, Homo sapiens
ggatgctgcagc

SEQ ID NO: 1082092 - DNA, 14 bp, Homo sapiens
ggatgctgcctgag

SEQ ID NO: 1082093 - DNA, 16 bp, Homo sapiens
ggatgctgggctgggc

SEQ ID NO: 1082094 - DNA, 19 bp, Homo sapiens
ggatgctggtggctggtga

SEQ ID NO: 1082095 - DNA, 11 bp, Homo sapiens
ggatgcttcat

SEQ ID NO: 1082096 - DNA, 22 bp, Homo sapiens
ggatggaacgggcatgggcctc

SEQ ID NO: 1082097 - DNA, 15 bp, Homo sapiens
ggatggaaggagact

SEQ ID NO: 1082098 - DNA, 14 bp, Homo sapiens
ggatggacagacac

SEQ ID NO: 1082099 - DNA, 18 bp, Homo sapiens
ggatggacagacacctcc

SEQ ID NO: 1082100 - DNA, 22 bp, Homo sapiens
ggatggacagacacctccccct

SEQ ID NO: 1082101 - DNA, 20 bp, Homo sapiens
ggatggaccaacctgctctg

SEQ ID NO: 1082102 - DNA, 22 bp, Homo sapiens
ggatggacttgtatagtgagag

SEQ ID NO: 1082103 - DNA, 16 bp, Homo sapiens
ggatggagaaagaagt

SEQ ID NO: 1082104 - DNA, 19 bp, Homo sapiens
ggatggagaaagaagtgga

SEQ ID NO: 1082105 - DNA, 20 bp, Homo sapiens
ggatggagaaagaagtggag

SEQ ID NO: 1082106 - DNA, 16 bp, Homo sapiens
ggatggagagagggga

SEQ ID NO: 1082107 - DNA, 17 bp, Homo sapiens
ggatggagagtggggag

SEQ ID NO: 1082108 - DNA, 17 bp, Homo sapiens
ggatggcatttggtctc

SEQ ID NO: 1082109 - DNA, 16 bp, Homo sapiens
ggatggccccagcaca

SEQ ID NO: 1082110 - DNA, 14 bp, Homo sapiens
ggatgggaacactg

SEQ ID NO: 1082111 - DNA, 18 bp, Homo sapiens
ggatgggaatttgtcagc

SEQ ID NO: 1082112 - DNA, 15 bp, Homo sapiens
ggatgggaccaggga

SEQ ID NO: 1082113 - DNA, 15 bp, Homo sapiens
ggatgggagtgagac

SEQ ID NO: 1082114 - DNA, 16 bp, Homo sapiens
ggatgggagtgggcac

SEQ ID NO: 1082115 - DNA, 22 bp, Homo sapiens
ggatgggagtgggcacctcaga

SEQ ID NO: 1082116 - DNA, 18 bp, Homo sapiens
ggatgggctcccaccctc

SEQ ID NO: 1082117 - DNA, 14 bp, Homo sapiens
ggatggggctccca

SEQ ID NO: 1082118 - DNA, 17 bp, Homo sapiens
ggatgggggatgggcca

SEQ ID NO: 1082119 - DNA, 21 bp, Homo sapiens
ggatgggggatgggccagggt

SEQ ID NO: 1082120 - DNA, 17 bp, Homo sapiens
ggatgggggtgcaggca

SEQ ID NO: 1082121 - DNA, 15 bp, Homo sapiens
ggatgggtcagagct

SEQ ID NO: 1082122 - DNA, 13 bp, Homo sapiens
ggatgggtgggga

SEQ ID NO: 1082123 - DNA, 15 bp, Homo sapiens
ggatgggttccagag

SEQ ID NO: 1082124 - DNA, 16 bp, Homo sapiens
ggatggtagttttttc

SEQ ID NO: 1082125 - DNA, 20 bp, Homo sapiens
ggatggtagttttttcatct

SEQ ID NO: 1082126 - DNA, 20 bp, Homo sapiens
ggatggtcctggggctctgt

SEQ ID NO: 1082127 - DNA, 20 bp, Homo sapiens
ggatggtctcgatctcctga

SEQ ID NO: 1082128 - DNA, 18 bp, Homo sapiens
ggatggtggcacaggcac

SEQ ID NO: 1082129 - DNA, 18 bp, Homo sapiens
ggatggtgggcaggatct

SEQ ID NO: 1082130 - DNA, 18 bp, Homo sapiens
ggatggtggttattttaa

SEQ ID NO: 1082131 - DNA, 17 bp, Homo sapiens
ggatgtaaacagtgcct

SEQ ID NO: 1082132 - DNA, 22 bp, Homo sapiens
ggatgtacttaagagtggcata

SEQ ID NO: 1082133 - DNA, 12 bp, Homo sapiens
ggatgtagcatg

SEQ ID NO: 1082134 - DNA, 19 bp, Homo sapiens
ggatgtccctgggccaggg

SEQ ID NO: 1082135 - DNA, 23 bp, Homo sapiens
ggatgtccctgggccagggtctg

SEQ ID NO: 1082136 - DNA, 23 bp, Homo sapiens
ggatgtcctctttactcccttcc

SEQ ID NO: 1082137 - DNA, 17 bp, Homo sapiens
ggatgtcttccttggag

SEQ ID NO: 1082138 - DNA, 22 bp, Homo sapiens
ggatgtgaattgcctgcagaga

SEQ ID NO: 1082139 - DNA, 23 bp, Homo sapiens
ggatgtgggagggagcagacagg

SEQ ID NO: 1082140 - DNA, 22 bp, Homo sapiens
ggatgtggggtccccatcatcc

SEQ ID NO: 1082141 - DNA, 14 bp, Homo sapiens
ggatgtgtgtgtgt

SEQ ID NO: 1082142 - DNA, 15 bp, Homo sapiens
ggatgttacaagttt

SEQ ID NO: 1082143 - DNA, 18 bp, Homo sapiens
ggatgttactctcttgca

SEQ ID NO: 1082144 - DNA, 16 bp, Homo sapiens
ggatgttagcctgcaa

SEQ ID NO: 1082145 - DNA, 12 bp, Homo sapiens
ggatgtttgccc

SEQ ID NO: 1082146 - DNA, 15 bp, Homo sapiens
ggattaacctctgca

SEQ ID NO: 1082147 - DNA, 14 bp, Homo sapiens
ggattaagggacgg

SEQ ID NO: 1082148 - DNA, 13 bp, Homo sapiens
ggattaagggcaa

SEQ ID NO: 1082149 - DNA, 15 bp, Homo sapiens
ggattaatatgaaaa

SEQ ID NO: 1082150 - DNA, 16 bp, Homo sapiens
ggattaatatgaaaac

SEQ ID NO: 1082151 - DNA, 14 bp, Homo sapiens
ggattacaggcgtg

SEQ ID NO: 1082152 - DNA, 15 bp, Homo sapiens
ggattataatcagaa

SEQ ID NO: 1082153 - DNA, 20 bp, Homo sapiens
ggattataggcatgagccac

SEQ ID NO: 1082154 - DNA, 21 bp, Homo sapiens
ggattatgttatacaaggcaa

SEQ ID NO: 1082155 - DNA, 15 bp, Homo sapiens
ggattattcatttaa

SEQ ID NO: 1082156 - DNA, 17 bp, Homo sapiens
ggattattcatttaaaa

SEQ ID NO: 1082157 - DNA, 11 bp, Homo sapiens
ggattcaaatt

SEQ ID NO: 1082158 - DNA, 12 bp, Homo sapiens
ggattcagcctt

SEQ ID NO: 1082159 - DNA, 16 bp, Homo sapiens
ggattcagccttcttt

SEQ ID NO: 1082160 - DNA, 23 bp, Homo sapiens
ggattcagccttctttttctgga

SEQ ID NO: 1082161 - DNA, 21 bp, Homo sapiens
ggattcaggaatgtgtggcct

SEQ ID NO: 1082162 - DNA, 13 bp, Homo sapiens
ggattcaggctgc

SEQ ID NO: 1082163 - DNA, 15 bp, Homo sapiens
ggattcaggctgctt

SEQ ID NO: 1082164 - DNA, 15 bp, Homo sapiens
ggattcatttcctgc

SEQ ID NO: 1082165 - DNA, 16 bp, Homo sapiens
ggattcatttcctgcc

SEQ ID NO: 1082166 - DNA, 18 bp, Homo sapiens
ggattcatttcctgccct

SEQ ID NO: 1082167 - DNA, 14 bp, Homo sapiens
ggattccccctgcc

SEQ ID NO: 1082168 - DNA, 23 bp, Homo sapiens
ggattcccctcaatgcagtcagt

SEQ ID NO: 1082169 - DNA, 15 bp, Homo sapiens
ggattcccttctggg

SEQ ID NO: 1082170 - DNA, 15 bp, Homo sapiens
ggattcctgacccag

SEQ ID NO: 1082171 - DNA, 16 bp, Homo sapiens
ggattcctgacccagg

SEQ ID NO: 1082172 - DNA, 18 bp, Homo sapiens
ggattccttaaacctgaa

SEQ ID NO: 1082173 - DNA, 11 bp, Homo sapiens
ggattctctac

SEQ ID NO: 1082174 - DNA, 19 bp, Homo sapiens
ggattctgggaggaagcag

SEQ ID NO: 1082175 - DNA, 22 bp, Homo sapiens
ggattctgggaggcaagaaaag

SEQ ID NO: 1082176 - DNA, 11 bp, Homo sapiens
ggattcttctt

SEQ ID NO: 1082177 - DNA, 18 bp, Homo sapiens
ggattctttccattatga

SEQ ID NO: 1082178 - DNA, 16 bp, Homo sapiens
ggattctttccccaga

SEQ ID NO: 1082179 - DNA, 16 bp, Homo sapiens
ggattgaagccctcca

SEQ ID NO: 1082180 - DNA, 19 bp, Homo sapiens
ggattgaggggccctggcc

SEQ ID NO: 1082181 - DNA, 15 bp, Homo sapiens
ggattgcgcctttgt

SEQ ID NO: 1082182 - DNA, 16 bp, Homo sapiens
ggattgctatgaatga

SEQ ID NO: 1082183 - DNA, 17 bp, Homo sapiens
ggattgcttgagcccag

SEQ ID NO: 1082184 - DNA, 23 bp, Homo sapiens
ggattgtggttccatgcagcctt

SEQ ID NO: 1082185 - DNA, 23 bp, Homo sapiens
ggattgtgtatctgtgcttctaa

SEQ ID NO: 1082186 - DNA, 12 bp, Homo sapiens
ggatttaacaga

SEQ ID NO: 1082187 - DNA, 17 bp, Homo sapiens
ggatttaacagaaatgt

SEQ ID NO: 1082188 - DNA, 20 bp, Homo sapiens
ggatttaccagcttaagagt

SEQ ID NO: 1082189 - DNA, 15 bp, Homo sapiens
ggatttatgtatttt

SEQ ID NO: 1082190 - DNA, 14 bp, Homo sapiens
ggatttatttaaaa

SEQ ID NO: 1082191 - DNA, 15 bp, Homo sapiens
ggatttccctgcaga

SEQ ID NO: 1082192 - DNA, 23 bp, Homo sapiens
ggatttcctgctttgggaagccg

SEQ ID NO: 1082193 - DNA, 19 bp, Homo sapiens
ggatttgattcattttcct

SEQ ID NO: 1082194 - DNA, 16 bp, Homo sapiens
ggattttaccaaagca

SEQ ID NO: 1082195 - DNA, 17 bp, Homo sapiens
ggattttaccaaagcat

SEQ ID NO: 1082196 - DNA, 19 bp, Homo sapiens
ggattttagcctcttccct

SEQ ID NO: 1082197 - DNA, 22 bp, Homo sapiens
ggattttctattgttactctgg

SEQ ID NO: 1082198 - DNA, 17 bp, Homo sapiens
ggattttgtgttttttc

SEQ ID NO: 1082199 - DNA, 16 bp, Homo sapiens
ggatttttgtcttgtg

SEQ ID NO: 1082200 - DNA, 15 bp, Homo sapiens
ggattttttcccttt

SEQ ID NO: 1082201 - DNA, 15 bp, Homo sapiens
ggcaaaaaaattaaa

SEQ ID NO: 1082202 - DNA, 17 bp, Homo sapiens
ggcaaaaaagggacagc

SEQ ID NO: 1082203 - DNA, 23 bp, Homo sapiens
ggcaaaaatgtccagccaccccc

SEQ ID NO: 1082204 - DNA, 23 bp, Homo sapiens
ggcaaaaggatctttgtggccaa

SEQ ID NO: 1082205 - DNA, 16 bp, Homo sapiens
ggcaaaatccttgctt

SEQ ID NO: 1082206 - DNA, 12 bp, Homo sapiens
ggcaaacaatcc

SEQ ID NO: 1082207 - DNA, 16 bp, Homo sapiens
ggcaaaccctcccaga

SEQ ID NO: 1082208 - DNA, 16 bp, Homo sapiens
ggcaaagatggtggct

SEQ ID NO: 1082209 - DNA, 22 bp, Homo sapiens
ggcaaagcacgaaatgttattt

SEQ ID NO: 1082210 - DNA, 23 bp, Homo sapiens
ggcaaagccacaaggctggccag

SEQ ID NO: 1082211 - DNA, 16 bp, Homo sapiens
ggcaaaggaaggtgga

SEQ ID NO: 1082212 - DNA, 22 bp, Homo sapiens
ggcaaaggaggggaaacaatga

SEQ ID NO: 1082213 - DNA, 20 bp, Homo sapiens
ggcaaaggtggctctccagt

SEQ ID NO: 1082214 - DNA, 14 bp, Homo sapiens
ggcaaagtccagct

SEQ ID NO: 1082215 - DNA, 18 bp, Homo sapiens
ggcaaagttttacagaga

SEQ ID NO: 1082216 - DNA, 17 bp, Homo sapiens
ggcaaataatggaaaaa

SEQ ID NO: 1082217 - DNA, 20 bp, Homo sapiens
ggcaaatcaggggccagaga

SEQ ID NO: 1082218 - DNA, 15 bp, Homo sapiens
ggcaaatggctgaga

SEQ ID NO: 1082219 - DNA, 16 bp, Homo sapiens
ggcaaatgtttattta

SEQ ID NO: 1082220 - DNA, 16 bp, Homo sapiens
ggcaaattaacttgag

SEQ ID NO: 1082221 - DNA, 20 bp, Homo sapiens
ggcaaattaacttgagtttt

SEQ ID NO: 1082222 - DNA, 23 bp, Homo sapiens
ggcaaattattttaatattttgt

SEQ ID NO: 1082223 - DNA, 18 bp, Homo sapiens
ggcaaattcttttgaatt

SEQ ID NO: 1082224 - DNA, 17 bp, Homo sapiens
ggcaaattttaaaacat

SEQ ID NO: 1082225 - DNA, 21 bp, Homo sapiens
ggcaaattttaaaacattttt

SEQ ID NO: 1082226 - DNA, 19 bp, Homo sapiens
ggcaacaagggtccgtgga

SEQ ID NO: 1082227 - DNA, 12 bp, Homo sapiens
ggcaacagagca

SEQ ID NO: 1082228 - DNA, 17 bp, Homo sapiens
ggcaacagagcaagact

SEQ ID NO: 1082229 - DNA, 20 bp, Homo sapiens
ggcaacagggagcacctgtc

SEQ ID NO: 1082230 - DNA, 19 bp, Homo sapiens
ggcaaccacatgtcccaga

SEQ ID NO: 1082231 - DNA, 19 bp, Homo sapiens
ggcaaccactaagaattca

SEQ ID NO: 1082232 - DNA, 21 bp, Homo sapiens
ggcaaccccagttctgctcct

SEQ ID NO: 1082233 - DNA, 22 bp, Homo sapiens
ggcaaccccagttctgctcctc

SEQ ID NO: 1082234 - DNA, 19 bp, Homo sapiens
ggcaaccccctcggagcct

SEQ ID NO: 1082235 - DNA, 17 bp, Homo sapiens
ggcaacgaagaaaaaaa

SEQ ID NO: 1082236 - DNA, 16 bp, Homo sapiens
ggcaactcaaagatga

SEQ ID NO: 1082237 - DNA, 23 bp, Homo sapiens
ggcaactgacattgctccaagat

SEQ ID NO: 1082238 - DNA, 13 bp, Homo sapiens
ggcaactgaggca

SEQ ID NO: 1082239 - DNA, 14 bp, Homo sapiens
ggcaactgaggcag

SEQ ID NO: 1082240 - DNA, 19 bp, Homo sapiens
ggcaactgaggcagacagc

SEQ ID NO: 1082241 - DNA, 15 bp, Homo sapiens
ggcaacttttaaagc

SEQ ID NO: 1082242 - DNA, 14 bp, Homo sapiens
ggcaagaaaaggac

SEQ ID NO: 1082243 - DNA, 24 bp, Homo sapiens
ggcaagacagaaaagtgcctgagc

SEQ ID NO: 1082244 - DNA, 21 bp, Homo sapiens
ggcaagactgcaaactttttt

SEQ ID NO: 1082245 - DNA, 16 bp, Homo sapiens
ggcaagagggagggga

SEQ ID NO: 1082246 - DNA, 14 bp, Homo sapiens
ggcaagaggggtgg

SEQ ID NO: 1082247 - DNA, 19 bp, Homo sapiens
ggcaagattggaaagacag

SEQ ID NO: 1082248 - DNA, 13 bp, Homo sapiens
ggcaagcagctgg

SEQ ID NO: 1082249 - DNA, 17 bp, Homo sapiens
ggcaagcagctggtcag

SEQ ID NO: 1082250 - DNA, 14 bp, Homo sapiens
ggcaagccagggcc

SEQ ID NO: 1082251 - DNA, 21 bp, Homo sapiens
ggcaagccagggcccagagcc

SEQ ID NO: 1082252 - DNA, 22 bp, Homo sapiens
ggcaagccagggcccagagccc

SEQ ID NO: 1082253 - DNA, 16 bp, Homo sapiens
ggcaagcccctcagcc

SEQ ID NO: 1082254 - DNA, 17 bp, Homo sapiens
ggcaagcccctcagccc

SEQ ID NO: 1082255 - DNA, 20 bp, Homo sapiens
ggcaagcccctcagcccttg

SEQ ID NO: 1082256 - DNA, 22 bp, Homo sapiens
ggcaagcccctcagcccttgcc

SEQ ID NO: 1082257 - DNA, 11 bp, Homo sapiens
ggcaagctgca

SEQ ID NO: 1082258 - DNA, 12 bp, Homo sapiens
ggcaagctgcag

SEQ ID NO: 1082259 - DNA, 16 bp, Homo sapiens
ggcaaggagtttatta

SEQ ID NO: 1082260 - DNA, 23 bp, Homo sapiens
ggcaaggagtttattacaatgta

SEQ ID NO: 1082261 - DNA, 19 bp, Homo sapiens
ggcaagggccatgctgaag

SEQ ID NO: 1082262 - DNA, 21 bp, Homo sapiens
ggcaagggccatgctgaaggg

SEQ ID NO: 1082263 - DNA, 19 bp, Homo sapiens
ggcaagggttaaggcctga

SEQ ID NO: 1082264 - DNA, 17 bp, Homo sapiens
ggcaagtagcaggacta

SEQ ID NO: 1082265 - DNA, 14 bp, Homo sapiens
ggcaagtccacccc

SEQ ID NO: 1082266 - DNA, 15 bp, Homo sapiens
ggcaagtccacccca

SEQ ID NO: 1082267 - DNA, 19 bp, Homo sapiens
ggcaagtcggggcctggga

SEQ ID NO: 1082268 - DNA, 18 bp, Homo sapiens
ggcaagtgagaggggagg

SEQ ID NO: 1082269 - DNA, 20 bp, Homo sapiens
ggcaagtgagaggggaggga

SEQ ID NO: 1082270 - DNA, 19 bp, Homo sapiens
ggcaagtgatatcacctct

SEQ ID NO: 1082271 - DNA, 19 bp, Homo sapiens
ggcaagtggatggcccagc

SEQ ID NO: 1082272 - DNA, 13 bp, Homo sapiens
ggcaagtgtgggc

SEQ ID NO: 1082273 - DNA, 20 bp, Homo sapiens
ggcaatagaccgagactccg

SEQ ID NO: 1082274 - DNA, 22 bp, Homo sapiens
ggcaatgccatcagcccctggg

SEQ ID NO: 1082275 - DNA, 20 bp, Homo sapiens
ggcaatgggagctgaggcca

SEQ ID NO: 1082276 - DNA, 15 bp, Homo sapiens
ggcaattctggaagc

SEQ ID NO: 1082277 - DNA, 16 bp, Homo sapiens
ggcaattctggaagct

SEQ ID NO: 1082278 - DNA, 19 bp, Homo sapiens
ggcacaaactgcagctgtg

SEQ ID NO: 1082279 - DNA, 22 bp, Homo sapiens
ggcacaaactgcagctgtgagt

SEQ ID NO: 1082280 - DNA, 23 bp, Homo sapiens
ggcacaagtcctggatgttgtgt

SEQ ID NO: 1082281 - DNA, 18 bp, Homo sapiens
ggcacaatgaatgtatat

SEQ ID NO: 1082282 - DNA, 20 bp, Homo sapiens
ggcacaatggctaattccca

SEQ ID NO: 1082283 - DNA, 22 bp, Homo sapiens
ggcacaatggctaattcccaga

SEQ ID NO: 1082284 - DNA, 21 bp, Homo sapiens
ggcacacaaggggcccttgga

SEQ ID NO: 1082285 - DNA, 20 bp, Homo sapiens
ggcacacaccaccatgctca

SEQ ID NO: 1082286 - DNA, 21 bp, Homo sapiens
ggcacacactgtgccccacaa

SEQ ID NO: 1082287 - DNA, 14 bp, Homo sapiens
ggcacacagactgg

SEQ ID NO: 1082288 - DNA, 13 bp, Homo sapiens
ggcacacagcagc

SEQ ID NO: 1082289 - DNA, 17 bp, Homo sapiens
ggcacacagcagccccc

SEQ ID NO: 1082290 - DNA, 13 bp, Homo sapiens
ggcacaccactgc

SEQ ID NO: 1082291 - DNA, 15 bp, Homo sapiens
ggcacacgcctccca

SEQ ID NO: 1082292 - DNA, 18 bp, Homo sapiens
ggcacagacttctggaag

SEQ ID NO: 1082293 - DNA, 19 bp, Homo sapiens
ggcacagaggaggtcagca

SEQ ID NO: 1082294 - DNA, 22 bp, Homo sapiens
ggcacagattgaagaatctgcc

SEQ ID NO: 1082295 - DNA, 16 bp, Homo sapiens
ggcacagcaggggagc

SEQ ID NO: 1082296 - DNA, 14 bp, Homo sapiens
ggcacagctgccct

SEQ ID NO: 1082297 - DNA, 15 bp, Homo sapiens
ggcacagctgccctg

SEQ ID NO: 1082298 - DNA, 16 bp, Homo sapiens
ggcacagctgccctgc

SEQ ID NO: 1082299 - DNA, 19 bp, Homo sapiens
ggcacagctgggagcctgg

SEQ ID NO: 1082300 - DNA, 15 bp, Homo sapiens
ggcacagctgtctgc

SEQ ID NO: 1082301 - DNA, 16 bp, Homo sapiens
ggcacagctgtctgcc

SEQ ID NO: 1082302 - DNA, 21 bp, Homo sapiens
ggcacagctgtctgccaggca

SEQ ID NO: 1082303 - DNA, 22 bp, Homo sapiens
ggcacagctgtctgccaggcac

SEQ ID NO: 1082304 - DNA, 20 bp, Homo sapiens
ggcacaggagtgtcctcttc

SEQ ID NO: 1082305 - DNA, 13 bp, Homo sapiens
ggcacagtccaga

SEQ ID NO: 1082306 - DNA, 17 bp, Homo sapiens
ggcacagtccagaccca

SEQ ID NO: 1082307 - DNA, 22 bp, Homo sapiens
ggcacagtccaggaacaagcta

SEQ ID NO: 1082308 - DNA, 16 bp, Homo sapiens
ggcacagtgctgcccc

SEQ ID NO: 1082309 - DNA, 20 bp, Homo sapiens
ggcacagtgctgccccttgc

SEQ ID NO: 1082310 - DNA, 21 bp, Homo sapiens
ggcacagtgctgccccttgca

SEQ ID NO: 1082311 - DNA, 13 bp, Homo sapiens
ggcacagtgggag

SEQ ID NO: 1082312 - DNA, 23 bp, Homo sapiens
ggcacagttgtctattctgagcc

SEQ ID NO: 1082313 - DNA, 12 bp, Homo sapiens
ggcacatagaga

SEQ ID NO: 1082314 - DNA, 17 bp, Homo sapiens
ggcacatcagaaaggaa

SEQ ID NO: 1082315 - DNA, 17 bp, Homo sapiens
ggcacatgaaaaatttt

SEQ ID NO: 1082316 - DNA, 15 bp, Homo sapiens
ggcacatgctggccg

SEQ ID NO: 1082317 - DNA, 15 bp, Homo sapiens
ggcacatttcatgag

SEQ ID NO: 1082318 - DNA, 21 bp, Homo sapiens
ggcaccaccagggtggaccag

SEQ ID NO: 1082319 - DNA, 17 bp, Homo sapiens
ggcaccagcagcctgga

SEQ ID NO: 1082320 - DNA, 14 bp, Homo sapiens
ggcaccagccccct

SEQ ID NO: 1082321 - DNA, 19 bp, Homo sapiens
ggcaccagccccctggatg

SEQ ID NO: 1082322 - DNA, 14 bp, Homo sapiens
ggcaccagctctgt

SEQ ID NO: 1082323 - DNA, 18 bp, Homo sapiens
ggcaccagctctgtggcc

SEQ ID NO: 1082324 - DNA, 22 bp, Homo sapiens
ggcaccagctctgtggcctgtg

SEQ ID NO: 1082325 - DNA, 16 bp, Homo sapiens
ggcaccatggtgactg

SEQ ID NO: 1082326 - DNA, 17 bp, Homo sapiens
ggcaccatggtgactgc

SEQ ID NO: 1082327 - DNA, 23 bp, Homo sapiens
ggcacccacaagcccgtgacaga

SEQ ID NO: 1082328 - DNA, 20 bp, Homo sapiens
ggcacccaccgtctcggccc

SEQ ID NO: 1082329 - DNA, 23 bp, Homo sapiens
ggcacccaccgtctcggccctga

SEQ ID NO: 1082330 - DNA, 17 bp, Homo sapiens
ggcacccccatgctgcc

SEQ ID NO: 1082331 - DNA, 14 bp, Homo sapiens
ggcaccccctggag

SEQ ID NO: 1082332 - DNA, 20 bp, Homo sapiens
ggcaccccctggagagaagt

SEQ ID NO: 1082333 - DNA, 12 bp, Homo sapiens
ggcaccctcagg

SEQ ID NO: 1082334 - DNA, 19 bp, Homo sapiens
ggcaccctcagggagcctc

SEQ ID NO: 1082335 - DNA, 20 bp, Homo sapiens
ggcaccctcagggagcctcc

SEQ ID NO: 1082336 - DNA, 15 bp, Homo sapiens
ggcaccgagaatgtt

SEQ ID NO: 1082337 - DNA, 14 bp, Homo sapiens
ggcaccgggctcca

SEQ ID NO: 1082338 - DNA, 18 bp, Homo sapiens
ggcaccgtgtcctcctct

SEQ ID NO: 1082339 - DNA, 18 bp, Homo sapiens
ggcacctatagtcccagc

SEQ ID NO: 1082340 - DNA, 12 bp, Homo sapiens
ggcacctccagg

SEQ ID NO: 1082341 - DNA, 12 bp, Homo sapiens
ggcacctcttcc

SEQ ID NO: 1082342 - DNA, 13 bp, Homo sapiens
ggcacctgctgga

SEQ ID NO: 1082343 - DNA, 14 bp, Homo sapiens
ggcacctggcctgc

SEQ ID NO: 1082344 - DNA, 15 bp, Homo sapiens
ggcacctggcctgct

SEQ ID NO: 1082345 - DNA, 18 bp, Homo sapiens
ggcacctggcctgctggg

SEQ ID NO: 1082346 - DNA, 14 bp, Homo sapiens
ggcacctggggagt

SEQ ID NO: 1082347 - DNA, 19 bp, Homo sapiens
ggcacctgtttcccgggca

SEQ ID NO: 1082348 - DNA, 21 bp, Homo sapiens
ggcacggccacgtcatgtctc

SEQ ID NO: 1082349 - DNA, 20 bp, Homo sapiens
ggcacggcgggatcctccac

SEQ ID NO: 1082350 - DNA, 21 bp, Homo sapiens
ggcacggcgggatcctccaca

SEQ ID NO: 1082351 - DNA, 16 bp, Homo sapiens
ggcacgggccctccct

SEQ ID NO: 1082352 - DNA, 14 bp, Homo sapiens
ggcacggggacctg

SEQ ID NO: 1082353 - DNA, 14 bp, Homo sapiens
ggcacgggtggtcc

SEQ ID NO: 1082354 - DNA, 15 bp, Homo sapiens
ggcacgggtggtccc

SEQ ID NO: 1082355 - DNA, 15 bp, Homo sapiens
ggcacgtgacaggct

SEQ ID NO: 1082356 - DNA, 21 bp, Homo sapiens
ggcactaaaccacttctctgc

SEQ ID NO: 1082357 - DNA, 15 bp, Homo sapiens
ggcactatttattta

SEQ ID NO: 1082358 - DNA, 21 bp, Homo sapiens
ggcactctcatcaccccagag

SEQ ID NO: 1082359 - DNA, 22 bp, Homo sapiens
ggcactctcatcaccccagagg

SEQ ID NO: 1082360 - DNA, 20 bp, Homo sapiens
ggcactgaacaggctggggc

SEQ ID NO: 1082361 - DNA, 23 bp, Homo sapiens
ggcactgaagtggccctccctca

SEQ ID NO: 1082362 - DNA, 17 bp, Homo sapiens
ggcactgagatatttat

SEQ ID NO: 1082363 - DNA, 23 bp, Homo sapiens
ggcactgagcccccccaacactg

SEQ ID NO: 1082364 - DNA, 23 bp, Homo sapiens
ggcactgccttctcctctctggg

SEQ ID NO: 1082365 - DNA, 19 bp, Homo sapiens
ggcactgcgatcaggaaga

SEQ ID NO: 1082366 - DNA, 13 bp, Homo sapiens
ggcactggcactg

SEQ ID NO: 1082367 - DNA, 21 bp, Homo sapiens
ggcactggcattgtccctgtg

SEQ ID NO: 1082368 - DNA, 19 bp, Homo sapiens
ggcactggccacccctccc

SEQ ID NO: 1082369 - DNA, 13 bp, Homo sapiens
ggcactggcccag

SEQ ID NO: 1082370 - DNA, 19 bp, Homo sapiens
ggcactgggaggcagggct

SEQ ID NO: 1082371 - DNA, 19 bp, Homo sapiens
ggcactgggatgagccgct

SEQ ID NO: 1082372 - DNA, 21 bp, Homo sapiens
ggcactggtaggttgggacac

SEQ ID NO: 1082373 - DNA, 16 bp, Homo sapiens
ggcactggtggcatcg

SEQ ID NO: 1082374 - DNA, 15 bp, Homo sapiens
ggcactggtggcccg

SEQ ID NO: 1082375 - DNA, 12 bp, Homo sapiens
ggcactgtggcc

SEQ ID NO: 1082376 - DNA, 17 bp, Homo sapiens
ggcacttaagtgcactt

SEQ ID NO: 1082377 - DNA, 13 bp, Homo sapiens
ggcacttaatttg

SEQ ID NO: 1082378 - DNA, 14 bp, Homo sapiens
ggcacttcaggtcc

SEQ ID NO: 1082379 - DNA, 18 bp, Homo sapiens
ggcacttcaggtccgtgg

SEQ ID NO: 1082380 - DNA, 19 bp, Homo sapiens
ggcacttcaggtccgtggg

SEQ ID NO: 1082381 - DNA, 22 bp, Homo sapiens
ggcacttcaggtccgtgggccg

SEQ ID NO: 1082382 - DNA, 22 bp, Homo sapiens
ggcacttccattggttcttcct

SEQ ID NO: 1082383 - DNA, 15 bp, Homo sapiens
ggcacttcctccaca

SEQ ID NO: 1082384 - DNA, 13 bp, Homo sapiens
ggcacttggagga

SEQ ID NO: 1082385 - DNA, 10 bp, Homo sapiens
ggcacttgta

SEQ ID NO: 1082386 - DNA, 13 bp, Homo sapiens
ggcacttgtattt

SEQ ID NO: 1082387 - DNA, 14 bp, Homo sapiens
ggcacttgtattta

SEQ ID NO: 1082388 - DNA, 16 bp, Homo sapiens
ggcactttaaaacact

SEQ ID NO: 1082389 - DNA, 22 bp, Homo sapiens
ggcactttgaaggggcctcacc

SEQ ID NO: 1082390 - DNA, 23 bp, Homo sapiens
ggcagaaaagaggagaccctgga

SEQ ID NO: 1082391 - DNA, 22 bp, Homo sapiens
ggcagaaacctatctcagggag

SEQ ID NO: 1082392 - DNA, 17 bp, Homo sapiens
ggcagaaatacagtctt

SEQ ID NO: 1082393 - DNA, 23 bp, Homo sapiens
ggcagaaatcgagagtgtgctct

SEQ ID NO: 1082394 - DNA, 14 bp, Homo sapiens
ggcagaactgagct

SEQ ID NO: 1082395 - DNA, 23 bp, Homo sapiens
ggcagaagaattgaacccaggag

SEQ ID NO: 1082396 - DNA, 11 bp, Homo sapiens
ggcagaagaga

SEQ ID NO: 1082397 - DNA, 19 bp, Homo sapiens
ggcagaagagaaaggactc

SEQ ID NO: 1082398 - DNA, 17 bp, Homo sapiens
ggcagaaggcaaaccca

SEQ ID NO: 1082399 - DNA, 11 bp, Homo sapiens
ggcagaaggga

SEQ ID NO: 1082400 - DNA, 21 bp, Homo sapiens
ggcagaagtgtcaccctgtgg

SEQ ID NO: 1082401 - DNA, 19 bp, Homo sapiens
ggcagaataatctttgggt

SEQ ID NO: 1082402 - DNA, 16 bp, Homo sapiens
ggcagacaaccttgtc

SEQ ID NO: 1082403 - DNA, 15 bp, Homo sapiens
ggcagacaagagctg

SEQ ID NO: 1082404 - DNA, 19 bp, Homo sapiens
ggcagacaagagctgctgt

SEQ ID NO: 1082405 - DNA, 19 bp, Homo sapiens
ggcagacacggatctgaga

SEQ ID NO: 1082406 - DNA, 17 bp, Homo sapiens
ggcagacagcagctcag

SEQ ID NO: 1082407 - DNA, 18 bp, Homo sapiens
ggcagacagcagctcagg

SEQ ID NO: 1082408 - DNA, 21 bp, Homo sapiens
ggcagacatgccttggtgccg

SEQ ID NO: 1082409 - DNA, 19 bp, Homo sapiens
ggcagaccctgagcagaat

SEQ ID NO: 1082410 - DNA, 16 bp, Homo sapiens
ggcagaccgggccccc

SEQ ID NO: 1082411 - DNA, 17 bp, Homo sapiens
ggcagaccgggcccccc

SEQ ID NO: 1082412 - DNA, 15 bp, Homo sapiens
ggcagactacacagg

SEQ ID NO: 1082413 - DNA, 18 bp, Homo sapiens
ggcagactctttaataaa

SEQ ID NO: 1082414 - DNA, 21 bp, Homo sapiens
ggcagactctttaataaattg

SEQ ID NO: 1082415 - DNA, 14 bp, Homo sapiens
ggcagagaaagaag

SEQ ID NO: 1082416 - DNA, 17 bp, Homo sapiens
ggcagagaaagaagaga

SEQ ID NO: 1082417 - DNA, 18 bp, Homo sapiens
ggcagagaaagaagagac

SEQ ID NO: 1082418 - DNA, 21 bp, Homo sapiens
ggcagagaaagaagagacagg

SEQ ID NO: 1082419 - DNA, 12 bp, Homo sapiens
ggcagagaataa

SEQ ID NO: 1082420 - DNA, 12 bp, Homo sapiens
ggcagagaggaa

SEQ ID NO: 1082421 - DNA, 15 bp, Homo sapiens
ggcagagaggaagtg

SEQ ID NO: 1082422 - DNA, 18 bp, Homo sapiens
ggcagagaggagtgaccg

SEQ ID NO: 1082423 - DNA, 19 bp, Homo sapiens
ggcagagagtacagactgc

SEQ ID NO: 1082424 - DNA, 20 bp, Homo sapiens
ggcagagcacagcccacggg

SEQ ID NO: 1082425 - DNA, 12 bp, Homo sapiens
ggcagagcattt

SEQ ID NO: 1082426 - DNA, 12 bp, Homo sapiens
ggcagagccagg

SEQ ID NO: 1082427 - DNA, 13 bp, Homo sapiens
ggcagagccagga

SEQ ID NO: 1082428 - DNA, 16 bp, Homo sapiens
ggcagagccaggaaga

SEQ ID NO: 1082429 - DNA, 13 bp, Homo sapiens
ggcagagccaggc

SEQ ID NO: 1082430 - DNA, 15 bp, Homo sapiens
ggcagagccaggctg

SEQ ID NO: 1082431 - DNA, 15 bp, Homo sapiens
ggcagagcctctgag

SEQ ID NO: 1082432 - DNA, 12 bp, Homo sapiens
ggcagagcctgt

SEQ ID NO: 1082433 - DNA, 15 bp, Homo sapiens
ggcagagcctgtccc

SEQ ID NO: 1082434 - DNA, 16 bp, Homo sapiens
ggcagagcgggaggga

SEQ ID NO: 1082435 - DNA, 19 bp, Homo sapiens
ggcagagcgggagggagtc

SEQ ID NO: 1082436 - DNA, 24 bp, Homo sapiens
ggcagagctggagcccccagcaga

SEQ ID NO: 1082437 - DNA, 17 bp, Homo sapiens
ggcagagctggctctga

SEQ ID NO: 1082438 - DNA, 20 bp, Homo sapiens
ggcagaggaccaggctgtag

SEQ ID NO: 1082439 - DNA, 22 bp, Homo sapiens
ggcagaggcctgggctgggaaa

SEQ ID NO: 1082440 - DNA, 19 bp, Homo sapiens
ggcagaggctggaggcagg

SEQ ID NO: 1082441 - DNA, 22 bp, Homo sapiens
ggcagaggctggaggcagggcc

SEQ ID NO: 1082442 - DNA, 23 bp, Homo sapiens
ggcagaggctggaggcagggcct

SEQ ID NO: 1082443 - DNA, 15 bp, Homo sapiens
ggcagaggctggcac

SEQ ID NO: 1082444 - DNA, 16 bp, Homo sapiens
ggcagaggctggcacc

SEQ ID NO: 1082445 - DNA, 14 bp, Homo sapiens
ggcagagggcagag

SEQ ID NO: 1082446 - DNA, 12 bp, Homo sapiens
ggcagagggctg

SEQ ID NO: 1082447 - DNA, 18 bp, Homo sapiens
ggcagaggttcatttcaa

SEQ ID NO: 1082448 - DNA, 20 bp, Homo sapiens
ggcagaggttgcagtgagcc

SEQ ID NO: 1082449 - DNA, 21 bp, Homo sapiens
ggcagagtggcgtggcctccc

SEQ ID NO: 1082450 - DNA, 16 bp, Homo sapiens
ggcagagttgtaaata

SEQ ID NO: 1082451 - DNA, 17 bp, Homo sapiens
ggcagagttgtaaatat

SEQ ID NO: 1082452 - DNA, 18 bp, Homo sapiens
ggcagagttgtaaatata

SEQ ID NO: 1082453 - DNA, 22 bp, Homo sapiens
ggcagagttgtaaatatataaa

SEQ ID NO: 1082454 - DNA, 15 bp, Homo sapiens
ggcagataatcagcc

SEQ ID NO: 1082455 - DNA, 18 bp, Homo sapiens
ggcagataatcagcctct

SEQ ID NO: 1082456 - DNA, 18 bp, Homo sapiens
ggcagatcaccagaggtc

SEQ ID NO: 1082457 - DNA, 16 bp, Homo sapiens
ggcagatctgtgcccc

SEQ ID NO: 1082458 - DNA, 18 bp, Homo sapiens
ggcagatctgtgccccat

SEQ ID NO: 1082459 - DNA, 15 bp, Homo sapiens
ggcagatcttttctt

SEQ ID NO: 1082460 - DNA, 17 bp, Homo sapiens
ggcagatcttttcttta

SEQ ID NO: 1082461 - DNA, 20 bp, Homo sapiens
ggcagatgtcccccactgct

SEQ ID NO: 1082462 - DNA, 21 bp, Homo sapiens
ggcagatgtcccccactgcta

SEQ ID NO: 1082463 - DNA, 22 bp, Homo sapiens
ggcagatgtcttccctgggctg

SEQ ID NO: 1082464 - DNA, 16 bp, Homo sapiens
ggcagattttacaaaa

SEQ ID NO: 1082465 - DNA, 17 bp, Homo sapiens
ggcagattttcatgcaa

SEQ ID NO: 1082466 - DNA, 19 bp, Homo sapiens
ggcagcaaagaggggcgct

SEQ ID NO: 1082467 - DNA, 20 bp, Homo sapiens
ggcagcaaagaggggcgctg

SEQ ID NO: 1082468 - DNA, 17 bp, Homo sapiens
ggcagcaacaataaata

SEQ ID NO: 1082469 - DNA, 16 bp, Homo sapiens
ggcagcaaggctgctg

SEQ ID NO: 1082470 - DNA, 21 bp, Homo sapiens
ggcagcaaggctgctgccgga

SEQ ID NO: 1082471 - DNA, 16 bp, Homo sapiens
ggcagcaatggcgctg

SEQ ID NO: 1082472 - DNA, 20 bp, Homo sapiens
ggcagcaatggcgctgtgcg

SEQ ID NO: 1082473 - DNA, 15 bp, Homo sapiens
ggcagcaatttaaat

SEQ ID NO: 1082474 - DNA, 16 bp, Homo sapiens
ggcagcaatttaaatg

SEQ ID NO: 1082475 - DNA, 16 bp, Homo sapiens
ggcagcacagcccagg

SEQ ID NO: 1082476 - DNA, 19 bp, Homo sapiens
ggcagcacagcccagggcc

SEQ ID NO: 1082477 - DNA, 19 bp, Homo sapiens
ggcagcaccctataaatca

SEQ ID NO: 1082478 - DNA, 15 bp, Homo sapiens
ggcagcaccctcccc

SEQ ID NO: 1082479 - DNA, 16 bp, Homo sapiens
ggcagcaccctccccc

SEQ ID NO: 1082480 - DNA, 18 bp, Homo sapiens
ggcagcacctctggtcag

SEQ ID NO: 1082481 - DNA, 18 bp, Homo sapiens
ggcagcacgcaggcgggg

SEQ ID NO: 1082482 - DNA, 13 bp, Homo sapiens
ggcagcactggga

SEQ ID NO: 1082483 - DNA, 16 bp, Homo sapiens
ggcagcactgggaagc

SEQ ID NO: 1082484 - DNA, 13 bp, Homo sapiens
ggcagcagcaggt

SEQ ID NO: 1082485 - DNA, 19 bp, Homo sapiens
ggcagcagcatcccagcct

SEQ ID NO: 1082486 - DNA, 12 bp, Homo sapiens
ggcagcagccat

SEQ ID NO: 1082487 - DNA, 14 bp, Homo sapiens
ggcagcaggaggag

SEQ ID NO: 1082488 - DNA, 12 bp, Homo sapiens
ggcagcaggggc

SEQ ID NO: 1082489 - DNA, 16 bp, Homo sapiens
ggcagcaggggctgct

SEQ ID NO: 1082490 - DNA, 13 bp, Homo sapiens
ggcagcagtgggg

SEQ ID NO: 1082491 - DNA, 15 bp, Homo sapiens
ggcagcagtggggtg

SEQ ID NO: 1082492 - DNA, 13 bp, Homo sapiens
ggcagcagtgtga

SEQ ID NO: 1082493 - DNA, 20 bp, Homo sapiens
ggcagcagtgtgaggccagg

SEQ ID NO: 1082494 - DNA, 14 bp, Homo sapiens
ggcagcatgcccag

SEQ ID NO: 1082495 - DNA, 19 bp, Homo sapiens
ggcagcatgcccagattcc

SEQ ID NO: 1082496 - DNA, 15 bp, Homo sapiens
ggcagccacaggact

SEQ ID NO: 1082497 - DNA, 17 bp, Homo sapiens
ggcagccacaggactga

SEQ ID NO: 1082498 - DNA, 12 bp, Homo sapiens
ggcagccaccca

SEQ ID NO: 1082499 - DNA, 13 bp, Homo sapiens
ggcagccagacca

SEQ ID NO: 1082500 - DNA, 15 bp, Homo sapiens
ggcagccagaccagc

SEQ ID NO: 1082501 - DNA, 15 bp, Homo sapiens
ggcagccagacccag

SEQ ID NO: 1082502 - DNA, 15 bp, Homo sapiens
ggcagccaggctgcc

SEQ ID NO: 1082503 - DNA, 14 bp, Homo sapiens
ggcagccaggctgg

SEQ ID NO: 1082504 - DNA, 13 bp, Homo sapiens
ggcagccagggct

SEQ ID NO: 1082505 - DNA, 14 bp, Homo sapiens
ggcagccagtgaga

SEQ ID NO: 1082506 - DNA, 12 bp, Homo sapiens
ggcagccatgcc

SEQ ID NO: 1082507 - DNA, 16 bp, Homo sapiens
ggcagccatgcctcat

SEQ ID NO: 1082508 - DNA, 19 bp, Homo sapiens
ggcagccatgcctcatgcc

SEQ ID NO: 1082509 - DNA, 21 bp, Homo sapiens
ggcagccatgcctcatgccac

SEQ ID NO: 1082510 - DNA, 15 bp, Homo sapiens
ggcagcccagagact

SEQ ID NO: 1082511 - DNA, 22 bp, Homo sapiens
ggcagcccagagactttgtaga

SEQ ID NO: 1082512 - DNA, 15 bp, Homo sapiens
ggcagccccacagtc

SEQ ID NO: 1082513 - DNA, 21 bp, Homo sapiens
ggcagccccacttcaccccca

SEQ ID NO: 1082514 - DNA, 16 bp, Homo sapiens
ggcagcccccccctca

SEQ ID NO: 1082515 - DNA, 14 bp, Homo sapiens
ggcagcccggctgc

SEQ ID NO: 1082516 - DNA, 18 bp, Homo sapiens
ggcagcccggctgctgct

SEQ ID NO: 1082517 - DNA, 13 bp, Homo sapiens
ggcagccctcacc

SEQ ID NO: 1082518 - DNA, 17 bp, Homo sapiens
ggcagccctcacctctg

SEQ ID NO: 1082519 - DNA, 18 bp, Homo sapiens
ggcagccctcacctctga

SEQ ID NO: 1082520 - DNA, 22 bp, Homo sapiens
ggcagccctcacctctgaggac

SEQ ID NO: 1082521 - DNA, 13 bp, Homo sapiens
ggcagccctgagt

SEQ ID NO: 1082522 - DNA, 13 bp, Homo sapiens
ggcagccctgtag

SEQ ID NO: 1082523 - DNA, 15 bp, Homo sapiens
ggcagccctgtaggg

SEQ ID NO: 1082524 - DNA, 21 bp, Homo sapiens
ggcagcccttgcttgttggga

SEQ ID NO: 1082525 - DNA, 17 bp, Homo sapiens
ggcagccgctaggagag

SEQ ID NO: 1082526 - DNA, 16 bp, Homo sapiens
ggcagccgtcccaggc

SEQ ID NO: 1082527 - DNA, 20 bp, Homo sapiens
ggcagccgtcccaggccacc

SEQ ID NO: 1082528 - DNA, 22 bp, Homo sapiens
ggcagcctccaccttgctcttc

SEQ ID NO: 1082529 - DNA, 14 bp, Homo sapiens
ggcagcctccagag

SEQ ID NO: 1082530 - DNA, 16 bp, Homo sapiens
ggcagcctccagagcc

SEQ ID NO: 1082531 - DNA, 22 bp, Homo sapiens
ggcagcctccagagccagcctg

SEQ ID NO: 1082532 - DNA, 23 bp, Homo sapiens
ggcagcctccagagccagcctgg

SEQ ID NO: 1082533 - DNA, 24 bp, Homo sapiens
ggcagcctccagagccagcctggg

SEQ ID NO: 1082534 - DNA, 22 bp, Homo sapiens
ggcagcctcccatccagggccc

SEQ ID NO: 1082535 - DNA, 15 bp, Homo sapiens
ggcagcctcctttgt

SEQ ID NO: 1082536 - DNA, 20 bp, Homo sapiens
ggcagcctggacatagagag

SEQ ID NO: 1082537 - DNA, 22 bp, Homo sapiens
ggcagccttgggggggctgcct

SEQ ID NO: 1082538 - DNA, 14 bp, Homo sapiens
ggcagcctttccag

SEQ ID NO: 1082539 - DNA, 18 bp, Homo sapiens
ggcagcgtgggctctgcc

SEQ ID NO: 1082540 - DNA, 19 bp, Homo sapiens
ggcagcgtgggctctgcca

SEQ ID NO: 1082541 - DNA, 13 bp, Homo sapiens
ggcagctagtgcc

SEQ ID NO: 1082542 - DNA, 18 bp, Homo sapiens
ggcagctatctgcactct

SEQ ID NO: 1082543 - DNA, 15 bp, Homo sapiens
ggcagctcaaagact

SEQ ID NO: 1082544 - DNA, 18 bp, Homo sapiens
ggcagctcacccctgggc

SEQ ID NO: 1082545 - DNA, 18 bp, Homo sapiens
ggcagctcctccctgtgc

SEQ ID NO: 1082546 - DNA, 13 bp, Homo sapiens
ggcagctctccag

SEQ ID NO: 1082547 - DNA, 16 bp, Homo sapiens
ggcagctcttctggag

SEQ ID NO: 1082548 - DNA, 17 bp, Homo sapiens
ggcagctcttctgggca

SEQ ID NO: 1082549 - DNA, 21 bp, Homo sapiens
ggcagctgaactattggaggg

SEQ ID NO: 1082550 - DNA, 18 bp, Homo sapiens
ggcagctgagaccagggt

SEQ ID NO: 1082551 - DNA, 22 bp, Homo sapiens
ggcagctgagagccctgctgtg

SEQ ID NO: 1082552 - DNA, 23 bp, Homo sapiens
ggcagctgaggacacaccccaca

SEQ ID NO: 1082553 - DNA, 11 bp, Homo sapiens
ggcagctgcca

SEQ ID NO: 1082554 - DNA, 17 bp, Homo sapiens
ggcagctgccagagaag

SEQ ID NO: 1082555 - DNA, 19 bp, Homo sapiens
ggcagctgcctctgctccc

SEQ ID NO: 1082556 - DNA, 20 bp, Homo sapiens
ggcagctgcctctgctccct

SEQ ID NO: 1082557 - DNA, 15 bp, Homo sapiens
ggcagctgcctggcc

SEQ ID NO: 1082558 - DNA, 21 bp, Homo sapiens
ggcagctgcctggccatgctg

SEQ ID NO: 1082559 - DNA, 11 bp, Homo sapiens
ggcagctgcta

SEQ ID NO: 1082560 - DNA, 22 bp, Homo sapiens
ggcagctgctcttagtgcccgc

SEQ ID NO: 1082561 - DNA, 23 bp, Homo sapiens
ggcagctgctcttagtgcccgcc

SEQ ID NO: 1082562 - DNA, 16 bp, Homo sapiens
ggcagctggatgagac

SEQ ID NO: 1082563 - DNA, 22 bp, Homo sapiens
ggcagctggcccccagccctgg

SEQ ID NO: 1082564 - DNA, 11 bp, Homo sapiens
ggcagctgggc

SEQ ID NO: 1082565 - DNA, 20 bp, Homo sapiens
ggcagctgggccccacctac

SEQ ID NO: 1082566 - DNA, 14 bp, Homo sapiens
ggcagctgtcctga

SEQ ID NO: 1082567 - DNA, 17 bp, Homo sapiens
ggcagctgtcctgaacc

SEQ ID NO: 1082568 - DNA, 12 bp, Homo sapiens
ggcagctgtgat

SEQ ID NO: 1082569 - DNA, 16 bp, Homo sapiens
ggcagcttagggccct

SEQ ID NO: 1082570 - DNA, 22 bp, Homo sapiens
ggcagcttctgttggcagagct

SEQ ID NO: 1082571 - DNA, 18 bp, Homo sapiens
ggccctcccccagctcct

SEQ ID NO: 1082572 - DNA, 22 bp, Homo sapiens
ggccctcccccagctccttggc

SEQ ID NO: 1082573 - DNA, 13 bp, Homo sapiens
ggccctccctcag

SEQ ID NO: 1082574 - DNA, 13 bp, Homo sapiens
ggccctccctccc

SEQ ID NO: 1082575 - DNA, 16 bp, Homo sapiens
ggccctccctcccagc

SEQ ID NO: 1082576 - DNA, 23 bp, Homo sapiens
ggccctccctcccagcgctctgg

SEQ ID NO: 1082577 - DNA, 18 bp, Homo sapiens
ggccctccctccctagcc

SEQ ID NO: 1082578 - DNA, 22 bp, Homo sapiens
ggccctccctccctagcccttc

SEQ ID NO: 1082579 - DNA, 23 bp, Homo sapiens
ggccctccctgactccctgtggg

SEQ ID NO: 1082580 - DNA, 23 bp, Homo sapiens
ggccctcccttggaaacctgccc

SEQ ID NO: 1082581 - DNA, 20 bp, Homo sapiens
ggccctcctgtgctggggga

SEQ ID NO: 1082582 - DNA, 19 bp, Homo sapiens
ggccctcgctgccagctct

SEQ ID NO: 1082583 - DNA, 15 bp, Homo sapiens
ggccctcggagctgg

SEQ ID NO: 1082584 - DNA, 16 bp, Homo sapiens
ggccctctatgctggc

SEQ ID NO: 1082585 - DNA, 16 bp, Homo sapiens
ggccctctctctgggc

SEQ ID NO: 1082586 - DNA, 14 bp, Homo sapiens
ggccctctctgctc

SEQ ID NO: 1082587 - DNA, 20 bp, Homo sapiens
ggccctctcttctcaccttt

SEQ ID NO: 1082588 - DNA, 13 bp, Homo sapiens
ggccctctgcctg

SEQ ID NO: 1082589 - DNA, 19 bp, Homo sapiens
ggccctctgcctgcactcc

SEQ ID NO: 1082590 - DNA, 18 bp, Homo sapiens
ggccctctggagtggcca

SEQ ID NO: 1082591 - DNA, 19 bp, Homo sapiens
ggccctctggagtggccac

SEQ ID NO: 1082592 - DNA, 16 bp, Homo sapiens
ggccctctgtggcctg

SEQ ID NO: 1082593 - DNA, 17 bp, Homo sapiens
ggccctctgtggcctgt

SEQ ID NO: 1082594 - DNA, 22 bp, Homo sapiens
ggccctctgtggtcacagaggg

SEQ ID NO: 1082595 - DNA, 13 bp, Homo sapiens
ggccctcttgcca

SEQ ID NO: 1082596 - DNA, 16 bp, Homo sapiens
ggccctctttccctgc

SEQ ID NO: 1082597 - DNA, 16 bp, Homo sapiens
ggccctgaaccacgag

SEQ ID NO: 1082598 - DNA, 18 bp, Homo sapiens
ggccctgaaccacgaggc

SEQ ID NO: 1082599 - DNA, 22 bp, Homo sapiens
ggccctgactcctctggctttc

SEQ ID NO: 1082600 - DNA, 19 bp, Homo sapiens
ggccctgagctcggtggac

SEQ ID NO: 1082601 - DNA, 15 bp, Homo sapiens
ggccctgaggtgtgg

SEQ ID NO: 1082602 - DNA, 19 bp, Homo sapiens
ggccctgaggtgtgggggc

SEQ ID NO: 1082603 - DNA, 22 bp, Homo sapiens
ggccctgaggtgtgggggctgc

SEQ ID NO: 1082604 - DNA, 17 bp, Homo sapiens
ggccctgcaaaaatata

SEQ ID NO: 1082605 - DNA, 16 bp, Homo sapiens
ggccctgcaggagcag

SEQ ID NO: 1082606 - DNA, 14 bp, Homo sapiens
ggccctgcaggctg

SEQ ID NO: 1082607 - DNA, 15 bp, Homo sapiens
ggccctgcaggctgc

SEQ ID NO: 1082608 - DNA, 21 bp, Homo sapiens
ggccctgccacgtcccgctgc

SEQ ID NO: 1082609 - DNA, 23 bp, Homo sapiens
ggccctgccacgtcccgctgcct

SEQ ID NO: 1082610 - DNA, 18 bp, Homo sapiens
ggccctgccatcttccca

SEQ ID NO: 1082611 - DNA, 11 bp, Homo sapiens
ggccctgcccc

SEQ ID NO: 1082612 - DNA, 13 bp, Homo sapiens
ggccctgccccac

SEQ ID NO: 1082613 - DNA, 16 bp, Homo sapiens
ggccctgccccacccc

SEQ ID NO: 1082614 - DNA, 19 bp, Homo sapiens
ggccctgccccagccccta

SEQ ID NO: 1082615 - DNA, 17 bp, Homo sapiens
ggccctgccccaggcct

SEQ ID NO: 1082616 - DNA, 18 bp, Homo sapiens
ggccctgccccaggcctg

SEQ ID NO: 1082617 - DNA, 22 bp, Homo sapiens
ggccctgcccctaggatgctgc

SEQ ID NO: 1082618 - DNA, 23 bp, Homo sapiens
ggccctgcccggggagctgcaga

SEQ ID NO: 1082619 - DNA, 13 bp, Homo sapiens
ggccctgccctgt

SEQ ID NO: 1082620 - DNA, 19 bp, Homo sapiens
ggccctgcccttggcacca

SEQ ID NO: 1082621 - DNA, 13 bp, Homo sapiens
ggccctgcctccg

SEQ ID NO: 1082622 - DNA, 19 bp, Homo sapiens
ggccctgcgtcggccctgg

SEQ ID NO: 1082623 - DNA, 20 bp, Homo sapiens
ggccctgcgtcggccctggg

SEQ ID NO: 1082624 - DNA, 15 bp, Homo sapiens
ggccctgctcctgca

SEQ ID NO: 1082625 - DNA, 20 bp, Homo sapiens
ggccctgctgagtcatctgt

SEQ ID NO: 1082626 - DNA, 20 bp, Homo sapiens
ggccctggagccagggcaga

SEQ ID NO: 1082627 - DNA, 12 bp, Homo sapiens
ggccctggaggc

SEQ ID NO: 1082628 - DNA, 12 bp, Homo sapiens
ggccctggcctg

SEQ ID NO: 1082629 - DNA, 22 bp, Homo sapiens
ggccctggctcccacaggccct

SEQ ID NO: 1082630 - DNA, 13 bp, Homo sapiens
ggccctgggctga

SEQ ID NO: 1082631 - DNA, 23 bp, Homo sapiens
ggccctggggatcttcccacagg

SEQ ID NO: 1082632 - DNA, 11 bp, Homo sapiens
ggccctggggg

SEQ ID NO: 1082633 - DNA, 19 bp, Homo sapiens
ggccctgggggtctgggcg

SEQ ID NO: 1082634 - DNA, 22 bp, Homo sapiens
ggccctggggtgtgtctcggtg

SEQ ID NO: 1082635 - DNA, 17 bp, Homo sapiens
ggccctggtcctggcct

SEQ ID NO: 1082636 - DNA, 18 bp, Homo sapiens
ggccctggtcctggcctc

SEQ ID NO: 1082637 - DNA, 15 bp, Homo sapiens
ggccctggtgtcagg

SEQ ID NO: 1082638 - DNA, 12 bp, Homo sapiens
ggccctgtacag

SEQ ID NO: 1082639 - DNA, 19 bp, Homo sapiens
ggccctgtcatccagctca

SEQ ID NO: 1082640 - DNA, 15 bp, Homo sapiens
ggccctgtcccaggc

SEQ ID NO: 1082641 - DNA, 20 bp, Homo sapiens
ggccctgtgatatggcggcc

SEQ ID NO: 1082642 - DNA, 10 bp, Homo sapiens
ggccctgtgg

SEQ ID NO: 1082643 - DNA, 13 bp, Homo sapiens
ggccctgtggagt

SEQ ID NO: 1082644 - DNA, 15 bp, Homo sapiens
ggccctgtggcagga

SEQ ID NO: 1082645 - DNA, 20 bp, Homo sapiens
ggccctgtgtgtttgacatg

SEQ ID NO: 1082646 - DNA, 18 bp, Homo sapiens
ggccctgttccctggagt

SEQ ID NO: 1082647 - DNA, 22 bp, Homo sapiens
ggccctgttccctggagtcagg

SEQ ID NO: 1082648 - DNA, 20 bp, Homo sapiens
ggcccttacttgcttctcta

SEQ ID NO: 1082649 - DNA, 11 bp, Homo sapiens
ggcccttcagt

SEQ ID NO: 1082650 - DNA, 21 bp, Homo sapiens
ggcccttcagtctgctccacc

SEQ ID NO: 1082651 - DNA, 15 bp, Homo sapiens
ggcccttcccctccc

SEQ ID NO: 1082652 - DNA, 13 bp, Homo sapiens
ggcccttcctctc

SEQ ID NO: 1082653 - DNA, 19 bp, Homo sapiens
ggcccttcctctccactgc

SEQ ID NO: 1082654 - DNA, 16 bp, Homo sapiens
ggcccttcctctttgg

SEQ ID NO: 1082655 - DNA, 15 bp, Homo sapiens
ggcccttctgtccac

SEQ ID NO: 1082656 - DNA, 19 bp, Homo sapiens
ggcccttcttgctgccctg

SEQ ID NO: 1082657 - DNA, 10 bp, Homo sapiens
ggcccttgga

SEQ ID NO: 1082658 - DNA, 11 bp, Homo sapiens
ggcccttggaa

SEQ ID NO: 1082659 - DNA, 13 bp, Homo sapiens
ggcccttggaata

SEQ ID NO: 1082660 - DNA, 14 bp, Homo sapiens
ggcccttggaataa

SEQ ID NO: 1082661 - DNA, 15 bp, Homo sapiens
ggcccttggaataaa

SEQ ID NO: 1082662 - DNA, 16 bp, Homo sapiens
ggcccttggggcctgg

SEQ ID NO: 1082663 - DNA, 18 bp, Homo sapiens
ggcccttggggcctggct

SEQ ID NO: 1082664 - DNA, 21 bp, Homo sapiens
ggcccttggggcctggcttgc

SEQ ID NO: 1082665 - DNA, 18 bp, Homo sapiens
ggcccttgtcattgcctt

SEQ ID NO: 1082666 - DNA, 14 bp, Homo sapiens
ggcccttgtcctgc

SEQ ID NO: 1082667 - DNA, 21 bp, Homo sapiens
ggcccttgtcctgccagctgc

SEQ ID NO: 1082668 - DNA, 22 bp, Homo sapiens
ggcccttgtcctgccagctgcc

SEQ ID NO: 1082669 - DNA, 23 bp, Homo sapiens
ggcccttgtcctgccagctgcct

SEQ ID NO: 1082670 - DNA, 15 bp, Homo sapiens
ggcccttgtcttttc

SEQ ID NO: 1082671 - DNA, 11 bp, Homo sapiens
ggccctttcct

SEQ ID NO: 1082672 - DNA, 19 bp, Homo sapiens
ggccctttgaagcctcagc

SEQ ID NO: 1082673 - DNA, 17 bp, Homo sapiens
ggccgaagccccttgga

SEQ ID NO: 1082674 - DNA, 15 bp, Homo sapiens
ggccgaagctctggc

SEQ ID NO: 1082675 - DNA, 21 bp, Homo sapiens
ggccgacagtcggtgacccca

SEQ ID NO: 1082676 - DNA, 16 bp, Homo sapiens
ggccgacattgtctcc

SEQ ID NO: 1082677 - DNA, 17 bp, Homo sapiens
ggccgacgttttctccg

SEQ ID NO: 1082678 - DNA, 12 bp, Homo sapiens
ggccgagctcct

SEQ ID NO: 1082679 - DNA, 21 bp, Homo sapiens
ggccgagctcctggggagctc

SEQ ID NO: 1082680 - DNA, 22 bp, Homo sapiens
ggccgagctcctggggagctcc

SEQ ID NO: 1082681 - DNA, 19 bp, Homo sapiens
ggccgagctgcctggcggg

SEQ ID NO: 1082682 - DNA, 22 bp, Homo sapiens
ggccgaggcgcgtttgtgcata

SEQ ID NO: 1082683 - DNA, 14 bp, Homo sapiens
ggccgagggccagg

SEQ ID NO: 1082684 - DNA, 18 bp, Homo sapiens
ggccgagggtcctggctc

SEQ ID NO: 1082685 - DNA, 20 bp, Homo sapiens
ggccgatttgggaaccaagc

SEQ ID NO: 1082686 - DNA, 22 bp, Homo sapiens
ggccgatttgggaaccaagcta

SEQ ID NO: 1082687 - DNA, 14 bp, Homo sapiens
ggccgcaggaggga

SEQ ID NO: 1082688 - DNA, 15 bp, Homo sapiens
ggccgcaggagggag

SEQ ID NO: 1082689 - DNA, 17 bp, Homo sapiens
ggccgcaggagggaggc

SEQ ID NO: 1082690 - DNA, 16 bp, Homo sapiens
ggccgcagggcccacc

SEQ ID NO: 1082691 - DNA, 16 bp, Homo sapiens
ggccgcataggcccag

SEQ ID NO: 1082692 - DNA, 17 bp, Homo sapiens
ggccgcataggcccagc

SEQ ID NO: 1082693 - DNA, 15 bp, Homo sapiens
ggccgcattccctga

SEQ ID NO: 1082694 - DNA, 16 bp, Homo sapiens
ggccgcattccctgag

SEQ ID NO: 1082695 - DNA, 21 bp, Homo sapiens
ggccgccagcgtgtggagcag

SEQ ID NO: 1082696 - DNA, 15 bp, Homo sapiens
ggcctctctgcctgg

SEQ ID NO: 1082697 - DNA, 13 bp, Homo sapiens
ggcctctctggcc

SEQ ID NO: 1082698 - DNA, 16 bp, Homo sapiens
ggcctctctggcctcc

SEQ ID NO: 1082699 - DNA, 14 bp, Homo sapiens
ggcctctctggggg

SEQ ID NO: 1082700 - DNA, 18 bp, Homo sapiens
ggcctctctgggggaggc

SEQ ID NO: 1082701 - DNA, 21 bp, Homo sapiens
ggcctctctgggggaggcagg

SEQ ID NO: 1082702 - DNA, 14 bp, Homo sapiens
ggcctctgcctggg

SEQ ID NO: 1082703 - DNA, 12 bp, Homo sapiens
ggcctctgctgc

SEQ ID NO: 1082704 - DNA, 17 bp, Homo sapiens
ggcctctgctgccccct

SEQ ID NO: 1082705 - DNA, 18 bp, Homo sapiens
ggcctctggactggcctg

SEQ ID NO: 1082706 - DNA, 19 bp, Homo sapiens
ggcctctggactggcctgt

SEQ ID NO: 1082707 - DNA, 13 bp, Homo sapiens
ggcctctggccct

SEQ ID NO: 1082708 - DNA, 16 bp, Homo sapiens
ggcctctgtgccttct

SEQ ID NO: 1082709 - DNA, 18 bp, Homo sapiens
ggcctcttcaaattagaa

SEQ ID NO: 1082710 - DNA, 14 bp, Homo sapiens
ggcctcttgtccct

SEQ ID NO: 1082711 - DNA, 17 bp, Homo sapiens
ggcctcttgtcccttgg

SEQ ID NO: 1082712 - DNA, 16 bp, Homo sapiens
ggcctcttgtgctcac

SEQ ID NO: 1082713 - DNA, 15 bp, Homo sapiens
ggcctctttttgccc

SEQ ID NO: 1082714 - DNA, 17 bp, Homo sapiens
ggcctctttttgccctt

SEQ ID NO: 1082715 - DNA, 16 bp, Homo sapiens
ggcctgaaacccgccc

SEQ ID NO: 1082716 - DNA, 16 bp, Homo sapiens
ggcctgaactgaggag

SEQ ID NO: 1082717 - DNA, 19 bp, Homo sapiens
ggcctgaagagtcctctga

SEQ ID NO: 1082718 - DNA, 17 bp, Homo sapiens
ggcctgaagccagctgc

SEQ ID NO: 1082719 - DNA, 19 bp, Homo sapiens
ggcctgaagccagctgccc

SEQ ID NO: 1082720 - DNA, 21 bp, Homo sapiens
ggcctgaatcatgagcctgct

SEQ ID NO: 1082721 - DNA, 22 bp, Homo sapiens
ggcctgaatcatgagcctgctg

SEQ ID NO: 1082722 - DNA, 15 bp, Homo sapiens
ggcctgacaccccct

SEQ ID NO: 1082723 - DNA, 17 bp, Homo sapiens
ggcctgacaccccctcc

SEQ ID NO: 1082724 - DNA, 11 bp, Homo sapiens
ggcctgactgt

SEQ ID NO: 1082725 - DNA, 16 bp, Homo sapiens
ggcctgacttgagcca

SEQ ID NO: 1082726 - DNA, 17 bp, Homo sapiens
ggcctgacttgagccac

SEQ ID NO: 1082727 - DNA, 16 bp, Homo sapiens
ggcctgagctggggcc

SEQ ID NO: 1082728 - DNA, 17 bp, Homo sapiens
ggcctgagctggggcca

SEQ ID NO: 1082729 - DNA, 22 bp, Homo sapiens
ggcctgagctggggccacaaat

SEQ ID NO: 1082730 - DNA, 13 bp, Homo sapiens
ggcctgaggatga

SEQ ID NO: 1082731 - DNA, 22 bp, Homo sapiens
ggcctgaggatgagctggaagg

SEQ ID NO: 1082732 - DNA, 18 bp, Homo sapiens
ggcctgatgctccctccc

SEQ ID NO: 1082733 - DNA, 24 bp, Homo sapiens
ggcctgcaaaccttcctgggagga

SEQ ID NO: 1082734 - DNA, 22 bp, Homo sapiens
ggcctgcacagatacctcatca

SEQ ID NO: 1082735 - DNA, 14 bp, Homo sapiens
ggcctgcacagtga

SEQ ID NO: 1082736 - DNA, 21 bp, Homo sapiens
ggcctgcaccgacccgaggcc

SEQ ID NO: 1082737 - DNA, 13 bp, Homo sapiens
ggcctgcactaat

SEQ ID NO: 1082738 - DNA, 19 bp, Homo sapiens
ggcctgcagcaggagtggt

SEQ ID NO: 1082739 - DNA, 20 bp, Homo sapiens
ggcctgcagcaggagtggtg

SEQ ID NO: 1082740 - DNA, 14 bp, Homo sapiens
ggcctgcatggaga

SEQ ID NO: 1082741 - DNA, 15 bp, Homo sapiens
ggcctgcatggagaa

SEQ ID NO: 1082742 - DNA, 17 bp, Homo sapiens
ggcctgcatggagaagg

SEQ ID NO: 1082743 - DNA, 13 bp, Homo sapiens
ggcctgcccagcc

SEQ ID NO: 1082744 - DNA, 14 bp, Homo sapiens
ggcctgccccctgg

SEQ ID NO: 1082745 - DNA, 11 bp, Homo sapiens
ggcctgccctc

SEQ ID NO: 1082746 - DNA, 21 bp, Homo sapiens
ggcctgccgggctgagggcct

SEQ ID NO: 1082747 - DNA, 15 bp, Homo sapiens
ggcctgcctcccact

SEQ ID NO: 1082748 - DNA, 12 bp, Homo sapiens
ggcctgcctgcc

SEQ ID NO: 1082749 - DNA, 22 bp, Homo sapiens
ggcctgcctgccccacccaccc

SEQ ID NO: 1082750 - DNA, 16 bp, Homo sapiens
ggcctgcctgcctcca

SEQ ID NO: 1082751 - DNA, 19 bp, Homo sapiens
ggcctgcctgcctccaccc

SEQ ID NO: 1082752 - DNA, 12 bp, Homo sapiens
ggcctgcctggc

SEQ ID NO: 1082753 - DNA, 18 bp, Homo sapiens
ggcctgcgccagtcctgc

SEQ ID NO: 1082754 - DNA, 15 bp, Homo sapiens
ggcctgcgcccagag

SEQ ID NO: 1082755 - DNA, 18 bp, Homo sapiens
ggcctgctaaggctcctc

SEQ ID NO: 1082756 - DNA, 17 bp, Homo sapiens
ggcctgctgccagtgca

SEQ ID NO: 1082757 - DNA, 20 bp, Homo sapiens
ggcctgctgccagtgcagcc

SEQ ID NO: 1082758 - DNA, 18 bp, Homo sapiens
ggcctgctgcgtcagacc

SEQ ID NO: 1082759 - DNA, 12 bp, Homo sapiens
ggcctgctggga

SEQ ID NO: 1082760 - DNA, 17 bp, Homo sapiens
ggcctgctgggctctcc

SEQ ID NO: 1082761 - DNA, 10 bp, Homo sapiens
ggcctgctgt

SEQ ID NO: 1082762 - DNA, 19 bp, Homo sapiens
ggcctgctgtgattccact

SEQ ID NO: 1082763 - DNA, 16 bp, Homo sapiens
ggcctgcttttccagg

SEQ ID NO: 1082764 - DNA, 17 bp, Homo sapiens
ggcctgcttttccagga

SEQ ID NO: 1082765 - DNA, 24 bp, Homo sapiens
ggcctggaaccagggaggagagga

SEQ ID NO: 1082766 - DNA, 16 bp, Homo sapiens
ggcctggaccgagatg

SEQ ID NO: 1082767 - DNA, 21 bp, Homo sapiens
ggcctggacctatgcagggag

SEQ ID NO: 1082768 - DNA, 15 bp, Homo sapiens
ggcctggacctgcct

SEQ ID NO: 1082769 - DNA, 18 bp, Homo sapiens
ggcctggactttcctgca

SEQ ID NO: 1082770 - DNA, 14 bp, Homo sapiens
ggcctggagaggac

SEQ ID NO: 1082771 - DNA, 21 bp, Homo sapiens
ggcctggagaggacggccctg

SEQ ID NO: 1082772 - DNA, 11 bp, Homo sapiens
ggcctggagat

SEQ ID NO: 1082773 - DNA, 24 bp, Homo sapiens
ggcctggagcgtttgctgtgccag

SEQ ID NO: 1082774 - DNA, 23 bp, Homo sapiens
ggcctggaggaatcactggggat

SEQ ID NO: 1082775 - DNA, 19 bp, Homo sapiens
ggcctggaggtggggttgg

SEQ ID NO: 1082776 - DNA, 15 bp, Homo sapiens
ggcctggcagccgtg

SEQ ID NO: 1082777 - DNA, 14 bp, Homo sapiens
ggcctggcatctgt

SEQ ID NO: 1082778 - DNA, 21 bp, Homo sapiens
ggcctggcatctgtgtgcgtg

SEQ ID NO: 1082779 - DNA, 13 bp, Homo sapiens
ggcctggcattct

SEQ ID NO: 1082780 - DNA, 17 bp, Homo sapiens
ggcctggccacctctct

SEQ ID NO: 1082781 - DNA, 23 bp, Homo sapiens
ggcctggccaggagctcttcagg

SEQ ID NO: 1082782 - DNA, 14 bp, Homo sapiens
ggcctggccatgtg

SEQ ID NO: 1082783 - DNA, 21 bp, Homo sapiens
ggcctggccggcaaccccagt

SEQ ID NO: 1082784 - DNA, 12 bp, Homo sapiens
ggcctggcctcg

SEQ ID NO: 1082785 - DNA, 22 bp, Homo sapiens
ggcctggcctcgcctgcctttc

SEQ ID NO: 1082786 - DNA, 16 bp, Homo sapiens
ggcctggcggcctgtg

SEQ ID NO: 1082787 - DNA, 19 bp, Homo sapiens
ggcctggcggcctgtgggt

SEQ ID NO: 1082788 - DNA, 18 bp, Homo sapiens
ggcctggcgtcggccaga

SEQ ID NO: 1082789 - DNA, 19 bp, Homo sapiens
ggcctggcgtcggccagag

SEQ ID NO: 1082790 - DNA, 15 bp, Homo sapiens
ggcctggctccccac

SEQ ID NO: 1082791 - DNA, 16 bp, Homo sapiens
ggcctggctccccgag

SEQ ID NO: 1082792 - DNA, 21 bp, Homo sapiens
ggcctggcttgctccagggtc

SEQ ID NO: 1082793 - DNA, 20 bp, Homo sapiens
ggcctgggacccagctactc

SEQ ID NO: 1082794 - DNA, 23 bp, Homo sapiens
ggcctgggcagagggcctggacc

SEQ ID NO: 1082795 - DNA, 15 bp, Homo sapiens
ggcctgggccacacc

SEQ ID NO: 1082796 - DNA, 18 bp, Homo sapiens
ggcctggggcctgagaga

SEQ ID NO: 1082797 - DNA, 18 bp, Homo sapiens
ggcctggggctcctttct

SEQ ID NO: 1082798 - DNA, 17 bp, Homo sapiens
ggcctggggtccctctg

SEQ ID NO: 1082799 - DNA, 20 bp, Homo sapiens
ggcctggggtgcatcctcct

SEQ ID NO: 1082800 - DNA, 17 bp, Homo sapiens
ggcctggggtgggacag

SEQ ID NO: 1082801 - DNA, 14 bp, Homo sapiens
ggcctggtagcaca

SEQ ID NO: 1082802 - DNA, 14 bp, Homo sapiens
ggcctggtccctgt

SEQ ID NO: 1082803 - DNA, 11 bp, Homo sapiens
ggcctggtggg

SEQ ID NO: 1082804 - DNA, 20 bp, Homo sapiens
ggcctggtgggtcaggggga

SEQ ID NO: 1082805 - DNA, 21 bp, Homo sapiens
ggcctggtgggtcagggggag

SEQ ID NO: 1082806 - DNA, 15 bp, Homo sapiens
ggcctgtaatcagct

SEQ ID NO: 1082807 - DNA, 23 bp, Homo sapiens
ggcctgtaatcagctctcctggc

SEQ ID NO: 1082808 - DNA, 15 bp, Homo sapiens
ggccgccatctgcgc

SEQ ID NO: 1082809 - DNA, 21 bp, Homo sapiens
ggccgccatctgcgcagggtg

SEQ ID NO: 1082810 - DNA, 22 bp, Homo sapiens
ggccgccatctgcgcagggtgg

SEQ ID NO: 1082811 - DNA, 21 bp, Homo sapiens
ggccgcccccacctgcggccg

SEQ ID NO: 1082812 - DNA, 16 bp, Homo sapiens
ggccgccccctgcccc

SEQ ID NO: 1082813 - DNA, 14 bp, Homo sapiens
ggccgcccctgagg

SEQ ID NO: 1082814 - DNA, 21 bp, Homo sapiens
ggccgcccctgaggcttcacg

SEQ ID NO: 1082815 - DNA, 17 bp, Homo sapiens
ggccgccgccaggactg

SEQ ID NO: 1082816 - DNA, 18 bp, Homo sapiens
ggccgccgccaggactgt

SEQ ID NO: 1082817 - DNA, 17 bp, Homo sapiens
ggccgcctgccctgcct

SEQ ID NO: 1082818 - DNA, 12 bp, Homo sapiens
ggccgcctgcct

SEQ ID NO: 1082819 - DNA, 18 bp, Homo sapiens
ggccgcgccacccgggca

SEQ ID NO: 1082820 - DNA, 16 bp, Homo sapiens
ggccgcggagcctgca

SEQ ID NO: 1082821 - DNA, 15 bp, Homo sapiens
ggccgctagaggcct

SEQ ID NO: 1082822 - DNA, 18 bp, Homo sapiens
ggccgctagaggcctgag

SEQ ID NO: 1082823 - DNA, 15 bp, Homo sapiens
ggccgctcctccctg

SEQ ID NO: 1082824 - DNA, 23 bp, Homo sapiens
ggccgctcctccctgctcctcat

SEQ ID NO: 1082825 - DNA, 19 bp, Homo sapiens
ggccgctgccacccacctc

SEQ ID NO: 1082826 - DNA, 23 bp, Homo sapiens
ggccgctgccacccacctccctg

SEQ ID NO: 1082827 - DNA, 23 bp, Homo sapiens
ggccggaaggaatgtcagggcca

SEQ ID NO: 1082828 - DNA, 20 bp, Homo sapiens
ggccggacccccgtcagctg

SEQ ID NO: 1082829 - DNA, 14 bp, Homo sapiens
ggccggacctctga

SEQ ID NO: 1082830 - DNA, 15 bp, Homo sapiens
ggccggacctgagcc

SEQ ID NO: 1082831 - DNA, 15 bp, Homo sapiens
ggccggagagctggt

SEQ ID NO: 1082832 - DNA, 15 bp, Homo sapiens
ggccggagcccagat

SEQ ID NO: 1082833 - DNA, 14 bp, Homo sapiens
ggccggcccagatg

SEQ ID NO: 1082834 - DNA, 17 bp, Homo sapiens
ggccggccgagctgcct

SEQ ID NO: 1082835 - DNA, 15 bp, Homo sapiens
ggccggcggctctga

SEQ ID NO: 1082836 - DNA, 16 bp, Homo sapiens
ggccggcggctctgag

SEQ ID NO: 1082837 - DNA, 22 bp, Homo sapiens
ggccggcttcatgccagctact

SEQ ID NO: 1082838 - DNA, 15 bp, Homo sapiens
ggccgggaggcagtg

SEQ ID NO: 1082839 - DNA, 15 bp, Homo sapiens
ggccggggcagggac

SEQ ID NO: 1082840 - DNA, 16 bp, Homo sapiens
ggccggggggagggga

SEQ ID NO: 1082841 - DNA, 18 bp, Homo sapiens
ggccggggggaggggaca

SEQ ID NO: 1082842 - DNA, 17 bp, Homo sapiens
ggccggtgaggggaggg

SEQ ID NO: 1082843 - DNA, 14 bp, Homo sapiens
ggccgtaccccacc

SEQ ID NO: 1082844 - DNA, 17 bp, Homo sapiens
ggccgtcacgctttcat

SEQ ID NO: 1082845 - DNA, 14 bp, Homo sapiens
ggccgtcccctctc

SEQ ID NO: 1082846 - DNA, 15 bp, Homo sapiens
ggccgtctcctccct

SEQ ID NO: 1082847 - DNA, 17 bp, Homo sapiens
ggccgtctcctccctca

SEQ ID NO: 1082848 - DNA, 16 bp, Homo sapiens
ggccgtggcacagctg

SEQ ID NO: 1082849 - DNA, 17 bp, Homo sapiens
ggccgtggcttgggctg

SEQ ID NO: 1082850 - DNA, 19 bp, Homo sapiens
ggccgtgggccgggaggca

SEQ ID NO: 1082851 - DNA, 18 bp, Homo sapiens
ggccgtgtctctgaggac

SEQ ID NO: 1082852 - DNA, 17 bp, Homo sapiens
ggccgttccccttggct

SEQ ID NO: 1082853 - DNA, 19 bp, Homo sapiens
ggcctaaatttattaaata

SEQ ID NO: 1082854 - DNA, 17 bp, Homo sapiens
ggcctaatcactctgag

SEQ ID NO: 1082855 - DNA, 16 bp, Homo sapiens
ggcctacaaatcagta

SEQ ID NO: 1082856 - DNA, 18 bp, Homo sapiens
ggcctacagaggaggcct

SEQ ID NO: 1082857 - DNA, 23 bp, Homo sapiens
ggcctacagctttgatccctgac

SEQ ID NO: 1082858 - DNA, 13 bp, Homo sapiens
ggcctacctcaag

SEQ ID NO: 1082859 - DNA, 20 bp, Homo sapiens
ggcctacctcaagttcttgg

SEQ ID NO: 1082860 - DNA, 23 bp, Homo sapiens
ggcctacctcaagttcttggacc

SEQ ID NO: 1082861 - DNA, 14 bp, Homo sapiens
ggcctagaccagca

SEQ ID NO: 1082862 - DNA, 18 bp, Homo sapiens
ggcctagactctgtctac

SEQ ID NO: 1082863 - DNA, 16 bp, Homo sapiens
ggcctagagcactctc

SEQ ID NO: 1082864 - DNA, 22 bp, Homo sapiens
ggcctagcatacgtacacattt

SEQ ID NO: 1082865 - DNA, 19 bp, Homo sapiens
ggcctagcgatctctcctg

SEQ ID NO: 1082866 - DNA, 16 bp, Homo sapiens
ggcctaggggtggcgc

SEQ ID NO: 1082867 - DNA, 19 bp, Homo sapiens
ggcctaggggtggcgctca

SEQ ID NO: 1082868 - DNA, 22 bp, Homo sapiens
ggcctaggggtggcgctcagac

SEQ ID NO: 1082869 - DNA, 16 bp, Homo sapiens
ggcctaggtgcagctc

SEQ ID NO: 1082870 - DNA, 18 bp, Homo sapiens
ggcctaggtgcagctcct

SEQ ID NO: 1082871 - DNA, 14 bp, Homo sapiens
ggcctatgcagaca

SEQ ID NO: 1082872 - DNA, 14 bp, Homo sapiens
ggcctatttcatca

SEQ ID NO: 1082873 - DNA, 15 bp, Homo sapiens
ggcctcaaaacagaa

SEQ ID NO: 1082874 - DNA, 20 bp, Homo sapiens
ggcctcaaagcaacccgctg

SEQ ID NO: 1082875 - DNA, 15 bp, Homo sapiens
ggcctcaaccctccc

SEQ ID NO: 1082876 - DNA, 18 bp, Homo sapiens
ggcctcaaccctccctca

SEQ ID NO: 1082877 - DNA, 22 bp, Homo sapiens
ggcctcaaccctccctcagccc

SEQ ID NO: 1082878 - DNA, 20 bp, Homo sapiens
ggcctcaagcaatccacctg

SEQ ID NO: 1082879 - DNA, 13 bp, Homo sapiens
ggcctcaccaggc

SEQ ID NO: 1082880 - DNA, 13 bp, Homo sapiens
ggcctcacccacc

SEQ ID NO: 1082881 - DNA, 16 bp, Homo sapiens
ggcctcacctgcccct

SEQ ID NO: 1082882 - DNA, 19 bp, Homo sapiens
ggcctcactggctcatgcc

SEQ ID NO: 1082883 - DNA, 23 bp, Homo sapiens
ggcctcacttgattcatctctgg

SEQ ID NO: 1082884 - DNA, 19 bp, Homo sapiens
ggcctcagaccccctcagc

SEQ ID NO: 1082885 - DNA, 21 bp, Homo sapiens
ggcctcagaccccctcagcct

SEQ ID NO: 1082886 - DNA, 19 bp, Homo sapiens
ggcctcagagcctgacctg

SEQ ID NO: 1082887 - DNA, 12 bp, Homo sapiens
ggcctcagcctg

SEQ ID NO: 1082888 - DNA, 22 bp, Homo sapiens
ggcctcagcctggggctctctg

SEQ ID NO: 1082889 - DNA, 17 bp, Homo sapiens
ggcctcagctgaatgcc

SEQ ID NO: 1082890 - DNA, 13 bp, Homo sapiens
ggcctcagctgcc

SEQ ID NO: 1082891 - DNA, 16 bp, Homo sapiens
ggcctcagctgcctca

SEQ ID NO: 1082892 - DNA, 14 bp, Homo sapiens
ggcctcagggtcct

SEQ ID NO: 1082893 - DNA, 15 bp, Homo sapiens
ggcctcagggtcctg

SEQ ID NO: 1082894 - DNA, 17 bp, Homo sapiens
ggcctcaggtgctgtcc

SEQ ID NO: 1082895 - DNA, 18 bp, Homo sapiens
ggcctcagttcccagctc

SEQ ID NO: 1082896 - DNA, 20 bp, Homo sapiens
ggcctcagtttctccatcag

SEQ ID NO: 1082897 - DNA, 21 bp, Homo sapiens
ggcctcagtttctccatcagc

SEQ ID NO: 1082898 - DNA, 14 bp, Homo sapiens
ggcctcatccctcg

SEQ ID NO: 1082899 - DNA, 15 bp, Homo sapiens
ggcctcatctcacct

SEQ ID NO: 1082900 - DNA, 14 bp, Homo sapiens
ggcctcatgtggct

SEQ ID NO: 1082901 - DNA, 15 bp, Homo sapiens
ggcctcatgtggctg

SEQ ID NO: 1082902 - DNA, 23 bp, Homo sapiens
ggcctccaacgcccctgtggcca

SEQ ID NO: 1082903 - DNA, 18 bp, Homo sapiens
ggcctccagcctctcccg

SEQ ID NO: 1082904 - DNA, 21 bp, Homo sapiens
ggcctccagcctctcccggct

SEQ ID NO: 1082905 - DNA, 23 bp, Homo sapiens
ggcctccagcctctcccggctgc

SEQ ID NO: 1082906 - DNA, 10 bp, Homo sapiens
ggcctccagg

SEQ ID NO: 1082907 - DNA, 12 bp, Homo sapiens
ggcctccaggag

SEQ ID NO: 1082908 - DNA, 13 bp, Homo sapiens
ggcctccaggagg

SEQ ID NO: 1082909 - DNA, 21 bp, Homo sapiens
ggcctccatgccccagctctg

SEQ ID NO: 1082910 - DNA, 22 bp, Homo sapiens
ggcctccatgccccagctctgg

SEQ ID NO: 1082911 - DNA, 16 bp, Homo sapiens
ggcctccatttctgtc

SEQ ID NO: 1082912 - DNA, 16 bp, Homo sapiens
ggcctcccaaagtgct

SEQ ID NO: 1082913 - DNA, 11 bp, Homo sapiens
ggcctcccacc

SEQ ID NO: 1082914 - DNA, 13 bp, Homo sapiens
ggcctcccaccag

SEQ ID NO: 1082915 - DNA, 13 bp, Homo sapiens
ggcctcccacccg

SEQ ID NO: 1082916 - DNA, 20 bp, Homo sapiens
ggcctcccacccgatgctgc

SEQ ID NO: 1082917 - DNA, 13 bp, Homo sapiens
ggcctcccccaac

SEQ ID NO: 1082918 - DNA, 14 bp, Homo sapiens
ggcctcccccagca

SEQ ID NO: 1082919 - DNA, 15 bp, Homo sapiens
ggcctcccctgccac

SEQ ID NO: 1082920 - DNA, 21 bp, Homo sapiens
ggcctcccggggcccaggact

SEQ ID NO: 1082921 - DNA, 13 bp, Homo sapiens
ggcctccctgctg

SEQ ID NO: 1082922 - DNA, 12 bp, Homo sapiens
ggcctccctggc

SEQ ID NO: 1082923 - DNA, 20 bp, Homo sapiens
ggcctccctggctcctccgt

SEQ ID NO: 1082924 - DNA, 15 bp, Homo sapiens
ggcctccctgttcac

SEQ ID NO: 1082925 - DNA, 16 bp, Homo sapiens
ggcctccgaggctccc

SEQ ID NO: 1082926 - DNA, 18 bp, Homo sapiens
ggcctccgaggctccccg

SEQ ID NO: 1082927 - DNA, 20 bp, Homo sapiens
ggcctccggcgtcttgccca

SEQ ID NO: 1082928 - DNA, 18 bp, Homo sapiens
ggcctcctcggagagcag

SEQ ID NO: 1082929 - DNA, 19 bp, Homo sapiens
ggcctcctcggagagcagc

SEQ ID NO: 1082930 - DNA, 22 bp, Homo sapiens
ggcctcctcggagagcagcagc

SEQ ID NO: 1082931 - DNA, 19 bp, Homo sapiens
ggcctcctctgtccagggc

SEQ ID NO: 1082932 - DNA, 18 bp, Homo sapiens
ggcctcctgggggacctt

SEQ ID NO: 1082933 - DNA, 23 bp, Homo sapiens
ggcctgtatcctccctggcagac

SEQ ID NO: 1082934 - DNA, 16 bp, Homo sapiens
ggcctgtccaccctgc

SEQ ID NO: 1082935 - DNA, 17 bp, Homo sapiens
ggcctgtccacctgtgc

SEQ ID NO: 1082936 - DNA, 22 bp, Homo sapiens
ggcctgtccacctgtgctgctg

SEQ ID NO: 1082937 - DNA, 17 bp, Homo sapiens
ggcctgtcccccaaggt

SEQ ID NO: 1082938 - DNA, 20 bp, Homo sapiens
ggcctgtctcatccccaggg

SEQ ID NO: 1082939 - DNA, 12 bp, Homo sapiens
ggcctgtgaatc

SEQ ID NO: 1082940 - DNA, 20 bp, Homo sapiens
ggcctgtgaggtaactggga

SEQ ID NO: 1082941 - DNA, 19 bp, Homo sapiens
ggcctgtgcagcagcccag

SEQ ID NO: 1082942 - DNA, 19 bp, Homo sapiens
ggcctgtggaatgagtgtg

SEQ ID NO: 1082943 - DNA, 20 bp, Homo sapiens
ggcctgtggcctgtgtccca

SEQ ID NO: 1082944 - DNA, 20 bp, Homo sapiens
ggcctgtgggagcctgcaaa

SEQ ID NO: 1082945 - DNA, 14 bp, Homo sapiens
ggcctgtgggcctc

SEQ ID NO: 1082946 - DNA, 19 bp, Homo sapiens
ggcctgtgggtttgggtgc

SEQ ID NO: 1082947 - DNA, 22 bp, Homo sapiens
ggcctgtgggtttgggtgcctc

SEQ ID NO: 1082948 - DNA, 18 bp, Homo sapiens
ggcctgtggtggctcccc

SEQ ID NO: 1082949 - DNA, 21 bp, Homo sapiens
ggcctgtgtcccatgacccac

SEQ ID NO: 1082950 - DNA, 22 bp, Homo sapiens
ggcctgtgtcccatgacccacc

SEQ ID NO: 1082951 - DNA, 12 bp, Homo sapiens
ggcctgtgtgtg

SEQ ID NO: 1082952 - DNA, 22 bp, Homo sapiens
ggcctgtgtgtgaaaggaagct

SEQ ID NO: 1082953 - DNA, 18 bp, Homo sapiens
ggcctgttatgattctga

SEQ ID NO: 1082954 - DNA, 21 bp, Homo sapiens
ggcctgttcccttgtggcttg

SEQ ID NO: 1082955 - DNA, 22 bp, Homo sapiens
ggcctgttgatgtttacatggc

SEQ ID NO: 1082956 - DNA, 17 bp, Homo sapiens
ggcctgtttggcctctc

SEQ ID NO: 1082957 - DNA, 15 bp, Homo sapiens
ggccttaatttcctt

SEQ ID NO: 1082958 - DNA, 15 bp, Homo sapiens
ggccttagggcactg

SEQ ID NO: 1082959 - DNA, 21 bp, Homo sapiens
ggccttagtgggccagggctg

SEQ ID NO: 1082960 - DNA, 16 bp, Homo sapiens
ggccttccagctgctg

SEQ ID NO: 1082961 - DNA, 17 bp, Homo sapiens
ggccttccagctgctgt

SEQ ID NO: 1082962 - DNA, 15 bp, Homo sapiens
ggccttcccatggcc

SEQ ID NO: 1082963 - DNA, 13 bp, Homo sapiens
ggccttccccagc

SEQ ID NO: 1082964 - DNA, 21 bp, Homo sapiens
ggccttccccttttgcctggc

SEQ ID NO: 1082965 - DNA, 13 bp, Homo sapiens
ggccttcctgccc

SEQ ID NO: 1082966 - DNA, 20 bp, Homo sapiens
ggccttctggttttaggaaa

SEQ ID NO: 1082967 - DNA, 17 bp, Homo sapiens
ggccttctgtggggctg

SEQ ID NO: 1082968 - DNA, 23 bp, Homo sapiens
ggccttgacatcagttcctttgt

SEQ ID NO: 1082969 - DNA, 13 bp, Homo sapiens
ggccttgcccgtc

SEQ ID NO: 1082970 - DNA, 18 bp, Homo sapiens
ggccttgcggaagccata

SEQ ID NO: 1082971 - DNA, 13 bp, Homo sapiens
ggccttgctctga

SEQ ID NO: 1082972 - DNA, 16 bp, Homo sapiens
ggccttgctctgagca

SEQ ID NO: 1082973 - DNA, 22 bp, Homo sapiens
ggccttgctggggtccagggct

SEQ ID NO: 1082974 - DNA, 13 bp, Homo sapiens
ggccttgcttctc

SEQ ID NO: 1082975 - DNA, 22 bp, Homo sapiens
ggccttgctttgtctggcctca

SEQ ID NO: 1082976 - DNA, 19 bp, Homo sapiens
ggccttggctgggcctctg

SEQ ID NO: 1082977 - DNA, 22 bp, Homo sapiens
ggccttggggtgggggccaggc

SEQ ID NO: 1082978 - DNA, 24 bp, Homo sapiens
ggccttggggtgggggccaggcct

SEQ ID NO: 1082979 - DNA, 18 bp, Homo sapiens
ggccttggtggagcagcc

SEQ ID NO: 1082980 - DNA, 19 bp, Homo sapiens
ggccttggtggagcagcca

SEQ ID NO: 1082981 - DNA, 21 bp, Homo sapiens
ggccttggtggagcagccaga

SEQ ID NO: 1082982 - DNA, 19 bp, Homo sapiens
ggccttgtcatcctccctt

SEQ ID NO: 1082983 - DNA, 19 bp, Homo sapiens
ggccttgtcctcagccagt

SEQ ID NO: 1082984 - DNA, 18 bp, Homo sapiens
ggccttgtgtgtcaggcc

SEQ ID NO: 1082985 - DNA, 19 bp, Homo sapiens
ggccttgtgtgtcaggccc

SEQ ID NO: 1082986 - DNA, 20 bp, Homo sapiens
ggccttgtgtgtcaggccct

SEQ ID NO: 1082987 - DNA, 23 bp, Homo sapiens
ggccttgtgtgtcaggccctctg

SEQ ID NO: 1082988 - DNA, 14 bp, Homo sapiens
ggcctttcactttt

SEQ ID NO: 1082989 - DNA, 22 bp, Homo sapiens
ggcctttccagagaactgcaga

SEQ ID NO: 1082990 - DNA, 14 bp, Homo sapiens
ggcctttcctacat

SEQ ID NO: 1082991 - DNA, 13 bp, Homo sapiens
ggcctttcctgtg

SEQ ID NO: 1082992 - DNA, 15 bp, Homo sapiens
ggcctttccttccct

SEQ ID NO: 1082993 - DNA, 22 bp, Homo sapiens
ggcctttctcctccccacctgt

SEQ ID NO: 1082994 - DNA, 12 bp, Homo sapiens
ggcctttcttct

SEQ ID NO: 1082995 - DNA, 15 bp, Homo sapiens
ggcctttcttctgtg

SEQ ID NO: 1082996 - DNA, 23 bp, Homo sapiens
ggcctttgagcccacaaagcctt

SEQ ID NO: 1082997 - DNA, 21 bp, Homo sapiens
ggcctttggacccagggcctg

SEQ ID NO: 1082998 - DNA, 13 bp, Homo sapiens
ggcctttggcttc

SEQ ID NO: 1082999 - DNA, 14 bp, Homo sapiens
ggcctttggcttca

SEQ ID NO: 1083000 - DNA, 9 bp, Homo sapiens
ggccttttg

SEQ ID NO: 1083001 - DNA, 12 bp, Homo sapiens
ggctcactactg

SEQ ID NO: 1083002 - DNA, 16 bp, Homo sapiens
ggctcactactgaaca

SEQ ID NO: 1083003 - DNA, 14 bp, Homo sapiens
ggctcactcagcca

SEQ ID NO: 1083004 - DNA, 15 bp, Homo sapiens
ggctcactgcaacct

SEQ ID NO: 1083005 - DNA, 13 bp, Homo sapiens
ggctcactgccag

SEQ ID NO: 1083006 - DNA, 18 bp, Homo sapiens
ggctcactgccaggccag

SEQ ID NO: 1083007 - DNA, 21 bp, Homo sapiens
ggctcactggctgggagtcct

SEQ ID NO: 1083008 - DNA, 15 bp, Homo sapiens
ggctcagaagagcag

SEQ ID NO: 1083009 - DNA, 16 bp, Homo sapiens
ggctcagaagagcagc

SEQ ID NO: 1083010 - DNA, 19 bp, Homo sapiens
ggctcagaagagcagcttc

SEQ ID NO: 1083011 - DNA, 11 bp, Homo sapiens
ggctcagagct

SEQ ID NO: 1083012 - DNA, 23 bp, Homo sapiens
ggctcagagctttgtcacttgcc

SEQ ID NO: 1083013 - DNA, 21 bp, Homo sapiens
ggctcagagtgaccctcagct

SEQ ID NO: 1083014 - DNA, 15 bp, Homo sapiens
ggctcagccagcact

SEQ ID NO: 1083015 - DNA, 13 bp, Homo sapiens
ggctcagcctggt

SEQ ID NO: 1083016 - DNA, 15 bp, Homo sapiens
ggctcagccttgcac

SEQ ID NO: 1083017 - DNA, 17 bp, Homo sapiens
ggctcagccttgcacac

SEQ ID NO: 1083018 - DNA, 18 bp, Homo sapiens
ggctcagccttgcacacc

SEQ ID NO: 1083019 - DNA, 12 bp, Homo sapiens
ggctcaggaaaa

SEQ ID NO: 1083020 - DNA, 19 bp, Homo sapiens
ggctcaggcaagcccctca

SEQ ID NO: 1083021 - DNA, 12 bp, Homo sapiens
ggctcaggcaga

SEQ ID NO: 1083022 - DNA, 12 bp, Homo sapiens
ggctcagggctg

SEQ ID NO: 1083023 - DNA, 17 bp, Homo sapiens
ggctcagggctggagtg

SEQ ID NO: 1083024 - DNA, 16 bp, Homo sapiens
ggctcatgccccttgg

SEQ ID NO: 1083025 - DNA, 22 bp, Homo sapiens
ggctcatggcgtaatgggcctg

SEQ ID NO: 1083026 - DNA, 16 bp, Homo sapiens
ggctcatttaaaacag

SEQ ID NO: 1083027 - DNA, 18 bp, Homo sapiens
ggctccaccttgatgggt

SEQ ID NO: 1083028 - DNA, 14 bp, Homo sapiens
ggctccagaaatgt

SEQ ID NO: 1083029 - DNA, 22 bp, Homo sapiens
ggctccagagggcactctgctt

SEQ ID NO: 1083030 - DNA, 18 bp, Homo sapiens
ggctccagatgcagggca

SEQ ID NO: 1083031 - DNA, 18 bp, Homo sapiens
ggctccagcaccttcttt

SEQ ID NO: 1083032 - DNA, 17 bp, Homo sapiens
ggctccagttgaacact

SEQ ID NO: 1083033 - DNA, 18 bp, Homo sapiens
ggctccatgcctctggag

SEQ ID NO: 1083034 - DNA, 18 bp, Homo sapiens
ggctcccaatcagctttt

SEQ ID NO: 1083035 - DNA, 18 bp, Homo sapiens
ggctcccacaggcccttc

SEQ ID NO: 1083036 - DNA, 21 bp, Homo sapiens
ggctcccacaggcccttcctc

SEQ ID NO: 1083037 - DNA, 11 bp, Homo sapiens
ggctcccaggg

SEQ ID NO: 1083038 - DNA, 12 bp, Homo sapiens
ggctcccagggg

SEQ ID NO: 1083039 - DNA, 20 bp, Homo sapiens
ggctcccaggggtctccctg

SEQ ID NO: 1083040 - DNA, 12 bp, Homo sapiens
ggctcccagggt

SEQ ID NO: 1083041 - DNA, 15 bp, Homo sapiens
ggctcccagggtgga

SEQ ID NO: 1083042 - DNA, 19 bp, Homo sapiens
ggctcccagggtggaggaa

SEQ ID NO: 1083043 - DNA, 19 bp, Homo sapiens
ggctcccatgaccatactg

SEQ ID NO: 1083044 - DNA, 21 bp, Homo sapiens
ggctcccatgggctgagtggg

SEQ ID NO: 1083045 - DNA, 13 bp, Homo sapiens
ggctccccacccc

SEQ ID NO: 1083046 - DNA, 22 bp, Homo sapiens
ggctccccacctggacacacac

SEQ ID NO: 1083047 - DNA, 13 bp, Homo sapiens
ggctccccacgag

SEQ ID NO: 1083048 - DNA, 23 bp, Homo sapiens
ggctccccacgagtcacctgcaa

SEQ ID NO: 1083049 - DNA, 23 bp, Homo sapiens
ggctccccagaactggctgggcc

SEQ ID NO: 1083050 - DNA, 19 bp, Homo sapiens
ggctccccctccccaggct

SEQ ID NO: 1083051 - DNA, 20 bp, Homo sapiens
ggctccccctccccaggctg

SEQ ID NO: 1083052 - DNA, 20 bp, Homo sapiens
ggctccccctctgcttctcg

SEQ ID NO: 1083053 - DNA, 13 bp, Homo sapiens
ggctccccgcctc

SEQ ID NO: 1083054 - DNA, 17 bp, Homo sapiens
ggctccccgcctccact

SEQ ID NO: 1083055 - DNA, 18 bp, Homo sapiens
ggctcccctcccagggga

SEQ ID NO: 1083056 - DNA, 16 bp, Homo sapiens
ggctgcagaggccaga

SEQ ID NO: 1083057 - DNA, 13 bp, Homo sapiens
ggctgcagcagcc

SEQ ID NO: 1083058 - DNA, 16 bp, Homo sapiens
ggctgcagcaggtgct

SEQ ID NO: 1083059 - DNA, 17 bp, Homo sapiens
ggctgcagctggacaga

SEQ ID NO: 1083060 - DNA, 18 bp, Homo sapiens
ggctgcagctggacagag

SEQ ID NO: 1083061 - DNA, 13 bp, Homo sapiens
ggctgcaggaggg

SEQ ID NO: 1083062 - DNA, 14 bp, Homo sapiens
ggctgcaggcaggc

SEQ ID NO: 1083063 - DNA, 15 bp, Homo sapiens
ggctgcaggcaggcg

SEQ ID NO: 1083064 - DNA, 17 bp, Homo sapiens
ggctgcaggcaggcggc

SEQ ID NO: 1083065 - DNA, 17 bp, Homo sapiens
ggctgcaggtgctgctg

SEQ ID NO: 1083066 - DNA, 22 bp, Homo sapiens
ggctgcagtgacgtgcacctgt

SEQ ID NO: 1083067 - DNA, 19 bp, Homo sapiens
ggctgcatgctctggaagc

SEQ ID NO: 1083068 - DNA, 18 bp, Homo sapiens
ggctgccacacccagggg

SEQ ID NO: 1083069 - DNA, 17 bp, Homo sapiens
ggctgccaccagccccc

SEQ ID NO: 1083070 - DNA, 15 bp, Homo sapiens
ggctgccagcctgag

SEQ ID NO: 1083071 - DNA, 16 bp, Homo sapiens
ggctgccagcctgagc

SEQ ID NO: 1083072 - DNA, 12 bp, Homo sapiens
ggctgccaggcg

SEQ ID NO: 1083073 - DNA, 17 bp, Homo sapiens
ggctgccatagggtctg

SEQ ID NO: 1083074 - DNA, 20 bp, Homo sapiens
ggctgccattggtccaccct

SEQ ID NO: 1083075 - DNA, 21 bp, Homo sapiens
ggctgcccagccccgctcagg

SEQ ID NO: 1083076 - DNA, 23 bp, Homo sapiens
ggctgcccagccccgctcaggcc

SEQ ID NO: 1083077 - DNA, 17 bp, Homo sapiens
ggctgcccagctgctcc

SEQ ID NO: 1083078 - DNA, 12 bp, Homo sapiens
ggctgcccagga

SEQ ID NO: 1083079 - DNA, 17 bp, Homo sapiens
ggctgccccaggccgga

SEQ ID NO: 1083080 - DNA, 19 bp, Homo sapiens
ggctgccccaggccggagc

SEQ ID NO: 1083081 - DNA, 21 bp, Homo sapiens
ggctgccccaggccggagccc

SEQ ID NO: 1083082 - DNA, 23 bp, Homo sapiens
ggctgccccaggccggagcccag

SEQ ID NO: 1083083 - DNA, 21 bp, Homo sapiens
ggctgcccccatcacctctac

SEQ ID NO: 1083084 - DNA, 22 bp, Homo sapiens
ggctgcccctaatctctgtagg

SEQ ID NO: 1083085 - DNA, 23 bp, Homo sapiens
ggctgcccctaatctctgtagga

SEQ ID NO: 1083086 - DNA, 23 bp, Homo sapiens
ggctgcccctcgcacacagggct

SEQ ID NO: 1083087 - DNA, 12 bp, Homo sapiens
ggctgccctgag

SEQ ID NO: 1083088 - DNA, 18 bp, Homo sapiens
ggctgccctgagaagctg

SEQ ID NO: 1083089 - DNA, 15 bp, Homo sapiens
ggctgccctgagggg

SEQ ID NO: 1083090 - DNA, 19 bp, Homo sapiens
ggctgccctggccctgagg

SEQ ID NO: 1083091 - DNA, 16 bp, Homo sapiens
ggctgccctggtgctg

SEQ ID NO: 1083092 - DNA, 22 bp, Homo sapiens
ggctgccgactcccccaaccaa

SEQ ID NO: 1083093 - DNA, 13 bp, Homo sapiens
ggctgcctagccc

SEQ ID NO: 1083094 - DNA, 11 bp, Homo sapiens
ggctgcctcag

SEQ ID NO: 1083095 - DNA, 21 bp, Homo sapiens
ggctgggccatgtccaaagag

SEQ ID NO: 1083096 - DNA, 22 bp, Homo sapiens
ggctgggcccacagagatgcat

SEQ ID NO: 1083097 - DNA, 23 bp, Homo sapiens
ggctgggcccacagagatgcatg

SEQ ID NO: 1083098 - DNA, 18 bp, Homo sapiens
ggctgggcccacccaggg

SEQ ID NO: 1083099 - DNA, 19 bp, Homo sapiens
ggctgggcccacccaggga

SEQ ID NO: 1083100 - DNA, 13 bp, Homo sapiens
ggctgggcccctg

SEQ ID NO: 1083101 - DNA, 21 bp, Homo sapiens
ggctgggcccctgggatggga

SEQ ID NO: 1083102 - DNA, 21 bp, Homo sapiens
ggctgggccctctttccctgc

SEQ ID NO: 1083103 - DNA, 14 bp, Homo sapiens
ggctgggcctcctt

SEQ ID NO: 1083104 - DNA, 21 bp, Homo sapiens
ggctgggctagaaagaccact

SEQ ID NO: 1083105 - DNA, 18 bp, Homo sapiens
ggctgggctgagcccctg

SEQ ID NO: 1083106 - DNA, 19 bp, Homo sapiens
ggctgggctgagcccctgg

SEQ ID NO: 1083107 - DNA, 19 bp, Homo sapiens
ggctgggctgggctgggct

SEQ ID NO: 1083108 - DNA, 20 bp, Homo sapiens
ggctggggacccacccagcc

SEQ ID NO: 1083109 - DNA, 15 bp, Homo sapiens
ggctggggactctgg

SEQ ID NO: 1083110 - DNA, 20 bp, Homo sapiens
ggctggggactctggcacag

SEQ ID NO: 1083111 - DNA, 21 bp, Homo sapiens
ggctggggactctggcacagt

SEQ ID NO: 1083112 - DNA, 11 bp, Homo sapiens
ggctggggagg

SEQ ID NO: 1083113 - DNA, 15 bp, Homo sapiens
ggctggggaggacca

SEQ ID NO: 1083114 - DNA, 18 bp, Homo sapiens
ggctggggaggaccaggg

SEQ ID NO: 1083115 - DNA, 16 bp, Homo sapiens
ggctggggaggccagt

SEQ ID NO: 1083116 - DNA, 14 bp, Homo sapiens
ggctggggaggtgc

SEQ ID NO: 1083117 - DNA, 15 bp, Homo sapiens
ggctggggcagaggg

SEQ ID NO: 1083118 - DNA, 15 bp, Homo sapiens
ggctggggcaggctc

SEQ ID NO: 1083119 - DNA, 20 bp, Homo sapiens
ggctggggcaggggcctggg

SEQ ID NO: 1083120 - DNA, 16 bp, Homo sapiens
ggctgggggcaggagg

SEQ ID NO: 1083121 - DNA, 20 bp, Homo sapiens
ggctgggggccagggctgga

SEQ ID NO: 1083122 - DNA, 23 bp, Homo sapiens
ggctgggggccagggctggatgg

SEQ ID NO: 1083123 - DNA, 16 bp, Homo sapiens
ggctgggggtagcctg

SEQ ID NO: 1083124 - DNA, 17 bp, Homo sapiens
ggctgggggtagcctgg

SEQ ID NO: 1083125 - DNA, 17 bp, Homo sapiens
ggctggggtgagcctga

SEQ ID NO: 1083126 - DNA, 22 bp, Homo sapiens
ggctgggtaatgtgaaggccca

SEQ ID NO: 1083127 - DNA, 21 bp, Homo sapiens
gggtgcctgcagcgcctccct

SEQ ID NO: 1083128 - DNA, 18 bp, Homo sapiens
gggtgcgagtgtgagagt

SEQ ID NO: 1083129 - DNA, 21 bp, Homo sapiens
gggtgctagggacatgggaaa

SEQ ID NO: 1083130 - DNA, 18 bp, Homo sapiens
gggtgctcagaataaggc

SEQ ID NO: 1083131 - DNA, 21 bp, Homo sapiens
gggtgctcagaataaggcagg

SEQ ID NO: 1083132 - DNA, 13 bp, Homo sapiens
gggtgctgccctg

SEQ ID NO: 1083133 - DNA, 15 bp, Homo sapiens
gggtgctgccctgtg

SEQ ID NO: 1083134 - DNA, 20 bp, Homo sapiens
gggtgctgctggtaacagtg

SEQ ID NO: 1083135 - DNA, 21 bp, Homo sapiens
gggtgctgcttccctctgcct

SEQ ID NO: 1083136 - DNA, 23 bp, Homo sapiens
gggtgctgcttccctctgcctgt

SEQ ID NO: 1083137 - DNA, 19 bp, Homo sapiens
gggtgctggctgcccagac

SEQ ID NO: 1083138 - DNA, 20 bp, Homo sapiens
gggtgcttttatagaggcta

SEQ ID NO: 1083139 - DNA, 15 bp, Homo sapiens
gggtggaatgagccg

SEQ ID NO: 1083140 - DNA, 20 bp, Homo sapiens
gggtggaccacgccgccctc

SEQ ID NO: 1083141 - DNA, 13 bp, Homo sapiens
gggtggagaggga

SEQ ID NO: 1083142 - DNA, 15 bp, Homo sapiens
gggtggcaccagcag

SEQ ID NO: 1083143 - DNA, 17 bp, Homo sapiens
gggtggcacctcctgag

SEQ ID NO: 1083144 - DNA, 12 bp, Homo sapiens
gggtggcaggca

SEQ ID NO: 1083145 - DNA, 23 bp, Homo sapiens
gggtggcaggcacacagcagccc

SEQ ID NO: 1083146 - DNA, 16 bp, Homo sapiens
gggtggcaggtcactg

SEQ ID NO: 1083147 - DNA, 11 bp, Homo sapiens
gggtggccagg

SEQ ID NO: 1083148 - DNA, 14 bp, Homo sapiens
gggtggcctggccc

SEQ ID NO: 1083149 - DNA, 15 bp, Homo sapiens
gggtggcctggccct

SEQ ID NO: 1083150 - DNA, 15 bp, Homo sapiens
gggtggcgctggtgc

SEQ ID NO: 1083151 - DNA, 22 bp, Homo sapiens
gggtggctcactactgaacaca

SEQ ID NO: 1083152 - DNA, 22 bp, Homo sapiens
gggtggctgtgacaaccctggc

SEQ ID NO: 1083153 - DNA, 20 bp, Homo sapiens
gggtggctttcaaggctggg

SEQ ID NO: 1083154 - DNA, 11 bp, Homo sapiens
gggtgggaaga

SEQ ID NO: 1083155 - DNA, 16 bp, Homo sapiens
gggtgggaagaaagaa

SEQ ID NO: 1083156 - DNA, 13 bp, Homo sapiens
gggtgggaaggga

SEQ ID NO: 1083157 - DNA, 15 bp, Homo sapiens
gggtgggacagggag

SEQ ID NO: 1083158 - DNA, 17 bp, Homo sapiens
gggtgggagggcgtcag

SEQ ID NO: 1083159 - DNA, 17 bp, Homo sapiens
gggtgggatggaggaga

SEQ ID NO: 1083160 - DNA, 17 bp, Homo sapiens
gggtgggcagcctatgg

SEQ ID NO: 1083161 - DNA, 13 bp, Homo sapiens
gggtgggcccaga

SEQ ID NO: 1083162 - DNA, 11 bp, Homo sapiens
gggtgggccct

SEQ ID NO: 1083163 - DNA, 19 bp, Homo sapiens
gggtgggcttcctgccctt

SEQ ID NO: 1083164 - DNA, 12 bp, Homo sapiens
gggtggggagaa

SEQ ID NO: 1083165 - DNA, 19 bp, Homo sapiens
gggtggggaggccctgcct

SEQ ID NO: 1083166 - DNA, 13 bp, Homo sapiens
gggtggggcagca

SEQ ID NO: 1083167 - DNA, 15 bp, Homo sapiens
gggtgggggccaggc

SEQ ID NO: 1083168 - DNA, 17 bp, Homo sapiens
gggtgggggccaggcct

SEQ ID NO: 1083169 - DNA, 17 bp, Homo sapiens
gggtggggtcatgccct

SEQ ID NO: 1083170 - DNA, 20 bp, Homo sapiens
gggtggggttatgtgagggt

SEQ ID NO: 1083171 - DNA, 21 bp, Homo sapiens
gggtggggttggggcaaagcc

SEQ ID NO: 1083172 - DNA, 16 bp, Homo sapiens
gggtgggtgagagaga

SEQ ID NO: 1083173 - DNA, 14 bp, Homo sapiens
gggtggtgctggga

SEQ ID NO: 1083174 - DNA, 13 bp, Homo sapiens
gggtggtgtcaga

SEQ ID NO: 1083175 - DNA, 13 bp, Homo sapiens
gggtgtagccagg

SEQ ID NO: 1083176 - DNA, 19 bp, Homo sapiens
gggtgtaggggccacctcc

SEQ ID NO: 1083177 - DNA, 22 bp, Homo sapiens
gggtgtatagtgttcacaaact

SEQ ID NO: 1083178 - DNA, 15 bp, Homo sapiens
gggtgtcttgggcag

SEQ ID NO: 1083179 - DNA, 20 bp, Homo sapiens
gggtgtgactcgggagctgc

SEQ ID NO: 1083180 - DNA, 12 bp, Homo sapiens
gggtgtgccctt

SEQ ID NO: 1083181 - DNA, 13 bp, Homo sapiens
gggtgtgcccttg

SEQ ID NO: 1083182 - DNA, 16 bp, Homo sapiens
gggtgtgcctgccctg

SEQ ID NO: 1083183 - DNA, 12 bp, Homo sapiens
gggtgtggcagt

SEQ ID NO: 1083184 - DNA, 15 bp, Homo sapiens
gggtgtggccagcac

SEQ ID NO: 1083185 - DNA, 21 bp, Homo sapiens
gggtgtgtttggcttggcctt

SEQ ID NO: 1083186 - DNA, 15 bp, Homo sapiens
gggtgttcagaggca

SEQ ID NO: 1083187 - DNA, 19 bp, Homo sapiens
gggtgttctttcctgccct

SEQ ID NO: 1083188 - DNA, 14 bp, Homo sapiens
gggttaaggcctga

SEQ ID NO: 1083189 - DNA, 15 bp, Homo sapiens
gggttaaggcctgaa

SEQ ID NO: 1083190 - DNA, 12 bp, Homo sapiens
gggttacaaact

SEQ ID NO: 1083191 - DNA, 21 bp, Homo sapiens
gggttagagccaagctgcaca

SEQ ID NO: 1083192 - DNA, 22 bp, Homo sapiens
gggttagcctgcaccgccgcca

SEQ ID NO: 1083193 - DNA, 18 bp, Homo sapiens
gggttaggaatctcttca

SEQ ID NO: 1083194 - DNA, 20 bp, Homo sapiens
gggttaggtggccgctcctc

SEQ ID NO: 1083195 - DNA, 21 bp, Homo sapiens
gggttaggtggccgctcctcc

SEQ ID NO: 1083196 - DNA, 21 bp, Homo sapiens
gggttatttttattaaatgta

SEQ ID NO: 1083197 - DNA, 20 bp, Homo sapiens
gggttcagaaatgctgcctg

SEQ ID NO: 1083198 - DNA, 16 bp, Homo sapiens
gggttcagcccctcct

SEQ ID NO: 1083199 - DNA, 20 bp, Homo sapiens
gggttcagcccctcctctgc

SEQ ID NO: 1083200 - DNA, 18 bp, Homo sapiens
gggttcataggggcaggt

SEQ ID NO: 1083201 - DNA, 22 bp, Homo sapiens
gggttcataggtcactggctct

SEQ ID NO: 1083202 - DNA, 17 bp, Homo sapiens
gggttcattattggaat

SEQ ID NO: 1083203 - DNA, 11 bp, Homo sapiens
gggttccaaat

SEQ ID NO: 1083204 - DNA, 23 bp, Homo sapiens
gggttccagaggtattcctctct

SEQ ID NO: 1083205 - DNA, 21 bp, Homo sapiens
gggttccctttccttccatcc

SEQ ID NO: 1083206 - DNA, 16 bp, Homo sapiens
gggttccgcactttcc

SEQ ID NO: 1083207 - DNA, 20 bp, Homo sapiens
gggttccttcctctgagcct

SEQ ID NO: 1083208 - DNA, 17 bp, Homo sapiens
gggttcgttggggacat

SEQ ID NO: 1083209 - DNA, 12 bp, Homo sapiens
gggttctagacg

SEQ ID NO: 1083210 - DNA, 15 bp, Homo sapiens
gggttctcagtgccg

SEQ ID NO: 1083211 - DNA, 13 bp, Homo sapiens
gggttctggggca

SEQ ID NO: 1083212 - DNA, 17 bp, Homo sapiens
gggttctttcttcctct

SEQ ID NO: 1083213 - DNA, 19 bp, Homo sapiens
gggttctttcttcctctgc

SEQ ID NO: 1083214 - DNA, 12 bp, Homo sapiens
gggttgaaaatt

SEQ ID NO: 1083215 - DNA, 21 bp, Homo sapiens
gggttgaagacggaaaacaat

SEQ ID NO: 1083216 - DNA, 22 bp, Homo sapiens
gggttgaaggcagtctgaaccc

SEQ ID NO: 1083217 - DNA, 13 bp, Homo sapiens
gggttgagagcca

SEQ ID NO: 1083218 - DNA, 19 bp, Homo sapiens
gggttgagggatgctggaa

SEQ ID NO: 1083219 - DNA, 19 bp, Homo sapiens
gggttgcagtggagaggga

SEQ ID NO: 1083220 - DNA, 20 bp, Homo sapiens
gggttgcgtcctgacggcgc

SEQ ID NO: 1083221 - DNA, 15 bp, Homo sapiens
gggttgcgtctgagg

SEQ ID NO: 1083222 - DNA, 23 bp, Homo sapiens
gggttgcgtctgaggcctgcccc

SEQ ID NO: 1083223 - DNA, 15 bp, Homo sapiens
gggttggccaggagg

SEQ ID NO: 1083224 - DNA, 19 bp, Homo sapiens
gggttggctgttccagact

SEQ ID NO: 1083225 - DNA, 14 bp, Homo sapiens
gggttgggcccaga

SEQ ID NO: 1083226 - DNA, 12 bp, Homo sapiens
gggttggggtgg

SEQ ID NO: 1083227 - DNA, 23 bp, Homo sapiens
ggtaaacattcctccagcctccc

SEQ ID NO: 1083228 - DNA, 20 bp, Homo sapiens
ggtaaagttaagttgagata

SEQ ID NO: 1083229 - DNA, 20 bp, Homo sapiens
ggtaaataaaccactgtgcg

SEQ ID NO: 1083230 - DNA, 20 bp, Homo sapiens
ggtaaataccaagtatttat

SEQ ID NO: 1083231 - DNA, 13 bp, Homo sapiens
ggtaaatgatgtg

SEQ ID NO: 1083232 - DNA, 13 bp, Homo sapiens
ggtaaatttctgt

SEQ ID NO: 1083233 - DNA, 13 bp, Homo sapiens
ggtaaatttttga

SEQ ID NO: 1083234 - DNA, 17 bp, Homo sapiens
ggtaaatttttgaaaaa

SEQ ID NO: 1083235 - DNA, 23 bp, Homo sapiens
ggtaacgtgattgattcagtatc

SEQ ID NO: 1083236 - DNA, 18 bp, Homo sapiens
ggtaactagggaagataa

SEQ ID NO: 1083237 - DNA, 21 bp, Homo sapiens
ggtaactgcacctgggcagct

SEQ ID NO: 1083238 - DNA, 14 bp, Homo sapiens
ggtaactgtcctgt

SEQ ID NO: 1083239 - DNA, 17 bp, Homo sapiens
ggtaactgtcctgtcct

SEQ ID NO: 1083240 - DNA, 23 bp, Homo sapiens
ggtaagaaagccaccttgttaca

SEQ ID NO: 1083241 - DNA, 20 bp, Homo sapiens
ggtaagaagtttgtgtcttt

SEQ ID NO: 1083242 - DNA, 18 bp, Homo sapiens
ggtaagattgttattaaa

SEQ ID NO: 1083243 - DNA, 15 bp, Homo sapiens
ggtaagccagagcct

SEQ ID NO: 1083244 - DNA, 14 bp, Homo sapiens
ggtaagtgaattta

SEQ ID NO: 1083245 - DNA, 23 bp, Homo sapiens
ggtaagtgttctcatgaagcagg

SEQ ID NO: 1083246 - DNA, 18 bp, Homo sapiens
ggtaagttttttgaaatt

SEQ ID NO: 1083247 - DNA, 19 bp, Homo sapiens
ggtaataagtactgtgtac

SEQ ID NO: 1083248 - DNA, 20 bp, Homo sapiens
ggtaatacttccagaagtgc

SEQ ID NO: 1083249 - DNA, 18 bp, Homo sapiens
ggtaatatacctggttta

SEQ ID NO: 1083250 - DNA, 23 bp, Homo sapiens
ggtaattattttggtacttttat

SEQ ID NO: 1083251 - DNA, 20 bp, Homo sapiens
ggtaatttaaattggtcatg

SEQ ID NO: 1083252 - DNA, 14 bp, Homo sapiens
ggtacaaaaataaa

SEQ ID NO: 1083253 - DNA, 14 bp, Homo sapiens
ggtacacagtgaga

SEQ ID NO: 1083254 - DNA, 11 bp, Homo sapiens
ggtacagcagg

SEQ ID NO: 1083255 - DNA, 17 bp, Homo sapiens
ggtacagcgggctgtgc

SEQ ID NO: 1083256 - DNA, 18 bp, Homo sapiens
ggtacagcgggctgtgcc

SEQ ID NO: 1083257 - DNA, 19 bp, Homo sapiens
ggtacagcgggctgtgccc

SEQ ID NO: 1083258 - DNA, 23 bp, Homo sapiens
ggtacagcgggctgtgcccggcc

SEQ ID NO: 1083259 - DNA, 13 bp, Homo sapiens
ggtacaggagagg

SEQ ID NO: 1083260 - DNA, 17 bp, Homo sapiens
ggtacaggagaggcagc

SEQ ID NO: 1083261 - DNA, 18 bp, Homo sapiens
ggtacatggtgtttgtgg

SEQ ID NO: 1083262 - DNA, 15 bp, Homo sapiens
ggtaccaatgctgca

SEQ ID NO: 1083263 - DNA, 15 bp, Homo sapiens
ggtaccagctgcgct

SEQ ID NO: 1083264 - DNA, 20 bp, Homo sapiens
ggtaccaggtgtcaggaaac

SEQ ID NO: 1083265 - DNA, 18 bp, Homo sapiens
ggtacccccaaaccccca

SEQ ID NO: 1083266 - DNA, 20 bp, Homo sapiens
ggtaccctttggggagcagg

SEQ ID NO: 1083267 - DNA, 17 bp, Homo sapiens
ggtacctcaagccccat

SEQ ID NO: 1083268 - DNA, 22 bp, Homo sapiens
ggtacctcaagccccatttcct

SEQ ID NO: 1083269 - DNA, 14 bp, Homo sapiens
ggtacctcatgagg

SEQ ID NO: 1083270 - DNA, 19 bp, Homo sapiens
ggtacctggtccccactgc

SEQ ID NO: 1083271 - DNA, 15 bp, Homo sapiens
ggtaccttcagccct

SEQ ID NO: 1083272 - DNA, 19 bp, Homo sapiens
ggtaccttcagccctggcc

SEQ ID NO: 1083273 - DNA, 12 bp, Homo sapiens
ggtaccttgaac

SEQ ID NO: 1083274 - DNA, 18 bp, Homo sapiens
ggtaccttgaacactggg

SEQ ID NO: 1083275 - DNA, 16 bp, Homo sapiens
ggtaccttgtgcccag

SEQ ID NO: 1083276 - DNA, 16 bp, Homo sapiens
ggtactcttgatgtga

SEQ ID NO: 1083277 - DNA, 18 bp, Homo sapiens
ggtactgactttgcttgc

SEQ ID NO: 1083278 - DNA, 16 bp, Homo sapiens
ggtactgagacagggt

SEQ ID NO: 1083279 - DNA, 17 bp, Homo sapiens
ggtactgttgctttggg

SEQ ID NO: 1083280 - DNA, 13 bp, Homo sapiens
ggtacttagagtt

SEQ ID NO: 1083281 - DNA, 16 bp, Homo sapiens
ggtacttgtcatttcg

SEQ ID NO: 1083282 - DNA, 18 bp, Homo sapiens
ggtactttattcttgctg

SEQ ID NO: 1083283 - DNA, 21 bp, Homo sapiens
ggtactttattcttgctgggc

SEQ ID NO: 1083284 - DNA, 20 bp, Homo sapiens
ggtacttttgagtgtgtgtg

SEQ ID NO: 1083285 - DNA, 18 bp, Homo sapiens
ggtagaaaactccagggt

SEQ ID NO: 1083286 - DNA, 12 bp, Homo sapiens
ggtagaagccag

SEQ ID NO: 1083287 - DNA, 21 bp, Homo sapiens
ggtagaaggggaggacactgg

SEQ ID NO: 1083288 - DNA, 17 bp, Homo sapiens
ggtagaatgattaatca

SEQ ID NO: 1083289 - DNA, 18 bp, Homo sapiens
ggtagaattgggaagctg

SEQ ID NO: 1083290 - DNA, 12 bp, Homo sapiens
ggtagaccttga

SEQ ID NO: 1083291 - DNA, 17 bp, Homo sapiens
ggtagaccttgagggtg

SEQ ID NO: 1083292 - DNA, 19 bp, Homo sapiens
ggtagaccttgagggtggg

SEQ ID NO: 1083293 - DNA, 14 bp, Homo sapiens
ggtagactttgctt

SEQ ID NO: 1083294 - DNA, 12 bp, Homo sapiens
ggtagagacccc

SEQ ID NO: 1083295 - DNA, 19 bp, Homo sapiens
ggtagagacccccaggcct

SEQ ID NO: 1083296 - DNA, 18 bp, Homo sapiens
ggtagagaggggactggg

SEQ ID NO: 1083297 - DNA, 22 bp, Homo sapiens
ggtagagaggtttttcttggga

SEQ ID NO: 1083298 - DNA, 18 bp, Homo sapiens
ggtagagcaaaggagaca

SEQ ID NO: 1083299 - DNA, 18 bp, Homo sapiens
ggtagagccctcagaacc

SEQ ID NO: 1083300 - DNA, 17 bp, Homo sapiens
ggtagagctgatccaga

SEQ ID NO: 1083301 - DNA, 21 bp, Homo sapiens
ggtagagctgatccagagcac

SEQ ID NO: 1083302 - DNA, 23 bp, Homo sapiens
ggtagagctgatccagagcacag

SEQ ID NO: 1083303 - DNA, 18 bp, Homo sapiens
ggtagatcgcttgagccc

SEQ ID NO: 1083304 - DNA, 20 bp, Homo sapiens
ggtagatcgcttgagcccag

SEQ ID NO: 1083305 - DNA, 20 bp, Homo sapiens
ggtagatgcatgacttgtgt

SEQ ID NO: 1083306 - DNA, 16 bp, Homo sapiens
ggtagcaagagagcag

SEQ ID NO: 1083307 - DNA, 13 bp, Homo sapiens
ggtagcagctgga

SEQ ID NO: 1083308 - DNA, 21 bp, Homo sapiens
ggtagcataaataaaactgaa

SEQ ID NO: 1083309 - DNA, 22 bp, Homo sapiens
ggtagcatgggtccaagagaca

SEQ ID NO: 1083310 - DNA, 16 bp, Homo sapiens
ggtagcattgaaaaat

SEQ ID NO: 1083311 - DNA, 14 bp, Homo sapiens
ggtagcattttaaa

SEQ ID NO: 1083312 - DNA, 13 bp, Homo sapiens
ggtagccagcaca

SEQ ID NO: 1083313 - DNA, 21 bp, Homo sapiens
ggtagccatgatttgtcccag

SEQ ID NO: 1083314 - DNA, 16 bp, Homo sapiens
ggtagcctgctgtggg

SEQ ID NO: 1083315 - DNA, 18 bp, Homo sapiens
ggtagctgggaaagcata

SEQ ID NO: 1083316 - DNA, 12 bp, Homo sapiens
ggtagctgtaag

SEQ ID NO: 1083317 - DNA, 19 bp, Homo sapiens
ggtagcttgtatcaaatgt

SEQ ID NO: 1083318 - DNA, 12 bp, Homo sapiens
ggtaggaaatgt

SEQ ID NO: 1083319 - DNA, 14 bp, Homo sapiens
ggtaggagcccttc

SEQ ID NO: 1083320 - DNA, 14 bp, Homo sapiens
ggtaggatgttgct

SEQ ID NO: 1083321 - DNA, 14 bp, Homo sapiens
ggtaggcagagcct

SEQ ID NO: 1083322 - DNA, 11 bp, Homo sapiens
ggtaggccctt

SEQ ID NO: 1083323 - DNA, 20 bp, Homo sapiens
ggtaggcccttgtcctgcca

SEQ ID NO: 1083324 - DNA, 16 bp, Homo sapiens
ggtagggaaataatag

SEQ ID NO: 1083325 - DNA, 13 bp, Homo sapiens
ggtaggggcaggg

SEQ ID NO: 1083326 - DNA, 14 bp, Homo sapiens
ggtaggggcaggga

SEQ ID NO: 1083327 - DNA, 15 bp, Homo sapiens
ggtagggtaaatcag

SEQ ID NO: 1083328 - DNA, 16 bp, Homo sapiens
ggtagggtaaatcagt

SEQ ID NO: 1083329 - DNA, 17 bp, Homo sapiens
ggtaggttcagccaagg

SEQ ID NO: 1083330 - DNA, 23 bp, Homo sapiens
ggtagtactcctgcaaaatttta

SEQ ID NO: 1083331 - DNA, 15 bp, Homo sapiens
ggtagtctcactgct

SEQ ID NO: 1083332 - DNA, 12 bp, Homo sapiens
ggtagtgcccca

SEQ ID NO: 1083333 - DNA, 21 bp, Homo sapiens
ggtagtggaggaggtggcttc

SEQ ID NO: 1083334 - DNA, 17 bp, Homo sapiens
ggtagttcaaagagtct

SEQ ID NO: 1083335 - DNA, 20 bp, Homo sapiens
ggtagttctgtgcctccccc

SEQ ID NO: 1083336 - DNA, 18 bp, Homo sapiens
ggtagttgcaattgaatt

SEQ ID NO: 1083337 - DNA, 18 bp, Homo sapiens
ggtagttgggtagaaaaa

SEQ ID NO: 1083338 - DNA, 21 bp, Homo sapiens
ggtataaaactttcctcgcct

SEQ ID NO: 1083339 - DNA, 22 bp, Homo sapiens
ggtataaaactttcctcgcctg

SEQ ID NO: 1083340 - DNA, 17 bp, Homo sapiens
ggtataatggttgactg

SEQ ID NO: 1083341 - DNA, 17 bp, Homo sapiens
ggtataatgtgtctgtg

SEQ ID NO: 1083342 - DNA, 15 bp, Homo sapiens
ggtataatgtttaaa

SEQ ID NO: 1083343 - DNA, 12 bp, Homo sapiens
ggtataattgaa

SEQ ID NO: 1083344 - DNA, 12 bp, Homo sapiens
ggtataggaatg

SEQ ID NO: 1083345 - DNA, 21 bp, Homo sapiens
ggtataggtctcatctcttca

SEQ ID NO: 1083346 - DNA, 22 bp, Homo sapiens
ggtataggtctcatctcttcag

SEQ ID NO: 1083347 - DNA, 18 bp, Homo sapiens
ggtatatgtcattattta

SEQ ID NO: 1083348 - DNA, 14 bp, Homo sapiens
ggtatcaaaattac

SEQ ID NO: 1083349 - DNA, 14 bp, Homo sapiens
ggtatcagttatat

SEQ ID NO: 1083350 - DNA, 20 bp, Homo sapiens
ggtatcccctgcctcctgcc

SEQ ID NO: 1083351 - DNA, 23 bp, Homo sapiens
ggtatcctactgagcatttgcac

SEQ ID NO: 1083352 - DNA, 17 bp, Homo sapiens
ggtatcctccctgccca

SEQ ID NO: 1083353 - DNA, 20 bp, Homo sapiens
ggtatctcagaaagtgcctg

SEQ ID NO: 1083354 - DNA, 12 bp, Homo sapiens
ggtatctccagg

SEQ ID NO: 1083355 - DNA, 14 bp, Homo sapiens
ggtatctccaggat

SEQ ID NO: 1083356 - DNA, 23 bp, Homo sapiens
ggtatctccaggattgaagagca

SEQ ID NO: 1083357 - DNA, 15 bp, Homo sapiens
ggtatgagctgaggg

SEQ ID NO: 1083358 - DNA, 21 bp, Homo sapiens
ggtatgattctattatatatt

SEQ ID NO: 1083359 - DNA, 16 bp, Homo sapiens
ggtatgctggccagca

SEQ ID NO: 1083360 - DNA, 17 bp, Homo sapiens
ggtatgctggccagcac

SEQ ID NO: 1083361 - DNA, 20 bp, Homo sapiens
ggtatgctggccagcaccct

SEQ ID NO: 1083362 - DNA, 13 bp, Homo sapiens
ggtatggccatgc

SEQ ID NO: 1083363 - DNA, 16 bp, Homo sapiens
ggtatggccatgccct

SEQ ID NO: 1083364 - DNA, 21 bp, Homo sapiens
ggtatgtcagaaaaaatatgt

SEQ ID NO: 1083365 - DNA, 12 bp, Homo sapiens
ggtatgtctgcc

SEQ ID NO: 1083366 - DNA, 19 bp, Homo sapiens
ggtatgtgccaggcttgcc

SEQ ID NO: 1083367 - DNA, 20 bp, Homo sapiens
ggtatgtgtgtgtgggtgtg

SEQ ID NO: 1083368 - DNA, 11 bp, Homo sapiens
ggtattaaact

SEQ ID NO: 1083369 - DNA, 22 bp, Homo sapiens
ggtattcccactcaccagccct

SEQ ID NO: 1083370 - DNA, 21 bp, Homo sapiens
ggtattgcagagaagatttta

SEQ ID NO: 1083371 - DNA, 14 bp, Homo sapiens
ggtatttataatat

SEQ ID NO: 1083372 - DNA, 17 bp, Homo sapiens
ggtatttcgaaactgcc

SEQ ID NO: 1083373 - DNA, 20 bp, Homo sapiens
ggtatttgcaccaacatagt

SEQ ID NO: 1083374 - DNA, 16 bp, Homo sapiens
ggtattttgaatacca

SEQ ID NO: 1083375 - DNA, 16 bp, Homo sapiens
ggtattttttcctttt

SEQ ID NO: 1083376 - DNA, 21 bp, Homo sapiens
ggtcaaactttttccagcaaa

SEQ ID NO: 1083377 - DNA, 14 bp, Homo sapiens
ggtcaaaggaagac

SEQ ID NO: 1083378 - DNA, 20 bp, Homo sapiens
ggtcaaagtgtaaggagttt

SEQ ID NO: 1083379 - DNA, 20 bp, Homo sapiens
ggtcaacagagaaggcagga

SEQ ID NO: 1083380 - DNA, 23 bp, Homo sapiens
ggtcaacatcttttacattctgc

SEQ ID NO: 1083381 - DNA, 21 bp, Homo sapiens
ggtcaacctttgtgtggctcc

SEQ ID NO: 1083382 - DNA, 18 bp, Homo sapiens
ggtcaagaaacagccagc

SEQ ID NO: 1083383 - DNA, 21 bp, Homo sapiens
ggtcaagaaacagccagcaag

SEQ ID NO: 1083384 - DNA, 20 bp, Homo sapiens
ggtcaagattttgaatgctt

SEQ ID NO: 1083385 - DNA, 14 bp, Homo sapiens
ggtcaagcccagaa

SEQ ID NO: 1083386 - DNA, 17 bp, Homo sapiens
ggtcaaggacagggctg

SEQ ID NO: 1083387 - DNA, 19 bp, Homo sapiens
ggtcaagttgagattttta

SEQ ID NO: 1083388 - DNA, 18 bp, Homo sapiens
ggtcaataaagcagagcc

SEQ ID NO: 1083389 - DNA, 18 bp, Homo sapiens
ggtcacacaccagcactt

SEQ ID NO: 1083390 - DNA, 21 bp, Homo sapiens
ggtcacactctacacggactg

SEQ ID NO: 1083391 - DNA, 10 bp, Homo sapiens
ggtcacagag

SEQ ID NO: 1083392 - DNA, 16 bp, Homo sapiens
ggtcacagcatggagg

SEQ ID NO: 1083393 - DNA, 15 bp, Homo sapiens
ggtcacagcggaggt

SEQ ID NO: 1083394 - DNA, 15 bp, Homo sapiens
ggtcaccaagcagtg

SEQ ID NO: 1083395 - DNA, 13 bp, Homo sapiens
ggtcaccagctgc

SEQ ID NO: 1083396 - DNA, 15 bp, Homo sapiens
ggtcaccagctgctg

SEQ ID NO: 1083397 - DNA, 16 bp, Homo sapiens
ggtcaccagctgctgt

SEQ ID NO: 1083398 - DNA, 18 bp, Homo sapiens
ggtcaccatcctcagagg

SEQ ID NO: 1083399 - DNA, 20 bp, Homo sapiens
ggtcaccatcctcagaggct

SEQ ID NO: 1083400 - DNA, 21 bp, Homo sapiens
ggtcaccatcctcagaggctg

SEQ ID NO: 1083401 - DNA, 19 bp, Homo sapiens
ggtcaccctggcctgccag

SEQ ID NO: 1083402 - DNA, 13 bp, Homo sapiens
ggtcaccctgtga

SEQ ID NO: 1083403 - DNA, 21 bp, Homo sapiens
ggtcactccagtagctcctgg

SEQ ID NO: 1083404 - DNA, 22 bp, Homo sapiens
ggtcactcttcctgcaaggact

SEQ ID NO: 1083405 - DNA, 13 bp, Homo sapiens
ggtcactcttggt

SEQ ID NO: 1083406 - DNA, 23 bp, Homo sapiens
ggtcactgaaccactgcttctct

SEQ ID NO: 1083407 - DNA, 14 bp, Homo sapiens
ggtcactgtcactg

SEQ ID NO: 1083408 - DNA, 16 bp, Homo sapiens
ggtcactgtcactgcc

SEQ ID NO: 1083409 - DNA, 23 bp, Homo sapiens
ggtcactttgccattatgcaaat

SEQ ID NO: 1083410 - DNA, 17 bp, Homo sapiens
ggtcagaaccagagggc

SEQ ID NO: 1083411 - DNA, 17 bp, Homo sapiens
ggtcagagagacctcat

SEQ ID NO: 1083412 - DNA, 14 bp, Homo sapiens
ggtcagagggccca

SEQ ID NO: 1083413 - DNA, 22 bp, Homo sapiens
ggtcagagtggcgtgagctgcc

SEQ ID NO: 1083414 - DNA, 12 bp, Homo sapiens
ggtcagatggag

SEQ ID NO: 1083415 - DNA, 22 bp, Homo sapiens
ggtcagcagatgccagtgaagg

SEQ ID NO: 1083416 - DNA, 21 bp, Homo sapiens
ggtcagcatgtctattcagct

SEQ ID NO: 1083417 - DNA, 15 bp, Homo sapiens
ggtcagccagggcca

SEQ ID NO: 1083418 - DNA, 18 bp, Homo sapiens
ggtcagccagggccaggg

SEQ ID NO: 1083419 - DNA, 18 bp, Homo sapiens
ggtctcgtcccagccctc

SEQ ID NO: 1083420 - DNA, 20 bp, Homo sapiens
ggtctcgtcttccgtctccc

SEQ ID NO: 1083421 - DNA, 16 bp, Homo sapiens
ggtctctagtgctgtg

SEQ ID NO: 1083422 - DNA, 19 bp, Homo sapiens
ggtctctagtgctgtgaaa

SEQ ID NO: 1083423 - DNA, 11 bp, Homo sapiens
ggtctctctcc

SEQ ID NO: 1083424 - DNA, 13 bp, Homo sapiens
ggtctctctccct

SEQ ID NO: 1083425 - DNA, 22 bp, Homo sapiens
ggtctctctccctacctccctc

SEQ ID NO: 1083426 - DNA, 14 bp, Homo sapiens
ggtctctctccctc

SEQ ID NO: 1083427 - DNA, 15 bp, Homo sapiens
ggtctctgaagggac

SEQ ID NO: 1083428 - DNA, 20 bp, Homo sapiens
ggtctctgaagggacccccc

SEQ ID NO: 1083429 - DNA, 11 bp, Homo sapiens
ggtctctgggg

SEQ ID NO: 1083430 - DNA, 22 bp, Homo sapiens
ggtctctggggaccctccagag

SEQ ID NO: 1083431 - DNA, 22 bp, Homo sapiens
ggtctcttcctttgctctgagg

SEQ ID NO: 1083432 - DNA, 14 bp, Homo sapiens
ggtctcttctccca

SEQ ID NO: 1083433 - DNA, 22 bp, Homo sapiens
ggtctcttcttctttctggttg

SEQ ID NO: 1083434 - DNA, 17 bp, Homo sapiens
ggtctctttgctttctg

SEQ ID NO: 1083435 - DNA, 12 bp, Homo sapiens
ggtctgaaatgg

SEQ ID NO: 1083436 - DNA, 23 bp, Homo sapiens
ggtctgaaggaatagccagagag

SEQ ID NO: 1083437 - DNA, 17 bp, Homo sapiens
ggtctgaatgttctgac

SEQ ID NO: 1083438 - DNA, 21 bp, Homo sapiens
ggtctgaatgttctgacatta

SEQ ID NO: 1083439 - DNA, 20 bp, Homo sapiens
ggtctgcaagggcccagagt

SEQ ID NO: 1083440 - DNA, 15 bp, Homo sapiens
ggtctgcacagattc

SEQ ID NO: 1083441 - DNA, 16 bp, Homo sapiens
ggtctgccaggggctt

SEQ ID NO: 1083442 - DNA, 14 bp, Homo sapiens
ggtctgccctgccc

SEQ ID NO: 1083443 - DNA, 16 bp, Homo sapiens
ggtctgctctttctct

SEQ ID NO: 1083444 - DNA, 18 bp, Homo sapiens
ggtctgctctttctctgc

SEQ ID NO: 1083445 - DNA, 19 bp, Homo sapiens
ggtctgctctttctctgcc

SEQ ID NO: 1083446 - DNA, 23 bp, Homo sapiens
ggtctggagaagctcccaggaac

SEQ ID NO: 1083447 - DNA, 17 bp, Homo sapiens
ggtctggagtcccaccc

SEQ ID NO: 1083448 - DNA, 18 bp, Homo sapiens
ggtctggagtcccacccg

SEQ ID NO: 1083449 - DNA, 21 bp, Homo sapiens
ggtctggcagagcctctgaga

SEQ ID NO: 1083450 - DNA, 17 bp, Homo sapiens
ggtctgggacttccttg

SEQ ID NO: 1083451 - DNA, 20 bp, Homo sapiens
ggtctgggcaagtagcagga

SEQ ID NO: 1083452 - DNA, 20 bp, Homo sapiens
ggtctgggcagtgccacagc

SEQ ID NO: 1083453 - DNA, 21 bp, Homo sapiens
ggtctgggcagtgccacagcc

SEQ ID NO: 1083454 - DNA, 18 bp, Homo sapiens
ggtctgggcgtccagctc

SEQ ID NO: 1083455 - DNA, 21 bp, Homo sapiens
ggtctgggcgtccagctcagc

SEQ ID NO: 1083456 - DNA, 18 bp, Homo sapiens
ggtctggggaagaggatg

SEQ ID NO: 1083457 - DNA, 18 bp, Homo sapiens
ggtctggggacaggcccg

SEQ ID NO: 1083458 - DNA, 15 bp, Homo sapiens
ggtctggttgggcag

SEQ ID NO: 1083459 - DNA, 16 bp, Homo sapiens
ggtctgtatatacatt

SEQ ID NO: 1083460 - DNA, 14 bp, Homo sapiens
ggtctgtcccacca

SEQ ID NO: 1083461 - DNA, 15 bp, Homo sapiens
ggtctgtcccaccag

SEQ ID NO: 1083462 - DNA, 12 bp, Homo sapiens
ggtctgtctgga

SEQ ID NO: 1083463 - DNA, 14 bp, Homo sapiens
ggtctgtctggatc

SEQ ID NO: 1083464 - DNA, 16 bp, Homo sapiens
ggtctgtgcatttctg

SEQ ID NO: 1083465 - DNA, 18 bp, Homo sapiens
ggtctgtgtctcttttct

SEQ ID NO: 1083466 - DNA, 22 bp, Homo sapiens
ggtcttatgattttattacaga

SEQ ID NO: 1083467 - DNA, 22 bp, Homo sapiens
ggtcttcagcctccctcagccc

SEQ ID NO: 1083468 - DNA, 12 bp, Homo sapiens
ggtcttccaggg

SEQ ID NO: 1083469 - DNA, 17 bp, Homo sapiens
ggtcttccctacctcag

SEQ ID NO: 1083470 - DNA, 18 bp, Homo sapiens
ggtcttccttctacccca

SEQ ID NO: 1083471 - DNA, 16 bp, Homo sapiens
ggtcttcttgtgtcct

SEQ ID NO: 1083472 - DNA, 21 bp, Homo sapiens
ggtcttcttgtgtcctgatga

SEQ ID NO: 1083473 - DNA, 21 bp, Homo sapiens
ggtcttgaatagattttctct

SEQ ID NO: 1083474 - DNA, 23 bp, Homo sapiens
ggtcttgaatagattttctctgg

SEQ ID NO: 1083475 - DNA, 19 bp, Homo sapiens
ggtcttgactcatggcagc

SEQ ID NO: 1083476 - DNA, 21 bp, Homo sapiens
ggtcttgagccagtaatcttt

SEQ ID NO: 1083477 - DNA, 16 bp, Homo sapiens
ggtcttgaggggaagc

SEQ ID NO: 1083478 - DNA, 14 bp, Homo sapiens
ggtcttgccccatc

SEQ ID NO: 1083479 - DNA, 19 bp, Homo sapiens
ggtcttgctatgttgccca

SEQ ID NO: 1083480 - DNA, 13 bp, Homo sapiens
ggtcttgctctgt

SEQ ID NO: 1083481 - DNA, 15 bp, Homo sapiens
ggtcttgctctgtcc

SEQ ID NO: 1083482 - DNA, 18 bp, Homo sapiens
ggtcttggagctgagcct

SEQ ID NO: 1083483 - DNA, 15 bp, Homo sapiens
ggtcttggctgcctg

SEQ ID NO: 1083484 - DNA, 18 bp, Homo sapiens
ggtcttgggctactggca

SEQ ID NO: 1083485 - DNA, 19 bp, Homo sapiens
ggtcttgtttccaggagca

SEQ ID NO: 1083486 - DNA, 16 bp, Homo sapiens
ggtctttctcctcagg

SEQ ID NO: 1083487 - DNA, 17 bp, Homo sapiens
ggtctttctctcagtga

SEQ ID NO: 1083488 - DNA, 21 bp, Homo sapiens
ggtctttgttatgacagtgaa

SEQ ID NO: 1083489 - DNA, 22 bp, Homo sapiens
ggtcttttaccctgtgtcagag

SEQ ID NO: 1083490 - DNA, 23 bp, Homo sapiens
ggtcttttaccctgtgtcagagc

SEQ ID NO: 1083491 - DNA, 13 bp, Homo sapiens
ggtcttttctcct

SEQ ID NO: 1083492 - DNA, 14 bp, Homo sapiens
ggtcttttctttgg

SEQ ID NO: 1083493 - DNA, 17 bp, Homo sapiens
ggtcttttgacatgtgg

SEQ ID NO: 1083494 - DNA, 17 bp, Homo sapiens
ggtctttttatgcattt

SEQ ID NO: 1083495 - DNA, 20 bp, Homo sapiens
ggtgaaacgactcaaaatga

SEQ ID NO: 1083496 - DNA, 20 bp, Homo sapiens
ggtgaaagcataacatgggt

SEQ ID NO: 1083497 - DNA, 18 bp, Homo sapiens
ggtgaacaaagcagccac

SEQ ID NO: 1083498 - DNA, 14 bp, Homo sapiens
ggtgaacactgtga

SEQ ID NO: 1083499 - DNA, 15 bp, Homo sapiens
ggtgaacagctggtg

SEQ ID NO: 1083500 - DNA, 18 bp, Homo sapiens
ggtgaacagctggtgcca

SEQ ID NO: 1083501 - DNA, 15 bp, Homo sapiens
ggtgaactgcaaagc

SEQ ID NO: 1083502 - DNA, 15 bp, Homo sapiens
ggtgaagcgcctcag

SEQ ID NO: 1083503 - DNA, 16 bp, Homo sapiens
ggtgaaggctctcacc

SEQ ID NO: 1083504 - DNA, 17 bp, Homo sapiens
ggtgaagggatggggga

SEQ ID NO: 1083505 - DNA, 18 bp, Homo sapiens
ggtgaatatggtggaaaa

SEQ ID NO: 1083506 - DNA, 18 bp, Homo sapiens
ggtgacaagatagagagc

SEQ ID NO: 1083507 - DNA, 18 bp, Homo sapiens
ggtgacacaggtcagggc

SEQ ID NO: 1083508 - DNA, 23 bp, Homo sapiens
ggtgacagagcgagattccgtct

SEQ ID NO: 1083509 - DNA, 19 bp, Homo sapiens
ggtgacagtcatcatcagg

SEQ ID NO: 1083510 - DNA, 20 bp, Homo sapiens
ggtgacagtcatcatcaggg

SEQ ID NO: 1083511 - DNA, 21 bp, Homo sapiens
ggtgacagtcatcatcagggc

SEQ ID NO: 1083512 - DNA, 22 bp, Homo sapiens
ggtgacagtcatcatcagggcc

SEQ ID NO: 1083513 - DNA, 23 bp, Homo sapiens
ggtgacagtcatcatcagggcct

SEQ ID NO: 1083514 - DNA, 16 bp, Homo sapiens
ggtgacatatacatac

SEQ ID NO: 1083515 - DNA, 20 bp, Homo sapiens
ggtgacatggggaaggcaga

SEQ ID NO: 1083516 - DNA, 22 bp, Homo sapiens
ggtgaccagcctgtcacccagc

SEQ ID NO: 1083517 - DNA, 17 bp, Homo sapiens
ggtgacccacagctctg

SEQ ID NO: 1083518 - DNA, 23 bp, Homo sapiens
ggtgacccacagctctgggcctc

SEQ ID NO: 1083519 - DNA, 15 bp, Homo sapiens
ggtgaccgcccagct

SEQ ID NO: 1083520 - DNA, 15 bp, Homo sapiens
ggtgaccttctggga

SEQ ID NO: 1083521 - DNA, 20 bp, Homo sapiens
ggtgacgcccaccttcgggc

SEQ ID NO: 1083522 - DNA, 14 bp, Homo sapiens
ggtgacgcccagct

SEQ ID NO: 1083523 - DNA, 15 bp, Homo sapiens
ggtgacgcccagctc

SEQ ID NO: 1083524 - DNA, 16 bp, Homo sapiens
ggtgacgcccagctcc

SEQ ID NO: 1083525 - DNA, 21 bp, Homo sapiens
ggtgacggtcctttaggcagc

SEQ ID NO: 1083526 - DNA, 22 bp, Homo sapiens
ggtgacggtcctttaggcagcc

SEQ ID NO: 1083527 - DNA, 19 bp, Homo sapiens
ggtgactcacttcaatgtg

SEQ ID NO: 1083528 - DNA, 13 bp, Homo sapiens
ggtgactctgtcc

SEQ ID NO: 1083529 - DNA, 20 bp, Homo sapiens
ggtgactgaatttgggcctc

SEQ ID NO: 1083530 - DNA, 14 bp, Homo sapiens
ggtgactgtgtgtg

SEQ ID NO: 1083531 - DNA, 18 bp, Homo sapiens
ggtgacttccctggtcac

SEQ ID NO: 1083532 - DNA, 15 bp, Homo sapiens
ggtgagaaatttaaa

SEQ ID NO: 1083533 - DNA, 12 bp, Homo sapiens
ggtgccaagggc

SEQ ID NO: 1083534 - DNA, 23 bp, Homo sapiens
ggtgccaatttcaagttccaagt

SEQ ID NO: 1083535 - DNA, 13 bp, Homo sapiens
ggtgccactccct

SEQ ID NO: 1083536 - DNA, 19 bp, Homo sapiens
ggtgccactccctgagctt

SEQ ID NO: 1083537 - DNA, 23 bp, Homo sapiens
ggtgccacttcttaaaggcctgg

SEQ ID NO: 1083538 - DNA, 16 bp, Homo sapiens
ggtgccactttaccca

SEQ ID NO: 1083539 - DNA, 14 bp, Homo sapiens
ggtgccagcaactg

SEQ ID NO: 1083540 - DNA, 19 bp, Homo sapiens
ggtgccagcaactgaataa

SEQ ID NO: 1083541 - DNA, 15 bp, Homo sapiens
ggtgccagccttcct

SEQ ID NO: 1083542 - DNA, 23 bp, Homo sapiens
ggtgccagccttcctctgcagct

SEQ ID NO: 1083543 - DNA, 18 bp, Homo sapiens
ggtgccaggctgtaagca

SEQ ID NO: 1083544 - DNA, 14 bp, Homo sapiens
ggtgccagttgggc

SEQ ID NO: 1083545 - DNA, 14 bp, Homo sapiens
ggtgccatcacgct

SEQ ID NO: 1083546 - DNA, 15 bp, Homo sapiens
ggtgccatcacgctt

SEQ ID NO: 1083547 - DNA, 22 bp, Homo sapiens
ggtgccatgaagggaccctttg

SEQ ID NO: 1083548 - DNA, 15 bp, Homo sapiens
ggtgccattcccagc

SEQ ID NO: 1083549 - DNA, 19 bp, Homo sapiens
ggtgccattttaaatttta

SEQ ID NO: 1083550 - DNA, 20 bp, Homo sapiens
ggtgccattttaaattttat

SEQ ID NO: 1083551 - DNA, 22 bp, Homo sapiens
ggtgcccaagccagaggctggg

SEQ ID NO: 1083552 - DNA, 15 bp, Homo sapiens
ggtgcccatcctgcc

SEQ ID NO: 1083553 - DNA, 16 bp, Homo sapiens
ggtgcccatcctgcca

SEQ ID NO: 1083554 - DNA, 13 bp, Homo sapiens
ggtgccccacagc

SEQ ID NO: 1083555 - DNA, 22 bp, Homo sapiens
ggtgccccccacccctggaaga

SEQ ID NO: 1083556 - DNA, 12 bp, Homo sapiens
ggtgccccctcc

SEQ ID NO: 1083557 - DNA, 22 bp, Homo sapiens
ggtgccccctcctctcccatcc

SEQ ID NO: 1083558 - DNA, 14 bp, Homo sapiens
ggtgccctctcagg

SEQ ID NO: 1083559 - DNA, 16 bp, Homo sapiens
ggtgccctgaaagggc

SEQ ID NO: 1083560 - DNA, 20 bp, Homo sapiens
ggtgcctaagaagttatttt

SEQ ID NO: 1083561 - DNA, 22 bp, Homo sapiens
ggtgcctcagttttccttctgt

SEQ ID NO: 1083562 - DNA, 21 bp, Homo sapiens
ggtgcctcatagcatagccag

SEQ ID NO: 1083563 - DNA, 23 bp, Homo sapiens
ggtgcctcatagcatagccagca

SEQ ID NO: 1083564 - DNA, 13 bp, Homo sapiens
ggtgcctccaggt

SEQ ID NO: 1083565 - DNA, 14 bp, Homo sapiens
ggtgcctccaggtg

SEQ ID NO: 1083566 - DNA, 16 bp, Homo sapiens
ggtgcctccaggtgtg

SEQ ID NO: 1083567 - DNA, 19 bp, Homo sapiens
ggtgcctcccacacttgct

SEQ ID NO: 1083568 - DNA, 12 bp, Homo sapiens
ggtgcctcctgc

SEQ ID NO: 1083569 - DNA, 15 bp, Homo sapiens
ggtgcctcctgcagt

SEQ ID NO: 1083570 - DNA, 19 bp, Homo sapiens
ggtgcctgagaggcaggca

SEQ ID NO: 1083571 - DNA, 18 bp, Homo sapiens
ggtgcctgctcaggtgct

SEQ ID NO: 1083572 - DNA, 11 bp, Homo sapiens
ggtgcctggcc

SEQ ID NO: 1083573 - DNA, 19 bp, Homo sapiens
ggtgcctgggtggggctgc

SEQ ID NO: 1083574 - DNA, 22 bp, Homo sapiens
ggtgcctgggtggggctgctcc

SEQ ID NO: 1083575 - DNA, 17 bp, Homo sapiens
ggtgcctgtcccacccc

SEQ ID NO: 1083576 - DNA, 19 bp, Homo sapiens
ggtgcctgtgaggcagggg

SEQ ID NO: 1083577 - DNA, 19 bp, Homo sapiens
ggtgccttacatcttttct

SEQ ID NO: 1083578 - DNA, 23 bp, Homo sapiens
ggtgccttcttattctcactcca

SEQ ID NO: 1083579 - DNA, 23 bp, Homo sapiens
ggtgcggatggacactaatgcag

SEQ ID NO: 1083580 - DNA, 14 bp, Homo sapiens
ggtgcgtctccagt

SEQ ID NO: 1083581 - DNA, 17 bp, Homo sapiens
ggtgcgtctccagtcat

SEQ ID NO: 1083582 - DNA, 16 bp, Homo sapiens
ggtgcgtttttacagt

SEQ ID NO: 1083583 - DNA, 23 bp, Homo sapiens
ggtgctaaagccaaccagccttt

SEQ ID NO: 1083584 - DNA, 22 bp, Homo sapiens
ggtgctatatccagttcctgct

SEQ ID NO: 1083585 - DNA, 14 bp, Homo sapiens
ggtgctatttgaag

SEQ ID NO: 1083586 - DNA, 22 bp, Homo sapiens
ggtgctcacgactcttcctgca

SEQ ID NO: 1083587 - DNA, 23 bp, Homo sapiens
ggtgctcagaataaggcaggcat

SEQ ID NO: 1083588 - DNA, 19 bp, Homo sapiens
ggtgctcctgcccagccac

SEQ ID NO: 1083589 - DNA, 20 bp, Homo sapiens
ggtgctcggagaagagcgca

SEQ ID NO: 1083590 - DNA, 16 bp, Homo sapiens
ggtgctctctgccact

SEQ ID NO: 1083591 - DNA, 12 bp, Homo sapiens
ggtgctctggcg

SEQ ID NO: 1083592 - DNA, 12 bp, Homo sapiens
ggtgctctgtgt

SEQ ID NO: 1083593 - DNA, 19 bp, Homo sapiens
ggtgctgactggcttcagc

SEQ ID NO: 1083594 - DNA, 12 bp, Homo sapiens
ggtgctgcagga

SEQ ID NO: 1083595 - DNA, 15 bp, Homo sapiens
ggtgctgcaggagtg

SEQ ID NO: 1083596 - DNA, 14 bp, Homo sapiens
ggtgctgcttccct

SEQ ID NO: 1083597 - DNA, 21 bp, Homo sapiens
ggtgctgcttccctctgcctg

SEQ ID NO: 1083598 - DNA, 13 bp, Homo sapiens
ggtgctggaggat

SEQ ID NO: 1083599 - DNA, 14 bp, Homo sapiens
ggtgctgggactga

SEQ ID NO: 1083600 - DNA, 22 bp, Homo sapiens
ggtgctgggctggactggccat

SEQ ID NO: 1083601 - DNA, 12 bp, Homo sapiens
ggtgctggggcc

SEQ ID NO: 1083602 - DNA, 16 bp, Homo sapiens
ggtgctggggccaggg

SEQ ID NO: 1083603 - DNA, 18 bp, Homo sapiens
ggtgctggggccagggca

SEQ ID NO: 1083604 - DNA, 16 bp, Homo sapiens
ggtgctgggggcacag

SEQ ID NO: 1083605 - DNA, 19 bp, Homo sapiens
ggtgctgggggcacagctg

SEQ ID NO: 1083606 - DNA, 15 bp, Homo sapiens
ggtgctggtagctga

SEQ ID NO: 1083607 - DNA, 16 bp, Homo sapiens
ggtgctggtagctgag

SEQ ID NO: 1083608 - DNA, 19 bp, Homo sapiens
ggtgctggtagctgagggg

SEQ ID NO: 1083609 - DNA, 13 bp, Homo sapiens
ggtgctggtgggt

SEQ ID NO: 1083610 - DNA, 11 bp, Homo sapiens
ggtgctgtcca

SEQ ID NO: 1083611 - DNA, 15 bp, Homo sapiens
ggtgctgtcctcagg

SEQ ID NO: 1083612 - DNA, 19 bp, Homo sapiens
ggtgctgtcctcaggtggc

SEQ ID NO: 1083613 - DNA, 23 bp, Homo sapiens
ggtgctgtcctcaggtggccatg

SEQ ID NO: 1083614 - DNA, 22 bp, Homo sapiens
ggtgctgtcttttgttctctga

SEQ ID NO: 1083615 - DNA, 20 bp, Homo sapiens
ggtgcttcctcctcaggccc

SEQ ID NO: 1083616 - DNA, 18 bp, Homo sapiens
ggtgcttggtgagtcttg

SEQ ID NO: 1083617 - DNA, 21 bp, Homo sapiens
ggtgcttgttccctctccctg

SEQ ID NO: 1083618 - DNA, 19 bp, Homo sapiens
ggtgcttttatagaggcta

SEQ ID NO: 1083619 - DNA, 21 bp, Homo sapiens
ggtgcttttatagaggctagc

SEQ ID NO: 1083620 - DNA, 18 bp, Homo sapiens
ggtgcttttgatgtgaaa

SEQ ID NO: 1083621 - DNA, 17 bp, Homo sapiens
ggtggaaaacagggtgc

SEQ ID NO: 1083622 - DNA, 23 bp, Homo sapiens
ggtggaaattttatatgtaaatg

SEQ ID NO: 1083623 - DNA, 15 bp, Homo sapiens
ggtggaacaagcaca

SEQ ID NO: 1083624 - DNA, 13 bp, Homo sapiens
ggtggaagccctc

SEQ ID NO: 1083625 - DNA, 15 bp, Homo sapiens
ggtggaaggatggga

SEQ ID NO: 1083626 - DNA, 20 bp, Homo sapiens
ggtggaaggtaagaggttgg

SEQ ID NO: 1083627 - DNA, 23 bp, Homo sapiens
ggttattttgatgtaaagatgtt

SEQ ID NO: 1083628 - DNA, 20 bp, Homo sapiens
ggttcaagtgattctcctgc

SEQ ID NO: 1083629 - DNA, 19 bp, Homo sapiens
ggttcaagtgattctcttg

SEQ ID NO: 1083630 - DNA, 13 bp, Homo sapiens
ggttcaccttgcc

SEQ ID NO: 1083631 - DNA, 22 bp, Homo sapiens
ggttcaccttgccgagagaggc

SEQ ID NO: 1083632 - DNA, 21 bp, Homo sapiens
ggttcacttgccatgcaggaa

SEQ ID NO: 1083633 - DNA, 22 bp, Homo sapiens
ggttcacttgccatgcaggaag

SEQ ID NO: 1083634 - DNA, 22 bp, Homo sapiens
ggttcagaaatgctgcctgcct

SEQ ID NO: 1083635 - DNA, 15 bp, Homo sapiens
ggttcagacacagct

SEQ ID NO: 1083636 - DNA, 16 bp, Homo sapiens
ggttcagacacagctc

SEQ ID NO: 1083637 - DNA, 17 bp, Homo sapiens
ggttcagacacagctct

SEQ ID NO: 1083638 - DNA, 20 bp, Homo sapiens
ggttcagcccctcctctgcc

SEQ ID NO: 1083639 - DNA, 22 bp, Homo sapiens
ggttcagcccctcctctgccac

SEQ ID NO: 1083640 - DNA, 20 bp, Homo sapiens
ggttcatacgcatcccatct

SEQ ID NO: 1083641 - DNA, 21 bp, Homo sapiens
ggttcatacgcatcccatctc

SEQ ID NO: 1083642 - DNA, 22 bp, Homo sapiens
ggttcatacgcatcccatctct

SEQ ID NO: 1083643 - DNA, 21 bp, Homo sapiens
ggttcatgtagagaaaagcac

SEQ ID NO: 1083644 - DNA, 17 bp, Homo sapiens
ggttcattattggaatt

SEQ ID NO: 1083645 - DNA, 23 bp, Homo sapiens
ggttccaagaaagatccaccctc

SEQ ID NO: 1083646 - DNA, 22 bp, Homo sapiens
ggttccagaacagccctcggcc

SEQ ID NO: 1083647 - DNA, 11 bp, Homo sapiens
ggttccagagg

SEQ ID NO: 1083648 - DNA, 20 bp, Homo sapiens
ggttccagcaattctcctgc

SEQ ID NO: 1083649 - DNA, 19 bp, Homo sapiens
ggttccatgcagccttggg

SEQ ID NO: 1083650 - DNA, 14 bp, Homo sapiens
ggttccatgcctga

SEQ ID NO: 1083651 - DNA, 18 bp, Homo sapiens
ggttccatgcctgagggt

SEQ ID NO: 1083652 - DNA, 20 bp, Homo sapiens
ggttccatttttcctctgtt

SEQ ID NO: 1083653 - DNA, 15 bp, Homo sapiens
ggttcccaaggacat

SEQ ID NO: 1083654 - DNA, 17 bp, Homo sapiens
ggttcccaataaaagtg

SEQ ID NO: 1083655 - DNA, 16 bp, Homo sapiens
ggttccccacacaggg

SEQ ID NO: 1083656 - DNA, 13 bp, Homo sapiens
ggttccccagaga

SEQ ID NO: 1083657 - DNA, 14 bp, Homo sapiens
ggttccccagagag

SEQ ID NO: 1083658 - DNA, 22 bp, Homo sapiens
ggttccccagagagcaggcagg

SEQ ID NO: 1083659 - DNA, 13 bp, Homo sapiens
ggttcccccagcc

SEQ ID NO: 1083660 - DNA, 14 bp, Homo sapiens
ggttcccccagccc

SEQ ID NO: 1083661 - DNA, 16 bp, Homo sapiens
ggttcccccagccctg

SEQ ID NO: 1083662 - DNA, 15 bp, Homo sapiens
ggttcccctggcctt

SEQ ID NO: 1083663 - DNA, 17 bp, Homo sapiens
ggttcccgagggagctg

SEQ ID NO: 1083664 - DNA, 16 bp, Homo sapiens
ggttcccggtcccgag

SEQ ID NO: 1083665 - DNA, 19 bp, Homo sapiens
ggttccctcctagctctcc

SEQ ID NO: 1083666 - DNA, 22 bp, Homo sapiens
ggttccgcttggagcagagggg

SEQ ID NO: 1083667 - DNA, 23 bp, Homo sapiens
ggttccgcttggagcagaggggc

SEQ ID NO: 1083668 - DNA, 24 bp, Homo sapiens
ggttccgtatctccctggagaagc

SEQ ID NO: 1083669 - DNA, 16 bp, Homo sapiens
ggttcctaagcctgtt

SEQ ID NO: 1083670 - DNA, 17 bp, Homo sapiens
ggttcctctgcctgccc

SEQ ID NO: 1083671 - DNA, 11 bp, Homo sapiens
ggttcctgtga

SEQ ID NO: 1083672 - DNA, 15 bp, Homo sapiens
ggttccttccctggg

SEQ ID NO: 1083673 - DNA, 17 bp, Homo sapiens
ggttcgagactccatct

SEQ ID NO: 1083674 - DNA, 16 bp, Homo sapiens
ggttctaagtgggaga

SEQ ID NO: 1083675 - DNA, 11 bp, Homo sapiens
ggttctagacg

SEQ ID NO: 1083676 - DNA, 20 bp, Homo sapiens
ggttctagacgcccctccca

SEQ ID NO: 1083677 - DNA, 13 bp, Homo sapiens
ggttctataataa

SEQ ID NO: 1083678 - DNA, 20 bp, Homo sapiens
ggttctatctgcttagcaac

SEQ ID NO: 1083679 - DNA, 11 bp, Homo sapiens
ggttctatttt

SEQ ID NO: 1083680 - DNA, 17 bp, Homo sapiens
ggttctccccctcctga

SEQ ID NO: 1083681 - DNA, 19 bp, Homo sapiens
ggttctccgttagctcctg

SEQ ID NO: 1083682 - DNA, 13 bp, Homo sapiens
ggttctgccctgc

SEQ ID NO: 1083683 - DNA, 17 bp, Homo sapiens
ggttctgccctgcctga

SEQ ID NO: 1083684 - DNA, 21 bp, Homo sapiens
ggttctgccctgcctgaggag

SEQ ID NO: 1083685 - DNA, 13 bp, Homo sapiens
ggttctgcctgct

SEQ ID NO: 1083686 - DNA, 23 bp, Homo sapiens
ggttctgcctttagcctggacca

SEQ ID NO: 1083687 - DNA, 21 bp, Homo sapiens
ggttctgctagagcagacagg

SEQ ID NO: 1083688 - DNA, 13 bp, Homo sapiens
ggttctggcagga

SEQ ID NO: 1083689 - DNA, 21 bp, Homo sapiens
ggttctggcaggacctgccta

SEQ ID NO: 1083690 - DNA, 13 bp, Homo sapiens
ggttctggctgtt

SEQ ID NO: 1083691 - DNA, 15 bp, Homo sapiens
ggttctgtttcagag

SEQ ID NO: 1083692 - DNA, 13 bp, Homo sapiens
ggttcttcctttc

SEQ ID NO: 1083693 - DNA, 22 bp, Homo sapiens
ggttcttcctttccctggagct

SEQ ID NO: 1083694 - DNA, 22 bp, Homo sapiens
ggttcttgagccagccaggccc

SEQ ID NO: 1083695 - DNA, 17 bp, Homo sapiens
ggttcttggtagagatt

SEQ ID NO: 1083696 - DNA, 10 bp, Homo sapiens
ggttcttgtt

SEQ ID NO: 1083697 - DNA, 14 bp, Homo sapiens
ggttcttgttggtg

SEQ ID NO: 1083698 - DNA, 18 bp, Homo sapiens
ggttctttcatttgcttt

SEQ ID NO: 1083699 - DNA, 16 bp, Homo sapiens
ggttctttcttcctct

SEQ ID NO: 1083700 - DNA, 22 bp, Homo sapiens
ggttgaactctggtggcacagg

SEQ ID NO: 1083701 - DNA, 16 bp, Homo sapiens
ggttgaaggcagtctg

SEQ ID NO: 1083702 - DNA, 19 bp, Homo sapiens
ggttgaggggctcctggaa

SEQ ID NO: 1083703 - DNA, 17 bp, Homo sapiens
ggttgatggaaaataaa

SEQ ID NO: 1083704 - DNA, 14 bp, Homo sapiens
ggttgattgtttaa

SEQ ID NO: 1083705 - DNA, 14 bp, Homo sapiens
ggttgcaaccactg

SEQ ID NO: 1083706 - DNA, 22 bp, Homo sapiens
ggttgcactttagacatttttg

SEQ ID NO: 1083707 - DNA, 13 bp, Homo sapiens
ggttgcagggagc

SEQ ID NO: 1083708 - DNA, 13 bp, Homo sapiens
ggttgcagtcact

SEQ ID NO: 1083709 - DNA, 13 bp, Homo sapiens
ggttgccacccca

SEQ ID NO: 1083710 - DNA, 13 bp, Homo sapiens
ggttgccatggag

SEQ ID NO: 1083711 - DNA, 13 bp, Homo sapiens
ggttgcctccccc

SEQ ID NO: 1083712 - DNA, 19 bp, Homo sapiens
ggttgcctctcttgcccct

SEQ ID NO: 1083713 - DNA, 16 bp, Homo sapiens
ggttgctcacagctgt

SEQ ID NO: 1083714 - DNA, 15 bp, Homo sapiens
ggttgctggtcaggt

SEQ ID NO: 1083715 - DNA, 15 bp, Homo sapiens
ggttggacagccccc

SEQ ID NO: 1083716 - DNA, 14 bp, Homo sapiens
ggttggagagccct

SEQ ID NO: 1083717 - DNA, 17 bp, Homo sapiens
ggttggagagccctgga

SEQ ID NO: 1083718 - DNA, 12 bp, Homo sapiens
ggttggagggaa

SEQ ID NO: 1083719 - DNA, 18 bp, Homo sapiens
ggttggcaaaaaggcagg

SEQ ID NO: 1083720 - DNA, 14 bp, Homo sapiens
ggttggcagtaagg

SEQ ID NO: 1083721 - DNA, 15 bp, Homo sapiens
ggttggccaggaggt

SEQ ID NO: 1083722 - DNA, 21 bp, Homo sapiens
ggttgggcagccagaccagca

SEQ ID NO: 1083723 - DNA, 17 bp, Homo sapiens
ggttgggcccagatctg

SEQ ID NO: 1083724 - DNA, 14 bp, Homo sapiens
ggttggggtgacag

SEQ ID NO: 1083725 - DNA, 15 bp, Homo sapiens
ggttggggtgacagt

SEQ ID NO: 1083726 - DNA, 17 bp, Homo sapiens
ggttggggtgggagggc

SEQ ID NO: 1083727 - DNA, 13 bp, Homo sapiens
ggttggtagggtg

SEQ ID NO: 1083728 - DNA, 15 bp, Homo sapiens
ggttggtgggctggc

SEQ ID NO: 1083729 - DNA, 19 bp, Homo sapiens
ggttggtgggctggcccag

SEQ ID NO: 1083730 - DNA, 13 bp, Homo sapiens
ggttgtatttcta

SEQ ID NO: 1083731 - DNA, 10 bp, Homo sapiens
ggttgtcaat

SEQ ID NO: 1083732 - DNA, 13 bp, Homo sapiens
ggttgtcaatatt

SEQ ID NO: 1083733 - DNA, 17 bp, Homo sapiens
ggttgtgaaatgtaaca

SEQ ID NO: 1083734 - DNA, 22 bp, Homo sapiens
ggttgtgaggcctggccaggca

SEQ ID NO: 1083735 - DNA, 11 bp, Homo sapiens
ggttgtgcatg

SEQ ID NO: 1083736 - DNA, 21 bp, Homo sapiens
ggttgtggcccccgccccctc

SEQ ID NO: 1083737 - DNA, 19 bp, Homo sapiens
ggttgtggggaggctgcac

SEQ ID NO: 1083738 - DNA, 16 bp, Homo sapiens
ggtttaaaagaaaaaa

SEQ ID NO: 1083739 - DNA, 13 bp, Homo sapiens
ggtttaagctgtt

SEQ ID NO: 1083740 - DNA, 17 bp, Homo sapiens
ggtttcatatttcttat

SEQ ID NO: 1083741 - DNA, 13 bp, Homo sapiens
ggtttcatgttca

SEQ ID NO: 1083742 - DNA, 17 bp, Homo sapiens
ggtttcatgttcactgt

SEQ ID NO: 1083743 - DNA, 12 bp, Homo sapiens
ggtttcctctgg

SEQ ID NO: 1083744 - DNA, 14 bp, Homo sapiens
ggtttcctctggat

SEQ ID NO: 1083745 - DNA, 17 bp, Homo sapiens
ggtttcgactggtccag

SEQ ID NO: 1083746 - DNA, 19 bp, Homo sapiens
ggtttcgactggtccagct

SEQ ID NO: 1083747 - DNA, 22 bp, Homo sapiens
ggtttcgactggtccagctctg

SEQ ID NO: 1083748 - DNA, 15 bp, Homo sapiens
ggtttcggaaaaaaa

SEQ ID NO: 1083749 - DNA, 17 bp, Homo sapiens
ggtttcgtttctgtata

SEQ ID NO: 1083750 - DNA, 18 bp, Homo sapiens
ggtttctacttcccctgg

SEQ ID NO: 1083751 - DNA, 21 bp, Homo sapiens
ggtttctcgcataggaccttt

SEQ ID NO: 1083752 - DNA, 20 bp, Homo sapiens
ggtttctctattaaaatgca

SEQ ID NO: 1083753 - DNA, 16 bp, Homo sapiens
ggtttctctccctcct

SEQ ID NO: 1083754 - DNA, 15 bp, Homo sapiens
ggtttctctctacag

SEQ ID NO: 1083755 - DNA, 18 bp, Homo sapiens
ggtttctctctacagtgc

SEQ ID NO: 1083756 - DNA, 14 bp, Homo sapiens
ggtttctctgtgct

SEQ ID NO: 1083757 - DNA, 21 bp, Homo sapiens
ggtttctctgtgctctgaatg

SEQ ID NO: 1083758 - DNA, 20 bp, Homo sapiens
ggtttctgatctgtactttg

SEQ ID NO: 1083759 - DNA, 18 bp, Homo sapiens
ggtttctggataaaccac

SEQ ID NO: 1083760 - DNA, 21 bp, Homo sapiens
ggtttctgtctgaattattct

SEQ ID NO: 1083761 - DNA, 12 bp, Homo sapiens
ggtttgagaaat

SEQ ID NO: 1083762 - DNA, 22 bp, Homo sapiens
ggtttgcccacttgattgagaa

SEQ ID NO: 1083763 - DNA, 19 bp, Homo sapiens
ggtttgcccagtcctgggt

SEQ ID NO: 1083764 - DNA, 18 bp, Homo sapiens
ggtttgctcatgtaatgt

SEQ ID NO: 1083765 - DNA, 14 bp, Homo sapiens
ggtttgctgacagg

SEQ ID NO: 1083766 - DNA, 14 bp, Homo sapiens
ggtttgcttgctct

SEQ ID NO: 1083767 - DNA, 14 bp, Homo sapiens
ggtttggccaggga

SEQ ID NO: 1083768 - DNA, 23 bp, Homo sapiens
ggtttggccagggaggcgcaggg

SEQ ID NO: 1083769 - DNA, 21 bp, Homo sapiens
ggtttggcccaagactgggct

SEQ ID NO: 1083770 - DNA, 17 bp, Homo sapiens
ggtttggcgggccaagg

SEQ ID NO: 1083771 - DNA, 19 bp, Homo sapiens
ggtttgggcccctcagagc

SEQ ID NO: 1083772 - DNA, 13 bp, Homo sapiens
ggtttggggagaa

SEQ ID NO: 1083773 - DNA, 19 bp, Homo sapiens
ggtttggggccatggtgga

SEQ ID NO: 1083774 - DNA, 18 bp, Homo sapiens
ggtttgggtgcctcctgc

SEQ ID NO: 1083775 - DNA, 22 bp, Homo sapiens
ggtttgggtgggggctgtggcc

SEQ ID NO: 1083776 - DNA, 15 bp, Homo sapiens
ggtttggtttgcttt

SEQ ID NO: 1083777 - DNA, 13 bp, Homo sapiens
ggtttgtatattg

SEQ ID NO: 1083778 - DNA, 18 bp, Homo sapiens
ggtttgtttgcttaattt

SEQ ID NO: 1083779 - DNA, 21 bp, Homo sapiens
ggtttgtttgcttaatttcct

SEQ ID NO: 1083780 - DNA, 18 bp, Homo sapiens
ggttttaaacctttaatg

SEQ ID NO: 1083781 - DNA, 16 bp, Homo sapiens
ggttttacacagagaa

SEQ ID NO: 1083782 - DNA, 18 bp, Homo sapiens
ggttttagacccatagca

SEQ ID NO: 1083783 - DNA, 22 bp, Homo sapiens
ggttttattctgacttcctctg

SEQ ID NO: 1083784 - DNA, 19 bp, Homo sapiens
ggttttattgtccttcaga

SEQ ID NO: 1083785 - DNA, 21 bp, Homo sapiens
ggttttcccatgactcttgga

SEQ ID NO: 1083786 - DNA, 13 bp, Homo sapiens
ggttttcgagatt

SEQ ID NO: 1083787 - DNA, 12 bp, Homo sapiens
ggttttctctct

SEQ ID NO: 1083788 - DNA, 15 bp, Homo sapiens
ggttttctctctgga

SEQ ID NO: 1083789 - DNA, 16 bp, Homo sapiens
ggttttctctctggat

SEQ ID NO: 1083790 - DNA, 18 bp, Homo sapiens
ggttttcttaaccatctt

SEQ ID NO: 1083791 - DNA, 23 bp, Homo sapiens
ggttttcttgccaccctctggga

SEQ ID NO: 1083792 - DNA, 17 bp, Homo sapiens
ggttttgaataaaaagt

SEQ ID NO: 1083793 - DNA, 17 bp, Homo sapiens
ggttttggagtcagtag

SEQ ID NO: 1083794 - DNA, 20 bp, Homo sapiens
ggttttggctctcccacccc

SEQ ID NO: 1083795 - DNA, 20 bp, Homo sapiens
ggttttgtaagatgctgggt

SEQ ID NO: 1083796 - DNA, 19 bp, Homo sapiens
ggttttgtattctctgagc

SEQ ID NO: 1083797 - DNA, 15 bp, Homo sapiens
ggttttgtattcttt

SEQ ID NO: 1083798 - DNA, 12 bp, Homo sapiens
ggtttttagaga

SEQ ID NO: 1083799 - DNA, 13 bp, Homo sapiens
ggtttttattatt

SEQ ID NO: 1083800 - DNA, 21 bp, Homo sapiens
ggtttttatttctcgggtgca

SEQ ID NO: 1083801 - DNA, 16 bp, Homo sapiens
ggtttttccaaactta

SEQ ID NO: 1083802 - DNA, 12 bp, Homo sapiens
ggtttttctcaa

SEQ ID NO: 1083803 - DNA, 15 bp, Homo sapiens
ggtttttgaaatcca

SEQ ID NO: 1083804 - DNA, 16 bp, Homo sapiens
ggtttttggctctttc

SEQ ID NO: 1083805 - DNA, 20 bp, Homo sapiens
ggtttttggctctttcagag

SEQ ID NO: 1083806 - DNA, 23 bp, Homo sapiens
ggtttttgtttgtttcctttgtt

SEQ ID NO: 1083807 - DNA, 19 bp, Homo sapiens
ggtttttttcctgtgccca

SEQ ID NO: 1083808 - DNA, 18 bp, Homo sapiens
ggttttttttttctgaat

SEQ ID NO: 1083809 - DNA, 21 bp, Homo sapiens
ggttttttttttctgaataaa

SEQ ID NO: 1083810 - DNA, 15 bp, Homo sapiens
gtaaaaaaagcaaaa

SEQ ID NO: 1083811 - DNA, 11 bp, Homo sapiens
gtaaaaaatgg

SEQ ID NO: 1083812 - DNA, 14 bp, Homo sapiens
gtaaaaaatggaaa

SEQ ID NO: 1083813 - DNA, 13 bp, Homo sapiens
gtaaaaaatgtct

SEQ ID NO: 1083814 - DNA, 22 bp, Homo sapiens
gtaaaaaatgtctcatgtcaat

SEQ ID NO: 1083815 - DNA, 18 bp, Homo sapiens
gtaaaaacagcattgctt

SEQ ID NO: 1083816 - DNA, 19 bp, Homo sapiens
gtaaaaacagcattgcttt

SEQ ID NO: 1083817 - DNA, 14 bp, Homo sapiens
gtaaaaacccagcg

SEQ ID NO: 1083818 - DNA, 17 bp, Homo sapiens
gtaaaaactagaaggct

SEQ ID NO: 1083819 - DNA, 18 bp, Homo sapiens
gtaaaaataaaatacttt

SEQ ID NO: 1083820 - DNA, 20 bp, Homo sapiens
gtaaaaatcctggaagacaa

SEQ ID NO: 1083821 - DNA, 18 bp, Homo sapiens
gtaaaaatgaaggaatta

SEQ ID NO: 1083822 - DNA, 19 bp, Homo sapiens
gtaaaaatgagtcatttgt

SEQ ID NO: 1083823 - DNA, 13 bp, Homo sapiens
gtaaaacacatat

SEQ ID NO: 1083824 - DNA, 20 bp, Homo sapiens
gtaaaacagggccacataga

SEQ ID NO: 1083825 - DNA, 15 bp, Homo sapiens
gtaaaactttatttt

SEQ ID NO: 1083826 - DNA, 18 bp, Homo sapiens
gtaaaagcaaaaaagaaa

SEQ ID NO: 1083827 - DNA, 18 bp, Homo sapiens
gtaaaagtggtctctgct

SEQ ID NO: 1083828 - DNA, 20 bp, Homo sapiens
gtaaaagttataataactga

SEQ ID NO: 1083829 - DNA, 20 bp, Homo sapiens
gtaaaatacatgtacctata

SEQ ID NO: 1083830 - DNA, 12 bp, Homo sapiens
gtaaaatacttt

SEQ ID NO: 1083831 - DNA, 22 bp, Homo sapiens
gtaaaatacttttactctgcct

SEQ ID NO: 1083832 - DNA, 20 bp, Homo sapiens
gtaaaatatagctgtacaaa

SEQ ID NO: 1083833 - DNA, 21 bp, Homo sapiens
gtaaaatatagctgtacaaat

SEQ ID NO: 1083834 - DNA, 14 bp, Homo sapiens
gtaaaatatgtaaa

SEQ ID NO: 1083835 - DNA, 18 bp, Homo sapiens
gtaaaatatgtaaaacta

SEQ ID NO: 1083836 - DNA, 13 bp, Homo sapiens
gtaaaatcacttc

SEQ ID NO: 1083837 - DNA, 22 bp, Homo sapiens
gtaaaatcccatctgctagaag

SEQ ID NO: 1083838 - DNA, 13 bp, Homo sapiens
gtaaaatgagttt

SEQ ID NO: 1083839 - DNA, 15 bp, Homo sapiens
gtaaaatgtctttcc

SEQ ID NO: 1083840 - DNA, 12 bp, Homo sapiens
gtaaaatttatt

SEQ ID NO: 1083841 - DNA, 15 bp, Homo sapiens
gtaaaatttgtgtaa

SEQ ID NO: 1083842 - DNA, 18 bp, Homo sapiens
gtaaaatttgtgtaaatt

SEQ ID NO: 1083843 - DNA, 22 bp, Homo sapiens
gtaaaatttgtgtaaatttgta

SEQ ID NO: 1083844 - DNA, 23 bp, Homo sapiens
gtaaacaacgtgtatagtgccta

SEQ ID NO: 1083845 - DNA, 15 bp, Homo sapiens
gtaaacttggaatca

SEQ ID NO: 1083846 - DNA, 17 bp, Homo sapiens
gtaaactttatcactta

SEQ ID NO: 1083847 - DNA, 13 bp, Homo sapiens
gtaaagaaaacca

SEQ ID NO: 1083848 - DNA, 22 bp, Homo sapiens
gtaaagaaatttaaaagacact

SEQ ID NO: 1083849 - DNA, 19 bp, Homo sapiens
gtaaagaacttaaattatg

SEQ ID NO: 1083850 - DNA, 14 bp, Homo sapiens
gtaaagaattttca

SEQ ID NO: 1083851 - DNA, 19 bp, Homo sapiens
gtaaagaattttcatcccg

SEQ ID NO: 1083852 - DNA, 14 bp, Homo sapiens
gtaaagacaaataa

SEQ ID NO: 1083853 - DNA, 14 bp, Homo sapiens
gtaaagactggctt

SEQ ID NO: 1083854 - DNA, 18 bp, Homo sapiens
gtaaagactggttttctg

SEQ ID NO: 1083855 - DNA, 16 bp, Homo sapiens
gtaaagccatgttaaa

SEQ ID NO: 1083856 - DNA, 21 bp, Homo sapiens
gtaaagcccatttttaaaata

SEQ ID NO: 1083857 - DNA, 20 bp, Homo sapiens
gtaaagctaaaataaagaaa

SEQ ID NO: 1083858 - DNA, 20 bp, Homo sapiens
gtaaaggaaataagagcagt

SEQ ID NO: 1083859 - DNA, 15 bp, Homo sapiens
gtaaaggagaaatga

SEQ ID NO: 1083860 - DNA, 19 bp, Homo sapiens
gtaaaggatattaaatgtt

SEQ ID NO: 1083861 - DNA, 15 bp, Homo sapiens
gtaaagggcaaataa

SEQ ID NO: 1083862 - DNA, 18 bp, Homo sapiens
gtaaagggcaaataatga

SEQ ID NO: 1083863 - DNA, 23 bp, Homo sapiens
gtaaagtgataatttctggaatt

SEQ ID NO: 1083864 - DNA, 13 bp, Homo sapiens
gtaaataaaaaga

SEQ ID NO: 1083865 - DNA, 15 bp, Homo sapiens
gtaaataaaaagaaa

SEQ ID NO: 1083866 - DNA, 19 bp, Homo sapiens
gtaaataaaatgtgtacag

SEQ ID NO: 1083867 - DNA, 22 bp, Homo sapiens
gtaaataaaatgtgtacagtga

SEQ ID NO: 1083868 - DNA, 14 bp, Homo sapiens
gtaaataaagccct

SEQ ID NO: 1083869 - DNA, 15 bp, Homo sapiens
gtaaataaagccctg

SEQ ID NO: 1083870 - DNA, 21 bp, Homo sapiens
gtaaataactggaaaacagaa

SEQ ID NO: 1083871 - DNA, 11 bp, Homo sapiens
gtaaataagag

SEQ ID NO: 1083872 - DNA, 15 bp, Homo sapiens
gtaaataatttattt

SEQ ID NO: 1083873 - DNA, 13 bp, Homo sapiens
gtaaataatttgc

SEQ ID NO: 1083874 - DNA, 12 bp, Homo sapiens
gtaaataatttt

SEQ ID NO: 1083875 - DNA, 19 bp, Homo sapiens
gtaaatacaatttttttta

SEQ ID NO: 1083876 - DNA, 12 bp, Homo sapiens
gtaaatacacca

SEQ ID NO: 1083877 - DNA, 22 bp, Homo sapiens
gtaaatactcatgaatgaaaat

SEQ ID NO: 1083878 - DNA, 15 bp, Homo sapiens
gtaaatactggactc

SEQ ID NO: 1083879 - DNA, 13 bp, Homo sapiens
gtaaatactgtga

SEQ ID NO: 1083880 - DNA, 20 bp, Homo sapiens
gtaaataggatttttagaat

SEQ ID NO: 1083881 - DNA, 23 bp, Homo sapiens
gtaaataggtttctaaaaagtca

SEQ ID NO: 1083882 - DNA, 17 bp, Homo sapiens
gtaaatatgaagagttt

SEQ ID NO: 1083883 - DNA, 21 bp, Homo sapiens
gtaattatcgggaacagtgtt

SEQ ID NO: 1083884 - DNA, 22 bp, Homo sapiens
gtaattcaagcctctaaacaga

SEQ ID NO: 1083885 - DNA, 13 bp, Homo sapiens
gtaattcaggact

SEQ ID NO: 1083886 - DNA, 22 bp, Homo sapiens
gtaattctaaatgaatgtttac

SEQ ID NO: 1083887 - DNA, 23 bp, Homo sapiens
gtaattctccctaaggaatctga

SEQ ID NO: 1083888 - DNA, 16 bp, Homo sapiens
gtaattggaatcttca

SEQ ID NO: 1083889 - DNA, 21 bp, Homo sapiens
gtaattggaatcttcacctca

SEQ ID NO: 1083890 - DNA, 12 bp, Homo sapiens
gtaattggtaat

SEQ ID NO: 1083891 - DNA, 12 bp, Homo sapiens
gtaattgtaatt

SEQ ID NO: 1083892 - DNA, 15 bp, Homo sapiens
gtaattgtaattttg

SEQ ID NO: 1083893 - DNA, 9 bp, Homo sapiens
gtaattgtg

SEQ ID NO: 1083894 - DNA, 14 bp, Homo sapiens
gtaattgttccttt

SEQ ID NO: 1083895 - DNA, 17 bp, Homo sapiens
gtaattgttgtttgtat

SEQ ID NO: 1083896 - DNA, 19 bp, Homo sapiens
gtaattgttgtttgtatgt

SEQ ID NO: 1083897 - DNA, 21 bp, Homo sapiens
gtaattgttgtttgtatgtat

SEQ ID NO: 1083898 - DNA, 21 bp, Homo sapiens
gtaatttaaaataattatata

SEQ ID NO: 1083899 - DNA, 16 bp, Homo sapiens
gtaatttaaacaggcc

SEQ ID NO: 1083900 - DNA, 23 bp, Homo sapiens
gtaatttaaacatttgttcctgg

SEQ ID NO: 1083901 - DNA, 18 bp, Homo sapiens
gtaatttagaaatcattt

SEQ ID NO: 1083902 - DNA, 14 bp, Homo sapiens
gtaatttatatggt

SEQ ID NO: 1083903 - DNA, 13 bp, Homo sapiens
gtaatttcctaga

SEQ ID NO: 1083904 - DNA, 21 bp, Homo sapiens
gtaatttctttttttcctttt

SEQ ID NO: 1083905 - DNA, 19 bp, Homo sapiens
gtaatttgaagatgtggat

SEQ ID NO: 1083906 - DNA, 18 bp, Homo sapiens
gtaatttgtacaggggcc

SEQ ID NO: 1083907 - DNA, 17 bp, Homo sapiens
gtaatttgtgatacaat

SEQ ID NO: 1083908 - DNA, 20 bp, Homo sapiens
gtaatttgtgatacaatgct

SEQ ID NO: 1083909 - DNA, 20 bp, Homo sapiens
gtaattttacacgcttttgt

SEQ ID NO: 1083910 - DNA, 15 bp, Homo sapiens
gtaattttatatgaa

SEQ ID NO: 1083911 - DNA, 23 bp, Homo sapiens
gtaattttatttgttctttttct

SEQ ID NO: 1083912 - DNA, 16 bp, Homo sapiens
gtaattttattttaaa

SEQ ID NO: 1083913 - DNA, 18 bp, Homo sapiens
gtaattttcatattaaac

SEQ ID NO: 1083914 - DNA, 14 bp, Homo sapiens
gtaattttggattt

SEQ ID NO: 1083915 - DNA, 16 bp, Homo sapiens
gtaattttgtgtaaga

SEQ ID NO: 1083916 - DNA, 21 bp, Homo sapiens
gtaatttttttatcgtcactg

SEQ ID NO: 1083917 - DNA, 22 bp, Homo sapiens
gtaattttttttgttttttgta

SEQ ID NO: 1083918 - DNA, 12 bp, Homo sapiens
gtacaaaaataa

SEQ ID NO: 1083919 - DNA, 12 bp, Homo sapiens
gtacaaaacaat

SEQ ID NO: 1083920 - DNA, 13 bp, Homo sapiens
gtacaaacatgaa

SEQ ID NO: 1083921 - DNA, 15 bp, Homo sapiens
gtacaaacatgaaaa

SEQ ID NO: 1083922 - DNA, 17 bp, Homo sapiens
gtacaaatataagaata

SEQ ID NO: 1083923 - DNA, 23 bp, Homo sapiens
gtacaaatataagaataaaatgt

SEQ ID NO: 1083924 - DNA, 17 bp, Homo sapiens
gtacaaatgtaagcaaa

SEQ ID NO: 1083925 - DNA, 23 bp, Homo sapiens
gtacaaattgtcgtttttattcc

SEQ ID NO: 1083926 - DNA, 20 bp, Homo sapiens
gtacaaccccctccaccccc

SEQ ID NO: 1083927 - DNA, 13 bp, Homo sapiens
gtacaaccctgac

SEQ ID NO: 1083928 - DNA, 14 bp, Homo sapiens
gtacaaccctgacc

SEQ ID NO: 1083929 - DNA, 17 bp, Homo sapiens
gtacaagagtccctttg

SEQ ID NO: 1083930 - DNA, 15 bp, Homo sapiens
gtacaaggtaattgt

SEQ ID NO: 1083931 - DNA, 17 bp, Homo sapiens
gtacaatacaatgtaca

SEQ ID NO: 1083932 - DNA, 20 bp, Homo sapiens
gtacaatacaatgtacaatt

SEQ ID NO: 1083933 - DNA, 14 bp, Homo sapiens
gtacaatcatgaac

SEQ ID NO: 1083934 - DNA, 22 bp, Homo sapiens
gtacaatcatgaacagctctga

SEQ ID NO: 1083935 - DNA, 21 bp, Homo sapiens
gtacaatgactttattgcatc

SEQ ID NO: 1083936 - DNA, 13 bp, Homo sapiens
gtacaatggttta

SEQ ID NO: 1083937 - DNA, 16 bp, Homo sapiens
gtacaatgtacacact

SEQ ID NO: 1083938 - DNA, 14 bp, Homo sapiens
gtacaattatgtct

SEQ ID NO: 1083939 - DNA, 22 bp, Homo sapiens
gtacaattgatcttttttaatt

SEQ ID NO: 1083940 - DNA, 18 bp, Homo sapiens
gtacacaataagcaaaaa

SEQ ID NO: 1083941 - DNA, 16 bp, Homo sapiens
gtacacagcaccagaa

SEQ ID NO: 1083942 - DNA, 14 bp, Homo sapiens
gtacactgaatatt

SEQ ID NO: 1083943 - DNA, 15 bp, Homo sapiens
gtacactgaatattt

SEQ ID NO: 1083944 - DNA, 20 bp, Homo sapiens
gtacagaacacaaatgtcta

SEQ ID NO: 1083945 - DNA, 17 bp, Homo sapiens
gtacagaatcattgctt

SEQ ID NO: 1083946 - DNA, 12 bp, Homo sapiens
gtacagactgtt

SEQ ID NO: 1083947 - DNA, 14 bp, Homo sapiens
gtacagagactcta

SEQ ID NO: 1083948 - DNA, 19 bp, Homo sapiens
gtacagatgaatgataaac

SEQ ID NO: 1083949 - DNA, 13 bp, Homo sapiens
gtacagattttat

SEQ ID NO: 1083950 - DNA, 18 bp, Homo sapiens
gtacagcattaaaatttt

SEQ ID NO: 1083951 - DNA, 13 bp, Homo sapiens
gtacagcggctcc

SEQ ID NO: 1083952 - DNA, 21 bp, Homo sapiens
gtacagcggctcccctctgct

SEQ ID NO: 1083953 - DNA, 15 bp, Homo sapiens
gtacagcgggctgtg

SEQ ID NO: 1083954 - DNA, 19 bp, Homo sapiens
gtacagcgggctgtgcccg

SEQ ID NO: 1083955 - DNA, 17 bp, Homo sapiens
gtacagctcccttccct

SEQ ID NO: 1083956 - DNA, 15 bp, Homo sapiens
gtacaggagaggcag

SEQ ID NO: 1083957 - DNA, 24 bp, Homo sapiens
gtacaggcaaaacacgcaagggca

SEQ ID NO: 1083958 - DNA, 16 bp, Homo sapiens
gtacaggggccatgcc

SEQ ID NO: 1083959 - DNA, 16 bp, Homo sapiens
gtacagggttatctgc

SEQ ID NO: 1083960 - DNA, 17 bp, Homo sapiens
gtacagtaggataagcc

SEQ ID NO: 1083961 - DNA, 12 bp, Homo sapiens
gtacagtctgtc

SEQ ID NO: 1083962 - DNA, 13 bp, Homo sapiens
gtacagtcttgta

SEQ ID NO: 1083963 - DNA, 14 bp, Homo sapiens
gtacagtcttgtat

SEQ ID NO: 1083964 - DNA, 13 bp, Homo sapiens
gtacagtgaatgg

SEQ ID NO: 1083965 - DNA, 18 bp, Homo sapiens
gtacagtgaattgtcttt

SEQ ID NO: 1083966 - DNA, 19 bp, Homo sapiens
gtacagtgaattgtctttt

SEQ ID NO: 1083967 - DNA, 14 bp, Homo sapiens
gtacagtgaggagg

SEQ ID NO: 1083968 - DNA, 13 bp, Homo sapiens
gtacagtgtcttt

SEQ ID NO: 1083969 - DNA, 20 bp, Homo sapiens
gtacagtgtctttttttgta

SEQ ID NO: 1083970 - DNA, 16 bp, Homo sapiens
gtacagtgtgtaaagt

SEQ ID NO: 1083971 - DNA, 21 bp, Homo sapiens
gtacagtttattgatattcaa

SEQ ID NO: 1083972 - DNA, 13 bp, Homo sapiens
gtacagtttttat

SEQ ID NO: 1083973 - DNA, 16 bp, Homo sapiens
gtacataaaagaattt

SEQ ID NO: 1083974 - DNA, 16 bp, Homo sapiens
gtacataattgattaa

SEQ ID NO: 1083975 - DNA, 13 bp, Homo sapiens
gtacatacattgt

SEQ ID NO: 1083976 - DNA, 22 bp, Homo sapiens
gtacataccctggccgccccct

SEQ ID NO: 1083977 - DNA, 15 bp, Homo sapiens
gtacatactggcctc

SEQ ID NO: 1083978 - DNA, 21 bp, Homo sapiens
gtacatactggcctctgtgat

SEQ ID NO: 1083979 - DNA, 17 bp, Homo sapiens
gtacatagttatttatt

SEQ ID NO: 1083980 - DNA, 21 bp, Homo sapiens
gtacatagttatttttctctt

SEQ ID NO: 1083981 - DNA, 23 bp, Homo sapiens
gtacatataaatgaatctggtgt

SEQ ID NO: 1083982 - DNA, 22 bp, Homo sapiens
gtacatcaagtccatctgacaa

SEQ ID NO: 1083983 - DNA, 18 bp, Homo sapiens
gtacatctattttggatt

SEQ ID NO: 1083984 - DNA, 20 bp, Homo sapiens
gtacatctattttggattgt

SEQ ID NO: 1083985 - DNA, 18 bp, Homo sapiens
gtacatgaaaacacattt

SEQ ID NO: 1083986 - DNA, 16 bp, Homo sapiens
gtacatggcccgcagt

SEQ ID NO: 1083987 - DNA, 17 bp, Homo sapiens
gtacattcaatgtttat

SEQ ID NO: 1083988 - DNA, 20 bp, Homo sapiens
gtacattgaaaccctccaaa

SEQ ID NO: 1083989 - DNA, 19 bp, Homo sapiens
gtacattgcttaaaatata

SEQ ID NO: 1083990 - DNA, 14 bp, Homo sapiens
gtacattgtgagct

SEQ ID NO: 1083991 - DNA, 15 bp, Homo sapiens
gtacatttaaaattg

SEQ ID NO: 1083992 - DNA, 18 bp, Homo sapiens
gtacatttcaccatggcc

SEQ ID NO: 1083993 - DNA, 13 bp, Homo sapiens
gtaccaaaacatc

SEQ ID NO: 1083994 - DNA, 16 bp, Homo sapiens
gtaccaaaattttaaa

SEQ ID NO: 1083995 - DNA, 19 bp, Homo sapiens
gtaccaaaattttaaaaaa

SEQ ID NO: 1083996 - DNA, 20 bp, Homo sapiens
gtaccaaaattttaaaaaag

SEQ ID NO: 1083997 - DNA, 17 bp, Homo sapiens
gtaccaaacaaggaagc

SEQ ID NO: 1083998 - DNA, 18 bp, Homo sapiens
gtaccaaacaaggaagcc

SEQ ID NO: 1083999 - DNA, 15 bp, Homo sapiens
gtaccaatcatttta

SEQ ID NO: 1084000 - DNA, 12 bp, Homo sapiens
gtaccacactga

SEQ ID NO: 1084001 - DNA, 16 bp, Homo sapiens
gtaccacactgagttc

SEQ ID NO: 1084002 - DNA, 15 bp, Homo sapiens
gtaccacagacacaa

SEQ ID NO: 1084003 - DNA, 18 bp, Homo sapiens
gtaccacttctgtgggca

SEQ ID NO: 1084004 - DNA, 16 bp, Homo sapiens
gtaccagcccagatgt

SEQ ID NO: 1084005 - DNA, 19 bp, Homo sapiens
gtaccagctgcgcttgctt

SEQ ID NO: 1084006 - DNA, 23 bp, Homo sapiens
gtaccagttaatttttccaacta

SEQ ID NO: 1084007 - DNA, 21 bp, Homo sapiens
gtaccatagaaaaatgtataa

SEQ ID NO: 1084008 - DNA, 11 bp, Homo sapiens
gtaccatcaat

SEQ ID NO: 1084009 - DNA, 21 bp, Homo sapiens
gtaccatgctggcggcgcaga

SEQ ID NO: 1084010 - DNA, 19 bp, Homo sapiens
gtaccattccttcaaataa

SEQ ID NO: 1084011 - DNA, 16 bp, Homo sapiens
gtacccaccccagcac

SEQ ID NO: 1084012 - DNA, 12 bp, Homo sapiens
gtacccagccat

SEQ ID NO: 1084013 - DNA, 20 bp, Homo sapiens
gtacccagccatctgcccag

SEQ ID NO: 1084014 - DNA, 21 bp, Homo sapiens
gtacccagccatctgcccagg

SEQ ID NO: 1084015 - DNA, 13 bp, Homo sapiens
gtacccagctcct

SEQ ID NO: 1084016 - DNA, 17 bp, Homo sapiens
gtacccatctagtactt

SEQ ID NO: 1084017 - DNA, 22 bp, Homo sapiens
gtacccattctgttttccccca

SEQ ID NO: 1084018 - DNA, 22 bp, Homo sapiens
gtaccccaccctcagcacccct

SEQ ID NO: 1084019 - DNA, 19 bp, Homo sapiens
gtacccctggtaaaccaag

SEQ ID NO: 1084020 - DNA, 14 bp, Homo sapiens
gtacccgaggcctc

SEQ ID NO: 1084021 - DNA, 18 bp, Homo sapiens
gtaccctatagagagggg

SEQ ID NO: 1084022 - DNA, 17 bp, Homo sapiens
gtaccctctcagctcca

SEQ ID NO: 1084023 - DNA, 18 bp, Homo sapiens
gtaccctctcagctccag

SEQ ID NO: 1084024 - DNA, 14 bp, Homo sapiens
gtacccttccacct

SEQ ID NO: 1084025 - DNA, 20 bp, Homo sapiens
gtacccttccacctcctaga

SEQ ID NO: 1084026 - DNA, 20 bp, Homo sapiens
gtaccctttaagatatccat

SEQ ID NO: 1084027 - DNA, 22 bp, Homo sapiens
gtaccctttaagatatccatct

SEQ ID NO: 1084028 - DNA, 21 bp, Homo sapiens
gtaccgatgatactgtttctt

SEQ ID NO: 1084029 - DNA, 18 bp, Homo sapiens
gtaccgccagcagctgtc

SEQ ID NO: 1084030 - DNA, 19 bp, Homo sapiens
gtacctataaagtaaagct

SEQ ID NO: 1084031 - DNA, 22 bp, Homo sapiens
gtacctatattgatttaaaagt

SEQ ID NO: 1084032 - DNA, 16 bp, Homo sapiens
gtacctcaagccccat

SEQ ID NO: 1084033 - DNA, 20 bp, Homo sapiens
gtacctcagtggatcttcag

SEQ ID NO: 1084034 - DNA, 21 bp, Homo sapiens
gtacctcagtggatcttcaga

SEQ ID NO: 1084035 - DNA, 20 bp, Homo sapiens
gtacctcccctgccttgctg

SEQ ID NO: 1084036 - DNA, 15 bp, Homo sapiens
gtacctctgtataga

SEQ ID NO: 1084037 - DNA, 12 bp, Homo sapiens
gtacctgaaaag

SEQ ID NO: 1084038 - DNA, 23 bp, Homo sapiens
gtacctgaaaagtaacttggctt

SEQ ID NO: 1084039 - DNA, 15 bp, Homo sapiens
gtacctgattgtatt

SEQ ID NO: 1084040 - DNA, 15 bp, Homo sapiens
gtacctggggccaaa

SEQ ID NO: 1084041 - DNA, 16 bp, Homo sapiens
gtacctggtccccact

SEQ ID NO: 1084042 - DNA, 17 bp, Homo sapiens
gtacctggtccccactg

SEQ ID NO: 1084043 - DNA, 15 bp, Homo sapiens
gtacctgttcctccc

SEQ ID NO: 1084044 - DNA, 19 bp, Homo sapiens
gtacctgttccttagacct

SEQ ID NO: 1084045 - DNA, 21 bp, Homo sapiens
gtaccttcagaataagcttcc

SEQ ID NO: 1084046 - DNA, 14 bp, Homo sapiens
gtaccttcagccct

SEQ ID NO: 1084047 - DNA, 15 bp, Homo sapiens
gtaccttcagccctg

SEQ ID NO: 1084048 - DNA, 12 bp, Homo sapiens
gtaccttcccac

SEQ ID NO: 1084049 - DNA, 18 bp, Homo sapiens
gtaccttgaacactgggg

SEQ ID NO: 1084050 - DNA, 23 bp, Homo sapiens
gtaccttgaacactgggggaggg

SEQ ID NO: 1084051 - DNA, 14 bp, Homo sapiens
gtaccttgctgtgg

SEQ ID NO: 1084052 - DNA, 23 bp, Homo sapiens
gtaccttgcttcttactgataat

SEQ ID NO: 1084053 - DNA, 16 bp, Homo sapiens
gtaccttgtgcccagg

SEQ ID NO: 1084054 - DNA, 14 bp, Homo sapiens
gtacctttatgtta

SEQ ID NO: 1084055 - DNA, 17 bp, Homo sapiens
gtacctttctagcctta

SEQ ID NO: 1084056 - DNA, 15 bp, Homo sapiens
gtacgatgacagtgt

SEQ ID NO: 1084057 - DNA, 13 bp, Homo sapiens
gtacgtcccagcg

SEQ ID NO: 1084058 - DNA, 20 bp, Homo sapiens
gtacgtcccagcggcctcag

SEQ ID NO: 1084059 - DNA, 22 bp, Homo sapiens
gtacgtcccagcggcctcaggg

SEQ ID NO: 1084060 - DNA, 24 bp, Homo sapiens
gtacgtcccgctgctgtgctctgg

SEQ ID NO: 1084061 - DNA, 20 bp, Homo sapiens
gtacgtggcacctcttccga

SEQ ID NO: 1084062 - DNA, 21 bp, Homo sapiens
gtacgttattgttgacttatt

SEQ ID NO: 1084063 - DNA, 15 bp, Homo sapiens
gtacgttgtgcattt

SEQ ID NO: 1084064 - DNA, 16 bp, Homo sapiens
gtacgttgtgcatttg

SEQ ID NO: 1084065 - DNA, 17 bp, Homo sapiens
gtacgttgtgcatttgg

SEQ ID NO: 1084066 - DNA, 15 bp, Homo sapiens
gtactaaggaatctt

SEQ ID NO: 1084067 - DNA, 20 bp, Homo sapiens
gtactaagggaacaatccat

SEQ ID NO: 1084068 - DNA, 21 bp, Homo sapiens
gtactactagatgtctttagg

SEQ ID NO: 1084069 - DNA, 19 bp, Homo sapiens
gtactagtcctctagaaat

SEQ ID NO: 1084070 - DNA, 15 bp, Homo sapiens
gtactagtgttctgt

SEQ ID NO: 1084071 - DNA, 20 bp, Homo sapiens
gtactataagtagttggttt

SEQ ID NO: 1084072 - DNA, 21 bp, Homo sapiens
gtactatctgtgcgtagaagt

SEQ ID NO: 1084073 - DNA, 18 bp, Homo sapiens
gtactatgatgggcttct

SEQ ID NO: 1084074 - DNA, 13 bp, Homo sapiens
gtactatgtatca

SEQ ID NO: 1084075 - DNA, 17 bp, Homo sapiens
gtactatgtatcaatga

SEQ ID NO: 1084076 - DNA, 21 bp, Homo sapiens
gtactatttagatataacact

SEQ ID NO: 1084077 - DNA, 19 bp, Homo sapiens
gtactcaagccagcctgta

SEQ ID NO: 1084078 - DNA, 15 bp, Homo sapiens
gtactcactgaagcc

SEQ ID NO: 1084079 - DNA, 16 bp, Homo sapiens
gtactcactgaagcct

SEQ ID NO: 1084080 - DNA, 20 bp, Homo sapiens
gtactcactgaagcctgcgt

SEQ ID NO: 1084081 - DNA, 16 bp, Homo sapiens
gtactcacttttcact

SEQ ID NO: 1084082 - DNA, 23 bp, Homo sapiens
gtactcaggaggctgaggggagg

SEQ ID NO: 1084083 - DNA, 24 bp, Homo sapiens
gtactccagcccggcactccagcc

SEQ ID NO: 1084084 - DNA, 15 bp, Homo sapiens
gtactccagcctggg

SEQ ID NO: 1084085 - DNA, 18 bp, Homo sapiens
gtactcctcacttttcaa

SEQ ID NO: 1084086 - DNA, 14 bp, Homo sapiens
gtactcctcccagg

SEQ ID NO: 1084087 - DNA, 15 bp, Homo sapiens
gtactcctgcaaaat

SEQ ID NO: 1084088 - DNA, 21 bp, Homo sapiens
gtactcctgcaaaattttata

SEQ ID NO: 1084089 - DNA, 16 bp, Homo sapiens
gtactcggcttcctgt

SEQ ID NO: 1084090 - DNA, 15 bp, Homo sapiens
gtactctcctagaga

SEQ ID NO: 1084091 - DNA, 22 bp, Homo sapiens
gtactctctgctctagccagga

SEQ ID NO: 1084092 - DNA, 23 bp, Homo sapiens
gtactcttccgaaaaatcctctt

SEQ ID NO: 1084093 - DNA, 11 bp, Homo sapiens
gtactctttaa

SEQ ID NO: 1084094 - DNA, 14 bp, Homo sapiens
gtactctttaacat

SEQ ID NO: 1084095 - DNA, 15 bp, Homo sapiens
gtactctttatttct

SEQ ID NO: 1084096 - DNA, 23 bp, Homo sapiens
gtactgaagactctgcagccctc

SEQ ID NO: 1084097 - DNA, 14 bp, Homo sapiens
gtactgaatttttt

SEQ ID NO: 1084098 - DNA, 18 bp, Homo sapiens
gtactgaatttttttgta

SEQ ID NO: 1084099 - DNA, 20 bp, Homo sapiens
gtactgactttctgattact

SEQ ID NO: 1084100 - DNA, 16 bp, Homo sapiens
gtactgagacagggtg

SEQ ID NO: 1084101 - DNA, 16 bp, Homo sapiens
gtactgagccttgtaa

SEQ ID NO: 1084102 - DNA, 15 bp, Homo sapiens
gtactgcatgtgact

SEQ ID NO: 1084103 - DNA, 18 bp, Homo sapiens
gtactgcattctctccca

SEQ ID NO: 1084104 - DNA, 22 bp, Homo sapiens
gtactgcattctctcccatcct

SEQ ID NO: 1084105 - DNA, 17 bp, Homo sapiens
gtactgctcaggctgca

SEQ ID NO: 1084106 - DNA, 20 bp, Homo sapiens
gtactgctcaggctgcagct

SEQ ID NO: 1084107 - DNA, 22 bp, Homo sapiens
gtactgctcaggctgcagctgg

SEQ ID NO: 1084108 - DNA, 23 bp, Homo sapiens
gtactgctcaggctgcagctgga

SEQ ID NO: 1084109 - DNA, 15 bp, Homo sapiens
gtagatgtagcattg

SEQ ID NO: 1084110 - DNA, 20 bp, Homo sapiens
gtagatgtatgcacacacat

SEQ ID NO: 1084111 - DNA, 22 bp, Homo sapiens
gtagatgttagggtataagttg

SEQ ID NO: 1084112 - DNA, 14 bp, Homo sapiens
gtagattgcttctg

SEQ ID NO: 1084113 - DNA, 16 bp, Homo sapiens
gtagatttatttcatc

SEQ ID NO: 1084114 - DNA, 19 bp, Homo sapiens
gtagatttatttcatcata

SEQ ID NO: 1084115 - DNA, 22 bp, Homo sapiens
gtagatttctcttgggcaggca

SEQ ID NO: 1084116 - DNA, 15 bp, Homo sapiens
gtagatttgaaaatt

SEQ ID NO: 1084117 - DNA, 17 bp, Homo sapiens
gtagatttgaaaattgt

SEQ ID NO: 1084118 - DNA, 13 bp, Homo sapiens
gtaggagaggaga

SEQ ID NO: 1084119 - DNA, 18 bp, Homo sapiens
gtaggagaggagaaaaaa

SEQ ID NO: 1084120 - DNA, 16 bp, Homo sapiens
gtaggagcccttctct

SEQ ID NO: 1084121 - DNA, 22 bp, Homo sapiens
gtaggagctgccttggctcaga

SEQ ID NO: 1084122 - DNA, 23 bp, Homo sapiens
gtaggatgtggaacctgtttaat

SEQ ID NO: 1084123 - DNA, 22 bp, Homo sapiens
gtaggatgttgcttctgaatca

SEQ ID NO: 1084124 - DNA, 23 bp, Homo sapiens
gtaggatgttgcttctgaatcac

SEQ ID NO: 1084125 - DNA, 13 bp, Homo sapiens
gtaggattgctgt

SEQ ID NO: 1084126 - DNA, 22 bp, Homo sapiens
gtaggatttatgtattttgaaa

SEQ ID NO: 1084127 - DNA, 23 bp, Homo sapiens
gtaggatttatgtattttgaaaa

SEQ ID NO: 1084128 - DNA, 23 bp, Homo sapiens
gtaggcagacacagggacttgaa

SEQ ID NO: 1084129 - DNA, 14 bp, Homo sapiens
gtaggcagagcctt

SEQ ID NO: 1084130 - DNA, 15 bp, Homo sapiens
gtaggcagaggctgc

SEQ ID NO: 1084131 - DNA, 13 bp, Homo sapiens
gtaggcagcctct

SEQ ID NO: 1084132 - DNA, 14 bp, Homo sapiens
gtaggcatttccta

SEQ ID NO: 1084133 - DNA, 17 bp, Homo sapiens
gtaggcccttgtcctgc

SEQ ID NO: 1084134 - DNA, 21 bp, Homo sapiens
gtaggcccttgtcctgccagc

SEQ ID NO: 1084135 - DNA, 23 bp, Homo sapiens
gtaggctcctgccagtgtggaac

SEQ ID NO: 1084136 - DNA, 15 bp, Homo sapiens
gtaggctgtctgtgc

SEQ ID NO: 1084137 - DNA, 17 bp, Homo sapiens
gtagggaaaccttggag

SEQ ID NO: 1084138 - DNA, 23 bp, Homo sapiens
gtagggaaaccttggagaggaga

SEQ ID NO: 1084139 - DNA, 21 bp, Homo sapiens
gtagggaagaaaactatcctg

SEQ ID NO: 1084140 - DNA, 13 bp, Homo sapiens
gtagggaataaaa

SEQ ID NO: 1084141 - DNA, 21 bp, Homo sapiens
gtagggaccagtgggatgggc

SEQ ID NO: 1084142 - DNA, 18 bp, Homo sapiens
gtagggagtacctgctgc

SEQ ID NO: 1084143 - DNA, 17 bp, Homo sapiens
gtagggagtgaagccac

SEQ ID NO: 1084144 - DNA, 19 bp, Homo sapiens
gtagggcaagggtgcctca

SEQ ID NO: 1084145 - DNA, 12 bp, Homo sapiens
gtagggcagaca

SEQ ID NO: 1084146 - DNA, 14 bp, Homo sapiens
gtagggcagacatg

SEQ ID NO: 1084147 - DNA, 13 bp, Homo sapiens
gtagggcctgcat

SEQ ID NO: 1084148 - DNA, 14 bp, Homo sapiens
gtagggggccttgc

SEQ ID NO: 1084149 - DNA, 15 bp, Homo sapiens
gtagggggctctggg

SEQ ID NO: 1084150 - DNA, 22 bp, Homo sapiens
gtagggtaattagtaacatgtg

SEQ ID NO: 1084151 - DNA, 13 bp, Homo sapiens
gtaggtgagcctg

SEQ ID NO: 1084152 - DNA, 15 bp, Homo sapiens
gtaggtgagcctggg

SEQ ID NO: 1084153 - DNA, 18 bp, Homo sapiens
gtaggtgagcctgggcag

SEQ ID NO: 1084154 - DNA, 23 bp, Homo sapiens
gtaggtggaagctagacacatga

SEQ ID NO: 1084155 - DNA, 17 bp, Homo sapiens
gtaggtgggtaggagcc

SEQ ID NO: 1084156 - DNA, 22 bp, Homo sapiens
gtaggtgggtaggagcccttct

SEQ ID NO: 1084157 - DNA, 13 bp, Homo sapiens
gtaggtgtctctg

SEQ ID NO: 1084158 - DNA, 17 bp, Homo sapiens
gtaagaattcagaagac

SEQ ID NO: 1084159 - DNA, 18 bp, Homo sapiens
gtaagaccaaatgtagtt

SEQ ID NO: 1084160 - DNA, 21 bp, Homo sapiens
gtaagactttctgaaaacact

SEQ ID NO: 1084161 - DNA, 19 bp, Homo sapiens
gtaagagaaaagagagaaa

SEQ ID NO: 1084162 - DNA, 14 bp, Homo sapiens
gtaagagacagaat

SEQ ID NO: 1084163 - DNA, 23 bp, Homo sapiens
gtaagagacagaatgtatctgtg

SEQ ID NO: 1084164 - DNA, 15 bp, Homo sapiens
gtaagagcaaaagaa

SEQ ID NO: 1084165 - DNA, 16 bp, Homo sapiens
gtaagagcaaaagcct

SEQ ID NO: 1084166 - DNA, 21 bp, Homo sapiens
gtaagagcaccttcctcactt

SEQ ID NO: 1084167 - DNA, 14 bp, Homo sapiens
gtaagagctggtgt

SEQ ID NO: 1084168 - DNA, 23 bp, Homo sapiens
gtaagatacaagtttcagacagg

SEQ ID NO: 1084169 - DNA, 16 bp, Homo sapiens
gtaagatgactctgag

SEQ ID NO: 1084170 - DNA, 21 bp, Homo sapiens
gtaagatttgtttttaaactg

SEQ ID NO: 1084171 - DNA, 12 bp, Homo sapiens
gtaagcagtgtt

SEQ ID NO: 1084172 - DNA, 15 bp, Homo sapiens
gtaagcatctacttc

SEQ ID NO: 1084173 - DNA, 15 bp, Homo sapiens
gtaagcattctgagc

SEQ ID NO: 1084174 - DNA, 19 bp, Homo sapiens
gtaagcattctgagctggg

SEQ ID NO: 1084175 - DNA, 21 bp, Homo sapiens
gtaagcattctgagctgggct

SEQ ID NO: 1084176 - DNA, 16 bp, Homo sapiens
gtaagcgatttgaaac

SEQ ID NO: 1084177 - DNA, 17 bp, Homo sapiens
gtaagctgctctattgt

SEQ ID NO: 1084178 - DNA, 12 bp, Homo sapiens
gtaagctgtgtg

SEQ ID NO: 1084179 - DNA, 18 bp, Homo sapiens
gtaagcttttaagaaaaa

SEQ ID NO: 1084180 - DNA, 21 bp, Homo sapiens
gtaagcttttaagaaaaacaa

SEQ ID NO: 1084181 - DNA, 22 bp, Homo sapiens
gtaagcttttaagaaaaacaaa

SEQ ID NO: 1084182 - DNA, 23 bp, Homo sapiens
gtaaggcagggtcccatttctca

SEQ ID NO: 1084183 - DNA, 11 bp, Homo sapiens
gtaagggcagt

SEQ ID NO: 1084184 - DNA, 21 bp, Homo sapiens
gtaaggtctttgtaaaatctt

SEQ ID NO: 1084185 - DNA, 23 bp, Homo sapiens
gtaaggtgtcttaatactgtcct

SEQ ID NO: 1084186 - DNA, 16 bp, Homo sapiens
gtaaggtttcaatgca

SEQ ID NO: 1084187 - DNA, 15 bp, Homo sapiens
gtaagtaaacagatt

SEQ ID NO: 1084188 - DNA, 23 bp, Homo sapiens
gtaagtaacaatatgtaatcaaa

SEQ ID NO: 1084189 - DNA, 22 bp, Homo sapiens
gtaagtattcttatttaatgaa

SEQ ID NO: 1084190 - DNA, 12 bp, Homo sapiens
gtaagtcatcta

SEQ ID NO: 1084191 - DNA, 20 bp, Homo sapiens
gtaagtcttttttttttcca

SEQ ID NO: 1084192 - DNA, 23 bp, Homo sapiens
gtaagtcttttttttttccaaat

SEQ ID NO: 1084193 - DNA, 15 bp, Homo sapiens
gtaagtgaaattaag

SEQ ID NO: 1084194 - DNA, 21 bp, Homo sapiens
gtaagtggggttgcaaccact

SEQ ID NO: 1084195 - DNA, 14 bp, Homo sapiens
gtaagtgtaaaaaa

SEQ ID NO: 1084196 - DNA, 13 bp, Homo sapiens
gtaagtgtacaat

SEQ ID NO: 1084197 - DNA, 22 bp, Homo sapiens
gtaagtgtgtcttcctagaatt

SEQ ID NO: 1084198 - DNA, 17 bp, Homo sapiens
gtaagtgttctcatgaa

SEQ ID NO: 1084199 - DNA, 18 bp, Homo sapiens
gtaagttaataatgtatt

SEQ ID NO: 1084200 - DNA, 18 bp, Homo sapiens
gtaagttaatgtatataa

SEQ ID NO: 1084201 - DNA, 21 bp, Homo sapiens
gtaagttcctactaggcaaaa

SEQ ID NO: 1084202 - DNA, 21 bp, Homo sapiens
gtaagtttaaaggatgttggt

SEQ ID NO: 1084203 - DNA, 14 bp, Homo sapiens
gtaataaaaagaga

SEQ ID NO: 1084204 - DNA, 19 bp, Homo sapiens
gtaataaaatggtacattt

SEQ ID NO: 1084205 - DNA, 16 bp, Homo sapiens
gtaataaactgtgttt

SEQ ID NO: 1084206 - DNA, 15 bp, Homo sapiens
gtaataaactttaat

SEQ ID NO: 1084207 - DNA, 14 bp, Homo sapiens
gtaataaaggtctt

SEQ ID NO: 1084208 - DNA, 14 bp, Homo sapiens
gtaataaagtatat

SEQ ID NO: 1084209 - DNA, 19 bp, Homo sapiens
gtaataacaaacgtgtttt

SEQ ID NO: 1084210 - DNA, 22 bp, Homo sapiens
gtaataagaaagtataaagtca

SEQ ID NO: 1084211 - DNA, 20 bp, Homo sapiens
gtaataagcacttgcctgga

SEQ ID NO: 1084212 - DNA, 13 bp, Homo sapiens
gtaataatagact

SEQ ID NO: 1084213 - DNA, 12 bp, Homo sapiens
gtaatactggaa

SEQ ID NO: 1084214 - DNA, 22 bp, Homo sapiens
gtaatactggaataatttgtaa

SEQ ID NO: 1084215 - DNA, 17 bp, Homo sapiens
gtaatacttccagaagt

SEQ ID NO: 1084216 - DNA, 15 bp, Homo sapiens
gtaatactttacaaa

SEQ ID NO: 1084217 - DNA, 19 bp, Homo sapiens
gtaatataaagtattcaac

SEQ ID NO: 1084218 - DNA, 15 bp, Homo sapiens
gtaatatattgtaca

SEQ ID NO: 1084219 - DNA, 14 bp, Homo sapiens
gtaatatgcacaca

SEQ ID NO: 1084220 - DNA, 17 bp, Homo sapiens
gtaatatgcacacattt

SEQ ID NO: 1084221 - DNA, 12 bp, Homo sapiens
gtaatattatta

SEQ ID NO: 1084222 - DNA, 15 bp, Homo sapiens
gtaatattctgtttt

SEQ ID NO: 1084223 - DNA, 16 bp, Homo sapiens
gtaatattctgttttg

SEQ ID NO: 1084224 - DNA, 16 bp, Homo sapiens
gtaatattgacttgta

SEQ ID NO: 1084225 - DNA, 19 bp, Homo sapiens
gtaatattgacttgtatat

SEQ ID NO: 1084226 - DNA, 20 bp, Homo sapiens
gtaatatttacataaagact

SEQ ID NO: 1084227 - DNA, 18 bp, Homo sapiens
gtaatatttatatattta

SEQ ID NO: 1084228 - DNA, 17 bp, Homo sapiens
gtaatattttccataaa

SEQ ID NO: 1084229 - DNA, 19 bp, Homo sapiens
gtaatcaataaagaaaact

SEQ ID NO: 1084230 - DNA, 17 bp, Homo sapiens
gtaatcatatgtgtctt

SEQ ID NO: 1084231 - DNA, 16 bp, Homo sapiens
gtaatcatgtactttg

SEQ ID NO: 1084232 - DNA, 13 bp, Homo sapiens
gtaatcattttaa

SEQ ID NO: 1084233 - DNA, 15 bp, Homo sapiens
gtaatccaggggtgt

SEQ ID NO: 1084234 - DNA, 17 bp, Homo sapiens
gtaatccatcactagcc

SEQ ID NO: 1084235 - DNA, 12 bp, Homo sapiens
gtaatcccagca

SEQ ID NO: 1084236 - DNA, 18 bp, Homo sapiens
gtaatcccagcactttgg

SEQ ID NO: 1084237 - DNA, 13 bp, Homo sapiens
gtaatcccagcag

SEQ ID NO: 1084238 - DNA, 12 bp, Homo sapiens
gtaatcccagct

SEQ ID NO: 1084239 - DNA, 17 bp, Homo sapiens
gtaatcccagctactca

SEQ ID NO: 1084240 - DNA, 15 bp, Homo sapiens
gtaatcgtgtcccct

SEQ ID NO: 1084241 - DNA, 17 bp, Homo sapiens
gtaatctctctgcagct

SEQ ID NO: 1084242 - DNA, 18 bp, Homo sapiens
gtaatctctctgcagctg

SEQ ID NO: 1084243 - DNA, 21 bp, Homo sapiens
gtaatctctctgcagctgccg

SEQ ID NO: 1084244 - DNA, 22 bp, Homo sapiens
gtaatctctctgcagctgccgg

SEQ ID NO: 1084245 - DNA, 22 bp, Homo sapiens
gtaatctgtataatactttgta

SEQ ID NO: 1084246 - DNA, 12 bp, Homo sapiens
gtaatctgtgta

SEQ ID NO: 1084247 - DNA, 20 bp, Homo sapiens
gtaatctgtgtacaaagaaa

SEQ ID NO: 1084248 - DNA, 16 bp, Homo sapiens
gtaatctttaaactgg

SEQ ID NO: 1084249 - DNA, 19 bp, Homo sapiens
gtaatctttacctgtatac

SEQ ID NO: 1084250 - DNA, 20 bp, Homo sapiens
gtaatctttacctgtataca

SEQ ID NO: 1084251 - DNA, 10 bp, Homo sapiens
gtaatgaaac

SEQ ID NO: 1084252 - DNA, 21 bp, Homo sapiens
gtaatgaatttttatgatatt

SEQ ID NO: 1084253 - DNA, 21 bp, Homo sapiens
gtaatgatatagccagaaaaa

SEQ ID NO: 1084254 - DNA, 20 bp, Homo sapiens
gtaatgatgaaatctttctt

SEQ ID NO: 1084255 - DNA, 16 bp, Homo sapiens
gtaatgcaaaaggctg

SEQ ID NO: 1084256 - DNA, 23 bp, Homo sapiens
gtatactgtgtgggatacttagt

SEQ ID NO: 1084257 - DNA, 19 bp, Homo sapiens
gtatacttgtattccctta

SEQ ID NO: 1084258 - DNA, 22 bp, Homo sapiens
gtatagaaatgctggtttttca

SEQ ID NO: 1084259 - DNA, 23 bp, Homo sapiens
gtatagaaatgctggtttttcag

SEQ ID NO: 1084260 - DNA, 15 bp, Homo sapiens
gtatagaataggcac

SEQ ID NO: 1084261 - DNA, 21 bp, Homo sapiens
gtatagaataggcactttaaa

SEQ ID NO: 1084262 - DNA, 21 bp, Homo sapiens
gtatagaccaaagcaaagaaa

SEQ ID NO: 1084263 - DNA, 22 bp, Homo sapiens
gtatagaccaaagcaaagaaaa

SEQ ID NO: 1084264 - DNA, 14 bp, Homo sapiens
gtatagatgcaaga

SEQ ID NO: 1084265 - DNA, 20 bp, Homo sapiens
gtataggtctcatctcttca

SEQ ID NO: 1084266 - DNA, 16 bp, Homo sapiens
gtatagtatctgtata

SEQ ID NO: 1084267 - DNA, 22 bp, Homo sapiens
gtatagtattggaaaataaaaa

SEQ ID NO: 1084268 - DNA, 15 bp, Homo sapiens
gtatagtgtaaaata

SEQ ID NO: 1084269 - DNA, 20 bp, Homo sapiens
gtatagtgttcacaaactgt

SEQ ID NO: 1084270 - DNA, 19 bp, Homo sapiens
gtatagttaggatagcatt

SEQ ID NO: 1084271 - DNA, 12 bp, Homo sapiens
gtatagttgctt

SEQ ID NO: 1084272 - DNA, 16 bp, Homo sapiens
gtatagttgcttgcct

SEQ ID NO: 1084273 - DNA, 20 bp, Homo sapiens
gtatataaacatatttttat

SEQ ID NO: 1084274 - DNA, 21 bp, Homo sapiens
gtatataaatacatgcacaca

SEQ ID NO: 1084275 - DNA, 15 bp, Homo sapiens
gtatataatatgtca

SEQ ID NO: 1084276 - DNA, 13 bp, Homo sapiens
gtatataatttta

SEQ ID NO: 1084277 - DNA, 13 bp, Homo sapiens
gtatatacatttc

SEQ ID NO: 1084278 - DNA, 19 bp, Homo sapiens
gtatatacttaagaataca

SEQ ID NO: 1084279 - DNA, 23 bp, Homo sapiens
gtatatactttgaaaggagatgt

SEQ ID NO: 1084280 - DNA, 15 bp, Homo sapiens
gtatatagcccagcc

SEQ ID NO: 1084281 - DNA, 21 bp, Homo sapiens
gtatatatatatagtaactac

SEQ ID NO: 1084282 - DNA, 22 bp, Homo sapiens
gtatatatctgcttcagtggag

SEQ ID NO: 1084283 - DNA, 22 bp, Homo sapiens
gtatatatcttataactgtttt

SEQ ID NO: 1084284 - DNA, 13 bp, Homo sapiens
gtatatatgtgtg

SEQ ID NO: 1084285 - DNA, 14 bp, Homo sapiens
gtatatatgtgtgt

SEQ ID NO: 1084286 - DNA, 19 bp, Homo sapiens
gtatatcagaaaagggaag

SEQ ID NO: 1084287 - DNA, 18 bp, Homo sapiens
gtatatcgttatcactgt

SEQ ID NO: 1084288 - DNA, 17 bp, Homo sapiens
gtatatctggacaagcc

SEQ ID NO: 1084289 - DNA, 18 bp, Homo sapiens
gtatatctggacaagcca

SEQ ID NO: 1084290 - DNA, 15 bp, Homo sapiens
gtatatgacatttaa

SEQ ID NO: 1084291 - DNA, 18 bp, Homo sapiens
gtatatgattctctgtgg

SEQ ID NO: 1084292 - DNA, 18 bp, Homo sapiens
gtatatgtataaattaat

SEQ ID NO: 1084293 - DNA, 14 bp, Homo sapiens
gtatatgtatatat

SEQ ID NO: 1084294 - DNA, 12 bp, Homo sapiens
gtatatgtattc

SEQ ID NO: 1084295 - DNA, 15 bp, Homo sapiens
gtatatgtattccct

SEQ ID NO: 1084296 - DNA, 16 bp, Homo sapiens
gtatatgtattccctt

SEQ ID NO: 1084297 - DNA, 20 bp, Homo sapiens
gtattccaccttaaattaaa

SEQ ID NO: 1084298 - DNA, 17 bp, Homo sapiens
gtattcccttgtatttt

SEQ ID NO: 1084299 - DNA, 18 bp, Homo sapiens
gtattccttaaataaact

SEQ ID NO: 1084300 - DNA, 18 bp, Homo sapiens
gtattctagttttgtcaa

SEQ ID NO: 1084301 - DNA, 14 bp, Homo sapiens
gtattctcaaagat

SEQ ID NO: 1084302 - DNA, 21 bp, Homo sapiens
gtattctctcctgtacctctt

SEQ ID NO: 1084303 - DNA, 19 bp, Homo sapiens
gtattctctgagctgtgca

SEQ ID NO: 1084304 - DNA, 14 bp, Homo sapiens
gtattctgacatgt

SEQ ID NO: 1084305 - DNA, 15 bp, Homo sapiens
gtattcttatttaat

SEQ ID NO: 1084306 - DNA, 16 bp, Homo sapiens
gtattcttctcttcct

SEQ ID NO: 1084307 - DNA, 22 bp, Homo sapiens
gtattcttctcttccttttatc

SEQ ID NO: 1084308 - DNA, 15 bp, Homo sapiens
gtattcttctgtatt

SEQ ID NO: 1084309 - DNA, 16 bp, Homo sapiens
gtattcttgagggaca

SEQ ID NO: 1084310 - DNA, 22 bp, Homo sapiens
gtattcttgctttagaaaacat

SEQ ID NO: 1084311 - DNA, 14 bp, Homo sapiens
gtattgaaaacttc

SEQ ID NO: 1084312 - DNA, 16 bp, Homo sapiens
gtattgaaaacttcaa

SEQ ID NO: 1084313 - DNA, 18 bp, Homo sapiens
gtattgaaaacttcaaag

SEQ ID NO: 1084314 - DNA, 20 bp, Homo sapiens
gtattgactttatgttgtat

SEQ ID NO: 1084315 - DNA, 19 bp, Homo sapiens
gtattgagggccagtgatg

SEQ ID NO: 1084316 - DNA, 20 bp, Homo sapiens
gtattgagggccagtgatga

SEQ ID NO: 1084317 - DNA, 21 bp, Homo sapiens
gtattgagtcttaactgtatt

SEQ ID NO: 1084318 - DNA, 14 bp, Homo sapiens
gtattgcacattgt

SEQ ID NO: 1084319 - DNA, 18 bp, Homo sapiens
gtattgcacattgtaaaa

SEQ ID NO: 1084320 - DNA, 15 bp, Homo sapiens
gtattgcatctgtat

SEQ ID NO: 1084321 - DNA, 20 bp, Homo sapiens
gtattggagcacatgttact

SEQ ID NO: 1084322 - DNA, 14 bp, Homo sapiens
gtattgtaaaacat

SEQ ID NO: 1084323 - DNA, 16 bp, Homo sapiens
gtattgtaaaacattc

SEQ ID NO: 1084324 - DNA, 19 bp, Homo sapiens
gtattgtaaaacattcaca

SEQ ID NO: 1084325 - DNA, 14 bp, Homo sapiens
gtattgtaaatgtg

SEQ ID NO: 1084326 - DNA, 19 bp, Homo sapiens
gtattgtaaattatatttg

SEQ ID NO: 1084327 - DNA, 13 bp, Homo sapiens
gtattgtaatctt

SEQ ID NO: 1084328 - DNA, 12 bp, Homo sapiens
gtattgtggttt

SEQ ID NO: 1084329 - DNA, 16 bp, Homo sapiens
gtattgttgaaaaagt

SEQ ID NO: 1084330 - DNA, 13 bp, Homo sapiens
gtattgttgtcct

SEQ ID NO: 1084331 - DNA, 18 bp, Homo sapiens
gtattgttgtccttttca

SEQ ID NO: 1084332 - DNA, 19 bp, Homo sapiens
gtattgttgtccttttcat

SEQ ID NO: 1084333 - DNA, 21 bp, Homo sapiens
gtattgttgtccttttcatag

SEQ ID NO: 1084334 - DNA, 18 bp, Homo sapiens
gtattgtttattatacca

SEQ ID NO: 1084335 - DNA, 18 bp, Homo sapiens
gtatttaaactatcttgt

SEQ ID NO: 1084336 - DNA, 21 bp, Homo sapiens
gtatttaaagaaaataaacac

SEQ ID NO: 1084337 - DNA, 17 bp, Homo sapiens
gtatttaacagaaattg

SEQ ID NO: 1084338 - DNA, 19 bp, Homo sapiens
gtatttaacagaaattgta

SEQ ID NO: 1084339 - DNA, 18 bp, Homo sapiens
gtatttaactacatctgc

SEQ ID NO: 1084340 - DNA, 15 bp, Homo sapiens
gtatttaagactgat

SEQ ID NO: 1084341 - DNA, 19 bp, Homo sapiens
gtatttaagatgtacattt

SEQ ID NO: 1084342 - DNA, 13 bp, Homo sapiens
gtatttaattaaa

SEQ ID NO: 1084343 - DNA, 23 bp, Homo sapiens
gtatttacactatgataaagttg

SEQ ID NO: 1084344 - DNA, 20 bp, Homo sapiens
gtatttaccaaaaattttgt

SEQ ID NO: 1084345 - DNA, 17 bp, Homo sapiens
gtatttataaaaatata

SEQ ID NO: 1084346 - DNA, 18 bp, Homo sapiens
gtatttataaaaatataa

SEQ ID NO: 1084347 - DNA, 15 bp, Homo sapiens
gtatttataatttaa

SEQ ID NO: 1084348 - DNA, 19 bp, Homo sapiens
gtatttatagtaaccattt

SEQ ID NO: 1084349 - DNA, 20 bp, Homo sapiens
gtatttatatttggaaagag

SEQ ID NO: 1084350 - DNA, 22 bp, Homo sapiens
gtatttatgggtggatttatcc

SEQ ID NO: 1084351 - DNA, 21 bp, Homo sapiens
gtatttatgtaatttgtacag

SEQ ID NO: 1084352 - DNA, 15 bp, Homo sapiens
gtatttattgtcagt

SEQ ID NO: 1084353 - DNA, 17 bp, Homo sapiens
gtatttattttcctccc

SEQ ID NO: 1084354 - DNA, 20 bp, Homo sapiens
gtatttattttcctccccag

SEQ ID NO: 1084355 - DNA, 13 bp, Homo sapiens
gtatttcaaattg

SEQ ID NO: 1084356 - DNA, 19 bp, Homo sapiens
gtatttcagtattttccag

SEQ ID NO: 1084357 - DNA, 17 bp, Homo sapiens
gtatttcatgtggctgt

SEQ ID NO: 1084358 - DNA, 15 bp, Homo sapiens
gtcaaactttttcca

SEQ ID NO: 1084359 - DNA, 13 bp, Homo sapiens
gtcaaagaagctt

SEQ ID NO: 1084360 - DNA, 16 bp, Homo sapiens
gtcaaagacagaatgg

SEQ ID NO: 1084361 - DNA, 20 bp, Homo sapiens
gtcaaagatgccccattcct

SEQ ID NO: 1084362 - DNA, 18 bp, Homo sapiens
gtcaaagcattgagatct

SEQ ID NO: 1084363 - DNA, 13 bp, Homo sapiens
gtcaaagtaaaac

SEQ ID NO: 1084364 - DNA, 16 bp, Homo sapiens
gtcaaatctgggctca

SEQ ID NO: 1084365 - DNA, 13 bp, Homo sapiens
gtcaaatgaactt

SEQ ID NO: 1084366 - DNA, 15 bp, Homo sapiens
gtcaaatgaactttt

SEQ ID NO: 1084367 - DNA, 20 bp, Homo sapiens
gtcaaatgaacttttacaga

SEQ ID NO: 1084368 - DNA, 16 bp, Homo sapiens
gtcaaatgatgtgcaa

SEQ ID NO: 1084369 - DNA, 14 bp, Homo sapiens
gtcaaatgccaaac

SEQ ID NO: 1084370 - DNA, 14 bp, Homo sapiens
gtcaaatgtttcct

SEQ ID NO: 1084371 - DNA, 11 bp, Homo sapiens
gtcaacaaact

SEQ ID NO: 1084372 - DNA, 19 bp, Homo sapiens
gtcaacactcttcttgagc

SEQ ID NO: 1084373 - DNA, 19 bp, Homo sapiens
gtcaacagagaaggcagga

SEQ ID NO: 1084374 - DNA, 14 bp, Homo sapiens
gtcaacagtaaacc

SEQ ID NO: 1084375 - DNA, 15 bp, Homo sapiens
gtcaacccaagctct

SEQ ID NO: 1084376 - DNA, 20 bp, Homo sapiens
gtcaacccaagctctgggga

SEQ ID NO: 1084377 - DNA, 14 bp, Homo sapiens
gtcaacctgggcaa

SEQ ID NO: 1084378 - DNA, 21 bp, Homo sapiens
gtcaacctttgtgtggctcct

SEQ ID NO: 1084379 - DNA, 13 bp, Homo sapiens
gtcaactggctgg

SEQ ID NO: 1084380 - DNA, 12 bp, Homo sapiens
gtcaagaaagga

SEQ ID NO: 1084381 - DNA, 21 bp, Homo sapiens
gtcaagaaaggaggggagaac

SEQ ID NO: 1084382 - DNA, 13 bp, Homo sapiens
gtcaagacatttg

SEQ ID NO: 1084383 - DNA, 14 bp, Homo sapiens
gtcaagattttgaa

SEQ ID NO: 1084384 - DNA, 23 bp, Homo sapiens
gtcaagcacatgtaataaattca

SEQ ID NO: 1084385 - DNA, 15 bp, Homo sapiens
gtcaagctcctcctc

SEQ ID NO: 1084386 - DNA, 12 bp, Homo sapiens
gtcaagctgctc

SEQ ID NO: 1084387 - DNA, 13 bp, Homo sapiens
gtcaagctgctct

SEQ ID NO: 1084388 - DNA, 16 bp, Homo sapiens
gtcaaggacagggctg

SEQ ID NO: 1084389 - DNA, 22 bp, Homo sapiens
gtcaaggccgagggccaggcag

SEQ ID NO: 1084390 - DNA, 20 bp, Homo sapiens
gtcaagggcttactatttct

SEQ ID NO: 1084391 - DNA, 15 bp, Homo sapiens
gtcaagtaagaagac

SEQ ID NO: 1084392 - DNA, 21 bp, Homo sapiens
gtcaagtctctgctggcccag

SEQ ID NO: 1084393 - DNA, 17 bp, Homo sapiens
gtcaagtgcgtccacga

SEQ ID NO: 1084394 - DNA, 17 bp, Homo sapiens
gtcaagttaacaaggaa

SEQ ID NO: 1084395 - DNA, 22 bp, Homo sapiens
gtcaagttgggttcacttgcca

SEQ ID NO: 1084396 - DNA, 13 bp, Homo sapiens
gtcaataaaatga

SEQ ID NO: 1084397 - DNA, 17 bp, Homo sapiens
gtcaataaacaacagct

SEQ ID NO: 1084398 - DNA, 17 bp, Homo sapiens
gtcaataaacctgtcat

SEQ ID NO: 1084399 - DNA, 13 bp, Homo sapiens
gtcaataaagcag

SEQ ID NO: 1084400 - DNA, 14 bp, Homo sapiens
gtcaataaagcaga

SEQ ID NO: 1084401 - DNA, 17 bp, Homo sapiens
gtcaatacaaatagatt

SEQ ID NO: 1084402 - DNA, 15 bp, Homo sapiens
gtcaatactgagcca

SEQ ID NO: 1084403 - DNA, 17 bp, Homo sapiens
gtcaatagcaaatgaag

SEQ ID NO: 1084404 - DNA, 19 bp, Homo sapiens
gtcaatatttagtaaagct

SEQ ID NO: 1084405 - DNA, 18 bp, Homo sapiens
gtcaatcacagtctcagt

SEQ ID NO: 1084406 - DNA, 12 bp, Homo sapiens
gtcaatccaaga

SEQ ID NO: 1084407 - DNA, 16 bp, Homo sapiens
gtcaatcccctcattc

SEQ ID NO: 1084408 - DNA, 21 bp, Homo sapiens
gtcaatggcttgttcatcatc

SEQ ID NO: 1084409 - DNA, 12 bp, Homo sapiens
gtcaatgtactt

SEQ ID NO: 1084410 - DNA, 14 bp, Homo sapiens
gtcaatgtgcagtg

SEQ ID NO: 1084411 - DNA, 18 bp, Homo sapiens
gtcaatgtgcagtgtagc

SEQ ID NO: 1084412 - DNA, 22 bp, Homo sapiens
gtcaattaaacagctggtcctc

SEQ ID NO: 1084413 - DNA, 17 bp, Homo sapiens
gtcaatttctgtgttgc

SEQ ID NO: 1084414 - DNA, 22 bp, Homo sapiens
gtcaatttctgtgttgccaagc

SEQ ID NO: 1084415 - DNA, 15 bp, Homo sapiens
gtcaattttttcagg

SEQ ID NO: 1084416 - DNA, 20 bp, Homo sapiens
gtcacaaactgatctaaaat

SEQ ID NO: 1084417 - DNA, 13 bp, Homo sapiens
gtcacaataaagt

SEQ ID NO: 1084418 - DNA, 12 bp, Homo sapiens
gtcacaataaat

SEQ ID NO: 1084419 - DNA, 18 bp, Homo sapiens
gtcacaataaatggccag

SEQ ID NO: 1084420 - DNA, 20 bp, Homo sapiens
gtcacaatgagattgaattt

SEQ ID NO: 1084421 - DNA, 17 bp, Homo sapiens
gtcacacaccagcactt

SEQ ID NO: 1084422 - DNA, 15 bp, Homo sapiens
gtcacaccatcttaa

SEQ ID NO: 1084423 - DNA, 21 bp, Homo sapiens
gtcacactctacacggactga

SEQ ID NO: 1084424 - DNA, 19 bp, Homo sapiens
gtcacagaaatcagaggag

SEQ ID NO: 1084425 - DNA, 22 bp, Homo sapiens
gtcacagcatggaggaggaggg

SEQ ID NO: 1084426 - DNA, 13 bp, Homo sapiens
gtcacagctgcag

SEQ ID NO: 1084427 - DNA, 15 bp, Homo sapiens
gtcacagctgcagct

SEQ ID NO: 1084428 - DNA, 22 bp, Homo sapiens
gtcaccctgtgggtgtctccct

SEQ ID NO: 1084429 - DNA, 17 bp, Homo sapiens
gtcacccttctgggcaa

SEQ ID NO: 1084430 - DNA, 21 bp, Homo sapiens
gtcaccgacagcggccttgaa

SEQ ID NO: 1084431 - DNA, 17 bp, Homo sapiens
gtcaccgcggacgtgct

SEQ ID NO: 1084432 - DNA, 20 bp, Homo sapiens
gtcaccgcggacgtgctggc

SEQ ID NO: 1084433 - DNA, 19 bp, Homo sapiens
gtcaccgtggaccttcctg

SEQ ID NO: 1084434 - DNA, 22 bp, Homo sapiens
gtcacctagaacgtgcatcctt

SEQ ID NO: 1084435 - DNA, 16 bp, Homo sapiens
gtcacctagcaagctg

SEQ ID NO: 1084436 - DNA, 19 bp, Homo sapiens
gtcacctagcaagctgccg

SEQ ID NO: 1084437 - DNA, 13 bp, Homo sapiens
gtcacctcctcca

SEQ ID NO: 1084438 - DNA, 15 bp, Homo sapiens
gtcacctcctccact

SEQ ID NO: 1084439 - DNA, 16 bp, Homo sapiens
gtcacctcctccactc

SEQ ID NO: 1084440 - DNA, 22 bp, Homo sapiens
gtcacctcgtctccctggtgcc

SEQ ID NO: 1084441 - DNA, 14 bp, Homo sapiens
gtcacctgcaagcc

SEQ ID NO: 1084442 - DNA, 23 bp, Homo sapiens
gtcacctgcaagccccagggcct

SEQ ID NO: 1084443 - DNA, 21 bp, Homo sapiens
gtcacctgccccgtagagaat

SEQ ID NO: 1084444 - DNA, 13 bp, Homo sapiens
gtcacctgctcac

SEQ ID NO: 1084445 - DNA, 15 bp, Homo sapiens
gtcacctgctcacag

SEQ ID NO: 1084446 - DNA, 23 bp, Homo sapiens
gtcacctgctcacagggatgctg

SEQ ID NO: 1084447 - DNA, 14 bp, Homo sapiens
gtcacctgctccag

SEQ ID NO: 1084448 - DNA, 15 bp, Homo sapiens
gtcacctgctccaga

SEQ ID NO: 1084449 - DNA, 20 bp, Homo sapiens
gtcacctggctgctaggcca

SEQ ID NO: 1084450 - DNA, 22 bp, Homo sapiens
gtcacctggctgctaggccaga

SEQ ID NO: 1084451 - DNA, 14 bp, Homo sapiens
gtcaccttcgagta

SEQ ID NO: 1084452 - DNA, 14 bp, Homo sapiens
gtcaccttgcactc

SEQ ID NO: 1084453 - DNA, 13 bp, Homo sapiens
gtcacctttctgg

SEQ ID NO: 1084454 - DNA, 20 bp, Homo sapiens
gtcacctttctgggctttct

SEQ ID NO: 1084455 - DNA, 17 bp, Homo sapiens
gtcaccttttctgtggc

SEQ ID NO: 1084456 - DNA, 22 bp, Homo sapiens
gtcacgaggtccagacccactc

SEQ ID NO: 1084457 - DNA, 13 bp, Homo sapiens
gtcacgctttcat

SEQ ID NO: 1084458 - DNA, 15 bp, Homo sapiens
gtcacgtgtggaatt

SEQ ID NO: 1084459 - DNA, 19 bp, Homo sapiens
gtcacgtttggtgcttctc

SEQ ID NO: 1084460 - DNA, 14 bp, Homo sapiens
gtcactaatacaca

SEQ ID NO: 1084461 - DNA, 22 bp, Homo sapiens
gtcactactcacagtctcttta

SEQ ID NO: 1084462 - DNA, 13 bp, Homo sapiens
gtcactatatctt

SEQ ID NO: 1084463 - DNA, 20 bp, Homo sapiens
gtcactatgggatgagaaaa

SEQ ID NO: 1084464 - DNA, 18 bp, Homo sapiens
gtcactcattgctgagcc

SEQ ID NO: 1084465 - DNA, 19 bp, Homo sapiens
gtcactcattgctgagcct

SEQ ID NO: 1084466 - DNA, 22 bp, Homo sapiens
gtcactcattgctgagcctctg

SEQ ID NO: 1084467 - DNA, 23 bp, Homo sapiens
gtcactcattgctgagcctctgc

SEQ ID NO: 1084468 - DNA, 19 bp, Homo sapiens
gtcactccaccatccccac

SEQ ID NO: 1084469 - DNA, 11 bp, Homo sapiens
gtcactccagt

SEQ ID NO: 1084470 - DNA, 21 bp, Homo sapiens
gtcactccagtagctcctgga

SEQ ID NO: 1084471 - DNA, 13 bp, Homo sapiens
gtcactcctgggg

SEQ ID NO: 1084472 - DNA, 21 bp, Homo sapiens
gtcactcctggggcctcttgg

SEQ ID NO: 1084473 - DNA, 16 bp, Homo sapiens
gtcactctgccctctg

SEQ ID NO: 1084474 - DNA, 13 bp, Homo sapiens
gtcactgaacaaa

SEQ ID NO: 1084475 - DNA, 22 bp, Homo sapiens
gtcactgaaccactgcttctct

SEQ ID NO: 1084476 - DNA, 22 bp, Homo sapiens
gtcactgatgtacaattaaaaa

SEQ ID NO: 1084477 - DNA, 20 bp, Homo sapiens
gtcactgcacagtgcatctc

SEQ ID NO: 1084478 - DNA, 13 bp, Homo sapiens
gtcactgcccacc

SEQ ID NO: 1084479 - DNA, 15 bp, Homo sapiens
gtcactgcccaccaa

SEQ ID NO: 1084480 - DNA, 23 bp, Homo sapiens
gtcactgcctgcagaggtctgtg

SEQ ID NO: 1084481 - DNA, 15 bp, Homo sapiens
gtcactgctctggac

SEQ ID NO: 1084482 - DNA, 11 bp, Homo sapiens
gtcactgctgt

SEQ ID NO: 1084483 - DNA, 12 bp, Homo sapiens
gtcactggaaag

SEQ ID NO: 1084484 - DNA, 12 bp, Homo sapiens
gtcactggcaga

SEQ ID NO: 1084485 - DNA, 13 bp, Homo sapiens
gtcactggcagag

SEQ ID NO: 1084486 - DNA, 15 bp, Homo sapiens
gtcactggcagagca

SEQ ID NO: 1084487 - DNA, 20 bp, Homo sapiens
gtcactggcagagcacagcc

SEQ ID NO: 1084488 - DNA, 15 bp, Homo sapiens
gtcactggctctcca

SEQ ID NO: 1084489 - DNA, 17 bp, Homo sapiens
gtcactggctctccaag

SEQ ID NO: 1084490 - DNA, 20 bp, Homo sapiens
gtcactggctctccaagtgc

SEQ ID NO: 1084491 - DNA, 21 bp, Homo sapiens
gtcactggctctccaagtgcc

SEQ ID NO: 1084492 - DNA, 17 bp, Homo sapiens
gtcactgtccctcaaat

SEQ ID NO: 1084493 - DNA, 22 bp, Homo sapiens
gtcactgtccttgaacccaaca

SEQ ID NO: 1084494 - DNA, 14 bp, Homo sapiens
gtcactgtggtcct

SEQ ID NO: 1084495 - DNA, 16 bp, Homo sapiens
gtcactgtttctctgc

SEQ ID NO: 1084496 - DNA, 21 bp, Homo sapiens
gtcactgtttttattccttcc

SEQ ID NO: 1084497 - DNA, 16 bp, Homo sapiens
gtcacttccagtgttg

SEQ ID NO: 1084498 - DNA, 18 bp, Homo sapiens
gtcacttcgcgtgccctc

SEQ ID NO: 1084499 - DNA, 22 bp, Homo sapiens
gtcacttctcctgctgctcctg

SEQ ID NO: 1084500 - DNA, 22 bp, Homo sapiens
gtcacttcttcacctcttccac

SEQ ID NO: 1084501 - DNA, 15 bp, Homo sapiens
gtcacttgccacatg

SEQ ID NO: 1084502 - DNA, 16 bp, Homo sapiens
gtcacttgggagctgc

SEQ ID NO: 1084503 - DNA, 23 bp, Homo sapiens
gtcactttgctctgggtggaagt

SEQ ID NO: 1084504 - DNA, 13 bp, Homo sapiens
gtcacttttcctt

SEQ ID NO: 1084505 - DNA, 14 bp, Homo sapiens
gtcactttttatgc

SEQ ID NO: 1084506 - DNA, 22 bp, Homo sapiens
gtcactttttttttttttcccc

SEQ ID NO: 1084507 - DNA, 15 bp, Homo sapiens
gtcagaaaacagaga

SEQ ID NO: 1084508 - DNA, 13 bp, Homo sapiens
gtcagaaataaaa

SEQ ID NO: 1084509 - DNA, 12 bp, Homo sapiens
gtcagaacatgt

SEQ ID NO: 1084510 - DNA, 22 bp, Homo sapiens
gtcagaaccagagggcatgctg

SEQ ID NO: 1084511 - DNA, 16 bp, Homo sapiens
gtcagaagaagtggga

SEQ ID NO: 1084512 - DNA, 21 bp, Homo sapiens
gtcagaagaagtgggagcagc

SEQ ID NO: 1084513 - DNA, 18 bp, Homo sapiens
gtcagaagcctccaagcc

SEQ ID NO: 1084514 - DNA, 18 bp, Homo sapiens
gtcagaatcagaatcatg

SEQ ID NO: 1084515 - DNA, 20 bp, Homo sapiens
gtcagaatgtgaaaaaggaa

SEQ ID NO: 1084516 - DNA, 13 bp, Homo sapiens
gtcagacacagat

SEQ ID NO: 1084517 - DNA, 16 bp, Homo sapiens
gtcagacagcaaggaa

SEQ ID NO: 1084518 - DNA, 14 bp, Homo sapiens
gtcagaccctggag

SEQ ID NO: 1084519 - DNA, 15 bp, Homo sapiens
gtcagactaagaaat

SEQ ID NO: 1084520 - DNA, 18 bp, Homo sapiens
gtcagactggctggctgc

SEQ ID NO: 1084521 - DNA, 16 bp, Homo sapiens
gtcagactttaaagaa

SEQ ID NO: 1084522 - DNA, 20 bp, Homo sapiens
gtcagactttgctgcatttt

SEQ ID NO: 1084523 - DNA, 12 bp, Homo sapiens
gtcagagagacc

SEQ ID NO: 1084524 - DNA, 16 bp, Homo sapiens
gtcagagagacctcat

SEQ ID NO: 1084525 - DNA, 21 bp, Homo sapiens
gtcagagagacctcatcctgc

SEQ ID NO: 1084526 - DNA, 13 bp, Homo sapiens
gtcagagcccagg

SEQ ID NO: 1084527 - DNA, 23 bp, Homo sapiens
gtcagagccctggctgggttcag

SEQ ID NO: 1084528 - DNA, 14 bp, Homo sapiens
gtcagagcctacct

SEQ ID NO: 1084529 - DNA, 14 bp, Homo sapiens
gtcagagctgggag

SEQ ID NO: 1084530 - DNA, 17 bp, Homo sapiens
gtcagaggaccccaggg

SEQ ID NO: 1084531 - DNA, 18 bp, Homo sapiens
gtcagaggaccccagggt

SEQ ID NO: 1084532 - DNA, 13 bp, Homo sapiens
gtcagaggagaag

SEQ ID NO: 1084533 - DNA, 17 bp, Homo sapiens
gtcagaggagcgcaggc

SEQ ID NO: 1084534 - DNA, 20 bp, Homo sapiens
gtcagaggagcgcaggcagc

SEQ ID NO: 1084535 - DNA, 18 bp, Homo sapiens
gtcagaggagggcatggg

SEQ ID NO: 1084536 - DNA, 19 bp, Homo sapiens
gtcagaggctaagatgaga

SEQ ID NO: 1084537 - DNA, 19 bp, Homo sapiens
gtcagagtggcgtgagctg

SEQ ID NO: 1084538 - DNA, 16 bp, Homo sapiens
gtcagagtgttgttcc

SEQ ID NO: 1084539 - DNA, 15 bp, Homo sapiens
gtcagatgagaacaa

SEQ ID NO: 1084540 - DNA, 16 bp, Homo sapiens
gtcagatgagaacaaa

SEQ ID NO: 1084541 - DNA, 12 bp, Homo sapiens
gtcagatgaggc

SEQ ID NO: 1084542 - DNA, 15 bp, Homo sapiens
gtcagatgaggcaaa

SEQ ID NO: 1084543 - DNA, 22 bp, Homo sapiens
gtcagatgcgtgcccagctctt

SEQ ID NO: 1084544 - DNA, 18 bp, Homo sapiens
gtcagatgggaagacatg

SEQ ID NO: 1084545 - DNA, 15 bp, Homo sapiens
gtcagatttctggtt

SEQ ID NO: 1084546 - DNA, 23 bp, Homo sapiens
gtcagcaaaaagcaaaatcattt

SEQ ID NO: 1084547 - DNA, 18 bp, Homo sapiens
gtcagcaccttggcccag

SEQ ID NO: 1084548 - DNA, 23 bp, Homo sapiens
gtcagcaccttggcccaggagct

SEQ ID NO: 1084549 - DNA, 22 bp, Homo sapiens
gtcagcatctggctgtctagaa

SEQ ID NO: 1084550 - DNA, 14 bp, Homo sapiens
gtcagcatttgatc

SEQ ID NO: 1084551 - DNA, 14 bp, Homo sapiens
gtcagccacactgg

SEQ ID NO: 1084552 - DNA, 12 bp, Homo sapiens
gtcagccagggc

SEQ ID NO: 1084553 - DNA, 18 bp, Homo sapiens
gtcagccatcgtcctggg

SEQ ID NO: 1084554 - DNA, 14 bp, Homo sapiens
gtcagccctgtgtc

SEQ ID NO: 1084555 - DNA, 10 bp, Homo sapiens
gtcagccctt

SEQ ID NO: 1084556 - DNA, 18 bp, Homo sapiens
gtcagcccttggcttctg

SEQ ID NO: 1084557 - DNA, 15 bp, Homo sapiens
gtcagccgggccctg

SEQ ID NO: 1084558 - DNA, 12 bp, Homo sapiens
gtcagtctttag

SEQ ID NO: 1084559 - DNA, 17 bp, Homo sapiens
gtcagtctttgctcagt

SEQ ID NO: 1084560 - DNA, 14 bp, Homo sapiens
gtcagtgaggccca

SEQ ID NO: 1084561 - DNA, 23 bp, Homo sapiens
gtcagtgcagcccgtgtggcccc

SEQ ID NO: 1084562 - DNA, 13 bp, Homo sapiens
gtcagtgctgcct

SEQ ID NO: 1084563 - DNA, 17 bp, Homo sapiens
gtcagtggctttgcata

SEQ ID NO: 1084564 - DNA, 22 bp, Homo sapiens
gtcagtgggaacgtgactgccc

SEQ ID NO: 1084565 - DNA, 15 bp, Homo sapiens
gtcagtgtggagagg

SEQ ID NO: 1084566 - DNA, 16 bp, Homo sapiens
gtcagtgtggagaggg

SEQ ID NO: 1084567 - DNA, 19 bp, Homo sapiens
gtcagtgttaaagattttg

SEQ ID NO: 1084568 - DNA, 14 bp, Homo sapiens
gtcagtgtttcttt

SEQ ID NO: 1084569 - DNA, 22 bp, Homo sapiens
gtcagttcccggagcacagccc

SEQ ID NO: 1084570 - DNA, 14 bp, Homo sapiens
gtcagttcttggtg

SEQ ID NO: 1084571 - DNA, 16 bp, Homo sapiens
gtcagtttcctctcct

SEQ ID NO: 1084572 - DNA, 11 bp, Homo sapiens
gtcagttttca

SEQ ID NO: 1084573 - DNA, 13 bp, Homo sapiens
gtcagttttcata

SEQ ID NO: 1084574 - DNA, 14 bp, Homo sapiens
gtcataaaatgcat

SEQ ID NO: 1084575 - DNA, 21 bp, Homo sapiens
gtcataaagtgagaaaactgt

SEQ ID NO: 1084576 - DNA, 22 bp, Homo sapiens
gtcataacatttaaagagattt

SEQ ID NO: 1084577 - DNA, 18 bp, Homo sapiens
gtcataataaagttgttt

SEQ ID NO: 1084578 - DNA, 20 bp, Homo sapiens
gtcataataaagttgtttta

SEQ ID NO: 1084579 - DNA, 15 bp, Homo sapiens
gtcataccaatgaaa

SEQ ID NO: 1084580 - DNA, 19 bp, Homo sapiens
gtcatagactcctttgcta

SEQ ID NO: 1084581 - DNA, 17 bp, Homo sapiens
gtcatagagctgcaggg

SEQ ID NO: 1084582 - DNA, 22 bp, Homo sapiens
gtcatagggattgtccctgtgt

SEQ ID NO: 1084583 - DNA, 22 bp, Homo sapiens
gtcatatactgccatgtactag

SEQ ID NO: 1084584 - DNA, 14 bp, Homo sapiens
gtcatatagtaaac

SEQ ID NO: 1084585 - DNA, 21 bp, Homo sapiens
gtcatcaaacatttgccaagt

SEQ ID NO: 1084586 - DNA, 19 bp, Homo sapiens
gtcatcactccctggatgt

SEQ ID NO: 1084587 - DNA, 17 bp, Homo sapiens
gtcatcacttttcagtg

SEQ ID NO: 1084588 - DNA, 20 bp, Homo sapiens
gtcatcagatgcctgcttga

SEQ ID NO: 1084589 - DNA, 14 bp, Homo sapiens
gtcatcagccacca

SEQ ID NO: 1084590 - DNA, 16 bp, Homo sapiens
gtcatcagccagcaag

SEQ ID NO: 1084591 - DNA, 15 bp, Homo sapiens
gtcatcatcagggcc

SEQ ID NO: 1084592 - DNA, 21 bp, Homo sapiens
gtcatcatcagggcctggggc

SEQ ID NO: 1084593 - DNA, 15 bp, Homo sapiens
gtcatccaacaagaa

SEQ ID NO: 1084594 - DNA, 22 bp, Homo sapiens
gtcatccaacaagaagaaatat

SEQ ID NO: 1084595 - DNA, 14 bp, Homo sapiens
gtcatccatgccct

SEQ ID NO: 1084596 - DNA, 18 bp, Homo sapiens
gtcatcccctctcaggag

SEQ ID NO: 1084597 - DNA, 17 bp, Homo sapiens
gtcatcctcaggaacca

SEQ ID NO: 1084598 - DNA, 15 bp, Homo sapiens
gtcatcctcccttgc

SEQ ID NO: 1084599 - DNA, 19 bp, Homo sapiens
gtcatcctgccctgcagca

SEQ ID NO: 1084600 - DNA, 16 bp, Homo sapiens
gtcatccttggtgctc

SEQ ID NO: 1084601 - DNA, 17 bp, Homo sapiens
gtcatcgttccccaccc

SEQ ID NO: 1084602 - DNA, 17 bp, Homo sapiens
gtcatctcattccactg

SEQ ID NO: 1084603 - DNA, 17 bp, Homo sapiens
gtcatctccatcagctg

SEQ ID NO: 1084604 - DNA, 22 bp, Homo sapiens
gtcatctccggggtggccacag

SEQ ID NO: 1084605 - DNA, 15 bp, Homo sapiens
gtcatctctctgggg

SEQ ID NO: 1084606 - DNA, 17 bp, Homo sapiens
gtcatctctctggggcc

SEQ ID NO: 1084607 - DNA, 17 bp, Homo sapiens
gtcatctgtaagagctt

SEQ ID NO: 1084608 - DNA, 19 bp, Homo sapiens
gtcatctgtaagagcttgc

SEQ ID NO: 1084609 - DNA, 12 bp, Homo sapiens
gtcatcttgcta

SEQ ID NO: 1084610 - DNA, 21 bp, Homo sapiens
gtcatcttgtgagtggataat

SEQ ID NO: 1084611 - DNA, 23 bp, Homo sapiens
gtcatctttcttttctttgagtc

SEQ ID NO: 1084612 - DNA, 16 bp, Homo sapiens
gtcatgacagtgcttg

SEQ ID NO: 1084613 - DNA, 15 bp, Homo sapiens
gtcatgatctccctg

SEQ ID NO: 1084614 - DNA, 14 bp, Homo sapiens
gtcatgatgaatca

SEQ ID NO: 1084615 - DNA, 15 bp, Homo sapiens
gtcatgatggcacca

SEQ ID NO: 1084616 - DNA, 19 bp, Homo sapiens
gtcatgcacagtatttgta

SEQ ID NO: 1084617 - DNA, 16 bp, Homo sapiens
gtcatgcccccctcaa

SEQ ID NO: 1084618 - DNA, 16 bp, Homo sapiens
gtcatgccctcctctc

SEQ ID NO: 1084619 - DNA, 15 bp, Homo sapiens
gtcatgcttgtgtta

SEQ ID NO: 1084620 - DNA, 20 bp, Homo sapiens
gtcatggaaaatgtcctgtg

SEQ ID NO: 1084621 - DNA, 15 bp, Homo sapiens
gtcatggaatcttgc

SEQ ID NO: 1084622 - DNA, 18 bp, Homo sapiens
gtcatggaatcttgctgc

SEQ ID NO: 1084623 - DNA, 16 bp, Homo sapiens
gtcatggcctgagatg

SEQ ID NO: 1084624 - DNA, 15 bp, Homo sapiens
gtcatggccttgaaa

SEQ ID NO: 1084625 - DNA, 19 bp, Homo sapiens
gtcatgggaacgcagcctc

SEQ ID NO: 1084626 - DNA, 23 bp, Homo sapiens
gtcatgggccactgcttttccct

SEQ ID NO: 1084627 - DNA, 21 bp, Homo sapiens
gtcatggtagatttttttcat

SEQ ID NO: 1084628 - DNA, 12 bp, Homo sapiens
gtcatgtatttt

SEQ ID NO: 1084629 - DNA, 13 bp, Homo sapiens
gtcatgtatttta

SEQ ID NO: 1084630 - DNA, 18 bp, Homo sapiens
gtcatgtgcatctggtgt

SEQ ID NO: 1084631 - DNA, 21 bp, Homo sapiens
gtcatgtgggtcttccagggg

SEQ ID NO: 1084632 - DNA, 13 bp, Homo sapiens
gtcatgtgtgcat

SEQ ID NO: 1084633 - DNA, 19 bp, Homo sapiens
gtcatgtgtgcatgtgagc

SEQ ID NO: 1084634 - DNA, 23 bp, Homo sapiens
gtcatgttggtcaaaagctggat

SEQ ID NO: 1084635 - DNA, 14 bp, Homo sapiens
gtcatgtttatctg

SEQ ID NO: 1084636 - DNA, 23 bp, Homo sapiens
gtcatgtttgcaggggtgacggc

SEQ ID NO: 1084637 - DNA, 12 bp, Homo sapiens
gtcattaaaggt

SEQ ID NO: 1084638 - DNA, 22 bp, Homo sapiens
gtcattacaaaaaaacacgtgg

SEQ ID NO: 1084639 - DNA, 21 bp, Homo sapiens
gtcattatgagaggcaatgat

SEQ ID NO: 1084640 - DNA, 17 bp, Homo sapiens
gtcattatgatttcatt

SEQ ID NO: 1084641 - DNA, 18 bp, Homo sapiens
gtcattattactggtatt

SEQ ID NO: 1084642 - DNA, 20 bp, Homo sapiens
gtcattatttattgttaaat

SEQ ID NO: 1084643 - DNA, 17 bp, Homo sapiens
gtcattatttcagtgtg

SEQ ID NO: 1084644 - DNA, 11 bp, Homo sapiens
gtcattcatat

SEQ ID NO: 1084645 - DNA, 15 bp, Homo sapiens
gtcattctgcctgct

SEQ ID NO: 1084646 - DNA, 21 bp, Homo sapiens
gtcattcttacaattgcactg

SEQ ID NO: 1084647 - DNA, 18 bp, Homo sapiens
gtcattgctgttgtccct

SEQ ID NO: 1084648 - DNA, 22 bp, Homo sapiens
gtcattgctgttgtccctctgc

SEQ ID NO: 1084649 - DNA, 20 bp, Homo sapiens
gtcattgtaaacaaactctt

SEQ ID NO: 1084650 - DNA, 13 bp, Homo sapiens
gtcatttaaatgt

SEQ ID NO: 1084651 - DNA, 17 bp, Homo sapiens
gtcatttgaacctggat

SEQ ID NO: 1084652 - DNA, 15 bp, Homo sapiens
gtcatttgcaagctg

SEQ ID NO: 1084653 - DNA, 21 bp, Homo sapiens
gtcatttgctgagcatgtact

SEQ ID NO: 1084654 - DNA, 19 bp, Homo sapiens
gtcattttattttttccct

SEQ ID NO: 1084655 - DNA, 13 bp, Homo sapiens
gtcattttgggtt

SEQ ID NO: 1084656 - DNA, 13 bp, Homo sapiens
gtcattttgtaat

SEQ ID NO: 1084657 - DNA, 14 bp, Homo sapiens
gtcatttttaatgt

SEQ ID NO: 1084658 - DNA, 17 bp, Homo sapiens
gtcatttttaatgtatc

SEQ ID NO: 1084659 - DNA, 22 bp, Homo sapiens
gtcatttttaatgtatctattt

SEQ ID NO: 1084660 - DNA, 19 bp, Homo sapiens
gtcattttttttaagaaaa

SEQ ID NO: 1084661 - DNA, 22 bp, Homo sapiens
gtccaaaagatacccaaatttt

SEQ ID NO: 1084662 - DNA, 14 bp, Homo sapiens
gtccaaacccttca

SEQ ID NO: 1084663 - DNA, 21 bp, Homo sapiens
gtccaaacccttcaactcctg

SEQ ID NO: 1084664 - DNA, 22 bp, Homo sapiens
gtccaaacccttcaactcctgg

SEQ ID NO: 1084665 - DNA, 23 bp, Homo sapiens
gtccaaacccttcaactcctggc

SEQ ID NO: 1084666 - DNA, 20 bp, Homo sapiens
gtccaaaggaggctggcagg

SEQ ID NO: 1084667 - DNA, 16 bp, Homo sapiens
gtccaaattgtttgta

SEQ ID NO: 1084668 - DNA, 23 bp, Homo sapiens
gtccaacaataaacaggaatttt

SEQ ID NO: 1084669 - DNA, 14 bp, Homo sapiens
gtccaacctaaccc

SEQ ID NO: 1084670 - DNA, 21 bp, Homo sapiens
gtccaacctaacccctttcct

SEQ ID NO: 1084671 - DNA, 16 bp, Homo sapiens
gtccaacctgcctgtg

SEQ ID NO: 1084672 - DNA, 13 bp, Homo sapiens
gtccaagagacat

SEQ ID NO: 1084673 - DNA, 22 bp, Homo sapiens
gtccaaggaaacttgaatcaaa

SEQ ID NO: 1084674 - DNA, 13 bp, Homo sapiens
gtccaaggccagt

SEQ ID NO: 1084675 - DNA, 16 bp, Homo sapiens
gtccaagtggctgtga

SEQ ID NO: 1084676 - DNA, 15 bp, Homo sapiens
gtccaagtgtgtgtg

SEQ ID NO: 1084677 - DNA, 15 bp, Homo sapiens
gtccaagttcacagt

SEQ ID NO: 1084678 - DNA, 20 bp, Homo sapiens
gtccaagttcttcacctcta

SEQ ID NO: 1084679 - DNA, 22 bp, Homo sapiens
gtccaagttcttcacctctatc

SEQ ID NO: 1084680 - DNA, 23 bp, Homo sapiens
gtccaatgtacaggaagtagttc

SEQ ID NO: 1084681 - DNA, 16 bp, Homo sapiens
gtccaattagtttcct

SEQ ID NO: 1084682 - DNA, 13 bp, Homo sapiens
gtcccctggagtg

SEQ ID NO: 1084683 - DNA, 20 bp, Homo sapiens
gtcccctgtcccaccaactc

SEQ ID NO: 1084684 - DNA, 23 bp, Homo sapiens
gtcccctgtggtgatgtgcctgt

SEQ ID NO: 1084685 - DNA, 12 bp, Homo sapiens
gtccccttcccc

SEQ ID NO: 1084686 - DNA, 13 bp, Homo sapiens
gtcccctttcctc

SEQ ID NO: 1084687 - DNA, 23 bp, Homo sapiens
gtccccttttcttttctacccta

SEQ ID NO: 1084688 - DNA, 14 bp, Homo sapiens
gtcccgccttcctc

SEQ ID NO: 1084689 - DNA, 22 bp, Homo sapiens
gtcccgccttcctcctccacag

SEQ ID NO: 1084690 - DNA, 15 bp, Homo sapiens
gtcccgctgcctcct

SEQ ID NO: 1084691 - DNA, 12 bp, Homo sapiens
gtcccgctgctg

SEQ ID NO: 1084692 - DNA, 21 bp, Homo sapiens
gtcccggggccagcacttcca

SEQ ID NO: 1084693 - DNA, 17 bp, Homo sapiens
gtccctaaagaaaaaaa

SEQ ID NO: 1084694 - DNA, 16 bp, Homo sapiens
gtccctacctgcttca

SEQ ID NO: 1084695 - DNA, 18 bp, Homo sapiens
gtccctatagtttcacca

SEQ ID NO: 1084696 - DNA, 23 bp, Homo sapiens
gtccctatctattaaagtgactt

SEQ ID NO: 1084697 - DNA, 23 bp, Homo sapiens
gtccctcaaatgacccaaagacc

SEQ ID NO: 1084698 - DNA, 14 bp, Homo sapiens
gtccctcaggttcc

SEQ ID NO: 1084699 - DNA, 17 bp, Homo sapiens
gtccctcatggagacct

SEQ ID NO: 1084700 - DNA, 15 bp, Homo sapiens
gtccctccctgcctg

SEQ ID NO: 1084701 - DNA, 19 bp, Homo sapiens
gtccctccctgcctgaggg

SEQ ID NO: 1084702 - DNA, 13 bp, Homo sapiens
gtccctccgagct

SEQ ID NO: 1084703 - DNA, 23 bp, Homo sapiens
gtccctccgggacctggtgctgc

SEQ ID NO: 1084704 - DNA, 15 bp, Homo sapiens
gtccctcgtccacag

SEQ ID NO: 1084705 - DNA, 20 bp, Homo sapiens
gtccctctgccccatcctcc

SEQ ID NO: 1084706 - DNA, 12 bp, Homo sapiens
gtccctctgcct

SEQ ID NO: 1084707 - DNA, 11 bp, Homo sapiens
gtccctctgtg

SEQ ID NO: 1084708 - DNA, 21 bp, Homo sapiens
gtccctcttctctcctcagtt

SEQ ID NO: 1084709 - DNA, 17 bp, Homo sapiens
gtccctgactctctgtg

SEQ ID NO: 1084710 - DNA, 18 bp, Homo sapiens
gtccctgactctctgtga

SEQ ID NO: 1084711 - DNA, 20 bp, Homo sapiens
gtccctgactctctgtgacc

SEQ ID NO: 1084712 - DNA, 12 bp, Homo sapiens
gtccctgaggat

SEQ ID NO: 1084713 - DNA, 22 bp, Homo sapiens
gtccctgaggatgggtcagagc

SEQ ID NO: 1084714 - DNA, 19 bp, Homo sapiens
gtccctgccaatgctccag

SEQ ID NO: 1084715 - DNA, 24 bp, Homo sapiens
gtccctgccacactcagtccccca

SEQ ID NO: 1084716 - DNA, 12 bp, Homo sapiens
gtccctgccccg

SEQ ID NO: 1084717 - DNA, 19 bp, Homo sapiens
gtccctgccccgcccccca

SEQ ID NO: 1084718 - DNA, 14 bp, Homo sapiens
gtccctgctcccct

SEQ ID NO: 1084719 - DNA, 22 bp, Homo sapiens
gtccctgctgctgccagggctt

SEQ ID NO: 1084720 - DNA, 14 bp, Homo sapiens
gtccctggaagctt

SEQ ID NO: 1084721 - DNA, 22 bp, Homo sapiens
gtccctggggctagggggagcc

SEQ ID NO: 1084722 - DNA, 13 bp, Homo sapiens
gtccctggtccct

SEQ ID NO: 1084723 - DNA, 15 bp, Homo sapiens
gtccctggtccctcg

SEQ ID NO: 1084724 - DNA, 19 bp, Homo sapiens
gtccctggtccctcgtcca

SEQ ID NO: 1084725 - DNA, 22 bp, Homo sapiens
gtccctggtccctcgtccacag

SEQ ID NO: 1084726 - DNA, 18 bp, Homo sapiens
gtccctgtcatttgaacc

SEQ ID NO: 1084727 - DNA, 12 bp, Homo sapiens
gtccctgtcccc

SEQ ID NO: 1084728 - DNA, 18 bp, Homo sapiens
gtccctgtcccccagcat

SEQ ID NO: 1084729 - DNA, 14 bp, Homo sapiens
gtccctgtccctgc

SEQ ID NO: 1084730 - DNA, 15 bp, Homo sapiens
gtccctgtccctgcc

SEQ ID NO: 1084731 - DNA, 12 bp, Homo sapiens
gtccctgtcctt

SEQ ID NO: 1084732 - DNA, 15 bp, Homo sapiens
gtccctgtccttcta

SEQ ID NO: 1084733 - DNA, 15 bp, Homo sapiens
gtccctgtgcctaac

SEQ ID NO: 1084734 - DNA, 15 bp, Homo sapiens
gtccctgtgttgtcc

SEQ ID NO: 1084735 - DNA, 19 bp, Homo sapiens
gtccctgtgttgtcccatc

SEQ ID NO: 1084736 - DNA, 24 bp, Homo sapiens
gtccctgtgttgtcccatctgccc

SEQ ID NO: 1084737 - DNA, 12 bp, Homo sapiens
gtccctgttaga

SEQ ID NO: 1084738 - DNA, 11 bp, Homo sapiens
gtcccttccat

SEQ ID NO: 1084739 - DNA, 12 bp, Homo sapiens
gtcccttcccct

SEQ ID NO: 1084740 - DNA, 17 bp, Homo sapiens
gtcccttcccctccctg

SEQ ID NO: 1084741 - DNA, 17 bp, Homo sapiens
gtcccttccccttcacc

SEQ ID NO: 1084742 - DNA, 17 bp, Homo sapiens
gtcccttcccgacccag

SEQ ID NO: 1084743 - DNA, 19 bp, Homo sapiens
gtcccttcctattctcctg

SEQ ID NO: 1084744 - DNA, 24 bp, Homo sapiens
gtcccttcctattctcctgccatg

SEQ ID NO: 1084745 - DNA, 20 bp, Homo sapiens
gtcccttgagacctcagcca

SEQ ID NO: 1084746 - DNA, 16 bp, Homo sapiens
gtcccttgatgcacag

SEQ ID NO: 1084747 - DNA, 17 bp, Homo sapiens
gtcccttgatgcacaga

SEQ ID NO: 1084748 - DNA, 22 bp, Homo sapiens
gtcccttgatgcacagagaagc

SEQ ID NO: 1084749 - DNA, 13 bp, Homo sapiens
gtcccttgcagct

SEQ ID NO: 1084750 - DNA, 19 bp, Homo sapiens
gtcccttgcctcaatgcca

SEQ ID NO: 1084751 - DNA, 19 bp, Homo sapiens
gtcccttgcttagcctgtg

SEQ ID NO: 1084752 - DNA, 13 bp, Homo sapiens
gtccctttcccta

SEQ ID NO: 1084753 - DNA, 17 bp, Homo sapiens
gtccctttccctacctt

SEQ ID NO: 1084754 - DNA, 15 bp, Homo sapiens
gtccctttcttggcc

SEQ ID NO: 1084755 - DNA, 13 bp, Homo sapiens
gtcccttttgcta

SEQ ID NO: 1084756 - DNA, 12 bp, Homo sapiens
gtccgagaggct

SEQ ID NO: 1084757 - DNA, 15 bp, Homo sapiens
gtccgatctttgact

SEQ ID NO: 1084758 - DNA, 16 bp, Homo sapiens
gtccgcaccagctgct

SEQ ID NO: 1084759 - DNA, 22 bp, Homo sapiens
gtccgcaccagctgctctgccc

SEQ ID NO: 1084760 - DNA, 20 bp, Homo sapiens
gtccgccatccagggtctgg

SEQ ID NO: 1084761 - DNA, 13 bp, Homo sapiens
gtccgcccatccc

SEQ ID NO: 1084762 - DNA, 15 bp, Homo sapiens
gtccgcccatccctg

SEQ ID NO: 1084763 - DNA, 21 bp, Homo sapiens
gtccgcctctgcccgcagagc

SEQ ID NO: 1084764 - DNA, 14 bp, Homo sapiens
gtccgcctgcgcct

SEQ ID NO: 1084765 - DNA, 12 bp, Homo sapiens
gtccgcggcctg

SEQ ID NO: 1084766 - DNA, 15 bp, Homo sapiens
gtccgcggcctgcac

SEQ ID NO: 1084767 - DNA, 22 bp, Homo sapiens
gtccgctgggtggtaccctctg

SEQ ID NO: 1084768 - DNA, 15 bp, Homo sapiens
gtccggaggcagcag

SEQ ID NO: 1084769 - DNA, 16 bp, Homo sapiens
gtccggcccagtgcca

SEQ ID NO: 1084770 - DNA, 19 bp, Homo sapiens
gtccggcccagtgccagct

SEQ ID NO: 1084771 - DNA, 13 bp, Homo sapiens
gtccggcgccccg

SEQ ID NO: 1084772 - DNA, 15 bp, Homo sapiens
gtccggcgccccgca

SEQ ID NO: 1084773 - DNA, 17 bp, Homo sapiens
gtccggtgtccttttca

SEQ ID NO: 1084774 - DNA, 17 bp, Homo sapiens
gtccgtccacccttcca

SEQ ID NO: 1084775 - DNA, 14 bp, Homo sapiens
gtccgtctgtctcg

SEQ ID NO: 1084776 - DNA, 17 bp, Homo sapiens
gtccgtgcccaggccct

SEQ ID NO: 1084777 - DNA, 22 bp, Homo sapiens
gtccgtgcccaggcccttggct

SEQ ID NO: 1084778 - DNA, 15 bp, Homo sapiens
gtccgtgctgacagc

SEQ ID NO: 1084779 - DNA, 21 bp, Homo sapiens
gtccgtgctgacagctgctcc

SEQ ID NO: 1084780 - DNA, 22 bp, Homo sapiens
gtccgtgctgacagctgctcct

SEQ ID NO: 1084781 - DNA, 19 bp, Homo sapiens
gtccgtgggacggtgccca

SEQ ID NO: 1084782 - DNA, 19 bp, Homo sapiens
gtccgtgggccgtatctgt

SEQ ID NO: 1084783 - DNA, 19 bp, Homo sapiens
gtccgttcacatgtgtggt

SEQ ID NO: 1084784 - DNA, 13 bp, Homo sapiens
gtcctaaaacacc

SEQ ID NO: 1084785 - DNA, 16 bp, Homo sapiens
gtcctaactggtatag

SEQ ID NO: 1084786 - DNA, 13 bp, Homo sapiens
gtcctaagcacct

SEQ ID NO: 1084787 - DNA, 15 bp, Homo sapiens
gtcctaaggaacctt

SEQ ID NO: 1084788 - DNA, 19 bp, Homo sapiens
gtcctaaggacacactaat

SEQ ID NO: 1084789 - DNA, 20 bp, Homo sapiens
gtcctacagtgactccctgg

SEQ ID NO: 1084790 - DNA, 18 bp, Homo sapiens
gtcctaccagttgcccta

SEQ ID NO: 1084791 - DNA, 14 bp, Homo sapiens
gtcctacccatccc

SEQ ID NO: 1084792 - DNA, 16 bp, Homo sapiens
gtcctacccatccccg

SEQ ID NO: 1084793 - DNA, 14 bp, Homo sapiens
gtcctacccgcccg

SEQ ID NO: 1084794 - DNA, 24 bp, Homo sapiens
gtcctacgtccaaggtggcagatg

SEQ ID NO: 1084795 - DNA, 23 bp, Homo sapiens
gtcctagaaattccccaccctga

SEQ ID NO: 1084796 - DNA, 18 bp, Homo sapiens
gtcctagaatgtttcatt

SEQ ID NO: 1084797 - DNA, 19 bp, Homo sapiens
gtcctagccactcaggagg

SEQ ID NO: 1084798 - DNA, 13 bp, Homo sapiens
gtcctagcccagt

SEQ ID NO: 1084799 - DNA, 16 bp, Homo sapiens
gtcctagcccttccct

SEQ ID NO: 1084800 - DNA, 20 bp, Homo sapiens
gtcctagcccttccctgagt

SEQ ID NO: 1084801 - DNA, 23 bp, Homo sapiens
gtcctagcttgggaggcttcccc

SEQ ID NO: 1084802 - DNA, 18 bp, Homo sapiens
gtcctatctatcttccaa

SEQ ID NO: 1084803 - DNA, 15 bp, Homo sapiens
gtcctatggaaaaaa

SEQ ID NO: 1084804 - DNA, 15 bp, Homo sapiens
gtcctatgtacagag

SEQ ID NO: 1084805 - DNA, 15 bp, Homo sapiens
gtcctcacaagcctc

SEQ ID NO: 1084806 - DNA, 20 bp, Homo sapiens
gtcctcaccctgtgggaccg

SEQ ID NO: 1084807 - DNA, 17 bp, Homo sapiens
gtcctgtcactgagcac

SEQ ID NO: 1084808 - DNA, 18 bp, Homo sapiens
gtcctgtccacacccagc

SEQ ID NO: 1084809 - DNA, 15 bp, Homo sapiens
gtcctgtcccagagg

SEQ ID NO: 1084810 - DNA, 16 bp, Homo sapiens
gtcctgtcccagaggt

SEQ ID NO: 1084811 - DNA, 14 bp, Homo sapiens
gtcctgtcctgctc

SEQ ID NO: 1084812 - DNA, 19 bp, Homo sapiens
gtcctgtgaatgccactgc

SEQ ID NO: 1084813 - DNA, 16 bp, Homo sapiens
gtcctgtgagatgtgt

SEQ ID NO: 1084814 - DNA, 23 bp, Homo sapiens
gtcctgtgatctgtgtacaattt

SEQ ID NO: 1084815 - DNA, 11 bp, Homo sapiens
gtcctgtgctt

SEQ ID NO: 1084816 - DNA, 18 bp, Homo sapiens
gtcctgtggatgggatcc

SEQ ID NO: 1084817 - DNA, 23 bp, Homo sapiens
gtcctgttaatttataggcgttt

SEQ ID NO: 1084818 - DNA, 18 bp, Homo sapiens
gtcctgttcaaatttttt

SEQ ID NO: 1084819 - DNA, 16 bp, Homo sapiens
gtcctgttgaagactt

SEQ ID NO: 1084820 - DNA, 16 bp, Homo sapiens
gtccttacctcgggga

SEQ ID NO: 1084821 - DNA, 18 bp, Homo sapiens
gtccttactcccccacca

SEQ ID NO: 1084822 - DNA, 18 bp, Homo sapiens
gtccttagactccttctc

SEQ ID NO: 1084823 - DNA, 17 bp, Homo sapiens
gtccttaggcctctgag

SEQ ID NO: 1084824 - DNA, 18 bp, Homo sapiens
gtccttaggcctctgaga

SEQ ID NO: 1084825 - DNA, 17 bp, Homo sapiens
gtccttattatcccagc

SEQ ID NO: 1084826 - DNA, 17 bp, Homo sapiens
gtccttattcttctcat

SEQ ID NO: 1084827 - DNA, 13 bp, Homo sapiens
gtccttcaaaggc

SEQ ID NO: 1084828 - DNA, 15 bp, Homo sapiens
gtccttcacctcact

SEQ ID NO: 1084829 - DNA, 14 bp, Homo sapiens
gtccttccaggccc

SEQ ID NO: 1084830 - DNA, 22 bp, Homo sapiens
gtccttccaggcccccaccact

SEQ ID NO: 1084831 - DNA, 11 bp, Homo sapiens
gtccttccctg

SEQ ID NO: 1084832 - DNA, 19 bp, Homo sapiens
gtccttccctgttctccct

SEQ ID NO: 1084833 - DNA, 20 bp, Homo sapiens
gtccttccctgttctccctt

SEQ ID NO: 1084834 - DNA, 15 bp, Homo sapiens
gtccttccttgactg

SEQ ID NO: 1084835 - DNA, 21 bp, Homo sapiens
gtccttctacagaacctgagg

SEQ ID NO: 1084836 - DNA, 23 bp, Homo sapiens
gtccttctacagaacctgagggc

SEQ ID NO: 1084837 - DNA, 11 bp, Homo sapiens
gtccttgaaaa

SEQ ID NO: 1084838 - DNA, 16 bp, Homo sapiens
gtccttgaaaaacaaa

SEQ ID NO: 1084839 - DNA, 18 bp, Homo sapiens
gtccttgaacccaacagt

SEQ ID NO: 1084840 - DNA, 19 bp, Homo sapiens
gtccttgaacccaacagtc

SEQ ID NO: 1084841 - DNA, 19 bp, Homo sapiens
gtccttgaactgaggccct

SEQ ID NO: 1084842 - DNA, 20 bp, Homo sapiens
gtccttgaactgaggccctg

SEQ ID NO: 1084843 - DNA, 19 bp, Homo sapiens
gtccttgagtgctcttgct

SEQ ID NO: 1084844 - DNA, 18 bp, Homo sapiens
gtccttgcacccctcact

SEQ ID NO: 1084845 - DNA, 15 bp, Homo sapiens
gtccttgcacctgca

SEQ ID NO: 1084846 - DNA, 18 bp, Homo sapiens
gtccttgcacctgcatcc

SEQ ID NO: 1084847 - DNA, 21 bp, Homo sapiens
gtctagccactccctcccaga

SEQ ID NO: 1084848 - DNA, 14 bp, Homo sapiens
gtctagggagagac

SEQ ID NO: 1084849 - DNA, 18 bp, Homo sapiens
gtctaggtctcctcaggg

SEQ ID NO: 1084850 - DNA, 16 bp, Homo sapiens
gtctaggttaaagcta

SEQ ID NO: 1084851 - DNA, 16 bp, Homo sapiens
gtctagtcattgtcat

SEQ ID NO: 1084852 - DNA, 16 bp, Homo sapiens
gtctataaaataaact

SEQ ID NO: 1084853 - DNA, 24 bp, Homo sapiens
gtctataaaataaacttcttaaca

SEQ ID NO: 1084854 - DNA, 19 bp, Homo sapiens
gtctataatggaaacattt

SEQ ID NO: 1084855 - DNA, 13 bp, Homo sapiens
gtctatatataca

SEQ ID NO: 1084856 - DNA, 21 bp, Homo sapiens
gtctatcaaccccagacactg

SEQ ID NO: 1084857 - DNA, 22 bp, Homo sapiens
gtctatctggtattaaatgcca

SEQ ID NO: 1084858 - DNA, 16 bp, Homo sapiens
gtctatgaagttgctg

SEQ ID NO: 1084859 - DNA, 15 bp, Homo sapiens
gtctatgcttaaaaa

SEQ ID NO: 1084860 - DNA, 23 bp, Homo sapiens
gtctatgtagctgaaaataaaat

SEQ ID NO: 1084861 - DNA, 13 bp, Homo sapiens
gtctattcagctt

SEQ ID NO: 1084862 - DNA, 21 bp, Homo sapiens
gtctattcattaagtaatctt

SEQ ID NO: 1084863 - DNA, 14 bp, Homo sapiens
gtctattctgagcc

SEQ ID NO: 1084864 - DNA, 15 bp, Homo sapiens
gtctattctgagcct

SEQ ID NO: 1084865 - DNA, 12 bp, Homo sapiens
gtctatttaagc

SEQ ID NO: 1084866 - DNA, 21 bp, Homo sapiens
gtctatttccactgaacaaaa

SEQ ID NO: 1084867 - DNA, 15 bp, Homo sapiens
gtctattttaaaata

SEQ ID NO: 1084868 - DNA, 18 bp, Homo sapiens
gtctattttgtatatttg

SEQ ID NO: 1084869 - DNA, 13 bp, Homo sapiens
gtctattttttta

SEQ ID NO: 1084870 - DNA, 22 bp, Homo sapiens
gtctatttttttaactgaaaat

SEQ ID NO: 1084871 - DNA, 18 bp, Homo sapiens
gtctcaaaataaagcaat

SEQ ID NO: 1084872 - DNA, 20 bp, Homo sapiens
gtctcaaactcctgacctca

SEQ ID NO: 1084873 - DNA, 16 bp, Homo sapiens
gtctcaaactcctggg

SEQ ID NO: 1084874 - DNA, 15 bp, Homo sapiens
gtctcaagagggcac

SEQ ID NO: 1084875 - DNA, 17 bp, Homo sapiens
gtctcaagagggcactg

SEQ ID NO: 1084876 - DNA, 22 bp, Homo sapiens
gtctcaagagggcactggtggc

SEQ ID NO: 1084877 - DNA, 19 bp, Homo sapiens
gtctcaagggctagcatcc

SEQ ID NO: 1084878 - DNA, 14 bp, Homo sapiens
gtctcaagggtggc

SEQ ID NO: 1084879 - DNA, 20 bp, Homo sapiens
gtctcaagggtggcaggtca

SEQ ID NO: 1084880 - DNA, 23 bp, Homo sapiens
gtctcctttgcactgagggccac

SEQ ID NO: 1084881 - DNA, 15 bp, Homo sapiens
gtctcgaactcctga

SEQ ID NO: 1084882 - DNA, 17 bp, Homo sapiens
gtctcgaactcctgacc

SEQ ID NO: 1084883 - DNA, 22 bp, Homo sapiens
gtctcgaactcctgacctcaag

SEQ ID NO: 1084884 - DNA, 15 bp, Homo sapiens
gtctcgaatgtaatt

SEQ ID NO: 1084885 - DNA, 16 bp, Homo sapiens
gtctcgaatgtaattg

SEQ ID NO: 1084886 - DNA, 13 bp, Homo sapiens
gtctcgcagcctg

SEQ ID NO: 1084887 - DNA, 16 bp, Homo sapiens
gtctcgcagcctgaag

SEQ ID NO: 1084888 - DNA, 19 bp, Homo sapiens
gtctcgcagcctgaagcct

SEQ ID NO: 1084889 - DNA, 16 bp, Homo sapiens
gtctcgcgcgactgag

SEQ ID NO: 1084890 - DNA, 18 bp, Homo sapiens
gtctcgcgcgactgagaa

SEQ ID NO: 1084891 - DNA, 21 bp, Homo sapiens
gtctcggatgacaccctggcc

SEQ ID NO: 1084892 - DNA, 16 bp, Homo sapiens
gtctcggccctgaacc

SEQ ID NO: 1084893 - DNA, 15 bp, Homo sapiens
gtctcggccttcaca

SEQ ID NO: 1084894 - DNA, 19 bp, Homo sapiens
gtctcgtgtacagctccct

SEQ ID NO: 1084895 - DNA, 22 bp, Homo sapiens
gtctctaagccaactttaattg

SEQ ID NO: 1084896 - DNA, 18 bp, Homo sapiens
gtctctactaaaaataag

SEQ ID NO: 1084897 - DNA, 12 bp, Homo sapiens
gtctctagagca

SEQ ID NO: 1084898 - DNA, 16 bp, Homo sapiens
gtctctagctgttctg

SEQ ID NO: 1084899 - DNA, 14 bp, Homo sapiens
gtctctagtgctgt

SEQ ID NO: 1084900 - DNA, 18 bp, Homo sapiens
gtctctatattatgtctt

SEQ ID NO: 1084901 - DNA, 14 bp, Homo sapiens
gtctctcccacccc

SEQ ID NO: 1084902 - DNA, 18 bp, Homo sapiens
gtctctccccctctgtct

SEQ ID NO: 1084903 - DNA, 22 bp, Homo sapiens
gtctctccccctctgtcttctc

SEQ ID NO: 1084904 - DNA, 23 bp, Homo sapiens
gtctctccccggtaatgtcactg

SEQ ID NO: 1084905 - DNA, 18 bp, Homo sapiens
gtctctctccctacctcc

SEQ ID NO: 1084906 - DNA, 21 bp, Homo sapiens
gtctctctccctacctccctc

SEQ ID NO: 1084907 - DNA, 22 bp, Homo sapiens
gtctctctgccaagatccatct

SEQ ID NO: 1084908 - DNA, 11 bp, Homo sapiens
gtctctctgtg

SEQ ID NO: 1084909 - DNA, 16 bp, Homo sapiens
gtctctctgtgaatac

SEQ ID NO: 1084910 - DNA, 18 bp, Homo sapiens
gtctctctgtgaatacaa

SEQ ID NO: 1084911 - DNA, 22 bp, Homo sapiens
gtctctctgtgaatacaattaa

SEQ ID NO: 1084912 - DNA, 13 bp, Homo sapiens
gtctctgagtcct

SEQ ID NO: 1084913 - DNA, 17 bp, Homo sapiens
gtctctgagtcctttgc

SEQ ID NO: 1084914 - DNA, 23 bp, Homo sapiens
gtctctgatacacagtaattgtg

SEQ ID NO: 1084915 - DNA, 16 bp, Homo sapiens
gtctctgccacccact

SEQ ID NO: 1084916 - DNA, 21 bp, Homo sapiens
gtctctgccacccactcagga

SEQ ID NO: 1084917 - DNA, 23 bp, Homo sapiens
gtctctgccctgcctacttttag

SEQ ID NO: 1084918 - DNA, 18 bp, Homo sapiens
gtctctgcctccctcacc

SEQ ID NO: 1084919 - DNA, 15 bp, Homo sapiens
gtctctgctcgccct

SEQ ID NO: 1084920 - DNA, 23 bp, Homo sapiens
gtctctgctcgccctcctttctg

SEQ ID NO: 1084921 - DNA, 20 bp, Homo sapiens
gtctctgctggcccagccaa

SEQ ID NO: 1084922 - DNA, 12 bp, Homo sapiens
gtctctgctggg

SEQ ID NO: 1084923 - DNA, 12 bp, Homo sapiens
gtctctgcttcc

SEQ ID NO: 1084924 - DNA, 14 bp, Homo sapiens
gtctctgcttccat

SEQ ID NO: 1084925 - DNA, 17 bp, Homo sapiens
gtctctgcttccatggc

SEQ ID NO: 1084926 - DNA, 12 bp, Homo sapiens
gtctctgctttc

SEQ ID NO: 1084927 - DNA, 21 bp, Homo sapiens
gtctctgctttccttttctct

SEQ ID NO: 1084928 - DNA, 20 bp, Homo sapiens
gtctctgggccacttggagt

SEQ ID NO: 1084929 - DNA, 10 bp, Homo sapiens
gtctctgggg

SEQ ID NO: 1084930 - DNA, 17 bp, Homo sapiens
gtctctggtagcctgca

SEQ ID NO: 1084931 - DNA, 12 bp, Homo sapiens
gtctctgtcctc

SEQ ID NO: 1084932 - DNA, 22 bp, Homo sapiens
gtctctgtctctcctagcccct

SEQ ID NO: 1084933 - DNA, 19 bp, Homo sapiens
gtctctgtgtttgaagttt

SEQ ID NO: 1084934 - DNA, 21 bp, Homo sapiens
gtctctgttaacatctagcct

SEQ ID NO: 1084935 - DNA, 19 bp, Homo sapiens
gtctctgttggtccactgt

SEQ ID NO: 1084936 - DNA, 13 bp, Homo sapiens
gtctctgtttcct

SEQ ID NO: 1084937 - DNA, 18 bp, Homo sapiens
gtctctgtttcctgaaat

SEQ ID NO: 1084938 - DNA, 20 bp, Homo sapiens
gtctctgtttcctgaaatat

SEQ ID NO: 1084939 - DNA, 15 bp, Homo sapiens
gtctcttacatgtag

SEQ ID NO: 1084940 - DNA, 18 bp, Homo sapiens
gtctcttccacaggaagt

SEQ ID NO: 1084941 - DNA, 23 bp, Homo sapiens
gtctcttcctctgttctatccca

SEQ ID NO: 1084942 - DNA, 17 bp, Homo sapiens
gtctcttctcccagaat

SEQ ID NO: 1084943 - DNA, 14 bp, Homo sapiens
gtctcttctgagct

SEQ ID NO: 1084944 - DNA, 15 bp, Homo sapiens
gtctcttgagcatca

SEQ ID NO: 1084945 - DNA, 20 bp, Homo sapiens
gtctcttgagcatcaatctt

SEQ ID NO: 1084946 - DNA, 13 bp, Homo sapiens
gtctcttgaggga

SEQ ID NO: 1084947 - DNA, 22 bp, Homo sapiens
gtctctttaaaaggaaagaaaa

SEQ ID NO: 1084948 - DNA, 17 bp, Homo sapiens
gtctctttaatcttcag

SEQ ID NO: 1084949 - DNA, 17 bp, Homo sapiens
gtctctttccactttgt

SEQ ID NO: 1084950 - DNA, 19 bp, Homo sapiens
gtctctttcttcctttcta

SEQ ID NO: 1084951 - DNA, 17 bp, Homo sapiens
gtctgaaacatttcata

SEQ ID NO: 1084952 - DNA, 11 bp, Homo sapiens
gtctgaaatgg

SEQ ID NO: 1084953 - DNA, 17 bp, Homo sapiens
gtctgaagctcgcatcc

SEQ ID NO: 1084954 - DNA, 22 bp, Homo sapiens
gtctgaagctcgcatccagaca

SEQ ID NO: 1084955 - DNA, 21 bp, Homo sapiens
gtctgaaggaatagccagaga

SEQ ID NO: 1084956 - DNA, 19 bp, Homo sapiens
gtctgaaggacacttcctg

SEQ ID NO: 1084957 - DNA, 17 bp, Homo sapiens
gtctgaagtcactgcac

SEQ ID NO: 1084958 - DNA, 22 bp, Homo sapiens
gtctgaagtgcctactgggggg

SEQ ID NO: 1084959 - DNA, 16 bp, Homo sapiens
gtctgaagtggttgtt

SEQ ID NO: 1084960 - DNA, 13 bp, Homo sapiens
gtctgaatgttct

SEQ ID NO: 1084961 - DNA, 15 bp, Homo sapiens
gtctgaatgttctga

SEQ ID NO: 1084962 - DNA, 24 bp, Homo sapiens
gtctgacatcagaggtatcttact

SEQ ID NO: 1084963 - DNA, 23 bp, Homo sapiens
gtctgaccccagtggaaaacaaa

SEQ ID NO: 1084964 - DNA, 14 bp, Homo sapiens
gtctgaccctctgc

SEQ ID NO: 1084965 - DNA, 19 bp, Homo sapiens
gtctgaccctctgcggcca

SEQ ID NO: 1084966 - DNA, 13 bp, Homo sapiens
gtctgactccaga

SEQ ID NO: 1084967 - DNA, 16 bp, Homo sapiens
gtctgccctgcccata

SEQ ID NO: 1084968 - DNA, 17 bp, Homo sapiens
gtctgccgcccacctcg

SEQ ID NO: 1084969 - DNA, 11 bp, Homo sapiens
gtctgcctctt

SEQ ID NO: 1084970 - DNA, 11 bp, Homo sapiens
gtctgcctgta

SEQ ID NO: 1084971 - DNA, 13 bp, Homo sapiens
gtctgccttcaca

SEQ ID NO: 1084972 - DNA, 18 bp, Homo sapiens
gtctgccttcacaaatgt

SEQ ID NO: 1084973 - DNA, 12 bp, Homo sapiens
gtctgctctggt

SEQ ID NO: 1084974 - DNA, 17 bp, Homo sapiens
gtctgctctttctctgc

SEQ ID NO: 1084975 - DNA, 17 bp, Homo sapiens
gtctgctgaataataaa

SEQ ID NO: 1084976 - DNA, 15 bp, Homo sapiens
gtctgctgccctcca

SEQ ID NO: 1084977 - DNA, 18 bp, Homo sapiens
gtctgctgccctccatcc

SEQ ID NO: 1084978 - DNA, 19 bp, Homo sapiens
gtctgctgccctccatccc

SEQ ID NO: 1084979 - DNA, 12 bp, Homo sapiens
gtctgcttagaa

SEQ ID NO: 1084980 - DNA, 19 bp, Homo sapiens
gtctgcttctgtccaggac

SEQ ID NO: 1084981 - DNA, 23 bp, Homo sapiens
gtctgcttctgtccaggacatga

SEQ ID NO: 1084982 - DNA, 12 bp, Homo sapiens
gtctggaaacag

SEQ ID NO: 1084983 - DNA, 14 bp, Homo sapiens
gtctggaagtccaa

SEQ ID NO: 1084984 - DNA, 23 bp, Homo sapiens
gtctggacctccatccctgctct

SEQ ID NO: 1084985 - DNA, 14 bp, Homo sapiens
gtctggactgacag

SEQ ID NO: 1084986 - DNA, 15 bp, Homo sapiens
gtctggactgacagc

SEQ ID NO: 1084987 - DNA, 19 bp, Homo sapiens
gtctggagaagcagtgagc

SEQ ID NO: 1084988 - DNA, 16 bp, Homo sapiens
gtctggagtcccaccc

SEQ ID NO: 1084989 - DNA, 17 bp, Homo sapiens
gtctggagtcccacccg

SEQ ID NO: 1084990 - DNA, 18 bp, Homo sapiens
gtctggagtcccacccgg

SEQ ID NO: 1084991 - DNA, 21 bp, Homo sapiens
gtctggagtcccacccggaca

SEQ ID NO: 1084992 - DNA, 22 bp, Homo sapiens
gtctggagtcccacccggacag

SEQ ID NO: 1084993 - DNA, 12 bp, Homo sapiens
gtctggatgcac

SEQ ID NO: 1084994 - DNA, 21 bp, Homo sapiens
gtctggatgggaggagagcca

SEQ ID NO: 1084995 - DNA, 22 bp, Homo sapiens
gtctggatgggaggagagccac

SEQ ID NO: 1084996 - DNA, 23 bp, Homo sapiens
gtctggatgggaggagagccact

SEQ ID NO: 1084997 - DNA, 17 bp, Homo sapiens
gtctggcagagcctctg

SEQ ID NO: 1084998 - DNA, 18 bp, Homo sapiens
gtctggcagagcctctga

SEQ ID NO: 1084999 - DNA, 17 bp, Homo sapiens
gtctggccactgtcaag

SEQ ID NO: 1085000 - DNA, 19 bp, Homo sapiens
gtctggcgttctcaagaat

SEQ ID NO: 1085001 - DNA, 17 bp, Homo sapiens
gtctggctccctgcccc

SEQ ID NO: 1085002 - DNA, 18 bp, Homo sapiens
gtctggctccctgcccct

SEQ ID NO: 1085003 - DNA, 12 bp, Homo sapiens
gtctggctgtgt

SEQ ID NO: 1085004 - DNA, 18 bp, Homo sapiens
gtctgggacttccttgct

SEQ ID NO: 1085005 - DNA, 20 bp, Homo sapiens
gtctgggacttccttgctct

SEQ ID NO: 1085006 - DNA, 16 bp, Homo sapiens
gtctgggagaaattga

SEQ ID NO: 1085007 - DNA, 19 bp, Homo sapiens
gtctgggagagcctggcaa

SEQ ID NO: 1085008 - DNA, 20 bp, Homo sapiens
gtctgggagagcctggcaag

SEQ ID NO: 1085009 - DNA, 16 bp, Homo sapiens
gtctgggagggggtga

SEQ ID NO: 1085010 - DNA, 17 bp, Homo sapiens
gtctgggagggggtgag

SEQ ID NO: 1085011 - DNA, 21 bp, Homo sapiens
gtctgggatatggctgcccag

SEQ ID NO: 1085012 - DNA, 13 bp, Homo sapiens
gtctgggatggac

SEQ ID NO: 1085013 - DNA, 19 bp, Homo sapiens
gtctgggatgtagaacttc

SEQ ID NO: 1085014 - DNA, 12 bp, Homo sapiens
gtctgggcaagt

SEQ ID NO: 1085015 - DNA, 19 bp, Homo sapiens
gtctgggcaagtagcagga

SEQ ID NO: 1085016 - DNA, 18 bp, Homo sapiens
gtctgggcagtgccacag

SEQ ID NO: 1085017 - DNA, 11 bp, Homo sapiens
gtctgggcctc

SEQ ID NO: 1085018 - DNA, 22 bp, Homo sapiens
gtctggggaagaggatgagcag

SEQ ID NO: 1085019 - DNA, 19 bp, Homo sapiens
gtctgggggcagctgtcct

SEQ ID NO: 1085020 - DNA, 21 bp, Homo sapiens
gtctgggggcagctgtcctga

SEQ ID NO: 1085021 - DNA, 16 bp, Homo sapiens
gtctggggttcagccc

SEQ ID NO: 1085022 - DNA, 17 bp, Homo sapiens
gtctggggttcagcccc

SEQ ID NO: 1085023 - DNA, 20 bp, Homo sapiens
gtctggggttcagcccctcc

SEQ ID NO: 1085024 - DNA, 16 bp, Homo sapiens
gtctgggtgtccgcca

SEQ ID NO: 1085025 - DNA, 20 bp, Homo sapiens
gtctgggtgtccgccatcca

SEQ ID NO: 1085026 - DNA, 16 bp, Homo sapiens
gtctgggtttggccca

SEQ ID NO: 1085027 - DNA, 18 bp, Homo sapiens
gtctggtgaggtggccca

SEQ ID NO: 1085028 - DNA, 15 bp, Homo sapiens
gtctggtggaggagc

SEQ ID NO: 1085029 - DNA, 13 bp, Homo sapiens
gtctggtggcccc

SEQ ID NO: 1085030 - DNA, 18 bp, Homo sapiens
gtctggttttaacaattt

SEQ ID NO: 1085031 - DNA, 21 bp, Homo sapiens
gtctggttttaacaatttcct

SEQ ID NO: 1085032 - DNA, 15 bp, Homo sapiens
gtctgtaactgccca

SEQ ID NO: 1085033 - DNA, 16 bp, Homo sapiens
gtctgtaactgcccag

SEQ ID NO: 1085034 - DNA, 21 bp, Homo sapiens
gtctgtaactgcccagcccct

SEQ ID NO: 1085035 - DNA, 14 bp, Homo sapiens
gtctgtaatcatgt

SEQ ID NO: 1085036 - DNA, 18 bp, Homo sapiens
gtctgtaatgacaaataa

SEQ ID NO: 1085037 - DNA, 13 bp, Homo sapiens
gtctgtacatact

SEQ ID NO: 1085038 - DNA, 19 bp, Homo sapiens
gtctgtacatactggcctc

SEQ ID NO: 1085039 - DNA, 20 bp, Homo sapiens
gtctgtacatactggcctct

SEQ ID NO: 1085040 - DNA, 15 bp, Homo sapiens
gtctgtaggtgtctc

SEQ ID NO: 1085041 - DNA, 18 bp, Homo sapiens
gtctgtaggtgtctctgg

SEQ ID NO: 1085042 - DNA, 19 bp, Homo sapiens
gtctgtaggtgtctctggg

SEQ ID NO: 1085043 - DNA, 18 bp, Homo sapiens
gtctgtatactcctgtca

SEQ ID NO: 1085044 - DNA, 23 bp, Homo sapiens
gtcttaagccttttgctcacaaa

SEQ ID NO: 1085045 - DNA, 14 bp, Homo sapiens
gtcttaatgttgaa

SEQ ID NO: 1085046 - DNA, 15 bp, Homo sapiens
gtcttaatgttgaat

SEQ ID NO: 1085047 - DNA, 13 bp, Homo sapiens
gtcttaattatta

SEQ ID NO: 1085048 - DNA, 18 bp, Homo sapiens
gtcttaattattatttgt

SEQ ID NO: 1085049 - DNA, 19 bp, Homo sapiens
gtcttaatttatttcttaa

SEQ ID NO: 1085050 - DNA, 15 bp, Homo sapiens
gtcttacctctctgg

SEQ ID NO: 1085051 - DNA, 20 bp, Homo sapiens
gtcttacctctctgggacct

SEQ ID NO: 1085052 - DNA, 23 bp, Homo sapiens
gtcttagaagtggaccaggacag

SEQ ID NO: 1085053 - DNA, 18 bp, Homo sapiens
gtcttagacttgaaatac

SEQ ID NO: 1085054 - DNA, 18 bp, Homo sapiens
gtcttaggatgtctgtaa

SEQ ID NO: 1085055 - DNA, 18 bp, Homo sapiens
gtcttatgattttattac

SEQ ID NO: 1085056 - DNA, 16 bp, Homo sapiens
gtcttatggtcttgat

SEQ ID NO: 1085057 - DNA, 14 bp, Homo sapiens
gtcttattcttaag

SEQ ID NO: 1085058 - DNA, 14 bp, Homo sapiens
gtcttatttattat

SEQ ID NO: 1085059 - DNA, 17 bp, Homo sapiens
gtcttcaaactgtgaag

SEQ ID NO: 1085060 - DNA, 14 bp, Homo sapiens
gtcttcaatctctg

SEQ ID NO: 1085061 - DNA, 12 bp, Homo sapiens
gtcttcacttaa

SEQ ID NO: 1085062 - DNA, 20 bp, Homo sapiens
gtcttcactttcctcagttg

SEQ ID NO: 1085063 - DNA, 15 bp, Homo sapiens
gtcttcagacccaga

SEQ ID NO: 1085064 - DNA, 16 bp, Homo sapiens
gtcttcagacccagag

SEQ ID NO: 1085065 - DNA, 19 bp, Homo sapiens
gtcttcagacccagagaag

SEQ ID NO: 1085066 - DNA, 14 bp, Homo sapiens
gtcttcagcctccc

SEQ ID NO: 1085067 - DNA, 17 bp, Homo sapiens
gtcttcagcctccctca

SEQ ID NO: 1085068 - DNA, 16 bp, Homo sapiens
gtcttcatctccctgc

SEQ ID NO: 1085069 - DNA, 20 bp, Homo sapiens
gtcttcatctccctgccatc

SEQ ID NO: 1085070 - DNA, 21 bp, Homo sapiens
gtcttcatctccctgccatcc

SEQ ID NO: 1085071 - DNA, 17 bp, Homo sapiens
gtcttcatttcattgta

SEQ ID NO: 1085072 - DNA, 13 bp, Homo sapiens
gtcttccataatg

SEQ ID NO: 1085073 - DNA, 15 bp, Homo sapiens
gtcttcccctgagag

SEQ ID NO: 1085074 - DNA, 22 bp, Homo sapiens
gtcttcccctgagagtttcctc

SEQ ID NO: 1085075 - DNA, 18 bp, Homo sapiens
gtcttcccgcaaggcctc

SEQ ID NO: 1085076 - DNA, 16 bp, Homo sapiens
gtcttccctacctcag

SEQ ID NO: 1085077 - DNA, 21 bp, Homo sapiens
gtcttccctacctcaggcagg

SEQ ID NO: 1085078 - DNA, 12 bp, Homo sapiens
gtcttccctcag

SEQ ID NO: 1085079 - DNA, 11 bp, Homo sapiens
gtcttccctgg

SEQ ID NO: 1085080 - DNA, 14 bp, Homo sapiens
gtcttccctgggct

SEQ ID NO: 1085081 - DNA, 16 bp, Homo sapiens
gtcttccctgggctgc

SEQ ID NO: 1085082 - DNA, 23 bp, Homo sapiens
gtcttccgcccctgcctgccatg

SEQ ID NO: 1085083 - DNA, 19 bp, Homo sapiens
gtcttccggggccatgggc

SEQ ID NO: 1085084 - DNA, 15 bp, Homo sapiens
gtcttccgtctcccc

SEQ ID NO: 1085085 - DNA, 18 bp, Homo sapiens
gtcttcctgaaatgcagt

SEQ ID NO: 1085086 - DNA, 18 bp, Homo sapiens
gtcttcctgacactttaa

SEQ ID NO: 1085087 - DNA, 18 bp, Homo sapiens
gtcttccttctaccccaa

SEQ ID NO: 1085088 - DNA, 18 bp, Homo sapiens
gtcttccttgtctctgct

SEQ ID NO: 1085089 - DNA, 15 bp, Homo sapiens
gtcttctaatttcaa

SEQ ID NO: 1085090 - DNA, 23 bp, Homo sapiens
gtcttctaatttcaaaaatataa

SEQ ID NO: 1085091 - DNA, 16 bp, Homo sapiens
gtcttctcatagcatt

SEQ ID NO: 1085092 - DNA, 19 bp, Homo sapiens
gtcttctcatagcattaac

SEQ ID NO: 1085093 - DNA, 20 bp, Homo sapiens
gtcttctcatagcattaact

SEQ ID NO: 1085094 - DNA, 13 bp, Homo sapiens
gtcttctctatcc

SEQ ID NO: 1085095 - DNA, 17 bp, Homo sapiens
gtcttctctatcctctc

SEQ ID NO: 1085096 - DNA, 13 bp, Homo sapiens
gtcttctgcctgt

SEQ ID NO: 1085097 - DNA, 23 bp, Homo sapiens
gtcttctggacaggctctgcttc

SEQ ID NO: 1085098 - DNA, 17 bp, Homo sapiens
gtcttctggttttctag

SEQ ID NO: 1085099 - DNA, 21 bp, Homo sapiens
gtcttctgtaattcattgagc

SEQ ID NO: 1085100 - DNA, 12 bp, Homo sapiens
gtcttctgttcc

SEQ ID NO: 1085101 - DNA, 15 bp, Homo sapiens
gtcttcttggcagct

SEQ ID NO: 1085102 - DNA, 16 bp, Homo sapiens
gtcttcttgtgtcctg

SEQ ID NO: 1085103 - DNA, 23 bp, Homo sapiens
gtcttgagaggagacttgtgaat

SEQ ID NO: 1085104 - DNA, 17 bp, Homo sapiens
gtcttgaggggaagctg

SEQ ID NO: 1085105 - DNA, 12 bp, Homo sapiens
gtcttgccccag

SEQ ID NO: 1085106 - DNA, 14 bp, Homo sapiens
gtcttttgcttttg

SEQ ID NO: 1085107 - DNA, 22 bp, Homo sapiens
gtcttttgcttttgcccatttt

SEQ ID NO: 1085108 - DNA, 15 bp, Homo sapiens
gtcttttgttcgcat

SEQ ID NO: 1085109 - DNA, 16 bp, Homo sapiens
gtctttttctcttctg

SEQ ID NO: 1085110 - DNA, 16 bp, Homo sapiens
gtctttttctggactg

SEQ ID NO: 1085111 - DNA, 17 bp, Homo sapiens
gtctttttttgtattat

SEQ ID NO: 1085112 - DNA, 14 bp, Homo sapiens
gtcttttttttcct

SEQ ID NO: 1085113 - DNA, 19 bp, Homo sapiens
gtcttttttttttccaaat

SEQ ID NO: 1085114 - DNA, 14 bp, Homo sapiens
gtgaaaaaaaaaat

SEQ ID NO: 1085115 - DNA, 18 bp, Homo sapiens
gtgaaaaaaaaaatgctg

SEQ ID NO: 1085116 - DNA, 15 bp, Homo sapiens
gtgaaaaaaagaaac

SEQ ID NO: 1085117 - DNA, 12 bp, Homo sapiens
gtgaaaaaggaa

SEQ ID NO: 1085118 - DNA, 11 bp, Homo sapiens
gtgaaaaatgt

SEQ ID NO: 1085119 - DNA, 14 bp, Homo sapiens
gtgaaaagaaaaat

SEQ ID NO: 1085120 - DNA, 19 bp, Homo sapiens
gtgaaaagtccttgattgt

SEQ ID NO: 1085121 - DNA, 15 bp, Homo sapiens
gtgaaaatagtgtaa

SEQ ID NO: 1085122 - DNA, 14 bp, Homo sapiens
gtgaaaatgtactg

SEQ ID NO: 1085123 - DNA, 17 bp, Homo sapiens
gtgaaaatgttttacat

SEQ ID NO: 1085124 - DNA, 18 bp, Homo sapiens
gtgaaacacaccaggctg

SEQ ID NO: 1085125 - DNA, 20 bp, Homo sapiens
gtgaaacacaccaggctgtg

SEQ ID NO: 1085126 - DNA, 21 bp, Homo sapiens
gtgaaacacaccaggctgtgg

SEQ ID NO: 1085127 - DNA, 23 bp, Homo sapiens
gtgaaacacaccaggctgtgggc

SEQ ID NO: 1085128 - DNA, 17 bp, Homo sapiens
gtgaaacagagaaagaa

SEQ ID NO: 1085129 - DNA, 18 bp, Homo sapiens
gtgaaacagttgctgtga

SEQ ID NO: 1085130 - DNA, 12 bp, Homo sapiens
gtgaaaccctgt

SEQ ID NO: 1085131 - DNA, 13 bp, Homo sapiens
gtgaaacgactca

SEQ ID NO: 1085132 - DNA, 15 bp, Homo sapiens
gtgaaacgactcaaa

SEQ ID NO: 1085133 - DNA, 12 bp, Homo sapiens
gtgaaactggat

SEQ ID NO: 1085134 - DNA, 21 bp, Homo sapiens
gtgaaacttttctagaattat

SEQ ID NO: 1085135 - DNA, 19 bp, Homo sapiens
gtgaaaggatatgaatctg

SEQ ID NO: 1085136 - DNA, 13 bp, Homo sapiens
gtgaaagggtact

SEQ ID NO: 1085137 - DNA, 13 bp, Homo sapiens
gtgaaataataaa

SEQ ID NO: 1085138 - DNA, 15 bp, Homo sapiens
gtgaaataataaaat

SEQ ID NO: 1085139 - DNA, 15 bp, Homo sapiens
gtgaaatggatacta

SEQ ID NO: 1085140 - DNA, 13 bp, Homo sapiens
gtgaaatggccac

SEQ ID NO: 1085141 - DNA, 13 bp, Homo sapiens
gtgaaatgtaaca

SEQ ID NO: 1085142 - DNA, 18 bp, Homo sapiens
gtgaaatttgcctctgtc

SEQ ID NO: 1085143 - DNA, 13 bp, Homo sapiens
gtgaaattttcag

SEQ ID NO: 1085144 - DNA, 20 bp, Homo sapiens
gtgaaattttggtgaatgtg

SEQ ID NO: 1085145 - DNA, 18 bp, Homo sapiens
gtgaacaaaagatgctct

SEQ ID NO: 1085146 - DNA, 18 bp, Homo sapiens
gtgaacaaagcagccacg

SEQ ID NO: 1085147 - DNA, 17 bp, Homo sapiens
gtgaacagagagaccct

SEQ ID NO: 1085148 - DNA, 15 bp, Homo sapiens
gtgaacagcttgctg

SEQ ID NO: 1085149 - DNA, 24 bp, Homo sapiens
gtgaacatcccttattagttacaa

SEQ ID NO: 1085150 - DNA, 15 bp, Homo sapiens
gtgaacattcccagc

SEQ ID NO: 1085151 - DNA, 22 bp, Homo sapiens
gtgaaccaaagagactggagca

SEQ ID NO: 1085152 - DNA, 23 bp, Homo sapiens
gtgaaccaaagagactggagcat

SEQ ID NO: 1085153 - DNA, 14 bp, Homo sapiens
gtgaaccaatgcaa

SEQ ID NO: 1085154 - DNA, 15 bp, Homo sapiens
gtgaaccaatgcaag

SEQ ID NO: 1085155 - DNA, 17 bp, Homo sapiens
gtgaaccagagggtgtg

SEQ ID NO: 1085156 - DNA, 21 bp, Homo sapiens
gtgaaccatctcagaccttta

SEQ ID NO: 1085157 - DNA, 21 bp, Homo sapiens
gtgaaccctggggcctgactg

SEQ ID NO: 1085158 - DNA, 16 bp, Homo sapiens
gtgaaccgtcctttca

SEQ ID NO: 1085159 - DNA, 14 bp, Homo sapiens
gtgaacgatttaga

SEQ ID NO: 1085160 - DNA, 17 bp, Homo sapiens
gtgaacgctgtgatgct

SEQ ID NO: 1085161 - DNA, 20 bp, Homo sapiens
gtgaacgctgtgatgctgtg

SEQ ID NO: 1085162 - DNA, 21 bp, Homo sapiens
gtgaacgtccacatgaaacct

SEQ ID NO: 1085163 - DNA, 23 bp, Homo sapiens
gtgaactcaccctgggagccagt

SEQ ID NO: 1085164 - DNA, 13 bp, Homo sapiens
gtgaactcctgcc

SEQ ID NO: 1085165 - DNA, 13 bp, Homo sapiens
gtgaactgacagg

SEQ ID NO: 1085166 - DNA, 20 bp, Homo sapiens
gtgaactgcaaagctttggc

SEQ ID NO: 1085167 - DNA, 17 bp, Homo sapiens
gtgaacttgactgggtg

SEQ ID NO: 1085168 - DNA, 15 bp, Homo sapiens
gtgaactttattaaa

SEQ ID NO: 1085169 - DNA, 16 bp, Homo sapiens
gtgaacttttgtaatt

SEQ ID NO: 1085170 - DNA, 19 bp, Homo sapiens
gtgaacttttgtaatttga

SEQ ID NO: 1085171 - DNA, 20 bp, Homo sapiens
gtgaagaaagccagacaact

SEQ ID NO: 1085172 - DNA, 12 bp, Homo sapiens
gtgaagaaataa

SEQ ID NO: 1085173 - DNA, 20 bp, Homo sapiens
gtgaagaaataaatgaaact

SEQ ID NO: 1085174 - DNA, 23 bp, Homo sapiens
gtgaagaatgcacaagaatggat

SEQ ID NO: 1085175 - DNA, 15 bp, Homo sapiens
gtgaagacagaaacc

SEQ ID NO: 1085176 - DNA, 13 bp, Homo sapiens
gtgaagacatttt

SEQ ID NO: 1085177 - DNA, 12 bp, Homo sapiens
gtgaagaggctg

SEQ ID NO: 1085178 - DNA, 17 bp, Homo sapiens
gtgaagaggggcagccc

SEQ ID NO: 1085179 - DNA, 18 bp, Homo sapiens
gtgaagataatttgcata

SEQ ID NO: 1085180 - DNA, 22 bp, Homo sapiens
gtgaagcagtgcctcgaggcac

SEQ ID NO: 1085181 - DNA, 20 bp, Homo sapiens
gtgaagccaattcagacagg

SEQ ID NO: 1085182 - DNA, 11 bp, Homo sapiens
gtgaagctaat

SEQ ID NO: 1085183 - DNA, 16 bp, Homo sapiens
gtgaagctcacactga

SEQ ID NO: 1085184 - DNA, 15 bp, Homo sapiens
gtgaaggaatatatg

SEQ ID NO: 1085185 - DNA, 14 bp, Homo sapiens
gtgaaggagaagtc

SEQ ID NO: 1085186 - DNA, 18 bp, Homo sapiens
gtgaaggatccaggaata

SEQ ID NO: 1085187 - DNA, 23 bp, Homo sapiens
gtgaaggcccaagagcagagtct

SEQ ID NO: 1085188 - DNA, 15 bp, Homo sapiens
gtgaaggcttcactc

SEQ ID NO: 1085189 - DNA, 22 bp, Homo sapiens
gtgaaggcttctctctgtggga

SEQ ID NO: 1085190 - DNA, 18 bp, Homo sapiens
gtgaagggatgggggaag

SEQ ID NO: 1085191 - DNA, 20 bp, Homo sapiens
gtgaaggtcctgctattact

SEQ ID NO: 1085192 - DNA, 17 bp, Homo sapiens
gtgaaggtgacagcagt

SEQ ID NO: 1085193 - DNA, 14 bp, Homo sapiens
gtgaagtgtggctg

SEQ ID NO: 1085194 - DNA, 22 bp, Homo sapiens
gtgaagtgtggctggtgtcccc

SEQ ID NO: 1085195 - DNA, 16 bp, Homo sapiens
gtgaagtttggagatt

SEQ ID NO: 1085196 - DNA, 14 bp, Homo sapiens
gtgaatacaattaa

SEQ ID NO: 1085197 - DNA, 19 bp, Homo sapiens
gtgaatacaattaaaggtc

SEQ ID NO: 1085198 - DNA, 22 bp, Homo sapiens
gtgaatacattaacggtgctaa

SEQ ID NO: 1085199 - DNA, 19 bp, Homo sapiens
gtgaatactgctacagcaa

SEQ ID NO: 1085200 - DNA, 22 bp, Homo sapiens
gtgaatacttattttcagtgca

SEQ ID NO: 1085201 - DNA, 17 bp, Homo sapiens
gtgaatataaatgtgtg

SEQ ID NO: 1085202 - DNA, 13 bp, Homo sapiens
gtgaatattgctt

SEQ ID NO: 1085203 - DNA, 16 bp, Homo sapiens
gtgaatcacgtaaagc

SEQ ID NO: 1085204 - DNA, 14 bp, Homo sapiens
gtgaatcagagcac

SEQ ID NO: 1085205 - DNA, 14 bp, Homo sapiens
gtgaatcaggcaaa

SEQ ID NO: 1085206 - DNA, 21 bp, Homo sapiens
gtgaatctaaggataatgaaa

SEQ ID NO: 1085207 - DNA, 16 bp, Homo sapiens
gtgaatcttgtctaac

SEQ ID NO: 1085208 - DNA, 13 bp, Homo sapiens
gtgaatctttctc

SEQ ID NO: 1085209 - DNA, 13 bp, Homo sapiens
gtgaatgaacact

SEQ ID NO: 1085210 - DNA, 16 bp, Homo sapiens
gtgaatgctagacaga

SEQ ID NO: 1085211 - DNA, 13 bp, Homo sapiens
gtgaatgctggga

SEQ ID NO: 1085212 - DNA, 15 bp, Homo sapiens
gtgaatgctgggact

SEQ ID NO: 1085213 - DNA, 20 bp, Homo sapiens
gtgaatgctgggactcagcc

SEQ ID NO: 1085214 - DNA, 21 bp, Homo sapiens
gtgaatgctgggactcagcct

SEQ ID NO: 1085215 - DNA, 13 bp, Homo sapiens
gtgaatggaggca

SEQ ID NO: 1085216 - DNA, 15 bp, Homo sapiens
gtgaatggaggcaga

SEQ ID NO: 1085217 - DNA, 22 bp, Homo sapiens
gtgaatgtagcttccacctcat

SEQ ID NO: 1085218 - DNA, 23 bp, Homo sapiens
gtgaatgtaggctggctttcaga

SEQ ID NO: 1085219 - DNA, 22 bp, Homo sapiens
gtgaattaggctgtaactactt

SEQ ID NO: 1085220 - DNA, 18 bp, Homo sapiens
gtgaattattgacactga

SEQ ID NO: 1085221 - DNA, 13 bp, Homo sapiens
gtgaattgactac

SEQ ID NO: 1085222 - DNA, 22 bp, Homo sapiens
gtgaattgtacctatttctgat

SEQ ID NO: 1085223 - DNA, 23 bp, Homo sapiens
gtgaattgtacctatttctgatg

SEQ ID NO: 1085224 - DNA, 15 bp, Homo sapiens
gtgaattgtctttta

SEQ ID NO: 1085225 - DNA, 18 bp, Homo sapiens
gtgaattgtttttgtaca

SEQ ID NO: 1085226 - DNA, 22 bp, Homo sapiens
gtgaattttcaaggccttcagt

SEQ ID NO: 1085227 - DNA, 20 bp, Homo sapiens
gtgaatttttaatcagcaat

SEQ ID NO: 1085228 - DNA, 12 bp, Homo sapiens
gtgaatttttat

SEQ ID NO: 1085229 - DNA, 22 bp, Homo sapiens
gtgacaaaatgggaggaggaaa

SEQ ID NO: 1085230 - DNA, 16 bp, Homo sapiens
gtgacaaaccatccag

SEQ ID NO: 1085231 - DNA, 21 bp, Homo sapiens
gtgagatccttcacaggcagt

SEQ ID NO: 1085232 - DNA, 12 bp, Homo sapiens
gtgagatgaggg

SEQ ID NO: 1085233 - DNA, 19 bp, Homo sapiens
gtgagatgagggatgggcc

SEQ ID NO: 1085234 - DNA, 22 bp, Homo sapiens
gtgagatgagggatgggcctgg

SEQ ID NO: 1085235 - DNA, 18 bp, Homo sapiens
gtgagatgcagctggaaa

SEQ ID NO: 1085236 - DNA, 15 bp, Homo sapiens
gtgagatgtaattgt

SEQ ID NO: 1085237 - DNA, 18 bp, Homo sapiens
gtgagcaaccagctggaa

SEQ ID NO: 1085238 - DNA, 21 bp, Homo sapiens
gtgagcaagaagtcaaagtaa

SEQ ID NO: 1085239 - DNA, 13 bp, Homo sapiens
gtgagcagaacag

SEQ ID NO: 1085240 - DNA, 16 bp, Homo sapiens
gtgagcagaacaggta

SEQ ID NO: 1085241 - DNA, 19 bp, Homo sapiens
gtgagcagaagtggagctg

SEQ ID NO: 1085242 - DNA, 20 bp, Homo sapiens
gtgagcagaagtggagctgg

SEQ ID NO: 1085243 - DNA, 15 bp, Homo sapiens
gtgagcagggtgggg

SEQ ID NO: 1085244 - DNA, 16 bp, Homo sapiens
gtgagcagggtggggt

SEQ ID NO: 1085245 - DNA, 23 bp, Homo sapiens
gtgagccactgcgcccagcctga

SEQ ID NO: 1085246 - DNA, 12 bp, Homo sapiens
gtgagccagtga

SEQ ID NO: 1085247 - DNA, 18 bp, Homo sapiens
gtgagcccagctgggtca

SEQ ID NO: 1085248 - DNA, 14 bp, Homo sapiens
gtgagcccccccct

SEQ ID NO: 1085249 - DNA, 15 bp, Homo sapiens
gtgagcccctcccca

SEQ ID NO: 1085250 - DNA, 16 bp, Homo sapiens
gtgagcccctccccag

SEQ ID NO: 1085251 - DNA, 17 bp, Homo sapiens
gtgagcccctccccagc

SEQ ID NO: 1085252 - DNA, 21 bp, Homo sapiens
gtgagccgcatcttctccatc

SEQ ID NO: 1085253 - DNA, 21 bp, Homo sapiens
gtgagccgcggggcacatgct

SEQ ID NO: 1085254 - DNA, 13 bp, Homo sapiens
gtgagcctatgat

SEQ ID NO: 1085255 - DNA, 13 bp, Homo sapiens
gtgagcctcctgt

SEQ ID NO: 1085256 - DNA, 15 bp, Homo sapiens
gtgagcctcctgtgc

SEQ ID NO: 1085257 - DNA, 19 bp, Homo sapiens
gtgagcctcctgtgcctgg

SEQ ID NO: 1085258 - DNA, 18 bp, Homo sapiens
gtgagcctcgtgtcatct

SEQ ID NO: 1085259 - DNA, 13 bp, Homo sapiens
gtgagcctgactg

SEQ ID NO: 1085260 - DNA, 16 bp, Homo sapiens
gtgagcctgggccagg

SEQ ID NO: 1085261 - DNA, 22 bp, Homo sapiens
gtgagcgatcatttatttcatg

SEQ ID NO: 1085262 - DNA, 17 bp, Homo sapiens
gtgagcgtggccttggg

SEQ ID NO: 1085263 - DNA, 20 bp, Homo sapiens
gtgagcgtggccttgggagg

SEQ ID NO: 1085264 - DNA, 21 bp, Homo sapiens
gtgagctgcccggcgcctgcc

SEQ ID NO: 1085265 - DNA, 19 bp, Homo sapiens
gtgagctggatagacttgg

SEQ ID NO: 1085266 - DNA, 23 bp, Homo sapiens
gtgagctggatagacttgggatg

SEQ ID NO: 1085267 - DNA, 14 bp, Homo sapiens
gtgagctgggaagc

SEQ ID NO: 1085268 - DNA, 14 bp, Homo sapiens
gtgagctggggact

SEQ ID NO: 1085269 - DNA, 18 bp, Homo sapiens
gtgaggaaatccattgtt

SEQ ID NO: 1085270 - DNA, 20 bp, Homo sapiens
gtgaggaaatccattgttta

SEQ ID NO: 1085271 - DNA, 21 bp, Homo sapiens
gtgaggaaatccattgtttaa

SEQ ID NO: 1085272 - DNA, 22 bp, Homo sapiens
gtgaggaaatccattgtttaaa

SEQ ID NO: 1085273 - DNA, 23 bp, Homo sapiens
gtgaggactcggccactgtgtct

SEQ ID NO: 1085274 - DNA, 22 bp, Homo sapiens
gtgaggagaatgaaatgtatgt

SEQ ID NO: 1085275 - DNA, 14 bp, Homo sapiens
gtgaggagctgctg

SEQ ID NO: 1085276 - DNA, 17 bp, Homo sapiens
gtgaggagctgctggct

SEQ ID NO: 1085277 - DNA, 13 bp, Homo sapiens
gtgaggaggaaaa

SEQ ID NO: 1085278 - DNA, 18 bp, Homo sapiens
gtgaggaggaaaaggaaa

SEQ ID NO: 1085279 - DNA, 20 bp, Homo sapiens
gtgaggaggaaaaggaaaaa

SEQ ID NO: 1085280 - DNA, 19 bp, Homo sapiens
gtgaggataaggggtgggg

SEQ ID NO: 1085281 - DNA, 20 bp, Homo sapiens
gtgaggcattcggggaagct

SEQ ID NO: 1085282 - DNA, 14 bp, Homo sapiens
gtgaggccagggca

SEQ ID NO: 1085283 - DNA, 17 bp, Homo sapiens
gtgaggccagggcagag

SEQ ID NO: 1085284 - DNA, 13 bp, Homo sapiens
gtgaggcctggcc

SEQ ID NO: 1085285 - DNA, 19 bp, Homo sapiens
gtgaggcgttctcctgctt

SEQ ID NO: 1085286 - DNA, 20 bp, Homo sapiens
gtgaggcgttctcctgcttg

SEQ ID NO: 1085287 - DNA, 16 bp, Homo sapiens
gtgaggcttccaggct

SEQ ID NO: 1085288 - DNA, 13 bp, Homo sapiens
gtgagggagggga

SEQ ID NO: 1085289 - DNA, 21 bp, Homo sapiens
gtgagggaggggaaaagcatt

SEQ ID NO: 1085290 - DNA, 17 bp, Homo sapiens
gtgagggcctcagagcc

SEQ ID NO: 1085291 - DNA, 18 bp, Homo sapiens
gtgagggcctcagagcct

SEQ ID NO: 1085292 - DNA, 20 bp, Homo sapiens
gtgagggcctcagagcctga

SEQ ID NO: 1085293 - DNA, 15 bp, Homo sapiens
gtgaggggcaggacc

SEQ ID NO: 1085294 - DNA, 15 bp, Homo sapiens
gtgaggggctttctc

SEQ ID NO: 1085295 - DNA, 19 bp, Homo sapiens
gtgaggggctttctcttcc

SEQ ID NO: 1085296 - DNA, 22 bp, Homo sapiens
gtgaggggctttctcttcccct

SEQ ID NO: 1085297 - DNA, 21 bp, Homo sapiens
gtgaggggggggtgggtgaga

SEQ ID NO: 1085298 - DNA, 19 bp, Homo sapiens
gtgaggggttacctccctc

SEQ ID NO: 1085299 - DNA, 18 bp, Homo sapiens
gtgagggtaagtattttc

SEQ ID NO: 1085300 - DNA, 15 bp, Homo sapiens
gtgagggtcccatgt

SEQ ID NO: 1085301 - DNA, 24 bp, Homo sapiens
gtgagggtcctgcagcctgcagga

SEQ ID NO: 1085302 - DNA, 16 bp, Homo sapiens
gtgaggtggcccaggc

SEQ ID NO: 1085303 - DNA, 17 bp, Homo sapiens
gtgaggtggcccaggcc

SEQ ID NO: 1085304 - DNA, 18 bp, Homo sapiens
gtgagtaattttggattt

SEQ ID NO: 1085305 - DNA, 14 bp, Homo sapiens
gtgagtcaccactt

SEQ ID NO: 1085306 - DNA, 16 bp, Homo sapiens
gtgagtcacctgctcc

SEQ ID NO: 1085307 - DNA, 17 bp, Homo sapiens
gtgagtcacctgctcca

SEQ ID NO: 1085308 - DNA, 21 bp, Homo sapiens
gtgagtcacctgctccagaag

SEQ ID NO: 1085309 - DNA, 13 bp, Homo sapiens
gtgagtcagcacc

SEQ ID NO: 1085310 - DNA, 17 bp, Homo sapiens
gtgagtcatttaaatgt

SEQ ID NO: 1085311 - DNA, 15 bp, Homo sapiens
gtgagtccattctcc

SEQ ID NO: 1085312 - DNA, 18 bp, Homo sapiens
gtgagtcctgttgaagac

SEQ ID NO: 1085313 - DNA, 23 bp, Homo sapiens
gtgagtctccccttgcagcctgg

SEQ ID NO: 1085314 - DNA, 17 bp, Homo sapiens
gtgagtcttggcggcag

SEQ ID NO: 1085315 - DNA, 19 bp, Homo sapiens
gtgagtcttggcggcagca

SEQ ID NO: 1085316 - DNA, 18 bp, Homo sapiens
gtgagtcttggttctaaa

SEQ ID NO: 1085317 - DNA, 20 bp, Homo sapiens
gtgagtgacatagcctcatg

SEQ ID NO: 1085318 - DNA, 14 bp, Homo sapiens
gtgagtgatcactg

SEQ ID NO: 1085319 - DNA, 17 bp, Homo sapiens
gtgagtgatcactggta

SEQ ID NO: 1085320 - DNA, 18 bp, Homo sapiens
gtgagtgatcactggtat

SEQ ID NO: 1085321 - DNA, 17 bp, Homo sapiens
gtgagtgcgcctcacca

SEQ ID NO: 1085322 - DNA, 11 bp, Homo sapiens
gtgagtggagt

SEQ ID NO: 1085323 - DNA, 13 bp, Homo sapiens
gtgagtggataat

SEQ ID NO: 1085324 - DNA, 13 bp, Homo sapiens
gtgagtggcagcc

SEQ ID NO: 1085325 - DNA, 14 bp, Homo sapiens
gtgagtgtatgtgt

SEQ ID NO: 1085326 - DNA, 16 bp, Homo sapiens
gtgagtgtatgtgtgt

SEQ ID NO: 1085327 - DNA, 14 bp, Homo sapiens
gtgagtgtgacagg

SEQ ID NO: 1085328 - DNA, 17 bp, Homo sapiens
gtgagtgtgacagggcc

SEQ ID NO: 1085329 - DNA, 18 bp, Homo sapiens
gtgagtgtgacagggcca

SEQ ID NO: 1085330 - DNA, 20 bp, Homo sapiens
gtgagtgtgagggcagcact

SEQ ID NO: 1085331 - DNA, 15 bp, Homo sapiens
gtgagtgtgagtgtg

SEQ ID NO: 1085332 - DNA, 22 bp, Homo sapiens
gtgacatttatgtctcatgtaa

SEQ ID NO: 1085333 - DNA, 22 bp, Homo sapiens
gtgacatttgggagacatgtga

SEQ ID NO: 1085334 - DNA, 20 bp, Homo sapiens
gtgacattttacattaaatt

SEQ ID NO: 1085335 - DNA, 21 bp, Homo sapiens
gtgacattttacattaaattt

SEQ ID NO: 1085336 - DNA, 13 bp, Homo sapiens
gtgaccaactgtg

SEQ ID NO: 1085337 - DNA, 22 bp, Homo sapiens
gtgaccaactgtgttgtattaa

SEQ ID NO: 1085338 - DNA, 19 bp, Homo sapiens
gtgaccaagttataaatca

SEQ ID NO: 1085339 - DNA, 15 bp, Homo sapiens
gtgaccaatgtcttg

SEQ ID NO: 1085340 - DNA, 16 bp, Homo sapiens
gtgaccaatgtcttga

SEQ ID NO: 1085341 - DNA, 13 bp, Homo sapiens
gtgaccaccccct

SEQ ID NO: 1085342 - DNA, 15 bp, Homo sapiens
gtgaccaccccctgt

SEQ ID NO: 1085343 - DNA, 13 bp, Homo sapiens
gtgaccaccttct

SEQ ID NO: 1085344 - DNA, 22 bp, Homo sapiens
gtgaccaccttctgtccccagc

SEQ ID NO: 1085345 - DNA, 18 bp, Homo sapiens
gtgaccagcctgtcaccc

SEQ ID NO: 1085346 - DNA, 20 bp, Homo sapiens
gtgaccaggcttttgtagat

SEQ ID NO: 1085347 - DNA, 12 bp, Homo sapiens
gtgacccacagc

SEQ ID NO: 1085348 - DNA, 17 bp, Homo sapiens
gtgacccacagctctgg

SEQ ID NO: 1085349 - DNA, 14 bp, Homo sapiens
gtgacccaggtcct

SEQ ID NO: 1085350 - DNA, 16 bp, Homo sapiens
gtgacccccagctccg

SEQ ID NO: 1085351 - DNA, 17 bp, Homo sapiens
gtgacccccagctccgg

SEQ ID NO: 1085352 - DNA, 21 bp, Homo sapiens
gtgacccccttgattcccacc

SEQ ID NO: 1085353 - DNA, 23 bp, Homo sapiens
gtgacccccttgattcccaccgt

SEQ ID NO: 1085354 - DNA, 19 bp, Homo sapiens
gtgaccctcagctgtcacc

SEQ ID NO: 1085355 - DNA, 20 bp, Homo sapiens
gtgaccctgggcaagtcact

SEQ ID NO: 1085356 - DNA, 19 bp, Homo sapiens
gtgaccgattatgctttct

SEQ ID NO: 1085357 - DNA, 21 bp, Homo sapiens
gtgaccgattatgctttcttt

SEQ ID NO: 1085358 - DNA, 19 bp, Homo sapiens
gtgaccgcccagctctccc

SEQ ID NO: 1085359 - DNA, 15 bp, Homo sapiens
gtgaccggacttttc

SEQ ID NO: 1085360 - DNA, 17 bp, Homo sapiens
gtgaccgggggctgctg

SEQ ID NO: 1085361 - DNA, 20 bp, Homo sapiens
gtgacctattcaccctccac

SEQ ID NO: 1085362 - DNA, 23 bp, Homo sapiens
gtgacctgggtatcccctgcctc

SEQ ID NO: 1085363 - DNA, 15 bp, Homo sapiens
gtgaccttctgggaa

SEQ ID NO: 1085364 - DNA, 14 bp, Homo sapiens
gtgacgcccacctt

SEQ ID NO: 1085365 - DNA, 18 bp, Homo sapiens
gtgacgcccaccttcggg

SEQ ID NO: 1085366 - DNA, 19 bp, Homo sapiens
gtgacgcccaccttcgggc

SEQ ID NO: 1085367 - DNA, 21 bp, Homo sapiens
gtgacgcctgagacagcacca

SEQ ID NO: 1085368 - DNA, 14 bp, Homo sapiens
gtgacggccctcat

SEQ ID NO: 1085369 - DNA, 23 bp, Homo sapiens
gtgacggggtgtgtggcccgagg

SEQ ID NO: 1085370 - DNA, 13 bp, Homo sapiens
gtgacggtcccac

SEQ ID NO: 1085371 - DNA, 15 bp, Homo sapiens
gtgacggtcccacac

SEQ ID NO: 1085372 - DNA, 22 bp, Homo sapiens
gtgacggtcccacactggtgac

SEQ ID NO: 1085373 - DNA, 16 bp, Homo sapiens
gtgacgtgcactgtga

SEQ ID NO: 1085374 - DNA, 17 bp, Homo sapiens
gtgactagcgcctggcc

SEQ ID NO: 1085375 - DNA, 19 bp, Homo sapiens
gtgactagcgcctggcctt

SEQ ID NO: 1085376 - DNA, 20 bp, Homo sapiens
gtgactaggcatacactgta

SEQ ID NO: 1085377 - DNA, 15 bp, Homo sapiens
gtgactatatagaga

SEQ ID NO: 1085378 - DNA, 20 bp, Homo sapiens
gtgactatatagagatgttt

SEQ ID NO: 1085379 - DNA, 21 bp, Homo sapiens
gtgactcacttcaatgtgtca

SEQ ID NO: 1085380 - DNA, 17 bp, Homo sapiens
gtgactcagcagaggca

SEQ ID NO: 1085381 - DNA, 23 bp, Homo sapiens
gtgactcgacaaaggccacaggc

SEQ ID NO: 1085382 - DNA, 20 bp, Homo sapiens
gtgactcgagtcacactcaa

SEQ ID NO: 1085383 - DNA, 14 bp, Homo sapiens
gtgactcgggagct

SEQ ID NO: 1085384 - DNA, 21 bp, Homo sapiens
gtgactcgggagctgcacaca

SEQ ID NO: 1085385 - DNA, 13 bp, Homo sapiens
gtgactctgggca

SEQ ID NO: 1085386 - DNA, 22 bp, Homo sapiens
gtgactctttttagggccaggc

SEQ ID NO: 1085387 - DNA, 10 bp, Homo sapiens
gtgactgaaa

SEQ ID NO: 1085388 - DNA, 12 bp, Homo sapiens
gtgactgaaggg

SEQ ID NO: 1085389 - DNA, 18 bp, Homo sapiens
gtgactgaaggggcacac

SEQ ID NO: 1085390 - DNA, 22 bp, Homo sapiens
gtgactgaaggggcacaccact

SEQ ID NO: 1085391 - DNA, 13 bp, Homo sapiens
gtgactggcaggt

SEQ ID NO: 1085392 - DNA, 15 bp, Homo sapiens
gtgactgtatctgtg

SEQ ID NO: 1085393 - DNA, 22 bp, Homo sapiens
gtgactgtgctgtgcagctctc

SEQ ID NO: 1085394 - DNA, 22 bp, Homo sapiens
gtgactgtgtaactttctctta

SEQ ID NO: 1085395 - DNA, 18 bp, Homo sapiens
gtgactgttgtagcattt

SEQ ID NO: 1085396 - DNA, 16 bp, Homo sapiens
gtgactgtttggctta

SEQ ID NO: 1085397 - DNA, 12 bp, Homo sapiens
gtgacttcactg

SEQ ID NO: 1085398 - DNA, 14 bp, Homo sapiens
gtgacttcactgta

SEQ ID NO: 1085399 - DNA, 17 bp, Homo sapiens
gtgacttccctggtcac

SEQ ID NO: 1085400 - DNA, 15 bp, Homo sapiens
gtgacttctccaggt

SEQ ID NO: 1085401 - DNA, 11 bp, Homo sapiens
gtgacttctga

SEQ ID NO: 1085402 - DNA, 17 bp, Homo sapiens
gtgacttgtgtcccatg

SEQ ID NO: 1085403 - DNA, 13 bp, Homo sapiens
gtgactttgggga

SEQ ID NO: 1085404 - DNA, 16 bp, Homo sapiens
gtgactttttttggta

SEQ ID NO: 1085405 - DNA, 16 bp, Homo sapiens
gtgagaaaatgcctca

SEQ ID NO: 1085406 - DNA, 17 bp, Homo sapiens
gtgagaaaatgcctcaa

SEQ ID NO: 1085407 - DNA, 21 bp, Homo sapiens
gtgagaactcagaagagaaat

SEQ ID NO: 1085408 - DNA, 20 bp, Homo sapiens
gtgagaactctctccctggt

SEQ ID NO: 1085409 - DNA, 22 bp, Homo sapiens
gtgagaactctctccctggtct

SEQ ID NO: 1085410 - DNA, 17 bp, Homo sapiens
gtgagaagctgaggcct

SEQ ID NO: 1085411 - DNA, 19 bp, Homo sapiens
gtgagaatcctgcctctcc

SEQ ID NO: 1085412 - DNA, 18 bp, Homo sapiens
gtgagaattgtgctttca

SEQ ID NO: 1085413 - DNA, 22 bp, Homo sapiens
gtgagacactgcacagaagaca

SEQ ID NO: 1085414 - DNA, 15 bp, Homo sapiens
gtgagacagtctgga

SEQ ID NO: 1085415 - DNA, 15 bp, Homo sapiens
gtgagacccccacac

SEQ ID NO: 1085416 - DNA, 16 bp, Homo sapiens
gtgagaccccgcactg

SEQ ID NO: 1085417 - DNA, 16 bp, Homo sapiens
gtgagacccctgtctc

SEQ ID NO: 1085418 - DNA, 17 bp, Homo sapiens
gtgagactccacctcaa

SEQ ID NO: 1085419 - DNA, 13 bp, Homo sapiens
gtgccagctccag

SEQ ID NO: 1085420 - DNA, 18 bp, Homo sapiens
gtgccaggactccccagg

SEQ ID NO: 1085421 - DNA, 11 bp, Homo sapiens
gtgccaggagg

SEQ ID NO: 1085422 - DNA, 18 bp, Homo sapiens
gtgccagtattttaaaat

SEQ ID NO: 1085423 - DNA, 20 bp, Homo sapiens
gtggaagacaatactccctt

SEQ ID NO: 1085424 - DNA, 13 bp, Homo sapiens
gtggaagagcagc

SEQ ID NO: 1085425 - DNA, 14 bp, Homo sapiens
gtggaagcatggct

SEQ ID NO: 1085426 - DNA, 14 bp, Homo sapiens
gtggaaggcctccc

SEQ ID NO: 1085427 - DNA, 17 bp, Homo sapiens
gtggaaggcctccctct

SEQ ID NO: 1085428 - DNA, 15 bp, Homo sapiens
gtggaagggggagga

SEQ ID NO: 1085429 - DNA, 20 bp, Homo sapiens
gtggaagggggtgtgcgtgc

SEQ ID NO: 1085430 - DNA, 22 bp, Homo sapiens
gtggaagttcttcaagaggaaa

SEQ ID NO: 1085431 - DNA, 23 bp, Homo sapiens
gtggaataaacattaattttgtg

SEQ ID NO: 1085432 - DNA, 18 bp, Homo sapiens
gtggaatataaggaaagc

SEQ ID NO: 1085433 - DNA, 20 bp, Homo sapiens
gtggaatgttggataaggaa

SEQ ID NO: 1085434 - DNA, 21 bp, Homo sapiens
gtggaattccaacttgaagga

SEQ ID NO: 1085435 - DNA, 22 bp, Homo sapiens
gtggaattccaacttgaaggat

SEQ ID NO: 1085436 - DNA, 22 bp, Homo sapiens
gtggacacagatcccactggaa

SEQ ID NO: 1085437 - DNA, 16 bp, Homo sapiens
gtggacaccgctcagt

SEQ ID NO: 1085438 - DNA, 13 bp, Homo sapiens
gtggacagtcctg

SEQ ID NO: 1085439 - DNA, 21 bp, Homo sapiens
gtggaccacgccgccctccat

SEQ ID NO: 1085440 - DNA, 14 bp, Homo sapiens
gtggaccaggacag

SEQ ID NO: 1085441 - DNA, 19 bp, Homo sapiens
gtggacccagcgggcaggt

SEQ ID NO: 1085442 - DNA, 22 bp, Homo sapiens
gtggaccctgtcttctgggcac

SEQ ID NO: 1085443 - DNA, 15 bp, Homo sapiens
gtggaccctgtggcc

SEQ ID NO: 1085444 - DNA, 16 bp, Homo sapiens
gtggacctagcctgga

SEQ ID NO: 1085445 - DNA, 17 bp, Homo sapiens
gtggaccttaggccttc

SEQ ID NO: 1085446 - DNA, 18 bp, Homo sapiens
gtggaccttaggccttcc

SEQ ID NO: 1085447 - DNA, 13 bp, Homo sapiens
gtggaccttcctg

SEQ ID NO: 1085448 - DNA, 14 bp, Homo sapiens
gtggaccttcctgc

SEQ ID NO: 1085449 - DNA, 13 bp, Homo sapiens
gtggacggcgctg

SEQ ID NO: 1085450 - DNA, 17 bp, Homo sapiens
gtggacggcgctgcctc

SEQ ID NO: 1085451 - DNA, 20 bp, Homo sapiens
gtggacgtcacgctccctga

SEQ ID NO: 1085452 - DNA, 18 bp, Homo sapiens
gtggacgtgcactgacag

SEQ ID NO: 1085453 - DNA, 19 bp, Homo sapiens
gtggactaaatatctgtca

SEQ ID NO: 1085454 - DNA, 15 bp, Homo sapiens
gtggactcagggcag

SEQ ID NO: 1085455 - DNA, 21 bp, Homo sapiens
gtggactcagggcagcgccag

SEQ ID NO: 1085456 - DNA, 13 bp, Homo sapiens
gtggactggctca

SEQ ID NO: 1085457 - DNA, 20 bp, Homo sapiens
gtggactgtcctgaggagcc

SEQ ID NO: 1085458 - DNA, 23 bp, Homo sapiens
gtggactgtcctgaggagccctg

SEQ ID NO: 1085459 - DNA, 18 bp, Homo sapiens
gtggactgtgctggtgca

SEQ ID NO: 1085460 - DNA, 15 bp, Homo sapiens
gtggacttggagctg

SEQ ID NO: 1085461 - DNA, 16 bp, Homo sapiens
gtggacttggagctgc

SEQ ID NO: 1085462 - DNA, 17 bp, Homo sapiens
gtggactttccaccccc

SEQ ID NO: 1085463 - DNA, 20 bp, Homo sapiens
gtggagaagcggctggcagc

SEQ ID NO: 1085464 - DNA, 18 bp, Homo sapiens
gtggagaccctgccacag

SEQ ID NO: 1085465 - DNA, 23 bp, Homo sapiens
gtggagaccctgccacagccaga

SEQ ID NO: 1085466 - DNA, 11 bp, Homo sapiens
gtggagactgc

SEQ ID NO: 1085467 - DNA, 14 bp, Homo sapiens
gtggagagctggtg

SEQ ID NO: 1085468 - DNA, 17 bp, Homo sapiens
gtggagagctggtgccc

SEQ ID NO: 1085469 - DNA, 21 bp, Homo sapiens
gtgggacaaaccagagcagag

SEQ ID NO: 1085470 - DNA, 17 bp, Homo sapiens
gtgggacactgggcagc

SEQ ID NO: 1085471 - DNA, 14 bp, Homo sapiens
gtgggactggtggg

SEQ ID NO: 1085472 - DNA, 17 bp, Homo sapiens
gtgggactggtgggggt

SEQ ID NO: 1085473 - DNA, 18 bp, Homo sapiens
gtgggacttagcagtgag

SEQ ID NO: 1085474 - DNA, 16 bp, Homo sapiens
gtgggacttggagagc

SEQ ID NO: 1085475 - DNA, 12 bp, Homo sapiens
gtgggagacagc

SEQ ID NO: 1085476 - DNA, 15 bp, Homo sapiens
gtgggagacagcagc

SEQ ID NO: 1085477 - DNA, 15 bp, Homo sapiens
gtgggagagcccagc

SEQ ID NO: 1085478 - DNA, 19 bp, Homo sapiens
gtgggagcagcggtttggg

SEQ ID NO: 1085479 - DNA, 15 bp, Homo sapiens
gtgggagcagcttct

SEQ ID NO: 1085480 - DNA, 12 bp, Homo sapiens
gtgggagccctg

SEQ ID NO: 1085481 - DNA, 13 bp, Homo sapiens
gtgggagctgagc

SEQ ID NO: 1085482 - DNA, 21 bp, Homo sapiens
gtgggaggaaagggcctggcc

SEQ ID NO: 1085483 - DNA, 22 bp, Homo sapiens
gtgggaggaaagggcctggcca

SEQ ID NO: 1085484 - DNA, 18 bp, Homo sapiens
gtgggaggcagaaaccta

SEQ ID NO: 1085485 - DNA, 19 bp, Homo sapiens
gtgggagggagcagacagg

SEQ ID NO: 1085486 - DNA, 11 bp, Homo sapiens
gtgggagggcg

SEQ ID NO: 1085487 - DNA, 19 bp, Homo sapiens
gtgggagggcgtcaggcag

SEQ ID NO: 1085488 - DNA, 13 bp, Homo sapiens
gtgggaggggcag

SEQ ID NO: 1085489 - DNA, 16 bp, Homo sapiens
gtgggaggggcaggct

SEQ ID NO: 1085490 - DNA, 17 bp, Homo sapiens
gtgggaggggcaggctg

SEQ ID NO: 1085491 - DNA, 15 bp, Homo sapiens
gtgggagggggagga

SEQ ID NO: 1085492 - DNA, 22 bp, Homo sapiens
gtgggagggggcgttggattta

SEQ ID NO: 1085493 - DNA, 17 bp, Homo sapiens
gtgggaggtaggctgtg

SEQ ID NO: 1085494 - DNA, 13 bp, Homo sapiens
gtgggaggtcagg

SEQ ID NO: 1085495 - DNA, 19 bp, Homo sapiens
gtgggagtgtgtctgctga

SEQ ID NO: 1085496 - DNA, 21 bp, Homo sapiens
gtgggagtgtgtctgctgagt

SEQ ID NO: 1085497 - DNA, 15 bp, Homo sapiens
gtgggatacttagtg

SEQ ID NO: 1085498 - DNA, 13 bp, Homo sapiens
gtgggatcctccc

SEQ ID NO: 1085499 - DNA, 14 bp, Homo sapiens
gtgggatcctccct

SEQ ID NO: 1085500 - DNA, 15 bp, Homo sapiens
gtgggatcctccctc

SEQ ID NO: 1085501 - DNA, 20 bp, Homo sapiens
gtgggatcctccctcatggc

SEQ ID NO: 1085502 - DNA, 14 bp, Homo sapiens
gtgggatggaggag

SEQ ID NO: 1085503 - DNA, 17 bp, Homo sapiens
gtgggatgggctctacc

SEQ ID NO: 1085504 - DNA, 23 bp, Homo sapiens
gtgggatgttcagcactgtccct

SEQ ID NO: 1085505 - DNA, 14 bp, Homo sapiens
gtgggatttgtaaa

SEQ ID NO: 1085506 - DNA, 18 bp, Homo sapiens
gtgggatttttcagaaaa

SEQ ID NO: 1085507 - DNA, 13 bp, Homo sapiens
gtgggcaaaggca

SEQ ID NO: 1085508 - DNA, 19 bp, Homo sapiens
gtgggcaaaggcagggcca

SEQ ID NO: 1085509 - DNA, 14 bp, Homo sapiens
gtgggcacctcaga

SEQ ID NO: 1085510 - DNA, 16 bp, Homo sapiens
gtgggcagcagcatcc

SEQ ID NO: 1085511 - DNA, 12 bp, Homo sapiens
gtgggcagctgg

SEQ ID NO: 1085512 - DNA, 14 bp, Homo sapiens
gtgggcagctgggc

SEQ ID NO: 1085513 - DNA, 21 bp, Homo sapiens
gtgggcaggtggccgcccctg

SEQ ID NO: 1085514 - DNA, 19 bp, Homo sapiens
gtgggcagtcaccacccag

SEQ ID NO: 1085515 - DNA, 23 bp, Homo sapiens
gtgggcagtcaccacccagccct

SEQ ID NO: 1085516 - DNA, 14 bp, Homo sapiens
gtgggcagtgccac

SEQ ID NO: 1085517 - DNA, 14 bp, Homo sapiens
gtgggcatgagctg

SEQ ID NO: 1085518 - DNA, 20 bp, Homo sapiens
gtgggcatgagctgctgtgc

SEQ ID NO: 1085519 - DNA, 19 bp, Homo sapiens
gtgggcatgccaccctcac

SEQ ID NO: 1085520 - DNA, 19 bp, Homo sapiens
gtgggccactctcccctcc

SEQ ID NO: 1085521 - DNA, 22 bp, Homo sapiens
gtgggccagcataggggggagg

SEQ ID NO: 1085522 - DNA, 23 bp, Homo sapiens
gtgggccagcataggggggaggg

SEQ ID NO: 1085523 - DNA, 12 bp, Homo sapiens
gtgggccagccc

SEQ ID NO: 1085524 - DNA, 17 bp, Homo sapiens
gtgggccagcccctccc

SEQ ID NO: 1085525 - DNA, 19 bp, Homo sapiens
gtgggccagcccctcccac

SEQ ID NO: 1085526 - DNA, 18 bp, Homo sapiens
gtgggccaggacaggccc

SEQ ID NO: 1085527 - DNA, 14 bp, Homo sapiens
gtgggccaggatcc

SEQ ID NO: 1085528 - DNA, 13 bp, Homo sapiens
gtgggccagggct

SEQ ID NO: 1085529 - DNA, 15 bp, Homo sapiens
gtgggccagtctgtg

SEQ ID NO: 1085530 - DNA, 16 bp, Homo sapiens
gtgggccagtctgtgg

SEQ ID NO: 1085531 - DNA, 18 bp, Homo sapiens
gtgggccagtctgtggat

SEQ ID NO: 1085532 - DNA, 21 bp, Homo sapiens
gtgggcccagaactgccccca

SEQ ID NO: 1085533 - DNA, 20 bp, Homo sapiens
gtgggccctgcaggctgcag

SEQ ID NO: 1085534 - DNA, 13 bp, Homo sapiens
gtgggccctgccc

SEQ ID NO: 1085535 - DNA, 21 bp, Homo sapiens
gtgggccctgcccggggagct

SEQ ID NO: 1085536 - DNA, 13 bp, Homo sapiens
gtgggccgggagg

SEQ ID NO: 1085537 - DNA, 19 bp, Homo sapiens
gtgggccgggaggcagtgc

SEQ ID NO: 1085538 - DNA, 21 bp, Homo sapiens
gtgggccgtggcttgggctgg

SEQ ID NO: 1085539 - DNA, 22 bp, Homo sapiens
gtgggcctcacctgcccctctg

SEQ ID NO: 1085540 - DNA, 15 bp, Homo sapiens
gtgggcctcctctgt

SEQ ID NO: 1085541 - DNA, 13 bp, Homo sapiens
gtgggcctggcct

SEQ ID NO: 1085542 - DNA, 16 bp, Homo sapiens
gtgggcctggcctgag

SEQ ID NO: 1085543 - DNA, 18 bp, Homo sapiens
gtgggcctggcctgagct

SEQ ID NO: 1085544 - DNA, 22 bp, Homo sapiens
gtgggcctggcctgagctgggg

SEQ ID NO: 1085545 - DNA, 22 bp, Homo sapiens
gtgggcctgtcgtgccagtcct

SEQ ID NO: 1085546 - DNA, 22 bp, Homo sapiens
gtgggcggatcacaaggtcagg

SEQ ID NO: 1085547 - DNA, 12 bp, Homo sapiens
gtgggcggggag

SEQ ID NO: 1085548 - DNA, 14 bp, Homo sapiens
gtgggctaattaaa

SEQ ID NO: 1085549 - DNA, 19 bp, Homo sapiens
gtgggctacatgctggggt

SEQ ID NO: 1085550 - DNA, 18 bp, Homo sapiens
gtgggctctgtgcagtca

SEQ ID NO: 1085551 - DNA, 16 bp, Homo sapiens
gtgggctgagccctgg

SEQ ID NO: 1085552 - DNA, 18 bp, Homo sapiens
gtgggctgagccctggca

SEQ ID NO: 1085553 - DNA, 16 bp, Homo sapiens
gtgggctgcagcagcc

SEQ ID NO: 1085554 - DNA, 19 bp, Homo sapiens
gtgggctggacttctacct

SEQ ID NO: 1085555 - DNA, 13 bp, Homo sapiens
gtgggctggccca

SEQ ID NO: 1085556 - DNA, 14 bp, Homo sapiens
gtgggctggcccag

SEQ ID NO: 1085557 - DNA, 20 bp, Homo sapiens
gtgggctgggaatgggggag

SEQ ID NO: 1085558 - DNA, 18 bp, Homo sapiens
gtgggctgggcccaccca

SEQ ID NO: 1085559 - DNA, 14 bp, Homo sapiens
gtgggctggggact

SEQ ID NO: 1085560 - DNA, 12 bp, Homo sapiens
gtgggctggggc

SEQ ID NO: 1085561 - DNA, 21 bp, Homo sapiens
gtgggctggggctgctcccct

SEQ ID NO: 1085562 - DNA, 12 bp, Homo sapiens
gtgggctggtgc

SEQ ID NO: 1085563 - DNA, 18 bp, Homo sapiens
gtgggctggtgccccaca

SEQ ID NO: 1085564 - DNA, 12 bp, Homo sapiens
gtgggctgttca

SEQ ID NO: 1085565 - DNA, 14 bp, Homo sapiens
gtgggcttcctgcc

SEQ ID NO: 1085566 - DNA, 14 bp, Homo sapiens
gtgggcttggcctt

SEQ ID NO: 1085567 - DNA, 21 bp, Homo sapiens
gtgggctttctccggggtctg

SEQ ID NO: 1085568 - DNA, 20 bp, Homo sapiens
gtggggaacaggtcttgggg

SEQ ID NO: 1085569 - DNA, 16 bp, Homo sapiens
gtggggaaggggtgca

SEQ ID NO: 1085570 - DNA, 13 bp, Homo sapiens
gtggggacacagc

SEQ ID NO: 1085571 - DNA, 12 bp, Homo sapiens
gtggggacagat

SEQ ID NO: 1085572 - DNA, 18 bp, Homo sapiens
gtggggagaggcacttaa

SEQ ID NO: 1085573 - DNA, 21 bp, Homo sapiens
gtggggagatgcttctctcct

SEQ ID NO: 1085574 - DNA, 20 bp, Homo sapiens
gtggggagcagttttcccct

SEQ ID NO: 1085575 - DNA, 22 bp, Homo sapiens
gtggggaggccctgcctgaccc

SEQ ID NO: 1085576 - DNA, 21 bp, Homo sapiens
gtggggagggtgacccacagc

SEQ ID NO: 1085577 - DNA, 16 bp, Homo sapiens
gtggggataaagacag

SEQ ID NO: 1085578 - DNA, 16 bp, Homo sapiens
gtggggatttctccca

SEQ ID NO: 1085579 - DNA, 21 bp, Homo sapiens
gtggggcagcacacctctggg

SEQ ID NO: 1085580 - DNA, 22 bp, Homo sapiens
gtggggcaggagtgccaggacc

SEQ ID NO: 1085581 - DNA, 12 bp, Homo sapiens
gtggggccagga

SEQ ID NO: 1085582 - DNA, 24 bp, Homo sapiens
gtggggcccagacaccagcctagc

SEQ ID NO: 1085583 - DNA, 13 bp, Homo sapiens
gtggggccctgcc

SEQ ID NO: 1085584 - DNA, 23 bp, Homo sapiens
gtggggcccttgggccacgctct

SEQ ID NO: 1085585 - DNA, 13 bp, Homo sapiens
gtggggcctcagc

SEQ ID NO: 1085586 - DNA, 14 bp, Homo sapiens
gtggggcctcagcc

SEQ ID NO: 1085587 - DNA, 17 bp, Homo sapiens
gtggggcctcagcctgg

SEQ ID NO: 1085588 - DNA, 21 bp, Homo sapiens
gtggggcctcagcctggggct

SEQ ID NO: 1085589 - DNA, 21 bp, Homo sapiens
gtggggcctgggagggttccc

SEQ ID NO: 1085590 - DNA, 13 bp, Homo sapiens
gtggggcctgtgg

SEQ ID NO: 1085591 - DNA, 13 bp, Homo sapiens
gtggggccttggt

SEQ ID NO: 1085592 - DNA, 15 bp, Homo sapiens
gtggggcgtggatcg

SEQ ID NO: 1085593 - DNA, 17 bp, Homo sapiens
gtggggctgagctgggg

SEQ ID NO: 1085594 - DNA, 13 bp, Homo sapiens
gtggggctgcagg

SEQ ID NO: 1085595 - DNA, 14 bp, Homo sapiens
gtggggctgcaggc

SEQ ID NO: 1085596 - DNA, 18 bp, Homo sapiens
gtgggggaactgacgctg

SEQ ID NO: 1085597 - DNA, 20 bp, Homo sapiens
gtgggggaactgacgctgga

SEQ ID NO: 1085598 - DNA, 20 bp, Homo sapiens
gtgggggagagcaggctggc

SEQ ID NO: 1085599 - DNA, 14 bp, Homo sapiens
gtgggggagggagg

SEQ ID NO: 1085600 - DNA, 20 bp, Homo sapiens
gtgggggatcacagcctctg

SEQ ID NO: 1085601 - DNA, 18 bp, Homo sapiens
gtgggggcagagggcaga

SEQ ID NO: 1085602 - DNA, 15 bp, Homo sapiens
gtgggggctggaggt

SEQ ID NO: 1085603 - DNA, 15 bp, Homo sapiens
gtggggggaggaagc

SEQ ID NO: 1085604 - DNA, 12 bp, Homo sapiens
gtgggggtcatc

SEQ ID NO: 1085605 - DNA, 21 bp, Homo sapiens
gtgggggtggccatccctggg

SEQ ID NO: 1085606 - DNA, 17 bp, Homo sapiens
gtgggggttctggcagg

SEQ ID NO: 1085607 - DNA, 18 bp, Homo sapiens
gtgggggttctggcagga

SEQ ID NO: 1085608 - DNA, 20 bp, Homo sapiens
gtgggggttttggggtgggc

SEQ ID NO: 1085609 - DNA, 15 bp, Homo sapiens
gtggggtcatgccct

SEQ ID NO: 1085610 - DNA, 19 bp, Homo sapiens
gtggggtcatgccctcctc

SEQ ID NO: 1085611 - DNA, 22 bp, Homo sapiens
gtggggtctccctctcctgcct

SEQ ID NO: 1085612 - DNA, 14 bp, Homo sapiens
gtggggtctggctg

SEQ ID NO: 1085613 - DNA, 16 bp, Homo sapiens
gtggggtctggctgtg

SEQ ID NO: 1085614 - DNA, 17 bp, Homo sapiens
gtggggtctggctgtgt

SEQ ID NO: 1085615 - DNA, 16 bp, Homo sapiens
gtggggtctgggaggg

SEQ ID NO: 1085616 - DNA, 17 bp, Homo sapiens
gtggggtgaggaccact

SEQ ID NO: 1085617 - DNA, 15 bp, Homo sapiens
gtggggtgctgccct

SEQ ID NO: 1085618 - DNA, 20 bp, Homo sapiens
gtggggtggagcactggact

SEQ ID NO: 1085619 - DNA, 15 bp, Homo sapiens
gtggggtgggctgga

SEQ ID NO: 1085620 - DNA, 15 bp, Homo sapiens
gtgggtacatcaagt

SEQ ID NO: 1085621 - DNA, 16 bp, Homo sapiens
gtgggtccaggaaggc

SEQ ID NO: 1085622 - DNA, 18 bp, Homo sapiens
gtgggtccaggaaggcag

SEQ ID NO: 1085623 - DNA, 20 bp, Homo sapiens
gtgggtccaggaaggcagct

SEQ ID NO: 1085624 - DNA, 21 bp, Homo sapiens
gtgggtccaggaaggcagctg

SEQ ID NO: 1085625 - DNA, 11 bp, Homo sapiens
gtgggtctctg

SEQ ID NO: 1085626 - DNA, 14 bp, Homo sapiens
gtgggtctctggaa

SEQ ID NO: 1085627 - DNA, 12 bp, Homo sapiens
gtgggtgagcca

SEQ ID NO: 1085628 - DNA, 12 bp, Homo sapiens
gtgggtgcagtc

SEQ ID NO: 1085629 - DNA, 12 bp, Homo sapiens
gtgggtgctgcc

SEQ ID NO: 1085630 - DNA, 13 bp, Homo sapiens
gtgggtgctgcca

SEQ ID NO: 1085631 - DNA, 15 bp, Homo sapiens
gtgggtgctgccctg

SEQ ID NO: 1085632 - DNA, 16 bp, Homo sapiens
gtgggtgggcagggag

SEQ ID NO: 1085633 - DNA, 13 bp, Homo sapiens
gtgggtgggcctg

SEQ ID NO: 1085634 - DNA, 14 bp, Homo sapiens
gtgggtgggcctga

SEQ ID NO: 1085635 - DNA, 16 bp, Homo sapiens
gtgggtgtctccctcg

SEQ ID NO: 1085636 - DNA, 22 bp, Homo sapiens
gtgggtgtgggacacctgggag

SEQ ID NO: 1085637 - DNA, 19 bp, Homo sapiens
gtgggtttgggtgcctcct

SEQ ID NO: 1085638 - DNA, 21 bp, Homo sapiens
gtgggtttgggtgcctcctgc

SEQ ID NO: 1085639 - DNA, 22 bp, Homo sapiens
gtgggttttattgtccttcaga

SEQ ID NO: 1085640 - DNA, 16 bp, Homo sapiens
gtgggttttcttccca

SEQ ID NO: 1085641 - DNA, 21 bp, Homo sapiens
gtgggtttttgtatccagagc

SEQ ID NO: 1085642 - DNA, 13 bp, Homo sapiens
gtggtaaagaaag

SEQ ID NO: 1085643 - DNA, 16 bp, Homo sapiens
gtggtaagctctggct

SEQ ID NO: 1085644 - DNA, 18 bp, Homo sapiens
gtggtaattctatttgta

SEQ ID NO: 1085645 - DNA, 17 bp, Homo sapiens
gtggtacaaatgtgata

SEQ ID NO: 1085646 - DNA, 14 bp, Homo sapiens
gtggtaccctctgg

SEQ ID NO: 1085647 - DNA, 20 bp, Homo sapiens
gtggtaccttcagccctggc

SEQ ID NO: 1085648 - DNA, 20 bp, Homo sapiens
gtggtactttattcttgctg

SEQ ID NO: 1085649 - DNA, 14 bp, Homo sapiens
gtggtagaagccag

SEQ ID NO: 1085650 - DNA, 17 bp, Homo sapiens
gtggtagagtgtgcctg

SEQ ID NO: 1085651 - DNA, 21 bp, Homo sapiens
gtggtaggcctataaaattaa

SEQ ID NO: 1085652 - DNA, 13 bp, Homo sapiens
gtggtatgtctct

SEQ ID NO: 1085653 - DNA, 14 bp, Homo sapiens
gtggtatgtctgcc

SEQ ID NO: 1085654 - DNA, 15 bp, Homo sapiens
gtggtattctgtcat

SEQ ID NO: 1085655 - DNA, 23 bp, Homo sapiens
gtggtattttattttggcttcat

SEQ ID NO: 1085656 - DNA, 14 bp, Homo sapiens
gtggtattttcaat

SEQ ID NO: 1085657 - DNA, 23 bp, Homo sapiens
gtggtattttcaatagccactaa

SEQ ID NO: 1085658 - DNA, 14 bp, Homo sapiens
gtggtatttttata

SEQ ID NO: 1085659 - DNA, 15 bp, Homo sapiens
gtggtcacagcggag

SEQ ID NO: 1085660 - DNA, 17 bp, Homo sapiens
gtggtcaccttcgagta

SEQ ID NO: 1085661 - DNA, 14 bp, Homo sapiens
gtggtcactggtca

SEQ ID NO: 1085662 - DNA, 21 bp, Homo sapiens
gtggtcactggtcagggcagt

SEQ ID NO: 1085663 - DNA, 22 bp, Homo sapiens
gtggtcactggtcagggcagtg

SEQ ID NO: 1085664 - DNA, 12 bp, Homo sapiens
gtggtctaaagt

SEQ ID NO: 1085665 - DNA, 18 bp, Homo sapiens
gtggtctaaagtgtttag

SEQ ID NO: 1085666 - DNA, 20 bp, Homo sapiens
gtggtctaaagtgtttagct

SEQ ID NO: 1085667 - DNA, 22 bp, Homo sapiens
gtggtctataaaataaacttct

SEQ ID NO: 1085668 - DNA, 23 bp, Homo sapiens
gtggtctataaaataaacttctt

SEQ ID NO: 1085669 - DNA, 11 bp, Homo sapiens
gtggtctcagg

SEQ ID NO: 1085670 - DNA, 13 bp, Homo sapiens
gtggtctgaatgt

SEQ ID NO: 1085671 - DNA, 20 bp, Homo sapiens
gtggtctgaatgttctgaca

SEQ ID NO: 1085672 - DNA, 24 bp, Homo sapiens
gtggtctgaatgttctgacattaa

SEQ ID NO: 1085673 - DNA, 15 bp, Homo sapiens
gtggtctggaaacag

SEQ ID NO: 1085674 - DNA, 17 bp, Homo sapiens
gtggtctgttggcaggc

SEQ ID NO: 1085675 - DNA, 21 bp, Homo sapiens
gtggtctgttggcaggctggc

SEQ ID NO: 1085676 - DNA, 22 bp, Homo sapiens
gtggtctgttggcaggctggcc

SEQ ID NO: 1085677 - DNA, 16 bp, Homo sapiens
gtggtctttctggaga

SEQ ID NO: 1085678 - DNA, 16 bp, Homo sapiens
gtggtgaagtgtggct

SEQ ID NO: 1085679 - DNA, 18 bp, Homo sapiens
gtggtgaagtgtggctgg

SEQ ID NO: 1085680 - DNA, 17 bp, Homo sapiens
gtggtgacacctccccc

SEQ ID NO: 1085681 - DNA, 18 bp, Homo sapiens
gtggtgaccccaggaggg

SEQ ID NO: 1085682 - DNA, 17 bp, Homo sapiens
gtggtgaggggctttct

SEQ ID NO: 1085683 - DNA, 19 bp, Homo sapiens
gtggtgcagccttcccctc

SEQ ID NO: 1085684 - DNA, 20 bp, Homo sapiens
gtggtggatctgtccaagga

SEQ ID NO: 1085685 - DNA, 22 bp, Homo sapiens
gtggtggccgtcacgctttcat

SEQ ID NO: 1085686 - DNA, 19 bp, Homo sapiens
gtggtggctccccctctgc

SEQ ID NO: 1085687 - DNA, 12 bp, Homo sapiens
gtggtggggagg

SEQ ID NO: 1085688 - DNA, 20 bp, Homo sapiens
gtggtggggaggggcgctgg

SEQ ID NO: 1085689 - DNA, 16 bp, Homo sapiens
gtggtggtaaccctgg

SEQ ID NO: 1085690 - DNA, 12 bp, Homo sapiens
gtggtgtatttg

SEQ ID NO: 1085691 - DNA, 20 bp, Homo sapiens
gtggtgtcccctatcctccc

SEQ ID NO: 1085692 - DNA, 13 bp, Homo sapiens
gtggtgtgaaaca

SEQ ID NO: 1085693 - DNA, 21 bp, Homo sapiens
gtggtgtgaaacacacaatgt

SEQ ID NO: 1085694 - DNA, 13 bp, Homo sapiens
gtggtgtgaccat

SEQ ID NO: 1085695 - DNA, 20 bp, Homo sapiens
gtggttacagtgcagacagg

SEQ ID NO: 1085696 - DNA, 13 bp, Homo sapiens
gtggttagaatct

SEQ ID NO: 1085697 - DNA, 20 bp, Homo sapiens
gtggttataacttaatgaaa

SEQ ID NO: 1085698 - DNA, 21 bp, Homo sapiens
gtggttatgttcccagcagtg

SEQ ID NO: 1085699 - DNA, 22 bp, Homo sapiens
gtggttattagcaaggctgggt

SEQ ID NO: 1085700 - DNA, 14 bp, Homo sapiens
gtggttatttctca

SEQ ID NO: 1085701 - DNA, 19 bp, Homo sapiens
gtggttcaagcacactgga

SEQ ID NO: 1085702 - DNA, 16 bp, Homo sapiens
gtggttcagtcactgc

SEQ ID NO: 1085703 - DNA, 17 bp, Homo sapiens
gtggttcctaagggaaa

SEQ ID NO: 1085704 - DNA, 17 bp, Homo sapiens
gtggttgcctgccctcc

SEQ ID NO: 1085705 - DNA, 18 bp, Homo sapiens
gtggttgctgttttcctc

SEQ ID NO: 1085706 - DNA, 20 bp, Homo sapiens
gtggttgctgttttcctccc

SEQ ID NO: 1085707 - DNA, 12 bp, Homo sapiens
gtggttggaaaa

SEQ ID NO: 1085708 - DNA, 14 bp, Homo sapiens
gtggttgtgccttt

SEQ ID NO: 1085709 - DNA, 22 bp, Homo sapiens
gtggttgttgccaactaagccc

SEQ ID NO: 1085710 - DNA, 15 bp, Homo sapiens
gtggtttcagatgtg

SEQ ID NO: 1085711 - DNA, 21 bp, Homo sapiens
gtggtttccctgcccctgtcc

SEQ ID NO: 1085712 - DNA, 23 bp, Homo sapiens
gtggtttctacttcccctgggat

SEQ ID NO: 1085713 - DNA, 19 bp, Homo sapiens
gtggtttgatcatttctgc

SEQ ID NO: 1085714 - DNA, 17 bp, Homo sapiens
gtggtttgcaggtcagc

SEQ ID NO: 1085715 - DNA, 23 bp, Homo sapiens
gtggttttcagagcaggaggccg

SEQ ID NO: 1085716 - DNA, 19 bp, Homo sapiens
gtggttttcccctccctgg

SEQ ID NO: 1085717 - DNA, 24 bp, Homo sapiens
gtggttttcccctccctgggttca

SEQ ID NO: 1085718 - DNA, 17 bp, Homo sapiens
gtggttttgggtttttt

SEQ ID NO: 1085719 - DNA, 15 bp, Homo sapiens
gtgtaaaaaatggaa

SEQ ID NO: 1085720 - DNA, 17 bp, Homo sapiens
gtgtaaaaaatggaaaa

SEQ ID NO: 1085721 - DNA, 18 bp, Homo sapiens
gtgtaaaatattttgaat

SEQ ID NO: 1085722 - DNA, 22 bp, Homo sapiens
gtgtaaatatatgtctgataat

SEQ ID NO: 1085723 - DNA, 20 bp, Homo sapiens
gtgtaaatatttttccctcc

SEQ ID NO: 1085724 - DNA, 12 bp, Homo sapiens
gtgtaaatttgt

SEQ ID NO: 1085725 - DNA, 17 bp, Homo sapiens
gtgtaacaattgtgtag

SEQ ID NO: 1085726 - DNA, 15 bp, Homo sapiens
gtgtaacagctgagg

SEQ ID NO: 1085727 - DNA, 18 bp, Homo sapiens
gtgtaactggcagttttc

SEQ ID NO: 1085728 - DNA, 16 bp, Homo sapiens
gtgtaacttcctgctg

SEQ ID NO: 1085729 - DNA, 16 bp, Homo sapiens
gtgtaactttaaacat

SEQ ID NO: 1085730 - DNA, 18 bp, Homo sapiens
gtgtaagaaatacagact

SEQ ID NO: 1085731 - DNA, 23 bp, Homo sapiens
gtgtaagaactgtacattgtgag

SEQ ID NO: 1085732 - DNA, 15 bp, Homo sapiens
gtgtaatcattttaa

SEQ ID NO: 1085733 - DNA, 14 bp, Homo sapiens
gtgtaatttgaaga

SEQ ID NO: 1085734 - DNA, 15 bp, Homo sapiens
gtgtaatttgaagat

SEQ ID NO: 1085735 - DNA, 14 bp, Homo sapiens
gtgtacaaaactgt

SEQ ID NO: 1085736 - DNA, 16 bp, Homo sapiens
gtgtacaaaactgtaa

SEQ ID NO: 1085737 - DNA, 22 bp, Homo sapiens
gtgtacaaattgtcgtttttat

SEQ ID NO: 1085738 - DNA, 14 bp, Homo sapiens
gtgtacaatgtaca

SEQ ID NO: 1085739 - DNA, 16 bp, Homo sapiens
gtgtacaatgtacaca

SEQ ID NO: 1085740 - DNA, 19 bp, Homo sapiens
gtgtacaattgatcttttt

SEQ ID NO: 1085741 - DNA, 15 bp, Homo sapiens
gtgtacacgggactg

SEQ ID NO: 1085742 - DNA, 18 bp, Homo sapiens
gtgtacagaattctgcta

SEQ ID NO: 1085743 - DNA, 16 bp, Homo sapiens
gtgtacagtcttgtat

SEQ ID NO: 1085744 - DNA, 14 bp, Homo sapiens
gtgtacataactga

SEQ ID NO: 1085745 - DNA, 15 bp, Homo sapiens
gtgtacatatgtgct

SEQ ID NO: 1085746 - DNA, 22 bp, Homo sapiens
gtgtacatggaataacatgtaa

SEQ ID NO: 1085747 - DNA, 19 bp, Homo sapiens
gtgtactgggttaatggct

SEQ ID NO: 1085748 - DNA, 15 bp, Homo sapiens
gtgtactgtgcctgg

SEQ ID NO: 1085749 - DNA, 16 bp, Homo sapiens
gtgtactgtgcctggt

SEQ ID NO: 1085750 - DNA, 17 bp, Homo sapiens
gtgtagactgtaacttt

SEQ ID NO: 1085751 - DNA, 16 bp, Homo sapiens
gtgtagatttctgaca

SEQ ID NO: 1085752 - DNA, 17 bp, Homo sapiens
gtgtagcatcttcctct

SEQ ID NO: 1085753 - DNA, 20 bp, Homo sapiens
gtgtagccagccaggtgcat

SEQ ID NO: 1085754 - DNA, 21 bp, Homo sapiens
gtgtagccagccaggtgcatg

SEQ ID NO: 1085755 - DNA, 16 bp, Homo sapiens
gtgtagcctaaagggc

SEQ ID NO: 1085756 - DNA, 18 bp, Homo sapiens
gtgtagcctaaagggcag

SEQ ID NO: 1085757 - DNA, 19 bp, Homo sapiens
gtgtagcctaaagggcagg

SEQ ID NO: 1085758 - DNA, 13 bp, Homo sapiens
gtgtagccttttt

SEQ ID NO: 1085759 - DNA, 20 bp, Homo sapiens
gtgtagcctttttgtataaa

SEQ ID NO: 1085760 - DNA, 17 bp, Homo sapiens
gtgtagctgcaaaaata

SEQ ID NO: 1085761 - DNA, 12 bp, Homo sapiens
gtgtagctgtgt

SEQ ID NO: 1085762 - DNA, 14 bp, Homo sapiens
gtgtaggcagacac

SEQ ID NO: 1085763 - DNA, 21 bp, Homo sapiens
gtgtagggaccagtgggatgg

SEQ ID NO: 1085764 - DNA, 17 bp, Homo sapiens
gtgtaggggccacctcc

SEQ ID NO: 1085765 - DNA, 15 bp, Homo sapiens
gtgtagggggccttg

SEQ ID NO: 1085766 - DNA, 23 bp, Homo sapiens
gtgtagggggccttgcggaagcc

SEQ ID NO: 1085767 - DNA, 13 bp, Homo sapiens
gtgtaggtgactt

SEQ ID NO: 1085768 - DNA, 22 bp, Homo sapiens
gtgtagtggaagagcagcctga

SEQ ID NO: 1085769 - DNA, 20 bp, Homo sapiens
gtgtataaactgctgtcaat

SEQ ID NO: 1085770 - DNA, 19 bp, Homo sapiens
gtgtataaatgtacatttc

SEQ ID NO: 1085771 - DNA, 22 bp, Homo sapiens
gtgtatacatgtgtgggtgctg

SEQ ID NO: 1085772 - DNA, 20 bp, Homo sapiens
gtgtataccacctgtacata

SEQ ID NO: 1085773 - DNA, 22 bp, Homo sapiens
gtgtatagaagcgatttaagtt

SEQ ID NO: 1085774 - DNA, 18 bp, Homo sapiens
gtgtatagaagtagatta

SEQ ID NO: 1085775 - DNA, 21 bp, Homo sapiens
gtgtatagtgttcacaaactg

SEQ ID NO: 1085776 - DNA, 16 bp, Homo sapiens
gtgtatatatcttata

SEQ ID NO: 1085777 - DNA, 14 bp, Homo sapiens
gtgtatatccttcc

SEQ ID NO: 1085778 - DNA, 20 bp, Homo sapiens
gtgtatatgtataaattaat

SEQ ID NO: 1085779 - DNA, 14 bp, Homo sapiens
gtgtatatgtattt

SEQ ID NO: 1085780 - DNA, 15 bp, Homo sapiens
gtgtatatgtattta

SEQ ID NO: 1085781 - DNA, 17 bp, Homo sapiens
gtgtatattatataact

SEQ ID NO: 1085782 - DNA, 14 bp, Homo sapiens
gtgtatatttgctt

SEQ ID NO: 1085783 - DNA, 19 bp, Homo sapiens
gtgtatatttttgtatgtc

SEQ ID NO: 1085784 - DNA, 15 bp, Homo sapiens
gtgtatcagtgttta

SEQ ID NO: 1085785 - DNA, 13 bp, Homo sapiens
gtgtatcattaaa

SEQ ID NO: 1085786 - DNA, 21 bp, Homo sapiens
gtgtatcattaaaatatatgt

SEQ ID NO: 1085787 - DNA, 13 bp, Homo sapiens
gtgtatcctggcc

SEQ ID NO: 1085788 - DNA, 15 bp, Homo sapiens
gtgtatcctggggct

SEQ ID NO: 1085789 - DNA, 19 bp, Homo sapiens
gtgtatgccacacctggcc

SEQ ID NO: 1085790 - DNA, 20 bp, Homo sapiens
gtgtatgcgtgtccgtctgt

SEQ ID NO: 1085791 - DNA, 18 bp, Homo sapiens
gtgtatgtgcgtgtgtgc

SEQ ID NO: 1085792 - DNA, 13 bp, Homo sapiens
gtgtatgtggttt

SEQ ID NO: 1085793 - DNA, 12 bp, Homo sapiens
gtgtatgtttct

SEQ ID NO: 1085794 - DNA, 20 bp, Homo sapiens
gtgtatgttttatatcaaat

SEQ ID NO: 1085795 - DNA, 14 bp, Homo sapiens
gtgtattcagaggc

SEQ ID NO: 1085796 - DNA, 20 bp, Homo sapiens
gtgtattccaagacatgtct

SEQ ID NO: 1085797 - DNA, 20 bp, Homo sapiens
gtgtattgatgcaatataag

SEQ ID NO: 1085798 - DNA, 19 bp, Homo sapiens
gtgtatttattttcctccc

SEQ ID NO: 1085799 - DNA, 21 bp, Homo sapiens
gtgtatttattttcctcccca

SEQ ID NO: 1085800 - DNA, 21 bp, Homo sapiens
gtgtatttggaaataaagtca

SEQ ID NO: 1085801 - DNA, 23 bp, Homo sapiens
gtgtatttgtatttttttgcaag

SEQ ID NO: 1085802 - DNA, 14 bp, Homo sapiens
gtgtattttattca

SEQ ID NO: 1085803 - DNA, 17 bp, Homo sapiens
gtgtatttttttactaa

SEQ ID NO: 1085804 - DNA, 16 bp, Homo sapiens
gtgtcaagctgctctg

SEQ ID NO: 1085805 - DNA, 18 bp, Homo sapiens
gtgtcaagttgtgcttgt

SEQ ID NO: 1085806 - DNA, 10 bp, Homo sapiens
gtgtcacagt

SEQ ID NO: 1085807 - DNA, 15 bp, Homo sapiens
gtgtcaccaattcca

SEQ ID NO: 1085808 - DNA, 12 bp, Homo sapiens
gtgtcagaagct

SEQ ID NO: 1085809 - DNA, 16 bp, Homo sapiens
gtgtcagagcctacct

SEQ ID NO: 1085810 - DNA, 16 bp, Homo sapiens
gtgtcagcatagaagt

SEQ ID NO: 1085811 - DNA, 13 bp, Homo sapiens
gtgtcagcccctc

SEQ ID NO: 1085812 - DNA, 14 bp, Homo sapiens
gtgtcagcccctct

SEQ ID NO: 1085813 - DNA, 13 bp, Homo sapiens
gtgtcaggcccgt

SEQ ID NO: 1085814 - DNA, 16 bp, Homo sapiens
gtgtcaggccctctgc

SEQ ID NO: 1085815 - DNA, 21 bp, Homo sapiens
gtgtcaggccctctgcctgca

SEQ ID NO: 1085816 - DNA, 22 bp, Homo sapiens
gtgtcaggccctctgcctgcac

SEQ ID NO: 1085817 - DNA, 23 bp, Homo sapiens
gtgtcaggccctctgcctgcact

SEQ ID NO: 1085818 - DNA, 15 bp, Homo sapiens
gtgtcagggatgagt

SEQ ID NO: 1085819 - DNA, 17 bp, Homo sapiens
gtgtcagggtccaggag

SEQ ID NO: 1085820 - DNA, 15 bp, Homo sapiens
gtgtcagtaatttat

SEQ ID NO: 1085821 - DNA, 16 bp, Homo sapiens
gtgtcatcagaagata

SEQ ID NO: 1085822 - DNA, 20 bp, Homo sapiens
gtgtcatcctcacagtgaac

SEQ ID NO: 1085823 - DNA, 11 bp, Homo sapiens
gtgtcatgctt

SEQ ID NO: 1085824 - DNA, 20 bp, Homo sapiens
gtgtcatttccggctgctgt

SEQ ID NO: 1085825 - DNA, 21 bp, Homo sapiens
gtgtcattttattttttccct

SEQ ID NO: 1085826 - DNA, 17 bp, Homo sapiens
gtgtccacctgtgggtg

SEQ ID NO: 1085827 - DNA, 18 bp, Homo sapiens
gtgtccacgactgtctcc

SEQ ID NO: 1085828 - DNA, 13 bp, Homo sapiens
gtgtccagcagct

SEQ ID NO: 1085829 - DNA, 19 bp, Homo sapiens
gtgtccagcattgaagaga

SEQ ID NO: 1085830 - DNA, 16 bp, Homo sapiens
gtgtccagcttccaaa

SEQ ID NO: 1085831 - DNA, 20 bp, Homo sapiens
gtgtccaggctctgggcaca

SEQ ID NO: 1085832 - DNA, 19 bp, Homo sapiens
gtgtccataaataaagttt

SEQ ID NO: 1085833 - DNA, 17 bp, Homo sapiens
gtgtcccaaggagctga

SEQ ID NO: 1085834 - DNA, 18 bp, Homo sapiens
gtgtcccaaggagctgat

SEQ ID NO: 1085835 - DNA, 13 bp, Homo sapiens
gtgtcccagggcc

SEQ ID NO: 1085836 - DNA, 18 bp, Homo sapiens
gtgtcccagggccctgga

SEQ ID NO: 1085837 - DNA, 19 bp, Homo sapiens
gtgtcccatgacccacccc

SEQ ID NO: 1085838 - DNA, 22 bp, Homo sapiens
gtgtcccatgacccacccctgt

SEQ ID NO: 1085839 - DNA, 22 bp, Homo sapiens
gtgtcccccccaggccttgtcc

SEQ ID NO: 1085840 - DNA, 20 bp, Homo sapiens
gtgtcccctcacgcaagtgc

SEQ ID NO: 1085841 - DNA, 21 bp, Homo sapiens
gtgtcccctcactctgtcagc

SEQ ID NO: 1085842 - DNA, 13 bp, Homo sapiens
gtgtcccctgacc

SEQ ID NO: 1085843 - DNA, 17 bp, Homo sapiens
gtgtccccttcccctgc

SEQ ID NO: 1085844 - DNA, 18 bp, Homo sapiens
gtgtccgccatccagggt

SEQ ID NO: 1085845 - DNA, 14 bp, Homo sapiens
aaaaaaaaaacact

SEQ ID NO: 1085846 - DNA, 13 bp, Homo sapiens
aaaaaaaaagttc

SEQ ID NO: 1085847 - DNA, 13 bp, Homo sapiens
aaaaaaaacactt

SEQ ID NO: 1085848 - DNA, 14 bp, Homo sapiens
aaaaaaaaccttgt

SEQ ID NO: 1085849 - DNA, 13 bp, Homo sapiens
aaaaaaaatagga

SEQ ID NO: 1085850 - DNA, 11 bp, Homo sapiens
aaaaaaaatgg

SEQ ID NO: 1085851 - DNA, 11 bp, Homo sapiens
aaaaaaacaaa

SEQ ID NO: 1085852 - DNA, 11 bp, Homo sapiens
aaaaaaacaat

SEQ ID NO: 1085853 - DNA, 13 bp, Homo sapiens
aaaaaaactgaag

SEQ ID NO: 1085854 - DNA, 11 bp, Homo sapiens
aaaaaaacttt

SEQ ID NO: 1085855 - DNA, 13 bp, Homo sapiens
aaaaaaactttta

SEQ ID NO: 1085856 - DNA, 11 bp, Homo sapiens
aaaaaaagaca

SEQ ID NO: 1085857 - DNA, 11 bp, Homo sapiens
aaaaaaagcaa

SEQ ID NO: 1085858 - DNA, 11 bp, Homo sapiens
aaaaaaagcct

SEQ ID NO: 1085859 - DNA, 13 bp, Homo sapiens
aaaaaaataggat

SEQ ID NO: 1085860 - DNA, 14 bp, Homo sapiens
aaaaaaatctgcag

SEQ ID NO: 1085861 - DNA, 13 bp, Homo sapiens
aaaaaaatgaatg

SEQ ID NO: 1085862 - DNA, 12 bp, Homo sapiens
aaaaaaatgaca

SEQ ID NO: 1085863 - DNA, 13 bp, Homo sapiens
aaaaaaatgacta

SEQ ID NO: 1085864 - DNA, 13 bp, Homo sapiens
aaaaaaatgctga

SEQ ID NO: 1085865 - DNA, 13 bp, Homo sapiens
aaaaaaattctgt

SEQ ID NO: 1085866 - DNA, 11 bp, Homo sapiens
aaaaaacactt

SEQ ID NO: 1085867 - DNA, 18 bp, Homo sapiens
aaaacaagaaaccaagtg

SEQ ID NO: 1085868 - DNA, 16 bp, Homo sapiens
aaaacaatatctgcag

SEQ ID NO: 1085869 - DNA, 15 bp, Homo sapiens
aaaacaatattgttt

SEQ ID NO: 1085870 - DNA, 13 bp, Homo sapiens
aaaacaatcttat

SEQ ID NO: 1085871 - DNA, 19 bp, Homo sapiens
aaaacaatggtaacatttt

SEQ ID NO: 1085872 - DNA, 21 bp, Homo sapiens
aaaacaattcagtggtcttat

SEQ ID NO: 1085873 - DNA, 17 bp, Homo sapiens
aaaacaattgcaacaga

SEQ ID NO: 1085874 - DNA, 15 bp, Homo sapiens
aaaacacaagcaaaa

SEQ ID NO: 1085875 - DNA, 13 bp, Homo sapiens
aaaacacattttt

SEQ ID NO: 1085876 - DNA, 15 bp, Homo sapiens
aaaacacctagcttt

SEQ ID NO: 1085877 - DNA, 20 bp, Homo sapiens
aaaacactgaaaaattatac

SEQ ID NO: 1085878 - DNA, 13 bp, Homo sapiens
aaaacactgtgca

SEQ ID NO: 1085879 - DNA, 23 bp, Homo sapiens
aaaacactgtggaactaataaat

SEQ ID NO: 1085880 - DNA, 18 bp, Homo sapiens
aaaacacttccagtctgg

SEQ ID NO: 1085881 - DNA, 19 bp, Homo sapiens
aaaacacttgatgatgtgg

SEQ ID NO: 1085882 - DNA, 18 bp, Homo sapiens
aaaacacttggcatacaa

SEQ ID NO: 1085883 - DNA, 12 bp, Homo sapiens
aaaacagaaacc

SEQ ID NO: 1085884 - DNA, 15 bp, Homo sapiens
aaaacagaatcttct

SEQ ID NO: 1085885 - DNA, 17 bp, Homo sapiens
aaaacagacactggcat

SEQ ID NO: 1085886 - DNA, 16 bp, Homo sapiens
aaaacagattctatat

SEQ ID NO: 1085887 - DNA, 20 bp, Homo sapiens
aaaacagattctatattatt

SEQ ID NO: 1085888 - DNA, 20 bp, Homo sapiens
aaaacagattctgattccct

SEQ ID NO: 1085889 - DNA, 20 bp, Homo sapiens
aaaacagcattgctttctga

SEQ ID NO: 1085890 - DNA, 19 bp, Homo sapiens
aaaacaggaaaaaaacttt

SEQ ID NO: 1085891 - DNA, 17 bp, Homo sapiens
aaaacaggcaaagtttt

SEQ ID NO: 1085892 - DNA, 23 bp, Homo sapiens
aaaacagggccacatagatgctg

SEQ ID NO: 1085893 - DNA, 12 bp, Homo sapiens
aaaacaggtaga

SEQ ID NO: 1085894 - DNA, 18 bp, Homo sapiens
aaaacaggtatatacttt

SEQ ID NO: 1085895 - DNA, 18 bp, Homo sapiens
aaaacaggtttttgattt

SEQ ID NO: 1085896 - DNA, 18 bp, Homo sapiens
aaaacataatcttctgcc

SEQ ID NO: 1085897 - DNA, 13 bp, Homo sapiens
aaaacatatttca

SEQ ID NO: 1085898 - DNA, 13 bp, Homo sapiens
aaaacatcacatt

SEQ ID NO: 1085899 - DNA, 14 bp, Homo sapiens
aaaacatcacattc

SEQ ID NO: 1085900 - DNA, 17 bp, Homo sapiens
aaaacatccacttaagt

SEQ ID NO: 1085901 - DNA, 19 bp, Homo sapiens
aaaacatccacttaagttc

SEQ ID NO: 1085902 - DNA, 22 bp, Homo sapiens
aaaacatccacttaagttcttt

SEQ ID NO: 1085903 - DNA, 15 bp, Homo sapiens
aaaacatcccaaact

SEQ ID NO: 1085904 - DNA, 15 bp, Homo sapiens
aaaacattaagaaaa

SEQ ID NO: 1085905 - DNA, 19 bp, Homo sapiens
aaaacattctatctactga

SEQ ID NO: 1085906 - DNA, 22 bp, Homo sapiens
aaaacattgcctttgaatgtta

SEQ ID NO: 1085907 - DNA, 13 bp, Homo sapiens
aaaacatttattt

SEQ ID NO: 1085908 - DNA, 11 bp, Homo sapiens
aaaacatttct

SEQ ID NO: 1085909 - DNA, 16 bp, Homo sapiens
aaaacattttaaatga

SEQ ID NO: 1085910 - DNA, 18 bp, Homo sapiens
aaaacattttaaatgaaa

SEQ ID NO: 1085911 - DNA, 14 bp, Homo sapiens
aaaacattttttag

SEQ ID NO: 1085912 - DNA, 21 bp, Homo sapiens
aaaaccaaacttgttcattta

SEQ ID NO: 1085913 - DNA, 22 bp, Homo sapiens
aaaaccaaagagggcttcctct

SEQ ID NO: 1085914 - DNA, 16 bp, Homo sapiens
aaaaccacatgggctg

SEQ ID NO: 1085915 - DNA, 16 bp, Homo sapiens
aaaaccactagaactc

SEQ ID NO: 1085916 - DNA, 17 bp, Homo sapiens
aaaaccactagaactct

SEQ ID NO: 1085917 - DNA, 13 bp, Homo sapiens
aaaaccagttacc

SEQ ID NO: 1085918 - DNA, 17 bp, Homo sapiens
aaaaccatcaagttgtg

SEQ ID NO: 1085919 - DNA, 14 bp, Homo sapiens
aaaaccattgcttc

SEQ ID NO: 1085920 - DNA, 15 bp, Homo sapiens
aaaacccagagagga

SEQ ID NO: 1085921 - DNA, 18 bp, Homo sapiens
aaaacccccaataaacct

SEQ ID NO: 1085922 - DNA, 19 bp, Homo sapiens
aaaacccttgggccagaag

SEQ ID NO: 1085923 - DNA, 13 bp, Homo sapiens
aaaacctaaaggt

SEQ ID NO: 1085924 - DNA, 15 bp, Homo sapiens
aaaacctgcagttaa

SEQ ID NO: 1085925 - DNA, 13 bp, Homo sapiens
aaaaccttgtaaa

SEQ ID NO: 1085926 - DNA, 16 bp, Homo sapiens
aaaaccttgttctatt

SEQ ID NO: 1085927 - DNA, 13 bp, Homo sapiens
aaaaccttttact

SEQ ID NO: 1085928 - DNA, 14 bp, Homo sapiens
aaaacgaaaataaa

SEQ ID NO: 1085929 - DNA, 18 bp, Homo sapiens
aaaacgcatggagtgtgt

SEQ ID NO: 1085930 - DNA, 23 bp, Homo sapiens
aaaacgcctcttttccctctcta

SEQ ID NO: 1085931 - DNA, 19 bp, Homo sapiens
aaaacggatgagttattat

SEQ ID NO: 1085932 - DNA, 18 bp, Homo sapiens
aaaacgggttactaagat

SEQ ID NO: 1085933 - DNA, 14 bp, Homo sapiens
aaaacgtgatgttt

SEQ ID NO: 1085934 - DNA, 15 bp, Homo sapiens
aaaacgttttattgt

SEQ ID NO: 1085935 - DNA, 13 bp, Homo sapiens
aaaactaaaaact

SEQ ID NO: 1085936 - DNA, 19 bp, Homo sapiens
aaaactaaatctctaatat

SEQ ID NO: 1085937 - DNA, 19 bp, Homo sapiens
aaaactaatgtactgtaca

SEQ ID NO: 1085938 - DNA, 20 bp, Homo sapiens
aaaactaatgtactgtacat

SEQ ID NO: 1085939 - DNA, 17 bp, Homo sapiens
aaaactacttctttttt

SEQ ID NO: 1085940 - DNA, 11 bp, Homo sapiens
aaaactacttt

SEQ ID NO: 1085941 - DNA, 22 bp, Homo sapiens
aaaactagaggtgagaaattta

SEQ ID NO: 1085942 - DNA, 23 bp, Homo sapiens
aaaactataaaaaagaaagaatt

SEQ ID NO: 1085943 - DNA, 12 bp, Homo sapiens
aaaactatggtt

SEQ ID NO: 1085944 - DNA, 17 bp, Homo sapiens
aaaactatggttcccaa

SEQ ID NO: 1085945 - DNA, 17 bp, Homo sapiens
aaaactatttaaaattg

SEQ ID NO: 1085946 - DNA, 19 bp, Homo sapiens
aaaactatttattgtgctg

SEQ ID NO: 1085947 - DNA, 15 bp, Homo sapiens
aaaactcactgtgat

SEQ ID NO: 1085948 - DNA, 14 bp, Homo sapiens
aaaactcagaatat

SEQ ID NO: 1085949 - DNA, 13 bp, Homo sapiens
aaaactcataatt

SEQ ID NO: 1085950 - DNA, 15 bp, Homo sapiens
aaaactcatgatcaa

SEQ ID NO: 1085951 - DNA, 17 bp, Homo sapiens
aaaactcatgatcaaga

SEQ ID NO: 1085952 - DNA, 16 bp, Homo sapiens
aaaactccgcccccag

SEQ ID NO: 1085953 - DNA, 20 bp, Homo sapiens
aaaactccgcccccagccta

SEQ ID NO: 1085954 - DNA, 13 bp, Homo sapiens
aaaactcctgtgt

SEQ ID NO: 1085955 - DNA, 14 bp, Homo sapiens
aaaactcctgtgtc

SEQ ID NO: 1085956 - DNA, 12 bp, Homo sapiens
aaaactctactt

SEQ ID NO: 1085957 - DNA, 15 bp, Homo sapiens
aaaactctacttaat

SEQ ID NO: 1085958 - DNA, 18 bp, Homo sapiens
aaaactctacttaatcca

SEQ ID NO: 1085959 - DNA, 13 bp, Homo sapiens
aaaactctgggtc

SEQ ID NO: 1085960 - DNA, 16 bp, Homo sapiens
aaaactcttaatctgt

SEQ ID NO: 1085961 - DNA, 15 bp, Homo sapiens
aaaactcttcagtgc

SEQ ID NO: 1085962 - DNA, 18 bp, Homo sapiens
aaaactgaaaatctaata

SEQ ID NO: 1085963 - DNA, 16 bp, Homo sapiens
aaaactgactccttag

SEQ ID NO: 1085964 - DNA, 21 bp, Homo sapiens
aaaactgatgttactagcctc

SEQ ID NO: 1085965 - DNA, 18 bp, Homo sapiens
aaaactgcgaggacatca

SEQ ID NO: 1085966 - DNA, 20 bp, Homo sapiens
aaaactgctgactgttttct

SEQ ID NO: 1085967 - DNA, 18 bp, Homo sapiens
aaaactgctttgtgcata

SEQ ID NO: 1085968 - DNA, 20 bp, Homo sapiens
aaaactggtgggtctttaat

SEQ ID NO: 1085969 - DNA, 17 bp, Homo sapiens
aaaactgtacatttaaa

SEQ ID NO: 1085970 - DNA, 17 bp, Homo sapiens
aaaactgtgaccaagta

SEQ ID NO: 1085971 - DNA, 15 bp, Homo sapiens
aaaactgtgtaaacc

SEQ ID NO: 1085972 - DNA, 18 bp, Homo sapiens
aaaactgtgtaaaccaca

SEQ ID NO: 1085973 - DNA, 12 bp, Homo sapiens
aaaactgtgttg

SEQ ID NO: 1085974 - DNA, 15 bp, Homo sapiens
aaaactgttcttttg

SEQ ID NO: 1085975 - DNA, 16 bp, Homo sapiens
aaaacttaaagcaaaa

SEQ ID NO: 1085976 - DNA, 18 bp, Homo sapiens
aaaacttaaagcaaaata

SEQ ID NO: 1085977 - DNA, 20 bp, Homo sapiens
aaaacttatgctagtttatt

SEQ ID NO: 1085978 - DNA, 12 bp, Homo sapiens
aaaacttccttt

SEQ ID NO: 1085979 - DNA, 13 bp, Homo sapiens
aaaacttccttta

SEQ ID NO: 1085980 - DNA, 13 bp, Homo sapiens
aaaacttcttaga

SEQ ID NO: 1085981 - DNA, 20 bp, Homo sapiens
aaaacttgaaaatatatgat

SEQ ID NO: 1085982 - DNA, 20 bp, Homo sapiens
aaaacttggacccttggaaa

SEQ ID NO: 1085983 - DNA, 12 bp, Homo sapiens
aaaactttaaaa

SEQ ID NO: 1085984 - DNA, 14 bp, Homo sapiens
aaaactttaaaagg

SEQ ID NO: 1085985 - DNA, 19 bp, Homo sapiens
aaaactttaaagataagtc

SEQ ID NO: 1085986 - DNA, 13 bp, Homo sapiens
aaaactttaaagc

SEQ ID NO: 1085987 - DNA, 16 bp, Homo sapiens
aaaactttatgtactg

SEQ ID NO: 1085988 - DNA, 17 bp, Homo sapiens
aaaactttatgtactgc

SEQ ID NO: 1085989 - DNA, 12 bp, Homo sapiens
aaaactttattg

SEQ ID NO: 1085990 - DNA, 20 bp, Homo sapiens
aaaactttattttatataat

SEQ ID NO: 1085991 - DNA, 20 bp, Homo sapiens
aaaatagctaaatacctcaa

SEQ ID NO: 1085992 - DNA, 13 bp, Homo sapiens
aaaatagcttgta

SEQ ID NO: 1085993 - DNA, 21 bp, Homo sapiens
aaaatagcttgtatagtgtaa

SEQ ID NO: 1085994 - DNA, 12 bp, Homo sapiens
aaaataggcagg

SEQ ID NO: 1085995 - DNA, 13 bp, Homo sapiens
aaaataggcagga

SEQ ID NO: 1085996 - DNA, 16 bp, Homo sapiens
aaaataggctttttaa

SEQ ID NO: 1085997 - DNA, 21 bp, Homo sapiens
aaaataggctttttaatcatg

SEQ ID NO: 1085998 - DNA, 18 bp, Homo sapiens
aaaatagtaaatgctttg

SEQ ID NO: 1085999 - DNA, 13 bp, Homo sapiens
aaaatagtgtaag

SEQ ID NO: 1086000 - DNA, 19 bp, Homo sapiens
aaaatagtgtaagaactgt

SEQ ID NO: 1086001 - DNA, 17 bp, Homo sapiens
aaaatagtttaggaaaa

SEQ ID NO: 1086002 - DNA, 13 bp, Homo sapiens
aaaatagtttgga

SEQ ID NO: 1086003 - DNA, 22 bp, Homo sapiens
aaaatataaaactgcgttaaag

SEQ ID NO: 1086004 - DNA, 13 bp, Homo sapiens
aaaatataaaata

SEQ ID NO: 1086005 - DNA, 22 bp, Homo sapiens
aaaatataaggactttttgatg

SEQ ID NO: 1086006 - DNA, 13 bp, Homo sapiens
aaaatatagctaa

SEQ ID NO: 1086007 - DNA, 13 bp, Homo sapiens
aaaatatatatat

SEQ ID NO: 1086008 - DNA, 19 bp, Homo sapiens
aaaatatatatatatattt

SEQ ID NO: 1086009 - DNA, 21 bp, Homo sapiens
aaaatatatatatatatttaa

SEQ ID NO: 1086010 - DNA, 13 bp, Homo sapiens
aaaatatatatct

SEQ ID NO: 1086011 - DNA, 14 bp, Homo sapiens
aaaatatatatcta

SEQ ID NO: 1086012 - DNA, 17 bp, Homo sapiens
aaaatatatctggaact

SEQ ID NO: 1086013 - DNA, 12 bp, Homo sapiens
aaaatatatctt

SEQ ID NO: 1086014 - DNA, 13 bp, Homo sapiens
aaaatatatgtat

SEQ ID NO: 1086015 - DNA, 15 bp, Homo sapiens
aaaatatatgtattt

SEQ ID NO: 1086016 - DNA, 21 bp, Homo sapiens
aaaatatatgttctgcaagaa

SEQ ID NO: 1086017 - DNA, 19 bp, Homo sapiens
aaaatatattgctgcattt

SEQ ID NO: 1086018 - DNA, 18 bp, Homo sapiens
aaaatatatttataagga

SEQ ID NO: 1086019 - DNA, 19 bp, Homo sapiens
aaaatatcagacaagcact

SEQ ID NO: 1086020 - DNA, 12 bp, Homo sapiens
aaaatatctcct

SEQ ID NO: 1086021 - DNA, 12 bp, Homo sapiens
aaaatatcttgg

SEQ ID NO: 1086022 - DNA, 19 bp, Homo sapiens
aaaatatgaacctattttc

SEQ ID NO: 1086023 - DNA, 21 bp, Homo sapiens
aaaatatggaacttctaatat

SEQ ID NO: 1086024 - DNA, 14 bp, Homo sapiens
aaaatatgtaattt

SEQ ID NO: 1086025 - DNA, 12 bp, Homo sapiens
aaaatatgtatg

SEQ ID NO: 1086026 - DNA, 22 bp, Homo sapiens
aaaatatgtatgtctaattgag

SEQ ID NO: 1086027 - DNA, 13 bp, Homo sapiens
aaaatatgtcaac

SEQ ID NO: 1086028 - DNA, 16 bp, Homo sapiens
aaaatatgtgaagttt

SEQ ID NO: 1086029 - DNA, 19 bp, Homo sapiens
aaaatattataacttaaaa

SEQ ID NO: 1086030 - DNA, 14 bp, Homo sapiens
aaaatattctctat

SEQ ID NO: 1086031 - DNA, 21 bp, Homo sapiens
aaaatattgctaaaagtgcat

SEQ ID NO: 1086032 - DNA, 16 bp, Homo sapiens
aaaatattgtttctgc

SEQ ID NO: 1086033 - DNA, 23 bp, Homo sapiens
aaaatattgtttctgcattcatt

SEQ ID NO: 1086034 - DNA, 20 bp, Homo sapiens
aaaatatttaaaaatgtctt

SEQ ID NO: 1086035 - DNA, 13 bp, Homo sapiens
aaaatatttcaga

SEQ ID NO: 1086036 - DNA, 20 bp, Homo sapiens
aaaatatttctatgtaaatt

SEQ ID NO: 1086037 - DNA, 14 bp, Homo sapiens
aaaatatttggaat

SEQ ID NO: 1086038 - DNA, 15 bp, Homo sapiens
aaaatatttgtacat

SEQ ID NO: 1086039 - DNA, 19 bp, Homo sapiens
aaaatatttgtctttaaac

SEQ ID NO: 1086040 - DNA, 15 bp, Homo sapiens
aaaatattttaagaa

SEQ ID NO: 1086041 - DNA, 16 bp, Homo sapiens
aaaatattttaagaaa

SEQ ID NO: 1086042 - DNA, 13 bp, Homo sapiens
aaaatattttaga

SEQ ID NO: 1086043 - DNA, 13 bp, Homo sapiens
aaaatattttata

SEQ ID NO: 1086044 - DNA, 16 bp, Homo sapiens
aaaatattttcctgcc

SEQ ID NO: 1086045 - DNA, 13 bp, Homo sapiens
aaaatattttgaa

SEQ ID NO: 1086046 - DNA, 18 bp, Homo sapiens
aaaatattttgtctaaaa

SEQ ID NO: 1086047 - DNA, 22 bp, Homo sapiens
aaaatattttgttaacttttgt

SEQ ID NO: 1086048 - DNA, 23 bp, Homo sapiens
aaaatattttttatatatacagt

SEQ ID NO: 1086049 - DNA, 17 bp, Homo sapiens
aaaatattttttctgta

SEQ ID NO: 1086050 - DNA, 18 bp, Homo sapiens
aaaatcaaagaacagatg

SEQ ID NO: 1086051 - DNA, 14 bp, Homo sapiens
aaaatcaacatgac

SEQ ID NO: 1086052 - DNA, 15 bp, Homo sapiens
aaaatcaacttgtgt

SEQ ID NO: 1086053 - DNA, 16 bp, Homo sapiens
aaaatcaacttgtgta

SEQ ID NO: 1086054 - DNA, 10 bp, Homo sapiens
aaaatcaaga

SEQ ID NO: 1086055 - DNA, 16 bp, Homo sapiens
aaaatcaagagtgaga

SEQ ID NO: 1086056 - DNA, 24 bp, Homo sapiens
aaaatcaagagtgagatgtagaaa

SEQ ID NO: 1086057 - DNA, 12 bp, Homo sapiens
aaaatcaatcaa

SEQ ID NO: 1086058 - DNA, 13 bp, Homo sapiens
aaaatcaatcaat

SEQ ID NO: 1086059 - DNA, 15 bp, Homo sapiens
aaaatcaattaacca

SEQ ID NO: 1086060 - DNA, 16 bp, Homo sapiens
aaaatcacaaaaacaa

SEQ ID NO: 1086061 - DNA, 17 bp, Homo sapiens
aaaatcacaaaaacaaa

SEQ ID NO: 1086062 - DNA, 14 bp, Homo sapiens
aaaatcacaaaaat

SEQ ID NO: 1086063 - DNA, 16 bp, Homo sapiens
aaaatcacattttaag

SEQ ID NO: 1086064 - DNA, 13 bp, Homo sapiens
aaaatcactgtca

SEQ ID NO: 1086065 - DNA, 17 bp, Homo sapiens
aaaatcactttcataat

SEQ ID NO: 1086066 - DNA, 20 bp, Homo sapiens
aaaatcactttcataatctt

SEQ ID NO: 1086067 - DNA, 21 bp, Homo sapiens
aaaatcagcctgctccagctg

SEQ ID NO: 1086068 - DNA, 18 bp, Homo sapiens
aaaatcagctattttgtg

SEQ ID NO: 1086069 - DNA, 18 bp, Homo sapiens
aaaatcaggaaaggctgt

SEQ ID NO: 1086070 - DNA, 15 bp, Homo sapiens
aaaatcagtttttca

SEQ ID NO: 1086071 - DNA, 16 bp, Homo sapiens
aaaatcagtttttcat

SEQ ID NO: 1086072 - DNA, 22 bp, Homo sapiens
aaaatcatgatccttgtgttca

SEQ ID NO: 1086073 - DNA, 18 bp, Homo sapiens
aaaatcatgccagtattt

SEQ ID NO: 1086074 - DNA, 12 bp, Homo sapiens
aaaatcattgat

SEQ ID NO: 1086075 - DNA, 18 bp, Homo sapiens
aaaatccaaaaagctctg

SEQ ID NO: 1086076 - DNA, 16 bp, Homo sapiens
aaaatccaaaatgaat

SEQ ID NO: 1086077 - DNA, 18 bp, Homo sapiens
aaaatccatagatttatt

SEQ ID NO: 1086078 - DNA, 19 bp, Homo sapiens
aaaatccatagatttattt

SEQ ID NO: 1086079 - DNA, 17 bp, Homo sapiens
aaaatccccttcgctga

SEQ ID NO: 1086080 - DNA, 16 bp, Homo sapiens
aaaatcctaagacaca

SEQ ID NO: 1086081 - DNA, 21 bp, Homo sapiens
aaaatcctaagacacaaatgc

SEQ ID NO: 1086082 - DNA, 22 bp, Homo sapiens
aaaatcctaagacacaaatgca

SEQ ID NO: 1086083 - DNA, 20 bp, Homo sapiens
aaaatcctatatctgtttgt

SEQ ID NO: 1086084 - DNA, 18 bp, Homo sapiens
aaaatcctcaacactatt

SEQ ID NO: 1086085 - DNA, 16 bp, Homo sapiens
aaaatcctcttcctct

SEQ ID NO: 1086086 - DNA, 23 bp, Homo sapiens
aaaatcctgaactttctccctca

SEQ ID NO: 1086087 - DNA, 14 bp, Homo sapiens
aaaatcctgaataa

SEQ ID NO: 1086088 - DNA, 14 bp, Homo sapiens
aaaatcctggaaga

SEQ ID NO: 1086089 - DNA, 17 bp, Homo sapiens
aaaatccttttgaatga

SEQ ID NO: 1086090 - DNA, 16 bp, Homo sapiens
aaaatctaaaacaaaa

SEQ ID NO: 1086091 - DNA, 22 bp, Homo sapiens
aaaatctaaaacaaaatctgaa

SEQ ID NO: 1086092 - DNA, 15 bp, Homo sapiens
aaaatctaatattaa

SEQ ID NO: 1086093 - DNA, 22 bp, Homo sapiens
aaaatctagtgggttgaccttt

SEQ ID NO: 1086094 - DNA, 12 bp, Homo sapiens
aaaatctagttt

SEQ ID NO: 1086095 - DNA, 22 bp, Homo sapiens
aaaatctagttttggcaagaag

SEQ ID NO: 1086096 - DNA, 18 bp, Homo sapiens
aaaatctcaaatttctaa

SEQ ID NO: 1086097 - DNA, 19 bp, Homo sapiens
aaaatctcccattttggaa

SEQ ID NO: 1086098 - DNA, 14 bp, Homo sapiens
aaaatctcctaaat

SEQ ID NO: 1086099 - DNA, 15 bp, Homo sapiens
aaaatctcttgatta

SEQ ID NO: 1086100 - DNA, 16 bp, Homo sapiens
aaaatctgagggaaat

SEQ ID NO: 1086101 - DNA, 15 bp, Homo sapiens
aaaatctgattagaa

SEQ ID NO: 1086102 - DNA, 12 bp, Homo sapiens
aaaatctgattt

SEQ ID NO: 1086103 - DNA, 16 bp, Homo sapiens
aaaatctgatttaatg

SEQ ID NO: 1086104 - DNA, 12 bp, Homo sapiens
aaaatctgtcca

SEQ ID NO: 1086105 - DNA, 19 bp, Homo sapiens
aaaatctgtttgatccctg

SEQ ID NO: 1086106 - DNA, 14 bp, Homo sapiens
aaaatcttataaaa

SEQ ID NO: 1086107 - DNA, 16 bp, Homo sapiens
aaaatcttcatggaat

SEQ ID NO: 1086108 - DNA, 18 bp, Homo sapiens
aaaatcttggcacagaaa

SEQ ID NO: 1086109 - DNA, 18 bp, Homo sapiens
aaaatcttgtgctagaat

SEQ ID NO: 1086110 - DNA, 19 bp, Homo sapiens
aaaatcttgtgctagaata

SEQ ID NO: 1086111 - DNA, 20 bp, Homo sapiens
aaaatctttaggctttcaaa

SEQ ID NO: 1086112 - DNA, 16 bp, Homo sapiens
aaaatgaaaagcaata

SEQ ID NO: 1086113 - DNA, 16 bp, Homo sapiens
aaaatgaaaattgtat

SEQ ID NO: 1086114 - DNA, 18 bp, Homo sapiens
aaacacagggttttgtat

SEQ ID NO: 1086115 - DNA, 20 bp, Homo sapiens
aaacacagtcaaaataattc

SEQ ID NO: 1086116 - DNA, 18 bp, Homo sapiens
aaacacagttacacttgt

SEQ ID NO: 1086117 - DNA, 19 bp, Homo sapiens
aaacacatagattcacctg

SEQ ID NO: 1086118 - DNA, 22 bp, Homo sapiens
aaacacatagattcacctgtaa

SEQ ID NO: 1086119 - DNA, 16 bp, Homo sapiens
aaacacatcttcccta

SEQ ID NO: 1086120 - DNA, 18 bp, Homo sapiens
aaacacatctttcctgtc

SEQ ID NO: 1086121 - DNA, 23 bp, Homo sapiens
aaacacattcttattaattcttc

SEQ ID NO: 1086122 - DNA, 11 bp, Homo sapiens
aaacacatttt

SEQ ID NO: 1086123 - DNA, 12 bp, Homo sapiens
aaacacattttt

SEQ ID NO: 1086124 - DNA, 16 bp, Homo sapiens
aaacacatttttctta

SEQ ID NO: 1086125 - DNA, 19 bp, Homo sapiens
aaacaccaacataaaaatg

SEQ ID NO: 1086126 - DNA, 14 bp, Homo sapiens
aaacacccctctgt

SEQ ID NO: 1086127 - DNA, 18 bp, Homo sapiens
aaacacctcctcatgtac

SEQ ID NO: 1086128 - DNA, 13 bp, Homo sapiens
aaacaccttctct

SEQ ID NO: 1086129 - DNA, 23 bp, Homo sapiens
aaacacgaaacttgttattgtga

SEQ ID NO: 1086130 - DNA, 19 bp, Homo sapiens
aaacactaaggctgcttca

SEQ ID NO: 1086131 - DNA, 20 bp, Homo sapiens
aaacactacctcttttgaga

SEQ ID NO: 1086132 - DNA, 22 bp, Homo sapiens
aaacactcaagttgattagaaa

SEQ ID NO: 1086133 - DNA, 19 bp, Homo sapiens
aaacactcaataaattgca

SEQ ID NO: 1086134 - DNA, 19 bp, Homo sapiens
aaacactccacagtgttta

SEQ ID NO: 1086135 - DNA, 21 bp, Homo sapiens
aaacactccacagtgtttata

SEQ ID NO: 1086136 - DNA, 20 bp, Homo sapiens
aaacactccaccctccacct

SEQ ID NO: 1086137 - DNA, 17 bp, Homo sapiens
aaacactgaatcatgtt

SEQ ID NO: 1086138 - DNA, 18 bp, Homo sapiens
aaacactgcagtttcctg

SEQ ID NO: 1086139 - DNA, 19 bp, Homo sapiens
aaacactgcagtttcctgg

SEQ ID NO: 1086140 - DNA, 14 bp, Homo sapiens
aaacactgcctgcc

SEQ ID NO: 1086141 - DNA, 23 bp, Homo sapiens
aaacactgtaatcttaaaagtgt

SEQ ID NO: 1086142 - DNA, 13 bp, Homo sapiens
aaacactgtggaa

SEQ ID NO: 1086143 - DNA, 13 bp, Homo sapiens
aaacacttagtat

SEQ ID NO: 1086144 - DNA, 17 bp, Homo sapiens
aaacacttctgctttca

SEQ ID NO: 1086145 - DNA, 14 bp, Homo sapiens
aaacactttcaaaa

SEQ ID NO: 1086146 - DNA, 13 bp, Homo sapiens
aaacactttctct

SEQ ID NO: 1086147 - DNA, 14 bp, Homo sapiens
aaacagaaaaaaag

SEQ ID NO: 1086148 - DNA, 13 bp, Homo sapiens
aaacagaaacaaa

SEQ ID NO: 1086149 - DNA, 15 bp, Homo sapiens
aaacagaacagggtc

SEQ ID NO: 1086150 - DNA, 12 bp, Homo sapiens
aaacagaagcct

SEQ ID NO: 1086151 - DNA, 17 bp, Homo sapiens
aaacagaatcagtgtta

SEQ ID NO: 1086152 - DNA, 13 bp, Homo sapiens
aaacagaatttga

SEQ ID NO: 1086153 - DNA, 16 bp, Homo sapiens
aaacagacaatatgtg

SEQ ID NO: 1086154 - DNA, 14 bp, Homo sapiens
aaacagactcaggt

SEQ ID NO: 1086155 - DNA, 13 bp, Homo sapiens
aaacagagaaaga

SEQ ID NO: 1086156 - DNA, 17 bp, Homo sapiens
aaacagagaaagaaaag

SEQ ID NO: 1086157 - DNA, 18 bp, Homo sapiens
aaacagagaaagaaaagg

SEQ ID NO: 1086158 - DNA, 18 bp, Homo sapiens
aaacagagaaagggtaat

SEQ ID NO: 1086159 - DNA, 16 bp, Homo sapiens
aaacagagatgtgata

SEQ ID NO: 1086160 - DNA, 14 bp, Homo sapiens
aaacagagtatttc

SEQ ID NO: 1086161 - DNA, 20 bp, Homo sapiens
aaacagagtccaatttaagg

SEQ ID NO: 1086162 - DNA, 22 bp, Homo sapiens
aaacagagtggcctccctgctg

SEQ ID NO: 1086163 - DNA, 12 bp, Homo sapiens
aaacagatataa

SEQ ID NO: 1086164 - DNA, 17 bp, Homo sapiens
aaacagatgaaaagcct

SEQ ID NO: 1086165 - DNA, 21 bp, Homo sapiens
aaacagattcaggccagccca

SEQ ID NO: 1086166 - DNA, 12 bp, Homo sapiens
aaacagattctg

SEQ ID NO: 1086167 - DNA, 14 bp, Homo sapiens
aaacagattctgat

SEQ ID NO: 1086168 - DNA, 14 bp, Homo sapiens
aaacagcagctcat

SEQ ID NO: 1086169 - DNA, 11 bp, Homo sapiens
aaacagcatga

SEQ ID NO: 1086170 - DNA, 16 bp, Homo sapiens
aaacagcattgctttc

SEQ ID NO: 1086171 - DNA, 20 bp, Homo sapiens
aaacagccaccgtttcttcc

SEQ ID NO: 1086172 - DNA, 23 bp, Homo sapiens
aaacagccgtcagccaaatgtaa

SEQ ID NO: 1086173 - DNA, 11 bp, Homo sapiens
aaacagcctgg

SEQ ID NO: 1086174 - DNA, 20 bp, Homo sapiens
aaacagctgaaagaggagga

SEQ ID NO: 1086175 - DNA, 18 bp, Homo sapiens
aaacagctgcattagaaa

SEQ ID NO: 1086176 - DNA, 16 bp, Homo sapiens
aaacaggaaaaaaact

SEQ ID NO: 1086177 - DNA, 12 bp, Homo sapiens
aaacaggatcag

SEQ ID NO: 1086178 - DNA, 16 bp, Homo sapiens
aaacaggctccaagag

SEQ ID NO: 1086179 - DNA, 17 bp, Homo sapiens
aaacagggccacataga

SEQ ID NO: 1086180 - DNA, 23 bp, Homo sapiens
aaacaggtatatactttgaaagg

SEQ ID NO: 1086181 - DNA, 20 bp, Homo sapiens
aaacaggtgtgtgtgaactg

SEQ ID NO: 1086182 - DNA, 23 bp, Homo sapiens
aaacaggtttttgattttgaata

SEQ ID NO: 1086183 - DNA, 20 bp, Homo sapiens
aaacagtaatctaggtgtgg

SEQ ID NO: 1086184 - DNA, 15 bp, Homo sapiens
aaacagtatttcatt

SEQ ID NO: 1086185 - DNA, 17 bp, Homo sapiens
aaacagtgagcatatct

SEQ ID NO: 1086186 - DNA, 12 bp, Homo sapiens
aaacagtgcctg

SEQ ID NO: 1086187 - DNA, 11 bp, Homo sapiens
aaacagttcca

SEQ ID NO: 1086188 - DNA, 16 bp, Homo sapiens
aaacagttcttggacc

SEQ ID NO: 1086189 - DNA, 15 bp, Homo sapiens
aaacagttgctgtga

SEQ ID NO: 1086190 - DNA, 22 bp, Homo sapiens
aaacagttgctgtgaactttca

SEQ ID NO: 1086191 - DNA, 16 bp, Homo sapiens
aaacagttggtaactt

SEQ ID NO: 1086192 - DNA, 22 bp, Homo sapiens
aaacagttggtaacttttgtga

SEQ ID NO: 1086193 - DNA, 14 bp, Homo sapiens
aaacataaaaagca

SEQ ID NO: 1086194 - DNA, 21 bp, Homo sapiens
aaacataaaaagcagaatttt

SEQ ID NO: 1086195 - DNA, 22 bp, Homo sapiens
aaacataaaaagcagaatttta

SEQ ID NO: 1086196 - DNA, 16 bp, Homo sapiens
aaacataagagagcct

SEQ ID NO: 1086197 - DNA, 13 bp, Homo sapiens
aaacataataata

SEQ ID NO: 1086198 - DNA, 13 bp, Homo sapiens
aaacataattctt

SEQ ID NO: 1086199 - DNA, 21 bp, Homo sapiens
aaacataattcttgtatatta

SEQ ID NO: 1086200 - DNA, 20 bp, Homo sapiens
aaacataattgtggattata

SEQ ID NO: 1086201 - DNA, 12 bp, Homo sapiens
aaacatacagag

SEQ ID NO: 1086202 - DNA, 18 bp, Homo sapiens
aaacatacttacatttca

SEQ ID NO: 1086203 - DNA, 23 bp, Homo sapiens
aaacatatcatggtaatgacaga

SEQ ID NO: 1086204 - DNA, 14 bp, Homo sapiens
aaacatatctctta

SEQ ID NO: 1086205 - DNA, 15 bp, Homo sapiens
aaacatatttcattt

SEQ ID NO: 1086206 - DNA, 20 bp, Homo sapiens
aaacatatttttatacttta

SEQ ID NO: 1086207 - DNA, 21 bp, Homo sapiens
aaacatcacattccagtctga

SEQ ID NO: 1086208 - DNA, 17 bp, Homo sapiens
aaacatcagacctgtct

SEQ ID NO: 1086209 - DNA, 18 bp, Homo sapiens
aaacatcagacctgtctt

SEQ ID NO: 1086210 - DNA, 14 bp, Homo sapiens
aaacatcagtttct

SEQ ID NO: 1086211 - DNA, 19 bp, Homo sapiens
aaacatcattcatttttgt

SEQ ID NO: 1086212 - DNA, 19 bp, Homo sapiens
aaacatccaatattttctt

SEQ ID NO: 1086213 - DNA, 18 bp, Homo sapiens
aaacatccacttaagttc

SEQ ID NO: 1086214 - DNA, 20 bp, Homo sapiens
aaacatccacttaagttctt

SEQ ID NO: 1086215 - DNA, 14 bp, Homo sapiens
aaacatcccaaact

SEQ ID NO: 1086216 - DNA, 15 bp, Homo sapiens
aaacatcccaaactt

SEQ ID NO: 1086217 - DNA, 16 bp, Homo sapiens
aaacatcccaaacttt

SEQ ID NO: 1086218 - DNA, 18 bp, Homo sapiens
aaacatcctacaagacac

SEQ ID NO: 1086219 - DNA, 20 bp, Homo sapiens
aaacatccttcaagaactct

SEQ ID NO: 1086220 - DNA, 16 bp, Homo sapiens
aaacatgaagcataat

SEQ ID NO: 1086221 - DNA, 22 bp, Homo sapiens
aaacatgctacacactgcatgt

SEQ ID NO: 1086222 - DNA, 19 bp, Homo sapiens
aaacatgcttgaataactg

SEQ ID NO: 1086223 - DNA, 15 bp, Homo sapiens
aaacatggaaaacag

SEQ ID NO: 1086224 - DNA, 21 bp, Homo sapiens
aaacatggtagaattggagag

SEQ ID NO: 1086225 - DNA, 19 bp, Homo sapiens
aaacatgtttaaatagcct

SEQ ID NO: 1086226 - DNA, 20 bp, Homo sapiens
aaacatgtttatttttcttg

SEQ ID NO: 1086227 - DNA, 13 bp, Homo sapiens
aaacattaaacac

SEQ ID NO: 1086228 - DNA, 15 bp, Homo sapiens
aaacattaaacactg

SEQ ID NO: 1086229 - DNA, 12 bp, Homo sapiens
aaacattaagaa

SEQ ID NO: 1086230 - DNA, 13 bp, Homo sapiens
aaacattaagaaa

SEQ ID NO: 1086231 - DNA, 15 bp, Homo sapiens
aaacattaagaaaat

SEQ ID NO: 1086232 - DNA, 20 bp, Homo sapiens
aaacattaagaaaatcatat

SEQ ID NO: 1086233 - DNA, 22 bp, Homo sapiens
aaacattaatagcagcctttct

SEQ ID NO: 1086234 - DNA, 17 bp, Homo sapiens
aaacattagtgaaaatt

SEQ ID NO: 1086235 - DNA, 12 bp, Homo sapiens
aaacattcactt

SEQ ID NO: 1086236 - DNA, 14 bp, Homo sapiens
aaacattcatgtaa

SEQ ID NO: 1086237 - DNA, 14 bp, Homo sapiens
aaactctgggtctt

SEQ ID NO: 1086238 - DNA, 22 bp, Homo sapiens
aaactctgggtcttggccatga

SEQ ID NO: 1086239 - DNA, 12 bp, Homo sapiens
aaactcttaaaa

SEQ ID NO: 1086240 - DNA, 12 bp, Homo sapiens
aaactcttcagt

SEQ ID NO: 1086241 - DNA, 13 bp, Homo sapiens
aaactcttcagtg

SEQ ID NO: 1086242 - DNA, 14 bp, Homo sapiens
aaactctttaactt

SEQ ID NO: 1086243 - DNA, 13 bp, Homo sapiens
aaactcttttccc

SEQ ID NO: 1086244 - DNA, 13 bp, Homo sapiens
aaactgaaagtgt

SEQ ID NO: 1086245 - DNA, 23 bp, Homo sapiens
aaactgaaagtgttttactcttt

SEQ ID NO: 1086246 - DNA, 17 bp, Homo sapiens
aaactgaagaattttga

SEQ ID NO: 1086247 - DNA, 21 bp, Homo sapiens
aaactgaagatgaaatatata

SEQ ID NO: 1086248 - DNA, 17 bp, Homo sapiens
aaactgaagcaacttga

SEQ ID NO: 1086249 - DNA, 14 bp, Homo sapiens
aaactgaagccaga

SEQ ID NO: 1086250 - DNA, 18 bp, Homo sapiens
aaactgaatattttggaa

SEQ ID NO: 1086251 - DNA, 14 bp, Homo sapiens
aaactgaatgaatc

SEQ ID NO: 1086252 - DNA, 14 bp, Homo sapiens
aaactgaatggaag

SEQ ID NO: 1086253 - DNA, 20 bp, Homo sapiens
aaactgacagtattaagggt

SEQ ID NO: 1086254 - DNA, 19 bp, Homo sapiens
aaactgacatgccctccct

SEQ ID NO: 1086255 - DNA, 21 bp, Homo sapiens
aaactgagctcgcagcccccg

SEQ ID NO: 1086256 - DNA, 18 bp, Homo sapiens
aaactgaggaattttctt

SEQ ID NO: 1086257 - DNA, 20 bp, Homo sapiens
aaactgaggtatggccatgc

SEQ ID NO: 1086258 - DNA, 20 bp, Homo sapiens
aaactgagtccatgaaaata

SEQ ID NO: 1086259 - DNA, 21 bp, Homo sapiens
aaactgagtccatgaaaatac

SEQ ID NO: 1086260 - DNA, 22 bp, Homo sapiens
aaactgatccagtataagacta

SEQ ID NO: 1086261 - DNA, 16 bp, Homo sapiens
aaactgatctaaaatg

SEQ ID NO: 1086262 - DNA, 12 bp, Homo sapiens
aaactgcaatag

SEQ ID NO: 1086263 - DNA, 17 bp, Homo sapiens
aaactgcaatagagact

SEQ ID NO: 1086264 - DNA, 22 bp, Homo sapiens
aaactgcaatagagactgtaga

SEQ ID NO: 1086265 - DNA, 15 bp, Homo sapiens
aaactgcacagtgct

SEQ ID NO: 1086266 - DNA, 17 bp, Homo sapiens
aaactgcacagtgctgt

SEQ ID NO: 1086267 - DNA, 22 bp, Homo sapiens
aaactgcacagtgctgttggtg

SEQ ID NO: 1086268 - DNA, 15 bp, Homo sapiens
aaactgcagcctctc

SEQ ID NO: 1086269 - DNA, 17 bp, Homo sapiens
aaactgcattagaaatt

SEQ ID NO: 1086270 - DNA, 11 bp, Homo sapiens
aaactgcattt

SEQ ID NO: 1086271 - DNA, 18 bp, Homo sapiens
aaactgcgaggacatcaa

SEQ ID NO: 1086272 - DNA, 21 bp, Homo sapiens
aaactgcgaggacatcaaagt

SEQ ID NO: 1086273 - DNA, 17 bp, Homo sapiens
aaactgcgttaaaggct

SEQ ID NO: 1086274 - DNA, 15 bp, Homo sapiens
aaactgctgcatact

SEQ ID NO: 1086275 - DNA, 16 bp, Homo sapiens
aaactgctttgtgcat

SEQ ID NO: 1086276 - DNA, 17 bp, Homo sapiens
aaactgctttgtgcata

SEQ ID NO: 1086277 - DNA, 23 bp, Homo sapiens
aaactgcttttttttttccagca

SEQ ID NO: 1086278 - DNA, 21 bp, Homo sapiens
aaactggattaaaacaatttt

SEQ ID NO: 1086279 - DNA, 22 bp, Homo sapiens
aaactggattaaaacaattttt

SEQ ID NO: 1086280 - DNA, 20 bp, Homo sapiens
aaactggcaaacttcagact

SEQ ID NO: 1086281 - DNA, 21 bp, Homo sapiens
aaactggcatctgacacaaaa

SEQ ID NO: 1086282 - DNA, 15 bp, Homo sapiens
aaactggccccggat

SEQ ID NO: 1086283 - DNA, 15 bp, Homo sapiens
aaactggcctgactt

SEQ ID NO: 1086284 - DNA, 13 bp, Homo sapiens
aaactggctttgg

SEQ ID NO: 1086285 - DNA, 13 bp, Homo sapiens
aaactgggaaggc

SEQ ID NO: 1086286 - DNA, 17 bp, Homo sapiens
aaactggggcctccaga

SEQ ID NO: 1086287 - DNA, 18 bp, Homo sapiens
aaactggggcctccagaa

SEQ ID NO: 1086288 - DNA, 22 bp, Homo sapiens
aaactggtttgttgcagccaaa

SEQ ID NO: 1086289 - DNA, 20 bp, Homo sapiens
aaactgtaaatatgtttgtg

SEQ ID NO: 1086290 - DNA, 12 bp, Homo sapiens
aaactgtacagt

SEQ ID NO: 1086291 - DNA, 16 bp, Homo sapiens
aaactgtacagtgtct

SEQ ID NO: 1086292 - DNA, 16 bp, Homo sapiens
aaactgtacatttaaa

SEQ ID NO: 1086293 - DNA, 16 bp, Homo sapiens
aaactgtagaaatgat

SEQ ID NO: 1086294 - DNA, 18 bp, Homo sapiens
aaactgtagaaatgatga

SEQ ID NO: 1086295 - DNA, 21 bp, Homo sapiens
aaactgtagcgaccccagact

SEQ ID NO: 1086296 - DNA, 21 bp, Homo sapiens
aaactgtatcaaatctgtata

SEQ ID NO: 1086297 - DNA, 15 bp, Homo sapiens
aaactgtcactgttg

SEQ ID NO: 1086298 - DNA, 15 bp, Homo sapiens
aaactgtctgtctcc

SEQ ID NO: 1086299 - DNA, 19 bp, Homo sapiens
aaactgtctttaaaagaga

SEQ ID NO: 1086300 - DNA, 21 bp, Homo sapiens
aaactgtgcaactttttaaag

SEQ ID NO: 1086301 - DNA, 22 bp, Homo sapiens
aaactgtgcaactttttaaagt

SEQ ID NO: 1086302 - DNA, 16 bp, Homo sapiens
aaactgtggcaactga

SEQ ID NO: 1086303 - DNA, 20 bp, Homo sapiens
aaactgtgtatcattaaaat

SEQ ID NO: 1086304 - DNA, 21 bp, Homo sapiens
aaactgtgtatcattaaaata

SEQ ID NO: 1086305 - DNA, 22 bp, Homo sapiens
aaactgtgtatcattaaaatat

SEQ ID NO: 1086306 - DNA, 19 bp, Homo sapiens
aaactgtgtggactgtgat

SEQ ID NO: 1086307 - DNA, 16 bp, Homo sapiens
aaactgtgttgccaca

SEQ ID NO: 1086308 - DNA, 23 bp, Homo sapiens
aaactgttctctattagacttta

SEQ ID NO: 1086309 - DNA, 12 bp, Homo sapiens
aaactgttcttt

SEQ ID NO: 1086310 - DNA, 18 bp, Homo sapiens
aaactgttcttttgcatt

SEQ ID NO: 1086311 - DNA, 15 bp, Homo sapiens
aaactgttgttttgt

SEQ ID NO: 1086312 - DNA, 16 bp, Homo sapiens
aaactgttgttttgta

SEQ ID NO: 1086313 - DNA, 14 bp, Homo sapiens
aaactgtttgaaaa

SEQ ID NO: 1086314 - DNA, 20 bp, Homo sapiens
aaactgttttagacctataa

SEQ ID NO: 1086315 - DNA, 15 bp, Homo sapiens
aaactgtttttacta

SEQ ID NO: 1086316 - DNA, 12 bp, Homo sapiens
aaacttaaagca

SEQ ID NO: 1086317 - DNA, 16 bp, Homo sapiens
aaacttaaatgttatt

SEQ ID NO: 1086318 - DNA, 17 bp, Homo sapiens
aaacttaaatgttatta

SEQ ID NO: 1086319 - DNA, 21 bp, Homo sapiens
aaacttaaatgttattatctg

SEQ ID NO: 1086320 - DNA, 18 bp, Homo sapiens
aaacttaagatgggcctg

SEQ ID NO: 1086321 - DNA, 22 bp, Homo sapiens
aaacttacctataaattaagaa

SEQ ID NO: 1086322 - DNA, 13 bp, Homo sapiens
aaacttcaaagct

SEQ ID NO: 1086323 - DNA, 20 bp, Homo sapiens
aaacttcagttgatcttctt

SEQ ID NO: 1086324 - DNA, 20 bp, Homo sapiens
aaacttcagtttcacagaaa

SEQ ID NO: 1086325 - DNA, 16 bp, Homo sapiens
aaacttcatgtaattt

SEQ ID NO: 1086326 - DNA, 21 bp, Homo sapiens
aaacttcatgtaattttattt

SEQ ID NO: 1086327 - DNA, 20 bp, Homo sapiens
aaacttccaaacagtgtgtt

SEQ ID NO: 1086328 - DNA, 18 bp, Homo sapiens
aaacttccaaagaaagtt

SEQ ID NO: 1086329 - DNA, 13 bp, Homo sapiens
aaacttgaaatat

SEQ ID NO: 1086330 - DNA, 15 bp, Homo sapiens
aaacttgaaatatat

SEQ ID NO: 1086331 - DNA, 18 bp, Homo sapiens
aaacttgctttatgcctt

SEQ ID NO: 1086332 - DNA, 16 bp, Homo sapiens
aaacttggaatcaagg

SEQ ID NO: 1086333 - DNA, 17 bp, Homo sapiens
aaacttggatacttgga

SEQ ID NO: 1086334 - DNA, 16 bp, Homo sapiens
aaacttggatggactt

SEQ ID NO: 1086335 - DNA, 14 bp, Homo sapiens
aaacttggctggaa

SEQ ID NO: 1086336 - DNA, 23 bp, Homo sapiens
aaacttggtgacttgatccacta

SEQ ID NO: 1086337 - DNA, 21 bp, Homo sapiens
aaacttgtgctatagtgtata

SEQ ID NO: 1086338 - DNA, 24 bp, Homo sapiens
aaacttgtggcctcaagcaatcca

SEQ ID NO: 1086339 - DNA, 16 bp, Homo sapiens
aaacttgttattgtga

SEQ ID NO: 1086340 - DNA, 17 bp, Homo sapiens
aaacttgttattgtgaa

SEQ ID NO: 1086341 - DNA, 21 bp, Homo sapiens
aaacttgttattgtgaatgat

SEQ ID NO: 1086342 - DNA, 13 bp, Homo sapiens
aaacttgttcatt

SEQ ID NO: 1086343 - DNA, 16 bp, Homo sapiens
aaactttaaaatgcga

SEQ ID NO: 1086344 - DNA, 17 bp, Homo sapiens
aaactttaaaatgcgaa

SEQ ID NO: 1086345 - DNA, 22 bp, Homo sapiens
aaactttaaagcgtttgcacag

SEQ ID NO: 1086346 - DNA, 22 bp, Homo sapiens
aaactttaccttttttatacat

SEQ ID NO: 1086347 - DNA, 18 bp, Homo sapiens
aaactttactatggccct

SEQ ID NO: 1086348 - DNA, 16 bp, Homo sapiens
aaactttatttaaatg

SEQ ID NO: 1086349 - DNA, 20 bp, Homo sapiens
aaactttatttgtaaaccat

SEQ ID NO: 1086350 - DNA, 19 bp, Homo sapiens
aaactttattttatataat

SEQ ID NO: 1086351 - DNA, 14 bp, Homo sapiens
aaactttcagagaa

SEQ ID NO: 1086352 - DNA, 18 bp, Homo sapiens
aaactttcctcgcctgac

SEQ ID NO: 1086353 - DNA, 16 bp, Homo sapiens
aaactttgaagttagc

SEQ ID NO: 1086354 - DNA, 19 bp, Homo sapiens
aaactttggaaccagactc

SEQ ID NO: 1086355 - DNA, 16 bp, Homo sapiens
aaactttggcctttgt

SEQ ID NO: 1086356 - DNA, 13 bp, Homo sapiens
aaacttttataaa

SEQ ID NO: 1086357 - DNA, 16 bp, Homo sapiens
aaacttttataaatta

SEQ ID NO: 1086358 - DNA, 21 bp, Homo sapiens
aaacttttgttagggctgctt

SEQ ID NO: 1086359 - DNA, 17 bp, Homo sapiens
aaagagatagcttctct

SEQ ID NO: 1086360 - DNA, 12 bp, Homo sapiens
aaagagatattt

SEQ ID NO: 1086361 - DNA, 15 bp, Homo sapiens
aaagagcaagtctgg

SEQ ID NO: 1086362 - DNA, 23 bp, Homo sapiens
aaagagcaagtctggatctggga

SEQ ID NO: 1086363 - DNA, 21 bp, Homo sapiens
aaagagcacttaagagaatat

SEQ ID NO: 1086364 - DNA, 14 bp, Homo sapiens
aaagagccctggct

SEQ ID NO: 1086365 - DNA, 21 bp, Homo sapiens
aaagagccctggctctgcccc

SEQ ID NO: 1086366 - DNA, 23 bp, Homo sapiens
aaagagccctggctctgcccctc

SEQ ID NO: 1086367 - DNA, 18 bp, Homo sapiens
aaagagccttcagaatgc

SEQ ID NO: 1086368 - DNA, 19 bp, Homo sapiens
aaagaggcaccaggaagcc

SEQ ID NO: 1086369 - DNA, 12 bp, Homo sapiens
aaagaggcatct

SEQ ID NO: 1086370 - DNA, 21 bp, Homo sapiens
aaagaggctctggacagcaga

SEQ ID NO: 1086371 - DNA, 20 bp, Homo sapiens
aaagaggctgaaagaggcca

SEQ ID NO: 1086372 - DNA, 19 bp, Homo sapiens
aaagaggctgaggctggca

SEQ ID NO: 1086373 - DNA, 14 bp, Homo sapiens
aaagaggctgcccc

SEQ ID NO: 1086374 - DNA, 20 bp, Homo sapiens
aaagaggctgcccctctcac

SEQ ID NO: 1086375 - DNA, 18 bp, Homo sapiens
aaagagtagaattgcatt

SEQ ID NO: 1086376 - DNA, 14 bp, Homo sapiens
aaagagtcagccct

SEQ ID NO: 1086377 - DNA, 14 bp, Homo sapiens
aaagagtctgggac

SEQ ID NO: 1086378 - DNA, 16 bp, Homo sapiens
aaagagttcaagaaat

SEQ ID NO: 1086379 - DNA, 20 bp, Homo sapiens
aaagagttcaagaaataagt

SEQ ID NO: 1086380 - DNA, 16 bp, Homo sapiens
aaagagttcttaagga

SEQ ID NO: 1086381 - DNA, 21 bp, Homo sapiens
aaagataaacctggagatatt

SEQ ID NO: 1086382 - DNA, 18 bp, Homo sapiens
aaagataaatttgttgaa

SEQ ID NO: 1086383 - DNA, 18 bp, Homo sapiens
aaagataataaattgatt

SEQ ID NO: 1086384 - DNA, 17 bp, Homo sapiens
aaagatatatacacagg

SEQ ID NO: 1086385 - DNA, 21 bp, Homo sapiens
aaagatatattaaaaatataa

SEQ ID NO: 1086386 - DNA, 23 bp, Homo sapiens
aaagatatattaaaaatataaaa

SEQ ID NO: 1086387 - DNA, 16 bp, Homo sapiens
aaagatattttgcttt

SEQ ID NO: 1086388 - DNA, 17 bp, Homo sapiens
aaagatattttgctttg

SEQ ID NO: 1086389 - DNA, 16 bp, Homo sapiens
aaagatcaccttgtat

SEQ ID NO: 1086390 - DNA, 23 bp, Homo sapiens
aaagatccaccctcaaatgtcag

SEQ ID NO: 1086391 - DNA, 17 bp, Homo sapiens
aaagatccagggatgga

SEQ ID NO: 1086392 - DNA, 12 bp, Homo sapiens
aaagatctctgt

SEQ ID NO: 1086393 - DNA, 21 bp, Homo sapiens
aaagatctgttttgaaggcaa

SEQ ID NO: 1086394 - DNA, 12 bp, Homo sapiens
aaagatgaagtt

SEQ ID NO: 1086395 - DNA, 12 bp, Homo sapiens
aaagatgagttg

SEQ ID NO: 1086396 - DNA, 14 bp, Homo sapiens
aaagatgatggaaa

SEQ ID NO: 1086397 - DNA, 13 bp, Homo sapiens
aaagatgcacaga

SEQ ID NO: 1086398 - DNA, 14 bp, Homo sapiens
aaagatgccacatt

SEQ ID NO: 1086399 - DNA, 21 bp, Homo sapiens
aaagatgccatagcataatat

SEQ ID NO: 1086400 - DNA, 20 bp, Homo sapiens
aaagatgccccattccttgc

SEQ ID NO: 1086401 - DNA, 22 bp, Homo sapiens
aaagatgccgggttttatattt

SEQ ID NO: 1086402 - DNA, 14 bp, Homo sapiens
aaagatgcttctca

SEQ ID NO: 1086403 - DNA, 22 bp, Homo sapiens
aaagatggctgtgcctctgcct

SEQ ID NO: 1086404 - DNA, 20 bp, Homo sapiens
aaagatggtaaaccagatct

SEQ ID NO: 1086405 - DNA, 17 bp, Homo sapiens
aaagatggtggctgtgt

SEQ ID NO: 1086406 - DNA, 17 bp, Homo sapiens
aaagatggttaaacatt

SEQ ID NO: 1086407 - DNA, 20 bp, Homo sapiens
aaagatggttgtagcattta

SEQ ID NO: 1086408 - DNA, 15 bp, Homo sapiens
aaagatgttaaatgg

SEQ ID NO: 1086409 - DNA, 18 bp, Homo sapiens
aaagatgttaaatggaat

SEQ ID NO: 1086410 - DNA, 23 bp, Homo sapiens
aaagattattgtgacttcactgt

SEQ ID NO: 1086411 - DNA, 23 bp, Homo sapiens
aaagattatttgtgcattttatt

SEQ ID NO: 1086412 - DNA, 10 bp, Homo sapiens
aaagattcta

SEQ ID NO: 1086413 - DNA, 22 bp, Homo sapiens
aaagattctctttaaaaaagac

SEQ ID NO: 1086414 - DNA, 23 bp, Homo sapiens
aaagattctctttaaaaaagact

SEQ ID NO: 1086415 - DNA, 22 bp, Homo sapiens
aaagattctgaccttaaatgca

SEQ ID NO: 1086416 - DNA, 16 bp, Homo sapiens
aaagatttacattcca

SEQ ID NO: 1086417 - DNA, 18 bp, Homo sapiens
aaagatttcagtagaatt

SEQ ID NO: 1086418 - DNA, 19 bp, Homo sapiens
aaagatttctagtaggcag

SEQ ID NO: 1086419 - DNA, 12 bp, Homo sapiens
aaagatttgtta

SEQ ID NO: 1086420 - DNA, 14 bp, Homo sapiens
aaagatttgttact

SEQ ID NO: 1086421 - DNA, 17 bp, Homo sapiens
aaagatttgttactgta

SEQ ID NO: 1086422 - DNA, 22 bp, Homo sapiens
aaagatttgttactgtattttt

SEQ ID NO: 1086423 - DNA, 14 bp, Homo sapiens
aaagattttaatca

SEQ ID NO: 1086424 - DNA, 19 bp, Homo sapiens
aaagattttatttatggaa

SEQ ID NO: 1086425 - DNA, 21 bp, Homo sapiens
aaagattttttaataatttag

SEQ ID NO: 1086426 - DNA, 22 bp, Homo sapiens
aaagattttttaataatttaga

SEQ ID NO: 1086427 - DNA, 19 bp, Homo sapiens
aaagattttttttaatcta

SEQ ID NO: 1086428 - DNA, 14 bp, Homo sapiens
aaagcaaaaaagaa

SEQ ID NO: 1086429 - DNA, 15 bp, Homo sapiens
aaagcaaaaaagaaa

SEQ ID NO: 1086430 - DNA, 21 bp, Homo sapiens
aaagcaaaaaagaaaaccttt

SEQ ID NO: 1086431 - DNA, 22 bp, Homo sapiens
aaagcaaaaagatgtatatttg

SEQ ID NO: 1086432 - DNA, 14 bp, Homo sapiens
aaagcaaaaatgac

SEQ ID NO: 1086433 - DNA, 15 bp, Homo sapiens
aaagcaaaggcagtc

SEQ ID NO: 1086434 - DNA, 23 bp, Homo sapiens
aaagcaagggagaaaagagaaac

SEQ ID NO: 1086435 - DNA, 17 bp, Homo sapiens
aaagcaagggctccagc

SEQ ID NO: 1086436 - DNA, 17 bp, Homo sapiens
aaagcaataaatgaatg

SEQ ID NO: 1086437 - DNA, 14 bp, Homo sapiens
aaagcaatacaact

SEQ ID NO: 1086438 - DNA, 18 bp, Homo sapiens
aaagcaatacaactttac

SEQ ID NO: 1086439 - DNA, 12 bp, Homo sapiens
aaagcaatattg

SEQ ID NO: 1086440 - DNA, 14 bp, Homo sapiens
aaagcaatattgta

SEQ ID NO: 1086441 - DNA, 18 bp, Homo sapiens
aaagcaatcaagcaccag

SEQ ID NO: 1086442 - DNA, 20 bp, Homo sapiens
aaagcaatcaagcaccagga

SEQ ID NO: 1086443 - DNA, 16 bp, Homo sapiens
aaagcaattctgactg

SEQ ID NO: 1086444 - DNA, 17 bp, Homo sapiens
aaagcaattgccctgta

SEQ ID NO: 1086445 - DNA, 18 bp, Homo sapiens
aaagcacaaagttctcag

SEQ ID NO: 1086446 - DNA, 22 bp, Homo sapiens
aaagcacaaagttctcagagct

SEQ ID NO: 1086447 - DNA, 17 bp, Homo sapiens
aaagcacaatgtggatt

SEQ ID NO: 1086448 - DNA, 23 bp, Homo sapiens
aaagcacatgcttagcttatctt

SEQ ID NO: 1086449 - DNA, 17 bp, Homo sapiens
aaagcaccaaaataaga

SEQ ID NO: 1086450 - DNA, 20 bp, Homo sapiens
aaagcaccaaaataagaaaa

SEQ ID NO: 1086451 - DNA, 21 bp, Homo sapiens
aaagcaccaaaataagaaaag

SEQ ID NO: 1086452 - DNA, 22 bp, Homo sapiens
aaagcaccagcttctccaggct

SEQ ID NO: 1086453 - DNA, 12 bp, Homo sapiens
aaagcactctct

SEQ ID NO: 1086454 - DNA, 14 bp, Homo sapiens
aaagcagaagtctg

SEQ ID NO: 1086455 - DNA, 15 bp, Homo sapiens
aaagcagaattttaa

SEQ ID NO: 1086456 - DNA, 17 bp, Homo sapiens
aaagcagaattttaatg

SEQ ID NO: 1086457 - DNA, 21 bp, Homo sapiens
aaagcagaattttaatgtgaa

SEQ ID NO: 1086458 - DNA, 12 bp, Homo sapiens
aaagcagagcca

SEQ ID NO: 1086459 - DNA, 17 bp, Homo sapiens
aaagcagagccaaggcc

SEQ ID NO: 1086460 - DNA, 17 bp, Homo sapiens
aaagcagagcctcctgg

SEQ ID NO: 1086461 - DNA, 14 bp, Homo sapiens
aaagcagaggccaa

SEQ ID NO: 1086462 - DNA, 17 bp, Homo sapiens
aaagcagagtggactgc

SEQ ID NO: 1086463 - DNA, 21 bp, Homo sapiens
aaagcagagtggactgcattt

SEQ ID NO: 1086464 - DNA, 21 bp, Homo sapiens
aaagcagcattctggagggga

SEQ ID NO: 1086465 - DNA, 22 bp, Homo sapiens
aaagcagcgtttctatgacaca

SEQ ID NO: 1086466 - DNA, 23 bp, Homo sapiens
aaagcagctaaatgtaacttatt

SEQ ID NO: 1086467 - DNA, 21 bp, Homo sapiens
aaagcaggatgtagttctgcc

SEQ ID NO: 1086468 - DNA, 24 bp, Homo sapiens
aaagcaggcttgcccagtacattt

SEQ ID NO: 1086469 - DNA, 15 bp, Homo sapiens
aaagcaggttcttgt

SEQ ID NO: 1086470 - DNA, 18 bp, Homo sapiens
aaagcagtagacaatccc

SEQ ID NO: 1086471 - DNA, 22 bp, Homo sapiens
aaagcagtatataataacttta

SEQ ID NO: 1086472 - DNA, 23 bp, Homo sapiens
aaagcagtatataataactttat

SEQ ID NO: 1086473 - DNA, 18 bp, Homo sapiens
aaagcagtcccattcata

SEQ ID NO: 1086474 - DNA, 23 bp, Homo sapiens
aaagcagttaactttaagactga

SEQ ID NO: 1086475 - DNA, 14 bp, Homo sapiens
aaagcataaaaaca

SEQ ID NO: 1086476 - DNA, 13 bp, Homo sapiens
aaagcataaagct

SEQ ID NO: 1086477 - DNA, 15 bp, Homo sapiens
aaagcataaatgcaa

SEQ ID NO: 1086478 - DNA, 17 bp, Homo sapiens
aaagcatattgactttt

SEQ ID NO: 1086479 - DNA, 17 bp, Homo sapiens
aaagcatcacctcaggc

SEQ ID NO: 1086480 - DNA, 12 bp, Homo sapiens
aaagtgtttagc

SEQ ID NO: 1086481 - DNA, 11 bp, Homo sapiens
aaagttaaaag

SEQ ID NO: 1086482 - DNA, 22 bp, Homo sapiens
aaagttaaacattgaagtaatg

SEQ ID NO: 1086483 - DNA, 15 bp, Homo sapiens
aaagttaacattaat

SEQ ID NO: 1086484 - DNA, 18 bp, Homo sapiens
aaagttaatgggatggtc

SEQ ID NO: 1086485 - DNA, 16 bp, Homo sapiens
aaagttaccagtgcct

SEQ ID NO: 1086486 - DNA, 21 bp, Homo sapiens
aaagttactaggtaacttcat

SEQ ID NO: 1086487 - DNA, 22 bp, Homo sapiens
aaagttactgattcactgcatg

SEQ ID NO: 1086488 - DNA, 20 bp, Homo sapiens
aaagttactttgtcagaggc

SEQ ID NO: 1086489 - DNA, 18 bp, Homo sapiens
aaagttagcctttgaatg

SEQ ID NO: 1086490 - DNA, 15 bp, Homo sapiens
aaagttataataact

SEQ ID NO: 1086491 - DNA, 18 bp, Homo sapiens
aaagttcaacatgttatt

SEQ ID NO: 1086492 - DNA, 12 bp, Homo sapiens
aaagttcaggga

SEQ ID NO: 1086493 - DNA, 22 bp, Homo sapiens
aaagttcatagggtctcttcag

SEQ ID NO: 1086494 - DNA, 13 bp, Homo sapiens
aaagttcatgttg

SEQ ID NO: 1086495 - DNA, 17 bp, Homo sapiens
aaagttccaaatgttta

SEQ ID NO: 1086496 - DNA, 19 bp, Homo sapiens
aaagttcctgtcattcctc

SEQ ID NO: 1086497 - DNA, 14 bp, Homo sapiens
aaagttctgtactc

SEQ ID NO: 1086498 - DNA, 21 bp, Homo sapiens
aaagttctgtactcaaatgta

SEQ ID NO: 1086499 - DNA, 13 bp, Homo sapiens
aaagttcttattt

SEQ ID NO: 1086500 - DNA, 20 bp, Homo sapiens
aaagttgataaagatttttt

SEQ ID NO: 1086501 - DNA, 21 bp, Homo sapiens
aaagttgattttgaacttttt

SEQ ID NO: 1086502 - DNA, 23 bp, Homo sapiens
aaagttgcagatgtattgactgt

SEQ ID NO: 1086503 - DNA, 14 bp, Homo sapiens
aaagttgcttttat

SEQ ID NO: 1086504 - DNA, 19 bp, Homo sapiens
aaagttggaaggatctgct

SEQ ID NO: 1086505 - DNA, 20 bp, Homo sapiens
aaagttggaaggatctgctg

SEQ ID NO: 1086506 - DNA, 21 bp, Homo sapiens
aaagttggccatgtattatga

SEQ ID NO: 1086507 - DNA, 18 bp, Homo sapiens
aaagttggtattaataaa

SEQ ID NO: 1086508 - DNA, 16 bp, Homo sapiens
aaagttggtgacagat

SEQ ID NO: 1086509 - DNA, 19 bp, Homo sapiens
aaagttggttcacttcaaa

SEQ ID NO: 1086510 - DNA, 16 bp, Homo sapiens
aaagttggttggataa

SEQ ID NO: 1086511 - DNA, 13 bp, Homo sapiens
aaagttgtaaaat

SEQ ID NO: 1086512 - DNA, 18 bp, Homo sapiens
aaagttgtaaaatagaaa

SEQ ID NO: 1086513 - DNA, 23 bp, Homo sapiens
aaagttgtaacaaatacagatga

SEQ ID NO: 1086514 - DNA, 21 bp, Homo sapiens
aaagttgtgcatgtatgtata

SEQ ID NO: 1086515 - DNA, 12 bp, Homo sapiens
aaagtttaataa

SEQ ID NO: 1086516 - DNA, 15 bp, Homo sapiens
aaagtttacagatgt

SEQ ID NO: 1086517 - DNA, 12 bp, Homo sapiens
aaagtttcaatg

SEQ ID NO: 1086518 - DNA, 23 bp, Homo sapiens
aaagtttcacaggtcaataaact

SEQ ID NO: 1086519 - DNA, 14 bp, Homo sapiens
aaagtttctatttt

SEQ ID NO: 1086520 - DNA, 13 bp, Homo sapiens
aaagtttctgttg

SEQ ID NO: 1086521 - DNA, 16 bp, Homo sapiens
aaagtttgcttagaaa

SEQ ID NO: 1086522 - DNA, 11 bp, Homo sapiens
aaagtttgttc

SEQ ID NO: 1086523 - DNA, 14 bp, Homo sapiens
aaagttttccagta

SEQ ID NO: 1086524 - DNA, 15 bp, Homo sapiens
aaagttttccagtat

SEQ ID NO: 1086525 - DNA, 15 bp, Homo sapiens
aaagttttcccttga

SEQ ID NO: 1086526 - DNA, 13 bp, Homo sapiens
aaagttttctaat

SEQ ID NO: 1086527 - DNA, 16 bp, Homo sapiens
aaagttttgatattta

SEQ ID NO: 1086528 - DNA, 16 bp, Homo sapiens
aaagttttgcaaaggg

SEQ ID NO: 1086529 - DNA, 13 bp, Homo sapiens
aaagttttgtaaa

SEQ ID NO: 1086530 - DNA, 16 bp, Homo sapiens
aaagttttgtaaaaga

SEQ ID NO: 1086531 - DNA, 15 bp, Homo sapiens
aaataaaaaaaagaa

SEQ ID NO: 1086532 - DNA, 16 bp, Homo sapiens
aaataaaaaagcaaaa

SEQ ID NO: 1086533 - DNA, 22 bp, Homo sapiens
aaataaaaactaatttcatact

SEQ ID NO: 1086534 - DNA, 17 bp, Homo sapiens
aaataaaaacttatttt

SEQ ID NO: 1086535 - DNA, 19 bp, Homo sapiens
aaataaaaagtgacacagc

SEQ ID NO: 1086536 - DNA, 14 bp, Homo sapiens
aaataaaaataaat

SEQ ID NO: 1086537 - DNA, 12 bp, Homo sapiens
aaataaaacaag

SEQ ID NO: 1086538 - DNA, 14 bp, Homo sapiens
aaataaaacaagcc

SEQ ID NO: 1086539 - DNA, 14 bp, Homo sapiens
aaataaaaccagct

SEQ ID NO: 1086540 - DNA, 11 bp, Homo sapiens
aaataaaacct

SEQ ID NO: 1086541 - DNA, 12 bp, Homo sapiens
aaataaaacctt

SEQ ID NO: 1086542 - DNA, 17 bp, Homo sapiens
aaataaaacctttcaaa

SEQ ID NO: 1086543 - DNA, 14 bp, Homo sapiens
aaataaaactattt

SEQ ID NO: 1086544 - DNA, 14 bp, Homo sapiens
aaataaaactgaat

SEQ ID NO: 1086545 - DNA, 12 bp, Homo sapiens
aaataaaactgt

SEQ ID NO: 1086546 - DNA, 22 bp, Homo sapiens
aaataaaactttccaaatattt

SEQ ID NO: 1086547 - DNA, 16 bp, Homo sapiens
aaataaaactttttaa

SEQ ID NO: 1086548 - DNA, 16 bp, Homo sapiens
aaataaaagcacaagt

SEQ ID NO: 1086549 - DNA, 13 bp, Homo sapiens
aaataaaagcagc

SEQ ID NO: 1086550 - DNA, 19 bp, Homo sapiens
aaataaaagcagcatctgc

SEQ ID NO: 1086551 - DNA, 13 bp, Homo sapiens
aaataaaatactt

SEQ ID NO: 1086552 - DNA, 14 bp, Homo sapiens
aaataaaatatatc

SEQ ID NO: 1086553 - DNA, 14 bp, Homo sapiens
aaataaaatgaaaa

SEQ ID NO: 1086554 - DNA, 19 bp, Homo sapiens
aaataaaatgaaaattgta

SEQ ID NO: 1086555 - DNA, 15 bp, Homo sapiens
aaataaaatttgttg

SEQ ID NO: 1086556 - DNA, 17 bp, Homo sapiens
aaataaaatttgttgca

SEQ ID NO: 1086557 - DNA, 13 bp, Homo sapiens
aaataaacacgat

SEQ ID NO: 1086558 - DNA, 16 bp, Homo sapiens
aaataaacagttgtta

SEQ ID NO: 1086559 - DNA, 14 bp, Homo sapiens
aaataaacatcagt

SEQ ID NO: 1086560 - DNA, 19 bp, Homo sapiens
aaataaaccattggacaga

SEQ ID NO: 1086561 - DNA, 19 bp, Homo sapiens
aaataaacctgcactgaaa

SEQ ID NO: 1086562 - DNA, 14 bp, Homo sapiens
aaataaactctaaa

SEQ ID NO: 1086563 - DNA, 13 bp, Homo sapiens
aaataaactgttt

SEQ ID NO: 1086564 - DNA, 13 bp, Homo sapiens
aaataaacttctt

SEQ ID NO: 1086565 - DNA, 14 bp, Homo sapiens
aaataaacttctta

SEQ ID NO: 1086566 - DNA, 21 bp, Homo sapiens
aaataaacttcttaacatgct

SEQ ID NO: 1086567 - DNA, 16 bp, Homo sapiens
aaataaagaaatttgg

SEQ ID NO: 1086568 - DNA, 17 bp, Homo sapiens
aaataaagaaatttggt

SEQ ID NO: 1086569 - DNA, 23 bp, Homo sapiens
aaataaagaggagtgttattgca

SEQ ID NO: 1086570 - DNA, 17 bp, Homo sapiens
aaataaagatcacacat

SEQ ID NO: 1086571 - DNA, 20 bp, Homo sapiens
aaataaagcttgcaacaaaa

SEQ ID NO: 1086572 - DNA, 17 bp, Homo sapiens
aaataaataattttaat

SEQ ID NO: 1086573 - DNA, 20 bp, Homo sapiens
aaataaatagctatatccat

SEQ ID NO: 1086574 - DNA, 13 bp, Homo sapiens
aaataaatatata

SEQ ID NO: 1086575 - DNA, 14 bp, Homo sapiens
aaataaatatatat

SEQ ID NO: 1086576 - DNA, 20 bp, Homo sapiens
aaataaatcttagtgttcaa

SEQ ID NO: 1086577 - DNA, 16 bp, Homo sapiens
aaataaatgtttcaaa

SEQ ID NO: 1086578 - DNA, 17 bp, Homo sapiens
aaataaattaataaatt

SEQ ID NO: 1086579 - DNA, 21 bp, Homo sapiens
aaataaattcagccaacatgt

SEQ ID NO: 1086580 - DNA, 14 bp, Homo sapiens
aaataaatttatat

SEQ ID NO: 1086581 - DNA, 17 bp, Homo sapiens
aaataaatttatatgaa

SEQ ID NO: 1086582 - DNA, 16 bp, Homo sapiens
aaataaatttcccagt

SEQ ID NO: 1086583 - DNA, 19 bp, Homo sapiens
aaataaattttgtttcaga

SEQ ID NO: 1086584 - DNA, 20 bp, Homo sapiens
aaataacaagagttttaaca

SEQ ID NO: 1086585 - DNA, 14 bp, Homo sapiens
aaataacaatgtgc

SEQ ID NO: 1086586 - DNA, 13 bp, Homo sapiens
aaataacacacat

SEQ ID NO: 1086587 - DNA, 17 bp, Homo sapiens
aaataacagaagaaaat

SEQ ID NO: 1086588 - DNA, 12 bp, Homo sapiens
aaataacattgc

SEQ ID NO: 1086589 - DNA, 13 bp, Homo sapiens
aaataacattgca

SEQ ID NO: 1086590 - DNA, 22 bp, Homo sapiens
aaataacattgcactttataaa

SEQ ID NO: 1086591 - DNA, 19 bp, Homo sapiens
aaataaccaatcctggaca

SEQ ID NO: 1086592 - DNA, 17 bp, Homo sapiens
aaataaccctgggctgt

SEQ ID NO: 1086593 - DNA, 21 bp, Homo sapiens
aaataaccctgggctgtccag

SEQ ID NO: 1086594 - DNA, 17 bp, Homo sapiens
aaataactagtgttgct

SEQ ID NO: 1086595 - DNA, 13 bp, Homo sapiens
aaataactatttt

SEQ ID NO: 1086596 - DNA, 13 bp, Homo sapiens
aaataactggaaa

SEQ ID NO: 1086597 - DNA, 15 bp, Homo sapiens
aaataacttcagtcc

SEQ ID NO: 1086598 - DNA, 14 bp, Homo sapiens
aaataagaaaccta

SEQ ID NO: 1086599 - DNA, 21 bp, Homo sapiens
aaataagaaacttttttattt

SEQ ID NO: 1086600 - DNA, 15 bp, Homo sapiens
aaataagaaattagc

SEQ ID NO: 1086601 - DNA, 14 bp, Homo sapiens
aaataagaagaatg

SEQ ID NO: 1086602 - DNA, 20 bp, Homo sapiens
aaataagaagggggagtgaa

SEQ ID NO: 1086603 - DNA, 21 bp, Homo sapiens
aaataagaagggggagtgaaa

SEQ ID NO: 1086604 - DNA, 17 bp, Homo sapiens
aaatcttaaacaatgta

SEQ ID NO: 1086605 - DNA, 21 bp, Homo sapiens
aaatcttaaacaatgtataaa

SEQ ID NO: 1086606 - DNA, 13 bp, Homo sapiens
aaatcttaatgtt

SEQ ID NO: 1086607 - DNA, 13 bp, Homo sapiens
aaatcttacaaca

SEQ ID NO: 1086608 - DNA, 20 bp, Homo sapiens
aaatcttagtatagtagaaa

SEQ ID NO: 1086609 - DNA, 23 bp, Homo sapiens
aaatcttagtatagtagaaagac

SEQ ID NO: 1086610 - DNA, 15 bp, Homo sapiens
aaatcttagtgttca

SEQ ID NO: 1086611 - DNA, 22 bp, Homo sapiens
aaatcttcatggaattcacaaa

SEQ ID NO: 1086612 - DNA, 19 bp, Homo sapiens
aaatcttgcagttttgtaa

SEQ ID NO: 1086613 - DNA, 16 bp, Homo sapiens
aaatcttgttaatgtc

SEQ ID NO: 1086614 - DNA, 21 bp, Homo sapiens
aaatcttgttaatgtcattgc

SEQ ID NO: 1086615 - DNA, 17 bp, Homo sapiens
aaatctttctgtaaaca

SEQ ID NO: 1086616 - DNA, 18 bp, Homo sapiens
aaatctttgttgaagttt

SEQ ID NO: 1086617 - DNA, 18 bp, Homo sapiens
aaatcttttataggattt

SEQ ID NO: 1086618 - DNA, 23 bp, Homo sapiens
aaatctttttgcttctactttca

SEQ ID NO: 1086619 - DNA, 15 bp, Homo sapiens
aaatgaaaacttttg

SEQ ID NO: 1086620 - DNA, 16 bp, Homo sapiens
aaatgaaaacttttgt

SEQ ID NO: 1086621 - DNA, 20 bp, Homo sapiens
aaatgaaaacttttgtaaat

SEQ ID NO: 1086622 - DNA, 22 bp, Homo sapiens
aaatgaaaacttttgtaaatta

SEQ ID NO: 1086623 - DNA, 12 bp, Homo sapiens
aaatgaaaagca

SEQ ID NO: 1086624 - DNA, 14 bp, Homo sapiens
aaatgaaaagcaat

SEQ ID NO: 1086625 - DNA, 16 bp, Homo sapiens
aaatgaaaatgtcttg

SEQ ID NO: 1086626 - DNA, 17 bp, Homo sapiens
aaatgaaaatgtcttgt

SEQ ID NO: 1086627 - DNA, 13 bp, Homo sapiens
aaatgaaactctt

SEQ ID NO: 1086628 - DNA, 22 bp, Homo sapiens
aaatgaaacttggccagtttgt

SEQ ID NO: 1086629 - DNA, 13 bp, Homo sapiens
aaatgaaagctac

SEQ ID NO: 1086630 - DNA, 14 bp, Homo sapiens
aaatgaaagctact

SEQ ID NO: 1086631 - DNA, 23 bp, Homo sapiens
aaatgaaaggagtttaaaaacat

SEQ ID NO: 1086632 - DNA, 14 bp, Homo sapiens
aaatgaaatgcata

SEQ ID NO: 1086633 - DNA, 12 bp, Homo sapiens
aaatgaaattgt

SEQ ID NO: 1086634 - DNA, 13 bp, Homo sapiens
aaatgaacaaaag

SEQ ID NO: 1086635 - DNA, 18 bp, Homo sapiens
aaatgaacatctcttgaa

SEQ ID NO: 1086636 - DNA, 19 bp, Homo sapiens
aaatgaacatctcttgaaa

SEQ ID NO: 1086637 - DNA, 12 bp, Homo sapiens
aaatgaacctga

SEQ ID NO: 1086638 - DNA, 14 bp, Homo sapiens
aaatgaactgaagt

SEQ ID NO: 1086639 - DNA, 21 bp, Homo sapiens
aaatgaactgaagtttcacat

SEQ ID NO: 1086640 - DNA, 12 bp, Homo sapiens
aaatgaactttt

SEQ ID NO: 1086641 - DNA, 13 bp, Homo sapiens
aaatgaagaaagt

SEQ ID NO: 1086642 - DNA, 22 bp, Homo sapiens
aaatgaaggttaggatttaaca

SEQ ID NO: 1086643 - DNA, 23 bp, Homo sapiens
aaatgaagtacagtagtttccct

SEQ ID NO: 1086644 - DNA, 21 bp, Homo sapiens
aaatgaataatgcctttgtaa

SEQ ID NO: 1086645 - DNA, 19 bp, Homo sapiens
aaatgaatatctattaata

SEQ ID NO: 1086646 - DNA, 15 bp, Homo sapiens
aaatgaatcattgtt

SEQ ID NO: 1086647 - DNA, 21 bp, Homo sapiens
aaatgaatgagccaaaatgac

SEQ ID NO: 1086648 - DNA, 18 bp, Homo sapiens
aaatgaatttcatgtgaa

SEQ ID NO: 1086649 - DNA, 17 bp, Homo sapiens
aaatgacaaagccattc

SEQ ID NO: 1086650 - DNA, 15 bp, Homo sapiens
aaatgacaaagtgtt

SEQ ID NO: 1086651 - DNA, 16 bp, Homo sapiens
aaatgacaaagtgttg

SEQ ID NO: 1086652 - DNA, 19 bp, Homo sapiens
aaatgacaaatgtattaat

SEQ ID NO: 1086653 - DNA, 16 bp, Homo sapiens
aaatgacaacagaaaa

SEQ ID NO: 1086654 - DNA, 15 bp, Homo sapiens
aaatgacaatgatga

SEQ ID NO: 1086655 - DNA, 14 bp, Homo sapiens
aaatgacacccaga

SEQ ID NO: 1086656 - DNA, 16 bp, Homo sapiens
aaatgacatgttcctt

SEQ ID NO: 1086657 - DNA, 16 bp, Homo sapiens
aaatgacccaaagacc

SEQ ID NO: 1086658 - DNA, 19 bp, Homo sapiens
aaatgactaaaaaacaaag

SEQ ID NO: 1086659 - DNA, 17 bp, Homo sapiens
aaatgacttatttctgc

SEQ ID NO: 1086660 - DNA, 13 bp, Homo sapiens
aaatgacttttct

SEQ ID NO: 1086661 - DNA, 21 bp, Homo sapiens
aaatgagaattttatattcta

SEQ ID NO: 1086662 - DNA, 16 bp, Homo sapiens
aaatgagaggagaaca

SEQ ID NO: 1086663 - DNA, 18 bp, Homo sapiens
aaatgagaggagaacagt

SEQ ID NO: 1086664 - DNA, 19 bp, Homo sapiens
aaatgagatttttgttttc

SEQ ID NO: 1086665 - DNA, 12 bp, Homo sapiens
aaatgagccctg

SEQ ID NO: 1086666 - DNA, 23 bp, Homo sapiens
aaatgagctgccagaatcaggtt

SEQ ID NO: 1086667 - DNA, 19 bp, Homo sapiens
aaatgaggaatagcaaaat

SEQ ID NO: 1086668 - DNA, 20 bp, Homo sapiens
aaatgaggaggtacattgaa

SEQ ID NO: 1086669 - DNA, 18 bp, Homo sapiens
aaatgaggattattgata

SEQ ID NO: 1086670 - DNA, 16 bp, Homo sapiens
aaatgagggtttctga

SEQ ID NO: 1086671 - DNA, 16 bp, Homo sapiens
aaatgaggtactctcc

SEQ ID NO: 1086672 - DNA, 20 bp, Homo sapiens
aaatgagtaaaaactagaag

SEQ ID NO: 1086673 - DNA, 12 bp, Homo sapiens
aaatgagtaaca

SEQ ID NO: 1086674 - DNA, 14 bp, Homo sapiens
aaatgagtaacatt

SEQ ID NO: 1086675 - DNA, 16 bp, Homo sapiens
aaatgagtcatttgtt

SEQ ID NO: 1086676 - DNA, 18 bp, Homo sapiens
aaatgagtcatttgttta

SEQ ID NO: 1086677 - DNA, 22 bp, Homo sapiens
aaatgagtcatttgtttaaaca

SEQ ID NO: 1086678 - DNA, 18 bp, Homo sapiens
aaatgagtgtgtttgtca

SEQ ID NO: 1086679 - DNA, 13 bp, Homo sapiens
aaatgagttactt

SEQ ID NO: 1086680 - DNA, 18 bp, Homo sapiens
aaatgagttacttagaat

SEQ ID NO: 1086681 - DNA, 22 bp, Homo sapiens
aaatgagtttttatggggctga

SEQ ID NO: 1086682 - DNA, 14 bp, Homo sapiens
aaatgataaagact

SEQ ID NO: 1086683 - DNA, 19 bp, Homo sapiens
aaatgatgatgtggaagaa

SEQ ID NO: 1086684 - DNA, 21 bp, Homo sapiens
aaatgatggatcaccattata

SEQ ID NO: 1086685 - DNA, 16 bp, Homo sapiens
aaatgatgtgcaaaac

SEQ ID NO: 1086686 - DNA, 17 bp, Homo sapiens
aaatgattactaaggaa

SEQ ID NO: 1086687 - DNA, 18 bp, Homo sapiens
aaatgattcaaattgctg

SEQ ID NO: 1086688 - DNA, 20 bp, Homo sapiens
aaatgattcaaattgctgct

SEQ ID NO: 1086689 - DNA, 13 bp, Homo sapiens
aaatgattccaaa

SEQ ID NO: 1086690 - DNA, 15 bp, Homo sapiens
aaatgattccaaata

SEQ ID NO: 1086691 - DNA, 22 bp, Homo sapiens
aaatgattgtaaaatagcttgt

SEQ ID NO: 1086692 - DNA, 19 bp, Homo sapiens
aaatgattttaattttata

SEQ ID NO: 1086693 - DNA, 15 bp, Homo sapiens
aaatgcaaaaaaaat

SEQ ID NO: 1086694 - DNA, 17 bp, Homo sapiens
aaatgcaaaaaaaatta

SEQ ID NO: 1086695 - DNA, 18 bp, Homo sapiens
aaatgcaaaaaaaattag

SEQ ID NO: 1086696 - DNA, 17 bp, Homo sapiens
aaatgcaaagcacacct

SEQ ID NO: 1086697 - DNA, 16 bp, Homo sapiens
aaatgcaaatgaatca

SEQ ID NO: 1086698 - DNA, 14 bp, Homo sapiens
aaatgcaagatttt

SEQ ID NO: 1086699 - DNA, 15 bp, Homo sapiens
aaatgcaataactct

SEQ ID NO: 1086700 - DNA, 14 bp, Homo sapiens
aaatgcaataattt

SEQ ID NO: 1086701 - DNA, 18 bp, Homo sapiens
aaatgcacctggaatata

SEQ ID NO: 1086702 - DNA, 12 bp, Homo sapiens
aaatgcactgta

SEQ ID NO: 1086703 - DNA, 17 bp, Homo sapiens
aaatgcagaatacttga

SEQ ID NO: 1086704 - DNA, 15 bp, Homo sapiens
aaatgcagggagggg

SEQ ID NO: 1086705 - DNA, 16 bp, Homo sapiens
aaatgcaggtgaactt

SEQ ID NO: 1086706 - DNA, 16 bp, Homo sapiens
aaatgcagttttaaga

SEQ ID NO: 1086707 - DNA, 15 bp, Homo sapiens
aaatgcataaatgca

SEQ ID NO: 1086708 - DNA, 14 bp, Homo sapiens
aaatgcatactgtt

SEQ ID NO: 1086709 - DNA, 12 bp, Homo sapiens
aaatgcatattt

SEQ ID NO: 1086710 - DNA, 23 bp, Homo sapiens
aaatgcatccattcctcagggac

SEQ ID NO: 1086711 - DNA, 21 bp, Homo sapiens
aaatgcatgattttgtaaccc

SEQ ID NO: 1086712 - DNA, 13 bp, Homo sapiens
aaatgcatgtctt

SEQ ID NO: 1086713 - DNA, 15 bp, Homo sapiens
aaatgcatgtcttaa

SEQ ID NO: 1086714 - DNA, 24 bp, Homo sapiens
aaatgcatgtcttaaatgctcata

SEQ ID NO: 1086715 - DNA, 16 bp, Homo sapiens
aaatgcattgaaagaa

SEQ ID NO: 1086716 - DNA, 13 bp, Homo sapiens
aaatgcattttct

SEQ ID NO: 1086717 - DNA, 19 bp, Homo sapiens
aaatgcattttcttcagaa

SEQ ID NO: 1086718 - DNA, 16 bp, Homo sapiens
aaatgccagaaacagt

SEQ ID NO: 1086719 - DNA, 18 bp, Homo sapiens
aaatgccatagtttgtga

SEQ ID NO: 1086720 - DNA, 19 bp, Homo sapiens
aaatgccatagtttgtgaa

SEQ ID NO: 1086721 - DNA, 19 bp, Homo sapiens
aaatgcccaaggatgcctt

SEQ ID NO: 1086722 - DNA, 18 bp, Homo sapiens
aaatgcccccattctccc

SEQ ID NO: 1086723 - DNA, 22 bp, Homo sapiens
aaatgccttagaaatgtaaact

SEQ ID NO: 1086724 - DNA, 16 bp, Homo sapiens
aaatgccttgtataaa

SEQ ID NO: 1086725 - DNA, 18 bp, Homo sapiens
aaatgcgaaattattggt

SEQ ID NO: 1086726 - DNA, 19 bp, Homo sapiens
aaattatgcaaaagcagct

SEQ ID NO: 1086727 - DNA, 17 bp, Homo sapiens
aaattatgtgacatttt

SEQ ID NO: 1086728 - DNA, 15 bp, Homo sapiens
aaattattaattgtc

SEQ ID NO: 1086729 - DNA, 21 bp, Homo sapiens
aaattattgtaaactttttca

SEQ ID NO: 1086730 - DNA, 12 bp, Homo sapiens
aaattatttaaa

SEQ ID NO: 1086731 - DNA, 23 bp, Homo sapiens
aaattatttattacttgtgcact

SEQ ID NO: 1086732 - DNA, 20 bp, Homo sapiens
aaattatttcttaattatta

SEQ ID NO: 1086733 - DNA, 22 bp, Homo sapiens
aaattatttcttaattattata

SEQ ID NO: 1086734 - DNA, 13 bp, Homo sapiens
aaattatttgcat

SEQ ID NO: 1086735 - DNA, 16 bp, Homo sapiens
aaattatttgtgtaat

SEQ ID NO: 1086736 - DNA, 21 bp, Homo sapiens
aaattatttgtgtaatagaaa

SEQ ID NO: 1086737 - DNA, 22 bp, Homo sapiens
aaattatttgtgtaatagaaaa

SEQ ID NO: 1086738 - DNA, 17 bp, Homo sapiens
aaattattttaaacaaa

SEQ ID NO: 1086739 - DNA, 21 bp, Homo sapiens
aaattattttaatattttgta

SEQ ID NO: 1086740 - DNA, 21 bp, Homo sapiens
aaattattttgttagtggaaa

SEQ ID NO: 1086741 - DNA, 21 bp, Homo sapiens
aaattcaaaaagtgtttattt

SEQ ID NO: 1086742 - DNA, 14 bp, Homo sapiens
aaattcaaaatgct

SEQ ID NO: 1086743 - DNA, 16 bp, Homo sapiens
aaattcaaacatattc

SEQ ID NO: 1086744 - DNA, 14 bp, Homo sapiens
aaattcaacaaaca

SEQ ID NO: 1086745 - DNA, 16 bp, Homo sapiens
aaattcaacaaacatt

SEQ ID NO: 1086746 - DNA, 16 bp, Homo sapiens
aaattcaagaaaataa

SEQ ID NO: 1086747 - DNA, 18 bp, Homo sapiens
aaattcaagagctagaaa

SEQ ID NO: 1086748 - DNA, 21 bp, Homo sapiens
aaattcaaggccacaaaaaca

SEQ ID NO: 1086749 - DNA, 22 bp, Homo sapiens
aaattcaaggccacaaaaacaa

SEQ ID NO: 1086750 - DNA, 23 bp, Homo sapiens
aaattcaaggccacaaaaacaat

SEQ ID NO: 1086751 - DNA, 14 bp, Homo sapiens
aaattcacaaactt

SEQ ID NO: 1086752 - DNA, 17 bp, Homo sapiens
aaattcacaaactttta

SEQ ID NO: 1086753 - DNA, 22 bp, Homo sapiens
aaattcaccccctttcctggac

SEQ ID NO: 1086754 - DNA, 16 bp, Homo sapiens
aaattcagatcaaaat

SEQ ID NO: 1086755 - DNA, 21 bp, Homo sapiens
aaattcagatcaaaatgcctt

SEQ ID NO: 1086756 - DNA, 21 bp, Homo sapiens
aaattcagcaaaccattttta

SEQ ID NO: 1086757 - DNA, 9 bp, Homo sapiens
aaattcagg

SEQ ID NO: 1086758 - DNA, 13 bp, Homo sapiens
aaattcagtattt

SEQ ID NO: 1086759 - DNA, 21 bp, Homo sapiens
aaattcagtttttgtatcttg

SEQ ID NO: 1086760 - DNA, 12 bp, Homo sapiens
aaattcatttct

SEQ ID NO: 1086761 - DNA, 14 bp, Homo sapiens
aaattccactgaaa

SEQ ID NO: 1086762 - DNA, 22 bp, Homo sapiens
aaattccactgaaaatttaaca

SEQ ID NO: 1086763 - DNA, 23 bp, Homo sapiens
aaattccagcaataagaaatgaa

SEQ ID NO: 1086764 - DNA, 17 bp, Homo sapiens
aaattcccgttttgtca

SEQ ID NO: 1086765 - DNA, 12 bp, Homo sapiens
aaattcctcctt

SEQ ID NO: 1086766 - DNA, 19 bp, Homo sapiens
aaattcctctttgctttgc

SEQ ID NO: 1086767 - DNA, 21 bp, Homo sapiens
aaattcctgtgttcaatattt

SEQ ID NO: 1086768 - DNA, 22 bp, Homo sapiens
aaattcctgtgttcaatattta

SEQ ID NO: 1086769 - DNA, 21 bp, Homo sapiens
aaattcgctgcaacctgttga

SEQ ID NO: 1086770 - DNA, 19 bp, Homo sapiens
aaattctataggaacatat

SEQ ID NO: 1086771 - DNA, 12 bp, Homo sapiens
aaattctatgtt

SEQ ID NO: 1086772 - DNA, 18 bp, Homo sapiens
aaattctatgttaaatac

SEQ ID NO: 1086773 - DNA, 16 bp, Homo sapiens
aaattctcttaaataa

SEQ ID NO: 1086774 - DNA, 22 bp, Homo sapiens
aaattctcttaatcactactgt

SEQ ID NO: 1086775 - DNA, 23 bp, Homo sapiens
aaattctcttaatcactactgta

SEQ ID NO: 1086776 - DNA, 17 bp, Homo sapiens
aaattctgtggcagttt

SEQ ID NO: 1086777 - DNA, 18 bp, Homo sapiens
aaattctgttgttccatt

SEQ ID NO: 1086778 - DNA, 13 bp, Homo sapiens
aaattctgtttct

SEQ ID NO: 1086779 - DNA, 15 bp, Homo sapiens
aaattcttgcaaagt

SEQ ID NO: 1086780 - DNA, 11 bp, Homo sapiens
aaattctttag

SEQ ID NO: 1086781 - DNA, 14 bp, Homo sapiens
aaattctttcactt

SEQ ID NO: 1086782 - DNA, 20 bp, Homo sapiens
aaattctttcccagtctgtc

SEQ ID NO: 1086783 - DNA, 12 bp, Homo sapiens
aaattgaaaaaa

SEQ ID NO: 1086784 - DNA, 14 bp, Homo sapiens
aaattgaaagaact

SEQ ID NO: 1086785 - DNA, 13 bp, Homo sapiens
aaattgaaagtat

SEQ ID NO: 1086786 - DNA, 15 bp, Homo sapiens
aaattgaaagtattc

SEQ ID NO: 1086787 - DNA, 18 bp, Homo sapiens
aaattgaagcaactacaa

SEQ ID NO: 1086788 - DNA, 17 bp, Homo sapiens
aaattgaagtgtcttct

SEQ ID NO: 1086789 - DNA, 13 bp, Homo sapiens
aaattgaatgcaa

SEQ ID NO: 1086790 - DNA, 15 bp, Homo sapiens
aaattgacaaaaaaa

SEQ ID NO: 1086791 - DNA, 22 bp, Homo sapiens
aaattgacttagatattaaaat

SEQ ID NO: 1086792 - DNA, 22 bp, Homo sapiens
aaattgagtgcactaaacaaat

SEQ ID NO: 1086793 - DNA, 13 bp, Homo sapiens
aaattgatttgtt

SEQ ID NO: 1086794 - DNA, 17 bp, Homo sapiens
aaattgatttgttatgg

SEQ ID NO: 1086795 - DNA, 23 bp, Homo sapiens
aaattgatttgttatggttacat

SEQ ID NO: 1086796 - DNA, 22 bp, Homo sapiens
aaattgcagtttcatgtatgta

SEQ ID NO: 1086797 - DNA, 15 bp, Homo sapiens
aaattgcatgaaact

SEQ ID NO: 1086798 - DNA, 16 bp, Homo sapiens
aaattgcatgaaacta

SEQ ID NO: 1086799 - DNA, 18 bp, Homo sapiens
aaattgcatttcctgaca

SEQ ID NO: 1086800 - DNA, 15 bp, Homo sapiens
aaattgctattttat

SEQ ID NO: 1086801 - DNA, 15 bp, Homo sapiens
aaattgctgcttgga

SEQ ID NO: 1086802 - DNA, 23 bp, Homo sapiens
aaattgctgtgctttatggatag

SEQ ID NO: 1086803 - DNA, 21 bp, Homo sapiens
aaattgcttgagcctggctgt

SEQ ID NO: 1086804 - DNA, 22 bp, Homo sapiens
aaattggaatggaactactgta

SEQ ID NO: 1086805 - DNA, 23 bp, Homo sapiens
aaattggcatggaaatttaaagc

SEQ ID NO: 1086806 - DNA, 18 bp, Homo sapiens
aaattgggtgaagagctt

SEQ ID NO: 1086807 - DNA, 16 bp, Homo sapiens
aaattggttctttatt

SEQ ID NO: 1086808 - DNA, 12 bp, Homo sapiens
aaattgtacata

SEQ ID NO: 1086809 - DNA, 13 bp, Homo sapiens
aaattgtacattt

SEQ ID NO: 1086810 - DNA, 15 bp, Homo sapiens
aaattgtaccttttt

SEQ ID NO: 1086811 - DNA, 20 bp, Homo sapiens
aaattgtagctttttattaa

SEQ ID NO: 1086812 - DNA, 16 bp, Homo sapiens
aaattgtagtgcaaaa

SEQ ID NO: 1086813 - DNA, 20 bp, Homo sapiens
aaattgtagtgcaaaatggt

SEQ ID NO: 1086814 - DNA, 18 bp, Homo sapiens
aaattgtatacattttgt

SEQ ID NO: 1086815 - DNA, 13 bp, Homo sapiens
aaattgtatacca

SEQ ID NO: 1086816 - DNA, 22 bp, Homo sapiens
aaattgtatcttattataaaat

SEQ ID NO: 1086817 - DNA, 21 bp, Homo sapiens
aaattgtcccttaaacaaaaa

SEQ ID NO: 1086818 - DNA, 14 bp, Homo sapiens
aaattgtctttaaa

SEQ ID NO: 1086819 - DNA, 15 bp, Homo sapiens
aaattgtgatgtttt

SEQ ID NO: 1086820 - DNA, 23 bp, Homo sapiens
aaattgtgcagtactttgtgcat

SEQ ID NO: 1086821 - DNA, 19 bp, Homo sapiens
aaattgttatcaaaatagt

SEQ ID NO: 1086822 - DNA, 14 bp, Homo sapiens
aaattgttctctta

SEQ ID NO: 1086823 - DNA, 13 bp, Homo sapiens
aaattgtttagtg

SEQ ID NO: 1086824 - DNA, 11 bp, Homo sapiens
aaattgtttca

SEQ ID NO: 1086825 - DNA, 14 bp, Homo sapiens
aaattgtttgtaca

SEQ ID NO: 1086826 - DNA, 14 bp, Homo sapiens
aaattgttttcact

SEQ ID NO: 1086827 - DNA, 18 bp, Homo sapiens
aaattgttttcacttgta

SEQ ID NO: 1086828 - DNA, 18 bp, Homo sapiens
aaatttaaaagtaaaatg

SEQ ID NO: 1086829 - DNA, 22 bp, Homo sapiens
aaatttaaaagtaaaatgtctt

SEQ ID NO: 1086830 - DNA, 13 bp, Homo sapiens
aaatttaaaatta

SEQ ID NO: 1086831 - DNA, 17 bp, Homo sapiens
aaatttaaataatagac

SEQ ID NO: 1086832 - DNA, 16 bp, Homo sapiens
aaatttaagaaaacaa

SEQ ID NO: 1086833 - DNA, 21 bp, Homo sapiens
aaatttaagaaaacaagtata

SEQ ID NO: 1086834 - DNA, 13 bp, Homo sapiens
aaatttaagcaaa

SEQ ID NO: 1086835 - DNA, 14 bp, Homo sapiens
aaatttaagcaaac

SEQ ID NO: 1086836 - DNA, 15 bp, Homo sapiens
aaatttaagcattgt

SEQ ID NO: 1086837 - DNA, 15 bp, Homo sapiens
aaatttaatgctgcc

SEQ ID NO: 1086838 - DNA, 17 bp, Homo sapiens
aaatttactgtgagact

SEQ ID NO: 1086839 - DNA, 19 bp, Homo sapiens
aaatttactgtgagactgt

SEQ ID NO: 1086840 - DNA, 23 bp, Homo sapiens
aaatttagagtcaatttgctgaa

SEQ ID NO: 1086841 - DNA, 19 bp, Homo sapiens
aaatttagccctttaaaac

SEQ ID NO: 1086842 - DNA, 21 bp, Homo sapiens
aaatttataaactaattttgt

SEQ ID NO: 1086843 - DNA, 16 bp, Homo sapiens
aaatttataaaggtct

SEQ ID NO: 1086844 - DNA, 17 bp, Homo sapiens
aaatttatatacttttt

SEQ ID NO: 1086845 - DNA, 14 bp, Homo sapiens
aaatttatatgaaa

SEQ ID NO: 1086846 - DNA, 16 bp, Homo sapiens
aaatttatattgtaaa

SEQ ID NO: 1086847 - DNA, 14 bp, Homo sapiens
aaatttatgcattt

SEQ ID NO: 1086848 - DNA, 17 bp, Homo sapiens
aacactaattcataatc

SEQ ID NO: 1086849 - DNA, 18 bp, Homo sapiens
aacactacctcttttgag

SEQ ID NO: 1086850 - DNA, 15 bp, Homo sapiens
aacactataaaggtt

SEQ ID NO: 1086851 - DNA, 14 bp, Homo sapiens
aacactcagtccac

SEQ ID NO: 1086852 - DNA, 22 bp, Homo sapiens
aacactcctctactcttacaga

SEQ ID NO: 1086853 - DNA, 20 bp, Homo sapiens
aacactcttcttgagcagac

SEQ ID NO: 1086854 - DNA, 16 bp, Homo sapiens
aacactcttttgcttt

SEQ ID NO: 1086855 - DNA, 19 bp, Homo sapiens
aacactcttttgctttatt

SEQ ID NO: 1086856 - DNA, 12 bp, Homo sapiens
aacactgaaaaa

SEQ ID NO: 1086857 - DNA, 15 bp, Homo sapiens
aacactgaaaaatta

SEQ ID NO: 1086858 - DNA, 14 bp, Homo sapiens
aacactgaatcatg

SEQ ID NO: 1086859 - DNA, 16 bp, Homo sapiens
aacactgcaggacagt

SEQ ID NO: 1086860 - DNA, 19 bp, Homo sapiens
aacactgcagtttcctgga

SEQ ID NO: 1086861 - DNA, 22 bp, Homo sapiens
aacactgccatcttagtttgga

SEQ ID NO: 1086862 - DNA, 15 bp, Homo sapiens
aacactgcctctgag

SEQ ID NO: 1086863 - DNA, 20 bp, Homo sapiens
aacactggcacactgctctt

SEQ ID NO: 1086864 - DNA, 23 bp, Homo sapiens
aacactggtggaggatggaaagg

SEQ ID NO: 1086865 - DNA, 14 bp, Homo sapiens
aacactgtattgta

SEQ ID NO: 1086866 - DNA, 17 bp, Homo sapiens
aacactgtcatcaatgt

SEQ ID NO: 1086867 - DNA, 15 bp, Homo sapiens
aacactgtgaccagg

SEQ ID NO: 1086868 - DNA, 20 bp, Homo sapiens
aacactgtggaactaataaa

SEQ ID NO: 1086869 - DNA, 13 bp, Homo sapiens
aacactgttggca

SEQ ID NO: 1086870 - DNA, 22 bp, Homo sapiens
aacactgttggcacttataggt

SEQ ID NO: 1086871 - DNA, 22 bp, Homo sapiens
aacacttgcaggggtccctgct

SEQ ID NO: 1086872 - DNA, 18 bp, Homo sapiens
aacacttggcatacaaaa

SEQ ID NO: 1086873 - DNA, 20 bp, Homo sapiens
aacacttggcatacaaaata

SEQ ID NO: 1086874 - DNA, 22 bp, Homo sapiens
aacacttggcatacaaaatatt

SEQ ID NO: 1086875 - DNA, 18 bp, Homo sapiens
aacactttacaatgttca

SEQ ID NO: 1086876 - DNA, 19 bp, Homo sapiens
aacactttgagcattttta

SEQ ID NO: 1086877 - DNA, 16 bp, Homo sapiens
aacactttgtattact

SEQ ID NO: 1086878 - DNA, 16 bp, Homo sapiens
aacagaaaaacaatct

SEQ ID NO: 1086879 - DNA, 21 bp, Homo sapiens
aacagaaatcaggtgttttaa

SEQ ID NO: 1086880 - DNA, 10 bp, Homo sapiens
aacagaaatg

SEQ ID NO: 1086881 - DNA, 11 bp, Homo sapiens
aacagaaatgt

SEQ ID NO: 1086882 - DNA, 15 bp, Homo sapiens
aacagaaattgtata

SEQ ID NO: 1086883 - DNA, 19 bp, Homo sapiens
aacagaaattgtatattgt

SEQ ID NO: 1086884 - DNA, 11 bp, Homo sapiens
aacagaacagg

SEQ ID NO: 1086885 - DNA, 13 bp, Homo sapiens
aacagaacagggt

SEQ ID NO: 1086886 - DNA, 14 bp, Homo sapiens
aacagaacagggtc

SEQ ID NO: 1086887 - DNA, 17 bp, Homo sapiens
aacagaacagggtcatg

SEQ ID NO: 1086888 - DNA, 20 bp, Homo sapiens
aacagaacatcattagaaca

SEQ ID NO: 1086889 - DNA, 21 bp, Homo sapiens
aacagaactcgatgcactgac

SEQ ID NO: 1086890 - DNA, 13 bp, Homo sapiens
aacagaagaaaat

SEQ ID NO: 1086891 - DNA, 20 bp, Homo sapiens
aacagaagaaaatagaattg

SEQ ID NO: 1086892 - DNA, 22 bp, Homo sapiens
aacagaagctcttactctttcc

SEQ ID NO: 1086893 - DNA, 21 bp, Homo sapiens
aacagaatcagtgttaaattc

SEQ ID NO: 1086894 - DNA, 15 bp, Homo sapiens
aacagaatcttctgg

SEQ ID NO: 1086895 - DNA, 14 bp, Homo sapiens
aacagaatgtttta

SEQ ID NO: 1086896 - DNA, 13 bp, Homo sapiens
aacagaattttaa

SEQ ID NO: 1086897 - DNA, 18 bp, Homo sapiens
aacagacaacagaagtca

SEQ ID NO: 1086898 - DNA, 19 bp, Homo sapiens
aacagacaccatcttttgt

SEQ ID NO: 1086899 - DNA, 17 bp, Homo sapiens
aacagaccaatagacat

SEQ ID NO: 1086900 - DNA, 19 bp, Homo sapiens
aacagaccccctctagaaa

SEQ ID NO: 1086901 - DNA, 15 bp, Homo sapiens
aacagactagaagta

SEQ ID NO: 1086902 - DNA, 14 bp, Homo sapiens
aacagactctcaca

SEQ ID NO: 1086903 - DNA, 14 bp, Homo sapiens
aacagagaaagaaa

SEQ ID NO: 1086904 - DNA, 15 bp, Homo sapiens
aacagagaaagaaaa

SEQ ID NO: 1086905 - DNA, 17 bp, Homo sapiens
aacagagaaagaaaagg

SEQ ID NO: 1086906 - DNA, 14 bp, Homo sapiens
aacagagaaagggt

SEQ ID NO: 1086907 - DNA, 13 bp, Homo sapiens
aacagagaaggca

SEQ ID NO: 1086908 - DNA, 19 bp, Homo sapiens
aacagagacaggcccaaga

SEQ ID NO: 1086909 - DNA, 16 bp, Homo sapiens
aacagagagaatgaga

SEQ ID NO: 1086910 - DNA, 20 bp, Homo sapiens
aacagaggcaggagtggcag

SEQ ID NO: 1086911 - DNA, 17 bp, Homo sapiens
aacagaggccatggcag

SEQ ID NO: 1086912 - DNA, 21 bp, Homo sapiens
aacagaggccatggcagaata

SEQ ID NO: 1086913 - DNA, 20 bp, Homo sapiens
aacagagggaccaaattgct

SEQ ID NO: 1086914 - DNA, 13 bp, Homo sapiens
aacagagggctgc

SEQ ID NO: 1086915 - DNA, 20 bp, Homo sapiens
aacagagtccaatttaagga

SEQ ID NO: 1086916 - DNA, 15 bp, Homo sapiens
aacagagtgaaaaat

SEQ ID NO: 1086917 - DNA, 15 bp, Homo sapiens
aacagagtggcctcc

SEQ ID NO: 1086918 - DNA, 22 bp, Homo sapiens
aacagatgcaatgtgctactga

SEQ ID NO: 1086919 - DNA, 14 bp, Homo sapiens
aacagatgcttttc

SEQ ID NO: 1086920 - DNA, 21 bp, Homo sapiens
aacagatggggtctgtgactg

SEQ ID NO: 1086921 - DNA, 23 bp, Homo sapiens
aacagatggggtctgtgactgga

SEQ ID NO: 1086922 - DNA, 20 bp, Homo sapiens
aacagattcaggccagccca

SEQ ID NO: 1086923 - DNA, 20 bp, Homo sapiens
aacagattctgattcccttc

SEQ ID NO: 1086924 - DNA, 15 bp, Homo sapiens
aacagattgtttgca

SEQ ID NO: 1086925 - DNA, 14 bp, Homo sapiens
aacagatttttaca

SEQ ID NO: 1086926 - DNA, 13 bp, Homo sapiens
aacagcaagaaat

SEQ ID NO: 1086927 - DNA, 17 bp, Homo sapiens
aacagcaagaaataaat

SEQ ID NO: 1086928 - DNA, 21 bp, Homo sapiens
aacagcactggctctctccag

SEQ ID NO: 1086929 - DNA, 16 bp, Homo sapiens
aacagcagaggttctt

SEQ ID NO: 1086930 - DNA, 11 bp, Homo sapiens
aacagcagtgt

SEQ ID NO: 1086931 - DNA, 15 bp, Homo sapiens
aacagcagtttgtga

SEQ ID NO: 1086932 - DNA, 23 bp, Homo sapiens
aacagcattcttgtcacaataaa

SEQ ID NO: 1086933 - DNA, 12 bp, Homo sapiens
aacagcattgct

SEQ ID NO: 1086934 - DNA, 16 bp, Homo sapiens
aacagcattgctttct

SEQ ID NO: 1086935 - DNA, 17 bp, Homo sapiens
aacagcattgctttctg

SEQ ID NO: 1086936 - DNA, 16 bp, Homo sapiens
aacagccatgcccgca

SEQ ID NO: 1086937 - DNA, 22 bp, Homo sapiens
aacagcccaggcatctccttgg

SEQ ID NO: 1086938 - DNA, 18 bp, Homo sapiens
aacagcctcttgcccgtc

SEQ ID NO: 1086939 - DNA, 11 bp, Homo sapiens
aacagccttag

SEQ ID NO: 1086940 - DNA, 16 bp, Homo sapiens
aacagccttagctgcc

SEQ ID NO: 1086941 - DNA, 16 bp, Homo sapiens
aacagctctgagatcc

SEQ ID NO: 1086942 - DNA, 19 bp, Homo sapiens
aacagctctgagatcctgg

SEQ ID NO: 1086943 - DNA, 23 bp, Homo sapiens
aacagctctgagatcctggagtg

SEQ ID NO: 1086944 - DNA, 11 bp, Homo sapiens
aacagctgcaa

SEQ ID NO: 1086945 - DNA, 19 bp, Homo sapiens
aacagctgcaattccctgg

SEQ ID NO: 1086946 - DNA, 21 bp, Homo sapiens
aacagctggggacaactgcgg

SEQ ID NO: 1086947 - DNA, 14 bp, Homo sapiens
aacagctgtattta

SEQ ID NO: 1086948 - DNA, 15 bp, Homo sapiens
aacagctgtatttat

SEQ ID NO: 1086949 - DNA, 20 bp, Homo sapiens
aacagctgtgagccatgcct

SEQ ID NO: 1086950 - DNA, 21 bp, Homo sapiens
aacagctgtgagccatgcctc

SEQ ID NO: 1086951 - DNA, 21 bp, Homo sapiens
aacagcttcatgcctttgtaa

SEQ ID NO: 1086952 - DNA, 15 bp, Homo sapiens
aacagcttgctgtca

SEQ ID NO: 1086953 - DNA, 18 bp, Homo sapiens
aacagcttttcccaggag

SEQ ID NO: 1086954 - DNA, 22 bp, Homo sapiens
aacaggaaaaaaacttttataa

SEQ ID NO: 1086955 - DNA, 22 bp, Homo sapiens
aacaggaaaggctcgaaataca

SEQ ID NO: 1086956 - DNA, 18 bp, Homo sapiens
aacaggaattttattttg

SEQ ID NO: 1086957 - DNA, 21 bp, Homo sapiens
aacaggaattttattttgctg

SEQ ID NO: 1086958 - DNA, 23 bp, Homo sapiens
aacaggagaatggggttcctgct

SEQ ID NO: 1086959 - DNA, 17 bp, Homo sapiens
aacaggagacaggaagg

SEQ ID NO: 1086960 - DNA, 20 bp, Homo sapiens
aacaggcaaagttttacaga

SEQ ID NO: 1086961 - DNA, 23 bp, Homo sapiens
aacaggccattgtgaaccaatgc

SEQ ID NO: 1086962 - DNA, 13 bp, Homo sapiens
aacaggcccagca

SEQ ID NO: 1086963 - DNA, 21 bp, Homo sapiens
aacagggagaagtagctagta

SEQ ID NO: 1086964 - DNA, 15 bp, Homo sapiens
aacagggagcacctg

SEQ ID NO: 1086965 - DNA, 11 bp, Homo sapiens
aacagggaggg

SEQ ID NO: 1086966 - DNA, 16 bp, Homo sapiens
aacagggccacataga

SEQ ID NO: 1086967 - DNA, 20 bp, Homo sapiens
aacagggcgggggggggggc

SEQ ID NO: 1086968 - DNA, 19 bp, Homo sapiens
aacagggctatttgaagaa

SEQ ID NO: 1086969 - DNA, 21 bp, Homo sapiens
aacagggctgccttctggcct

SEQ ID NO: 1086970 - DNA, 15 bp, Homo sapiens
aaccaatacagaatt

SEQ ID NO: 1086971 - DNA, 24 bp, Homo sapiens
aaccaatgcctttttagatgtatt

SEQ ID NO: 1086972 - DNA, 19 bp, Homo sapiens
aaccaatggtgatcctcta

SEQ ID NO: 1086973 - DNA, 21 bp, Homo sapiens
aaccaatggtgatcctctatt

SEQ ID NO: 1086974 - DNA, 13 bp, Homo sapiens
aaccaatgtggca

SEQ ID NO: 1086975 - DNA, 12 bp, Homo sapiens
aaccaatttctt

SEQ ID NO: 1086976 - DNA, 16 bp, Homo sapiens
aaccaatttcttcctt

SEQ ID NO: 1086977 - DNA, 17 bp, Homo sapiens
aaccaatttcttccttc

SEQ ID NO: 1086978 - DNA, 21 bp, Homo sapiens
aaccacaaacggagcccctga

SEQ ID NO: 1086979 - DNA, 19 bp, Homo sapiens
aaccacaaggtccactccc

SEQ ID NO: 1086980 - DNA, 17 bp, Homo sapiens
aaccacaatgtttcttc

SEQ ID NO: 1086981 - DNA, 23 bp, Homo sapiens
aaccacaccacatctaagcctga

SEQ ID NO: 1086982 - DNA, 22 bp, Homo sapiens
aaccacactcaccccagcctca

SEQ ID NO: 1086983 - DNA, 15 bp, Homo sapiens
aaccacacttcttga

SEQ ID NO: 1086984 - DNA, 13 bp, Homo sapiens
aaccacagatgtg

SEQ ID NO: 1086985 - DNA, 13 bp, Homo sapiens
aaccacagccctg

SEQ ID NO: 1086986 - DNA, 14 bp, Homo sapiens
aaccacagccctgt

SEQ ID NO: 1086987 - DNA, 21 bp, Homo sapiens
aaccacagctgggcagggtga

SEQ ID NO: 1086988 - DNA, 21 bp, Homo sapiens
aaccacataatttttgtacat

SEQ ID NO: 1086989 - DNA, 14 bp, Homo sapiens
aaccacattgaaga

SEQ ID NO: 1086990 - DNA, 22 bp, Homo sapiens
aaccacattgaagaatgttaga

SEQ ID NO: 1086991 - DNA, 22 bp, Homo sapiens
aaccaccagcgttcccttctcc

SEQ ID NO: 1086992 - DNA, 14 bp, Homo sapiens
aaccacccaaaaca

SEQ ID NO: 1086993 - DNA, 15 bp, Homo sapiens
aaccaccctctgggg

SEQ ID NO: 1086994 - DNA, 20 bp, Homo sapiens
aaccaccgcatatgcatgcc

SEQ ID NO: 1086995 - DNA, 21 bp, Homo sapiens
aaccaccgcatatgcatgcca

SEQ ID NO: 1086996 - DNA, 14 bp, Homo sapiens
aaccacgaggctgc

SEQ ID NO: 1086997 - DNA, 19 bp, Homo sapiens
aaccactcaaattaatctt

SEQ ID NO: 1086998 - DNA, 21 bp, Homo sapiens
aaccactcccaccacaggcat

SEQ ID NO: 1086999 - DNA, 11 bp, Homo sapiens
aaccactgaat

SEQ ID NO: 1087000 - DNA, 16 bp, Homo sapiens
aaccactgcttctctt

SEQ ID NO: 1087001 - DNA, 15 bp, Homo sapiens
aaccactgtaaaatg

SEQ ID NO: 1087002 - DNA, 16 bp, Homo sapiens
aaccactgtaaaatga

SEQ ID NO: 1087003 - DNA, 14 bp, Homo sapiens
aaccactgtgccac

SEQ ID NO: 1087004 - DNA, 21 bp, Homo sapiens
aaccactgtgcgtcttggtgt

SEQ ID NO: 1087005 - DNA, 13 bp, Homo sapiens
aaccacttctcca

SEQ ID NO: 1087006 - DNA, 20 bp, Homo sapiens
aaccacttctccatgctgca

SEQ ID NO: 1087007 - DNA, 20 bp, Homo sapiens
aaccacttctctgctgcctc

SEQ ID NO: 1087008 - DNA, 12 bp, Homo sapiens
aaccacttgcct

SEQ ID NO: 1087009 - DNA, 22 bp, Homo sapiens
aaccagaaaagcaatactgttt

SEQ ID NO: 1087010 - DNA, 17 bp, Homo sapiens
aaccagactttgagcct

SEQ ID NO: 1087011 - DNA, 23 bp, Homo sapiens
aaccagagggtgtggctttccag

SEQ ID NO: 1087012 - DNA, 15 bp, Homo sapiens
aaccagagtgctgaa

SEQ ID NO: 1087013 - DNA, 15 bp, Homo sapiens
aaccagcccagcctg

SEQ ID NO: 1087014 - DNA, 15 bp, Homo sapiens
aaccagccccatcag

SEQ ID NO: 1087015 - DNA, 20 bp, Homo sapiens
aaccagcccgacagtgccat

SEQ ID NO: 1087016 - DNA, 14 bp, Homo sapiens
aaccagccggggcc

SEQ ID NO: 1087017 - DNA, 20 bp, Homo sapiens
aaccagctggtctgggtgta

SEQ ID NO: 1087018 - DNA, 12 bp, Homo sapiens
aaccaggaaaaa

SEQ ID NO: 1087019 - DNA, 13 bp, Homo sapiens
aaccaggaaaagg

SEQ ID NO: 1087020 - DNA, 12 bp, Homo sapiens
aaccaggaccca

SEQ ID NO: 1087021 - DNA, 11 bp, Homo sapiens
aaccagggcct

SEQ ID NO: 1087022 - DNA, 14 bp, Homo sapiens
aaccaggtgcaatt

SEQ ID NO: 1087023 - DNA, 14 bp, Homo sapiens
aaccaggttgcagt

SEQ ID NO: 1087024 - DNA, 16 bp, Homo sapiens
aaccagtatttttgct

SEQ ID NO: 1087025 - DNA, 21 bp, Homo sapiens
aaccagtatttttgctgcttc

SEQ ID NO: 1087026 - DNA, 22 bp, Homo sapiens
aaccagtatttttgctgcttct

SEQ ID NO: 1087027 - DNA, 22 bp, Homo sapiens
aaccagtctgaagtttcattta

SEQ ID NO: 1087028 - DNA, 13 bp, Homo sapiens
aaccagttaaagc

SEQ ID NO: 1087029 - DNA, 14 bp, Homo sapiens
aaccataaaagaag

SEQ ID NO: 1087030 - DNA, 16 bp, Homo sapiens
aaccataactgacaag

SEQ ID NO: 1087031 - DNA, 19 bp, Homo sapiens
aaccataactgacaagaga

SEQ ID NO: 1087032 - DNA, 22 bp, Homo sapiens
aaccatagcacaggctaatttt

SEQ ID NO: 1087033 - DNA, 20 bp, Homo sapiens
aaccatccatccctagaaga

SEQ ID NO: 1087034 - DNA, 22 bp, Homo sapiens
aaccatccctgatgtctgtctg

SEQ ID NO: 1087035 - DNA, 14 bp, Homo sapiens
aaccatgaactcag

SEQ ID NO: 1087036 - DNA, 22 bp, Homo sapiens
aaccatgagaccactgttatca

SEQ ID NO: 1087037 - DNA, 22 bp, Homo sapiens
aaccatggctgaaggaaaccag

SEQ ID NO: 1087038 - DNA, 17 bp, Homo sapiens
aaccatgtagaaaattt

SEQ ID NO: 1087039 - DNA, 23 bp, Homo sapiens
aaccatgtcagcaaaaagcaaaa

SEQ ID NO: 1087040 - DNA, 13 bp, Homo sapiens
aaccatgttttgg

SEQ ID NO: 1087041 - DNA, 14 bp, Homo sapiens
aaccattaaagtca

SEQ ID NO: 1087042 - DNA, 15 bp, Homo sapiens
aaccattacatgttt

SEQ ID NO: 1087043 - DNA, 20 bp, Homo sapiens
aaccattacatgtttaaatt

SEQ ID NO: 1087044 - DNA, 17 bp, Homo sapiens
aaccattcaaaaatttc

SEQ ID NO: 1087045 - DNA, 19 bp, Homo sapiens
aaccattcaaaaatttcac

SEQ ID NO: 1087046 - DNA, 15 bp, Homo sapiens
aaccattccaacttc

SEQ ID NO: 1087047 - DNA, 17 bp, Homo sapiens
aaccattccatttccaa

SEQ ID NO: 1087048 - DNA, 16 bp, Homo sapiens
aaccattcgacctata

SEQ ID NO: 1087049 - DNA, 18 bp, Homo sapiens
aaccattgtaactattaa

SEQ ID NO: 1087050 - DNA, 21 bp, Homo sapiens
aaccatttaaagaaagaatgc

SEQ ID NO: 1087051 - DNA, 17 bp, Homo sapiens
aaccatttaataaagaa

SEQ ID NO: 1087052 - DNA, 20 bp, Homo sapiens
aaccatttaataaagaaata

SEQ ID NO: 1087053 - DNA, 12 bp, Homo sapiens
aaccatttccaa

SEQ ID NO: 1087054 - DNA, 13 bp, Homo sapiens
aaccatttccaac

SEQ ID NO: 1087055 - DNA, 21 bp, Homo sapiens
aaccatttccaacagcaacac

SEQ ID NO: 1087056 - DNA, 15 bp, Homo sapiens
aaccattttattttt

SEQ ID NO: 1087057 - DNA, 12 bp, Homo sapiens
aaccattttcct

SEQ ID NO: 1087058 - DNA, 13 bp, Homo sapiens
aaccattttcctt

SEQ ID NO: 1087059 - DNA, 22 bp, Homo sapiens
aaccattttttgttctgtgtcc

SEQ ID NO: 1087060 - DNA, 20 bp, Homo sapiens
aaccattttttttcagcaga

SEQ ID NO: 1087061 - DNA, 15 bp, Homo sapiens
aacccaagctctggg

SEQ ID NO: 1087062 - DNA, 15 bp, Homo sapiens
aacccaagcttagaa

SEQ ID NO: 1087063 - DNA, 16 bp, Homo sapiens
aacccaagcttagaac

SEQ ID NO: 1087064 - DNA, 16 bp, Homo sapiens
aacccaagtgggggca

SEQ ID NO: 1087065 - DNA, 22 bp, Homo sapiens
aacccaagtttatttctctctt

SEQ ID NO: 1087066 - DNA, 14 bp, Homo sapiens
aacccaatccaaat

SEQ ID NO: 1087067 - DNA, 18 bp, Homo sapiens
aacccacaagctgcctct

SEQ ID NO: 1087068 - DNA, 21 bp, Homo sapiens
aacccacagatgtctctgggg

SEQ ID NO: 1087069 - DNA, 23 bp, Homo sapiens
aacccacttctggcctccagcct

SEQ ID NO: 1087070 - DNA, 16 bp, Homo sapiens
aacccagcaacagaaa

SEQ ID NO: 1087071 - DNA, 18 bp, Homo sapiens
aacccagcggcttagcca

SEQ ID NO: 1087072 - DNA, 17 bp, Homo sapiens
aacccaggacgcttctg

SEQ ID NO: 1087073 - DNA, 19 bp, Homo sapiens
aacccaggacgcttctgaa

SEQ ID NO: 1087074 - DNA, 12 bp, Homo sapiens
aacccagggcaa

SEQ ID NO: 1087075 - DNA, 17 bp, Homo sapiens
aacccagggctctgccc

SEQ ID NO: 1087076 - DNA, 22 bp, Homo sapiens
aacccagggctctgccccagtc

SEQ ID NO: 1087077 - DNA, 16 bp, Homo sapiens
aacccagtctcctctc

SEQ ID NO: 1087078 - DNA, 19 bp, Homo sapiens
aacccagtctcctctccat

SEQ ID NO: 1087079 - DNA, 13 bp, Homo sapiens
aacccagttactt

SEQ ID NO: 1087080 - DNA, 19 bp, Homo sapiens
aacccataatcatgtaaat

SEQ ID NO: 1087081 - DNA, 21 bp, Homo sapiens
aacccatacaatgtatgtaca

SEQ ID NO: 1087082 - DNA, 20 bp, Homo sapiens
aacccatcaacaaaaattgt

SEQ ID NO: 1087083 - DNA, 17 bp, Homo sapiens
aacccattcactacagg

SEQ ID NO: 1087084 - DNA, 20 bp, Homo sapiens
aaccccaaggactgagggca

SEQ ID NO: 1087085 - DNA, 21 bp, Homo sapiens
aaccccagcctgacctgagac

SEQ ID NO: 1087086 - DNA, 18 bp, Homo sapiens
aaccccagttctgctcct

SEQ ID NO: 1087087 - DNA, 13 bp, Homo sapiens
aaccccatgggct

SEQ ID NO: 1087088 - DNA, 18 bp, Homo sapiens
aaccccatgtcctcagca

SEQ ID NO: 1087089 - DNA, 16 bp, Homo sapiens
aacccccaaggaggaa

SEQ ID NO: 1087090 - DNA, 12 bp, Homo sapiens
aacccccacccc

SEQ ID NO: 1087091 - DNA, 19 bp, Homo sapiens
aacccccaccccacacttg

SEQ ID NO: 1087092 - DNA, 14 bp, Homo sapiens
aactatctgcatta

SEQ ID NO: 1087093 - DNA, 18 bp, Homo sapiens
aactatctgcattatcta

SEQ ID NO: 1087094 - DNA, 18 bp, Homo sapiens
aactatcttggtgaattt

SEQ ID NO: 1087095 - DNA, 17 bp, Homo sapiens
aactatgaactacaaag

SEQ ID NO: 1087096 - DNA, 20 bp, Homo sapiens
aactatgatttattttggtg

SEQ ID NO: 1087097 - DNA, 17 bp, Homo sapiens
aactatgcctatgtagt

SEQ ID NO: 1087098 - DNA, 23 bp, Homo sapiens
aactatgcctatgtagtgtcttt

SEQ ID NO: 1087099 - DNA, 23 bp, Homo sapiens
aactatggttcccaataaaagtg

SEQ ID NO: 1087100 - DNA, 23 bp, Homo sapiens
aactatgtgctatcacatgtgaa

SEQ ID NO: 1087101 - DNA, 22 bp, Homo sapiens
aactatgtgtttttctcatatt

SEQ ID NO: 1087102 - DNA, 20 bp, Homo sapiens
aactattagagtatttccct

SEQ ID NO: 1087103 - DNA, 23 bp, Homo sapiens
aactattagagtatttcccttcc

SEQ ID NO: 1087104 - DNA, 15 bp, Homo sapiens
aactattggaaagta

SEQ ID NO: 1087105 - DNA, 22 bp, Homo sapiens
aactattgtgctcagagacact

SEQ ID NO: 1087106 - DNA, 12 bp, Homo sapiens
aactatttaaaa

SEQ ID NO: 1087107 - DNA, 19 bp, Homo sapiens
aactatttaaaataaagag

SEQ ID NO: 1087108 - DNA, 23 bp, Homo sapiens
aactatttatctgtgtttttgaa

SEQ ID NO: 1087109 - DNA, 22 bp, Homo sapiens
aactatttattgtgctgggtcc

SEQ ID NO: 1087110 - DNA, 19 bp, Homo sapiens
aactatttgtctttcagga

SEQ ID NO: 1087111 - DNA, 18 bp, Homo sapiens
aactattttgttttaatc

SEQ ID NO: 1087112 - DNA, 19 bp, Homo sapiens
aactattttgttttaatct

SEQ ID NO: 1087113 - DNA, 16 bp, Homo sapiens
aactcaaaatatttgt

SEQ ID NO: 1087114 - DNA, 17 bp, Homo sapiens
aactcaaactcttaaaa

SEQ ID NO: 1087115 - DNA, 22 bp, Homo sapiens
aactcaaagatgatggaaacgc

SEQ ID NO: 1087116 - DNA, 21 bp, Homo sapiens
aactcaaatgtgagtgttttt

SEQ ID NO: 1087117 - DNA, 21 bp, Homo sapiens
aactcaagatttgaccaaatc

SEQ ID NO: 1087118 - DNA, 22 bp, Homo sapiens
aactcaaggataccttcttatt

SEQ ID NO: 1087119 - DNA, 23 bp, Homo sapiens
aactcaaggataccttcttattt

SEQ ID NO: 1087120 - DNA, 19 bp, Homo sapiens
aactcaatgctttatttgt

SEQ ID NO: 1087121 - DNA, 20 bp, Homo sapiens
aactcaatgctttatttgta

SEQ ID NO: 1087122 - DNA, 13 bp, Homo sapiens
aactcacagagct

SEQ ID NO: 1087123 - DNA, 21 bp, Homo sapiens
aactcacctaatgtttatgag

SEQ ID NO: 1087124 - DNA, 17 bp, Homo sapiens
aactcactctgggctgt

SEQ ID NO: 1087125 - DNA, 16 bp, Homo sapiens
aactcactgattctct

SEQ ID NO: 1087126 - DNA, 14 bp, Homo sapiens
aactcactgcctag

SEQ ID NO: 1087127 - DNA, 15 bp, Homo sapiens
aactcactgcctagg

SEQ ID NO: 1087128 - DNA, 21 bp, Homo sapiens
aactcactgctcaagaagaca

SEQ ID NO: 1087129 - DNA, 15 bp, Homo sapiens
aactcactgtgatca

SEQ ID NO: 1087130 - DNA, 13 bp, Homo sapiens
aactcagaagaga

SEQ ID NO: 1087131 - DNA, 14 bp, Homo sapiens
aactcagaagagaa

SEQ ID NO: 1087132 - DNA, 21 bp, Homo sapiens
aactcagatctgatcaagagt

SEQ ID NO: 1087133 - DNA, 16 bp, Homo sapiens
aactcagattgactaa

SEQ ID NO: 1087134 - DNA, 21 bp, Homo sapiens
aactcagattgactaaataaa

SEQ ID NO: 1087135 - DNA, 14 bp, Homo sapiens
aactcagcagttga

SEQ ID NO: 1087136 - DNA, 20 bp, Homo sapiens
aactcagctattaagaaaat

SEQ ID NO: 1087137 - DNA, 14 bp, Homo sapiens
aactcaggcaaaga

SEQ ID NO: 1087138 - DNA, 18 bp, Homo sapiens
aactcagttttaactaga

SEQ ID NO: 1087139 - DNA, 21 bp, Homo sapiens
aactcataatctataaacaat

SEQ ID NO: 1087140 - DNA, 14 bp, Homo sapiens
aactcatcataaaa

SEQ ID NO: 1087141 - DNA, 14 bp, Homo sapiens
aactcatcattttt

SEQ ID NO: 1087142 - DNA, 17 bp, Homo sapiens
aactcatcctcttttaa

SEQ ID NO: 1087143 - DNA, 22 bp, Homo sapiens
aactcatttcctatgtaactgc

SEQ ID NO: 1087144 - DNA, 19 bp, Homo sapiens
aactcatttgttaaaatta

SEQ ID NO: 1087145 - DNA, 10 bp, Homo sapiens
aactccaaga

SEQ ID NO: 1087146 - DNA, 16 bp, Homo sapiens
aactccaagcagactc

SEQ ID NO: 1087147 - DNA, 14 bp, Homo sapiens
aactccacatctgc

SEQ ID NO: 1087148 - DNA, 22 bp, Homo sapiens
aactccaccgaccaactgccct

SEQ ID NO: 1087149 - DNA, 21 bp, Homo sapiens
aactccaggaaagagcagtca

SEQ ID NO: 1087150 - DNA, 16 bp, Homo sapiens
aactccaggccctcct

SEQ ID NO: 1087151 - DNA, 10 bp, Homo sapiens
aactccaggg

SEQ ID NO: 1087152 - DNA, 19 bp, Homo sapiens
aactccagggtcccctgcc

SEQ ID NO: 1087153 - DNA, 18 bp, Homo sapiens
aactccataagtaagaaa

SEQ ID NO: 1087154 - DNA, 16 bp, Homo sapiens
aactccatacagcctc

SEQ ID NO: 1087155 - DNA, 19 bp, Homo sapiens
aactccatacagcctctac

SEQ ID NO: 1087156 - DNA, 13 bp, Homo sapiens
aactccatcattc

SEQ ID NO: 1087157 - DNA, 20 bp, Homo sapiens
aactccatggggttcgagac

SEQ ID NO: 1087158 - DNA, 15 bp, Homo sapiens
aactcccctccccca

SEQ ID NO: 1087159 - DNA, 23 bp, Homo sapiens
aactcccctgggggtttcacctg

SEQ ID NO: 1087160 - DNA, 14 bp, Homo sapiens
aactccccttccct

SEQ ID NO: 1087161 - DNA, 19 bp, Homo sapiens
aactccccttccctgggga

SEQ ID NO: 1087162 - DNA, 18 bp, Homo sapiens
aactccctccaccagcct

SEQ ID NO: 1087163 - DNA, 19 bp, Homo sapiens
aactccctccaccagcctg

SEQ ID NO: 1087164 - DNA, 20 bp, Homo sapiens
aactccctccaccagcctgc

SEQ ID NO: 1087165 - DNA, 13 bp, Homo sapiens
aactccctgcccc

SEQ ID NO: 1087166 - DNA, 14 bp, Homo sapiens
aactcccttcaaaa

SEQ ID NO: 1087167 - DNA, 15 bp, Homo sapiens
aactccgcccccagc

SEQ ID NO: 1087168 - DNA, 18 bp, Homo sapiens
aactccgcccccagccta

SEQ ID NO: 1087169 - DNA, 19 bp, Homo sapiens
aactccgcccccagcctat

SEQ ID NO: 1087170 - DNA, 21 bp, Homo sapiens
aactcctcacacaccctgagg

SEQ ID NO: 1087171 - DNA, 15 bp, Homo sapiens
aactcctgaaattca

SEQ ID NO: 1087172 - DNA, 11 bp, Homo sapiens
aactcctgacc

SEQ ID NO: 1087173 - DNA, 23 bp, Homo sapiens
aactcctgacgtctgaagcttga

SEQ ID NO: 1087174 - DNA, 17 bp, Homo sapiens
aactcctgattttgtag

SEQ ID NO: 1087175 - DNA, 14 bp, Homo sapiens
aactcctgtccttt

SEQ ID NO: 1087176 - DNA, 11 bp, Homo sapiens
aactcctgtgt

SEQ ID NO: 1087177 - DNA, 13 bp, Homo sapiens
aactcctgtttct

SEQ ID NO: 1087178 - DNA, 21 bp, Homo sapiens
aactcctgtttctccttagtt

SEQ ID NO: 1087179 - DNA, 19 bp, Homo sapiens
aactccttattttgtatta

SEQ ID NO: 1087180 - DNA, 16 bp, Homo sapiens
aactcgaatctgtgtg

SEQ ID NO: 1087181 - DNA, 15 bp, Homo sapiens
aactcgatgcactga

SEQ ID NO: 1087182 - DNA, 16 bp, Homo sapiens
aactcgcgctcagtaa

SEQ ID NO: 1087183 - DNA, 17 bp, Homo sapiens
aactcgggctcccgggt

SEQ ID NO: 1087184 - DNA, 17 bp, Homo sapiens
aactcgggggcgcctgg

SEQ ID NO: 1087185 - DNA, 18 bp, Homo sapiens
aactcgggggcgcctgga

SEQ ID NO: 1087186 - DNA, 22 bp, Homo sapiens
aactcggtttggtagacttgga

SEQ ID NO: 1087187 - DNA, 14 bp, Homo sapiens
aactctaaaagatc

SEQ ID NO: 1087188 - DNA, 15 bp, Homo sapiens
aactctaaccctgtg

SEQ ID NO: 1087189 - DNA, 17 bp, Homo sapiens
aactctaaccctgtgga

SEQ ID NO: 1087190 - DNA, 18 bp, Homo sapiens
aactctaaccctgtggaa

SEQ ID NO: 1087191 - DNA, 15 bp, Homo sapiens
aactctacccctgct

SEQ ID NO: 1087192 - DNA, 16 bp, Homo sapiens
aactctacccctgctc

SEQ ID NO: 1087193 - DNA, 23 bp, Homo sapiens
aactctagctgggggtgggccag

SEQ ID NO: 1087194 - DNA, 18 bp, Homo sapiens
aactctagggatataaaa

SEQ ID NO: 1087195 - DNA, 22 bp, Homo sapiens
aactctcaccatgatgtgaaga

SEQ ID NO: 1087196 - DNA, 15 bp, Homo sapiens
aactctccactccat

SEQ ID NO: 1087197 - DNA, 11 bp, Homo sapiens
aactctcccca

SEQ ID NO: 1087198 - DNA, 22 bp, Homo sapiens
aactctcgggacctcgtttggg

SEQ ID NO: 1087199 - DNA, 22 bp, Homo sapiens
aactctctccctggtctctgcc

SEQ ID NO: 1087200 - DNA, 20 bp, Homo sapiens
aactctctgtcttctctcca

SEQ ID NO: 1087201 - DNA, 22 bp, Homo sapiens
aactctctgtcttctctccact

SEQ ID NO: 1087202 - DNA, 19 bp, Homo sapiens
aactctctttgggaatgtt

SEQ ID NO: 1087203 - DNA, 11 bp, Homo sapiens
aactctgcaaa

SEQ ID NO: 1087204 - DNA, 16 bp, Homo sapiens
aactctgcactccatg

SEQ ID NO: 1087205 - DNA, 23 bp, Homo sapiens
aactctgcactccatggccaccc

SEQ ID NO: 1087206 - DNA, 11 bp, Homo sapiens
aactctgctgt

SEQ ID NO: 1087207 - DNA, 22 bp, Homo sapiens
aactctgctgtctaacctgtga

SEQ ID NO: 1087208 - DNA, 21 bp, Homo sapiens
aactctggacactctatatgt

SEQ ID NO: 1087209 - DNA, 12 bp, Homo sapiens
aactctggctca

SEQ ID NO: 1087210 - DNA, 16 bp, Homo sapiens
aactctggctcagcct

SEQ ID NO: 1087211 - DNA, 16 bp, Homo sapiens
aactctggcttccagg

SEQ ID NO: 1087212 - DNA, 16 bp, Homo sapiens
aactctggggcttgtc

SEQ ID NO: 1087213 - DNA, 15 bp, Homo sapiens
aacttccaaagaaag

SEQ ID NO: 1087214 - DNA, 18 bp, Homo sapiens
aacttccaacaagcctca

SEQ ID NO: 1087215 - DNA, 21 bp, Homo sapiens
aacttccaaggccctgctttt

SEQ ID NO: 1087216 - DNA, 22 bp, Homo sapiens
aacttccaaggccctgcttttt

SEQ ID NO: 1087217 - DNA, 20 bp, Homo sapiens
aacttccagaggacagctct

SEQ ID NO: 1087218 - DNA, 14 bp, Homo sapiens
aacttccgctgagg

SEQ ID NO: 1087219 - DNA, 15 bp, Homo sapiens
aacttccgctgaggg

SEQ ID NO: 1087220 - DNA, 16 bp, Homo sapiens
aacttcctctgccatg

SEQ ID NO: 1087221 - DNA, 13 bp, Homo sapiens
aacttcctgctgc

SEQ ID NO: 1087222 - DNA, 14 bp, Homo sapiens
aacttcctgctgca

SEQ ID NO: 1087223 - DNA, 12 bp, Homo sapiens
aacttcctttac

SEQ ID NO: 1087224 - DNA, 16 bp, Homo sapiens
aacttctatattttaa

SEQ ID NO: 1087225 - DNA, 13 bp, Homo sapiens
aacttctatcctt

SEQ ID NO: 1087226 - DNA, 16 bp, Homo sapiens
aacttctatgttggtt

SEQ ID NO: 1087227 - DNA, 14 bp, Homo sapiens
aacttctcccaccc

SEQ ID NO: 1087228 - DNA, 18 bp, Homo sapiens
aacttctcttgaaaagtt

SEQ ID NO: 1087229 - DNA, 20 bp, Homo sapiens
aacttctgtttcttctcttg

SEQ ID NO: 1087230 - DNA, 24 bp, Homo sapiens
aacttcttatggaattgatttgca

SEQ ID NO: 1087231 - DNA, 22 bp, Homo sapiens
aacttcttgaaaaagatggctt

SEQ ID NO: 1087232 - DNA, 19 bp, Homo sapiens
aacttcttgcttctttcta

SEQ ID NO: 1087233 - DNA, 23 bp, Homo sapiens
aacttgaaaagtttattgcttgt

SEQ ID NO: 1087234 - DNA, 14 bp, Homo sapiens
aacttgaaaatata

SEQ ID NO: 1087235 - DNA, 13 bp, Homo sapiens
aacttgaaatata

SEQ ID NO: 1087236 - DNA, 14 bp, Homo sapiens
aacttgaaatatat

SEQ ID NO: 1087237 - DNA, 15 bp, Homo sapiens
aacttgaaatatata

SEQ ID NO: 1087238 - DNA, 22 bp, Homo sapiens
aacttgaaatctaatatttcta

SEQ ID NO: 1087239 - DNA, 21 bp, Homo sapiens
aacttgaactgattcacatct

SEQ ID NO: 1087240 - DNA, 12 bp, Homo sapiens
aacttgaaggat

SEQ ID NO: 1087241 - DNA, 14 bp, Homo sapiens
aacttgactgggtg

SEQ ID NO: 1087242 - DNA, 18 bp, Homo sapiens
aacttgagatctgtataa

SEQ ID NO: 1087243 - DNA, 20 bp, Homo sapiens
aacttgagatgtatgaaggc

SEQ ID NO: 1087244 - DNA, 20 bp, Homo sapiens
aacttgatttgcatggattt

SEQ ID NO: 1087245 - DNA, 23 bp, Homo sapiens
aacttgatttgcatggattttgg

SEQ ID NO: 1087246 - DNA, 14 bp, Homo sapiens
aacttgcatcactt

SEQ ID NO: 1087247 - DNA, 23 bp, Homo sapiens
aacttgccaaaatgttggctgcg

SEQ ID NO: 1087248 - DNA, 14 bp, Homo sapiens
aacttgccacatgt

SEQ ID NO: 1087249 - DNA, 16 bp, Homo sapiens
aacttgctacttatca

SEQ ID NO: 1087250 - DNA, 19 bp, Homo sapiens
aacttgctacttatcattt

SEQ ID NO: 1087251 - DNA, 16 bp, Homo sapiens
aacttgctgctgtctt

SEQ ID NO: 1087252 - DNA, 19 bp, Homo sapiens
aacttgctgctgtgcctgc

SEQ ID NO: 1087253 - DNA, 19 bp, Homo sapiens
aacttgcttaaatttctta

SEQ ID NO: 1087254 - DNA, 22 bp, Homo sapiens
aacttgcttagtatggttctca

SEQ ID NO: 1087255 - DNA, 13 bp, Homo sapiens
aacttgcttctaa

SEQ ID NO: 1087256 - DNA, 14 bp, Homo sapiens
aacttgctttcttc

SEQ ID NO: 1087257 - DNA, 15 bp, Homo sapiens
aacttgctttcttct

SEQ ID NO: 1087258 - DNA, 23 bp, Homo sapiens
aacttggaatttgtaacctcagc

SEQ ID NO: 1087259 - DNA, 17 bp, Homo sapiens
aacttggacccttggaa

SEQ ID NO: 1087260 - DNA, 18 bp, Homo sapiens
aacttggacccttggaaa

SEQ ID NO: 1087261 - DNA, 17 bp, Homo sapiens
aacttggatacttggat

SEQ ID NO: 1087262 - DNA, 13 bp, Homo sapiens
aacttggattctc

SEQ ID NO: 1087263 - DNA, 14 bp, Homo sapiens
aacttggattctct

SEQ ID NO: 1087264 - DNA, 18 bp, Homo sapiens
aacttggcagctttttct

SEQ ID NO: 1087265 - DNA, 19 bp, Homo sapiens
aacttggcagctttttctg

SEQ ID NO: 1087266 - DNA, 20 bp, Homo sapiens
aacttggcagctttttctgt

SEQ ID NO: 1087267 - DNA, 21 bp, Homo sapiens
aacttggcatttctatacttt

SEQ ID NO: 1087268 - DNA, 22 bp, Homo sapiens
aacttggctcgaatctctgtgc

SEQ ID NO: 1087269 - DNA, 19 bp, Homo sapiens
aacttggggaacaagggtg

SEQ ID NO: 1087270 - DNA, 16 bp, Homo sapiens
aacttggttctgcttc

SEQ ID NO: 1087271 - DNA, 20 bp, Homo sapiens
aacttgtaatttttttaatt

SEQ ID NO: 1087272 - DNA, 17 bp, Homo sapiens
aacttgtattaaagaca

SEQ ID NO: 1087273 - DNA, 17 bp, Homo sapiens
aacttgtattttgtcac

SEQ ID NO: 1087274 - DNA, 20 bp, Homo sapiens
aacttgtcaaaaaacaaaaa

SEQ ID NO: 1087275 - DNA, 22 bp, Homo sapiens
aacttgtcagaatttctttgtc

SEQ ID NO: 1087276 - DNA, 15 bp, Homo sapiens
aacttgtcaggcatg

SEQ ID NO: 1087277 - DNA, 20 bp, Homo sapiens
aacttgtctttttctggact

SEQ ID NO: 1087278 - DNA, 20 bp, Homo sapiens
aacttgtgctatagtgtata

SEQ ID NO: 1087279 - DNA, 12 bp, Homo sapiens
aacttgtggcct

SEQ ID NO: 1087280 - DNA, 18 bp, Homo sapiens
aacttgtgggatggtggg

SEQ ID NO: 1087281 - DNA, 19 bp, Homo sapiens
aacttgtgtccctaatgtg

SEQ ID NO: 1087282 - DNA, 19 bp, Homo sapiens
aacttgttattgtgaatga

SEQ ID NO: 1087283 - DNA, 21 bp, Homo sapiens
aacttgttcatttagataatt

SEQ ID NO: 1087284 - DNA, 14 bp, Homo sapiens
aactttaaaactgt

SEQ ID NO: 1087285 - DNA, 21 bp, Homo sapiens
aactttaaaactgtatttaag

SEQ ID NO: 1087286 - DNA, 12 bp, Homo sapiens
aactttaaaagg

SEQ ID NO: 1087287 - DNA, 17 bp, Homo sapiens
aactttaaaaggcaact

SEQ ID NO: 1087288 - DNA, 12 bp, Homo sapiens
aactttaaacat

SEQ ID NO: 1087289 - DNA, 15 bp, Homo sapiens
aactttaaacatcta

SEQ ID NO: 1087290 - DNA, 17 bp, Homo sapiens
aactttaaagataagtc

SEQ ID NO: 1087291 - DNA, 19 bp, Homo sapiens
aactttaaagcgtttgcac

SEQ ID NO: 1087292 - DNA, 22 bp, Homo sapiens
aactttaaccacagtgaaagtt

SEQ ID NO: 1087293 - DNA, 16 bp, Homo sapiens
aactttaatcaagttg

SEQ ID NO: 1087294 - DNA, 14 bp, Homo sapiens
aactttaatgtttt

SEQ ID NO: 1087295 - DNA, 19 bp, Homo sapiens
aactttaatgttttttgcc

SEQ ID NO: 1087296 - DNA, 22 bp, Homo sapiens
aactttaccttttttatacata

SEQ ID NO: 1087297 - DNA, 23 bp, Homo sapiens
aactttaccttttttatacataa

SEQ ID NO: 1087298 - DNA, 21 bp, Homo sapiens
aactttagggggtgggagggg

SEQ ID NO: 1087299 - DNA, 14 bp, Homo sapiens
aactttatcactta

SEQ ID NO: 1087300 - DNA, 14 bp, Homo sapiens
aactttatgtactg

SEQ ID NO: 1087301 - DNA, 17 bp, Homo sapiens
aactttatgtgtaaata

SEQ ID NO: 1087302 - DNA, 19 bp, Homo sapiens
aactttattaaatacaaaa

SEQ ID NO: 1087303 - DNA, 23 bp, Homo sapiens
aactttattaaatacaaaacttc

SEQ ID NO: 1087304 - DNA, 24 bp, Homo sapiens
aactttatttaaatgcatgtctta

SEQ ID NO: 1087305 - DNA, 20 bp, Homo sapiens
aactttatttgtaaaccatt

SEQ ID NO: 1087306 - DNA, 15 bp, Homo sapiens
aactttcaattgtca

SEQ ID NO: 1087307 - DNA, 20 bp, Homo sapiens
aactttcagaagtgccactt

SEQ ID NO: 1087308 - DNA, 12 bp, Homo sapiens
aactttccaaat

SEQ ID NO: 1087309 - DNA, 23 bp, Homo sapiens
aactttccccagatcaaattcta

SEQ ID NO: 1087310 - DNA, 14 bp, Homo sapiens
aactttcctcgcct

SEQ ID NO: 1087311 - DNA, 18 bp, Homo sapiens
aactttctcttcatactt

SEQ ID NO: 1087312 - DNA, 11 bp, Homo sapiens
aactttctgta

SEQ ID NO: 1087313 - DNA, 15 bp, Homo sapiens
aactttctgtaaact

SEQ ID NO: 1087314 - DNA, 13 bp, Homo sapiens
aactttgacctct

SEQ ID NO: 1087315 - DNA, 17 bp, Homo sapiens
aactttggttcctgtga

SEQ ID NO: 1087316 - DNA, 18 bp, Homo sapiens
aactttgtcgtggttctt

SEQ ID NO: 1087317 - DNA, 20 bp, Homo sapiens
aactttgtcgtggttcttaa

SEQ ID NO: 1087318 - DNA, 22 bp, Homo sapiens
aactttgtggtctaaagtgttt

SEQ ID NO: 1087319 - DNA, 12 bp, Homo sapiens
aacttttaatgg

SEQ ID NO: 1087320 - DNA, 13 bp, Homo sapiens
aacttttaatggt

SEQ ID NO: 1087321 - DNA, 11 bp, Homo sapiens
aacttttaatt

SEQ ID NO: 1087322 - DNA, 16 bp, Homo sapiens
aacttttacagaatgc

SEQ ID NO: 1087323 - DNA, 20 bp, Homo sapiens
aacttttacagaatgcatta

SEQ ID NO: 1087324 - DNA, 18 bp, Homo sapiens
aacttttaggttgttacc

SEQ ID NO: 1087325 - DNA, 12 bp, Homo sapiens
aacttttataaa

SEQ ID NO: 1087326 - DNA, 16 bp, Homo sapiens
aacttttataaattaa

SEQ ID NO: 1087327 - DNA, 20 bp, Homo sapiens
aacttttataaattaaatat

SEQ ID NO: 1087328 - DNA, 17 bp, Homo sapiens
aacttttcaatgacatt

SEQ ID NO: 1087329 - DNA, 19 bp, Homo sapiens
aacttttcattccctgtag

SEQ ID NO: 1087330 - DNA, 14 bp, Homo sapiens
aacttttctaaagt

SEQ ID NO: 1087331 - DNA, 19 bp, Homo sapiens
aacttttctaagaaaagca

SEQ ID NO: 1087332 - DNA, 13 bp, Homo sapiens
aacttttgtaaat

SEQ ID NO: 1087333 - DNA, 16 bp, Homo sapiens
aacttttgtaatttga

SEQ ID NO: 1087334 - DNA, 19 bp, Homo sapiens
aacttttgtaatttgaatt

SEQ ID NO: 1087335 - DNA, 22 bp, Homo sapiens
aagaattgtttttgaatttaaa

SEQ ID NO: 1087336 - DNA, 17 bp, Homo sapiens
aagaatttaatggactg

SEQ ID NO: 1087337 - DNA, 20 bp, Homo sapiens
aagaatttaatggactgtga

SEQ ID NO: 1087338 - DNA, 14 bp, Homo sapiens
aagaatttcacaag

SEQ ID NO: 1087339 - DNA, 20 bp, Homo sapiens
aagaatttctgctaaatatc

SEQ ID NO: 1087340 - DNA, 13 bp, Homo sapiens
aagaatttgcata

SEQ ID NO: 1087341 - DNA, 17 bp, Homo sapiens
aagaattttatttttct

SEQ ID NO: 1087342 - DNA, 19 bp, Homo sapiens
aagaattttatttttctgt

SEQ ID NO: 1087343 - DNA, 16 bp, Homo sapiens
aagaatttttgtttgg

SEQ ID NO: 1087344 - DNA, 17 bp, Homo sapiens
aagaatttttgtttgga

SEQ ID NO: 1087345 - DNA, 13 bp, Homo sapiens
aagaatttttttg

SEQ ID NO: 1087346 - DNA, 18 bp, Homo sapiens
aagacaaaaagccttgaa

SEQ ID NO: 1087347 - DNA, 21 bp, Homo sapiens
aagacaaaaagccttgaagaa

SEQ ID NO: 1087348 - DNA, 18 bp, Homo sapiens
aagacaaaaatcaaagaa

SEQ ID NO: 1087349 - DNA, 15 bp, Homo sapiens
aagacaaaacgagtc

SEQ ID NO: 1087350 - DNA, 18 bp, Homo sapiens
aagacaaaacgagtcttt

SEQ ID NO: 1087351 - DNA, 14 bp, Homo sapiens
aagacaaaagaaac

SEQ ID NO: 1087352 - DNA, 16 bp, Homo sapiens
aagacaaaagtctgtc

SEQ ID NO: 1087353 - DNA, 17 bp, Homo sapiens
aagacaaataaatgatt

SEQ ID NO: 1087354 - DNA, 13 bp, Homo sapiens
aagacaaatattc

SEQ ID NO: 1087355 - DNA, 22 bp, Homo sapiens
aagacaaatgacagattctgac

SEQ ID NO: 1087356 - DNA, 15 bp, Homo sapiens
aagacaacattaaaa

SEQ ID NO: 1087357 - DNA, 20 bp, Homo sapiens
aagacaatgtgaaaagaaaa

SEQ ID NO: 1087358 - DNA, 17 bp, Homo sapiens
aagacaatttgatacat

SEQ ID NO: 1087359 - DNA, 20 bp, Homo sapiens
aagacaatttgatacataat

SEQ ID NO: 1087360 - DNA, 18 bp, Homo sapiens
aagacacatgctgaggtt

SEQ ID NO: 1087361 - DNA, 12 bp, Homo sapiens
aagacactgtga

SEQ ID NO: 1087362 - DNA, 22 bp, Homo sapiens
aagacacttcagatctgaggtt

SEQ ID NO: 1087363 - DNA, 11 bp, Homo sapiens
aagacagaaaa

SEQ ID NO: 1087364 - DNA, 13 bp, Homo sapiens
aagacagaaaagt

SEQ ID NO: 1087365 - DNA, 22 bp, Homo sapiens
aagacagagtcttgctctgtct

SEQ ID NO: 1087366 - DNA, 15 bp, Homo sapiens
aagacagatggacac

SEQ ID NO: 1087367 - DNA, 22 bp, Homo sapiens
aagacaggatgggggctggcct

SEQ ID NO: 1087368 - DNA, 17 bp, Homo sapiens
aagacagtgtacaaaac

SEQ ID NO: 1087369 - DNA, 13 bp, Homo sapiens
aagacataaaact

SEQ ID NO: 1087370 - DNA, 17 bp, Homo sapiens
aagacataaaactttaa

SEQ ID NO: 1087371 - DNA, 23 bp, Homo sapiens
aagacataaaactttaaaaggca

SEQ ID NO: 1087372 - DNA, 23 bp, Homo sapiens
aagacatactgcttgattttaat

SEQ ID NO: 1087373 - DNA, 21 bp, Homo sapiens
aagacatccataaagaagcaa

SEQ ID NO: 1087374 - DNA, 13 bp, Homo sapiens
aagacatctgcct

SEQ ID NO: 1087375 - DNA, 16 bp, Homo sapiens
aagacatgatttcctt

SEQ ID NO: 1087376 - DNA, 21 bp, Homo sapiens
aagacatgatttccttgaatg

SEQ ID NO: 1087377 - DNA, 18 bp, Homo sapiens
aagacatggagactcctg

SEQ ID NO: 1087378 - DNA, 12 bp, Homo sapiens
aagacatgtctg

SEQ ID NO: 1087379 - DNA, 19 bp, Homo sapiens
aagacatgtgaggaggaaa

SEQ ID NO: 1087380 - DNA, 23 bp, Homo sapiens
aagacatgtgaggaggaaaagga

SEQ ID NO: 1087381 - DNA, 21 bp, Homo sapiens
aagacattcaaaacgtgatgt

SEQ ID NO: 1087382 - DNA, 14 bp, Homo sapiens
aagacatttgctga

SEQ ID NO: 1087383 - DNA, 13 bp, Homo sapiens
aagacatttgtat

SEQ ID NO: 1087384 - DNA, 16 bp, Homo sapiens
aagacatttgtatatt

SEQ ID NO: 1087385 - DNA, 17 bp, Homo sapiens
aagacatttgtatattg

SEQ ID NO: 1087386 - DNA, 16 bp, Homo sapiens
aagacattttgttaca

SEQ ID NO: 1087387 - DNA, 17 bp, Homo sapiens
aagacattttttgctat

SEQ ID NO: 1087388 - DNA, 18 bp, Homo sapiens
aagaccaaaatgacaatg

SEQ ID NO: 1087389 - DNA, 13 bp, Homo sapiens
aagaccaaaatta

SEQ ID NO: 1087390 - DNA, 15 bp, Homo sapiens
aagaccaaaggaagg

SEQ ID NO: 1087391 - DNA, 17 bp, Homo sapiens
aagaccacaaaaattga

SEQ ID NO: 1087392 - DNA, 22 bp, Homo sapiens
aagaccaccagggtcccaggaa

SEQ ID NO: 1087393 - DNA, 22 bp, Homo sapiens
aagaccacctccaacccaaccc

SEQ ID NO: 1087394 - DNA, 15 bp, Homo sapiens
aagaccactacagtc

SEQ ID NO: 1087395 - DNA, 14 bp, Homo sapiens
aagaccagaaattc

SEQ ID NO: 1087396 - DNA, 23 bp, Homo sapiens
aagaccagagatagtggggagac

SEQ ID NO: 1087397 - DNA, 16 bp, Homo sapiens
aagaccccaagaggaa

SEQ ID NO: 1087398 - DNA, 15 bp, Homo sapiens
aagacccccagcact

SEQ ID NO: 1087399 - DNA, 14 bp, Homo sapiens
aagacccctgtctt

SEQ ID NO: 1087400 - DNA, 23 bp, Homo sapiens
aagacccggttattcgcccaccc

SEQ ID NO: 1087401 - DNA, 13 bp, Homo sapiens
aagaccctgtctc

SEQ ID NO: 1087402 - DNA, 15 bp, Homo sapiens
aagaccgtgtcccaa

SEQ ID NO: 1087403 - DNA, 15 bp, Homo sapiens
aagacctagctatgt

SEQ ID NO: 1087404 - DNA, 18 bp, Homo sapiens
aagacctagtgctcttaa

SEQ ID NO: 1087405 - DNA, 16 bp, Homo sapiens
aagacctcatctgtgg

SEQ ID NO: 1087406 - DNA, 20 bp, Homo sapiens
aagacctcatctgtggagct

SEQ ID NO: 1087407 - DNA, 16 bp, Homo sapiens
aagacctgagtatttt

SEQ ID NO: 1087408 - DNA, 13 bp, Homo sapiens
aagacctggcctt

SEQ ID NO: 1087409 - DNA, 20 bp, Homo sapiens
aagaccttctagtgagcctg

SEQ ID NO: 1087410 - DNA, 18 bp, Homo sapiens
aagaccttggcctctcct

SEQ ID NO: 1087411 - DNA, 14 bp, Homo sapiens
aagacgccctctat

SEQ ID NO: 1087412 - DNA, 22 bp, Homo sapiens
aagacgccttcatctgggacaa

SEQ ID NO: 1087413 - DNA, 22 bp, Homo sapiens
aagacgtaaagaattttcatcc

SEQ ID NO: 1087414 - DNA, 20 bp, Homo sapiens
aagacgtctctttttggtaa

SEQ ID NO: 1087415 - DNA, 18 bp, Homo sapiens
aagacgtggactcctctt

SEQ ID NO: 1087416 - DNA, 17 bp, Homo sapiens
aagacgtggctctgggt

SEQ ID NO: 1087417 - DNA, 19 bp, Homo sapiens
aagacgtggctctgggtga

SEQ ID NO: 1087418 - DNA, 15 bp, Homo sapiens
aagacgtgtttgtgt

SEQ ID NO: 1087419 - DNA, 20 bp, Homo sapiens
aagactagaggcttgcataa

SEQ ID NO: 1087420 - DNA, 17 bp, Homo sapiens
aagactatgaaaatgct

SEQ ID NO: 1087421 - DNA, 20 bp, Homo sapiens
aagactatttcaaaatgtcc

SEQ ID NO: 1087422 - DNA, 13 bp, Homo sapiens
aagactcaatcat

SEQ ID NO: 1087423 - DNA, 12 bp, Homo sapiens
aagactcagcca

SEQ ID NO: 1087424 - DNA, 23 bp, Homo sapiens
aagactcagtatgctttccctga

SEQ ID NO: 1087425 - DNA, 17 bp, Homo sapiens
aagactcattccctaga

SEQ ID NO: 1087426 - DNA, 22 bp, Homo sapiens
aagactcccgccccgggctggc

SEQ ID NO: 1087427 - DNA, 21 bp, Homo sapiens
aagactcctcctgggggctgg

SEQ ID NO: 1087428 - DNA, 22 bp, Homo sapiens
aagactcctcctgggggctggc

SEQ ID NO: 1087429 - DNA, 14 bp, Homo sapiens
aagactccttgtgg

SEQ ID NO: 1087430 - DNA, 10 bp, Homo sapiens
aagactctga

SEQ ID NO: 1087431 - DNA, 14 bp, Homo sapiens
aagactgaacatgt

SEQ ID NO: 1087432 - DNA, 15 bp, Homo sapiens
aagactgaacatgtt

SEQ ID NO: 1087433 - DNA, 15 bp, Homo sapiens
aagactgaagatggc

SEQ ID NO: 1087434 - DNA, 20 bp, Homo sapiens
aagactgaatgttttattta

SEQ ID NO: 1087435 - DNA, 15 bp, Homo sapiens
aagactgagcacctg

SEQ ID NO: 1087436 - DNA, 19 bp, Homo sapiens
aagactgagcacctgcttc

SEQ ID NO: 1087437 - DNA, 18 bp, Homo sapiens
aagactgagccagcttag

SEQ ID NO: 1087438 - DNA, 15 bp, Homo sapiens
aagactgataatttt

SEQ ID NO: 1087439 - DNA, 17 bp, Homo sapiens
aagactgataattttac

SEQ ID NO: 1087440 - DNA, 20 bp, Homo sapiens
aagactgatgaagaaattta

SEQ ID NO: 1087441 - DNA, 15 bp, Homo sapiens
aagactgcagctgct

SEQ ID NO: 1087442 - DNA, 12 bp, Homo sapiens
aagactgcctcc

SEQ ID NO: 1087443 - DNA, 15 bp, Homo sapiens
aagactgctcccggc

SEQ ID NO: 1087444 - DNA, 22 bp, Homo sapiens
aagactggaagctaatttgcat

SEQ ID NO: 1087445 - DNA, 23 bp, Homo sapiens
aagactggaagctaatttgcatt

SEQ ID NO: 1087446 - DNA, 22 bp, Homo sapiens
aagactggcttttattaatgca

SEQ ID NO: 1087447 - DNA, 12 bp, Homo sapiens
aagactgggctg

SEQ ID NO: 1087448 - DNA, 19 bp, Homo sapiens
aagactggtttgtttgctt

SEQ ID NO: 1087449 - DNA, 20 bp, Homo sapiens
aagactggtttgtttgctta

SEQ ID NO: 1087450 - DNA, 20 bp, Homo sapiens
aagactgtactggccagtgt

SEQ ID NO: 1087451 - DNA, 21 bp, Homo sapiens
aagactgtcaaatgaactttt

SEQ ID NO: 1087452 - DNA, 17 bp, Homo sapiens
aagactgttgctcaaat

SEQ ID NO: 1087453 - DNA, 22 bp, Homo sapiens
aagacttcagtatgttgtcaaa

SEQ ID NO: 1087454 - DNA, 19 bp, Homo sapiens
aagacttccaccctggaga

SEQ ID NO: 1087455 - DNA, 14 bp, Homo sapiens
aagacttcccagct

SEQ ID NO: 1087456 - DNA, 12 bp, Homo sapiens
aagacttcctct

SEQ ID NO: 1087457 - DNA, 15 bp, Homo sapiens
aagatcactttctca

SEQ ID NO: 1087458 - DNA, 15 bp, Homo sapiens
aagatccgtggtttg

SEQ ID NO: 1087459 - DNA, 17 bp, Homo sapiens
aagatcctaaactctct

SEQ ID NO: 1087460 - DNA, 15 bp, Homo sapiens
aagatctctgtcaca

SEQ ID NO: 1087461 - DNA, 15 bp, Homo sapiens
aagatctctttctaa

SEQ ID NO: 1087462 - DNA, 15 bp, Homo sapiens
aagatctgactgcca

SEQ ID NO: 1087463 - DNA, 16 bp, Homo sapiens
aagatctgactgccaa

SEQ ID NO: 1087464 - DNA, 18 bp, Homo sapiens
aagatctgactgccaaat

SEQ ID NO: 1087465 - DNA, 23 bp, Homo sapiens
aagatctgcagggggtgtgtctg

SEQ ID NO: 1087466 - DNA, 21 bp, Homo sapiens
aagatctgttttgaaggcaaa

SEQ ID NO: 1087467 - DNA, 22 bp, Homo sapiens
aagatctgttttgaaggcaaaa

SEQ ID NO: 1087468 - DNA, 15 bp, Homo sapiens
aagatcttggcttaa

SEQ ID NO: 1087469 - DNA, 17 bp, Homo sapiens
aagatcttggcttaatt

SEQ ID NO: 1087470 - DNA, 17 bp, Homo sapiens
aagatgaaaatggaagt

SEQ ID NO: 1087471 - DNA, 19 bp, Homo sapiens
aagatgaaaggcaggccta

SEQ ID NO: 1087472 - DNA, 12 bp, Homo sapiens
aagatgaaataa

SEQ ID NO: 1087473 - DNA, 13 bp, Homo sapiens
aagatgaaatata

SEQ ID NO: 1087474 - DNA, 16 bp, Homo sapiens
aagatgaaatgcactg

SEQ ID NO: 1087475 - DNA, 12 bp, Homo sapiens
aagatgaaattg

SEQ ID NO: 1087476 - DNA, 13 bp, Homo sapiens
aagatgaaattgc

SEQ ID NO: 1087477 - DNA, 23 bp, Homo sapiens
aagatgaacccgaggctgagaat

SEQ ID NO: 1087478 - DNA, 14 bp, Homo sapiens
aagatgaactttgt

SEQ ID NO: 1087479 - DNA, 15 bp, Homo sapiens
aagatgaactttgtc

SEQ ID NO: 1087480 - DNA, 16 bp, Homo sapiens
aagatgaatttgtcca

SEQ ID NO: 1087481 - DNA, 22 bp, Homo sapiens
aagatgaatttgtccaattgtg

SEQ ID NO: 1087482 - DNA, 23 bp, Homo sapiens
aagatgactaccaactttcactt

SEQ ID NO: 1087483 - DNA, 13 bp, Homo sapiens
aagatgactctga

SEQ ID NO: 1087484 - DNA, 15 bp, Homo sapiens
aagatgactctgaga

SEQ ID NO: 1087485 - DNA, 22 bp, Homo sapiens
aagatgagccttgcagatatct

SEQ ID NO: 1087486 - DNA, 21 bp, Homo sapiens
aagatgagctctgaacaaaca

SEQ ID NO: 1087487 - DNA, 22 bp, Homo sapiens
aagatgagctctgaacaaacac

SEQ ID NO: 1087488 - DNA, 15 bp, Homo sapiens
aagatgatcagacct

SEQ ID NO: 1087489 - DNA, 22 bp, Homo sapiens
aagatgatggaaacgcacttac

SEQ ID NO: 1087490 - DNA, 20 bp, Homo sapiens
aagatgatttaatgttgatt

SEQ ID NO: 1087491 - DNA, 14 bp, Homo sapiens
aagatgcaaatgca

SEQ ID NO: 1087492 - DNA, 15 bp, Homo sapiens
aagatgctcttctgt

SEQ ID NO: 1087493 - DNA, 16 bp, Homo sapiens
aagatggaagtcacct

SEQ ID NO: 1087494 - DNA, 20 bp, Homo sapiens
aagatggaatttatcaaacc

SEQ ID NO: 1087495 - DNA, 18 bp, Homo sapiens
aagatggataaactgagc

SEQ ID NO: 1087496 - DNA, 21 bp, Homo sapiens
aagatggattctcagatattt

SEQ ID NO: 1087497 - DNA, 23 bp, Homo sapiens
aagatggcacttataaccaaagc

SEQ ID NO: 1087498 - DNA, 23 bp, Homo sapiens
aagatggccatgccctccatgtg

SEQ ID NO: 1087499 - DNA, 18 bp, Homo sapiens
aagatggctgtgcctctg

SEQ ID NO: 1087500 - DNA, 23 bp, Homo sapiens
aagatggctgtgcctctgcctgt

SEQ ID NO: 1087501 - DNA, 21 bp, Homo sapiens
aagatggctgtggcatttcca

SEQ ID NO: 1087502 - DNA, 13 bp, Homo sapiens
aagatgggaggag

SEQ ID NO: 1087503 - DNA, 14 bp, Homo sapiens
aagatgggaggaga

SEQ ID NO: 1087504 - DNA, 22 bp, Homo sapiens
aagatgggcatcttttgtatta

SEQ ID NO: 1087505 - DNA, 21 bp, Homo sapiens
aagatgggggcagggctgtgc

SEQ ID NO: 1087506 - DNA, 15 bp, Homo sapiens
aagatggtccatttg

SEQ ID NO: 1087507 - DNA, 21 bp, Homo sapiens
aagatggtccatttgttcctg

SEQ ID NO: 1087508 - DNA, 22 bp, Homo sapiens
aagatggtccgtgcccaggccc

SEQ ID NO: 1087509 - DNA, 20 bp, Homo sapiens
aagatggtgaagacagaaac

SEQ ID NO: 1087510 - DNA, 21 bp, Homo sapiens
aagatggtgaagacagaaacc

SEQ ID NO: 1087511 - DNA, 12 bp, Homo sapiens
aagatggtggcc

SEQ ID NO: 1087512 - DNA, 20 bp, Homo sapiens
aagatggtgtgggtgtcctg

SEQ ID NO: 1087513 - DNA, 14 bp, Homo sapiens
aagatggttgtagc

SEQ ID NO: 1087514 - DNA, 17 bp, Homo sapiens
aagatggtttcaattca

SEQ ID NO: 1087515 - DNA, 19 bp, Homo sapiens
aagatgtacatttaataat

SEQ ID NO: 1087516 - DNA, 18 bp, Homo sapiens
aagatgtgaattattgac

SEQ ID NO: 1087517 - DNA, 20 bp, Homo sapiens
aagatgtgaattattgacac

SEQ ID NO: 1087518 - DNA, 17 bp, Homo sapiens
aagatgtggatcccttt

SEQ ID NO: 1087519 - DNA, 14 bp, Homo sapiens
aagatgttaaatgg

SEQ ID NO: 1087520 - DNA, 20 bp, Homo sapiens
aagatgttatggtgtttaga

SEQ ID NO: 1087521 - DNA, 15 bp, Homo sapiens
aagatgttctggata

SEQ ID NO: 1087522 - DNA, 15 bp, Homo sapiens
aagatgttgttttag

SEQ ID NO: 1087523 - DNA, 13 bp, Homo sapiens
aagatgtttattg

SEQ ID NO: 1087524 - DNA, 14 bp, Homo sapiens
aagatgtttgaaaa

SEQ ID NO: 1087525 - DNA, 15 bp, Homo sapiens
aagatgtttgaaaat

SEQ ID NO: 1087526 - DNA, 18 bp, Homo sapiens
aagattaaatgtgtcatt

SEQ ID NO: 1087527 - DNA, 16 bp, Homo sapiens
aagattaatctttaaa

SEQ ID NO: 1087528 - DNA, 18 bp, Homo sapiens
aagattaatctttaaacc

SEQ ID NO: 1087529 - DNA, 20 bp, Homo sapiens
aagattacttagaggaaata

SEQ ID NO: 1087530 - DNA, 17 bp, Homo sapiens
aagattagtttcaatgt

SEQ ID NO: 1087531 - DNA, 13 bp, Homo sapiens
aagattatatgaa

SEQ ID NO: 1087532 - DNA, 16 bp, Homo sapiens
aagattatatgaagtt

SEQ ID NO: 1087533 - DNA, 12 bp, Homo sapiens
aagattatctga

SEQ ID NO: 1087534 - DNA, 21 bp, Homo sapiens
aagattatgatgcatacagtt

SEQ ID NO: 1087535 - DNA, 16 bp, Homo sapiens
aagattatgtgacttg

SEQ ID NO: 1087536 - DNA, 21 bp, Homo sapiens
aagattattgtgacttcactg

SEQ ID NO: 1087537 - DNA, 15 bp, Homo sapiens
aagattcaggtatgt

SEQ ID NO: 1087538 - DNA, 20 bp, Homo sapiens
aagattcatatttacttctt

SEQ ID NO: 1087539 - DNA, 12 bp, Homo sapiens
aagattccaaaa

SEQ ID NO: 1087540 - DNA, 12 bp, Homo sapiens
aagattcccaga

SEQ ID NO: 1087541 - DNA, 15 bp, Homo sapiens
aagattcccagagac

SEQ ID NO: 1087542 - DNA, 19 bp, Homo sapiens
aagattcccagagacagga

SEQ ID NO: 1087543 - DNA, 23 bp, Homo sapiens
aagattcctcgttattgttgttg

SEQ ID NO: 1087544 - DNA, 12 bp, Homo sapiens
aagattctaaag

SEQ ID NO: 1087545 - DNA, 16 bp, Homo sapiens
aagattctatttaatt

SEQ ID NO: 1087546 - DNA, 21 bp, Homo sapiens
aagattctatttaattgaaac

SEQ ID NO: 1087547 - DNA, 15 bp, Homo sapiens
aagattctctttaaa

SEQ ID NO: 1087548 - DNA, 20 bp, Homo sapiens
aagattcttttaaattagaa

SEQ ID NO: 1087549 - DNA, 18 bp, Homo sapiens
aagattgccccatctaga

SEQ ID NO: 1087550 - DNA, 15 bp, Homo sapiens
aagattgctgaaatt

SEQ ID NO: 1087551 - DNA, 19 bp, Homo sapiens
aagattgtacttagccagt

SEQ ID NO: 1087552 - DNA, 21 bp, Homo sapiens
aagatttagaaaaaagtttac

SEQ ID NO: 1087553 - DNA, 22 bp, Homo sapiens
aagatttccacaattcttctgt

SEQ ID NO: 1087554 - DNA, 18 bp, Homo sapiens
aagatttccttaaaatct

SEQ ID NO: 1087555 - DNA, 13 bp, Homo sapiens
aagatttcttgag

SEQ ID NO: 1087556 - DNA, 20 bp, Homo sapiens
aagatttcttttcattattc

SEQ ID NO: 1087557 - DNA, 20 bp, Homo sapiens
aagatttgacgttgttgtca

SEQ ID NO: 1087558 - DNA, 22 bp, Homo sapiens
aagatttgatgctggagaggtt

SEQ ID NO: 1087559 - DNA, 17 bp, Homo sapiens
aagatttggaataaagt

SEQ ID NO: 1087560 - DNA, 21 bp, Homo sapiens
aagatttgttgacagcaaaat

SEQ ID NO: 1087561 - DNA, 14 bp, Homo sapiens
aagatttgttttta

SEQ ID NO: 1087562 - DNA, 18 bp, Homo sapiens
aagattttaatcaagttg

SEQ ID NO: 1087563 - DNA, 14 bp, Homo sapiens
aagattttagggct

SEQ ID NO: 1087564 - DNA, 15 bp, Homo sapiens
aagattttgaaggaa

SEQ ID NO: 1087565 - DNA, 21 bp, Homo sapiens
aagattttggaggagaaggac

SEQ ID NO: 1087566 - DNA, 14 bp, Homo sapiens
aagattttttaata

SEQ ID NO: 1087567 - DNA, 17 bp, Homo sapiens
aagattttttaataatt

SEQ ID NO: 1087568 - DNA, 15 bp, Homo sapiens
aagcaaaaaagaaaa

SEQ ID NO: 1087569 - DNA, 14 bp, Homo sapiens
aagcaaaaaaggta

SEQ ID NO: 1087570 - DNA, 17 bp, Homo sapiens
aagcaaaaactcttgtg

SEQ ID NO: 1087571 - DNA, 12 bp, Homo sapiens
aagcaaaaagat

SEQ ID NO: 1087572 - DNA, 15 bp, Homo sapiens
aagcaaaaagatgta

SEQ ID NO: 1087573 - DNA, 21 bp, Homo sapiens
aagcaaaaatgacaacagaaa

SEQ ID NO: 1087574 - DNA, 16 bp, Homo sapiens
aagcaaaacatcacat

SEQ ID NO: 1087575 - DNA, 20 bp, Homo sapiens
aagcaaaacatctctgcagt

SEQ ID NO: 1087576 - DNA, 15 bp, Homo sapiens
aagcaaaagaaaaag

SEQ ID NO: 1087577 - DNA, 13 bp, Homo sapiens
aagcaaaatagta

SEQ ID NO: 1087578 - DNA, 19 bp, Homo sapiens
aagcaaaatagtattgctg

SEQ ID NO: 1087579 - DNA, 17 bp, Homo sapiens
aagccagttgcttcttc

SEQ ID NO: 1087580 - DNA, 23 bp, Homo sapiens
aagccagtttgggtaaaatactt

SEQ ID NO: 1087581 - DNA, 18 bp, Homo sapiens
aagccataattgttctta

SEQ ID NO: 1087582 - DNA, 18 bp, Homo sapiens
aagccatcatcctccatt

SEQ ID NO: 1087583 - DNA, 19 bp, Homo sapiens
aagccatcctgcccttctg

SEQ ID NO: 1087584 - DNA, 18 bp, Homo sapiens
aagccatctcaggttggc

SEQ ID NO: 1087585 - DNA, 20 bp, Homo sapiens
aagccatcttgagtggtcat

SEQ ID NO: 1087586 - DNA, 15 bp, Homo sapiens
aagccatctttcttt

SEQ ID NO: 1087587 - DNA, 23 bp, Homo sapiens
aagccatgagttccagaaagtaa

SEQ ID NO: 1087588 - DNA, 20 bp, Homo sapiens
aagccatgtatttcagggac

SEQ ID NO: 1087589 - DNA, 21 bp, Homo sapiens
aagccatgtatttcagggacc

SEQ ID NO: 1087590 - DNA, 20 bp, Homo sapiens
aagccatgttaaatgacttg

SEQ ID NO: 1087591 - DNA, 14 bp, Homo sapiens
aagccattccaaag

SEQ ID NO: 1087592 - DNA, 13 bp, Homo sapiens
aagccattctttt

SEQ ID NO: 1087593 - DNA, 21 bp, Homo sapiens
aagcccacaggcctgttccct

SEQ ID NO: 1087594 - DNA, 20 bp, Homo sapiens
aagcccaccaatctgccctt

SEQ ID NO: 1087595 - DNA, 21 bp, Homo sapiens
aagcccacctgaaagcctgtc

SEQ ID NO: 1087596 - DNA, 22 bp, Homo sapiens
aagcccacctgaaagcctgtct

SEQ ID NO: 1087597 - DNA, 12 bp, Homo sapiens
aagcccacctgg

SEQ ID NO: 1087598 - DNA, 17 bp, Homo sapiens
aagcccagtgcactgaa

SEQ ID NO: 1087599 - DNA, 22 bp, Homo sapiens
aagcccagtgcactgaaagtca

SEQ ID NO: 1087600 - DNA, 21 bp, Homo sapiens
aagcccataaggccagaaact

SEQ ID NO: 1087601 - DNA, 16 bp, Homo sapiens
aagcccatcctgacca

SEQ ID NO: 1087602 - DNA, 20 bp, Homo sapiens
aagcccatcctgaccagctg

SEQ ID NO: 1087603 - DNA, 19 bp, Homo sapiens
aagcccatgagtccttgaa

SEQ ID NO: 1087604 - DNA, 22 bp, Homo sapiens
aagcccatgagtccttgaaaat

SEQ ID NO: 1087605 - DNA, 17 bp, Homo sapiens
aagcccatgtcttctgc

SEQ ID NO: 1087606 - DNA, 18 bp, Homo sapiens
aagcccatgtcttctgct

SEQ ID NO: 1087607 - DNA, 14 bp, Homo sapiens
aagccccaggcagg

SEQ ID NO: 1087608 - DNA, 13 bp, Homo sapiens
aagccccagggcc

SEQ ID NO: 1087609 - DNA, 18 bp, Homo sapiens
aagccccagggcctgggg

SEQ ID NO: 1087610 - DNA, 14 bp, Homo sapiens
aagcccccaccgtg

SEQ ID NO: 1087611 - DNA, 14 bp, Homo sapiens
aagcccccagggcc

SEQ ID NO: 1087612 - DNA, 13 bp, Homo sapiens
aagccccctggca

SEQ ID NO: 1087613 - DNA, 19 bp, Homo sapiens
aagccccctggcagctgcc

SEQ ID NO: 1087614 - DNA, 20 bp, Homo sapiens
aagccccctggcagctgccc

SEQ ID NO: 1087615 - DNA, 12 bp, Homo sapiens
aagcccctcagc

SEQ ID NO: 1087616 - DNA, 20 bp, Homo sapiens
aagcccctgccctggggaga

SEQ ID NO: 1087617 - DNA, 21 bp, Homo sapiens
aagcccctgccctggggagaa

SEQ ID NO: 1087618 - DNA, 17 bp, Homo sapiens
aagcccctgtgaccctc

SEQ ID NO: 1087619 - DNA, 19 bp, Homo sapiens
aagcccctgtgaccctctc

SEQ ID NO: 1087620 - DNA, 13 bp, Homo sapiens
aagccccttattt

SEQ ID NO: 1087621 - DNA, 21 bp, Homo sapiens
aagccccttgctctcccctgc

SEQ ID NO: 1087622 - DNA, 14 bp, Homo sapiens
aagccccttggaga

SEQ ID NO: 1087623 - DNA, 17 bp, Homo sapiens
aagcccgacttgctgtt

SEQ ID NO: 1087624 - DNA, 19 bp, Homo sapiens
aagcccgttagccccaggg

SEQ ID NO: 1087625 - DNA, 17 bp, Homo sapiens
aagccctacagagctgt

SEQ ID NO: 1087626 - DNA, 22 bp, Homo sapiens
aagccctcatttttataacctg

SEQ ID NO: 1087627 - DNA, 9 bp, Homo sapiens
aagccctcc

SEQ ID NO: 1087628 - DNA, 15 bp, Homo sapiens
aagccctccttccac

SEQ ID NO: 1087629 - DNA, 21 bp, Homo sapiens
aagccctcgaaccaaggcagc

SEQ ID NO: 1087630 - DNA, 14 bp, Homo sapiens
aagccctggcaaca

SEQ ID NO: 1087631 - DNA, 19 bp, Homo sapiens
aagccctgggatcactgtg

SEQ ID NO: 1087632 - DNA, 16 bp, Homo sapiens
aagccctttttatcag

SEQ ID NO: 1087633 - DNA, 17 bp, Homo sapiens
aagccgagagccttttg

SEQ ID NO: 1087634 - DNA, 13 bp, Homo sapiens
aagccgctgctgg

SEQ ID NO: 1087635 - DNA, 23 bp, Homo sapiens
aagccggccccccctcttttggc

SEQ ID NO: 1087636 - DNA, 19 bp, Homo sapiens
aagccggcggcccaagccc

SEQ ID NO: 1087637 - DNA, 14 bp, Homo sapiens
aagccgggaacaga

SEQ ID NO: 1087638 - DNA, 16 bp, Homo sapiens
aagccgggggaggggc

SEQ ID NO: 1087639 - DNA, 22 bp, Homo sapiens
aagccgggggaggggccctcag

SEQ ID NO: 1087640 - DNA, 23 bp, Homo sapiens
aagccgggggaggggccctcagg

SEQ ID NO: 1087641 - DNA, 21 bp, Homo sapiens
aagccggggtgtaacttcctg

SEQ ID NO: 1087642 - DNA, 18 bp, Homo sapiens
aagccggtgtccctggat

SEQ ID NO: 1087643 - DNA, 14 bp, Homo sapiens
aagccgtctgactc

SEQ ID NO: 1087644 - DNA, 13 bp, Homo sapiens
aagccgtggcttc

SEQ ID NO: 1087645 - DNA, 19 bp, Homo sapiens
aagccgttgaatctgggag

SEQ ID NO: 1087646 - DNA, 23 bp, Homo sapiens
aagccgttgaatctgggagggaa

SEQ ID NO: 1087647 - DNA, 13 bp, Homo sapiens
aagcctaaaattg

SEQ ID NO: 1087648 - DNA, 23 bp, Homo sapiens
aagcctaaatgccttagaaatgt

SEQ ID NO: 1087649 - DNA, 20 bp, Homo sapiens
aagcctaacttcatagaaac

SEQ ID NO: 1087650 - DNA, 14 bp, Homo sapiens
aagcctaagaatct

SEQ ID NO: 1087651 - DNA, 21 bp, Homo sapiens
aagcctacccgactctattta

SEQ ID NO: 1087652 - DNA, 16 bp, Homo sapiens
aagcctacctaagcat

SEQ ID NO: 1087653 - DNA, 22 bp, Homo sapiens
aagcctagtgaaggcttctctc

SEQ ID NO: 1087654 - DNA, 22 bp, Homo sapiens
aagcctcaactagtcatttttt

SEQ ID NO: 1087655 - DNA, 11 bp, Homo sapiens
aagcctcagtg

SEQ ID NO: 1087656 - DNA, 12 bp, Homo sapiens
aagcctccacag

SEQ ID NO: 1087657 - DNA, 13 bp, Homo sapiens
aagcctccacagc

SEQ ID NO: 1087658 - DNA, 16 bp, Homo sapiens
aagcctcccacgactg

SEQ ID NO: 1087659 - DNA, 20 bp, Homo sapiens
aagcctccgtggaacattct

SEQ ID NO: 1087660 - DNA, 15 bp, Homo sapiens
aagcctcctccagcc

SEQ ID NO: 1087661 - DNA, 15 bp, Homo sapiens
aagcctctaaacaga

SEQ ID NO: 1087662 - DNA, 12 bp, Homo sapiens
aagcctctctct

SEQ ID NO: 1087663 - DNA, 14 bp, Homo sapiens
aagcctctctctcc

SEQ ID NO: 1087664 - DNA, 15 bp, Homo sapiens
aagcctctctctccc

SEQ ID NO: 1087665 - DNA, 16 bp, Homo sapiens
aagcctctctctccct

SEQ ID NO: 1087666 - DNA, 23 bp, Homo sapiens
aagcctctctctccctccctctc

SEQ ID NO: 1087667 - DNA, 14 bp, Homo sapiens
aagcctctgccctg

SEQ ID NO: 1087668 - DNA, 18 bp, Homo sapiens
aagcctctgccctgcctc

SEQ ID NO: 1087669 - DNA, 13 bp, Homo sapiens
aagcctcttctga

SEQ ID NO: 1087670 - DNA, 17 bp, Homo sapiens
aagcctgaactgaggcc

SEQ ID NO: 1087671 - DNA, 19 bp, Homo sapiens
aagcctgaactgaggcctt

SEQ ID NO: 1087672 - DNA, 19 bp, Homo sapiens
aagcctgatactttagcca

SEQ ID NO: 1087673 - DNA, 13 bp, Homo sapiens
aagcctgatccag

SEQ ID NO: 1087674 - DNA, 22 bp, Homo sapiens
aagcctgcacaataaaaatgtt

SEQ ID NO: 1087675 - DNA, 16 bp, Homo sapiens
aagcctgcaggagaaa

SEQ ID NO: 1087676 - DNA, 14 bp, Homo sapiens
aagcctgctggctg

SEQ ID NO: 1087677 - DNA, 15 bp, Homo sapiens
aagcctgctggctgc

SEQ ID NO: 1087678 - DNA, 14 bp, Homo sapiens
aagcctgctgtgtc

SEQ ID NO: 1087679 - DNA, 12 bp, Homo sapiens
aagcctggaagc

SEQ ID NO: 1087680 - DNA, 17 bp, Homo sapiens
aagcctggactctaagc

SEQ ID NO: 1087681 - DNA, 12 bp, Homo sapiens
aagcctggcttc

SEQ ID NO: 1087682 - DNA, 13 bp, Homo sapiens
aagcctggcttct

SEQ ID NO: 1087683 - DNA, 18 bp, Homo sapiens
aagcctggtttttctcaa

SEQ ID NO: 1087684 - DNA, 17 bp, Homo sapiens
aagcctgtaatcccagc

SEQ ID NO: 1087685 - DNA, 18 bp, Homo sapiens
aagcctgtcccaggactc

SEQ ID NO: 1087686 - DNA, 14 bp, Homo sapiens
aagcctgtccccag

SEQ ID NO: 1087687 - DNA, 23 bp, Homo sapiens
aagcctgtccccagaccaaccct

SEQ ID NO: 1087688 - DNA, 12 bp, Homo sapiens
aagcctgtgaat

SEQ ID NO: 1087689 - DNA, 14 bp, Homo sapiens
aagcctgtgccagc

SEQ ID NO: 1087690 - DNA, 17 bp, Homo sapiens
aagccttaactaagact

SEQ ID NO: 1087691 - DNA, 15 bp, Homo sapiens
aagccttaagcaaat

SEQ ID NO: 1087692 - DNA, 19 bp, Homo sapiens
aagccttaatttgcacagt

SEQ ID NO: 1087693 - DNA, 16 bp, Homo sapiens
aagccttatcaagtgt

SEQ ID NO: 1087694 - DNA, 16 bp, Homo sapiens
aagccttcagctccag

SEQ ID NO: 1087695 - DNA, 17 bp, Homo sapiens
aagccttcagctccagg

SEQ ID NO: 1087696 - DNA, 13 bp, Homo sapiens
aagccttcatttg

SEQ ID NO: 1087697 - DNA, 14 bp, Homo sapiens
aagccttctgtgag

SEQ ID NO: 1087698 - DNA, 18 bp, Homo sapiens
aagccttggaaccagccc

SEQ ID NO: 1087699 - DNA, 19 bp, Homo sapiens
aagccttggaaccagcccc

SEQ ID NO: 1087700 - DNA, 23 bp, Homo sapiens
aagccttgggttccaaccaggca

SEQ ID NO: 1087701 - DNA, 12 bp, Homo sapiens
aaggatgacttt

SEQ ID NO: 1087702 - DNA, 17 bp, Homo sapiens
aaggatgacttttttat

SEQ ID NO: 1087703 - DNA, 19 bp, Homo sapiens
aaggatgacttttttatac

SEQ ID NO: 1087704 - DNA, 16 bp, Homo sapiens
aaggatgagaatgtga

SEQ ID NO: 1087705 - DNA, 22 bp, Homo sapiens
aaggatgatcgcccgataaaga

SEQ ID NO: 1087706 - DNA, 19 bp, Homo sapiens
aaggatgatgtctttttat

SEQ ID NO: 1087707 - DNA, 19 bp, Homo sapiens
aaggatgccccgtccccct

SEQ ID NO: 1087708 - DNA, 15 bp, Homo sapiens
aaggatgcttgtaca

SEQ ID NO: 1087709 - DNA, 16 bp, Homo sapiens
aaggatgcttgtacat

SEQ ID NO: 1087710 - DNA, 20 bp, Homo sapiens
aaggatggtggttattttaa

SEQ ID NO: 1087711 - DNA, 19 bp, Homo sapiens
aaggatgtaaacagtgcct

SEQ ID NO: 1087712 - DNA, 17 bp, Homo sapiens
aaggatgtcacagggcc

SEQ ID NO: 1087713 - DNA, 16 bp, Homo sapiens
aaggattatggaaaaa

SEQ ID NO: 1087714 - DNA, 20 bp, Homo sapiens
aaggattattactaattcta

SEQ ID NO: 1087715 - DNA, 19 bp, Homo sapiens
aaggattgcatcctgctgg

SEQ ID NO: 1087716 - DNA, 14 bp, Homo sapiens
aaggattttaccaa

SEQ ID NO: 1087717 - DNA, 18 bp, Homo sapiens
aaggatttttccatgtgt

SEQ ID NO: 1087718 - DNA, 19 bp, Homo sapiens
aaggcaaaaactgtactgt

SEQ ID NO: 1087719 - DNA, 13 bp, Homo sapiens
aaggcaaaaatag

SEQ ID NO: 1087720 - DNA, 14 bp, Homo sapiens
aaggcaaaaatgta

SEQ ID NO: 1087721 - DNA, 19 bp, Homo sapiens
aaggcaaaattgcaaatct

SEQ ID NO: 1087722 - DNA, 16 bp, Homo sapiens
aaggcaaaggcagagg

SEQ ID NO: 1087723 - DNA, 17 bp, Homo sapiens
aaggcaaaggcagagga

SEQ ID NO: 1087724 - DNA, 19 bp, Homo sapiens
aaggcaaaggcagaggaat

SEQ ID NO: 1087725 - DNA, 16 bp, Homo sapiens
aaggcaaatattgaag

SEQ ID NO: 1087726 - DNA, 19 bp, Homo sapiens
aaggcaagagggggtggag

SEQ ID NO: 1087727 - DNA, 18 bp, Homo sapiens
aaggcaagcacttgtggg

SEQ ID NO: 1087728 - DNA, 17 bp, Homo sapiens
aaggcaatattaaccta

SEQ ID NO: 1087729 - DNA, 14 bp, Homo sapiens
aaggcaattatatc

SEQ ID NO: 1087730 - DNA, 20 bp, Homo sapiens
aaggcaattttagtgtatta

SEQ ID NO: 1087731 - DNA, 15 bp, Homo sapiens
aaggcacaatatggg

SEQ ID NO: 1087732 - DNA, 21 bp, Homo sapiens
aaggcacacagagattctgga

SEQ ID NO: 1087733 - DNA, 14 bp, Homo sapiens
aaggcacagtggga

SEQ ID NO: 1087734 - DNA, 17 bp, Homo sapiens
aaggcacagtgggagct

SEQ ID NO: 1087735 - DNA, 19 bp, Homo sapiens
aaggcacagtgggagctga

SEQ ID NO: 1087736 - DNA, 12 bp, Homo sapiens
aaggcaccttct

SEQ ID NO: 1087737 - DNA, 16 bp, Homo sapiens
aaggcagaaagcaaaa

SEQ ID NO: 1087738 - DNA, 13 bp, Homo sapiens
aaggcagagaaat

SEQ ID NO: 1087739 - DNA, 22 bp, Homo sapiens
aaggcagagaaatctaagctgt

SEQ ID NO: 1087740 - DNA, 14 bp, Homo sapiens
aaggcagaggcctg

SEQ ID NO: 1087741 - DNA, 16 bp, Homo sapiens
aaggcagaggcctggg

SEQ ID NO: 1087742 - DNA, 17 bp, Homo sapiens
aaggcagaggcctgggc

SEQ ID NO: 1087743 - DNA, 19 bp, Homo sapiens
aaggcagaggcctgggctg

SEQ ID NO: 1087744 - DNA, 15 bp, Homo sapiens
aaggcagaggctggc

SEQ ID NO: 1087745 - DNA, 16 bp, Homo sapiens
aaggcagaggctggca

SEQ ID NO: 1087746 - DNA, 17 bp, Homo sapiens
aaggcagcaaagagggg

SEQ ID NO: 1087747 - DNA, 22 bp, Homo sapiens
aaggcagcaaagaggggcgctg

SEQ ID NO: 1087748 - DNA, 14 bp, Homo sapiens
aaggcagcattcca

SEQ ID NO: 1087749 - DNA, 16 bp, Homo sapiens
aaggcagccctcacct

SEQ ID NO: 1087750 - DNA, 11 bp, Homo sapiens
aaggcagcctc

SEQ ID NO: 1087751 - DNA, 17 bp, Homo sapiens
aaggcagcctccagagc

SEQ ID NO: 1087752 - DNA, 20 bp, Homo sapiens
aaggcagcctccagagccag

SEQ ID NO: 1087753 - DNA, 22 bp, Homo sapiens
aaggcagctcacccctgggcag

SEQ ID NO: 1087754 - DNA, 21 bp, Homo sapiens
aaggcagctcttctggagttt

SEQ ID NO: 1087755 - DNA, 12 bp, Homo sapiens
aaggcagctgcc

SEQ ID NO: 1087756 - DNA, 18 bp, Homo sapiens
aaggcagctgcctctgct

SEQ ID NO: 1087757 - DNA, 21 bp, Homo sapiens
aaggcagctgcctctgctccc

SEQ ID NO: 1087758 - DNA, 23 bp, Homo sapiens
aaggcagctgcctctgctccctc

SEQ ID NO: 1087759 - DNA, 14 bp, Homo sapiens
aaggcaggcctccg

SEQ ID NO: 1087760 - DNA, 18 bp, Homo sapiens
aaggcagggaaaggaaaa

SEQ ID NO: 1087761 - DNA, 14 bp, Homo sapiens
aaggcaggtgcctc

SEQ ID NO: 1087762 - DNA, 22 bp, Homo sapiens
aaggcaggtgcctccaggtgtg

SEQ ID NO: 1087763 - DNA, 13 bp, Homo sapiens
aaggcaggtttca

SEQ ID NO: 1087764 - DNA, 18 bp, Homo sapiens
aaggcagtagttttcaaa

SEQ ID NO: 1087765 - DNA, 19 bp, Homo sapiens
aaggcagtagttttcaaaa

SEQ ID NO: 1087766 - DNA, 16 bp, Homo sapiens
aaggcagtcccgggag

SEQ ID NO: 1087767 - DNA, 19 bp, Homo sapiens
aaggcagtgcatgcatgtt

SEQ ID NO: 1087768 - DNA, 15 bp, Homo sapiens
aaggcagttttctaa

SEQ ID NO: 1087769 - DNA, 23 bp, Homo sapiens
aaggcatgcctggacaaaccctt

SEQ ID NO: 1087770 - DNA, 17 bp, Homo sapiens
aaggcatggacttctgg

SEQ ID NO: 1087771 - DNA, 16 bp, Homo sapiens
aaggcatgttcctctg

SEQ ID NO: 1087772 - DNA, 17 bp, Homo sapiens
aaggcattgtcctgtga

SEQ ID NO: 1087773 - DNA, 13 bp, Homo sapiens
aaggcattttatt

SEQ ID NO: 1087774 - DNA, 21 bp, Homo sapiens
aaggccaataaagagttagaa

SEQ ID NO: 1087775 - DNA, 16 bp, Homo sapiens
aaggccacaaaaacaa

SEQ ID NO: 1087776 - DNA, 13 bp, Homo sapiens
aaggccagaagga

SEQ ID NO: 1087777 - DNA, 23 bp, Homo sapiens
aaggccagagtggcctggccagg

SEQ ID NO: 1087778 - DNA, 11 bp, Homo sapiens
aaggccagggc

SEQ ID NO: 1087779 - DNA, 22 bp, Homo sapiens
aaggccagtccccatttctgcc

SEQ ID NO: 1087780 - DNA, 17 bp, Homo sapiens
aaggccagtggaagaaa

SEQ ID NO: 1087781 - DNA, 13 bp, Homo sapiens
aaggcccaagagc

SEQ ID NO: 1087782 - DNA, 15 bp, Homo sapiens
aaggcccaagagcag

SEQ ID NO: 1087783 - DNA, 22 bp, Homo sapiens
aaggcccaagagcagagtctgg

SEQ ID NO: 1087784 - DNA, 14 bp, Homo sapiens
aaggccccagggac

SEQ ID NO: 1087785 - DNA, 15 bp, Homo sapiens
aaggccccagggaca

SEQ ID NO: 1087786 - DNA, 16 bp, Homo sapiens
aaggccccagggacag

SEQ ID NO: 1087787 - DNA, 21 bp, Homo sapiens
aaggccccagggacagaggcc

SEQ ID NO: 1087788 - DNA, 23 bp, Homo sapiens
aaggcccccaaacatagcccctg

SEQ ID NO: 1087789 - DNA, 17 bp, Homo sapiens
aaggcccccacttctcc

SEQ ID NO: 1087790 - DNA, 21 bp, Homo sapiens
aaggcccggaagcgccaggct

SEQ ID NO: 1087791 - DNA, 18 bp, Homo sapiens
aaggccctgctgagtcat

SEQ ID NO: 1087792 - DNA, 12 bp, Homo sapiens
aaggccctgtgg

SEQ ID NO: 1087793 - DNA, 20 bp, Homo sapiens
aaggccgaagctctggctga

SEQ ID NO: 1087794 - DNA, 17 bp, Homo sapiens
aaggccgtgtctctgag

SEQ ID NO: 1087795 - DNA, 22 bp, Homo sapiens
aaggcctaattctatgcctgtc

SEQ ID NO: 1087796 - DNA, 16 bp, Homo sapiens
aaggcctactatacat

SEQ ID NO: 1087797 - DNA, 17 bp, Homo sapiens
aaggcctactatacatt

SEQ ID NO: 1087798 - DNA, 10 bp, Homo sapiens
aaggcctccc

SEQ ID NO: 1087799 - DNA, 14 bp, Homo sapiens
aaggcctctcaccc

SEQ ID NO: 1087800 - DNA, 20 bp, Homo sapiens
aaggcctcttgtaaagactg

SEQ ID NO: 1087801 - DNA, 13 bp, Homo sapiens
aaggcctgaatca

SEQ ID NO: 1087802 - DNA, 16 bp, Homo sapiens
aaggcctgccctccca

SEQ ID NO: 1087803 - DNA, 18 bp, Homo sapiens
aaggcctgccctcccatg

SEQ ID NO: 1087804 - DNA, 22 bp, Homo sapiens
aaggcctggaaccagggaggag

SEQ ID NO: 1087805 - DNA, 20 bp, Homo sapiens
aaggcctgtcagctaaagaa

SEQ ID NO: 1087806 - DNA, 16 bp, Homo sapiens
aaggccttgcctggcc

SEQ ID NO: 1087807 - DNA, 13 bp, Homo sapiens
aaggcctttcttc

SEQ ID NO: 1087808 - DNA, 16 bp, Homo sapiens
aaggcgaggagagtgg

SEQ ID NO: 1087809 - DNA, 17 bp, Homo sapiens
aaggcgcccccgcccca

SEQ ID NO: 1087810 - DNA, 22 bp, Homo sapiens
aaggcggggtattcccactcac

SEQ ID NO: 1087811 - DNA, 16 bp, Homo sapiens
aaggctaaaaagcaac

SEQ ID NO: 1087812 - DNA, 21 bp, Homo sapiens
aaggctaattttttatccttt

SEQ ID NO: 1087813 - DNA, 15 bp, Homo sapiens
aaggctacaggctcc

SEQ ID NO: 1087814 - DNA, 19 bp, Homo sapiens
aaggctacctttgtattct

SEQ ID NO: 1087815 - DNA, 15 bp, Homo sapiens
aaggctacgctgaca

SEQ ID NO: 1087816 - DNA, 23 bp, Homo sapiens
aaggctacttgagccggacacca

SEQ ID NO: 1087817 - DNA, 22 bp, Homo sapiens
aaggctcagcttggatttgtgt

SEQ ID NO: 1087818 - DNA, 17 bp, Homo sapiens
aaggctcagtctcagga

SEQ ID NO: 1087819 - DNA, 15 bp, Homo sapiens
aaggctcatttaaaa

SEQ ID NO: 1087820 - DNA, 15 bp, Homo sapiens
aaggctcgattttgt

SEQ ID NO: 1087821 - DNA, 22 bp, Homo sapiens
aaggctcgattttgtatctgca

SEQ ID NO: 1087822 - DNA, 23 bp, Homo sapiens
aaggctctcccctctcgccccat

SEQ ID NO: 1087823 - DNA, 18 bp, Homo sapiens
aaggtttggaaggagcag

SEQ ID NO: 1087824 - DNA, 23 bp, Homo sapiens
aaggttttggatcttgaatgtgg

SEQ ID NO: 1087825 - DNA, 21 bp, Homo sapiens
aaggttttggttatggagtct

SEQ ID NO: 1087826 - DNA, 15 bp, Homo sapiens
aaggttttgtatttt

SEQ ID NO: 1087827 - DNA, 20 bp, Homo sapiens
aaggttttgtattttttaaa

SEQ ID NO: 1087828 - DNA, 12 bp, Homo sapiens
aaggtttttaaa

SEQ ID NO: 1087829 - DNA, 13 bp, Homo sapiens
aaggtttttagca

SEQ ID NO: 1087830 - DNA, 18 bp, Homo sapiens
aaggttttttttttaagt

SEQ ID NO: 1087831 - DNA, 17 bp, Homo sapiens
aagtaaaaaaaatcaga

SEQ ID NO: 1087832 - DNA, 18 bp, Homo sapiens
aagtaaaagcaaaaaaga

SEQ ID NO: 1087833 - DNA, 21 bp, Homo sapiens
aagtaaaagcaaaaaagaaaa

SEQ ID NO: 1087834 - DNA, 21 bp, Homo sapiens
aagtaaaagtctacctgtgtt

SEQ ID NO: 1087835 - DNA, 13 bp, Homo sapiens
aagtaaaataaat

SEQ ID NO: 1087836 - DNA, 14 bp, Homo sapiens
aagtaaaatgaaca

SEQ ID NO: 1087837 - DNA, 15 bp, Homo sapiens
aagtaaaatgaacat

SEQ ID NO: 1087838 - DNA, 12 bp, Homo sapiens
aagtaaaatgtc

SEQ ID NO: 1087839 - DNA, 13 bp, Homo sapiens
aagtaaaatgttt

SEQ ID NO: 1087840 - DNA, 16 bp, Homo sapiens
aagtaaacttgtgtat

SEQ ID NO: 1087841 - DNA, 12 bp, Homo sapiens
aagtaaagctaa

SEQ ID NO: 1087842 - DNA, 17 bp, Homo sapiens
aagtaaagtggttttgt

SEQ ID NO: 1087843 - DNA, 13 bp, Homo sapiens
aagtaaatacaat

SEQ ID NO: 1087844 - DNA, 15 bp, Homo sapiens
aagtaaatacaattt

SEQ ID NO: 1087845 - DNA, 17 bp, Homo sapiens
aagtaaatacaattttt

SEQ ID NO: 1087846 - DNA, 16 bp, Homo sapiens
aagtaaatgggagggc

SEQ ID NO: 1087847 - DNA, 21 bp, Homo sapiens
aagtaaattgcctgatttgtt

SEQ ID NO: 1087848 - DNA, 13 bp, Homo sapiens
aagtaacaatatg

SEQ ID NO: 1087849 - DNA, 19 bp, Homo sapiens
aagtaacatcagccatttt

SEQ ID NO: 1087850 - DNA, 16 bp, Homo sapiens
aagtaacatgcatact

SEQ ID NO: 1087851 - DNA, 22 bp, Homo sapiens
aagtaaccaggccccagcctcc

SEQ ID NO: 1087852 - DNA, 12 bp, Homo sapiens
aagtaactcatt

SEQ ID NO: 1087853 - DNA, 19 bp, Homo sapiens
aagtaacttttaaaatttg

SEQ ID NO: 1087854 - DNA, 12 bp, Homo sapiens
aagtaagaaaat

SEQ ID NO: 1087855 - DNA, 20 bp, Homo sapiens
aagtaagaagacatgaacca

SEQ ID NO: 1087856 - DNA, 21 bp, Homo sapiens
aagtaagagctaagttctaag

SEQ ID NO: 1087857 - DNA, 22 bp, Homo sapiens
aagtaagagctaagttctaagt

SEQ ID NO: 1087858 - DNA, 20 bp, Homo sapiens
aagtaaggtgcttggagttt

SEQ ID NO: 1087859 - DNA, 20 bp, Homo sapiens
aagtaagtcttttttttttc

SEQ ID NO: 1087860 - DNA, 22 bp, Homo sapiens
aagtaagtcttttttttttcca

SEQ ID NO: 1087861 - DNA, 12 bp, Homo sapiens
aagtaagttaat

SEQ ID NO: 1087862 - DNA, 20 bp, Homo sapiens
aagtaagttaataatgtatt

SEQ ID NO: 1087863 - DNA, 21 bp, Homo sapiens
aagtaagtttatccaaatctt

SEQ ID NO: 1087864 - DNA, 12 bp, Homo sapiens
aagtaatatgca

SEQ ID NO: 1087865 - DNA, 21 bp, Homo sapiens
aagtaatccacctgcctcggc

SEQ ID NO: 1087866 - DNA, 14 bp, Homo sapiens
aagtaatcttttta

SEQ ID NO: 1087867 - DNA, 20 bp, Homo sapiens
aagtaatctttttacagttg

SEQ ID NO: 1087868 - DNA, 15 bp, Homo sapiens
aagtaattatcggga

SEQ ID NO: 1087869 - DNA, 22 bp, Homo sapiens
aagtaattatcgggaacagtgt

SEQ ID NO: 1087870 - DNA, 14 bp, Homo sapiens
aagtaattcataca

SEQ ID NO: 1087871 - DNA, 14 bp, Homo sapiens
aagtaattcctctc

SEQ ID NO: 1087872 - DNA, 20 bp, Homo sapiens
aagtaattgcatttctgctc

SEQ ID NO: 1087873 - DNA, 19 bp, Homo sapiens
aagtaattgcctacaataa

SEQ ID NO: 1087874 - DNA, 23 bp, Homo sapiens
aagtaatttcagtgtaaagtgtg

SEQ ID NO: 1087875 - DNA, 16 bp, Homo sapiens
aagtaatttggaaatt

SEQ ID NO: 1087876 - DNA, 17 bp, Homo sapiens
aagtacaaacatgaaaa

SEQ ID NO: 1087877 - DNA, 12 bp, Homo sapiens
aagtacaatgaa

SEQ ID NO: 1087878 - DNA, 15 bp, Homo sapiens
aagtacactctgctg

SEQ ID NO: 1087879 - DNA, 18 bp, Homo sapiens
aagtacactgtttcaaac

SEQ ID NO: 1087880 - DNA, 23 bp, Homo sapiens
aagtacagaatagaatacattga

SEQ ID NO: 1087881 - DNA, 13 bp, Homo sapiens
aagtacagaattt

SEQ ID NO: 1087882 - DNA, 19 bp, Homo sapiens
aagtacagaatttgaatta

SEQ ID NO: 1087883 - DNA, 17 bp, Homo sapiens
aagtacattgcttaaaa

SEQ ID NO: 1087884 - DNA, 12 bp, Homo sapiens
aagtacatttaa

SEQ ID NO: 1087885 - DNA, 13 bp, Homo sapiens
aagtacatttaat

SEQ ID NO: 1087886 - DNA, 18 bp, Homo sapiens
aagtaccaatgctgttgt

SEQ ID NO: 1087887 - DNA, 14 bp, Homo sapiens
aagtaccacactga

SEQ ID NO: 1087888 - DNA, 15 bp, Homo sapiens
aagtaccacactgag

SEQ ID NO: 1087889 - DNA, 17 bp, Homo sapiens
aagtaccactcaggcca

SEQ ID NO: 1087890 - DNA, 12 bp, Homo sapiens
aagtaccagact

SEQ ID NO: 1087891 - DNA, 19 bp, Homo sapiens
aagtaccctcttttaccaa

SEQ ID NO: 1087892 - DNA, 21 bp, Homo sapiens
aagtaccctcttttaccaact

SEQ ID NO: 1087893 - DNA, 19 bp, Homo sapiens
aagtacctatattgattta

SEQ ID NO: 1087894 - DNA, 18 bp, Homo sapiens
aagtacgtcccagcggcc

SEQ ID NO: 1087895 - DNA, 23 bp, Homo sapiens
aagtacgtcccagcggcctcagg

SEQ ID NO: 1087896 - DNA, 13 bp, Homo sapiens
aagtactatgtat

SEQ ID NO: 1087897 - DNA, 17 bp, Homo sapiens
aagtactgctgtaaata

SEQ ID NO: 1087898 - DNA, 23 bp, Homo sapiens
aagtactggtaagattgttatta

SEQ ID NO: 1087899 - DNA, 17 bp, Homo sapiens
aagtactggttgacttt

SEQ ID NO: 1087900 - DNA, 21 bp, Homo sapiens
aagtactgttttgaagctggg

SEQ ID NO: 1087901 - DNA, 20 bp, Homo sapiens
aagtacttaaacttccacaa

SEQ ID NO: 1087902 - DNA, 23 bp, Homo sapiens
aagtacttccacttgtgtatatt

SEQ ID NO: 1087903 - DNA, 17 bp, Homo sapiens
aagtactttaaaaagga

SEQ ID NO: 1087904 - DNA, 13 bp, Homo sapiens
aagtagaaatcat

SEQ ID NO: 1087905 - DNA, 16 bp, Homo sapiens
aagtagaacaaaaaac

SEQ ID NO: 1087906 - DNA, 22 bp, Homo sapiens
aagtagaactcttaaatacttt

SEQ ID NO: 1087907 - DNA, 23 bp, Homo sapiens
aagtagaactcttaaatactttt

SEQ ID NO: 1087908 - DNA, 19 bp, Homo sapiens
aagtagacacgagcttaat

SEQ ID NO: 1087909 - DNA, 16 bp, Homo sapiens
aagtagaccaaatctt

SEQ ID NO: 1087910 - DNA, 14 bp, Homo sapiens
aagtagatttcatg

SEQ ID NO: 1087911 - DNA, 14 bp, Homo sapiens
aagtagctgggatt

SEQ ID NO: 1087912 - DNA, 22 bp, Homo sapiens
aagtaggactttcctaaatgtt

SEQ ID NO: 1087913 - DNA, 17 bp, Homo sapiens
aagtaggaggaaacagt

SEQ ID NO: 1087914 - DNA, 19 bp, Homo sapiens
aagtagtacttcttctgta

SEQ ID NO: 1087915 - DNA, 15 bp, Homo sapiens
aagtagtcctggcag

SEQ ID NO: 1087916 - DNA, 16 bp, Homo sapiens
aagtagttcctatttt

SEQ ID NO: 1087917 - DNA, 15 bp, Homo sapiens
aagtataaaatacaa

SEQ ID NO: 1087918 - DNA, 20 bp, Homo sapiens
aagtataaaatagtatgaaa

SEQ ID NO: 1087919 - DNA, 22 bp, Homo sapiens
aagtataaaatagtatgaaaat

SEQ ID NO: 1087920 - DNA, 19 bp, Homo sapiens
aagtatacaacaggagaga

SEQ ID NO: 1087921 - DNA, 22 bp, Homo sapiens
aagtatacctggctttttaaaa

SEQ ID NO: 1087922 - DNA, 12 bp, Homo sapiens
aagtatactgta

SEQ ID NO: 1087923 - DNA, 14 bp, Homo sapiens
aagtatacttttcc

SEQ ID NO: 1087924 - DNA, 19 bp, Homo sapiens
aagtatagaaaatcttcat

SEQ ID NO: 1087925 - DNA, 19 bp, Homo sapiens
aagtatagaaatatattta

SEQ ID NO: 1087926 - DNA, 22 bp, Homo sapiens
aagtatatagtatatttatact

SEQ ID NO: 1087927 - DNA, 11 bp, Homo sapiens
aagtatatata

SEQ ID NO: 1087928 - DNA, 13 bp, Homo sapiens
aagtatatattta

SEQ ID NO: 1087929 - DNA, 19 bp, Homo sapiens
aagtatatgtgagaaatca

SEQ ID NO: 1087930 - DNA, 21 bp, Homo sapiens
aagtatattcttattggaaat

SEQ ID NO: 1087931 - DNA, 16 bp, Homo sapiens
aagtatcacttttctg

SEQ ID NO: 1087932 - DNA, 21 bp, Homo sapiens
aagtatcttctatttttatca

SEQ ID NO: 1087933 - DNA, 19 bp, Homo sapiens
aagtatctttaacaattgt

SEQ ID NO: 1087934 - DNA, 22 bp, Homo sapiens
aagtatctttaacaattgtctt

SEQ ID NO: 1087935 - DNA, 18 bp, Homo sapiens
aagtatcttttttcaaaa

SEQ ID NO: 1087936 - DNA, 14 bp, Homo sapiens
aagtatgaatctat

SEQ ID NO: 1087937 - DNA, 22 bp, Homo sapiens
aagtatgcaatgcttcattatt

SEQ ID NO: 1087938 - DNA, 18 bp, Homo sapiens
aagtatgcattattaaat

SEQ ID NO: 1087939 - DNA, 16 bp, Homo sapiens
aagtatgccttaagca

SEQ ID NO: 1087940 - DNA, 22 bp, Homo sapiens
aagtatgccttaagcagaacaa

SEQ ID NO: 1087941 - DNA, 18 bp, Homo sapiens
aagtatggaatattcatt

SEQ ID NO: 1087942 - DNA, 14 bp, Homo sapiens
aagtatgtgagtag

SEQ ID NO: 1087943 - DNA, 13 bp, Homo sapiens
aagtatgtgagtg

SEQ ID NO: 1087944 - DNA, 18 bp, Homo sapiens
aagtatgtgagtgtgtcc

SEQ ID NO: 1087945 - DNA, 14 bp, Homo sapiens
aagtgggggcgggg

SEQ ID NO: 1087946 - DNA, 13 bp, Homo sapiens
aagtggggtctgg

SEQ ID NO: 1087947 - DNA, 18 bp, Homo sapiens
aagtggggtgctctggtc

SEQ ID NO: 1087948 - DNA, 16 bp, Homo sapiens
aagtggggtgttcttc

SEQ ID NO: 1087949 - DNA, 13 bp, Homo sapiens
aagtgggtgtgtg

SEQ ID NO: 1087950 - DNA, 14 bp, Homo sapiens
aagtggtacaggaa

SEQ ID NO: 1087951 - DNA, 14 bp, Homo sapiens
aagtggtgaccaaa

SEQ ID NO: 1087952 - DNA, 23 bp, Homo sapiens
aagtggtgaccaaaatttttagg

SEQ ID NO: 1087953 - DNA, 22 bp, Homo sapiens
aagtggtgctataagttttaga

SEQ ID NO: 1087954 - DNA, 13 bp, Homo sapiens
aagtggtttctaa

SEQ ID NO: 1087955 - DNA, 15 bp, Homo sapiens
aagtgtaaaaaatgt

SEQ ID NO: 1087956 - DNA, 22 bp, Homo sapiens
aagtgtaaaatattttgaatca

SEQ ID NO: 1087957 - DNA, 17 bp, Homo sapiens
aagtgtaaacaccatag

SEQ ID NO: 1087958 - DNA, 13 bp, Homo sapiens
aagtgtaaatgaa

SEQ ID NO: 1087959 - DNA, 14 bp, Homo sapiens
aagtgtaaatgaag

SEQ ID NO: 1087960 - DNA, 21 bp, Homo sapiens
aagtgtaacagctgaggtctc

SEQ ID NO: 1087961 - DNA, 16 bp, Homo sapiens
aagtgtaacctcagta

SEQ ID NO: 1087962 - DNA, 12 bp, Homo sapiens
aagtgtaactgg

SEQ ID NO: 1087963 - DNA, 18 bp, Homo sapiens
aagtgtaagttcacaact

SEQ ID NO: 1087964 - DNA, 16 bp, Homo sapiens
aagtgtaatagattat

SEQ ID NO: 1087965 - DNA, 14 bp, Homo sapiens
aagtgtaattgaga

SEQ ID NO: 1087966 - DNA, 21 bp, Homo sapiens
aagtgtacaattgatcttttt

SEQ ID NO: 1087967 - DNA, 14 bp, Homo sapiens
aagtgtacatatgt

SEQ ID NO: 1087968 - DNA, 20 bp, Homo sapiens
aagtgtagatgtagcattgt

SEQ ID NO: 1087969 - DNA, 14 bp, Homo sapiens
aagtgtaggcagac

SEQ ID NO: 1087970 - DNA, 16 bp, Homo sapiens
aagtgtaggcagacac

SEQ ID NO: 1087971 - DNA, 17 bp, Homo sapiens
aagtgtaggcagacaca

SEQ ID NO: 1087972 - DNA, 19 bp, Homo sapiens
aagtgtaggcagacacagg

SEQ ID NO: 1087973 - DNA, 21 bp, Homo sapiens
aagtgtaggcagacacaggga

SEQ ID NO: 1087974 - DNA, 18 bp, Homo sapiens
aagtgtatatttattcat

SEQ ID NO: 1087975 - DNA, 17 bp, Homo sapiens
aagtgtatgatgtcaca

SEQ ID NO: 1087976 - DNA, 21 bp, Homo sapiens
aagtgtattttgaaattgttt

SEQ ID NO: 1087977 - DNA, 16 bp, Homo sapiens
aagtgtcaactctttg

SEQ ID NO: 1087978 - DNA, 24 bp, Homo sapiens
aagtgtcatatgtaggtgtctgca

SEQ ID NO: 1087979 - DNA, 20 bp, Homo sapiens
aagtgtctagagtcatgtga

SEQ ID NO: 1087980 - DNA, 24 bp, Homo sapiens
aagtgtctagagtcatgtgagcct

SEQ ID NO: 1087981 - DNA, 19 bp, Homo sapiens
aagtgtcttttgacatttt

SEQ ID NO: 1087982 - DNA, 15 bp, Homo sapiens
aagtgtgagcagtga

SEQ ID NO: 1087983 - DNA, 19 bp, Homo sapiens
aagtgtgagtaagagctgg

SEQ ID NO: 1087984 - DNA, 21 bp, Homo sapiens
aagtgtgagtaagagctggtg

SEQ ID NO: 1087985 - DNA, 20 bp, Homo sapiens
aagtgtggctggtgtcccct

SEQ ID NO: 1087986 - DNA, 16 bp, Homo sapiens
aagtgtgtattaaaaa

SEQ ID NO: 1087987 - DNA, 21 bp, Homo sapiens
aagtgtgtccatcctgacctg

SEQ ID NO: 1087988 - DNA, 18 bp, Homo sapiens
aagtgtgtgattgaaggt

SEQ ID NO: 1087989 - DNA, 11 bp, Homo sapiens
aagtgttactt

SEQ ID NO: 1087990 - DNA, 15 bp, Homo sapiens
aagtgttagatagaa

SEQ ID NO: 1087991 - DNA, 21 bp, Homo sapiens
aagtgttatttttcaaggaag

SEQ ID NO: 1087992 - DNA, 17 bp, Homo sapiens
aagtgttcaagaaataa

SEQ ID NO: 1087993 - DNA, 23 bp, Homo sapiens
aagtgttgaaaatgtatttcctg

SEQ ID NO: 1087994 - DNA, 23 bp, Homo sapiens
aagtgttgagccatgctacagtt

SEQ ID NO: 1087995 - DNA, 14 bp, Homo sapiens
aagtgttggaaaaa

SEQ ID NO: 1087996 - DNA, 11 bp, Homo sapiens
aagtgttggtc

SEQ ID NO: 1087997 - DNA, 22 bp, Homo sapiens
aagtgttggtctttctaatgta

SEQ ID NO: 1087998 - DNA, 20 bp, Homo sapiens
aagtgttgtaaatatttatg

SEQ ID NO: 1087999 - DNA, 12 bp, Homo sapiens
aagtgttgtatc

SEQ ID NO: 1088000 - DNA, 15 bp, Homo sapiens
aagtgttgtgttcct

SEQ ID NO: 1088001 - DNA, 16 bp, Homo sapiens
aagtgttgtgttcctg

SEQ ID NO: 1088002 - DNA, 18 bp, Homo sapiens
aagtgttgtgttcctggc

SEQ ID NO: 1088003 - DNA, 15 bp, Homo sapiens
aagtgtttatgttgt

SEQ ID NO: 1088004 - DNA, 19 bp, Homo sapiens
aagtgtttatttttcatat

SEQ ID NO: 1088005 - DNA, 21 bp, Homo sapiens
aagtgtttctgttattaacaa

SEQ ID NO: 1088006 - DNA, 23 bp, Homo sapiens
aagtgtttctgttattaacaaac

SEQ ID NO: 1088007 - DNA, 13 bp, Homo sapiens
aagtgttttctct

SEQ ID NO: 1088008 - DNA, 14 bp, Homo sapiens
aagtgttttctctg

SEQ ID NO: 1088009 - DNA, 12 bp, Homo sapiens
aagttaaataaa

SEQ ID NO: 1088010 - DNA, 14 bp, Homo sapiens
aagttaaataaatc

SEQ ID NO: 1088011 - DNA, 18 bp, Homo sapiens
aagttaataatgtattgt

SEQ ID NO: 1088012 - DNA, 24 bp, Homo sapiens
aagttaataatgtattgtaatctt

SEQ ID NO: 1088013 - DNA, 17 bp, Homo sapiens
aagttaatgtatataaa

SEQ ID NO: 1088014 - DNA, 22 bp, Homo sapiens
aagttaatgtatataaaaatgg

SEQ ID NO: 1088015 - DNA, 20 bp, Homo sapiens
aagttaattcacctatgtta

SEQ ID NO: 1088016 - DNA, 17 bp, Homo sapiens
aagttaatttaaagttg

SEQ ID NO: 1088017 - DNA, 16 bp, Homo sapiens
aagttacacaattaat

SEQ ID NO: 1088018 - DNA, 21 bp, Homo sapiens
aagttacacagaaatgctgct

SEQ ID NO: 1088019 - DNA, 22 bp, Homo sapiens
aagttacacagaaatgctgctg

SEQ ID NO: 1088020 - DNA, 14 bp, Homo sapiens
aagttacacatttt

SEQ ID NO: 1088021 - DNA, 18 bp, Homo sapiens
aagttactaggtaacttc

SEQ ID NO: 1088022 - DNA, 13 bp, Homo sapiens
aagttactgggca

SEQ ID NO: 1088023 - DNA, 12 bp, Homo sapiens
aagttactttgt

SEQ ID NO: 1088024 - DNA, 13 bp, Homo sapiens
aagttagactctt

SEQ ID NO: 1088025 - DNA, 13 bp, Homo sapiens
aagttagctcagg

SEQ ID NO: 1088026 - DNA, 14 bp, Homo sapiens
aagttagctgagcg

SEQ ID NO: 1088027 - DNA, 21 bp, Homo sapiens
aagttagctgagcgtggtggc

SEQ ID NO: 1088028 - DNA, 16 bp, Homo sapiens
aagttagctttaactt

SEQ ID NO: 1088029 - DNA, 19 bp, Homo sapiens
aagttataaatcaatgtca

SEQ ID NO: 1088030 - DNA, 16 bp, Homo sapiens
aagttatagtatatct

SEQ ID NO: 1088031 - DNA, 17 bp, Homo sapiens
aagttatagtatatctg

SEQ ID NO: 1088032 - DNA, 17 bp, Homo sapiens
aagttatagtgaatact

SEQ ID NO: 1088033 - DNA, 19 bp, Homo sapiens
aagttatattgaatatatc

SEQ ID NO: 1088034 - DNA, 16 bp, Homo sapiens
aagttatcatctcacc

SEQ ID NO: 1088035 - DNA, 15 bp, Homo sapiens
aagttatctttgaat

SEQ ID NO: 1088036 - DNA, 22 bp, Homo sapiens
aagttatctttgaatatgtagt

SEQ ID NO: 1088037 - DNA, 18 bp, Homo sapiens
aagttatggcagtgatgc

SEQ ID NO: 1088038 - DNA, 22 bp, Homo sapiens
aagttattaagaggtaagactt

SEQ ID NO: 1088039 - DNA, 14 bp, Homo sapiens
aagttattgcagtt

SEQ ID NO: 1088040 - DNA, 17 bp, Homo sapiens
aagttattgcagtttat

SEQ ID NO: 1088041 - DNA, 23 bp, Homo sapiens
aagttattgcagtttatcattca

SEQ ID NO: 1088042 - DNA, 20 bp, Homo sapiens
aagttattgctggtgcaaag

SEQ ID NO: 1088043 - DNA, 12 bp, Homo sapiens
aagttattgtac

SEQ ID NO: 1088044 - DNA, 16 bp, Homo sapiens
aagttatttaaatctg

SEQ ID NO: 1088045 - DNA, 21 bp, Homo sapiens
aagttatttactcctcctgct

SEQ ID NO: 1088046 - DNA, 18 bp, Homo sapiens
aagttattttatttgctt

SEQ ID NO: 1088047 - DNA, 21 bp, Homo sapiens
aagttattttctacagtggtt

SEQ ID NO: 1088048 - DNA, 16 bp, Homo sapiens
aagttcaacatgttat

SEQ ID NO: 1088049 - DNA, 19 bp, Homo sapiens
aagttcaatctgtttttca

SEQ ID NO: 1088050 - DNA, 21 bp, Homo sapiens
aagttcacgtaagatacaagt

SEQ ID NO: 1088051 - DNA, 16 bp, Homo sapiens
aagttcaggctctgag

SEQ ID NO: 1088052 - DNA, 13 bp, Homo sapiens
aagttcagggacc

SEQ ID NO: 1088053 - DNA, 15 bp, Homo sapiens
aagttcatattccat

SEQ ID NO: 1088054 - DNA, 17 bp, Homo sapiens
aagttcatgtttgtaaa

SEQ ID NO: 1088055 - DNA, 20 bp, Homo sapiens
aagttcatgtttgtaaatta

SEQ ID NO: 1088056 - DNA, 14 bp, Homo sapiens
aagttcccaactga

SEQ ID NO: 1088057 - DNA, 20 bp, Homo sapiens
aagttccccatccctgtcat

SEQ ID NO: 1088058 - DNA, 17 bp, Homo sapiens
aagttccctacttcctg

SEQ ID NO: 1088059 - DNA, 20 bp, Homo sapiens
aagttccctacttcctgtga

SEQ ID NO: 1088060 - DNA, 16 bp, Homo sapiens
aagttcctaggaaaaa

SEQ ID NO: 1088061 - DNA, 12 bp, Homo sapiens
aagttctcaaag

SEQ ID NO: 1088062 - DNA, 20 bp, Homo sapiens
aagttctcaaagttaattca

SEQ ID NO: 1088063 - DNA, 15 bp, Homo sapiens
aagttctcagagctc

SEQ ID NO: 1088064 - DNA, 22 bp, Homo sapiens
aagttctccagcttcagctcaa

SEQ ID NO: 1088065 - DNA, 18 bp, Homo sapiens
aagttctccttttgaact

SEQ ID NO: 1088066 - DNA, 19 bp, Homo sapiens
aagttctccttttgaactt

SEQ ID NO: 1088067 - DNA, 14 bp, Homo sapiens
aataacaaacgtgt

SEQ ID NO: 1088068 - DNA, 20 bp, Homo sapiens
aataacaaagcacataactg

SEQ ID NO: 1088069 - DNA, 18 bp, Homo sapiens
aataacaaggagatttct

SEQ ID NO: 1088070 - DNA, 13 bp, Homo sapiens
aataacaatgtgc

SEQ ID NO: 1088071 - DNA, 20 bp, Homo sapiens
aataacacacatataaacat

SEQ ID NO: 1088072 - DNA, 18 bp, Homo sapiens
aataacacagatattgtt

SEQ ID NO: 1088073 - DNA, 20 bp, Homo sapiens
aataacactgttggcactta

SEQ ID NO: 1088074 - DNA, 12 bp, Homo sapiens
aataacagctgc

SEQ ID NO: 1088075 - DNA, 14 bp, Homo sapiens
aataacagctgcaa

SEQ ID NO: 1088076 - DNA, 12 bp, Homo sapiens
aataacattgca

SEQ ID NO: 1088077 - DNA, 20 bp, Homo sapiens
aataacatttaaattccaca

SEQ ID NO: 1088078 - DNA, 18 bp, Homo sapiens
aataacattttatacaat

SEQ ID NO: 1088079 - DNA, 21 bp, Homo sapiens
aataaccacttaaaaaatgtc

SEQ ID NO: 1088080 - DNA, 12 bp, Homo sapiens
aataacccagtt

SEQ ID NO: 1088081 - DNA, 17 bp, Homo sapiens
aataacccagttacttt

SEQ ID NO: 1088082 - DNA, 18 bp, Homo sapiens
aataacctcaaagtgact

SEQ ID NO: 1088083 - DNA, 13 bp, Homo sapiens
aataacctctggc

SEQ ID NO: 1088084 - DNA, 15 bp, Homo sapiens
aataacctctggccc

SEQ ID NO: 1088085 - DNA, 19 bp, Homo sapiens
aataacctctggcccttgg

SEQ ID NO: 1088086 - DNA, 19 bp, Homo sapiens
aataaccttccatacattt

SEQ ID NO: 1088087 - DNA, 15 bp, Homo sapiens
aataactaaaatgta

SEQ ID NO: 1088088 - DNA, 23 bp, Homo sapiens
aataactaaagctagttaatgtc

SEQ ID NO: 1088089 - DNA, 22 bp, Homo sapiens
aataactaatgctaagaaatgc

SEQ ID NO: 1088090 - DNA, 13 bp, Homo sapiens
aataactactgtg

SEQ ID NO: 1088091 - DNA, 18 bp, Homo sapiens
aataactactgtgttcct

SEQ ID NO: 1088092 - DNA, 15 bp, Homo sapiens
aataactatctcact

SEQ ID NO: 1088093 - DNA, 19 bp, Homo sapiens
aataactatctcacttcca

SEQ ID NO: 1088094 - DNA, 22 bp, Homo sapiens
aataactattttgttttaatct

SEQ ID NO: 1088095 - DNA, 19 bp, Homo sapiens
aataactctgtggcattat

SEQ ID NO: 1088096 - DNA, 15 bp, Homo sapiens
aataactgaactgtt

SEQ ID NO: 1088097 - DNA, 13 bp, Homo sapiens
aataactgaattt

SEQ ID NO: 1088098 - DNA, 15 bp, Homo sapiens
aataactgaatttgg

SEQ ID NO: 1088099 - DNA, 21 bp, Homo sapiens
aataactggaaaacagaacac

SEQ ID NO: 1088100 - DNA, 21 bp, Homo sapiens
aataactggaacaaattattt

SEQ ID NO: 1088101 - DNA, 14 bp, Homo sapiens
aataacttcagtcc

SEQ ID NO: 1088102 - DNA, 24 bp, Homo sapiens
aataacttcagtcctgctccagaa

SEQ ID NO: 1088103 - DNA, 11 bp, Homo sapiens
aataacttcta

SEQ ID NO: 1088104 - DNA, 13 bp, Homo sapiens
aataacttctata

SEQ ID NO: 1088105 - DNA, 20 bp, Homo sapiens
aataacttctatgttggttt

SEQ ID NO: 1088106 - DNA, 21 bp, Homo sapiens
aataacttgtcctatgtcaat

SEQ ID NO: 1088107 - DNA, 14 bp, Homo sapiens
aataactttattgc

SEQ ID NO: 1088108 - DNA, 12 bp, Homo sapiens
aataactttttt

SEQ ID NO: 1088109 - DNA, 12 bp, Homo sapiens
aataagaaaaga

SEQ ID NO: 1088110 - DNA, 22 bp, Homo sapiens
aataagaaacttttttttccta

SEQ ID NO: 1088111 - DNA, 15 bp, Homo sapiens
aataagaaagtttca

SEQ ID NO: 1088112 - DNA, 21 bp, Homo sapiens
aataagaaatgaacaaaagat

SEQ ID NO: 1088113 - DNA, 12 bp, Homo sapiens
aataagaaggta

SEQ ID NO: 1088114 - DNA, 14 bp, Homo sapiens
aataagaatgattt

SEQ ID NO: 1088115 - DNA, 15 bp, Homo sapiens
aataagagaaagaaa

SEQ ID NO: 1088116 - DNA, 19 bp, Homo sapiens
aataagcacttgcctggaa

SEQ ID NO: 1088117 - DNA, 14 bp, Homo sapiens
aataagcaggtgga

SEQ ID NO: 1088118 - DNA, 13 bp, Homo sapiens
aataagctaaaga

SEQ ID NO: 1088119 - DNA, 14 bp, Homo sapiens
aataagctaaagag

SEQ ID NO: 1088120 - DNA, 20 bp, Homo sapiens
aataagctttctcagaatgt

SEQ ID NO: 1088121 - DNA, 21 bp, Homo sapiens
aataagctttctcagaatgtt

SEQ ID NO: 1088122 - DNA, 23 bp, Homo sapiens
aataagctttctctcagaaatgc

SEQ ID NO: 1088123 - DNA, 21 bp, Homo sapiens
aataaggacaagcctaacttc

SEQ ID NO: 1088124 - DNA, 15 bp, Homo sapiens
aataaggatgacttt

SEQ ID NO: 1088125 - DNA, 21 bp, Homo sapiens
aataaggcaggcattgaggaa

SEQ ID NO: 1088126 - DNA, 21 bp, Homo sapiens
aataaggcatgcgaaatgttc

SEQ ID NO: 1088127 - DNA, 15 bp, Homo sapiens
aataaggtacaagaa

SEQ ID NO: 1088128 - DNA, 19 bp, Homo sapiens
aataaggtacaagaagcat

SEQ ID NO: 1088129 - DNA, 14 bp, Homo sapiens
aataagtcaacagt

SEQ ID NO: 1088130 - DNA, 15 bp, Homo sapiens
aataagtctgattta

SEQ ID NO: 1088131 - DNA, 22 bp, Homo sapiens
aataagtttcttttaatccaat

SEQ ID NO: 1088132 - DNA, 14 bp, Homo sapiens
aataagtttgaacc

SEQ ID NO: 1088133 - DNA, 18 bp, Homo sapiens
aataagtttgtgttagaa

SEQ ID NO: 1088134 - DNA, 16 bp, Homo sapiens
aataataaaatgcaaa

SEQ ID NO: 1088135 - DNA, 19 bp, Homo sapiens
aataataaaatgcaaatga

SEQ ID NO: 1088136 - DNA, 21 bp, Homo sapiens
aataataaaatgcaaatgaat

SEQ ID NO: 1088137 - DNA, 13 bp, Homo sapiens
aataataaacttt

SEQ ID NO: 1088138 - DNA, 20 bp, Homo sapiens
aataataaagaatagcttta

SEQ ID NO: 1088139 - DNA, 14 bp, Homo sapiens
aataataaagtgtt

SEQ ID NO: 1088140 - DNA, 14 bp, Homo sapiens
aataataaatagtt

SEQ ID NO: 1088141 - DNA, 16 bp, Homo sapiens
aataataaatagttct

SEQ ID NO: 1088142 - DNA, 11 bp, Homo sapiens
aataataaatc

SEQ ID NO: 1088143 - DNA, 19 bp, Homo sapiens
aataataagtgatgtgctg

SEQ ID NO: 1088144 - DNA, 14 bp, Homo sapiens
aataatacactaat

SEQ ID NO: 1088145 - DNA, 20 bp, Homo sapiens
aataatactgacctacctca

SEQ ID NO: 1088146 - DNA, 23 bp, Homo sapiens
aataataggtagggggctttcac

SEQ ID NO: 1088147 - DNA, 14 bp, Homo sapiens
aataatatcaaata

SEQ ID NO: 1088148 - DNA, 12 bp, Homo sapiens
aataatatgcat

SEQ ID NO: 1088149 - DNA, 15 bp, Homo sapiens
aataatatgcattgt

SEQ ID NO: 1088150 - DNA, 17 bp, Homo sapiens
aataatatgcattgtca

SEQ ID NO: 1088151 - DNA, 17 bp, Homo sapiens
aataatcacattgactt

SEQ ID NO: 1088152 - DNA, 21 bp, Homo sapiens
aataatcacgctttcctgaat

SEQ ID NO: 1088153 - DNA, 19 bp, Homo sapiens
aataatccagtattgctga

SEQ ID NO: 1088154 - DNA, 20 bp, Homo sapiens
aataatccagtattgctgat

SEQ ID NO: 1088155 - DNA, 18 bp, Homo sapiens
aataatcccattctttat

SEQ ID NO: 1088156 - DNA, 13 bp, Homo sapiens
aataatcttatta

SEQ ID NO: 1088157 - DNA, 23 bp, Homo sapiens
aataatcttattagggagaaaat

SEQ ID NO: 1088158 - DNA, 18 bp, Homo sapiens
aataatgaagtagaagtt

SEQ ID NO: 1088159 - DNA, 20 bp, Homo sapiens
aataatgacagatggtgaag

SEQ ID NO: 1088160 - DNA, 23 bp, Homo sapiens
aataatgcctccaattttttctt

SEQ ID NO: 1088161 - DNA, 15 bp, Homo sapiens
aataatggaaacatt

SEQ ID NO: 1088162 - DNA, 16 bp, Homo sapiens
aataatggaaacatta

SEQ ID NO: 1088163 - DNA, 20 bp, Homo sapiens
aataatggaaacattacagt

SEQ ID NO: 1088164 - DNA, 20 bp, Homo sapiens
aataatggtcccatccaggc

SEQ ID NO: 1088165 - DNA, 12 bp, Homo sapiens
aataatgtattg

SEQ ID NO: 1088166 - DNA, 12 bp, Homo sapiens
aataatgtgcaa

SEQ ID NO: 1088167 - DNA, 14 bp, Homo sapiens
aataatgtgcaaat

SEQ ID NO: 1088168 - DNA, 16 bp, Homo sapiens
aataattaaatctctt

SEQ ID NO: 1088169 - DNA, 20 bp, Homo sapiens
aataattatgagtttgctta

SEQ ID NO: 1088170 - DNA, 19 bp, Homo sapiens
aataattattcatctaatg

SEQ ID NO: 1088171 - DNA, 21 bp, Homo sapiens
aataattgatcaaattcattt

SEQ ID NO: 1088172 - DNA, 20 bp, Homo sapiens
aataattgatttcaagacct

SEQ ID NO: 1088173 - DNA, 19 bp, Homo sapiens
aataattggagaagattta

SEQ ID NO: 1088174 - DNA, 14 bp, Homo sapiens
aataattgttgttc

SEQ ID NO: 1088175 - DNA, 14 bp, Homo sapiens
aataattgtttcca

SEQ ID NO: 1088176 - DNA, 20 bp, Homo sapiens
aataatttacaggttcttag

SEQ ID NO: 1088177 - DNA, 21 bp, Homo sapiens
aataatttattattaaggtaa

SEQ ID NO: 1088178 - DNA, 20 bp, Homo sapiens
aataatttcctggtgtgaag

SEQ ID NO: 1088179 - DNA, 12 bp, Homo sapiens
aataatttgaat

SEQ ID NO: 1088180 - DNA, 22 bp, Homo sapiens
aataatttgaatgtatttgatt

SEQ ID NO: 1088181 - DNA, 15 bp, Homo sapiens
aataatttgcactga

SEQ ID NO: 1088182 - DNA, 16 bp, Homo sapiens
aataatttgtaaatga

SEQ ID NO: 1088183 - DNA, 13 bp, Homo sapiens
aataatttgtaca

SEQ ID NO: 1088184 - DNA, 20 bp, Homo sapiens
aataatttgtacaatggttt

SEQ ID NO: 1088185 - DNA, 16 bp, Homo sapiens
aataattttaaacaaa

SEQ ID NO: 1088186 - DNA, 12 bp, Homo sapiens
aataattttcca

SEQ ID NO: 1088187 - DNA, 20 bp, Homo sapiens
aataattttccaagtaaagt

SEQ ID NO: 1088188 - DNA, 14 bp, Homo sapiens
aataattttctaag

SEQ ID NO: 1088189 - DNA, 21 bp, Homo sapiens
aatataacttaaaaatgtaaa

SEQ ID NO: 1088190 - DNA, 16 bp, Homo sapiens
aatataagaataaaat

SEQ ID NO: 1088191 - DNA, 16 bp, Homo sapiens
aatataagacatttgt

SEQ ID NO: 1088192 - DNA, 17 bp, Homo sapiens
aatataagcataaaaga

SEQ ID NO: 1088193 - DNA, 21 bp, Homo sapiens
aatataaggaaagcaataaat

SEQ ID NO: 1088194 - DNA, 19 bp, Homo sapiens
aatataaggactttttgat

SEQ ID NO: 1088195 - DNA, 14 bp, Homo sapiens
aatataagtaaagt

SEQ ID NO: 1088196 - DNA, 21 bp, Homo sapiens
aatataagtggtgcttagaaa

SEQ ID NO: 1088197 - DNA, 17 bp, Homo sapiens
aatataataatgatgat

SEQ ID NO: 1088198 - DNA, 13 bp, Homo sapiens
aatataattctgt

SEQ ID NO: 1088199 - DNA, 18 bp, Homo sapiens
aatataattttttagaga

SEQ ID NO: 1088200 - DNA, 13 bp, Homo sapiens
aatatacagtttg

SEQ ID NO: 1088201 - DNA, 14 bp, Homo sapiens
aatatacagtttga

SEQ ID NO: 1088202 - DNA, 18 bp, Homo sapiens
aatatacattcaaactta

SEQ ID NO: 1088203 - DNA, 19 bp, Homo sapiens
aatatacattcaaacttaa

SEQ ID NO: 1088204 - DNA, 21 bp, Homo sapiens
aatatacattttctaaataaa

SEQ ID NO: 1088205 - DNA, 15 bp, Homo sapiens
aatataccccaaatt

SEQ ID NO: 1088206 - DNA, 14 bp, Homo sapiens
aatatacctggttt

SEQ ID NO: 1088207 - DNA, 16 bp, Homo sapiens
aatataccttatttat

SEQ ID NO: 1088208 - DNA, 22 bp, Homo sapiens
aatataccttatttatttttgt

SEQ ID NO: 1088209 - DNA, 16 bp, Homo sapiens
aatatacgaaaagcca

SEQ ID NO: 1088210 - DNA, 20 bp, Homo sapiens
aatatacttatgcaaaacct

SEQ ID NO: 1088211 - DNA, 18 bp, Homo sapiens
aatatacttttacaagta

SEQ ID NO: 1088212 - DNA, 18 bp, Homo sapiens
aatatactttttttgtta

SEQ ID NO: 1088213 - DNA, 19 bp, Homo sapiens
aatatagacattctcacat

SEQ ID NO: 1088214 - DNA, 21 bp, Homo sapiens
aatatagatcagttataagta

SEQ ID NO: 1088215 - DNA, 18 bp, Homo sapiens
aatatagctgtacaaata

SEQ ID NO: 1088216 - DNA, 21 bp, Homo sapiens
aatatagctgtacaaatataa

SEQ ID NO: 1088217 - DNA, 20 bp, Homo sapiens
aatataggaacttaaataat

SEQ ID NO: 1088218 - DNA, 20 bp, Homo sapiens
aatataggatagacactgga

SEQ ID NO: 1088219 - DNA, 21 bp, Homo sapiens
aatataggatagacactggac

SEQ ID NO: 1088220 - DNA, 23 bp, Homo sapiens
aatataggatagacactggacat

SEQ ID NO: 1088221 - DNA, 21 bp, Homo sapiens
aatatagggttttttttaatg

SEQ ID NO: 1088222 - DNA, 13 bp, Homo sapiens
aatataggtctct

SEQ ID NO: 1088223 - DNA, 20 bp, Homo sapiens
aatatagttctgtgtagaga

SEQ ID NO: 1088224 - DNA, 23 bp, Homo sapiens
aatatagtttggaaataaaaatg

SEQ ID NO: 1088225 - DNA, 15 bp, Homo sapiens
aatatataaacactc

SEQ ID NO: 1088226 - DNA, 21 bp, Homo sapiens
aatatataaacactccacagt

SEQ ID NO: 1088227 - DNA, 11 bp, Homo sapiens
aatatataaat

SEQ ID NO: 1088228 - DNA, 14 bp, Homo sapiens
aatatataaatata

SEQ ID NO: 1088229 - DNA, 14 bp, Homo sapiens
aatatataatattc

SEQ ID NO: 1088230 - DNA, 14 bp, Homo sapiens
aatatataatttat

SEQ ID NO: 1088231 - DNA, 16 bp, Homo sapiens
aatatatagtgaaaaa

SEQ ID NO: 1088232 - DNA, 21 bp, Homo sapiens
aatatatagtgaaaaatgtca

SEQ ID NO: 1088233 - DNA, 20 bp, Homo sapiens
aatatatagtgggtacatca

SEQ ID NO: 1088234 - DNA, 21 bp, Homo sapiens
aatatatagtgggtacatcaa

SEQ ID NO: 1088235 - DNA, 14 bp, Homo sapiens
aatatatataaacc

SEQ ID NO: 1088236 - DNA, 16 bp, Homo sapiens
aatatatatacatata

SEQ ID NO: 1088237 - DNA, 13 bp, Homo sapiens
aatatatatatat

SEQ ID NO: 1088238 - DNA, 18 bp, Homo sapiens
aatatatatatatataaa

SEQ ID NO: 1088239 - DNA, 19 bp, Homo sapiens
aatatatatatatataaaa

SEQ ID NO: 1088240 - DNA, 13 bp, Homo sapiens
aatatatatgaat

SEQ ID NO: 1088241 - DNA, 15 bp, Homo sapiens
aatatatatgtcaat

SEQ ID NO: 1088242 - DNA, 16 bp, Homo sapiens
aatatatatgtcaata

SEQ ID NO: 1088243 - DNA, 23 bp, Homo sapiens
aatatatattactactcctttgg

SEQ ID NO: 1088244 - DNA, 12 bp, Homo sapiens
aatatatatttc

SEQ ID NO: 1088245 - DNA, 14 bp, Homo sapiens
aatatatattttgt

SEQ ID NO: 1088246 - DNA, 16 bp, Homo sapiens
aatatatatttttcaa

SEQ ID NO: 1088247 - DNA, 17 bp, Homo sapiens
aatatatatttttcaaa

SEQ ID NO: 1088248 - DNA, 20 bp, Homo sapiens
aatatatatttttcaaatag

SEQ ID NO: 1088249 - DNA, 22 bp, Homo sapiens
aatatatatttttcaaatagat

SEQ ID NO: 1088250 - DNA, 14 bp, Homo sapiens
aatatatctctatt

SEQ ID NO: 1088251 - DNA, 21 bp, Homo sapiens
aatatatgccttgtataatat

SEQ ID NO: 1088252 - DNA, 20 bp, Homo sapiens
aatatatggcagagttgtaa

SEQ ID NO: 1088253 - DNA, 23 bp, Homo sapiens
aatatatggcagagttgtaaata

SEQ ID NO: 1088254 - DNA, 16 bp, Homo sapiens
aatatatgtatataca

SEQ ID NO: 1088255 - DNA, 14 bp, Homo sapiens
aatatatgtattat

SEQ ID NO: 1088256 - DNA, 18 bp, Homo sapiens
aatatatgtattatttat

SEQ ID NO: 1088257 - DNA, 21 bp, Homo sapiens
aatatatgtattatttataat

SEQ ID NO: 1088258 - DNA, 14 bp, Homo sapiens
aatatatgtatttt

SEQ ID NO: 1088259 - DNA, 18 bp, Homo sapiens
aatatatgtctgataatg

SEQ ID NO: 1088260 - DNA, 12 bp, Homo sapiens
aatatatgttct

SEQ ID NO: 1088261 - DNA, 17 bp, Homo sapiens
aatatatgttctgcaag

SEQ ID NO: 1088262 - DNA, 20 bp, Homo sapiens
aatatatgttctgcaagaat

SEQ ID NO: 1088263 - DNA, 15 bp, Homo sapiens
aatatattaccagca

SEQ ID NO: 1088264 - DNA, 22 bp, Homo sapiens
aatatattaccagcaagaataa

SEQ ID NO: 1088265 - DNA, 13 bp, Homo sapiens
aatatattactga

SEQ ID NO: 1088266 - DNA, 17 bp, Homo sapiens
aatatattactgattta

SEQ ID NO: 1088267 - DNA, 13 bp, Homo sapiens
aatatattataat

SEQ ID NO: 1088268 - DNA, 13 bp, Homo sapiens
aatatattatata

SEQ ID NO: 1088269 - DNA, 16 bp, Homo sapiens
aatatattcaggagtt

SEQ ID NO: 1088270 - DNA, 17 bp, Homo sapiens
aatatattgctgcattt

SEQ ID NO: 1088271 - DNA, 13 bp, Homo sapiens
aatatattgtaca

SEQ ID NO: 1088272 - DNA, 19 bp, Homo sapiens
aatatatttaagataatta

SEQ ID NO: 1088273 - DNA, 20 bp, Homo sapiens
aatatatttaagataattat

SEQ ID NO: 1088274 - DNA, 18 bp, Homo sapiens
aatatatttaatatattg

SEQ ID NO: 1088275 - DNA, 12 bp, Homo sapiens
aatatatttctt

SEQ ID NO: 1088276 - DNA, 12 bp, Homo sapiens
aatatatttgta

SEQ ID NO: 1088277 - DNA, 14 bp, Homo sapiens
aatatatttgtaaa

SEQ ID NO: 1088278 - DNA, 15 bp, Homo sapiens
aatatatttgtaaaa

SEQ ID NO: 1088279 - DNA, 17 bp, Homo sapiens
aatatatttgtaaaaga

SEQ ID NO: 1088280 - DNA, 14 bp, Homo sapiens
aatatatttgtgta

SEQ ID NO: 1088281 - DNA, 15 bp, Homo sapiens
aatatatttttagac

SEQ ID NO: 1088282 - DNA, 18 bp, Homo sapiens
aatatatttttagactca

SEQ ID NO: 1088283 - DNA, 21 bp, Homo sapiens
aatatattttttgttattatt

SEQ ID NO: 1088284 - DNA, 15 bp, Homo sapiens
aatatcaaataaaat

SEQ ID NO: 1088285 - DNA, 16 bp, Homo sapiens
aatatcaaataaaata

SEQ ID NO: 1088286 - DNA, 17 bp, Homo sapiens
aatatcaaataaaatat

SEQ ID NO: 1088287 - DNA, 18 bp, Homo sapiens
aatatcaaataataaagt

SEQ ID NO: 1088288 - DNA, 20 bp, Homo sapiens
aatatcaaatgcagtatatt

SEQ ID NO: 1088289 - DNA, 21 bp, Homo sapiens
aatatcaaatgcagtatattt

SEQ ID NO: 1088290 - DNA, 22 bp, Homo sapiens
aatatcaactctcactcctgaa

SEQ ID NO: 1088291 - DNA, 15 bp, Homo sapiens
aatatcaactctgaa

SEQ ID NO: 1088292 - DNA, 15 bp, Homo sapiens
aatatcaatataatg

SEQ ID NO: 1088293 - DNA, 15 bp, Homo sapiens
aatatcaatcacatt

SEQ ID NO: 1088294 - DNA, 16 bp, Homo sapiens
aatatcactcattaat

SEQ ID NO: 1088295 - DNA, 17 bp, Homo sapiens
aatatcactcattaatt

SEQ ID NO: 1088296 - DNA, 13 bp, Homo sapiens
aatatcagacaag

SEQ ID NO: 1088297 - DNA, 15 bp, Homo sapiens
aatatcagacaagca

SEQ ID NO: 1088298 - DNA, 15 bp, Homo sapiens
aatatcagtattctg

SEQ ID NO: 1088299 - DNA, 18 bp, Homo sapiens
aatatcagtattctgaca

SEQ ID NO: 1088300 - DNA, 19 bp, Homo sapiens
aatatcagtattctgacat

SEQ ID NO: 1088301 - DNA, 20 bp, Homo sapiens
aatatcagtattctgacatg

SEQ ID NO: 1088302 - DNA, 19 bp, Homo sapiens
aatatcagttactcagccc

SEQ ID NO: 1088303 - DNA, 22 bp, Homo sapiens
aatatcagttactcagccctgg

SEQ ID NO: 1088304 - DNA, 16 bp, Homo sapiens
aatatcataaagcatt

SEQ ID NO: 1088305 - DNA, 15 bp, Homo sapiens
aatatcatgtcttgt

SEQ ID NO: 1088306 - DNA, 16 bp, Homo sapiens
aatatcatttactctt

SEQ ID NO: 1088307 - DNA, 13 bp, Homo sapiens
aatatcatttatt

SEQ ID NO: 1088308 - DNA, 13 bp, Homo sapiens
aatatccacagta

SEQ ID NO: 1088309 - DNA, 14 bp, Homo sapiens
aatatcccagagaa

SEQ ID NO: 1088310 - DNA, 20 bp, Homo sapiens
aatatcccagagaacaatca

SEQ ID NO: 1088311 - DNA, 18 bp, Homo sapiens
aatcagcaatattgcctg

SEQ ID NO: 1088312 - DNA, 21 bp, Homo sapiens
aatcagcatgacaaaaataac

SEQ ID NO: 1088313 - DNA, 14 bp, Homo sapiens
aatcagcatttagt

SEQ ID NO: 1088314 - DNA, 15 bp, Homo sapiens
aatcagccagtctca

SEQ ID NO: 1088315 - DNA, 23 bp, Homo sapiens
aatcagcctaggggtcagggacc

SEQ ID NO: 1088316 - DNA, 16 bp, Homo sapiens
aatcagcctcttaaag

SEQ ID NO: 1088317 - DNA, 11 bp, Homo sapiens
aatcagcctgc

SEQ ID NO: 1088318 - DNA, 18 bp, Homo sapiens
aatcagcctgctccagct

SEQ ID NO: 1088319 - DNA, 11 bp, Homo sapiens
aatcagccttt

SEQ ID NO: 1088320 - DNA, 21 bp, Homo sapiens
aatcagcctttaggtctttag

SEQ ID NO: 1088321 - DNA, 15 bp, Homo sapiens
aatcagctattttgt

SEQ ID NO: 1088322 - DNA, 14 bp, Homo sapiens
aatcaggaaaaatg

SEQ ID NO: 1088323 - DNA, 16 bp, Homo sapiens
aatcaggaaaaatgag

SEQ ID NO: 1088324 - DNA, 14 bp, Homo sapiens
aatcaggcagcctt

SEQ ID NO: 1088325 - DNA, 15 bp, Homo sapiens
aatcaggggccagag

SEQ ID NO: 1088326 - DNA, 20 bp, Homo sapiens
aatcaggtagaccatattct

SEQ ID NO: 1088327 - DNA, 13 bp, Homo sapiens
aatcagtatcaga

SEQ ID NO: 1088328 - DNA, 16 bp, Homo sapiens
aatcagtatcagaata

SEQ ID NO: 1088329 - DNA, 18 bp, Homo sapiens
aatcagtatcagaatact

SEQ ID NO: 1088330 - DNA, 22 bp, Homo sapiens
aatcagtcatgtgtaatatgca

SEQ ID NO: 1088331 - DNA, 14 bp, Homo sapiens
aatcagtcccctcc

SEQ ID NO: 1088332 - DNA, 16 bp, Homo sapiens
aatcagtcccctccca

SEQ ID NO: 1088333 - DNA, 24 bp, Homo sapiens
aatcagtctcagaatgtcattttg

SEQ ID NO: 1088334 - DNA, 15 bp, Homo sapiens
aatcagtcttccttg

SEQ ID NO: 1088335 - DNA, 13 bp, Homo sapiens
aatcagtgttaaa

SEQ ID NO: 1088336 - DNA, 17 bp, Homo sapiens
aatcagtgtttaaataa

SEQ ID NO: 1088337 - DNA, 18 bp, Homo sapiens
aatcagtgtttaaataaa

SEQ ID NO: 1088338 - DNA, 15 bp, Homo sapiens
aatcagttagttttt

SEQ ID NO: 1088339 - DNA, 23 bp, Homo sapiens
aatcagttgtttaataatttaca

SEQ ID NO: 1088340 - DNA, 14 bp, Homo sapiens
aatcataaagtcag

SEQ ID NO: 1088341 - DNA, 22 bp, Homo sapiens
aatcatagtactctttgtagca

SEQ ID NO: 1088342 - DNA, 15 bp, Homo sapiens
aatcatatgattctg

SEQ ID NO: 1088343 - DNA, 14 bp, Homo sapiens
aatcatccctcctt

SEQ ID NO: 1088344 - DNA, 15 bp, Homo sapiens
aatcatcccttaata

SEQ ID NO: 1088345 - DNA, 12 bp, Homo sapiens
aatcatcctcat

SEQ ID NO: 1088346 - DNA, 21 bp, Homo sapiens
aatcatgaaaagaggaacagg

SEQ ID NO: 1088347 - DNA, 21 bp, Homo sapiens
aatcatgaacagctctgagat

SEQ ID NO: 1088348 - DNA, 21 bp, Homo sapiens
aatcatgagaaaaactgttct

SEQ ID NO: 1088349 - DNA, 13 bp, Homo sapiens
aatcatgagcctg

SEQ ID NO: 1088350 - DNA, 15 bp, Homo sapiens
aatcatgccagtatt

SEQ ID NO: 1088351 - DNA, 17 bp, Homo sapiens
aatcatgccagtatttt

SEQ ID NO: 1088352 - DNA, 20 bp, Homo sapiens
aatcatggtcaagttcccaa

SEQ ID NO: 1088353 - DNA, 14 bp, Homo sapiens
aatcatgtaaatgc

SEQ ID NO: 1088354 - DNA, 13 bp, Homo sapiens
aatcatgtagttt

SEQ ID NO: 1088355 - DNA, 12 bp, Homo sapiens
aatcatgtatgt

SEQ ID NO: 1088356 - DNA, 17 bp, Homo sapiens
aatcatgtatgttatga

SEQ ID NO: 1088357 - DNA, 22 bp, Homo sapiens
aatcatgtccatacactttgtt

SEQ ID NO: 1088358 - DNA, 15 bp, Homo sapiens
aatcatgtgaacccg

SEQ ID NO: 1088359 - DNA, 19 bp, Homo sapiens
aatcatgtgggtgagccag

SEQ ID NO: 1088360 - DNA, 21 bp, Homo sapiens
aatcatgtgggtgagccagtg

SEQ ID NO: 1088361 - DNA, 23 bp, Homo sapiens
aatcatgttgatcatgtactttt

SEQ ID NO: 1088362 - DNA, 12 bp, Homo sapiens
aatcatgttgtt

SEQ ID NO: 1088363 - DNA, 19 bp, Homo sapiens
aatcatgtttattttgagt

SEQ ID NO: 1088364 - DNA, 23 bp, Homo sapiens
aatcatgttttgatgagaaaaaa

SEQ ID NO: 1088365 - DNA, 15 bp, Homo sapiens
aatcattaggtgtga

SEQ ID NO: 1088366 - DNA, 23 bp, Homo sapiens
aatcattaggtgtgactgaattt

SEQ ID NO: 1088367 - DNA, 20 bp, Homo sapiens
aatcattagttttagaggca

SEQ ID NO: 1088368 - DNA, 13 bp, Homo sapiens
aatcattatgttt

SEQ ID NO: 1088369 - DNA, 12 bp, Homo sapiens
aatcattccagt

SEQ ID NO: 1088370 - DNA, 17 bp, Homo sapiens
aatcattcttactaaaa

SEQ ID NO: 1088371 - DNA, 18 bp, Homo sapiens
aatcattcttactaaaaa

SEQ ID NO: 1088372 - DNA, 20 bp, Homo sapiens
aatcattgaagtatattctt

SEQ ID NO: 1088373 - DNA, 19 bp, Homo sapiens
aatcattgcttatgtcaaa

SEQ ID NO: 1088374 - DNA, 14 bp, Homo sapiens
aatcattgctttga

SEQ ID NO: 1088375 - DNA, 17 bp, Homo sapiens
aatcattgttataaaga

SEQ ID NO: 1088376 - DNA, 14 bp, Homo sapiens
aatcatttggttaa

SEQ ID NO: 1088377 - DNA, 17 bp, Homo sapiens
aatcatttggttaaatc

SEQ ID NO: 1088378 - DNA, 11 bp, Homo sapiens
aatcatttgtt

SEQ ID NO: 1088379 - DNA, 18 bp, Homo sapiens
aatcatttgttcaaagct

SEQ ID NO: 1088380 - DNA, 22 bp, Homo sapiens
aatcatttgtttacatttgatg

SEQ ID NO: 1088381 - DNA, 11 bp, Homo sapiens
aatcattttaa

SEQ ID NO: 1088382 - DNA, 15 bp, Homo sapiens
aatcattttaaattc

SEQ ID NO: 1088383 - DNA, 15 bp, Homo sapiens
aatcattttaattat

SEQ ID NO: 1088384 - DNA, 19 bp, Homo sapiens
aatcattttaattattatt

SEQ ID NO: 1088385 - DNA, 20 bp, Homo sapiens
aatcattttaattattattc

SEQ ID NO: 1088386 - DNA, 19 bp, Homo sapiens
aatcattttatatgtcaaa

SEQ ID NO: 1088387 - DNA, 14 bp, Homo sapiens
aatcattttatgct

SEQ ID NO: 1088388 - DNA, 17 bp, Homo sapiens
aatcattttcattccta

SEQ ID NO: 1088389 - DNA, 18 bp, Homo sapiens
aatcattttcattcctaa

SEQ ID NO: 1088390 - DNA, 13 bp, Homo sapiens
aatcattttgcaa

SEQ ID NO: 1088391 - DNA, 19 bp, Homo sapiens
aatccaaaaagctctgaaa

SEQ ID NO: 1088392 - DNA, 22 bp, Homo sapiens
aatccaaaaagctctgaaaaca

SEQ ID NO: 1088393 - DNA, 17 bp, Homo sapiens
aatccaaaacttctctt

SEQ ID NO: 1088394 - DNA, 22 bp, Homo sapiens
aatccaaatctgtcctctgtag

SEQ ID NO: 1088395 - DNA, 17 bp, Homo sapiens
aatccaaatttctcatg

SEQ ID NO: 1088396 - DNA, 23 bp, Homo sapiens
aatccaagcctccacagcgaggg

SEQ ID NO: 1088397 - DNA, 23 bp, Homo sapiens
aatccaagtagataggaagaaag

SEQ ID NO: 1088398 - DNA, 22 bp, Homo sapiens
aatccaataaaaacattttgaa

SEQ ID NO: 1088399 - DNA, 19 bp, Homo sapiens
aatccaatattttgccttt

SEQ ID NO: 1088400 - DNA, 15 bp, Homo sapiens
aatccacatctttac

SEQ ID NO: 1088401 - DNA, 14 bp, Homo sapiens
aatccacccccagg

SEQ ID NO: 1088402 - DNA, 18 bp, Homo sapiens
aatccacctgcctcggcc

SEQ ID NO: 1088403 - DNA, 16 bp, Homo sapiens
aatccactaacacttt

SEQ ID NO: 1088404 - DNA, 14 bp, Homo sapiens
aatccactccttcc

SEQ ID NO: 1088405 - DNA, 13 bp, Homo sapiens
aatccagaaagaa

SEQ ID NO: 1088406 - DNA, 20 bp, Homo sapiens
aatccagtttgtgtttttct

SEQ ID NO: 1088407 - DNA, 15 bp, Homo sapiens
aatccataaatgtgt

SEQ ID NO: 1088408 - DNA, 17 bp, Homo sapiens
aatccatagatttattt

SEQ ID NO: 1088409 - DNA, 13 bp, Homo sapiens
aatccatcctgca

SEQ ID NO: 1088410 - DNA, 21 bp, Homo sapiens
aatccatcctgcaaaggccct

SEQ ID NO: 1088411 - DNA, 15 bp, Homo sapiens
aatccatgcttcact

SEQ ID NO: 1088412 - DNA, 18 bp, Homo sapiens
aatccatgtgaccattct

SEQ ID NO: 1088413 - DNA, 20 bp, Homo sapiens
aatccatgtgattaatgttt

SEQ ID NO: 1088414 - DNA, 17 bp, Homo sapiens
aatccatgttagttttt

SEQ ID NO: 1088415 - DNA, 22 bp, Homo sapiens
aatccatgttagtttttacttt

SEQ ID NO: 1088416 - DNA, 13 bp, Homo sapiens
aatccattccagg

SEQ ID NO: 1088417 - DNA, 15 bp, Homo sapiens
aatccattgtttaaa

SEQ ID NO: 1088418 - DNA, 13 bp, Homo sapiens
aatccatttagca

SEQ ID NO: 1088419 - DNA, 22 bp, Homo sapiens
aatccatttagcactatttaaa

SEQ ID NO: 1088420 - DNA, 12 bp, Homo sapiens
aatccattttag

SEQ ID NO: 1088421 - DNA, 11 bp, Homo sapiens
aatcccaaatt

SEQ ID NO: 1088422 - DNA, 18 bp, Homo sapiens
aatcccaaatttgattga

SEQ ID NO: 1088423 - DNA, 15 bp, Homo sapiens
aatcccaatctttct

SEQ ID NO: 1088424 - DNA, 18 bp, Homo sapiens
aatcccaatctttctata

SEQ ID NO: 1088425 - DNA, 21 bp, Homo sapiens
aatcccaccaaatcatcctga

SEQ ID NO: 1088426 - DNA, 18 bp, Homo sapiens
aatcccagctactcagga

SEQ ID NO: 1088427 - DNA, 16 bp, Homo sapiens
aatcccatcaggctgt

SEQ ID NO: 1088428 - DNA, 16 bp, Homo sapiens
aatcccatctctacaa

SEQ ID NO: 1088429 - DNA, 19 bp, Homo sapiens
aatcccctcattcaggaaa

SEQ ID NO: 1088430 - DNA, 12 bp, Homo sapiens
aatcccctcctt

SEQ ID NO: 1088431 - DNA, 17 bp, Homo sapiens
aatcccctccttgggca

SEQ ID NO: 1088432 - DNA, 18 bp, Homo sapiens
aatcccctccttgggcac

SEQ ID NO: 1088433 - DNA, 15 bp, Homo sapiens
aatccccttatgact

SEQ ID NO: 1088434 - DNA, 15 bp, Homo sapiens
aatctttgtataaat

SEQ ID NO: 1088435 - DNA, 13 bp, Homo sapiens
aatctttgttaag

SEQ ID NO: 1088436 - DNA, 23 bp, Homo sapiens
aatctttgttgaagtttgaacca

SEQ ID NO: 1088437 - DNA, 21 bp, Homo sapiens
aatcttttaaaaattcaaatg

SEQ ID NO: 1088438 - DNA, 21 bp, Homo sapiens
aatcttttataatgattcata

SEQ ID NO: 1088439 - DNA, 16 bp, Homo sapiens
aatcttttataggatt

SEQ ID NO: 1088440 - DNA, 15 bp, Homo sapiens
aatcttttcttattt

SEQ ID NO: 1088441 - DNA, 21 bp, Homo sapiens
aatctttttatcccatttagt

SEQ ID NO: 1088442 - DNA, 19 bp, Homo sapiens
aatgaaaaatttaagcatt

SEQ ID NO: 1088443 - DNA, 13 bp, Homo sapiens
aatgaaaacattt

SEQ ID NO: 1088444 - DNA, 18 bp, Homo sapiens
aatgaaaactctttgctg

SEQ ID NO: 1088445 - DNA, 14 bp, Homo sapiens
aatgaaaacttttg

SEQ ID NO: 1088446 - DNA, 19 bp, Homo sapiens
aatgaaaacttttgtaaat

SEQ ID NO: 1088447 - DNA, 21 bp, Homo sapiens
aatgaaaacttttgtaaatta

SEQ ID NO: 1088448 - DNA, 12 bp, Homo sapiens
aatgaaaagcaa

SEQ ID NO: 1088449 - DNA, 17 bp, Homo sapiens
aatgaaaataaaacaca

SEQ ID NO: 1088450 - DNA, 13 bp, Homo sapiens
aatgaaaatatct

SEQ ID NO: 1088451 - DNA, 14 bp, Homo sapiens
aatgaaaatgaata

SEQ ID NO: 1088452 - DNA, 17 bp, Homo sapiens
aatgaaaatgcagtcct

SEQ ID NO: 1088453 - DNA, 14 bp, Homo sapiens
aatgaaaatgtcag

SEQ ID NO: 1088454 - DNA, 17 bp, Homo sapiens
aatgaaaattgtattat

SEQ ID NO: 1088455 - DNA, 20 bp, Homo sapiens
aatgaaacaaataatcacat

SEQ ID NO: 1088456 - DNA, 18 bp, Homo sapiens
aatgaaagactgtacaaa

SEQ ID NO: 1088457 - DNA, 23 bp, Homo sapiens
aatgaaaggagtttaaaaacatt

SEQ ID NO: 1088458 - DNA, 20 bp, Homo sapiens
aatgaaaggtactatatttg

SEQ ID NO: 1088459 - DNA, 23 bp, Homo sapiens
aatgaaaggtactatatttgcta

SEQ ID NO: 1088460 - DNA, 18 bp, Homo sapiens
aatgaaagtgactttaaa

SEQ ID NO: 1088461 - DNA, 14 bp, Homo sapiens
aatgaaatattgct

SEQ ID NO: 1088462 - DNA, 19 bp, Homo sapiens
aatgaaatattgtttccaa

SEQ ID NO: 1088463 - DNA, 21 bp, Homo sapiens
aatgaaatcctgcttcagtgt

SEQ ID NO: 1088464 - DNA, 17 bp, Homo sapiens
aatgaaatgataaagac

SEQ ID NO: 1088465 - DNA, 23 bp, Homo sapiens
aatgaaatgtttactaagtggac

SEQ ID NO: 1088466 - DNA, 14 bp, Homo sapiens
aatgaaattgtaaa

SEQ ID NO: 1088467 - DNA, 14 bp, Homo sapiens
aatgaacaaaatta

SEQ ID NO: 1088468 - DNA, 18 bp, Homo sapiens
aatgaacactcttttgct

SEQ ID NO: 1088469 - DNA, 22 bp, Homo sapiens
aatgaacagaacatagacagaa

SEQ ID NO: 1088470 - DNA, 13 bp, Homo sapiens
aatgaacatctct

SEQ ID NO: 1088471 - DNA, 19 bp, Homo sapiens
aatgaacatctcttgaaac

SEQ ID NO: 1088472 - DNA, 14 bp, Homo sapiens
aatgaacattttgt

SEQ ID NO: 1088473 - DNA, 19 bp, Homo sapiens
aatgaacccatagggagct

SEQ ID NO: 1088474 - DNA, 16 bp, Homo sapiens
aatgaaccctcctcct

SEQ ID NO: 1088475 - DNA, 19 bp, Homo sapiens
aatgaactaccatctgatg

SEQ ID NO: 1088476 - DNA, 22 bp, Homo sapiens
aatgaactaccatctgatgttt

SEQ ID NO: 1088477 - DNA, 23 bp, Homo sapiens
aatgaactatgtcgatgcacagt

SEQ ID NO: 1088478 - DNA, 15 bp, Homo sapiens
aatgaactgaagttt

SEQ ID NO: 1088479 - DNA, 12 bp, Homo sapiens
aatgaactgtgg

SEQ ID NO: 1088480 - DNA, 15 bp, Homo sapiens
aatgaactgtggaat

SEQ ID NO: 1088481 - DNA, 17 bp, Homo sapiens
aatgaactgtggaattt

SEQ ID NO: 1088482 - DNA, 18 bp, Homo sapiens
aatgaactgtggaattta

SEQ ID NO: 1088483 - DNA, 18 bp, Homo sapiens
aatgaacttttacagaat

SEQ ID NO: 1088484 - DNA, 20 bp, Homo sapiens
aatgaacttttacagaatgc

SEQ ID NO: 1088485 - DNA, 21 bp, Homo sapiens
aatgaagaaagggaggcccag

SEQ ID NO: 1088486 - DNA, 15 bp, Homo sapiens
aatgaagaatcacga

SEQ ID NO: 1088487 - DNA, 19 bp, Homo sapiens
aatgaagaattatgtaata

SEQ ID NO: 1088488 - DNA, 17 bp, Homo sapiens
aatgaagcagctttaaa

SEQ ID NO: 1088489 - DNA, 22 bp, Homo sapiens
aatgaagcagctttaaacaaat

SEQ ID NO: 1088490 - DNA, 14 bp, Homo sapiens
aatgaagcagtatt

SEQ ID NO: 1088491 - DNA, 13 bp, Homo sapiens
aatgaagccagct

SEQ ID NO: 1088492 - DNA, 13 bp, Homo sapiens
aatgaaggaatta

SEQ ID NO: 1088493 - DNA, 16 bp, Homo sapiens
aatgaagtatttctca

SEQ ID NO: 1088494 - DNA, 15 bp, Homo sapiens
aatgaagtgattcta

SEQ ID NO: 1088495 - DNA, 16 bp, Homo sapiens
aatgaataaactgaat

SEQ ID NO: 1088496 - DNA, 20 bp, Homo sapiens
aatgaataatgcctttgtaa

SEQ ID NO: 1088497 - DNA, 14 bp, Homo sapiens
aatgaataatttat

SEQ ID NO: 1088498 - DNA, 16 bp, Homo sapiens
aatgaataatttccca

SEQ ID NO: 1088499 - DNA, 16 bp, Homo sapiens
aatgaatatcaggcta

SEQ ID NO: 1088500 - DNA, 15 bp, Homo sapiens
aatgaatatctatta

SEQ ID NO: 1088501 - DNA, 13 bp, Homo sapiens
aatgaatcattgt

SEQ ID NO: 1088502 - DNA, 14 bp, Homo sapiens
aatgaatcattgtt

SEQ ID NO: 1088503 - DNA, 18 bp, Homo sapiens
aatgaatgcaaaattgtt

SEQ ID NO: 1088504 - DNA, 23 bp, Homo sapiens
aatgaatgcaaaattgttttcac

SEQ ID NO: 1088505 - DNA, 19 bp, Homo sapiens
aatgaatggactcaaactg

SEQ ID NO: 1088506 - DNA, 14 bp, Homo sapiens
aatgaatgtatatt

SEQ ID NO: 1088507 - DNA, 13 bp, Homo sapiens
aatgaatgtcact

SEQ ID NO: 1088508 - DNA, 23 bp, Homo sapiens
aatgaatgtttacactctttgta

SEQ ID NO: 1088509 - DNA, 19 bp, Homo sapiens
aatgaattataacagttat

SEQ ID NO: 1088510 - DNA, 17 bp, Homo sapiens
aatgaatttaaggcaaa

SEQ ID NO: 1088511 - DNA, 19 bp, Homo sapiens
aatgaatttaaggcaaaaa

SEQ ID NO: 1088512 - DNA, 15 bp, Homo sapiens
aatgacaaagccatt

SEQ ID NO: 1088513 - DNA, 18 bp, Homo sapiens
aatgacaaagtgttgaaa

SEQ ID NO: 1088514 - DNA, 19 bp, Homo sapiens
aatgacaaatgtattaatg

SEQ ID NO: 1088515 - DNA, 12 bp, Homo sapiens
aatgacaacact

SEQ ID NO: 1088516 - DNA, 13 bp, Homo sapiens
aatgacaacagaa

SEQ ID NO: 1088517 - DNA, 14 bp, Homo sapiens
aatgacaacagaaa

SEQ ID NO: 1088518 - DNA, 19 bp, Homo sapiens
aatgacaacagaaaaacaa

SEQ ID NO: 1088519 - DNA, 21 bp, Homo sapiens
aatgacaacagaaaaacaatc

SEQ ID NO: 1088520 - DNA, 13 bp, Homo sapiens
aatgacagtttca

SEQ ID NO: 1088521 - DNA, 21 bp, Homo sapiens
aatgacatacgcttttaatga

SEQ ID NO: 1088522 - DNA, 21 bp, Homo sapiens
aatgacattaaatgcaataat

SEQ ID NO: 1088523 - DNA, 15 bp, Homo sapiens
aatgaccattcaatt

SEQ ID NO: 1088524 - DNA, 14 bp, Homo sapiens
aatgacgtatacat

SEQ ID NO: 1088525 - DNA, 15 bp, Homo sapiens
aatgactatataatt

SEQ ID NO: 1088526 - DNA, 16 bp, Homo sapiens
aatgactatgtccaga

SEQ ID NO: 1088527 - DNA, 18 bp, Homo sapiens
aatgactatgtccagatt

SEQ ID NO: 1088528 - DNA, 21 bp, Homo sapiens
aatgactctttctgaaggaag

SEQ ID NO: 1088529 - DNA, 14 bp, Homo sapiens
aatgactgaaagaa

SEQ ID NO: 1088530 - DNA, 21 bp, Homo sapiens
aatgactgaaagaagaacagc

SEQ ID NO: 1088531 - DNA, 13 bp, Homo sapiens
aatgacttagaaa

SEQ ID NO: 1088532 - DNA, 19 bp, Homo sapiens
aatgacttgattgtacttg

SEQ ID NO: 1088533 - DNA, 20 bp, Homo sapiens
aatgactttatttttctaag

SEQ ID NO: 1088534 - DNA, 12 bp, Homo sapiens
aatgactttgaa

SEQ ID NO: 1088535 - DNA, 15 bp, Homo sapiens
aatgagacttgctct

SEQ ID NO: 1088536 - DNA, 16 bp, Homo sapiens
aatgagacttgctctc

SEQ ID NO: 1088537 - DNA, 16 bp, Homo sapiens
aatgagactttaaaag

SEQ ID NO: 1088538 - DNA, 19 bp, Homo sapiens
aatgagagttccttctcac

SEQ ID NO: 1088539 - DNA, 14 bp, Homo sapiens
aatgagatgcatga

SEQ ID NO: 1088540 - DNA, 16 bp, Homo sapiens
aatgagatgcatgatt

SEQ ID NO: 1088541 - DNA, 20 bp, Homo sapiens
aatgagatgttattactgtt

SEQ ID NO: 1088542 - DNA, 18 bp, Homo sapiens
aatgagattatatgtgga

SEQ ID NO: 1088543 - DNA, 23 bp, Homo sapiens
aatgagcacccattccaaagctt

SEQ ID NO: 1088544 - DNA, 13 bp, Homo sapiens
aatgagcatcaga

SEQ ID NO: 1088545 - DNA, 21 bp, Homo sapiens
aatgagccatcactagaagaa

SEQ ID NO: 1088546 - DNA, 22 bp, Homo sapiens
aatgagccatcactagaagaaa

SEQ ID NO: 1088547 - DNA, 23 bp, Homo sapiens
aatgagccccttcatccgcctgt

SEQ ID NO: 1088548 - DNA, 15 bp, Homo sapiens
aatgagccctggctc

SEQ ID NO: 1088549 - DNA, 23 bp, Homo sapiens
aatgagccctggctcccacctgt

SEQ ID NO: 1088550 - DNA, 21 bp, Homo sapiens
aatgagcctacgctgaagatg

SEQ ID NO: 1088551 - DNA, 11 bp, Homo sapiens
aatgagcctgg

SEQ ID NO: 1088552 - DNA, 15 bp, Homo sapiens
aatgagcctggcaag

SEQ ID NO: 1088553 - DNA, 19 bp, Homo sapiens
aatgaggaatagcaaaatt

SEQ ID NO: 1088554 - DNA, 14 bp, Homo sapiens
aatgaggacatgtt

SEQ ID NO: 1088555 - DNA, 22 bp, Homo sapiens
aatgaggagagaaaatatatgt

SEQ ID NO: 1088556 - DNA, 19 bp, Homo sapiens
aatgaggtcagcatgtcta

SEQ ID NO: 1088557 - DNA, 16 bp, Homo sapiens
aatgaggtcccaggca

SEQ ID NO: 1088558 - DNA, 15 bp, Homo sapiens
aatgaggtctgttta

SEQ ID NO: 1088559 - DNA, 23 bp, Homo sapiens
aatgagtaaaaactagaaggctt

SEQ ID NO: 1088560 - DNA, 19 bp, Homo sapiens
aatgagtaacatttgctgt

SEQ ID NO: 1088561 - DNA, 15 bp, Homo sapiens
aatgagtatttggtc

SEQ ID NO: 1088562 - DNA, 19 bp, Homo sapiens
aatgagtcaatcagccttt

SEQ ID NO: 1088563 - DNA, 20 bp, Homo sapiens
aatgagtcaatcagccttta

SEQ ID NO: 1088564 - DNA, 20 bp, Homo sapiens
aatgagtcaggcaattgatt

SEQ ID NO: 1088565 - DNA, 16 bp, Homo sapiens
aatgagtcatttgttt

SEQ ID NO: 1088566 - DNA, 19 bp, Homo sapiens
aatgagtcatttgtttaaa

SEQ ID NO: 1088567 - DNA, 13 bp, Homo sapiens
aatgagtgtgcat

SEQ ID NO: 1088568 - DNA, 23 bp, Homo sapiens
aatgataaaataaataattttaa

SEQ ID NO: 1088569 - DNA, 15 bp, Homo sapiens
aatgataaactctct

SEQ ID NO: 1088570 - DNA, 14 bp, Homo sapiens
aatgataaagactt

SEQ ID NO: 1088571 - DNA, 17 bp, Homo sapiens
aatgatacccaacagtt

SEQ ID NO: 1088572 - DNA, 18 bp, Homo sapiens
aatgataccctgaatttg

SEQ ID NO: 1088573 - DNA, 22 bp, Homo sapiens
aatgatactgtgtgttttccca

SEQ ID NO: 1088574 - DNA, 13 bp, Homo sapiens
aatgatagaactt

SEQ ID NO: 1088575 - DNA, 15 bp, Homo sapiens
aatgatagaactttg

SEQ ID NO: 1088576 - DNA, 21 bp, Homo sapiens
aatgatagacaattgaggtaa

SEQ ID NO: 1088577 - DNA, 18 bp, Homo sapiens
aatgatatgcttgtaact

SEQ ID NO: 1088578 - DNA, 19 bp, Homo sapiens
aatgatatgcttgtaacta

SEQ ID NO: 1088579 - DNA, 22 bp, Homo sapiens
aatgatattgctgaagaatcta

SEQ ID NO: 1088580 - DNA, 17 bp, Homo sapiens
aatgatcacatctaaag

SEQ ID NO: 1088581 - DNA, 16 bp, Homo sapiens
aatgatcataagtcta

SEQ ID NO: 1088582 - DNA, 11 bp, Homo sapiens
aatgatcctgc

SEQ ID NO: 1088583 - DNA, 13 bp, Homo sapiens
aatgatcctgcca

SEQ ID NO: 1088584 - DNA, 17 bp, Homo sapiens
aatgatcgaaaaaataa

SEQ ID NO: 1088585 - DNA, 21 bp, Homo sapiens
aatgatcgaaaaaataattat

SEQ ID NO: 1088586 - DNA, 21 bp, Homo sapiens
aatgatctcggatgaccaaac

SEQ ID NO: 1088587 - DNA, 23 bp, Homo sapiens
aatgatctcggatgaccaaacca

SEQ ID NO: 1088588 - DNA, 13 bp, Homo sapiens
aatgatgatcttc

SEQ ID NO: 1088589 - DNA, 21 bp, Homo sapiens
aatgatgatgtggaagaactt

SEQ ID NO: 1088590 - DNA, 15 bp, Homo sapiens
aatgatgattatgga

SEQ ID NO: 1088591 - DNA, 15 bp, Homo sapiens
aatgatgcagctgtt

SEQ ID NO: 1088592 - DNA, 22 bp, Homo sapiens
aatgatggatcaccattatatt

SEQ ID NO: 1088593 - DNA, 14 bp, Homo sapiens
aatgatggcaattt

SEQ ID NO: 1088594 - DNA, 17 bp, Homo sapiens
aatgatggcaattttgt

SEQ ID NO: 1088595 - DNA, 12 bp, Homo sapiens
aatgatggtaaa

SEQ ID NO: 1088596 - DNA, 21 bp, Homo sapiens
aatgatggtgttaaagctgta

SEQ ID NO: 1088597 - DNA, 14 bp, Homo sapiens
aatgatgttgataa

SEQ ID NO: 1088598 - DNA, 16 bp, Homo sapiens
aatgatgttgataatt

SEQ ID NO: 1088599 - DNA, 20 bp, Homo sapiens
aatgatgttgataatttcag

SEQ ID NO: 1088600 - DNA, 15 bp, Homo sapiens
aatgattaatcaaag

SEQ ID NO: 1088601 - DNA, 16 bp, Homo sapiens
aatgattaatcaaagg

SEQ ID NO: 1088602 - DNA, 17 bp, Homo sapiens
aatgattaatcaaaggc

SEQ ID NO: 1088603 - DNA, 13 bp, Homo sapiens
aatgattagaagt

SEQ ID NO: 1088604 - DNA, 18 bp, Homo sapiens
aatgattcaaatgtttta

SEQ ID NO: 1088605 - DNA, 21 bp, Homo sapiens
aatgattcaaattgctgcttg

SEQ ID NO: 1088606 - DNA, 21 bp, Homo sapiens
aatgattcagtgttaaatgtg

SEQ ID NO: 1088607 - DNA, 15 bp, Homo sapiens
aatgattcatgttat

SEQ ID NO: 1088608 - DNA, 16 bp, Homo sapiens
aatgattcatgttata

SEQ ID NO: 1088609 - DNA, 11 bp, Homo sapiens
aatgattccaa

SEQ ID NO: 1088610 - DNA, 14 bp, Homo sapiens
aatgattccaaata

SEQ ID NO: 1088611 - DNA, 13 bp, Homo sapiens
aatgattgtaaaa

SEQ ID NO: 1088612 - DNA, 20 bp, Homo sapiens
aatgattgtaaaatagcttg

SEQ ID NO: 1088613 - DNA, 13 bp, Homo sapiens
aatgatttgtaaa

SEQ ID NO: 1088614 - DNA, 20 bp, Homo sapiens
aatgattttatctgtgaatt

SEQ ID NO: 1088615 - DNA, 14 bp, Homo sapiens
aatgatttttagat

SEQ ID NO: 1088616 - DNA, 15 bp, Homo sapiens
aatgatttttcttta

SEQ ID NO: 1088617 - DNA, 17 bp, Homo sapiens
aatgcaaaaactctttg

SEQ ID NO: 1088618 - DNA, 13 bp, Homo sapiens
aatgcaaaaatct

SEQ ID NO: 1088619 - DNA, 22 bp, Homo sapiens
aatgcaaaaggctgattactga

SEQ ID NO: 1088620 - DNA, 14 bp, Homo sapiens
aatgcaaaattgtt

SEQ ID NO: 1088621 - DNA, 13 bp, Homo sapiens
aatgcaaatgaat

SEQ ID NO: 1088622 - DNA, 18 bp, Homo sapiens
aatgcaaatgaatcattg

SEQ ID NO: 1088623 - DNA, 17 bp, Homo sapiens
aatgcaaccagaattgt

SEQ ID NO: 1088624 - DNA, 21 bp, Homo sapiens
aatgcaaccagaattgtcctc

SEQ ID NO: 1088625 - DNA, 14 bp, Homo sapiens
aatgcaataactct

SEQ ID NO: 1088626 - DNA, 16 bp, Homo sapiens
aatgcaataactctgg

SEQ ID NO: 1088627 - DNA, 18 bp, Homo sapiens
aatgcaataactctggga

SEQ ID NO: 1088628 - DNA, 13 bp, Homo sapiens
aatgcaataagaa

SEQ ID NO: 1088629 - DNA, 15 bp, Homo sapiens
aatgcaatcaggatt

SEQ ID NO: 1088630 - DNA, 14 bp, Homo sapiens
aatgcaatttaaaa

SEQ ID NO: 1088631 - DNA, 18 bp, Homo sapiens
aatgcaatttaaaattat

SEQ ID NO: 1088632 - DNA, 17 bp, Homo sapiens
aatgcacaagaatggat

SEQ ID NO: 1088633 - DNA, 17 bp, Homo sapiens
aatgcacactagcctct

SEQ ID NO: 1088634 - DNA, 14 bp, Homo sapiens
aatgcaccaagaaa

SEQ ID NO: 1088635 - DNA, 15 bp, Homo sapiens
aatgcacctaaagaa

SEQ ID NO: 1088636 - DNA, 14 bp, Homo sapiens
aatgcacctcccca

SEQ ID NO: 1088637 - DNA, 16 bp, Homo sapiens
aatgcacctccccaaa

SEQ ID NO: 1088638 - DNA, 19 bp, Homo sapiens
aatgcacgtagctgaggcc

SEQ ID NO: 1088639 - DNA, 14 bp, Homo sapiens
aatgcactgtattg

SEQ ID NO: 1088640 - DNA, 13 bp, Homo sapiens
aatgcagaaatca

SEQ ID NO: 1088641 - DNA, 15 bp, Homo sapiens
aatgcagaaatcacg

SEQ ID NO: 1088642 - DNA, 14 bp, Homo sapiens
aatgcagaggtctc

SEQ ID NO: 1088643 - DNA, 18 bp, Homo sapiens
aatgcagattacactgat

SEQ ID NO: 1088644 - DNA, 18 bp, Homo sapiens
aatgcagattcctgggcc

SEQ ID NO: 1088645 - DNA, 15 bp, Homo sapiens
aatgcagcaggaagg

SEQ ID NO: 1088646 - DNA, 22 bp, Homo sapiens
aatgcagccacgattggagaat

SEQ ID NO: 1088647 - DNA, 23 bp, Homo sapiens
aatgcagccacgattggagaata

SEQ ID NO: 1088648 - DNA, 15 bp, Homo sapiens
aatgcagcccaccag

SEQ ID NO: 1088649 - DNA, 22 bp, Homo sapiens
aatgcagcccaccaggagcacc

SEQ ID NO: 1088650 - DNA, 18 bp, Homo sapiens
aatgcagggaagagggca

SEQ ID NO: 1088651 - DNA, 17 bp, Homo sapiens
aatgcagtcctgaggag

SEQ ID NO: 1088652 - DNA, 17 bp, Homo sapiens
aatgcagtgaattgtga

SEQ ID NO: 1088653 - DNA, 16 bp, Homo sapiens
aatgcagttttaagaa

SEQ ID NO: 1088654 - DNA, 14 bp, Homo sapiens
aatgcataaatgca

SEQ ID NO: 1088655 - DNA, 16 bp, Homo sapiens
aatgcatacaataaaa

SEQ ID NO: 1088656 - DNA, 19 bp, Homo sapiens
aatgcatacaataaaagag

SEQ ID NO: 1088657 - DNA, 20 bp, Homo sapiens
aatgcatacaataaaagagc

SEQ ID NO: 1088658 - DNA, 18 bp, Homo sapiens
aatgcatatcctgagcca

SEQ ID NO: 1088659 - DNA, 17 bp, Homo sapiens
aatgcatatttgcaaag

SEQ ID NO: 1088660 - DNA, 22 bp, Homo sapiens
aatgcatcacgtaccccactgg

SEQ ID NO: 1088661 - DNA, 16 bp, Homo sapiens
aatgcatgattttgta

SEQ ID NO: 1088662 - DNA, 19 bp, Homo sapiens
aatgcatgattttgtaacc

SEQ ID NO: 1088663 - DNA, 19 bp, Homo sapiens
aatgcatgcagccactgtg

SEQ ID NO: 1088664 - DNA, 13 bp, Homo sapiens
aatgcatgtctta

SEQ ID NO: 1088665 - DNA, 18 bp, Homo sapiens
aatgcatgtcttaaatgc

SEQ ID NO: 1088666 - DNA, 13 bp, Homo sapiens
aatgcatgtgctg

SEQ ID NO: 1088667 - DNA, 18 bp, Homo sapiens
aatgcatgttaggaaaat

SEQ ID NO: 1088668 - DNA, 14 bp, Homo sapiens
aatgcattaaaaaa

SEQ ID NO: 1088669 - DNA, 15 bp, Homo sapiens
aatgcattaaacctg

SEQ ID NO: 1088670 - DNA, 18 bp, Homo sapiens
aatgcattaataaaaatc

SEQ ID NO: 1088671 - DNA, 15 bp, Homo sapiens
aatgcattcaaaata

SEQ ID NO: 1088672 - DNA, 18 bp, Homo sapiens
aatgcattccagaacaaa

SEQ ID NO: 1088673 - DNA, 14 bp, Homo sapiens
aatgcattcttctc

SEQ ID NO: 1088674 - DNA, 17 bp, Homo sapiens
aatgcattgtcttgtgg

SEQ ID NO: 1088675 - DNA, 11 bp, Homo sapiens
aatgccaaaac

SEQ ID NO: 1088676 - DNA, 23 bp, Homo sapiens
aatgccaacttgtccttttgtac

SEQ ID NO: 1088677 - DNA, 12 bp, Homo sapiens
aatgccactccc

SEQ ID NO: 1088678 - DNA, 13 bp, Homo sapiens
aatgccagggccc

SEQ ID NO: 1088679 - DNA, 13 bp, Homo sapiens
aatgtataaaaat

SEQ ID NO: 1088680 - DNA, 16 bp, Homo sapiens
aatgtataaagattgt

SEQ ID NO: 1088681 - DNA, 18 bp, Homo sapiens
aatgtataaattattcag

SEQ ID NO: 1088682 - DNA, 22 bp, Homo sapiens
aatgtataattaacttaactga

SEQ ID NO: 1088683 - DNA, 19 bp, Homo sapiens
aatgtatactatagtacca

SEQ ID NO: 1088684 - DNA, 14 bp, Homo sapiens
aatgtatataaaaa

SEQ ID NO: 1088685 - DNA, 17 bp, Homo sapiens
aatgtatataaaaatgg

SEQ ID NO: 1088686 - DNA, 16 bp, Homo sapiens
aatgtatataaagtac

SEQ ID NO: 1088687 - DNA, 19 bp, Homo sapiens
aatgtatatagtctttgca

SEQ ID NO: 1088688 - DNA, 13 bp, Homo sapiens
aatgtatatgcac

SEQ ID NO: 1088689 - DNA, 14 bp, Homo sapiens
aatgtatatgcact

SEQ ID NO: 1088690 - DNA, 12 bp, Homo sapiens
aatgtatatttg

SEQ ID NO: 1088691 - DNA, 16 bp, Homo sapiens
aatgtatatttgctgc

SEQ ID NO: 1088692 - DNA, 17 bp, Homo sapiens
aatgtatattttgatga

SEQ ID NO: 1088693 - DNA, 14 bp, Homo sapiens
aatgtatattttgt

SEQ ID NO: 1088694 - DNA, 15 bp, Homo sapiens
aatgtatatttttaa

SEQ ID NO: 1088695 - DNA, 18 bp, Homo sapiens
aatgtatcaaatacattt

SEQ ID NO: 1088696 - DNA, 14 bp, Homo sapiens
aatgtatcaggaaa

SEQ ID NO: 1088697 - DNA, 16 bp, Homo sapiens
aatgtatcatagaaat

SEQ ID NO: 1088698 - DNA, 15 bp, Homo sapiens
aatgtatctatttgt

SEQ ID NO: 1088699 - DNA, 13 bp, Homo sapiens
aatgtatctgtga

SEQ ID NO: 1088700 - DNA, 16 bp, Homo sapiens
aatgtatcttattcac

SEQ ID NO: 1088701 - DNA, 15 bp, Homo sapiens
aatgtatgtaaatag

SEQ ID NO: 1088702 - DNA, 15 bp, Homo sapiens
aatgtatgtacaata

SEQ ID NO: 1088703 - DNA, 12 bp, Homo sapiens
aatgtatgtgta

SEQ ID NO: 1088704 - DNA, 20 bp, Homo sapiens
aatgtatgtgtaagtattct

SEQ ID NO: 1088705 - DNA, 21 bp, Homo sapiens
aatgtatgtgtggctgtgggt

SEQ ID NO: 1088706 - DNA, 19 bp, Homo sapiens
aatgtattaatctgtttgt

SEQ ID NO: 1088707 - DNA, 13 bp, Homo sapiens
aatgtattcaaat

SEQ ID NO: 1088708 - DNA, 16 bp, Homo sapiens
aatgtattctatctct

SEQ ID NO: 1088709 - DNA, 18 bp, Homo sapiens
aatgtattgaacttggaa

SEQ ID NO: 1088710 - DNA, 19 bp, Homo sapiens
aatgtattgaacttggaaa

SEQ ID NO: 1088711 - DNA, 15 bp, Homo sapiens
aatgtatttcctgaa

SEQ ID NO: 1088712 - DNA, 21 bp, Homo sapiens
aatgtattttggttgctgatg

SEQ ID NO: 1088713 - DNA, 18 bp, Homo sapiens
aatgtcaaatcaaggcaa

SEQ ID NO: 1088714 - DNA, 19 bp, Homo sapiens
aatgtcaatagcaaatgaa

SEQ ID NO: 1088715 - DNA, 24 bp, Homo sapiens
aatgtcaatagcaaatgaaggatg

SEQ ID NO: 1088716 - DNA, 18 bp, Homo sapiens
aatgtcacaattatgtgc

SEQ ID NO: 1088717 - DNA, 22 bp, Homo sapiens
aatgtcacaattatgtgcaaag

SEQ ID NO: 1088718 - DNA, 19 bp, Homo sapiens
aatgtcacagtaatgcaag

SEQ ID NO: 1088719 - DNA, 15 bp, Homo sapiens
aatgtcaccaccttc

SEQ ID NO: 1088720 - DNA, 23 bp, Homo sapiens
aatgtcaccaccttcccagctct

SEQ ID NO: 1088721 - DNA, 15 bp, Homo sapiens
aatgtcactgccaac

SEQ ID NO: 1088722 - DNA, 22 bp, Homo sapiens
aatgtcagagctatgttccctc

SEQ ID NO: 1088723 - DNA, 19 bp, Homo sapiens
aatgtcagatgcgtgccca

SEQ ID NO: 1088724 - DNA, 17 bp, Homo sapiens
aatgtcagcctttgtta

SEQ ID NO: 1088725 - DNA, 12 bp, Homo sapiens
aatgtcagtgtt

SEQ ID NO: 1088726 - DNA, 18 bp, Homo sapiens
aatgtcatatactgccat

SEQ ID NO: 1088727 - DNA, 19 bp, Homo sapiens
aatgtcatatactgccatg

SEQ ID NO: 1088728 - DNA, 12 bp, Homo sapiens
aatgtcattaca

SEQ ID NO: 1088729 - DNA, 22 bp, Homo sapiens
aatgtcattacatagaacactt

SEQ ID NO: 1088730 - DNA, 17 bp, Homo sapiens
aatgtcattgctaaaaa

SEQ ID NO: 1088731 - DNA, 14 bp, Homo sapiens
aatgtcattttggt

SEQ ID NO: 1088732 - DNA, 22 bp, Homo sapiens
aatgtcctgtggtgacaggccc

SEQ ID NO: 1088733 - DNA, 21 bp, Homo sapiens
aatgtcgatcaagagaatcaa

SEQ ID NO: 1088734 - DNA, 22 bp, Homo sapiens
aatgtctagttgtaacaccatg

SEQ ID NO: 1088735 - DNA, 14 bp, Homo sapiens
aatgtctattaagg

SEQ ID NO: 1088736 - DNA, 16 bp, Homo sapiens
aatgtctcactgttct

SEQ ID NO: 1088737 - DNA, 18 bp, Homo sapiens
aatgtctcactgttctgc

SEQ ID NO: 1088738 - DNA, 17 bp, Homo sapiens
aatgtctcatgtcaatg

SEQ ID NO: 1088739 - DNA, 12 bp, Homo sapiens
aatgtctcccac

SEQ ID NO: 1088740 - DNA, 17 bp, Homo sapiens
aatgtctgacacattaa

SEQ ID NO: 1088741 - DNA, 18 bp, Homo sapiens
aatgtctgacacattaat

SEQ ID NO: 1088742 - DNA, 20 bp, Homo sapiens
aatgtctgctggtatttcta

SEQ ID NO: 1088743 - DNA, 16 bp, Homo sapiens
aatgtctgtaataata

SEQ ID NO: 1088744 - DNA, 18 bp, Homo sapiens
aatgtctgtaataataga

SEQ ID NO: 1088745 - DNA, 23 bp, Homo sapiens
aatgtctgtagctcctcaactca

SEQ ID NO: 1088746 - DNA, 12 bp, Homo sapiens
aatgtctgtgaa

SEQ ID NO: 1088747 - DNA, 12 bp, Homo sapiens
aatgtctgtgct

SEQ ID NO: 1088748 - DNA, 18 bp, Homo sapiens
aatgtcttaaataaaact

SEQ ID NO: 1088749 - DNA, 23 bp, Homo sapiens
aatgtcttgctgttgacatattt

SEQ ID NO: 1088750 - DNA, 11 bp, Homo sapiens
aatgtcttgtg

SEQ ID NO: 1088751 - DNA, 14 bp, Homo sapiens
aatgtgaaaaagga

SEQ ID NO: 1088752 - DNA, 15 bp, Homo sapiens
aatgtgaaaaaggaa

SEQ ID NO: 1088753 - DNA, 18 bp, Homo sapiens
aatgtgaaaaatctgctg

SEQ ID NO: 1088754 - DNA, 15 bp, Homo sapiens
aatgtgaaaagaaaa

SEQ ID NO: 1088755 - DNA, 16 bp, Homo sapiens
aatgtgaaatctcaga

SEQ ID NO: 1088756 - DNA, 15 bp, Homo sapiens
aatgtgaaatgcttt

SEQ ID NO: 1088757 - DNA, 17 bp, Homo sapiens
aatgtgaacgtccttcc

SEQ ID NO: 1088758 - DNA, 20 bp, Homo sapiens
aatgtgaactttattaaata

SEQ ID NO: 1088759 - DNA, 19 bp, Homo sapiens
aatgtgaatcgcagctgtg

SEQ ID NO: 1088760 - DNA, 15 bp, Homo sapiens
aatgtgaatttttat

SEQ ID NO: 1088761 - DNA, 17 bp, Homo sapiens
aatgtgaccaggggtga

SEQ ID NO: 1088762 - DNA, 15 bp, Homo sapiens
aatgtgaccctccaa

SEQ ID NO: 1088763 - DNA, 19 bp, Homo sapiens
aatgtgaccctccaaatgg

SEQ ID NO: 1088764 - DNA, 19 bp, Homo sapiens
aatgtgacctttaattcag

SEQ ID NO: 1088765 - DNA, 15 bp, Homo sapiens
aatgtgagaagccag

SEQ ID NO: 1088766 - DNA, 21 bp, Homo sapiens
aatgtgagaagccagccagag

SEQ ID NO: 1088767 - DNA, 21 bp, Homo sapiens
aatgtgataatatattgctaa

SEQ ID NO: 1088768 - DNA, 18 bp, Homo sapiens
aatgtgatcaactgttca

SEQ ID NO: 1088769 - DNA, 20 bp, Homo sapiens
aatgtgatcaactgttcagg

SEQ ID NO: 1088770 - DNA, 17 bp, Homo sapiens
aatgtgattactgctct

SEQ ID NO: 1088771 - DNA, 14 bp, Homo sapiens
aatgtgattctaat

SEQ ID NO: 1088772 - DNA, 22 bp, Homo sapiens
aatgtgattctaatgtcttcat

SEQ ID NO: 1088773 - DNA, 15 bp, Homo sapiens
aatgtgcaaattttg

SEQ ID NO: 1088774 - DNA, 19 bp, Homo sapiens
aatgtgcaggtttgttaca

SEQ ID NO: 1088775 - DNA, 20 bp, Homo sapiens
aatgtgcaggtttgttacat

SEQ ID NO: 1088776 - DNA, 23 bp, Homo sapiens
aatgtgcattcttttaaaagaca

SEQ ID NO: 1088777 - DNA, 15 bp, Homo sapiens
aatgtgcccctggcc

SEQ ID NO: 1088778 - DNA, 20 bp, Homo sapiens
aatgtgcctaatggagaaga

SEQ ID NO: 1088779 - DNA, 21 bp, Homo sapiens
aatgtgctgaatggttttcaa

SEQ ID NO: 1088780 - DNA, 20 bp, Homo sapiens
aatgtggacgtgcactgaca

SEQ ID NO: 1088781 - DNA, 21 bp, Homo sapiens
aatgtggcccctgaacaagaa

SEQ ID NO: 1088782 - DNA, 17 bp, Homo sapiens
aatgtggcctaaaaatg

SEQ ID NO: 1088783 - DNA, 16 bp, Homo sapiens
aatgtggcttgagaaa

SEQ ID NO: 1088784 - DNA, 13 bp, Homo sapiens
aatgtgtaagaac

SEQ ID NO: 1088785 - DNA, 14 bp, Homo sapiens
aatgtgtacagtga

SEQ ID NO: 1088786 - DNA, 23 bp, Homo sapiens
aatgtgtacagtgaattgtcttt

SEQ ID NO: 1088787 - DNA, 23 bp, Homo sapiens
aatgtgtataaactgctgtcaat

SEQ ID NO: 1088788 - DNA, 12 bp, Homo sapiens
aatgtgtccaag

SEQ ID NO: 1088789 - DNA, 14 bp, Homo sapiens
aatgtgtctgtgtt

SEQ ID NO: 1088790 - DNA, 23 bp, Homo sapiens
aatgtgtctttagatagccctgt

SEQ ID NO: 1088791 - DNA, 15 bp, Homo sapiens
aatgtgtctttctaa

SEQ ID NO: 1088792 - DNA, 13 bp, Homo sapiens
aatgtgtgaaaaa

SEQ ID NO: 1088793 - DNA, 22 bp, Homo sapiens
aatgtgtgaaaaagatgccaat

SEQ ID NO: 1088794 - DNA, 13 bp, Homo sapiens
aatgtgtgcttta

SEQ ID NO: 1088795 - DNA, 18 bp, Homo sapiens
aatgtgtgggatcattgc

SEQ ID NO: 1088796 - DNA, 21 bp, Homo sapiens
aatgtgtgggatcattgcatt

SEQ ID NO: 1088797 - DNA, 21 bp, Homo sapiens
aatgtgtggtggcctcagctg

SEQ ID NO: 1088798 - DNA, 15 bp, Homo sapiens
aatgtgtgtatgtgt

SEQ ID NO: 1088799 - DNA, 23 bp, Homo sapiens
aatgtgttcttttctcctttacc

SEQ ID NO: 1088800 - DNA, 15 bp, Homo sapiens
aatgtgttggaaact

SEQ ID NO: 1088801 - DNA, 21 bp, Homo sapiens
aattattatttatatatgtat

SEQ ID NO: 1088802 - DNA, 22 bp, Homo sapiens
aattattatttatatatgtatt

SEQ ID NO: 1088803 - DNA, 17 bp, Homo sapiens
aattattcagtgaattt

SEQ ID NO: 1088804 - DNA, 17 bp, Homo sapiens
aattattctgattcttt

SEQ ID NO: 1088805 - DNA, 19 bp, Homo sapiens
aattattgacactgaactt

SEQ ID NO: 1088806 - DNA, 18 bp, Homo sapiens
aattattgatgattttgt

SEQ ID NO: 1088807 - DNA, 22 bp, Homo sapiens
aattatttctgtcacagtaaaa

SEQ ID NO: 1088808 - DNA, 14 bp, Homo sapiens
aattatttgtgtaa

SEQ ID NO: 1088809 - DNA, 21 bp, Homo sapiens
aattatttgtgtaatagaaaa

SEQ ID NO: 1088810 - DNA, 17 bp, Homo sapiens
aattattttaaaatatt

SEQ ID NO: 1088811 - DNA, 22 bp, Homo sapiens
aattattttatatcatacagtt

SEQ ID NO: 1088812 - DNA, 16 bp, Homo sapiens
aattattttgaatgtc

SEQ ID NO: 1088813 - DNA, 20 bp, Homo sapiens
aattattttggtacttttat

SEQ ID NO: 1088814 - DNA, 16 bp, Homo sapiens
aattatttttaattta

SEQ ID NO: 1088815 - DNA, 15 bp, Homo sapiens
aattattttttctat

SEQ ID NO: 1088816 - DNA, 14 bp, Homo sapiens
aattcaaaaagtgt

SEQ ID NO: 1088817 - DNA, 16 bp, Homo sapiens
aattcaaaaagtgttt

SEQ ID NO: 1088818 - DNA, 22 bp, Homo sapiens
aattcaaaagtattgaaagcca

SEQ ID NO: 1088819 - DNA, 14 bp, Homo sapiens
aattcaaagctcta

SEQ ID NO: 1088820 - DNA, 18 bp, Homo sapiens
aattcaaagctctattaa

SEQ ID NO: 1088821 - DNA, 22 bp, Homo sapiens
aattcaaagctgtgtgtttgga

SEQ ID NO: 1088822 - DNA, 17 bp, Homo sapiens
aattcaaataaaaatcc

SEQ ID NO: 1088823 - DNA, 14 bp, Homo sapiens
aattcaacaatgtg

SEQ ID NO: 1088824 - DNA, 13 bp, Homo sapiens
aattcaacatcaa

SEQ ID NO: 1088825 - DNA, 16 bp, Homo sapiens
aattcaaggaatttct

SEQ ID NO: 1088826 - DNA, 21 bp, Homo sapiens
aattcaatgccgcaacatata

SEQ ID NO: 1088827 - DNA, 22 bp, Homo sapiens
aattcaatgccgcaacatatag

SEQ ID NO: 1088828 - DNA, 22 bp, Homo sapiens
aattcaatgtgaacactggcac

SEQ ID NO: 1088829 - DNA, 15 bp, Homo sapiens
aattcaattcaaagc

SEQ ID NO: 1088830 - DNA, 14 bp, Homo sapiens
aattcaattgtaaa

SEQ ID NO: 1088831 - DNA, 19 bp, Homo sapiens
aattcaattgtaaattgaa

SEQ ID NO: 1088832 - DNA, 15 bp, Homo sapiens
aattcaattttaaag

SEQ ID NO: 1088833 - DNA, 17 bp, Homo sapiens
aattcaattttaaagac

SEQ ID NO: 1088834 - DNA, 21 bp, Homo sapiens
aattcacatctaacctcatct

SEQ ID NO: 1088835 - DNA, 21 bp, Homo sapiens
aattcacctcagcctggagag

SEQ ID NO: 1088836 - DNA, 13 bp, Homo sapiens
aattcactcccac

SEQ ID NO: 1088837 - DNA, 23 bp, Homo sapiens
aattcactcccacacccaagaag

SEQ ID NO: 1088838 - DNA, 21 bp, Homo sapiens
aattcactttcatttttgata

SEQ ID NO: 1088839 - DNA, 21 bp, Homo sapiens
aattcagaactaaatttttca

SEQ ID NO: 1088840 - DNA, 17 bp, Homo sapiens
aattcagattgtcttgc

SEQ ID NO: 1088841 - DNA, 16 bp, Homo sapiens
aattcagcaaaccatt

SEQ ID NO: 1088842 - DNA, 15 bp, Homo sapiens
aattcagcagtttta

SEQ ID NO: 1088843 - DNA, 22 bp, Homo sapiens
aattcagcctactgcctcggat

SEQ ID NO: 1088844 - DNA, 13 bp, Homo sapiens
aattcagctcagc

SEQ ID NO: 1088845 - DNA, 22 bp, Homo sapiens
aattcagggtggtaaagtatgt

SEQ ID NO: 1088846 - DNA, 15 bp, Homo sapiens
aattcaggtttttcc

SEQ ID NO: 1088847 - DNA, 18 bp, Homo sapiens
aattcagtacaacccata

SEQ ID NO: 1088848 - DNA, 13 bp, Homo sapiens
aattcagtatttt

SEQ ID NO: 1088849 - DNA, 13 bp, Homo sapiens
aattcagtttcat

SEQ ID NO: 1088850 - DNA, 14 bp, Homo sapiens
aattcagtttcata

SEQ ID NO: 1088851 - DNA, 17 bp, Homo sapiens
aattcataatcactcta

SEQ ID NO: 1088852 - DNA, 18 bp, Homo sapiens
aattcatataaaagttgc

SEQ ID NO: 1088853 - DNA, 22 bp, Homo sapiens
aattcatataaaagttgcgttt

SEQ ID NO: 1088854 - DNA, 13 bp, Homo sapiens
aattcatattctg

SEQ ID NO: 1088855 - DNA, 18 bp, Homo sapiens
aattcatcccaactgtct

SEQ ID NO: 1088856 - DNA, 18 bp, Homo sapiens
aattcatgggctgtgtgt

SEQ ID NO: 1088857 - DNA, 18 bp, Homo sapiens
aattcatgtaacagttgt

SEQ ID NO: 1088858 - DNA, 20 bp, Homo sapiens
aattcatgtaacagttgtgt

SEQ ID NO: 1088859 - DNA, 16 bp, Homo sapiens
aattcattcaccagat

SEQ ID NO: 1088860 - DNA, 16 bp, Homo sapiens
aattcattcatactta

SEQ ID NO: 1088861 - DNA, 20 bp, Homo sapiens
aattcattgagcagttagct

SEQ ID NO: 1088862 - DNA, 19 bp, Homo sapiens
aattcatttctagactcaa

SEQ ID NO: 1088863 - DNA, 11 bp, Homo sapiens
aattcatttgg

SEQ ID NO: 1088864 - DNA, 20 bp, Homo sapiens
aattcatttgtattgcttat

SEQ ID NO: 1088865 - DNA, 18 bp, Homo sapiens
aattcattttttaaattc

SEQ ID NO: 1088866 - DNA, 14 bp, Homo sapiens
aattccaaagcaaa

SEQ ID NO: 1088867 - DNA, 15 bp, Homo sapiens
aattccaaagcaaaa

SEQ ID NO: 1088868 - DNA, 15 bp, Homo sapiens
aattccaacttgaag

SEQ ID NO: 1088869 - DNA, 18 bp, Homo sapiens
aattccaacttgaaggat

SEQ ID NO: 1088870 - DNA, 23 bp, Homo sapiens
aattccaaggagttccatgaaga

SEQ ID NO: 1088871 - DNA, 13 bp, Homo sapiens
aattccacagctg

SEQ ID NO: 1088872 - DNA, 14 bp, Homo sapiens
aattccactgaaaa

SEQ ID NO: 1088873 - DNA, 21 bp, Homo sapiens
aattccactgaaaatttaaca

SEQ ID NO: 1088874 - DNA, 20 bp, Homo sapiens
aattccagaaaggatattta

SEQ ID NO: 1088875 - DNA, 18 bp, Homo sapiens
aattccagcaataagaaa

SEQ ID NO: 1088876 - DNA, 23 bp, Homo sapiens
aattccaggtgtgcacagaaaac

SEQ ID NO: 1088877 - DNA, 18 bp, Homo sapiens
aattcccagactctgcct

SEQ ID NO: 1088878 - DNA, 21 bp, Homo sapiens
aattcccattttgcaaaattt

SEQ ID NO: 1088879 - DNA, 22 bp, Homo sapiens
aattcccattttgcaaaatttc

SEQ ID NO: 1088880 - DNA, 16 bp, Homo sapiens
aattccctccccctcc

SEQ ID NO: 1088881 - DNA, 17 bp, Homo sapiens
aattccctccccctcct

SEQ ID NO: 1088882 - DNA, 14 bp, Homo sapiens
aattccctgctgtc

SEQ ID NO: 1088883 - DNA, 22 bp, Homo sapiens
aattcccttcctgttccctcct

SEQ ID NO: 1088884 - DNA, 18 bp, Homo sapiens
aattcccttgaattgtgt

SEQ ID NO: 1088885 - DNA, 15 bp, Homo sapiens
aattcccttttaatc

SEQ ID NO: 1088886 - DNA, 15 bp, Homo sapiens
aattcctaaaattat

SEQ ID NO: 1088887 - DNA, 17 bp, Homo sapiens
aattcctacaacttaat

SEQ ID NO: 1088888 - DNA, 21 bp, Homo sapiens
aattcctatatcctgtgactg

SEQ ID NO: 1088889 - DNA, 10 bp, Homo sapiens
aattcctcct

SEQ ID NO: 1088890 - DNA, 14 bp, Homo sapiens
aattcctctgataa

SEQ ID NO: 1088891 - DNA, 23 bp, Homo sapiens
aattcctgctatgacagctggct

SEQ ID NO: 1088892 - DNA, 21 bp, Homo sapiens
aattcctggcatgacactcta

SEQ ID NO: 1088893 - DNA, 19 bp, Homo sapiens
aattccttcgaaaggcctt

SEQ ID NO: 1088894 - DNA, 19 bp, Homo sapiens
aattccttttctaactctc

SEQ ID NO: 1088895 - DNA, 18 bp, Homo sapiens
aattcgctgcaacctgtt

SEQ ID NO: 1088896 - DNA, 17 bp, Homo sapiens
aattcggtgtgctgcca

SEQ ID NO: 1088897 - DNA, 12 bp, Homo sapiens
aattctaaaatg

SEQ ID NO: 1088898 - DNA, 14 bp, Homo sapiens
aattctaaaatgat

SEQ ID NO: 1088899 - DNA, 20 bp, Homo sapiens
aattctaaatccgacttgaa

SEQ ID NO: 1088900 - DNA, 19 bp, Homo sapiens
aattctaaatgaatgttta

SEQ ID NO: 1088901 - DNA, 14 bp, Homo sapiens
aattctaacccaag

SEQ ID NO: 1088902 - DNA, 17 bp, Homo sapiens
aattctaacccaggtat

SEQ ID NO: 1088903 - DNA, 23 bp, Homo sapiens
aattctaccaaggtcttcttaat

SEQ ID NO: 1088904 - DNA, 17 bp, Homo sapiens
aattctagtgctgctga

SEQ ID NO: 1088905 - DNA, 18 bp, Homo sapiens
aattctagtgctgctgaa

SEQ ID NO: 1088906 - DNA, 23 bp, Homo sapiens
aattctagtgtccataaataaag

SEQ ID NO: 1088907 - DNA, 22 bp, Homo sapiens
aattctatcttttgtttccttt

SEQ ID NO: 1088908 - DNA, 13 bp, Homo sapiens
aattctatgcctg

SEQ ID NO: 1088909 - DNA, 20 bp, Homo sapiens
aattctatgttaaatactgt

SEQ ID NO: 1088910 - DNA, 17 bp, Homo sapiens
aattctcaacctaccac

SEQ ID NO: 1088911 - DNA, 22 bp, Homo sapiens
aattctcaagacctgagtattt

SEQ ID NO: 1088912 - DNA, 16 bp, Homo sapiens
aattctccaggatttt

SEQ ID NO: 1088913 - DNA, 15 bp, Homo sapiens
aattctcctggaggt

SEQ ID NO: 1088914 - DNA, 14 bp, Homo sapiens
aattctctgttcct

SEQ ID NO: 1088915 - DNA, 21 bp, Homo sapiens
aattctgagaaaacttctttt

SEQ ID NO: 1088916 - DNA, 21 bp, Homo sapiens
aattctgcaactagccaaggc

SEQ ID NO: 1088917 - DNA, 20 bp, Homo sapiens
aattctgcaatgttttcctt

SEQ ID NO: 1088918 - DNA, 13 bp, Homo sapiens
aattctgcatgta

SEQ ID NO: 1088919 - DNA, 13 bp, Homo sapiens
aattctgccccca

SEQ ID NO: 1088920 - DNA, 12 bp, Homo sapiens
aattctgcctgc

SEQ ID NO: 1088921 - DNA, 15 bp, Homo sapiens
aattctgctacctca

SEQ ID NO: 1088922 - DNA, 12 bp, Homo sapiens
aattctggaagc

SEQ ID NO: 1088923 - DNA, 12 bp, Homo sapiens
aattctgggtgc

SEQ ID NO: 1088924 - DNA, 15 bp, Homo sapiens
aattctgtaattaca

SEQ ID NO: 1088925 - DNA, 16 bp, Homo sapiens
aattctgtccctgtcc

SEQ ID NO: 1088926 - DNA, 23 bp, Homo sapiens
aattctgtccctgtccctgcccc

SEQ ID NO: 1088927 - DNA, 13 bp, Homo sapiens
aattctgtttctt

SEQ ID NO: 1088928 - DNA, 10 bp, Homo sapiens
aattcttatg

SEQ ID NO: 1088929 - DNA, 19 bp, Homo sapiens
aattcttattttttaaaaa

SEQ ID NO: 1088930 - DNA, 23 bp, Homo sapiens
aattcttcacctgttatgtatga

SEQ ID NO: 1088931 - DNA, 17 bp, Homo sapiens
aattcttcacctttgta

SEQ ID NO: 1088932 - DNA, 16 bp, Homo sapiens
aattcttcctctcctt

SEQ ID NO: 1088933 - DNA, 13 bp, Homo sapiens
aattcttctgaac

SEQ ID NO: 1088934 - DNA, 18 bp, Homo sapiens
aattcttctgaactcaaa

SEQ ID NO: 1088935 - DNA, 18 bp, Homo sapiens
aattcttggttgaggaaa

SEQ ID NO: 1088936 - DNA, 20 bp, Homo sapiens
aattcttggttgaggaaaca

SEQ ID NO: 1088937 - DNA, 18 bp, Homo sapiens
aattcttgtaatttttat

SEQ ID NO: 1088938 - DNA, 22 bp, Homo sapiens
aattctttcacttgatgtttgt

SEQ ID NO: 1088939 - DNA, 14 bp, Homo sapiens
aattctttgttctg

SEQ ID NO: 1088940 - DNA, 17 bp, Homo sapiens
aattctttgttctgttt

SEQ ID NO: 1088941 - DNA, 16 bp, Homo sapiens
aattcttttataaata

SEQ ID NO: 1088942 - DNA, 15 bp, Homo sapiens
aattcttttctgagg

SEQ ID NO: 1088943 - DNA, 17 bp, Homo sapiens
aattcttttgaattgtt

SEQ ID NO: 1088944 - DNA, 14 bp, Homo sapiens
aattgaaaagtaca

SEQ ID NO: 1088945 - DNA, 18 bp, Homo sapiens
aattgaaactctctgttc

SEQ ID NO: 1088946 - DNA, 21 bp, Homo sapiens
aattgaaaggcattctctgaa

SEQ ID NO: 1088947 - DNA, 13 bp, Homo sapiens
aattgaaagtatt

SEQ ID NO: 1088948 - DNA, 14 bp, Homo sapiens
aattgaaagtattc

SEQ ID NO: 1088949 - DNA, 18 bp, Homo sapiens
aattgaaagtattcagaa

SEQ ID NO: 1088950 - DNA, 19 bp, Homo sapiens
aattgaaagtattcagaaa

SEQ ID NO: 1088951 - DNA, 20 bp, Homo sapiens
aattgaaagtattcagaaat

SEQ ID NO: 1088952 - DNA, 21 bp, Homo sapiens
aattgaacgactgtatattgc

SEQ ID NO: 1088953 - DNA, 14 bp, Homo sapiens
aattgaatattatt

SEQ ID NO: 1088954 - DNA, 15 bp, Homo sapiens
aattgaatattattc

SEQ ID NO: 1088955 - DNA, 18 bp, Homo sapiens
aattgacagatcaagctg

SEQ ID NO: 1088956 - DNA, 21 bp, Homo sapiens
aattgacagatcaagctgtga

SEQ ID NO: 1088957 - DNA, 22 bp, Homo sapiens
aattgacaggggaacttggttt

SEQ ID NO: 1088958 - DNA, 17 bp, Homo sapiens
aattgacattgaaatct

SEQ ID NO: 1088959 - DNA, 17 bp, Homo sapiens
aattgaccatctgcttt

SEQ ID NO: 1088960 - DNA, 21 bp, Homo sapiens
aattgaccctagccagagaat

SEQ ID NO: 1088961 - DNA, 14 bp, Homo sapiens
aattgactgtcact

SEQ ID NO: 1088962 - DNA, 17 bp, Homo sapiens
aattgacttagatatta

SEQ ID NO: 1088963 - DNA, 21 bp, Homo sapiens
aattgacttatttatataaat

SEQ ID NO: 1088964 - DNA, 18 bp, Homo sapiens
aattgacttcgactgtga

SEQ ID NO: 1088965 - DNA, 23 bp, Homo sapiens
aattgagaaaaatatatactaaa

SEQ ID NO: 1088966 - DNA, 18 bp, Homo sapiens
aattgagaataagaattt

SEQ ID NO: 1088967 - DNA, 15 bp, Homo sapiens
aattgagattagagg

SEQ ID NO: 1088968 - DNA, 19 bp, Homo sapiens
aattgaggtctgctcggcc

SEQ ID NO: 1088969 - DNA, 16 bp, Homo sapiens
aattgagtaatggtgt

SEQ ID NO: 1088970 - DNA, 21 bp, Homo sapiens
aattgagtaatggtgtagaac

SEQ ID NO: 1088971 - DNA, 21 bp, Homo sapiens
aattgagtctcttttttattc

SEQ ID NO: 1088972 - DNA, 22 bp, Homo sapiens
aattgagtctcttttttattct

SEQ ID NO: 1088973 - DNA, 19 bp, Homo sapiens
aattgatccttaaccaata

SEQ ID NO: 1088974 - DNA, 13 bp, Homo sapiens
aattgatcttttt

SEQ ID NO: 1088975 - DNA, 20 bp, Homo sapiens
aattgatgtatatgtttata

SEQ ID NO: 1088976 - DNA, 21 bp, Homo sapiens
aattgatgtcggtcatagttt

SEQ ID NO: 1088977 - DNA, 13 bp, Homo sapiens
aattgatgtttta

SEQ ID NO: 1088978 - DNA, 21 bp, Homo sapiens
aattgatgttttacgtgcaaa

SEQ ID NO: 1088979 - DNA, 23 bp, Homo sapiens
aattgatgttttacgtgcaaaca

SEQ ID NO: 1088980 - DNA, 14 bp, Homo sapiens
aattgattaaaatc

SEQ ID NO: 1088981 - DNA, 17 bp, Homo sapiens
aattgattaaaatctct

SEQ ID NO: 1088982 - DNA, 14 bp, Homo sapiens
aattgattattctg

SEQ ID NO: 1088983 - DNA, 23 bp, Homo sapiens
aattgattattctgattccactt

SEQ ID NO: 1088984 - DNA, 15 bp, Homo sapiens
aattgattgtcagcc

SEQ ID NO: 1088985 - DNA, 14 bp, Homo sapiens
aattgatttataaa

SEQ ID NO: 1088986 - DNA, 19 bp, Homo sapiens
aattgatttataaataaca

SEQ ID NO: 1088987 - DNA, 22 bp, Homo sapiens
aattgatttataaataacaaaa

SEQ ID NO: 1088988 - DNA, 15 bp, Homo sapiens
aattgatttcaagac

SEQ ID NO: 1088989 - DNA, 20 bp, Homo sapiens
aattgatttgcattgaacac

SEQ ID NO: 1088990 - DNA, 22 bp, Homo sapiens
aattgatttgcattgaacacaa

SEQ ID NO: 1088991 - DNA, 20 bp, Homo sapiens
aattgcacagagcacactta

SEQ ID NO: 1088992 - DNA, 15 bp, Homo sapiens
aattgcactgctgtt

SEQ ID NO: 1088993 - DNA, 17 bp, Homo sapiens
aattgcagaattcaaaa

SEQ ID NO: 1088994 - DNA, 23 bp, Homo sapiens
aattgcagcagacccagcagcag

SEQ ID NO: 1088995 - DNA, 13 bp, Homo sapiens
aattgccagcaaa

SEQ ID NO: 1088996 - DNA, 15 bp, Homo sapiens
aattgccagcaaata

SEQ ID NO: 1088997 - DNA, 17 bp, Homo sapiens
aattgccctatgctgtg

SEQ ID NO: 1088998 - DNA, 20 bp, Homo sapiens
aattgcctacaataaaaaga

SEQ ID NO: 1088999 - DNA, 23 bp, Homo sapiens
aattgcctagaaatatctttctc

SEQ ID NO: 1089000 - DNA, 20 bp, Homo sapiens
aattgcctataatacttgca

SEQ ID NO: 1089001 - DNA, 22 bp, Homo sapiens
aattgcctataatacttgcaac

SEQ ID NO: 1089002 - DNA, 15 bp, Homo sapiens
aattgcctgatttgt

SEQ ID NO: 1089003 - DNA, 13 bp, Homo sapiens
aattgcctttgag

SEQ ID NO: 1089004 - DNA, 20 bp, Homo sapiens
aattgctaatacccagttac

SEQ ID NO: 1089005 - DNA, 16 bp, Homo sapiens
aattgctacatctaaa

SEQ ID NO: 1089006 - DNA, 13 bp, Homo sapiens
aattgctatgtta

SEQ ID NO: 1089007 - DNA, 20 bp, Homo sapiens
aattgctatgttactatttt

SEQ ID NO: 1089008 - DNA, 23 bp, Homo sapiens
aattgctcctgcatgcaactaat

SEQ ID NO: 1089009 - DNA, 12 bp, Homo sapiens
aattgctgtgcc

SEQ ID NO: 1089010 - DNA, 22 bp, Homo sapiens
aattgctgtgcctcccaaaatt

SEQ ID NO: 1089011 - DNA, 17 bp, Homo sapiens
aattgcttaaaagacat

SEQ ID NO: 1089012 - DNA, 21 bp, Homo sapiens
aattgcttactgatattatct

SEQ ID NO: 1089013 - DNA, 14 bp, Homo sapiens
aattgcttgagcct

SEQ ID NO: 1089014 - DNA, 11 bp, Homo sapiens
aattgctttga

SEQ ID NO: 1089015 - DNA, 13 bp, Homo sapiens
aattggaatcttc

SEQ ID NO: 1089016 - DNA, 17 bp, Homo sapiens
aattggagaagatttat

SEQ ID NO: 1089017 - DNA, 15 bp, Homo sapiens
aattgggagtccagg

SEQ ID NO: 1089018 - DNA, 16 bp, Homo sapiens
aattgggccagctttt

SEQ ID NO: 1089019 - DNA, 13 bp, Homo sapiens
aattggggaggga

SEQ ID NO: 1089020 - DNA, 15 bp, Homo sapiens
aattggggagggaga

SEQ ID NO: 1089021 - DNA, 18 bp, Homo sapiens
aattgggtcatagaaatt

SEQ ID NO: 1089022 - DNA, 16 bp, Homo sapiens
aattggtcatggtaga

SEQ ID NO: 1089023 - DNA, 20 bp, Homo sapiens
aattggtcatggtagatttt

SEQ ID NO: 1089024 - DNA, 18 bp, Homo sapiens
aattggtgctatttgaag

SEQ ID NO: 1089025 - DNA, 21 bp, Homo sapiens
aattggtgctatttgaagaaa

SEQ ID NO: 1089026 - DNA, 19 bp, Homo sapiens
aattgtaaatattttgata

SEQ ID NO: 1089027 - DNA, 13 bp, Homo sapiens
aattgtaaatttt

SEQ ID NO: 1089028 - DNA, 13 bp, Homo sapiens
aattgtaacctgc

SEQ ID NO: 1089029 - DNA, 19 bp, Homo sapiens
aattgtaagtgaaattaag

SEQ ID NO: 1089030 - DNA, 14 bp, Homo sapiens
aattgtacatattt

SEQ ID NO: 1089031 - DNA, 18 bp, Homo sapiens
aattgtactaatctgaga

SEQ ID NO: 1089032 - DNA, 14 bp, Homo sapiens
aattgtagggcttt

SEQ ID NO: 1089033 - DNA, 17 bp, Homo sapiens
aattgtagttctgtgta

SEQ ID NO: 1089034 - DNA, 11 bp, Homo sapiens
aattgtataag

SEQ ID NO: 1089035 - DNA, 12 bp, Homo sapiens
aattgtataagt

SEQ ID NO: 1089036 - DNA, 14 bp, Homo sapiens
aattgtataagtca

SEQ ID NO: 1089037 - DNA, 19 bp, Homo sapiens
aattgtataagtcaagcac

SEQ ID NO: 1089038 - DNA, 13 bp, Homo sapiens
aattgtatacatt

SEQ ID NO: 1089039 - DNA, 14 bp, Homo sapiens
aattgtatattgta

SEQ ID NO: 1089040 - DNA, 13 bp, Homo sapiens
aattgtatctagt

SEQ ID NO: 1089041 - DNA, 23 bp, Homo sapiens
aattgtatctagtgcagctgatt

SEQ ID NO: 1089042 - DNA, 19 bp, Homo sapiens
aattgtatcttattataaa

SEQ ID NO: 1089043 - DNA, 13 bp, Homo sapiens
aattgtattttat

SEQ ID NO: 1089044 - DNA, 12 bp, Homo sapiens
aattttaaaaaa

SEQ ID NO: 1089045 - DNA, 15 bp, Homo sapiens
aattttaaaacattt

SEQ ID NO: 1089046 - DNA, 12 bp, Homo sapiens
aattttaaagta

SEQ ID NO: 1089047 - DNA, 16 bp, Homo sapiens
aattttaaagtatgca

SEQ ID NO: 1089048 - DNA, 22 bp, Homo sapiens
aattttaaataacctctggccc

SEQ ID NO: 1089049 - DNA, 22 bp, Homo sapiens
aattttaacaaacgcattaaga

SEQ ID NO: 1089050 - DNA, 23 bp, Homo sapiens
aattttaacaaacgcattaagag

SEQ ID NO: 1089051 - DNA, 22 bp, Homo sapiens
aattttaacttttaaggttgaa

SEQ ID NO: 1089052 - DNA, 15 bp, Homo sapiens
aattttaatcccctg

SEQ ID NO: 1089053 - DNA, 19 bp, Homo sapiens
aattttaatgctgtttcta

SEQ ID NO: 1089054 - DNA, 14 bp, Homo sapiens
aattttaatgtgaa

SEQ ID NO: 1089055 - DNA, 16 bp, Homo sapiens
aattttaatgtgaaga

SEQ ID NO: 1089056 - DNA, 16 bp, Homo sapiens
aattttacaatttata

SEQ ID NO: 1089057 - DNA, 17 bp, Homo sapiens
aattttagaaatattca

SEQ ID NO: 1089058 - DNA, 18 bp, Homo sapiens
aattttagtaatttccta

SEQ ID NO: 1089059 - DNA, 19 bp, Homo sapiens
aattttagtaatttcctag

SEQ ID NO: 1089060 - DNA, 19 bp, Homo sapiens
aattttagtagagacaggg

SEQ ID NO: 1089061 - DNA, 15 bp, Homo sapiens
aattttagtgtatta

SEQ ID NO: 1089062 - DNA, 21 bp, Homo sapiens
aattttagtgtgccttccaaa

SEQ ID NO: 1089063 - DNA, 15 bp, Homo sapiens
aattttataatctgc

SEQ ID NO: 1089064 - DNA, 20 bp, Homo sapiens
aattttatccctcacctgta

SEQ ID NO: 1089065 - DNA, 21 bp, Homo sapiens
aattttattaaacaattttgt

SEQ ID NO: 1089066 - DNA, 17 bp, Homo sapiens
aattttatttataaact

SEQ ID NO: 1089067 - DNA, 22 bp, Homo sapiens
aattttatttgttctttttctg

SEQ ID NO: 1089068 - DNA, 20 bp, Homo sapiens
aattttattttgtgctcatt

SEQ ID NO: 1089069 - DNA, 17 bp, Homo sapiens
aattttatttttctgtg

SEQ ID NO: 1089070 - DNA, 14 bp, Homo sapiens
aattttcaaggcct

SEQ ID NO: 1089071 - DNA, 17 bp, Homo sapiens
aattttcaaggccttca

SEQ ID NO: 1089072 - DNA, 21 bp, Homo sapiens
aattttcaaggccttcagttt

SEQ ID NO: 1089073 - DNA, 14 bp, Homo sapiens
aattttcaagttta

SEQ ID NO: 1089074 - DNA, 15 bp, Homo sapiens
aattttcaagtttac

SEQ ID NO: 1089075 - DNA, 17 bp, Homo sapiens
aattttcagaccccagc

SEQ ID NO: 1089076 - DNA, 12 bp, Homo sapiens
aattttcagcat

SEQ ID NO: 1089077 - DNA, 20 bp, Homo sapiens
aattttcagtataatttaac

SEQ ID NO: 1089078 - DNA, 15 bp, Homo sapiens
aattttcatattaaa

SEQ ID NO: 1089079 - DNA, 19 bp, Homo sapiens
aattttcattttgcactga

SEQ ID NO: 1089080 - DNA, 18 bp, Homo sapiens
aattttccaagtaaagtg

SEQ ID NO: 1089081 - DNA, 14 bp, Homo sapiens
aattttctaagaca

SEQ ID NO: 1089082 - DNA, 20 bp, Homo sapiens
aattttctagactttctgtt

SEQ ID NO: 1089083 - DNA, 23 bp, Homo sapiens
aattttctccttggtttgctagt

SEQ ID NO: 1089084 - DNA, 22 bp, Homo sapiens
aattttcttcatgcaatgacat

SEQ ID NO: 1089085 - DNA, 14 bp, Homo sapiens
aattttgaagtgct

SEQ ID NO: 1089086 - DNA, 17 bp, Homo sapiens
aattttgacttaatgtg

SEQ ID NO: 1089087 - DNA, 13 bp, Homo sapiens
aattttgagaaaa

SEQ ID NO: 1089088 - DNA, 19 bp, Homo sapiens
aattttgagaaaaatagag

SEQ ID NO: 1089089 - DNA, 13 bp, Homo sapiens
aattttgatatac

SEQ ID NO: 1089090 - DNA, 20 bp, Homo sapiens
aattttgatatacattgtgt

SEQ ID NO: 1089091 - DNA, 22 bp, Homo sapiens
aattttgatatacattgtgtga

SEQ ID NO: 1089092 - DNA, 19 bp, Homo sapiens
aattttgcatactgaaaat

SEQ ID NO: 1089093 - DNA, 16 bp, Homo sapiens
aattttgcttttaatt

SEQ ID NO: 1089094 - DNA, 17 bp, Homo sapiens
aattttgcttttaatta

SEQ ID NO: 1089095 - DNA, 13 bp, Homo sapiens
aattttggaataa

SEQ ID NO: 1089096 - DNA, 18 bp, Homo sapiens
aattttggaatatttgct

SEQ ID NO: 1089097 - DNA, 12 bp, Homo sapiens
aattttggattt

SEQ ID NO: 1089098 - DNA, 12 bp, Homo sapiens
aattttgtaaga

SEQ ID NO: 1089099 - DNA, 22 bp, Homo sapiens
aattttgtacatactgtatttt

SEQ ID NO: 1089100 - DNA, 13 bp, Homo sapiens
aattttgtatatt

SEQ ID NO: 1089101 - DNA, 18 bp, Homo sapiens
aattttgtggttttcgag

SEQ ID NO: 1089102 - DNA, 14 bp, Homo sapiens
aattttgtgtaaga

SEQ ID NO: 1089103 - DNA, 20 bp, Homo sapiens
aattttgttctagttttcag

SEQ ID NO: 1089104 - DNA, 21 bp, Homo sapiens
aattttgttctctgggagaaa

SEQ ID NO: 1089105 - DNA, 19 bp, Homo sapiens
aattttgttttctttttct

SEQ ID NO: 1089106 - DNA, 21 bp, Homo sapiens
aattttgtttttattttcaag

SEQ ID NO: 1089107 - DNA, 12 bp, Homo sapiens
aatttttaaaaa

SEQ ID NO: 1089108 - DNA, 15 bp, Homo sapiens
aatttttaaacaagt

SEQ ID NO: 1089109 - DNA, 13 bp, Homo sapiens
aatttttaaagta

SEQ ID NO: 1089110 - DNA, 20 bp, Homo sapiens
aatttttaaatgtaaaacat

SEQ ID NO: 1089111 - DNA, 11 bp, Homo sapiens
aatttttaagc

SEQ ID NO: 1089112 - DNA, 11 bp, Homo sapiens
aatttttaata

SEQ ID NO: 1089113 - DNA, 14 bp, Homo sapiens
aatttttaatgatg

SEQ ID NO: 1089114 - DNA, 20 bp, Homo sapiens
aatttttacattcatcaata

SEQ ID NO: 1089115 - DNA, 16 bp, Homo sapiens
aatttttacatttgtt

SEQ ID NO: 1089116 - DNA, 17 bp, Homo sapiens
aatttttacctttatct

SEQ ID NO: 1089117 - DNA, 19 bp, Homo sapiens
aatttttataaattactat

SEQ ID NO: 1089118 - DNA, 17 bp, Homo sapiens
aatttttattaaattat

SEQ ID NO: 1089119 - DNA, 14 bp, Homo sapiens
aatttttatttctt

SEQ ID NO: 1089120 - DNA, 15 bp, Homo sapiens
aatttttatttcttc

SEQ ID NO: 1089121 - DNA, 15 bp, Homo sapiens
aatttttatttttct

SEQ ID NO: 1089122 - DNA, 15 bp, Homo sapiens
aatttttcagatgct

SEQ ID NO: 1089123 - DNA, 13 bp, Homo sapiens
aatttttcctgca

SEQ ID NO: 1089124 - DNA, 17 bp, Homo sapiens
aatttttcctgcatgtt

SEQ ID NO: 1089125 - DNA, 22 bp, Homo sapiens
aatttttctgtacttcagtatg

SEQ ID NO: 1089126 - DNA, 18 bp, Homo sapiens
aatttttcttaagacaga

SEQ ID NO: 1089127 - DNA, 13 bp, Homo sapiens
aatttttcttctt

SEQ ID NO: 1089128 - DNA, 16 bp, Homo sapiens
aatttttcttcttgag

SEQ ID NO: 1089129 - DNA, 13 bp, Homo sapiens
aatttttgaaaaa

SEQ ID NO: 1089130 - DNA, 18 bp, Homo sapiens
aatttttgaaaaatattg

SEQ ID NO: 1089131 - DNA, 20 bp, Homo sapiens
aatttttgaaaaatattgct

SEQ ID NO: 1089132 - DNA, 13 bp, Homo sapiens
aatttttgatact

SEQ ID NO: 1089133 - DNA, 21 bp, Homo sapiens
aatttttgcctatctttaaac

SEQ ID NO: 1089134 - DNA, 19 bp, Homo sapiens
aatttttgcttttagaaaa

SEQ ID NO: 1089135 - DNA, 14 bp, Homo sapiens
aatttttggttgaa

SEQ ID NO: 1089136 - DNA, 21 bp, Homo sapiens
aatttttggtttatgactttg

SEQ ID NO: 1089137 - DNA, 23 bp, Homo sapiens
aatttttggtttatgactttgtc

SEQ ID NO: 1089138 - DNA, 23 bp, Homo sapiens
aatttttgtcattttaaaatctg

SEQ ID NO: 1089139 - DNA, 15 bp, Homo sapiens
aatttttgtctcaga

SEQ ID NO: 1089140 - DNA, 16 bp, Homo sapiens
aatttttgtttggact

SEQ ID NO: 1089141 - DNA, 19 bp, Homo sapiens
aatttttgtttttgagtac

SEQ ID NO: 1089142 - DNA, 21 bp, Homo sapiens
aattttttaagtgaaaatata

SEQ ID NO: 1089143 - DNA, 19 bp, Homo sapiens
aattttttgatgtcagcct

SEQ ID NO: 1089144 - DNA, 20 bp, Homo sapiens
aattttttggcacttgccat

SEQ ID NO: 1089145 - DNA, 16 bp, Homo sapiens
aattttttggtacaaa

SEQ ID NO: 1089146 - DNA, 17 bp, Homo sapiens
aattttttgttgacatt

SEQ ID NO: 1089147 - DNA, 19 bp, Homo sapiens
aatttttttaaatttcagt

SEQ ID NO: 1089148 - DNA, 19 bp, Homo sapiens
aatttttttaatttacaaa

SEQ ID NO: 1089149 - DNA, 18 bp, Homo sapiens
aatttttttatgttttgt

SEQ ID NO: 1089150 - DNA, 23 bp, Homo sapiens
aatttttttatgttttgtttctg

SEQ ID NO: 1089151 - DNA, 15 bp, Homo sapiens
aatttttttgtaata

SEQ ID NO: 1089152 - DNA, 15 bp, Homo sapiens
aattttttttaatgt

SEQ ID NO: 1089153 - DNA, 17 bp, Homo sapiens
aattttttttaatgtac

SEQ ID NO: 1089154 - DNA, 19 bp, Homo sapiens
aattttttttaatgtacaa

SEQ ID NO: 1089155 - DNA, 18 bp, Homo sapiens
aattttttttgttttttg

SEQ ID NO: 1089156 - DNA, 20 bp, Homo sapiens
aatttttttttcatagagat

SEQ ID NO: 1089157 - DNA, 19 bp, Homo sapiens
aatttttttttcctagccc

SEQ ID NO: 1089158 - DNA, 17 bp, Homo sapiens
aatttttttttctcttt

SEQ ID NO: 1089159 - DNA, 21 bp, Homo sapiens
aattttttttttaaatgattc

SEQ ID NO: 1089160 - DNA, 21 bp, Homo sapiens
aattttttttttcctcttcag

SEQ ID NO: 1089161 - DNA, 17 bp, Homo sapiens
acaaaaaaatttaaaat

SEQ ID NO: 1089162 - DNA, 15 bp, Homo sapiens
acaaaaaatgtaatt

SEQ ID NO: 1089163 - DNA, 14 bp, Homo sapiens
acaaaaaatgtttt

SEQ ID NO: 1089164 - DNA, 13 bp, Homo sapiens
acaaaaacaaaaa

SEQ ID NO: 1089165 - DNA, 15 bp, Homo sapiens
acaaaaacagcctca

SEQ ID NO: 1089166 - DNA, 18 bp, Homo sapiens
acaaaaagaaaagaaaat

SEQ ID NO: 1089167 - DNA, 14 bp, Homo sapiens
acaaaaagaaatct

SEQ ID NO: 1089168 - DNA, 21 bp, Homo sapiens
acaaaaagctaacatctttac

SEQ ID NO: 1089169 - DNA, 16 bp, Homo sapiens
acaaaaaggcaaatat

SEQ ID NO: 1089170 - DNA, 20 bp, Homo sapiens
acaaaaaggttctcaggtgt

SEQ ID NO: 1089171 - DNA, 12 bp, Homo sapiens
acaaaaataaca

SEQ ID NO: 1089172 - DNA, 19 bp, Homo sapiens
acaaaaataacactgttgg

SEQ ID NO: 1089173 - DNA, 17 bp, Homo sapiens
acaaaaatcaaagaaca

SEQ ID NO: 1089174 - DNA, 21 bp, Homo sapiens
acaaaaatgtaatgatcataa

SEQ ID NO: 1089175 - DNA, 17 bp, Homo sapiens
acaaaaatgtttccact

SEQ ID NO: 1089176 - DNA, 15 bp, Homo sapiens
acaaaaattgactca

SEQ ID NO: 1089177 - DNA, 14 bp, Homo sapiens
acaaaacaacaaaa

SEQ ID NO: 1089178 - DNA, 23 bp, Homo sapiens
acaaaacatttaaataaaacttt

SEQ ID NO: 1089179 - DNA, 17 bp, Homo sapiens
acaaaaccaagccttgg

SEQ ID NO: 1089180 - DNA, 16 bp, Homo sapiens
acaaaacctaacttgc

SEQ ID NO: 1089181 - DNA, 18 bp, Homo sapiens
acaaaacgagtctttcat

SEQ ID NO: 1089182 - DNA, 15 bp, Homo sapiens
acaaaactacatgag

SEQ ID NO: 1089183 - DNA, 17 bp, Homo sapiens
acaaaactacatgagaa

SEQ ID NO: 1089184 - DNA, 21 bp, Homo sapiens
acaaaacttaaaagtattcat

SEQ ID NO: 1089185 - DNA, 13 bp, Homo sapiens
acaaaagaatttt

SEQ ID NO: 1089186 - DNA, 11 bp, Homo sapiens
acaaaagatgt

SEQ ID NO: 1089187 - DNA, 21 bp, Homo sapiens
acaaaagatgtatccttccaa

SEQ ID NO: 1089188 - DNA, 23 bp, Homo sapiens
acaaaagcaagactgttgctcaa

SEQ ID NO: 1089189 - DNA, 12 bp, Homo sapiens
acaaaagcagat

SEQ ID NO: 1089190 - DNA, 17 bp, Homo sapiens
acaaaagcagcacaagg

SEQ ID NO: 1089191 - DNA, 14 bp, Homo sapiens
acaaaagcagccct

SEQ ID NO: 1089192 - DNA, 11 bp, Homo sapiens
acaaaagcatg

SEQ ID NO: 1089193 - DNA, 20 bp, Homo sapiens
acaaaagctgtaaattacta

SEQ ID NO: 1089194 - DNA, 19 bp, Homo sapiens
acaaaagggtgtatagtgt

SEQ ID NO: 1089195 - DNA, 21 bp, Homo sapiens
acaaaagggtttaaactgatt

SEQ ID NO: 1089196 - DNA, 14 bp, Homo sapiens
acaaaagtaaatgg

SEQ ID NO: 1089197 - DNA, 19 bp, Homo sapiens
acaaaagtacattgcttaa

SEQ ID NO: 1089198 - DNA, 22 bp, Homo sapiens
acaaaagtacattgcttaaaat

SEQ ID NO: 1089199 - DNA, 16 bp, Homo sapiens
acaaaagttcaacctc

SEQ ID NO: 1089200 - DNA, 19 bp, Homo sapiens
acaaaataccaccctacaa

SEQ ID NO: 1089201 - DNA, 15 bp, Homo sapiens
acaaaatagaagctg

SEQ ID NO: 1089202 - DNA, 22 bp, Homo sapiens
acaaaatatttaagtgaaggag

SEQ ID NO: 1089203 - DNA, 19 bp, Homo sapiens
acaaaatccattccaggta

SEQ ID NO: 1089204 - DNA, 19 bp, Homo sapiens
acaaaatcgattggcttta

SEQ ID NO: 1089205 - DNA, 22 bp, Homo sapiens
acaaaatctaaaacaaaatctg

SEQ ID NO: 1089206 - DNA, 14 bp, Homo sapiens
acaaaatctgttta

SEQ ID NO: 1089207 - DNA, 14 bp, Homo sapiens
acaaaatgaaagaa

SEQ ID NO: 1089208 - DNA, 17 bp, Homo sapiens
acaaaatgggaggagga

SEQ ID NO: 1089209 - DNA, 17 bp, Homo sapiens
acaaaatgtagaatatt

SEQ ID NO: 1089210 - DNA, 20 bp, Homo sapiens
acaaaatgtagggttataat

SEQ ID NO: 1089211 - DNA, 16 bp, Homo sapiens
acaaaatgtatgtctg

SEQ ID NO: 1089212 - DNA, 17 bp, Homo sapiens
acaaaatgttttttgat

SEQ ID NO: 1089213 - DNA, 19 bp, Homo sapiens
acaaaattagaaaggacaa

SEQ ID NO: 1089214 - DNA, 14 bp, Homo sapiens
acaaaattataaag

SEQ ID NO: 1089215 - DNA, 14 bp, Homo sapiens
acaaaattatttgt

SEQ ID NO: 1089216 - DNA, 16 bp, Homo sapiens
acaaaattatttgtaa

SEQ ID NO: 1089217 - DNA, 13 bp, Homo sapiens
acaaaattcaaag

SEQ ID NO: 1089218 - DNA, 18 bp, Homo sapiens
acaaaattcaaagcatgg

SEQ ID NO: 1089219 - DNA, 22 bp, Homo sapiens
acaaaatttcacagttctgtaa

SEQ ID NO: 1089220 - DNA, 13 bp, Homo sapiens
acaaaatttgact

SEQ ID NO: 1089221 - DNA, 12 bp, Homo sapiens
acaaaatttgag

SEQ ID NO: 1089222 - DNA, 13 bp, Homo sapiens
acaaaatttgaga

SEQ ID NO: 1089223 - DNA, 14 bp, Homo sapiens
acaaaatttgagaa

SEQ ID NO: 1089224 - DNA, 22 bp, Homo sapiens
acaaaattttattttgtgctca

SEQ ID NO: 1089225 - DNA, 14 bp, Homo sapiens
acaaacaaaaaact

SEQ ID NO: 1089226 - DNA, 15 bp, Homo sapiens
acaaacaaacaaaaa

SEQ ID NO: 1089227 - DNA, 15 bp, Homo sapiens
acaaacaagggagaa

SEQ ID NO: 1089228 - DNA, 21 bp, Homo sapiens
acaaacaagtggatgttttta

SEQ ID NO: 1089229 - DNA, 20 bp, Homo sapiens
acaaacacatgggggagaga

SEQ ID NO: 1089230 - DNA, 14 bp, Homo sapiens
acaaacactgaatc

SEQ ID NO: 1089231 - DNA, 23 bp, Homo sapiens
acaaacactgaatcatgttaata

SEQ ID NO: 1089232 - DNA, 22 bp, Homo sapiens
acaaacactgcagaacagcatc

SEQ ID NO: 1089233 - DNA, 21 bp, Homo sapiens
acaaacactgcagtttcctgg

SEQ ID NO: 1089234 - DNA, 16 bp, Homo sapiens
acaaacagaaacacaa

SEQ ID NO: 1089235 - DNA, 13 bp, Homo sapiens
acaaacagctcag

SEQ ID NO: 1089236 - DNA, 14 bp, Homo sapiens
acaaacataagtgc

SEQ ID NO: 1089237 - DNA, 12 bp, Homo sapiens
acaaacatgaaa

SEQ ID NO: 1089238 - DNA, 14 bp, Homo sapiens
acaaacatgaccct

SEQ ID NO: 1089239 - DNA, 13 bp, Homo sapiens
acaaacattgctg

SEQ ID NO: 1089240 - DNA, 22 bp, Homo sapiens
acaaaccaacatctttgcgaaa

SEQ ID NO: 1089241 - DNA, 21 bp, Homo sapiens
acaaaccaccaggactgaaag

SEQ ID NO: 1089242 - DNA, 13 bp, Homo sapiens
acaaaccaggtca

SEQ ID NO: 1089243 - DNA, 14 bp, Homo sapiens
acaaaccatttcca

SEQ ID NO: 1089244 - DNA, 23 bp, Homo sapiens
acaaaccctgctgaacacagtgt

SEQ ID NO: 1089245 - DNA, 18 bp, Homo sapiens
acaaacctaccaaaatgg

SEQ ID NO: 1089246 - DNA, 15 bp, Homo sapiens
acaaacgggctcagc

SEQ ID NO: 1089247 - DNA, 18 bp, Homo sapiens
acaaacgtgttttttaaa

SEQ ID NO: 1089248 - DNA, 20 bp, Homo sapiens
acaaactatgatcacagtga

SEQ ID NO: 1089249 - DNA, 22 bp, Homo sapiens
acaaactcatcctcttttaatg

SEQ ID NO: 1089250 - DNA, 20 bp, Homo sapiens
acaaactcgttttttacaaa

SEQ ID NO: 1089251 - DNA, 21 bp, Homo sapiens
acaaactcgttttttacaaag

SEQ ID NO: 1089252 - DNA, 15 bp, Homo sapiens
acaaactctctgaac

SEQ ID NO: 1089253 - DNA, 11 bp, Homo sapiens
acaaactgaag

SEQ ID NO: 1089254 - DNA, 13 bp, Homo sapiens
acaaactgcagct

SEQ ID NO: 1089255 - DNA, 16 bp, Homo sapiens
acaaactgcagctgtg

SEQ ID NO: 1089256 - DNA, 17 bp, Homo sapiens
acaaactggtattctgt

SEQ ID NO: 1089257 - DNA, 12 bp, Homo sapiens
acaaactgtgaa

SEQ ID NO: 1089258 - DNA, 22 bp, Homo sapiens
acaaactgtgaaaatagtgtaa

SEQ ID NO: 1089259 - DNA, 12 bp, Homo sapiens
acaaacttccaa

SEQ ID NO: 1089260 - DNA, 19 bp, Homo sapiens
acaaactttgcatctcagt

SEQ ID NO: 1089261 - DNA, 13 bp, Homo sapiens
acaaacttttata

SEQ ID NO: 1089262 - DNA, 12 bp, Homo sapiens
acaaagaaaatt

SEQ ID NO: 1089263 - DNA, 21 bp, Homo sapiens
acaaagaaatccggagaagct

SEQ ID NO: 1089264 - DNA, 21 bp, Homo sapiens
acaaagactcctctgggcctg

SEQ ID NO: 1089265 - DNA, 17 bp, Homo sapiens
acaaagactccttgtgg

SEQ ID NO: 1089266 - DNA, 15 bp, Homo sapiens
acaaagcaaaggcag

SEQ ID NO: 1089267 - DNA, 16 bp, Homo sapiens
acaaagcacagtgtta

SEQ ID NO: 1089268 - DNA, 18 bp, Homo sapiens
acaaagcacagtttgaac

SEQ ID NO: 1089269 - DNA, 11 bp, Homo sapiens
acaaagcccaa

SEQ ID NO: 1089270 - DNA, 20 bp, Homo sapiens
acaaagcccaagggatctgg

SEQ ID NO: 1089271 - DNA, 18 bp, Homo sapiens
acaaagcccttccatgtc

SEQ ID NO: 1089272 - DNA, 16 bp, Homo sapiens
acaaagcccttttata

SEQ ID NO: 1089273 - DNA, 18 bp, Homo sapiens
acaaagccttaaaatgca

SEQ ID NO: 1089274 - DNA, 23 bp, Homo sapiens
acaaagccttaagcaaattttgt

SEQ ID NO: 1089275 - DNA, 13 bp, Homo sapiens
acaaagctgttaa

SEQ ID NO: 1089276 - DNA, 14 bp, Homo sapiens
acaaagctgttaaa

SEQ ID NO: 1089277 - DNA, 23 bp, Homo sapiens
acaaagcttctatcccaggaggt

SEQ ID NO: 1089278 - DNA, 14 bp, Homo sapiens
acaaagctttgcta

SEQ ID NO: 1089279 - DNA, 19 bp, Homo sapiens
acaaagctttgctacaaat

SEQ ID NO: 1089280 - DNA, 22 bp, Homo sapiens
acaaagctttgctacaaattta

SEQ ID NO: 1089281 - DNA, 20 bp, Homo sapiens
acaaaggagcattaagccca

SEQ ID NO: 1089282 - DNA, 15 bp, Homo sapiens
acaaaggagccttga

SEQ ID NO: 1089283 - DNA, 21 bp, Homo sapiens
acaaaggatgaagaacacagc

SEQ ID NO: 1089284 - DNA, 11 bp, Homo sapiens
acaaaggcaag

SEQ ID NO: 1089285 - DNA, 13 bp, Homo sapiens
acaaaggccacag

SEQ ID NO: 1089286 - DNA, 15 bp, Homo sapiens
acaaagggccatcgt

SEQ ID NO: 1089287 - DNA, 24 bp, Homo sapiens
acaaaggttgagatgtaaaaggta

SEQ ID NO: 1089288 - DNA, 14 bp, Homo sapiens
acaaagtaatttct

SEQ ID NO: 1089289 - DNA, 15 bp, Homo sapiens
acaagtggactcagg

SEQ ID NO: 1089290 - DNA, 17 bp, Homo sapiens
acaagtggatgttttta

SEQ ID NO: 1089291 - DNA, 11 bp, Homo sapiens
acaagtggctc

SEQ ID NO: 1089292 - DNA, 20 bp, Homo sapiens
acaagtggtgaccaaaattt

SEQ ID NO: 1089293 - DNA, 23 bp, Homo sapiens
acaagtggtgaccaaaattttta

SEQ ID NO: 1089294 - DNA, 13 bp, Homo sapiens
acaagtggtggta

SEQ ID NO: 1089295 - DNA, 11 bp, Homo sapiens
acaagtgtcta

SEQ ID NO: 1089296 - DNA, 12 bp, Homo sapiens
acaagtgtctaa

SEQ ID NO: 1089297 - DNA, 18 bp, Homo sapiens
acaagtgttttagatgtt

SEQ ID NO: 1089298 - DNA, 18 bp, Homo sapiens
acaagttgcttttacctg

SEQ ID NO: 1089299 - DNA, 13 bp, Homo sapiens
acaagttgttatt

SEQ ID NO: 1089300 - DNA, 17 bp, Homo sapiens
acaagttgttattgttg

SEQ ID NO: 1089301 - DNA, 17 bp, Homo sapiens
acaagttgtttatgtat

SEQ ID NO: 1089302 - DNA, 13 bp, Homo sapiens
acaagtttcagac

SEQ ID NO: 1089303 - DNA, 13 bp, Homo sapiens
acaagtttgctaa

SEQ ID NO: 1089304 - DNA, 16 bp, Homo sapiens
acaagtttgctaaaag

SEQ ID NO: 1089305 - DNA, 19 bp, Homo sapiens
acaagtttgctaaaagaag

SEQ ID NO: 1089306 - DNA, 15 bp, Homo sapiens
acaagttttaatgta

SEQ ID NO: 1089307 - DNA, 12 bp, Homo sapiens
acaagttttgta

SEQ ID NO: 1089308 - DNA, 15 bp, Homo sapiens
acaagtttttctgtc

SEQ ID NO: 1089309 - DNA, 18 bp, Homo sapiens
acaataaaaacaactttc

SEQ ID NO: 1089310 - DNA, 21 bp, Homo sapiens
acaataaaaacaactttcact

SEQ ID NO: 1089311 - DNA, 14 bp, Homo sapiens
acaataaaaatgtt

SEQ ID NO: 1089312 - DNA, 24 bp, Homo sapiens
acaataaaccaaacccagccactg

SEQ ID NO: 1089313 - DNA, 12 bp, Homo sapiens
acaataaagaat

SEQ ID NO: 1089314 - DNA, 21 bp, Homo sapiens
acaataaagcagtcctgttca

SEQ ID NO: 1089315 - DNA, 13 bp, Homo sapiens
acaataaatattc

SEQ ID NO: 1089316 - DNA, 18 bp, Homo sapiens
acaataaatattctgcat

SEQ ID NO: 1089317 - DNA, 12 bp, Homo sapiens
acaataaatggc

SEQ ID NO: 1089318 - DNA, 16 bp, Homo sapiens
acaataaatggccagt

SEQ ID NO: 1089319 - DNA, 20 bp, Homo sapiens
acaataaatggccagtgctg

SEQ ID NO: 1089320 - DNA, 15 bp, Homo sapiens
acaataaatgtgctt

SEQ ID NO: 1089321 - DNA, 17 bp, Homo sapiens
acaataacccagttact

SEQ ID NO: 1089322 - DNA, 20 bp, Homo sapiens
acaataacccagttactttt

SEQ ID NO: 1089323 - DNA, 18 bp, Homo sapiens
acaataactactgtgttc

SEQ ID NO: 1089324 - DNA, 19 bp, Homo sapiens
acaataactactgtgttcc

SEQ ID NO: 1089325 - DNA, 20 bp, Homo sapiens
acaataactactgtgttcct

SEQ ID NO: 1089326 - DNA, 14 bp, Homo sapiens
acaataacttctta

SEQ ID NO: 1089327 - DNA, 21 bp, Homo sapiens
acaataagacatgcttacttt

SEQ ID NO: 1089328 - DNA, 13 bp, Homo sapiens
acaatacaaatgg

SEQ ID NO: 1089329 - DNA, 22 bp, Homo sapiens
acaatacaatgtacaattatgt

SEQ ID NO: 1089330 - DNA, 17 bp, Homo sapiens
acaatacagatcatctt

SEQ ID NO: 1089331 - DNA, 16 bp, Homo sapiens
acaatacatgctgcta

SEQ ID NO: 1089332 - DNA, 21 bp, Homo sapiens
acaatagcattgattcacctt

SEQ ID NO: 1089333 - DNA, 20 bp, Homo sapiens
acaatagctttaccctcagg

SEQ ID NO: 1089334 - DNA, 19 bp, Homo sapiens
acaatataaaactgtactt

SEQ ID NO: 1089335 - DNA, 13 bp, Homo sapiens
acaatatctgcag

SEQ ID NO: 1089336 - DNA, 14 bp, Homo sapiens
acaatatctgcagc

SEQ ID NO: 1089337 - DNA, 17 bp, Homo sapiens
acaatatctgcagcgtt

SEQ ID NO: 1089338 - DNA, 15 bp, Homo sapiens
acaatatgaaaagga

SEQ ID NO: 1089339 - DNA, 22 bp, Homo sapiens
acaatatgtgccaatcaatagc

SEQ ID NO: 1089340 - DNA, 15 bp, Homo sapiens
acaatcaaagaaaag

SEQ ID NO: 1089341 - DNA, 16 bp, Homo sapiens
acaatcaaagaaaaga

SEQ ID NO: 1089342 - DNA, 17 bp, Homo sapiens
acaatcactaaacttta

SEQ ID NO: 1089343 - DNA, 19 bp, Homo sapiens
acaatcactaaactttatt

SEQ ID NO: 1089344 - DNA, 16 bp, Homo sapiens
acaatcagtcatcatg

SEQ ID NO: 1089345 - DNA, 19 bp, Homo sapiens
acaatcagtcatcatgggt

SEQ ID NO: 1089346 - DNA, 22 bp, Homo sapiens
acaatcagtcccctcccatctg

SEQ ID NO: 1089347 - DNA, 17 bp, Homo sapiens
acaatcagttatacagt

SEQ ID NO: 1089348 - DNA, 14 bp, Homo sapiens
acaatcagtttatc

SEQ ID NO: 1089349 - DNA, 18 bp, Homo sapiens
acaatcatgaaatatgca

SEQ ID NO: 1089350 - DNA, 19 bp, Homo sapiens
acaatcatgaacagctctg

SEQ ID NO: 1089351 - DNA, 21 bp, Homo sapiens
acaatcatggtcaagttccca

SEQ ID NO: 1089352 - DNA, 18 bp, Homo sapiens
acaatcattgctgaaaat

SEQ ID NO: 1089353 - DNA, 19 bp, Homo sapiens
acaatccacgcttctccgg

SEQ ID NO: 1089354 - DNA, 23 bp, Homo sapiens
acaatccatgtgattaatgtttt

SEQ ID NO: 1089355 - DNA, 17 bp, Homo sapiens
acaatcccaatctttct

SEQ ID NO: 1089356 - DNA, 20 bp, Homo sapiens
acaatcccaatctttctata

SEQ ID NO: 1089357 - DNA, 20 bp, Homo sapiens
acaatctatggcttatttct

SEQ ID NO: 1089358 - DNA, 21 bp, Homo sapiens
acaatctatggcttatttcta

SEQ ID NO: 1089359 - DNA, 16 bp, Homo sapiens
acaatctgggactttc

SEQ ID NO: 1089360 - DNA, 14 bp, Homo sapiens
acaatctttcatgt

SEQ ID NO: 1089361 - DNA, 15 bp, Homo sapiens
acaatctttcatgtc

SEQ ID NO: 1089362 - DNA, 14 bp, Homo sapiens
acaatgaaaacaaa

SEQ ID NO: 1089363 - DNA, 16 bp, Homo sapiens
acaatgaacacttata

SEQ ID NO: 1089364 - DNA, 18 bp, Homo sapiens
acaatgaactgcttttcc

SEQ ID NO: 1089365 - DNA, 21 bp, Homo sapiens
acaatgaactgcttttcctca

SEQ ID NO: 1089366 - DNA, 13 bp, Homo sapiens
acaatgaatgtat

SEQ ID NO: 1089367 - DNA, 14 bp, Homo sapiens
acaatgaatgtata

SEQ ID NO: 1089368 - DNA, 12 bp, Homo sapiens
acaatgacttac

SEQ ID NO: 1089369 - DNA, 17 bp, Homo sapiens
acaatgacttactgtac

SEQ ID NO: 1089370 - DNA, 18 bp, Homo sapiens
acaatgacttactgtaca

SEQ ID NO: 1089371 - DNA, 18 bp, Homo sapiens
acaatgacttttaaagat

SEQ ID NO: 1089372 - DNA, 16 bp, Homo sapiens
acaatgatgatgataa

SEQ ID NO: 1089373 - DNA, 17 bp, Homo sapiens
acaatgatgatgataat

SEQ ID NO: 1089374 - DNA, 22 bp, Homo sapiens
acaatgatgtataattaatgct

SEQ ID NO: 1089375 - DNA, 19 bp, Homo sapiens
acaatgcacctagctgtgc

SEQ ID NO: 1089376 - DNA, 16 bp, Homo sapiens
acaatgcatgtgctgt

SEQ ID NO: 1089377 - DNA, 12 bp, Homo sapiens
acaatgccaggg

SEQ ID NO: 1089378 - DNA, 15 bp, Homo sapiens
acaatgccagggccc

SEQ ID NO: 1089379 - DNA, 17 bp, Homo sapiens
acaatgccagggcccag

SEQ ID NO: 1089380 - DNA, 22 bp, Homo sapiens
acaatgctcatgtccctgtccc

SEQ ID NO: 1089381 - DNA, 17 bp, Homo sapiens
acaatgctgatttggtg

SEQ ID NO: 1089382 - DNA, 22 bp, Homo sapiens
acaatgctgtgccctaaagtgt

SEQ ID NO: 1089383 - DNA, 23 bp, Homo sapiens
acaatgctgtgccctaaagtgta

SEQ ID NO: 1089384 - DNA, 18 bp, Homo sapiens
acaatggaccctttttgt

SEQ ID NO: 1089385 - DNA, 11 bp, Homo sapiens
acaatggcacc

SEQ ID NO: 1089386 - DNA, 15 bp, Homo sapiens
acaatggcacctctg

SEQ ID NO: 1089387 - DNA, 20 bp, Homo sapiens
acaatggcccgacatttctt

SEQ ID NO: 1089388 - DNA, 19 bp, Homo sapiens
acaatgggaggctgtgatt

SEQ ID NO: 1089389 - DNA, 14 bp, Homo sapiens
acaatggtaacatt

SEQ ID NO: 1089390 - DNA, 18 bp, Homo sapiens
acaatggtcttacattgg

SEQ ID NO: 1089391 - DNA, 15 bp, Homo sapiens
acaatggtgtctctt

SEQ ID NO: 1089392 - DNA, 12 bp, Homo sapiens
acaatggtttat

SEQ ID NO: 1089393 - DNA, 18 bp, Homo sapiens
acaatggtttattcccaa

SEQ ID NO: 1089394 - DNA, 19 bp, Homo sapiens
acaatggtttattcccaag

SEQ ID NO: 1089395 - DNA, 16 bp, Homo sapiens
acaatggtttttaaat

SEQ ID NO: 1089396 - DNA, 22 bp, Homo sapiens
acaatgtatctttattaaaaca

SEQ ID NO: 1089397 - DNA, 22 bp, Homo sapiens
acaatgtcatatactgccatgt

SEQ ID NO: 1089398 - DNA, 22 bp, Homo sapiens
acaatgtcctaactgaaagatg

SEQ ID NO: 1089399 - DNA, 20 bp, Homo sapiens
acaatgtcgagtatattatt

SEQ ID NO: 1089400 - DNA, 23 bp, Homo sapiens
acaatgtctggttagttaaaagc

SEQ ID NO: 1089401 - DNA, 17 bp, Homo sapiens
acaatgtgaaaagaaaa

SEQ ID NO: 1089402 - DNA, 19 bp, Homo sapiens
acaatgtgaaaagaaaaat

SEQ ID NO: 1089403 - DNA, 19 bp, Homo sapiens
acaatgtgaactttattaa

SEQ ID NO: 1089404 - DNA, 17 bp, Homo sapiens
acaatgttatcaaccaa

SEQ ID NO: 1089405 - DNA, 15 bp, Homo sapiens
acaatgttcatccca

SEQ ID NO: 1089406 - DNA, 21 bp, Homo sapiens
acaatgttcatcccatgatgt

SEQ ID NO: 1089407 - DNA, 13 bp, Homo sapiens
acaatgttgagaa

SEQ ID NO: 1089408 - DNA, 18 bp, Homo sapiens
acaatgttgctagttttt

SEQ ID NO: 1089409 - DNA, 16 bp, Homo sapiens
acaatgttgtccaaca

SEQ ID NO: 1089410 - DNA, 17 bp, Homo sapiens
acaatgtttaaaccttt

SEQ ID NO: 1089411 - DNA, 22 bp, Homo sapiens
acaatgtttcttcatttctctg

SEQ ID NO: 1089412 - DNA, 12 bp, Homo sapiens
acaatgttttct

SEQ ID NO: 1089413 - DNA, 15 bp, Homo sapiens
acaattaattcatcc

SEQ ID NO: 1089414 - DNA, 17 bp, Homo sapiens
acaattactaaattgta

SEQ ID NO: 1089415 - DNA, 14 bp, Homo sapiens
acaattagatttct

SEQ ID NO: 1089416 - DNA, 16 bp, Homo sapiens
acaattagcagaatgg

SEQ ID NO: 1089417 - DNA, 18 bp, Homo sapiens
acaattagcagaatggag

SEQ ID NO: 1089418 - DNA, 19 bp, Homo sapiens
acaattagcagaatggaga

SEQ ID NO: 1089419 - DNA, 16 bp, Homo sapiens
acaattatgtctcttg

SEQ ID NO: 1089420 - DNA, 20 bp, Homo sapiens
acaattattccaaaccaaat

SEQ ID NO: 1089421 - DNA, 18 bp, Homo sapiens
acaattatttttacagtt

SEQ ID NO: 1089422 - DNA, 21 bp, Homo sapiens
acaattcaagctgagaaaagt

SEQ ID NO: 1089423 - DNA, 14 bp, Homo sapiens
acaattccaaagga

SEQ ID NO: 1089424 - DNA, 22 bp, Homo sapiens
acaattcctagataaaaagatg

SEQ ID NO: 1089425 - DNA, 17 bp, Homo sapiens
acaattctaaaatgatt

SEQ ID NO: 1089426 - DNA, 23 bp, Homo sapiens
acaattctaaaatgattgtagta

SEQ ID NO: 1089427 - DNA, 14 bp, Homo sapiens
acaattctgggtgc

SEQ ID NO: 1089428 - DNA, 13 bp, Homo sapiens
acaattctgtccc

SEQ ID NO: 1089429 - DNA, 15 bp, Homo sapiens
acaattctgtccctg

SEQ ID NO: 1089430 - DNA, 17 bp, Homo sapiens
acaattctgtttttaat

SEQ ID NO: 1089431 - DNA, 21 bp, Homo sapiens
acaattctgtttttaatgcta

SEQ ID NO: 1089432 - DNA, 19 bp, Homo sapiens
acaattgaagtaaactttt

SEQ ID NO: 1089433 - DNA, 17 bp, Homo sapiens
acaattgatacttcagg

SEQ ID NO: 1089434 - DNA, 13 bp, Homo sapiens
acaattgatcttt

SEQ ID NO: 1089435 - DNA, 16 bp, Homo sapiens
acaattgatctttttt

SEQ ID NO: 1089436 - DNA, 17 bp, Homo sapiens
acaattgcactgctgtt

SEQ ID NO: 1089437 - DNA, 20 bp, Homo sapiens
acaattgggagctgccaaga

SEQ ID NO: 1089438 - DNA, 13 bp, Homo sapiens
acaattgtaattg

SEQ ID NO: 1089439 - DNA, 14 bp, Homo sapiens
acaattgtcttaaa

SEQ ID NO: 1089440 - DNA, 14 bp, Homo sapiens
acaattgtgtagcc

SEQ ID NO: 1089441 - DNA, 21 bp, Homo sapiens
acaattgtgtagcctttttgt

SEQ ID NO: 1089442 - DNA, 23 bp, Homo sapiens
acaatttacaaagtgtgtattaa

SEQ ID NO: 1089443 - DNA, 18 bp, Homo sapiens
acaatttatgaattgaat

SEQ ID NO: 1089444 - DNA, 14 bp, Homo sapiens
acaatttattatgg

SEQ ID NO: 1089445 - DNA, 16 bp, Homo sapiens
acaatttattatggca

SEQ ID NO: 1089446 - DNA, 14 bp, Homo sapiens
acaatttattttat

SEQ ID NO: 1089447 - DNA, 15 bp, Homo sapiens
acaatttattttatt

SEQ ID NO: 1089448 - DNA, 16 bp, Homo sapiens
acaatttcctttatat

SEQ ID NO: 1089449 - DNA, 17 bp, Homo sapiens
acaatttcctttatatt

SEQ ID NO: 1089450 - DNA, 19 bp, Homo sapiens
acaatttgagactgaaatt

SEQ ID NO: 1089451 - DNA, 14 bp, Homo sapiens
acaatttgatacat

SEQ ID NO: 1089452 - DNA, 18 bp, Homo sapiens
acaatttgatacataata

SEQ ID NO: 1089453 - DNA, 21 bp, Homo sapiens
acaatttgatacataataaaa

SEQ ID NO: 1089454 - DNA, 21 bp, Homo sapiens
acaatttgcacaatatttctt

SEQ ID NO: 1089455 - DNA, 13 bp, Homo sapiens
acaatttgttaat

SEQ ID NO: 1089456 - DNA, 14 bp, Homo sapiens
acaattttaaagtt

SEQ ID NO: 1089457 - DNA, 16 bp, Homo sapiens
acaattttaaagttct

SEQ ID NO: 1089458 - DNA, 19 bp, Homo sapiens
acaattttaaagttcttat

SEQ ID NO: 1089459 - DNA, 12 bp, Homo sapiens
acaattttaatg

SEQ ID NO: 1089460 - DNA, 13 bp, Homo sapiens
acaattttagtca

SEQ ID NO: 1089461 - DNA, 21 bp, Homo sapiens
acaattttagtcactaagact

SEQ ID NO: 1089462 - DNA, 12 bp, Homo sapiens
acaattttgtac

SEQ ID NO: 1089463 - DNA, 15 bp, Homo sapiens
acaattttgtacaaa

SEQ ID NO: 1089464 - DNA, 16 bp, Homo sapiens
acaatttttaataaat

SEQ ID NO: 1089465 - DNA, 16 bp, Homo sapiens
acaattttttatcatg

SEQ ID NO: 1089466 - DNA, 18 bp, Homo sapiens
acacaaaaaaacaagtat

SEQ ID NO: 1089467 - DNA, 17 bp, Homo sapiens
acacaaaacaacaaaaa

SEQ ID NO: 1089468 - DNA, 16 bp, Homo sapiens
acacaaaactccgccc

SEQ ID NO: 1089469 - DNA, 19 bp, Homo sapiens
acacaaaactccgccccca

SEQ ID NO: 1089470 - DNA, 17 bp, Homo sapiens
acacaaaacttgaaaga

SEQ ID NO: 1089471 - DNA, 19 bp, Homo sapiens
acacaaaatccattccagg

SEQ ID NO: 1089472 - DNA, 24 bp, Homo sapiens
acacaaaatccattccaggtagct

SEQ ID NO: 1089473 - DNA, 18 bp, Homo sapiens
acacaaacgggctcagca

SEQ ID NO: 1089474 - DNA, 15 bp, Homo sapiens
acacaaagcacattg

SEQ ID NO: 1089475 - DNA, 16 bp, Homo sapiens
acacaaagcttctaaa

SEQ ID NO: 1089476 - DNA, 20 bp, Homo sapiens
acacaaaggtggaataaaca

SEQ ID NO: 1089477 - DNA, 13 bp, Homo sapiens
acacaaatgcatg

SEQ ID NO: 1089478 - DNA, 13 bp, Homo sapiens
acacaaattcagt

SEQ ID NO: 1089479 - DNA, 18 bp, Homo sapiens
acacaaattttcaagttt

SEQ ID NO: 1089480 - DNA, 21 bp, Homo sapiens
acacaaattttcaagtttaca

SEQ ID NO: 1089481 - DNA, 14 bp, Homo sapiens
acacaactttgcaa

SEQ ID NO: 1089482 - DNA, 22 bp, Homo sapiens
acacaagaagaagggcacccta

SEQ ID NO: 1089483 - DNA, 19 bp, Homo sapiens
acacaagaccagtgcttag

SEQ ID NO: 1089484 - DNA, 13 bp, Homo sapiens
acacaagccacag

SEQ ID NO: 1089485 - DNA, 16 bp, Homo sapiens
acacaagccacagaag

SEQ ID NO: 1089486 - DNA, 21 bp, Homo sapiens
acacaaggacccttcaggtgt

SEQ ID NO: 1089487 - DNA, 20 bp, Homo sapiens
acacaaggggcaaatgaatt

SEQ ID NO: 1089488 - DNA, 18 bp, Homo sapiens
acacaataggtctttctc

SEQ ID NO: 1089489 - DNA, 15 bp, Homo sapiens
acacaatatgtatgc

SEQ ID NO: 1089490 - DNA, 22 bp, Homo sapiens
acacaatggtttttaaattttg

SEQ ID NO: 1089491 - DNA, 23 bp, Homo sapiens
acacaatggtttttaaattttgt

SEQ ID NO: 1089492 - DNA, 18 bp, Homo sapiens
acacaattgatacttcag

SEQ ID NO: 1089493 - DNA, 19 bp, Homo sapiens
acacaattgatacttcagg

SEQ ID NO: 1089494 - DNA, 23 bp, Homo sapiens
acacaatttaattcctcttttta

SEQ ID NO: 1089495 - DNA, 13 bp, Homo sapiens
acacacacacaca

SEQ ID NO: 1089496 - DNA, 15 bp, Homo sapiens
acacacacacacagg

SEQ ID NO: 1089497 - DNA, 16 bp, Homo sapiens
acacacacacacgatg

SEQ ID NO: 1089498 - DNA, 13 bp, Homo sapiens
acacacacacagg

SEQ ID NO: 1089499 - DNA, 13 bp, Homo sapiens
acacacacacgca

SEQ ID NO: 1089500 - DNA, 14 bp, Homo sapiens
acacacacacgcac

SEQ ID NO: 1089501 - DNA, 13 bp, Homo sapiens
acacacacagctg

SEQ ID NO: 1089502 - DNA, 11 bp, Homo sapiens
acacacacagg

SEQ ID NO: 1089503 - DNA, 14 bp, Homo sapiens
acacacacgatgca

SEQ ID NO: 1089504 - DNA, 15 bp, Homo sapiens
acacacacgatgcat

SEQ ID NO: 1089505 - DNA, 21 bp, Homo sapiens
acacacacgcacgcacacaca

SEQ ID NO: 1089506 - DNA, 14 bp, Homo sapiens
acacacactcacca

SEQ ID NO: 1089507 - DNA, 15 bp, Homo sapiens
acacacactcaccag

SEQ ID NO: 1089508 - DNA, 23 bp, Homo sapiens
acacacactcaccagtggccttt

SEQ ID NO: 1089509 - DNA, 14 bp, Homo sapiens
acacacactgtctg

SEQ ID NO: 1089510 - DNA, 18 bp, Homo sapiens
acacacactgtctggggc

SEQ ID NO: 1089511 - DNA, 14 bp, Homo sapiens
acacacagccccta

SEQ ID NO: 1089512 - DNA, 11 bp, Homo sapiens
acacacagctg

SEQ ID NO: 1089513 - DNA, 21 bp, Homo sapiens
acacacagctgggcaaagcca

SEQ ID NO: 1089514 - DNA, 13 bp, Homo sapiens
acacacaggagga

SEQ ID NO: 1089515 - DNA, 12 bp, Homo sapiens
acacacaggcct

SEQ ID NO: 1089516 - DNA, 16 bp, Homo sapiens
acacacaggccttctg

SEQ ID NO: 1089517 - DNA, 19 bp, Homo sapiens
acacacaggccttctgtgg

SEQ ID NO: 1089518 - DNA, 13 bp, Homo sapiens
acacacatacaga

SEQ ID NO: 1089519 - DNA, 18 bp, Homo sapiens
acacacatatattatttg

SEQ ID NO: 1089520 - DNA, 16 bp, Homo sapiens
acacacatctggccct

SEQ ID NO: 1089521 - DNA, 13 bp, Homo sapiens
acacacatgccct

SEQ ID NO: 1089522 - DNA, 16 bp, Homo sapiens
acacacatgccctcct

SEQ ID NO: 1089523 - DNA, 14 bp, Homo sapiens
acacaccaggcgct

SEQ ID NO: 1089524 - DNA, 19 bp, Homo sapiens
acacaccccacaccccagc

SEQ ID NO: 1089525 - DNA, 20 bp, Homo sapiens
acacaccccacaccccagcc

SEQ ID NO: 1089526 - DNA, 21 bp, Homo sapiens
acacaccccacaccccagccc

SEQ ID NO: 1089527 - DNA, 13 bp, Homo sapiens
acacaccctgagg

SEQ ID NO: 1089528 - DNA, 14 bp, Homo sapiens
acacaccctgaggt

SEQ ID NO: 1089529 - DNA, 16 bp, Homo sapiens
acacacctgctccaat

SEQ ID NO: 1089530 - DNA, 20 bp, Homo sapiens
acacacgagcaaacccagag

SEQ ID NO: 1089531 - DNA, 22 bp, Homo sapiens
acacacgatgcatttaataaag

SEQ ID NO: 1089532 - DNA, 15 bp, Homo sapiens
acacacgcacgcaca

SEQ ID NO: 1089533 - DNA, 13 bp, Homo sapiens
acacacgccagct

SEQ ID NO: 1089534 - DNA, 18 bp, Homo sapiens
acacgtgggctcccctct

SEQ ID NO: 1089535 - DNA, 19 bp, Homo sapiens
acacgtgggctcccctctt

SEQ ID NO: 1089536 - DNA, 22 bp, Homo sapiens
acacgtgtgcacatgcgcactc

SEQ ID NO: 1089537 - DNA, 12 bp, Homo sapiens
acacgtgtgtat

SEQ ID NO: 1089538 - DNA, 14 bp, Homo sapiens
acacgtgtgtatga

SEQ ID NO: 1089539 - DNA, 20 bp, Homo sapiens
acacgttgacgggccgcagg

SEQ ID NO: 1089540 - DNA, 22 bp, Homo sapiens
acacgttgccaggggcttgaga

SEQ ID NO: 1089541 - DNA, 15 bp, Homo sapiens
acactaaaaactgat

SEQ ID NO: 1089542 - DNA, 23 bp, Homo sapiens
acactaaaagcagcgtcactcta

SEQ ID NO: 1089543 - DNA, 17 bp, Homo sapiens
acactaaagatccaaga

SEQ ID NO: 1089544 - DNA, 18 bp, Homo sapiens
acactaaaggtggaaata

SEQ ID NO: 1089545 - DNA, 22 bp, Homo sapiens
acactaaccaagctgagtttcc

SEQ ID NO: 1089546 - DNA, 23 bp, Homo sapiens
acactaaccaagctgagtttcct

SEQ ID NO: 1089547 - DNA, 21 bp, Homo sapiens
acactaacgaaatatcaaagt

SEQ ID NO: 1089548 - DNA, 11 bp, Homo sapiens
acactaagaaa

SEQ ID NO: 1089549 - DNA, 12 bp, Homo sapiens
acactaaggctg

SEQ ID NO: 1089550 - DNA, 14 bp, Homo sapiens
acactaagggtgta

SEQ ID NO: 1089551 - DNA, 23 bp, Homo sapiens
acactaagttatagtatatctgg

SEQ ID NO: 1089552 - DNA, 23 bp, Homo sapiens
acactaagtttgcaacatttatt

SEQ ID NO: 1089553 - DNA, 18 bp, Homo sapiens
acactaatatatggacct

SEQ ID NO: 1089554 - DNA, 22 bp, Homo sapiens
acactaatatatggacctagct

SEQ ID NO: 1089555 - DNA, 19 bp, Homo sapiens
acactaatatatttaaaaa

SEQ ID NO: 1089556 - DNA, 21 bp, Homo sapiens
acactaatatatttaaaaata

SEQ ID NO: 1089557 - DNA, 22 bp, Homo sapiens
acactaatatatttaaaaataa

SEQ ID NO: 1089558 - DNA, 13 bp, Homo sapiens
acactaattcata

SEQ ID NO: 1089559 - DNA, 23 bp, Homo sapiens
acactaattcctttctatcctac

SEQ ID NO: 1089560 - DNA, 17 bp, Homo sapiens
acactacacactgtgta

SEQ ID NO: 1089561 - DNA, 14 bp, Homo sapiens
acactacacccagc

SEQ ID NO: 1089562 - DNA, 17 bp, Homo sapiens
acactacacccagcaat

SEQ ID NO: 1089563 - DNA, 13 bp, Homo sapiens
acactacagatca

SEQ ID NO: 1089564 - DNA, 14 bp, Homo sapiens
acactacattagaa

SEQ ID NO: 1089565 - DNA, 22 bp, Homo sapiens
acactaccaaacactcagtcca

SEQ ID NO: 1089566 - DNA, 16 bp, Homo sapiens
acactaccgaatgtgt

SEQ ID NO: 1089567 - DNA, 19 bp, Homo sapiens
acactaccgaatgtgtctt

SEQ ID NO: 1089568 - DNA, 15 bp, Homo sapiens
acactagaggccagg

SEQ ID NO: 1089569 - DNA, 21 bp, Homo sapiens
acactagccagacactctgct

SEQ ID NO: 1089570 - DNA, 20 bp, Homo sapiens
acactagcccaatgaaatga

SEQ ID NO: 1089571 - DNA, 22 bp, Homo sapiens
acactagcttgaacttagatgt

SEQ ID NO: 1089572 - DNA, 20 bp, Homo sapiens
acactagggactatcaggta

SEQ ID NO: 1089573 - DNA, 21 bp, Homo sapiens
acactagggactatcaggtaa

SEQ ID NO: 1089574 - DNA, 16 bp, Homo sapiens
acactagtctgtgtaa

SEQ ID NO: 1089575 - DNA, 18 bp, Homo sapiens
acactagttttgtgccag

SEQ ID NO: 1089576 - DNA, 17 bp, Homo sapiens
acactatgataaagttg

SEQ ID NO: 1089577 - DNA, 22 bp, Homo sapiens
acactatgataaagttgtaaat

SEQ ID NO: 1089578 - DNA, 17 bp, Homo sapiens
acactatggtatttgag

SEQ ID NO: 1089579 - DNA, 18 bp, Homo sapiens
acactattaccatgagaa

SEQ ID NO: 1089580 - DNA, 17 bp, Homo sapiens
acactcaaggacaggag

SEQ ID NO: 1089581 - DNA, 15 bp, Homo sapiens
acactcaccagtggc

SEQ ID NO: 1089582 - DNA, 17 bp, Homo sapiens
acactcaccagtggcct

SEQ ID NO: 1089583 - DNA, 18 bp, Homo sapiens
acactcaccagtggcctt

SEQ ID NO: 1089584 - DNA, 20 bp, Homo sapiens
acactcaccatgaagcgaaa

SEQ ID NO: 1089585 - DNA, 17 bp, Homo sapiens
acactcaccccagcctc

SEQ ID NO: 1089586 - DNA, 18 bp, Homo sapiens
acactcaccccagcctca

SEQ ID NO: 1089587 - DNA, 11 bp, Homo sapiens
acactcagggc

SEQ ID NO: 1089588 - DNA, 18 bp, Homo sapiens
acactcagggcagctgcc

SEQ ID NO: 1089589 - DNA, 19 bp, Homo sapiens
acactcagggcagctgcct

SEQ ID NO: 1089590 - DNA, 18 bp, Homo sapiens
acactcagtccactgttg

SEQ ID NO: 1089591 - DNA, 20 bp, Homo sapiens
acactcagtccactgttgag

SEQ ID NO: 1089592 - DNA, 22 bp, Homo sapiens
acactcagtggcccatggcatt

SEQ ID NO: 1089593 - DNA, 14 bp, Homo sapiens
acactccaagatat

SEQ ID NO: 1089594 - DNA, 14 bp, Homo sapiens
acactccactctga

SEQ ID NO: 1089595 - DNA, 17 bp, Homo sapiens
acactccactctgattc

SEQ ID NO: 1089596 - DNA, 14 bp, Homo sapiens
acactccagcctga

SEQ ID NO: 1089597 - DNA, 16 bp, Homo sapiens
acactccagtgccagc

SEQ ID NO: 1089598 - DNA, 19 bp, Homo sapiens
acactccagtgccagcaat

SEQ ID NO: 1089599 - DNA, 13 bp, Homo sapiens
acactccagtggc

SEQ ID NO: 1089600 - DNA, 16 bp, Homo sapiens
acactccagtggcaga

SEQ ID NO: 1089601 - DNA, 20 bp, Homo sapiens
acactcccaaggttggagcc

SEQ ID NO: 1089602 - DNA, 21 bp, Homo sapiens
acactcccaaggttggagccc

SEQ ID NO: 1089603 - DNA, 16 bp, Homo sapiens
acactccctctccttg

SEQ ID NO: 1089604 - DNA, 17 bp, Homo sapiens
acactctcatgtcccct

SEQ ID NO: 1089605 - DNA, 18 bp, Homo sapiens
acactctcgtggtatgta

SEQ ID NO: 1089606 - DNA, 21 bp, Homo sapiens
acactctcgtggtatgtatgg

SEQ ID NO: 1089607 - DNA, 20 bp, Homo sapiens
acactctcttgggccagccc

SEQ ID NO: 1089608 - DNA, 14 bp, Homo sapiens
acactctgctctgc

SEQ ID NO: 1089609 - DNA, 12 bp, Homo sapiens
acactctgctgt

SEQ ID NO: 1089610 - DNA, 20 bp, Homo sapiens
acactctgggctccagagtg

SEQ ID NO: 1089611 - DNA, 21 bp, Homo sapiens
acactcttcttcaagttgagg

SEQ ID NO: 1089612 - DNA, 16 bp, Homo sapiens
acactctttgtaagag

SEQ ID NO: 1089613 - DNA, 14 bp, Homo sapiens
acactgaaaaatta

SEQ ID NO: 1089614 - DNA, 17 bp, Homo sapiens
acactgaaagttttgta

SEQ ID NO: 1089615 - DNA, 23 bp, Homo sapiens
acactgaatatttatatttcact

SEQ ID NO: 1089616 - DNA, 13 bp, Homo sapiens
acactgaattgaa

SEQ ID NO: 1089617 - DNA, 20 bp, Homo sapiens
acactgaattgaatctacaa

SEQ ID NO: 1089618 - DNA, 19 bp, Homo sapiens
acactgacaaagtcatccc

SEQ ID NO: 1089619 - DNA, 17 bp, Homo sapiens
acactgaccatccactc

SEQ ID NO: 1089620 - DNA, 17 bp, Homo sapiens
acactgagcttctgaga

SEQ ID NO: 1089621 - DNA, 13 bp, Homo sapiens
acactgaggactg

SEQ ID NO: 1089622 - DNA, 20 bp, Homo sapiens
acactgatacataaaaatta

SEQ ID NO: 1089623 - DNA, 23 bp, Homo sapiens
acactgatgagtttcactgtact

SEQ ID NO: 1089624 - DNA, 15 bp, Homo sapiens
acactgatgggctgg

SEQ ID NO: 1089625 - DNA, 16 bp, Homo sapiens
acactgattcctggag

SEQ ID NO: 1089626 - DNA, 22 bp, Homo sapiens
acactgcactcttaagcttccg

SEQ ID NO: 1089627 - DNA, 15 bp, Homo sapiens
acactgcactttgtt

SEQ ID NO: 1089628 - DNA, 17 bp, Homo sapiens
acactgcactttgttta

SEQ ID NO: 1089629 - DNA, 21 bp, Homo sapiens
acactgcactttgtttagaaa

SEQ ID NO: 1089630 - DNA, 16 bp, Homo sapiens
acactgcagtttcctg

SEQ ID NO: 1089631 - DNA, 14 bp, Homo sapiens
acactgcatgtttg

SEQ ID NO: 1089632 - DNA, 18 bp, Homo sapiens
acactgccaagagccgac

SEQ ID NO: 1089633 - DNA, 16 bp, Homo sapiens
acactgccagaagaga

SEQ ID NO: 1089634 - DNA, 17 bp, Homo sapiens
acactgccagaagagaa

SEQ ID NO: 1089635 - DNA, 22 bp, Homo sapiens
acactgccatcttagtttggat

SEQ ID NO: 1089636 - DNA, 15 bp, Homo sapiens
acactgccctcttgt

SEQ ID NO: 1089637 - DNA, 12 bp, Homo sapiens
acactgcctgcc

SEQ ID NO: 1089638 - DNA, 13 bp, Homo sapiens
acactgcgccccg

SEQ ID NO: 1089639 - DNA, 15 bp, Homo sapiens
acactgcgccccgcc

SEQ ID NO: 1089640 - DNA, 18 bp, Homo sapiens
acactgctaggtgggcca

SEQ ID NO: 1089641 - DNA, 19 bp, Homo sapiens
acactgctctaacagccct

SEQ ID NO: 1089642 - DNA, 19 bp, Homo sapiens
acactgctgcaccagagtg

SEQ ID NO: 1089643 - DNA, 21 bp, Homo sapiens
acactgctgctccagtgcagg

SEQ ID NO: 1089644 - DNA, 13 bp, Homo sapiens
acactgctgtcca

SEQ ID NO: 1089645 - DNA, 15 bp, Homo sapiens
acactgctgtccaca

SEQ ID NO: 1089646 - DNA, 21 bp, Homo sapiens
acactgctgtcctctccccct

SEQ ID NO: 1089647 - DNA, 22 bp, Homo sapiens
acactgcttctcggccagcccg

SEQ ID NO: 1089648 - DNA, 19 bp, Homo sapiens
acactggacaacattttac

SEQ ID NO: 1089649 - DNA, 17 bp, Homo sapiens
acactggaccccactgg

SEQ ID NO: 1089650 - DNA, 23 bp, Homo sapiens
acactggaccccactggctgaga

SEQ ID NO: 1089651 - DNA, 22 bp, Homo sapiens
acactggaggagagaagaatga

SEQ ID NO: 1089652 - DNA, 11 bp, Homo sapiens
acactggatat

SEQ ID NO: 1089653 - DNA, 21 bp, Homo sapiens
acactggatccatcttgagcc

SEQ ID NO: 1089654 - DNA, 22 bp, Homo sapiens
acactggcacactgctcttaag

SEQ ID NO: 1089655 - DNA, 17 bp, Homo sapiens
acactggccccacagga

SEQ ID NO: 1089656 - DNA, 23 bp, Homo sapiens
acactgggagaggtgccagcaac

SEQ ID NO: 1089657 - DNA, 12 bp, Homo sapiens
acactgggcctg

SEQ ID NO: 1089658 - DNA, 16 bp, Homo sapiens
acactgggggagggga

SEQ ID NO: 1089659 - DNA, 15 bp, Homo sapiens
acactggtctaatgt

SEQ ID NO: 1089660 - DNA, 18 bp, Homo sapiens
acactggtctaatgtttg

SEQ ID NO: 1089661 - DNA, 11 bp, Homo sapiens
acactggtggt

SEQ ID NO: 1089662 - DNA, 22 bp, Homo sapiens
acactggtggttctactgaccc

SEQ ID NO: 1089663 - DNA, 13 bp, Homo sapiens
acactggttctca

SEQ ID NO: 1089664 - DNA, 17 bp, Homo sapiens
acactggttctcaatga

SEQ ID NO: 1089665 - DNA, 18 bp, Homo sapiens
acactggttctcaatgaa

SEQ ID NO: 1089666 - DNA, 21 bp, Homo sapiens
acactgtaagcttttaagaaa

SEQ ID NO: 1089667 - DNA, 22 bp, Homo sapiens
acactgtaagcttttaagaaaa

SEQ ID NO: 1089668 - DNA, 20 bp, Homo sapiens
acactgtagtttttgaaaat

SEQ ID NO: 1089669 - DNA, 21 bp, Homo sapiens
acactgtagtttttgaaaatt

SEQ ID NO: 1089670 - DNA, 21 bp, Homo sapiens
acactgtatgttatagaactt

SEQ ID NO: 1089671 - DNA, 17 bp, Homo sapiens
acactgtcatgcttcat

SEQ ID NO: 1089672 - DNA, 15 bp, Homo sapiens
acactgtctgcccct

SEQ ID NO: 1089673 - DNA, 21 bp, Homo sapiens
acactgtgcacatctgtgtct

SEQ ID NO: 1089674 - DNA, 17 bp, Homo sapiens
acactgtgcagacccag

SEQ ID NO: 1089675 - DNA, 13 bp, Homo sapiens
acactgtgccctg

SEQ ID NO: 1089676 - DNA, 20 bp, Homo sapiens
acactgtggaactaataaat

SEQ ID NO: 1089677 - DNA, 15 bp, Homo sapiens
acactgtggccaggc

SEQ ID NO: 1089678 - DNA, 18 bp, Homo sapiens
acactgtggccaggcctt

SEQ ID NO: 1089679 - DNA, 20 bp, Homo sapiens
acactgtgtcctggtgctct

SEQ ID NO: 1089680 - DNA, 17 bp, Homo sapiens
acactgttgataaaaac

SEQ ID NO: 1089681 - DNA, 13 bp, Homo sapiens
acactgttgcaaa

SEQ ID NO: 1089682 - DNA, 18 bp, Homo sapiens
acactgttggcacttata

SEQ ID NO: 1089683 - DNA, 17 bp, Homo sapiens
acactgtttcaaacttt

SEQ ID NO: 1089684 - DNA, 20 bp, Homo sapiens
acactgtttcaaactttact

SEQ ID NO: 1089685 - DNA, 15 bp, Homo sapiens
acacttaaatttctt

SEQ ID NO: 1089686 - DNA, 14 bp, Homo sapiens
acacttaacagatg

SEQ ID NO: 1089687 - DNA, 16 bp, Homo sapiens
acacttaacagatgca

SEQ ID NO: 1089688 - DNA, 20 bp, Homo sapiens
acacttagtgatcatttaaa

SEQ ID NO: 1089689 - DNA, 14 bp, Homo sapiens
acacttataagtga

SEQ ID NO: 1089690 - DNA, 15 bp, Homo sapiens
acacttatattttat

SEQ ID NO: 1089691 - DNA, 16 bp, Homo sapiens
acacttatattttatg

SEQ ID NO: 1089692 - DNA, 19 bp, Homo sapiens
acacttatattttgatttt

SEQ ID NO: 1089693 - DNA, 19 bp, Homo sapiens
acacttatttatgaattgt

SEQ ID NO: 1089694 - DNA, 15 bp, Homo sapiens
acacttcagacacag

SEQ ID NO: 1089695 - DNA, 20 bp, Homo sapiens
acacttcagagagctggtag

SEQ ID NO: 1089696 - DNA, 12 bp, Homo sapiens
acacttcagatc

SEQ ID NO: 1089697 - DNA, 19 bp, Homo sapiens
acacttcagatctgaggtt

SEQ ID NO: 1089698 - DNA, 24 bp, Homo sapiens
acacttccacccttttttctaagt

SEQ ID NO: 1089699 - DNA, 15 bp, Homo sapiens
acacttccagtctgg

SEQ ID NO: 1089700 - DNA, 19 bp, Homo sapiens
acacttcccacccccaggc

SEQ ID NO: 1089701 - DNA, 11 bp, Homo sapiens
acacttcccca

SEQ ID NO: 1089702 - DNA, 17 bp, Homo sapiens
acacttccccatctttg

SEQ ID NO: 1089703 - DNA, 15 bp, Homo sapiens
acacttccctctgtt

SEQ ID NO: 1089704 - DNA, 18 bp, Homo sapiens
acacttccctctgtttct

SEQ ID NO: 1089705 - DNA, 22 bp, Homo sapiens
acacttccctctgtttctcttt

SEQ ID NO: 1089706 - DNA, 11 bp, Homo sapiens
acacttccctg

SEQ ID NO: 1089707 - DNA, 12 bp, Homo sapiens
acacttccctgg

SEQ ID NO: 1089708 - DNA, 14 bp, Homo sapiens
acacttccctggcg

SEQ ID NO: 1089709 - DNA, 18 bp, Homo sapiens
acacttccctgggcctca

SEQ ID NO: 1089710 - DNA, 13 bp, Homo sapiens
acacttcctgtcc

SEQ ID NO: 1089711 - DNA, 19 bp, Homo sapiens
acacttctcatcatattgt

SEQ ID NO: 1089712 - DNA, 20 bp, Homo sapiens
acacttctcttaagtggtct

SEQ ID NO: 1089713 - DNA, 12 bp, Homo sapiens
acacttctgctt

SEQ ID NO: 1089714 - DNA, 14 bp, Homo sapiens
acacttctgctttc

SEQ ID NO: 1089715 - DNA, 19 bp, Homo sapiens
acacttctggctcacagga

SEQ ID NO: 1089716 - DNA, 12 bp, Homo sapiens
acacttctgtat

SEQ ID NO: 1089717 - DNA, 20 bp, Homo sapiens
acacttcttgaaacagcctg

SEQ ID NO: 1089718 - DNA, 23 bp, Homo sapiens
acacttgatggagtgtgagccac

SEQ ID NO: 1089719 - DNA, 19 bp, Homo sapiens
acacttggcatacaaaata

SEQ ID NO: 1089720 - DNA, 22 bp, Homo sapiens
acacttggcatacaaaatattt

SEQ ID NO: 1089721 - DNA, 16 bp, Homo sapiens
acacttgtgccagccc

SEQ ID NO: 1089722 - DNA, 18 bp, Homo sapiens
acacttgtgccagcccgg

SEQ ID NO: 1089723 - DNA, 13 bp, Homo sapiens
acacttgtgtgtg

SEQ ID NO: 1089724 - DNA, 21 bp, Homo sapiens
acactttatgccggatgtgct

SEQ ID NO: 1089725 - DNA, 16 bp, Homo sapiens
acactttcatttagta

SEQ ID NO: 1089726 - DNA, 14 bp, Homo sapiens
acactttctggaac

SEQ ID NO: 1089727 - DNA, 17 bp, Homo sapiens
acactttgagcattttt

SEQ ID NO: 1089728 - DNA, 17 bp, Homo sapiens
acactttgcactgatat

SEQ ID NO: 1089729 - DNA, 19 bp, Homo sapiens
acactttgccaaggctctc

SEQ ID NO: 1089730 - DNA, 24 bp, Homo sapiens
acactttgggcttagtatttctca

SEQ ID NO: 1089731 - DNA, 14 bp, Homo sapiens
acactttgtattac

SEQ ID NO: 1089732 - DNA, 20 bp, Homo sapiens
acacttttaaaaaacaaaaa

SEQ ID NO: 1089733 - DNA, 23 bp, Homo sapiens
acacttttaaaaaacaaaaaaag

SEQ ID NO: 1089734 - DNA, 16 bp, Homo sapiens
acacttttcatatcat

SEQ ID NO: 1089735 - DNA, 22 bp, Homo sapiens
acactttttgtattttttcctt

SEQ ID NO: 1089736 - DNA, 13 bp, Homo sapiens
acagaaaaagcat

SEQ ID NO: 1089737 - DNA, 22 bp, Homo sapiens
acagaaaaagcatgatgggaaa

SEQ ID NO: 1089738 - DNA, 20 bp, Homo sapiens
acagaaaaatactttgattt

SEQ ID NO: 1089739 - DNA, 22 bp, Homo sapiens
acagaaaacatgtataaatata

SEQ ID NO: 1089740 - DNA, 19 bp, Homo sapiens
acagaaaaccgagaatatt

SEQ ID NO: 1089741 - DNA, 22 bp, Homo sapiens
acagaaaactcccaatacaaag

SEQ ID NO: 1089742 - DNA, 14 bp, Homo sapiens
acagaaaagtgcct

SEQ ID NO: 1089743 - DNA, 12 bp, Homo sapiens
acagaaaatgct

SEQ ID NO: 1089744 - DNA, 13 bp, Homo sapiens
acagaaaatgctg

SEQ ID NO: 1089745 - DNA, 17 bp, Homo sapiens
acagaaacaaaaacact

SEQ ID NO: 1089746 - DNA, 15 bp, Homo sapiens
acagaaaccttttta

SEQ ID NO: 1089747 - DNA, 18 bp, Homo sapiens
acagaaacgcatccagca

SEQ ID NO: 1089748 - DNA, 19 bp, Homo sapiens
acagaaactggattaaaac

SEQ ID NO: 1089749 - DNA, 16 bp, Homo sapiens
acagaaacttgaactc

SEQ ID NO: 1089750 - DNA, 20 bp, Homo sapiens
acagaaaggcaggtttcatt

SEQ ID NO: 1089751 - DNA, 15 bp, Homo sapiens
acagaaatactgctc

SEQ ID NO: 1089752 - DNA, 14 bp, Homo sapiens
acagaaatgactgc

SEQ ID NO: 1089753 - DNA, 17 bp, Homo sapiens
acagaaatgtacagcaa

SEQ ID NO: 1089754 - DNA, 15 bp, Homo sapiens
acagaaattgtatat

SEQ ID NO: 1089755 - DNA, 16 bp, Homo sapiens
acagaaattgtatatt

SEQ ID NO: 1089756 - DNA, 18 bp, Homo sapiens
acagaacacaaatgtcta

SEQ ID NO: 1089757 - DNA, 14 bp, Homo sapiens
acagaacagggtca

SEQ ID NO: 1089758 - DNA, 15 bp, Homo sapiens
acagaacagggtcat

SEQ ID NO: 1089759 - DNA, 12 bp, Homo sapiens
acagaacccttt

SEQ ID NO: 1089760 - DNA, 13 bp, Homo sapiens
acagaactccctt

SEQ ID NO: 1089761 - DNA, 17 bp, Homo sapiens
acagaacttcagaaaga

SEQ ID NO: 1089762 - DNA, 14 bp, Homo sapiens
acagaagaaaagca

SEQ ID NO: 1089763 - DNA, 15 bp, Homo sapiens
acagaagcatttgta

SEQ ID NO: 1089764 - DNA, 23 bp, Homo sapiens
acagaagcatttgtattttgtgt

SEQ ID NO: 1089765 - DNA, 17 bp, Homo sapiens
acagaagccaagctccc

SEQ ID NO: 1089766 - DNA, 21 bp, Homo sapiens
acagaagccaagctccctgga

SEQ ID NO: 1089767 - DNA, 16 bp, Homo sapiens
acagaagccaggagca

SEQ ID NO: 1089768 - DNA, 18 bp, Homo sapiens
acagaagccaggagcaaa

SEQ ID NO: 1089769 - DNA, 13 bp, Homo sapiens
acagaagcttcag

SEQ ID NO: 1089770 - DNA, 14 bp, Homo sapiens
acagaagcttcaga

SEQ ID NO: 1089771 - DNA, 19 bp, Homo sapiens
acagaagcttcagaagttt

SEQ ID NO: 1089772 - DNA, 24 bp, Homo sapiens
acagaaggcaaagtttacagatgt

SEQ ID NO: 1089773 - DNA, 15 bp, Homo sapiens
acagaataaaagttc

SEQ ID NO: 1089774 - DNA, 19 bp, Homo sapiens
acagaatacggaagagcag

SEQ ID NO: 1089775 - DNA, 15 bp, Homo sapiens
acagaatatttttat

SEQ ID NO: 1089776 - DNA, 16 bp, Homo sapiens
acagaatcagtgttaa

SEQ ID NO: 1089777 - DNA, 20 bp, Homo sapiens
acagcccccttgccctccgc

SEQ ID NO: 1089778 - DNA, 23 bp, Homo sapiens
acagcccctatagcactgagctc

SEQ ID NO: 1089779 - DNA, 17 bp, Homo sapiens
acagcccgcaggatcag

SEQ ID NO: 1089780 - DNA, 15 bp, Homo sapiens
acagcccgctctctg

SEQ ID NO: 1089781 - DNA, 23 bp, Homo sapiens
acagccctcagcgtcagacagca

SEQ ID NO: 1089782 - DNA, 14 bp, Homo sapiens
acagccctgcctga

SEQ ID NO: 1089783 - DNA, 21 bp, Homo sapiens
acagccctgtcagtgcagccc

SEQ ID NO: 1089784 - DNA, 13 bp, Homo sapiens
acagccgcagcct

SEQ ID NO: 1089785 - DNA, 23 bp, Homo sapiens
acagccgcagcctccctctgacc

SEQ ID NO: 1089786 - DNA, 18 bp, Homo sapiens
acagccgctcctgtctgc

SEQ ID NO: 1089787 - DNA, 18 bp, Homo sapiens
acagcctatagtaaatgt

SEQ ID NO: 1089788 - DNA, 13 bp, Homo sapiens
acagcctccaggg

SEQ ID NO: 1089789 - DNA, 20 bp, Homo sapiens
acagcctcccccgccagccc

SEQ ID NO: 1089790 - DNA, 15 bp, Homo sapiens
acagcctcccctgcc

SEQ ID NO: 1089791 - DNA, 18 bp, Homo sapiens
acagcctcccctgccagg

SEQ ID NO: 1089792 - DNA, 22 bp, Homo sapiens
acagcctcccctgccagggcag

SEQ ID NO: 1089793 - DNA, 16 bp, Homo sapiens
acagcctccctgagcc

SEQ ID NO: 1089794 - DNA, 18 bp, Homo sapiens
acagcctccctgagcctg

SEQ ID NO: 1089795 - DNA, 14 bp, Homo sapiens
acagcctcggggat

SEQ ID NO: 1089796 - DNA, 21 bp, Homo sapiens
acagcctcggggatggggagg

SEQ ID NO: 1089797 - DNA, 22 bp, Homo sapiens
acagcctctaagcgtgctgaca

SEQ ID NO: 1089798 - DNA, 15 bp, Homo sapiens
acagcctctacagcc

SEQ ID NO: 1089799 - DNA, 14 bp, Homo sapiens
acagcctcttactt

SEQ ID NO: 1089800 - DNA, 20 bp, Homo sapiens
acagcctgacaacatttcta

SEQ ID NO: 1089801 - DNA, 14 bp, Homo sapiens
acagcctgctggca

SEQ ID NO: 1089802 - DNA, 23 bp, Homo sapiens
acagcctgctggcagggccaggg

SEQ ID NO: 1089803 - DNA, 12 bp, Homo sapiens
acagcctggcac

SEQ ID NO: 1089804 - DNA, 14 bp, Homo sapiens
acagcctggcacag

SEQ ID NO: 1089805 - DNA, 20 bp, Homo sapiens
acagcctgggtgacggtcct

SEQ ID NO: 1089806 - DNA, 20 bp, Homo sapiens
acagcctgtggcggtgcctg

SEQ ID NO: 1089807 - DNA, 12 bp, Homo sapiens
acagccttcact

SEQ ID NO: 1089808 - DNA, 18 bp, Homo sapiens
acagccttgggcctttca

SEQ ID NO: 1089809 - DNA, 21 bp, Homo sapiens
acagcctttcgttctgctgac

SEQ ID NO: 1089810 - DNA, 19 bp, Homo sapiens
acagcgacgctcccctgag

SEQ ID NO: 1089811 - DNA, 15 bp, Homo sapiens
acagcgagaggcaga

SEQ ID NO: 1089812 - DNA, 13 bp, Homo sapiens
acagcgagcctgt

SEQ ID NO: 1089813 - DNA, 16 bp, Homo sapiens
acagcgagcctgtgcc

SEQ ID NO: 1089814 - DNA, 21 bp, Homo sapiens
acagcgagcctgtgccttcct

SEQ ID NO: 1089815 - DNA, 15 bp, Homo sapiens
acagcgagggcagct

SEQ ID NO: 1089816 - DNA, 23 bp, Homo sapiens
acagcgagggcagctgctattta

SEQ ID NO: 1089817 - DNA, 22 bp, Homo sapiens
acagcgatggcaggcctgaccc

SEQ ID NO: 1089818 - DNA, 18 bp, Homo sapiens
acagcgccagcctcagac

SEQ ID NO: 1089819 - DNA, 15 bp, Homo sapiens
acagcggaggtgtgg

SEQ ID NO: 1089820 - DNA, 16 bp, Homo sapiens
acagcggaggtgtgga

SEQ ID NO: 1089821 - DNA, 23 bp, Homo sapiens
acagcggcagtgggcctgctgag

SEQ ID NO: 1089822 - DNA, 15 bp, Homo sapiens
acagcggcccctgca

SEQ ID NO: 1089823 - DNA, 16 bp, Homo sapiens
acagcggcccctgcat

SEQ ID NO: 1089824 - DNA, 12 bp, Homo sapiens
acagcggccttg

SEQ ID NO: 1089825 - DNA, 19 bp, Homo sapiens
acagcggctcccctctgct

SEQ ID NO: 1089826 - DNA, 18 bp, Homo sapiens
acagcggtttgcagagaa

SEQ ID NO: 1089827 - DNA, 15 bp, Homo sapiens
acagcgtccctggcg

SEQ ID NO: 1089828 - DNA, 16 bp, Homo sapiens
acagctaccaccctta

SEQ ID NO: 1089829 - DNA, 15 bp, Homo sapiens
acagctacctgagac

SEQ ID NO: 1089830 - DNA, 22 bp, Homo sapiens
acagctactctccccacgaggg

SEQ ID NO: 1089831 - DNA, 23 bp, Homo sapiens
acagctactctccccacgagggc

SEQ ID NO: 1089832 - DNA, 15 bp, Homo sapiens
acagctagacaccta

SEQ ID NO: 1089833 - DNA, 16 bp, Homo sapiens
acagctatgggagccc

SEQ ID NO: 1089834 - DNA, 13 bp, Homo sapiens
acagctatttaga

SEQ ID NO: 1089835 - DNA, 16 bp, Homo sapiens
acagctcactgcagcc

SEQ ID NO: 1089836 - DNA, 19 bp, Homo sapiens
acagctcaggaggcgccct

SEQ ID NO: 1089837 - DNA, 19 bp, Homo sapiens
acagctcattaaacttttt

SEQ ID NO: 1089838 - DNA, 17 bp, Homo sapiens
acagctccaccctggcc

SEQ ID NO: 1089839 - DNA, 18 bp, Homo sapiens
acagctcccaccccaccc

SEQ ID NO: 1089840 - DNA, 22 bp, Homo sapiens
acagctcccaccccaccccctt

SEQ ID NO: 1089841 - DNA, 14 bp, Homo sapiens
acagctcctgccag

SEQ ID NO: 1089842 - DNA, 15 bp, Homo sapiens
acagctcctgccagg

SEQ ID NO: 1089843 - DNA, 16 bp, Homo sapiens
acagctctgagatcct

SEQ ID NO: 1089844 - DNA, 17 bp, Homo sapiens
acagctctgggcctctt

SEQ ID NO: 1089845 - DNA, 16 bp, Homo sapiens
acagctcttaaatgta

SEQ ID NO: 1089846 - DNA, 17 bp, Homo sapiens
acagctcttccagggca

SEQ ID NO: 1089847 - DNA, 18 bp, Homo sapiens
acagctcttccagggcag

SEQ ID NO: 1089848 - DNA, 19 bp, Homo sapiens
acagctcttccagggcagc

SEQ ID NO: 1089849 - DNA, 18 bp, Homo sapiens
acagctgaaagaggagga

SEQ ID NO: 1089850 - DNA, 16 bp, Homo sapiens
acagctgaagagcaag

SEQ ID NO: 1089851 - DNA, 19 bp, Homo sapiens
acagctgagagacttttaa

SEQ ID NO: 1089852 - DNA, 23 bp, Homo sapiens
acagctgagcacccagctctgtc

SEQ ID NO: 1089853 - DNA, 22 bp, Homo sapiens
acagctgaggtctcttgaggga

SEQ ID NO: 1089854 - DNA, 13 bp, Homo sapiens
acagctgcagctg

SEQ ID NO: 1089855 - DNA, 16 bp, Homo sapiens
acagctgcagctgggc

SEQ ID NO: 1089856 - DNA, 18 bp, Homo sapiens
acagctgcagctgggccc

SEQ ID NO: 1089857 - DNA, 16 bp, Homo sapiens
acagctgcattagaaa

SEQ ID NO: 1089858 - DNA, 20 bp, Homo sapiens
acagctgcattagaaaaaga

SEQ ID NO: 1089859 - DNA, 15 bp, Homo sapiens
acagctgccctagct

SEQ ID NO: 1089860 - DNA, 14 bp, Homo sapiens
acagctgccctgct

SEQ ID NO: 1089861 - DNA, 15 bp, Homo sapiens
acagctgccctgctg

SEQ ID NO: 1089862 - DNA, 10 bp, Homo sapiens
acagctgctc

SEQ ID NO: 1089863 - DNA, 14 bp, Homo sapiens
acagctgctggaga

SEQ ID NO: 1089864 - DNA, 13 bp, Homo sapiens
acagctgctgttc

SEQ ID NO: 1089865 - DNA, 11 bp, Homo sapiens
acagctgcttc

SEQ ID NO: 1089866 - DNA, 16 bp, Homo sapiens
acagctgcttctcccc

SEQ ID NO: 1089867 - DNA, 19 bp, Homo sapiens
acagctgcttgtcctgctc

SEQ ID NO: 1089868 - DNA, 21 bp, Homo sapiens
acagctgcttgtcctgctctc

SEQ ID NO: 1089869 - DNA, 13 bp, Homo sapiens
acagctgcttgtg

SEQ ID NO: 1089870 - DNA, 22 bp, Homo sapiens
acagctggaggaatacatttta

SEQ ID NO: 1089871 - DNA, 10 bp, Homo sapiens
acagctggct

SEQ ID NO: 1089872 - DNA, 19 bp, Homo sapiens
acagctggctctgacaaga

SEQ ID NO: 1089873 - DNA, 13 bp, Homo sapiens
acagctgggcagg

SEQ ID NO: 1089874 - DNA, 12 bp, Homo sapiens
acagctggtcct

SEQ ID NO: 1089875 - DNA, 13 bp, Homo sapiens
acagctggtgcca

SEQ ID NO: 1089876 - DNA, 16 bp, Homo sapiens
acagctgtatttatat

SEQ ID NO: 1089877 - DNA, 23 bp, Homo sapiens
acagctgtattttggctttctcc

SEQ ID NO: 1089878 - DNA, 10 bp, Homo sapiens
acagctgtct

SEQ ID NO: 1089879 - DNA, 13 bp, Homo sapiens
acagctgtctgcc

SEQ ID NO: 1089880 - DNA, 15 bp, Homo sapiens
acagctgtctgccag

SEQ ID NO: 1089881 - DNA, 16 bp, Homo sapiens
acagctgtctgccagg

SEQ ID NO: 1089882 - DNA, 18 bp, Homo sapiens
acagctgtctgccaggca

SEQ ID NO: 1089883 - DNA, 19 bp, Homo sapiens
acagctgtctgccaggcac

SEQ ID NO: 1089884 - DNA, 21 bp, Homo sapiens
acagctgtgagccatgcctcc

SEQ ID NO: 1089885 - DNA, 10 bp, Homo sapiens
acagctgtgt

SEQ ID NO: 1089886 - DNA, 16 bp, Homo sapiens
acagctgtgtctgcca

SEQ ID NO: 1089887 - DNA, 15 bp, Homo sapiens
acagctgttcctgtg

SEQ ID NO: 1089888 - DNA, 16 bp, Homo sapiens
acagctgttcctgtgt

SEQ ID NO: 1089889 - DNA, 23 bp, Homo sapiens
acagctgttcctgtgttcttcgt

SEQ ID NO: 1089890 - DNA, 14 bp, Homo sapiens
acagctgtttaaga

SEQ ID NO: 1089891 - DNA, 17 bp, Homo sapiens
acagctgtttaagatgg

SEQ ID NO: 1089892 - DNA, 19 bp, Homo sapiens
acagctgtttaagatgggc

SEQ ID NO: 1089893 - DNA, 21 bp, Homo sapiens
acagcttcaccctgtcaagtt

SEQ ID NO: 1089894 - DNA, 13 bp, Homo sapiens
acagcttcagcta

SEQ ID NO: 1089895 - DNA, 21 bp, Homo sapiens
acagcttcattatctgagttg

SEQ ID NO: 1089896 - DNA, 14 bp, Homo sapiens
acagcttcctcaca

SEQ ID NO: 1089897 - DNA, 20 bp, Homo sapiens
acagcttcctcacacccctg

SEQ ID NO: 1089898 - DNA, 16 bp, Homo sapiens
acagcttctccaagca

SEQ ID NO: 1089899 - DNA, 11 bp, Homo sapiens
acagcttctct

SEQ ID NO: 1089900 - DNA, 14 bp, Homo sapiens
acagcttctctgca

SEQ ID NO: 1089901 - DNA, 16 bp, Homo sapiens
acagcttctctgcagt

SEQ ID NO: 1089902 - DNA, 15 bp, Homo sapiens
acagcttgacctgag

SEQ ID NO: 1089903 - DNA, 21 bp, Homo sapiens
acagcttgagccgggcccctg

SEQ ID NO: 1089904 - DNA, 22 bp, Homo sapiens
acagcttgagccgggcccctgg

SEQ ID NO: 1089905 - DNA, 22 bp, Homo sapiens
acagcttgctgtcacttcttca

SEQ ID NO: 1089906 - DNA, 23 bp, Homo sapiens
acagcttgggtcaggttcttgcc

SEQ ID NO: 1089907 - DNA, 20 bp, Homo sapiens
acagctttcatgattagcaa

SEQ ID NO: 1089908 - DNA, 16 bp, Homo sapiens
acagctttctgggatg

SEQ ID NO: 1089909 - DNA, 21 bp, Homo sapiens
acagctttctgggatgtcaca

SEQ ID NO: 1089910 - DNA, 21 bp, Homo sapiens
acagctttgctccgctcccac

SEQ ID NO: 1089911 - DNA, 19 bp, Homo sapiens
acaggaaaaaaaattctgt

SEQ ID NO: 1089912 - DNA, 22 bp, Homo sapiens
acaggaaaaaaacttttataaa

SEQ ID NO: 1089913 - DNA, 14 bp, Homo sapiens
acaggaaaaataaa

SEQ ID NO: 1089914 - DNA, 18 bp, Homo sapiens
acaggaaaatcctctggc

SEQ ID NO: 1089915 - DNA, 23 bp, Homo sapiens
acaggaaaatgtatccagaggaa

SEQ ID NO: 1089916 - DNA, 15 bp, Homo sapiens
acaggaaagccctcc

SEQ ID NO: 1089917 - DNA, 22 bp, Homo sapiens
acaggaacccttgcatccattg

SEQ ID NO: 1089918 - DNA, 14 bp, Homo sapiens
acaggaagaaagag

SEQ ID NO: 1089919 - DNA, 15 bp, Homo sapiens
acaggaagctggcag

SEQ ID NO: 1089920 - DNA, 21 bp, Homo sapiens
acaggaagctggcagaacgga

SEQ ID NO: 1089921 - DNA, 22 bp, Homo sapiens
acaggaaggcaggaggggtgag

SEQ ID NO: 1089922 - DNA, 17 bp, Homo sapiens
acaggaaggtgcctggc

SEQ ID NO: 1089923 - DNA, 18 bp, Homo sapiens
acaggaaggtgcctggcc

SEQ ID NO: 1089924 - DNA, 19 bp, Homo sapiens
acaggaaggtgcctggcca

SEQ ID NO: 1089925 - DNA, 13 bp, Homo sapiens
acaggaagttgga

SEQ ID NO: 1089926 - DNA, 15 bp, Homo sapiens
acaggaatttttaaa

SEQ ID NO: 1089927 - DNA, 18 bp, Homo sapiens
acaggacacgaaggctgc

SEQ ID NO: 1089928 - DNA, 14 bp, Homo sapiens
acaggacagaatgt

SEQ ID NO: 1089929 - DNA, 17 bp, Homo sapiens
acaggacagtgcttcag

SEQ ID NO: 1089930 - DNA, 20 bp, Homo sapiens
acaggacagtgcttcagcct

SEQ ID NO: 1089931 - DNA, 22 bp, Homo sapiens
acaggacagtgcttcagcctga

SEQ ID NO: 1089932 - DNA, 14 bp, Homo sapiens
acaggacatatatt

SEQ ID NO: 1089933 - DNA, 17 bp, Homo sapiens
acaggacatatattttt

SEQ ID NO: 1089934 - DNA, 22 bp, Homo sapiens
acaggacatgcggtagccagca

SEQ ID NO: 1089935 - DNA, 15 bp, Homo sapiens
acaggaccccagctc

SEQ ID NO: 1089936 - DNA, 16 bp, Homo sapiens
acaggaccccagctct

SEQ ID NO: 1089937 - DNA, 21 bp, Homo sapiens
acaggactgaaaagggaatca

SEQ ID NO: 1089938 - DNA, 19 bp, Homo sapiens
acaggactgagccctctca

SEQ ID NO: 1089939 - DNA, 23 bp, Homo sapiens
acaggactgagccctctcactcc

SEQ ID NO: 1089940 - DNA, 18 bp, Homo sapiens
acaggacttaaaatgaca

SEQ ID NO: 1089941 - DNA, 11 bp, Homo sapiens
acaggagaaat

SEQ ID NO: 1089942 - DNA, 18 bp, Homo sapiens
acaggagacaaaagagca

SEQ ID NO: 1089943 - DNA, 18 bp, Homo sapiens
acaggagcaatcacagga

SEQ ID NO: 1089944 - DNA, 14 bp, Homo sapiens
acaggagcctagcg

SEQ ID NO: 1089945 - DNA, 14 bp, Homo sapiens
acaggaggaggtga

SEQ ID NO: 1089946 - DNA, 15 bp, Homo sapiens
acaggaggctccggc

SEQ ID NO: 1089947 - DNA, 18 bp, Homo sapiens
acaggagggcaagggcca

SEQ ID NO: 1089948 - DNA, 13 bp, Homo sapiens
acaggagggccag

SEQ ID NO: 1089949 - DNA, 14 bp, Homo sapiens
acaggagggccagc

SEQ ID NO: 1089950 - DNA, 13 bp, Homo sapiens
acaggagggcccg

SEQ ID NO: 1089951 - DNA, 23 bp, Homo sapiens
acaggagtcttcagacccagaga

SEQ ID NO: 1089952 - DNA, 17 bp, Homo sapiens
acaggagtgtcctcttc

SEQ ID NO: 1089953 - DNA, 19 bp, Homo sapiens
acaggagttgtgagccctc

SEQ ID NO: 1089954 - DNA, 14 bp, Homo sapiens
acaggataataaaa

SEQ ID NO: 1089955 - DNA, 17 bp, Homo sapiens
acaggataataaaacat

SEQ ID NO: 1089956 - DNA, 22 bp, Homo sapiens
acaggatattaaacgtgtaaat

SEQ ID NO: 1089957 - DNA, 13 bp, Homo sapiens
acaggatccaggc

SEQ ID NO: 1089958 - DNA, 22 bp, Homo sapiens
acaggatctataggcagcttct

SEQ ID NO: 1089959 - DNA, 18 bp, Homo sapiens
acaggatgacctggataa

SEQ ID NO: 1089960 - DNA, 14 bp, Homo sapiens
acaggattattgga

SEQ ID NO: 1089961 - DNA, 14 bp, Homo sapiens
acaggcaaagattt

SEQ ID NO: 1089962 - DNA, 16 bp, Homo sapiens
acaggcaaagttttac

SEQ ID NO: 1089963 - DNA, 18 bp, Homo sapiens
acaggcaactgaggcaga

SEQ ID NO: 1089964 - DNA, 19 bp, Homo sapiens
acaggcaactgaggcagac

SEQ ID NO: 1089965 - DNA, 20 bp, Homo sapiens
acaggcaagtccaccccata

SEQ ID NO: 1089966 - DNA, 12 bp, Homo sapiens
acaggcactcca

SEQ ID NO: 1089967 - DNA, 21 bp, Homo sapiens
acaggcactgaacaggctggg

SEQ ID NO: 1089968 - DNA, 11 bp, Homo sapiens
acaggcagccc

SEQ ID NO: 1089969 - DNA, 22 bp, Homo sapiens
acaggcagcctggacatagaga

SEQ ID NO: 1089970 - DNA, 21 bp, Homo sapiens
acaggcagctggatgagactt

SEQ ID NO: 1089971 - DNA, 16 bp, Homo sapiens
acaggcaggggtgaga

SEQ ID NO: 1089972 - DNA, 15 bp, Homo sapiens
acaggcaggtcacag

SEQ ID NO: 1089973 - DNA, 16 bp, Homo sapiens
acaggcaggtcacaga

SEQ ID NO: 1089974 - DNA, 21 bp, Homo sapiens
acaggcatgggtgcaaggaaa

SEQ ID NO: 1089975 - DNA, 14 bp, Homo sapiens
acaggcatgtgcca

SEQ ID NO: 1089976 - DNA, 22 bp, Homo sapiens
acaggcatgtgccaccacgccc

SEQ ID NO: 1089977 - DNA, 17 bp, Homo sapiens
acaggccatgtgagcca

SEQ ID NO: 1089978 - DNA, 11 bp, Homo sapiens
acaggcccagc

SEQ ID NO: 1089979 - DNA, 18 bp, Homo sapiens
acaggccccacgccctct

SEQ ID NO: 1089980 - DNA, 12 bp, Homo sapiens
acaggccccctt

SEQ ID NO: 1089981 - DNA, 21 bp, Homo sapiens
acaggcccgccctctgcctcc

SEQ ID NO: 1089982 - DNA, 13 bp, Homo sapiens
acaggccctagct

SEQ ID NO: 1089983 - DNA, 12 bp, Homo sapiens
acaggccctccc

SEQ ID NO: 1089984 - DNA, 18 bp, Homo sapiens
acaggccctctgtggcct

SEQ ID NO: 1089985 - DNA, 21 bp, Homo sapiens
acaggccctgctcctgcagca

SEQ ID NO: 1089986 - DNA, 15 bp, Homo sapiens
acaggcctcacctct

SEQ ID NO: 1089987 - DNA, 19 bp, Homo sapiens
acaggcctcacctctaccc

SEQ ID NO: 1089988 - DNA, 20 bp, Homo sapiens
acaggcctcacctctaccca

SEQ ID NO: 1089989 - DNA, 21 bp, Homo sapiens
acaggcctcacctctacccaa

SEQ ID NO: 1089990 - DNA, 13 bp, Homo sapiens
acaggccttctgt

SEQ ID NO: 1089991 - DNA, 17 bp, Homo sapiens
acaggccttctgtgggg

SEQ ID NO: 1089992 - DNA, 19 bp, Homo sapiens
acaggccttctgtggggct

SEQ ID NO: 1089993 - DNA, 22 bp, Homo sapiens
acaggcgtgagccactgttccc

SEQ ID NO: 1089994 - DNA, 18 bp, Homo sapiens
acaggctactctcctcgg

SEQ ID NO: 1089995 - DNA, 21 bp, Homo sapiens
acaggctcgtcagccacctgg

SEQ ID NO: 1089996 - DNA, 14 bp, Homo sapiens
acaggctctagaga

SEQ ID NO: 1089997 - DNA, 17 bp, Homo sapiens
acaggctctagagagag

SEQ ID NO: 1089998 - DNA, 22 bp, Homo sapiens
acaggctctagagagagggaga

SEQ ID NO: 1089999 - DNA, 21 bp, Homo sapiens
acaggctgaaatatccaccca

SEQ ID NO: 1090000 - DNA, 23 bp, Homo sapiens
acaggctgaaatatccacccagc

SEQ ID NO: 1090001 - DNA, 12 bp, Homo sapiens
acaggctgaaga

SEQ ID NO: 1090002 - DNA, 21 bp, Homo sapiens
acaggctgaagagagggacag

SEQ ID NO: 1090003 - DNA, 20 bp, Homo sapiens
acaggctggaatgagggagg

SEQ ID NO: 1090004 - DNA, 15 bp, Homo sapiens
acaggctggcattct

SEQ ID NO: 1090005 - DNA, 14 bp, Homo sapiens
acaggctgggtcaa

SEQ ID NO: 1090006 - DNA, 23 bp, Homo sapiens
acagggaagaaactttctggtgc

SEQ ID NO: 1090007 - DNA, 17 bp, Homo sapiens
acagggaatgctgaggc

SEQ ID NO: 1090008 - DNA, 15 bp, Homo sapiens
acagggacaaagaaa

SEQ ID NO: 1090009 - DNA, 20 bp, Homo sapiens
acagggacatgccctgtgtg

SEQ ID NO: 1090010 - DNA, 22 bp, Homo sapiens
acagggactgaaaacctctcct

SEQ ID NO: 1090011 - DNA, 13 bp, Homo sapiens
acagggacttgaa

SEQ ID NO: 1090012 - DNA, 12 bp, Homo sapiens
acagggagggga

SEQ ID NO: 1090013 - DNA, 17 bp, Homo sapiens
acagggagggggacctg

SEQ ID NO: 1090014 - DNA, 21 bp, Homo sapiens
acagggagggggacctgtccc

SEQ ID NO: 1090015 - DNA, 22 bp, Homo sapiens
acagggataaggcctgtggggg

SEQ ID NO: 1090016 - DNA, 23 bp, Homo sapiens
acagggatctgtttgaacactta

SEQ ID NO: 1090017 - DNA, 23 bp, Homo sapiens
acagggcaaaatcgccataggcc

SEQ ID NO: 1090018 - DNA, 13 bp, Homo sapiens
acagggcagaaat

SEQ ID NO: 1090019 - DNA, 17 bp, Homo sapiens
acagggcagagcaggaa

SEQ ID NO: 1090020 - DNA, 11 bp, Homo sapiens
acagggcagca

SEQ ID NO: 1090021 - DNA, 15 bp, Homo sapiens
acagtttatttgttg

SEQ ID NO: 1090022 - DNA, 15 bp, Homo sapiens
acagtttatttttat

SEQ ID NO: 1090023 - DNA, 20 bp, Homo sapiens
acagtttcagagagtcaatg

SEQ ID NO: 1090024 - DNA, 24 bp, Homo sapiens
acagtttcagagagtcaatgtcat

SEQ ID NO: 1090025 - DNA, 23 bp, Homo sapiens
acagtttcttgcttggaagccag

SEQ ID NO: 1090026 - DNA, 19 bp, Homo sapiens
acagtttcttttttcttac

SEQ ID NO: 1090027 - DNA, 15 bp, Homo sapiens
acagtttgaacaaaa

SEQ ID NO: 1090028 - DNA, 15 bp, Homo sapiens
acagtttgacttttt

SEQ ID NO: 1090029 - DNA, 20 bp, Homo sapiens
acagtttgttagtatgaggc

SEQ ID NO: 1090030 - DNA, 13 bp, Homo sapiens
acagttttaactg

SEQ ID NO: 1090031 - DNA, 21 bp, Homo sapiens
acagttttaactgtggatatt

SEQ ID NO: 1090032 - DNA, 12 bp, Homo sapiens
acagttttaata

SEQ ID NO: 1090033 - DNA, 15 bp, Homo sapiens
acagttttataattt

SEQ ID NO: 1090034 - DNA, 21 bp, Homo sapiens
acagttttcagaaaaagaaat

SEQ ID NO: 1090035 - DNA, 15 bp, Homo sapiens
acagttttccatgaa

SEQ ID NO: 1090036 - DNA, 22 bp, Homo sapiens
acagttttccttctcatctgtg

SEQ ID NO: 1090037 - DNA, 16 bp, Homo sapiens
acagttttctagcaat

SEQ ID NO: 1090038 - DNA, 13 bp, Homo sapiens
acagttttgtgaa

SEQ ID NO: 1090039 - DNA, 12 bp, Homo sapiens
acagtttttaaa

SEQ ID NO: 1090040 - DNA, 14 bp, Homo sapiens
acagtttttaaact

SEQ ID NO: 1090041 - DNA, 14 bp, Homo sapiens
acataaaaaggaac

SEQ ID NO: 1090042 - DNA, 21 bp, Homo sapiens
acataaaaaggacatcagcaa

SEQ ID NO: 1090043 - DNA, 23 bp, Homo sapiens
acataaaacaaaaccaagccttg

SEQ ID NO: 1090044 - DNA, 16 bp, Homo sapiens
acataaaactttaaaa

SEQ ID NO: 1090045 - DNA, 21 bp, Homo sapiens
acataaaactttaaaaggcaa

SEQ ID NO: 1090046 - DNA, 15 bp, Homo sapiens
acataaaagaaataa

SEQ ID NO: 1090047 - DNA, 17 bp, Homo sapiens
acataaaagaaataaac

SEQ ID NO: 1090048 - DNA, 14 bp, Homo sapiens
acataaaatctgtg

SEQ ID NO: 1090049 - DNA, 16 bp, Homo sapiens
acataaaccatttttg

SEQ ID NO: 1090050 - DNA, 15 bp, Homo sapiens
acataaactgacttt

SEQ ID NO: 1090051 - DNA, 21 bp, Homo sapiens
acataaagactgtgctgagaa

SEQ ID NO: 1090052 - DNA, 12 bp, Homo sapiens
acataaagttga

SEQ ID NO: 1090053 - DNA, 15 bp, Homo sapiens
acataaagttgataa

SEQ ID NO: 1090054 - DNA, 16 bp, Homo sapiens
acataaatcacagaaa

SEQ ID NO: 1090055 - DNA, 12 bp, Homo sapiens
acataaatgctc

SEQ ID NO: 1090056 - DNA, 14 bp, Homo sapiens
acataaattccaga

SEQ ID NO: 1090057 - DNA, 14 bp, Homo sapiens
acataacaacaaca

SEQ ID NO: 1090058 - DNA, 20 bp, Homo sapiens
acataaccaacattaaaact

SEQ ID NO: 1090059 - DNA, 13 bp, Homo sapiens
acataactgcttc

SEQ ID NO: 1090060 - DNA, 14 bp, Homo sapiens
acataactgcttct

SEQ ID NO: 1090061 - DNA, 21 bp, Homo sapiens
acataactgcttcttggagct

SEQ ID NO: 1090062 - DNA, 17 bp, Homo sapiens
acataactggattttga

SEQ ID NO: 1090063 - DNA, 14 bp, Homo sapiens
acataagaccataa

SEQ ID NO: 1090064 - DNA, 19 bp, Homo sapiens
acataagaccgtgtcccaa

SEQ ID NO: 1090065 - DNA, 18 bp, Homo sapiens
acataagccattattcac

SEQ ID NO: 1090066 - DNA, 14 bp, Homo sapiens
acataagctcagaa

SEQ ID NO: 1090067 - DNA, 15 bp, Homo sapiens
acataaggagaatgt

SEQ ID NO: 1090068 - DNA, 15 bp, Homo sapiens
acataaggatgactt

SEQ ID NO: 1090069 - DNA, 16 bp, Homo sapiens
acataaggatgacttt

SEQ ID NO: 1090070 - DNA, 23 bp, Homo sapiens
acataagtaacttttaaaatttg

SEQ ID NO: 1090071 - DNA, 23 bp, Homo sapiens
acataataaaaaattatgacaat

SEQ ID NO: 1090072 - DNA, 19 bp, Homo sapiens
acataatctagtttacaga

SEQ ID NO: 1090073 - DNA, 22 bp, Homo sapiens
acataatctagtttacagaaaa

SEQ ID NO: 1090074 - DNA, 22 bp, Homo sapiens
acataatgggccactgaaatct

SEQ ID NO: 1090075 - DNA, 17 bp, Homo sapiens
acataatttttgtacat

SEQ ID NO: 1090076 - DNA, 17 bp, Homo sapiens
acatacaacacaaagag

SEQ ID NO: 1090077 - DNA, 18 bp, Homo sapiens
acatacaacacaaagaga

SEQ ID NO: 1090078 - DNA, 14 bp, Homo sapiens
acatacaagaaaat

SEQ ID NO: 1090079 - DNA, 16 bp, Homo sapiens
acatacaagaaaatgt

SEQ ID NO: 1090080 - DNA, 18 bp, Homo sapiens
acatacaagaaaatgtat

SEQ ID NO: 1090081 - DNA, 16 bp, Homo sapiens
acatacaattattttt

SEQ ID NO: 1090082 - DNA, 16 bp, Homo sapiens
acatacaattccaaac

SEQ ID NO: 1090083 - DNA, 13 bp, Homo sapiens
acatacaccagca

SEQ ID NO: 1090084 - DNA, 22 bp, Homo sapiens
acatacacccaaacacttacac

SEQ ID NO: 1090085 - DNA, 20 bp, Homo sapiens
acatacagagatatacaaat

SEQ ID NO: 1090086 - DNA, 18 bp, Homo sapiens
acatacagattttaccta

SEQ ID NO: 1090087 - DNA, 20 bp, Homo sapiens
acatacataatgtttttcct

SEQ ID NO: 1090088 - DNA, 13 bp, Homo sapiens
acatacatacaca

SEQ ID NO: 1090089 - DNA, 13 bp, Homo sapiens
acatacatacata

SEQ ID NO: 1090090 - DNA, 15 bp, Homo sapiens
acatacatacataca

SEQ ID NO: 1090091 - DNA, 17 bp, Homo sapiens
acatacatacatacata

SEQ ID NO: 1090092 - DNA, 18 bp, Homo sapiens
acatacatatatatctga

SEQ ID NO: 1090093 - DNA, 17 bp, Homo sapiens
acatacatgctactttt

SEQ ID NO: 1090094 - DNA, 15 bp, Homo sapiens
acataccagcttaga

SEQ ID NO: 1090095 - DNA, 22 bp, Homo sapiens
acatacccacacattccagggc

SEQ ID NO: 1090096 - DNA, 19 bp, Homo sapiens
acatacctaccagtattat

SEQ ID NO: 1090097 - DNA, 12 bp, Homo sapiens
acatacgtgtta

SEQ ID NO: 1090098 - DNA, 18 bp, Homo sapiens
acatacgtgttaggaggc

SEQ ID NO: 1090099 - DNA, 12 bp, Homo sapiens
acatactcattt

SEQ ID NO: 1090100 - DNA, 14 bp, Homo sapiens
acatactcattttt

SEQ ID NO: 1090101 - DNA, 13 bp, Homo sapiens
acatactgctgga

SEQ ID NO: 1090102 - DNA, 16 bp, Homo sapiens
acatactgctggagtc

SEQ ID NO: 1090103 - DNA, 12 bp, Homo sapiens
acatactgctgt

SEQ ID NO: 1090104 - DNA, 13 bp, Homo sapiens
acatactggcctc

SEQ ID NO: 1090105 - DNA, 17 bp, Homo sapiens
acatactggcctctgtg

SEQ ID NO: 1090106 - DNA, 19 bp, Homo sapiens
acatactggcctggactgt

SEQ ID NO: 1090107 - DNA, 15 bp, Homo sapiens
acatactgtattttt

SEQ ID NO: 1090108 - DNA, 15 bp, Homo sapiens
acatactgtgttcca

SEQ ID NO: 1090109 - DNA, 14 bp, Homo sapiens
acatacttacattt

SEQ ID NO: 1090110 - DNA, 23 bp, Homo sapiens
acatacttacatttcagacatat

SEQ ID NO: 1090111 - DNA, 20 bp, Homo sapiens
acatacttcaaaaataatgt

SEQ ID NO: 1090112 - DNA, 22 bp, Homo sapiens
acatacttcaaaaataatgtgc

SEQ ID NO: 1090113 - DNA, 12 bp, Homo sapiens
acatacttttgc

SEQ ID NO: 1090114 - DNA, 12 bp, Homo sapiens
acatagaaagtt

SEQ ID NO: 1090115 - DNA, 20 bp, Homo sapiens
acatagaaatggaaattttg

SEQ ID NO: 1090116 - DNA, 14 bp, Homo sapiens
acatagaacacttc

SEQ ID NO: 1090117 - DNA, 15 bp, Homo sapiens
acatagaacatgtgt

SEQ ID NO: 1090118 - DNA, 18 bp, Homo sapiens
acatagacagaagaaaca

SEQ ID NO: 1090119 - DNA, 16 bp, Homo sapiens
acatagacatttcaaa

SEQ ID NO: 1090120 - DNA, 22 bp, Homo sapiens
acatagagctttttaatagcac

SEQ ID NO: 1090121 - DNA, 20 bp, Homo sapiens
acatagatcagccattaaaa

SEQ ID NO: 1090122 - DNA, 21 bp, Homo sapiens
acatagatcagccattaaaat

SEQ ID NO: 1090123 - DNA, 22 bp, Homo sapiens
acatagcatgcttcctttctct

SEQ ID NO: 1090124 - DNA, 23 bp, Homo sapiens
acatagcgccgtgctgtaaataa

SEQ ID NO: 1090125 - DNA, 13 bp, Homo sapiens
acataggaaggga

SEQ ID NO: 1090126 - DNA, 20 bp, Homo sapiens
acataggaagggatctgaga

SEQ ID NO: 1090127 - DNA, 21 bp, Homo sapiens
acataggaagggatctgagaa

SEQ ID NO: 1090128 - DNA, 16 bp, Homo sapiens
acataggcacaggcaa

SEQ ID NO: 1090129 - DNA, 14 bp, Homo sapiens
acataggccaaggc

SEQ ID NO: 1090130 - DNA, 19 bp, Homo sapiens
acataggctggtggccttg

SEQ ID NO: 1090131 - DNA, 19 bp, Homo sapiens
acataggcttctattacct

SEQ ID NO: 1090132 - DNA, 18 bp, Homo sapiens
acatagtctgaagtgaag

SEQ ID NO: 1090133 - DNA, 15 bp, Homo sapiens
acatagtctgttcct

SEQ ID NO: 1090134 - DNA, 16 bp, Homo sapiens
acatagtgatggttcc

SEQ ID NO: 1090135 - DNA, 21 bp, Homo sapiens
acatagtgatggttcccctgt

SEQ ID NO: 1090136 - DNA, 19 bp, Homo sapiens
acatagtgcaaaactgtgt

SEQ ID NO: 1090137 - DNA, 16 bp, Homo sapiens
acatagtgtcctgccc

SEQ ID NO: 1090138 - DNA, 20 bp, Homo sapiens
acatagtgtcctgcccaccc

SEQ ID NO: 1090139 - DNA, 15 bp, Homo sapiens
acatagttatttatt

SEQ ID NO: 1090140 - DNA, 17 bp, Homo sapiens
acatagttcgtttacct

SEQ ID NO: 1090141 - DNA, 21 bp, Homo sapiens
acatagttggtaatgcttgga

SEQ ID NO: 1090142 - DNA, 20 bp, Homo sapiens
acatataaacatcacacaca

SEQ ID NO: 1090143 - DNA, 19 bp, Homo sapiens
acatcctttctaaacaaga

SEQ ID NO: 1090144 - DNA, 21 bp, Homo sapiens
acatcgcaatagttttttact

SEQ ID NO: 1090145 - DNA, 15 bp, Homo sapiens
acatcgcactgtgga

SEQ ID NO: 1090146 - DNA, 15 bp, Homo sapiens
acatctaagcctgaa

SEQ ID NO: 1090147 - DNA, 23 bp, Homo sapiens
acatctaatgtctcttcctctgt

SEQ ID NO: 1090148 - DNA, 16 bp, Homo sapiens
acatctatagagataa

SEQ ID NO: 1090149 - DNA, 22 bp, Homo sapiens
acatctcagaccctttagccaa

SEQ ID NO: 1090150 - DNA, 18 bp, Homo sapiens
acatctccagtgtgccag

SEQ ID NO: 1090151 - DNA, 22 bp, Homo sapiens
acatctcccccatagcaccctg

SEQ ID NO: 1090152 - DNA, 16 bp, Homo sapiens
acatctcgagccccct

SEQ ID NO: 1090153 - DNA, 18 bp, Homo sapiens
acatctctctgccctctc

SEQ ID NO: 1090154 - DNA, 23 bp, Homo sapiens
acatctctctgccctctccctgt

SEQ ID NO: 1090155 - DNA, 13 bp, Homo sapiens
acatctctgcagt

SEQ ID NO: 1090156 - DNA, 13 bp, Homo sapiens
acatctctggaaa

SEQ ID NO: 1090157 - DNA, 14 bp, Homo sapiens
acatctctggagcc

SEQ ID NO: 1090158 - DNA, 15 bp, Homo sapiens
acatctctggagcca

SEQ ID NO: 1090159 - DNA, 19 bp, Homo sapiens
acatctctggagccagaga

SEQ ID NO: 1090160 - DNA, 18 bp, Homo sapiens
acatctctggcccagaaa

SEQ ID NO: 1090161 - DNA, 15 bp, Homo sapiens
acatctcttgaaacc

SEQ ID NO: 1090162 - DNA, 14 bp, Homo sapiens
acatctgccagacc

SEQ ID NO: 1090163 - DNA, 16 bp, Homo sapiens
acatctgcctcctctc

SEQ ID NO: 1090164 - DNA, 12 bp, Homo sapiens
acatctgcctta

SEQ ID NO: 1090165 - DNA, 13 bp, Homo sapiens
acatctggccctg

SEQ ID NO: 1090166 - DNA, 16 bp, Homo sapiens
acatctgggtgccctg

SEQ ID NO: 1090167 - DNA, 17 bp, Homo sapiens
acatctgggtgccctga

SEQ ID NO: 1090168 - DNA, 16 bp, Homo sapiens
acatctgtcctcaccc

SEQ ID NO: 1090169 - DNA, 23 bp, Homo sapiens
acatctgtcctcaccctgtggga

SEQ ID NO: 1090170 - DNA, 16 bp, Homo sapiens
acatctgttttaaatt

SEQ ID NO: 1090171 - DNA, 11 bp, Homo sapiens
acatcttaaat

SEQ ID NO: 1090172 - DNA, 17 bp, Homo sapiens
acatcttattgaataaa

SEQ ID NO: 1090173 - DNA, 13 bp, Homo sapiens
acatcttcaaagc

SEQ ID NO: 1090174 - DNA, 16 bp, Homo sapiens
acatcttcagcaaata

SEQ ID NO: 1090175 - DNA, 22 bp, Homo sapiens
acatcttctcaaccttatcaag

SEQ ID NO: 1090176 - DNA, 18 bp, Homo sapiens
acatcttgcctacttttc

SEQ ID NO: 1090177 - DNA, 21 bp, Homo sapiens
acatcttgctctgcatttata

SEQ ID NO: 1090178 - DNA, 15 bp, Homo sapiens
acatctttactcagg

SEQ ID NO: 1090179 - DNA, 17 bp, Homo sapiens
acatctttatctgttct

SEQ ID NO: 1090180 - DNA, 16 bp, Homo sapiens
acatctttattgaaat

SEQ ID NO: 1090181 - DNA, 11 bp, Homo sapiens
acatctttccc

SEQ ID NO: 1090182 - DNA, 22 bp, Homo sapiens
acatgaaaaacacggcagctgt

SEQ ID NO: 1090183 - DNA, 15 bp, Homo sapiens
acatgaaaacacatt

SEQ ID NO: 1090184 - DNA, 18 bp, Homo sapiens
acatgaaaattttaaaaa

SEQ ID NO: 1090185 - DNA, 20 bp, Homo sapiens
acatgaaactgaataaggag

SEQ ID NO: 1090186 - DNA, 16 bp, Homo sapiens
acatgaaagttttgca

SEQ ID NO: 1090187 - DNA, 13 bp, Homo sapiens
acatgaaatgccc

SEQ ID NO: 1090188 - DNA, 16 bp, Homo sapiens
acatgaagaagctaaa

SEQ ID NO: 1090189 - DNA, 16 bp, Homo sapiens
acatgaagaatgcatt

SEQ ID NO: 1090190 - DNA, 16 bp, Homo sapiens
acatgaagcataattt

SEQ ID NO: 1090191 - DNA, 13 bp, Homo sapiens
acatgaagctgtt

SEQ ID NO: 1090192 - DNA, 15 bp, Homo sapiens
acatgaagcttcatg

SEQ ID NO: 1090193 - DNA, 13 bp, Homo sapiens
acatgaaggtaaa

SEQ ID NO: 1090194 - DNA, 16 bp, Homo sapiens
acatgaaggtaaataa

SEQ ID NO: 1090195 - DNA, 22 bp, Homo sapiens
acatgaaggtaaataaaaagaa

SEQ ID NO: 1090196 - DNA, 13 bp, Homo sapiens
acatgaatactat

SEQ ID NO: 1090197 - DNA, 18 bp, Homo sapiens
acatgaattgcattttac

SEQ ID NO: 1090198 - DNA, 15 bp, Homo sapiens
acatgacaactttgc

SEQ ID NO: 1090199 - DNA, 19 bp, Homo sapiens
acatgacagatattttatc

SEQ ID NO: 1090200 - DNA, 20 bp, Homo sapiens
acatgacccagcctgaaaga

SEQ ID NO: 1090201 - DNA, 19 bp, Homo sapiens
acatgaccctaaatcttga

SEQ ID NO: 1090202 - DNA, 14 bp, Homo sapiens
acatgaccctctgt

SEQ ID NO: 1090203 - DNA, 17 bp, Homo sapiens
acatgaccctctgtccc

SEQ ID NO: 1090204 - DNA, 15 bp, Homo sapiens
acatgactgggcctc

SEQ ID NO: 1090205 - DNA, 15 bp, Homo sapiens
acatgagaaagatgt

SEQ ID NO: 1090206 - DNA, 15 bp, Homo sapiens
acatgagaaagggag

SEQ ID NO: 1090207 - DNA, 16 bp, Homo sapiens
acatgagaaagggaga

SEQ ID NO: 1090208 - DNA, 15 bp, Homo sapiens
acatgagaacaaaca

SEQ ID NO: 1090209 - DNA, 19 bp, Homo sapiens
acatgagatggagaggctg

SEQ ID NO: 1090210 - DNA, 22 bp, Homo sapiens
acatgagctatttccattccag

SEQ ID NO: 1090211 - DNA, 13 bp, Homo sapiens
acatgaggactct

SEQ ID NO: 1090212 - DNA, 21 bp, Homo sapiens
acatgaggactctattcttta

SEQ ID NO: 1090213 - DNA, 22 bp, Homo sapiens
acatgagtagataatttcaggg

SEQ ID NO: 1090214 - DNA, 22 bp, Homo sapiens
acatgagtctgtaggagcaagg

SEQ ID NO: 1090215 - DNA, 14 bp, Homo sapiens
acatgatacatttt

SEQ ID NO: 1090216 - DNA, 15 bp, Homo sapiens
acatgatacattttt

SEQ ID NO: 1090217 - DNA, 15 bp, Homo sapiens
acatgatcttcttta

SEQ ID NO: 1090218 - DNA, 17 bp, Homo sapiens
acatgatcttctttata

SEQ ID NO: 1090219 - DNA, 17 bp, Homo sapiens
acatgatgcaaactgtg

SEQ ID NO: 1090220 - DNA, 19 bp, Homo sapiens
acatgatgttaactttgtg

SEQ ID NO: 1090221 - DNA, 21 bp, Homo sapiens
acatgatttagggaagcaggg

SEQ ID NO: 1090222 - DNA, 13 bp, Homo sapiens
acatgatttcaaa

SEQ ID NO: 1090223 - DNA, 13 bp, Homo sapiens
acatgatttcctt

SEQ ID NO: 1090224 - DNA, 16 bp, Homo sapiens
acatgatttccttgaa

SEQ ID NO: 1090225 - DNA, 21 bp, Homo sapiens
acatgatttccttgaatgtgg

SEQ ID NO: 1090226 - DNA, 15 bp, Homo sapiens
acatgcacacacttg

SEQ ID NO: 1090227 - DNA, 16 bp, Homo sapiens
acatgcacatttatat

SEQ ID NO: 1090228 - DNA, 18 bp, Homo sapiens
acatgcacatttatatat

SEQ ID NO: 1090229 - DNA, 17 bp, Homo sapiens
acatgcagcccatgccc

SEQ ID NO: 1090230 - DNA, 18 bp, Homo sapiens
acatgcagcccatgccca

SEQ ID NO: 1090231 - DNA, 18 bp, Homo sapiens
acatgcatataatgaata

SEQ ID NO: 1090232 - DNA, 16 bp, Homo sapiens
acatgccccctccctt

SEQ ID NO: 1090233 - DNA, 12 bp, Homo sapiens
acatgccccctg

SEQ ID NO: 1090234 - DNA, 16 bp, Homo sapiens
acatgcccctccccca

SEQ ID NO: 1090235 - DNA, 18 bp, Homo sapiens
acatgcccctcccccagc

SEQ ID NO: 1090236 - DNA, 21 bp, Homo sapiens
acatgcccctcccccagctgc

SEQ ID NO: 1090237 - DNA, 22 bp, Homo sapiens
acatgcccctcccccagctgcg

SEQ ID NO: 1090238 - DNA, 21 bp, Homo sapiens
acatgccctcccttctccctg

SEQ ID NO: 1090239 - DNA, 18 bp, Homo sapiens
acatgccctcctggacaa

SEQ ID NO: 1090240 - DNA, 20 bp, Homo sapiens
acatgcctgcgcctgctgcc

SEQ ID NO: 1090241 - DNA, 13 bp, Homo sapiens
acatgccttggtg

SEQ ID NO: 1090242 - DNA, 13 bp, Homo sapiens
acatgcgggctcg

SEQ ID NO: 1090243 - DNA, 18 bp, Homo sapiens
acatgcggtagccagcac

SEQ ID NO: 1090244 - DNA, 23 bp, Homo sapiens
acatgcggtagccagcacacagg

SEQ ID NO: 1090245 - DNA, 14 bp, Homo sapiens
acatgcgtgtgtca

SEQ ID NO: 1090246 - DNA, 15 bp, Homo sapiens
acatgctaaagccag

SEQ ID NO: 1090247 - DNA, 15 bp, Homo sapiens
acatgctacacactg

SEQ ID NO: 1090248 - DNA, 22 bp, Homo sapiens
acatgctacacactgcatgttt

SEQ ID NO: 1090249 - DNA, 15 bp, Homo sapiens
acatgctatgttctg

SEQ ID NO: 1090250 - DNA, 22 bp, Homo sapiens
acatgctatgttctgtcttccc

SEQ ID NO: 1090251 - DNA, 16 bp, Homo sapiens
acatgctccagattag

SEQ ID NO: 1090252 - DNA, 20 bp, Homo sapiens
acatgctgaggttttgaata

SEQ ID NO: 1090253 - DNA, 13 bp, Homo sapiens
acatgctgcctgg

SEQ ID NO: 1090254 - DNA, 16 bp, Homo sapiens
acatgctgcctggcac

SEQ ID NO: 1090255 - DNA, 22 bp, Homo sapiens
acatgctgcctggcacagacca

SEQ ID NO: 1090256 - DNA, 23 bp, Homo sapiens
acatgctgcctggcacagaccag

SEQ ID NO: 1090257 - DNA, 17 bp, Homo sapiens
acatgctgtctggccct

SEQ ID NO: 1090258 - DNA, 20 bp, Homo sapiens
acatgctgtgctctttgaag

SEQ ID NO: 1090259 - DNA, 21 bp, Homo sapiens
acatgctgtgctctttgaaga

SEQ ID NO: 1090260 - DNA, 20 bp, Homo sapiens
acatgcttactttttaattt

SEQ ID NO: 1090261 - DNA, 21 bp, Homo sapiens
acatggaatcgaagtgtttat

SEQ ID NO: 1090262 - DNA, 13 bp, Homo sapiens
acatggaccagca

SEQ ID NO: 1090263 - DNA, 23 bp, Homo sapiens
acatggaccagcatctggtcttg

SEQ ID NO: 1090264 - DNA, 13 bp, Homo sapiens
acatggacccgga

SEQ ID NO: 1090265 - DNA, 17 bp, Homo sapiens
acattcatgtaactctc

SEQ ID NO: 1090266 - DNA, 14 bp, Homo sapiens
acattccagccagg

SEQ ID NO: 1090267 - DNA, 16 bp, Homo sapiens
acattccagccaggcc

SEQ ID NO: 1090268 - DNA, 19 bp, Homo sapiens
acattccagccaggcccag

SEQ ID NO: 1090269 - DNA, 22 bp, Homo sapiens
acattccagccaggcccaggcc

SEQ ID NO: 1090270 - DNA, 17 bp, Homo sapiens
acattcccatctgtcac

SEQ ID NO: 1090271 - DNA, 13 bp, Homo sapiens
acattccctctcc

SEQ ID NO: 1090272 - DNA, 15 bp, Homo sapiens
acattccctctcctg

SEQ ID NO: 1090273 - DNA, 18 bp, Homo sapiens
acattccctctcctgccc

SEQ ID NO: 1090274 - DNA, 21 bp, Homo sapiens
acattccctctcctgcccaga

SEQ ID NO: 1090275 - DNA, 17 bp, Homo sapiens
acattcctaactagaat

SEQ ID NO: 1090276 - DNA, 19 bp, Homo sapiens
acattcctaactagaatta

SEQ ID NO: 1090277 - DNA, 21 bp, Homo sapiens
acattcctaactagaattagt

SEQ ID NO: 1090278 - DNA, 15 bp, Homo sapiens
acattcctcagctgc

SEQ ID NO: 1090279 - DNA, 16 bp, Homo sapiens
acattcctcagctgcc

SEQ ID NO: 1090280 - DNA, 23 bp, Homo sapiens
acattcctccagcctcccctccc

SEQ ID NO: 1090281 - DNA, 19 bp, Homo sapiens
acattcctggccccgggct

SEQ ID NO: 1090282 - DNA, 14 bp, Homo sapiens
acattcgatctcat

SEQ ID NO: 1090283 - DNA, 19 bp, Homo sapiens
acattcgatctcattcagt

SEQ ID NO: 1090284 - DNA, 15 bp, Homo sapiens
acattcggctccctg

SEQ ID NO: 1090285 - DNA, 17 bp, Homo sapiens
acattcggctccctgga

SEQ ID NO: 1090286 - DNA, 15 bp, Homo sapiens
acattcgtgagctgg

SEQ ID NO: 1090287 - DNA, 17 bp, Homo sapiens
acattctagctgagaag

SEQ ID NO: 1090288 - DNA, 14 bp, Homo sapiens
acattctatctact

SEQ ID NO: 1090289 - DNA, 18 bp, Homo sapiens
acattctatctactgatt

SEQ ID NO: 1090290 - DNA, 17 bp, Homo sapiens
acattctatgacatttt

SEQ ID NO: 1090291 - DNA, 22 bp, Homo sapiens
acattctattttgggtattaat

SEQ ID NO: 1090292 - DNA, 20 bp, Homo sapiens
acattctgaatgcttctaag

SEQ ID NO: 1090293 - DNA, 21 bp, Homo sapiens
acattctgaatgcttctaagt

SEQ ID NO: 1090294 - DNA, 16 bp, Homo sapiens
acattctgatgagcaa

SEQ ID NO: 1090295 - DNA, 19 bp, Homo sapiens
acattctgcaatggcagca

SEQ ID NO: 1090296 - DNA, 12 bp, Homo sapiens
acattctgcttt

SEQ ID NO: 1090297 - DNA, 13 bp, Homo sapiens
acattctggatct

SEQ ID NO: 1090298 - DNA, 19 bp, Homo sapiens
acattctggatctgaccct

SEQ ID NO: 1090299 - DNA, 14 bp, Homo sapiens
acattctgtaaaat

SEQ ID NO: 1090300 - DNA, 19 bp, Homo sapiens
acattcttattaattcttc

SEQ ID NO: 1090301 - DNA, 14 bp, Homo sapiens
acattcttccatca

SEQ ID NO: 1090302 - DNA, 19 bp, Homo sapiens
acattcttccatcatcact

SEQ ID NO: 1090303 - DNA, 20 bp, Homo sapiens
acattcttggcttaatcatt

SEQ ID NO: 1090304 - DNA, 23 bp, Homo sapiens
acattcttggttgttaatttaga

SEQ ID NO: 1090305 - DNA, 11 bp, Homo sapiens
acattctttat

SEQ ID NO: 1090306 - DNA, 18 bp, Homo sapiens
acattctttataaaatgt

SEQ ID NO: 1090307 - DNA, 19 bp, Homo sapiens
acattctttataaaatgta

SEQ ID NO: 1090308 - DNA, 16 bp, Homo sapiens
acattctttattctgc

SEQ ID NO: 1090309 - DNA, 19 bp, Homo sapiens
acattcttttaacttcttt

SEQ ID NO: 1090310 - DNA, 20 bp, Homo sapiens
acattcttttaacttctttc

SEQ ID NO: 1090311 - DNA, 12 bp, Homo sapiens
acattgaaagag

SEQ ID NO: 1090312 - DNA, 17 bp, Homo sapiens
acattgaaatctaggaa

SEQ ID NO: 1090313 - DNA, 20 bp, Homo sapiens
acattgaaatctaggaaaat

SEQ ID NO: 1090314 - DNA, 23 bp, Homo sapiens
acattgaaatctaggaaaattat

SEQ ID NO: 1090315 - DNA, 12 bp, Homo sapiens
acattgaagaat

SEQ ID NO: 1090316 - DNA, 16 bp, Homo sapiens
acattgaccaagaact

SEQ ID NO: 1090317 - DNA, 18 bp, Homo sapiens
acattgaccaagaactgc

SEQ ID NO: 1090318 - DNA, 17 bp, Homo sapiens
acattgagactttcttc

SEQ ID NO: 1090319 - DNA, 18 bp, Homo sapiens
acattgcactcatcatat

SEQ ID NO: 1090320 - DNA, 22 bp, Homo sapiens
acattgcactttataaacactg

SEQ ID NO: 1090321 - DNA, 23 bp, Homo sapiens
acattgcagagtggcctagagca

SEQ ID NO: 1090322 - DNA, 19 bp, Homo sapiens
acattgcatataacttata

SEQ ID NO: 1090323 - DNA, 23 bp, Homo sapiens
acattgccaaaaaggatacataa

SEQ ID NO: 1090324 - DNA, 22 bp, Homo sapiens
acattgccatgtaactatgtat

SEQ ID NO: 1090325 - DNA, 20 bp, Homo sapiens
acattgcccatggctgggaa

SEQ ID NO: 1090326 - DNA, 11 bp, Homo sapiens
acattgcctca

SEQ ID NO: 1090327 - DNA, 13 bp, Homo sapiens
acattgcctgttc

SEQ ID NO: 1090328 - DNA, 17 bp, Homo sapiens
acattgcctgttctgct

SEQ ID NO: 1090329 - DNA, 18 bp, Homo sapiens
acattgcctgttctgctt

SEQ ID NO: 1090330 - DNA, 14 bp, Homo sapiens
acattgccttcctc

SEQ ID NO: 1090331 - DNA, 18 bp, Homo sapiens
acattgccttctggagct

SEQ ID NO: 1090332 - DNA, 12 bp, Homo sapiens
acattgcctttg

SEQ ID NO: 1090333 - DNA, 23 bp, Homo sapiens
acattgcctttgaatgttaattt

SEQ ID NO: 1090334 - DNA, 23 bp, Homo sapiens
acattgcgtttgaccttttatgt

SEQ ID NO: 1090335 - DNA, 21 bp, Homo sapiens
acattgctctatgtctgcctt

SEQ ID NO: 1090336 - DNA, 12 bp, Homo sapiens
acattgcttttc

SEQ ID NO: 1090337 - DNA, 15 bp, Homo sapiens
acattgcttttgaaa

SEQ ID NO: 1090338 - DNA, 19 bp, Homo sapiens
acattgggaaggggacccc

SEQ ID NO: 1090339 - DNA, 21 bp, Homo sapiens
acattggggattgaaaatcat

SEQ ID NO: 1090340 - DNA, 23 bp, Homo sapiens
acattggtgaaggatccaggaat

SEQ ID NO: 1090341 - DNA, 15 bp, Homo sapiens
acattgtaaagtatg

SEQ ID NO: 1090342 - DNA, 22 bp, Homo sapiens
acattgtaaatatttactcttt

SEQ ID NO: 1090343 - DNA, 23 bp, Homo sapiens
acattgtataggccatctgtaaa

SEQ ID NO: 1090344 - DNA, 12 bp, Homo sapiens
acattgtcaata

SEQ ID NO: 1090345 - DNA, 14 bp, Homo sapiens
acattgtcaataaa

SEQ ID NO: 1090346 - DNA, 17 bp, Homo sapiens
acattgtcatcagaggg

SEQ ID NO: 1090347 - DNA, 24 bp, Homo sapiens
acattgtccccaatgaatatactc

SEQ ID NO: 1090348 - DNA, 16 bp, Homo sapiens
acattgtcctgtagct

SEQ ID NO: 1090349 - DNA, 12 bp, Homo sapiens
acattgtctccc

SEQ ID NO: 1090350 - DNA, 13 bp, Homo sapiens
acattgtctcccg

SEQ ID NO: 1090351 - DNA, 16 bp, Homo sapiens
acattgtctcccgccc

SEQ ID NO: 1090352 - DNA, 19 bp, Homo sapiens
acattgtctcctatatatt

SEQ ID NO: 1090353 - DNA, 22 bp, Homo sapiens
acattgtctcctatatatttct

SEQ ID NO: 1090354 - DNA, 12 bp, Homo sapiens
acattgtctgcg

SEQ ID NO: 1090355 - DNA, 23 bp, Homo sapiens
acattgtgtgaaaaaagaaaatg

SEQ ID NO: 1090356 - DNA, 20 bp, Homo sapiens
acattgttgtttttttaata

SEQ ID NO: 1090357 - DNA, 14 bp, Homo sapiens
acatttaaaacatt

SEQ ID NO: 1090358 - DNA, 16 bp, Homo sapiens
acatttaaaacatttg

SEQ ID NO: 1090359 - DNA, 12 bp, Homo sapiens
acatttaaaatt

SEQ ID NO: 1090360 - DNA, 14 bp, Homo sapiens
acatttaaaccttt

SEQ ID NO: 1090361 - DNA, 16 bp, Homo sapiens
acatttaaacctttta

SEQ ID NO: 1090362 - DNA, 16 bp, Homo sapiens
acatttaaacttttta

SEQ ID NO: 1090363 - DNA, 13 bp, Homo sapiens
acatttaaagaga

SEQ ID NO: 1090364 - DNA, 19 bp, Homo sapiens
acatttaaataaaactttc

SEQ ID NO: 1090365 - DNA, 21 bp, Homo sapiens
acatttaaataaaactttcca

SEQ ID NO: 1090366 - DNA, 12 bp, Homo sapiens
acatttaaatgt

SEQ ID NO: 1090367 - DNA, 11 bp, Homo sapiens
acatttaacat

SEQ ID NO: 1090368 - DNA, 17 bp, Homo sapiens
acatttaatacagcagt

SEQ ID NO: 1090369 - DNA, 17 bp, Homo sapiens
acatttacaaactgaag

SEQ ID NO: 1090370 - DNA, 21 bp, Homo sapiens
acatttacaaactgaagagta

SEQ ID NO: 1090371 - DNA, 22 bp, Homo sapiens
acatttaccctttggccccact

SEQ ID NO: 1090372 - DNA, 13 bp, Homo sapiens
acatttagaactt

SEQ ID NO: 1090373 - DNA, 16 bp, Homo sapiens
acatttaggattttgt

SEQ ID NO: 1090374 - DNA, 16 bp, Homo sapiens
acatttatatatatat

SEQ ID NO: 1090375 - DNA, 19 bp, Homo sapiens
acatttatttattactgtc

SEQ ID NO: 1090376 - DNA, 16 bp, Homo sapiens
acatttattttgacat

SEQ ID NO: 1090377 - DNA, 23 bp, Homo sapiens
acatttattttttttaaagaaaa

SEQ ID NO: 1090378 - DNA, 14 bp, Homo sapiens
acatttcaaagctg

SEQ ID NO: 1090379 - DNA, 14 bp, Homo sapiens
acatttcaaagttt

SEQ ID NO: 1090380 - DNA, 20 bp, Homo sapiens
acatttcaccatggccccct

SEQ ID NO: 1090381 - DNA, 24 bp, Homo sapiens
acatttcacctactttgtaagtga

SEQ ID NO: 1090382 - DNA, 22 bp, Homo sapiens
acatttcataaggcctgccctc

SEQ ID NO: 1090383 - DNA, 23 bp, Homo sapiens
acatttcataatttgtttccagc

SEQ ID NO: 1090384 - DNA, 12 bp, Homo sapiens
acatttcatctg

SEQ ID NO: 1090385 - DNA, 18 bp, Homo sapiens
acatttcattgtacaagt

SEQ ID NO: 1090386 - DNA, 21 bp, Homo sapiens
acatttcattgtacaagtatt

SEQ ID NO: 1090387 - DNA, 15 bp, Homo sapiens
accaaattttaaaag

SEQ ID NO: 1090388 - DNA, 18 bp, Homo sapiens
accaaattttaaaagcca

SEQ ID NO: 1090389 - DNA, 13 bp, Homo sapiens
accaaattttaat

SEQ ID NO: 1090390 - DNA, 14 bp, Homo sapiens
accaaattttaatt

SEQ ID NO: 1090391 - DNA, 17 bp, Homo sapiens
accaaatttttctatca

SEQ ID NO: 1090392 - DNA, 21 bp, Homo sapiens
accaacaactcagaatggggg

SEQ ID NO: 1090393 - DNA, 14 bp, Homo sapiens
accaacaataaacc

SEQ ID NO: 1090394 - DNA, 15 bp, Homo sapiens
accaacagaagcaga

SEQ ID NO: 1090395 - DNA, 14 bp, Homo sapiens
accaacataaaaat

SEQ ID NO: 1090396 - DNA, 14 bp, Homo sapiens
accaacataaaaca

SEQ ID NO: 1090397 - DNA, 15 bp, Homo sapiens
accaacataaaacaa

SEQ ID NO: 1090398 - DNA, 16 bp, Homo sapiens
accaacataaaacaaa

SEQ ID NO: 1090399 - DNA, 18 bp, Homo sapiens
accaacatcccattgccc

SEQ ID NO: 1090400 - DNA, 22 bp, Homo sapiens
accaacatcccattgccctggt

SEQ ID NO: 1090401 - DNA, 15 bp, Homo sapiens
accaacatggagaaa

SEQ ID NO: 1090402 - DNA, 24 bp, Homo sapiens
accaacatggagaaaccctgtctc

SEQ ID NO: 1090403 - DNA, 17 bp, Homo sapiens
accaaccccgcggccca

SEQ ID NO: 1090404 - DNA, 15 bp, Homo sapiens
accaaccctcagagc

SEQ ID NO: 1090405 - DNA, 16 bp, Homo sapiens
accaaccctgggacct

SEQ ID NO: 1090406 - DNA, 19 bp, Homo sapiens
accaaccctggggaaggag

SEQ ID NO: 1090407 - DNA, 14 bp, Homo sapiens
accaaccctgtttc

SEQ ID NO: 1090408 - DNA, 16 bp, Homo sapiens
accaaccctgtttcct

SEQ ID NO: 1090409 - DNA, 19 bp, Homo sapiens
accaacctgaagacaccgt

SEQ ID NO: 1090410 - DNA, 14 bp, Homo sapiens
accaacctgctctg

SEQ ID NO: 1090411 - DNA, 20 bp, Homo sapiens
accaacgttactcagggctc

SEQ ID NO: 1090412 - DNA, 13 bp, Homo sapiens
accaactatccaa

SEQ ID NO: 1090413 - DNA, 23 bp, Homo sapiens
accaactgaaggctaaaaagcaa

SEQ ID NO: 1090414 - DNA, 17 bp, Homo sapiens
accaactgcacaatcag

SEQ ID NO: 1090415 - DNA, 21 bp, Homo sapiens
accaactgccctaagccccca

SEQ ID NO: 1090416 - DNA, 14 bp, Homo sapiens
accaactgggccca

SEQ ID NO: 1090417 - DNA, 10 bp, Homo sapiens
accaactgtg

SEQ ID NO: 1090418 - DNA, 18 bp, Homo sapiens
accaactgtgttgtatta

SEQ ID NO: 1090419 - DNA, 12 bp, Homo sapiens
accaactttctg

SEQ ID NO: 1090420 - DNA, 13 bp, Homo sapiens
accaactttctgt

SEQ ID NO: 1090421 - DNA, 14 bp, Homo sapiens
accaactttctgta

SEQ ID NO: 1090422 - DNA, 19 bp, Homo sapiens
accaactttctgtaaactc

SEQ ID NO: 1090423 - DNA, 12 bp, Homo sapiens
accaagaactgc

SEQ ID NO: 1090424 - DNA, 24 bp, Homo sapiens
accaagaagcctttcctgtagcct

SEQ ID NO: 1090425 - DNA, 21 bp, Homo sapiens
accaagacaggttcaggtagg

SEQ ID NO: 1090426 - DNA, 12 bp, Homo sapiens
accaagaggctg

SEQ ID NO: 1090427 - DNA, 15 bp, Homo sapiens
accaagatacttaag

SEQ ID NO: 1090428 - DNA, 21 bp, Homo sapiens
accaagatacttaagtgctgc

SEQ ID NO: 1090429 - DNA, 19 bp, Homo sapiens
accaagatgcaaatgtttt

SEQ ID NO: 1090430 - DNA, 16 bp, Homo sapiens
accaagatgggtggca

SEQ ID NO: 1090431 - DNA, 20 bp, Homo sapiens
accaagattttgaaggaaat

SEQ ID NO: 1090432 - DNA, 12 bp, Homo sapiens
accaagcagctt

SEQ ID NO: 1090433 - DNA, 17 bp, Homo sapiens
accaagcagtggccttt

SEQ ID NO: 1090434 - DNA, 17 bp, Homo sapiens
accaagccgtggcttcc

SEQ ID NO: 1090435 - DNA, 12 bp, Homo sapiens
accaagccttgg

SEQ ID NO: 1090436 - DNA, 13 bp, Homo sapiens
accaagccttggc

SEQ ID NO: 1090437 - DNA, 16 bp, Homo sapiens
accaagcgaccaagga

SEQ ID NO: 1090438 - DNA, 21 bp, Homo sapiens
accaagctattcctttccctt

SEQ ID NO: 1090439 - DNA, 22 bp, Homo sapiens
accaagctattcctttcccttc

SEQ ID NO: 1090440 - DNA, 18 bp, Homo sapiens
accaagctcacagttcct

SEQ ID NO: 1090441 - DNA, 14 bp, Homo sapiens
accaagctctctgc

SEQ ID NO: 1090442 - DNA, 14 bp, Homo sapiens
accaagctgagttt

SEQ ID NO: 1090443 - DNA, 19 bp, Homo sapiens
accaagctgagtttcctat

SEQ ID NO: 1090444 - DNA, 21 bp, Homo sapiens
accaaggaaacgctacctctc

SEQ ID NO: 1090445 - DNA, 17 bp, Homo sapiens
accaaggaagcagcctc

SEQ ID NO: 1090446 - DNA, 15 bp, Homo sapiens
accaaggactgagca

SEQ ID NO: 1090447 - DNA, 19 bp, Homo sapiens
accaaggcaaggcaggtgc

SEQ ID NO: 1090448 - DNA, 21 bp, Homo sapiens
accaaggcagcctccagagcc

SEQ ID NO: 1090449 - DNA, 16 bp, Homo sapiens
accaaggcagtgcatg

SEQ ID NO: 1090450 - DNA, 17 bp, Homo sapiens
accaaggcagtgcatgc

SEQ ID NO: 1090451 - DNA, 21 bp, Homo sapiens
accaaggcagtgcatgcatgt

SEQ ID NO: 1090452 - DNA, 22 bp, Homo sapiens
accaaggcagtgcatgcatgtt

SEQ ID NO: 1090453 - DNA, 23 bp, Homo sapiens
accaaggctgagacagtgaattt

SEQ ID NO: 1090454 - DNA, 17 bp, Homo sapiens
accaaggctttctctac

SEQ ID NO: 1090455 - DNA, 23 bp, Homo sapiens
accaaggctttctctactgattc

SEQ ID NO: 1090456 - DNA, 14 bp, Homo sapiens
accaagggggcggg

SEQ ID NO: 1090457 - DNA, 15 bp, Homo sapiens
accaaggtcttcagc

SEQ ID NO: 1090458 - DNA, 15 bp, Homo sapiens
accaagtcaggccag

SEQ ID NO: 1090459 - DNA, 16 bp, Homo sapiens
accaagtcaggccagg

SEQ ID NO: 1090460 - DNA, 19 bp, Homo sapiens
accaagtcaggccaggtgg

SEQ ID NO: 1090461 - DNA, 21 bp, Homo sapiens
accaagtcaggccaggtgggc

SEQ ID NO: 1090462 - DNA, 13 bp, Homo sapiens
accaagtcctggc

SEQ ID NO: 1090463 - DNA, 15 bp, Homo sapiens
accaagtcctggcta

SEQ ID NO: 1090464 - DNA, 20 bp, Homo sapiens
accaagtcctggctacatcc

SEQ ID NO: 1090465 - DNA, 14 bp, Homo sapiens
accaagtgggctgg

SEQ ID NO: 1090466 - DNA, 14 bp, Homo sapiens
accaagtgtgctct

SEQ ID NO: 1090467 - DNA, 18 bp, Homo sapiens
accaagttgtgcttttct

SEQ ID NO: 1090468 - DNA, 15 bp, Homo sapiens
accaataaaatttct

SEQ ID NO: 1090469 - DNA, 13 bp, Homo sapiens
accaataaactga

SEQ ID NO: 1090470 - DNA, 23 bp, Homo sapiens
accaataacaaggagctcaccct

SEQ ID NO: 1090471 - DNA, 16 bp, Homo sapiens
accaatagcccacagc

SEQ ID NO: 1090472 - DNA, 11 bp, Homo sapiens
accaatatata

SEQ ID NO: 1090473 - DNA, 20 bp, Homo sapiens
accaatattatactaagaaa

SEQ ID NO: 1090474 - DNA, 19 bp, Homo sapiens
accaatcagagagcctaga

SEQ ID NO: 1090475 - DNA, 12 bp, Homo sapiens
accaatcatttt

SEQ ID NO: 1090476 - DNA, 13 bp, Homo sapiens
accaatcatttta

SEQ ID NO: 1090477 - DNA, 20 bp, Homo sapiens
accaatcattttaattatta

SEQ ID NO: 1090478 - DNA, 15 bp, Homo sapiens
accaatccccagcct

SEQ ID NO: 1090479 - DNA, 13 bp, Homo sapiens
accaatcctggac

SEQ ID NO: 1090480 - DNA, 12 bp, Homo sapiens
accaatgcatgc

SEQ ID NO: 1090481 - DNA, 21 bp, Homo sapiens
accaatgccaaaaaaagacag

SEQ ID NO: 1090482 - DNA, 17 bp, Homo sapiens
accaatgcctttttaga

SEQ ID NO: 1090483 - DNA, 22 bp, Homo sapiens
accaatgcctttttagatgtat

SEQ ID NO: 1090484 - DNA, 16 bp, Homo sapiens
accaatgctgttgtaa

SEQ ID NO: 1090485 - DNA, 19 bp, Homo sapiens
accaatgcttttatcaaac

SEQ ID NO: 1090486 - DNA, 13 bp, Homo sapiens
accaatgggaagc

SEQ ID NO: 1090487 - DNA, 15 bp, Homo sapiens
accaatgggaagcag

SEQ ID NO: 1090488 - DNA, 19 bp, Homo sapiens
accaatgggaagcagggaa

SEQ ID NO: 1090489 - DNA, 12 bp, Homo sapiens
accaatgtcttg

SEQ ID NO: 1090490 - DNA, 18 bp, Homo sapiens
accaattctggacagaca

SEQ ID NO: 1090491 - DNA, 15 bp, Homo sapiens
accaattgctttgtc

SEQ ID NO: 1090492 - DNA, 14 bp, Homo sapiens
accaattgtgctgc

SEQ ID NO: 1090493 - DNA, 16 bp, Homo sapiens
accaattgtgctgcca

SEQ ID NO: 1090494 - DNA, 18 bp, Homo sapiens
accaattgtgctgccatt

SEQ ID NO: 1090495 - DNA, 18 bp, Homo sapiens
accaatttacactgccat

SEQ ID NO: 1090496 - DNA, 13 bp, Homo sapiens
accaatttcttcc

SEQ ID NO: 1090497 - DNA, 14 bp, Homo sapiens
accaatttcttcct

SEQ ID NO: 1090498 - DNA, 23 bp, Homo sapiens
accaatttggtaaaaatgctgct

SEQ ID NO: 1090499 - DNA, 19 bp, Homo sapiens
accacaaacggagcccctg

SEQ ID NO: 1090500 - DNA, 20 bp, Homo sapiens
accacaaagcacagtttgaa

SEQ ID NO: 1090501 - DNA, 12 bp, Homo sapiens
accacaaggaaa

SEQ ID NO: 1090502 - DNA, 21 bp, Homo sapiens
accacaatgtttcttcatttc

SEQ ID NO: 1090503 - DNA, 13 bp, Homo sapiens
accacaccacagg

SEQ ID NO: 1090504 - DNA, 21 bp, Homo sapiens
accacacccaggtctcttcct

SEQ ID NO: 1090505 - DNA, 13 bp, Homo sapiens
accacaccctgta

SEQ ID NO: 1090506 - DNA, 17 bp, Homo sapiens
accacaccttggccttc

SEQ ID NO: 1090507 - DNA, 21 bp, Homo sapiens
accacactcaccccagcctca

SEQ ID NO: 1090508 - DNA, 14 bp, Homo sapiens
accacactgagttc

SEQ ID NO: 1090509 - DNA, 21 bp, Homo sapiens
accacactggactccggccct

SEQ ID NO: 1090510 - DNA, 18 bp, Homo sapiens
accagctctgtggcctgt

SEQ ID NO: 1090511 - DNA, 12 bp, Homo sapiens
accagctgaaag

SEQ ID NO: 1090512 - DNA, 18 bp, Homo sapiens
accagctgcgcttgcttt

SEQ ID NO: 1090513 - DNA, 22 bp, Homo sapiens
accagctgctccgaggacccag

SEQ ID NO: 1090514 - DNA, 16 bp, Homo sapiens
accagctgctgtgccc

SEQ ID NO: 1090515 - DNA, 19 bp, Homo sapiens
accagctgctgtgccccac

SEQ ID NO: 1090516 - DNA, 16 bp, Homo sapiens
accagcttagatttta

SEQ ID NO: 1090517 - DNA, 20 bp, Homo sapiens
accagcttcactctctccgt

SEQ ID NO: 1090518 - DNA, 15 bp, Homo sapiens
accaggaagtgttta

SEQ ID NO: 1090519 - DNA, 20 bp, Homo sapiens
accaggaatgttaaagtcag

SEQ ID NO: 1090520 - DNA, 12 bp, Homo sapiens
accaggacccag

SEQ ID NO: 1090521 - DNA, 15 bp, Homo sapiens
accaggacccagggt

SEQ ID NO: 1090522 - DNA, 20 bp, Homo sapiens
accaggactatagcccaggt

SEQ ID NO: 1090523 - DNA, 14 bp, Homo sapiens
accaggactccctc

SEQ ID NO: 1090524 - DNA, 18 bp, Homo sapiens
accaggactccctcctca

SEQ ID NO: 1090525 - DNA, 21 bp, Homo sapiens
accaggactccctcctcacct

SEQ ID NO: 1090526 - DNA, 19 bp, Homo sapiens
accaggagcacctggaccc

SEQ ID NO: 1090527 - DNA, 20 bp, Homo sapiens
accaggagcacctggacccc

SEQ ID NO: 1090528 - DNA, 14 bp, Homo sapiens
accaggagcagcag

SEQ ID NO: 1090529 - DNA, 16 bp, Homo sapiens
accaggagcagcagcc

SEQ ID NO: 1090530 - DNA, 17 bp, Homo sapiens
accaggaggattgcctt

SEQ ID NO: 1090531 - DNA, 17 bp, Homo sapiens
accaggcaccaaaagaa

SEQ ID NO: 1090532 - DNA, 21 bp, Homo sapiens
accaggcacgaacccacctgc

SEQ ID NO: 1090533 - DNA, 22 bp, Homo sapiens
accaggcacgaacccacctgct

SEQ ID NO: 1090534 - DNA, 11 bp, Homo sapiens
accaggcagct

SEQ ID NO: 1090535 - DNA, 21 bp, Homo sapiens
accaggcagctgagaccaggg

SEQ ID NO: 1090536 - DNA, 17 bp, Homo sapiens
accaggccacctcccca

SEQ ID NO: 1090537 - DNA, 19 bp, Homo sapiens
accaggcccaaggagggtc

SEQ ID NO: 1090538 - DNA, 23 bp, Homo sapiens
accaggcccaaggagggtccagg

SEQ ID NO: 1090539 - DNA, 19 bp, Homo sapiens
accaggcccacgaggagca

SEQ ID NO: 1090540 - DNA, 20 bp, Homo sapiens
accaggcccacgaggagcag

SEQ ID NO: 1090541 - DNA, 22 bp, Homo sapiens
accaggcccacgaggagcagca

SEQ ID NO: 1090542 - DNA, 13 bp, Homo sapiens
accaggccccagc

SEQ ID NO: 1090543 - DNA, 17 bp, Homo sapiens
accaggccccagcctcc

SEQ ID NO: 1090544 - DNA, 17 bp, Homo sapiens
accaggccgtgccttgt

SEQ ID NO: 1090545 - DNA, 15 bp, Homo sapiens
accaggcctcactgg

SEQ ID NO: 1090546 - DNA, 22 bp, Homo sapiens
accaggcctcactggctcatgc

SEQ ID NO: 1090547 - DNA, 19 bp, Homo sapiens
accaggcctggagggcact

SEQ ID NO: 1090548 - DNA, 17 bp, Homo sapiens
accaggctggcgcagcc

SEQ ID NO: 1090549 - DNA, 23 bp, Homo sapiens
accaggctggcgcagccaaggcc

SEQ ID NO: 1090550 - DNA, 13 bp, Homo sapiens
accaggctgtgtc

SEQ ID NO: 1090551 - DNA, 20 bp, Homo sapiens
accagggagcccctttgatg

SEQ ID NO: 1090552 - DNA, 14 bp, Homo sapiens
accagggaggagag

SEQ ID NO: 1090553 - DNA, 16 bp, Homo sapiens
accagggaggagagga

SEQ ID NO: 1090554 - DNA, 23 bp, Homo sapiens
accagggatgctgggctgggccc

SEQ ID NO: 1090555 - DNA, 13 bp, Homo sapiens
accagggccagct

SEQ ID NO: 1090556 - DNA, 14 bp, Homo sapiens
accagggccctggg

SEQ ID NO: 1090557 - DNA, 13 bp, Homo sapiens
accagggcctccc

SEQ ID NO: 1090558 - DNA, 22 bp, Homo sapiens
accagggcgaacgacaatagct

SEQ ID NO: 1090559 - DNA, 16 bp, Homo sapiens
accagggctccagccc

SEQ ID NO: 1090560 - DNA, 16 bp, Homo sapiens
accaggggaaggaagg

SEQ ID NO: 1090561 - DNA, 17 bp, Homo sapiens
accaggggtttctcgca

SEQ ID NO: 1090562 - DNA, 21 bp, Homo sapiens
accagggtcttacctctctgg

SEQ ID NO: 1090563 - DNA, 22 bp, Homo sapiens
accagggtcttacctctctggg

SEQ ID NO: 1090564 - DNA, 22 bp, Homo sapiens
accagggtggaccaggcctgga

SEQ ID NO: 1090565 - DNA, 22 bp, Homo sapiens
accaggtcaccatcctcagagg

SEQ ID NO: 1090566 - DNA, 16 bp, Homo sapiens
accaggtgagaagtga

SEQ ID NO: 1090567 - DNA, 13 bp, Homo sapiens
accaggtgccttt

SEQ ID NO: 1090568 - DNA, 22 bp, Homo sapiens
accaggtgcctttcaaatttag

SEQ ID NO: 1090569 - DNA, 18 bp, Homo sapiens
accaggtgtgcctggaag

SEQ ID NO: 1090570 - DNA, 15 bp, Homo sapiens
accagtagccgctgg

SEQ ID NO: 1090571 - DNA, 18 bp, Homo sapiens
accagtatttagaagcca

SEQ ID NO: 1090572 - DNA, 16 bp, Homo sapiens
accagtatttttgctg

SEQ ID NO: 1090573 - DNA, 23 bp, Homo sapiens
accagtatttttgctgcttctga

SEQ ID NO: 1090574 - DNA, 21 bp, Homo sapiens
accagtctatttccactgaac

SEQ ID NO: 1090575 - DNA, 20 bp, Homo sapiens
accagtctcctcactctgtc

SEQ ID NO: 1090576 - DNA, 14 bp, Homo sapiens
accagtctctcaag

SEQ ID NO: 1090577 - DNA, 13 bp, Homo sapiens
accagtctgaagt

SEQ ID NO: 1090578 - DNA, 19 bp, Homo sapiens
accagtctgaagtttcatt

SEQ ID NO: 1090579 - DNA, 23 bp, Homo sapiens
accagtctgaagtttcatttatg

SEQ ID NO: 1090580 - DNA, 22 bp, Homo sapiens
accagtctttaaaggcccagcc

SEQ ID NO: 1090581 - DNA, 23 bp, Homo sapiens
accagtctttaaaggcccagccc

SEQ ID NO: 1090582 - DNA, 20 bp, Homo sapiens
accagtgagaactctctccc

SEQ ID NO: 1090583 - DNA, 17 bp, Homo sapiens
accagtgcaacagcact

SEQ ID NO: 1090584 - DNA, 13 bp, Homo sapiens
accagtgcaagca

SEQ ID NO: 1090585 - DNA, 12 bp, Homo sapiens
accagtgcctta

SEQ ID NO: 1090586 - DNA, 13 bp, Homo sapiens
accagtggccttt

SEQ ID NO: 1090587 - DNA, 22 bp, Homo sapiens
accagtgtagcatcttcctctg

SEQ ID NO: 1090588 - DNA, 23 bp, Homo sapiens
accagtgtagcatcttcctctgc

SEQ ID NO: 1090589 - DNA, 13 bp, Homo sapiens
accagtgtagcct

SEQ ID NO: 1090590 - DNA, 12 bp, Homo sapiens
accagtgtgtgg

SEQ ID NO: 1090591 - DNA, 17 bp, Homo sapiens
accagtgttcctgaagc

SEQ ID NO: 1090592 - DNA, 21 bp, Homo sapiens
accagtgttcctgaagctgct

SEQ ID NO: 1090593 - DNA, 21 bp, Homo sapiens
accagtgttgtggatttaaca

SEQ ID NO: 1090594 - DNA, 12 bp, Homo sapiens
accagttgcctt

SEQ ID NO: 1090595 - DNA, 16 bp, Homo sapiens
accagttgccttttat

SEQ ID NO: 1090596 - DNA, 16 bp, Homo sapiens
accagttggccatgat

SEQ ID NO: 1090597 - DNA, 15 bp, Homo sapiens
accagttgggagcac

SEQ ID NO: 1090598 - DNA, 19 bp, Homo sapiens
accagttgggagcactgga

SEQ ID NO: 1090599 - DNA, 20 bp, Homo sapiens
accagttgggagcactggag

SEQ ID NO: 1090600 - DNA, 21 bp, Homo sapiens
accagttgggagcactggagt

SEQ ID NO: 1090601 - DNA, 15 bp, Homo sapiens
accagtttattctgt

SEQ ID NO: 1090602 - DNA, 16 bp, Homo sapiens
accagtttgcagagtg

SEQ ID NO: 1090603 - DNA, 13 bp, Homo sapiens
accataaaaagag

SEQ ID NO: 1090604 - DNA, 20 bp, Homo sapiens
accataaaaccctatacaag

SEQ ID NO: 1090605 - DNA, 14 bp, Homo sapiens
accataaagccttt

SEQ ID NO: 1090606 - DNA, 22 bp, Homo sapiens
accataaggtttcgtttctgta

SEQ ID NO: 1090607 - DNA, 21 bp, Homo sapiens
accatactaattataccccct

SEQ ID NO: 1090608 - DNA, 22 bp, Homo sapiens
accatactcaaatggtgtcatg

SEQ ID NO: 1090609 - DNA, 14 bp, Homo sapiens
accatactgtctct

SEQ ID NO: 1090610 - DNA, 15 bp, Homo sapiens
accatactgtctctg

SEQ ID NO: 1090611 - DNA, 17 bp, Homo sapiens
accatactgtctctgga

SEQ ID NO: 1090612 - DNA, 19 bp, Homo sapiens
accatactgtctctggagt

SEQ ID NO: 1090613 - DNA, 20 bp, Homo sapiens
accatagaaaaatgtataaa

SEQ ID NO: 1090614 - DNA, 19 bp, Homo sapiens
accataggaagacataaaa

SEQ ID NO: 1090615 - DNA, 17 bp, Homo sapiens
accatagggctggggac

SEQ ID NO: 1090616 - DNA, 17 bp, Homo sapiens
accatagttttgtttaa

SEQ ID NO: 1090617 - DNA, 13 bp, Homo sapiens
accatatgatact

SEQ ID NO: 1090618 - DNA, 17 bp, Homo sapiens
accatatgtctgcttct

SEQ ID NO: 1090619 - DNA, 19 bp, Homo sapiens
accatatgtctgcttctgt

SEQ ID NO: 1090620 - DNA, 16 bp, Homo sapiens
accatattaccacaga

SEQ ID NO: 1090621 - DNA, 19 bp, Homo sapiens
accatcaaaggaatataag

SEQ ID NO: 1090622 - DNA, 15 bp, Homo sapiens
accatcaccaccgcc

SEQ ID NO: 1090623 - DNA, 18 bp, Homo sapiens
accatcaccaccgcctct

SEQ ID NO: 1090624 - DNA, 14 bp, Homo sapiens
accatcagggacag

SEQ ID NO: 1090625 - DNA, 12 bp, Homo sapiens
accatcatccta

SEQ ID NO: 1090626 - DNA, 19 bp, Homo sapiens
accatcattggaaatgaaa

SEQ ID NO: 1090627 - DNA, 18 bp, Homo sapiens
accatccaccttcccttc

SEQ ID NO: 1090628 - DNA, 19 bp, Homo sapiens
accatccctttttgaagtg

SEQ ID NO: 1090629 - DNA, 17 bp, Homo sapiens
accatcctcagaggctg

SEQ ID NO: 1090630 - DNA, 20 bp, Homo sapiens
accatcctggctaacacggt

SEQ ID NO: 1090631 - DNA, 13 bp, Homo sapiens
accatcgcctctg

SEQ ID NO: 1090632 - DNA, 16 bp, Homo sapiens
accatctcagaccttt

SEQ ID NO: 1090633 - DNA, 16 bp, Homo sapiens
accatctcaggccacc

SEQ ID NO: 1090634 - DNA, 21 bp, Homo sapiens
accatctcaggccacctgccc

SEQ ID NO: 1090635 - DNA, 18 bp, Homo sapiens
accatctctaccatcatc

SEQ ID NO: 1090636 - DNA, 17 bp, Homo sapiens
accatctgctgcagtta

SEQ ID NO: 1090637 - DNA, 16 bp, Homo sapiens
accatctggggcacct

SEQ ID NO: 1090638 - DNA, 14 bp, Homo sapiens
accatgaaacaaag

SEQ ID NO: 1090639 - DNA, 12 bp, Homo sapiens
accatgaaagac

SEQ ID NO: 1090640 - DNA, 14 bp, Homo sapiens
accatgaaagactt

SEQ ID NO: 1090641 - DNA, 15 bp, Homo sapiens
accatgaagacagga

SEQ ID NO: 1090642 - DNA, 16 bp, Homo sapiens
accatgacaaacctag

SEQ ID NO: 1090643 - DNA, 19 bp, Homo sapiens
accatgaccccttctctct

SEQ ID NO: 1090644 - DNA, 15 bp, Homo sapiens
accatgactgtgacc

SEQ ID NO: 1090645 - DNA, 20 bp, Homo sapiens
accatgagtgaatttatatc

SEQ ID NO: 1090646 - DNA, 20 bp, Homo sapiens
accatgcactatatttgtat

SEQ ID NO: 1090647 - DNA, 19 bp, Homo sapiens
accatgcactgtaaatatc

SEQ ID NO: 1090648 - DNA, 12 bp, Homo sapiens
accatgcagccc

SEQ ID NO: 1090649 - DNA, 21 bp, Homo sapiens
accatgcagcccctgggccct

SEQ ID NO: 1090650 - DNA, 18 bp, Homo sapiens
accatgcattttaccatc

SEQ ID NO: 1090651 - DNA, 19 bp, Homo sapiens
accatgccagattctgcct

SEQ ID NO: 1090652 - DNA, 21 bp, Homo sapiens
accatgccagattctgcctct

SEQ ID NO: 1090653 - DNA, 20 bp, Homo sapiens
accatgccaggctaattttt

SEQ ID NO: 1090654 - DNA, 22 bp, Homo sapiens
accatgcccagctaattttgta

SEQ ID NO: 1090655 - DNA, 19 bp, Homo sapiens
accatgcccggctaatttt

SEQ ID NO: 1090656 - DNA, 20 bp, Homo sapiens
accatgcccggctaattttt

SEQ ID NO: 1090657 - DNA, 22 bp, Homo sapiens
accatgcgtcaggggcctagag

SEQ ID NO: 1090658 - DNA, 19 bp, Homo sapiens
accatgctcatctgctggt

SEQ ID NO: 1090659 - DNA, 22 bp, Homo sapiens
accatgctgctttttggcacag

SEQ ID NO: 1090660 - DNA, 20 bp, Homo sapiens
accatgctggcggcgcagag

SEQ ID NO: 1090661 - DNA, 16 bp, Homo sapiens
accatgcttgcctgaa

SEQ ID NO: 1090662 - DNA, 18 bp, Homo sapiens
accatgcttgcctgaagc

SEQ ID NO: 1090663 - DNA, 23 bp, Homo sapiens
accatggccgaagccccttggag

SEQ ID NO: 1090664 - DNA, 16 bp, Homo sapiens
accatggtgaagtgct

SEQ ID NO: 1090665 - DNA, 21 bp, Homo sapiens
accatggttttggctctccca

SEQ ID NO: 1090666 - DNA, 22 bp, Homo sapiens
accatggttttggctctcccac

SEQ ID NO: 1090667 - DNA, 12 bp, Homo sapiens
accatgtaatgg

SEQ ID NO: 1090668 - DNA, 17 bp, Homo sapiens
accatgtagaaaatttg

SEQ ID NO: 1090669 - DNA, 15 bp, Homo sapiens
accatgtattccctt

SEQ ID NO: 1090670 - DNA, 15 bp, Homo sapiens
accatgtcactgtgg

SEQ ID NO: 1090671 - DNA, 19 bp, Homo sapiens
accatgtcagcaaaaagca

SEQ ID NO: 1090672 - DNA, 21 bp, Homo sapiens
accatgtgccatctgtacata

SEQ ID NO: 1090673 - DNA, 22 bp, Homo sapiens
accatgtggataactttacaga

SEQ ID NO: 1090674 - DNA, 14 bp, Homo sapiens
accatgtggccaca

SEQ ID NO: 1090675 - DNA, 21 bp, Homo sapiens
accatgtgtcacttgtgcttt

SEQ ID NO: 1090676 - DNA, 12 bp, Homo sapiens
accatgttcatt

SEQ ID NO: 1090677 - DNA, 13 bp, Homo sapiens
accatgttcatta

SEQ ID NO: 1090678 - DNA, 15 bp, Homo sapiens
accatgtttcaaaca

SEQ ID NO: 1090679 - DNA, 21 bp, Homo sapiens
accatgtttgagctcagaccc

SEQ ID NO: 1090680 - DNA, 16 bp, Homo sapiens
accattaaaactgctt

SEQ ID NO: 1090681 - DNA, 20 bp, Homo sapiens
accattaaaactgctttttt

SEQ ID NO: 1090682 - DNA, 14 bp, Homo sapiens
accattaattacat

SEQ ID NO: 1090683 - DNA, 17 bp, Homo sapiens
accattaattacataca

SEQ ID NO: 1090684 - DNA, 17 bp, Homo sapiens
accattacatgtttaaa

SEQ ID NO: 1090685 - DNA, 18 bp, Homo sapiens
accattacatgtttaaat

SEQ ID NO: 1090686 - DNA, 14 bp, Homo sapiens
accattaccaaaat

SEQ ID NO: 1090687 - DNA, 14 bp, Homo sapiens
accattacctgtac

SEQ ID NO: 1090688 - DNA, 22 bp, Homo sapiens
accattactgaggggattctct

SEQ ID NO: 1090689 - DNA, 19 bp, Homo sapiens
accattataaccttaattt

SEQ ID NO: 1090690 - DNA, 16 bp, Homo sapiens
accattattcacaggt

SEQ ID NO: 1090691 - DNA, 14 bp, Homo sapiens
accattcaaatgac

SEQ ID NO: 1090692 - DNA, 21 bp, Homo sapiens
accattcagtgattactgtca

SEQ ID NO: 1090693 - DNA, 18 bp, Homo sapiens
accattccttcaaataaa

SEQ ID NO: 1090694 - DNA, 13 bp, Homo sapiens
accattctcctgc

SEQ ID NO: 1090695 - DNA, 11 bp, Homo sapiens
accattctgtg

SEQ ID NO: 1090696 - DNA, 16 bp, Homo sapiens
accattgaaatcagca

SEQ ID NO: 1090697 - DNA, 13 bp, Homo sapiens
accattgacctca

SEQ ID NO: 1090698 - DNA, 15 bp, Homo sapiens
accattgacctcagc

SEQ ID NO: 1090699 - DNA, 16 bp, Homo sapiens
accattgacctcagct

SEQ ID NO: 1090700 - DNA, 20 bp, Homo sapiens
accattgacctcagctgcac

SEQ ID NO: 1090701 - DNA, 16 bp, Homo sapiens
accattgagtccctgc

SEQ ID NO: 1090702 - DNA, 17 bp, Homo sapiens
accattgagtccctgct

SEQ ID NO: 1090703 - DNA, 18 bp, Homo sapiens
accattgatttaatgtaa

SEQ ID NO: 1090704 - DNA, 22 bp, Homo sapiens
accattggacagatttcagtaa

SEQ ID NO: 1090705 - DNA, 18 bp, Homo sapiens
accattggacagtctccc

SEQ ID NO: 1090706 - DNA, 12 bp, Homo sapiens
accattggctgc

SEQ ID NO: 1090707 - DNA, 22 bp, Homo sapiens
accattgtaactattaaccttt

SEQ ID NO: 1090708 - DNA, 13 bp, Homo sapiens
accattgtatttt

SEQ ID NO: 1090709 - DNA, 19 bp, Homo sapiens
accatttaataaagaaata

SEQ ID NO: 1090710 - DNA, 21 bp, Homo sapiens
accatttatacaaattagaaa

SEQ ID NO: 1090711 - DNA, 16 bp, Homo sapiens
accatttccaacagca

SEQ ID NO: 1090712 - DNA, 23 bp, Homo sapiens
accatttgaagtgtacctgtgta

SEQ ID NO: 1090713 - DNA, 22 bp, Homo sapiens
accatttgcatggctccagaaa

SEQ ID NO: 1090714 - DNA, 14 bp, Homo sapiens
accatttgtaataa

SEQ ID NO: 1090715 - DNA, 16 bp, Homo sapiens
accatttgtaataaag

SEQ ID NO: 1090716 - DNA, 20 bp, Homo sapiens
accatttgtattaccattac

SEQ ID NO: 1090717 - DNA, 15 bp, Homo sapiens
accatttgttaatat

SEQ ID NO: 1090718 - DNA, 18 bp, Homo sapiens
accattttaacgctgcct

SEQ ID NO: 1090719 - DNA, 17 bp, Homo sapiens
accattttacatttcta

SEQ ID NO: 1090720 - DNA, 20 bp, Homo sapiens
accattttattttttgggcc

SEQ ID NO: 1090721 - DNA, 21 bp, Homo sapiens
accattttattttttgggcca

SEQ ID NO: 1090722 - DNA, 23 bp, Homo sapiens
accattttattttttgggccatt

SEQ ID NO: 1090723 - DNA, 19 bp, Homo sapiens
accattttcccatcatcct

SEQ ID NO: 1090724 - DNA, 19 bp, Homo sapiens
accattttggatgtcattg

SEQ ID NO: 1090725 - DNA, 23 bp, Homo sapiens
accattttgttattgactaacag

SEQ ID NO: 1090726 - DNA, 20 bp, Homo sapiens
accattttttaaggaaacaa

SEQ ID NO: 1090727 - DNA, 17 bp, Homo sapiens
acccaaaaatatctcct

SEQ ID NO: 1090728 - DNA, 13 bp, Homo sapiens
acccaaacacttc

SEQ ID NO: 1090729 - DNA, 21 bp, Homo sapiens
acccaaagagacagctcttct

SEQ ID NO: 1090730 - DNA, 15 bp, Homo sapiens
acccaaagcctgtcc

SEQ ID NO: 1090731 - DNA, 20 bp, Homo sapiens
acccaaagcggtccctgtcc

SEQ ID NO: 1090732 - DNA, 16 bp, Homo sapiens
acccaaatgtccctgc

SEQ ID NO: 1090733 - DNA, 22 bp, Homo sapiens
acccaaattataagggccctgc

SEQ ID NO: 1090734 - DNA, 23 bp, Homo sapiens
acccaacagtttatttttattat

SEQ ID NO: 1090735 - DNA, 18 bp, Homo sapiens
acccaacccaaaccatga

SEQ ID NO: 1090736 - DNA, 16 bp, Homo sapiens
acccaactgacctgcc

SEQ ID NO: 1090737 - DNA, 17 bp, Homo sapiens
acccaagagaggaagga

SEQ ID NO: 1090738 - DNA, 13 bp, Homo sapiens
acccaagatgact

SEQ ID NO: 1090739 - DNA, 22 bp, Homo sapiens
acccaagatgggcatcttttgt

SEQ ID NO: 1090740 - DNA, 16 bp, Homo sapiens
acccaagcctgctggc

SEQ ID NO: 1090741 - DNA, 17 bp, Homo sapiens
acccaagcctgctggct

SEQ ID NO: 1090742 - DNA, 20 bp, Homo sapiens
acccaagcctgctggctgcg

SEQ ID NO: 1090743 - DNA, 17 bp, Homo sapiens
acccaagctctggggat

SEQ ID NO: 1090744 - DNA, 21 bp, Homo sapiens
acccaagctctggggatgggt

SEQ ID NO: 1090745 - DNA, 15 bp, Homo sapiens
acccaagctgtggca

SEQ ID NO: 1090746 - DNA, 21 bp, Homo sapiens
acccaagctgtggcagccgtc

SEQ ID NO: 1090747 - DNA, 13 bp, Homo sapiens
acccaagcttggc

SEQ ID NO: 1090748 - DNA, 21 bp, Homo sapiens
acccaaggagcacaggtccca

SEQ ID NO: 1090749 - DNA, 23 bp, Homo sapiens
acccaaggggatttttatgtctg

SEQ ID NO: 1090750 - DNA, 16 bp, Homo sapiens
acccaagtccctgtca

SEQ ID NO: 1090751 - DNA, 16 bp, Homo sapiens
acccaagtgggggcag

SEQ ID NO: 1090752 - DNA, 15 bp, Homo sapiens
acccccagaggtggc

SEQ ID NO: 1090753 - DNA, 16 bp, Homo sapiens
acccccagaggtggcc

SEQ ID NO: 1090754 - DNA, 12 bp, Homo sapiens
acccccagcact

SEQ ID NO: 1090755 - DNA, 14 bp, Homo sapiens
acccccagccaggc

SEQ ID NO: 1090756 - DNA, 11 bp, Homo sapiens
acccccagccc

SEQ ID NO: 1090757 - DNA, 12 bp, Homo sapiens
acccccagcccc

SEQ ID NO: 1090758 - DNA, 13 bp, Homo sapiens
acccccagccccg

SEQ ID NO: 1090759 - DNA, 14 bp, Homo sapiens
acccccagccccga

SEQ ID NO: 1090760 - DNA, 12 bp, Homo sapiens
acccccagctca

SEQ ID NO: 1090761 - DNA, 20 bp, Homo sapiens
acccccagctcaatggactg

SEQ ID NO: 1090762 - DNA, 12 bp, Homo sapiens
acccccaggcct

SEQ ID NO: 1090763 - DNA, 19 bp, Homo sapiens
acccccaggtcttcctgct

SEQ ID NO: 1090764 - DNA, 14 bp, Homo sapiens
acccccagtcctca

SEQ ID NO: 1090765 - DNA, 17 bp, Homo sapiens
acccccagtcctcactg

SEQ ID NO: 1090766 - DNA, 22 bp, Homo sapiens
acccccagtgtattttgtccaa

SEQ ID NO: 1090767 - DNA, 18 bp, Homo sapiens
acccccatcttccacctg

SEQ ID NO: 1090768 - DNA, 16 bp, Homo sapiens
acccccatgtggcagc

SEQ ID NO: 1090769 - DNA, 17 bp, Homo sapiens
acccccatgtggcagcc

SEQ ID NO: 1090770 - DNA, 20 bp, Homo sapiens
acccccatgtggcagcccat

SEQ ID NO: 1090771 - DNA, 18 bp, Homo sapiens
acccccatttctatttat

SEQ ID NO: 1090772 - DNA, 13 bp, Homo sapiens
accccccacctgc

SEQ ID NO: 1090773 - DNA, 13 bp, Homo sapiens
accccccactcag

SEQ ID NO: 1090774 - DNA, 15 bp, Homo sapiens
accccccagcctcca

SEQ ID NO: 1090775 - DNA, 13 bp, Homo sapiens
accccccaggccc

SEQ ID NO: 1090776 - DNA, 21 bp, Homo sapiens
accccccccattagaatgtga

SEQ ID NO: 1090777 - DNA, 18 bp, Homo sapiens
acccccccccaatcggac

SEQ ID NO: 1090778 - DNA, 19 bp, Homo sapiens
acccccctaccccatgctg

SEQ ID NO: 1090779 - DNA, 14 bp, Homo sapiens
acccccctcccaga

SEQ ID NO: 1090780 - DNA, 17 bp, Homo sapiens
acccccctcccagacag

SEQ ID NO: 1090781 - DNA, 11 bp, Homo sapiens
acccccctcct

SEQ ID NO: 1090782 - DNA, 17 bp, Homo sapiens
acccccctcctccccct

SEQ ID NO: 1090783 - DNA, 12 bp, Homo sapiens
acccccctcctg

SEQ ID NO: 1090784 - DNA, 15 bp, Homo sapiens
acccccctcctgctc

SEQ ID NO: 1090785 - DNA, 17 bp, Homo sapiens
acccccctcctgctcct

SEQ ID NO: 1090786 - DNA, 17 bp, Homo sapiens
acccccctctctttctc

SEQ ID NO: 1090787 - DNA, 20 bp, Homo sapiens
acccccctctctttctctgg

SEQ ID NO: 1090788 - DNA, 14 bp, Homo sapiens
acccccctgtacac

SEQ ID NO: 1090789 - DNA, 16 bp, Homo sapiens
acccccgacggcctcc

SEQ ID NO: 1090790 - DNA, 20 bp, Homo sapiens
acccccgacggcctccagga

SEQ ID NO: 1090791 - DNA, 16 bp, Homo sapiens
acccccgaggggaggg

SEQ ID NO: 1090792 - DNA, 14 bp, Homo sapiens
acccccgccaggcg

SEQ ID NO: 1090793 - DNA, 14 bp, Homo sapiens
acccccgcccccac

SEQ ID NO: 1090794 - DNA, 21 bp, Homo sapiens
acccccgcccccaccgggctg

SEQ ID NO: 1090795 - DNA, 18 bp, Homo sapiens
acccccgccccctgccct

SEQ ID NO: 1090796 - DNA, 19 bp, Homo sapiens
acccccgccccctgccctc

SEQ ID NO: 1090797 - DNA, 15 bp, Homo sapiens
acccccgctggagga

SEQ ID NO: 1090798 - DNA, 19 bp, Homo sapiens
acccccgggatcctgcccc

SEQ ID NO: 1090799 - DNA, 20 bp, Homo sapiens
acccccgggatcctgccccc

SEQ ID NO: 1090800 - DNA, 13 bp, Homo sapiens
accccctcagcct

SEQ ID NO: 1090801 - DNA, 18 bp, Homo sapiens
accccctcagccttggga

SEQ ID NO: 1090802 - DNA, 16 bp, Homo sapiens
accccctcatccccca

SEQ ID NO: 1090803 - DNA, 15 bp, Homo sapiens
accccctcattcccc

SEQ ID NO: 1090804 - DNA, 17 bp, Homo sapiens
accccctcattcccctc

SEQ ID NO: 1090805 - DNA, 18 bp, Homo sapiens
accccctcattcccctcg

SEQ ID NO: 1090806 - DNA, 14 bp, Homo sapiens
accccctccctggc

SEQ ID NO: 1090807 - DNA, 16 bp, Homo sapiens
accccctccctggcct

SEQ ID NO: 1090808 - DNA, 22 bp, Homo sapiens
accccctccctggcctgttctg

SEQ ID NO: 1090809 - DNA, 13 bp, Homo sapiens
accccctccctgt

SEQ ID NO: 1090810 - DNA, 13 bp, Homo sapiens
accccctcctccc

SEQ ID NO: 1090811 - DNA, 14 bp, Homo sapiens
accccctcctctct

SEQ ID NO: 1090812 - DNA, 15 bp, Homo sapiens
accccctcctctctg

SEQ ID NO: 1090813 - DNA, 16 bp, Homo sapiens
accccctcctctctgc

SEQ ID NO: 1090814 - DNA, 15 bp, Homo sapiens
accccctcgccagct

SEQ ID NO: 1090815 - DNA, 19 bp, Homo sapiens
accccctcgccagcttggc

SEQ ID NO: 1090816 - DNA, 17 bp, Homo sapiens
accccctgcaaagccca

SEQ ID NO: 1090817 - DNA, 12 bp, Homo sapiens
accccctggaga

SEQ ID NO: 1090818 - DNA, 13 bp, Homo sapiens
accccctgtccca

SEQ ID NO: 1090819 - DNA, 12 bp, Homo sapiens
acccccttcccc

SEQ ID NO: 1090820 - DNA, 18 bp, Homo sapiens
acccccttctactgagcc

SEQ ID NO: 1090821 - DNA, 19 bp, Homo sapiens
acccccttctactgagcct

SEQ ID NO: 1090822 - DNA, 13 bp, Homo sapiens
acccccttctctg

SEQ ID NO: 1090823 - DNA, 20 bp, Homo sapiens
accccgagaagtgctcttgg

SEQ ID NO: 1090824 - DNA, 15 bp, Homo sapiens
accccgagggctgag

SEQ ID NO: 1090825 - DNA, 17 bp, Homo sapiens
accccgagggctgagga

SEQ ID NO: 1090826 - DNA, 22 bp, Homo sapiens
accccgagggctgaggagcagc

SEQ ID NO: 1090827 - DNA, 17 bp, Homo sapiens
accccgcagacaccttg

SEQ ID NO: 1090828 - DNA, 20 bp, Homo sapiens
accccgcagacaccttggac

SEQ ID NO: 1090829 - DNA, 20 bp, Homo sapiens
accccgcggcccagacccag

SEQ ID NO: 1090830 - DNA, 18 bp, Homo sapiens
accccgcggtgctctggc

SEQ ID NO: 1090831 - DNA, 22 bp, Homo sapiens
accccgcggtgctctggcggct

SEQ ID NO: 1090832 - DNA, 15 bp, Homo sapiens
accccggcctccact

SEQ ID NO: 1090833 - DNA, 21 bp, Homo sapiens
accccggcctccactccccca

SEQ ID NO: 1090834 - DNA, 15 bp, Homo sapiens
accccgggctctctg

SEQ ID NO: 1090835 - DNA, 17 bp, Homo sapiens
accccgggctctctgct

SEQ ID NO: 1090836 - DNA, 18 bp, Homo sapiens
accccggggaccctgtga

SEQ ID NO: 1090837 - DNA, 22 bp, Homo sapiens
accccggggcatggacagggcc

SEQ ID NO: 1090838 - DNA, 21 bp, Homo sapiens
accccggggtgcccacaggcc

SEQ ID NO: 1090839 - DNA, 15 bp, Homo sapiens
accccgtctctacta

SEQ ID NO: 1090840 - DNA, 22 bp, Homo sapiens
accccgtctggggttcagcccc

SEQ ID NO: 1090841 - DNA, 23 bp, Homo sapiens
accccgtctggggttcagcccct

SEQ ID NO: 1090842 - DNA, 14 bp, Homo sapiens
accccgtgccaccc

SEQ ID NO: 1090843 - DNA, 15 bp, Homo sapiens
accccgtgcccctgt

SEQ ID NO: 1090844 - DNA, 13 bp, Homo sapiens
accccgtggctct

SEQ ID NO: 1090845 - DNA, 17 bp, Homo sapiens
accccgtggctctggga

SEQ ID NO: 1090846 - DNA, 17 bp, Homo sapiens
acccctaaaaagattgc

SEQ ID NO: 1090847 - DNA, 15 bp, Homo sapiens
acccctaagactgcc

SEQ ID NO: 1090848 - DNA, 13 bp, Homo sapiens
acccctaccccct

SEQ ID NO: 1090849 - DNA, 19 bp, Homo sapiens
acccctagaaaggagagaa

SEQ ID NO: 1090850 - DNA, 20 bp, Homo sapiens
acccctcaacacctctgcac

SEQ ID NO: 1090851 - DNA, 15 bp, Homo sapiens
acccctcaccacccc

SEQ ID NO: 1090852 - DNA, 20 bp, Homo sapiens
acccctcaccacccccactg

SEQ ID NO: 1090853 - DNA, 19 bp, Homo sapiens
acccctcaccttgcaacac

SEQ ID NO: 1090854 - DNA, 15 bp, Homo sapiens
acccctcactcccca

SEQ ID NO: 1090855 - DNA, 18 bp, Homo sapiens
acccctcactccccaggg

SEQ ID NO: 1090856 - DNA, 11 bp, Homo sapiens
acccctcccat

SEQ ID NO: 1090857 - DNA, 12 bp, Homo sapiens
acccctccccag

SEQ ID NO: 1090858 - DNA, 13 bp, Homo sapiens
acccctccctccc

SEQ ID NO: 1090859 - DNA, 15 bp, Homo sapiens
acccctccctccctc

SEQ ID NO: 1090860 - DNA, 18 bp, Homo sapiens
acccctccctgcaggggc

SEQ ID NO: 1090861 - DNA, 11 bp, Homo sapiens
acccctccctt

SEQ ID NO: 1090862 - DNA, 19 bp, Homo sapiens
acccctcgactcagcacca

SEQ ID NO: 1090863 - DNA, 21 bp, Homo sapiens
acccctcgcaaccctgcctgt

SEQ ID NO: 1090864 - DNA, 12 bp, Homo sapiens
acccctctggtg

SEQ ID NO: 1090865 - DNA, 22 bp, Homo sapiens
acccctctggtgtgtggtgagg

SEQ ID NO: 1090866 - DNA, 13 bp, Homo sapiens
acccctcttccag

SEQ ID NO: 1090867 - DNA, 18 bp, Homo sapiens
acccctcttccagcttct

SEQ ID NO: 1090868 - DNA, 17 bp, Homo sapiens
acccctcttctgctcct

SEQ ID NO: 1090869 - DNA, 16 bp, Homo sapiens
acccctgactcatcat

SEQ ID NO: 1090870 - DNA, 18 bp, Homo sapiens
acccctgccactcaccct

SEQ ID NO: 1090871 - DNA, 18 bp, Homo sapiens
acccctgccctgctccta

SEQ ID NO: 1090872 - DNA, 21 bp, Homo sapiens
acccctgcctcccatgcctgg

SEQ ID NO: 1090873 - DNA, 22 bp, Homo sapiens
acccctgcctcccatgcctggt

SEQ ID NO: 1090874 - DNA, 14 bp, Homo sapiens
acccctgcctcgag

SEQ ID NO: 1090875 - DNA, 22 bp, Homo sapiens
acccctgcctcgagggccgcct

SEQ ID NO: 1090876 - DNA, 20 bp, Homo sapiens
accctggcctgaactgagga

SEQ ID NO: 1090877 - DNA, 22 bp, Homo sapiens
accctggcctgccagtctgcct

SEQ ID NO: 1090878 - DNA, 21 bp, Homo sapiens
accctggcttgcttgccgagc

SEQ ID NO: 1090879 - DNA, 23 bp, Homo sapiens
accctgggacctaggggcgccgc

SEQ ID NO: 1090880 - DNA, 15 bp, Homo sapiens
accctgggagagaag

SEQ ID NO: 1090881 - DNA, 17 bp, Homo sapiens
accctgggcagtgagtg

SEQ ID NO: 1090882 - DNA, 18 bp, Homo sapiens
accctgggccctgggctg

SEQ ID NO: 1090883 - DNA, 20 bp, Homo sapiens
accctgggccctgggctgga

SEQ ID NO: 1090884 - DNA, 17 bp, Homo sapiens
accctgggctggggagg

SEQ ID NO: 1090885 - DNA, 15 bp, Homo sapiens
accctgggctgtcca

SEQ ID NO: 1090886 - DNA, 22 bp, Homo sapiens
accctgggctgtccagccttaa

SEQ ID NO: 1090887 - DNA, 19 bp, Homo sapiens
accctggggaaggagccag

SEQ ID NO: 1090888 - DNA, 17 bp, Homo sapiens
accctggggcaggggtg

SEQ ID NO: 1090889 - DNA, 18 bp, Homo sapiens
accctggggcaggggtgc

SEQ ID NO: 1090890 - DNA, 18 bp, Homo sapiens
accctggggcctggacct

SEQ ID NO: 1090891 - DNA, 19 bp, Homo sapiens
accctgggtgggctctgtg

SEQ ID NO: 1090892 - DNA, 15 bp, Homo sapiens
accctggtctgtgga

SEQ ID NO: 1090893 - DNA, 18 bp, Homo sapiens
accctggtgacctcctgt

SEQ ID NO: 1090894 - DNA, 18 bp, Homo sapiens
accctggtggttgctgtt

SEQ ID NO: 1090895 - DNA, 20 bp, Homo sapiens
accctgtactgttctgtgtc

SEQ ID NO: 1090896 - DNA, 18 bp, Homo sapiens
accctgtatatagcccag

SEQ ID NO: 1090897 - DNA, 20 bp, Homo sapiens
accctgtcaagttaacaagg

SEQ ID NO: 1090898 - DNA, 21 bp, Homo sapiens
accctgtcaagttaacaagga

SEQ ID NO: 1090899 - DNA, 14 bp, Homo sapiens
accctgtcccccag

SEQ ID NO: 1090900 - DNA, 15 bp, Homo sapiens
accctgtccggccca

SEQ ID NO: 1090901 - DNA, 16 bp, Homo sapiens
accctgtccggcccag

SEQ ID NO: 1090902 - DNA, 18 bp, Homo sapiens
accctgtccggcccagtg

SEQ ID NO: 1090903 - DNA, 21 bp, Homo sapiens
accctgtccggcccagtgcca

SEQ ID NO: 1090904 - DNA, 14 bp, Homo sapiens
accctgtcctgcag

SEQ ID NO: 1090905 - DNA, 14 bp, Homo sapiens
accctgtctgtccc

SEQ ID NO: 1090906 - DNA, 22 bp, Homo sapiens
accctgtctgtcccttttcttt

SEQ ID NO: 1090907 - DNA, 17 bp, Homo sapiens
accctgtcttctgggca

SEQ ID NO: 1090908 - DNA, 23 bp, Homo sapiens
accctgtgctggtgtcctgacca

SEQ ID NO: 1090909 - DNA, 17 bp, Homo sapiens
accctgtggaagcatgg

SEQ ID NO: 1090910 - DNA, 22 bp, Homo sapiens
accctgtggaagcatggctgtc

SEQ ID NO: 1090911 - DNA, 12 bp, Homo sapiens
accctgtggcca

SEQ ID NO: 1090912 - DNA, 22 bp, Homo sapiens
accctgtgggaccgcctggccc

SEQ ID NO: 1090913 - DNA, 19 bp, Homo sapiens
accctgtgggtgtctccct

SEQ ID NO: 1090914 - DNA, 20 bp, Homo sapiens
accctgtgggtgtctccctc

SEQ ID NO: 1090915 - DNA, 16 bp, Homo sapiens
accctgtgtcagagcc

SEQ ID NO: 1090916 - DNA, 15 bp, Homo sapiens
accctgttcctggag

SEQ ID NO: 1090917 - DNA, 18 bp, Homo sapiens
accctgttcctggaggtc

SEQ ID NO: 1090918 - DNA, 15 bp, Homo sapiens
accctgtttcctgag

SEQ ID NO: 1090919 - DNA, 12 bp, Homo sapiens
accctgtttctg

SEQ ID NO: 1090920 - DNA, 14 bp, Homo sapiens
acccttaacccaag

SEQ ID NO: 1090921 - DNA, 15 bp, Homo sapiens
acccttaacccaagg

SEQ ID NO: 1090922 - DNA, 18 bp, Homo sapiens
acccttaacccaaggagc

SEQ ID NO: 1090923 - DNA, 22 bp, Homo sapiens
acccttaccccttagcctccct

SEQ ID NO: 1090924 - DNA, 13 bp, Homo sapiens
acccttacttcct

SEQ ID NO: 1090925 - DNA, 18 bp, Homo sapiens
acccttacttcctggcct

SEQ ID NO: 1090926 - DNA, 20 bp, Homo sapiens
acccttacttcctggcctct

SEQ ID NO: 1090927 - DNA, 17 bp, Homo sapiens
acccttaggatggggct

SEQ ID NO: 1090928 - DNA, 24 bp, Homo sapiens
acccttaggatggggctcccagct

SEQ ID NO: 1090929 - DNA, 23 bp, Homo sapiens
acccttatcaccagctgcctctt

SEQ ID NO: 1090930 - DNA, 15 bp, Homo sapiens
acccttattgctgtc

SEQ ID NO: 1090931 - DNA, 16 bp, Homo sapiens
acccttcaactcctgg

SEQ ID NO: 1090932 - DNA, 20 bp, Homo sapiens
acccttcaactcctggctcc

SEQ ID NO: 1090933 - DNA, 15 bp, Homo sapiens
acccttcagacccca

SEQ ID NO: 1090934 - DNA, 16 bp, Homo sapiens
acccttcagaccccag

SEQ ID NO: 1090935 - DNA, 17 bp, Homo sapiens
acccttcagaccccagt

SEQ ID NO: 1090936 - DNA, 15 bp, Homo sapiens
acccttcagggccag

SEQ ID NO: 1090937 - DNA, 16 bp, Homo sapiens
acccttcagggccaga

SEQ ID NO: 1090938 - DNA, 20 bp, Homo sapiens
acccttcatcttcctgtgtc

SEQ ID NO: 1090939 - DNA, 12 bp, Homo sapiens
acccttccatca

SEQ ID NO: 1090940 - DNA, 21 bp, Homo sapiens
acccttcccagccctcatccc

SEQ ID NO: 1090941 - DNA, 22 bp, Homo sapiens
acccttcccgcctccctctcag

SEQ ID NO: 1090942 - DNA, 13 bp, Homo sapiens
acccttccctgca

SEQ ID NO: 1090943 - DNA, 20 bp, Homo sapiens
acccttcctggcccaggcct

SEQ ID NO: 1090944 - DNA, 21 bp, Homo sapiens
acccttctccaaaggctctgt

SEQ ID NO: 1090945 - DNA, 15 bp, Homo sapiens
acccttctcctcttg

SEQ ID NO: 1090946 - DNA, 12 bp, Homo sapiens
acccttctcgga

SEQ ID NO: 1090947 - DNA, 13 bp, Homo sapiens
acccttctgggca

SEQ ID NO: 1090948 - DNA, 15 bp, Homo sapiens
acccttctttcctct

SEQ ID NO: 1090949 - DNA, 14 bp, Homo sapiens
acccttgaatttct

SEQ ID NO: 1090950 - DNA, 19 bp, Homo sapiens
acccttgaatttctagaca

SEQ ID NO: 1090951 - DNA, 20 bp, Homo sapiens
acccttgcatccattgttgt

SEQ ID NO: 1090952 - DNA, 18 bp, Homo sapiens
acccttgctttcctgggc

SEQ ID NO: 1090953 - DNA, 15 bp, Homo sapiens
acccttggaaaacaa

SEQ ID NO: 1090954 - DNA, 23 bp, Homo sapiens
acccttggaaaacaaaagtttta

SEQ ID NO: 1090955 - DNA, 11 bp, Homo sapiens
acccttggcct

SEQ ID NO: 1090956 - DNA, 12 bp, Homo sapiens
acccttggcctc

SEQ ID NO: 1090957 - DNA, 12 bp, Homo sapiens
acccttggcctg

SEQ ID NO: 1090958 - DNA, 13 bp, Homo sapiens
acccttggcctgt

SEQ ID NO: 1090959 - DNA, 23 bp, Homo sapiens
acccttggctatgaaaatgagcc

SEQ ID NO: 1090960 - DNA, 17 bp, Homo sapiens
acccttggctcaatcct

SEQ ID NO: 1090961 - DNA, 20 bp, Homo sapiens
acccttgggccagaagtacc

SEQ ID NO: 1090962 - DNA, 17 bp, Homo sapiens
acccttggttcctaact

SEQ ID NO: 1090963 - DNA, 15 bp, Homo sapiens
accctttagtgcttt

SEQ ID NO: 1090964 - DNA, 21 bp, Homo sapiens
accctttagtgctttgtgata

SEQ ID NO: 1090965 - DNA, 14 bp, Homo sapiens
accctttcctcccc

SEQ ID NO: 1090966 - DNA, 19 bp, Homo sapiens
accctttccttccttccct

SEQ ID NO: 1090967 - DNA, 22 bp, Homo sapiens
accctttccttccttccctggc

SEQ ID NO: 1090968 - DNA, 23 bp, Homo sapiens
accctttccttccttccctggct

SEQ ID NO: 1090969 - DNA, 15 bp, Homo sapiens
accctttctgttgcc

SEQ ID NO: 1090970 - DNA, 21 bp, Homo sapiens
accctttcttgacaaaaccta

SEQ ID NO: 1090971 - DNA, 23 bp, Homo sapiens
accctttgcctttcttctgccct

SEQ ID NO: 1090972 - DNA, 23 bp, Homo sapiens
accctttggggggggcccgcctg

SEQ ID NO: 1090973 - DNA, 19 bp, Homo sapiens
accctttgtattataattg

SEQ ID NO: 1090974 - DNA, 23 bp, Homo sapiens
acccttttaagtttaaaatgtgt

SEQ ID NO: 1090975 - DNA, 11 bp, Homo sapiens
acccttttcat

SEQ ID NO: 1090976 - DNA, 12 bp, Homo sapiens
acccttttccag

SEQ ID NO: 1090977 - DNA, 16 bp, Homo sapiens
acccttttttctaagt

SEQ ID NO: 1090978 - DNA, 13 bp, Homo sapiens
accgaataaatgt

SEQ ID NO: 1090979 - DNA, 16 bp, Homo sapiens
accgaatatattactg

SEQ ID NO: 1090980 - DNA, 15 bp, Homo sapiens
accgaccaactgccc

SEQ ID NO: 1090981 - DNA, 14 bp, Homo sapiens
accgaccccgggcc

SEQ ID NO: 1090982 - DNA, 15 bp, Homo sapiens
accgaccccgggccg

SEQ ID NO: 1090983 - DNA, 23 bp, Homo sapiens
accgacctggtttttaaatagag

SEQ ID NO: 1090984 - DNA, 17 bp, Homo sapiens
accgacgcgtctcctgt

SEQ ID NO: 1090985 - DNA, 14 bp, Homo sapiens
accgactttcccca

SEQ ID NO: 1090986 - DNA, 17 bp, Homo sapiens
accgagagtagccgaga

SEQ ID NO: 1090987 - DNA, 19 bp, Homo sapiens
accgagataggggaggggg

SEQ ID NO: 1090988 - DNA, 15 bp, Homo sapiens
accgagatgtgagtc

SEQ ID NO: 1090989 - DNA, 24 bp, Homo sapiens
accgagatgtgagtcctgttgaag

SEQ ID NO: 1090990 - DNA, 19 bp, Homo sapiens
accgagcaaagatcaaaat

SEQ ID NO: 1090991 - DNA, 16 bp, Homo sapiens
accgagccagcagctg

SEQ ID NO: 1090992 - DNA, 14 bp, Homo sapiens
accgaggttcccag

SEQ ID NO: 1090993 - DNA, 20 bp, Homo sapiens
accgagtagaaaatgtgacc

SEQ ID NO: 1090994 - DNA, 15 bp, Homo sapiens
accgagtatctgtaa

SEQ ID NO: 1090995 - DNA, 18 bp, Homo sapiens
accgagtctcttctccac

SEQ ID NO: 1090996 - DNA, 21 bp, Homo sapiens
accgagtctcttctccactgg

SEQ ID NO: 1090997 - DNA, 18 bp, Homo sapiens
acctcagctgcacattcc

SEQ ID NO: 1090998 - DNA, 17 bp, Homo sapiens
acctcaggagggcaggc

SEQ ID NO: 1090999 - DNA, 15 bp, Homo sapiens
acctcaggcagctca

SEQ ID NO: 1091000 - DNA, 16 bp, Homo sapiens
acctcaggcagctcaa

SEQ ID NO: 1091001 - DNA, 21 bp, Homo sapiens
acctcaggccaggtgcagtgg

SEQ ID NO: 1091002 - DNA, 15 bp, Homo sapiens
acctcagggctccca

SEQ ID NO: 1091003 - DNA, 16 bp, Homo sapiens
acctcagggctcccag

SEQ ID NO: 1091004 - DNA, 18 bp, Homo sapiens
acctcagggctgtcccag

SEQ ID NO: 1091005 - DNA, 21 bp, Homo sapiens
acctcaggggcacctccggct

SEQ ID NO: 1091006 - DNA, 15 bp, Homo sapiens
acctcaggtgatcca

SEQ ID NO: 1091007 - DNA, 22 bp, Homo sapiens
acctcaggtgatctgcccgcct

SEQ ID NO: 1091008 - DNA, 17 bp, Homo sapiens
acctcaggtgtgcctgt

SEQ ID NO: 1091009 - DNA, 21 bp, Homo sapiens
acctcagtaatttagaaatca

SEQ ID NO: 1091010 - DNA, 18 bp, Homo sapiens
acctcagtatttatgtaa

SEQ ID NO: 1091011 - DNA, 13 bp, Homo sapiens
acctcagtgggaa

SEQ ID NO: 1091012 - DNA, 19 bp, Homo sapiens
acctcagtgtcatttatga

SEQ ID NO: 1091013 - DNA, 18 bp, Homo sapiens
acctcagttattacatgt

SEQ ID NO: 1091014 - DNA, 22 bp, Homo sapiens
acctcagttattacatgtaatt

SEQ ID NO: 1091015 - DNA, 22 bp, Homo sapiens
acctcagttcccttggcctcag

SEQ ID NO: 1091016 - DNA, 23 bp, Homo sapiens
acctcagttcccttggcctcaga

SEQ ID NO: 1091017 - DNA, 18 bp, Homo sapiens
acctcagttttatcattt

SEQ ID NO: 1091018 - DNA, 14 bp, Homo sapiens
acctcatcactgga

SEQ ID NO: 1091019 - DNA, 21 bp, Homo sapiens
acctcatcactggactgcatg

SEQ ID NO: 1091020 - DNA, 15 bp, Homo sapiens
acctcatcatccacc

SEQ ID NO: 1091021 - DNA, 11 bp, Homo sapiens
acctcatcctg

SEQ ID NO: 1091022 - DNA, 14 bp, Homo sapiens
acctcatcctgctc

SEQ ID NO: 1091023 - DNA, 19 bp, Homo sapiens
acctcatctgtggagctgc

SEQ ID NO: 1091024 - DNA, 19 bp, Homo sapiens
acctcatctttctccttca

SEQ ID NO: 1091025 - DNA, 23 bp, Homo sapiens
acctcatgcccaccccctgccct

SEQ ID NO: 1091026 - DNA, 15 bp, Homo sapiens
acctcatgcccagct

SEQ ID NO: 1091027 - DNA, 19 bp, Homo sapiens
acctcatggattgccacag

SEQ ID NO: 1091028 - DNA, 23 bp, Homo sapiens
acctcatggattgccacagctca

SEQ ID NO: 1091029 - DNA, 22 bp, Homo sapiens
acctccaaccaaataagacttc

SEQ ID NO: 1091030 - DNA, 15 bp, Homo sapiens
acctccaaccctgcc

SEQ ID NO: 1091031 - DNA, 23 bp, Homo sapiens
acctccaaccctgccgtcaccac

SEQ ID NO: 1091032 - DNA, 23 bp, Homo sapiens
acctccaataaagtgccttctgg

SEQ ID NO: 1091033 - DNA, 20 bp, Homo sapiens
acctccaccacatctgccag

SEQ ID NO: 1091034 - DNA, 11 bp, Homo sapiens
acctccaccca

SEQ ID NO: 1091035 - DNA, 12 bp, Homo sapiens
acctccacccag

SEQ ID NO: 1091036 - DNA, 20 bp, Homo sapiens
acctccacccccgccacggc

SEQ ID NO: 1091037 - DNA, 22 bp, Homo sapiens
acctccacccccgccacggcca

SEQ ID NO: 1091038 - DNA, 12 bp, Homo sapiens
acctccaccctg

SEQ ID NO: 1091039 - DNA, 19 bp, Homo sapiens
acctccactctctgcccct

SEQ ID NO: 1091040 - DNA, 19 bp, Homo sapiens
acctccagcccgggagcct

SEQ ID NO: 1091041 - DNA, 21 bp, Homo sapiens
acctccaggcaggccaggctg

SEQ ID NO: 1091042 - DNA, 22 bp, Homo sapiens
acctccaggcaggccaggctgc

SEQ ID NO: 1091043 - DNA, 18 bp, Homo sapiens
acctccagtgtcagggtc

SEQ ID NO: 1091044 - DNA, 22 bp, Homo sapiens
acctccatactcaagctgtctc

SEQ ID NO: 1091045 - DNA, 13 bp, Homo sapiens
acctccatccctg

SEQ ID NO: 1091046 - DNA, 17 bp, Homo sapiens
acctccatccctgctct

SEQ ID NO: 1091047 - DNA, 18 bp, Homo sapiens
acctccatccctgctctg

SEQ ID NO: 1091048 - DNA, 21 bp, Homo sapiens
acctccattctattttagaat

SEQ ID NO: 1091049 - DNA, 12 bp, Homo sapiens
acctcccagagg

SEQ ID NO: 1091050 - DNA, 22 bp, Homo sapiens
acctcccagaggtccagcccat

SEQ ID NO: 1091051 - DNA, 13 bp, Homo sapiens
acctcccagccct

SEQ ID NO: 1091052 - DNA, 20 bp, Homo sapiens
acctcccagccctatggatg

SEQ ID NO: 1091053 - DNA, 13 bp, Homo sapiens
acctcccaggaca

SEQ ID NO: 1091054 - DNA, 13 bp, Homo sapiens
acctcccagggga

SEQ ID NO: 1091055 - DNA, 15 bp, Homo sapiens
acctcccaggggact

SEQ ID NO: 1091056 - DNA, 19 bp, Homo sapiens
acctcccatttctgttgct

SEQ ID NO: 1091057 - DNA, 20 bp, Homo sapiens
acctcccatttctgttgctg

SEQ ID NO: 1091058 - DNA, 11 bp, Homo sapiens
acctccccaaa

SEQ ID NO: 1091059 - DNA, 20 bp, Homo sapiens
acctccccacacacaggcct

SEQ ID NO: 1091060 - DNA, 22 bp, Homo sapiens
acctccccacacacaggccttc

SEQ ID NO: 1091061 - DNA, 17 bp, Homo sapiens
acctccccccactgcag

SEQ ID NO: 1091062 - DNA, 20 bp, Homo sapiens
acctccccctacccatatcc

SEQ ID NO: 1091063 - DNA, 21 bp, Homo sapiens
acctccccctcccccttctcc

SEQ ID NO: 1091064 - DNA, 14 bp, Homo sapiens
acctcccctatcca

SEQ ID NO: 1091065 - DNA, 19 bp, Homo sapiens
acctcccctatccacccag

SEQ ID NO: 1091066 - DNA, 16 bp, Homo sapiens
acctcccctccccagc

SEQ ID NO: 1091067 - DNA, 13 bp, Homo sapiens
acctcccctcctt

SEQ ID NO: 1091068 - DNA, 21 bp, Homo sapiens
acctcccctccttgcctcctg

SEQ ID NO: 1091069 - DNA, 22 bp, Homo sapiens
acctcccctccttgcctcctgt

SEQ ID NO: 1091070 - DNA, 15 bp, Homo sapiens
acctcccctgccttg

SEQ ID NO: 1091071 - DNA, 16 bp, Homo sapiens
acctcccctgccttgc

SEQ ID NO: 1091072 - DNA, 17 bp, Homo sapiens
acctcccctgccttgct

SEQ ID NO: 1091073 - DNA, 13 bp, Homo sapiens
acctcccctgcgt

SEQ ID NO: 1091074 - DNA, 20 bp, Homo sapiens
acctcccgccctcacctgca

SEQ ID NO: 1091075 - DNA, 17 bp, Homo sapiens
acctccctaccaaaaat

SEQ ID NO: 1091076 - DNA, 14 bp, Homo sapiens
acctccctactccc

SEQ ID NO: 1091077 - DNA, 9 bp, Homo sapiens
acctccctc

SEQ ID NO: 1091078 - DNA, 10 bp, Homo sapiens
acctccctcc

SEQ ID NO: 1091079 - DNA, 11 bp, Homo sapiens
acctccctccc

SEQ ID NO: 1091080 - DNA, 19 bp, Homo sapiens
acctccctccccagctccg

SEQ ID NO: 1091081 - DNA, 21 bp, Homo sapiens
acctccctccccagctccgga

SEQ ID NO: 1091082 - DNA, 15 bp, Homo sapiens
acctccctcccggca

SEQ ID NO: 1091083 - DNA, 12 bp, Homo sapiens
acctccctccct

SEQ ID NO: 1091084 - DNA, 14 bp, Homo sapiens
acctccctcctcag

SEQ ID NO: 1091085 - DNA, 13 bp, Homo sapiens
acctccctcgccc

SEQ ID NO: 1091086 - DNA, 15 bp, Homo sapiens
acctccctgaaccat

SEQ ID NO: 1091087 - DNA, 13 bp, Homo sapiens
acctccctgaccc

SEQ ID NO: 1091088 - DNA, 17 bp, Homo sapiens
acctccctgacccgtct

SEQ ID NO: 1091089 - DNA, 14 bp, Homo sapiens
acctccctgcgccc

SEQ ID NO: 1091090 - DNA, 13 bp, Homo sapiens
acctcccttccca

SEQ ID NO: 1091091 - DNA, 13 bp, Homo sapiens
acctcccttccga

SEQ ID NO: 1091092 - DNA, 18 bp, Homo sapiens
acctcccttccgaccctc

SEQ ID NO: 1091093 - DNA, 17 bp, Homo sapiens
acctccgcgggctgact

SEQ ID NO: 1091094 - DNA, 20 bp, Homo sapiens
acctcctaccccttcctgtc

SEQ ID NO: 1091095 - DNA, 22 bp, Homo sapiens
acctcctaccccttcctgtcct

SEQ ID NO: 1091096 - DNA, 17 bp, Homo sapiens
acctcctaccctcccac

SEQ ID NO: 1091097 - DNA, 15 bp, Homo sapiens
acctcctatatcatt

SEQ ID NO: 1091098 - DNA, 12 bp, Homo sapiens
acctcctccccc

SEQ ID NO: 1091099 - DNA, 17 bp, Homo sapiens
acctcctccccctgttc

SEQ ID NO: 1091100 - DNA, 18 bp, Homo sapiens
acctcctctcactcccca

SEQ ID NO: 1091101 - DNA, 19 bp, Homo sapiens
acctcctctcactccccag

SEQ ID NO: 1091102 - DNA, 12 bp, Homo sapiens
acctcctctcag

SEQ ID NO: 1091103 - DNA, 17 bp, Homo sapiens
acctcctctcagtgttt

SEQ ID NO: 1091104 - DNA, 21 bp, Homo sapiens
acctcctgagaaggcgaggag

SEQ ID NO: 1091105 - DNA, 15 bp, Homo sapiens
acctcctgcccagga

SEQ ID NO: 1091106 - DNA, 16 bp, Homo sapiens
acctcctgcccaggag

SEQ ID NO: 1091107 - DNA, 21 bp, Homo sapiens
acctcctgcccaggagagcca

SEQ ID NO: 1091108 - DNA, 17 bp, Homo sapiens
acctcgctcccctctgg

SEQ ID NO: 1091109 - DNA, 19 bp, Homo sapiens
acctcgctcccctctggaa

SEQ ID NO: 1091110 - DNA, 16 bp, Homo sapiens
acctcgctggactctc

SEQ ID NO: 1091111 - DNA, 22 bp, Homo sapiens
acctcggagggatggagaaaga

SEQ ID NO: 1091112 - DNA, 18 bp, Homo sapiens
acctcggcttgtgggctg

SEQ ID NO: 1091113 - DNA, 19 bp, Homo sapiens
acctcggcttgtgggctgg

SEQ ID NO: 1091114 - DNA, 17 bp, Homo sapiens
acctcggggagaggggg

SEQ ID NO: 1091115 - DNA, 15 bp, Homo sapiens
acctcggtgaccact

SEQ ID NO: 1091116 - DNA, 23 bp, Homo sapiens
acctcgtgccaccccgagggctg

SEQ ID NO: 1091117 - DNA, 17 bp, Homo sapiens
acctctaatagaggcag

SEQ ID NO: 1091118 - DNA, 21 bp, Homo sapiens
acctctacccaaaccctaggt

SEQ ID NO: 1091119 - DNA, 14 bp, Homo sapiens
acctgcacctcccc

SEQ ID NO: 1091120 - DNA, 20 bp, Homo sapiens
acctgcacctccccccactg

SEQ ID NO: 1091121 - DNA, 20 bp, Homo sapiens
acctgcactgaaacctgaga

SEQ ID NO: 1091122 - DNA, 14 bp, Homo sapiens
acctgcaggaccct

SEQ ID NO: 1091123 - DNA, 15 bp, Homo sapiens
acctgcagttaacag

SEQ ID NO: 1091124 - DNA, 16 bp, Homo sapiens
acctgcagttcctgag

SEQ ID NO: 1091125 - DNA, 17 bp, Homo sapiens
acctgcagttcctgagt

SEQ ID NO: 1091126 - DNA, 15 bp, Homo sapiens
acctgccaccaggga

SEQ ID NO: 1091127 - DNA, 14 bp, Homo sapiens
acctgccagcctgg

SEQ ID NO: 1091128 - DNA, 13 bp, Homo sapiens
acctgccaggcag

SEQ ID NO: 1091129 - DNA, 15 bp, Homo sapiens
acctgccaggcaggg

SEQ ID NO: 1091130 - DNA, 20 bp, Homo sapiens
acctgccaggcaggggtggg

SEQ ID NO: 1091131 - DNA, 19 bp, Homo sapiens
acctgcccagctccccaac

SEQ ID NO: 1091132 - DNA, 16 bp, Homo sapiens
acctgcccccaatcca

SEQ ID NO: 1091133 - DNA, 19 bp, Homo sapiens
acctgcccccttctcccac

SEQ ID NO: 1091134 - DNA, 22 bp, Homo sapiens
acctgcccccttctcccacact

SEQ ID NO: 1091135 - DNA, 16 bp, Homo sapiens
acctgccccgcccagc

SEQ ID NO: 1091136 - DNA, 23 bp, Homo sapiens
acctgccccggacctacctccct

SEQ ID NO: 1091137 - DNA, 17 bp, Homo sapiens
acctgccccgtagagaa

SEQ ID NO: 1091138 - DNA, 18 bp, Homo sapiens
acctgccccgtagagaat

SEQ ID NO: 1091139 - DNA, 19 bp, Homo sapiens
acctgccccgtagagaatg

SEQ ID NO: 1091140 - DNA, 16 bp, Homo sapiens
acctgcccctctgttc

SEQ ID NO: 1091141 - DNA, 22 bp, Homo sapiens
acctgcccctctgttctctccc

SEQ ID NO: 1091142 - DNA, 16 bp, Homo sapiens
acctgcccctgcctga

SEQ ID NO: 1091143 - DNA, 17 bp, Homo sapiens
acctgccctaaaccctg

SEQ ID NO: 1091144 - DNA, 15 bp, Homo sapiens
acctgccctcaaggg

SEQ ID NO: 1091145 - DNA, 17 bp, Homo sapiens
acctgccctcaagggtg

SEQ ID NO: 1091146 - DNA, 12 bp, Homo sapiens
acctgccctgcc

SEQ ID NO: 1091147 - DNA, 16 bp, Homo sapiens
acctgccctgcctgag

SEQ ID NO: 1091148 - DNA, 12 bp, Homo sapiens
acctgccgacct

SEQ ID NO: 1091149 - DNA, 17 bp, Homo sapiens
acctgccgacctcgtcc

SEQ ID NO: 1091150 - DNA, 19 bp, Homo sapiens
acctgccgcatgctccctc

SEQ ID NO: 1091151 - DNA, 18 bp, Homo sapiens
acctgcctcagctaccta

SEQ ID NO: 1091152 - DNA, 13 bp, Homo sapiens
acctgcctcctcg

SEQ ID NO: 1091153 - DNA, 20 bp, Homo sapiens
acctgcctcctcgttccttt

SEQ ID NO: 1091154 - DNA, 13 bp, Homo sapiens
acctgcctcctgc

SEQ ID NO: 1091155 - DNA, 18 bp, Homo sapiens
acctgcctcctgcctgcc

SEQ ID NO: 1091156 - DNA, 21 bp, Homo sapiens
acctgcctcggcctcccaaag

SEQ ID NO: 1091157 - DNA, 21 bp, Homo sapiens
acctgcctgacatttggagtg

SEQ ID NO: 1091158 - DNA, 13 bp, Homo sapiens
acctgcctgcgtc

SEQ ID NO: 1091159 - DNA, 17 bp, Homo sapiens
acctgcctgcgtcttcc

SEQ ID NO: 1091160 - DNA, 20 bp, Homo sapiens
acctgcctgcgtcttccgcc

SEQ ID NO: 1091161 - DNA, 22 bp, Homo sapiens
acctgcctgcgtcttccgcccc

SEQ ID NO: 1091162 - DNA, 13 bp, Homo sapiens
acctgcctgtacc

SEQ ID NO: 1091163 - DNA, 16 bp, Homo sapiens
acctgccttctaccct

SEQ ID NO: 1091164 - DNA, 22 bp, Homo sapiens
acctgccttggcctcccaaagt

SEQ ID NO: 1091165 - DNA, 13 bp, Homo sapiens
acctgcctttgta

SEQ ID NO: 1091166 - DNA, 14 bp, Homo sapiens
acctgcctttgtat

SEQ ID NO: 1091167 - DNA, 21 bp, Homo sapiens
acctgcgagggccgcccgctc

SEQ ID NO: 1091168 - DNA, 14 bp, Homo sapiens
acctgcgcttctgc

SEQ ID NO: 1091169 - DNA, 18 bp, Homo sapiens
acctgcgcttctgctgga

SEQ ID NO: 1091170 - DNA, 22 bp, Homo sapiens
acctgcgcttctgctggaggag

SEQ ID NO: 1091171 - DNA, 19 bp, Homo sapiens
acctgcgggtcctcagctg

SEQ ID NO: 1091172 - DNA, 20 bp, Homo sapiens
acctgcgggtcctcagctgc

SEQ ID NO: 1091173 - DNA, 21 bp, Homo sapiens
acctgctcacagggatgctgg

SEQ ID NO: 1091174 - DNA, 20 bp, Homo sapiens
acctgctcacgtcaaatgca

SEQ ID NO: 1091175 - DNA, 13 bp, Homo sapiens
acctgctccaatt

SEQ ID NO: 1091176 - DNA, 12 bp, Homo sapiens
acctgctccaga

SEQ ID NO: 1091177 - DNA, 17 bp, Homo sapiens
acctgctccagaagatg

SEQ ID NO: 1091178 - DNA, 16 bp, Homo sapiens
acctgctccgccagga

SEQ ID NO: 1091179 - DNA, 19 bp, Homo sapiens
acctgctccgccaggaaag

SEQ ID NO: 1091180 - DNA, 16 bp, Homo sapiens
acctgctccgctgctc

SEQ ID NO: 1091181 - DNA, 18 bp, Homo sapiens
acctgctctcctcttgcc

SEQ ID NO: 1091182 - DNA, 19 bp, Homo sapiens
acctgctctcctcttgcca

SEQ ID NO: 1091183 - DNA, 16 bp, Homo sapiens
acctgctctcttgtaa

SEQ ID NO: 1091184 - DNA, 13 bp, Homo sapiens
acctgctctgtcc

SEQ ID NO: 1091185 - DNA, 21 bp, Homo sapiens
acctgctgaattgtttataat

SEQ ID NO: 1091186 - DNA, 16 bp, Homo sapiens
acctgctgacctgtgc

SEQ ID NO: 1091187 - DNA, 17 bp, Homo sapiens
acctgctgccccagctg

SEQ ID NO: 1091188 - DNA, 17 bp, Homo sapiens
acctgctgcgtccccac

SEQ ID NO: 1091189 - DNA, 20 bp, Homo sapiens
acctgctgcgtccccactcc

SEQ ID NO: 1091190 - DNA, 21 bp, Homo sapiens
acctgctgcgtccccactccc

SEQ ID NO: 1091191 - DNA, 19 bp, Homo sapiens
acctgctggaaaccacact

SEQ ID NO: 1091192 - DNA, 13 bp, Homo sapiens
acctgctggcccc

SEQ ID NO: 1091193 - DNA, 19 bp, Homo sapiens
acctgctggcccctcacct

SEQ ID NO: 1091194 - DNA, 21 bp, Homo sapiens
acctgctggcccctcacctgg

SEQ ID NO: 1091195 - DNA, 13 bp, Homo sapiens
acctgcttcctgg

SEQ ID NO: 1091196 - DNA, 13 bp, Homo sapiens
acctgcttccttc

SEQ ID NO: 1091197 - DNA, 17 bp, Homo sapiens
acctggaaaaattccag

SEQ ID NO: 1091198 - DNA, 18 bp, Homo sapiens
acctggaaacagaccaat

SEQ ID NO: 1091199 - DNA, 19 bp, Homo sapiens
acctggaaccagagccaca

SEQ ID NO: 1091200 - DNA, 18 bp, Homo sapiens
acctggaagcatttgttt

SEQ ID NO: 1091201 - DNA, 23 bp, Homo sapiens
acctggaagcatttgtttctact

SEQ ID NO: 1091202 - DNA, 20 bp, Homo sapiens
acctggaatatataaccagt

SEQ ID NO: 1091203 - DNA, 17 bp, Homo sapiens
acctggaccccctgccc

SEQ ID NO: 1091204 - DNA, 18 bp, Homo sapiens
acctggaccccctgcccg

SEQ ID NO: 1091205 - DNA, 14 bp, Homo sapiens
acctggacctggaa

SEQ ID NO: 1091206 - DNA, 15 bp, Homo sapiens
acctggacctggaac

SEQ ID NO: 1091207 - DNA, 22 bp, Homo sapiens
acctggactgagccaaggaggc

SEQ ID NO: 1091208 - DNA, 15 bp, Homo sapiens
acctggagactgtcc

SEQ ID NO: 1091209 - DNA, 16 bp, Homo sapiens
acctggagatgcagct

SEQ ID NO: 1091210 - DNA, 14 bp, Homo sapiens
acctggagggaaga

SEQ ID NO: 1091211 - DNA, 19 bp, Homo sapiens
acctggatagttaagggct

SEQ ID NO: 1091212 - DNA, 17 bp, Homo sapiens
acctggatccagcactg

SEQ ID NO: 1091213 - DNA, 19 bp, Homo sapiens
acctggcactgggaggcag

SEQ ID NO: 1091214 - DNA, 14 bp, Homo sapiens
acctggcagacttg

SEQ ID NO: 1091215 - DNA, 21 bp, Homo sapiens
acctggcagggctcacactcc

SEQ ID NO: 1091216 - DNA, 23 bp, Homo sapiens
acctggcagggctcacactcctg

SEQ ID NO: 1091217 - DNA, 19 bp, Homo sapiens
acctggcagtggctctcag

SEQ ID NO: 1091218 - DNA, 21 bp, Homo sapiens
acctggcagtggctctcagag

SEQ ID NO: 1091219 - DNA, 21 bp, Homo sapiens
acctggcatcgcaccattctg

SEQ ID NO: 1091220 - DNA, 14 bp, Homo sapiens
acctggccactgtc

SEQ ID NO: 1091221 - DNA, 23 bp, Homo sapiens
acctggccactgtccctgtcctt

SEQ ID NO: 1091222 - DNA, 15 bp, Homo sapiens
acctggccctgcttc

SEQ ID NO: 1091223 - DNA, 17 bp, Homo sapiens
acctggccctgcttcct

SEQ ID NO: 1091224 - DNA, 19 bp, Homo sapiens
acctggccctgcttcctgc

SEQ ID NO: 1091225 - DNA, 14 bp, Homo sapiens
acctggcctgctgg

SEQ ID NO: 1091226 - DNA, 15 bp, Homo sapiens
acctggcctgctggg

SEQ ID NO: 1091227 - DNA, 17 bp, Homo sapiens
acctggcctgctgggaa

SEQ ID NO: 1091228 - DNA, 13 bp, Homo sapiens
acctggctgaggt

SEQ ID NO: 1091229 - DNA, 22 bp, Homo sapiens
acctggctgaggttcctctgcc

SEQ ID NO: 1091230 - DNA, 16 bp, Homo sapiens
acctggctgccatact

SEQ ID NO: 1091231 - DNA, 14 bp, Homo sapiens
acctggctgctagg

SEQ ID NO: 1091232 - DNA, 21 bp, Homo sapiens
acctggctgctaggccagagc

SEQ ID NO: 1091233 - DNA, 21 bp, Homo sapiens
acctggcttttactttattaa

SEQ ID NO: 1091234 - DNA, 15 bp, Homo sapiens
acctgggaaaggacc

SEQ ID NO: 1091235 - DNA, 22 bp, Homo sapiens
acctgggagaaggtctccaagg

SEQ ID NO: 1091236 - DNA, 14 bp, Homo sapiens
acctgggcacctgg

SEQ ID NO: 1091237 - DNA, 19 bp, Homo sapiens
acctgggcacctggggagt

SEQ ID NO: 1091238 - DNA, 23 bp, Homo sapiens
acctgggcactccgcgccgatgc

SEQ ID NO: 1091239 - DNA, 18 bp, Homo sapiens
acctgggcagctcctccc

SEQ ID NO: 1091240 - DNA, 15 bp, Homo sapiens
acctgggcatatcca

SEQ ID NO: 1091241 - DNA, 17 bp, Homo sapiens
acgccgccctccatccg

SEQ ID NO: 1091242 - DNA, 22 bp, Homo sapiens
acgccgccctccatccgtgctg

SEQ ID NO: 1091243 - DNA, 13 bp, Homo sapiens
acgccggcctctg

SEQ ID NO: 1091244 - DNA, 15 bp, Homo sapiens
acgccggcctctgct

SEQ ID NO: 1091245 - DNA, 19 bp, Homo sapiens
acgccgggagaagccacct

SEQ ID NO: 1091246 - DNA, 17 bp, Homo sapiens
acgcctatgatcccagc

SEQ ID NO: 1091247 - DNA, 22 bp, Homo sapiens
acgcctcactgaaacatggctg

SEQ ID NO: 1091248 - DNA, 15 bp, Homo sapiens
acgcctcctggccag

SEQ ID NO: 1091249 - DNA, 15 bp, Homo sapiens
acgcctcttgaccag

SEQ ID NO: 1091250 - DNA, 16 bp, Homo sapiens
acgcctgagacagcac

SEQ ID NO: 1091251 - DNA, 17 bp, Homo sapiens
acgcctgagacagcacc

SEQ ID NO: 1091252 - DNA, 20 bp, Homo sapiens
acgcctgagacagcaccact

SEQ ID NO: 1091253 - DNA, 21 bp, Homo sapiens
acgcctgagacagcaccactg

SEQ ID NO: 1091254 - DNA, 17 bp, Homo sapiens
acgcctgagagtggcac

SEQ ID NO: 1091255 - DNA, 13 bp, Homo sapiens
acgcctgaggaac

SEQ ID NO: 1091256 - DNA, 15 bp, Homo sapiens
acgcctgaggcaatt

SEQ ID NO: 1091257 - DNA, 19 bp, Homo sapiens
acgcctgaggcaattagac

SEQ ID NO: 1091258 - DNA, 21 bp, Homo sapiens
acgcctgatggtgctgctcag

SEQ ID NO: 1091259 - DNA, 14 bp, Homo sapiens
acgcctgcaggaga

SEQ ID NO: 1091260 - DNA, 23 bp, Homo sapiens
acgcctgccatcttctccccgag

SEQ ID NO: 1091261 - DNA, 18 bp, Homo sapiens
acgccttccaggtcagga

SEQ ID NO: 1091262 - DNA, 16 bp, Homo sapiens
acgcgacttccacaaa

SEQ ID NO: 1091263 - DNA, 23 bp, Homo sapiens
acgcgcctcgccggatctgaggg

SEQ ID NO: 1091264 - DNA, 19 bp, Homo sapiens
acgcgtatgttcgttgcag

SEQ ID NO: 1091265 - DNA, 21 bp, Homo sapiens
acgctaaagagcccttgcctc

SEQ ID NO: 1091266 - DNA, 18 bp, Homo sapiens
acgctaacaatttctcat

SEQ ID NO: 1091267 - DNA, 15 bp, Homo sapiens
acgctacctctctgt

SEQ ID NO: 1091268 - DNA, 18 bp, Homo sapiens
acgctactataaagagaa

SEQ ID NO: 1091269 - DNA, 16 bp, Homo sapiens
acgctcatctctggaa

SEQ ID NO: 1091270 - DNA, 11 bp, Homo sapiens
acgctccagct

SEQ ID NO: 1091271 - DNA, 16 bp, Homo sapiens
acgctccagctgcccc

SEQ ID NO: 1091272 - DNA, 11 bp, Homo sapiens
acgctcccctc

SEQ ID NO: 1091273 - DNA, 13 bp, Homo sapiens
acgctcccctcca

SEQ ID NO: 1091274 - DNA, 14 bp, Homo sapiens
acgctcccctccat

SEQ ID NO: 1091275 - DNA, 21 bp, Homo sapiens
acgctccctgacttctccccc

SEQ ID NO: 1091276 - DNA, 13 bp, Homo sapiens
acgctcctgccct

SEQ ID NO: 1091277 - DNA, 22 bp, Homo sapiens
acgctcctttgtgtgtgtgtca

SEQ ID NO: 1091278 - DNA, 23 bp, Homo sapiens
acgctcgctgccatcaccgctgg

SEQ ID NO: 1091279 - DNA, 16 bp, Homo sapiens
acgctctcctcgagcc

SEQ ID NO: 1091280 - DNA, 22 bp, Homo sapiens
acgctcttgaggaagcccaggc

SEQ ID NO: 1091281 - DNA, 23 bp, Homo sapiens
acgctgaactgacaatgaaggga

SEQ ID NO: 1091282 - DNA, 13 bp, Homo sapiens
acgctgcctggtc

SEQ ID NO: 1091283 - DNA, 12 bp, Homo sapiens
acgctgctgtca

SEQ ID NO: 1091284 - DNA, 20 bp, Homo sapiens
acgctggagatgcaaggtgc

SEQ ID NO: 1091285 - DNA, 22 bp, Homo sapiens
acgctggagatgcaaggtgctg

SEQ ID NO: 1091286 - DNA, 20 bp, Homo sapiens
acgctgtcctctcgagccca

SEQ ID NO: 1091287 - DNA, 21 bp, Homo sapiens
acgctgtcctctcgagcccag

SEQ ID NO: 1091288 - DNA, 21 bp, Homo sapiens
acgctgtctccagacccccac

SEQ ID NO: 1091289 - DNA, 17 bp, Homo sapiens
acgctgtgatgctgtgt

SEQ ID NO: 1091290 - DNA, 18 bp, Homo sapiens
acgctgtgatgctgtgtg

SEQ ID NO: 1091291 - DNA, 13 bp, Homo sapiens
acgcttctgaatg

SEQ ID NO: 1091292 - DNA, 22 bp, Homo sapiens
acgcttgcctggtcaccctggg

SEQ ID NO: 1091293 - DNA, 18 bp, Homo sapiens
acgcttgcgtatgtctgt

SEQ ID NO: 1091294 - DNA, 15 bp, Homo sapiens
acgcttgctcatttt

SEQ ID NO: 1091295 - DNA, 12 bp, Homo sapiens
acgctttcatga

SEQ ID NO: 1091296 - DNA, 22 bp, Homo sapiens
acgctttgctgctaccgccctg

SEQ ID NO: 1091297 - DNA, 17 bp, Homo sapiens
acgctttgggagaatgt

SEQ ID NO: 1091298 - DNA, 11 bp, Homo sapiens
acgctttgtca

SEQ ID NO: 1091299 - DNA, 14 bp, Homo sapiens
acgcttttctttgt

SEQ ID NO: 1091300 - DNA, 19 bp, Homo sapiens
acgcttttgagtgggccct

SEQ ID NO: 1091301 - DNA, 20 bp, Homo sapiens
acgcttttgagtgggccctg

SEQ ID NO: 1091302 - DNA, 23 bp, Homo sapiens
acgcttttgtgatggagtgctgt

SEQ ID NO: 1091303 - DNA, 12 bp, Homo sapiens
acggaaaacaat

SEQ ID NO: 1091304 - DNA, 18 bp, Homo sapiens
acggaagccccctcttcc

SEQ ID NO: 1091305 - DNA, 14 bp, Homo sapiens
acggaagttttcaa

SEQ ID NO: 1091306 - DNA, 19 bp, Homo sapiens
acggacactcaaaagctgg

SEQ ID NO: 1091307 - DNA, 17 bp, Homo sapiens
acggactgaggtgcctg

SEQ ID NO: 1091308 - DNA, 20 bp, Homo sapiens
acggactgaggtgcctgctc

SEQ ID NO: 1091309 - DNA, 12 bp, Homo sapiens
acggagagaaaa

SEQ ID NO: 1091310 - DNA, 13 bp, Homo sapiens
acggagagaaaaa

SEQ ID NO: 1091311 - DNA, 14 bp, Homo sapiens
acggagaggccact

SEQ ID NO: 1091312 - DNA, 13 bp, Homo sapiens
acggagggaggca

SEQ ID NO: 1091313 - DNA, 18 bp, Homo sapiens
acggaggggagtagagaa

SEQ ID NO: 1091314 - DNA, 23 bp, Homo sapiens
acggagtggggggacagagactc

SEQ ID NO: 1091315 - DNA, 14 bp, Homo sapiens
acggatctgctggg

SEQ ID NO: 1091316 - DNA, 16 bp, Homo sapiens
acggatgattggatta

SEQ ID NO: 1091317 - DNA, 19 bp, Homo sapiens
acggatgctccgaggactg

SEQ ID NO: 1091318 - DNA, 22 bp, Homo sapiens
acggatttattatataaatata

SEQ ID NO: 1091319 - DNA, 13 bp, Homo sapiens
acggcagcccccc

SEQ ID NO: 1091320 - DNA, 16 bp, Homo sapiens
acggcagcccccccct

SEQ ID NO: 1091321 - DNA, 18 bp, Homo sapiens
acggcagcccccccctca

SEQ ID NO: 1091322 - DNA, 15 bp, Homo sapiens
acggcagctgtagct

SEQ ID NO: 1091323 - DNA, 18 bp, Homo sapiens
acggcaggctcactgcca

SEQ ID NO: 1091324 - DNA, 20 bp, Homo sapiens
acggcatcgcatccgtcctg

SEQ ID NO: 1091325 - DNA, 13 bp, Homo sapiens
acggccaccactg

SEQ ID NO: 1091326 - DNA, 16 bp, Homo sapiens
acggccaccactgcag

SEQ ID NO: 1091327 - DNA, 10 bp, Homo sapiens
acggccaccc

SEQ ID NO: 1091328 - DNA, 11 bp, Homo sapiens
acggccaccct

SEQ ID NO: 1091329 - DNA, 15 bp, Homo sapiens
acggcccggcccctc

SEQ ID NO: 1091330 - DNA, 17 bp, Homo sapiens
acggcccggcccctcac

SEQ ID NO: 1091331 - DNA, 19 bp, Homo sapiens
acggcccggcccctcaccc

SEQ ID NO: 1091332 - DNA, 21 bp, Homo sapiens
acggcccggcccctcaccctc

SEQ ID NO: 1091333 - DNA, 22 bp, Homo sapiens
acggcccggcccctcaccctct

SEQ ID NO: 1091334 - DNA, 22 bp, Homo sapiens
acggccctcatctatgaggaaa

SEQ ID NO: 1091335 - DNA, 12 bp, Homo sapiens
acggccctgcct

SEQ ID NO: 1091336 - DNA, 15 bp, Homo sapiens
acggccctgcctgcc

SEQ ID NO: 1091337 - DNA, 20 bp, Homo sapiens
acggccggccggacctctga

SEQ ID NO: 1091338 - DNA, 10 bp, Homo sapiens
acggcctcca

SEQ ID NO: 1091339 - DNA, 18 bp, Homo sapiens
acggcctccaggaggggc

SEQ ID NO: 1091340 - DNA, 19 bp, Homo sapiens
acggcctccaggaggggcc

SEQ ID NO: 1091341 - DNA, 22 bp, Homo sapiens
acggcctgatgctccctcccct

SEQ ID NO: 1091342 - DNA, 14 bp, Homo sapiens
acggccttcttggt

SEQ ID NO: 1091343 - DNA, 16 bp, Homo sapiens
acggcgcccccagtgt

SEQ ID NO: 1091344 - DNA, 21 bp, Homo sapiens
acggctaacctggacctggaa

SEQ ID NO: 1091345 - DNA, 13 bp, Homo sapiens
acggctcctcaga

SEQ ID NO: 1091346 - DNA, 19 bp, Homo sapiens
acggctcgatttctccagg

SEQ ID NO: 1091347 - DNA, 11 bp, Homo sapiens
acggctgggca

SEQ ID NO: 1091348 - DNA, 22 bp, Homo sapiens
acggctgggcacacgcctccca

SEQ ID NO: 1091349 - DNA, 22 bp, Homo sapiens
acggctgggtgtttcagtttga

SEQ ID NO: 1091350 - DNA, 17 bp, Homo sapiens
acggctggtcactctgc

SEQ ID NO: 1091351 - DNA, 21 bp, Homo sapiens
acggctggtcactctgccctc

SEQ ID NO: 1091352 - DNA, 12 bp, Homo sapiens
acggctgtgacg

SEQ ID NO: 1091353 - DNA, 21 bp, Homo sapiens
acggctgttcccctcacccaa

SEQ ID NO: 1091354 - DNA, 22 bp, Homo sapiens
acggctgttcccctcacccaaa

SEQ ID NO: 1091355 - DNA, 16 bp, Homo sapiens
acggcttgctttcctg

SEQ ID NO: 1091356 - DNA, 18 bp, Homo sapiens
acggcttttacttaaacc

SEQ ID NO: 1091357 - DNA, 16 bp, Homo sapiens
acgggaatgcctaggt

SEQ ID NO: 1091358 - DNA, 21 bp, Homo sapiens
acgggacccacatgctccaga

SEQ ID NO: 1091359 - DNA, 18 bp, Homo sapiens
acgggagcattggcccct

SEQ ID NO: 1091360 - DNA, 22 bp, Homo sapiens
acgggatggttctggctgtttg

SEQ ID NO: 1091361 - DNA, 10 bp, Homo sapiens
acgggcagcc

SEQ ID NO: 1091362 - DNA, 13 bp, Homo sapiens
acgggcagccaca

SEQ ID NO: 1091363 - DNA, 13 bp, Homo sapiens
actaatgatgttt

SEQ ID NO: 1091364 - DNA, 21 bp, Homo sapiens
actaatgctttttagaaagca

SEQ ID NO: 1091365 - DNA, 14 bp, Homo sapiens
actaatgtactgta

SEQ ID NO: 1091366 - DNA, 16 bp, Homo sapiens
actaattaaaatctgg

SEQ ID NO: 1091367 - DNA, 19 bp, Homo sapiens
actaattaaaatctggaaa

SEQ ID NO: 1091368 - DNA, 20 bp, Homo sapiens
actaattaaaatctggaaat

SEQ ID NO: 1091369 - DNA, 13 bp, Homo sapiens
actaattccacac

SEQ ID NO: 1091370 - DNA, 23 bp, Homo sapiens
actaattccacaccttttattga

SEQ ID NO: 1091371 - DNA, 19 bp, Homo sapiens
actaattctatttctctat

SEQ ID NO: 1091372 - DNA, 20 bp, Homo sapiens
actaatttcaaaatgctttt

SEQ ID NO: 1091373 - DNA, 13 bp, Homo sapiens
actaatttcttct

SEQ ID NO: 1091374 - DNA, 14 bp, Homo sapiens
actaatttcttctt

SEQ ID NO: 1091375 - DNA, 16 bp, Homo sapiens
actaattttatttcta

SEQ ID NO: 1091376 - DNA, 20 bp, Homo sapiens
actaatttttgcttaacatt

SEQ ID NO: 1091377 - DNA, 13 bp, Homo sapiens
actaatttttgta

SEQ ID NO: 1091378 - DNA, 14 bp, Homo sapiens
actacaaaatttga

SEQ ID NO: 1091379 - DNA, 23 bp, Homo sapiens
actacaatgatggtaaagccatg

SEQ ID NO: 1091380 - DNA, 13 bp, Homo sapiens
actacacacagta

SEQ ID NO: 1091381 - DNA, 20 bp, Homo sapiens
actacacatccctaatgtgt

SEQ ID NO: 1091382 - DNA, 14 bp, Homo sapiens
actacacccagcaa

SEQ ID NO: 1091383 - DNA, 16 bp, Homo sapiens
actacacccagcaata

SEQ ID NO: 1091384 - DNA, 18 bp, Homo sapiens
actacactccagcctgag

SEQ ID NO: 1091385 - DNA, 19 bp, Homo sapiens
actacactccagcctgagc

SEQ ID NO: 1091386 - DNA, 17 bp, Homo sapiens
actacagcttcagtgat

SEQ ID NO: 1091387 - DNA, 20 bp, Homo sapiens
actacagtcaagatagaaag

SEQ ID NO: 1091388 - DNA, 15 bp, Homo sapiens
actacagtcaggaaa

SEQ ID NO: 1091389 - DNA, 16 bp, Homo sapiens
actacataaactgact

SEQ ID NO: 1091390 - DNA, 15 bp, Homo sapiens
actacatattgtctg

SEQ ID NO: 1091391 - DNA, 11 bp, Homo sapiens
actacattctg

SEQ ID NO: 1091392 - DNA, 13 bp, Homo sapiens
actaccagccagc

SEQ ID NO: 1091393 - DNA, 21 bp, Homo sapiens
actaccaggtgtgcctggaag

SEQ ID NO: 1091394 - DNA, 23 bp, Homo sapiens
actaccatctgatgtttcatatt

SEQ ID NO: 1091395 - DNA, 23 bp, Homo sapiens
actacccacgttctcacacccac

SEQ ID NO: 1091396 - DNA, 20 bp, Homo sapiens
actacccgagcccagctaca

SEQ ID NO: 1091397 - DNA, 13 bp, Homo sapiens
actaccctcaccc

SEQ ID NO: 1091398 - DNA, 22 bp, Homo sapiens
actaccctctcactagtgccaa

SEQ ID NO: 1091399 - DNA, 19 bp, Homo sapiens
actaccgaatgtgtcttta

SEQ ID NO: 1091400 - DNA, 23 bp, Homo sapiens
actaccgaatgtgtctttagata

SEQ ID NO: 1091401 - DNA, 13 bp, Homo sapiens
actaccgcaggcc

SEQ ID NO: 1091402 - DNA, 14 bp, Homo sapiens
actaccgtggacca

SEQ ID NO: 1091403 - DNA, 12 bp, Homo sapiens
actacctctgga

SEQ ID NO: 1091404 - DNA, 21 bp, Homo sapiens
actacgaaaaataaaaaggaa

SEQ ID NO: 1091405 - DNA, 23 bp, Homo sapiens
actacgcatgactaattttttaa

SEQ ID NO: 1091406 - DNA, 20 bp, Homo sapiens
actacgggggggagaaggaa

SEQ ID NO: 1091407 - DNA, 15 bp, Homo sapiens
actacgttaagggaa

SEQ ID NO: 1091408 - DNA, 13 bp, Homo sapiens
actactaaagtgc

SEQ ID NO: 1091409 - DNA, 18 bp, Homo sapiens
actactacagaaattctg

SEQ ID NO: 1091410 - DNA, 20 bp, Homo sapiens
actactccggagacagggtt

SEQ ID NO: 1091411 - DNA, 12 bp, Homo sapiens
actactctgcca

SEQ ID NO: 1091412 - DNA, 17 bp, Homo sapiens
actactgaaacagattt

SEQ ID NO: 1091413 - DNA, 19 bp, Homo sapiens
actactgaacacatgtgta

SEQ ID NO: 1091414 - DNA, 16 bp, Homo sapiens
actactgaataatgct

SEQ ID NO: 1091415 - DNA, 20 bp, Homo sapiens
actactgacagggagcagcc

SEQ ID NO: 1091416 - DNA, 19 bp, Homo sapiens
actactgagggaaatagcc

SEQ ID NO: 1091417 - DNA, 20 bp, Homo sapiens
actactgattttaaaatgaa

SEQ ID NO: 1091418 - DNA, 21 bp, Homo sapiens
actactgattttaaaatgaat

SEQ ID NO: 1091419 - DNA, 19 bp, Homo sapiens
actactgctcctgtggcag

SEQ ID NO: 1091420 - DNA, 12 bp, Homo sapiens
actactgggtgt

SEQ ID NO: 1091421 - DNA, 21 bp, Homo sapiens
actactgggtgtcatttcatt

SEQ ID NO: 1091422 - DNA, 12 bp, Homo sapiens
actactgtacat

SEQ ID NO: 1091423 - DNA, 15 bp, Homo sapiens
actactgtacatttt

SEQ ID NO: 1091424 - DNA, 16 bp, Homo sapiens
actactgtgttcctgg

SEQ ID NO: 1091425 - DNA, 12 bp, Homo sapiens
actactttataa

SEQ ID NO: 1091426 - DNA, 22 bp, Homo sapiens
actactttcatgaattttttaa

SEQ ID NO: 1091427 - DNA, 23 bp, Homo sapiens
actactttcatgaattttttaat

SEQ ID NO: 1091428 - DNA, 13 bp, Homo sapiens
actactttgcctt

SEQ ID NO: 1091429 - DNA, 19 bp, Homo sapiens
actactttgttaggatttt

SEQ ID NO: 1091430 - DNA, 22 bp, Homo sapiens
actactttgttaggattttcac

SEQ ID NO: 1091431 - DNA, 14 bp, Homo sapiens
actactttttatac

SEQ ID NO: 1091432 - DNA, 15 bp, Homo sapiens
actactttttatact

SEQ ID NO: 1091433 - DNA, 23 bp, Homo sapiens
actactttttatactccatacat

SEQ ID NO: 1091434 - DNA, 18 bp, Homo sapiens
actagaaggcttctctcc

SEQ ID NO: 1091435 - DNA, 18 bp, Homo sapiens
actagaattagtatgtct

SEQ ID NO: 1091436 - DNA, 18 bp, Homo sapiens
actagaattctagtgctg

SEQ ID NO: 1091437 - DNA, 15 bp, Homo sapiens
actagacatctgctg

SEQ ID NO: 1091438 - DNA, 17 bp, Homo sapiens
actagactactcaatat

SEQ ID NO: 1091439 - DNA, 13 bp, Homo sapiens
actagagacaaat

SEQ ID NO: 1091440 - DNA, 21 bp, Homo sapiens
actagagacaaatctttaaga

SEQ ID NO: 1091441 - DNA, 16 bp, Homo sapiens
actagagatattttgt

SEQ ID NO: 1091442 - DNA, 18 bp, Homo sapiens
actagagatattttgtaa

SEQ ID NO: 1091443 - DNA, 21 bp, Homo sapiens
actagagatattttgtaaaat

SEQ ID NO: 1091444 - DNA, 15 bp, Homo sapiens
actagaggcagggag

SEQ ID NO: 1091445 - DNA, 16 bp, Homo sapiens
actagaggccagggca

SEQ ID NO: 1091446 - DNA, 18 bp, Homo sapiens
actagagggacctctccc

SEQ ID NO: 1091447 - DNA, 14 bp, Homo sapiens
actagagggcccat

SEQ ID NO: 1091448 - DNA, 18 bp, Homo sapiens
actagaggtgagaaattt

SEQ ID NO: 1091449 - DNA, 14 bp, Homo sapiens
actagagtgctctg

SEQ ID NO: 1091450 - DNA, 14 bp, Homo sapiens
actagatgactgta

SEQ ID NO: 1091451 - DNA, 13 bp, Homo sapiens
actagatgatgga

SEQ ID NO: 1091452 - DNA, 18 bp, Homo sapiens
actagatggacctgcctg

SEQ ID NO: 1091453 - DNA, 20 bp, Homo sapiens
actagatggacctgcctgca

SEQ ID NO: 1091454 - DNA, 13 bp, Homo sapiens
actagatttgtcc

SEQ ID NO: 1091455 - DNA, 14 bp, Homo sapiens
actagatttgtcct

SEQ ID NO: 1091456 - DNA, 16 bp, Homo sapiens
actagatttgtccttt

SEQ ID NO: 1091457 - DNA, 17 bp, Homo sapiens
actagcatacttaaaat

SEQ ID NO: 1091458 - DNA, 16 bp, Homo sapiens
actagcattacattat

SEQ ID NO: 1091459 - DNA, 14 bp, Homo sapiens
actagcgcctggcc

SEQ ID NO: 1091460 - DNA, 16 bp, Homo sapiens
actagcgcctggcctt

SEQ ID NO: 1091461 - DNA, 12 bp, Homo sapiens
actagctgcctt

SEQ ID NO: 1091462 - DNA, 10 bp, Homo sapiens
actaggaatt

SEQ ID NO: 1091463 - DNA, 12 bp, Homo sapiens
actaggaattct

SEQ ID NO: 1091464 - DNA, 17 bp, Homo sapiens
actaggactctgaggct

SEQ ID NO: 1091465 - DNA, 12 bp, Homo sapiens
actaggacttgg

SEQ ID NO: 1091466 - DNA, 19 bp, Homo sapiens
actaggatatgtatatttt

SEQ ID NO: 1091467 - DNA, 22 bp, Homo sapiens
actaggcatgtcagaggacccc

SEQ ID NO: 1091468 - DNA, 23 bp, Homo sapiens
actaggcccccacttgcctcttc

SEQ ID NO: 1091469 - DNA, 15 bp, Homo sapiens
actaggcttctgtaa

SEQ ID NO: 1091470 - DNA, 20 bp, Homo sapiens
actaggcttctgtaatcaat

SEQ ID NO: 1091471 - DNA, 18 bp, Homo sapiens
actagggatccctcatct

SEQ ID NO: 1091472 - DNA, 21 bp, Homo sapiens
actagggattcaggctgcttg

SEQ ID NO: 1091473 - DNA, 16 bp, Homo sapiens
actagggccaagccca

SEQ ID NO: 1091474 - DNA, 21 bp, Homo sapiens
actaggtaacttattagaaac

SEQ ID NO: 1091475 - DNA, 16 bp, Homo sapiens
actaggtgtccccaac

SEQ ID NO: 1091476 - DNA, 19 bp, Homo sapiens
actaggtgtccccaacgtc

SEQ ID NO: 1091477 - DNA, 20 bp, Homo sapiens
actaggttggacagccccct

SEQ ID NO: 1091478 - DNA, 16 bp, Homo sapiens
actaggtttttgcttc

SEQ ID NO: 1091479 - DNA, 14 bp, Homo sapiens
actagtagatttct

SEQ ID NO: 1091480 - DNA, 18 bp, Homo sapiens
actagtctacttcttaaa

SEQ ID NO: 1091481 - DNA, 18 bp, Homo sapiens
actagtctgtgtaacttt

SEQ ID NO: 1091482 - DNA, 16 bp, Homo sapiens
actagtgaacaattcg

SEQ ID NO: 1091483 - DNA, 23 bp, Homo sapiens
actagtgacaagctcctggtctt

SEQ ID NO: 1091484 - DNA, 16 bp, Homo sapiens
actagtgacagcttgt

SEQ ID NO: 1091485 - DNA, 17 bp, Homo sapiens
actcacctgctggcccc

SEQ ID NO: 1091486 - DNA, 13 bp, Homo sapiens
actcactcactcc

SEQ ID NO: 1091487 - DNA, 13 bp, Homo sapiens
actcactccaaga

SEQ ID NO: 1091488 - DNA, 15 bp, Homo sapiens
actcactccccactc

SEQ ID NO: 1091489 - DNA, 19 bp, Homo sapiens
actcactccttttaaagaa

SEQ ID NO: 1091490 - DNA, 13 bp, Homo sapiens
actcactctaaag

SEQ ID NO: 1091491 - DNA, 15 bp, Homo sapiens
actcactgaagcctg

SEQ ID NO: 1091492 - DNA, 16 bp, Homo sapiens
actcactgaagcctgc

SEQ ID NO: 1091493 - DNA, 12 bp, Homo sapiens
actcactgaggc

SEQ ID NO: 1091494 - DNA, 22 bp, Homo sapiens
actcactgaggccatcagggcc

SEQ ID NO: 1091495 - DNA, 12 bp, Homo sapiens
actcactgccta

SEQ ID NO: 1091496 - DNA, 21 bp, Homo sapiens
actcactgcctaggaggctgg

SEQ ID NO: 1091497 - DNA, 21 bp, Homo sapiens
actcactgggaagctcccacc

SEQ ID NO: 1091498 - DNA, 23 bp, Homo sapiens
actcacttgccattgccaggaga

SEQ ID NO: 1091499 - DNA, 19 bp, Homo sapiens
actcacttttcacttgtct

SEQ ID NO: 1091500 - DNA, 15 bp, Homo sapiens
actcagaaagccaac

SEQ ID NO: 1091501 - DNA, 13 bp, Homo sapiens
actcagaaattca

SEQ ID NO: 1091502 - DNA, 16 bp, Homo sapiens
actcagaactgtccca

SEQ ID NO: 1091503 - DNA, 15 bp, Homo sapiens
actcagaagcctgag

SEQ ID NO: 1091504 - DNA, 17 bp, Homo sapiens
actcagaatagctgttt

SEQ ID NO: 1091505 - DNA, 20 bp, Homo sapiens
actcagaatataacatgtaa

SEQ ID NO: 1091506 - DNA, 15 bp, Homo sapiens
actcagacattccaa

SEQ ID NO: 1091507 - DNA, 14 bp, Homo sapiens
actcagagggagga

SEQ ID NO: 1091508 - DNA, 19 bp, Homo sapiens
actcagatctgatcaagag

SEQ ID NO: 1091509 - DNA, 23 bp, Homo sapiens
actcagatctgatcaagagtccg

SEQ ID NO: 1091510 - DNA, 17 bp, Homo sapiens
actcagatgaggacaga

SEQ ID NO: 1091511 - DNA, 22 bp, Homo sapiens
actcagcaccacattgcctcat

SEQ ID NO: 1091512 - DNA, 18 bp, Homo sapiens
actcagcagaggcagtgg

SEQ ID NO: 1091513 - DNA, 17 bp, Homo sapiens
actcagcagcagagagc

SEQ ID NO: 1091514 - DNA, 19 bp, Homo sapiens
actcagcagcagagagccc

SEQ ID NO: 1091515 - DNA, 18 bp, Homo sapiens
actcagcagccctcctca

SEQ ID NO: 1091516 - DNA, 19 bp, Homo sapiens
actcagcagccctcctcac

SEQ ID NO: 1091517 - DNA, 12 bp, Homo sapiens
actcagcagtga

SEQ ID NO: 1091518 - DNA, 16 bp, Homo sapiens
actcagcagttgacat

SEQ ID NO: 1091519 - DNA, 14 bp, Homo sapiens
actcagccaagaca

SEQ ID NO: 1091520 - DNA, 18 bp, Homo sapiens
actcagccatttccccct

SEQ ID NO: 1091521 - DNA, 12 bp, Homo sapiens
actcagccccta

SEQ ID NO: 1091522 - DNA, 19 bp, Homo sapiens
actcagcccctacccctgc

SEQ ID NO: 1091523 - DNA, 21 bp, Homo sapiens
actcagcccctacccctgccc

SEQ ID NO: 1091524 - DNA, 22 bp, Homo sapiens
actcagcccctacccctgccct

SEQ ID NO: 1091525 - DNA, 14 bp, Homo sapiens
actcagcccctagg

SEQ ID NO: 1091526 - DNA, 14 bp, Homo sapiens
actcagccctgagg

SEQ ID NO: 1091527 - DNA, 15 bp, Homo sapiens
actcagccctgaggt

SEQ ID NO: 1091528 - DNA, 14 bp, Homo sapiens
actcagccctgggc

SEQ ID NO: 1091529 - DNA, 16 bp, Homo sapiens
actcagccctgggccc

SEQ ID NO: 1091530 - DNA, 22 bp, Homo sapiens
actcagccctgggccccaccac

SEQ ID NO: 1091531 - DNA, 22 bp, Homo sapiens
actcagcctgctgcccaggctg

SEQ ID NO: 1091532 - DNA, 20 bp, Homo sapiens
actcagctattaagaaaatc

SEQ ID NO: 1091533 - DNA, 22 bp, Homo sapiens
actcagctccagaataccttct

SEQ ID NO: 1091534 - DNA, 19 bp, Homo sapiens
actcagctctgacattctg

SEQ ID NO: 1091535 - DNA, 17 bp, Homo sapiens
actcagctgtcctgcag

SEQ ID NO: 1091536 - DNA, 18 bp, Homo sapiens
actcagctgtcctgcagc

SEQ ID NO: 1091537 - DNA, 19 bp, Homo sapiens
actcagctgtcctgcagca

SEQ ID NO: 1091538 - DNA, 19 bp, Homo sapiens
actcagcttaattctcctt

SEQ ID NO: 1091539 - DNA, 20 bp, Homo sapiens
actcagcttcggggccggtg

SEQ ID NO: 1091540 - DNA, 21 bp, Homo sapiens
actcagcttcggggccggtga

SEQ ID NO: 1091541 - DNA, 13 bp, Homo sapiens
actcaggaacttt

SEQ ID NO: 1091542 - DNA, 18 bp, Homo sapiens
actcaggaacttttgtta

SEQ ID NO: 1091543 - DNA, 11 bp, Homo sapiens
actcaggaggc

SEQ ID NO: 1091544 - DNA, 18 bp, Homo sapiens
actcaggatccagtccct

SEQ ID NO: 1091545 - DNA, 13 bp, Homo sapiens
actcaggattctc

SEQ ID NO: 1091546 - DNA, 12 bp, Homo sapiens
actcaggccaca

SEQ ID NO: 1091547 - DNA, 24 bp, Homo sapiens
actcaggccacagtggggctgcag

SEQ ID NO: 1091548 - DNA, 15 bp, Homo sapiens
actcagggacagagc

SEQ ID NO: 1091549 - DNA, 18 bp, Homo sapiens
actcagggacagagccat

SEQ ID NO: 1091550 - DNA, 20 bp, Homo sapiens
actcagggacagagccatgc

SEQ ID NO: 1091551 - DNA, 22 bp, Homo sapiens
actcagggaccggtgctgcagg

SEQ ID NO: 1091552 - DNA, 21 bp, Homo sapiens
actcagggcagcgccaggctg

SEQ ID NO: 1091553 - DNA, 14 bp, Homo sapiens
actcagggcagctg

SEQ ID NO: 1091554 - DNA, 18 bp, Homo sapiens
actcagggccccagcact

SEQ ID NO: 1091555 - DNA, 22 bp, Homo sapiens
actcagggctcctcccagcttg

SEQ ID NO: 1091556 - DNA, 14 bp, Homo sapiens
actcaggtctgtaa

SEQ ID NO: 1091557 - DNA, 15 bp, Homo sapiens
actcaggtctgtaac

SEQ ID NO: 1091558 - DNA, 22 bp, Homo sapiens
actcaggtctgtaactgcccag

SEQ ID NO: 1091559 - DNA, 15 bp, Homo sapiens
actcaggtgggccct

SEQ ID NO: 1091560 - DNA, 19 bp, Homo sapiens
actcaggtgggccctctga

SEQ ID NO: 1091561 - DNA, 14 bp, Homo sapiens
actcaggttccaga

SEQ ID NO: 1091562 - DNA, 15 bp, Homo sapiens
actcaggttccagaa

SEQ ID NO: 1091563 - DNA, 18 bp, Homo sapiens
actcagtcccccaccaca

SEQ ID NO: 1091564 - DNA, 20 bp, Homo sapiens
actcagtgtctgcctttaaa

SEQ ID NO: 1091565 - DNA, 22 bp, Homo sapiens
actcagtgtgtgatccggtttc

SEQ ID NO: 1091566 - DNA, 17 bp, Homo sapiens
actcagtgttagagaaa

SEQ ID NO: 1091567 - DNA, 17 bp, Homo sapiens
actcagttccaggcctg

SEQ ID NO: 1091568 - DNA, 14 bp, Homo sapiens
actcagtttgtcag

SEQ ID NO: 1091569 - DNA, 15 bp, Homo sapiens
actcagtttgtcaga

SEQ ID NO: 1091570 - DNA, 23 bp, Homo sapiens
actcataatctataaacaatgaa

SEQ ID NO: 1091571 - DNA, 18 bp, Homo sapiens
actcatagacactgatct

SEQ ID NO: 1091572 - DNA, 16 bp, Homo sapiens
actcatagggtgctct

SEQ ID NO: 1091573 - DNA, 20 bp, Homo sapiens
actcatagggtgctctgagg

SEQ ID NO: 1091574 - DNA, 14 bp, Homo sapiens
actcataggtccct

SEQ ID NO: 1091575 - DNA, 19 bp, Homo sapiens
actcatattacaaaaacaa

SEQ ID NO: 1091576 - DNA, 20 bp, Homo sapiens
actcatattctgggctcctg

SEQ ID NO: 1091577 - DNA, 17 bp, Homo sapiens
actcatcagagcagcta

SEQ ID NO: 1091578 - DNA, 9 bp, Homo sapiens
actcatcat

SEQ ID NO: 1091579 - DNA, 13 bp, Homo sapiens
actcatcataaaa

SEQ ID NO: 1091580 - DNA, 17 bp, Homo sapiens
actcatcataaaataaa

SEQ ID NO: 1091581 - DNA, 16 bp, Homo sapiens
actcatcattttctac

SEQ ID NO: 1091582 - DNA, 22 bp, Homo sapiens
actcatccccacagctggctct

SEQ ID NO: 1091583 - DNA, 23 bp, Homo sapiens
actcatcctcttttaatggcatt

SEQ ID NO: 1091584 - DNA, 13 bp, Homo sapiens
actcatctgttat

SEQ ID NO: 1091585 - DNA, 14 bp, Homo sapiens
actcatctgttatc

SEQ ID NO: 1091586 - DNA, 23 bp, Homo sapiens
actcatctgttatcctgctagct

SEQ ID NO: 1091587 - DNA, 19 bp, Homo sapiens
actcatcttactgtacctg

SEQ ID NO: 1091588 - DNA, 18 bp, Homo sapiens
actcatcttagtgcctga

SEQ ID NO: 1091589 - DNA, 15 bp, Homo sapiens
actcatgaatgaaaa

SEQ ID NO: 1091590 - DNA, 16 bp, Homo sapiens
actcatgaatgaaaat

SEQ ID NO: 1091591 - DNA, 18 bp, Homo sapiens
actcatgatcaagatata

SEQ ID NO: 1091592 - DNA, 20 bp, Homo sapiens
actcatgcaaactgctttat

SEQ ID NO: 1091593 - DNA, 12 bp, Homo sapiens
actcattaatta

SEQ ID NO: 1091594 - DNA, 13 bp, Homo sapiens
actcattagactg

SEQ ID NO: 1091595 - DNA, 21 bp, Homo sapiens
actcattcaaaagttgaaatt

SEQ ID NO: 1091596 - DNA, 16 bp, Homo sapiens
actcattcattagtca

SEQ ID NO: 1091597 - DNA, 13 bp, Homo sapiens
actcattccttca

SEQ ID NO: 1091598 - DNA, 15 bp, Homo sapiens
actcattctgaagga

SEQ ID NO: 1091599 - DNA, 19 bp, Homo sapiens
actcattctgaaggagccc

SEQ ID NO: 1091600 - DNA, 21 bp, Homo sapiens
actcattctgatcctcagccc

SEQ ID NO: 1091601 - DNA, 20 bp, Homo sapiens
actcattgctgagcctctgc

SEQ ID NO: 1091602 - DNA, 21 bp, Homo sapiens
actcattgctgagcctctgct

SEQ ID NO: 1091603 - DNA, 22 bp, Homo sapiens
actcattgctgagcctctgctc

SEQ ID NO: 1091604 - DNA, 18 bp, Homo sapiens
actcatttatctcctctt

SEQ ID NO: 1091605 - DNA, 13 bp, Homo sapiens
actcatttcatct

SEQ ID NO: 1091606 - DNA, 17 bp, Homo sapiens
actcatttcatctcatt

SEQ ID NO: 1091607 - DNA, 15 bp, Homo sapiens
actcgggggcgcctg

SEQ ID NO: 1091608 - DNA, 18 bp, Homo sapiens
actcgggggcgcctggag

SEQ ID NO: 1091609 - DNA, 14 bp, Homo sapiens
actcgggggctggt

SEQ ID NO: 1091610 - DNA, 17 bp, Homo sapiens
actcgggtctgcagacc

SEQ ID NO: 1091611 - DNA, 12 bp, Homo sapiens
actcggtttctc

SEQ ID NO: 1091612 - DNA, 14 bp, Homo sapiens
actcggtttctcca

SEQ ID NO: 1091613 - DNA, 16 bp, Homo sapiens
actcggtttctccaaa

SEQ ID NO: 1091614 - DNA, 12 bp, Homo sapiens
actctaaaagat

SEQ ID NO: 1091615 - DNA, 23 bp, Homo sapiens
actctaaaatggacattttcttt

SEQ ID NO: 1091616 - DNA, 21 bp, Homo sapiens
actctaaaattataaatgaca

SEQ ID NO: 1091617 - DNA, 15 bp, Homo sapiens
actctaaactgcaaa

SEQ ID NO: 1091618 - DNA, 21 bp, Homo sapiens
actctaaactgcaaacagaaa

SEQ ID NO: 1091619 - DNA, 15 bp, Homo sapiens
actctaaagaaaaat

SEQ ID NO: 1091620 - DNA, 20 bp, Homo sapiens
actctaaagcttctataaaa

SEQ ID NO: 1091621 - DNA, 12 bp, Homo sapiens
actctaaataga

SEQ ID NO: 1091622 - DNA, 21 bp, Homo sapiens
actctaactgtatatttgtat

SEQ ID NO: 1091623 - DNA, 16 bp, Homo sapiens
actctaagctggagct

SEQ ID NO: 1091624 - DNA, 19 bp, Homo sapiens
actctaagctggagctctt

SEQ ID NO: 1091625 - DNA, 19 bp, Homo sapiens
actctaagtcatgtatgtt

SEQ ID NO: 1091626 - DNA, 22 bp, Homo sapiens
actctaagtcatgtatgtttct

SEQ ID NO: 1091627 - DNA, 21 bp, Homo sapiens
actctaatagtgcttaaaaat

SEQ ID NO: 1091628 - DNA, 18 bp, Homo sapiens
actctaccaaataatttc

SEQ ID NO: 1091629 - DNA, 14 bp, Homo sapiens
actctacccctgct

SEQ ID NO: 1091630 - DNA, 16 bp, Homo sapiens
actctacctaatgtct

SEQ ID NO: 1091631 - DNA, 13 bp, Homo sapiens
actctacctcata

SEQ ID NO: 1091632 - DNA, 19 bp, Homo sapiens
actctagacaagatattgt

SEQ ID NO: 1091633 - DNA, 21 bp, Homo sapiens
actctagacaagatattgtac

SEQ ID NO: 1091634 - DNA, 13 bp, Homo sapiens
actctagcctggg

SEQ ID NO: 1091635 - DNA, 18 bp, Homo sapiens
actctaggatgtatattt

SEQ ID NO: 1091636 - DNA, 20 bp, Homo sapiens
actctaggatgtatatttta

SEQ ID NO: 1091637 - DNA, 21 bp, Homo sapiens
actctaggatgtatattttat

SEQ ID NO: 1091638 - DNA, 22 bp, Homo sapiens
actctaggatgtatattttata

SEQ ID NO: 1091639 - DNA, 17 bp, Homo sapiens
actctagggaaaaacca

SEQ ID NO: 1091640 - DNA, 18 bp, Homo sapiens
actctagggatataaaaa

SEQ ID NO: 1091641 - DNA, 20 bp, Homo sapiens
actctagggatataaaaaca

SEQ ID NO: 1091642 - DNA, 21 bp, Homo sapiens
actctaggggtcaggctccat

SEQ ID NO: 1091643 - DNA, 20 bp, Homo sapiens
actctagtgacttcctggtg

SEQ ID NO: 1091644 - DNA, 23 bp, Homo sapiens
actctagtgacttcctggtgagg

SEQ ID NO: 1091645 - DNA, 15 bp, Homo sapiens
actctagttctagat

SEQ ID NO: 1091646 - DNA, 17 bp, Homo sapiens
actctagttctagatga

SEQ ID NO: 1091647 - DNA, 15 bp, Homo sapiens
actctatagactcta

SEQ ID NO: 1091648 - DNA, 15 bp, Homo sapiens
actctatatgtagtg

SEQ ID NO: 1091649 - DNA, 16 bp, Homo sapiens
actctatcaagtatta

SEQ ID NO: 1091650 - DNA, 23 bp, Homo sapiens
actctatcaagtattataccttt

SEQ ID NO: 1091651 - DNA, 13 bp, Homo sapiens
actctatcagcat

SEQ ID NO: 1091652 - DNA, 20 bp, Homo sapiens
actctatcagcattgtttca

SEQ ID NO: 1091653 - DNA, 12 bp, Homo sapiens
actctattcttt

SEQ ID NO: 1091654 - DNA, 13 bp, Homo sapiens
actctattttaat

SEQ ID NO: 1091655 - DNA, 18 bp, Homo sapiens
actctcaaaatctttgta

SEQ ID NO: 1091656 - DNA, 14 bp, Homo sapiens
actctcacatgtgg

SEQ ID NO: 1091657 - DNA, 12 bp, Homo sapiens
actctcaccatg

SEQ ID NO: 1091658 - DNA, 22 bp, Homo sapiens
actctcaggatcaagaaagtgt

SEQ ID NO: 1091659 - DNA, 13 bp, Homo sapiens
actctcagtctct

SEQ ID NO: 1091660 - DNA, 18 bp, Homo sapiens
actctcagtctctgagca

SEQ ID NO: 1091661 - DNA, 22 bp, Homo sapiens
actctcatcaccccagaggcct

SEQ ID NO: 1091662 - DNA, 18 bp, Homo sapiens
actctcatgtccccttcc

SEQ ID NO: 1091663 - DNA, 19 bp, Homo sapiens
actctcatgtccccttcct

SEQ ID NO: 1091664 - DNA, 15 bp, Homo sapiens
actctcattccccag

SEQ ID NO: 1091665 - DNA, 19 bp, Homo sapiens
actctcattctttgaacat

SEQ ID NO: 1091666 - DNA, 14 bp, Homo sapiens
actctccaacctgg

SEQ ID NO: 1091667 - DNA, 19 bp, Homo sapiens
actctccaacctggacaac

SEQ ID NO: 1091668 - DNA, 16 bp, Homo sapiens
actctccaatgttcta

SEQ ID NO: 1091669 - DNA, 19 bp, Homo sapiens
actctccaatgttctatta

SEQ ID NO: 1091670 - DNA, 14 bp, Homo sapiens
actctccccacact

SEQ ID NO: 1091671 - DNA, 20 bp, Homo sapiens
actctccccagtgcctgcca

SEQ ID NO: 1091672 - DNA, 21 bp, Homo sapiens
actctccccagtgcctgccac

SEQ ID NO: 1091673 - DNA, 13 bp, Homo sapiens
actctcccctccc

SEQ ID NO: 1091674 - DNA, 14 bp, Homo sapiens
actctcccctccct

SEQ ID NO: 1091675 - DNA, 13 bp, Homo sapiens
actctcctagaga

SEQ ID NO: 1091676 - DNA, 14 bp, Homo sapiens
actctcctcctccc

SEQ ID NO: 1091677 - DNA, 17 bp, Homo sapiens
actctcctcctcccctc

SEQ ID NO: 1091678 - DNA, 20 bp, Homo sapiens
actctcctcggccccctcca

SEQ ID NO: 1091679 - DNA, 13 bp, Homo sapiens
actctcctgcctc

SEQ ID NO: 1091680 - DNA, 18 bp, Homo sapiens
actctccttcgtgtctct

SEQ ID NO: 1091681 - DNA, 22 bp, Homo sapiens
actctccttcgtgtctctccca

SEQ ID NO: 1091682 - DNA, 18 bp, Homo sapiens
actctcctttgtgtggct

SEQ ID NO: 1091683 - DNA, 14 bp, Homo sapiens
actctcggggccct

SEQ ID NO: 1091684 - DNA, 19 bp, Homo sapiens
actctctaaactggtacaa

SEQ ID NO: 1091685 - DNA, 11 bp, Homo sapiens
actctctacag

SEQ ID NO: 1091686 - DNA, 15 bp, Homo sapiens
actctctcacccacc

SEQ ID NO: 1091687 - DNA, 18 bp, Homo sapiens
actctctcacccaccagc

SEQ ID NO: 1091688 - DNA, 19 bp, Homo sapiens
actctctcacccaccagct

SEQ ID NO: 1091689 - DNA, 14 bp, Homo sapiens
actctctccctggt

SEQ ID NO: 1091690 - DNA, 19 bp, Homo sapiens
actctctgaacccctccct

SEQ ID NO: 1091691 - DNA, 12 bp, Homo sapiens
actctctgagct

SEQ ID NO: 1091692 - DNA, 18 bp, Homo sapiens
actctctgagctggggag

SEQ ID NO: 1091693 - DNA, 18 bp, Homo sapiens
actctctgcagcccagcc

SEQ ID NO: 1091694 - DNA, 16 bp, Homo sapiens
actctctgcagtcctc

SEQ ID NO: 1091695 - DNA, 17 bp, Homo sapiens
actctctgcagtcctcc

SEQ ID NO: 1091696 - DNA, 12 bp, Homo sapiens
actctctgctct

SEQ ID NO: 1091697 - DNA, 18 bp, Homo sapiens
actctctgctctagccag

SEQ ID NO: 1091698 - DNA, 12 bp, Homo sapiens
actctctgggac

SEQ ID NO: 1091699 - DNA, 17 bp, Homo sapiens
actctctgggactctcc

SEQ ID NO: 1091700 - DNA, 21 bp, Homo sapiens
actctctgggactctcctcct

SEQ ID NO: 1091701 - DNA, 15 bp, Homo sapiens
actctctgttcagaa

SEQ ID NO: 1091702 - DNA, 15 bp, Homo sapiens
actctgaagctaatt

SEQ ID NO: 1091703 - DNA, 16 bp, Homo sapiens
actctgagccaaggga

SEQ ID NO: 1091704 - DNA, 19 bp, Homo sapiens
actctgagccaagggaggg

SEQ ID NO: 1091705 - DNA, 12 bp, Homo sapiens
actctgagccca

SEQ ID NO: 1091706 - DNA, 16 bp, Homo sapiens
actctgagcccaggcc

SEQ ID NO: 1091707 - DNA, 14 bp, Homo sapiens
actctgagcccatg

SEQ ID NO: 1091708 - DNA, 22 bp, Homo sapiens
actctgagtttaccatttgtaa

SEQ ID NO: 1091709 - DNA, 15 bp, Homo sapiens
actctgcactactcc

SEQ ID NO: 1091710 - DNA, 23 bp, Homo sapiens
actctgcactactcctctgcagt

SEQ ID NO: 1091711 - DNA, 13 bp, Homo sapiens
actctgcactcca

SEQ ID NO: 1091712 - DNA, 19 bp, Homo sapiens
actctgcactccatggcca

SEQ ID NO: 1091713 - DNA, 16 bp, Homo sapiens
actctgcattctagta

SEQ ID NO: 1091714 - DNA, 20 bp, Homo sapiens
actctgccaatcggctaccc

SEQ ID NO: 1091715 - DNA, 22 bp, Homo sapiens
actctgccagaaaaaaataact

SEQ ID NO: 1091716 - DNA, 13 bp, Homo sapiens
actctgccagcca

SEQ ID NO: 1091717 - DNA, 16 bp, Homo sapiens
actctgcccaccctcc

SEQ ID NO: 1091718 - DNA, 15 bp, Homo sapiens
actctgccctctgct

SEQ ID NO: 1091719 - DNA, 16 bp, Homo sapiens
actctgccctctgctg

SEQ ID NO: 1091720 - DNA, 19 bp, Homo sapiens
actctgcctacagaacttc

SEQ ID NO: 1091721 - DNA, 12 bp, Homo sapiens
actctgcctcct

SEQ ID NO: 1091722 - DNA, 16 bp, Homo sapiens
actctgcctttatgat

SEQ ID NO: 1091723 - DNA, 19 bp, Homo sapiens
actctgcggatagcatttg

SEQ ID NO: 1091724 - DNA, 16 bp, Homo sapiens
actctgcggcccgggc

SEQ ID NO: 1091725 - DNA, 21 bp, Homo sapiens
actctgcgggaggctggggcc

SEQ ID NO: 1091726 - DNA, 17 bp, Homo sapiens
actctgctccaaagtag

SEQ ID NO: 1091727 - DNA, 9 bp, Homo sapiens
actctgctg

SEQ ID NO: 1091728 - DNA, 12 bp, Homo sapiens
actctgctgctc

SEQ ID NO: 1091729 - DNA, 16 bp, Homo sapiens
actctgcttaaacaaa

SEQ ID NO: 1091730 - DNA, 23 bp, Homo sapiens
actgccataaaacattaagaaaa

SEQ ID NO: 1091731 - DNA, 21 bp, Homo sapiens
actgccatgatagctggggct

SEQ ID NO: 1091732 - DNA, 22 bp, Homo sapiens
actgccatggaattccctcctg

SEQ ID NO: 1091733 - DNA, 21 bp, Homo sapiens
actgccatgtactagttttag

SEQ ID NO: 1091734 - DNA, 18 bp, Homo sapiens
actgccattattttctgt

SEQ ID NO: 1091735 - DNA, 22 bp, Homo sapiens
actgccattattttctgtcaga

SEQ ID NO: 1091736 - DNA, 19 bp, Homo sapiens
actgcccacatgggacctg

SEQ ID NO: 1091737 - DNA, 22 bp, Homo sapiens
actgcccacatgggacctggcc

SEQ ID NO: 1091738 - DNA, 14 bp, Homo sapiens
actgcccaccaaag

SEQ ID NO: 1091739 - DNA, 15 bp, Homo sapiens
actgcccaccaaagg

SEQ ID NO: 1091740 - DNA, 17 bp, Homo sapiens
actgcccaccaaaggtc

SEQ ID NO: 1091741 - DNA, 13 bp, Homo sapiens
actgcccaccccc

SEQ ID NO: 1091742 - DNA, 17 bp, Homo sapiens
actgcccaccccctcaa

SEQ ID NO: 1091743 - DNA, 14 bp, Homo sapiens
actgcccagccact

SEQ ID NO: 1091744 - DNA, 16 bp, Homo sapiens
actgcccagccactcc

SEQ ID NO: 1091745 - DNA, 18 bp, Homo sapiens
actgcccagccccttttc

SEQ ID NO: 1091746 - DNA, 21 bp, Homo sapiens
actgcccatggacaggctggc

SEQ ID NO: 1091747 - DNA, 15 bp, Homo sapiens
actgccccaactcct

SEQ ID NO: 1091748 - DNA, 17 bp, Homo sapiens
actgccccaactcctgg

SEQ ID NO: 1091749 - DNA, 21 bp, Homo sapiens
actgccccaactcctggaagc

SEQ ID NO: 1091750 - DNA, 19 bp, Homo sapiens
actgccccacttctggcat

SEQ ID NO: 1091751 - DNA, 12 bp, Homo sapiens
actgccccaggg

SEQ ID NO: 1091752 - DNA, 12 bp, Homo sapiens
actgcccccaga

SEQ ID NO: 1091753 - DNA, 22 bp, Homo sapiens
actgcccccagaaagcctcctg

SEQ ID NO: 1091754 - DNA, 18 bp, Homo sapiens
actgccccccgaggctgc

SEQ ID NO: 1091755 - DNA, 16 bp, Homo sapiens
actgccccctgctgcc

SEQ ID NO: 1091756 - DNA, 18 bp, Homo sapiens
actgccccctgctgccat

SEQ ID NO: 1091757 - DNA, 22 bp, Homo sapiens
actgccccgggtgcctcagagc

SEQ ID NO: 1091758 - DNA, 19 bp, Homo sapiens
actgccccgtgtgaatgta

SEQ ID NO: 1091759 - DNA, 14 bp, Homo sapiens
actgcccgagctgg

SEQ ID NO: 1091760 - DNA, 15 bp, Homo sapiens
actgcccgagctggt

SEQ ID NO: 1091761 - DNA, 11 bp, Homo sapiens
actgccctgcc

SEQ ID NO: 1091762 - DNA, 17 bp, Homo sapiens
actgccctgcctgccca

SEQ ID NO: 1091763 - DNA, 18 bp, Homo sapiens
actgccctgcctgcccac

SEQ ID NO: 1091764 - DNA, 13 bp, Homo sapiens
actgccctggcag

SEQ ID NO: 1091765 - DNA, 16 bp, Homo sapiens
actgccctggcagcag

SEQ ID NO: 1091766 - DNA, 13 bp, Homo sapiens
actgcccttctca

SEQ ID NO: 1091767 - DNA, 17 bp, Homo sapiens
actgccgacatcagcat

SEQ ID NO: 1091768 - DNA, 20 bp, Homo sapiens
actgccggtcatttgaatga

SEQ ID NO: 1091769 - DNA, 15 bp, Homo sapiens
actgccgtaatttaa

SEQ ID NO: 1091770 - DNA, 18 bp, Homo sapiens
actgcctaaggccctttg

SEQ ID NO: 1091771 - DNA, 21 bp, Homo sapiens
actgcctaggaggctggccaa

SEQ ID NO: 1091772 - DNA, 16 bp, Homo sapiens
actgcctataatctta

SEQ ID NO: 1091773 - DNA, 16 bp, Homo sapiens
actgcctcctgcctgg

SEQ ID NO: 1091774 - DNA, 23 bp, Homo sapiens
actgcctcctgttttctccctct

SEQ ID NO: 1091775 - DNA, 17 bp, Homo sapiens
actgcctctatgccctg

SEQ ID NO: 1091776 - DNA, 19 bp, Homo sapiens
actgcctctatgccctgca

SEQ ID NO: 1091777 - DNA, 22 bp, Homo sapiens
actgcctctatgccctgcagag

SEQ ID NO: 1091778 - DNA, 16 bp, Homo sapiens
actgcctgcccacccg

SEQ ID NO: 1091779 - DNA, 19 bp, Homo sapiens
actgcctgcccacccgtgg

SEQ ID NO: 1091780 - DNA, 17 bp, Homo sapiens
actgcctgtctccatga

SEQ ID NO: 1091781 - DNA, 16 bp, Homo sapiens
actgccttagcctctt

SEQ ID NO: 1091782 - DNA, 15 bp, Homo sapiens
actgccttcctcctt

SEQ ID NO: 1091783 - DNA, 16 bp, Homo sapiens
actgccttcgcttctt

SEQ ID NO: 1091784 - DNA, 17 bp, Homo sapiens
actgccttcgcttcttg

SEQ ID NO: 1091785 - DNA, 21 bp, Homo sapiens
actgccttcgcttcttgcctc

SEQ ID NO: 1091786 - DNA, 16 bp, Homo sapiens
actgccttctcctctc

SEQ ID NO: 1091787 - DNA, 21 bp, Homo sapiens
actgcgaagaccctcttgccc

SEQ ID NO: 1091788 - DNA, 18 bp, Homo sapiens
actgcgactttctgcctg

SEQ ID NO: 1091789 - DNA, 21 bp, Homo sapiens
actgcgactttctgcctggag

SEQ ID NO: 1091790 - DNA, 22 bp, Homo sapiens
actgcgactttctgcctggagt

SEQ ID NO: 1091791 - DNA, 23 bp, Homo sapiens
actgcgactttctgcctggagtg

SEQ ID NO: 1091792 - DNA, 16 bp, Homo sapiens
actgcgaggacatcaa

SEQ ID NO: 1091793 - DNA, 14 bp, Homo sapiens
actgcgataactga

SEQ ID NO: 1091794 - DNA, 16 bp, Homo sapiens
actgcgataactgaga

SEQ ID NO: 1091795 - DNA, 18 bp, Homo sapiens
actgcgatcttcagagca

SEQ ID NO: 1091796 - DNA, 19 bp, Homo sapiens
actgcgatcttcagagcag

SEQ ID NO: 1091797 - DNA, 19 bp, Homo sapiens
actgcgccccgcctgacct

SEQ ID NO: 1091798 - DNA, 14 bp, Homo sapiens
actgctaaataaaa

SEQ ID NO: 1091799 - DNA, 15 bp, Homo sapiens
actgctaaataaaat

SEQ ID NO: 1091800 - DNA, 16 bp, Homo sapiens
actgctaaataaaatt

SEQ ID NO: 1091801 - DNA, 15 bp, Homo sapiens
actgctaaggctgct

SEQ ID NO: 1091802 - DNA, 21 bp, Homo sapiens
actgctaaggctgctggcttc

SEQ ID NO: 1091803 - DNA, 19 bp, Homo sapiens
actgctaagtatttcccag

SEQ ID NO: 1091804 - DNA, 20 bp, Homo sapiens
actgctaagtatttcccagc

SEQ ID NO: 1091805 - DNA, 16 bp, Homo sapiens
actgctacagcaattt

SEQ ID NO: 1091806 - DNA, 21 bp, Homo sapiens
actgctaggcgagtgccagga

SEQ ID NO: 1091807 - DNA, 23 bp, Homo sapiens
actgctaggcgagtgccaggact

SEQ ID NO: 1091808 - DNA, 13 bp, Homo sapiens
actgctataaata

SEQ ID NO: 1091809 - DNA, 14 bp, Homo sapiens
actgctatgccatt

SEQ ID NO: 1091810 - DNA, 16 bp, Homo sapiens
actgctcagagcttta

SEQ ID NO: 1091811 - DNA, 17 bp, Homo sapiens
actgctcagagctttaa

SEQ ID NO: 1091812 - DNA, 17 bp, Homo sapiens
actgctccaagggacag

SEQ ID NO: 1091813 - DNA, 23 bp, Homo sapiens
actgctccaagggacaggtgggc

SEQ ID NO: 1091814 - DNA, 18 bp, Homo sapiens
actgctccccagccctgg

SEQ ID NO: 1091815 - DNA, 21 bp, Homo sapiens
actgctccccagccctggctc

SEQ ID NO: 1091816 - DNA, 20 bp, Homo sapiens
actgctcccggcccgcctgc

SEQ ID NO: 1091817 - DNA, 15 bp, Homo sapiens
actgctcctgtggca

SEQ ID NO: 1091818 - DNA, 16 bp, Homo sapiens
actgctcctgtggcag

SEQ ID NO: 1091819 - DNA, 18 bp, Homo sapiens
actgctctaacagccctc

SEQ ID NO: 1091820 - DNA, 15 bp, Homo sapiens
actgctctactttga

SEQ ID NO: 1091821 - DNA, 17 bp, Homo sapiens
actgctcttaagaaact

SEQ ID NO: 1091822 - DNA, 15 bp, Homo sapiens
actgctcttgaacat

SEQ ID NO: 1091823 - DNA, 17 bp, Homo sapiens
actgctgaagccagttg

SEQ ID NO: 1091824 - DNA, 12 bp, Homo sapiens
actgctgagcca

SEQ ID NO: 1091825 - DNA, 20 bp, Homo sapiens
actgctgaggagtctgagga

SEQ ID NO: 1091826 - DNA, 18 bp, Homo sapiens
actgctgaggtcccgggc

SEQ ID NO: 1091827 - DNA, 19 bp, Homo sapiens
actgctgaggtcccgggct

SEQ ID NO: 1091828 - DNA, 18 bp, Homo sapiens
actgctgataaaatatga

SEQ ID NO: 1091829 - DNA, 17 bp, Homo sapiens
actgctgatcgtagaaa

SEQ ID NO: 1091830 - DNA, 19 bp, Homo sapiens
actgctgatcgtagaaaat

SEQ ID NO: 1091831 - DNA, 21 bp, Homo sapiens
actgctgatcgtagaaaattt

SEQ ID NO: 1091832 - DNA, 19 bp, Homo sapiens
actgctgattcttgtaaat

SEQ ID NO: 1091833 - DNA, 20 bp, Homo sapiens
actgctgattcttgtaaatc

SEQ ID NO: 1091834 - DNA, 23 bp, Homo sapiens
actgctgattcttgtaaatcttt

SEQ ID NO: 1091835 - DNA, 13 bp, Homo sapiens
actgctgcatact

SEQ ID NO: 1091836 - DNA, 19 bp, Homo sapiens
actgctgcatactttgaca

SEQ ID NO: 1091837 - DNA, 17 bp, Homo sapiens
actgctgctccccaccc

SEQ ID NO: 1091838 - DNA, 13 bp, Homo sapiens
actgctgctcctc

SEQ ID NO: 1091839 - DNA, 15 bp, Homo sapiens
actgctgctcctctt

SEQ ID NO: 1091840 - DNA, 16 bp, Homo sapiens
actgctgctcctcttt

SEQ ID NO: 1091841 - DNA, 12 bp, Homo sapiens
actgctgctgtg

SEQ ID NO: 1091842 - DNA, 14 bp, Homo sapiens
actgctgcttctcc

SEQ ID NO: 1091843 - DNA, 16 bp, Homo sapiens
actgctggacatgaga

SEQ ID NO: 1091844 - DNA, 12 bp, Homo sapiens
actgctggctca

SEQ ID NO: 1091845 - DNA, 13 bp, Homo sapiens
actgctggctgcc

SEQ ID NO: 1091846 - DNA, 23 bp, Homo sapiens
actgctggggaggagaggactgg

SEQ ID NO: 1091847 - DNA, 14 bp, Homo sapiens
actgctgtcttcca

SEQ ID NO: 1091848 - DNA, 23 bp, Homo sapiens
actgctgtgaaccctggggcctg

SEQ ID NO: 1091849 - DNA, 21 bp, Homo sapiens
actgctgtgagtgcgcctcac

SEQ ID NO: 1091850 - DNA, 23 bp, Homo sapiens
actgctgtgagtgcgcctcacca

SEQ ID NO: 1091851 - DNA, 15 bp, Homo sapiens
actgtaatgtgtact

SEQ ID NO: 1091852 - DNA, 19 bp, Homo sapiens
actgtaatttgtgatacaa

SEQ ID NO: 1091853 - DNA, 13 bp, Homo sapiens
actgtacaaagta

SEQ ID NO: 1091854 - DNA, 15 bp, Homo sapiens
actgtacacataagc

SEQ ID NO: 1091855 - DNA, 21 bp, Homo sapiens
actgtacagattgctgcttct

SEQ ID NO: 1091856 - DNA, 12 bp, Homo sapiens
actgtacataaa

SEQ ID NO: 1091857 - DNA, 18 bp, Homo sapiens
actgtacataaattccag

SEQ ID NO: 1091858 - DNA, 20 bp, Homo sapiens
actgtacataaattccagag

SEQ ID NO: 1091859 - DNA, 16 bp, Homo sapiens
actgtacatactgcag

SEQ ID NO: 1091860 - DNA, 13 bp, Homo sapiens
actgtacatgaaa

SEQ ID NO: 1091861 - DNA, 16 bp, Homo sapiens
actgtacatgaaaaca

SEQ ID NO: 1091862 - DNA, 19 bp, Homo sapiens
actgtacatgaaaacacat

SEQ ID NO: 1091863 - DNA, 14 bp, Homo sapiens
actgtacatttaaa

SEQ ID NO: 1091864 - DNA, 15 bp, Homo sapiens
actgtacatttaaaa

SEQ ID NO: 1091865 - DNA, 14 bp, Homo sapiens
actgtacatttttt

SEQ ID NO: 1091866 - DNA, 17 bp, Homo sapiens
actgtacccaaatggaa

SEQ ID NO: 1091867 - DNA, 13 bp, Homo sapiens
actgtactcctcc

SEQ ID NO: 1091868 - DNA, 15 bp, Homo sapiens
actgtactcctccca

SEQ ID NO: 1091869 - DNA, 13 bp, Homo sapiens
actgtactgcatg

SEQ ID NO: 1091870 - DNA, 16 bp, Homo sapiens
actgtactgcatgtga

SEQ ID NO: 1091871 - DNA, 11 bp, Homo sapiens
actgtactgtg

SEQ ID NO: 1091872 - DNA, 12 bp, Homo sapiens
actgtactgtgt

SEQ ID NO: 1091873 - DNA, 17 bp, Homo sapiens
actgtacttaataaatt

SEQ ID NO: 1091874 - DNA, 15 bp, Homo sapiens
actgtacttcactgt

SEQ ID NO: 1091875 - DNA, 14 bp, Homo sapiens
actgtactttgcca

SEQ ID NO: 1091876 - DNA, 19 bp, Homo sapiens
actgtactttgccattttt

SEQ ID NO: 1091877 - DNA, 22 bp, Homo sapiens
actgtagaagaagcccatatca

SEQ ID NO: 1091878 - DNA, 21 bp, Homo sapiens
actgtagaaggtgagaggcga

SEQ ID NO: 1091879 - DNA, 15 bp, Homo sapiens
actgtagagattttt

SEQ ID NO: 1091880 - DNA, 18 bp, Homo sapiens
actgtagattgcttctgt

SEQ ID NO: 1091881 - DNA, 20 bp, Homo sapiens
actgtagattgcttctgtag

SEQ ID NO: 1091882 - DNA, 21 bp, Homo sapiens
actgtagattgcttctgtagt

SEQ ID NO: 1091883 - DNA, 22 bp, Homo sapiens
actgtagcaagatgcaaatgca

SEQ ID NO: 1091884 - DNA, 15 bp, Homo sapiens
actgtagcgacccca

SEQ ID NO: 1091885 - DNA, 17 bp, Homo sapiens
actgtagcgaccccaga

SEQ ID NO: 1091886 - DNA, 21 bp, Homo sapiens
actgtagctattagcggctcc

SEQ ID NO: 1091887 - DNA, 20 bp, Homo sapiens
actgtagctcaagtttaaaa

SEQ ID NO: 1091888 - DNA, 13 bp, Homo sapiens
actgtagggaggg

SEQ ID NO: 1091889 - DNA, 18 bp, Homo sapiens
actgtagtttttgaaaat

SEQ ID NO: 1091890 - DNA, 15 bp, Homo sapiens
actgtatagacatgc

SEQ ID NO: 1091891 - DNA, 23 bp, Homo sapiens
actgtataggtagatccagatcc

SEQ ID NO: 1091892 - DNA, 16 bp, Homo sapiens
actgtatataaacata

SEQ ID NO: 1091893 - DNA, 16 bp, Homo sapiens
actgtatattacagat

SEQ ID NO: 1091894 - DNA, 16 bp, Homo sapiens
actgtatcaaatctgt

SEQ ID NO: 1091895 - DNA, 17 bp, Homo sapiens
actgtatcaaatctgta

SEQ ID NO: 1091896 - DNA, 16 bp, Homo sapiens
actgtatgccttctgt

SEQ ID NO: 1091897 - DNA, 20 bp, Homo sapiens
actgtatgtgccaaagcttt

SEQ ID NO: 1091898 - DNA, 13 bp, Homo sapiens
actgtatgtgtgt

SEQ ID NO: 1091899 - DNA, 16 bp, Homo sapiens
actgtatgttatagaa

SEQ ID NO: 1091900 - DNA, 14 bp, Homo sapiens
actgtattaaatct

SEQ ID NO: 1091901 - DNA, 18 bp, Homo sapiens
actgtattaaatcttaaa

SEQ ID NO: 1091902 - DNA, 22 bp, Homo sapiens
actgtattaaatcttaaacaat

SEQ ID NO: 1091903 - DNA, 16 bp, Homo sapiens
actgtattctagtggc

SEQ ID NO: 1091904 - DNA, 22 bp, Homo sapiens
actgtattctagtggctgttca

SEQ ID NO: 1091905 - DNA, 21 bp, Homo sapiens
actgtattgctcctcccactt

SEQ ID NO: 1091906 - DNA, 17 bp, Homo sapiens
actgtattgggcttctt

SEQ ID NO: 1091907 - DNA, 15 bp, Homo sapiens
actgtatttcagtat

SEQ ID NO: 1091908 - DNA, 12 bp, Homo sapiens
actgtatttgaa

SEQ ID NO: 1091909 - DNA, 13 bp, Homo sapiens
actgtatttgtat

SEQ ID NO: 1091910 - DNA, 14 bp, Homo sapiens
actgtatttgtatc

SEQ ID NO: 1091911 - DNA, 20 bp, Homo sapiens
actgtatttttacctttttc

SEQ ID NO: 1091912 - DNA, 15 bp, Homo sapiens
actgtatttttacta

SEQ ID NO: 1091913 - DNA, 17 bp, Homo sapiens
actgtcaaatgaacttt

SEQ ID NO: 1091914 - DNA, 23 bp, Homo sapiens
actgtcaaatgaacttttacaga

SEQ ID NO: 1091915 - DNA, 22 bp, Homo sapiens
actgtcaaggctgcttagaatc

SEQ ID NO: 1091916 - DNA, 13 bp, Homo sapiens
actgtcaataaac

SEQ ID NO: 1091917 - DNA, 14 bp, Homo sapiens
actgtcaataaaca

SEQ ID NO: 1091918 - DNA, 15 bp, Homo sapiens
actgtcaataaacag

SEQ ID NO: 1091919 - DNA, 18 bp, Homo sapiens
actgtcaataaacagctt

SEQ ID NO: 1091920 - DNA, 14 bp, Homo sapiens
actgtcaccctcca

SEQ ID NO: 1091921 - DNA, 22 bp, Homo sapiens
actgtcacggggttccctccta

SEQ ID NO: 1091922 - DNA, 15 bp, Homo sapiens
actgtcactcattgc

SEQ ID NO: 1091923 - DNA, 16 bp, Homo sapiens
actgtcagccgggccc

SEQ ID NO: 1091924 - DNA, 16 bp, Homo sapiens
actgtcagggagggcc

SEQ ID NO: 1091925 - DNA, 23 bp, Homo sapiens
actgtcatagggattgtccctgt

SEQ ID NO: 1091926 - DNA, 18 bp, Homo sapiens
actgtcccatccccaggt

SEQ ID NO: 1091927 - DNA, 16 bp, Homo sapiens
actgtccccctaccca

SEQ ID NO: 1091928 - DNA, 18 bp, Homo sapiens
actgtccccctacccacc

SEQ ID NO: 1091929 - DNA, 19 bp, Homo sapiens
actgtccccctacccaccg

SEQ ID NO: 1091930 - DNA, 13 bp, Homo sapiens
actgtccctcaaa

SEQ ID NO: 1091931 - DNA, 20 bp, Homo sapiens
actgtccctcaaatgaccca

SEQ ID NO: 1091932 - DNA, 19 bp, Homo sapiens
actgtccctgtccttctac

SEQ ID NO: 1091933 - DNA, 20 bp, Homo sapiens
actgtcctaccagttgccct

SEQ ID NO: 1091934 - DNA, 18 bp, Homo sapiens
actgtcctccaagccagc

SEQ ID NO: 1091935 - DNA, 12 bp, Homo sapiens
actgtcctccca

SEQ ID NO: 1091936 - DNA, 16 bp, Homo sapiens
actgtcctcccacaga

SEQ ID NO: 1091937 - DNA, 17 bp, Homo sapiens
actgtcctcccacagac

SEQ ID NO: 1091938 - DNA, 19 bp, Homo sapiens
actgtcctgaggagccctg

SEQ ID NO: 1091939 - DNA, 11 bp, Homo sapiens
actgtcctgga

SEQ ID NO: 1091940 - DNA, 12 bp, Homo sapiens
actgtcctgtcc

SEQ ID NO: 1091941 - DNA, 15 bp, Homo sapiens
actgtcctgtcctgc

SEQ ID NO: 1091942 - DNA, 17 bp, Homo sapiens
actgtcctgtcctgctc

SEQ ID NO: 1091943 - DNA, 22 bp, Homo sapiens
actgtcctgttgattaatttct

SEQ ID NO: 1091944 - DNA, 21 bp, Homo sapiens
actgtcggagaggctgtctgg

SEQ ID NO: 1091945 - DNA, 17 bp, Homo sapiens
actgtctagccactccc

SEQ ID NO: 1091946 - DNA, 23 bp, Homo sapiens
actgtctagccactccctcccag

SEQ ID NO: 1091947 - DNA, 21 bp, Homo sapiens
actgtctatatcataactata

SEQ ID NO: 1091948 - DNA, 20 bp, Homo sapiens
actgtctctcttctcagagt

SEQ ID NO: 1091949 - DNA, 12 bp, Homo sapiens
actgtctctgga

SEQ ID NO: 1091950 - DNA, 15 bp, Homo sapiens
actgtctctggagtg

SEQ ID NO: 1091951 - DNA, 13 bp, Homo sapiens
actgtctgggatt

SEQ ID NO: 1091952 - DNA, 18 bp, Homo sapiens
actgtctggttttaacaa

SEQ ID NO: 1091953 - DNA, 23 bp, Homo sapiens
actgtcttcccgatgagggaagg

SEQ ID NO: 1091954 - DNA, 18 bp, Homo sapiens
actgtcttcctcaaaata

SEQ ID NO: 1091955 - DNA, 19 bp, Homo sapiens
actgtctttaaaagagaga

SEQ ID NO: 1091956 - DNA, 22 bp, Homo sapiens
actgtctttataacccatattt

SEQ ID NO: 1091957 - DNA, 18 bp, Homo sapiens
actgtctttattcttatt

SEQ ID NO: 1091958 - DNA, 12 bp, Homo sapiens
actgtctttcag

SEQ ID NO: 1091959 - DNA, 16 bp, Homo sapiens
actgtgaaaatagtgt

SEQ ID NO: 1091960 - DNA, 23 bp, Homo sapiens
actgtgaaaatagtgtaagaact

SEQ ID NO: 1091961 - DNA, 12 bp, Homo sapiens
actgtgaaatac

SEQ ID NO: 1091962 - DNA, 18 bp, Homo sapiens
actgtgaaatttcatgat

SEQ ID NO: 1091963 - DNA, 16 bp, Homo sapiens
actgtgaacagcttgc

SEQ ID NO: 1091964 - DNA, 18 bp, Homo sapiens
actgtgaacagcttgctg

SEQ ID NO: 1091965 - DNA, 20 bp, Homo sapiens
actgtgaacagcttgctgtc

SEQ ID NO: 1091966 - DNA, 21 bp, Homo sapiens
actgtgaacagcttgctgtca

SEQ ID NO: 1091967 - DNA, 18 bp, Homo sapiens
actgtgaacctggagggc

SEQ ID NO: 1091968 - DNA, 22 bp, Homo sapiens
actgtgaacctgggcactccgc

SEQ ID NO: 1091969 - DNA, 13 bp, Homo sapiens
actgtgaacttga

SEQ ID NO: 1091970 - DNA, 16 bp, Homo sapiens
actgtgaagagaacca

SEQ ID NO: 1091971 - DNA, 18 bp, Homo sapiens
actgtgaatcctggcaag

SEQ ID NO: 1091972 - DNA, 19 bp, Homo sapiens
actgtgacccccagctccg

SEQ ID NO: 1091973 - DNA, 14 bp, Homo sapiens
actgttttatgttg

SEQ ID NO: 1091974 - DNA, 17 bp, Homo sapiens
actgttttccagttcat

SEQ ID NO: 1091975 - DNA, 13 bp, Homo sapiens
actgttttcctta

SEQ ID NO: 1091976 - DNA, 22 bp, Homo sapiens
actgttttctctcggctcccca

SEQ ID NO: 1091977 - DNA, 23 bp, Homo sapiens
actgttttctctcggctccccat

SEQ ID NO: 1091978 - DNA, 22 bp, Homo sapiens
actgttttgggcctccatgccc

SEQ ID NO: 1091979 - DNA, 14 bp, Homo sapiens
actgtttttaagta

SEQ ID NO: 1091980 - DNA, 20 bp, Homo sapiens
actgtttttattccttccat

SEQ ID NO: 1091981 - DNA, 17 bp, Homo sapiens
actgtttttgataaagt

SEQ ID NO: 1091982 - DNA, 17 bp, Homo sapiens
actgttttttcctgagc

SEQ ID NO: 1091983 - DNA, 19 bp, Homo sapiens
actgttttttcctgagctt

SEQ ID NO: 1091984 - DNA, 16 bp, Homo sapiens
actgttttttttgcag

SEQ ID NO: 1091985 - DNA, 21 bp, Homo sapiens
actgttttttttgcaggggtt

SEQ ID NO: 1091986 - DNA, 23 bp, Homo sapiens
acttaaaaaacttgtaaatgctg

SEQ ID NO: 1091987 - DNA, 14 bp, Homo sapiens
acttaaaaaatgtc

SEQ ID NO: 1091988 - DNA, 15 bp, Homo sapiens
acttaaaaaatgtcc

SEQ ID NO: 1091989 - DNA, 16 bp, Homo sapiens
acttaaaaatgtaaat

SEQ ID NO: 1091990 - DNA, 17 bp, Homo sapiens
acttaaaaatgtaaata

SEQ ID NO: 1091991 - DNA, 18 bp, Homo sapiens
acttaaaaatgtaaatat

SEQ ID NO: 1091992 - DNA, 23 bp, Homo sapiens
acttaaaaatgtaaatattctat

SEQ ID NO: 1091993 - DNA, 16 bp, Homo sapiens
acttaaaaatttatta

SEQ ID NO: 1091994 - DNA, 22 bp, Homo sapiens
acttaaaagtcagtatcatatt

SEQ ID NO: 1091995 - DNA, 20 bp, Homo sapiens
acttaaaatattcctgcatt

SEQ ID NO: 1091996 - DNA, 17 bp, Homo sapiens
acttaaaattagtcttt

SEQ ID NO: 1091997 - DNA, 15 bp, Homo sapiens
acttaaagaagtatt

SEQ ID NO: 1091998 - DNA, 14 bp, Homo sapiens
acttaaataatgtg

SEQ ID NO: 1091999 - DNA, 16 bp, Homo sapiens
acttaaatagtatttc

SEQ ID NO: 1092000 - DNA, 13 bp, Homo sapiens
acttaaatgaaag

SEQ ID NO: 1092001 - DNA, 11 bp, Homo sapiens
acttaaatgag

SEQ ID NO: 1092002 - DNA, 15 bp, Homo sapiens
acttaaattcctcaa

SEQ ID NO: 1092003 - DNA, 16 bp, Homo sapiens
acttaaattcttttga

SEQ ID NO: 1092004 - DNA, 22 bp, Homo sapiens
acttaaatttgaatctgagtga

SEQ ID NO: 1092005 - DNA, 20 bp, Homo sapiens
acttaacatttcattgtaca

SEQ ID NO: 1092006 - DNA, 16 bp, Homo sapiens
acttaaccggagttcg

SEQ ID NO: 1092007 - DNA, 22 bp, Homo sapiens
acttaactgaaatgcctgcttt

SEQ ID NO: 1092008 - DNA, 21 bp, Homo sapiens
acttaactgtccgtaagcagt

SEQ ID NO: 1092009 - DNA, 16 bp, Homo sapiens
acttaagaaacactga

SEQ ID NO: 1092010 - DNA, 17 bp, Homo sapiens
acttaagaatacacagg

SEQ ID NO: 1092011 - DNA, 11 bp, Homo sapiens
acttaagactt

SEQ ID NO: 1092012 - DNA, 15 bp, Homo sapiens
acttaagagtggcat

SEQ ID NO: 1092013 - DNA, 15 bp, Homo sapiens
acttaagcaaaagaa

SEQ ID NO: 1092014 - DNA, 16 bp, Homo sapiens
acttaagcaaaagaaa

SEQ ID NO: 1092015 - DNA, 17 bp, Homo sapiens
acttaagcatctggctc

SEQ ID NO: 1092016 - DNA, 20 bp, Homo sapiens
acttaagcatctggctctaa

SEQ ID NO: 1092017 - DNA, 20 bp, Homo sapiens
acttaaggaagtttgatttt

SEQ ID NO: 1092018 - DNA, 16 bp, Homo sapiens
acttaagtcttcctta

SEQ ID NO: 1092019 - DNA, 17 bp, Homo sapiens
acttaagtcttccttaa

SEQ ID NO: 1092020 - DNA, 17 bp, Homo sapiens
acttaagtgcacttttt

SEQ ID NO: 1092021 - DNA, 19 bp, Homo sapiens
acttaatactaccttgaaa

SEQ ID NO: 1092022 - DNA, 19 bp, Homo sapiens
acttaatactcaaatgagt

SEQ ID NO: 1092023 - DNA, 16 bp, Homo sapiens
acttaatcaaaactca

SEQ ID NO: 1092024 - DNA, 19 bp, Homo sapiens
acttaatctaaatggaacc

SEQ ID NO: 1092025 - DNA, 16 bp, Homo sapiens
acttaatctaagaaac

SEQ ID NO: 1092026 - DNA, 13 bp, Homo sapiens
acttaatctcaca

SEQ ID NO: 1092027 - DNA, 19 bp, Homo sapiens
acttaatgagactttaaaa

SEQ ID NO: 1092028 - DNA, 12 bp, Homo sapiens
acttaatggaaa

SEQ ID NO: 1092029 - DNA, 18 bp, Homo sapiens
acttaatgtaattcagga

SEQ ID NO: 1092030 - DNA, 21 bp, Homo sapiens
acttaatgtaattcaggactc

SEQ ID NO: 1092031 - DNA, 13 bp, Homo sapiens
acttaatttgtaa

SEQ ID NO: 1092032 - DNA, 17 bp, Homo sapiens
acttaatttgtaaactt

SEQ ID NO: 1092033 - DNA, 18 bp, Homo sapiens
acttaatttgtaaacttc

SEQ ID NO: 1092034 - DNA, 17 bp, Homo sapiens
acttacaaaatgccaag

SEQ ID NO: 1092035 - DNA, 22 bp, Homo sapiens
acttacaatttgcacaatattt

SEQ ID NO: 1092036 - DNA, 17 bp, Homo sapiens
acttacactttatgcac

SEQ ID NO: 1092037 - DNA, 15 bp, Homo sapiens
acttacatcatgtgt

SEQ ID NO: 1092038 - DNA, 15 bp, Homo sapiens
acttacatcttctgt

SEQ ID NO: 1092039 - DNA, 17 bp, Homo sapiens
acttacatcttctgtga

SEQ ID NO: 1092040 - DNA, 18 bp, Homo sapiens
acttacatcttctgtgaa

SEQ ID NO: 1092041 - DNA, 21 bp, Homo sapiens
acttacatttccatttattgt

SEQ ID NO: 1092042 - DNA, 18 bp, Homo sapiens
acttaccaggcaccaaaa

SEQ ID NO: 1092043 - DNA, 21 bp, Homo sapiens
acttaccaggcaccaaaagaa

SEQ ID NO: 1092044 - DNA, 22 bp, Homo sapiens
acttaccaggcaccaaaagaag

SEQ ID NO: 1092045 - DNA, 18 bp, Homo sapiens
acttaccccgagacctca

SEQ ID NO: 1092046 - DNA, 20 bp, Homo sapiens
acttaccccgagacctcact

SEQ ID NO: 1092047 - DNA, 16 bp, Homo sapiens
acttacctagtgaaac

SEQ ID NO: 1092048 - DNA, 13 bp, Homo sapiens
acttacctggcag

SEQ ID NO: 1092049 - DNA, 19 bp, Homo sapiens
acttacggatttattatat

SEQ ID NO: 1092050 - DNA, 15 bp, Homo sapiens
acttacgtaaaacat

SEQ ID NO: 1092051 - DNA, 15 bp, Homo sapiens
acttactgtacatga

SEQ ID NO: 1092052 - DNA, 21 bp, Homo sapiens
acttactgtacatgaaaacac

SEQ ID NO: 1092053 - DNA, 22 bp, Homo sapiens
acttactgtacatgaaaacaca

SEQ ID NO: 1092054 - DNA, 17 bp, Homo sapiens
acttactgtatatgtat

SEQ ID NO: 1092055 - DNA, 14 bp, Homo sapiens
acttacttgcttat

SEQ ID NO: 1092056 - DNA, 12 bp, Homo sapiens
acttagaaactg

SEQ ID NO: 1092057 - DNA, 16 bp, Homo sapiens
acttagaaattgcatt

SEQ ID NO: 1092058 - DNA, 19 bp, Homo sapiens
acttagaagtagtatgtta

SEQ ID NO: 1092059 - DNA, 22 bp, Homo sapiens
acttagaatccgaagggaatta

SEQ ID NO: 1092060 - DNA, 21 bp, Homo sapiens
acttagaatgccataaaattg

SEQ ID NO: 1092061 - DNA, 15 bp, Homo sapiens
acttagaggaaaatg

SEQ ID NO: 1092062 - DNA, 16 bp, Homo sapiens
acttagaggaaaatga

SEQ ID NO: 1092063 - DNA, 22 bp, Homo sapiens
acttagagtttctgtttgattc

SEQ ID NO: 1092064 - DNA, 16 bp, Homo sapiens
acttagatattaaaat

SEQ ID NO: 1092065 - DNA, 15 bp, Homo sapiens
acttagattaagatt

SEQ ID NO: 1092066 - DNA, 23 bp, Homo sapiens
acttagccgtccatggcaccagc

SEQ ID NO: 1092067 - DNA, 18 bp, Homo sapiens
acttagcgtcaagacatt

SEQ ID NO: 1092068 - DNA, 12 bp, Homo sapiens
acttagctcagg

SEQ ID NO: 1092069 - DNA, 15 bp, Homo sapiens
acttagctcaggtgc

SEQ ID NO: 1092070 - DNA, 18 bp, Homo sapiens
acttaggcatgcacagct

SEQ ID NO: 1092071 - DNA, 18 bp, Homo sapiens
acttagggaagaaaaagc

SEQ ID NO: 1092072 - DNA, 23 bp, Homo sapiens
acttagggcaccaggggtttctc

SEQ ID NO: 1092073 - DNA, 17 bp, Homo sapiens
acttagggtttggagct

SEQ ID NO: 1092074 - DNA, 19 bp, Homo sapiens
acttaggttattttgcttt

SEQ ID NO: 1092075 - DNA, 17 bp, Homo sapiens
acttagtagattaaaaa

SEQ ID NO: 1092076 - DNA, 17 bp, Homo sapiens
acttagtagtttttaca

SEQ ID NO: 1092077 - DNA, 12 bp, Homo sapiens
acttagtatttt

SEQ ID NO: 1092078 - DNA, 18 bp, Homo sapiens
acttagtgacaaaataga

SEQ ID NO: 1092079 - DNA, 15 bp, Homo sapiens
acttataccaaaggg

SEQ ID NO: 1092080 - DNA, 23 bp, Homo sapiens
acttataggtaacgtgattgatt

SEQ ID NO: 1092081 - DNA, 14 bp, Homo sapiens
acttatagtacatg

SEQ ID NO: 1092082 - DNA, 15 bp, Homo sapiens
acttatagtacatga

SEQ ID NO: 1092083 - DNA, 17 bp, Homo sapiens
acttatagttaatattt

SEQ ID NO: 1092084 - DNA, 16 bp, Homo sapiens
acttatattaatagta

SEQ ID NO: 1092085 - DNA, 22 bp, Homo sapiens
acttatattaatagtaatttgt

SEQ ID NO: 1092086 - DNA, 18 bp, Homo sapiens
acttatattgaagacaat

SEQ ID NO: 1092087 - DNA, 13 bp, Homo sapiens
acttatattttga

SEQ ID NO: 1092088 - DNA, 15 bp, Homo sapiens
acttatcatttttgt

SEQ ID NO: 1092089 - DNA, 17 bp, Homo sapiens
acttatcatttttgtat

SEQ ID NO: 1092090 - DNA, 19 bp, Homo sapiens
acttatcctaaaacaaata

SEQ ID NO: 1092091 - DNA, 14 bp, Homo sapiens
acttatgaaatctc

SEQ ID NO: 1092092 - DNA, 13 bp, Homo sapiens
acttatgctgctg

SEQ ID NO: 1092093 - DNA, 16 bp, Homo sapiens
acttatgctgctgtga

SEQ ID NO: 1092094 - DNA, 17 bp, Homo sapiens
acttatgctgctgtgaa

SEQ ID NO: 1092095 - DNA, 14 bp, Homo sapiens
acttgcatgaagag

SEQ ID NO: 1092096 - DNA, 21 bp, Homo sapiens
acttgcatgaagagaagcaat

SEQ ID NO: 1092097 - DNA, 20 bp, Homo sapiens
acttgcatgaattactgtat

SEQ ID NO: 1092098 - DNA, 22 bp, Homo sapiens
acttgcatgaattactgtatat

SEQ ID NO: 1092099 - DNA, 16 bp, Homo sapiens
acttgcattgctggac

SEQ ID NO: 1092100 - DNA, 11 bp, Homo sapiens
acttgcatttc

SEQ ID NO: 1092101 - DNA, 21 bp, Homo sapiens
acttgccaaaatgttggctgc

SEQ ID NO: 1092102 - DNA, 22 bp, Homo sapiens
acttgccaagcagtgcacattt

SEQ ID NO: 1092103 - DNA, 16 bp, Homo sapiens
acttgccatgcaggaa

SEQ ID NO: 1092104 - DNA, 22 bp, Homo sapiens
acttgccatgcaggaagaggcc

SEQ ID NO: 1092105 - DNA, 12 bp, Homo sapiens
acttgccatgtt

SEQ ID NO: 1092106 - DNA, 14 bp, Homo sapiens
acttgccattaaaa

SEQ ID NO: 1092107 - DNA, 16 bp, Homo sapiens
acttgcccaattttaa

SEQ ID NO: 1092108 - DNA, 15 bp, Homo sapiens
acttgcccaggtcac

SEQ ID NO: 1092109 - DNA, 20 bp, Homo sapiens
acttgccctgaccatgcatt

SEQ ID NO: 1092110 - DNA, 22 bp, Homo sapiens
acttgccgtcccctaaggaaat

SEQ ID NO: 1092111 - DNA, 13 bp, Homo sapiens
acttgcctggaat

SEQ ID NO: 1092112 - DNA, 17 bp, Homo sapiens
acttgcgagaaattcgt

SEQ ID NO: 1092113 - DNA, 14 bp, Homo sapiens
acttgcgagtccaa

SEQ ID NO: 1092114 - DNA, 14 bp, Homo sapiens
acttgcgtcctgca

SEQ ID NO: 1092115 - DNA, 15 bp, Homo sapiens
acttgcgtcctgcag

SEQ ID NO: 1092116 - DNA, 17 bp, Homo sapiens
acttgctacttatcatt

SEQ ID NO: 1092117 - DNA, 18 bp, Homo sapiens
acttgctacttatcattt

SEQ ID NO: 1092118 - DNA, 23 bp, Homo sapiens
acttgctctctggccttttccta

SEQ ID NO: 1092119 - DNA, 15 bp, Homo sapiens
acttgctgctgtctt

SEQ ID NO: 1092120 - DNA, 16 bp, Homo sapiens
acttgctgtccaggca

SEQ ID NO: 1092121 - DNA, 13 bp, Homo sapiens
acttgctgtgtga

SEQ ID NO: 1092122 - DNA, 20 bp, Homo sapiens
acttgctgtgtgaccctggg

SEQ ID NO: 1092123 - DNA, 16 bp, Homo sapiens
acttgcttaaatttct

SEQ ID NO: 1092124 - DNA, 15 bp, Homo sapiens
acttgcttctctagc

SEQ ID NO: 1092125 - DNA, 16 bp, Homo sapiens
acttgcttctctagct

SEQ ID NO: 1092126 - DNA, 23 bp, Homo sapiens
acttgcttgtattgtaaatgtgg

SEQ ID NO: 1092127 - DNA, 21 bp, Homo sapiens
acttgctttaccttttcaggg

SEQ ID NO: 1092128 - DNA, 14 bp, Homo sapiens
acttgctttcaatt

SEQ ID NO: 1092129 - DNA, 14 bp, Homo sapiens
acttgctttcttct

SEQ ID NO: 1092130 - DNA, 15 bp, Homo sapiens
acttgctttcttctt

SEQ ID NO: 1092131 - DNA, 21 bp, Homo sapiens
acttggaaaaatccagaaaga

SEQ ID NO: 1092132 - DNA, 11 bp, Homo sapiens
acttggaaata

SEQ ID NO: 1092133 - DNA, 16 bp, Homo sapiens
acttggaaataaacca

SEQ ID NO: 1092134 - DNA, 18 bp, Homo sapiens
acttggaaataaaccatt

SEQ ID NO: 1092135 - DNA, 24 bp, Homo sapiens
acttggaaataaaccattggacag

SEQ ID NO: 1092136 - DNA, 21 bp, Homo sapiens
acttggacatctctctggctt

SEQ ID NO: 1092137 - DNA, 15 bp, Homo sapiens
acttggactcttgct

SEQ ID NO: 1092138 - DNA, 19 bp, Homo sapiens
acttggactcttgctcttt

SEQ ID NO: 1092139 - DNA, 16 bp, Homo sapiens
acttggagactcctgg

SEQ ID NO: 1092140 - DNA, 17 bp, Homo sapiens
acttggagataataaaa

SEQ ID NO: 1092141 - DNA, 11 bp, Homo sapiens
acttggagcca

SEQ ID NO: 1092142 - DNA, 12 bp, Homo sapiens
acttggagcccg

SEQ ID NO: 1092143 - DNA, 14 bp, Homo sapiens
acttggagcccgtg

SEQ ID NO: 1092144 - DNA, 15 bp, Homo sapiens
acttggaggacctgg

SEQ ID NO: 1092145 - DNA, 16 bp, Homo sapiens
acttggaggacctggc

SEQ ID NO: 1092146 - DNA, 22 bp, Homo sapiens
acttggagggtctgggggcagc

SEQ ID NO: 1092147 - DNA, 17 bp, Homo sapiens
acttggagtaattgcac

SEQ ID NO: 1092148 - DNA, 18 bp, Homo sapiens
acttggatacttggattt

SEQ ID NO: 1092149 - DNA, 13 bp, Homo sapiens
acttggatggact

SEQ ID NO: 1092150 - DNA, 17 bp, Homo sapiens
acttggattctttccat

SEQ ID NO: 1092151 - DNA, 15 bp, Homo sapiens
acttggcaacagaag

SEQ ID NO: 1092152 - DNA, 17 bp, Homo sapiens
acttggcagctttttct

SEQ ID NO: 1092153 - DNA, 16 bp, Homo sapiens
acttggcaggtgcctg

SEQ ID NO: 1092154 - DNA, 15 bp, Homo sapiens
acttggcatacaaaa

SEQ ID NO: 1092155 - DNA, 15 bp, Homo sapiens
acttggcatttctat

SEQ ID NO: 1092156 - DNA, 22 bp, Homo sapiens
acttggcccagaaagctgcgga

SEQ ID NO: 1092157 - DNA, 18 bp, Homo sapiens
acttggctcgaatctctg

SEQ ID NO: 1092158 - DNA, 22 bp, Homo sapiens
acttggctcgaatctctgtgcc

SEQ ID NO: 1092159 - DNA, 17 bp, Homo sapiens
acttggctggaatttct

SEQ ID NO: 1092160 - DNA, 20 bp, Homo sapiens
acttggctggggaggaccag

SEQ ID NO: 1092161 - DNA, 17 bp, Homo sapiens
acttggctgtccttccc

SEQ ID NO: 1092162 - DNA, 17 bp, Homo sapiens
acttgggaaatttttaa

SEQ ID NO: 1092163 - DNA, 18 bp, Homo sapiens
acttgggaaatttttaat

SEQ ID NO: 1092164 - DNA, 19 bp, Homo sapiens
acttgggagcctgaggcag

SEQ ID NO: 1092165 - DNA, 14 bp, Homo sapiens
acttggggaggcaa

SEQ ID NO: 1092166 - DNA, 22 bp, Homo sapiens
acttgggggaacgatgtgtctg

SEQ ID NO: 1092167 - DNA, 23 bp, Homo sapiens
acttggggggctgaggtgggagg

SEQ ID NO: 1092168 - DNA, 20 bp, Homo sapiens
acttggtaagatgactctga

SEQ ID NO: 1092169 - DNA, 21 bp, Homo sapiens
acttggtaagatgactctgag

SEQ ID NO: 1092170 - DNA, 22 bp, Homo sapiens
acttggtaagatgactctgaga

SEQ ID NO: 1092171 - DNA, 20 bp, Homo sapiens
acttggtatttcaagaaaat

SEQ ID NO: 1092172 - DNA, 21 bp, Homo sapiens
acttggtgcggggttaacacc

SEQ ID NO: 1092173 - DNA, 23 bp, Homo sapiens
acttggttagacgccttccaggt

SEQ ID NO: 1092174 - DNA, 16 bp, Homo sapiens
acttggttctgaagcc

SEQ ID NO: 1092175 - DNA, 16 bp, Homo sapiens
acttggtttttaaaaa

SEQ ID NO: 1092176 - DNA, 20 bp, Homo sapiens
acttggtttttggctctttc

SEQ ID NO: 1092177 - DNA, 18 bp, Homo sapiens
acttgtaatttttttaat

SEQ ID NO: 1092178 - DNA, 18 bp, Homo sapiens
acttgtacccacaggtga

SEQ ID NO: 1092179 - DNA, 22 bp, Homo sapiens
acttgtactatgttaataactt

SEQ ID NO: 1092180 - DNA, 18 bp, Homo sapiens
acttgtaggaatctgcct

SEQ ID NO: 1092181 - DNA, 20 bp, Homo sapiens
acttgtaggaatctgccttc

SEQ ID NO: 1092182 - DNA, 19 bp, Homo sapiens
acttgtatatttgtacaaa

SEQ ID NO: 1092183 - DNA, 14 bp, Homo sapiens
acttgtatatttta

SEQ ID NO: 1092184 - DNA, 15 bp, Homo sapiens
acttgtattccctta

SEQ ID NO: 1092185 - DNA, 22 bp, Homo sapiens
acttgtattccttttagcagta

SEQ ID NO: 1092186 - DNA, 13 bp, Homo sapiens
acttgtattgact

SEQ ID NO: 1092187 - DNA, 16 bp, Homo sapiens
acttgtattgacttta

SEQ ID NO: 1092188 - DNA, 18 bp, Homo sapiens
acttgtattgactttatg

SEQ ID NO: 1092189 - DNA, 18 bp, Homo sapiens
acttgtattttgtcactt

SEQ ID NO: 1092190 - DNA, 15 bp, Homo sapiens
acttgtcaaagaagg

SEQ ID NO: 1092191 - DNA, 17 bp, Homo sapiens
acttgtcaatatttaaa

SEQ ID NO: 1092192 - DNA, 20 bp, Homo sapiens
acttgtcatatgtagccttc

SEQ ID NO: 1092193 - DNA, 23 bp, Homo sapiens
acttgtccttttgtaccatggtg

SEQ ID NO: 1092194 - DNA, 17 bp, Homo sapiens
acttgtctcctttctga

SEQ ID NO: 1092195 - DNA, 15 bp, Homo sapiens
acttgtctgtcaaat

SEQ ID NO: 1092196 - DNA, 18 bp, Homo sapiens
acttgtctgtcaaatgtt

SEQ ID NO: 1092197 - DNA, 22 bp, Homo sapiens
acttgtctgtcaaatgtttcct

SEQ ID NO: 1092198 - DNA, 15 bp, Homo sapiens
acttgtcttgctctt

SEQ ID NO: 1092199 - DNA, 17 bp, Homo sapiens
acttgtctttttctgga

SEQ ID NO: 1092200 - DNA, 18 bp, Homo sapiens
acttgtgaactccatcat

SEQ ID NO: 1092201 - DNA, 21 bp, Homo sapiens
acttgtgctttcagttagcct

SEQ ID NO: 1092202 - DNA, 19 bp, Homo sapiens
acttgtggcaatttgaatt

SEQ ID NO: 1092203 - DNA, 20 bp, Homo sapiens
acttgtgtactgataaaata

SEQ ID NO: 1092204 - DNA, 17 bp, Homo sapiens
acttgtgtcattgatgt

SEQ ID NO: 1092205 - DNA, 14 bp, Homo sapiens
acttgtgtctctgt

SEQ ID NO: 1092206 - DNA, 16 bp, Homo sapiens
acttgtgtctctgtgc

SEQ ID NO: 1092207 - DNA, 11 bp, Homo sapiens
acttgtgtctg

SEQ ID NO: 1092208 - DNA, 21 bp, Homo sapiens
acttgtgtgtgggctgtgagt

SEQ ID NO: 1092209 - DNA, 23 bp, Homo sapiens
acttgtgtgtgggctgtgagtgt

SEQ ID NO: 1092210 - DNA, 13 bp, Homo sapiens
acttgtgttactt

SEQ ID NO: 1092211 - DNA, 19 bp, Homo sapiens
acttgtgtttgcttaaaca

SEQ ID NO: 1092212 - DNA, 16 bp, Homo sapiens
acttgttattgtgaat

SEQ ID NO: 1092213 - DNA, 17 bp, Homo sapiens
acttgttattgtgaatg

SEQ ID NO: 1092214 - DNA, 16 bp, Homo sapiens
acttgttggtgtggat

SEQ ID NO: 1092215 - DNA, 12 bp, Homo sapiens
acttgtttgaat

SEQ ID NO: 1092216 - DNA, 18 bp, Homo sapiens
acttgtttgaatatttgt

SEQ ID NO: 1092217 - DNA, 10 bp, Homo sapiens
acttttcatt

SEQ ID NO: 1092218 - DNA, 14 bp, Homo sapiens
acttttcattctct

SEQ ID NO: 1092219 - DNA, 17 bp, Homo sapiens
acttttccattcccaat

SEQ ID NO: 1092220 - DNA, 20 bp, Homo sapiens
acttttcccctgttaaacag

SEQ ID NO: 1092221 - DNA, 17 bp, Homo sapiens
acttttcctccctcagt

SEQ ID NO: 1092222 - DNA, 20 bp, Homo sapiens
acttttcctcttagaagaat

SEQ ID NO: 1092223 - DNA, 21 bp, Homo sapiens
acttttcctggacttaaagaa

SEQ ID NO: 1092224 - DNA, 23 bp, Homo sapiens
acttttcctggacttaaagaaaa

SEQ ID NO: 1092225 - DNA, 17 bp, Homo sapiens
acttttccttttcttaa

SEQ ID NO: 1092226 - DNA, 22 bp, Homo sapiens
acttttcgttaacattgaccaa

SEQ ID NO: 1092227 - DNA, 18 bp, Homo sapiens
acttttctaagaaaagca

SEQ ID NO: 1092228 - DNA, 22 bp, Homo sapiens
acttttctaagaaaagcatttt

SEQ ID NO: 1092229 - DNA, 18 bp, Homo sapiens
acttttctagaattattt

SEQ ID NO: 1092230 - DNA, 12 bp, Homo sapiens
acttttctcttt

SEQ ID NO: 1092231 - DNA, 23 bp, Homo sapiens
acttttctctttaattttaactg

SEQ ID NO: 1092232 - DNA, 12 bp, Homo sapiens
acttttctgatt

SEQ ID NO: 1092233 - DNA, 17 bp, Homo sapiens
acttttctgattaatat

SEQ ID NO: 1092234 - DNA, 19 bp, Homo sapiens
acttttctggttccaaacc

SEQ ID NO: 1092235 - DNA, 17 bp, Homo sapiens
acttttctgtaattcag

SEQ ID NO: 1092236 - DNA, 13 bp, Homo sapiens
acttttctgttta

SEQ ID NO: 1092237 - DNA, 14 bp, Homo sapiens
acttttctgtttag

SEQ ID NO: 1092238 - DNA, 24 bp, Homo sapiens
acttttcttaaaccttcagttatg

SEQ ID NO: 1092239 - DNA, 12 bp, Homo sapiens
acttttcttctt

SEQ ID NO: 1092240 - DNA, 14 bp, Homo sapiens
acttttctttgaag

SEQ ID NO: 1092241 - DNA, 21 bp, Homo sapiens
acttttgaagtcttccctcag

SEQ ID NO: 1092242 - DNA, 15 bp, Homo sapiens
acttttgcaaataag

SEQ ID NO: 1092243 - DNA, 20 bp, Homo sapiens
acttttgctgtttatacttg

SEQ ID NO: 1092244 - DNA, 15 bp, Homo sapiens
acttttgtaaatatt

SEQ ID NO: 1092245 - DNA, 17 bp, Homo sapiens
acttttgtaatttgaat

SEQ ID NO: 1092246 - DNA, 19 bp, Homo sapiens
acttttgtaatttgaattg

SEQ ID NO: 1092247 - DNA, 16 bp, Homo sapiens
acttttgtactgaatt

SEQ ID NO: 1092248 - DNA, 17 bp, Homo sapiens
acttttgtactgaattt

SEQ ID NO: 1092249 - DNA, 22 bp, Homo sapiens
acttttgtgaattaggctgtaa

SEQ ID NO: 1092250 - DNA, 19 bp, Homo sapiens
acttttgtggagtttgaca

SEQ ID NO: 1092251 - DNA, 20 bp, Homo sapiens
acttttgttagggctgcttt

SEQ ID NO: 1092252 - DNA, 18 bp, Homo sapiens
acttttgttctcttctgc

SEQ ID NO: 1092253 - DNA, 15 bp, Homo sapiens
acttttgttcttggt

SEQ ID NO: 1092254 - DNA, 13 bp, Homo sapiens
actttttaaagta

SEQ ID NO: 1092255 - DNA, 14 bp, Homo sapiens
actttttaattttt

SEQ ID NO: 1092256 - DNA, 11 bp, Homo sapiens
actttttacat

SEQ ID NO: 1092257 - DNA, 16 bp, Homo sapiens
actttttagattattc

SEQ ID NO: 1092258 - DNA, 10 bp, Homo sapiens
actttttagc

SEQ ID NO: 1092259 - DNA, 22 bp, Homo sapiens
actttttagccagtgacttttt

SEQ ID NO: 1092260 - DNA, 17 bp, Homo sapiens
actttttagtaatttct

SEQ ID NO: 1092261 - DNA, 18 bp, Homo sapiens
actttttatactccatac

SEQ ID NO: 1092262 - DNA, 14 bp, Homo sapiens
actttttatttaat

SEQ ID NO: 1092263 - DNA, 14 bp, Homo sapiens
actttttatttgag

SEQ ID NO: 1092264 - DNA, 15 bp, Homo sapiens
actttttcaatggtt

SEQ ID NO: 1092265 - DNA, 17 bp, Homo sapiens
actttttctgagctttt

SEQ ID NO: 1092266 - DNA, 14 bp, Homo sapiens
actttttcttgtat

SEQ ID NO: 1092267 - DNA, 23 bp, Homo sapiens
actttttgctgttagttataaaa

SEQ ID NO: 1092268 - DNA, 22 bp, Homo sapiens
actttttggaattcagcagttt

SEQ ID NO: 1092269 - DNA, 23 bp, Homo sapiens
actttttgttctggtcctttttg

SEQ ID NO: 1092270 - DNA, 21 bp, Homo sapiens
acttttttaaaaagaaactat

SEQ ID NO: 1092271 - DNA, 14 bp, Homo sapiens
acttttttaaacta

SEQ ID NO: 1092272 - DNA, 15 bp, Homo sapiens
acttttttacactga

SEQ ID NO: 1092273 - DNA, 20 bp, Homo sapiens
acttttttacactgataaaa

SEQ ID NO: 1092274 - DNA, 13 bp, Homo sapiens
acttttttatagc

SEQ ID NO: 1092275 - DNA, 22 bp, Homo sapiens
acttttttatccacctccctac

SEQ ID NO: 1092276 - DNA, 13 bp, Homo sapiens
acttttttatgaa

SEQ ID NO: 1092277 - DNA, 20 bp, Homo sapiens
acttttttatgaagaaaaag

SEQ ID NO: 1092278 - DNA, 22 bp, Homo sapiens
acttttttatgaagaaaaagta

SEQ ID NO: 1092279 - DNA, 20 bp, Homo sapiens
acttttttgagacatgggat

SEQ ID NO: 1092280 - DNA, 15 bp, Homo sapiens
acttttttgtgtatg

SEQ ID NO: 1092281 - DNA, 12 bp, Homo sapiens
actttttttagt

SEQ ID NO: 1092282 - DNA, 19 bp, Homo sapiens
actttttttataagcaaaa

SEQ ID NO: 1092283 - DNA, 21 bp, Homo sapiens
actttttttctgtaccagtta

SEQ ID NO: 1092284 - DNA, 14 bp, Homo sapiens
actttttttctgtg

SEQ ID NO: 1092285 - DNA, 18 bp, Homo sapiens
actttttttctgtgacat

SEQ ID NO: 1092286 - DNA, 17 bp, Homo sapiens
actttttttctttttct

SEQ ID NO: 1092287 - DNA, 19 bp, Homo sapiens
actttttttgtagatgaac

SEQ ID NO: 1092288 - DNA, 15 bp, Homo sapiens
actttttttgttata

SEQ ID NO: 1092289 - DNA, 16 bp, Homo sapiens
actttttttttatact

SEQ ID NO: 1092290 - DNA, 18 bp, Homo sapiens
agaaaaaaaactgaagat

SEQ ID NO: 1092291 - DNA, 16 bp, Homo sapiens
agaaaaaaaagtgtct

SEQ ID NO: 1092292 - DNA, 18 bp, Homo sapiens
agaaaaaaaatagacttt

SEQ ID NO: 1092293 - DNA, 22 bp, Homo sapiens
agaaaaaaacattctatctact

SEQ ID NO: 1092294 - DNA, 18 bp, Homo sapiens
agaaaaaaaccacacaaa

SEQ ID NO: 1092295 - DNA, 13 bp, Homo sapiens
agaaaaaaaccat

SEQ ID NO: 1092296 - DNA, 20 bp, Homo sapiens
agaaaaaaagaaaaaaaaag

SEQ ID NO: 1092297 - DNA, 19 bp, Homo sapiens
agaaaaaaagaggtttaag

SEQ ID NO: 1092298 - DNA, 23 bp, Homo sapiens
agaaaaaaagtatttaatttgga

SEQ ID NO: 1092299 - DNA, 12 bp, Homo sapiens
agaaaaaaatcc

SEQ ID NO: 1092300 - DNA, 17 bp, Homo sapiens
agaaaaaaattgaaatg

SEQ ID NO: 1092301 - DNA, 12 bp, Homo sapiens
agaaaaaacaac

SEQ ID NO: 1092302 - DNA, 14 bp, Homo sapiens
agaaaaaacaacta

SEQ ID NO: 1092303 - DNA, 18 bp, Homo sapiens
agaaaaaagagaaaagaa

SEQ ID NO: 1092304 - DNA, 15 bp, Homo sapiens
agaaaaaagtgttga

SEQ ID NO: 1092305 - DNA, 11 bp, Homo sapiens
agaaaaacaaa

SEQ ID NO: 1092306 - DNA, 23 bp, Homo sapiens
agaaaaacaaactcgttttttac

SEQ ID NO: 1092307 - DNA, 19 bp, Homo sapiens
agaaaaacaatggtaacat

SEQ ID NO: 1092308 - DNA, 19 bp, Homo sapiens
agaaaaaccccgtttccct

SEQ ID NO: 1092309 - DNA, 20 bp, Homo sapiens
agaaaaactggctctgattg

SEQ ID NO: 1092310 - DNA, 13 bp, Homo sapiens
agaaaaagaaaaa

SEQ ID NO: 1092311 - DNA, 14 bp, Homo sapiens
agaaaaagaaatgc

SEQ ID NO: 1092312 - DNA, 15 bp, Homo sapiens
agaaaaagaaatgca

SEQ ID NO: 1092313 - DNA, 18 bp, Homo sapiens
agaaaaagcaagtgttca

SEQ ID NO: 1092314 - DNA, 20 bp, Homo sapiens
agaaaaagcaataacctcaa

SEQ ID NO: 1092315 - DNA, 18 bp, Homo sapiens
agaaaaaggatgcacaga

SEQ ID NO: 1092316 - DNA, 22 bp, Homo sapiens
agaaaaataaatgtcactgcca

SEQ ID NO: 1092317 - DNA, 15 bp, Homo sapiens
agaaaaataaccctt

SEQ ID NO: 1092318 - DNA, 17 bp, Homo sapiens
agaaaaatagagcaaaa

SEQ ID NO: 1092319 - DNA, 21 bp, Homo sapiens
agaaaaatagagcaaaatcaa

SEQ ID NO: 1092320 - DNA, 17 bp, Homo sapiens
agaaaaatatatactaa

SEQ ID NO: 1092321 - DNA, 13 bp, Homo sapiens
agaaaaatgaaaa

SEQ ID NO: 1092322 - DNA, 17 bp, Homo sapiens
agaaaaatgaaaagcaa

SEQ ID NO: 1092323 - DNA, 18 bp, Homo sapiens
agaaaaatgagcctggca

SEQ ID NO: 1092324 - DNA, 13 bp, Homo sapiens
agaaaaattcaca

SEQ ID NO: 1092325 - DNA, 18 bp, Homo sapiens
agaaaacaacaaaagaat

SEQ ID NO: 1092326 - DNA, 23 bp, Homo sapiens
agaaaacaacttggcatttctat

SEQ ID NO: 1092327 - DNA, 17 bp, Homo sapiens
agaaaacacttgtaagt

SEQ ID NO: 1092328 - DNA, 12 bp, Homo sapiens
agaaaacagaaa

SEQ ID NO: 1092329 - DNA, 12 bp, Homo sapiens
agaaaacagaga

SEQ ID NO: 1092330 - DNA, 20 bp, Homo sapiens
agaaaacaggaaaaaaactt

SEQ ID NO: 1092331 - DNA, 14 bp, Homo sapiens
agaaaacagtacag

SEQ ID NO: 1092332 - DNA, 15 bp, Homo sapiens
agaaaacatgcctct

SEQ ID NO: 1092333 - DNA, 12 bp, Homo sapiens
agaaaacattta

SEQ ID NO: 1092334 - DNA, 19 bp, Homo sapiens
agaaaacatttaacataat

SEQ ID NO: 1092335 - DNA, 20 bp, Homo sapiens
agaaaacggagagtgcttgg

SEQ ID NO: 1092336 - DNA, 21 bp, Homo sapiens
agaaaactcctttagcaggtg

SEQ ID NO: 1092337 - DNA, 16 bp, Homo sapiens
agaaaactgaaaatct

SEQ ID NO: 1092338 - DNA, 9 bp, Homo sapiens
agaaaagaa

SEQ ID NO: 1092339 - DNA, 12 bp, Homo sapiens
agaaaagaaaaa

SEQ ID NO: 1092340 - DNA, 13 bp, Homo sapiens
agaaaagaaaaaa

SEQ ID NO: 1092341 - DNA, 15 bp, Homo sapiens
agaaaagaaaacatt

SEQ ID NO: 1092342 - DNA, 18 bp, Homo sapiens
agaaaagaaaacatttaa

SEQ ID NO: 1092343 - DNA, 21 bp, Homo sapiens
agaaaagaaaacatttaacat

SEQ ID NO: 1092344 - DNA, 21 bp, Homo sapiens
agaaaagaatccctgttcatt

SEQ ID NO: 1092345 - DNA, 14 bp, Homo sapiens
agaaaagaccctga

SEQ ID NO: 1092346 - DNA, 15 bp, Homo sapiens
agaaaagacttttgt

SEQ ID NO: 1092347 - DNA, 19 bp, Homo sapiens
agaaaagacttttgttgaa

SEQ ID NO: 1092348 - DNA, 20 bp, Homo sapiens
agaaaagatacgactttatt

SEQ ID NO: 1092349 - DNA, 13 bp, Homo sapiens
agaaaagatgaaa

SEQ ID NO: 1092350 - DNA, 20 bp, Homo sapiens
agaaaagattttaatcaagt

SEQ ID NO: 1092351 - DNA, 18 bp, Homo sapiens
agaaaagcaatactgttt

SEQ ID NO: 1092352 - DNA, 15 bp, Homo sapiens
agaaaagcacctgcc

SEQ ID NO: 1092353 - DNA, 21 bp, Homo sapiens
agaaaagcagtcccattcata

SEQ ID NO: 1092354 - DNA, 17 bp, Homo sapiens
agaaaagcattttcagt

SEQ ID NO: 1092355 - DNA, 23 bp, Homo sapiens
agaaaagcattttcagtcttgta

SEQ ID NO: 1092356 - DNA, 13 bp, Homo sapiens
agaaaagcccatt

SEQ ID NO: 1092357 - DNA, 14 bp, Homo sapiens
agaaaagctcagag

SEQ ID NO: 1092358 - DNA, 12 bp, Homo sapiens
agaaaagctgat

SEQ ID NO: 1092359 - DNA, 20 bp, Homo sapiens
agaaaaggcaaaagactggt

SEQ ID NO: 1092360 - DNA, 16 bp, Homo sapiens
agaaaagggaaaaaag

SEQ ID NO: 1092361 - DNA, 20 bp, Homo sapiens
agaaaagggaactgaacatt

SEQ ID NO: 1092362 - DNA, 23 bp, Homo sapiens
agaaaagggaagttgtgcctttt

SEQ ID NO: 1092363 - DNA, 15 bp, Homo sapiens
agaaaagtaagccct

SEQ ID NO: 1092364 - DNA, 13 bp, Homo sapiens
agaaaagtaatga

SEQ ID NO: 1092365 - DNA, 17 bp, Homo sapiens
agaaaagtatgttctaa

SEQ ID NO: 1092366 - DNA, 21 bp, Homo sapiens
agaaaagtatgttctaacctt

SEQ ID NO: 1092367 - DNA, 21 bp, Homo sapiens
agaaaagtgcatatttatcca

SEQ ID NO: 1092368 - DNA, 18 bp, Homo sapiens
agaaaataaaaaaaagaa

SEQ ID NO: 1092369 - DNA, 20 bp, Homo sapiens
agaaaataaaaaaaagaaaa

SEQ ID NO: 1092370 - DNA, 21 bp, Homo sapiens
agaaaataaaaaaaagaaaaa

SEQ ID NO: 1092371 - DNA, 22 bp, Homo sapiens
agaaaataaggcacccatctgt

SEQ ID NO: 1092372 - DNA, 19 bp, Homo sapiens
agaaaataatggagaatca

SEQ ID NO: 1092373 - DNA, 16 bp, Homo sapiens
agaaaatataataaaa

SEQ ID NO: 1092374 - DNA, 14 bp, Homo sapiens
agaaaatatatgta

SEQ ID NO: 1092375 - DNA, 23 bp, Homo sapiens
agaaaatatatgtatttttatat

SEQ ID NO: 1092376 - DNA, 10 bp, Homo sapiens
agaaaatatt

SEQ ID NO: 1092377 - DNA, 16 bp, Homo sapiens
agaaaatattttgtct

SEQ ID NO: 1092378 - DNA, 20 bp, Homo sapiens
agaaaatattttgtctaaaa

SEQ ID NO: 1092379 - DNA, 17 bp, Homo sapiens
agaaaatcatcaagaag

SEQ ID NO: 1092380 - DNA, 11 bp, Homo sapiens
agaaaatcttt

SEQ ID NO: 1092381 - DNA, 21 bp, Homo sapiens
agaaaatgaaatgcatatttg

SEQ ID NO: 1092382 - DNA, 23 bp, Homo sapiens
agaaaatgacttatttctgctct

SEQ ID NO: 1092383 - DNA, 23 bp, Homo sapiens
agaaaatgactttatttttctaa

SEQ ID NO: 1092384 - DNA, 18 bp, Homo sapiens
agaaaatgcaaaatgaaa

SEQ ID NO: 1092385 - DNA, 22 bp, Homo sapiens
agaaaatgcggttataaaaaat

SEQ ID NO: 1092386 - DNA, 21 bp, Homo sapiens
agaaaatggctaataaactgt

SEQ ID NO: 1092387 - DNA, 16 bp, Homo sapiens
agaaaatgtaaggcaa

SEQ ID NO: 1092388 - DNA, 20 bp, Homo sapiens
agaaaatgtaaggcaatgct

SEQ ID NO: 1092389 - DNA, 11 bp, Homo sapiens
agaaaatgtag

SEQ ID NO: 1092390 - DNA, 22 bp, Homo sapiens
agaaaatgtctttctcttcctt

SEQ ID NO: 1092391 - DNA, 15 bp, Homo sapiens
agaaaattaaaagaa

SEQ ID NO: 1092392 - DNA, 18 bp, Homo sapiens
agaaaattaaacacaaag

SEQ ID NO: 1092393 - DNA, 18 bp, Homo sapiens
agaaaattcaattgtaaa

SEQ ID NO: 1092394 - DNA, 15 bp, Homo sapiens
agaaaattcctataa

SEQ ID NO: 1092395 - DNA, 19 bp, Homo sapiens
agaaaattcctataaggaa

SEQ ID NO: 1092396 - DNA, 23 bp, Homo sapiens
agaaaattctgtgccttgttttt

SEQ ID NO: 1092397 - DNA, 13 bp, Homo sapiens
agaaaattgcatg

SEQ ID NO: 1092398 - DNA, 21 bp, Homo sapiens
agaaaattgcatgaaactagg

SEQ ID NO: 1092399 - DNA, 21 bp, Homo sapiens
agaaaattggaactctactca

SEQ ID NO: 1092400 - DNA, 21 bp, Homo sapiens
agaaaatttacaaaatttatt

SEQ ID NO: 1092401 - DNA, 23 bp, Homo sapiens
agaaaatttacaaaatttattct

SEQ ID NO: 1092402 - DNA, 15 bp, Homo sapiens
agaaaatttagccct

SEQ ID NO: 1092403 - DNA, 21 bp, Homo sapiens
agaaaatttagccctttaaaa

SEQ ID NO: 1092404 - DNA, 21 bp, Homo sapiens
agaaaattttgtattaatttc

SEQ ID NO: 1092405 - DNA, 22 bp, Homo sapiens
agaaaattttgtattaatttct

SEQ ID NO: 1092406 - DNA, 16 bp, Homo sapiens
agaaacaaaaagagct

SEQ ID NO: 1092407 - DNA, 17 bp, Homo sapiens
agaaacaaaaagagctt

SEQ ID NO: 1092408 - DNA, 13 bp, Homo sapiens
agaaacaaagatg

SEQ ID NO: 1092409 - DNA, 15 bp, Homo sapiens
agaaacaacagggga

SEQ ID NO: 1092410 - DNA, 17 bp, Homo sapiens
agaaacaactctttgag

SEQ ID NO: 1092411 - DNA, 17 bp, Homo sapiens
agaaacaagctgtgcag

SEQ ID NO: 1092412 - DNA, 18 bp, Homo sapiens
agaaacaaggttttcagt

SEQ ID NO: 1092413 - DNA, 16 bp, Homo sapiens
agaaacaatactgttc

SEQ ID NO: 1092414 - DNA, 14 bp, Homo sapiens
agaaacaatgaatg

SEQ ID NO: 1092415 - DNA, 19 bp, Homo sapiens
agaaacacagggttttgta

SEQ ID NO: 1092416 - DNA, 22 bp, Homo sapiens
agaaacacagggttttgtattc

SEQ ID NO: 1092417 - DNA, 19 bp, Homo sapiens
agaaacacattcttattaa

SEQ ID NO: 1092418 - DNA, 18 bp, Homo sapiens
agaaacacccctctgtct

SEQ ID NO: 1092419 - DNA, 23 bp, Homo sapiens
agaaacacgtatcccacctgaca

SEQ ID NO: 1092420 - DNA, 11 bp, Homo sapiens
agaaacactga

SEQ ID NO: 1092421 - DNA, 15 bp, Homo sapiens
agaaacactttctct

SEQ ID NO: 1092422 - DNA, 18 bp, Homo sapiens
agaaacagagtggcctcc

SEQ ID NO: 1092423 - DNA, 22 bp, Homo sapiens
agaaacagagtggcctccctgc

SEQ ID NO: 1092424 - DNA, 12 bp, Homo sapiens
agaaacagctgc

SEQ ID NO: 1092425 - DNA, 16 bp, Homo sapiens
agaaacagctgcttct

SEQ ID NO: 1092426 - DNA, 16 bp, Homo sapiens
agaaacagctttcaag

SEQ ID NO: 1092427 - DNA, 19 bp, Homo sapiens
agaaacagtgggagccctg

SEQ ID NO: 1092428 - DNA, 21 bp, Homo sapiens
agaaacagtgggagccctgac

SEQ ID NO: 1092429 - DNA, 19 bp, Homo sapiens
agaaacagttggtaacttt

SEQ ID NO: 1092430 - DNA, 21 bp, Homo sapiens
agaaacagttggtaacttttg

SEQ ID NO: 1092431 - DNA, 22 bp, Homo sapiens
agaaacagttggtaacttttgt

SEQ ID NO: 1092432 - DNA, 23 bp, Homo sapiens
agaaacatagtaattagtagaaa

SEQ ID NO: 1092433 - DNA, 18 bp, Homo sapiens
agaaacatgaaatgcttc

SEQ ID NO: 1092434 - DNA, 14 bp, Homo sapiens
agaaacatggtttt

SEQ ID NO: 1092435 - DNA, 14 bp, Homo sapiens
agaaaccaagccat

SEQ ID NO: 1092436 - DNA, 17 bp, Homo sapiens
agaaacctatctcaggg

SEQ ID NO: 1092437 - DNA, 19 bp, Homo sapiens
agaaacctatctcagggag

SEQ ID NO: 1092438 - DNA, 19 bp, Homo sapiens
agaaacctggggtgaatac

SEQ ID NO: 1092439 - DNA, 23 bp, Homo sapiens
agaaacctggggtgaatacttat

SEQ ID NO: 1092440 - DNA, 18 bp, Homo sapiens
agaaacctgttgaagatt

SEQ ID NO: 1092441 - DNA, 16 bp, Homo sapiens
agaaaccttattgtac

SEQ ID NO: 1092442 - DNA, 18 bp, Homo sapiens
agaaacgcatccagcaag

SEQ ID NO: 1092443 - DNA, 18 bp, Homo sapiens
agaaactaacttggtggc

SEQ ID NO: 1092444 - DNA, 16 bp, Homo sapiens
agaaactatcaagaga

SEQ ID NO: 1092445 - DNA, 19 bp, Homo sapiens
agaaactatgaagatctga

SEQ ID NO: 1092446 - DNA, 11 bp, Homo sapiens
agaaactattg

SEQ ID NO: 1092447 - DNA, 13 bp, Homo sapiens
agaaactcccctg

SEQ ID NO: 1092448 - DNA, 18 bp, Homo sapiens
agaaactcccctgggggt

SEQ ID NO: 1092449 - DNA, 14 bp, Homo sapiens
agaaactccttttg

SEQ ID NO: 1092450 - DNA, 21 bp, Homo sapiens
agaaactccttttgctgtctt

SEQ ID NO: 1092451 - DNA, 22 bp, Homo sapiens
agaaactccttttgctgtcttt

SEQ ID NO: 1092452 - DNA, 18 bp, Homo sapiens
agaaactcgggcttgagt

SEQ ID NO: 1092453 - DNA, 15 bp, Homo sapiens
agaaactgaaagtgt

SEQ ID NO: 1092454 - DNA, 20 bp, Homo sapiens
agaaactgacatgccctccc

SEQ ID NO: 1092455 - DNA, 21 bp, Homo sapiens
agaaactgacatgccctccct

SEQ ID NO: 1092456 - DNA, 18 bp, Homo sapiens
agaaactgaggaattttc

SEQ ID NO: 1092457 - DNA, 21 bp, Homo sapiens
agaaactgttcccacctgctg

SEQ ID NO: 1092458 - DNA, 17 bp, Homo sapiens
agaaacttaaatgttat

SEQ ID NO: 1092459 - DNA, 20 bp, Homo sapiens
agaaacttaaatgttattat

SEQ ID NO: 1092460 - DNA, 17 bp, Homo sapiens
agaacattccatttgaa

SEQ ID NO: 1092461 - DNA, 18 bp, Homo sapiens
agaacattgccttcctcg

SEQ ID NO: 1092462 - DNA, 16 bp, Homo sapiens
agaacattttaattca

SEQ ID NO: 1092463 - DNA, 16 bp, Homo sapiens
agaaccaaaacttcca

SEQ ID NO: 1092464 - DNA, 18 bp, Homo sapiens
agaaccaaaagttttcct

SEQ ID NO: 1092465 - DNA, 17 bp, Homo sapiens
agaaccaaatacctcaa

SEQ ID NO: 1092466 - DNA, 13 bp, Homo sapiens
agaaccaaattaa

SEQ ID NO: 1092467 - DNA, 16 bp, Homo sapiens
agaaccaccactgcct

SEQ ID NO: 1092468 - DNA, 16 bp, Homo sapiens
agaaccagagggcatg

SEQ ID NO: 1092469 - DNA, 17 bp, Homo sapiens
agaaccagccgtatttt

SEQ ID NO: 1092470 - DNA, 14 bp, Homo sapiens
agaaccagtctcct

SEQ ID NO: 1092471 - DNA, 16 bp, Homo sapiens
agaaccagtctcctca

SEQ ID NO: 1092472 - DNA, 18 bp, Homo sapiens
agaacccacagtgagagg

SEQ ID NO: 1092473 - DNA, 23 bp, Homo sapiens
agaacccacagtgagaggggagg

SEQ ID NO: 1092474 - DNA, 22 bp, Homo sapiens
agaacccagggctctgccccag

SEQ ID NO: 1092475 - DNA, 17 bp, Homo sapiens
agaacccctctgtcttc

SEQ ID NO: 1092476 - DNA, 14 bp, Homo sapiens
agaaccgagcaaag

SEQ ID NO: 1092477 - DNA, 16 bp, Homo sapiens
agaaccgagcaaagat

SEQ ID NO: 1092478 - DNA, 14 bp, Homo sapiens
agaacctcttcccc

SEQ ID NO: 1092479 - DNA, 22 bp, Homo sapiens
agaacctgagctattttcctct

SEQ ID NO: 1092480 - DNA, 20 bp, Homo sapiens
agaacctgtctcctactttg

SEQ ID NO: 1092481 - DNA, 14 bp, Homo sapiens
agaaccttgcctga

SEQ ID NO: 1092482 - DNA, 18 bp, Homo sapiens
agaacctttagaatatct

SEQ ID NO: 1092483 - DNA, 19 bp, Homo sapiens
agaacgcgacttccacaaa

SEQ ID NO: 1092484 - DNA, 16 bp, Homo sapiens
agaacgtgcatccttg

SEQ ID NO: 1092485 - DNA, 18 bp, Homo sapiens
agaactaaagctggagag

SEQ ID NO: 1092486 - DNA, 20 bp, Homo sapiens
agaactaaatttttcataga

SEQ ID NO: 1092487 - DNA, 21 bp, Homo sapiens
agaactaaatttttcatagaa

SEQ ID NO: 1092488 - DNA, 23 bp, Homo sapiens
agaactaagccaacttgatgtga

SEQ ID NO: 1092489 - DNA, 19 bp, Homo sapiens
agaactagccaaaccagga

SEQ ID NO: 1092490 - DNA, 21 bp, Homo sapiens
agaactagccaaaccaggacc

SEQ ID NO: 1092491 - DNA, 19 bp, Homo sapiens
agaactatatataaatgac

SEQ ID NO: 1092492 - DNA, 16 bp, Homo sapiens
agaactatatgtgaat

SEQ ID NO: 1092493 - DNA, 15 bp, Homo sapiens
agaactatcattttt

SEQ ID NO: 1092494 - DNA, 15 bp, Homo sapiens
agaactatctgcatt

SEQ ID NO: 1092495 - DNA, 17 bp, Homo sapiens
agaactatctgcattat

SEQ ID NO: 1092496 - DNA, 21 bp, Homo sapiens
agaactattgtgctcagagac

SEQ ID NO: 1092497 - DNA, 15 bp, Homo sapiens
agaactatttaaaat

SEQ ID NO: 1092498 - DNA, 19 bp, Homo sapiens
agaactatttaaaataaag

SEQ ID NO: 1092499 - DNA, 22 bp, Homo sapiens
agaactatttaaaataaagagg

SEQ ID NO: 1092500 - DNA, 19 bp, Homo sapiens
agaactcactggggcctac

SEQ ID NO: 1092501 - DNA, 15 bp, Homo sapiens
agaactcagaagaga

SEQ ID NO: 1092502 - DNA, 19 bp, Homo sapiens
agaactccacccccagagg

SEQ ID NO: 1092503 - DNA, 20 bp, Homo sapiens
agaactccacccccagagga

SEQ ID NO: 1092504 - DNA, 15 bp, Homo sapiens
agaactccaggccct

SEQ ID NO: 1092505 - DNA, 17 bp, Homo sapiens
agaactccaggccctcc

SEQ ID NO: 1092506 - DNA, 18 bp, Homo sapiens
agaactcgcgctcagtaa

SEQ ID NO: 1092507 - DNA, 23 bp, Homo sapiens
agaactctccatcttattttcat

SEQ ID NO: 1092508 - DNA, 18 bp, Homo sapiens
agaactctctccctggtc

SEQ ID NO: 1092509 - DNA, 14 bp, Homo sapiens
agaactctctgtct

SEQ ID NO: 1092510 - DNA, 21 bp, Homo sapiens
agaactctctgtcttctctcc

SEQ ID NO: 1092511 - DNA, 14 bp, Homo sapiens
agaactctgggctg

SEQ ID NO: 1092512 - DNA, 20 bp, Homo sapiens
agaactctgggctgctaccc

SEQ ID NO: 1092513 - DNA, 20 bp, Homo sapiens
agaactcttaaatacttttt

SEQ ID NO: 1092514 - DNA, 23 bp, Homo sapiens
agaactgaagccacttggcccag

SEQ ID NO: 1092515 - DNA, 18 bp, Homo sapiens
agaactgacaaaggagcc

SEQ ID NO: 1092516 - DNA, 15 bp, Homo sapiens
agaactgactttctc

SEQ ID NO: 1092517 - DNA, 16 bp, Homo sapiens
agaactgagctcctct

SEQ ID NO: 1092518 - DNA, 13 bp, Homo sapiens
agaactgcacttt

SEQ ID NO: 1092519 - DNA, 15 bp, Homo sapiens
agaactgcagacctc

SEQ ID NO: 1092520 - DNA, 12 bp, Homo sapiens
agaactgcaggc

SEQ ID NO: 1092521 - DNA, 18 bp, Homo sapiens
agaactgcaggccctggc

SEQ ID NO: 1092522 - DNA, 16 bp, Homo sapiens
agaactgcatggacct

SEQ ID NO: 1092523 - DNA, 15 bp, Homo sapiens
agaactgcccccact

SEQ ID NO: 1092524 - DNA, 20 bp, Homo sapiens
agaactgcccttgctgcccg

SEQ ID NO: 1092525 - DNA, 22 bp, Homo sapiens
agaactgcccttgctgcccgcg

SEQ ID NO: 1092526 - DNA, 14 bp, Homo sapiens
agaactggctgggc

SEQ ID NO: 1092527 - DNA, 18 bp, Homo sapiens
agaactggctgggcccct

SEQ ID NO: 1092528 - DNA, 11 bp, Homo sapiens
agaactgtccc

SEQ ID NO: 1092529 - DNA, 21 bp, Homo sapiens
agaactgtcccatccccaggt

SEQ ID NO: 1092530 - DNA, 21 bp, Homo sapiens
agaactgtgaaatttacaaat

SEQ ID NO: 1092531 - DNA, 19 bp, Homo sapiens
agaactgtgtttcaagttc

SEQ ID NO: 1092532 - DNA, 20 bp, Homo sapiens
agaacttaagtctcgaatgt

SEQ ID NO: 1092533 - DNA, 15 bp, Homo sapiens
agaacttcagaaaga

SEQ ID NO: 1092534 - DNA, 21 bp, Homo sapiens
agaacttccaacaagcctcaa

SEQ ID NO: 1092535 - DNA, 16 bp, Homo sapiens
agaacttgatttgcat

SEQ ID NO: 1092536 - DNA, 18 bp, Homo sapiens
agaacttggatgtacctg

SEQ ID NO: 1092537 - DNA, 23 bp, Homo sapiens
agaacttggatgtacctgccccc

SEQ ID NO: 1092538 - DNA, 17 bp, Homo sapiens
agaactttaaagctcag

SEQ ID NO: 1092539 - DNA, 20 bp, Homo sapiens
agaactttaaagctcaggag

SEQ ID NO: 1092540 - DNA, 23 bp, Homo sapiens
agaactttaaagctcaggagggt

SEQ ID NO: 1092541 - DNA, 20 bp, Homo sapiens
agaactttattaagtaaaat

SEQ ID NO: 1092542 - DNA, 22 bp, Homo sapiens
agaactttattaagtaaaatcc

SEQ ID NO: 1092543 - DNA, 16 bp, Homo sapiens
agaactttgtattttc

SEQ ID NO: 1092544 - DNA, 17 bp, Homo sapiens
agaagaaaacagtacag

SEQ ID NO: 1092545 - DNA, 19 bp, Homo sapiens
agaagaaaattgctgtgcc

SEQ ID NO: 1092546 - DNA, 22 bp, Homo sapiens
agaagaaactccgaagaaaaga

SEQ ID NO: 1092547 - DNA, 15 bp, Homo sapiens
agaagaaactttgcc

SEQ ID NO: 1092548 - DNA, 15 bp, Homo sapiens
agaagaaagatgttt

SEQ ID NO: 1092549 - DNA, 16 bp, Homo sapiens
agaagaaattaatata

SEQ ID NO: 1092550 - DNA, 16 bp, Homo sapiens
agaagaacaagaaatg

SEQ ID NO: 1092551 - DNA, 13 bp, Homo sapiens
agaagaacatcca

SEQ ID NO: 1092552 - DNA, 19 bp, Homo sapiens
agaagaaccaaatacctca

SEQ ID NO: 1092553 - DNA, 20 bp, Homo sapiens
agaagaaccaaatacctcaa

SEQ ID NO: 1092554 - DNA, 13 bp, Homo sapiens
agaagaaccattt

SEQ ID NO: 1092555 - DNA, 21 bp, Homo sapiens
agaagaactgtgtttcaagtt

SEQ ID NO: 1092556 - DNA, 19 bp, Homo sapiens
agaagaagtggctgccaca

SEQ ID NO: 1092557 - DNA, 15 bp, Homo sapiens
agaagaagtgggagc

SEQ ID NO: 1092558 - DNA, 16 bp, Homo sapiens
agaagaagtgggagca

SEQ ID NO: 1092559 - DNA, 16 bp, Homo sapiens
agaagaagtgtgagaa

SEQ ID NO: 1092560 - DNA, 15 bp, Homo sapiens
agaagaatatcaaat

SEQ ID NO: 1092561 - DNA, 19 bp, Homo sapiens
agaagaatatcaaataata

SEQ ID NO: 1092562 - DNA, 16 bp, Homo sapiens
agaagaatattcagga

SEQ ID NO: 1092563 - DNA, 18 bp, Homo sapiens
agaagaatattcaggact

SEQ ID NO: 1092564 - DNA, 14 bp, Homo sapiens
agaagaatattgta

SEQ ID NO: 1092565 - DNA, 22 bp, Homo sapiens
agaagaatattgtattgttaga

SEQ ID NO: 1092566 - DNA, 13 bp, Homo sapiens
agaagaatggctt

SEQ ID NO: 1092567 - DNA, 17 bp, Homo sapiens
agaagaattgaacccag

SEQ ID NO: 1092568 - DNA, 20 bp, Homo sapiens
agaagaattgaacccaggag

SEQ ID NO: 1092569 - DNA, 21 bp, Homo sapiens
agaagaattttatttttctgt

SEQ ID NO: 1092570 - DNA, 23 bp, Homo sapiens
agaagaattttcagaccccagcg

SEQ ID NO: 1092571 - DNA, 15 bp, Homo sapiens
agaagacaaaaagac

SEQ ID NO: 1092572 - DNA, 16 bp, Homo sapiens
agaagacaaactttgc

SEQ ID NO: 1092573 - DNA, 12 bp, Homo sapiens
agaagacactgc

SEQ ID NO: 1092574 - DNA, 14 bp, Homo sapiens
agaagacatggaga

SEQ ID NO: 1092575 - DNA, 19 bp, Homo sapiens
agaagactgggctagggag

SEQ ID NO: 1092576 - DNA, 19 bp, Homo sapiens
agaagactttaattatata

SEQ ID NO: 1092577 - DNA, 20 bp, Homo sapiens
agaagagaaatacagctggc

SEQ ID NO: 1092578 - DNA, 21 bp, Homo sapiens
agaagagaaatacagctggct

SEQ ID NO: 1092579 - DNA, 13 bp, Homo sapiens
agaagagaagctg

SEQ ID NO: 1092580 - DNA, 16 bp, Homo sapiens
agaagagaagctgctg

SEQ ID NO: 1092581 - DNA, 16 bp, Homo sapiens
agaagggctgcatgat

SEQ ID NO: 1092582 - DNA, 12 bp, Homo sapiens
agaaggggagct

SEQ ID NO: 1092583 - DNA, 21 bp, Homo sapiens
agaagggggagtgaaacagag

SEQ ID NO: 1092584 - DNA, 22 bp, Homo sapiens
agaagggggagtgaaacagaga

SEQ ID NO: 1092585 - DNA, 24 bp, Homo sapiens
agaagggggtggggcgggtctatg

SEQ ID NO: 1092586 - DNA, 17 bp, Homo sapiens
agaagggttcaggactt

SEQ ID NO: 1092587 - DNA, 21 bp, Homo sapiens
agaagggttctgccctgcctg

SEQ ID NO: 1092588 - DNA, 24 bp, Homo sapiens
agaagggttctgccctgcctgagg

SEQ ID NO: 1092589 - DNA, 21 bp, Homo sapiens
agaagggttttccaccctgga

SEQ ID NO: 1092590 - DNA, 23 bp, Homo sapiens
agaagggttttccaccctggaat

SEQ ID NO: 1092591 - DNA, 20 bp, Homo sapiens
agaaggtatcagttatatga

SEQ ID NO: 1092592 - DNA, 13 bp, Homo sapiens
agaaggtggggac

SEQ ID NO: 1092593 - DNA, 18 bp, Homo sapiens
agaaggttaccaagaagc

SEQ ID NO: 1092594 - DNA, 14 bp, Homo sapiens
agaagtaacttact

SEQ ID NO: 1092595 - DNA, 14 bp, Homo sapiens
agaagtaccagact

SEQ ID NO: 1092596 - DNA, 17 bp, Homo sapiens
agaagtagaaatcatag

SEQ ID NO: 1092597 - DNA, 19 bp, Homo sapiens
agaagtaggaggaaacagt

SEQ ID NO: 1092598 - DNA, 19 bp, Homo sapiens
agaagtaggggaagacatg

SEQ ID NO: 1092599 - DNA, 14 bp, Homo sapiens
agaagtatttttag

SEQ ID NO: 1092600 - DNA, 18 bp, Homo sapiens
agaagtcactgaacaaaa

SEQ ID NO: 1092601 - DNA, 17 bp, Homo sapiens
agaagtcagcctacata

SEQ ID NO: 1092602 - DNA, 16 bp, Homo sapiens
agaagtcatcttgcta

SEQ ID NO: 1092603 - DNA, 17 bp, Homo sapiens
agaagtcatgaagccca

SEQ ID NO: 1092604 - DNA, 22 bp, Homo sapiens
agaagtcctgctggatcttgcc

SEQ ID NO: 1092605 - DNA, 17 bp, Homo sapiens
agaagtccttatgttaa

SEQ ID NO: 1092606 - DNA, 22 bp, Homo sapiens
agaagtctcagctaagctcacg

SEQ ID NO: 1092607 - DNA, 13 bp, Homo sapiens
agaagtctcattc

SEQ ID NO: 1092608 - DNA, 15 bp, Homo sapiens
agaagtctggctttg

SEQ ID NO: 1092609 - DNA, 13 bp, Homo sapiens
agaagtcttgaag

SEQ ID NO: 1092610 - DNA, 22 bp, Homo sapiens
agaagtctttcagtggaattgt

SEQ ID NO: 1092611 - DNA, 14 bp, Homo sapiens
agaagtgagccccc

SEQ ID NO: 1092612 - DNA, 19 bp, Homo sapiens
agaagtgagtttgtaaata

SEQ ID NO: 1092613 - DNA, 11 bp, Homo sapiens
agaagtgattt

SEQ ID NO: 1092614 - DNA, 16 bp, Homo sapiens
agaagtgcccctgctg

SEQ ID NO: 1092615 - DNA, 17 bp, Homo sapiens
agaagtggaccaggaca

SEQ ID NO: 1092616 - DNA, 18 bp, Homo sapiens
agaagtgggagcagcttc

SEQ ID NO: 1092617 - DNA, 19 bp, Homo sapiens
agaagtgggccaggacagg

SEQ ID NO: 1092618 - DNA, 20 bp, Homo sapiens
agaagtgggggcagcccagg

SEQ ID NO: 1092619 - DNA, 21 bp, Homo sapiens
agaagtgtcaccctgtgggtg

SEQ ID NO: 1092620 - DNA, 22 bp, Homo sapiens
agaagtgtggggattttcactg

SEQ ID NO: 1092621 - DNA, 23 bp, Homo sapiens
agaagtgtttcagattttttaaa

SEQ ID NO: 1092622 - DNA, 15 bp, Homo sapiens
agaagttagtttgta

SEQ ID NO: 1092623 - DNA, 23 bp, Homo sapiens
agaagttattttctacagtggtt

SEQ ID NO: 1092624 - DNA, 16 bp, Homo sapiens
agaagttctagtgttt

SEQ ID NO: 1092625 - DNA, 21 bp, Homo sapiens
agaagttgtaaagtatgtatt

SEQ ID NO: 1092626 - DNA, 13 bp, Homo sapiens
agaagttgtttga

SEQ ID NO: 1092627 - DNA, 15 bp, Homo sapiens
agaagtttaaggaat

SEQ ID NO: 1092628 - DNA, 16 bp, Homo sapiens
agaagtttaaggaata

SEQ ID NO: 1092629 - DNA, 17 bp, Homo sapiens
agaagtttaaggaatat

SEQ ID NO: 1092630 - DNA, 21 bp, Homo sapiens
agaagtttcagttgtccttaa

SEQ ID NO: 1092631 - DNA, 21 bp, Homo sapiens
agaagtttcatcattttttac

SEQ ID NO: 1092632 - DNA, 23 bp, Homo sapiens
agaagtttctggccctggctgac

SEQ ID NO: 1092633 - DNA, 19 bp, Homo sapiens
agaagtttctttaaagacg

SEQ ID NO: 1092634 - DNA, 16 bp, Homo sapiens
agaagtttgtagccag

SEQ ID NO: 1092635 - DNA, 18 bp, Homo sapiens
agaagtttgtagccaggt

SEQ ID NO: 1092636 - DNA, 13 bp, Homo sapiens
agaagtttgtgtc

SEQ ID NO: 1092637 - DNA, 15 bp, Homo sapiens
agaataaaagctata

SEQ ID NO: 1092638 - DNA, 19 bp, Homo sapiens
agaataaaagctataaagt

SEQ ID NO: 1092639 - DNA, 17 bp, Homo sapiens
agaataaaagttcctct

SEQ ID NO: 1092640 - DNA, 14 bp, Homo sapiens
agaataaaatgttg

SEQ ID NO: 1092641 - DNA, 14 bp, Homo sapiens
agaataaaattcct

SEQ ID NO: 1092642 - DNA, 18 bp, Homo sapiens
agaataaaggcagttttc

SEQ ID NO: 1092643 - DNA, 15 bp, Homo sapiens
agaataaatttggga

SEQ ID NO: 1092644 - DNA, 16 bp, Homo sapiens
agaataacctttcaga

SEQ ID NO: 1092645 - DNA, 13 bp, Homo sapiens
agaataagaattt

SEQ ID NO: 1092646 - DNA, 16 bp, Homo sapiens
agaataagaatttgca

SEQ ID NO: 1092647 - DNA, 15 bp, Homo sapiens
agaataagtgtcttt

SEQ ID NO: 1092648 - DNA, 13 bp, Homo sapiens
agaataagttatt

SEQ ID NO: 1092649 - DNA, 14 bp, Homo sapiens
agaataagttattg

SEQ ID NO: 1092650 - DNA, 21 bp, Homo sapiens
agaataagttattgcagttta

SEQ ID NO: 1092651 - DNA, 23 bp, Homo sapiens
agaataatatgctgccaaatttt

SEQ ID NO: 1092652 - DNA, 21 bp, Homo sapiens
agaataatcacgctttcctga

SEQ ID NO: 1092653 - DNA, 22 bp, Homo sapiens
agaataatccagtattgctgat

SEQ ID NO: 1092654 - DNA, 14 bp, Homo sapiens
agaataatctatta

SEQ ID NO: 1092655 - DNA, 20 bp, Homo sapiens
agaataatctcatcccccca

SEQ ID NO: 1092656 - DNA, 13 bp, Homo sapiens
agaataatctttg

SEQ ID NO: 1092657 - DNA, 15 bp, Homo sapiens
agaataatgaatgga

SEQ ID NO: 1092658 - DNA, 15 bp, Homo sapiens
agaataatggaaaca

SEQ ID NO: 1092659 - DNA, 16 bp, Homo sapiens
agaataatggaaacat

SEQ ID NO: 1092660 - DNA, 17 bp, Homo sapiens
agaataatggaaacatt

SEQ ID NO: 1092661 - DNA, 23 bp, Homo sapiens
agaataatggaaacattacagtt

SEQ ID NO: 1092662 - DNA, 12 bp, Homo sapiens
agaatacagaaa

SEQ ID NO: 1092663 - DNA, 15 bp, Homo sapiens
agaatacatgtaagt

SEQ ID NO: 1092664 - DNA, 19 bp, Homo sapiens
agaatacttctcatttttt

SEQ ID NO: 1092665 - DNA, 15 bp, Homo sapiens
agaatacttgcactc

SEQ ID NO: 1092666 - DNA, 17 bp, Homo sapiens
agaatactttgcttcat

SEQ ID NO: 1092667 - DNA, 13 bp, Homo sapiens
agaatagaaacaa

SEQ ID NO: 1092668 - DNA, 17 bp, Homo sapiens
agaatagaacacagttt

SEQ ID NO: 1092669 - DNA, 17 bp, Homo sapiens
agaatagagctgccact

SEQ ID NO: 1092670 - DNA, 23 bp, Homo sapiens
agaatagatctgatggtgagctg

SEQ ID NO: 1092671 - DNA, 15 bp, Homo sapiens
agaataggaaaacat

SEQ ID NO: 1092672 - DNA, 18 bp, Homo sapiens
agaataggcattaacaca

SEQ ID NO: 1092673 - DNA, 19 bp, Homo sapiens
agaataggcattaacacaa

SEQ ID NO: 1092674 - DNA, 22 bp, Homo sapiens
agaatagtgcctaaagtgctgc

SEQ ID NO: 1092675 - DNA, 18 bp, Homo sapiens
agaatagtttgaaataga

SEQ ID NO: 1092676 - DNA, 16 bp, Homo sapiens
agaatataaaaaactt

SEQ ID NO: 1092677 - DNA, 14 bp, Homo sapiens
agaatataattatc

SEQ ID NO: 1092678 - DNA, 23 bp, Homo sapiens
agaatataattatcggaagcagt

SEQ ID NO: 1092679 - DNA, 19 bp, Homo sapiens
agaatataccttatttatt

SEQ ID NO: 1092680 - DNA, 19 bp, Homo sapiens
agaatatagaagcatttga

SEQ ID NO: 1092681 - DNA, 15 bp, Homo sapiens
agaatatgtttcctt

SEQ ID NO: 1092682 - DNA, 18 bp, Homo sapiens
agaatatgtttccttgtt

SEQ ID NO: 1092683 - DNA, 16 bp, Homo sapiens
agaatattgcaaaata

SEQ ID NO: 1092684 - DNA, 22 bp, Homo sapiens
agaatattgcaaaatacatgaa

SEQ ID NO: 1092685 - DNA, 18 bp, Homo sapiens
agaatattgtattgttag

SEQ ID NO: 1092686 - DNA, 12 bp, Homo sapiens
agaatattgtcc

SEQ ID NO: 1092687 - DNA, 11 bp, Homo sapiens
agaatatttat

SEQ ID NO: 1092688 - DNA, 19 bp, Homo sapiens
agaatatttattacctctg

SEQ ID NO: 1092689 - DNA, 14 bp, Homo sapiens
agaatattttaagt

SEQ ID NO: 1092690 - DNA, 20 bp, Homo sapiens
agaatattttaagtattgca

SEQ ID NO: 1092691 - DNA, 22 bp, Homo sapiens
agaatatttttatatttccttt

SEQ ID NO: 1092692 - DNA, 14 bp, Homo sapiens
agaatcaaaactct

SEQ ID NO: 1092693 - DNA, 14 bp, Homo sapiens
agaatcaaacattt

SEQ ID NO: 1092694 - DNA, 20 bp, Homo sapiens
agaatcacggtggtaaagaa

SEQ ID NO: 1092695 - DNA, 21 bp, Homo sapiens
agaatcacttaagcctggaag

SEQ ID NO: 1092696 - DNA, 17 bp, Homo sapiens
agaatcagaagatagtc

SEQ ID NO: 1092697 - DNA, 20 bp, Homo sapiens
agaatcagaatcatggagaa

SEQ ID NO: 1092698 - DNA, 17 bp, Homo sapiens
agaatcaggagagggat

SEQ ID NO: 1092699 - DNA, 22 bp, Homo sapiens
agaatcatacttaacatttcat

SEQ ID NO: 1092700 - DNA, 17 bp, Homo sapiens
agaatcatatgattctg

SEQ ID NO: 1092701 - DNA, 14 bp, Homo sapiens
agaatcatggagaa

SEQ ID NO: 1092702 - DNA, 12 bp, Homo sapiens
agaatccaaact

SEQ ID NO: 1092703 - DNA, 19 bp, Homo sapiens
agaattctccaaaacaatt

SEQ ID NO: 1092704 - DNA, 14 bp, Homo sapiens
agaattctctagtt

SEQ ID NO: 1092705 - DNA, 17 bp, Homo sapiens
agaattcttcaggtgga

SEQ ID NO: 1092706 - DNA, 14 bp, Homo sapiens
agaattgaaaatgc

SEQ ID NO: 1092707 - DNA, 17 bp, Homo sapiens
agaattgaacccaggag

SEQ ID NO: 1092708 - DNA, 17 bp, Homo sapiens
agaattgacattgaaat

SEQ ID NO: 1092709 - DNA, 16 bp, Homo sapiens
agaattgactgcagtt

SEQ ID NO: 1092710 - DNA, 17 bp, Homo sapiens
agaattgactgcagttg

SEQ ID NO: 1092711 - DNA, 17 bp, Homo sapiens
agaattgagtgtttaaa

SEQ ID NO: 1092712 - DNA, 20 bp, Homo sapiens
agaattgatatacacggatg

SEQ ID NO: 1092713 - DNA, 22 bp, Homo sapiens
agaattgatcattttcccccca

SEQ ID NO: 1092714 - DNA, 18 bp, Homo sapiens
agaattggcataatttgt

SEQ ID NO: 1092715 - DNA, 20 bp, Homo sapiens
agaattggccatcttaaaaa

SEQ ID NO: 1092716 - DNA, 18 bp, Homo sapiens
agaattggggattctcta

SEQ ID NO: 1092717 - DNA, 19 bp, Homo sapiens
agaattgtctctgggctga

SEQ ID NO: 1092718 - DNA, 20 bp, Homo sapiens
agaattgtgtcagactgttt

SEQ ID NO: 1092719 - DNA, 19 bp, Homo sapiens
agaattgtgtgttaatgtc

SEQ ID NO: 1092720 - DNA, 16 bp, Homo sapiens
agaattgttgagatac

SEQ ID NO: 1092721 - DNA, 21 bp, Homo sapiens
agaatttaatggactgtgaat

SEQ ID NO: 1092722 - DNA, 22 bp, Homo sapiens
agaatttagggagaaatgttgt

SEQ ID NO: 1092723 - DNA, 18 bp, Homo sapiens
agaatttattagtttaaa

SEQ ID NO: 1092724 - DNA, 13 bp, Homo sapiens
agaatttattcaa

SEQ ID NO: 1092725 - DNA, 14 bp, Homo sapiens
agaatttattcaat

SEQ ID NO: 1092726 - DNA, 21 bp, Homo sapiens
agaatttattcaattcctctg

SEQ ID NO: 1092727 - DNA, 20 bp, Homo sapiens
agaatttcaatgtccagtga

SEQ ID NO: 1092728 - DNA, 14 bp, Homo sapiens
agaatttctaaagt

SEQ ID NO: 1092729 - DNA, 13 bp, Homo sapiens
agaatttcttggt

SEQ ID NO: 1092730 - DNA, 22 bp, Homo sapiens
agaatttcttggtaagaagccg

SEQ ID NO: 1092731 - DNA, 17 bp, Homo sapiens
agaatttgagtgctctg

SEQ ID NO: 1092732 - DNA, 12 bp, Homo sapiens
agaatttgcata

SEQ ID NO: 1092733 - DNA, 16 bp, Homo sapiens
agaatttggaaatcct

SEQ ID NO: 1092734 - DNA, 22 bp, Homo sapiens
agaatttggaaatcctagtttc

SEQ ID NO: 1092735 - DNA, 19 bp, Homo sapiens
agaatttgtgttgaaggaa

SEQ ID NO: 1092736 - DNA, 23 bp, Homo sapiens
agaatttgtgttgaaggaacttg

SEQ ID NO: 1092737 - DNA, 21 bp, Homo sapiens
agaattttaagtgctttgtaa

SEQ ID NO: 1092738 - DNA, 22 bp, Homo sapiens
agaattttaagtgctttgtaat

SEQ ID NO: 1092739 - DNA, 16 bp, Homo sapiens
agaattttaatgtgaa

SEQ ID NO: 1092740 - DNA, 19 bp, Homo sapiens
agaattttaatgtgaagac

SEQ ID NO: 1092741 - DNA, 20 bp, Homo sapiens
agaattttaggaacttcaga

SEQ ID NO: 1092742 - DNA, 21 bp, Homo sapiens
agaattttcagaccccagcgg

SEQ ID NO: 1092743 - DNA, 22 bp, Homo sapiens
agaattttcatcccgtatcaca

SEQ ID NO: 1092744 - DNA, 22 bp, Homo sapiens
agaattttgtatattgtaggaa

SEQ ID NO: 1092745 - DNA, 22 bp, Homo sapiens
agaatttttgtttggactgttt

SEQ ID NO: 1092746 - DNA, 16 bp, Homo sapiens
agacaaaaacagcctc

SEQ ID NO: 1092747 - DNA, 20 bp, Homo sapiens
agacaaaaagccttgaagaa

SEQ ID NO: 1092748 - DNA, 21 bp, Homo sapiens
agacaaaacttcctgtttgtg

SEQ ID NO: 1092749 - DNA, 15 bp, Homo sapiens
agacaaaaggaaagg

SEQ ID NO: 1092750 - DNA, 22 bp, Homo sapiens
agacaaaagtctgtctttcctg

SEQ ID NO: 1092751 - DNA, 15 bp, Homo sapiens
agacaaaatttgaga

SEQ ID NO: 1092752 - DNA, 23 bp, Homo sapiens
agacaaaatttgagaatacataa

SEQ ID NO: 1092753 - DNA, 19 bp, Homo sapiens
agacaaacacctcccagga

SEQ ID NO: 1092754 - DNA, 21 bp, Homo sapiens
agacaaactttgcatctcagt

SEQ ID NO: 1092755 - DNA, 18 bp, Homo sapiens
agacaaagcaggagtgga

SEQ ID NO: 1092756 - DNA, 19 bp, Homo sapiens
agacaaagcggctttctaa

SEQ ID NO: 1092757 - DNA, 18 bp, Homo sapiens
agacaaaggttttcctct

SEQ ID NO: 1092758 - DNA, 22 bp, Homo sapiens
agacaaagtcaataaaagagct

SEQ ID NO: 1092759 - DNA, 23 bp, Homo sapiens
agacaaagtcaataaaagagctg

SEQ ID NO: 1092760 - DNA, 23 bp, Homo sapiens
agacaaagtcccagaattgtatc

SEQ ID NO: 1092761 - DNA, 14 bp, Homo sapiens
agacaaagtgggtg

SEQ ID NO: 1092762 - DNA, 12 bp, Homo sapiens
agacaaatattt

SEQ ID NO: 1092763 - DNA, 15 bp, Homo sapiens
agacaaatatttgga

SEQ ID NO: 1092764 - DNA, 18 bp, Homo sapiens
agacaaatctcagaacct

SEQ ID NO: 1092765 - DNA, 18 bp, Homo sapiens
agacaaatggaggaatat

SEQ ID NO: 1092766 - DNA, 17 bp, Homo sapiens
agacaaattctgtttct

SEQ ID NO: 1092767 - DNA, 14 bp, Homo sapiens
agacaaatttaaag

SEQ ID NO: 1092768 - DNA, 13 bp, Homo sapiens
agacaacagccca

SEQ ID NO: 1092769 - DNA, 15 bp, Homo sapiens
agacaacagcccagg

SEQ ID NO: 1092770 - DNA, 16 bp, Homo sapiens
agacaacagcccaggc

SEQ ID NO: 1092771 - DNA, 19 bp, Homo sapiens
agacaacaggtaaaacagg

SEQ ID NO: 1092772 - DNA, 13 bp, Homo sapiens
agacaaccaaaac

SEQ ID NO: 1092773 - DNA, 21 bp, Homo sapiens
agacaacgggcccatggcctt

SEQ ID NO: 1092774 - DNA, 13 bp, Homo sapiens
agacaagaaatcc

SEQ ID NO: 1092775 - DNA, 19 bp, Homo sapiens
agacaagacttcagtatgt

SEQ ID NO: 1092776 - DNA, 21 bp, Homo sapiens
agacaagacttcagtatgttg

SEQ ID NO: 1092777 - DNA, 18 bp, Homo sapiens
agacaagatattgtacat

SEQ ID NO: 1092778 - DNA, 19 bp, Homo sapiens
agacaagatattgtacata

SEQ ID NO: 1092779 - DNA, 20 bp, Homo sapiens
agacaagattttttaattgt

SEQ ID NO: 1092780 - DNA, 21 bp, Homo sapiens
agacaagattttttaattgtt

SEQ ID NO: 1092781 - DNA, 18 bp, Homo sapiens
agacaagcactattttat

SEQ ID NO: 1092782 - DNA, 20 bp, Homo sapiens
agacaagcactattttatat

SEQ ID NO: 1092783 - DNA, 12 bp, Homo sapiens
agacaagccctg

SEQ ID NO: 1092784 - DNA, 17 bp, Homo sapiens
agacaagccctggcaac

SEQ ID NO: 1092785 - DNA, 23 bp, Homo sapiens
agacaaggctggcaaaccctccc

SEQ ID NO: 1092786 - DNA, 15 bp, Homo sapiens
agacaagtaatttca

SEQ ID NO: 1092787 - DNA, 22 bp, Homo sapiens
agacaagtaatttcagtgtaaa

SEQ ID NO: 1092788 - DNA, 22 bp, Homo sapiens
agacaagtgactgtatctgtgt

SEQ ID NO: 1092789 - DNA, 11 bp, Homo sapiens
agacaatatac

SEQ ID NO: 1092790 - DNA, 20 bp, Homo sapiens
agacaatccccacataccat

SEQ ID NO: 1092791 - DNA, 21 bp, Homo sapiens
agacaatgacttactgtacat

SEQ ID NO: 1092792 - DNA, 22 bp, Homo sapiens
agacaatgacttactgtacatg

SEQ ID NO: 1092793 - DNA, 20 bp, Homo sapiens
agacaatgtgaaaagaaaaa

SEQ ID NO: 1092794 - DNA, 14 bp, Homo sapiens
agacaatttattat

SEQ ID NO: 1092795 - DNA, 22 bp, Homo sapiens
agacaatttgatacataataaa

SEQ ID NO: 1092796 - DNA, 23 bp, Homo sapiens
agacaatttgatacataataaaa

SEQ ID NO: 1092797 - DNA, 10 bp, Homo sapiens
agacacacac

SEQ ID NO: 1092798 - DNA, 16 bp, Homo sapiens
agacacacacacgcac

SEQ ID NO: 1092799 - DNA, 18 bp, Homo sapiens
agacacacacacgcacgc

SEQ ID NO: 1092800 - DNA, 23 bp, Homo sapiens
agacacacacacgcacgcacaca

SEQ ID NO: 1092801 - DNA, 13 bp, Homo sapiens
agacacacctgag

SEQ ID NO: 1092802 - DNA, 14 bp, Homo sapiens
agacacagaacaca

SEQ ID NO: 1092803 - DNA, 16 bp, Homo sapiens
agacacagaacacaga

SEQ ID NO: 1092804 - DNA, 16 bp, Homo sapiens
agacacagactggcaa

SEQ ID NO: 1092805 - DNA, 12 bp, Homo sapiens
agacacagctct

SEQ ID NO: 1092806 - DNA, 14 bp, Homo sapiens
agacacagctcttc

SEQ ID NO: 1092807 - DNA, 22 bp, Homo sapiens
agacacagctcttccagggcag

SEQ ID NO: 1092808 - DNA, 16 bp, Homo sapiens
agacacatatgagggg

SEQ ID NO: 1092809 - DNA, 17 bp, Homo sapiens
agacacatcaaatgccc

SEQ ID NO: 1092810 - DNA, 13 bp, Homo sapiens
agacacatgaagg

SEQ ID NO: 1092811 - DNA, 19 bp, Homo sapiens
agacacatgaaggtaaata

SEQ ID NO: 1092812 - DNA, 20 bp, Homo sapiens
agacacatgaaggtaaataa

SEQ ID NO: 1092813 - DNA, 14 bp, Homo sapiens
agacacattgcctt

SEQ ID NO: 1092814 - DNA, 16 bp, Homo sapiens
agacacattgccttct

SEQ ID NO: 1092815 - DNA, 19 bp, Homo sapiens
agacacctccccctaccca

SEQ ID NO: 1092816 - DNA, 17 bp, Homo sapiens
agacacctgcacctccc

SEQ ID NO: 1092817 - DNA, 21 bp, Homo sapiens
agacacctgcacctcccccca

SEQ ID NO: 1092818 - DNA, 13 bp, Homo sapiens
agacacctggact

SEQ ID NO: 1092819 - DNA, 17 bp, Homo sapiens
agacacctggactgagc

SEQ ID NO: 1092820 - DNA, 15 bp, Homo sapiens
agacacgcacggcag

SEQ ID NO: 1092821 - DNA, 21 bp, Homo sapiens
agacacgctggcgacacactc

SEQ ID NO: 1092822 - DNA, 18 bp, Homo sapiens
agacacggatctgagaat

SEQ ID NO: 1092823 - DNA, 20 bp, Homo sapiens
agacacggatctgagaatct

SEQ ID NO: 1092824 - DNA, 21 bp, Homo sapiens
agacacggatctgagaatctt

SEQ ID NO: 1092825 - DNA, 14 bp, Homo sapiens
agacactaactttg

SEQ ID NO: 1092826 - DNA, 22 bp, Homo sapiens
agacactccccgaagtcttttg

SEQ ID NO: 1092827 - DNA, 12 bp, Homo sapiens
agacactctgct

SEQ ID NO: 1092828 - DNA, 14 bp, Homo sapiens
agacactctgctct

SEQ ID NO: 1092829 - DNA, 15 bp, Homo sapiens
agacactctgctctg

SEQ ID NO: 1092830 - DNA, 19 bp, Homo sapiens
agacactgaccatccactc

SEQ ID NO: 1092831 - DNA, 15 bp, Homo sapiens
agacactgagtcaga

SEQ ID NO: 1092832 - DNA, 15 bp, Homo sapiens
agacactgcacagaa

SEQ ID NO: 1092833 - DNA, 20 bp, Homo sapiens
agacactgccgacatcagca

SEQ ID NO: 1092834 - DNA, 13 bp, Homo sapiens
agacactggacat

SEQ ID NO: 1092835 - DNA, 14 bp, Homo sapiens
agacactggacatg

SEQ ID NO: 1092836 - DNA, 20 bp, Homo sapiens
agacactggtttacacttta

SEQ ID NO: 1092837 - DNA, 23 bp, Homo sapiens
agacactgtgagagttgtctctg

SEQ ID NO: 1092838 - DNA, 18 bp, Homo sapiens
agacactgtttacaagaa

SEQ ID NO: 1092839 - DNA, 19 bp, Homo sapiens
agacactgtttacaagaaa

SEQ ID NO: 1092840 - DNA, 16 bp, Homo sapiens
agacacttatattttg

SEQ ID NO: 1092841 - DNA, 22 bp, Homo sapiens
agacacttatattttgatttta

SEQ ID NO: 1092842 - DNA, 13 bp, Homo sapiens
agacacttcagat

SEQ ID NO: 1092843 - DNA, 14 bp, Homo sapiens
agacacttcccctt

SEQ ID NO: 1092844 - DNA, 23 bp, Homo sapiens
agacacttccccttgtctccctg

SEQ ID NO: 1092845 - DNA, 13 bp, Homo sapiens
agacacttgcctt

SEQ ID NO: 1092846 - DNA, 17 bp, Homo sapiens
agacacttgctcccaac

SEQ ID NO: 1092847 - DNA, 15 bp, Homo sapiens
agacactttggaagt

SEQ ID NO: 1092848 - DNA, 12 bp, Homo sapiens
agacagaaaagt

SEQ ID NO: 1092849 - DNA, 13 bp, Homo sapiens
agacagaaaagtg

SEQ ID NO: 1092850 - DNA, 15 bp, Homo sapiens
agacagaaactggat

SEQ ID NO: 1092851 - DNA, 12 bp, Homo sapiens
agacagaacacc

SEQ ID NO: 1092852 - DNA, 17 bp, Homo sapiens
agacagaagtctcctca

SEQ ID NO: 1092853 - DNA, 21 bp, Homo sapiens
agacagaatgtatctgtgaag

SEQ ID NO: 1092854 - DNA, 14 bp, Homo sapiens
agacagacacacac

SEQ ID NO: 1092855 - DNA, 15 bp, Homo sapiens
agacagacacacaca

SEQ ID NO: 1092856 - DNA, 14 bp, Homo sapiens
agacagacacacag

SEQ ID NO: 1092857 - DNA, 19 bp, Homo sapiens
agacagacacacagcctca

SEQ ID NO: 1092858 - DNA, 16 bp, Homo sapiens
agacagaccacttgcc

SEQ ID NO: 1092859 - DNA, 19 bp, Homo sapiens
agacagacccagtgagtga

SEQ ID NO: 1092860 - DNA, 15 bp, Homo sapiens
agacagacttgagaa

SEQ ID NO: 1092861 - DNA, 17 bp, Homo sapiens
agacagagacaagtaat

SEQ ID NO: 1092862 - DNA, 18 bp, Homo sapiens
agacagagacgcaggaat

SEQ ID NO: 1092863 - DNA, 15 bp, Homo sapiens
agacagagaggactg

SEQ ID NO: 1092864 - DNA, 13 bp, Homo sapiens
agacagagccagg

SEQ ID NO: 1092865 - DNA, 14 bp, Homo sapiens
agacagagccagga

SEQ ID NO: 1092866 - DNA, 18 bp, Homo sapiens
agacagaggaaagggctg

SEQ ID NO: 1092867 - DNA, 20 bp, Homo sapiens
agacagaggaaagggctggc

SEQ ID NO: 1092868 - DNA, 19 bp, Homo sapiens
agacagatcactcctggag

SEQ ID NO: 1092869 - DNA, 14 bp, Homo sapiens
agacagatgcccca

SEQ ID NO: 1092870 - DNA, 15 bp, Homo sapiens
agacagatgccccag

SEQ ID NO: 1092871 - DNA, 19 bp, Homo sapiens
agacagatgccccagagct

SEQ ID NO: 1092872 - DNA, 22 bp, Homo sapiens
agacagatggacactgccaaga

SEQ ID NO: 1092873 - DNA, 15 bp, Homo sapiens
agacagcaccactgc

SEQ ID NO: 1092874 - DNA, 17 bp, Homo sapiens
agacagcaccactgctg

SEQ ID NO: 1092875 - DNA, 14 bp, Homo sapiens
agacagcagctcag

SEQ ID NO: 1092876 - DNA, 16 bp, Homo sapiens
agacagcagctcaggc

SEQ ID NO: 1092877 - DNA, 17 bp, Homo sapiens
agacagcccaggatact

SEQ ID NO: 1092878 - DNA, 11 bp, Homo sapiens
agacagcctct

SEQ ID NO: 1092879 - DNA, 19 bp, Homo sapiens
agacagctgatacttcatt

SEQ ID NO: 1092880 - DNA, 18 bp, Homo sapiens
agacagcttctctgcagt

SEQ ID NO: 1092881 - DNA, 13 bp, Homo sapiens
agacagcttttta

SEQ ID NO: 1092882 - DNA, 21 bp, Homo sapiens
agacaggaaaatcctctggct

SEQ ID NO: 1092883 - DNA, 15 bp, Homo sapiens
agacaggaacccttg

SEQ ID NO: 1092884 - DNA, 14 bp, Homo sapiens
agacaggacagaat

SEQ ID NO: 1092885 - DNA, 16 bp, Homo sapiens
agacaggacagaatgt

SEQ ID NO: 1092886 - DNA, 22 bp, Homo sapiens
agacaggacagaatgtgttctt

SEQ ID NO: 1092887 - DNA, 15 bp, Homo sapiens
agacaggagcctagc

SEQ ID NO: 1092888 - DNA, 18 bp, Homo sapiens
agacaggcagcccagcag

SEQ ID NO: 1092889 - DNA, 15 bp, Homo sapiens
agacaggctcttagc

SEQ ID NO: 1092890 - DNA, 23 bp, Homo sapiens
agacagggtctcactctgtcgct

SEQ ID NO: 1092891 - DNA, 19 bp, Homo sapiens
agacagggtctgaaggact

SEQ ID NO: 1092892 - DNA, 23 bp, Homo sapiens
agacagggtgctgatgggaagga

SEQ ID NO: 1092893 - DNA, 18 bp, Homo sapiens
agacagggtgggcttcct

SEQ ID NO: 1092894 - DNA, 20 bp, Homo sapiens
agacagggtgggcttcctgc

SEQ ID NO: 1092895 - DNA, 22 bp, Homo sapiens
agacagggtgggcttcctgccc

SEQ ID NO: 1092896 - DNA, 18 bp, Homo sapiens
agacaggtttaaaagttg

SEQ ID NO: 1092897 - DNA, 17 bp, Homo sapiens
agacagtctggaaagtg

SEQ ID NO: 1092898 - DNA, 20 bp, Homo sapiens
agacagtctgttatgcactg

SEQ ID NO: 1092899 - DNA, 21 bp, Homo sapiens
agacagtctgttatgcactgt

SEQ ID NO: 1092900 - DNA, 12 bp, Homo sapiens
agacagtcttgc

SEQ ID NO: 1092901 - DNA, 15 bp, Homo sapiens
agacagtgatctcca

SEQ ID NO: 1092902 - DNA, 18 bp, Homo sapiens
agacagtggatatgaccc

SEQ ID NO: 1092903 - DNA, 20 bp, Homo sapiens
agacagtggtagagaggttt

SEQ ID NO: 1092904 - DNA, 13 bp, Homo sapiens
agacagtggttct

SEQ ID NO: 1092905 - DNA, 11 bp, Homo sapiens
agacagtgtac

SEQ ID NO: 1092906 - DNA, 13 bp, Homo sapiens
agacataaaactt

SEQ ID NO: 1092907 - DNA, 21 bp, Homo sapiens
agacataaaactttaaaaggc

SEQ ID NO: 1092908 - DNA, 20 bp, Homo sapiens
agacatatccaaagggaata

SEQ ID NO: 1092909 - DNA, 23 bp, Homo sapiens
agacatatgggatattcccaagc

SEQ ID NO: 1092910 - DNA, 15 bp, Homo sapiens
agacatatttaactg

SEQ ID NO: 1092911 - DNA, 14 bp, Homo sapiens
agacatcagtctcc

SEQ ID NO: 1092912 - DNA, 23 bp, Homo sapiens
agacatcagtctccaacatgttt

SEQ ID NO: 1092913 - DNA, 15 bp, Homo sapiens
agacatccataaaga

SEQ ID NO: 1092914 - DNA, 22 bp, Homo sapiens
agacatccataaagaagcaata

SEQ ID NO: 1092915 - DNA, 17 bp, Homo sapiens
agacatctccagtgtgc

SEQ ID NO: 1092916 - DNA, 14 bp, Homo sapiens
agacatctctgcac

SEQ ID NO: 1092917 - DNA, 14 bp, Homo sapiens
agacatctctggag

SEQ ID NO: 1092918 - DNA, 18 bp, Homo sapiens
agacatctctggagccag

SEQ ID NO: 1092919 - DNA, 13 bp, Homo sapiens
agacatctgcctg

SEQ ID NO: 1092920 - DNA, 12 bp, Homo sapiens
agacatcttcag

SEQ ID NO: 1092921 - DNA, 12 bp, Homo sapiens
agacatgaatac

SEQ ID NO: 1092922 - DNA, 13 bp, Homo sapiens
agacatgaatact

SEQ ID NO: 1092923 - DNA, 17 bp, Homo sapiens
agacatgaatgcacact

SEQ ID NO: 1092924 - DNA, 17 bp, Homo sapiens
agacatgcccaaaactt

SEQ ID NO: 1092925 - DNA, 17 bp, Homo sapiens
agacatgcttacttttt

SEQ ID NO: 1092926 - DNA, 13 bp, Homo sapiens
agacatggagact

SEQ ID NO: 1092927 - DNA, 21 bp, Homo sapiens
agacatgggatccaattttaa

SEQ ID NO: 1092928 - DNA, 19 bp, Homo sapiens
agacatgtaggtgtttgtt

SEQ ID NO: 1092929 - DNA, 13 bp, Homo sapiens
agacatgtgacat

SEQ ID NO: 1092930 - DNA, 15 bp, Homo sapiens
agacatgtgacattt

SEQ ID NO: 1092931 - DNA, 17 bp, Homo sapiens
agacatgtgaggaggaa

SEQ ID NO: 1092932 - DNA, 19 bp, Homo sapiens
agacatgtgaggaggaaaa

SEQ ID NO: 1092933 - DNA, 20 bp, Homo sapiens
agacatgtgaggaggaaaag

SEQ ID NO: 1092934 - DNA, 21 bp, Homo sapiens
agacatgtgaggaggaaaagg

SEQ ID NO: 1092935 - DNA, 20 bp, Homo sapiens
agacattctcgcttccctga

SEQ ID NO: 1092936 - DNA, 21 bp, Homo sapiens
agacattctcgcttccctgaa

SEQ ID NO: 1092937 - DNA, 22 bp, Homo sapiens
agacattgctctatgtctgcct

SEQ ID NO: 1092938 - DNA, 23 bp, Homo sapiens
agacatttatactcttttttcat

SEQ ID NO: 1092939 - DNA, 13 bp, Homo sapiens
agacatttcaaaa

SEQ ID NO: 1092940 - DNA, 15 bp, Homo sapiens
agacatttgtttgct

SEQ ID NO: 1092941 - DNA, 21 bp, Homo sapiens
agacatttgtttgctgtacag

SEQ ID NO: 1092942 - DNA, 19 bp, Homo sapiens
agacattttaaaaaatggt

SEQ ID NO: 1092943 - DNA, 20 bp, Homo sapiens
agacattttaaaaaatggtc

SEQ ID NO: 1092944 - DNA, 15 bp, Homo sapiens
agacattttaagttt

SEQ ID NO: 1092945 - DNA, 21 bp, Homo sapiens
agacattttaagtttgtagta

SEQ ID NO: 1092946 - DNA, 14 bp, Homo sapiens
agacatttttgtgc

SEQ ID NO: 1092947 - DNA, 15 bp, Homo sapiens
agactctaggttata

SEQ ID NO: 1092948 - DNA, 17 bp, Homo sapiens
agactctaggttataca

SEQ ID NO: 1092949 - DNA, 21 bp, Homo sapiens
agactctaggttatacaataa

SEQ ID NO: 1092950 - DNA, 16 bp, Homo sapiens
agactctgaaatctca

SEQ ID NO: 1092951 - DNA, 16 bp, Homo sapiens
agactctgagccaagg

SEQ ID NO: 1092952 - DNA, 21 bp, Homo sapiens
agactctgagccaagggaggg

SEQ ID NO: 1092953 - DNA, 21 bp, Homo sapiens
agactctgggtccctcggagc

SEQ ID NO: 1092954 - DNA, 14 bp, Homo sapiens
agactctggtcttc

SEQ ID NO: 1092955 - DNA, 13 bp, Homo sapiens
agactctggtgtt

SEQ ID NO: 1092956 - DNA, 18 bp, Homo sapiens
agactctgtctcaaaaaa

SEQ ID NO: 1092957 - DNA, 18 bp, Homo sapiens
agactcttgcctgtttcc

SEQ ID NO: 1092958 - DNA, 20 bp, Homo sapiens
agactctttaataaattgct

SEQ ID NO: 1092959 - DNA, 23 bp, Homo sapiens
agactctttatttttctctttct

SEQ ID NO: 1092960 - DNA, 22 bp, Homo sapiens
agactctttgggtccattcaga

SEQ ID NO: 1092961 - DNA, 18 bp, Homo sapiens
agactcttttccttccct

SEQ ID NO: 1092962 - DNA, 22 bp, Homo sapiens
agactctttttttgagtgacag

SEQ ID NO: 1092963 - DNA, 23 bp, Homo sapiens
agactctttttttgagtgacagc

SEQ ID NO: 1092964 - DNA, 16 bp, Homo sapiens
agactgaaagcagcag

SEQ ID NO: 1092965 - DNA, 17 bp, Homo sapiens
agactgaaagcagcagc

SEQ ID NO: 1092966 - DNA, 19 bp, Homo sapiens
agactgaaatttagtacac

SEQ ID NO: 1092967 - DNA, 14 bp, Homo sapiens
agactgaacatgtt

SEQ ID NO: 1092968 - DNA, 21 bp, Homo sapiens
agactgaatagatatgaaagc

SEQ ID NO: 1092969 - DNA, 22 bp, Homo sapiens
agactgaattttaaatgttcac

SEQ ID NO: 1092970 - DNA, 13 bp, Homo sapiens
agactgagaactt

SEQ ID NO: 1092971 - DNA, 13 bp, Homo sapiens
agactgagaggca

SEQ ID NO: 1092972 - DNA, 13 bp, Homo sapiens
agactgagctctc

SEQ ID NO: 1092973 - DNA, 15 bp, Homo sapiens
agactgagctctcca

SEQ ID NO: 1092974 - DNA, 23 bp, Homo sapiens
agactgagctctccaggccaggt

SEQ ID NO: 1092975 - DNA, 17 bp, Homo sapiens
agactgaggacaaagtg

SEQ ID NO: 1092976 - DNA, 18 bp, Homo sapiens
agactgaggtataaagac

SEQ ID NO: 1092977 - DNA, 19 bp, Homo sapiens
agactgaggtataaagaca

SEQ ID NO: 1092978 - DNA, 17 bp, Homo sapiens
agactgagtcagatggg

SEQ ID NO: 1092979 - DNA, 18 bp, Homo sapiens
agactgagtcagatgggt

SEQ ID NO: 1092980 - DNA, 15 bp, Homo sapiens
agactgataatttta

SEQ ID NO: 1092981 - DNA, 17 bp, Homo sapiens
agactgataattttaca

SEQ ID NO: 1092982 - DNA, 21 bp, Homo sapiens
agactgatcatccaggcctca

SEQ ID NO: 1092983 - DNA, 19 bp, Homo sapiens
agactgatccaaaaattat

SEQ ID NO: 1092984 - DNA, 20 bp, Homo sapiens
agactgatccctggccactg

SEQ ID NO: 1092985 - DNA, 19 bp, Homo sapiens
agactgatggaacagaata

SEQ ID NO: 1092986 - DNA, 23 bp, Homo sapiens
agactgatggggtcgctctttgg

SEQ ID NO: 1092987 - DNA, 15 bp, Homo sapiens
agactgcaaactttt

SEQ ID NO: 1092988 - DNA, 21 bp, Homo sapiens
agactgcagacattctcaaag

SEQ ID NO: 1092989 - DNA, 17 bp, Homo sapiens
agactgcagctgctgaa

SEQ ID NO: 1092990 - DNA, 17 bp, Homo sapiens
agactgcaggtgggctg

SEQ ID NO: 1092991 - DNA, 20 bp, Homo sapiens
agactgcaggtgggctgggc

SEQ ID NO: 1092992 - DNA, 22 bp, Homo sapiens
agactgcaggtgggctgggccc

SEQ ID NO: 1092993 - DNA, 23 bp, Homo sapiens
agactgccccacggagacagagg

SEQ ID NO: 1092994 - DNA, 12 bp, Homo sapiens
agactgcctccc

SEQ ID NO: 1092995 - DNA, 14 bp, Homo sapiens
agactgcctccctc

SEQ ID NO: 1092996 - DNA, 12 bp, Homo sapiens
agactgctcccg

SEQ ID NO: 1092997 - DNA, 14 bp, Homo sapiens
agactgctcccggc

SEQ ID NO: 1092998 - DNA, 14 bp, Homo sapiens
agactgctgggact

SEQ ID NO: 1092999 - DNA, 15 bp, Homo sapiens
agactgcttggccag

SEQ ID NO: 1093000 - DNA, 19 bp, Homo sapiens
agactgcttggccagatgc

SEQ ID NO: 1093001 - DNA, 19 bp, Homo sapiens
agactggaagctaatttgc

SEQ ID NO: 1093002 - DNA, 14 bp, Homo sapiens
agactggagcatct

SEQ ID NO: 1093003 - DNA, 16 bp, Homo sapiens
agactggagcatctga

SEQ ID NO: 1093004 - DNA, 16 bp, Homo sapiens
agactggcaataaact

SEQ ID NO: 1093005 - DNA, 22 bp, Homo sapiens
agactggcgtgaacccaggagg

SEQ ID NO: 1093006 - DNA, 23 bp, Homo sapiens
agactggcgtgaacccaggaggc

SEQ ID NO: 1093007 - DNA, 20 bp, Homo sapiens
agactggctggctgcagtga

SEQ ID NO: 1093008 - DNA, 11 bp, Homo sapiens
agactggcttt

SEQ ID NO: 1093009 - DNA, 23 bp, Homo sapiens
agactggcttttattaatgcact

SEQ ID NO: 1093010 - DNA, 23 bp, Homo sapiens
agactgggaagataggctctgca

SEQ ID NO: 1093011 - DNA, 18 bp, Homo sapiens
agactgggagccacttct

SEQ ID NO: 1093012 - DNA, 20 bp, Homo sapiens
agactgggagccacttctcc

SEQ ID NO: 1093013 - DNA, 22 bp, Homo sapiens
agactgggagccacttctcccc

SEQ ID NO: 1093014 - DNA, 13 bp, Homo sapiens
agactgggcccag

SEQ ID NO: 1093015 - DNA, 14 bp, Homo sapiens
agactgggctgagg

SEQ ID NO: 1093016 - DNA, 16 bp, Homo sapiens
agactgggctgaggga

SEQ ID NO: 1093017 - DNA, 15 bp, Homo sapiens
agactgggctgtagt

SEQ ID NO: 1093018 - DNA, 14 bp, Homo sapiens
agactggggccact

SEQ ID NO: 1093019 - DNA, 22 bp, Homo sapiens
agactgggtaggaaagaggaag

SEQ ID NO: 1093020 - DNA, 18 bp, Homo sapiens
agactggtcctgtgtgca

SEQ ID NO: 1093021 - DNA, 22 bp, Homo sapiens
agactggtttatccacccacaa

SEQ ID NO: 1093022 - DNA, 15 bp, Homo sapiens
agactggtttgtttg

SEQ ID NO: 1093023 - DNA, 16 bp, Homo sapiens
agactggtttgtttgc

SEQ ID NO: 1093024 - DNA, 19 bp, Homo sapiens
agactggtttgtttgctta

SEQ ID NO: 1093025 - DNA, 15 bp, Homo sapiens
agactggttttctgc

SEQ ID NO: 1093026 - DNA, 21 bp, Homo sapiens
agactgtaactttttttcagt

SEQ ID NO: 1093027 - DNA, 22 bp, Homo sapiens
agactgtaactttttttcagtt

SEQ ID NO: 1093028 - DNA, 14 bp, Homo sapiens
agactgtaagatgt

SEQ ID NO: 1093029 - DNA, 16 bp, Homo sapiens
agactgtaagatgttg

SEQ ID NO: 1093030 - DNA, 17 bp, Homo sapiens
agactgtaagatgttgt

SEQ ID NO: 1093031 - DNA, 23 bp, Homo sapiens
agactgtatgttttaattgcatt

SEQ ID NO: 1093032 - DNA, 19 bp, Homo sapiens
agactgtcaaatgaacttt

SEQ ID NO: 1093033 - DNA, 15 bp, Homo sapiens
agactgtcaggaagt

SEQ ID NO: 1093034 - DNA, 21 bp, Homo sapiens
agactgtcggagaggctgtct

SEQ ID NO: 1093035 - DNA, 24 bp, Homo sapiens
agactgtcggagaggctgtctggg

SEQ ID NO: 1093036 - DNA, 15 bp, Homo sapiens
agactgtgaacttga

SEQ ID NO: 1093037 - DNA, 15 bp, Homo sapiens
agactgtgctctctg

SEQ ID NO: 1093038 - DNA, 17 bp, Homo sapiens
agactgtgctctctgtg

SEQ ID NO: 1093039 - DNA, 19 bp, Homo sapiens
agactgtgctgttgttctc

SEQ ID NO: 1093040 - DNA, 23 bp, Homo sapiens
agactgtggccatatatgctgta

SEQ ID NO: 1093041 - DNA, 13 bp, Homo sapiens
agactgtgggtgg

SEQ ID NO: 1093042 - DNA, 17 bp, Homo sapiens
agactgtgggtggggag

SEQ ID NO: 1093043 - DNA, 19 bp, Homo sapiens
agactgtgggtggggaggc

SEQ ID NO: 1093044 - DNA, 17 bp, Homo sapiens
agactgtggtaggggca

SEQ ID NO: 1093045 - DNA, 20 bp, Homo sapiens
agactgtggtaggggcaggg

SEQ ID NO: 1093046 - DNA, 17 bp, Homo sapiens
agactgttaaatgaaac

SEQ ID NO: 1093047 - DNA, 14 bp, Homo sapiens
agactgtttcacat

SEQ ID NO: 1093048 - DNA, 14 bp, Homo sapiens
agactgttttactg

SEQ ID NO: 1093049 - DNA, 16 bp, Homo sapiens
agactgttttactgtt

SEQ ID NO: 1093050 - DNA, 21 bp, Homo sapiens
agactgttttactgttttaat

SEQ ID NO: 1093051 - DNA, 15 bp, Homo sapiens
agactgtttttaagt

SEQ ID NO: 1093052 - DNA, 21 bp, Homo sapiens
agacttaaagggcccaatgaa

SEQ ID NO: 1093053 - DNA, 23 bp, Homo sapiens
agacttacagggataaggcctgt

SEQ ID NO: 1093054 - DNA, 21 bp, Homo sapiens
agacttacttgcattgctgga

SEQ ID NO: 1093055 - DNA, 21 bp, Homo sapiens
agacttactttactcattttt

SEQ ID NO: 1093056 - DNA, 17 bp, Homo sapiens
agacttagggcaccagg

SEQ ID NO: 1093057 - DNA, 18 bp, Homo sapiens
agacttagtatattttct

SEQ ID NO: 1093058 - DNA, 19 bp, Homo sapiens
agacttagtatattttctt

SEQ ID NO: 1093059 - DNA, 17 bp, Homo sapiens
agacttcaaaatattga

SEQ ID NO: 1093060 - DNA, 19 bp, Homo sapiens
agacttcaagcatggctat

SEQ ID NO: 1093061 - DNA, 22 bp, Homo sapiens
agacttcaagcatggctatttt

SEQ ID NO: 1093062 - DNA, 15 bp, Homo sapiens
agacttcacactgca

SEQ ID NO: 1093063 - DNA, 21 bp, Homo sapiens
agacttcacactgcaagagcc

SEQ ID NO: 1093064 - DNA, 19 bp, Homo sapiens
agacttcagtatgttgtca

SEQ ID NO: 1093065 - DNA, 17 bp, Homo sapiens
agacttccaaatcctgg

SEQ ID NO: 1093066 - DNA, 20 bp, Homo sapiens
agacttccaaatcctggaag

SEQ ID NO: 1093067 - DNA, 14 bp, Homo sapiens
agacttccaccctg

SEQ ID NO: 1093068 - DNA, 19 bp, Homo sapiens
agacttcccaacagcctta

SEQ ID NO: 1093069 - DNA, 17 bp, Homo sapiens
agacttcccactgttct

SEQ ID NO: 1093070 - DNA, 22 bp, Homo sapiens
agacttcccactgttctgaaag

SEQ ID NO: 1093071 - DNA, 14 bp, Homo sapiens
agacttcccagcta

SEQ ID NO: 1093072 - DNA, 14 bp, Homo sapiens
agacttcccagctt

SEQ ID NO: 1093073 - DNA, 15 bp, Homo sapiens
agacttcccagcttc

SEQ ID NO: 1093074 - DNA, 20 bp, Homo sapiens
agacttccccatcccgaagc

SEQ ID NO: 1093075 - DNA, 15 bp, Homo sapiens
agacttccctgaatg

SEQ ID NO: 1093076 - DNA, 19 bp, Homo sapiens
agacttccctgaatgtatt

SEQ ID NO: 1093077 - DNA, 19 bp, Homo sapiens
agacttcctctctaccccc

SEQ ID NO: 1093078 - DNA, 16 bp, Homo sapiens
agacttccttgagaca

SEQ ID NO: 1093079 - DNA, 15 bp, Homo sapiens
agacttctggaaggc

SEQ ID NO: 1093080 - DNA, 20 bp, Homo sapiens
agacttctggaaggctggct

SEQ ID NO: 1093081 - DNA, 21 bp, Homo sapiens
agacttctggaaggctggctg

SEQ ID NO: 1093082 - DNA, 23 bp, Homo sapiens
agacttctggaaggctggctgag

SEQ ID NO: 1093083 - DNA, 12 bp, Homo sapiens
agacttgaaagt

SEQ ID NO: 1093084 - DNA, 20 bp, Homo sapiens
agacttgaaagttttccagt

SEQ ID NO: 1093085 - DNA, 15 bp, Homo sapiens
agacttgaagcacag

SEQ ID NO: 1093086 - DNA, 15 bp, Homo sapiens
agacttgacagtgga

SEQ ID NO: 1093087 - DNA, 18 bp, Homo sapiens
agacttggaagaggagga

SEQ ID NO: 1093088 - DNA, 18 bp, Homo sapiens
agacttggacatctctct

SEQ ID NO: 1093089 - DNA, 21 bp, Homo sapiens
agacttggacatctctctggc

SEQ ID NO: 1093090 - DNA, 14 bp, Homo sapiens
agacttggcctcca

SEQ ID NO: 1093091 - DNA, 22 bp, Homo sapiens
agacttggggccagcgcttctg

SEQ ID NO: 1093092 - DNA, 21 bp, Homo sapiens
agacttgggttgatctcttag

SEQ ID NO: 1093093 - DNA, 22 bp, Homo sapiens
agacttgtcaagcctgtgcaaa

SEQ ID NO: 1093094 - DNA, 14 bp, Homo sapiens
agactttaaaagca

SEQ ID NO: 1093095 - DNA, 14 bp, Homo sapiens
agactttaaagaat

SEQ ID NO: 1093096 - DNA, 17 bp, Homo sapiens
agactttagaaataaat

SEQ ID NO: 1093097 - DNA, 18 bp, Homo sapiens
agactttagaaataaatg

SEQ ID NO: 1093098 - DNA, 16 bp, Homo sapiens
agactttataattcct

SEQ ID NO: 1093099 - DNA, 14 bp, Homo sapiens
agactttgagcctg

SEQ ID NO: 1093100 - DNA, 14 bp, Homo sapiens
agactttgatcctt

SEQ ID NO: 1093101 - DNA, 21 bp, Homo sapiens
agactttgatccttggaaacc

SEQ ID NO: 1093102 - DNA, 16 bp, Homo sapiens
agactttgctgcattt

SEQ ID NO: 1093103 - DNA, 18 bp, Homo sapiens
agactttgctgcatttta

SEQ ID NO: 1093104 - DNA, 22 bp, Homo sapiens
agactttgctgcattttacaca

SEQ ID NO: 1093105 - DNA, 23 bp, Homo sapiens
agactttgctgcattttacacat

SEQ ID NO: 1093106 - DNA, 16 bp, Homo sapiens
agactttgctgttact

SEQ ID NO: 1093107 - DNA, 17 bp, Homo sapiens
agactttgctgttactg

SEQ ID NO: 1093108 - DNA, 22 bp, Homo sapiens
agactttgctgttactgcttct

SEQ ID NO: 1093109 - DNA, 17 bp, Homo sapiens
agactttggacagtggc

SEQ ID NO: 1093110 - DNA, 19 bp, Homo sapiens
agactttggacagtggcct

SEQ ID NO: 1093111 - DNA, 19 bp, Homo sapiens
agactttgtttttaaaatg

SEQ ID NO: 1093112 - DNA, 16 bp, Homo sapiens
agacttttatgtgaga

SEQ ID NO: 1093113 - DNA, 17 bp, Homo sapiens
agacttttatgtgagat

SEQ ID NO: 1093114 - DNA, 15 bp, Homo sapiens
agacttttcagaaga

SEQ ID NO: 1093115 - DNA, 21 bp, Homo sapiens
agacttttcagaagatggtga

SEQ ID NO: 1093116 - DNA, 22 bp, Homo sapiens
agacttttcagaagatggtgaa

SEQ ID NO: 1093117 - DNA, 16 bp, Homo sapiens
agacttttcaggagag

SEQ ID NO: 1093118 - DNA, 13 bp, Homo sapiens
agacttttctttg

SEQ ID NO: 1093119 - DNA, 18 bp, Homo sapiens
agagaaaaaaaaaatagt

SEQ ID NO: 1093120 - DNA, 17 bp, Homo sapiens
agagaaaaaagaagtgt

SEQ ID NO: 1093121 - DNA, 17 bp, Homo sapiens
agagaaaaagtgcccct

SEQ ID NO: 1093122 - DNA, 14 bp, Homo sapiens
agagaaaagaaaaa

SEQ ID NO: 1093123 - DNA, 17 bp, Homo sapiens
agagaaaagggaaaaaa

SEQ ID NO: 1093124 - DNA, 12 bp, Homo sapiens
agagaaaatata

SEQ ID NO: 1093125 - DNA, 16 bp, Homo sapiens
agagaaagaaaaggca

SEQ ID NO: 1093126 - DNA, 21 bp, Homo sapiens
agagaaagaaaaggcaaaaga

SEQ ID NO: 1093127 - DNA, 16 bp, Homo sapiens
agagaaagaaaatgaa

SEQ ID NO: 1093128 - DNA, 17 bp, Homo sapiens
agagaaagaagagacag

SEQ ID NO: 1093129 - DNA, 13 bp, Homo sapiens
agagaaagagaac

SEQ ID NO: 1093130 - DNA, 18 bp, Homo sapiens
agagaaagtgatttctag

SEQ ID NO: 1093131 - DNA, 14 bp, Homo sapiens
agagaaatcacagg

SEQ ID NO: 1093132 - DNA, 22 bp, Homo sapiens
agagaaatttttatttttgaac

SEQ ID NO: 1093133 - DNA, 15 bp, Homo sapiens
agagaacaacaggca

SEQ ID NO: 1093134 - DNA, 13 bp, Homo sapiens
agagaacaatcac

SEQ ID NO: 1093135 - DNA, 13 bp, Homo sapiens
agagaacaggtgg

SEQ ID NO: 1093136 - DNA, 20 bp, Homo sapiens
agagaaccaccactgcctga

SEQ ID NO: 1093137 - DNA, 13 bp, Homo sapiens
agagaaccaggct

SEQ ID NO: 1093138 - DNA, 17 bp, Homo sapiens
agagaaccgagcaaaga

SEQ ID NO: 1093139 - DNA, 16 bp, Homo sapiens
agagaacgggcgtcag

SEQ ID NO: 1093140 - DNA, 23 bp, Homo sapiens
agagaacgggcgtcaggggtgca

SEQ ID NO: 1093141 - DNA, 12 bp, Homo sapiens
agagaactaaag

SEQ ID NO: 1093142 - DNA, 19 bp, Homo sapiens
agagaactaaagctggaga

SEQ ID NO: 1093143 - DNA, 19 bp, Homo sapiens
agagaactactaaggaaaa

SEQ ID NO: 1093144 - DNA, 16 bp, Homo sapiens
agagaactgcagacct

SEQ ID NO: 1093145 - DNA, 13 bp, Homo sapiens
agagaactgcctt

SEQ ID NO: 1093146 - DNA, 20 bp, Homo sapiens
agagaactggaggaaccaca

SEQ ID NO: 1093147 - DNA, 13 bp, Homo sapiens
agagaagaaagtg

SEQ ID NO: 1093148 - DNA, 15 bp, Homo sapiens
agagaagaatgagcc

SEQ ID NO: 1093149 - DNA, 17 bp, Homo sapiens
agagaagacctagctat

SEQ ID NO: 1093150 - DNA, 23 bp, Homo sapiens
agagaagaggacttttttgatta

SEQ ID NO: 1093151 - DNA, 12 bp, Homo sapiens
agagaagaggct

SEQ ID NO: 1093152 - DNA, 18 bp, Homo sapiens
agagaagagggcccagcc

SEQ ID NO: 1093153 - DNA, 20 bp, Homo sapiens
agagaagatggccatgccct

SEQ ID NO: 1093154 - DNA, 15 bp, Homo sapiens
agagaagccacgctg

SEQ ID NO: 1093155 - DNA, 13 bp, Homo sapiens
agagaagccccgc

SEQ ID NO: 1093156 - DNA, 12 bp, Homo sapiens
agagaagctacc

SEQ ID NO: 1093157 - DNA, 13 bp, Homo sapiens
agagaaggaaaag

SEQ ID NO: 1093158 - DNA, 21 bp, Homo sapiens
agagaaggatgggtcccctcc

SEQ ID NO: 1093159 - DNA, 22 bp, Homo sapiens
agagaaggcccataccttctgg

SEQ ID NO: 1093160 - DNA, 13 bp, Homo sapiens
agagaaggcctct

SEQ ID NO: 1093161 - DNA, 20 bp, Homo sapiens
agagaaggcctcttgtgctc

SEQ ID NO: 1093162 - DNA, 22 bp, Homo sapiens
agagaagggggattggagggaa

SEQ ID NO: 1093163 - DNA, 18 bp, Homo sapiens
agagaagttctcaaagtt

SEQ ID NO: 1093164 - DNA, 23 bp, Homo sapiens
agagaagttgctgcttgtgatct

SEQ ID NO: 1093165 - DNA, 17 bp, Homo sapiens
agagaagtttgtagcca

SEQ ID NO: 1093166 - DNA, 14 bp, Homo sapiens
agagaatagagctg

SEQ ID NO: 1093167 - DNA, 17 bp, Homo sapiens
agagaatagagctgcca

SEQ ID NO: 1093168 - DNA, 21 bp, Homo sapiens
agagaatagagctgccactgg

SEQ ID NO: 1093169 - DNA, 23 bp, Homo sapiens
agagaatagagctgccactgggc

SEQ ID NO: 1093170 - DNA, 17 bp, Homo sapiens
agagaatcaacagatga

SEQ ID NO: 1093171 - DNA, 19 bp, Homo sapiens
agagaatcacacaagtttg

SEQ ID NO: 1093172 - DNA, 15 bp, Homo sapiens
agagaatcatactta

SEQ ID NO: 1093173 - DNA, 19 bp, Homo sapiens
agagaatgagagcgacaca

SEQ ID NO: 1093174 - DNA, 20 bp, Homo sapiens
agagaatggctgggtcaggg

SEQ ID NO: 1093175 - DNA, 17 bp, Homo sapiens
agagaatgtattttcat

SEQ ID NO: 1093176 - DNA, 15 bp, Homo sapiens
agagaatgtcactgt

SEQ ID NO: 1093177 - DNA, 20 bp, Homo sapiens
agagaatgtcactgtagttt

SEQ ID NO: 1093178 - DNA, 14 bp, Homo sapiens
agagaattactatt

SEQ ID NO: 1093179 - DNA, 14 bp, Homo sapiens
agagaattcagtat

SEQ ID NO: 1093180 - DNA, 14 bp, Homo sapiens
agagaattcatgtg

SEQ ID NO: 1093181 - DNA, 15 bp, Homo sapiens
agagaattggctcaa

SEQ ID NO: 1093182 - DNA, 22 bp, Homo sapiens
agagaatttctaccatttcaga

SEQ ID NO: 1093183 - DNA, 23 bp, Homo sapiens
agagaatttctaccatttcagag

SEQ ID NO: 1093184 - DNA, 20 bp, Homo sapiens
agagacaaacacctcccagg

SEQ ID NO: 1093185 - DNA, 15 bp, Homo sapiens
agagacaagtaattt

SEQ ID NO: 1093186 - DNA, 23 bp, Homo sapiens
agagacaccccttcctgctgaca

SEQ ID NO: 1093187 - DNA, 19 bp, Homo sapiens
agagacacctgcacctccc

SEQ ID NO: 1093188 - DNA, 22 bp, Homo sapiens
agagacactgttgataaaaact

SEQ ID NO: 1093189 - DNA, 23 bp, Homo sapiens
agagacagaactgtccacatctg

SEQ ID NO: 1093190 - DNA, 22 bp, Homo sapiens
agagccctgaggcctagactct

SEQ ID NO: 1093191 - DNA, 13 bp, Homo sapiens
agagccctgaggg

SEQ ID NO: 1093192 - DNA, 19 bp, Homo sapiens
agagccctgaggggctggg

SEQ ID NO: 1093193 - DNA, 23 bp, Homo sapiens
agagccctggacacccctgctct

SEQ ID NO: 1093194 - DNA, 19 bp, Homo sapiens
agagccctggctctgcccc

SEQ ID NO: 1093195 - DNA, 23 bp, Homo sapiens
agagccctggctctgcccctcag

SEQ ID NO: 1093196 - DNA, 12 bp, Homo sapiens
agagccctgtgg

SEQ ID NO: 1093197 - DNA, 15 bp, Homo sapiens
agagcccttcactgc

SEQ ID NO: 1093198 - DNA, 18 bp, Homo sapiens
agagcccttcactgccat

SEQ ID NO: 1093199 - DNA, 14 bp, Homo sapiens
agagcccttgcctc

SEQ ID NO: 1093200 - DNA, 19 bp, Homo sapiens
agagccggcccgcctctcc

SEQ ID NO: 1093201 - DNA, 22 bp, Homo sapiens
agagccggccgccttctcccct

SEQ ID NO: 1093202 - DNA, 23 bp, Homo sapiens
agagccgggaggaaaaggcccct

SEQ ID NO: 1093203 - DNA, 24 bp, Homo sapiens
agagccgggaggaaaaggcccctg

SEQ ID NO: 1093204 - DNA, 18 bp, Homo sapiens
agagccggtggtgcccgt

SEQ ID NO: 1093205 - DNA, 21 bp, Homo sapiens
agagcctagaacatccctggg

SEQ ID NO: 1093206 - DNA, 23 bp, Homo sapiens
agagcctcccaccagagccggga

SEQ ID NO: 1093207 - DNA, 19 bp, Homo sapiens
agagcctcgacaccccccc

SEQ ID NO: 1093208 - DNA, 21 bp, Homo sapiens
agagcctcggccctagcattg

SEQ ID NO: 1093209 - DNA, 15 bp, Homo sapiens
agagcctctggcccc

SEQ ID NO: 1093210 - DNA, 13 bp, Homo sapiens
agagcctcttagt

SEQ ID NO: 1093211 - DNA, 15 bp, Homo sapiens
agagcctctttgctg

SEQ ID NO: 1093212 - DNA, 20 bp, Homo sapiens
agagcctctttgctggagtc

SEQ ID NO: 1093213 - DNA, 14 bp, Homo sapiens
agagcctgaagctg

SEQ ID NO: 1093214 - DNA, 17 bp, Homo sapiens
agagcctgaagctggcc

SEQ ID NO: 1093215 - DNA, 18 bp, Homo sapiens
agagcctgaagctggcct

SEQ ID NO: 1093216 - DNA, 13 bp, Homo sapiens
agagcctgatctc

SEQ ID NO: 1093217 - DNA, 18 bp, Homo sapiens
agagcctgatctcttcct

SEQ ID NO: 1093218 - DNA, 16 bp, Homo sapiens
agagcctgctccccca

SEQ ID NO: 1093219 - DNA, 17 bp, Homo sapiens
agagcctgctgcatggg

SEQ ID NO: 1093220 - DNA, 13 bp, Homo sapiens
agagcctgctggc

SEQ ID NO: 1093221 - DNA, 14 bp, Homo sapiens
agagcctggagaag

SEQ ID NO: 1093222 - DNA, 16 bp, Homo sapiens
agagcctggagaagct

SEQ ID NO: 1093223 - DNA, 10 bp, Homo sapiens
agagcctggc

SEQ ID NO: 1093224 - DNA, 15 bp, Homo sapiens
agagcctggccccag

SEQ ID NO: 1093225 - DNA, 14 bp, Homo sapiens
agagccttcagaat

SEQ ID NO: 1093226 - DNA, 20 bp, Homo sapiens
agagccttccacagtgaatg

SEQ ID NO: 1093227 - DNA, 15 bp, Homo sapiens
agagccttctcagaa

SEQ ID NO: 1093228 - DNA, 16 bp, Homo sapiens
agagccttctcagaag

SEQ ID NO: 1093229 - DNA, 11 bp, Homo sapiens
agagccttgcg

SEQ ID NO: 1093230 - DNA, 17 bp, Homo sapiens
agagccttggtgtccac

SEQ ID NO: 1093231 - DNA, 19 bp, Homo sapiens
agagccttggtgtccacct

SEQ ID NO: 1093232 - DNA, 22 bp, Homo sapiens
agagccttggtgtccacctggc

SEQ ID NO: 1093233 - DNA, 15 bp, Homo sapiens
agagcctttccaaag

SEQ ID NO: 1093234 - DNA, 21 bp, Homo sapiens
agagccttttatctgcagaac

SEQ ID NO: 1093235 - DNA, 16 bp, Homo sapiens
agagcgaggaaaggat

SEQ ID NO: 1093236 - DNA, 12 bp, Homo sapiens
agagcgaggctg

SEQ ID NO: 1093237 - DNA, 14 bp, Homo sapiens
agagcgaggctgag

SEQ ID NO: 1093238 - DNA, 23 bp, Homo sapiens
agagcgaggctgagcctacagat

SEQ ID NO: 1093239 - DNA, 14 bp, Homo sapiens
agagcgcacaggga

SEQ ID NO: 1093240 - DNA, 17 bp, Homo sapiens
agagcgccaggaagcca

SEQ ID NO: 1093241 - DNA, 20 bp, Homo sapiens
agagcgccaggaagccagag

SEQ ID NO: 1093242 - DNA, 20 bp, Homo sapiens
agagcgcctcttcctctggg

SEQ ID NO: 1093243 - DNA, 12 bp, Homo sapiens
agagcggaggag

SEQ ID NO: 1093244 - DNA, 19 bp, Homo sapiens
agagcggaggctgtgtgcc

SEQ ID NO: 1093245 - DNA, 15 bp, Homo sapiens
agagcgggagggagt

SEQ ID NO: 1093246 - DNA, 22 bp, Homo sapiens
agagcgggagggagtctcagga

SEQ ID NO: 1093247 - DNA, 18 bp, Homo sapiens
agagcggggtcccctctg

SEQ ID NO: 1093248 - DNA, 17 bp, Homo sapiens
agagcgtccttccccct

SEQ ID NO: 1093249 - DNA, 18 bp, Homo sapiens
agagcgtccttccccctg

SEQ ID NO: 1093250 - DNA, 20 bp, Homo sapiens
agagctaaactccttcctgg

SEQ ID NO: 1093251 - DNA, 18 bp, Homo sapiens
agagctaagggtgggtgc

SEQ ID NO: 1093252 - DNA, 16 bp, Homo sapiens
agagctacataattta

SEQ ID NO: 1093253 - DNA, 18 bp, Homo sapiens
agagctacataatttagt

SEQ ID NO: 1093254 - DNA, 14 bp, Homo sapiens
agagctactcagaa

SEQ ID NO: 1093255 - DNA, 21 bp, Homo sapiens
agagctagaaaaataaaatgt

SEQ ID NO: 1093256 - DNA, 14 bp, Homo sapiens
agagctagagaaat

SEQ ID NO: 1093257 - DNA, 16 bp, Homo sapiens
agagctagcgctgccg

SEQ ID NO: 1093258 - DNA, 21 bp, Homo sapiens
agagctagcgctgccgcaccc

SEQ ID NO: 1093259 - DNA, 16 bp, Homo sapiens
agagctagctgccact

SEQ ID NO: 1093260 - DNA, 21 bp, Homo sapiens
agagctagctgccactttcac

SEQ ID NO: 1093261 - DNA, 19 bp, Homo sapiens
agagctagggctgctgctt

SEQ ID NO: 1093262 - DNA, 20 bp, Homo sapiens
agagctagggctgctgcttc

SEQ ID NO: 1093263 - DNA, 23 bp, Homo sapiens
agagctatttaatggccggctgg

SEQ ID NO: 1093264 - DNA, 22 bp, Homo sapiens
agagctcatcccccctgctgcc

SEQ ID NO: 1093265 - DNA, 23 bp, Homo sapiens
agagctcccctccacagctgcag

SEQ ID NO: 1093266 - DNA, 16 bp, Homo sapiens
agagctcccgaggaag

SEQ ID NO: 1093267 - DNA, 22 bp, Homo sapiens
agagctctcccctcctgctggg

SEQ ID NO: 1093268 - DNA, 17 bp, Homo sapiens
agagctcttcaagctgt

SEQ ID NO: 1093269 - DNA, 21 bp, Homo sapiens
agagctcttcggtttctgagc

SEQ ID NO: 1093270 - DNA, 23 bp, Homo sapiens
agagctgagagtctgaaagacag

SEQ ID NO: 1093271 - DNA, 16 bp, Homo sapiens
agagctgagccagttg

SEQ ID NO: 1093272 - DNA, 21 bp, Homo sapiens
agagctgagccagttgtccta

SEQ ID NO: 1093273 - DNA, 23 bp, Homo sapiens
agagctgaggatttcctggagtg

SEQ ID NO: 1093274 - DNA, 18 bp, Homo sapiens
agagctgagggccctgtg

SEQ ID NO: 1093275 - DNA, 19 bp, Homo sapiens
agagctgagggccctgtgg

SEQ ID NO: 1093276 - DNA, 15 bp, Homo sapiens
agagctgcagggtgg

SEQ ID NO: 1093277 - DNA, 17 bp, Homo sapiens
agagctgccactgggca

SEQ ID NO: 1093278 - DNA, 14 bp, Homo sapiens
agagctgcctctcg

SEQ ID NO: 1093279 - DNA, 23 bp, Homo sapiens
agagctgctctggaaaatgtgac

SEQ ID NO: 1093280 - DNA, 15 bp, Homo sapiens
agagctgctgtcctt

SEQ ID NO: 1093281 - DNA, 19 bp, Homo sapiens
agagctgctgtccttttag

SEQ ID NO: 1093282 - DNA, 16 bp, Homo sapiens
agagctggaaggcagg

SEQ ID NO: 1093283 - DNA, 21 bp, Homo sapiens
agagctggaaggcagggcaga

SEQ ID NO: 1093284 - DNA, 12 bp, Homo sapiens
agagctggaggc

SEQ ID NO: 1093285 - DNA, 18 bp, Homo sapiens
agagctggcaaaggtggc

SEQ ID NO: 1093286 - DNA, 16 bp, Homo sapiens
agagctggcctccccc

SEQ ID NO: 1093287 - DNA, 15 bp, Homo sapiens
agagctggctctgag

SEQ ID NO: 1093288 - DNA, 22 bp, Homo sapiens
agagctgggaggcatggccctg

SEQ ID NO: 1093289 - DNA, 19 bp, Homo sapiens
agagctggggctgccagcc

SEQ ID NO: 1093290 - DNA, 22 bp, Homo sapiens
agagctggggctgccagcctga

SEQ ID NO: 1093291 - DNA, 19 bp, Homo sapiens
agagctggtgactttgggg

SEQ ID NO: 1093292 - DNA, 20 bp, Homo sapiens
agagctggtgactttgggga

SEQ ID NO: 1093293 - DNA, 13 bp, Homo sapiens
agagctggtgccc

SEQ ID NO: 1093294 - DNA, 23 bp, Homo sapiens
agagctggtggtgcagccttccc

SEQ ID NO: 1093295 - DNA, 14 bp, Homo sapiens
agagctggtggttt

SEQ ID NO: 1093296 - DNA, 13 bp, Homo sapiens
agagctgtattaa

SEQ ID NO: 1093297 - DNA, 19 bp, Homo sapiens
agagctgtattaagtgact

SEQ ID NO: 1093298 - DNA, 21 bp, Homo sapiens
agagctgtattaagtgactga

SEQ ID NO: 1093299 - DNA, 17 bp, Homo sapiens
agagctgtctgaactca

SEQ ID NO: 1093300 - DNA, 15 bp, Homo sapiens
agagctgtcttcccc

SEQ ID NO: 1093301 - DNA, 18 bp, Homo sapiens
agagctgtcttcccctga

SEQ ID NO: 1093302 - DNA, 21 bp, Homo sapiens
agagctgtcttcccctgagag

SEQ ID NO: 1093303 - DNA, 22 bp, Homo sapiens
agagctgtcttcccctgagagt

SEQ ID NO: 1093304 - DNA, 19 bp, Homo sapiens
agagctgtgcctgctcagc

SEQ ID NO: 1093305 - DNA, 22 bp, Homo sapiens
agagctgtgcctgctcagcagc

SEQ ID NO: 1093306 - DNA, 23 bp, Homo sapiens
agagctgtgcctgctcagcagcc

SEQ ID NO: 1093307 - DNA, 24 bp, Homo sapiens
agagctgtgcctgctcagcagcca

SEQ ID NO: 1093308 - DNA, 20 bp, Homo sapiens
agagctgtggaggattgcta

SEQ ID NO: 1093309 - DNA, 20 bp, Homo sapiens
agagctgttcccaaattttc

SEQ ID NO: 1093310 - DNA, 19 bp, Homo sapiens
agagctgttcgctcctccc

SEQ ID NO: 1093311 - DNA, 10 bp, Homo sapiens
agaggctggt

SEQ ID NO: 1093312 - DNA, 16 bp, Homo sapiens
agaggctggtgctgtg

SEQ ID NO: 1093313 - DNA, 18 bp, Homo sapiens
agaggctggttttggcat

SEQ ID NO: 1093314 - DNA, 14 bp, Homo sapiens
agaggctgtctgtt

SEQ ID NO: 1093315 - DNA, 22 bp, Homo sapiens
agaggctgtgtggccaaccagg

SEQ ID NO: 1093316 - DNA, 17 bp, Homo sapiens
agaggcttctccgccag

SEQ ID NO: 1093317 - DNA, 22 bp, Homo sapiens
agaggcttctccgccagcctcc

SEQ ID NO: 1093318 - DNA, 21 bp, Homo sapiens
agaggcttcttcagatcagtg

SEQ ID NO: 1093319 - DNA, 15 bp, Homo sapiens
agagggaacaaaact

SEQ ID NO: 1093320 - DNA, 15 bp, Homo sapiens
agagggaagagggag

SEQ ID NO: 1093321 - DNA, 17 bp, Homo sapiens
agagggaagagtgcatt

SEQ ID NO: 1093322 - DNA, 21 bp, Homo sapiens
agagggaaggggcctacaccc

SEQ ID NO: 1093323 - DNA, 21 bp, Homo sapiens
agagggacacatgcccctccc

SEQ ID NO: 1093324 - DNA, 22 bp, Homo sapiens
agagggacacatgcccctcccc

SEQ ID NO: 1093325 - DNA, 15 bp, Homo sapiens
agagggacaggcact

SEQ ID NO: 1093326 - DNA, 15 bp, Homo sapiens
agagggacaggctga

SEQ ID NO: 1093327 - DNA, 18 bp, Homo sapiens
agagggacaggctgaaga

SEQ ID NO: 1093328 - DNA, 20 bp, Homo sapiens
agagggaccaaattgcttct

SEQ ID NO: 1093329 - DNA, 15 bp, Homo sapiens
agagggacgcctggg

SEQ ID NO: 1093330 - DNA, 21 bp, Homo sapiens
agagggacgcctgggggtgcc

SEQ ID NO: 1093331 - DNA, 13 bp, Homo sapiens
agagggactgaat

SEQ ID NO: 1093332 - DNA, 15 bp, Homo sapiens
agagggagaagaagt

SEQ ID NO: 1093333 - DNA, 16 bp, Homo sapiens
agagggagaagcatga

SEQ ID NO: 1093334 - DNA, 13 bp, Homo sapiens
agagggagcaacg

SEQ ID NO: 1093335 - DNA, 16 bp, Homo sapiens
agagggaggcaagccc

SEQ ID NO: 1093336 - DNA, 19 bp, Homo sapiens
agagggaggggacagaggc

SEQ ID NO: 1093337 - DNA, 22 bp, Homo sapiens
agagggaggggacagaggccct

SEQ ID NO: 1093338 - DNA, 16 bp, Homo sapiens
agagggaggggcctag

SEQ ID NO: 1093339 - DNA, 20 bp, Homo sapiens
agagggaggtcactggaaag

SEQ ID NO: 1093340 - DNA, 16 bp, Homo sapiens
agagggcactctgctt

SEQ ID NO: 1093341 - DNA, 18 bp, Homo sapiens
agagggcagactgtgaac

SEQ ID NO: 1093342 - DNA, 15 bp, Homo sapiens
agagggcagtacctg

SEQ ID NO: 1093343 - DNA, 18 bp, Homo sapiens
agagggcagtacctggga

SEQ ID NO: 1093344 - DNA, 18 bp, Homo sapiens
agagggccaagacttggc

SEQ ID NO: 1093345 - DNA, 13 bp, Homo sapiens
agagggccagagc

SEQ ID NO: 1093346 - DNA, 15 bp, Homo sapiens
agagggccagagcta

SEQ ID NO: 1093347 - DNA, 14 bp, Homo sapiens
agagggccagcagg

SEQ ID NO: 1093348 - DNA, 21 bp, Homo sapiens
agagggcccagcccagagcca

SEQ ID NO: 1093349 - DNA, 13 bp, Homo sapiens
agagggcccagct

SEQ ID NO: 1093350 - DNA, 17 bp, Homo sapiens
agagggcccaggcaggc

SEQ ID NO: 1093351 - DNA, 15 bp, Homo sapiens
agagggcccatcagg

SEQ ID NO: 1093352 - DNA, 18 bp, Homo sapiens
agagggccctgcctgctg

SEQ ID NO: 1093353 - DNA, 14 bp, Homo sapiens
agagggcctggacc

SEQ ID NO: 1093354 - DNA, 16 bp, Homo sapiens
agagggccttgcttct

SEQ ID NO: 1093355 - DNA, 18 bp, Homo sapiens
agagggctagccctgagc

SEQ ID NO: 1093356 - DNA, 22 bp, Homo sapiens
agagggctagccctgagcccgg

SEQ ID NO: 1093357 - DNA, 23 bp, Homo sapiens
agagggctagccctgagcccggc

SEQ ID NO: 1093358 - DNA, 11 bp, Homo sapiens
agagggctgga

SEQ ID NO: 1093359 - DNA, 17 bp, Homo sapiens
agagggctggaggccca

SEQ ID NO: 1093360 - DNA, 18 bp, Homo sapiens
agagggctggaggcccag

SEQ ID NO: 1093361 - DNA, 20 bp, Homo sapiens
agagggctggtccttattta

SEQ ID NO: 1093362 - DNA, 21 bp, Homo sapiens
agagggctgttggacagctgc

SEQ ID NO: 1093363 - DNA, 22 bp, Homo sapiens
agagggctgttggacagctgct

SEQ ID NO: 1093364 - DNA, 16 bp, Homo sapiens
agagggctttttaaat

SEQ ID NO: 1093365 - DNA, 16 bp, Homo sapiens
agaggggaagggccag

SEQ ID NO: 1093366 - DNA, 15 bp, Homo sapiens
agaggggactctggg

SEQ ID NO: 1093367 - DNA, 19 bp, Homo sapiens
agaggggagggctcctggg

SEQ ID NO: 1093368 - DNA, 15 bp, Homo sapiens
agaggggaggggcct

SEQ ID NO: 1093369 - DNA, 15 bp, Homo sapiens
agaggggcagaacag

SEQ ID NO: 1093370 - DNA, 16 bp, Homo sapiens
agaggggcagaacagc

SEQ ID NO: 1093371 - DNA, 14 bp, Homo sapiens
agaggggcagccct

SEQ ID NO: 1093372 - DNA, 16 bp, Homo sapiens
agaggggcagcccttg

SEQ ID NO: 1093373 - DNA, 13 bp, Homo sapiens
agaggggcagccg

SEQ ID NO: 1093374 - DNA, 15 bp, Homo sapiens
agaggggcagccgct

SEQ ID NO: 1093375 - DNA, 19 bp, Homo sapiens
agaggggcgccttttcagc

SEQ ID NO: 1093376 - DNA, 14 bp, Homo sapiens
agaggggcgctgtc

SEQ ID NO: 1093377 - DNA, 13 bp, Homo sapiens
agaggggcgggct

SEQ ID NO: 1093378 - DNA, 14 bp, Homo sapiens
agaggggcgggctc

SEQ ID NO: 1093379 - DNA, 21 bp, Homo sapiens
agaggggcgttctcccaaaga

SEQ ID NO: 1093380 - DNA, 22 bp, Homo sapiens
agaggggcgttctcccaaagat

SEQ ID NO: 1093381 - DNA, 16 bp, Homo sapiens
agagggggactgctgc

SEQ ID NO: 1093382 - DNA, 13 bp, Homo sapiens
agagggggccgga

SEQ ID NO: 1093383 - DNA, 12 bp, Homo sapiens
agagggggtgga

SEQ ID NO: 1093384 - DNA, 16 bp, Homo sapiens
agaggggtggagactg

SEQ ID NO: 1093385 - DNA, 15 bp, Homo sapiens
agagggtagggcaca

SEQ ID NO: 1093386 - DNA, 17 bp, Homo sapiens
agagggtcccagggctg

SEQ ID NO: 1093387 - DNA, 18 bp, Homo sapiens
agagggtcccagggctgc

SEQ ID NO: 1093388 - DNA, 22 bp, Homo sapiens
agagggtgacaagatagagagc

SEQ ID NO: 1093389 - DNA, 22 bp, Homo sapiens
agagggtgggagcctaaggaag

SEQ ID NO: 1093390 - DNA, 16 bp, Homo sapiens
agaggtaaaagtgtga

SEQ ID NO: 1093391 - DNA, 18 bp, Homo sapiens
agaggtaaaagtgtgagc

SEQ ID NO: 1093392 - DNA, 15 bp, Homo sapiens
agaggtagcgagctg

SEQ ID NO: 1093393 - DNA, 16 bp, Homo sapiens
agaggtcacaaagaat

SEQ ID NO: 1093394 - DNA, 23 bp, Homo sapiens
agaggtcagaggggactctgacc

SEQ ID NO: 1093395 - DNA, 19 bp, Homo sapiens
agaggtcaggacggctcct

SEQ ID NO: 1093396 - DNA, 15 bp, Homo sapiens
agaggtccagcccat

SEQ ID NO: 1093397 - DNA, 14 bp, Homo sapiens
agaggtcccagccc

SEQ ID NO: 1093398 - DNA, 17 bp, Homo sapiens
agaggtcccagccccag

SEQ ID NO: 1093399 - DNA, 20 bp, Homo sapiens
agaggtcccagccccaggcc

SEQ ID NO: 1093400 - DNA, 17 bp, Homo sapiens
agaggtcctctggagcc

SEQ ID NO: 1093401 - DNA, 13 bp, Homo sapiens
agaggtctccaaa

SEQ ID NO: 1093402 - DNA, 12 bp, Homo sapiens
agaggtctgagc

SEQ ID NO: 1093403 - DNA, 14 bp, Homo sapiens
agaggtctgagccc

SEQ ID NO: 1093404 - DNA, 21 bp, Homo sapiens
agaggtctgagccctggtgtg

SEQ ID NO: 1093405 - DNA, 16 bp, Homo sapiens
agaggtgaaagcataa

SEQ ID NO: 1093406 - DNA, 17 bp, Homo sapiens
agaggtgagaaatttaa

SEQ ID NO: 1093407 - DNA, 18 bp, Homo sapiens
agaggtgagaactcagaa

SEQ ID NO: 1093408 - DNA, 19 bp, Homo sapiens
agaggtgattcttacatat

SEQ ID NO: 1093409 - DNA, 15 bp, Homo sapiens
agaggtggaaaaaca

SEQ ID NO: 1093410 - DNA, 22 bp, Homo sapiens
agaggtggaggtgggctgatgg

SEQ ID NO: 1093411 - DNA, 20 bp, Homo sapiens
agaggtggatgttatgaaca

SEQ ID NO: 1093412 - DNA, 10 bp, Homo sapiens
agaggtggcc

SEQ ID NO: 1093413 - DNA, 13 bp, Homo sapiens
agaggtggccaga

SEQ ID NO: 1093414 - DNA, 18 bp, Homo sapiens
agaggtggccagagctgg

SEQ ID NO: 1093415 - DNA, 19 bp, Homo sapiens
agaggtgggatcctccctc

SEQ ID NO: 1093416 - DNA, 12 bp, Homo sapiens
agaggtgggcag

SEQ ID NO: 1093417 - DNA, 14 bp, Homo sapiens
agaggtgggcagct

SEQ ID NO: 1093418 - DNA, 19 bp, Homo sapiens
agaggtgggcagctgggcc

SEQ ID NO: 1093419 - DNA, 13 bp, Homo sapiens
agaggtgggcagg

SEQ ID NO: 1093420 - DNA, 17 bp, Homo sapiens
agaggtgggcaggtggt

SEQ ID NO: 1093421 - DNA, 24 bp, Homo sapiens
agaggtgggccagtctgtggatca

SEQ ID NO: 1093422 - DNA, 19 bp, Homo sapiens
agaggtggggatcctgcct

SEQ ID NO: 1093423 - DNA, 21 bp, Homo sapiens
agaggtgggtggtgggcttct

SEQ ID NO: 1093424 - DNA, 17 bp, Homo sapiens
agaggtgtcatgctttg

SEQ ID NO: 1093425 - DNA, 19 bp, Homo sapiens
agaggtgtcgggacatggt

SEQ ID NO: 1093426 - DNA, 20 bp, Homo sapiens
agaggttaaggtgggtccag

SEQ ID NO: 1093427 - DNA, 22 bp, Homo sapiens
agaggttaaggtgggtccagga

SEQ ID NO: 1093428 - DNA, 14 bp, Homo sapiens
agaggttaggagta

SEQ ID NO: 1093429 - DNA, 19 bp, Homo sapiens
agaggttcaaagatatttt

SEQ ID NO: 1093430 - DNA, 20 bp, Homo sapiens
agaggttcaaagatattttg

SEQ ID NO: 1093431 - DNA, 13 bp, Homo sapiens
agaggttggtgtg

SEQ ID NO: 1093432 - DNA, 15 bp, Homo sapiens
agaggtttaaatgta

SEQ ID NO: 1093433 - DNA, 14 bp, Homo sapiens
agaggtttcttgaa

SEQ ID NO: 1093434 - DNA, 20 bp, Homo sapiens
agataaaacagaatcttctg

SEQ ID NO: 1093435 - DNA, 18 bp, Homo sapiens
agataaaagctgaagtta

SEQ ID NO: 1093436 - DNA, 23 bp, Homo sapiens
agataaaaggtggagtttctctg

SEQ ID NO: 1093437 - DNA, 13 bp, Homo sapiens
agataaactcaga

SEQ ID NO: 1093438 - DNA, 18 bp, Homo sapiens
agataaagaccagaaatt

SEQ ID NO: 1093439 - DNA, 16 bp, Homo sapiens
agataaagatgatcta

SEQ ID NO: 1093440 - DNA, 18 bp, Homo sapiens
agataaagatttcttgag

SEQ ID NO: 1093441 - DNA, 13 bp, Homo sapiens
agataaagccaga

SEQ ID NO: 1093442 - DNA, 18 bp, Homo sapiens
agataaatgcacatttca

SEQ ID NO: 1093443 - DNA, 18 bp, Homo sapiens
agataacaagatctttca

SEQ ID NO: 1093444 - DNA, 18 bp, Homo sapiens
agataacagcctcttgcc

SEQ ID NO: 1093445 - DNA, 15 bp, Homo sapiens
agataactgaaaatt

SEQ ID NO: 1093446 - DNA, 18 bp, Homo sapiens
agataacttactgtatat

SEQ ID NO: 1093447 - DNA, 19 bp, Homo sapiens
agataacttactgtatatg

SEQ ID NO: 1093448 - DNA, 21 bp, Homo sapiens
agataacttcttgaaaaagat

SEQ ID NO: 1093449 - DNA, 22 bp, Homo sapiens
agataagaatgctggttttcct

SEQ ID NO: 1093450 - DNA, 23 bp, Homo sapiens
agataaggtttcctgctccagtg

SEQ ID NO: 1093451 - DNA, 21 bp, Homo sapiens
agataagtctacattaaacaa

SEQ ID NO: 1093452 - DNA, 19 bp, Homo sapiens
agataataaattgatttgt

SEQ ID NO: 1093453 - DNA, 14 bp, Homo sapiens
agataataagatta

SEQ ID NO: 1093454 - DNA, 15 bp, Homo sapiens
agataataagattag

SEQ ID NO: 1093455 - DNA, 13 bp, Homo sapiens
agataatagttta

SEQ ID NO: 1093456 - DNA, 18 bp, Homo sapiens
agataatattaaggaaga

SEQ ID NO: 1093457 - DNA, 22 bp, Homo sapiens
agataatattaaggaagacaat

SEQ ID NO: 1093458 - DNA, 14 bp, Homo sapiens
agataatatttttg

SEQ ID NO: 1093459 - DNA, 15 bp, Homo sapiens
agataatatttttgt

SEQ ID NO: 1093460 - DNA, 21 bp, Homo sapiens
agataatatttttgtatttct

SEQ ID NO: 1093461 - DNA, 13 bp, Homo sapiens
agataatccctgt

SEQ ID NO: 1093462 - DNA, 16 bp, Homo sapiens
agataatctagaacac

SEQ ID NO: 1093463 - DNA, 15 bp, Homo sapiens
agataatctctcagc

SEQ ID NO: 1093464 - DNA, 17 bp, Homo sapiens
agataatgatacttaac

SEQ ID NO: 1093465 - DNA, 13 bp, Homo sapiens
agataatggagaa

SEQ ID NO: 1093466 - DNA, 16 bp, Homo sapiens
agataatgtatataaa

SEQ ID NO: 1093467 - DNA, 18 bp, Homo sapiens
agataatgtgaaaatggt

SEQ ID NO: 1093468 - DNA, 12 bp, Homo sapiens
agataattataa

SEQ ID NO: 1093469 - DNA, 12 bp, Homo sapiens
agataattcatt

SEQ ID NO: 1093470 - DNA, 14 bp, Homo sapiens
agataattcatttg

SEQ ID NO: 1093471 - DNA, 15 bp, Homo sapiens
agataattcatttgt

SEQ ID NO: 1093472 - DNA, 16 bp, Homo sapiens
agataattcatttgta

SEQ ID NO: 1093473 - DNA, 16 bp, Homo sapiens
agataatttcagggtg

SEQ ID NO: 1093474 - DNA, 12 bp, Homo sapiens
agataatttgaa

SEQ ID NO: 1093475 - DNA, 21 bp, Homo sapiens
agataatttgcatattctatt

SEQ ID NO: 1093476 - DNA, 14 bp, Homo sapiens
agatacaaattaat

SEQ ID NO: 1093477 - DNA, 17 bp, Homo sapiens
agatacaagtttcagac

SEQ ID NO: 1093478 - DNA, 12 bp, Homo sapiens
agatacaataaa

SEQ ID NO: 1093479 - DNA, 18 bp, Homo sapiens
agatacagaactctttca

SEQ ID NO: 1093480 - DNA, 20 bp, Homo sapiens
agatacagaactctttcaaa

SEQ ID NO: 1093481 - DNA, 23 bp, Homo sapiens
agatacagaagcccatgtcttct

SEQ ID NO: 1093482 - DNA, 18 bp, Homo sapiens
agatacatatgagtgtgg

SEQ ID NO: 1093483 - DNA, 23 bp, Homo sapiens
agataccattcaacccagcaatc

SEQ ID NO: 1093484 - DNA, 19 bp, Homo sapiens
agatacctccaaccctgcc

SEQ ID NO: 1093485 - DNA, 21 bp, Homo sapiens
agataccttgaaaggcaggaa

SEQ ID NO: 1093486 - DNA, 14 bp, Homo sapiens
agatacgactttat

SEQ ID NO: 1093487 - DNA, 16 bp, Homo sapiens
agatacgactttattt

SEQ ID NO: 1093488 - DNA, 16 bp, Homo sapiens
agatacgggggctgtg

SEQ ID NO: 1093489 - DNA, 18 bp, Homo sapiens
agatactaaggacgttgt

SEQ ID NO: 1093490 - DNA, 12 bp, Homo sapiens
agatactatttt

SEQ ID NO: 1093491 - DNA, 14 bp, Homo sapiens
agatactattttca

SEQ ID NO: 1093492 - DNA, 13 bp, Homo sapiens
agatactggaaac

SEQ ID NO: 1093493 - DNA, 20 bp, Homo sapiens
agatacttacatttccattt

SEQ ID NO: 1093494 - DNA, 22 bp, Homo sapiens
agatacttacatttccatttat

SEQ ID NO: 1093495 - DNA, 15 bp, Homo sapiens
agatacttatgaaat

SEQ ID NO: 1093496 - DNA, 17 bp, Homo sapiens
agatacttcccaaagcc

SEQ ID NO: 1093497 - DNA, 19 bp, Homo sapiens
agatactttgcattgtctg

SEQ ID NO: 1093498 - DNA, 23 bp, Homo sapiens
agatagaaaacagcccccactcc

SEQ ID NO: 1093499 - DNA, 12 bp, Homo sapiens
agatagaatgac

SEQ ID NO: 1093500 - DNA, 13 bp, Homo sapiens
agatagaatttcc

SEQ ID NO: 1093501 - DNA, 20 bp, Homo sapiens
agatagacagtgctgccctg

SEQ ID NO: 1093502 - DNA, 23 bp, Homo sapiens
agatagacagtgctgccctgcga

SEQ ID NO: 1093503 - DNA, 12 bp, Homo sapiens
agatagagaaat

SEQ ID NO: 1093504 - DNA, 20 bp, Homo sapiens
agatagagaaatagtgacaa

SEQ ID NO: 1093505 - DNA, 15 bp, Homo sapiens
agatagagctgggtg

SEQ ID NO: 1093506 - DNA, 14 bp, Homo sapiens
agatagatttggaa

SEQ ID NO: 1093507 - DNA, 17 bp, Homo sapiens
agatagatttggaatag

SEQ ID NO: 1093508 - DNA, 17 bp, Homo sapiens
agatagcattgtgaact

SEQ ID NO: 1093509 - DNA, 22 bp, Homo sapiens
agatagcattgtgaactgacag

SEQ ID NO: 1093510 - DNA, 18 bp, Homo sapiens
agatagccctgtcctggt

SEQ ID NO: 1093511 - DNA, 20 bp, Homo sapiens
agatagccctgtcctggtgg

SEQ ID NO: 1093512 - DNA, 14 bp, Homo sapiens
agatagcgcatata

SEQ ID NO: 1093513 - DNA, 13 bp, Homo sapiens
agatagctggggc

SEQ ID NO: 1093514 - DNA, 14 bp, Homo sapiens
agatagctggggct

SEQ ID NO: 1093515 - DNA, 14 bp, Homo sapiens
agataggaccttgg

SEQ ID NO: 1093516 - DNA, 18 bp, Homo sapiens
agataggaccttgggcca

SEQ ID NO: 1093517 - DNA, 17 bp, Homo sapiens
agataggagttctctga

SEQ ID NO: 1093518 - DNA, 13 bp, Homo sapiens
agataggctctgc

SEQ ID NO: 1093519 - DNA, 14 bp, Homo sapiens
agataggctctgca

SEQ ID NO: 1093520 - DNA, 21 bp, Homo sapiens
agataggctctgcacagatgg

SEQ ID NO: 1093521 - DNA, 18 bp, Homo sapiens
agatagtaaaacacttat

SEQ ID NO: 1093522 - DNA, 17 bp, Homo sapiens
agatagtagcatacatt

SEQ ID NO: 1093523 - DNA, 22 bp, Homo sapiens
agatagtatctagcaatcacaa

SEQ ID NO: 1093524 - DNA, 21 bp, Homo sapiens
agatagtatgcactatataca

SEQ ID NO: 1093525 - DNA, 20 bp, Homo sapiens
agatagttacaaaatacaaa

SEQ ID NO: 1093526 - DNA, 13 bp, Homo sapiens
agatagttttcat

SEQ ID NO: 1093527 - DNA, 17 bp, Homo sapiens
agatagttttcatccat

SEQ ID NO: 1093528 - DNA, 16 bp, Homo sapiens
agatataacattcagt

SEQ ID NO: 1093529 - DNA, 15 bp, Homo sapiens
agatataactgtctt

SEQ ID NO: 1093530 - DNA, 21 bp, Homo sapiens
agatataagagaagtctcatt

SEQ ID NO: 1093531 - DNA, 21 bp, Homo sapiens
agatataatgaacaaaattat

SEQ ID NO: 1093532 - DNA, 21 bp, Homo sapiens
agatatagggtgtggctccta

SEQ ID NO: 1093533 - DNA, 16 bp, Homo sapiens
agatatatacaaggtg

SEQ ID NO: 1093534 - DNA, 19 bp, Homo sapiens
agatatatacatggaatcg

SEQ ID NO: 1093535 - DNA, 14 bp, Homo sapiens
agatatatagagat

SEQ ID NO: 1093536 - DNA, 19 bp, Homo sapiens
agatatatgctctgcatgt

SEQ ID NO: 1093537 - DNA, 15 bp, Homo sapiens
agatatatttttcac

SEQ ID NO: 1093538 - DNA, 13 bp, Homo sapiens
agatatcaaaatt

SEQ ID NO: 1093539 - DNA, 21 bp, Homo sapiens
agatatcaaaattctagctgt

SEQ ID NO: 1093540 - DNA, 16 bp, Homo sapiens
agatatcagagctctt

SEQ ID NO: 1093541 - DNA, 18 bp, Homo sapiens
agatatcctctccccctc

SEQ ID NO: 1093542 - DNA, 16 bp, Homo sapiens
agatatcgacttgttt

SEQ ID NO: 1093543 - DNA, 17 bp, Homo sapiens
agatatctgagggagga

SEQ ID NO: 1093544 - DNA, 14 bp, Homo sapiens
agatatctgcatgt

SEQ ID NO: 1093545 - DNA, 21 bp, Homo sapiens
agatatcttggacaaatcaca

SEQ ID NO: 1093546 - DNA, 17 bp, Homo sapiens
agatatgaacagggccc

SEQ ID NO: 1093547 - DNA, 18 bp, Homo sapiens
agatatgaacatattgtt

SEQ ID NO: 1093548 - DNA, 15 bp, Homo sapiens
agatatgagttgttt

SEQ ID NO: 1093549 - DNA, 17 bp, Homo sapiens
agatatgatatgtaaac

SEQ ID NO: 1093550 - DNA, 17 bp, Homo sapiens
agatatggcagcgaaag

SEQ ID NO: 1093551 - DNA, 22 bp, Homo sapiens
agatattaggggggaaagtcat

SEQ ID NO: 1093552 - DNA, 14 bp, Homo sapiens
agatattattgctt

SEQ ID NO: 1093553 - DNA, 20 bp, Homo sapiens
agatattcattggcagctca

SEQ ID NO: 1093554 - DNA, 22 bp, Homo sapiens
agatattgaggccaagaatatt

SEQ ID NO: 1093555 - DNA, 19 bp, Homo sapiens
agatattgggaaggaaata

SEQ ID NO: 1093556 - DNA, 16 bp, Homo sapiens
agatgcaacctcacta

SEQ ID NO: 1093557 - DNA, 13 bp, Homo sapiens
agatgcaagatat

SEQ ID NO: 1093558 - DNA, 17 bp, Homo sapiens
agatgcaaggaccagga

SEQ ID NO: 1093559 - DNA, 18 bp, Homo sapiens
agatgcaaggaccaggac

SEQ ID NO: 1093560 - DNA, 20 bp, Homo sapiens
agatgcaaggaccaggactc

SEQ ID NO: 1093561 - DNA, 16 bp, Homo sapiens
agatgcaaggtgctgg

SEQ ID NO: 1093562 - DNA, 14 bp, Homo sapiens
agatgcaattgttt

SEQ ID NO: 1093563 - DNA, 22 bp, Homo sapiens
agatgcacgtggggcccactgc

SEQ ID NO: 1093564 - DNA, 12 bp, Homo sapiens
agatgcactgaa

SEQ ID NO: 1093565 - DNA, 15 bp, Homo sapiens
agatgcagtttggag

SEQ ID NO: 1093566 - DNA, 17 bp, Homo sapiens
agatgcatcgggaaaga

SEQ ID NO: 1093567 - DNA, 23 bp, Homo sapiens
agatgcatcgggaaagaagaaac

SEQ ID NO: 1093568 - DNA, 17 bp, Homo sapiens
agatgcatgacttgtgt

SEQ ID NO: 1093569 - DNA, 12 bp, Homo sapiens
agatgccaactt

SEQ ID NO: 1093570 - DNA, 17 bp, Homo sapiens
agatgccaacttcccac

SEQ ID NO: 1093571 - DNA, 18 bp, Homo sapiens
agatgccaacttcccaca

SEQ ID NO: 1093572 - DNA, 22 bp, Homo sapiens
agatgccaacttcccacacggc

SEQ ID NO: 1093573 - DNA, 22 bp, Homo sapiens
agatgccacttctcactcacca

SEQ ID NO: 1093574 - DNA, 19 bp, Homo sapiens
agatgccatagcataatat

SEQ ID NO: 1093575 - DNA, 17 bp, Homo sapiens
agatgccccagagctgt

SEQ ID NO: 1093576 - DNA, 23 bp, Homo sapiens
agatgccccattccttgcgcctc

SEQ ID NO: 1093577 - DNA, 21 bp, Homo sapiens
agatgccccctccaggagaga

SEQ ID NO: 1093578 - DNA, 23 bp, Homo sapiens
agatgccccctccaggagagagc

SEQ ID NO: 1093579 - DNA, 17 bp, Homo sapiens
agatgcccctgctccct

SEQ ID NO: 1093580 - DNA, 16 bp, Homo sapiens
agatgccgcatttgga

SEQ ID NO: 1093581 - DNA, 13 bp, Homo sapiens
agatgcctccacc

SEQ ID NO: 1093582 - DNA, 16 bp, Homo sapiens
agatgcctccaccgct

SEQ ID NO: 1093583 - DNA, 17 bp, Homo sapiens
agatgcctccaccgctg

SEQ ID NO: 1093584 - DNA, 18 bp, Homo sapiens
agatgcctcctgtcagat

SEQ ID NO: 1093585 - DNA, 16 bp, Homo sapiens
agatgcctgcttgata

SEQ ID NO: 1093586 - DNA, 19 bp, Homo sapiens
agatgcctgttaatttata

SEQ ID NO: 1093587 - DNA, 20 bp, Homo sapiens
agatgcggggacaggctgga

SEQ ID NO: 1093588 - DNA, 17 bp, Homo sapiens
agatgcgtgcccagctc

SEQ ID NO: 1093589 - DNA, 20 bp, Homo sapiens
agatgctaaaatccctggat

SEQ ID NO: 1093590 - DNA, 16 bp, Homo sapiens
agatgctcactttatt

SEQ ID NO: 1093591 - DNA, 13 bp, Homo sapiens
agatgctctttta

SEQ ID NO: 1093592 - DNA, 23 bp, Homo sapiens
agatgctgactgtactcctccca

SEQ ID NO: 1093593 - DNA, 13 bp, Homo sapiens
agatgctgctgaa

SEQ ID NO: 1093594 - DNA, 18 bp, Homo sapiens
agatgctgctgaagagag

SEQ ID NO: 1093595 - DNA, 17 bp, Homo sapiens
agatgctgggctgtctc

SEQ ID NO: 1093596 - DNA, 22 bp, Homo sapiens
agatgctgggctgtctctccct

SEQ ID NO: 1093597 - DNA, 18 bp, Homo sapiens
agatgctgggttggtgca

SEQ ID NO: 1093598 - DNA, 21 bp, Homo sapiens
agatgctgtcactggcagagc

SEQ ID NO: 1093599 - DNA, 19 bp, Homo sapiens
agatgcttctctccttgcc

SEQ ID NO: 1093600 - DNA, 16 bp, Homo sapiens
agatgcttctgggaga

SEQ ID NO: 1093601 - DNA, 21 bp, Homo sapiens
agatgcttggttgtgttgagg

SEQ ID NO: 1093602 - DNA, 19 bp, Homo sapiens
agatgctttcctaaatcag

SEQ ID NO: 1093603 - DNA, 18 bp, Homo sapiens
agatggaaaattcatttt

SEQ ID NO: 1093604 - DNA, 21 bp, Homo sapiens
agatggaaggccttttgcccg

SEQ ID NO: 1093605 - DNA, 23 bp, Homo sapiens
agatggaagttgcagtgagctga

SEQ ID NO: 1093606 - DNA, 20 bp, Homo sapiens
agatggacactgccaagagc

SEQ ID NO: 1093607 - DNA, 14 bp, Homo sapiens
agatggacccctcc

SEQ ID NO: 1093608 - DNA, 17 bp, Homo sapiens
agatggacccctccctt

SEQ ID NO: 1093609 - DNA, 18 bp, Homo sapiens
agatggacccctcccttg

SEQ ID NO: 1093610 - DNA, 21 bp, Homo sapiens
agatggacccctcccttgctc

SEQ ID NO: 1093611 - DNA, 15 bp, Homo sapiens
agatggacgcaggcc

SEQ ID NO: 1093612 - DNA, 17 bp, Homo sapiens
agatggacgcaggccct

SEQ ID NO: 1093613 - DNA, 17 bp, Homo sapiens
agatggactcaggatcc

SEQ ID NO: 1093614 - DNA, 22 bp, Homo sapiens
agatggagaggctgagggacag

SEQ ID NO: 1093615 - DNA, 18 bp, Homo sapiens
agatggaggttctcagag

SEQ ID NO: 1093616 - DNA, 22 bp, Homo sapiens
agatggagtcttgctctgtcac

SEQ ID NO: 1093617 - DNA, 18 bp, Homo sapiens
agatggagtttctctctt

SEQ ID NO: 1093618 - DNA, 19 bp, Homo sapiens
agatggataaactgagcct

SEQ ID NO: 1093619 - DNA, 20 bp, Homo sapiens
agatggataaactgagcctc

SEQ ID NO: 1093620 - DNA, 11 bp, Homo sapiens
agatggattct

SEQ ID NO: 1093621 - DNA, 15 bp, Homo sapiens
agatggattctcaga

SEQ ID NO: 1093622 - DNA, 16 bp, Homo sapiens
agatggattctcagat

SEQ ID NO: 1093623 - DNA, 18 bp, Homo sapiens
agatggattctcagatat

SEQ ID NO: 1093624 - DNA, 20 bp, Homo sapiens
agatggattctcagatattt

SEQ ID NO: 1093625 - DNA, 15 bp, Homo sapiens
agatggcaggagagc

SEQ ID NO: 1093626 - DNA, 21 bp, Homo sapiens
agatggcataacctgtctcac

SEQ ID NO: 1093627 - DNA, 23 bp, Homo sapiens
agatggcatatatgtgatctggg

SEQ ID NO: 1093628 - DNA, 16 bp, Homo sapiens
agatggccataggaga

SEQ ID NO: 1093629 - DNA, 14 bp, Homo sapiens
agatggccatgctc

SEQ ID NO: 1093630 - DNA, 19 bp, Homo sapiens
agatggcccaagggatggc

SEQ ID NO: 1093631 - DNA, 19 bp, Homo sapiens
agatggcccagctccccaa

SEQ ID NO: 1093632 - DNA, 17 bp, Homo sapiens
agatggcccctccactg

SEQ ID NO: 1093633 - DNA, 14 bp, Homo sapiens
agatggcctttgct

SEQ ID NO: 1093634 - DNA, 15 bp, Homo sapiens
agatggcctttgctt

SEQ ID NO: 1093635 - DNA, 19 bp, Homo sapiens
agatggcgaccaccaaagt

SEQ ID NO: 1093636 - DNA, 16 bp, Homo sapiens
agatggcgatgtgtta

SEQ ID NO: 1093637 - DNA, 17 bp, Homo sapiens
agatggcgatgtgttat

SEQ ID NO: 1093638 - DNA, 14 bp, Homo sapiens
agatggctcctctc

SEQ ID NO: 1093639 - DNA, 14 bp, Homo sapiens
agatggctgtgcct

SEQ ID NO: 1093640 - DNA, 21 bp, Homo sapiens
agatggctgtggcatttccaa

SEQ ID NO: 1093641 - DNA, 18 bp, Homo sapiens
agatggcttcggagggcc

SEQ ID NO: 1093642 - DNA, 19 bp, Homo sapiens
agatggcttcggagggccg

SEQ ID NO: 1093643 - DNA, 20 bp, Homo sapiens
agatggcttcggagggccgc

SEQ ID NO: 1093644 - DNA, 21 bp, Homo sapiens
agatggcttcggagggccgca

SEQ ID NO: 1093645 - DNA, 21 bp, Homo sapiens
agatgggaaggttagaaaggc

SEQ ID NO: 1093646 - DNA, 23 bp, Homo sapiens
agatgggaaggttagaaaggcag

SEQ ID NO: 1093647 - DNA, 13 bp, Homo sapiens
agatgggaatgag

SEQ ID NO: 1093648 - DNA, 20 bp, Homo sapiens
agatgggacaagcagtccct

SEQ ID NO: 1093649 - DNA, 14 bp, Homo sapiens
agatgggaggagac

SEQ ID NO: 1093650 - DNA, 16 bp, Homo sapiens
agatgggcatcttttg

SEQ ID NO: 1093651 - DNA, 20 bp, Homo sapiens
agatgggcatcttttgtatt

SEQ ID NO: 1093652 - DNA, 15 bp, Homo sapiens
agatggggcgggggt

SEQ ID NO: 1093653 - DNA, 16 bp, Homo sapiens
agatgggggcagggct

SEQ ID NO: 1093654 - DNA, 22 bp, Homo sapiens
agatgggggcagggctgtgctt

SEQ ID NO: 1093655 - DNA, 16 bp, Homo sapiens
agatgggggcttcttc

SEQ ID NO: 1093656 - DNA, 20 bp, Homo sapiens
agatgggggcttcttcctca

SEQ ID NO: 1093657 - DNA, 18 bp, Homo sapiens
agatggggtctgtgactg

SEQ ID NO: 1093658 - DNA, 15 bp, Homo sapiens
agatggggtttcacc

SEQ ID NO: 1093659 - DNA, 16 bp, Homo sapiens
agatggggtttcacca

SEQ ID NO: 1093660 - DNA, 22 bp, Homo sapiens
agatgggtctggctgagctgaa

SEQ ID NO: 1093661 - DNA, 20 bp, Homo sapiens
agatggtaatctacagctca

SEQ ID NO: 1093662 - DNA, 16 bp, Homo sapiens
agatggtactgctgag

SEQ ID NO: 1093663 - DNA, 19 bp, Homo sapiens
agatggtccatttgttcct

SEQ ID NO: 1093664 - DNA, 14 bp, Homo sapiens
agatggtccgtgcc

SEQ ID NO: 1093665 - DNA, 23 bp, Homo sapiens
agatggtccgtgcccaggccctt

SEQ ID NO: 1093666 - DNA, 22 bp, Homo sapiens
agatggtgaggctgtcagtgta

SEQ ID NO: 1093667 - DNA, 17 bp, Homo sapiens
agatggtgctgctaatt

SEQ ID NO: 1093668 - DNA, 14 bp, Homo sapiens
agatggtggctgtg

SEQ ID NO: 1093669 - DNA, 19 bp, Homo sapiens
agatggtgtgtccagcact

SEQ ID NO: 1093670 - DNA, 19 bp, Homo sapiens
agatggttaaaaaggccaa

SEQ ID NO: 1093671 - DNA, 21 bp, Homo sapiens
agatggttaaaaaggccaaag

SEQ ID NO: 1093672 - DNA, 15 bp, Homo sapiens
agatggttaaacatt

SEQ ID NO: 1093673 - DNA, 18 bp, Homo sapiens
agatggtttcaattcaga

SEQ ID NO: 1093674 - DNA, 14 bp, Homo sapiens
agatgtaatgtttt

SEQ ID NO: 1093675 - DNA, 17 bp, Homo sapiens
agatgtaatgttttctt

SEQ ID NO: 1093676 - DNA, 23 bp, Homo sapiens
agatgtaatgttttctttgcaaa

SEQ ID NO: 1093677 - DNA, 13 bp, Homo sapiens
agcaaaatcaaca

SEQ ID NO: 1093678 - DNA, 14 bp, Homo sapiens
agcaaaatcatttt

SEQ ID NO: 1093679 - DNA, 16 bp, Homo sapiens
agcaaaatggaagcaa

SEQ ID NO: 1093680 - DNA, 19 bp, Homo sapiens
agcaaaatggaagcaaaga

SEQ ID NO: 1093681 - DNA, 13 bp, Homo sapiens
agcaaacagagga

SEQ ID NO: 1093682 - DNA, 22 bp, Homo sapiens
agcaaacagctgaaagaggagg

SEQ ID NO: 1093683 - DNA, 12 bp, Homo sapiens
agcaaaccatta

SEQ ID NO: 1093684 - DNA, 14 bp, Homo sapiens
agcaaacccagagg

SEQ ID NO: 1093685 - DNA, 18 bp, Homo sapiens
agcaaaccgccctgcagc

SEQ ID NO: 1093686 - DNA, 18 bp, Homo sapiens
agcaaactatgatttatt

SEQ ID NO: 1093687 - DNA, 13 bp, Homo sapiens
agcaaactctgct

SEQ ID NO: 1093688 - DNA, 17 bp, Homo sapiens
agcaaactcttttccca

SEQ ID NO: 1093689 - DNA, 18 bp, Homo sapiens
agcaaactgatgctgagg

SEQ ID NO: 1093690 - DNA, 16 bp, Homo sapiens
agcaaagacaaaagaa

SEQ ID NO: 1093691 - DNA, 14 bp, Homo sapiens
agcaaagaggggcg

SEQ ID NO: 1093692 - DNA, 17 bp, Homo sapiens
agcaaagaggggcgctg

SEQ ID NO: 1093693 - DNA, 22 bp, Homo sapiens
agcaaagagtgggctgcatctg

SEQ ID NO: 1093694 - DNA, 13 bp, Homo sapiens
agcaaagatcaaa

SEQ ID NO: 1093695 - DNA, 22 bp, Homo sapiens
agcaaagatttcagtagaattt

SEQ ID NO: 1093696 - DNA, 22 bp, Homo sapiens
agcaaagcaccagcttctccag

SEQ ID NO: 1093697 - DNA, 19 bp, Homo sapiens
agcaaagcacccatttcaa

SEQ ID NO: 1093698 - DNA, 22 bp, Homo sapiens
agcaaagcacccatttcaatgt

SEQ ID NO: 1093699 - DNA, 18 bp, Homo sapiens
agcaaagctacaggactg

SEQ ID NO: 1093700 - DNA, 22 bp, Homo sapiens
agcaaaggagacaaagcaggag

SEQ ID NO: 1093701 - DNA, 20 bp, Homo sapiens
agcaaaggcagtcccgggag

SEQ ID NO: 1093702 - DNA, 20 bp, Homo sapiens
agcaaaggcccatgccccct

SEQ ID NO: 1093703 - DNA, 13 bp, Homo sapiens
agcaaagggggga

SEQ ID NO: 1093704 - DNA, 15 bp, Homo sapiens
agcaaaggggggagg

SEQ ID NO: 1093705 - DNA, 18 bp, Homo sapiens
agcaaaggggggaggtca

SEQ ID NO: 1093706 - DNA, 20 bp, Homo sapiens
agcaaagtagatcatgcata

SEQ ID NO: 1093707 - DNA, 20 bp, Homo sapiens
agcaaatagattaatgacgt

SEQ ID NO: 1093708 - DNA, 22 bp, Homo sapiens
agcaaatcatttgtttaaaaag

SEQ ID NO: 1093709 - DNA, 15 bp, Homo sapiens
agcaaatcgaatgaa

SEQ ID NO: 1093710 - DNA, 17 bp, Homo sapiens
agcaaatcgaatgaaat

SEQ ID NO: 1093711 - DNA, 22 bp, Homo sapiens
agcaaatctttctgtaaacaga

SEQ ID NO: 1093712 - DNA, 18 bp, Homo sapiens
agcaaatggaaaatgtat

SEQ ID NO: 1093713 - DNA, 20 bp, Homo sapiens
agcaaatggcctcatgtcaa

SEQ ID NO: 1093714 - DNA, 14 bp, Homo sapiens
agcaaatgtttctg

SEQ ID NO: 1093715 - DNA, 18 bp, Homo sapiens
agcaaatgtttctgcagt

SEQ ID NO: 1093716 - DNA, 19 bp, Homo sapiens
agcaaattgctagtcaggg

SEQ ID NO: 1093717 - DNA, 15 bp, Homo sapiens
agcaaatttaagaga

SEQ ID NO: 1093718 - DNA, 17 bp, Homo sapiens
agcaacaagactgccag

SEQ ID NO: 1093719 - DNA, 17 bp, Homo sapiens
agcaacacaagctggaa

SEQ ID NO: 1093720 - DNA, 18 bp, Homo sapiens
agcaacacaagctggaag

SEQ ID NO: 1093721 - DNA, 20 bp, Homo sapiens
agcaacacaagctggaagca

SEQ ID NO: 1093722 - DNA, 16 bp, Homo sapiens
agcaacagaaaaatgg

SEQ ID NO: 1093723 - DNA, 18 bp, Homo sapiens
agcaacagactctcacag

SEQ ID NO: 1093724 - DNA, 23 bp, Homo sapiens
agcaacagagtgagaccctgtct

SEQ ID NO: 1093725 - DNA, 17 bp, Homo sapiens
agcaacagcaagaaata

SEQ ID NO: 1093726 - DNA, 17 bp, Homo sapiens
agcaacagcttcagaaa

SEQ ID NO: 1093727 - DNA, 19 bp, Homo sapiens
agcaacaggttttataatt

SEQ ID NO: 1093728 - DNA, 19 bp, Homo sapiens
agcaacatatctctgccgt

SEQ ID NO: 1093729 - DNA, 17 bp, Homo sapiens
agcaaccagctggaagg

SEQ ID NO: 1093730 - DNA, 14 bp, Homo sapiens
agcaaccccaggct

SEQ ID NO: 1093731 - DNA, 16 bp, Homo sapiens
agcaaccccaggctga

SEQ ID NO: 1093732 - DNA, 22 bp, Homo sapiens
agcaaccctcctatcacctccc

SEQ ID NO: 1093733 - DNA, 15 bp, Homo sapiens
agcaacctacccagc

SEQ ID NO: 1093734 - DNA, 15 bp, Homo sapiens
agcaacctcagtaat

SEQ ID NO: 1093735 - DNA, 19 bp, Homo sapiens
agcaacgcccctccaaacc

SEQ ID NO: 1093736 - DNA, 20 bp, Homo sapiens
agcaacgcccctccaaacct

SEQ ID NO: 1093737 - DNA, 14 bp, Homo sapiens
agcaacgcttgtag

SEQ ID NO: 1093738 - DNA, 23 bp, Homo sapiens
agcaacgcttgtagaactcactc

SEQ ID NO: 1093739 - DNA, 21 bp, Homo sapiens
agcaacggcccatagccttgg

SEQ ID NO: 1093740 - DNA, 22 bp, Homo sapiens
agcaacggcccatagccttggg

SEQ ID NO: 1093741 - DNA, 20 bp, Homo sapiens
agcaacgtagcttctaccat

SEQ ID NO: 1093742 - DNA, 16 bp, Homo sapiens
agcaactaggccttca

SEQ ID NO: 1093743 - DNA, 14 bp, Homo sapiens
agcaactgacctga

SEQ ID NO: 1093744 - DNA, 17 bp, Homo sapiens
agcaactgcccttccag

SEQ ID NO: 1093745 - DNA, 17 bp, Homo sapiens
agcaactgttatgaaat

SEQ ID NO: 1093746 - DNA, 21 bp, Homo sapiens
agcaactgttatgaaataaag

SEQ ID NO: 1093747 - DNA, 15 bp, Homo sapiens
agcaacttcttctcc

SEQ ID NO: 1093748 - DNA, 15 bp, Homo sapiens
agcaacttgtctttt

SEQ ID NO: 1093749 - DNA, 20 bp, Homo sapiens
agcaacttgtctttttctgg

SEQ ID NO: 1093750 - DNA, 16 bp, Homo sapiens
agcaagaaacagtttc

SEQ ID NO: 1093751 - DNA, 11 bp, Homo sapiens
agcaagaaata

SEQ ID NO: 1093752 - DNA, 22 bp, Homo sapiens
agcaagaagaaaatgtggccct

SEQ ID NO: 1093753 - DNA, 18 bp, Homo sapiens
agcaagaagggagttcca

SEQ ID NO: 1093754 - DNA, 21 bp, Homo sapiens
agcaagaataaaaaagaaatc

SEQ ID NO: 1093755 - DNA, 15 bp, Homo sapiens
agcaagacagagacg

SEQ ID NO: 1093756 - DNA, 19 bp, Homo sapiens
agcaagactctttcaaaaa

SEQ ID NO: 1093757 - DNA, 17 bp, Homo sapiens
agcaagactgttagccc

SEQ ID NO: 1093758 - DNA, 12 bp, Homo sapiens
agcaagagagat

SEQ ID NO: 1093759 - DNA, 22 bp, Homo sapiens
agcaagaggcaagctgaaattt

SEQ ID NO: 1093760 - DNA, 16 bp, Homo sapiens
agcaagagggaacaaa

SEQ ID NO: 1093761 - DNA, 21 bp, Homo sapiens
agcaagagggaacaaaactgt

SEQ ID NO: 1093762 - DNA, 20 bp, Homo sapiens
agcaagatattgatcaaata

SEQ ID NO: 1093763 - DNA, 19 bp, Homo sapiens
agcaagcagtctaccctgt

SEQ ID NO: 1093764 - DNA, 18 bp, Homo sapiens
agcaagcattcagaagaa

SEQ ID NO: 1093765 - DNA, 11 bp, Homo sapiens
agcaagccaga

SEQ ID NO: 1093766 - DNA, 12 bp, Homo sapiens
agcaagccagac

SEQ ID NO: 1093767 - DNA, 19 bp, Homo sapiens
agcaagccctacagagctg

SEQ ID NO: 1093768 - DNA, 17 bp, Homo sapiens
agcaagcttaatggctg

SEQ ID NO: 1093769 - DNA, 12 bp, Homo sapiens
agcaaggcaggt

SEQ ID NO: 1093770 - DNA, 23 bp, Homo sapiens
agcaaggccttggtggagcagcc

SEQ ID NO: 1093771 - DNA, 24 bp, Homo sapiens
agcaaggccttggtggagcagcca

SEQ ID NO: 1093772 - DNA, 13 bp, Homo sapiens
agcaaggctgggt

SEQ ID NO: 1093773 - DNA, 14 bp, Homo sapiens
agcaagggagaaaa

SEQ ID NO: 1093774 - DNA, 15 bp, Homo sapiens
agcaagggagaaaag

SEQ ID NO: 1093775 - DNA, 21 bp, Homo sapiens
agcaagggagaaaagagaaac

SEQ ID NO: 1093776 - DNA, 18 bp, Homo sapiens
agcaagggggtgatgtag

SEQ ID NO: 1093777 - DNA, 23 bp, Homo sapiens
agcaaggtgctcacaccccattg

SEQ ID NO: 1093778 - DNA, 18 bp, Homo sapiens
agcaaggtttcgtggcag

SEQ ID NO: 1093779 - DNA, 20 bp, Homo sapiens
agcaaggtttcgtggcagca

SEQ ID NO: 1093780 - DNA, 13 bp, Homo sapiens
agcaagtaaaaag

SEQ ID NO: 1093781 - DNA, 20 bp, Homo sapiens
agcaagtacagcggctcccc

SEQ ID NO: 1093782 - DNA, 15 bp, Homo sapiens
agcaagtagataaat

SEQ ID NO: 1093783 - DNA, 22 bp, Homo sapiens
agcaagtcccagacaaggagag

SEQ ID NO: 1093784 - DNA, 20 bp, Homo sapiens
agcaagtcttaacaaaccaa

SEQ ID NO: 1093785 - DNA, 16 bp, Homo sapiens
agcaagtgagaccctg

SEQ ID NO: 1093786 - DNA, 22 bp, Homo sapiens
agcaagtgagtctggtggagga

SEQ ID NO: 1093787 - DNA, 19 bp, Homo sapiens
agcaagtgtgcactccagc

SEQ ID NO: 1093788 - DNA, 17 bp, Homo sapiens
agcaagtgttcactgct

SEQ ID NO: 1093789 - DNA, 21 bp, Homo sapiens
agcaagtgttcactgctcctt

SEQ ID NO: 1093790 - DNA, 16 bp, Homo sapiens
agcaagttacagtgat

SEQ ID NO: 1093791 - DNA, 15 bp, Homo sapiens
agcaagttcgtctgt

SEQ ID NO: 1093792 - DNA, 18 bp, Homo sapiens
agcaagttcgtctgttgt

SEQ ID NO: 1093793 - DNA, 17 bp, Homo sapiens
agcaagttctagagaag

SEQ ID NO: 1093794 - DNA, 17 bp, Homo sapiens
agcaataaaaactgtct

SEQ ID NO: 1093795 - DNA, 17 bp, Homo sapiens
agcaataaagatttttc

SEQ ID NO: 1093796 - DNA, 14 bp, Homo sapiens
agcaataaatgaat

SEQ ID NO: 1093797 - DNA, 15 bp, Homo sapiens
agcaataaatgaatg

SEQ ID NO: 1093798 - DNA, 22 bp, Homo sapiens
agcactttgaaaatatttctat

SEQ ID NO: 1093799 - DNA, 23 bp, Homo sapiens
agcactttgggaggccaaggtgg

SEQ ID NO: 1093800 - DNA, 21 bp, Homo sapiens
agcactttgggaggccgaggc

SEQ ID NO: 1093801 - DNA, 18 bp, Homo sapiens
agcactttgggaggctga

SEQ ID NO: 1093802 - DNA, 19 bp, Homo sapiens
agcactttgggaggctgag

SEQ ID NO: 1093803 - DNA, 21 bp, Homo sapiens
agcactttgggaggctgaggc

SEQ ID NO: 1093804 - DNA, 22 bp, Homo sapiens
agcactttgggaggctgaggcg

SEQ ID NO: 1093805 - DNA, 14 bp, Homo sapiens
agcacttttaaaaa

SEQ ID NO: 1093806 - DNA, 16 bp, Homo sapiens
agcacttttaaaaaaa

SEQ ID NO: 1093807 - DNA, 19 bp, Homo sapiens
agcagaaaaaaaagtgtct

SEQ ID NO: 1093808 - DNA, 23 bp, Homo sapiens
agcagaaaaaaaagtgtctcaaa

SEQ ID NO: 1093809 - DNA, 15 bp, Homo sapiens
agcagaaaacccttg

SEQ ID NO: 1093810 - DNA, 21 bp, Homo sapiens
agcagaaagtaagcatttcca

SEQ ID NO: 1093811 - DNA, 14 bp, Homo sapiens
agcagaaagtgcct

SEQ ID NO: 1093812 - DNA, 15 bp, Homo sapiens
agcagaaatctagaa

SEQ ID NO: 1093813 - DNA, 12 bp, Homo sapiens
agcagaaatgcc

SEQ ID NO: 1093814 - DNA, 13 bp, Homo sapiens
agcagaacaaatg

SEQ ID NO: 1093815 - DNA, 15 bp, Homo sapiens
agcagaacaggtagt

SEQ ID NO: 1093816 - DNA, 24 bp, Homo sapiens
agcagaacctgcacacaggacagc

SEQ ID NO: 1093817 - DNA, 15 bp, Homo sapiens
agcagaactgaagcc

SEQ ID NO: 1093818 - DNA, 13 bp, Homo sapiens
agcagaagacaaa

SEQ ID NO: 1093819 - DNA, 19 bp, Homo sapiens
agcagaagccccacagcct

SEQ ID NO: 1093820 - DNA, 23 bp, Homo sapiens
agcagaagcctccaagcacagag

SEQ ID NO: 1093821 - DNA, 15 bp, Homo sapiens
agcagaagtctggct

SEQ ID NO: 1093822 - DNA, 13 bp, Homo sapiens
agcagaatactgg

SEQ ID NO: 1093823 - DNA, 19 bp, Homo sapiens
agcagaatagcaaggtgct

SEQ ID NO: 1093824 - DNA, 15 bp, Homo sapiens
agcagaatggagaaa

SEQ ID NO: 1093825 - DNA, 16 bp, Homo sapiens
agcagaatggaggcag

SEQ ID NO: 1093826 - DNA, 12 bp, Homo sapiens
agcagacacatg

SEQ ID NO: 1093827 - DNA, 16 bp, Homo sapiens
agcagacacatgccag

SEQ ID NO: 1093828 - DNA, 17 bp, Homo sapiens
agcagacagaaactgga

SEQ ID NO: 1093829 - DNA, 15 bp, Homo sapiens
agcagacagagccag

SEQ ID NO: 1093830 - DNA, 19 bp, Homo sapiens
agcagacagagccaggaga

SEQ ID NO: 1093831 - DNA, 22 bp, Homo sapiens
agcagaccaccccgcctgccct

SEQ ID NO: 1093832 - DNA, 14 bp, Homo sapiens
agcagaccagcttt

SEQ ID NO: 1093833 - DNA, 21 bp, Homo sapiens
agcagacccatacctttccag

SEQ ID NO: 1093834 - DNA, 23 bp, Homo sapiens
agcagacgcagcagctgggaccc

SEQ ID NO: 1093835 - DNA, 19 bp, Homo sapiens
agcagactcagctctgaca

SEQ ID NO: 1093836 - DNA, 13 bp, Homo sapiens
agcagactccagc

SEQ ID NO: 1093837 - DNA, 21 bp, Homo sapiens
agcagactttcccaaatgtat

SEQ ID NO: 1093838 - DNA, 14 bp, Homo sapiens
agcagagaattctc

SEQ ID NO: 1093839 - DNA, 21 bp, Homo sapiens
agcagagaattctcttatcca

SEQ ID NO: 1093840 - DNA, 22 bp, Homo sapiens
agcagagagagaggacagaggg

SEQ ID NO: 1093841 - DNA, 17 bp, Homo sapiens
agcagagagagccagac

SEQ ID NO: 1093842 - DNA, 19 bp, Homo sapiens
agcagagagccctgggtga

SEQ ID NO: 1093843 - DNA, 14 bp, Homo sapiens
agcagagaggtggc

SEQ ID NO: 1093844 - DNA, 18 bp, Homo sapiens
agcagagaggtggccacc

SEQ ID NO: 1093845 - DNA, 17 bp, Homo sapiens
agcagagcaaatgaggg

SEQ ID NO: 1093846 - DNA, 14 bp, Homo sapiens
agcagagcaggggc

SEQ ID NO: 1093847 - DNA, 15 bp, Homo sapiens
agcagagccaaggcc

SEQ ID NO: 1093848 - DNA, 17 bp, Homo sapiens
agcagagccaaggccac

SEQ ID NO: 1093849 - DNA, 19 bp, Homo sapiens
agcagagcccaccagccag

SEQ ID NO: 1093850 - DNA, 14 bp, Homo sapiens
agcagagcctcctg

SEQ ID NO: 1093851 - DNA, 16 bp, Homo sapiens
agcagagcctcctggg

SEQ ID NO: 1093852 - DNA, 22 bp, Homo sapiens
agcagagcctcctgggaacaca

SEQ ID NO: 1093853 - DNA, 13 bp, Homo sapiens
agcagaggcagtg

SEQ ID NO: 1093854 - DNA, 18 bp, Homo sapiens
agcagaggcagtggccac

SEQ ID NO: 1093855 - DNA, 15 bp, Homo sapiens
agcagagggaggaag

SEQ ID NO: 1093856 - DNA, 14 bp, Homo sapiens
agcagagggggagt

SEQ ID NO: 1093857 - DNA, 21 bp, Homo sapiens
agcagaggtgagaactcagaa

SEQ ID NO: 1093858 - DNA, 22 bp, Homo sapiens
agcagaggtgagaactcagaag

SEQ ID NO: 1093859 - DNA, 18 bp, Homo sapiens
agcagaggtttaaatgta

SEQ ID NO: 1093860 - DNA, 20 bp, Homo sapiens
agcagaggtttgctgacagg

SEQ ID NO: 1093861 - DNA, 20 bp, Homo sapiens
agcagagtccttattcttct

SEQ ID NO: 1093862 - DNA, 14 bp, Homo sapiens
agcagagtctgtct

SEQ ID NO: 1093863 - DNA, 15 bp, Homo sapiens
agcagagtctgtctc

SEQ ID NO: 1093864 - DNA, 21 bp, Homo sapiens
agcagagtgagcaagggggcc

SEQ ID NO: 1093865 - DNA, 20 bp, Homo sapiens
agcagagtggactgcattta

SEQ ID NO: 1093866 - DNA, 22 bp, Homo sapiens
agcagagtgggacttggagagc

SEQ ID NO: 1093867 - DNA, 14 bp, Homo sapiens
agcagagttaaatc

SEQ ID NO: 1093868 - DNA, 19 bp, Homo sapiens
agcagagttattgaatctt

SEQ ID NO: 1093869 - DNA, 22 bp, Homo sapiens
agcagatacatatgagtgtgga

SEQ ID NO: 1093870 - DNA, 16 bp, Homo sapiens
agcagatctcatctca

SEQ ID NO: 1093871 - DNA, 21 bp, Homo sapiens
agcagatgctgttgtgaagct

SEQ ID NO: 1093872 - DNA, 17 bp, Homo sapiens
agcagatggaaagaaag

SEQ ID NO: 1093873 - DNA, 16 bp, Homo sapiens
agcagatggggagggt

SEQ ID NO: 1093874 - DNA, 14 bp, Homo sapiens
agcagattacctct

SEQ ID NO: 1093875 - DNA, 20 bp, Homo sapiens
agcagattacctcttgccct

SEQ ID NO: 1093876 - DNA, 22 bp, Homo sapiens
agcagattgtttcctcttccaa

SEQ ID NO: 1093877 - DNA, 18 bp, Homo sapiens
agcagatttaacaattcc

SEQ ID NO: 1093878 - DNA, 13 bp, Homo sapiens
agcagattttaat

SEQ ID NO: 1093879 - DNA, 20 bp, Homo sapiens
agcagcaagaagcagcctgt

SEQ ID NO: 1093880 - DNA, 12 bp, Homo sapiens
agcagcacaatt

SEQ ID NO: 1093881 - DNA, 20 bp, Homo sapiens
agcagcacaattctgtccct

SEQ ID NO: 1093882 - DNA, 21 bp, Homo sapiens
agcagcacaattctgtccctg

SEQ ID NO: 1093883 - DNA, 18 bp, Homo sapiens
agcagcaccaaccacagc

SEQ ID NO: 1093884 - DNA, 20 bp, Homo sapiens
agcagcaccgttctgtgcac

SEQ ID NO: 1093885 - DNA, 19 bp, Homo sapiens
agcagcactcccgctgcac

SEQ ID NO: 1093886 - DNA, 23 bp, Homo sapiens
agcagcactccgcatcacctcac

SEQ ID NO: 1093887 - DNA, 18 bp, Homo sapiens
agcagcagaatggaaaaa

SEQ ID NO: 1093888 - DNA, 22 bp, Homo sapiens
agcagcagagagccctgggtga

SEQ ID NO: 1093889 - DNA, 23 bp, Homo sapiens
agcagcagaggtgagaactcaga

SEQ ID NO: 1093890 - DNA, 13 bp, Homo sapiens
agcagcagcagca

SEQ ID NO: 1093891 - DNA, 16 bp, Homo sapiens
agcagcagcagcagca

SEQ ID NO: 1093892 - DNA, 12 bp, Homo sapiens
agcagcagcagg

SEQ ID NO: 1093893 - DNA, 16 bp, Homo sapiens
agcagcagcaggtgat

SEQ ID NO: 1093894 - DNA, 18 bp, Homo sapiens
agcagcagccactgcaca

SEQ ID NO: 1093895 - DNA, 13 bp, Homo sapiens
agcagcagccagc

SEQ ID NO: 1093896 - DNA, 14 bp, Homo sapiens
agcagcagcccaag

SEQ ID NO: 1093897 - DNA, 19 bp, Homo sapiens
agcagcagcttggggagag

SEQ ID NO: 1093898 - DNA, 14 bp, Homo sapiens
agcagcaggaaggc

SEQ ID NO: 1093899 - DNA, 14 bp, Homo sapiens
agcagcaggctcag

SEQ ID NO: 1093900 - DNA, 16 bp, Homo sapiens
agcagcagggagggct

SEQ ID NO: 1093901 - DNA, 13 bp, Homo sapiens
agcagcaggtgat

SEQ ID NO: 1093902 - DNA, 15 bp, Homo sapiens
agcagcatcccagcc

SEQ ID NO: 1093903 - DNA, 19 bp, Homo sapiens
agcagcatcccagccttga

SEQ ID NO: 1093904 - DNA, 18 bp, Homo sapiens
agcagcatctgctaataa

SEQ ID NO: 1093905 - DNA, 14 bp, Homo sapiens
agcagcatggaaaa

SEQ ID NO: 1093906 - DNA, 15 bp, Homo sapiens
agcagcatggaaaaa

SEQ ID NO: 1093907 - DNA, 21 bp, Homo sapiens
agcagcatggaaaaatggttg

SEQ ID NO: 1093908 - DNA, 17 bp, Homo sapiens
agcagcatggcatagcc

SEQ ID NO: 1093909 - DNA, 18 bp, Homo sapiens
agcagccacacttccttt

SEQ ID NO: 1093910 - DNA, 20 bp, Homo sapiens
agcagccacacttcctttag

SEQ ID NO: 1093911 - DNA, 21 bp, Homo sapiens
agcagccactgcacaggagga

SEQ ID NO: 1093912 - DNA, 12 bp, Homo sapiens
agcagccagagc

SEQ ID NO: 1093913 - DNA, 17 bp, Homo sapiens
agcagccagagctgtgc

SEQ ID NO: 1093914 - DNA, 18 bp, Homo sapiens
agcagccagagctgtgcc

SEQ ID NO: 1093915 - DNA, 15 bp, Homo sapiens
agcagccagcaccac

SEQ ID NO: 1093916 - DNA, 13 bp, Homo sapiens
agcagccagccag

SEQ ID NO: 1093917 - DNA, 21 bp, Homo sapiens
agcagccagccagtcttgcct

SEQ ID NO: 1093918 - DNA, 15 bp, Homo sapiens
agcagccagctctca

SEQ ID NO: 1093919 - DNA, 16 bp, Homo sapiens
agcagccagctctcag

SEQ ID NO: 1093920 - DNA, 23 bp, Homo sapiens
agcccttccatgtcgcctctgca

SEQ ID NO: 1093921 - DNA, 13 bp, Homo sapiens
agcccttccctga

SEQ ID NO: 1093922 - DNA, 15 bp, Homo sapiens
agcccttccctgagt

SEQ ID NO: 1093923 - DNA, 14 bp, Homo sapiens
agcccttcctacct

SEQ ID NO: 1093924 - DNA, 18 bp, Homo sapiens
agcccttcctacctctgg

SEQ ID NO: 1093925 - DNA, 14 bp, Homo sapiens
agcccttccttggg

SEQ ID NO: 1093926 - DNA, 16 bp, Homo sapiens
agcccttcggtcacct

SEQ ID NO: 1093927 - DNA, 17 bp, Homo sapiens
agcccttctgcctttct

SEQ ID NO: 1093928 - DNA, 20 bp, Homo sapiens
agcccttgactgtacagaga

SEQ ID NO: 1093929 - DNA, 22 bp, Homo sapiens
agcccttgcccccatccctcgg

SEQ ID NO: 1093930 - DNA, 12 bp, Homo sapiens
agcccttgcctc

SEQ ID NO: 1093931 - DNA, 13 bp, Homo sapiens
agcccttgggcag

SEQ ID NO: 1093932 - DNA, 14 bp, Homo sapiens
agcccttgggcagt

SEQ ID NO: 1093933 - DNA, 18 bp, Homo sapiens
agcccttgtgtgtgccct

SEQ ID NO: 1093934 - DNA, 20 bp, Homo sapiens
agcccttgtgtgtgccctgg

SEQ ID NO: 1093935 - DNA, 21 bp, Homo sapiens
agcccttgtgtgtgccctggg

SEQ ID NO: 1093936 - DNA, 21 bp, Homo sapiens
agccctttacttgacctccta

SEQ ID NO: 1093937 - DNA, 13 bp, Homo sapiens
agccctttctgtg

SEQ ID NO: 1093938 - DNA, 21 bp, Homo sapiens
agccctttgggaggctgaggc

SEQ ID NO: 1093939 - DNA, 23 bp, Homo sapiens
agcccttttgttgagccaggcct

SEQ ID NO: 1093940 - DNA, 14 bp, Homo sapiens
agccgaagcccagg

SEQ ID NO: 1093941 - DNA, 13 bp, Homo sapiens
agccgacctcagc

SEQ ID NO: 1093942 - DNA, 14 bp, Homo sapiens
agccgacctcagcc

SEQ ID NO: 1093943 - DNA, 12 bp, Homo sapiens
agccgactctgg

SEQ ID NO: 1093944 - DNA, 13 bp, Homo sapiens
agccgactctggc

SEQ ID NO: 1093945 - DNA, 20 bp, Homo sapiens
agccgactctggccctggcc

SEQ ID NO: 1093946 - DNA, 23 bp, Homo sapiens
agccgactgcacagcggcccctg

SEQ ID NO: 1093947 - DNA, 14 bp, Homo sapiens
agccgactgtcttg

SEQ ID NO: 1093948 - DNA, 13 bp, Homo sapiens
agccgagagcctg

SEQ ID NO: 1093949 - DNA, 16 bp, Homo sapiens
agccgagagcctgctc

SEQ ID NO: 1093950 - DNA, 17 bp, Homo sapiens
agccgagagcctgctcc

SEQ ID NO: 1093951 - DNA, 21 bp, Homo sapiens
agccgagagcctgctccccca

SEQ ID NO: 1093952 - DNA, 18 bp, Homo sapiens
agccgagatcacgccact

SEQ ID NO: 1093953 - DNA, 17 bp, Homo sapiens
agccgagattgcaccac

SEQ ID NO: 1093954 - DNA, 19 bp, Homo sapiens
agccgagattgcaccactg

SEQ ID NO: 1093955 - DNA, 19 bp, Homo sapiens
agccgagattgcgccattg

SEQ ID NO: 1093956 - DNA, 16 bp, Homo sapiens
agccgagccgggcctg

SEQ ID NO: 1093957 - DNA, 18 bp, Homo sapiens
agccgagccgggcctggg

SEQ ID NO: 1093958 - DNA, 21 bp, Homo sapiens
agccgagccgggcctggggct

SEQ ID NO: 1093959 - DNA, 23 bp, Homo sapiens
agccgagctcgtgtatcctgggg

SEQ ID NO: 1093960 - DNA, 14 bp, Homo sapiens
agccgattctctgc

SEQ ID NO: 1093961 - DNA, 15 bp, Homo sapiens
agccgcattggtgac

SEQ ID NO: 1093962 - DNA, 15 bp, Homo sapiens
agccgccagctggga

SEQ ID NO: 1093963 - DNA, 20 bp, Homo sapiens
agccgccattgccaccagga

SEQ ID NO: 1093964 - DNA, 21 bp, Homo sapiens
agccgccattgccaccaggag

SEQ ID NO: 1093965 - DNA, 12 bp, Homo sapiens
agccgccctgag

SEQ ID NO: 1093966 - DNA, 12 bp, Homo sapiens
agccgccctggg

SEQ ID NO: 1093967 - DNA, 19 bp, Homo sapiens
agccgcctgaaagccacaa

SEQ ID NO: 1093968 - DNA, 17 bp, Homo sapiens
agccgccttaagctgat

SEQ ID NO: 1093969 - DNA, 22 bp, Homo sapiens
agccgctcctgtctgccagcca

SEQ ID NO: 1093970 - DNA, 16 bp, Homo sapiens
agccggaggaggagat

SEQ ID NO: 1093971 - DNA, 20 bp, Homo sapiens
agccggagggacgcggagga

SEQ ID NO: 1093972 - DNA, 14 bp, Homo sapiens
agccggcacagggt

SEQ ID NO: 1093973 - DNA, 15 bp, Homo sapiens
agccggcacagggtc

SEQ ID NO: 1093974 - DNA, 19 bp, Homo sapiens
agccggcatccttgcctgt

SEQ ID NO: 1093975 - DNA, 20 bp, Homo sapiens
agccggccgccttctcccct

SEQ ID NO: 1093976 - DNA, 22 bp, Homo sapiens
agccggccgccttctcccctct

SEQ ID NO: 1093977 - DNA, 23 bp, Homo sapiens
agccgggaccctcaggtgtagct

SEQ ID NO: 1093978 - DNA, 23 bp, Homo sapiens
agccgggaggaaaaggcccctgc

SEQ ID NO: 1093979 - DNA, 13 bp, Homo sapiens
agccgggcaagtc

SEQ ID NO: 1093980 - DNA, 16 bp, Homo sapiens
agccgggcccctgggc

SEQ ID NO: 1093981 - DNA, 13 bp, Homo sapiens
agccgggcctggg

SEQ ID NO: 1093982 - DNA, 13 bp, Homo sapiens
agccgggggaggg

SEQ ID NO: 1093983 - DNA, 15 bp, Homo sapiens
agccgggggaggggc

SEQ ID NO: 1093984 - DNA, 16 bp, Homo sapiens
agccgggggaggggcc

SEQ ID NO: 1093985 - DNA, 19 bp, Homo sapiens
agccgggggaggggccctc

SEQ ID NO: 1093986 - DNA, 20 bp, Homo sapiens
agccgggggaggggccctca

SEQ ID NO: 1093987 - DNA, 22 bp, Homo sapiens
agccgggggaggggccctcagg

SEQ ID NO: 1093988 - DNA, 15 bp, Homo sapiens
agccgggggctggcc

SEQ ID NO: 1093989 - DNA, 22 bp, Homo sapiens
agccgggggctggccttctcct

SEQ ID NO: 1093990 - DNA, 19 bp, Homo sapiens
agccggggtgtaacttcct

SEQ ID NO: 1093991 - DNA, 16 bp, Homo sapiens
agccgggtctgcctct

SEQ ID NO: 1093992 - DNA, 20 bp, Homo sapiens
agccgggtctgcctcttctg

SEQ ID NO: 1093993 - DNA, 17 bp, Homo sapiens
agccggtaactgtcctg

SEQ ID NO: 1093994 - DNA, 18 bp, Homo sapiens
agccggtaactgtcctgt

SEQ ID NO: 1093995 - DNA, 20 bp, Homo sapiens
agccggtaactgtcctgtcc

SEQ ID NO: 1093996 - DNA, 21 bp, Homo sapiens
agccggtaactgtcctgtcct

SEQ ID NO: 1093997 - DNA, 22 bp, Homo sapiens
agccggtcagaggagcgcaggc

SEQ ID NO: 1093998 - DNA, 13 bp, Homo sapiens
agccggtggtgcc

SEQ ID NO: 1093999 - DNA, 15 bp, Homo sapiens
agccggtggtgcccg

SEQ ID NO: 1094000 - DNA, 14 bp, Homo sapiens
agccggtgtccctg

SEQ ID NO: 1094001 - DNA, 22 bp, Homo sapiens
agccggttctgctagagcagac

SEQ ID NO: 1094002 - DNA, 18 bp, Homo sapiens
agccgtattttacatgaa

SEQ ID NO: 1094003 - DNA, 16 bp, Homo sapiens
agccgtcagccaaatg

SEQ ID NO: 1094004 - DNA, 14 bp, Homo sapiens
agccgtcagccatc

SEQ ID NO: 1094005 - DNA, 22 bp, Homo sapiens
agccgtccatggcaccagcccc

SEQ ID NO: 1094006 - DNA, 15 bp, Homo sapiens
agccgtcccaggcca

SEQ ID NO: 1094007 - DNA, 17 bp, Homo sapiens
agccgtcccaggccacc

SEQ ID NO: 1094008 - DNA, 20 bp, Homo sapiens
agccgtcccgcgttcaagac

SEQ ID NO: 1094009 - DNA, 20 bp, Homo sapiens
agccgtctgactccagagtc

SEQ ID NO: 1094010 - DNA, 22 bp, Homo sapiens
agccgtctgactccagagtctg

SEQ ID NO: 1094011 - DNA, 17 bp, Homo sapiens
agccgtgaactgtgcat

SEQ ID NO: 1094012 - DNA, 18 bp, Homo sapiens
agccgtgatgctcaggct

SEQ ID NO: 1094013 - DNA, 13 bp, Homo sapiens
agccgtggcttcc

SEQ ID NO: 1094014 - DNA, 14 bp, Homo sapiens
agccgtggcttccc

SEQ ID NO: 1094015 - DNA, 16 bp, Homo sapiens
agccgttgaatctggg

SEQ ID NO: 1094016 - DNA, 15 bp, Homo sapiens
agccgttttcctcat

SEQ ID NO: 1094017 - DNA, 16 bp, Homo sapiens
agccgttttcctcatc

SEQ ID NO: 1094018 - DNA, 16 bp, Homo sapiens
agcctaaagggcaggg

SEQ ID NO: 1094019 - DNA, 18 bp, Homo sapiens
agcctaaagggcagggcc

SEQ ID NO: 1094020 - DNA, 21 bp, Homo sapiens
agcctaaagtatacaactgcc

SEQ ID NO: 1094021 - DNA, 12 bp, Homo sapiens
agcctaaatgat

SEQ ID NO: 1094022 - DNA, 12 bp, Homo sapiens
agcctaagggat

SEQ ID NO: 1094023 - DNA, 21 bp, Homo sapiens
agcctaagggatcctgcctgc

SEQ ID NO: 1094024 - DNA, 22 bp, Homo sapiens
agcctaatccctgggcattgct

SEQ ID NO: 1094025 - DNA, 14 bp, Homo sapiens
agcctaatgaaagg

SEQ ID NO: 1094026 - DNA, 23 bp, Homo sapiens
agcctaatgaaagggaaagtcag

SEQ ID NO: 1094027 - DNA, 16 bp, Homo sapiens
agcctacagatgaact

SEQ ID NO: 1094028 - DNA, 16 bp, Homo sapiens
agcctaccatgtgaaa

SEQ ID NO: 1094029 - DNA, 14 bp, Homo sapiens
agcctacccttcct

SEQ ID NO: 1094030 - DNA, 20 bp, Homo sapiens
agcctagaacatccctgggc

SEQ ID NO: 1094031 - DNA, 18 bp, Homo sapiens
agcctagaagctggtggc

SEQ ID NO: 1094032 - DNA, 16 bp, Homo sapiens
agcctagccctgggac

SEQ ID NO: 1094033 - DNA, 18 bp, Homo sapiens
agcctagccgacctcagc

SEQ ID NO: 1094034 - DNA, 19 bp, Homo sapiens
agcctagccgacctcagcc

SEQ ID NO: 1094035 - DNA, 21 bp, Homo sapiens
agcctagccgacctcagcctt

SEQ ID NO: 1094036 - DNA, 13 bp, Homo sapiens
agcctagcggagc

SEQ ID NO: 1094037 - DNA, 17 bp, Homo sapiens
agcctagcggagcccag

SEQ ID NO: 1094038 - DNA, 19 bp, Homo sapiens
agcctagcggagcccagcc

SEQ ID NO: 1094039 - DNA, 12 bp, Homo sapiens
agcctagctcct

SEQ ID NO: 1094040 - DNA, 17 bp, Homo sapiens
agcctagctcctgccac

SEQ ID NO: 1094041 - DNA, 21 bp, Homo sapiens
agcctagctcctgccacatgg

SEQ ID NO: 1094042 - DNA, 20 bp, Homo sapiens
agcctggtttgcaaagacca

SEQ ID NO: 1094043 - DNA, 21 bp, Homo sapiens
agcctggtttgcaaagaccac

SEQ ID NO: 1094044 - DNA, 17 bp, Homo sapiens
agcctgtaagcctgcaa

SEQ ID NO: 1094045 - DNA, 16 bp, Homo sapiens
agcctgtaatcccagc

SEQ ID NO: 1094046 - DNA, 19 bp, Homo sapiens
agcctgtcacccagctcct

SEQ ID NO: 1094047 - DNA, 15 bp, Homo sapiens
agcctgtcccaggac

SEQ ID NO: 1094048 - DNA, 16 bp, Homo sapiens
agcctgtcccaggact

SEQ ID NO: 1094049 - DNA, 23 bp, Homo sapiens
agcctgtccccagaccaaccctg

SEQ ID NO: 1094050 - DNA, 15 bp, Homo sapiens
agcctgtcctcaccg

SEQ ID NO: 1094051 - DNA, 22 bp, Homo sapiens
agcctgtcctggtacagcaggg

SEQ ID NO: 1094052 - DNA, 16 bp, Homo sapiens
agcctgtctcgggctg

SEQ ID NO: 1094053 - DNA, 20 bp, Homo sapiens
agcctgtctctttccacttt

SEQ ID NO: 1094054 - DNA, 23 bp, Homo sapiens
agcctgtgaataaaaaccctgta

SEQ ID NO: 1094055 - DNA, 15 bp, Homo sapiens
agcctgtgaccttgg

SEQ ID NO: 1094056 - DNA, 20 bp, Homo sapiens
agcctgtgagggagtgcaga

SEQ ID NO: 1094057 - DNA, 20 bp, Homo sapiens
agcctgtgcaaaaaaattaa

SEQ ID NO: 1094058 - DNA, 15 bp, Homo sapiens
agcctgtgccagcac

SEQ ID NO: 1094059 - DNA, 17 bp, Homo sapiens
agcctgtgccagcacct

SEQ ID NO: 1094060 - DNA, 11 bp, Homo sapiens
agcctgtggca

SEQ ID NO: 1094061 - DNA, 22 bp, Homo sapiens
agcctgtggcatctttgccttg

SEQ ID NO: 1094062 - DNA, 17 bp, Homo sapiens
agcctgtggcggtgcct

SEQ ID NO: 1094063 - DNA, 18 bp, Homo sapiens
agcctgtggcggtgcctg

SEQ ID NO: 1094064 - DNA, 19 bp, Homo sapiens
agcctgtggcggtgcctgg

SEQ ID NO: 1094065 - DNA, 22 bp, Homo sapiens
agcctgtggcggtgcctgggtg

SEQ ID NO: 1094066 - DNA, 13 bp, Homo sapiens
agcctgtggcttg

SEQ ID NO: 1094067 - DNA, 17 bp, Homo sapiens
agcctgtgggagtagaa

SEQ ID NO: 1094068 - DNA, 13 bp, Homo sapiens
agcctgtgggcag

SEQ ID NO: 1094069 - DNA, 19 bp, Homo sapiens
agcctgtgggcagcatgcc

SEQ ID NO: 1094070 - DNA, 21 bp, Homo sapiens
agcctgtgggcagcatgccca

SEQ ID NO: 1094071 - DNA, 22 bp, Homo sapiens
agcctgtgggcagcatgcccag

SEQ ID NO: 1094072 - DNA, 18 bp, Homo sapiens
agcctgttcccctcactg

SEQ ID NO: 1094073 - DNA, 19 bp, Homo sapiens
agcctgttttcactcagct

SEQ ID NO: 1094074 - DNA, 20 bp, Homo sapiens
agcctgttttcactcagctt

SEQ ID NO: 1094075 - DNA, 18 bp, Homo sapiens
agcctgttttgttggaag

SEQ ID NO: 1094076 - DNA, 22 bp, Homo sapiens
agccttaaatttttgtcatttt

SEQ ID NO: 1094077 - DNA, 22 bp, Homo sapiens
agccttaactaagactcccgcc

SEQ ID NO: 1094078 - DNA, 15 bp, Homo sapiens
agccttaagcaaatt

SEQ ID NO: 1094079 - DNA, 18 bp, Homo sapiens
agccttaatagacttctc

SEQ ID NO: 1094080 - DNA, 20 bp, Homo sapiens
agccttaatagacttctctt

SEQ ID NO: 1094081 - DNA, 20 bp, Homo sapiens
agccttagacgaagaagctg

SEQ ID NO: 1094082 - DNA, 12 bp, Homo sapiens
agccttagatgc

SEQ ID NO: 1094083 - DNA, 15 bp, Homo sapiens
agccttagctgccag

SEQ ID NO: 1094084 - DNA, 15 bp, Homo sapiens
agccttagggaagct

SEQ ID NO: 1094085 - DNA, 22 bp, Homo sapiens
agccttagggaagctggcctga

SEQ ID NO: 1094086 - DNA, 19 bp, Homo sapiens
agccttatcaagtgtcttc

SEQ ID NO: 1094087 - DNA, 14 bp, Homo sapiens
agccttatgtgtta

SEQ ID NO: 1094088 - DNA, 17 bp, Homo sapiens
agccttatgtgttacat

SEQ ID NO: 1094089 - DNA, 18 bp, Homo sapiens
agccttatgtgttacatt

SEQ ID NO: 1094090 - DNA, 17 bp, Homo sapiens
agccttcacttttctga

SEQ ID NO: 1094091 - DNA, 15 bp, Homo sapiens
agccttcagaatgct

SEQ ID NO: 1094092 - DNA, 21 bp, Homo sapiens
agccttccaactagctgggac

SEQ ID NO: 1094093 - DNA, 17 bp, Homo sapiens
agccttccatgacctcc

SEQ ID NO: 1094094 - DNA, 14 bp, Homo sapiens
agccttcctctgca

SEQ ID NO: 1094095 - DNA, 12 bp, Homo sapiens
agccttcggaca

SEQ ID NO: 1094096 - DNA, 18 bp, Homo sapiens
agccttcgtgtggctcct

SEQ ID NO: 1094097 - DNA, 18 bp, Homo sapiens
agccttctcagaagcaca

SEQ ID NO: 1094098 - DNA, 24 bp, Homo sapiens
agccttctccatatctccatggcc

SEQ ID NO: 1094099 - DNA, 21 bp, Homo sapiens
agccttcttccctcggggagc

SEQ ID NO: 1094100 - DNA, 23 bp, Homo sapiens
agccttctttttctggactctgg

SEQ ID NO: 1094101 - DNA, 16 bp, Homo sapiens
agccttgaactttgac

SEQ ID NO: 1094102 - DNA, 21 bp, Homo sapiens
agccttgaagaaaatgacttt

SEQ ID NO: 1094103 - DNA, 23 bp, Homo sapiens
agccttgaagaaaatgactttat

SEQ ID NO: 1094104 - DNA, 16 bp, Homo sapiens
agccttgagagaccca

SEQ ID NO: 1094105 - DNA, 17 bp, Homo sapiens
agccttgagagacccag

SEQ ID NO: 1094106 - DNA, 19 bp, Homo sapiens
agccttgagccctggctgt

SEQ ID NO: 1094107 - DNA, 17 bp, Homo sapiens
agccttgataatacttg

SEQ ID NO: 1094108 - DNA, 17 bp, Homo sapiens
agccttgcacacccact

SEQ ID NO: 1094109 - DNA, 20 bp, Homo sapiens
agccttgcacacccactgcc

SEQ ID NO: 1094110 - DNA, 18 bp, Homo sapiens
agccttgcatgtacttga

SEQ ID NO: 1094111 - DNA, 22 bp, Homo sapiens
agccttgcctaaatttaatgct

SEQ ID NO: 1094112 - DNA, 21 bp, Homo sapiens
agccttgcgctgtcccaggca

SEQ ID NO: 1094113 - DNA, 10 bp, Homo sapiens
agccttgctg

SEQ ID NO: 1094114 - DNA, 11 bp, Homo sapiens
agccttgctgg

SEQ ID NO: 1094115 - DNA, 21 bp, Homo sapiens
agccttggaaccagccccatc

SEQ ID NO: 1094116 - DNA, 19 bp, Homo sapiens
agccttggataatgctgtt

SEQ ID NO: 1094117 - DNA, 14 bp, Homo sapiens
agccttggcccaca

SEQ ID NO: 1094118 - DNA, 16 bp, Homo sapiens
agccttgggacccctg

SEQ ID NO: 1094119 - DNA, 18 bp, Homo sapiens
agccttgggggggctgcc

SEQ ID NO: 1094120 - DNA, 20 bp, Homo sapiens
agccttgggggggctgcctt

SEQ ID NO: 1094121 - DNA, 17 bp, Homo sapiens
agccttggggttggaca

SEQ ID NO: 1094122 - DNA, 20 bp, Homo sapiens
agccttggttcatcagtgtt

SEQ ID NO: 1094123 - DNA, 17 bp, Homo sapiens
agccttgtgccctgccc

SEQ ID NO: 1094124 - DNA, 18 bp, Homo sapiens
agccttgtgccctgcccc

SEQ ID NO: 1094125 - DNA, 20 bp, Homo sapiens
agccttgtgccctgccccca

SEQ ID NO: 1094126 - DNA, 13 bp, Homo sapiens
agccttgttgtga

SEQ ID NO: 1094127 - DNA, 17 bp, Homo sapiens
agccttgtttctgatga

SEQ ID NO: 1094128 - DNA, 14 bp, Homo sapiens
agcctttaatgcat

SEQ ID NO: 1094129 - DNA, 15 bp, Homo sapiens
agcctttaatgcatc

SEQ ID NO: 1094130 - DNA, 16 bp, Homo sapiens
agcctttacctgtgaa

SEQ ID NO: 1094131 - DNA, 18 bp, Homo sapiens
agcctttacctgtgaagt

SEQ ID NO: 1094132 - DNA, 22 bp, Homo sapiens
agcctttatggctgctgggctg

SEQ ID NO: 1094133 - DNA, 23 bp, Homo sapiens
agcctttccataaggaatgtagc

SEQ ID NO: 1094134 - DNA, 13 bp, Homo sapiens
agcctttcctcgg

SEQ ID NO: 1094135 - DNA, 23 bp, Homo sapiens
agcctttcctcggtctcccttcc

SEQ ID NO: 1094136 - DNA, 20 bp, Homo sapiens
agcctttgaatgctaagaat

SEQ ID NO: 1094137 - DNA, 15 bp, Homo sapiens
agcctttgcctcccc

SEQ ID NO: 1094138 - DNA, 13 bp, Homo sapiens
agcctttgccttt

SEQ ID NO: 1094139 - DNA, 17 bp, Homo sapiens
agcctttgctccctccc

SEQ ID NO: 1094140 - DNA, 19 bp, Homo sapiens
agcctttggttctggccag

SEQ ID NO: 1094141 - DNA, 23 bp, Homo sapiens
agcctttgttaaccttaaataca

SEQ ID NO: 1094142 - DNA, 18 bp, Homo sapiens
agcctttgtttttctcca

SEQ ID NO: 1094143 - DNA, 17 bp, Homo sapiens
agccttttatctgcaga

SEQ ID NO: 1094144 - DNA, 20 bp, Homo sapiens
agccttttctggtccctctt

SEQ ID NO: 1094145 - DNA, 22 bp, Homo sapiens
agccttttctggtccctcttct

SEQ ID NO: 1094146 - DNA, 20 bp, Homo sapiens
agcctttttttaggccacat

SEQ ID NO: 1094147 - DNA, 21 bp, Homo sapiens
agcctttttttaggccacatt

SEQ ID NO: 1094148 - DNA, 14 bp, Homo sapiens
agcgaaacacagag

SEQ ID NO: 1094149 - DNA, 18 bp, Homo sapiens
agcgaacgtatttctcca

SEQ ID NO: 1094150 - DNA, 23 bp, Homo sapiens
agcgaacttcacataggaaggga

SEQ ID NO: 1094151 - DNA, 16 bp, Homo sapiens
agcgaaggaacctctc

SEQ ID NO: 1094152 - DNA, 19 bp, Homo sapiens
agcgaagtctttgccttct

SEQ ID NO: 1094153 - DNA, 13 bp, Homo sapiens
agcgaccccagac

SEQ ID NO: 1094154 - DNA, 16 bp, Homo sapiens
agcgaccgccccctcc

SEQ ID NO: 1094155 - DNA, 17 bp, Homo sapiens
agcgaccgccccctcct

SEQ ID NO: 1094156 - DNA, 17 bp, Homo sapiens
agcgacggctcctcccc

SEQ ID NO: 1094157 - DNA, 19 bp, Homo sapiens
agcgacggctcctccccga

SEQ ID NO: 1094158 - DNA, 16 bp, Homo sapiens
agcgactccgttggcc

SEQ ID NO: 1094159 - DNA, 17 bp, Homo sapiens
agcgactccgttggcca

SEQ ID NO: 1094160 - DNA, 14 bp, Homo sapiens
agcgactctcctgt

SEQ ID NO: 1094161 - DNA, 14 bp, Homo sapiens
agcgagcacagtat

SEQ ID NO: 1094162 - DNA, 16 bp, Homo sapiens
agcgagccacaggaac

SEQ ID NO: 1094163 - DNA, 13 bp, Homo sapiens
agcgagcctgtgc

SEQ ID NO: 1094164 - DNA, 15 bp, Homo sapiens
agcgagcctgtgcct

SEQ ID NO: 1094165 - DNA, 16 bp, Homo sapiens
agcgagcctgtgcctt

SEQ ID NO: 1094166 - DNA, 16 bp, Homo sapiens
agcgagctgctctgct

SEQ ID NO: 1094167 - DNA, 19 bp, Homo sapiens
agcgaggaaaggattttac

SEQ ID NO: 1094168 - DNA, 24 bp, Homo sapiens
agcgaggctgagcctacagatgaa

SEQ ID NO: 1094169 - DNA, 19 bp, Homo sapiens
agcgaggtcaacagagaag

SEQ ID NO: 1094170 - DNA, 14 bp, Homo sapiens
agcgaggtcagagg

SEQ ID NO: 1094171 - DNA, 15 bp, Homo sapiens
agcgaggtcagagga

SEQ ID NO: 1094172 - DNA, 20 bp, Homo sapiens
agcgaggtgggagaggcctc

SEQ ID NO: 1094173 - DNA, 18 bp, Homo sapiens
agcgatgaatttggagac

SEQ ID NO: 1094174 - DNA, 23 bp, Homo sapiens
agcgattattatctaaagtgtgt

SEQ ID NO: 1094175 - DNA, 22 bp, Homo sapiens
agcgattgattgatgtacagaa

SEQ ID NO: 1094176 - DNA, 15 bp, Homo sapiens
agcgatttgaaacac

SEQ ID NO: 1094177 - DNA, 14 bp, Homo sapiens
agcgcaaggcactt

SEQ ID NO: 1094178 - DNA, 18 bp, Homo sapiens
agcgcacctgccccctgg

SEQ ID NO: 1094179 - DNA, 15 bp, Homo sapiens
agcgcaggctgcaga

SEQ ID NO: 1094180 - DNA, 13 bp, Homo sapiens
agcgcagggctgg

SEQ ID NO: 1094181 - DNA, 16 bp, Homo sapiens
agcgcagggctggcac

SEQ ID NO: 1094182 - DNA, 18 bp, Homo sapiens
agcgcagggctggcacgt

SEQ ID NO: 1094183 - DNA, 19 bp, Homo sapiens
agcgcaggtttagtttact

SEQ ID NO: 1094184 - DNA, 20 bp, Homo sapiens
agcgccaagtgcgtgccgtg

SEQ ID NO: 1094185 - DNA, 18 bp, Homo sapiens
agcgccagcctgtcccat

SEQ ID NO: 1094186 - DNA, 17 bp, Homo sapiens
agcgccagggcccaggc

SEQ ID NO: 1094187 - DNA, 21 bp, Homo sapiens
agcgccagggcccaggccatg

SEQ ID NO: 1094188 - DNA, 18 bp, Homo sapiens
agcgcccacccaggtccc

SEQ ID NO: 1094189 - DNA, 16 bp, Homo sapiens
agcgcccccgagccct

SEQ ID NO: 1094190 - DNA, 17 bp, Homo sapiens
agcgcccccgagccctg

SEQ ID NO: 1094191 - DNA, 22 bp, Homo sapiens
agcgcccctcactcctgcgctg

SEQ ID NO: 1094192 - DNA, 15 bp, Homo sapiens
agcgccgactccctg

SEQ ID NO: 1094193 - DNA, 16 bp, Homo sapiens
agcgccgactccctga

SEQ ID NO: 1094194 - DNA, 15 bp, Homo sapiens
agcgccgtgctgtaa

SEQ ID NO: 1094195 - DNA, 21 bp, Homo sapiens
agcgcctagtggggtctccct

SEQ ID NO: 1094196 - DNA, 18 bp, Homo sapiens
agcgcctccatccaaggc

SEQ ID NO: 1094197 - DNA, 13 bp, Homo sapiens
agcgcctccctcc

SEQ ID NO: 1094198 - DNA, 15 bp, Homo sapiens
agcgcctccctccac

SEQ ID NO: 1094199 - DNA, 12 bp, Homo sapiens
agcgcctcttcc

SEQ ID NO: 1094200 - DNA, 13 bp, Homo sapiens
agcgcctcttcct

SEQ ID NO: 1094201 - DNA, 15 bp, Homo sapiens
agcgcctggctgctg

SEQ ID NO: 1094202 - DNA, 17 bp, Homo sapiens
agcgcctggctgctgct

SEQ ID NO: 1094203 - DNA, 14 bp, Homo sapiens
agcgcgctcctgac

SEQ ID NO: 1094204 - DNA, 17 bp, Homo sapiens
agcgcggacgtgctggg

SEQ ID NO: 1094205 - DNA, 15 bp, Homo sapiens
agcgcggctaactta

SEQ ID NO: 1094206 - DNA, 21 bp, Homo sapiens
agcgcggttttttccacgcag

SEQ ID NO: 1094207 - DNA, 19 bp, Homo sapiens
agcgctcatgttgagccag

SEQ ID NO: 1094208 - DNA, 15 bp, Homo sapiens
agcgctcctctgcct

SEQ ID NO: 1094209 - DNA, 12 bp, Homo sapiens
agcgctcgccac

SEQ ID NO: 1094210 - DNA, 15 bp, Homo sapiens
agcgctcgccccgca

SEQ ID NO: 1094211 - DNA, 16 bp, Homo sapiens
agcgctcggcccggag

SEQ ID NO: 1094212 - DNA, 12 bp, Homo sapiens
agcgctctggac

SEQ ID NO: 1094213 - DNA, 20 bp, Homo sapiens
agcgctgccgcaccccagag

SEQ ID NO: 1094214 - DNA, 21 bp, Homo sapiens
agcgctgccgcaccccagagt

SEQ ID NO: 1094215 - DNA, 19 bp, Homo sapiens
agcgctggctccctgggca

SEQ ID NO: 1094216 - DNA, 22 bp, Homo sapiens
agcgctggctccctgggcagtg

SEQ ID NO: 1094217 - DNA, 22 bp, Homo sapiens
agcgcttgggcgccgtgctggg

SEQ ID NO: 1094218 - DNA, 16 bp, Homo sapiens
agcgctttctggaaaa

SEQ ID NO: 1094219 - DNA, 19 bp, Homo sapiens
agcgctttgggaggcggag

SEQ ID NO: 1094220 - DNA, 15 bp, Homo sapiens
agcggaaaagttgtc

SEQ ID NO: 1094221 - DNA, 21 bp, Homo sapiens
agcggagcccgatattctccc

SEQ ID NO: 1094222 - DNA, 21 bp, Homo sapiens
agcggaggttgcagtgagctg

SEQ ID NO: 1094223 - DNA, 17 bp, Homo sapiens
agcggagtctgtcctgt

SEQ ID NO: 1094224 - DNA, 19 bp, Homo sapiens
agcggagttcctaacagga

SEQ ID NO: 1094225 - DNA, 17 bp, Homo sapiens
agcggattgctctggag

SEQ ID NO: 1094226 - DNA, 13 bp, Homo sapiens
agcggatttccag

SEQ ID NO: 1094227 - DNA, 20 bp, Homo sapiens
agcggcaaacctttccccct

SEQ ID NO: 1094228 - DNA, 19 bp, Homo sapiens
agcggcagtgggcctgctg

SEQ ID NO: 1094229 - DNA, 21 bp, Homo sapiens
agcggcagtgggcctgctgag

SEQ ID NO: 1094230 - DNA, 20 bp, Homo sapiens
agcggccccccgcacagcca

SEQ ID NO: 1094231 - DNA, 17 bp, Homo sapiens
agcggccctaagggagt

SEQ ID NO: 1094232 - DNA, 14 bp, Homo sapiens
agcggccctgtcat

SEQ ID NO: 1094233 - DNA, 18 bp, Homo sapiens
agcggccctgtcatccag

SEQ ID NO: 1094234 - DNA, 16 bp, Homo sapiens
agcggccctgtgtgtt

SEQ ID NO: 1094235 - DNA, 21 bp, Homo sapiens
agcggccgatgggagtctccc

SEQ ID NO: 1094236 - DNA, 22 bp, Homo sapiens
agcggcctccggcgtcttgccc

SEQ ID NO: 1094237 - DNA, 21 bp, Homo sapiens
agcggccttgaagacagagca

SEQ ID NO: 1094238 - DNA, 14 bp, Homo sapiens
agcggctctggtcc

SEQ ID NO: 1094239 - DNA, 15 bp, Homo sapiens
agcggctgttccccc

SEQ ID NO: 1094240 - DNA, 20 bp, Homo sapiens
agcgggaatggcagctgcca

SEQ ID NO: 1094241 - DNA, 13 bp, Homo sapiens
agcgggactcagt

SEQ ID NO: 1094242 - DNA, 12 bp, Homo sapiens
agcgggaggaag

SEQ ID NO: 1094243 - DNA, 15 bp, Homo sapiens
agcgggaggcagagt

SEQ ID NO: 1094244 - DNA, 11 bp, Homo sapiens
agcgggcagcc

SEQ ID NO: 1094245 - DNA, 14 bp, Homo sapiens
agcgggcagccccg

SEQ ID NO: 1094246 - DNA, 15 bp, Homo sapiens
agcgggcgctgctgg

SEQ ID NO: 1094247 - DNA, 16 bp, Homo sapiens
agcggggtatgaagag

SEQ ID NO: 1094248 - DNA, 22 bp, Homo sapiens
agcggtccatgggtctggcctg

SEQ ID NO: 1094249 - DNA, 12 bp, Homo sapiens
agcggtccctgc

SEQ ID NO: 1094250 - DNA, 23 bp, Homo sapiens
agcggtccctgcagaagccagaa

SEQ ID NO: 1094251 - DNA, 17 bp, Homo sapiens
agcggtccctgtccctc

SEQ ID NO: 1094252 - DNA, 19 bp, Homo sapiens
agcggtgaccagcctgtca

SEQ ID NO: 1094253 - DNA, 22 bp, Homo sapiens
agcggtgaccagcctgtcaccc

SEQ ID NO: 1094254 - DNA, 15 bp, Homo sapiens
agcggtggaggaagg

SEQ ID NO: 1094255 - DNA, 16 bp, Homo sapiens
agcggtggaggaaggc

SEQ ID NO: 1094256 - DNA, 20 bp, Homo sapiens
agcggtggaggaaggctctg

SEQ ID NO: 1094257 - DNA, 23 bp, Homo sapiens
agcggtggataactagccagaca

SEQ ID NO: 1094258 - DNA, 15 bp, Homo sapiens
agcggtgggaaggaa

SEQ ID NO: 1094259 - DNA, 16 bp, Homo sapiens
agcggtggtttgtaat

SEQ ID NO: 1094260 - DNA, 19 bp, Homo sapiens
agcggtttggggagcagag

SEQ ID NO: 1094261 - DNA, 22 bp, Homo sapiens
agcggtttggggagcagagaca

SEQ ID NO: 1094262 - DNA, 14 bp, Homo sapiens
agcgtagcctctcc

SEQ ID NO: 1094263 - DNA, 15 bp, Homo sapiens
agcgtcacttctcct

SEQ ID NO: 1094264 - DNA, 21 bp, Homo sapiens
agcgtcagcgggcgctgctgg

SEQ ID NO: 1094265 - DNA, 21 bp, Homo sapiens
agcgtcagctgctccctggca

SEQ ID NO: 1094266 - DNA, 20 bp, Homo sapiens
agcgtcagtttcactccctc

SEQ ID NO: 1094267 - DNA, 20 bp, Homo sapiens
agcgtcccctgctactcctg

SEQ ID NO: 1094268 - DNA, 22 bp, Homo sapiens
agcgtcccctgctactcctgtg

SEQ ID NO: 1094269 - DNA, 19 bp, Homo sapiens
agcgtcctcctctgtgacc

SEQ ID NO: 1094270 - DNA, 11 bp, Homo sapiens
agcgtcctgcc

SEQ ID NO: 1094271 - DNA, 12 bp, Homo sapiens
agcgtcctgccc

SEQ ID NO: 1094272 - DNA, 14 bp, Homo sapiens
agcgtcctgccctg

SEQ ID NO: 1094273 - DNA, 16 bp, Homo sapiens
agcgtcgccccagtgg

SEQ ID NO: 1094274 - DNA, 18 bp, Homo sapiens
agcgtcgccccagtggca

SEQ ID NO: 1094275 - DNA, 13 bp, Homo sapiens
agcgtctgcaggg

SEQ ID NO: 1094276 - DNA, 15 bp, Homo sapiens
agcgtctgcagggtg

SEQ ID NO: 1094277 - DNA, 22 bp, Homo sapiens
agcgtctgcagggtgacgcctg

SEQ ID NO: 1094278 - DNA, 23 bp, Homo sapiens
agcgtctgcagggtgacgcctga

SEQ ID NO: 1094279 - DNA, 15 bp, Homo sapiens
agcgtgctgacatca

SEQ ID NO: 1094280 - DNA, 20 bp, Homo sapiens
agcgtgctggcgacactcag

SEQ ID NO: 1094281 - DNA, 21 bp, Homo sapiens
agcgtgctggcgacactcagg

SEQ ID NO: 1094282 - DNA, 22 bp, Homo sapiens
agcgtgctggcgacactcaggg

SEQ ID NO: 1094283 - DNA, 14 bp, Homo sapiens
agcgtggaaggggg

SEQ ID NO: 1094284 - DNA, 18 bp, Homo sapiens
agcgtggaagggggagga

SEQ ID NO: 1094285 - DNA, 17 bp, Homo sapiens
agctccttggctgcagc

SEQ ID NO: 1094286 - DNA, 18 bp, Homo sapiens
agctcctttctcctgtga

SEQ ID NO: 1094287 - DNA, 20 bp, Homo sapiens
agctcctttctcctgtgaat

SEQ ID NO: 1094288 - DNA, 13 bp, Homo sapiens
agctccttttgtc

SEQ ID NO: 1094289 - DNA, 17 bp, Homo sapiens
agctccttttgtcccca

SEQ ID NO: 1094290 - DNA, 21 bp, Homo sapiens
agctccttttgtccccagggc

SEQ ID NO: 1094291 - DNA, 19 bp, Homo sapiens
agctcgaggcccccgacca

SEQ ID NO: 1094292 - DNA, 22 bp, Homo sapiens
agctcgcattctcttgtgttcg

SEQ ID NO: 1094293 - DNA, 14 bp, Homo sapiens
agctcgcccctccc

SEQ ID NO: 1094294 - DNA, 16 bp, Homo sapiens
agctcgcccctcccct

SEQ ID NO: 1094295 - DNA, 23 bp, Homo sapiens
agctcgcccctcccctcagcctg

SEQ ID NO: 1094296 - DNA, 15 bp, Homo sapiens
agctcggcaccaact

SEQ ID NO: 1094297 - DNA, 12 bp, Homo sapiens
agctcggtggac

SEQ ID NO: 1094298 - DNA, 14 bp, Homo sapiens
agctcggtggaccc

SEQ ID NO: 1094299 - DNA, 17 bp, Homo sapiens
agctcggtggacccagg

SEQ ID NO: 1094300 - DNA, 19 bp, Homo sapiens
agctcgtgtatcctggggc

SEQ ID NO: 1094301 - DNA, 14 bp, Homo sapiens
agctcgtttttcag

SEQ ID NO: 1094302 - DNA, 19 bp, Homo sapiens
agctcgtttttcagcaccc

SEQ ID NO: 1094303 - DNA, 22 bp, Homo sapiens
agctcgtttttcagcaccccca

SEQ ID NO: 1094304 - DNA, 15 bp, Homo sapiens
agctctaataagttt

SEQ ID NO: 1094305 - DNA, 16 bp, Homo sapiens
agctctaataagtttg

SEQ ID NO: 1094306 - DNA, 16 bp, Homo sapiens
agctctagacaaccct

SEQ ID NO: 1094307 - DNA, 20 bp, Homo sapiens
agctctagttttcagccttg

SEQ ID NO: 1094308 - DNA, 12 bp, Homo sapiens
agctctcagcca

SEQ ID NO: 1094309 - DNA, 13 bp, Homo sapiens
agctctccaggcc

SEQ ID NO: 1094310 - DNA, 15 bp, Homo sapiens
agctctccaggccag

SEQ ID NO: 1094311 - DNA, 16 bp, Homo sapiens
agctctccaggccagg

SEQ ID NO: 1094312 - DNA, 18 bp, Homo sapiens
agctctccaggccaggtg

SEQ ID NO: 1094313 - DNA, 19 bp, Homo sapiens
agctctccaggccaggtgg

SEQ ID NO: 1094314 - DNA, 21 bp, Homo sapiens
agctctccaggccaggtggga

SEQ ID NO: 1094315 - DNA, 12 bp, Homo sapiens
agctctcccaca

SEQ ID NO: 1094316 - DNA, 17 bp, Homo sapiens
agctctcccagtgaact

SEQ ID NO: 1094317 - DNA, 19 bp, Homo sapiens
agctctcccctcctgctgg

SEQ ID NO: 1094318 - DNA, 20 bp, Homo sapiens
agctctcccctcctgctggg

SEQ ID NO: 1094319 - DNA, 23 bp, Homo sapiens
agctctcccctcctgctgggcgt

SEQ ID NO: 1094320 - DNA, 11 bp, Homo sapiens
agctctccctc

SEQ ID NO: 1094321 - DNA, 18 bp, Homo sapiens
agctctccctctggccct

SEQ ID NO: 1094322 - DNA, 20 bp, Homo sapiens
agctctccctctggccctgc

SEQ ID NO: 1094323 - DNA, 22 bp, Homo sapiens
agctctccctctggccctgcct

SEQ ID NO: 1094324 - DNA, 14 bp, Homo sapiens
agctctcctgactt

SEQ ID NO: 1094325 - DNA, 18 bp, Homo sapiens
agctctcgaggaaagtgg

SEQ ID NO: 1094326 - DNA, 13 bp, Homo sapiens
agctctctaggcc

SEQ ID NO: 1094327 - DNA, 16 bp, Homo sapiens
agctctctaggcctct

SEQ ID NO: 1094328 - DNA, 13 bp, Homo sapiens
agctctctgacgc

SEQ ID NO: 1094329 - DNA, 21 bp, Homo sapiens
agctctctgacgcttgtgaca

SEQ ID NO: 1094330 - DNA, 14 bp, Homo sapiens
agctctctgccctg

SEQ ID NO: 1094331 - DNA, 14 bp, Homo sapiens
agctctctgctggg

SEQ ID NO: 1094332 - DNA, 18 bp, Homo sapiens
agctctctgggacctcct

SEQ ID NO: 1094333 - DNA, 11 bp, Homo sapiens
agctctgaaaa

SEQ ID NO: 1094334 - DNA, 19 bp, Homo sapiens
agctctgaaaccagtgtta

SEQ ID NO: 1094335 - DNA, 16 bp, Homo sapiens
agctctgaaagagaaa

SEQ ID NO: 1094336 - DNA, 16 bp, Homo sapiens
agctctgacatccctt

SEQ ID NO: 1094337 - DNA, 18 bp, Homo sapiens
agctctgacatcccttcc

SEQ ID NO: 1094338 - DNA, 20 bp, Homo sapiens
agctctgacatcccttcctg

SEQ ID NO: 1094339 - DNA, 19 bp, Homo sapiens
agctctgagatcctggagt

SEQ ID NO: 1094340 - DNA, 17 bp, Homo sapiens
agctctgaggggaggca

SEQ ID NO: 1094341 - DNA, 23 bp, Homo sapiens
agctctgaggggaggcacctcca

SEQ ID NO: 1094342 - DNA, 21 bp, Homo sapiens
agctctgcagagcaggaaaca

SEQ ID NO: 1094343 - DNA, 13 bp, Homo sapiens
agctctgcattat

SEQ ID NO: 1094344 - DNA, 14 bp, Homo sapiens
agctctgcccccgc

SEQ ID NO: 1094345 - DNA, 21 bp, Homo sapiens
agctctgcgccaggcagagct

SEQ ID NO: 1094346 - DNA, 22 bp, Homo sapiens
agctctgcgtcggtcctggtgc

SEQ ID NO: 1094347 - DNA, 19 bp, Homo sapiens
agctctggaggggaggggg

SEQ ID NO: 1094348 - DNA, 19 bp, Homo sapiens
agctctggaggtgctgctc

SEQ ID NO: 1094349 - DNA, 21 bp, Homo sapiens
agctctggaggtgctgctcta

SEQ ID NO: 1094350 - DNA, 22 bp, Homo sapiens
agctctggccacaacagggcat

SEQ ID NO: 1094351 - DNA, 17 bp, Homo sapiens
agctctggctgaaccct

SEQ ID NO: 1094352 - DNA, 18 bp, Homo sapiens
agctctggctgaaccctg

SEQ ID NO: 1094353 - DNA, 21 bp, Homo sapiens
agctctggctgaaccctgtgc

SEQ ID NO: 1094354 - DNA, 20 bp, Homo sapiens
agctctggcttccagaaaac

SEQ ID NO: 1094355 - DNA, 15 bp, Homo sapiens
agctctgggagagga

SEQ ID NO: 1094356 - DNA, 13 bp, Homo sapiens
agctctgggcctc

SEQ ID NO: 1094357 - DNA, 23 bp, Homo sapiens
agctctggggacagcttcctcac

SEQ ID NO: 1094358 - DNA, 14 bp, Homo sapiens
agctctggggatgg

SEQ ID NO: 1094359 - DNA, 21 bp, Homo sapiens
agctctggttatttttctctt

SEQ ID NO: 1094360 - DNA, 15 bp, Homo sapiens
agctctgtaacttac

SEQ ID NO: 1094361 - DNA, 22 bp, Homo sapiens
agctctgtatcaggacccagag

SEQ ID NO: 1094362 - DNA, 13 bp, Homo sapiens
agctctgtggcct

SEQ ID NO: 1094363 - DNA, 16 bp, Homo sapiens
agctctgtggcctgtg

SEQ ID NO: 1094364 - DNA, 19 bp, Homo sapiens
agctctgtgggtctctgga

SEQ ID NO: 1094365 - DNA, 15 bp, Homo sapiens
agctcttcaggcctc

SEQ ID NO: 1094366 - DNA, 16 bp, Homo sapiens
agctcttcaggcctcc

SEQ ID NO: 1094367 - DNA, 14 bp, Homo sapiens
agctcttcatttct

SEQ ID NO: 1094368 - DNA, 16 bp, Homo sapiens
agctcttcatttctgg

SEQ ID NO: 1094369 - DNA, 18 bp, Homo sapiens
agctcttcggtttctgag

SEQ ID NO: 1094370 - DNA, 17 bp, Homo sapiens
agctcttctccccaggt

SEQ ID NO: 1094371 - DNA, 15 bp, Homo sapiens
agctcttctggagtt

SEQ ID NO: 1094372 - DNA, 20 bp, Homo sapiens
agctcttctggagtttctct

SEQ ID NO: 1094373 - DNA, 12 bp, Homo sapiens
agctcttctggg

SEQ ID NO: 1094374 - DNA, 16 bp, Homo sapiens
agctcttctgggcaga

SEQ ID NO: 1094375 - DNA, 20 bp, Homo sapiens
agctcttctgggcagagcct

SEQ ID NO: 1094376 - DNA, 21 bp, Homo sapiens
agctcttgaaatatgtagtat

SEQ ID NO: 1094377 - DNA, 12 bp, Homo sapiens
agctcttgccct

SEQ ID NO: 1094378 - DNA, 19 bp, Homo sapiens
agctcttgctctcttgtga

SEQ ID NO: 1094379 - DNA, 14 bp, Homo sapiens
agctcttggacaac

SEQ ID NO: 1094380 - DNA, 19 bp, Homo sapiens
agctcttggcattttcctc

SEQ ID NO: 1094381 - DNA, 21 bp, Homo sapiens
agctctttccaaattaaaaca

SEQ ID NO: 1094382 - DNA, 14 bp, Homo sapiens
agctctttggtcta

SEQ ID NO: 1094383 - DNA, 18 bp, Homo sapiens
agctcttttttgtttgtt

SEQ ID NO: 1094384 - DNA, 23 bp, Homo sapiens
agctcttttttgtttgtttcttt

SEQ ID NO: 1094385 - DNA, 19 bp, Homo sapiens
agctgaaaaatcacatcct

SEQ ID NO: 1094386 - DNA, 22 bp, Homo sapiens
agctgaaaaatcacatcctggc

SEQ ID NO: 1094387 - DNA, 22 bp, Homo sapiens
agctgaaaacctaagtccttta

SEQ ID NO: 1094388 - DNA, 22 bp, Homo sapiens
agctgaaaaggatcgaggcatg

SEQ ID NO: 1094389 - DNA, 16 bp, Homo sapiens
agctgaaaagggcact

SEQ ID NO: 1094390 - DNA, 20 bp, Homo sapiens
agctgaaaagggcactccca

SEQ ID NO: 1094391 - DNA, 12 bp, Homo sapiens
agctgaaagagg

SEQ ID NO: 1094392 - DNA, 14 bp, Homo sapiens
agctgaaagttggg

SEQ ID NO: 1094393 - DNA, 17 bp, Homo sapiens
agctgaaagttgggact

SEQ ID NO: 1094394 - DNA, 13 bp, Homo sapiens
agctgaaatgctg

SEQ ID NO: 1094395 - DNA, 18 bp, Homo sapiens
agctgaaatgctgcattt

SEQ ID NO: 1094396 - DNA, 20 bp, Homo sapiens
agctgaaatgctgcatttta

SEQ ID NO: 1094397 - DNA, 20 bp, Homo sapiens
agctgaaattttagaaatat

SEQ ID NO: 1094398 - DNA, 22 bp, Homo sapiens
agctgaacagccaaatgcatgg

SEQ ID NO: 1094399 - DNA, 13 bp, Homo sapiens
agctgaaccacag

SEQ ID NO: 1094400 - DNA, 17 bp, Homo sapiens
agctgaaccacagaaat

SEQ ID NO: 1094401 - DNA, 14 bp, Homo sapiens
agctgaaccttgag

SEQ ID NO: 1094402 - DNA, 20 bp, Homo sapiens
agctgaaccttgaggggcta

SEQ ID NO: 1094403 - DNA, 15 bp, Homo sapiens
agctgaaggctgagg

SEQ ID NO: 1094404 - DNA, 17 bp, Homo sapiens
agctgaagtgcatccaa

SEQ ID NO: 1094405 - DNA, 18 bp, Homo sapiens
agctgaatacattctgct

SEQ ID NO: 1094406 - DNA, 14 bp, Homo sapiens
agctgacatggaaa

SEQ ID NO: 1094407 - DNA, 18 bp, Homo sapiens
agctgccttccctagctt

SEQ ID NO: 1094408 - DNA, 19 bp, Homo sapiens
agctgccttcctcatcccc

SEQ ID NO: 1094409 - DNA, 14 bp, Homo sapiens
agctgccttggctc

SEQ ID NO: 1094410 - DNA, 17 bp, Homo sapiens
agctgccttggctcaga

SEQ ID NO: 1094411 - DNA, 18 bp, Homo sapiens
agctgcgcttgcttttct

SEQ ID NO: 1094412 - DNA, 18 bp, Homo sapiens
agctgcgggtctgaagga

SEQ ID NO: 1094413 - DNA, 16 bp, Homo sapiens
agctgctatagcctgg

SEQ ID NO: 1094414 - DNA, 21 bp, Homo sapiens
agctgctatagcctggggtgg

SEQ ID NO: 1094415 - DNA, 18 bp, Homo sapiens
agctgctatatattttaa

SEQ ID NO: 1094416 - DNA, 23 bp, Homo sapiens
agctgctatccccatctccctgc

SEQ ID NO: 1094417 - DNA, 21 bp, Homo sapiens
agctgctatttattttcctaa

SEQ ID NO: 1094418 - DNA, 15 bp, Homo sapiens
agctgctccaggcct

SEQ ID NO: 1094419 - DNA, 16 bp, Homo sapiens
agctgctcccctggag

SEQ ID NO: 1094420 - DNA, 18 bp, Homo sapiens
agctgctccgaggaccca

SEQ ID NO: 1094421 - DNA, 21 bp, Homo sapiens
agctgctctgaaatctccttt

SEQ ID NO: 1094422 - DNA, 16 bp, Homo sapiens
agctgctctgagccac

SEQ ID NO: 1094423 - DNA, 20 bp, Homo sapiens
agctgctgaagttctgagcc

SEQ ID NO: 1094424 - DNA, 19 bp, Homo sapiens
agctgctggctgacctggg

SEQ ID NO: 1094425 - DNA, 20 bp, Homo sapiens
agctgctggctgacctgggc

SEQ ID NO: 1094426 - DNA, 16 bp, Homo sapiens
agctgctgtgccccac

SEQ ID NO: 1094427 - DNA, 18 bp, Homo sapiens
agctgctgtgccccacca

SEQ ID NO: 1094428 - DNA, 14 bp, Homo sapiens
agctgcttctcccc

SEQ ID NO: 1094429 - DNA, 19 bp, Homo sapiens
agctgcttctccccccatc

SEQ ID NO: 1094430 - DNA, 16 bp, Homo sapiens
agctgcttctgctgcc

SEQ ID NO: 1094431 - DNA, 21 bp, Homo sapiens
agctgcttctgctgcctaggt

SEQ ID NO: 1094432 - DNA, 16 bp, Homo sapiens
agctgcttgacctagc

SEQ ID NO: 1094433 - DNA, 19 bp, Homo sapiens
agctgcttgacctagctct

SEQ ID NO: 1094434 - DNA, 19 bp, Homo sapiens
agctgcttgtcctgctctc

SEQ ID NO: 1094435 - DNA, 19 bp, Homo sapiens
agctgctttctgttgtcat

SEQ ID NO: 1094436 - DNA, 14 bp, Homo sapiens
agctgctttcttct

SEQ ID NO: 1094437 - DNA, 19 bp, Homo sapiens
agctggaacatttgatatt

SEQ ID NO: 1094438 - DNA, 18 bp, Homo sapiens
agctggaaggcagggcag

SEQ ID NO: 1094439 - DNA, 20 bp, Homo sapiens
agctggaaggcagggcagag

SEQ ID NO: 1094440 - DNA, 13 bp, Homo sapiens
agctggaaggggc

SEQ ID NO: 1094441 - DNA, 13 bp, Homo sapiens
agctggacagagg

SEQ ID NO: 1094442 - DNA, 22 bp, Homo sapiens
agctggacagaggggactctgg

SEQ ID NO: 1094443 - DNA, 23 bp, Homo sapiens
agctggacatactgctggagtcc

SEQ ID NO: 1094444 - DNA, 16 bp, Homo sapiens
agctggaccatctctg

SEQ ID NO: 1094445 - DNA, 18 bp, Homo sapiens
agctggaccctgcttcac

SEQ ID NO: 1094446 - DNA, 19 bp, Homo sapiens
agctggaccctgcttcacc

SEQ ID NO: 1094447 - DNA, 13 bp, Homo sapiens
agctggactagtg

SEQ ID NO: 1094448 - DNA, 14 bp, Homo sapiens
agctggactagtgt

SEQ ID NO: 1094449 - DNA, 23 bp, Homo sapiens
agctggagatctgaacccagctg

SEQ ID NO: 1094450 - DNA, 21 bp, Homo sapiens
agctggagatgaggccagacc

SEQ ID NO: 1094451 - DNA, 14 bp, Homo sapiens
agctggagcagcgg

SEQ ID NO: 1094452 - DNA, 20 bp, Homo sapiens
agctggagcccccagcagag

SEQ ID NO: 1094453 - DNA, 21 bp, Homo sapiens
agctggagtgagggcctcaga

SEQ ID NO: 1094454 - DNA, 16 bp, Homo sapiens
agctggagtgctgctt

SEQ ID NO: 1094455 - DNA, 22 bp, Homo sapiens
agctggagtgctgcttgtgcct

SEQ ID NO: 1094456 - DNA, 18 bp, Homo sapiens
agctggatagacttggga

SEQ ID NO: 1094457 - DNA, 14 bp, Homo sapiens
agctggatgagaat

SEQ ID NO: 1094458 - DNA, 15 bp, Homo sapiens
agctggcaggacaca

SEQ ID NO: 1094459 - DNA, 21 bp, Homo sapiens
agctggcattacagctggaga

SEQ ID NO: 1094460 - DNA, 20 bp, Homo sapiens
agctggccccgcttggtggc

SEQ ID NO: 1094461 - DNA, 13 bp, Homo sapiens
agctggcccttgg

SEQ ID NO: 1094462 - DNA, 22 bp, Homo sapiens
agctggcctaatcactctgagt

SEQ ID NO: 1094463 - DNA, 13 bp, Homo sapiens
agctggcctcccc

SEQ ID NO: 1094464 - DNA, 14 bp, Homo sapiens
agctggcctccccc

SEQ ID NO: 1094465 - DNA, 17 bp, Homo sapiens
agctggcctcccccaac

SEQ ID NO: 1094466 - DNA, 16 bp, Homo sapiens
agctggcctctctagc

SEQ ID NO: 1094467 - DNA, 15 bp, Homo sapiens
agctggctagcattc

SEQ ID NO: 1094468 - DNA, 22 bp, Homo sapiens
agctggctagcattcctcagga

SEQ ID NO: 1094469 - DNA, 23 bp, Homo sapiens
agctggctagcattcctcaggaa

SEQ ID NO: 1094470 - DNA, 16 bp, Homo sapiens
agctggctagtccttt

SEQ ID NO: 1094471 - DNA, 20 bp, Homo sapiens
agctggctctgagcgcctcc

SEQ ID NO: 1094472 - DNA, 20 bp, Homo sapiens
agctggctctgtgagggtgc

SEQ ID NO: 1094473 - DNA, 21 bp, Homo sapiens
agctggctctgtgagggtgct

SEQ ID NO: 1094474 - DNA, 20 bp, Homo sapiens
agctggctgtgcctgcttct

SEQ ID NO: 1094475 - DNA, 14 bp, Homo sapiens
agctgggaaattca

SEQ ID NO: 1094476 - DNA, 20 bp, Homo sapiens
agctgggaacgtgtgtccag

SEQ ID NO: 1094477 - DNA, 22 bp, Homo sapiens
agctgggaacgtgtgtccaggc

SEQ ID NO: 1094478 - DNA, 14 bp, Homo sapiens
agctgggacccctc

SEQ ID NO: 1094479 - DNA, 23 bp, Homo sapiens
agctgggacctaatgctggcctg

SEQ ID NO: 1094480 - DNA, 14 bp, Homo sapiens
agctgggagccagg

SEQ ID NO: 1094481 - DNA, 22 bp, Homo sapiens
agctgggagccagtgtgcccaa

SEQ ID NO: 1094482 - DNA, 13 bp, Homo sapiens
agctgggaggaaa

SEQ ID NO: 1094483 - DNA, 17 bp, Homo sapiens
agctgggaggcaagagg

SEQ ID NO: 1094484 - DNA, 19 bp, Homo sapiens
agctgggaggcaagagggg

SEQ ID NO: 1094485 - DNA, 18 bp, Homo sapiens
agctgggagggaacctgt

SEQ ID NO: 1094486 - DNA, 16 bp, Homo sapiens
agctgggattacaggc

SEQ ID NO: 1094487 - DNA, 14 bp, Homo sapiens
agctgggcaggttg

SEQ ID NO: 1094488 - DNA, 17 bp, Homo sapiens
agctgggcagtgccagc

SEQ ID NO: 1094489 - DNA, 21 bp, Homo sapiens
agctgggcccaaaggcccagg

SEQ ID NO: 1094490 - DNA, 23 bp, Homo sapiens
agctgggcccaaaggcccaggga

SEQ ID NO: 1094491 - DNA, 14 bp, Homo sapiens
agctgggcccctgc

SEQ ID NO: 1094492 - DNA, 15 bp, Homo sapiens
agctgggcctgtgca

SEQ ID NO: 1094493 - DNA, 21 bp, Homo sapiens
agctgggcttggcctggagag

SEQ ID NO: 1094494 - DNA, 15 bp, Homo sapiens
agctggggactcagg

SEQ ID NO: 1094495 - DNA, 15 bp, Homo sapiens
agctggggagatggg

SEQ ID NO: 1094496 - DNA, 17 bp, Homo sapiens
agctggggagatggggg

SEQ ID NO: 1094497 - DNA, 12 bp, Homo sapiens
agctggggaggt

SEQ ID NO: 1094498 - DNA, 18 bp, Homo sapiens
agctggggaggtgggagg

SEQ ID NO: 1094499 - DNA, 22 bp, Homo sapiens
agctggggaggtgggaggccag

SEQ ID NO: 1094500 - DNA, 17 bp, Homo sapiens
agctggggccagaggct

SEQ ID NO: 1094501 - DNA, 16 bp, Homo sapiens
agctggggcgtgggga

SEQ ID NO: 1094502 - DNA, 14 bp, Homo sapiens
agctggggtctggg

SEQ ID NO: 1094503 - DNA, 16 bp, Homo sapiens
agctggggtctgggca

SEQ ID NO: 1094504 - DNA, 18 bp, Homo sapiens
agctggggtctgggcagt

SEQ ID NO: 1094505 - DNA, 21 bp, Homo sapiens
agctggggtctgggcagtgcc

SEQ ID NO: 1094506 - DNA, 14 bp, Homo sapiens
agctgggtcaggca

SEQ ID NO: 1094507 - DNA, 17 bp, Homo sapiens
agctgggtcaggcaggg

SEQ ID NO: 1094508 - DNA, 15 bp, Homo sapiens
agctgggtggcctgt

SEQ ID NO: 1094509 - DNA, 12 bp, Homo sapiens
agctgggtgggg

SEQ ID NO: 1094510 - DNA, 20 bp, Homo sapiens
agctgggtggggacagtgat

SEQ ID NO: 1094511 - DNA, 22 bp, Homo sapiens
agctgggtggggcagcacacct

SEQ ID NO: 1094512 - DNA, 21 bp, Homo sapiens
agctgggttccgggaggcaga

SEQ ID NO: 1094513 - DNA, 21 bp, Homo sapiens
agctggtcctccactttgctg

SEQ ID NO: 1094514 - DNA, 21 bp, Homo sapiens
agctggtctgccaggggcttc

SEQ ID NO: 1094515 - DNA, 15 bp, Homo sapiens
agctggtcttttctc

SEQ ID NO: 1094516 - DNA, 23 bp, Homo sapiens
agctggtcttttctcctactctt

SEQ ID NO: 1094517 - DNA, 20 bp, Homo sapiens
agctggtgcaaattcagaac

SEQ ID NO: 1094518 - DNA, 14 bp, Homo sapiens
agctggtgcattac

SEQ ID NO: 1094519 - DNA, 17 bp, Homo sapiens
agctggtgcattacaga

SEQ ID NO: 1094520 - DNA, 19 bp, Homo sapiens
agctggtgcattacagaga

SEQ ID NO: 1094521 - DNA, 23 bp, Homo sapiens
agctggtgccaaatagccccaga

SEQ ID NO: 1094522 - DNA, 14 bp, Homo sapiens
agctggtggccctg

SEQ ID NO: 1094523 - DNA, 21 bp, Homo sapiens
agctggtggccctgtgcctgg

SEQ ID NO: 1094524 - DNA, 13 bp, Homo sapiens
agctggtgggaag

SEQ ID NO: 1094525 - DNA, 18 bp, Homo sapiens
agctggtggttgtgcctt

SEQ ID NO: 1094526 - DNA, 19 bp, Homo sapiens
agctggtggttgtgccttt

SEQ ID NO: 1094527 - DNA, 17 bp, Homo sapiens
agctggtgtcagcccct

SEQ ID NO: 1094528 - DNA, 22 bp, Homo sapiens
agctttagaccctgggtgggct

SEQ ID NO: 1094529 - DNA, 17 bp, Homo sapiens
agctttatctttgtgta

SEQ ID NO: 1094530 - DNA, 23 bp, Homo sapiens
agctttatgttcatttgtttgtt

SEQ ID NO: 1094531 - DNA, 14 bp, Homo sapiens
agctttattgtgat

SEQ ID NO: 1094532 - DNA, 23 bp, Homo sapiens
agctttattgtgattacgtgtat

SEQ ID NO: 1094533 - DNA, 18 bp, Homo sapiens
agctttatttttcttttc

SEQ ID NO: 1094534 - DNA, 23 bp, Homo sapiens
agctttatttttcttttcctggg

SEQ ID NO: 1094535 - DNA, 19 bp, Homo sapiens
agctttattttttaagtat

SEQ ID NO: 1094536 - DNA, 17 bp, Homo sapiens
agctttcaagtgccttt

SEQ ID NO: 1094537 - DNA, 16 bp, Homo sapiens
agctttcagagccagt

SEQ ID NO: 1094538 - DNA, 20 bp, Homo sapiens
agctttccacatttgtcaca

SEQ ID NO: 1094539 - DNA, 15 bp, Homo sapiens
agctttccccagccc

SEQ ID NO: 1094540 - DNA, 16 bp, Homo sapiens
agctttccctgcctct

SEQ ID NO: 1094541 - DNA, 15 bp, Homo sapiens
agctttcctgcccca

SEQ ID NO: 1094542 - DNA, 20 bp, Homo sapiens
agctttcctgccccaggcct

SEQ ID NO: 1094543 - DNA, 21 bp, Homo sapiens
agctttcctgccccaggcctg

SEQ ID NO: 1094544 - DNA, 22 bp, Homo sapiens
agctttcctgccccaggcctga

SEQ ID NO: 1094545 - DNA, 22 bp, Homo sapiens
agctttcctttttcccaataaa

SEQ ID NO: 1094546 - DNA, 23 bp, Homo sapiens
agctttcctttttcccaataaat

SEQ ID NO: 1094547 - DNA, 17 bp, Homo sapiens
agctttctcaatgtctt

SEQ ID NO: 1094548 - DNA, 23 bp, Homo sapiens
agctttctcagggggtcagcaga

SEQ ID NO: 1094549 - DNA, 13 bp, Homo sapiens
agctttctgcctt

SEQ ID NO: 1094550 - DNA, 18 bp, Homo sapiens
agctttctgccttagcct

SEQ ID NO: 1094551 - DNA, 15 bp, Homo sapiens
agctttctggaattt

SEQ ID NO: 1094552 - DNA, 22 bp, Homo sapiens
agctttctgtccttttggcact

SEQ ID NO: 1094553 - DNA, 22 bp, Homo sapiens
agctttgaaactccatgcaaac

SEQ ID NO: 1094554 - DNA, 19 bp, Homo sapiens
agctttgagaagccttcag

SEQ ID NO: 1094555 - DNA, 19 bp, Homo sapiens
agctttgcaaaatgagact

SEQ ID NO: 1094556 - DNA, 17 bp, Homo sapiens
agctttgctacaaattt

SEQ ID NO: 1094557 - DNA, 21 bp, Homo sapiens
agctttgctaccaaagcacct

SEQ ID NO: 1094558 - DNA, 18 bp, Homo sapiens
agctttgctccgctccca

SEQ ID NO: 1094559 - DNA, 19 bp, Homo sapiens
agctttgctccgctcccac

SEQ ID NO: 1094560 - DNA, 21 bp, Homo sapiens
agctttgctccgctcccaccg

SEQ ID NO: 1094561 - DNA, 22 bp, Homo sapiens
agctttgctccgctcccaccgc

SEQ ID NO: 1094562 - DNA, 12 bp, Homo sapiens
agctttggaata

SEQ ID NO: 1094563 - DNA, 12 bp, Homo sapiens
agctttgtcact

SEQ ID NO: 1094564 - DNA, 19 bp, Homo sapiens
agctttgtcacttgccaca

SEQ ID NO: 1094565 - DNA, 14 bp, Homo sapiens
agctttgtgcttgt

SEQ ID NO: 1094566 - DNA, 12 bp, Homo sapiens
agctttgtgttt

SEQ ID NO: 1094567 - DNA, 16 bp, Homo sapiens
agctttgtgtttactt

SEQ ID NO: 1094568 - DNA, 14 bp, Homo sapiens
agcttttaaaaaat

SEQ ID NO: 1094569 - DNA, 22 bp, Homo sapiens
agcttttaaaaaatattttaag

SEQ ID NO: 1094570 - DNA, 23 bp, Homo sapiens
agcttttacagatccagaattta

SEQ ID NO: 1094571 - DNA, 17 bp, Homo sapiens
agcttttcatggaagtg

SEQ ID NO: 1094572 - DNA, 14 bp, Homo sapiens
agcttttcccagga

SEQ ID NO: 1094573 - DNA, 15 bp, Homo sapiens
agcttttcctcaggg

SEQ ID NO: 1094574 - DNA, 18 bp, Homo sapiens
agcttttctttttctgta

SEQ ID NO: 1094575 - DNA, 19 bp, Homo sapiens
agcttttgaaatccagaag

SEQ ID NO: 1094576 - DNA, 23 bp, Homo sapiens
agcttttgttctagacttcccca

SEQ ID NO: 1094577 - DNA, 13 bp, Homo sapiens
agcttttgttgtt

SEQ ID NO: 1094578 - DNA, 16 bp, Homo sapiens
agctttttattccctg

SEQ ID NO: 1094579 - DNA, 14 bp, Homo sapiens
agctttttcaaaag

SEQ ID NO: 1094580 - DNA, 14 bp, Homo sapiens
agctttttgtatta

SEQ ID NO: 1094581 - DNA, 14 bp, Homo sapiens
agcttttttcttta

SEQ ID NO: 1094582 - DNA, 13 bp, Homo sapiens
aggaaaaaaaaca

SEQ ID NO: 1094583 - DNA, 19 bp, Homo sapiens
aggaaaaacacaagcaaaa

SEQ ID NO: 1094584 - DNA, 13 bp, Homo sapiens
aggaaaaacaggt

SEQ ID NO: 1094585 - DNA, 14 bp, Homo sapiens
aggaaaaacaggtc

SEQ ID NO: 1094586 - DNA, 16 bp, Homo sapiens
aggaaaaaccaacagg

SEQ ID NO: 1094587 - DNA, 14 bp, Homo sapiens
aggaaaaataatca

SEQ ID NO: 1094588 - DNA, 15 bp, Homo sapiens
aggaaaaataatcaa

SEQ ID NO: 1094589 - DNA, 14 bp, Homo sapiens
aggaaaaatattta

SEQ ID NO: 1094590 - DNA, 22 bp, Homo sapiens
aggaaaaatgccactccctacc

SEQ ID NO: 1094591 - DNA, 15 bp, Homo sapiens
aggaaaaatgtgtaa

SEQ ID NO: 1094592 - DNA, 18 bp, Homo sapiens
aggaaaacaaatcactgt

SEQ ID NO: 1094593 - DNA, 18 bp, Homo sapiens
aggaaaacatgctgctct

SEQ ID NO: 1094594 - DNA, 12 bp, Homo sapiens
aggaaaacattg

SEQ ID NO: 1094595 - DNA, 20 bp, Homo sapiens
aggaaaaccaagccgtggct

SEQ ID NO: 1094596 - DNA, 22 bp, Homo sapiens
aggaaaaccaagccgtggcttc

SEQ ID NO: 1094597 - DNA, 17 bp, Homo sapiens
aggaaaagaaacctggg

SEQ ID NO: 1094598 - DNA, 20 bp, Homo sapiens
aggaaaagcggacatcagct

SEQ ID NO: 1094599 - DNA, 15 bp, Homo sapiens
aggaaaaggaaaaaa

SEQ ID NO: 1094600 - DNA, 17 bp, Homo sapiens
aggaaaaggcccctgca

SEQ ID NO: 1094601 - DNA, 16 bp, Homo sapiens
aggaaaagggagctat

SEQ ID NO: 1094602 - DNA, 19 bp, Homo sapiens
aggaaaagtacatttaata

SEQ ID NO: 1094603 - DNA, 22 bp, Homo sapiens
aggaaaagttaaactaaaaaaa

SEQ ID NO: 1094604 - DNA, 16 bp, Homo sapiens
aggaaaatagtaatgt

SEQ ID NO: 1094605 - DNA, 23 bp, Homo sapiens
aggaaaatataatatttactgtt

SEQ ID NO: 1094606 - DNA, 15 bp, Homo sapiens
aggaaaatctgtgat

SEQ ID NO: 1094607 - DNA, 22 bp, Homo sapiens
aggaaaatgtatccagaggaat

SEQ ID NO: 1094608 - DNA, 15 bp, Homo sapiens
aggaaaatgtattga

SEQ ID NO: 1094609 - DNA, 20 bp, Homo sapiens
aggaaaatgtattgattcaa

SEQ ID NO: 1094610 - DNA, 13 bp, Homo sapiens
aggaaaattaatc

SEQ ID NO: 1094611 - DNA, 13 bp, Homo sapiens
aggaaaattgaaa

SEQ ID NO: 1094612 - DNA, 13 bp, Homo sapiens
aggaaaatttcac

SEQ ID NO: 1094613 - DNA, 20 bp, Homo sapiens
aggaaacaaatgtgtataaa

SEQ ID NO: 1094614 - DNA, 16 bp, Homo sapiens
aggaaacaagggaagg

SEQ ID NO: 1094615 - DNA, 15 bp, Homo sapiens
aggaaacaggctcca

SEQ ID NO: 1094616 - DNA, 20 bp, Homo sapiens
aggaaacagttgcatgtagt

SEQ ID NO: 1094617 - DNA, 20 bp, Homo sapiens
aggaaacatgaagcataatt

SEQ ID NO: 1094618 - DNA, 11 bp, Homo sapiens
aggaaaccaag

SEQ ID NO: 1094619 - DNA, 20 bp, Homo sapiens
aggaaaccacaaccttgcag

SEQ ID NO: 1094620 - DNA, 17 bp, Homo sapiens
aggaaaccagctcgtgg

SEQ ID NO: 1094621 - DNA, 20 bp, Homo sapiens
aggaaaccccccaatgtctg

SEQ ID NO: 1094622 - DNA, 20 bp, Homo sapiens
aggaaaccgcctagtttact

SEQ ID NO: 1094623 - DNA, 21 bp, Homo sapiens
aggaaaccgcctagtttactg

SEQ ID NO: 1094624 - DNA, 15 bp, Homo sapiens
aggaaacgagacttt

SEQ ID NO: 1094625 - DNA, 16 bp, Homo sapiens
aggaaacgctacctct

SEQ ID NO: 1094626 - DNA, 19 bp, Homo sapiens
aggaaactaagcattgtat

SEQ ID NO: 1094627 - DNA, 16 bp, Homo sapiens
aggaaactcatctcct

SEQ ID NO: 1094628 - DNA, 22 bp, Homo sapiens
aggaaactccacatctgcctta

SEQ ID NO: 1094629 - DNA, 21 bp, Homo sapiens
aggaaactctgcattctagta

SEQ ID NO: 1094630 - DNA, 21 bp, Homo sapiens
aggaaactttatttaaatgca

SEQ ID NO: 1094631 - DNA, 15 bp, Homo sapiens
aggaaacttttaact

SEQ ID NO: 1094632 - DNA, 18 bp, Homo sapiens
aggaaagagcagtcagag

SEQ ID NO: 1094633 - DNA, 17 bp, Homo sapiens
aggaaagaggaagcaaa

SEQ ID NO: 1094634 - DNA, 23 bp, Homo sapiens
aggaaagcatgtctctgcttcca

SEQ ID NO: 1094635 - DNA, 12 bp, Homo sapiens
aggaaagccaca

SEQ ID NO: 1094636 - DNA, 21 bp, Homo sapiens
aggaaagccacacggagaggc

SEQ ID NO: 1094637 - DNA, 19 bp, Homo sapiens
aggaaaggattttaccaaa

SEQ ID NO: 1094638 - DNA, 14 bp, Homo sapiens
aggaaagggaggag

SEQ ID NO: 1094639 - DNA, 15 bp, Homo sapiens
aggaaagggcctggc

SEQ ID NO: 1094640 - DNA, 13 bp, Homo sapiens
aggaaagggctgg

SEQ ID NO: 1094641 - DNA, 18 bp, Homo sapiens
aggaaaggggagaaggga

SEQ ID NO: 1094642 - DNA, 15 bp, Homo sapiens
aggaaagtttcttca

SEQ ID NO: 1094643 - DNA, 16 bp, Homo sapiens
aggaaataaaaccttt

SEQ ID NO: 1094644 - DNA, 19 bp, Homo sapiens
aggaaataaaacctttcaa

SEQ ID NO: 1094645 - DNA, 14 bp, Homo sapiens
aggaaataaacatt

SEQ ID NO: 1094646 - DNA, 16 bp, Homo sapiens
aggaaataaacattac

SEQ ID NO: 1094647 - DNA, 12 bp, Homo sapiens
aggaaataaagg

SEQ ID NO: 1094648 - DNA, 22 bp, Homo sapiens
aggaaataaaggtaaaatcact

SEQ ID NO: 1094649 - DNA, 17 bp, Homo sapiens
aggaaataacagagaga

SEQ ID NO: 1094650 - DNA, 17 bp, Homo sapiens
aggaagtgtaacagctg

SEQ ID NO: 1094651 - DNA, 13 bp, Homo sapiens
aggaagtgtttat

SEQ ID NO: 1094652 - DNA, 17 bp, Homo sapiens
aggaagtgtttatgagg

SEQ ID NO: 1094653 - DNA, 18 bp, Homo sapiens
aggaagttgacttatagt

SEQ ID NO: 1094654 - DNA, 17 bp, Homo sapiens
aggaagttggctgagcc

SEQ ID NO: 1094655 - DNA, 19 bp, Homo sapiens
aggaagttttgtctaatta

SEQ ID NO: 1094656 - DNA, 19 bp, Homo sapiens
aggaataaataaaaatgga

SEQ ID NO: 1094657 - DNA, 21 bp, Homo sapiens
aggaataaatgagagggaatc

SEQ ID NO: 1094658 - DNA, 20 bp, Homo sapiens
aggaataaattgctccttga

SEQ ID NO: 1094659 - DNA, 16 bp, Homo sapiens
aggaataacctttctg

SEQ ID NO: 1094660 - DNA, 19 bp, Homo sapiens
aggaataaggcccagagcg

SEQ ID NO: 1094661 - DNA, 14 bp, Homo sapiens
aggaataaggcctt

SEQ ID NO: 1094662 - DNA, 13 bp, Homo sapiens
aggaataataaat

SEQ ID NO: 1094663 - DNA, 14 bp, Homo sapiens
aggaatagaggaag

SEQ ID NO: 1094664 - DNA, 20 bp, Homo sapiens
aggaatagaggaagaaatgt

SEQ ID NO: 1094665 - DNA, 18 bp, Homo sapiens
aggaatagcaaaattcct

SEQ ID NO: 1094666 - DNA, 17 bp, Homo sapiens
aggaatagccagagagg

SEQ ID NO: 1094667 - DNA, 21 bp, Homo sapiens
aggaatagtggacatggtcac

SEQ ID NO: 1094668 - DNA, 21 bp, Homo sapiens
aggaatagttgagccccaagt

SEQ ID NO: 1094669 - DNA, 23 bp, Homo sapiens
aggaatatatggcagagttgtaa

SEQ ID NO: 1094670 - DNA, 18 bp, Homo sapiens
aggaatatgggagaaata

SEQ ID NO: 1094671 - DNA, 16 bp, Homo sapiens
aggaatcaattattta

SEQ ID NO: 1094672 - DNA, 16 bp, Homo sapiens
aggaatcaccctccta

SEQ ID NO: 1094673 - DNA, 19 bp, Homo sapiens
aggaatcacgttagaggaa

SEQ ID NO: 1094674 - DNA, 21 bp, Homo sapiens
aggaatcatgtcaggcctgtg

SEQ ID NO: 1094675 - DNA, 15 bp, Homo sapiens
aggaatcccagaggt

SEQ ID NO: 1094676 - DNA, 19 bp, Homo sapiens
aggaatcctggcagcccag

SEQ ID NO: 1094677 - DNA, 20 bp, Homo sapiens
aggaatcctggcagcccaga

SEQ ID NO: 1094678 - DNA, 23 bp, Homo sapiens
aggaatcctttgagaatgtgatt

SEQ ID NO: 1094679 - DNA, 15 bp, Homo sapiens
aggaatctcttcact

SEQ ID NO: 1094680 - DNA, 22 bp, Homo sapiens
aggaatctcttcactaccctga

SEQ ID NO: 1094681 - DNA, 23 bp, Homo sapiens
aggaatctcttcactaccctgat

SEQ ID NO: 1094682 - DNA, 19 bp, Homo sapiens
aggaatctgaaagtatatt

SEQ ID NO: 1094683 - DNA, 17 bp, Homo sapiens
aggaatctgccttccag

SEQ ID NO: 1094684 - DNA, 19 bp, Homo sapiens
aggaatctgtgggtctggg

SEQ ID NO: 1094685 - DNA, 18 bp, Homo sapiens
aggaatctgtttctctgc

SEQ ID NO: 1094686 - DNA, 20 bp, Homo sapiens
aggaatctgtttctctgctg

SEQ ID NO: 1094687 - DNA, 21 bp, Homo sapiens
aggaatctgtttctctgctgt

SEQ ID NO: 1094688 - DNA, 22 bp, Homo sapiens
aggaatctgtttctctgctgtc

SEQ ID NO: 1094689 - DNA, 23 bp, Homo sapiens
aggaatctgtttctctgctgtca

SEQ ID NO: 1094690 - DNA, 12 bp, Homo sapiens
aggaatgagaat

SEQ ID NO: 1094691 - DNA, 15 bp, Homo sapiens
aggaatgatattgct

SEQ ID NO: 1094692 - DNA, 24 bp, Homo sapiens
aggaatgcctcctccctgggcaga

SEQ ID NO: 1094693 - DNA, 14 bp, Homo sapiens
aggaatgcctgtgc

SEQ ID NO: 1094694 - DNA, 15 bp, Homo sapiens
aggaatgcctgtgcc

SEQ ID NO: 1094695 - DNA, 16 bp, Homo sapiens
aggaatgcctgtgcca

SEQ ID NO: 1094696 - DNA, 17 bp, Homo sapiens
aggaatgcctgtgccaa

SEQ ID NO: 1094697 - DNA, 14 bp, Homo sapiens
aggaatgctccccc

SEQ ID NO: 1094698 - DNA, 17 bp, Homo sapiens
aggaatgctctgtgcca

SEQ ID NO: 1094699 - DNA, 15 bp, Homo sapiens
aggaatgctggactg

SEQ ID NO: 1094700 - DNA, 16 bp, Homo sapiens
aggaatggaatcttct

SEQ ID NO: 1094701 - DNA, 21 bp, Homo sapiens
aggaatggaggagtctcaaca

SEQ ID NO: 1094702 - DNA, 20 bp, Homo sapiens
aggaatgggggcctcttcaa

SEQ ID NO: 1094703 - DNA, 21 bp, Homo sapiens
aggaatgggggcctcttcaaa

SEQ ID NO: 1094704 - DNA, 16 bp, Homo sapiens
aggaatgggggtcaga

SEQ ID NO: 1094705 - DNA, 18 bp, Homo sapiens
aggaatgtagctggtttc

SEQ ID NO: 1094706 - DNA, 15 bp, Homo sapiens
aggaatgtcagggcc

SEQ ID NO: 1094707 - DNA, 17 bp, Homo sapiens
aggaatgtcagggccag

SEQ ID NO: 1094708 - DNA, 20 bp, Homo sapiens
aggaatgtcagggccaggtg

SEQ ID NO: 1094709 - DNA, 18 bp, Homo sapiens
aggaatgtgtccaagaca

SEQ ID NO: 1094710 - DNA, 20 bp, Homo sapiens
aggaatgtgtccaagacaca

SEQ ID NO: 1094711 - DNA, 14 bp, Homo sapiens
aggaatgttaaagt

SEQ ID NO: 1094712 - DNA, 12 bp, Homo sapiens
aggaattatgtc

SEQ ID NO: 1094713 - DNA, 12 bp, Homo sapiens
aggaattgactt

SEQ ID NO: 1094714 - DNA, 17 bp, Homo sapiens
aggaattgattgtcagc

SEQ ID NO: 1094715 - DNA, 22 bp, Homo sapiens
aggaattgattgtcagccacct

SEQ ID NO: 1094716 - DNA, 16 bp, Homo sapiens
aggaattgtttataca

SEQ ID NO: 1094717 - DNA, 13 bp, Homo sapiens
aggaatttaaaat

SEQ ID NO: 1094718 - DNA, 14 bp, Homo sapiens
aggaatttaaaatt

SEQ ID NO: 1094719 - DNA, 19 bp, Homo sapiens
aggaatttcttaacttctt

SEQ ID NO: 1094720 - DNA, 16 bp, Homo sapiens
aggaatttgattgctt

SEQ ID NO: 1094721 - DNA, 20 bp, Homo sapiens
aggaatttgattgctttgct

SEQ ID NO: 1094722 - DNA, 15 bp, Homo sapiens
aggaatttgtacttc

SEQ ID NO: 1094723 - DNA, 20 bp, Homo sapiens
aggaatttgtacttcttatt

SEQ ID NO: 1094724 - DNA, 16 bp, Homo sapiens
aggaattttctttgtg

SEQ ID NO: 1094725 - DNA, 11 bp, Homo sapiens
aggaattttgt

SEQ ID NO: 1094726 - DNA, 16 bp, Homo sapiens
aggaatttttaaacca

SEQ ID NO: 1094727 - DNA, 18 bp, Homo sapiens
aggacaaaaatgaactga

SEQ ID NO: 1094728 - DNA, 19 bp, Homo sapiens
aggacaaaaatgaactgaa

SEQ ID NO: 1094729 - DNA, 16 bp, Homo sapiens
aggacaaattagcatg

SEQ ID NO: 1094730 - DNA, 21 bp, Homo sapiens
aggacaaattagcatgcaagc

SEQ ID NO: 1094731 - DNA, 22 bp, Homo sapiens
aggacaaattagcatgcaagct

SEQ ID NO: 1094732 - DNA, 22 bp, Homo sapiens
aggacaacagttctgagctgta

SEQ ID NO: 1094733 - DNA, 16 bp, Homo sapiens
aggacaatactggggt

SEQ ID NO: 1094734 - DNA, 19 bp, Homo sapiens
aggacaatcagtcccctcc

SEQ ID NO: 1094735 - DNA, 12 bp, Homo sapiens
aggacacagcac

SEQ ID NO: 1094736 - DNA, 22 bp, Homo sapiens
aggacacagcacaagggcacat

SEQ ID NO: 1094737 - DNA, 16 bp, Homo sapiens
aggacacagcagtatt

SEQ ID NO: 1094738 - DNA, 12 bp, Homo sapiens
aggacacagtga

SEQ ID NO: 1094739 - DNA, 15 bp, Homo sapiens
aggacacagttcctg

SEQ ID NO: 1094740 - DNA, 16 bp, Homo sapiens
aggacacagttcctgg

SEQ ID NO: 1094741 - DNA, 18 bp, Homo sapiens
aggacacagttcctggga

SEQ ID NO: 1094742 - DNA, 14 bp, Homo sapiens
aggacacttccgta

SEQ ID NO: 1094743 - DNA, 15 bp, Homo sapiens
aggacagaacattgc

SEQ ID NO: 1094744 - DNA, 14 bp, Homo sapiens
aggacagaatgtgt

SEQ ID NO: 1094745 - DNA, 13 bp, Homo sapiens
aggacagacagca

SEQ ID NO: 1094746 - DNA, 17 bp, Homo sapiens
aggacagagcaggggct

SEQ ID NO: 1094747 - DNA, 17 bp, Homo sapiens
aggacagaggccggggt

SEQ ID NO: 1094748 - DNA, 22 bp, Homo sapiens
aggacagaggggtaagatgagg

SEQ ID NO: 1094749 - DNA, 16 bp, Homo sapiens
aggacagcagcactcc

SEQ ID NO: 1094750 - DNA, 14 bp, Homo sapiens
aggacagccagcag

SEQ ID NO: 1094751 - DNA, 14 bp, Homo sapiens
aggacagctctggg

SEQ ID NO: 1094752 - DNA, 12 bp, Homo sapiens
aggacagctctt

SEQ ID NO: 1094753 - DNA, 13 bp, Homo sapiens
aggacagctcttg

SEQ ID NO: 1094754 - DNA, 15 bp, Homo sapiens
aggacagctcttgat

SEQ ID NO: 1094755 - DNA, 12 bp, Homo sapiens
aggacagctgtc

SEQ ID NO: 1094756 - DNA, 15 bp, Homo sapiens
aggacagctgtcctc

SEQ ID NO: 1094757 - DNA, 12 bp, Homo sapiens
aggacaggagcc

SEQ ID NO: 1094758 - DNA, 14 bp, Homo sapiens
aggacaggagcctg

SEQ ID NO: 1094759 - DNA, 21 bp, Homo sapiens
aggacaggaggaggagatggc

SEQ ID NO: 1094760 - DNA, 17 bp, Homo sapiens
aggacaggctggtgcta

SEQ ID NO: 1094761 - DNA, 12 bp, Homo sapiens
aggacagggctg

SEQ ID NO: 1094762 - DNA, 22 bp, Homo sapiens
aggacagtgcttcagcctgagg

SEQ ID NO: 1094763 - DNA, 20 bp, Homo sapiens
aggacagtttatcctgtctg

SEQ ID NO: 1094764 - DNA, 16 bp, Homo sapiens
aggacataaagagagc

SEQ ID NO: 1094765 - DNA, 20 bp, Homo sapiens
aggacataaattagaggtct

SEQ ID NO: 1094766 - DNA, 20 bp, Homo sapiens
aggacataatggggtcctgg

SEQ ID NO: 1094767 - DNA, 16 bp, Homo sapiens
aggacatactgcatgt

SEQ ID NO: 1094768 - DNA, 12 bp, Homo sapiens
aggacatcagca

SEQ ID NO: 1094769 - DNA, 12 bp, Homo sapiens
aggacatcataa

SEQ ID NO: 1094770 - DNA, 19 bp, Homo sapiens
aggacatgaacagacactt

SEQ ID NO: 1094771 - DNA, 19 bp, Homo sapiens
aggacatgagtctgtagga

SEQ ID NO: 1094772 - DNA, 19 bp, Homo sapiens
aggagcttcttgtttcctt

SEQ ID NO: 1094773 - DNA, 19 bp, Homo sapiens
aggagcttgggcagtgccc

SEQ ID NO: 1094774 - DNA, 22 bp, Homo sapiens
aggagcttgggcagtgccccag

SEQ ID NO: 1094775 - DNA, 15 bp, Homo sapiens
aggagctttctcaat

SEQ ID NO: 1094776 - DNA, 16 bp, Homo sapiens
aggagctttctcaatg

SEQ ID NO: 1094777 - DNA, 13 bp, Homo sapiens
aggagcttttctg

SEQ ID NO: 1094778 - DNA, 20 bp, Homo sapiens
aggaggaaaacacagcctcc

SEQ ID NO: 1094779 - DNA, 21 bp, Homo sapiens
aggaggaaaacacagcctccc

SEQ ID NO: 1094780 - DNA, 22 bp, Homo sapiens
aggaggaaaacacagcctccct

SEQ ID NO: 1094781 - DNA, 23 bp, Homo sapiens
aggaggaaaacacagcctccctg

SEQ ID NO: 1094782 - DNA, 16 bp, Homo sapiens
aggaggaaacagttct

SEQ ID NO: 1094783 - DNA, 20 bp, Homo sapiens
aggaggaaacgggttaaaaa

SEQ ID NO: 1094784 - DNA, 20 bp, Homo sapiens
aggaggaaataactaagaga

SEQ ID NO: 1094785 - DNA, 15 bp, Homo sapiens
aggaggaacgggcag

SEQ ID NO: 1094786 - DNA, 18 bp, Homo sapiens
aggaggaacgggcagcca

SEQ ID NO: 1094787 - DNA, 22 bp, Homo sapiens
aggaggaatcatgtcaggcctg

SEQ ID NO: 1094788 - DNA, 19 bp, Homo sapiens
aggaggaatgctggactgg

SEQ ID NO: 1094789 - DNA, 23 bp, Homo sapiens
aggaggaattagttgggatgcca

SEQ ID NO: 1094790 - DNA, 12 bp, Homo sapiens
aggaggacccag

SEQ ID NO: 1094791 - DNA, 14 bp, Homo sapiens
aggaggacccagga

SEQ ID NO: 1094792 - DNA, 18 bp, Homo sapiens
aggaggacccaggacagg

SEQ ID NO: 1094793 - DNA, 15 bp, Homo sapiens
aggaggacccctgcc

SEQ ID NO: 1094794 - DNA, 20 bp, Homo sapiens
aggaggacccctgccttcct

SEQ ID NO: 1094795 - DNA, 12 bp, Homo sapiens
aggaggagaagg

SEQ ID NO: 1094796 - DNA, 11 bp, Homo sapiens
aggaggagaga

SEQ ID NO: 1094797 - DNA, 14 bp, Homo sapiens
aggaggagccttgc

SEQ ID NO: 1094798 - DNA, 13 bp, Homo sapiens
aggaggagctctc

SEQ ID NO: 1094799 - DNA, 13 bp, Homo sapiens
aggaggagctgcc

SEQ ID NO: 1094800 - DNA, 17 bp, Homo sapiens
aggaggaggacacagca

SEQ ID NO: 1094801 - DNA, 16 bp, Homo sapiens
aggaggaggagatggc

SEQ ID NO: 1094802 - DNA, 11 bp, Homo sapiens
aggaggaggct

SEQ ID NO: 1094803 - DNA, 12 bp, Homo sapiens
aggaggaggctg

SEQ ID NO: 1094804 - DNA, 15 bp, Homo sapiens
aggaggagggaggcc

SEQ ID NO: 1094805 - DNA, 17 bp, Homo sapiens
aggaggaggtgggggct

SEQ ID NO: 1094806 - DNA, 21 bp, Homo sapiens
aggaggatgtccctgggccag

SEQ ID NO: 1094807 - DNA, 14 bp, Homo sapiens
aggaggattgcctt

SEQ ID NO: 1094808 - DNA, 18 bp, Homo sapiens
aggaggcacctacactca

SEQ ID NO: 1094809 - DNA, 20 bp, Homo sapiens
aggaggcagaggttgcagtg

SEQ ID NO: 1094810 - DNA, 18 bp, Homo sapiens
aggaggcagccccctcca

SEQ ID NO: 1094811 - DNA, 19 bp, Homo sapiens
aggaggcagccccctccac

SEQ ID NO: 1094812 - DNA, 20 bp, Homo sapiens
aggaggcagccccctccaca

SEQ ID NO: 1094813 - DNA, 15 bp, Homo sapiens
aggaggccaataaaa

SEQ ID NO: 1094814 - DNA, 13 bp, Homo sapiens
aggaggccacctc

SEQ ID NO: 1094815 - DNA, 22 bp, Homo sapiens
aggaggccacctctccaagggc

SEQ ID NO: 1094816 - DNA, 12 bp, Homo sapiens
aggaggcccctg

SEQ ID NO: 1094817 - DNA, 19 bp, Homo sapiens
aggaggccctggtgtcagg

SEQ ID NO: 1094818 - DNA, 23 bp, Homo sapiens
aggaggccctggtgtcaggcagg

SEQ ID NO: 1094819 - DNA, 22 bp, Homo sapiens
aggaggcctggaccgagatgtg

SEQ ID NO: 1094820 - DNA, 24 bp, Homo sapiens
aggaggcctggaccgagatgtgag

SEQ ID NO: 1094821 - DNA, 20 bp, Homo sapiens
aggaggcgcccttggcttct

SEQ ID NO: 1094822 - DNA, 20 bp, Homo sapiens
aggaggcggaggttgcagta

SEQ ID NO: 1094823 - DNA, 21 bp, Homo sapiens
aggaggctcaggtgatctgtt

SEQ ID NO: 1094824 - DNA, 13 bp, Homo sapiens
aggaggctccaga

SEQ ID NO: 1094825 - DNA, 19 bp, Homo sapiens
aggaggctgaggcaggagg

SEQ ID NO: 1094826 - DNA, 13 bp, Homo sapiens
aggaggctgaggt

SEQ ID NO: 1094827 - DNA, 13 bp, Homo sapiens
aggaggctgcatg

SEQ ID NO: 1094828 - DNA, 19 bp, Homo sapiens
aggaggctgcatgctctgg

SEQ ID NO: 1094829 - DNA, 19 bp, Homo sapiens
aggaggctgccctgagggg

SEQ ID NO: 1094830 - DNA, 21 bp, Homo sapiens
aggaggctggaggaagggggg

SEQ ID NO: 1094831 - DNA, 23 bp, Homo sapiens
aggaggctggccaaggtgtccag

SEQ ID NO: 1094832 - DNA, 24 bp, Homo sapiens
aggaggctggccaaggtgtccagg

SEQ ID NO: 1094833 - DNA, 15 bp, Homo sapiens
aggagggagaaagga

SEQ ID NO: 1094834 - DNA, 16 bp, Homo sapiens
aggagggagacactgg

SEQ ID NO: 1094835 - DNA, 23 bp, Homo sapiens
aggagggagacactggcccctca

SEQ ID NO: 1094836 - DNA, 14 bp, Homo sapiens
aggagggagaggga

SEQ ID NO: 1094837 - DNA, 15 bp, Homo sapiens
aggagggagagggag

SEQ ID NO: 1094838 - DNA, 12 bp, Homo sapiens
aggagggaggcg

SEQ ID NO: 1094839 - DNA, 14 bp, Homo sapiens
aggagggaggcggg

SEQ ID NO: 1094840 - DNA, 23 bp, Homo sapiens
aggagggcagagccatgggcctg

SEQ ID NO: 1094841 - DNA, 21 bp, Homo sapiens
aggagggcaggctgaggtggg

SEQ ID NO: 1094842 - DNA, 12 bp, Homo sapiens
aggagggccagc

SEQ ID NO: 1094843 - DNA, 20 bp, Homo sapiens
aggagggccctacctgattg

SEQ ID NO: 1094844 - DNA, 14 bp, Homo sapiens
aggagggcgcccat

SEQ ID NO: 1094845 - DNA, 17 bp, Homo sapiens
aggaggggaaaaaaatg

SEQ ID NO: 1094846 - DNA, 19 bp, Homo sapiens
aggaggggaaaaaaatgtt

SEQ ID NO: 1094847 - DNA, 15 bp, Homo sapiens
aggaggggaaaaaat

SEQ ID NO: 1094848 - DNA, 12 bp, Homo sapiens
aggaggggaaga

SEQ ID NO: 1094849 - DNA, 18 bp, Homo sapiens
aggaggggaagaggcctg

SEQ ID NO: 1094850 - DNA, 18 bp, Homo sapiens
aggaggggaagctgggcc

SEQ ID NO: 1094851 - DNA, 22 bp, Homo sapiens
aggaggggacttgtaggaatct

SEQ ID NO: 1094852 - DNA, 12 bp, Homo sapiens
aggaggggagaa

SEQ ID NO: 1094853 - DNA, 19 bp, Homo sapiens
aggaggggagagacaggca

SEQ ID NO: 1094854 - DNA, 17 bp, Homo sapiens
aggagggggccgggcgc

SEQ ID NO: 1094855 - DNA, 22 bp, Homo sapiens
aggaggggtgagtcccctactc

SEQ ID NO: 1094856 - DNA, 18 bp, Homo sapiens
aggagggtgacgcccagc

SEQ ID NO: 1094857 - DNA, 21 bp, Homo sapiens
aggagggtgacgcccagctcc

SEQ ID NO: 1094858 - DNA, 15 bp, Homo sapiens
aggagggtggaggaa

SEQ ID NO: 1094859 - DNA, 16 bp, Homo sapiens
aggagggtggaggaag

SEQ ID NO: 1094860 - DNA, 15 bp, Homo sapiens
aggagggtgggaagg

SEQ ID NO: 1094861 - DNA, 16 bp, Homo sapiens
aggagggtgtaatgga

SEQ ID NO: 1094862 - DNA, 20 bp, Homo sapiens
aggaggtcatctgaccttca

SEQ ID NO: 1094863 - DNA, 20 bp, Homo sapiens
aggaggtggagaaaattgga

SEQ ID NO: 1094864 - DNA, 13 bp, Homo sapiens
aggaggtggcttc

SEQ ID NO: 1094865 - DNA, 14 bp, Homo sapiens
aggaggtgggggct

SEQ ID NO: 1094866 - DNA, 18 bp, Homo sapiens
aggaggttgtggatgctc

SEQ ID NO: 1094867 - DNA, 14 bp, Homo sapiens
aggaggtttgcagg

SEQ ID NO: 1094868 - DNA, 16 bp, Homo sapiens
aggagtaaaattcagt

SEQ ID NO: 1094869 - DNA, 21 bp, Homo sapiens
aggagtaaaattcagtttttt

SEQ ID NO: 1094870 - DNA, 20 bp, Homo sapiens
aggagtaaataattggaaaa

SEQ ID NO: 1094871 - DNA, 17 bp, Homo sapiens
aggagtaagtgtacaat

SEQ ID NO: 1094872 - DNA, 20 bp, Homo sapiens
aggagtaatctgtgtacaaa

SEQ ID NO: 1094873 - DNA, 16 bp, Homo sapiens
aggagtacaaaacaat

SEQ ID NO: 1094874 - DNA, 15 bp, Homo sapiens
aggagtcaggggctc

SEQ ID NO: 1094875 - DNA, 17 bp, Homo sapiens
aggagtcaggggctctg

SEQ ID NO: 1094876 - DNA, 14 bp, Homo sapiens
aggagtcccaagga

SEQ ID NO: 1094877 - DNA, 17 bp, Homo sapiens
aggagtcccaaggaaag

SEQ ID NO: 1094878 - DNA, 21 bp, Homo sapiens
aggagtctctgccacccactc

SEQ ID NO: 1094879 - DNA, 16 bp, Homo sapiens
aggagtctgaggactg

SEQ ID NO: 1094880 - DNA, 13 bp, Homo sapiens
aggagtctgccac

SEQ ID NO: 1094881 - DNA, 17 bp, Homo sapiens
aggagtcttcagaccca

SEQ ID NO: 1094882 - DNA, 15 bp, Homo sapiens
aggagtgacatgaag

SEQ ID NO: 1094883 - DNA, 15 bp, Homo sapiens
aggagtgaccgggca

SEQ ID NO: 1094884 - DNA, 14 bp, Homo sapiens
aggagtgagatcat

SEQ ID NO: 1094885 - DNA, 20 bp, Homo sapiens
aggagtgagtgtatgtgtgt

SEQ ID NO: 1094886 - DNA, 22 bp, Homo sapiens
aggagtgagtgtatgtgtgtgt

SEQ ID NO: 1094887 - DNA, 22 bp, Homo sapiens
aggagtgattgaaccagctcat

SEQ ID NO: 1094888 - DNA, 17 bp, Homo sapiens
aggagtgcagccttctc

SEQ ID NO: 1094889 - DNA, 20 bp, Homo sapiens
aggagtgccaggaccagcct

SEQ ID NO: 1094890 - DNA, 16 bp, Homo sapiens
aggagtgcccgccttg

SEQ ID NO: 1094891 - DNA, 23 bp, Homo sapiens
aggagtggcagctgtcccctctc

SEQ ID NO: 1094892 - DNA, 23 bp, Homo sapiens
aggagtgggtgacaagagcctga

SEQ ID NO: 1094893 - DNA, 18 bp, Homo sapiens
aggagtgggttgatttca

SEQ ID NO: 1094894 - DNA, 20 bp, Homo sapiens
aggagtgtgtgacattccag

SEQ ID NO: 1094895 - DNA, 18 bp, Homo sapiens
aggagtgtgtgatttttt

SEQ ID NO: 1094896 - DNA, 17 bp, Homo sapiens
aggagtgttattgcatg

SEQ ID NO: 1094897 - DNA, 20 bp, Homo sapiens
aggagttccttgatctgtat

SEQ ID NO: 1094898 - DNA, 21 bp, Homo sapiens
aggagttctctgatgcagaaa

SEQ ID NO: 1094899 - DNA, 22 bp, Homo sapiens
aggagttctctgatgcagaaat

SEQ ID NO: 1094900 - DNA, 15 bp, Homo sapiens
aggagttctcttccg

SEQ ID NO: 1094901 - DNA, 20 bp, Homo sapiens
aggagttgagtacagtgagg

SEQ ID NO: 1094902 - DNA, 12 bp, Homo sapiens
aggagttgcctg

SEQ ID NO: 1094903 - DNA, 17 bp, Homo sapiens
aggagtttattacaatg

SEQ ID NO: 1094904 - DNA, 20 bp, Homo sapiens
aggagtttattacaatgtat

SEQ ID NO: 1094905 - DNA, 22 bp, Homo sapiens
aggagtttattacaatgtatct

SEQ ID NO: 1094906 - DNA, 19 bp, Homo sapiens
aggagtttgagaccagcct

SEQ ID NO: 1094907 - DNA, 20 bp, Homo sapiens
aggagtttgaggctgcagcg

SEQ ID NO: 1094908 - DNA, 18 bp, Homo sapiens
aggagttttactgcctgt

SEQ ID NO: 1094909 - DNA, 21 bp, Homo sapiens
aggagttttgttccagaggag

SEQ ID NO: 1094910 - DNA, 22 bp, Homo sapiens
aggagttttgttccagaggagc

SEQ ID NO: 1094911 - DNA, 21 bp, Homo sapiens
aggataaaaagccagggctgg

SEQ ID NO: 1094912 - DNA, 21 bp, Homo sapiens
aggataaaaaggaaggagaga

SEQ ID NO: 1094913 - DNA, 15 bp, Homo sapiens
aggataaagccactt

SEQ ID NO: 1094914 - DNA, 22 bp, Homo sapiens
aggataagaaagcctaaaattg

SEQ ID NO: 1094915 - DNA, 14 bp, Homo sapiens
aggataatatattt

SEQ ID NO: 1094916 - DNA, 18 bp, Homo sapiens
aggataatgaaataatca

SEQ ID NO: 1094917 - DNA, 22 bp, Homo sapiens
aggataattatccaataaaaaa

SEQ ID NO: 1094918 - DNA, 21 bp, Homo sapiens
aggatacatgtgccgaatgtg

SEQ ID NO: 1094919 - DNA, 14 bp, Homo sapiens
aggatacatttaat

SEQ ID NO: 1094920 - DNA, 13 bp, Homo sapiens
aggatactctgtc

SEQ ID NO: 1094921 - DNA, 17 bp, Homo sapiens
aggatagctaactgtaa

SEQ ID NO: 1094922 - DNA, 20 bp, Homo sapiens
aggatagctaactgtaaatc

SEQ ID NO: 1094923 - DNA, 15 bp, Homo sapiens
aggatataatgtgtg

SEQ ID NO: 1094924 - DNA, 14 bp, Homo sapiens
aggatatattttca

SEQ ID NO: 1094925 - DNA, 22 bp, Homo sapiens
aggatatccttatcagagctaa

SEQ ID NO: 1094926 - DNA, 21 bp, Homo sapiens
aggatatcggcatttgtttct

SEQ ID NO: 1094927 - DNA, 19 bp, Homo sapiens
aggatatgattaatattat

SEQ ID NO: 1094928 - DNA, 19 bp, Homo sapiens
aggatatgtatattttaat

SEQ ID NO: 1094929 - DNA, 20 bp, Homo sapiens
aggatattaaacgtgtaaat

SEQ ID NO: 1094930 - DNA, 15 bp, Homo sapiens
aggatattatctacc

SEQ ID NO: 1094931 - DNA, 22 bp, Homo sapiens
aggatattatctacctgttctg

SEQ ID NO: 1094932 - DNA, 13 bp, Homo sapiens
aggatattctact

SEQ ID NO: 1094933 - DNA, 16 bp, Homo sapiens
aggatatttaagaaaa

SEQ ID NO: 1094934 - DNA, 17 bp, Homo sapiens
aggatatttaagaaaat

SEQ ID NO: 1094935 - DNA, 18 bp, Homo sapiens
aggatatttaagaaaata

SEQ ID NO: 1094936 - DNA, 19 bp, Homo sapiens
aggatatttaagaaaatac

SEQ ID NO: 1094937 - DNA, 22 bp, Homo sapiens
aggatattttggggggcagaga

SEQ ID NO: 1094938 - DNA, 16 bp, Homo sapiens
aggatcactggagccc

SEQ ID NO: 1094939 - DNA, 19 bp, Homo sapiens
aggatcactggagcccagg

SEQ ID NO: 1094940 - DNA, 22 bp, Homo sapiens
aggatcactggagcccaggagt

SEQ ID NO: 1094941 - DNA, 19 bp, Homo sapiens
aggatcacttgagcccagg

SEQ ID NO: 1094942 - DNA, 16 bp, Homo sapiens
aggatcaggctgctgg

SEQ ID NO: 1094943 - DNA, 23 bp, Homo sapiens
aggatcagttaactattgcattt

SEQ ID NO: 1094944 - DNA, 15 bp, Homo sapiens
aggatccagagagca

SEQ ID NO: 1094945 - DNA, 16 bp, Homo sapiens
aggatccagagagcag

SEQ ID NO: 1094946 - DNA, 17 bp, Homo sapiens
aggatccagtgacatga

SEQ ID NO: 1094947 - DNA, 22 bp, Homo sapiens
aggatccagtgacatgattctg

SEQ ID NO: 1094948 - DNA, 14 bp, Homo sapiens
aggatccccctctt

SEQ ID NO: 1094949 - DNA, 17 bp, Homo sapiens
aggatccgctgccacca

SEQ ID NO: 1094950 - DNA, 22 bp, Homo sapiens
aggatcctattctcaccaggaa

SEQ ID NO: 1094951 - DNA, 13 bp, Homo sapiens
aggatcctgcagg

SEQ ID NO: 1094952 - DNA, 15 bp, Homo sapiens
aggatcctggaggct

SEQ ID NO: 1094953 - DNA, 22 bp, Homo sapiens
aggatcgaagggtttttagaga

SEQ ID NO: 1094954 - DNA, 15 bp, Homo sapiens
aggatctaagggaag

SEQ ID NO: 1094955 - DNA, 14 bp, Homo sapiens
aggatctacttttt

SEQ ID NO: 1094956 - DNA, 14 bp, Homo sapiens
aggatctcaagcca

SEQ ID NO: 1094957 - DNA, 19 bp, Homo sapiens
aggatctcaagccagcccc

SEQ ID NO: 1094958 - DNA, 13 bp, Homo sapiens
aggatctctcagg

SEQ ID NO: 1094959 - DNA, 20 bp, Homo sapiens
aggatctctcaggagcacag

SEQ ID NO: 1094960 - DNA, 21 bp, Homo sapiens
aggatctctcaggagcacagg

SEQ ID NO: 1094961 - DNA, 22 bp, Homo sapiens
aggatctctcaggagcacaggc

SEQ ID NO: 1094962 - DNA, 15 bp, Homo sapiens
aggatctgctgaggc

SEQ ID NO: 1094963 - DNA, 21 bp, Homo sapiens
aggatctgctgaggcccagtg

SEQ ID NO: 1094964 - DNA, 15 bp, Homo sapiens
aggatctttgtggcc

SEQ ID NO: 1094965 - DNA, 20 bp, Homo sapiens
aggatctttgtggccaagga

SEQ ID NO: 1094966 - DNA, 21 bp, Homo sapiens
aggatgaagaacacagcatgt

SEQ ID NO: 1094967 - DNA, 20 bp, Homo sapiens
aggatgaatgaggtcccagg

SEQ ID NO: 1094968 - DNA, 22 bp, Homo sapiens
aggatgaatgaggtcccaggca

SEQ ID NO: 1094969 - DNA, 13 bp, Homo sapiens
aggatgacttttt

SEQ ID NO: 1094970 - DNA, 16 bp, Homo sapiens
aggatgagaatgtgac

SEQ ID NO: 1094971 - DNA, 15 bp, Homo sapiens
aggatgagcagaggg

SEQ ID NO: 1094972 - DNA, 13 bp, Homo sapiens
aggatgagctgga

SEQ ID NO: 1094973 - DNA, 21 bp, Homo sapiens
aggatgatttcagaaggagaa

SEQ ID NO: 1094974 - DNA, 22 bp, Homo sapiens
aggatgcacagagttgttacat

SEQ ID NO: 1094975 - DNA, 16 bp, Homo sapiens
aggatgcacatataca

SEQ ID NO: 1094976 - DNA, 21 bp, Homo sapiens
aggatgcacatttctggattg

SEQ ID NO: 1094977 - DNA, 22 bp, Homo sapiens
aggatgcattctgataggaggg

SEQ ID NO: 1094978 - DNA, 21 bp, Homo sapiens
aggatgccacgcacttcctct

SEQ ID NO: 1094979 - DNA, 21 bp, Homo sapiens
aggatgccttagcatgtgact

SEQ ID NO: 1094980 - DNA, 15 bp, Homo sapiens
aggatgccttttctg

SEQ ID NO: 1094981 - DNA, 19 bp, Homo sapiens
aggatgctaacatctaaaa

SEQ ID NO: 1094982 - DNA, 17 bp, Homo sapiens
aggatgctgcagcagag

SEQ ID NO: 1094983 - DNA, 21 bp, Homo sapiens
aggatgctgcagtgaggctgt

SEQ ID NO: 1094984 - DNA, 16 bp, Homo sapiens
aggatgcttgtacata

SEQ ID NO: 1094985 - DNA, 21 bp, Homo sapiens
aggatgcttgtacataatgcg

SEQ ID NO: 1094986 - DNA, 14 bp, Homo sapiens
aggatggaacacgg

SEQ ID NO: 1094987 - DNA, 19 bp, Homo sapiens
aggatggaacacggccaca

SEQ ID NO: 1094988 - DNA, 15 bp, Homo sapiens
aggatggcagcaatg

SEQ ID NO: 1094989 - DNA, 18 bp, Homo sapiens
aggatggcctttccttcc

SEQ ID NO: 1094990 - DNA, 17 bp, Homo sapiens
aggatgggatctttctg

SEQ ID NO: 1094991 - DNA, 17 bp, Homo sapiens
aggatgggatgggttcc

SEQ ID NO: 1094992 - DNA, 22 bp, Homo sapiens
aggatgggctgagctagcctcc

SEQ ID NO: 1094993 - DNA, 19 bp, Homo sapiens
aggatgggggctggcctct

SEQ ID NO: 1094994 - DNA, 13 bp, Homo sapiens
aggatgggtcccc

SEQ ID NO: 1094995 - DNA, 20 bp, Homo sapiens
aggatgggtcccctccgcca

SEQ ID NO: 1094996 - DNA, 21 bp, Homo sapiens
aggatggtctcgatctcctga

SEQ ID NO: 1094997 - DNA, 16 bp, Homo sapiens
aggatggtgggcagga

SEQ ID NO: 1094998 - DNA, 18 bp, Homo sapiens
aggatggtgggcaggatc

SEQ ID NO: 1094999 - DNA, 19 bp, Homo sapiens
aggatggtggttattttaa

SEQ ID NO: 1095000 - DNA, 22 bp, Homo sapiens
aggatgtaaacagtgcctgctg

SEQ ID NO: 1095001 - DNA, 11 bp, Homo sapiens
aggatgtaaag

SEQ ID NO: 1095002 - DNA, 21 bp, Homo sapiens
aggatgtatattttatataaa

SEQ ID NO: 1095003 - DNA, 17 bp, Homo sapiens
aggatgtccctgggcca

SEQ ID NO: 1095004 - DNA, 23 bp, Homo sapiens
aggatgtccctgggccagggtct

SEQ ID NO: 1095005 - DNA, 21 bp, Homo sapiens
aggatgtggagctactgatga

SEQ ID NO: 1095006 - DNA, 14 bp, Homo sapiens
aggatgtgtgcatg

SEQ ID NO: 1095007 - DNA, 15 bp, Homo sapiens
aggatgtgttttgca

SEQ ID NO: 1095008 - DNA, 20 bp, Homo sapiens
aggatgttgcttctgaatca

SEQ ID NO: 1095009 - DNA, 23 bp, Homo sapiens
aggatgttgcttctgaatcactg

SEQ ID NO: 1095010 - DNA, 20 bp, Homo sapiens
aggattaagggacgggggtg

SEQ ID NO: 1095011 - DNA, 22 bp, Homo sapiens
aggattacttagattgtgttcc

SEQ ID NO: 1095012 - DNA, 24 bp, Homo sapiens
aggattattactaattctatttct

SEQ ID NO: 1095013 - DNA, 13 bp, Homo sapiens
aggattattgata

SEQ ID NO: 1095014 - DNA, 19 bp, Homo sapiens
aggcatcagtccctatgta

SEQ ID NO: 1095015 - DNA, 21 bp, Homo sapiens
aggcatcatggaaagactggg

SEQ ID NO: 1095016 - DNA, 16 bp, Homo sapiens
aggcatcccaggggac

SEQ ID NO: 1095017 - DNA, 17 bp, Homo sapiens
aggcatccttgtctttt

SEQ ID NO: 1095018 - DNA, 21 bp, Homo sapiens
aggcatcgggggtgaatcttg

SEQ ID NO: 1095019 - DNA, 19 bp, Homo sapiens
aggcatcgtcatgcacagt

SEQ ID NO: 1095020 - DNA, 14 bp, Homo sapiens
aggcatctgagggg

SEQ ID NO: 1095021 - DNA, 19 bp, Homo sapiens
aggcatctgttagcagagt

SEQ ID NO: 1095022 - DNA, 21 bp, Homo sapiens
aggcatctgttagcagagtct

SEQ ID NO: 1095023 - DNA, 14 bp, Homo sapiens
aggcatcttttcta

SEQ ID NO: 1095024 - DNA, 11 bp, Homo sapiens
aggcatgaagg

SEQ ID NO: 1095025 - DNA, 14 bp, Homo sapiens
aggcatgagaaaga

SEQ ID NO: 1095026 - DNA, 14 bp, Homo sapiens
aggcatgagccact

SEQ ID NO: 1095027 - DNA, 22 bp, Homo sapiens
aggcatgagggatcacagggcc

SEQ ID NO: 1095028 - DNA, 20 bp, Homo sapiens
aggcatgatgatctgcctct

SEQ ID NO: 1095029 - DNA, 19 bp, Homo sapiens
aggcatgcagctgcctggg

SEQ ID NO: 1095030 - DNA, 15 bp, Homo sapiens
aggcatgcctgtgtg

SEQ ID NO: 1095031 - DNA, 12 bp, Homo sapiens
aggcatggccct

SEQ ID NO: 1095032 - DNA, 14 bp, Homo sapiens
aggcatggccctgg

SEQ ID NO: 1095033 - DNA, 15 bp, Homo sapiens
aggcatggccctggg

SEQ ID NO: 1095034 - DNA, 23 bp, Homo sapiens
aggcatggctcagagcttgaaga

SEQ ID NO: 1095035 - DNA, 21 bp, Homo sapiens
aggcatggtcccttaaggcac

SEQ ID NO: 1095036 - DNA, 23 bp, Homo sapiens
aggcatggtcccttaaggcacag

SEQ ID NO: 1095037 - DNA, 19 bp, Homo sapiens
aggcatgtcagaggacccc

SEQ ID NO: 1095038 - DNA, 21 bp, Homo sapiens
aggcatgtcagaggaccccag

SEQ ID NO: 1095039 - DNA, 22 bp, Homo sapiens
aggcatgtcagaggaccccagg

SEQ ID NO: 1095040 - DNA, 15 bp, Homo sapiens
aggcatgtcccaccc

SEQ ID NO: 1095041 - DNA, 16 bp, Homo sapiens
aggcatgtcccaccca

SEQ ID NO: 1095042 - DNA, 14 bp, Homo sapiens
aggcatgtcctgga

SEQ ID NO: 1095043 - DNA, 13 bp, Homo sapiens
aggcattaatgtt

SEQ ID NO: 1095044 - DNA, 20 bp, Homo sapiens
aggcattaatgtttctatct

SEQ ID NO: 1095045 - DNA, 20 bp, Homo sapiens
aggcattacttgctttcaat

SEQ ID NO: 1095046 - DNA, 20 bp, Homo sapiens
aggcattatttaatgtttga

SEQ ID NO: 1095047 - DNA, 14 bp, Homo sapiens
aggcattgaggaag

SEQ ID NO: 1095048 - DNA, 13 bp, Homo sapiens
aggcattgccaag

SEQ ID NO: 1095049 - DNA, 23 bp, Homo sapiens
aggcattgccttctctgcccaca

SEQ ID NO: 1095050 - DNA, 20 bp, Homo sapiens
aggcatttaaaatggaaaag

SEQ ID NO: 1095051 - DNA, 14 bp, Homo sapiens
aggcatttcctgct

SEQ ID NO: 1095052 - DNA, 22 bp, Homo sapiens
aggcatttcctgctgaacgttt

SEQ ID NO: 1095053 - DNA, 14 bp, Homo sapiens
aggcatttgtcttt

SEQ ID NO: 1095054 - DNA, 14 bp, Homo sapiens
aggccaaagcccca

SEQ ID NO: 1095055 - DNA, 16 bp, Homo sapiens
aggccaaatgcacaag

SEQ ID NO: 1095056 - DNA, 14 bp, Homo sapiens
aggccaacagcacc

SEQ ID NO: 1095057 - DNA, 18 bp, Homo sapiens
aggccaacagcacctccc

SEQ ID NO: 1095058 - DNA, 13 bp, Homo sapiens
aggccaaccagcc

SEQ ID NO: 1095059 - DNA, 15 bp, Homo sapiens
aggccaaccagcccg

SEQ ID NO: 1095060 - DNA, 19 bp, Homo sapiens
aggccaaccagcccgacag

SEQ ID NO: 1095061 - DNA, 18 bp, Homo sapiens
aggccaagaatattgcaa

SEQ ID NO: 1095062 - DNA, 18 bp, Homo sapiens
aggccaagagcagaggca

SEQ ID NO: 1095063 - DNA, 20 bp, Homo sapiens
aggccaagagcagaggcagc

SEQ ID NO: 1095064 - DNA, 13 bp, Homo sapiens
aggccaaggactg

SEQ ID NO: 1095065 - DNA, 22 bp, Homo sapiens
aggccaaggactgactttgcca

SEQ ID NO: 1095066 - DNA, 13 bp, Homo sapiens
aggccaaggcagg

SEQ ID NO: 1095067 - DNA, 16 bp, Homo sapiens
aggccaaggcccaact

SEQ ID NO: 1095068 - DNA, 14 bp, Homo sapiens
aggccaaggtgcat

SEQ ID NO: 1095069 - DNA, 18 bp, Homo sapiens
aggccaaggtgggaggat

SEQ ID NO: 1095070 - DNA, 23 bp, Homo sapiens
aggccaagtccgcagaagccctg

SEQ ID NO: 1095071 - DNA, 21 bp, Homo sapiens
aggccaagtgcaggctggcac

SEQ ID NO: 1095072 - DNA, 19 bp, Homo sapiens
aggccaataataaagacat

SEQ ID NO: 1095073 - DNA, 22 bp, Homo sapiens
aggccacaccatctcctttcag

SEQ ID NO: 1095074 - DNA, 17 bp, Homo sapiens
aggccacactcagcaca

SEQ ID NO: 1095075 - DNA, 22 bp, Homo sapiens
aggccacagtggggctgcaggc

SEQ ID NO: 1095076 - DNA, 21 bp, Homo sapiens
aggccacatgtcaccgtggac

SEQ ID NO: 1095077 - DNA, 22 bp, Homo sapiens
aggccaccatattcagtgctgt

SEQ ID NO: 1095078 - DNA, 14 bp, Homo sapiens
aggccaccctccac

SEQ ID NO: 1095079 - DNA, 16 bp, Homo sapiens
aggccacctccagaaa

SEQ ID NO: 1095080 - DNA, 13 bp, Homo sapiens
aggccacctctcc

SEQ ID NO: 1095081 - DNA, 17 bp, Homo sapiens
aggccacctctccaagg

SEQ ID NO: 1095082 - DNA, 16 bp, Homo sapiens
aggccacctgccccct

SEQ ID NO: 1095083 - DNA, 16 bp, Homo sapiens
aggccaccttggagga

SEQ ID NO: 1095084 - DNA, 17 bp, Homo sapiens
aggccaccttggaggag

SEQ ID NO: 1095085 - DNA, 21 bp, Homo sapiens
aggccacgtcccaccccacct

SEQ ID NO: 1095086 - DNA, 15 bp, Homo sapiens
aggccactagtgaca

SEQ ID NO: 1095087 - DNA, 14 bp, Homo sapiens
aggccactcagagg

SEQ ID NO: 1095088 - DNA, 15 bp, Homo sapiens
aggccactcagaggc

SEQ ID NO: 1095089 - DNA, 22 bp, Homo sapiens
aggccactcagaggcccccagt

SEQ ID NO: 1095090 - DNA, 13 bp, Homo sapiens
aggccactcctcc

SEQ ID NO: 1095091 - DNA, 15 bp, Homo sapiens
aggccactgtggcca

SEQ ID NO: 1095092 - DNA, 18 bp, Homo sapiens
aggccactgtggccagag

SEQ ID NO: 1095093 - DNA, 23 bp, Homo sapiens
aggccactgtggccagagctgga

SEQ ID NO: 1095094 - DNA, 15 bp, Homo sapiens
aggccagagtctccc

SEQ ID NO: 1095095 - DNA, 19 bp, Homo sapiens
aggccagagtctcccagtg

SEQ ID NO: 1095096 - DNA, 16 bp, Homo sapiens
aggccagagtggcctg

SEQ ID NO: 1095097 - DNA, 20 bp, Homo sapiens
aggccagatggcccctccac

SEQ ID NO: 1095098 - DNA, 12 bp, Homo sapiens
aggccagcaacg

SEQ ID NO: 1095099 - DNA, 13 bp, Homo sapiens
aggccagcaacgc

SEQ ID NO: 1095100 - DNA, 14 bp, Homo sapiens
aggccagcaacgct

SEQ ID NO: 1095101 - DNA, 17 bp, Homo sapiens
aggccagcaataaaaac

SEQ ID NO: 1095102 - DNA, 15 bp, Homo sapiens
aggccagcccagcca

SEQ ID NO: 1095103 - DNA, 15 bp, Homo sapiens
aggccagccccaccc

SEQ ID NO: 1095104 - DNA, 18 bp, Homo sapiens
aggccagccccacccagg

SEQ ID NO: 1095105 - DNA, 18 bp, Homo sapiens
aggccagcccccccaccc

SEQ ID NO: 1095106 - DNA, 19 bp, Homo sapiens
aggccagcccccccaccca

SEQ ID NO: 1095107 - DNA, 20 bp, Homo sapiens
aggccagcccccccacccac

SEQ ID NO: 1095108 - DNA, 21 bp, Homo sapiens
aggccagcccccccacccacc

SEQ ID NO: 1095109 - DNA, 22 bp, Homo sapiens
aggccagcccccccacccaccc

SEQ ID NO: 1095110 - DNA, 22 bp, Homo sapiens
aggccagcctccgagagggaga

SEQ ID NO: 1095111 - DNA, 23 bp, Homo sapiens
aggccagcctccgagagggagag

SEQ ID NO: 1095112 - DNA, 19 bp, Homo sapiens
aggccagcttcgtgctgga

SEQ ID NO: 1095113 - DNA, 14 bp, Homo sapiens
aggccaggccacca

SEQ ID NO: 1095114 - DNA, 16 bp, Homo sapiens
aggccaggccaccagg

SEQ ID NO: 1095115 - DNA, 19 bp, Homo sapiens
aggccaggccaccaggatg

SEQ ID NO: 1095116 - DNA, 13 bp, Homo sapiens
aggccaggccagc

SEQ ID NO: 1095117 - DNA, 13 bp, Homo sapiens
aggccagggcaga

SEQ ID NO: 1095118 - DNA, 20 bp, Homo sapiens
aggccagggcagcaagggac

SEQ ID NO: 1095119 - DNA, 13 bp, Homo sapiens
aggccagggcagt

SEQ ID NO: 1095120 - DNA, 12 bp, Homo sapiens
aggccagggcct

SEQ ID NO: 1095121 - DNA, 16 bp, Homo sapiens
aggccagggctgatgg

SEQ ID NO: 1095122 - DNA, 14 bp, Homo sapiens
aggccaggtgcagt

SEQ ID NO: 1095123 - DNA, 13 bp, Homo sapiens
aggccaggtgggc

SEQ ID NO: 1095124 - DNA, 17 bp, Homo sapiens
aggccaggtgggcggac

SEQ ID NO: 1095125 - DNA, 15 bp, Homo sapiens
aggccagtgagctgt

SEQ ID NO: 1095126 - DNA, 15 bp, Homo sapiens
aggccagtggaagaa

SEQ ID NO: 1095127 - DNA, 23 bp, Homo sapiens
aggccagtggactctgaggactc

SEQ ID NO: 1095128 - DNA, 13 bp, Homo sapiens
aggccagtggccc

SEQ ID NO: 1095129 - DNA, 19 bp, Homo sapiens
aggccagtggcccccgggc

SEQ ID NO: 1095130 - DNA, 18 bp, Homo sapiens
aggccagttgatctgctc

SEQ ID NO: 1095131 - DNA, 16 bp, Homo sapiens
aggccatcagggccct

SEQ ID NO: 1095132 - DNA, 22 bp, Homo sapiens
aggccatcagggccctgcccca

SEQ ID NO: 1095133 - DNA, 21 bp, Homo sapiens
aggccatctgggctcctccag

SEQ ID NO: 1095134 - DNA, 17 bp, Homo sapiens
aggccatctgtaaatat

SEQ ID NO: 1095135 - DNA, 22 bp, Homo sapiens
aggccatctgtaaatatcccag

SEQ ID NO: 1095136 - DNA, 19 bp, Homo sapiens
aggccgcgcgtccagctgc

SEQ ID NO: 1095137 - DNA, 18 bp, Homo sapiens
aggccgcggcctccccga

SEQ ID NO: 1095138 - DNA, 18 bp, Homo sapiens
aggccgctagaggcctga

SEQ ID NO: 1095139 - DNA, 20 bp, Homo sapiens
aggccgctgttcacccacag

SEQ ID NO: 1095140 - DNA, 16 bp, Homo sapiens
aggccgcttagtgctg

SEQ ID NO: 1095141 - DNA, 19 bp, Homo sapiens
aggccgggaagagccacct

SEQ ID NO: 1095142 - DNA, 22 bp, Homo sapiens
aggccgggaagagccacctggc

SEQ ID NO: 1095143 - DNA, 16 bp, Homo sapiens
aggccgtcctcccggg

SEQ ID NO: 1095144 - DNA, 21 bp, Homo sapiens
aggccgtcctcccgggccctc

SEQ ID NO: 1095145 - DNA, 14 bp, Homo sapiens
aggccgtgccttgt

SEQ ID NO: 1095146 - DNA, 14 bp, Homo sapiens
aggccgtgtctctg

SEQ ID NO: 1095147 - DNA, 13 bp, Homo sapiens
aggccgttcccct

SEQ ID NO: 1095148 - DNA, 18 bp, Homo sapiens
aggccgttccccttggct

SEQ ID NO: 1095149 - DNA, 21 bp, Homo sapiens
aggccgttccccttggcttcc

SEQ ID NO: 1095150 - DNA, 22 bp, Homo sapiens
aggccgttccccttggcttcct

SEQ ID NO: 1095151 - DNA, 23 bp, Homo sapiens
aggccgttccccttggcttcctc

SEQ ID NO: 1095152 - DNA, 18 bp, Homo sapiens
aggcctaaggaagccagt

SEQ ID NO: 1095153 - DNA, 13 bp, Homo sapiens
aggcctacagagg

SEQ ID NO: 1095154 - DNA, 19 bp, Homo sapiens
aggcctaccccgcagacac

SEQ ID NO: 1095155 - DNA, 19 bp, Homo sapiens
aggcctacctcaagttctt

SEQ ID NO: 1095156 - DNA, 17 bp, Homo sapiens
aggcctagactctgtct

SEQ ID NO: 1095157 - DNA, 16 bp, Homo sapiens
aggcctaggaggcccc

SEQ ID NO: 1095158 - DNA, 23 bp, Homo sapiens
aggcctaggaggccccccgtgtg

SEQ ID NO: 1095159 - DNA, 22 bp, Homo sapiens
aggcctaggtgcagctcctcag

SEQ ID NO: 1095160 - DNA, 15 bp, Homo sapiens
aggcctatgcagaca

SEQ ID NO: 1095161 - DNA, 23 bp, Homo sapiens
aggcctatgcagacatctctgga

SEQ ID NO: 1095162 - DNA, 14 bp, Homo sapiens
aggcctatttcatc

SEQ ID NO: 1095163 - DNA, 21 bp, Homo sapiens
aggcctcaaagcaacccgctg

SEQ ID NO: 1095164 - DNA, 14 bp, Homo sapiens
aggcctcactggct

SEQ ID NO: 1095165 - DNA, 13 bp, Homo sapiens
aggcctcagcctc

SEQ ID NO: 1095166 - DNA, 21 bp, Homo sapiens
aggcctcagtttctccatcag

SEQ ID NO: 1095167 - DNA, 22 bp, Homo sapiens
aggcctcagtttctccatcagc

SEQ ID NO: 1095168 - DNA, 15 bp, Homo sapiens
aggcctcatccaggg

SEQ ID NO: 1095169 - DNA, 13 bp, Homo sapiens
aggcctcatccct

SEQ ID NO: 1095170 - DNA, 15 bp, Homo sapiens
aggcctcatccctcg

SEQ ID NO: 1095171 - DNA, 18 bp, Homo sapiens
aggcctcatttctttgtc

SEQ ID NO: 1095172 - DNA, 20 bp, Homo sapiens
aggcctccaacgcccctgtg

SEQ ID NO: 1095173 - DNA, 22 bp, Homo sapiens
aggcctccaacgcccctgtggc

SEQ ID NO: 1095174 - DNA, 15 bp, Homo sapiens
aggcctccagcctct

SEQ ID NO: 1095175 - DNA, 17 bp, Homo sapiens
aggcctccagcctctcc

SEQ ID NO: 1095176 - DNA, 21 bp, Homo sapiens
aggcctccagcctctcccggc

SEQ ID NO: 1095177 - DNA, 18 bp, Homo sapiens
aggcctccccaatccagg

SEQ ID NO: 1095178 - DNA, 14 bp, Homo sapiens
aggcctccctagca

SEQ ID NO: 1095179 - DNA, 22 bp, Homo sapiens
aggcctccctctctcttctgct

SEQ ID NO: 1095180 - DNA, 13 bp, Homo sapiens
aggcctcctaggg

SEQ ID NO: 1095181 - DNA, 15 bp, Homo sapiens
aggcctcctagggga

SEQ ID NO: 1095182 - DNA, 16 bp, Homo sapiens
aggcctcctaggggaa

SEQ ID NO: 1095183 - DNA, 17 bp, Homo sapiens
aggcctcctaggggaag

SEQ ID NO: 1095184 - DNA, 18 bp, Homo sapiens
aggcctcctaggggaagg

SEQ ID NO: 1095185 - DNA, 21 bp, Homo sapiens
aggcctcctaggggaaggggg

SEQ ID NO: 1095186 - DNA, 14 bp, Homo sapiens
aggcctcctggctg

SEQ ID NO: 1095187 - DNA, 20 bp, Homo sapiens
aggcctcgaaaaccatcaca

SEQ ID NO: 1095188 - DNA, 19 bp, Homo sapiens
aggcctcgcacttgcagag

SEQ ID NO: 1095189 - DNA, 22 bp, Homo sapiens
aggcctctcaccccacttccca

SEQ ID NO: 1095190 - DNA, 17 bp, Homo sapiens
aggcctctcagacccag

SEQ ID NO: 1095191 - DNA, 12 bp, Homo sapiens
aggcctctctca

SEQ ID NO: 1095192 - DNA, 15 bp, Homo sapiens
aggcctctctctgct

SEQ ID NO: 1095193 - DNA, 16 bp, Homo sapiens
aggcctctctctgctc

SEQ ID NO: 1095194 - DNA, 16 bp, Homo sapiens
aggcctctctgcctgg

SEQ ID NO: 1095195 - DNA, 13 bp, Homo sapiens
aggcctctggact

SEQ ID NO: 1095196 - DNA, 12 bp, Homo sapiens
aggcctctggcc

SEQ ID NO: 1095197 - DNA, 14 bp, Homo sapiens
aggcctctggccct

SEQ ID NO: 1095198 - DNA, 13 bp, Homo sapiens
aggcctctgtgtc

SEQ ID NO: 1095199 - DNA, 14 bp, Homo sapiens
aggcctctgtgtcc

SEQ ID NO: 1095200 - DNA, 15 bp, Homo sapiens
aggcctctgtgtcct

SEQ ID NO: 1095201 - DNA, 16 bp, Homo sapiens
aggcctctgtgtcctt

SEQ ID NO: 1095202 - DNA, 20 bp, Homo sapiens
aggcctctgtgtccttccct

SEQ ID NO: 1095203 - DNA, 15 bp, Homo sapiens
aggcctcttcctgtt

SEQ ID NO: 1095204 - DNA, 23 bp, Homo sapiens
aggcctcttggacctctgctctg

SEQ ID NO: 1095205 - DNA, 24 bp, Homo sapiens
aggcctcttggacctctgctctga

SEQ ID NO: 1095206 - DNA, 20 bp, Homo sapiens
aggcctcttgtgctcacgct

SEQ ID NO: 1095207 - DNA, 21 bp, Homo sapiens
aggcctgaacccgtccattca

SEQ ID NO: 1095208 - DNA, 16 bp, Homo sapiens
aggcctgaagctgagc

SEQ ID NO: 1095209 - DNA, 20 bp, Homo sapiens
aggcctgaatcatgagcctg

SEQ ID NO: 1095210 - DNA, 22 bp, Homo sapiens
aggcctgaatcatgagcctgct

SEQ ID NO: 1095211 - DNA, 17 bp, Homo sapiens
aggcctgacccacgggg

SEQ ID NO: 1095212 - DNA, 15 bp, Homo sapiens
aggcctgacctcaag

SEQ ID NO: 1095213 - DNA, 19 bp, Homo sapiens
aggcctgacttctgctggc

SEQ ID NO: 1095214 - DNA, 21 bp, Homo sapiens
aggcctgagaatgagtgggaa

SEQ ID NO: 1095215 - DNA, 22 bp, Homo sapiens
aggcctgagaatgagtgggaat

SEQ ID NO: 1095216 - DNA, 23 bp, Homo sapiens
aggcctgaggatgagctggaagg

SEQ ID NO: 1095217 - DNA, 23 bp, Homo sapiens
aggcctgatcttgcctgtctggc

SEQ ID NO: 1095218 - DNA, 17 bp, Homo sapiens
aggcctgatgctgcccc

SEQ ID NO: 1095219 - DNA, 20 bp, Homo sapiens
aggcctgcaaaccttcctgg

SEQ ID NO: 1095220 - DNA, 18 bp, Homo sapiens
aggcctgcctcccacttc

SEQ ID NO: 1095221 - DNA, 22 bp, Homo sapiens
aggcctgcctcccacttcactg

SEQ ID NO: 1095222 - DNA, 14 bp, Homo sapiens
aggcctgcctgcat

SEQ ID NO: 1095223 - DNA, 17 bp, Homo sapiens
aggcctgctgccagtgc

SEQ ID NO: 1095224 - DNA, 16 bp, Homo sapiens
aggcctgctggcatca

SEQ ID NO: 1095225 - DNA, 21 bp, Homo sapiens
aggcctgctggcatcaggtct

SEQ ID NO: 1095226 - DNA, 23 bp, Homo sapiens
aggcctgctggcatcaggtctgg

SEQ ID NO: 1095227 - DNA, 15 bp, Homo sapiens
aggcctggaaccagg

SEQ ID NO: 1095228 - DNA, 22 bp, Homo sapiens
aggcctggaaccagggaggaga

SEQ ID NO: 1095229 - DNA, 11 bp, Homo sapiens
aggcctggacc

SEQ ID NO: 1095230 - DNA, 20 bp, Homo sapiens
aggcctggaccgagatgtga

SEQ ID NO: 1095231 - DNA, 18 bp, Homo sapiens
aggcctggacgggccctc

SEQ ID NO: 1095232 - DNA, 22 bp, Homo sapiens
aggcctggacgggccctccttc

SEQ ID NO: 1095233 - DNA, 18 bp, Homo sapiens
aggcctggactttcctgc

SEQ ID NO: 1095234 - DNA, 22 bp, Homo sapiens
aggcctggactttcctgcaact

SEQ ID NO: 1095235 - DNA, 20 bp, Homo sapiens
aggcctggagcgtttgctgt

SEQ ID NO: 1095236 - DNA, 14 bp, Homo sapiens
aggcctggccaggc

SEQ ID NO: 1095237 - DNA, 11 bp, Homo sapiens
aggcctggcct

SEQ ID NO: 1095238 - DNA, 23 bp, Homo sapiens
aggcctggcgtcggccagagggg

SEQ ID NO: 1095239 - DNA, 22 bp, Homo sapiens
aggcctggctggaggagcagca

SEQ ID NO: 1095240 - DNA, 17 bp, Homo sapiens
aggcctgggacccagct

SEQ ID NO: 1095241 - DNA, 16 bp, Homo sapiens
aggcctgggcaggacc

SEQ ID NO: 1095242 - DNA, 19 bp, Homo sapiens
aggcctgggccgctgccac

SEQ ID NO: 1095243 - DNA, 20 bp, Homo sapiens
aggcctggggtgggacaggg

SEQ ID NO: 1095244 - DNA, 21 bp, Homo sapiens
aggcctggggtgggacaggga

SEQ ID NO: 1095245 - DNA, 23 bp, Homo sapiens
aggcctggggtgggacagggagg

SEQ ID NO: 1095246 - DNA, 16 bp, Homo sapiens
aggcctgggtctgtgt

SEQ ID NO: 1095247 - DNA, 18 bp, Homo sapiens
aggcctgtccaccctgcc

SEQ ID NO: 1095248 - DNA, 12 bp, Homo sapiens
aggcctgtgtgt

SEQ ID NO: 1095249 - DNA, 20 bp, Homo sapiens
aggcctgttgctatagagcc

SEQ ID NO: 1095250 - DNA, 15 bp, Homo sapiens
aggccttcagacaca

SEQ ID NO: 1095251 - DNA, 18 bp, Homo sapiens
aggccttcagacacatgc

SEQ ID NO: 1095252 - DNA, 11 bp, Homo sapiens
aggccttcagt

SEQ ID NO: 1095253 - DNA, 16 bp, Homo sapiens
aggccttccagctgct

SEQ ID NO: 1095254 - DNA, 17 bp, Homo sapiens
aggccttccagctgctg

SEQ ID NO: 1095255 - DNA, 16 bp, Homo sapiens
aggccttcctctctcc

SEQ ID NO: 1095256 - DNA, 13 bp, Homo sapiens
aggccttctgtgg

SEQ ID NO: 1095257 - DNA, 17 bp, Homo sapiens
aggctgtctggccaggc

SEQ ID NO: 1095258 - DNA, 12 bp, Homo sapiens
aggctgtctggg

SEQ ID NO: 1095259 - DNA, 16 bp, Homo sapiens
aggctgtctggggcct

SEQ ID NO: 1095260 - DNA, 18 bp, Homo sapiens
aggctgtgcagcgcagct

SEQ ID NO: 1095261 - DNA, 15 bp, Homo sapiens
aggctgtgctgccct

SEQ ID NO: 1095262 - DNA, 20 bp, Homo sapiens
aggctgtgctgccctgaaga

SEQ ID NO: 1095263 - DNA, 12 bp, Homo sapiens
aggctgtggaga

SEQ ID NO: 1095264 - DNA, 14 bp, Homo sapiens
aggctgtggctggt

SEQ ID NO: 1095265 - DNA, 15 bp, Homo sapiens
aggctgtggctggtg

SEQ ID NO: 1095266 - DNA, 20 bp, Homo sapiens
aggctgtggggtctggctgt

SEQ ID NO: 1095267 - DNA, 17 bp, Homo sapiens
aggctgtgtaagatttg

SEQ ID NO: 1095268 - DNA, 14 bp, Homo sapiens
aggctgtgtctctg

SEQ ID NO: 1095269 - DNA, 17 bp, Homo sapiens
aggctgtgtctctgcca

SEQ ID NO: 1095270 - DNA, 16 bp, Homo sapiens
aggctgtgtggccaac

SEQ ID NO: 1095271 - DNA, 23 bp, Homo sapiens
aggctgtgtggccaaccaggacc

SEQ ID NO: 1095272 - DNA, 20 bp, Homo sapiens
aggctgttctcgaactcctg

SEQ ID NO: 1095273 - DNA, 21 bp, Homo sapiens
aggctgttctcgaactcctga

SEQ ID NO: 1095274 - DNA, 14 bp, Homo sapiens
aggcttaaacccat

SEQ ID NO: 1095275 - DNA, 17 bp, Homo sapiens
aggcttaagaactgctt

SEQ ID NO: 1095276 - DNA, 21 bp, Homo sapiens
aggcttataagttaaaacaaa

SEQ ID NO: 1095277 - DNA, 24 bp, Homo sapiens
aggcttcacgccgggagaagccac

SEQ ID NO: 1095278 - DNA, 15 bp, Homo sapiens
aggcttccaggctct

SEQ ID NO: 1095279 - DNA, 13 bp, Homo sapiens
aggcttccccctt

SEQ ID NO: 1095280 - DNA, 20 bp, Homo sapiens
aggcttcctgcgtcctcctc

SEQ ID NO: 1095281 - DNA, 13 bp, Homo sapiens
aggcttccttggc

SEQ ID NO: 1095282 - DNA, 18 bp, Homo sapiens
aggcttcggagtttctta

SEQ ID NO: 1095283 - DNA, 17 bp, Homo sapiens
aggcttctccgccagcc

SEQ ID NO: 1095284 - DNA, 20 bp, Homo sapiens
aggcttctccgccagcctcc

SEQ ID NO: 1095285 - DNA, 21 bp, Homo sapiens
aggcttctccgccagcctcct

SEQ ID NO: 1095286 - DNA, 23 bp, Homo sapiens
aggcttctccgccagcctcctct

SEQ ID NO: 1095287 - DNA, 13 bp, Homo sapiens
aggcttctccttc

SEQ ID NO: 1095288 - DNA, 19 bp, Homo sapiens
aggcttctctccacagtgt

SEQ ID NO: 1095289 - DNA, 15 bp, Homo sapiens
aggcttgagggaggg

SEQ ID NO: 1095290 - DNA, 16 bp, Homo sapiens
aggcttgagggagggc

SEQ ID NO: 1095291 - DNA, 13 bp, Homo sapiens
aggcttgcctcaa

SEQ ID NO: 1095292 - DNA, 16 bp, Homo sapiens
aggcttggggaaaatg

SEQ ID NO: 1095293 - DNA, 21 bp, Homo sapiens
aggctttcaattgtattttat

SEQ ID NO: 1095294 - DNA, 22 bp, Homo sapiens
aggctttcaattgtattttata

SEQ ID NO: 1095295 - DNA, 20 bp, Homo sapiens
aggctttcactatttccttt

SEQ ID NO: 1095296 - DNA, 13 bp, Homo sapiens
aggctttctctac

SEQ ID NO: 1095297 - DNA, 23 bp, Homo sapiens
aggctttgccatgggcctgctgc

SEQ ID NO: 1095298 - DNA, 20 bp, Homo sapiens
aggctttggggtcctagccc

SEQ ID NO: 1095299 - DNA, 22 bp, Homo sapiens
aggctttggggtcctagcccag

SEQ ID NO: 1095300 - DNA, 15 bp, Homo sapiens
aggctttgggtggct

SEQ ID NO: 1095301 - DNA, 18 bp, Homo sapiens
aggctttggtaactgcgg

SEQ ID NO: 1095302 - DNA, 18 bp, Homo sapiens
aggcttttcactgcctgt

SEQ ID NO: 1095303 - DNA, 15 bp, Homo sapiens
agggaaaaaagaaag

SEQ ID NO: 1095304 - DNA, 16 bp, Homo sapiens
agggaaaactcttcat

SEQ ID NO: 1095305 - DNA, 10 bp, Homo sapiens
agggaaaagg

SEQ ID NO: 1095306 - DNA, 21 bp, Homo sapiens
agggaaaatggatatagaaaa

SEQ ID NO: 1095307 - DNA, 16 bp, Homo sapiens
agggaaaccttggaga

SEQ ID NO: 1095308 - DNA, 18 bp, Homo sapiens
agggaaactcagatgtcc

SEQ ID NO: 1095309 - DNA, 19 bp, Homo sapiens
agggaaagatgtagaaaga

SEQ ID NO: 1095310 - DNA, 13 bp, Homo sapiens
agggaaaggaaaa

SEQ ID NO: 1095311 - DNA, 15 bp, Homo sapiens
agggaaaggggtgct

SEQ ID NO: 1095312 - DNA, 19 bp, Homo sapiens
agggaaaggggtgctttta

SEQ ID NO: 1095313 - DNA, 18 bp, Homo sapiens
agggaaaggttttgtatt

SEQ ID NO: 1095314 - DNA, 19 bp, Homo sapiens
agggaaatctgtaaagcca

SEQ ID NO: 1095315 - DNA, 14 bp, Homo sapiens
agggaaatgaaaga

SEQ ID NO: 1095316 - DNA, 19 bp, Homo sapiens
agggaacagacaggagaaa

SEQ ID NO: 1095317 - DNA, 21 bp, Homo sapiens
agggaacagacaggagaaatg

SEQ ID NO: 1095318 - DNA, 14 bp, Homo sapiens
agggaacctgtgtc

SEQ ID NO: 1095319 - DNA, 19 bp, Homo sapiens
agggaacggggtccttcaa

SEQ ID NO: 1095320 - DNA, 20 bp, Homo sapiens
agggaagaaaaagcaagtgt

SEQ ID NO: 1095321 - DNA, 23 bp, Homo sapiens
agggaagaaaactatcctgcggg

SEQ ID NO: 1095322 - DNA, 13 bp, Homo sapiens
agggaagaaactg

SEQ ID NO: 1095323 - DNA, 15 bp, Homo sapiens
agggaagaaggagga

SEQ ID NO: 1095324 - DNA, 21 bp, Homo sapiens
agggaagacaggtctagactt

SEQ ID NO: 1095325 - DNA, 14 bp, Homo sapiens
agggaagaccagaa

SEQ ID NO: 1095326 - DNA, 15 bp, Homo sapiens
agggaagagaaagtg

SEQ ID NO: 1095327 - DNA, 13 bp, Homo sapiens
agggaagagtgga

SEQ ID NO: 1095328 - DNA, 13 bp, Homo sapiens
agggaagcaggga

SEQ ID NO: 1095329 - DNA, 13 bp, Homo sapiens
agggaagccatgt

SEQ ID NO: 1095330 - DNA, 14 bp, Homo sapiens
agggaagctcttgg

SEQ ID NO: 1095331 - DNA, 13 bp, Homo sapiens
agggaagctggcc

SEQ ID NO: 1095332 - DNA, 16 bp, Homo sapiens
agggaagctggcctga

SEQ ID NO: 1095333 - DNA, 12 bp, Homo sapiens
agggaaggcctg

SEQ ID NO: 1095334 - DNA, 13 bp, Homo sapiens
agggaaggcctga

SEQ ID NO: 1095335 - DNA, 14 bp, Homo sapiens
agggaaggcctgac

SEQ ID NO: 1095336 - DNA, 16 bp, Homo sapiens
agggaaggcctgactt

SEQ ID NO: 1095337 - DNA, 14 bp, Homo sapiens
agggaagggcctgc

SEQ ID NO: 1095338 - DNA, 18 bp, Homo sapiens
agggaagggcctgccaca

SEQ ID NO: 1095339 - DNA, 15 bp, Homo sapiens
agggaaggggatgga

SEQ ID NO: 1095340 - DNA, 16 bp, Homo sapiens
agggaaggggatggag

SEQ ID NO: 1095341 - DNA, 16 bp, Homo sapiens
agggaaggggcctccc

SEQ ID NO: 1095342 - DNA, 19 bp, Homo sapiens
agggaaggggcctccctcc

SEQ ID NO: 1095343 - DNA, 15 bp, Homo sapiens
agggaaggtggggcc

SEQ ID NO: 1095344 - DNA, 20 bp, Homo sapiens
agggaaggtggggccctgcc

SEQ ID NO: 1095345 - DNA, 14 bp, Homo sapiens
agggaaggttcttc

SEQ ID NO: 1095346 - DNA, 15 bp, Homo sapiens
agggaagtagtcctt

SEQ ID NO: 1095347 - DNA, 15 bp, Homo sapiens
agggaagtcctggga

SEQ ID NO: 1095348 - DNA, 20 bp, Homo sapiens
agggaagtgaggcccaagga

SEQ ID NO: 1095349 - DNA, 23 bp, Homo sapiens
agggaagtgaggcccaaggagct

SEQ ID NO: 1095350 - DNA, 14 bp, Homo sapiens
agggaagtggaggt

SEQ ID NO: 1095351 - DNA, 12 bp, Homo sapiens
agggaagtgtgt

SEQ ID NO: 1095352 - DNA, 23 bp, Homo sapiens
agggaagtgtgtgtgtgtccatg

SEQ ID NO: 1095353 - DNA, 18 bp, Homo sapiens
agggaagttgtctccttc

SEQ ID NO: 1095354 - DNA, 18 bp, Homo sapiens
agggaatactcacatttt

SEQ ID NO: 1095355 - DNA, 15 bp, Homo sapiens
agggaatccagctcc

SEQ ID NO: 1095356 - DNA, 23 bp, Homo sapiens
agggaatccattgaactggaaga

SEQ ID NO: 1095357 - DNA, 15 bp, Homo sapiens
agggaatctggatta

SEQ ID NO: 1095358 - DNA, 21 bp, Homo sapiens
agggaatgagagttccttctc

SEQ ID NO: 1095359 - DNA, 16 bp, Homo sapiens
agggaatgcaatcctt

SEQ ID NO: 1095360 - DNA, 14 bp, Homo sapiens
agggaatgcagcag

SEQ ID NO: 1095361 - DNA, 18 bp, Homo sapiens
agggaattcgatgccccc

SEQ ID NO: 1095362 - DNA, 20 bp, Homo sapiens
agggacaaagaaatcccccc

SEQ ID NO: 1095363 - DNA, 13 bp, Homo sapiens
agggacaaagagg

SEQ ID NO: 1095364 - DNA, 17 bp, Homo sapiens
agggacaagggggagga

SEQ ID NO: 1095365 - DNA, 15 bp, Homo sapiens
agggacacacagcct

SEQ ID NO: 1095366 - DNA, 10 bp, Homo sapiens
agggacagag

SEQ ID NO: 1095367 - DNA, 11 bp, Homo sapiens
agggacagcaa

SEQ ID NO: 1095368 - DNA, 20 bp, Homo sapiens
agggacagcaagtgagcaga

SEQ ID NO: 1095369 - DNA, 13 bp, Homo sapiens
agggacaggaccc

SEQ ID NO: 1095370 - DNA, 18 bp, Homo sapiens
agggacaggaccccagct

SEQ ID NO: 1095371 - DNA, 20 bp, Homo sapiens
agggacaggctgaagagagg

SEQ ID NO: 1095372 - DNA, 22 bp, Homo sapiens
agggacagggaatgctgaggcc

SEQ ID NO: 1095373 - DNA, 16 bp, Homo sapiens
agggacagggcaggcg

SEQ ID NO: 1095374 - DNA, 12 bp, Homo sapiens
agggacaggtgg

SEQ ID NO: 1095375 - DNA, 19 bp, Homo sapiens
agggacaggtgggcctggc

SEQ ID NO: 1095376 - DNA, 20 bp, Homo sapiens
agggacatgccctgtgtggc

SEQ ID NO: 1095377 - DNA, 21 bp, Homo sapiens
agggaccaagcgaccaaggat

SEQ ID NO: 1095378 - DNA, 18 bp, Homo sapiens
agggaccaaggacccctc

SEQ ID NO: 1095379 - DNA, 17 bp, Homo sapiens
agggaccaaggcaaggc

SEQ ID NO: 1095380 - DNA, 19 bp, Homo sapiens
agggccacctgcaggaccc

SEQ ID NO: 1095381 - DNA, 15 bp, Homo sapiens
agggccacgtgccag

SEQ ID NO: 1095382 - DNA, 16 bp, Homo sapiens
agggccacgtgccagg

SEQ ID NO: 1095383 - DNA, 19 bp, Homo sapiens
agggccacgtgccaggccc

SEQ ID NO: 1095384 - DNA, 12 bp, Homo sapiens
agggccagaagg

SEQ ID NO: 1095385 - DNA, 17 bp, Homo sapiens
agggccagaaggagggc

SEQ ID NO: 1095386 - DNA, 20 bp, Homo sapiens
agggccagaaggagggcaga

SEQ ID NO: 1095387 - DNA, 21 bp, Homo sapiens
agggccagaaggagggcagag

SEQ ID NO: 1095388 - DNA, 18 bp, Homo sapiens
agggccagactggaagac

SEQ ID NO: 1095389 - DNA, 19 bp, Homo sapiens
agggccagagctagggctg

SEQ ID NO: 1095390 - DNA, 12 bp, Homo sapiens
agggccagcagg

SEQ ID NO: 1095391 - DNA, 14 bp, Homo sapiens
agggccagcaggct

SEQ ID NO: 1095392 - DNA, 23 bp, Homo sapiens
agggccagcaggctcctggctgt

SEQ ID NO: 1095393 - DNA, 15 bp, Homo sapiens
agggccaggagatgg

SEQ ID NO: 1095394 - DNA, 10 bp, Homo sapiens
agggccaggc

SEQ ID NO: 1095395 - DNA, 13 bp, Homo sapiens
agggccaggcagg

SEQ ID NO: 1095396 - DNA, 15 bp, Homo sapiens
agggccagggcaatg

SEQ ID NO: 1095397 - DNA, 17 bp, Homo sapiens
agggccagggcaatgcc

SEQ ID NO: 1095398 - DNA, 22 bp, Homo sapiens
agggccagggccctgcagaggg

SEQ ID NO: 1095399 - DNA, 20 bp, Homo sapiens
agggccaggggtctccctgg

SEQ ID NO: 1095400 - DNA, 12 bp, Homo sapiens
agggccagggtt

SEQ ID NO: 1095401 - DNA, 12 bp, Homo sapiens
agggccaggtgc

SEQ ID NO: 1095402 - DNA, 18 bp, Homo sapiens
agggccaggtgcggcctg

SEQ ID NO: 1095403 - DNA, 13 bp, Homo sapiens
agggccagtcctg

SEQ ID NO: 1095404 - DNA, 16 bp, Homo sapiens
agggccagtcctgcct

SEQ ID NO: 1095405 - DNA, 18 bp, Homo sapiens
agggccagtcctgcctgg

SEQ ID NO: 1095406 - DNA, 21 bp, Homo sapiens
agggccagtcctgcctggcca

SEQ ID NO: 1095407 - DNA, 15 bp, Homo sapiens
agggccagtctgggc

SEQ ID NO: 1095408 - DNA, 16 bp, Homo sapiens
agggccagtgatgatg

SEQ ID NO: 1095409 - DNA, 17 bp, Homo sapiens
agggccagtggggcctg

SEQ ID NO: 1095410 - DNA, 21 bp, Homo sapiens
agggccagtggggcctgtgga

SEQ ID NO: 1095411 - DNA, 18 bp, Homo sapiens
agggccatgctgaaggga

SEQ ID NO: 1095412 - DNA, 22 bp, Homo sapiens
agggccatgctgaggcctgggc

SEQ ID NO: 1095413 - DNA, 23 bp, Homo sapiens
agggccatgctgaggcctgggcc

SEQ ID NO: 1095414 - DNA, 17 bp, Homo sapiens
agggcccaagtccctgt

SEQ ID NO: 1095415 - DNA, 13 bp, Homo sapiens
agggcccagagcc

SEQ ID NO: 1095416 - DNA, 17 bp, Homo sapiens
agggcccagagcccttg

SEQ ID NO: 1095417 - DNA, 19 bp, Homo sapiens
agggcccagagcccttgac

SEQ ID NO: 1095418 - DNA, 11 bp, Homo sapiens
agggcccagcc

SEQ ID NO: 1095419 - DNA, 13 bp, Homo sapiens
agggcccagccca

SEQ ID NO: 1095420 - DNA, 17 bp, Homo sapiens
agggcccagcccagagc

SEQ ID NO: 1095421 - DNA, 22 bp, Homo sapiens
agggcccagcccagagccacct

SEQ ID NO: 1095422 - DNA, 13 bp, Homo sapiens
agggcccagctgt

SEQ ID NO: 1095423 - DNA, 15 bp, Homo sapiens
agggcccagctgtag

SEQ ID NO: 1095424 - DNA, 23 bp, Homo sapiens
agggcccagctgtagccatggct

SEQ ID NO: 1095425 - DNA, 12 bp, Homo sapiens
agggcccaggcc

SEQ ID NO: 1095426 - DNA, 14 bp, Homo sapiens
agggcccaggcctg

SEQ ID NO: 1095427 - DNA, 18 bp, Homo sapiens
agggcccatcaggcagtg

SEQ ID NO: 1095428 - DNA, 23 bp, Homo sapiens
agggccccaggcccgcgggcaca

SEQ ID NO: 1095429 - DNA, 14 bp, Homo sapiens
agggccccaggggc

SEQ ID NO: 1095430 - DNA, 15 bp, Homo sapiens
agggccccaggggca

SEQ ID NO: 1095431 - DNA, 16 bp, Homo sapiens
agggccccaggggcag

SEQ ID NO: 1095432 - DNA, 21 bp, Homo sapiens
agggccccccaaatcccaggg

SEQ ID NO: 1095433 - DNA, 15 bp, Homo sapiens
agggcccctctgccc

SEQ ID NO: 1095434 - DNA, 16 bp, Homo sapiens
agggcccctctgccca

SEQ ID NO: 1095435 - DNA, 17 bp, Homo sapiens
agggcccctctgcccag

SEQ ID NO: 1095436 - DNA, 15 bp, Homo sapiens
agggcccctgaccct

SEQ ID NO: 1095437 - DNA, 12 bp, Homo sapiens
agggcccctgcg

SEQ ID NO: 1095438 - DNA, 19 bp, Homo sapiens
agggcccctgcgtgggggc

SEQ ID NO: 1095439 - DNA, 14 bp, Homo sapiens
agggcccctggatc

SEQ ID NO: 1095440 - DNA, 17 bp, Homo sapiens
agggcccggccacaccc

SEQ ID NO: 1095441 - DNA, 18 bp, Homo sapiens
agggcccggccacaccca

SEQ ID NO: 1095442 - DNA, 13 bp, Homo sapiens
agggccctacctg

SEQ ID NO: 1095443 - DNA, 13 bp, Homo sapiens
agggccctgcaga

SEQ ID NO: 1095444 - DNA, 15 bp, Homo sapiens
agggccctgccccag

SEQ ID NO: 1095445 - DNA, 20 bp, Homo sapiens
agggccctgccccaggcctg

SEQ ID NO: 1095446 - DNA, 21 bp, Homo sapiens
agggccctgccccaggcctgg

SEQ ID NO: 1095447 - DNA, 23 bp, Homo sapiens
agggccctgccccaggcctggac

SEQ ID NO: 1095448 - DNA, 14 bp, Homo sapiens
agggccctggaggc

SEQ ID NO: 1095449 - DNA, 15 bp, Homo sapiens
agggccctgggcagg

SEQ ID NO: 1095450 - DNA, 16 bp, Homo sapiens
agggccctgggcaggg

SEQ ID NO: 1095451 - DNA, 15 bp, Homo sapiens
agggccctgtggagt

SEQ ID NO: 1095452 - DNA, 19 bp, Homo sapiens
agggccctgtggagtccag

SEQ ID NO: 1095453 - DNA, 15 bp, Homo sapiens
agggccctgtgtctg

SEQ ID NO: 1095454 - DNA, 17 bp, Homo sapiens
agggcccttcccctccc

SEQ ID NO: 1095455 - DNA, 18 bp, Homo sapiens
agggcccttcccctcccc

SEQ ID NO: 1095456 - DNA, 14 bp, Homo sapiens
agggccgcagggcc

SEQ ID NO: 1095457 - DNA, 15 bp, Homo sapiens
agggccgcagggccc

SEQ ID NO: 1095458 - DNA, 16 bp, Homo sapiens
agggccgcagggccca

SEQ ID NO: 1095459 - DNA, 16 bp, Homo sapiens
agggccgcccgctccc

SEQ ID NO: 1095460 - DNA, 20 bp, Homo sapiens
agggccgctcgatgcctttg

SEQ ID NO: 1095461 - DNA, 15 bp, Homo sapiens
agggccggcggctct

SEQ ID NO: 1095462 - DNA, 16 bp, Homo sapiens
agggccggcggctctg

SEQ ID NO: 1095463 - DNA, 19 bp, Homo sapiens
agggccggcggctctgagc

SEQ ID NO: 1095464 - DNA, 21 bp, Homo sapiens
agggccggcggctctgagcag

SEQ ID NO: 1095465 - DNA, 22 bp, Homo sapiens
agggccggcggctctgagcagg

SEQ ID NO: 1095466 - DNA, 20 bp, Homo sapiens
agggccggggggggtaggag

SEQ ID NO: 1095467 - DNA, 22 bp, Homo sapiens
agggccggggggggtaggagag

SEQ ID NO: 1095468 - DNA, 17 bp, Homo sapiens
agggccgtaccccaccc

SEQ ID NO: 1095469 - DNA, 19 bp, Homo sapiens
agggccgtaccccaccctc

SEQ ID NO: 1095470 - DNA, 16 bp, Homo sapiens
agggcctactgccacc

SEQ ID NO: 1095471 - DNA, 19 bp, Homo sapiens
agggcctcagagcctgacc

SEQ ID NO: 1095472 - DNA, 15 bp, Homo sapiens
agggcctccagggcc

SEQ ID NO: 1095473 - DNA, 22 bp, Homo sapiens
agggcctctccctttagtggag

SEQ ID NO: 1095474 - DNA, 20 bp, Homo sapiens
agggcctgacttgagccact

SEQ ID NO: 1095475 - DNA, 16 bp, Homo sapiens
agggcctgcatggaga

SEQ ID NO: 1095476 - DNA, 19 bp, Homo sapiens
agggcctgcatggagaagg

SEQ ID NO: 1095477 - DNA, 16 bp, Homo sapiens
agggcctgcttcccct

SEQ ID NO: 1095478 - DNA, 12 bp, Homo sapiens
agggcctggagc

SEQ ID NO: 1095479 - DNA, 13 bp, Homo sapiens
agggcctggccag

SEQ ID NO: 1095480 - DNA, 21 bp, Homo sapiens
agggcctggccagtcctggtc

SEQ ID NO: 1095481 - DNA, 15 bp, Homo sapiens
agggcctggggcctg

SEQ ID NO: 1095482 - DNA, 20 bp, Homo sapiens
agggcctggggcctgagaga

SEQ ID NO: 1095483 - DNA, 21 bp, Homo sapiens
agggcctggggcctgagagaa

SEQ ID NO: 1095484 - DNA, 17 bp, Homo sapiens
agggcctgggggcagtg

SEQ ID NO: 1095485 - DNA, 23 bp, Homo sapiens
agggcctgggggcagtgactggc

SEQ ID NO: 1095486 - DNA, 17 bp, Homo sapiens
agggcctggtccctggg

SEQ ID NO: 1095487 - DNA, 12 bp, Homo sapiens
agggcctgtggg

SEQ ID NO: 1095488 - DNA, 18 bp, Homo sapiens
agggcctgtgggagcctg

SEQ ID NO: 1095489 - DNA, 15 bp, Homo sapiens
agggccttgcccaga

SEQ ID NO: 1095490 - DNA, 19 bp, Homo sapiens
agggccttgcttctcttct

SEQ ID NO: 1095491 - DNA, 15 bp, Homo sapiens
agggcctttctcctc

SEQ ID NO: 1095492 - DNA, 20 bp, Homo sapiens
agggccttttctgtgccaga

SEQ ID NO: 1095493 - DNA, 20 bp, Homo sapiens
agggcgaacgacaatagctt

SEQ ID NO: 1095494 - DNA, 18 bp, Homo sapiens
agggcgacgtcttcagag

SEQ ID NO: 1095495 - DNA, 13 bp, Homo sapiens
agggcgagactcc

SEQ ID NO: 1095496 - DNA, 23 bp, Homo sapiens
agggcgaggggagggtggcaggt

SEQ ID NO: 1095497 - DNA, 14 bp, Homo sapiens
agggcgccagggtg

SEQ ID NO: 1095498 - DNA, 23 bp, Homo sapiens
agggcgcccattcgtctgtccca

SEQ ID NO: 1095499 - DNA, 16 bp, Homo sapiens
agggcggcaggggcct

SEQ ID NO: 1095500 - DNA, 19 bp, Homo sapiens
agggcggcaggggcctgga

SEQ ID NO: 1095501 - DNA, 23 bp, Homo sapiens
agggcggcaggggcctggagatc

SEQ ID NO: 1095502 - DNA, 15 bp, Homo sapiens
aggggagaagctgaa

SEQ ID NO: 1095503 - DNA, 18 bp, Homo sapiens
aggggagagacaggcagc

SEQ ID NO: 1095504 - DNA, 19 bp, Homo sapiens
aggggagagctttgtgctt

SEQ ID NO: 1095505 - DNA, 23 bp, Homo sapiens
aggggagcaaaatcgatgcagtg

SEQ ID NO: 1095506 - DNA, 12 bp, Homo sapiens
aggggagcaagc

SEQ ID NO: 1095507 - DNA, 19 bp, Homo sapiens
aggggagcacggagccgcg

SEQ ID NO: 1095508 - DNA, 12 bp, Homo sapiens
aggggagccaga

SEQ ID NO: 1095509 - DNA, 23 bp, Homo sapiens
aggggagccagaaatgggcagtt

SEQ ID NO: 1095510 - DNA, 12 bp, Homo sapiens
aggggagccagc

SEQ ID NO: 1095511 - DNA, 21 bp, Homo sapiens
aggggagcctttggggggcca

SEQ ID NO: 1095512 - DNA, 15 bp, Homo sapiens
aggggagcttgggac

SEQ ID NO: 1095513 - DNA, 13 bp, Homo sapiens
aggggaggaaaaa

SEQ ID NO: 1095514 - DNA, 15 bp, Homo sapiens
aggggaggaaaaaag

SEQ ID NO: 1095515 - DNA, 13 bp, Homo sapiens
aggggaggagaat

SEQ ID NO: 1095516 - DNA, 14 bp, Homo sapiens
aggggaggcagatg

SEQ ID NO: 1095517 - DNA, 21 bp, Homo sapiens
aggggaggcagccggcaccca

SEQ ID NO: 1095518 - DNA, 13 bp, Homo sapiens
aggggagggaggg

SEQ ID NO: 1095519 - DNA, 18 bp, Homo sapiens
aggggagggagggaagtc

SEQ ID NO: 1095520 - DNA, 15 bp, Homo sapiens
aggggagggctcctg

SEQ ID NO: 1095521 - DNA, 16 bp, Homo sapiens
aggggagggctcctgg

SEQ ID NO: 1095522 - DNA, 19 bp, Homo sapiens
aggggagggctcctggggc

SEQ ID NO: 1095523 - DNA, 20 bp, Homo sapiens
aggggagggctcctggggca

SEQ ID NO: 1095524 - DNA, 12 bp, Homo sapiens
aggggaggggcc

SEQ ID NO: 1095525 - DNA, 22 bp, Homo sapiens
aggggaggggcctagggagccg

SEQ ID NO: 1095526 - DNA, 15 bp, Homo sapiens
aggggaggggcctcc

SEQ ID NO: 1095527 - DNA, 14 bp, Homo sapiens
aggggaggggggag

SEQ ID NO: 1095528 - DNA, 16 bp, Homo sapiens
aggggaggggggaggg

SEQ ID NO: 1095529 - DNA, 18 bp, Homo sapiens
aggggaggggggaggggg

SEQ ID NO: 1095530 - DNA, 16 bp, Homo sapiens
aggggagggtggcagg

SEQ ID NO: 1095531 - DNA, 19 bp, Homo sapiens
aggggagggtggcaggtga

SEQ ID NO: 1095532 - DNA, 12 bp, Homo sapiens
aggggagtagag

SEQ ID NO: 1095533 - DNA, 14 bp, Homo sapiens
aggggatggaggcc

SEQ ID NO: 1095534 - DNA, 17 bp, Homo sapiens
aggggatggaggccaga

SEQ ID NO: 1095535 - DNA, 18 bp, Homo sapiens
aggggatggggatagagg

SEQ ID NO: 1095536 - DNA, 20 bp, Homo sapiens
aggggatgtttacctggtgc

SEQ ID NO: 1095537 - DNA, 13 bp, Homo sapiens
aggggattctcta

SEQ ID NO: 1095538 - DNA, 15 bp, Homo sapiens
aggggattctctact

SEQ ID NO: 1095539 - DNA, 18 bp, Homo sapiens
aggggatttttatgtctg

SEQ ID NO: 1095540 - DNA, 20 bp, Homo sapiens
aggggcaacgaagaaaaaaa

SEQ ID NO: 1095541 - DNA, 20 bp, Homo sapiens
aggggcacaccactgccctg

SEQ ID NO: 1095542 - DNA, 21 bp, Homo sapiens
aggggcacaccactgccctgc

SEQ ID NO: 1095543 - DNA, 23 bp, Homo sapiens
aggggcacaccactgccctgcct

SEQ ID NO: 1095544 - DNA, 22 bp, Homo sapiens
aggggcacctatgagatggcca

SEQ ID NO: 1095545 - DNA, 18 bp, Homo sapiens
aggggcagagaggaagtg

SEQ ID NO: 1095546 - DNA, 16 bp, Homo sapiens
aggggcagagccagga

SEQ ID NO: 1095547 - DNA, 14 bp, Homo sapiens
aggggcagcaaggc

SEQ ID NO: 1095548 - DNA, 21 bp, Homo sapiens
aggggcagccctgagtggtca

SEQ ID NO: 1095549 - DNA, 17 bp, Homo sapiens
aggggcagcctgtgcct

SEQ ID NO: 1095550 - DNA, 18 bp, Homo sapiens
aggggcagcctgtgcctg

SEQ ID NO: 1095551 - DNA, 15 bp, Homo sapiens
aggggcaggcagggc

SEQ ID NO: 1095552 - DNA, 14 bp, Homo sapiens
aggggcaggcctgg

SEQ ID NO: 1095553 - DNA, 15 bp, Homo sapiens
aggggcaggcctggg

SEQ ID NO: 1095554 - DNA, 16 bp, Homo sapiens
aggggcaggcctggga

SEQ ID NO: 1095555 - DNA, 18 bp, Homo sapiens
aggggcaggcgcagaggt

SEQ ID NO: 1095556 - DNA, 19 bp, Homo sapiens
aggggcaggcgcagaggtc

SEQ ID NO: 1095557 - DNA, 11 bp, Homo sapiens
aggggcaggga

SEQ ID NO: 1095558 - DNA, 10 bp, Homo sapiens
aggggcaggt

SEQ ID NO: 1095559 - DNA, 23 bp, Homo sapiens
aggggcaggtaaactcctgtcct

SEQ ID NO: 1095560 - DNA, 12 bp, Homo sapiens
aggggcaggtgt

SEQ ID NO: 1095561 - DNA, 22 bp, Homo sapiens
aggggcaggtgtttctttcctg

SEQ ID NO: 1095562 - DNA, 17 bp, Homo sapiens
aggggcagtcagtggag

SEQ ID NO: 1095563 - DNA, 16 bp, Homo sapiens
aggggcatctgcccct

SEQ ID NO: 1095564 - DNA, 17 bp, Homo sapiens
aggggcatctgcccctc

SEQ ID NO: 1095565 - DNA, 20 bp, Homo sapiens
aggggcatctgcccctcccc

SEQ ID NO: 1095566 - DNA, 20 bp, Homo sapiens
aggggcatgtattggcctgg

SEQ ID NO: 1095567 - DNA, 20 bp, Homo sapiens
aggggccaccacctttggct

SEQ ID NO: 1095568 - DNA, 17 bp, Homo sapiens
aggggccactccaaact

SEQ ID NO: 1095569 - DNA, 16 bp, Homo sapiens
aggggccactgaccca

SEQ ID NO: 1095570 - DNA, 21 bp, Homo sapiens
aggggccactgacccacctgc

SEQ ID NO: 1095571 - DNA, 22 bp, Homo sapiens
aggggccactgacccacctgcg

SEQ ID NO: 1095572 - DNA, 24 bp, Homo sapiens
aggggccactgacccacctgcgct

SEQ ID NO: 1095573 - DNA, 21 bp, Homo sapiens
aggggccagagagcaggggag

SEQ ID NO: 1095574 - DNA, 14 bp, Homo sapiens
aggggccagaggct

SEQ ID NO: 1095575 - DNA, 14 bp, Homo sapiens
aggggccagcagag

SEQ ID NO: 1095576 - DNA, 18 bp, Homo sapiens
aggggccagtggattccc

SEQ ID NO: 1095577 - DNA, 17 bp, Homo sapiens
aggggcccaagccccat

SEQ ID NO: 1095578 - DNA, 20 bp, Homo sapiens
aggggcccaagccccatctc

SEQ ID NO: 1095579 - DNA, 21 bp, Homo sapiens
aggggcccacagggaaccctg

SEQ ID NO: 1095580 - DNA, 15 bp, Homo sapiens
aggggccccagatct

SEQ ID NO: 1095581 - DNA, 22 bp, Homo sapiens
aggggccccagatctgcctggg

SEQ ID NO: 1095582 - DNA, 21 bp, Homo sapiens
aggggccccagcgtctgcagg

SEQ ID NO: 1095583 - DNA, 21 bp, Homo sapiens
aggggccccggggctggcaag

SEQ ID NO: 1095584 - DNA, 22 bp, Homo sapiens
aggggccccggggctggcaagc

SEQ ID NO: 1095585 - DNA, 15 bp, Homo sapiens
aggggcccggccagc

SEQ ID NO: 1095586 - DNA, 21 bp, Homo sapiens
aggggcccggccagccatgtc

SEQ ID NO: 1095587 - DNA, 23 bp, Homo sapiens
aggggcccggccagccatgtctg

SEQ ID NO: 1095588 - DNA, 13 bp, Homo sapiens
aggggccctcagg

SEQ ID NO: 1095589 - DNA, 16 bp, Homo sapiens
aggggccctcaggcca

SEQ ID NO: 1095590 - DNA, 16 bp, Homo sapiens
aggggccctggccagg

SEQ ID NO: 1095591 - DNA, 15 bp, Homo sapiens
aggggccctgtacag

SEQ ID NO: 1095592 - DNA, 15 bp, Homo sapiens
aggggccgctgccac

SEQ ID NO: 1095593 - DNA, 15 bp, Homo sapiens
aggggccggctggcc

SEQ ID NO: 1095594 - DNA, 21 bp, Homo sapiens
aggggccggctggcctggagg

SEQ ID NO: 1095595 - DNA, 16 bp, Homo sapiens
aggggccggggagggg

SEQ ID NO: 1095596 - DNA, 17 bp, Homo sapiens
aggggccggggaggggg

SEQ ID NO: 1095597 - DNA, 21 bp, Homo sapiens
aggggccggggagggggcacg

SEQ ID NO: 1095598 - DNA, 17 bp, Homo sapiens
aggggcctagggagccg

SEQ ID NO: 1095599 - DNA, 21 bp, Homo sapiens
aggggcctcccggggcccagg

SEQ ID NO: 1095600 - DNA, 22 bp, Homo sapiens
aggggcctcccggggcccagga

SEQ ID NO: 1095601 - DNA, 14 bp, Homo sapiens
aggggcctctctcc

SEQ ID NO: 1095602 - DNA, 18 bp, Homo sapiens
aggggcctctctcctgcc

SEQ ID NO: 1095603 - DNA, 20 bp, Homo sapiens
aggggcctctctcctgcctg

SEQ ID NO: 1095604 - DNA, 12 bp, Homo sapiens
aggggcctgagt

SEQ ID NO: 1095605 - DNA, 20 bp, Homo sapiens
aggggcctgcgcccagagct

SEQ ID NO: 1095606 - DNA, 15 bp, Homo sapiens
aggggcctggcagcc

SEQ ID NO: 1095607 - DNA, 15 bp, Homo sapiens
aggggcctgggcagc

SEQ ID NO: 1095608 - DNA, 15 bp, Homo sapiens
aggggcctgggccgg

SEQ ID NO: 1095609 - DNA, 20 bp, Homo sapiens
aggggccttagggcactggg

SEQ ID NO: 1095610 - DNA, 19 bp, Homo sapiens
aggggccttgctctgagca

SEQ ID NO: 1095611 - DNA, 20 bp, Homo sapiens
aggggccttgctctgagcac

SEQ ID NO: 1095612 - DNA, 15 bp, Homo sapiens
aggggcgcccagggt

SEQ ID NO: 1095613 - DNA, 16 bp, Homo sapiens
aggggcgccttttcag

SEQ ID NO: 1095614 - DNA, 19 bp, Homo sapiens
aggggcgccttttcagccc

SEQ ID NO: 1095615 - DNA, 19 bp, Homo sapiens
aggggcgctggcccagccg

SEQ ID NO: 1095616 - DNA, 14 bp, Homo sapiens
aggggcgctgtcct

SEQ ID NO: 1095617 - DNA, 17 bp, Homo sapiens
aggggcgctgtcctgcg

SEQ ID NO: 1095618 - DNA, 18 bp, Homo sapiens
aggggcggcaggagggag

SEQ ID NO: 1095619 - DNA, 16 bp, Homo sapiens
aggggcggggcaggaa

SEQ ID NO: 1095620 - DNA, 22 bp, Homo sapiens
aggggcggggttagagccaagc

SEQ ID NO: 1095621 - DNA, 20 bp, Homo sapiens
aggggcgttctcccaaagat

SEQ ID NO: 1095622 - DNA, 15 bp, Homo sapiens
aggggctaccaggaa

SEQ ID NO: 1095623 - DNA, 22 bp, Homo sapiens
aggggctacgttagcagcccag

SEQ ID NO: 1095624 - DNA, 16 bp, Homo sapiens
aggtaaaaacccagcg

SEQ ID NO: 1095625 - DNA, 14 bp, Homo sapiens
aggtaaaacagggc

SEQ ID NO: 1095626 - DNA, 17 bp, Homo sapiens
aggtaaaagtgtgagca

SEQ ID NO: 1095627 - DNA, 21 bp, Homo sapiens
aggtaaaatcacttcagatct

SEQ ID NO: 1095628 - DNA, 19 bp, Homo sapiens
aggtaaaattgaaaggcat

SEQ ID NO: 1095629 - DNA, 19 bp, Homo sapiens
aggtaaagggcaaataatg

SEQ ID NO: 1095630 - DNA, 19 bp, Homo sapiens
aggtaaatggttaaatttt

SEQ ID NO: 1095631 - DNA, 22 bp, Homo sapiens
aggtaacgtgattgattcagta

SEQ ID NO: 1095632 - DNA, 16 bp, Homo sapiens
aggtaactactgctaa

SEQ ID NO: 1095633 - DNA, 19 bp, Homo sapiens
aggtaactactgctaatgt

SEQ ID NO: 1095634 - DNA, 16 bp, Homo sapiens
aggtaagatgttaatc

SEQ ID NO: 1095635 - DNA, 16 bp, Homo sapiens
aggtaagggccgccgg

SEQ ID NO: 1095636 - DNA, 18 bp, Homo sapiens
aggtaagtgggggcgggg

SEQ ID NO: 1095637 - DNA, 24 bp, Homo sapiens
aggtaataaaagctttgactccct

SEQ ID NO: 1095638 - DNA, 21 bp, Homo sapiens
aggtaatatacctggtttact

SEQ ID NO: 1095639 - DNA, 14 bp, Homo sapiens
aggtaatgagggac

SEQ ID NO: 1095640 - DNA, 21 bp, Homo sapiens
aggtaatgtagggttatattt

SEQ ID NO: 1095641 - DNA, 11 bp, Homo sapiens
aggtaattgtt

SEQ ID NO: 1095642 - DNA, 19 bp, Homo sapiens
aggtacagcgggctgtgcc

SEQ ID NO: 1095643 - DNA, 21 bp, Homo sapiens
aggtacagcgggctgtgcccg

SEQ ID NO: 1095644 - DNA, 17 bp, Homo sapiens
aggtacaggagaggcag

SEQ ID NO: 1095645 - DNA, 17 bp, Homo sapiens
aggtaccaaacaaggaa

SEQ ID NO: 1095646 - DNA, 15 bp, Homo sapiens
aggtaccacccttca

SEQ ID NO: 1095647 - DNA, 21 bp, Homo sapiens
aggtaccactgatttggagat

SEQ ID NO: 1095648 - DNA, 23 bp, Homo sapiens
aggtaccagctgcgcttgctttt

SEQ ID NO: 1095649 - DNA, 20 bp, Homo sapiens
aggtactaattaacttaaac

SEQ ID NO: 1095650 - DNA, 15 bp, Homo sapiens
aggtactatatttgc

SEQ ID NO: 1095651 - DNA, 14 bp, Homo sapiens
aggtactctcctgg

SEQ ID NO: 1095652 - DNA, 15 bp, Homo sapiens
aggtactgagacagg

SEQ ID NO: 1095653 - DNA, 16 bp, Homo sapiens
aggtactgctgtgtaa

SEQ ID NO: 1095654 - DNA, 16 bp, Homo sapiens
aggtactggtcccttc

SEQ ID NO: 1095655 - DNA, 16 bp, Homo sapiens
aggtacttcctcctga

SEQ ID NO: 1095656 - DNA, 23 bp, Homo sapiens
aggtactttcatattttaaacag

SEQ ID NO: 1095657 - DNA, 19 bp, Homo sapiens
aggtagaaatatctgaaaa

SEQ ID NO: 1095658 - DNA, 15 bp, Homo sapiens
aggtagactttgctt

SEQ ID NO: 1095659 - DNA, 20 bp, Homo sapiens
aggtagacttttatgagaac

SEQ ID NO: 1095660 - DNA, 16 bp, Homo sapiens
aggtagagtcattcat

SEQ ID NO: 1095661 - DNA, 17 bp, Homo sapiens
aggtagagtcattcata

SEQ ID NO: 1095662 - DNA, 20 bp, Homo sapiens
aggtagatcgcttgagccca

SEQ ID NO: 1095663 - DNA, 18 bp, Homo sapiens
aggtagcaagagagcagc

SEQ ID NO: 1095664 - DNA, 17 bp, Homo sapiens
aggtagcctgctgtggg

SEQ ID NO: 1095665 - DNA, 18 bp, Homo sapiens
aggtagcctgctgtgggg

SEQ ID NO: 1095666 - DNA, 17 bp, Homo sapiens
aggtagcgagctgctct

SEQ ID NO: 1095667 - DNA, 20 bp, Homo sapiens
aggtagcgagctgctctgct

SEQ ID NO: 1095668 - DNA, 16 bp, Homo sapiens
aggtagctcggcacca

SEQ ID NO: 1095669 - DNA, 18 bp, Homo sapiens
aggtaggaagcaacagct

SEQ ID NO: 1095670 - DNA, 20 bp, Homo sapiens
aggtaggcaccacagagaag

SEQ ID NO: 1095671 - DNA, 17 bp, Homo sapiens
aggtaggcccttgtcct

SEQ ID NO: 1095672 - DNA, 18 bp, Homo sapiens
aggtaggcccttgtcctg

SEQ ID NO: 1095673 - DNA, 18 bp, Homo sapiens
aggtaggctgtggggtgg

SEQ ID NO: 1095674 - DNA, 15 bp, Homo sapiens
aggtagggagatatt

SEQ ID NO: 1095675 - DNA, 20 bp, Homo sapiens
aggtaggtggatcacctgag

SEQ ID NO: 1095676 - DNA, 20 bp, Homo sapiens
aggtagtattacaccaccgg

SEQ ID NO: 1095677 - DNA, 15 bp, Homo sapiens
aggtagtctcactgc

SEQ ID NO: 1095678 - DNA, 18 bp, Homo sapiens
aggtagttgggtagaaaa

SEQ ID NO: 1095679 - DNA, 19 bp, Homo sapiens
aggtagttgggtagaaaaa

SEQ ID NO: 1095680 - DNA, 14 bp, Homo sapiens
aggtagtttggata

SEQ ID NO: 1095681 - DNA, 19 bp, Homo sapiens
aggtagtttggatattttt

SEQ ID NO: 1095682 - DNA, 22 bp, Homo sapiens
aggtagtttggatatttttgta

SEQ ID NO: 1095683 - DNA, 11 bp, Homo sapiens
aggtataattt

SEQ ID NO: 1095684 - DNA, 17 bp, Homo sapiens
aggtatactttagtaga

SEQ ID NO: 1095685 - DNA, 17 bp, Homo sapiens
aggtatcaaaatagttt

SEQ ID NO: 1095686 - DNA, 18 bp, Homo sapiens
aggtatcagttatatgat

SEQ ID NO: 1095687 - DNA, 17 bp, Homo sapiens
aggtatgcaatcaaatc

SEQ ID NO: 1095688 - DNA, 21 bp, Homo sapiens
aggtatgcaatcaaatctgct

SEQ ID NO: 1095689 - DNA, 14 bp, Homo sapiens
aggtatggcagagg

SEQ ID NO: 1095690 - DNA, 18 bp, Homo sapiens
aggtatggcagaggtgca

SEQ ID NO: 1095691 - DNA, 16 bp, Homo sapiens
aggtatggccatgccc

SEQ ID NO: 1095692 - DNA, 22 bp, Homo sapiens
aggtatgtcagaaaaaatatgt

SEQ ID NO: 1095693 - DNA, 18 bp, Homo sapiens
aggtattctattctaata

SEQ ID NO: 1095694 - DNA, 14 bp, Homo sapiens
aggtattggcctgt

SEQ ID NO: 1095695 - DNA, 15 bp, Homo sapiens
aggtattggcctgtt

SEQ ID NO: 1095696 - DNA, 17 bp, Homo sapiens
aggtattggcctgttca

SEQ ID NO: 1095697 - DNA, 21 bp, Homo sapiens
aggtattgtctactctgaaga

SEQ ID NO: 1095698 - DNA, 15 bp, Homo sapiens
aggtatttaagactg

SEQ ID NO: 1095699 - DNA, 16 bp, Homo sapiens
aggtatttaagactga

SEQ ID NO: 1095700 - DNA, 18 bp, Homo sapiens
aggtattttgtagatgtg

SEQ ID NO: 1095701 - DNA, 13 bp, Homo sapiens
aggtatttttcca

SEQ ID NO: 1095702 - DNA, 19 bp, Homo sapiens
aggtatttttttaaatcaa

SEQ ID NO: 1095703 - DNA, 21 bp, Homo sapiens
aggtcaacagagaaggcagga

SEQ ID NO: 1095704 - DNA, 17 bp, Homo sapiens
aggtcaagaccagcctg

SEQ ID NO: 1095705 - DNA, 14 bp, Homo sapiens
aggtcaagcccaga

SEQ ID NO: 1095706 - DNA, 19 bp, Homo sapiens
aggtcaagcccagaaagtg

SEQ ID NO: 1095707 - DNA, 21 bp, Homo sapiens
aggtcaaggctgcagtgagcc

SEQ ID NO: 1095708 - DNA, 13 bp, Homo sapiens
aggtcaagggaaa

SEQ ID NO: 1095709 - DNA, 14 bp, Homo sapiens
aggtcaagggaaaa

SEQ ID NO: 1095710 - DNA, 15 bp, Homo sapiens
aggtcaagtaataaa

SEQ ID NO: 1095711 - DNA, 14 bp, Homo sapiens
aggtcaataaagca

SEQ ID NO: 1095712 - DNA, 21 bp, Homo sapiens
aggtcaataaagcagagccaa

SEQ ID NO: 1095713 - DNA, 23 bp, Homo sapiens
aggtcaataaagcagagccaagg

SEQ ID NO: 1095714 - DNA, 22 bp, Homo sapiens
aggtcaataaggtcaagggaaa

SEQ ID NO: 1095715 - DNA, 13 bp, Homo sapiens
aggtcaccagctg

SEQ ID NO: 1095716 - DNA, 14 bp, Homo sapiens
aggtcaccagctgc

SEQ ID NO: 1095717 - DNA, 14 bp, Homo sapiens
aggtcaccatcctc

SEQ ID NO: 1095718 - DNA, 15 bp, Homo sapiens
aggtcaccctttgct

SEQ ID NO: 1095719 - DNA, 18 bp, Homo sapiens
aggtcacgttggccctca

SEQ ID NO: 1095720 - DNA, 19 bp, Homo sapiens
aggtcactagatggcgagc

SEQ ID NO: 1095721 - DNA, 21 bp, Homo sapiens
aggtcactcttcctgcaagga

SEQ ID NO: 1095722 - DNA, 16 bp, Homo sapiens
aggtcactggaaaggg

SEQ ID NO: 1095723 - DNA, 17 bp, Homo sapiens
aggtcactggctctcca

SEQ ID NO: 1095724 - DNA, 16 bp, Homo sapiens
aggtcactgtcactgc

SEQ ID NO: 1095725 - DNA, 18 bp, Homo sapiens
aggtcactgtttcctggg

SEQ ID NO: 1095726 - DNA, 23 bp, Homo sapiens
aggtcactttttttttttttccc

SEQ ID NO: 1095727 - DNA, 23 bp, Homo sapiens
aggtcagactgaaacgccttgca

SEQ ID NO: 1095728 - DNA, 17 bp, Homo sapiens
aggtcagcaaaggtctt

SEQ ID NO: 1095729 - DNA, 16 bp, Homo sapiens
aggtcagcatgtctat

SEQ ID NO: 1095730 - DNA, 14 bp, Homo sapiens
aggtcagccaggct

SEQ ID NO: 1095731 - DNA, 12 bp, Homo sapiens
aggtcagccctg

SEQ ID NO: 1095732 - DNA, 13 bp, Homo sapiens
aggtcagctggga

SEQ ID NO: 1095733 - DNA, 12 bp, Homo sapiens
aggtcaggaaac

SEQ ID NO: 1095734 - DNA, 16 bp, Homo sapiens
aggtcaggacggctcc

SEQ ID NO: 1095735 - DNA, 20 bp, Homo sapiens
aggtcaggagttcctaacca

SEQ ID NO: 1095736 - DNA, 12 bp, Homo sapiens
aggtcagggctc

SEQ ID NO: 1095737 - DNA, 15 bp, Homo sapiens
aggtcagggctcaga

SEQ ID NO: 1095738 - DNA, 16 bp, Homo sapiens
aggtcaggggctccct

SEQ ID NO: 1095739 - DNA, 19 bp, Homo sapiens
aggtcagttgtgtttttta

SEQ ID NO: 1095740 - DNA, 19 bp, Homo sapiens
aggtcagtttagcaagaac

SEQ ID NO: 1095741 - DNA, 23 bp, Homo sapiens
aggtcattttttttaagaaaaag

SEQ ID NO: 1095742 - DNA, 17 bp, Homo sapiens
aggtccaaacccttcaa

SEQ ID NO: 1095743 - DNA, 16 bp, Homo sapiens
aggtccaagattctgg

SEQ ID NO: 1095744 - DNA, 18 bp, Homo sapiens
aggtccaagggccatact

SEQ ID NO: 1095745 - DNA, 20 bp, Homo sapiens
aggtccactccctgctccac

SEQ ID NO: 1095746 - DNA, 15 bp, Homo sapiens
aggtgccggggaggg

SEQ ID NO: 1095747 - DNA, 21 bp, Homo sapiens
aggtgcctcagttttccttct

SEQ ID NO: 1095748 - DNA, 23 bp, Homo sapiens
aggtgcctcagttttccttctgt

SEQ ID NO: 1095749 - DNA, 21 bp, Homo sapiens
aggtgcctccaattggtgctt

SEQ ID NO: 1095750 - DNA, 12 bp, Homo sapiens
aggtgcctccag

SEQ ID NO: 1095751 - DNA, 13 bp, Homo sapiens
aggtgcctgctca

SEQ ID NO: 1095752 - DNA, 13 bp, Homo sapiens
aggtgccttctta

SEQ ID NO: 1095753 - DNA, 22 bp, Homo sapiens
aggtgccttcttattctcactc

SEQ ID NO: 1095754 - DNA, 18 bp, Homo sapiens
aggtgcctttcaaattta

SEQ ID NO: 1095755 - DNA, 20 bp, Homo sapiens
aggtgcgcgccaccgtgcct

SEQ ID NO: 1095756 - DNA, 23 bp, Homo sapiens
aggtgcgcgccaccgtgcctggc

SEQ ID NO: 1095757 - DNA, 18 bp, Homo sapiens
aggtgcggcctgggggga

SEQ ID NO: 1095758 - DNA, 17 bp, Homo sapiens
aggtgcgtgtgtctctg

SEQ ID NO: 1095759 - DNA, 16 bp, Homo sapiens
aggtgctaacatagat

SEQ ID NO: 1095760 - DNA, 17 bp, Homo sapiens
aggtgctaatttgtttt

SEQ ID NO: 1095761 - DNA, 22 bp, Homo sapiens
aggtgctacaacatgtgaggca

SEQ ID NO: 1095762 - DNA, 20 bp, Homo sapiens
aggtgctacacccttttcca

SEQ ID NO: 1095763 - DNA, 14 bp, Homo sapiens
aggtgctatataat

SEQ ID NO: 1095764 - DNA, 18 bp, Homo sapiens
aggtgctcacaccccatt

SEQ ID NO: 1095765 - DNA, 18 bp, Homo sapiens
aggtgctgaatgaagctg

SEQ ID NO: 1095766 - DNA, 12 bp, Homo sapiens
aggtgctgagct

SEQ ID NO: 1095767 - DNA, 13 bp, Homo sapiens
aggtgctgagctt

SEQ ID NO: 1095768 - DNA, 23 bp, Homo sapiens
aggtgctgagcttagccttgtgc

SEQ ID NO: 1095769 - DNA, 13 bp, Homo sapiens
aggtgctgcttaa

SEQ ID NO: 1095770 - DNA, 18 bp, Homo sapiens
aggtgctgggctggactg

SEQ ID NO: 1095771 - DNA, 22 bp, Homo sapiens
aggtgctgggctggactggcca

SEQ ID NO: 1095772 - DNA, 21 bp, Homo sapiens
aggtgctggtagctgagggga

SEQ ID NO: 1095773 - DNA, 23 bp, Homo sapiens
aggtgctggtagctgaggggacg

SEQ ID NO: 1095774 - DNA, 20 bp, Homo sapiens
aggtgctgtgcgccttgtag

SEQ ID NO: 1095775 - DNA, 19 bp, Homo sapiens
aggtgcttaagcagaagca

SEQ ID NO: 1095776 - DNA, 20 bp, Homo sapiens
aggtgcttctcaccacggga

SEQ ID NO: 1095777 - DNA, 14 bp, Homo sapiens
aggtgcttttgatg

SEQ ID NO: 1095778 - DNA, 13 bp, Homo sapiens
aggtggaaaaaca

SEQ ID NO: 1095779 - DNA, 13 bp, Homo sapiens
aggtggaagccct

SEQ ID NO: 1095780 - DNA, 18 bp, Homo sapiens
aggtggaaggcagacagc

SEQ ID NO: 1095781 - DNA, 19 bp, Homo sapiens
aggtggagaaaattggaac

SEQ ID NO: 1095782 - DNA, 23 bp, Homo sapiens
aggtggagagacacacctgctcc

SEQ ID NO: 1095783 - DNA, 17 bp, Homo sapiens
aggtggaggtgggctga

SEQ ID NO: 1095784 - DNA, 15 bp, Homo sapiens
aggtggatctatttc

SEQ ID NO: 1095785 - DNA, 16 bp, Homo sapiens
aggtggatctatttca

SEQ ID NO: 1095786 - DNA, 23 bp, Homo sapiens
aggtggcagatgtcttccctggg

SEQ ID NO: 1095787 - DNA, 13 bp, Homo sapiens
aggtggcagccct

SEQ ID NO: 1095788 - DNA, 14 bp, Homo sapiens
aggtggcaggacca

SEQ ID NO: 1095789 - DNA, 15 bp, Homo sapiens
aggtggcatctctaa

SEQ ID NO: 1095790 - DNA, 21 bp, Homo sapiens
aggtggccacagtgtcactgg

SEQ ID NO: 1095791 - DNA, 14 bp, Homo sapiens
aggtggccactcca

SEQ ID NO: 1095792 - DNA, 18 bp, Homo sapiens
aggtggccatgcctcagc

SEQ ID NO: 1095793 - DNA, 18 bp, Homo sapiens
aggtggcccaggcccccg

SEQ ID NO: 1095794 - DNA, 15 bp, Homo sapiens
aggtggcctctgcct

SEQ ID NO: 1095795 - DNA, 18 bp, Homo sapiens
aggtggcctctgcctggg

SEQ ID NO: 1095796 - DNA, 14 bp, Homo sapiens
aggtggcctttgtg

SEQ ID NO: 1095797 - DNA, 17 bp, Homo sapiens
aggtggctctccagtta

SEQ ID NO: 1095798 - DNA, 19 bp, Homo sapiens
aggtggctgacccagtccc

SEQ ID NO: 1095799 - DNA, 22 bp, Homo sapiens
aggtggctgcgcccccagcttc

SEQ ID NO: 1095800 - DNA, 23 bp, Homo sapiens
aggtggctgtagatggtgacctg

SEQ ID NO: 1095801 - DNA, 20 bp, Homo sapiens
aggtgggacttagcagtgag

SEQ ID NO: 1095802 - DNA, 12 bp, Homo sapiens
aggtgggagctg

SEQ ID NO: 1095803 - DNA, 23 bp, Homo sapiens
aggtgggaggaaagggcctggcc

SEQ ID NO: 1095804 - DNA, 15 bp, Homo sapiens
aggtgggaggccagg

SEQ ID NO: 1095805 - DNA, 21 bp, Homo sapiens
aggtgggaggccaggcgagcc

SEQ ID NO: 1095806 - DNA, 16 bp, Homo sapiens
aggtgggatcctccct

SEQ ID NO: 1095807 - DNA, 16 bp, Homo sapiens
aggtgggcagctgggc

SEQ ID NO: 1095808 - DNA, 17 bp, Homo sapiens
aggtgggcagctgggcc

SEQ ID NO: 1095809 - DNA, 18 bp, Homo sapiens
aggtgggcagctgggccc

SEQ ID NO: 1095810 - DNA, 22 bp, Homo sapiens
aggtgggccacacccaggaagg

SEQ ID NO: 1095811 - DNA, 16 bp, Homo sapiens
aggtgggccagcccct

SEQ ID NO: 1095812 - DNA, 15 bp, Homo sapiens
aggtgggccttgcta

SEQ ID NO: 1095813 - DNA, 19 bp, Homo sapiens
aggtgggccttgctacctc

SEQ ID NO: 1095814 - DNA, 18 bp, Homo sapiens
aggtgggcggacaaaagg

SEQ ID NO: 1095815 - DNA, 21 bp, Homo sapiens
aggtgggcggacaaaagggcc

SEQ ID NO: 1095816 - DNA, 22 bp, Homo sapiens
aggtgggcggacaaaagggcca

SEQ ID NO: 1095817 - DNA, 16 bp, Homo sapiens
aggtgggcggtgtgtc

SEQ ID NO: 1095818 - DNA, 18 bp, Homo sapiens
aggtgggctgagccctgg

SEQ ID NO: 1095819 - DNA, 19 bp, Homo sapiens
aggtgggctgagccctggc

SEQ ID NO: 1095820 - DNA, 20 bp, Homo sapiens
aggtgggctgatggcctggc

SEQ ID NO: 1095821 - DNA, 17 bp, Homo sapiens
aggtgggctgcctgctg

SEQ ID NO: 1095822 - DNA, 15 bp, Homo sapiens
aggtgggctggactt

SEQ ID NO: 1095823 - DNA, 14 bp, Homo sapiens
aggtgggctgggcc

SEQ ID NO: 1095824 - DNA, 22 bp, Homo sapiens
aggtgggctggggctgctcccc

SEQ ID NO: 1095825 - DNA, 21 bp, Homo sapiens
aggtggggacctggggggagg

SEQ ID NO: 1095826 - DNA, 23 bp, Homo sapiens
aggtggggagggggtttgggggc

SEQ ID NO: 1095827 - DNA, 15 bp, Homo sapiens
aggtggggccctgcc

SEQ ID NO: 1095828 - DNA, 22 bp, Homo sapiens
aggtggggccctgcccctagga

SEQ ID NO: 1095829 - DNA, 23 bp, Homo sapiens
aggtggggcctcaatctaaggcc

SEQ ID NO: 1095830 - DNA, 15 bp, Homo sapiens
aggtggggcctcagc

SEQ ID NO: 1095831 - DNA, 22 bp, Homo sapiens
aggtggggcctcagcctggggc

SEQ ID NO: 1095832 - DNA, 21 bp, Homo sapiens
aggtggggtctttgtgagagt

SEQ ID NO: 1095833 - DNA, 22 bp, Homo sapiens
aggtggggtctttgtgagagtg

SEQ ID NO: 1095834 - DNA, 17 bp, Homo sapiens
aggtggggtgatggcca

SEQ ID NO: 1095835 - DNA, 22 bp, Homo sapiens
aggtggggtgatggccagagga

SEQ ID NO: 1095836 - DNA, 22 bp, Homo sapiens
aggtggggttgggattgggggc

SEQ ID NO: 1095837 - DNA, 17 bp, Homo sapiens
aggtgggtaggagccct

SEQ ID NO: 1095838 - DNA, 13 bp, Homo sapiens
aggtgggtccagg

SEQ ID NO: 1095839 - DNA, 18 bp, Homo sapiens
aggtgggtccaggaaggc

SEQ ID NO: 1095840 - DNA, 19 bp, Homo sapiens
aggtgggtccaggaaggca

SEQ ID NO: 1095841 - DNA, 20 bp, Homo sapiens
aggtgggtgctgccctgtgt

SEQ ID NO: 1095842 - DNA, 15 bp, Homo sapiens
aggtgggtgggcctg

SEQ ID NO: 1095843 - DNA, 19 bp, Homo sapiens
aggtgggtgggcctgactg

SEQ ID NO: 1095844 - DNA, 17 bp, Homo sapiens
aggtgggttagagatgg

SEQ ID NO: 1095845 - DNA, 23 bp, Homo sapiens
aggtgggttttcttcccatcact

SEQ ID NO: 1095846 - DNA, 15 bp, Homo sapiens
aggtggtcagtaaat

SEQ ID NO: 1095847 - DNA, 21 bp, Homo sapiens
aggtggtctgaatgttctgac

SEQ ID NO: 1095848 - DNA, 15 bp, Homo sapiens
aggtggtgcttacat

SEQ ID NO: 1095849 - DNA, 19 bp, Homo sapiens
aggtggtggcactgagccc

SEQ ID NO: 1095850 - DNA, 18 bp, Homo sapiens
aggtggtgtcgggccctt

SEQ ID NO: 1095851 - DNA, 16 bp, Homo sapiens
aggtggtgtgatctta

SEQ ID NO: 1095852 - DNA, 18 bp, Homo sapiens
aggtgtaaatgagaagac

SEQ ID NO: 1095853 - DNA, 13 bp, Homo sapiens
aggtgtatttaaa

SEQ ID NO: 1095854 - DNA, 15 bp, Homo sapiens
aggtgtcaccctgca

SEQ ID NO: 1095855 - DNA, 17 bp, Homo sapiens
aggtgtcaccctgcaga

SEQ ID NO: 1095856 - DNA, 18 bp, Homo sapiens
aggtgtcaccctgcagag

SEQ ID NO: 1095857 - DNA, 13 bp, Homo sapiens
aggtgtcaggccc

SEQ ID NO: 1095858 - DNA, 15 bp, Homo sapiens
aggtgtcatttccat

SEQ ID NO: 1095859 - DNA, 16 bp, Homo sapiens
aggtgtccagggtcct

SEQ ID NO: 1095860 - DNA, 21 bp, Homo sapiens
aggtgtccccaacgtcccctc

SEQ ID NO: 1095861 - DNA, 14 bp, Homo sapiens
aggtgtctctgggc

SEQ ID NO: 1095862 - DNA, 16 bp, Homo sapiens
aggtgtctctgggcct

SEQ ID NO: 1095863 - DNA, 14 bp, Homo sapiens
aggtgtctgcaccc

SEQ ID NO: 1095864 - DNA, 15 bp, Homo sapiens
aggtgtgagactggg

SEQ ID NO: 1095865 - DNA, 17 bp, Homo sapiens
aggtgtgcacagaaaac

SEQ ID NO: 1095866 - DNA, 13 bp, Homo sapiens
aggtgtggaaggg

SEQ ID NO: 1095867 - DNA, 16 bp, Homo sapiens
agtaatttagaagata

SEQ ID NO: 1095868 - DNA, 11 bp, Homo sapiens
agtaatttata

SEQ ID NO: 1095869 - DNA, 13 bp, Homo sapiens
agtaatttcagtg

SEQ ID NO: 1095870 - DNA, 14 bp, Homo sapiens
agtaatttcctaga

SEQ ID NO: 1095871 - DNA, 22 bp, Homo sapiens
agtaatttggaaattaggttga

SEQ ID NO: 1095872 - DNA, 14 bp, Homo sapiens
agtaatttgtaaag

SEQ ID NO: 1095873 - DNA, 21 bp, Homo sapiens
agtaatttgtttaaaaagtaa

SEQ ID NO: 1095874 - DNA, 14 bp, Homo sapiens
agtaattttcatat

SEQ ID NO: 1095875 - DNA, 15 bp, Homo sapiens
agtacaaatgaagaa

SEQ ID NO: 1095876 - DNA, 22 bp, Homo sapiens
agtacacaataagcaaaaacaa

SEQ ID NO: 1095877 - DNA, 20 bp, Homo sapiens
agtacacagcaccagaatgt

SEQ ID NO: 1095878 - DNA, 14 bp, Homo sapiens
agtacactctgctg

SEQ ID NO: 1095879 - DNA, 15 bp, Homo sapiens
agtacactctgctgt

SEQ ID NO: 1095880 - DNA, 21 bp, Homo sapiens
agtacactgtttcaaacttta

SEQ ID NO: 1095881 - DNA, 14 bp, Homo sapiens
agtacagaatttga

SEQ ID NO: 1095882 - DNA, 17 bp, Homo sapiens
agtacagaatttgaatt

SEQ ID NO: 1095883 - DNA, 13 bp, Homo sapiens
agtacagactgca

SEQ ID NO: 1095884 - DNA, 13 bp, Homo sapiens
agtacagcggctc

SEQ ID NO: 1095885 - DNA, 14 bp, Homo sapiens
agtacagcggctcc

SEQ ID NO: 1095886 - DNA, 22 bp, Homo sapiens
agtacagcggctcccctctgct

SEQ ID NO: 1095887 - DNA, 18 bp, Homo sapiens
agtacaggtgcatattaa

SEQ ID NO: 1095888 - DNA, 18 bp, Homo sapiens
agtacaggttttgccctg

SEQ ID NO: 1095889 - DNA, 13 bp, Homo sapiens
agtacataattga

SEQ ID NO: 1095890 - DNA, 17 bp, Homo sapiens
agtacatattaggaaaa

SEQ ID NO: 1095891 - DNA, 22 bp, Homo sapiens
agtacatgataaatgatagaca

SEQ ID NO: 1095892 - DNA, 22 bp, Homo sapiens
agtacattgcttaaaatatata

SEQ ID NO: 1095893 - DNA, 15 bp, Homo sapiens
agtacatttaaattt

SEQ ID NO: 1095894 - DNA, 19 bp, Homo sapiens
agtacatttaaattttttg

SEQ ID NO: 1095895 - DNA, 21 bp, Homo sapiens
agtacatttaatacagcagtg

SEQ ID NO: 1095896 - DNA, 16 bp, Homo sapiens
agtaccaatgggaagc

SEQ ID NO: 1095897 - DNA, 22 bp, Homo sapiens
agtaccaatgggaagcagggaa

SEQ ID NO: 1095898 - DNA, 14 bp, Homo sapiens
agtaccagactaga

SEQ ID NO: 1095899 - DNA, 23 bp, Homo sapiens
agtaccagtaggggcttataata

SEQ ID NO: 1095900 - DNA, 21 bp, Homo sapiens
agtaccatagtaccatttata

SEQ ID NO: 1095901 - DNA, 18 bp, Homo sapiens
agtacccatctagtactt

SEQ ID NO: 1095902 - DNA, 13 bp, Homo sapiens
agtacccctggta

SEQ ID NO: 1095903 - DNA, 21 bp, Homo sapiens
agtaccctccattgggcacag

SEQ ID NO: 1095904 - DNA, 15 bp, Homo sapiens
agtacctatgacttt

SEQ ID NO: 1095905 - DNA, 13 bp, Homo sapiens
agtacctccaagc

SEQ ID NO: 1095906 - DNA, 15 bp, Homo sapiens
agtacctccaagcaa

SEQ ID NO: 1095907 - DNA, 14 bp, Homo sapiens
agtacctgaaaagt

SEQ ID NO: 1095908 - DNA, 17 bp, Homo sapiens
agtacctgattgtattt

SEQ ID NO: 1095909 - DNA, 12 bp, Homo sapiens
agtacctgctgc

SEQ ID NO: 1095910 - DNA, 20 bp, Homo sapiens
agtacctgggaaaggaccca

SEQ ID NO: 1095911 - DNA, 13 bp, Homo sapiens
agtacctttgtca

SEQ ID NO: 1095912 - DNA, 14 bp, Homo sapiens
agtacctttgtcac

SEQ ID NO: 1095913 - DNA, 16 bp, Homo sapiens
agtacgatcaagttgt

SEQ ID NO: 1095914 - DNA, 21 bp, Homo sapiens
agtacgtcccgctgctgtgct

SEQ ID NO: 1095915 - DNA, 16 bp, Homo sapiens
agtacgttaaaagcaa

SEQ ID NO: 1095916 - DNA, 13 bp, Homo sapiens
agtacgttattgt

SEQ ID NO: 1095917 - DNA, 15 bp, Homo sapiens
agtacgttgtgcatt

SEQ ID NO: 1095918 - DNA, 16 bp, Homo sapiens
agtacgttgtgcattt

SEQ ID NO: 1095919 - DNA, 20 bp, Homo sapiens
agtactagatgcatcactgg

SEQ ID NO: 1095920 - DNA, 21 bp, Homo sapiens
agtactcctcacttttcaatt

SEQ ID NO: 1095921 - DNA, 19 bp, Homo sapiens
agtactcctgcaaaatttt

SEQ ID NO: 1095922 - DNA, 15 bp, Homo sapiens
agtactccttaagaa

SEQ ID NO: 1095923 - DNA, 18 bp, Homo sapiens
agtactccttaagaacac

SEQ ID NO: 1095924 - DNA, 19 bp, Homo sapiens
agtactccttaagaacaca

SEQ ID NO: 1095925 - DNA, 17 bp, Homo sapiens
agtactctacaattcct

SEQ ID NO: 1095926 - DNA, 22 bp, Homo sapiens
agtactctttaacatacaagaa

SEQ ID NO: 1095927 - DNA, 17 bp, Homo sapiens
agtactgctcttgtttc

SEQ ID NO: 1095928 - DNA, 13 bp, Homo sapiens
agtactggaataa

SEQ ID NO: 1095929 - DNA, 23 bp, Homo sapiens
agtactggggagaaataattgtt

SEQ ID NO: 1095930 - DNA, 19 bp, Homo sapiens
agtactggtaagattgtta

SEQ ID NO: 1095931 - DNA, 21 bp, Homo sapiens
agtactggtaagattgttatt

SEQ ID NO: 1095932 - DNA, 13 bp, Homo sapiens
agtactgtactat

SEQ ID NO: 1095933 - DNA, 16 bp, Homo sapiens
agtacttcttctgtaa

SEQ ID NO: 1095934 - DNA, 23 bp, Homo sapiens
agtacttcttctgtaatatttac

SEQ ID NO: 1095935 - DNA, 11 bp, Homo sapiens
agtacttgaaa

SEQ ID NO: 1095936 - DNA, 16 bp, Homo sapiens
agtacttgaaaaagta

SEQ ID NO: 1095937 - DNA, 16 bp, Homo sapiens
agtactttaaaaagga

SEQ ID NO: 1095938 - DNA, 19 bp, Homo sapiens
agtactttaaaaaggaaat

SEQ ID NO: 1095939 - DNA, 17 bp, Homo sapiens
agtactttagcctggta

SEQ ID NO: 1095940 - DNA, 17 bp, Homo sapiens
agtactttattgtacag

SEQ ID NO: 1095941 - DNA, 17 bp, Homo sapiens
agtactttggaggcccc

SEQ ID NO: 1095942 - DNA, 19 bp, Homo sapiens
agtactttggaggccccta

SEQ ID NO: 1095943 - DNA, 16 bp, Homo sapiens
agtactttgtgcattc

SEQ ID NO: 1095944 - DNA, 17 bp, Homo sapiens
agtacttttctgttcat

SEQ ID NO: 1095945 - DNA, 23 bp, Homo sapiens
agtacttttttaaatattttcta

SEQ ID NO: 1095946 - DNA, 22 bp, Homo sapiens
agtagaaaagcagtcccattca

SEQ ID NO: 1095947 - DNA, 12 bp, Homo sapiens
agtagaaaatgt

SEQ ID NO: 1095948 - DNA, 23 bp, Homo sapiens
agtagaaactacgaaaaataaaa

SEQ ID NO: 1095949 - DNA, 20 bp, Homo sapiens
agtagaaagacatctgcctg

SEQ ID NO: 1095950 - DNA, 20 bp, Homo sapiens
agtagaaatgccagaaacag

SEQ ID NO: 1095951 - DNA, 17 bp, Homo sapiens
agtagaactcttaaata

SEQ ID NO: 1095952 - DNA, 14 bp, Homo sapiens
agtagaactggatc

SEQ ID NO: 1095953 - DNA, 17 bp, Homo sapiens
agtagaagtcttagatg

SEQ ID NO: 1095954 - DNA, 19 bp, Homo sapiens
agtagaagtcttagatgta

SEQ ID NO: 1095955 - DNA, 20 bp, Homo sapiens
agtagaagtcttagatgtat

SEQ ID NO: 1095956 - DNA, 19 bp, Homo sapiens
agtagaataacctttcaga

SEQ ID NO: 1095957 - DNA, 14 bp, Homo sapiens
agtagaattaccat

SEQ ID NO: 1095958 - DNA, 18 bp, Homo sapiens
agtagaattaccattaat

SEQ ID NO: 1095959 - DNA, 22 bp, Homo sapiens
agtagaattaccattaattaca

SEQ ID NO: 1095960 - DNA, 14 bp, Homo sapiens
agtagaattgcatt

SEQ ID NO: 1095961 - DNA, 23 bp, Homo sapiens
agtagaatttcaatgtccagtga

SEQ ID NO: 1095962 - DNA, 23 bp, Homo sapiens
agtagaccttgttacttctgagg

SEQ ID NO: 1095963 - DNA, 18 bp, Homo sapiens
agtagacttggtgtgaag

SEQ ID NO: 1095964 - DNA, 13 bp, Homo sapiens
agtagagccagct

SEQ ID NO: 1095965 - DNA, 16 bp, Homo sapiens
agtagagccaggtgct

SEQ ID NO: 1095966 - DNA, 17 bp, Homo sapiens
agtagagctagctgcca

SEQ ID NO: 1095967 - DNA, 17 bp, Homo sapiens
agtagagtcatctccat

SEQ ID NO: 1095968 - DNA, 20 bp, Homo sapiens
agtagataatttcagggtgc

SEQ ID NO: 1095969 - DNA, 23 bp, Homo sapiens
agtagatctatattagatcaaat

SEQ ID NO: 1095970 - DNA, 15 bp, Homo sapiens
agtagatggtgaaat

SEQ ID NO: 1095971 - DNA, 17 bp, Homo sapiens
agtagatggtgaaattt

SEQ ID NO: 1095972 - DNA, 21 bp, Homo sapiens
agtagatggtgaaatttatta

SEQ ID NO: 1095973 - DNA, 18 bp, Homo sapiens
agtagatgtggcctttga

SEQ ID NO: 1095974 - DNA, 19 bp, Homo sapiens
agtagattaaaaattatag

SEQ ID NO: 1095975 - DNA, 20 bp, Homo sapiens
agtagatttttaacaaaaaa

SEQ ID NO: 1095976 - DNA, 20 bp, Homo sapiens
agtagcaaaacaaattcaaa

SEQ ID NO: 1095977 - DNA, 20 bp, Homo sapiens
agtagcaagttctagagaag

SEQ ID NO: 1095978 - DNA, 23 bp, Homo sapiens
agtagcacaagttatttaaatct

SEQ ID NO: 1095979 - DNA, 12 bp, Homo sapiens
agtagcaggact

SEQ ID NO: 1095980 - DNA, 17 bp, Homo sapiens
agtagccaaaaggaatg

SEQ ID NO: 1095981 - DNA, 15 bp, Homo sapiens
agtagccctttctgt

SEQ ID NO: 1095982 - DNA, 16 bp, Homo sapiens
agtagccctttctgtg

SEQ ID NO: 1095983 - DNA, 19 bp, Homo sapiens
agtagccctttctgtgtgc

SEQ ID NO: 1095984 - DNA, 20 bp, Homo sapiens
agtagccctttctgtgtgca

SEQ ID NO: 1095985 - DNA, 15 bp, Homo sapiens
agtagccgagagcct

SEQ ID NO: 1095986 - DNA, 22 bp, Homo sapiens
agtagcctaacacactccaaga

SEQ ID NO: 1095987 - DNA, 22 bp, Homo sapiens
agtagcctctcctgtatttaac

SEQ ID NO: 1095988 - DNA, 14 bp, Homo sapiens
agtagctagtttgc

SEQ ID NO: 1095989 - DNA, 13 bp, Homo sapiens
agtccaggcacag

SEQ ID NO: 1095990 - DNA, 12 bp, Homo sapiens
agtccaggcccc

SEQ ID NO: 1095991 - DNA, 20 bp, Homo sapiens
agtccaggcctctctctgct

SEQ ID NO: 1095992 - DNA, 18 bp, Homo sapiens
agtccaggctgccgtggg

SEQ ID NO: 1095993 - DNA, 17 bp, Homo sapiens
agtccagggtttctctg

SEQ ID NO: 1095994 - DNA, 19 bp, Homo sapiens
agtccagggtttctctgca

SEQ ID NO: 1095995 - DNA, 16 bp, Homo sapiens
agtccagtgctctgcc

SEQ ID NO: 1095996 - DNA, 18 bp, Homo sapiens
agtccagtgctctgcctc

SEQ ID NO: 1095997 - DNA, 20 bp, Homo sapiens
agtccagtgctctgcctcag

SEQ ID NO: 1095998 - DNA, 20 bp, Homo sapiens
agtccagtgctttctttccg

SEQ ID NO: 1095999 - DNA, 19 bp, Homo sapiens
agtccatgttattctctca

SEQ ID NO: 1096000 - DNA, 16 bp, Homo sapiens
agtccattctcccagg

SEQ ID NO: 1096001 - DNA, 14 bp, Homo sapiens
agtccatttcctaa

SEQ ID NO: 1096002 - DNA, 20 bp, Homo sapiens
agtccattttttaaaaatgt

SEQ ID NO: 1096003 - DNA, 17 bp, Homo sapiens
agtcccaaggaaagccc

SEQ ID NO: 1096004 - DNA, 21 bp, Homo sapiens
agtcccacactgtggccaggc

SEQ ID NO: 1096005 - DNA, 21 bp, Homo sapiens
agtcccacccggacaggtggg

SEQ ID NO: 1096006 - DNA, 23 bp, Homo sapiens
agtcccagagcaggaggcccctg

SEQ ID NO: 1096007 - DNA, 17 bp, Homo sapiens
agtcccagagctcatcc

SEQ ID NO: 1096008 - DNA, 19 bp, Homo sapiens
agtcccagctactcgggag

SEQ ID NO: 1096009 - DNA, 20 bp, Homo sapiens
agtcccagctacttgggagc

SEQ ID NO: 1096010 - DNA, 19 bp, Homo sapiens
agtcccaggctgagcctca

SEQ ID NO: 1096011 - DNA, 20 bp, Homo sapiens
agtcccaggctgagcctcag

SEQ ID NO: 1096012 - DNA, 22 bp, Homo sapiens
agtccccacagataactgaaaa

SEQ ID NO: 1096013 - DNA, 11 bp, Homo sapiens
agtccccaccc

SEQ ID NO: 1096014 - DNA, 15 bp, Homo sapiens
agtccccacccctgc

SEQ ID NO: 1096015 - DNA, 14 bp, Homo sapiens
agtccccagccctg

SEQ ID NO: 1096016 - DNA, 18 bp, Homo sapiens
agtcccccaactctgagc

SEQ ID NO: 1096017 - DNA, 19 bp, Homo sapiens
agtcccccaactctgagcc

SEQ ID NO: 1096018 - DNA, 15 bp, Homo sapiens
agtcccccacccacc

SEQ ID NO: 1096019 - DNA, 21 bp, Homo sapiens
agtcccccacccacctcctgc

SEQ ID NO: 1096020 - DNA, 16 bp, Homo sapiens
agtccccctgccccag

SEQ ID NO: 1096021 - DNA, 22 bp, Homo sapiens
agtccccgaggagctgggcccc

SEQ ID NO: 1096022 - DNA, 17 bp, Homo sapiens
agtcccctactccctct

SEQ ID NO: 1096023 - DNA, 16 bp, Homo sapiens
agtcccctcccatctg

SEQ ID NO: 1096024 - DNA, 19 bp, Homo sapiens
agtcccctccccggcccta

SEQ ID NO: 1096025 - DNA, 21 bp, Homo sapiens
agtcccctccccggccctacc

SEQ ID NO: 1096026 - DNA, 15 bp, Homo sapiens
agtcccctctctctg

SEQ ID NO: 1096027 - DNA, 17 bp, Homo sapiens
agtcccctctctctggg

SEQ ID NO: 1096028 - DNA, 12 bp, Homo sapiens
agtcccctgttg

SEQ ID NO: 1096029 - DNA, 15 bp, Homo sapiens
agtccctatgtattt

SEQ ID NO: 1096030 - DNA, 21 bp, Homo sapiens
agtccctcacgtttcttcccc

SEQ ID NO: 1096031 - DNA, 22 bp, Homo sapiens
agtccctcacgtttcttcccca

SEQ ID NO: 1096032 - DNA, 23 bp, Homo sapiens
agtccctcccatctctaccccaa

SEQ ID NO: 1096033 - DNA, 15 bp, Homo sapiens
agtccctccctgcct

SEQ ID NO: 1096034 - DNA, 18 bp, Homo sapiens
agtccctctggaaagaaa

SEQ ID NO: 1096035 - DNA, 21 bp, Homo sapiens
agtccctgcacagtgacttct

SEQ ID NO: 1096036 - DNA, 17 bp, Homo sapiens
agtccctgggggaagcc

SEQ ID NO: 1096037 - DNA, 16 bp, Homo sapiens
agtccctggttcattg

SEQ ID NO: 1096038 - DNA, 13 bp, Homo sapiens
agtccctgttttc

SEQ ID NO: 1096039 - DNA, 14 bp, Homo sapiens
agtcccttcccctc

SEQ ID NO: 1096040 - DNA, 19 bp, Homo sapiens
agtcccttcccctccctgg

SEQ ID NO: 1096041 - DNA, 20 bp, Homo sapiens
agtcccttcctattctcctg

SEQ ID NO: 1096042 - DNA, 13 bp, Homo sapiens
agtcccttcctgc

SEQ ID NO: 1096043 - DNA, 20 bp, Homo sapiens
agtcccttcctgcttcctgt

SEQ ID NO: 1096044 - DNA, 18 bp, Homo sapiens
agtccgcagaagccctga

SEQ ID NO: 1096045 - DNA, 17 bp, Homo sapiens
agtccgcctgcgcctcc

SEQ ID NO: 1096046 - DNA, 21 bp, Homo sapiens
agtccgtgctgacagctgctc

SEQ ID NO: 1096047 - DNA, 19 bp, Homo sapiens
agtcctaacttcctgtgcc

SEQ ID NO: 1096048 - DNA, 23 bp, Homo sapiens
agtcctagttttcctacttataa

SEQ ID NO: 1096049 - DNA, 15 bp, Homo sapiens
agtcctatgtacaga

SEQ ID NO: 1096050 - DNA, 18 bp, Homo sapiens
agtcctattcaaattcct

SEQ ID NO: 1096051 - DNA, 18 bp, Homo sapiens
agtcctcactcccagtcc

SEQ ID NO: 1096052 - DNA, 14 bp, Homo sapiens
agtcctcactgtcc

SEQ ID NO: 1096053 - DNA, 16 bp, Homo sapiens
agtcctcactgtcctg

SEQ ID NO: 1096054 - DNA, 18 bp, Homo sapiens
agtcctcactgtcctgtt

SEQ ID NO: 1096055 - DNA, 20 bp, Homo sapiens
agtcctcaggtacagcgggc

SEQ ID NO: 1096056 - DNA, 19 bp, Homo sapiens
agtcctccctgacttttct

SEQ ID NO: 1096057 - DNA, 15 bp, Homo sapiens
agtcctcgtagccat

SEQ ID NO: 1096058 - DNA, 17 bp, Homo sapiens
agtcctcgtagccatct

SEQ ID NO: 1096059 - DNA, 14 bp, Homo sapiens
agtcctctgaatga

SEQ ID NO: 1096060 - DNA, 13 bp, Homo sapiens
agtcctctgctcc

SEQ ID NO: 1096061 - DNA, 14 bp, Homo sapiens
agtcctctgctcca

SEQ ID NO: 1096062 - DNA, 13 bp, Homo sapiens
agtcctgaagagg

SEQ ID NO: 1096063 - DNA, 22 bp, Homo sapiens
agtcctgaagaggcgggccagc

SEQ ID NO: 1096064 - DNA, 15 bp, Homo sapiens
agtcctgaggagagg

SEQ ID NO: 1096065 - DNA, 13 bp, Homo sapiens
agtcctgcctggc

SEQ ID NO: 1096066 - DNA, 16 bp, Homo sapiens
agtcctgcctggccag

SEQ ID NO: 1096067 - DNA, 17 bp, Homo sapiens
agtcctgcctggccagg

SEQ ID NO: 1096068 - DNA, 19 bp, Homo sapiens
agtcctgctacctcccttg

SEQ ID NO: 1096069 - DNA, 22 bp, Homo sapiens
agtcctgctacctcccttgcct

SEQ ID NO: 1096070 - DNA, 24 bp, Homo sapiens
agtcctgctacctcccttgccttt

SEQ ID NO: 1096071 - DNA, 14 bp, Homo sapiens
agtcctgctccaga

SEQ ID NO: 1096072 - DNA, 18 bp, Homo sapiens
agtcctgctccagaattt

SEQ ID NO: 1096073 - DNA, 15 bp, Homo sapiens
agtcctgctggatct

SEQ ID NO: 1096074 - DNA, 20 bp, Homo sapiens
agtcctggaagccagctttc

SEQ ID NO: 1096075 - DNA, 23 bp, Homo sapiens
agtcctggaagccagctttccct

SEQ ID NO: 1096076 - DNA, 19 bp, Homo sapiens
agtcctggatgatactaat

SEQ ID NO: 1096077 - DNA, 17 bp, Homo sapiens
agtcctggatgttgtgt

SEQ ID NO: 1096078 - DNA, 14 bp, Homo sapiens
agtcctggcagctg

SEQ ID NO: 1096079 - DNA, 15 bp, Homo sapiens
agtcctggcagctgg

SEQ ID NO: 1096080 - DNA, 10 bp, Homo sapiens
agtcctgggt

SEQ ID NO: 1096081 - DNA, 18 bp, Homo sapiens
agtcctgggttgtttcca

SEQ ID NO: 1096082 - DNA, 22 bp, Homo sapiens
agtcctgggttgtttccaggag

SEQ ID NO: 1096083 - DNA, 15 bp, Homo sapiens
agtcctggtcctggc

SEQ ID NO: 1096084 - DNA, 18 bp, Homo sapiens
agtcctggtcctggctgc

SEQ ID NO: 1096085 - DNA, 21 bp, Homo sapiens
agtcctggtcctggctgcact

SEQ ID NO: 1096086 - DNA, 17 bp, Homo sapiens
agtcctgtctcccactt

SEQ ID NO: 1096087 - DNA, 16 bp, Homo sapiens
agtcctgtctctgcct

SEQ ID NO: 1096088 - DNA, 16 bp, Homo sapiens
agtcctgtgaatttct

SEQ ID NO: 1096089 - DNA, 15 bp, Homo sapiens
agtcctgtgctgaat

SEQ ID NO: 1096090 - DNA, 13 bp, Homo sapiens
agtcctgttcaaa

SEQ ID NO: 1096091 - DNA, 20 bp, Homo sapiens
agtcctgttgaagacttcct

SEQ ID NO: 1096092 - DNA, 23 bp, Homo sapiens
agtcctgttgaagacttcctctc

SEQ ID NO: 1096093 - DNA, 23 bp, Homo sapiens
agtccttacctcttccggagatg

SEQ ID NO: 1096094 - DNA, 20 bp, Homo sapiens
agtccttattatcccagctt

SEQ ID NO: 1096095 - DNA, 24 bp, Homo sapiens
agtccttattatcccagcttgctg

SEQ ID NO: 1096096 - DNA, 20 bp, Homo sapiens
agtccttattcttctcataa

SEQ ID NO: 1096097 - DNA, 20 bp, Homo sapiens
agtcctttcccaccattcct

SEQ ID NO: 1096098 - DNA, 20 bp, Homo sapiens
agtcctttctgtgaagctaa

SEQ ID NO: 1096099 - DNA, 16 bp, Homo sapiens
agtcctttttttccat

SEQ ID NO: 1096100 - DNA, 21 bp, Homo sapiens
agtcctttttttccatcttta

SEQ ID NO: 1096101 - DNA, 18 bp, Homo sapiens
agtcgaattaatagcttt

SEQ ID NO: 1096102 - DNA, 21 bp, Homo sapiens
agtcgaattaatagcttttat

SEQ ID NO: 1096103 - DNA, 20 bp, Homo sapiens
agtcgagacctcacacacgg

SEQ ID NO: 1096104 - DNA, 16 bp, Homo sapiens
agtcgagattgcactg

SEQ ID NO: 1096105 - DNA, 13 bp, Homo sapiens
agtcgagcactct

SEQ ID NO: 1096106 - DNA, 23 bp, Homo sapiens
agtcgattatttccagtgttcta

SEQ ID NO: 1096107 - DNA, 20 bp, Homo sapiens
agtcgcaggatccgctgcca

SEQ ID NO: 1096108 - DNA, 23 bp, Homo sapiens
agtcgcaggatccgctgccacca

SEQ ID NO: 1096109 - DNA, 19 bp, Homo sapiens
agtcgcatctcagtgcagg

SEQ ID NO: 1096110 - DNA, 21 bp, Homo sapiens
agtgacagaccacatctttat

SEQ ID NO: 1096111 - DNA, 15 bp, Homo sapiens
agtgacagctttctg

SEQ ID NO: 1096112 - DNA, 21 bp, Homo sapiens
agtgacagtcataaatactgt

SEQ ID NO: 1096113 - DNA, 19 bp, Homo sapiens
agtgacagtggattgcatt

SEQ ID NO: 1096114 - DNA, 20 bp, Homo sapiens
agtgacataatatattctat

SEQ ID NO: 1096115 - DNA, 12 bp, Homo sapiens
agtgacatgaag

SEQ ID NO: 1096116 - DNA, 14 bp, Homo sapiens
agtgacatgaagca

SEQ ID NO: 1096117 - DNA, 15 bp, Homo sapiens
agtgacatgaagcat

SEQ ID NO: 1096118 - DNA, 18 bp, Homo sapiens
agtgaccatactaattat

SEQ ID NO: 1096119 - DNA, 13 bp, Homo sapiens
agtgacccagcta

SEQ ID NO: 1096120 - DNA, 15 bp, Homo sapiens
agtgaccccagggcc

SEQ ID NO: 1096121 - DNA, 16 bp, Homo sapiens
agtgaccctcagctgt

SEQ ID NO: 1096122 - DNA, 19 bp, Homo sapiens
agtgaccctcagctgtcac

SEQ ID NO: 1096123 - DNA, 20 bp, Homo sapiens
agtgaccctcagctgtcacc

SEQ ID NO: 1096124 - DNA, 18 bp, Homo sapiens
agtgaccgattatgcttt

SEQ ID NO: 1096125 - DNA, 19 bp, Homo sapiens
agtgaccgattatgctttc

SEQ ID NO: 1096126 - DNA, 20 bp, Homo sapiens
agtgaccgggcactggcact

SEQ ID NO: 1096127 - DNA, 22 bp, Homo sapiens
agtgactatgaacttctctcag

SEQ ID NO: 1096128 - DNA, 17 bp, Homo sapiens
agtgactccctgggagc

SEQ ID NO: 1096129 - DNA, 13 bp, Homo sapiens
agtgactctcctg

SEQ ID NO: 1096130 - DNA, 21 bp, Homo sapiens
agtgactctcctgcctcagcc

SEQ ID NO: 1096131 - DNA, 14 bp, Homo sapiens
agtgactggcaggt

SEQ ID NO: 1096132 - DNA, 23 bp, Homo sapiens
agtgactgttgtagcattttcct

SEQ ID NO: 1096133 - DNA, 18 bp, Homo sapiens
agtgacttattttgtctt

SEQ ID NO: 1096134 - DNA, 21 bp, Homo sapiens
agtgacttcctggggatgtca

SEQ ID NO: 1096135 - DNA, 16 bp, Homo sapiens
agtgacttcctggtga

SEQ ID NO: 1096136 - DNA, 14 bp, Homo sapiens
agtgacttctgaga

SEQ ID NO: 1096137 - DNA, 15 bp, Homo sapiens
agtgacttctgagat

SEQ ID NO: 1096138 - DNA, 17 bp, Homo sapiens
agtgacttctggagaaa

SEQ ID NO: 1096139 - DNA, 17 bp, Homo sapiens
agtgacttggccccaga

SEQ ID NO: 1096140 - DNA, 17 bp, Homo sapiens
agtgactttaaaagaaa

SEQ ID NO: 1096141 - DNA, 18 bp, Homo sapiens
agtgactttacaggaggt

SEQ ID NO: 1096142 - DNA, 14 bp, Homo sapiens
agtgagaaaaagct

SEQ ID NO: 1096143 - DNA, 18 bp, Homo sapiens
agtgagaaaaagctcctg

SEQ ID NO: 1096144 - DNA, 19 bp, Homo sapiens
agtgagaaaaagctcctgt

SEQ ID NO: 1096145 - DNA, 20 bp, Homo sapiens
agtgagaaaaagctcctgtc

SEQ ID NO: 1096146 - DNA, 20 bp, Homo sapiens
agtgagaaagggcatacatc

SEQ ID NO: 1096147 - DNA, 12 bp, Homo sapiens
agtgagacagaa

SEQ ID NO: 1096148 - DNA, 21 bp, Homo sapiens
agtgagacccagccctcatcc

SEQ ID NO: 1096149 - DNA, 18 bp, Homo sapiens
agtgagacccctgtctcc

SEQ ID NO: 1096150 - DNA, 13 bp, Homo sapiens
agtgagagagaca

SEQ ID NO: 1096151 - DNA, 16 bp, Homo sapiens
agtgagagcctttgcc

SEQ ID NO: 1096152 - DNA, 19 bp, Homo sapiens
agtgagagcctttgccttt

SEQ ID NO: 1096153 - DNA, 22 bp, Homo sapiens
agtgagagggcatgcgcacaag

SEQ ID NO: 1096154 - DNA, 14 bp, Homo sapiens
agtgagaggggagg

SEQ ID NO: 1096155 - DNA, 19 bp, Homo sapiens
agtgagatagcattgtgaa

SEQ ID NO: 1096156 - DNA, 16 bp, Homo sapiens
agtgagatatcataga

SEQ ID NO: 1096157 - DNA, 22 bp, Homo sapiens
agtgagatgagggatgggcctg

SEQ ID NO: 1096158 - DNA, 18 bp, Homo sapiens
agtgagatggtatgaaat

SEQ ID NO: 1096159 - DNA, 12 bp, Homo sapiens
agtgagcagaac

SEQ ID NO: 1096160 - DNA, 13 bp, Homo sapiens
agtgagcagaaca

SEQ ID NO: 1096161 - DNA, 18 bp, Homo sapiens
agtgagcagaacaggtag

SEQ ID NO: 1096162 - DNA, 19 bp, Homo sapiens
agtgagcagaacaggtagt

SEQ ID NO: 1096163 - DNA, 11 bp, Homo sapiens
agtgagcagct

SEQ ID NO: 1096164 - DNA, 12 bp, Homo sapiens
agtgagcagcta

SEQ ID NO: 1096165 - DNA, 19 bp, Homo sapiens
agtgagcagctactgtaac

SEQ ID NO: 1096166 - DNA, 21 bp, Homo sapiens
agtgagcagctactgtaactt

SEQ ID NO: 1096167 - DNA, 19 bp, Homo sapiens
agtgagcagggtggggtct

SEQ ID NO: 1096168 - DNA, 22 bp, Homo sapiens
agtgagcatggaacacttcgag

SEQ ID NO: 1096169 - DNA, 21 bp, Homo sapiens
agtgagccatgattttctaaa

SEQ ID NO: 1096170 - DNA, 13 bp, Homo sapiens
agtgagcccctcc

SEQ ID NO: 1096171 - DNA, 20 bp, Homo sapiens
agtgagcccctccccagcca

SEQ ID NO: 1096172 - DNA, 21 bp, Homo sapiens
agtgagcccctccccagccag

SEQ ID NO: 1096173 - DNA, 20 bp, Homo sapiens
agtgagcctcctgtgcctgg

SEQ ID NO: 1096174 - DNA, 11 bp, Homo sapiens
agtgagcctga

SEQ ID NO: 1096175 - DNA, 12 bp, Homo sapiens
agtgagcctggg

SEQ ID NO: 1096176 - DNA, 16 bp, Homo sapiens
agtgagcctgggccag

SEQ ID NO: 1096177 - DNA, 17 bp, Homo sapiens
agtgagcctgggccagg

SEQ ID NO: 1096178 - DNA, 23 bp, Homo sapiens
agtgagctgagatcgtgccgtta

SEQ ID NO: 1096179 - DNA, 17 bp, Homo sapiens
agtgagctgtaggtgtg

SEQ ID NO: 1096180 - DNA, 19 bp, Homo sapiens
agtgagctttgctgctaca

SEQ ID NO: 1096181 - DNA, 18 bp, Homo sapiens
agtgaggactcggccact

SEQ ID NO: 1096182 - DNA, 21 bp, Homo sapiens
agtgaggactcggccactgtg

SEQ ID NO: 1096183 - DNA, 18 bp, Homo sapiens
agtgaggatcttgatttg

SEQ ID NO: 1096184 - DNA, 20 bp, Homo sapiens
agtgaggatggatttagaaa

SEQ ID NO: 1096185 - DNA, 12 bp, Homo sapiens
agtgaggcccaa

SEQ ID NO: 1096186 - DNA, 14 bp, Homo sapiens
agtgaggcttccag

SEQ ID NO: 1096187 - DNA, 19 bp, Homo sapiens
agtgaggcttccaggctct

SEQ ID NO: 1096188 - DNA, 19 bp, Homo sapiens
agtgagggagggctgtcat

SEQ ID NO: 1096189 - DNA, 15 bp, Homo sapiens
agtgagggcctcaga

SEQ ID NO: 1096190 - DNA, 20 bp, Homo sapiens
agtgagggcctcagagcctg

SEQ ID NO: 1096191 - DNA, 22 bp, Homo sapiens
agtgagggcctcagagcctgac

SEQ ID NO: 1096192 - DNA, 24 bp, Homo sapiens
agtgagggcctcagagcctgacct

SEQ ID NO: 1096193 - DNA, 13 bp, Homo sapiens
agtgagggctggg

SEQ ID NO: 1096194 - DNA, 18 bp, Homo sapiens
agtgaggggttacctccc

SEQ ID NO: 1096195 - DNA, 19 bp, Homo sapiens
agtgaggttcttgtaccac

SEQ ID NO: 1096196 - DNA, 21 bp, Homo sapiens
agtgagtcacctgctccagaa

SEQ ID NO: 1096197 - DNA, 15 bp, Homo sapiens
agtgagtcagcacct

SEQ ID NO: 1096198 - DNA, 22 bp, Homo sapiens
agtgagtcgagattgcactgct

SEQ ID NO: 1096199 - DNA, 16 bp, Homo sapiens
agtgagtctcttcaga

SEQ ID NO: 1096200 - DNA, 16 bp, Homo sapiens
agtgagtctggtggag

SEQ ID NO: 1096201 - DNA, 15 bp, Homo sapiens
agtgagtctgtcagc

SEQ ID NO: 1096202 - DNA, 18 bp, Homo sapiens
agtgagtgccatgctttt

SEQ ID NO: 1096203 - DNA, 15 bp, Homo sapiens
agtgagtgtaaataa

SEQ ID NO: 1096204 - DNA, 13 bp, Homo sapiens
agtgagtgtatgt

SEQ ID NO: 1096205 - DNA, 21 bp, Homo sapiens
agtgagtgtggctcccctcta

SEQ ID NO: 1096206 - DNA, 17 bp, Homo sapiens
agtgagtttgtaaatat

SEQ ID NO: 1096207 - DNA, 19 bp, Homo sapiens
agtgagtttgtaaatattc

SEQ ID NO: 1096208 - DNA, 23 bp, Homo sapiens
agtgatacaacttcaagtgcatg

SEQ ID NO: 1096209 - DNA, 14 bp, Homo sapiens
agtgataggcccaa

SEQ ID NO: 1096210 - DNA, 20 bp, Homo sapiens
agtgatagtcttttgctttt

SEQ ID NO: 1096211 - DNA, 12 bp, Homo sapiens
agtgatcactgg

SEQ ID NO: 1096212 - DNA, 21 bp, Homo sapiens
agtgatcatttaaaaagctca

SEQ ID NO: 1096213 - DNA, 16 bp, Homo sapiens
agtgatccttacaagt

SEQ ID NO: 1096214 - DNA, 20 bp, Homo sapiens
agtgatccttccacctcagt

SEQ ID NO: 1096215 - DNA, 23 bp, Homo sapiens
agtgatccttccacctcagtctc

SEQ ID NO: 1096216 - DNA, 15 bp, Homo sapiens
agtgatctatgtttg

SEQ ID NO: 1096217 - DNA, 21 bp, Homo sapiens
agtgatctatgtttgtgtgat

SEQ ID NO: 1096218 - DNA, 17 bp, Homo sapiens
agtgatctcagggcaga

SEQ ID NO: 1096219 - DNA, 17 bp, Homo sapiens
agtgatgatttggggga

SEQ ID NO: 1096220 - DNA, 22 bp, Homo sapiens
agtgatgatttgggggaggctt

SEQ ID NO: 1096221 - DNA, 18 bp, Homo sapiens
agtgatgccgggcgccag

SEQ ID NO: 1096222 - DNA, 21 bp, Homo sapiens
agtgatgctgtgctatgaatt

SEQ ID NO: 1096223 - DNA, 21 bp, Homo sapiens
agtgatggcgcgggaggcacc

SEQ ID NO: 1096224 - DNA, 22 bp, Homo sapiens
agtgattaaatatatctagaac

SEQ ID NO: 1096225 - DNA, 14 bp, Homo sapiens
agtgattactgtca

SEQ ID NO: 1096226 - DNA, 16 bp, Homo sapiens
agtgattatctctttg

SEQ ID NO: 1096227 - DNA, 19 bp, Homo sapiens
agtgattctcctgcctcag

SEQ ID NO: 1096228 - DNA, 14 bp, Homo sapiens
agtgattctgattt

SEQ ID NO: 1096229 - DNA, 17 bp, Homo sapiens
agtgattctgatttcag

SEQ ID NO: 1096230 - DNA, 19 bp, Homo sapiens
agtgattctgatttcagtt

SEQ ID NO: 1096231 - DNA, 21 bp, Homo sapiens
agtggtggttttctgttcttt

SEQ ID NO: 1096232 - DNA, 20 bp, Homo sapiens
agtggtgtgatctcggctca

SEQ ID NO: 1096233 - DNA, 17 bp, Homo sapiens
agtggttattcattatt

SEQ ID NO: 1096234 - DNA, 23 bp, Homo sapiens
agtggttattcattattcctcag

SEQ ID NO: 1096235 - DNA, 14 bp, Homo sapiens
agtggttgttgcca

SEQ ID NO: 1096236 - DNA, 17 bp, Homo sapiens
agtggtttcggaaaaaa

SEQ ID NO: 1096237 - DNA, 23 bp, Homo sapiens
agtggtttcggaaaaaaaaaaag

SEQ ID NO: 1096238 - DNA, 17 bp, Homo sapiens
agtggtttgcaggtcag

SEQ ID NO: 1096239 - DNA, 23 bp, Homo sapiens
agtggttttatactgaaggaaaa

SEQ ID NO: 1096240 - DNA, 14 bp, Homo sapiens
agtgtaaaaaatgt

SEQ ID NO: 1096241 - DNA, 20 bp, Homo sapiens
agtgtaaataattttaaata

SEQ ID NO: 1096242 - DNA, 22 bp, Homo sapiens
agtgtaaataattttaaataac

SEQ ID NO: 1096243 - DNA, 22 bp, Homo sapiens
agtgtaacaattgtgtagcctt

SEQ ID NO: 1096244 - DNA, 13 bp, Homo sapiens
agtgtaacagctg

SEQ ID NO: 1096245 - DNA, 14 bp, Homo sapiens
agtgtaacagctga

SEQ ID NO: 1096246 - DNA, 15 bp, Homo sapiens
agtgtaacagctgag

SEQ ID NO: 1096247 - DNA, 12 bp, Homo sapiens
agtgtaactttc

SEQ ID NO: 1096248 - DNA, 15 bp, Homo sapiens
agtgtaagaactgta

SEQ ID NO: 1096249 - DNA, 16 bp, Homo sapiens
agtgtaagaactgtac

SEQ ID NO: 1096250 - DNA, 18 bp, Homo sapiens
agtgtaagaactgtacat

SEQ ID NO: 1096251 - DNA, 23 bp, Homo sapiens
agtgtaagaactgtacattgtga

SEQ ID NO: 1096252 - DNA, 20 bp, Homo sapiens
agtgtaatataattgtgtaa

SEQ ID NO: 1096253 - DNA, 18 bp, Homo sapiens
agtgtacaattgatcttt

SEQ ID NO: 1096254 - DNA, 21 bp, Homo sapiens
agtgtacacgtctggaccccg

SEQ ID NO: 1096255 - DNA, 16 bp, Homo sapiens
agtgtacagtcttgta

SEQ ID NO: 1096256 - DNA, 13 bp, Homo sapiens
agtgtacatcatg

SEQ ID NO: 1096257 - DNA, 14 bp, Homo sapiens
agtgtacatcatgt

SEQ ID NO: 1096258 - DNA, 22 bp, Homo sapiens
agtgtacatttatgttccttta

SEQ ID NO: 1096259 - DNA, 16 bp, Homo sapiens
agtgtaccatttgcct

SEQ ID NO: 1096260 - DNA, 15 bp, Homo sapiens
agtgtacctcctctc

SEQ ID NO: 1096261 - DNA, 22 bp, Homo sapiens
agtgtacctcctctcagtgttt

SEQ ID NO: 1096262 - DNA, 13 bp, Homo sapiens
agtgtactgtgcc

SEQ ID NO: 1096263 - DNA, 15 bp, Homo sapiens
agtgtagattttata

SEQ ID NO: 1096264 - DNA, 19 bp, Homo sapiens
agtgtagcatcctaaagat

SEQ ID NO: 1096265 - DNA, 23 bp, Homo sapiens
agtgtagcctaaagggcagggcc

SEQ ID NO: 1096266 - DNA, 19 bp, Homo sapiens
agtgtagctgtaagggcag

SEQ ID NO: 1096267 - DNA, 17 bp, Homo sapiens
agtgtagctgtgaaatc

SEQ ID NO: 1096268 - DNA, 20 bp, Homo sapiens
agtgtaggcagacacaggga

SEQ ID NO: 1096269 - DNA, 22 bp, Homo sapiens
agtgtaggcagacacagggact

SEQ ID NO: 1096270 - DNA, 22 bp, Homo sapiens
agtgtagggcaagggtgcctca

SEQ ID NO: 1096271 - DNA, 23 bp, Homo sapiens
agtgtagggcaagggtgcctcag

SEQ ID NO: 1096272 - DNA, 22 bp, Homo sapiens
agtgtataaatccaatatcatg

SEQ ID NO: 1096273 - DNA, 16 bp, Homo sapiens
agtgtataccacctgt

SEQ ID NO: 1096274 - DNA, 22 bp, Homo sapiens
agtgtataccacctgtacatac

SEQ ID NO: 1096275 - DNA, 22 bp, Homo sapiens
agtgtatatatatttatatata

SEQ ID NO: 1096276 - DNA, 16 bp, Homo sapiens
agtgtatatttattca

SEQ ID NO: 1096277 - DNA, 21 bp, Homo sapiens
agtgtatatttattcataatg

SEQ ID NO: 1096278 - DNA, 21 bp, Homo sapiens
agtgtatgagtgtgagtgtgt

SEQ ID NO: 1096279 - DNA, 22 bp, Homo sapiens
agtgtatgagttgcatttgtaa

SEQ ID NO: 1096280 - DNA, 14 bp, Homo sapiens
agtgtatgattact

SEQ ID NO: 1096281 - DNA, 20 bp, Homo sapiens
agtgtatggcgttggtttgt

SEQ ID NO: 1096282 - DNA, 16 bp, Homo sapiens
agtgtatggggcagct

SEQ ID NO: 1096283 - DNA, 15 bp, Homo sapiens
agtgtatgtgtgtgt

SEQ ID NO: 1096284 - DNA, 23 bp, Homo sapiens
agtgtatttggaaataaagtcag

SEQ ID NO: 1096285 - DNA, 14 bp, Homo sapiens
agtgtatttgtatt

SEQ ID NO: 1096286 - DNA, 16 bp, Homo sapiens
agtgtattttgaaatt

SEQ ID NO: 1096287 - DNA, 17 bp, Homo sapiens
agtgtcaagttgtgctt

SEQ ID NO: 1096288 - DNA, 19 bp, Homo sapiens
agtgtcaagttgtgcttgt

SEQ ID NO: 1096289 - DNA, 20 bp, Homo sapiens
agtgtcaagttgtgcttgtt

SEQ ID NO: 1096290 - DNA, 21 bp, Homo sapiens
agtgtcacttacctagattta

SEQ ID NO: 1096291 - DNA, 15 bp, Homo sapiens
agtgtcattgccgat

SEQ ID NO: 1096292 - DNA, 22 bp, Homo sapiens
agtgtccagcttccaaagccta

SEQ ID NO: 1096293 - DNA, 14 bp, Homo sapiens
agtgtcccaggcag

SEQ ID NO: 1096294 - DNA, 15 bp, Homo sapiens
agtgtccccccttga

SEQ ID NO: 1096295 - DNA, 17 bp, Homo sapiens
agtgtccccccttgaag

SEQ ID NO: 1096296 - DNA, 14 bp, Homo sapiens
agtgtcccctccac

SEQ ID NO: 1096297 - DNA, 19 bp, Homo sapiens
agtgtcccctccactgtca

SEQ ID NO: 1096298 - DNA, 21 bp, Homo sapiens
agtgtcccctccactgtcaca

SEQ ID NO: 1096299 - DNA, 16 bp, Homo sapiens
agtgtccgagaactaa

SEQ ID NO: 1096300 - DNA, 12 bp, Homo sapiens
agtgtcctgccc

SEQ ID NO: 1096301 - DNA, 21 bp, Homo sapiens
agtgtcctgtgctttctgcat

SEQ ID NO: 1096302 - DNA, 17 bp, Homo sapiens
agtgtcggatcctgtga

SEQ ID NO: 1096303 - DNA, 19 bp, Homo sapiens
agtgtcggatcctgtgagt

SEQ ID NO: 1096304 - DNA, 14 bp, Homo sapiens
agtgtctaaaaaca

SEQ ID NO: 1096305 - DNA, 20 bp, Homo sapiens
agtgtctataaaagaaacac

SEQ ID NO: 1096306 - DNA, 16 bp, Homo sapiens
agtgtctattatcaca

SEQ ID NO: 1096307 - DNA, 17 bp, Homo sapiens
agtgtctggaattgtgg

SEQ ID NO: 1096308 - DNA, 20 bp, Homo sapiens
agtgtctggatcagtaaaat

SEQ ID NO: 1096309 - DNA, 23 bp, Homo sapiens
agtgtctggcccgcaatactgta

SEQ ID NO: 1096310 - DNA, 15 bp, Homo sapiens
agtgtctgtgccatg

SEQ ID NO: 1096311 - DNA, 19 bp, Homo sapiens
agtgtctgtgccatggatt

SEQ ID NO: 1096312 - DNA, 15 bp, Homo sapiens
agtgtcttctgttcc

SEQ ID NO: 1096313 - DNA, 16 bp, Homo sapiens
agtgtctttctagcca

SEQ ID NO: 1096314 - DNA, 19 bp, Homo sapiens
agtgtctttctagccataa

SEQ ID NO: 1096315 - DNA, 15 bp, Homo sapiens
agtgtcttttaaaca

SEQ ID NO: 1096316 - DNA, 15 bp, Homo sapiens
agtgtcttttgacat

SEQ ID NO: 1096317 - DNA, 13 bp, Homo sapiens
agtgtgaacaaaa

SEQ ID NO: 1096318 - DNA, 22 bp, Homo sapiens
agtgtgaacaaaagatgctctt

SEQ ID NO: 1096319 - DNA, 14 bp, Homo sapiens
agtgtgaatataaa

SEQ ID NO: 1096320 - DNA, 11 bp, Homo sapiens
agtgtgacagg

SEQ ID NO: 1096321 - DNA, 15 bp, Homo sapiens
agtgtgacagggcca

SEQ ID NO: 1096322 - DNA, 17 bp, Homo sapiens
agtgtgaccaaaagtta

SEQ ID NO: 1096323 - DNA, 19 bp, Homo sapiens
agtgtgaccaaaagttaca

SEQ ID NO: 1096324 - DNA, 22 bp, Homo sapiens
agtgtgaccaaaagttacatgt

SEQ ID NO: 1096325 - DNA, 18 bp, Homo sapiens
agtgtgacctcctgtgac

SEQ ID NO: 1096326 - DNA, 12 bp, Homo sapiens
agtgtgagtaag

SEQ ID NO: 1096327 - DNA, 16 bp, Homo sapiens
agtgtgagtaagagct

SEQ ID NO: 1096328 - DNA, 17 bp, Homo sapiens
agtgtgagtcagaatgt

SEQ ID NO: 1096329 - DNA, 14 bp, Homo sapiens
agtgtgagtggcag

SEQ ID NO: 1096330 - DNA, 17 bp, Homo sapiens
agtgtgagtggcagcca

SEQ ID NO: 1096331 - DNA, 15 bp, Homo sapiens
agtgtgagtgtgaga

SEQ ID NO: 1096332 - DNA, 17 bp, Homo sapiens
agtgtgcaactggccag

SEQ ID NO: 1096333 - DNA, 17 bp, Homo sapiens
agtgtgcagacagccat

SEQ ID NO: 1096334 - DNA, 16 bp, Homo sapiens
agtgtgcagactgatg

SEQ ID NO: 1096335 - DNA, 18 bp, Homo sapiens
agtgtgcatggaggccct

SEQ ID NO: 1096336 - DNA, 20 bp, Homo sapiens
agtgtgcccaaaagccatgt

SEQ ID NO: 1096337 - DNA, 19 bp, Homo sapiens
agtgtgctgtatggcccag

SEQ ID NO: 1096338 - DNA, 22 bp, Homo sapiens
agtgtgctgtatggcccaggca

SEQ ID NO: 1096339 - DNA, 17 bp, Homo sapiens
agtgtggagtgggtaat

SEQ ID NO: 1096340 - DNA, 23 bp, Homo sapiens
agtgtggagttcaccttggaagg

SEQ ID NO: 1096341 - DNA, 13 bp, Homo sapiens
agtgtggccaggc

SEQ ID NO: 1096342 - DNA, 11 bp, Homo sapiens
agtgtggcctg

SEQ ID NO: 1096343 - DNA, 20 bp, Homo sapiens
agtgtggcctgtgccagcac

SEQ ID NO: 1096344 - DNA, 22 bp, Homo sapiens
agtgtggcctgtgccagcacca

SEQ ID NO: 1096345 - DNA, 16 bp, Homo sapiens
agtgtggctcccctct

SEQ ID NO: 1096346 - DNA, 15 bp, Homo sapiens
agtgtggctggtgtc

SEQ ID NO: 1096347 - DNA, 16 bp, Homo sapiens
agtgtggctggtgtcc

SEQ ID NO: 1096348 - DNA, 20 bp, Homo sapiens
agtgtgggagtgcagagaaa

SEQ ID NO: 1096349 - DNA, 19 bp, Homo sapiens
agtgtggggataaagacag

SEQ ID NO: 1096350 - DNA, 23 bp, Homo sapiens
agtgtggtgtttcctgcaggcca

SEQ ID NO: 1096351 - DNA, 13 bp, Homo sapiens
agtgtgtaaataa

SEQ ID NO: 1096352 - DNA, 14 bp, Homo sapiens
agttgccaccacct

SEQ ID NO: 1096353 - DNA, 19 bp, Homo sapiens
agttgccaccacctctgtg

SEQ ID NO: 1096354 - DNA, 22 bp, Homo sapiens
agttgccaccacctctgtggca

SEQ ID NO: 1096355 - DNA, 23 bp, Homo sapiens
agttgcccgaaactaagccaggc

SEQ ID NO: 1096356 - DNA, 13 bp, Homo sapiens
agttgccttttat

SEQ ID NO: 1096357 - DNA, 22 bp, Homo sapiens
agttgcgacggagagaaaaaag

SEQ ID NO: 1096358 - DNA, 19 bp, Homo sapiens
agttgcgtttaagttgtat

SEQ ID NO: 1096359 - DNA, 15 bp, Homo sapiens
agttgctcaaaaaga

SEQ ID NO: 1096360 - DNA, 12 bp, Homo sapiens
agttgctgagag

SEQ ID NO: 1096361 - DNA, 16 bp, Homo sapiens
agttgctgcaaacctg

SEQ ID NO: 1096362 - DNA, 18 bp, Homo sapiens
agttgctgggattacagg

SEQ ID NO: 1096363 - DNA, 16 bp, Homo sapiens
agttgctgtgaacttt

SEQ ID NO: 1096364 - DNA, 16 bp, Homo sapiens
agttgctgtgtgtctg

SEQ ID NO: 1096365 - DNA, 13 bp, Homo sapiens
agttgctgtttat

SEQ ID NO: 1096366 - DNA, 18 bp, Homo sapiens
agttgcttcttcagctga

SEQ ID NO: 1096367 - DNA, 22 bp, Homo sapiens
agttgctttaaagtacctgtag

SEQ ID NO: 1096368 - DNA, 18 bp, Homo sapiens
agttgctttgccagagca

SEQ ID NO: 1096369 - DNA, 16 bp, Homo sapiens
agttgctttgcccaag

SEQ ID NO: 1096370 - DNA, 10 bp, Homo sapiens
agttggaagg

SEQ ID NO: 1096371 - DNA, 18 bp, Homo sapiens
agttggaaggatctgctg

SEQ ID NO: 1096372 - DNA, 19 bp, Homo sapiens
agttggaaggatctgctga

SEQ ID NO: 1096373 - DNA, 21 bp, Homo sapiens
agttggaatgactgaaagaag

SEQ ID NO: 1096374 - DNA, 17 bp, Homo sapiens
agttggacagtttaaag

SEQ ID NO: 1096375 - DNA, 16 bp, Homo sapiens
agttggactctcaggg

SEQ ID NO: 1096376 - DNA, 13 bp, Homo sapiens
agttggactgggt

SEQ ID NO: 1096377 - DNA, 17 bp, Homo sapiens
agttggactgggttgcg

SEQ ID NO: 1096378 - DNA, 16 bp, Homo sapiens
agttggacttgagaaa

SEQ ID NO: 1096379 - DNA, 19 bp, Homo sapiens
agttggacttgagaaagat

SEQ ID NO: 1096380 - DNA, 18 bp, Homo sapiens
agttggagtactatattt

SEQ ID NO: 1096381 - DNA, 18 bp, Homo sapiens
agttggagttttattttt

SEQ ID NO: 1096382 - DNA, 20 bp, Homo sapiens
agttggagttttatttttaa

SEQ ID NO: 1096383 - DNA, 15 bp, Homo sapiens
agttggcatgaaagt

SEQ ID NO: 1096384 - DNA, 15 bp, Homo sapiens
agttggccaagcaga

SEQ ID NO: 1096385 - DNA, 16 bp, Homo sapiens
agttggccagagagcc

SEQ ID NO: 1096386 - DNA, 21 bp, Homo sapiens
agttggccagattgtggggtg

SEQ ID NO: 1096387 - DNA, 23 bp, Homo sapiens
agttggccagattgtggggtgca

SEQ ID NO: 1096388 - DNA, 15 bp, Homo sapiens
agttggccaggctct

SEQ ID NO: 1096389 - DNA, 16 bp, Homo sapiens
agttggctcaggcaga

SEQ ID NO: 1096390 - DNA, 11 bp, Homo sapiens
agttggctgga

SEQ ID NO: 1096391 - DNA, 19 bp, Homo sapiens
agttggctttgcccacccc

SEQ ID NO: 1096392 - DNA, 23 bp, Homo sapiens
agttggctttgcccacccctcac

SEQ ID NO: 1096393 - DNA, 15 bp, Homo sapiens
agttgggactcagga

SEQ ID NO: 1096394 - DNA, 21 bp, Homo sapiens
agttgggatgccaatttcctc

SEQ ID NO: 1096395 - DNA, 18 bp, Homo sapiens
agttggggaaggcaagat

SEQ ID NO: 1096396 - DNA, 13 bp, Homo sapiens
agttggggccctc

SEQ ID NO: 1096397 - DNA, 21 bp, Homo sapiens
agttggggccctcttgccagc

SEQ ID NO: 1096398 - DNA, 18 bp, Homo sapiens
agttgggtagaaaaatta

SEQ ID NO: 1096399 - DNA, 20 bp, Homo sapiens
agttggtaacttttgtgaat

SEQ ID NO: 1096400 - DNA, 19 bp, Homo sapiens
agttggtattaataaaaag

SEQ ID NO: 1096401 - DNA, 21 bp, Homo sapiens
agttggtgtaatcattttaaa

SEQ ID NO: 1096402 - DNA, 19 bp, Homo sapiens
agttggtttgtatgagatg

SEQ ID NO: 1096403 - DNA, 16 bp, Homo sapiens
agttggtttgtgtgat

SEQ ID NO: 1096404 - DNA, 22 bp, Homo sapiens
agttgtaaaaatgaaagtgact

SEQ ID NO: 1096405 - DNA, 16 bp, Homo sapiens
agttgtaaaatagaaa

SEQ ID NO: 1096406 - DNA, 21 bp, Homo sapiens
agttgtaaaatagaaaaagtg

SEQ ID NO: 1096407 - DNA, 18 bp, Homo sapiens
agttgtaaataatttatt

SEQ ID NO: 1096408 - DNA, 17 bp, Homo sapiens
agttgtaaataattttc

SEQ ID NO: 1096409 - DNA, 20 bp, Homo sapiens
agttgtaaataattttctaa

SEQ ID NO: 1096410 - DNA, 13 bp, Homo sapiens
agttgtaaatata

SEQ ID NO: 1096411 - DNA, 15 bp, Homo sapiens
agttgtaaatatata

SEQ ID NO: 1096412 - DNA, 16 bp, Homo sapiens
agttgtaaatatataa

SEQ ID NO: 1096413 - DNA, 17 bp, Homo sapiens
agttgtaacttatattg

SEQ ID NO: 1096414 - DNA, 16 bp, Homo sapiens
agttgtaataaatcta

SEQ ID NO: 1096415 - DNA, 14 bp, Homo sapiens
agttgtaccaaaac

SEQ ID NO: 1096416 - DNA, 16 bp, Homo sapiens
agttgtaccaaaacat

SEQ ID NO: 1096417 - DNA, 14 bp, Homo sapiens
agttgtactgcttt

SEQ ID NO: 1096418 - DNA, 18 bp, Homo sapiens
agttgtagacaaagtaca

SEQ ID NO: 1096419 - DNA, 16 bp, Homo sapiens
agttgtagcagattgt

SEQ ID NO: 1096420 - DNA, 17 bp, Homo sapiens
agttgtatgtttgctga

SEQ ID NO: 1096421 - DNA, 18 bp, Homo sapiens
agttgtattcttctgtat

SEQ ID NO: 1096422 - DNA, 19 bp, Homo sapiens
agttgtattcttctgtatt

SEQ ID NO: 1096423 - DNA, 16 bp, Homo sapiens
agttgtcctgatttct

SEQ ID NO: 1096424 - DNA, 22 bp, Homo sapiens
agttgtctctgatgcagcttat

SEQ ID NO: 1096425 - DNA, 19 bp, Homo sapiens
agttgtctgtccaggccct

SEQ ID NO: 1096426 - DNA, 20 bp, Homo sapiens
agttgtctgtccaggccctt

SEQ ID NO: 1096427 - DNA, 17 bp, Homo sapiens
agttgtctgtctgaatg

SEQ ID NO: 1096428 - DNA, 14 bp, Homo sapiens
agttgtgatataaa

SEQ ID NO: 1096429 - DNA, 18 bp, Homo sapiens
agttgtgcatgtatgtat

SEQ ID NO: 1096430 - DNA, 15 bp, Homo sapiens
agttgtgccttttat

SEQ ID NO: 1096431 - DNA, 21 bp, Homo sapiens
agttgtgccttttatagctat

SEQ ID NO: 1096432 - DNA, 14 bp, Homo sapiens
agttgtgcttgagc

SEQ ID NO: 1096433 - DNA, 19 bp, Homo sapiens
agttgtgcttgtttacagc

SEQ ID NO: 1096434 - DNA, 16 bp, Homo sapiens
agttgtgcttttctgt

SEQ ID NO: 1096435 - DNA, 18 bp, Homo sapiens
agttgtggaaagcctctg

SEQ ID NO: 1096436 - DNA, 18 bp, Homo sapiens
agttgtggatatcagggt

SEQ ID NO: 1096437 - DNA, 17 bp, Homo sapiens
agttgtgtcataaatta

SEQ ID NO: 1096438 - DNA, 16 bp, Homo sapiens
agttgtgtgtatgtgt

SEQ ID NO: 1096439 - DNA, 14 bp, Homo sapiens
agttgtgtttcaac

SEQ ID NO: 1096440 - DNA, 23 bp, Homo sapiens
agttgtgtttcaacggaaagtgc

SEQ ID NO: 1096441 - DNA, 20 bp, Homo sapiens
agttgttacatttttaagtg

SEQ ID NO: 1096442 - DNA, 18 bp, Homo sapiens
agttgttactaactaaac

SEQ ID NO: 1096443 - DNA, 17 bp, Homo sapiens
agttgttattgttgaac

SEQ ID NO: 1096444 - DNA, 15 bp, Homo sapiens
agttgttgactgtga

SEQ ID NO: 1096445 - DNA, 16 bp, Homo sapiens
agttgttgtaacctgc

SEQ ID NO: 1096446 - DNA, 14 bp, Homo sapiens
agttgttgtttgcc

SEQ ID NO: 1096447 - DNA, 22 bp, Homo sapiens
agttgtttatgtatcagctctc

SEQ ID NO: 1096448 - DNA, 13 bp, Homo sapiens
agttgtttctcta

SEQ ID NO: 1096449 - DNA, 20 bp, Homo sapiens
agttgtttctgacccactga

SEQ ID NO: 1096450 - DNA, 14 bp, Homo sapiens
agttgtttgcttct

SEQ ID NO: 1096451 - DNA, 17 bp, Homo sapiens
agttgtttgtttttgct

SEQ ID NO: 1096452 - DNA, 15 bp, Homo sapiens
agtttaaaaaaattg

SEQ ID NO: 1096453 - DNA, 14 bp, Homo sapiens
agtttaaaagcatg

SEQ ID NO: 1096454 - DNA, 20 bp, Homo sapiens
agtttaaaagcatgaaacat

SEQ ID NO: 1096455 - DNA, 15 bp, Homo sapiens
agtttaaaagccatg

SEQ ID NO: 1096456 - DNA, 23 bp, Homo sapiens
agtttaaaatgtgtatttttcaa

SEQ ID NO: 1096457 - DNA, 13 bp, Homo sapiens
agtttaaattcta

SEQ ID NO: 1096458 - DNA, 14 bp, Homo sapiens
agtttaaattctag

SEQ ID NO: 1096459 - DNA, 12 bp, Homo sapiens
agtttaacacaa

SEQ ID NO: 1096460 - DNA, 17 bp, Homo sapiens
agtttaagaccagcctg

SEQ ID NO: 1096461 - DNA, 21 bp, Homo sapiens
agtttaagggtggaaaaatgc

SEQ ID NO: 1096462 - DNA, 18 bp, Homo sapiens
agtttaattgacttattt

SEQ ID NO: 1096463 - DNA, 15 bp, Homo sapiens
agtttacaacttgat

SEQ ID NO: 1096464 - DNA, 16 bp, Homo sapiens
agtttacaagtgtata

SEQ ID NO: 1096465 - DNA, 18 bp, Homo sapiens
agtttacagaaaaatctt

SEQ ID NO: 1096466 - DNA, 15 bp, Homo sapiens
agtttacagtttgtg

SEQ ID NO: 1096467 - DNA, 20 bp, Homo sapiens
agtttacattgtcctgtagc

SEQ ID NO: 1096468 - DNA, 17 bp, Homo sapiens
agtttacccatgaagat

SEQ ID NO: 1096469 - DNA, 21 bp, Homo sapiens
agtttacctcatccatgcact

SEQ ID NO: 1096470 - DNA, 14 bp, Homo sapiens
agtttaccttgtat

SEQ ID NO: 1096471 - DNA, 17 bp, Homo sapiens
agtttagaacagaggga

SEQ ID NO: 1096472 - DNA, 22 bp, Homo sapiens
agtttagccctgaacatttcat

SEQ ID NO: 1096473 - DNA, 16 bp, Homo sapiens
agtttaggaaaatgag

SEQ ID NO: 1096474 - DNA, 12 bp, Homo sapiens
ataaaacaagcc

SEQ ID NO: 1096475 - DNA, 14 bp, Homo sapiens
ataaaacaagcctt

SEQ ID NO: 1096476 - DNA, 21 bp, Homo sapiens
ataaaacaatgacttttaaag

SEQ ID NO: 1096477 - DNA, 18 bp, Homo sapiens
ataaaacccaatactttt

SEQ ID NO: 1096478 - DNA, 17 bp, Homo sapiens
ataaaacctgggtgtca

SEQ ID NO: 1096479 - DNA, 13 bp, Homo sapiens
ataaaacctttca

SEQ ID NO: 1096480 - DNA, 14 bp, Homo sapiens
ataaaacctttcaa

SEQ ID NO: 1096481 - DNA, 22 bp, Homo sapiens
ataaaacctttcaaatttcaca

SEQ ID NO: 1096482 - DNA, 16 bp, Homo sapiens
ataaaactaaatatat

SEQ ID NO: 1096483 - DNA, 17 bp, Homo sapiens
ataaaactaaatatatg

SEQ ID NO: 1096484 - DNA, 18 bp, Homo sapiens
ataaaactaaatatatgt

SEQ ID NO: 1096485 - DNA, 20 bp, Homo sapiens
ataaaactaaggcttttatt

SEQ ID NO: 1096486 - DNA, 11 bp, Homo sapiens
ataaaactatt

SEQ ID NO: 1096487 - DNA, 19 bp, Homo sapiens
ataaaactatttattgtgc

SEQ ID NO: 1096488 - DNA, 20 bp, Homo sapiens
ataaaactatttattgtgct

SEQ ID NO: 1096489 - DNA, 17 bp, Homo sapiens
ataaaactcagttaaaa

SEQ ID NO: 1096490 - DNA, 18 bp, Homo sapiens
ataaaactcagttaaaat

SEQ ID NO: 1096491 - DNA, 15 bp, Homo sapiens
ataaaactgaaataa

SEQ ID NO: 1096492 - DNA, 14 bp, Homo sapiens
ataaaactgaatct

SEQ ID NO: 1096493 - DNA, 20 bp, Homo sapiens
ataaaactgcgaggacatca

SEQ ID NO: 1096494 - DNA, 14 bp, Homo sapiens
ataaaactgtgact

SEQ ID NO: 1096495 - DNA, 21 bp, Homo sapiens
ataaaactgtgactaggcata

SEQ ID NO: 1096496 - DNA, 12 bp, Homo sapiens
ataaaactgtgt

SEQ ID NO: 1096497 - DNA, 13 bp, Homo sapiens
ataaaactgtgta

SEQ ID NO: 1096498 - DNA, 14 bp, Homo sapiens
ataaaacttatgct

SEQ ID NO: 1096499 - DNA, 16 bp, Homo sapiens
ataaaactttaaaagg

SEQ ID NO: 1096500 - DNA, 18 bp, Homo sapiens
ataaaactttaaaaggca

SEQ ID NO: 1096501 - DNA, 19 bp, Homo sapiens
ataaaactttatgtactgc

SEQ ID NO: 1096502 - DNA, 11 bp, Homo sapiens
ataaaactttt

SEQ ID NO: 1096503 - DNA, 15 bp, Homo sapiens
ataaaactttttaaa

SEQ ID NO: 1096504 - DNA, 17 bp, Homo sapiens
ataaaactttttaaaat

SEQ ID NO: 1096505 - DNA, 15 bp, Homo sapiens
ataaaagaaaaaata

SEQ ID NO: 1096506 - DNA, 17 bp, Homo sapiens
ataaaagaacatgcttg

SEQ ID NO: 1096507 - DNA, 17 bp, Homo sapiens
ataaaagagctgtctga

SEQ ID NO: 1096508 - DNA, 21 bp, Homo sapiens
ataaaagagctgtctgactgc

SEQ ID NO: 1096509 - DNA, 16 bp, Homo sapiens
ataaaagcagcatctg

SEQ ID NO: 1096510 - DNA, 13 bp, Homo sapiens
ataaaagccttgg

SEQ ID NO: 1096511 - DNA, 13 bp, Homo sapiens
ataaaagctataa

SEQ ID NO: 1096512 - DNA, 18 bp, Homo sapiens
ataaaagctcagatgaca

SEQ ID NO: 1096513 - DNA, 22 bp, Homo sapiens
ataaaagctcagatgacatttc

SEQ ID NO: 1096514 - DNA, 15 bp, Homo sapiens
ataaaaggaagccaa

SEQ ID NO: 1096515 - DNA, 19 bp, Homo sapiens
ataaaaggaagccaaagag

SEQ ID NO: 1096516 - DNA, 21 bp, Homo sapiens
ataaaaggtggagtttctctg

SEQ ID NO: 1096517 - DNA, 15 bp, Homo sapiens
ataaaagtacatgtt

SEQ ID NO: 1096518 - DNA, 21 bp, Homo sapiens
ataaaagtacatgttaaactt

SEQ ID NO: 1096519 - DNA, 15 bp, Homo sapiens
ataaaagtgaagtga

SEQ ID NO: 1096520 - DNA, 16 bp, Homo sapiens
ataaaagtgcacacct

SEQ ID NO: 1096521 - DNA, 23 bp, Homo sapiens
ataaaagttcctctcccttccct

SEQ ID NO: 1096522 - DNA, 12 bp, Homo sapiens
ataaaataaact

SEQ ID NO: 1096523 - DNA, 14 bp, Homo sapiens
ataaaataaatata

SEQ ID NO: 1096524 - DNA, 18 bp, Homo sapiens
ataaaataactaaaatgt

SEQ ID NO: 1096525 - DNA, 19 bp, Homo sapiens
ataaaataactaaaatgta

SEQ ID NO: 1096526 - DNA, 15 bp, Homo sapiens
ataaaataagaaggg

SEQ ID NO: 1096527 - DNA, 23 bp, Homo sapiens
ataaaataagaagggggagtgaa

SEQ ID NO: 1096528 - DNA, 16 bp, Homo sapiens
ataaaatactaaacta

SEQ ID NO: 1096529 - DNA, 19 bp, Homo sapiens
ataaaatactttttatcac

SEQ ID NO: 1096530 - DNA, 15 bp, Homo sapiens
ataaaatagaataat

SEQ ID NO: 1096531 - DNA, 17 bp, Homo sapiens
ataaaatatatcttata

SEQ ID NO: 1096532 - DNA, 17 bp, Homo sapiens
ataaaatatcataaagc

SEQ ID NO: 1096533 - DNA, 20 bp, Homo sapiens
ataaaatatcataaagcatt

SEQ ID NO: 1096534 - DNA, 22 bp, Homo sapiens
ataaaatattttgttaactttt

SEQ ID NO: 1096535 - DNA, 16 bp, Homo sapiens
ataaaatccaaaatga

SEQ ID NO: 1096536 - DNA, 11 bp, Homo sapiens
ataaaatctgt

SEQ ID NO: 1096537 - DNA, 19 bp, Homo sapiens
ataaaatgaaaattgtatt

SEQ ID NO: 1096538 - DNA, 19 bp, Homo sapiens
ataaaatgaggacatgttt

SEQ ID NO: 1096539 - DNA, 17 bp, Homo sapiens
ataaaatgatcctgcca

SEQ ID NO: 1096540 - DNA, 18 bp, Homo sapiens
ataaaatgatttgtggaa

SEQ ID NO: 1096541 - DNA, 12 bp, Homo sapiens
ataaaatgcaaa

SEQ ID NO: 1096542 - DNA, 18 bp, Homo sapiens
ataaaatgcccatttcga

SEQ ID NO: 1096543 - DNA, 21 bp, Homo sapiens
ataaaatggacacaaattttc

SEQ ID NO: 1096544 - DNA, 17 bp, Homo sapiens
ataaaatggcaccttcc

SEQ ID NO: 1096545 - DNA, 19 bp, Homo sapiens
ataaaatgtattcaagcaa

SEQ ID NO: 1096546 - DNA, 14 bp, Homo sapiens
ataaaatgtcttct

SEQ ID NO: 1096547 - DNA, 11 bp, Homo sapiens
ataaaatgtgc

SEQ ID NO: 1096548 - DNA, 20 bp, Homo sapiens
ataaaatgtgtacagtgaat

SEQ ID NO: 1096549 - DNA, 16 bp, Homo sapiens
ataaaattaaatgcct

SEQ ID NO: 1096550 - DNA, 16 bp, Homo sapiens
ataaaattcctatctc

SEQ ID NO: 1096551 - DNA, 13 bp, Homo sapiens
ataaaattcgctt

SEQ ID NO: 1096552 - DNA, 22 bp, Homo sapiens
ataaaattctattacagtatgt

SEQ ID NO: 1096553 - DNA, 20 bp, Homo sapiens
ataaaattgcagtttcatgt

SEQ ID NO: 1096554 - DNA, 22 bp, Homo sapiens
ataaaattgcagtttcatgtat

SEQ ID NO: 1096555 - DNA, 19 bp, Homo sapiens
ataaaattgtgatgttttg

SEQ ID NO: 1096556 - DNA, 13 bp, Homo sapiens
ataaaatttaatt

SEQ ID NO: 1096557 - DNA, 14 bp, Homo sapiens
ataaaattttgctt

SEQ ID NO: 1096558 - DNA, 16 bp, Homo sapiens
ataaacaacttaatgt

SEQ ID NO: 1096559 - DNA, 19 bp, Homo sapiens
ataaacaataaaaacaact

SEQ ID NO: 1096560 - DNA, 22 bp, Homo sapiens
ataaacacaaaatccattccag

SEQ ID NO: 1096561 - DNA, 23 bp, Homo sapiens
ataaacacagctgctttcttctt

SEQ ID NO: 1096562 - DNA, 20 bp, Homo sapiens
ataaacacatagattcacct

SEQ ID NO: 1096563 - DNA, 16 bp, Homo sapiens
ataaacacattgaatg

SEQ ID NO: 1096564 - DNA, 22 bp, Homo sapiens
ataaacactccacagtgtttat

SEQ ID NO: 1096565 - DNA, 17 bp, Homo sapiens
ataaacaggaattttat

SEQ ID NO: 1096566 - DNA, 18 bp, Homo sapiens
ataaacaggaattttatt

SEQ ID NO: 1096567 - DNA, 20 bp, Homo sapiens
ataaacaggaattttatttt

SEQ ID NO: 1096568 - DNA, 13 bp, Homo sapiens
ataaacagttgtt

SEQ ID NO: 1096569 - DNA, 16 bp, Homo sapiens
ataaacatcagtttct

SEQ ID NO: 1096570 - DNA, 15 bp, Homo sapiens
ataaacatgaccctg

SEQ ID NO: 1096571 - DNA, 22 bp, Homo sapiens
ataaacatgtcacaatacagta

SEQ ID NO: 1096572 - DNA, 15 bp, Homo sapiens
ataaacattaaacac

SEQ ID NO: 1096573 - DNA, 23 bp, Homo sapiens
ataaacattaagattgaggcctg

SEQ ID NO: 1096574 - DNA, 21 bp, Homo sapiens
ataaacattaattttgtgcat

SEQ ID NO: 1096575 - DNA, 23 bp, Homo sapiens
ataaacattaattttgtgcattc

SEQ ID NO: 1096576 - DNA, 20 bp, Homo sapiens
ataaaccaccctctggggac

SEQ ID NO: 1096577 - DNA, 14 bp, Homo sapiens
ataaaccattggac

SEQ ID NO: 1096578 - DNA, 18 bp, Homo sapiens
ataaaccgtgtatttatt

SEQ ID NO: 1096579 - DNA, 20 bp, Homo sapiens
ataaaccgtttttaacacat

SEQ ID NO: 1096580 - DNA, 17 bp, Homo sapiens
ataaacctaaaaaagat

SEQ ID NO: 1096581 - DNA, 22 bp, Homo sapiens
ataaacctaaaaaagatatatt

SEQ ID NO: 1096582 - DNA, 17 bp, Homo sapiens
ataaacctgcactgaaa

SEQ ID NO: 1096583 - DNA, 19 bp, Homo sapiens
ataaacctgcactgaaacc

SEQ ID NO: 1096584 - DNA, 16 bp, Homo sapiens
ataaacctggagatat

SEQ ID NO: 1096585 - DNA, 14 bp, Homo sapiens
ataaaccttcagaa

SEQ ID NO: 1096586 - DNA, 14 bp, Homo sapiens
ataaaccttgaaca

SEQ ID NO: 1096587 - DNA, 20 bp, Homo sapiens
ataaacgtgatgatcagctg

SEQ ID NO: 1096588 - DNA, 15 bp, Homo sapiens
ataaactaataattg

SEQ ID NO: 1096589 - DNA, 12 bp, Homo sapiens
ataaactataaa

SEQ ID NO: 1096590 - DNA, 16 bp, Homo sapiens
ataaactataaactta

SEQ ID NO: 1096591 - DNA, 17 bp, Homo sapiens
ataaactataaacttaa

SEQ ID NO: 1096592 - DNA, 17 bp, Homo sapiens
ataaactcataaaactc

SEQ ID NO: 1096593 - DNA, 14 bp, Homo sapiens
ataaactcatttat

SEQ ID NO: 1096594 - DNA, 23 bp, Homo sapiens
ataaactcctactaaatccctcc

SEQ ID NO: 1096595 - DNA, 20 bp, Homo sapiens
ataaactccttaacttcagg

SEQ ID NO: 1096596 - DNA, 16 bp, Homo sapiens
ataacttcttaaaagt

SEQ ID NO: 1096597 - DNA, 16 bp, Homo sapiens
ataacttcttgaaaaa

SEQ ID NO: 1096598 - DNA, 21 bp, Homo sapiens
ataacttgagacctaatctct

SEQ ID NO: 1096599 - DNA, 19 bp, Homo sapiens
ataacttgctgaatttcag

SEQ ID NO: 1096600 - DNA, 22 bp, Homo sapiens
ataacttgctgaatttcaggca

SEQ ID NO: 1096601 - DNA, 17 bp, Homo sapiens
ataacttggggaggcaa

SEQ ID NO: 1096602 - DNA, 18 bp, Homo sapiens
ataacttggggaggcaag

SEQ ID NO: 1096603 - DNA, 17 bp, Homo sapiens
ataactttattgcatat

SEQ ID NO: 1096604 - DNA, 20 bp, Homo sapiens
ataactttgtctcgttcctg

SEQ ID NO: 1096605 - DNA, 18 bp, Homo sapiens
ataacttttacacgacca

SEQ ID NO: 1096606 - DNA, 14 bp, Homo sapiens
ataacttttgatga

SEQ ID NO: 1096607 - DNA, 20 bp, Homo sapiens
ataactttttttgagaagga

SEQ ID NO: 1096608 - DNA, 23 bp, Homo sapiens
ataactttttttgagaaggaaat

SEQ ID NO: 1096609 - DNA, 18 bp, Homo sapiens
ataacttttttttaagtt

SEQ ID NO: 1096610 - DNA, 22 bp, Homo sapiens
ataagaaaaaattctttcactt

SEQ ID NO: 1096611 - DNA, 15 bp, Homo sapiens
ataagaaaaactttt

SEQ ID NO: 1096612 - DNA, 15 bp, Homo sapiens
ataagaaaaatcatg

SEQ ID NO: 1096613 - DNA, 12 bp, Homo sapiens
ataagaaaagat

SEQ ID NO: 1096614 - DNA, 13 bp, Homo sapiens
ataagaaaagtaa

SEQ ID NO: 1096615 - DNA, 13 bp, Homo sapiens
ataagaaactttt

SEQ ID NO: 1096616 - DNA, 22 bp, Homo sapiens
ataagaaacttttttatttaaa

SEQ ID NO: 1096617 - DNA, 15 bp, Homo sapiens
ataagaaagtttcac

SEQ ID NO: 1096618 - DNA, 11 bp, Homo sapiens
ataagaaatga

SEQ ID NO: 1096619 - DNA, 13 bp, Homo sapiens
ataagaaatgaac

SEQ ID NO: 1096620 - DNA, 20 bp, Homo sapiens
ataagaaatgaacaaaagat

SEQ ID NO: 1096621 - DNA, 13 bp, Homo sapiens
ataagaagaatgc

SEQ ID NO: 1096622 - DNA, 20 bp, Homo sapiens
ataagaagaatgcttaatca

SEQ ID NO: 1096623 - DNA, 18 bp, Homo sapiens
ataagaataaaatgttga

SEQ ID NO: 1096624 - DNA, 19 bp, Homo sapiens
ataagaatgctggttttcc

SEQ ID NO: 1096625 - DNA, 16 bp, Homo sapiens
ataagaattgtctctg

SEQ ID NO: 1096626 - DNA, 18 bp, Homo sapiens
ataagaattgtctctggg

SEQ ID NO: 1096627 - DNA, 13 bp, Homo sapiens
ataagaatttgca

SEQ ID NO: 1096628 - DNA, 14 bp, Homo sapiens
ataagaatttgcat

SEQ ID NO: 1096629 - DNA, 15 bp, Homo sapiens
ataagaatttgcata

SEQ ID NO: 1096630 - DNA, 17 bp, Homo sapiens
ataagaatttgcatact

SEQ ID NO: 1096631 - DNA, 19 bp, Homo sapiens
ataagacatgcttactttt

SEQ ID NO: 1096632 - DNA, 20 bp, Homo sapiens
ataagaccgtgtcccaagga

SEQ ID NO: 1096633 - DNA, 16 bp, Homo sapiens
ataagactataaataa

SEQ ID NO: 1096634 - DNA, 19 bp, Homo sapiens
ataagagaagtctcattcg

SEQ ID NO: 1096635 - DNA, 16 bp, Homo sapiens
ataagagacagacact

SEQ ID NO: 1096636 - DNA, 19 bp, Homo sapiens
ataagagagccttggttca

SEQ ID NO: 1096637 - DNA, 22 bp, Homo sapiens
ataagaggtgtgggtgtctgtt

SEQ ID NO: 1096638 - DNA, 22 bp, Homo sapiens
ataagagttgctttgccagagc

SEQ ID NO: 1096639 - DNA, 16 bp, Homo sapiens
ataagatgacaatgtt

SEQ ID NO: 1096640 - DNA, 16 bp, Homo sapiens
ataagatttttgaaaa

SEQ ID NO: 1096641 - DNA, 16 bp, Homo sapiens
ataagcaagagagatg

SEQ ID NO: 1096642 - DNA, 16 bp, Homo sapiens
ataagcacaccaagtt

SEQ ID NO: 1096643 - DNA, 20 bp, Homo sapiens
ataagcactgaaaaacaaca

SEQ ID NO: 1096644 - DNA, 22 bp, Homo sapiens
ataagcacttgcctggaataaa

SEQ ID NO: 1096645 - DNA, 16 bp, Homo sapiens
ataagcaggtggatct

SEQ ID NO: 1096646 - DNA, 17 bp, Homo sapiens
ataagcataaaagatca

SEQ ID NO: 1096647 - DNA, 21 bp, Homo sapiens
ataagcctccatttagttctt

SEQ ID NO: 1096648 - DNA, 13 bp, Homo sapiens
ataagctaagcct

SEQ ID NO: 1096649 - DNA, 16 bp, Homo sapiens
ataagctactagcaaa

SEQ ID NO: 1096650 - DNA, 22 bp, Homo sapiens
ataagctactagcaaaataaaa

SEQ ID NO: 1096651 - DNA, 16 bp, Homo sapiens
ataagctgaataaagt

SEQ ID NO: 1096652 - DNA, 17 bp, Homo sapiens
ataagctggactagtgt

SEQ ID NO: 1096653 - DNA, 12 bp, Homo sapiens
ataaggaaattt

SEQ ID NO: 1096654 - DNA, 13 bp, Homo sapiens
ataaggaagttat

SEQ ID NO: 1096655 - DNA, 16 bp, Homo sapiens
ataaggactttttgat

SEQ ID NO: 1096656 - DNA, 13 bp, Homo sapiens
ataaggagaatgt

SEQ ID NO: 1096657 - DNA, 20 bp, Homo sapiens
ataaggatcagaacagcaga

SEQ ID NO: 1096658 - DNA, 14 bp, Homo sapiens
ataaggatgacttt

SEQ ID NO: 1096659 - DNA, 15 bp, Homo sapiens
ataaggatgactttt

SEQ ID NO: 1096660 - DNA, 19 bp, Homo sapiens
ataaggccataaaacaggt

SEQ ID NO: 1096661 - DNA, 15 bp, Homo sapiens
ataaggcctgccctc

SEQ ID NO: 1096662 - DNA, 17 bp, Homo sapiens
ataaggcctgccctccc

SEQ ID NO: 1096663 - DNA, 13 bp, Homo sapiens
ataagggaaaaga

SEQ ID NO: 1096664 - DNA, 15 bp, Homo sapiens
ataagggaaaagata

SEQ ID NO: 1096665 - DNA, 16 bp, Homo sapiens
ataagggaaaagataa

SEQ ID NO: 1096666 - DNA, 12 bp, Homo sapiens
ataagggagagc

SEQ ID NO: 1096667 - DNA, 19 bp, Homo sapiens
ataagggagagctgagcca

SEQ ID NO: 1096668 - DNA, 20 bp, Homo sapiens
ataagggagagctgagccag

SEQ ID NO: 1096669 - DNA, 18 bp, Homo sapiens
ataagggccctgccctgt

SEQ ID NO: 1096670 - DNA, 21 bp, Homo sapiens
ataaggggccttgctctgagc

SEQ ID NO: 1096671 - DNA, 22 bp, Homo sapiens
ataaggggccttgctctgagca

SEQ ID NO: 1096672 - DNA, 17 bp, Homo sapiens
ataaggtgctctctttc

SEQ ID NO: 1096673 - DNA, 20 bp, Homo sapiens
ataaggtgctctctttctgt

SEQ ID NO: 1096674 - DNA, 20 bp, Homo sapiens
ataaggtttcgtttctgtat

SEQ ID NO: 1096675 - DNA, 12 bp, Homo sapiens
ataagtaagaaa

SEQ ID NO: 1096676 - DNA, 17 bp, Homo sapiens
ataagtaagaaaatatt

SEQ ID NO: 1096677 - DNA, 14 bp, Homo sapiens
ataagtaagaaatt

SEQ ID NO: 1096678 - DNA, 16 bp, Homo sapiens
ataagtactgtgtaca

SEQ ID NO: 1096679 - DNA, 13 bp, Homo sapiens
ataagtagtaaat

SEQ ID NO: 1096680 - DNA, 13 bp, Homo sapiens
ataagtagttggt

SEQ ID NO: 1096681 - DNA, 20 bp, Homo sapiens
ataagtagttggtttgtatg

SEQ ID NO: 1096682 - DNA, 15 bp, Homo sapiens
ataagtcaacagtaa

SEQ ID NO: 1096683 - DNA, 17 bp, Homo sapiens
ataagtcaacagtaaac

SEQ ID NO: 1096684 - DNA, 14 bp, Homo sapiens
ataagtcattgaaa

SEQ ID NO: 1096685 - DNA, 11 bp, Homo sapiens
ataagtctgat

SEQ ID NO: 1096686 - DNA, 14 bp, Homo sapiens
ataagtctgattta

SEQ ID NO: 1096687 - DNA, 14 bp, Homo sapiens
ataagtctgttatt

SEQ ID NO: 1096688 - DNA, 16 bp, Homo sapiens
ataagtgaaaatctta

SEQ ID NO: 1096689 - DNA, 15 bp, Homo sapiens
ataagtgaagtgata

SEQ ID NO: 1096690 - DNA, 20 bp, Homo sapiens
ataagtgacaccaataaatg

SEQ ID NO: 1096691 - DNA, 17 bp, Homo sapiens
ataagtgcagggaggaa

SEQ ID NO: 1096692 - DNA, 15 bp, Homo sapiens
ataagtgtaaataga

SEQ ID NO: 1096693 - DNA, 20 bp, Homo sapiens
ataagtgtacatatgtgctg

SEQ ID NO: 1096694 - DNA, 14 bp, Homo sapiens
ataagtgtattttt

SEQ ID NO: 1096695 - DNA, 21 bp, Homo sapiens
ataagtgtgtggtcccaagtt

SEQ ID NO: 1096696 - DNA, 19 bp, Homo sapiens
ataagttaaaacaaaggaa

SEQ ID NO: 1096697 - DNA, 15 bp, Homo sapiens
ataagttaaaggcag

SEQ ID NO: 1096698 - DNA, 17 bp, Homo sapiens
ataagttaaaggcagtc

SEQ ID NO: 1096699 - DNA, 21 bp, Homo sapiens
ataagttattgcagtttatca

SEQ ID NO: 1096700 - DNA, 21 bp, Homo sapiens
ataagttcaaattcttctgaa

SEQ ID NO: 1096701 - DNA, 24 bp, Homo sapiens
ataagttgctgtaaaatttgtgta

SEQ ID NO: 1096702 - DNA, 13 bp, Homo sapiens
ataagttgtacca

SEQ ID NO: 1096703 - DNA, 17 bp, Homo sapiens
ataagttgtaccaaaac

SEQ ID NO: 1096704 - DNA, 20 bp, Homo sapiens
ataagtttaactttaaaact

SEQ ID NO: 1096705 - DNA, 22 bp, Homo sapiens
ataagtttaactttaaaactgt

SEQ ID NO: 1096706 - DNA, 20 bp, Homo sapiens
ataagtttacacctttatct

SEQ ID NO: 1096707 - DNA, 20 bp, Homo sapiens
ataagtttgtgttagaaaag

SEQ ID NO: 1096708 - DNA, 12 bp, Homo sapiens
ataagttttaga

SEQ ID NO: 1096709 - DNA, 15 bp, Homo sapiens
ataagttttgatata

SEQ ID NO: 1096710 - DNA, 16 bp, Homo sapiens
ataagttttgatataa

SEQ ID NO: 1096711 - DNA, 20 bp, Homo sapiens
ataataaaaggaaaagcaaa

SEQ ID NO: 1096712 - DNA, 13 bp, Homo sapiens
ataataaaatcac

SEQ ID NO: 1096713 - DNA, 19 bp, Homo sapiens
ataataaaatgcaaatgaa

SEQ ID NO: 1096714 - DNA, 20 bp, Homo sapiens
ataataaaatgcaaatgaat

SEQ ID NO: 1096715 - DNA, 23 bp, Homo sapiens
ataataaagaatagctttaatga

SEQ ID NO: 1096716 - DNA, 16 bp, Homo sapiens
ataataaagctactga

SEQ ID NO: 1096717 - DNA, 13 bp, Homo sapiens
ataataaaggact

SEQ ID NO: 1096718 - DNA, 17 bp, Homo sapiens
ataccagacctcttcta

SEQ ID NO: 1096719 - DNA, 18 bp, Homo sapiens
ataccagatgaacatttc

SEQ ID NO: 1096720 - DNA, 22 bp, Homo sapiens
ataccagcccctgtatggcact

SEQ ID NO: 1096721 - DNA, 12 bp, Homo sapiens
ataccagcctac

SEQ ID NO: 1096722 - DNA, 14 bp, Homo sapiens
ataccagctcaggg

SEQ ID NO: 1096723 - DNA, 14 bp, Homo sapiens
ataccaggttgaaa

SEQ ID NO: 1096724 - DNA, 15 bp, Homo sapiens
ataccatgtctctaa

SEQ ID NO: 1096725 - DNA, 17 bp, Homo sapiens
ataccattaaaactgct

SEQ ID NO: 1096726 - DNA, 18 bp, Homo sapiens
ataccattaaaactgctt

SEQ ID NO: 1096727 - DNA, 17 bp, Homo sapiens
ataccatttcctcagct

SEQ ID NO: 1096728 - DNA, 20 bp, Homo sapiens
ataccattttttaaggaaac

SEQ ID NO: 1096729 - DNA, 22 bp, Homo sapiens
atacccaaattttaatattcca

SEQ ID NO: 1096730 - DNA, 17 bp, Homo sapiens
atacccaacagtttatt

SEQ ID NO: 1096731 - DNA, 22 bp, Homo sapiens
atacccaacagtttatttttat

SEQ ID NO: 1096732 - DNA, 23 bp, Homo sapiens
atacccacacattccagggctgg

SEQ ID NO: 1096733 - DNA, 15 bp, Homo sapiens
ataccccaaattgtg

SEQ ID NO: 1096734 - DNA, 16 bp, Homo sapiens
atacccccaggaaact

SEQ ID NO: 1096735 - DNA, 22 bp, Homo sapiens
atacccccctacttaatgtaat

SEQ ID NO: 1096736 - DNA, 13 bp, Homo sapiens
atacccccctctg

SEQ ID NO: 1096737 - DNA, 19 bp, Homo sapiens
ataccccctgcaaagccca

SEQ ID NO: 1096738 - DNA, 21 bp, Homo sapiens
ataccccctgcaaagcccagc

SEQ ID NO: 1096739 - DNA, 17 bp, Homo sapiens
ataccccttaaccccgg

SEQ ID NO: 1096740 - DNA, 16 bp, Homo sapiens
ataccccttattgctg

SEQ ID NO: 1096741 - DNA, 19 bp, Homo sapiens
ataccccttattgctgcca

SEQ ID NO: 1096742 - DNA, 13 bp, Homo sapiens
ataccctactgtg

SEQ ID NO: 1096743 - DNA, 16 bp, Homo sapiens
ataccctactgtgggg

SEQ ID NO: 1096744 - DNA, 11 bp, Homo sapiens
ataccctagaa

SEQ ID NO: 1096745 - DNA, 18 bp, Homo sapiens
ataccctagaagaaaacc

SEQ ID NO: 1096746 - DNA, 20 bp, Homo sapiens
ataccctagaagaaaacccg

SEQ ID NO: 1096747 - DNA, 21 bp, Homo sapiens
ataccgaccatcgtccagccc

SEQ ID NO: 1096748 - DNA, 22 bp, Homo sapiens
ataccgaccatcgtccagccct

SEQ ID NO: 1096749 - DNA, 16 bp, Homo sapiens
ataccgcctcgtgcca

SEQ ID NO: 1096750 - DNA, 19 bp, Homo sapiens
ataccgcctcgtgccagca

SEQ ID NO: 1096751 - DNA, 16 bp, Homo sapiens
ataccgctcagtattt

SEQ ID NO: 1096752 - DNA, 15 bp, Homo sapiens
atacctaattgtgga

SEQ ID NO: 1096753 - DNA, 15 bp, Homo sapiens
atacctccaaccctg

SEQ ID NO: 1096754 - DNA, 15 bp, Homo sapiens
atacctctgctggga

SEQ ID NO: 1096755 - DNA, 18 bp, Homo sapiens
atacctcttactttgctt

SEQ ID NO: 1096756 - DNA, 22 bp, Homo sapiens
atacctgattgatcacacagtg

SEQ ID NO: 1096757 - DNA, 21 bp, Homo sapiens
ataccttatttatttttgtgt

SEQ ID NO: 1096758 - DNA, 20 bp, Homo sapiens
ataccttccttccctgggct

SEQ ID NO: 1096759 - DNA, 22 bp, Homo sapiens
ataccttctatgtattagtgtc

SEQ ID NO: 1096760 - DNA, 14 bp, Homo sapiens
ataccttgcttatt

SEQ ID NO: 1096761 - DNA, 13 bp, Homo sapiens
atacctttccagg

SEQ ID NO: 1096762 - DNA, 19 bp, Homo sapiens
ataccttttctcacaaaaa

SEQ ID NO: 1096763 - DNA, 13 bp, Homo sapiens
atacgaaaagcca

SEQ ID NO: 1096764 - DNA, 15 bp, Homo sapiens
atacgaaataattgt

SEQ ID NO: 1096765 - DNA, 21 bp, Homo sapiens
atacgaaataattgttgttct

SEQ ID NO: 1096766 - DNA, 16 bp, Homo sapiens
atacgagagcagaggt

SEQ ID NO: 1096767 - DNA, 13 bp, Homo sapiens
atacgataaataa

SEQ ID NO: 1096768 - DNA, 17 bp, Homo sapiens
atacgcatcccatctct

SEQ ID NO: 1096769 - DNA, 19 bp, Homo sapiens
atacgctactataaagaga

SEQ ID NO: 1096770 - DNA, 15 bp, Homo sapiens
atacgcttttctttg

SEQ ID NO: 1096771 - DNA, 24 bp, Homo sapiens
atacgcttttctttgttataccat

SEQ ID NO: 1096772 - DNA, 23 bp, Homo sapiens
atacgggagtgacccagctactg

SEQ ID NO: 1096773 - DNA, 20 bp, Homo sapiens
atacgggggctgtgactctg

SEQ ID NO: 1096774 - DNA, 22 bp, Homo sapiens
atacggtcaggtttaacatttg

SEQ ID NO: 1096775 - DNA, 16 bp, Homo sapiens
atacgtacacatttta

SEQ ID NO: 1096776 - DNA, 16 bp, Homo sapiens
atacgtataaatatca

SEQ ID NO: 1096777 - DNA, 15 bp, Homo sapiens
atacgtgcacagggt

SEQ ID NO: 1096778 - DNA, 17 bp, Homo sapiens
atacgtgccagatataa

SEQ ID NO: 1096779 - DNA, 18 bp, Homo sapiens
atacgtgtcaatgtgtgc

SEQ ID NO: 1096780 - DNA, 16 bp, Homo sapiens
atacgttttgtgtata

SEQ ID NO: 1096781 - DNA, 17 bp, Homo sapiens
atacgttttgtgtatat

SEQ ID NO: 1096782 - DNA, 13 bp, Homo sapiens
atactaaccagca

SEQ ID NO: 1096783 - DNA, 21 bp, Homo sapiens
atactaagaccctaattcttt

SEQ ID NO: 1096784 - DNA, 20 bp, Homo sapiens
atactaagatgttcactgtg

SEQ ID NO: 1096785 - DNA, 22 bp, Homo sapiens
atactaataaactaataattgc

SEQ ID NO: 1096786 - DNA, 13 bp, Homo sapiens
atactaatgatga

SEQ ID NO: 1096787 - DNA, 24 bp, Homo sapiens
atactaatttttgcttaacattag

SEQ ID NO: 1096788 - DNA, 15 bp, Homo sapiens
atactacaacttttg

SEQ ID NO: 1096789 - DNA, 12 bp, Homo sapiens
atactacatctt

SEQ ID NO: 1096790 - DNA, 16 bp, Homo sapiens
atactacatctttaaa

SEQ ID NO: 1096791 - DNA, 16 bp, Homo sapiens
atactacctataggaa

SEQ ID NO: 1096792 - DNA, 15 bp, Homo sapiens
atactaccttgaaaa

SEQ ID NO: 1096793 - DNA, 19 bp, Homo sapiens
atactactgaaacagattt

SEQ ID NO: 1096794 - DNA, 21 bp, Homo sapiens
atactactgaaacagatttca

SEQ ID NO: 1096795 - DNA, 16 bp, Homo sapiens
atactagggagccatt

SEQ ID NO: 1096796 - DNA, 14 bp, Homo sapiens
atactatagtacca

SEQ ID NO: 1096797 - DNA, 17 bp, Homo sapiens
atactatgaaataaaaa

SEQ ID NO: 1096798 - DNA, 22 bp, Homo sapiens
atactatttaaagcctcctcat

SEQ ID NO: 1096799 - DNA, 17 bp, Homo sapiens
atactcaaatggtgtca

SEQ ID NO: 1096800 - DNA, 12 bp, Homo sapiens
atactcaagttt

SEQ ID NO: 1096801 - DNA, 17 bp, Homo sapiens
atactcaagtttcaggt

SEQ ID NO: 1096802 - DNA, 14 bp, Homo sapiens
atactcagaactgt

SEQ ID NO: 1096803 - DNA, 18 bp, Homo sapiens
atactcagaactgtccca

SEQ ID NO: 1096804 - DNA, 24 bp, Homo sapiens
atactcagaactgtcccatcccca

SEQ ID NO: 1096805 - DNA, 12 bp, Homo sapiens
atactcagcctg

SEQ ID NO: 1096806 - DNA, 13 bp, Homo sapiens
atactcagcctgc

SEQ ID NO: 1096807 - DNA, 17 bp, Homo sapiens
atactcagcctgctgcc

SEQ ID NO: 1096808 - DNA, 20 bp, Homo sapiens
atactcagcctgctgcccag

SEQ ID NO: 1096809 - DNA, 17 bp, Homo sapiens
atactcatcagagcagc

SEQ ID NO: 1096810 - DNA, 19 bp, Homo sapiens
atactcatcagagcagcta

SEQ ID NO: 1096811 - DNA, 13 bp, Homo sapiens
atactcatgaatg

SEQ ID NO: 1096812 - DNA, 15 bp, Homo sapiens
atactcatgaatgaa

SEQ ID NO: 1096813 - DNA, 13 bp, Homo sapiens
atactcattagaa

SEQ ID NO: 1096814 - DNA, 17 bp, Homo sapiens
atactcatttttcatga

SEQ ID NO: 1096815 - DNA, 13 bp, Homo sapiens
atactccagcacc

SEQ ID NO: 1096816 - DNA, 15 bp, Homo sapiens
atactccatacataa

SEQ ID NO: 1096817 - DNA, 17 bp, Homo sapiens
atactccctttaaagag

SEQ ID NO: 1096818 - DNA, 22 bp, Homo sapiens
atactcctcccctcttctcttt

SEQ ID NO: 1096819 - DNA, 13 bp, Homo sapiens
atactcctgtcac

SEQ ID NO: 1096820 - DNA, 22 bp, Homo sapiens
atactcctgtcacctagaacgt

SEQ ID NO: 1096821 - DNA, 17 bp, Homo sapiens
atactctagaacatgca

SEQ ID NO: 1096822 - DNA, 23 bp, Homo sapiens
atactctagatgaagttttacat

SEQ ID NO: 1096823 - DNA, 21 bp, Homo sapiens
atactctgtagtctcagttcg

SEQ ID NO: 1096824 - DNA, 14 bp, Homo sapiens
atactctgtcagat

SEQ ID NO: 1096825 - DNA, 16 bp, Homo sapiens
atactctgtcagatgg

SEQ ID NO: 1096826 - DNA, 16 bp, Homo sapiens
atactctgttgtacta

SEQ ID NO: 1096827 - DNA, 19 bp, Homo sapiens
atactcttaggaagagaaa

SEQ ID NO: 1096828 - DNA, 22 bp, Homo sapiens
atactcttaggaagagaaacca

SEQ ID NO: 1096829 - DNA, 13 bp, Homo sapiens
atactcttcccac

SEQ ID NO: 1096830 - DNA, 14 bp, Homo sapiens
atactcttgaaatg

SEQ ID NO: 1096831 - DNA, 16 bp, Homo sapiens
atactcttgaaatgta

SEQ ID NO: 1096832 - DNA, 16 bp, Homo sapiens
atactctttctgtata

SEQ ID NO: 1096833 - DNA, 17 bp, Homo sapiens
atactctttctgtatat

SEQ ID NO: 1096834 - DNA, 23 bp, Homo sapiens
atactctttctgtatatactttt

SEQ ID NO: 1096835 - DNA, 17 bp, Homo sapiens
atactgaaagatctctg

SEQ ID NO: 1096836 - DNA, 22 bp, Homo sapiens
atactgaacatctgagtcctgg

SEQ ID NO: 1096837 - DNA, 23 bp, Homo sapiens
atactgaacatctgagtcctgga

SEQ ID NO: 1096838 - DNA, 14 bp, Homo sapiens
atactgaaggaaaa

SEQ ID NO: 1096839 - DNA, 20 bp, Homo sapiens
atactgaaggaaaaacacaa

SEQ ID NO: 1096840 - DNA, 14 bp, Homo sapiens
atataataaagtat

SEQ ID NO: 1096841 - DNA, 17 bp, Homo sapiens
atataataaagtattcc

SEQ ID NO: 1096842 - DNA, 20 bp, Homo sapiens
atataataaagtattccacc

SEQ ID NO: 1096843 - DNA, 20 bp, Homo sapiens
atataatatatttgtgtatt

SEQ ID NO: 1096844 - DNA, 23 bp, Homo sapiens
atataatattcagccagcttaaa

SEQ ID NO: 1096845 - DNA, 16 bp, Homo sapiens
atataatcatgctcat

SEQ ID NO: 1096846 - DNA, 19 bp, Homo sapiens
atataatcttggcttctta

SEQ ID NO: 1096847 - DNA, 21 bp, Homo sapiens
atataatcttggcttcttaaa

SEQ ID NO: 1096848 - DNA, 17 bp, Homo sapiens
atataatctttcaaacc

SEQ ID NO: 1096849 - DNA, 19 bp, Homo sapiens
atataatgaataaatcatt

SEQ ID NO: 1096850 - DNA, 13 bp, Homo sapiens
atataatgtattt

SEQ ID NO: 1096851 - DNA, 20 bp, Homo sapiens
atataatgttgataatatat

SEQ ID NO: 1096852 - DNA, 22 bp, Homo sapiens
atataatgttgttatttaaaga

SEQ ID NO: 1096853 - DNA, 21 bp, Homo sapiens
atataattatcggaagcagtg

SEQ ID NO: 1096854 - DNA, 22 bp, Homo sapiens
atataattgtaccaacctcata

SEQ ID NO: 1096855 - DNA, 13 bp, Homo sapiens
atataattgtgaa

SEQ ID NO: 1096856 - DNA, 18 bp, Homo sapiens
atataatttactttgtag

SEQ ID NO: 1096857 - DNA, 21 bp, Homo sapiens
atataatttactttgtagact

SEQ ID NO: 1096858 - DNA, 18 bp, Homo sapiens
atataatttcctcactgc

SEQ ID NO: 1096859 - DNA, 18 bp, Homo sapiens
atataatttgagtgtata

SEQ ID NO: 1096860 - DNA, 13 bp, Homo sapiens
atataattttatg

SEQ ID NO: 1096861 - DNA, 19 bp, Homo sapiens
atataattttcacttctgt

SEQ ID NO: 1096862 - DNA, 11 bp, Homo sapiens
atataattttt

SEQ ID NO: 1096863 - DNA, 20 bp, Homo sapiens
atataattttttagagagct

SEQ ID NO: 1096864 - DNA, 15 bp, Homo sapiens
atatacaaaaagaaa

SEQ ID NO: 1096865 - DNA, 18 bp, Homo sapiens
atatacaactgtaaagca

SEQ ID NO: 1096866 - DNA, 14 bp, Homo sapiens
atatacaattatat

SEQ ID NO: 1096867 - DNA, 14 bp, Homo sapiens
atatacacatacat

SEQ ID NO: 1096868 - DNA, 17 bp, Homo sapiens
atatacacatacataca

SEQ ID NO: 1096869 - DNA, 22 bp, Homo sapiens
atatacacatacatacacatac

SEQ ID NO: 1096870 - DNA, 13 bp, Homo sapiens
atatacacgaata

SEQ ID NO: 1096871 - DNA, 13 bp, Homo sapiens
atatacatatata

SEQ ID NO: 1096872 - DNA, 23 bp, Homo sapiens
atatacatatatatatacacata

SEQ ID NO: 1096873 - DNA, 21 bp, Homo sapiens
atatacatgtttttctattaa

SEQ ID NO: 1096874 - DNA, 14 bp, Homo sapiens
atatacattgtgtg

SEQ ID NO: 1096875 - DNA, 11 bp, Homo sapiens
atatacatttc

SEQ ID NO: 1096876 - DNA, 22 bp, Homo sapiens
atatacatttcataaggcctgc

SEQ ID NO: 1096877 - DNA, 16 bp, Homo sapiens
atataccaaattaaaa

SEQ ID NO: 1096878 - DNA, 14 bp, Homo sapiens
atataccatttatc

SEQ ID NO: 1096879 - DNA, 22 bp, Homo sapiens
atatacctggcttttactttat

SEQ ID NO: 1096880 - DNA, 16 bp, Homo sapiens
atatacgaaaagccag

SEQ ID NO: 1096881 - DNA, 20 bp, Homo sapiens
atatacgtgaaaattatttg

SEQ ID NO: 1096882 - DNA, 12 bp, Homo sapiens
atatactataat

SEQ ID NO: 1096883 - DNA, 14 bp, Homo sapiens
atatactcaagttt

SEQ ID NO: 1096884 - DNA, 17 bp, Homo sapiens
atatacttaagaataca

SEQ ID NO: 1096885 - DNA, 16 bp, Homo sapiens
atatagagatgcattc

SEQ ID NO: 1096886 - DNA, 17 bp, Homo sapiens
atatagagatgcattca

SEQ ID NO: 1096887 - DNA, 13 bp, Homo sapiens
atatagagatgtt

SEQ ID NO: 1096888 - DNA, 14 bp, Homo sapiens
atatagcaaaatga

SEQ ID NO: 1096889 - DNA, 17 bp, Homo sapiens
atatagcattgataatc

SEQ ID NO: 1096890 - DNA, 18 bp, Homo sapiens
atatagctgatcagtttt

SEQ ID NO: 1096891 - DNA, 14 bp, Homo sapiens
atatagctgtacaa

SEQ ID NO: 1096892 - DNA, 15 bp, Homo sapiens
atatagctgtacaaa

SEQ ID NO: 1096893 - DNA, 18 bp, Homo sapiens
atatagctgtacaaatat

SEQ ID NO: 1096894 - DNA, 20 bp, Homo sapiens
atataggaaaacaataattt

SEQ ID NO: 1096895 - DNA, 20 bp, Homo sapiens
atataggaaactaagcattg

SEQ ID NO: 1096896 - DNA, 23 bp, Homo sapiens
atatagggtgtggctcctaccag

SEQ ID NO: 1096897 - DNA, 20 bp, Homo sapiens
atatagggttttttttaatg

SEQ ID NO: 1096898 - DNA, 18 bp, Homo sapiens
atataggtgatgtttgct

SEQ ID NO: 1096899 - DNA, 22 bp, Homo sapiens
atataggttgtgcaaattaaca

SEQ ID NO: 1096900 - DNA, 16 bp, Homo sapiens
atatagtatatttata

SEQ ID NO: 1096901 - DNA, 18 bp, Homo sapiens
atatagtatatttatact

SEQ ID NO: 1096902 - DNA, 18 bp, Homo sapiens
atatagtgaaaaatgtca

SEQ ID NO: 1096903 - DNA, 13 bp, Homo sapiens
atatagtgctgtt

SEQ ID NO: 1096904 - DNA, 23 bp, Homo sapiens
atatagtggatgatatacacagt

SEQ ID NO: 1096905 - DNA, 18 bp, Homo sapiens
atatagttccttgcctta

SEQ ID NO: 1096906 - DNA, 22 bp, Homo sapiens
atatagttccttgccttaataa

SEQ ID NO: 1096907 - DNA, 18 bp, Homo sapiens
atatagttgaggccgagg

SEQ ID NO: 1096908 - DNA, 12 bp, Homo sapiens
atatagttttac

SEQ ID NO: 1096909 - DNA, 17 bp, Homo sapiens
atatagtttttaccttt

SEQ ID NO: 1096910 - DNA, 19 bp, Homo sapiens
atatataaaaagaaaagat

SEQ ID NO: 1096911 - DNA, 21 bp, Homo sapiens
atatataaaacggtgctgtga

SEQ ID NO: 1096912 - DNA, 20 bp, Homo sapiens
atatataaaataaatatata

SEQ ID NO: 1096913 - DNA, 14 bp, Homo sapiens
atatataaacactc

SEQ ID NO: 1096914 - DNA, 22 bp, Homo sapiens
atatataaacactccacagtgt

SEQ ID NO: 1096915 - DNA, 22 bp, Homo sapiens
atatataaacagaactcccttc

SEQ ID NO: 1096916 - DNA, 16 bp, Homo sapiens
atatataatatgtata

SEQ ID NO: 1096917 - DNA, 19 bp, Homo sapiens
atatataatttgagtgtat

SEQ ID NO: 1096918 - DNA, 21 bp, Homo sapiens
atatataatttgagtgtatat

SEQ ID NO: 1096919 - DNA, 17 bp, Homo sapiens
atatatacacatacata

SEQ ID NO: 1096920 - DNA, 23 bp, Homo sapiens
atatatacagtaactttatgtgt

SEQ ID NO: 1096921 - DNA, 13 bp, Homo sapiens
atatatacatata

SEQ ID NO: 1096922 - DNA, 16 bp, Homo sapiens
atatatagatatgtat

SEQ ID NO: 1096923 - DNA, 22 bp, Homo sapiens
atatatagtgaaaaatgtcact

SEQ ID NO: 1096924 - DNA, 19 bp, Homo sapiens
atatatagtgggtacatca

SEQ ID NO: 1096925 - DNA, 12 bp, Homo sapiens
atatatataaac

SEQ ID NO: 1096926 - DNA, 14 bp, Homo sapiens
atatatataaatat

SEQ ID NO: 1096927 - DNA, 15 bp, Homo sapiens
atatatatagtaact

SEQ ID NO: 1096928 - DNA, 14 bp, Homo sapiens
atatatatatttaa

SEQ ID NO: 1096929 - DNA, 22 bp, Homo sapiens
atatatatctgataaaattgtg

SEQ ID NO: 1096930 - DNA, 14 bp, Homo sapiens
atatatatgaataa

SEQ ID NO: 1096931 - DNA, 13 bp, Homo sapiens
atatatatgtcaa

SEQ ID NO: 1096932 - DNA, 16 bp, Homo sapiens
atatatatgtcaatat

SEQ ID NO: 1096933 - DNA, 17 bp, Homo sapiens
atatatattgtaaagaa

SEQ ID NO: 1096934 - DNA, 10 bp, Homo sapiens
atatatattt

SEQ ID NO: 1096935 - DNA, 13 bp, Homo sapiens
atatatatttgta

SEQ ID NO: 1096936 - DNA, 18 bp, Homo sapiens
atatatatttttcaaata

SEQ ID NO: 1096937 - DNA, 20 bp, Homo sapiens
atatatatttttcaaataga

SEQ ID NO: 1096938 - DNA, 16 bp, Homo sapiens
atatatcaaagtgaga

SEQ ID NO: 1096939 - DNA, 15 bp, Homo sapiens
atatatcaagaagtc

SEQ ID NO: 1096940 - DNA, 20 bp, Homo sapiens
atatatcaagaagtcttgaa

SEQ ID NO: 1096941 - DNA, 24 bp, Homo sapiens
atatatctaccccagactagatgt

SEQ ID NO: 1096942 - DNA, 16 bp, Homo sapiens
atatatctatctattt

SEQ ID NO: 1096943 - DNA, 17 bp, Homo sapiens
atatatctctatttgag

SEQ ID NO: 1096944 - DNA, 20 bp, Homo sapiens
atatatctgataaaattgtg

SEQ ID NO: 1096945 - DNA, 15 bp, Homo sapiens
atatatctgcttcag

SEQ ID NO: 1096946 - DNA, 16 bp, Homo sapiens
atatatcttaagcagg

SEQ ID NO: 1096947 - DNA, 18 bp, Homo sapiens
atatatgaccagaagcct

SEQ ID NO: 1096948 - DNA, 15 bp, Homo sapiens
atatatgcactatgt

SEQ ID NO: 1096949 - DNA, 20 bp, Homo sapiens
atatatgcacttaatttgtt

SEQ ID NO: 1096950 - DNA, 12 bp, Homo sapiens
atatatggacat

SEQ ID NO: 1096951 - DNA, 13 bp, Homo sapiens
atatatggaccta

SEQ ID NO: 1096952 - DNA, 15 bp, Homo sapiens
atatatggacctagc

SEQ ID NO: 1096953 - DNA, 17 bp, Homo sapiens
atatatggatgtgtgtg

SEQ ID NO: 1096954 - DNA, 17 bp, Homo sapiens
atatatggcagagttgt

SEQ ID NO: 1096955 - DNA, 21 bp, Homo sapiens
atatatggcagagttgtaaat

SEQ ID NO: 1096956 - DNA, 10 bp, Homo sapiens
atatatgtat

SEQ ID NO: 1096957 - DNA, 14 bp, Homo sapiens
atatatgtatatgt

SEQ ID NO: 1096958 - DNA, 16 bp, Homo sapiens
atatatgtatatgtat

SEQ ID NO: 1096959 - DNA, 17 bp, Homo sapiens
atatatgtatatgtata

SEQ ID NO: 1096960 - DNA, 22 bp, Homo sapiens
atatatgtatctacaatacata

SEQ ID NO: 1096961 - DNA, 16 bp, Homo sapiens
atatatgtatgtaaaa

SEQ ID NO: 1096962 - DNA, 14 bp, Homo sapiens
atatgtaaaataaa

SEQ ID NO: 1096963 - DNA, 16 bp, Homo sapiens
atatgtaaaataaaat

SEQ ID NO: 1096964 - DNA, 15 bp, Homo sapiens
atatgtaagtacttc

SEQ ID NO: 1096965 - DNA, 22 bp, Homo sapiens
atatgtaatataaatttaagca

SEQ ID NO: 1096966 - DNA, 21 bp, Homo sapiens
atatgtaatttcaaaatacat

SEQ ID NO: 1096967 - DNA, 23 bp, Homo sapiens
atatgtaatttcaaaatacattt

SEQ ID NO: 1096968 - DNA, 19 bp, Homo sapiens
atatgtacagtttattgat

SEQ ID NO: 1096969 - DNA, 20 bp, Homo sapiens
atatgtacagtttattgata

SEQ ID NO: 1096970 - DNA, 22 bp, Homo sapiens
atatgtacagtttattgatatt

SEQ ID NO: 1096971 - DNA, 20 bp, Homo sapiens
atatgtagatgtatgcacac

SEQ ID NO: 1096972 - DNA, 17 bp, Homo sapiens
atatgtagcagaaaggc

SEQ ID NO: 1096973 - DNA, 18 bp, Homo sapiens
atatgtagtataaagaaa

SEQ ID NO: 1096974 - DNA, 19 bp, Homo sapiens
atatgtagtataaagaaaa

SEQ ID NO: 1096975 - DNA, 14 bp, Homo sapiens
atatgtagtattaa

SEQ ID NO: 1096976 - DNA, 23 bp, Homo sapiens
atatgtagtgcatttttaaactt

SEQ ID NO: 1096977 - DNA, 15 bp, Homo sapiens
atatgtataaattaa

SEQ ID NO: 1096978 - DNA, 15 bp, Homo sapiens
atatgtatatgtata

SEQ ID NO: 1096979 - DNA, 16 bp, Homo sapiens
atatgtatatgtatat

SEQ ID NO: 1096980 - DNA, 18 bp, Homo sapiens
atatgtatatgtatatat

SEQ ID NO: 1096981 - DNA, 18 bp, Homo sapiens
atatgtatatttttttaa

SEQ ID NO: 1096982 - DNA, 23 bp, Homo sapiens
atatgtatatttttttaatttaa

SEQ ID NO: 1096983 - DNA, 13 bp, Homo sapiens
atatgtatgtaaa

SEQ ID NO: 1096984 - DNA, 21 bp, Homo sapiens
atatgtattaagccaaacatg

SEQ ID NO: 1096985 - DNA, 16 bp, Homo sapiens
atatgtattataggag

SEQ ID NO: 1096986 - DNA, 18 bp, Homo sapiens
atatgtattatttataat

SEQ ID NO: 1096987 - DNA, 15 bp, Homo sapiens
atatgtattcccttg

SEQ ID NO: 1096988 - DNA, 12 bp, Homo sapiens
atatgtatttaa

SEQ ID NO: 1096989 - DNA, 14 bp, Homo sapiens
atatgtatttaaaa

SEQ ID NO: 1096990 - DNA, 16 bp, Homo sapiens
atatgtatttaccaaa

SEQ ID NO: 1096991 - DNA, 21 bp, Homo sapiens
atatgtattttcctaagtgtt

SEQ ID NO: 1096992 - DNA, 22 bp, Homo sapiens
atatgtcaagtgctgtgcaagg

SEQ ID NO: 1096993 - DNA, 14 bp, Homo sapiens
atatgtcacctggc

SEQ ID NO: 1096994 - DNA, 13 bp, Homo sapiens
atatgtcattatt

SEQ ID NO: 1096995 - DNA, 11 bp, Homo sapiens
atatgtcctgg

SEQ ID NO: 1096996 - DNA, 21 bp, Homo sapiens
atatgtcgtagaattccttcg

SEQ ID NO: 1096997 - DNA, 13 bp, Homo sapiens
atatgtctatata

SEQ ID NO: 1096998 - DNA, 21 bp, Homo sapiens
atatgtctgcaggtttctcct

SEQ ID NO: 1096999 - DNA, 13 bp, Homo sapiens
atatgtctgcttc

SEQ ID NO: 1097000 - DNA, 14 bp, Homo sapiens
atatgtctgtgtgt

SEQ ID NO: 1097001 - DNA, 14 bp, Homo sapiens
atatgtgaaaaaaa

SEQ ID NO: 1097002 - DNA, 15 bp, Homo sapiens
atatgtgaagttttc

SEQ ID NO: 1097003 - DNA, 18 bp, Homo sapiens
atatgtgctggaattcta

SEQ ID NO: 1097004 - DNA, 18 bp, Homo sapiens
atatgtgcttgcctcagt

SEQ ID NO: 1097005 - DNA, 16 bp, Homo sapiens
atatgtgtatacatac

SEQ ID NO: 1097006 - DNA, 20 bp, Homo sapiens
atatgtgtatacatacatgt

SEQ ID NO: 1097007 - DNA, 14 bp, Homo sapiens
atatgtgtatgtac

SEQ ID NO: 1097008 - DNA, 17 bp, Homo sapiens
atatgtgtttttcacat

SEQ ID NO: 1097009 - DNA, 23 bp, Homo sapiens
atatgttaagcagctaaattttc

SEQ ID NO: 1097010 - DNA, 16 bp, Homo sapiens
atatgttcaactggag

SEQ ID NO: 1097011 - DNA, 23 bp, Homo sapiens
atatgttctgcaagaattaaaac

SEQ ID NO: 1097012 - DNA, 15 bp, Homo sapiens
atatgttgaatactt

SEQ ID NO: 1097013 - DNA, 16 bp, Homo sapiens
atatgttgaatacttt

SEQ ID NO: 1097014 - DNA, 18 bp, Homo sapiens
atatgttgctataataaa

SEQ ID NO: 1097015 - DNA, 16 bp, Homo sapiens
atatgttgtaatattt

SEQ ID NO: 1097016 - DNA, 21 bp, Homo sapiens
atatgttgtaatatttcttca

SEQ ID NO: 1097017 - DNA, 16 bp, Homo sapiens
atatgtttaatgttca

SEQ ID NO: 1097018 - DNA, 17 bp, Homo sapiens
atatgtttaatgttcat

SEQ ID NO: 1097019 - DNA, 14 bp, Homo sapiens
atatgtttatatac

SEQ ID NO: 1097020 - DNA, 14 bp, Homo sapiens
atatgtttcacaca

SEQ ID NO: 1097021 - DNA, 18 bp, Homo sapiens
atatgtttcacacaaaca

SEQ ID NO: 1097022 - DNA, 20 bp, Homo sapiens
atatgtttccttgtttatca

SEQ ID NO: 1097023 - DNA, 21 bp, Homo sapiens
atatgttttgtgggaacagat

SEQ ID NO: 1097024 - DNA, 14 bp, Homo sapiens
atatgttttttaga

SEQ ID NO: 1097025 - DNA, 12 bp, Homo sapiens
atattaaaaaac

SEQ ID NO: 1097026 - DNA, 15 bp, Homo sapiens
atattaaaaatataa

SEQ ID NO: 1097027 - DNA, 16 bp, Homo sapiens
atattaaaaatataaa

SEQ ID NO: 1097028 - DNA, 21 bp, Homo sapiens
atattaaaatagcatactgtg

SEQ ID NO: 1097029 - DNA, 22 bp, Homo sapiens
atattaaaatagcatactgtgt

SEQ ID NO: 1097030 - DNA, 13 bp, Homo sapiens
atattaaaatcac

SEQ ID NO: 1097031 - DNA, 18 bp, Homo sapiens
atattaaaatgtcggatt

SEQ ID NO: 1097032 - DNA, 12 bp, Homo sapiens
atattaaacaaa

SEQ ID NO: 1097033 - DNA, 18 bp, Homo sapiens
atattaaacaaagtttca

SEQ ID NO: 1097034 - DNA, 22 bp, Homo sapiens
atattaaacaaagtttcagagt

SEQ ID NO: 1097035 - DNA, 12 bp, Homo sapiens
atattaaagatt

SEQ ID NO: 1097036 - DNA, 14 bp, Homo sapiens
atattaaagatttc

SEQ ID NO: 1097037 - DNA, 21 bp, Homo sapiens
atattaaagctcttcatttct

SEQ ID NO: 1097038 - DNA, 14 bp, Homo sapiens
atattaaaggagtt

SEQ ID NO: 1097039 - DNA, 19 bp, Homo sapiens
atattaaatacagacacta

SEQ ID NO: 1097040 - DNA, 20 bp, Homo sapiens
atattaaatgagggtttctg

SEQ ID NO: 1097041 - DNA, 22 bp, Homo sapiens
atattaaatgagggtttctgat

SEQ ID NO: 1097042 - DNA, 20 bp, Homo sapiens
atattaacacgctgcctggt

SEQ ID NO: 1097043 - DNA, 13 bp, Homo sapiens
atattaacatatt

SEQ ID NO: 1097044 - DNA, 14 bp, Homo sapiens
atattaacatattc

SEQ ID NO: 1097045 - DNA, 17 bp, Homo sapiens
atattaacatcatctta

SEQ ID NO: 1097046 - DNA, 15 bp, Homo sapiens
atattaacattcttt

SEQ ID NO: 1097047 - DNA, 15 bp, Homo sapiens
atattaacttttaat

SEQ ID NO: 1097048 - DNA, 18 bp, Homo sapiens
atattaacttttaatggt

SEQ ID NO: 1097049 - DNA, 15 bp, Homo sapiens
atattaagaaagact

SEQ ID NO: 1097050 - DNA, 12 bp, Homo sapiens
atattaagacag

SEQ ID NO: 1097051 - DNA, 16 bp, Homo sapiens
atattaagacagtgta

SEQ ID NO: 1097052 - DNA, 20 bp, Homo sapiens
atattaagacagtgtacaaa

SEQ ID NO: 1097053 - DNA, 13 bp, Homo sapiens
atattaagcactt

SEQ ID NO: 1097054 - DNA, 17 bp, Homo sapiens
atattaataaaacttta

SEQ ID NO: 1097055 - DNA, 11 bp, Homo sapiens
atattaatcaa

SEQ ID NO: 1097056 - DNA, 17 bp, Homo sapiens
atattaatgcctttaaa

SEQ ID NO: 1097057 - DNA, 16 bp, Homo sapiens
atattacaaaaacaaa

SEQ ID NO: 1097058 - DNA, 21 bp, Homo sapiens
atattacaataccgttaagat

SEQ ID NO: 1097059 - DNA, 16 bp, Homo sapiens
atattacaatgatcac

SEQ ID NO: 1097060 - DNA, 23 bp, Homo sapiens
atattactctcaaaatctttgta

SEQ ID NO: 1097061 - DNA, 14 bp, Homo sapiens
atattactgattta

SEQ ID NO: 1097062 - DNA, 16 bp, Homo sapiens
atattactgatttaga

SEQ ID NO: 1097063 - DNA, 17 bp, Homo sapiens
atattactgatttagaa

SEQ ID NO: 1097064 - DNA, 21 bp, Homo sapiens
atattactgatttagaagcaa

SEQ ID NO: 1097065 - DNA, 13 bp, Homo sapiens
atattactgtctt

SEQ ID NO: 1097066 - DNA, 19 bp, Homo sapiens
atattactgtctttattct

SEQ ID NO: 1097067 - DNA, 20 bp, Homo sapiens
atattactgtctttattctt

SEQ ID NO: 1097068 - DNA, 15 bp, Homo sapiens
atattactgttgcat

SEQ ID NO: 1097069 - DNA, 19 bp, Homo sapiens
atattacttttgtaaatat

SEQ ID NO: 1097070 - DNA, 21 bp, Homo sapiens
atattagctttactgtttgtt

SEQ ID NO: 1097071 - DNA, 15 bp, Homo sapiens
atattaggaaaatat

SEQ ID NO: 1097072 - DNA, 15 bp, Homo sapiens
atattagtgaagatg

SEQ ID NO: 1097073 - DNA, 18 bp, Homo sapiens
atattagtgattctgatt

SEQ ID NO: 1097074 - DNA, 13 bp, Homo sapiens
atattataaagga

SEQ ID NO: 1097075 - DNA, 22 bp, Homo sapiens
atattataatttttttcaatat

SEQ ID NO: 1097076 - DNA, 17 bp, Homo sapiens
atattatataactcttt

SEQ ID NO: 1097077 - DNA, 19 bp, Homo sapiens
atattatcatgcaaatgct

SEQ ID NO: 1097078 - DNA, 23 bp, Homo sapiens
atattatctacctgttctgtagc

SEQ ID NO: 1097079 - DNA, 21 bp, Homo sapiens
atattatggcaagtgatatca

SEQ ID NO: 1097080 - DNA, 13 bp, Homo sapiens
atattattagaaa

SEQ ID NO: 1097081 - DNA, 13 bp, Homo sapiens
atattattatata

SEQ ID NO: 1097082 - DNA, 15 bp, Homo sapiens
atattattatatata

SEQ ID NO: 1097083 - DNA, 13 bp, Homo sapiens
atattattatgaa

SEQ ID NO: 1097084 - DNA, 17 bp, Homo sapiens
atatttacataaagact

SEQ ID NO: 1097085 - DNA, 18 bp, Homo sapiens
atatttacataaagactg

SEQ ID NO: 1097086 - DNA, 23 bp, Homo sapiens
atatttactaagccacaagaaat

SEQ ID NO: 1097087 - DNA, 16 bp, Homo sapiens
atatttactgctcttt

SEQ ID NO: 1097088 - DNA, 19 bp, Homo sapiens
atatttagattgttaaaat

SEQ ID NO: 1097089 - DNA, 15 bp, Homo sapiens
atatttagcaaataa

SEQ ID NO: 1097090 - DNA, 14 bp, Homo sapiens
atatttataaaact

SEQ ID NO: 1097091 - DNA, 16 bp, Homo sapiens
atatttataacagcat

SEQ ID NO: 1097092 - DNA, 20 bp, Homo sapiens
atatttataactcatcataa

SEQ ID NO: 1097093 - DNA, 15 bp, Homo sapiens
atatttatatattta

SEQ ID NO: 1097094 - DNA, 20 bp, Homo sapiens
atatttatattgtatattct

SEQ ID NO: 1097095 - DNA, 14 bp, Homo sapiens
atatttatatttca

SEQ ID NO: 1097096 - DNA, 18 bp, Homo sapiens
atatttatgcttaaaata

SEQ ID NO: 1097097 - DNA, 23 bp, Homo sapiens
atatttatgcttaaaatatgtat

SEQ ID NO: 1097098 - DNA, 19 bp, Homo sapiens
atatttatggggggagaac

SEQ ID NO: 1097099 - DNA, 18 bp, Homo sapiens
atatttatgtctatttaa

SEQ ID NO: 1097100 - DNA, 16 bp, Homo sapiens
atatttattacctctg

SEQ ID NO: 1097101 - DNA, 13 bp, Homo sapiens
atatttattactt

SEQ ID NO: 1097102 - DNA, 16 bp, Homo sapiens
atatttattcattatt

SEQ ID NO: 1097103 - DNA, 23 bp, Homo sapiens
atatttattcattatttgtcaaa

SEQ ID NO: 1097104 - DNA, 14 bp, Homo sapiens
atatttattgatta

SEQ ID NO: 1097105 - DNA, 14 bp, Homo sapiens
atatttattgtgct

SEQ ID NO: 1097106 - DNA, 23 bp, Homo sapiens
atatttattgtttatttatcagt

SEQ ID NO: 1097107 - DNA, 17 bp, Homo sapiens
atatttatttatttatt

SEQ ID NO: 1097108 - DNA, 22 bp, Homo sapiens
atatttattttcagtatactgt

SEQ ID NO: 1097109 - DNA, 19 bp, Homo sapiens
atatttattttttttaagt

SEQ ID NO: 1097110 - DNA, 14 bp, Homo sapiens
atatttcagatatc

SEQ ID NO: 1097111 - DNA, 20 bp, Homo sapiens
atatttcaggttcttcagaa

SEQ ID NO: 1097112 - DNA, 12 bp, Homo sapiens
atatttcagtga

SEQ ID NO: 1097113 - DNA, 15 bp, Homo sapiens
atatttcattttaac

SEQ ID NO: 1097114 - DNA, 18 bp, Homo sapiens
atatttccatatggattt

SEQ ID NO: 1097115 - DNA, 21 bp, Homo sapiens
atatttcccatttgtgccaga

SEQ ID NO: 1097116 - DNA, 16 bp, Homo sapiens
atatttccccttggac

SEQ ID NO: 1097117 - DNA, 10 bp, Homo sapiens
atatttccta

SEQ ID NO: 1097118 - DNA, 15 bp, Homo sapiens
atatttcctgtattg

SEQ ID NO: 1097119 - DNA, 21 bp, Homo sapiens
atatttccttaaactgtgtgg

SEQ ID NO: 1097120 - DNA, 14 bp, Homo sapiens
atatttcctttatg

SEQ ID NO: 1097121 - DNA, 21 bp, Homo sapiens
atatttcctttatgtgaattt

SEQ ID NO: 1097122 - DNA, 14 bp, Homo sapiens
atatttctaactat

SEQ ID NO: 1097123 - DNA, 12 bp, Homo sapiens
atatttctgtgt

SEQ ID NO: 1097124 - DNA, 13 bp, Homo sapiens
atatttctgtgta

SEQ ID NO: 1097125 - DNA, 12 bp, Homo sapiens
atatttcttcaa

SEQ ID NO: 1097126 - DNA, 14 bp, Homo sapiens
atatttcttcaaat

SEQ ID NO: 1097127 - DNA, 19 bp, Homo sapiens
atatttcttcgttcttttt

SEQ ID NO: 1097128 - DNA, 24 bp, Homo sapiens
atatttcttcttctaagaagacat

SEQ ID NO: 1097129 - DNA, 14 bp, Homo sapiens
atatttcttgcttt

SEQ ID NO: 1097130 - DNA, 20 bp, Homo sapiens
atatttcttgctttcaatta

SEQ ID NO: 1097131 - DNA, 20 bp, Homo sapiens
atatttcttttgttgtactt

SEQ ID NO: 1097132 - DNA, 21 bp, Homo sapiens
atatttcttttgttgtacttt

SEQ ID NO: 1097133 - DNA, 13 bp, Homo sapiens
atatttgaaactg

SEQ ID NO: 1097134 - DNA, 10 bp, Homo sapiens
atatttgaat

SEQ ID NO: 1097135 - DNA, 23 bp, Homo sapiens
atatttgactctttcaaagaaat

SEQ ID NO: 1097136 - DNA, 23 bp, Homo sapiens
atatttgagacggggtctccctg

SEQ ID NO: 1097137 - DNA, 15 bp, Homo sapiens
atatttgatttctaa

SEQ ID NO: 1097138 - DNA, 19 bp, Homo sapiens
atatttgcaaaccctttgt

SEQ ID NO: 1097139 - DNA, 18 bp, Homo sapiens
atatttgcatatttttct

SEQ ID NO: 1097140 - DNA, 13 bp, Homo sapiens
atatttgcattat

SEQ ID NO: 1097141 - DNA, 23 bp, Homo sapiens
atatttgctttatactgagcttt

SEQ ID NO: 1097142 - DNA, 13 bp, Homo sapiens
atatttgcttttt

SEQ ID NO: 1097143 - DNA, 14 bp, Homo sapiens
atatttggaaagag

SEQ ID NO: 1097144 - DNA, 15 bp, Homo sapiens
atatttggaaagaga

SEQ ID NO: 1097145 - DNA, 16 bp, Homo sapiens
atatttggaaagagac

SEQ ID NO: 1097146 - DNA, 16 bp, Homo sapiens
atatttggaattgaac

SEQ ID NO: 1097147 - DNA, 15 bp, Homo sapiens
atatttgtaacattg

SEQ ID NO: 1097148 - DNA, 20 bp, Homo sapiens
atatttgtaacattgtaaag

SEQ ID NO: 1097149 - DNA, 12 bp, Homo sapiens
atatttgtacat

SEQ ID NO: 1097150 - DNA, 13 bp, Homo sapiens
atatttgtacata

SEQ ID NO: 1097151 - DNA, 13 bp, Homo sapiens
atatttgtaggag

SEQ ID NO: 1097152 - DNA, 23 bp, Homo sapiens
atatttgtatatattttatatgt

SEQ ID NO: 1097153 - DNA, 13 bp, Homo sapiens
atatttgtatgat

SEQ ID NO: 1097154 - DNA, 12 bp, Homo sapiens
atatttgtcatg

SEQ ID NO: 1097155 - DNA, 21 bp, Homo sapiens
atatttgtgtattttcctgga

SEQ ID NO: 1097156 - DNA, 13 bp, Homo sapiens
atatttgttactt

SEQ ID NO: 1097157 - DNA, 14 bp, Homo sapiens
atattttaaaatga

SEQ ID NO: 1097158 - DNA, 17 bp, Homo sapiens
atattttacctcttatt

SEQ ID NO: 1097159 - DNA, 17 bp, Homo sapiens
atattttatatgttcat

SEQ ID NO: 1097160 - DNA, 13 bp, Homo sapiens
atattttatcctg

SEQ ID NO: 1097161 - DNA, 17 bp, Homo sapiens
atattttatcctgtatt

SEQ ID NO: 1097162 - DNA, 14 bp, Homo sapiens
atattttatctcaa

SEQ ID NO: 1097163 - DNA, 14 bp, Homo sapiens
atattttatgaaca

SEQ ID NO: 1097164 - DNA, 23 bp, Homo sapiens
atattttatgaacattgtactgt

SEQ ID NO: 1097165 - DNA, 14 bp, Homo sapiens
atattttatggtta

SEQ ID NO: 1097166 - DNA, 20 bp, Homo sapiens
atattttatgtgagagaaag

SEQ ID NO: 1097167 - DNA, 17 bp, Homo sapiens
atattttatttcaatgt

SEQ ID NO: 1097168 - DNA, 17 bp, Homo sapiens
atattttcaaattgtat

SEQ ID NO: 1097169 - DNA, 18 bp, Homo sapiens
atattttccctttttaaa

SEQ ID NO: 1097170 - DNA, 24 bp, Homo sapiens
atattttcctagtagatctatatt

SEQ ID NO: 1097171 - DNA, 19 bp, Homo sapiens
atattttcctatattacgg

SEQ ID NO: 1097172 - DNA, 21 bp, Homo sapiens
atattttctatttctctgtgt

SEQ ID NO: 1097173 - DNA, 12 bp, Homo sapiens
atattttctgtt

SEQ ID NO: 1097174 - DNA, 12 bp, Homo sapiens
atattttgaatc

SEQ ID NO: 1097175 - DNA, 15 bp, Homo sapiens
atattttgatacaaa

SEQ ID NO: 1097176 - DNA, 12 bp, Homo sapiens
atattttgcagt

SEQ ID NO: 1097177 - DNA, 12 bp, Homo sapiens
atattttgctgg

SEQ ID NO: 1097178 - DNA, 19 bp, Homo sapiens
atattttggaaactgctaa

SEQ ID NO: 1097179 - DNA, 20 bp, Homo sapiens
atattttggaaactgctaaa

SEQ ID NO: 1097180 - DNA, 14 bp, Homo sapiens
atattttgtaatat

SEQ ID NO: 1097181 - DNA, 22 bp, Homo sapiens
atattttgtattgttaatatct

SEQ ID NO: 1097182 - DNA, 16 bp, Homo sapiens
atattttgttaacttt

SEQ ID NO: 1097183 - DNA, 14 bp, Homo sapiens
atattttgttctta

SEQ ID NO: 1097184 - DNA, 21 bp, Homo sapiens
atattttgttgccttcatctt

SEQ ID NO: 1097185 - DNA, 11 bp, Homo sapiens
atatttttaaa

SEQ ID NO: 1097186 - DNA, 21 bp, Homo sapiens
atatttttaaaatatttaact

SEQ ID NO: 1097187 - DNA, 20 bp, Homo sapiens
atatttttaaaatatttatt

SEQ ID NO: 1097188 - DNA, 14 bp, Homo sapiens
atatttttaaagat

SEQ ID NO: 1097189 - DNA, 13 bp, Homo sapiens
atatttttatact

SEQ ID NO: 1097190 - DNA, 13 bp, Homo sapiens
atatttttataga

SEQ ID NO: 1097191 - DNA, 14 bp, Homo sapiens
atatttttatagac

SEQ ID NO: 1097192 - DNA, 19 bp, Homo sapiens
atatttttatatttccttt

SEQ ID NO: 1097193 - DNA, 17 bp, Homo sapiens
atatttttatgtgcagc

SEQ ID NO: 1097194 - DNA, 16 bp, Homo sapiens
atatttttattttatt

SEQ ID NO: 1097195 - DNA, 16 bp, Homo sapiens
atatttttcaaataga

SEQ ID NO: 1097196 - DNA, 23 bp, Homo sapiens
atatttttccatttatttatgaa

SEQ ID NO: 1097197 - DNA, 22 bp, Homo sapiens
atatttttccctccgggcaggg

SEQ ID NO: 1097198 - DNA, 16 bp, Homo sapiens
atatttttctgagatt

SEQ ID NO: 1097199 - DNA, 15 bp, Homo sapiens
atatttttggggcat

SEQ ID NO: 1097200 - DNA, 16 bp, Homo sapiens
atatttttgtacatat

SEQ ID NO: 1097201 - DNA, 21 bp, Homo sapiens
atatttttgtacatattgtta

SEQ ID NO: 1097202 - DNA, 15 bp, Homo sapiens
atatttttgtacttg

SEQ ID NO: 1097203 - DNA, 15 bp, Homo sapiens
atattttttaaaata

SEQ ID NO: 1097204 - DNA, 17 bp, Homo sapiens
atattttttaatttaaa

SEQ ID NO: 1097205 - DNA, 20 bp, Homo sapiens
atattttttaatttgatgaa

SEQ ID NO: 1097206 - DNA, 17 bp, Homo sapiens
atattttttgaaggttt

SEQ ID NO: 1097207 - DNA, 21 bp, Homo sapiens
atcagcaaaccggggcctact

SEQ ID NO: 1097208 - DNA, 18 bp, Homo sapiens
atcagcaatattgcctgt

SEQ ID NO: 1097209 - DNA, 16 bp, Homo sapiens
atcagcaatttcagaa

SEQ ID NO: 1097210 - DNA, 19 bp, Homo sapiens
atcagcacgatttctgttt

SEQ ID NO: 1097211 - DNA, 16 bp, Homo sapiens
atcagcactttaacca

SEQ ID NO: 1097212 - DNA, 20 bp, Homo sapiens
atcagcaggctccagttgaa

SEQ ID NO: 1097213 - DNA, 15 bp, Homo sapiens
atcagcatgacaaaa

SEQ ID NO: 1097214 - DNA, 16 bp, Homo sapiens
atcagcatgacaaaaa

SEQ ID NO: 1097215 - DNA, 17 bp, Homo sapiens
atcagcatgacaaaaat

SEQ ID NO: 1097216 - DNA, 16 bp, Homo sapiens
atcagcattgtgactt

SEQ ID NO: 1097217 - DNA, 20 bp, Homo sapiens
atcagcattgtttcaaaata

SEQ ID NO: 1097218 - DNA, 16 bp, Homo sapiens
atcagcattttagaaa

SEQ ID NO: 1097219 - DNA, 16 bp, Homo sapiens
atcagccaagttttat

SEQ ID NO: 1097220 - DNA, 21 bp, Homo sapiens
atcagccagcccatggccccc

SEQ ID NO: 1097221 - DNA, 16 bp, Homo sapiens
atcagccagccttccc

SEQ ID NO: 1097222 - DNA, 18 bp, Homo sapiens
atcagccattaaaataaa

SEQ ID NO: 1097223 - DNA, 22 bp, Homo sapiens
atcagccattaaaataaaacaa

SEQ ID NO: 1097224 - DNA, 23 bp, Homo sapiens
atcagccattaaaataaaacaag

SEQ ID NO: 1097225 - DNA, 16 bp, Homo sapiens
atcagccatttttaga

SEQ ID NO: 1097226 - DNA, 19 bp, Homo sapiens
atcagccccaccctggcct

SEQ ID NO: 1097227 - DNA, 22 bp, Homo sapiens
atcagccccagagtgctttaaa

SEQ ID NO: 1097228 - DNA, 14 bp, Homo sapiens
atcagcccccagcc

SEQ ID NO: 1097229 - DNA, 14 bp, Homo sapiens
atcagccccgcctg

SEQ ID NO: 1097230 - DNA, 17 bp, Homo sapiens
atcagccccgcctgtca

SEQ ID NO: 1097231 - DNA, 22 bp, Homo sapiens
atcagccccgcctgtcacaata

SEQ ID NO: 1097232 - DNA, 17 bp, Homo sapiens
atcagccccgctcctcc

SEQ ID NO: 1097233 - DNA, 22 bp, Homo sapiens
atcagccccgctcctcccctct

SEQ ID NO: 1097234 - DNA, 23 bp, Homo sapiens
atcagccccgctcctcccctctt

SEQ ID NO: 1097235 - DNA, 13 bp, Homo sapiens
atcagcccctggg

SEQ ID NO: 1097236 - DNA, 18 bp, Homo sapiens
atcagcccctgggaacag

SEQ ID NO: 1097237 - DNA, 22 bp, Homo sapiens
atcagcccctgggaacaggccc

SEQ ID NO: 1097238 - DNA, 11 bp, Homo sapiens
atcagcctctt

SEQ ID NO: 1097239 - DNA, 13 bp, Homo sapiens
atcagcctcttaa

SEQ ID NO: 1097240 - DNA, 20 bp, Homo sapiens
atcagcctgctccagctgtt

SEQ ID NO: 1097241 - DNA, 17 bp, Homo sapiens
atcagcgggtctcctcc

SEQ ID NO: 1097242 - DNA, 22 bp, Homo sapiens
atcagcgggtctcctcccagcg

SEQ ID NO: 1097243 - DNA, 15 bp, Homo sapiens
atcagctatttactg

SEQ ID NO: 1097244 - DNA, 12 bp, Homo sapiens
atcagctcccaa

SEQ ID NO: 1097245 - DNA, 13 bp, Homo sapiens
atcagctcccaac

SEQ ID NO: 1097246 - DNA, 14 bp, Homo sapiens
atcagctctcctgg

SEQ ID NO: 1097247 - DNA, 14 bp, Homo sapiens
atcagctctctgct

SEQ ID NO: 1097248 - DNA, 17 bp, Homo sapiens
atcagctggacatactg

SEQ ID NO: 1097249 - DNA, 23 bp, Homo sapiens
atcaggaaaggctgtagaaggaa

SEQ ID NO: 1097250 - DNA, 20 bp, Homo sapiens
atcaggaaatatatatgtgt

SEQ ID NO: 1097251 - DNA, 19 bp, Homo sapiens
atcaggaaccagggcctcc

SEQ ID NO: 1097252 - DNA, 23 bp, Homo sapiens
atcaggaaggtaaaaacccagcg

SEQ ID NO: 1097253 - DNA, 22 bp, Homo sapiens
atcaggaattctaaataaattt

SEQ ID NO: 1097254 - DNA, 23 bp, Homo sapiens
atcaggaccaaaaaacctcactg

SEQ ID NO: 1097255 - DNA, 18 bp, Homo sapiens
atcaggacccagaggaag

SEQ ID NO: 1097256 - DNA, 23 bp, Homo sapiens
atcaggagaaagcttggttctgt

SEQ ID NO: 1097257 - DNA, 20 bp, Homo sapiens
atcaggagagggatacaaga

SEQ ID NO: 1097258 - DNA, 11 bp, Homo sapiens
atcaggagccc

SEQ ID NO: 1097259 - DNA, 14 bp, Homo sapiens
atcaggagccccca

SEQ ID NO: 1097260 - DNA, 20 bp, Homo sapiens
atcaggagcccccaacacag

SEQ ID NO: 1097261 - DNA, 21 bp, Homo sapiens
atcaggatccagtctggaaaa

SEQ ID NO: 1097262 - DNA, 18 bp, Homo sapiens
atcaggatgaacccagga

SEQ ID NO: 1097263 - DNA, 13 bp, Homo sapiens
atcaggattttaa

SEQ ID NO: 1097264 - DNA, 15 bp, Homo sapiens
atcaggattttaaac

SEQ ID NO: 1097265 - DNA, 17 bp, Homo sapiens
atcaggcactggtggca

SEQ ID NO: 1097266 - DNA, 18 bp, Homo sapiens
atcaggctctgttcctca

SEQ ID NO: 1097267 - DNA, 22 bp, Homo sapiens
atcaggctgctggaaacacagt

SEQ ID NO: 1097268 - DNA, 16 bp, Homo sapiens
atcaggctgttattat

SEQ ID NO: 1097269 - DNA, 17 bp, Homo sapiens
atcaggctgttattatg

SEQ ID NO: 1097270 - DNA, 19 bp, Homo sapiens
atcaggctgttattatgaa

SEQ ID NO: 1097271 - DNA, 18 bp, Homo sapiens
atcagggaatccagctcc

SEQ ID NO: 1097272 - DNA, 20 bp, Homo sapiens
atcagggcctttctcctccc

SEQ ID NO: 1097273 - DNA, 16 bp, Homo sapiens
atcaggggccagagag

SEQ ID NO: 1097274 - DNA, 23 bp, Homo sapiens
atcagggggaagaagcagagaga

SEQ ID NO: 1097275 - DNA, 23 bp, Homo sapiens
atcagggtataaattatatccgt

SEQ ID NO: 1097276 - DNA, 13 bp, Homo sapiens
atcaggtaacttt

SEQ ID NO: 1097277 - DNA, 22 bp, Homo sapiens
atcaggtgacttctagcagaga

SEQ ID NO: 1097278 - DNA, 13 bp, Homo sapiens
atcaggtttccaa

SEQ ID NO: 1097279 - DNA, 20 bp, Homo sapiens
atcaggttttcttttaagaa

SEQ ID NO: 1097280 - DNA, 14 bp, Homo sapiens
atcagtaaataact

SEQ ID NO: 1097281 - DNA, 18 bp, Homo sapiens
atcagtaaatagtgtcat

SEQ ID NO: 1097282 - DNA, 15 bp, Homo sapiens
atcagtaatatttat

SEQ ID NO: 1097283 - DNA, 14 bp, Homo sapiens
atcagtagcatttt

SEQ ID NO: 1097284 - DNA, 16 bp, Homo sapiens
atcagtagttcacata

SEQ ID NO: 1097285 - DNA, 14 bp, Homo sapiens
atcagtataaacaa

SEQ ID NO: 1097286 - DNA, 18 bp, Homo sapiens
atcagtataaacaaagtt

SEQ ID NO: 1097287 - DNA, 19 bp, Homo sapiens
atcagtattctgacatgta

SEQ ID NO: 1097288 - DNA, 22 bp, Homo sapiens
atcagtatttttttttaatttt

SEQ ID NO: 1097289 - DNA, 23 bp, Homo sapiens
atcagtatttttttttaattttg

SEQ ID NO: 1097290 - DNA, 13 bp, Homo sapiens
atcagtcaagctg

SEQ ID NO: 1097291 - DNA, 17 bp, Homo sapiens
atcagtccaactgaacg

SEQ ID NO: 1097292 - DNA, 23 bp, Homo sapiens
atcagtcccctcccatctgggag

SEQ ID NO: 1097293 - DNA, 16 bp, Homo sapiens
atcagtccctatgtat

SEQ ID NO: 1097294 - DNA, 16 bp, Homo sapiens
atcagtcctagaatgt

SEQ ID NO: 1097295 - DNA, 22 bp, Homo sapiens
atcagtcctagaatgtttcatt

SEQ ID NO: 1097296 - DNA, 23 bp, Homo sapiens
atcagtcctagaatgtttcattt

SEQ ID NO: 1097297 - DNA, 14 bp, Homo sapiens
atcagtcctttgat

SEQ ID NO: 1097298 - DNA, 19 bp, Homo sapiens
atcagtgactgaaaccatt

SEQ ID NO: 1097299 - DNA, 15 bp, Homo sapiens
atcagtgcagtgata

SEQ ID NO: 1097300 - DNA, 17 bp, Homo sapiens
atcagtgcctggtgttc

SEQ ID NO: 1097301 - DNA, 15 bp, Homo sapiens
atcagtgctccctca

SEQ ID NO: 1097302 - DNA, 23 bp, Homo sapiens
atcagtgtagttaaggagcctaa

SEQ ID NO: 1097303 - DNA, 14 bp, Homo sapiens
atcagtgtgtaaat

SEQ ID NO: 1097304 - DNA, 15 bp, Homo sapiens
atcagtgtgtaaata

SEQ ID NO: 1097305 - DNA, 13 bp, Homo sapiens
atcagtgttactg

SEQ ID NO: 1097306 - DNA, 21 bp, Homo sapiens
atcagtgttgttgctctagga

SEQ ID NO: 1097307 - DNA, 13 bp, Homo sapiens
atcagtgtttaca

SEQ ID NO: 1097308 - DNA, 20 bp, Homo sapiens
atcagttaaaatcacatttt

SEQ ID NO: 1097309 - DNA, 18 bp, Homo sapiens
atcagttaactattgcat

SEQ ID NO: 1097310 - DNA, 19 bp, Homo sapiens
atcagttaccaaacattac

SEQ ID NO: 1097311 - DNA, 15 bp, Homo sapiens
atcagttactcagcc

SEQ ID NO: 1097312 - DNA, 17 bp, Homo sapiens
atcagttactcagccct

SEQ ID NO: 1097313 - DNA, 18 bp, Homo sapiens
atcagttactctgaaggg

SEQ ID NO: 1097314 - DNA, 20 bp, Homo sapiens
atcagttatatgatattctt

SEQ ID NO: 1097315 - DNA, 19 bp, Homo sapiens
atcagttatcctttgtgag

SEQ ID NO: 1097316 - DNA, 21 bp, Homo sapiens
atcagttatcctttgtgagcc

SEQ ID NO: 1097317 - DNA, 22 bp, Homo sapiens
atcagttatcctttgtgagcct

SEQ ID NO: 1097318 - DNA, 16 bp, Homo sapiens
atcagttcaaaaggag

SEQ ID NO: 1097319 - DNA, 18 bp, Homo sapiens
atcagttcattagaaata

SEQ ID NO: 1097320 - DNA, 21 bp, Homo sapiens
atcagttgactttaagtgaaa

SEQ ID NO: 1097321 - DNA, 24 bp, Homo sapiens
atcagtttatcctgacatattcaa

SEQ ID NO: 1097322 - DNA, 16 bp, Homo sapiens
atcagttttggaatct

SEQ ID NO: 1097323 - DNA, 21 bp, Homo sapiens
atcagttttttcacctggaag

SEQ ID NO: 1097324 - DNA, 15 bp, Homo sapiens
atcataaaacttgat

SEQ ID NO: 1097325 - DNA, 12 bp, Homo sapiens
atcataaagcat

SEQ ID NO: 1097326 - DNA, 14 bp, Homo sapiens
atcataaagcattt

SEQ ID NO: 1097327 - DNA, 14 bp, Homo sapiens
atcataaagtcagt

SEQ ID NO: 1097328 - DNA, 20 bp, Homo sapiens
atccatgtgaccattctgcc

SEQ ID NO: 1097329 - DNA, 17 bp, Homo sapiens
atccattatcctttatt

SEQ ID NO: 1097330 - DNA, 21 bp, Homo sapiens
atccattcacaagcctcctgt

SEQ ID NO: 1097331 - DNA, 18 bp, Homo sapiens
atccattcctcagggaca

SEQ ID NO: 1097332 - DNA, 11 bp, Homo sapiens
atccattgttg

SEQ ID NO: 1097333 - DNA, 13 bp, Homo sapiens
atccattgttgtg

SEQ ID NO: 1097334 - DNA, 18 bp, Homo sapiens
atccatttcatctatttc

SEQ ID NO: 1097335 - DNA, 23 bp, Homo sapiens
atccatttcatctatttctgaga

SEQ ID NO: 1097336 - DNA, 22 bp, Homo sapiens
atccatttcttttactctgtgt

SEQ ID NO: 1097337 - DNA, 23 bp, Homo sapiens
atccatttcttttactctgtgta

SEQ ID NO: 1097338 - DNA, 15 bp, Homo sapiens
atccatttcttttat

SEQ ID NO: 1097339 - DNA, 13 bp, Homo sapiens
atccatttgtgca

SEQ ID NO: 1097340 - DNA, 11 bp, Homo sapiens
atccattttag

SEQ ID NO: 1097341 - DNA, 18 bp, Homo sapiens
atcccaaactttaaaatg

SEQ ID NO: 1097342 - DNA, 22 bp, Homo sapiens
atcccaaactttaaaatgcgaa

SEQ ID NO: 1097343 - DNA, 20 bp, Homo sapiens
atcccaaagttgttgtaacc

SEQ ID NO: 1097344 - DNA, 22 bp, Homo sapiens
atcccaaagttgttgtaacctg

SEQ ID NO: 1097345 - DNA, 18 bp, Homo sapiens
atcccaacctctttttcc

SEQ ID NO: 1097346 - DNA, 17 bp, Homo sapiens
atcccaatcaaagaatt

SEQ ID NO: 1097347 - DNA, 16 bp, Homo sapiens
atcccaatctttctat

SEQ ID NO: 1097348 - DNA, 15 bp, Homo sapiens
atcccaattctgtcc

SEQ ID NO: 1097349 - DNA, 14 bp, Homo sapiens
atcccacaccctgg

SEQ ID NO: 1097350 - DNA, 15 bp, Homo sapiens
atcccaccaaccctc

SEQ ID NO: 1097351 - DNA, 18 bp, Homo sapiens
atcccacgcactccatga

SEQ ID NO: 1097352 - DNA, 14 bp, Homo sapiens
atcccactggatct

SEQ ID NO: 1097353 - DNA, 17 bp, Homo sapiens
atcccacttcactgtga

SEQ ID NO: 1097354 - DNA, 21 bp, Homo sapiens
atcccacttcctttcctactg

SEQ ID NO: 1097355 - DNA, 17 bp, Homo sapiens
atcccagaaattagaaa

SEQ ID NO: 1097356 - DNA, 14 bp, Homo sapiens
atcccagaccagcc

SEQ ID NO: 1097357 - DNA, 17 bp, Homo sapiens
atcccagagaacaatca

SEQ ID NO: 1097358 - DNA, 21 bp, Homo sapiens
atcccagagaacaatcactat

SEQ ID NO: 1097359 - DNA, 22 bp, Homo sapiens
atcccagagaacaatcactatt

SEQ ID NO: 1097360 - DNA, 21 bp, Homo sapiens
atcccagcacctgcctcctcg

SEQ ID NO: 1097361 - DNA, 15 bp, Homo sapiens
atcccagcagcccaa

SEQ ID NO: 1097362 - DNA, 16 bp, Homo sapiens
atcccagcctgtggtt

SEQ ID NO: 1097363 - DNA, 23 bp, Homo sapiens
atcccagctactcaagaggctga

SEQ ID NO: 1097364 - DNA, 17 bp, Homo sapiens
atcccagctactcagga

SEQ ID NO: 1097365 - DNA, 20 bp, Homo sapiens
atcccagctactcaggaggc

SEQ ID NO: 1097366 - DNA, 20 bp, Homo sapiens
atcccagctacttgggaagc

SEQ ID NO: 1097367 - DNA, 20 bp, Homo sapiens
atcccagcttcggcatttga

SEQ ID NO: 1097368 - DNA, 21 bp, Homo sapiens
atcccagcttgctgaggggca

SEQ ID NO: 1097369 - DNA, 17 bp, Homo sapiens
atcccaggaaagaggca

SEQ ID NO: 1097370 - DNA, 19 bp, Homo sapiens
atcccaggggaccacacct

SEQ ID NO: 1097371 - DNA, 12 bp, Homo sapiens
atcccagggtcc

SEQ ID NO: 1097372 - DNA, 22 bp, Homo sapiens
atcccagggtcccacccccaac

SEQ ID NO: 1097373 - DNA, 11 bp, Homo sapiens
atcccatcagg

SEQ ID NO: 1097374 - DNA, 18 bp, Homo sapiens
atcccatctctacaaaaa

SEQ ID NO: 1097375 - DNA, 21 bp, Homo sapiens
atcccattaatcatttcccca

SEQ ID NO: 1097376 - DNA, 16 bp, Homo sapiens
atcccattctgcgtca

SEQ ID NO: 1097377 - DNA, 19 bp, Homo sapiens
atcccatttagtgtgaata

SEQ ID NO: 1097378 - DNA, 15 bp, Homo sapiens
atccccaaactcctt

SEQ ID NO: 1097379 - DNA, 21 bp, Homo sapiens
atccccaactccatggggttc

SEQ ID NO: 1097380 - DNA, 17 bp, Homo sapiens
atccccaagaccccctg

SEQ ID NO: 1097381 - DNA, 18 bp, Homo sapiens
atccccaagcctggcaag

SEQ ID NO: 1097382 - DNA, 13 bp, Homo sapiens
atccccaagctgg

SEQ ID NO: 1097383 - DNA, 17 bp, Homo sapiens
atccccaagctggccac

SEQ ID NO: 1097384 - DNA, 12 bp, Homo sapiens
atccccaccact

SEQ ID NO: 1097385 - DNA, 16 bp, Homo sapiens
atccccaccagctcgt

SEQ ID NO: 1097386 - DNA, 14 bp, Homo sapiens
atccccaccccacc

SEQ ID NO: 1097387 - DNA, 16 bp, Homo sapiens
atccccacgacccctg

SEQ ID NO: 1097388 - DNA, 15 bp, Homo sapiens
atccccactgtccta

SEQ ID NO: 1097389 - DNA, 16 bp, Homo sapiens
atccccagagcccagc

SEQ ID NO: 1097390 - DNA, 11 bp, Homo sapiens
atccccagcct

SEQ ID NO: 1097391 - DNA, 19 bp, Homo sapiens
atccccaggggtcccagcc

SEQ ID NO: 1097392 - DNA, 21 bp, Homo sapiens
atccccaggggtcccagccac

SEQ ID NO: 1097393 - DNA, 17 bp, Homo sapiens
atccccaggtccccaaa

SEQ ID NO: 1097394 - DNA, 18 bp, Homo sapiens
atccccaggtccccaaac

SEQ ID NO: 1097395 - DNA, 20 bp, Homo sapiens
atccccaggtccccaaactt

SEQ ID NO: 1097396 - DNA, 15 bp, Homo sapiens
atccccatcctccag

SEQ ID NO: 1097397 - DNA, 19 bp, Homo sapiens
atccccatcggccctgtcc

SEQ ID NO: 1097398 - DNA, 16 bp, Homo sapiens
atccccatctccctgc

SEQ ID NO: 1097399 - DNA, 17 bp, Homo sapiens
atcccccagaaaagaaa

SEQ ID NO: 1097400 - DNA, 17 bp, Homo sapiens
atccccccatcttgctt

SEQ ID NO: 1097401 - DNA, 20 bp, Homo sapiens
atccccccatcttgcttccc

SEQ ID NO: 1097402 - DNA, 19 bp, Homo sapiens
atcccccccacctctccct

SEQ ID NO: 1097403 - DNA, 12 bp, Homo sapiens
atccccctgccc

SEQ ID NO: 1097404 - DNA, 14 bp, Homo sapiens
atccccctgccctc

SEQ ID NO: 1097405 - DNA, 15 bp, Homo sapiens
atccccctgccctcg

SEQ ID NO: 1097406 - DNA, 14 bp, Homo sapiens
atccccctgtggaa

SEQ ID NO: 1097407 - DNA, 19 bp, Homo sapiens
atcccccttcttcctcccc

SEQ ID NO: 1097408 - DNA, 21 bp, Homo sapiens
atcccccttcttcctcccctc

SEQ ID NO: 1097409 - DNA, 22 bp, Homo sapiens
atcccccttcttcctcccctca

SEQ ID NO: 1097410 - DNA, 22 bp, Homo sapiens
atccccgcagtgtgcactaagg

SEQ ID NO: 1097411 - DNA, 17 bp, Homo sapiens
atcccctcaacaccctg

SEQ ID NO: 1097412 - DNA, 19 bp, Homo sapiens
atcccctccctgcctgctc

SEQ ID NO: 1097413 - DNA, 17 bp, Homo sapiens
atcccctcgtcctgtcc

SEQ ID NO: 1097414 - DNA, 16 bp, Homo sapiens
atcccctctcaggaga

SEQ ID NO: 1097415 - DNA, 15 bp, Homo sapiens
atcccctctcctgcc

SEQ ID NO: 1097416 - DNA, 12 bp, Homo sapiens
atcccctgagcc

SEQ ID NO: 1097417 - DNA, 14 bp, Homo sapiens
atcccctgagcccc

SEQ ID NO: 1097418 - DNA, 20 bp, Homo sapiens
atcccctgcactaggcaggt

SEQ ID NO: 1097419 - DNA, 17 bp, Homo sapiens
atcccctgcctcctgcc

SEQ ID NO: 1097420 - DNA, 19 bp, Homo sapiens
atcccctgcctcctgccac

SEQ ID NO: 1097421 - DNA, 20 bp, Homo sapiens
atccccttcccccatcccta

SEQ ID NO: 1097422 - DNA, 13 bp, Homo sapiens
atcccctttcctc

SEQ ID NO: 1097423 - DNA, 20 bp, Homo sapiens
atcccgaagccatcacttct

SEQ ID NO: 1097424 - DNA, 14 bp, Homo sapiens
atcccgagcacctc

SEQ ID NO: 1097425 - DNA, 16 bp, Homo sapiens
atcccgccacctatct

SEQ ID NO: 1097426 - DNA, 22 bp, Homo sapiens
atcccgcttagcgctctggaca

SEQ ID NO: 1097427 - DNA, 15 bp, Homo sapiens
atcccggaggaaatc

SEQ ID NO: 1097428 - DNA, 15 bp, Homo sapiens
atcccggcctcttcc

SEQ ID NO: 1097429 - DNA, 20 bp, Homo sapiens
atcccgtgcccctttccttc

SEQ ID NO: 1097430 - DNA, 17 bp, Homo sapiens
atccctaatgttttgct

SEQ ID NO: 1097431 - DNA, 14 bp, Homo sapiens
atccctacatgtat

SEQ ID NO: 1097432 - DNA, 14 bp, Homo sapiens
atccctaccactgt

SEQ ID NO: 1097433 - DNA, 16 bp, Homo sapiens
atccctaccactgtgg

SEQ ID NO: 1097434 - DNA, 21 bp, Homo sapiens
atccctaccccctaagagcca

SEQ ID NO: 1097435 - DNA, 22 bp, Homo sapiens
atccctaccccctaagagccat

SEQ ID NO: 1097436 - DNA, 17 bp, Homo sapiens
atccctatgggattcag

SEQ ID NO: 1097437 - DNA, 17 bp, Homo sapiens
atccctcagatcccact

SEQ ID NO: 1097438 - DNA, 11 bp, Homo sapiens
atccctcatct

SEQ ID NO: 1097439 - DNA, 17 bp, Homo sapiens
atccctcatctgtccct

SEQ ID NO: 1097440 - DNA, 15 bp, Homo sapiens
atccctccccagttc

SEQ ID NO: 1097441 - DNA, 16 bp, Homo sapiens
atccctccccagttca

SEQ ID NO: 1097442 - DNA, 15 bp, Homo sapiens
atccctcccccagca

SEQ ID NO: 1097443 - DNA, 17 bp, Homo sapiens
atccctccttaagagat

SEQ ID NO: 1097444 - DNA, 24 bp, Homo sapiens
atccctcgatatttttaaagatct

SEQ ID NO: 1097445 - DNA, 17 bp, Homo sapiens
atccctctacagagctt

SEQ ID NO: 1097446 - DNA, 12 bp, Homo sapiens
atccctctccac

SEQ ID NO: 1097447 - DNA, 14 bp, Homo sapiens
atccctctccactc

SEQ ID NO: 1097448 - DNA, 15 bp, Homo sapiens
atccctctccactct

SEQ ID NO: 1097449 - DNA, 21 bp, Homo sapiens
atccctctccactcttctctc

SEQ ID NO: 1097450 - DNA, 23 bp, Homo sapiens
atcgcccaggcctgggatgcagt

SEQ ID NO: 1097451 - DNA, 16 bp, Homo sapiens
atcgccccaccgcagc

SEQ ID NO: 1097452 - DNA, 15 bp, Homo sapiens
atcgccctcctttcc

SEQ ID NO: 1097453 - DNA, 21 bp, Homo sapiens
atcgcgccagcgacctctctg

SEQ ID NO: 1097454 - DNA, 22 bp, Homo sapiens
atcgctaaagggaccatctgct

SEQ ID NO: 1097455 - DNA, 22 bp, Homo sapiens
atcgctcctgcagccccagccc

SEQ ID NO: 1097456 - DNA, 19 bp, Homo sapiens
atcgctcttttccactcca

SEQ ID NO: 1097457 - DNA, 21 bp, Homo sapiens
atcgctgctacatcagactct

SEQ ID NO: 1097458 - DNA, 14 bp, Homo sapiens
atcgcttgagccca

SEQ ID NO: 1097459 - DNA, 14 bp, Homo sapiens
atcggactgccaaa

SEQ ID NO: 1097460 - DNA, 15 bp, Homo sapiens
atcggagcctcctct

SEQ ID NO: 1097461 - DNA, 16 bp, Homo sapiens
atcggagcctcctctc

SEQ ID NO: 1097462 - DNA, 22 bp, Homo sapiens
atcggaggcttgtcagagctgg

SEQ ID NO: 1097463 - DNA, 23 bp, Homo sapiens
atcggccaagaatacttgaagaa

SEQ ID NO: 1097464 - DNA, 14 bp, Homo sapiens
atcggccacagggc

SEQ ID NO: 1097465 - DNA, 19 bp, Homo sapiens
atcggcccacagctcccac

SEQ ID NO: 1097466 - DNA, 20 bp, Homo sapiens
atcggcccacagctcccacc

SEQ ID NO: 1097467 - DNA, 14 bp, Homo sapiens
atcggccctgtccc

SEQ ID NO: 1097468 - DNA, 20 bp, Homo sapiens
atcggccctgtcccctggag

SEQ ID NO: 1097469 - DNA, 13 bp, Homo sapiens
atcgggaaagaag

SEQ ID NO: 1097470 - DNA, 16 bp, Homo sapiens
atcgggaaagaagaaa

SEQ ID NO: 1097471 - DNA, 17 bp, Homo sapiens
atcgggaacagtgtttc

SEQ ID NO: 1097472 - DNA, 19 bp, Homo sapiens
atcgggagcacccagagca

SEQ ID NO: 1097473 - DNA, 16 bp, Homo sapiens
atcgggagcagtgtct

SEQ ID NO: 1097474 - DNA, 15 bp, Homo sapiens
atcgggcccagggac

SEQ ID NO: 1097475 - DNA, 17 bp, Homo sapiens
atcgggctaaggtccct

SEQ ID NO: 1097476 - DNA, 13 bp, Homo sapiens
atcggggggtgga

SEQ ID NO: 1097477 - DNA, 16 bp, Homo sapiens
atcggggtagaaatgc

SEQ ID NO: 1097478 - DNA, 19 bp, Homo sapiens
atcgggttcagaacacttt

SEQ ID NO: 1097479 - DNA, 16 bp, Homo sapiens
atcggttgttctttcc

SEQ ID NO: 1097480 - DNA, 13 bp, Homo sapiens
atcggtttttaaa

SEQ ID NO: 1097481 - DNA, 23 bp, Homo sapiens
atcggtttttaaaggtgatgtaa

SEQ ID NO: 1097482 - DNA, 18 bp, Homo sapiens
atcgtcactgcttaactt

SEQ ID NO: 1097483 - DNA, 12 bp, Homo sapiens
atcgtccagccc

SEQ ID NO: 1097484 - DNA, 14 bp, Homo sapiens
atcgtccagccctc

SEQ ID NO: 1097485 - DNA, 14 bp, Homo sapiens
atcgtcctgggact

SEQ ID NO: 1097486 - DNA, 13 bp, Homo sapiens
atcgtccttcctc

SEQ ID NO: 1097487 - DNA, 16 bp, Homo sapiens
atcgtccttcctctca

SEQ ID NO: 1097488 - DNA, 15 bp, Homo sapiens
atcgtctcggcccct

SEQ ID NO: 1097489 - DNA, 12 bp, Homo sapiens
atcgtgaaaccc

SEQ ID NO: 1097490 - DNA, 20 bp, Homo sapiens
atcgtgaaaccctgtctcta

SEQ ID NO: 1097491 - DNA, 21 bp, Homo sapiens
atcgtgacccttcagggccag

SEQ ID NO: 1097492 - DNA, 17 bp, Homo sapiens
atcgtgatcactgagcc

SEQ ID NO: 1097493 - DNA, 23 bp, Homo sapiens
atcgtgccgttactctccaacct

SEQ ID NO: 1097494 - DNA, 12 bp, Homo sapiens
atcgtgctaaat

SEQ ID NO: 1097495 - DNA, 15 bp, Homo sapiens
atcgtggcacgtatt

SEQ ID NO: 1097496 - DNA, 21 bp, Homo sapiens
atcgtgtctgctgactgtttc

SEQ ID NO: 1097497 - DNA, 15 bp, Homo sapiens
atcgtgtttgcaaag

SEQ ID NO: 1097498 - DNA, 16 bp, Homo sapiens
atcgttccccacccct

SEQ ID NO: 1097499 - DNA, 14 bp, Homo sapiens
atcgttctctgcct

SEQ ID NO: 1097500 - DNA, 21 bp, Homo sapiens
atcgttgagacatcaggaagg

SEQ ID NO: 1097501 - DNA, 20 bp, Homo sapiens
atcgttgcaaccactgcaat

SEQ ID NO: 1097502 - DNA, 19 bp, Homo sapiens
atcgtttctcagaagtact

SEQ ID NO: 1097503 - DNA, 14 bp, Homo sapiens
atcgttttcttaaa

SEQ ID NO: 1097504 - DNA, 13 bp, Homo sapiens
atctaaaacaaaa

SEQ ID NO: 1097505 - DNA, 22 bp, Homo sapiens
atctaaaatgattgtgcctctg

SEQ ID NO: 1097506 - DNA, 22 bp, Homo sapiens
atctaaaatttcataattctga

SEQ ID NO: 1097507 - DNA, 18 bp, Homo sapiens
atctaaacgtggtcacct

SEQ ID NO: 1097508 - DNA, 14 bp, Homo sapiens
atctaaagctttat

SEQ ID NO: 1097509 - DNA, 21 bp, Homo sapiens
atctaaagctttatctttgtg

SEQ ID NO: 1097510 - DNA, 22 bp, Homo sapiens
atctaaagctttatctttgtgt

SEQ ID NO: 1097511 - DNA, 21 bp, Homo sapiens
atctaaaggatggaaaaataa

SEQ ID NO: 1097512 - DNA, 15 bp, Homo sapiens
atctaaagtgtgttg

SEQ ID NO: 1097513 - DNA, 13 bp, Homo sapiens
atctaaagttata

SEQ ID NO: 1097514 - DNA, 13 bp, Homo sapiens
atctaaatgaatg

SEQ ID NO: 1097515 - DNA, 15 bp, Homo sapiens
atctaaatgttgaaa

SEQ ID NO: 1097516 - DNA, 19 bp, Homo sapiens
atctaacattattactttt

SEQ ID NO: 1097517 - DNA, 15 bp, Homo sapiens
atctaaccctcccat

SEQ ID NO: 1097518 - DNA, 22 bp, Homo sapiens
atctaaccctcccatggcacct

SEQ ID NO: 1097519 - DNA, 12 bp, Homo sapiens
atctaagaataa

SEQ ID NO: 1097520 - DNA, 13 bp, Homo sapiens
atctaagcctgaa

SEQ ID NO: 1097521 - DNA, 17 bp, Homo sapiens
atctaagcctttccata

SEQ ID NO: 1097522 - DNA, 20 bp, Homo sapiens
atctaagggaagatcactgt

SEQ ID NO: 1097523 - DNA, 15 bp, Homo sapiens
atctaagtatatgtg

SEQ ID NO: 1097524 - DNA, 23 bp, Homo sapiens
atctaagtatatgtgagaaatca

SEQ ID NO: 1097525 - DNA, 16 bp, Homo sapiens
atctaagttaatttaa

SEQ ID NO: 1097526 - DNA, 17 bp, Homo sapiens
atctaagttaatttaaa

SEQ ID NO: 1097527 - DNA, 15 bp, Homo sapiens
atctaataaatcagt

SEQ ID NO: 1097528 - DNA, 18 bp, Homo sapiens
atctaatatatatgaata

SEQ ID NO: 1097529 - DNA, 22 bp, Homo sapiens
atctaatatatatgaataaagt

SEQ ID NO: 1097530 - DNA, 16 bp, Homo sapiens
atctaatatttctagt

SEQ ID NO: 1097531 - DNA, 21 bp, Homo sapiens
atctaatctcttattctaata

SEQ ID NO: 1097532 - DNA, 13 bp, Homo sapiens
atctaatctgaac

SEQ ID NO: 1097533 - DNA, 13 bp, Homo sapiens
atctaatgaaaaa

SEQ ID NO: 1097534 - DNA, 22 bp, Homo sapiens
atctaatgaaaaacaaaaagct

SEQ ID NO: 1097535 - DNA, 17 bp, Homo sapiens
atctaatgcttgtttat

SEQ ID NO: 1097536 - DNA, 17 bp, Homo sapiens
atctaattcagacagag

SEQ ID NO: 1097537 - DNA, 17 bp, Homo sapiens
atctacaatacatatat

SEQ ID NO: 1097538 - DNA, 20 bp, Homo sapiens
atctacaatacatatatcta

SEQ ID NO: 1097539 - DNA, 14 bp, Homo sapiens
atctacacatacag

SEQ ID NO: 1097540 - DNA, 19 bp, Homo sapiens
atctacacatacagaaaga

SEQ ID NO: 1097541 - DNA, 15 bp, Homo sapiens
atctacagtaatgaa

SEQ ID NO: 1097542 - DNA, 14 bp, Homo sapiens
atctacccaaagga

SEQ ID NO: 1097543 - DNA, 21 bp, Homo sapiens
atctaccccagactagatgta

SEQ ID NO: 1097544 - DNA, 22 bp, Homo sapiens
atctaccccagactagatgtag

SEQ ID NO: 1097545 - DNA, 17 bp, Homo sapiens
atctaccccagggagaa

SEQ ID NO: 1097546 - DNA, 14 bp, Homo sapiens
atctacccgtgcct

SEQ ID NO: 1097547 - DNA, 19 bp, Homo sapiens
atctacctggagggaagag

SEQ ID NO: 1097548 - DNA, 21 bp, Homo sapiens
atctacctgttctgtagcttt

SEQ ID NO: 1097549 - DNA, 21 bp, Homo sapiens
atctactaccagaagggcttc

SEQ ID NO: 1097550 - DNA, 13 bp, Homo sapiens
atctactcccaag

SEQ ID NO: 1097551 - DNA, 16 bp, Homo sapiens
atctactgtacacaat

SEQ ID NO: 1097552 - DNA, 19 bp, Homo sapiens
atctacttctgtaattgtg

SEQ ID NO: 1097553 - DNA, 17 bp, Homo sapiens
atctactttttgtattt

SEQ ID NO: 1097554 - DNA, 19 bp, Homo sapiens
atctactttttgtatttag

SEQ ID NO: 1097555 - DNA, 18 bp, Homo sapiens
atctagaactatcatttt

SEQ ID NO: 1097556 - DNA, 19 bp, Homo sapiens
atctagaagatgtgtaaac

SEQ ID NO: 1097557 - DNA, 23 bp, Homo sapiens
atctagaagatgtgtaaacaggt

SEQ ID NO: 1097558 - DNA, 19 bp, Homo sapiens
atctagattatggagcttt

SEQ ID NO: 1097559 - DNA, 15 bp, Homo sapiens
atctagcagctggcc

SEQ ID NO: 1097560 - DNA, 16 bp, Homo sapiens
atctagcagctggcct

SEQ ID NO: 1097561 - DNA, 16 bp, Homo sapiens
atctagcagtaaaaga

SEQ ID NO: 1097562 - DNA, 18 bp, Homo sapiens
atctagcagtaaaagata

SEQ ID NO: 1097563 - DNA, 14 bp, Homo sapiens
atctaggaaaatta

SEQ ID NO: 1097564 - DNA, 14 bp, Homo sapiens
atctaggagaggag

SEQ ID NO: 1097565 - DNA, 16 bp, Homo sapiens
atctaggcatttcatt

SEQ ID NO: 1097566 - DNA, 19 bp, Homo sapiens
atctaggcatttcattatg

SEQ ID NO: 1097567 - DNA, 22 bp, Homo sapiens
atctaggtggagttgaaagagt

SEQ ID NO: 1097568 - DNA, 17 bp, Homo sapiens
atctaggtgtggctgtg

SEQ ID NO: 1097569 - DNA, 21 bp, Homo sapiens
atctagtgcagctgattttaa

SEQ ID NO: 1097570 - DNA, 23 bp, Homo sapiens
atctagtgggttgacctttaaat

SEQ ID NO: 1097571 - DNA, 22 bp, Homo sapiens
atctagttatttacaggaactt

SEQ ID NO: 1097572 - DNA, 13 bp, Homo sapiens
atctgtacaatga

SEQ ID NO: 1097573 - DNA, 15 bp, Homo sapiens
atctgtacgtaagaa

SEQ ID NO: 1097574 - DNA, 15 bp, Homo sapiens
atctgtagggctgga

SEQ ID NO: 1097575 - DNA, 17 bp, Homo sapiens
atctgtataaataagag

SEQ ID NO: 1097576 - DNA, 20 bp, Homo sapiens
atctgtataagtaagaaaat

SEQ ID NO: 1097577 - DNA, 20 bp, Homo sapiens
atctgtataatactttgtat

SEQ ID NO: 1097578 - DNA, 24 bp, Homo sapiens
atctgtataatactttgtatacaa

SEQ ID NO: 1097579 - DNA, 14 bp, Homo sapiens
atctgtatatacaa

SEQ ID NO: 1097580 - DNA, 20 bp, Homo sapiens
atctgtatatacaataacat

SEQ ID NO: 1097581 - DNA, 11 bp, Homo sapiens
atctgtatcta

SEQ ID NO: 1097582 - DNA, 21 bp, Homo sapiens
atctgtcaagagtagttatat

SEQ ID NO: 1097583 - DNA, 19 bp, Homo sapiens
atctgtcatctctctgggg

SEQ ID NO: 1097584 - DNA, 21 bp, Homo sapiens
atctgtccaaaggaggctggc

SEQ ID NO: 1097585 - DNA, 14 bp, Homo sapiens
atctgtcctcaccc

SEQ ID NO: 1097586 - DNA, 12 bp, Homo sapiens
atctgtcctctg

SEQ ID NO: 1097587 - DNA, 14 bp, Homo sapiens
atctgtcctctgta

SEQ ID NO: 1097588 - DNA, 18 bp, Homo sapiens
atctgtcctctgtagtat

SEQ ID NO: 1097589 - DNA, 19 bp, Homo sapiens
atctgtctgccaacctaaa

SEQ ID NO: 1097590 - DNA, 18 bp, Homo sapiens
atctgtctgtctgtgggc

SEQ ID NO: 1097591 - DNA, 19 bp, Homo sapiens
atctgtctgtggcaaaagt

SEQ ID NO: 1097592 - DNA, 22 bp, Homo sapiens
atctgtctgtggcaaaagttta

SEQ ID NO: 1097593 - DNA, 20 bp, Homo sapiens
atctgtctttcactggaatg

SEQ ID NO: 1097594 - DNA, 13 bp, Homo sapiens
atctgtcttttat

SEQ ID NO: 1097595 - DNA, 20 bp, Homo sapiens
atctgtgaaaggtaggaaac

SEQ ID NO: 1097596 - DNA, 12 bp, Homo sapiens
atctgtgaaata

SEQ ID NO: 1097597 - DNA, 17 bp, Homo sapiens
atctgtgaaatatcatc

SEQ ID NO: 1097598 - DNA, 21 bp, Homo sapiens
atctgtgaaatgctggcattt

SEQ ID NO: 1097599 - DNA, 21 bp, Homo sapiens
atctgtgaagtagttctgttt

SEQ ID NO: 1097600 - DNA, 12 bp, Homo sapiens
atctgtgaataa

SEQ ID NO: 1097601 - DNA, 16 bp, Homo sapiens
atctgtgaattcagat

SEQ ID NO: 1097602 - DNA, 17 bp, Homo sapiens
atctgtgaattcagatt

SEQ ID NO: 1097603 - DNA, 15 bp, Homo sapiens
atctgtgattccccc

SEQ ID NO: 1097604 - DNA, 14 bp, Homo sapiens
atctgtgatttctt

SEQ ID NO: 1097605 - DNA, 16 bp, Homo sapiens
atctgtgcactgccca

SEQ ID NO: 1097606 - DNA, 16 bp, Homo sapiens
atctgtgcctgggatc

SEQ ID NO: 1097607 - DNA, 16 bp, Homo sapiens
atctgtgcgtgaaaca

SEQ ID NO: 1097608 - DNA, 16 bp, Homo sapiens
atctgtgcttctaata

SEQ ID NO: 1097609 - DNA, 21 bp, Homo sapiens
atctgtgcttctaatattagt

SEQ ID NO: 1097610 - DNA, 13 bp, Homo sapiens
atctgtggaaagc

SEQ ID NO: 1097611 - DNA, 16 bp, Homo sapiens
atctgtggaaagctag

SEQ ID NO: 1097612 - DNA, 21 bp, Homo sapiens
atctgtggagctgccacagag

SEQ ID NO: 1097613 - DNA, 18 bp, Homo sapiens
atctgtggagttcctgct

SEQ ID NO: 1097614 - DNA, 17 bp, Homo sapiens
atctgtgtacaaagaaa

SEQ ID NO: 1097615 - DNA, 13 bp, Homo sapiens
atctgtgtgaaaa

SEQ ID NO: 1097616 - DNA, 14 bp, Homo sapiens
atctgtgtgcatat

SEQ ID NO: 1097617 - DNA, 17 bp, Homo sapiens
atctgtgtgcatatttg

SEQ ID NO: 1097618 - DNA, 21 bp, Homo sapiens
atctgtgtgcatatttgttac

SEQ ID NO: 1097619 - DNA, 15 bp, Homo sapiens
atctgtgtgtatatt

SEQ ID NO: 1097620 - DNA, 18 bp, Homo sapiens
atctgtgtttttgaaata

SEQ ID NO: 1097621 - DNA, 22 bp, Homo sapiens
atctgttatcctgctagctgta

SEQ ID NO: 1097622 - DNA, 14 bp, Homo sapiens
atctgttctaacat

SEQ ID NO: 1097623 - DNA, 16 bp, Homo sapiens
atctgttctaacatgt

SEQ ID NO: 1097624 - DNA, 15 bp, Homo sapiens
atctgttgttttgtt

SEQ ID NO: 1097625 - DNA, 16 bp, Homo sapiens
atctgtttctctgctg

SEQ ID NO: 1097626 - DNA, 18 bp, Homo sapiens
atctgtttctctgctgtc

SEQ ID NO: 1097627 - DNA, 19 bp, Homo sapiens
atctgtttctctgctgtca

SEQ ID NO: 1097628 - DNA, 22 bp, Homo sapiens
atctgtttgaagattatatgaa

SEQ ID NO: 1097629 - DNA, 19 bp, Homo sapiens
atctgtttgtatatttgca

SEQ ID NO: 1097630 - DNA, 13 bp, Homo sapiens
atctgttttcaac

SEQ ID NO: 1097631 - DNA, 17 bp, Homo sapiens
atctgttttgaaggcaa

SEQ ID NO: 1097632 - DNA, 18 bp, Homo sapiens
atctgttttgaaggcaaa

SEQ ID NO: 1097633 - DNA, 19 bp, Homo sapiens
atctgttttgaaggcaaaa

SEQ ID NO: 1097634 - DNA, 21 bp, Homo sapiens
atctgttttgtggtttggaat

SEQ ID NO: 1097635 - DNA, 14 bp, Homo sapiens
atctgtttttctaa

SEQ ID NO: 1097636 - DNA, 19 bp, Homo sapiens
atcttaaaagctatcttca

SEQ ID NO: 1097637 - DNA, 13 bp, Homo sapiens
atcttaaacaatg

SEQ ID NO: 1097638 - DNA, 16 bp, Homo sapiens
atcttaaacaatgtat

SEQ ID NO: 1097639 - DNA, 20 bp, Homo sapiens
atcttaaacaatgtataaag

SEQ ID NO: 1097640 - DNA, 16 bp, Homo sapiens
atcttaaactaatacg

SEQ ID NO: 1097641 - DNA, 17 bp, Homo sapiens
atcttaaagatcgtgta

SEQ ID NO: 1097642 - DNA, 13 bp, Homo sapiens
atcttaaattcat

SEQ ID NO: 1097643 - DNA, 17 bp, Homo sapiens
atcttaaattcatttct

SEQ ID NO: 1097644 - DNA, 20 bp, Homo sapiens
atcttaagagcttgatctgt

SEQ ID NO: 1097645 - DNA, 21 bp, Homo sapiens
atcttaagagcttgatctgtg

SEQ ID NO: 1097646 - DNA, 14 bp, Homo sapiens
atcttaaggtctaa

SEQ ID NO: 1097647 - DNA, 17 bp, Homo sapiens
atcttaaggtctaactg

SEQ ID NO: 1097648 - DNA, 13 bp, Homo sapiens
atcttaatataaa

SEQ ID NO: 1097649 - DNA, 13 bp, Homo sapiens
atcttaatatata

SEQ ID NO: 1097650 - DNA, 19 bp, Homo sapiens
atcttaatcgatgaatgta

SEQ ID NO: 1097651 - DNA, 17 bp, Homo sapiens
atcttaatgtatatcgt

SEQ ID NO: 1097652 - DNA, 15 bp, Homo sapiens
atcttaatgttactc

SEQ ID NO: 1097653 - DNA, 19 bp, Homo sapiens
atcttaattttttttaatg

SEQ ID NO: 1097654 - DNA, 15 bp, Homo sapiens
atcttacaaaatcct

SEQ ID NO: 1097655 - DNA, 14 bp, Homo sapiens
atcttaccagatgc

SEQ ID NO: 1097656 - DNA, 15 bp, Homo sapiens
atcttaccagatgct

SEQ ID NO: 1097657 - DNA, 16 bp, Homo sapiens
atcttaccagatgcta

SEQ ID NO: 1097658 - DNA, 23 bp, Homo sapiens
atcttaccagatgctactggact

SEQ ID NO: 1097659 - DNA, 18 bp, Homo sapiens
atcttacctgtaaagtct

SEQ ID NO: 1097660 - DNA, 16 bp, Homo sapiens
atcttactatttcaca

SEQ ID NO: 1097661 - DNA, 18 bp, Homo sapiens
atcttagagtttacagtt

SEQ ID NO: 1097662 - DNA, 22 bp, Homo sapiens
atcttagagtttacagtttgtg

SEQ ID NO: 1097663 - DNA, 18 bp, Homo sapiens
atcttagataacttcttg

SEQ ID NO: 1097664 - DNA, 19 bp, Homo sapiens
atcttagataacttcttga

SEQ ID NO: 1097665 - DNA, 20 bp, Homo sapiens
atcttagataacttcttgaa

SEQ ID NO: 1097666 - DNA, 16 bp, Homo sapiens
atcttagctggatata

SEQ ID NO: 1097667 - DNA, 17 bp, Homo sapiens
atcttaggcatgtgctg

SEQ ID NO: 1097668 - DNA, 20 bp, Homo sapiens
atcttaggggagagctttct

SEQ ID NO: 1097669 - DNA, 18 bp, Homo sapiens
atcttagtgcctgagagt

SEQ ID NO: 1097670 - DNA, 21 bp, Homo sapiens
atcttagtgcctgagagtatt

SEQ ID NO: 1097671 - DNA, 14 bp, Homo sapiens
atcttagtgtatga

SEQ ID NO: 1097672 - DNA, 19 bp, Homo sapiens
atcttagtgtatgattact

SEQ ID NO: 1097673 - DNA, 23 bp, Homo sapiens
atcttagtttggattcttatgta

SEQ ID NO: 1097674 - DNA, 14 bp, Homo sapiens
atcttataattgtt

SEQ ID NO: 1097675 - DNA, 16 bp, Homo sapiens
atcttataattgttct

SEQ ID NO: 1097676 - DNA, 13 bp, Homo sapiens
atcttatactgta

SEQ ID NO: 1097677 - DNA, 16 bp, Homo sapiens
atcttatactgtacaa

SEQ ID NO: 1097678 - DNA, 19 bp, Homo sapiens
atcttatactgtacaataa

SEQ ID NO: 1097679 - DNA, 13 bp, Homo sapiens
atcttatcttttg

SEQ ID NO: 1097680 - DNA, 13 bp, Homo sapiens
atcttattcacat

SEQ ID NO: 1097681 - DNA, 18 bp, Homo sapiens
atcttattcattttctct

SEQ ID NO: 1097682 - DNA, 19 bp, Homo sapiens
atcttattccgagcattcc

SEQ ID NO: 1097683 - DNA, 15 bp, Homo sapiens
atcttattttatctt

SEQ ID NO: 1097684 - DNA, 16 bp, Homo sapiens
atcttcaaactttcac

SEQ ID NO: 1097685 - DNA, 15 bp, Homo sapiens
atcttcaaagcttga

SEQ ID NO: 1097686 - DNA, 19 bp, Homo sapiens
atcttcaaagcttgaagat

SEQ ID NO: 1097687 - DNA, 20 bp, Homo sapiens
atcttcaatatgaatctata

SEQ ID NO: 1097688 - DNA, 15 bp, Homo sapiens
atcttcaatggcttt

SEQ ID NO: 1097689 - DNA, 14 bp, Homo sapiens
atcttcaatttgga

SEQ ID NO: 1097690 - DNA, 16 bp, Homo sapiens
atcttcacctcagagt

SEQ ID NO: 1097691 - DNA, 18 bp, Homo sapiens
atcttcacctcagagtgg

SEQ ID NO: 1097692 - DNA, 22 bp, Homo sapiens
atcttcactgcaattttgtgta

SEQ ID NO: 1097693 - DNA, 23 bp, Homo sapiens
atcttcacttctaaatgcatatc

SEQ ID NO: 1097694 - DNA, 16 bp, Homo sapiens
atgaaccctcttgcca

SEQ ID NO: 1097695 - DNA, 15 bp, Homo sapiens
atgaacctattttca

SEQ ID NO: 1097696 - DNA, 17 bp, Homo sapiens
atgaaccttctggcctc

SEQ ID NO: 1097697 - DNA, 21 bp, Homo sapiens
atgaaccttctggcctcccac

SEQ ID NO: 1097698 - DNA, 12 bp, Homo sapiens
atgaactagtga

SEQ ID NO: 1097699 - DNA, 13 bp, Homo sapiens
atgaactattccc

SEQ ID NO: 1097700 - DNA, 20 bp, Homo sapiens
atgaactattccccagcagg

SEQ ID NO: 1097701 - DNA, 17 bp, Homo sapiens
atgaactgaagtttcac

SEQ ID NO: 1097702 - DNA, 17 bp, Homo sapiens
atgaactgtggaattta

SEQ ID NO: 1097703 - DNA, 20 bp, Homo sapiens
atgaactgtggaatttattg

SEQ ID NO: 1097704 - DNA, 18 bp, Homo sapiens
atgaacttattctgtaga

SEQ ID NO: 1097705 - DNA, 13 bp, Homo sapiens
atgaactttaaaa

SEQ ID NO: 1097706 - DNA, 17 bp, Homo sapiens
atgaactttgtcattat

SEQ ID NO: 1097707 - DNA, 19 bp, Homo sapiens
atgaagaaaagtgggccag

SEQ ID NO: 1097708 - DNA, 18 bp, Homo sapiens
atgaagaaagtcaaaaaa

SEQ ID NO: 1097709 - DNA, 18 bp, Homo sapiens
atgaagaacacagcatgt

SEQ ID NO: 1097710 - DNA, 15 bp, Homo sapiens
atgaagaatcacgat

SEQ ID NO: 1097711 - DNA, 18 bp, Homo sapiens
atgaagagaagcaatttt

SEQ ID NO: 1097712 - DNA, 18 bp, Homo sapiens
atgaagagctagagaaat

SEQ ID NO: 1097713 - DNA, 12 bp, Homo sapiens
atgaagagctgt

SEQ ID NO: 1097714 - DNA, 19 bp, Homo sapiens
atgaagagctgtcttcccc

SEQ ID NO: 1097715 - DNA, 19 bp, Homo sapiens
atgaagagtgagagggcat

SEQ ID NO: 1097716 - DNA, 21 bp, Homo sapiens
atgaagatgtctaatagttat

SEQ ID NO: 1097717 - DNA, 21 bp, Homo sapiens
atgaagattggtgggattttt

SEQ ID NO: 1097718 - DNA, 15 bp, Homo sapiens
atgaagcagctttaa

SEQ ID NO: 1097719 - DNA, 16 bp, Homo sapiens
atgaagcccaataaac

SEQ ID NO: 1097720 - DNA, 14 bp, Homo sapiens
atgaagccttgctg

SEQ ID NO: 1097721 - DNA, 14 bp, Homo sapiens
atgaagctacctca

SEQ ID NO: 1097722 - DNA, 17 bp, Homo sapiens
atgaaggaaagtgtatg

SEQ ID NO: 1097723 - DNA, 22 bp, Homo sapiens
atgaaggaatcattccagtgct

SEQ ID NO: 1097724 - DNA, 21 bp, Homo sapiens
atgaaggaatttgattgcttt

SEQ ID NO: 1097725 - DNA, 14 bp, Homo sapiens
atgaaggatgaagt

SEQ ID NO: 1097726 - DNA, 16 bp, Homo sapiens
atgaaggcaaaaaaat

SEQ ID NO: 1097727 - DNA, 15 bp, Homo sapiens
atgaaggtaaataaa

SEQ ID NO: 1097728 - DNA, 20 bp, Homo sapiens
atgaaggtaatattgataag

SEQ ID NO: 1097729 - DNA, 20 bp, Homo sapiens
atgaaggttaggatttaaca

SEQ ID NO: 1097730 - DNA, 15 bp, Homo sapiens
atgaagtaaattatg

SEQ ID NO: 1097731 - DNA, 21 bp, Homo sapiens
atgaagtaatatgcacacatt

SEQ ID NO: 1097732 - DNA, 23 bp, Homo sapiens
atgaagtaatatgcacacatttt

SEQ ID NO: 1097733 - DNA, 15 bp, Homo sapiens
atgaagtataaatct

SEQ ID NO: 1097734 - DNA, 16 bp, Homo sapiens
atgaagtataaatctg

SEQ ID NO: 1097735 - DNA, 18 bp, Homo sapiens
atgaagtgcgtgaatgta

SEQ ID NO: 1097736 - DNA, 20 bp, Homo sapiens
atgaagtgcgtgaatgtatg

SEQ ID NO: 1097737 - DNA, 16 bp, Homo sapiens
atgaagttgctgttta

SEQ ID NO: 1097738 - DNA, 18 bp, Homo sapiens
atgaagttgctgtttatt

SEQ ID NO: 1097739 - DNA, 19 bp, Homo sapiens
atgaagtttgaacttcata

SEQ ID NO: 1097740 - DNA, 17 bp, Homo sapiens
atgaataaactgaatat

SEQ ID NO: 1097741 - DNA, 15 bp, Homo sapiens
atgaataaagaatgc

SEQ ID NO: 1097742 - DNA, 17 bp, Homo sapiens
atgaataaagaatgcca

SEQ ID NO: 1097743 - DNA, 23 bp, Homo sapiens
atgaataaagaatgccatttctc

SEQ ID NO: 1097744 - DNA, 18 bp, Homo sapiens
atgaataacatttaaatt

SEQ ID NO: 1097745 - DNA, 22 bp, Homo sapiens
atgaataagctttctctcagaa

SEQ ID NO: 1097746 - DNA, 16 bp, Homo sapiens
atgaataatgaaaata

SEQ ID NO: 1097747 - DNA, 19 bp, Homo sapiens
atgaataatgcctttgtaa

SEQ ID NO: 1097748 - DNA, 20 bp, Homo sapiens
atgaataatgcctttgtaac

SEQ ID NO: 1097749 - DNA, 14 bp, Homo sapiens
atgaataatggaaa

SEQ ID NO: 1097750 - DNA, 17 bp, Homo sapiens
atgaataatttattatt

SEQ ID NO: 1097751 - DNA, 14 bp, Homo sapiens
atgaatacatttcc

SEQ ID NO: 1097752 - DNA, 16 bp, Homo sapiens
atgaatagcttgtttc

SEQ ID NO: 1097753 - DNA, 21 bp, Homo sapiens
atgaatagcttgtttctgtca

SEQ ID NO: 1097754 - DNA, 18 bp, Homo sapiens
atgaatatcatacaaatc

SEQ ID NO: 1097755 - DNA, 20 bp, Homo sapiens
atgaatatctattaatatat

SEQ ID NO: 1097756 - DNA, 22 bp, Homo sapiens
atgaatatctattaatatatgt

SEQ ID NO: 1097757 - DNA, 22 bp, Homo sapiens
atgaatattactctcaaaatct

SEQ ID NO: 1097758 - DNA, 13 bp, Homo sapiens
atgaatattgatg

SEQ ID NO: 1097759 - DNA, 14 bp, Homo sapiens
atgaatcaatgaaa

SEQ ID NO: 1097760 - DNA, 20 bp, Homo sapiens
atgaatcagttttggaatct

SEQ ID NO: 1097761 - DNA, 20 bp, Homo sapiens
atgaatcattgttaaccaca

SEQ ID NO: 1097762 - DNA, 17 bp, Homo sapiens
atgaatccattggagaa

SEQ ID NO: 1097763 - DNA, 17 bp, Homo sapiens
atgaatccccgaccccc

SEQ ID NO: 1097764 - DNA, 19 bp, Homo sapiens
atgaatccccgacccccct

SEQ ID NO: 1097765 - DNA, 21 bp, Homo sapiens
atgaatctttcatacatatat

SEQ ID NO: 1097766 - DNA, 16 bp, Homo sapiens
atgaatgagaatctac

SEQ ID NO: 1097767 - DNA, 19 bp, Homo sapiens
atgaatgaggtcccaggca

SEQ ID NO: 1097768 - DNA, 17 bp, Homo sapiens
atgaatgatatctttga

SEQ ID NO: 1097769 - DNA, 18 bp, Homo sapiens
atgaatgcaaaattgttt

SEQ ID NO: 1097770 - DNA, 18 bp, Homo sapiens
atgaatgcccccagctgg

SEQ ID NO: 1097771 - DNA, 23 bp, Homo sapiens
atgaatggactcaaactgccttg

SEQ ID NO: 1097772 - DNA, 21 bp, Homo sapiens
atgaatggtatggaactctct

SEQ ID NO: 1097773 - DNA, 18 bp, Homo sapiens
atgaatgtatgtgcactg

SEQ ID NO: 1097774 - DNA, 19 bp, Homo sapiens
atgaatgtatgtgcactgt

SEQ ID NO: 1097775 - DNA, 17 bp, Homo sapiens
atgaatgtatttatttg

SEQ ID NO: 1097776 - DNA, 12 bp, Homo sapiens
atgaatgtcaca

SEQ ID NO: 1097777 - DNA, 14 bp, Homo sapiens
atgaatgtgctggt

SEQ ID NO: 1097778 - DNA, 15 bp, Homo sapiens
atgaatgtgctggtg

SEQ ID NO: 1097779 - DNA, 11 bp, Homo sapiens
atgaatgttta

SEQ ID NO: 1097780 - DNA, 14 bp, Homo sapiens
atgaattaaagtgg

SEQ ID NO: 1097781 - DNA, 15 bp, Homo sapiens
atgaattataaatgt

SEQ ID NO: 1097782 - DNA, 23 bp, Homo sapiens
atgaattcgatgcgtattctgtg

SEQ ID NO: 1097783 - DNA, 15 bp, Homo sapiens
atgaattcttcctct

SEQ ID NO: 1097784 - DNA, 14 bp, Homo sapiens
atgaattgtctaaa

SEQ ID NO: 1097785 - DNA, 16 bp, Homo sapiens
atgaatttaaatataa

SEQ ID NO: 1097786 - DNA, 21 bp, Homo sapiens
atgaatttattgcacattgtt

SEQ ID NO: 1097787 - DNA, 17 bp, Homo sapiens
atgaatttcatgtgaat

SEQ ID NO: 1097788 - DNA, 20 bp, Homo sapiens
atgaatttctaccagatgtg

SEQ ID NO: 1097789 - DNA, 14 bp, Homo sapiens
atgaatttgtccaa

SEQ ID NO: 1097790 - DNA, 17 bp, Homo sapiens
atgaattttaaagtatg

SEQ ID NO: 1097791 - DNA, 22 bp, Homo sapiens
atgaattttcaagtaattgtga

SEQ ID NO: 1097792 - DNA, 19 bp, Homo sapiens
atgaattttgtatgctgaa

SEQ ID NO: 1097793 - DNA, 23 bp, Homo sapiens
atgaattttgtatgctgaatttc

SEQ ID NO: 1097794 - DNA, 22 bp, Homo sapiens
atgaatttttttcatcttctct

SEQ ID NO: 1097795 - DNA, 23 bp, Homo sapiens
atgaatttttttcatcttctctg

SEQ ID NO: 1097796 - DNA, 14 bp, Homo sapiens
atgacaaaaaatgt

SEQ ID NO: 1097797 - DNA, 17 bp, Homo sapiens
atgacaaaaaatgtttt

SEQ ID NO: 1097798 - DNA, 19 bp, Homo sapiens
atgacaaacctagctttta

SEQ ID NO: 1097799 - DNA, 13 bp, Homo sapiens
atgacaaagccat

SEQ ID NO: 1097800 - DNA, 14 bp, Homo sapiens
atgacaaagccatt

SEQ ID NO: 1097801 - DNA, 14 bp, Homo sapiens
atgacaacagaagc

SEQ ID NO: 1097802 - DNA, 15 bp, Homo sapiens
atgacaagccccagg

SEQ ID NO: 1097803 - DNA, 21 bp, Homo sapiens
atgacacaaaggtggaataaa

SEQ ID NO: 1097804 - DNA, 14 bp, Homo sapiens
atgacacatgcaag

SEQ ID NO: 1097805 - DNA, 22 bp, Homo sapiens
atgacacatgcaaggtcatttt

SEQ ID NO: 1097806 - DNA, 15 bp, Homo sapiens
atgacaccatctttt

SEQ ID NO: 1097807 - DNA, 20 bp, Homo sapiens
atgacaccatcttttattct

SEQ ID NO: 1097808 - DNA, 15 bp, Homo sapiens
atgacacccatgcca

SEQ ID NO: 1097809 - DNA, 14 bp, Homo sapiens
atgacaccctggcc

SEQ ID NO: 1097810 - DNA, 15 bp, Homo sapiens
atgacaccctggcct

SEQ ID NO: 1097811 - DNA, 16 bp, Homo sapiens
atgacaccctggcctg

SEQ ID NO: 1097812 - DNA, 15 bp, Homo sapiens
atgacactcctagac

SEQ ID NO: 1097813 - DNA, 22 bp, Homo sapiens
atgacactctagtgacttcctg

SEQ ID NO: 1097814 - DNA, 16 bp, Homo sapiens
atgacactgttcagga

SEQ ID NO: 1097815 - DNA, 15 bp, Homo sapiens
atgacagaggctgca

SEQ ID NO: 1097816 - DNA, 14 bp, Homo sapiens
atgataaaagagaa

SEQ ID NO: 1097817 - DNA, 17 bp, Homo sapiens
atgataaaaggaatctg

SEQ ID NO: 1097818 - DNA, 14 bp, Homo sapiens
atgataaaataaat

SEQ ID NO: 1097819 - DNA, 21 bp, Homo sapiens
atgataaaataaataatttta

SEQ ID NO: 1097820 - DNA, 15 bp, Homo sapiens
atgataaactcagat

SEQ ID NO: 1097821 - DNA, 22 bp, Homo sapiens
atgataaactcagatctgatca

SEQ ID NO: 1097822 - DNA, 17 bp, Homo sapiens
atgataaagttgtaaat

SEQ ID NO: 1097823 - DNA, 18 bp, Homo sapiens
atgataaagttgtaaata

SEQ ID NO: 1097824 - DNA, 12 bp, Homo sapiens
atgataaatatt

SEQ ID NO: 1097825 - DNA, 14 bp, Homo sapiens
atgataagaacaga

SEQ ID NO: 1097826 - DNA, 20 bp, Homo sapiens
atgataagttcctttccttt

SEQ ID NO: 1097827 - DNA, 15 bp, Homo sapiens
atgataatgaacaga

SEQ ID NO: 1097828 - DNA, 13 bp, Homo sapiens
atgatacaatgaa

SEQ ID NO: 1097829 - DNA, 17 bp, Homo sapiens
atgatacaatgaacact

SEQ ID NO: 1097830 - DNA, 13 bp, Homo sapiens
atgatacattttt

SEQ ID NO: 1097831 - DNA, 19 bp, Homo sapiens
atgataccacctttactgt

SEQ ID NO: 1097832 - DNA, 19 bp, Homo sapiens
atgatactaataaactaat

SEQ ID NO: 1097833 - DNA, 21 bp, Homo sapiens
atgatactatcatactactga

SEQ ID NO: 1097834 - DNA, 18 bp, Homo sapiens
atgatactcatttcttat

SEQ ID NO: 1097835 - DNA, 12 bp, Homo sapiens
atgatactgtgt

SEQ ID NO: 1097836 - DNA, 15 bp, Homo sapiens
atgatacttgaattt

SEQ ID NO: 1097837 - DNA, 20 bp, Homo sapiens
atgatagcgggaaaaggaga

SEQ ID NO: 1097838 - DNA, 15 bp, Homo sapiens
atgatagttgaatgt

SEQ ID NO: 1097839 - DNA, 19 bp, Homo sapiens
atgatatctatatatgtat

SEQ ID NO: 1097840 - DNA, 17 bp, Homo sapiens
atgatatgcttgtaact

SEQ ID NO: 1097841 - DNA, 23 bp, Homo sapiens
atgatatgcttgtaactaaaata

SEQ ID NO: 1097842 - DNA, 23 bp, Homo sapiens
atgatattgctgaagaatctact

SEQ ID NO: 1097843 - DNA, 22 bp, Homo sapiens
atgatattgtttaaaattcagt

SEQ ID NO: 1097844 - DNA, 12 bp, Homo sapiens
atgatattttat

SEQ ID NO: 1097845 - DNA, 13 bp, Homo sapiens
atgatcaaaacat

SEQ ID NO: 1097846 - DNA, 13 bp, Homo sapiens
atgatcaagatat

SEQ ID NO: 1097847 - DNA, 18 bp, Homo sapiens
atgatcaccatgttagcc

SEQ ID NO: 1097848 - DNA, 21 bp, Homo sapiens
atgatcaccatgttagcctta

SEQ ID NO: 1097849 - DNA, 22 bp, Homo sapiens
atgatcactaatactaattcat

SEQ ID NO: 1097850 - DNA, 22 bp, Homo sapiens
atgatcagaagaacatgatttt

SEQ ID NO: 1097851 - DNA, 16 bp, Homo sapiens
atgatcagacatacag

SEQ ID NO: 1097852 - DNA, 16 bp, Homo sapiens
atgatcagggatccaa

SEQ ID NO: 1097853 - DNA, 17 bp, Homo sapiens
atgatcagtgttactgc

SEQ ID NO: 1097854 - DNA, 20 bp, Homo sapiens
atgatcagtgttgttgctct

SEQ ID NO: 1097855 - DNA, 11 bp, Homo sapiens
atgatcatgaa

SEQ ID NO: 1097856 - DNA, 13 bp, Homo sapiens
atgatcatgaaac

SEQ ID NO: 1097857 - DNA, 18 bp, Homo sapiens
atgatcattgaaatactt

SEQ ID NO: 1097858 - DNA, 15 bp, Homo sapiens
atgatccagaacagt

SEQ ID NO: 1097859 - DNA, 19 bp, Homo sapiens
atgatccagagcagagttt

SEQ ID NO: 1097860 - DNA, 20 bp, Homo sapiens
atgatccctgtgttgtctct

SEQ ID NO: 1097861 - DNA, 19 bp, Homo sapiens
atgatccttttttgtcatt

SEQ ID NO: 1097862 - DNA, 22 bp, Homo sapiens
atgatcgaaaaaataattattt

SEQ ID NO: 1097863 - DNA, 15 bp, Homo sapiens
atgatctgtctgtgg

SEQ ID NO: 1097864 - DNA, 15 bp, Homo sapiens
atgatcttgtgacat

SEQ ID NO: 1097865 - DNA, 12 bp, Homo sapiens
atgatgaatgag

SEQ ID NO: 1097866 - DNA, 17 bp, Homo sapiens
atgatgactcaaggcca

SEQ ID NO: 1097867 - DNA, 23 bp, Homo sapiens
atgatgactcaaggccaataata

SEQ ID NO: 1097868 - DNA, 16 bp, Homo sapiens
atgatgagaggccagc

SEQ ID NO: 1097869 - DNA, 15 bp, Homo sapiens
atgatgatctgcctc

SEQ ID NO: 1097870 - DNA, 13 bp, Homo sapiens
atgatgatgttaa

SEQ ID NO: 1097871 - DNA, 15 bp, Homo sapiens
atgatgatgttaacc

SEQ ID NO: 1097872 - DNA, 19 bp, Homo sapiens
atgatgcagctgttgagaa

SEQ ID NO: 1097873 - DNA, 23 bp, Homo sapiens
atgatgccctcccctcagcgcag

SEQ ID NO: 1097874 - DNA, 24 bp, Homo sapiens
atgatgccctcccctcagcgcagg

SEQ ID NO: 1097875 - DNA, 17 bp, Homo sapiens
atgatgctaagctgata

SEQ ID NO: 1097876 - DNA, 15 bp, Homo sapiens
atgatgctgtgacaa

SEQ ID NO: 1097877 - DNA, 22 bp, Homo sapiens
atgatgcttctataattttgcc

SEQ ID NO: 1097878 - DNA, 14 bp, Homo sapiens
atgatggaagtgtt

SEQ ID NO: 1097879 - DNA, 14 bp, Homo sapiens
atgatggatggcag

SEQ ID NO: 1097880 - DNA, 18 bp, Homo sapiens
atgatggatggcagactc

SEQ ID NO: 1097881 - DNA, 21 bp, Homo sapiens
atgatggcagagccaggctgt

SEQ ID NO: 1097882 - DNA, 16 bp, Homo sapiens
atgatggccatttcta

SEQ ID NO: 1097883 - DNA, 22 bp, Homo sapiens
atgatgggaatagggagacagg

SEQ ID NO: 1097884 - DNA, 17 bp, Homo sapiens
atgatgggcttctgttc

SEQ ID NO: 1097885 - DNA, 22 bp, Homo sapiens
atgatggtgttaaagctgtaca

SEQ ID NO: 1097886 - DNA, 16 bp, Homo sapiens
atgatgtcacacaagc

SEQ ID NO: 1097887 - DNA, 18 bp, Homo sapiens
atgatgtccagaagaata

SEQ ID NO: 1097888 - DNA, 19 bp, Homo sapiens
atgatgtccagaagaatat

SEQ ID NO: 1097889 - DNA, 18 bp, Homo sapiens
atgatgtctacagaaaat

SEQ ID NO: 1097890 - DNA, 21 bp, Homo sapiens
atgatgtctacagaaaatgct

SEQ ID NO: 1097891 - DNA, 15 bp, Homo sapiens
atgatgtctcttgta

SEQ ID NO: 1097892 - DNA, 22 bp, Homo sapiens
atgatgtggacatatgtatact

SEQ ID NO: 1097893 - DNA, 20 bp, Homo sapiens
atgatgtggtgcctgaggtc

SEQ ID NO: 1097894 - DNA, 13 bp, Homo sapiens
atgatgtgtgagt

SEQ ID NO: 1097895 - DNA, 21 bp, Homo sapiens
atgatgttaaaaaaataagaa

SEQ ID NO: 1097896 - DNA, 22 bp, Homo sapiens
atgatgttaaaaaaataagaag

SEQ ID NO: 1097897 - DNA, 21 bp, Homo sapiens
atgatgttagaagaagaggaa

SEQ ID NO: 1097898 - DNA, 21 bp, Homo sapiens
atgatgtttcgtgaagtatac

SEQ ID NO: 1097899 - DNA, 11 bp, Homo sapiens
atgatgtttgc

SEQ ID NO: 1097900 - DNA, 19 bp, Homo sapiens
atgatgtttgcccaaaatt

SEQ ID NO: 1097901 - DNA, 15 bp, Homo sapiens
atgatgttttaaaaa

SEQ ID NO: 1097902 - DNA, 21 bp, Homo sapiens
atgatgttttaaaaaaatttg

SEQ ID NO: 1097903 - DNA, 16 bp, Homo sapiens
atgattaattcacctt

SEQ ID NO: 1097904 - DNA, 19 bp, Homo sapiens
atgattactctttgagata

SEQ ID NO: 1097905 - DNA, 15 bp, Homo sapiens
atgattactggcctt

SEQ ID NO: 1097906 - DNA, 22 bp, Homo sapiens
atgattagaaattacctgtgga

SEQ ID NO: 1097907 - DNA, 23 bp, Homo sapiens
atgattagaaattacctgtggat

SEQ ID NO: 1097908 - DNA, 16 bp, Homo sapiens
atgattcaaatgtttt

SEQ ID NO: 1097909 - DNA, 14 bp, Homo sapiens
atgattcaacctga

SEQ ID NO: 1097910 - DNA, 13 bp, Homo sapiens
atgattcaagcca

SEQ ID NO: 1097911 - DNA, 23 bp, Homo sapiens
atgattcacatgctaaagccagg

SEQ ID NO: 1097912 - DNA, 14 bp, Homo sapiens
atgattcagaaatt

SEQ ID NO: 1097913 - DNA, 12 bp, Homo sapiens
atgattccaaat

SEQ ID NO: 1097914 - DNA, 22 bp, Homo sapiens
atgattccaatctctgttctgt

SEQ ID NO: 1097915 - DNA, 14 bp, Homo sapiens
atgattccatgccc

SEQ ID NO: 1097916 - DNA, 22 bp, Homo sapiens
atgattctagtacataattgat

SEQ ID NO: 1097917 - DNA, 23 bp, Homo sapiens
atgattctagtacataattgatt

SEQ ID NO: 1097918 - DNA, 23 bp, Homo sapiens
atgattctatttatatgtacatg

SEQ ID NO: 1097919 - DNA, 13 bp, Homo sapiens
atgattctctgtg

SEQ ID NO: 1097920 - DNA, 16 bp, Homo sapiens
atgattctctgtggtt

SEQ ID NO: 1097921 - DNA, 21 bp, Homo sapiens
atgattctgaacttttgtgga

SEQ ID NO: 1097922 - DNA, 22 bp, Homo sapiens
atgattcttaacacagccttcc

SEQ ID NO: 1097923 - DNA, 12 bp, Homo sapiens
atgattgaaaat

SEQ ID NO: 1097924 - DNA, 19 bp, Homo sapiens
atgattggaatattacaat

SEQ ID NO: 1097925 - DNA, 22 bp, Homo sapiens
atgattggattattcatttaaa

SEQ ID NO: 1097926 - DNA, 15 bp, Homo sapiens
atgattggcttaaag

SEQ ID NO: 1097927 - DNA, 20 bp, Homo sapiens
atgattggcttaaagtgaag

SEQ ID NO: 1097928 - DNA, 21 bp, Homo sapiens
atgattggttaaaatgtgatt

SEQ ID NO: 1097929 - DNA, 15 bp, Homo sapiens
atgattggttcagtt

SEQ ID NO: 1097930 - DNA, 20 bp, Homo sapiens
atgatttataaacagacaat

SEQ ID NO: 1097931 - DNA, 19 bp, Homo sapiens
atgatttcatcttctggaa

SEQ ID NO: 1097932 - DNA, 21 bp, Homo sapiens
atgatttcatcttctggaata

SEQ ID NO: 1097933 - DNA, 22 bp, Homo sapiens
atgatttcatcttctggaatat

SEQ ID NO: 1097934 - DNA, 14 bp, Homo sapiens
atgatttcatttca

SEQ ID NO: 1097935 - DNA, 20 bp, Homo sapiens
atgatttccaaagagaaaaa

SEQ ID NO: 1097936 - DNA, 20 bp, Homo sapiens
atgatttccttgaatgtggc

SEQ ID NO: 1097937 - DNA, 13 bp, Homo sapiens
atgctctctgcag

SEQ ID NO: 1097938 - DNA, 15 bp, Homo sapiens
atgctctgcatgtta

SEQ ID NO: 1097939 - DNA, 12 bp, Homo sapiens
atgctctgcccc

SEQ ID NO: 1097940 - DNA, 13 bp, Homo sapiens
atgctctgcccca

SEQ ID NO: 1097941 - DNA, 16 bp, Homo sapiens
atgctctggaagcctg

SEQ ID NO: 1097942 - DNA, 21 bp, Homo sapiens
atgctctggcttgccccagga

SEQ ID NO: 1097943 - DNA, 15 bp, Homo sapiens
atgctcttaaaatat

SEQ ID NO: 1097944 - DNA, 16 bp, Homo sapiens
atgctcttaaaatatc

SEQ ID NO: 1097945 - DNA, 23 bp, Homo sapiens
atgctcttaaaatatcttccttt

SEQ ID NO: 1097946 - DNA, 21 bp, Homo sapiens
atgctcttggggttcataggg

SEQ ID NO: 1097947 - DNA, 16 bp, Homo sapiens
atgctctttacttcat

SEQ ID NO: 1097948 - DNA, 23 bp, Homo sapiens
atgctgaacattgcatataactt

SEQ ID NO: 1097949 - DNA, 15 bp, Homo sapiens
atgctgaagacattc

SEQ ID NO: 1097950 - DNA, 19 bp, Homo sapiens
atgctgaatatctgttcac

SEQ ID NO: 1097951 - DNA, 18 bp, Homo sapiens
atgctgaatgccccctgc

SEQ ID NO: 1097952 - DNA, 19 bp, Homo sapiens
atgctgactgtactcctcc

SEQ ID NO: 1097953 - DNA, 14 bp, Homo sapiens
atgctgagctgtga

SEQ ID NO: 1097954 - DNA, 23 bp, Homo sapiens
atgctgaggatataagcttttag

SEQ ID NO: 1097955 - DNA, 14 bp, Homo sapiens
atgctgaggcctgg

SEQ ID NO: 1097956 - DNA, 18 bp, Homo sapiens
atgctgaggcctgggccg

SEQ ID NO: 1097957 - DNA, 23 bp, Homo sapiens
atgctgagggtgtttcttcctgc

SEQ ID NO: 1097958 - DNA, 21 bp, Homo sapiens
atgctgaggttttgaataaaa

SEQ ID NO: 1097959 - DNA, 12 bp, Homo sapiens
atgctgatcatc

SEQ ID NO: 1097960 - DNA, 14 bp, Homo sapiens
atgctgatcatcgc

SEQ ID NO: 1097961 - DNA, 19 bp, Homo sapiens
atgctgatcatcgccagag

SEQ ID NO: 1097962 - DNA, 22 bp, Homo sapiens
atgctgatcatcgccagaggtg

SEQ ID NO: 1097963 - DNA, 17 bp, Homo sapiens
atgctgatcttttaaaa

SEQ ID NO: 1097964 - DNA, 18 bp, Homo sapiens
atgctgatcttttaaaat

SEQ ID NO: 1097965 - DNA, 13 bp, Homo sapiens
atgctgatggagc

SEQ ID NO: 1097966 - DNA, 16 bp, Homo sapiens
atgctgcaaaggagaa

SEQ ID NO: 1097967 - DNA, 15 bp, Homo sapiens
atgctgcaggaaaag

SEQ ID NO: 1097968 - DNA, 12 bp, Homo sapiens
atgctgccagtg

SEQ ID NO: 1097969 - DNA, 16 bp, Homo sapiens
atgctgccattcttga

SEQ ID NO: 1097970 - DNA, 13 bp, Homo sapiens
atgctgcctgagt

SEQ ID NO: 1097971 - DNA, 14 bp, Homo sapiens
atgctgcctgcctg

SEQ ID NO: 1097972 - DNA, 18 bp, Homo sapiens
atgctgcctgcctgtctg

SEQ ID NO: 1097973 - DNA, 13 bp, Homo sapiens
atgctgcctggca

SEQ ID NO: 1097974 - DNA, 14 bp, Homo sapiens
atgctgcctggcac

SEQ ID NO: 1097975 - DNA, 18 bp, Homo sapiens
atgctgccttttctttaa

SEQ ID NO: 1097976 - DNA, 21 bp, Homo sapiens
atgctgctacttaattccttt

SEQ ID NO: 1097977 - DNA, 22 bp, Homo sapiens
atgctgctctcagcctcccaca

SEQ ID NO: 1097978 - DNA, 12 bp, Homo sapiens
atgctgctggcc

SEQ ID NO: 1097979 - DNA, 13 bp, Homo sapiens
atgctgctggcca

SEQ ID NO: 1097980 - DNA, 11 bp, Homo sapiens
atgctgctttt

SEQ ID NO: 1097981 - DNA, 21 bp, Homo sapiens
atgctgcttttcttttctaac

SEQ ID NO: 1097982 - DNA, 17 bp, Homo sapiens
atgctggaacctgcaaa

SEQ ID NO: 1097983 - DNA, 18 bp, Homo sapiens
atgctggaacctgcaaaa

SEQ ID NO: 1097984 - DNA, 22 bp, Homo sapiens
atgctggacggcattcctgctt

SEQ ID NO: 1097985 - DNA, 16 bp, Homo sapiens
atgctggactggaggc

SEQ ID NO: 1097986 - DNA, 22 bp, Homo sapiens
atgctggactggaggcccctgg

SEQ ID NO: 1097987 - DNA, 13 bp, Homo sapiens
atgctggagggag

SEQ ID NO: 1097988 - DNA, 23 bp, Homo sapiens
atgctggcatttgcacctacctc

SEQ ID NO: 1097989 - DNA, 13 bp, Homo sapiens
atgctggccagca

SEQ ID NO: 1097990 - DNA, 18 bp, Homo sapiens
atgctggcctgactggtt

SEQ ID NO: 1097991 - DNA, 22 bp, Homo sapiens
atgctggctatagatgtctttt

SEQ ID NO: 1097992 - DNA, 20 bp, Homo sapiens
atgctggctgagctgaacac

SEQ ID NO: 1097993 - DNA, 23 bp, Homo sapiens
atgctgggaagacgcctgagctc

SEQ ID NO: 1097994 - DNA, 10 bp, Homo sapiens
atgctgggac

SEQ ID NO: 1097995 - DNA, 15 bp, Homo sapiens
atgctgggactcagc

SEQ ID NO: 1097996 - DNA, 20 bp, Homo sapiens
atgctgggcccccagcctgg

SEQ ID NO: 1097997 - DNA, 19 bp, Homo sapiens
atgctgggctctgttcttg

SEQ ID NO: 1097998 - DNA, 23 bp, Homo sapiens
atgctgggctgtctctcccttcc

SEQ ID NO: 1097999 - DNA, 22 bp, Homo sapiens
atgctggggcaagtccctgact

SEQ ID NO: 1098000 - DNA, 19 bp, Homo sapiens
atgctgggttggtgcacag

SEQ ID NO: 1098001 - DNA, 22 bp, Homo sapiens
atgctggtggctggtgagaccc

SEQ ID NO: 1098002 - DNA, 22 bp, Homo sapiens
atgctggttttcctaaatgcag

SEQ ID NO: 1098003 - DNA, 14 bp, Homo sapiens
atgctgtatatgtt

SEQ ID NO: 1098004 - DNA, 14 bp, Homo sapiens
atgctgtatttctt

SEQ ID NO: 1098005 - DNA, 17 bp, Homo sapiens
atgctgtatttctttgt

SEQ ID NO: 1098006 - DNA, 22 bp, Homo sapiens
atgctgtatttctttgtagaat

SEQ ID NO: 1098007 - DNA, 18 bp, Homo sapiens
atgctgtattttaacact

SEQ ID NO: 1098008 - DNA, 22 bp, Homo sapiens
atgctgtcaactatgatatggt

SEQ ID NO: 1098009 - DNA, 16 bp, Homo sapiens
atgctgtcactggcag

SEQ ID NO: 1098010 - DNA, 11 bp, Homo sapiens
atgctgtgaca

SEQ ID NO: 1098011 - DNA, 19 bp, Homo sapiens
atgctgtgccctaaagtgt

SEQ ID NO: 1098012 - DNA, 22 bp, Homo sapiens
atgctgtgccctaaagtgtatt

SEQ ID NO: 1098013 - DNA, 18 bp, Homo sapiens
atgctgtgcgcccagggc

SEQ ID NO: 1098014 - DNA, 20 bp, Homo sapiens
atgctgtgcgcccagggctg

SEQ ID NO: 1098015 - DNA, 18 bp, Homo sapiens
atgctgtgctccatattt

SEQ ID NO: 1098016 - DNA, 14 bp, Homo sapiens
atgctgtgctcttt

SEQ ID NO: 1098017 - DNA, 16 bp, Homo sapiens
atgctgtgctctttga

SEQ ID NO: 1098018 - DNA, 14 bp, Homo sapiens
atgctgtgtgccca

SEQ ID NO: 1098019 - DNA, 21 bp, Homo sapiens
atgctgtgtgcccaagtgggc

SEQ ID NO: 1098020 - DNA, 22 bp, Homo sapiens
atgctgtgtgcccaagtgggca

SEQ ID NO: 1098021 - DNA, 17 bp, Homo sapiens
atgctgttgcctcatct

SEQ ID NO: 1098022 - DNA, 14 bp, Homo sapiens
atgctgttgtaaac

SEQ ID NO: 1098023 - DNA, 16 bp, Homo sapiens
atgctgttgtgaagct

SEQ ID NO: 1098024 - DNA, 13 bp, Homo sapiens
atgctgtttctaa

SEQ ID NO: 1098025 - DNA, 15 bp, Homo sapiens
atgctgtttctaaga

SEQ ID NO: 1098026 - DNA, 22 bp, Homo sapiens
atgctgtttctaagaaaatgta

SEQ ID NO: 1098027 - DNA, 24 bp, Homo sapiens
atgctgtttctaagaaaatgtagt

SEQ ID NO: 1098028 - DNA, 16 bp, Homo sapiens
atgcttaaaataagca

SEQ ID NO: 1098029 - DNA, 15 bp, Homo sapiens
atgcttaaactaaat

SEQ ID NO: 1098030 - DNA, 20 bp, Homo sapiens
atgcttaaactaaataatga

SEQ ID NO: 1098031 - DNA, 14 bp, Homo sapiens
atgcttaataaaag

SEQ ID NO: 1098032 - DNA, 16 bp, Homo sapiens
atgcttaataaaagaa

SEQ ID NO: 1098033 - DNA, 23 bp, Homo sapiens
atgcttacgtgatcctctcacct

SEQ ID NO: 1098034 - DNA, 15 bp, Homo sapiens
atgcttactcttgct

SEQ ID NO: 1098035 - DNA, 17 bp, Homo sapiens
atgcttagatgttccag

SEQ ID NO: 1098036 - DNA, 16 bp, Homo sapiens
atgcttagcttatctt

SEQ ID NO: 1098037 - DNA, 17 bp, Homo sapiens
atgcttagcttatcttt

SEQ ID NO: 1098038 - DNA, 18 bp, Homo sapiens
atgcttagcttatctttc

SEQ ID NO: 1098039 - DNA, 21 bp, Homo sapiens
atgcttagcttatctttcttt

SEQ ID NO: 1098040 - DNA, 15 bp, Homo sapiens
atgcttagtcactgc

SEQ ID NO: 1098041 - DNA, 18 bp, Homo sapiens
atgcttatgcttgtgtat

SEQ ID NO: 1098042 - DNA, 19 bp, Homo sapiens
atgcttcatatgaggagga

SEQ ID NO: 1098043 - DNA, 20 bp, Homo sapiens
atgcttcatcattccctctc

SEQ ID NO: 1098044 - DNA, 13 bp, Homo sapiens
atgcttcattatt

SEQ ID NO: 1098045 - DNA, 20 bp, Homo sapiens
atgcttcattcaatattgac

SEQ ID NO: 1098046 - DNA, 23 bp, Homo sapiens
atgcttccacaggcaaaactcag

SEQ ID NO: 1098047 - DNA, 13 bp, Homo sapiens
atgcttcctttct

SEQ ID NO: 1098048 - DNA, 15 bp, Homo sapiens
atgcttcctttctct

SEQ ID NO: 1098049 - DNA, 18 bp, Homo sapiens
atgcttcctttctctcct

SEQ ID NO: 1098050 - DNA, 19 bp, Homo sapiens
atgcttctataattttgcc

SEQ ID NO: 1098051 - DNA, 14 bp, Homo sapiens
atgcttctgttgta

SEQ ID NO: 1098052 - DNA, 15 bp, Homo sapiens
atgcttgacatacct

SEQ ID NO: 1098053 - DNA, 21 bp, Homo sapiens
atgcttgcctagggcctggtc

SEQ ID NO: 1098054 - DNA, 23 bp, Homo sapiens
atgcttgcctagggcctggtcca

SEQ ID NO: 1098055 - DNA, 15 bp, Homo sapiens
atgcttgcttgggga

SEQ ID NO: 1098056 - DNA, 23 bp, Homo sapiens
atgcttgggaccagaagtgtttc

SEQ ID NO: 1098057 - DNA, 20 bp, Homo sapiens
atgcttgtaacaagaaaaca

SEQ ID NO: 1098058 - DNA, 12 bp, Homo sapiens
atgcttgtttat

SEQ ID NO: 1098059 - DNA, 17 bp, Homo sapiens
atgggcccgctgcctct

SEQ ID NO: 1098060 - DNA, 18 bp, Homo sapiens
atgggcccgctgcctctt

SEQ ID NO: 1098061 - DNA, 19 bp, Homo sapiens
atgggccgtcccctctccc

SEQ ID NO: 1098062 - DNA, 15 bp, Homo sapiens
atgggcctctctggg

SEQ ID NO: 1098063 - DNA, 21 bp, Homo sapiens
atgggcctgcccaatgctttg

SEQ ID NO: 1098064 - DNA, 15 bp, Homo sapiens
atgggcctgcctgcc

SEQ ID NO: 1098065 - DNA, 18 bp, Homo sapiens
atgggcctgcctgcctcc

SEQ ID NO: 1098066 - DNA, 13 bp, Homo sapiens
atgggcctggcat

SEQ ID NO: 1098067 - DNA, 11 bp, Homo sapiens
atgggcctggg

SEQ ID NO: 1098068 - DNA, 19 bp, Homo sapiens
atgggcctgtatgagacag

SEQ ID NO: 1098069 - DNA, 12 bp, Homo sapiens
atgggccttgct

SEQ ID NO: 1098070 - DNA, 21 bp, Homo sapiens
atgggccttgctttgggcttt

SEQ ID NO: 1098071 - DNA, 21 bp, Homo sapiens
atgggcctttaagaaccttaa

SEQ ID NO: 1098072 - DNA, 21 bp, Homo sapiens
atgggccttttcttgaataaa

SEQ ID NO: 1098073 - DNA, 16 bp, Homo sapiens
atgggcgcaggcccag

SEQ ID NO: 1098074 - DNA, 21 bp, Homo sapiens
atgggcgcccccccctcccca

SEQ ID NO: 1098075 - DNA, 17 bp, Homo sapiens
atgggctaatgaagatc

SEQ ID NO: 1098076 - DNA, 23 bp, Homo sapiens
atgggctcgccgtgtctcagcct

SEQ ID NO: 1098077 - DNA, 14 bp, Homo sapiens
atgggctctacctc

SEQ ID NO: 1098078 - DNA, 17 bp, Homo sapiens
atgggctgagctagcct

SEQ ID NO: 1098079 - DNA, 20 bp, Homo sapiens
atgggctgagctagcctcca

SEQ ID NO: 1098080 - DNA, 21 bp, Homo sapiens
atgggctgagctagcctccag

SEQ ID NO: 1098081 - DNA, 15 bp, Homo sapiens
atgggctggggcagg

SEQ ID NO: 1098082 - DNA, 20 bp, Homo sapiens
atgggctggggcaggggcct

SEQ ID NO: 1098083 - DNA, 23 bp, Homo sapiens
atgggctggggcaggggcctggg

SEQ ID NO: 1098084 - DNA, 17 bp, Homo sapiens
atgggcttctgttctct

SEQ ID NO: 1098085 - DNA, 20 bp, Homo sapiens
atgggcttctgttctctgct

SEQ ID NO: 1098086 - DNA, 21 bp, Homo sapiens
atgggcttctgttctctgctg

SEQ ID NO: 1098087 - DNA, 22 bp, Homo sapiens
atgggcttctgttctctgctga

SEQ ID NO: 1098088 - DNA, 23 bp, Homo sapiens
atgggcttggacttcctggggcc

SEQ ID NO: 1098089 - DNA, 20 bp, Homo sapiens
atgggcttttgttctgaggg

SEQ ID NO: 1098090 - DNA, 23 bp, Homo sapiens
atggggaaagcagaactgaagcc

SEQ ID NO: 1098091 - DNA, 22 bp, Homo sapiens
atggggaatctaagagagctgc

SEQ ID NO: 1098092 - DNA, 15 bp, Homo sapiens
atggggactctgccg

SEQ ID NO: 1098093 - DNA, 12 bp, Homo sapiens
atggggagaaag

SEQ ID NO: 1098094 - DNA, 13 bp, Homo sapiens
atggggagaaagg

SEQ ID NO: 1098095 - DNA, 22 bp, Homo sapiens
atggggagaaagggcaaattat

SEQ ID NO: 1098096 - DNA, 22 bp, Homo sapiens
atggggagacagttgagagcgg

SEQ ID NO: 1098097 - DNA, 17 bp, Homo sapiens
atggggaggacaaaatg

SEQ ID NO: 1098098 - DNA, 21 bp, Homo sapiens
atggggaggcaagtgtggggg

SEQ ID NO: 1098099 - DNA, 11 bp, Homo sapiens
atggggaggga

SEQ ID NO: 1098100 - DNA, 16 bp, Homo sapiens
atggggagggagggag

SEQ ID NO: 1098101 - DNA, 23 bp, Homo sapiens
atggggagtgagtgatcactggt

SEQ ID NO: 1098102 - DNA, 15 bp, Homo sapiens
atggggatagaggaa

SEQ ID NO: 1098103 - DNA, 14 bp, Homo sapiens
atggggatctgggg

SEQ ID NO: 1098104 - DNA, 18 bp, Homo sapiens
atggggatctggggggtg

SEQ ID NO: 1098105 - DNA, 22 bp, Homo sapiens
atggggattcaggggctttggg

SEQ ID NO: 1098106 - DNA, 17 bp, Homo sapiens
atggggcaagccagggc

SEQ ID NO: 1098107 - DNA, 21 bp, Homo sapiens
atggggcaagccagggcccag

SEQ ID NO: 1098108 - DNA, 23 bp, Homo sapiens
atggggcaagccagggcccagag

SEQ ID NO: 1098109 - DNA, 14 bp, Homo sapiens
atggggctcccagc

SEQ ID NO: 1098110 - DNA, 19 bp, Homo sapiens
atggggctgacagcactaa

SEQ ID NO: 1098111 - DNA, 19 bp, Homo sapiens
atggggctggcatgttttc

SEQ ID NO: 1098112 - DNA, 22 bp, Homo sapiens
atgggggaaggcgctgggtgcc

SEQ ID NO: 1098113 - DNA, 14 bp, Homo sapiens
atgggggatgcttc

SEQ ID NO: 1098114 - DNA, 22 bp, Homo sapiens
atgggggcatctcttccccaga

SEQ ID NO: 1098115 - DNA, 17 bp, Homo sapiens
atgggggcttcttcctc

SEQ ID NO: 1098116 - DNA, 18 bp, Homo sapiens
atggggggcgggccaggg

SEQ ID NO: 1098117 - DNA, 21 bp, Homo sapiens
atggggggcgggccagggtgg

SEQ ID NO: 1098118 - DNA, 14 bp, Homo sapiens
atgggggtaaagtt

SEQ ID NO: 1098119 - DNA, 19 bp, Homo sapiens
atgggggtagcagctggac

SEQ ID NO: 1098120 - DNA, 17 bp, Homo sapiens
atgggggtgcaggcagc

SEQ ID NO: 1098121 - DNA, 13 bp, Homo sapiens
atggggtcagccc

SEQ ID NO: 1098122 - DNA, 15 bp, Homo sapiens
atggggtcagcccca

SEQ ID NO: 1098123 - DNA, 16 bp, Homo sapiens
atggggtccagagagc

SEQ ID NO: 1098124 - DNA, 20 bp, Homo sapiens
atggggtccatccccttccc

SEQ ID NO: 1098125 - DNA, 16 bp, Homo sapiens
atggggtcctggccat

SEQ ID NO: 1098126 - DNA, 16 bp, Homo sapiens
atggggtcggctcctg

SEQ ID NO: 1098127 - DNA, 16 bp, Homo sapiens
atggggtctgtgactg

SEQ ID NO: 1098128 - DNA, 21 bp, Homo sapiens
atggggtcttgctatgttgcc

SEQ ID NO: 1098129 - DNA, 19 bp, Homo sapiens
atggggtggggtagggctg

SEQ ID NO: 1098130 - DNA, 23 bp, Homo sapiens
atggggtggggttggggcaaagc

SEQ ID NO: 1098131 - DNA, 13 bp, Homo sapiens
atgggtacagagg

SEQ ID NO: 1098132 - DNA, 12 bp, Homo sapiens
atgggtagggta

SEQ ID NO: 1098133 - DNA, 17 bp, Homo sapiens
atgggtagggtaaatca

SEQ ID NO: 1098134 - DNA, 20 bp, Homo sapiens
atgggtcaacctttgtgtgg

SEQ ID NO: 1098135 - DNA, 13 bp, Homo sapiens
atgggtcccctcc

SEQ ID NO: 1098136 - DNA, 21 bp, Homo sapiens
atgggtcctagcccttccctg

SEQ ID NO: 1098137 - DNA, 19 bp, Homo sapiens
atgggtccttgatgccaga

SEQ ID NO: 1098138 - DNA, 16 bp, Homo sapiens
atgggtctgatattaa

SEQ ID NO: 1098139 - DNA, 19 bp, Homo sapiens
atgggtctgatattaatca

SEQ ID NO: 1098140 - DNA, 14 bp, Homo sapiens
atgggtctggcctg

SEQ ID NO: 1098141 - DNA, 10 bp, Homo sapiens
atgggtctta

SEQ ID NO: 1098142 - DNA, 19 bp, Homo sapiens
atgggtcttagctctttct

SEQ ID NO: 1098143 - DNA, 20 bp, Homo sapiens
atgggtgcaaggaaaattag

SEQ ID NO: 1098144 - DNA, 16 bp, Homo sapiens
atgggtgctatcagag

SEQ ID NO: 1098145 - DNA, 17 bp, Homo sapiens
atgggtggaaagtgctc

SEQ ID NO: 1098146 - DNA, 16 bp, Homo sapiens
atgggtggacacggat

SEQ ID NO: 1098147 - DNA, 17 bp, Homo sapiens
atgggtggctttcaagg

SEQ ID NO: 1098148 - DNA, 22 bp, Homo sapiens
atgggtggctttcaaggctggg

SEQ ID NO: 1098149 - DNA, 13 bp, Homo sapiens
atgggttccagag

SEQ ID NO: 1098150 - DNA, 14 bp, Homo sapiens
atgggttccagagg

SEQ ID NO: 1098151 - DNA, 23 bp, Homo sapiens
atggtaaaagttacttattctag

SEQ ID NO: 1098152 - DNA, 21 bp, Homo sapiens
atggtaaagccatgttaaatg

SEQ ID NO: 1098153 - DNA, 20 bp, Homo sapiens
atggtaactgctttctgttc

SEQ ID NO: 1098154 - DNA, 15 bp, Homo sapiens
atggtaagagaaaag

SEQ ID NO: 1098155 - DNA, 16 bp, Homo sapiens
atggtaagagaaaaga

SEQ ID NO: 1098156 - DNA, 19 bp, Homo sapiens
atggtaagtacttgagtaa

SEQ ID NO: 1098157 - DNA, 23 bp, Homo sapiens
atggtaatctttacctgtataca

SEQ ID NO: 1098158 - DNA, 19 bp, Homo sapiens
atggtactagggggaagtg

SEQ ID NO: 1098159 - DNA, 13 bp, Homo sapiens
atggtactattta

SEQ ID NO: 1098160 - DNA, 18 bp, Homo sapiens
atggtaggcatttcctat

SEQ ID NO: 1098161 - DNA, 18 bp, Homo sapiens
atggtaggggagggcagg

SEQ ID NO: 1098162 - DNA, 22 bp, Homo sapiens
atggtagggtataatgtgtctg

SEQ ID NO: 1098163 - DNA, 19 bp, Homo sapiens
atggtagttttttcatctt

SEQ ID NO: 1098164 - DNA, 17 bp, Homo sapiens
atggtataattgaaact

SEQ ID NO: 1098165 - DNA, 18 bp, Homo sapiens
atggtatcctactgagca

SEQ ID NO: 1098166 - DNA, 20 bp, Homo sapiens
atggtatgagctgagggggg

SEQ ID NO: 1098167 - DNA, 23 bp, Homo sapiens
atggtatgctggccagcaccctc

SEQ ID NO: 1098168 - DNA, 18 bp, Homo sapiens
atggtatgtacaagttga

SEQ ID NO: 1098169 - DNA, 18 bp, Homo sapiens
atggtattaatcttgtgt

SEQ ID NO: 1098170 - DNA, 15 bp, Homo sapiens
atggtatttctttct

SEQ ID NO: 1098171 - DNA, 17 bp, Homo sapiens
atggtcacacaccagca

SEQ ID NO: 1098172 - DNA, 14 bp, Homo sapiens
atggtcacacactg

SEQ ID NO: 1098173 - DNA, 21 bp, Homo sapiens
atggtcacagtcctatgtaca

SEQ ID NO: 1098174 - DNA, 23 bp, Homo sapiens
atggtcacagtcctatgtacaga

SEQ ID NO: 1098175 - DNA, 24 bp, Homo sapiens
atggtcacagtcctatgtacagag

SEQ ID NO: 1098176 - DNA, 24 bp, Homo sapiens
atggtcacgtttggtgcttctcag

SEQ ID NO: 1098177 - DNA, 20 bp, Homo sapiens
atggtcagctcccttctctg

SEQ ID NO: 1098178 - DNA, 19 bp, Homo sapiens
atggtccaattagtttcct

SEQ ID NO: 1098179 - DNA, 14 bp, Homo sapiens
atgtatccagagga

SEQ ID NO: 1098180 - DNA, 15 bp, Homo sapiens
atgtatccagaggaa

SEQ ID NO: 1098181 - DNA, 14 bp, Homo sapiens
atgtatcgcatatt

SEQ ID NO: 1098182 - DNA, 14 bp, Homo sapiens
atgtatctaagaat

SEQ ID NO: 1098183 - DNA, 16 bp, Homo sapiens
atgtatctaagaataa

SEQ ID NO: 1098184 - DNA, 14 bp, Homo sapiens
atgtatctatttgt

SEQ ID NO: 1098185 - DNA, 15 bp, Homo sapiens
atgtatctatttgta

SEQ ID NO: 1098186 - DNA, 20 bp, Homo sapiens
atgtatctatttgtacaatt

SEQ ID NO: 1098187 - DNA, 14 bp, Homo sapiens
atgtatctgtgaag

SEQ ID NO: 1098188 - DNA, 18 bp, Homo sapiens
atgtatctttattaaaac

SEQ ID NO: 1098189 - DNA, 23 bp, Homo sapiens
atgtatgaaggaatcattccagt

SEQ ID NO: 1098190 - DNA, 13 bp, Homo sapiens
atgtatgaaggct

SEQ ID NO: 1098191 - DNA, 13 bp, Homo sapiens
atgtatgaatgta

SEQ ID NO: 1098192 - DNA, 15 bp, Homo sapiens
atgtatgcacacaca

SEQ ID NO: 1098193 - DNA, 16 bp, Homo sapiens
atgtatgcacacacat

SEQ ID NO: 1098194 - DNA, 17 bp, Homo sapiens
atgtatgcagctatctg

SEQ ID NO: 1098195 - DNA, 19 bp, Homo sapiens
atgtatgggtagggtaaat

SEQ ID NO: 1098196 - DNA, 14 bp, Homo sapiens
atgtatgtaaaaat

SEQ ID NO: 1098197 - DNA, 13 bp, Homo sapiens
atgtatgtacaat

SEQ ID NO: 1098198 - DNA, 18 bp, Homo sapiens
atgtatgtacaatacaat

SEQ ID NO: 1098199 - DNA, 17 bp, Homo sapiens
atgtatgtgtgaaacaa

SEQ ID NO: 1098200 - DNA, 20 bp, Homo sapiens
atgtatgtgtgaaacaatgt

SEQ ID NO: 1098201 - DNA, 16 bp, Homo sapiens
atgtatgtgtggctgt

SEQ ID NO: 1098202 - DNA, 12 bp, Homo sapiens
atgtatgttacc

SEQ ID NO: 1098203 - DNA, 14 bp, Homo sapiens
atgtatgttaccaa

SEQ ID NO: 1098204 - DNA, 17 bp, Homo sapiens
atgtatgttatgatatt

SEQ ID NO: 1098205 - DNA, 12 bp, Homo sapiens
atgtatgtttac

SEQ ID NO: 1098206 - DNA, 18 bp, Homo sapiens
atgtatgtttttttccaa

SEQ ID NO: 1098207 - DNA, 21 bp, Homo sapiens
atgtattaagcccacagtata

SEQ ID NO: 1098208 - DNA, 23 bp, Homo sapiens
atgtattaagcccacagtatatt

SEQ ID NO: 1098209 - DNA, 17 bp, Homo sapiens
atgtattatttataatt

SEQ ID NO: 1098210 - DNA, 13 bp, Homo sapiens
atgtattcaagca

SEQ ID NO: 1098211 - DNA, 18 bp, Homo sapiens
atgtattcaagcaaacat

SEQ ID NO: 1098212 - DNA, 17 bp, Homo sapiens
atgtattcccttatctt

SEQ ID NO: 1098213 - DNA, 22 bp, Homo sapiens
atgtattctttctgcctttaat

SEQ ID NO: 1098214 - DNA, 14 bp, Homo sapiens
atgtattgactgta

SEQ ID NO: 1098215 - DNA, 14 bp, Homo sapiens
atgtattgattaca

SEQ ID NO: 1098216 - DNA, 14 bp, Homo sapiens
atgtattgattcaa

SEQ ID NO: 1098217 - DNA, 22 bp, Homo sapiens
atgtattgcacattgtaaaaag

SEQ ID NO: 1098218 - DNA, 16 bp, Homo sapiens
atgtattggcctggag

SEQ ID NO: 1098219 - DNA, 21 bp, Homo sapiens
atgtatttaagatgtacattt

SEQ ID NO: 1098220 - DNA, 21 bp, Homo sapiens
atgtatttaccaaaaattttg

SEQ ID NO: 1098221 - DNA, 17 bp, Homo sapiens
atgtatttataaatata

SEQ ID NO: 1098222 - DNA, 14 bp, Homo sapiens
atgtatttataatt

SEQ ID NO: 1098223 - DNA, 17 bp, Homo sapiens
atgtatttataatttaa

SEQ ID NO: 1098224 - DNA, 23 bp, Homo sapiens
atgtatttataatttaaatgata

SEQ ID NO: 1098225 - DNA, 14 bp, Homo sapiens
atgtatttatattt

SEQ ID NO: 1098226 - DNA, 22 bp, Homo sapiens
atgtatttcagggacctcaggg

SEQ ID NO: 1098227 - DNA, 14 bp, Homo sapiens
atgtatttcctgaa

SEQ ID NO: 1098228 - DNA, 14 bp, Homo sapiens
atgtatttgattta

SEQ ID NO: 1098229 - DNA, 15 bp, Homo sapiens
atgtatttgtagtgt

SEQ ID NO: 1098230 - DNA, 14 bp, Homo sapiens
atgtattttcatag

SEQ ID NO: 1098231 - DNA, 12 bp, Homo sapiens
atgtattttcct

SEQ ID NO: 1098232 - DNA, 18 bp, Homo sapiens
atgtattttcctaatgtg

SEQ ID NO: 1098233 - DNA, 20 bp, Homo sapiens
atgtattttcctaatgtgat

SEQ ID NO: 1098234 - DNA, 21 bp, Homo sapiens
atgtatttttcttgctgttca

SEQ ID NO: 1098235 - DNA, 20 bp, Homo sapiens
atgtatttttgatgtatata

SEQ ID NO: 1098236 - DNA, 17 bp, Homo sapiens
atgtatttttgtcaatt

SEQ ID NO: 1098237 - DNA, 13 bp, Homo sapiens
atgtcaaacaaat

SEQ ID NO: 1098238 - DNA, 19 bp, Homo sapiens
atgtcaaatatttagatgt

SEQ ID NO: 1098239 - DNA, 17 bp, Homo sapiens
atgtcaaatcaaggcaa

SEQ ID NO: 1098240 - DNA, 23 bp, Homo sapiens
atgtcaaccaggtccagatgtgc

SEQ ID NO: 1098241 - DNA, 16 bp, Homo sapiens
atgtcaagttgggttc

SEQ ID NO: 1098242 - DNA, 14 bp, Homo sapiens
atgtcaattcatga

SEQ ID NO: 1098243 - DNA, 18 bp, Homo sapiens
atgtcaatttgtatatca

SEQ ID NO: 1098244 - DNA, 19 bp, Homo sapiens
atgtcacaaattgatcaag

SEQ ID NO: 1098245 - DNA, 14 bp, Homo sapiens
atgtcacagggcca

SEQ ID NO: 1098246 - DNA, 13 bp, Homo sapiens
atgtcacagtcca

SEQ ID NO: 1098247 - DNA, 19 bp, Homo sapiens
atgtcacatttgaattctt

SEQ ID NO: 1098248 - DNA, 15 bp, Homo sapiens
atgtcaccaccttcc

SEQ ID NO: 1098249 - DNA, 18 bp, Homo sapiens
atgtcaccaccttcccag

SEQ ID NO: 1098250 - DNA, 20 bp, Homo sapiens
atgtcaccaccttcccagct

SEQ ID NO: 1098251 - DNA, 23 bp, Homo sapiens
atgtcaccaccttcccagctctc

SEQ ID NO: 1098252 - DNA, 21 bp, Homo sapiens
atgtcaccggtcagtgccttt

SEQ ID NO: 1098253 - DNA, 13 bp, Homo sapiens
atgtcacctggct

SEQ ID NO: 1098254 - DNA, 19 bp, Homo sapiens
atgtcagacaataccactg

SEQ ID NO: 1098255 - DNA, 21 bp, Homo sapiens
atgtcagacacagattggcca

SEQ ID NO: 1098256 - DNA, 23 bp, Homo sapiens
atgtcagacatccatgtttgtaa

SEQ ID NO: 1098257 - DNA, 16 bp, Homo sapiens
atgtcagactggctgg

SEQ ID NO: 1098258 - DNA, 22 bp, Homo sapiens
atgtcagagctatgttccctcc

SEQ ID NO: 1098259 - DNA, 23 bp, Homo sapiens
atgtcagataagtgtaaatagaa

SEQ ID NO: 1098260 - DNA, 14 bp, Homo sapiens
atgtcagatttctg

SEQ ID NO: 1098261 - DNA, 16 bp, Homo sapiens
atgtcagatttctggt

SEQ ID NO: 1098262 - DNA, 17 bp, Homo sapiens
atgtcagatttctggtt

SEQ ID NO: 1098263 - DNA, 13 bp, Homo sapiens
atgtcagcaaaaa

SEQ ID NO: 1098264 - DNA, 15 bp, Homo sapiens
atgtcagcctttgtt

SEQ ID NO: 1098265 - DNA, 16 bp, Homo sapiens
atgtcagcctttgtta

SEQ ID NO: 1098266 - DNA, 17 bp, Homo sapiens
atgtcagcctttgttaa

SEQ ID NO: 1098267 - DNA, 15 bp, Homo sapiens
atgtcaggaacagaa

SEQ ID NO: 1098268 - DNA, 20 bp, Homo sapiens
atgtcaggaacagaaggatg

SEQ ID NO: 1098269 - DNA, 16 bp, Homo sapiens
atgtcagggccaggtg

SEQ ID NO: 1098270 - DNA, 20 bp, Homo sapiens
atgtcagggtacctggggcc

SEQ ID NO: 1098271 - DNA, 15 bp, Homo sapiens
atgtcagtattttaa

SEQ ID NO: 1098272 - DNA, 16 bp, Homo sapiens
atgtcagtattttaat

SEQ ID NO: 1098273 - DNA, 20 bp, Homo sapiens
atgtcagtgacattaaacta

SEQ ID NO: 1098274 - DNA, 18 bp, Homo sapiens
atgtcagtggtttctact

SEQ ID NO: 1098275 - DNA, 16 bp, Homo sapiens
atgtcagttctgatat

SEQ ID NO: 1098276 - DNA, 23 bp, Homo sapiens
atgtcataaagtgagaaaactgt

SEQ ID NO: 1098277 - DNA, 19 bp, Homo sapiens
atgtcataataaagttgtt

SEQ ID NO: 1098278 - DNA, 14 bp, Homo sapiens
atgtcatagccaaa

SEQ ID NO: 1098279 - DNA, 22 bp, Homo sapiens
atgtcatatactgccatgtact

SEQ ID NO: 1098280 - DNA, 13 bp, Homo sapiens
atgtcatatcatt

SEQ ID NO: 1098281 - DNA, 16 bp, Homo sapiens
atgtcatattttgcca

SEQ ID NO: 1098282 - DNA, 22 bp, Homo sapiens
atgtcatgaggaaactactgaa

SEQ ID NO: 1098283 - DNA, 21 bp, Homo sapiens
atgtcatgcctcactttcttc

SEQ ID NO: 1098284 - DNA, 22 bp, Homo sapiens
atgtcatgcctcactttcttct

SEQ ID NO: 1098285 - DNA, 13 bp, Homo sapiens
atgtcattaaatg

SEQ ID NO: 1098286 - DNA, 18 bp, Homo sapiens
atgtcattacatagaaca

SEQ ID NO: 1098287 - DNA, 18 bp, Homo sapiens
atgtcattgagtaatata

SEQ ID NO: 1098288 - DNA, 13 bp, Homo sapiens
atgtcattgctaa

SEQ ID NO: 1098289 - DNA, 19 bp, Homo sapiens
atgtcattgctaaaaaata

SEQ ID NO: 1098290 - DNA, 15 bp, Homo sapiens
atgtcatttttaatg

SEQ ID NO: 1098291 - DNA, 18 bp, Homo sapiens
atgtcatttttaatgtat

SEQ ID NO: 1098292 - DNA, 20 bp, Homo sapiens
atgtcatttttaatgtatct

SEQ ID NO: 1098293 - DNA, 12 bp, Homo sapiens
atgtccaaagag

SEQ ID NO: 1098294 - DNA, 18 bp, Homo sapiens
atgtccaaagaggctgcc

SEQ ID NO: 1098295 - DNA, 20 bp, Homo sapiens
atgtccaaagaggctgcccc

SEQ ID NO: 1098296 - DNA, 14 bp, Homo sapiens
atgtccaagttctt

SEQ ID NO: 1098297 - DNA, 17 bp, Homo sapiens
atgtccaagttcttcac

SEQ ID NO: 1098298 - DNA, 20 bp, Homo sapiens
atgtccaagttcttcacctc

SEQ ID NO: 1098299 - DNA, 22 bp, Homo sapiens
atgtccaagttcttcacctcta

SEQ ID NO: 1098300 - DNA, 14 bp, Homo sapiens
atgtccactgtgta

SEQ ID NO: 1098301 - DNA, 11 bp, Homo sapiens
atgtgggcagc

SEQ ID NO: 1098302 - DNA, 16 bp, Homo sapiens
atgtggggccaggtca

SEQ ID NO: 1098303 - DNA, 18 bp, Homo sapiens
atgtggggctgagctggg

SEQ ID NO: 1098304 - DNA, 14 bp, Homo sapiens
atgtgggtcttcca

SEQ ID NO: 1098305 - DNA, 17 bp, Homo sapiens
atgtgggtcttccaggg

SEQ ID NO: 1098306 - DNA, 14 bp, Homo sapiens
atgtgggtgctagg

SEQ ID NO: 1098307 - DNA, 15 bp, Homo sapiens
atgtggtctcaggat

SEQ ID NO: 1098308 - DNA, 19 bp, Homo sapiens
atgtggtcttatgatttta

SEQ ID NO: 1098309 - DNA, 22 bp, Homo sapiens
atgtggtcttatgattttatta

SEQ ID NO: 1098310 - DNA, 18 bp, Homo sapiens
atgtggtgacacctcccc

SEQ ID NO: 1098311 - DNA, 21 bp, Homo sapiens
atgtggtgggacagggaccca

SEQ ID NO: 1098312 - DNA, 20 bp, Homo sapiens
atgtggttacttcctactgt

SEQ ID NO: 1098313 - DNA, 21 bp, Homo sapiens
atgtggttacttcctactgta

SEQ ID NO: 1098314 - DNA, 20 bp, Homo sapiens
atgtggttagttaactgaat

SEQ ID NO: 1098315 - DNA, 13 bp, Homo sapiens
atgtggtttatag

SEQ ID NO: 1098316 - DNA, 14 bp, Homo sapiens
atgtgtaaacaggt

SEQ ID NO: 1098317 - DNA, 13 bp, Homo sapiens
atgtgtaataaat

SEQ ID NO: 1098318 - DNA, 14 bp, Homo sapiens
atgtgtacatggca

SEQ ID NO: 1098319 - DNA, 15 bp, Homo sapiens
atgtgtactggtcag

SEQ ID NO: 1098320 - DNA, 16 bp, Homo sapiens
atgtgtagggaaagtt

SEQ ID NO: 1098321 - DNA, 18 bp, Homo sapiens
atgtgtatcggatgcttt

SEQ ID NO: 1098322 - DNA, 15 bp, Homo sapiens
atgtgtatgcacagt

SEQ ID NO: 1098323 - DNA, 19 bp, Homo sapiens
atgtgtatgcacagtaaaa

SEQ ID NO: 1098324 - DNA, 20 bp, Homo sapiens
atgtgtatgtacgtttgtat

SEQ ID NO: 1098325 - DNA, 16 bp, Homo sapiens
atgtgtatttcttata

SEQ ID NO: 1098326 - DNA, 20 bp, Homo sapiens
atgtgtatttttcaaggcat

SEQ ID NO: 1098327 - DNA, 21 bp, Homo sapiens
atgtgtatttttcaaggcatt

SEQ ID NO: 1098328 - DNA, 16 bp, Homo sapiens
atgtgtcaaattataa

SEQ ID NO: 1098329 - DNA, 14 bp, Homo sapiens
atgtgtcaactgag

SEQ ID NO: 1098330 - DNA, 21 bp, Homo sapiens
atgtgtcactactcacagtct

SEQ ID NO: 1098331 - DNA, 17 bp, Homo sapiens
atgtgtcacttgtgctt

SEQ ID NO: 1098332 - DNA, 20 bp, Homo sapiens
atgtgtcattggaagccatc

SEQ ID NO: 1098333 - DNA, 19 bp, Homo sapiens
atgtgtcccccccaggcct

SEQ ID NO: 1098334 - DNA, 14 bp, Homo sapiens
atgtgtcccctcac

SEQ ID NO: 1098335 - DNA, 19 bp, Homo sapiens
atgtgtcctatctatcttc

SEQ ID NO: 1098336 - DNA, 17 bp, Homo sapiens
atgtgtctcccagaact

SEQ ID NO: 1098337 - DNA, 22 bp, Homo sapiens
atgtgtctctgctttccttttc

SEQ ID NO: 1098338 - DNA, 13 bp, Homo sapiens
atgtgtctgggag

SEQ ID NO: 1098339 - DNA, 18 bp, Homo sapiens
atgtgtctgggagagcct

SEQ ID NO: 1098340 - DNA, 20 bp, Homo sapiens
atgtgtctgggagagcctgg

SEQ ID NO: 1098341 - DNA, 22 bp, Homo sapiens
atgtgtctgggagagcctggca

SEQ ID NO: 1098342 - DNA, 20 bp, Homo sapiens
atgtgtctgtatttcatgtg

SEQ ID NO: 1098343 - DNA, 20 bp, Homo sapiens
atgtgtctgtgttgcttcaa

SEQ ID NO: 1098344 - DNA, 21 bp, Homo sapiens
atgtgtctttagatagccctg

SEQ ID NO: 1098345 - DNA, 14 bp, Homo sapiens
atgtgtctttctaa

SEQ ID NO: 1098346 - DNA, 19 bp, Homo sapiens
atgtgtctttctaagaaat

SEQ ID NO: 1098347 - DNA, 14 bp, Homo sapiens
atgtgtgaaacaat

SEQ ID NO: 1098348 - DNA, 17 bp, Homo sapiens
atgtgtgagcatcctgc

SEQ ID NO: 1098349 - DNA, 20 bp, Homo sapiens
atgtgtgagcatcctgcaag

SEQ ID NO: 1098350 - DNA, 19 bp, Homo sapiens
atgtgtgaggagctgctgg

SEQ ID NO: 1098351 - DNA, 13 bp, Homo sapiens
atgtgtgagtgtg

SEQ ID NO: 1098352 - DNA, 16 bp, Homo sapiens
atgtgtgagtgtgtgc

SEQ ID NO: 1098353 - DNA, 17 bp, Homo sapiens
atgtgtgagtgtgtgca

SEQ ID NO: 1098354 - DNA, 12 bp, Homo sapiens
atgtgtgcagga

SEQ ID NO: 1098355 - DNA, 23 bp, Homo sapiens
atgtgtgcaggagcctccctgca

SEQ ID NO: 1098356 - DNA, 11 bp, Homo sapiens
atgtgtgcatg

SEQ ID NO: 1098357 - DNA, 14 bp, Homo sapiens
atgtgtgcatgtga

SEQ ID NO: 1098358 - DNA, 23 bp, Homo sapiens
atgtgtgcctcctagagtgcagg

SEQ ID NO: 1098359 - DNA, 19 bp, Homo sapiens
atgtgtgcgagtgtgtgca

SEQ ID NO: 1098360 - DNA, 15 bp, Homo sapiens
atgtgtggcagattt

SEQ ID NO: 1098361 - DNA, 13 bp, Homo sapiens
atgtgtggtggtg

SEQ ID NO: 1098362 - DNA, 19 bp, Homo sapiens
atgtgtgtagacaaatatt

SEQ ID NO: 1098363 - DNA, 20 bp, Homo sapiens
atgtgtgtagacaaatattt

SEQ ID NO: 1098364 - DNA, 15 bp, Homo sapiens
atgtgtgtagactgt

SEQ ID NO: 1098365 - DNA, 19 bp, Homo sapiens
atgtgtgtaggttatcttt

SEQ ID NO: 1098366 - DNA, 14 bp, Homo sapiens
atgtgtgtatgtgt

SEQ ID NO: 1098367 - DNA, 13 bp, Homo sapiens
atgtgtgtctcac

SEQ ID NO: 1098368 - DNA, 19 bp, Homo sapiens
atgtgtgtgcaagtgtgtg

SEQ ID NO: 1098369 - DNA, 17 bp, Homo sapiens
atgtgtgtgtgggtgtg

SEQ ID NO: 1098370 - DNA, 18 bp, Homo sapiens
atgtgtgtgtgtggcagg

SEQ ID NO: 1098371 - DNA, 14 bp, Homo sapiens
atgtgttatgaaca

SEQ ID NO: 1098372 - DNA, 13 bp, Homo sapiens
atgtgttatgaga

SEQ ID NO: 1098373 - DNA, 19 bp, Homo sapiens
atgtgttattacttcctca

SEQ ID NO: 1098374 - DNA, 17 bp, Homo sapiens
atgtgttcattcaagct

SEQ ID NO: 1098375 - DNA, 18 bp, Homo sapiens
atgtgttcctccattttc

SEQ ID NO: 1098376 - DNA, 20 bp, Homo sapiens
atgtgttcctccattttctt

SEQ ID NO: 1098377 - DNA, 13 bp, Homo sapiens
atgtgttcttatt

SEQ ID NO: 1098378 - DNA, 14 bp, Homo sapiens
atgtgttgaaaaaa

SEQ ID NO: 1098379 - DNA, 16 bp, Homo sapiens
atgtgttggaaactgt

SEQ ID NO: 1098380 - DNA, 22 bp, Homo sapiens
atgtgttggggaagggcctgcc

SEQ ID NO: 1098381 - DNA, 13 bp, Homo sapiens
atgtgttgtgata

SEQ ID NO: 1098382 - DNA, 13 bp, Homo sapiens
atgtgtttctgac

SEQ ID NO: 1098383 - DNA, 15 bp, Homo sapiens
atgtgtttctgtaac

SEQ ID NO: 1098384 - DNA, 14 bp, Homo sapiens
atgtgttttctgta

SEQ ID NO: 1098385 - DNA, 22 bp, Homo sapiens
atgtgttttgcacgtcttgcta

SEQ ID NO: 1098386 - DNA, 20 bp, Homo sapiens
atgtgttttgtttattaaat

SEQ ID NO: 1098387 - DNA, 15 bp, Homo sapiens
atgttaaaaaaataa

SEQ ID NO: 1098388 - DNA, 19 bp, Homo sapiens
atgttaaaaagaaatccag

SEQ ID NO: 1098389 - DNA, 14 bp, Homo sapiens
atgttaaaataaat

SEQ ID NO: 1098390 - DNA, 13 bp, Homo sapiens
atgttaaaatgta

SEQ ID NO: 1098391 - DNA, 13 bp, Homo sapiens
atgttaaactctt

SEQ ID NO: 1098392 - DNA, 14 bp, Homo sapiens
atgttaaactcttt

SEQ ID NO: 1098393 - DNA, 21 bp, Homo sapiens
atgttaaacttacttagtgtt

SEQ ID NO: 1098394 - DNA, 14 bp, Homo sapiens
atgttaaatactgt

SEQ ID NO: 1098395 - DNA, 13 bp, Homo sapiens
atgttaaatggaa

SEQ ID NO: 1098396 - DNA, 14 bp, Homo sapiens
atgttaaatggaat

SEQ ID NO: 1098397 - DNA, 15 bp, Homo sapiens
atgttaaatggaatt

SEQ ID NO: 1098398 - DNA, 16 bp, Homo sapiens
atgttaaatggaattc

SEQ ID NO: 1098399 - DNA, 22 bp, Homo sapiens
atgttaacaagaggggaaaaca

SEQ ID NO: 1098400 - DNA, 15 bp, Homo sapiens
atgttaactttgtgg

SEQ ID NO: 1098401 - DNA, 21 bp, Homo sapiens
atgttaagaatgaagttctgc

SEQ ID NO: 1098402 - DNA, 18 bp, Homo sapiens
atgttaagacttgacagt

SEQ ID NO: 1098403 - DNA, 20 bp, Homo sapiens
atgttaagacttgacagtgg

SEQ ID NO: 1098404 - DNA, 21 bp, Homo sapiens
atgttaagataacttactgta

SEQ ID NO: 1098405 - DNA, 22 bp, Homo sapiens
atgttaagataacttactgtat

SEQ ID NO: 1098406 - DNA, 23 bp, Homo sapiens
atgttaagcagctaaattttctg

SEQ ID NO: 1098407 - DNA, 16 bp, Homo sapiens
atgttaagcatttatt

SEQ ID NO: 1098408 - DNA, 21 bp, Homo sapiens
atgttaagccctggcaggcag

SEQ ID NO: 1098409 - DNA, 17 bp, Homo sapiens
atgttaagctttattgt

SEQ ID NO: 1098410 - DNA, 17 bp, Homo sapiens
atgttaatttattttgc

SEQ ID NO: 1098411 - DNA, 23 bp, Homo sapiens
atgttaattttttggtacaaaaa

SEQ ID NO: 1098412 - DNA, 19 bp, Homo sapiens
atgttacaagtttgctaaa

SEQ ID NO: 1098413 - DNA, 19 bp, Homo sapiens
atgttacataagataaatg

SEQ ID NO: 1098414 - DNA, 20 bp, Homo sapiens
atgttacataagataaatgt

SEQ ID NO: 1098415 - DNA, 17 bp, Homo sapiens
atgttacatcacagtgt

SEQ ID NO: 1098416 - DNA, 20 bp, Homo sapiens
atgttacatctgttttaaat

SEQ ID NO: 1098417 - DNA, 14 bp, Homo sapiens
atgttacattatta

SEQ ID NO: 1098418 - DNA, 19 bp, Homo sapiens
atgttacggcatcacactt

SEQ ID NO: 1098419 - DNA, 21 bp, Homo sapiens
atgttacggcatcacacttat

SEQ ID NO: 1098420 - DNA, 15 bp, Homo sapiens
atgttactaaatggt

SEQ ID NO: 1098421 - DNA, 14 bp, Homo sapiens
atgttactcagtgt

SEQ ID NO: 1098422 - DNA, 22 bp, Homo sapiens
atgttactcagtgttagagaaa

SEQ ID NO: 1098423 - DNA, 13 bp, Homo sapiens
attaaaaaagaga

SEQ ID NO: 1098424 - DNA, 17 bp, Homo sapiens
attaaaaagcctgcatt

SEQ ID NO: 1098425 - DNA, 17 bp, Homo sapiens
attaaaaagtctgtatg

SEQ ID NO: 1098426 - DNA, 17 bp, Homo sapiens
attaaaaataccttcta

SEQ ID NO: 1098427 - DNA, 21 bp, Homo sapiens
attaaaaataccttctatgta

SEQ ID NO: 1098428 - DNA, 12 bp, Homo sapiens
attaaaaatata

SEQ ID NO: 1098429 - DNA, 15 bp, Homo sapiens
attaaaaatataaaa

SEQ ID NO: 1098430 - DNA, 19 bp, Homo sapiens
attaaaaatctcaaatttc

SEQ ID NO: 1098431 - DNA, 20 bp, Homo sapiens
attaaaaatctcaaatttct

SEQ ID NO: 1098432 - DNA, 16 bp, Homo sapiens
attaaaaatgctgtgc

SEQ ID NO: 1098433 - DNA, 15 bp, Homo sapiens
attaaaaatgttctc

SEQ ID NO: 1098434 - DNA, 18 bp, Homo sapiens
attaaaaatgttctcaaa

SEQ ID NO: 1098435 - DNA, 22 bp, Homo sapiens
attaaaaattacctttaatttt

SEQ ID NO: 1098436 - DNA, 14 bp, Homo sapiens
attaaaacaaaaca

SEQ ID NO: 1098437 - DNA, 15 bp, Homo sapiens
attaaaacaaaacaa

SEQ ID NO: 1098438 - DNA, 19 bp, Homo sapiens
attaaaacaaatatacatt

SEQ ID NO: 1098439 - DNA, 14 bp, Homo sapiens
attaaaacacacat

SEQ ID NO: 1098440 - DNA, 11 bp, Homo sapiens
attaaaactca

SEQ ID NO: 1098441 - DNA, 14 bp, Homo sapiens
attaaaactgagtc

SEQ ID NO: 1098442 - DNA, 21 bp, Homo sapiens
attaaaactgagtccatgaaa

SEQ ID NO: 1098443 - DNA, 22 bp, Homo sapiens
attaaaactgagtccatgaaaa

SEQ ID NO: 1098444 - DNA, 12 bp, Homo sapiens
attaaaactgct

SEQ ID NO: 1098445 - DNA, 13 bp, Homo sapiens
attaaaactgctt

SEQ ID NO: 1098446 - DNA, 21 bp, Homo sapiens
attaaaagaaatatacagttt

SEQ ID NO: 1098447 - DNA, 16 bp, Homo sapiens
attaaaagcaaatcat

SEQ ID NO: 1098448 - DNA, 14 bp, Homo sapiens
attaaaataaaaca

SEQ ID NO: 1098449 - DNA, 19 bp, Homo sapiens
attaaaataaaacaagcct

SEQ ID NO: 1098450 - DNA, 22 bp, Homo sapiens
attaaaataaaacaagccttaa

SEQ ID NO: 1098451 - DNA, 22 bp, Homo sapiens
attaaaatactatgcagtatct

SEQ ID NO: 1098452 - DNA, 18 bp, Homo sapiens
attaaaatatagagacag

SEQ ID NO: 1098453 - DNA, 22 bp, Homo sapiens
attaaaatatggctataaatat

SEQ ID NO: 1098454 - DNA, 15 bp, Homo sapiens
attaaaatattattt

SEQ ID NO: 1098455 - DNA, 13 bp, Homo sapiens
attaaaatatttc

SEQ ID NO: 1098456 - DNA, 16 bp, Homo sapiens
attaaaatattttgga

SEQ ID NO: 1098457 - DNA, 20 bp, Homo sapiens
attaaaatctggaaatctgt

SEQ ID NO: 1098458 - DNA, 13 bp, Homo sapiens
attaaaatcttaa

SEQ ID NO: 1098459 - DNA, 13 bp, Homo sapiens
attaaaatgaatt

SEQ ID NO: 1098460 - DNA, 18 bp, Homo sapiens
attaaaatgattgtaaaa

SEQ ID NO: 1098461 - DNA, 20 bp, Homo sapiens
attaaaatgattgtaaaata

SEQ ID NO: 1098462 - DNA, 13 bp, Homo sapiens
attaaaatggatg

SEQ ID NO: 1098463 - DNA, 17 bp, Homo sapiens
attaaaatgtaaaactc

SEQ ID NO: 1098464 - DNA, 19 bp, Homo sapiens
attaaaattctgaattttg

SEQ ID NO: 1098465 - DNA, 20 bp, Homo sapiens
attaaacaaaaacaaagaaa

SEQ ID NO: 1098466 - DNA, 13 bp, Homo sapiens
attaaacaaagtt

SEQ ID NO: 1098467 - DNA, 17 bp, Homo sapiens
attaaacaatttatttt

SEQ ID NO: 1098468 - DNA, 19 bp, Homo sapiens
attaaacaatttattttat

SEQ ID NO: 1098469 - DNA, 20 bp, Homo sapiens
attaaacaatttattttatt

SEQ ID NO: 1098470 - DNA, 14 bp, Homo sapiens
attaaacaattttg

SEQ ID NO: 1098471 - DNA, 15 bp, Homo sapiens
attaaacactgtaat

SEQ ID NO: 1098472 - DNA, 16 bp, Homo sapiens
attaaacccacaagct

SEQ ID NO: 1098473 - DNA, 14 bp, Homo sapiens
attaaaccgcatgt

SEQ ID NO: 1098474 - DNA, 20 bp, Homo sapiens
attaaacgtatgcatgtgaa

SEQ ID NO: 1098475 - DNA, 14 bp, Homo sapiens
attaaacttgaagc

SEQ ID NO: 1098476 - DNA, 13 bp, Homo sapiens
attaaagaaatga

SEQ ID NO: 1098477 - DNA, 22 bp, Homo sapiens
attaaagaagacctgagaatgt

SEQ ID NO: 1098478 - DNA, 12 bp, Homo sapiens
attaaagcacac

SEQ ID NO: 1098479 - DNA, 18 bp, Homo sapiens
attaaagctaaagtatct

SEQ ID NO: 1098480 - DNA, 12 bp, Homo sapiens
attaaaggaagg

SEQ ID NO: 1098481 - DNA, 19 bp, Homo sapiens
attaaaggcataaatgact

SEQ ID NO: 1098482 - DNA, 11 bp, Homo sapiens
attaaagtatg

SEQ ID NO: 1098483 - DNA, 14 bp, Homo sapiens
attaaagtatgcaa

SEQ ID NO: 1098484 - DNA, 11 bp, Homo sapiens
attaaagtcag

SEQ ID NO: 1098485 - DNA, 13 bp, Homo sapiens
attaaagtcagaa

SEQ ID NO: 1098486 - DNA, 19 bp, Homo sapiens
attaaagtcagaagtttta

SEQ ID NO: 1098487 - DNA, 16 bp, Homo sapiens
attaaagtctgaatca

SEQ ID NO: 1098488 - DNA, 15 bp, Homo sapiens
attaaagtgactttc

SEQ ID NO: 1098489 - DNA, 17 bp, Homo sapiens
attaaataaactgtttt

SEQ ID NO: 1098490 - DNA, 14 bp, Homo sapiens
attaaatacagaca

SEQ ID NO: 1098491 - DNA, 17 bp, Homo sapiens
attaaatacagacacta

SEQ ID NO: 1098492 - DNA, 12 bp, Homo sapiens
attaaatacata

SEQ ID NO: 1098493 - DNA, 17 bp, Homo sapiens
attaaatatatctagaa

SEQ ID NO: 1098494 - DNA, 19 bp, Homo sapiens
attaaatatatgtatgtaa

SEQ ID NO: 1098495 - DNA, 21 bp, Homo sapiens
attaaatatatgtatgtaaaa

SEQ ID NO: 1098496 - DNA, 20 bp, Homo sapiens
attaaatatgttagcaaaga

SEQ ID NO: 1098497 - DNA, 22 bp, Homo sapiens
attaaatatgttagcaaagagt

SEQ ID NO: 1098498 - DNA, 15 bp, Homo sapiens
attaaatccaataaa

SEQ ID NO: 1098499 - DNA, 18 bp, Homo sapiens
attaaatctcaaatttat

SEQ ID NO: 1098500 - DNA, 16 bp, Homo sapiens
attaaatcttaaacaa

SEQ ID NO: 1098501 - DNA, 19 bp, Homo sapiens
attaaatcttaaacaatgt

SEQ ID NO: 1098502 - DNA, 20 bp, Homo sapiens
attaaatcttaaacaatgta

SEQ ID NO: 1098503 - DNA, 23 bp, Homo sapiens
attaaatcttaaacaatgtataa

SEQ ID NO: 1098504 - DNA, 18 bp, Homo sapiens
attaaatgaacttatgta

SEQ ID NO: 1098505 - DNA, 16 bp, Homo sapiens
attaaatgccttgtat

SEQ ID NO: 1098506 - DNA, 18 bp, Homo sapiens
attaaatgccttgtataa

SEQ ID NO: 1098507 - DNA, 18 bp, Homo sapiens
attaaatggtttttaaat

SEQ ID NO: 1098508 - DNA, 23 bp, Homo sapiens
attaaatgtctgacacattaatg

SEQ ID NO: 1098509 - DNA, 22 bp, Homo sapiens
attaaattacacaattacactt

SEQ ID NO: 1098510 - DNA, 18 bp, Homo sapiens
attaaattagtttgtgaa

SEQ ID NO: 1098511 - DNA, 15 bp, Homo sapiens
attaaattgtaaaac

SEQ ID NO: 1098512 - DNA, 21 bp, Homo sapiens
attaaatttgttgacaaaatt

SEQ ID NO: 1098513 - DNA, 20 bp, Homo sapiens
attaaattttttttacattt

SEQ ID NO: 1098514 - DNA, 16 bp, Homo sapiens
attaacacgctgcctg

SEQ ID NO: 1098515 - DNA, 12 bp, Homo sapiens
attaacagtttt

SEQ ID NO: 1098516 - DNA, 16 bp, Homo sapiens
attaacagttttccat

SEQ ID NO: 1098517 - DNA, 18 bp, Homo sapiens
attaacagttttccatga

SEQ ID NO: 1098518 - DNA, 19 bp, Homo sapiens
attaacagttttccatgaa

SEQ ID NO: 1098519 - DNA, 12 bp, Homo sapiens
attaacatacct

SEQ ID NO: 1098520 - DNA, 17 bp, Homo sapiens
attaaccacttcagctg

SEQ ID NO: 1098521 - DNA, 19 bp, Homo sapiens
attaaccgagacactttat

SEQ ID NO: 1098522 - DNA, 17 bp, Homo sapiens
attaaccttactaatta

SEQ ID NO: 1098523 - DNA, 14 bp, Homo sapiens
attaacgggcatgt

SEQ ID NO: 1098524 - DNA, 15 bp, Homo sapiens
attaactaaatgctc

SEQ ID NO: 1098525 - DNA, 20 bp, Homo sapiens
attaactactgaataatgct

SEQ ID NO: 1098526 - DNA, 12 bp, Homo sapiens
attaactcatta

SEQ ID NO: 1098527 - DNA, 18 bp, Homo sapiens
attaactgggtaatgaaa

SEQ ID NO: 1098528 - DNA, 15 bp, Homo sapiens
attaacttaactgaa

SEQ ID NO: 1098529 - DNA, 15 bp, Homo sapiens
attaacttagcatgt

SEQ ID NO: 1098530 - DNA, 12 bp, Homo sapiens
attaacttattt

SEQ ID NO: 1098531 - DNA, 12 bp, Homo sapiens
attaacttttat

SEQ ID NO: 1098532 - DNA, 16 bp, Homo sapiens
attaacttttataaac

SEQ ID NO: 1098533 - DNA, 17 bp, Homo sapiens
attaacttttataaact

SEQ ID NO: 1098534 - DNA, 23 bp, Homo sapiens
attaacttttataaactttacct

SEQ ID NO: 1098535 - DNA, 12 bp, Homo sapiens
attaagaaaatc

SEQ ID NO: 1098536 - DNA, 15 bp, Homo sapiens
attaagaaaatcata

SEQ ID NO: 1098537 - DNA, 14 bp, Homo sapiens
attaagaagaaact

SEQ ID NO: 1098538 - DNA, 21 bp, Homo sapiens
attaagaatatgtttccttgt

SEQ ID NO: 1098539 - DNA, 13 bp, Homo sapiens
attaagaatctta

SEQ ID NO: 1098540 - DNA, 20 bp, Homo sapiens
attaagaatcttagataact

SEQ ID NO: 1098541 - DNA, 20 bp, Homo sapiens
attaagacaaaaagccttga

SEQ ID NO: 1098542 - DNA, 14 bp, Homo sapiens
attaagacagtgta

SEQ ID NO: 1098543 - DNA, 23 bp, Homo sapiens
attaagacagtgtacaaaactgt

SEQ ID NO: 1098544 - DNA, 20 bp, Homo sapiens
attaagattgaggcctgccc

SEQ ID NO: 1098545 - DNA, 18 bp, Homo sapiens
attaagattttactttaa

SEQ ID NO: 1098546 - DNA, 17 bp, Homo sapiens
attagcatgcaagcttg

SEQ ID NO: 1098547 - DNA, 15 bp, Homo sapiens
attagccaggtaatg

SEQ ID NO: 1098548 - DNA, 13 bp, Homo sapiens
attagccgtccca

SEQ ID NO: 1098549 - DNA, 13 bp, Homo sapiens
attagctctggac

SEQ ID NO: 1098550 - DNA, 12 bp, Homo sapiens
attagctgggca

SEQ ID NO: 1098551 - DNA, 16 bp, Homo sapiens
attagctgtgtgaaat

SEQ ID NO: 1098552 - DNA, 13 bp, Homo sapiens
attagcttaccca

SEQ ID NO: 1098553 - DNA, 13 bp, Homo sapiens
attagctttctcc

SEQ ID NO: 1098554 - DNA, 16 bp, Homo sapiens
attaggaattgtttat

SEQ ID NO: 1098555 - DNA, 14 bp, Homo sapiens
attaggactgtata

SEQ ID NO: 1098556 - DNA, 15 bp, Homo sapiens
attaggactgtataa

SEQ ID NO: 1098557 - DNA, 15 bp, Homo sapiens
attaggagtaacttt

SEQ ID NO: 1098558 - DNA, 15 bp, Homo sapiens
attaggcaaagtaca

SEQ ID NO: 1098559 - DNA, 20 bp, Homo sapiens
attaggcaaggctatgtgat

SEQ ID NO: 1098560 - DNA, 15 bp, Homo sapiens
attaggctgtaacta

SEQ ID NO: 1098561 - DNA, 18 bp, Homo sapiens
attagggagaaaattcaa

SEQ ID NO: 1098562 - DNA, 20 bp, Homo sapiens
attagggagaaaattcaatt

SEQ ID NO: 1098563 - DNA, 16 bp, Homo sapiens
attaggggattcttct

SEQ ID NO: 1098564 - DNA, 16 bp, Homo sapiens
attaggtcttaaagta

SEQ ID NO: 1098565 - DNA, 21 bp, Homo sapiens
attaggttatggtttaatgtt

SEQ ID NO: 1098566 - DNA, 16 bp, Homo sapiens
attagtaaatgcttat

SEQ ID NO: 1098567 - DNA, 13 bp, Homo sapiens
attagtaacatgt

SEQ ID NO: 1098568 - DNA, 19 bp, Homo sapiens
attagtacacagcaccaga

SEQ ID NO: 1098569 - DNA, 13 bp, Homo sapiens
attagtagaaatg

SEQ ID NO: 1098570 - DNA, 17 bp, Homo sapiens
attagtagttaccacag

SEQ ID NO: 1098571 - DNA, 14 bp, Homo sapiens
attagtatgtctgt

SEQ ID NO: 1098572 - DNA, 15 bp, Homo sapiens
attagtattcaggca

SEQ ID NO: 1098573 - DNA, 20 bp, Homo sapiens
attagtattcaggcactgag

SEQ ID NO: 1098574 - DNA, 17 bp, Homo sapiens
attagtattgttgtcct

SEQ ID NO: 1098575 - DNA, 23 bp, Homo sapiens
attagtattgttgtccttttcat

SEQ ID NO: 1098576 - DNA, 24 bp, Homo sapiens
attagtctatatggttctccaaga

SEQ ID NO: 1098577 - DNA, 15 bp, Homo sapiens
attagtgatatagtg

SEQ ID NO: 1098578 - DNA, 22 bp, Homo sapiens
attagtgatatagtgctgttta

SEQ ID NO: 1098579 - DNA, 15 bp, Homo sapiens
attagtgattctgat

SEQ ID NO: 1098580 - DNA, 18 bp, Homo sapiens
attagtgattctgatttc

SEQ ID NO: 1098581 - DNA, 19 bp, Homo sapiens
attagtgattctgatttca

SEQ ID NO: 1098582 - DNA, 19 bp, Homo sapiens
attagtgccacttaatgta

SEQ ID NO: 1098583 - DNA, 22 bp, Homo sapiens
attagtgccacttaatgtatgt

SEQ ID NO: 1098584 - DNA, 21 bp, Homo sapiens
attagtgccagaattttagga

SEQ ID NO: 1098585 - DNA, 16 bp, Homo sapiens
attagtgtcccccctt

SEQ ID NO: 1098586 - DNA, 19 bp, Homo sapiens
attagtgtccccccttgaa

SEQ ID NO: 1098587 - DNA, 23 bp, Homo sapiens
attagtgtgacagtttccaaatt

SEQ ID NO: 1098588 - DNA, 21 bp, Homo sapiens
attagttgaaaggcctcaaga

SEQ ID NO: 1098589 - DNA, 17 bp, Homo sapiens
attagttggctttcata

SEQ ID NO: 1098590 - DNA, 20 bp, Homo sapiens
attagttttagaggcattgt

SEQ ID NO: 1098591 - DNA, 18 bp, Homo sapiens
attataaaaaatgtaaca

SEQ ID NO: 1098592 - DNA, 11 bp, Homo sapiens
attataaaaat

SEQ ID NO: 1098593 - DNA, 14 bp, Homo sapiens
attataaaaatatt

SEQ ID NO: 1098594 - DNA, 21 bp, Homo sapiens
attataaactataaacttaag

SEQ ID NO: 1098595 - DNA, 17 bp, Homo sapiens
attataaatatcattgt

SEQ ID NO: 1098596 - DNA, 15 bp, Homo sapiens
attataaatgtgttt

SEQ ID NO: 1098597 - DNA, 14 bp, Homo sapiens
attataaccttaat

SEQ ID NO: 1098598 - DNA, 21 bp, Homo sapiens
attataactgaaggagaaggt

SEQ ID NO: 1098599 - DNA, 15 bp, Homo sapiens
attataacttaaaaa

SEQ ID NO: 1098600 - DNA, 22 bp, Homo sapiens
attataacttaaaaaaatgaca

SEQ ID NO: 1098601 - DNA, 15 bp, Homo sapiens
attataacttaaaat

SEQ ID NO: 1098602 - DNA, 20 bp, Homo sapiens
attataacttaaaatatttt

SEQ ID NO: 1098603 - DNA, 23 bp, Homo sapiens
attataagccctgcataatgtta

SEQ ID NO: 1098604 - DNA, 15 bp, Homo sapiens
attataagggagagc

SEQ ID NO: 1098605 - DNA, 16 bp, Homo sapiens
attataagggccctgc

SEQ ID NO: 1098606 - DNA, 19 bp, Homo sapiens
attataagtcttacataaa

SEQ ID NO: 1098607 - DNA, 20 bp, Homo sapiens
attataataagcaaaaagat

SEQ ID NO: 1098608 - DNA, 14 bp, Homo sapiens
attataatcttata

SEQ ID NO: 1098609 - DNA, 18 bp, Homo sapiens
attataatcttataattg

SEQ ID NO: 1098610 - DNA, 16 bp, Homo sapiens
attataattggaagtg

SEQ ID NO: 1098611 - DNA, 16 bp, Homo sapiens
attataattgttgata

SEQ ID NO: 1098612 - DNA, 19 bp, Homo sapiens
attataatttgggtgacta

SEQ ID NO: 1098613 - DNA, 19 bp, Homo sapiens
attataccagatgaacatt

SEQ ID NO: 1098614 - DNA, 22 bp, Homo sapiens
attataccagatgaacatttca

SEQ ID NO: 1098615 - DNA, 14 bp, Homo sapiens
attatacgctggca

SEQ ID NO: 1098616 - DNA, 13 bp, Homo sapiens
attatactgtgtg

SEQ ID NO: 1098617 - DNA, 14 bp, Homo sapiens
attatagaaaatta

SEQ ID NO: 1098618 - DNA, 12 bp, Homo sapiens
attatagaaaca

SEQ ID NO: 1098619 - DNA, 19 bp, Homo sapiens
attatagcaactaatgttt

SEQ ID NO: 1098620 - DNA, 19 bp, Homo sapiens
attataggaatatcaatat

SEQ ID NO: 1098621 - DNA, 21 bp, Homo sapiens
attataggaatatcaatataa

SEQ ID NO: 1098622 - DNA, 17 bp, Homo sapiens
attataggagccttaat

SEQ ID NO: 1098623 - DNA, 19 bp, Homo sapiens
attataggagccttaattt

SEQ ID NO: 1098624 - DNA, 16 bp, Homo sapiens
attataggccaaactg

SEQ ID NO: 1098625 - DNA, 18 bp, Homo sapiens
attatataaatatatatt

SEQ ID NO: 1098626 - DNA, 17 bp, Homo sapiens
attatataactctttga

SEQ ID NO: 1098627 - DNA, 13 bp, Homo sapiens
attatataggttg

SEQ ID NO: 1098628 - DNA, 20 bp, Homo sapiens
attatataggttgtgcaaat

SEQ ID NO: 1098629 - DNA, 23 bp, Homo sapiens
attatataggttgtgcaaattaa

SEQ ID NO: 1098630 - DNA, 18 bp, Homo sapiens
attatatatttacagaag

SEQ ID NO: 1098631 - DNA, 15 bp, Homo sapiens
attatatatttttct

SEQ ID NO: 1098632 - DNA, 16 bp, Homo sapiens
attatatctaattatt

SEQ ID NO: 1098633 - DNA, 13 bp, Homo sapiens
attatattaaaat

SEQ ID NO: 1098634 - DNA, 19 bp, Homo sapiens
attatattcacagactgat

SEQ ID NO: 1098635 - DNA, 20 bp, Homo sapiens
attatattggtccagaagtt

SEQ ID NO: 1098636 - DNA, 16 bp, Homo sapiens
attatattgtccaggc

SEQ ID NO: 1098637 - DNA, 16 bp, Homo sapiens
attatatttgaaatcg

SEQ ID NO: 1098638 - DNA, 14 bp, Homo sapiens
attatatttgcatt

SEQ ID NO: 1098639 - DNA, 19 bp, Homo sapiens
attatatttgtgctatagt

SEQ ID NO: 1098640 - DNA, 21 bp, Homo sapiens
attatattttgagtagaactc

SEQ ID NO: 1098641 - DNA, 22 bp, Homo sapiens
attatcagttaaaatcacattt

SEQ ID NO: 1098642 - DNA, 15 bp, Homo sapiens
attatcatgcaaatg

SEQ ID NO: 1098643 - DNA, 17 bp, Homo sapiens
attatcatgcaaatgct

SEQ ID NO: 1098644 - DNA, 21 bp, Homo sapiens
attatcattgctcccctgata

SEQ ID NO: 1098645 - DNA, 17 bp, Homo sapiens
attatccaggtaatcca

SEQ ID NO: 1098646 - DNA, 13 bp, Homo sapiens
attatcccagctt

SEQ ID NO: 1098647 - DNA, 23 bp, Homo sapiens
attatccctatttttaaagtaca

SEQ ID NO: 1098648 - DNA, 21 bp, Homo sapiens
attatcctgaactcttctgca

SEQ ID NO: 1098649 - DNA, 20 bp, Homo sapiens
attatcctttattttattga

SEQ ID NO: 1098650 - DNA, 19 bp, Homo sapiens
attatcggaagcagtgcct

SEQ ID NO: 1098651 - DNA, 17 bp, Homo sapiens
attatcgggagcagtgt

SEQ ID NO: 1098652 - DNA, 20 bp, Homo sapiens
attatcgggagcagtgtctt

SEQ ID NO: 1098653 - DNA, 20 bp, Homo sapiens
attatcgttttcttaaagtg

SEQ ID NO: 1098654 - DNA, 19 bp, Homo sapiens
attatctaaaatctgctag

SEQ ID NO: 1098655 - DNA, 18 bp, Homo sapiens
attatctagatactgtat

SEQ ID NO: 1098656 - DNA, 14 bp, Homo sapiens
attatctatacata

SEQ ID NO: 1098657 - DNA, 22 bp, Homo sapiens
attatctatagctaagtacaca

SEQ ID NO: 1098658 - DNA, 14 bp, Homo sapiens
attatctgggctta

SEQ ID NO: 1098659 - DNA, 18 bp, Homo sapiens
attatcttgatacattca

SEQ ID NO: 1098660 - DNA, 20 bp, Homo sapiens
attatcttgatacattcaaa

SEQ ID NO: 1098661 - DNA, 14 bp, Homo sapiens
attatgaaaaagat

SEQ ID NO: 1098662 - DNA, 17 bp, Homo sapiens
attatgaaaaagattat

SEQ ID NO: 1098663 - DNA, 13 bp, Homo sapiens
attatgaaaataa

SEQ ID NO: 1098664 - DNA, 21 bp, Homo sapiens
attatgaaagcaacaaagaaa

SEQ ID NO: 1098665 - DNA, 23 bp, Homo sapiens
attatgaaagcaacaaagaaatc

SEQ ID NO: 1098666 - DNA, 20 bp, Homo sapiens
attatgaaggaatttgattg

SEQ ID NO: 1098667 - DNA, 21 bp, Homo sapiens
attatgaaggaatttgattgc

SEQ ID NO: 1098668 - DNA, 22 bp, Homo sapiens
attccagtcaaatctgggctca

SEQ ID NO: 1098669 - DNA, 17 bp, Homo sapiens
attccagtggaccctgg

SEQ ID NO: 1098670 - DNA, 23 bp, Homo sapiens
attccatagtggaccacttggaa

SEQ ID NO: 1098671 - DNA, 18 bp, Homo sapiens
attccatgaatgtatcag

SEQ ID NO: 1098672 - DNA, 15 bp, Homo sapiens
attccatgagctgct

SEQ ID NO: 1098673 - DNA, 18 bp, Homo sapiens
attccatgagctgctcat

SEQ ID NO: 1098674 - DNA, 19 bp, Homo sapiens
attccatggaaataaaaag

SEQ ID NO: 1098675 - DNA, 18 bp, Homo sapiens
attccatggaatttctag

SEQ ID NO: 1098676 - DNA, 19 bp, Homo sapiens
attccattgcctagctctt

SEQ ID NO: 1098677 - DNA, 18 bp, Homo sapiens
attccatttaaaaaacaa

SEQ ID NO: 1098678 - DNA, 13 bp, Homo sapiens
attccatttctgg

SEQ ID NO: 1098679 - DNA, 19 bp, Homo sapiens
attcccaagccgaccttcc

SEQ ID NO: 1098680 - DNA, 22 bp, Homo sapiens
attcccaagctctagtgggaag

SEQ ID NO: 1098681 - DNA, 15 bp, Homo sapiens
attcccactgccagg

SEQ ID NO: 1098682 - DNA, 19 bp, Homo sapiens
attcccagagcaaaataat

SEQ ID NO: 1098683 - DNA, 15 bp, Homo sapiens
attcccattgtgaca

SEQ ID NO: 1098684 - DNA, 18 bp, Homo sapiens
attcccattttgcaaaat

SEQ ID NO: 1098685 - DNA, 23 bp, Homo sapiens
attcccattttgcaaaatttcca

SEQ ID NO: 1098686 - DNA, 14 bp, Homo sapiens
attccccagagtgg

SEQ ID NO: 1098687 - DNA, 17 bp, Homo sapiens
attccccatttcctgta

SEQ ID NO: 1098688 - DNA, 19 bp, Homo sapiens
attcccccttaaacttcca

SEQ ID NO: 1098689 - DNA, 23 bp, Homo sapiens
attcccccttaaacttccaaagc

SEQ ID NO: 1098690 - DNA, 21 bp, Homo sapiens
attcccctccccactcctctc

SEQ ID NO: 1098691 - DNA, 22 bp, Homo sapiens
attcccctccccactcctctcc

SEQ ID NO: 1098692 - DNA, 15 bp, Homo sapiens
attcccctctgctgc

SEQ ID NO: 1098693 - DNA, 16 bp, Homo sapiens
attcccgttttgtcac

SEQ ID NO: 1098694 - DNA, 20 bp, Homo sapiens
attccctagaaacttccaaa

SEQ ID NO: 1098695 - DNA, 21 bp, Homo sapiens
attccctagaaacttccaaat

SEQ ID NO: 1098696 - DNA, 22 bp, Homo sapiens
attccctccccctccttgtgcc

SEQ ID NO: 1098697 - DNA, 19 bp, Homo sapiens
attccctctcctgcccaga

SEQ ID NO: 1098698 - DNA, 23 bp, Homo sapiens
attccctgcccaaacccttaact

SEQ ID NO: 1098699 - DNA, 22 bp, Homo sapiens
attccctgctaaatgccatgtt

SEQ ID NO: 1098700 - DNA, 14 bp, Homo sapiens
attccctgggatct

SEQ ID NO: 1098701 - DNA, 16 bp, Homo sapiens
attccctgggatctgg

SEQ ID NO: 1098702 - DNA, 13 bp, Homo sapiens
attcccttcctgt

SEQ ID NO: 1098703 - DNA, 17 bp, Homo sapiens
attcccttgaattgtgt

SEQ ID NO: 1098704 - DNA, 12 bp, Homo sapiens
attcccttgtat

SEQ ID NO: 1098705 - DNA, 15 bp, Homo sapiens
attccgtatttaaag

SEQ ID NO: 1098706 - DNA, 18 bp, Homo sapiens
attccgttgtctgtggat

SEQ ID NO: 1098707 - DNA, 19 bp, Homo sapiens
attccgttgtctgtggatg

SEQ ID NO: 1098708 - DNA, 14 bp, Homo sapiens
attcctaaaattat

SEQ ID NO: 1098709 - DNA, 24 bp, Homo sapiens
attcctaaagctgcttagaatctg

SEQ ID NO: 1098710 - DNA, 21 bp, Homo sapiens
attcctaaatattttcaagaa

SEQ ID NO: 1098711 - DNA, 18 bp, Homo sapiens
attcctaacttttcaatg

SEQ ID NO: 1098712 - DNA, 15 bp, Homo sapiens
attcctaagccactt

SEQ ID NO: 1098713 - DNA, 18 bp, Homo sapiens
attcctacaaagatgttt

SEQ ID NO: 1098714 - DNA, 13 bp, Homo sapiens
attcctacaactt

SEQ ID NO: 1098715 - DNA, 14 bp, Homo sapiens
attcctacaactta

SEQ ID NO: 1098716 - DNA, 21 bp, Homo sapiens
attcctacaacttaatggaaa

SEQ ID NO: 1098717 - DNA, 15 bp, Homo sapiens
attcctacagcacta

SEQ ID NO: 1098718 - DNA, 16 bp, Homo sapiens
attcctacagcactac

SEQ ID NO: 1098719 - DNA, 15 bp, Homo sapiens
attcctacccctctt

SEQ ID NO: 1098720 - DNA, 20 bp, Homo sapiens
attcctacccctcttccagc

SEQ ID NO: 1098721 - DNA, 17 bp, Homo sapiens
attcctacctccctgca

SEQ ID NO: 1098722 - DNA, 15 bp, Homo sapiens
attcctactccctct

SEQ ID NO: 1098723 - DNA, 18 bp, Homo sapiens
attcctactccctcttcc

SEQ ID NO: 1098724 - DNA, 18 bp, Homo sapiens
attcctagaaattgaaca

SEQ ID NO: 1098725 - DNA, 20 bp, Homo sapiens
attcctatatcctgtgactg

SEQ ID NO: 1098726 - DNA, 11 bp, Homo sapiens
attcctatgaa

SEQ ID NO: 1098727 - DNA, 15 bp, Homo sapiens
attcctattactgca

SEQ ID NO: 1098728 - DNA, 22 bp, Homo sapiens
attcctattgtgcaatgtaaat

SEQ ID NO: 1098729 - DNA, 17 bp, Homo sapiens
attcctcagattgctga

SEQ ID NO: 1098730 - DNA, 13 bp, Homo sapiens
attcctcagctgc

SEQ ID NO: 1098731 - DNA, 19 bp, Homo sapiens
attcctcaggaaggacatg

SEQ ID NO: 1098732 - DNA, 13 bp, Homo sapiens
attcctccagcct

SEQ ID NO: 1098733 - DNA, 16 bp, Homo sapiens
attcctccagcctccc

SEQ ID NO: 1098734 - DNA, 20 bp, Homo sapiens
attcctccagcctcccctcc

SEQ ID NO: 1098735 - DNA, 16 bp, Homo sapiens
attcctccctccggcc

SEQ ID NO: 1098736 - DNA, 16 bp, Homo sapiens
attcctccttcccccc

SEQ ID NO: 1098737 - DNA, 23 bp, Homo sapiens
attcctccttccccccatctctg

SEQ ID NO: 1098738 - DNA, 12 bp, Homo sapiens
attcctctggga

SEQ ID NO: 1098739 - DNA, 13 bp, Homo sapiens
attcctctgggaa

SEQ ID NO: 1098740 - DNA, 19 bp, Homo sapiens
attcctcttgcctctctca

SEQ ID NO: 1098741 - DNA, 19 bp, Homo sapiens
attcctcttggcaagatgt

SEQ ID NO: 1098742 - DNA, 17 bp, Homo sapiens
attcctctttgctttgc

SEQ ID NO: 1098743 - DNA, 13 bp, Homo sapiens
attcctcttttta

SEQ ID NO: 1098744 - DNA, 15 bp, Homo sapiens
attcctgaagccaga

SEQ ID NO: 1098745 - DNA, 17 bp, Homo sapiens
attcctgaatgaaatat

SEQ ID NO: 1098746 - DNA, 16 bp, Homo sapiens
attcctgacccaggcc

SEQ ID NO: 1098747 - DNA, 21 bp, Homo sapiens
attcctgacccaggccgcagc

SEQ ID NO: 1098748 - DNA, 15 bp, Homo sapiens
attcctgcatttgtg

SEQ ID NO: 1098749 - DNA, 20 bp, Homo sapiens
attcctgcctttaagccaaa

SEQ ID NO: 1098750 - DNA, 19 bp, Homo sapiens
attcctgctatgacagctg

SEQ ID NO: 1098751 - DNA, 21 bp, Homo sapiens
attcctgctatgacagctggc

SEQ ID NO: 1098752 - DNA, 14 bp, Homo sapiens
attcctggacatca

SEQ ID NO: 1098753 - DNA, 17 bp, Homo sapiens
attcctggccccgggct

SEQ ID NO: 1098754 - DNA, 11 bp, Homo sapiens
attcctgggcc

SEQ ID NO: 1098755 - DNA, 15 bp, Homo sapiens
attcctgggcctgtc

SEQ ID NO: 1098756 - DNA, 18 bp, Homo sapiens
attcctggtacccagcca

SEQ ID NO: 1098757 - DNA, 13 bp, Homo sapiens
attcctgtaaata

SEQ ID NO: 1098758 - DNA, 17 bp, Homo sapiens
attcctgtccctttgtt

SEQ ID NO: 1098759 - DNA, 20 bp, Homo sapiens
attcctgtgttcaatattta

SEQ ID NO: 1098760 - DNA, 16 bp, Homo sapiens
attccttaaataaact

SEQ ID NO: 1098761 - DNA, 13 bp, Homo sapiens
attccttacttgc

SEQ ID NO: 1098762 - DNA, 17 bp, Homo sapiens
attccttacttgcactg

SEQ ID NO: 1098763 - DNA, 22 bp, Homo sapiens
attccttagactcttttccttc

SEQ ID NO: 1098764 - DNA, 20 bp, Homo sapiens
attccttagataccttgaaa

SEQ ID NO: 1098765 - DNA, 18 bp, Homo sapiens
attccttcaaataaagaa

SEQ ID NO: 1098766 - DNA, 17 bp, Homo sapiens
attccttcactcatcca

SEQ ID NO: 1098767 - DNA, 22 bp, Homo sapiens
attccttccatctagcagctgg

SEQ ID NO: 1098768 - DNA, 18 bp, Homo sapiens
attccttcgaaaggcctt

SEQ ID NO: 1098769 - DNA, 20 bp, Homo sapiens
attccttcgaaaggccttca

SEQ ID NO: 1098770 - DNA, 22 bp, Homo sapiens
attccttcgaaaggccttcaga

SEQ ID NO: 1098771 - DNA, 19 bp, Homo sapiens
attccttctaagataaaaa

SEQ ID NO: 1098772 - DNA, 21 bp, Homo sapiens
attccttctcccatctcttcc

SEQ ID NO: 1098773 - DNA, 23 bp, Homo sapiens
attccttctgcctaacttgtaaa

SEQ ID NO: 1098774 - DNA, 19 bp, Homo sapiens
attccttgcgcctcagccc

SEQ ID NO: 1098775 - DNA, 12 bp, Homo sapiens
attccttgtgaa

SEQ ID NO: 1098776 - DNA, 20 bp, Homo sapiens
attccttgtgttttgtcctg

SEQ ID NO: 1098777 - DNA, 21 bp, Homo sapiens
attcctttacaactaaataac

SEQ ID NO: 1098778 - DNA, 22 bp, Homo sapiens
attcctttacaactaaataaca

SEQ ID NO: 1098779 - DNA, 12 bp, Homo sapiens
attcctttccct

SEQ ID NO: 1098780 - DNA, 13 bp, Homo sapiens
attcctttccctt

SEQ ID NO: 1098781 - DNA, 15 bp, Homo sapiens
attcctttctcatcc

SEQ ID NO: 1098782 - DNA, 23 bp, Homo sapiens
attcctttcttgtgccctgggcc

SEQ ID NO: 1098783 - DNA, 23 bp, Homo sapiens
attcctttgaatattttttgaag

SEQ ID NO: 1098784 - DNA, 23 bp, Homo sapiens
attcctttgtcttcaaactgtga

SEQ ID NO: 1098785 - DNA, 18 bp, Homo sapiens
attcctttgtgtttctat

SEQ ID NO: 1098786 - DNA, 19 bp, Homo sapiens
attccttttgatggggaga

SEQ ID NO: 1098787 - DNA, 19 bp, Homo sapiens
attcgaggtgtcaccctgc

SEQ ID NO: 1098788 - DNA, 19 bp, Homo sapiens
attcgatctcattcagtat

SEQ ID NO: 1098789 - DNA, 14 bp, Homo sapiens
attgaaaatggctt

SEQ ID NO: 1098790 - DNA, 21 bp, Homo sapiens
attgaaaatggctttctcagc

SEQ ID NO: 1098791 - DNA, 22 bp, Homo sapiens
attgaaaatgtccaggaaagtg

SEQ ID NO: 1098792 - DNA, 18 bp, Homo sapiens
attgaaaattgaaaagta

SEQ ID NO: 1098793 - DNA, 15 bp, Homo sapiens
attgaaacacagagt

SEQ ID NO: 1098794 - DNA, 13 bp, Homo sapiens
attgaaagaactt

SEQ ID NO: 1098795 - DNA, 16 bp, Homo sapiens
attgaaagaattatcc

SEQ ID NO: 1098796 - DNA, 23 bp, Homo sapiens
attgaaagccaacaactctgcct

SEQ ID NO: 1098797 - DNA, 12 bp, Homo sapiens
attgaaagtatt

SEQ ID NO: 1098798 - DNA, 17 bp, Homo sapiens
attgaaagtattcagaa

SEQ ID NO: 1098799 - DNA, 16 bp, Homo sapiens
attgaaatattataga

SEQ ID NO: 1098800 - DNA, 17 bp, Homo sapiens
attgaaattgtacatat

SEQ ID NO: 1098801 - DNA, 21 bp, Homo sapiens
attgaaattgtacatatttgt

SEQ ID NO: 1098802 - DNA, 23 bp, Homo sapiens
attgaacaaaaatgtttccactg

SEQ ID NO: 1098803 - DNA, 22 bp, Homo sapiens
attgaaccatttgggatggaga

SEQ ID NO: 1098804 - DNA, 23 bp, Homo sapiens
attgaaccatttgggatggagaa

SEQ ID NO: 1098805 - DNA, 15 bp, Homo sapiens
attgaacccaggagg

SEQ ID NO: 1098806 - DNA, 21 bp, Homo sapiens
attgaacgactgtatattgct

SEQ ID NO: 1098807 - DNA, 22 bp, Homo sapiens
attgaacgactgtatattgcta

SEQ ID NO: 1098808 - DNA, 23 bp, Homo sapiens
attgaactgtattctagtggctg

SEQ ID NO: 1098809 - DNA, 19 bp, Homo sapiens
attgaacttactgtagcct

SEQ ID NO: 1098810 - DNA, 16 bp, Homo sapiens
attgaacttttgtact

SEQ ID NO: 1098811 - DNA, 17 bp, Homo sapiens
attgaacttttgtactg

SEQ ID NO: 1098812 - DNA, 23 bp, Homo sapiens
attgaacttttgtactgaatttt

SEQ ID NO: 1098813 - DNA, 16 bp, Homo sapiens
attgaagaatgttaga

SEQ ID NO: 1098814 - DNA, 14 bp, Homo sapiens
attgaagacaattt

SEQ ID NO: 1098815 - DNA, 22 bp, Homo sapiens
attgaagacaatttgatacata

SEQ ID NO: 1098816 - DNA, 13 bp, Homo sapiens
attgaagagaact

SEQ ID NO: 1098817 - DNA, 20 bp, Homo sapiens
attgaaggtgataagggaaa

SEQ ID NO: 1098818 - DNA, 16 bp, Homo sapiens
attgaaggttttagac

SEQ ID NO: 1098819 - DNA, 16 bp, Homo sapiens
attgaagtaatgaatt

SEQ ID NO: 1098820 - DNA, 19 bp, Homo sapiens
attgaagtattttgctgga

SEQ ID NO: 1098821 - DNA, 19 bp, Homo sapiens
attgaagtgttctgagctg

SEQ ID NO: 1098822 - DNA, 13 bp, Homo sapiens
attgaagtttcaa

SEQ ID NO: 1098823 - DNA, 13 bp, Homo sapiens
attgaatatatca

SEQ ID NO: 1098824 - DNA, 19 bp, Homo sapiens
attgaatctacaaaagtga

SEQ ID NO: 1098825 - DNA, 14 bp, Homo sapiens
attgaatctattta

SEQ ID NO: 1098826 - DNA, 16 bp, Homo sapiens
attgaatctatttaag

SEQ ID NO: 1098827 - DNA, 22 bp, Homo sapiens
attgaatgatatataaatatat

SEQ ID NO: 1098828 - DNA, 20 bp, Homo sapiens
attgaatggtgcattgtata

SEQ ID NO: 1098829 - DNA, 16 bp, Homo sapiens
attgaatgtttccaac

SEQ ID NO: 1098830 - DNA, 13 bp, Homo sapiens
attgaattagaaa

SEQ ID NO: 1098831 - DNA, 22 bp, Homo sapiens
attgaattcttggttgaggaaa

SEQ ID NO: 1098832 - DNA, 23 bp, Homo sapiens
attgaatttgcacggtttgtgag

SEQ ID NO: 1098833 - DNA, 13 bp, Homo sapiens
attgaatttgtta

SEQ ID NO: 1098834 - DNA, 15 bp, Homo sapiens
attgacaagtcattt

SEQ ID NO: 1098835 - DNA, 15 bp, Homo sapiens
attgacaataaaata

SEQ ID NO: 1098836 - DNA, 20 bp, Homo sapiens
attgacaataaaatattatt

SEQ ID NO: 1098837 - DNA, 17 bp, Homo sapiens
attgacaataatttcag

SEQ ID NO: 1098838 - DNA, 18 bp, Homo sapiens
attgacaataatttcagg

SEQ ID NO: 1098839 - DNA, 12 bp, Homo sapiens
attgacacagaa

SEQ ID NO: 1098840 - DNA, 14 bp, Homo sapiens
attgacactgaact

SEQ ID NO: 1098841 - DNA, 16 bp, Homo sapiens
attgacagaacccttt

SEQ ID NO: 1098842 - DNA, 23 bp, Homo sapiens
attgacagaaccctttgggagca

SEQ ID NO: 1098843 - DNA, 13 bp, Homo sapiens
attgacagctttg

SEQ ID NO: 1098844 - DNA, 15 bp, Homo sapiens
attgacagctttgct

SEQ ID NO: 1098845 - DNA, 18 bp, Homo sapiens
attgacagctttgctgct

SEQ ID NO: 1098846 - DNA, 23 bp, Homo sapiens
attgacatgaccctctgtcccca

SEQ ID NO: 1098847 - DNA, 17 bp, Homo sapiens
attgacattgaaatcta

SEQ ID NO: 1098848 - DNA, 18 bp, Homo sapiens
attgacatttgtagttga

SEQ ID NO: 1098849 - DNA, 21 bp, Homo sapiens
attgaccctagccagagaata

SEQ ID NO: 1098850 - DNA, 20 bp, Homo sapiens
attgaccgcgactaatttca

SEQ ID NO: 1098851 - DNA, 22 bp, Homo sapiens
attgacctatttccagaaatac

SEQ ID NO: 1098852 - DNA, 16 bp, Homo sapiens
attgacctcagctgca

SEQ ID NO: 1098853 - DNA, 20 bp, Homo sapiens
attgacctcagctgcacatt

SEQ ID NO: 1098854 - DNA, 21 bp, Homo sapiens
attgacctcagctgcacattc

SEQ ID NO: 1098855 - DNA, 14 bp, Homo sapiens
attgactgcagttg

SEQ ID NO: 1098856 - DNA, 19 bp, Homo sapiens
attgacttagatattaaaa

SEQ ID NO: 1098857 - DNA, 14 bp, Homo sapiens
attgacttcaatga

SEQ ID NO: 1098858 - DNA, 14 bp, Homo sapiens
attgacttgtatat

SEQ ID NO: 1098859 - DNA, 13 bp, Homo sapiens
attgactttgaca

SEQ ID NO: 1098860 - DNA, 17 bp, Homo sapiens
attgagaaagatgttcc

SEQ ID NO: 1098861 - DNA, 18 bp, Homo sapiens
attgagaactgcatatgt

SEQ ID NO: 1098862 - DNA, 12 bp, Homo sapiens
attgagaatcag

SEQ ID NO: 1098863 - DNA, 18 bp, Homo sapiens
attgagacctacaggctg

SEQ ID NO: 1098864 - DNA, 19 bp, Homo sapiens
attgagacctacaggctga

SEQ ID NO: 1098865 - DNA, 18 bp, Homo sapiens
attgagcagaattcattc

SEQ ID NO: 1098866 - DNA, 23 bp, Homo sapiens
attgagcatattttcttactttt

SEQ ID NO: 1098867 - DNA, 16 bp, Homo sapiens
attgagccttgcatgt

SEQ ID NO: 1098868 - DNA, 20 bp, Homo sapiens
attgagctctctgcccttga

SEQ ID NO: 1098869 - DNA, 14 bp, Homo sapiens
attgaggaattaac

SEQ ID NO: 1098870 - DNA, 21 bp, Homo sapiens
attgaggccaagaatattgca

SEQ ID NO: 1098871 - DNA, 22 bp, Homo sapiens
attgaggccaagaatattgcaa

SEQ ID NO: 1098872 - DNA, 12 bp, Homo sapiens
attgaggcctgc

SEQ ID NO: 1098873 - DNA, 21 bp, Homo sapiens
attgaggctgcagcaggtgct

SEQ ID NO: 1098874 - DNA, 22 bp, Homo sapiens
attgaggggattaatatgaaaa

SEQ ID NO: 1098875 - DNA, 22 bp, Homo sapiens
attgagtaatggtgtagaacac

SEQ ID NO: 1098876 - DNA, 16 bp, Homo sapiens
attgagtgctggggga

SEQ ID NO: 1098877 - DNA, 13 bp, Homo sapiens
attgataatcttc

SEQ ID NO: 1098878 - DNA, 16 bp, Homo sapiens
attgataatcttcagg

SEQ ID NO: 1098879 - DNA, 14 bp, Homo sapiens
attgatacttcagg

SEQ ID NO: 1098880 - DNA, 20 bp, Homo sapiens
attgatacttcaggtgcttt

SEQ ID NO: 1098881 - DNA, 17 bp, Homo sapiens
attgatatcgtgaaatc

SEQ ID NO: 1098882 - DNA, 21 bp, Homo sapiens
attgatatcgtgaaatcctca

SEQ ID NO: 1098883 - DNA, 14 bp, Homo sapiens
attgatattctaag

SEQ ID NO: 1098884 - DNA, 18 bp, Homo sapiens
attgatcattttcccccc

SEQ ID NO: 1098885 - DNA, 21 bp, Homo sapiens
attgatcattttccccccact

SEQ ID NO: 1098886 - DNA, 14 bp, Homo sapiens
attgatccaggaga

SEQ ID NO: 1098887 - DNA, 15 bp, Homo sapiens
attgatgattttgta

SEQ ID NO: 1098888 - DNA, 13 bp, Homo sapiens
attgatgtaagga

SEQ ID NO: 1098889 - DNA, 16 bp, Homo sapiens
attgatgttaacaaga

SEQ ID NO: 1098890 - DNA, 21 bp, Homo sapiens
attgatgttttacgtgcaaac

SEQ ID NO: 1098891 - DNA, 22 bp, Homo sapiens
attgatgttttacgtgcaaaca

SEQ ID NO: 1098892 - DNA, 16 bp, Homo sapiens
attgattaaaatctct

SEQ ID NO: 1098893 - DNA, 17 bp, Homo sapiens
attgattaaaatctctt

SEQ ID NO: 1098894 - DNA, 18 bp, Homo sapiens
attgattaaaatctcttg

SEQ ID NO: 1098895 - DNA, 19 bp, Homo sapiens
attgattacaaataaacag

SEQ ID NO: 1098896 - DNA, 21 bp, Homo sapiens
attgattacaaataaacagtt

SEQ ID NO: 1098897 - DNA, 13 bp, Homo sapiens
attgattacaatt

SEQ ID NO: 1098898 - DNA, 15 bp, Homo sapiens
attgattacaattga

SEQ ID NO: 1098899 - DNA, 14 bp, Homo sapiens
attgattgaatttt

SEQ ID NO: 1098900 - DNA, 16 bp, Homo sapiens
attgattgtcagccac

SEQ ID NO: 1098901 - DNA, 21 bp, Homo sapiens
attgatttaaaagtgtatttt

SEQ ID NO: 1098902 - DNA, 21 bp, Homo sapiens
attgatttccgttaaaatacc

SEQ ID NO: 1098903 - DNA, 12 bp, Homo sapiens
attgatttgcat

SEQ ID NO: 1098904 - DNA, 15 bp, Homo sapiens
attgatttgcattga

SEQ ID NO: 1098905 - DNA, 23 bp, Homo sapiens
attgatttttctataatcacttg

SEQ ID NO: 1098906 - DNA, 18 bp, Homo sapiens
attgcaaaatacatgaag

SEQ ID NO: 1098907 - DNA, 15 bp, Homo sapiens
attgcaaaatagcat

SEQ ID NO: 1098908 - DNA, 19 bp, Homo sapiens
attgcaaaatagcatttgt

SEQ ID NO: 1098909 - DNA, 23 bp, Homo sapiens
attgcaaaggttccaactgtata

SEQ ID NO: 1098910 - DNA, 15 bp, Homo sapiens
attgttccaagacat

SEQ ID NO: 1098911 - DNA, 21 bp, Homo sapiens
attgttccaagacattgtcaa

SEQ ID NO: 1098912 - DNA, 24 bp, Homo sapiens
attgttccagcagttttcaagtca

SEQ ID NO: 1098913 - DNA, 21 bp, Homo sapiens
attgttcccagtgacacttca

SEQ ID NO: 1098914 - DNA, 14 bp, Homo sapiens
attgttcccttcct

SEQ ID NO: 1098915 - DNA, 21 bp, Homo sapiens
attgttcctgaatacaagcct

SEQ ID NO: 1098916 - DNA, 17 bp, Homo sapiens
attgttctaatgcaaca

SEQ ID NO: 1098917 - DNA, 17 bp, Homo sapiens
attgttctcagaatccc

SEQ ID NO: 1098918 - DNA, 19 bp, Homo sapiens
attgttcttagtttgcagt

SEQ ID NO: 1098919 - DNA, 18 bp, Homo sapiens
attgttgaaaaagtttgt

SEQ ID NO: 1098920 - DNA, 20 bp, Homo sapiens
attgttgaaaaagtttgttt

SEQ ID NO: 1098921 - DNA, 18 bp, Homo sapiens
attgttgataggaactgt

SEQ ID NO: 1098922 - DNA, 14 bp, Homo sapiens
attgttgattaatt

SEQ ID NO: 1098923 - DNA, 14 bp, Homo sapiens
attgttgcattgct

SEQ ID NO: 1098924 - DNA, 16 bp, Homo sapiens
attgttgtaaactgtt

SEQ ID NO: 1098925 - DNA, 16 bp, Homo sapiens
attgttgtccttttca

SEQ ID NO: 1098926 - DNA, 18 bp, Homo sapiens
attgttgtccttttcata

SEQ ID NO: 1098927 - DNA, 15 bp, Homo sapiens
attgttgtgtctgtg

SEQ ID NO: 1098928 - DNA, 19 bp, Homo sapiens
attgttgttctgttaactg

SEQ ID NO: 1098929 - DNA, 13 bp, Homo sapiens
attgttgttgcca

SEQ ID NO: 1098930 - DNA, 18 bp, Homo sapiens
attgttgtttgtatgtat

SEQ ID NO: 1098931 - DNA, 20 bp, Homo sapiens
attgttgtttgtatgtataa

SEQ ID NO: 1098932 - DNA, 22 bp, Homo sapiens
attgtttaaaaaccgaataaat

SEQ ID NO: 1098933 - DNA, 19 bp, Homo sapiens
attgtttaaaattcagttt

SEQ ID NO: 1098934 - DNA, 12 bp, Homo sapiens
attgtttaaaga

SEQ ID NO: 1098935 - DNA, 16 bp, Homo sapiens
attgtttagtggaaaa

SEQ ID NO: 1098936 - DNA, 20 bp, Homo sapiens
attgtttatacacaactttg

SEQ ID NO: 1098937 - DNA, 21 bp, Homo sapiens
attgtttatgtgttatgaaca

SEQ ID NO: 1098938 - DNA, 23 bp, Homo sapiens
attgtttatgtgttatgaacatc

SEQ ID NO: 1098939 - DNA, 14 bp, Homo sapiens
attgtttattcttt

SEQ ID NO: 1098940 - DNA, 15 bp, Homo sapiens
attgtttatttatca

SEQ ID NO: 1098941 - DNA, 19 bp, Homo sapiens
attgtttatttatcagtga

SEQ ID NO: 1098942 - DNA, 21 bp, Homo sapiens
attgtttcaaaatagtcattt

SEQ ID NO: 1098943 - DNA, 19 bp, Homo sapiens
attgtttccaacttgtctg

SEQ ID NO: 1098944 - DNA, 17 bp, Homo sapiens
attgtttcctcttccaa

SEQ ID NO: 1098945 - DNA, 12 bp, Homo sapiens
attgtttctgca

SEQ ID NO: 1098946 - DNA, 14 bp, Homo sapiens
attgtttcttgaca

SEQ ID NO: 1098947 - DNA, 20 bp, Homo sapiens
attgtttctttaagaaagta

SEQ ID NO: 1098948 - DNA, 13 bp, Homo sapiens
attgtttgaaaca

SEQ ID NO: 1098949 - DNA, 15 bp, Homo sapiens
attgtttgaaatgtc

SEQ ID NO: 1098950 - DNA, 16 bp, Homo sapiens
attgtttgaaatgtcg

SEQ ID NO: 1098951 - DNA, 15 bp, Homo sapiens
attgtttgatgtttt

SEQ ID NO: 1098952 - DNA, 15 bp, Homo sapiens
attgtttgctgttgg

SEQ ID NO: 1098953 - DNA, 15 bp, Homo sapiens
attgtttgcttattg

SEQ ID NO: 1098954 - DNA, 21 bp, Homo sapiens
attgtttgcttattgttccaa

SEQ ID NO: 1098955 - DNA, 22 bp, Homo sapiens
attgtttgcttattgttccaag

SEQ ID NO: 1098956 - DNA, 23 bp, Homo sapiens
attgtttgtttgtaagtttgaat

SEQ ID NO: 1098957 - DNA, 18 bp, Homo sapiens
attgttttacaatagttc

SEQ ID NO: 1098958 - DNA, 18 bp, Homo sapiens
attgttttcagtgtacat

SEQ ID NO: 1098959 - DNA, 19 bp, Homo sapiens
attgttttcccaagtgtaa

SEQ ID NO: 1098960 - DNA, 19 bp, Homo sapiens
attgttttctttaaagatg

SEQ ID NO: 1098961 - DNA, 16 bp, Homo sapiens
attgtttttgaattta

SEQ ID NO: 1098962 - DNA, 16 bp, Homo sapiens
attgtttttgtatatt

SEQ ID NO: 1098963 - DNA, 14 bp, Homo sapiens
attgttttttaaag

SEQ ID NO: 1098964 - DNA, 16 bp, Homo sapiens
attgttttttaaagaa

SEQ ID NO: 1098965 - DNA, 16 bp, Homo sapiens
attgttttttaaagca

SEQ ID NO: 1098966 - DNA, 23 bp, Homo sapiens
attgttttttaaagcaagtcacc

SEQ ID NO: 1098967 - DNA, 13 bp, Homo sapiens
atttaaaaaacta

SEQ ID NO: 1098968 - DNA, 15 bp, Homo sapiens
atttaaaaaataact

SEQ ID NO: 1098969 - DNA, 17 bp, Homo sapiens
atttaaaaaattaaaaa

SEQ ID NO: 1098970 - DNA, 22 bp, Homo sapiens
atttaaaaagctcactgctgat

SEQ ID NO: 1098971 - DNA, 16 bp, Homo sapiens
atttaaaaataagaaa

SEQ ID NO: 1098972 - DNA, 14 bp, Homo sapiens
atttaaaaatattt

SEQ ID NO: 1098973 - DNA, 16 bp, Homo sapiens
atttaaaaatatttca

SEQ ID NO: 1098974 - DNA, 18 bp, Homo sapiens
atttaaaaatctccatta

SEQ ID NO: 1098975 - DNA, 21 bp, Homo sapiens
atttaaaaatgccaaaactta

SEQ ID NO: 1098976 - DNA, 14 bp, Homo sapiens
atttaaaaatgtct

SEQ ID NO: 1098977 - DNA, 16 bp, Homo sapiens
atttaaaaatgtcttg

SEQ ID NO: 1098978 - DNA, 15 bp, Homo sapiens
atttaaaaatgttag

SEQ ID NO: 1098979 - DNA, 15 bp, Homo sapiens
atttaaaaattgttt

SEQ ID NO: 1098980 - DNA, 16 bp, Homo sapiens
atttaaaacagacact

SEQ ID NO: 1098981 - DNA, 19 bp, Homo sapiens
atttaaaacattaaaatat

SEQ ID NO: 1098982 - DNA, 19 bp, Homo sapiens
atttaaaacttttgtttaa

SEQ ID NO: 1098983 - DNA, 21 bp, Homo sapiens
atttaaaagtaaaatgtcttt

SEQ ID NO: 1098984 - DNA, 15 bp, Homo sapiens
atttaaaatagcaaa

SEQ ID NO: 1098985 - DNA, 20 bp, Homo sapiens
atttaaaatagcaaaagaag

SEQ ID NO: 1098986 - DNA, 21 bp, Homo sapiens
atttaaaatagcaaaagaaga

SEQ ID NO: 1098987 - DNA, 14 bp, Homo sapiens
atttaaaattaagt

SEQ ID NO: 1098988 - DNA, 11 bp, Homo sapiens
atttaaaattg

SEQ ID NO: 1098989 - DNA, 17 bp, Homo sapiens
atttaaaattgctatgt

SEQ ID NO: 1098990 - DNA, 14 bp, Homo sapiens
atttaaacacacag

SEQ ID NO: 1098991 - DNA, 14 bp, Homo sapiens
atttaaacagcagt

SEQ ID NO: 1098992 - DNA, 15 bp, Homo sapiens
atttaaacagcagtg

SEQ ID NO: 1098993 - DNA, 18 bp, Homo sapiens
atttaaacaggcccagca

SEQ ID NO: 1098994 - DNA, 20 bp, Homo sapiens
atttaaacccaatcagatgc

SEQ ID NO: 1098995 - DNA, 21 bp, Homo sapiens
atttaaaccgctaaaagaaac

SEQ ID NO: 1098996 - DNA, 18 bp, Homo sapiens
atttaaactaaattactg

SEQ ID NO: 1098997 - DNA, 15 bp, Homo sapiens
atttaaactctgcca

SEQ ID NO: 1098998 - DNA, 19 bp, Homo sapiens
atttaaactctgccagaaa

SEQ ID NO: 1098999 - DNA, 22 bp, Homo sapiens
atttaaactttttaaaatactt

SEQ ID NO: 1099000 - DNA, 19 bp, Homo sapiens
atttaaagaaaataaacac

SEQ ID NO: 1099001 - DNA, 15 bp, Homo sapiens
atttaaagaaagtga

SEQ ID NO: 1099002 - DNA, 17 bp, Homo sapiens
atttaaagaatgagaaa

SEQ ID NO: 1099003 - DNA, 12 bp, Homo sapiens
atttaaagcagg

SEQ ID NO: 1099004 - DNA, 19 bp, Homo sapiens
atttaaagcaggttcttgt

SEQ ID NO: 1099005 - DNA, 15 bp, Homo sapiens
atttaaagctaaatt

SEQ ID NO: 1099006 - DNA, 16 bp, Homo sapiens
atttaaaggaaacact

SEQ ID NO: 1099007 - DNA, 17 bp, Homo sapiens
atttaaaggaaacacta

SEQ ID NO: 1099008 - DNA, 15 bp, Homo sapiens
atttaaataaaatca

SEQ ID NO: 1099009 - DNA, 13 bp, Homo sapiens
atttaaataaagt

SEQ ID NO: 1099010 - DNA, 21 bp, Homo sapiens
atttaaatacagtcttccatt

SEQ ID NO: 1099011 - DNA, 19 bp, Homo sapiens
atttaaatataattctgta

SEQ ID NO: 1099012 - DNA, 13 bp, Homo sapiens
atttaaatctgtt

SEQ ID NO: 1099013 - DNA, 22 bp, Homo sapiens
atttaaatgcaaccagaattgt

SEQ ID NO: 1099014 - DNA, 14 bp, Homo sapiens
atttaaatgcatgt

SEQ ID NO: 1099015 - DNA, 23 bp, Homo sapiens
atttaaatgcatgtcttaaatgc

SEQ ID NO: 1099016 - DNA, 15 bp, Homo sapiens
atttaaatgtgtaca

SEQ ID NO: 1099017 - DNA, 24 bp, Homo sapiens
atttaaatgtgtacaatgtacaca

SEQ ID NO: 1099018 - DNA, 21 bp, Homo sapiens
atttaaattacaattttatct

SEQ ID NO: 1099019 - DNA, 12 bp, Homo sapiens
atttaaatttga

SEQ ID NO: 1099020 - DNA, 20 bp, Homo sapiens
atttaacaaaaagtgcttca

SEQ ID NO: 1099021 - DNA, 15 bp, Homo sapiens
atttaacagaaatgt

SEQ ID NO: 1099022 - DNA, 17 bp, Homo sapiens
atttaacagaaatgtac

SEQ ID NO: 1099023 - DNA, 17 bp, Homo sapiens
atttaacagaaattgta

SEQ ID NO: 1099024 - DNA, 15 bp, Homo sapiens
atttaacagctgaat

SEQ ID NO: 1099025 - DNA, 13 bp, Homo sapiens
atttaacataatg

SEQ ID NO: 1099026 - DNA, 13 bp, Homo sapiens
atttaacattgtt

SEQ ID NO: 1099027 - DNA, 17 bp, Homo sapiens
atttaaccataaatcaa

SEQ ID NO: 1099028 - DNA, 16 bp, Homo sapiens
atttaacccccctgta

SEQ ID NO: 1099029 - DNA, 23 bp, Homo sapiens
atttaacccccctgtacacaact

SEQ ID NO: 1099030 - DNA, 13 bp, Homo sapiens
atttaactctctt

SEQ ID NO: 1099031 - DNA, 15 bp, Homo sapiens
atttaacttacattt

SEQ ID NO: 1099032 - DNA, 22 bp, Homo sapiens
atttattaagatggattctcag

SEQ ID NO: 1099033 - DNA, 15 bp, Homo sapiens
atttattaatattta

SEQ ID NO: 1099034 - DNA, 15 bp, Homo sapiens
atttattaattgctt

SEQ ID NO: 1099035 - DNA, 17 bp, Homo sapiens
atttattaattgctttg

SEQ ID NO: 1099036 - DNA, 13 bp, Homo sapiens
atttattacaaat

SEQ ID NO: 1099037 - DNA, 14 bp, Homo sapiens
atttattacctctg

SEQ ID NO: 1099038 - DNA, 15 bp, Homo sapiens
atttattactgtccc

SEQ ID NO: 1099039 - DNA, 16 bp, Homo sapiens
atttattacttgtgca

SEQ ID NO: 1099040 - DNA, 13 bp, Homo sapiens
atttattatggca

SEQ ID NO: 1099041 - DNA, 21 bp, Homo sapiens
atttattattaatttattggg

SEQ ID NO: 1099042 - DNA, 14 bp, Homo sapiens
atttattcactgta

SEQ ID NO: 1099043 - DNA, 15 bp, Homo sapiens
atttattcactgtaa

SEQ ID NO: 1099044 - DNA, 20 bp, Homo sapiens
atttattcactgtaagttta

SEQ ID NO: 1099045 - DNA, 18 bp, Homo sapiens
atttattcataatgaatt

SEQ ID NO: 1099046 - DNA, 20 bp, Homo sapiens
atttattcataatgaattat

SEQ ID NO: 1099047 - DNA, 15 bp, Homo sapiens
atttattcatagata

SEQ ID NO: 1099048 - DNA, 22 bp, Homo sapiens
atttattcattatttgtcaaat

SEQ ID NO: 1099049 - DNA, 13 bp, Homo sapiens
atttattcctgtt

SEQ ID NO: 1099050 - DNA, 18 bp, Homo sapiens
atttattgactttgacaa

SEQ ID NO: 1099051 - DNA, 19 bp, Homo sapiens
atttattgattaaaaatgt

SEQ ID NO: 1099052 - DNA, 16 bp, Homo sapiens
atttattgcacattgt

SEQ ID NO: 1099053 - DNA, 14 bp, Homo sapiens
atttattgccatat

SEQ ID NO: 1099054 - DNA, 19 bp, Homo sapiens
atttattggcagccaagga

SEQ ID NO: 1099055 - DNA, 21 bp, Homo sapiens
atttattggcagccaaggaat

SEQ ID NO: 1099056 - DNA, 13 bp, Homo sapiens
atttattggggtg

SEQ ID NO: 1099057 - DNA, 13 bp, Homo sapiens
atttattgtcagt

SEQ ID NO: 1099058 - DNA, 19 bp, Homo sapiens
atttattgttaaattacat

SEQ ID NO: 1099059 - DNA, 14 bp, Homo sapiens
atttattgttagaa

SEQ ID NO: 1099060 - DNA, 14 bp, Homo sapiens
atttattgttgcct

SEQ ID NO: 1099061 - DNA, 20 bp, Homo sapiens
atttattgtttatttatcag

SEQ ID NO: 1099062 - DNA, 22 bp, Homo sapiens
atttattgtttatttatcagtg

SEQ ID NO: 1099063 - DNA, 15 bp, Homo sapiens
atttattgtttgaaa

SEQ ID NO: 1099064 - DNA, 17 bp, Homo sapiens
atttattgtttgaaatg

SEQ ID NO: 1099065 - DNA, 15 bp, Homo sapiens
atttatttaaaactc

SEQ ID NO: 1099066 - DNA, 16 bp, Homo sapiens
atttatttaaaactct

SEQ ID NO: 1099067 - DNA, 12 bp, Homo sapiens
atttatttaata

SEQ ID NO: 1099068 - DNA, 15 bp, Homo sapiens
atttatttaatattt

SEQ ID NO: 1099069 - DNA, 21 bp, Homo sapiens
atttatttaatgtgagtttgg

SEQ ID NO: 1099070 - DNA, 17 bp, Homo sapiens
atttatttaatgttatg

SEQ ID NO: 1099071 - DNA, 15 bp, Homo sapiens
atttatttacaaatg

SEQ ID NO: 1099072 - DNA, 24 bp, Homo sapiens
atttatttactgagcttctctgtg

SEQ ID NO: 1099073 - DNA, 14 bp, Homo sapiens
atttatttattaag

SEQ ID NO: 1099074 - DNA, 15 bp, Homo sapiens
atttatttattactg

SEQ ID NO: 1099075 - DNA, 14 bp, Homo sapiens
atttatttattatt

SEQ ID NO: 1099076 - DNA, 12 bp, Homo sapiens
atttatttcatg

SEQ ID NO: 1099077 - DNA, 20 bp, Homo sapiens
atttatttccactaaaaata

SEQ ID NO: 1099078 - DNA, 22 bp, Homo sapiens
atttatttccactaaaaatatt

SEQ ID NO: 1099079 - DNA, 12 bp, Homo sapiens
atttatttcctg

SEQ ID NO: 1099080 - DNA, 22 bp, Homo sapiens
atttatttctagttctttcctc

SEQ ID NO: 1099081 - DNA, 16 bp, Homo sapiens
atttatttgaatgatt

SEQ ID NO: 1099082 - DNA, 21 bp, Homo sapiens
atttatttgaatgatttttct

SEQ ID NO: 1099083 - DNA, 14 bp, Homo sapiens
atttatttgtttcc

SEQ ID NO: 1099084 - DNA, 13 bp, Homo sapiens
atttattttacat

SEQ ID NO: 1099085 - DNA, 14 bp, Homo sapiens
atttattttacatt

SEQ ID NO: 1099086 - DNA, 16 bp, Homo sapiens
atttattttacattta

SEQ ID NO: 1099087 - DNA, 19 bp, Homo sapiens
atttattttacatttagag

SEQ ID NO: 1099088 - DNA, 14 bp, Homo sapiens
atttattttcagta

SEQ ID NO: 1099089 - DNA, 16 bp, Homo sapiens
atttattttcctaaag

SEQ ID NO: 1099090 - DNA, 19 bp, Homo sapiens
atttattttcctaaagaga

SEQ ID NO: 1099091 - DNA, 13 bp, Homo sapiens
atttattttcctc

SEQ ID NO: 1099092 - DNA, 17 bp, Homo sapiens
atttattttcctcccca

SEQ ID NO: 1099093 - DNA, 20 bp, Homo sapiens
atttattttgctccctctgt

SEQ ID NO: 1099094 - DNA, 15 bp, Homo sapiens
atttattttgtatga

SEQ ID NO: 1099095 - DNA, 22 bp, Homo sapiens
atttattttgtatgaaatatat

SEQ ID NO: 1099096 - DNA, 18 bp, Homo sapiens
atttatttttcagttcca

SEQ ID NO: 1099097 - DNA, 19 bp, Homo sapiens
atttatttttcagttccaa

SEQ ID NO: 1099098 - DNA, 20 bp, Homo sapiens
atttatttttcagttccaag

SEQ ID NO: 1099099 - DNA, 23 bp, Homo sapiens
atttatttttgggtttggccagg

SEQ ID NO: 1099100 - DNA, 17 bp, Homo sapiens
atttattttttttaaag

SEQ ID NO: 1099101 - DNA, 14 bp, Homo sapiens
atttcaaaaatata

SEQ ID NO: 1099102 - DNA, 21 bp, Homo sapiens
atttcaaaatcagtttttcat

SEQ ID NO: 1099103 - DNA, 15 bp, Homo sapiens
atttcaaaatgcttt

SEQ ID NO: 1099104 - DNA, 19 bp, Homo sapiens
atttcaaaattaatagctt

SEQ ID NO: 1099105 - DNA, 14 bp, Homo sapiens
atttcaaaatttaa

SEQ ID NO: 1099106 - DNA, 19 bp, Homo sapiens
atttcaaaccattgctctt

SEQ ID NO: 1099107 - DNA, 20 bp, Homo sapiens
atttcaaattgaatttgcac

SEQ ID NO: 1099108 - DNA, 14 bp, Homo sapiens
atttcaactaatgt

SEQ ID NO: 1099109 - DNA, 22 bp, Homo sapiens
atttcaagaaaatttaaaacga

SEQ ID NO: 1099110 - DNA, 18 bp, Homo sapiens
atttcaagcagctgaaga

SEQ ID NO: 1099111 - DNA, 19 bp, Homo sapiens
atttcaaggaatggaatct

SEQ ID NO: 1099112 - DNA, 22 bp, Homo sapiens
atttcaaggaatggaatcttct

SEQ ID NO: 1099113 - DNA, 11 bp, Homo sapiens
atttcaagttc

SEQ ID NO: 1099114 - DNA, 16 bp, Homo sapiens
atttcaagttccaagt

SEQ ID NO: 1099115 - DNA, 22 bp, Homo sapiens
atttcaatcccacgtacttata

SEQ ID NO: 1099116 - DNA, 13 bp, Homo sapiens
atttcaatgtaat

SEQ ID NO: 1099117 - DNA, 15 bp, Homo sapiens
atttcaatgtccagt

SEQ ID NO: 1099118 - DNA, 19 bp, Homo sapiens
atttcaatgtccagtgagt

SEQ ID NO: 1099119 - DNA, 15 bp, Homo sapiens
atttcaattctcaaa

SEQ ID NO: 1099120 - DNA, 20 bp, Homo sapiens
atttcacaacagatcaattt

SEQ ID NO: 1099121 - DNA, 19 bp, Homo sapiens
atttcacagagcacgcctg

SEQ ID NO: 1099122 - DNA, 15 bp, Homo sapiens
atttcacagcctttc

SEQ ID NO: 1099123 - DNA, 17 bp, Homo sapiens
atttcacagtgcccaag

SEQ ID NO: 1099124 - DNA, 16 bp, Homo sapiens
atttcacagttctgta

SEQ ID NO: 1099125 - DNA, 15 bp, Homo sapiens
atttcacattattct

SEQ ID NO: 1099126 - DNA, 16 bp, Homo sapiens
atttcacctgtaaacc

SEQ ID NO: 1099127 - DNA, 15 bp, Homo sapiens
atttcacctgtgaca

SEQ ID NO: 1099128 - DNA, 16 bp, Homo sapiens
atttcacctgtgacaa

SEQ ID NO: 1099129 - DNA, 16 bp, Homo sapiens
atttcacgaactgttc

SEQ ID NO: 1099130 - DNA, 18 bp, Homo sapiens
atttcactaaatgtaaaa

SEQ ID NO: 1099131 - DNA, 23 bp, Homo sapiens
atttcactgtctttaattctgta

SEQ ID NO: 1099132 - DNA, 18 bp, Homo sapiens
atttcactttagatgctg

SEQ ID NO: 1099133 - DNA, 15 bp, Homo sapiens
atttcagaagagact

SEQ ID NO: 1099134 - DNA, 19 bp, Homo sapiens
atttcagaagttagtttgt

SEQ ID NO: 1099135 - DNA, 17 bp, Homo sapiens
atttcagacatatccaa

SEQ ID NO: 1099136 - DNA, 19 bp, Homo sapiens
atttcagatatcaaaattc

SEQ ID NO: 1099137 - DNA, 20 bp, Homo sapiens
atttcagatgtaatgttttc

SEQ ID NO: 1099138 - DNA, 12 bp, Homo sapiens
atttcagccaaa

SEQ ID NO: 1099139 - DNA, 15 bp, Homo sapiens
atttcagccaaagtc

SEQ ID NO: 1099140 - DNA, 22 bp, Homo sapiens
atttcagcttgaacctgcttcc

SEQ ID NO: 1099141 - DNA, 23 bp, Homo sapiens
atttcagcttgaacctgcttcct

SEQ ID NO: 1099142 - DNA, 20 bp, Homo sapiens
atttcaggaaaatgtattga

SEQ ID NO: 1099143 - DNA, 21 bp, Homo sapiens
atttcaggaaaatgtattgat

SEQ ID NO: 1099144 - DNA, 19 bp, Homo sapiens
atttcaggaatcagaaatc

SEQ ID NO: 1099145 - DNA, 16 bp, Homo sapiens
atttcaggaatttaaa

SEQ ID NO: 1099146 - DNA, 20 bp, Homo sapiens
atttcaggaggaatactgaa

SEQ ID NO: 1099147 - DNA, 19 bp, Homo sapiens
atttcaggcattggatatt

SEQ ID NO: 1099148 - DNA, 20 bp, Homo sapiens
atttcagggaaattaatcaa

SEQ ID NO: 1099149 - DNA, 20 bp, Homo sapiens
atttcagggacctcaggggc

SEQ ID NO: 1099150 - DNA, 19 bp, Homo sapiens
atttcaggggtcgtcacca

SEQ ID NO: 1099151 - DNA, 20 bp, Homo sapiens
atttcaggttttgtaaagat

SEQ ID NO: 1099152 - DNA, 19 bp, Homo sapiens
atttcagtaagctgtgtgg

SEQ ID NO: 1099153 - DNA, 17 bp, Homo sapiens
atttcagtagaatttta

SEQ ID NO: 1099154 - DNA, 18 bp, Homo sapiens
atttgagataaagtcaaa

SEQ ID NO: 1099155 - DNA, 14 bp, Homo sapiens
atttgagcatgcac

SEQ ID NO: 1099156 - DNA, 23 bp, Homo sapiens
atttgaggagtgttaagattgca

SEQ ID NO: 1099157 - DNA, 22 bp, Homo sapiens
atttgaggggccaggggcaggc

SEQ ID NO: 1099158 - DNA, 13 bp, Homo sapiens
atttgaggtcaag

SEQ ID NO: 1099159 - DNA, 21 bp, Homo sapiens
atttgaggtctacattcttgg

SEQ ID NO: 1099160 - DNA, 21 bp, Homo sapiens
atttgaggtctgttctttcca

SEQ ID NO: 1099161 - DNA, 16 bp, Homo sapiens
atttgagtgctctgat

SEQ ID NO: 1099162 - DNA, 14 bp, Homo sapiens
atttgagtgtatat

SEQ ID NO: 1099163 - DNA, 18 bp, Homo sapiens
atttgagtgtatatatat

SEQ ID NO: 1099164 - DNA, 19 bp, Homo sapiens
atttgagtgttttaagata

SEQ ID NO: 1099165 - DNA, 19 bp, Homo sapiens
atttgatacataataaaaa

SEQ ID NO: 1099166 - DNA, 13 bp, Homo sapiens
atttgatatgcac

SEQ ID NO: 1099167 - DNA, 17 bp, Homo sapiens
atttgatatttttccat

SEQ ID NO: 1099168 - DNA, 22 bp, Homo sapiens
atttgatatttttccatttatt

SEQ ID NO: 1099169 - DNA, 23 bp, Homo sapiens
atttgatctttgtttaaatgcca

SEQ ID NO: 1099170 - DNA, 11 bp, Homo sapiens
atttgatgaaa

SEQ ID NO: 1099171 - DNA, 21 bp, Homo sapiens
atttgatgaaagctgattact

SEQ ID NO: 1099172 - DNA, 19 bp, Homo sapiens
atttgatgctggagaggtt

SEQ ID NO: 1099173 - DNA, 23 bp, Homo sapiens
atttgatgctgtttgacaaagtt

SEQ ID NO: 1099174 - DNA, 20 bp, Homo sapiens
atttgatggtatttctttct

SEQ ID NO: 1099175 - DNA, 17 bp, Homo sapiens
atttgatgtacatgtgt

SEQ ID NO: 1099176 - DNA, 18 bp, Homo sapiens
atttgatgtacatgtgta

SEQ ID NO: 1099177 - DNA, 20 bp, Homo sapiens
atttgatgtttacaggtgga

SEQ ID NO: 1099178 - DNA, 16 bp, Homo sapiens
atttgattatttaaga

SEQ ID NO: 1099179 - DNA, 15 bp, Homo sapiens
atttgattcaaaata

SEQ ID NO: 1099180 - DNA, 16 bp, Homo sapiens
atttgattcaaaatat

SEQ ID NO: 1099181 - DNA, 20 bp, Homo sapiens
atttgattcattttcctgtt

SEQ ID NO: 1099182 - DNA, 13 bp, Homo sapiens
atttgattcgtat

SEQ ID NO: 1099183 - DNA, 23 bp, Homo sapiens
atttgattcttaactaaaattgt

SEQ ID NO: 1099184 - DNA, 13 bp, Homo sapiens
atttgattgattt

SEQ ID NO: 1099185 - DNA, 13 bp, Homo sapiens
atttgattgcttt

SEQ ID NO: 1099186 - DNA, 17 bp, Homo sapiens
atttgattgctttgctg

SEQ ID NO: 1099187 - DNA, 18 bp, Homo sapiens
atttgattgctttgctgc

SEQ ID NO: 1099188 - DNA, 14 bp, Homo sapiens
atttgatttccatc

SEQ ID NO: 1099189 - DNA, 15 bp, Homo sapiens
atttgatttctaatt

SEQ ID NO: 1099190 - DNA, 13 bp, Homo sapiens
atttgatttctat

SEQ ID NO: 1099191 - DNA, 19 bp, Homo sapiens
atttgcaaaccctttgtat

SEQ ID NO: 1099192 - DNA, 23 bp, Homo sapiens
atttgcaacaggggaggaaaaaa

SEQ ID NO: 1099193 - DNA, 20 bp, Homo sapiens
atttgcaataacagctgcaa

SEQ ID NO: 1099194 - DNA, 16 bp, Homo sapiens
atttgcaattcatgta

SEQ ID NO: 1099195 - DNA, 18 bp, Homo sapiens
atttgcacaatatttctt

SEQ ID NO: 1099196 - DNA, 19 bp, Homo sapiens
atttgcacaatatttcttt

SEQ ID NO: 1099197 - DNA, 11 bp, Homo sapiens
atttgcacagt

SEQ ID NO: 1099198 - DNA, 21 bp, Homo sapiens
atttgcactggagttctatgc

SEQ ID NO: 1099199 - DNA, 15 bp, Homo sapiens
atttgcagagacagg

SEQ ID NO: 1099200 - DNA, 19 bp, Homo sapiens
atttgcagagacaggacct

SEQ ID NO: 1099201 - DNA, 17 bp, Homo sapiens
atttgcaggattccctt

SEQ ID NO: 1099202 - DNA, 18 bp, Homo sapiens
atttgcaggattcccttc

SEQ ID NO: 1099203 - DNA, 19 bp, Homo sapiens
atttgcaggattcccttct

SEQ ID NO: 1099204 - DNA, 13 bp, Homo sapiens
atttgcatactta

SEQ ID NO: 1099205 - DNA, 18 bp, Homo sapiens
atttgcatggattttgga

SEQ ID NO: 1099206 - DNA, 22 bp, Homo sapiens
atttgcatggctccagaaatgt

SEQ ID NO: 1099207 - DNA, 12 bp, Homo sapiens
atttgcatgtta

SEQ ID NO: 1099208 - DNA, 15 bp, Homo sapiens
atttgcatgttatgt

SEQ ID NO: 1099209 - DNA, 19 bp, Homo sapiens
atttgcattaaattcacaa

SEQ ID NO: 1099210 - DNA, 20 bp, Homo sapiens
atttgcattactctggtgga

SEQ ID NO: 1099211 - DNA, 16 bp, Homo sapiens
atttgcattgaacaca

SEQ ID NO: 1099212 - DNA, 21 bp, Homo sapiens
atttgcattgaacacaaactg

SEQ ID NO: 1099213 - DNA, 16 bp, Homo sapiens
atttgcattgggcatt

SEQ ID NO: 1099214 - DNA, 13 bp, Homo sapiens
atttgcatttgtt

SEQ ID NO: 1099215 - DNA, 23 bp, Homo sapiens
atttgcatttgtttatgtaattt

SEQ ID NO: 1099216 - DNA, 19 bp, Homo sapiens
atttgccacttagtatttt

SEQ ID NO: 1099217 - DNA, 13 bp, Homo sapiens
atttgccagcaca

SEQ ID NO: 1099218 - DNA, 14 bp, Homo sapiens
atttgccagcacag

SEQ ID NO: 1099219 - DNA, 20 bp, Homo sapiens
atttgccaggggcatccaag

SEQ ID NO: 1099220 - DNA, 21 bp, Homo sapiens
atttgccatttttattagaaa

SEQ ID NO: 1099221 - DNA, 15 bp, Homo sapiens
atttgccccttgagc

SEQ ID NO: 1099222 - DNA, 17 bp, Homo sapiens
atttgcctaattcctgg

SEQ ID NO: 1099223 - DNA, 13 bp, Homo sapiens
atttgcctgtaac

SEQ ID NO: 1099224 - DNA, 15 bp, Homo sapiens
atttgcctgtaacaa

SEQ ID NO: 1099225 - DNA, 14 bp, Homo sapiens
atttgccttgcaga

SEQ ID NO: 1099226 - DNA, 18 bp, Homo sapiens
atttgccttgcagaactg

SEQ ID NO: 1099227 - DNA, 14 bp, Homo sapiens
atttgctaagcata

SEQ ID NO: 1099228 - DNA, 20 bp, Homo sapiens
atttgctaagtgtatgatgt

SEQ ID NO: 1099229 - DNA, 18 bp, Homo sapiens
atttgctaatcaaagcca

SEQ ID NO: 1099230 - DNA, 16 bp, Homo sapiens
atttgctaatttttat

SEQ ID NO: 1099231 - DNA, 19 bp, Homo sapiens
atttgctaatttttattaa

SEQ ID NO: 1099232 - DNA, 23 bp, Homo sapiens
atttgctctttgacaactaaaat

SEQ ID NO: 1099233 - DNA, 22 bp, Homo sapiens
atttgctgacaaccattaaagt

SEQ ID NO: 1099234 - DNA, 23 bp, Homo sapiens
atttgctgacaaccattaaagtc

SEQ ID NO: 1099235 - DNA, 13 bp, Homo sapiens
atttgctgatttc

SEQ ID NO: 1099236 - DNA, 16 bp, Homo sapiens
atttgctgatttctag

SEQ ID NO: 1099237 - DNA, 10 bp, Homo sapiens
atttgctgca

SEQ ID NO: 1099238 - DNA, 16 bp, Homo sapiens
atttgctgcaaagaga

SEQ ID NO: 1099239 - DNA, 15 bp, Homo sapiens
atttgctgccaaatg

SEQ ID NO: 1099240 - DNA, 22 bp, Homo sapiens
atttgctgccagacactgagct

SEQ ID NO: 1099241 - DNA, 19 bp, Homo sapiens
atttgctgtattgccccca

SEQ ID NO: 1099242 - DNA, 18 bp, Homo sapiens
atttgcttatttaataaa

SEQ ID NO: 1099243 - DNA, 19 bp, Homo sapiens
atttgcttatttttataat

SEQ ID NO: 1099244 - DNA, 22 bp, Homo sapiens
atttgcttatttttataattaa

SEQ ID NO: 1099245 - DNA, 12 bp, Homo sapiens
atttgcttcatt

SEQ ID NO: 1099246 - DNA, 19 bp, Homo sapiens
atttgcttgcaatctaatc

SEQ ID NO: 1099247 - DNA, 12 bp, Homo sapiens
atttgcttttca

SEQ ID NO: 1099248 - DNA, 23 bp, Homo sapiens
atttgcttttcatgtagaactca

SEQ ID NO: 1099249 - DNA, 16 bp, Homo sapiens
atttggaaagagacca

SEQ ID NO: 1099250 - DNA, 17 bp, Homo sapiens
atttggaaataaagtca

SEQ ID NO: 1099251 - DNA, 22 bp, Homo sapiens
atttggaaataaagtcagatgg

SEQ ID NO: 1099252 - DNA, 13 bp, Homo sapiens
atttggaaatttt

SEQ ID NO: 1099253 - DNA, 17 bp, Homo sapiens
atttggaaccaaagtct

SEQ ID NO: 1099254 - DNA, 13 bp, Homo sapiens
atttggaatactt

SEQ ID NO: 1099255 - DNA, 20 bp, Homo sapiens
atttggaatatttgaataat

SEQ ID NO: 1099256 - DNA, 17 bp, Homo sapiens
atttggagactctgtgg

SEQ ID NO: 1099257 - DNA, 23 bp, Homo sapiens
atttggagggaagctcttggagc

SEQ ID NO: 1099258 - DNA, 16 bp, Homo sapiens
atttggagttaggtcc

SEQ ID NO: 1099259 - DNA, 13 bp, Homo sapiens
atttggataataa

SEQ ID NO: 1099260 - DNA, 19 bp, Homo sapiens
atttggatctggatctgtt

SEQ ID NO: 1099261 - DNA, 20 bp, Homo sapiens
atttggatctggatctgtta

SEQ ID NO: 1099262 - DNA, 18 bp, Homo sapiens
atttggatttaaaagcct

SEQ ID NO: 1099263 - DNA, 14 bp, Homo sapiens
atttggcaaaacaa

SEQ ID NO: 1099264 - DNA, 21 bp, Homo sapiens
atttggcaaaatgtcttaaca

SEQ ID NO: 1099265 - DNA, 13 bp, Homo sapiens
atttggccttaag

SEQ ID NO: 1099266 - DNA, 18 bp, Homo sapiens
atttggccttaagaactg

SEQ ID NO: 1099267 - DNA, 21 bp, Homo sapiens
atttggccttaagaactgtgt

SEQ ID NO: 1099268 - DNA, 19 bp, Homo sapiens
atttggcttgacaaaggca

SEQ ID NO: 1099269 - DNA, 19 bp, Homo sapiens
atttggcttgctgtttact

SEQ ID NO: 1099270 - DNA, 18 bp, Homo sapiens
atttgggaagtgaagact

SEQ ID NO: 1099271 - DNA, 14 bp, Homo sapiens
atttgggatggaga

SEQ ID NO: 1099272 - DNA, 17 bp, Homo sapiens
atttgggctgaatgtat

SEQ ID NO: 1099273 - DNA, 18 bp, Homo sapiens
atttgggctgaatgtatg

SEQ ID NO: 1099274 - DNA, 20 bp, Homo sapiens
atttgggctgaatgtatgta

SEQ ID NO: 1099275 - DNA, 21 bp, Homo sapiens
atttgggctgaatgtatgtaa

SEQ ID NO: 1099276 - DNA, 20 bp, Homo sapiens
attttatccctcacctgtag

SEQ ID NO: 1099277 - DNA, 18 bp, Homo sapiens
attttatcctgtattctt

SEQ ID NO: 1099278 - DNA, 14 bp, Homo sapiens
attttatctgtgaa

SEQ ID NO: 1099279 - DNA, 13 bp, Homo sapiens
attttatgaacat

SEQ ID NO: 1099280 - DNA, 22 bp, Homo sapiens
attttatgaacattgtactgtt

SEQ ID NO: 1099281 - DNA, 24 bp, Homo sapiens
attttatgaacattgtactgttgc

SEQ ID NO: 1099282 - DNA, 16 bp, Homo sapiens
attttatgaatgtctt

SEQ ID NO: 1099283 - DNA, 20 bp, Homo sapiens
attttatgatacttgaattt

SEQ ID NO: 1099284 - DNA, 17 bp, Homo sapiens
attttatgatcagtgtt

SEQ ID NO: 1099285 - DNA, 13 bp, Homo sapiens
attttatgcacag

SEQ ID NO: 1099286 - DNA, 14 bp, Homo sapiens
attttatggttatg

SEQ ID NO: 1099287 - DNA, 15 bp, Homo sapiens
attttatgtctgtaa

SEQ ID NO: 1099288 - DNA, 20 bp, Homo sapiens
attttattacatctttcaca

SEQ ID NO: 1099289 - DNA, 16 bp, Homo sapiens
attttattactgttta

SEQ ID NO: 1099290 - DNA, 13 bp, Homo sapiens
attttattatgca

SEQ ID NO: 1099291 - DNA, 14 bp, Homo sapiens
attttattatgcat

SEQ ID NO: 1099292 - DNA, 14 bp, Homo sapiens
attttattgaaatg

SEQ ID NO: 1099293 - DNA, 14 bp, Homo sapiens
attttattgcttga

SEQ ID NO: 1099294 - DNA, 15 bp, Homo sapiens
attttattgtataaa

SEQ ID NO: 1099295 - DNA, 22 bp, Homo sapiens
attttattgtgtaattgattta

SEQ ID NO: 1099296 - DNA, 22 bp, Homo sapiens
attttatttacccctcccctat

SEQ ID NO: 1099297 - DNA, 17 bp, Homo sapiens
attttatttagacaaga

SEQ ID NO: 1099298 - DNA, 19 bp, Homo sapiens
attttatttagacaagaga

SEQ ID NO: 1099299 - DNA, 14 bp, Homo sapiens
attttatttcaatg

SEQ ID NO: 1099300 - DNA, 16 bp, Homo sapiens
attttatttgcttatt

SEQ ID NO: 1099301 - DNA, 15 bp, Homo sapiens
attttattttgctga

SEQ ID NO: 1099302 - DNA, 19 bp, Homo sapiens
attttattttggcttcatt

SEQ ID NO: 1099303 - DNA, 22 bp, Homo sapiens
attttattttgtgctcatttaa

SEQ ID NO: 1099304 - DNA, 19 bp, Homo sapiens
attttatttttaaaatatt

SEQ ID NO: 1099305 - DNA, 16 bp, Homo sapiens
attttatttttgcaaa

SEQ ID NO: 1099306 - DNA, 17 bp, Homo sapiens
attttatttttgtatct

SEQ ID NO: 1099307 - DNA, 15 bp, Homo sapiens
attttcaaaagataa

SEQ ID NO: 1099308 - DNA, 24 bp, Homo sapiens
attttcaaaagataatattttaca

SEQ ID NO: 1099309 - DNA, 15 bp, Homo sapiens
attttcaaagagatg

SEQ ID NO: 1099310 - DNA, 18 bp, Homo sapiens
attttcaaattgtatcta

SEQ ID NO: 1099311 - DNA, 18 bp, Homo sapiens
attttcaacgcagccctg

SEQ ID NO: 1099312 - DNA, 20 bp, Homo sapiens
attttcaacgcagccctgct

SEQ ID NO: 1099313 - DNA, 14 bp, Homo sapiens
attttcaactgctt

SEQ ID NO: 1099314 - DNA, 16 bp, Homo sapiens
attttcaactgctttg

SEQ ID NO: 1099315 - DNA, 16 bp, Homo sapiens
attttcaaggccttca

SEQ ID NO: 1099316 - DNA, 12 bp, Homo sapiens
attttcaagtaa

SEQ ID NO: 1099317 - DNA, 23 bp, Homo sapiens
attttcaataacaaaacgaaact

SEQ ID NO: 1099318 - DNA, 22 bp, Homo sapiens
attttcacattcccatctgtca

SEQ ID NO: 1099319 - DNA, 15 bp, Homo sapiens
attttcaccccaccc

SEQ ID NO: 1099320 - DNA, 16 bp, Homo sapiens
attttcaccccaccct

SEQ ID NO: 1099321 - DNA, 15 bp, Homo sapiens
attttcactagggct

SEQ ID NO: 1099322 - DNA, 18 bp, Homo sapiens
attttcactgctgctcct

SEQ ID NO: 1099323 - DNA, 13 bp, Homo sapiens
attttcactgtag

SEQ ID NO: 1099324 - DNA, 12 bp, Homo sapiens
attttcagagac

SEQ ID NO: 1099325 - DNA, 23 bp, Homo sapiens
attttcagagccggcccgcctct

SEQ ID NO: 1099326 - DNA, 19 bp, Homo sapiens
attttcagcaaactctttt

SEQ ID NO: 1099327 - DNA, 19 bp, Homo sapiens
attttcagtcttgtagtgt

SEQ ID NO: 1099328 - DNA, 21 bp, Homo sapiens
attttcataagtatttcaaat

SEQ ID NO: 1099329 - DNA, 17 bp, Homo sapiens
attttcataatcagtaa

SEQ ID NO: 1099330 - DNA, 21 bp, Homo sapiens
attttcataatcagtaaatag

SEQ ID NO: 1099331 - DNA, 21 bp, Homo sapiens
attttcatcccgtatcacagt

SEQ ID NO: 1099332 - DNA, 18 bp, Homo sapiens
attttcatgtatatgtgt

SEQ ID NO: 1099333 - DNA, 12 bp, Homo sapiens
attttcattaaa

SEQ ID NO: 1099334 - DNA, 16 bp, Homo sapiens
attttcattaaacttg

SEQ ID NO: 1099335 - DNA, 19 bp, Homo sapiens
attttcattaaacttgaag

SEQ ID NO: 1099336 - DNA, 13 bp, Homo sapiens
attttcattgtga

SEQ ID NO: 1099337 - DNA, 15 bp, Homo sapiens
attttcattgtgatt

SEQ ID NO: 1099338 - DNA, 22 bp, Homo sapiens
attttcatttgtacaaggtaat

SEQ ID NO: 1099339 - DNA, 14 bp, Homo sapiens
attttccaaatgta

SEQ ID NO: 1099340 - DNA, 17 bp, Homo sapiens
attttccaaatgtaata

SEQ ID NO: 1099341 - DNA, 14 bp, Homo sapiens
attttccaaccttt

SEQ ID NO: 1099342 - DNA, 18 bp, Homo sapiens
attttccacggaaacaga

SEQ ID NO: 1099343 - DNA, 13 bp, Homo sapiens
attttccagcctt

SEQ ID NO: 1099344 - DNA, 17 bp, Homo sapiens
attttccagccttatgt

SEQ ID NO: 1099345 - DNA, 13 bp, Homo sapiens
attttccataaat

SEQ ID NO: 1099346 - DNA, 21 bp, Homo sapiens
attttccccccactctcccca

SEQ ID NO: 1099347 - DNA, 22 bp, Homo sapiens
attttccccccactctccccac

SEQ ID NO: 1099348 - DNA, 19 bp, Homo sapiens
attttccctattagagaag

SEQ ID NO: 1099349 - DNA, 14 bp, Homo sapiens
attttcccttttta

SEQ ID NO: 1099350 - DNA, 18 bp, Homo sapiens
attttccctttttaaaaa

SEQ ID NO: 1099351 - DNA, 21 bp, Homo sapiens
attttccctttttaaaaaata

SEQ ID NO: 1099352 - DNA, 12 bp, Homo sapiens
attttcctctgg

SEQ ID NO: 1099353 - DNA, 13 bp, Homo sapiens
attttcctctggc

SEQ ID NO: 1099354 - DNA, 14 bp, Homo sapiens
attttcctcttgtg

SEQ ID NO: 1099355 - DNA, 16 bp, Homo sapiens
attttcctgccaggca

SEQ ID NO: 1099356 - DNA, 20 bp, Homo sapiens
attttcctggatttatagta

SEQ ID NO: 1099357 - DNA, 18 bp, Homo sapiens
attttcctggtgccaatt

SEQ ID NO: 1099358 - DNA, 22 bp, Homo sapiens
attttcctggtgccaatttcaa

SEQ ID NO: 1099359 - DNA, 19 bp, Homo sapiens
attttcctgttgtcaagaa

SEQ ID NO: 1099360 - DNA, 16 bp, Homo sapiens
attttccttgcttttc

SEQ ID NO: 1099361 - DNA, 17 bp, Homo sapiens
attttcgggctgagaag

SEQ ID NO: 1099362 - DNA, 15 bp, Homo sapiens
attttctaaaagctt

SEQ ID NO: 1099363 - DNA, 14 bp, Homo sapiens
attttctaaagact

SEQ ID NO: 1099364 - DNA, 20 bp, Homo sapiens
attttctaaataaaaatatg

SEQ ID NO: 1099365 - DNA, 22 bp, Homo sapiens
attttctaaataaaaatatgta

SEQ ID NO: 1099366 - DNA, 15 bp, Homo sapiens
attttctaagacagt

SEQ ID NO: 1099367 - DNA, 14 bp, Homo sapiens
attttctagataca

SEQ ID NO: 1099368 - DNA, 20 bp, Homo sapiens
attttctatcagaagttgta

SEQ ID NO: 1099369 - DNA, 16 bp, Homo sapiens
attttctattgttact

SEQ ID NO: 1099370 - DNA, 13 bp, Homo sapiens
attttctatttct

SEQ ID NO: 1099371 - DNA, 17 bp, Homo sapiens
attttctatttctctgt

SEQ ID NO: 1099372 - DNA, 17 bp, Homo sapiens
attttctccttggtttg

SEQ ID NO: 1099373 - DNA, 17 bp, Homo sapiens
attttctctgtactttt

SEQ ID NO: 1099374 - DNA, 14 bp, Homo sapiens
attttctgatgtat

SEQ ID NO: 1099375 - DNA, 15 bp, Homo sapiens
attttctgctacttt

SEQ ID NO: 1099376 - DNA, 18 bp, Homo sapiens
attttctggccagtgttt

SEQ ID NO: 1099377 - DNA, 18 bp, Homo sapiens
attttctggtagatagaa

SEQ ID NO: 1099378 - DNA, 12 bp, Homo sapiens
attttctgtcag

SEQ ID NO: 1099379 - DNA, 18 bp, Homo sapiens
attttctgtcagatgaga

SEQ ID NO: 1099380 - DNA, 21 bp, Homo sapiens
attttctgtgcctgaatattt

SEQ ID NO: 1099381 - DNA, 11 bp, Homo sapiens
attttctgtgg

SEQ ID NO: 1099382 - DNA, 11 bp, Homo sapiens
attttctgttg

SEQ ID NO: 1099383 - DNA, 20 bp, Homo sapiens
attttcttacccaatttccc

SEQ ID NO: 1099384 - DNA, 19 bp, Homo sapiens
attttcttattgcgctgct

SEQ ID NO: 1099385 - DNA, 14 bp, Homo sapiens
attttcttcacagt

SEQ ID NO: 1099386 - DNA, 23 bp, Homo sapiens
attttcttcacagtgcagcttgc

SEQ ID NO: 1099387 - DNA, 18 bp, Homo sapiens
attttcttcatgcaatga

SEQ ID NO: 1099388 - DNA, 21 bp, Homo sapiens
attttcttcatgcaatgacat

SEQ ID NO: 1099389 - DNA, 21 bp, Homo sapiens
attttcttccaagcaaaggtg

SEQ ID NO: 1099390 - DNA, 16 bp, Homo sapiens
attttcttctctgtga

SEQ ID NO: 1099391 - DNA, 12 bp, Homo sapiens
attttcttgttt

SEQ ID NO: 1099392 - DNA, 12 bp, Homo sapiens
attttctttaat

SEQ ID NO: 1099393 - DNA, 15 bp, Homo sapiens
attttctttaatgct

SEQ ID NO: 1099394 - DNA, 21 bp, Homo sapiens
attttctttctctactttgag

SEQ ID NO: 1099395 - DNA, 14 bp, Homo sapiens
attttctttgtttc

SEQ ID NO: 1099396 - DNA, 15 bp, Homo sapiens
attttctttgtttct

SEQ ID NO: 1099397 - DNA, 16 bp, Homo sapiens
attttctttgtttctt

SEQ ID NO: 1099398 - DNA, 20 bp, Homo sapiens
attttcttttaagcatttgt

SEQ ID NO: 1099399 - DNA, 14 bp, Homo sapiens
atttttgtatttct

SEQ ID NO: 1099400 - DNA, 15 bp, Homo sapiens
atttttgtctgcagc

SEQ ID NO: 1099401 - DNA, 23 bp, Homo sapiens
atttttgtcttatatatatttct

SEQ ID NO: 1099402 - DNA, 20 bp, Homo sapiens
atttttgtgagcctctttgt

SEQ ID NO: 1099403 - DNA, 15 bp, Homo sapiens
atttttgtgccatta

SEQ ID NO: 1099404 - DNA, 17 bp, Homo sapiens
atttttgtgtttctaaa

SEQ ID NO: 1099405 - DNA, 20 bp, Homo sapiens
atttttgttactctcttcca

SEQ ID NO: 1099406 - DNA, 21 bp, Homo sapiens
atttttgttagcaaagattaa

SEQ ID NO: 1099407 - DNA, 14 bp, Homo sapiens
atttttgttttccc

SEQ ID NO: 1099408 - DNA, 14 bp, Homo sapiens
attttttaaaaaag

SEQ ID NO: 1099409 - DNA, 13 bp, Homo sapiens
attttttaaaaca

SEQ ID NO: 1099410 - DNA, 13 bp, Homo sapiens
attttttaaaata

SEQ ID NO: 1099411 - DNA, 21 bp, Homo sapiens
attttttaaaattttggaata

SEQ ID NO: 1099412 - DNA, 20 bp, Homo sapiens
attttttaaagttactttgt

SEQ ID NO: 1099413 - DNA, 18 bp, Homo sapiens
attttttaaatgtaaaat

SEQ ID NO: 1099414 - DNA, 21 bp, Homo sapiens
attttttaagagacagtttcg

SEQ ID NO: 1099415 - DNA, 16 bp, Homo sapiens
attttttaagtattta

SEQ ID NO: 1099416 - DNA, 17 bp, Homo sapiens
attttttaagtatttat

SEQ ID NO: 1099417 - DNA, 22 bp, Homo sapiens
attttttaagtatttatatatt

SEQ ID NO: 1099418 - DNA, 14 bp, Homo sapiens
attttttaataatt

SEQ ID NO: 1099419 - DNA, 15 bp, Homo sapiens
attttttaattatta

SEQ ID NO: 1099420 - DNA, 14 bp, Homo sapiens
attttttaattgtt

SEQ ID NO: 1099421 - DNA, 12 bp, Homo sapiens
attttttatact

SEQ ID NO: 1099422 - DNA, 14 bp, Homo sapiens
attttttatactgt

SEQ ID NO: 1099423 - DNA, 21 bp, Homo sapiens
attttttatcatgcatgtcct

SEQ ID NO: 1099424 - DNA, 21 bp, Homo sapiens
attttttatgatcaaggtgaa

SEQ ID NO: 1099425 - DNA, 20 bp, Homo sapiens
attttttatgtacaaccctg

SEQ ID NO: 1099426 - DNA, 13 bp, Homo sapiens
attttttattgtt

SEQ ID NO: 1099427 - DNA, 13 bp, Homo sapiens
attttttatttct

SEQ ID NO: 1099428 - DNA, 14 bp, Homo sapiens
attttttatttcta

SEQ ID NO: 1099429 - DNA, 22 bp, Homo sapiens
attttttcagaaatatgtggtt

SEQ ID NO: 1099430 - DNA, 14 bp, Homo sapiens
attttttcagttgt

SEQ ID NO: 1099431 - DNA, 13 bp, Homo sapiens
attttttcccttt

SEQ ID NO: 1099432 - DNA, 21 bp, Homo sapiens
attttttccttcaaagtttaa

SEQ ID NO: 1099433 - DNA, 20 bp, Homo sapiens
attttttcgtgcactctgct

SEQ ID NO: 1099434 - DNA, 12 bp, Homo sapiens
attttttcttcc

SEQ ID NO: 1099435 - DNA, 12 bp, Homo sapiens
attttttgaagg

SEQ ID NO: 1099436 - DNA, 20 bp, Homo sapiens
attttttgctataatcatta

SEQ ID NO: 1099437 - DNA, 16 bp, Homo sapiens
attttttggcacttgc

SEQ ID NO: 1099438 - DNA, 22 bp, Homo sapiens
attttttgggcagcaatttaaa

SEQ ID NO: 1099439 - DNA, 16 bp, Homo sapiens
attttttgggccatta

SEQ ID NO: 1099440 - DNA, 14 bp, Homo sapiens
attttttgttctgt

SEQ ID NO: 1099441 - DNA, 14 bp, Homo sapiens
attttttgttgaca

SEQ ID NO: 1099442 - DNA, 16 bp, Homo sapiens
attttttgttgacatt

SEQ ID NO: 1099443 - DNA, 18 bp, Homo sapiens
atttttttaaaatgttaa

SEQ ID NO: 1099444 - DNA, 21 bp, Homo sapiens
atttttttaaacaaaatttca

SEQ ID NO: 1099445 - DNA, 14 bp, Homo sapiens
atttttttaaagta

SEQ ID NO: 1099446 - DNA, 15 bp, Homo sapiens
atttttttaaagtag

SEQ ID NO: 1099447 - DNA, 15 bp, Homo sapiens
atttttttaaccaaa

SEQ ID NO: 1099448 - DNA, 19 bp, Homo sapiens
atttttttaaccaaaggtg

SEQ ID NO: 1099449 - DNA, 23 bp, Homo sapiens
atttttttaactgaaaatgtaaa

SEQ ID NO: 1099450 - DNA, 18 bp, Homo sapiens
atttttttaagctatcag

SEQ ID NO: 1099451 - DNA, 21 bp, Homo sapiens
atttttttaagctatcagcaa

SEQ ID NO: 1099452 - DNA, 22 bp, Homo sapiens
atttttttatctatgtggaaaa

SEQ ID NO: 1099453 - DNA, 16 bp, Homo sapiens
atttttttatgctctt

SEQ ID NO: 1099454 - DNA, 19 bp, Homo sapiens
atttttttcccaattgaga

SEQ ID NO: 1099455 - DNA, 16 bp, Homo sapiens
atttttttcctaagtt

SEQ ID NO: 1099456 - DNA, 16 bp, Homo sapiens
atttttttctacctat

SEQ ID NO: 1099457 - DNA, 17 bp, Homo sapiens
atttttttctctctgga

SEQ ID NO: 1099458 - DNA, 14 bp, Homo sapiens
atttttttgcaagt

SEQ ID NO: 1099459 - DNA, 22 bp, Homo sapiens
atttttttggtacctatttgac

SEQ ID NO: 1099460 - DNA, 13 bp, Homo sapiens
atttttttgtaat

SEQ ID NO: 1099461 - DNA, 14 bp, Homo sapiens
atttttttgtaata

SEQ ID NO: 1099462 - DNA, 19 bp, Homo sapiens
atttttttgtaataagcaa

SEQ ID NO: 1099463 - DNA, 15 bp, Homo sapiens
atttttttgtgtatg

SEQ ID NO: 1099464 - DNA, 19 bp, Homo sapiens
attttttttaaagtttggt

SEQ ID NO: 1099465 - DNA, 22 bp, Homo sapiens
attttttttaattgaaaagaag

SEQ ID NO: 1099466 - DNA, 14 bp, Homo sapiens
attttttttatatt

SEQ ID NO: 1099467 - DNA, 16 bp, Homo sapiens
attttttttattagta

SEQ ID NO: 1099468 - DNA, 21 bp, Homo sapiens
attttttttcaagtgctaaaa

SEQ ID NO: 1099469 - DNA, 14 bp, Homo sapiens
attttttttcttgg

SEQ ID NO: 1099470 - DNA, 18 bp, Homo sapiens
attttttttggcctgttt

SEQ ID NO: 1099471 - DNA, 22 bp, Homo sapiens
attttttttggcctgtttgatg

SEQ ID NO: 1099472 - DNA, 21 bp, Homo sapiens
attttttttgttttttgtaac

SEQ ID NO: 1099473 - DNA, 23 bp, Homo sapiens
atttttttttaacgtggcttgta

SEQ ID NO: 1099474 - DNA, 22 bp, Homo sapiens
atttttttttaattttgatata

SEQ ID NO: 1099475 - DNA, 16 bp, Homo sapiens
atttttttttcaatca

SEQ ID NO: 1099476 - DNA, 16 bp, Homo sapiens
atttttttttcataca

SEQ ID NO: 1099477 - DNA, 15 bp, Homo sapiens
atttttttttctaag

SEQ ID NO: 1099478 - DNA, 14 bp, Homo sapiens
atttttttttctct

SEQ ID NO: 1099479 - DNA, 21 bp, Homo sapiens
attttttttttcctcttcaga

SEQ ID NO: 1099480 - DNA, 19 bp, Homo sapiens
caaaaaaaaaaaaatgcac

SEQ ID NO: 1099481 - DNA, 15 bp, Homo sapiens
caaaaaaaaaaaagc

SEQ ID NO: 1099482 - DNA, 18 bp, Homo sapiens
caaaaaaaaaatagagag

SEQ ID NO: 1099483 - DNA, 13 bp, Homo sapiens
caaaaaaaaactt

SEQ ID NO: 1099484 - DNA, 20 bp, Homo sapiens
caaaaaaaaacttaaagcaa

SEQ ID NO: 1099485 - DNA, 23 bp, Homo sapiens
caaaaaaaaacttaaagcaaaat

SEQ ID NO: 1099486 - DNA, 14 bp, Homo sapiens
caaaaaaaaaggct

SEQ ID NO: 1099487 - DNA, 13 bp, Homo sapiens
caaaaaaaattag

SEQ ID NO: 1099488 - DNA, 18 bp, Homo sapiens
caaaaaaacaagtttaga

SEQ ID NO: 1099489 - DNA, 14 bp, Homo sapiens
caaaaaaagcctcc

SEQ ID NO: 1099490 - DNA, 12 bp, Homo sapiens
caaaaaaaggaa

SEQ ID NO: 1099491 - DNA, 15 bp, Homo sapiens
caaaaaaaggaaaaa

SEQ ID NO: 1099492 - DNA, 17 bp, Homo sapiens
caaaaaaatctgcagaa

SEQ ID NO: 1099493 - DNA, 16 bp, Homo sapiens
caaaaaaatttaaaat

SEQ ID NO: 1099494 - DNA, 22 bp, Homo sapiens
caaaaaacatacttacatttca

SEQ ID NO: 1099495 - DNA, 13 bp, Homo sapiens
caaaaaaggaaaa

SEQ ID NO: 1099496 - DNA, 17 bp, Homo sapiens
caaaaaagggacagcat

SEQ ID NO: 1099497 - DNA, 16 bp, Homo sapiens
caaaaaatgttttaaa

SEQ ID NO: 1099498 - DNA, 18 bp, Homo sapiens
caaaaaattaaagcattt

SEQ ID NO: 1099499 - DNA, 17 bp, Homo sapiens
caaaaacaaaaaaacta

SEQ ID NO: 1099500 - DNA, 18 bp, Homo sapiens
caaaaacaaaaaaactat

SEQ ID NO: 1099501 - DNA, 19 bp, Homo sapiens
caaaaacaagactgcctcc

SEQ ID NO: 1099502 - DNA, 15 bp, Homo sapiens
caaaaacagcctcac

SEQ ID NO: 1099503 - DNA, 20 bp, Homo sapiens
caaaaacaggtatatacttt

SEQ ID NO: 1099504 - DNA, 22 bp, Homo sapiens
caaaaacatacttcaaaaatgt

SEQ ID NO: 1099505 - DNA, 22 bp, Homo sapiens
caaaaacatgtatgtgcatttc

SEQ ID NO: 1099506 - DNA, 23 bp, Homo sapiens
caaaaacatgtatgtgcatttca

SEQ ID NO: 1099507 - DNA, 14 bp, Homo sapiens
caaaaacattttat

SEQ ID NO: 1099508 - DNA, 10 bp, Homo sapiens
caaaaaccaa

SEQ ID NO: 1099509 - DNA, 15 bp, Homo sapiens
caaaaaccagcaggt

SEQ ID NO: 1099510 - DNA, 13 bp, Homo sapiens
caaaaaccatgtt

SEQ ID NO: 1099511 - DNA, 19 bp, Homo sapiens
caaaaacgccttttcttgg

SEQ ID NO: 1099512 - DNA, 16 bp, Homo sapiens
caaaaactatttggga

SEQ ID NO: 1099513 - DNA, 15 bp, Homo sapiens
caaaaactgtactgt

SEQ ID NO: 1099514 - DNA, 22 bp, Homo sapiens
caaaaactgtctttaaaagaga

SEQ ID NO: 1099515 - DNA, 13 bp, Homo sapiens
caaaaacttcctt

SEQ ID NO: 1099516 - DNA, 14 bp, Homo sapiens
caaaaacttccttt

SEQ ID NO: 1099517 - DNA, 16 bp, Homo sapiens
caaaaagaaaagtgtt

SEQ ID NO: 1099518 - DNA, 13 bp, Homo sapiens
caaaaagaacaaa

SEQ ID NO: 1099519 - DNA, 19 bp, Homo sapiens
caaaaagaacaaaaaaatc

SEQ ID NO: 1099520 - DNA, 18 bp, Homo sapiens
caaaaagaacaaagctgg

SEQ ID NO: 1099521 - DNA, 22 bp, Homo sapiens
caaagaggtgaacattaaaata

SEQ ID NO: 1099522 - DNA, 16 bp, Homo sapiens
caaagagttaatatat

SEQ ID NO: 1099523 - DNA, 16 bp, Homo sapiens
caaagagttcaagaaa

SEQ ID NO: 1099524 - DNA, 21 bp, Homo sapiens
caaagataaaaggtttctttt

SEQ ID NO: 1099525 - DNA, 16 bp, Homo sapiens
caaagataatctctca

SEQ ID NO: 1099526 - DNA, 20 bp, Homo sapiens
caaagataatctctcagctt

SEQ ID NO: 1099527 - DNA, 23 bp, Homo sapiens
caaagatatatacacaggatcct

SEQ ID NO: 1099528 - DNA, 18 bp, Homo sapiens
caaagatattttgctttg

SEQ ID NO: 1099529 - DNA, 15 bp, Homo sapiens
caaagatcaaaataa

SEQ ID NO: 1099530 - DNA, 20 bp, Homo sapiens
caaagatcaaaataaaaagt

SEQ ID NO: 1099531 - DNA, 15 bp, Homo sapiens
caaagatcacttgtt

SEQ ID NO: 1099532 - DNA, 23 bp, Homo sapiens
caaagatgagctctgaacaaaca

SEQ ID NO: 1099533 - DNA, 22 bp, Homo sapiens
caaagatgcgtttgcctcctgg

SEQ ID NO: 1099534 - DNA, 15 bp, Homo sapiens
caaagatggtggctg

SEQ ID NO: 1099535 - DNA, 23 bp, Homo sapiens
caaagatggtggctgtgtctctc

SEQ ID NO: 1099536 - DNA, 22 bp, Homo sapiens
caaagatgtttgtcagatatga

SEQ ID NO: 1099537 - DNA, 17 bp, Homo sapiens
caaagattaggtcgttt

SEQ ID NO: 1099538 - DNA, 20 bp, Homo sapiens
caaagattaggtcgttttcc

SEQ ID NO: 1099539 - DNA, 15 bp, Homo sapiens
caaagattatctgat

SEQ ID NO: 1099540 - DNA, 18 bp, Homo sapiens
caaagattatctgattcc

SEQ ID NO: 1099541 - DNA, 13 bp, Homo sapiens
caaagatttcagt

SEQ ID NO: 1099542 - DNA, 21 bp, Homo sapiens
caaagatttcagtagaatttt

SEQ ID NO: 1099543 - DNA, 12 bp, Homo sapiens
caaagcaaagaa

SEQ ID NO: 1099544 - DNA, 13 bp, Homo sapiens
caaagcaaagaaa

SEQ ID NO: 1099545 - DNA, 21 bp, Homo sapiens
caaagcaacccgctggagccc

SEQ ID NO: 1099546 - DNA, 13 bp, Homo sapiens
caaagcaaggaaa

SEQ ID NO: 1099547 - DNA, 15 bp, Homo sapiens
caaagcaaggaaact

SEQ ID NO: 1099548 - DNA, 11 bp, Homo sapiens
caaagcaaggg

SEQ ID NO: 1099549 - DNA, 13 bp, Homo sapiens
caaagcaagggct

SEQ ID NO: 1099550 - DNA, 18 bp, Homo sapiens
caaagcaattgaaatgca

SEQ ID NO: 1099551 - DNA, 14 bp, Homo sapiens
caaagcacagtgtt

SEQ ID NO: 1099552 - DNA, 23 bp, Homo sapiens
caaagcacatgcttagcttatct

SEQ ID NO: 1099553 - DNA, 18 bp, Homo sapiens
caaagcacattgaaagag

SEQ ID NO: 1099554 - DNA, 17 bp, Homo sapiens
caaagcaccaaaataag

SEQ ID NO: 1099555 - DNA, 19 bp, Homo sapiens
caaagcaccaaaataagaa

SEQ ID NO: 1099556 - DNA, 21 bp, Homo sapiens
caaagcaccaaaataagaaaa

SEQ ID NO: 1099557 - DNA, 22 bp, Homo sapiens
caaagcaccaaaataagaaaag

SEQ ID NO: 1099558 - DNA, 20 bp, Homo sapiens
caaagcacgaaatgttattt

SEQ ID NO: 1099559 - DNA, 22 bp, Homo sapiens
caaagcacgaaatgttattttt

SEQ ID NO: 1099560 - DNA, 15 bp, Homo sapiens
caaagcactctctgc

SEQ ID NO: 1099561 - DNA, 23 bp, Homo sapiens
caaagcactctctgcagtcctcc

SEQ ID NO: 1099562 - DNA, 22 bp, Homo sapiens
caaagcacttggactcttgctc

SEQ ID NO: 1099563 - DNA, 15 bp, Homo sapiens
caaagcacttttaaa

SEQ ID NO: 1099564 - DNA, 22 bp, Homo sapiens
caaagcacttttaaaaaaattt

SEQ ID NO: 1099565 - DNA, 15 bp, Homo sapiens
caaagcagacagctc

SEQ ID NO: 1099566 - DNA, 11 bp, Homo sapiens
caaagcagagt

SEQ ID NO: 1099567 - DNA, 13 bp, Homo sapiens
caaagcagagtgg

SEQ ID NO: 1099568 - DNA, 23 bp, Homo sapiens
caaagcagagtgggacttggaga

SEQ ID NO: 1099569 - DNA, 19 bp, Homo sapiens
caaagcagcaggcctctgg

SEQ ID NO: 1099570 - DNA, 13 bp, Homo sapiens
caaagcagccacg

SEQ ID NO: 1099571 - DNA, 18 bp, Homo sapiens
caaagcaggagtggaagg

SEQ ID NO: 1099572 - DNA, 20 bp, Homo sapiens
caaagcagtatataataact

SEQ ID NO: 1099573 - DNA, 17 bp, Homo sapiens
caaagccaaactctgcc

SEQ ID NO: 1099574 - DNA, 18 bp, Homo sapiens
caaagccaaactctgcca

SEQ ID NO: 1099575 - DNA, 19 bp, Homo sapiens
caaagccacaaggctggcc

SEQ ID NO: 1099576 - DNA, 21 bp, Homo sapiens
caaagccacaaggctggccag

SEQ ID NO: 1099577 - DNA, 12 bp, Homo sapiens
caaagccagaac

SEQ ID NO: 1099578 - DNA, 15 bp, Homo sapiens
caaagccagacagca

SEQ ID NO: 1099579 - DNA, 14 bp, Homo sapiens
caaagccagaggag

SEQ ID NO: 1099580 - DNA, 15 bp, Homo sapiens
caaagccagaggaga

SEQ ID NO: 1099581 - DNA, 20 bp, Homo sapiens
caaagccagcgtcctcctct

SEQ ID NO: 1099582 - DNA, 22 bp, Homo sapiens
caaagccagcgtcctcctctgt

SEQ ID NO: 1099583 - DNA, 23 bp, Homo sapiens
caaagccagcgtcctcctctgtg

SEQ ID NO: 1099584 - DNA, 22 bp, Homo sapiens
caaagccagggtctctccctca

SEQ ID NO: 1099585 - DNA, 14 bp, Homo sapiens
caaagccattcttt

SEQ ID NO: 1099586 - DNA, 15 bp, Homo sapiens
caaagccattctttt

SEQ ID NO: 1099587 - DNA, 19 bp, Homo sapiens
caaagcccaaagtggtata

SEQ ID NO: 1099588 - DNA, 22 bp, Homo sapiens
caaagccccatgtgccttgtcc

SEQ ID NO: 1099589 - DNA, 11 bp, Homo sapiens
caaagcccccg

SEQ ID NO: 1099590 - DNA, 23 bp, Homo sapiens
caaagccccttgctctcccctgc

SEQ ID NO: 1099591 - DNA, 14 bp, Homo sapiens
caaagccctgcctc

SEQ ID NO: 1099592 - DNA, 18 bp, Homo sapiens
caaagcccttccatgtcg

SEQ ID NO: 1099593 - DNA, 23 bp, Homo sapiens
caaagcctagacaacctttctgt

SEQ ID NO: 1099594 - DNA, 17 bp, Homo sapiens
caaagcctcctccagcc

SEQ ID NO: 1099595 - DNA, 18 bp, Homo sapiens
caaagcctcctccagccg

SEQ ID NO: 1099596 - DNA, 11 bp, Homo sapiens
caaagccttat

SEQ ID NO: 1099597 - DNA, 18 bp, Homo sapiens
caaagccttatcaagtgt

SEQ ID NO: 1099598 - DNA, 13 bp, Homo sapiens
caaagcgacagat

SEQ ID NO: 1099599 - DNA, 16 bp, Homo sapiens
caaagcgcccacccag

SEQ ID NO: 1099600 - DNA, 18 bp, Homo sapiens
caaagcgcccacccaggt

SEQ ID NO: 1099601 - DNA, 18 bp, Homo sapiens
caaagcgctcgccccgca

SEQ ID NO: 1099602 - DNA, 17 bp, Homo sapiens
caaagcggtccctgtcc

SEQ ID NO: 1099603 - DNA, 18 bp, Homo sapiens
caaagctcaaataaaaat

SEQ ID NO: 1099604 - DNA, 20 bp, Homo sapiens
caaagctcgggtctccctcc

SEQ ID NO: 1099605 - DNA, 21 bp, Homo sapiens
caaagctgagttacttgtctg

SEQ ID NO: 1099606 - DNA, 12 bp, Homo sapiens
caaagctgcctg

SEQ ID NO: 1099607 - DNA, 23 bp, Homo sapiens
caaagctgcctgtgccatgccca

SEQ ID NO: 1099608 - DNA, 16 bp, Homo sapiens
caaagctgttaaactg

SEQ ID NO: 1099609 - DNA, 17 bp, Homo sapiens
caaagctgttaaactgt

SEQ ID NO: 1099610 - DNA, 17 bp, Homo sapiens
caaagcttcgtcttgtg

SEQ ID NO: 1099611 - DNA, 18 bp, Homo sapiens
caaagcttcgtcttgtgt

SEQ ID NO: 1099612 - DNA, 13 bp, Homo sapiens
caaagctttacta

SEQ ID NO: 1099613 - DNA, 18 bp, Homo sapiens
caaagctttcctgcccca

SEQ ID NO: 1099614 - DNA, 23 bp, Homo sapiens
caaagctttcctgccccaggcct

SEQ ID NO: 1099615 - DNA, 14 bp, Homo sapiens
caaagctttgctac

SEQ ID NO: 1099616 - DNA, 18 bp, Homo sapiens
caaagctttgctacaaat

SEQ ID NO: 1099617 - DNA, 23 bp, Homo sapiens
caaagctttgctacaaatttatg

SEQ ID NO: 1099618 - DNA, 22 bp, Homo sapiens
caaaggaaaatagtaatgtttt

SEQ ID NO: 1099619 - DNA, 19 bp, Homo sapiens
caaaggaccgttttgtatt

SEQ ID NO: 1099620 - DNA, 18 bp, Homo sapiens
caaaggagaagcacagct

SEQ ID NO: 1099621 - DNA, 17 bp, Homo sapiens
caaaggagcattaagcc

SEQ ID NO: 1099622 - DNA, 13 bp, Homo sapiens
caaaggagccttg

SEQ ID NO: 1099623 - DNA, 18 bp, Homo sapiens
caaaggagcgagcatgtc

SEQ ID NO: 1099624 - DNA, 16 bp, Homo sapiens
caaaggaggaatttac

SEQ ID NO: 1099625 - DNA, 14 bp, Homo sapiens
caaaggatgaagaa

SEQ ID NO: 1099626 - DNA, 15 bp, Homo sapiens
caaaggcaagcactt

SEQ ID NO: 1099627 - DNA, 13 bp, Homo sapiens
caaaggcagagga

SEQ ID NO: 1099628 - DNA, 15 bp, Homo sapiens
caaaggcagaggaat

SEQ ID NO: 1099629 - DNA, 12 bp, Homo sapiens
caaaggccagcg

SEQ ID NO: 1099630 - DNA, 14 bp, Homo sapiens
caaaggccagcggt

SEQ ID NO: 1099631 - DNA, 19 bp, Homo sapiens
caaaggccagtggaagaaa

SEQ ID NO: 1099632 - DNA, 22 bp, Homo sapiens
caaaggcccagggaggcagcgt

SEQ ID NO: 1099633 - DNA, 23 bp, Homo sapiens
caaaggcctaattctatgcctgt

SEQ ID NO: 1099634 - DNA, 20 bp, Homo sapiens
caaagggaagtgaggcccaa

SEQ ID NO: 1099635 - DNA, 22 bp, Homo sapiens
caaagggaatactcacattttg

SEQ ID NO: 1099636 - DNA, 17 bp, Homo sapiens
caaagggcagttttgag

SEQ ID NO: 1099637 - DNA, 17 bp, Homo sapiens
caaagggccatcgttca

SEQ ID NO: 1099638 - DNA, 18 bp, Homo sapiens
caaagggctgaaagccat

SEQ ID NO: 1099639 - DNA, 21 bp, Homo sapiens
caaagggctgaaagccatttg

SEQ ID NO: 1099640 - DNA, 18 bp, Homo sapiens
caaaggggacaggcctca

SEQ ID NO: 1099641 - DNA, 22 bp, Homo sapiens
caaaggggaggcatcagtgtcc

SEQ ID NO: 1099642 - DNA, 17 bp, Homo sapiens
caaattattaattgtcc

SEQ ID NO: 1099643 - DNA, 13 bp, Homo sapiens
caaattatttatt

SEQ ID NO: 1099644 - DNA, 12 bp, Homo sapiens
caaattatttgt

SEQ ID NO: 1099645 - DNA, 14 bp, Homo sapiens
caaattatttgtgt

SEQ ID NO: 1099646 - DNA, 15 bp, Homo sapiens
caaattatttgtgta

SEQ ID NO: 1099647 - DNA, 14 bp, Homo sapiens
caaattcaaataaa

SEQ ID NO: 1099648 - DNA, 19 bp, Homo sapiens
caaattcaaggccttccaa

SEQ ID NO: 1099649 - DNA, 12 bp, Homo sapiens
caaattcagaac

SEQ ID NO: 1099650 - DNA, 15 bp, Homo sapiens
caaattcagtttcat

SEQ ID NO: 1099651 - DNA, 16 bp, Homo sapiens
caaattcagtttcata

SEQ ID NO: 1099652 - DNA, 18 bp, Homo sapiens
caaattcagtttcataaa

SEQ ID NO: 1099653 - DNA, 14 bp, Homo sapiens
caaattcattttta

SEQ ID NO: 1099654 - DNA, 15 bp, Homo sapiens
caaattcatttttaa

SEQ ID NO: 1099655 - DNA, 14 bp, Homo sapiens
caaattcatttttt

SEQ ID NO: 1099656 - DNA, 23 bp, Homo sapiens
caaattccgattagacctttatc

SEQ ID NO: 1099657 - DNA, 20 bp, Homo sapiens
caaattcctatttttaaata

SEQ ID NO: 1099658 - DNA, 14 bp, Homo sapiens
caaattctgtttct

SEQ ID NO: 1099659 - DNA, 19 bp, Homo sapiens
caaattgagagaatggaaa

SEQ ID NO: 1099660 - DNA, 22 bp, Homo sapiens
caaattgagataatgatactta

SEQ ID NO: 1099661 - DNA, 15 bp, Homo sapiens
caaattgctgcttgg

SEQ ID NO: 1099662 - DNA, 21 bp, Homo sapiens
caaattggagcttcatggcag

SEQ ID NO: 1099663 - DNA, 17 bp, Homo sapiens
caaattgggatctgtct

SEQ ID NO: 1099664 - DNA, 20 bp, Homo sapiens
caaattgggatctgtcttgg

SEQ ID NO: 1099665 - DNA, 23 bp, Homo sapiens
caaattgggatctgtcttggcat

SEQ ID NO: 1099666 - DNA, 18 bp, Homo sapiens
caaattgtatctagtgca

SEQ ID NO: 1099667 - DNA, 15 bp, Homo sapiens
caaattgtatcttat

SEQ ID NO: 1099668 - DNA, 16 bp, Homo sapiens
caaattgtcgttttta

SEQ ID NO: 1099669 - DNA, 18 bp, Homo sapiens
caaattgtgcagtacttt

SEQ ID NO: 1099670 - DNA, 18 bp, Homo sapiens
caaattgtttgtacagta

SEQ ID NO: 1099671 - DNA, 16 bp, Homo sapiens
caaatttatgcatttc

SEQ ID NO: 1099672 - DNA, 17 bp, Homo sapiens
caaatttatgcatttca

SEQ ID NO: 1099673 - DNA, 18 bp, Homo sapiens
caaatttatgcatttcat

SEQ ID NO: 1099674 - DNA, 22 bp, Homo sapiens
caaatttatgcatttcattcaa

SEQ ID NO: 1099675 - DNA, 11 bp, Homo sapiens
caaatttattt

SEQ ID NO: 1099676 - DNA, 15 bp, Homo sapiens
caaatttatttccaa

SEQ ID NO: 1099677 - DNA, 11 bp, Homo sapiens
caaatttcaca

SEQ ID NO: 1099678 - DNA, 17 bp, Homo sapiens
caaatttcatgaccagt

SEQ ID NO: 1099679 - DNA, 13 bp, Homo sapiens
caaatttcctgtt

SEQ ID NO: 1099680 - DNA, 19 bp, Homo sapiens
caaatttcctgtttgaaat

SEQ ID NO: 1099681 - DNA, 23 bp, Homo sapiens
caaatttctataaatttaagaaa

SEQ ID NO: 1099682 - DNA, 13 bp, Homo sapiens
caaatttctctct

SEQ ID NO: 1099683 - DNA, 14 bp, Homo sapiens
caaatttctctctt

SEQ ID NO: 1099684 - DNA, 17 bp, Homo sapiens
caaatttggccttaaga

SEQ ID NO: 1099685 - DNA, 22 bp, Homo sapiens
caaatttggctcacttgcctta

SEQ ID NO: 1099686 - DNA, 19 bp, Homo sapiens
caaatttgtacctctaagt

SEQ ID NO: 1099687 - DNA, 22 bp, Homo sapiens
caaatttgtctggttaaaaaat

SEQ ID NO: 1099688 - DNA, 17 bp, Homo sapiens
caaattttaaaacattt

SEQ ID NO: 1099689 - DNA, 17 bp, Homo sapiens
caaattttcaaataata

SEQ ID NO: 1099690 - DNA, 13 bp, Homo sapiens
caaattttcaagt

SEQ ID NO: 1099691 - DNA, 19 bp, Homo sapiens
caaattttcactgctgctc

SEQ ID NO: 1099692 - DNA, 21 bp, Homo sapiens
caaattttgatgccaagaaag

SEQ ID NO: 1099693 - DNA, 21 bp, Homo sapiens
caaattttgccagagaaacta

SEQ ID NO: 1099694 - DNA, 13 bp, Homo sapiens
caaattttggcca

SEQ ID NO: 1099695 - DNA, 13 bp, Homo sapiens
caaattttttaat

SEQ ID NO: 1099696 - DNA, 17 bp, Homo sapiens
caacaaaaagcttcccc

SEQ ID NO: 1099697 - DNA, 20 bp, Homo sapiens
caacaaaaggacttcaggaa

SEQ ID NO: 1099698 - DNA, 15 bp, Homo sapiens
caacaaagaaacaaa

SEQ ID NO: 1099699 - DNA, 15 bp, Homo sapiens
caacaacaattggta

SEQ ID NO: 1099700 - DNA, 18 bp, Homo sapiens
caacaacctcaactgcct

SEQ ID NO: 1099701 - DNA, 17 bp, Homo sapiens
caacaacgggcagaaat

SEQ ID NO: 1099702 - DNA, 23 bp, Homo sapiens
caacaagaccgccccagggctat

SEQ ID NO: 1099703 - DNA, 18 bp, Homo sapiens
caacaagactgccaggtg

SEQ ID NO: 1099704 - DNA, 14 bp, Homo sapiens
caacaagagcgaaa

SEQ ID NO: 1099705 - DNA, 19 bp, Homo sapiens
caacaaggttggcacccca

SEQ ID NO: 1099706 - DNA, 13 bp, Homo sapiens
caacaagtaactt

SEQ ID NO: 1099707 - DNA, 22 bp, Homo sapiens
caacaatacatgctgctaattc

SEQ ID NO: 1099708 - DNA, 16 bp, Homo sapiens
caacaatggggtgggc

SEQ ID NO: 1099709 - DNA, 18 bp, Homo sapiens
caacaatggggtgggccc

SEQ ID NO: 1099710 - DNA, 14 bp, Homo sapiens
caacaattggtaaa

SEQ ID NO: 1099711 - DNA, 17 bp, Homo sapiens
caacaatttatgaattg

SEQ ID NO: 1099712 - DNA, 16 bp, Homo sapiens
caacacaaagagaaaa

SEQ ID NO: 1099713 - DNA, 16 bp, Homo sapiens
caacacaataacacta

SEQ ID NO: 1099714 - DNA, 21 bp, Homo sapiens
caacacacagatttgagctca

SEQ ID NO: 1099715 - DNA, 22 bp, Homo sapiens
caacacaggcaagtccacccca

SEQ ID NO: 1099716 - DNA, 12 bp, Homo sapiens
caacaccacaga

SEQ ID NO: 1099717 - DNA, 16 bp, Homo sapiens
caacaccagccccact

SEQ ID NO: 1099718 - DNA, 19 bp, Homo sapiens
caacacccaagatgaatta

SEQ ID NO: 1099719 - DNA, 20 bp, Homo sapiens
caacacccccgacggcctcc

SEQ ID NO: 1099720 - DNA, 21 bp, Homo sapiens
caacacccccgacggcctcca

SEQ ID NO: 1099721 - DNA, 23 bp, Homo sapiens
caacaccctgcttctcccgggga

SEQ ID NO: 1099722 - DNA, 13 bp, Homo sapiens
caacacctgctgc

SEQ ID NO: 1099723 - DNA, 14 bp, Homo sapiens
caacacctgctgcg

SEQ ID NO: 1099724 - DNA, 17 bp, Homo sapiens
caacaccttcttggctt

SEQ ID NO: 1099725 - DNA, 15 bp, Homo sapiens
caacactattgtaat

SEQ ID NO: 1099726 - DNA, 23 bp, Homo sapiens
caacactgaaaaaatactaccta

SEQ ID NO: 1099727 - DNA, 22 bp, Homo sapiens
caacactgaagtgcttgcagat

SEQ ID NO: 1099728 - DNA, 15 bp, Homo sapiens
caacactgcaggaca

SEQ ID NO: 1099729 - DNA, 13 bp, Homo sapiens
caacactgctgtc

SEQ ID NO: 1099730 - DNA, 15 bp, Homo sapiens
caacactgctgtcca

SEQ ID NO: 1099731 - DNA, 15 bp, Homo sapiens
caacactgtgccctg

SEQ ID NO: 1099732 - DNA, 17 bp, Homo sapiens
caacactgtgccctggt

SEQ ID NO: 1099733 - DNA, 15 bp, Homo sapiens
caacactttgagcat

SEQ ID NO: 1099734 - DNA, 21 bp, Homo sapiens
caacactttgagcatttttaa

SEQ ID NO: 1099735 - DNA, 10 bp, Homo sapiens
caacagaaaa

SEQ ID NO: 1099736 - DNA, 15 bp, Homo sapiens
caacagaagaactgt

SEQ ID NO: 1099737 - DNA, 15 bp, Homo sapiens
caacagaagcatttg

SEQ ID NO: 1099738 - DNA, 23 bp, Homo sapiens
caacagaagcatttgtattttgt

SEQ ID NO: 1099739 - DNA, 17 bp, Homo sapiens
caacagaagcttcagaa

SEQ ID NO: 1099740 - DNA, 20 bp, Homo sapiens
caacagaagtcatgaagccc

SEQ ID NO: 1099741 - DNA, 22 bp, Homo sapiens
caacagaagtcatgaagcccaa

SEQ ID NO: 1099742 - DNA, 23 bp, Homo sapiens
caacagaagtcatgaagcccaag

SEQ ID NO: 1099743 - DNA, 17 bp, Homo sapiens
caacagaattaaaatgt

SEQ ID NO: 1099744 - DNA, 17 bp, Homo sapiens
caacagatactggaagt

SEQ ID NO: 1099745 - DNA, 17 bp, Homo sapiens
caacagatcaatttgta

SEQ ID NO: 1099746 - DNA, 14 bp, Homo sapiens
caacagcaagtgtt

SEQ ID NO: 1099747 - DNA, 18 bp, Homo sapiens
caacagcacctccccgct

SEQ ID NO: 1099748 - DNA, 12 bp, Homo sapiens
caacagccatgc

SEQ ID NO: 1099749 - DNA, 23 bp, Homo sapiens
caacagcccaggcatctccttgg

SEQ ID NO: 1099750 - DNA, 19 bp, Homo sapiens
caacagcctaatcccgtgc

SEQ ID NO: 1099751 - DNA, 14 bp, Homo sapiens
caacagcctggggt

SEQ ID NO: 1099752 - DNA, 22 bp, Homo sapiens
caacagctcaagtcttccctga

SEQ ID NO: 1099753 - DNA, 16 bp, Homo sapiens
caacagctcagagatg

SEQ ID NO: 1099754 - DNA, 21 bp, Homo sapiens
caacagctctcgttctccttc

SEQ ID NO: 1099755 - DNA, 22 bp, Homo sapiens
caacagctctcgttctccttcc

SEQ ID NO: 1099756 - DNA, 19 bp, Homo sapiens
caacaggagaatggggttc

SEQ ID NO: 1099757 - DNA, 21 bp, Homo sapiens
caacaggccattgtgaaccaa

SEQ ID NO: 1099758 - DNA, 20 bp, Homo sapiens
caacagggagcacctgtctg

SEQ ID NO: 1099759 - DNA, 15 bp, Homo sapiens
caacaggggaggaaa

SEQ ID NO: 1099760 - DNA, 16 bp, Homo sapiens
caacaggggaggaaaa

SEQ ID NO: 1099761 - DNA, 22 bp, Homo sapiens
caacaggggaggaaaaaagaac

SEQ ID NO: 1099762 - DNA, 21 bp, Homo sapiens
caacagggtagatttctcttg

SEQ ID NO: 1099763 - DNA, 23 bp, Homo sapiens
caacaggtaaaacagggccacat

SEQ ID NO: 1099764 - DNA, 17 bp, Homo sapiens
caacttatttaaaaata

SEQ ID NO: 1099765 - DNA, 19 bp, Homo sapiens
caacttatttaaaaatatt

SEQ ID NO: 1099766 - DNA, 20 bp, Homo sapiens
caacttatttaaaaatattt

SEQ ID NO: 1099767 - DNA, 16 bp, Homo sapiens
caacttatttttcacc

SEQ ID NO: 1099768 - DNA, 19 bp, Homo sapiens
caacttcatgtcaacttct

SEQ ID NO: 1099769 - DNA, 16 bp, Homo sapiens
caacttccaagacaag

SEQ ID NO: 1099770 - DNA, 17 bp, Homo sapiens
caacttcccacacggca

SEQ ID NO: 1099771 - DNA, 20 bp, Homo sapiens
caacttcccacacggcagcc

SEQ ID NO: 1099772 - DNA, 23 bp, Homo sapiens
caacttcccagttcaggagtccc

SEQ ID NO: 1099773 - DNA, 22 bp, Homo sapiens
caacttcctcccttacagagca

SEQ ID NO: 1099774 - DNA, 22 bp, Homo sapiens
caacttgagatgtatgaaggct

SEQ ID NO: 1099775 - DNA, 18 bp, Homo sapiens
caacttgatgtcaagcaa

SEQ ID NO: 1099776 - DNA, 21 bp, Homo sapiens
caacttgatgttccacctgcc

SEQ ID NO: 1099777 - DNA, 21 bp, Homo sapiens
caacttgccaaaatgttggct

SEQ ID NO: 1099778 - DNA, 14 bp, Homo sapiens
caacttgcttctaa

SEQ ID NO: 1099779 - DNA, 22 bp, Homo sapiens
caacttgcttctaaatgcccag

SEQ ID NO: 1099780 - DNA, 16 bp, Homo sapiens
caacttgggttcttct

SEQ ID NO: 1099781 - DNA, 15 bp, Homo sapiens
caactttaccataaa

SEQ ID NO: 1099782 - DNA, 19 bp, Homo sapiens
caactttattgattgaatt

SEQ ID NO: 1099783 - DNA, 18 bp, Homo sapiens
caactttcacttcttcct

SEQ ID NO: 1099784 - DNA, 11 bp, Homo sapiens
caactttctgt

SEQ ID NO: 1099785 - DNA, 16 bp, Homo sapiens
caactttctgtaaact

SEQ ID NO: 1099786 - DNA, 17 bp, Homo sapiens
caactttgcaaattatt

SEQ ID NO: 1099787 - DNA, 18 bp, Homo sapiens
caactttggttcctgtga

SEQ ID NO: 1099788 - DNA, 23 bp, Homo sapiens
caactttgtcgtggttcttaaat

SEQ ID NO: 1099789 - DNA, 21 bp, Homo sapiens
caactttgtggatgtcttcct

SEQ ID NO: 1099790 - DNA, 13 bp, Homo sapiens
caacttttaaagc

SEQ ID NO: 1099791 - DNA, 23 bp, Homo sapiens
caacttttcaatgtgattcttct

SEQ ID NO: 1099792 - DNA, 18 bp, Homo sapiens
caacttttgactaagaat

SEQ ID NO: 1099793 - DNA, 16 bp, Homo sapiens
caacttttgttttctg

SEQ ID NO: 1099794 - DNA, 20 bp, Homo sapiens
caactttttaaagtaaatta

SEQ ID NO: 1099795 - DNA, 12 bp, Homo sapiens
caagaaaacata

SEQ ID NO: 1099796 - DNA, 16 bp, Homo sapiens
caagaaacagccagca

SEQ ID NO: 1099797 - DNA, 19 bp, Homo sapiens
caagaaaccaagtgggctg

SEQ ID NO: 1099798 - DNA, 13 bp, Homo sapiens
caagaaactgaat

SEQ ID NO: 1099799 - DNA, 20 bp, Homo sapiens
caagaaagagggtcccaggg

SEQ ID NO: 1099800 - DNA, 21 bp, Homo sapiens
caagaaagagggtcccagggc

SEQ ID NO: 1099801 - DNA, 17 bp, Homo sapiens
caagaaagatccaccct

SEQ ID NO: 1099802 - DNA, 21 bp, Homo sapiens
caagaaaggggacccaagaaa

SEQ ID NO: 1099803 - DNA, 15 bp, Homo sapiens
caagaaataaatcag

SEQ ID NO: 1099804 - DNA, 18 bp, Homo sapiens
caagaaatggcgtctgct

SEQ ID NO: 1099805 - DNA, 21 bp, Homo sapiens
caagaaatggcgtctgctctg

SEQ ID NO: 1099806 - DNA, 21 bp, Homo sapiens
caagaactccacccccagagg

SEQ ID NO: 1099807 - DNA, 16 bp, Homo sapiens
caagaagaaatatgaa

SEQ ID NO: 1099808 - DNA, 17 bp, Homo sapiens
caagaagaaatatgaaa

SEQ ID NO: 1099809 - DNA, 22 bp, Homo sapiens
caagaagaaatgctttccaaaa

SEQ ID NO: 1099810 - DNA, 12 bp, Homo sapiens
caagaagacatg

SEQ ID NO: 1099811 - DNA, 14 bp, Homo sapiens
caagaagcagtggc

SEQ ID NO: 1099812 - DNA, 18 bp, Homo sapiens
caagaagcagtggcctta

SEQ ID NO: 1099813 - DNA, 11 bp, Homo sapiens
caagaagccca

SEQ ID NO: 1099814 - DNA, 16 bp, Homo sapiens
caagaaggcaaaaata

SEQ ID NO: 1099815 - DNA, 13 bp, Homo sapiens
caagaaggcgagt

SEQ ID NO: 1099816 - DNA, 16 bp, Homo sapiens
caagaagggactgaga

SEQ ID NO: 1099817 - DNA, 18 bp, Homo sapiens
caagaagggactgagaga

SEQ ID NO: 1099818 - DNA, 16 bp, Homo sapiens
caagaagggctgcatg

SEQ ID NO: 1099819 - DNA, 17 bp, Homo sapiens
caagaagggctgcatga

SEQ ID NO: 1099820 - DNA, 19 bp, Homo sapiens
caagaagggctgcatgatg

SEQ ID NO: 1099821 - DNA, 22 bp, Homo sapiens
caagaagggttttccaccctgg

SEQ ID NO: 1099822 - DNA, 16 bp, Homo sapiens
caagaaggtgagtgct

SEQ ID NO: 1099823 - DNA, 16 bp, Homo sapiens
caagaagtagcagtgt

SEQ ID NO: 1099824 - DNA, 22 bp, Homo sapiens
caagaagtgggtgcccttggta

SEQ ID NO: 1099825 - DNA, 12 bp, Homo sapiens
caagaataaaaa

SEQ ID NO: 1099826 - DNA, 22 bp, Homo sapiens
caagaataatcacgctttcctg

SEQ ID NO: 1099827 - DNA, 14 bp, Homo sapiens
caagaatacttgaa

SEQ ID NO: 1099828 - DNA, 18 bp, Homo sapiens
caagaatatggaggctgg

SEQ ID NO: 1099829 - DNA, 13 bp, Homo sapiens
caagaatattgca

SEQ ID NO: 1099830 - DNA, 17 bp, Homo sapiens
caagaatattgtatgtt

SEQ ID NO: 1099831 - DNA, 15 bp, Homo sapiens
caagaatctagaaga

SEQ ID NO: 1099832 - DNA, 16 bp, Homo sapiens
caagaatctagaagat

SEQ ID NO: 1099833 - DNA, 17 bp, Homo sapiens
caagaatggaagcctga

SEQ ID NO: 1099834 - DNA, 19 bp, Homo sapiens
caagaatggaagcctgaac

SEQ ID NO: 1099835 - DNA, 13 bp, Homo sapiens
caagaatggatca

SEQ ID NO: 1099836 - DNA, 14 bp, Homo sapiens
caagaatggatcac

SEQ ID NO: 1099837 - DNA, 18 bp, Homo sapiens
caagaattagaagtcttt

SEQ ID NO: 1099838 - DNA, 19 bp, Homo sapiens
caagaattctccaaaacaa

SEQ ID NO: 1099839 - DNA, 23 bp, Homo sapiens
caagaatttcttggtaagaagcc

SEQ ID NO: 1099840 - DNA, 13 bp, Homo sapiens
caagacaaatcaa

SEQ ID NO: 1099841 - DNA, 14 bp, Homo sapiens
caagacaaatcaac

SEQ ID NO: 1099842 - DNA, 15 bp, Homo sapiens
caagacacatcccta

SEQ ID NO: 1099843 - DNA, 20 bp, Homo sapiens
caagacacttccccttgtct

SEQ ID NO: 1099844 - DNA, 14 bp, Homo sapiens
caagacagaaaagt

SEQ ID NO: 1099845 - DNA, 17 bp, Homo sapiens
caagacagaaaagtgcc

SEQ ID NO: 1099846 - DNA, 20 bp, Homo sapiens
caagacagaaaagtgcctga

SEQ ID NO: 1099847 - DNA, 22 bp, Homo sapiens
caagacagaaaagtgcctgagc

SEQ ID NO: 1099848 - DNA, 18 bp, Homo sapiens
caagacagaagctgaagt

SEQ ID NO: 1099849 - DNA, 18 bp, Homo sapiens
caagacagagacgcagga

SEQ ID NO: 1099850 - DNA, 22 bp, Homo sapiens
caagacagatgccccagagctg

SEQ ID NO: 1099851 - DNA, 16 bp, Homo sapiens
caagacagatggacac

SEQ ID NO: 1099852 - DNA, 13 bp, Homo sapiens
caagacagccttc

SEQ ID NO: 1099853 - DNA, 15 bp, Homo sapiens
caagacagccttcac

SEQ ID NO: 1099854 - DNA, 18 bp, Homo sapiens
caagacagtgctgagatt

SEQ ID NO: 1099855 - DNA, 15 bp, Homo sapiens
caagacagtggttct

SEQ ID NO: 1099856 - DNA, 17 bp, Homo sapiens
caagacatgtctgttct

SEQ ID NO: 1099857 - DNA, 14 bp, Homo sapiens
caagacattgtcaa

SEQ ID NO: 1099858 - DNA, 13 bp, Homo sapiens
caagacatttgct

SEQ ID NO: 1099859 - DNA, 20 bp, Homo sapiens
caagacatttgctgaactca

SEQ ID NO: 1099860 - DNA, 17 bp, Homo sapiens
caagaccaccagggtcc

SEQ ID NO: 1099861 - DNA, 22 bp, Homo sapiens
caagaccagcctgggcaacacg

SEQ ID NO: 1099862 - DNA, 14 bp, Homo sapiens
caagacccccagca

SEQ ID NO: 1099863 - DNA, 16 bp, Homo sapiens
caagacccccagcact

SEQ ID NO: 1099864 - DNA, 20 bp, Homo sapiens
caagacccccatttgtccca

SEQ ID NO: 1099865 - DNA, 21 bp, Homo sapiens
caagacccggttattcgccca

SEQ ID NO: 1099866 - DNA, 22 bp, Homo sapiens
caagacccggttattcgcccac

SEQ ID NO: 1099867 - DNA, 14 bp, Homo sapiens
caagaccctgtctc

SEQ ID NO: 1099868 - DNA, 15 bp, Homo sapiens
caagaccctgtgttc

SEQ ID NO: 1099869 - DNA, 20 bp, Homo sapiens
caagaccgccccagggctat

SEQ ID NO: 1099870 - DNA, 17 bp, Homo sapiens
caagacctcagtgcctt

SEQ ID NO: 1099871 - DNA, 14 bp, Homo sapiens
caagacctgaaaat

SEQ ID NO: 1099872 - DNA, 13 bp, Homo sapiens
caagacctggtgt

SEQ ID NO: 1099873 - DNA, 22 bp, Homo sapiens
caagactagactactcaatatt

SEQ ID NO: 1099874 - DNA, 20 bp, Homo sapiens
caagactatctacaaaaatt

SEQ ID NO: 1099875 - DNA, 18 bp, Homo sapiens
caagactcctcaggcagc

SEQ ID NO: 1099876 - DNA, 18 bp, Homo sapiens
caagactctttggacact

SEQ ID NO: 1099877 - DNA, 18 bp, Homo sapiens
caagactgaagactgcac

SEQ ID NO: 1099878 - DNA, 22 bp, Homo sapiens
caagactgaagatggcttttcc

SEQ ID NO: 1099879 - DNA, 18 bp, Homo sapiens
caagactgcaaacttttt

SEQ ID NO: 1099880 - DNA, 13 bp, Homo sapiens
caagactgccagg

SEQ ID NO: 1099881 - DNA, 15 bp, Homo sapiens
caagactgggctgta

SEQ ID NO: 1099882 - DNA, 18 bp, Homo sapiens
caagactgttgctcaaat

SEQ ID NO: 1099883 - DNA, 20 bp, Homo sapiens
caagactttagcttttcctt

SEQ ID NO: 1099884 - DNA, 22 bp, Homo sapiens
caagactttagcttttccttcc

SEQ ID NO: 1099885 - DNA, 15 bp, Homo sapiens
caagactttgatcct

SEQ ID NO: 1099886 - DNA, 11 bp, Homo sapiens
caagctgcaca

SEQ ID NO: 1099887 - DNA, 10 bp, Homo sapiens
caagctgcag

SEQ ID NO: 1099888 - DNA, 12 bp, Homo sapiens
caagctgcaggt

SEQ ID NO: 1099889 - DNA, 16 bp, Homo sapiens
caagctgcctctgggc

SEQ ID NO: 1099890 - DNA, 15 bp, Homo sapiens
caagctgctctgagc

SEQ ID NO: 1099891 - DNA, 16 bp, Homo sapiens
caagctgctctgagcc

SEQ ID NO: 1099892 - DNA, 18 bp, Homo sapiens
caagctgctctgagccac

SEQ ID NO: 1099893 - DNA, 12 bp, Homo sapiens
caagctggaagc

SEQ ID NO: 1099894 - DNA, 20 bp, Homo sapiens
caagctggtcttaaactcct

SEQ ID NO: 1099895 - DNA, 14 bp, Homo sapiens
caagctgtgagaca

SEQ ID NO: 1099896 - DNA, 18 bp, Homo sapiens
caagcttaatagccctcc

SEQ ID NO: 1099897 - DNA, 20 bp, Homo sapiens
caagcttaatggctgataat

SEQ ID NO: 1099898 - DNA, 12 bp, Homo sapiens
caagcttcctgt

SEQ ID NO: 1099899 - DNA, 13 bp, Homo sapiens
caagcttcctgtg

SEQ ID NO: 1099900 - DNA, 17 bp, Homo sapiens
caagcttcctgtgccct

SEQ ID NO: 1099901 - DNA, 20 bp, Homo sapiens
caagcttcctgtgccctcac

SEQ ID NO: 1099902 - DNA, 23 bp, Homo sapiens
caagcttcctgtgccctcacccc

SEQ ID NO: 1099903 - DNA, 13 bp, Homo sapiens
caagcttctttta

SEQ ID NO: 1099904 - DNA, 18 bp, Homo sapiens
caagcttggtcaaacttt

SEQ ID NO: 1099905 - DNA, 20 bp, Homo sapiens
caagcttgtgtacttgaccg

SEQ ID NO: 1099906 - DNA, 13 bp, Homo sapiens
caagctttaaatt

SEQ ID NO: 1099907 - DNA, 16 bp, Homo sapiens
caagctttaaattatg

SEQ ID NO: 1099908 - DNA, 22 bp, Homo sapiens
caagcttttagtatccacagga

SEQ ID NO: 1099909 - DNA, 15 bp, Homo sapiens
caagcttttctgtag

SEQ ID NO: 1099910 - DNA, 20 bp, Homo sapiens
caaggaaaaatgccactccc

SEQ ID NO: 1099911 - DNA, 23 bp, Homo sapiens
caaggaaaaatgccactccctac

SEQ ID NO: 1099912 - DNA, 22 bp, Homo sapiens
caaggaaaatagtttaggagaa

SEQ ID NO: 1099913 - DNA, 16 bp, Homo sapiens
caaggaaaattgaaag

SEQ ID NO: 1099914 - DNA, 19 bp, Homo sapiens
caaggaaaattgaaagtat

SEQ ID NO: 1099915 - DNA, 22 bp, Homo sapiens
caaggaaaattgaaagtattca

SEQ ID NO: 1099916 - DNA, 20 bp, Homo sapiens
caaggaaacgctacctctct

SEQ ID NO: 1099917 - DNA, 14 bp, Homo sapiens
caaggaaagaacta

SEQ ID NO: 1099918 - DNA, 17 bp, Homo sapiens
caaggaaagccccagca

SEQ ID NO: 1099919 - DNA, 20 bp, Homo sapiens
caaggaaagccccagcacta

SEQ ID NO: 1099920 - DNA, 19 bp, Homo sapiens
caaggaaaggctcatttaa

SEQ ID NO: 1099921 - DNA, 23 bp, Homo sapiens
caaggaaaggctcatttaaaaca

SEQ ID NO: 1099922 - DNA, 20 bp, Homo sapiens
caaggaaagggggtcccagt

SEQ ID NO: 1099923 - DNA, 22 bp, Homo sapiens
caaggaaagggggtcccagtgg

SEQ ID NO: 1099924 - DNA, 15 bp, Homo sapiens
caaggaaccctcagg

SEQ ID NO: 1099925 - DNA, 12 bp, Homo sapiens
caaggaagaaaa

SEQ ID NO: 1099926 - DNA, 16 bp, Homo sapiens
caaggaagaaaacgga

SEQ ID NO: 1099927 - DNA, 16 bp, Homo sapiens
caaggaagatatacat

SEQ ID NO: 1099928 - DNA, 19 bp, Homo sapiens
caaggaagcagcctcagag

SEQ ID NO: 1099929 - DNA, 14 bp, Homo sapiens
caaggaagccaaag

SEQ ID NO: 1099930 - DNA, 18 bp, Homo sapiens
caaggaagctccttcctg

SEQ ID NO: 1099931 - DNA, 13 bp, Homo sapiens
caaggaaggaaag

SEQ ID NO: 1099932 - DNA, 16 bp, Homo sapiens
caaggaaggaaagaaa

SEQ ID NO: 1099933 - DNA, 13 bp, Homo sapiens
caaggaaggactt

SEQ ID NO: 1099934 - DNA, 13 bp, Homo sapiens
caaggaaggagcc

SEQ ID NO: 1099935 - DNA, 17 bp, Homo sapiens
caaggaaggagcccctg

SEQ ID NO: 1099936 - DNA, 17 bp, Homo sapiens
caaggaagggatgtatt

SEQ ID NO: 1099937 - DNA, 14 bp, Homo sapiens
caaggaatccatcc

SEQ ID NO: 1099938 - DNA, 22 bp, Homo sapiens
caaggaatccatcctgcaaagg

SEQ ID NO: 1099939 - DNA, 18 bp, Homo sapiens
caaggaatgcctgtgcca

SEQ ID NO: 1099940 - DNA, 23 bp, Homo sapiens
caaggaatttcttaacttcttgc

SEQ ID NO: 1099941 - DNA, 15 bp, Homo sapiens
caaggacaggagcct

SEQ ID NO: 1099942 - DNA, 16 bp, Homo sapiens
caaggacattcactgc

SEQ ID NO: 1099943 - DNA, 17 bp, Homo sapiens
caaggacattcactgct

SEQ ID NO: 1099944 - DNA, 22 bp, Homo sapiens
caaggacattcactgctgattt

SEQ ID NO: 1099945 - DNA, 16 bp, Homo sapiens
caaggaccaggactcc

SEQ ID NO: 1099946 - DNA, 14 bp, Homo sapiens
caaggacccctcac

SEQ ID NO: 1099947 - DNA, 20 bp, Homo sapiens
caaggactgagcaccctctg

SEQ ID NO: 1099948 - DNA, 12 bp, Homo sapiens
caaggactgagg

SEQ ID NO: 1099949 - DNA, 16 bp, Homo sapiens
caaggactttgcagcc

SEQ ID NO: 1099950 - DNA, 16 bp, Homo sapiens
caaggactttgtacat

SEQ ID NO: 1099951 - DNA, 14 bp, Homo sapiens
caaggagaaacaga

SEQ ID NO: 1099952 - DNA, 21 bp, Homo sapiens
caaggagaatatgataaaaca

SEQ ID NO: 1099953 - DNA, 17 bp, Homo sapiens
caaggagagcggaggag

SEQ ID NO: 1099954 - DNA, 16 bp, Homo sapiens
caaggagatttcttag

SEQ ID NO: 1099955 - DNA, 18 bp, Homo sapiens
caaggagcaaacactgaa

SEQ ID NO: 1099956 - DNA, 15 bp, Homo sapiens
caaggagcacaagcc

SEQ ID NO: 1099957 - DNA, 17 bp, Homo sapiens
caaggagcacaggtccc

SEQ ID NO: 1099958 - DNA, 18 bp, Homo sapiens
caaggagcacaggtccca

SEQ ID NO: 1099959 - DNA, 15 bp, Homo sapiens
caaggagcagagagg

SEQ ID NO: 1099960 - DNA, 16 bp, Homo sapiens
caaggagcgcggcggc

SEQ ID NO: 1099961 - DNA, 17 bp, Homo sapiens
caaggagctcaccctgc

SEQ ID NO: 1099962 - DNA, 19 bp, Homo sapiens
caaggagctgatttccagg

SEQ ID NO: 1099963 - DNA, 20 bp, Homo sapiens
caaggagctgatttccaggc

SEQ ID NO: 1099964 - DNA, 22 bp, Homo sapiens
caaggagctgatttccaggccc

SEQ ID NO: 1099965 - DNA, 23 bp, Homo sapiens
caaggagctgatttccaggcccc

SEQ ID NO: 1099966 - DNA, 13 bp, Homo sapiens
caaggaggaaaaa

SEQ ID NO: 1099967 - DNA, 14 bp, Homo sapiens
caaggaggggccag

SEQ ID NO: 1099968 - DNA, 23 bp, Homo sapiens
caaggagggtgtaatggagcatc

SEQ ID NO: 1099969 - DNA, 18 bp, Homo sapiens
caaggaggtggtgaattt

SEQ ID NO: 1099970 - DNA, 19 bp, Homo sapiens
caaggaggtggtgaatttt

SEQ ID NO: 1099971 - DNA, 16 bp, Homo sapiens
caaggagtcactgaga

SEQ ID NO: 1099972 - DNA, 16 bp, Homo sapiens
caaggagtgtaaaatg

SEQ ID NO: 1099973 - DNA, 23 bp, Homo sapiens
caaggagttccatgaagaccaca

SEQ ID NO: 1099974 - DNA, 17 bp, Homo sapiens
caaggagttctcttccg

SEQ ID NO: 1099975 - DNA, 16 bp, Homo sapiens
caaggagtttattaca

SEQ ID NO: 1099976 - DNA, 17 bp, Homo sapiens
caaggatagaagtatac

SEQ ID NO: 1099977 - DNA, 21 bp, Homo sapiens
caaggatcctctccactccat

SEQ ID NO: 1099978 - DNA, 15 bp, Homo sapiens
caaggatgaaagaaa

SEQ ID NO: 1099979 - DNA, 21 bp, Homo sapiens
caaggatgaattctttcaatt

SEQ ID NO: 1099980 - DNA, 22 bp, Homo sapiens
caaggatgaattctttcaattc

SEQ ID NO: 1099981 - DNA, 19 bp, Homo sapiens
caaggatgccccgtccccc

SEQ ID NO: 1099982 - DNA, 17 bp, Homo sapiens
caaggatttttccatgt

SEQ ID NO: 1099983 - DNA, 18 bp, Homo sapiens
caaggcaaggcaggtgcc

SEQ ID NO: 1099984 - DNA, 21 bp, Homo sapiens
caaggcacttttaaacgtgga

SEQ ID NO: 1099985 - DNA, 14 bp, Homo sapiens
caaggcagaggcct

SEQ ID NO: 1099986 - DNA, 19 bp, Homo sapiens
caaggcagaggcctgggct

SEQ ID NO: 1099987 - DNA, 14 bp, Homo sapiens
caaggcagcctcca

SEQ ID NO: 1099988 - DNA, 19 bp, Homo sapiens
caaggcagcctccagagcc

SEQ ID NO: 1099989 - DNA, 20 bp, Homo sapiens
caaggcagcctccagagcca

SEQ ID NO: 1099990 - DNA, 21 bp, Homo sapiens
caaggcagcctccagagccag

SEQ ID NO: 1099991 - DNA, 14 bp, Homo sapiens
caaggcaggtgcct

SEQ ID NO: 1099992 - DNA, 19 bp, Homo sapiens
caaggcaggtgcctccagg

SEQ ID NO: 1099993 - DNA, 22 bp, Homo sapiens
caaggcaggtgcctccaggtgt

SEQ ID NO: 1099994 - DNA, 23 bp, Homo sapiens
caaggcaggtgcctccaggtgtg

SEQ ID NO: 1099995 - DNA, 15 bp, Homo sapiens
caaggcagtgcatgc

SEQ ID NO: 1099996 - DNA, 17 bp, Homo sapiens
caaggcagtgcatgcat

SEQ ID NO: 1099997 - DNA, 17 bp, Homo sapiens
caaggcatttgtctttg

SEQ ID NO: 1099998 - DNA, 18 bp, Homo sapiens
caaggccaataataaaga

SEQ ID NO: 1099999 - DNA, 16 bp, Homo sapiens
caaggccacaaaaaca

SEQ ID NO: 1100000 - DNA, 19 bp, Homo sapiens
caaggccaccttggaggag

SEQ ID NO: 1100001 - DNA, 14 bp, Homo sapiens
caaggccatctggg

SEQ ID NO: 1100002 - DNA, 15 bp, Homo sapiens
caaggccccagagac

SEQ ID NO: 1100003 - DNA, 16 bp, Homo sapiens
caaggccccagggaca

SEQ ID NO: 1100004 - DNA, 19 bp, Homo sapiens
caaggccccagggacagag

SEQ ID NO: 1100005 - DNA, 20 bp, Homo sapiens
caaggccccagggacagagg

SEQ ID NO: 1100006 - DNA, 15 bp, Homo sapiens
caaggccctcggagc

SEQ ID NO: 1100007 - DNA, 22 bp, Homo sapiens
caaggccctcggagctggctgt

SEQ ID NO: 1100008 - DNA, 21 bp, Homo sapiens
caagtgctggagtctcctgag

SEQ ID NO: 1100009 - DNA, 23 bp, Homo sapiens
caagtgcttaaaaatacttctat

SEQ ID NO: 1100010 - DNA, 21 bp, Homo sapiens
caagtggaccttaggccttcc

SEQ ID NO: 1100011 - DNA, 22 bp, Homo sapiens
caagtggaccttaggccttcct

SEQ ID NO: 1100012 - DNA, 15 bp, Homo sapiens
caagtggactcaggg

SEQ ID NO: 1100013 - DNA, 16 bp, Homo sapiens
caagtggactcagggc

SEQ ID NO: 1100014 - DNA, 18 bp, Homo sapiens
caagtggactcagggcag

SEQ ID NO: 1100015 - DNA, 18 bp, Homo sapiens
caagtggacttggagctg

SEQ ID NO: 1100016 - DNA, 15 bp, Homo sapiens
caagtggatgggaat

SEQ ID NO: 1100017 - DNA, 19 bp, Homo sapiens
caagtggatgggaatttgt

SEQ ID NO: 1100018 - DNA, 14 bp, Homo sapiens
caagtggatgtttt

SEQ ID NO: 1100019 - DNA, 16 bp, Homo sapiens
caagtggctccccacc

SEQ ID NO: 1100020 - DNA, 19 bp, Homo sapiens
caagtggctccccacctgg

SEQ ID NO: 1100021 - DNA, 22 bp, Homo sapiens
caagtggctccccacctggaca

SEQ ID NO: 1100022 - DNA, 20 bp, Homo sapiens
caagtggctgggtgccctct

SEQ ID NO: 1100023 - DNA, 20 bp, Homo sapiens
caagtgggcagtcaccaccc

SEQ ID NO: 1100024 - DNA, 10 bp, Homo sapiens
caagtgggct

SEQ ID NO: 1100025 - DNA, 12 bp, Homo sapiens
caagtgggctgg

SEQ ID NO: 1100026 - DNA, 23 bp, Homo sapiens
caagtgggctggtattctctcta

SEQ ID NO: 1100027 - DNA, 14 bp, Homo sapiens
caagtgggggcaga

SEQ ID NO: 1100028 - DNA, 11 bp, Homo sapiens
caagtggtagg

SEQ ID NO: 1100029 - DNA, 22 bp, Homo sapiens
caagtggtggtaaccctggtgg

SEQ ID NO: 1100030 - DNA, 20 bp, Homo sapiens
caagtgtagatgtagcattg

SEQ ID NO: 1100031 - DNA, 22 bp, Homo sapiens
caagtgtagatgtagcattgtt

SEQ ID NO: 1100032 - DNA, 18 bp, Homo sapiens
caagtgtatatcagaaaa

SEQ ID NO: 1100033 - DNA, 22 bp, Homo sapiens
caagtgtatgcacgtgtgcaca

SEQ ID NO: 1100034 - DNA, 15 bp, Homo sapiens
caagtgtcttccatc

SEQ ID NO: 1100035 - DNA, 14 bp, Homo sapiens
caagtgtcttttaa

SEQ ID NO: 1100036 - DNA, 14 bp, Homo sapiens
caagtgtgaacaaa

SEQ ID NO: 1100037 - DNA, 19 bp, Homo sapiens
caagtgtgctaaaaatgag

SEQ ID NO: 1100038 - DNA, 19 bp, Homo sapiens
caagtgtgctttagcttga

SEQ ID NO: 1100039 - DNA, 18 bp, Homo sapiens
caagtgtggggggtcctt

SEQ ID NO: 1100040 - DNA, 23 bp, Homo sapiens
caagtgtgtatgtgcgtgtgtgc

SEQ ID NO: 1100041 - DNA, 20 bp, Homo sapiens
caagtgtgtgcatgtgtgcg

SEQ ID NO: 1100042 - DNA, 11 bp, Homo sapiens
caagtgtgtgt

SEQ ID NO: 1100043 - DNA, 17 bp, Homo sapiens
caagtgttaaattattt

SEQ ID NO: 1100044 - DNA, 23 bp, Homo sapiens
caagtgttcactgctccttgctg

SEQ ID NO: 1100045 - DNA, 19 bp, Homo sapiens
caagtgttgttttttaagt

SEQ ID NO: 1100046 - DNA, 21 bp, Homo sapiens
caagtgttttagatgttacta

SEQ ID NO: 1100047 - DNA, 19 bp, Homo sapiens
caagtgttttggagaaaaa

SEQ ID NO: 1100048 - DNA, 15 bp, Homo sapiens
caagttaacaaggaa

SEQ ID NO: 1100049 - DNA, 18 bp, Homo sapiens
caagttaacaaggaatgc

SEQ ID NO: 1100050 - DNA, 14 bp, Homo sapiens
caagttaaggcttc

SEQ ID NO: 1100051 - DNA, 17 bp, Homo sapiens
caagttagctcaggagg

SEQ ID NO: 1100052 - DNA, 21 bp, Homo sapiens
caagttatattagtgaagatg

SEQ ID NO: 1100053 - DNA, 12 bp, Homo sapiens
caagttattgta

SEQ ID NO: 1100054 - DNA, 17 bp, Homo sapiens
caagttattttatttgc

SEQ ID NO: 1100055 - DNA, 18 bp, Homo sapiens
caagttattttatttgct

SEQ ID NO: 1100056 - DNA, 20 bp, Homo sapiens
caagttattttatttgctta

SEQ ID NO: 1100057 - DNA, 12 bp, Homo sapiens
caagttcaatct

SEQ ID NO: 1100058 - DNA, 17 bp, Homo sapiens
caagttcaatctgtttt

SEQ ID NO: 1100059 - DNA, 23 bp, Homo sapiens
caagttccccatccctgtcattt

SEQ ID NO: 1100060 - DNA, 13 bp, Homo sapiens
caagttctagaga

SEQ ID NO: 1100061 - DNA, 15 bp, Homo sapiens
caagttcttcacctc

SEQ ID NO: 1100062 - DNA, 15 bp, Homo sapiens
caagttgagattttt

SEQ ID NO: 1100063 - DNA, 22 bp, Homo sapiens
caagttgagatttttaagaact

SEQ ID NO: 1100064 - DNA, 20 bp, Homo sapiens
caagttgctgtcactgtttt

SEQ ID NO: 1100065 - DNA, 14 bp, Homo sapiens
caagttggactggg

SEQ ID NO: 1100066 - DNA, 18 bp, Homo sapiens
caagttggatgcggccat

SEQ ID NO: 1100067 - DNA, 20 bp, Homo sapiens
caagttgggttcacttgcca

SEQ ID NO: 1100068 - DNA, 19 bp, Homo sapiens
caagttgtgccaaattatt

SEQ ID NO: 1100069 - DNA, 16 bp, Homo sapiens
caagttgttattgttg

SEQ ID NO: 1100070 - DNA, 22 bp, Homo sapiens
caagttgttccttaagtcagaa

SEQ ID NO: 1100071 - DNA, 16 bp, Homo sapiens
caagttgttgactgtg

SEQ ID NO: 1100072 - DNA, 13 bp, Homo sapiens
caagtttacactt

SEQ ID NO: 1100073 - DNA, 15 bp, Homo sapiens
caagtttacacttca

SEQ ID NO: 1100074 - DNA, 14 bp, Homo sapiens
caagtttatttctc

SEQ ID NO: 1100075 - DNA, 12 bp, Homo sapiens
caagtttgctaa

SEQ ID NO: 1100076 - DNA, 13 bp, Homo sapiens
caagtttgctaaa

SEQ ID NO: 1100077 - DNA, 14 bp, Homo sapiens
caagttttaaagtt

SEQ ID NO: 1100078 - DNA, 17 bp, Homo sapiens
caagttttcttccatga

SEQ ID NO: 1100079 - DNA, 12 bp, Homo sapiens
caagttttgtat

SEQ ID NO: 1100080 - DNA, 17 bp, Homo sapiens
caagttttgtataaata

SEQ ID NO: 1100081 - DNA, 13 bp, Homo sapiens
caagttttgtgta

SEQ ID NO: 1100082 - DNA, 21 bp, Homo sapiens
caataaaaaaaagaaatgaaa

SEQ ID NO: 1100083 - DNA, 11 bp, Homo sapiens
caataaaaaat

SEQ ID NO: 1100084 - DNA, 19 bp, Homo sapiens
caataaaaacaactttcac

SEQ ID NO: 1100085 - DNA, 18 bp, Homo sapiens
caataaaaacattttgaa

SEQ ID NO: 1100086 - DNA, 19 bp, Homo sapiens
caataaaaacattttgaag

SEQ ID NO: 1100087 - DNA, 16 bp, Homo sapiens
caataaaaagttcaga

SEQ ID NO: 1100088 - DNA, 14 bp, Homo sapiens
caataaaaatcata

SEQ ID NO: 1100089 - DNA, 15 bp, Homo sapiens
caataaaacattaat

SEQ ID NO: 1100090 - DNA, 13 bp, Homo sapiens
caataaaagagct

SEQ ID NO: 1100091 - DNA, 15 bp, Homo sapiens
caataaaagagcttt

SEQ ID NO: 1100092 - DNA, 17 bp, Homo sapiens
caataaaatattattga

SEQ ID NO: 1100093 - DNA, 20 bp, Homo sapiens
caataaaatcttgaaaatgc

SEQ ID NO: 1100094 - DNA, 21 bp, Homo sapiens
caataaaatgtgatttttctg

SEQ ID NO: 1100095 - DNA, 22 bp, Homo sapiens
caataaaatgtgatttttctga

SEQ ID NO: 1100096 - DNA, 21 bp, Homo sapiens
caataaacaacagctgaagca

SEQ ID NO: 1100097 - DNA, 22 bp, Homo sapiens
caataaacaggaattttatttt

SEQ ID NO: 1100098 - DNA, 12 bp, Homo sapiens
caataaactcct

SEQ ID NO: 1100099 - DNA, 18 bp, Homo sapiens
caataaacttagaggaaa

SEQ ID NO: 1100100 - DNA, 18 bp, Homo sapiens
caataaagcagagccaag

SEQ ID NO: 1100101 - DNA, 23 bp, Homo sapiens
caataaagcagcctcattctgag

SEQ ID NO: 1100102 - DNA, 13 bp, Homo sapiens
caataaagcagtc

SEQ ID NO: 1100103 - DNA, 17 bp, Homo sapiens
caataaagcagtcctgt

SEQ ID NO: 1100104 - DNA, 16 bp, Homo sapiens
caataaagcatttata

SEQ ID NO: 1100105 - DNA, 19 bp, Homo sapiens
caataaagcatttataaat

SEQ ID NO: 1100106 - DNA, 12 bp, Homo sapiens
caataaaggcag

SEQ ID NO: 1100107 - DNA, 17 bp, Homo sapiens
caataaaggcagctgcc

SEQ ID NO: 1100108 - DNA, 18 bp, Homo sapiens
caataaaggcagctgcct

SEQ ID NO: 1100109 - DNA, 22 bp, Homo sapiens
caataaaggcagctgcctctgc

SEQ ID NO: 1100110 - DNA, 23 bp, Homo sapiens
caataaaggcagctgcctctgct

SEQ ID NO: 1100111 - DNA, 21 bp, Homo sapiens
caataaagggagaatggtgct

SEQ ID NO: 1100112 - DNA, 14 bp, Homo sapiens
caataaagtgatct

SEQ ID NO: 1100113 - DNA, 16 bp, Homo sapiens
caataaagtgatctgt

SEQ ID NO: 1100114 - DNA, 22 bp, Homo sapiens
caataaagtgatctgtgttcaa

SEQ ID NO: 1100115 - DNA, 19 bp, Homo sapiens
caataaagtgccttctggg

SEQ ID NO: 1100116 - DNA, 12 bp, Homo sapiens
caataaatgaat

SEQ ID NO: 1100117 - DNA, 17 bp, Homo sapiens
caataaatgacacccag

SEQ ID NO: 1100118 - DNA, 21 bp, Homo sapiens
caataaatggccagtgctgct

SEQ ID NO: 1100119 - DNA, 20 bp, Homo sapiens
caataaatgtatcatttttg

SEQ ID NO: 1100120 - DNA, 14 bp, Homo sapiens
caataaatgtattc

SEQ ID NO: 1100121 - DNA, 15 bp, Homo sapiens
caataaatgtattca

SEQ ID NO: 1100122 - DNA, 13 bp, Homo sapiens
caataaattgcta

SEQ ID NO: 1100123 - DNA, 15 bp, Homo sapiens
caataaattgctaat

SEQ ID NO: 1100124 - DNA, 22 bp, Homo sapiens
caataaattgctaatgttgctg

SEQ ID NO: 1100125 - DNA, 19 bp, Homo sapiens
caataacaaaacgaaacta

SEQ ID NO: 1100126 - DNA, 13 bp, Homo sapiens
caataacaaagca

SEQ ID NO: 1100127 - DNA, 20 bp, Homo sapiens
caataacaaagcacataact

SEQ ID NO: 1100128 - DNA, 17 bp, Homo sapiens
caataacagatggtgct

SEQ ID NO: 1100129 - DNA, 13 bp, Homo sapiens
caataacagctgc

SEQ ID NO: 1100130 - DNA, 23 bp, Homo sapiens
caatggctaattcccagagtgtg

SEQ ID NO: 1100131 - DNA, 22 bp, Homo sapiens
caatggctatatggcaagaaag

SEQ ID NO: 1100132 - DNA, 16 bp, Homo sapiens
caatgggaagactcag

SEQ ID NO: 1100133 - DNA, 23 bp, Homo sapiens
caatgggaccgtgccccacctcc

SEQ ID NO: 1100134 - DNA, 17 bp, Homo sapiens
caatgggcactgggatg

SEQ ID NO: 1100135 - DNA, 22 bp, Homo sapiens
caatgggccgtcccctctcccc

SEQ ID NO: 1100136 - DNA, 16 bp, Homo sapiens
caatgggctcttccaa

SEQ ID NO: 1100137 - DNA, 22 bp, Homo sapiens
caatggtagaagtgagagcttt

SEQ ID NO: 1100138 - DNA, 13 bp, Homo sapiens
caatggtgcaaaa

SEQ ID NO: 1100139 - DNA, 14 bp, Homo sapiens
caatggtgcttccc

SEQ ID NO: 1100140 - DNA, 17 bp, Homo sapiens
caatggtgcttccccca

SEQ ID NO: 1100141 - DNA, 17 bp, Homo sapiens
caatggtgttgccctga

SEQ ID NO: 1100142 - DNA, 16 bp, Homo sapiens
caatggtttttaaatt

SEQ ID NO: 1100143 - DNA, 23 bp, Homo sapiens
caatggtttttaaattttgtaat

SEQ ID NO: 1100144 - DNA, 19 bp, Homo sapiens
caatgtaaatattttaaag

SEQ ID NO: 1100145 - DNA, 18 bp, Homo sapiens
caatgtaattaaactgtt

SEQ ID NO: 1100146 - DNA, 13 bp, Homo sapiens
caatgtacaatta

SEQ ID NO: 1100147 - DNA, 18 bp, Homo sapiens
caatgtacaattatgtct

SEQ ID NO: 1100148 - DNA, 21 bp, Homo sapiens
caatgtacaattatgtctctt

SEQ ID NO: 1100149 - DNA, 17 bp, Homo sapiens
caatgtagaaagctttg

SEQ ID NO: 1100150 - DNA, 15 bp, Homo sapiens
caatgtataaagatt

SEQ ID NO: 1100151 - DNA, 11 bp, Homo sapiens
caatgtatctt

SEQ ID NO: 1100152 - DNA, 14 bp, Homo sapiens
caatgtatctttat

SEQ ID NO: 1100153 - DNA, 16 bp, Homo sapiens
caatgtatgtacaata

SEQ ID NO: 1100154 - DNA, 17 bp, Homo sapiens
caatgtatgtacaatac

SEQ ID NO: 1100155 - DNA, 18 bp, Homo sapiens
caatgtatgtgtggctgt

SEQ ID NO: 1100156 - DNA, 22 bp, Homo sapiens
caatgtcacaacctctctgatc

SEQ ID NO: 1100157 - DNA, 16 bp, Homo sapiens
caatgtcagcctttgt

SEQ ID NO: 1100158 - DNA, 21 bp, Homo sapiens
caatgtcagcctttgttaacc

SEQ ID NO: 1100159 - DNA, 16 bp, Homo sapiens
caatgtcaggaacaga

SEQ ID NO: 1100160 - DNA, 16 bp, Homo sapiens
caatgtccagtgagtg

SEQ ID NO: 1100161 - DNA, 13 bp, Homo sapiens
caatgtctcccac

SEQ ID NO: 1100162 - DNA, 16 bp, Homo sapiens
caatgtctgagtgaac

SEQ ID NO: 1100163 - DNA, 13 bp, Homo sapiens
caatgtctgtgct

SEQ ID NO: 1100164 - DNA, 20 bp, Homo sapiens
caatgtctgtgctagggaaa

SEQ ID NO: 1100165 - DNA, 20 bp, Homo sapiens
caatgtcttaaataaaacta

SEQ ID NO: 1100166 - DNA, 14 bp, Homo sapiens
caatgtcttcccac

SEQ ID NO: 1100167 - DNA, 12 bp, Homo sapiens
caatgtgaaaaa

SEQ ID NO: 1100168 - DNA, 22 bp, Homo sapiens
caatgtgaaaagaaaaatgagc

SEQ ID NO: 1100169 - DNA, 21 bp, Homo sapiens
caatgtgaaacacatgccagt

SEQ ID NO: 1100170 - DNA, 15 bp, Homo sapiens
caatgtgaactttat

SEQ ID NO: 1100171 - DNA, 19 bp, Homo sapiens
caatgtgaactttattaaa

SEQ ID NO: 1100172 - DNA, 22 bp, Homo sapiens
caatgtgattcttctaaagcac

SEQ ID NO: 1100173 - DNA, 15 bp, Homo sapiens
caatgtgcagactga

SEQ ID NO: 1100174 - DNA, 13 bp, Homo sapiens
caatgtgcagtgt

SEQ ID NO: 1100175 - DNA, 18 bp, Homo sapiens
caatgtgcataatgataa

SEQ ID NO: 1100176 - DNA, 22 bp, Homo sapiens
caatgtgcataatgataaaata

SEQ ID NO: 1100177 - DNA, 18 bp, Homo sapiens
caatgtggagcagcagcc

SEQ ID NO: 1100178 - DNA, 13 bp, Homo sapiens
caatgtggcaaga

SEQ ID NO: 1100179 - DNA, 17 bp, Homo sapiens
caatgtgggatctcaga

SEQ ID NO: 1100180 - DNA, 17 bp, Homo sapiens
caatgtgggctgcccct

SEQ ID NO: 1100181 - DNA, 22 bp, Homo sapiens
caatgtggtgacacctccccct

SEQ ID NO: 1100182 - DNA, 17 bp, Homo sapiens
caatgtgtataaattgt

SEQ ID NO: 1100183 - DNA, 22 bp, Homo sapiens
caatgtgtctttctaagaaatc

SEQ ID NO: 1100184 - DNA, 11 bp, Homo sapiens
caatgtgttca

SEQ ID NO: 1100185 - DNA, 16 bp, Homo sapiens
caatgtgttttctgta

SEQ ID NO: 1100186 - DNA, 22 bp, Homo sapiens
caatgttagcctcaatttctga

SEQ ID NO: 1100187 - DNA, 14 bp, Homo sapiens
caatgttcatccca

SEQ ID NO: 1100188 - DNA, 13 bp, Homo sapiens
caatgttcattgt

SEQ ID NO: 1100189 - DNA, 22 bp, Homo sapiens
caatgttcattgtaatgttact

SEQ ID NO: 1100190 - DNA, 14 bp, Homo sapiens
caatgttctctctt

SEQ ID NO: 1100191 - DNA, 19 bp, Homo sapiens
caatgttgtatttgttatt

SEQ ID NO: 1100192 - DNA, 17 bp, Homo sapiens
caatgttgtccaacaat

SEQ ID NO: 1100193 - DNA, 20 bp, Homo sapiens
caatgttgtccaacaataaa

SEQ ID NO: 1100194 - DNA, 20 bp, Homo sapiens
caatgtttatgcaaggaagg

SEQ ID NO: 1100195 - DNA, 15 bp, Homo sapiens
caatgtttcttcatt

SEQ ID NO: 1100196 - DNA, 22 bp, Homo sapiens
caatgtttgatgtccccaaagt

SEQ ID NO: 1100197 - DNA, 16 bp, Homo sapiens
caatgtttgggggaaa

SEQ ID NO: 1100198 - DNA, 23 bp, Homo sapiens
caatgtttgggggaaaaaaaaga

SEQ ID NO: 1100199 - DNA, 22 bp, Homo sapiens
caatgttttcctttgtcatcat

SEQ ID NO: 1100200 - DNA, 22 bp, Homo sapiens
caattaaaaaaaattaaaacca

SEQ ID NO: 1100201 - DNA, 12 bp, Homo sapiens
caattaaaatac

SEQ ID NO: 1100202 - DNA, 18 bp, Homo sapiens
caattaaaatactatgca

SEQ ID NO: 1100203 - DNA, 11 bp, Homo sapiens
caattaaaatt

SEQ ID NO: 1100204 - DNA, 17 bp, Homo sapiens
caattaaaccgcatgtg

SEQ ID NO: 1100205 - DNA, 19 bp, Homo sapiens
caattaaacttccaaagaa

SEQ ID NO: 1100206 - DNA, 12 bp, Homo sapiens
caattaaagtct

SEQ ID NO: 1100207 - DNA, 12 bp, Homo sapiens
caattaaatgta

SEQ ID NO: 1100208 - DNA, 13 bp, Homo sapiens
caattaaatgtag

SEQ ID NO: 1100209 - DNA, 14 bp, Homo sapiens
caattaaatgtagg

SEQ ID NO: 1100210 - DNA, 16 bp, Homo sapiens
caattaagaaattcca

SEQ ID NO: 1100211 - DNA, 15 bp, Homo sapiens
caattaataaaaaat

SEQ ID NO: 1100212 - DNA, 18 bp, Homo sapiens
caattaatagtttgtcta

SEQ ID NO: 1100213 - DNA, 17 bp, Homo sapiens
caattacagggtgactc

SEQ ID NO: 1100214 - DNA, 19 bp, Homo sapiens
caattacagggtgactcac

SEQ ID NO: 1100215 - DNA, 19 bp, Homo sapiens
caattactaaattgtatac

SEQ ID NO: 1100216 - DNA, 15 bp, Homo sapiens
caattactcaggttt

SEQ ID NO: 1100217 - DNA, 16 bp, Homo sapiens
caattacttattttag

SEQ ID NO: 1100218 - DNA, 23 bp, Homo sapiens
caattagcagaatggagaaagta

SEQ ID NO: 1100219 - DNA, 16 bp, Homo sapiens
caattagggcctagcc

SEQ ID NO: 1100220 - DNA, 18 bp, Homo sapiens
caattagtttccttttta

SEQ ID NO: 1100221 - DNA, 15 bp, Homo sapiens
caattataattgtaa

SEQ ID NO: 1100222 - DNA, 22 bp, Homo sapiens
caattatctgattaagcattct

SEQ ID NO: 1100223 - DNA, 14 bp, Homo sapiens
caattatgtctctt

SEQ ID NO: 1100224 - DNA, 17 bp, Homo sapiens
caattatgtctcttgag

SEQ ID NO: 1100225 - DNA, 20 bp, Homo sapiens
caattattacatttatacat

SEQ ID NO: 1100226 - DNA, 12 bp, Homo sapiens
caattcaaaaca

SEQ ID NO: 1100227 - DNA, 14 bp, Homo sapiens
caattcaacccttt

SEQ ID NO: 1100228 - DNA, 20 bp, Homo sapiens
caattcacatctaacctcat

SEQ ID NO: 1100229 - DNA, 13 bp, Homo sapiens
caattcagacagg

SEQ ID NO: 1100230 - DNA, 14 bp, Homo sapiens
caattcagacaggc

SEQ ID NO: 1100231 - DNA, 15 bp, Homo sapiens
caattcagacaggca

SEQ ID NO: 1100232 - DNA, 14 bp, Homo sapiens
caattcagacccct

SEQ ID NO: 1100233 - DNA, 19 bp, Homo sapiens
caattcagattgtcttgca

SEQ ID NO: 1100234 - DNA, 14 bp, Homo sapiens
caattcatgtaaca

SEQ ID NO: 1100235 - DNA, 17 bp, Homo sapiens
caattcatgtaacagtt

SEQ ID NO: 1100236 - DNA, 17 bp, Homo sapiens
caattccaagaaaatat

SEQ ID NO: 1100237 - DNA, 18 bp, Homo sapiens
caattccaagaaaatatc

SEQ ID NO: 1100238 - DNA, 13 bp, Homo sapiens
caattccacctgc

SEQ ID NO: 1100239 - DNA, 23 bp, Homo sapiens
caattccaggtgtgcacagaaaa

SEQ ID NO: 1100240 - DNA, 13 bp, Homo sapiens
caattcccctctg

SEQ ID NO: 1100241 - DNA, 17 bp, Homo sapiens
caattcccctctgctgc

SEQ ID NO: 1100242 - DNA, 13 bp, Homo sapiens
caattcctgggcc

SEQ ID NO: 1100243 - DNA, 11 bp, Homo sapiens
caattctaaat

SEQ ID NO: 1100244 - DNA, 16 bp, Homo sapiens
caattctcctgcctca

SEQ ID NO: 1100245 - DNA, 12 bp, Homo sapiens
caattctgactg

SEQ ID NO: 1100246 - DNA, 16 bp, Homo sapiens
caattcttgagaccca

SEQ ID NO: 1100247 - DNA, 19 bp, Homo sapiens
caattcttttaactgttgt

SEQ ID NO: 1100248 - DNA, 14 bp, Homo sapiens
caattgaaatgcat

SEQ ID NO: 1100249 - DNA, 18 bp, Homo sapiens
caattgaagtaaactttt

SEQ ID NO: 1100250 - DNA, 14 bp, Homo sapiens
caattgagaaaaat

SEQ ID NO: 1100251 - DNA, 21 bp, Homo sapiens
caattgatgtatatgtttata

SEQ ID NO: 1100252 - DNA, 15 bp, Homo sapiens
caattgattgtgaat

SEQ ID NO: 1100253 - DNA, 19 bp, Homo sapiens
cacagccggtcagaggagc

SEQ ID NO: 1100254 - DNA, 20 bp, Homo sapiens
cacagcctagcacagcagct

SEQ ID NO: 1100255 - DNA, 14 bp, Homo sapiens
cacagcctccaggg

SEQ ID NO: 1100256 - DNA, 15 bp, Homo sapiens
cacagcctccagggc

SEQ ID NO: 1100257 - DNA, 12 bp, Homo sapiens
cacagcctcccc

SEQ ID NO: 1100258 - DNA, 17 bp, Homo sapiens
cacagcctcccctgcca

SEQ ID NO: 1100259 - DNA, 18 bp, Homo sapiens
cacagcctccctgagcct

SEQ ID NO: 1100260 - DNA, 20 bp, Homo sapiens
cacagcctccctgagcctgc

SEQ ID NO: 1100261 - DNA, 11 bp, Homo sapiens
cacagcctctg

SEQ ID NO: 1100262 - DNA, 15 bp, Homo sapiens
cacagcctgctggca

SEQ ID NO: 1100263 - DNA, 17 bp, Homo sapiens
cacagcctgctggcagg

SEQ ID NO: 1100264 - DNA, 23 bp, Homo sapiens
cacagcctgctggcagggccagg

SEQ ID NO: 1100265 - DNA, 13 bp, Homo sapiens
cacagccttcctt

SEQ ID NO: 1100266 - DNA, 15 bp, Homo sapiens
cacagccttccttct

SEQ ID NO: 1100267 - DNA, 17 bp, Homo sapiens
cacagccttccttctgc

SEQ ID NO: 1100268 - DNA, 18 bp, Homo sapiens
cacagccttccttctgct

SEQ ID NO: 1100269 - DNA, 13 bp, Homo sapiens
cacagccttcgga

SEQ ID NO: 1100270 - DNA, 23 bp, Homo sapiens
cacagccttcggacagacatatg

SEQ ID NO: 1100271 - DNA, 19 bp, Homo sapiens
cacagcctttcgttctgct

SEQ ID NO: 1100272 - DNA, 23 bp, Homo sapiens
cacagcgacgctcccctgagagg

SEQ ID NO: 1100273 - DNA, 14 bp, Homo sapiens
cacagcgagcctgt

SEQ ID NO: 1100274 - DNA, 19 bp, Homo sapiens
cacagcgagcctgtgcctt

SEQ ID NO: 1100275 - DNA, 17 bp, Homo sapiens
cacagcgagggcagctg

SEQ ID NO: 1100276 - DNA, 16 bp, Homo sapiens
cacagcggcccctgca

SEQ ID NO: 1100277 - DNA, 16 bp, Homo sapiens
cacagcgtccctggcg

SEQ ID NO: 1100278 - DNA, 15 bp, Homo sapiens
cacagctacctcttc

SEQ ID NO: 1100279 - DNA, 16 bp, Homo sapiens
cacagctacctgagac

SEQ ID NO: 1100280 - DNA, 15 bp, Homo sapiens
cacagctcaactcgg

SEQ ID NO: 1100281 - DNA, 15 bp, Homo sapiens
cacagctcactgcag

SEQ ID NO: 1100282 - DNA, 13 bp, Homo sapiens
cacagctcaggag

SEQ ID NO: 1100283 - DNA, 14 bp, Homo sapiens
cacagctccaggac

SEQ ID NO: 1100284 - DNA, 22 bp, Homo sapiens
cacagctcccaccccaccccct

SEQ ID NO: 1100285 - DNA, 16 bp, Homo sapiens
cacagctcctgccagg

SEQ ID NO: 1100286 - DNA, 13 bp, Homo sapiens
cacagctctgggc

SEQ ID NO: 1100287 - DNA, 18 bp, Homo sapiens
cacagctgagagactttt

SEQ ID NO: 1100288 - DNA, 18 bp, Homo sapiens
cacagctgagcacttagc

SEQ ID NO: 1100289 - DNA, 13 bp, Homo sapiens
cacagctgcagct

SEQ ID NO: 1100290 - DNA, 13 bp, Homo sapiens
cacagctgcccta

SEQ ID NO: 1100291 - DNA, 18 bp, Homo sapiens
cacagctgccctagctga

SEQ ID NO: 1100292 - DNA, 21 bp, Homo sapiens
cacagctgccctagctgaccc

SEQ ID NO: 1100293 - DNA, 14 bp, Homo sapiens
cacagctgccctgc

SEQ ID NO: 1100294 - DNA, 12 bp, Homo sapiens
cacagctgctca

SEQ ID NO: 1100295 - DNA, 22 bp, Homo sapiens
cacagctgctggagaataaatt

SEQ ID NO: 1100296 - DNA, 21 bp, Homo sapiens
cacagctgctgttctcaggac

SEQ ID NO: 1100297 - DNA, 13 bp, Homo sapiens
cacagctgcttgt

SEQ ID NO: 1100298 - DNA, 20 bp, Homo sapiens
cacagctgctttctgttgtc

SEQ ID NO: 1100299 - DNA, 15 bp, Homo sapiens
cacagctgggagcct

SEQ ID NO: 1100300 - DNA, 13 bp, Homo sapiens
cacagctgggcaa

SEQ ID NO: 1100301 - DNA, 19 bp, Homo sapiens
cacagctgggcaaagccac

SEQ ID NO: 1100302 - DNA, 18 bp, Homo sapiens
cacagctgggcagggtga

SEQ ID NO: 1100303 - DNA, 15 bp, Homo sapiens
cacagctgtctgcca

SEQ ID NO: 1100304 - DNA, 15 bp, Homo sapiens
cacagcttcctgagg

SEQ ID NO: 1100305 - DNA, 17 bp, Homo sapiens
cacagcttcctgagggc

SEQ ID NO: 1100306 - DNA, 13 bp, Homo sapiens
cacagcttcttct

SEQ ID NO: 1100307 - DNA, 14 bp, Homo sapiens
cacagcttcttctg

SEQ ID NO: 1100308 - DNA, 21 bp, Homo sapiens
cacagcttgacctgaggctgt

SEQ ID NO: 1100309 - DNA, 15 bp, Homo sapiens
cacagcttgggtcag

SEQ ID NO: 1100310 - DNA, 17 bp, Homo sapiens
cacagctttgcacccct

SEQ ID NO: 1100311 - DNA, 15 bp, Homo sapiens
cacaggaacggccct

SEQ ID NO: 1100312 - DNA, 17 bp, Homo sapiens
cacaggaacggccctgc

SEQ ID NO: 1100313 - DNA, 20 bp, Homo sapiens
cacaggaacggccctgcagg

SEQ ID NO: 1100314 - DNA, 23 bp, Homo sapiens
cacaggaaggaggggagagacag

SEQ ID NO: 1100315 - DNA, 16 bp, Homo sapiens
cacaggacccccttcc

SEQ ID NO: 1100316 - DNA, 15 bp, Homo sapiens
cacaggactctgcct

SEQ ID NO: 1100317 - DNA, 16 bp, Homo sapiens
cacaggactgaaaagg

SEQ ID NO: 1100318 - DNA, 19 bp, Homo sapiens
cacaggactgagccctctc

SEQ ID NO: 1100319 - DNA, 21 bp, Homo sapiens
cacaggagactccaaggagct

SEQ ID NO: 1100320 - DNA, 17 bp, Homo sapiens
cacaggagctgccatgt

SEQ ID NO: 1100321 - DNA, 21 bp, Homo sapiens
cacaggagtcttcagacccag

SEQ ID NO: 1100322 - DNA, 22 bp, Homo sapiens
cacaggagttgtgagccctcta

SEQ ID NO: 1100323 - DNA, 23 bp, Homo sapiens
cacaggatattaaacgtgtaaat

SEQ ID NO: 1100324 - DNA, 23 bp, Homo sapiens
cacaggatgaggtggtggagtgg

SEQ ID NO: 1100325 - DNA, 14 bp, Homo sapiens
cacaggcaactgag

SEQ ID NO: 1100326 - DNA, 18 bp, Homo sapiens
cacaggcaactgaggcag

SEQ ID NO: 1100327 - DNA, 20 bp, Homo sapiens
cacaggcacacaggtctcat

SEQ ID NO: 1100328 - DNA, 22 bp, Homo sapiens
cacaggcactgaacaggctggg

SEQ ID NO: 1100329 - DNA, 16 bp, Homo sapiens
cacaggcagctggatg

SEQ ID NO: 1100330 - DNA, 19 bp, Homo sapiens
cacaggcaggggtgagagc

SEQ ID NO: 1100331 - DNA, 12 bp, Homo sapiens
cacaggccccct

SEQ ID NO: 1100332 - DNA, 22 bp, Homo sapiens
cacaggcccccttgagtggggt

SEQ ID NO: 1100333 - DNA, 22 bp, Homo sapiens
cacaggcccgccctctgcctcc

SEQ ID NO: 1100334 - DNA, 17 bp, Homo sapiens
cacaggccctggagaag

SEQ ID NO: 1100335 - DNA, 17 bp, Homo sapiens
cacaggcccttcctctc

SEQ ID NO: 1100336 - DNA, 22 bp, Homo sapiens
cacaggcccttcctctccactg

SEQ ID NO: 1100337 - DNA, 14 bp, Homo sapiens
cacaggccttctgt

SEQ ID NO: 1100338 - DNA, 16 bp, Homo sapiens
cacaggccttctgtgg

SEQ ID NO: 1100339 - DNA, 19 bp, Homo sapiens
cacaggccttctgtggggc

SEQ ID NO: 1100340 - DNA, 17 bp, Homo sapiens
cacaggctgagaactcg

SEQ ID NO: 1100341 - DNA, 19 bp, Homo sapiens
cacaggcttagggacagga

SEQ ID NO: 1100342 - DNA, 22 bp, Homo sapiens
cacaggcttagggacaggaccc

SEQ ID NO: 1100343 - DNA, 17 bp, Homo sapiens
cacagggacttgaagtt

SEQ ID NO: 1100344 - DNA, 24 bp, Homo sapiens
cacagggcaaaatcgccataggcc

SEQ ID NO: 1100345 - DNA, 12 bp, Homo sapiens
cacagggcaggc

SEQ ID NO: 1100346 - DNA, 15 bp, Homo sapiens
cacagggcccggcca

SEQ ID NO: 1100347 - DNA, 13 bp, Homo sapiens
cacagggcgagac

SEQ ID NO: 1100348 - DNA, 18 bp, Homo sapiens
cacagggctcacagggca

SEQ ID NO: 1100349 - DNA, 19 bp, Homo sapiens
cacagggctcacagggcag

SEQ ID NO: 1100350 - DNA, 18 bp, Homo sapiens
cacaggggaaggaaataa

SEQ ID NO: 1100351 - DNA, 17 bp, Homo sapiens
cacaggggacagggctg

SEQ ID NO: 1100352 - DNA, 16 bp, Homo sapiens
cacaggggcaggcctg

SEQ ID NO: 1100353 - DNA, 23 bp, Homo sapiens
cacaggggccaccacctttggct

SEQ ID NO: 1100354 - DNA, 14 bp, Homo sapiens
cacaggggccccag

SEQ ID NO: 1100355 - DNA, 15 bp, Homo sapiens
cacaggggccccaga

SEQ ID NO: 1100356 - DNA, 19 bp, Homo sapiens
cacaggggccccagatctg

SEQ ID NO: 1100357 - DNA, 15 bp, Homo sapiens
cacagggtctgctct

SEQ ID NO: 1100358 - DNA, 16 bp, Homo sapiens
cacagggtctgctctt

SEQ ID NO: 1100359 - DNA, 19 bp, Homo sapiens
cacagggtctgctctttct

SEQ ID NO: 1100360 - DNA, 18 bp, Homo sapiens
cacagggttgggcccaga

SEQ ID NO: 1100361 - DNA, 23 bp, Homo sapiens
cacagggttgggcccagatctgg

SEQ ID NO: 1100362 - DNA, 15 bp, Homo sapiens
cacagggttttgtat

SEQ ID NO: 1100363 - DNA, 16 bp, Homo sapiens
cacagggttttgtatt

SEQ ID NO: 1100364 - DNA, 13 bp, Homo sapiens
cacaggtcagggc

SEQ ID NO: 1100365 - DNA, 14 bp, Homo sapiens
cacaggtcagggct

SEQ ID NO: 1100366 - DNA, 15 bp, Homo sapiens
cacaggtcagggctc

SEQ ID NO: 1100367 - DNA, 15 bp, Homo sapiens
cacaggtctttccta

SEQ ID NO: 1100368 - DNA, 16 bp, Homo sapiens
cacaggtgaggggcag

SEQ ID NO: 1100369 - DNA, 18 bp, Homo sapiens
cacaggtgcgggaccatc

SEQ ID NO: 1100370 - DNA, 22 bp, Homo sapiens
cacaggtttccccaaggcctct

SEQ ID NO: 1100371 - DNA, 20 bp, Homo sapiens
cacagtaaaaacttgtacta

SEQ ID NO: 1100372 - DNA, 16 bp, Homo sapiens
cacagtaaaaataaaa

SEQ ID NO: 1100373 - DNA, 17 bp, Homo sapiens
cacagtacagcatgtgc

SEQ ID NO: 1100374 - DNA, 13 bp, Homo sapiens
cacagtagaactg

SEQ ID NO: 1100375 - DNA, 21 bp, Homo sapiens
cacccccagccccgactccag

SEQ ID NO: 1100376 - DNA, 11 bp, Homo sapiens
cacccccagct

SEQ ID NO: 1100377 - DNA, 12 bp, Homo sapiens
cacccccagctc

SEQ ID NO: 1100378 - DNA, 13 bp, Homo sapiens
cacccccaggcct

SEQ ID NO: 1100379 - DNA, 15 bp, Homo sapiens
cacccccaggcctcc

SEQ ID NO: 1100380 - DNA, 20 bp, Homo sapiens
cacccccaggtgcagcccca

SEQ ID NO: 1100381 - DNA, 13 bp, Homo sapiens
cacccccatctct

SEQ ID NO: 1100382 - DNA, 13 bp, Homo sapiens
cacccccatcttc

SEQ ID NO: 1100383 - DNA, 20 bp, Homo sapiens
cacccccatcttccacctgt

SEQ ID NO: 1100384 - DNA, 13 bp, Homo sapiens
cacccccatgctg

SEQ ID NO: 1100385 - DNA, 14 bp, Homo sapiens
cacccccatgctgc

SEQ ID NO: 1100386 - DNA, 18 bp, Homo sapiens
cacccccatgctgccttc

SEQ ID NO: 1100387 - DNA, 22 bp, Homo sapiens
cacccccatgctgccttcaggg

SEQ ID NO: 1100388 - DNA, 20 bp, Homo sapiens
cacccccatgtggcagccca

SEQ ID NO: 1100389 - DNA, 14 bp, Homo sapiens
caccccccaagctg

SEQ ID NO: 1100390 - DNA, 16 bp, Homo sapiens
caccccccagcctcca

SEQ ID NO: 1100391 - DNA, 16 bp, Homo sapiens
cacccccccaaccccc

SEQ ID NO: 1100392 - DNA, 21 bp, Homo sapiens
cacccccgacggcctccagga

SEQ ID NO: 1100393 - DNA, 22 bp, Homo sapiens
cacccccgacggcctccaggag

SEQ ID NO: 1100394 - DNA, 13 bp, Homo sapiens
cacccccgccagg

SEQ ID NO: 1100395 - DNA, 14 bp, Homo sapiens
cacccccgccaggc

SEQ ID NO: 1100396 - DNA, 18 bp, Homo sapiens
cacccccgctttggttct

SEQ ID NO: 1100397 - DNA, 19 bp, Homo sapiens
cacccccgggatcctgccc

SEQ ID NO: 1100398 - DNA, 11 bp, Homo sapiens
caccccctcat

SEQ ID NO: 1100399 - DNA, 14 bp, Homo sapiens
caccccctcattcc

SEQ ID NO: 1100400 - DNA, 16 bp, Homo sapiens
caccccctcattcccc

SEQ ID NO: 1100401 - DNA, 15 bp, Homo sapiens
caccccctcccaccc

SEQ ID NO: 1100402 - DNA, 16 bp, Homo sapiens
caccccctcccacccc

SEQ ID NO: 1100403 - DNA, 15 bp, Homo sapiens
caccccctccccagg

SEQ ID NO: 1100404 - DNA, 13 bp, Homo sapiens
caccccctccccg

SEQ ID NO: 1100405 - DNA, 15 bp, Homo sapiens
caccccctccccgcc

SEQ ID NO: 1100406 - DNA, 14 bp, Homo sapiens
caccccctccctgg

SEQ ID NO: 1100407 - DNA, 11 bp, Homo sapiens
caccccctcct

SEQ ID NO: 1100408 - DNA, 19 bp, Homo sapiens
caccccctgctccaccagc

SEQ ID NO: 1100409 - DNA, 12 bp, Homo sapiens
caccccctgggc

SEQ ID NO: 1100410 - DNA, 13 bp, Homo sapiens
caccccctgggca

SEQ ID NO: 1100411 - DNA, 13 bp, Homo sapiens
caccccctgtccc

SEQ ID NO: 1100412 - DNA, 14 bp, Homo sapiens
caccccctgtccca

SEQ ID NO: 1100413 - DNA, 22 bp, Homo sapiens
caccccctgtcccattctagat

SEQ ID NO: 1100414 - DNA, 16 bp, Homo sapiens
cacccccttcagtgcc

SEQ ID NO: 1100415 - DNA, 21 bp, Homo sapiens
cacccccttcagtgcccacca

SEQ ID NO: 1100416 - DNA, 14 bp, Homo sapiens
cacccccttccccc

SEQ ID NO: 1100417 - DNA, 13 bp, Homo sapiens
cacccccttctct

SEQ ID NO: 1100418 - DNA, 17 bp, Homo sapiens
cacccccttctctgctc

SEQ ID NO: 1100419 - DNA, 14 bp, Homo sapiens
caccccctttcctg

SEQ ID NO: 1100420 - DNA, 14 bp, Homo sapiens
caccccggcctcca

SEQ ID NO: 1100421 - DNA, 16 bp, Homo sapiens
caccccggcctccact

SEQ ID NO: 1100422 - DNA, 17 bp, Homo sapiens
caccccggggaccctgt

SEQ ID NO: 1100423 - DNA, 15 bp, Homo sapiens
caccccgtgccaccc

SEQ ID NO: 1100424 - DNA, 15 bp, Homo sapiens
caccccgtgcccctg

SEQ ID NO: 1100425 - DNA, 14 bp, Homo sapiens
cacccctaaagaga

SEQ ID NO: 1100426 - DNA, 15 bp, Homo sapiens
cacccctaagtacaa

SEQ ID NO: 1100427 - DNA, 12 bp, Homo sapiens
cacccctcactc

SEQ ID NO: 1100428 - DNA, 16 bp, Homo sapiens
cacccctcactcccca

SEQ ID NO: 1100429 - DNA, 20 bp, Homo sapiens
cacccctcactccccaggga

SEQ ID NO: 1100430 - DNA, 12 bp, Homo sapiens
cacccctccacg

SEQ ID NO: 1100431 - DNA, 17 bp, Homo sapiens
cacccctccacgtgtcc

SEQ ID NO: 1100432 - DNA, 13 bp, Homo sapiens
cacccctcccatt

SEQ ID NO: 1100433 - DNA, 17 bp, Homo sapiens
cacccctcccattagga

SEQ ID NO: 1100434 - DNA, 18 bp, Homo sapiens
cacccctccctccctctt

SEQ ID NO: 1100435 - DNA, 20 bp, Homo sapiens
cacccctccgtgtggagcac

SEQ ID NO: 1100436 - DNA, 22 bp, Homo sapiens
cacccctctgtctaggactgca

SEQ ID NO: 1100437 - DNA, 23 bp, Homo sapiens
cacccctctgtctaggactgcag

SEQ ID NO: 1100438 - DNA, 13 bp, Homo sapiens
cacccctgcactt

SEQ ID NO: 1100439 - DNA, 19 bp, Homo sapiens
cacccctgccactcaccct

SEQ ID NO: 1100440 - DNA, 21 bp, Homo sapiens
cacccctgcccccacttcctg

SEQ ID NO: 1100441 - DNA, 18 bp, Homo sapiens
cacccctggaagagccca

SEQ ID NO: 1100442 - DNA, 20 bp, Homo sapiens
cacccctggaagagcccagt

SEQ ID NO: 1100443 - DNA, 14 bp, Homo sapiens
cacccctgggccag

SEQ ID NO: 1100444 - DNA, 12 bp, Homo sapiens
cacccctgtagg

SEQ ID NO: 1100445 - DNA, 20 bp, Homo sapiens
cacccctgtcccacccacac

SEQ ID NO: 1100446 - DNA, 23 bp, Homo sapiens
cacccctgtgctcccctgccaca

SEQ ID NO: 1100447 - DNA, 21 bp, Homo sapiens
cacccctgtgctccgtgcctc

SEQ ID NO: 1100448 - DNA, 23 bp, Homo sapiens
cacccctgtgctccgtgcctcca

SEQ ID NO: 1100449 - DNA, 16 bp, Homo sapiens
caccccttatccagga

SEQ ID NO: 1100450 - DNA, 15 bp, Homo sapiens
caccccttccatgtg

SEQ ID NO: 1100451 - DNA, 15 bp, Homo sapiens
caccccttccccact

SEQ ID NO: 1100452 - DNA, 18 bp, Homo sapiens
caccccttccccaggccc

SEQ ID NO: 1100453 - DNA, 19 bp, Homo sapiens
caccccttccccaggccca

SEQ ID NO: 1100454 - DNA, 11 bp, Homo sapiens
caccccttcct

SEQ ID NO: 1100455 - DNA, 12 bp, Homo sapiens
caccccttctct

SEQ ID NO: 1100456 - DNA, 18 bp, Homo sapiens
cacccctttcctccccat

SEQ ID NO: 1100457 - DNA, 15 bp, Homo sapiens
cacccctttctagtt

SEQ ID NO: 1100458 - DNA, 22 bp, Homo sapiens
cacccgaagtcctgtcactgag

SEQ ID NO: 1100459 - DNA, 14 bp, Homo sapiens
cacccgactcctca

SEQ ID NO: 1100460 - DNA, 17 bp, Homo sapiens
cacccgagttcctctgg

SEQ ID NO: 1100461 - DNA, 19 bp, Homo sapiens
cacccgagttcctctgggt

SEQ ID NO: 1100462 - DNA, 15 bp, Homo sapiens
cacccgatgctgctt

SEQ ID NO: 1100463 - DNA, 16 bp, Homo sapiens
cacccgatgctgcttt

SEQ ID NO: 1100464 - DNA, 18 bp, Homo sapiens
cacccgatgctgctttcc

SEQ ID NO: 1100465 - DNA, 19 bp, Homo sapiens
cacccgatgctgctttccc

SEQ ID NO: 1100466 - DNA, 16 bp, Homo sapiens
cacccgcccctggact

SEQ ID NO: 1100467 - DNA, 21 bp, Homo sapiens
cacccgccgcctcccacggca

SEQ ID NO: 1100468 - DNA, 22 bp, Homo sapiens
cacccgccgcctcccacggcac

SEQ ID NO: 1100469 - DNA, 17 bp, Homo sapiens
cacccgctgcccctccc

SEQ ID NO: 1100470 - DNA, 13 bp, Homo sapiens
cacccggacaggt

SEQ ID NO: 1100471 - DNA, 17 bp, Homo sapiens
cacccggccacagctgc

SEQ ID NO: 1100472 - DNA, 15 bp, Homo sapiens
cacccgggctgcctg

SEQ ID NO: 1100473 - DNA, 23 bp, Homo sapiens
cacccgggggagcccagtgaagc

SEQ ID NO: 1100474 - DNA, 18 bp, Homo sapiens
cacccgtaggcagcctct

SEQ ID NO: 1100475 - DNA, 22 bp, Homo sapiens
cacccgtaggcagcctctctgc

SEQ ID NO: 1100476 - DNA, 14 bp, Homo sapiens
cacccgtcctccct

SEQ ID NO: 1100477 - DNA, 15 bp, Homo sapiens
cacccgtctctctgc

SEQ ID NO: 1100478 - DNA, 20 bp, Homo sapiens
cacccgtctctctgcccact

SEQ ID NO: 1100479 - DNA, 21 bp, Homo sapiens
cacccgtcttcaatctctgtt

SEQ ID NO: 1100480 - DNA, 20 bp, Homo sapiens
cacccgtcttggggctcgcc

SEQ ID NO: 1100481 - DNA, 21 bp, Homo sapiens
cacccgtcttggggctcgccc

SEQ ID NO: 1100482 - DNA, 19 bp, Homo sapiens
cacccgttctgctggcctg

SEQ ID NO: 1100483 - DNA, 21 bp, Homo sapiens
caccctaccagctcctccagc

SEQ ID NO: 1100484 - DNA, 14 bp, Homo sapiens
caccctattcccta

SEQ ID NO: 1100485 - DNA, 15 bp, Homo sapiens
caccctcacacacac

SEQ ID NO: 1100486 - DNA, 18 bp, Homo sapiens
caccctcacacacacagc

SEQ ID NO: 1100487 - DNA, 22 bp, Homo sapiens
caccctcaccccctcctggcaa

SEQ ID NO: 1100488 - DNA, 21 bp, Homo sapiens
caccctcactggctctcctgg

SEQ ID NO: 1100489 - DNA, 12 bp, Homo sapiens
caccctcaggtg

SEQ ID NO: 1100490 - DNA, 18 bp, Homo sapiens
caccctcaggtgcctcca

SEQ ID NO: 1100491 - DNA, 19 bp, Homo sapiens
caccctcatttttccttta

SEQ ID NO: 1100492 - DNA, 17 bp, Homo sapiens
caccctccaccctgtcc

SEQ ID NO: 1100493 - DNA, 14 bp, Homo sapiens
caccctccacctct

SEQ ID NO: 1100494 - DNA, 17 bp, Homo sapiens
caccctccaccttccat

SEQ ID NO: 1100495 - DNA, 13 bp, Homo sapiens
caccctcccctct

SEQ ID NO: 1100496 - DNA, 17 bp, Homo sapiens
caccctcccctctcttg

SEQ ID NO: 1100497 - DNA, 19 bp, Homo sapiens
caccctcccctctcttgca

SEQ ID NO: 1100498 - DNA, 19 bp, Homo sapiens
cacctcggcacacactgtg

SEQ ID NO: 1100499 - DNA, 15 bp, Homo sapiens
cacctcggggacacc

SEQ ID NO: 1100500 - DNA, 20 bp, Homo sapiens
cacctcgtcaagagcatgca

SEQ ID NO: 1100501 - DNA, 18 bp, Homo sapiens
cacctcgtctccctggtg

SEQ ID NO: 1100502 - DNA, 16 bp, Homo sapiens
cacctctacccaaacc

SEQ ID NO: 1100503 - DNA, 22 bp, Homo sapiens
cacctctacccaaaccctaggt

SEQ ID NO: 1100504 - DNA, 14 bp, Homo sapiens
cacctctactgtct

SEQ ID NO: 1100505 - DNA, 21 bp, Homo sapiens
cacctctactgtctcctccct

SEQ ID NO: 1100506 - DNA, 22 bp, Homo sapiens
cacctctattcttgggaaacac

SEQ ID NO: 1100507 - DNA, 23 bp, Homo sapiens
cacctctcacgggccctgcccca

SEQ ID NO: 1100508 - DNA, 18 bp, Homo sapiens
cacctctccaagggcttc

SEQ ID NO: 1100509 - DNA, 17 bp, Homo sapiens
cacctctccctgcatcc

SEQ ID NO: 1100510 - DNA, 19 bp, Homo sapiens
cacctctcctactcactta

SEQ ID NO: 1100511 - DNA, 17 bp, Homo sapiens
cacctctcttttcctct

SEQ ID NO: 1100512 - DNA, 23 bp, Homo sapiens
cacctctcttttcctctctgtct

SEQ ID NO: 1100513 - DNA, 21 bp, Homo sapiens
cacctctgaggacagaggccg

SEQ ID NO: 1100514 - DNA, 19 bp, Homo sapiens
cacctctgatagactttgt

SEQ ID NO: 1100515 - DNA, 18 bp, Homo sapiens
cacctctgcacaagctgc

SEQ ID NO: 1100516 - DNA, 11 bp, Homo sapiens
cacctctgccc

SEQ ID NO: 1100517 - DNA, 12 bp, Homo sapiens
cacctctgccct

SEQ ID NO: 1100518 - DNA, 21 bp, Homo sapiens
cacctctgcccttcccctccc

SEQ ID NO: 1100519 - DNA, 13 bp, Homo sapiens
cacctctgcctca

SEQ ID NO: 1100520 - DNA, 14 bp, Homo sapiens
cacctctgcctcaa

SEQ ID NO: 1100521 - DNA, 19 bp, Homo sapiens
cacctctggactggctaga

SEQ ID NO: 1100522 - DNA, 13 bp, Homo sapiens
cacctctggccaa

SEQ ID NO: 1100523 - DNA, 18 bp, Homo sapiens
cacctctggccaaatatg

SEQ ID NO: 1100524 - DNA, 22 bp, Homo sapiens
cacctctggccaaatatgcact

SEQ ID NO: 1100525 - DNA, 14 bp, Homo sapiens
cacctctgggcttc

SEQ ID NO: 1100526 - DNA, 21 bp, Homo sapiens
cacctctgggtccttggctcc

SEQ ID NO: 1100527 - DNA, 17 bp, Homo sapiens
cacctcttcctctggtt

SEQ ID NO: 1100528 - DNA, 17 bp, Homo sapiens
cacctcttgtttctggg

SEQ ID NO: 1100529 - DNA, 20 bp, Homo sapiens
cacctctttaaaaactcact

SEQ ID NO: 1100530 - DNA, 16 bp, Homo sapiens
cacctctttgcccccg

SEQ ID NO: 1100531 - DNA, 17 bp, Homo sapiens
cacctgaaacactggac

SEQ ID NO: 1100532 - DNA, 17 bp, Homo sapiens
cacctgaaagcctgtct

SEQ ID NO: 1100533 - DNA, 19 bp, Homo sapiens
cacctgaaattaatttgtg

SEQ ID NO: 1100534 - DNA, 20 bp, Homo sapiens
cacctgacaatggcagctag

SEQ ID NO: 1100535 - DNA, 17 bp, Homo sapiens
cacctgacctgctgaat

SEQ ID NO: 1100536 - DNA, 15 bp, Homo sapiens
cacctgacttggctg

SEQ ID NO: 1100537 - DNA, 17 bp, Homo sapiens
cacctgacttggctggg

SEQ ID NO: 1100538 - DNA, 20 bp, Homo sapiens
cacctgacttggctggggag

SEQ ID NO: 1100539 - DNA, 17 bp, Homo sapiens
cacctgagaccctactg

SEQ ID NO: 1100540 - DNA, 18 bp, Homo sapiens
cacctgagaccctactga

SEQ ID NO: 1100541 - DNA, 20 bp, Homo sapiens
cacctgaggtgggcccagga

SEQ ID NO: 1100542 - DNA, 24 bp, Homo sapiens
cacctgaggtgggcccaggaccag

SEQ ID NO: 1100543 - DNA, 19 bp, Homo sapiens
cacctgagtcaccctacct

SEQ ID NO: 1100544 - DNA, 23 bp, Homo sapiens
cacctgagtcaccctacctgtgc

SEQ ID NO: 1100545 - DNA, 11 bp, Homo sapiens
cacctgcaaga

SEQ ID NO: 1100546 - DNA, 12 bp, Homo sapiens
cacctgcaagat

SEQ ID NO: 1100547 - DNA, 15 bp, Homo sapiens
cacctgcaagcccca

SEQ ID NO: 1100548 - DNA, 22 bp, Homo sapiens
cacctgcaagccccagggcctg

SEQ ID NO: 1100549 - DNA, 13 bp, Homo sapiens
cacctgcacctcc

SEQ ID NO: 1100550 - DNA, 15 bp, Homo sapiens
cacctgcacctcccc

SEQ ID NO: 1100551 - DNA, 17 bp, Homo sapiens
cacctgcacctcccccc

SEQ ID NO: 1100552 - DNA, 22 bp, Homo sapiens
cacctgcacctccccccactgc

SEQ ID NO: 1100553 - DNA, 15 bp, Homo sapiens
cacctgcactaacag

SEQ ID NO: 1100554 - DNA, 11 bp, Homo sapiens
cacctgcagga

SEQ ID NO: 1100555 - DNA, 15 bp, Homo sapiens
cacctgccccaactc

SEQ ID NO: 1100556 - DNA, 21 bp, Homo sapiens
cacctgcccccttctcccaca

SEQ ID NO: 1100557 - DNA, 15 bp, Homo sapiens
cacctgcccctctgt

SEQ ID NO: 1100558 - DNA, 18 bp, Homo sapiens
cacctgccgcatgctccc

SEQ ID NO: 1100559 - DNA, 13 bp, Homo sapiens
cacctgcctctga

SEQ ID NO: 1100560 - DNA, 17 bp, Homo sapiens
cacctgcctgccccaca

SEQ ID NO: 1100561 - DNA, 17 bp, Homo sapiens
cacctgccttggcctcc

SEQ ID NO: 1100562 - DNA, 15 bp, Homo sapiens
cacctgcgcacaggt

SEQ ID NO: 1100563 - DNA, 16 bp, Homo sapiens
cacctgcgcttctgct

SEQ ID NO: 1100564 - DNA, 13 bp, Homo sapiens
cacctgctcacag

SEQ ID NO: 1100565 - DNA, 13 bp, Homo sapiens
cacctgctccaga

SEQ ID NO: 1100566 - DNA, 23 bp, Homo sapiens
cacctgctgagaaaacatgcctc

SEQ ID NO: 1100567 - DNA, 19 bp, Homo sapiens
cacctgctgagagacccaa

SEQ ID NO: 1100568 - DNA, 14 bp, Homo sapiens
cacctgctgcgctt

SEQ ID NO: 1100569 - DNA, 14 bp, Homo sapiens
cacctgctgcgtcc

SEQ ID NO: 1100570 - DNA, 15 bp, Homo sapiens
cacctgctgcgtccc

SEQ ID NO: 1100571 - DNA, 20 bp, Homo sapiens
cacctgctgcgtccccactc

SEQ ID NO: 1100572 - DNA, 22 bp, Homo sapiens
cacctgctggaaaccacacttc

SEQ ID NO: 1100573 - DNA, 13 bp, Homo sapiens
cacctgctggccc

SEQ ID NO: 1100574 - DNA, 14 bp, Homo sapiens
cacctgctggcccc

SEQ ID NO: 1100575 - DNA, 18 bp, Homo sapiens
cacctggacacacactca

SEQ ID NO: 1100576 - DNA, 19 bp, Homo sapiens
cacctggacacacactcac

SEQ ID NO: 1100577 - DNA, 16 bp, Homo sapiens
cacctggactgagcca

SEQ ID NO: 1100578 - DNA, 23 bp, Homo sapiens
cacctggactgagccaaggaggc

SEQ ID NO: 1100579 - DNA, 14 bp, Homo sapiens
cacctggagactgt

SEQ ID NO: 1100580 - DNA, 19 bp, Homo sapiens
cacctggcagggctcacac

SEQ ID NO: 1100581 - DNA, 23 bp, Homo sapiens
cacctggcatcgcaccattctga

SEQ ID NO: 1100582 - DNA, 22 bp, Homo sapiens
cacctggcatggtgcagggaga

SEQ ID NO: 1100583 - DNA, 14 bp, Homo sapiens
cacctggccacctg

SEQ ID NO: 1100584 - DNA, 15 bp, Homo sapiens
cacctggccacctga

SEQ ID NO: 1100585 - DNA, 19 bp, Homo sapiens
cacctggccacctgaggtg

SEQ ID NO: 1100586 - DNA, 20 bp, Homo sapiens
cacctggccacctgaggtgg

SEQ ID NO: 1100587 - DNA, 11 bp, Homo sapiens
cacctggcccc

SEQ ID NO: 1100588 - DNA, 20 bp, Homo sapiens
cacctggccccatgtctctc

SEQ ID NO: 1100589 - DNA, 13 bp, Homo sapiens
cacctggccctgc

SEQ ID NO: 1100590 - DNA, 16 bp, Homo sapiens
cacctggccctgcttc

SEQ ID NO: 1100591 - DNA, 14 bp, Homo sapiens
cacctggcctgctg

SEQ ID NO: 1100592 - DNA, 18 bp, Homo sapiens
cacctggcctgctgggaa

SEQ ID NO: 1100593 - DNA, 19 bp, Homo sapiens
cacctggcctgctgggaac

SEQ ID NO: 1100594 - DNA, 13 bp, Homo sapiens
cacctggccttaa

SEQ ID NO: 1100595 - DNA, 21 bp, Homo sapiens
cacctgggagaaggtctccaa

SEQ ID NO: 1100596 - DNA, 19 bp, Homo sapiens
cacctgggcacctggggag

SEQ ID NO: 1100597 - DNA, 15 bp, Homo sapiens
cacctgggcagctcc

SEQ ID NO: 1100598 - DNA, 17 bp, Homo sapiens
cacctgggccccactgg

SEQ ID NO: 1100599 - DNA, 16 bp, Homo sapiens
cacctgggctgggcgc

SEQ ID NO: 1100600 - DNA, 14 bp, Homo sapiens
cacctggggtctct

SEQ ID NO: 1100601 - DNA, 18 bp, Homo sapiens
cacctggggtctctctcc

SEQ ID NO: 1100602 - DNA, 12 bp, Homo sapiens
cacctgtacatt

SEQ ID NO: 1100603 - DNA, 14 bp, Homo sapiens
cacctgtacattct

SEQ ID NO: 1100604 - DNA, 23 bp, Homo sapiens
cacctgtactcaggaggctgagg

SEQ ID NO: 1100605 - DNA, 18 bp, Homo sapiens
cacctgtagcacttactg

SEQ ID NO: 1100606 - DNA, 22 bp, Homo sapiens
cacctgtagcacttactggtag

SEQ ID NO: 1100607 - DNA, 15 bp, Homo sapiens
cacctgtagcagcca

SEQ ID NO: 1100608 - DNA, 11 bp, Homo sapiens
cacctgtagct

SEQ ID NO: 1100609 - DNA, 13 bp, Homo sapiens
cacctgtagtccc

SEQ ID NO: 1100610 - DNA, 20 bp, Homo sapiens
cacctgtccggcccagtgcc

SEQ ID NO: 1100611 - DNA, 13 bp, Homo sapiens
cacctgtgctgct

SEQ ID NO: 1100612 - DNA, 16 bp, Homo sapiens
cacctgtgctgctgca

SEQ ID NO: 1100613 - DNA, 20 bp, Homo sapiens
cacctgtgggtgtagccagg

SEQ ID NO: 1100614 - DNA, 15 bp, Homo sapiens
cacctgttaaaatgt

SEQ ID NO: 1100615 - DNA, 20 bp, Homo sapiens
cacctgttaaaatgtacact

SEQ ID NO: 1100616 - DNA, 22 bp, Homo sapiens
cacctgttaaaatgtacactgg

SEQ ID NO: 1100617 - DNA, 16 bp, Homo sapiens
cacctgttatgtatga

SEQ ID NO: 1100618 - DNA, 14 bp, Homo sapiens
cacctgttttctga

SEQ ID NO: 1100619 - DNA, 19 bp, Homo sapiens
cacctgtttttaagctgtt

SEQ ID NO: 1100620 - DNA, 22 bp, Homo sapiens
cacgtggcatgtggcctgtggc

SEQ ID NO: 1100621 - DNA, 12 bp, Homo sapiens
cacgtggcctct

SEQ ID NO: 1100622 - DNA, 17 bp, Homo sapiens
cacgtggcctctctctc

SEQ ID NO: 1100623 - DNA, 16 bp, Homo sapiens
cacgtgggctcccctc

SEQ ID NO: 1100624 - DNA, 19 bp, Homo sapiens
cacgtgggctcccctcttc

SEQ ID NO: 1100625 - DNA, 13 bp, Homo sapiens
cacgtggggccca

SEQ ID NO: 1100626 - DNA, 19 bp, Homo sapiens
cacgtgtatagtatctgta

SEQ ID NO: 1100627 - DNA, 14 bp, Homo sapiens
cacgtgtcttccac

SEQ ID NO: 1100628 - DNA, 19 bp, Homo sapiens
cacgtgtgggccgtggctt

SEQ ID NO: 1100629 - DNA, 12 bp, Homo sapiens
cacgtgtgtatg

SEQ ID NO: 1100630 - DNA, 19 bp, Homo sapiens
cacgttagaggaaaaatat

SEQ ID NO: 1100631 - DNA, 16 bp, Homo sapiens
cacgttcagggagggg

SEQ ID NO: 1100632 - DNA, 19 bp, Homo sapiens
cacgttccttactgcagaa

SEQ ID NO: 1100633 - DNA, 18 bp, Homo sapiens
cacgttctcacacccacc

SEQ ID NO: 1100634 - DNA, 19 bp, Homo sapiens
cacgttctcacacccaccg

SEQ ID NO: 1100635 - DNA, 22 bp, Homo sapiens
cacgttgacagtacctagctgt

SEQ ID NO: 1100636 - DNA, 19 bp, Homo sapiens
cactaaaacaagaggacac

SEQ ID NO: 1100637 - DNA, 15 bp, Homo sapiens
cactaaaattttagg

SEQ ID NO: 1100638 - DNA, 17 bp, Homo sapiens
cactaaaccacttctct

SEQ ID NO: 1100639 - DNA, 24 bp, Homo sapiens
cactaaaccacttctctgctgcct

SEQ ID NO: 1100640 - DNA, 14 bp, Homo sapiens
cactaaactttatt

SEQ ID NO: 1100641 - DNA, 12 bp, Homo sapiens
cactaaagcagt

SEQ ID NO: 1100642 - DNA, 16 bp, Homo sapiens
cactaaagccagcctg

SEQ ID NO: 1100643 - DNA, 17 bp, Homo sapiens
cactaaagccagcctga

SEQ ID NO: 1100644 - DNA, 13 bp, Homo sapiens
cactaaagcttca

SEQ ID NO: 1100645 - DNA, 15 bp, Homo sapiens
cactaaatcagagac

SEQ ID NO: 1100646 - DNA, 20 bp, Homo sapiens
cactaaatctccaagacctg

SEQ ID NO: 1100647 - DNA, 21 bp, Homo sapiens
cactaaatctccaagacctgg

SEQ ID NO: 1100648 - DNA, 12 bp, Homo sapiens
cactaaatgctg

SEQ ID NO: 1100649 - DNA, 13 bp, Homo sapiens
cactaaatgtaaa

SEQ ID NO: 1100650 - DNA, 14 bp, Homo sapiens
cactaacagagtgg

SEQ ID NO: 1100651 - DNA, 14 bp, Homo sapiens
cactaacagggaga

SEQ ID NO: 1100652 - DNA, 15 bp, Homo sapiens
cactaaccaaaaact

SEQ ID NO: 1100653 - DNA, 17 bp, Homo sapiens
cactaaccaatgccttt

SEQ ID NO: 1100654 - DNA, 14 bp, Homo sapiens
cactaaccttgcct

SEQ ID NO: 1100655 - DNA, 16 bp, Homo sapiens
cactaacgaaatatca

SEQ ID NO: 1100656 - DNA, 19 bp, Homo sapiens
cactaactcaccagcccca

SEQ ID NO: 1100657 - DNA, 17 bp, Homo sapiens
cactaagaaaatagcaa

SEQ ID NO: 1100658 - DNA, 15 bp, Homo sapiens
cactaagagggcaga

SEQ ID NO: 1100659 - DNA, 15 bp, Homo sapiens
cactaagcagaggag

SEQ ID NO: 1100660 - DNA, 15 bp, Homo sapiens
cactaaggacttaaa

SEQ ID NO: 1100661 - DNA, 21 bp, Homo sapiens
cactaaggccgtgtctctgag

SEQ ID NO: 1100662 - DNA, 12 bp, Homo sapiens
cactaaggctgc

SEQ ID NO: 1100663 - DNA, 13 bp, Homo sapiens
cactaaggggccc

SEQ ID NO: 1100664 - DNA, 23 bp, Homo sapiens
cactaaggggcccggccagccat

SEQ ID NO: 1100665 - DNA, 14 bp, Homo sapiens
cactaagttatagt

SEQ ID NO: 1100666 - DNA, 17 bp, Homo sapiens
cactaagttatagtata

SEQ ID NO: 1100667 - DNA, 18 bp, Homo sapiens
cactaatatatggaccta

SEQ ID NO: 1100668 - DNA, 16 bp, Homo sapiens
cactaatatatttaaa

SEQ ID NO: 1100669 - DNA, 19 bp, Homo sapiens
cactaatccattatccttt

SEQ ID NO: 1100670 - DNA, 16 bp, Homo sapiens
cactaatctgaaagga

SEQ ID NO: 1100671 - DNA, 11 bp, Homo sapiens
cactaattcat

SEQ ID NO: 1100672 - DNA, 17 bp, Homo sapiens
cactaatttcttcttta

SEQ ID NO: 1100673 - DNA, 15 bp, Homo sapiens
cactaatttttgtat

SEQ ID NO: 1100674 - DNA, 18 bp, Homo sapiens
cactaatttttgtattat

SEQ ID NO: 1100675 - DNA, 12 bp, Homo sapiens
cactacacccag

SEQ ID NO: 1100676 - DNA, 21 bp, Homo sapiens
cactacacccagcaatagaga

SEQ ID NO: 1100677 - DNA, 19 bp, Homo sapiens
cactacactccagcctgag

SEQ ID NO: 1100678 - DNA, 22 bp, Homo sapiens
cactacaggtgaaggctctcac

SEQ ID NO: 1100679 - DNA, 19 bp, Homo sapiens
cactacatgtggtttatag

SEQ ID NO: 1100680 - DNA, 21 bp, Homo sapiens
cactaccacgccaagctaatt

SEQ ID NO: 1100681 - DNA, 18 bp, Homo sapiens
cactaccagccagcctca

SEQ ID NO: 1100682 - DNA, 22 bp, Homo sapiens
cactacccatcggtgtccattt

SEQ ID NO: 1100683 - DNA, 14 bp, Homo sapiens
cactaccctgattc

SEQ ID NO: 1100684 - DNA, 18 bp, Homo sapiens
cactaccctgattcttga

SEQ ID NO: 1100685 - DNA, 15 bp, Homo sapiens
cactaccgtggacca

SEQ ID NO: 1100686 - DNA, 20 bp, Homo sapiens
cactaccgtggaccacctag

SEQ ID NO: 1100687 - DNA, 15 bp, Homo sapiens
cactactcctctgca

SEQ ID NO: 1100688 - DNA, 15 bp, Homo sapiens
cactactgacatgtg

SEQ ID NO: 1100689 - DNA, 17 bp, Homo sapiens
cactactgcagcacctc

SEQ ID NO: 1100690 - DNA, 21 bp, Homo sapiens
cactactgctaccacaactat

SEQ ID NO: 1100691 - DNA, 14 bp, Homo sapiens
cactactgggtgtc

SEQ ID NO: 1100692 - DNA, 16 bp, Homo sapiens
cactactgggtgtcat

SEQ ID NO: 1100693 - DNA, 15 bp, Homo sapiens
cactagaactctcca

SEQ ID NO: 1100694 - DNA, 20 bp, Homo sapiens
cactagaagaaaagcccatt

SEQ ID NO: 1100695 - DNA, 16 bp, Homo sapiens
cactagaattcatgtg

SEQ ID NO: 1100696 - DNA, 17 bp, Homo sapiens
cactagaattcatgtga

SEQ ID NO: 1100697 - DNA, 16 bp, Homo sapiens
cactagacccactgga

SEQ ID NO: 1100698 - DNA, 18 bp, Homo sapiens
cactagagacaaatcttt

SEQ ID NO: 1100699 - DNA, 14 bp, Homo sapiens
cactagagggccca

SEQ ID NO: 1100700 - DNA, 18 bp, Homo sapiens
cactagagggcccatcag

SEQ ID NO: 1100701 - DNA, 16 bp, Homo sapiens
cactagcctctccagg

SEQ ID NO: 1100702 - DNA, 16 bp, Homo sapiens
cactaggaaacgtgtt

SEQ ID NO: 1100703 - DNA, 16 bp, Homo sapiens
cactaggactctgagg

SEQ ID NO: 1100704 - DNA, 19 bp, Homo sapiens
cactagggactatcaggta

SEQ ID NO: 1100705 - DNA, 16 bp, Homo sapiens
cactagggctgagggg

SEQ ID NO: 1100706 - DNA, 21 bp, Homo sapiens
cactaggggatataggagagg

SEQ ID NO: 1100707 - DNA, 16 bp, Homo sapiens
cactaggtgtccccaa

SEQ ID NO: 1100708 - DNA, 22 bp, Homo sapiens
cactaggtgtccccaacgtccc

SEQ ID NO: 1100709 - DNA, 16 bp, Homo sapiens
cactagtcaccgacag

SEQ ID NO: 1100710 - DNA, 21 bp, Homo sapiens
cactagtcaccgacagcggcc

SEQ ID NO: 1100711 - DNA, 12 bp, Homo sapiens
cactagtctgtg

SEQ ID NO: 1100712 - DNA, 16 bp, Homo sapiens
cactagtgcaaatcat

SEQ ID NO: 1100713 - DNA, 21 bp, Homo sapiens
cactagtgcaattccaagaaa

SEQ ID NO: 1100714 - DNA, 12 bp, Homo sapiens
cactagtgccaa

SEQ ID NO: 1100715 - DNA, 13 bp, Homo sapiens
cactagtgccaat

SEQ ID NO: 1100716 - DNA, 14 bp, Homo sapiens
cactataatgtaag

SEQ ID NO: 1100717 - DNA, 17 bp, Homo sapiens
cactataatgtgaaatg

SEQ ID NO: 1100718 - DNA, 14 bp, Homo sapiens
cactatataaataa

SEQ ID NO: 1100719 - DNA, 12 bp, Homo sapiens
cactatatcttc

SEQ ID NO: 1100720 - DNA, 19 bp, Homo sapiens
cactatatttgtatatatt

SEQ ID NO: 1100721 - DNA, 21 bp, Homo sapiens
cactatcccaatcaaagaatt

SEQ ID NO: 1100722 - DNA, 11 bp, Homo sapiens
cactatctggg

SEQ ID NO: 1100723 - DNA, 17 bp, Homo sapiens
cactatctgggtgcatg

SEQ ID NO: 1100724 - DNA, 21 bp, Homo sapiens
cactatgataaagttgtaaat

SEQ ID NO: 1100725 - DNA, 14 bp, Homo sapiens
cactatgcatttta

SEQ ID NO: 1100726 - DNA, 19 bp, Homo sapiens
cactatggtatgctggcca

SEQ ID NO: 1100727 - DNA, 18 bp, Homo sapiens
cactattcttaagcactt

SEQ ID NO: 1100728 - DNA, 14 bp, Homo sapiens
cactattgaaaaat

SEQ ID NO: 1100729 - DNA, 15 bp, Homo sapiens
cactattttatattt

SEQ ID NO: 1100730 - DNA, 18 bp, Homo sapiens
cactattttatatttaaa

SEQ ID NO: 1100731 - DNA, 14 bp, Homo sapiens
cactattttcaaag

SEQ ID NO: 1100732 - DNA, 21 bp, Homo sapiens
cactattttcactagggctga

SEQ ID NO: 1100733 - DNA, 19 bp, Homo sapiens
cactcaaattaatctttct

SEQ ID NO: 1100734 - DNA, 16 bp, Homo sapiens
cactcaactctgagcc

SEQ ID NO: 1100735 - DNA, 19 bp, Homo sapiens
cactcaactctgagcccat

SEQ ID NO: 1100736 - DNA, 13 bp, Homo sapiens
cactcaagcttgg

SEQ ID NO: 1100737 - DNA, 19 bp, Homo sapiens
cactcaaggacaggagcct

SEQ ID NO: 1100738 - DNA, 22 bp, Homo sapiens
cactcaaggacaggagcctggt

SEQ ID NO: 1100739 - DNA, 24 bp, Homo sapiens
cactcaaggacaggagcctggtcc

SEQ ID NO: 1100740 - DNA, 13 bp, Homo sapiens
cactcacacagga

SEQ ID NO: 1100741 - DNA, 21 bp, Homo sapiens
cactcaccacaagctgagcag

SEQ ID NO: 1100742 - DNA, 22 bp, Homo sapiens
cactcaccagccctagctgtcc

SEQ ID NO: 1100743 - DNA, 14 bp, Homo sapiens
cactgagagggcaa

SEQ ID NO: 1100744 - DNA, 22 bp, Homo sapiens
cactgagattgacctgaggaga

SEQ ID NO: 1100745 - DNA, 16 bp, Homo sapiens
cactgagcacagtcag

SEQ ID NO: 1100746 - DNA, 12 bp, Homo sapiens
cactgagcaggg

SEQ ID NO: 1100747 - DNA, 11 bp, Homo sapiens
cactgagccat

SEQ ID NO: 1100748 - DNA, 21 bp, Homo sapiens
cactgagccatcatttcctgg

SEQ ID NO: 1100749 - DNA, 13 bp, Homo sapiens
cactgagcccccc

SEQ ID NO: 1100750 - DNA, 14 bp, Homo sapiens
cactgagccccccc

SEQ ID NO: 1100751 - DNA, 19 bp, Homo sapiens
cactgagctccccagatct

SEQ ID NO: 1100752 - DNA, 13 bp, Homo sapiens
cactgaggactgt

SEQ ID NO: 1100753 - DNA, 17 bp, Homo sapiens
cactgaggccatcaggg

SEQ ID NO: 1100754 - DNA, 21 bp, Homo sapiens
cactgaggccatcagggccct

SEQ ID NO: 1100755 - DNA, 19 bp, Homo sapiens
cactgaggcttaggcctct

SEQ ID NO: 1100756 - DNA, 13 bp, Homo sapiens
cactgagggccac

SEQ ID NO: 1100757 - DNA, 17 bp, Homo sapiens
cactgatacataaaaat

SEQ ID NO: 1100758 - DNA, 17 bp, Homo sapiens
cactgatatcatgggga

SEQ ID NO: 1100759 - DNA, 19 bp, Homo sapiens
cactgatattttacctctt

SEQ ID NO: 1100760 - DNA, 22 bp, Homo sapiens
cactgatattttacctcttatt

SEQ ID NO: 1100761 - DNA, 13 bp, Homo sapiens
cactgatcaccca

SEQ ID NO: 1100762 - DNA, 23 bp, Homo sapiens
cactgatgagtttcactgtactg

SEQ ID NO: 1100763 - DNA, 16 bp, Homo sapiens
cactgatgcttagatg

SEQ ID NO: 1100764 - DNA, 14 bp, Homo sapiens
cactgatggctcaa

SEQ ID NO: 1100765 - DNA, 17 bp, Homo sapiens
cactgatgggctggggc

SEQ ID NO: 1100766 - DNA, 19 bp, Homo sapiens
cactgatgggctggggcag

SEQ ID NO: 1100767 - DNA, 21 bp, Homo sapiens
cactgatgggctggggcaggg

SEQ ID NO: 1100768 - DNA, 13 bp, Homo sapiens
cactgatttcaca

SEQ ID NO: 1100769 - DNA, 18 bp, Homo sapiens
cactgatttcacaacaga

SEQ ID NO: 1100770 - DNA, 14 bp, Homo sapiens
cactgatttggaga

SEQ ID NO: 1100771 - DNA, 14 bp, Homo sapiens
cactgcaacctccg

SEQ ID NO: 1100772 - DNA, 18 bp, Homo sapiens
cactgcaacctccgcctc

SEQ ID NO: 1100773 - DNA, 13 bp, Homo sapiens
cactgcaagagcc

SEQ ID NO: 1100774 - DNA, 19 bp, Homo sapiens
cactgcaagagccttggtg

SEQ ID NO: 1100775 - DNA, 19 bp, Homo sapiens
cactgcaatcctgtctttc

SEQ ID NO: 1100776 - DNA, 12 bp, Homo sapiens
cactgcacagaa

SEQ ID NO: 1100777 - DNA, 21 bp, Homo sapiens
cactgcacagtgcatctcagc

SEQ ID NO: 1100778 - DNA, 22 bp, Homo sapiens
cactgcacagtgcatctcagcc

SEQ ID NO: 1100779 - DNA, 13 bp, Homo sapiens
cactgcacatctt

SEQ ID NO: 1100780 - DNA, 16 bp, Homo sapiens
cactgcactccagctt

SEQ ID NO: 1100781 - DNA, 14 bp, Homo sapiens
cactgcacttcagt

SEQ ID NO: 1100782 - DNA, 20 bp, Homo sapiens
cactgcactttgtttagaaa

SEQ ID NO: 1100783 - DNA, 13 bp, Homo sapiens
cactgcagacttg

SEQ ID NO: 1100784 - DNA, 12 bp, Homo sapiens
cactgcagaggg

SEQ ID NO: 1100785 - DNA, 18 bp, Homo sapiens
cactgcagtctgcagagt

SEQ ID NO: 1100786 - DNA, 24 bp, Homo sapiens
cactgcagtctgcagagttctcct

SEQ ID NO: 1100787 - DNA, 19 bp, Homo sapiens
cactgcatggctcccacag

SEQ ID NO: 1100788 - DNA, 18 bp, Homo sapiens
cactgccaagcttcctgt

SEQ ID NO: 1100789 - DNA, 19 bp, Homo sapiens
cactgccaagcttcctgtg

SEQ ID NO: 1100790 - DNA, 22 bp, Homo sapiens
cactgccaagcttcctgtgccc

SEQ ID NO: 1100791 - DNA, 14 bp, Homo sapiens
cactgccagaagag

SEQ ID NO: 1100792 - DNA, 22 bp, Homo sapiens
cactgccagaagagaattcagt

SEQ ID NO: 1100793 - DNA, 19 bp, Homo sapiens
cactgccagcagcagcagg

SEQ ID NO: 1100794 - DNA, 21 bp, Homo sapiens
cactgccagcagcagcaggtg

SEQ ID NO: 1100795 - DNA, 11 bp, Homo sapiens
cactgccaggc

SEQ ID NO: 1100796 - DNA, 22 bp, Homo sapiens
cactgccaggcacctggcctgc

SEQ ID NO: 1100797 - DNA, 23 bp, Homo sapiens
cactgccaggcacctggcctgct

SEQ ID NO: 1100798 - DNA, 13 bp, Homo sapiens
cactgccaggcca

SEQ ID NO: 1100799 - DNA, 14 bp, Homo sapiens
cactgccaggccag

SEQ ID NO: 1100800 - DNA, 21 bp, Homo sapiens
cactgccatcggacaggagga

SEQ ID NO: 1100801 - DNA, 22 bp, Homo sapiens
cactgccatcggacaggaggat

SEQ ID NO: 1100802 - DNA, 16 bp, Homo sapiens
cactgccatcttagtt

SEQ ID NO: 1100803 - DNA, 21 bp, Homo sapiens
cactgccatgatagctggggc

SEQ ID NO: 1100804 - DNA, 22 bp, Homo sapiens
cactgccatgcaccaggactgg

SEQ ID NO: 1100805 - DNA, 17 bp, Homo sapiens
cactgccatgccagctt

SEQ ID NO: 1100806 - DNA, 16 bp, Homo sapiens
cactgcccaccaaagg

SEQ ID NO: 1100807 - DNA, 15 bp, Homo sapiens
cactgcccaccccct

SEQ ID NO: 1100808 - DNA, 16 bp, Homo sapiens
cactgcccaccccctc

SEQ ID NO: 1100809 - DNA, 17 bp, Homo sapiens
cactgcccaccccctca

SEQ ID NO: 1100810 - DNA, 14 bp, Homo sapiens
cactgccccccgag

SEQ ID NO: 1100811 - DNA, 20 bp, Homo sapiens
cactgccccccgaggctgct

SEQ ID NO: 1100812 - DNA, 20 bp, Homo sapiens
cactgccccctgctgccatg

SEQ ID NO: 1100813 - DNA, 17 bp, Homo sapiens
cactgccccctgcttgg

SEQ ID NO: 1100814 - DNA, 21 bp, Homo sapiens
cactgccccgtgtgaatgtag

SEQ ID NO: 1100815 - DNA, 16 bp, Homo sapiens
cactgcccgagctggt

SEQ ID NO: 1100816 - DNA, 15 bp, Homo sapiens
cactgccctgcctgc

SEQ ID NO: 1100817 - DNA, 17 bp, Homo sapiens
cactgccctgcctgccc

SEQ ID NO: 1100818 - DNA, 14 bp, Homo sapiens
cactgccctggcag

SEQ ID NO: 1100819 - DNA, 15 bp, Homo sapiens
cactgccgcctactg

SEQ ID NO: 1100820 - DNA, 12 bp, Homo sapiens
cactgccgctgc

SEQ ID NO: 1100821 - DNA, 22 bp, Homo sapiens
cactgcctaggaggctggccaa

SEQ ID NO: 1100822 - DNA, 18 bp, Homo sapiens
cactgcctcctgcctggg

SEQ ID NO: 1100823 - DNA, 19 bp, Homo sapiens
cactgcctctatgccctgc

SEQ ID NO: 1100824 - DNA, 21 bp, Homo sapiens
cactgcctctatgccctgcag

SEQ ID NO: 1100825 - DNA, 15 bp, Homo sapiens
cactgcctctggaat

SEQ ID NO: 1100826 - DNA, 10 bp, Homo sapiens
cactgcctga

SEQ ID NO: 1100827 - DNA, 22 bp, Homo sapiens
cactgcctgcagaggtctgtgc

SEQ ID NO: 1100828 - DNA, 21 bp, Homo sapiens
cactgccttcgcttcttgcct

SEQ ID NO: 1100829 - DNA, 23 bp, Homo sapiens
cactgccttcgcttcttgcctct

SEQ ID NO: 1100830 - DNA, 15 bp, Homo sapiens
cactgccttggcccc

SEQ ID NO: 1100831 - DNA, 22 bp, Homo sapiens
cactgcgaagaccctcttgccc

SEQ ID NO: 1100832 - DNA, 17 bp, Homo sapiens
cactgcgatcaggaaga

SEQ ID NO: 1100833 - DNA, 12 bp, Homo sapiens
cactgcgccccg

SEQ ID NO: 1100834 - DNA, 19 bp, Homo sapiens
cactgctaaggctgctggc

SEQ ID NO: 1100835 - DNA, 22 bp, Homo sapiens
cactgctaggcgagtgccagga

SEQ ID NO: 1100836 - DNA, 16 bp, Homo sapiens
cactgctaggtgggcc

SEQ ID NO: 1100837 - DNA, 23 bp, Homo sapiens
cactgctaggtgggccagcccct

SEQ ID NO: 1100838 - DNA, 18 bp, Homo sapiens
cactgctccaagggacag

SEQ ID NO: 1100839 - DNA, 19 bp, Homo sapiens
cactgctccaagggacagg

SEQ ID NO: 1100840 - DNA, 11 bp, Homo sapiens
cactgctccct

SEQ ID NO: 1100841 - DNA, 12 bp, Homo sapiens
cactgctcccta

SEQ ID NO: 1100842 - DNA, 23 bp, Homo sapiens
cactgctccctaagccagcctgg

SEQ ID NO: 1100843 - DNA, 13 bp, Homo sapiens
cactgctccttgc

SEQ ID NO: 1100844 - DNA, 14 bp, Homo sapiens
cactgctccttgct

SEQ ID NO: 1100845 - DNA, 20 bp, Homo sapiens
cactgctcgtggactgtgct

SEQ ID NO: 1100846 - DNA, 18 bp, Homo sapiens
cactgctctaacagccct

SEQ ID NO: 1100847 - DNA, 17 bp, Homo sapiens
cactgctcttaagaaac

SEQ ID NO: 1100848 - DNA, 12 bp, Homo sapiens
cactgctgagct

SEQ ID NO: 1100849 - DNA, 14 bp, Homo sapiens
cactgctgagctgg

SEQ ID NO: 1100850 - DNA, 15 bp, Homo sapiens
cactgctgagctggc

SEQ ID NO: 1100851 - DNA, 17 bp, Homo sapiens
cactgctgagctggccc

SEQ ID NO: 1100852 - DNA, 16 bp, Homo sapiens
cactgctgaggagtct

SEQ ID NO: 1100853 - DNA, 19 bp, Homo sapiens
cactgctgaggagtctgag

SEQ ID NO: 1100854 - DNA, 18 bp, Homo sapiens
cactgctgatcgtagaaa

SEQ ID NO: 1100855 - DNA, 15 bp, Homo sapiens
cactgctgcaaggtg

SEQ ID NO: 1100856 - DNA, 14 bp, Homo sapiens
cactgctgcaccag

SEQ ID NO: 1100857 - DNA, 15 bp, Homo sapiens
cactgctgcaccaga

SEQ ID NO: 1100858 - DNA, 16 bp, Homo sapiens
cactgctgcaccagag

SEQ ID NO: 1100859 - DNA, 20 bp, Homo sapiens
cactgctgcaccagagtgaa

SEQ ID NO: 1100860 - DNA, 13 bp, Homo sapiens
cactgctgcattc

SEQ ID NO: 1100861 - DNA, 13 bp, Homo sapiens
cactgctgctcct

SEQ ID NO: 1100862 - DNA, 21 bp, Homo sapiens
cactgctgctcctctttcccc

SEQ ID NO: 1100863 - DNA, 13 bp, Homo sapiens
cactgctggacat

SEQ ID NO: 1100864 - DNA, 13 bp, Homo sapiens
cactgctggctgc

SEQ ID NO: 1100865 - DNA, 20 bp, Homo sapiens
cacttatttattgttgcctt

SEQ ID NO: 1100866 - DNA, 21 bp, Homo sapiens
cacttatttattgttgccttt

SEQ ID NO: 1100867 - DNA, 14 bp, Homo sapiens
cacttatttcataa

SEQ ID NO: 1100868 - DNA, 17 bp, Homo sapiens
cacttatttcataaaca

SEQ ID NO: 1100869 - DNA, 17 bp, Homo sapiens
cacttcaatcctcaaat

SEQ ID NO: 1100870 - DNA, 16 bp, Homo sapiens
cacttcacccccaact

SEQ ID NO: 1100871 - DNA, 18 bp, Homo sapiens
cacttcacccccaacttc

SEQ ID NO: 1100872 - DNA, 18 bp, Homo sapiens
cacttcactccagcctgg

SEQ ID NO: 1100873 - DNA, 13 bp, Homo sapiens
cacttcactgtga

SEQ ID NO: 1100874 - DNA, 16 bp, Homo sapiens
cacttcagaattccat

SEQ ID NO: 1100875 - DNA, 13 bp, Homo sapiens
cacttcagagagc

SEQ ID NO: 1100876 - DNA, 18 bp, Homo sapiens
cacttcagagagctggta

SEQ ID NO: 1100877 - DNA, 16 bp, Homo sapiens
cacttcaggctcttct

SEQ ID NO: 1100878 - DNA, 19 bp, Homo sapiens
cacttcagggctttactcc

SEQ ID NO: 1100879 - DNA, 13 bp, Homo sapiens
cacttcaggtccg

SEQ ID NO: 1100880 - DNA, 22 bp, Homo sapiens
cacttccagatatccacataaa

SEQ ID NO: 1100881 - DNA, 17 bp, Homo sapiens
cacttccaggggaacct

SEQ ID NO: 1100882 - DNA, 20 bp, Homo sapiens
cacttccaggggaacctgcc

SEQ ID NO: 1100883 - DNA, 14 bp, Homo sapiens
cacttccagtctgg

SEQ ID NO: 1100884 - DNA, 12 bp, Homo sapiens
cacttccagtgt

SEQ ID NO: 1100885 - DNA, 23 bp, Homo sapiens
cacttccagtgttggctgtgtga

SEQ ID NO: 1100886 - DNA, 20 bp, Homo sapiens
cacttccataatctggactc

SEQ ID NO: 1100887 - DNA, 18 bp, Homo sapiens
cacttcccacccccaggc

SEQ ID NO: 1100888 - DNA, 20 bp, Homo sapiens
cacttcccatctccagggaa

SEQ ID NO: 1100889 - DNA, 19 bp, Homo sapiens
cacttccccttgtctccct

SEQ ID NO: 1100890 - DNA, 20 bp, Homo sapiens
cacttccccttgtctccctg

SEQ ID NO: 1100891 - DNA, 17 bp, Homo sapiens
cacttcccgtctcagaa

SEQ ID NO: 1100892 - DNA, 16 bp, Homo sapiens
cacttccctacatgga

SEQ ID NO: 1100893 - DNA, 15 bp, Homo sapiens
cacttccctctgttt

SEQ ID NO: 1100894 - DNA, 11 bp, Homo sapiens
cacttccctgg

SEQ ID NO: 1100895 - DNA, 12 bp, Homo sapiens
cacttccctggc

SEQ ID NO: 1100896 - DNA, 13 bp, Homo sapiens
cacttcctccaca

SEQ ID NO: 1100897 - DNA, 15 bp, Homo sapiens
cacttcctccacagt

SEQ ID NO: 1100898 - DNA, 12 bp, Homo sapiens
cacttcctccta

SEQ ID NO: 1100899 - DNA, 17 bp, Homo sapiens
cacttcctcctacctgg

SEQ ID NO: 1100900 - DNA, 12 bp, Homo sapiens
cacttcctgtcc

SEQ ID NO: 1100901 - DNA, 12 bp, Homo sapiens
cacttcctttag

SEQ ID NO: 1100902 - DNA, 23 bp, Homo sapiens
cacttcgggaggtcgaggcagga

SEQ ID NO: 1100903 - DNA, 23 bp, Homo sapiens
cacttcgggctgtgtaaacacag

SEQ ID NO: 1100904 - DNA, 19 bp, Homo sapiens
cacttcgttcgcagagctt

SEQ ID NO: 1100905 - DNA, 20 bp, Homo sapiens
cacttcgttcgcagagcttt

SEQ ID NO: 1100906 - DNA, 20 bp, Homo sapiens
cacttctaaattaatggtaa

SEQ ID NO: 1100907 - DNA, 12 bp, Homo sapiens
cacttctagaat

SEQ ID NO: 1100908 - DNA, 21 bp, Homo sapiens
cacttctagtggtctcacctg

SEQ ID NO: 1100909 - DNA, 22 bp, Homo sapiens
cacttctagtggtctcacctgg

SEQ ID NO: 1100910 - DNA, 11 bp, Homo sapiens
cacttctattt

SEQ ID NO: 1100911 - DNA, 16 bp, Homo sapiens
cacttctatttaatgc

SEQ ID NO: 1100912 - DNA, 14 bp, Homo sapiens
cacttctccatgct

SEQ ID NO: 1100913 - DNA, 15 bp, Homo sapiens
cacttctccatgctg

SEQ ID NO: 1100914 - DNA, 23 bp, Homo sapiens
cacttctccccgcagcccgcctg

SEQ ID NO: 1100915 - DNA, 20 bp, Homo sapiens
cacttctcctgctgctcctg

SEQ ID NO: 1100916 - DNA, 21 bp, Homo sapiens
cacttctcctgctgctcctgt

SEQ ID NO: 1100917 - DNA, 16 bp, Homo sapiens
cacttctctgctgcct

SEQ ID NO: 1100918 - DNA, 18 bp, Homo sapiens
cacttctctgctgcctct

SEQ ID NO: 1100919 - DNA, 21 bp, Homo sapiens
cacttctctgggtcccggggt

SEQ ID NO: 1100920 - DNA, 16 bp, Homo sapiens
cacttctgaccacact

SEQ ID NO: 1100921 - DNA, 21 bp, Homo sapiens
cacttctgaccttgctgccac

SEQ ID NO: 1100922 - DNA, 18 bp, Homo sapiens
cacttctgcgggctccct

SEQ ID NO: 1100923 - DNA, 22 bp, Homo sapiens
cacttctggatatagctaggtg

SEQ ID NO: 1100924 - DNA, 23 bp, Homo sapiens
cacttctggatatagctaggtga

SEQ ID NO: 1100925 - DNA, 18 bp, Homo sapiens
cacttctggcatgggaca

SEQ ID NO: 1100926 - DNA, 19 bp, Homo sapiens
cacttctggcctccagcct

SEQ ID NO: 1100927 - DNA, 17 bp, Homo sapiens
cacttctggctcacagg

SEQ ID NO: 1100928 - DNA, 18 bp, Homo sapiens
cacttctgggcttcatct

SEQ ID NO: 1100929 - DNA, 16 bp, Homo sapiens
cacttctgtatgcatc

SEQ ID NO: 1100930 - DNA, 12 bp, Homo sapiens
cacttctgtggg

SEQ ID NO: 1100931 - DNA, 22 bp, Homo sapiens
cacttctgtgggcatggccgct

SEQ ID NO: 1100932 - DNA, 17 bp, Homo sapiens
cacttcttaaaggcctg

SEQ ID NO: 1100933 - DNA, 18 bp, Homo sapiens
cacttcttaaaggcctgg

SEQ ID NO: 1100934 - DNA, 20 bp, Homo sapiens
cacttcttcacctcttccac

SEQ ID NO: 1100935 - DNA, 15 bp, Homo sapiens
cacttcttcctattg

SEQ ID NO: 1100936 - DNA, 20 bp, Homo sapiens
cacttcttgaaacagcctgg

SEQ ID NO: 1100937 - DNA, 18 bp, Homo sapiens
cacttcttggttcctggg

SEQ ID NO: 1100938 - DNA, 19 bp, Homo sapiens
cacttcttggttcctggga

SEQ ID NO: 1100939 - DNA, 18 bp, Homo sapiens
cacttcttgttccccact

SEQ ID NO: 1100940 - DNA, 15 bp, Homo sapiens
cacttcttttgaaca

SEQ ID NO: 1100941 - DNA, 23 bp, Homo sapiens
cacttgaaagattttattgtata

SEQ ID NO: 1100942 - DNA, 17 bp, Homo sapiens
cacttgaagcacttaag

SEQ ID NO: 1100943 - DNA, 22 bp, Homo sapiens
cacttgagaaccagtctcctca

SEQ ID NO: 1100944 - DNA, 18 bp, Homo sapiens
cacttgaggtcaggagtt

SEQ ID NO: 1100945 - DNA, 13 bp, Homo sapiens
cacttgagtccag

SEQ ID NO: 1100946 - DNA, 16 bp, Homo sapiens
cacttgagttggctgt

SEQ ID NO: 1100947 - DNA, 16 bp, Homo sapiens
cacttgatgtgccatt

SEQ ID NO: 1100948 - DNA, 17 bp, Homo sapiens
cacttgattcatctctg

SEQ ID NO: 1100949 - DNA, 14 bp, Homo sapiens
cacttgattccttg

SEQ ID NO: 1100950 - DNA, 23 bp, Homo sapiens
cacttgccacatggtgtctccca

SEQ ID NO: 1100951 - DNA, 13 bp, Homo sapiens
cacttgccatgca

SEQ ID NO: 1100952 - DNA, 16 bp, Homo sapiens
cacttgccatgcagga

SEQ ID NO: 1100953 - DNA, 23 bp, Homo sapiens
cacttgccatgcaggaagaggcc

SEQ ID NO: 1100954 - DNA, 21 bp, Homo sapiens
cacttgccattgccaggagat

SEQ ID NO: 1100955 - DNA, 12 bp, Homo sapiens
cacttgcctctt

SEQ ID NO: 1100956 - DNA, 21 bp, Homo sapiens
cacttgcctcttccttgaaga

SEQ ID NO: 1100957 - DNA, 14 bp, Homo sapiens
cacttgcctggaat

SEQ ID NO: 1100958 - DNA, 15 bp, Homo sapiens
cacttgcctggggcg

SEQ ID NO: 1100959 - DNA, 16 bp, Homo sapiens
cacttgcgtcctgcag

SEQ ID NO: 1100960 - DNA, 19 bp, Homo sapiens
cacttgcgtcctgcagagg

SEQ ID NO: 1100961 - DNA, 15 bp, Homo sapiens
cacttggagcccgtg

SEQ ID NO: 1100962 - DNA, 18 bp, Homo sapiens
cacttggagcccgtgcag

SEQ ID NO: 1100963 - DNA, 20 bp, Homo sapiens
cacttggatttcatttgtaa

SEQ ID NO: 1100964 - DNA, 15 bp, Homo sapiens
cacttggcatacaaa

SEQ ID NO: 1100965 - DNA, 17 bp, Homo sapiens
cacttggcatacaaaat

SEQ ID NO: 1100966 - DNA, 20 bp, Homo sapiens
cacttggcatacaaaatatt

SEQ ID NO: 1100967 - DNA, 21 bp, Homo sapiens
cacttggcccagaaagctgcg

SEQ ID NO: 1100968 - DNA, 15 bp, Homo sapiens
cacttgggagctgct

SEQ ID NO: 1100969 - DNA, 20 bp, Homo sapiens
cacttgggagctgctgggct

SEQ ID NO: 1100970 - DNA, 14 bp, Homo sapiens
cacttgggctctct

SEQ ID NO: 1100971 - DNA, 17 bp, Homo sapiens
cacttggttagacgcct

SEQ ID NO: 1100972 - DNA, 14 bp, Homo sapiens
cacttgtaggataa

SEQ ID NO: 1100973 - DNA, 16 bp, Homo sapiens
cacttgtattgacttt

SEQ ID NO: 1100974 - DNA, 14 bp, Homo sapiens
cacttgtccagctg

SEQ ID NO: 1100975 - DNA, 20 bp, Homo sapiens
cacttgtcccactatctggg

SEQ ID NO: 1100976 - DNA, 18 bp, Homo sapiens
cacttgtcgggggcccaa

SEQ ID NO: 1100977 - DNA, 17 bp, Homo sapiens
cacttgtctcctttctg

SEQ ID NO: 1100978 - DNA, 20 bp, Homo sapiens
cacttgtctcctttctgact

SEQ ID NO: 1100979 - DNA, 21 bp, Homo sapiens
cacttgtctcctttctgactg

SEQ ID NO: 1100980 - DNA, 13 bp, Homo sapiens
cacttgtgccagc

SEQ ID NO: 1100981 - DNA, 20 bp, Homo sapiens
cacttgtgctttgctcttgt

SEQ ID NO: 1100982 - DNA, 22 bp, Homo sapiens
cacttgtgggtttttgttttgt

SEQ ID NO: 1100983 - DNA, 15 bp, Homo sapiens
cacttgttccagctc

SEQ ID NO: 1100984 - DNA, 16 bp, Homo sapiens
cactttaaagaggctg

SEQ ID NO: 1100985 - DNA, 15 bp, Homo sapiens
cactttaagctcctt

SEQ ID NO: 1100986 - DNA, 20 bp, Homo sapiens
cactttaatggcctggaggg

SEQ ID NO: 1100987 - DNA, 20 bp, Homo sapiens
cagaagccccacagcctggc

SEQ ID NO: 1100988 - DNA, 16 bp, Homo sapiens
cagaagcctccaagca

SEQ ID NO: 1100989 - DNA, 21 bp, Homo sapiens
cagaagcctccaagcacagag

SEQ ID NO: 1100990 - DNA, 15 bp, Homo sapiens
cagaagcctctggct

SEQ ID NO: 1100991 - DNA, 18 bp, Homo sapiens
cagaagcctggactctgc

SEQ ID NO: 1100992 - DNA, 17 bp, Homo sapiens
cagaagctaagctgcag

SEQ ID NO: 1100993 - DNA, 21 bp, Homo sapiens
cagaagctcttactctttcct

SEQ ID NO: 1100994 - DNA, 12 bp, Homo sapiens
cagaagctgctc

SEQ ID NO: 1100995 - DNA, 16 bp, Homo sapiens
cagaagctgctccttt

SEQ ID NO: 1100996 - DNA, 14 bp, Homo sapiens
cagaagctgggaac

SEQ ID NO: 1100997 - DNA, 15 bp, Homo sapiens
cagaagctgtgagtt

SEQ ID NO: 1100998 - DNA, 20 bp, Homo sapiens
cagaaggaaatgatggaatt

SEQ ID NO: 1100999 - DNA, 14 bp, Homo sapiens
cagaaggagaagga

SEQ ID NO: 1101000 - DNA, 20 bp, Homo sapiens
cagaaggagaaggaaggaga

SEQ ID NO: 1101001 - DNA, 13 bp, Homo sapiens
cagaaggagggca

SEQ ID NO: 1101002 - DNA, 15 bp, Homo sapiens
cagaaggagggcaga

SEQ ID NO: 1101003 - DNA, 21 bp, Homo sapiens
cagaaggcaatcttaaaacag

SEQ ID NO: 1101004 - DNA, 14 bp, Homo sapiens
cagaaggccccaga

SEQ ID NO: 1101005 - DNA, 17 bp, Homo sapiens
cagaaggccccagagag

SEQ ID NO: 1101006 - DNA, 12 bp, Homo sapiens
cagaagggcttc

SEQ ID NO: 1101007 - DNA, 13 bp, Homo sapiens
cagaagggcttca

SEQ ID NO: 1101008 - DNA, 19 bp, Homo sapiens
cagaaggggctgcttgctt

SEQ ID NO: 1101009 - DNA, 21 bp, Homo sapiens
cagaaggggctgcttgctttt

SEQ ID NO: 1101010 - DNA, 14 bp, Homo sapiens
cagaagggggccat

SEQ ID NO: 1101011 - DNA, 22 bp, Homo sapiens
cagaaggggtttggtctgggac

SEQ ID NO: 1101012 - DNA, 15 bp, Homo sapiens
cagaaggtgtgtcct

SEQ ID NO: 1101013 - DNA, 13 bp, Homo sapiens
cagaagtaagcct

SEQ ID NO: 1101014 - DNA, 15 bp, Homo sapiens
cagaagtaagcctca

SEQ ID NO: 1101015 - DNA, 15 bp, Homo sapiens
cagaagtaccagact

SEQ ID NO: 1101016 - DNA, 17 bp, Homo sapiens
cagaagtatcaagccat

SEQ ID NO: 1101017 - DNA, 20 bp, Homo sapiens
cagaagtcacacattacaaa

SEQ ID NO: 1101018 - DNA, 22 bp, Homo sapiens
cagaagtcacacattacaaagt

SEQ ID NO: 1101019 - DNA, 20 bp, Homo sapiens
cagaagtcatcttgctacca

SEQ ID NO: 1101020 - DNA, 17 bp, Homo sapiens
cagaagtcatgaagccc

SEQ ID NO: 1101021 - DNA, 18 bp, Homo sapiens
cagaagtcatgaagccca

SEQ ID NO: 1101022 - DNA, 19 bp, Homo sapiens
cagaagtcatgaagcccaa

SEQ ID NO: 1101023 - DNA, 14 bp, Homo sapiens
cagaagtctcctca

SEQ ID NO: 1101024 - DNA, 14 bp, Homo sapiens
cagaagtctggctt

SEQ ID NO: 1101025 - DNA, 13 bp, Homo sapiens
cagaagtgaaaat

SEQ ID NO: 1101026 - DNA, 21 bp, Homo sapiens
cagaagtgagctttgctgcta

SEQ ID NO: 1101027 - DNA, 13 bp, Homo sapiens
cagaagtggagct

SEQ ID NO: 1101028 - DNA, 15 bp, Homo sapiens
cagaagtggagctgg

SEQ ID NO: 1101029 - DNA, 16 bp, Homo sapiens
cagaagtggagctggg

SEQ ID NO: 1101030 - DNA, 16 bp, Homo sapiens
cagaagttagtttgta

SEQ ID NO: 1101031 - DNA, 19 bp, Homo sapiens
cagaagtttgtcaagtcaa

SEQ ID NO: 1101032 - DNA, 22 bp, Homo sapiens
cagaataaaagttcctctccct

SEQ ID NO: 1101033 - DNA, 18 bp, Homo sapiens
cagaataaggcaggcatt

SEQ ID NO: 1101034 - DNA, 20 bp, Homo sapiens
cagaataaggcaggcattga

SEQ ID NO: 1101035 - DNA, 21 bp, Homo sapiens
cagaataagttattgcagttt

SEQ ID NO: 1101036 - DNA, 14 bp, Homo sapiens
cagaataatccagt

SEQ ID NO: 1101037 - DNA, 11 bp, Homo sapiens
cagaataatgg

SEQ ID NO: 1101038 - DNA, 16 bp, Homo sapiens
cagaataatggaaaca

SEQ ID NO: 1101039 - DNA, 16 bp, Homo sapiens
cagaatacggaagagc

SEQ ID NO: 1101040 - DNA, 19 bp, Homo sapiens
cagaatacttgactcattt

SEQ ID NO: 1101041 - DNA, 16 bp, Homo sapiens
cagaatagaatacatt

SEQ ID NO: 1101042 - DNA, 16 bp, Homo sapiens
cagaataggaaaacat

SEQ ID NO: 1101043 - DNA, 18 bp, Homo sapiens
cagaataggaaaacattg

SEQ ID NO: 1101044 - DNA, 20 bp, Homo sapiens
cagaatagggtggcagaagt

SEQ ID NO: 1101045 - DNA, 22 bp, Homo sapiens
cagaatataaaaactcctgggc

SEQ ID NO: 1101046 - DNA, 19 bp, Homo sapiens
cagaatcagaatcatggag

SEQ ID NO: 1101047 - DNA, 21 bp, Homo sapiens
cagaatcagaatcatggagaa

SEQ ID NO: 1101048 - DNA, 14 bp, Homo sapiens
cagaatcagtgtta

SEQ ID NO: 1101049 - DNA, 16 bp, Homo sapiens
cagaatcatatgattc

SEQ ID NO: 1101050 - DNA, 19 bp, Homo sapiens
cagaatcatatgattctgc

SEQ ID NO: 1101051 - DNA, 14 bp, Homo sapiens
cagaatcattgctt

SEQ ID NO: 1101052 - DNA, 18 bp, Homo sapiens
cagaatccataaatgtgt

SEQ ID NO: 1101053 - DNA, 21 bp, Homo sapiens
cagaatcccaaataaaaccca

SEQ ID NO: 1101054 - DNA, 13 bp, Homo sapiens
cagaatcccagcc

SEQ ID NO: 1101055 - DNA, 18 bp, Homo sapiens
cagaatcccttaacagtt

SEQ ID NO: 1101056 - DNA, 23 bp, Homo sapiens
cagaatccctttgcacctgagac

SEQ ID NO: 1101057 - DNA, 17 bp, Homo sapiens
cagaatccttggctgaa

SEQ ID NO: 1101058 - DNA, 23 bp, Homo sapiens
cagaatccttggctgaattaaaa

SEQ ID NO: 1101059 - DNA, 17 bp, Homo sapiens
cagaatctaaacgtggt

SEQ ID NO: 1101060 - DNA, 17 bp, Homo sapiens
cagaatctcgcagtgtt

SEQ ID NO: 1101061 - DNA, 23 bp, Homo sapiens
cagaatctctctactcagatgac

SEQ ID NO: 1101062 - DNA, 19 bp, Homo sapiens
cagaatcttgactttctga

SEQ ID NO: 1101063 - DNA, 22 bp, Homo sapiens
cagaatcttgactttctgattg

SEQ ID NO: 1101064 - DNA, 13 bp, Homo sapiens
cagaatcttgttt

SEQ ID NO: 1101065 - DNA, 20 bp, Homo sapiens
cagaatcttgttttgaaaat

SEQ ID NO: 1101066 - DNA, 14 bp, Homo sapiens
cagaatgaattcga

SEQ ID NO: 1101067 - DNA, 16 bp, Homo sapiens
cagaatgcattaaaaa

SEQ ID NO: 1101068 - DNA, 17 bp, Homo sapiens
cagaatgcattaaaaaa

SEQ ID NO: 1101069 - DNA, 16 bp, Homo sapiens
cagaatgctgtacatc

SEQ ID NO: 1101070 - DNA, 18 bp, Homo sapiens
cagaatggaatccatctg

SEQ ID NO: 1101071 - DNA, 20 bp, Homo sapiens
cagaatggaatccatctgtc

SEQ ID NO: 1101072 - DNA, 16 bp, Homo sapiens
cagaatggagaaagta

SEQ ID NO: 1101073 - DNA, 13 bp, Homo sapiens
cagaatggcattt

SEQ ID NO: 1101074 - DNA, 19 bp, Homo sapiens
cagaatggtgatcactcca

SEQ ID NO: 1101075 - DNA, 14 bp, Homo sapiens
cagaatgtatatta

SEQ ID NO: 1101076 - DNA, 12 bp, Homo sapiens
cagaatgtatct

SEQ ID NO: 1101077 - DNA, 18 bp, Homo sapiens
cagaatgtatctgtgaag

SEQ ID NO: 1101078 - DNA, 18 bp, Homo sapiens
cagaatgtgaaaaaggaa

SEQ ID NO: 1101079 - DNA, 18 bp, Homo sapiens
cagaatgtgttcttttct

SEQ ID NO: 1101080 - DNA, 15 bp, Homo sapiens
cagaattaaactttt

SEQ ID NO: 1101081 - DNA, 15 bp, Homo sapiens
cagaattaagcagaa

SEQ ID NO: 1101082 - DNA, 22 bp, Homo sapiens
cagaattagatggcttattttt

SEQ ID NO: 1101083 - DNA, 17 bp, Homo sapiens
cagaattatccattacg

SEQ ID NO: 1101084 - DNA, 16 bp, Homo sapiens
cagaattcaaaagtga

SEQ ID NO: 1101085 - DNA, 12 bp, Homo sapiens
cagaattcacta

SEQ ID NO: 1101086 - DNA, 19 bp, Homo sapiens
cagaattcggtgtgctgcc

SEQ ID NO: 1101087 - DNA, 20 bp, Homo sapiens
cagaattcggtgtgctgcca

SEQ ID NO: 1101088 - DNA, 23 bp, Homo sapiens
cagaattcggtgtgctgccaact

SEQ ID NO: 1101089 - DNA, 13 bp, Homo sapiens
cagaattctgcta

SEQ ID NO: 1101090 - DNA, 23 bp, Homo sapiens
cagaattctgctacctcactggg

SEQ ID NO: 1101091 - DNA, 18 bp, Homo sapiens
cagaattgactgcagttg

SEQ ID NO: 1101092 - DNA, 23 bp, Homo sapiens
cagaattggcataatttgtctta

SEQ ID NO: 1101093 - DNA, 18 bp, Homo sapiens
cagaatttagtgtatcca

SEQ ID NO: 1101094 - DNA, 22 bp, Homo sapiens
cagaatttattagtttaaaatg

SEQ ID NO: 1101095 - DNA, 15 bp, Homo sapiens
cagaatttgaattat

SEQ ID NO: 1101096 - DNA, 11 bp, Homo sapiens
cagaatttgag

SEQ ID NO: 1101097 - DNA, 21 bp, Homo sapiens
cagacaaaaacagcctcacag

SEQ ID NO: 1101098 - DNA, 22 bp, Homo sapiens
cagacaaataggagtgagtgta

SEQ ID NO: 1101099 - DNA, 17 bp, Homo sapiens
cagacaacaccttcctc

SEQ ID NO: 1101100 - DNA, 18 bp, Homo sapiens
cagacaacaccttcctcc

SEQ ID NO: 1101101 - DNA, 16 bp, Homo sapiens
cagacaacagcccagg

SEQ ID NO: 1101102 - DNA, 13 bp, Homo sapiens
cagacaaccttgt

SEQ ID NO: 1101103 - DNA, 18 bp, Homo sapiens
cagacaacgggcccatgg

SEQ ID NO: 1101104 - DNA, 20 bp, Homo sapiens
cagacaacgggcccatggcc

SEQ ID NO: 1101105 - DNA, 17 bp, Homo sapiens
cagacaactctagaaat

SEQ ID NO: 1101106 - DNA, 19 bp, Homo sapiens
cagacaagcaacaggtttt

SEQ ID NO: 1101107 - DNA, 23 bp, Homo sapiens
cagacaagcaacaggttttataa

SEQ ID NO: 1101108 - DNA, 13 bp, Homo sapiens
cagacaagcacta

SEQ ID NO: 1101109 - DNA, 16 bp, Homo sapiens
cagagacagatacctc

SEQ ID NO: 1101110 - DNA, 19 bp, Homo sapiens
cagagacagatacctccaa

SEQ ID NO: 1101111 - DNA, 13 bp, Homo sapiens
cagagacaggaaa

SEQ ID NO: 1101112 - DNA, 21 bp, Homo sapiens
cagagacaggaaaatcctctg

SEQ ID NO: 1101113 - DNA, 23 bp, Homo sapiens
cagagacaggcccaagagatgaa

SEQ ID NO: 1101114 - DNA, 14 bp, Homo sapiens
cagagaccacacca

SEQ ID NO: 1101115 - DNA, 13 bp, Homo sapiens
cagagaccagcac

SEQ ID NO: 1101116 - DNA, 19 bp, Homo sapiens
cagagaccagcactcagcc

SEQ ID NO: 1101117 - DNA, 18 bp, Homo sapiens
cagagaccaggctgtgtc

SEQ ID NO: 1101118 - DNA, 20 bp, Homo sapiens
cagagacccaacagcagtga

SEQ ID NO: 1101119 - DNA, 20 bp, Homo sapiens
cagagaccccttcctttcct

SEQ ID NO: 1101120 - DNA, 22 bp, Homo sapiens
cagagaccccttcctttcctct

SEQ ID NO: 1101121 - DNA, 15 bp, Homo sapiens
cagagacctccaata

SEQ ID NO: 1101122 - DNA, 15 bp, Homo sapiens
cagagacctgaagtg

SEQ ID NO: 1101123 - DNA, 17 bp, Homo sapiens
cagagacctgaggcaga

SEQ ID NO: 1101124 - DNA, 14 bp, Homo sapiens
cagagacgcaggaa

SEQ ID NO: 1101125 - DNA, 22 bp, Homo sapiens
cagagactcagatgaggacaga

SEQ ID NO: 1101126 - DNA, 19 bp, Homo sapiens
cagagactcagggccccag

SEQ ID NO: 1101127 - DNA, 22 bp, Homo sapiens
cagagactcagggccccagcac

SEQ ID NO: 1101128 - DNA, 23 bp, Homo sapiens
cagagactcagggccccagcact

SEQ ID NO: 1101129 - DNA, 12 bp, Homo sapiens
cagagactctat

SEQ ID NO: 1101130 - DNA, 18 bp, Homo sapiens
cagagactgcccttctca

SEQ ID NO: 1101131 - DNA, 17 bp, Homo sapiens
cagagactttagggggt

SEQ ID NO: 1101132 - DNA, 14 bp, Homo sapiens
cagagagaagcctg

SEQ ID NO: 1101133 - DNA, 19 bp, Homo sapiens
cagagagaatgagagcgac

SEQ ID NO: 1101134 - DNA, 22 bp, Homo sapiens
cagagagaatgagagcgacaca

SEQ ID NO: 1101135 - DNA, 23 bp, Homo sapiens
cagagagaatgagagcgacacag

SEQ ID NO: 1101136 - DNA, 15 bp, Homo sapiens
cagagagacagactt

SEQ ID NO: 1101137 - DNA, 22 bp, Homo sapiens
cagagagacagacttgagaact

SEQ ID NO: 1101138 - DNA, 17 bp, Homo sapiens
cagagagaccctgcaag

SEQ ID NO: 1101139 - DNA, 16 bp, Homo sapiens
cagagagacccttgtg

SEQ ID NO: 1101140 - DNA, 19 bp, Homo sapiens
cagagagacctcatcctgc

SEQ ID NO: 1101141 - DNA, 23 bp, Homo sapiens
cagagagagaagtgcccctgctg

SEQ ID NO: 1101142 - DNA, 17 bp, Homo sapiens
cagagagagaggacaga

SEQ ID NO: 1101143 - DNA, 10 bp, Homo sapiens
cagagagagc

SEQ ID NO: 1101144 - DNA, 14 bp, Homo sapiens
cagagagagccaga

SEQ ID NO: 1101145 - DNA, 12 bp, Homo sapiens
cagagagagtgt

SEQ ID NO: 1101146 - DNA, 15 bp, Homo sapiens
cagagagcaaggcat

SEQ ID NO: 1101147 - DNA, 14 bp, Homo sapiens
cagagagcagctcc

SEQ ID NO: 1101148 - DNA, 13 bp, Homo sapiens
cagagagcaggca

SEQ ID NO: 1101149 - DNA, 16 bp, Homo sapiens
cagagagcaggcaggg

SEQ ID NO: 1101150 - DNA, 16 bp, Homo sapiens
cagagagcaggggagc

SEQ ID NO: 1101151 - DNA, 17 bp, Homo sapiens
cagagagcaggggagct

SEQ ID NO: 1101152 - DNA, 22 bp, Homo sapiens
cagagagcaggggagcttggga

SEQ ID NO: 1101153 - DNA, 13 bp, Homo sapiens
cagagagctggta

SEQ ID NO: 1101154 - DNA, 13 bp, Homo sapiens
cagagaggaatca

SEQ ID NO: 1101155 - DNA, 20 bp, Homo sapiens
cagagaggactgtagggagg

SEQ ID NO: 1101156 - DNA, 12 bp, Homo sapiens
cagagaggagca

SEQ ID NO: 1101157 - DNA, 17 bp, Homo sapiens
cagagaggatacattta

SEQ ID NO: 1101158 - DNA, 15 bp, Homo sapiens
cagagaggcaaggtt

SEQ ID NO: 1101159 - DNA, 22 bp, Homo sapiens
cagagagggacacatgcccctc

SEQ ID NO: 1101160 - DNA, 21 bp, Homo sapiens
cagagagggatgggttcctgc

SEQ ID NO: 1101161 - DNA, 14 bp, Homo sapiens
cagagagggcccag

SEQ ID NO: 1101162 - DNA, 17 bp, Homo sapiens
cagagagggcccagctg

SEQ ID NO: 1101163 - DNA, 23 bp, Homo sapiens
cagagagggcccagctgtagcca

SEQ ID NO: 1101164 - DNA, 15 bp, Homo sapiens
cagagagtacagact

SEQ ID NO: 1101165 - DNA, 16 bp, Homo sapiens
cagagagtacagactg

SEQ ID NO: 1101166 - DNA, 17 bp, Homo sapiens
cagagagtcctctggat

SEQ ID NO: 1101167 - DNA, 15 bp, Homo sapiens
cagagagtggctcct

SEQ ID NO: 1101168 - DNA, 20 bp, Homo sapiens
cagagataaaccaataaatc

SEQ ID NO: 1101169 - DNA, 20 bp, Homo sapiens
cagagatctgcaggctgcct

SEQ ID NO: 1101170 - DNA, 21 bp, Homo sapiens
cagagatgcaccaccaagcca

SEQ ID NO: 1101171 - DNA, 15 bp, Homo sapiens
cagagatgcctccac

SEQ ID NO: 1101172 - DNA, 22 bp, Homo sapiens
cagagatgtccatttttacaag

SEQ ID NO: 1101173 - DNA, 15 bp, Homo sapiens
cagagattctggatc

SEQ ID NO: 1101174 - DNA, 21 bp, Homo sapiens
cagagattctggatctcctgc

SEQ ID NO: 1101175 - DNA, 18 bp, Homo sapiens
cagagatttcctccatgg

SEQ ID NO: 1101176 - DNA, 17 bp, Homo sapiens
cagagatttgagaacca

SEQ ID NO: 1101177 - DNA, 14 bp, Homo sapiens
cagagcaaaataat

SEQ ID NO: 1101178 - DNA, 18 bp, Homo sapiens
cagagcaaagcgcccacc

SEQ ID NO: 1101179 - DNA, 19 bp, Homo sapiens
cagagcaaatgagggaggg

SEQ ID NO: 1101180 - DNA, 18 bp, Homo sapiens
cagagcaagatcctgtct

SEQ ID NO: 1101181 - DNA, 20 bp, Homo sapiens
cagagcaagatcctgtcttt

SEQ ID NO: 1101182 - DNA, 14 bp, Homo sapiens
cagagcaagtgaga

SEQ ID NO: 1101183 - DNA, 19 bp, Homo sapiens
cagagcaataacactatat

SEQ ID NO: 1101184 - DNA, 13 bp, Homo sapiens
cagagcacaggag

SEQ ID NO: 1101185 - DNA, 15 bp, Homo sapiens
cagagcacaggagct

SEQ ID NO: 1101186 - DNA, 13 bp, Homo sapiens
cagagcaccccct

SEQ ID NO: 1101187 - DNA, 15 bp, Homo sapiens
cagagcaccccctgc

SEQ ID NO: 1101188 - DNA, 22 bp, Homo sapiens
cagagcacctttgcacaggatg

SEQ ID NO: 1101189 - DNA, 17 bp, Homo sapiens
cagagcacgcctgccat

SEQ ID NO: 1101190 - DNA, 14 bp, Homo sapiens
cagagcactcccta

SEQ ID NO: 1101191 - DNA, 22 bp, Homo sapiens
cagagcactttgcaactccctg

SEQ ID NO: 1101192 - DNA, 12 bp, Homo sapiens
cagagcagagcc

SEQ ID NO: 1101193 - DNA, 15 bp, Homo sapiens
cagagcagcagcacc

SEQ ID NO: 1101194 - DNA, 19 bp, Homo sapiens
cagagcagcagcacctttc

SEQ ID NO: 1101195 - DNA, 22 bp, Homo sapiens
cagagcagcagcacctttctct

SEQ ID NO: 1101196 - DNA, 14 bp, Homo sapiens
cagagcagctaact

SEQ ID NO: 1101197 - DNA, 22 bp, Homo sapiens
cagagcagctaactccgagagc

SEQ ID NO: 1101198 - DNA, 15 bp, Homo sapiens
cagagcagctagctc

SEQ ID NO: 1101199 - DNA, 17 bp, Homo sapiens
cagagcaggaaggacag

SEQ ID NO: 1101200 - DNA, 13 bp, Homo sapiens
cagagcaggacct

SEQ ID NO: 1101201 - DNA, 14 bp, Homo sapiens
cagagcaggactgc

SEQ ID NO: 1101202 - DNA, 16 bp, Homo sapiens
cagagcaggagcccct

SEQ ID NO: 1101203 - DNA, 13 bp, Homo sapiens
cagagcaggaggc

SEQ ID NO: 1101204 - DNA, 17 bp, Homo sapiens
cagagcaggaggcccct

SEQ ID NO: 1101205 - DNA, 19 bp, Homo sapiens
cagagcaggaggcccctgg

SEQ ID NO: 1101206 - DNA, 12 bp, Homo sapiens
cagagcaggctc

SEQ ID NO: 1101207 - DNA, 21 bp, Homo sapiens
cagagcaggctcagactctgg

SEQ ID NO: 1101208 - DNA, 15 bp, Homo sapiens
cagagcaggggccag

SEQ ID NO: 1101209 - DNA, 16 bp, Homo sapiens
cagagcaggggctcca

SEQ ID NO: 1101210 - DNA, 18 bp, Homo sapiens
cagagcaggggctccagc

SEQ ID NO: 1101211 - DNA, 16 bp, Homo sapiens
cagagccaaggccacc

SEQ ID NO: 1101212 - DNA, 13 bp, Homo sapiens
cagagccaagtcc

SEQ ID NO: 1101213 - DNA, 21 bp, Homo sapiens
cagagccaagtcctccctctc

SEQ ID NO: 1101214 - DNA, 11 bp, Homo sapiens
cagagccaccc

SEQ ID NO: 1101215 - DNA, 12 bp, Homo sapiens
cagagccagcct

SEQ ID NO: 1101216 - DNA, 23 bp, Homo sapiens
cagagccagcctggctctgcccc

SEQ ID NO: 1101217 - DNA, 21 bp, Homo sapiens
cagagccaggaagatccccca

SEQ ID NO: 1101218 - DNA, 11 bp, Homo sapiens
cagagccaggc

SEQ ID NO: 1101219 - DNA, 12 bp, Homo sapiens
cagagccagggc

SEQ ID NO: 1101220 - DNA, 13 bp, Homo sapiens
cagagccagggct

SEQ ID NO: 1101221 - DNA, 14 bp, Homo sapiens
cagagccagggctg

SEQ ID NO: 1101222 - DNA, 13 bp, Homo sapiens
cagagccagtgaa

SEQ ID NO: 1101223 - DNA, 17 bp, Homo sapiens
cagagccagtgaaggag

SEQ ID NO: 1101224 - DNA, 13 bp, Homo sapiens
cagagccatgggc

SEQ ID NO: 1101225 - DNA, 14 bp, Homo sapiens
cagagccatgggcc

SEQ ID NO: 1101226 - DNA, 16 bp, Homo sapiens
cagagccatgggcctg

SEQ ID NO: 1101227 - DNA, 19 bp, Homo sapiens
cagagccatgggcctgggc

SEQ ID NO: 1101228 - DNA, 21 bp, Homo sapiens
cagagcccaccagccagccct

SEQ ID NO: 1101229 - DNA, 22 bp, Homo sapiens
cagagcccaccagccagccctg

SEQ ID NO: 1101230 - DNA, 23 bp, Homo sapiens
cagagcccaccagccagccctgg

SEQ ID NO: 1101231 - DNA, 12 bp, Homo sapiens
cagagcccagct

SEQ ID NO: 1101232 - DNA, 19 bp, Homo sapiens
cagagttgctgggagctga

SEQ ID NO: 1101233 - DNA, 19 bp, Homo sapiens
cagagttgtaaatatataa

SEQ ID NO: 1101234 - DNA, 20 bp, Homo sapiens
cagagttgtaaatatataaa

SEQ ID NO: 1101235 - DNA, 18 bp, Homo sapiens
cagagttgttacattttt

SEQ ID NO: 1101236 - DNA, 12 bp, Homo sapiens
cagagtttgtgt

SEQ ID NO: 1101237 - DNA, 15 bp, Homo sapiens
cagagtttgtgtgta

SEQ ID NO: 1101238 - DNA, 18 bp, Homo sapiens
cagagtttgtgtgtattt

SEQ ID NO: 1101239 - DNA, 15 bp, Homo sapiens
cagataaatagaact

SEQ ID NO: 1101240 - DNA, 17 bp, Homo sapiens
cagataaccagctgtaa

SEQ ID NO: 1101241 - DNA, 19 bp, Homo sapiens
cagataactctctttcctt

SEQ ID NO: 1101242 - DNA, 19 bp, Homo sapiens
cagataactgaaaattatt

SEQ ID NO: 1101243 - DNA, 22 bp, Homo sapiens
cagataactgaaaattatttaa

SEQ ID NO: 1101244 - DNA, 19 bp, Homo sapiens
cagataagtgtaaatagaa

SEQ ID NO: 1101245 - DNA, 15 bp, Homo sapiens
cagataatcagcctc

SEQ ID NO: 1101246 - DNA, 18 bp, Homo sapiens
cagataatcagcctctta

SEQ ID NO: 1101247 - DNA, 19 bp, Homo sapiens
cagataatcagcctcttaa

SEQ ID NO: 1101248 - DNA, 16 bp, Homo sapiens
cagataattcatttgt

SEQ ID NO: 1101249 - DNA, 20 bp, Homo sapiens
cagataattcatttgtattg

SEQ ID NO: 1101250 - DNA, 17 bp, Homo sapiens
cagataattctggacca

SEQ ID NO: 1101251 - DNA, 16 bp, Homo sapiens
cagatacataggtctg

SEQ ID NO: 1101252 - DNA, 14 bp, Homo sapiens
cagatacatcactg

SEQ ID NO: 1101253 - DNA, 19 bp, Homo sapiens
cagatacatcactgcttga

SEQ ID NO: 1101254 - DNA, 19 bp, Homo sapiens
cagataccttgaaaggaag

SEQ ID NO: 1101255 - DNA, 21 bp, Homo sapiens
cagatacgggggctgtgactc

SEQ ID NO: 1101256 - DNA, 20 bp, Homo sapiens
cagatacgtagttgtgcttt

SEQ ID NO: 1101257 - DNA, 16 bp, Homo sapiens
cagatagacagtgctg

SEQ ID NO: 1101258 - DNA, 17 bp, Homo sapiens
cagatagacagtgctgc

SEQ ID NO: 1101259 - DNA, 20 bp, Homo sapiens
cagatagacagtgctgccct

SEQ ID NO: 1101260 - DNA, 21 bp, Homo sapiens
cagatagacagtgctgccctg

SEQ ID NO: 1101261 - DNA, 24 bp, Homo sapiens
cagatagacagtgctgccctgcga

SEQ ID NO: 1101262 - DNA, 13 bp, Homo sapiens
cagatagagaaat

SEQ ID NO: 1101263 - DNA, 16 bp, Homo sapiens
cagatagagctgggtg

SEQ ID NO: 1101264 - DNA, 19 bp, Homo sapiens
cagatagatatatgctctg

SEQ ID NO: 1101265 - DNA, 17 bp, Homo sapiens
cagatagcccaggagca

SEQ ID NO: 1101266 - DNA, 18 bp, Homo sapiens
cagatagtgtagctgagg

SEQ ID NO: 1101267 - DNA, 20 bp, Homo sapiens
cagatagtgtagctgaggag

SEQ ID NO: 1101268 - DNA, 23 bp, Homo sapiens
cagatataaatggctggttttta

SEQ ID NO: 1101269 - DNA, 16 bp, Homo sapiens
cagatataactgtctt

SEQ ID NO: 1101270 - DNA, 18 bp, Homo sapiens
cagatataactgtcttgt

SEQ ID NO: 1101271 - DNA, 22 bp, Homo sapiens
cagatataactgtcttgtttca

SEQ ID NO: 1101272 - DNA, 14 bp, Homo sapiens
cagatatatttttc

SEQ ID NO: 1101273 - DNA, 16 bp, Homo sapiens
cagatatatttttcac

SEQ ID NO: 1101274 - DNA, 18 bp, Homo sapiens
cagatatatttttcacag

SEQ ID NO: 1101275 - DNA, 13 bp, Homo sapiens
cagatatcaaaat

SEQ ID NO: 1101276 - DNA, 15 bp, Homo sapiens
cagatatctgcatgt

SEQ ID NO: 1101277 - DNA, 18 bp, Homo sapiens
cagatatgaacagggccc

SEQ ID NO: 1101278 - DNA, 18 bp, Homo sapiens
cagatatgatatgtaaac

SEQ ID NO: 1101279 - DNA, 20 bp, Homo sapiens
cagatattgttataaataaa

SEQ ID NO: 1101280 - DNA, 16 bp, Homo sapiens
cagatatttatatttt

SEQ ID NO: 1101281 - DNA, 21 bp, Homo sapiens
cagatatttatatttttattt

SEQ ID NO: 1101282 - DNA, 14 bp, Homo sapiens
cagatcaagagttt

SEQ ID NO: 1101283 - DNA, 18 bp, Homo sapiens
cagatcaagagttttgga

SEQ ID NO: 1101284 - DNA, 15 bp, Homo sapiens
cagatcaagctgtga

SEQ ID NO: 1101285 - DNA, 22 bp, Homo sapiens
cagatcaccagcccggcctgct

SEQ ID NO: 1101286 - DNA, 18 bp, Homo sapiens
cagatcactcctggaggc

SEQ ID NO: 1101287 - DNA, 14 bp, Homo sapiens
cagatcactgccac

SEQ ID NO: 1101288 - DNA, 16 bp, Homo sapiens
cagatcactgccacac

SEQ ID NO: 1101289 - DNA, 17 bp, Homo sapiens
cagatcagaacatgaaa

SEQ ID NO: 1101290 - DNA, 17 bp, Homo sapiens
cagatcagtcagagccc

SEQ ID NO: 1101291 - DNA, 16 bp, Homo sapiens
cagatcataggaagtg

SEQ ID NO: 1101292 - DNA, 23 bp, Homo sapiens
cagatccagactgtaagatgttg

SEQ ID NO: 1101293 - DNA, 17 bp, Homo sapiens
cagatcccactggaaga

SEQ ID NO: 1101294 - DNA, 15 bp, Homo sapiens
cagatccccaagcct

SEQ ID NO: 1101295 - DNA, 23 bp, Homo sapiens
cagatccccagctttctcctctg

SEQ ID NO: 1101296 - DNA, 23 bp, Homo sapiens
cagatcctgttacttgcttcagt

SEQ ID NO: 1101297 - DNA, 12 bp, Homo sapiens
cagatcctttca

SEQ ID NO: 1101298 - DNA, 15 bp, Homo sapiens
cagatcgatcctgga

SEQ ID NO: 1101299 - DNA, 14 bp, Homo sapiens
cagatcgttcattg

SEQ ID NO: 1101300 - DNA, 13 bp, Homo sapiens
cagatctcccact

SEQ ID NO: 1101301 - DNA, 15 bp, Homo sapiens
cagatctcccactgc

SEQ ID NO: 1101302 - DNA, 13 bp, Homo sapiens
cagatctctaatt

SEQ ID NO: 1101303 - DNA, 14 bp, Homo sapiens
cagatctgaacaca

SEQ ID NO: 1101304 - DNA, 15 bp, Homo sapiens
cagatctgcctgggc

SEQ ID NO: 1101305 - DNA, 17 bp, Homo sapiens
cagatctgcctgggcct

SEQ ID NO: 1101306 - DNA, 18 bp, Homo sapiens
cagatctgcctgggcctg

SEQ ID NO: 1101307 - DNA, 23 bp, Homo sapiens
cagatctgcctgggcctgtgcag

SEQ ID NO: 1101308 - DNA, 23 bp, Homo sapiens
cagatctggggcagcaccctata

SEQ ID NO: 1101309 - DNA, 14 bp, Homo sapiens
cagatctgtgcccc

SEQ ID NO: 1101310 - DNA, 13 bp, Homo sapiens
cagatctgtgcct

SEQ ID NO: 1101311 - DNA, 14 bp, Homo sapiens
cagatctttctctt

SEQ ID NO: 1101312 - DNA, 15 bp, Homo sapiens
cagatgaacatttca

SEQ ID NO: 1101313 - DNA, 16 bp, Homo sapiens
cagatgaactgactga

SEQ ID NO: 1101314 - DNA, 19 bp, Homo sapiens
cagatgaatgataaactct

SEQ ID NO: 1101315 - DNA, 20 bp, Homo sapiens
cagatgacaaaaaggtgcag

SEQ ID NO: 1101316 - DNA, 20 bp, Homo sapiens
cagatgacatttcgtttttt

SEQ ID NO: 1101317 - DNA, 18 bp, Homo sapiens
cagatgaccaaagtccct

SEQ ID NO: 1101318 - DNA, 18 bp, Homo sapiens
cagatgaccccagaaact

SEQ ID NO: 1101319 - DNA, 17 bp, Homo sapiens
cagatgaccgtgtacaa

SEQ ID NO: 1101320 - DNA, 16 bp, Homo sapiens
cagatgactctctcca

SEQ ID NO: 1101321 - DNA, 15 bp, Homo sapiens
cagatgagaacaaag

SEQ ID NO: 1101322 - DNA, 20 bp, Homo sapiens
cagatgaggagcagctgggg

SEQ ID NO: 1101323 - DNA, 17 bp, Homo sapiens
cagatgaggatccgaaa

SEQ ID NO: 1101324 - DNA, 22 bp, Homo sapiens
cagatgaggatccgaaacggca

SEQ ID NO: 1101325 - DNA, 17 bp, Homo sapiens
cagatgaggggccactg

SEQ ID NO: 1101326 - DNA, 22 bp, Homo sapiens
cagatgaggggccactgaccca

SEQ ID NO: 1101327 - DNA, 14 bp, Homo sapiens
cagatgaggtcaac

SEQ ID NO: 1101328 - DNA, 16 bp, Homo sapiens
cagatgataaatattt

SEQ ID NO: 1101329 - DNA, 15 bp, Homo sapiens
cagatgattttcctc

SEQ ID NO: 1101330 - DNA, 17 bp, Homo sapiens
cagatgattttcctccc

SEQ ID NO: 1101331 - DNA, 13 bp, Homo sapiens
cagatgcaacctc

SEQ ID NO: 1101332 - DNA, 14 bp, Homo sapiens
cagatgcagggcag

SEQ ID NO: 1101333 - DNA, 17 bp, Homo sapiens
cagatgcagggcagtca

SEQ ID NO: 1101334 - DNA, 13 bp, Homo sapiens
cagatgccaactt

SEQ ID NO: 1101335 - DNA, 14 bp, Homo sapiens
cagatgccaacttc

SEQ ID NO: 1101336 - DNA, 16 bp, Homo sapiens
cagatgccacacctgc

SEQ ID NO: 1101337 - DNA, 19 bp, Homo sapiens
cagatgcccagagggccca

SEQ ID NO: 1101338 - DNA, 20 bp, Homo sapiens
cagatgcccagagggcccag

SEQ ID NO: 1101339 - DNA, 15 bp, Homo sapiens
cagatgccccagagc

SEQ ID NO: 1101340 - DNA, 22 bp, Homo sapiens
cagatgcctgcttgataatata

SEQ ID NO: 1101341 - DNA, 16 bp, Homo sapiens
cagatgccttctagat

SEQ ID NO: 1101342 - DNA, 22 bp, Homo sapiens
cagatgccttctagattcactg

SEQ ID NO: 1101343 - DNA, 18 bp, Homo sapiens
cagatgcggggacaggct

SEQ ID NO: 1101344 - DNA, 14 bp, Homo sapiens
cagatgcgtgccca

SEQ ID NO: 1101345 - DNA, 20 bp, Homo sapiens
cagatgcgttcgcctctggc

SEQ ID NO: 1101346 - DNA, 12 bp, Homo sapiens
cagatgctgaat

SEQ ID NO: 1101347 - DNA, 16 bp, Homo sapiens
cagatgctgagccata

SEQ ID NO: 1101348 - DNA, 17 bp, Homo sapiens
cagatgctgagccatag

SEQ ID NO: 1101349 - DNA, 14 bp, Homo sapiens
cagatgctgctgaa

SEQ ID NO: 1101350 - DNA, 17 bp, Homo sapiens
cagatgctgctgaagag

SEQ ID NO: 1101351 - DNA, 20 bp, Homo sapiens
cagatgctgctgaagagagg

SEQ ID NO: 1101352 - DNA, 18 bp, Homo sapiens
cagatgctgttgtgaagc

SEQ ID NO: 1101353 - DNA, 22 bp, Homo sapiens
cagatgctgttgtgaagctaat

SEQ ID NO: 1101354 - DNA, 12 bp, Homo sapiens
cagcagaggtga

SEQ ID NO: 1101355 - DNA, 20 bp, Homo sapiens
cagcagaggtgagaactcag

SEQ ID NO: 1101356 - DNA, 23 bp, Homo sapiens
cagcagaggtgagaactcagaag

SEQ ID NO: 1101357 - DNA, 21 bp, Homo sapiens
cagcagaggtttgctgacagg

SEQ ID NO: 1101358 - DNA, 24 bp, Homo sapiens
cagcagaggtttgctgacaggtga

SEQ ID NO: 1101359 - DNA, 22 bp, Homo sapiens
cagcagagtgagcaagggggcc

SEQ ID NO: 1101360 - DNA, 16 bp, Homo sapiens
cagcagatgccagtga

SEQ ID NO: 1101361 - DNA, 17 bp, Homo sapiens
cagcagatggaaagaaa

SEQ ID NO: 1101362 - DNA, 18 bp, Homo sapiens
cagcagatggaaagaaag

SEQ ID NO: 1101363 - DNA, 12 bp, Homo sapiens
cagcagcacaat

SEQ ID NO: 1101364 - DNA, 13 bp, Homo sapiens
cagcagcacaatt

SEQ ID NO: 1101365 - DNA, 23 bp, Homo sapiens
cagcagcacaattctgtccctgt

SEQ ID NO: 1101366 - DNA, 18 bp, Homo sapiens
cagcagcaccaaccacag

SEQ ID NO: 1101367 - DNA, 21 bp, Homo sapiens
cagcagcactcccgctgcaca

SEQ ID NO: 1101368 - DNA, 13 bp, Homo sapiens
cagcagcagcagg

SEQ ID NO: 1101369 - DNA, 15 bp, Homo sapiens
cagcagcagcccaag

SEQ ID NO: 1101370 - DNA, 16 bp, Homo sapiens
cagcagcatcccagcc

SEQ ID NO: 1101371 - DNA, 17 bp, Homo sapiens
cagcagcatcccagcct

SEQ ID NO: 1101372 - DNA, 21 bp, Homo sapiens
cagcagcatcccagccttgag

SEQ ID NO: 1101373 - DNA, 12 bp, Homo sapiens
cagcagccagca

SEQ ID NO: 1101374 - DNA, 13 bp, Homo sapiens
cagcagccagctc

SEQ ID NO: 1101375 - DNA, 21 bp, Homo sapiens
cagcagccagctctcagccaa

SEQ ID NO: 1101376 - DNA, 23 bp, Homo sapiens
cagcagccagtctcagagaccag

SEQ ID NO: 1101377 - DNA, 13 bp, Homo sapiens
cagcagcccaagc

SEQ ID NO: 1101378 - DNA, 16 bp, Homo sapiens
cagcagcccaagctta

SEQ ID NO: 1101379 - DNA, 19 bp, Homo sapiens
cagcagcccagcttcctgg

SEQ ID NO: 1101380 - DNA, 14 bp, Homo sapiens
cagcagccccccag

SEQ ID NO: 1101381 - DNA, 16 bp, Homo sapiens
cagcagccccccagca

SEQ ID NO: 1101382 - DNA, 17 bp, Homo sapiens
cagcagccccccagcac

SEQ ID NO: 1101383 - DNA, 13 bp, Homo sapiens
cagcagcccctgc

SEQ ID NO: 1101384 - DNA, 23 bp, Homo sapiens
cagcagcccctgcacaaagccct

SEQ ID NO: 1101385 - DNA, 13 bp, Homo sapiens
cagcagccctcct

SEQ ID NO: 1101386 - DNA, 21 bp, Homo sapiens
cagcagccgccttaagctgat

SEQ ID NO: 1101387 - DNA, 18 bp, Homo sapiens
cagcagcctcgcacaggc

SEQ ID NO: 1101388 - DNA, 12 bp, Homo sapiens
cagcagcctgga

SEQ ID NO: 1101389 - DNA, 14 bp, Homo sapiens
cagcagcctgtatg

SEQ ID NO: 1101390 - DNA, 12 bp, Homo sapiens
cagcagcctgtg

SEQ ID NO: 1101391 - DNA, 17 bp, Homo sapiens
cagcagctaggactgag

SEQ ID NO: 1101392 - DNA, 12 bp, Homo sapiens
cagcagctcagg

SEQ ID NO: 1101393 - DNA, 13 bp, Homo sapiens
cagcagctcaggc

SEQ ID NO: 1101394 - DNA, 14 bp, Homo sapiens
cagcagctcaggca

SEQ ID NO: 1101395 - DNA, 15 bp, Homo sapiens
cagcagctcatagaa

SEQ ID NO: 1101396 - DNA, 20 bp, Homo sapiens
cagcagctgaacagccaaat

SEQ ID NO: 1101397 - DNA, 13 bp, Homo sapiens
cagcagctgaagt

SEQ ID NO: 1101398 - DNA, 17 bp, Homo sapiens
cagcagctgcaccccag

SEQ ID NO: 1101399 - DNA, 15 bp, Homo sapiens
cagcagctgggaccc

SEQ ID NO: 1101400 - DNA, 22 bp, Homo sapiens
cagcagctgggacccctcccaa

SEQ ID NO: 1101401 - DNA, 18 bp, Homo sapiens
cagcagcttcaccagagc

SEQ ID NO: 1101402 - DNA, 22 bp, Homo sapiens
cagcaggaaggaacaaagacag

SEQ ID NO: 1101403 - DNA, 12 bp, Homo sapiens
cagcaggaaggg

SEQ ID NO: 1101404 - DNA, 13 bp, Homo sapiens
cagcaggaagggt

SEQ ID NO: 1101405 - DNA, 20 bp, Homo sapiens
cagcaggaagggtgggaagg

SEQ ID NO: 1101406 - DNA, 23 bp, Homo sapiens
cagcaggacttgctaaagcactt

SEQ ID NO: 1101407 - DNA, 13 bp, Homo sapiens
cagcaggaggagt

SEQ ID NO: 1101408 - DNA, 22 bp, Homo sapiens
cagcaggaggttctgggcctct

SEQ ID NO: 1101409 - DNA, 16 bp, Homo sapiens
cagcaggagtggtgca

SEQ ID NO: 1101410 - DNA, 21 bp, Homo sapiens
cagcaggagtggtgcagacag

SEQ ID NO: 1101411 - DNA, 22 bp, Homo sapiens
cagcaggatcgaagggttttta

SEQ ID NO: 1101412 - DNA, 19 bp, Homo sapiens
cagcaggcacggcccgcag

SEQ ID NO: 1101413 - DNA, 12 bp, Homo sapiens
cagcaggcaggc

SEQ ID NO: 1101414 - DNA, 16 bp, Homo sapiens
cagcaggccactagtg

SEQ ID NO: 1101415 - DNA, 17 bp, Homo sapiens
cagcaggccactagtga

SEQ ID NO: 1101416 - DNA, 19 bp, Homo sapiens
cagcaggccactagtgaca

SEQ ID NO: 1101417 - DNA, 12 bp, Homo sapiens
cagcaggcccag

SEQ ID NO: 1101418 - DNA, 16 bp, Homo sapiens
cagcaggcccagcatg

SEQ ID NO: 1101419 - DNA, 17 bp, Homo sapiens
cagcaggcccagcatgc

SEQ ID NO: 1101420 - DNA, 18 bp, Homo sapiens
cagcaggcccagcatgca

SEQ ID NO: 1101421 - DNA, 23 bp, Homo sapiens
cagcagggaaaatgcagcaggga

SEQ ID NO: 1101422 - DNA, 16 bp, Homo sapiens
cagcagggatgccctg

SEQ ID NO: 1101423 - DNA, 18 bp, Homo sapiens
cagcagggcaggaagggg

SEQ ID NO: 1101424 - DNA, 14 bp, Homo sapiens
cagcagggcctcaa

SEQ ID NO: 1101425 - DNA, 15 bp, Homo sapiens
cagcagggcctcaaa

SEQ ID NO: 1101426 - DNA, 18 bp, Homo sapiens
cagcagggtcttttcatc

SEQ ID NO: 1101427 - DNA, 20 bp, Homo sapiens
cagcaggtgattggaccagg

SEQ ID NO: 1101428 - DNA, 21 bp, Homo sapiens
cagcaggtgattggaccaggc

SEQ ID NO: 1101429 - DNA, 16 bp, Homo sapiens
cagcaggtgctgggct

SEQ ID NO: 1101430 - DNA, 21 bp, Homo sapiens
cagcaggtgctgggctggact

SEQ ID NO: 1101431 - DNA, 21 bp, Homo sapiens
cagcagtcccagtattctcag

SEQ ID NO: 1101432 - DNA, 11 bp, Homo sapiens
cagcagtgaag

SEQ ID NO: 1101433 - DNA, 16 bp, Homo sapiens
cagcagtgagactggg

SEQ ID NO: 1101434 - DNA, 21 bp, Homo sapiens
cagcagtgagtctcttcagaa

SEQ ID NO: 1101435 - DNA, 15 bp, Homo sapiens
cagcagtgatctcag

SEQ ID NO: 1101436 - DNA, 17 bp, Homo sapiens
cagcagtgggggtcaga

SEQ ID NO: 1101437 - DNA, 12 bp, Homo sapiens
cagcagtggggt

SEQ ID NO: 1101438 - DNA, 13 bp, Homo sapiens
cagcagtggggtg

SEQ ID NO: 1101439 - DNA, 21 bp, Homo sapiens
cagcagtgtgaatagcctggc

SEQ ID NO: 1101440 - DNA, 19 bp, Homo sapiens
cagcagtgtgaggccaggg

SEQ ID NO: 1101441 - DNA, 22 bp, Homo sapiens
cagcagtgtgaggccagggcag

SEQ ID NO: 1101442 - DNA, 19 bp, Homo sapiens
cagcagtgtggagaccctg

SEQ ID NO: 1101443 - DNA, 14 bp, Homo sapiens
cagcagtgttcccc

SEQ ID NO: 1101444 - DNA, 17 bp, Homo sapiens
cagcagtgttccccatc

SEQ ID NO: 1101445 - DNA, 22 bp, Homo sapiens
cagcagtgttccccatctgggt

SEQ ID NO: 1101446 - DNA, 11 bp, Homo sapiens
cagcagtttta

SEQ ID NO: 1101447 - DNA, 17 bp, Homo sapiens
cagcatagaagtaactt

SEQ ID NO: 1101448 - DNA, 16 bp, Homo sapiens
cagcatagcctgcctg

SEQ ID NO: 1101449 - DNA, 21 bp, Homo sapiens
cagcatagcctgcctgatccc

SEQ ID NO: 1101450 - DNA, 12 bp, Homo sapiens
cagcatatttat

SEQ ID NO: 1101451 - DNA, 13 bp, Homo sapiens
cagcatcactgat

SEQ ID NO: 1101452 - DNA, 12 bp, Homo sapiens
cagcatcactgg

SEQ ID NO: 1101453 - DNA, 14 bp, Homo sapiens
cagcatcccagcct

SEQ ID NO: 1101454 - DNA, 15 bp, Homo sapiens
cagcatccctggagc

SEQ ID NO: 1101455 - DNA, 16 bp, Homo sapiens
cagcatccctggagca

SEQ ID NO: 1101456 - DNA, 16 bp, Homo sapiens
cagcatcccttcccac

SEQ ID NO: 1101457 - DNA, 23 bp, Homo sapiens
cagcatcccttcccacatgcctg

SEQ ID NO: 1101458 - DNA, 23 bp, Homo sapiens
cagcatccgcaggtgctggtccc

SEQ ID NO: 1101459 - DNA, 15 bp, Homo sapiens
cagcatcgggagcac

SEQ ID NO: 1101460 - DNA, 18 bp, Homo sapiens
cagcatcgggagcaccca

SEQ ID NO: 1101461 - DNA, 23 bp, Homo sapiens
cagcatcgggagcacccagagca

SEQ ID NO: 1101462 - DNA, 24 bp, Homo sapiens
cagcatcgggagcacccagagcac

SEQ ID NO: 1101463 - DNA, 16 bp, Homo sapiens
cagcatcgggggcctg

SEQ ID NO: 1101464 - DNA, 20 bp, Homo sapiens
cagcatcgggggcctgcaaa

SEQ ID NO: 1101465 - DNA, 15 bp, Homo sapiens
cagcatctcccagca

SEQ ID NO: 1101466 - DNA, 14 bp, Homo sapiens
cagcatctggaaga

SEQ ID NO: 1101467 - DNA, 21 bp, Homo sapiens
cagcatctggctgtctagaat

SEQ ID NO: 1101468 - DNA, 21 bp, Homo sapiens
cagcatctggtcttgtttcca

SEQ ID NO: 1101469 - DNA, 20 bp, Homo sapiens
cagcatgaataaaacactca

SEQ ID NO: 1101470 - DNA, 14 bp, Homo sapiens
cagcatgacaaaaa

SEQ ID NO: 1101471 - DNA, 15 bp, Homo sapiens
cagcatgacaaaaat

SEQ ID NO: 1101472 - DNA, 21 bp, Homo sapiens
cagcatgagactttctgctgg

SEQ ID NO: 1101473 - DNA, 15 bp, Homo sapiens
cagcatgaggacaga

SEQ ID NO: 1101474 - DNA, 22 bp, Homo sapiens
cagcatgaggacagaccacaga

SEQ ID NO: 1101475 - DNA, 13 bp, Homo sapiens
cagcatgattctt

SEQ ID NO: 1101476 - DNA, 18 bp, Homo sapiens
cagccctggttctggctg

SEQ ID NO: 1101477 - DNA, 12 bp, Homo sapiens
cagccctgtcag

SEQ ID NO: 1101478 - DNA, 16 bp, Homo sapiens
cagccctgtcagtgca

SEQ ID NO: 1101479 - DNA, 18 bp, Homo sapiens
cagccctgtcagtgcagc

SEQ ID NO: 1101480 - DNA, 21 bp, Homo sapiens
cagccctgtcagtgcagcccg

SEQ ID NO: 1101481 - DNA, 11 bp, Homo sapiens
cagccctgtgg

SEQ ID NO: 1101482 - DNA, 13 bp, Homo sapiens
cagccctgtgtct

SEQ ID NO: 1101483 - DNA, 14 bp, Homo sapiens
cagccctgtgtctg

SEQ ID NO: 1101484 - DNA, 16 bp, Homo sapiens
cagcccttagcacaga

SEQ ID NO: 1101485 - DNA, 22 bp, Homo sapiens
cagcccttagcacagagaggga

SEQ ID NO: 1101486 - DNA, 16 bp, Homo sapiens
cagcccttccctggcc

SEQ ID NO: 1101487 - DNA, 15 bp, Homo sapiens
cagcccttctgcctt

SEQ ID NO: 1101488 - DNA, 11 bp, Homo sapiens
cagcccttgct

SEQ ID NO: 1101489 - DNA, 13 bp, Homo sapiens
cagcccttgcttg

SEQ ID NO: 1101490 - DNA, 13 bp, Homo sapiens
cagcccttggctt

SEQ ID NO: 1101491 - DNA, 15 bp, Homo sapiens
cagcccttgggcagt

SEQ ID NO: 1101492 - DNA, 21 bp, Homo sapiens
cagcccttgtgtgtgccctgg

SEQ ID NO: 1101493 - DNA, 22 bp, Homo sapiens
cagcccttgtgtgtgccctggg

SEQ ID NO: 1101494 - DNA, 14 bp, Homo sapiens
cagccgaccctcct

SEQ ID NO: 1101495 - DNA, 17 bp, Homo sapiens
cagccgaccctcctggc

SEQ ID NO: 1101496 - DNA, 19 bp, Homo sapiens
cagccgaccctcctggcct

SEQ ID NO: 1101497 - DNA, 22 bp, Homo sapiens
cagccgaccctcctggccttcc

SEQ ID NO: 1101498 - DNA, 14 bp, Homo sapiens
cagccgagctcgtg

SEQ ID NO: 1101499 - DNA, 16 bp, Homo sapiens
cagccgcagcctccct

SEQ ID NO: 1101500 - DNA, 15 bp, Homo sapiens
cagccgccagctggg

SEQ ID NO: 1101501 - DNA, 21 bp, Homo sapiens
cagccgccattgccaccagga

SEQ ID NO: 1101502 - DNA, 22 bp, Homo sapiens
cagccgccattgccaccaggag

SEQ ID NO: 1101503 - DNA, 23 bp, Homo sapiens
cagccgccattgccaccaggaga

SEQ ID NO: 1101504 - DNA, 14 bp, Homo sapiens
cagccgctaggaga

SEQ ID NO: 1101505 - DNA, 21 bp, Homo sapiens
cagccgctaggagagactgaa

SEQ ID NO: 1101506 - DNA, 12 bp, Homo sapiens
cagccgctcctg

SEQ ID NO: 1101507 - DNA, 14 bp, Homo sapiens
cagccgctcctgtc

SEQ ID NO: 1101508 - DNA, 19 bp, Homo sapiens
cagccgctgagcgaggaga

SEQ ID NO: 1101509 - DNA, 13 bp, Homo sapiens
cagccgctgcagg

SEQ ID NO: 1101510 - DNA, 22 bp, Homo sapiens
cagccgctgcagggctcccatg

SEQ ID NO: 1101511 - DNA, 14 bp, Homo sapiens
cagccgcttctgac

SEQ ID NO: 1101512 - DNA, 19 bp, Homo sapiens
cagccggaatagagcctcg

SEQ ID NO: 1101513 - DNA, 13 bp, Homo sapiens
cagccggcacagg

SEQ ID NO: 1101514 - DNA, 15 bp, Homo sapiens
cagccggcacagggt

SEQ ID NO: 1101515 - DNA, 18 bp, Homo sapiens
cagccggcacagggtctg

SEQ ID NO: 1101516 - DNA, 14 bp, Homo sapiens
cagccggcacccac

SEQ ID NO: 1101517 - DNA, 16 bp, Homo sapiens
cagccggccaatggaa

SEQ ID NO: 1101518 - DNA, 17 bp, Homo sapiens
cagccggcctctctggc

SEQ ID NO: 1101519 - DNA, 20 bp, Homo sapiens
cagccggcctctctggcctc

SEQ ID NO: 1101520 - DNA, 15 bp, Homo sapiens
cagccggtcagagga

SEQ ID NO: 1101521 - DNA, 15 bp, Homo sapiens
cagccggtgcctggc

SEQ ID NO: 1101522 - DNA, 18 bp, Homo sapiens
cagccgtcagccaaatgt

SEQ ID NO: 1101523 - DNA, 14 bp, Homo sapiens
cagccgtcagccat

SEQ ID NO: 1101524 - DNA, 15 bp, Homo sapiens
cagccgtcagccatc

SEQ ID NO: 1101525 - DNA, 16 bp, Homo sapiens
cagccgtcccaggcca

SEQ ID NO: 1101526 - DNA, 20 bp, Homo sapiens
cagccgtcccgcgttcaaga

SEQ ID NO: 1101527 - DNA, 17 bp, Homo sapiens
cagccgtgatgctcagg

SEQ ID NO: 1101528 - DNA, 15 bp, Homo sapiens
cagccgttttcctca

SEQ ID NO: 1101529 - DNA, 16 bp, Homo sapiens
cagccgttttcctcat

SEQ ID NO: 1101530 - DNA, 18 bp, Homo sapiens
cagccgttttcctcatcc

SEQ ID NO: 1101531 - DNA, 18 bp, Homo sapiens
cagcctagccgacctcag

SEQ ID NO: 1101532 - DNA, 22 bp, Homo sapiens
cagcctagccgacctcagcctt

SEQ ID NO: 1101533 - DNA, 15 bp, Homo sapiens
cagcctaggacgcca

SEQ ID NO: 1101534 - DNA, 19 bp, Homo sapiens
cagcctaggggtcagggac

SEQ ID NO: 1101535 - DNA, 18 bp, Homo sapiens
cagcctatagtaaatgtg

SEQ ID NO: 1101536 - DNA, 19 bp, Homo sapiens
cagcctatgagcatcctga

SEQ ID NO: 1101537 - DNA, 17 bp, Homo sapiens
cagcctatgggggctct

SEQ ID NO: 1101538 - DNA, 17 bp, Homo sapiens
cagcctcaaggccctcg

SEQ ID NO: 1101539 - DNA, 21 bp, Homo sapiens
cagcctcacgcccccaggaat

SEQ ID NO: 1101540 - DNA, 19 bp, Homo sapiens
cagcctcagaaggccccag

SEQ ID NO: 1101541 - DNA, 21 bp, Homo sapiens
cagcctcagaaggccccagag

SEQ ID NO: 1101542 - DNA, 11 bp, Homo sapiens
cagcctcagcc

SEQ ID NO: 1101543 - DNA, 13 bp, Homo sapiens
cagcctcagccca

SEQ ID NO: 1101544 - DNA, 14 bp, Homo sapiens
cagcctcagcccaa

SEQ ID NO: 1101545 - DNA, 23 bp, Homo sapiens
cagcctcaggcttgagggagggc

SEQ ID NO: 1101546 - DNA, 14 bp, Homo sapiens
cagcctcagtgcca

SEQ ID NO: 1101547 - DNA, 16 bp, Homo sapiens
cagcctcagtgccact

SEQ ID NO: 1101548 - DNA, 20 bp, Homo sapiens
cagcctcatactcctgggct

SEQ ID NO: 1101549 - DNA, 18 bp, Homo sapiens
cagcctcattcagcatgg

SEQ ID NO: 1101550 - DNA, 18 bp, Homo sapiens
cagcctcattgtgccaag

SEQ ID NO: 1101551 - DNA, 19 bp, Homo sapiens
cagcctcattgtgccaagc

SEQ ID NO: 1101552 - DNA, 21 bp, Homo sapiens
cagcctcattgtgccaagcct

SEQ ID NO: 1101553 - DNA, 12 bp, Homo sapiens
cagcctccaaag

SEQ ID NO: 1101554 - DNA, 15 bp, Homo sapiens
cagcctccaaagtgg

SEQ ID NO: 1101555 - DNA, 12 bp, Homo sapiens
cagcctccagag

SEQ ID NO: 1101556 - DNA, 21 bp, Homo sapiens
cagcctccagagaagccccgc

SEQ ID NO: 1101557 - DNA, 14 bp, Homo sapiens
cagcctccagagcc

SEQ ID NO: 1101558 - DNA, 15 bp, Homo sapiens
cagcctccagagcca

SEQ ID NO: 1101559 - DNA, 17 bp, Homo sapiens
cagcctccagagccagc

SEQ ID NO: 1101560 - DNA, 21 bp, Homo sapiens
cagcctccagagccagcctgg

SEQ ID NO: 1101561 - DNA, 23 bp, Homo sapiens
cagcctccagagccagcctggga

SEQ ID NO: 1101562 - DNA, 12 bp, Homo sapiens
cagcctccaggc

SEQ ID NO: 1101563 - DNA, 14 bp, Homo sapiens
cagcctccagttgt

SEQ ID NO: 1101564 - DNA, 22 bp, Homo sapiens
cagcctcccaaagtgctgggat

SEQ ID NO: 1101565 - DNA, 18 bp, Homo sapiens
cagcctcccaagtagctg

SEQ ID NO: 1101566 - DNA, 21 bp, Homo sapiens
cagcctcccaagtagctggga

SEQ ID NO: 1101567 - DNA, 14 bp, Homo sapiens
cagcctcccatcca

SEQ ID NO: 1101568 - DNA, 23 bp, Homo sapiens
cagcctcccatccagggccccca

SEQ ID NO: 1101569 - DNA, 22 bp, Homo sapiens
cagcctccccaccccagtggga

SEQ ID NO: 1101570 - DNA, 12 bp, Homo sapiens
cagcctcccccg

SEQ ID NO: 1101571 - DNA, 23 bp, Homo sapiens
cagcctccccctgtcccctctat

SEQ ID NO: 1101572 - DNA, 18 bp, Homo sapiens
cagcctcccctcccctgg

SEQ ID NO: 1101573 - DNA, 19 bp, Homo sapiens
cagcctcccctcccctggg

SEQ ID NO: 1101574 - DNA, 16 bp, Homo sapiens
cagcctcccctgccag

SEQ ID NO: 1101575 - DNA, 22 bp, Homo sapiens
cagcctccccttcttcccgccc

SEQ ID NO: 1101576 - DNA, 21 bp, Homo sapiens
cagcctcccgagtagctggga

SEQ ID NO: 1101577 - DNA, 17 bp, Homo sapiens
cagcctccctcagcccc

SEQ ID NO: 1101578 - DNA, 13 bp, Homo sapiens
cagcctccctctg

SEQ ID NO: 1101579 - DNA, 14 bp, Homo sapiens
cagcctccctctga

SEQ ID NO: 1101580 - DNA, 23 bp, Homo sapiens
cagcctccctctgacctgcaggc

SEQ ID NO: 1101581 - DNA, 13 bp, Homo sapiens
cagcctccctgag

SEQ ID NO: 1101582 - DNA, 19 bp, Homo sapiens
cagcctccctgagcctgca

SEQ ID NO: 1101583 - DNA, 21 bp, Homo sapiens
cagcctccctgagcctgcatt

SEQ ID NO: 1101584 - DNA, 13 bp, Homo sapiens
cagcctccctgtc

SEQ ID NO: 1101585 - DNA, 14 bp, Homo sapiens
cagcctccctgtct

SEQ ID NO: 1101586 - DNA, 22 bp, Homo sapiens
cagcctccctgtctccagctgc

SEQ ID NO: 1101587 - DNA, 17 bp, Homo sapiens
cagcctccgagagggag

SEQ ID NO: 1101588 - DNA, 17 bp, Homo sapiens
cagcctccgccattcca

SEQ ID NO: 1101589 - DNA, 23 bp, Homo sapiens
cagcctccgggcgtgtgaagaac

SEQ ID NO: 1101590 - DNA, 21 bp, Homo sapiens
cagcctcctgagcctgtgggt

SEQ ID NO: 1101591 - DNA, 18 bp, Homo sapiens
cagcctccttgctgaccc

SEQ ID NO: 1101592 - DNA, 21 bp, Homo sapiens
cagcctcctttgtgtgtattc

SEQ ID NO: 1101593 - DNA, 18 bp, Homo sapiens
cagcctcgaggctggtgg

SEQ ID NO: 1101594 - DNA, 19 bp, Homo sapiens
cagcctcgagtgcccctgt

SEQ ID NO: 1101595 - DNA, 16 bp, Homo sapiens
cagcctcgcacaggcc

SEQ ID NO: 1101596 - DNA, 20 bp, Homo sapiens
cagcctcgcacaggccctag

SEQ ID NO: 1101597 - DNA, 21 bp, Homo sapiens
cagcctcgcacaggccctagc

SEQ ID NO: 1101598 - DNA, 13 bp, Homo sapiens
cagctaccccttc

SEQ ID NO: 1101599 - DNA, 24 bp, Homo sapiens
cagctaccctttttctccagctgg

SEQ ID NO: 1101600 - DNA, 14 bp, Homo sapiens
cagctacctgagac

SEQ ID NO: 1101601 - DNA, 20 bp, Homo sapiens
cagctacctgagacgggcat

SEQ ID NO: 1101602 - DNA, 17 bp, Homo sapiens
cagctactaatgatgtt

SEQ ID NO: 1101603 - DNA, 19 bp, Homo sapiens
cagctactaatgatgtttt

SEQ ID NO: 1101604 - DNA, 23 bp, Homo sapiens
cagctactcaagaggctgaggca

SEQ ID NO: 1101605 - DNA, 16 bp, Homo sapiens
cagctactcagaagcc

SEQ ID NO: 1101606 - DNA, 19 bp, Homo sapiens
cagctactcagaagcctga

SEQ ID NO: 1101607 - DNA, 13 bp, Homo sapiens
cagctactcagga

SEQ ID NO: 1101608 - DNA, 17 bp, Homo sapiens
cagctactcgggaggct

SEQ ID NO: 1101609 - DNA, 14 bp, Homo sapiens
cagctactctgtcc

SEQ ID NO: 1101610 - DNA, 19 bp, Homo sapiens
cagctactctgtccaggcc

SEQ ID NO: 1101611 - DNA, 22 bp, Homo sapiens
cagctactctgtccaggccact

SEQ ID NO: 1101612 - DNA, 19 bp, Homo sapiens
cagctactgaaccagccac

SEQ ID NO: 1101613 - DNA, 21 bp, Homo sapiens
cagctacttcctcctccccac

SEQ ID NO: 1101614 - DNA, 16 bp, Homo sapiens
cagctacttggaaggc

SEQ ID NO: 1101615 - DNA, 17 bp, Homo sapiens
cagctacttgggagcct

SEQ ID NO: 1101616 - DNA, 19 bp, Homo sapiens
cagctacttgggagcctga

SEQ ID NO: 1101617 - DNA, 15 bp, Homo sapiens
cagctacttgggagg

SEQ ID NO: 1101618 - DNA, 18 bp, Homo sapiens
cagctacttgggaggctg

SEQ ID NO: 1101619 - DNA, 19 bp, Homo sapiens
cagctacttggtttgtgtt

SEQ ID NO: 1101620 - DNA, 22 bp, Homo sapiens
cagctagaaaacacaaaatctt

SEQ ID NO: 1101621 - DNA, 23 bp, Homo sapiens
cagctagaaataagcccaacaga

SEQ ID NO: 1101622 - DNA, 19 bp, Homo sapiens
cagctagaagatccacatc

SEQ ID NO: 1101623 - DNA, 21 bp, Homo sapiens
cagctagaagatccacatcct

SEQ ID NO: 1101624 - DNA, 15 bp, Homo sapiens
cagctagactggagt

SEQ ID NO: 1101625 - DNA, 18 bp, Homo sapiens
cagctagactggagtgag

SEQ ID NO: 1101626 - DNA, 16 bp, Homo sapiens
cagctaggaagagcag

SEQ ID NO: 1101627 - DNA, 21 bp, Homo sapiens
cagctaggaagagcaggactc

SEQ ID NO: 1101628 - DNA, 12 bp, Homo sapiens
cagctaggactg

SEQ ID NO: 1101629 - DNA, 14 bp, Homo sapiens
cagctaggactgag

SEQ ID NO: 1101630 - DNA, 17 bp, Homo sapiens
cagctaggactgaggag

SEQ ID NO: 1101631 - DNA, 20 bp, Homo sapiens
cagctaggactgaggagtgg

SEQ ID NO: 1101632 - DNA, 19 bp, Homo sapiens
cagctagtttttgtatttt

SEQ ID NO: 1101633 - DNA, 23 bp, Homo sapiens
cagctatctgcactctaaactgc

SEQ ID NO: 1101634 - DNA, 23 bp, Homo sapiens
cagctatctggtcaacctcctgg

SEQ ID NO: 1101635 - DNA, 21 bp, Homo sapiens
cagctatgcgcaatgtggcat

SEQ ID NO: 1101636 - DNA, 13 bp, Homo sapiens
cagctatgggagc

SEQ ID NO: 1101637 - DNA, 22 bp, Homo sapiens
cagctatgggagccccagggtc

SEQ ID NO: 1101638 - DNA, 18 bp, Homo sapiens
cagctattaagaaaatca

SEQ ID NO: 1101639 - DNA, 19 bp, Homo sapiens
cagctatttcagcctcctg

SEQ ID NO: 1101640 - DNA, 15 bp, Homo sapiens
cagctattttgtgaa

SEQ ID NO: 1101641 - DNA, 19 bp, Homo sapiens
cagctcaactcacagcttc

SEQ ID NO: 1101642 - DNA, 24 bp, Homo sapiens
cagctcaactcgggggcgcctgga

SEQ ID NO: 1101643 - DNA, 22 bp, Homo sapiens
cagctcaagggaccctgggtgg

SEQ ID NO: 1101644 - DNA, 13 bp, Homo sapiens
cagctcacccctg

SEQ ID NO: 1101645 - DNA, 17 bp, Homo sapiens
cagctcacccctgggca

SEQ ID NO: 1101646 - DNA, 15 bp, Homo sapiens
cagctcagaacccag

SEQ ID NO: 1101647 - DNA, 16 bp, Homo sapiens
cagctcagaacccagg

SEQ ID NO: 1101648 - DNA, 21 bp, Homo sapiens
cagctcagccctggcctggct

SEQ ID NO: 1101649 - DNA, 23 bp, Homo sapiens
cagctcagccctggcctggctgg

SEQ ID NO: 1101650 - DNA, 17 bp, Homo sapiens
cagctcagcgccagcct

SEQ ID NO: 1101651 - DNA, 21 bp, Homo sapiens
cagctcaggcacacttcttct

SEQ ID NO: 1101652 - DNA, 15 bp, Homo sapiens
cagctcaggcagctc

SEQ ID NO: 1101653 - DNA, 16 bp, Homo sapiens
cagctcaggcagctcg

SEQ ID NO: 1101654 - DNA, 17 bp, Homo sapiens
cagctcaggcagctcga

SEQ ID NO: 1101655 - DNA, 19 bp, Homo sapiens
cagctcaggggacactggc

SEQ ID NO: 1101656 - DNA, 20 bp, Homo sapiens
cagctcaggggacactggcc

SEQ ID NO: 1101657 - DNA, 18 bp, Homo sapiens
cagctcagtcccatcaga

SEQ ID NO: 1101658 - DNA, 13 bp, Homo sapiens
cagctcatagaat

SEQ ID NO: 1101659 - DNA, 23 bp, Homo sapiens
cagctcatatgctgacagctctt

SEQ ID NO: 1101660 - DNA, 16 bp, Homo sapiens
cagctcatctccaagg

SEQ ID NO: 1101661 - DNA, 17 bp, Homo sapiens
cagctcatctccaagga

SEQ ID NO: 1101662 - DNA, 22 bp, Homo sapiens
cagctcatgtaggtgagcctgg

SEQ ID NO: 1101663 - DNA, 17 bp, Homo sapiens
cagctcattatgaaaaa

SEQ ID NO: 1101664 - DNA, 19 bp, Homo sapiens
cagctcattatgaaaaaca

SEQ ID NO: 1101665 - DNA, 18 bp, Homo sapiens
cagctccacacattccag

SEQ ID NO: 1101666 - DNA, 22 bp, Homo sapiens
cagctccacacattccagccag

SEQ ID NO: 1101667 - DNA, 14 bp, Homo sapiens
cagctccaggacac

SEQ ID NO: 1101668 - DNA, 14 bp, Homo sapiens
cagctccaggggcc

SEQ ID NO: 1101669 - DNA, 13 bp, Homo sapiens
cagctccagtgcc

SEQ ID NO: 1101670 - DNA, 23 bp, Homo sapiens
cagctccagtgccgctcctgctt

SEQ ID NO: 1101671 - DNA, 19 bp, Homo sapiens
cagctccatcctcttgact

SEQ ID NO: 1101672 - DNA, 14 bp, Homo sapiens
cagctccattttct

SEQ ID NO: 1101673 - DNA, 15 bp, Homo sapiens
cagctcccaccccac

SEQ ID NO: 1101674 - DNA, 21 bp, Homo sapiens
cagctcccagggtggacttca

SEQ ID NO: 1101675 - DNA, 16 bp, Homo sapiens
cagctccccggcactg

SEQ ID NO: 1101676 - DNA, 13 bp, Homo sapiens
cagctccctagac

SEQ ID NO: 1101677 - DNA, 20 bp, Homo sapiens
cagctccctaggagaccaag

SEQ ID NO: 1101678 - DNA, 14 bp, Homo sapiens
cagctccctcctgc

SEQ ID NO: 1101679 - DNA, 17 bp, Homo sapiens
cagctcccttcccttga

SEQ ID NO: 1101680 - DNA, 14 bp, Homo sapiens
cagctccctttctc

SEQ ID NO: 1101681 - DNA, 16 bp, Homo sapiens
cagctccctttctcag

SEQ ID NO: 1101682 - DNA, 17 bp, Homo sapiens
cagctccctttctcagg

SEQ ID NO: 1101683 - DNA, 20 bp, Homo sapiens
cagctccctttctcaggagc

SEQ ID NO: 1101684 - DNA, 14 bp, Homo sapiens
cagctccgcctgct

SEQ ID NO: 1101685 - DNA, 23 bp, Homo sapiens
cagctccggagggggtcctcctc

SEQ ID NO: 1101686 - DNA, 17 bp, Homo sapiens
cagctcctcagcggctc

SEQ ID NO: 1101687 - DNA, 14 bp, Homo sapiens
cagctcctccagcc

SEQ ID NO: 1101688 - DNA, 16 bp, Homo sapiens
cagctcctccagccct

SEQ ID NO: 1101689 - DNA, 17 bp, Homo sapiens
cagctcctccagccctg

SEQ ID NO: 1101690 - DNA, 13 bp, Homo sapiens
cagctcctccctg

SEQ ID NO: 1101691 - DNA, 16 bp, Homo sapiens
cagctcctccctgtgc

SEQ ID NO: 1101692 - DNA, 19 bp, Homo sapiens
cagctcctctaggggcagc

SEQ ID NO: 1101693 - DNA, 13 bp, Homo sapiens
cagctcctctgag

SEQ ID NO: 1101694 - DNA, 12 bp, Homo sapiens
cagctcctctta

SEQ ID NO: 1101695 - DNA, 14 bp, Homo sapiens
cagctcctgagtag

SEQ ID NO: 1101696 - DNA, 15 bp, Homo sapiens
cagctcctgagtagc

SEQ ID NO: 1101697 - DNA, 22 bp, Homo sapiens
cagctcctgagtagctgggcct

SEQ ID NO: 1101698 - DNA, 12 bp, Homo sapiens
cagctcctgcca

SEQ ID NO: 1101699 - DNA, 14 bp, Homo sapiens
cagctcctgccagg

SEQ ID NO: 1101700 - DNA, 15 bp, Homo sapiens
cagctccttggctgc

SEQ ID NO: 1101701 - DNA, 16 bp, Homo sapiens
cagctccttggctgca

SEQ ID NO: 1101702 - DNA, 18 bp, Homo sapiens
cagctccttggctgcagc

SEQ ID NO: 1101703 - DNA, 19 bp, Homo sapiens
cagctccttggctgcagcc

SEQ ID NO: 1101704 - DNA, 20 bp, Homo sapiens
cagctccttggctgcagcca

SEQ ID NO: 1101705 - DNA, 22 bp, Homo sapiens
cagctccttggctgcagccatc

SEQ ID NO: 1101706 - DNA, 16 bp, Homo sapiens
cagctcctttctcctg

SEQ ID NO: 1101707 - DNA, 21 bp, Homo sapiens
cagctcctttctcctgtgaat

SEQ ID NO: 1101708 - DNA, 22 bp, Homo sapiens
cagctcctttctcctgtgaatg

SEQ ID NO: 1101709 - DNA, 20 bp, Homo sapiens
cagctccttttgtccccagg

SEQ ID NO: 1101710 - DNA, 23 bp, Homo sapiens
cagctccttttgtccccagggcc

SEQ ID NO: 1101711 - DNA, 19 bp, Homo sapiens
cagctcgaattaagaatat

SEQ ID NO: 1101712 - DNA, 22 bp, Homo sapiens
cagctcggttaagtacccgagg

SEQ ID NO: 1101713 - DNA, 23 bp, Homo sapiens
cagctcggttaagtacccgaggc

SEQ ID NO: 1101714 - DNA, 23 bp, Homo sapiens
cagctcgtttttcagcaccccca

SEQ ID NO: 1101715 - DNA, 14 bp, Homo sapiens
cagctctactacct

SEQ ID NO: 1101716 - DNA, 21 bp, Homo sapiens
cagctctagacaaccctgcaa

SEQ ID NO: 1101717 - DNA, 20 bp, Homo sapiens
cagctctagttttcagcctt

SEQ ID NO: 1101718 - DNA, 12 bp, Homo sapiens
cagctctcagcc

SEQ ID NO: 1101719 - DNA, 20 bp, Homo sapiens
caggaccaaaaaacctcact

SEQ ID NO: 1101720 - DNA, 18 bp, Homo sapiens
caggaccaagggggcggg

SEQ ID NO: 1101721 - DNA, 10 bp, Homo sapiens
caggaccagc

SEQ ID NO: 1101722 - DNA, 13 bp, Homo sapiens
caggaccaggggc

SEQ ID NO: 1101723 - DNA, 16 bp, Homo sapiens
caggaccatgggacca

SEQ ID NO: 1101724 - DNA, 16 bp, Homo sapiens
caggacccagaggaag

SEQ ID NO: 1101725 - DNA, 12 bp, Homo sapiens
caggacccaggc

SEQ ID NO: 1101726 - DNA, 14 bp, Homo sapiens
caggacccaggccc

SEQ ID NO: 1101727 - DNA, 16 bp, Homo sapiens
caggacccaggccctc

SEQ ID NO: 1101728 - DNA, 15 bp, Homo sapiens
caggacccagggtcc

SEQ ID NO: 1101729 - DNA, 12 bp, Homo sapiens
caggaccccagc

SEQ ID NO: 1101730 - DNA, 14 bp, Homo sapiens
caggaccccagctc

SEQ ID NO: 1101731 - DNA, 16 bp, Homo sapiens
caggaccccagctctg

SEQ ID NO: 1101732 - DNA, 18 bp, Homo sapiens
caggaccccaggtcaggg

SEQ ID NO: 1101733 - DNA, 15 bp, Homo sapiens
caggacccccttccc

SEQ ID NO: 1101734 - DNA, 16 bp, Homo sapiens
caggacccccttcccc

SEQ ID NO: 1101735 - DNA, 18 bp, Homo sapiens
caggacccctcagctccc

SEQ ID NO: 1101736 - DNA, 21 bp, Homo sapiens
caggacccgccagccccgctc

SEQ ID NO: 1101737 - DNA, 22 bp, Homo sapiens
caggaccctcagccctggcctt

SEQ ID NO: 1101738 - DNA, 23 bp, Homo sapiens
caggaccctcagccctggccttt

SEQ ID NO: 1101739 - DNA, 13 bp, Homo sapiens
caggaccctccac

SEQ ID NO: 1101740 - DNA, 14 bp, Homo sapiens
caggaccctccact

SEQ ID NO: 1101741 - DNA, 15 bp, Homo sapiens
caggaccctgctgac

SEQ ID NO: 1101742 - DNA, 23 bp, Homo sapiens
caggacctagctgttgtaaagaa

SEQ ID NO: 1101743 - DNA, 14 bp, Homo sapiens
caggacctggctgc

SEQ ID NO: 1101744 - DNA, 13 bp, Homo sapiens
caggaccttttga

SEQ ID NO: 1101745 - DNA, 20 bp, Homo sapiens
caggaccttttgaagtagtt

SEQ ID NO: 1101746 - DNA, 14 bp, Homo sapiens
caggacgagatgac

SEQ ID NO: 1101747 - DNA, 16 bp, Homo sapiens
caggacgcttctgaat

SEQ ID NO: 1101748 - DNA, 15 bp, Homo sapiens
caggacggctcctca

SEQ ID NO: 1101749 - DNA, 17 bp, Homo sapiens
caggacggctcctcaga

SEQ ID NO: 1101750 - DNA, 21 bp, Homo sapiens
caggacggctcctcagagcgc

SEQ ID NO: 1101751 - DNA, 14 bp, Homo sapiens
caggacgtccttcc

SEQ ID NO: 1101752 - DNA, 16 bp, Homo sapiens
caggacgtccttccat

SEQ ID NO: 1101753 - DNA, 16 bp, Homo sapiens
caggactatagcccag

SEQ ID NO: 1101754 - DNA, 17 bp, Homo sapiens
caggactatagcccagg

SEQ ID NO: 1101755 - DNA, 18 bp, Homo sapiens
caggactccaggcccaag

SEQ ID NO: 1101756 - DNA, 21 bp, Homo sapiens
caggactccaggcccaaggct

SEQ ID NO: 1101757 - DNA, 19 bp, Homo sapiens
caggactccccaggccagg

SEQ ID NO: 1101758 - DNA, 20 bp, Homo sapiens
caggactccccaggccaggc

SEQ ID NO: 1101759 - DNA, 16 bp, Homo sapiens
caggactccctcctca

SEQ ID NO: 1101760 - DNA, 19 bp, Homo sapiens
caggactccctcctcacct

SEQ ID NO: 1101761 - DNA, 21 bp, Homo sapiens
caggactccctcctcacctct

SEQ ID NO: 1101762 - DNA, 23 bp, Homo sapiens
caggactccctcctcacctctgg

SEQ ID NO: 1101763 - DNA, 14 bp, Homo sapiens
caggactcctggca

SEQ ID NO: 1101764 - DNA, 18 bp, Homo sapiens
caggactcctggcagggc

SEQ ID NO: 1101765 - DNA, 22 bp, Homo sapiens
caggactcctggcagggccacc

SEQ ID NO: 1101766 - DNA, 21 bp, Homo sapiens
caggactctgcgggaggctgg

SEQ ID NO: 1101767 - DNA, 12 bp, Homo sapiens
caggactctggc

SEQ ID NO: 1101768 - DNA, 13 bp, Homo sapiens
caggactctggca

SEQ ID NO: 1101769 - DNA, 15 bp, Homo sapiens
caggactctggcact

SEQ ID NO: 1101770 - DNA, 18 bp, Homo sapiens
caggactctttgaagaaa

SEQ ID NO: 1101771 - DNA, 18 bp, Homo sapiens
caggactgaattgtcccc

SEQ ID NO: 1101772 - DNA, 16 bp, Homo sapiens
caggactgagccctct

SEQ ID NO: 1101773 - DNA, 17 bp, Homo sapiens
caggactgagccctctc

SEQ ID NO: 1101774 - DNA, 21 bp, Homo sapiens
caggactgagccctctcactc

SEQ ID NO: 1101775 - DNA, 21 bp, Homo sapiens
caggactgcaaaaatccttct

SEQ ID NO: 1101776 - DNA, 13 bp, Homo sapiens
caggactgcattg

SEQ ID NO: 1101777 - DNA, 20 bp, Homo sapiens
caggactgtaaagatttgtt

SEQ ID NO: 1101778 - DNA, 20 bp, Homo sapiens
caggacttaacggctccagg

SEQ ID NO: 1101779 - DNA, 21 bp, Homo sapiens
caggagaagaacaagaaatgg

SEQ ID NO: 1101780 - DNA, 16 bp, Homo sapiens
caggagaagagaggaa

SEQ ID NO: 1101781 - DNA, 20 bp, Homo sapiens
caggagaagctcagctgcat

SEQ ID NO: 1101782 - DNA, 19 bp, Homo sapiens
caggagaatagcttttact

SEQ ID NO: 1101783 - DNA, 21 bp, Homo sapiens
caggagaatcgcttgaacctg

SEQ ID NO: 1101784 - DNA, 22 bp, Homo sapiens
caggagaatcgcttgaacctgg

SEQ ID NO: 1101785 - DNA, 23 bp, Homo sapiens
caggagaatggggttcctgctgt

SEQ ID NO: 1101786 - DNA, 16 bp, Homo sapiens
caggagactccaagga

SEQ ID NO: 1101787 - DNA, 20 bp, Homo sapiens
caggagactccaaggagcta

SEQ ID NO: 1101788 - DNA, 23 bp, Homo sapiens
caggagactggcgtgaacccagg

SEQ ID NO: 1101789 - DNA, 18 bp, Homo sapiens
caggagagactgagcagc

SEQ ID NO: 1101790 - DNA, 17 bp, Homo sapiens
caggagagagcagcact

SEQ ID NO: 1101791 - DNA, 15 bp, Homo sapiens
caggagagagccagg

SEQ ID NO: 1101792 - DNA, 16 bp, Homo sapiens
caggagagagccagga

SEQ ID NO: 1101793 - DNA, 20 bp, Homo sapiens
caggagagattatttacaag

SEQ ID NO: 1101794 - DNA, 15 bp, Homo sapiens
caggagagccagccc

SEQ ID NO: 1101795 - DNA, 16 bp, Homo sapiens
caggagagccagccct

SEQ ID NO: 1101796 - DNA, 14 bp, Homo sapiens
caggagagcctggg

SEQ ID NO: 1101797 - DNA, 13 bp, Homo sapiens
caggagaggcagc

SEQ ID NO: 1101798 - DNA, 23 bp, Homo sapiens
caggagaggcagcatgcttgggc

SEQ ID NO: 1101799 - DNA, 18 bp, Homo sapiens
caggagagggatacaaga

SEQ ID NO: 1101800 - DNA, 20 bp, Homo sapiens
caggagagggatacaagaga

SEQ ID NO: 1101801 - DNA, 13 bp, Homo sapiens
caggagagtgtgt

SEQ ID NO: 1101802 - DNA, 21 bp, Homo sapiens
caggagagtgtgtgggcaggg

SEQ ID NO: 1101803 - DNA, 14 bp, Homo sapiens
caggagatcagcag

SEQ ID NO: 1101804 - DNA, 15 bp, Homo sapiens
caggagatcagcagc

SEQ ID NO: 1101805 - DNA, 23 bp, Homo sapiens
caggagatcgagaccatcctggc

SEQ ID NO: 1101806 - DNA, 17 bp, Homo sapiens
caggagatggagggctt

SEQ ID NO: 1101807 - DNA, 18 bp, Homo sapiens
caggagatggccccaaca

SEQ ID NO: 1101808 - DNA, 17 bp, Homo sapiens
caggagcaaatggcgtt

SEQ ID NO: 1101809 - DNA, 15 bp, Homo sapiens
caggagcaacagcct

SEQ ID NO: 1101810 - DNA, 16 bp, Homo sapiens
caggagcaatcacagg

SEQ ID NO: 1101811 - DNA, 17 bp, Homo sapiens
caggagcaatcacagga

SEQ ID NO: 1101812 - DNA, 15 bp, Homo sapiens
caggagcacaggcag

SEQ ID NO: 1101813 - DNA, 16 bp, Homo sapiens
caggagcacaggcagc

SEQ ID NO: 1101814 - DNA, 18 bp, Homo sapiens
caggagcacaggcagctg

SEQ ID NO: 1101815 - DNA, 23 bp, Homo sapiens
caggagcacaggcagctggatga

SEQ ID NO: 1101816 - DNA, 18 bp, Homo sapiens
caggagcagatggacagc

SEQ ID NO: 1101817 - DNA, 15 bp, Homo sapiens
caggagcaggaccta

SEQ ID NO: 1101818 - DNA, 14 bp, Homo sapiens
caggagcagggcgg

SEQ ID NO: 1101819 - DNA, 22 bp, Homo sapiens
caggagcatgtatgtctgcagg

SEQ ID NO: 1101820 - DNA, 18 bp, Homo sapiens
caggagcccccaacacag

SEQ ID NO: 1101821 - DNA, 19 bp, Homo sapiens
caggagcccccaacacagg

SEQ ID NO: 1101822 - DNA, 20 bp, Homo sapiens
caggagcccccaacacaggc

SEQ ID NO: 1101823 - DNA, 15 bp, Homo sapiens
caggagccccgccac

SEQ ID NO: 1101824 - DNA, 14 bp, Homo sapiens
caggagcccctggg

SEQ ID NO: 1101825 - DNA, 15 bp, Homo sapiens
caggagcctccctgc

SEQ ID NO: 1101826 - DNA, 16 bp, Homo sapiens
caggagcctccctgca

SEQ ID NO: 1101827 - DNA, 20 bp, Homo sapiens
caggagcctggtccttccct

SEQ ID NO: 1101828 - DNA, 15 bp, Homo sapiens
caggagcgcaagata

SEQ ID NO: 1101829 - DNA, 15 bp, Homo sapiens
caggagctcaggaag

SEQ ID NO: 1101830 - DNA, 12 bp, Homo sapiens
caggagctctgc

SEQ ID NO: 1101831 - DNA, 16 bp, Homo sapiens
caggagctctgcgcca

SEQ ID NO: 1101832 - DNA, 19 bp, Homo sapiens
caggagctctgcgccaggc

SEQ ID NO: 1101833 - DNA, 21 bp, Homo sapiens
caggagctctgcgccaggcag

SEQ ID NO: 1101834 - DNA, 12 bp, Homo sapiens
caggagctcttc

SEQ ID NO: 1101835 - DNA, 15 bp, Homo sapiens
caggagctcttcagg

SEQ ID NO: 1101836 - DNA, 19 bp, Homo sapiens
caggagctcttcaggcctc

SEQ ID NO: 1101837 - DNA, 22 bp, Homo sapiens
caggagctcttcaggcctccct

SEQ ID NO: 1101838 - DNA, 12 bp, Homo sapiens
caggagctgagt

SEQ ID NO: 1101839 - DNA, 14 bp, Homo sapiens
caggagctgagtca

SEQ ID NO: 1101840 - DNA, 21 bp, Homo sapiens
caggagctgagtcacctcctc

SEQ ID NO: 1101841 - DNA, 15 bp, Homo sapiens
caggccagcctccga

SEQ ID NO: 1101842 - DNA, 14 bp, Homo sapiens
caggccagcctgtc

SEQ ID NO: 1101843 - DNA, 17 bp, Homo sapiens
caggccagcctgtccct

SEQ ID NO: 1101844 - DNA, 14 bp, Homo sapiens
caggccagcgtgga

SEQ ID NO: 1101845 - DNA, 17 bp, Homo sapiens
caggccaggctgcctcg

SEQ ID NO: 1101846 - DNA, 16 bp, Homo sapiens
caggccaggtgcagtg

SEQ ID NO: 1101847 - DNA, 22 bp, Homo sapiens
caggccaggtgggaacggctga

SEQ ID NO: 1101848 - DNA, 19 bp, Homo sapiens
caggccagtgggcctggta

SEQ ID NO: 1101849 - DNA, 16 bp, Homo sapiens
caggccatgtggcctg

SEQ ID NO: 1101850 - DNA, 23 bp, Homo sapiens
caggccatgtggcctgcccagcc

SEQ ID NO: 1101851 - DNA, 19 bp, Homo sapiens
caggcccaagagatgaaga

SEQ ID NO: 1101852 - DNA, 13 bp, Homo sapiens
caggcccaccatc

SEQ ID NO: 1101853 - DNA, 23 bp, Homo sapiens
caggcccaccatcaccaccgcct

SEQ ID NO: 1101854 - DNA, 20 bp, Homo sapiens
caggcccacgaggagcagca

SEQ ID NO: 1101855 - DNA, 23 bp, Homo sapiens
caggcccactccccagccccagc

SEQ ID NO: 1101856 - DNA, 15 bp, Homo sapiens
caggcccactgtgcc

SEQ ID NO: 1101857 - DNA, 16 bp, Homo sapiens
caggcccactgtgcct

SEQ ID NO: 1101858 - DNA, 19 bp, Homo sapiens
caggcccactgtgcctcag

SEQ ID NO: 1101859 - DNA, 10 bp, Homo sapiens
caggcccagc

SEQ ID NO: 1101860 - DNA, 12 bp, Homo sapiens
caggcccagcat

SEQ ID NO: 1101861 - DNA, 15 bp, Homo sapiens
caggcccagcatgca

SEQ ID NO: 1101862 - DNA, 20 bp, Homo sapiens
caggcccagcattgctggtt

SEQ ID NO: 1101863 - DNA, 14 bp, Homo sapiens
caggcccagccctc

SEQ ID NO: 1101864 - DNA, 21 bp, Homo sapiens
caggcccagctgctcccctgg

SEQ ID NO: 1101865 - DNA, 22 bp, Homo sapiens
caggcccagctgctcccctgga

SEQ ID NO: 1101866 - DNA, 19 bp, Homo sapiens
caggcccaggccagccccc

SEQ ID NO: 1101867 - DNA, 16 bp, Homo sapiens
caggcccatctcaggt

SEQ ID NO: 1101868 - DNA, 22 bp, Homo sapiens
caggccccaaaaccacagccct

SEQ ID NO: 1101869 - DNA, 13 bp, Homo sapiens
caggccccacgcc

SEQ ID NO: 1101870 - DNA, 15 bp, Homo sapiens
caggccccacgccct

SEQ ID NO: 1101871 - DNA, 23 bp, Homo sapiens
caggccccacgccctctcctccc

SEQ ID NO: 1101872 - DNA, 17 bp, Homo sapiens
caggccccactccttcc

SEQ ID NO: 1101873 - DNA, 15 bp, Homo sapiens
caggccccagcctcc

SEQ ID NO: 1101874 - DNA, 18 bp, Homo sapiens
caggccccaggcagggcc

SEQ ID NO: 1101875 - DNA, 19 bp, Homo sapiens
caggcccccggctttcctc

SEQ ID NO: 1101876 - DNA, 21 bp, Homo sapiens
caggcccccggctttcctccg

SEQ ID NO: 1101877 - DNA, 13 bp, Homo sapiens
caggccccctagg

SEQ ID NO: 1101878 - DNA, 14 bp, Homo sapiens
caggccccctagga

SEQ ID NO: 1101879 - DNA, 17 bp, Homo sapiens
caggccccgcttgtcca

SEQ ID NO: 1101880 - DNA, 18 bp, Homo sapiens
caggccccgcttgtccag

SEQ ID NO: 1101881 - DNA, 23 bp, Homo sapiens
caggccccgcttgtccagcgcct

SEQ ID NO: 1101882 - DNA, 14 bp, Homo sapiens
caggcccctgagga

SEQ ID NO: 1101883 - DNA, 19 bp, Homo sapiens
caggcccctgaggactgga

SEQ ID NO: 1101884 - DNA, 20 bp, Homo sapiens
caggcccctgaggactggag

SEQ ID NO: 1101885 - DNA, 18 bp, Homo sapiens
caggcccgcgggcacagc

SEQ ID NO: 1101886 - DNA, 18 bp, Homo sapiens
caggcccggcgcggtggc

SEQ ID NO: 1101887 - DNA, 16 bp, Homo sapiens
caggcccggggctggc

SEQ ID NO: 1101888 - DNA, 16 bp, Homo sapiens
caggcccgtcggagct

SEQ ID NO: 1101889 - DNA, 17 bp, Homo sapiens
caggcccgtcggagctg

SEQ ID NO: 1101890 - DNA, 20 bp, Homo sapiens
caggcccgtcggagctgcct

SEQ ID NO: 1101891 - DNA, 21 bp, Homo sapiens
caggcccgtcggagctgcctg

SEQ ID NO: 1101892 - DNA, 24 bp, Homo sapiens
caggcccgtcggagctgcctgcag

SEQ ID NO: 1101893 - DNA, 17 bp, Homo sapiens
caggccctacaatgctc

SEQ ID NO: 1101894 - DNA, 19 bp, Homo sapiens
caggccctccatgggctag

SEQ ID NO: 1101895 - DNA, 15 bp, Homo sapiens
caggccctcccacca

SEQ ID NO: 1101896 - DNA, 22 bp, Homo sapiens
caggccctccctctactcttcc

SEQ ID NO: 1101897 - DNA, 16 bp, Homo sapiens
caggccctccctgact

SEQ ID NO: 1101898 - DNA, 20 bp, Homo sapiens
caggccctccctgactccct

SEQ ID NO: 1101899 - DNA, 22 bp, Homo sapiens
caggccctccctgactccctgt

SEQ ID NO: 1101900 - DNA, 14 bp, Homo sapiens
caggccctccctgt

SEQ ID NO: 1101901 - DNA, 14 bp, Homo sapiens
caggccctctgcct

SEQ ID NO: 1101902 - DNA, 16 bp, Homo sapiens
caggccctctgcctgc

SEQ ID NO: 1101903 - DNA, 20 bp, Homo sapiens
caggccctctgcctgcactc

SEQ ID NO: 1101904 - DNA, 16 bp, Homo sapiens
caggccctctgtggcc

SEQ ID NO: 1101905 - DNA, 21 bp, Homo sapiens
caggccctgactcctctggct

SEQ ID NO: 1101906 - DNA, 22 bp, Homo sapiens
caggccctgactcctctggctt

SEQ ID NO: 1101907 - DNA, 23 bp, Homo sapiens
caggccctgccagtggggaagga

SEQ ID NO: 1101908 - DNA, 22 bp, Homo sapiens
caggccctgccattggcctctt

SEQ ID NO: 1101909 - DNA, 13 bp, Homo sapiens
caggccctgtcca

SEQ ID NO: 1101910 - DNA, 16 bp, Homo sapiens
caggccctgtccagcc

SEQ ID NO: 1101911 - DNA, 17 bp, Homo sapiens
caggccctgtggcagga

SEQ ID NO: 1101912 - DNA, 17 bp, Homo sapiens
caggcccttagggaagt

SEQ ID NO: 1101913 - DNA, 19 bp, Homo sapiens
caggcccttagggaagttg

SEQ ID NO: 1101914 - DNA, 15 bp, Homo sapiens
caggcccttcctctc

SEQ ID NO: 1101915 - DNA, 16 bp, Homo sapiens
caggcccttcctctcc

SEQ ID NO: 1101916 - DNA, 16 bp, Homo sapiens
caggcccttggctgca

SEQ ID NO: 1101917 - DNA, 19 bp, Homo sapiens
caggccctttgaagcctca

SEQ ID NO: 1101918 - DNA, 15 bp, Homo sapiens
caggccgacagtcgg

SEQ ID NO: 1101919 - DNA, 18 bp, Homo sapiens
caggccgacagtcggtga

SEQ ID NO: 1101920 - DNA, 21 bp, Homo sapiens
caggccgacagtcggtgaccc

SEQ ID NO: 1101921 - DNA, 15 bp, Homo sapiens
caggccgcagctctt

SEQ ID NO: 1101922 - DNA, 22 bp, Homo sapiens
caggccgcagctcttgcccttc

SEQ ID NO: 1101923 - DNA, 17 bp, Homo sapiens
caggccggagcccagat

SEQ ID NO: 1101924 - DNA, 18 bp, Homo sapiens
caggccggagcccagata

SEQ ID NO: 1101925 - DNA, 15 bp, Homo sapiens
caggccggcccagat

SEQ ID NO: 1101926 - DNA, 16 bp, Homo sapiens
caggccggcccagatg

SEQ ID NO: 1101927 - DNA, 22 bp, Homo sapiens
caggccggtgtgggctgtgtcg

SEQ ID NO: 1101928 - DNA, 16 bp, Homo sapiens
caggccgtgccttgtt

SEQ ID NO: 1101929 - DNA, 20 bp, Homo sapiens
caggccgttccccttggctt

SEQ ID NO: 1101930 - DNA, 15 bp, Homo sapiens
caggcctaagacatg

SEQ ID NO: 1101931 - DNA, 14 bp, Homo sapiens
caggcctaggaggc

SEQ ID NO: 1101932 - DNA, 15 bp, Homo sapiens
caggcctaggaggcc

SEQ ID NO: 1101933 - DNA, 18 bp, Homo sapiens
caggcctaggaggccccc

SEQ ID NO: 1101934 - DNA, 16 bp, Homo sapiens
caggcctatttcatca

SEQ ID NO: 1101935 - DNA, 19 bp, Homo sapiens
caggcctcacctctaccca

SEQ ID NO: 1101936 - DNA, 22 bp, Homo sapiens
caggcctcacctctacccaaac

SEQ ID NO: 1101937 - DNA, 12 bp, Homo sapiens
caggcctcactg

SEQ ID NO: 1101938 - DNA, 20 bp, Homo sapiens
caggcctccaacgcccctgt

SEQ ID NO: 1101939 - DNA, 22 bp, Homo sapiens
caggcctccaacgcccctgtgg

SEQ ID NO: 1101940 - DNA, 14 bp, Homo sapiens
caggcctccagcct

SEQ ID NO: 1101941 - DNA, 16 bp, Homo sapiens
caggcctccagcctct

SEQ ID NO: 1101942 - DNA, 16 bp, Homo sapiens
caggcctccctagcac

SEQ ID NO: 1101943 - DNA, 17 bp, Homo sapiens
caggcctccctagcacc

SEQ ID NO: 1101944 - DNA, 17 bp, Homo sapiens
caggcctccctctctct

SEQ ID NO: 1101945 - DNA, 18 bp, Homo sapiens
caggcctccctctctctt

SEQ ID NO: 1101946 - DNA, 19 bp, Homo sapiens
caggcctccctctctcttc

SEQ ID NO: 1101947 - DNA, 22 bp, Homo sapiens
caggcctccctctctcttctgc

SEQ ID NO: 1101948 - DNA, 13 bp, Homo sapiens
caggcctccctga

SEQ ID NO: 1101949 - DNA, 16 bp, Homo sapiens
caggcctctctctgct

SEQ ID NO: 1101950 - DNA, 18 bp, Homo sapiens
caggcctctctctgctcc

SEQ ID NO: 1101951 - DNA, 19 bp, Homo sapiens
caggcctctctctgctcca

SEQ ID NO: 1101952 - DNA, 18 bp, Homo sapiens
caggcctctggttgcctc

SEQ ID NO: 1101953 - DNA, 20 bp, Homo sapiens
caggcctctggttgcctccc

SEQ ID NO: 1101954 - DNA, 12 bp, Homo sapiens
caggcctctgtg

SEQ ID NO: 1101955 - DNA, 14 bp, Homo sapiens
caggcctctgtgtc

SEQ ID NO: 1101956 - DNA, 15 bp, Homo sapiens
caggcctctgtgtcc

SEQ ID NO: 1101957 - DNA, 16 bp, Homo sapiens
caggcctcttcctgtt

SEQ ID NO: 1101958 - DNA, 18 bp, Homo sapiens
caggcctcttggcagtca

SEQ ID NO: 1101959 - DNA, 19 bp, Homo sapiens
caggcctcttggcagtcac

SEQ ID NO: 1101960 - DNA, 15 bp, Homo sapiens
caggcctgaaagagg

SEQ ID NO: 1101961 - DNA, 12 bp, Homo sapiens
caggcctgaccc

SEQ ID NO: 1101962 - DNA, 21 bp, Homo sapiens
caggcctgagaatgagtggga

SEQ ID NO: 1101963 - DNA, 22 bp, Homo sapiens
cagggccgctcgatgcctttgc

SEQ ID NO: 1101964 - DNA, 23 bp, Homo sapiens
cagggcctactgccacccgcttc

SEQ ID NO: 1101965 - DNA, 13 bp, Homo sapiens
cagggcctcatct

SEQ ID NO: 1101966 - DNA, 17 bp, Homo sapiens
cagggcctcatctcacc

SEQ ID NO: 1101967 - DNA, 18 bp, Homo sapiens
cagggcctcatctcacct

SEQ ID NO: 1101968 - DNA, 15 bp, Homo sapiens
cagggcctccagggc

SEQ ID NO: 1101969 - DNA, 19 bp, Homo sapiens
cagggcctccagggcccag

SEQ ID NO: 1101970 - DNA, 14 bp, Homo sapiens
cagggcctgacacc

SEQ ID NO: 1101971 - DNA, 19 bp, Homo sapiens
cagggcctgacaccccctc

SEQ ID NO: 1101972 - DNA, 20 bp, Homo sapiens
cagggcctgacttgagccac

SEQ ID NO: 1101973 - DNA, 21 bp, Homo sapiens
cagggcctgacttgagccact

SEQ ID NO: 1101974 - DNA, 18 bp, Homo sapiens
cagggcctgcttcccctt

SEQ ID NO: 1101975 - DNA, 21 bp, Homo sapiens
cagggcctgcttccccttcct

SEQ ID NO: 1101976 - DNA, 13 bp, Homo sapiens
cagggcctggagc

SEQ ID NO: 1101977 - DNA, 14 bp, Homo sapiens
cagggcctggagcc

SEQ ID NO: 1101978 - DNA, 12 bp, Homo sapiens
cagggcctgggg

SEQ ID NO: 1101979 - DNA, 22 bp, Homo sapiens
cagggcctggggagatggagga

SEQ ID NO: 1101980 - DNA, 13 bp, Homo sapiens
cagggcctggggc

SEQ ID NO: 1101981 - DNA, 19 bp, Homo sapiens
cagggcctggggcctgaga

SEQ ID NO: 1101982 - DNA, 23 bp, Homo sapiens
cagggcctggggcctgagagaat

SEQ ID NO: 1101983 - DNA, 14 bp, Homo sapiens
cagggccttgccca

SEQ ID NO: 1101984 - DNA, 16 bp, Homo sapiens
cagggccttgcccaga

SEQ ID NO: 1101985 - DNA, 19 bp, Homo sapiens
cagggccttgcccagagat

SEQ ID NO: 1101986 - DNA, 24 bp, Homo sapiens
cagggccttgcccagagatgcctc

SEQ ID NO: 1101987 - DNA, 18 bp, Homo sapiens
cagggccttggcccaggg

SEQ ID NO: 1101988 - DNA, 17 bp, Homo sapiens
cagggcctttctcctcc

SEQ ID NO: 1101989 - DNA, 18 bp, Homo sapiens
cagggcctttctcctccc

SEQ ID NO: 1101990 - DNA, 23 bp, Homo sapiens
cagggcctttctcctccccacct

SEQ ID NO: 1101991 - DNA, 23 bp, Homo sapiens
cagggcgataaaactaaatatat

SEQ ID NO: 1101992 - DNA, 20 bp, Homo sapiens
cagggcgcccctgggagaca

SEQ ID NO: 1101993 - DNA, 18 bp, Homo sapiens
cagggcgctgggaagggg

SEQ ID NO: 1101994 - DNA, 13 bp, Homo sapiens
cagggcggccagg

SEQ ID NO: 1101995 - DNA, 14 bp, Homo sapiens
cagggcggccaggg

SEQ ID NO: 1101996 - DNA, 19 bp, Homo sapiens
cagggcggccagggaccca

SEQ ID NO: 1101997 - DNA, 15 bp, Homo sapiens
cagggcggctgccga

SEQ ID NO: 1101998 - DNA, 21 bp, Homo sapiens
cagggcggctgccgactcccc

SEQ ID NO: 1101999 - DNA, 16 bp, Homo sapiens
cagggcgggcagaggg

SEQ ID NO: 1102000 - DNA, 17 bp, Homo sapiens
cagggcgggcagagggc

SEQ ID NO: 1102001 - DNA, 19 bp, Homo sapiens
cagggcgggggggggggcg

SEQ ID NO: 1102002 - DNA, 23 bp, Homo sapiens
cagggcgggggggggggcggtgt

SEQ ID NO: 1102003 - DNA, 22 bp, Homo sapiens
cagggcggtaccttgtgcccag

SEQ ID NO: 1102004 - DNA, 23 bp, Homo sapiens
cagggcggtaccttgtgcccagg

SEQ ID NO: 1102005 - DNA, 15 bp, Homo sapiens
cagggctaccctccc

SEQ ID NO: 1102006 - DNA, 17 bp, Homo sapiens
cagggctaccctccccc

SEQ ID NO: 1102007 - DNA, 24 bp, Homo sapiens
cagggctaccctgagctgaggcag

SEQ ID NO: 1102008 - DNA, 22 bp, Homo sapiens
cagggctagtgaagtggcctct

SEQ ID NO: 1102009 - DNA, 18 bp, Homo sapiens
cagggctagtgacttgtg

SEQ ID NO: 1102010 - DNA, 15 bp, Homo sapiens
cagggctcacactcc

SEQ ID NO: 1102011 - DNA, 17 bp, Homo sapiens
cagggctcacactcctg

SEQ ID NO: 1102012 - DNA, 17 bp, Homo sapiens
cagggctcacagggcag

SEQ ID NO: 1102013 - DNA, 23 bp, Homo sapiens
cagggctcacagggcaggccttg

SEQ ID NO: 1102014 - DNA, 13 bp, Homo sapiens
cagggctcagagt

SEQ ID NO: 1102015 - DNA, 19 bp, Homo sapiens
cagggctcagagtgaccct

SEQ ID NO: 1102016 - DNA, 14 bp, Homo sapiens
cagggctcagcctg

SEQ ID NO: 1102017 - DNA, 15 bp, Homo sapiens
cagggctcagcctgg

SEQ ID NO: 1102018 - DNA, 13 bp, Homo sapiens
cagggctccaaat

SEQ ID NO: 1102019 - DNA, 16 bp, Homo sapiens
cagggctccagcccct

SEQ ID NO: 1102020 - DNA, 14 bp, Homo sapiens
cagggctcccaggg

SEQ ID NO: 1102021 - DNA, 12 bp, Homo sapiens
cagggctcccat

SEQ ID NO: 1102022 - DNA, 12 bp, Homo sapiens
cagggctccctc

SEQ ID NO: 1102023 - DNA, 20 bp, Homo sapiens
cagggctccctcctggagca

SEQ ID NO: 1102024 - DNA, 21 bp, Homo sapiens
cagggctccctcctggagcat

SEQ ID NO: 1102025 - DNA, 15 bp, Homo sapiens
cagggctcctcccag

SEQ ID NO: 1102026 - DNA, 18 bp, Homo sapiens
cagggctcctcccagctt

SEQ ID NO: 1102027 - DNA, 11 bp, Homo sapiens
cagggctcctg

SEQ ID NO: 1102028 - DNA, 14 bp, Homo sapiens
cagggctcctgcac

SEQ ID NO: 1102029 - DNA, 13 bp, Homo sapiens
cagggctcctggg

SEQ ID NO: 1102030 - DNA, 16 bp, Homo sapiens
cagggctctgcaggcc

SEQ ID NO: 1102031 - DNA, 19 bp, Homo sapiens
cagggctctgccccagtcg

SEQ ID NO: 1102032 - DNA, 16 bp, Homo sapiens
cagggctgagcgtgga

SEQ ID NO: 1102033 - DNA, 21 bp, Homo sapiens
cagggctgagcgtggaagggg

SEQ ID NO: 1102034 - DNA, 23 bp, Homo sapiens
cagggctgccctgagaagctgct

SEQ ID NO: 1102035 - DNA, 24 bp, Homo sapiens
cagggctgctccccaacacctgcc

SEQ ID NO: 1102036 - DNA, 21 bp, Homo sapiens
cagggctgctgggggcaactg

SEQ ID NO: 1102037 - DNA, 14 bp, Homo sapiens
cagggctggagcct

SEQ ID NO: 1102038 - DNA, 20 bp, Homo sapiens
cagggctggagtgcgctctt

SEQ ID NO: 1102039 - DNA, 13 bp, Homo sapiens
cagggctggatgg

SEQ ID NO: 1102040 - DNA, 15 bp, Homo sapiens
cagggctggatggac

SEQ ID NO: 1102041 - DNA, 17 bp, Homo sapiens
cagggctggatggacag

SEQ ID NO: 1102042 - DNA, 22 bp, Homo sapiens
cagggctggatggacagacacc

SEQ ID NO: 1102043 - DNA, 13 bp, Homo sapiens
cagggctggcacg

SEQ ID NO: 1102044 - DNA, 10 bp, Homo sapiens
cagggctggg

SEQ ID NO: 1102045 - DNA, 13 bp, Homo sapiens
cagggctgggcct

SEQ ID NO: 1102046 - DNA, 14 bp, Homo sapiens
cagggctgggcctg

SEQ ID NO: 1102047 - DNA, 16 bp, Homo sapiens
cagggctgggccttgt

SEQ ID NO: 1102048 - DNA, 11 bp, Homo sapiens
cagggctgggg

SEQ ID NO: 1102049 - DNA, 15 bp, Homo sapiens
cagggctggggacag

SEQ ID NO: 1102050 - DNA, 16 bp, Homo sapiens
cagggctggggtgagc

SEQ ID NO: 1102051 - DNA, 18 bp, Homo sapiens
cagggctggggtgagcct

SEQ ID NO: 1102052 - DNA, 19 bp, Homo sapiens
cagggctggggtgagcctg

SEQ ID NO: 1102053 - DNA, 14 bp, Homo sapiens
cagggctgtcccag

SEQ ID NO: 1102054 - DNA, 15 bp, Homo sapiens
cagggctgtcccagc

SEQ ID NO: 1102055 - DNA, 13 bp, Homo sapiens
cagggctgtcctt

SEQ ID NO: 1102056 - DNA, 21 bp, Homo sapiens
cagggctgttggaggaccccg

SEQ ID NO: 1102057 - DNA, 23 bp, Homo sapiens
cagggcttacctgtacactgact

SEQ ID NO: 1102058 - DNA, 16 bp, Homo sapiens
caggggaaaatgaagg

SEQ ID NO: 1102059 - DNA, 18 bp, Homo sapiens
caggggaaagatgagctt

SEQ ID NO: 1102060 - DNA, 23 bp, Homo sapiens
caggggaaagatgagcttttcta

SEQ ID NO: 1102061 - DNA, 15 bp, Homo sapiens
caggggaacctgcca

SEQ ID NO: 1102062 - DNA, 18 bp, Homo sapiens
caggggaagagaagacaa

SEQ ID NO: 1102063 - DNA, 20 bp, Homo sapiens
caggggaaggaaggagggca

SEQ ID NO: 1102064 - DNA, 18 bp, Homo sapiens
caggggaaggccctgagg

SEQ ID NO: 1102065 - DNA, 22 bp, Homo sapiens
caggggaattccctccccctcc

SEQ ID NO: 1102066 - DNA, 17 bp, Homo sapiens
caggggacactggcccc

SEQ ID NO: 1102067 - DNA, 20 bp, Homo sapiens
caggggaccccactcccctc

SEQ ID NO: 1102068 - DNA, 18 bp, Homo sapiens
caggggagaagctgaagc

SEQ ID NO: 1102069 - DNA, 18 bp, Homo sapiens
caggggagacaggagcct

SEQ ID NO: 1102070 - DNA, 22 bp, Homo sapiens
caggggagacaggagcctagcg

SEQ ID NO: 1102071 - DNA, 21 bp, Homo sapiens
caggggagagggtctggagaa

SEQ ID NO: 1102072 - DNA, 20 bp, Homo sapiens
caggggagccagctgcttga

SEQ ID NO: 1102073 - DNA, 13 bp, Homo sapiens
caggggagccagg

SEQ ID NO: 1102074 - DNA, 15 bp, Homo sapiens
caggggagcttggga

SEQ ID NO: 1102075 - DNA, 16 bp, Homo sapiens
caggggagcttgggac

SEQ ID NO: 1102076 - DNA, 19 bp, Homo sapiens
caggggagcttgggactca

SEQ ID NO: 1102077 - DNA, 16 bp, Homo sapiens
caggggaggaaaaaag

SEQ ID NO: 1102078 - DNA, 18 bp, Homo sapiens
caggggaggaaaaaagaa

SEQ ID NO: 1102079 - DNA, 19 bp, Homo sapiens
caggggaggaaaaaagaac

SEQ ID NO: 1102080 - DNA, 20 bp, Homo sapiens
caggggattgaagccctcca

SEQ ID NO: 1102081 - DNA, 22 bp, Homo sapiens
caggggcacctatgagatggcc

SEQ ID NO: 1102082 - DNA, 21 bp, Homo sapiens
caggggcacctccggctgcct

SEQ ID NO: 1102083 - DNA, 11 bp, Homo sapiens
caggggcaggc

SEQ ID NO: 1102084 - DNA, 16 bp, Homo sapiens
caggggcaggcagggc

SEQ ID NO: 1102085 - DNA, 17 bp, Homo sapiens
caggtgcagatgggctg

SEQ ID NO: 1102086 - DNA, 18 bp, Homo sapiens
caggtgcagatgggctgt

SEQ ID NO: 1102087 - DNA, 21 bp, Homo sapiens
caggtgcagccccagggcctg

SEQ ID NO: 1102088 - DNA, 12 bp, Homo sapiens
caggtgcagtgg

SEQ ID NO: 1102089 - DNA, 15 bp, Homo sapiens
caggtgcatctgcag

SEQ ID NO: 1102090 - DNA, 18 bp, Homo sapiens
caggtgccactccctgag

SEQ ID NO: 1102091 - DNA, 21 bp, Homo sapiens
caggtgccactccctgagctt

SEQ ID NO: 1102092 - DNA, 12 bp, Homo sapiens
caggtgccactg

SEQ ID NO: 1102093 - DNA, 11 bp, Homo sapiens
caggtgcctcc

SEQ ID NO: 1102094 - DNA, 21 bp, Homo sapiens
caggtgcctccaattggtgct

SEQ ID NO: 1102095 - DNA, 13 bp, Homo sapiens
caggtgcctccag

SEQ ID NO: 1102096 - DNA, 21 bp, Homo sapiens
caggtgcctccaggtgtgcac

SEQ ID NO: 1102097 - DNA, 23 bp, Homo sapiens
caggtgccttacatcttttctaa

SEQ ID NO: 1102098 - DNA, 15 bp, Homo sapiens
caggtgcctttcaaa

SEQ ID NO: 1102099 - DNA, 17 bp, Homo sapiens
caggtgcctttcaaatt

SEQ ID NO: 1102100 - DNA, 14 bp, Homo sapiens
caggtgcgaaagga

SEQ ID NO: 1102101 - DNA, 20 bp, Homo sapiens
caggtgcgcgccaccgtgcc

SEQ ID NO: 1102102 - DNA, 17 bp, Homo sapiens
caggtgcggcctggggg

SEQ ID NO: 1102103 - DNA, 14 bp, Homo sapiens
caggtgcgggacca

SEQ ID NO: 1102104 - DNA, 18 bp, Homo sapiens
caggtgcgggaccatctg

SEQ ID NO: 1102105 - DNA, 19 bp, Homo sapiens
caggtgcgggaccatctga

SEQ ID NO: 1102106 - DNA, 21 bp, Homo sapiens
caggtgcgtgtgtctctgtct

SEQ ID NO: 1102107 - DNA, 14 bp, Homo sapiens
caggtgctacaaca

SEQ ID NO: 1102108 - DNA, 19 bp, Homo sapiens
caggtgctacaacatgtga

SEQ ID NO: 1102109 - DNA, 23 bp, Homo sapiens
caggtgctatgtcccaagagcca

SEQ ID NO: 1102110 - DNA, 21 bp, Homo sapiens
caggtgctgctgatgcgctgg

SEQ ID NO: 1102111 - DNA, 20 bp, Homo sapiens
caggtgctgggctggactgg

SEQ ID NO: 1102112 - DNA, 14 bp, Homo sapiens
caggtgctggtccc

SEQ ID NO: 1102113 - DNA, 15 bp, Homo sapiens
caggtgctggtcccg

SEQ ID NO: 1102114 - DNA, 20 bp, Homo sapiens
caggtgcttttgatgtgaaa

SEQ ID NO: 1102115 - DNA, 17 bp, Homo sapiens
caggtggactctgggat

SEQ ID NO: 1102116 - DNA, 15 bp, Homo sapiens
caggtggcaggacca

SEQ ID NO: 1102117 - DNA, 17 bp, Homo sapiens
caggtggcaggaccagg

SEQ ID NO: 1102118 - DNA, 13 bp, Homo sapiens
caggtggccgccc

SEQ ID NO: 1102119 - DNA, 17 bp, Homo sapiens
caggtggccgcccctga

SEQ ID NO: 1102120 - DNA, 16 bp, Homo sapiens
caggtggcctcctggc

SEQ ID NO: 1102121 - DNA, 15 bp, Homo sapiens
caggtggcctggagg

SEQ ID NO: 1102122 - DNA, 19 bp, Homo sapiens
caggtggctgacccagtcc

SEQ ID NO: 1102123 - DNA, 22 bp, Homo sapiens
caggtggctgacccagtccctg

SEQ ID NO: 1102124 - DNA, 17 bp, Homo sapiens
caggtggcttgttaagg

SEQ ID NO: 1102125 - DNA, 13 bp, Homo sapiens
caggtgggagctg

SEQ ID NO: 1102126 - DNA, 22 bp, Homo sapiens
caggtgggaggaaagggcctgg

SEQ ID NO: 1102127 - DNA, 16 bp, Homo sapiens
caggtgggccctctga

SEQ ID NO: 1102128 - DNA, 12 bp, Homo sapiens
caggtgggcctg

SEQ ID NO: 1102129 - DNA, 17 bp, Homo sapiens
caggtgggcctggcggc

SEQ ID NO: 1102130 - DNA, 15 bp, Homo sapiens
caggtgggcctggga

SEQ ID NO: 1102131 - DNA, 16 bp, Homo sapiens
caggtgggcctgggag

SEQ ID NO: 1102132 - DNA, 19 bp, Homo sapiens
caggtgggcggtgtgtctt

SEQ ID NO: 1102133 - DNA, 23 bp, Homo sapiens
caggtgggctggacttctacctg

SEQ ID NO: 1102134 - DNA, 20 bp, Homo sapiens
caggtggggagactgggctg

SEQ ID NO: 1102135 - DNA, 23 bp, Homo sapiens
caggtggggagactgggctgagg

SEQ ID NO: 1102136 - DNA, 16 bp, Homo sapiens
caggtggggcctcagc

SEQ ID NO: 1102137 - DNA, 21 bp, Homo sapiens
caggtggggcctcagcctggg

SEQ ID NO: 1102138 - DNA, 20 bp, Homo sapiens
caggtgggggtgggctgctg

SEQ ID NO: 1102139 - DNA, 21 bp, Homo sapiens
caggtggggtgatggccagag

SEQ ID NO: 1102140 - DNA, 18 bp, Homo sapiens
caggtgggtgctgccctg

SEQ ID NO: 1102141 - DNA, 19 bp, Homo sapiens
caggtgggtgctgccctgt

SEQ ID NO: 1102142 - DNA, 22 bp, Homo sapiens
caggtgggtgtgggacacctgg

SEQ ID NO: 1102143 - DNA, 20 bp, Homo sapiens
caggtggtcctgagacctga

SEQ ID NO: 1102144 - DNA, 17 bp, Homo sapiens
caggtggtggaggggcg

SEQ ID NO: 1102145 - DNA, 15 bp, Homo sapiens
caggtggtggcactg

SEQ ID NO: 1102146 - DNA, 22 bp, Homo sapiens
caggtggtggcactgagccccc

SEQ ID NO: 1102147 - DNA, 19 bp, Homo sapiens
caggtgtataaatgtacat

SEQ ID NO: 1102148 - DNA, 14 bp, Homo sapiens
caggtgtcaggccc

SEQ ID NO: 1102149 - DNA, 19 bp, Homo sapiens
caggtgtgagccactgcgc

SEQ ID NO: 1102150 - DNA, 13 bp, Homo sapiens
caggtgtgcacag

SEQ ID NO: 1102151 - DNA, 16 bp, Homo sapiens
caggtgtgcacagaaa

SEQ ID NO: 1102152 - DNA, 23 bp, Homo sapiens
caggtgtgcacgtggcatgtggc

SEQ ID NO: 1102153 - DNA, 14 bp, Homo sapiens
caggtgtgcctgtt

SEQ ID NO: 1102154 - DNA, 20 bp, Homo sapiens
caggtgtggggacacagcag

SEQ ID NO: 1102155 - DNA, 13 bp, Homo sapiens
caggtgtggtggc

SEQ ID NO: 1102156 - DNA, 20 bp, Homo sapiens
caggtgtgtccacctgggca

SEQ ID NO: 1102157 - DNA, 22 bp, Homo sapiens
caggtgtgtgtgaactgggcac

SEQ ID NO: 1102158 - DNA, 23 bp, Homo sapiens
caggtgtgtgtgaactgggcaca

SEQ ID NO: 1102159 - DNA, 24 bp, Homo sapiens
caggtgtgtgtgaactgggcacag

SEQ ID NO: 1102160 - DNA, 18 bp, Homo sapiens
caggtgttgattgttata

SEQ ID NO: 1102161 - DNA, 14 bp, Homo sapiens
caggtgttgccaaa

SEQ ID NO: 1102162 - DNA, 22 bp, Homo sapiens
caggtgttgccatttctctgct

SEQ ID NO: 1102163 - DNA, 20 bp, Homo sapiens
caggtgttttaagactgaat

SEQ ID NO: 1102164 - DNA, 14 bp, Homo sapiens
caggtgtttttcca

SEQ ID NO: 1102165 - DNA, 12 bp, Homo sapiens
caggttaaaatt

SEQ ID NO: 1102166 - DNA, 18 bp, Homo sapiens
caggttactaccctcacc

SEQ ID NO: 1102167 - DNA, 14 bp, Homo sapiens
caggttagaagaac

SEQ ID NO: 1102168 - DNA, 16 bp, Homo sapiens
caggttataacagtgt

SEQ ID NO: 1102169 - DNA, 17 bp, Homo sapiens
caggttataacagtgtt

SEQ ID NO: 1102170 - DNA, 17 bp, Homo sapiens
caggttatactcctcct

SEQ ID NO: 1102171 - DNA, 22 bp, Homo sapiens
caggttcatggattacttctct

SEQ ID NO: 1102172 - DNA, 13 bp, Homo sapiens
caggttccagaac

SEQ ID NO: 1102173 - DNA, 23 bp, Homo sapiens
caggttccagaacagccctcggc

SEQ ID NO: 1102174 - DNA, 15 bp, Homo sapiens
caggttcccccagca

SEQ ID NO: 1102175 - DNA, 15 bp, Homo sapiens
caggttccctcccag

SEQ ID NO: 1102176 - DNA, 16 bp, Homo sapiens
caggttccctcccaga

SEQ ID NO: 1102177 - DNA, 12 bp, Homo sapiens
caggttcctggg

SEQ ID NO: 1102178 - DNA, 22 bp, Homo sapiens
caggttcctggggccgcctgcc

SEQ ID NO: 1102179 - DNA, 13 bp, Homo sapiens
caggttcctgtgg

SEQ ID NO: 1102180 - DNA, 15 bp, Homo sapiens
caggttctgcctgct

SEQ ID NO: 1102181 - DNA, 12 bp, Homo sapiens
caggttcttcag

SEQ ID NO: 1102182 - DNA, 18 bp, Homo sapiens
caggttcttcttcctgaa

SEQ ID NO: 1102183 - DNA, 20 bp, Homo sapiens
caggttcttcttcctgaagc

SEQ ID NO: 1102184 - DNA, 14 bp, Homo sapiens
caggttggtggggg

SEQ ID NO: 1102185 - DNA, 19 bp, Homo sapiens
caggttgtagtaaagaaat

SEQ ID NO: 1102186 - DNA, 20 bp, Homo sapiens
caggtttaaaagttgtgcat

SEQ ID NO: 1102187 - DNA, 15 bp, Homo sapiens
caggtttaacatttg

SEQ ID NO: 1102188 - DNA, 16 bp, Homo sapiens
caggtttaacatttgc

SEQ ID NO: 1102189 - DNA, 17 bp, Homo sapiens
caggtttaacatttgcc

SEQ ID NO: 1102190 - DNA, 18 bp, Homo sapiens
caggtttctccttgaagc

SEQ ID NO: 1102191 - DNA, 23 bp, Homo sapiens
caggtttggggagggggaagaga

SEQ ID NO: 1102192 - DNA, 16 bp, Homo sapiens
caggtttgtcctggtc

SEQ ID NO: 1102193 - DNA, 15 bp, Homo sapiens
caggtttttcctttt

SEQ ID NO: 1102194 - DNA, 20 bp, Homo sapiens
cagtaaaaacttgtactatg

SEQ ID NO: 1102195 - DNA, 21 bp, Homo sapiens
cagtaaaaacttgtactatgt

SEQ ID NO: 1102196 - DNA, 19 bp, Homo sapiens
cagtaaaagtaaagactat

SEQ ID NO: 1102197 - DNA, 16 bp, Homo sapiens
cagtaaaatactattc

SEQ ID NO: 1102198 - DNA, 18 bp, Homo sapiens
cagtaaaccactgaaaaa

SEQ ID NO: 1102199 - DNA, 21 bp, Homo sapiens
cagtaaaccactgaaaaaata

SEQ ID NO: 1102200 - DNA, 18 bp, Homo sapiens
cagtaaagatatttgaat

SEQ ID NO: 1102201 - DNA, 18 bp, Homo sapiens
cagtaaagtatagaaata

SEQ ID NO: 1102202 - DNA, 14 bp, Homo sapiens
cagtaaataacagg

SEQ ID NO: 1102203 - DNA, 18 bp, Homo sapiens
cagtaaataactggaaaa

SEQ ID NO: 1102204 - DNA, 23 bp, Homo sapiens
cagtaaataactggaaaacagaa

SEQ ID NO: 1102205 - DNA, 18 bp, Homo sapiens
cagtaaatcctcatttga

SEQ ID NO: 1102206 - DNA, 21 bp, Homo sapiens
cagtgccacttgacattcctt

SEQ ID NO: 1102207 - DNA, 21 bp, Homo sapiens
cagtgccagcaatgacatctc

SEQ ID NO: 1102208 - DNA, 14 bp, Homo sapiens
cagtgccagccaat

SEQ ID NO: 1102209 - DNA, 14 bp, Homo sapiens
cagtgccagctcca

SEQ ID NO: 1102210 - DNA, 11 bp, Homo sapiens
cagtgccaggg

SEQ ID NO: 1102211 - DNA, 13 bp, Homo sapiens
cagtgccatcccc

SEQ ID NO: 1102212 - DNA, 18 bp, Homo sapiens
cagtgccattccactcca

SEQ ID NO: 1102213 - DNA, 21 bp, Homo sapiens
cagtgccattccactccactc

SEQ ID NO: 1102214 - DNA, 22 bp, Homo sapiens
cagtgccattccactccactca

SEQ ID NO: 1102215 - DNA, 17 bp, Homo sapiens
cagtgcccaagagtggg

SEQ ID NO: 1102216 - DNA, 11 bp, Homo sapiens
cagtgcccacc

SEQ ID NO: 1102217 - DNA, 13 bp, Homo sapiens
cagtgcccaccgc

SEQ ID NO: 1102218 - DNA, 14 bp, Homo sapiens
cagtgcccaccgcc

SEQ ID NO: 1102219 - DNA, 21 bp, Homo sapiens
cagtgcccaccgccctcctcc

SEQ ID NO: 1102220 - DNA, 22 bp, Homo sapiens
cagtgcccaccgccctcctcca

SEQ ID NO: 1102221 - DNA, 16 bp, Homo sapiens
cagtgccccagggagt

SEQ ID NO: 1102222 - DNA, 21 bp, Homo sapiens
cagtgccccagggagtccagg

SEQ ID NO: 1102223 - DNA, 23 bp, Homo sapiens
cagtgccccagggagtccagggt

SEQ ID NO: 1102224 - DNA, 16 bp, Homo sapiens
cagtgccctccagccc

SEQ ID NO: 1102225 - DNA, 18 bp, Homo sapiens
cagtgccctccagccccg

SEQ ID NO: 1102226 - DNA, 18 bp, Homo sapiens
cagtgccgagaaggaagc

SEQ ID NO: 1102227 - DNA, 16 bp, Homo sapiens
cagtgccgctcctgct

SEQ ID NO: 1102228 - DNA, 13 bp, Homo sapiens
cagtgcctcctgg

SEQ ID NO: 1102229 - DNA, 14 bp, Homo sapiens
cagtgcctcgaggc

SEQ ID NO: 1102230 - DNA, 15 bp, Homo sapiens
cagtgcctcgaggca

SEQ ID NO: 1102231 - DNA, 21 bp, Homo sapiens
cagtgcctcttccagtgaaca

SEQ ID NO: 1102232 - DNA, 15 bp, Homo sapiens
cagtgcctctttgaa

SEQ ID NO: 1102233 - DNA, 24 bp, Homo sapiens
cagtgcctgccactctctgggact

SEQ ID NO: 1102234 - DNA, 19 bp, Homo sapiens
cagtgcctggtgttctgaa

SEQ ID NO: 1102235 - DNA, 20 bp, Homo sapiens
cagtgcctggtgttctgaag

SEQ ID NO: 1102236 - DNA, 19 bp, Homo sapiens
cagtgccttacctcctgcc

SEQ ID NO: 1102237 - DNA, 23 bp, Homo sapiens
cagtgccttacctcctgcccagg

SEQ ID NO: 1102238 - DNA, 15 bp, Homo sapiens
cagtgccttccataa

SEQ ID NO: 1102239 - DNA, 17 bp, Homo sapiens
cagtgccttccataatt

SEQ ID NO: 1102240 - DNA, 22 bp, Homo sapiens
cagtgccttcctgtttttcaca

SEQ ID NO: 1102241 - DNA, 14 bp, Homo sapiens
cagtgccttgggga

SEQ ID NO: 1102242 - DNA, 24 bp, Homo sapiens
cagtgcgcgtgcacgtggagagct

SEQ ID NO: 1102243 - DNA, 23 bp, Homo sapiens
cagtgcggacccttcccagccct

SEQ ID NO: 1102244 - DNA, 17 bp, Homo sapiens
cagtgcggttcctcatc

SEQ ID NO: 1102245 - DNA, 17 bp, Homo sapiens
cagtgctcaccagccct

SEQ ID NO: 1102246 - DNA, 18 bp, Homo sapiens
cagtgctcaccagccctg

SEQ ID NO: 1102247 - DNA, 22 bp, Homo sapiens
cagtgctcaccagccctgcagc

SEQ ID NO: 1102248 - DNA, 14 bp, Homo sapiens
cagtgctccctcac

SEQ ID NO: 1102249 - DNA, 14 bp, Homo sapiens
cagtgctctcagct

SEQ ID NO: 1102250 - DNA, 14 bp, Homo sapiens
cagtgctctgcctc

SEQ ID NO: 1102251 - DNA, 17 bp, Homo sapiens
cagtgctctgcctcaga

SEQ ID NO: 1102252 - DNA, 14 bp, Homo sapiens
cagtgctcttttct

SEQ ID NO: 1102253 - DNA, 23 bp, Homo sapiens
cagtgctgccatgccactgccag

SEQ ID NO: 1102254 - DNA, 13 bp, Homo sapiens
cagtgctgcccct

SEQ ID NO: 1102255 - DNA, 12 bp, Homo sapiens
cagtgctgcctg

SEQ ID NO: 1102256 - DNA, 14 bp, Homo sapiens
cagtgctgctgtaa

SEQ ID NO: 1102257 - DNA, 16 bp, Homo sapiens
cagtgctgctgtaaat

SEQ ID NO: 1102258 - DNA, 17 bp, Homo sapiens
cagtgctgctgtaaata

SEQ ID NO: 1102259 - DNA, 23 bp, Homo sapiens
cagtgctgctgtaaatacaggaa

SEQ ID NO: 1102260 - DNA, 11 bp, Homo sapiens
cagtgctgctt

SEQ ID NO: 1102261 - DNA, 12 bp, Homo sapiens
cagtgctggaag

SEQ ID NO: 1102262 - DNA, 20 bp, Homo sapiens
cagtgctgtggcctgggcaa

SEQ ID NO: 1102263 - DNA, 12 bp, Homo sapiens
cagtgctgtgtg

SEQ ID NO: 1102264 - DNA, 14 bp, Homo sapiens
cagtgctgttggtg

SEQ ID NO: 1102265 - DNA, 24 bp, Homo sapiens
cagtgcttagcaaaaaataatgac

SEQ ID NO: 1102266 - DNA, 23 bp, Homo sapiens
cagtgcttgcatcctatttggtg

SEQ ID NO: 1102267 - DNA, 17 bp, Homo sapiens
cagtggaacacaaatga

SEQ ID NO: 1102268 - DNA, 19 bp, Homo sapiens
cagtggaacagcgggagac

SEQ ID NO: 1102269 - DNA, 23 bp, Homo sapiens
cagtggaatataaggaaagcaat

SEQ ID NO: 1102270 - DNA, 22 bp, Homo sapiens
cagtggaattccaacttgaagg

SEQ ID NO: 1102271 - DNA, 19 bp, Homo sapiens
cagtggaattgtacaagag

SEQ ID NO: 1102272 - DNA, 22 bp, Homo sapiens
cagtggacaccaggagtccctg

SEQ ID NO: 1102273 - DNA, 18 bp, Homo sapiens
cagtggaccctgtggcca

SEQ ID NO: 1102274 - DNA, 17 bp, Homo sapiens
cagtggacggaggtccc

SEQ ID NO: 1102275 - DNA, 19 bp, Homo sapiens
cagtggactcagcagtgac

SEQ ID NO: 1102276 - DNA, 17 bp, Homo sapiens
cagtggactttccaccc

SEQ ID NO: 1102277 - DNA, 21 bp, Homo sapiens
cagtggactttccaccccctc

SEQ ID NO: 1102278 - DNA, 22 bp, Homo sapiens
cagtggagaagacattctggtg

SEQ ID NO: 1102279 - DNA, 14 bp, Homo sapiens
cagtggagaattat

SEQ ID NO: 1102280 - DNA, 17 bp, Homo sapiens
cagtggagctggtctgc

SEQ ID NO: 1102281 - DNA, 19 bp, Homo sapiens
cagtggagctggtctgcca

SEQ ID NO: 1102282 - DNA, 19 bp, Homo sapiens
cagtggatcttcagaactg

SEQ ID NO: 1102283 - DNA, 17 bp, Homo sapiens
cagtggattcccacagc

SEQ ID NO: 1102284 - DNA, 23 bp, Homo sapiens
cagtggcacaaaaaaatatcaga

SEQ ID NO: 1102285 - DNA, 16 bp, Homo sapiens
cagtggcacaatcatg

SEQ ID NO: 1102286 - DNA, 16 bp, Homo sapiens
cagtggcacaatctcg

SEQ ID NO: 1102287 - DNA, 16 bp, Homo sapiens
cagtggcactgaagtg

SEQ ID NO: 1102288 - DNA, 21 bp, Homo sapiens
cagtggcactgaagtggccct

SEQ ID NO: 1102289 - DNA, 19 bp, Homo sapiens
cagtggcatggctccagtc

SEQ ID NO: 1102290 - DNA, 14 bp, Homo sapiens
cagtggccaagcct

SEQ ID NO: 1102291 - DNA, 17 bp, Homo sapiens
cagtggccaagcctgct

SEQ ID NO: 1102292 - DNA, 18 bp, Homo sapiens
cagtggccaagcctgctg

SEQ ID NO: 1102293 - DNA, 22 bp, Homo sapiens
cagtggccacgttcagggaggg

SEQ ID NO: 1102294 - DNA, 13 bp, Homo sapiens
cagtggcccccgg

SEQ ID NO: 1102295 - DNA, 17 bp, Homo sapiens
cagtggcccccgggcct

SEQ ID NO: 1102296 - DNA, 18 bp, Homo sapiens
cagtggcccccgggcctg

SEQ ID NO: 1102297 - DNA, 22 bp, Homo sapiens
cagtggcctacaaatcagtaat

SEQ ID NO: 1102298 - DNA, 17 bp, Homo sapiens
cagtggccttggtcctt

SEQ ID NO: 1102299 - DNA, 20 bp, Homo sapiens
cagtggcgggtgatggccag

SEQ ID NO: 1102300 - DNA, 20 bp, Homo sapiens
cagtggctcacgcctatgat

SEQ ID NO: 1102301 - DNA, 20 bp, Homo sapiens
cagtggctcgctccctgtag

SEQ ID NO: 1102302 - DNA, 21 bp, Homo sapiens
cagtggctggaattaaaacaa

SEQ ID NO: 1102303 - DNA, 22 bp, Homo sapiens
cagtggctggaattaaaacaaa

SEQ ID NO: 1102304 - DNA, 17 bp, Homo sapiens
cagtggctgggtgggcc

SEQ ID NO: 1102305 - DNA, 19 bp, Homo sapiens
cagtggctggtccagggct

SEQ ID NO: 1102306 - DNA, 18 bp, Homo sapiens
cagtggctggtttctgag

SEQ ID NO: 1102307 - DNA, 11 bp, Homo sapiens
cagtggcttcc

SEQ ID NO: 1102308 - DNA, 19 bp, Homo sapiens
cagtggcttcccagctctg

SEQ ID NO: 1102309 - DNA, 21 bp, Homo sapiens
cagtggcttcccagctctgac

SEQ ID NO: 1102310 - DNA, 14 bp, Homo sapiens
cagtggctttgcat

SEQ ID NO: 1102311 - DNA, 12 bp, Homo sapiens
cagtgggaaata

SEQ ID NO: 1102312 - DNA, 20 bp, Homo sapiens
cagtgggacaaaccagagca

SEQ ID NO: 1102313 - DNA, 16 bp, Homo sapiens
cagtgggacagggcat

SEQ ID NO: 1102314 - DNA, 19 bp, Homo sapiens
cagtgggacagggcatggc

SEQ ID NO: 1102315 - DNA, 15 bp, Homo sapiens
cagtgggagatgtta

SEQ ID NO: 1102316 - DNA, 16 bp, Homo sapiens
cagtgggagccctgac

SEQ ID NO: 1102317 - DNA, 20 bp, Homo sapiens
cagtgggaggggcaggctga

SEQ ID NO: 1102318 - DNA, 12 bp, Homo sapiens
cagtgggcaggg

SEQ ID NO: 1102319 - DNA, 12 bp, Homo sapiens
cagtgggcctgc

SEQ ID NO: 1102320 - DNA, 22 bp, Homo sapiens
cagtgggcctgctgaggccttc

SEQ ID NO: 1102321 - DNA, 22 bp, Homo sapiens
cagtgggcgttgggagcctagc

SEQ ID NO: 1102322 - DNA, 15 bp, Homo sapiens
cagtgggctgatgct

SEQ ID NO: 1102323 - DNA, 21 bp, Homo sapiens
cagtgggctgatgctgggacc

SEQ ID NO: 1102324 - DNA, 14 bp, Homo sapiens
cagtgggctgtgtt

SEQ ID NO: 1102325 - DNA, 18 bp, Homo sapiens
cagtggggacagggaggg

SEQ ID NO: 1102326 - DNA, 15 bp, Homo sapiens
cagtggggcagtcat

SEQ ID NO: 1102327 - DNA, 20 bp, Homo sapiens
cagtttcttcttacacttct

SEQ ID NO: 1102328 - DNA, 14 bp, Homo sapiens
cagtttcttgtgta

SEQ ID NO: 1102329 - DNA, 17 bp, Homo sapiens
cagtttcttgtgtagat

SEQ ID NO: 1102330 - DNA, 15 bp, Homo sapiens
cagtttgagacagga

SEQ ID NO: 1102331 - DNA, 23 bp, Homo sapiens
cagtttgaggaagtggctgtccc

SEQ ID NO: 1102332 - DNA, 17 bp, Homo sapiens
cagtttgcaaaaaatgt

SEQ ID NO: 1102333 - DNA, 18 bp, Homo sapiens
cagtttgcctgctgtatt

SEQ ID NO: 1102334 - DNA, 13 bp, Homo sapiens
cagtttggccctg

SEQ ID NO: 1102335 - DNA, 14 bp, Homo sapiens
cagtttggccctgg

SEQ ID NO: 1102336 - DNA, 18 bp, Homo sapiens
cagtttggccctggagcc

SEQ ID NO: 1102337 - DNA, 20 bp, Homo sapiens
cagtttggccctggagccag

SEQ ID NO: 1102338 - DNA, 23 bp, Homo sapiens
cagtttgggagacatggaccagc

SEQ ID NO: 1102339 - DNA, 12 bp, Homo sapiens
cagtttgtgaat

SEQ ID NO: 1102340 - DNA, 21 bp, Homo sapiens
cagtttgtgatatagcagagg

SEQ ID NO: 1102341 - DNA, 16 bp, Homo sapiens
cagtttgtgttttaaa

SEQ ID NO: 1102342 - DNA, 23 bp, Homo sapiens
cagtttgtgttttaaaaaaactg

SEQ ID NO: 1102343 - DNA, 16 bp, Homo sapiens
cagttttaactagaat

SEQ ID NO: 1102344 - DNA, 14 bp, Homo sapiens
cagttttaactgtg

SEQ ID NO: 1102345 - DNA, 22 bp, Homo sapiens
cagttttaactgtggatattgt

SEQ ID NO: 1102346 - DNA, 22 bp, Homo sapiens
cagttttaataagaacagatca

SEQ ID NO: 1102347 - DNA, 14 bp, Homo sapiens
cagttttcagaaaa

SEQ ID NO: 1102348 - DNA, 12 bp, Homo sapiens
cagttttcataa

SEQ ID NO: 1102349 - DNA, 14 bp, Homo sapiens
cagttttccatgaa

SEQ ID NO: 1102350 - DNA, 15 bp, Homo sapiens
cagttttccatgaaa

SEQ ID NO: 1102351 - DNA, 18 bp, Homo sapiens
cagttttccatgaaaacg

SEQ ID NO: 1102352 - DNA, 21 bp, Homo sapiens
cagttttccatggtgtattca

SEQ ID NO: 1102353 - DNA, 13 bp, Homo sapiens
cagttttccattg

SEQ ID NO: 1102354 - DNA, 14 bp, Homo sapiens
cagttttcccctgg

SEQ ID NO: 1102355 - DNA, 14 bp, Homo sapiens
cagttttccttctg

SEQ ID NO: 1102356 - DNA, 19 bp, Homo sapiens
cagttttgagtgtactgtg

SEQ ID NO: 1102357 - DNA, 18 bp, Homo sapiens
cagttttggatcttttta

SEQ ID NO: 1102358 - DNA, 13 bp, Homo sapiens
cagtttttataat

SEQ ID NO: 1102359 - DNA, 18 bp, Homo sapiens
cagtttttataatagatt

SEQ ID NO: 1102360 - DNA, 15 bp, Homo sapiens
cagtttttcaggagc

SEQ ID NO: 1102361 - DNA, 14 bp, Homo sapiens
cagtttttcatttg

SEQ ID NO: 1102362 - DNA, 15 bp, Homo sapiens
cagtttttcatttgt

SEQ ID NO: 1102363 - DNA, 18 bp, Homo sapiens
cagttttttttttcttgt

SEQ ID NO: 1102364 - DNA, 23 bp, Homo sapiens
cagttttttttttcttgtctata

SEQ ID NO: 1102365 - DNA, 16 bp, Homo sapiens
cataaaaaaatgatgc

SEQ ID NO: 1102366 - DNA, 13 bp, Homo sapiens
cataaaaaccaaa

SEQ ID NO: 1102367 - DNA, 23 bp, Homo sapiens
cataaaaagaggatgatttcaga

SEQ ID NO: 1102368 - DNA, 18 bp, Homo sapiens
cataaaaagcagaatttt

SEQ ID NO: 1102369 - DNA, 22 bp, Homo sapiens
cataaaaaggaacaagactgac

SEQ ID NO: 1102370 - DNA, 15 bp, Homo sapiens
cataaaaatgatcta

SEQ ID NO: 1102371 - DNA, 21 bp, Homo sapiens
cataaaacaaaaccaagcctt

SEQ ID NO: 1102372 - DNA, 17 bp, Homo sapiens
cataaaacattaagaaa

SEQ ID NO: 1102373 - DNA, 18 bp, Homo sapiens
cataaaactttaaaaggc

SEQ ID NO: 1102374 - DNA, 16 bp, Homo sapiens
cataaaagaaataaac

SEQ ID NO: 1102375 - DNA, 16 bp, Homo sapiens
cataaaagaagtttca

SEQ ID NO: 1102376 - DNA, 21 bp, Homo sapiens
cataaaatagaataattcttt

SEQ ID NO: 1102377 - DNA, 14 bp, Homo sapiens
cataaaatctgtga

SEQ ID NO: 1102378 - DNA, 21 bp, Homo sapiens
cataaaatgcatactgttgat

SEQ ID NO: 1102379 - DNA, 21 bp, Homo sapiens
cataaaattgcagtttcatgt

SEQ ID NO: 1102380 - DNA, 17 bp, Homo sapiens
cataaaccaatgtggca

SEQ ID NO: 1102381 - DNA, 20 bp, Homo sapiens
cataaaccatttttgttact

SEQ ID NO: 1102382 - DNA, 21 bp, Homo sapiens
cataaacccagttgccatctg

SEQ ID NO: 1102383 - DNA, 15 bp, Homo sapiens
cataaactttctcca

SEQ ID NO: 1102384 - DNA, 11 bp, Homo sapiens
cataaagaagc

SEQ ID NO: 1102385 - DNA, 21 bp, Homo sapiens
cataaagaagcaataaagaag

SEQ ID NO: 1102386 - DNA, 12 bp, Homo sapiens
cataaagactgt

SEQ ID NO: 1102387 - DNA, 15 bp, Homo sapiens
cataaagatgttaaa

SEQ ID NO: 1102388 - DNA, 20 bp, Homo sapiens
cataaagatgttaaatggaa

SEQ ID NO: 1102389 - DNA, 21 bp, Homo sapiens
cataaagatgttaaatggaat

SEQ ID NO: 1102390 - DNA, 13 bp, Homo sapiens
cataaagcaaata

SEQ ID NO: 1102391 - DNA, 22 bp, Homo sapiens
cataaagtaaatacatgcatat

SEQ ID NO: 1102392 - DNA, 16 bp, Homo sapiens
cataaagtacaaatga

SEQ ID NO: 1102393 - DNA, 11 bp, Homo sapiens
cataaagtcag

SEQ ID NO: 1102394 - DNA, 15 bp, Homo sapiens
cataaagtcagtgcc

SEQ ID NO: 1102395 - DNA, 15 bp, Homo sapiens
cataaagtctgagaa

SEQ ID NO: 1102396 - DNA, 17 bp, Homo sapiens
cataaataaaactgaat

SEQ ID NO: 1102397 - DNA, 16 bp, Homo sapiens
cataaatcacagaaaa

SEQ ID NO: 1102398 - DNA, 17 bp, Homo sapiens
cataaatcagaaagttt

SEQ ID NO: 1102399 - DNA, 20 bp, Homo sapiens
cataaatcttcttattaaat

SEQ ID NO: 1102400 - DNA, 23 bp, Homo sapiens
cataaattacagtcatctgtctt

SEQ ID NO: 1102401 - DNA, 23 bp, Homo sapiens
cataaattccagaggactctgct

SEQ ID NO: 1102402 - DNA, 20 bp, Homo sapiens
cataacaccgtcccagggct

SEQ ID NO: 1102403 - DNA, 21 bp, Homo sapiens
cataacaccgtcccagggctc

SEQ ID NO: 1102404 - DNA, 18 bp, Homo sapiens
cataacagccaagaagcc

SEQ ID NO: 1102405 - DNA, 22 bp, Homo sapiens
cataacatttaaagagatttcc

SEQ ID NO: 1102406 - DNA, 23 bp, Homo sapiens
cataacctgtctcacctggactt

SEQ ID NO: 1102407 - DNA, 15 bp, Homo sapiens
cataacgtgccccca

SEQ ID NO: 1102408 - DNA, 16 bp, Homo sapiens
cataacgtgcccccag

SEQ ID NO: 1102409 - DNA, 19 bp, Homo sapiens
cataacgtgcccccagagt

SEQ ID NO: 1102410 - DNA, 21 bp, Homo sapiens
cataacgtgcccccagagtgt

SEQ ID NO: 1102411 - DNA, 18 bp, Homo sapiens
cataactctgtaaaaaca

SEQ ID NO: 1102412 - DNA, 22 bp, Homo sapiens
cataactctgtaaaaacactga

SEQ ID NO: 1102413 - DNA, 19 bp, Homo sapiens
cataactgtagctcaagtt

SEQ ID NO: 1102414 - DNA, 21 bp, Homo sapiens
cataacttgctgaatttcagg

SEQ ID NO: 1102415 - DNA, 15 bp, Homo sapiens
cataagacacttaga

SEQ ID NO: 1102416 - DNA, 17 bp, Homo sapiens
cataagaccgtgtccca

SEQ ID NO: 1102417 - DNA, 21 bp, Homo sapiens
cataagaccgtgtcccaagga

SEQ ID NO: 1102418 - DNA, 14 bp, Homo sapiens
cataagataaatgt

SEQ ID NO: 1102419 - DNA, 11 bp, Homo sapiens
cataagattaa

SEQ ID NO: 1102420 - DNA, 16 bp, Homo sapiens
cataagattaaaggaa

SEQ ID NO: 1102421 - DNA, 21 bp, Homo sapiens
cataagattaaaggaaggaaa

SEQ ID NO: 1102422 - DNA, 18 bp, Homo sapiens
cataagcaatcattttat

SEQ ID NO: 1102423 - DNA, 21 bp, Homo sapiens
cataagcctccatttagttct

SEQ ID NO: 1102424 - DNA, 16 bp, Homo sapiens
cataagctcagaatcc

SEQ ID NO: 1102425 - DNA, 22 bp, Homo sapiens
cataaggagaatgtatctcctc

SEQ ID NO: 1102426 - DNA, 18 bp, Homo sapiens
cataaggatgactttttt

SEQ ID NO: 1102427 - DNA, 17 bp, Homo sapiens
cataaggccagaaactc

SEQ ID NO: 1102428 - DNA, 21 bp, Homo sapiens
cataaggccagtatgatttat

SEQ ID NO: 1102429 - DNA, 23 bp, Homo sapiens
cataaggctggatggcacctcag

SEQ ID NO: 1102430 - DNA, 21 bp, Homo sapiens
cataaggtttcgtttctgtat

SEQ ID NO: 1102431 - DNA, 12 bp, Homo sapiens
cataagtaagaa

SEQ ID NO: 1102432 - DNA, 15 bp, Homo sapiens
cataagtatttcaaa

SEQ ID NO: 1102433 - DNA, 21 bp, Homo sapiens
cataagtccattaactgcttt

SEQ ID NO: 1102434 - DNA, 17 bp, Homo sapiens
cataagtgacaccaata

SEQ ID NO: 1102435 - DNA, 21 bp, Homo sapiens
cataagtgacaccaataaatg

SEQ ID NO: 1102436 - DNA, 22 bp, Homo sapiens
cataagtgacaccaataaatgt

SEQ ID NO: 1102437 - DNA, 12 bp, Homo sapiens
cataataaacta

SEQ ID NO: 1102438 - DNA, 18 bp, Homo sapiens
cataataaagttgtttta

SEQ ID NO: 1102439 - DNA, 17 bp, Homo sapiens
cataatagttagccctc

SEQ ID NO: 1102440 - DNA, 14 bp, Homo sapiens
cataatatgaagcc

SEQ ID NO: 1102441 - DNA, 14 bp, Homo sapiens
cataatcaaagcta

SEQ ID NO: 1102442 - DNA, 19 bp, Homo sapiens
cataatcagtaaatagtgt

SEQ ID NO: 1102443 - DNA, 21 bp, Homo sapiens
cataatctagtttacagaaaa

SEQ ID NO: 1102444 - DNA, 19 bp, Homo sapiens
cataatctggactcctctg

SEQ ID NO: 1102445 - DNA, 15 bp, Homo sapiens
cataatcttctgcct

SEQ ID NO: 1102446 - DNA, 18 bp, Homo sapiens
cataatgaattataacag

SEQ ID NO: 1102447 - DNA, 17 bp, Homo sapiens
cataatgataaaataaa

SEQ ID NO: 1102448 - DNA, 21 bp, Homo sapiens
catataggaaaacaataattt

SEQ ID NO: 1102449 - DNA, 19 bp, Homo sapiens
catatataacagatacatt

SEQ ID NO: 1102450 - DNA, 20 bp, Homo sapiens
catatataacagatacattt

SEQ ID NO: 1102451 - DNA, 16 bp, Homo sapiens
catatatacaggcata

SEQ ID NO: 1102452 - DNA, 22 bp, Homo sapiens
catatatatatacacatacata

SEQ ID NO: 1102453 - DNA, 22 bp, Homo sapiens
catatatatatttgtaacattg

SEQ ID NO: 1102454 - DNA, 14 bp, Homo sapiens
catatatatttatt

SEQ ID NO: 1102455 - DNA, 17 bp, Homo sapiens
catatatgaggacttgt

SEQ ID NO: 1102456 - DNA, 14 bp, Homo sapiens
catatatgctgtat

SEQ ID NO: 1102457 - DNA, 20 bp, Homo sapiens
catatatgctgtatttcttt

SEQ ID NO: 1102458 - DNA, 21 bp, Homo sapiens
catatatggggggccaacacc

SEQ ID NO: 1102459 - DNA, 23 bp, Homo sapiens
catatcaaaaagtattaaaacta

SEQ ID NO: 1102460 - DNA, 22 bp, Homo sapiens
catatcaattggcagtgacttt

SEQ ID NO: 1102461 - DNA, 23 bp, Homo sapiens
catatcaattggcagtgactttg

SEQ ID NO: 1102462 - DNA, 20 bp, Homo sapiens
catatcatggtaatgacaga

SEQ ID NO: 1102463 - DNA, 18 bp, Homo sapiens
catatcatttcactgtct

SEQ ID NO: 1102464 - DNA, 13 bp, Homo sapiens
catatcatttgtg

SEQ ID NO: 1102465 - DNA, 14 bp, Homo sapiens
catatcatttgtga

SEQ ID NO: 1102466 - DNA, 16 bp, Homo sapiens
catatccaagtttgaa

SEQ ID NO: 1102467 - DNA, 20 bp, Homo sapiens
catatccctcccgtgtgtgg

SEQ ID NO: 1102468 - DNA, 21 bp, Homo sapiens
catatccctgcccagcctgtg

SEQ ID NO: 1102469 - DNA, 23 bp, Homo sapiens
catatcctgagccatcggtgaaa

SEQ ID NO: 1102470 - DNA, 15 bp, Homo sapiens
catatcctgcctcag

SEQ ID NO: 1102471 - DNA, 18 bp, Homo sapiens
catatctccatggccctg

SEQ ID NO: 1102472 - DNA, 21 bp, Homo sapiens
catatctccatggccctgtcc

SEQ ID NO: 1102473 - DNA, 22 bp, Homo sapiens
catatctccatggccctgtccc

SEQ ID NO: 1102474 - DNA, 23 bp, Homo sapiens
catatctcttgcccttcctactc

SEQ ID NO: 1102475 - DNA, 20 bp, Homo sapiens
catatcttgcgaatccaagc

SEQ ID NO: 1102476 - DNA, 14 bp, Homo sapiens
catatctttattaa

SEQ ID NO: 1102477 - DNA, 15 bp, Homo sapiens
catatctttattaat

SEQ ID NO: 1102478 - DNA, 16 bp, Homo sapiens
catatctttattaatc

SEQ ID NO: 1102479 - DNA, 17 bp, Homo sapiens
catatctttattaatca

SEQ ID NO: 1102480 - DNA, 23 bp, Homo sapiens
catatgaacacagacaaagtgct

SEQ ID NO: 1102481 - DNA, 20 bp, Homo sapiens
catatgagaatataccttat

SEQ ID NO: 1102482 - DNA, 22 bp, Homo sapiens
catatgagaatataccttattt

SEQ ID NO: 1102483 - DNA, 22 bp, Homo sapiens
catatgagccgtgaactgtgca

SEQ ID NO: 1102484 - DNA, 20 bp, Homo sapiens
catatgaggacctttatatc

SEQ ID NO: 1102485 - DNA, 14 bp, Homo sapiens
catatgagtgtgga

SEQ ID NO: 1102486 - DNA, 17 bp, Homo sapiens
catatgagtgtggaagc

SEQ ID NO: 1102487 - DNA, 19 bp, Homo sapiens
catatgagtgtggaagccg

SEQ ID NO: 1102488 - DNA, 15 bp, Homo sapiens
catatgattctgctt

SEQ ID NO: 1102489 - DNA, 16 bp, Homo sapiens
catatgatttcttgct

SEQ ID NO: 1102490 - DNA, 21 bp, Homo sapiens
catatgcagaacgtatttagc

SEQ ID NO: 1102491 - DNA, 16 bp, Homo sapiens
catatgcagccaacca

SEQ ID NO: 1102492 - DNA, 20 bp, Homo sapiens
catatgcatgccaggctggg

SEQ ID NO: 1102493 - DNA, 13 bp, Homo sapiens
catatgccacccc

SEQ ID NO: 1102494 - DNA, 14 bp, Homo sapiens
catatgctctgctt

SEQ ID NO: 1102495 - DNA, 16 bp, Homo sapiens
catatgctgacagctc

SEQ ID NO: 1102496 - DNA, 23 bp, Homo sapiens
catatgctgatcttttaaaatca

SEQ ID NO: 1102497 - DNA, 17 bp, Homo sapiens
catatgcttactcttgc

SEQ ID NO: 1102498 - DNA, 15 bp, Homo sapiens
catatggaaaagatt

SEQ ID NO: 1102499 - DNA, 19 bp, Homo sapiens
catatggagctcatgtcag

SEQ ID NO: 1102500 - DNA, 12 bp, Homo sapiens
catatggaggac

SEQ ID NO: 1102501 - DNA, 11 bp, Homo sapiens
catatggatgt

SEQ ID NO: 1102502 - DNA, 20 bp, Homo sapiens
catatggattttctattgtt

SEQ ID NO: 1102503 - DNA, 20 bp, Homo sapiens
catatggcccagtgtcaagt

SEQ ID NO: 1102504 - DNA, 20 bp, Homo sapiens
catatgggatattcccaagc

SEQ ID NO: 1102505 - DNA, 12 bp, Homo sapiens
catatgtagata

SEQ ID NO: 1102506 - DNA, 12 bp, Homo sapiens
catatgtatact

SEQ ID NO: 1102507 - DNA, 21 bp, Homo sapiens
catatgtatacttatcttgct

SEQ ID NO: 1102508 - DNA, 17 bp, Homo sapiens
catatgtctgcttctgt

SEQ ID NO: 1102509 - DNA, 14 bp, Homo sapiens
catatgtgtaaaga

SEQ ID NO: 1102510 - DNA, 16 bp, Homo sapiens
catatgttgaatactt

SEQ ID NO: 1102511 - DNA, 19 bp, Homo sapiens
catatgttgaatacttttt

SEQ ID NO: 1102512 - DNA, 16 bp, Homo sapiens
catatgttgctcagtc

SEQ ID NO: 1102513 - DNA, 13 bp, Homo sapiens
catatgtttcccc

SEQ ID NO: 1102514 - DNA, 23 bp, Homo sapiens
catattaaaatctgatgtaacaa

SEQ ID NO: 1102515 - DNA, 22 bp, Homo sapiens
catattaaacaaaaacaaagaa

SEQ ID NO: 1102516 - DNA, 14 bp, Homo sapiens
catattaagacagt

SEQ ID NO: 1102517 - DNA, 15 bp, Homo sapiens
catattaagacagtg

SEQ ID NO: 1102518 - DNA, 16 bp, Homo sapiens
catattaagacagtgt

SEQ ID NO: 1102519 - DNA, 21 bp, Homo sapiens
catattaagacagtgtacaaa

SEQ ID NO: 1102520 - DNA, 20 bp, Homo sapiens
catattaagcactttaagct

SEQ ID NO: 1102521 - DNA, 17 bp, Homo sapiens
catattaccacagacat

SEQ ID NO: 1102522 - DNA, 23 bp, Homo sapiens
catattactgttgcatttacttt

SEQ ID NO: 1102523 - DNA, 19 bp, Homo sapiens
catattaggtggttctctt

SEQ ID NO: 1102524 - DNA, 21 bp, Homo sapiens
catattctaagttagactctt

SEQ ID NO: 1102525 - DNA, 13 bp, Homo sapiens
catattctgtctg

SEQ ID NO: 1102526 - DNA, 21 bp, Homo sapiens
catattgctgagagaaatatg

SEQ ID NO: 1102527 - DNA, 23 bp, Homo sapiens
catattgctgagagaaatatgga

SEQ ID NO: 1102528 - DNA, 23 bp, Homo sapiens
catattggattgcgcctttgtat

SEQ ID NO: 1102529 - DNA, 13 bp, Homo sapiens
catattgtatgta

SEQ ID NO: 1102530 - DNA, 15 bp, Homo sapiens
catattgtatgtaag

SEQ ID NO: 1102531 - DNA, 22 bp, Homo sapiens
catattgtgccaatatgtattg

SEQ ID NO: 1102532 - DNA, 23 bp, Homo sapiens
catattgttagggtcagccattt

SEQ ID NO: 1102533 - DNA, 19 bp, Homo sapiens
catattgttgcattgcttt

SEQ ID NO: 1102534 - DNA, 15 bp, Homo sapiens
catatttaatgtttt

SEQ ID NO: 1102535 - DNA, 16 bp, Homo sapiens
catatttaatgtttta

SEQ ID NO: 1102536 - DNA, 18 bp, Homo sapiens
catatttaatgttttaaa

SEQ ID NO: 1102537 - DNA, 20 bp, Homo sapiens
catatttaatgttttaaatg

SEQ ID NO: 1102538 - DNA, 16 bp, Homo sapiens
catatttacttcttat

SEQ ID NO: 1102539 - DNA, 19 bp, Homo sapiens
catatttatattgtatatt

SEQ ID NO: 1102540 - DNA, 22 bp, Homo sapiens
catatttatccaaaatgtgtat

SEQ ID NO: 1102541 - DNA, 21 bp, Homo sapiens
catatttattgcattgctggt

SEQ ID NO: 1102542 - DNA, 14 bp, Homo sapiens
catatttatttcag

SEQ ID NO: 1102543 - DNA, 14 bp, Homo sapiens
catatttctgtata

SEQ ID NO: 1102544 - DNA, 22 bp, Homo sapiens
catatttctgtatatttgtcat

SEQ ID NO: 1102545 - DNA, 23 bp, Homo sapiens
catatttctgtatatttgtcatg

SEQ ID NO: 1102546 - DNA, 14 bp, Homo sapiens
catatttctttggc

SEQ ID NO: 1102547 - DNA, 19 bp, Homo sapiens
catatttgactctttcaaa

SEQ ID NO: 1102548 - DNA, 22 bp, Homo sapiens
catatttgactctttcaaagaa

SEQ ID NO: 1102549 - DNA, 12 bp, Homo sapiens
catatttgagaa

SEQ ID NO: 1102550 - DNA, 15 bp, Homo sapiens
catatttgagactag

SEQ ID NO: 1102551 - DNA, 14 bp, Homo sapiens
catatttgatttct

SEQ ID NO: 1102552 - DNA, 16 bp, Homo sapiens
catatttgatttctaa

SEQ ID NO: 1102553 - DNA, 21 bp, Homo sapiens
catatttgatttctaattgta

SEQ ID NO: 1102554 - DNA, 22 bp, Homo sapiens
catatttgtatagttgcttgcc

SEQ ID NO: 1102555 - DNA, 17 bp, Homo sapiens
catatttgtctttgaat

SEQ ID NO: 1102556 - DNA, 23 bp, Homo sapiens
catatttgtttatggtaaaaaat

SEQ ID NO: 1102557 - DNA, 18 bp, Homo sapiens
catattttaaacagagga

SEQ ID NO: 1102558 - DNA, 17 bp, Homo sapiens
catattttattactgtt

SEQ ID NO: 1102559 - DNA, 18 bp, Homo sapiens
catattttattactgttt

SEQ ID NO: 1102560 - DNA, 13 bp, Homo sapiens
catattttcttac

SEQ ID NO: 1102561 - DNA, 19 bp, Homo sapiens
catattttcttacttttat

SEQ ID NO: 1102562 - DNA, 15 bp, Homo sapiens
catatttttatactt

SEQ ID NO: 1102563 - DNA, 17 bp, Homo sapiens
catatttttctaaagaa

SEQ ID NO: 1102564 - DNA, 20 bp, Homo sapiens
catatttttgatcatccctt

SEQ ID NO: 1102565 - DNA, 18 bp, Homo sapiens
catcaaaaactttggagt

SEQ ID NO: 1102566 - DNA, 18 bp, Homo sapiens
catcaaaaagccttattt

SEQ ID NO: 1102567 - DNA, 15 bp, Homo sapiens
catcaaaatcatgga

SEQ ID NO: 1102568 - DNA, 18 bp, Homo sapiens
catcaaacatttgccaag

SEQ ID NO: 1102569 - DNA, 16 bp, Homo sapiens
catccttggtgctctt

SEQ ID NO: 1102570 - DNA, 19 bp, Homo sapiens
catccttggtgctcttgct

SEQ ID NO: 1102571 - DNA, 21 bp, Homo sapiens
catccttggtgctcttgcttt

SEQ ID NO: 1102572 - DNA, 22 bp, Homo sapiens
catccttggtgctcttgctttt

SEQ ID NO: 1102573 - DNA, 14 bp, Homo sapiens
catccttgtaatac

SEQ ID NO: 1102574 - DNA, 15 bp, Homo sapiens
catcctttccctctc

SEQ ID NO: 1102575 - DNA, 22 bp, Homo sapiens
catcctttcctctagcttttct

SEQ ID NO: 1102576 - DNA, 18 bp, Homo sapiens
catcctttgttctgagca

SEQ ID NO: 1102577 - DNA, 11 bp, Homo sapiens
catcctttttt

SEQ ID NO: 1102578 - DNA, 20 bp, Homo sapiens
catccttttttctcttctgt

SEQ ID NO: 1102579 - DNA, 23 bp, Homo sapiens
catccttttttctcttctgtcca

SEQ ID NO: 1102580 - DNA, 17 bp, Homo sapiens
catcgaagggattgtgt

SEQ ID NO: 1102581 - DNA, 18 bp, Homo sapiens
catcgaagggattgtgta

SEQ ID NO: 1102582 - DNA, 21 bp, Homo sapiens
catcgaatctactaattccac

SEQ ID NO: 1102583 - DNA, 15 bp, Homo sapiens
catcgaatgtgtaca

SEQ ID NO: 1102584 - DNA, 18 bp, Homo sapiens
catcgatatgtatatcat

SEQ ID NO: 1102585 - DNA, 12 bp, Homo sapiens
catcgcaatgta

SEQ ID NO: 1102586 - DNA, 16 bp, Homo sapiens
catcgcaccattctga

SEQ ID NO: 1102587 - DNA, 23 bp, Homo sapiens
catcgcaggagtctctgccaccc

SEQ ID NO: 1102588 - DNA, 17 bp, Homo sapiens
catcgccatcttcttcc

SEQ ID NO: 1102589 - DNA, 17 bp, Homo sapiens
catcgcctctgtctcct

SEQ ID NO: 1102590 - DNA, 15 bp, Homo sapiens
catcggaaaaataat

SEQ ID NO: 1102591 - DNA, 19 bp, Homo sapiens
catcggacaagacccccag

SEQ ID NO: 1102592 - DNA, 15 bp, Homo sapiens
catcggacaggagga

SEQ ID NO: 1102593 - DNA, 16 bp, Homo sapiens
catcggccctgtcccc

SEQ ID NO: 1102594 - DNA, 19 bp, Homo sapiens
catcgggagcacccagagc

SEQ ID NO: 1102595 - DNA, 15 bp, Homo sapiens
catcgggcccaggga

SEQ ID NO: 1102596 - DNA, 16 bp, Homo sapiens
catcgggcccagggac

SEQ ID NO: 1102597 - DNA, 13 bp, Homo sapiens
catcgggggcctg

SEQ ID NO: 1102598 - DNA, 15 bp, Homo sapiens
catcgggggcctgca

SEQ ID NO: 1102599 - DNA, 18 bp, Homo sapiens
catcggtgtccatttata

SEQ ID NO: 1102600 - DNA, 13 bp, Homo sapiens
catcgtccagccc

SEQ ID NO: 1102601 - DNA, 16 bp, Homo sapiens
catcgtccagccctcc

SEQ ID NO: 1102602 - DNA, 15 bp, Homo sapiens
catcgtcctgggact

SEQ ID NO: 1102603 - DNA, 15 bp, Homo sapiens
catcgtccttcctct

SEQ ID NO: 1102604 - DNA, 16 bp, Homo sapiens
catcgtccttcctctc

SEQ ID NO: 1102605 - DNA, 21 bp, Homo sapiens
catcgtctcatcctcctttca

SEQ ID NO: 1102606 - DNA, 16 bp, Homo sapiens
catcgtgacccttcag

SEQ ID NO: 1102607 - DNA, 23 bp, Homo sapiens
catcgttgcaaccactgcaatat

SEQ ID NO: 1102608 - DNA, 19 bp, Homo sapiens
catctaaacacaacaataa

SEQ ID NO: 1102609 - DNA, 12 bp, Homo sapiens
catctaaagctt

SEQ ID NO: 1102610 - DNA, 13 bp, Homo sapiens
catctaaagcttt

SEQ ID NO: 1102611 - DNA, 15 bp, Homo sapiens
catctaaagctttat

SEQ ID NO: 1102612 - DNA, 17 bp, Homo sapiens
catctaaagctttatct

SEQ ID NO: 1102613 - DNA, 20 bp, Homo sapiens
catctaaattctgataattt

SEQ ID NO: 1102614 - DNA, 16 bp, Homo sapiens
catctaagcctgaagg

SEQ ID NO: 1102615 - DNA, 16 bp, Homo sapiens
catctaataaatcagt

SEQ ID NO: 1102616 - DNA, 13 bp, Homo sapiens
catctaatgaaaa

SEQ ID NO: 1102617 - DNA, 19 bp, Homo sapiens
catctaatgcttgtttatg

SEQ ID NO: 1102618 - DNA, 18 bp, Homo sapiens
catctaatgtctcttcct

SEQ ID NO: 1102619 - DNA, 22 bp, Homo sapiens
catctacgtatggctccacacc

SEQ ID NO: 1102620 - DNA, 17 bp, Homo sapiens
catctactctaaagaaa

SEQ ID NO: 1102621 - DNA, 14 bp, Homo sapiens
catctagcagctgg

SEQ ID NO: 1102622 - DNA, 16 bp, Homo sapiens
catctagcagctggcc

SEQ ID NO: 1102623 - DNA, 16 bp, Homo sapiens
catctagcagtaaata

SEQ ID NO: 1102624 - DNA, 22 bp, Homo sapiens
catctagcagtaaatacttgca

SEQ ID NO: 1102625 - DNA, 12 bp, Homo sapiens
catctagccagc

SEQ ID NO: 1102626 - DNA, 14 bp, Homo sapiens
catctataaattgt

SEQ ID NO: 1102627 - DNA, 19 bp, Homo sapiens
catctatgtcccttgctgt

SEQ ID NO: 1102628 - DNA, 19 bp, Homo sapiens
catctattgcagagactca

SEQ ID NO: 1102629 - DNA, 14 bp, Homo sapiens
catctattttggat

SEQ ID NO: 1102630 - DNA, 16 bp, Homo sapiens
catctattttggattg

SEQ ID NO: 1102631 - DNA, 19 bp, Homo sapiens
catctcaaaacagagggct

SEQ ID NO: 1102632 - DNA, 19 bp, Homo sapiens
catctcactggatgcaaag

SEQ ID NO: 1102633 - DNA, 18 bp, Homo sapiens
catctcagaccctttagc

SEQ ID NO: 1102634 - DNA, 13 bp, Homo sapiens
catctcagattct

SEQ ID NO: 1102635 - DNA, 14 bp, Homo sapiens
catctcagattctg

SEQ ID NO: 1102636 - DNA, 20 bp, Homo sapiens
catctcagcctcctgagcct

SEQ ID NO: 1102637 - DNA, 22 bp, Homo sapiens
catctcaggccacctgccccct

SEQ ID NO: 1102638 - DNA, 16 bp, Homo sapiens
catctcaggggccaga

SEQ ID NO: 1102639 - DNA, 13 bp, Homo sapiens
catctcaggtgcc

SEQ ID NO: 1102640 - DNA, 19 bp, Homo sapiens
catctcaggtgccactccc

SEQ ID NO: 1102641 - DNA, 21 bp, Homo sapiens
catctcaggttggcggcagac

SEQ ID NO: 1102642 - DNA, 17 bp, Homo sapiens
catctcagtatgaatta

SEQ ID NO: 1102643 - DNA, 12 bp, Homo sapiens
catctcatcctg

SEQ ID NO: 1102644 - DNA, 17 bp, Homo sapiens
catctcatcctggcacg

SEQ ID NO: 1102645 - DNA, 23 bp, Homo sapiens
catctcatgaggggagaggagac

SEQ ID NO: 1102646 - DNA, 18 bp, Homo sapiens
catctccaaggatcctct

SEQ ID NO: 1102647 - DNA, 13 bp, Homo sapiens
catctccagggaa

SEQ ID NO: 1102648 - DNA, 21 bp, Homo sapiens
catctccagggagtcccctcc

SEQ ID NO: 1102649 - DNA, 22 bp, Homo sapiens
catctccatgtagaataaatga

SEQ ID NO: 1102650 - DNA, 18 bp, Homo sapiens
catctcccagataatgtg

SEQ ID NO: 1102651 - DNA, 15 bp, Homo sapiens
catctccccaggcct

SEQ ID NO: 1102652 - DNA, 18 bp, Homo sapiens
catctccccaggcctcca

SEQ ID NO: 1102653 - DNA, 22 bp, Homo sapiens
catctccccaggcctccagcct

SEQ ID NO: 1102654 - DNA, 15 bp, Homo sapiens
catctcccctcctgg

SEQ ID NO: 1102655 - DNA, 16 bp, Homo sapiens
catctcccctcctggc

SEQ ID NO: 1102656 - DNA, 15 bp, Homo sapiens
catctccctccccag

SEQ ID NO: 1102657 - DNA, 13 bp, Homo sapiens
catctccctgcca

SEQ ID NO: 1102658 - DNA, 16 bp, Homo sapiens
catctccctgccatcc

SEQ ID NO: 1102659 - DNA, 17 bp, Homo sapiens
catctccctgccatccc

SEQ ID NO: 1102660 - DNA, 22 bp, Homo sapiens
catctccctgccatccccctct

SEQ ID NO: 1102661 - DNA, 13 bp, Homo sapiens
catctccctgcct

SEQ ID NO: 1102662 - DNA, 17 bp, Homo sapiens
catctccctgcctggcc

SEQ ID NO: 1102663 - DNA, 18 bp, Homo sapiens
catctccctgcctggccc

SEQ ID NO: 1102664 - DNA, 19 bp, Homo sapiens
catctccctgcctggcccc

SEQ ID NO: 1102665 - DNA, 21 bp, Homo sapiens
catctccctgcctggccccca

SEQ ID NO: 1102666 - DNA, 12 bp, Homo sapiens
catctccctgct

SEQ ID NO: 1102667 - DNA, 14 bp, Homo sapiens
catctcccttcatt

SEQ ID NO: 1102668 - DNA, 17 bp, Homo sapiens
catctcccttttccatg

SEQ ID NO: 1102669 - DNA, 21 bp, Homo sapiens
catctcctataatctgtcaaa

SEQ ID NO: 1102670 - DNA, 20 bp, Homo sapiens
catctcctccatactcagga

SEQ ID NO: 1102671 - DNA, 17 bp, Homo sapiens
catctcctgaccctccc

SEQ ID NO: 1102672 - DNA, 23 bp, Homo sapiens
catctcctgaccctcccactccc

SEQ ID NO: 1102673 - DNA, 12 bp, Homo sapiens
catctcctgagt

SEQ ID NO: 1102674 - DNA, 16 bp, Homo sapiens
catctcctgccttcct

SEQ ID NO: 1102675 - DNA, 19 bp, Homo sapiens
catctcctgccttcctcct

SEQ ID NO: 1102676 - DNA, 19 bp, Homo sapiens
catctcctgtgcatgggtg

SEQ ID NO: 1102677 - DNA, 17 bp, Homo sapiens
catctccttacctctgg

SEQ ID NO: 1102678 - DNA, 18 bp, Homo sapiens
catctcgagccccctgga

SEQ ID NO: 1102679 - DNA, 14 bp, Homo sapiens
catctcggagcatc

SEQ ID NO: 1102680 - DNA, 21 bp, Homo sapiens
catctcggagcatcccggagg

SEQ ID NO: 1102681 - DNA, 22 bp, Homo sapiens
catctcgggagtcctctagcag

SEQ ID NO: 1102682 - DNA, 15 bp, Homo sapiens
catctcggggctgct

SEQ ID NO: 1102683 - DNA, 16 bp, Homo sapiens
catctcggggctgctg

SEQ ID NO: 1102684 - DNA, 16 bp, Homo sapiens
catctctacaaaaagc

SEQ ID NO: 1102685 - DNA, 23 bp, Homo sapiens
catctctagtgtagctgccacat

SEQ ID NO: 1102686 - DNA, 20 bp, Homo sapiens
catctctcccacttcctcct

SEQ ID NO: 1102687 - DNA, 12 bp, Homo sapiens
catctctccctc

SEQ ID NO: 1102688 - DNA, 16 bp, Homo sapiens
catctctccctcccct

SEQ ID NO: 1102689 - DNA, 13 bp, Homo sapiens
catctctcctccc

SEQ ID NO: 1102690 - DNA, 21 bp, Homo sapiens
catctctctacctccaccctg

SEQ ID NO: 1102691 - DNA, 17 bp, Homo sapiens
catgcatttgaggtcaa

SEQ ID NO: 1102692 - DNA, 18 bp, Homo sapiens
catgccaataaagtgatc

SEQ ID NO: 1102693 - DNA, 21 bp, Homo sapiens
catgccaccatggccagccaa

SEQ ID NO: 1102694 - DNA, 19 bp, Homo sapiens
catgccactacactccagc

SEQ ID NO: 1102695 - DNA, 14 bp, Homo sapiens
catgccactgccag

SEQ ID NO: 1102696 - DNA, 22 bp, Homo sapiens
catgccagaaggaatcttctca

SEQ ID NO: 1102697 - DNA, 18 bp, Homo sapiens
catgccagacccactgaa

SEQ ID NO: 1102698 - DNA, 13 bp, Homo sapiens
catgccagagagg

SEQ ID NO: 1102699 - DNA, 22 bp, Homo sapiens
catgccagattctgcctctctg

SEQ ID NO: 1102700 - DNA, 23 bp, Homo sapiens
catgccagattctgcctctctgg

SEQ ID NO: 1102701 - DNA, 21 bp, Homo sapiens
catgccagctacttcctcctc

SEQ ID NO: 1102702 - DNA, 19 bp, Homo sapiens
catgccaggaacctgtcct

SEQ ID NO: 1102703 - DNA, 23 bp, Homo sapiens
catgccaggacccgccagccccg

SEQ ID NO: 1102704 - DNA, 16 bp, Homo sapiens
catgccaggctaattt

SEQ ID NO: 1102705 - DNA, 21 bp, Homo sapiens
catgccaggttaggaaggcag

SEQ ID NO: 1102706 - DNA, 16 bp, Homo sapiens
catgcccaaggcctag

SEQ ID NO: 1102707 - DNA, 16 bp, Homo sapiens
catgcccacctgccca

SEQ ID NO: 1102708 - DNA, 19 bp, Homo sapiens
catgcccagattcccagac

SEQ ID NO: 1102709 - DNA, 13 bp, Homo sapiens
catgcccagctct

SEQ ID NO: 1102710 - DNA, 12 bp, Homo sapiens
catgccccaccc

SEQ ID NO: 1102711 - DNA, 21 bp, Homo sapiens
catgccccacccccctcctcc

SEQ ID NO: 1102712 - DNA, 23 bp, Homo sapiens
catgccccacccccctcctcccc

SEQ ID NO: 1102713 - DNA, 17 bp, Homo sapiens
catgccccagctctgga

SEQ ID NO: 1102714 - DNA, 13 bp, Homo sapiens
catgccccagtcg

SEQ ID NO: 1102715 - DNA, 19 bp, Homo sapiens
catgcccccctcaaacctc

SEQ ID NO: 1102716 - DNA, 22 bp, Homo sapiens
catgccccctcccttcacaggg

SEQ ID NO: 1102717 - DNA, 17 bp, Homo sapiens
catgcccccttcgctcc

SEQ ID NO: 1102718 - DNA, 12 bp, Homo sapiens
catgcccctccc

SEQ ID NO: 1102719 - DNA, 16 bp, Homo sapiens
catgcccctggctggg

SEQ ID NO: 1102720 - DNA, 13 bp, Homo sapiens
catgccccttggg

SEQ ID NO: 1102721 - DNA, 18 bp, Homo sapiens
catgcccgagtccgccca

SEQ ID NO: 1102722 - DNA, 12 bp, Homo sapiens
catgccctagac

SEQ ID NO: 1102723 - DNA, 20 bp, Homo sapiens
catgccctagaccctcccca

SEQ ID NO: 1102724 - DNA, 21 bp, Homo sapiens
catgccctagaccctccccaa

SEQ ID NO: 1102725 - DNA, 14 bp, Homo sapiens
catgccctcccttc

SEQ ID NO: 1102726 - DNA, 22 bp, Homo sapiens
catgccctcccttctccctgga

SEQ ID NO: 1102727 - DNA, 13 bp, Homo sapiens
catgccctcctgg

SEQ ID NO: 1102728 - DNA, 14 bp, Homo sapiens
catgccctgtgcaa

SEQ ID NO: 1102729 - DNA, 17 bp, Homo sapiens
catgccctgtgtggctg

SEQ ID NO: 1102730 - DNA, 18 bp, Homo sapiens
catgccgatttcatacct

SEQ ID NO: 1102731 - DNA, 23 bp, Homo sapiens
catgccgggcccctccatccacc

SEQ ID NO: 1102732 - DNA, 18 bp, Homo sapiens
catgcctcactaattttt

SEQ ID NO: 1102733 - DNA, 16 bp, Homo sapiens
catgcctcagccctga

SEQ ID NO: 1102734 - DNA, 20 bp, Homo sapiens
catgcctcagccctgaccct

SEQ ID NO: 1102735 - DNA, 17 bp, Homo sapiens
catgcctcatgccacac

SEQ ID NO: 1102736 - DNA, 11 bp, Homo sapiens
catgcctccct

SEQ ID NO: 1102737 - DNA, 23 bp, Homo sapiens
catgcctccctgggccacctcct

SEQ ID NO: 1102738 - DNA, 15 bp, Homo sapiens
catgcctcctcagga

SEQ ID NO: 1102739 - DNA, 11 bp, Homo sapiens
catgcctgagg

SEQ ID NO: 1102740 - DNA, 10 bp, Homo sapiens
catgcctgca

SEQ ID NO: 1102741 - DNA, 13 bp, Homo sapiens
catgcctgcacct

SEQ ID NO: 1102742 - DNA, 20 bp, Homo sapiens
catgcctgccaaagacgtgt

SEQ ID NO: 1102743 - DNA, 17 bp, Homo sapiens
catgcctggacaaaccc

SEQ ID NO: 1102744 - DNA, 16 bp, Homo sapiens
catgcctggtattttc

SEQ ID NO: 1102745 - DNA, 18 bp, Homo sapiens
catgcctggtattttcaa

SEQ ID NO: 1102746 - DNA, 17 bp, Homo sapiens
catgcctgtccagcctg

SEQ ID NO: 1102747 - DNA, 18 bp, Homo sapiens
catgcctgtccagcctgg

SEQ ID NO: 1102748 - DNA, 21 bp, Homo sapiens
catgcctgtccagcctgggca

SEQ ID NO: 1102749 - DNA, 13 bp, Homo sapiens
catgcctgtctct

SEQ ID NO: 1102750 - DNA, 18 bp, Homo sapiens
catgcctgtgatcctagc

SEQ ID NO: 1102751 - DNA, 23 bp, Homo sapiens
catgcctgtgtgacatcagtggc

SEQ ID NO: 1102752 - DNA, 16 bp, Homo sapiens
catgccttaaatttgt

SEQ ID NO: 1102753 - DNA, 17 bp, Homo sapiens
catgccttgataaatat

SEQ ID NO: 1102754 - DNA, 21 bp, Homo sapiens
catgccttgataaatatatat

SEQ ID NO: 1102755 - DNA, 14 bp, Homo sapiens
catgcgaaatgttc

SEQ ID NO: 1102756 - DNA, 16 bp, Homo sapiens
catgcgaaatgttctc

SEQ ID NO: 1102757 - DNA, 13 bp, Homo sapiens
catgcgaggggcc

SEQ ID NO: 1102758 - DNA, 22 bp, Homo sapiens
catgcgaggggccagcagaggg

SEQ ID NO: 1102759 - DNA, 18 bp, Homo sapiens
catgcgcacagagggaag

SEQ ID NO: 1102760 - DNA, 15 bp, Homo sapiens
catgcgcagatgagg

SEQ ID NO: 1102761 - DNA, 19 bp, Homo sapiens
catgcgcagatgaggggcc

SEQ ID NO: 1102762 - DNA, 13 bp, Homo sapiens
catgcgcaggctc

SEQ ID NO: 1102763 - DNA, 17 bp, Homo sapiens
catgcgccaccatgccc

SEQ ID NO: 1102764 - DNA, 23 bp, Homo sapiens
catgcggtgccatgaagggaccc

SEQ ID NO: 1102765 - DNA, 15 bp, Homo sapiens
catgcgtcaggggcc

SEQ ID NO: 1102766 - DNA, 19 bp, Homo sapiens
catgcgtgccgcctgctcc

SEQ ID NO: 1102767 - DNA, 23 bp, Homo sapiens
catgcgtggccacgggggcagtg

SEQ ID NO: 1102768 - DNA, 13 bp, Homo sapiens
catgctaagagaa

SEQ ID NO: 1102769 - DNA, 17 bp, Homo sapiens
catgctaagagaagtag

SEQ ID NO: 1102770 - DNA, 19 bp, Homo sapiens
catgctaagagaagtagaa

SEQ ID NO: 1102771 - DNA, 23 bp, Homo sapiens
catgctacacactgcatgtttgt

SEQ ID NO: 1102772 - DNA, 17 bp, Homo sapiens
catgctatctgttccta

SEQ ID NO: 1102773 - DNA, 21 bp, Homo sapiens
catgctatgctgaagacattc

SEQ ID NO: 1102774 - DNA, 12 bp, Homo sapiens
catgctatgttc

SEQ ID NO: 1102775 - DNA, 19 bp, Homo sapiens
catgctatgttctgtcttc

SEQ ID NO: 1102776 - DNA, 20 bp, Homo sapiens
catgctcaacccccctccca

SEQ ID NO: 1102777 - DNA, 14 bp, Homo sapiens
catgctcacctcta

SEQ ID NO: 1102778 - DNA, 15 bp, Homo sapiens
catgctcagccctga

SEQ ID NO: 1102779 - DNA, 16 bp, Homo sapiens
catgctcagtgccttt

SEQ ID NO: 1102780 - DNA, 15 bp, Homo sapiens
catgctccaaatata

SEQ ID NO: 1102781 - DNA, 13 bp, Homo sapiens
catgctcctggcc

SEQ ID NO: 1102782 - DNA, 17 bp, Homo sapiens
catgctccttgagagga

SEQ ID NO: 1102783 - DNA, 13 bp, Homo sapiens
catgctctctgca

SEQ ID NO: 1102784 - DNA, 15 bp, Homo sapiens
catgctctctgcagc

SEQ ID NO: 1102785 - DNA, 13 bp, Homo sapiens
catgctctgcccc

SEQ ID NO: 1102786 - DNA, 14 bp, Homo sapiens
catgctctgcccca

SEQ ID NO: 1102787 - DNA, 16 bp, Homo sapiens
catgctctgccccaag

SEQ ID NO: 1102788 - DNA, 19 bp, Homo sapiens
catgctctgccccaagccc

SEQ ID NO: 1102789 - DNA, 13 bp, Homo sapiens
catgctctttttc

SEQ ID NO: 1102790 - DNA, 17 bp, Homo sapiens
catgctgaaaaatatag

SEQ ID NO: 1102791 - DNA, 20 bp, Homo sapiens
catgctgaaaaatatagcct

SEQ ID NO: 1102792 - DNA, 18 bp, Homo sapiens
catgctgaagggaccttg

SEQ ID NO: 1102793 - DNA, 15 bp, Homo sapiens
catgctgaggcctgg

SEQ ID NO: 1102794 - DNA, 17 bp, Homo sapiens
catgctgaggcctgggc

SEQ ID NO: 1102795 - DNA, 18 bp, Homo sapiens
catgctgaggcctgggcc

SEQ ID NO: 1102796 - DNA, 21 bp, Homo sapiens
catgctgaggttttgaataaa

SEQ ID NO: 1102797 - DNA, 18 bp, Homo sapiens
catgctgcaaaggagaag

SEQ ID NO: 1102798 - DNA, 20 bp, Homo sapiens
catgctgcctggcacagacc

SEQ ID NO: 1102799 - DNA, 21 bp, Homo sapiens
catgctgcctggcacagacca

SEQ ID NO: 1102800 - DNA, 14 bp, Homo sapiens
catgctgccttcag

SEQ ID NO: 1102801 - DNA, 17 bp, Homo sapiens
catgctgccttcaggga

SEQ ID NO: 1102802 - DNA, 12 bp, Homo sapiens
catgctgctttg

SEQ ID NO: 1102803 - DNA, 15 bp, Homo sapiens
catgctgctttgcca

SEQ ID NO: 1102804 - DNA, 21 bp, Homo sapiens
catgctgctttttggcacagt

SEQ ID NO: 1102805 - DNA, 22 bp, Homo sapiens
catgctggaacctgcaaaaaat

SEQ ID NO: 1102806 - DNA, 22 bp, Homo sapiens
catgctggaggtgacatctctt

SEQ ID NO: 1102807 - DNA, 23 bp, Homo sapiens
catgctgggaagacgcctgagct

SEQ ID NO: 1102808 - DNA, 14 bp, Homo sapiens
catgctgggccact

SEQ ID NO: 1102809 - DNA, 16 bp, Homo sapiens
catgctgtacttgtgg

SEQ ID NO: 1102810 - DNA, 15 bp, Homo sapiens
catgctgtccctgca

SEQ ID NO: 1102811 - DNA, 17 bp, Homo sapiens
catgctgtccctgcact

SEQ ID NO: 1102812 - DNA, 23 bp, Homo sapiens
catgctgtccctgcactgtgccc

SEQ ID NO: 1102813 - DNA, 20 bp, Homo sapiens
catgtggcccaactctcctg

SEQ ID NO: 1102814 - DNA, 21 bp, Homo sapiens
catgtggcctgcccagcctca

SEQ ID NO: 1102815 - DNA, 17 bp, Homo sapiens
catgtggcctttatctc

SEQ ID NO: 1102816 - DNA, 15 bp, Homo sapiens
catgtggctggaaga

SEQ ID NO: 1102817 - DNA, 20 bp, Homo sapiens
catgtggcttttttaaaaaa

SEQ ID NO: 1102818 - DNA, 18 bp, Homo sapiens
catgtggggccaggtcac

SEQ ID NO: 1102819 - DNA, 19 bp, Homo sapiens
catgtgggtcttccagggg

SEQ ID NO: 1102820 - DNA, 20 bp, Homo sapiens
catgtgggtgagccagtgga

SEQ ID NO: 1102821 - DNA, 15 bp, Homo sapiens
catgtgggtgagtta

SEQ ID NO: 1102822 - DNA, 12 bp, Homo sapiens
catgtggtggga

SEQ ID NO: 1102823 - DNA, 22 bp, Homo sapiens
catgtgtacattctgcctagag

SEQ ID NO: 1102824 - DNA, 12 bp, Homo sapiens
catgtgtatgtg

SEQ ID NO: 1102825 - DNA, 18 bp, Homo sapiens
catgtgtcccaggagcag

SEQ ID NO: 1102826 - DNA, 21 bp, Homo sapiens
catgtgtgagtgtgtgcaagt

SEQ ID NO: 1102827 - DNA, 18 bp, Homo sapiens
catgtgtgcaacagggta

SEQ ID NO: 1102828 - DNA, 14 bp, Homo sapiens
catgtgtgcctgtg

SEQ ID NO: 1102829 - DNA, 16 bp, Homo sapiens
catgtgtgcctgtggc

SEQ ID NO: 1102830 - DNA, 12 bp, Homo sapiens
catgtgtggaag

SEQ ID NO: 1102831 - DNA, 13 bp, Homo sapiens
catgtgtggaagt

SEQ ID NO: 1102832 - DNA, 18 bp, Homo sapiens
catgtgtggtggtgtttt

SEQ ID NO: 1102833 - DNA, 23 bp, Homo sapiens
catgtgtgtccacgactgtctcc

SEQ ID NO: 1102834 - DNA, 15 bp, Homo sapiens
catgtgtgtgtctgt

SEQ ID NO: 1102835 - DNA, 19 bp, Homo sapiens
catgtgtgtgtctgtcttt

SEQ ID NO: 1102836 - DNA, 16 bp, Homo sapiens
catgtgttaagtattt

SEQ ID NO: 1102837 - DNA, 15 bp, Homo sapiens
catgtgttaatctta

SEQ ID NO: 1102838 - DNA, 16 bp, Homo sapiens
catgtgttatgttttc

SEQ ID NO: 1102839 - DNA, 14 bp, Homo sapiens
catgtgttgaaaaa

SEQ ID NO: 1102840 - DNA, 20 bp, Homo sapiens
catgtgttggggagacatca

SEQ ID NO: 1102841 - DNA, 13 bp, Homo sapiens
catgtgtttctga

SEQ ID NO: 1102842 - DNA, 19 bp, Homo sapiens
catgtgtttggttctgggg

SEQ ID NO: 1102843 - DNA, 15 bp, Homo sapiens
catgtgttttcatca

SEQ ID NO: 1102844 - DNA, 21 bp, Homo sapiens
catgtgttttcatcatttcag

SEQ ID NO: 1102845 - DNA, 22 bp, Homo sapiens
catgtgttttcatcatttcagc

SEQ ID NO: 1102846 - DNA, 16 bp, Homo sapiens
catgttaaattagaat

SEQ ID NO: 1102847 - DNA, 16 bp, Homo sapiens
catgttacataagata

SEQ ID NO: 1102848 - DNA, 21 bp, Homo sapiens
catgttacataagataaatgt

SEQ ID NO: 1102849 - DNA, 17 bp, Homo sapiens
catgttacctcctataa

SEQ ID NO: 1102850 - DNA, 22 bp, Homo sapiens
catgttactaaatggtgttaca

SEQ ID NO: 1102851 - DNA, 23 bp, Homo sapiens
catgttactaaatggtgttacat

SEQ ID NO: 1102852 - DNA, 19 bp, Homo sapiens
catgttagggttatgtttt

SEQ ID NO: 1102853 - DNA, 24 bp, Homo sapiens
catgttagttaccttatagttact

SEQ ID NO: 1102854 - DNA, 22 bp, Homo sapiens
catgttatatattttttgtagg

SEQ ID NO: 1102855 - DNA, 20 bp, Homo sapiens
catgttatatttaatgcatt

SEQ ID NO: 1102856 - DNA, 14 bp, Homo sapiens
catgttattttatt

SEQ ID NO: 1102857 - DNA, 17 bp, Homo sapiens
catgttattttattatt

SEQ ID NO: 1102858 - DNA, 22 bp, Homo sapiens
catgttcattataatctcaaag

SEQ ID NO: 1102859 - DNA, 17 bp, Homo sapiens
catgttccctttaaaat

SEQ ID NO: 1102860 - DNA, 13 bp, Homo sapiens
catgttcctcctt

SEQ ID NO: 1102861 - DNA, 15 bp, Homo sapiens
catgttctatgtgtt

SEQ ID NO: 1102862 - DNA, 15 bp, Homo sapiens
catgttctgccccca

SEQ ID NO: 1102863 - DNA, 20 bp, Homo sapiens
catgttctgcccccagccca

SEQ ID NO: 1102864 - DNA, 20 bp, Homo sapiens
catgttcttgtcataaaatg

SEQ ID NO: 1102865 - DNA, 17 bp, Homo sapiens
catgttgatcatgtact

SEQ ID NO: 1102866 - DNA, 22 bp, Homo sapiens
catgttgcccctttctcttttc

SEQ ID NO: 1102867 - DNA, 18 bp, Homo sapiens
catgttgcgttcaaagag

SEQ ID NO: 1102868 - DNA, 17 bp, Homo sapiens
catgttggaaatgtgtt

SEQ ID NO: 1102869 - DNA, 17 bp, Homo sapiens
catgttggtcaggctgg

SEQ ID NO: 1102870 - DNA, 12 bp, Homo sapiens
catgttgtaatg

SEQ ID NO: 1102871 - DNA, 23 bp, Homo sapiens
catgtttaaactttgtgcctttg

SEQ ID NO: 1102872 - DNA, 23 bp, Homo sapiens
catgtttaaatagcctaaatgat

SEQ ID NO: 1102873 - DNA, 21 bp, Homo sapiens
catgtttagtgaatgactttt

SEQ ID NO: 1102874 - DNA, 17 bp, Homo sapiens
catgtttattctgttcc

SEQ ID NO: 1102875 - DNA, 22 bp, Homo sapiens
catgtttattgttttttaaaga

SEQ ID NO: 1102876 - DNA, 18 bp, Homo sapiens
catgtttatttttcttgt

SEQ ID NO: 1102877 - DNA, 19 bp, Homo sapiens
catgtttatttttcttgtc

SEQ ID NO: 1102878 - DNA, 20 bp, Homo sapiens
catgtttatttttcttgtct

SEQ ID NO: 1102879 - DNA, 17 bp, Homo sapiens
catgtttcactcctgct

SEQ ID NO: 1102880 - DNA, 16 bp, Homo sapiens
catgtttcatgttttg

SEQ ID NO: 1102881 - DNA, 19 bp, Homo sapiens
catgtttccatcatttctg

SEQ ID NO: 1102882 - DNA, 22 bp, Homo sapiens
catgtttgcacctttctagttg

SEQ ID NO: 1102883 - DNA, 14 bp, Homo sapiens
catgtttgcttcat

SEQ ID NO: 1102884 - DNA, 13 bp, Homo sapiens
catgtttgtaaat

SEQ ID NO: 1102885 - DNA, 12 bp, Homo sapiens
catgtttgtgat

SEQ ID NO: 1102886 - DNA, 16 bp, Homo sapiens
catgttttataatttg

SEQ ID NO: 1102887 - DNA, 16 bp, Homo sapiens
catgttttcaactgcc

SEQ ID NO: 1102888 - DNA, 17 bp, Homo sapiens
catgttttccattgttt

SEQ ID NO: 1102889 - DNA, 10 bp, Homo sapiens
catgttttct

SEQ ID NO: 1102890 - DNA, 21 bp, Homo sapiens
catgttttctgaaaatataac

SEQ ID NO: 1102891 - DNA, 12 bp, Homo sapiens
catgttttgtat

SEQ ID NO: 1102892 - DNA, 14 bp, Homo sapiens
catgttttgtgact

SEQ ID NO: 1102893 - DNA, 21 bp, Homo sapiens
catgttttgtgcatttgtaaa

SEQ ID NO: 1102894 - DNA, 20 bp, Homo sapiens
catgtttttctattaaaaat

SEQ ID NO: 1102895 - DNA, 13 bp, Homo sapiens
cattaaaaaatga

SEQ ID NO: 1102896 - DNA, 13 bp, Homo sapiens
cattaaaaattac

SEQ ID NO: 1102897 - DNA, 21 bp, Homo sapiens
cattaaaacaatattgtttct

SEQ ID NO: 1102898 - DNA, 13 bp, Homo sapiens
cattaaaactgct

SEQ ID NO: 1102899 - DNA, 14 bp, Homo sapiens
cattaaaactgctt

SEQ ID NO: 1102900 - DNA, 16 bp, Homo sapiens
cattaaaactgctttt

SEQ ID NO: 1102901 - DNA, 13 bp, Homo sapiens
cattaaaagaaaa

SEQ ID NO: 1102902 - DNA, 13 bp, Homo sapiens
cattaaaataaaa

SEQ ID NO: 1102903 - DNA, 19 bp, Homo sapiens
cattaaaataaaacaagcc

SEQ ID NO: 1102904 - DNA, 14 bp, Homo sapiens
cattaaaatataat

SEQ ID NO: 1102905 - DNA, 21 bp, Homo sapiens
cattaaaatatatgttctgca

SEQ ID NO: 1102906 - DNA, 15 bp, Homo sapiens
cattaaacaaataaa

SEQ ID NO: 1102907 - DNA, 16 bp, Homo sapiens
cattaaacactgtaat

SEQ ID NO: 1102908 - DNA, 18 bp, Homo sapiens
cattaaacactgtaatct

SEQ ID NO: 1102909 - DNA, 22 bp, Homo sapiens
cattaaacctgtctccactgtg

SEQ ID NO: 1102910 - DNA, 23 bp, Homo sapiens
cattaaacctgtctccactgtgc

SEQ ID NO: 1102911 - DNA, 18 bp, Homo sapiens
cattaaactctaaagatt

SEQ ID NO: 1102912 - DNA, 13 bp, Homo sapiens
cattaaacttgaa

SEQ ID NO: 1102913 - DNA, 15 bp, Homo sapiens
cattaaacttgaagc

SEQ ID NO: 1102914 - DNA, 11 bp, Homo sapiens
cattaaacttt

SEQ ID NO: 1102915 - DNA, 14 bp, Homo sapiens
cattaaactttttt

SEQ ID NO: 1102916 - DNA, 14 bp, Homo sapiens
cattaaagaagacc

SEQ ID NO: 1102917 - DNA, 21 bp, Homo sapiens
cattaaagccctgtgttaagt

SEQ ID NO: 1102918 - DNA, 22 bp, Homo sapiens
cattaaagccctgtgttaagtg

SEQ ID NO: 1102919 - DNA, 13 bp, Homo sapiens
cattaaataaatt

SEQ ID NO: 1102920 - DNA, 18 bp, Homo sapiens
cattaaatgcaataattt

SEQ ID NO: 1102921 - DNA, 20 bp, Homo sapiens
cattaaatgcaataatttta

SEQ ID NO: 1102922 - DNA, 13 bp, Homo sapiens
cattaaattacct

SEQ ID NO: 1102923 - DNA, 13 bp, Homo sapiens
cattaaattcaca

SEQ ID NO: 1102924 - DNA, 13 bp, Homo sapiens
cattaacacaaag

SEQ ID NO: 1102925 - DNA, 13 bp, Homo sapiens
cattaacagtttt

SEQ ID NO: 1102926 - DNA, 13 bp, Homo sapiens
cattaacattttt

SEQ ID NO: 1102927 - DNA, 18 bp, Homo sapiens
cattaactcattagactg

SEQ ID NO: 1102928 - DNA, 13 bp, Homo sapiens
cattaactccctc

SEQ ID NO: 1102929 - DNA, 14 bp, Homo sapiens
cattaactccctcc

SEQ ID NO: 1102930 - DNA, 15 bp, Homo sapiens
cattaactccctcca

SEQ ID NO: 1102931 - DNA, 12 bp, Homo sapiens
cattaagaaaat

SEQ ID NO: 1102932 - DNA, 20 bp, Homo sapiens
cattaagaagagcagagctg

SEQ ID NO: 1102933 - DNA, 16 bp, Homo sapiens
cattaagcacacacat

SEQ ID NO: 1102934 - DNA, 23 bp, Homo sapiens
cattaagcacacacatctggccc

SEQ ID NO: 1102935 - DNA, 15 bp, Homo sapiens
cattctgagctcccc

SEQ ID NO: 1102936 - DNA, 18 bp, Homo sapiens
cattctgataggaggggg

SEQ ID NO: 1102937 - DNA, 18 bp, Homo sapiens
cattctgcacgctgccca

SEQ ID NO: 1102938 - DNA, 21 bp, Homo sapiens
cattctgcattgctagataaa

SEQ ID NO: 1102939 - DNA, 18 bp, Homo sapiens
cattctgcctaacagaaa

SEQ ID NO: 1102940 - DNA, 14 bp, Homo sapiens
cattctgcctagag

SEQ ID NO: 1102941 - DNA, 19 bp, Homo sapiens
cattctgcctagagtgtag

SEQ ID NO: 1102942 - DNA, 22 bp, Homo sapiens
cattctgctacttcactgtcat

SEQ ID NO: 1102943 - DNA, 18 bp, Homo sapiens
cattctggaaacttttgt

SEQ ID NO: 1102944 - DNA, 12 bp, Homo sapiens
cattctggaggg

SEQ ID NO: 1102945 - DNA, 23 bp, Homo sapiens
cattctgtgaccaaaataccttg

SEQ ID NO: 1102946 - DNA, 14 bp, Homo sapiens
cattctgtttcctc

SEQ ID NO: 1102947 - DNA, 15 bp, Homo sapiens
cattctgtttcctct

SEQ ID NO: 1102948 - DNA, 16 bp, Homo sapiens
cattctgtttcctctt

SEQ ID NO: 1102949 - DNA, 22 bp, Homo sapiens
cattctgtttcctcttgatctc

SEQ ID NO: 1102950 - DNA, 13 bp, Homo sapiens
cattctgttttcc

SEQ ID NO: 1102951 - DNA, 21 bp, Homo sapiens
cattcttacaattgcactgct

SEQ ID NO: 1102952 - DNA, 18 bp, Homo sapiens
cattcttactaaaaagta

SEQ ID NO: 1102953 - DNA, 17 bp, Homo sapiens
cattcttcagtgtctct

SEQ ID NO: 1102954 - DNA, 20 bp, Homo sapiens
cattcttccatcatcactgt

SEQ ID NO: 1102955 - DNA, 22 bp, Homo sapiens
cattcttccatcatcactgtaa

SEQ ID NO: 1102956 - DNA, 21 bp, Homo sapiens
cattcttcctagttttctcct

SEQ ID NO: 1102957 - DNA, 16 bp, Homo sapiens
cattcttctctgttgt

SEQ ID NO: 1102958 - DNA, 18 bp, Homo sapiens
cattcttctgagcactgt

SEQ ID NO: 1102959 - DNA, 13 bp, Homo sapiens
cattcttctgggt

SEQ ID NO: 1102960 - DNA, 14 bp, Homo sapiens
cattcttctgggtg

SEQ ID NO: 1102961 - DNA, 17 bp, Homo sapiens
cattcttgagttttgat

SEQ ID NO: 1102962 - DNA, 20 bp, Homo sapiens
cattcttggcttaatcattt

SEQ ID NO: 1102963 - DNA, 18 bp, Homo sapiens
cattcttggttgttaatt

SEQ ID NO: 1102964 - DNA, 19 bp, Homo sapiens
cattcttggttgttaattt

SEQ ID NO: 1102965 - DNA, 17 bp, Homo sapiens
cattctttataaaatgt

SEQ ID NO: 1102966 - DNA, 21 bp, Homo sapiens
cattctttataatcctctgta

SEQ ID NO: 1102967 - DNA, 18 bp, Homo sapiens
cattctttatcttgacat

SEQ ID NO: 1102968 - DNA, 21 bp, Homo sapiens
cattctttcccctcagagctc

SEQ ID NO: 1102969 - DNA, 14 bp, Homo sapiens
cattctttccttct

SEQ ID NO: 1102970 - DNA, 13 bp, Homo sapiens
cattctttggtaa

SEQ ID NO: 1102971 - DNA, 14 bp, Homo sapiens
cattctttggtaat

SEQ ID NO: 1102972 - DNA, 18 bp, Homo sapiens
cattcttttaaaagacaa

SEQ ID NO: 1102973 - DNA, 19 bp, Homo sapiens
cattcttttgtaatttaaa

SEQ ID NO: 1102974 - DNA, 19 bp, Homo sapiens
cattgaaaagaagctctcc

SEQ ID NO: 1102975 - DNA, 17 bp, Homo sapiens
cattgaaagaagagatg

SEQ ID NO: 1102976 - DNA, 18 bp, Homo sapiens
cattgaaagaagagatga

SEQ ID NO: 1102977 - DNA, 14 bp, Homo sapiens
cattgaaagaatta

SEQ ID NO: 1102978 - DNA, 14 bp, Homo sapiens
cattgaaatcagca

SEQ ID NO: 1102979 - DNA, 18 bp, Homo sapiens
cattgaaattctgagaaa

SEQ ID NO: 1102980 - DNA, 15 bp, Homo sapiens
cattgaacacaaact

SEQ ID NO: 1102981 - DNA, 17 bp, Homo sapiens
cattgaacacaaactgt

SEQ ID NO: 1102982 - DNA, 14 bp, Homo sapiens
cattgaacagcaaa

SEQ ID NO: 1102983 - DNA, 15 bp, Homo sapiens
cattgaacagctgtg

SEQ ID NO: 1102984 - DNA, 23 bp, Homo sapiens
cattgaacagctgtgagccatgc

SEQ ID NO: 1102985 - DNA, 20 bp, Homo sapiens
cattgaacatttcttatgat

SEQ ID NO: 1102986 - DNA, 21 bp, Homo sapiens
cattgaacatttcttatgatt

SEQ ID NO: 1102987 - DNA, 22 bp, Homo sapiens
cattgaagaagaaccagcccag

SEQ ID NO: 1102988 - DNA, 18 bp, Homo sapiens
cattgaagccgactctgg

SEQ ID NO: 1102989 - DNA, 21 bp, Homo sapiens
cattgaagcttgcaccttttc

SEQ ID NO: 1102990 - DNA, 14 bp, Homo sapiens
cattgaaggcttaa

SEQ ID NO: 1102991 - DNA, 20 bp, Homo sapiens
cattgaagtatattcttatt

SEQ ID NO: 1102992 - DNA, 22 bp, Homo sapiens
cattgaatggctatgtttttaa

SEQ ID NO: 1102993 - DNA, 23 bp, Homo sapiens
cattgaattcttggttgaggaaa

SEQ ID NO: 1102994 - DNA, 17 bp, Homo sapiens
cattgacatgatataca

SEQ ID NO: 1102995 - DNA, 20 bp, Homo sapiens
cattgaccaagaactgcatg

SEQ ID NO: 1102996 - DNA, 22 bp, Homo sapiens
cattgaccgcgactaatttcaa

SEQ ID NO: 1102997 - DNA, 15 bp, Homo sapiens
cattgacctcagctg

SEQ ID NO: 1102998 - DNA, 18 bp, Homo sapiens
cattgactcctttccaat

SEQ ID NO: 1102999 - DNA, 18 bp, Homo sapiens
cattgagaactgcatatg

SEQ ID NO: 1103000 - DNA, 23 bp, Homo sapiens
cattgagaactgcatatgtttcg

SEQ ID NO: 1103001 - DNA, 19 bp, Homo sapiens
cattgagcagttagctcat

SEQ ID NO: 1103002 - DNA, 17 bp, Homo sapiens
cattgagcatttgaaag

SEQ ID NO: 1103003 - DNA, 15 bp, Homo sapiens
cattgataatcttca

SEQ ID NO: 1103004 - DNA, 13 bp, Homo sapiens
cattgatagaact

SEQ ID NO: 1103005 - DNA, 18 bp, Homo sapiens
cattgatagaactacttt

SEQ ID NO: 1103006 - DNA, 17 bp, Homo sapiens
cattgatccaggagata

SEQ ID NO: 1103007 - DNA, 14 bp, Homo sapiens
cattgatgtaagga

SEQ ID NO: 1103008 - DNA, 20 bp, Homo sapiens
cattgattcaccttgttttt

SEQ ID NO: 1103009 - DNA, 17 bp, Homo sapiens
cattgattgtcagctac

SEQ ID NO: 1103010 - DNA, 14 bp, Homo sapiens
cattgcaataaatg

SEQ ID NO: 1103011 - DNA, 23 bp, Homo sapiens
cattgcactctagcctggcaaca

SEQ ID NO: 1103012 - DNA, 24 bp, Homo sapiens
cattgcagccttgcgctgtcccag

SEQ ID NO: 1103013 - DNA, 16 bp, Homo sapiens
cattgcatataactta

SEQ ID NO: 1103014 - DNA, 15 bp, Homo sapiens
cattgccaaaaagga

SEQ ID NO: 1103015 - DNA, 17 bp, Homo sapiens
cattgccaccaggagaa

SEQ ID NO: 1103016 - DNA, 13 bp, Homo sapiens
cattgccaggaga

SEQ ID NO: 1103017 - DNA, 23 bp, Homo sapiens
cattgcctcatttcttcctctgc

SEQ ID NO: 1103018 - DNA, 13 bp, Homo sapiens
cattgcctcctgt

SEQ ID NO: 1103019 - DNA, 18 bp, Homo sapiens
cattgcctgttctgcttc

SEQ ID NO: 1103020 - DNA, 14 bp, Homo sapiens
cattgcctttccag

SEQ ID NO: 1103021 - DNA, 15 bp, Homo sapiens
cattgcctttccagg

SEQ ID NO: 1103022 - DNA, 17 bp, Homo sapiens
cattgcctttgaatgtt

SEQ ID NO: 1103023 - DNA, 23 bp, Homo sapiens
cattgcgtttgaccttttatgta

SEQ ID NO: 1103024 - DNA, 12 bp, Homo sapiens
cattgctaaaaa

SEQ ID NO: 1103025 - DNA, 16 bp, Homo sapiens
cattgctaaaaaataa

SEQ ID NO: 1103026 - DNA, 20 bp, Homo sapiens
cattgctcccctgatagaag

SEQ ID NO: 1103027 - DNA, 14 bp, Homo sapiens
cattgctctctggg

SEQ ID NO: 1103028 - DNA, 15 bp, Homo sapiens
cattgctgagcctct

SEQ ID NO: 1103029 - DNA, 16 bp, Homo sapiens
cattgctgagcctctg

SEQ ID NO: 1103030 - DNA, 17 bp, Homo sapiens
cattgctgagcctctgc

SEQ ID NO: 1103031 - DNA, 21 bp, Homo sapiens
cattgctgagcctctgctccc

SEQ ID NO: 1103032 - DNA, 18 bp, Homo sapiens
cattgctgattttgtctg

SEQ ID NO: 1103033 - DNA, 22 bp, Homo sapiens
cattgctgcctttgtccccaca

SEQ ID NO: 1103034 - DNA, 18 bp, Homo sapiens
cattgctgctgctaccag

SEQ ID NO: 1103035 - DNA, 21 bp, Homo sapiens
cattgctgctgctaccagcgc

SEQ ID NO: 1103036 - DNA, 20 bp, Homo sapiens
cattgctggtagagaccccc

SEQ ID NO: 1103037 - DNA, 22 bp, Homo sapiens
cattgctggtagagacccccag

SEQ ID NO: 1103038 - DNA, 18 bp, Homo sapiens
cattgctggtcatccttg

SEQ ID NO: 1103039 - DNA, 20 bp, Homo sapiens
cattgctgtcttgccccagt

SEQ ID NO: 1103040 - DNA, 15 bp, Homo sapiens
cattgcttaaaatat

SEQ ID NO: 1103041 - DNA, 21 bp, Homo sapiens
cattgcttattcttgagcaca

SEQ ID NO: 1103042 - DNA, 17 bp, Homo sapiens
cattgcttcactaccca

SEQ ID NO: 1103043 - DNA, 14 bp, Homo sapiens
cattgctttctgaa

SEQ ID NO: 1103044 - DNA, 15 bp, Homo sapiens
cattgctttctgaaa

SEQ ID NO: 1103045 - DNA, 22 bp, Homo sapiens
cattgctttgaagcagttgtgt

SEQ ID NO: 1103046 - DNA, 23 bp, Homo sapiens
cattgctttgaagcagttgtgtc

SEQ ID NO: 1103047 - DNA, 16 bp, Homo sapiens
cattggaagaccccac

SEQ ID NO: 1103048 - DNA, 18 bp, Homo sapiens
cattggaagaccccaccc

SEQ ID NO: 1103049 - DNA, 15 bp, Homo sapiens
cattggaagagcccg

SEQ ID NO: 1103050 - DNA, 13 bp, Homo sapiens
cattggaagccat

SEQ ID NO: 1103051 - DNA, 19 bp, Homo sapiens
cattggacagtctccctga

SEQ ID NO: 1103052 - DNA, 22 bp, Homo sapiens
cattggacagtctccctgatgg

SEQ ID NO: 1103053 - DNA, 18 bp, Homo sapiens
cattggacccacatgagg

SEQ ID NO: 1103054 - DNA, 17 bp, Homo sapiens
cattggacccttccatg

SEQ ID NO: 1103055 - DNA, 15 bp, Homo sapiens
cattggagcattttc

SEQ ID NO: 1103056 - DNA, 15 bp, Homo sapiens
catttgaaagaggag

SEQ ID NO: 1103057 - DNA, 16 bp, Homo sapiens
catttgaaagaggagt

SEQ ID NO: 1103058 - DNA, 22 bp, Homo sapiens
catttgaacctggatccagcac

SEQ ID NO: 1103059 - DNA, 19 bp, Homo sapiens
catttgaagtgtacctgtg

SEQ ID NO: 1103060 - DNA, 17 bp, Homo sapiens
catttgaatgagacctg

SEQ ID NO: 1103061 - DNA, 15 bp, Homo sapiens
catttgagagaagcc

SEQ ID NO: 1103062 - DNA, 16 bp, Homo sapiens
catttgagagaagcca

SEQ ID NO: 1103063 - DNA, 13 bp, Homo sapiens
catttgagataaa

SEQ ID NO: 1103064 - DNA, 20 bp, Homo sapiens
catttgaggaagctctccct

SEQ ID NO: 1103065 - DNA, 20 bp, Homo sapiens
catttgagggcccagccagg

SEQ ID NO: 1103066 - DNA, 21 bp, Homo sapiens
catttgagggcccagccagga

SEQ ID NO: 1103067 - DNA, 22 bp, Homo sapiens
catttgaggggccaggggcagg

SEQ ID NO: 1103068 - DNA, 17 bp, Homo sapiens
catttgaggtctgttct

SEQ ID NO: 1103069 - DNA, 19 bp, Homo sapiens
catttgaggtctgttcttt

SEQ ID NO: 1103070 - DNA, 18 bp, Homo sapiens
catttgatatttttccat

SEQ ID NO: 1103071 - DNA, 16 bp, Homo sapiens
catttgatgctaaata

SEQ ID NO: 1103072 - DNA, 15 bp, Homo sapiens
catttgatgtacatg

SEQ ID NO: 1103073 - DNA, 18 bp, Homo sapiens
catttgatgtacatgtgt

SEQ ID NO: 1103074 - DNA, 20 bp, Homo sapiens
catttgatgtacatgtgtag

SEQ ID NO: 1103075 - DNA, 17 bp, Homo sapiens
catttgattaacatttg

SEQ ID NO: 1103076 - DNA, 14 bp, Homo sapiens
catttgatttgttc

SEQ ID NO: 1103077 - DNA, 21 bp, Homo sapiens
catttgcaataacagctgcaa

SEQ ID NO: 1103078 - DNA, 21 bp, Homo sapiens
catttgcactggagttctatg

SEQ ID NO: 1103079 - DNA, 14 bp, Homo sapiens
catttgcagggtcc

SEQ ID NO: 1103080 - DNA, 20 bp, Homo sapiens
catttgccttgcagaactgc

SEQ ID NO: 1103081 - DNA, 21 bp, Homo sapiens
catttgctaagtgtatgatgt

SEQ ID NO: 1103082 - DNA, 22 bp, Homo sapiens
catttgctagttctgctgccct

SEQ ID NO: 1103083 - DNA, 13 bp, Homo sapiens
catttgctgaata

SEQ ID NO: 1103084 - DNA, 14 bp, Homo sapiens
catttgctgatttc

SEQ ID NO: 1103085 - DNA, 18 bp, Homo sapiens
catttgctgatttctagt

SEQ ID NO: 1103086 - DNA, 20 bp, Homo sapiens
catttgctgatttctagtgt

SEQ ID NO: 1103087 - DNA, 16 bp, Homo sapiens
catttgctgttttaaa

SEQ ID NO: 1103088 - DNA, 17 bp, Homo sapiens
catttgctgttttaaac

SEQ ID NO: 1103089 - DNA, 14 bp, Homo sapiens
catttgctttggaa

SEQ ID NO: 1103090 - DNA, 15 bp, Homo sapiens
catttgctttggaag

SEQ ID NO: 1103091 - DNA, 13 bp, Homo sapiens
catttgctttttg

SEQ ID NO: 1103092 - DNA, 14 bp, Homo sapiens
catttggattgggg

SEQ ID NO: 1103093 - DNA, 23 bp, Homo sapiens
catttggattggggtccctctaa

SEQ ID NO: 1103094 - DNA, 18 bp, Homo sapiens
catttggcaggaagatgt

SEQ ID NO: 1103095 - DNA, 23 bp, Homo sapiens
catttggcaggaagatgtatgct

SEQ ID NO: 1103096 - DNA, 23 bp, Homo sapiens
catttgggatgttccttttttca

SEQ ID NO: 1103097 - DNA, 14 bp, Homo sapiens
catttggtctcagg

SEQ ID NO: 1103098 - DNA, 15 bp, Homo sapiens
catttggtctcaggc

SEQ ID NO: 1103099 - DNA, 16 bp, Homo sapiens
catttggtctgccaga

SEQ ID NO: 1103100 - DNA, 21 bp, Homo sapiens
catttggtggtttcagaaatg

SEQ ID NO: 1103101 - DNA, 22 bp, Homo sapiens
catttggtggtttcagaaatgt

SEQ ID NO: 1103102 - DNA, 23 bp, Homo sapiens
catttggtgtggattttctactg

SEQ ID NO: 1103103 - DNA, 16 bp, Homo sapiens
catttggttaaatcat

SEQ ID NO: 1103104 - DNA, 16 bp, Homo sapiens
catttggttcattaat

SEQ ID NO: 1103105 - DNA, 18 bp, Homo sapiens
catttgtaaatgctgtgt

SEQ ID NO: 1103106 - DNA, 12 bp, Homo sapiens
catttgtaataa

SEQ ID NO: 1103107 - DNA, 14 bp, Homo sapiens
catttgtaataaag

SEQ ID NO: 1103108 - DNA, 18 bp, Homo sapiens
catttgtaataaagtata

SEQ ID NO: 1103109 - DNA, 23 bp, Homo sapiens
catttgtacaaggtaattgtttt

SEQ ID NO: 1103110 - DNA, 13 bp, Homo sapiens
catttgtacttta

SEQ ID NO: 1103111 - DNA, 19 bp, Homo sapiens
catttgtatgtcaaagctt

SEQ ID NO: 1103112 - DNA, 20 bp, Homo sapiens
catttgtatgtcaaagcttt

SEQ ID NO: 1103113 - DNA, 22 bp, Homo sapiens
catttgtattactgcttcccat

SEQ ID NO: 1103114 - DNA, 17 bp, Homo sapiens
catttgtattgcttatt

SEQ ID NO: 1103115 - DNA, 18 bp, Homo sapiens
catttgtattgcttattt

SEQ ID NO: 1103116 - DNA, 19 bp, Homo sapiens
catttgtattgcttatttt

SEQ ID NO: 1103117 - DNA, 20 bp, Homo sapiens
catttgtattgcttatttta

SEQ ID NO: 1103118 - DNA, 14 bp, Homo sapiens
catttgtattttgt

SEQ ID NO: 1103119 - DNA, 17 bp, Homo sapiens
catttgtattttgtgtg

SEQ ID NO: 1103120 - DNA, 13 bp, Homo sapiens
catttgtgaagaa

SEQ ID NO: 1103121 - DNA, 21 bp, Homo sapiens
catttgtgatcagcattgtga

SEQ ID NO: 1103122 - DNA, 14 bp, Homo sapiens
catttgtgccacac

SEQ ID NO: 1103123 - DNA, 21 bp, Homo sapiens
catttgtgctagaaattttca

SEQ ID NO: 1103124 - DNA, 15 bp, Homo sapiens
catttgtgtcaatgg

SEQ ID NO: 1103125 - DNA, 13 bp, Homo sapiens
catttgtgtgtgt

SEQ ID NO: 1103126 - DNA, 22 bp, Homo sapiens
catttgttaaaattatcaatat

SEQ ID NO: 1103127 - DNA, 22 bp, Homo sapiens
catttgttaatatcactcatta

SEQ ID NO: 1103128 - DNA, 24 bp, Homo sapiens
catttgttatcctcttgtatactt

SEQ ID NO: 1103129 - DNA, 13 bp, Homo sapiens
catttgttcctgg

SEQ ID NO: 1103130 - DNA, 14 bp, Homo sapiens
catttgttctcaca

SEQ ID NO: 1103131 - DNA, 16 bp, Homo sapiens
catttgttggaatgaa

SEQ ID NO: 1103132 - DNA, 17 bp, Homo sapiens
catttgtttatgtaatt

SEQ ID NO: 1103133 - DNA, 15 bp, Homo sapiens
catttgtttctactt

SEQ ID NO: 1103134 - DNA, 22 bp, Homo sapiens
catttgtttctttctctgagga

SEQ ID NO: 1103135 - DNA, 15 bp, Homo sapiens
catttgttttgcttt

SEQ ID NO: 1103136 - DNA, 16 bp, Homo sapiens
catttgttttgctttt

SEQ ID NO: 1103137 - DNA, 20 bp, Homo sapiens
cattttaaaaaaaaaggcat

SEQ ID NO: 1103138 - DNA, 21 bp, Homo sapiens
cattttaaaaaccaatcattt

SEQ ID NO: 1103139 - DNA, 17 bp, Homo sapiens
cattttaaaaactttat

SEQ ID NO: 1103140 - DNA, 13 bp, Homo sapiens
cattttaaaaagt

SEQ ID NO: 1103141 - DNA, 15 bp, Homo sapiens
cattttaaaatctga

SEQ ID NO: 1103142 - DNA, 19 bp, Homo sapiens
cattttaaaatctgattta

SEQ ID NO: 1103143 - DNA, 15 bp, Homo sapiens
cattttaaataaaag

SEQ ID NO: 1103144 - DNA, 16 bp, Homo sapiens
cattttaaataaaaga

SEQ ID NO: 1103145 - DNA, 18 bp, Homo sapiens
cattttaaataaaagaaa

SEQ ID NO: 1103146 - DNA, 14 bp, Homo sapiens
cattttaaatttta

SEQ ID NO: 1103147 - DNA, 18 bp, Homo sapiens
cattttaacatgatttca

SEQ ID NO: 1103148 - DNA, 18 bp, Homo sapiens
cattttaagaagacatga

SEQ ID NO: 1103149 - DNA, 20 bp, Homo sapiens
cattttaagaagacatgaca

SEQ ID NO: 1103150 - DNA, 18 bp, Homo sapiens
cattttaagtaaaagtct

SEQ ID NO: 1103151 - DNA, 19 bp, Homo sapiens
cattttaagtttgtagtaa

SEQ ID NO: 1103152 - DNA, 14 bp, Homo sapiens
cattttaattctct

SEQ ID NO: 1103153 - DNA, 11 bp, Homo sapiens
cattttacaca

SEQ ID NO: 1103154 - DNA, 19 bp, Homo sapiens
cattttacacactgtacac

SEQ ID NO: 1103155 - DNA, 13 bp, Homo sapiens
cattttacacagc

SEQ ID NO: 1103156 - DNA, 14 bp, Homo sapiens
cattttacacatgt

SEQ ID NO: 1103157 - DNA, 20 bp, Homo sapiens
cattttacccacacacagat

SEQ ID NO: 1103158 - DNA, 23 bp, Homo sapiens
cattttacccttgcagttttact

SEQ ID NO: 1103159 - DNA, 21 bp, Homo sapiens
cattttactactgagggaaat

SEQ ID NO: 1103160 - DNA, 15 bp, Homo sapiens
cattttactcagaat

SEQ ID NO: 1103161 - DNA, 20 bp, Homo sapiens
cattttactcagaatagctg

SEQ ID NO: 1103162 - DNA, 16 bp, Homo sapiens
cattttactgtacaga

SEQ ID NO: 1103163 - DNA, 20 bp, Homo sapiens
cattttactttttcctggct

SEQ ID NO: 1103164 - DNA, 22 bp, Homo sapiens
cattttactttttcctggctca

SEQ ID NO: 1103165 - DNA, 17 bp, Homo sapiens
cattttagaaactacaa

SEQ ID NO: 1103166 - DNA, 12 bp, Homo sapiens
cattttagccca

SEQ ID NO: 1103167 - DNA, 15 bp, Homo sapiens
cattttagctggtgt

SEQ ID NO: 1103168 - DNA, 20 bp, Homo sapiens
cattttaggaataataaatt

SEQ ID NO: 1103169 - DNA, 13 bp, Homo sapiens
cattttataattt

SEQ ID NO: 1103170 - DNA, 17 bp, Homo sapiens
cattttatactgtacat

SEQ ID NO: 1103171 - DNA, 18 bp, Homo sapiens
cattttatactgtacatg

SEQ ID NO: 1103172 - DNA, 22 bp, Homo sapiens
cattttatactgtacatgctat

SEQ ID NO: 1103173 - DNA, 14 bp, Homo sapiens
cattttatatgtca

SEQ ID NO: 1103174 - DNA, 19 bp, Homo sapiens
cattttatatgtcaaagca

SEQ ID NO: 1103175 - DNA, 20 bp, Homo sapiens
cattttatatttttgtacat

SEQ ID NO: 1103176 - DNA, 22 bp, Homo sapiens
cattttatatttttgtacatat

SEQ ID NO: 1103177 - DNA, 15 bp, Homo sapiens
ccaaatgttcatcct

SEQ ID NO: 1103178 - DNA, 12 bp, Homo sapiens
ccaaattaaaaa

SEQ ID NO: 1103179 - DNA, 14 bp, Homo sapiens
ccaaattaaaacaa

SEQ ID NO: 1103180 - DNA, 19 bp, Homo sapiens
ccaaattacctaggctgag

SEQ ID NO: 1103181 - DNA, 21 bp, Homo sapiens
ccaaattataagggccctgcc

SEQ ID NO: 1103182 - DNA, 21 bp, Homo sapiens
ccaaattatcctggtcttttt

SEQ ID NO: 1103183 - DNA, 13 bp, Homo sapiens
ccaaattcatata

SEQ ID NO: 1103184 - DNA, 15 bp, Homo sapiens
ccaaattctttcagt

SEQ ID NO: 1103185 - DNA, 20 bp, Homo sapiens
ccaaattgctgggattacag

SEQ ID NO: 1103186 - DNA, 13 bp, Homo sapiens
ccaaattgcttct

SEQ ID NO: 1103187 - DNA, 15 bp, Homo sapiens
ccaaattgtgtatat

SEQ ID NO: 1103188 - DNA, 11 bp, Homo sapiens
ccaaatttaaa

SEQ ID NO: 1103189 - DNA, 21 bp, Homo sapiens
ccaaatttggctcacttgcct

SEQ ID NO: 1103190 - DNA, 15 bp, Homo sapiens
ccaacaagaagaaat

SEQ ID NO: 1103191 - DNA, 22 bp, Homo sapiens
ccaacaagaagaaatatgaaat

SEQ ID NO: 1103192 - DNA, 21 bp, Homo sapiens
ccaacaagaccgccccagggc

SEQ ID NO: 1103193 - DNA, 14 bp, Homo sapiens
ccaacaagcagctg

SEQ ID NO: 1103194 - DNA, 21 bp, Homo sapiens
ccaacaaggttggcaccccag

SEQ ID NO: 1103195 - DNA, 16 bp, Homo sapiens
ccaacaataaacagga

SEQ ID NO: 1103196 - DNA, 21 bp, Homo sapiens
ccaacaatggggtgggcccat

SEQ ID NO: 1103197 - DNA, 13 bp, Homo sapiens
ccaacacaggcaa

SEQ ID NO: 1103198 - DNA, 19 bp, Homo sapiens
ccaacaccaagcacagcag

SEQ ID NO: 1103199 - DNA, 20 bp, Homo sapiens
ccaacaccctgtctaaaaaa

SEQ ID NO: 1103200 - DNA, 13 bp, Homo sapiens
ccaacacctgctg

SEQ ID NO: 1103201 - DNA, 17 bp, Homo sapiens
ccaacacctgctgcgct

SEQ ID NO: 1103202 - DNA, 23 bp, Homo sapiens
ccaacaccttcttggcttctggg

SEQ ID NO: 1103203 - DNA, 17 bp, Homo sapiens
ccaacacgcacctgcct

SEQ ID NO: 1103204 - DNA, 21 bp, Homo sapiens
ccaacacgcacctgcctcagg

SEQ ID NO: 1103205 - DNA, 16 bp, Homo sapiens
ccaacactgtgccctg

SEQ ID NO: 1103206 - DNA, 20 bp, Homo sapiens
ccaacagaaacatgccagaa

SEQ ID NO: 1103207 - DNA, 18 bp, Homo sapiens
ccaacagaaggaaggagg

SEQ ID NO: 1103208 - DNA, 12 bp, Homo sapiens
ccaacagccatg

SEQ ID NO: 1103209 - DNA, 15 bp, Homo sapiens
ccaacagccatgccc

SEQ ID NO: 1103210 - DNA, 20 bp, Homo sapiens
ccaacagcttttcccaggag

SEQ ID NO: 1103211 - DNA, 14 bp, Homo sapiens
ccaacaggtggcag

SEQ ID NO: 1103212 - DNA, 18 bp, Homo sapiens
ccaacaggtggcaggacc

SEQ ID NO: 1103213 - DNA, 19 bp, Homo sapiens
ccaacaggtggcaggacca

SEQ ID NO: 1103214 - DNA, 19 bp, Homo sapiens
ccaacagtcaaaacagaga

SEQ ID NO: 1103215 - DNA, 13 bp, Homo sapiens
ccaacatcaacat

SEQ ID NO: 1103216 - DNA, 20 bp, Homo sapiens
ccaacatcccattgccctgg

SEQ ID NO: 1103217 - DNA, 20 bp, Homo sapiens
ccaacatctttgcgaaaaga

SEQ ID NO: 1103218 - DNA, 15 bp, Homo sapiens
ccaacatgggaggga

SEQ ID NO: 1103219 - DNA, 23 bp, Homo sapiens
ccaacatgggagggatcagcccc

SEQ ID NO: 1103220 - DNA, 22 bp, Homo sapiens
ccaacatgtggctcctcccagc

SEQ ID NO: 1103221 - DNA, 22 bp, Homo sapiens
ccaacattaaaactcataatta

SEQ ID NO: 1103222 - DNA, 13 bp, Homo sapiens
ccaacattctgca

SEQ ID NO: 1103223 - DNA, 17 bp, Homo sapiens
ccaacatttcttaaatt

SEQ ID NO: 1103224 - DNA, 15 bp, Homo sapiens
ccaaccaaggaagga

SEQ ID NO: 1103225 - DNA, 16 bp, Homo sapiens
ccaaccacagagaaca

SEQ ID NO: 1103226 - DNA, 19 bp, Homo sapiens
ccaaccacagcatcgggag

SEQ ID NO: 1103227 - DNA, 17 bp, Homo sapiens
ccaaccactgtgccact

SEQ ID NO: 1103228 - DNA, 13 bp, Homo sapiens
ccaaccagacttt

SEQ ID NO: 1103229 - DNA, 12 bp, Homo sapiens
ccaaccagcccg

SEQ ID NO: 1103230 - DNA, 20 bp, Homo sapiens
ccaaccagcccgacagtgcc

SEQ ID NO: 1103231 - DNA, 21 bp, Homo sapiens
ccaaccagcccgacagtgcca

SEQ ID NO: 1103232 - DNA, 22 bp, Homo sapiens
ccaaccagcccgacagtgccat

SEQ ID NO: 1103233 - DNA, 13 bp, Homo sapiens
ccaaccaggaccc

SEQ ID NO: 1103234 - DNA, 15 bp, Homo sapiens
ccaaccaggacccag

SEQ ID NO: 1103235 - DNA, 18 bp, Homo sapiens
ccaaccaggacccagggt

SEQ ID NO: 1103236 - DNA, 14 bp, Homo sapiens
ccaaccaggccctg

SEQ ID NO: 1103237 - DNA, 14 bp, Homo sapiens
ccaacccaataaaa

SEQ ID NO: 1103238 - DNA, 22 bp, Homo sapiens
ccaacccaataaaactgatgtt

SEQ ID NO: 1103239 - DNA, 16 bp, Homo sapiens
ccaacccaatccctct

SEQ ID NO: 1103240 - DNA, 17 bp, Homo sapiens
ccaacccagccacgact

SEQ ID NO: 1103241 - DNA, 13 bp, Homo sapiens
ccaacccagccca

SEQ ID NO: 1103242 - DNA, 14 bp, Homo sapiens
ccaacccatcagaa

SEQ ID NO: 1103243 - DNA, 16 bp, Homo sapiens
ccaaccccacccagct

SEQ ID NO: 1103244 - DNA, 17 bp, Homo sapiens
ccaacccccaccccaca

SEQ ID NO: 1103245 - DNA, 13 bp, Homo sapiens
ccaacccccagag

SEQ ID NO: 1103246 - DNA, 19 bp, Homo sapiens
ccaacccccattctcatct

SEQ ID NO: 1103247 - DNA, 13 bp, Homo sapiens
ccaacccccctcc

SEQ ID NO: 1103248 - DNA, 14 bp, Homo sapiens
ccaacccccctcct

SEQ ID NO: 1103249 - DNA, 20 bp, Homo sapiens
ccaacccccgccacctcagg

SEQ ID NO: 1103250 - DNA, 13 bp, Homo sapiens
ccaaccccctgca

SEQ ID NO: 1103251 - DNA, 14 bp, Homo sapiens
ccaaccccctgcaa

SEQ ID NO: 1103252 - DNA, 15 bp, Homo sapiens
ccaaccccgcggccc

SEQ ID NO: 1103253 - DNA, 18 bp, Homo sapiens
ccaaccccgcggcccaga

SEQ ID NO: 1103254 - DNA, 15 bp, Homo sapiens
ccaacccctgtggag

SEQ ID NO: 1103255 - DNA, 21 bp, Homo sapiens
ccaacccggcccaacccagcc

SEQ ID NO: 1103256 - DNA, 22 bp, Homo sapiens
ccaaccctaggttccctgttct

SEQ ID NO: 1103257 - DNA, 14 bp, Homo sapiens
ccaaccctcagagc

SEQ ID NO: 1103258 - DNA, 15 bp, Homo sapiens
ccaaccctcagagcc

SEQ ID NO: 1103259 - DNA, 21 bp, Homo sapiens
ccaaccctgccgtcaccacca

SEQ ID NO: 1103260 - DNA, 22 bp, Homo sapiens
ccaaccctgccgtcaccaccac

SEQ ID NO: 1103261 - DNA, 19 bp, Homo sapiens
ccaaccctgggctggggag

SEQ ID NO: 1103262 - DNA, 20 bp, Homo sapiens
ccaaccctggggaaggagcc

SEQ ID NO: 1103263 - DNA, 12 bp, Homo sapiens
ccaacccttccc

SEQ ID NO: 1103264 - DNA, 19 bp, Homo sapiens
ccaacctcaatgccctgcc

SEQ ID NO: 1103265 - DNA, 21 bp, Homo sapiens
ccaacctcaatgccctgccat

SEQ ID NO: 1103266 - DNA, 22 bp, Homo sapiens
ccaacctcaatgccctgccatt

SEQ ID NO: 1103267 - DNA, 15 bp, Homo sapiens
ccaacctcactgccc

SEQ ID NO: 1103268 - DNA, 17 bp, Homo sapiens
ccaacctcactgccctc

SEQ ID NO: 1103269 - DNA, 17 bp, Homo sapiens
ccaacctctcggcccca

SEQ ID NO: 1103270 - DNA, 13 bp, Homo sapiens
ccaacctctggag

SEQ ID NO: 1103271 - DNA, 14 bp, Homo sapiens
ccaacctctggagc

SEQ ID NO: 1103272 - DNA, 17 bp, Homo sapiens
ccaacctctttttcctc

SEQ ID NO: 1103273 - DNA, 12 bp, Homo sapiens
ccaacctgacca

SEQ ID NO: 1103274 - DNA, 22 bp, Homo sapiens
ccaacctgaccaacatggagaa

SEQ ID NO: 1103275 - DNA, 14 bp, Homo sapiens
ccaacctggacaac

SEQ ID NO: 1103276 - DNA, 20 bp, Homo sapiens
ccaacctgtggcgctgcagc

SEQ ID NO: 1103277 - DNA, 15 bp, Homo sapiens
ccaacctttccctca

SEQ ID NO: 1103278 - DNA, 17 bp, Homo sapiens
ccaacctttccctcacc

SEQ ID NO: 1103279 - DNA, 21 bp, Homo sapiens
ccaacgagacacattgccttc

SEQ ID NO: 1103280 - DNA, 16 bp, Homo sapiens
ccaacgagcctcctca

SEQ ID NO: 1103281 - DNA, 15 bp, Homo sapiens
ccaacgcccctgtgg

SEQ ID NO: 1103282 - DNA, 21 bp, Homo sapiens
ccaacgcccctgtggccaact

SEQ ID NO: 1103283 - DNA, 17 bp, Homo sapiens
ccaacggggtggggagg

SEQ ID NO: 1103284 - DNA, 18 bp, Homo sapiens
ccaacggggtggggaggg

SEQ ID NO: 1103285 - DNA, 19 bp, Homo sapiens
ccaacgttactcagggctc

SEQ ID NO: 1103286 - DNA, 16 bp, Homo sapiens
ccaactacaaccaagc

SEQ ID NO: 1103287 - DNA, 17 bp, Homo sapiens
ccaactagcccctgggg

SEQ ID NO: 1103288 - DNA, 14 bp, Homo sapiens
ccaactccagcaac

SEQ ID NO: 1103289 - DNA, 21 bp, Homo sapiens
ccaactccagcaacttcttct

SEQ ID NO: 1103290 - DNA, 22 bp, Homo sapiens
ccaactccatggggttcgagac

SEQ ID NO: 1103291 - DNA, 19 bp, Homo sapiens
ccaactccctgccattttt

SEQ ID NO: 1103292 - DNA, 21 bp, Homo sapiens
ccaactccgcccagcctctcc

SEQ ID NO: 1103293 - DNA, 13 bp, Homo sapiens
ccaactcctgatg

SEQ ID NO: 1103294 - DNA, 15 bp, Homo sapiens
ccaactcctggaagc

SEQ ID NO: 1103295 - DNA, 19 bp, Homo sapiens
ccaactcgggctcccgggt

SEQ ID NO: 1103296 - DNA, 14 bp, Homo sapiens
ccaactctagctgg

SEQ ID NO: 1103297 - DNA, 15 bp, Homo sapiens
ccaactctccccagt

SEQ ID NO: 1103298 - DNA, 19 bp, Homo sapiens
ccaactctccccagtgcct

SEQ ID NO: 1103299 - DNA, 22 bp, Homo sapiens
ccaagtgggcagtcaccaccca

SEQ ID NO: 1103300 - DNA, 14 bp, Homo sapiens
ccaagtgggctggt

SEQ ID NO: 1103301 - DNA, 15 bp, Homo sapiens
ccaagtggggtgctg

SEQ ID NO: 1103302 - DNA, 19 bp, Homo sapiens
ccaagtgtagatgtagcat

SEQ ID NO: 1103303 - DNA, 22 bp, Homo sapiens
ccaagtgtagatgtagcattgt

SEQ ID NO: 1103304 - DNA, 12 bp, Homo sapiens
ccaagtgtgcta

SEQ ID NO: 1103305 - DNA, 13 bp, Homo sapiens
ccaagtgtgtgtg

SEQ ID NO: 1103306 - DNA, 12 bp, Homo sapiens
ccaagttatatt

SEQ ID NO: 1103307 - DNA, 18 bp, Homo sapiens
ccaagttcttcacctcta

SEQ ID NO: 1103308 - DNA, 20 bp, Homo sapiens
ccaagttcttcacctctatc

SEQ ID NO: 1103309 - DNA, 22 bp, Homo sapiens
ccaagttgatttagtgttttta

SEQ ID NO: 1103310 - DNA, 12 bp, Homo sapiens
ccaagttgcagt

SEQ ID NO: 1103311 - DNA, 16 bp, Homo sapiens
ccaagttgctgtcact

SEQ ID NO: 1103312 - DNA, 17 bp, Homo sapiens
ccaagttgctgtcactg

SEQ ID NO: 1103313 - DNA, 22 bp, Homo sapiens
ccaagttgtgcttgagccagga

SEQ ID NO: 1103314 - DNA, 10 bp, Homo sapiens
ccaataaaaa

SEQ ID NO: 1103315 - DNA, 13 bp, Homo sapiens
ccaataaaaacat

SEQ ID NO: 1103316 - DNA, 21 bp, Homo sapiens
ccaataaaaacattttgaagt

SEQ ID NO: 1103317 - DNA, 13 bp, Homo sapiens
ccaataaaaagtt

SEQ ID NO: 1103318 - DNA, 16 bp, Homo sapiens
ccaataaaaagttcag

SEQ ID NO: 1103319 - DNA, 13 bp, Homo sapiens
ccaataaaagtga

SEQ ID NO: 1103320 - DNA, 13 bp, Homo sapiens
ccaataaaggcag

SEQ ID NO: 1103321 - DNA, 15 bp, Homo sapiens
ccaataaaggcagct

SEQ ID NO: 1103322 - DNA, 18 bp, Homo sapiens
ccaataaaggcagctgcc

SEQ ID NO: 1103323 - DNA, 24 bp, Homo sapiens
ccaataaaggcagctgcctctgct

SEQ ID NO: 1103324 - DNA, 23 bp, Homo sapiens
ccaataaagtgccttctgggctt

SEQ ID NO: 1103325 - DNA, 21 bp, Homo sapiens
ccaataaatgtttgttattta

SEQ ID NO: 1103326 - DNA, 15 bp, Homo sapiens
ccaataataaagaca

SEQ ID NO: 1103327 - DNA, 20 bp, Homo sapiens
ccaataatcagaaaagtaat

SEQ ID NO: 1103328 - DNA, 18 bp, Homo sapiens
ccaataccctactgtggg

SEQ ID NO: 1103329 - DNA, 14 bp, Homo sapiens
ccaataccctagaa

SEQ ID NO: 1103330 - DNA, 22 bp, Homo sapiens
ccaataccctagaagaaaaccc

SEQ ID NO: 1103331 - DNA, 16 bp, Homo sapiens
ccaatagaaagaaact

SEQ ID NO: 1103332 - DNA, 15 bp, Homo sapiens
ccaatattaaatctg

SEQ ID NO: 1103333 - DNA, 14 bp, Homo sapiens
ccaatattgtacag

SEQ ID NO: 1103334 - DNA, 16 bp, Homo sapiens
ccaatattgtacagtt

SEQ ID NO: 1103335 - DNA, 14 bp, Homo sapiens
ccaatattttgcct

SEQ ID NO: 1103336 - DNA, 13 bp, Homo sapiens
ccaatatttttgg

SEQ ID NO: 1103337 - DNA, 17 bp, Homo sapiens
ccaatcaaagaattaca

SEQ ID NO: 1103338 - DNA, 19 bp, Homo sapiens
ccaatcacgagatcttcct

SEQ ID NO: 1103339 - DNA, 12 bp, Homo sapiens
ccaatcagcttt

SEQ ID NO: 1103340 - DNA, 22 bp, Homo sapiens
ccaatcagcttttgttctagac

SEQ ID NO: 1103341 - DNA, 12 bp, Homo sapiens
ccaatcatttta

SEQ ID NO: 1103342 - DNA, 22 bp, Homo sapiens
ccaatcattttaattattattc

SEQ ID NO: 1103343 - DNA, 13 bp, Homo sapiens
ccaatccccagcc

SEQ ID NO: 1103344 - DNA, 14 bp, Homo sapiens
ccaatccccagcct

SEQ ID NO: 1103345 - DNA, 16 bp, Homo sapiens
ccaatccccagcctag

SEQ ID NO: 1103346 - DNA, 17 bp, Homo sapiens
ccaatcccctccttggg

SEQ ID NO: 1103347 - DNA, 14 bp, Homo sapiens
ccaatcccgtgaaa

SEQ ID NO: 1103348 - DNA, 18 bp, Homo sapiens
ccaatcccgtgaaagaat

SEQ ID NO: 1103349 - DNA, 22 bp, Homo sapiens
ccaatccctctccactcttctc

SEQ ID NO: 1103350 - DNA, 18 bp, Homo sapiens
ccaatccctgccactggg

SEQ ID NO: 1103351 - DNA, 20 bp, Homo sapiens
ccaatccctgccactgggct

SEQ ID NO: 1103352 - DNA, 22 bp, Homo sapiens
ccaatccctgccactgggctct

SEQ ID NO: 1103353 - DNA, 14 bp, Homo sapiens
ccaatcctatgttt

SEQ ID NO: 1103354 - DNA, 15 bp, Homo sapiens
ccaatcgggtccaga

SEQ ID NO: 1103355 - DNA, 18 bp, Homo sapiens
ccaatcgggtccagagac

SEQ ID NO: 1103356 - DNA, 20 bp, Homo sapiens
ccaatctctacccctttctt

SEQ ID NO: 1103357 - DNA, 11 bp, Homo sapiens
ccaatctctgg

SEQ ID NO: 1103358 - DNA, 23 bp, Homo sapiens
ccaatctctgttctgtttggcac

SEQ ID NO: 1103359 - DNA, 19 bp, Homo sapiens
ccaatctcttggtggggag

SEQ ID NO: 1103360 - DNA, 12 bp, Homo sapiens
ccaatctgccct

SEQ ID NO: 1103361 - DNA, 17 bp, Homo sapiens
ccaatcttgcccactgg

SEQ ID NO: 1103362 - DNA, 15 bp, Homo sapiens
ccaatgaaaaaatgt

SEQ ID NO: 1103363 - DNA, 12 bp, Homo sapiens
ccaatgaataat

SEQ ID NO: 1103364 - DNA, 23 bp, Homo sapiens
ccaatgaataatggaaaatgcca

SEQ ID NO: 1103365 - DNA, 21 bp, Homo sapiens
ccaatgagactctagggtcca

SEQ ID NO: 1103366 - DNA, 19 bp, Homo sapiens
ccaatgaggtctgaaatgg

SEQ ID NO: 1103367 - DNA, 15 bp, Homo sapiens
ccaatgcaagacgcc

SEQ ID NO: 1103368 - DNA, 13 bp, Homo sapiens
ccaatgccaaaaa

SEQ ID NO: 1103369 - DNA, 22 bp, Homo sapiens
ccaatgcctgtgaagcagtcag

SEQ ID NO: 1103370 - DNA, 12 bp, Homo sapiens
ccaatgctctgg

SEQ ID NO: 1103371 - DNA, 17 bp, Homo sapiens
ccaatgctttgggaggc

SEQ ID NO: 1103372 - DNA, 18 bp, Homo sapiens
ccaatgcttttatcaaac

SEQ ID NO: 1103373 - DNA, 17 bp, Homo sapiens
ccaatgggaagcaggga

SEQ ID NO: 1103374 - DNA, 18 bp, Homo sapiens
ccaatgggaccgtgcccc

SEQ ID NO: 1103375 - DNA, 19 bp, Homo sapiens
ccaatgggaccgtgcccca

SEQ ID NO: 1103376 - DNA, 23 bp, Homo sapiens
ccaatgggaccgtgccccacctc

SEQ ID NO: 1103377 - DNA, 16 bp, Homo sapiens
ccaatggtgatcctct

SEQ ID NO: 1103378 - DNA, 20 bp, Homo sapiens
ccaatggtgatcctctattt

SEQ ID NO: 1103379 - DNA, 23 bp, Homo sapiens
ccaatggtgatcctctattttgt

SEQ ID NO: 1103380 - DNA, 15 bp, Homo sapiens
ccaatgtctcccaca

SEQ ID NO: 1103381 - DNA, 17 bp, Homo sapiens
ccaatgtctcccacacc

SEQ ID NO: 1103382 - DNA, 14 bp, Homo sapiens
ccaatgtgttttct

SEQ ID NO: 1103383 - DNA, 20 bp, Homo sapiens
ccaatgttctctcttctcca

SEQ ID NO: 1103384 - DNA, 20 bp, Homo sapiens
ccaatgttttattggggaat

SEQ ID NO: 1103385 - DNA, 12 bp, Homo sapiens
ccaattaaaata

SEQ ID NO: 1103386 - DNA, 22 bp, Homo sapiens
ccaattaaaatactatgcagta

SEQ ID NO: 1103387 - DNA, 19 bp, Homo sapiens
ccaattactattccctttg

SEQ ID NO: 1103388 - DNA, 17 bp, Homo sapiens
ccaattaggaagtgtaa

SEQ ID NO: 1103389 - DNA, 16 bp, Homo sapiens
ccaattagtttccttt

SEQ ID NO: 1103390 - DNA, 20 bp, Homo sapiens
ccaattagtttcctttttaa

SEQ ID NO: 1103391 - DNA, 17 bp, Homo sapiens
ccaattatcatcttttg

SEQ ID NO: 1103392 - DNA, 21 bp, Homo sapiens
ccaattcaaccctttgcccca

SEQ ID NO: 1103393 - DNA, 16 bp, Homo sapiens
ccaattcagacaggca

SEQ ID NO: 1103394 - DNA, 23 bp, Homo sapiens
ccaattccaccaagacagtgctg

SEQ ID NO: 1103395 - DNA, 18 bp, Homo sapiens
ccaattcccccttaaact

SEQ ID NO: 1103396 - DNA, 14 bp, Homo sapiens
ccaattctgcctgc

SEQ ID NO: 1103397 - DNA, 23 bp, Homo sapiens
ccaattctgcctgcctcctccct

SEQ ID NO: 1103398 - DNA, 14 bp, Homo sapiens
ccaattctgtccca

SEQ ID NO: 1103399 - DNA, 18 bp, Homo sapiens
ccaattgcctcttgcagg

SEQ ID NO: 1103400 - DNA, 18 bp, Homo sapiens
ccaattgtgtagacgata

SEQ ID NO: 1103401 - DNA, 21 bp, Homo sapiens
ccaattgttgacagttctgaa

SEQ ID NO: 1103402 - DNA, 22 bp, Homo sapiens
ccaattgttgacagttctgaag

SEQ ID NO: 1103403 - DNA, 11 bp, Homo sapiens
ccaatttcccc

SEQ ID NO: 1103404 - DNA, 13 bp, Homo sapiens
ccaatttcccgga

SEQ ID NO: 1103405 - DNA, 14 bp, Homo sapiens
ccaatttcccggag

SEQ ID NO: 1103406 - DNA, 11 bp, Homo sapiens
ccaatttcctc

SEQ ID NO: 1103407 - DNA, 15 bp, Homo sapiens
ccaatttcctctcca

SEQ ID NO: 1103408 - DNA, 21 bp, Homo sapiens
ccaatttcctctccactgctg

SEQ ID NO: 1103409 - DNA, 20 bp, Homo sapiens
ccaatttcggattttttcca

SEQ ID NO: 1103410 - DNA, 21 bp, Homo sapiens
ccaatttcggattttttccaa

SEQ ID NO: 1103411 - DNA, 16 bp, Homo sapiens
ccaatttcttccttcc

SEQ ID NO: 1103412 - DNA, 17 bp, Homo sapiens
ccaatttcttccttcca

SEQ ID NO: 1103413 - DNA, 23 bp, Homo sapiens
ccaatttggtaaaaatgctgctc

SEQ ID NO: 1103414 - DNA, 12 bp, Homo sapiens
ccaatttgtctc

SEQ ID NO: 1103415 - DNA, 21 bp, Homo sapiens
ccaattttaatttagtaaatg

SEQ ID NO: 1103416 - DNA, 23 bp, Homo sapiens
ccaattttaatttagtaaatgtt

SEQ ID NO: 1103417 - DNA, 19 bp, Homo sapiens
ccaattttgatctttttat

SEQ ID NO: 1103418 - DNA, 15 bp, Homo sapiens
ccacaaaaaatactt

SEQ ID NO: 1103419 - DNA, 12 bp, Homo sapiens
ccacaaaaacaa

SEQ ID NO: 1103420 - DNA, 22 bp, Homo sapiens
ccacaaaaacaggtatatactt

SEQ ID NO: 1103421 - DNA, 16 bp, Homo sapiens
ccaccccctgttccct

SEQ ID NO: 1103422 - DNA, 12 bp, Homo sapiens
ccacccccttca

SEQ ID NO: 1103423 - DNA, 20 bp, Homo sapiens
ccacccccttctctgctcca

SEQ ID NO: 1103424 - DNA, 16 bp, Homo sapiens
ccaccccgccgttccc

SEQ ID NO: 1103425 - DNA, 16 bp, Homo sapiens
ccaccccgcctgccct

SEQ ID NO: 1103426 - DNA, 18 bp, Homo sapiens
ccaccccggggaccctgt

SEQ ID NO: 1103427 - DNA, 20 bp, Homo sapiens
ccaccccggggaccctgtga

SEQ ID NO: 1103428 - DNA, 16 bp, Homo sapiens
ccaccccgtgccaccc

SEQ ID NO: 1103429 - DNA, 16 bp, Homo sapiens
ccacccctacccctgg

SEQ ID NO: 1103430 - DNA, 20 bp, Homo sapiens
ccacccctaccgatggtccc

SEQ ID NO: 1103431 - DNA, 11 bp, Homo sapiens
ccacccctcac

SEQ ID NO: 1103432 - DNA, 13 bp, Homo sapiens
ccacccctcactc

SEQ ID NO: 1103433 - DNA, 14 bp, Homo sapiens
ccacccctcactcc

SEQ ID NO: 1103434 - DNA, 13 bp, Homo sapiens
ccacccctccacg

SEQ ID NO: 1103435 - DNA, 14 bp, Homo sapiens
ccacccctccccag

SEQ ID NO: 1103436 - DNA, 15 bp, Homo sapiens
ccacccctgccactc

SEQ ID NO: 1103437 - DNA, 13 bp, Homo sapiens
ccacccctgcccc

SEQ ID NO: 1103438 - DNA, 21 bp, Homo sapiens
ccacccctggaagagcccagt

SEQ ID NO: 1103439 - DNA, 22 bp, Homo sapiens
ccacccctggaagagcccagtc

SEQ ID NO: 1103440 - DNA, 16 bp, Homo sapiens
ccaccccttccccact

SEQ ID NO: 1103441 - DNA, 19 bp, Homo sapiens
ccaccccttggcccctcac

SEQ ID NO: 1103442 - DNA, 23 bp, Homo sapiens
ccacccctttctagaccaataaa

SEQ ID NO: 1103443 - DNA, 18 bp, Homo sapiens
ccacccgagtacctccag

SEQ ID NO: 1103444 - DNA, 15 bp, Homo sapiens
ccacccgccgcctcc

SEQ ID NO: 1103445 - DNA, 21 bp, Homo sapiens
ccacccgccgcctcccacggc

SEQ ID NO: 1103446 - DNA, 14 bp, Homo sapiens
ccacccgctgcccc

SEQ ID NO: 1103447 - DNA, 15 bp, Homo sapiens
ccacccgctgcccct

SEQ ID NO: 1103448 - DNA, 23 bp, Homo sapiens
ccacccgctgcccctccccgtcc

SEQ ID NO: 1103449 - DNA, 19 bp, Homo sapiens
ccacccggccacagctgct

SEQ ID NO: 1103450 - DNA, 16 bp, Homo sapiens
ccacccgggagcagtg

SEQ ID NO: 1103451 - DNA, 12 bp, Homo sapiens
ccacccgggctg

SEQ ID NO: 1103452 - DNA, 15 bp, Homo sapiens
ccacccgggctgcct

SEQ ID NO: 1103453 - DNA, 21 bp, Homo sapiens
ccacccgggctgcctgcccct

SEQ ID NO: 1103454 - DNA, 16 bp, Homo sapiens
ccacccgggggagccc

SEQ ID NO: 1103455 - DNA, 20 bp, Homo sapiens
ccacccggtggggcccttgg

SEQ ID NO: 1103456 - DNA, 23 bp, Homo sapiens
ccacccgtaggcagcctctctgc

SEQ ID NO: 1103457 - DNA, 18 bp, Homo sapiens
ccacccgtcctccctcag

SEQ ID NO: 1103458 - DNA, 21 bp, Homo sapiens
ccacccgtcctccctcagcct

SEQ ID NO: 1103459 - DNA, 21 bp, Homo sapiens
ccacccgtcttcaatctctgt

SEQ ID NO: 1103460 - DNA, 20 bp, Homo sapiens
ccacccgtggggtgctgccc

SEQ ID NO: 1103461 - DNA, 15 bp, Homo sapiens
ccaccctaagggcag

SEQ ID NO: 1103462 - DNA, 15 bp, Homo sapiens
ccaccctaccagctc

SEQ ID NO: 1103463 - DNA, 17 bp, Homo sapiens
ccaccctaccagctcct

SEQ ID NO: 1103464 - DNA, 20 bp, Homo sapiens
ccaccctaccagctcctcca

SEQ ID NO: 1103465 - DNA, 22 bp, Homo sapiens
ccaccctacgctcatctctgga

SEQ ID NO: 1103466 - DNA, 11 bp, Homo sapiens
ccaccctcaca

SEQ ID NO: 1103467 - DNA, 12 bp, Homo sapiens
ccaccctcactg

SEQ ID NO: 1103468 - DNA, 17 bp, Homo sapiens
ccaccctcagcacccct

SEQ ID NO: 1103469 - DNA, 17 bp, Homo sapiens
ccaccctcaggtgcctc

SEQ ID NO: 1103470 - DNA, 16 bp, Homo sapiens
ccaccctccacctctc

SEQ ID NO: 1103471 - DNA, 17 bp, Homo sapiens
ccaccctccaccttcca

SEQ ID NO: 1103472 - DNA, 19 bp, Homo sapiens
ccaccctccaccttccatt

SEQ ID NO: 1103473 - DNA, 15 bp, Homo sapiens
ccaccctccatgctc

SEQ ID NO: 1103474 - DNA, 21 bp, Homo sapiens
ccaccctcccctctcttgcac

SEQ ID NO: 1103475 - DNA, 11 bp, Homo sapiens
ccaccctcctc

SEQ ID NO: 1103476 - DNA, 13 bp, Homo sapiens
ccaccctctggga

SEQ ID NO: 1103477 - DNA, 19 bp, Homo sapiens
ccaccctctggggacagga

SEQ ID NO: 1103478 - DNA, 17 bp, Homo sapiens
ccaccctgaaagccctg

SEQ ID NO: 1103479 - DNA, 20 bp, Homo sapiens
ccaccctgctcatccactct

SEQ ID NO: 1103480 - DNA, 22 bp, Homo sapiens
ccaccctgctcctcctgccctg

SEQ ID NO: 1103481 - DNA, 13 bp, Homo sapiens
ccaccctgctgca

SEQ ID NO: 1103482 - DNA, 15 bp, Homo sapiens
ccaccctggcccgcc

SEQ ID NO: 1103483 - DNA, 12 bp, Homo sapiens
ccaccctgggcc

SEQ ID NO: 1103484 - DNA, 17 bp, Homo sapiens
ccaccctgggccctggg

SEQ ID NO: 1103485 - DNA, 14 bp, Homo sapiens
ccaccctgtccccc

SEQ ID NO: 1103486 - DNA, 18 bp, Homo sapiens
ccaccctgtcccccagct

SEQ ID NO: 1103487 - DNA, 15 bp, Homo sapiens
ccaccctgttagttt

SEQ ID NO: 1103488 - DNA, 16 bp, Homo sapiens
ccacccttacttcctg

SEQ ID NO: 1103489 - DNA, 11 bp, Homo sapiens
ccacccttcca

SEQ ID NO: 1103490 - DNA, 12 bp, Homo sapiens
ccacccttccat

SEQ ID NO: 1103491 - DNA, 19 bp, Homo sapiens
ccacccttggcctgtctca

SEQ ID NO: 1103492 - DNA, 14 bp, Homo sapiens
ccaccctttcacaa

SEQ ID NO: 1103493 - DNA, 20 bp, Homo sapiens
ccaccctttcccccttctct

SEQ ID NO: 1103494 - DNA, 15 bp, Homo sapiens
ccaccctttgggggg

SEQ ID NO: 1103495 - DNA, 19 bp, Homo sapiens
ccaccctttttttggggtg

SEQ ID NO: 1103496 - DNA, 18 bp, Homo sapiens
ccaccgaagccgcctgtg

SEQ ID NO: 1103497 - DNA, 17 bp, Homo sapiens
ccaccgaatatattact

SEQ ID NO: 1103498 - DNA, 16 bp, Homo sapiens
ccaccgactgcccagc

SEQ ID NO: 1103499 - DNA, 15 bp, Homo sapiens
ccaccgatggagccc

SEQ ID NO: 1103500 - DNA, 13 bp, Homo sapiens
ccaccgcagctac

SEQ ID NO: 1103501 - DNA, 15 bp, Homo sapiens
ccaccgccctcctcc

SEQ ID NO: 1103502 - DNA, 16 bp, Homo sapiens
ccaccgccctcctcca

SEQ ID NO: 1103503 - DNA, 20 bp, Homo sapiens
ccaccgcgccctcctgccca

SEQ ID NO: 1103504 - DNA, 15 bp, Homo sapiens
ccaccgcggaggagg

SEQ ID NO: 1103505 - DNA, 14 bp, Homo sapiens
ccaccgctcagtgt

SEQ ID NO: 1103506 - DNA, 14 bp, Homo sapiens
ccaccgctccccag

SEQ ID NO: 1103507 - DNA, 15 bp, Homo sapiens
ccaccgctccccagc

SEQ ID NO: 1103508 - DNA, 20 bp, Homo sapiens
ccaccggaggtcactccacc

SEQ ID NO: 1103509 - DNA, 21 bp, Homo sapiens
ccaccggaggtcactccacca

SEQ ID NO: 1103510 - DNA, 13 bp, Homo sapiens
ccaccggcccctg

SEQ ID NO: 1103511 - DNA, 14 bp, Homo sapiens
ccaccggcccctgg

SEQ ID NO: 1103512 - DNA, 14 bp, Homo sapiens
ccaccggcctgtgg

SEQ ID NO: 1103513 - DNA, 17 bp, Homo sapiens
ccaccgggagcctcccc

SEQ ID NO: 1103514 - DNA, 22 bp, Homo sapiens
ccaccgggagcctccccctcag

SEQ ID NO: 1103515 - DNA, 23 bp, Homo sapiens
ccaccgggctgggagctctgcag

SEQ ID NO: 1103516 - DNA, 19 bp, Homo sapiens
ccaccggggcaagagggaa

SEQ ID NO: 1103517 - DNA, 19 bp, Homo sapiens
ccaccgggggtggctctgt

SEQ ID NO: 1103518 - DNA, 15 bp, Homo sapiens
ccaccggtccagctg

SEQ ID NO: 1103519 - DNA, 15 bp, Homo sapiens
ccaccgtccgccctg

SEQ ID NO: 1103520 - DNA, 19 bp, Homo sapiens
ccaccgtccgccctgctcc

SEQ ID NO: 1103521 - DNA, 23 bp, Homo sapiens
ccaccgtctcggccctgaaccac

SEQ ID NO: 1103522 - DNA, 18 bp, Homo sapiens
ccaccgtgaaccagaggg

SEQ ID NO: 1103523 - DNA, 14 bp, Homo sapiens
ccaccgtgcctggc

SEQ ID NO: 1103524 - DNA, 19 bp, Homo sapiens
ccaccgtgggcagtgccac

SEQ ID NO: 1103525 - DNA, 14 bp, Homo sapiens
ccaccgtgggggaa

SEQ ID NO: 1103526 - DNA, 21 bp, Homo sapiens
ccaccgtttcttcctgccagc

SEQ ID NO: 1103527 - DNA, 17 bp, Homo sapiens
ccacctaatcaggctga

SEQ ID NO: 1103528 - DNA, 20 bp, Homo sapiens
ccacctacacccctgtgctc

SEQ ID NO: 1103529 - DNA, 14 bp, Homo sapiens
ccacctactgcact

SEQ ID NO: 1103530 - DNA, 18 bp, Homo sapiens
ccacctagaacactaact

SEQ ID NO: 1103531 - DNA, 19 bp, Homo sapiens
ccacctagaacactaactc

SEQ ID NO: 1103532 - DNA, 21 bp, Homo sapiens
ccacctagactgtaaacctct

SEQ ID NO: 1103533 - DNA, 13 bp, Homo sapiens
ccacctagcagca

SEQ ID NO: 1103534 - DNA, 23 bp, Homo sapiens
ccacctagcagcaccgttctgtg

SEQ ID NO: 1103535 - DNA, 22 bp, Homo sapiens
ccacctaggccactcctccaaa

SEQ ID NO: 1103536 - DNA, 14 bp, Homo sapiens
ccacctagtctgta

SEQ ID NO: 1103537 - DNA, 15 bp, Homo sapiens
ccacctagtgcccca

SEQ ID NO: 1103538 - DNA, 16 bp, Homo sapiens
ccacctagtgccccag

SEQ ID NO: 1103539 - DNA, 19 bp, Homo sapiens
ccacctatgcctgtggtga

SEQ ID NO: 1103540 - DNA, 16 bp, Homo sapiens
ccacctcactcctgtt

SEQ ID NO: 1103541 - DNA, 18 bp, Homo sapiens
ccacctcactcctgttac

SEQ ID NO: 1103542 - DNA, 19 bp, Homo sapiens
ccacctcagaaaggatttt

SEQ ID NO: 1103543 - DNA, 14 bp, Homo sapiens
ccacctcagcctcc

SEQ ID NO: 1103544 - DNA, 22 bp, Homo sapiens
ccactgttctgaaaggagacat

SEQ ID NO: 1103545 - DNA, 17 bp, Homo sapiens
ccacttaatgtatgtta

SEQ ID NO: 1103546 - DNA, 18 bp, Homo sapiens
ccacttacagtgtgataa

SEQ ID NO: 1103547 - DNA, 19 bp, Homo sapiens
ccacttagaaattgcattt

SEQ ID NO: 1103548 - DNA, 19 bp, Homo sapiens
ccacttagccgtccatggc

SEQ ID NO: 1103549 - DNA, 20 bp, Homo sapiens
ccacttagccgtccatggca

SEQ ID NO: 1103550 - DNA, 21 bp, Homo sapiens
ccacttagccgtccatggcac

SEQ ID NO: 1103551 - DNA, 17 bp, Homo sapiens
ccacttagttaaaattg

SEQ ID NO: 1103552 - DNA, 14 bp, Homo sapiens
ccacttatgctgct

SEQ ID NO: 1103553 - DNA, 12 bp, Homo sapiens
ccacttcactgt

SEQ ID NO: 1103554 - DNA, 23 bp, Homo sapiens
ccacttcattccagcagctgcac

SEQ ID NO: 1103555 - DNA, 21 bp, Homo sapiens
ccacttcattcttgaaagctg

SEQ ID NO: 1103556 - DNA, 17 bp, Homo sapiens
ccacttccagagccaga

SEQ ID NO: 1103557 - DNA, 18 bp, Homo sapiens
ccacttccaggggaacct

SEQ ID NO: 1103558 - DNA, 21 bp, Homo sapiens
ccacttccaggggaacctgcc

SEQ ID NO: 1103559 - DNA, 18 bp, Homo sapiens
ccacttcccatctccagg

SEQ ID NO: 1103560 - DNA, 21 bp, Homo sapiens
ccacttcccatctccagggaa

SEQ ID NO: 1103561 - DNA, 18 bp, Homo sapiens
ccacttcccgtctcagaa

SEQ ID NO: 1103562 - DNA, 12 bp, Homo sapiens
ccacttcctcct

SEQ ID NO: 1103563 - DNA, 21 bp, Homo sapiens
ccacttcctcctacctgggga

SEQ ID NO: 1103564 - DNA, 22 bp, Homo sapiens
ccacttcctcctacctggggac

SEQ ID NO: 1103565 - DNA, 16 bp, Homo sapiens
ccacttctccatgctg

SEQ ID NO: 1103566 - DNA, 13 bp, Homo sapiens
ccacttctctgct

SEQ ID NO: 1103567 - DNA, 15 bp, Homo sapiens
ccacttctctgggtc

SEQ ID NO: 1103568 - DNA, 19 bp, Homo sapiens
ccacttctctgggtcccgg

SEQ ID NO: 1103569 - DNA, 22 bp, Homo sapiens
ccacttctgcgggctccctcct

SEQ ID NO: 1103570 - DNA, 16 bp, Homo sapiens
ccacttctggccacat

SEQ ID NO: 1103571 - DNA, 13 bp, Homo sapiens
ccacttctggcct

SEQ ID NO: 1103572 - DNA, 22 bp, Homo sapiens
ccacttctggcctccagccttt

SEQ ID NO: 1103573 - DNA, 19 bp, Homo sapiens
ccacttctggcttcagccc

SEQ ID NO: 1103574 - DNA, 12 bp, Homo sapiens
ccacttctgggt

SEQ ID NO: 1103575 - DNA, 14 bp, Homo sapiens
ccacttctggtccc

SEQ ID NO: 1103576 - DNA, 19 bp, Homo sapiens
ccacttctggtcccctgtg

SEQ ID NO: 1103577 - DNA, 23 bp, Homo sapiens
ccacttctggtcccctgtggtga

SEQ ID NO: 1103578 - DNA, 13 bp, Homo sapiens
ccacttctgtggg

SEQ ID NO: 1103579 - DNA, 17 bp, Homo sapiens
ccacttctgtgggcatg

SEQ ID NO: 1103580 - DNA, 21 bp, Homo sapiens
ccacttctgtgggcatggccg

SEQ ID NO: 1103581 - DNA, 13 bp, Homo sapiens
ccacttcttcctt

SEQ ID NO: 1103582 - DNA, 17 bp, Homo sapiens
ccacttcttcctttctc

SEQ ID NO: 1103583 - DNA, 16 bp, Homo sapiens
ccacttgcctcttcct

SEQ ID NO: 1103584 - DNA, 15 bp, Homo sapiens
ccacttgcctggggc

SEQ ID NO: 1103585 - DNA, 13 bp, Homo sapiens
ccacttggcccag

SEQ ID NO: 1103586 - DNA, 22 bp, Homo sapiens
ccacttggcccagaaagctgcg

SEQ ID NO: 1103587 - DNA, 10 bp, Homo sapiens
ccacttgtat

SEQ ID NO: 1103588 - DNA, 19 bp, Homo sapiens
ccacttgtcaaagaaggtg

SEQ ID NO: 1103589 - DNA, 17 bp, Homo sapiens
ccacttgtcaagttcag

SEQ ID NO: 1103590 - DNA, 21 bp, Homo sapiens
ccacttgtccgctgggtggta

SEQ ID NO: 1103591 - DNA, 18 bp, Homo sapiens
ccactttcacgtggcctc

SEQ ID NO: 1103592 - DNA, 12 bp, Homo sapiens
ccactttctgtt

SEQ ID NO: 1103593 - DNA, 19 bp, Homo sapiens
ccactttgaagggcaagaa

SEQ ID NO: 1103594 - DNA, 21 bp, Homo sapiens
ccactttgcacgacgccctct

SEQ ID NO: 1103595 - DNA, 23 bp, Homo sapiens
ccactttgcacgacgccctctcc

SEQ ID NO: 1103596 - DNA, 21 bp, Homo sapiens
ccactttgcatatgagccgtg

SEQ ID NO: 1103597 - DNA, 15 bp, Homo sapiens
ccactttgctggttc

SEQ ID NO: 1103598 - DNA, 22 bp, Homo sapiens
ccactttggcttctcctgtgac

SEQ ID NO: 1103599 - DNA, 15 bp, Homo sapiens
ccactttgtctgtac

SEQ ID NO: 1103600 - DNA, 20 bp, Homo sapiens
ccactttgtctgtacatact

SEQ ID NO: 1103601 - DNA, 15 bp, Homo sapiens
ccactttgttcttta

SEQ ID NO: 1103602 - DNA, 21 bp, Homo sapiens
ccactttgttggcccttccag

SEQ ID NO: 1103603 - DNA, 22 bp, Homo sapiens
ccactttgttggcccttccagt

SEQ ID NO: 1103604 - DNA, 14 bp, Homo sapiens
ccacttttcttctt

SEQ ID NO: 1103605 - DNA, 16 bp, Homo sapiens
ccacttttcttcttcc

SEQ ID NO: 1103606 - DNA, 20 bp, Homo sapiens
ccacttttcttcttcctggt

SEQ ID NO: 1103607 - DNA, 22 bp, Homo sapiens
ccacttttgcccacctcttctg

SEQ ID NO: 1103608 - DNA, 22 bp, Homo sapiens
ccacttttgttcttggtttgta

SEQ ID NO: 1103609 - DNA, 16 bp, Homo sapiens
ccagaaaaaaataact

SEQ ID NO: 1103610 - DNA, 20 bp, Homo sapiens
ccagaaaaaaataactattt

SEQ ID NO: 1103611 - DNA, 21 bp, Homo sapiens
ccagaaaaaaataactatttt

SEQ ID NO: 1103612 - DNA, 18 bp, Homo sapiens
ccagaaaaactggctctg

SEQ ID NO: 1103613 - DNA, 22 bp, Homo sapiens
ccagaaaaactggctctgattg

SEQ ID NO: 1103614 - DNA, 21 bp, Homo sapiens
ccagaaaacctctcctgaccc

SEQ ID NO: 1103615 - DNA, 18 bp, Homo sapiens
ccagaaacacccctctgt

SEQ ID NO: 1103616 - DNA, 20 bp, Homo sapiens
ccagaaacacccctctgtct

SEQ ID NO: 1103617 - DNA, 14 bp, Homo sapiens
ccagaaacagctgc

SEQ ID NO: 1103618 - DNA, 18 bp, Homo sapiens
ccagaaacagctgcttct

SEQ ID NO: 1103619 - DNA, 22 bp, Homo sapiens
ccagaaacatctctggcccaga

SEQ ID NO: 1103620 - DNA, 16 bp, Homo sapiens
ccagaaactccttttg

SEQ ID NO: 1103621 - DNA, 24 bp, Homo sapiens
ccagaaactgttcccacctgctgg

SEQ ID NO: 1103622 - DNA, 21 bp, Homo sapiens
ccagaaagcctcctgccccct

SEQ ID NO: 1103623 - DNA, 16 bp, Homo sapiens
ccagaaagcctctctc

SEQ ID NO: 1103624 - DNA, 21 bp, Homo sapiens
ccagaaagcctctctctccct

SEQ ID NO: 1103625 - DNA, 16 bp, Homo sapiens
ccagaaaggagactag

SEQ ID NO: 1103626 - DNA, 15 bp, Homo sapiens
ccagaaaggatattt

SEQ ID NO: 1103627 - DNA, 13 bp, Homo sapiens
ccagaaagggtgc

SEQ ID NO: 1103628 - DNA, 20 bp, Homo sapiens
ccagaaataaaacaactctg

SEQ ID NO: 1103629 - DNA, 21 bp, Homo sapiens
ccagaaataaagttggtgaca

SEQ ID NO: 1103630 - DNA, 12 bp, Homo sapiens
ccagaaatcact

SEQ ID NO: 1103631 - DNA, 16 bp, Homo sapiens
ccagaaatcactgtga

SEQ ID NO: 1103632 - DNA, 22 bp, Homo sapiens
ccagaaatgggcagttctccca

SEQ ID NO: 1103633 - DNA, 22 bp, Homo sapiens
ccagaacaaggttccctctgag

SEQ ID NO: 1103634 - DNA, 20 bp, Homo sapiens
ccagaacacggctcacgctt

SEQ ID NO: 1103635 - DNA, 13 bp, Homo sapiens
ccagaacagccct

SEQ ID NO: 1103636 - DNA, 20 bp, Homo sapiens
ccagaacagccctcggcctc

SEQ ID NO: 1103637 - DNA, 13 bp, Homo sapiens
ccagaacagtatg

SEQ ID NO: 1103638 - DNA, 19 bp, Homo sapiens
ccagaactcactggggcct

SEQ ID NO: 1103639 - DNA, 18 bp, Homo sapiens
ccagaactgcccccactg

SEQ ID NO: 1103640 - DNA, 18 bp, Homo sapiens
ccagaactggctgggccc

SEQ ID NO: 1103641 - DNA, 21 bp, Homo sapiens
ccagaactggctgggcccctg

SEQ ID NO: 1103642 - DNA, 13 bp, Homo sapiens
ccagaacttccct

SEQ ID NO: 1103643 - DNA, 23 bp, Homo sapiens
ccagaagaagagaagctgctgac

SEQ ID NO: 1103644 - DNA, 16 bp, Homo sapiens
ccagaagaatattcag

SEQ ID NO: 1103645 - DNA, 17 bp, Homo sapiens
ccagaagagaattcagt

SEQ ID NO: 1103646 - DNA, 22 bp, Homo sapiens
ccagaagagaattcagtatttt

SEQ ID NO: 1103647 - DNA, 17 bp, Homo sapiens
ccagaagatgccagctt

SEQ ID NO: 1103648 - DNA, 17 bp, Homo sapiens
ccagaagatgccctcca

SEQ ID NO: 1103649 - DNA, 16 bp, Homo sapiens
ccagaagccaaagact

SEQ ID NO: 1103650 - DNA, 16 bp, Homo sapiens
ccagaagcctctggct

SEQ ID NO: 1103651 - DNA, 20 bp, Homo sapiens
ccagaagcctctggctagag

SEQ ID NO: 1103652 - DNA, 13 bp, Homo sapiens
ccagaagctgctc

SEQ ID NO: 1103653 - DNA, 15 bp, Homo sapiens
ccagaagcttccata

SEQ ID NO: 1103654 - DNA, 13 bp, Homo sapiens
ccagaaggcagca

SEQ ID NO: 1103655 - DNA, 12 bp, Homo sapiens
ccagaagggctt

SEQ ID NO: 1103656 - DNA, 17 bp, Homo sapiens
ccagaaggggagctttt

SEQ ID NO: 1103657 - DNA, 19 bp, Homo sapiens
ccagaaggggctgcttgct

SEQ ID NO: 1103658 - DNA, 22 bp, Homo sapiens
ccagaaggggctgcttgctttt

SEQ ID NO: 1103659 - DNA, 14 bp, Homo sapiens
ccagaaggggtttg

SEQ ID NO: 1103660 - DNA, 16 bp, Homo sapiens
ccagaagtaccagact

SEQ ID NO: 1103661 - DNA, 19 bp, Homo sapiens
ccagaagtggctactgact

SEQ ID NO: 1103662 - DNA, 13 bp, Homo sapiens
ccagaatcccagc

SEQ ID NO: 1103663 - DNA, 15 bp, Homo sapiens
ccagaatcccagccg

SEQ ID NO: 1103664 - DNA, 20 bp, Homo sapiens
ccagaatccccaagtgcctg

SEQ ID NO: 1103665 - DNA, 20 bp, Homo sapiens
ccagatgccttctagattca

SEQ ID NO: 1103666 - DNA, 13 bp, Homo sapiens
ccagatgcgggga

SEQ ID NO: 1103667 - DNA, 13 bp, Homo sapiens
ccagatgctactg

SEQ ID NO: 1103668 - DNA, 12 bp, Homo sapiens
ccagatggcccc

SEQ ID NO: 1103669 - DNA, 12 bp, Homo sapiens
ccagatggtttc

SEQ ID NO: 1103670 - DNA, 21 bp, Homo sapiens
ccagatgttttacgtctggga

SEQ ID NO: 1103671 - DNA, 16 bp, Homo sapiens
ccagattcccctgtgt

SEQ ID NO: 1103672 - DNA, 12 bp, Homo sapiens
ccagattctgat

SEQ ID NO: 1103673 - DNA, 14 bp, Homo sapiens
ccagattctgcctc

SEQ ID NO: 1103674 - DNA, 17 bp, Homo sapiens
ccagattctgcctctct

SEQ ID NO: 1103675 - DNA, 23 bp, Homo sapiens
ccagattctgcctctctggaaag

SEQ ID NO: 1103676 - DNA, 14 bp, Homo sapiens
ccagattcttcagc

SEQ ID NO: 1103677 - DNA, 13 bp, Homo sapiens
ccagattgacgac

SEQ ID NO: 1103678 - DNA, 19 bp, Homo sapiens
ccagattgacgacaagtgc

SEQ ID NO: 1103679 - DNA, 17 bp, Homo sapiens
ccagattgctctgcccc

SEQ ID NO: 1103680 - DNA, 16 bp, Homo sapiens
ccagattgtggggtgc

SEQ ID NO: 1103681 - DNA, 13 bp, Homo sapiens
ccagatttacact

SEQ ID NO: 1103682 - DNA, 21 bp, Homo sapiens
ccagatttgctaatttatcct

SEQ ID NO: 1103683 - DNA, 23 bp, Homo sapiens
ccagatttgtctttttgttgtaa

SEQ ID NO: 1103684 - DNA, 24 bp, Homo sapiens
ccagattttttacagctgcctgca

SEQ ID NO: 1103685 - DNA, 18 bp, Homo sapiens
ccagcaaaaactgtggga

SEQ ID NO: 1103686 - DNA, 22 bp, Homo sapiens
ccagcaaaaactgtgggaagat

SEQ ID NO: 1103687 - DNA, 13 bp, Homo sapiens
ccagcaaaatgga

SEQ ID NO: 1103688 - DNA, 19 bp, Homo sapiens
ccagcaaaatggaagcaaa

SEQ ID NO: 1103689 - DNA, 17 bp, Homo sapiens
ccagcaaattgctagtc

SEQ ID NO: 1103690 - DNA, 13 bp, Homo sapiens
ccagcaacatctc

SEQ ID NO: 1103691 - DNA, 15 bp, Homo sapiens
ccagcaacgcccctc

SEQ ID NO: 1103692 - DNA, 18 bp, Homo sapiens
ccagcaacgcccctccaa

SEQ ID NO: 1103693 - DNA, 13 bp, Homo sapiens
ccagcaactgaat

SEQ ID NO: 1103694 - DNA, 17 bp, Homo sapiens
ccagcaactgaataaat

SEQ ID NO: 1103695 - DNA, 14 bp, Homo sapiens
ccagcaactgccct

SEQ ID NO: 1103696 - DNA, 18 bp, Homo sapiens
ccagcaactgcccttcca

SEQ ID NO: 1103697 - DNA, 18 bp, Homo sapiens
ccagcaacttgtcttttt

SEQ ID NO: 1103698 - DNA, 21 bp, Homo sapiens
ccagcaacttgtctttttctg

SEQ ID NO: 1103699 - DNA, 19 bp, Homo sapiens
ccagcaagaataaaaaaga

SEQ ID NO: 1103700 - DNA, 22 bp, Homo sapiens
ccagcaagcagtctaccctgtc

SEQ ID NO: 1103701 - DNA, 17 bp, Homo sapiens
ccagcaagtcccagaca

SEQ ID NO: 1103702 - DNA, 18 bp, Homo sapiens
ccagcaataagaaatgaa

SEQ ID NO: 1103703 - DNA, 21 bp, Homo sapiens
ccagcaattcataaaaactgc

SEQ ID NO: 1103704 - DNA, 16 bp, Homo sapiens
ccagcacacagggcag

SEQ ID NO: 1103705 - DNA, 19 bp, Homo sapiens
ccagcacaccaagtggctg

SEQ ID NO: 1103706 - DNA, 14 bp, Homo sapiens
ccagcacagagcgt

SEQ ID NO: 1103707 - DNA, 17 bp, Homo sapiens
ccagcacagatgaggag

SEQ ID NO: 1103708 - DNA, 13 bp, Homo sapiens
ccagcacagccac

SEQ ID NO: 1103709 - DNA, 18 bp, Homo sapiens
ccagcacagccacctccg

SEQ ID NO: 1103710 - DNA, 19 bp, Homo sapiens
ccagcacagcttagatttc

SEQ ID NO: 1103711 - DNA, 22 bp, Homo sapiens
ccagcacagcttagatttcata

SEQ ID NO: 1103712 - DNA, 14 bp, Homo sapiens
ccagcacaggggcc

SEQ ID NO: 1103713 - DNA, 18 bp, Homo sapiens
ccagcacaggggccccag

SEQ ID NO: 1103714 - DNA, 20 bp, Homo sapiens
ccagcacaggggccccagat

SEQ ID NO: 1103715 - DNA, 13 bp, Homo sapiens
ccagcacatgaaa

SEQ ID NO: 1103716 - DNA, 20 bp, Homo sapiens
ccagcacattatcttcatat

SEQ ID NO: 1103717 - DNA, 14 bp, Homo sapiens
ccagcaccacagcc

SEQ ID NO: 1103718 - DNA, 21 bp, Homo sapiens
ccagcaccacctacacaggag

SEQ ID NO: 1103719 - DNA, 19 bp, Homo sapiens
ccagcaccctctcctgggg

SEQ ID NO: 1103720 - DNA, 17 bp, Homo sapiens
ccagcaccttctttctg

SEQ ID NO: 1103721 - DNA, 17 bp, Homo sapiens
ccagcactaaagcagtg

SEQ ID NO: 1103722 - DNA, 24 bp, Homo sapiens
ccagcactaaagcagtggacacca

SEQ ID NO: 1103723 - DNA, 22 bp, Homo sapiens
ccagcactaaggccgtgtctct

SEQ ID NO: 1103724 - DNA, 15 bp, Homo sapiens
ccagcactgcctcct

SEQ ID NO: 1103725 - DNA, 16 bp, Homo sapiens
ccagcactgcctcctg

SEQ ID NO: 1103726 - DNA, 17 bp, Homo sapiens
ccagcactgcctcctgt

SEQ ID NO: 1103727 - DNA, 18 bp, Homo sapiens
ccagcactgcctcctgtt

SEQ ID NO: 1103728 - DNA, 12 bp, Homo sapiens
ccagcactgctt

SEQ ID NO: 1103729 - DNA, 15 bp, Homo sapiens
ccagcactgcttgag

SEQ ID NO: 1103730 - DNA, 18 bp, Homo sapiens
ccagcactgcttgaggaa

SEQ ID NO: 1103731 - DNA, 19 bp, Homo sapiens
ccagcactgcttgaggaaa

SEQ ID NO: 1103732 - DNA, 14 bp, Homo sapiens
ccagcactttggga

SEQ ID NO: 1103733 - DNA, 16 bp, Homo sapiens
ccagcactttgggagg

SEQ ID NO: 1103734 - DNA, 17 bp, Homo sapiens
ccagcactttgggaggc

SEQ ID NO: 1103735 - DNA, 24 bp, Homo sapiens
ccagcactttgggaggccgaggtg

SEQ ID NO: 1103736 - DNA, 19 bp, Homo sapiens
ccagcactttgggaggcct

SEQ ID NO: 1103737 - DNA, 12 bp, Homo sapiens
ccagcagaaatg

SEQ ID NO: 1103738 - DNA, 17 bp, Homo sapiens
ccagcagaaatgccccc

SEQ ID NO: 1103739 - DNA, 17 bp, Homo sapiens
ccagcagaaatgcctta

SEQ ID NO: 1103740 - DNA, 22 bp, Homo sapiens
ccagcagaaatgccttaccctc

SEQ ID NO: 1103741 - DNA, 17 bp, Homo sapiens
ccagcagaatggaggca

SEQ ID NO: 1103742 - DNA, 16 bp, Homo sapiens
ccagcagacagagcca

SEQ ID NO: 1103743 - DNA, 18 bp, Homo sapiens
ccagcagacagagccagg

SEQ ID NO: 1103744 - DNA, 22 bp, Homo sapiens
ccagcagacagagccaggagaa

SEQ ID NO: 1103745 - DNA, 12 bp, Homo sapiens
ccagcagagccc

SEQ ID NO: 1103746 - DNA, 19 bp, Homo sapiens
ccagcagagcccaccagcc

SEQ ID NO: 1103747 - DNA, 21 bp, Homo sapiens
ccagcagagcccaccagccag

SEQ ID NO: 1103748 - DNA, 16 bp, Homo sapiens
ccagcagaggcaggct

SEQ ID NO: 1103749 - DNA, 21 bp, Homo sapiens
ccagcagaggcaggctgggac

SEQ ID NO: 1103750 - DNA, 11 bp, Homo sapiens
ccagcagcaca

SEQ ID NO: 1103751 - DNA, 13 bp, Homo sapiens
ccagcagcacaat

SEQ ID NO: 1103752 - DNA, 21 bp, Homo sapiens
ccagcagcacaattctgtccc

SEQ ID NO: 1103753 - DNA, 22 bp, Homo sapiens
ccagcagcacaattctgtccct

SEQ ID NO: 1103754 - DNA, 24 bp, Homo sapiens
ccagcagcacaattctgtccctgt

SEQ ID NO: 1103755 - DNA, 15 bp, Homo sapiens
ccagcagcagcaggt

SEQ ID NO: 1103756 - DNA, 20 bp, Homo sapiens
ccagcagcaggatgggctga

SEQ ID NO: 1103757 - DNA, 14 bp, Homo sapiens
ccagcagcctcgca

SEQ ID NO: 1103758 - DNA, 14 bp, Homo sapiens
ccagcagcctggac

SEQ ID NO: 1103759 - DNA, 17 bp, Homo sapiens
ccagcagctgcacccca

SEQ ID NO: 1103760 - DNA, 12 bp, Homo sapiens
ccagcagctgcg

SEQ ID NO: 1103761 - DNA, 15 bp, Homo sapiens
ccagcagctgtcaga

SEQ ID NO: 1103762 - DNA, 22 bp, Homo sapiens
ccagcaggagagactgagcagc

SEQ ID NO: 1103763 - DNA, 23 bp, Homo sapiens
ccagcaggagagactgagcagcc

SEQ ID NO: 1103764 - DNA, 23 bp, Homo sapiens
ccagcaggaggttctgggcctct

SEQ ID NO: 1103765 - DNA, 19 bp, Homo sapiens
ccagcaggcaggcactgtg

SEQ ID NO: 1103766 - DNA, 20 bp, Homo sapiens
ccagcaggcaggcactgtgg

SEQ ID NO: 1103767 - DNA, 11 bp, Homo sapiens
ccagcaggccc

SEQ ID NO: 1103768 - DNA, 14 bp, Homo sapiens
ccagcaggcccagc

SEQ ID NO: 1103769 - DNA, 18 bp, Homo sapiens
ccagcaggcccagcatgc

SEQ ID NO: 1103770 - DNA, 20 bp, Homo sapiens
ccagcaggcccagcatgcag

SEQ ID NO: 1103771 - DNA, 17 bp, Homo sapiens
ccagcaggcctccctga

SEQ ID NO: 1103772 - DNA, 20 bp, Homo sapiens
ccagcaggcctccctgaaac

SEQ ID NO: 1103773 - DNA, 12 bp, Homo sapiens
ccagcaggctcc

SEQ ID NO: 1103774 - DNA, 19 bp, Homo sapiens
ccagcaggctcctggctgt

SEQ ID NO: 1103775 - DNA, 20 bp, Homo sapiens
ccagcagtgaatgctagaca

SEQ ID NO: 1103776 - DNA, 12 bp, Homo sapiens
ccagcagtttct

SEQ ID NO: 1103777 - DNA, 15 bp, Homo sapiens
ccagcagtttgggag

SEQ ID NO: 1103778 - DNA, 12 bp, Homo sapiens
ccagcatacagt

SEQ ID NO: 1103779 - DNA, 16 bp, Homo sapiens
ccagcatacagtttgg

SEQ ID NO: 1103780 - DNA, 17 bp, Homo sapiens
ccagcataggggggagg

SEQ ID NO: 1103781 - DNA, 18 bp, Homo sapiens
ccagcatccacactgccg

SEQ ID NO: 1103782 - DNA, 12 bp, Homo sapiens
ccagcatccctg

SEQ ID NO: 1103783 - DNA, 16 bp, Homo sapiens
ccagcatccctggagc

SEQ ID NO: 1103784 - DNA, 20 bp, Homo sapiens
ccagcatcctgattaaatgt

SEQ ID NO: 1103785 - DNA, 21 bp, Homo sapiens
ccagcatccttttctgcagag

SEQ ID NO: 1103786 - DNA, 15 bp, Homo sapiens
ccagcatcgggggcc

SEQ ID NO: 1103787 - DNA, 15 bp, Homo sapiens
ccagcgcccccagaa

SEQ ID NO: 1103788 - DNA, 16 bp, Homo sapiens
ccagcgcccgctgggc

SEQ ID NO: 1103789 - DNA, 18 bp, Homo sapiens
ccagcgcccgctgggctg

SEQ ID NO: 1103790 - DNA, 19 bp, Homo sapiens
ccagcgcctccctccaccc

SEQ ID NO: 1103791 - DNA, 22 bp, Homo sapiens
ccagcgcctccctccaccccag

SEQ ID NO: 1103792 - DNA, 23 bp, Homo sapiens
ccagcgcctccctccaccccagg

SEQ ID NO: 1103793 - DNA, 19 bp, Homo sapiens
ccagcggaaacaggtgtgt

SEQ ID NO: 1103794 - DNA, 22 bp, Homo sapiens
ccagcggccccccgcacagcca

SEQ ID NO: 1103795 - DNA, 14 bp, Homo sapiens
ccagcggcctcagg

SEQ ID NO: 1103796 - DNA, 13 bp, Homo sapiens
ccagcggctgagt

SEQ ID NO: 1103797 - DNA, 17 bp, Homo sapiens
ccagcggcttagccaag

SEQ ID NO: 1103798 - DNA, 21 bp, Homo sapiens
ccagcggcttagccaagccct

SEQ ID NO: 1103799 - DNA, 19 bp, Homo sapiens
ccagcggttcctgtgcaga

SEQ ID NO: 1103800 - DNA, 19 bp, Homo sapiens
ccagcgtcagtttcactcc

SEQ ID NO: 1103801 - DNA, 19 bp, Homo sapiens
ccagcgtcctcctctgtga

SEQ ID NO: 1103802 - DNA, 14 bp, Homo sapiens
ccagcgtgacggag

SEQ ID NO: 1103803 - DNA, 16 bp, Homo sapiens
ccagcgtggcccaggc

SEQ ID NO: 1103804 - DNA, 14 bp, Homo sapiens
ccagcgttcccttc

SEQ ID NO: 1103805 - DNA, 16 bp, Homo sapiens
ccagcgttcccttctc

SEQ ID NO: 1103806 - DNA, 21 bp, Homo sapiens
ccagcgttcccttctccccct

SEQ ID NO: 1103807 - DNA, 22 bp, Homo sapiens
ccagcgttcccttctccccctt

SEQ ID NO: 1103808 - DNA, 21 bp, Homo sapiens
ccagctaaggacatttcccag

SEQ ID NO: 1103809 - DNA, 23 bp, Homo sapiens
ccagctaaggacatttcccaggg

SEQ ID NO: 1103810 - DNA, 19 bp, Homo sapiens
ccagctaaggagtccctgg

SEQ ID NO: 1103811 - DNA, 17 bp, Homo sapiens
ccagctaatctgtaggg

SEQ ID NO: 1103812 - DNA, 23 bp, Homo sapiens
ccagctaatctgtagggctggac

SEQ ID NO: 1103813 - DNA, 14 bp, Homo sapiens
ccagctaattgaga

SEQ ID NO: 1103814 - DNA, 20 bp, Homo sapiens
ccagctacattcctcagctg

SEQ ID NO: 1103815 - DNA, 21 bp, Homo sapiens
ccagctacattcctcagctgc

SEQ ID NO: 1103816 - DNA, 22 bp, Homo sapiens
ccagctacattcctcagctgcc

SEQ ID NO: 1103817 - DNA, 23 bp, Homo sapiens
ccagctacattcctcagctgcca

SEQ ID NO: 1103818 - DNA, 18 bp, Homo sapiens
ccagctaccccttctttg

SEQ ID NO: 1103819 - DNA, 16 bp, Homo sapiens
ccagctaccccttgtg

SEQ ID NO: 1103820 - DNA, 16 bp, Homo sapiens
ccagctaccctttttc

SEQ ID NO: 1103821 - DNA, 17 bp, Homo sapiens
ccagctacgtgggaggc

SEQ ID NO: 1103822 - DNA, 20 bp, Homo sapiens
ccagctactcaagaggctga

SEQ ID NO: 1103823 - DNA, 14 bp, Homo sapiens
ccagctactcagaa

SEQ ID NO: 1103824 - DNA, 23 bp, Homo sapiens
ccagctactcagaagcctgaggc

SEQ ID NO: 1103825 - DNA, 14 bp, Homo sapiens
ccagctactcagga

SEQ ID NO: 1103826 - DNA, 17 bp, Homo sapiens
ccagctactcaggaggc

SEQ ID NO: 1103827 - DNA, 23 bp, Homo sapiens
ccagctactcgggaggctgaggc

SEQ ID NO: 1103828 - DNA, 22 bp, Homo sapiens
ccagctactctgtccaggccac

SEQ ID NO: 1103829 - DNA, 19 bp, Homo sapiens
ccagctactgaaccagcca

SEQ ID NO: 1103830 - DNA, 21 bp, Homo sapiens
ccagctactgaaccagccacg

SEQ ID NO: 1103831 - DNA, 18 bp, Homo sapiens
ccagctacttgggagcct

SEQ ID NO: 1103832 - DNA, 19 bp, Homo sapiens
ccagctacttgggagcctg

SEQ ID NO: 1103833 - DNA, 16 bp, Homo sapiens
ccagctacttgggagg

SEQ ID NO: 1103834 - DNA, 17 bp, Homo sapiens
ccagctacttgggaggc

SEQ ID NO: 1103835 - DNA, 20 bp, Homo sapiens
ccagctacttgggaggctga

SEQ ID NO: 1103836 - DNA, 23 bp, Homo sapiens
ccagctaggaagagcaggactcc

SEQ ID NO: 1103837 - DNA, 17 bp, Homo sapiens
ccagctcaatggactgg

SEQ ID NO: 1103838 - DNA, 14 bp, Homo sapiens
ccagctcagaaccc

SEQ ID NO: 1103839 - DNA, 22 bp, Homo sapiens
ccagctcatgtaggtgagcctg

SEQ ID NO: 1103840 - DNA, 23 bp, Homo sapiens
ccagctcatgtaggtgagcctgg

SEQ ID NO: 1103841 - DNA, 17 bp, Homo sapiens
ccagctccacacattcc

SEQ ID NO: 1103842 - DNA, 22 bp, Homo sapiens
ccagctccacacattccagcca

SEQ ID NO: 1103843 - DNA, 23 bp, Homo sapiens
ccagctccacacattccagccag

SEQ ID NO: 1103844 - DNA, 13 bp, Homo sapiens
ccagctccaggcc

SEQ ID NO: 1103845 - DNA, 21 bp, Homo sapiens
ccagctccaggggcccttggg

SEQ ID NO: 1103846 - DNA, 17 bp, Homo sapiens
ccagctccagtgccgct

SEQ ID NO: 1103847 - DNA, 23 bp, Homo sapiens
ccagctccagtgccgctcctgct

SEQ ID NO: 1103848 - DNA, 14 bp, Homo sapiens
ccagctccccaaga

SEQ ID NO: 1103849 - DNA, 12 bp, Homo sapiens
ccagctcccccc

SEQ ID NO: 1103850 - DNA, 16 bp, Homo sapiens
ccagctccccccaaga

SEQ ID NO: 1103851 - DNA, 14 bp, Homo sapiens
ccagctccccccgc

SEQ ID NO: 1103852 - DNA, 21 bp, Homo sapiens
ccagctccccccgcccaccca

SEQ ID NO: 1103853 - DNA, 15 bp, Homo sapiens
ccagctccctagact

SEQ ID NO: 1103854 - DNA, 21 bp, Homo sapiens
ccagctccctagactgcatcc

SEQ ID NO: 1103855 - DNA, 14 bp, Homo sapiens
ccagctccctagga

SEQ ID NO: 1103856 - DNA, 22 bp, Homo sapiens
ccagctcccttgggaaggacac

SEQ ID NO: 1103857 - DNA, 14 bp, Homo sapiens
ccagctccgacctc

SEQ ID NO: 1103858 - DNA, 20 bp, Homo sapiens
ccagctccgacctctctcag

SEQ ID NO: 1103859 - DNA, 17 bp, Homo sapiens
ccagctccgcctgctgg

SEQ ID NO: 1103860 - DNA, 22 bp, Homo sapiens
ccagctccggagggggtcctcc

SEQ ID NO: 1103861 - DNA, 18 bp, Homo sapiens
ccagctccggcctgtcct

SEQ ID NO: 1103862 - DNA, 19 bp, Homo sapiens
ccagctccggcctgtcctc

SEQ ID NO: 1103863 - DNA, 20 bp, Homo sapiens
ccagctccggcctgtcctcc

SEQ ID NO: 1103864 - DNA, 13 bp, Homo sapiens
ccagctcctcaca

SEQ ID NO: 1103865 - DNA, 16 bp, Homo sapiens
ccagctcctcacatac

SEQ ID NO: 1103866 - DNA, 15 bp, Homo sapiens
ccagctcctccagcc

SEQ ID NO: 1103867 - DNA, 18 bp, Homo sapiens
ccagctcctccagccctg

SEQ ID NO: 1103868 - DNA, 20 bp, Homo sapiens
ccagctcctccagccctgcc

SEQ ID NO: 1103869 - DNA, 11 bp, Homo sapiens
ccagctcctct

SEQ ID NO: 1103870 - DNA, 16 bp, Homo sapiens
ccagctcctctctgaa

SEQ ID NO: 1103871 - DNA, 21 bp, Homo sapiens
ccagctcctctgagccatacc

SEQ ID NO: 1103872 - DNA, 14 bp, Homo sapiens
ccagctccttcgct

SEQ ID NO: 1103873 - DNA, 15 bp, Homo sapiens
ccagctccttggctg

SEQ ID NO: 1103874 - DNA, 16 bp, Homo sapiens
ccagctccttggctgc

SEQ ID NO: 1103875 - DNA, 19 bp, Homo sapiens
ccagctccttggctgcagc

SEQ ID NO: 1103876 - DNA, 21 bp, Homo sapiens
ccagctccttttgtccccagg

SEQ ID NO: 1103877 - DNA, 19 bp, Homo sapiens
ccagctctaagcagccagg

SEQ ID NO: 1103878 - DNA, 21 bp, Homo sapiens
ccagctctaagcagccaggag

SEQ ID NO: 1103879 - DNA, 13 bp, Homo sapiens
ccagctctcagcc

SEQ ID NO: 1103880 - DNA, 14 bp, Homo sapiens
ccagctctcagcca

SEQ ID NO: 1103881 - DNA, 22 bp, Homo sapiens
ccagctctcccacatcccactg

SEQ ID NO: 1103882 - DNA, 14 bp, Homo sapiens
ccagctctctctac

SEQ ID NO: 1103883 - DNA, 16 bp, Homo sapiens
ccagctctctctaccc

SEQ ID NO: 1103884 - DNA, 12 bp, Homo sapiens
ccagctctctga

SEQ ID NO: 1103885 - DNA, 13 bp, Homo sapiens
ccagctctctgac

SEQ ID NO: 1103886 - DNA, 21 bp, Homo sapiens
ccagctctgaaaccagtgtta

SEQ ID NO: 1103887 - DNA, 13 bp, Homo sapiens
ccagctctgacat

SEQ ID NO: 1103888 - DNA, 14 bp, Homo sapiens
ccagctctgacatc

SEQ ID NO: 1103889 - DNA, 16 bp, Homo sapiens
ccagctctgacatccc

SEQ ID NO: 1103890 - DNA, 17 bp, Homo sapiens
ccagctctgacatccct

SEQ ID NO: 1103891 - DNA, 21 bp, Homo sapiens
ccagctctgacatcccttcct

SEQ ID NO: 1103892 - DNA, 23 bp, Homo sapiens
ccagctctgacatcccttcctgg

SEQ ID NO: 1103893 - DNA, 21 bp, Homo sapiens
ccagctctgaggggaggcacc

SEQ ID NO: 1103894 - DNA, 20 bp, Homo sapiens
ccagctctgccgtctctgga

SEQ ID NO: 1103895 - DNA, 22 bp, Homo sapiens
ccagctctgcgtcggtcctggt

SEQ ID NO: 1103896 - DNA, 19 bp, Homo sapiens
ccagctctggaggggaggg

SEQ ID NO: 1103897 - DNA, 21 bp, Homo sapiens
ccagctctggatgaaggcaaa

SEQ ID NO: 1103898 - DNA, 18 bp, Homo sapiens
ccagctctgtatcaggac

SEQ ID NO: 1103899 - DNA, 12 bp, Homo sapiens
ccagctctgtgg

SEQ ID NO: 1103900 - DNA, 15 bp, Homo sapiens
ccagctctgtggcct

SEQ ID NO: 1103901 - DNA, 17 bp, Homo sapiens
ccagctctgtggcctgt

SEQ ID NO: 1103902 - DNA, 16 bp, Homo sapiens
ccagctcttgctctct

SEQ ID NO: 1103903 - DNA, 18 bp, Homo sapiens
ccagctcttgctctcttg

SEQ ID NO: 1103904 - DNA, 14 bp, Homo sapiens
ccagctgactaaac

SEQ ID NO: 1103905 - DNA, 18 bp, Homo sapiens
ccagctgactgttggctc

SEQ ID NO: 1103906 - DNA, 20 bp, Homo sapiens
ccagctgactgttggctctc

SEQ ID NO: 1103907 - DNA, 17 bp, Homo sapiens
ccagctgagcgccagga

SEQ ID NO: 1103908 - DNA, 15 bp, Homo sapiens
ccaggcttgcctggg

SEQ ID NO: 1103909 - DNA, 17 bp, Homo sapiens
ccaggcttgcctgggct

SEQ ID NO: 1103910 - DNA, 18 bp, Homo sapiens
ccaggcttgcctgggctg

SEQ ID NO: 1103911 - DNA, 18 bp, Homo sapiens
ccagggaaaatgacttta

SEQ ID NO: 1103912 - DNA, 17 bp, Homo sapiens
ccagggaagctggccga

SEQ ID NO: 1103913 - DNA, 19 bp, Homo sapiens
ccagggaaggtggccacag

SEQ ID NO: 1103914 - DNA, 22 bp, Homo sapiens
ccagggaaggtggccacagcaa

SEQ ID NO: 1103915 - DNA, 16 bp, Homo sapiens
ccagggacacacagcc

SEQ ID NO: 1103916 - DNA, 15 bp, Homo sapiens
ccagggacagaggcc

SEQ ID NO: 1103917 - DNA, 12 bp, Homo sapiens
ccagggaccagc

SEQ ID NO: 1103918 - DNA, 16 bp, Homo sapiens
ccagggaccagcacct

SEQ ID NO: 1103919 - DNA, 22 bp, Homo sapiens
ccagggacccttgcctgcctcc

SEQ ID NO: 1103920 - DNA, 17 bp, Homo sapiens
ccagggagcaagacaga

SEQ ID NO: 1103921 - DNA, 18 bp, Homo sapiens
ccagggagcctttggttc

SEQ ID NO: 1103922 - DNA, 16 bp, Homo sapiens
ccagggagctctgggg

SEQ ID NO: 1103923 - DNA, 23 bp, Homo sapiens
ccagggagctctggggacagctt

SEQ ID NO: 1103924 - DNA, 17 bp, Homo sapiens
ccagggagcttcctggc

SEQ ID NO: 1103925 - DNA, 23 bp, Homo sapiens
ccagggagcttcctggctctggg

SEQ ID NO: 1103926 - DNA, 15 bp, Homo sapiens
ccagggaggagtcag

SEQ ID NO: 1103927 - DNA, 10 bp, Homo sapiens
ccagggaggc

SEQ ID NO: 1103928 - DNA, 13 bp, Homo sapiens
ccagggaggcaga

SEQ ID NO: 1103929 - DNA, 19 bp, Homo sapiens
ccagggaggcagagcggga

SEQ ID NO: 1103930 - DNA, 23 bp, Homo sapiens
ccagggaggcagagcgggaggga

SEQ ID NO: 1103931 - DNA, 15 bp, Homo sapiens
ccagggaggcgcagg

SEQ ID NO: 1103932 - DNA, 18 bp, Homo sapiens
ccagggaggcgcagggac

SEQ ID NO: 1103933 - DNA, 21 bp, Homo sapiens
ccagggaggcgcagggacatg

SEQ ID NO: 1103934 - DNA, 13 bp, Homo sapiens
ccagggagtcccc

SEQ ID NO: 1103935 - DNA, 12 bp, Homo sapiens
ccagggagtgag

SEQ ID NO: 1103936 - DNA, 17 bp, Homo sapiens
ccagggagtgagcagct

SEQ ID NO: 1103937 - DNA, 18 bp, Homo sapiens
ccagggatgctgggctgg

SEQ ID NO: 1103938 - DNA, 21 bp, Homo sapiens
ccagggcaatgccatcagccc

SEQ ID NO: 1103939 - DNA, 13 bp, Homo sapiens
ccagggcagcagc

SEQ ID NO: 1103940 - DNA, 13 bp, Homo sapiens
ccagggcagcggc

SEQ ID NO: 1103941 - DNA, 13 bp, Homo sapiens
ccagggcagggtc

SEQ ID NO: 1103942 - DNA, 14 bp, Homo sapiens
ccagggcagggtct

SEQ ID NO: 1103943 - DNA, 23 bp, Homo sapiens
ccagggcagggtgggcagcctat

SEQ ID NO: 1103944 - DNA, 23 bp, Homo sapiens
ccagggcatgtgtatgtgtctgc

SEQ ID NO: 1103945 - DNA, 17 bp, Homo sapiens
ccagggccagggccctg

SEQ ID NO: 1103946 - DNA, 17 bp, Homo sapiens
ccagggcccagagccct

SEQ ID NO: 1103947 - DNA, 13 bp, Homo sapiens
ccagggcccagga

SEQ ID NO: 1103948 - DNA, 23 bp, Homo sapiens
ccagggcccaggaggaccgcctg

SEQ ID NO: 1103949 - DNA, 17 bp, Homo sapiens
ccagggcccaggccatg

SEQ ID NO: 1103950 - DNA, 16 bp, Homo sapiens
ccagggcccccctccc

SEQ ID NO: 1103951 - DNA, 21 bp, Homo sapiens
ccagggcccctcaccctgcct

SEQ ID NO: 1103952 - DNA, 22 bp, Homo sapiens
ccagggcccctccctctgcccc

SEQ ID NO: 1103953 - DNA, 20 bp, Homo sapiens
ccagggcccgggcacccaca

SEQ ID NO: 1103954 - DNA, 18 bp, Homo sapiens
ccagggccctgagctcgg

SEQ ID NO: 1103955 - DNA, 15 bp, Homo sapiens
ccagggccctgggca

SEQ ID NO: 1103956 - DNA, 13 bp, Homo sapiens
ccagggcctagga

SEQ ID NO: 1103957 - DNA, 16 bp, Homo sapiens
ccagggcctccagggc

SEQ ID NO: 1103958 - DNA, 14 bp, Homo sapiens
ccagggcctccctg

SEQ ID NO: 1103959 - DNA, 21 bp, Homo sapiens
ccagggcctcctgggggacct

SEQ ID NO: 1103960 - DNA, 12 bp, Homo sapiens
ccagggcctctc

SEQ ID NO: 1103961 - DNA, 14 bp, Homo sapiens
ccagggcctgacac

SEQ ID NO: 1103962 - DNA, 15 bp, Homo sapiens
ccagggcctgacacc

SEQ ID NO: 1103963 - DNA, 19 bp, Homo sapiens
ccagggcctgacaccccct

SEQ ID NO: 1103964 - DNA, 18 bp, Homo sapiens
ccagggcctgacttgagc

SEQ ID NO: 1103965 - DNA, 22 bp, Homo sapiens
ccagggcctgcttccccttcct

SEQ ID NO: 1103966 - DNA, 13 bp, Homo sapiens
ccagggcctgggg

SEQ ID NO: 1103967 - DNA, 20 bp, Homo sapiens
ccagggcgccagggtgctgt

SEQ ID NO: 1103968 - DNA, 17 bp, Homo sapiens
ccagggcgctgggaagg

SEQ ID NO: 1103969 - DNA, 16 bp, Homo sapiens
ccagggcggccaggga

SEQ ID NO: 1103970 - DNA, 17 bp, Homo sapiens
ccagggcggccagggac

SEQ ID NO: 1103971 - DNA, 15 bp, Homo sapiens
ccagggctcaccagc

SEQ ID NO: 1103972 - DNA, 16 bp, Homo sapiens
ccagggctcagcctgg

SEQ ID NO: 1103973 - DNA, 14 bp, Homo sapiens
ccagggctccaaat

SEQ ID NO: 1103974 - DNA, 21 bp, Homo sapiens
ccagggctccctcctggagca

SEQ ID NO: 1103975 - DNA, 14 bp, Homo sapiens
ccagggctcctgca

SEQ ID NO: 1103976 - DNA, 20 bp, Homo sapiens
ccagggctcctgcacttact

SEQ ID NO: 1103977 - DNA, 15 bp, Homo sapiens
ccagggctcttctca

SEQ ID NO: 1103978 - DNA, 10 bp, Homo sapiens
ccagggctgc

SEQ ID NO: 1103979 - DNA, 21 bp, Homo sapiens
ccagggctgcaaaactggaag

SEQ ID NO: 1103980 - DNA, 22 bp, Homo sapiens
ccagggctgcaaaactggaagc

SEQ ID NO: 1103981 - DNA, 15 bp, Homo sapiens
ccagggctgccctga

SEQ ID NO: 1103982 - DNA, 18 bp, Homo sapiens
ccagggctgccctgagaa

SEQ ID NO: 1103983 - DNA, 19 bp, Homo sapiens
ccagggctgccctgagaag

SEQ ID NO: 1103984 - DNA, 23 bp, Homo sapiens
ccagggctgccctgagaagctgc

SEQ ID NO: 1103985 - DNA, 14 bp, Homo sapiens
ccagggctggatgg

SEQ ID NO: 1103986 - DNA, 16 bp, Homo sapiens
ccagggctggatggac

SEQ ID NO: 1103987 - DNA, 19 bp, Homo sapiens
ccagggctggatggacaga

SEQ ID NO: 1103988 - DNA, 18 bp, Homo sapiens
ccagggctgggaggaagg

SEQ ID NO: 1103989 - DNA, 21 bp, Homo sapiens
ccagggctgggaggaaggact

SEQ ID NO: 1103990 - DNA, 18 bp, Homo sapiens
ccagggctggggacagag

SEQ ID NO: 1103991 - DNA, 13 bp, Homo sapiens
ccagggctgtcct

SEQ ID NO: 1103992 - DNA, 20 bp, Homo sapiens
ccagggctgttggaggaccc

SEQ ID NO: 1103993 - DNA, 21 bp, Homo sapiens
ccagggcttacctgtacactg

SEQ ID NO: 1103994 - DNA, 14 bp, Homo sapiens
ccagggcttcccca

SEQ ID NO: 1103995 - DNA, 18 bp, Homo sapiens
ccagggcttttcccagga

SEQ ID NO: 1103996 - DNA, 19 bp, Homo sapiens
ccagggcttttcccaggaa

SEQ ID NO: 1103997 - DNA, 19 bp, Homo sapiens
ccaggggaaaatcagcctg

SEQ ID NO: 1103998 - DNA, 13 bp, Homo sapiens
ccaggggaacctg

SEQ ID NO: 1103999 - DNA, 16 bp, Homo sapiens
ccaggggaacctgcca

SEQ ID NO: 1104000 - DNA, 17 bp, Homo sapiens
ccaggggaacctgccat

SEQ ID NO: 1104001 - DNA, 14 bp, Homo sapiens
ccaggggaaggccc

SEQ ID NO: 1104002 - DNA, 18 bp, Homo sapiens
ccaggggaccacacctcc

SEQ ID NO: 1104003 - DNA, 20 bp, Homo sapiens
ccaggggacgtgggccctgc

SEQ ID NO: 1104004 - DNA, 20 bp, Homo sapiens
ccaggggagagggtctggag

SEQ ID NO: 1104005 - DNA, 17 bp, Homo sapiens
ccaggggagccagctgc

SEQ ID NO: 1104006 - DNA, 18 bp, Homo sapiens
ccaggggagccagctgct

SEQ ID NO: 1104007 - DNA, 21 bp, Homo sapiens
ccaggggagccagctgcttga

SEQ ID NO: 1104008 - DNA, 16 bp, Homo sapiens
ccaggggcagcaaggc

SEQ ID NO: 1104009 - DNA, 17 bp, Homo sapiens
ccaggggcagcaaggcc

SEQ ID NO: 1104010 - DNA, 20 bp, Homo sapiens
ccaggggcagcaaggccttg

SEQ ID NO: 1104011 - DNA, 15 bp, Homo sapiens
ccaggggcaggcagg

SEQ ID NO: 1104012 - DNA, 18 bp, Homo sapiens
ccaggggcccacagggaa

SEQ ID NO: 1104013 - DNA, 23 bp, Homo sapiens
ccaggggcccaccctctgcccag

SEQ ID NO: 1104014 - DNA, 14 bp, Homo sapiens
ccaggggcccttgg

SEQ ID NO: 1104015 - DNA, 22 bp, Homo sapiens
ccaggggcccttgggacagcca

SEQ ID NO: 1104016 - DNA, 17 bp, Homo sapiens
ccaggggctcctgggtt

SEQ ID NO: 1104017 - DNA, 21 bp, Homo sapiens
ccaggggctgcttcctcctgg

SEQ ID NO: 1104018 - DNA, 15 bp, Homo sapiens
ccagggggcaagagg

SEQ ID NO: 1104019 - DNA, 15 bp, Homo sapiens
ccaggggtctccctg

SEQ ID NO: 1104020 - DNA, 17 bp, Homo sapiens
ccaggggtctccctggc

SEQ ID NO: 1104021 - DNA, 19 bp, Homo sapiens
ccaggggtgatttcagaga

SEQ ID NO: 1104022 - DNA, 20 bp, Homo sapiens
ccaggggtgatttcagagag

SEQ ID NO: 1104023 - DNA, 18 bp, Homo sapiens
ccaggggtgccccctcct

SEQ ID NO: 1104024 - DNA, 20 bp, Homo sapiens
ccaggggtgccccctcctct

SEQ ID NO: 1104025 - DNA, 13 bp, Homo sapiens
ccaggggtttctc

SEQ ID NO: 1104026 - DNA, 20 bp, Homo sapiens
ccagggtagagcaaaggaga

SEQ ID NO: 1104027 - DNA, 15 bp, Homo sapiens
ccagggtcccacccc

SEQ ID NO: 1104028 - DNA, 17 bp, Homo sapiens
ccagggtcccaggaagc

SEQ ID NO: 1104029 - DNA, 18 bp, Homo sapiens
ccagggtcccaggaagcc

SEQ ID NO: 1104030 - DNA, 12 bp, Homo sapiens
cccactgtatga

SEQ ID NO: 1104031 - DNA, 14 bp, Homo sapiens
cccactgtcctacc

SEQ ID NO: 1104032 - DNA, 22 bp, Homo sapiens
cccactgtgcctcagagaccag

SEQ ID NO: 1104033 - DNA, 20 bp, Homo sapiens
cccactgttctgaaaggaga

SEQ ID NO: 1104034 - DNA, 14 bp, Homo sapiens
cccacttacattta

SEQ ID NO: 1104035 - DNA, 18 bp, Homo sapiens
cccacttagccgcaccct

SEQ ID NO: 1104036 - DNA, 19 bp, Homo sapiens
cccacttagccgcaccctg

SEQ ID NO: 1104037 - DNA, 21 bp, Homo sapiens
cccacttagccgcaccctgca

SEQ ID NO: 1104038 - DNA, 21 bp, Homo sapiens
cccacttagccgtccatggca

SEQ ID NO: 1104039 - DNA, 17 bp, Homo sapiens
cccacttatgctgctgt

SEQ ID NO: 1104040 - DNA, 18 bp, Homo sapiens
cccacttatgctgctgtg

SEQ ID NO: 1104041 - DNA, 22 bp, Homo sapiens
cccacttatgctgctgtgaatt

SEQ ID NO: 1104042 - DNA, 15 bp, Homo sapiens
cccacttcaccccca

SEQ ID NO: 1104043 - DNA, 15 bp, Homo sapiens
cccacttcccacttg

SEQ ID NO: 1104044 - DNA, 16 bp, Homo sapiens
cccacttcctcctacc

SEQ ID NO: 1104045 - DNA, 17 bp, Homo sapiens
cccacttcctcctacct

SEQ ID NO: 1104046 - DNA, 20 bp, Homo sapiens
cccacttcctcctacctggg

SEQ ID NO: 1104047 - DNA, 23 bp, Homo sapiens
cccacttcctcctacctggggac

SEQ ID NO: 1104048 - DNA, 13 bp, Homo sapiens
cccacttctggca

SEQ ID NO: 1104049 - DNA, 21 bp, Homo sapiens
cccacttgcctcttccttgaa

SEQ ID NO: 1104050 - DNA, 13 bp, Homo sapiens
cccactttctgtt

SEQ ID NO: 1104051 - DNA, 22 bp, Homo sapiens
cccactttgctgttccttactt

SEQ ID NO: 1104052 - DNA, 16 bp, Homo sapiens
cccactttgtctgtac

SEQ ID NO: 1104053 - DNA, 17 bp, Homo sapiens
cccactttgtctgtaca

SEQ ID NO: 1104054 - DNA, 19 bp, Homo sapiens
cccactttgtctgtacata

SEQ ID NO: 1104055 - DNA, 18 bp, Homo sapiens
cccagaaaaactggctct

SEQ ID NO: 1104056 - DNA, 20 bp, Homo sapiens
cccagaaaagaaagctacag

SEQ ID NO: 1104057 - DNA, 22 bp, Homo sapiens
cccagaaagcctcctgccccct

SEQ ID NO: 1104058 - DNA, 21 bp, Homo sapiens
cccagaaagctgcggattggg

SEQ ID NO: 1104059 - DNA, 22 bp, Homo sapiens
cccagaaagtgataagtgcagg

SEQ ID NO: 1104060 - DNA, 19 bp, Homo sapiens
cccagaaatcactgtgaaa

SEQ ID NO: 1104061 - DNA, 21 bp, Homo sapiens
cccagaaatcactgtgaaatt

SEQ ID NO: 1104062 - DNA, 20 bp, Homo sapiens
cccagaacaaaaagaaatct

SEQ ID NO: 1104063 - DNA, 14 bp, Homo sapiens
cccagaaccacaga

SEQ ID NO: 1104064 - DNA, 15 bp, Homo sapiens
cccagaaccacagat

SEQ ID NO: 1104065 - DNA, 16 bp, Homo sapiens
cccagaactattctgg

SEQ ID NO: 1104066 - DNA, 16 bp, Homo sapiens
cccagaacttccctga

SEQ ID NO: 1104067 - DNA, 14 bp, Homo sapiens
cccagaatcccagc

SEQ ID NO: 1104068 - DNA, 16 bp, Homo sapiens
cccagaatcccagccg

SEQ ID NO: 1104069 - DNA, 22 bp, Homo sapiens
cccagaatccccaagtgcctgc

SEQ ID NO: 1104070 - DNA, 15 bp, Homo sapiens
cccagaatggagcct

SEQ ID NO: 1104071 - DNA, 20 bp, Homo sapiens
cccagaatggagcctgctct

SEQ ID NO: 1104072 - DNA, 16 bp, Homo sapiens
cccagacaaccaaaac

SEQ ID NO: 1104073 - DNA, 16 bp, Homo sapiens
cccagacaaggagagc

SEQ ID NO: 1104074 - DNA, 22 bp, Homo sapiens
cccagacacagactggcaataa

SEQ ID NO: 1104075 - DNA, 20 bp, Homo sapiens
cccagacacatcgcactgtg

SEQ ID NO: 1104076 - DNA, 23 bp, Homo sapiens
cccagacacatcgcactgtggat

SEQ ID NO: 1104077 - DNA, 15 bp, Homo sapiens
cccagacaccatgtg

SEQ ID NO: 1104078 - DNA, 20 bp, Homo sapiens
cccagacagacatctctgca

SEQ ID NO: 1104079 - DNA, 22 bp, Homo sapiens
cccagacagggtgggcttcctg

SEQ ID NO: 1104080 - DNA, 19 bp, Homo sapiens
cccagaccaaccctgggac

SEQ ID NO: 1104081 - DNA, 15 bp, Homo sapiens
cccagaccaatggca

SEQ ID NO: 1104082 - DNA, 23 bp, Homo sapiens
cccagacccaactcgcctgtgga

SEQ ID NO: 1104083 - DNA, 16 bp, Homo sapiens
cccagacccccagtgt

SEQ ID NO: 1104084 - DNA, 21 bp, Homo sapiens
cccagaccccgcccctgggga

SEQ ID NO: 1104085 - DNA, 18 bp, Homo sapiens
cccagacccctctggcca

SEQ ID NO: 1104086 - DNA, 20 bp, Homo sapiens
cccagacctgcgaaggatga

SEQ ID NO: 1104087 - DNA, 22 bp, Homo sapiens
cccagactaaaggatccagaga

SEQ ID NO: 1104088 - DNA, 14 bp, Homo sapiens
cccagactcagctc

SEQ ID NO: 1104089 - DNA, 19 bp, Homo sapiens
cccagactctttttttgag

SEQ ID NO: 1104090 - DNA, 17 bp, Homo sapiens
cccagactgagctctcc

SEQ ID NO: 1104091 - DNA, 19 bp, Homo sapiens
cccagactgagctctccag

SEQ ID NO: 1104092 - DNA, 22 bp, Homo sapiens
cccagactgtagagatttttat

SEQ ID NO: 1104093 - DNA, 21 bp, Homo sapiens
cccagagaacaatcactattc

SEQ ID NO: 1104094 - DNA, 13 bp, Homo sapiens
cccagagaacagc

SEQ ID NO: 1104095 - DNA, 17 bp, Homo sapiens
cccagagaacagcgaag

SEQ ID NO: 1104096 - DNA, 22 bp, Homo sapiens
cccagagaagctggaagcctgc

SEQ ID NO: 1104097 - DNA, 16 bp, Homo sapiens
cccagagacaggaaaa

SEQ ID NO: 1104098 - DNA, 17 bp, Homo sapiens
cccagagacaggaaaat

SEQ ID NO: 1104099 - DNA, 20 bp, Homo sapiens
cccagagaccaggctgtgtc

SEQ ID NO: 1104100 - DNA, 17 bp, Homo sapiens
cccagagaccccttcct

SEQ ID NO: 1104101 - DNA, 21 bp, Homo sapiens
cccagagaccccttcctttcc

SEQ ID NO: 1104102 - DNA, 11 bp, Homo sapiens
cccagagactt

SEQ ID NO: 1104103 - DNA, 19 bp, Homo sapiens
cccagagactttgtagatc

SEQ ID NO: 1104104 - DNA, 21 bp, Homo sapiens
cccagagactttgtagatcct

SEQ ID NO: 1104105 - DNA, 15 bp, Homo sapiens
cccagagagaccctg

SEQ ID NO: 1104106 - DNA, 12 bp, Homo sapiens
cccagagagcag

SEQ ID NO: 1104107 - DNA, 15 bp, Homo sapiens
cccagagagcaggca

SEQ ID NO: 1104108 - DNA, 17 bp, Homo sapiens
cccagagagcaggcagg

SEQ ID NO: 1104109 - DNA, 17 bp, Homo sapiens
cccagagaggcactcag

SEQ ID NO: 1104110 - DNA, 14 bp, Homo sapiens
cccagagatgcctc

SEQ ID NO: 1104111 - DNA, 19 bp, Homo sapiens
cccagagatgcctccaccg

SEQ ID NO: 1104112 - DNA, 13 bp, Homo sapiens
cccagagcacagg

SEQ ID NO: 1104113 - DNA, 18 bp, Homo sapiens
cccagagcaccccctgct

SEQ ID NO: 1104114 - DNA, 12 bp, Homo sapiens
cccagagcactg

SEQ ID NO: 1104115 - DNA, 23 bp, Homo sapiens
cccagagcaggaggcccctggcc

SEQ ID NO: 1104116 - DNA, 21 bp, Homo sapiens
cccagagcattacgtgagcca

SEQ ID NO: 1104117 - DNA, 14 bp, Homo sapiens
cccagagccacctg

SEQ ID NO: 1104118 - DNA, 16 bp, Homo sapiens
cccagagccagggctg

SEQ ID NO: 1104119 - DNA, 19 bp, Homo sapiens
cccagagccagggctgtcc

SEQ ID NO: 1104120 - DNA, 20 bp, Homo sapiens
cccagagccagggctgtcct

SEQ ID NO: 1104121 - DNA, 12 bp, Homo sapiens
cccagagcccag

SEQ ID NO: 1104122 - DNA, 21 bp, Homo sapiens
cccagagcccagctcttgctc

SEQ ID NO: 1104123 - DNA, 16 bp, Homo sapiens
cccagagcccctcctc

SEQ ID NO: 1104124 - DNA, 20 bp, Homo sapiens
cccagagcccctcctccagc

SEQ ID NO: 1104125 - DNA, 13 bp, Homo sapiens
cccagagcccttg

SEQ ID NO: 1104126 - DNA, 23 bp, Homo sapiens
cccagagctcatcccccctgctg

SEQ ID NO: 1104127 - DNA, 13 bp, Homo sapiens
cccagagctggcc

SEQ ID NO: 1104128 - DNA, 14 bp, Homo sapiens
cccagagctggcct

SEQ ID NO: 1104129 - DNA, 22 bp, Homo sapiens
cccagagctggcctcccccaac

SEQ ID NO: 1104130 - DNA, 14 bp, Homo sapiens
cccagagctgtgcc

SEQ ID NO: 1104131 - DNA, 21 bp, Homo sapiens
cccagagcttattggccactg

SEQ ID NO: 1104132 - DNA, 24 bp, Homo sapiens
cccagaggaaggggccagaggctc

SEQ ID NO: 1104133 - DNA, 18 bp, Homo sapiens
cccagaggacacaggcag

SEQ ID NO: 1104134 - DNA, 13 bp, Homo sapiens
cccagaggcaggc

SEQ ID NO: 1104135 - DNA, 19 bp, Homo sapiens
cccagaggccttgtcatcc

SEQ ID NO: 1104136 - DNA, 16 bp, Homo sapiens
cccagaggctcccaat

SEQ ID NO: 1104137 - DNA, 23 bp, Homo sapiens
cccagagggcccaggcaggccac

SEQ ID NO: 1104138 - DNA, 18 bp, Homo sapiens
cccagaggtccagcccat

SEQ ID NO: 1104139 - DNA, 12 bp, Homo sapiens
cccagaggtggc

SEQ ID NO: 1104140 - DNA, 20 bp, Homo sapiens
cccagaggtggcccttgttt

SEQ ID NO: 1104141 - DNA, 17 bp, Homo sapiens
cccagaggttatctgcc

SEQ ID NO: 1104142 - DNA, 21 bp, Homo sapiens
cccagaggttatctgcctggc

SEQ ID NO: 1104143 - DNA, 16 bp, Homo sapiens
cccagagtagagccag

SEQ ID NO: 1104144 - DNA, 15 bp, Homo sapiens
cccagagtcccaggc

SEQ ID NO: 1104145 - DNA, 21 bp, Homo sapiens
cccagagtgctttaaaaaatt

SEQ ID NO: 1104146 - DNA, 15 bp, Homo sapiens
cccagagtggcccac

SEQ ID NO: 1104147 - DNA, 19 bp, Homo sapiens
cccagagtgtagggggcct

SEQ ID NO: 1104148 - DNA, 15 bp, Homo sapiens
cccagagtgtgaaac

SEQ ID NO: 1104149 - DNA, 20 bp, Homo sapiens
cccagatacgggggctgtga

SEQ ID NO: 1104150 - DNA, 21 bp, Homo sapiens
cccagatacgggggctgtgac

SEQ ID NO: 1104151 - DNA, 9 bp, Homo sapiens
cccaggcct

SEQ ID NO: 1104152 - DNA, 10 bp, Homo sapiens
cccaggcctc

SEQ ID NO: 1104153 - DNA, 14 bp, Homo sapiens
cccaggcctccagc

SEQ ID NO: 1104154 - DNA, 17 bp, Homo sapiens
cccaggcctccagcctc

SEQ ID NO: 1104155 - DNA, 13 bp, Homo sapiens
cccaggcctccta

SEQ ID NO: 1104156 - DNA, 20 bp, Homo sapiens
cccaggcctcctaggggaag

SEQ ID NO: 1104157 - DNA, 22 bp, Homo sapiens
cccaggcctcctaggggaaggg

SEQ ID NO: 1104158 - DNA, 15 bp, Homo sapiens
cccaggcctgcctgc

SEQ ID NO: 1104159 - DNA, 16 bp, Homo sapiens
cccaggcctgcctgtt

SEQ ID NO: 1104160 - DNA, 13 bp, Homo sapiens
cccaggcctgctg

SEQ ID NO: 1104161 - DNA, 19 bp, Homo sapiens
cccaggcctgctggcatca

SEQ ID NO: 1104162 - DNA, 13 bp, Homo sapiens
cccaggcctggac

SEQ ID NO: 1104163 - DNA, 16 bp, Homo sapiens
cccaggcctggcctcg

SEQ ID NO: 1104164 - DNA, 14 bp, Homo sapiens
cccaggcctggctc

SEQ ID NO: 1104165 - DNA, 20 bp, Homo sapiens
cccaggcctgggatgcagtg

SEQ ID NO: 1104166 - DNA, 22 bp, Homo sapiens
cccaggccttgctgactctctg

SEQ ID NO: 1104167 - DNA, 16 bp, Homo sapiens
cccaggccttgtccta

SEQ ID NO: 1104168 - DNA, 19 bp, Homo sapiens
cccaggcctttggagggga

SEQ ID NO: 1104169 - DNA, 18 bp, Homo sapiens
cccaggcgccccttcccc

SEQ ID NO: 1104170 - DNA, 19 bp, Homo sapiens
cccaggctagagtgcaatg

SEQ ID NO: 1104171 - DNA, 21 bp, Homo sapiens
cccaggctccgcccttagtcc

SEQ ID NO: 1104172 - DNA, 22 bp, Homo sapiens
cccaggctcgtggactgagtgg

SEQ ID NO: 1104173 - DNA, 16 bp, Homo sapiens
cccaggctgagcctca

SEQ ID NO: 1104174 - DNA, 17 bp, Homo sapiens
cccaggctgagcctcag

SEQ ID NO: 1104175 - DNA, 18 bp, Homo sapiens
cccaggctgcactgcagt

SEQ ID NO: 1104176 - DNA, 19 bp, Homo sapiens
cccaggctgcactgcagtg

SEQ ID NO: 1104177 - DNA, 20 bp, Homo sapiens
cccaggctgcactgcagtga

SEQ ID NO: 1104178 - DNA, 17 bp, Homo sapiens
cccaggctggagacccc

SEQ ID NO: 1104179 - DNA, 14 bp, Homo sapiens
cccaggctggagta

SEQ ID NO: 1104180 - DNA, 19 bp, Homo sapiens
cccaggctggagtgcagtg

SEQ ID NO: 1104181 - DNA, 19 bp, Homo sapiens
cccaggctggagtgtagtg

SEQ ID NO: 1104182 - DNA, 21 bp, Homo sapiens
cccaggctgtgcagcgcagct

SEQ ID NO: 1104183 - DNA, 23 bp, Homo sapiens
cccaggctgtgcagcgcagctgg

SEQ ID NO: 1104184 - DNA, 17 bp, Homo sapiens
cccaggcttccgcgccc

SEQ ID NO: 1104185 - DNA, 14 bp, Homo sapiens
cccagggaaggaaa

SEQ ID NO: 1104186 - DNA, 13 bp, Homo sapiens
cccagggaaggac

SEQ ID NO: 1104187 - DNA, 23 bp, Homo sapiens
cccagggaaggtggggccctgcc

SEQ ID NO: 1104188 - DNA, 16 bp, Homo sapiens
cccagggacagaggcc

SEQ ID NO: 1104189 - DNA, 20 bp, Homo sapiens
cccagggacattgcagagtg

SEQ ID NO: 1104190 - DNA, 21 bp, Homo sapiens
cccagggacattgcagagtgg

SEQ ID NO: 1104191 - DNA, 13 bp, Homo sapiens
cccagggaccagc

SEQ ID NO: 1104192 - DNA, 15 bp, Homo sapiens
cccagggaccagcac

SEQ ID NO: 1104193 - DNA, 21 bp, Homo sapiens
cccagggagaatctgagacat

SEQ ID NO: 1104194 - DNA, 14 bp, Homo sapiens
cccagggaggcagc

SEQ ID NO: 1104195 - DNA, 14 bp, Homo sapiens
cccagggagtcctt

SEQ ID NO: 1104196 - DNA, 13 bp, Homo sapiens
cccagggagtgag

SEQ ID NO: 1104197 - DNA, 9 bp, Homo sapiens
cccagggat

SEQ ID NO: 1104198 - DNA, 14 bp, Homo sapiens
cccagggcagcctg

SEQ ID NO: 1104199 - DNA, 19 bp, Homo sapiens
cccagggcatcttgctggc

SEQ ID NO: 1104200 - DNA, 15 bp, Homo sapiens
cccagggccagggcc

SEQ ID NO: 1104201 - DNA, 17 bp, Homo sapiens
cccagggccagggccct

SEQ ID NO: 1104202 - DNA, 18 bp, Homo sapiens
cccagggccagggccctg

SEQ ID NO: 1104203 - DNA, 20 bp, Homo sapiens
cccagggccagggccctgca

SEQ ID NO: 1104204 - DNA, 21 bp, Homo sapiens
cccagggccagggccctgcag

SEQ ID NO: 1104205 - DNA, 14 bp, Homo sapiens
cccagggcccctcc

SEQ ID NO: 1104206 - DNA, 17 bp, Homo sapiens
cccagggcccctccctc

SEQ ID NO: 1104207 - DNA, 19 bp, Homo sapiens
cccagggcccgggcaccca

SEQ ID NO: 1104208 - DNA, 20 bp, Homo sapiens
cccagggccctcccagccca

SEQ ID NO: 1104209 - DNA, 15 bp, Homo sapiens
cccagggccctggat

SEQ ID NO: 1104210 - DNA, 17 bp, Homo sapiens
cccagggcctcctgggg

SEQ ID NO: 1104211 - DNA, 13 bp, Homo sapiens
cccagggcctgac

SEQ ID NO: 1104212 - DNA, 15 bp, Homo sapiens
cccagggcctgactt

SEQ ID NO: 1104213 - DNA, 23 bp, Homo sapiens
cccagggcctgacttgagccact

SEQ ID NO: 1104214 - DNA, 13 bp, Homo sapiens
cccagggcctgtc

SEQ ID NO: 1104215 - DNA, 21 bp, Homo sapiens
cccagggcctgtctcccttct

SEQ ID NO: 1104216 - DNA, 10 bp, Homo sapiens
cccagggcta

SEQ ID NO: 1104217 - DNA, 21 bp, Homo sapiens
cccagggctaccctcccccag

SEQ ID NO: 1104218 - DNA, 22 bp, Homo sapiens
cccagggctagtataaacatga

SEQ ID NO: 1104219 - DNA, 18 bp, Homo sapiens
cccagggctagtgaagtg

SEQ ID NO: 1104220 - DNA, 21 bp, Homo sapiens
cccagggctagtgaagtggcc

SEQ ID NO: 1104221 - DNA, 17 bp, Homo sapiens
cccagggctctgcccca

SEQ ID NO: 1104222 - DNA, 19 bp, Homo sapiens
cccagggctctgccccagt

SEQ ID NO: 1104223 - DNA, 20 bp, Homo sapiens
cccagggctgggaggaagga

SEQ ID NO: 1104224 - DNA, 19 bp, Homo sapiens
cccaggggaaggccctgag

SEQ ID NO: 1104225 - DNA, 16 bp, Homo sapiens
cccaggggacaaggga

SEQ ID NO: 1104226 - DNA, 17 bp, Homo sapiens
cccaggggaccacacct

SEQ ID NO: 1104227 - DNA, 15 bp, Homo sapiens
cccaggggacgtggg

SEQ ID NO: 1104228 - DNA, 19 bp, Homo sapiens
cccaggggagaatgcagcc

SEQ ID NO: 1104229 - DNA, 21 bp, Homo sapiens
cccaggggagaatgcagccca

SEQ ID NO: 1104230 - DNA, 15 bp, Homo sapiens
cccaggggagagggt

SEQ ID NO: 1104231 - DNA, 15 bp, Homo sapiens
cccaggggcagcaag

SEQ ID NO: 1104232 - DNA, 18 bp, Homo sapiens
cccaggggcccacaggga

SEQ ID NO: 1104233 - DNA, 15 bp, Homo sapiens
cccaggggtcagcag

SEQ ID NO: 1104234 - DNA, 16 bp, Homo sapiens
cccaggggtcccagcc

SEQ ID NO: 1104235 - DNA, 16 bp, Homo sapiens
cccaggggtctccctg

SEQ ID NO: 1104236 - DNA, 17 bp, Homo sapiens
cccaggggtctccctgg

SEQ ID NO: 1104237 - DNA, 18 bp, Homo sapiens
cccaggggtctccctggc

SEQ ID NO: 1104238 - DNA, 23 bp, Homo sapiens
cccaggggtctccctggctccct

SEQ ID NO: 1104239 - DNA, 18 bp, Homo sapiens
cccaggggtgccccctcc

SEQ ID NO: 1104240 - DNA, 22 bp, Homo sapiens
cccaggggtgccccctcctctc

SEQ ID NO: 1104241 - DNA, 23 bp, Homo sapiens
cccaggggtgccccctcctctcc

SEQ ID NO: 1104242 - DNA, 16 bp, Homo sapiens
cccagggtcccacccc

SEQ ID NO: 1104243 - DNA, 15 bp, Homo sapiens
cccagggtcttccct

SEQ ID NO: 1104244 - DNA, 16 bp, Homo sapiens
cccagggtcttcccta

SEQ ID NO: 1104245 - DNA, 9 bp, Homo sapiens
cccagggtg

SEQ ID NO: 1104246 - DNA, 17 bp, Homo sapiens
cccagggtgcagtgtga

SEQ ID NO: 1104247 - DNA, 19 bp, Homo sapiens
cccagggtggaggaaggtg

SEQ ID NO: 1104248 - DNA, 17 bp, Homo sapiens
cccagggtggcgtccac

SEQ ID NO: 1104249 - DNA, 18 bp, Homo sapiens
cccagggtggctgccagc

SEQ ID NO: 1104250 - DNA, 19 bp, Homo sapiens
cccagggtggctgccagcc

SEQ ID NO: 1104251 - DNA, 21 bp, Homo sapiens
cccaggtaccacccttcagac

SEQ ID NO: 1104252 - DNA, 16 bp, Homo sapiens
cccaggtaccagctgc

SEQ ID NO: 1104253 - DNA, 18 bp, Homo sapiens
cccaggtcaggggctccc

SEQ ID NO: 1104254 - DNA, 19 bp, Homo sapiens
cccaggtcaggggctccct

SEQ ID NO: 1104255 - DNA, 22 bp, Homo sapiens
cccaggtcaggggctccctaca

SEQ ID NO: 1104256 - DNA, 14 bp, Homo sapiens
cccaggtccagctc

SEQ ID NO: 1104257 - DNA, 17 bp, Homo sapiens
cccaggtccccaaactt

SEQ ID NO: 1104258 - DNA, 20 bp, Homo sapiens
cccaggtcccccgactgcct

SEQ ID NO: 1104259 - DNA, 13 bp, Homo sapiens
cccaggtcctcac

SEQ ID NO: 1104260 - DNA, 20 bp, Homo sapiens
cccaggtcctctgataccca

SEQ ID NO: 1104261 - DNA, 11 bp, Homo sapiens
cccaggtcctg

SEQ ID NO: 1104262 - DNA, 18 bp, Homo sapiens
cccaggtcctgtctctgc

SEQ ID NO: 1104263 - DNA, 20 bp, Homo sapiens
cccaggtctcttcctttgct

SEQ ID NO: 1104264 - DNA, 19 bp, Homo sapiens
cccaggtcttcctgctttc

SEQ ID NO: 1104265 - DNA, 22 bp, Homo sapiens
cccaggtcttcctgctttccat

SEQ ID NO: 1104266 - DNA, 17 bp, Homo sapiens
cccaggtgcagccccag

SEQ ID NO: 1104267 - DNA, 21 bp, Homo sapiens
cccaggtgcagccccagggcc

SEQ ID NO: 1104268 - DNA, 23 bp, Homo sapiens
cccaggtggaaggcagacagcag

SEQ ID NO: 1104269 - DNA, 21 bp, Homo sapiens
cccaggtggattttgtggagg

SEQ ID NO: 1104270 - DNA, 15 bp, Homo sapiens
cccaggtggcctgga

SEQ ID NO: 1104271 - DNA, 18 bp, Homo sapiens
cccaggtggctgacccag

SEQ ID NO: 1104272 - DNA, 23 bp, Homo sapiens
cccaggtggctgacccagtccct

SEQ ID NO: 1104273 - DNA, 15 bp, Homo sapiens
ccccactccaccctg

SEQ ID NO: 1104274 - DNA, 13 bp, Homo sapiens
ccccactccagct

SEQ ID NO: 1104275 - DNA, 14 bp, Homo sapiens
ccccactcccacat

SEQ ID NO: 1104276 - DNA, 19 bp, Homo sapiens
ccccactcccttgctggcc

SEQ ID NO: 1104277 - DNA, 14 bp, Homo sapiens
ccccactctgcctg

SEQ ID NO: 1104278 - DNA, 16 bp, Homo sapiens
ccccactgcaggcccc

SEQ ID NO: 1104279 - DNA, 17 bp, Homo sapiens
ccccactgccagcagca

SEQ ID NO: 1104280 - DNA, 15 bp, Homo sapiens
ccccactgcctgccc

SEQ ID NO: 1104281 - DNA, 16 bp, Homo sapiens
ccccactgcctgccca

SEQ ID NO: 1104282 - DNA, 17 bp, Homo sapiens
ccccactgcctgcccac

SEQ ID NO: 1104283 - DNA, 12 bp, Homo sapiens
ccccactggctg

SEQ ID NO: 1104284 - DNA, 21 bp, Homo sapiens
ccccactggctgagaatctgg

SEQ ID NO: 1104285 - DNA, 15 bp, Homo sapiens
ccccactgggccagc

SEQ ID NO: 1104286 - DNA, 21 bp, Homo sapiens
ccccactgtccccctacccac

SEQ ID NO: 1104287 - DNA, 22 bp, Homo sapiens
ccccactgtccccctacccacc

SEQ ID NO: 1104288 - DNA, 16 bp, Homo sapiens
ccccacttagtgctgg

SEQ ID NO: 1104289 - DNA, 18 bp, Homo sapiens
ccccacttatgctgctgt

SEQ ID NO: 1104290 - DNA, 17 bp, Homo sapiens
ccccacttcccacttgc

SEQ ID NO: 1104291 - DNA, 14 bp, Homo sapiens
ccccacttctggca

SEQ ID NO: 1104292 - DNA, 13 bp, Homo sapiens
ccccacttgcctc

SEQ ID NO: 1104293 - DNA, 21 bp, Homo sapiens
ccccacttgcctcttccttga

SEQ ID NO: 1104294 - DNA, 19 bp, Homo sapiens
ccccagaaagctgccagag

SEQ ID NO: 1104295 - DNA, 20 bp, Homo sapiens
ccccagaaagctgccagagc

SEQ ID NO: 1104296 - DNA, 17 bp, Homo sapiens
ccccagaaatcactgtg

SEQ ID NO: 1104297 - DNA, 23 bp, Homo sapiens
ccccagaaatcactgtgaaattt

SEQ ID NO: 1104298 - DNA, 20 bp, Homo sapiens
ccccagaactggctgggccc

SEQ ID NO: 1104299 - DNA, 18 bp, Homo sapiens
ccccagaccaaccctggg

SEQ ID NO: 1104300 - DNA, 13 bp, Homo sapiens
ccccagaccccgc

SEQ ID NO: 1104301 - DNA, 14 bp, Homo sapiens
ccccagaccccgcc

SEQ ID NO: 1104302 - DNA, 20 bp, Homo sapiens
ccccagacctgcgaaggatg

SEQ ID NO: 1104303 - DNA, 17 bp, Homo sapiens
ccccagactcagctcca

SEQ ID NO: 1104304 - DNA, 17 bp, Homo sapiens
ccccagactgagctctc

SEQ ID NO: 1104305 - DNA, 19 bp, Homo sapiens
ccccagactgagctctcca

SEQ ID NO: 1104306 - DNA, 20 bp, Homo sapiens
ccccagactgggcccaggca

SEQ ID NO: 1104307 - DNA, 16 bp, Homo sapiens
ccccagagagaccctg

SEQ ID NO: 1104308 - DNA, 12 bp, Homo sapiens
ccccagagccag

SEQ ID NO: 1104309 - DNA, 13 bp, Homo sapiens
ccccagagccagg

SEQ ID NO: 1104310 - DNA, 15 bp, Homo sapiens
ccccagagccagggc

SEQ ID NO: 1104311 - DNA, 18 bp, Homo sapiens
ccccagagccagggctgt

SEQ ID NO: 1104312 - DNA, 21 bp, Homo sapiens
ccccagagccagggctgtcct

SEQ ID NO: 1104313 - DNA, 14 bp, Homo sapiens
ccccagagcccagc

SEQ ID NO: 1104314 - DNA, 18 bp, Homo sapiens
ccccagagcccagctctt

SEQ ID NO: 1104315 - DNA, 19 bp, Homo sapiens
ccccagagccccactcccg

SEQ ID NO: 1104316 - DNA, 19 bp, Homo sapiens
ccccagagcccctcctcca

SEQ ID NO: 1104317 - DNA, 21 bp, Homo sapiens
ccccagagcccctcctccagc

SEQ ID NO: 1104318 - DNA, 14 bp, Homo sapiens
ccccagagctgtgc

SEQ ID NO: 1104319 - DNA, 13 bp, Homo sapiens
ccccagaggaagt

SEQ ID NO: 1104320 - DNA, 15 bp, Homo sapiens
ccccagaggctccca

SEQ ID NO: 1104321 - DNA, 16 bp, Homo sapiens
ccccagaggctcccaa

SEQ ID NO: 1104322 - DNA, 20 bp, Homo sapiens
ccccagaggctcccaatcag

SEQ ID NO: 1104323 - DNA, 22 bp, Homo sapiens
ccccagagtgctttaaaaaatt

SEQ ID NO: 1104324 - DNA, 16 bp, Homo sapiens
ccccagagtggcccac

SEQ ID NO: 1104325 - DNA, 17 bp, Homo sapiens
ccccagatagagctggg

SEQ ID NO: 1104326 - DNA, 16 bp, Homo sapiens
ccccagatctgcctgg

SEQ ID NO: 1104327 - DNA, 19 bp, Homo sapiens
ccccagatctgcctgggcc

SEQ ID NO: 1104328 - DNA, 21 bp, Homo sapiens
ccccagatctgcctgggcctg

SEQ ID NO: 1104329 - DNA, 24 bp, Homo sapiens
ccccagatctgcctgggcctgtgc

SEQ ID NO: 1104330 - DNA, 20 bp, Homo sapiens
ccccagcaacgcccctccaa

SEQ ID NO: 1104331 - DNA, 22 bp, Homo sapiens
ccccagcaacgcccctccaaac

SEQ ID NO: 1104332 - DNA, 12 bp, Homo sapiens
ccccagcaagag

SEQ ID NO: 1104333 - DNA, 22 bp, Homo sapiens
ccccagcaagcgggagcccgtg

SEQ ID NO: 1104334 - DNA, 16 bp, Homo sapiens
ccccagcacagccacc

SEQ ID NO: 1104335 - DNA, 11 bp, Homo sapiens
ccccagcacta

SEQ ID NO: 1104336 - DNA, 19 bp, Homo sapiens
ccccagcactaaagcagtg

SEQ ID NO: 1104337 - DNA, 14 bp, Homo sapiens
ccccagcagaggca

SEQ ID NO: 1104338 - DNA, 15 bp, Homo sapiens
ccccagcagaggcag

SEQ ID NO: 1104339 - DNA, 23 bp, Homo sapiens
ccccagcagttgaatgacaacag

SEQ ID NO: 1104340 - DNA, 14 bp, Homo sapiens
ccccagcattccag

SEQ ID NO: 1104341 - DNA, 19 bp, Homo sapiens
ccccagcattccagcccct

SEQ ID NO: 1104342 - DNA, 23 bp, Homo sapiens
ccccagccagatggactccagcc

SEQ ID NO: 1104343 - DNA, 13 bp, Homo sapiens
ccccagccagccc

SEQ ID NO: 1104344 - DNA, 19 bp, Homo sapiens
ccccagccatgccagctgg

SEQ ID NO: 1104345 - DNA, 20 bp, Homo sapiens
ccccagccatgccagctggc

SEQ ID NO: 1104346 - DNA, 14 bp, Homo sapiens
ccccagcccagggc

SEQ ID NO: 1104347 - DNA, 15 bp, Homo sapiens
ccccagcccagggct

SEQ ID NO: 1104348 - DNA, 21 bp, Homo sapiens
ccccagcccagggctcctgca

SEQ ID NO: 1104349 - DNA, 15 bp, Homo sapiens
ccccagcccccaggg

SEQ ID NO: 1104350 - DNA, 17 bp, Homo sapiens
ccccagccccgactcca

SEQ ID NO: 1104351 - DNA, 22 bp, Homo sapiens
ccccagccccttctcccagcac

SEQ ID NO: 1104352 - DNA, 16 bp, Homo sapiens
ccccagccctcagtca

SEQ ID NO: 1104353 - DNA, 13 bp, Homo sapiens
ccccagccctgct

SEQ ID NO: 1104354 - DNA, 13 bp, Homo sapiens
ccccagccctggg

SEQ ID NO: 1104355 - DNA, 16 bp, Homo sapiens
ccccagccctgggctt

SEQ ID NO: 1104356 - DNA, 12 bp, Homo sapiens
ccccagccctgt

SEQ ID NO: 1104357 - DNA, 15 bp, Homo sapiens
ccccagccctgtgga

SEQ ID NO: 1104358 - DNA, 14 bp, Homo sapiens
ccccagcccttctg

SEQ ID NO: 1104359 - DNA, 16 bp, Homo sapiens
ccccagcccttctgcc

SEQ ID NO: 1104360 - DNA, 16 bp, Homo sapiens
ccccagcctacccttc

SEQ ID NO: 1104361 - DNA, 11 bp, Homo sapiens
ccccagcctca

SEQ ID NO: 1104362 - DNA, 12 bp, Homo sapiens
ccccagcctcag

SEQ ID NO: 1104363 - DNA, 16 bp, Homo sapiens
ccccagcctcagccca

SEQ ID NO: 1104364 - DNA, 13 bp, Homo sapiens
ccccagcctcatt

SEQ ID NO: 1104365 - DNA, 17 bp, Homo sapiens
ccccagcctcctgaggg

SEQ ID NO: 1104366 - DNA, 13 bp, Homo sapiens
ccccagcctgggc

SEQ ID NO: 1104367 - DNA, 21 bp, Homo sapiens
ccccagcctgggcccatctcc

SEQ ID NO: 1104368 - DNA, 23 bp, Homo sapiens
ccccagcgtcccagtctctggca

SEQ ID NO: 1104369 - DNA, 17 bp, Homo sapiens
ccccagcgtctgcaggg

SEQ ID NO: 1104370 - DNA, 20 bp, Homo sapiens
ccccagcgtctgcagggtga

SEQ ID NO: 1104371 - DNA, 15 bp, Homo sapiens
ccccagcgtcttgac

SEQ ID NO: 1104372 - DNA, 11 bp, Homo sapiens
ccccagctacc

SEQ ID NO: 1104373 - DNA, 22 bp, Homo sapiens
ccccagctaccctttttctcca

SEQ ID NO: 1104374 - DNA, 17 bp, Homo sapiens
ccccagctccctgcacc

SEQ ID NO: 1104375 - DNA, 21 bp, Homo sapiens
ccccagctccgacctctctca

SEQ ID NO: 1104376 - DNA, 19 bp, Homo sapiens
ccccagctccggagggggt

SEQ ID NO: 1104377 - DNA, 21 bp, Homo sapiens
ccccagctccttggctgcagc

SEQ ID NO: 1104378 - DNA, 12 bp, Homo sapiens
ccccagctctgg

SEQ ID NO: 1104379 - DNA, 18 bp, Homo sapiens
ccccagctgactgtggcc

SEQ ID NO: 1104380 - DNA, 22 bp, Homo sapiens
ccccagctgactgttggctctc

SEQ ID NO: 1104381 - DNA, 16 bp, Homo sapiens
ccccagctgcgttttt

SEQ ID NO: 1104382 - DNA, 10 bp, Homo sapiens
ccccagctgg

SEQ ID NO: 1104383 - DNA, 12 bp, Homo sapiens
ccccagctggcc

SEQ ID NO: 1104384 - DNA, 13 bp, Homo sapiens
ccccagctggccc

SEQ ID NO: 1104385 - DNA, 21 bp, Homo sapiens
ccccagctggcccgtgacaga

SEQ ID NO: 1104386 - DNA, 11 bp, Homo sapiens
ccccagctggg

SEQ ID NO: 1104387 - DNA, 19 bp, Homo sapiens
ccccaggaaactagctttt

SEQ ID NO: 1104388 - DNA, 15 bp, Homo sapiens
ccccaggacctggct

SEQ ID NO: 1104389 - DNA, 20 bp, Homo sapiens
ccccaggacctggctgccat

SEQ ID NO: 1104390 - DNA, 14 bp, Homo sapiens
ccccaggactctgg

SEQ ID NO: 1104391 - DNA, 16 bp, Homo sapiens
ccccaggactctggca

SEQ ID NO: 1104392 - DNA, 19 bp, Homo sapiens
ccccaggagggaggcaggg

SEQ ID NO: 1104393 - DNA, 17 bp, Homo sapiens
ccccaggcagccaccag

SEQ ID NO: 1104394 - DNA, 21 bp, Homo sapiens
ccccaggcagccaccagtgga

SEQ ID NO: 1104395 - DNA, 14 bp, Homo sapiens
ccccaggcaggctg

SEQ ID NO: 1104396 - DNA, 20 bp, Homo sapiens
ccccctcttcaaagcagagt

SEQ ID NO: 1104397 - DNA, 23 bp, Homo sapiens
ccccctgagtcaactggagcaag

SEQ ID NO: 1104398 - DNA, 12 bp, Homo sapiens
ccccctgcatct

SEQ ID NO: 1104399 - DNA, 14 bp, Homo sapiens
ccccctgccagtgc

SEQ ID NO: 1104400 - DNA, 20 bp, Homo sapiens
ccccctgccctcgtggccag

SEQ ID NO: 1104401 - DNA, 13 bp, Homo sapiens
ccccctgccctgc

SEQ ID NO: 1104402 - DNA, 23 bp, Homo sapiens
ccccctggatgggcattgggctg

SEQ ID NO: 1104403 - DNA, 16 bp, Homo sapiens
ccccctggcagctgcc

SEQ ID NO: 1104404 - DNA, 18 bp, Homo sapiens
ccccctggcagctgcccc

SEQ ID NO: 1104405 - DNA, 19 bp, Homo sapiens
ccccctggcagctgcccct

SEQ ID NO: 1104406 - DNA, 19 bp, Homo sapiens
ccccctggcctctgtgcct

SEQ ID NO: 1104407 - DNA, 22 bp, Homo sapiens
ccccctggcctctgtgccttct

SEQ ID NO: 1104408 - DNA, 22 bp, Homo sapiens
ccccctgggcagatgtccccca

SEQ ID NO: 1104409 - DNA, 11 bp, Homo sapiens
ccccctgggct

SEQ ID NO: 1104410 - DNA, 18 bp, Homo sapiens
ccccctgggctggggcct

SEQ ID NO: 1104411 - DNA, 23 bp, Homo sapiens
ccccctggggtgggatctgagct

SEQ ID NO: 1104412 - DNA, 19 bp, Homo sapiens
ccccctggtggacagtcct

SEQ ID NO: 1104413 - DNA, 21 bp, Homo sapiens
ccccctggtggacagtcctgg

SEQ ID NO: 1104414 - DNA, 18 bp, Homo sapiens
ccccctgtacacaactca

SEQ ID NO: 1104415 - DNA, 12 bp, Homo sapiens
ccccctgtgcag

SEQ ID NO: 1104416 - DNA, 11 bp, Homo sapiens
ccccctgtggc

SEQ ID NO: 1104417 - DNA, 15 bp, Homo sapiens
cccccttaaagaaaa

SEQ ID NO: 1104418 - DNA, 14 bp, Homo sapiens
cccccttcagctcc

SEQ ID NO: 1104419 - DNA, 15 bp, Homo sapiens
cccccttcagctcct

SEQ ID NO: 1104420 - DNA, 17 bp, Homo sapiens
cccccttcagctcctga

SEQ ID NO: 1104421 - DNA, 23 bp, Homo sapiens
cccccttcagtgcccaccaacat

SEQ ID NO: 1104422 - DNA, 11 bp, Homo sapiens
cccccttccac

SEQ ID NO: 1104423 - DNA, 16 bp, Homo sapiens
cccccttccccttctg

SEQ ID NO: 1104424 - DNA, 17 bp, Homo sapiens
cccccttcccgccttcc

SEQ ID NO: 1104425 - DNA, 15 bp, Homo sapiens
cccccttctctgctc

SEQ ID NO: 1104426 - DNA, 22 bp, Homo sapiens
cccccttctctgctccaccaca

SEQ ID NO: 1104427 - DNA, 14 bp, Homo sapiens
cccccttcttcctc

SEQ ID NO: 1104428 - DNA, 23 bp, Homo sapiens
cccccttgaatctgcagggagca

SEQ ID NO: 1104429 - DNA, 14 bp, Homo sapiens
cccccttgagtggg

SEQ ID NO: 1104430 - DNA, 22 bp, Homo sapiens
cccccttgccctccgcctggga

SEQ ID NO: 1104431 - DNA, 17 bp, Homo sapiens
ccccctttcagatgtct

SEQ ID NO: 1104432 - DNA, 22 bp, Homo sapiens
ccccctttcagatgtcttctgc

SEQ ID NO: 1104433 - DNA, 12 bp, Homo sapiens
ccccctttcctg

SEQ ID NO: 1104434 - DNA, 12 bp, Homo sapiens
ccccgacactgc

SEQ ID NO: 1104435 - DNA, 15 bp, Homo sapiens
ccccgacggcctcca

SEQ ID NO: 1104436 - DNA, 19 bp, Homo sapiens
ccccgacggcctccaggag

SEQ ID NO: 1104437 - DNA, 13 bp, Homo sapiens
ccccgactccagc

SEQ ID NO: 1104438 - DNA, 15 bp, Homo sapiens
ccccgactccagcca

SEQ ID NO: 1104439 - DNA, 16 bp, Homo sapiens
ccccgactccagccag

SEQ ID NO: 1104440 - DNA, 18 bp, Homo sapiens
ccccgactccagccagcg

SEQ ID NO: 1104441 - DNA, 16 bp, Homo sapiens
ccccgacttcctgact

SEQ ID NO: 1104442 - DNA, 12 bp, Homo sapiens
ccccgagccctg

SEQ ID NO: 1104443 - DNA, 19 bp, Homo sapiens
ccccgagccctgactcctg

SEQ ID NO: 1104444 - DNA, 17 bp, Homo sapiens
ccccgagggcgaaggcc

SEQ ID NO: 1104445 - DNA, 24 bp, Homo sapiens
ccccgagggcgaaggccattgggt

SEQ ID NO: 1104446 - DNA, 13 bp, Homo sapiens
ccccgagggctga

SEQ ID NO: 1104447 - DNA, 21 bp, Homo sapiens
ccccgagggctgagcctggtc

SEQ ID NO: 1104448 - DNA, 18 bp, Homo sapiens
ccccgagggctgaggagc

SEQ ID NO: 1104449 - DNA, 12 bp, Homo sapiens
ccccgagtcctc

SEQ ID NO: 1104450 - DNA, 22 bp, Homo sapiens
ccccgatccccgacagtggctc

SEQ ID NO: 1104451 - DNA, 13 bp, Homo sapiens
ccccgatgtcccc

SEQ ID NO: 1104452 - DNA, 13 bp, Homo sapiens
ccccgcacagcca

SEQ ID NO: 1104453 - DNA, 16 bp, Homo sapiens
ccccgcacccccgcca

SEQ ID NO: 1104454 - DNA, 13 bp, Homo sapiens
ccccgcactgcag

SEQ ID NO: 1104455 - DNA, 15 bp, Homo sapiens
ccccgcactgcagac

SEQ ID NO: 1104456 - DNA, 22 bp, Homo sapiens
ccccgcagacggtctgtgtgct

SEQ ID NO: 1104457 - DNA, 23 bp, Homo sapiens
ccccgcagacggtctgtgtgctg

SEQ ID NO: 1104458 - DNA, 18 bp, Homo sapiens
ccccgcagcccgcctgcc

SEQ ID NO: 1104459 - DNA, 14 bp, Homo sapiens
ccccgcagcccgtg

SEQ ID NO: 1104460 - DNA, 15 bp, Homo sapiens
ccccgcagtccccag

SEQ ID NO: 1104461 - DNA, 17 bp, Homo sapiens
ccccgcccagctgcacc

SEQ ID NO: 1104462 - DNA, 23 bp, Homo sapiens
ccccgcccagctgcacctgccag

SEQ ID NO: 1104463 - DNA, 15 bp, Homo sapiens
ccccgccccacaggg

SEQ ID NO: 1104464 - DNA, 20 bp, Homo sapiens
ccccgccccacattccgaca

SEQ ID NO: 1104465 - DNA, 14 bp, Homo sapiens
ccccgccccaggct

SEQ ID NO: 1104466 - DNA, 18 bp, Homo sapiens
ccccgccccccagagcca

SEQ ID NO: 1104467 - DNA, 13 bp, Homo sapiens
ccccgccccctgc

SEQ ID NO: 1104468 - DNA, 17 bp, Homo sapiens
ccccgccccctgccctc

SEQ ID NO: 1104469 - DNA, 18 bp, Homo sapiens
ccccgccccctgccctcc

SEQ ID NO: 1104470 - DNA, 15 bp, Homo sapiens
ccccgccccgcgcgc

SEQ ID NO: 1104471 - DNA, 14 bp, Homo sapiens
ccccgcctccactc

SEQ ID NO: 1104472 - DNA, 12 bp, Homo sapiens
ccccgcctgagt

SEQ ID NO: 1104473 - DNA, 13 bp, Homo sapiens
ccccgcctgagtc

SEQ ID NO: 1104474 - DNA, 13 bp, Homo sapiens
ccccgcctggcca

SEQ ID NO: 1104475 - DNA, 17 bp, Homo sapiens
ccccgcctggccaggag

SEQ ID NO: 1104476 - DNA, 19 bp, Homo sapiens
ccccgccttccctcactct

SEQ ID NO: 1104477 - DNA, 22 bp, Homo sapiens
ccccgccttcgtgtgctgctgc

SEQ ID NO: 1104478 - DNA, 22 bp, Homo sapiens
ccccgcgaccatgtggccacaa

SEQ ID NO: 1104479 - DNA, 13 bp, Homo sapiens
ccccgcgccctcc

SEQ ID NO: 1104480 - DNA, 20 bp, Homo sapiens
ccccgcgggctttgttgctg

SEQ ID NO: 1104481 - DNA, 17 bp, Homo sapiens
ccccgcgggttctagac

SEQ ID NO: 1104482 - DNA, 16 bp, Homo sapiens
ccccgcggtgctctgg

SEQ ID NO: 1104483 - DNA, 13 bp, Homo sapiens
ccccgctggagga

SEQ ID NO: 1104484 - DNA, 22 bp, Homo sapiens
ccccgctggaggatgtgggcag

SEQ ID NO: 1104485 - DNA, 20 bp, Homo sapiens
ccccgcttagccccgctgag

SEQ ID NO: 1104486 - DNA, 14 bp, Homo sapiens
ccccgcttctgcct

SEQ ID NO: 1104487 - DNA, 19 bp, Homo sapiens
ccccgcttgtccagcgcct

SEQ ID NO: 1104488 - DNA, 14 bp, Homo sapiens
ccccggacctacct

SEQ ID NO: 1104489 - DNA, 19 bp, Homo sapiens
ccccggaggaagcttgggg

SEQ ID NO: 1104490 - DNA, 18 bp, Homo sapiens
ccccggccccagccagag

SEQ ID NO: 1104491 - DNA, 19 bp, Homo sapiens
ccccggccccagccagagt

SEQ ID NO: 1104492 - DNA, 16 bp, Homo sapiens
ccccggcggtgccgcg

SEQ ID NO: 1104493 - DNA, 19 bp, Homo sapiens
ccccggcggtgccgcgctc

SEQ ID NO: 1104494 - DNA, 17 bp, Homo sapiens
ccccgggatattataga

SEQ ID NO: 1104495 - DNA, 23 bp, Homo sapiens
ccccgggatcctgcccccaagtc

SEQ ID NO: 1104496 - DNA, 20 bp, Homo sapiens
ccccgggcccgggcccccgc

SEQ ID NO: 1104497 - DNA, 13 bp, Homo sapiens
ccccgggcctgca

SEQ ID NO: 1104498 - DNA, 20 bp, Homo sapiens
ccccgggctctggccaccct

SEQ ID NO: 1104499 - DNA, 23 bp, Homo sapiens
ccccgggctggccctgtgcagac

SEQ ID NO: 1104500 - DNA, 16 bp, Homo sapiens
ccccggggaccctgtg

SEQ ID NO: 1104501 - DNA, 23 bp, Homo sapiens
ccccggggcatggacagggccag

SEQ ID NO: 1104502 - DNA, 14 bp, Homo sapiens
ccccggggctggca

SEQ ID NO: 1104503 - DNA, 23 bp, Homo sapiens
ccccgggtttggcgggccaagga

SEQ ID NO: 1104504 - DNA, 15 bp, Homo sapiens
ccccggtcccttgag

SEQ ID NO: 1104505 - DNA, 18 bp, Homo sapiens
ccccggttgctggtcagg

SEQ ID NO: 1104506 - DNA, 16 bp, Homo sapiens
ccccgtccccctctgg

SEQ ID NO: 1104507 - DNA, 16 bp, Homo sapiens
ccccgtcccctaaccc

SEQ ID NO: 1104508 - DNA, 15 bp, Homo sapiens
ccccgtcccctgcag

SEQ ID NO: 1104509 - DNA, 22 bp, Homo sapiens
ccccgtcccctgcagcctgggt

SEQ ID NO: 1104510 - DNA, 15 bp, Homo sapiens
ccccgtcggactgcc

SEQ ID NO: 1104511 - DNA, 17 bp, Homo sapiens
ccccgtcggactgcccc

SEQ ID NO: 1104512 - DNA, 14 bp, Homo sapiens
ccccgtctctacta

SEQ ID NO: 1104513 - DNA, 17 bp, Homo sapiens
ccccgtcttgtaaaaag

SEQ ID NO: 1104514 - DNA, 13 bp, Homo sapiens
ccccgtggctctg

SEQ ID NO: 1104515 - DNA, 15 bp, Homo sapiens
ccccgtgttcaggac

SEQ ID NO: 1104516 - DNA, 23 bp, Homo sapiens
ccccgtttcagtggaccctgtgg

SEQ ID NO: 1104517 - DNA, 13 bp, Homo sapiens
ccccgtttccctg

SEQ ID NO: 1104518 - DNA, 13 bp, Homo sapiens
cccgagtacctcc

SEQ ID NO: 1104519 - DNA, 15 bp, Homo sapiens
cccgagtacctccag

SEQ ID NO: 1104520 - DNA, 15 bp, Homo sapiens
cccgagtagctggga

SEQ ID NO: 1104521 - DNA, 21 bp, Homo sapiens
cccgagtcattcgttctgtgg

SEQ ID NO: 1104522 - DNA, 23 bp, Homo sapiens
cccgagtcattcgttctgtggag

SEQ ID NO: 1104523 - DNA, 19 bp, Homo sapiens
cccgagtcctcaggtacag

SEQ ID NO: 1104524 - DNA, 18 bp, Homo sapiens
cccgagtctgggacacaa

SEQ ID NO: 1104525 - DNA, 20 bp, Homo sapiens
cccgatatattttagcattt

SEQ ID NO: 1104526 - DNA, 16 bp, Homo sapiens
cccgatattctccctg

SEQ ID NO: 1104527 - DNA, 15 bp, Homo sapiens
cccgatgctgctttc

SEQ ID NO: 1104528 - DNA, 21 bp, Homo sapiens
cccgatggtctctctccctct

SEQ ID NO: 1104529 - DNA, 15 bp, Homo sapiens
cccgcaaggcctctc

SEQ ID NO: 1104530 - DNA, 22 bp, Homo sapiens
cccgcaaggcctctcagaccca

SEQ ID NO: 1104531 - DNA, 13 bp, Homo sapiens
cccgcacccccac

SEQ ID NO: 1104532 - DNA, 16 bp, Homo sapiens
cccgcacccccaccct

SEQ ID NO: 1104533 - DNA, 19 bp, Homo sapiens
cccgcaccccccaagctgt

SEQ ID NO: 1104534 - DNA, 13 bp, Homo sapiens
cccgcacccccgc

SEQ ID NO: 1104535 - DNA, 15 bp, Homo sapiens
cccgcacccccgcca

SEQ ID NO: 1104536 - DNA, 17 bp, Homo sapiens
cccgcacccccgccagg

SEQ ID NO: 1104537 - DNA, 18 bp, Homo sapiens
cccgcacccccgccaggc

SEQ ID NO: 1104538 - DNA, 13 bp, Homo sapiens
cccgcaccttcct

SEQ ID NO: 1104539 - DNA, 18 bp, Homo sapiens
cccgcaccttcctcctcc

SEQ ID NO: 1104540 - DNA, 12 bp, Homo sapiens
cccgcactctgc

SEQ ID NO: 1104541 - DNA, 15 bp, Homo sapiens
cccgcactctgcccc

SEQ ID NO: 1104542 - DNA, 12 bp, Homo sapiens
cccgcactgcag

SEQ ID NO: 1104543 - DNA, 15 bp, Homo sapiens
cccgcagacaccttg

SEQ ID NO: 1104544 - DNA, 22 bp, Homo sapiens
cccgcagcctggcatctgtgcg

SEQ ID NO: 1104545 - DNA, 22 bp, Homo sapiens
cccgcaggaactgggctgggcc

SEQ ID NO: 1104546 - DNA, 16 bp, Homo sapiens
cccgcagggccatgca

SEQ ID NO: 1104547 - DNA, 19 bp, Homo sapiens
cccgcagtgtgcactaagg

SEQ ID NO: 1104548 - DNA, 13 bp, Homo sapiens
cccgccaggcgca

SEQ ID NO: 1104549 - DNA, 13 bp, Homo sapiens
cccgccagggctg

SEQ ID NO: 1104550 - DNA, 13 bp, Homo sapiens
cccgcccagctgc

SEQ ID NO: 1104551 - DNA, 17 bp, Homo sapiens
cccgccccacctcccat

SEQ ID NO: 1104552 - DNA, 18 bp, Homo sapiens
cccgccccagagtggccc

SEQ ID NO: 1104553 - DNA, 14 bp, Homo sapiens
cccgccccagccct

SEQ ID NO: 1104554 - DNA, 19 bp, Homo sapiens
cccgccccagccctcagtc

SEQ ID NO: 1104555 - DNA, 14 bp, Homo sapiens
cccgccccccagag

SEQ ID NO: 1104556 - DNA, 22 bp, Homo sapiens
cccgccccccagagccagggct

SEQ ID NO: 1104557 - DNA, 17 bp, Homo sapiens
cccgccccctccctata

SEQ ID NO: 1104558 - DNA, 19 bp, Homo sapiens
cccgccccgggctggccct

SEQ ID NO: 1104559 - DNA, 21 bp, Homo sapiens
cccgccccgggctggccctgt

SEQ ID NO: 1104560 - DNA, 11 bp, Homo sapiens
cccgcccctcg

SEQ ID NO: 1104561 - DNA, 14 bp, Homo sapiens
cccgcccctcgctg

SEQ ID NO: 1104562 - DNA, 14 bp, Homo sapiens
cccgcccctgggga

SEQ ID NO: 1104563 - DNA, 21 bp, Homo sapiens
cccgcccgagggatggtgccc

SEQ ID NO: 1104564 - DNA, 12 bp, Homo sapiens
cccgccgcccgc

SEQ ID NO: 1104565 - DNA, 18 bp, Homo sapiens
cccgccgcctggtactca

SEQ ID NO: 1104566 - DNA, 20 bp, Homo sapiens
cccgccgtctgcaggggcct

SEQ ID NO: 1104567 - DNA, 21 bp, Homo sapiens
cccgccgtctgcaggggcctg

SEQ ID NO: 1104568 - DNA, 13 bp, Homo sapiens
cccgcctccactc

SEQ ID NO: 1104569 - DNA, 15 bp, Homo sapiens
cccgcctccctctca

SEQ ID NO: 1104570 - DNA, 12 bp, Homo sapiens
cccgcctgagtc

SEQ ID NO: 1104571 - DNA, 14 bp, Homo sapiens
cccgcctgccctca

SEQ ID NO: 1104572 - DNA, 14 bp, Homo sapiens
cccgcctgctccca

SEQ ID NO: 1104573 - DNA, 12 bp, Homo sapiens
cccgcctggcca

SEQ ID NO: 1104574 - DNA, 14 bp, Homo sapiens
cccgcctggccagg

SEQ ID NO: 1104575 - DNA, 13 bp, Homo sapiens
cccgcctgtcaca

SEQ ID NO: 1104576 - DNA, 20 bp, Homo sapiens
cccgccttccaaaacctgct

SEQ ID NO: 1104577 - DNA, 22 bp, Homo sapiens
cccgccttccaaaacctgcttc

SEQ ID NO: 1104578 - DNA, 14 bp, Homo sapiens
cccgccttccctca

SEQ ID NO: 1104579 - DNA, 11 bp, Homo sapiens
cccgccttcct

SEQ ID NO: 1104580 - DNA, 14 bp, Homo sapiens
cccgccttcctggg

SEQ ID NO: 1104581 - DNA, 18 bp, Homo sapiens
cccgccttcgtgtgctgc

SEQ ID NO: 1104582 - DNA, 19 bp, Homo sapiens
cccgcgcgcgtccccctgc

SEQ ID NO: 1104583 - DNA, 21 bp, Homo sapiens
cccgcgcttcgaactccaggc

SEQ ID NO: 1104584 - DNA, 16 bp, Homo sapiens
cccgcggcctgcaccg

SEQ ID NO: 1104585 - DNA, 17 bp, Homo sapiens
cccgcgggcacagccag

SEQ ID NO: 1104586 - DNA, 21 bp, Homo sapiens
cccgcggggacattgggaagg

SEQ ID NO: 1104587 - DNA, 15 bp, Homo sapiens
cccgcggtgctctgg

SEQ ID NO: 1104588 - DNA, 14 bp, Homo sapiens
cccgcgtccaaccc

SEQ ID NO: 1104589 - DNA, 15 bp, Homo sapiens
cccgcgtccaacccc

SEQ ID NO: 1104590 - DNA, 12 bp, Homo sapiens
cccgcgttcaag

SEQ ID NO: 1104591 - DNA, 19 bp, Homo sapiens
cccgctcccacagcttcct

SEQ ID NO: 1104592 - DNA, 14 bp, Homo sapiens
cccgctcccaggtt

SEQ ID NO: 1104593 - DNA, 19 bp, Homo sapiens
cccgctccgtctctgtcct

SEQ ID NO: 1104594 - DNA, 21 bp, Homo sapiens
cccgctctacatcttctgcct

SEQ ID NO: 1104595 - DNA, 18 bp, Homo sapiens
cccgctgagctgagtggc

SEQ ID NO: 1104596 - DNA, 21 bp, Homo sapiens
cccgctgagcttggaggaagt

SEQ ID NO: 1104597 - DNA, 13 bp, Homo sapiens
cccgctgcccctc

SEQ ID NO: 1104598 - DNA, 14 bp, Homo sapiens
cccgctgcccctcc

SEQ ID NO: 1104599 - DNA, 23 bp, Homo sapiens
cccgctgccctttggccaacagg

SEQ ID NO: 1104600 - DNA, 13 bp, Homo sapiens
cccgctgcctcct

SEQ ID NO: 1104601 - DNA, 15 bp, Homo sapiens
cccgctgcctcctgc

SEQ ID NO: 1104602 - DNA, 13 bp, Homo sapiens
cccgctgcctctt

SEQ ID NO: 1104603 - DNA, 15 bp, Homo sapiens
cccgctgctgctgct

SEQ ID NO: 1104604 - DNA, 16 bp, Homo sapiens
cccgctgctgctgctg

SEQ ID NO: 1104605 - DNA, 15 bp, Homo sapiens
cccgctgctgtgctc

SEQ ID NO: 1104606 - DNA, 23 bp, Homo sapiens
cccgctgctgtgctctggggatt

SEQ ID NO: 1104607 - DNA, 17 bp, Homo sapiens
cccgctggagcccacag

SEQ ID NO: 1104608 - DNA, 19 bp, Homo sapiens
cccgctggagcccacagcg

SEQ ID NO: 1104609 - DNA, 21 bp, Homo sapiens
cccgctggaggatgtgggcag

SEQ ID NO: 1104610 - DNA, 17 bp, Homo sapiens
cccgctgtgtcctccct

SEQ ID NO: 1104611 - DNA, 19 bp, Homo sapiens
cccgctgtgtcctccctcc

SEQ ID NO: 1104612 - DNA, 15 bp, Homo sapiens
cccgcttagcctgcc

SEQ ID NO: 1104613 - DNA, 14 bp, Homo sapiens
cccgcttagttctt

SEQ ID NO: 1104614 - DNA, 15 bp, Homo sapiens
cccgcttagttcttg

SEQ ID NO: 1104615 - DNA, 23 bp, Homo sapiens
cccgcttagttcttgaattgtta

SEQ ID NO: 1104616 - DNA, 17 bp, Homo sapiens
cccgcttattctcctcc

SEQ ID NO: 1104617 - DNA, 15 bp, Homo sapiens
cccgcttgtccagcg

SEQ ID NO: 1104618 - DNA, 17 bp, Homo sapiens
cccgcttttgcagcaga

SEQ ID NO: 1104619 - DNA, 18 bp, Homo sapiens
cccgcttttgcagcagag

SEQ ID NO: 1104620 - DNA, 16 bp, Homo sapiens
cccggaagggctttgg

SEQ ID NO: 1104621 - DNA, 19 bp, Homo sapiens
cccggaagggctttggttc

SEQ ID NO: 1104622 - DNA, 19 bp, Homo sapiens
cccggaattccgtcaccac

SEQ ID NO: 1104623 - DNA, 23 bp, Homo sapiens
cccggacctacctccctccctct

SEQ ID NO: 1104624 - DNA, 17 bp, Homo sapiens
cccggagcacagccctg

SEQ ID NO: 1104625 - DNA, 21 bp, Homo sapiens
cccggagcacagccctgggag

SEQ ID NO: 1104626 - DNA, 22 bp, Homo sapiens
cccggagcacagccctgggagg

SEQ ID NO: 1104627 - DNA, 14 bp, Homo sapiens
cccggagcagcagg

SEQ ID NO: 1104628 - DNA, 21 bp, Homo sapiens
cccggagctaacactggcccc

SEQ ID NO: 1104629 - DNA, 15 bp, Homo sapiens
cccggaggaaatctg

SEQ ID NO: 1104630 - DNA, 18 bp, Homo sapiens
cccggaggcgtggaggag

SEQ ID NO: 1104631 - DNA, 20 bp, Homo sapiens
cccggaggcgtggaggagag

SEQ ID NO: 1104632 - DNA, 17 bp, Homo sapiens
cccggaggggcctggca

SEQ ID NO: 1104633 - DNA, 19 bp, Homo sapiens
cccggagtaatcaggcagc

SEQ ID NO: 1104634 - DNA, 20 bp, Homo sapiens
cccggatcagagcaggacct

SEQ ID NO: 1104635 - DNA, 21 bp, Homo sapiens
cccggatcagagcaggacctc

SEQ ID NO: 1104636 - DNA, 22 bp, Homo sapiens
cccggcacagatgctccaggga

SEQ ID NO: 1104637 - DNA, 20 bp, Homo sapiens
cccggcactgcagtctgcag

SEQ ID NO: 1104638 - DNA, 12 bp, Homo sapiens
cccggcagggcg

SEQ ID NO: 1104639 - DNA, 16 bp, Homo sapiens
cccggccacacccagc

SEQ ID NO: 1104640 - DNA, 17 bp, Homo sapiens
cccggccacacccagcg

SEQ ID NO: 1104641 - DNA, 15 bp, Homo sapiens
ccctcctgcacacag

SEQ ID NO: 1104642 - DNA, 16 bp, Homo sapiens
ccctcctgcacacagg

SEQ ID NO: 1104643 - DNA, 21 bp, Homo sapiens
ccctcctgcccaggactgcat

SEQ ID NO: 1104644 - DNA, 18 bp, Homo sapiens
ccctcctgctcctccctg

SEQ ID NO: 1104645 - DNA, 13 bp, Homo sapiens
ccctcctgctggg

SEQ ID NO: 1104646 - DNA, 13 bp, Homo sapiens
ccctcctggctct

SEQ ID NO: 1104647 - DNA, 11 bp, Homo sapiens
ccctcctggtc

SEQ ID NO: 1104648 - DNA, 15 bp, Homo sapiens
ccctcctggtcctgg

SEQ ID NO: 1104649 - DNA, 19 bp, Homo sapiens
ccctcctggtcctggacac

SEQ ID NO: 1104650 - DNA, 13 bp, Homo sapiens
ccctcctgtaaat

SEQ ID NO: 1104651 - DNA, 12 bp, Homo sapiens
ccctcctgtgcc

SEQ ID NO: 1104652 - DNA, 19 bp, Homo sapiens
ccctcctgtgccccagctg

SEQ ID NO: 1104653 - DNA, 23 bp, Homo sapiens
ccctcctgtgctgggggaatgag

SEQ ID NO: 1104654 - DNA, 12 bp, Homo sapiens
ccctccttgcaa

SEQ ID NO: 1104655 - DNA, 16 bp, Homo sapiens
ccctccttgcaaccag

SEQ ID NO: 1104656 - DNA, 17 bp, Homo sapiens
ccctccttgcaaccagg

SEQ ID NO: 1104657 - DNA, 22 bp, Homo sapiens
ccctccttgcaaccaggcagct

SEQ ID NO: 1104658 - DNA, 23 bp, Homo sapiens
ccctccttgcaaccaggcagctg

SEQ ID NO: 1104659 - DNA, 18 bp, Homo sapiens
ccctcgaaccaaggcagc

SEQ ID NO: 1104660 - DNA, 19 bp, Homo sapiens
ccctcgaaccaaggcagcc

SEQ ID NO: 1104661 - DNA, 16 bp, Homo sapiens
ccctcgactcagcacc

SEQ ID NO: 1104662 - DNA, 15 bp, Homo sapiens
ccctcgaggcctaca

SEQ ID NO: 1104663 - DNA, 16 bp, Homo sapiens
ccctcgaggcctacag

SEQ ID NO: 1104664 - DNA, 13 bp, Homo sapiens
ccctcgcagacct

SEQ ID NO: 1104665 - DNA, 22 bp, Homo sapiens
ccctcgcagagcccttctcgtt

SEQ ID NO: 1104666 - DNA, 12 bp, Homo sapiens
ccctcgccagct

SEQ ID NO: 1104667 - DNA, 15 bp, Homo sapiens
ccctcgccagcttgg

SEQ ID NO: 1104668 - DNA, 23 bp, Homo sapiens
ccctcgcctgtggagctcagccc

SEQ ID NO: 1104669 - DNA, 21 bp, Homo sapiens
ccctcgctgctgctactaccc

SEQ ID NO: 1104670 - DNA, 21 bp, Homo sapiens
ccctcgcttggacggctgggc

SEQ ID NO: 1104671 - DNA, 23 bp, Homo sapiens
ccctcgcttggacggctgggcac

SEQ ID NO: 1104672 - DNA, 14 bp, Homo sapiens
ccctcggacccacc

SEQ ID NO: 1104673 - DNA, 13 bp, Homo sapiens
ccctcggagcctg

SEQ ID NO: 1104674 - DNA, 19 bp, Homo sapiens
ccctcggagctggctgtgc

SEQ ID NO: 1104675 - DNA, 18 bp, Homo sapiens
ccctcgggaccccactcg

SEQ ID NO: 1104676 - DNA, 14 bp, Homo sapiens
ccctcgggcccacc

SEQ ID NO: 1104677 - DNA, 16 bp, Homo sapiens
ccctcgggcccacctg

SEQ ID NO: 1104678 - DNA, 17 bp, Homo sapiens
ccctcgggggctcttcc

SEQ ID NO: 1104679 - DNA, 19 bp, Homo sapiens
ccctcgggggctcttcccc

SEQ ID NO: 1104680 - DNA, 23 bp, Homo sapiens
ccctcggtcagcgactggatgct

SEQ ID NO: 1104681 - DNA, 14 bp, Homo sapiens
ccctcggtggctgc

SEQ ID NO: 1104682 - DNA, 15 bp, Homo sapiens
ccctcgtccacaggg

SEQ ID NO: 1104683 - DNA, 15 bp, Homo sapiens
ccctcgtcccatcca

SEQ ID NO: 1104684 - DNA, 16 bp, Homo sapiens
ccctcgtcccatccag

SEQ ID NO: 1104685 - DNA, 18 bp, Homo sapiens
ccctcgtccgtctgtctc

SEQ ID NO: 1104686 - DNA, 19 bp, Homo sapiens
ccctcgtctccctggccac

SEQ ID NO: 1104687 - DNA, 20 bp, Homo sapiens
ccctcgtctccctggccacc

SEQ ID NO: 1104688 - DNA, 14 bp, Homo sapiens
ccctcgtggccagc

SEQ ID NO: 1104689 - DNA, 15 bp, Homo sapiens
ccctcgtggccagcc

SEQ ID NO: 1104690 - DNA, 23 bp, Homo sapiens
ccctcgtgggcttgtgctcggga

SEQ ID NO: 1104691 - DNA, 14 bp, Homo sapiens
ccctcgttgcccag

SEQ ID NO: 1104692 - DNA, 16 bp, Homo sapiens
ccctctaaagcaataa

SEQ ID NO: 1104693 - DNA, 14 bp, Homo sapiens
ccctctactcttcc

SEQ ID NO: 1104694 - DNA, 23 bp, Homo sapiens
ccctctagggcagggtgggagcc

SEQ ID NO: 1104695 - DNA, 17 bp, Homo sapiens
ccctctatgctggcttt

SEQ ID NO: 1104696 - DNA, 16 bp, Homo sapiens
ccctctcacccgggac

SEQ ID NO: 1104697 - DNA, 12 bp, Homo sapiens
ccctctcacgcc

SEQ ID NO: 1104698 - DNA, 22 bp, Homo sapiens
ccctctcactccagccaaagaa

SEQ ID NO: 1104699 - DNA, 11 bp, Homo sapiens
ccctctcagaa

SEQ ID NO: 1104700 - DNA, 13 bp, Homo sapiens
ccctctcagctcc

SEQ ID NO: 1104701 - DNA, 10 bp, Homo sapiens
ccctctcagg

SEQ ID NO: 1104702 - DNA, 13 bp, Homo sapiens
ccctctcaggaga

SEQ ID NO: 1104703 - DNA, 16 bp, Homo sapiens
ccctctcaggcatgcc

SEQ ID NO: 1104704 - DNA, 21 bp, Homo sapiens
ccctctcaggcatgcctgtgt

SEQ ID NO: 1104705 - DNA, 15 bp, Homo sapiens
ccctctcatctcagg

SEQ ID NO: 1104706 - DNA, 16 bp, Homo sapiens
ccctctcatctcaggt

SEQ ID NO: 1104707 - DNA, 17 bp, Homo sapiens
ccctctcatgtccctcc

SEQ ID NO: 1104708 - DNA, 22 bp, Homo sapiens
ccctctcatgtccctccaggga

SEQ ID NO: 1104709 - DNA, 23 bp, Homo sapiens
ccctctccaactgcctaaggccc

SEQ ID NO: 1104710 - DNA, 13 bp, Homo sapiens
ccctctcccaggg

SEQ ID NO: 1104711 - DNA, 15 bp, Homo sapiens
ccctctcccagtcca

SEQ ID NO: 1104712 - DNA, 18 bp, Homo sapiens
ccctctccccacccctac

SEQ ID NO: 1104713 - DNA, 11 bp, Homo sapiens
ccctctcccct

SEQ ID NO: 1104714 - DNA, 16 bp, Homo sapiens
ccctctcccctctctg

SEQ ID NO: 1104715 - DNA, 17 bp, Homo sapiens
ccctctcccctctctgc

SEQ ID NO: 1104716 - DNA, 22 bp, Homo sapiens
ccctctccctgtgttctgggct

SEQ ID NO: 1104717 - DNA, 20 bp, Homo sapiens
ccctctcccttccctcctcc

SEQ ID NO: 1104718 - DNA, 23 bp, Homo sapiens
ccctctccgcgggagaccccttg

SEQ ID NO: 1104719 - DNA, 10 bp, Homo sapiens
ccctctcctc

SEQ ID NO: 1104720 - DNA, 12 bp, Homo sapiens
ccctctcctccc

SEQ ID NO: 1104721 - DNA, 20 bp, Homo sapiens
ccctctcctcccagctgctt

SEQ ID NO: 1104722 - DNA, 17 bp, Homo sapiens
ccctctcctgcctactc

SEQ ID NO: 1104723 - DNA, 11 bp, Homo sapiens
ccctctcctgt

SEQ ID NO: 1104724 - DNA, 13 bp, Homo sapiens
ccctctcctgtcc

SEQ ID NO: 1104725 - DNA, 14 bp, Homo sapiens
ccctctcctgtcct

SEQ ID NO: 1104726 - DNA, 18 bp, Homo sapiens
ccctctcctgtctgccct

SEQ ID NO: 1104727 - DNA, 14 bp, Homo sapiens
ccctctccttcctg

SEQ ID NO: 1104728 - DNA, 15 bp, Homo sapiens
ccctctcgccccatc

SEQ ID NO: 1104729 - DNA, 16 bp, Homo sapiens
ccctctcgccccatcc

SEQ ID NO: 1104730 - DNA, 21 bp, Homo sapiens
ccctctcgccccatccctgct

SEQ ID NO: 1104731 - DNA, 19 bp, Homo sapiens
ccctctcgggctctctcac

SEQ ID NO: 1104732 - DNA, 12 bp, Homo sapiens
ccctctctcaca

SEQ ID NO: 1104733 - DNA, 13 bp, Homo sapiens
ccctctctcttct

SEQ ID NO: 1104734 - DNA, 17 bp, Homo sapiens
ccctctctcttctgctc

SEQ ID NO: 1104735 - DNA, 22 bp, Homo sapiens
ccctctctcttctgctccaccc

SEQ ID NO: 1104736 - DNA, 12 bp, Homo sapiens
ccctctctgctc

SEQ ID NO: 1104737 - DNA, 18 bp, Homo sapiens
ccctctctgctccttcac

SEQ ID NO: 1104738 - DNA, 13 bp, Homo sapiens
ccctctcttccct

SEQ ID NO: 1104739 - DNA, 13 bp, Homo sapiens
ccctctcttgcac

SEQ ID NO: 1104740 - DNA, 18 bp, Homo sapiens
ccctctcttgcacccgcc

SEQ ID NO: 1104741 - DNA, 16 bp, Homo sapiens
ccctctgaacttgcct

SEQ ID NO: 1104742 - DNA, 19 bp, Homo sapiens
ccctctgaatggtccaggg

SEQ ID NO: 1104743 - DNA, 13 bp, Homo sapiens
ccctctgagccgc

SEQ ID NO: 1104744 - DNA, 16 bp, Homo sapiens
ccctctgattgttccc

SEQ ID NO: 1104745 - DNA, 12 bp, Homo sapiens
ccctctgcccag

SEQ ID NO: 1104746 - DNA, 14 bp, Homo sapiens
ccctctgcccagct

SEQ ID NO: 1104747 - DNA, 16 bp, Homo sapiens
ccctctgcccagcttg

SEQ ID NO: 1104748 - DNA, 16 bp, Homo sapiens
ccctctgccccaagca

SEQ ID NO: 1104749 - DNA, 17 bp, Homo sapiens
ccctctgccccaagcag

SEQ ID NO: 1104750 - DNA, 22 bp, Homo sapiens
ccctctgccccaagcagccagc

SEQ ID NO: 1104751 - DNA, 13 bp, Homo sapiens
ccctctgccccat

SEQ ID NO: 1104752 - DNA, 23 bp, Homo sapiens
ccctctgccggtcgggcagccag

SEQ ID NO: 1104753 - DNA, 12 bp, Homo sapiens
ccctctgcctcc

SEQ ID NO: 1104754 - DNA, 14 bp, Homo sapiens
ccctctgcctgcac

SEQ ID NO: 1104755 - DNA, 21 bp, Homo sapiens
ccctctgcctgcactccctgg

SEQ ID NO: 1104756 - DNA, 15 bp, Homo sapiens
ccctctgcctgtccc

SEQ ID NO: 1104757 - DNA, 18 bp, Homo sapiens
ccctctgctcaggcctcc

SEQ ID NO: 1104758 - DNA, 18 bp, Homo sapiens
ccctctgctctgcctgga

SEQ ID NO: 1104759 - DNA, 16 bp, Homo sapiens
ccctctgctgctgccc

SEQ ID NO: 1104760 - DNA, 18 bp, Homo sapiens
ccctctgctgctgcccgg

SEQ ID NO: 1104761 - DNA, 20 bp, Homo sapiens
ccctctggaatcttccccaa

SEQ ID NO: 1104762 - DNA, 12 bp, Homo sapiens
ccctctggaggg

SEQ ID NO: 1104763 - DNA, 22 bp, Homo sapiens
ccctctggaggggtgtggctcc

SEQ ID NO: 1104764 - DNA, 17 bp, Homo sapiens
ccctgcccttggcacca

SEQ ID NO: 1104765 - DNA, 22 bp, Homo sapiens
ccctgcccttggcaccaccagg

SEQ ID NO: 1104766 - DNA, 13 bp, Homo sapiens
ccctgccgcctca

SEQ ID NO: 1104767 - DNA, 16 bp, Homo sapiens
ccctgccgtcaccacc

SEQ ID NO: 1104768 - DNA, 20 bp, Homo sapiens
ccctgccgtcaccaccaccc

SEQ ID NO: 1104769 - DNA, 22 bp, Homo sapiens
ccctgccgtcaccaccacccct

SEQ ID NO: 1104770 - DNA, 16 bp, Homo sapiens
ccctgcctcagccagg

SEQ ID NO: 1104771 - DNA, 22 bp, Homo sapiens
ccctgcctccctttctgggagg

SEQ ID NO: 1104772 - DNA, 14 bp, Homo sapiens
ccctgcctccggga

SEQ ID NO: 1104773 - DNA, 14 bp, Homo sapiens
ccctgcctcgaggg

SEQ ID NO: 1104774 - DNA, 16 bp, Homo sapiens
ccctgcctcgagggcc

SEQ ID NO: 1104775 - DNA, 18 bp, Homo sapiens
ccctgcctcgagggccgc

SEQ ID NO: 1104776 - DNA, 22 bp, Homo sapiens
ccctgcctctcatcaactgaat

SEQ ID NO: 1104777 - DNA, 13 bp, Homo sapiens
ccctgcctctgtg

SEQ ID NO: 1104778 - DNA, 14 bp, Homo sapiens
ccctgcctctgtgt

SEQ ID NO: 1104779 - DNA, 12 bp, Homo sapiens
ccctgcctgagg

SEQ ID NO: 1104780 - DNA, 13 bp, Homo sapiens
ccctgcctgagga

SEQ ID NO: 1104781 - DNA, 15 bp, Homo sapiens
ccctgcctgcacctc

SEQ ID NO: 1104782 - DNA, 13 bp, Homo sapiens
ccctgcctgccat

SEQ ID NO: 1104783 - DNA, 20 bp, Homo sapiens
ccctgcctgccatgtacctc

SEQ ID NO: 1104784 - DNA, 14 bp, Homo sapiens
ccctgcctgcccac

SEQ ID NO: 1104785 - DNA, 19 bp, Homo sapiens
ccctgcctgccgctgcacc

SEQ ID NO: 1104786 - DNA, 12 bp, Homo sapiens
ccctgcctgcct

SEQ ID NO: 1104787 - DNA, 14 bp, Homo sapiens
ccctgcctggactt

SEQ ID NO: 1104788 - DNA, 21 bp, Homo sapiens
ccctgcctggcccccaacctc

SEQ ID NO: 1104789 - DNA, 16 bp, Homo sapiens
ccctgcctgggccttg

SEQ ID NO: 1104790 - DNA, 17 bp, Homo sapiens
ccctgcctgggccttgg

SEQ ID NO: 1104791 - DNA, 22 bp, Homo sapiens
ccctgcctgggccttggctggg

SEQ ID NO: 1104792 - DNA, 12 bp, Homo sapiens
ccctgcctgtca

SEQ ID NO: 1104793 - DNA, 18 bp, Homo sapiens
ccctgcctgttggcaggc

SEQ ID NO: 1104794 - DNA, 18 bp, Homo sapiens
ccctgccttcctctgagg

SEQ ID NO: 1104795 - DNA, 20 bp, Homo sapiens
ccctgccttgccgctcccct

SEQ ID NO: 1104796 - DNA, 15 bp, Homo sapiens
ccctgcctttaaatg

SEQ ID NO: 1104797 - DNA, 16 bp, Homo sapiens
ccctgcgcctccagag

SEQ ID NO: 1104798 - DNA, 14 bp, Homo sapiens
ccctgcggcctcca

SEQ ID NO: 1104799 - DNA, 17 bp, Homo sapiens
ccctgcgggccacaggg

SEQ ID NO: 1104800 - DNA, 22 bp, Homo sapiens
ccctgcgggccacagggcaaaa

SEQ ID NO: 1104801 - DNA, 18 bp, Homo sapiens
ccctgcgggccagggtcc

SEQ ID NO: 1104802 - DNA, 18 bp, Homo sapiens
ccctgcgggcgcgggcag

SEQ ID NO: 1104803 - DNA, 21 bp, Homo sapiens
ccctgcgggcgcgggcagcca

SEQ ID NO: 1104804 - DNA, 23 bp, Homo sapiens
ccctgcgggcgcgggcagccacc

SEQ ID NO: 1104805 - DNA, 22 bp, Homo sapiens
ccctgcgggtgaacaaagcagc

SEQ ID NO: 1104806 - DNA, 21 bp, Homo sapiens
ccctgcgtcctgacgccctgc

SEQ ID NO: 1104807 - DNA, 22 bp, Homo sapiens
ccctgcgtgggggccagtcagg

SEQ ID NO: 1104808 - DNA, 16 bp, Homo sapiens
ccctgcgttggagcca

SEQ ID NO: 1104809 - DNA, 16 bp, Homo sapiens
ccctgctcagtgcttg

SEQ ID NO: 1104810 - DNA, 15 bp, Homo sapiens
ccctgctccaccagc

SEQ ID NO: 1104811 - DNA, 16 bp, Homo sapiens
ccctgctccaccagca

SEQ ID NO: 1104812 - DNA, 10 bp, Homo sapiens
ccctgctccc

SEQ ID NO: 1104813 - DNA, 20 bp, Homo sapiens
ccctgctcccagcctgctga

SEQ ID NO: 1104814 - DNA, 21 bp, Homo sapiens
ccctgctcccattcctccctc

SEQ ID NO: 1104815 - DNA, 12 bp, Homo sapiens
ccctgctccctc

SEQ ID NO: 1104816 - DNA, 17 bp, Homo sapiens
ccctgctcctcatggga

SEQ ID NO: 1104817 - DNA, 13 bp, Homo sapiens
ccctgctcctccc

SEQ ID NO: 1104818 - DNA, 16 bp, Homo sapiens
ccctgctcctccctgg

SEQ ID NO: 1104819 - DNA, 17 bp, Homo sapiens
ccctgctcctccctggc

SEQ ID NO: 1104820 - DNA, 18 bp, Homo sapiens
ccctgctcctccctggct

SEQ ID NO: 1104821 - DNA, 22 bp, Homo sapiens
ccctgctcctccctggctgccc

SEQ ID NO: 1104822 - DNA, 14 bp, Homo sapiens
ccctgctcctcctg

SEQ ID NO: 1104823 - DNA, 19 bp, Homo sapiens
ccctgctcctcctgccctg

SEQ ID NO: 1104824 - DNA, 13 bp, Homo sapiens
ccctgctcctgca

SEQ ID NO: 1104825 - DNA, 19 bp, Homo sapiens
ccctgctctacccatgagc

SEQ ID NO: 1104826 - DNA, 18 bp, Homo sapiens
ccctgctctgttgcctct

SEQ ID NO: 1104827 - DNA, 13 bp, Homo sapiens
ccctgctgcacta

SEQ ID NO: 1104828 - DNA, 12 bp, Homo sapiens
ccctgctgccca

SEQ ID NO: 1104829 - DNA, 20 bp, Homo sapiens
ccctgctgccgcctcccagc

SEQ ID NO: 1104830 - DNA, 14 bp, Homo sapiens
ccctgctgcctccc

SEQ ID NO: 1104831 - DNA, 14 bp, Homo sapiens
ccctgctgtctctc

SEQ ID NO: 1104832 - DNA, 15 bp, Homo sapiens
ccctgctgtctctct

SEQ ID NO: 1104833 - DNA, 19 bp, Homo sapiens
ccctgctgtctctctgggc

SEQ ID NO: 1104834 - DNA, 20 bp, Homo sapiens
ccctgctgtctctctgggct

SEQ ID NO: 1104835 - DNA, 16 bp, Homo sapiens
ccctgctgtgctgctc

SEQ ID NO: 1104836 - DNA, 18 bp, Homo sapiens
ccctgctgtgctgctcaa

SEQ ID NO: 1104837 - DNA, 13 bp, Homo sapiens
ccctgctgtggga

SEQ ID NO: 1104838 - DNA, 15 bp, Homo sapiens
ccctgcttccaggaa

SEQ ID NO: 1104839 - DNA, 16 bp, Homo sapiens
ccctgcttcctgcttg

SEQ ID NO: 1104840 - DNA, 19 bp, Homo sapiens
ccctgcttcctgcttgcca

SEQ ID NO: 1104841 - DNA, 12 bp, Homo sapiens
ccctgcttctcc

SEQ ID NO: 1104842 - DNA, 19 bp, Homo sapiens
ccctgcttctcccggggac

SEQ ID NO: 1104843 - DNA, 21 bp, Homo sapiens
ccctgcttgcacacttcccca

SEQ ID NO: 1104844 - DNA, 19 bp, Homo sapiens
ccctgcttgcccgctccca

SEQ ID NO: 1104845 - DNA, 17 bp, Homo sapiens
ccctgcttggccaggag

SEQ ID NO: 1104846 - DNA, 20 bp, Homo sapiens
ccctgctttgggctgccctg

SEQ ID NO: 1104847 - DNA, 15 bp, Homo sapiens
ccctggaagagccca

SEQ ID NO: 1104848 - DNA, 18 bp, Homo sapiens
ccctggaagagcccagtc

SEQ ID NO: 1104849 - DNA, 21 bp, Homo sapiens
ccctggaagagtcctccaccc

SEQ ID NO: 1104850 - DNA, 22 bp, Homo sapiens
ccctggaagccggcggcccaag

SEQ ID NO: 1104851 - DNA, 21 bp, Homo sapiens
ccctggaaggacatccatgtt

SEQ ID NO: 1104852 - DNA, 19 bp, Homo sapiens
ccctggaattcagcaccct

SEQ ID NO: 1104853 - DNA, 21 bp, Homo sapiens
ccctggaattcagcaccctgg

SEQ ID NO: 1104854 - DNA, 23 bp, Homo sapiens
ccctggaattcagcaccctgggt

SEQ ID NO: 1104855 - DNA, 10 bp, Homo sapiens
ccctggacag

SEQ ID NO: 1104856 - DNA, 17 bp, Homo sapiens
ccctggacagatggccc

SEQ ID NO: 1104857 - DNA, 20 bp, Homo sapiens
ccctggacagatggcccaag

SEQ ID NO: 1104858 - DNA, 23 bp, Homo sapiens
ccctggacagatggcccaaggga

SEQ ID NO: 1104859 - DNA, 22 bp, Homo sapiens
ccctggaccaccagccccagca

SEQ ID NO: 1104860 - DNA, 15 bp, Homo sapiens
ccctggacccctggg

SEQ ID NO: 1104861 - DNA, 13 bp, Homo sapiens
ccctggactggga

SEQ ID NO: 1104862 - DNA, 14 bp, Homo sapiens
ccctggagaagcac

SEQ ID NO: 1104863 - DNA, 18 bp, Homo sapiens
ccctggagaagcaccagc

SEQ ID NO: 1104864 - DNA, 18 bp, Homo sapiens
ccctggagaccacactgc

SEQ ID NO: 1104865 - DNA, 21 bp, Homo sapiens
ccctggagaggccctctggag

SEQ ID NO: 1104866 - DNA, 14 bp, Homo sapiens
ccctggagcaggag

SEQ ID NO: 1104867 - DNA, 15 bp, Homo sapiens
ccctggagcaggagc

SEQ ID NO: 1104868 - DNA, 12 bp, Homo sapiens
ccctggagccag

SEQ ID NO: 1104869 - DNA, 15 bp, Homo sapiens
ccctggagccagggc

SEQ ID NO: 1104870 - DNA, 16 bp, Homo sapiens
ccctggagccagggca

SEQ ID NO: 1104871 - DNA, 22 bp, Homo sapiens
ccctggagccagggcagaggaa

SEQ ID NO: 1104872 - DNA, 14 bp, Homo sapiens
ccctggagccctgt

SEQ ID NO: 1104873 - DNA, 18 bp, Homo sapiens
ccctggagcctccactgc

SEQ ID NO: 1104874 - DNA, 10 bp, Homo sapiens
ccctggagct

SEQ ID NO: 1104875 - DNA, 18 bp, Homo sapiens
ccctggaggacagaggga

SEQ ID NO: 1104876 - DNA, 15 bp, Homo sapiens
ccctggagtgcagtt

SEQ ID NO: 1104877 - DNA, 23 bp, Homo sapiens
ccctggagtgtgtcagagcccag

SEQ ID NO: 1104878 - DNA, 21 bp, Homo sapiens
ccctggatctacctggaggga

SEQ ID NO: 1104879 - DNA, 15 bp, Homo sapiens
ccctggatgcccagg

SEQ ID NO: 1104880 - DNA, 15 bp, Homo sapiens
ccctggatgggcatt

SEQ ID NO: 1104881 - DNA, 17 bp, Homo sapiens
ccctggatgggcattgg

SEQ ID NO: 1104882 - DNA, 13 bp, Homo sapiens
ccctggatgtccc

SEQ ID NO: 1104883 - DNA, 21 bp, Homo sapiens
ccctggattaggagggtgaca

SEQ ID NO: 1104884 - DNA, 22 bp, Homo sapiens
ccctggcaatcccaccaaatca

SEQ ID NO: 1104885 - DNA, 19 bp, Homo sapiens
ccctggcagcacagcccag

SEQ ID NO: 1104886 - DNA, 17 bp, Homo sapiens
cccttcaaggcctcccc

SEQ ID NO: 1104887 - DNA, 18 bp, Homo sapiens
cccttcacaaagcccaag

SEQ ID NO: 1104888 - DNA, 14 bp, Homo sapiens
cccttcacaggggt

SEQ ID NO: 1104889 - DNA, 16 bp, Homo sapiens
cccttcactgccatga

SEQ ID NO: 1104890 - DNA, 17 bp, Homo sapiens
cccttcacttctgacca

SEQ ID NO: 1104891 - DNA, 19 bp, Homo sapiens
cccttcagaacagaggcat

SEQ ID NO: 1104892 - DNA, 12 bp, Homo sapiens
cccttcagctcc

SEQ ID NO: 1104893 - DNA, 16 bp, Homo sapiens
cccttcagctcctgag

SEQ ID NO: 1104894 - DNA, 12 bp, Homo sapiens
cccttcagggcc

SEQ ID NO: 1104895 - DNA, 13 bp, Homo sapiens
cccttcagggcca

SEQ ID NO: 1104896 - DNA, 21 bp, Homo sapiens
cccttcagtaccctctcagct

SEQ ID NO: 1104897 - DNA, 14 bp, Homo sapiens
cccttcagtctgct

SEQ ID NO: 1104898 - DNA, 13 bp, Homo sapiens
cccttcagtgccc

SEQ ID NO: 1104899 - DNA, 14 bp, Homo sapiens
cccttcatcttcct

SEQ ID NO: 1104900 - DNA, 17 bp, Homo sapiens
cccttcatcttcctgtg

SEQ ID NO: 1104901 - DNA, 15 bp, Homo sapiens
cccttccagcctggg

SEQ ID NO: 1104902 - DNA, 16 bp, Homo sapiens
cccttccagcctggga

SEQ ID NO: 1104903 - DNA, 17 bp, Homo sapiens
cccttccagcctgggac

SEQ ID NO: 1104904 - DNA, 21 bp, Homo sapiens
cccttccaggtgggtgtggga

SEQ ID NO: 1104905 - DNA, 17 bp, Homo sapiens
cccttccatgccctggg

SEQ ID NO: 1104906 - DNA, 13 bp, Homo sapiens
cccttcccagccc

SEQ ID NO: 1104907 - DNA, 21 bp, Homo sapiens
cccttccccactgcctgccca

SEQ ID NO: 1104908 - DNA, 14 bp, Homo sapiens
cccttccccaggcc

SEQ ID NO: 1104909 - DNA, 22 bp, Homo sapiens
cccttcccctcccgacagccca

SEQ ID NO: 1104910 - DNA, 13 bp, Homo sapiens
cccttcccctgct

SEQ ID NO: 1104911 - DNA, 19 bp, Homo sapiens
cccttcccctgctgacctt

SEQ ID NO: 1104912 - DNA, 11 bp, Homo sapiens
cccttcccctt

SEQ ID NO: 1104913 - DNA, 13 bp, Homo sapiens
cccttccccttca

SEQ ID NO: 1104914 - DNA, 13 bp, Homo sapiens
cccttccccttct

SEQ ID NO: 1104915 - DNA, 19 bp, Homo sapiens
cccttccccttctgtgtca

SEQ ID NO: 1104916 - DNA, 15 bp, Homo sapiens
cccttcccgacccag

SEQ ID NO: 1104917 - DNA, 16 bp, Homo sapiens
cccttcccgccttcca

SEQ ID NO: 1104918 - DNA, 15 bp, Homo sapiens
cccttccctgcaaac

SEQ ID NO: 1104919 - DNA, 15 bp, Homo sapiens
cccttccctggcccc

SEQ ID NO: 1104920 - DNA, 16 bp, Homo sapiens
cccttccctggccccg

SEQ ID NO: 1104921 - DNA, 12 bp, Homo sapiens
cccttccctggg

SEQ ID NO: 1104922 - DNA, 14 bp, Homo sapiens
cccttccctgggga

SEQ ID NO: 1104923 - DNA, 13 bp, Homo sapiens
cccttccctgtcc

SEQ ID NO: 1104924 - DNA, 16 bp, Homo sapiens
cccttccctgtccttg

SEQ ID NO: 1104925 - DNA, 20 bp, Homo sapiens
cccttccgaccctctgggaa

SEQ ID NO: 1104926 - DNA, 15 bp, Homo sapiens
cccttccgtccatcc

SEQ ID NO: 1104927 - DNA, 20 bp, Homo sapiens
cccttccgtccatccccctt

SEQ ID NO: 1104928 - DNA, 18 bp, Homo sapiens
cccttcctattctcctgc

SEQ ID NO: 1104929 - DNA, 21 bp, Homo sapiens
cccttcctattctcctgccat

SEQ ID NO: 1104930 - DNA, 11 bp, Homo sapiens
cccttcctcac

SEQ ID NO: 1104931 - DNA, 13 bp, Homo sapiens
cccttcctcaccc

SEQ ID NO: 1104932 - DNA, 12 bp, Homo sapiens
cccttcctcctg

SEQ ID NO: 1104933 - DNA, 13 bp, Homo sapiens
cccttcctcctga

SEQ ID NO: 1104934 - DNA, 12 bp, Homo sapiens
cccttcctcggt

SEQ ID NO: 1104935 - DNA, 18 bp, Homo sapiens
cccttcctcggtggctct

SEQ ID NO: 1104936 - DNA, 10 bp, Homo sapiens
cccttcctct

SEQ ID NO: 1104937 - DNA, 17 bp, Homo sapiens
cccttcctctccactgc

SEQ ID NO: 1104938 - DNA, 19 bp, Homo sapiens
cccttcctcttcctgccct

SEQ ID NO: 1104939 - DNA, 14 bp, Homo sapiens
cccttcctctttgg

SEQ ID NO: 1104940 - DNA, 14 bp, Homo sapiens
cccttcctgccact

SEQ ID NO: 1104941 - DNA, 18 bp, Homo sapiens
cccttcctggaaacagca

SEQ ID NO: 1104942 - DNA, 17 bp, Homo sapiens
cccttcctggacacact

SEQ ID NO: 1104943 - DNA, 18 bp, Homo sapiens
cccttcctggacacactc

SEQ ID NO: 1104944 - DNA, 19 bp, Homo sapiens
cccttcctggacacactct

SEQ ID NO: 1104945 - DNA, 13 bp, Homo sapiens
cccttcctggccc

SEQ ID NO: 1104946 - DNA, 21 bp, Homo sapiens
cccttcctggcctcactggct

SEQ ID NO: 1104947 - DNA, 22 bp, Homo sapiens
cccttcctggcctcactggctg

SEQ ID NO: 1104948 - DNA, 24 bp, Homo sapiens
cccttcctggcctcactggctggg

SEQ ID NO: 1104949 - DNA, 17 bp, Homo sapiens
cccttcctgtcctgcct

SEQ ID NO: 1104950 - DNA, 20 bp, Homo sapiens
cccttcctgtcctgcctcct

SEQ ID NO: 1104951 - DNA, 19 bp, Homo sapiens
cccttcctgttccctcctg

SEQ ID NO: 1104952 - DNA, 20 bp, Homo sapiens
cccttcctgttccctcctgg

SEQ ID NO: 1104953 - DNA, 15 bp, Homo sapiens
cccttccttccattt

SEQ ID NO: 1104954 - DNA, 14 bp, Homo sapiens
cccttccttgctct

SEQ ID NO: 1104955 - DNA, 19 bp, Homo sapiens
cccttccttgggcagaatg

SEQ ID NO: 1104956 - DNA, 15 bp, Homo sapiens
cccttcctttcctct

SEQ ID NO: 1104957 - DNA, 20 bp, Homo sapiens
cccttcgacatgctgccagg

SEQ ID NO: 1104958 - DNA, 12 bp, Homo sapiens
cccttcgctcct

SEQ ID NO: 1104959 - DNA, 13 bp, Homo sapiens
cccttcgctcctc

SEQ ID NO: 1104960 - DNA, 15 bp, Homo sapiens
cccttctacaaggac

SEQ ID NO: 1104961 - DNA, 23 bp, Homo sapiens
cccttctagggttattgcatttg

SEQ ID NO: 1104962 - DNA, 23 bp, Homo sapiens
cccttctcattccaacagtgagt

SEQ ID NO: 1104963 - DNA, 14 bp, Homo sapiens
cccttctcccacac

SEQ ID NO: 1104964 - DNA, 18 bp, Homo sapiens
cccttctcccccttgtct

SEQ ID NO: 1104965 - DNA, 21 bp, Homo sapiens
cccttctcccccttgtcttcc

SEQ ID NO: 1104966 - DNA, 15 bp, Homo sapiens
cccttctccctggat

SEQ ID NO: 1104967 - DNA, 13 bp, Homo sapiens
cccttctctgctc

SEQ ID NO: 1104968 - DNA, 15 bp, Homo sapiens
cccttctctgctcca

SEQ ID NO: 1104969 - DNA, 20 bp, Homo sapiens
cccttctctgctccaccaca

SEQ ID NO: 1104970 - DNA, 12 bp, Homo sapiens
cccttcttcccg

SEQ ID NO: 1104971 - DNA, 13 bp, Homo sapiens
cccttcttcccgc

SEQ ID NO: 1104972 - DNA, 14 bp, Homo sapiens
cccttcttgggccc

SEQ ID NO: 1104973 - DNA, 18 bp, Homo sapiens
cccttcttgggccccaga

SEQ ID NO: 1104974 - DNA, 19 bp, Homo sapiens
cccttcttgggccccagac

SEQ ID NO: 1104975 - DNA, 18 bp, Homo sapiens
cccttctttgctgctgct

SEQ ID NO: 1104976 - DNA, 17 bp, Homo sapiens
cccttgaaattttaaac

SEQ ID NO: 1104977 - DNA, 20 bp, Homo sapiens
cccttgaagcaataactcca

SEQ ID NO: 1104978 - DNA, 21 bp, Homo sapiens
cccttgaagcaataactccaa

SEQ ID NO: 1104979 - DNA, 22 bp, Homo sapiens
cccttgaagcaataactccaag

SEQ ID NO: 1104980 - DNA, 15 bp, Homo sapiens
cccttgaccattggc

SEQ ID NO: 1104981 - DNA, 13 bp, Homo sapiens
cccttgagacctc

SEQ ID NO: 1104982 - DNA, 16 bp, Homo sapiens
cccttgagacctcagc

SEQ ID NO: 1104983 - DNA, 19 bp, Homo sapiens
cccttgagacctcagccat

SEQ ID NO: 1104984 - DNA, 20 bp, Homo sapiens
cccttgagacctcagccatg

SEQ ID NO: 1104985 - DNA, 14 bp, Homo sapiens
cccttgagatgagt

SEQ ID NO: 1104986 - DNA, 11 bp, Homo sapiens
cccttgagctc

SEQ ID NO: 1104987 - DNA, 13 bp, Homo sapiens
cccttgaggggcc

SEQ ID NO: 1104988 - DNA, 13 bp, Homo sapiens
cccttgcaagcca

SEQ ID NO: 1104989 - DNA, 15 bp, Homo sapiens
cccttgcaagccata

SEQ ID NO: 1104990 - DNA, 16 bp, Homo sapiens
cccttgcaagccataa

SEQ ID NO: 1104991 - DNA, 20 bp, Homo sapiens
cccttgcaccgtcctcagca

SEQ ID NO: 1104992 - DNA, 22 bp, Homo sapiens
cccttgcactaaagtatgtaaa

SEQ ID NO: 1104993 - DNA, 19 bp, Homo sapiens
cccttgcagctagttttct

SEQ ID NO: 1104994 - DNA, 22 bp, Homo sapiens
cccttgcaggggtcccccctca

SEQ ID NO: 1104995 - DNA, 21 bp, Homo sapiens
cccttgcagttcagcaccacc

SEQ ID NO: 1104996 - DNA, 15 bp, Homo sapiens
cccttgccactttgc

SEQ ID NO: 1104997 - DNA, 17 bp, Homo sapiens
cccttgccactttgcac

SEQ ID NO: 1104998 - DNA, 19 bp, Homo sapiens
cccttgccatccattctgg

SEQ ID NO: 1104999 - DNA, 21 bp, Homo sapiens
cccttgcccagggctcagcct

SEQ ID NO: 1105000 - DNA, 20 bp, Homo sapiens
cccttgccccaggccaggta

SEQ ID NO: 1105001 - DNA, 12 bp, Homo sapiens
cccttgccctga

SEQ ID NO: 1105002 - DNA, 21 bp, Homo sapiens
cccttgccctgacctcccagc

SEQ ID NO: 1105003 - DNA, 16 bp, Homo sapiens
cccttgcccttgccct

SEQ ID NO: 1105004 - DNA, 12 bp, Homo sapiens
cccttgcctccc

SEQ ID NO: 1105005 - DNA, 13 bp, Homo sapiens
cccttgcctcccc

SEQ ID NO: 1105006 - DNA, 15 bp, Homo sapiens
cccttgcctccccat

SEQ ID NO: 1105007 - DNA, 16 bp, Homo sapiens
cccttgctcagtgcct

SEQ ID NO: 1105008 - DNA, 19 bp, Homo sapiens
cccttgctcagtgcctcct

SEQ ID NO: 1105009 - DNA, 22 bp, Homo sapiens
cccttgctcagtgcctcctggc

SEQ ID NO: 1105010 - DNA, 14 bp, Homo sapiens
ccgccagaccccgt

SEQ ID NO: 1105011 - DNA, 20 bp, Homo sapiens
ccgccagaccccgtggctct

SEQ ID NO: 1105012 - DNA, 16 bp, Homo sapiens
ccgccagactgttaga

SEQ ID NO: 1105013 - DNA, 12 bp, Homo sapiens
ccgccagcctcc

SEQ ID NO: 1105014 - DNA, 15 bp, Homo sapiens
ccgccagctgggagc

SEQ ID NO: 1105015 - DNA, 17 bp, Homo sapiens
ccgccaggcgcatgtct

SEQ ID NO: 1105016 - DNA, 11 bp, Homo sapiens
ccgccagggct

SEQ ID NO: 1105017 - DNA, 14 bp, Homo sapiens
ccgccagggctggg

SEQ ID NO: 1105018 - DNA, 17 bp, Homo sapiens
ccgccagggctggggac

SEQ ID NO: 1105019 - DNA, 15 bp, Homo sapiens
ccgccagttcatctt

SEQ ID NO: 1105020 - DNA, 16 bp, Homo sapiens
ccgccagttcatcttt

SEQ ID NO: 1105021 - DNA, 14 bp, Homo sapiens
ccgccatccagggt

SEQ ID NO: 1105022 - DNA, 19 bp, Homo sapiens
ccgccatctgcgcagggtg

SEQ ID NO: 1105023 - DNA, 22 bp, Homo sapiens
ccgccatggggtcggctcctga

SEQ ID NO: 1105024 - DNA, 19 bp, Homo sapiens
ccgccattgccaccaggag

SEQ ID NO: 1105025 - DNA, 16 bp, Homo sapiens
ccgcccacgccggcct

SEQ ID NO: 1105026 - DNA, 18 bp, Homo sapiens
ccgcccacgccggcctct

SEQ ID NO: 1105027 - DNA, 13 bp, Homo sapiens
ccgcccactgtcc

SEQ ID NO: 1105028 - DNA, 18 bp, Homo sapiens
ccgcccactgtcctgggc

SEQ ID NO: 1105029 - DNA, 14 bp, Homo sapiens
ccgcccagcctctc

SEQ ID NO: 1105030 - DNA, 13 bp, Homo sapiens
ccgcccatccctg

SEQ ID NO: 1105031 - DNA, 13 bp, Homo sapiens
ccgccccagagtg

SEQ ID NO: 1105032 - DNA, 11 bp, Homo sapiens
ccgccccagcc

SEQ ID NO: 1105033 - DNA, 14 bp, Homo sapiens
ccgccccagcccct

SEQ ID NO: 1105034 - DNA, 16 bp, Homo sapiens
ccgcccccaccccttc

SEQ ID NO: 1105035 - DNA, 12 bp, Homo sapiens
ccgcccccagcc

SEQ ID NO: 1105036 - DNA, 18 bp, Homo sapiens
ccgccccccagagccagg

SEQ ID NO: 1105037 - DNA, 21 bp, Homo sapiens
ccgccccccagagccagggct

SEQ ID NO: 1105038 - DNA, 11 bp, Homo sapiens
ccgccccctgc

SEQ ID NO: 1105039 - DNA, 17 bp, Homo sapiens
ccgccccctgccctccc

SEQ ID NO: 1105040 - DNA, 14 bp, Homo sapiens
ccgccccgccccac

SEQ ID NO: 1105041 - DNA, 16 bp, Homo sapiens
ccgccccgggctggcc

SEQ ID NO: 1105042 - DNA, 11 bp, Homo sapiens
ccgcccctgag

SEQ ID NO: 1105043 - DNA, 13 bp, Homo sapiens
ccgcccctgggga

SEQ ID NO: 1105044 - DNA, 17 bp, Homo sapiens
ccgcccctgtggccctg

SEQ ID NO: 1105045 - DNA, 21 bp, Homo sapiens
ccgcccctgtggccctggcca

SEQ ID NO: 1105046 - DNA, 19 bp, Homo sapiens
ccgccctcacctgcagaga

SEQ ID NO: 1105047 - DNA, 14 bp, Homo sapiens
ccgccctcaggggc

SEQ ID NO: 1105048 - DNA, 14 bp, Homo sapiens
ccgccctcttcctg

SEQ ID NO: 1105049 - DNA, 13 bp, Homo sapiens
ccgccctgagaga

SEQ ID NO: 1105050 - DNA, 14 bp, Homo sapiens
ccgccctgccactc

SEQ ID NO: 1105051 - DNA, 11 bp, Homo sapiens
ccgccctgccc

SEQ ID NO: 1105052 - DNA, 17 bp, Homo sapiens
ccgccctgcgggccaca

SEQ ID NO: 1105053 - DNA, 18 bp, Homo sapiens
ccgccctgcgggccacag

SEQ ID NO: 1105054 - DNA, 15 bp, Homo sapiens
ccgccctgctcctcc

SEQ ID NO: 1105055 - DNA, 21 bp, Homo sapiens
ccgccctgctcctccctggct

SEQ ID NO: 1105056 - DNA, 16 bp, Homo sapiens
ccgccctggacagatg

SEQ ID NO: 1105057 - DNA, 18 bp, Homo sapiens
ccgccctggacagatggc

SEQ ID NO: 1105058 - DNA, 14 bp, Homo sapiens
ccgccctgggctgg

SEQ ID NO: 1105059 - DNA, 16 bp, Homo sapiens
ccgccctgggctggac

SEQ ID NO: 1105060 - DNA, 21 bp, Homo sapiens
ccgccctgtgtgtgtcccctc

SEQ ID NO: 1105061 - DNA, 13 bp, Homo sapiens
ccgccgcccgacc

SEQ ID NO: 1105062 - DNA, 17 bp, Homo sapiens
ccgccgcccgcccctca

SEQ ID NO: 1105063 - DNA, 14 bp, Homo sapiens
ccgccgcctcccac

SEQ ID NO: 1105064 - DNA, 17 bp, Homo sapiens
ccgccgcctcccacggc

SEQ ID NO: 1105065 - DNA, 18 bp, Homo sapiens
ccgccgtctgcaggggcc

SEQ ID NO: 1105066 - DNA, 20 bp, Homo sapiens
ccgccgtctgcaggggcctg

SEQ ID NO: 1105067 - DNA, 21 bp, Homo sapiens
ccgccgtctgcaggggcctgg

SEQ ID NO: 1105068 - DNA, 22 bp, Homo sapiens
ccgccgtctgcaggggcctgga

SEQ ID NO: 1105069 - DNA, 17 bp, Homo sapiens
ccgccgtgccggcggca

SEQ ID NO: 1105070 - DNA, 18 bp, Homo sapiens
ccgcctagtttactgttt

SEQ ID NO: 1105071 - DNA, 13 bp, Homo sapiens
ccgcctccactct

SEQ ID NO: 1105072 - DNA, 13 bp, Homo sapiens
ccgcctcctccca

SEQ ID NO: 1105073 - DNA, 20 bp, Homo sapiens
ccgcctctcccgtcagggcc

SEQ ID NO: 1105074 - DNA, 17 bp, Homo sapiens
ccgcctctgcccgcaga

SEQ ID NO: 1105075 - DNA, 17 bp, Homo sapiens
ccgcctctgtctggagc

SEQ ID NO: 1105076 - DNA, 12 bp, Homo sapiens
ccgcctgccacc

SEQ ID NO: 1105077 - DNA, 13 bp, Homo sapiens
ccgcctgccaccg

SEQ ID NO: 1105078 - DNA, 19 bp, Homo sapiens
ccgcctgcccagactgatg

SEQ ID NO: 1105079 - DNA, 14 bp, Homo sapiens
ccgcctgccctgcc

SEQ ID NO: 1105080 - DNA, 15 bp, Homo sapiens
ccgcctgccctgcct

SEQ ID NO: 1105081 - DNA, 14 bp, Homo sapiens
ccgcctgccgtgca

SEQ ID NO: 1105082 - DNA, 18 bp, Homo sapiens
ccgcctgccgtgcatggc

SEQ ID NO: 1105083 - DNA, 14 bp, Homo sapiens
ccgcctgccttagc

SEQ ID NO: 1105084 - DNA, 14 bp, Homo sapiens
ccgcctgctcctca

SEQ ID NO: 1105085 - DNA, 16 bp, Homo sapiens
ccgcctggcagaactg

SEQ ID NO: 1105086 - DNA, 21 bp, Homo sapiens
ccgcctggcagaactgagctc

SEQ ID NO: 1105087 - DNA, 17 bp, Homo sapiens
ccgcctggccaggagca

SEQ ID NO: 1105088 - DNA, 23 bp, Homo sapiens
ccgcctggccaggagcaggcacg

SEQ ID NO: 1105089 - DNA, 18 bp, Homo sapiens
ccgcctggccctccctcc

SEQ ID NO: 1105090 - DNA, 22 bp, Homo sapiens
ccgcctggtactcaagcccgcg

SEQ ID NO: 1105091 - DNA, 12 bp, Homo sapiens
ccgcctgtcaca

SEQ ID NO: 1105092 - DNA, 16 bp, Homo sapiens
ccgcctgtcacaataa

SEQ ID NO: 1105093 - DNA, 11 bp, Homo sapiens
ccgcctgtggg

SEQ ID NO: 1105094 - DNA, 13 bp, Homo sapiens
ccgccttccctca

SEQ ID NO: 1105095 - DNA, 14 bp, Homo sapiens
ccgccttccctcac

SEQ ID NO: 1105096 - DNA, 13 bp, Homo sapiens
ccgccttcctggg

SEQ ID NO: 1105097 - DNA, 21 bp, Homo sapiens
ccgccttcgtgtgctgctgct

SEQ ID NO: 1105098 - DNA, 17 bp, Homo sapiens
ccgccttctcccctctc

SEQ ID NO: 1105099 - DNA, 12 bp, Homo sapiens
ccgcgcaggctc

SEQ ID NO: 1105100 - DNA, 17 bp, Homo sapiens
ccgcgccctccgacctc

SEQ ID NO: 1105101 - DNA, 16 bp, Homo sapiens
ccgcgccgatgccacc

SEQ ID NO: 1105102 - DNA, 18 bp, Homo sapiens
ccgcgcggagacctcctg

SEQ ID NO: 1105103 - DNA, 22 bp, Homo sapiens
ccgcgcggagacctcctgacaa

SEQ ID NO: 1105104 - DNA, 22 bp, Homo sapiens
ccgcgcgttccttcgcacactg

SEQ ID NO: 1105105 - DNA, 13 bp, Homo sapiens
ccgcgctcaggag

SEQ ID NO: 1105106 - DNA, 19 bp, Homo sapiens
ccgcgctccgaaccccggg

SEQ ID NO: 1105107 - DNA, 18 bp, Homo sapiens
ccgcgctcgcccagcagg

SEQ ID NO: 1105108 - DNA, 19 bp, Homo sapiens
ccgcgctcgcccagcagga

SEQ ID NO: 1105109 - DNA, 19 bp, Homo sapiens
ccgcggacgtgctggcctt

SEQ ID NO: 1105110 - DNA, 15 bp, Homo sapiens
ccgcggagcctgcat

SEQ ID NO: 1105111 - DNA, 14 bp, Homo sapiens
ccgcggccctgggg

SEQ ID NO: 1105112 - DNA, 12 bp, Homo sapiens
ccgcggcctgga

SEQ ID NO: 1105113 - DNA, 17 bp, Homo sapiens
ccgcgggagacagcttc

SEQ ID NO: 1105114 - DNA, 20 bp, Homo sapiens
ccgcgggcgctcgctcaggt

SEQ ID NO: 1105115 - DNA, 22 bp, Homo sapiens
ccgcgggctgactgggccacag

SEQ ID NO: 1105116 - DNA, 20 bp, Homo sapiens
ccgcggggaagctggctttg

SEQ ID NO: 1105117 - DNA, 20 bp, Homo sapiens
ccgcggggaccctgccgagg

SEQ ID NO: 1105118 - DNA, 16 bp, Homo sapiens
ccgcgggttctagacg

SEQ ID NO: 1105119 - DNA, 12 bp, Homo sapiens
ccgcggtgctct

SEQ ID NO: 1105120 - DNA, 14 bp, Homo sapiens
ccgcggtgctctgg

SEQ ID NO: 1105121 - DNA, 20 bp, Homo sapiens
ccgcgtccaaccccggggca

SEQ ID NO: 1105122 - DNA, 16 bp, Homo sapiens
ccgctacctccctccc

SEQ ID NO: 1105123 - DNA, 16 bp, Homo sapiens
ccgctagaggcctgag

SEQ ID NO: 1105124 - DNA, 17 bp, Homo sapiens
ccgctagaggcctgagg

SEQ ID NO: 1105125 - DNA, 18 bp, Homo sapiens
ccgctagaggcctgagga

SEQ ID NO: 1105126 - DNA, 19 bp, Homo sapiens
ccgctagaggcctgaggat

SEQ ID NO: 1105127 - DNA, 21 bp, Homo sapiens
ccgctaggagagactgaaagc

SEQ ID NO: 1105128 - DNA, 21 bp, Homo sapiens
ccgctaggctcgccttccctc

SEQ ID NO: 1105129 - DNA, 11 bp, Homo sapiens
ccgctcagccc

SEQ ID NO: 1105130 - DNA, 22 bp, Homo sapiens
ccgctcagccctccctgcccct

SEQ ID NO: 1105131 - DNA, 22 bp, Homo sapiens
ccgctcagtgtcagcgggtgac

SEQ ID NO: 1105132 - DNA, 20 bp, Homo sapiens
ccgctcccaacccccctcct

SEQ ID NO: 1105133 - DNA, 14 bp, Homo sapiens
ccgctcccacagct

SEQ ID NO: 1105134 - DNA, 21 bp, Homo sapiens
ccgtgggccgtatctgtcaca

SEQ ID NO: 1105135 - DNA, 14 bp, Homo sapiens
ccgtgggctccctg

SEQ ID NO: 1105136 - DNA, 16 bp, Homo sapiens
ccgtggggtgctgccc

SEQ ID NO: 1105137 - DNA, 19 bp, Homo sapiens
ccgtggggtgctgccctta

SEQ ID NO: 1105138 - DNA, 19 bp, Homo sapiens
ccgtgtaaataatttatta

SEQ ID NO: 1105139 - DNA, 18 bp, Homo sapiens
ccgtgtcaagctgctctg

SEQ ID NO: 1105140 - DNA, 18 bp, Homo sapiens
ccgtgtcccaaggagctg

SEQ ID NO: 1105141 - DNA, 15 bp, Homo sapiens
ccgtgtcctcctctg

SEQ ID NO: 1105142 - DNA, 20 bp, Homo sapiens
ccgtgtctcagcctctgcca

SEQ ID NO: 1105143 - DNA, 13 bp, Homo sapiens
ccgtgtgaatgta

SEQ ID NO: 1105144 - DNA, 15 bp, Homo sapiens
ccgtgtgaatgtagc

SEQ ID NO: 1105145 - DNA, 23 bp, Homo sapiens
ccgtgtgagaagtgaatgctggg

SEQ ID NO: 1105146 - DNA, 18 bp, Homo sapiens
ccgtgtgagtgtgacagg

SEQ ID NO: 1105147 - DNA, 13 bp, Homo sapiens
ccgtgtggcccct

SEQ ID NO: 1105148 - DNA, 19 bp, Homo sapiens
ccgtgttagccaggatggt

SEQ ID NO: 1105149 - DNA, 14 bp, Homo sapiens
ccgtgttcccctct

SEQ ID NO: 1105150 - DNA, 17 bp, Homo sapiens
ccgttactctccaacct

SEQ ID NO: 1105151 - DNA, 22 bp, Homo sapiens
ccgttactctccaacctggaca

SEQ ID NO: 1105152 - DNA, 18 bp, Homo sapiens
ccgttcgtacgcccagga

SEQ ID NO: 1105153 - DNA, 20 bp, Homo sapiens
ccgttcgtacgcccaggaca

SEQ ID NO: 1105154 - DNA, 21 bp, Homo sapiens
ccgttctattgtgtggatgac

SEQ ID NO: 1105155 - DNA, 21 bp, Homo sapiens
ccgttctctgtccccaggtcc

SEQ ID NO: 1105156 - DNA, 23 bp, Homo sapiens
ccgttctgctggcctggatctcc

SEQ ID NO: 1105157 - DNA, 17 bp, Homo sapiens
ccgttgctgaaaatgat

SEQ ID NO: 1105158 - DNA, 20 bp, Homo sapiens
ccgttggggattggggaaga

SEQ ID NO: 1105159 - DNA, 12 bp, Homo sapiens
ccgttgtgagct

SEQ ID NO: 1105160 - DNA, 16 bp, Homo sapiens
ccgtttatgggccttg

SEQ ID NO: 1105161 - DNA, 18 bp, Homo sapiens
ccgtttcagaaggaccaa

SEQ ID NO: 1105162 - DNA, 12 bp, Homo sapiens
ccgtttcccggt

SEQ ID NO: 1105163 - DNA, 20 bp, Homo sapiens
ccgtttcccggttcaggacc

SEQ ID NO: 1105164 - DNA, 22 bp, Homo sapiens
ccgttttcacttgtctcctttc

SEQ ID NO: 1105165 - DNA, 18 bp, Homo sapiens
ccgttttcatcctggcct

SEQ ID NO: 1105166 - DNA, 15 bp, Homo sapiens
ccgttttggggacgt

SEQ ID NO: 1105167 - DNA, 14 bp, Homo sapiens
ccgttttgtcactt

SEQ ID NO: 1105168 - DNA, 14 bp, Homo sapiens
cctaaaaaagatat

SEQ ID NO: 1105169 - DNA, 18 bp, Homo sapiens
cctaaaaattcccttcct

SEQ ID NO: 1105170 - DNA, 19 bp, Homo sapiens
cctaaaaattcccttcctg

SEQ ID NO: 1105171 - DNA, 18 bp, Homo sapiens
cctaaaagcacactcatc

SEQ ID NO: 1105172 - DNA, 15 bp, Homo sapiens
cctaaaagtaaacat

SEQ ID NO: 1105173 - DNA, 18 bp, Homo sapiens
cctaaaataattggttct

SEQ ID NO: 1105174 - DNA, 18 bp, Homo sapiens
cctaaactgcagcctctc

SEQ ID NO: 1105175 - DNA, 16 bp, Homo sapiens
cctaaactttggcctt

SEQ ID NO: 1105176 - DNA, 16 bp, Homo sapiens
cctaaagaaaaacaaa

SEQ ID NO: 1105177 - DNA, 18 bp, Homo sapiens
cctaaagacgtctctttt

SEQ ID NO: 1105178 - DNA, 19 bp, Homo sapiens
cctaaagacgtctcttttt

SEQ ID NO: 1105179 - DNA, 13 bp, Homo sapiens
cctaaagagagta

SEQ ID NO: 1105180 - DNA, 23 bp, Homo sapiens
cctaaagagagtatttttataca

SEQ ID NO: 1105181 - DNA, 12 bp, Homo sapiens
cctaaagagata

SEQ ID NO: 1105182 - DNA, 18 bp, Homo sapiens
cctaaagatgggaggaga

SEQ ID NO: 1105183 - DNA, 20 bp, Homo sapiens
cctaaagcaaatctgccacc

SEQ ID NO: 1105184 - DNA, 22 bp, Homo sapiens
cctaaagccaaagtttctgttg

SEQ ID NO: 1105185 - DNA, 15 bp, Homo sapiens
cctaaagccatcatg

SEQ ID NO: 1105186 - DNA, 19 bp, Homo sapiens
cctaaagcctcaaaacaaa

SEQ ID NO: 1105187 - DNA, 18 bp, Homo sapiens
cctaaagctaaaaatatt

SEQ ID NO: 1105188 - DNA, 19 bp, Homo sapiens
cctaaataaacacatagat

SEQ ID NO: 1105189 - DNA, 14 bp, Homo sapiens
cctaaatatttatc

SEQ ID NO: 1105190 - DNA, 22 bp, Homo sapiens
cctaaatcaagcatctttctgt

SEQ ID NO: 1105191 - DNA, 16 bp, Homo sapiens
cctaaatgatggtgct

SEQ ID NO: 1105192 - DNA, 18 bp, Homo sapiens
cctaaatggcctcatgtg

SEQ ID NO: 1105193 - DNA, 19 bp, Homo sapiens
cctaaatttaatgctgcct

SEQ ID NO: 1105194 - DNA, 14 bp, Homo sapiens
cctaaatttattaa

SEQ ID NO: 1105195 - DNA, 17 bp, Homo sapiens
cctaacatgacagtatt

SEQ ID NO: 1105196 - DNA, 19 bp, Homo sapiens
cctaacccccagtcctcac

SEQ ID NO: 1105197 - DNA, 15 bp, Homo sapiens
cctaaccccttccag

SEQ ID NO: 1105198 - DNA, 16 bp, Homo sapiens
cctaaccccttccaga

SEQ ID NO: 1105199 - DNA, 18 bp, Homo sapiens
cctaaccccttccagatc

SEQ ID NO: 1105200 - DNA, 12 bp, Homo sapiens
cctaaccccttt

SEQ ID NO: 1105201 - DNA, 18 bp, Homo sapiens
cctaacctcgggcctgct

SEQ ID NO: 1105202 - DNA, 19 bp, Homo sapiens
cctaacctctaaccctcat

SEQ ID NO: 1105203 - DNA, 20 bp, Homo sapiens
cctaacttcctgtgcctttc

SEQ ID NO: 1105204 - DNA, 12 bp, Homo sapiens
cctaacttcctt

SEQ ID NO: 1105205 - DNA, 13 bp, Homo sapiens
cctaacttccttt

SEQ ID NO: 1105206 - DNA, 14 bp, Homo sapiens
cctaacttccttta

SEQ ID NO: 1105207 - DNA, 19 bp, Homo sapiens
cctaagaagttattttctt

SEQ ID NO: 1105208 - DNA, 14 bp, Homo sapiens
cctaagacatgtga

SEQ ID NO: 1105209 - DNA, 20 bp, Homo sapiens
cctaagagatgggactagga

SEQ ID NO: 1105210 - DNA, 16 bp, Homo sapiens
cctaagagatttatct

SEQ ID NO: 1105211 - DNA, 15 bp, Homo sapiens
cctaagagtggagga

SEQ ID NO: 1105212 - DNA, 21 bp, Homo sapiens
cctaagatgaagctgagcttt

SEQ ID NO: 1105213 - DNA, 19 bp, Homo sapiens
cctaagatgtgttcttatt

SEQ ID NO: 1105214 - DNA, 16 bp, Homo sapiens
cctaagcacttctaga

SEQ ID NO: 1105215 - DNA, 16 bp, Homo sapiens
cctaagccacttgaaa

SEQ ID NO: 1105216 - DNA, 14 bp, Homo sapiens
cctaagccagcctg

SEQ ID NO: 1105217 - DNA, 17 bp, Homo sapiens
cctaagccagcctggtc

SEQ ID NO: 1105218 - DNA, 19 bp, Homo sapiens
cctaagccagcctggtcca

SEQ ID NO: 1105219 - DNA, 13 bp, Homo sapiens
cctaagcccccag

SEQ ID NO: 1105220 - DNA, 15 bp, Homo sapiens
cctaagcccccaggg

SEQ ID NO: 1105221 - DNA, 18 bp, Homo sapiens
cctaagcccccagggcct

SEQ ID NO: 1105222 - DNA, 22 bp, Homo sapiens
cctaagcccccagggcctccag

SEQ ID NO: 1105223 - DNA, 21 bp, Homo sapiens
cctaagccccgtcccctaacc

SEQ ID NO: 1105224 - DNA, 14 bp, Homo sapiens
cctaagccctgccc

SEQ ID NO: 1105225 - DNA, 12 bp, Homo sapiens
cctaagcctgtt

SEQ ID NO: 1105226 - DNA, 20 bp, Homo sapiens
cctaagcggctgtttactgc

SEQ ID NO: 1105227 - DNA, 19 bp, Homo sapiens
cctaaggaagccagtcacc

SEQ ID NO: 1105228 - DNA, 13 bp, Homo sapiens
cctaaggacacac

SEQ ID NO: 1105229 - DNA, 14 bp, Homo sapiens
cctaaggctcccca

SEQ ID NO: 1105230 - DNA, 17 bp, Homo sapiens
cctaaggctccccaccc

SEQ ID NO: 1105231 - DNA, 15 bp, Homo sapiens
cctaagggcagccct

SEQ ID NO: 1105232 - DNA, 19 bp, Homo sapiens
cctaagtaagtttcttcct

SEQ ID NO: 1105233 - DNA, 15 bp, Homo sapiens
cctaagtagaccaaa

SEQ ID NO: 1105234 - DNA, 20 bp, Homo sapiens
cctaagtatcaagtatagaa

SEQ ID NO: 1105235 - DNA, 14 bp, Homo sapiens
cctaagtcccttcc

SEQ ID NO: 1105236 - DNA, 18 bp, Homo sapiens
cctaagtcccttcctatt

SEQ ID NO: 1105237 - DNA, 14 bp, Homo sapiens
cctaagtctctgtg

SEQ ID NO: 1105238 - DNA, 16 bp, Homo sapiens
cctaagtggctgctga

SEQ ID NO: 1105239 - DNA, 16 bp, Homo sapiens
cctaagtgttgattgt

SEQ ID NO: 1105240 - DNA, 23 bp, Homo sapiens
cctaagtgtttactatgtgccag

SEQ ID NO: 1105241 - DNA, 15 bp, Homo sapiens
cctaagttattacct

SEQ ID NO: 1105242 - DNA, 18 bp, Homo sapiens
cctaataaacatccttca

SEQ ID NO: 1105243 - DNA, 16 bp, Homo sapiens
cctaataaagttctgt

SEQ ID NO: 1105244 - DNA, 11 bp, Homo sapiens
cctaatatgat

SEQ ID NO: 1105245 - DNA, 16 bp, Homo sapiens
cctaatcactctgagt

SEQ ID NO: 1105246 - DNA, 21 bp, Homo sapiens
cctaatccctgggcattgctt

SEQ ID NO: 1105247 - DNA, 20 bp, Homo sapiens
cctaatctatggtcgggaga

SEQ ID NO: 1105248 - DNA, 13 bp, Homo sapiens
cctaatgtgtttc

SEQ ID NO: 1105249 - DNA, 14 bp, Homo sapiens
cctaatgttttgct

SEQ ID NO: 1105250 - DNA, 16 bp, Homo sapiens
cctaattaccagtctt

SEQ ID NO: 1105251 - DNA, 16 bp, Homo sapiens
cctaattccacagctg

SEQ ID NO: 1105252 - DNA, 23 bp, Homo sapiens
cctaatttctcctcccttccttt

SEQ ID NO: 1105253 - DNA, 23 bp, Homo sapiens
cctaattttgccaaaatcctgaa

SEQ ID NO: 1105254 - DNA, 19 bp, Homo sapiens
cctacaaccccagcctcct

SEQ ID NO: 1105255 - DNA, 16 bp, Homo sapiens
cctacaactaaaaata

SEQ ID NO: 1105256 - DNA, 22 bp, Homo sapiens
cctataaggagagttcaagcct

SEQ ID NO: 1105257 - DNA, 20 bp, Homo sapiens
cctataataaaatggcacct

SEQ ID NO: 1105258 - DNA, 21 bp, Homo sapiens
cctataataaaatggcacctt

SEQ ID NO: 1105259 - DNA, 15 bp, Homo sapiens
cctataatacaaata

SEQ ID NO: 1105260 - DNA, 23 bp, Homo sapiens
cctataatctgtcaaaacactgt

SEQ ID NO: 1105261 - DNA, 19 bp, Homo sapiens
cctatacagaacagagggc

SEQ ID NO: 1105262 - DNA, 18 bp, Homo sapiens
cctataccatatgtctgc

SEQ ID NO: 1105263 - DNA, 21 bp, Homo sapiens
cctataccatatgtctgcttc

SEQ ID NO: 1105264 - DNA, 22 bp, Homo sapiens
cctataccatatgtctgcttct

SEQ ID NO: 1105265 - DNA, 18 bp, Homo sapiens
cctatagaaatagaacac

SEQ ID NO: 1105266 - DNA, 21 bp, Homo sapiens
cctatagagagggggctctcc

SEQ ID NO: 1105267 - DNA, 20 bp, Homo sapiens
cctataggaaagtctgtcag

SEQ ID NO: 1105268 - DNA, 14 bp, Homo sapiens
cctatagtcccagc

SEQ ID NO: 1105269 - DNA, 15 bp, Homo sapiens
cctatagtttcacca

SEQ ID NO: 1105270 - DNA, 23 bp, Homo sapiens
cctatagtttcaccactcctctc

SEQ ID NO: 1105271 - DNA, 22 bp, Homo sapiens
cctatatctgtttgtatatttg

SEQ ID NO: 1105272 - DNA, 15 bp, Homo sapiens
cctatattgatttaa

SEQ ID NO: 1105273 - DNA, 16 bp, Homo sapiens
cctatattgatttaaa

SEQ ID NO: 1105274 - DNA, 22 bp, Homo sapiens
cctatattgttttcagtgtaca

SEQ ID NO: 1105275 - DNA, 16 bp, Homo sapiens
cctatcaaaaattatt

SEQ ID NO: 1105276 - DNA, 16 bp, Homo sapiens
cctatcacctatttcc

SEQ ID NO: 1105277 - DNA, 15 bp, Homo sapiens
cctatcacctcccct

SEQ ID NO: 1105278 - DNA, 17 bp, Homo sapiens
cctatcagaagtttctc

SEQ ID NO: 1105279 - DNA, 20 bp, Homo sapiens
cctatcagagttgctgcaaa

SEQ ID NO: 1105280 - DNA, 13 bp, Homo sapiens
cctatcctcccct

SEQ ID NO: 1105281 - DNA, 14 bp, Homo sapiens
cctatcctcccctt

SEQ ID NO: 1105282 - DNA, 19 bp, Homo sapiens
cctatcctggtttttgtag

SEQ ID NO: 1105283 - DNA, 23 bp, Homo sapiens
cctatccttggagagcagctggc

SEQ ID NO: 1105284 - DNA, 18 bp, Homo sapiens
cctatctaaccctcccat

SEQ ID NO: 1105285 - DNA, 16 bp, Homo sapiens
cctatctatcttccaa

SEQ ID NO: 1105286 - DNA, 21 bp, Homo sapiens
cctatctatcttccaaatgca

SEQ ID NO: 1105287 - DNA, 17 bp, Homo sapiens
cctatctatgaacaaca

SEQ ID NO: 1105288 - DNA, 19 bp, Homo sapiens
cctatctatgaacaacagt

SEQ ID NO: 1105289 - DNA, 17 bp, Homo sapiens
cctatctattaaagtga

SEQ ID NO: 1105290 - DNA, 15 bp, Homo sapiens
cctatctcctgacag

SEQ ID NO: 1105291 - DNA, 18 bp, Homo sapiens
cctatctcgtgggagagc

SEQ ID NO: 1105292 - DNA, 17 bp, Homo sapiens
cctatctggggagctcc

SEQ ID NO: 1105293 - DNA, 13 bp, Homo sapiens
cctatctttaaac

SEQ ID NO: 1105294 - DNA, 14 bp, Homo sapiens
cctatctttaaaca

SEQ ID NO: 1105295 - DNA, 16 bp, Homo sapiens
cctatgacacagttat

SEQ ID NO: 1105296 - DNA, 17 bp, Homo sapiens
cctatgagatggccatg

SEQ ID NO: 1105297 - DNA, 21 bp, Homo sapiens
cctatgagatggccatgctca

SEQ ID NO: 1105298 - DNA, 15 bp, Homo sapiens
cctatgatggatggc

SEQ ID NO: 1105299 - DNA, 22 bp, Homo sapiens
cctatgcagacatctctggagc

SEQ ID NO: 1105300 - DNA, 19 bp, Homo sapiens
cctatgcagaggtccacaa

SEQ ID NO: 1105301 - DNA, 17 bp, Homo sapiens
cctatgcagggaggcca

SEQ ID NO: 1105302 - DNA, 20 bp, Homo sapiens
cctatgcccaggtaccaccc

SEQ ID NO: 1105303 - DNA, 12 bp, Homo sapiens
cctatgccctgc

SEQ ID NO: 1105304 - DNA, 20 bp, Homo sapiens
cctatgccctgcccttcctc

SEQ ID NO: 1105305 - DNA, 15 bp, Homo sapiens
cctatgcctgtggtg

SEQ ID NO: 1105306 - DNA, 21 bp, Homo sapiens
cctatgctattgacaataaaa

SEQ ID NO: 1105307 - DNA, 22 bp, Homo sapiens
cctatgctattgacaataaaat

SEQ ID NO: 1105308 - DNA, 18 bp, Homo sapiens
cctatgcttaataaaaga

SEQ ID NO: 1105309 - DNA, 13 bp, Homo sapiens
cctatggaaacat

SEQ ID NO: 1105310 - DNA, 15 bp, Homo sapiens
cctatggaaacattt

SEQ ID NO: 1105311 - DNA, 17 bp, Homo sapiens
cctatggaagtggttct

SEQ ID NO: 1105312 - DNA, 22 bp, Homo sapiens
cctatgtaagaattcagaagac

SEQ ID NO: 1105313 - DNA, 14 bp, Homo sapiens
cctatgtacagagc

SEQ ID NO: 1105314 - DNA, 16 bp, Homo sapiens
cctatgtacagagctt

SEQ ID NO: 1105315 - DNA, 23 bp, Homo sapiens
cctatgtactctacgccaaagtg

SEQ ID NO: 1105316 - DNA, 16 bp, Homo sapiens
cctatgtagtccgtgc

SEQ ID NO: 1105317 - DNA, 14 bp, Homo sapiens
cctatgtcctaagg

SEQ ID NO: 1105318 - DNA, 19 bp, Homo sapiens
cctatgtcctaaggacaca

SEQ ID NO: 1105319 - DNA, 11 bp, Homo sapiens
cctatgtgtaa

SEQ ID NO: 1105320 - DNA, 12 bp, Homo sapiens
cctatgttattt

SEQ ID NO: 1105321 - DNA, 19 bp, Homo sapiens
cctattatttccgggtgga

SEQ ID NO: 1105322 - DNA, 23 bp, Homo sapiens
cctattcaccctccacttcccgt

SEQ ID NO: 1105323 - DNA, 22 bp, Homo sapiens
cctattctattgcagttataga

SEQ ID NO: 1105324 - DNA, 16 bp, Homo sapiens
cctattctcaccagga

SEQ ID NO: 1105325 - DNA, 19 bp, Homo sapiens
cctattctcaccaggaagg

SEQ ID NO: 1105326 - DNA, 15 bp, Homo sapiens
cctattctcctgcca

SEQ ID NO: 1105327 - DNA, 16 bp, Homo sapiens
cctattctcctgccat

SEQ ID NO: 1105328 - DNA, 17 bp, Homo sapiens
cctatttattgactttg

SEQ ID NO: 1105329 - DNA, 19 bp, Homo sapiens
cctatttcagtgttacctg

SEQ ID NO: 1105330 - DNA, 19 bp, Homo sapiens
cctatttctatgtcatttt

SEQ ID NO: 1105331 - DNA, 22 bp, Homo sapiens
cctatttctatgtcatttttaa

SEQ ID NO: 1105332 - DNA, 16 bp, Homo sapiens
cctatttctgatgatg

SEQ ID NO: 1105333 - DNA, 20 bp, Homo sapiens
cctattttcatttgtacaag

SEQ ID NO: 1105334 - DNA, 19 bp, Homo sapiens
cctattttctatccccctt

SEQ ID NO: 1105335 - DNA, 20 bp, Homo sapiens
cctatttttgacatggaaat

SEQ ID NO: 1105336 - DNA, 23 bp, Homo sapiens
cctatttttgacatggaaatgaa

SEQ ID NO: 1105337 - DNA, 14 bp, Homo sapiens
cctcaaaacaaagg

SEQ ID NO: 1105338 - DNA, 15 bp, Homo sapiens
cctcaaaactggagt

SEQ ID NO: 1105339 - DNA, 18 bp, Homo sapiens
cctcaaaattgataatta

SEQ ID NO: 1105340 - DNA, 13 bp, Homo sapiens
cctcaaacctcct

SEQ ID NO: 1105341 - DNA, 16 bp, Homo sapiens
cctcaaactgcacatc

SEQ ID NO: 1105342 - DNA, 21 bp, Homo sapiens
cctcaaagcaagcattcagaa

SEQ ID NO: 1105343 - DNA, 20 bp, Homo sapiens
cctcaaatcagtcttccttg

SEQ ID NO: 1105344 - DNA, 13 bp, Homo sapiens
cctcaaatgtcag

SEQ ID NO: 1105345 - DNA, 16 bp, Homo sapiens
cctcaaattttttgac

SEQ ID NO: 1105346 - DNA, 18 bp, Homo sapiens
cctcaacaccctgcttct

SEQ ID NO: 1105347 - DNA, 22 bp, Homo sapiens
cctcaacccatatttcatccag

SEQ ID NO: 1105348 - DNA, 16 bp, Homo sapiens
cctcaaccctccctca

SEQ ID NO: 1105349 - DNA, 18 bp, Homo sapiens
cctcaaccctccctcagc

SEQ ID NO: 1105350 - DNA, 19 bp, Homo sapiens
cctcaaccctccctcagcc

SEQ ID NO: 1105351 - DNA, 14 bp, Homo sapiens
cctcaacctgtgat

SEQ ID NO: 1105352 - DNA, 14 bp, Homo sapiens
cctcaactgcctac

SEQ ID NO: 1105353 - DNA, 18 bp, Homo sapiens
cctcaagactttgatcct

SEQ ID NO: 1105354 - DNA, 17 bp, Homo sapiens
cctcaagcaataattgt

SEQ ID NO: 1105355 - DNA, 20 bp, Homo sapiens
cctcaagcaatccacctgcc

SEQ ID NO: 1105356 - DNA, 16 bp, Homo sapiens
cctcaagccaatcccc

SEQ ID NO: 1105357 - DNA, 12 bp, Homo sapiens
cctcaagccatc

SEQ ID NO: 1105358 - DNA, 18 bp, Homo sapiens
cctcaagccccatttcct

SEQ ID NO: 1105359 - DNA, 12 bp, Homo sapiens
cctcaagcctgt

SEQ ID NO: 1105360 - DNA, 13 bp, Homo sapiens
cctcaagcctgtg

SEQ ID NO: 1105361 - DNA, 20 bp, Homo sapiens
cctcaagcctgtgggcagca

SEQ ID NO: 1105362 - DNA, 12 bp, Homo sapiens
cctcaaggactt

SEQ ID NO: 1105363 - DNA, 21 bp, Homo sapiens
cctcaaggacttgaaagcatc

SEQ ID NO: 1105364 - DNA, 18 bp, Homo sapiens
cctcaaggggcagggagg

SEQ ID NO: 1105365 - DNA, 19 bp, Homo sapiens
cctcaagggggactgtctt

SEQ ID NO: 1105366 - DNA, 20 bp, Homo sapiens
cctcaagttcttggaccagt

SEQ ID NO: 1105367 - DNA, 16 bp, Homo sapiens
cctcaatctaaggcct

SEQ ID NO: 1105368 - DNA, 23 bp, Homo sapiens
cctcaatgccagtaacgcgtctt

SEQ ID NO: 1105369 - DNA, 16 bp, Homo sapiens
cctcaatgccctgcca

SEQ ID NO: 1105370 - DNA, 20 bp, Homo sapiens
cctcaatgtgaatcagaccc

SEQ ID NO: 1105371 - DNA, 14 bp, Homo sapiens
cctcaatgtgacca

SEQ ID NO: 1105372 - DNA, 20 bp, Homo sapiens
cctcacacacacagctgggc

SEQ ID NO: 1105373 - DNA, 14 bp, Homo sapiens
cctcacacccctgt

SEQ ID NO: 1105374 - DNA, 15 bp, Homo sapiens
cctcacacccctgtc

SEQ ID NO: 1105375 - DNA, 20 bp, Homo sapiens
cctcacacccctgtcccacc

SEQ ID NO: 1105376 - DNA, 18 bp, Homo sapiens
cctcacactacagatcag

SEQ ID NO: 1105377 - DNA, 15 bp, Homo sapiens
cctcatctttctcct

SEQ ID NO: 1105378 - DNA, 21 bp, Homo sapiens
cctcatgaaaacacacataca

SEQ ID NO: 1105379 - DNA, 17 bp, Homo sapiens
cctcatgccacaccttc

SEQ ID NO: 1105380 - DNA, 13 bp, Homo sapiens
cctcatgcccacc

SEQ ID NO: 1105381 - DNA, 15 bp, Homo sapiens
cctcatgcccacccc

SEQ ID NO: 1105382 - DNA, 14 bp, Homo sapiens
cctcatgcccagct

SEQ ID NO: 1105383 - DNA, 19 bp, Homo sapiens
cctcatgcccagctctctg

SEQ ID NO: 1105384 - DNA, 14 bp, Homo sapiens
cctcatggagacct

SEQ ID NO: 1105385 - DNA, 16 bp, Homo sapiens
cctcatggattgccac

SEQ ID NO: 1105386 - DNA, 18 bp, Homo sapiens
cctcatggattgccacag

SEQ ID NO: 1105387 - DNA, 19 bp, Homo sapiens
cctcatggattgccacagc

SEQ ID NO: 1105388 - DNA, 12 bp, Homo sapiens
cctcatgtaaca

SEQ ID NO: 1105389 - DNA, 14 bp, Homo sapiens
cctcatgtaacatt

SEQ ID NO: 1105390 - DNA, 21 bp, Homo sapiens
cctcatgtacataccctggcc

SEQ ID NO: 1105391 - DNA, 13 bp, Homo sapiens
cctcatgtggctg

SEQ ID NO: 1105392 - DNA, 15 bp, Homo sapiens
cctcatgtggctgga

SEQ ID NO: 1105393 - DNA, 19 bp, Homo sapiens
cctcatgttctcttcccag

SEQ ID NO: 1105394 - DNA, 21 bp, Homo sapiens
cctcatgttctcttcccaggc

SEQ ID NO: 1105395 - DNA, 24 bp, Homo sapiens
cctcatgttctcttcccaggcctt

SEQ ID NO: 1105396 - DNA, 16 bp, Homo sapiens
cctcatgttctgtggg

SEQ ID NO: 1105397 - DNA, 19 bp, Homo sapiens
cctcatgttcttaattctt

SEQ ID NO: 1105398 - DNA, 19 bp, Homo sapiens
cctcattcagagactgccc

SEQ ID NO: 1105399 - DNA, 12 bp, Homo sapiens
cctcattcatct

SEQ ID NO: 1105400 - DNA, 21 bp, Homo sapiens
cctcattccaccttcccatgc

SEQ ID NO: 1105401 - DNA, 13 bp, Homo sapiens
cctcattcctgaa

SEQ ID NO: 1105402 - DNA, 16 bp, Homo sapiens
cctcattgcctcctgt

SEQ ID NO: 1105403 - DNA, 14 bp, Homo sapiens
cctcattgctgtct

SEQ ID NO: 1105404 - DNA, 16 bp, Homo sapiens
cctcattgctgtcttg

SEQ ID NO: 1105405 - DNA, 20 bp, Homo sapiens
cctcattgctgtcttgcccc

SEQ ID NO: 1105406 - DNA, 17 bp, Homo sapiens
cctcattgtgccaagcc

SEQ ID NO: 1105407 - DNA, 22 bp, Homo sapiens
cctcattgtgccaagccttctg

SEQ ID NO: 1105408 - DNA, 16 bp, Homo sapiens
cctcatttctttgtct

SEQ ID NO: 1105409 - DNA, 18 bp, Homo sapiens
cctccaaacctccagcct

SEQ ID NO: 1105410 - DNA, 19 bp, Homo sapiens
cctccaaacctccagcctc

SEQ ID NO: 1105411 - DNA, 11 bp, Homo sapiens
cctccaaagag

SEQ ID NO: 1105412 - DNA, 19 bp, Homo sapiens
cctccaaagcttcccacgg

SEQ ID NO: 1105413 - DNA, 16 bp, Homo sapiens
cctccaaaggaagggg

SEQ ID NO: 1105414 - DNA, 17 bp, Homo sapiens
cctccaaagtggagctg

SEQ ID NO: 1105415 - DNA, 20 bp, Homo sapiens
cctccaaccaaataagactt

SEQ ID NO: 1105416 - DNA, 13 bp, Homo sapiens
cctccaaccctgc

SEQ ID NO: 1105417 - DNA, 16 bp, Homo sapiens
cctccaacgcccctgt

SEQ ID NO: 1105418 - DNA, 21 bp, Homo sapiens
cctccaacgcccctgtggcca

SEQ ID NO: 1105419 - DNA, 16 bp, Homo sapiens
cctccaagcacagagc

SEQ ID NO: 1105420 - DNA, 18 bp, Homo sapiens
cctccaagcacagagcct

SEQ ID NO: 1105421 - DNA, 17 bp, Homo sapiens
cctccaagcctggcacc

SEQ ID NO: 1105422 - DNA, 16 bp, Homo sapiens
cctccaagcggccctg

SEQ ID NO: 1105423 - DNA, 21 bp, Homo sapiens
cctccaagctccatctccact

SEQ ID NO: 1105424 - DNA, 22 bp, Homo sapiens
cctccaagctccatctccactc

SEQ ID NO: 1105425 - DNA, 14 bp, Homo sapiens
cctccaaggaaaga

SEQ ID NO: 1105426 - DNA, 20 bp, Homo sapiens
cctccaaggaggggctgtaa

SEQ ID NO: 1105427 - DNA, 15 bp, Homo sapiens
cctccaagggtttcg

SEQ ID NO: 1105428 - DNA, 12 bp, Homo sapiens
cctccaatgtcc

SEQ ID NO: 1105429 - DNA, 16 bp, Homo sapiens
cctccaatgtcctgaa

SEQ ID NO: 1105430 - DNA, 13 bp, Homo sapiens
cctccacaccagt

SEQ ID NO: 1105431 - DNA, 23 bp, Homo sapiens
cctccacaccagtggcctcgtgg

SEQ ID NO: 1105432 - DNA, 21 bp, Homo sapiens
cctccacagagaggaggggac

SEQ ID NO: 1105433 - DNA, 16 bp, Homo sapiens
cctccacagccgcagc

SEQ ID NO: 1105434 - DNA, 13 bp, Homo sapiens
cctccacagctgc

SEQ ID NO: 1105435 - DNA, 11 bp, Homo sapiens
cctccacagtc

SEQ ID NO: 1105436 - DNA, 13 bp, Homo sapiens
cctccacagtccc

SEQ ID NO: 1105437 - DNA, 18 bp, Homo sapiens
cctccacagtcccccacc

SEQ ID NO: 1105438 - DNA, 14 bp, Homo sapiens
cctccacatcctcc

SEQ ID NO: 1105439 - DNA, 16 bp, Homo sapiens
cctccacatcctccac

SEQ ID NO: 1105440 - DNA, 20 bp, Homo sapiens
cctccacatgctgcctggca

SEQ ID NO: 1105441 - DNA, 22 bp, Homo sapiens
cctccaccacatctgccagacc

SEQ ID NO: 1105442 - DNA, 19 bp, Homo sapiens
cctccaccaccactggcca

SEQ ID NO: 1105443 - DNA, 21 bp, Homo sapiens
cctccaccaccactggccacc

SEQ ID NO: 1105444 - DNA, 23 bp, Homo sapiens
cctccaccaccactggccaccag

SEQ ID NO: 1105445 - DNA, 12 bp, Homo sapiens
cctccaccagcc

SEQ ID NO: 1105446 - DNA, 13 bp, Homo sapiens
cctccacccagcc

SEQ ID NO: 1105447 - DNA, 19 bp, Homo sapiens
cctccacccagcccctggc

SEQ ID NO: 1105448 - DNA, 19 bp, Homo sapiens
cctccacccccgccacggc

SEQ ID NO: 1105449 - DNA, 20 bp, Homo sapiens
cctccacccccgccacggcc

SEQ ID NO: 1105450 - DNA, 22 bp, Homo sapiens
cctccacccgtcctccctcagc

SEQ ID NO: 1105451 - DNA, 14 bp, Homo sapiens
cctccaccctgcat

SEQ ID NO: 1105452 - DNA, 21 bp, Homo sapiens
cctccaccctgcattttcctc

SEQ ID NO: 1105453 - DNA, 14 bp, Homo sapiens
cctccaccctgtcc

SEQ ID NO: 1105454 - DNA, 19 bp, Homo sapiens
cctccaccctgtcccccag

SEQ ID NO: 1105455 - DNA, 14 bp, Homo sapiens
cctccacctctcac

SEQ ID NO: 1105456 - DNA, 19 bp, Homo sapiens
cctccacctctcacgggcc

SEQ ID NO: 1105457 - DNA, 14 bp, Homo sapiens
cctccacgcctcct

SEQ ID NO: 1105458 - DNA, 12 bp, Homo sapiens
cctccacgtgat

SEQ ID NO: 1105459 - DNA, 18 bp, Homo sapiens
cctccacgttctgctcat

SEQ ID NO: 1105460 - DNA, 21 bp, Homo sapiens
cctccacgttctgctcatcat

SEQ ID NO: 1105461 - DNA, 22 bp, Homo sapiens
cctccactcaccacaagctgag

SEQ ID NO: 1105462 - DNA, 15 bp, Homo sapiens
cctccactcactcca

SEQ ID NO: 1105463 - DNA, 20 bp, Homo sapiens
cctccactcccccacctgac

SEQ ID NO: 1105464 - DNA, 20 bp, Homo sapiens
cctccactctagttctagat

SEQ ID NO: 1105465 - DNA, 21 bp, Homo sapiens
cctccactggggaatgctccc

SEQ ID NO: 1105466 - DNA, 21 bp, Homo sapiens
cctccagaactcactggggcc

SEQ ID NO: 1105467 - DNA, 13 bp, Homo sapiens
cctccagaagcct

SEQ ID NO: 1105468 - DNA, 19 bp, Homo sapiens
cctccagaagcctctggct

SEQ ID NO: 1105469 - DNA, 20 bp, Homo sapiens
cctccagaagcctctggcta

SEQ ID NO: 1105470 - DNA, 13 bp, Homo sapiens
cctccagaagctg

SEQ ID NO: 1105471 - DNA, 15 bp, Homo sapiens
cctccagaagctgct

SEQ ID NO: 1105472 - DNA, 15 bp, Homo sapiens
cctccagaccaccag

SEQ ID NO: 1105473 - DNA, 14 bp, Homo sapiens
cctccagaccctgc

SEQ ID NO: 1105474 - DNA, 17 bp, Homo sapiens
cctccagaccctgcctg

SEQ ID NO: 1105475 - DNA, 13 bp, Homo sapiens
cctccagagaagc

SEQ ID NO: 1105476 - DNA, 15 bp, Homo sapiens
cctccagagaagccc

SEQ ID NO: 1105477 - DNA, 17 bp, Homo sapiens
cctccagagacaacagg

SEQ ID NO: 1105478 - DNA, 14 bp, Homo sapiens
cctccagagccagc

SEQ ID NO: 1105479 - DNA, 18 bp, Homo sapiens
cctccagagccagcctgg

SEQ ID NO: 1105480 - DNA, 19 bp, Homo sapiens
cctccagagccagcctggg

SEQ ID NO: 1105481 - DNA, 22 bp, Homo sapiens
cctccagaggtcctccgtaggg

SEQ ID NO: 1105482 - DNA, 23 bp, Homo sapiens
cctccagaggtggaggtgggctg

SEQ ID NO: 1105483 - DNA, 13 bp, Homo sapiens
cctccagcaggga

SEQ ID NO: 1105484 - DNA, 20 bp, Homo sapiens
cctccagccccgcgaccatg

SEQ ID NO: 1105485 - DNA, 12 bp, Homo sapiens
cctccagcccgg

SEQ ID NO: 1105486 - DNA, 20 bp, Homo sapiens
cctccagcccgggagcctag

SEQ ID NO: 1105487 - DNA, 22 bp, Homo sapiens
cctccagcccgggagcctagga

SEQ ID NO: 1105488 - DNA, 23 bp, Homo sapiens
cctccagcccgggagcctaggac

SEQ ID NO: 1105489 - DNA, 19 bp, Homo sapiens
cctccagccctgcccaccc

SEQ ID NO: 1105490 - DNA, 14 bp, Homo sapiens
cctccagcccttca

SEQ ID NO: 1105491 - DNA, 15 bp, Homo sapiens
cctccagcctcccct

SEQ ID NO: 1105492 - DNA, 13 bp, Homo sapiens
cctccagcctctc

SEQ ID NO: 1105493 - DNA, 20 bp, Homo sapiens
cctccagcctttgctccctc

SEQ ID NO: 1105494 - DNA, 14 bp, Homo sapiens
cctccagctgcacc

SEQ ID NO: 1105495 - DNA, 15 bp, Homo sapiens
cctccagctgcacca

SEQ ID NO: 1105496 - DNA, 16 bp, Homo sapiens
cctccagctgcaccag

SEQ ID NO: 1105497 - DNA, 20 bp, Homo sapiens
cctccagctgcaccagagca

SEQ ID NO: 1105498 - DNA, 19 bp, Homo sapiens
cctccagcttttcctcagg

SEQ ID NO: 1105499 - DNA, 13 bp, Homo sapiens
cctccccctcact

SEQ ID NO: 1105500 - DNA, 12 bp, Homo sapiens
cctccccctgag

SEQ ID NO: 1105501 - DNA, 11 bp, Homo sapiens
cctccccctgc

SEQ ID NO: 1105502 - DNA, 13 bp, Homo sapiens
cctccccctgcaa

SEQ ID NO: 1105503 - DNA, 17 bp, Homo sapiens
cctccccctgccagtgc

SEQ ID NO: 1105504 - DNA, 18 bp, Homo sapiens
cctccccctgccagtgcc

SEQ ID NO: 1105505 - DNA, 20 bp, Homo sapiens
cctccccctgccagtgcctt

SEQ ID NO: 1105506 - DNA, 12 bp, Homo sapiens
cctcccccttct

SEQ ID NO: 1105507 - DNA, 18 bp, Homo sapiens
cctccccgatccccgaca

SEQ ID NO: 1105508 - DNA, 12 bp, Homo sapiens
cctccccgcccc

SEQ ID NO: 1105509 - DNA, 22 bp, Homo sapiens
cctccccgcctcctcccactgg

SEQ ID NO: 1105510 - DNA, 19 bp, Homo sapiens
cctccccgcgcgttccttc

SEQ ID NO: 1105511 - DNA, 23 bp, Homo sapiens
cctccccgctccgtctctgtcct

SEQ ID NO: 1105512 - DNA, 21 bp, Homo sapiens
cctccccggccctaccagcgc

SEQ ID NO: 1105513 - DNA, 16 bp, Homo sapiens
cctccccgtccctgtc

SEQ ID NO: 1105514 - DNA, 18 bp, Homo sapiens
cctccccgtccctgtccc

SEQ ID NO: 1105515 - DNA, 22 bp, Homo sapiens
cctccccgtccctgtcccccag

SEQ ID NO: 1105516 - DNA, 17 bp, Homo sapiens
cctcccctatccaccca

SEQ ID NO: 1105517 - DNA, 14 bp, Homo sapiens
cctcccctcaacag

SEQ ID NO: 1105518 - DNA, 14 bp, Homo sapiens
cctcccctcagagc

SEQ ID NO: 1105519 - DNA, 15 bp, Homo sapiens
cctcccctcagagcc

SEQ ID NO: 1105520 - DNA, 17 bp, Homo sapiens
cctcccctcagagccca

SEQ ID NO: 1105521 - DNA, 13 bp, Homo sapiens
cctcccctcagcg

SEQ ID NO: 1105522 - DNA, 14 bp, Homo sapiens
cctcccctcccctg

SEQ ID NO: 1105523 - DNA, 16 bp, Homo sapiens
cctcccctcccctggg

SEQ ID NO: 1105524 - DNA, 17 bp, Homo sapiens
cctcccctcctcttccc

SEQ ID NO: 1105525 - DNA, 15 bp, Homo sapiens
cctcccctctcagaa

SEQ ID NO: 1105526 - DNA, 18 bp, Homo sapiens
cctcccctctcagaacat

SEQ ID NO: 1105527 - DNA, 24 bp, Homo sapiens
cctcccctctcatccccctgtgga

SEQ ID NO: 1105528 - DNA, 17 bp, Homo sapiens
cctcccctctcttgcac

SEQ ID NO: 1105529 - DNA, 14 bp, Homo sapiens
cctcccctcttgag

SEQ ID NO: 1105530 - DNA, 17 bp, Homo sapiens
cctcccctgccaccagg

SEQ ID NO: 1105531 - DNA, 13 bp, Homo sapiens
cctcccctgcctt

SEQ ID NO: 1105532 - DNA, 14 bp, Homo sapiens
cctcccctgccttg

SEQ ID NO: 1105533 - DNA, 16 bp, Homo sapiens
cctcccctgctgaagg

SEQ ID NO: 1105534 - DNA, 13 bp, Homo sapiens
cctcccctgggca

SEQ ID NO: 1105535 - DNA, 14 bp, Homo sapiens
cctcccctgggcag

SEQ ID NO: 1105536 - DNA, 18 bp, Homo sapiens
cctccccttcttcccgcc

SEQ ID NO: 1105537 - DNA, 13 bp, Homo sapiens
cctccccttgggc

SEQ ID NO: 1105538 - DNA, 16 bp, Homo sapiens
cctccccttgggcggc

SEQ ID NO: 1105539 - DNA, 23 bp, Homo sapiens
cctccccttgggcggctgagagc

SEQ ID NO: 1105540 - DNA, 19 bp, Homo sapiens
cctccccttttaccactcc

SEQ ID NO: 1105541 - DNA, 20 bp, Homo sapiens
cctccccttttaccactccc

SEQ ID NO: 1105542 - DNA, 22 bp, Homo sapiens
cctccccttttaccactcccag

SEQ ID NO: 1105543 - DNA, 20 bp, Homo sapiens
cctcccgaaaaatgtgtggt

SEQ ID NO: 1105544 - DNA, 15 bp, Homo sapiens
cctcccgaagccacc

SEQ ID NO: 1105545 - DNA, 19 bp, Homo sapiens
cctcccgagctcctcttcc

SEQ ID NO: 1105546 - DNA, 18 bp, Homo sapiens
cctcccgagtagctggga

SEQ ID NO: 1105547 - DNA, 19 bp, Homo sapiens
cctcccgagtagctgggat

SEQ ID NO: 1105548 - DNA, 12 bp, Homo sapiens
cctcccgccctc

SEQ ID NO: 1105549 - DNA, 15 bp, Homo sapiens
cctcccggcatggga

SEQ ID NO: 1105550 - DNA, 17 bp, Homo sapiens
cctcccggctgccccca

SEQ ID NO: 1105551 - DNA, 16 bp, Homo sapiens
cctcccggtgcccaag

SEQ ID NO: 1105552 - DNA, 19 bp, Homo sapiens
cctcccgtagtctcctggg

SEQ ID NO: 1105553 - DNA, 14 bp, Homo sapiens
cctccctaccctcg

SEQ ID NO: 1105554 - DNA, 16 bp, Homo sapiens
cctccctaccctcgga

SEQ ID NO: 1105555 - DNA, 15 bp, Homo sapiens
cctccctactcccct

SEQ ID NO: 1105556 - DNA, 18 bp, Homo sapiens
cctccctactcccctggg

SEQ ID NO: 1105557 - DNA, 15 bp, Homo sapiens
cctccctagccagca

SEQ ID NO: 1105558 - DNA, 18 bp, Homo sapiens
cctccctagcccttccag

SEQ ID NO: 1105559 - DNA, 20 bp, Homo sapiens
cctccctagcccttccagcc

SEQ ID NO: 1105560 - DNA, 21 bp, Homo sapiens
cctccctagcccttccagcct

SEQ ID NO: 1105561 - DNA, 20 bp, Homo sapiens
cctccctatatgcacccctg

SEQ ID NO: 1105562 - DNA, 19 bp, Homo sapiens
cctccctcaccctgagccc

SEQ ID NO: 1105563 - DNA, 14 bp, Homo sapiens
cctccctcagcccc

SEQ ID NO: 1105564 - DNA, 20 bp, Homo sapiens
cctccctcagcccctcttgc

SEQ ID NO: 1105565 - DNA, 14 bp, Homo sapiens
cctccctcagcctc

SEQ ID NO: 1105566 - DNA, 15 bp, Homo sapiens
cctccctcagcctcc

SEQ ID NO: 1105567 - DNA, 16 bp, Homo sapiens
cctccctcagcctccc

SEQ ID NO: 1105568 - DNA, 18 bp, Homo sapiens
cctccctcagcctcccct

SEQ ID NO: 1105569 - DNA, 22 bp, Homo sapiens
cctccctcagctctctgggacc

SEQ ID NO: 1105570 - DNA, 17 bp, Homo sapiens
cctccctcattcatctt

SEQ ID NO: 1105571 - DNA, 14 bp, Homo sapiens
cctccctccaagcc

SEQ ID NO: 1105572 - DNA, 18 bp, Homo sapiens
cctccctccaagcctggc

SEQ ID NO: 1105573 - DNA, 16 bp, Homo sapiens
cctccctccaccccag

SEQ ID NO: 1105574 - DNA, 13 bp, Homo sapiens
cctccctcccaca

SEQ ID NO: 1105575 - DNA, 14 bp, Homo sapiens
cctccctcccggca

SEQ ID NO: 1105576 - DNA, 15 bp, Homo sapiens
cctccctccctcttt

SEQ ID NO: 1105577 - DNA, 16 bp, Homo sapiens
cctccctcccttcctt

SEQ ID NO: 1105578 - DNA, 15 bp, Homo sapiens
cctccctccgagtga

SEQ ID NO: 1105579 - DNA, 23 bp, Homo sapiens
cctccctccggccatactgcctt

SEQ ID NO: 1105580 - DNA, 12 bp, Homo sapiens
cctccctcctgc

SEQ ID NO: 1105581 - DNA, 22 bp, Homo sapiens
cctccctcgccccaaggttcca

SEQ ID NO: 1105582 - DNA, 23 bp, Homo sapiens
cctccctctcagaggcctgctgc

SEQ ID NO: 1105583 - DNA, 13 bp, Homo sapiens
cctccctctccat

SEQ ID NO: 1105584 - DNA, 13 bp, Homo sapiens
cctccctctctca

SEQ ID NO: 1105585 - DNA, 22 bp, Homo sapiens
cctccctctctcatgagaagcc

SEQ ID NO: 1105586 - DNA, 18 bp, Homo sapiens
cctccctctctcttctgc

SEQ ID NO: 1105587 - DNA, 18 bp, Homo sapiens
cctccctctgccccaagc

SEQ ID NO: 1105588 - DNA, 22 bp, Homo sapiens
cctccctctgccccaagcagcc

SEQ ID NO: 1105589 - DNA, 12 bp, Homo sapiens
cctccctcttcc

SEQ ID NO: 1105590 - DNA, 17 bp, Homo sapiens
cctccctcttccttccc

SEQ ID NO: 1105591 - DNA, 20 bp, Homo sapiens
cctccctcttccttccccca

SEQ ID NO: 1105592 - DNA, 21 bp, Homo sapiens
cctccctgaaacactgcttct

SEQ ID NO: 1105593 - DNA, 13 bp, Homo sapiens
cctccctgaacca

SEQ ID NO: 1105594 - DNA, 18 bp, Homo sapiens
cctccctgactccctgtg

SEQ ID NO: 1105595 - DNA, 22 bp, Homo sapiens
cctccctgagcctgcattctgc

SEQ ID NO: 1105596 - DNA, 21 bp, Homo sapiens
cctccctgcatctgaccagca

SEQ ID NO: 1105597 - DNA, 11 bp, Homo sapiens
cctccctgccc

SEQ ID NO: 1105598 - DNA, 16 bp, Homo sapiens
cctccctgcccaaact

SEQ ID NO: 1105599 - DNA, 15 bp, Homo sapiens
cctccctgcctccag

SEQ ID NO: 1105600 - DNA, 19 bp, Homo sapiens
cctccctgcctgctccttg

SEQ ID NO: 1105601 - DNA, 20 bp, Homo sapiens
cctccctgcctgctccttgg

SEQ ID NO: 1105602 - DNA, 12 bp, Homo sapiens
cctccctgcgcc

SEQ ID NO: 1105603 - DNA, 19 bp, Homo sapiens
cctccctgctcctcatggg

SEQ ID NO: 1105604 - DNA, 20 bp, Homo sapiens
cctccctgctcctcatggga

SEQ ID NO: 1105605 - DNA, 22 bp, Homo sapiens
cctccctgcttgcacacttccc

SEQ ID NO: 1105606 - DNA, 20 bp, Homo sapiens
cctccctggagcctccactg

SEQ ID NO: 1105607 - DNA, 17 bp, Homo sapiens
cctccctggcagacaca

SEQ ID NO: 1105608 - DNA, 14 bp, Homo sapiens
cctccctggcctgt

SEQ ID NO: 1105609 - DNA, 14 bp, Homo sapiens
cctccctggctccc

SEQ ID NO: 1105610 - DNA, 18 bp, Homo sapiens
cctccctggctcccatga

SEQ ID NO: 1105611 - DNA, 16 bp, Homo sapiens
cctccctggctcctcc

SEQ ID NO: 1105612 - DNA, 18 bp, Homo sapiens
cctccctggctcctccgt

SEQ ID NO: 1105613 - DNA, 12 bp, Homo sapiens
cctccctggctg

SEQ ID NO: 1105614 - DNA, 15 bp, Homo sapiens
cctccctggctgccc

SEQ ID NO: 1105615 - DNA, 17 bp, Homo sapiens
cctccctggctgccctg

SEQ ID NO: 1105616 - DNA, 18 bp, Homo sapiens
cctccctggctgccctgg

SEQ ID NO: 1105617 - DNA, 20 bp, Homo sapiens
cctccctggctgccctggcc

SEQ ID NO: 1105618 - DNA, 21 bp, Homo sapiens
cctccctgggccacctcctac

SEQ ID NO: 1105619 - DNA, 11 bp, Homo sapiens
cctccctgtcc

SEQ ID NO: 1105620 - DNA, 15 bp, Homo sapiens
cctccctgtcctcct

SEQ ID NO: 1105621 - DNA, 16 bp, Homo sapiens
cctccctgtcctcctc

SEQ ID NO: 1105622 - DNA, 18 bp, Homo sapiens
cctcggcttgtgggctgg

SEQ ID NO: 1105623 - DNA, 19 bp, Homo sapiens
cctcggcttgtgggctggt

SEQ ID NO: 1105624 - DNA, 14 bp, Homo sapiens
cctcgggcccacct

SEQ ID NO: 1105625 - DNA, 15 bp, Homo sapiens
cctcgggcccacctg

SEQ ID NO: 1105626 - DNA, 17 bp, Homo sapiens
cctcgggcccacctggc

SEQ ID NO: 1105627 - DNA, 19 bp, Homo sapiens
cctcgggcccacctggcca

SEQ ID NO: 1105628 - DNA, 12 bp, Homo sapiens
cctcggggagag

SEQ ID NO: 1105629 - DNA, 16 bp, Homo sapiens
cctcgggggcctgtgg

SEQ ID NO: 1105630 - DNA, 12 bp, Homo sapiens
cctcgggtgggg

SEQ ID NO: 1105631 - DNA, 16 bp, Homo sapiens
cctcggtgccttcctc

SEQ ID NO: 1105632 - DNA, 15 bp, Homo sapiens
cctcggtggccctga

SEQ ID NO: 1105633 - DNA, 16 bp, Homo sapiens
cctcggtggctctggg

SEQ ID NO: 1105634 - DNA, 17 bp, Homo sapiens
cctcggtggctgcacag

SEQ ID NO: 1105635 - DNA, 17 bp, Homo sapiens
cctcggtgggccagagc

SEQ ID NO: 1105636 - DNA, 14 bp, Homo sapiens
cctcggtgtggaga

SEQ ID NO: 1105637 - DNA, 13 bp, Homo sapiens
cctcgtcaagagc

SEQ ID NO: 1105638 - DNA, 21 bp, Homo sapiens
cctcgtccacaggggcaggcc

SEQ ID NO: 1105639 - DNA, 22 bp, Homo sapiens
cctcgtccacaggggcaggcct

SEQ ID NO: 1105640 - DNA, 15 bp, Homo sapiens
cctcgtcccatccag

SEQ ID NO: 1105641 - DNA, 23 bp, Homo sapiens
cctcgtcccatccagctaccacc

SEQ ID NO: 1105642 - DNA, 19 bp, Homo sapiens
cctcgtcctccccctgcca

SEQ ID NO: 1105643 - DNA, 18 bp, Homo sapiens
cctcgtcctgtcccagag

SEQ ID NO: 1105644 - DNA, 19 bp, Homo sapiens
cctcgtctccctggtgcct

SEQ ID NO: 1105645 - DNA, 13 bp, Homo sapiens
cctcgtgcagagc

SEQ ID NO: 1105646 - DNA, 14 bp, Homo sapiens
cctcgtgcagagct

SEQ ID NO: 1105647 - DNA, 21 bp, Homo sapiens
cctcgtgccagcagcctcgca

SEQ ID NO: 1105648 - DNA, 22 bp, Homo sapiens
cctcgtgcccatcaagtgcagt

SEQ ID NO: 1105649 - DNA, 16 bp, Homo sapiens
cctcgtggagctcgcc

SEQ ID NO: 1105650 - DNA, 19 bp, Homo sapiens
cctcgttcctttctcctgt

SEQ ID NO: 1105651 - DNA, 13 bp, Homo sapiens
cctcgttgcccag

SEQ ID NO: 1105652 - DNA, 16 bp, Homo sapiens
cctcgttggagagcag

SEQ ID NO: 1105653 - DNA, 17 bp, Homo sapiens
cctcgttgggccgctct

SEQ ID NO: 1105654 - DNA, 23 bp, Homo sapiens
cctctaaagcaataatggtccca

SEQ ID NO: 1105655 - DNA, 22 bp, Homo sapiens
cctctaaagcagaggcaacact

SEQ ID NO: 1105656 - DNA, 18 bp, Homo sapiens
cctctaaccctcattgct

SEQ ID NO: 1105657 - DNA, 14 bp, Homo sapiens
cctctaactcactg

SEQ ID NO: 1105658 - DNA, 24 bp, Homo sapiens
cctctaactcactgcctaggaggc

SEQ ID NO: 1105659 - DNA, 15 bp, Homo sapiens
cctctaatgagactg

SEQ ID NO: 1105660 - DNA, 20 bp, Homo sapiens
cctctacacaggggccctgt

SEQ ID NO: 1105661 - DNA, 24 bp, Homo sapiens
cctctacagagcttccctgactca

SEQ ID NO: 1105662 - DNA, 15 bp, Homo sapiens
cctctacagccgtcc

SEQ ID NO: 1105663 - DNA, 21 bp, Homo sapiens
cctctacagccgtcccgcgtt

SEQ ID NO: 1105664 - DNA, 14 bp, Homo sapiens
cctctacccaaacc

SEQ ID NO: 1105665 - DNA, 13 bp, Homo sapiens
cctctacctctct

SEQ ID NO: 1105666 - DNA, 23 bp, Homo sapiens
cctctactcttacagagccttga

SEQ ID NO: 1105667 - DNA, 13 bp, Homo sapiens
cctctactcttcc

SEQ ID NO: 1105668 - DNA, 14 bp, Homo sapiens
cctctactcttcct

SEQ ID NO: 1105669 - DNA, 10 bp, Homo sapiens
cctctactgt

SEQ ID NO: 1105670 - DNA, 19 bp, Homo sapiens
cctctactgtctcctccct

SEQ ID NO: 1105671 - DNA, 20 bp, Homo sapiens
cctctacttaatgagatagt

SEQ ID NO: 1105672 - DNA, 18 bp, Homo sapiens
cctctactttgattctga

SEQ ID NO: 1105673 - DNA, 15 bp, Homo sapiens
cctctagaagccaag

SEQ ID NO: 1105674 - DNA, 12 bp, Homo sapiens
cctctagccatc

SEQ ID NO: 1105675 - DNA, 14 bp, Homo sapiens
cctctagccatccc

SEQ ID NO: 1105676 - DNA, 20 bp, Homo sapiens
cctctagccatcccttgggg

SEQ ID NO: 1105677 - DNA, 22 bp, Homo sapiens
cctctagcccactccctgccta

SEQ ID NO: 1105678 - DNA, 14 bp, Homo sapiens
cctctagcttttct

SEQ ID NO: 1105679 - DNA, 15 bp, Homo sapiens
cctctagtgccttct

SEQ ID NO: 1105680 - DNA, 18 bp, Homo sapiens
cctctatacatctctccc

SEQ ID NO: 1105681 - DNA, 22 bp, Homo sapiens
cctctatgctggcttttcaccc

SEQ ID NO: 1105682 - DNA, 14 bp, Homo sapiens
cctctattgatgta

SEQ ID NO: 1105683 - DNA, 23 bp, Homo sapiens
cctctattgatgtacagtctgtc

SEQ ID NO: 1105684 - DNA, 16 bp, Homo sapiens
cctctatttagcatga

SEQ ID NO: 1105685 - DNA, 17 bp, Homo sapiens
cctctatttatgtttgc

SEQ ID NO: 1105686 - DNA, 21 bp, Homo sapiens
cctctatttatgtttgcactt

SEQ ID NO: 1105687 - DNA, 20 bp, Homo sapiens
cctctcaagctagtgtttct

SEQ ID NO: 1105688 - DNA, 14 bp, Homo sapiens
cctctcaccccact

SEQ ID NO: 1105689 - DNA, 13 bp, Homo sapiens
cctctcacgccac

SEQ ID NO: 1105690 - DNA, 14 bp, Homo sapiens
cctctcacgccacc

SEQ ID NO: 1105691 - DNA, 16 bp, Homo sapiens
cctctcacgggccctg

SEQ ID NO: 1105692 - DNA, 18 bp, Homo sapiens
cctctcacgggccctgcc

SEQ ID NO: 1105693 - DNA, 19 bp, Homo sapiens
cctctcactagtgccaatg

SEQ ID NO: 1105694 - DNA, 14 bp, Homo sapiens
cctctcactccagc

SEQ ID NO: 1105695 - DNA, 17 bp, Homo sapiens
cctctcactccagccaa

SEQ ID NO: 1105696 - DNA, 19 bp, Homo sapiens
cctctcactccagccaaag

SEQ ID NO: 1105697 - DNA, 20 bp, Homo sapiens
cctctcactccagccaaaga

SEQ ID NO: 1105698 - DNA, 14 bp, Homo sapiens
cctctcactcccca

SEQ ID NO: 1105699 - DNA, 13 bp, Homo sapiens
cctctcagagtga

SEQ ID NO: 1105700 - DNA, 20 bp, Homo sapiens
cctctcagagtgacagtcat

SEQ ID NO: 1105701 - DNA, 14 bp, Homo sapiens
cctctcagcatagc

SEQ ID NO: 1105702 - DNA, 13 bp, Homo sapiens
cctctcagctcca

SEQ ID NO: 1105703 - DNA, 12 bp, Homo sapiens
cctctcaggaga

SEQ ID NO: 1105704 - DNA, 14 bp, Homo sapiens
cctctcaggcatgc

SEQ ID NO: 1105705 - DNA, 23 bp, Homo sapiens
cctctcatcagtgtcctcttgct

SEQ ID NO: 1105706 - DNA, 19 bp, Homo sapiens
cctctcatccccctgtgga

SEQ ID NO: 1105707 - DNA, 15 bp, Homo sapiens
cctctcatctcaggt

SEQ ID NO: 1105708 - DNA, 14 bp, Homo sapiens
cctctcatgtccct

SEQ ID NO: 1105709 - DNA, 20 bp, Homo sapiens
cctctcatgtccctccaggg

SEQ ID NO: 1105710 - DNA, 18 bp, Homo sapiens
cctctccaagggcttctg

SEQ ID NO: 1105711 - DNA, 19 bp, Homo sapiens
cctctccaagggcttctgc

SEQ ID NO: 1105712 - DNA, 22 bp, Homo sapiens
cctctccaagggcttctgcacc

SEQ ID NO: 1105713 - DNA, 23 bp, Homo sapiens
cctctccaccagccctactcctg

SEQ ID NO: 1105714 - DNA, 14 bp, Homo sapiens
cctctccaccctcc

SEQ ID NO: 1105715 - DNA, 20 bp, Homo sapiens
cctctccactcttctctcct

SEQ ID NO: 1105716 - DNA, 12 bp, Homo sapiens
cctctccactgc

SEQ ID NO: 1105717 - DNA, 13 bp, Homo sapiens
cctctccactgct

SEQ ID NO: 1105718 - DNA, 13 bp, Homo sapiens
cctctccaggcac

SEQ ID NO: 1105719 - DNA, 14 bp, Homo sapiens
cctctccaggcacc

SEQ ID NO: 1105720 - DNA, 23 bp, Homo sapiens
cctctccagtttgcacctgtccc

SEQ ID NO: 1105721 - DNA, 15 bp, Homo sapiens
cctctcccaagtcca

SEQ ID NO: 1105722 - DNA, 24 bp, Homo sapiens
cctctcccacccggccacagctgc

SEQ ID NO: 1105723 - DNA, 14 bp, Homo sapiens
cctctcccagggat

SEQ ID NO: 1105724 - DNA, 23 bp, Homo sapiens
cctctcccagggatgctctttgt

SEQ ID NO: 1105725 - DNA, 18 bp, Homo sapiens
cctctcccagtccatttc

SEQ ID NO: 1105726 - DNA, 13 bp, Homo sapiens
cctctcccatccc

SEQ ID NO: 1105727 - DNA, 20 bp, Homo sapiens
cctctcccatccccctgccc

SEQ ID NO: 1105728 - DNA, 22 bp, Homo sapiens
cctctcccatccccctgccctc

SEQ ID NO: 1105729 - DNA, 20 bp, Homo sapiens
cctctccccaatccatgctt

SEQ ID NO: 1105730 - DNA, 15 bp, Homo sapiens
cctctccccacccct

SEQ ID NO: 1105731 - DNA, 21 bp, Homo sapiens
cctctccccaggtccagctct

SEQ ID NO: 1105732 - DNA, 23 bp, Homo sapiens
cctctccccaggtccagctctgg

SEQ ID NO: 1105733 - DNA, 19 bp, Homo sapiens
cctctccccattcggtgtg

SEQ ID NO: 1105734 - DNA, 18 bp, Homo sapiens
cctctccccctcctccag

SEQ ID NO: 1105735 - DNA, 20 bp, Homo sapiens
cctctcccccttcagctcct

SEQ ID NO: 1105736 - DNA, 14 bp, Homo sapiens
cctctccccttggt

SEQ ID NO: 1105737 - DNA, 21 bp, Homo sapiens
cctctccccttggttctgcac

SEQ ID NO: 1105738 - DNA, 22 bp, Homo sapiens
cctctcccgccagactgttaga

SEQ ID NO: 1105739 - DNA, 14 bp, Homo sapiens
cctctcccggctgc

SEQ ID NO: 1105740 - DNA, 22 bp, Homo sapiens
cctctcccgtcagggcccaagt

SEQ ID NO: 1105741 - DNA, 12 bp, Homo sapiens
cctctccctcag

SEQ ID NO: 1105742 - DNA, 14 bp, Homo sapiens
cctctccctcaggg

SEQ ID NO: 1105743 - DNA, 18 bp, Homo sapiens
cctctccctctggtccca

SEQ ID NO: 1105744 - DNA, 15 bp, Homo sapiens
cctcttcctccctca

SEQ ID NO: 1105745 - DNA, 16 bp, Homo sapiens
cctcttcctccctcat

SEQ ID NO: 1105746 - DNA, 12 bp, Homo sapiens
cctcttcctctg

SEQ ID NO: 1105747 - DNA, 16 bp, Homo sapiens
cctcttcctctgggca

SEQ ID NO: 1105748 - DNA, 15 bp, Homo sapiens
cctcttcctcttgac

SEQ ID NO: 1105749 - DNA, 16 bp, Homo sapiens
cctcttcctcttgacc

SEQ ID NO: 1105750 - DNA, 11 bp, Homo sapiens
cctcttcctga

SEQ ID NO: 1105751 - DNA, 16 bp, Homo sapiens
cctcttcctgcccttg

SEQ ID NO: 1105752 - DNA, 19 bp, Homo sapiens
cctcttcctgcccttgaac

SEQ ID NO: 1105753 - DNA, 21 bp, Homo sapiens
cctcttcctgtgatccaccca

SEQ ID NO: 1105754 - DNA, 14 bp, Homo sapiens
cctcttccttcccc

SEQ ID NO: 1105755 - DNA, 15 bp, Homo sapiens
cctcttcggccctca

SEQ ID NO: 1105756 - DNA, 17 bp, Homo sapiens
cctcttctattttgtaa

SEQ ID NO: 1105757 - DNA, 12 bp, Homo sapiens
cctcttctcctt

SEQ ID NO: 1105758 - DNA, 18 bp, Homo sapiens
cctcttctcttgacagtc

SEQ ID NO: 1105759 - DNA, 20 bp, Homo sapiens
cctcttctcttttgccccct

SEQ ID NO: 1105760 - DNA, 18 bp, Homo sapiens
cctcttctgacgtgcctt

SEQ ID NO: 1105761 - DNA, 15 bp, Homo sapiens
cctcttctggctcaa

SEQ ID NO: 1105762 - DNA, 13 bp, Homo sapiens
cctcttctgggag

SEQ ID NO: 1105763 - DNA, 21 bp, Homo sapiens
cctcttctgggagggcagcag

SEQ ID NO: 1105764 - DNA, 15 bp, Homo sapiens
cctcttcttcttcag

SEQ ID NO: 1105765 - DNA, 17 bp, Homo sapiens
cctcttgaccctgcacc

SEQ ID NO: 1105766 - DNA, 19 bp, Homo sapiens
cctcttgagccttgaactt

SEQ ID NO: 1105767 - DNA, 15 bp, Homo sapiens
cctcttgagttcctc

SEQ ID NO: 1105768 - DNA, 17 bp, Homo sapiens
cctcttgagttcctctg

SEQ ID NO: 1105769 - DNA, 18 bp, Homo sapiens
cctcttgagttcctctgc

SEQ ID NO: 1105770 - DNA, 22 bp, Homo sapiens
cctcttgagttcctctgcagtt

SEQ ID NO: 1105771 - DNA, 16 bp, Homo sapiens
cctcttgattcctggt

SEQ ID NO: 1105772 - DNA, 15 bp, Homo sapiens
cctcttgccatcctg

SEQ ID NO: 1105773 - DNA, 18 bp, Homo sapiens
cctcttgccatcctgatg

SEQ ID NO: 1105774 - DNA, 23 bp, Homo sapiens
cctcttgccccccaccccagcct

SEQ ID NO: 1105775 - DNA, 22 bp, Homo sapiens
cctcttgcccgtcggccctgcg

SEQ ID NO: 1105776 - DNA, 12 bp, Homo sapiens
cctcttgccctt

SEQ ID NO: 1105777 - DNA, 18 bp, Homo sapiens
cctcttgcctctctcagg

SEQ ID NO: 1105778 - DNA, 12 bp, Homo sapiens
cctcttgctcaa

SEQ ID NO: 1105779 - DNA, 17 bp, Homo sapiens
cctcttgctgaaagcca

SEQ ID NO: 1105780 - DNA, 12 bp, Homo sapiens
cctcttgctgtc

SEQ ID NO: 1105781 - DNA, 18 bp, Homo sapiens
cctcttgctgtctctgct

SEQ ID NO: 1105782 - DNA, 15 bp, Homo sapiens
cctcttggacctctg

SEQ ID NO: 1105783 - DNA, 20 bp, Homo sapiens
cctcttggataccagctcag

SEQ ID NO: 1105784 - DNA, 22 bp, Homo sapiens
cctcttggataccagctcaggg

SEQ ID NO: 1105785 - DNA, 18 bp, Homo sapiens
cctcttggattaaggaag

SEQ ID NO: 1105786 - DNA, 21 bp, Homo sapiens
cctcttggcttctcagcccct

SEQ ID NO: 1105787 - DNA, 14 bp, Homo sapiens
cctcttggtgggtg

SEQ ID NO: 1105788 - DNA, 20 bp, Homo sapiens
cctcttggtgggtgtggcca

SEQ ID NO: 1105789 - DNA, 22 bp, Homo sapiens
cctcttggtgggtgtggccagc

SEQ ID NO: 1105790 - DNA, 12 bp, Homo sapiens
cctcttgtaaat

SEQ ID NO: 1105791 - DNA, 20 bp, Homo sapiens
cctcttgtcccttggcacac

SEQ ID NO: 1105792 - DNA, 17 bp, Homo sapiens
cctcttgtcctggccct

SEQ ID NO: 1105793 - DNA, 21 bp, Homo sapiens
cctcttgtgcaaggtggcctt

SEQ ID NO: 1105794 - DNA, 13 bp, Homo sapiens
cctcttgtgctca

SEQ ID NO: 1105795 - DNA, 17 bp, Homo sapiens
cctcttgttgcagagat

SEQ ID NO: 1105796 - DNA, 15 bp, Homo sapiens
cctctttactccctt

SEQ ID NO: 1105797 - DNA, 19 bp, Homo sapiens
cctctttactcccttcctg

SEQ ID NO: 1105798 - DNA, 22 bp, Homo sapiens
cctctttactcccttcctggcc

SEQ ID NO: 1105799 - DNA, 23 bp, Homo sapiens
cctctttactcccttcctggcct

SEQ ID NO: 1105800 - DNA, 23 bp, Homo sapiens
cctctttcaagcagtcgtgcctg

SEQ ID NO: 1105801 - DNA, 19 bp, Homo sapiens
cctctttcccaccctccac

SEQ ID NO: 1105802 - DNA, 15 bp, Homo sapiens
cctctttcccctcct

SEQ ID NO: 1105803 - DNA, 16 bp, Homo sapiens
cctctttcccctcctt

SEQ ID NO: 1105804 - DNA, 22 bp, Homo sapiens
cctctttcccctcctttgtctt

SEQ ID NO: 1105805 - DNA, 14 bp, Homo sapiens
cctctttccctgcg

SEQ ID NO: 1105806 - DNA, 16 bp, Homo sapiens
cctctttccctgcgag

SEQ ID NO: 1105807 - DNA, 20 bp, Homo sapiens
cctctttcctaacttccttt

SEQ ID NO: 1105808 - DNA, 21 bp, Homo sapiens
cctctttcctaacttccttta

SEQ ID NO: 1105809 - DNA, 13 bp, Homo sapiens
cctctttctctcc

SEQ ID NO: 1105810 - DNA, 12 bp, Homo sapiens
cctctttctctt

SEQ ID NO: 1105811 - DNA, 14 bp, Homo sapiens
cctctttgcacagc

SEQ ID NO: 1105812 - DNA, 15 bp, Homo sapiens
cctctttgctttgct

SEQ ID NO: 1105813 - DNA, 21 bp, Homo sapiens
cctctttggtggcatggaagg

SEQ ID NO: 1105814 - DNA, 17 bp, Homo sapiens
cctcttttccctctcta

SEQ ID NO: 1105815 - DNA, 18 bp, Homo sapiens
cctcttttccctctctag

SEQ ID NO: 1105816 - DNA, 18 bp, Homo sapiens
cctcttttcctggcagct

SEQ ID NO: 1105817 - DNA, 11 bp, Homo sapiens
cctcttttctt

SEQ ID NO: 1105818 - DNA, 14 bp, Homo sapiens
cctctttttcctcc

SEQ ID NO: 1105819 - DNA, 21 bp, Homo sapiens
cctctttttcctcctggacac

SEQ ID NO: 1105820 - DNA, 17 bp, Homo sapiens
cctctttttgcccttta

SEQ ID NO: 1105821 - DNA, 18 bp, Homo sapiens
cctgaaaacactgtgcac

SEQ ID NO: 1105822 - DNA, 16 bp, Homo sapiens
cctgaaaacccagaga

SEQ ID NO: 1105823 - DNA, 21 bp, Homo sapiens
cctgaaaacgaaggggccccg

SEQ ID NO: 1105824 - DNA, 21 bp, Homo sapiens
cctgaaaatgtttttctgcca

SEQ ID NO: 1105825 - DNA, 13 bp, Homo sapiens
cctgaaacactgg

SEQ ID NO: 1105826 - DNA, 18 bp, Homo sapiens
cctgaaacagccatgtcc

SEQ ID NO: 1105827 - DNA, 22 bp, Homo sapiens
cctgaaacccgccctcaggggc

SEQ ID NO: 1105828 - DNA, 20 bp, Homo sapiens
cctgaaacctagtactgccc

SEQ ID NO: 1105829 - DNA, 20 bp, Homo sapiens
cctgaaacgctcctttgtgt

SEQ ID NO: 1105830 - DNA, 22 bp, Homo sapiens
cctgaaagaggctgaggcctgg

SEQ ID NO: 1105831 - DNA, 13 bp, Homo sapiens
cctgaaagccctg

SEQ ID NO: 1105832 - DNA, 14 bp, Homo sapiens
cctgaaagccctga

SEQ ID NO: 1105833 - DNA, 20 bp, Homo sapiens
cctgaaagggcacttaattt

SEQ ID NO: 1105834 - DNA, 15 bp, Homo sapiens
cctgaaataatatat

SEQ ID NO: 1105835 - DNA, 12 bp, Homo sapiens
cctgaaattaat

SEQ ID NO: 1105836 - DNA, 18 bp, Homo sapiens
cctgaaattaatttgtga

SEQ ID NO: 1105837 - DNA, 23 bp, Homo sapiens
cctgaaattaatttgtgaatttg

SEQ ID NO: 1105838 - DNA, 13 bp, Homo sapiens
cctgaacaagaat

SEQ ID NO: 1105839 - DNA, 14 bp, Homo sapiens
cctgaacagaagct

SEQ ID NO: 1105840 - DNA, 17 bp, Homo sapiens
cctgaaccacgaggctg

SEQ ID NO: 1105841 - DNA, 18 bp, Homo sapiens
cctgaaccacgaggctgc

SEQ ID NO: 1105842 - DNA, 19 bp, Homo sapiens
cctgaaccacgaggctgcc

SEQ ID NO: 1105843 - DNA, 22 bp, Homo sapiens
cctgaaccacgaggctgccccc

SEQ ID NO: 1105844 - DNA, 18 bp, Homo sapiens
cctgaaccccatgggctt

SEQ ID NO: 1105845 - DNA, 18 bp, Homo sapiens
cctgaacccctggccagc

SEQ ID NO: 1105846 - DNA, 20 bp, Homo sapiens
cctgaacccctggccagctc

SEQ ID NO: 1105847 - DNA, 17 bp, Homo sapiens
cctgaaccgcaccccat

SEQ ID NO: 1105848 - DNA, 16 bp, Homo sapiens
cctgaacgttttcttc

SEQ ID NO: 1105849 - DNA, 20 bp, Homo sapiens
cctgaacgttttcttctttc

SEQ ID NO: 1105850 - DNA, 22 bp, Homo sapiens
cctgaacgttttcttctttccc

SEQ ID NO: 1105851 - DNA, 13 bp, Homo sapiens
cctgaactccaga

SEQ ID NO: 1105852 - DNA, 17 bp, Homo sapiens
cctgaactgaacaccat

SEQ ID NO: 1105853 - DNA, 14 bp, Homo sapiens
cctgaactgaggag

SEQ ID NO: 1105854 - DNA, 14 bp, Homo sapiens
cctgaactgaggcc

SEQ ID NO: 1105855 - DNA, 19 bp, Homo sapiens
cctgaactgaggccttgtg

SEQ ID NO: 1105856 - DNA, 13 bp, Homo sapiens
cctgaactttctc

SEQ ID NO: 1105857 - DNA, 17 bp, Homo sapiens
cctgaactttctccctc

SEQ ID NO: 1105858 - DNA, 18 bp, Homo sapiens
cctgaactttctccctca

SEQ ID NO: 1105859 - DNA, 13 bp, Homo sapiens
cctgaagagcatt

SEQ ID NO: 1105860 - DNA, 17 bp, Homo sapiens
cctgaagaggcgggcca

SEQ ID NO: 1105861 - DNA, 23 bp, Homo sapiens
cctgaagaggcgggccagccagg

SEQ ID NO: 1105862 - DNA, 18 bp, Homo sapiens
cctgaagatcaagccagt

SEQ ID NO: 1105863 - DNA, 14 bp, Homo sapiens
cctgaagccagctg

SEQ ID NO: 1105864 - DNA, 18 bp, Homo sapiens
cctgaagccagctgccct

SEQ ID NO: 1105865 - DNA, 17 bp, Homo sapiens
cctgaagcctccgtgga

SEQ ID NO: 1105866 - DNA, 16 bp, Homo sapiens
cctgatggtcagctcc

SEQ ID NO: 1105867 - DNA, 18 bp, Homo sapiens
cctgatggtcagctccct

SEQ ID NO: 1105868 - DNA, 22 bp, Homo sapiens
cctgatggtcagctcccttctc

SEQ ID NO: 1105869 - DNA, 19 bp, Homo sapiens
cctgatgtgtcctcaggga

SEQ ID NO: 1105870 - DNA, 21 bp, Homo sapiens
cctgatgtgtcctcagggagc

SEQ ID NO: 1105871 - DNA, 17 bp, Homo sapiens
cctgatgttaaaattcc

SEQ ID NO: 1105872 - DNA, 21 bp, Homo sapiens
cctgattcatactccttttgg

SEQ ID NO: 1105873 - DNA, 16 bp, Homo sapiens
cctgattcggacggcc

SEQ ID NO: 1105874 - DNA, 13 bp, Homo sapiens
cctgattcttgat

SEQ ID NO: 1105875 - DNA, 21 bp, Homo sapiens
cctgattcttgattcctggct

SEQ ID NO: 1105876 - DNA, 16 bp, Homo sapiens
cctgattgacctgctc

SEQ ID NO: 1105877 - DNA, 22 bp, Homo sapiens
cctgattgtattttttttttaa

SEQ ID NO: 1105878 - DNA, 15 bp, Homo sapiens
cctgattgtttacag

SEQ ID NO: 1105879 - DNA, 22 bp, Homo sapiens
cctgatttaatatgcaaagtct

SEQ ID NO: 1105880 - DNA, 15 bp, Homo sapiens
cctgatttcagaaga

SEQ ID NO: 1105881 - DNA, 20 bp, Homo sapiens
cctgatttctacaactggag

SEQ ID NO: 1105882 - DNA, 15 bp, Homo sapiens
cctgattttgtagtt

SEQ ID NO: 1105883 - DNA, 16 bp, Homo sapiens
cctgattttttttcct

SEQ ID NO: 1105884 - DNA, 14 bp, Homo sapiens
cctgcaaaaaatac

SEQ ID NO: 1105885 - DNA, 22 bp, Homo sapiens
cctgcaaaatttgatgccagga

SEQ ID NO: 1105886 - DNA, 14 bp, Homo sapiens
cctgcaaaatttta

SEQ ID NO: 1105887 - DNA, 16 bp, Homo sapiens
cctgcaaaccttcctg

SEQ ID NO: 1105888 - DNA, 19 bp, Homo sapiens
cctgcaaagcccagcttga

SEQ ID NO: 1105889 - DNA, 17 bp, Homo sapiens
cctgcaaaggcccttgt

SEQ ID NO: 1105890 - DNA, 17 bp, Homo sapiens
cctgcaactcaaggact

SEQ ID NO: 1105891 - DNA, 23 bp, Homo sapiens
cctgcaagaagcgccgactccct

SEQ ID NO: 1105892 - DNA, 15 bp, Homo sapiens
cctgcaagatggaca

SEQ ID NO: 1105893 - DNA, 21 bp, Homo sapiens
cctgcaagatggacacgagcc

SEQ ID NO: 1105894 - DNA, 22 bp, Homo sapiens
cctgcaagatggacacgagcca

SEQ ID NO: 1105895 - DNA, 13 bp, Homo sapiens
cctgcaagcccca

SEQ ID NO: 1105896 - DNA, 18 bp, Homo sapiens
cctgcaagccccagggcc

SEQ ID NO: 1105897 - DNA, 13 bp, Homo sapiens
cctgcaaggacta

SEQ ID NO: 1105898 - DNA, 17 bp, Homo sapiens
cctgcaagtcagtccag

SEQ ID NO: 1105899 - DNA, 13 bp, Homo sapiens
cctgcaatatttg

SEQ ID NO: 1105900 - DNA, 19 bp, Homo sapiens
cctgcaatcactttttgga

SEQ ID NO: 1105901 - DNA, 20 bp, Homo sapiens
cctgcaatcactttttggaa

SEQ ID NO: 1105902 - DNA, 22 bp, Homo sapiens
cctgcaatgaaaggtactatat

SEQ ID NO: 1105903 - DNA, 14 bp, Homo sapiens
cctgcacacagaat

SEQ ID NO: 1105904 - DNA, 20 bp, Homo sapiens
cctgcacacagaatgctcag

SEQ ID NO: 1105905 - DNA, 16 bp, Homo sapiens
cctgcacacaggacag

SEQ ID NO: 1105906 - DNA, 19 bp, Homo sapiens
cctgcacacaggacagcgg

SEQ ID NO: 1105907 - DNA, 13 bp, Homo sapiens
cctgcacacaggg

SEQ ID NO: 1105908 - DNA, 20 bp, Homo sapiens
cctgcacacagggcagtcct

SEQ ID NO: 1105909 - DNA, 23 bp, Homo sapiens
cctgcacagatacctcatcatcc

SEQ ID NO: 1105910 - DNA, 17 bp, Homo sapiens
cctgcacaggcacacag

SEQ ID NO: 1105911 - DNA, 19 bp, Homo sapiens
cctgcacaggtggctgttt

SEQ ID NO: 1105912 - DNA, 21 bp, Homo sapiens
cctgcaccaaatgtcagaagc

SEQ ID NO: 1105913 - DNA, 13 bp, Homo sapiens
cctgcaccccagc

SEQ ID NO: 1105914 - DNA, 11 bp, Homo sapiens
cctgcaccctc

SEQ ID NO: 1105915 - DNA, 22 bp, Homo sapiens
cctgcaccgacccgaggcccag

SEQ ID NO: 1105916 - DNA, 22 bp, Homo sapiens
cctgcaccgccgcagaagcagc

SEQ ID NO: 1105917 - DNA, 23 bp, Homo sapiens
cctgcaccgccgcagaagcagcc

SEQ ID NO: 1105918 - DNA, 17 bp, Homo sapiens
cctgcaccgtctcactg

SEQ ID NO: 1105919 - DNA, 21 bp, Homo sapiens
cctgcacctccccccactgca

SEQ ID NO: 1105920 - DNA, 15 bp, Homo sapiens
cctgcacctggcctg

SEQ ID NO: 1105921 - DNA, 19 bp, Homo sapiens
cctgcacctggcctgggcc

SEQ ID NO: 1105922 - DNA, 19 bp, Homo sapiens
cctgcacgtcatgggaggg

SEQ ID NO: 1105923 - DNA, 23 bp, Homo sapiens
cctgcacgtcatgggagggggct

SEQ ID NO: 1105924 - DNA, 19 bp, Homo sapiens
cctgcactaaagccagcct

SEQ ID NO: 1105925 - DNA, 14 bp, Homo sapiens
cctgcactcccgac

SEQ ID NO: 1105926 - DNA, 17 bp, Homo sapiens
cctgcactccctcctgg

SEQ ID NO: 1105927 - DNA, 14 bp, Homo sapiens
cctgcactccctgg

SEQ ID NO: 1105928 - DNA, 21 bp, Homo sapiens
cctgcactccctggccttgcc

SEQ ID NO: 1105929 - DNA, 14 bp, Homo sapiens
cctgcactgaaacc

SEQ ID NO: 1105930 - DNA, 18 bp, Homo sapiens
cctgcactgaaacctgag

SEQ ID NO: 1105931 - DNA, 13 bp, Homo sapiens
cctgcactgagag

SEQ ID NO: 1105932 - DNA, 12 bp, Homo sapiens
cctgcactggga

SEQ ID NO: 1105933 - DNA, 14 bp, Homo sapiens
cctgcactggggag

SEQ ID NO: 1105934 - DNA, 14 bp, Homo sapiens
cctgcactgtgccc

SEQ ID NO: 1105935 - DNA, 18 bp, Homo sapiens
cctgcactgtgccccgcg

SEQ ID NO: 1105936 - DNA, 17 bp, Homo sapiens
cctgcacttcagacacc

SEQ ID NO: 1105937 - DNA, 22 bp, Homo sapiens
cctgcagaagtaagcctcatca

SEQ ID NO: 1105938 - DNA, 12 bp, Homo sapiens
cctgcagagaaa

SEQ ID NO: 1105939 - DNA, 13 bp, Homo sapiens
cctgcagagagaa

SEQ ID NO: 1105940 - DNA, 15 bp, Homo sapiens
cctgcagagagaagc

SEQ ID NO: 1105941 - DNA, 13 bp, Homo sapiens
cctgcagagcaat

SEQ ID NO: 1105942 - DNA, 22 bp, Homo sapiens
cctgcagaggaccacagtgggt

SEQ ID NO: 1105943 - DNA, 18 bp, Homo sapiens
cctgcagaggtctgtgct

SEQ ID NO: 1105944 - DNA, 22 bp, Homo sapiens
cctgcagaggtctgtgctgagg

SEQ ID NO: 1105945 - DNA, 13 bp, Homo sapiens
cctgcagatgcca

SEQ ID NO: 1105946 - DNA, 20 bp, Homo sapiens
cctgcagatgccaccctagc

SEQ ID NO: 1105947 - DNA, 19 bp, Homo sapiens
cctgcagcaaacactccac

SEQ ID NO: 1105948 - DNA, 21 bp, Homo sapiens
cctgcagcaaacactccaccc

SEQ ID NO: 1105949 - DNA, 20 bp, Homo sapiens
cctgcagcacatgcgggctc

SEQ ID NO: 1105950 - DNA, 18 bp, Homo sapiens
cctgcagcacgcggcctt

SEQ ID NO: 1105951 - DNA, 22 bp, Homo sapiens
cctgcagcatggtccctgcctt

SEQ ID NO: 1105952 - DNA, 16 bp, Homo sapiens
cctgcagccaccagac

SEQ ID NO: 1105953 - DNA, 22 bp, Homo sapiens
cctgcagcccaaaacccagggc

SEQ ID NO: 1105954 - DNA, 20 bp, Homo sapiens
cctgcagcccaccagacgtc

SEQ ID NO: 1105955 - DNA, 15 bp, Homo sapiens
cctgcagcctgggtc

SEQ ID NO: 1105956 - DNA, 15 bp, Homo sapiens
cctgcagcctggtag

SEQ ID NO: 1105957 - DNA, 20 bp, Homo sapiens
cctgcaggcacagaggaggt

SEQ ID NO: 1105958 - DNA, 23 bp, Homo sapiens
cctgcaggcacagaggaggtcag

SEQ ID NO: 1105959 - DNA, 12 bp, Homo sapiens
cctgcaggcaga

SEQ ID NO: 1105960 - DNA, 16 bp, Homo sapiens
cctgcaggcagagctg

SEQ ID NO: 1105961 - DNA, 20 bp, Homo sapiens
cctgcaggcagagctggagc

SEQ ID NO: 1105962 - DNA, 21 bp, Homo sapiens
cctgcaggcagagctggagcc

SEQ ID NO: 1105963 - DNA, 22 bp, Homo sapiens
cctgcaggcaggaacaaacagg

SEQ ID NO: 1105964 - DNA, 21 bp, Homo sapiens
cctgcaggccaagagcagagg

SEQ ID NO: 1105965 - DNA, 22 bp, Homo sapiens
cctgcaggccaagagcagaggc

SEQ ID NO: 1105966 - DNA, 18 bp, Homo sapiens
cctgcaggccaggccagc

SEQ ID NO: 1105967 - DNA, 15 bp, Homo sapiens
cctgcaggctcccga

SEQ ID NO: 1105968 - DNA, 14 bp, Homo sapiens
cctgcaggctggag

SEQ ID NO: 1105969 - DNA, 15 bp, Homo sapiens
cctgcagggccaagc

SEQ ID NO: 1105970 - DNA, 20 bp, Homo sapiens
cctgcagggggaggaggact

SEQ ID NO: 1105971 - DNA, 20 bp, Homo sapiens
cctgcaggggttgagagctt

SEQ ID NO: 1105972 - DNA, 20 bp, Homo sapiens
cctgcagggtggtgctggga

SEQ ID NO: 1105973 - DNA, 23 bp, Homo sapiens
cctgcagggtggtgctgggactg

SEQ ID NO: 1105974 - DNA, 21 bp, Homo sapiens
cctgcaggtcagttgtaataa

SEQ ID NO: 1105975 - DNA, 18 bp, Homo sapiens
cctgcagtactttacctc

SEQ ID NO: 1105976 - DNA, 20 bp, Homo sapiens
cctgcagtactttacctcct

SEQ ID NO: 1105977 - DNA, 21 bp, Homo sapiens
cctgcagtcccacactgtgca

SEQ ID NO: 1105978 - DNA, 22 bp, Homo sapiens
cctgcagtcccacactgtgcag

SEQ ID NO: 1105979 - DNA, 22 bp, Homo sapiens
cctgcagtgaggggccctccat

SEQ ID NO: 1105980 - DNA, 16 bp, Homo sapiens
cctgcagtttggccct

SEQ ID NO: 1105981 - DNA, 19 bp, Homo sapiens
cctgcagtttggccctgga

SEQ ID NO: 1105982 - DNA, 18 bp, Homo sapiens
cctgcagtttgggagaca

SEQ ID NO: 1105983 - DNA, 15 bp, Homo sapiens
cctgcatcctgaggc

SEQ ID NO: 1105984 - DNA, 16 bp, Homo sapiens
cctgcatcctgaggcc

SEQ ID NO: 1105985 - DNA, 23 bp, Homo sapiens
cctgcatcctgaggccagtggcc

SEQ ID NO: 1105986 - DNA, 15 bp, Homo sapiens
cctgcatctctgtga

SEQ ID NO: 1105987 - DNA, 13 bp, Homo sapiens
cctgctgccacag

SEQ ID NO: 1105988 - DNA, 14 bp, Homo sapiens
cctgctgccagtgc

SEQ ID NO: 1105989 - DNA, 17 bp, Homo sapiens
cctgctgcccaggctgt

SEQ ID NO: 1105990 - DNA, 22 bp, Homo sapiens
cctgctgcccaggctgtgcagc

SEQ ID NO: 1105991 - DNA, 14 bp, Homo sapiens
cctgctgccgcctc

SEQ ID NO: 1105992 - DNA, 15 bp, Homo sapiens
cctgctgccgcctcc

SEQ ID NO: 1105993 - DNA, 18 bp, Homo sapiens
cctgctgccgcctcccag

SEQ ID NO: 1105994 - DNA, 19 bp, Homo sapiens
cctgctgcctccccaaccc

SEQ ID NO: 1105995 - DNA, 15 bp, Homo sapiens
cctgctgcctgctga

SEQ ID NO: 1105996 - DNA, 15 bp, Homo sapiens
cctgctgcgtcccca

SEQ ID NO: 1105997 - DNA, 14 bp, Homo sapiens
cctgctgctcctgt

SEQ ID NO: 1105998 - DNA, 18 bp, Homo sapiens
cctgctgctgccagggct

SEQ ID NO: 1105999 - DNA, 14 bp, Homo sapiens
cctgctgctggggc

SEQ ID NO: 1106000 - DNA, 13 bp, Homo sapiens
cctgctggaagcc

SEQ ID NO: 1106001 - DNA, 14 bp, Homo sapiens
cctgctggaagccc

SEQ ID NO: 1106002 - DNA, 17 bp, Homo sapiens
cctgctggaagcccagc

SEQ ID NO: 1106003 - DNA, 13 bp, Homo sapiens
cctgctggaggcc

SEQ ID NO: 1106004 - DNA, 22 bp, Homo sapiens
cctgctggaggcctcaggtgct

SEQ ID NO: 1106005 - DNA, 17 bp, Homo sapiens
cctgctggatgggactc

SEQ ID NO: 1106006 - DNA, 15 bp, Homo sapiens
cctgctggcacccac

SEQ ID NO: 1106007 - DNA, 13 bp, Homo sapiens
cctgctggcaggg

SEQ ID NO: 1106008 - DNA, 11 bp, Homo sapiens
cctgctggccc

SEQ ID NO: 1106009 - DNA, 13 bp, Homo sapiens
cctgctggcccct

SEQ ID NO: 1106010 - DNA, 16 bp, Homo sapiens
cctgctggcccctcac

SEQ ID NO: 1106011 - DNA, 17 bp, Homo sapiens
cctgctgggaagagctc

SEQ ID NO: 1106012 - DNA, 21 bp, Homo sapiens
cctgctgggcgtgtgtgacac

SEQ ID NO: 1106013 - DNA, 16 bp, Homo sapiens
cctgctgggctctcca

SEQ ID NO: 1106014 - DNA, 17 bp, Homo sapiens
cctgctgggctctccac

SEQ ID NO: 1106015 - DNA, 18 bp, Homo sapiens
cctgctgggctctccacc

SEQ ID NO: 1106016 - DNA, 24 bp, Homo sapiens
cctgctgggctctccacctcagcc

SEQ ID NO: 1106017 - DNA, 12 bp, Homo sapiens
cctgctggtcaa

SEQ ID NO: 1106018 - DNA, 18 bp, Homo sapiens
cctgctgtatgtgagctg

SEQ ID NO: 1106019 - DNA, 17 bp, Homo sapiens
cctgctgtctctctggg

SEQ ID NO: 1106020 - DNA, 21 bp, Homo sapiens
cctgctgtgccatgctgggcc

SEQ ID NO: 1106021 - DNA, 18 bp, Homo sapiens
cctgctgtgcctcgcatc

SEQ ID NO: 1106022 - DNA, 15 bp, Homo sapiens
cctgctgtgctgctc

SEQ ID NO: 1106023 - DNA, 12 bp, Homo sapiens
cctgctgtggga

SEQ ID NO: 1106024 - DNA, 22 bp, Homo sapiens
cctgctgtggggtatacagcat

SEQ ID NO: 1106025 - DNA, 21 bp, Homo sapiens
cctgctgtgtccttcctccac

SEQ ID NO: 1106026 - DNA, 21 bp, Homo sapiens
cctgcttagctgccttgagct

SEQ ID NO: 1106027 - DNA, 14 bp, Homo sapiens
cctgcttcaaatat

SEQ ID NO: 1106028 - DNA, 21 bp, Homo sapiens
cctgcttccaggaaactccac

SEQ ID NO: 1106029 - DNA, 15 bp, Homo sapiens
cctgcttccaggcct

SEQ ID NO: 1106030 - DNA, 14 bp, Homo sapiens
cctgcttccccttc

SEQ ID NO: 1106031 - DNA, 18 bp, Homo sapiens
cctgcttccccttcctaa

SEQ ID NO: 1106032 - DNA, 19 bp, Homo sapiens
cctgcttccccttcctaag

SEQ ID NO: 1106033 - DNA, 15 bp, Homo sapiens
cctgcttcctgcttg

SEQ ID NO: 1106034 - DNA, 14 bp, Homo sapiens
cctgcttccttcag

SEQ ID NO: 1106035 - DNA, 15 bp, Homo sapiens
cctgcttccttcagt

SEQ ID NO: 1106036 - DNA, 19 bp, Homo sapiens
cctgcttccttcagtttgt

SEQ ID NO: 1106037 - DNA, 19 bp, Homo sapiens
cctgcttctcccggggacg

SEQ ID NO: 1106038 - DNA, 17 bp, Homo sapiens
cctgcttctctcagcca

SEQ ID NO: 1106039 - DNA, 20 bp, Homo sapiens
cctgcttctctcagccagct

SEQ ID NO: 1106040 - DNA, 16 bp, Homo sapiens
cctgcttctcttttcc

SEQ ID NO: 1106041 - DNA, 18 bp, Homo sapiens
cctgcttctcttttcctc

SEQ ID NO: 1106042 - DNA, 21 bp, Homo sapiens
cctgcttctcttttcctcgca

SEQ ID NO: 1106043 - DNA, 11 bp, Homo sapiens
cctgcttctgt

SEQ ID NO: 1106044 - DNA, 23 bp, Homo sapiens
cctgcttctgtgtaccacttctg

SEQ ID NO: 1106045 - DNA, 12 bp, Homo sapiens
cctgcttgataa

SEQ ID NO: 1106046 - DNA, 15 bp, Homo sapiens
cctgcttgccaaggc

SEQ ID NO: 1106047 - DNA, 17 bp, Homo sapiens
cctgcttgcccgctccc

SEQ ID NO: 1106048 - DNA, 22 bp, Homo sapiens
cctgcttgcccgctcccacagc

SEQ ID NO: 1106049 - DNA, 17 bp, Homo sapiens
cctgcttggtctttcat

SEQ ID NO: 1106050 - DNA, 18 bp, Homo sapiens
cctgcttggtctttcatt

SEQ ID NO: 1106051 - DNA, 20 bp, Homo sapiens
cctgcttgtactaagccagg

SEQ ID NO: 1106052 - DNA, 21 bp, Homo sapiens
cctgcttgtactaagccagga

SEQ ID NO: 1106053 - DNA, 23 bp, Homo sapiens
cctgcttgtactaagccaggagg

SEQ ID NO: 1106054 - DNA, 18 bp, Homo sapiens
cctgctttccatgggccc

SEQ ID NO: 1106055 - DNA, 22 bp, Homo sapiens
cctgctttccatgggcccgctg

SEQ ID NO: 1106056 - DNA, 18 bp, Homo sapiens
cctgctttgcgtgcccgg

SEQ ID NO: 1106057 - DNA, 19 bp, Homo sapiens
cctgctttgcgtgcccggg

SEQ ID NO: 1106058 - DNA, 20 bp, Homo sapiens
cctgctttgcgtgcccgggg

SEQ ID NO: 1106059 - DNA, 15 bp, Homo sapiens
cctgctttggcgggc

SEQ ID NO: 1106060 - DNA, 17 bp, Homo sapiens
cctgctttgggctgccc

SEQ ID NO: 1106061 - DNA, 18 bp, Homo sapiens
cctgctttgggctgccct

SEQ ID NO: 1106062 - DNA, 21 bp, Homo sapiens
cctgctttgggctgccctggt

SEQ ID NO: 1106063 - DNA, 20 bp, Homo sapiens
cctgcttttaggagaattca

SEQ ID NO: 1106064 - DNA, 16 bp, Homo sapiens
cctgcttttccaggat

SEQ ID NO: 1106065 - DNA, 22 bp, Homo sapiens
cctgcttttccaggatcctgca

SEQ ID NO: 1106066 - DNA, 16 bp, Homo sapiens
cctgcttttctgtcct

SEQ ID NO: 1106067 - DNA, 17 bp, Homo sapiens
cctgcttttctgtcctg

SEQ ID NO: 1106068 - DNA, 18 bp, Homo sapiens
cctgcttttctgtcctgg

SEQ ID NO: 1106069 - DNA, 21 bp, Homo sapiens
cctgcttttctgtcctgggca

SEQ ID NO: 1106070 - DNA, 13 bp, Homo sapiens
cctggaaacagca

SEQ ID NO: 1106071 - DNA, 15 bp, Homo sapiens
cctggaaacagcatg

SEQ ID NO: 1106072 - DNA, 21 bp, Homo sapiens
cctggaaaggctcagtctcag

SEQ ID NO: 1106073 - DNA, 15 bp, Homo sapiens
cctggaaccagagcc

SEQ ID NO: 1106074 - DNA, 22 bp, Homo sapiens
cctggaaccagcaagtcccaga

SEQ ID NO: 1106075 - DNA, 24 bp, Homo sapiens
cctggaaccagcaagtcccagaca

SEQ ID NO: 1106076 - DNA, 21 bp, Homo sapiens
cctggaaccttgctgtcctga

SEQ ID NO: 1106077 - DNA, 18 bp, Homo sapiens
cctggaactgtagggcca

SEQ ID NO: 1106078 - DNA, 16 bp, Homo sapiens
cctggaagacaaccca

SEQ ID NO: 1106079 - DNA, 14 bp, Homo sapiens
cctggaagagccca

SEQ ID NO: 1106080 - DNA, 16 bp, Homo sapiens
cctggaagagcccagt

SEQ ID NO: 1106081 - DNA, 16 bp, Homo sapiens
cctggaagcaggtgct

SEQ ID NO: 1106082 - DNA, 17 bp, Homo sapiens
cctggaagccagctttc

SEQ ID NO: 1106083 - DNA, 18 bp, Homo sapiens
cctggaagctgtgtcctt

SEQ ID NO: 1106084 - DNA, 21 bp, Homo sapiens
cctggaagctgtgtccttgca

SEQ ID NO: 1106085 - DNA, 15 bp, Homo sapiens
cctggaaggacacag

SEQ ID NO: 1106086 - DNA, 17 bp, Homo sapiens
cctggaataaaatataa

SEQ ID NO: 1106087 - DNA, 18 bp, Homo sapiens
cctggaatctacaagcca

SEQ ID NO: 1106088 - DNA, 19 bp, Homo sapiens
cctggaattcagcaccctg

SEQ ID NO: 1106089 - DNA, 23 bp, Homo sapiens
cctggaattcagcaccctgggtg

SEQ ID NO: 1106090 - DNA, 20 bp, Homo sapiens
cctggacaaggtctcttcct

SEQ ID NO: 1106091 - DNA, 20 bp, Homo sapiens
cctggacacacactcaccag

SEQ ID NO: 1106092 - DNA, 15 bp, Homo sapiens
cctggacacactctc

SEQ ID NO: 1106093 - DNA, 16 bp, Homo sapiens
cctggacacccctgct

SEQ ID NO: 1106094 - DNA, 14 bp, Homo sapiens
cctggacacctccc

SEQ ID NO: 1106095 - DNA, 17 bp, Homo sapiens
cctggacactcagacct

SEQ ID NO: 1106096 - DNA, 15 bp, Homo sapiens
cctggacaggcagcc

SEQ ID NO: 1106097 - DNA, 17 bp, Homo sapiens
cctggacaggcagcctc

SEQ ID NO: 1106098 - DNA, 19 bp, Homo sapiens
cctggacaggcagcctcct

SEQ ID NO: 1106099 - DNA, 20 bp, Homo sapiens
cctggacaggcagcctcctt

SEQ ID NO: 1106100 - DNA, 23 bp, Homo sapiens
cctggacagtatcccacatccaa

SEQ ID NO: 1106101 - DNA, 23 bp, Homo sapiens
cctggacatgaagattctttccc

SEQ ID NO: 1106102 - DNA, 20 bp, Homo sapiens
cctggacatttgccttgctg

SEQ ID NO: 1106103 - DNA, 23 bp, Homo sapiens
cctggaccaccagccccagcaag

SEQ ID NO: 1106104 - DNA, 23 bp, Homo sapiens
cctggaccattcctgtccctttg

SEQ ID NO: 1106105 - DNA, 13 bp, Homo sapiens
cctggacccctgg

SEQ ID NO: 1106106 - DNA, 15 bp, Homo sapiens
cctggacccctgggg

SEQ ID NO: 1106107 - DNA, 18 bp, Homo sapiens
cctggacccctggggtgg

SEQ ID NO: 1106108 - DNA, 20 bp, Homo sapiens
cctggacccctggggtggcc

SEQ ID NO: 1106109 - DNA, 22 bp, Homo sapiens
cctggctgtggaggcctgatgc

SEQ ID NO: 1106110 - DNA, 15 bp, Homo sapiens
cctggcttcactctc

SEQ ID NO: 1106111 - DNA, 23 bp, Homo sapiens
cctggcttctggagcccttgggt

SEQ ID NO: 1106112 - DNA, 18 bp, Homo sapiens
cctggcttgctccagggt

SEQ ID NO: 1106113 - DNA, 15 bp, Homo sapiens
cctggcttttacttt

SEQ ID NO: 1106114 - DNA, 16 bp, Homo sapiens
cctggcttttacttta

SEQ ID NO: 1106115 - DNA, 18 bp, Homo sapiens
cctggcttttcactgctg

SEQ ID NO: 1106116 - DNA, 22 bp, Homo sapiens
cctggcttttcactgctggctg

SEQ ID NO: 1106117 - DNA, 16 bp, Homo sapiens
cctggctttttaaaat

SEQ ID NO: 1106118 - DNA, 18 bp, Homo sapiens
cctggctttttaaaatat

SEQ ID NO: 1106119 - DNA, 18 bp, Homo sapiens
cctgggaaaggacccacc

SEQ ID NO: 1106120 - DNA, 18 bp, Homo sapiens
cctgggaaatattcccta

SEQ ID NO: 1106121 - DNA, 13 bp, Homo sapiens
cctgggaacacag

SEQ ID NO: 1106122 - DNA, 21 bp, Homo sapiens
cctgggaacacagttctgggc

SEQ ID NO: 1106123 - DNA, 22 bp, Homo sapiens
cctgggaacacagttctgggca

SEQ ID NO: 1106124 - DNA, 23 bp, Homo sapiens
cctgggaaggcgagtctggggac

SEQ ID NO: 1106125 - DNA, 18 bp, Homo sapiens
cctgggaatggaataact

SEQ ID NO: 1106126 - DNA, 19 bp, Homo sapiens
cctgggaatggaataacta

SEQ ID NO: 1106127 - DNA, 12 bp, Homo sapiens
cctgggacacag

SEQ ID NO: 1106128 - DNA, 17 bp, Homo sapiens
cctgggacacagaccca

SEQ ID NO: 1106129 - DNA, 16 bp, Homo sapiens
cctgggacacttccct

SEQ ID NO: 1106130 - DNA, 13 bp, Homo sapiens
cctgggacccagc

SEQ ID NO: 1106131 - DNA, 15 bp, Homo sapiens
cctgggacccagcta

SEQ ID NO: 1106132 - DNA, 16 bp, Homo sapiens
cctgggacccagctac

SEQ ID NO: 1106133 - DNA, 18 bp, Homo sapiens
cctgggacccagctactc

SEQ ID NO: 1106134 - DNA, 15 bp, Homo sapiens
cctgggaccccctcg

SEQ ID NO: 1106135 - DNA, 18 bp, Homo sapiens
cctgggaccccctcgcca

SEQ ID NO: 1106136 - DNA, 21 bp, Homo sapiens
cctgggaccccctcgccagct

SEQ ID NO: 1106137 - DNA, 19 bp, Homo sapiens
cctgggacctcccctgagg

SEQ ID NO: 1106138 - DNA, 14 bp, Homo sapiens
cctgggactcccag

SEQ ID NO: 1106139 - DNA, 18 bp, Homo sapiens
cctgggactcccagtgaa

SEQ ID NO: 1106140 - DNA, 18 bp, Homo sapiens
cctgggacttccatgcct

SEQ ID NO: 1106141 - DNA, 17 bp, Homo sapiens
cctgggagaacctcagg

SEQ ID NO: 1106142 - DNA, 19 bp, Homo sapiens
cctgggagaacctcaggct

SEQ ID NO: 1106143 - DNA, 21 bp, Homo sapiens
cctgggagaaggtctccaagg

SEQ ID NO: 1106144 - DNA, 22 bp, Homo sapiens
cctgggagaatcgctcctgcag

SEQ ID NO: 1106145 - DNA, 22 bp, Homo sapiens
cctgggagcccccaccacaaac

SEQ ID NO: 1106146 - DNA, 15 bp, Homo sapiens
cctgggagcgcctga

SEQ ID NO: 1106147 - DNA, 18 bp, Homo sapiens
cctgggagcgcctgaccc

SEQ ID NO: 1106148 - DNA, 18 bp, Homo sapiens
cctgggaggaagatgttt

SEQ ID NO: 1106149 - DNA, 16 bp, Homo sapiens
cctgggaggacaggca

SEQ ID NO: 1106150 - DNA, 17 bp, Homo sapiens
cctgggaggacaggcag

SEQ ID NO: 1106151 - DNA, 18 bp, Homo sapiens
cctgggaggacaggcagg

SEQ ID NO: 1106152 - DNA, 19 bp, Homo sapiens
cctgggaggacaggcaggc

SEQ ID NO: 1106153 - DNA, 13 bp, Homo sapiens
cctgggaggcaga

SEQ ID NO: 1106154 - DNA, 16 bp, Homo sapiens
cctgggaggcggagag

SEQ ID NO: 1106155 - DNA, 13 bp, Homo sapiens
cctgggagggttc

SEQ ID NO: 1106156 - DNA, 19 bp, Homo sapiens
cctgggagggttcccctgg

SEQ ID NO: 1106157 - DNA, 21 bp, Homo sapiens
cctgggagggttcccctggcc

SEQ ID NO: 1106158 - DNA, 18 bp, Homo sapiens
cctgggatcgtgcatttg

SEQ ID NO: 1106159 - DNA, 21 bp, Homo sapiens
cctgggatctggcacactccc

SEQ ID NO: 1106160 - DNA, 14 bp, Homo sapiens
cctgggatgcagtg

SEQ ID NO: 1106161 - DNA, 16 bp, Homo sapiens
cctgggatgctgaccc

SEQ ID NO: 1106162 - DNA, 20 bp, Homo sapiens
cctgggatggcgatggggac

SEQ ID NO: 1106163 - DNA, 13 bp, Homo sapiens
cctgggcaaagcc

SEQ ID NO: 1106164 - DNA, 23 bp, Homo sapiens
cctgggcaagtggatggcccagc

SEQ ID NO: 1106165 - DNA, 16 bp, Homo sapiens
cctgggcaccagcatt

SEQ ID NO: 1106166 - DNA, 15 bp, Homo sapiens
cctgggcacccacct

SEQ ID NO: 1106167 - DNA, 19 bp, Homo sapiens
cctgggcacccacctccac

SEQ ID NO: 1106168 - DNA, 21 bp, Homo sapiens
cctgggcacccacctccaccc

SEQ ID NO: 1106169 - DNA, 20 bp, Homo sapiens
cctgggcacctggggagtgg

SEQ ID NO: 1106170 - DNA, 13 bp, Homo sapiens
cctgggcactccg

SEQ ID NO: 1106171 - DNA, 23 bp, Homo sapiens
cctgggcactccgcgccgatgcc

SEQ ID NO: 1106172 - DNA, 17 bp, Homo sapiens
cctgggcagccaggctg

SEQ ID NO: 1106173 - DNA, 15 bp, Homo sapiens
cctgggcagccccac

SEQ ID NO: 1106174 - DNA, 16 bp, Homo sapiens
cctgggcagccccaca

SEQ ID NO: 1106175 - DNA, 13 bp, Homo sapiens
cctgggcagctcc

SEQ ID NO: 1106176 - DNA, 20 bp, Homo sapiens
cctgggcagctcctccctgt

SEQ ID NO: 1106177 - DNA, 22 bp, Homo sapiens
cctgggcagctcctccctgtgc

SEQ ID NO: 1106178 - DNA, 21 bp, Homo sapiens
cctgggcagcttctgttggca

SEQ ID NO: 1106179 - DNA, 12 bp, Homo sapiens
cctgggcaggcg

SEQ ID NO: 1106180 - DNA, 14 bp, Homo sapiens
cctgggcaggcggt

SEQ ID NO: 1106181 - DNA, 15 bp, Homo sapiens
cctgggcagtgagtg

SEQ ID NO: 1106182 - DNA, 17 bp, Homo sapiens
cctgggcagtgagtgcc

SEQ ID NO: 1106183 - DNA, 19 bp, Homo sapiens
cctgggcatgggtccaggg

SEQ ID NO: 1106184 - DNA, 20 bp, Homo sapiens
cctgggcatgggtccagggc

SEQ ID NO: 1106185 - DNA, 16 bp, Homo sapiens
cctgggcattgctttc

SEQ ID NO: 1106186 - DNA, 17 bp, Homo sapiens
cctgggcattgctttcc

SEQ ID NO: 1106187 - DNA, 19 bp, Homo sapiens
cctgggcatttggtgagag

SEQ ID NO: 1106188 - DNA, 15 bp, Homo sapiens
cctgggccacacctg

SEQ ID NO: 1106189 - DNA, 14 bp, Homo sapiens
cctgggccacctcc

SEQ ID NO: 1106190 - DNA, 15 bp, Homo sapiens
cctgggccacctcct

SEQ ID NO: 1106191 - DNA, 12 bp, Homo sapiens
cctgggccagga

SEQ ID NO: 1106192 - DNA, 16 bp, Homo sapiens
cctgggccaggcaggc

SEQ ID NO: 1106193 - DNA, 15 bp, Homo sapiens
cctgggccagggtct

SEQ ID NO: 1106194 - DNA, 18 bp, Homo sapiens
cctgggcccacagagcct

SEQ ID NO: 1106195 - DNA, 19 bp, Homo sapiens
cctgggcccacagagcctg

SEQ ID NO: 1106196 - DNA, 21 bp, Homo sapiens
cctgggcccacagagcctggc

SEQ ID NO: 1106197 - DNA, 18 bp, Homo sapiens
cctgggcccatctccctg

SEQ ID NO: 1106198 - DNA, 21 bp, Homo sapiens
cctgggccccaccacctaggc

SEQ ID NO: 1106199 - DNA, 23 bp, Homo sapiens
cctgggccccaccacctaggcca

SEQ ID NO: 1106200 - DNA, 13 bp, Homo sapiens
cctgggccccact

SEQ ID NO: 1106201 - DNA, 18 bp, Homo sapiens
cctgggcccctccacgcc

SEQ ID NO: 1106202 - DNA, 23 bp, Homo sapiens
cctgggcccctccacgcctcctg

SEQ ID NO: 1106203 - DNA, 14 bp, Homo sapiens
cctgggcccctccc

SEQ ID NO: 1106204 - DNA, 18 bp, Homo sapiens
cctgggcccctcccctca

SEQ ID NO: 1106205 - DNA, 19 bp, Homo sapiens
cctgggcccctcccctcag

SEQ ID NO: 1106206 - DNA, 22 bp, Homo sapiens
cctgggcccctcccctcagagc

SEQ ID NO: 1106207 - DNA, 18 bp, Homo sapiens
cctgggccctctctgctc

SEQ ID NO: 1106208 - DNA, 18 bp, Homo sapiens
cctgggccctgggctgga

SEQ ID NO: 1106209 - DNA, 15 bp, Homo sapiens
cctgggcccttgtgc

SEQ ID NO: 1106210 - DNA, 18 bp, Homo sapiens
cctgggcccttgtgctcc

SEQ ID NO: 1106211 - DNA, 22 bp, Homo sapiens
cctgggcctcagttcaacctgg

SEQ ID NO: 1106212 - DNA, 16 bp, Homo sapiens
cctgggcctgcccctg

SEQ ID NO: 1106213 - DNA, 17 bp, Homo sapiens
cctgggcctgcccctgt

SEQ ID NO: 1106214 - DNA, 12 bp, Homo sapiens
cctgggcctgct

SEQ ID NO: 1106215 - DNA, 13 bp, Homo sapiens
cctgggcctgtcc

SEQ ID NO: 1106216 - DNA, 14 bp, Homo sapiens
cctgggcctgtccc

SEQ ID NO: 1106217 - DNA, 16 bp, Homo sapiens
cctgggcctgtgcagc

SEQ ID NO: 1106218 - DNA, 17 bp, Homo sapiens
cctgggcctgtgcagca

SEQ ID NO: 1106219 - DNA, 23 bp, Homo sapiens
cctgggcctgtgcagcagcccag

SEQ ID NO: 1106220 - DNA, 19 bp, Homo sapiens
cctgggccttggctgggcc

SEQ ID NO: 1106221 - DNA, 14 bp, Homo sapiens
cctgggcctttcct

SEQ ID NO: 1106222 - DNA, 16 bp, Homo sapiens
cctgggcgccctggaa

SEQ ID NO: 1106223 - DNA, 17 bp, Homo sapiens
cctgggcgccctggaag

SEQ ID NO: 1106224 - DNA, 18 bp, Homo sapiens
cctgggcgccctggaagc

SEQ ID NO: 1106225 - DNA, 13 bp, Homo sapiens
cctgggcggagtc

SEQ ID NO: 1106226 - DNA, 18 bp, Homo sapiens
cctgggctcactgtgctg

SEQ ID NO: 1106227 - DNA, 23 bp, Homo sapiens
cctgggctcactgtgctggggca

SEQ ID NO: 1106228 - DNA, 16 bp, Homo sapiens
cctgggctccctcttg

SEQ ID NO: 1106229 - DNA, 12 bp, Homo sapiens
cctgggctctga

SEQ ID NO: 1106230 - DNA, 23 bp, Homo sapiens
cctgggctctggaagaggccttc

SEQ ID NO: 1106231 - DNA, 21 bp, Homo sapiens
cctgtgccccagctgccaggc

SEQ ID NO: 1106232 - DNA, 16 bp, Homo sapiens
cctgtgcccccagcct

SEQ ID NO: 1106233 - DNA, 19 bp, Homo sapiens
cctgtgcccccagcctcag

SEQ ID NO: 1106234 - DNA, 22 bp, Homo sapiens
cctgtgcccccagcctcagccc

SEQ ID NO: 1106235 - DNA, 23 bp, Homo sapiens
cctgtgcccccagcctcagccca

SEQ ID NO: 1106236 - DNA, 21 bp, Homo sapiens
cctgtgccctagatgcacgtg

SEQ ID NO: 1106237 - DNA, 14 bp, Homo sapiens
cctgtgccctcacc

SEQ ID NO: 1106238 - DNA, 18 bp, Homo sapiens
cctgtgcctaacaccagc

SEQ ID NO: 1106239 - DNA, 15 bp, Homo sapiens
cctgtgcctcctcac

SEQ ID NO: 1106240 - DNA, 13 bp, Homo sapiens
cctgtgcctggcc

SEQ ID NO: 1106241 - DNA, 14 bp, Homo sapiens
cctgtgcctggccc

SEQ ID NO: 1106242 - DNA, 13 bp, Homo sapiens
cctgtgcctgggc

SEQ ID NO: 1106243 - DNA, 20 bp, Homo sapiens
cctgtgctaagtctttccca

SEQ ID NO: 1106244 - DNA, 18 bp, Homo sapiens
cctgtgctcccctgccac

SEQ ID NO: 1106245 - DNA, 18 bp, Homo sapiens
cctgtgctccgtgcctcc

SEQ ID NO: 1106246 - DNA, 20 bp, Homo sapiens
cctgtgctccgtgcctccac

SEQ ID NO: 1106247 - DNA, 21 bp, Homo sapiens
cctgtgctccgtgcctccacc

SEQ ID NO: 1106248 - DNA, 13 bp, Homo sapiens
cctgtgctctgga

SEQ ID NO: 1106249 - DNA, 22 bp, Homo sapiens
cctgtgctggaccagctggcct

SEQ ID NO: 1106250 - DNA, 18 bp, Homo sapiens
cctgtgctggtgtcctga

SEQ ID NO: 1106251 - DNA, 21 bp, Homo sapiens
cctgtgctggtgtcctgacca

SEQ ID NO: 1106252 - DNA, 24 bp, Homo sapiens
cctgtgctggtgtcctgaccaccc

SEQ ID NO: 1106253 - DNA, 24 bp, Homo sapiens
cctgtgcttgcttagagtgcccag

SEQ ID NO: 1106254 - DNA, 12 bp, Homo sapiens
cctgtgctttga

SEQ ID NO: 1106255 - DNA, 19 bp, Homo sapiens
cctgtggaacataaaaagg

SEQ ID NO: 1106256 - DNA, 11 bp, Homo sapiens
cctgtggaagc

SEQ ID NO: 1106257 - DNA, 19 bp, Homo sapiens
cctgtggaagcatggctgt

SEQ ID NO: 1106258 - DNA, 24 bp, Homo sapiens
cctgtggaagcatggctgtctgca

SEQ ID NO: 1106259 - DNA, 20 bp, Homo sapiens
cctgtggaaggcagagaaat

SEQ ID NO: 1106260 - DNA, 16 bp, Homo sapiens
cctgtggagctcagcc

SEQ ID NO: 1106261 - DNA, 18 bp, Homo sapiens
cctgtggagtccagctct

SEQ ID NO: 1106262 - DNA, 19 bp, Homo sapiens
cctgtggagtccagctcta

SEQ ID NO: 1106263 - DNA, 20 bp, Homo sapiens
cctgtggatgataaaacaca

SEQ ID NO: 1106264 - DNA, 17 bp, Homo sapiens
cctgtggatgggatcct

SEQ ID NO: 1106265 - DNA, 21 bp, Homo sapiens
cctgtggatgggatcctctcc

SEQ ID NO: 1106266 - DNA, 22 bp, Homo sapiens
cctgtggatgggatcctctcca

SEQ ID NO: 1106267 - DNA, 13 bp, Homo sapiens
cctgtggcaggag

SEQ ID NO: 1106268 - DNA, 20 bp, Homo sapiens
cctgtggccaagttcttagt

SEQ ID NO: 1106269 - DNA, 14 bp, Homo sapiens
cctgtggccaggag

SEQ ID NO: 1106270 - DNA, 15 bp, Homo sapiens
cctgtggccccaccc

SEQ ID NO: 1106271 - DNA, 17 bp, Homo sapiens
cctgtggccccaccctg

SEQ ID NO: 1106272 - DNA, 14 bp, Homo sapiens
cctgtggccctggc

SEQ ID NO: 1106273 - DNA, 18 bp, Homo sapiens
cctgtggccgccacctga

SEQ ID NO: 1106274 - DNA, 19 bp, Homo sapiens
cctgtggcctgtgtcccat

SEQ ID NO: 1106275 - DNA, 14 bp, Homo sapiens
cctgtggccttgcc

SEQ ID NO: 1106276 - DNA, 17 bp, Homo sapiens
cctgtggcggtgcctgg

SEQ ID NO: 1106277 - DNA, 21 bp, Homo sapiens
cctgtggctcaggggagcaag

SEQ ID NO: 1106278 - DNA, 14 bp, Homo sapiens
cctgtggcttggag

SEQ ID NO: 1106279 - DNA, 16 bp, Homo sapiens
cctgtggcttggagtg

SEQ ID NO: 1106280 - DNA, 21 bp, Homo sapiens
cctgtggcttggagtggccaa

SEQ ID NO: 1106281 - DNA, 15 bp, Homo sapiens
cctgtgggagcctgc

SEQ ID NO: 1106282 - DNA, 13 bp, Homo sapiens
cctgtgggagggg

SEQ ID NO: 1106283 - DNA, 18 bp, Homo sapiens
cctgtgggcagcatgccc

SEQ ID NO: 1106284 - DNA, 12 bp, Homo sapiens
cctgtgggcctc

SEQ ID NO: 1106285 - DNA, 12 bp, Homo sapiens
cctgtgggcttc

SEQ ID NO: 1106286 - DNA, 19 bp, Homo sapiens
cctgtggggatttctccca

SEQ ID NO: 1106287 - DNA, 13 bp, Homo sapiens
cctgtggggcagg

SEQ ID NO: 1106288 - DNA, 14 bp, Homo sapiens
cctgtggggcagga

SEQ ID NO: 1106289 - DNA, 17 bp, Homo sapiens
cctgtggggcctgatgg

SEQ ID NO: 1106290 - DNA, 17 bp, Homo sapiens
cctgtgggggtggccat

SEQ ID NO: 1106291 - DNA, 13 bp, Homo sapiens
cctgtgggtcccc

SEQ ID NO: 1106292 - DNA, 17 bp, Homo sapiens
cctgtgggtccccactc

SEQ ID NO: 1106293 - DNA, 22 bp, Homo sapiens
cctgtgggtccccactcacccc

SEQ ID NO: 1106294 - DNA, 16 bp, Homo sapiens
cctgtgggtctctgaa

SEQ ID NO: 1106295 - DNA, 20 bp, Homo sapiens
cctgtgggtttgggtgcctc

SEQ ID NO: 1106296 - DNA, 15 bp, Homo sapiens
cctgtggtgaagtgt

SEQ ID NO: 1106297 - DNA, 18 bp, Homo sapiens
cctgtggtgaagtgtggc

SEQ ID NO: 1106298 - DNA, 21 bp, Homo sapiens
cctgtggtgaagtgtggctgg

SEQ ID NO: 1106299 - DNA, 19 bp, Homo sapiens
cctgtggtgacaggcccag

SEQ ID NO: 1106300 - DNA, 19 bp, Homo sapiens
cctgtggtgatgtgcctgt

SEQ ID NO: 1106301 - DNA, 20 bp, Homo sapiens
cctgtggtgatgtgcctgta

SEQ ID NO: 1106302 - DNA, 14 bp, Homo sapiens
cctgtggtggctcc

SEQ ID NO: 1106303 - DNA, 23 bp, Homo sapiens
cctgtggtggctccccctctgct

SEQ ID NO: 1106304 - DNA, 23 bp, Homo sapiens
cctgtggttacagtgcagacagg

SEQ ID NO: 1106305 - DNA, 17 bp, Homo sapiens
cctgtgtccacctgtgg

SEQ ID NO: 1106306 - DNA, 17 bp, Homo sapiens
cctgtgtccagcagctg

SEQ ID NO: 1106307 - DNA, 18 bp, Homo sapiens
cctgtgtccagcagctgc

SEQ ID NO: 1106308 - DNA, 13 bp, Homo sapiens
cctgtgtccatct

SEQ ID NO: 1106309 - DNA, 14 bp, Homo sapiens
cctgtgtccatctg

SEQ ID NO: 1106310 - DNA, 19 bp, Homo sapiens
cctgtgtccatgcgctcag

SEQ ID NO: 1106311 - DNA, 11 bp, Homo sapiens
cctgtgtccca

SEQ ID NO: 1106312 - DNA, 21 bp, Homo sapiens
cctgtgtcccatgacccaccc

SEQ ID NO: 1106313 - DNA, 13 bp, Homo sapiens
cctgtgtcccctg

SEQ ID NO: 1106314 - DNA, 13 bp, Homo sapiens
cctgtgtcctgaa

SEQ ID NO: 1106315 - DNA, 14 bp, Homo sapiens
cctgtgtgactcca

SEQ ID NO: 1106316 - DNA, 20 bp, Homo sapiens
cctgtgtggatgctgagctg

SEQ ID NO: 1106317 - DNA, 21 bp, Homo sapiens
cctgtgtggatgctgagctgt

SEQ ID NO: 1106318 - DNA, 19 bp, Homo sapiens
cctgtgtgtactctgtcca

SEQ ID NO: 1106319 - DNA, 20 bp, Homo sapiens
cctgtgtgtccaaaactgcc

SEQ ID NO: 1106320 - DNA, 21 bp, Homo sapiens
cctgtgtgtccaaaactgcct

SEQ ID NO: 1106321 - DNA, 14 bp, Homo sapiens
cctgtgtgtgtgta

SEQ ID NO: 1106322 - DNA, 19 bp, Homo sapiens
cctgtgtgtgtgtgtgctg

SEQ ID NO: 1106323 - DNA, 16 bp, Homo sapiens
cctgtgttctgggctg

SEQ ID NO: 1106324 - DNA, 20 bp, Homo sapiens
cctgtgttgtctctagagca

SEQ ID NO: 1106325 - DNA, 22 bp, Homo sapiens
cctgtgttgtctctagagcagg

SEQ ID NO: 1106326 - DNA, 18 bp, Homo sapiens
cctgtgtttgtcctgggt

SEQ ID NO: 1106327 - DNA, 19 bp, Homo sapiens
cctgtgtttttttctaaaa

SEQ ID NO: 1106328 - DNA, 23 bp, Homo sapiens
cctgtgtttttttctaaaaaggc

SEQ ID NO: 1106329 - DNA, 17 bp, Homo sapiens
cctgttaaaatgtacac

SEQ ID NO: 1106330 - DNA, 22 bp, Homo sapiens
cctgttacttgaaataccagtg

SEQ ID NO: 1106331 - DNA, 23 bp, Homo sapiens
cctgttacttgaaataccagtga

SEQ ID NO: 1106332 - DNA, 15 bp, Homo sapiens
cctgttacttgcttc

SEQ ID NO: 1106333 - DNA, 13 bp, Homo sapiens
cctgttagccagg

SEQ ID NO: 1106334 - DNA, 15 bp, Homo sapiens
cctgttagttttgta

SEQ ID NO: 1106335 - DNA, 14 bp, Homo sapiens
cctgttcacaccag

SEQ ID NO: 1106336 - DNA, 21 bp, Homo sapiens
cctgttcactctacttagcat

SEQ ID NO: 1106337 - DNA, 23 bp, Homo sapiens
cctgttcagaaaggggctcttct

SEQ ID NO: 1106338 - DNA, 19 bp, Homo sapiens
cctgttcagtgtcccgggc

SEQ ID NO: 1106339 - DNA, 14 bp, Homo sapiens
cctgttccaatgaa

SEQ ID NO: 1106340 - DNA, 17 bp, Homo sapiens
cctgttcccctcactgg

SEQ ID NO: 1106341 - DNA, 18 bp, Homo sapiens
cctgttcccctcactgga

SEQ ID NO: 1106342 - DNA, 15 bp, Homo sapiens
cctgttcccctctcc

SEQ ID NO: 1106343 - DNA, 13 bp, Homo sapiens
cctgttccctcct

SEQ ID NO: 1106344 - DNA, 15 bp, Homo sapiens
cctgttccctcctgg

SEQ ID NO: 1106345 - DNA, 14 bp, Homo sapiens
cctgttccctggag

SEQ ID NO: 1106346 - DNA, 13 bp, Homo sapiens
cctgttccctgtt

SEQ ID NO: 1106347 - DNA, 12 bp, Homo sapiens
cctgttcctccc

SEQ ID NO: 1106348 - DNA, 17 bp, Homo sapiens
cctgttctatgccttta

SEQ ID NO: 1106349 - DNA, 12 bp, Homo sapiens
cctgttctccct

SEQ ID NO: 1106350 - DNA, 19 bp, Homo sapiens
cctgttctccctttctctc

SEQ ID NO: 1106351 - DNA, 22 bp, Homo sapiens
cctgttctccctttctctctcc

SEQ ID NO: 1106352 - DNA, 13 bp, Homo sapiens
cctgttctcttca

SEQ ID NO: 1106353 - DNA, 14 bp, Homo sapiens
ccttccccaggccc

SEQ ID NO: 1106354 - DNA, 17 bp, Homo sapiens
ccttccccaggcccacc

SEQ ID NO: 1106355 - DNA, 15 bp, Homo sapiens
ccttcccccatccct

SEQ ID NO: 1106356 - DNA, 18 bp, Homo sapiens
ccttcccccatccctacc

SEQ ID NO: 1106357 - DNA, 21 bp, Homo sapiens
ccttcccccatccctaccact

SEQ ID NO: 1106358 - DNA, 18 bp, Homo sapiens
ccttccccccatctctga

SEQ ID NO: 1106359 - DNA, 19 bp, Homo sapiens
ccttccccccatctctgag

SEQ ID NO: 1106360 - DNA, 20 bp, Homo sapiens
ccttccccctcccagggcca

SEQ ID NO: 1106361 - DNA, 21 bp, Homo sapiens
ccttcccctcccgacagccca

SEQ ID NO: 1106362 - DNA, 14 bp, Homo sapiens
ccttcccctccctg

SEQ ID NO: 1106363 - DNA, 19 bp, Homo sapiens
ccttcccctccctggctcc

SEQ ID NO: 1106364 - DNA, 16 bp, Homo sapiens
ccttcccctccttctc

SEQ ID NO: 1106365 - DNA, 21 bp, Homo sapiens
ccttcccctgcacctggcctg

SEQ ID NO: 1106366 - DNA, 22 bp, Homo sapiens
ccttccccttcaccgctcccca

SEQ ID NO: 1106367 - DNA, 13 bp, Homo sapiens
ccttccccttccc

SEQ ID NO: 1106368 - DNA, 14 bp, Homo sapiens
ccttccccttctgt

SEQ ID NO: 1106369 - DNA, 23 bp, Homo sapiens
ccttcccgacccagccagctgca

SEQ ID NO: 1106370 - DNA, 12 bp, Homo sapiens
ccttccctccaa

SEQ ID NO: 1106371 - DNA, 13 bp, Homo sapiens
ccttccctcctgt

SEQ ID NO: 1106372 - DNA, 16 bp, Homo sapiens
ccttccctcctgtgcc

SEQ ID NO: 1106373 - DNA, 23 bp, Homo sapiens
ccttccctgatggcctttggacc

SEQ ID NO: 1106374 - DNA, 14 bp, Homo sapiens
ccttccctgcccca

SEQ ID NO: 1106375 - DNA, 13 bp, Homo sapiens
ccttccctggccc

SEQ ID NO: 1106376 - DNA, 14 bp, Homo sapiens
ccttccctggcccc

SEQ ID NO: 1106377 - DNA, 15 bp, Homo sapiens
ccttccctggccccg

SEQ ID NO: 1106378 - DNA, 18 bp, Homo sapiens
ccttccctgggctgtgct

SEQ ID NO: 1106379 - DNA, 18 bp, Homo sapiens
ccttccctggggagccct

SEQ ID NO: 1106380 - DNA, 12 bp, Homo sapiens
ccttccctgtcc

SEQ ID NO: 1106381 - DNA, 14 bp, Homo sapiens
ccttccctgtccct

SEQ ID NO: 1106382 - DNA, 15 bp, Homo sapiens
ccttccctgttctcc

SEQ ID NO: 1106383 - DNA, 17 bp, Homo sapiens
ccttccctgttctccct

SEQ ID NO: 1106384 - DNA, 20 bp, Homo sapiens
ccttcccttgccactttgca

SEQ ID NO: 1106385 - DNA, 18 bp, Homo sapiens
ccttcccttttctgttct

SEQ ID NO: 1106386 - DNA, 18 bp, Homo sapiens
ccttccgaccctctggga

SEQ ID NO: 1106387 - DNA, 22 bp, Homo sapiens
ccttccgaccctctgggaacct

SEQ ID NO: 1106388 - DNA, 22 bp, Homo sapiens
ccttccgcagtgtggccaggct

SEQ ID NO: 1106389 - DNA, 12 bp, Homo sapiens
ccttccgctctg

SEQ ID NO: 1106390 - DNA, 15 bp, Homo sapiens
ccttccgctctgagg

SEQ ID NO: 1106391 - DNA, 18 bp, Homo sapiens
ccttccgtccatccccct

SEQ ID NO: 1106392 - DNA, 18 bp, Homo sapiens
ccttcctaattccacagc

SEQ ID NO: 1106393 - DNA, 19 bp, Homo sapiens
ccttcctaattccacagct

SEQ ID NO: 1106394 - DNA, 20 bp, Homo sapiens
ccttcctattctcctgccat

SEQ ID NO: 1106395 - DNA, 15 bp, Homo sapiens
ccttcctcacttcca

SEQ ID NO: 1106396 - DNA, 16 bp, Homo sapiens
ccttcctcatccaccc

SEQ ID NO: 1106397 - DNA, 14 bp, Homo sapiens
ccttcctccattgc

SEQ ID NO: 1106398 - DNA, 14 bp, Homo sapiens
ccttcctccccaca

SEQ ID NO: 1106399 - DNA, 18 bp, Homo sapiens
ccttcctccccacactcc

SEQ ID NO: 1106400 - DNA, 19 bp, Homo sapiens
ccttcctccccacactcca

SEQ ID NO: 1106401 - DNA, 21 bp, Homo sapiens
ccttcctccccacactccact

SEQ ID NO: 1106402 - DNA, 10 bp, Homo sapiens
ccttcctcct

SEQ ID NO: 1106403 - DNA, 13 bp, Homo sapiens
ccttcctcctcca

SEQ ID NO: 1106404 - DNA, 16 bp, Homo sapiens
ccttcctcctccacag

SEQ ID NO: 1106405 - DNA, 20 bp, Homo sapiens
ccttcctcctccacagtgct

SEQ ID NO: 1106406 - DNA, 12 bp, Homo sapiens
ccttcctcctga

SEQ ID NO: 1106407 - DNA, 20 bp, Homo sapiens
ccttcctcggtggctctggg

SEQ ID NO: 1106408 - DNA, 17 bp, Homo sapiens
ccttcctctcaagctag

SEQ ID NO: 1106409 - DNA, 12 bp, Homo sapiens
ccttcctctgag

SEQ ID NO: 1106410 - DNA, 12 bp, Homo sapiens
ccttcctctgca

SEQ ID NO: 1106411 - DNA, 18 bp, Homo sapiens
ccttcctctgcagctgac

SEQ ID NO: 1106412 - DNA, 14 bp, Homo sapiens
ccttcctcttcggc

SEQ ID NO: 1106413 - DNA, 20 bp, Homo sapiens
ccttcctcttcggccctcag

SEQ ID NO: 1106414 - DNA, 14 bp, Homo sapiens
ccttcctgaagagt

SEQ ID NO: 1106415 - DNA, 15 bp, Homo sapiens
ccttcctgcatttct

SEQ ID NO: 1106416 - DNA, 17 bp, Homo sapiens
ccttcctgcatttctct

SEQ ID NO: 1106417 - DNA, 14 bp, Homo sapiens
ccttcctgccccca

SEQ ID NO: 1106418 - DNA, 11 bp, Homo sapiens
ccttcctgctg

SEQ ID NO: 1106419 - DNA, 14 bp, Homo sapiens
ccttcctgcttcct

SEQ ID NO: 1106420 - DNA, 16 bp, Homo sapiens
ccttcctggaaacagc

SEQ ID NO: 1106421 - DNA, 12 bp, Homo sapiens
ccttcctggaca

SEQ ID NO: 1106422 - DNA, 12 bp, Homo sapiens
ccttcctggccc

SEQ ID NO: 1106423 - DNA, 14 bp, Homo sapiens
ccttcctggcccag

SEQ ID NO: 1106424 - DNA, 16 bp, Homo sapiens
ccttcctggcccaggc

SEQ ID NO: 1106425 - DNA, 17 bp, Homo sapiens
ccttcctggcccaggcc

SEQ ID NO: 1106426 - DNA, 22 bp, Homo sapiens
ccttcctggcctcactggctgg

SEQ ID NO: 1106427 - DNA, 23 bp, Homo sapiens
ccttcctggcctcactggctggg

SEQ ID NO: 1106428 - DNA, 16 bp, Homo sapiens
ccttcctggcctgaga

SEQ ID NO: 1106429 - DNA, 12 bp, Homo sapiens
ccttcctgggac

SEQ ID NO: 1106430 - DNA, 24 bp, Homo sapiens
ccttcctgggaccccctcgccagc

SEQ ID NO: 1106431 - DNA, 14 bp, Homo sapiens
ccttcctgggagga

SEQ ID NO: 1106432 - DNA, 21 bp, Homo sapiens
ccttcctgggaggacaggcag

SEQ ID NO: 1106433 - DNA, 19 bp, Homo sapiens
ccttcctgtcccacctctt

SEQ ID NO: 1106434 - DNA, 18 bp, Homo sapiens
ccttcctgtccctgaggt

SEQ ID NO: 1106435 - DNA, 19 bp, Homo sapiens
ccttcctgtccctgaggtt

SEQ ID NO: 1106436 - DNA, 13 bp, Homo sapiens
ccttcctgtcctg

SEQ ID NO: 1106437 - DNA, 22 bp, Homo sapiens
ccttcctgtcctgcctcctcat

SEQ ID NO: 1106438 - DNA, 15 bp, Homo sapiens
ccttcctgtgccctg

SEQ ID NO: 1106439 - DNA, 23 bp, Homo sapiens
ccttcctgtgggtgttctttcct

SEQ ID NO: 1106440 - DNA, 20 bp, Homo sapiens
ccttcctgttccctcctggt

SEQ ID NO: 1106441 - DNA, 16 bp, Homo sapiens
ccttcctgttcttcct

SEQ ID NO: 1106442 - DNA, 13 bp, Homo sapiens
ccttcctgtttca

SEQ ID NO: 1106443 - DNA, 16 bp, Homo sapiens
ccttcctgtttcagac

SEQ ID NO: 1106444 - DNA, 19 bp, Homo sapiens
ccttcctgtttttcacatt

SEQ ID NO: 1106445 - DNA, 13 bp, Homo sapiens
ccttccttcccac

SEQ ID NO: 1106446 - DNA, 14 bp, Homo sapiens
ccttccttccctgg

SEQ ID NO: 1106447 - DNA, 15 bp, Homo sapiens
ccttccttccctggg

SEQ ID NO: 1106448 - DNA, 13 bp, Homo sapiens
ccttccttcctgt

SEQ ID NO: 1106449 - DNA, 11 bp, Homo sapiens
ccttccttctg

SEQ ID NO: 1106450 - DNA, 14 bp, Homo sapiens
ccttccttctgctc

SEQ ID NO: 1106451 - DNA, 19 bp, Homo sapiens
ccttccttctgctcccacc

SEQ ID NO: 1106452 - DNA, 17 bp, Homo sapiens
ccttccttgactgtcta

SEQ ID NO: 1106453 - DNA, 18 bp, Homo sapiens
ccttccttgctctgcacc

SEQ ID NO: 1106454 - DNA, 19 bp, Homo sapiens
ccttccttgctctgcaccc

SEQ ID NO: 1106455 - DNA, 17 bp, Homo sapiens
ccttcctttcctctgca

SEQ ID NO: 1106456 - DNA, 13 bp, Homo sapiens
ccttcctttctcc

SEQ ID NO: 1106457 - DNA, 18 bp, Homo sapiens
ccttccttttccctgctt

SEQ ID NO: 1106458 - DNA, 20 bp, Homo sapiens
ccttccttttccctgcttcc

SEQ ID NO: 1106459 - DNA, 15 bp, Homo sapiens
ccttcgaaaggcctt

SEQ ID NO: 1106460 - DNA, 13 bp, Homo sapiens
ccttcgacatgct

SEQ ID NO: 1106461 - DNA, 20 bp, Homo sapiens
ccttcgcaccttgctgtgtg

SEQ ID NO: 1106462 - DNA, 16 bp, Homo sapiens
ccttcgcttcttgcct

SEQ ID NO: 1106463 - DNA, 20 bp, Homo sapiens
ccttcgcttcttgcctctgt

SEQ ID NO: 1106464 - DNA, 23 bp, Homo sapiens
ccttcggagcgttctctgtccta

SEQ ID NO: 1106465 - DNA, 14 bp, Homo sapiens
ccttcgggctgtgc

SEQ ID NO: 1106466 - DNA, 16 bp, Homo sapiens
ccttcgggctgtgccc

SEQ ID NO: 1106467 - DNA, 14 bp, Homo sapiens
ccttcgtatcccga

SEQ ID NO: 1106468 - DNA, 17 bp, Homo sapiens
ccttcgtctttcccatg

SEQ ID NO: 1106469 - DNA, 13 bp, Homo sapiens
ccttcgtgccccc

SEQ ID NO: 1106470 - DNA, 13 bp, Homo sapiens
ccttcgtgtctct

SEQ ID NO: 1106471 - DNA, 18 bp, Homo sapiens
ccttcgtgtgctgctgct

SEQ ID NO: 1106472 - DNA, 16 bp, Homo sapiens
ccttcgtgtggctcct

SEQ ID NO: 1106473 - DNA, 17 bp, Homo sapiens
ccttcgtgtggctcctg

SEQ ID NO: 1106474 - DNA, 10 bp, Homo sapiens
ccttctaaaa

SEQ ID NO: 1106475 - DNA, 15 bp, Homo sapiens
ccttctaaaagccat

SEQ ID NO: 1106476 - DNA, 23 bp, Homo sapiens
ccttctaaaagccattattatga

SEQ ID NO: 1106477 - DNA, 23 bp, Homo sapiens
ccttggagagagaggctgcctca

SEQ ID NO: 1106478 - DNA, 12 bp, Homo sapiens
ccttggagagga

SEQ ID NO: 1106479 - DNA, 22 bp, Homo sapiens
ccttggagctgccgtgcctgtg

SEQ ID NO: 1106480 - DNA, 11 bp, Homo sapiens
ccttggagtga

SEQ ID NO: 1106481 - DNA, 22 bp, Homo sapiens
ccttggatcgctaagctggctc

SEQ ID NO: 1106482 - DNA, 15 bp, Homo sapiens
ccttggatttggact

SEQ ID NO: 1106483 - DNA, 11 bp, Homo sapiens
ccttggcacca

SEQ ID NO: 1106484 - DNA, 15 bp, Homo sapiens
ccttggcaccaccag

SEQ ID NO: 1106485 - DNA, 16 bp, Homo sapiens
ccttggcacccccatg

SEQ ID NO: 1106486 - DNA, 14 bp, Homo sapiens
ccttggccacagac

SEQ ID NO: 1106487 - DNA, 17 bp, Homo sapiens
ccttggccacagactga

SEQ ID NO: 1106488 - DNA, 17 bp, Homo sapiens
ccttggcccaggagctc

SEQ ID NO: 1106489 - DNA, 18 bp, Homo sapiens
ccttggcccaggagctct

SEQ ID NO: 1106490 - DNA, 13 bp, Homo sapiens
ccttggccccaga

SEQ ID NO: 1106491 - DNA, 17 bp, Homo sapiens
ccttggcccctcacatc

SEQ ID NO: 1106492 - DNA, 20 bp, Homo sapiens
ccttggcccctcacatcctc

SEQ ID NO: 1106493 - DNA, 19 bp, Homo sapiens
ccttggccggctgtgctca

SEQ ID NO: 1106494 - DNA, 23 bp, Homo sapiens
ccttggccggctgtgctcagaga

SEQ ID NO: 1106495 - DNA, 11 bp, Homo sapiens
ccttggcctca

SEQ ID NO: 1106496 - DNA, 18 bp, Homo sapiens
ccttggcctctccttgga

SEQ ID NO: 1106497 - DNA, 23 bp, Homo sapiens
ccttggcctgtctcatccccagg

SEQ ID NO: 1106498 - DNA, 23 bp, Homo sapiens
ccttggctatgaaaatgagccct

SEQ ID NO: 1106499 - DNA, 15 bp, Homo sapiens
ccttggctcagacat

SEQ ID NO: 1106500 - DNA, 19 bp, Homo sapiens
ccttggctcccattcactc

SEQ ID NO: 1106501 - DNA, 18 bp, Homo sapiens
ccttggctgactggggct

SEQ ID NO: 1106502 - DNA, 18 bp, Homo sapiens
ccttggctgcagccatcc

SEQ ID NO: 1106503 - DNA, 13 bp, Homo sapiens
ccttggctgcagg

SEQ ID NO: 1106504 - DNA, 19 bp, Homo sapiens
ccttggctgcaggcaacac

SEQ ID NO: 1106505 - DNA, 23 bp, Homo sapiens
ccttggctgctcactgtccacat

SEQ ID NO: 1106506 - DNA, 17 bp, Homo sapiens
ccttggctgggcctctg

SEQ ID NO: 1106507 - DNA, 20 bp, Homo sapiens
ccttggctgtctgtgggccg

SEQ ID NO: 1106508 - DNA, 19 bp, Homo sapiens
ccttggctttcagagccag

SEQ ID NO: 1106509 - DNA, 15 bp, Homo sapiens
ccttgggaaggacac

SEQ ID NO: 1106510 - DNA, 16 bp, Homo sapiens
ccttgggaaggacaca

SEQ ID NO: 1106511 - DNA, 12 bp, Homo sapiens
ccttgggacagc

SEQ ID NO: 1106512 - DNA, 15 bp, Homo sapiens
ccttgggacagccag

SEQ ID NO: 1106513 - DNA, 19 bp, Homo sapiens
ccttgggacagccagagct

SEQ ID NO: 1106514 - DNA, 20 bp, Homo sapiens
ccttgggacagccagagctg

SEQ ID NO: 1106515 - DNA, 21 bp, Homo sapiens
ccttgggacagccagagctgg

SEQ ID NO: 1106516 - DNA, 11 bp, Homo sapiens
ccttgggagga

SEQ ID NO: 1106517 - DNA, 22 bp, Homo sapiens
ccttgggagtcattaccacgcc

SEQ ID NO: 1106518 - DNA, 18 bp, Homo sapiens
ccttgggatcagatcaag

SEQ ID NO: 1106519 - DNA, 17 bp, Homo sapiens
ccttgggcatccaccca

SEQ ID NO: 1106520 - DNA, 16 bp, Homo sapiens
ccttgggccacgctct

SEQ ID NO: 1106521 - DNA, 14 bp, Homo sapiens
ccttgggccctgga

SEQ ID NO: 1106522 - DNA, 17 bp, Homo sapiens
ccttgggccctttgagt

SEQ ID NO: 1106523 - DNA, 11 bp, Homo sapiens
ccttgggcctt

SEQ ID NO: 1106524 - DNA, 15 bp, Homo sapiens
ccttgggcctttcag

SEQ ID NO: 1106525 - DNA, 12 bp, Homo sapiens
ccttgggctcct

SEQ ID NO: 1106526 - DNA, 14 bp, Homo sapiens
ccttgggctcctgg

SEQ ID NO: 1106527 - DNA, 18 bp, Homo sapiens
ccttgggctcctggctgc

SEQ ID NO: 1106528 - DNA, 22 bp, Homo sapiens
ccttgggctcctggctgccagg

SEQ ID NO: 1106529 - DNA, 15 bp, Homo sapiens
ccttgggctgctcct

SEQ ID NO: 1106530 - DNA, 22 bp, Homo sapiens
ccttgggctgggacttcttacc

SEQ ID NO: 1106531 - DNA, 17 bp, Homo sapiens
ccttggggaagggtggg

SEQ ID NO: 1106532 - DNA, 22 bp, Homo sapiens
ccttggggaatttcctctattg

SEQ ID NO: 1106533 - DNA, 23 bp, Homo sapiens
ccttggggaatttcctctattga

SEQ ID NO: 1106534 - DNA, 12 bp, Homo sapiens
ccttggggaggg

SEQ ID NO: 1106535 - DNA, 14 bp, Homo sapiens
ccttggggggccaa

SEQ ID NO: 1106536 - DNA, 16 bp, Homo sapiens
ccttggggtccctcca

SEQ ID NO: 1106537 - DNA, 20 bp, Homo sapiens
ccttggggtgagggacagag

SEQ ID NO: 1106538 - DNA, 19 bp, Homo sapiens
ccttggggtgggggccagg

SEQ ID NO: 1106539 - DNA, 21 bp, Homo sapiens
ccttggggtgggggccaggcc

SEQ ID NO: 1106540 - DNA, 22 bp, Homo sapiens
ccttggggtgggggccaggcct

SEQ ID NO: 1106541 - DNA, 15 bp, Homo sapiens
ccttgggtggcccct

SEQ ID NO: 1106542 - DNA, 19 bp, Homo sapiens
ccttgggttccaaccaggc

SEQ ID NO: 1106543 - DNA, 16 bp, Homo sapiens
ccttggtatgtgccag

SEQ ID NO: 1106544 - DNA, 20 bp, Homo sapiens
ccttggtatgtgccaggctt

SEQ ID NO: 1106545 - DNA, 15 bp, Homo sapiens
ccttggtccctctca

SEQ ID NO: 1106546 - DNA, 16 bp, Homo sapiens
ccttggtgctcttgct

SEQ ID NO: 1106547 - DNA, 21 bp, Homo sapiens
ccttggtggagcagccagagc

SEQ ID NO: 1106548 - DNA, 22 bp, Homo sapiens
ccttggtggagcagccagagct

SEQ ID NO: 1106549 - DNA, 15 bp, Homo sapiens
ccttggtggcaagag

SEQ ID NO: 1106550 - DNA, 17 bp, Homo sapiens
ccttggtggcaagagcc

SEQ ID NO: 1106551 - DNA, 18 bp, Homo sapiens
ccttggtgtccacctggc

SEQ ID NO: 1106552 - DNA, 19 bp, Homo sapiens
ccttggtgtccacctggcc

SEQ ID NO: 1106553 - DNA, 20 bp, Homo sapiens
ccttggtgtccacctggccc

SEQ ID NO: 1106554 - DNA, 22 bp, Homo sapiens
ccttggtgtttcccttcctcgg

SEQ ID NO: 1106555 - DNA, 23 bp, Homo sapiens
ccttggtgtttcccttcctcggt

SEQ ID NO: 1106556 - DNA, 17 bp, Homo sapiens
ccttggttcatcagtgt

SEQ ID NO: 1106557 - DNA, 18 bp, Homo sapiens
ccttggttctggccaccc

SEQ ID NO: 1106558 - DNA, 23 bp, Homo sapiens
ccttggttctggccaccccagag

SEQ ID NO: 1106559 - DNA, 16 bp, Homo sapiens
ccttgtaattctaaat

SEQ ID NO: 1106560 - DNA, 19 bp, Homo sapiens
ccttgtaattctaaatgaa

SEQ ID NO: 1106561 - DNA, 16 bp, Homo sapiens
ccttgtacagtgtctg

SEQ ID NO: 1106562 - DNA, 17 bp, Homo sapiens
ccttgtacttgcttgta

SEQ ID NO: 1106563 - DNA, 20 bp, Homo sapiens
ccttgtatgtgggtgtttat

SEQ ID NO: 1106564 - DNA, 19 bp, Homo sapiens
ccttgtcaatactgagcca

SEQ ID NO: 1106565 - DNA, 16 bp, Homo sapiens
ccttgtcccagccagt

SEQ ID NO: 1106566 - DNA, 17 bp, Homo sapiens
ccttgtcctcagccagt

SEQ ID NO: 1106567 - DNA, 15 bp, Homo sapiens
ccttgtcctcccagg

SEQ ID NO: 1106568 - DNA, 14 bp, Homo sapiens
ccttgtcctgccag

SEQ ID NO: 1106569 - DNA, 20 bp, Homo sapiens
ccttgtcctgccagctgcct

SEQ ID NO: 1106570 - DNA, 20 bp, Homo sapiens
ccttgtcgcgcgtctcccat

SEQ ID NO: 1106571 - DNA, 15 bp, Homo sapiens
ccttgtctccctggt

SEQ ID NO: 1106572 - DNA, 17 bp, Homo sapiens
ccttgtctctcactgca

SEQ ID NO: 1106573 - DNA, 12 bp, Homo sapiens
ccttgtctctgg

SEQ ID NO: 1106574 - DNA, 13 bp, Homo sapiens
ccttgtctgggtg

SEQ ID NO: 1106575 - DNA, 21 bp, Homo sapiens
ccttgtctgggtgcagctggg

SEQ ID NO: 1106576 - DNA, 20 bp, Homo sapiens
ccttgtcttcccccctctcc

SEQ ID NO: 1106577 - DNA, 19 bp, Homo sapiens
ccttgtctttactgacaag

SEQ ID NO: 1106578 - DNA, 14 bp, Homo sapiens
ccttgtcttttcaa

SEQ ID NO: 1106579 - DNA, 22 bp, Homo sapiens
ccttgtcttttcaagtaatttt

SEQ ID NO: 1106580 - DNA, 19 bp, Homo sapiens
ccttgtgacttacaatttg

SEQ ID NO: 1106581 - DNA, 21 bp, Homo sapiens
ccttgtgacttacaatttgca

SEQ ID NO: 1106582 - DNA, 14 bp, Homo sapiens
ccttgtgccctgcc

SEQ ID NO: 1106583 - DNA, 17 bp, Homo sapiens
ccttgtgccctgccccc

SEQ ID NO: 1106584 - DNA, 18 bp, Homo sapiens
ccttgtgccctgccccca

SEQ ID NO: 1106585 - DNA, 21 bp, Homo sapiens
ccttgtggactggctgtgccc

SEQ ID NO: 1106586 - DNA, 22 bp, Homo sapiens
ccttgtggactggctgtgcccc

SEQ ID NO: 1106587 - DNA, 21 bp, Homo sapiens
ccttgtggccttttttataac

SEQ ID NO: 1106588 - DNA, 23 bp, Homo sapiens
ccttgtggtctttgctgctgctc

SEQ ID NO: 1106589 - DNA, 21 bp, Homo sapiens
ccttgtgtcagagctgggagt

SEQ ID NO: 1106590 - DNA, 15 bp, Homo sapiens
ccttgtgtgtcaggc

SEQ ID NO: 1106591 - DNA, 14 bp, Homo sapiens
ccttgtgtgtgccc

SEQ ID NO: 1106592 - DNA, 15 bp, Homo sapiens
ccttgtgtgtgccct

SEQ ID NO: 1106593 - DNA, 23 bp, Homo sapiens
ccttgtgttgcactgaacaggtt

SEQ ID NO: 1106594 - DNA, 14 bp, Homo sapiens
ccttgtgtttctgt

SEQ ID NO: 1106595 - DNA, 19 bp, Homo sapiens
ccttgttcatggagagctg

SEQ ID NO: 1106596 - DNA, 17 bp, Homo sapiens
ccttgttgcactgcccc

SEQ ID NO: 1106597 - DNA, 20 bp, Homo sapiens
ccttgttgcactgccccctg

SEQ ID NO: 1106598 - DNA, 20 bp, Homo sapiens
cgagtggtgacaggacgctg

SEQ ID NO: 1106599 - DNA, 17 bp, Homo sapiens
cgagtgtagctgtgaaa

SEQ ID NO: 1106600 - DNA, 22 bp, Homo sapiens
cgagtgtgctgtatggcccagg

SEQ ID NO: 1106601 - DNA, 11 bp, Homo sapiens
cgagtgtgtgc

SEQ ID NO: 1106602 - DNA, 19 bp, Homo sapiens
cgagtgtgtgcatgtgtgt

SEQ ID NO: 1106603 - DNA, 18 bp, Homo sapiens
cgagtttgcaatgtcaca

SEQ ID NO: 1106604 - DNA, 23 bp, Homo sapiens
cgagtttggatgttgtaaataaa

SEQ ID NO: 1106605 - DNA, 15 bp, Homo sapiens
cgataatcagagaaa

SEQ ID NO: 1106606 - DNA, 20 bp, Homo sapiens
cgatacaccgggcctggaga

SEQ ID NO: 1106607 - DNA, 23 bp, Homo sapiens
cgatacccaggaccaagccacag

SEQ ID NO: 1106608 - DNA, 19 bp, Homo sapiens
cgatactgcgactttctgc

SEQ ID NO: 1106609 - DNA, 20 bp, Homo sapiens
cgatactgcgactttctgcc

SEQ ID NO: 1106610 - DNA, 23 bp, Homo sapiens
cgatactgcgactttctgcctgg

SEQ ID NO: 1106611 - DNA, 18 bp, Homo sapiens
cgatatcagaatttgtgt

SEQ ID NO: 1106612 - DNA, 21 bp, Homo sapiens
cgatatttaattcacctcagc

SEQ ID NO: 1106613 - DNA, 22 bp, Homo sapiens
cgatatttaattcacctcagcc

SEQ ID NO: 1106614 - DNA, 22 bp, Homo sapiens
cgatcaacatttatgacctaag

SEQ ID NO: 1106615 - DNA, 14 bp, Homo sapiens
cgatcaagagaatc

SEQ ID NO: 1106616 - DNA, 20 bp, Homo sapiens
cgatcaagttgttgactgtg

SEQ ID NO: 1106617 - DNA, 21 bp, Homo sapiens
cgatcaagttgttgactgtga

SEQ ID NO: 1106618 - DNA, 19 bp, Homo sapiens
cgatcatatttccccttgg

SEQ ID NO: 1106619 - DNA, 21 bp, Homo sapiens
cgatccaggggaagccagtga

SEQ ID NO: 1106620 - DNA, 18 bp, Homo sapiens
cgatccccgacagtggct

SEQ ID NO: 1106621 - DNA, 12 bp, Homo sapiens
cgatcccctccc

SEQ ID NO: 1106622 - DNA, 15 bp, Homo sapiens
cgatcccctccccca

SEQ ID NO: 1106623 - DNA, 21 bp, Homo sapiens
cgatcctggattcactcactc

SEQ ID NO: 1106624 - DNA, 16 bp, Homo sapiens
cgatcgcccaggctgg

SEQ ID NO: 1106625 - DNA, 19 bp, Homo sapiens
cgatcgcggcggagctggc

SEQ ID NO: 1106626 - DNA, 13 bp, Homo sapiens
cgatgaatgtaaa

SEQ ID NO: 1106627 - DNA, 23 bp, Homo sapiens
cgatgaatttggagactctgtgg

SEQ ID NO: 1106628 - DNA, 13 bp, Homo sapiens
cgatgagggaagg

SEQ ID NO: 1106629 - DNA, 13 bp, Homo sapiens
cgatgcactgacc

SEQ ID NO: 1106630 - DNA, 17 bp, Homo sapiens
cgatgcactgacctgct

SEQ ID NO: 1106631 - DNA, 14 bp, Homo sapiens
cgatgccaccggcc

SEQ ID NO: 1106632 - DNA, 14 bp, Homo sapiens
cgatgcctgattcg

SEQ ID NO: 1106633 - DNA, 15 bp, Homo sapiens
cgatgcctggcctgc

SEQ ID NO: 1106634 - DNA, 18 bp, Homo sapiens
cgatgctccagccaaccc

SEQ ID NO: 1106635 - DNA, 12 bp, Homo sapiens
cgatgctgcttt

SEQ ID NO: 1106636 - DNA, 14 bp, Homo sapiens
cgatggagccccca

SEQ ID NO: 1106637 - DNA, 16 bp, Homo sapiens
cgatggagcccccaga

SEQ ID NO: 1106638 - DNA, 15 bp, Homo sapiens
cgatggcaggcctga

SEQ ID NO: 1106639 - DNA, 19 bp, Homo sapiens
cgatggcaggcctgaccca

SEQ ID NO: 1106640 - DNA, 20 bp, Homo sapiens
cgatggggcaagacagaaaa

SEQ ID NO: 1106641 - DNA, 22 bp, Homo sapiens
cgatggggcaagacagaaaagt

SEQ ID NO: 1106642 - DNA, 17 bp, Homo sapiens
cgatggtctctctccct

SEQ ID NO: 1106643 - DNA, 20 bp, Homo sapiens
cgatgtggacgtcacgctcc

SEQ ID NO: 1106644 - DNA, 21 bp, Homo sapiens
cgatgtggacgtcacgctccc

SEQ ID NO: 1106645 - DNA, 11 bp, Homo sapiens
cgatgtggccc

SEQ ID NO: 1106646 - DNA, 15 bp, Homo sapiens
cgatgttgtcaagga

SEQ ID NO: 1106647 - DNA, 21 bp, Homo sapiens
cgattaagagacagagaatct

SEQ ID NO: 1106648 - DNA, 11 bp, Homo sapiens
cgattagactg

SEQ ID NO: 1106649 - DNA, 18 bp, Homo sapiens
cgattagactggacagct

SEQ ID NO: 1106650 - DNA, 14 bp, Homo sapiens
cgattatacttgag

SEQ ID NO: 1106651 - DNA, 17 bp, Homo sapiens
cgattattatctaaagt

SEQ ID NO: 1106652 - DNA, 21 bp, Homo sapiens
cgattctcccaaagtaccttg

SEQ ID NO: 1106653 - DNA, 13 bp, Homo sapiens
cgattctctgccc

SEQ ID NO: 1106654 - DNA, 21 bp, Homo sapiens
cgattgacctgtcctctttgt

SEQ ID NO: 1106655 - DNA, 22 bp, Homo sapiens
cgatttcactaggactcagaaa

SEQ ID NO: 1106656 - DNA, 21 bp, Homo sapiens
cgatttccctggttttagtct

SEQ ID NO: 1106657 - DNA, 11 bp, Homo sapiens
cgatttctaaa

SEQ ID NO: 1106658 - DNA, 21 bp, Homo sapiens
cgatttgggggctcggggagg

SEQ ID NO: 1106659 - DNA, 20 bp, Homo sapiens
cgattttcaagattctaaag

SEQ ID NO: 1106660 - DNA, 17 bp, Homo sapiens
cgattttctccagctca

SEQ ID NO: 1106661 - DNA, 13 bp, Homo sapiens
cgattttgcctgt

SEQ ID NO: 1106662 - DNA, 13 bp, Homo sapiens
cgattttgtatct

SEQ ID NO: 1106663 - DNA, 18 bp, Homo sapiens
cgattttgtatctgcagg

SEQ ID NO: 1106664 - DNA, 13 bp, Homo sapiens
cgatttttgtatg

SEQ ID NO: 1106665 - DNA, 16 bp, Homo sapiens
cgcaaaaacttccttt

SEQ ID NO: 1106666 - DNA, 16 bp, Homo sapiens
cgcaaaggtgcctcat

SEQ ID NO: 1106667 - DNA, 13 bp, Homo sapiens
cgcaaggaaggac

SEQ ID NO: 1106668 - DNA, 13 bp, Homo sapiens
cgcaaggcctctc

SEQ ID NO: 1106669 - DNA, 16 bp, Homo sapiens
cgcaagggcatcaggc

SEQ ID NO: 1106670 - DNA, 21 bp, Homo sapiens
cgcaagggcatcaggcactgg

SEQ ID NO: 1106671 - DNA, 13 bp, Homo sapiens
cgcaagtgtgtga

SEQ ID NO: 1106672 - DNA, 13 bp, Homo sapiens
cgcaatgtggcat

SEQ ID NO: 1106673 - DNA, 22 bp, Homo sapiens
cgcaattgtgggatgtcctctt

SEQ ID NO: 1106674 - DNA, 13 bp, Homo sapiens
cgcacacacacaa

SEQ ID NO: 1106675 - DNA, 15 bp, Homo sapiens
cgcacacacacacac

SEQ ID NO: 1106676 - DNA, 20 bp, Homo sapiens
cgcacacacacacacaggag

SEQ ID NO: 1106677 - DNA, 16 bp, Homo sapiens
cgcacacagctgagca

SEQ ID NO: 1106678 - DNA, 12 bp, Homo sapiens
cgcacacagggc

SEQ ID NO: 1106679 - DNA, 20 bp, Homo sapiens
cgcacacagggctcacaggg

SEQ ID NO: 1106680 - DNA, 23 bp, Homo sapiens
cgcacacagggctcacagggcag

SEQ ID NO: 1106681 - DNA, 14 bp, Homo sapiens
cgcacacgcacaca

SEQ ID NO: 1106682 - DNA, 23 bp, Homo sapiens
cgcacactgtgattttgccctcc

SEQ ID NO: 1106683 - DNA, 15 bp, Homo sapiens
cgcacagccacccgt

SEQ ID NO: 1106684 - DNA, 17 bp, Homo sapiens
cgcacagccacccgtgg

SEQ ID NO: 1106685 - DNA, 13 bp, Homo sapiens
cgcacagtgcagt

SEQ ID NO: 1106686 - DNA, 21 bp, Homo sapiens
cgcacagtggacggaggtccc

SEQ ID NO: 1106687 - DNA, 16 bp, Homo sapiens
cgcacatggtgtgggg

SEQ ID NO: 1106688 - DNA, 20 bp, Homo sapiens
cgcaccaaaactatcctgat

SEQ ID NO: 1106689 - DNA, 17 bp, Homo sapiens
cgcaccagctgctctgc

SEQ ID NO: 1106690 - DNA, 14 bp, Homo sapiens
cgcacccccgccag

SEQ ID NO: 1106691 - DNA, 13 bp, Homo sapiens
cgcaccctgcacc

SEQ ID NO: 1106692 - DNA, 14 bp, Homo sapiens
cgcaccctgcacct

SEQ ID NO: 1106693 - DNA, 19 bp, Homo sapiens
cgcacctaccatcagggac

SEQ ID NO: 1106694 - DNA, 20 bp, Homo sapiens
cgcacctccacgccactgcc

SEQ ID NO: 1106695 - DNA, 17 bp, Homo sapiens
cgcacctgtagtcccag

SEQ ID NO: 1106696 - DNA, 15 bp, Homo sapiens
cgcaccttgctgtgt

SEQ ID NO: 1106697 - DNA, 22 bp, Homo sapiens
cgcaccttgtcatgtaccatca

SEQ ID NO: 1106698 - DNA, 16 bp, Homo sapiens
cgcaccttttatacca

SEQ ID NO: 1106699 - DNA, 13 bp, Homo sapiens
cgcacgcacacac

SEQ ID NO: 1106700 - DNA, 15 bp, Homo sapiens
cgcacgcacacacac

SEQ ID NO: 1106701 - DNA, 16 bp, Homo sapiens
cgcacgcctctccctg

SEQ ID NO: 1106702 - DNA, 17 bp, Homo sapiens
cgcactccatgagcacc

SEQ ID NO: 1106703 - DNA, 12 bp, Homo sapiens
cgcactctggcg

SEQ ID NO: 1106704 - DNA, 12 bp, Homo sapiens
cgcactgtggat

SEQ ID NO: 1106705 - DNA, 23 bp, Homo sapiens
cgcacttaccgccctgcgggcca

SEQ ID NO: 1106706 - DNA, 19 bp, Homo sapiens
cgcacttgcagaggagccc

SEQ ID NO: 1106707 - DNA, 20 bp, Homo sapiens
cgcacttgcagaggagccca

SEQ ID NO: 1106708 - DNA, 14 bp, Homo sapiens
cgcactttccactt

SEQ ID NO: 1106709 - DNA, 13 bp, Homo sapiens
cgcagaagccctg

SEQ ID NO: 1106710 - DNA, 19 bp, Homo sapiens
cgcagactgcttggccaga

SEQ ID NO: 1106711 - DNA, 13 bp, Homo sapiens
cgcagaggacgca

SEQ ID NO: 1106712 - DNA, 13 bp, Homo sapiens
cgcagaggcagaa

SEQ ID NO: 1106713 - DNA, 12 bp, Homo sapiens
cgcagaggtccc

SEQ ID NO: 1106714 - DNA, 18 bp, Homo sapiens
cgcagaggtcccagcccc

SEQ ID NO: 1106715 - DNA, 16 bp, Homo sapiens
cgcagatctgtgcctg

SEQ ID NO: 1106716 - DNA, 19 bp, Homo sapiens
cgcagatgaggggccactg

SEQ ID NO: 1106717 - DNA, 18 bp, Homo sapiens
cgcagatgctgtcactgg

SEQ ID NO: 1106718 - DNA, 17 bp, Homo sapiens
cgcagcccgtgaagcag

SEQ ID NO: 1106719 - DNA, 22 bp, Homo sapiens
cgcagcccgtgaagcagtgcct

SEQ ID NO: 1106720 - DNA, 21 bp, Homo sapiens
cgcctgacaaccactggtctg

SEQ ID NO: 1106721 - DNA, 14 bp, Homo sapiens
cgcctgagacagca

SEQ ID NO: 1106722 - DNA, 15 bp, Homo sapiens
cgcctgagacagcac

SEQ ID NO: 1106723 - DNA, 15 bp, Homo sapiens
cgcctgagtcagtgc

SEQ ID NO: 1106724 - DNA, 17 bp, Homo sapiens
cgcctgatggtgctgct

SEQ ID NO: 1106725 - DNA, 14 bp, Homo sapiens
cgcctgcaggcaga

SEQ ID NO: 1106726 - DNA, 11 bp, Homo sapiens
cgcctgccatc

SEQ ID NO: 1106727 - DNA, 20 bp, Homo sapiens
cgcctgccatcttctccccg

SEQ ID NO: 1106728 - DNA, 13 bp, Homo sapiens
cgcctgccctccc

SEQ ID NO: 1106729 - DNA, 21 bp, Homo sapiens
cgcctgccctcccgcaccttc

SEQ ID NO: 1106730 - DNA, 14 bp, Homo sapiens
cgcctgccctgccc

SEQ ID NO: 1106731 - DNA, 14 bp, Homo sapiens
cgcctgcctgccac

SEQ ID NO: 1106732 - DNA, 18 bp, Homo sapiens
cgcctgcctgccaccctg

SEQ ID NO: 1106733 - DNA, 12 bp, Homo sapiens
cgcctgcgcctc

SEQ ID NO: 1106734 - DNA, 13 bp, Homo sapiens
cgcctgctcctca

SEQ ID NO: 1106735 - DNA, 16 bp, Homo sapiens
cgcctgctcctcactg

SEQ ID NO: 1106736 - DNA, 19 bp, Homo sapiens
cgcctgctcctcactggag

SEQ ID NO: 1106737 - DNA, 23 bp, Homo sapiens
cgcctgctcctcactggaggagc

SEQ ID NO: 1106738 - DNA, 18 bp, Homo sapiens
cgcctgctgcctgctgag

SEQ ID NO: 1106739 - DNA, 20 bp, Homo sapiens
cgcctggcagaactgagctc

SEQ ID NO: 1106740 - DNA, 14 bp, Homo sapiens
cgcctggccaggag

SEQ ID NO: 1106741 - DNA, 12 bp, Homo sapiens
cgcctggccctc

SEQ ID NO: 1106742 - DNA, 16 bp, Homo sapiens
cgcctggccctccctc

SEQ ID NO: 1106743 - DNA, 17 bp, Homo sapiens
cgcctggccctccctcc

SEQ ID NO: 1106744 - DNA, 17 bp, Homo sapiens
cgcctgggcgactccat

SEQ ID NO: 1106745 - DNA, 17 bp, Homo sapiens
cgcctgtaatcccagca

SEQ ID NO: 1106746 - DNA, 20 bp, Homo sapiens
cgcctgtaatcccagctact

SEQ ID NO: 1106747 - DNA, 18 bp, Homo sapiens
cgcctgtagtcccagcca

SEQ ID NO: 1106748 - DNA, 17 bp, Homo sapiens
cgcctgtagtcctagcc

SEQ ID NO: 1106749 - DNA, 18 bp, Homo sapiens
cgcctgtcacaataaagt

SEQ ID NO: 1106750 - DNA, 16 bp, Homo sapiens
cgcctgtgtccatctg

SEQ ID NO: 1106751 - DNA, 12 bp, Homo sapiens
cgccttaaactc

SEQ ID NO: 1106752 - DNA, 21 bp, Homo sapiens
cgccttccaaaacctgcttcc

SEQ ID NO: 1106753 - DNA, 14 bp, Homo sapiens
cgccttccctcact

SEQ ID NO: 1106754 - DNA, 17 bp, Homo sapiens
cgccttcgtgtgctgct

SEQ ID NO: 1106755 - DNA, 18 bp, Homo sapiens
cgccttcgtgtgctgctg

SEQ ID NO: 1106756 - DNA, 21 bp, Homo sapiens
cgccttcgtgtgctgctgctg

SEQ ID NO: 1106757 - DNA, 14 bp, Homo sapiens
cgccttggcctccc

SEQ ID NO: 1106758 - DNA, 15 bp, Homo sapiens
cgccttggctttctc

SEQ ID NO: 1106759 - DNA, 13 bp, Homo sapiens
cgcctttcccagg

SEQ ID NO: 1106760 - DNA, 20 bp, Homo sapiens
cgcctttgtattataaaagc

SEQ ID NO: 1106761 - DNA, 19 bp, Homo sapiens
cgcctttgtcttgtacttc

SEQ ID NO: 1106762 - DNA, 16 bp, Homo sapiens
cgcgaccatgtggcca

SEQ ID NO: 1106763 - DNA, 15 bp, Homo sapiens
cgcgactaatttcaa

SEQ ID NO: 1106764 - DNA, 22 bp, Homo sapiens
cgcgactaatttcaaaatgctt

SEQ ID NO: 1106765 - DNA, 17 bp, Homo sapiens
cgcgagggtcacgcttg

SEQ ID NO: 1106766 - DNA, 19 bp, Homo sapiens
cgcgagtgtgctgtatggc

SEQ ID NO: 1106767 - DNA, 14 bp, Homo sapiens
cgcgatcccacaca

SEQ ID NO: 1106768 - DNA, 22 bp, Homo sapiens
cgcgccactacactccagcctg

SEQ ID NO: 1106769 - DNA, 23 bp, Homo sapiens
cgcgccactacactccagcctga

SEQ ID NO: 1106770 - DNA, 18 bp, Homo sapiens
cgcgccccccgcgcccct

SEQ ID NO: 1106771 - DNA, 13 bp, Homo sapiens
cgcgccctccctc

SEQ ID NO: 1106772 - DNA, 14 bp, Homo sapiens
cgcgccgatgccac

SEQ ID NO: 1106773 - DNA, 15 bp, Homo sapiens
cgcgccgatgccacc

SEQ ID NO: 1106774 - DNA, 19 bp, Homo sapiens
cgcgccggtccggcgcccc

SEQ ID NO: 1106775 - DNA, 18 bp, Homo sapiens
cgcgcggagacctcctga

SEQ ID NO: 1106776 - DNA, 14 bp, Homo sapiens
cgcgcgtctcccat

SEQ ID NO: 1106777 - DNA, 18 bp, Homo sapiens
cgcgcgtctcccatcctg

SEQ ID NO: 1106778 - DNA, 12 bp, Homo sapiens
cgcgctcaggag

SEQ ID NO: 1106779 - DNA, 16 bp, Homo sapiens
cgcgctcgcccagcag

SEQ ID NO: 1106780 - DNA, 17 bp, Homo sapiens
cgcgctcgcccagcagg

SEQ ID NO: 1106781 - DNA, 15 bp, Homo sapiens
cgcggacgtgctggc

SEQ ID NO: 1106782 - DNA, 14 bp, Homo sapiens
cgcggcccagaccc

SEQ ID NO: 1106783 - DNA, 14 bp, Homo sapiens
cgcggcctccccga

SEQ ID NO: 1106784 - DNA, 13 bp, Homo sapiens
cgcggcctggacc

SEQ ID NO: 1106785 - DNA, 19 bp, Homo sapiens
cgcggccttgtctgggtgc

SEQ ID NO: 1106786 - DNA, 23 bp, Homo sapiens
cgcggccttgtctgggtgcagct

SEQ ID NO: 1106787 - DNA, 15 bp, Homo sapiens
cgcggcggagctggc

SEQ ID NO: 1106788 - DNA, 17 bp, Homo sapiens
cgcggcggagctggccc

SEQ ID NO: 1106789 - DNA, 18 bp, Homo sapiens
cgcggcggagctggcccc

SEQ ID NO: 1106790 - DNA, 20 bp, Homo sapiens
cgcggcggctctgcccacct

SEQ ID NO: 1106791 - DNA, 23 bp, Homo sapiens
cgcgggagccatgcgccccctcc

SEQ ID NO: 1106792 - DNA, 12 bp, Homo sapiens
cgcgggcacagc

SEQ ID NO: 1106793 - DNA, 16 bp, Homo sapiens
cgcgggcacagccagc

SEQ ID NO: 1106794 - DNA, 13 bp, Homo sapiens
cgcgggctttgtt

SEQ ID NO: 1106795 - DNA, 17 bp, Homo sapiens
cgcggggaagctggctt

SEQ ID NO: 1106796 - DNA, 14 bp, Homo sapiens
cgcgggttctagac

SEQ ID NO: 1106797 - DNA, 18 bp, Homo sapiens
cgcggtgctctggcggct

SEQ ID NO: 1106798 - DNA, 23 bp, Homo sapiens
cgcgtaataggaatcaccctcct

SEQ ID NO: 1106799 - DNA, 21 bp, Homo sapiens
cgcgtcgccctcccaggctct

SEQ ID NO: 1106800 - DNA, 13 bp, Homo sapiens
cgcgtctgcccca

SEQ ID NO: 1106801 - DNA, 19 bp, Homo sapiens
cgcgtctgccccaccctca

SEQ ID NO: 1106802 - DNA, 15 bp, Homo sapiens
cgcgtctgcctgggc

SEQ ID NO: 1106803 - DNA, 12 bp, Homo sapiens
cgcgtcttcctg

SEQ ID NO: 1106804 - DNA, 16 bp, Homo sapiens
cgcgtcttcctgagtg

SEQ ID NO: 1106805 - DNA, 15 bp, Homo sapiens
cgcgtgattgaccct

SEQ ID NO: 1106806 - DNA, 14 bp, Homo sapiens
cgcgtgtgctcctc

SEQ ID NO: 1106807 - DNA, 22 bp, Homo sapiens
cgcgttctgggagctcaaggcc

SEQ ID NO: 1106808 - DNA, 16 bp, Homo sapiens
cgcgttgtaaaatata

SEQ ID NO: 1106809 - DNA, 13 bp, Homo sapiens
cgctaaaagaaac

SEQ ID NO: 1106810 - DNA, 22 bp, Homo sapiens
cgctaaagagcccttgcctccc

SEQ ID NO: 1106811 - DNA, 14 bp, Homo sapiens
cgctaacaatttct

SEQ ID NO: 1106812 - DNA, 23 bp, Homo sapiens
cgctaattcaaggaatttcttaa

SEQ ID NO: 1106813 - DNA, 11 bp, Homo sapiens
cgctacccact

SEQ ID NO: 1106814 - DNA, 15 bp, Homo sapiens
cgctacctccctccc

SEQ ID NO: 1106815 - DNA, 21 bp, Homo sapiens
cgctacggggaaaatgcattt

SEQ ID NO: 1106816 - DNA, 20 bp, Homo sapiens
cgctactatgatttaatttg

SEQ ID NO: 1106817 - DNA, 15 bp, Homo sapiens
cgctagaggcctgag

SEQ ID NO: 1106818 - DNA, 17 bp, Homo sapiens
cgctagaggcctgagga

SEQ ID NO: 1106819 - DNA, 12 bp, Homo sapiens
cgctagcagccc

SEQ ID NO: 1106820 - DNA, 13 bp, Homo sapiens
cgctagcagccct

SEQ ID NO: 1106821 - DNA, 15 bp, Homo sapiens
cgctagcagcccttg

SEQ ID NO: 1106822 - DNA, 18 bp, Homo sapiens
cgctaggaaatgacccga

SEQ ID NO: 1106823 - DNA, 15 bp, Homo sapiens
cgctaggctcgcctt

SEQ ID NO: 1106824 - DNA, 18 bp, Homo sapiens
cgctaggctcgccttccc

SEQ ID NO: 1106825 - DNA, 15 bp, Homo sapiens
cgctagtgccttgcc

SEQ ID NO: 1106826 - DNA, 23 bp, Homo sapiens
cgctcaccgctggcccttagaga

SEQ ID NO: 1106827 - DNA, 14 bp, Homo sapiens
cgctcactgaactc

SEQ ID NO: 1106828 - DNA, 14 bp, Homo sapiens
cgctcagaccccac

SEQ ID NO: 1106829 - DNA, 22 bp, Homo sapiens
cgctcagcaatagggtgcagtt

SEQ ID NO: 1106830 - DNA, 18 bp, Homo sapiens
cgctcagcatgcatcctt

SEQ ID NO: 1106831 - DNA, 15 bp, Homo sapiens
cgctcagcccagctg

SEQ ID NO: 1106832 - DNA, 12 bp, Homo sapiens
cgctcagccctc

SEQ ID NO: 1106833 - DNA, 21 bp, Homo sapiens
cgctcagccctccctgcccct

SEQ ID NO: 1106834 - DNA, 14 bp, Homo sapiens
cgctcaggacccag

SEQ ID NO: 1106835 - DNA, 19 bp, Homo sapiens
cgctcagggccatgctgag

SEQ ID NO: 1106836 - DNA, 20 bp, Homo sapiens
cgctcagggccatgctgagg

SEQ ID NO: 1106837 - DNA, 12 bp, Homo sapiens
cgctcagtctgt

SEQ ID NO: 1106838 - DNA, 11 bp, Homo sapiens
cgctcagtgtc

SEQ ID NO: 1106839 - DNA, 14 bp, Homo sapiens
cgctcatctctgga

SEQ ID NO: 1106840 - DNA, 15 bp, Homo sapiens
cgctccagctgcccc

SEQ ID NO: 1106841 - DNA, 18 bp, Homo sapiens
cgctccagctgccccggc

SEQ ID NO: 1106842 - DNA, 13 bp, Homo sapiens
cgctccagggccg

SEQ ID NO: 1106843 - DNA, 21 bp, Homo sapiens
cggctctgagcaggggcaggc

SEQ ID NO: 1106844 - DNA, 13 bp, Homo sapiens
cggctctggaggc

SEQ ID NO: 1106845 - DNA, 13 bp, Homo sapiens
cggctctggtcct

SEQ ID NO: 1106846 - DNA, 20 bp, Homo sapiens
cggctctggtcctcggagct

SEQ ID NO: 1106847 - DNA, 16 bp, Homo sapiens
cggctgaccatgctca

SEQ ID NO: 1106848 - DNA, 11 bp, Homo sapiens
cggctgagagc

SEQ ID NO: 1106849 - DNA, 14 bp, Homo sapiens
cggctgagagcccc

SEQ ID NO: 1106850 - DNA, 16 bp, Homo sapiens
cggctgagagccccag

SEQ ID NO: 1106851 - DNA, 17 bp, Homo sapiens
cggctgagagccccagc

SEQ ID NO: 1106852 - DNA, 20 bp, Homo sapiens
cggctgagagccccagctga

SEQ ID NO: 1106853 - DNA, 15 bp, Homo sapiens
cggctgcacaacagc

SEQ ID NO: 1106854 - DNA, 20 bp, Homo sapiens
cggctgccattggtccaccc

SEQ ID NO: 1106855 - DNA, 16 bp, Homo sapiens
cggctgccgactcccc

SEQ ID NO: 1106856 - DNA, 18 bp, Homo sapiens
cggctgccgactccccca

SEQ ID NO: 1106857 - DNA, 16 bp, Homo sapiens
cggctgcctagccctc

SEQ ID NO: 1106858 - DNA, 21 bp, Homo sapiens
cggctgcctgacactgagccc

SEQ ID NO: 1106859 - DNA, 13 bp, Homo sapiens
cggctgcctgccg

SEQ ID NO: 1106860 - DNA, 14 bp, Homo sapiens
cggctgcctgccgc

SEQ ID NO: 1106861 - DNA, 17 bp, Homo sapiens
cggctgcctgccgccca

SEQ ID NO: 1106862 - DNA, 14 bp, Homo sapiens
cggctgctcctcca

SEQ ID NO: 1106863 - DNA, 17 bp, Homo sapiens
cggctgctcctccagcc

SEQ ID NO: 1106864 - DNA, 18 bp, Homo sapiens
cggctgctcctccagccc

SEQ ID NO: 1106865 - DNA, 18 bp, Homo sapiens
cggctggaaatgctgggc

SEQ ID NO: 1106866 - DNA, 15 bp, Homo sapiens
cggctggaagaacat

SEQ ID NO: 1106867 - DNA, 16 bp, Homo sapiens
cggctggaagaacatc

SEQ ID NO: 1106868 - DNA, 14 bp, Homo sapiens
cggctggcagccca

SEQ ID NO: 1106869 - DNA, 22 bp, Homo sapiens
cggctggcctggaggctcagcc

SEQ ID NO: 1106870 - DNA, 22 bp, Homo sapiens
cggctgggagcctcgcccctcc

SEQ ID NO: 1106871 - DNA, 11 bp, Homo sapiens
cggctgggcct

SEQ ID NO: 1106872 - DNA, 23 bp, Homo sapiens
cggctggggacccacccagcccc

SEQ ID NO: 1106873 - DNA, 18 bp, Homo sapiens
cggctggtcactctgccc

SEQ ID NO: 1106874 - DNA, 17 bp, Homo sapiens
cggctggttttgtaaga

SEQ ID NO: 1106875 - DNA, 12 bp, Homo sapiens
cggctgtggagc

SEQ ID NO: 1106876 - DNA, 22 bp, Homo sapiens
cggctgtggagcaaaaggcagc

SEQ ID NO: 1106877 - DNA, 15 bp, Homo sapiens
cggcttcatgccagc

SEQ ID NO: 1106878 - DNA, 19 bp, Homo sapiens
cggcttcatgccagctact

SEQ ID NO: 1106879 - DNA, 15 bp, Homo sapiens
cggcttcctgtccac

SEQ ID NO: 1106880 - DNA, 19 bp, Homo sapiens
cggcttggatcctgggctg

SEQ ID NO: 1106881 - DNA, 14 bp, Homo sapiens
cggcttgtgggctg

SEQ ID NO: 1106882 - DNA, 15 bp, Homo sapiens
cggctttcctccgga

SEQ ID NO: 1106883 - DNA, 15 bp, Homo sapiens
cggctttctctgcct

SEQ ID NO: 1106884 - DNA, 13 bp, Homo sapiens
cgggaacagtgtt

SEQ ID NO: 1106885 - DNA, 22 bp, Homo sapiens
cgggaacagtgtttcccataat

SEQ ID NO: 1106886 - DNA, 16 bp, Homo sapiens
cgggaagggaggggaa

SEQ ID NO: 1106887 - DNA, 21 bp, Homo sapiens
cgggaagggcatgcacgggca

SEQ ID NO: 1106888 - DNA, 21 bp, Homo sapiens
cgggaatgaccgctctccctt

SEQ ID NO: 1106889 - DNA, 19 bp, Homo sapiens
cgggacaccgtggggaagg

SEQ ID NO: 1106890 - DNA, 13 bp, Homo sapiens
cgggaccacatct

SEQ ID NO: 1106891 - DNA, 17 bp, Homo sapiens
cgggaccattgacctca

SEQ ID NO: 1106892 - DNA, 14 bp, Homo sapiens
cgggaccctcaggt

SEQ ID NO: 1106893 - DNA, 22 bp, Homo sapiens
cgggacctcccaggacaagcac

SEQ ID NO: 1106894 - DNA, 13 bp, Homo sapiens
cgggactgacacc

SEQ ID NO: 1106895 - DNA, 17 bp, Homo sapiens
cgggactgacaccctgg

SEQ ID NO: 1106896 - DNA, 13 bp, Homo sapiens
cgggactgcggag

SEQ ID NO: 1106897 - DNA, 15 bp, Homo sapiens
cgggagaagccacct

SEQ ID NO: 1106898 - DNA, 14 bp, Homo sapiens
cgggagaccccttg

SEQ ID NO: 1106899 - DNA, 14 bp, Homo sapiens
cgggagcacccaga

SEQ ID NO: 1106900 - DNA, 16 bp, Homo sapiens
cgggagcacccagagc

SEQ ID NO: 1106901 - DNA, 20 bp, Homo sapiens
cgggagcagtgtcttccata

SEQ ID NO: 1106902 - DNA, 23 bp, Homo sapiens
cgggagcagtgtcttccataatg

SEQ ID NO: 1106903 - DNA, 22 bp, Homo sapiens
cgggagcattggcccctgagcc

SEQ ID NO: 1106904 - DNA, 22 bp, Homo sapiens
cgggagccatgcgccccctccg

SEQ ID NO: 1106905 - DNA, 17 bp, Homo sapiens
cgggagccgctggcaga

SEQ ID NO: 1106906 - DNA, 12 bp, Homo sapiens
cgggagcctccc

SEQ ID NO: 1106907 - DNA, 15 bp, Homo sapiens
cgggagctgggagcc

SEQ ID NO: 1106908 - DNA, 19 bp, Homo sapiens
cgggagctgggagccaggc

SEQ ID NO: 1106909 - DNA, 15 bp, Homo sapiens
cgggaggcaccagct

SEQ ID NO: 1106910 - DNA, 17 bp, Homo sapiens
cgggaggcaccagctct

SEQ ID NO: 1106911 - DNA, 16 bp, Homo sapiens
cgggaggctggggccc

SEQ ID NO: 1106912 - DNA, 21 bp, Homo sapiens
cgggagggagtctcaggagga

SEQ ID NO: 1106913 - DNA, 24 bp, Homo sapiens
cgggagggagtctcaggaggaggc

SEQ ID NO: 1106914 - DNA, 17 bp, Homo sapiens
cgggaggtcgaggcagg

SEQ ID NO: 1106915 - DNA, 19 bp, Homo sapiens
cgggatcctccacagagag

SEQ ID NO: 1106916 - DNA, 12 bp, Homo sapiens
cgggatgggctc

SEQ ID NO: 1106917 - DNA, 16 bp, Homo sapiens
cgggatggttctggct

SEQ ID NO: 1106918 - DNA, 20 bp, Homo sapiens
cgggcaagtcatcctcctgg

SEQ ID NO: 1106919 - DNA, 19 bp, Homo sapiens
cgggcaagtgagaggggag

SEQ ID NO: 1106920 - DNA, 14 bp, Homo sapiens
cgggcacaataaat

SEQ ID NO: 1106921 - DNA, 15 bp, Homo sapiens
cgggcacaataaatc

SEQ ID NO: 1106922 - DNA, 15 bp, Homo sapiens
cgggcacagccagcc

SEQ ID NO: 1106923 - DNA, 19 bp, Homo sapiens
cgggcacctatagtcccag

SEQ ID NO: 1106924 - DNA, 21 bp, Homo sapiens
cgggcacctatagtcccagct

SEQ ID NO: 1106925 - DNA, 15 bp, Homo sapiens
cgggcactggcactg

SEQ ID NO: 1106926 - DNA, 10 bp, Homo sapiens
cgggcagaaa

SEQ ID NO: 1106927 - DNA, 18 bp, Homo sapiens
cgggcagagggctggagg

SEQ ID NO: 1106928 - DNA, 19 bp, Homo sapiens
cgggcagagggctggaggc

SEQ ID NO: 1106929 - DNA, 23 bp, Homo sapiens
cgggcagagggctggaggcccag

SEQ ID NO: 1106930 - DNA, 16 bp, Homo sapiens
cgggcagccacaggac

SEQ ID NO: 1106931 - DNA, 22 bp, Homo sapiens
cgggcagccacaggactgagcc

SEQ ID NO: 1106932 - DNA, 13 bp, Homo sapiens
cgggcagccaccc

SEQ ID NO: 1106933 - DNA, 14 bp, Homo sapiens
cgggcagccaccca

SEQ ID NO: 1106934 - DNA, 15 bp, Homo sapiens
cgggcagccagcaga

SEQ ID NO: 1106935 - DNA, 14 bp, Homo sapiens
cgggcagccaggct

SEQ ID NO: 1106936 - DNA, 16 bp, Homo sapiens
cgggcaggggagccag

SEQ ID NO: 1106937 - DNA, 17 bp, Homo sapiens
cgggcaggtcctgccca

SEQ ID NO: 1106938 - DNA, 15 bp, Homo sapiens
cgggcatgggcactc

SEQ ID NO: 1106939 - DNA, 16 bp, Homo sapiens
cgggcatgggcctctc

SEQ ID NO: 1106940 - DNA, 19 bp, Homo sapiens
cgggcatgggcctctctgg

SEQ ID NO: 1106941 - DNA, 20 bp, Homo sapiens
cgggcatggtggctcatgcc

SEQ ID NO: 1106942 - DNA, 18 bp, Homo sapiens
cgggcatgtattatcaca

SEQ ID NO: 1106943 - DNA, 18 bp, Homo sapiens
cgggccaagacagatgga

SEQ ID NO: 1106944 - DNA, 14 bp, Homo sapiens
cgggccaaggactg

SEQ ID NO: 1106945 - DNA, 15 bp, Homo sapiens
cgggccacagggcaa

SEQ ID NO: 1106946 - DNA, 21 bp, Homo sapiens
cgggccaccctctgtttaaaa

SEQ ID NO: 1106947 - DNA, 23 bp, Homo sapiens
cgggccacgccccagcccgacaa

SEQ ID NO: 1106948 - DNA, 13 bp, Homo sapiens
cgggccagccagg

SEQ ID NO: 1106949 - DNA, 14 bp, Homo sapiens
cgggccagccaggc

SEQ ID NO: 1106950 - DNA, 15 bp, Homo sapiens
cgggccagccaggcg

SEQ ID NO: 1106951 - DNA, 18 bp, Homo sapiens
cgggccagccaggcgggc

SEQ ID NO: 1106952 - DNA, 23 bp, Homo sapiens
cgggccagccaggcgggctcaag

SEQ ID NO: 1106953 - DNA, 18 bp, Homo sapiens
cgggccagtttctctgcc

SEQ ID NO: 1106954 - DNA, 23 bp, Homo sapiens
cgggccagtttctctgccttctt

SEQ ID NO: 1106955 - DNA, 13 bp, Homo sapiens
cgggcccacctgg

SEQ ID NO: 1106956 - DNA, 17 bp, Homo sapiens
cgggcccacctggccac

SEQ ID NO: 1106957 - DNA, 12 bp, Homo sapiens
cgggcccaggga

SEQ ID NO: 1106958 - DNA, 13 bp, Homo sapiens
cgggcccagggac

SEQ ID NO: 1106959 - DNA, 14 bp, Homo sapiens
cgggcccagggaca

SEQ ID NO: 1106960 - DNA, 15 bp, Homo sapiens
cgggcccagggacat

SEQ ID NO: 1106961 - DNA, 20 bp, Homo sapiens
cgggcccccgccccgccccc

SEQ ID NO: 1106962 - DNA, 12 bp, Homo sapiens
cgggccctgccc

SEQ ID NO: 1106963 - DNA, 18 bp, Homo sapiens
cgggccctgccccagccc

SEQ ID NO: 1106964 - DNA, 21 bp, Homo sapiens
cgggccctgccccagccccta

SEQ ID NO: 1106965 - DNA, 23 bp, Homo sapiens
cgggcccttcttgctgccctgcc

SEQ ID NO: 1106966 - DNA, 15 bp, Homo sapiens
cgtcacgctccctga

SEQ ID NO: 1106967 - DNA, 18 bp, Homo sapiens
cgtcactgcccaccaaag

SEQ ID NO: 1106968 - DNA, 22 bp, Homo sapiens
cgtcactgcccaccaaaggtca

SEQ ID NO: 1106969 - DNA, 11 bp, Homo sapiens
cgtcacttctc

SEQ ID NO: 1106970 - DNA, 17 bp, Homo sapiens
cgtcagaagcacccagg

SEQ ID NO: 1106971 - DNA, 14 bp, Homo sapiens
cgtcagccacctgg

SEQ ID NO: 1106972 - DNA, 16 bp, Homo sapiens
cgtcagccacctggga

SEQ ID NO: 1106973 - DNA, 16 bp, Homo sapiens
cgtcagggttggtgtg

SEQ ID NO: 1106974 - DNA, 19 bp, Homo sapiens
cgtcagggttggtgtgctg

SEQ ID NO: 1106975 - DNA, 20 bp, Homo sapiens
cgtcagggttggtgtgctga

SEQ ID NO: 1106976 - DNA, 13 bp, Homo sapiens
cgtcatccatgcc

SEQ ID NO: 1106977 - DNA, 20 bp, Homo sapiens
cgtcatcggaggctgggccc

SEQ ID NO: 1106978 - DNA, 15 bp, Homo sapiens
cgtcatgcttgtgtt

SEQ ID NO: 1106979 - DNA, 19 bp, Homo sapiens
cgtcatggcttaatgttta

SEQ ID NO: 1106980 - DNA, 22 bp, Homo sapiens
cgtcattgctgctgctaccagc

SEQ ID NO: 1106981 - DNA, 17 bp, Homo sapiens
cgtccaaccccggggca

SEQ ID NO: 1106982 - DNA, 14 bp, Homo sapiens
cgtccacaggggca

SEQ ID NO: 1106983 - DNA, 15 bp, Homo sapiens
cgtccacaggggcag

SEQ ID NO: 1106984 - DNA, 19 bp, Homo sapiens
cgtccacccaggctgcact

SEQ ID NO: 1106985 - DNA, 20 bp, Homo sapiens
cgtccacccaggctgcactg

SEQ ID NO: 1106986 - DNA, 15 bp, Homo sapiens
cgtccacccttccat

SEQ ID NO: 1106987 - DNA, 16 bp, Homo sapiens
cgtccacccttccatc

SEQ ID NO: 1106988 - DNA, 13 bp, Homo sapiens
cgtccagctcagc

SEQ ID NO: 1106989 - DNA, 15 bp, Homo sapiens
cgtccagctcagccc

SEQ ID NO: 1106990 - DNA, 14 bp, Homo sapiens
cgtccatccccctt

SEQ ID NO: 1106991 - DNA, 15 bp, Homo sapiens
cgtccatggcaccag

SEQ ID NO: 1106992 - DNA, 17 bp, Homo sapiens
cgtccattcagaaagct

SEQ ID NO: 1106993 - DNA, 17 bp, Homo sapiens
cgtcccaccccacctct

SEQ ID NO: 1106994 - DNA, 17 bp, Homo sapiens
cgtcccagcggcctcag

SEQ ID NO: 1106995 - DNA, 20 bp, Homo sapiens
cgtcccagcggcctcagggt

SEQ ID NO: 1106996 - DNA, 19 bp, Homo sapiens
cgtcccatgaggtcttccc

SEQ ID NO: 1106997 - DNA, 16 bp, Homo sapiens
cgtccccccccaggcc

SEQ ID NO: 1106998 - DNA, 11 bp, Homo sapiens
cgtccccctcc

SEQ ID NO: 1106999 - DNA, 14 bp, Homo sapiens
cgtccccctccctg

SEQ ID NO: 1107000 - DNA, 19 bp, Homo sapiens
cgtccccctccctgcccaa

SEQ ID NO: 1107001 - DNA, 23 bp, Homo sapiens
cgtcccctaacccccagtcctca

SEQ ID NO: 1107002 - DNA, 13 bp, Homo sapiens
cgtcccctccgcc

SEQ ID NO: 1107003 - DNA, 15 bp, Homo sapiens
cgtcccctccgccgt

SEQ ID NO: 1107004 - DNA, 13 bp, Homo sapiens
cgtcccctctccc

SEQ ID NO: 1107005 - DNA, 16 bp, Homo sapiens
cgtcccctctcccctt

SEQ ID NO: 1107006 - DNA, 20 bp, Homo sapiens
cgtcccctgcagcctgggtc

SEQ ID NO: 1107007 - DNA, 12 bp, Homo sapiens
cgtcccgctatg

SEQ ID NO: 1107008 - DNA, 13 bp, Homo sapiens
cgtcccgctgcct

SEQ ID NO: 1107009 - DNA, 14 bp, Homo sapiens
cgtcccgctgcctc

SEQ ID NO: 1107010 - DNA, 22 bp, Homo sapiens
cgtcccgctgctgtgctctggg

SEQ ID NO: 1107011 - DNA, 14 bp, Homo sapiens
cgtccctgtccccc

SEQ ID NO: 1107012 - DNA, 18 bp, Homo sapiens
cgtccctgtcccccagca

SEQ ID NO: 1107013 - DNA, 19 bp, Homo sapiens
cgtccgccctgctcctccc

SEQ ID NO: 1107014 - DNA, 15 bp, Homo sapiens
cgtccgccgcgtgtg

SEQ ID NO: 1107015 - DNA, 15 bp, Homo sapiens
cgtccgtctgtctcg

SEQ ID NO: 1107016 - DNA, 15 bp, Homo sapiens
cgtcctccaagctca

SEQ ID NO: 1107017 - DNA, 14 bp, Homo sapiens
cgtcctcccgggcc

SEQ ID NO: 1107018 - DNA, 18 bp, Homo sapiens
cgtcctccgtccatatca

SEQ ID NO: 1107019 - DNA, 17 bp, Homo sapiens
cgtcctcctcacctcat

SEQ ID NO: 1107020 - DNA, 13 bp, Homo sapiens
cgtcctcctctgt

SEQ ID NO: 1107021 - DNA, 15 bp, Homo sapiens
cgtcctcctctgtga

SEQ ID NO: 1107022 - DNA, 13 bp, Homo sapiens
cgtcctgaggaat

SEQ ID NO: 1107023 - DNA, 16 bp, Homo sapiens
cgtcctgatccctcca

SEQ ID NO: 1107024 - DNA, 15 bp, Homo sapiens
cgtcctgcctgtggc

SEQ ID NO: 1107025 - DNA, 16 bp, Homo sapiens
cgtcctgcctgtggcg

SEQ ID NO: 1107026 - DNA, 14 bp, Homo sapiens
cgtcctgctgtccc

SEQ ID NO: 1107027 - DNA, 15 bp, Homo sapiens
cgtcctgctgtccct

SEQ ID NO: 1107028 - DNA, 12 bp, Homo sapiens
cgtcctgtccca

SEQ ID NO: 1107029 - DNA, 13 bp, Homo sapiens
cgtcctgtcccag

SEQ ID NO: 1107030 - DNA, 18 bp, Homo sapiens
cgtcctttcacacatctg

SEQ ID NO: 1107031 - DNA, 15 bp, Homo sapiens
cgtcgaccaggaaag

SEQ ID NO: 1107032 - DNA, 14 bp, Homo sapiens
cgtcgccccagtgg

SEQ ID NO: 1107033 - DNA, 15 bp, Homo sapiens
cgtcgccctcccagg

SEQ ID NO: 1107034 - DNA, 21 bp, Homo sapiens
cgtcggagctgcctgcagcac

SEQ ID NO: 1107035 - DNA, 22 bp, Homo sapiens
cgtcggagctgcctgcagcaca

SEQ ID NO: 1107036 - DNA, 12 bp, Homo sapiens
cgtcggccctgc

SEQ ID NO: 1107037 - DNA, 21 bp, Homo sapiens
cgtcggccctgcgtcggccct

SEQ ID NO: 1107038 - DNA, 22 bp, Homo sapiens
cgtcgggcgtgggtctctgggg

SEQ ID NO: 1107039 - DNA, 21 bp, Homo sapiens
cgtcggggaggctcctgcctg

SEQ ID NO: 1107040 - DNA, 15 bp, Homo sapiens
cgtcggtcctggtgc

SEQ ID NO: 1107041 - DNA, 22 bp, Homo sapiens
cgtctagctatgctgtatctgt

SEQ ID NO: 1107042 - DNA, 17 bp, Homo sapiens
cgtctcaacccctcaca

SEQ ID NO: 1107043 - DNA, 16 bp, Homo sapiens
cgtctcagaatctaaa

SEQ ID NO: 1107044 - DNA, 15 bp, Homo sapiens
cgtctcatcctcctt

SEQ ID NO: 1107045 - DNA, 18 bp, Homo sapiens
cgtctcatcctcctttca

SEQ ID NO: 1107046 - DNA, 16 bp, Homo sapiens
cgtctccagtcatctg

SEQ ID NO: 1107047 - DNA, 13 bp, Homo sapiens
cgtctcccatcct

SEQ ID NO: 1107048 - DNA, 15 bp, Homo sapiens
cgtctcccatcctga

SEQ ID NO: 1107049 - DNA, 13 bp, Homo sapiens
cgtctcccccaga

SEQ ID NO: 1107050 - DNA, 22 bp, Homo sapiens
cgtctcccccagagtgctgtcg

SEQ ID NO: 1107051 - DNA, 21 bp, Homo sapiens
cgtctcccccgtgttcccctc

SEQ ID NO: 1107052 - DNA, 15 bp, Homo sapiens
cgtctccctggccac

SEQ ID NO: 1107053 - DNA, 20 bp, Homo sapiens
cgtctccctggccacccttg

SEQ ID NO: 1107054 - DNA, 17 bp, Homo sapiens
cgtctccctggtgcctc

SEQ ID NO: 1107055 - DNA, 21 bp, Homo sapiens
cgtctccctggtgcctctgtg

SEQ ID NO: 1107056 - DNA, 13 bp, Homo sapiens
cgtctcctccctc

SEQ ID NO: 1107057 - DNA, 19 bp, Homo sapiens
cgtctctctttctccctca

SEQ ID NO: 1107058 - DNA, 21 bp, Homo sapiens
cgtctgaagcttgactcccaa

SEQ ID NO: 1107059 - DNA, 16 bp, Homo sapiens
cgtctgactccagagt

SEQ ID NO: 1107060 - DNA, 23 bp, Homo sapiens
cgtctgactccagagtctgagcc

SEQ ID NO: 1107061 - DNA, 14 bp, Homo sapiens
cgtctgactctggg

SEQ ID NO: 1107062 - DNA, 15 bp, Homo sapiens
cgtctgccaggccca

SEQ ID NO: 1107063 - DNA, 15 bp, Homo sapiens
cgtctgccccaccct

SEQ ID NO: 1107064 - DNA, 16 bp, Homo sapiens
cgtctgccccaccctc

SEQ ID NO: 1107065 - DNA, 21 bp, Homo sapiens
cgtctgctcttctgtgcccag

SEQ ID NO: 1107066 - DNA, 16 bp, Homo sapiens
cgtctggctccctgcc

SEQ ID NO: 1107067 - DNA, 21 bp, Homo sapiens
cgtctgggagaaattgacaga

SEQ ID NO: 1107068 - DNA, 14 bp, Homo sapiens
cgtctggggtgtgg

SEQ ID NO: 1107069 - DNA, 17 bp, Homo sapiens
cgtctggggttcagccc

SEQ ID NO: 1107070 - DNA, 18 bp, Homo sapiens
cgtctggggttcagcccc

SEQ ID NO: 1107071 - DNA, 19 bp, Homo sapiens
cgtctggggttcagcccct

SEQ ID NO: 1107072 - DNA, 15 bp, Homo sapiens
cgtctgtatattttg

SEQ ID NO: 1107073 - DNA, 11 bp, Homo sapiens
cgtctgtccca

SEQ ID NO: 1107074 - DNA, 22 bp, Homo sapiens
cgtctgtgtggggttctcagtg

SEQ ID NO: 1107075 - DNA, 21 bp, Homo sapiens
cgtctgtgtggtggagccagg

SEQ ID NO: 1107076 - DNA, 14 bp, Homo sapiens
cgtctgttccccct

SEQ ID NO: 1107077 - DNA, 23 bp, Homo sapiens
cgtcttagaagtggaccaggaca

SEQ ID NO: 1107078 - DNA, 20 bp, Homo sapiens
cgtcttagcaagaagtaaaa

SEQ ID NO: 1107079 - DNA, 15 bp, Homo sapiens
cgtcttcagcctagc

SEQ ID NO: 1107080 - DNA, 15 bp, Homo sapiens
cgtcttcatctccct

SEQ ID NO: 1107081 - DNA, 21 bp, Homo sapiens
cgtcttcatctccctgccatc

SEQ ID NO: 1107082 - DNA, 19 bp, Homo sapiens
cgtcttccgcccctgcctg

SEQ ID NO: 1107083 - DNA, 17 bp, Homo sapiens
cgtcttcgccctctgaa

SEQ ID NO: 1107084 - DNA, 19 bp, Homo sapiens
cgtcttcgccctctgaaat

SEQ ID NO: 1107085 - DNA, 17 bp, Homo sapiens
cgtcttctccctattcc

SEQ ID NO: 1107086 - DNA, 21 bp, Homo sapiens
cgtcttgacgggagcattggc

SEQ ID NO: 1107087 - DNA, 23 bp, Homo sapiens
cgtcttgcccagcagctcaagaa

SEQ ID NO: 1107088 - DNA, 16 bp, Homo sapiens
cgtcttggtgtaattt

SEQ ID NO: 1107089 - DNA, 21 bp, Homo sapiens
ctaaactttttttctgtacca

SEQ ID NO: 1107090 - DNA, 21 bp, Homo sapiens
ctaaagaaacttggctggaat

SEQ ID NO: 1107091 - DNA, 20 bp, Homo sapiens
ctaaagaaatattgatagta

SEQ ID NO: 1107092 - DNA, 17 bp, Homo sapiens
ctaaagaagtttgaaca

SEQ ID NO: 1107093 - DNA, 15 bp, Homo sapiens
ctaaagagcccttgc

SEQ ID NO: 1107094 - DNA, 17 bp, Homo sapiens
ctaaagagcccttgcct

SEQ ID NO: 1107095 - DNA, 21 bp, Homo sapiens
ctaaagagcccttgcctcccc

SEQ ID NO: 1107096 - DNA, 22 bp, Homo sapiens
ctaaagagcccttgcctcccca

SEQ ID NO: 1107097 - DNA, 23 bp, Homo sapiens
ctaaagagttattcaaatgaagg

SEQ ID NO: 1107098 - DNA, 20 bp, Homo sapiens
ctaaagatatcagagctctt

SEQ ID NO: 1107099 - DNA, 15 bp, Homo sapiens
ctaaagatgggagga

SEQ ID NO: 1107100 - DNA, 14 bp, Homo sapiens
ctaaagcaaattgt

SEQ ID NO: 1107101 - DNA, 20 bp, Homo sapiens
ctaaagcaataatggtccca

SEQ ID NO: 1107102 - DNA, 21 bp, Homo sapiens
ctaaagcactggtttcaagaa

SEQ ID NO: 1107103 - DNA, 22 bp, Homo sapiens
ctaaagcactggtttcaagaat

SEQ ID NO: 1107104 - DNA, 13 bp, Homo sapiens
ctaaagcagaggc

SEQ ID NO: 1107105 - DNA, 14 bp, Homo sapiens
ctaaagcagaggca

SEQ ID NO: 1107106 - DNA, 18 bp, Homo sapiens
ctaaagcagtggacacca

SEQ ID NO: 1107107 - DNA, 11 bp, Homo sapiens
ctaaagccaaa

SEQ ID NO: 1107108 - DNA, 20 bp, Homo sapiens
ctaaagccaaagtttctgtt

SEQ ID NO: 1107109 - DNA, 19 bp, Homo sapiens
ctaaagccaaccagccttt

SEQ ID NO: 1107110 - DNA, 14 bp, Homo sapiens
ctaaagccagcctg

SEQ ID NO: 1107111 - DNA, 15 bp, Homo sapiens
ctaaagcctgaattt

SEQ ID NO: 1107112 - DNA, 18 bp, Homo sapiens
ctaaagctaaaaatatta

SEQ ID NO: 1107113 - DNA, 17 bp, Homo sapiens
ctaaagctggtttaatg

SEQ ID NO: 1107114 - DNA, 18 bp, Homo sapiens
ctaaagctggtttaatgt

SEQ ID NO: 1107115 - DNA, 14 bp, Homo sapiens
ctaaagctttatct

SEQ ID NO: 1107116 - DNA, 14 bp, Homo sapiens
ctaaagctttggac

SEQ ID NO: 1107117 - DNA, 19 bp, Homo sapiens
ctaaaggaaatcaaatgaa

SEQ ID NO: 1107118 - DNA, 14 bp, Homo sapiens
ctaaaggatccaga

SEQ ID NO: 1107119 - DNA, 18 bp, Homo sapiens
ctaaaggatccagagagc

SEQ ID NO: 1107120 - DNA, 20 bp, Homo sapiens
ctaaaggatccagagagcag

SEQ ID NO: 1107121 - DNA, 16 bp, Homo sapiens
ctaaaggatggaaaaa

SEQ ID NO: 1107122 - DNA, 23 bp, Homo sapiens
ctaaaggctaaacatatggcttt

SEQ ID NO: 1107123 - DNA, 15 bp, Homo sapiens
ctaaaggctaccttt

SEQ ID NO: 1107124 - DNA, 19 bp, Homo sapiens
ctaaagggaccatctgctg

SEQ ID NO: 1107125 - DNA, 18 bp, Homo sapiens
ctaaagggagaaatgcca

SEQ ID NO: 1107126 - DNA, 13 bp, Homo sapiens
ctaaagggcaggg

SEQ ID NO: 1107127 - DNA, 17 bp, Homo sapiens
ctaaaggggagaaactg

SEQ ID NO: 1107128 - DNA, 17 bp, Homo sapiens
ctaaaggggttccaaat

SEQ ID NO: 1107129 - DNA, 22 bp, Homo sapiens
ctaaaggggttttttgggaaga

SEQ ID NO: 1107130 - DNA, 19 bp, Homo sapiens
ctaaaggtgttgtcccttc

SEQ ID NO: 1107131 - DNA, 21 bp, Homo sapiens
ctaaagtagtttaagtctcct

SEQ ID NO: 1107132 - DNA, 19 bp, Homo sapiens
ctaaagtccagactatgga

SEQ ID NO: 1107133 - DNA, 15 bp, Homo sapiens
ctaaagtgttggtct

SEQ ID NO: 1107134 - DNA, 20 bp, Homo sapiens
ctaaagtgttggtctttcta

SEQ ID NO: 1107135 - DNA, 18 bp, Homo sapiens
ctaaagtgtttagctgtc

SEQ ID NO: 1107136 - DNA, 15 bp, Homo sapiens
ctaaagttacctgtt

SEQ ID NO: 1107137 - DNA, 18 bp, Homo sapiens
ctaaagttactactgatt

SEQ ID NO: 1107138 - DNA, 10 bp, Homo sapiens
ctaaagttat

SEQ ID NO: 1107139 - DNA, 15 bp, Homo sapiens
ctaaagttatatttc

SEQ ID NO: 1107140 - DNA, 15 bp, Homo sapiens
ctaaataaaaatatg

SEQ ID NO: 1107141 - DNA, 18 bp, Homo sapiens
ctaaataaggaatttcct

SEQ ID NO: 1107142 - DNA, 20 bp, Homo sapiens
ctaaataatgaataaactga

SEQ ID NO: 1107143 - DNA, 21 bp, Homo sapiens
ctaaataatgaataaactgaa

SEQ ID NO: 1107144 - DNA, 23 bp, Homo sapiens
ctaaatacatgtttgttggttga

SEQ ID NO: 1107145 - DNA, 14 bp, Homo sapiens
ctaaatatatgtct

SEQ ID NO: 1107146 - DNA, 23 bp, Homo sapiens
ctaaatatccaaagactgtactg

SEQ ID NO: 1107147 - DNA, 16 bp, Homo sapiens
ctaaatatggactgct

SEQ ID NO: 1107148 - DNA, 14 bp, Homo sapiens
ctaaatattttcaa

SEQ ID NO: 1107149 - DNA, 19 bp, Homo sapiens
ctaaatattttcaagaaaa

SEQ ID NO: 1107150 - DNA, 20 bp, Homo sapiens
ctaaatattttcaagaaaag

SEQ ID NO: 1107151 - DNA, 17 bp, Homo sapiens
ctaaatcctttactgtt

SEQ ID NO: 1107152 - DNA, 14 bp, Homo sapiens
ctaaatctatttat

SEQ ID NO: 1107153 - DNA, 19 bp, Homo sapiens
ctaaatctatttattaata

SEQ ID NO: 1107154 - DNA, 16 bp, Homo sapiens
ctaaatgaatgtttac

SEQ ID NO: 1107155 - DNA, 16 bp, Homo sapiens
ctaaatgatggtgctt

SEQ ID NO: 1107156 - DNA, 12 bp, Homo sapiens
ctaaatgcaaag

SEQ ID NO: 1107157 - DNA, 20 bp, Homo sapiens
ctaaatgcaatttaaaatta

SEQ ID NO: 1107158 - DNA, 21 bp, Homo sapiens
ctaaatgcaatttaaaattat

SEQ ID NO: 1107159 - DNA, 16 bp, Homo sapiens
ctaaatgcaccaagaa

SEQ ID NO: 1107160 - DNA, 18 bp, Homo sapiens
ctaaatgcagttttaaga

SEQ ID NO: 1107161 - DNA, 21 bp, Homo sapiens
ctaaatgcatatcctgagcca

SEQ ID NO: 1107162 - DNA, 12 bp, Homo sapiens
ctaaatgcccag

SEQ ID NO: 1107163 - DNA, 19 bp, Homo sapiens
ctaaatgctgttcttacac

SEQ ID NO: 1107164 - DNA, 18 bp, Homo sapiens
ctaaatggaaccactcta

SEQ ID NO: 1107165 - DNA, 16 bp, Homo sapiens
ctaaatggcctcatgt

SEQ ID NO: 1107166 - DNA, 18 bp, Homo sapiens
ctaaatggtcgcccagga

SEQ ID NO: 1107167 - DNA, 19 bp, Homo sapiens
ctaaatggtcgcccaggag

SEQ ID NO: 1107168 - DNA, 20 bp, Homo sapiens
ctaaatggtcgcccaggaga

SEQ ID NO: 1107169 - DNA, 21 bp, Homo sapiens
ctaaatgtgcaatagaaggtg

SEQ ID NO: 1107170 - DNA, 16 bp, Homo sapiens
ctaaatgttggaatgt

SEQ ID NO: 1107171 - DNA, 13 bp, Homo sapiens
ctaaattactgtt

SEQ ID NO: 1107172 - DNA, 14 bp, Homo sapiens
ctaaattctatgtt

SEQ ID NO: 1107173 - DNA, 22 bp, Homo sapiens
ctaaattctatgttaaatactg

SEQ ID NO: 1107174 - DNA, 21 bp, Homo sapiens
ctaaattgtatacattttgtt

SEQ ID NO: 1107175 - DNA, 17 bp, Homo sapiens
ctaaatttaatgctgcc

SEQ ID NO: 1107176 - DNA, 18 bp, Homo sapiens
ctaaatttaatgctgcct

SEQ ID NO: 1107177 - DNA, 17 bp, Homo sapiens
ctaaattttaaagccat

SEQ ID NO: 1107178 - DNA, 15 bp, Homo sapiens
ctaaattttctgaaa

SEQ ID NO: 1107179 - DNA, 15 bp, Homo sapiens
ctaaatttttcatag

SEQ ID NO: 1107180 - DNA, 14 bp, Homo sapiens
ctaacacagcatgt

SEQ ID NO: 1107181 - DNA, 17 bp, Homo sapiens
ctaacacagcatgtgta

SEQ ID NO: 1107182 - DNA, 21 bp, Homo sapiens
ctaacaccagcgtttgagggg

SEQ ID NO: 1107183 - DNA, 14 bp, Homo sapiens
ctaacacccagtct

SEQ ID NO: 1107184 - DNA, 11 bp, Homo sapiens
ctaacactggc

SEQ ID NO: 1107185 - DNA, 13 bp, Homo sapiens
ctaacactggccc

SEQ ID NO: 1107186 - DNA, 17 bp, Homo sapiens
ctaacagataagcaaga

SEQ ID NO: 1107187 - DNA, 18 bp, Homo sapiens
ctaacagatcagaacatg

SEQ ID NO: 1107188 - DNA, 22 bp, Homo sapiens
ctaacagcaacagcaagaaata

SEQ ID NO: 1107189 - DNA, 12 bp, Homo sapiens
ctaacagggaga

SEQ ID NO: 1107190 - DNA, 23 bp, Homo sapiens
ctaacagggagaagtagctagta

SEQ ID NO: 1107191 - DNA, 15 bp, Homo sapiens
ctaacagtcaagaaa

SEQ ID NO: 1107192 - DNA, 16 bp, Homo sapiens
ctaacataaaatctgt

SEQ ID NO: 1107193 - DNA, 21 bp, Homo sapiens
ctaacataacactaaatgctg

SEQ ID NO: 1107194 - DNA, 23 bp, Homo sapiens
ctaacatataatgttgttattta

SEQ ID NO: 1107195 - DNA, 22 bp, Homo sapiens
ctaacatggtgaaaccccgtct

SEQ ID NO: 1107196 - DNA, 17 bp, Homo sapiens
ctaacatgtcctgccta

SEQ ID NO: 1107197 - DNA, 16 bp, Homo sapiens
ctaaccaagaggctgg

SEQ ID NO: 1107198 - DNA, 17 bp, Homo sapiens
ctaaccaagaggctggt

SEQ ID NO: 1107199 - DNA, 12 bp, Homo sapiens
ctaaccatcccc

SEQ ID NO: 1107200 - DNA, 18 bp, Homo sapiens
ctaaccatccccaactcc

SEQ ID NO: 1107201 - DNA, 18 bp, Homo sapiens
ctaaccatgtgttatgtt

SEQ ID NO: 1107202 - DNA, 22 bp, Homo sapiens
ctaaccattcaaatgacgcctg

SEQ ID NO: 1107203 - DNA, 19 bp, Homo sapiens
ctaaccccttccagatcac

SEQ ID NO: 1107204 - DNA, 13 bp, Homo sapiens
ctaacccctttcc

SEQ ID NO: 1107205 - DNA, 19 bp, Homo sapiens
ctaaccctcattgctgtct

SEQ ID NO: 1107206 - DNA, 15 bp, Homo sapiens
ctaaccctgtggaag

SEQ ID NO: 1107207 - DNA, 20 bp, Homo sapiens
ctaacctctaaccctcattg

SEQ ID NO: 1107208 - DNA, 13 bp, Homo sapiens
ctaacctctctga

SEQ ID NO: 1107209 - DNA, 17 bp, Homo sapiens
ctaacctgggttccctt

SEQ ID NO: 1107210 - DNA, 12 bp, Homo sapiens
ctaaccttgaat

SEQ ID NO: 1107211 - DNA, 20 bp, Homo sapiens
ctaagggtgggtgctcagaa

SEQ ID NO: 1107212 - DNA, 21 bp, Homo sapiens
ctaagggtgggtgctcagaat

SEQ ID NO: 1107213 - DNA, 18 bp, Homo sapiens
ctaagggtgtaagtaatt

SEQ ID NO: 1107214 - DNA, 16 bp, Homo sapiens
ctaaggtccctggggg

SEQ ID NO: 1107215 - DNA, 19 bp, Homo sapiens
ctaaggtctcatgctgttg

SEQ ID NO: 1107216 - DNA, 16 bp, Homo sapiens
ctaaggtttccagtca

SEQ ID NO: 1107217 - DNA, 16 bp, Homo sapiens
ctaagtaaaaatatgt

SEQ ID NO: 1107218 - DNA, 13 bp, Homo sapiens
ctaagtatttaaa

SEQ ID NO: 1107219 - DNA, 13 bp, Homo sapiens
ctaagtatttccc

SEQ ID NO: 1107220 - DNA, 17 bp, Homo sapiens
ctaagtatttcccagca

SEQ ID NO: 1107221 - DNA, 13 bp, Homo sapiens
ctaagtcaggtaa

SEQ ID NO: 1107222 - DNA, 15 bp, Homo sapiens
ctaagtcccttccta

SEQ ID NO: 1107223 - DNA, 22 bp, Homo sapiens
ctaagtcccttcctattctcct

SEQ ID NO: 1107224 - DNA, 13 bp, Homo sapiens
ctaagtctctgtg

SEQ ID NO: 1107225 - DNA, 14 bp, Homo sapiens
ctaagtctctgtga

SEQ ID NO: 1107226 - DNA, 13 bp, Homo sapiens
ctaagtgatataa

SEQ ID NO: 1107227 - DNA, 15 bp, Homo sapiens
ctaagtgatgctgtg

SEQ ID NO: 1107228 - DNA, 23 bp, Homo sapiens
ctaagtggattggctttgtgctt

SEQ ID NO: 1107229 - DNA, 17 bp, Homo sapiens
ctaagtggcgtgtgcat

SEQ ID NO: 1107230 - DNA, 17 bp, Homo sapiens
ctaagtgtaacctcagt

SEQ ID NO: 1107231 - DNA, 18 bp, Homo sapiens
ctaagtgtaacctcagta

SEQ ID NO: 1107232 - DNA, 17 bp, Homo sapiens
ctaagtgtaatgttgct

SEQ ID NO: 1107233 - DNA, 23 bp, Homo sapiens
ctaagtgttcgtctttagttttg

SEQ ID NO: 1107234 - DNA, 18 bp, Homo sapiens
ctaagtgttgattgtgcc

SEQ ID NO: 1107235 - DNA, 20 bp, Homo sapiens
ctaagttatagtatatctgg

SEQ ID NO: 1107236 - DNA, 17 bp, Homo sapiens
ctaagttatttactttt

SEQ ID NO: 1107237 - DNA, 16 bp, Homo sapiens
ctaagttgggatctag

SEQ ID NO: 1107238 - DNA, 24 bp, Homo sapiens
ctaagttgggatctaggagaggag

SEQ ID NO: 1107239 - DNA, 19 bp, Homo sapiens
ctaagtttcagttgatttt

SEQ ID NO: 1107240 - DNA, 16 bp, Homo sapiens
ctaagttttgtgtgta

SEQ ID NO: 1107241 - DNA, 20 bp, Homo sapiens
ctaagttttgtgtgtatata

SEQ ID NO: 1107242 - DNA, 14 bp, Homo sapiens
ctaagtttttatgg

SEQ ID NO: 1107243 - DNA, 23 bp, Homo sapiens
ctaagtttttatggcttttgtgc

SEQ ID NO: 1107244 - DNA, 19 bp, Homo sapiens
ctaataaactaataattgc

SEQ ID NO: 1107245 - DNA, 14 bp, Homo sapiens
ctaataaactgtat

SEQ ID NO: 1107246 - DNA, 16 bp, Homo sapiens
ctaataaactgtatta

SEQ ID NO: 1107247 - DNA, 21 bp, Homo sapiens
ctaataaactgtattaaatct

SEQ ID NO: 1107248 - DNA, 11 bp, Homo sapiens
ctaataaatac

SEQ ID NO: 1107249 - DNA, 22 bp, Homo sapiens
ctaataaattttagtgtgcctt

SEQ ID NO: 1107250 - DNA, 17 bp, Homo sapiens
ctaataacatgtgaaaa

SEQ ID NO: 1107251 - DNA, 13 bp, Homo sapiens
ctaataagaagtg

SEQ ID NO: 1107252 - DNA, 23 bp, Homo sapiens
ctaataagtttgtgttagaaaag

SEQ ID NO: 1107253 - DNA, 23 bp, Homo sapiens
ctaatacagcaacaatttatgaa

SEQ ID NO: 1107254 - DNA, 23 bp, Homo sapiens
ctaatacgtgccagatataactg

SEQ ID NO: 1107255 - DNA, 18 bp, Homo sapiens
ctaatagaaaagtatgtt

SEQ ID NO: 1107256 - DNA, 17 bp, Homo sapiens
ctaatagactaaatgaa

SEQ ID NO: 1107257 - DNA, 18 bp, Homo sapiens
ctaatagactaaatgaaa

SEQ ID NO: 1107258 - DNA, 18 bp, Homo sapiens
ctaatagcccataaagtc

SEQ ID NO: 1107259 - DNA, 23 bp, Homo sapiens
ctaatagcgggttactttcacat

SEQ ID NO: 1107260 - DNA, 23 bp, Homo sapiens
ctaatatactttttttgttatag

SEQ ID NO: 1107261 - DNA, 14 bp, Homo sapiens
ctaatatatggacc

SEQ ID NO: 1107262 - DNA, 13 bp, Homo sapiens
ctaatatggcaaa

SEQ ID NO: 1107263 - DNA, 20 bp, Homo sapiens
ctaatatggccacagtagtc

SEQ ID NO: 1107264 - DNA, 13 bp, Homo sapiens
ctaatattaaaaa

SEQ ID NO: 1107265 - DNA, 18 bp, Homo sapiens
ctaatattagttggcttt

SEQ ID NO: 1107266 - DNA, 14 bp, Homo sapiens
ctaatatttttcat

SEQ ID NO: 1107267 - DNA, 16 bp, Homo sapiens
ctaatcaaagccaggg

SEQ ID NO: 1107268 - DNA, 20 bp, Homo sapiens
ctaatcaaagccagggtctc

SEQ ID NO: 1107269 - DNA, 13 bp, Homo sapiens
ctaatcacagtgt

SEQ ID NO: 1107270 - DNA, 13 bp, Homo sapiens
ctaatcacatgtg

SEQ ID NO: 1107271 - DNA, 19 bp, Homo sapiens
ctaatcaccatgtaagcac

SEQ ID NO: 1107272 - DNA, 14 bp, Homo sapiens
ctaatcactctgag

SEQ ID NO: 1107273 - DNA, 15 bp, Homo sapiens
ctaatcactctgagt

SEQ ID NO: 1107274 - DNA, 22 bp, Homo sapiens
ctaatcagatgatggccatttc

SEQ ID NO: 1107275 - DNA, 19 bp, Homo sapiens
ctaatcagggaggtcattt

SEQ ID NO: 1107276 - DNA, 20 bp, Homo sapiens
ctaatcatgagaaaaactgt

SEQ ID NO: 1107277 - DNA, 20 bp, Homo sapiens
ctaatcatgtgggtgagcca

SEQ ID NO: 1107278 - DNA, 21 bp, Homo sapiens
ctaatcatgtgggtgagccag

SEQ ID NO: 1107279 - DNA, 19 bp, Homo sapiens
ctaatctagatatcgactt

SEQ ID NO: 1107280 - DNA, 18 bp, Homo sapiens
ctaatctatggtcgggag

SEQ ID NO: 1107281 - DNA, 20 bp, Homo sapiens
ctaatctattgggttcatta

SEQ ID NO: 1107282 - DNA, 15 bp, Homo sapiens
ctaatctcttattct

SEQ ID NO: 1107283 - DNA, 23 bp, Homo sapiens
ctaatctgaccgttctattgtgt

SEQ ID NO: 1107284 - DNA, 14 bp, Homo sapiens
ctaatctgagattg

SEQ ID NO: 1107285 - DNA, 14 bp, Homo sapiens
ctaatctgtagggc

SEQ ID NO: 1107286 - DNA, 11 bp, Homo sapiens
ctaatctttca

SEQ ID NO: 1107287 - DNA, 13 bp, Homo sapiens
ctaatgaaaaaca

SEQ ID NO: 1107288 - DNA, 22 bp, Homo sapiens
ctaatgaaaaacaaaaagctaa

SEQ ID NO: 1107289 - DNA, 21 bp, Homo sapiens
ctaatgaaggttttcatttgc

SEQ ID NO: 1107290 - DNA, 13 bp, Homo sapiens
ctaatgagactga

SEQ ID NO: 1107291 - DNA, 21 bp, Homo sapiens
ctaatgaggagagaaaatata

SEQ ID NO: 1107292 - DNA, 23 bp, Homo sapiens
ctaatgatgagcatttagcacaa

SEQ ID NO: 1107293 - DNA, 13 bp, Homo sapiens
ctaatgatgtttt

SEQ ID NO: 1107294 - DNA, 19 bp, Homo sapiens
ctaatgcaaattaaaacat

SEQ ID NO: 1107295 - DNA, 16 bp, Homo sapiens
ctaatgcctcttcatt

SEQ ID NO: 1107296 - DNA, 18 bp, Homo sapiens
ctaatgctaagaaatgct

SEQ ID NO: 1107297 - DNA, 13 bp, Homo sapiens
ctaatgctcacct

SEQ ID NO: 1107298 - DNA, 20 bp, Homo sapiens
ctaatgctggcctgactggt

SEQ ID NO: 1107299 - DNA, 14 bp, Homo sapiens
ctaatggagaagac

SEQ ID NO: 1107300 - DNA, 21 bp, Homo sapiens
ctaatggattataatcagaat

SEQ ID NO: 1107301 - DNA, 14 bp, Homo sapiens
ctaatggctttcac

SEQ ID NO: 1107302 - DNA, 14 bp, Homo sapiens
ctaatgtactgcat

SEQ ID NO: 1107303 - DNA, 14 bp, Homo sapiens
ctaatgtactgtac

SEQ ID NO: 1107304 - DNA, 17 bp, Homo sapiens
ctaatgtactgtacata

SEQ ID NO: 1107305 - DNA, 20 bp, Homo sapiens
ctaatgtactgtacataaat

SEQ ID NO: 1107306 - DNA, 23 bp, Homo sapiens
ctaatgtactgtacataaattcc

SEQ ID NO: 1107307 - DNA, 15 bp, Homo sapiens
ctaatgtagctattt

SEQ ID NO: 1107308 - DNA, 17 bp, Homo sapiens
ctaatgtcacaattatg

SEQ ID NO: 1107309 - DNA, 13 bp, Homo sapiens
ctaatgtcttcat

SEQ ID NO: 1107310 - DNA, 23 bp, Homo sapiens
ctaatgtgcagggatattgcctt

SEQ ID NO: 1107311 - DNA, 19 bp, Homo sapiens
ctaatgttgatcagcaaat

SEQ ID NO: 1107312 - DNA, 22 bp, Homo sapiens
ctaatgttgatcagcaaattta

SEQ ID NO: 1107313 - DNA, 22 bp, Homo sapiens
ctaatgttggacagacactgtt

SEQ ID NO: 1107314 - DNA, 20 bp, Homo sapiens
ctaatgtttatgagccagac

SEQ ID NO: 1107315 - DNA, 16 bp, Homo sapiens
ctaatgtttgtgagaa

SEQ ID NO: 1107316 - DNA, 15 bp, Homo sapiens
ctaatgttttgctta

SEQ ID NO: 1107317 - DNA, 20 bp, Homo sapiens
ctaattaaaacactttcaaa

SEQ ID NO: 1107318 - DNA, 18 bp, Homo sapiens
ctaattaaataatacaac

SEQ ID NO: 1107319 - DNA, 17 bp, Homo sapiens
ctaattaaccttactaa

SEQ ID NO: 1107320 - DNA, 17 bp, Homo sapiens
ctaattaattgtaatct

SEQ ID NO: 1107321 - DNA, 18 bp, Homo sapiens
ctaattatactactttgt

SEQ ID NO: 1107322 - DNA, 21 bp, Homo sapiens
ctaattatactactttgttag

SEQ ID NO: 1107323 - DNA, 18 bp, Homo sapiens
ctaattatttaattgtcc

SEQ ID NO: 1107324 - DNA, 15 bp, Homo sapiens
ctaattcacagtgct

SEQ ID NO: 1107325 - DNA, 17 bp, Homo sapiens
ctaattccacacctttt

SEQ ID NO: 1107326 - DNA, 15 bp, Homo sapiens
ctaattccacagctg

SEQ ID NO: 1107327 - DNA, 17 bp, Homo sapiens
ctaattcccaacatttc

SEQ ID NO: 1107328 - DNA, 18 bp, Homo sapiens
ctaattcccattttgcaa

SEQ ID NO: 1107329 - DNA, 19 bp, Homo sapiens
ctaattcccattttgcaaa

SEQ ID NO: 1107330 - DNA, 20 bp, Homo sapiens
ctaattcccattttgcaaaa

SEQ ID NO: 1107331 - DNA, 17 bp, Homo sapiens
ctaattcgatgaaggct

SEQ ID NO: 1107332 - DNA, 14 bp, Homo sapiens
ctagaaaggagaga

SEQ ID NO: 1107333 - DNA, 21 bp, Homo sapiens
ctagaaatagatttaaagaat

SEQ ID NO: 1107334 - DNA, 19 bp, Homo sapiens
ctagaaattccccaccctg

SEQ ID NO: 1107335 - DNA, 18 bp, Homo sapiens
ctagaaattgaacaaaaa

SEQ ID NO: 1107336 - DNA, 13 bp, Homo sapiens
ctagaaatttttc

SEQ ID NO: 1107337 - DNA, 22 bp, Homo sapiens
ctagaacacaggcaaaatcctt

SEQ ID NO: 1107338 - DNA, 16 bp, Homo sapiens
ctagaacactaactca

SEQ ID NO: 1107339 - DNA, 20 bp, Homo sapiens
ctagaacactaactcaccag

SEQ ID NO: 1107340 - DNA, 19 bp, Homo sapiens
ctagaacatccctgggcaa

SEQ ID NO: 1107341 - DNA, 22 bp, Homo sapiens
ctagaacatgcacatttatata

SEQ ID NO: 1107342 - DNA, 15 bp, Homo sapiens
ctagaagaaaacccg

SEQ ID NO: 1107343 - DNA, 20 bp, Homo sapiens
ctagaagaaaacccgaggga

SEQ ID NO: 1107344 - DNA, 22 bp, Homo sapiens
ctagaagaaccaaatacctcaa

SEQ ID NO: 1107345 - DNA, 19 bp, Homo sapiens
ctagaagagcacagagccc

SEQ ID NO: 1107346 - DNA, 20 bp, Homo sapiens
ctagaagagcacagagccct

SEQ ID NO: 1107347 - DNA, 22 bp, Homo sapiens
ctagaagagcacagagccctga

SEQ ID NO: 1107348 - DNA, 16 bp, Homo sapiens
ctagaagagtctattg

SEQ ID NO: 1107349 - DNA, 19 bp, Homo sapiens
ctagaagagtctattgtct

SEQ ID NO: 1107350 - DNA, 14 bp, Homo sapiens
ctagaagatgtgta

SEQ ID NO: 1107351 - DNA, 17 bp, Homo sapiens
ctagaagatgtgtaaac

SEQ ID NO: 1107352 - DNA, 18 bp, Homo sapiens
ctagaagatgtgtaaaca

SEQ ID NO: 1107353 - DNA, 20 bp, Homo sapiens
ctagaagccaagggaaaggg

SEQ ID NO: 1107354 - DNA, 17 bp, Homo sapiens
ctagaaggcttctctcc

SEQ ID NO: 1107355 - DNA, 16 bp, Homo sapiens
ctagaaggggtggctg

SEQ ID NO: 1107356 - DNA, 22 bp, Homo sapiens
ctagaaggtggggacctggggg

SEQ ID NO: 1107357 - DNA, 15 bp, Homo sapiens
ctagaagtatttgtg

SEQ ID NO: 1107358 - DNA, 20 bp, Homo sapiens
ctagaataatctcatccccc

SEQ ID NO: 1107359 - DNA, 23 bp, Homo sapiens
ctagaataatctcatccccccac

SEQ ID NO: 1107360 - DNA, 18 bp, Homo sapiens
ctagaatactttttaaaa

SEQ ID NO: 1107361 - DNA, 22 bp, Homo sapiens
ctagaatcagcctaggggtcag

SEQ ID NO: 1107362 - DNA, 20 bp, Homo sapiens
ctagaatgtggatttgattc

SEQ ID NO: 1107363 - DNA, 19 bp, Homo sapiens
ctagaattagtatgtctgt

SEQ ID NO: 1107364 - DNA, 20 bp, Homo sapiens
ctagaattctagtgctgctg

SEQ ID NO: 1107365 - DNA, 19 bp, Homo sapiens
ctagaattttaagtgcttt

SEQ ID NO: 1107366 - DNA, 16 bp, Homo sapiens
ctagacaaacaaggga

SEQ ID NO: 1107367 - DNA, 20 bp, Homo sapiens
ctagacaaacaagggagaag

SEQ ID NO: 1107368 - DNA, 13 bp, Homo sapiens
ctagacaaccctg

SEQ ID NO: 1107369 - DNA, 16 bp, Homo sapiens
ctagacaacctttctg

SEQ ID NO: 1107370 - DNA, 18 bp, Homo sapiens
ctagacaacctttctgta

SEQ ID NO: 1107371 - DNA, 15 bp, Homo sapiens
ctagacaagatattg

SEQ ID NO: 1107372 - DNA, 19 bp, Homo sapiens
ctagacagaaaccaagcca

SEQ ID NO: 1107373 - DNA, 20 bp, Homo sapiens
ctagacagtattgccacctc

SEQ ID NO: 1107374 - DNA, 22 bp, Homo sapiens
ctagacagtattgccacctctg

SEQ ID NO: 1107375 - DNA, 18 bp, Homo sapiens
ctagaccagcagacagag

SEQ ID NO: 1107376 - DNA, 17 bp, Homo sapiens
ctagaccagtttgcatg

SEQ ID NO: 1107377 - DNA, 12 bp, Homo sapiens
ctagaccctccc

SEQ ID NO: 1107378 - DNA, 16 bp, Homo sapiens
ctagacctccccctca

SEQ ID NO: 1107379 - DNA, 17 bp, Homo sapiens
ctagacctccccctcac

SEQ ID NO: 1107380 - DNA, 21 bp, Homo sapiens
ctagactaattaaaatctgga

SEQ ID NO: 1107381 - DNA, 15 bp, Homo sapiens
ctagactctagacaa

SEQ ID NO: 1107382 - DNA, 16 bp, Homo sapiens
ctagacttcccaacag

SEQ ID NO: 1107383 - DNA, 19 bp, Homo sapiens
ctagacttcccaacagcct

SEQ ID NO: 1107384 - DNA, 15 bp, Homo sapiens
ctagacttccccatc

SEQ ID NO: 1107385 - DNA, 17 bp, Homo sapiens
ctagacttccccatccc

SEQ ID NO: 1107386 - DNA, 14 bp, Homo sapiens
ctagacttgaaagt

SEQ ID NO: 1107387 - DNA, 16 bp, Homo sapiens
ctagacttgaaagttt

SEQ ID NO: 1107388 - DNA, 12 bp, Homo sapiens
ctagactttctg

SEQ ID NO: 1107389 - DNA, 14 bp, Homo sapiens
ctagactttctgtt

SEQ ID NO: 1107390 - DNA, 18 bp, Homo sapiens
ctagagaaattcttgtta

SEQ ID NO: 1107391 - DNA, 12 bp, Homo sapiens
ctagagaagagg

SEQ ID NO: 1107392 - DNA, 19 bp, Homo sapiens
ctagagaagaggctggtgc

SEQ ID NO: 1107393 - DNA, 13 bp, Homo sapiens
ctagagacacatt

SEQ ID NO: 1107394 - DNA, 20 bp, Homo sapiens
ctagagacagaagcaggctg

SEQ ID NO: 1107395 - DNA, 23 bp, Homo sapiens
ctagagacagaagcaggctggag

SEQ ID NO: 1107396 - DNA, 11 bp, Homo sapiens
ctagagagagg

SEQ ID NO: 1107397 - DNA, 17 bp, Homo sapiens
ctagagatatggcagcg

SEQ ID NO: 1107398 - DNA, 18 bp, Homo sapiens
ctagagatattttgtaaa

SEQ ID NO: 1107399 - DNA, 14 bp, Homo sapiens
ctagagcaacccct

SEQ ID NO: 1107400 - DNA, 22 bp, Homo sapiens
ctagagcaacccctgtacccag

SEQ ID NO: 1107401 - DNA, 23 bp, Homo sapiens
ctagagcaacccctgtacccagc

SEQ ID NO: 1107402 - DNA, 23 bp, Homo sapiens
ctagagcagttggccaagcagaa

SEQ ID NO: 1107403 - DNA, 15 bp, Homo sapiens
ctagagccagaccaa

SEQ ID NO: 1107404 - DNA, 17 bp, Homo sapiens
ctagagccgggcacagc

SEQ ID NO: 1107405 - DNA, 13 bp, Homo sapiens
ctagagcctcgac

SEQ ID NO: 1107406 - DNA, 17 bp, Homo sapiens
ctagagccttcagcctt

SEQ ID NO: 1107407 - DNA, 14 bp, Homo sapiens
ctagagctttcttt

SEQ ID NO: 1107408 - DNA, 22 bp, Homo sapiens
ctagagctttctttcacaaaaa

SEQ ID NO: 1107409 - DNA, 17 bp, Homo sapiens
ctagaggaaaagaaaga

SEQ ID NO: 1107410 - DNA, 14 bp, Homo sapiens
ctagaggcagggag

SEQ ID NO: 1107411 - DNA, 19 bp, Homo sapiens
ctagaggcagggaggggac

SEQ ID NO: 1107412 - DNA, 12 bp, Homo sapiens
ctagaggcctca

SEQ ID NO: 1107413 - DNA, 15 bp, Homo sapiens
ctagaggcctcagtt

SEQ ID NO: 1107414 - DNA, 18 bp, Homo sapiens
ctagaggcctgaggatga

SEQ ID NO: 1107415 - DNA, 22 bp, Homo sapiens
ctagaggcttgcataataagct

SEQ ID NO: 1107416 - DNA, 21 bp, Homo sapiens
ctagagggacctctcccaggg

SEQ ID NO: 1107417 - DNA, 15 bp, Homo sapiens
ctagagggcccatca

SEQ ID NO: 1107418 - DNA, 18 bp, Homo sapiens
ctagagggcccatcaggc

SEQ ID NO: 1107419 - DNA, 19 bp, Homo sapiens
ctagagggcccatcaggca

SEQ ID NO: 1107420 - DNA, 19 bp, Homo sapiens
ctagagggttcctgtagac

SEQ ID NO: 1107421 - DNA, 20 bp, Homo sapiens
ctagagggttgctgcctttc

SEQ ID NO: 1107422 - DNA, 20 bp, Homo sapiens
ctagaggtcaggacggctcc

SEQ ID NO: 1107423 - DNA, 23 bp, Homo sapiens
ctagaggtgggcagctgggcccc

SEQ ID NO: 1107424 - DNA, 15 bp, Homo sapiens
ctagaggttcaaaga

SEQ ID NO: 1107425 - DNA, 18 bp, Homo sapiens
ctagaggttcaaagatat

SEQ ID NO: 1107426 - DNA, 19 bp, Homo sapiens
ctagagtcatgtgagcctc

SEQ ID NO: 1107427 - DNA, 19 bp, Homo sapiens
ctagagtcctcactcccag

SEQ ID NO: 1107428 - DNA, 14 bp, Homo sapiens
ctagagtctcagaa

SEQ ID NO: 1107429 - DNA, 19 bp, Homo sapiens
ctagagtctgaacagctgt

SEQ ID NO: 1107430 - DNA, 17 bp, Homo sapiens
ctagagttatcttcttt

SEQ ID NO: 1107431 - DNA, 19 bp, Homo sapiens
ctagagttcggtctgacag

SEQ ID NO: 1107432 - DNA, 21 bp, Homo sapiens
ctagatatcgacttgtttttg

SEQ ID NO: 1107433 - DNA, 15 bp, Homo sapiens
ctagatccacgtgtg

SEQ ID NO: 1107434 - DNA, 19 bp, Homo sapiens
ctagatcctgcaccccagc

SEQ ID NO: 1107435 - DNA, 17 bp, Homo sapiens
ctagatgcaagtctctt

SEQ ID NO: 1107436 - DNA, 18 bp, Homo sapiens
ctagatggaatggaaaag

SEQ ID NO: 1107437 - DNA, 16 bp, Homo sapiens
ctagatggacctgcct

SEQ ID NO: 1107438 - DNA, 14 bp, Homo sapiens
ctagatggctcctc

SEQ ID NO: 1107439 - DNA, 15 bp, Homo sapiens
ctagatggctcctct

SEQ ID NO: 1107440 - DNA, 16 bp, Homo sapiens
ctagatggctcctctc

SEQ ID NO: 1107441 - DNA, 16 bp, Homo sapiens
ctagatgtagtatttt

SEQ ID NO: 1107442 - DNA, 19 bp, Homo sapiens
ctagatgtatgtgaataaa

SEQ ID NO: 1107443 - DNA, 13 bp, Homo sapiens
ctagatgtcttta

SEQ ID NO: 1107444 - DNA, 20 bp, Homo sapiens
ctagatgtttaacaaatcta

SEQ ID NO: 1107445 - DNA, 19 bp, Homo sapiens
ctagattacagagggctca

SEQ ID NO: 1107446 - DNA, 13 bp, Homo sapiens
ctagattactttt

SEQ ID NO: 1107447 - DNA, 21 bp, Homo sapiens
ctagattaggtagactttgct

SEQ ID NO: 1107448 - DNA, 23 bp, Homo sapiens
ctagattaggtagactttgctta

SEQ ID NO: 1107449 - DNA, 19 bp, Homo sapiens
ctagcaaaataaaacatag

SEQ ID NO: 1107450 - DNA, 17 bp, Homo sapiens
ctagcaacatatctctg

SEQ ID NO: 1107451 - DNA, 20 bp, Homo sapiens
ctagcaacatatctctgccg

SEQ ID NO: 1107452 - DNA, 17 bp, Homo sapiens
ctagcaattttctttgt

SEQ ID NO: 1107453 - DNA, 16 bp, Homo sapiens
ctagtgccccagactg

SEQ ID NO: 1107454 - DNA, 22 bp, Homo sapiens
ctagtgccttgcccacaggtgc

SEQ ID NO: 1107455 - DNA, 12 bp, Homo sapiens
ctagtgctgtaa

SEQ ID NO: 1107456 - DNA, 17 bp, Homo sapiens
ctagtgctgtaatattg

SEQ ID NO: 1107457 - DNA, 21 bp, Homo sapiens
ctagtggctctcagttaaaat

SEQ ID NO: 1107458 - DNA, 16 bp, Homo sapiens
ctagtggctgttcatg

SEQ ID NO: 1107459 - DNA, 23 bp, Homo sapiens
ctagtgggacagcccagagcctg

SEQ ID NO: 1107460 - DNA, 18 bp, Homo sapiens
ctagtggggtctccctct

SEQ ID NO: 1107461 - DNA, 20 bp, Homo sapiens
ctagtggggtctccctctcc

SEQ ID NO: 1107462 - DNA, 23 bp, Homo sapiens
ctagtggggtgaacagctggtgc

SEQ ID NO: 1107463 - DNA, 21 bp, Homo sapiens
ctagtggtctcacctggaggc

SEQ ID NO: 1107464 - DNA, 23 bp, Homo sapiens
ctagtgtacctcctctcagtgtt

SEQ ID NO: 1107465 - DNA, 21 bp, Homo sapiens
ctagtgtttctagctaaataa

SEQ ID NO: 1107466 - DNA, 18 bp, Homo sapiens
ctagttaaagaaaggaaa

SEQ ID NO: 1107467 - DNA, 16 bp, Homo sapiens
ctagttatacttattt

SEQ ID NO: 1107468 - DNA, 23 bp, Homo sapiens
ctagttatacttatttgtatatg

SEQ ID NO: 1107469 - DNA, 23 bp, Homo sapiens
ctagttcagatacagggtgctcc

SEQ ID NO: 1107470 - DNA, 12 bp, Homo sapiens
ctagttcatcca

SEQ ID NO: 1107471 - DNA, 18 bp, Homo sapiens
ctagttcatccaatcctc

SEQ ID NO: 1107472 - DNA, 19 bp, Homo sapiens
ctagttcatccaatcctca

SEQ ID NO: 1107473 - DNA, 24 bp, Homo sapiens
ctagttcatccaatcctcactggg

SEQ ID NO: 1107474 - DNA, 22 bp, Homo sapiens
ctagttccagaaaacctctcct

SEQ ID NO: 1107475 - DNA, 13 bp, Homo sapiens
ctagttctagatg

SEQ ID NO: 1107476 - DNA, 23 bp, Homo sapiens
ctagttctcaatcactgctcccc

SEQ ID NO: 1107477 - DNA, 18 bp, Homo sapiens
ctagttctcttgtcctgt

SEQ ID NO: 1107478 - DNA, 17 bp, Homo sapiens
ctagttctgctgccctc

SEQ ID NO: 1107479 - DNA, 16 bp, Homo sapiens
ctagttctttcctccc

SEQ ID NO: 1107480 - DNA, 21 bp, Homo sapiens
ctagttctttcctccccctgc

SEQ ID NO: 1107481 - DNA, 23 bp, Homo sapiens
ctagttctttcctccccctgcaa

SEQ ID NO: 1107482 - DNA, 21 bp, Homo sapiens
ctagttgccctctacctgact

SEQ ID NO: 1107483 - DNA, 21 bp, Homo sapiens
ctagtttacagaaaaatcttg

SEQ ID NO: 1107484 - DNA, 16 bp, Homo sapiens
ctagtttactgttttg

SEQ ID NO: 1107485 - DNA, 20 bp, Homo sapiens
ctagtttcacgtaaatattc

SEQ ID NO: 1107486 - DNA, 21 bp, Homo sapiens
ctagtttcagtaaataatgaa

SEQ ID NO: 1107487 - DNA, 19 bp, Homo sapiens
ctagtttctagtgtcactg

SEQ ID NO: 1107488 - DNA, 13 bp, Homo sapiens
ctagtttgattaa

SEQ ID NO: 1107489 - DNA, 17 bp, Homo sapiens
ctagtttgattaaattc

SEQ ID NO: 1107490 - DNA, 22 bp, Homo sapiens
ctagtttgattaaattcttgca

SEQ ID NO: 1107491 - DNA, 19 bp, Homo sapiens
ctagttttctcctcccagg

SEQ ID NO: 1107492 - DNA, 20 bp, Homo sapiens
ctagttttctcctcccagga

SEQ ID NO: 1107493 - DNA, 11 bp, Homo sapiens
ctagtttttta

SEQ ID NO: 1107494 - DNA, 22 bp, Homo sapiens
ctagttttttgcttctctttcc

SEQ ID NO: 1107495 - DNA, 16 bp, Homo sapiens
ctagttttttttgtaa

SEQ ID NO: 1107496 - DNA, 16 bp, Homo sapiens
ctataaaaaagaaaga

SEQ ID NO: 1107497 - DNA, 18 bp, Homo sapiens
ctataaaaaataaaataa

SEQ ID NO: 1107498 - DNA, 12 bp, Homo sapiens
ctataaaagctt

SEQ ID NO: 1107499 - DNA, 14 bp, Homo sapiens
ctataaaataaact

SEQ ID NO: 1107500 - DNA, 14 bp, Homo sapiens
ctataaaattaaat

SEQ ID NO: 1107501 - DNA, 19 bp, Homo sapiens
ctataaacttaagggcaag

SEQ ID NO: 1107502 - DNA, 21 bp, Homo sapiens
ctataaacttaagggcaagga

SEQ ID NO: 1107503 - DNA, 23 bp, Homo sapiens
ctataaagaagaacttgcatgga

SEQ ID NO: 1107504 - DNA, 16 bp, Homo sapiens
ctataaagcagtattt

SEQ ID NO: 1107505 - DNA, 18 bp, Homo sapiens
ctataaagcagtattttt

SEQ ID NO: 1107506 - DNA, 19 bp, Homo sapiens
ctataaagcagtatttttc

SEQ ID NO: 1107507 - DNA, 14 bp, Homo sapiens
ctataaagcattta

SEQ ID NO: 1107508 - DNA, 15 bp, Homo sapiens
ctataaagcatttaa

SEQ ID NO: 1107509 - DNA, 16 bp, Homo sapiens
ctataaagtaaagcta

SEQ ID NO: 1107510 - DNA, 15 bp, Homo sapiens
ctataaatcagtatt

SEQ ID NO: 1107511 - DNA, 14 bp, Homo sapiens
ctataaatgttgct

SEQ ID NO: 1107512 - DNA, 17 bp, Homo sapiens
ctataaattcctctttg

SEQ ID NO: 1107513 - DNA, 19 bp, Homo sapiens
ctataaattcctctttgct

SEQ ID NO: 1107514 - DNA, 17 bp, Homo sapiens
ctataaatttaagaaaa

SEQ ID NO: 1107515 - DNA, 21 bp, Homo sapiens
ctataagaggaatttcttttc

SEQ ID NO: 1107516 - DNA, 22 bp, Homo sapiens
ctataagaggaatttcttttcc

SEQ ID NO: 1107517 - DNA, 22 bp, Homo sapiens
ctataagcaagaaggcaaaaat

SEQ ID NO: 1107518 - DNA, 21 bp, Homo sapiens
ctataaggagagttcaagcct

SEQ ID NO: 1107519 - DNA, 12 bp, Homo sapiens
ctataaggtgcc

SEQ ID NO: 1107520 - DNA, 13 bp, Homo sapiens
ctataaggtgcct

SEQ ID NO: 1107521 - DNA, 11 bp, Homo sapiens
ctataagttgt

SEQ ID NO: 1107522 - DNA, 21 bp, Homo sapiens
ctataagttgtaccaaaacat

SEQ ID NO: 1107523 - DNA, 18 bp, Homo sapiens
ctataataagttttgata

SEQ ID NO: 1107524 - DNA, 16 bp, Homo sapiens
ctataatacttgcaac

SEQ ID NO: 1107525 - DNA, 11 bp, Homo sapiens
ctataatcatt

SEQ ID NO: 1107526 - DNA, 19 bp, Homo sapiens
ctataatctgtcaaaacac

SEQ ID NO: 1107527 - DNA, 22 bp, Homo sapiens
ctataatctgtcaaaacactgt

SEQ ID NO: 1107528 - DNA, 14 bp, Homo sapiens
ctataatctgtttt

SEQ ID NO: 1107529 - DNA, 17 bp, Homo sapiens
ctataatcttatacaac

SEQ ID NO: 1107530 - DNA, 16 bp, Homo sapiens
ctataatgtaagctct

SEQ ID NO: 1107531 - DNA, 13 bp, Homo sapiens
ctataatgtgaaa

SEQ ID NO: 1107532 - DNA, 14 bp, Homo sapiens
ctataatgtgaaat

SEQ ID NO: 1107533 - DNA, 17 bp, Homo sapiens
ctataatgtgaaatgta

SEQ ID NO: 1107534 - DNA, 21 bp, Homo sapiens
ctataatgtgaaatgtaactg

SEQ ID NO: 1107535 - DNA, 23 bp, Homo sapiens
ctataattgtaaatattttgata

SEQ ID NO: 1107536 - DNA, 22 bp, Homo sapiens
ctataatttacctaagattaca

SEQ ID NO: 1107537 - DNA, 19 bp, Homo sapiens
ctataatttccatttactt

SEQ ID NO: 1107538 - DNA, 19 bp, Homo sapiens
ctatacactagacaaaact

SEQ ID NO: 1107539 - DNA, 19 bp, Homo sapiens
ctatacagaacagagggcc

SEQ ID NO: 1107540 - DNA, 22 bp, Homo sapiens
ctatacatatctttattaatca

SEQ ID NO: 1107541 - DNA, 14 bp, Homo sapiens
ctatacatctctcc

SEQ ID NO: 1107542 - DNA, 12 bp, Homo sapiens
ctatacatgttg

SEQ ID NO: 1107543 - DNA, 21 bp, Homo sapiens
ctatactgaaagatctctgtc

SEQ ID NO: 1107544 - DNA, 13 bp, Homo sapiens
ctatactggaaat

SEQ ID NO: 1107545 - DNA, 14 bp, Homo sapiens
ctatactttacagg

SEQ ID NO: 1107546 - DNA, 19 bp, Homo sapiens
ctatagaaaaagtaaaaga

SEQ ID NO: 1107547 - DNA, 15 bp, Homo sapiens
ctatagaaatagaac

SEQ ID NO: 1107548 - DNA, 19 bp, Homo sapiens
ctatagaaatagaacactg

SEQ ID NO: 1107549 - DNA, 17 bp, Homo sapiens
ctatagcaaagtagtac

SEQ ID NO: 1107550 - DNA, 16 bp, Homo sapiens
ctatagcactgagctc

SEQ ID NO: 1107551 - DNA, 18 bp, Homo sapiens
ctatagcctggggtgggg

SEQ ID NO: 1107552 - DNA, 15 bp, Homo sapiens
ctatagctaagtaca

SEQ ID NO: 1107553 - DNA, 23 bp, Homo sapiens
ctatagctcaggacctgggacct

SEQ ID NO: 1107554 - DNA, 22 bp, Homo sapiens
ctatagctgttctaatggatta

SEQ ID NO: 1107555 - DNA, 15 bp, Homo sapiens
ctatagtaaatgtgt

SEQ ID NO: 1107556 - DNA, 18 bp, Homo sapiens
ctatagtatttgattcaa

SEQ ID NO: 1107557 - DNA, 22 bp, Homo sapiens
ctatagtatttgattcaaaata

SEQ ID NO: 1107558 - DNA, 13 bp, Homo sapiens
ctatagtcccagc

SEQ ID NO: 1107559 - DNA, 14 bp, Homo sapiens
ctatagtgtccagg

SEQ ID NO: 1107560 - DNA, 15 bp, Homo sapiens
ctatataaaatgtat

SEQ ID NO: 1107561 - DNA, 18 bp, Homo sapiens
ctatataaaatgtattca

SEQ ID NO: 1107562 - DNA, 20 bp, Homo sapiens
ctatataatttatttccact

SEQ ID NO: 1107563 - DNA, 15 bp, Homo sapiens
ctatatagagatgtt

SEQ ID NO: 1107564 - DNA, 23 bp, Homo sapiens
ctatataggaaactaagcattgt

SEQ ID NO: 1107565 - DNA, 14 bp, Homo sapiens
ctatatagttcctt

SEQ ID NO: 1107566 - DNA, 21 bp, Homo sapiens
ctatatagttccttgccttaa

SEQ ID NO: 1107567 - DNA, 22 bp, Homo sapiens
ctatatagttccttgccttaat

SEQ ID NO: 1107568 - DNA, 16 bp, Homo sapiens
ctatatagtttattga

SEQ ID NO: 1107569 - DNA, 22 bp, Homo sapiens
ctatatataaaacggtgctgtg

SEQ ID NO: 1107570 - DNA, 22 bp, Homo sapiens
ctatatataatttgagtgtata

SEQ ID NO: 1107571 - DNA, 17 bp, Homo sapiens
ctatatatccttaatat

SEQ ID NO: 1107572 - DNA, 12 bp, Homo sapiens
ctatatatttct

SEQ ID NO: 1107573 - DNA, 22 bp, Homo sapiens
ctatatccagaaggggagcttt

SEQ ID NO: 1107574 - DNA, 14 bp, Homo sapiens
ctattgcatttata

SEQ ID NO: 1107575 - DNA, 17 bp, Homo sapiens
ctattgcatttatatgt

SEQ ID NO: 1107576 - DNA, 16 bp, Homo sapiens
ctattgctgcttgagg

SEQ ID NO: 1107577 - DNA, 21 bp, Homo sapiens
ctattggaggatcagtttttt

SEQ ID NO: 1107578 - DNA, 15 bp, Homo sapiens
ctattgggttcatta

SEQ ID NO: 1107579 - DNA, 23 bp, Homo sapiens
ctattgggttcattattggaatt

SEQ ID NO: 1107580 - DNA, 22 bp, Homo sapiens
ctattggtgcttgactctcact

SEQ ID NO: 1107581 - DNA, 17 bp, Homo sapiens
ctattgtaaatatgttt

SEQ ID NO: 1107582 - DNA, 19 bp, Homo sapiens
ctattgtaatatagaaaaa

SEQ ID NO: 1107583 - DNA, 15 bp, Homo sapiens
ctattgtaatcattt

SEQ ID NO: 1107584 - DNA, 16 bp, Homo sapiens
ctattgtaatcatttg

SEQ ID NO: 1107585 - DNA, 20 bp, Homo sapiens
ctattgttactctggttctt

SEQ ID NO: 1107586 - DNA, 15 bp, Homo sapiens
ctattgttgtgggct

SEQ ID NO: 1107587 - DNA, 11 bp, Homo sapiens
ctattgtttac

SEQ ID NO: 1107588 - DNA, 12 bp, Homo sapiens
ctattgtttact

SEQ ID NO: 1107589 - DNA, 14 bp, Homo sapiens
ctattgtttattct

SEQ ID NO: 1107590 - DNA, 21 bp, Homo sapiens
ctattgtttctttaagaaagt

SEQ ID NO: 1107591 - DNA, 16 bp, Homo sapiens
ctatttaaaacttgta

SEQ ID NO: 1107592 - DNA, 12 bp, Homo sapiens
ctatttaaaata

SEQ ID NO: 1107593 - DNA, 15 bp, Homo sapiens
ctatttaaaattggc

SEQ ID NO: 1107594 - DNA, 16 bp, Homo sapiens
ctatttaaaattggca

SEQ ID NO: 1107595 - DNA, 14 bp, Homo sapiens
ctatttaatattta

SEQ ID NO: 1107596 - DNA, 22 bp, Homo sapiens
ctatttaattgaaactctctgt

SEQ ID NO: 1107597 - DNA, 23 bp, Homo sapiens
ctatttagcatgacaagccccag

SEQ ID NO: 1107598 - DNA, 22 bp, Homo sapiens
ctatttatctgtgtttttgaaa

SEQ ID NO: 1107599 - DNA, 11 bp, Homo sapiens
ctatttatgaa

SEQ ID NO: 1107600 - DNA, 11 bp, Homo sapiens
ctatttatgca

SEQ ID NO: 1107601 - DNA, 14 bp, Homo sapiens
ctatttattaatat

SEQ ID NO: 1107602 - DNA, 17 bp, Homo sapiens
ctatttattaatattta

SEQ ID NO: 1107603 - DNA, 16 bp, Homo sapiens
ctatttattcctgtta

SEQ ID NO: 1107604 - DNA, 14 bp, Homo sapiens
ctatttattgactt

SEQ ID NO: 1107605 - DNA, 17 bp, Homo sapiens
ctatttattgactttga

SEQ ID NO: 1107606 - DNA, 22 bp, Homo sapiens
ctatttattgactttgacaatt

SEQ ID NO: 1107607 - DNA, 14 bp, Homo sapiens
ctatttatttactg

SEQ ID NO: 1107608 - DNA, 13 bp, Homo sapiens
ctatttattttcc

SEQ ID NO: 1107609 - DNA, 16 bp, Homo sapiens
ctatttattttcctaa

SEQ ID NO: 1107610 - DNA, 16 bp, Homo sapiens
ctatttcaaaatgtcc

SEQ ID NO: 1107611 - DNA, 17 bp, Homo sapiens
ctatttcagcctcctgt

SEQ ID NO: 1107612 - DNA, 15 bp, Homo sapiens
ctatttccactgaac

SEQ ID NO: 1107613 - DNA, 14 bp, Homo sapiens
ctatttccattcca

SEQ ID NO: 1107614 - DNA, 17 bp, Homo sapiens
ctatttccattccagaa

SEQ ID NO: 1107615 - DNA, 15 bp, Homo sapiens
ctatttctatgagaa

SEQ ID NO: 1107616 - DNA, 16 bp, Homo sapiens
ctatttctattcctta

SEQ ID NO: 1107617 - DNA, 16 bp, Homo sapiens
ctatttctcctccatg

SEQ ID NO: 1107618 - DNA, 14 bp, Homo sapiens
ctatttctctatgt

SEQ ID NO: 1107619 - DNA, 13 bp, Homo sapiens
ctatttctctgtg

SEQ ID NO: 1107620 - DNA, 13 bp, Homo sapiens
ctatttctgatga

SEQ ID NO: 1107621 - DNA, 14 bp, Homo sapiens
ctatttctgatgat

SEQ ID NO: 1107622 - DNA, 15 bp, Homo sapiens
ctatttctgatgatg

SEQ ID NO: 1107623 - DNA, 21 bp, Homo sapiens
ctatttctgggtcttttgcta

SEQ ID NO: 1107624 - DNA, 14 bp, Homo sapiens
ctatttgaagaaaa

SEQ ID NO: 1107625 - DNA, 23 bp, Homo sapiens
ctatttgagcatgcacagctgct

SEQ ID NO: 1107626 - DNA, 18 bp, Homo sapiens
ctatttgcttatttaata

SEQ ID NO: 1107627 - DNA, 19 bp, Homo sapiens
ctatttgcttatttaataa

SEQ ID NO: 1107628 - DNA, 14 bp, Homo sapiens
ctatttgtaaatct

SEQ ID NO: 1107629 - DNA, 13 bp, Homo sapiens
ctatttgtacaat

SEQ ID NO: 1107630 - DNA, 21 bp, Homo sapiens
ctatttgtacaattttaaagt

SEQ ID NO: 1107631 - DNA, 21 bp, Homo sapiens
ctatttgtatatctcaacaga

SEQ ID NO: 1107632 - DNA, 22 bp, Homo sapiens
ctattttaaaataaattagttg

SEQ ID NO: 1107633 - DNA, 14 bp, Homo sapiens
ctattttaagccat

SEQ ID NO: 1107634 - DNA, 23 bp, Homo sapiens
ctattttaatgtatatttgctgc

SEQ ID NO: 1107635 - DNA, 12 bp, Homo sapiens
ctattttattcc

SEQ ID NO: 1107636 - DNA, 16 bp, Homo sapiens
ctattttcactagggc

SEQ ID NO: 1107637 - DNA, 17 bp, Homo sapiens
ctattttcactagggct

SEQ ID NO: 1107638 - DNA, 18 bp, Homo sapiens
ctattttcactagggctg

SEQ ID NO: 1107639 - DNA, 13 bp, Homo sapiens
ctattttcataat

SEQ ID NO: 1107640 - DNA, 14 bp, Homo sapiens
ctattttcctctgg

SEQ ID NO: 1107641 - DNA, 16 bp, Homo sapiens
ctattttctgcagaaa

SEQ ID NO: 1107642 - DNA, 17 bp, Homo sapiens
ctattttgggtattaat

SEQ ID NO: 1107643 - DNA, 15 bp, Homo sapiens
ctattttgtatattt

SEQ ID NO: 1107644 - DNA, 11 bp, Homo sapiens
ctattttgtga

SEQ ID NO: 1107645 - DNA, 14 bp, Homo sapiens
ctatttttatctga

SEQ ID NO: 1107646 - DNA, 18 bp, Homo sapiens
ctatttttatttatattt

SEQ ID NO: 1107647 - DNA, 14 bp, Homo sapiens
ctatttttcaaatt

SEQ ID NO: 1107648 - DNA, 13 bp, Homo sapiens
ctatttttcaatc

SEQ ID NO: 1107649 - DNA, 13 bp, Homo sapiens
ctatttttgagga

SEQ ID NO: 1107650 - DNA, 22 bp, Homo sapiens
ctatttttggcagtctgaattt

SEQ ID NO: 1107651 - DNA, 15 bp, Homo sapiens
ctatttttgtccttg

SEQ ID NO: 1107652 - DNA, 17 bp, Homo sapiens
ctatttttgtccttgca

SEQ ID NO: 1107653 - DNA, 20 bp, Homo sapiens
ctatttttgtgtttgaaagt

SEQ ID NO: 1107654 - DNA, 18 bp, Homo sapiens
ctattttttaaagactgt

SEQ ID NO: 1107655 - DNA, 20 bp, Homo sapiens
ctattttttacttgttttcg

SEQ ID NO: 1107656 - DNA, 21 bp, Homo sapiens
ctattttttacttgttttcgg

SEQ ID NO: 1107657 - DNA, 13 bp, Homo sapiens
ctattttttgtat

SEQ ID NO: 1107658 - DNA, 18 bp, Homo sapiens
ctatttttttaactgaaa

SEQ ID NO: 1107659 - DNA, 23 bp, Homo sapiens
ctatttttttaactgaaaatgta

SEQ ID NO: 1107660 - DNA, 17 bp, Homo sapiens
ctatttttttagattga

SEQ ID NO: 1107661 - DNA, 22 bp, Homo sapiens
ctatttttttagattgagaaat

SEQ ID NO: 1107662 - DNA, 14 bp, Homo sapiens
ctcaaaaagaaatc

SEQ ID NO: 1107663 - DNA, 13 bp, Homo sapiens
ctcaaaacaaagg

SEQ ID NO: 1107664 - DNA, 21 bp, Homo sapiens
ctcaaaacacttccagtctgg

SEQ ID NO: 1107665 - DNA, 14 bp, Homo sapiens
ctcaaaacctggag

SEQ ID NO: 1107666 - DNA, 16 bp, Homo sapiens
ctcaaaacttaacata

SEQ ID NO: 1107667 - DNA, 20 bp, Homo sapiens
ctcaaaagcacccttgacgt

SEQ ID NO: 1107668 - DNA, 13 bp, Homo sapiens
ctcaaaaggaaac

SEQ ID NO: 1107669 - DNA, 13 bp, Homo sapiens
ctcaaaattagat

SEQ ID NO: 1107670 - DNA, 15 bp, Homo sapiens
ctcaaacacagttac

SEQ ID NO: 1107671 - DNA, 21 bp, Homo sapiens
ctcaaacacagttacacttgt

SEQ ID NO: 1107672 - DNA, 14 bp, Homo sapiens
ctcaaaccctgtgg

SEQ ID NO: 1107673 - DNA, 17 bp, Homo sapiens
ctcaaactccattctcc

SEQ ID NO: 1107674 - DNA, 13 bp, Homo sapiens
ctcaaactcctga

SEQ ID NO: 1107675 - DNA, 12 bp, Homo sapiens
ctcaaactgcac

SEQ ID NO: 1107676 - DNA, 17 bp, Homo sapiens
ctcaaactgcacatcta

SEQ ID NO: 1107677 - DNA, 17 bp, Homo sapiens
ctcaaactgccttggct

SEQ ID NO: 1107678 - DNA, 15 bp, Homo sapiens
ctcaaacttgtggcc

SEQ ID NO: 1107679 - DNA, 20 bp, Homo sapiens
ctcaaacttttcccctgtcc

SEQ ID NO: 1107680 - DNA, 12 bp, Homo sapiens
ctcaaagatgca

SEQ ID NO: 1107681 - DNA, 20 bp, Homo sapiens
ctcaaagatgcgtttgcctc

SEQ ID NO: 1107682 - DNA, 22 bp, Homo sapiens
ctcaaagcaacccgctggagcc

SEQ ID NO: 1107683 - DNA, 22 bp, Homo sapiens
ctcaaagcctcttatttttcta

SEQ ID NO: 1107684 - DNA, 15 bp, Homo sapiens
ctcaaaggagctttc

SEQ ID NO: 1107685 - DNA, 23 bp, Homo sapiens
ctcaaagggcagttttgaggcat

SEQ ID NO: 1107686 - DNA, 17 bp, Homo sapiens
ctcaaaggtttggaagg

SEQ ID NO: 1107687 - DNA, 22 bp, Homo sapiens
ctcaaaggtttggaaggagcag

SEQ ID NO: 1107688 - DNA, 19 bp, Homo sapiens
ctcaaagtatgcaatgctt

SEQ ID NO: 1107689 - DNA, 15 bp, Homo sapiens
ctcaaagttaattca

SEQ ID NO: 1107690 - DNA, 23 bp, Homo sapiens
ctcaaagttaattcacctatgtt

SEQ ID NO: 1107691 - DNA, 14 bp, Homo sapiens
ctcaaatccctctc

SEQ ID NO: 1107692 - DNA, 19 bp, Homo sapiens
ctcaaatcgtccagcgacc

SEQ ID NO: 1107693 - DNA, 16 bp, Homo sapiens
ctcaaatctattcaga

SEQ ID NO: 1107694 - DNA, 20 bp, Homo sapiens
ctcaaatgagtaacatttgc

SEQ ID NO: 1107695 - DNA, 19 bp, Homo sapiens
ctcaaatgctcagaccagc

SEQ ID NO: 1107696 - DNA, 17 bp, Homo sapiens
ctcaaatggtgtcatgg

SEQ ID NO: 1107697 - DNA, 13 bp, Homo sapiens
ctcagagctttgt

SEQ ID NO: 1107698 - DNA, 19 bp, Homo sapiens
ctcagagctttgtcacttg

SEQ ID NO: 1107699 - DNA, 21 bp, Homo sapiens
ctcagagctttgtcacttgcc

SEQ ID NO: 1107700 - DNA, 19 bp, Homo sapiens
ctcagaggcccccagtggg

SEQ ID NO: 1107701 - DNA, 18 bp, Homo sapiens
ctcagaggcgcactgtga

SEQ ID NO: 1107702 - DNA, 19 bp, Homo sapiens
ctcagaggcgcactgtgac

SEQ ID NO: 1107703 - DNA, 16 bp, Homo sapiens
ctcagaggctgagccc

SEQ ID NO: 1107704 - DNA, 17 bp, Homo sapiens
ctcagaggctgagccct

SEQ ID NO: 1107705 - DNA, 18 bp, Homo sapiens
ctcagaggctgagccctg

SEQ ID NO: 1107706 - DNA, 16 bp, Homo sapiens
ctcagagtcccaggac

SEQ ID NO: 1107707 - DNA, 20 bp, Homo sapiens
ctcagagtgaccctcagctg

SEQ ID NO: 1107708 - DNA, 21 bp, Homo sapiens
ctcagagtgaccctcagctgt

SEQ ID NO: 1107709 - DNA, 16 bp, Homo sapiens
ctcagagtggtggggg

SEQ ID NO: 1107710 - DNA, 19 bp, Homo sapiens
ctcagatacccagtggaat

SEQ ID NO: 1107711 - DNA, 16 bp, Homo sapiens
ctcagatagaatgaca

SEQ ID NO: 1107712 - DNA, 21 bp, Homo sapiens
ctcagatcagtgtaccatttg

SEQ ID NO: 1107713 - DNA, 22 bp, Homo sapiens
ctcagatccccagctttctcct

SEQ ID NO: 1107714 - DNA, 17 bp, Homo sapiens
ctcagatctgatcaaga

SEQ ID NO: 1107715 - DNA, 13 bp, Homo sapiens
ctcagatgacatt

SEQ ID NO: 1107716 - DNA, 17 bp, Homo sapiens
ctcagatgatctctcca

SEQ ID NO: 1107717 - DNA, 18 bp, Homo sapiens
ctcagatgcgttcgcctc

SEQ ID NO: 1107718 - DNA, 13 bp, Homo sapiens
ctcagatggggca

SEQ ID NO: 1107719 - DNA, 22 bp, Homo sapiens
ctcagatggtgtgtccagcact

SEQ ID NO: 1107720 - DNA, 23 bp, Homo sapiens
ctcagatgttaaaataaatggtt

SEQ ID NO: 1107721 - DNA, 18 bp, Homo sapiens
ctcagattctgtctaaag

SEQ ID NO: 1107722 - DNA, 18 bp, Homo sapiens
ctcagattgactaaataa

SEQ ID NO: 1107723 - DNA, 19 bp, Homo sapiens
ctcagattgactaaataaa

SEQ ID NO: 1107724 - DNA, 15 bp, Homo sapiens
ctcagattgtaatat

SEQ ID NO: 1107725 - DNA, 21 bp, Homo sapiens
ctcagatttccattgtgtggc

SEQ ID NO: 1107726 - DNA, 23 bp, Homo sapiens
ctcagatttccattgtgtggcct

SEQ ID NO: 1107727 - DNA, 13 bp, Homo sapiens
ctcagattttata

SEQ ID NO: 1107728 - DNA, 13 bp, Homo sapiens
ctcagcaagccct

SEQ ID NO: 1107729 - DNA, 17 bp, Homo sapiens
ctcagcaattcagaccc

SEQ ID NO: 1107730 - DNA, 20 bp, Homo sapiens
ctcagcaccacattgcctca

SEQ ID NO: 1107731 - DNA, 21 bp, Homo sapiens
ctcagcaccacattgcctcat

SEQ ID NO: 1107732 - DNA, 16 bp, Homo sapiens
ctcagcaccccttcca

SEQ ID NO: 1107733 - DNA, 13 bp, Homo sapiens
ctcagcagaggca

SEQ ID NO: 1107734 - DNA, 21 bp, Homo sapiens
ctcagcagaggcagtggccac

SEQ ID NO: 1107735 - DNA, 12 bp, Homo sapiens
ctcagcagccct

SEQ ID NO: 1107736 - DNA, 13 bp, Homo sapiens
ctcagcagccctc

SEQ ID NO: 1107737 - DNA, 14 bp, Homo sapiens
ctcagcagccctcc

SEQ ID NO: 1107738 - DNA, 17 bp, Homo sapiens
ctcagcagccctcctca

SEQ ID NO: 1107739 - DNA, 19 bp, Homo sapiens
ctcagcagccctcctcacc

SEQ ID NO: 1107740 - DNA, 18 bp, Homo sapiens
ctcagcatagcctgcctg

SEQ ID NO: 1107741 - DNA, 19 bp, Homo sapiens
ctcagcatagcctgcctga

SEQ ID NO: 1107742 - DNA, 14 bp, Homo sapiens
ctcagcatatttgt

SEQ ID NO: 1107743 - DNA, 18 bp, Homo sapiens
ctcagcatatttgtatag

SEQ ID NO: 1107744 - DNA, 13 bp, Homo sapiens
ctcagcatgcatc

SEQ ID NO: 1107745 - DNA, 14 bp, Homo sapiens
ctcagcatttgatt

SEQ ID NO: 1107746 - DNA, 13 bp, Homo sapiens
ctcagccagcact

SEQ ID NO: 1107747 - DNA, 13 bp, Homo sapiens
ctcagccaggccc

SEQ ID NO: 1107748 - DNA, 16 bp, Homo sapiens
ctcagccagtggcaca

SEQ ID NO: 1107749 - DNA, 16 bp, Homo sapiens
ctcagccatccgcaga

SEQ ID NO: 1107750 - DNA, 16 bp, Homo sapiens
ctcagcccacccccct

SEQ ID NO: 1107751 - DNA, 15 bp, Homo sapiens
ctcagccccatcgcc

SEQ ID NO: 1107752 - DNA, 11 bp, Homo sapiens
ctcagcccctc

SEQ ID NO: 1107753 - DNA, 17 bp, Homo sapiens
ctcagccctcagaacaa

SEQ ID NO: 1107754 - DNA, 14 bp, Homo sapiens
ctcagccctcagtt

SEQ ID NO: 1107755 - DNA, 21 bp, Homo sapiens
ctcagccctccctgcccctcc

SEQ ID NO: 1107756 - DNA, 14 bp, Homo sapiens
ctcagccctgaccc

SEQ ID NO: 1107757 - DNA, 15 bp, Homo sapiens
ctcagccctggcctg

SEQ ID NO: 1107758 - DNA, 20 bp, Homo sapiens
ctcagccctggcctggctgg

SEQ ID NO: 1107759 - DNA, 12 bp, Homo sapiens
ctcagccctggg

SEQ ID NO: 1107760 - DNA, 19 bp, Homo sapiens
ctcagccctgggccccacc

SEQ ID NO: 1107761 - DNA, 18 bp, Homo sapiens
ctcagcccttgcccccat

SEQ ID NO: 1107762 - DNA, 18 bp, Homo sapiens
ctcagccgtcagccatca

SEQ ID NO: 1107763 - DNA, 10 bp, Homo sapiens
ctcagcctcc

SEQ ID NO: 1107764 - DNA, 20 bp, Homo sapiens
ctcagcctccaaagtggagc

SEQ ID NO: 1107765 - DNA, 23 bp, Homo sapiens
ctcagcctccaaagtggagctgg

SEQ ID NO: 1107766 - DNA, 21 bp, Homo sapiens
ctcagcctcccaaagtgctgg

SEQ ID NO: 1107767 - DNA, 20 bp, Homo sapiens
ctcagcctcccaagtagctg

SEQ ID NO: 1107768 - DNA, 21 bp, Homo sapiens
ctcagcctcccaagtagctgg

SEQ ID NO: 1107769 - DNA, 17 bp, Homo sapiens
ctcagcctccccttctt

SEQ ID NO: 1107770 - DNA, 21 bp, Homo sapiens
ctcagcctccccttcttcccg

SEQ ID NO: 1107771 - DNA, 22 bp, Homo sapiens
ctcagcctccccttcttcccgc

SEQ ID NO: 1107772 - DNA, 19 bp, Homo sapiens
ctcagcctcctgagcctgt

SEQ ID NO: 1107773 - DNA, 20 bp, Homo sapiens
ctcagcctcctgagcctgtg

SEQ ID NO: 1107774 - DNA, 15 bp, Homo sapiens
ctcagcctctgccag

SEQ ID NO: 1107775 - DNA, 17 bp, Homo sapiens
ctcagcctcttctctgc

SEQ ID NO: 1107776 - DNA, 18 bp, Homo sapiens
ctcagcctcttctctgca

SEQ ID NO: 1107777 - DNA, 10 bp, Homo sapiens
ctcagcctgc

SEQ ID NO: 1107778 - DNA, 13 bp, Homo sapiens
ctcagcctgccca

SEQ ID NO: 1107779 - DNA, 17 bp, Homo sapiens
ctcagcctgcccacctc

SEQ ID NO: 1107780 - DNA, 22 bp, Homo sapiens
ctcagcctgcccacctctccct

SEQ ID NO: 1107781 - DNA, 15 bp, Homo sapiens
ctcagcctgctgccc

SEQ ID NO: 1107782 - DNA, 16 bp, Homo sapiens
ctcagcctgctgccca

SEQ ID NO: 1107783 - DNA, 12 bp, Homo sapiens
ctcagcctgggg

SEQ ID NO: 1107784 - DNA, 13 bp, Homo sapiens
ctcagcctggggc

SEQ ID NO: 1107785 - DNA, 22 bp, Homo sapiens
ctcagcctggggctctctgacc

SEQ ID NO: 1107786 - DNA, 23 bp, Homo sapiens
ctcagcctggggctctctgaccc

SEQ ID NO: 1107787 - DNA, 12 bp, Homo sapiens
ctcagcctgtct

SEQ ID NO: 1107788 - DNA, 16 bp, Homo sapiens
ctcagcctgtgctgcc

SEQ ID NO: 1107789 - DNA, 15 bp, Homo sapiens
ctcagccttcagaca

SEQ ID NO: 1107790 - DNA, 17 bp, Homo sapiens
ctcagcgagaggcagca

SEQ ID NO: 1107791 - DNA, 14 bp, Homo sapiens
ctcagcgcaggctg

SEQ ID NO: 1107792 - DNA, 15 bp, Homo sapiens
ctcagcgcaggctgc

SEQ ID NO: 1107793 - DNA, 16 bp, Homo sapiens
ctcagcgcaggctgca

SEQ ID NO: 1107794 - DNA, 18 bp, Homo sapiens
ctcagcgcaggctgcaga

SEQ ID NO: 1107795 - DNA, 21 bp, Homo sapiens
ctcagcgcaggctgcagagcc

SEQ ID NO: 1107796 - DNA, 19 bp, Homo sapiens
ctcagctacccactatcct

SEQ ID NO: 1107797 - DNA, 13 bp, Homo sapiens
ctcagctccagaa

SEQ ID NO: 1107798 - DNA, 19 bp, Homo sapiens
ctcagctcccaaggctctg

SEQ ID NO: 1107799 - DNA, 21 bp, Homo sapiens
ctcagctctctgggacctcct

SEQ ID NO: 1107800 - DNA, 20 bp, Homo sapiens
ctcagctcttggctccactg

SEQ ID NO: 1107801 - DNA, 13 bp, Homo sapiens
ctcagctgcacat

SEQ ID NO: 1107802 - DNA, 18 bp, Homo sapiens
ctcagctgcacattcctg

SEQ ID NO: 1107803 - DNA, 21 bp, Homo sapiens
ctcagctgcatggagcctgga

SEQ ID NO: 1107804 - DNA, 12 bp, Homo sapiens
ctcagctgcctc

SEQ ID NO: 1107805 - DNA, 14 bp, Homo sapiens
ctcagctgcctcac

SEQ ID NO: 1107806 - DNA, 14 bp, Homo sapiens
ctcagctgctccca

SEQ ID NO: 1107807 - DNA, 23 bp, Homo sapiens
ctcagctggctgagacactgaag

SEQ ID NO: 1107808 - DNA, 18 bp, Homo sapiens
ctcagctgtcaaggctca

SEQ ID NO: 1107809 - DNA, 16 bp, Homo sapiens
ctcagctgtcacctgc

SEQ ID NO: 1107810 - DNA, 22 bp, Homo sapiens
ctcagctgtcacctgctcacag

SEQ ID NO: 1107811 - DNA, 19 bp, Homo sapiens
ctcagctgtcctgcagcaa

SEQ ID NO: 1107812 - DNA, 17 bp, Homo sapiens
ctcagcttaattctcct

SEQ ID NO: 1107813 - DNA, 19 bp, Homo sapiens
ctcagcttaattctccttc

SEQ ID NO: 1107814 - DNA, 16 bp, Homo sapiens
ctcagcttctcctgtg

SEQ ID NO: 1107815 - DNA, 21 bp, Homo sapiens
ctcaggaactatggcaaggaa

SEQ ID NO: 1107816 - DNA, 19 bp, Homo sapiens
ctcaggaagtccagccact

SEQ ID NO: 1107817 - DNA, 16 bp, Homo sapiens
ctcaggacagcatccc

SEQ ID NO: 1107818 - DNA, 19 bp, Homo sapiens
ctcaggacagcatcccttc

SEQ ID NO: 1107819 - DNA, 17 bp, Homo sapiens
ctcatttaatcccagga

SEQ ID NO: 1107820 - DNA, 15 bp, Homo sapiens
ctcatttcacagcct

SEQ ID NO: 1107821 - DNA, 18 bp, Homo sapiens
ctcatttcttcctctgca

SEQ ID NO: 1107822 - DNA, 19 bp, Homo sapiens
ctcatttgagataaagtca

SEQ ID NO: 1107823 - DNA, 22 bp, Homo sapiens
ctcatttggtctgccagaatac

SEQ ID NO: 1107824 - DNA, 15 bp, Homo sapiens
ctcatttgttctcac

SEQ ID NO: 1107825 - DNA, 20 bp, Homo sapiens
ctcattttctacgtcatgta

SEQ ID NO: 1107826 - DNA, 22 bp, Homo sapiens
ctcatttttataacctggcaaa

SEQ ID NO: 1107827 - DNA, 22 bp, Homo sapiens
ctcatttttccgtaaaaatgat

SEQ ID NO: 1107828 - DNA, 15 bp, Homo sapiens
ctcatttttccttta

SEQ ID NO: 1107829 - DNA, 15 bp, Homo sapiens
ctccaaaagcactta

SEQ ID NO: 1107830 - DNA, 18 bp, Homo sapiens
ctccaaacaccggcagaa

SEQ ID NO: 1107831 - DNA, 13 bp, Homo sapiens
ctccaaacctcca

SEQ ID NO: 1107832 - DNA, 18 bp, Homo sapiens
ctccaaactgaagcagcc

SEQ ID NO: 1107833 - DNA, 22 bp, Homo sapiens
ctccaaactgaagcagcctctc

SEQ ID NO: 1107834 - DNA, 15 bp, Homo sapiens
ctccaaaggaagggg

SEQ ID NO: 1107835 - DNA, 23 bp, Homo sapiens
ctccaaatctcaatgaagccagc

SEQ ID NO: 1107836 - DNA, 16 bp, Homo sapiens
ctccaacaccaagcac

SEQ ID NO: 1107837 - DNA, 23 bp, Homo sapiens
ctccaaccaagaggatttcttca

SEQ ID NO: 1107838 - DNA, 18 bp, Homo sapiens
ctccaaccactgtgccac

SEQ ID NO: 1107839 - DNA, 22 bp, Homo sapiens
ctccaaccctgccgtcaccacc

SEQ ID NO: 1107840 - DNA, 14 bp, Homo sapiens
ctccaacctctcgg

SEQ ID NO: 1107841 - DNA, 18 bp, Homo sapiens
ctccaacgcccctgtggc

SEQ ID NO: 1107842 - DNA, 20 bp, Homo sapiens
ctccaacgcccctgtggcca

SEQ ID NO: 1107843 - DNA, 21 bp, Homo sapiens
ctccaagaatggaagcctgaa

SEQ ID NO: 1107844 - DNA, 19 bp, Homo sapiens
ctccaagaccaccagggtc

SEQ ID NO: 1107845 - DNA, 15 bp, Homo sapiens
ctccaagacctggtg

SEQ ID NO: 1107846 - DNA, 16 bp, Homo sapiens
ctccaagaggctgagg

SEQ ID NO: 1107847 - DNA, 16 bp, Homo sapiens
ctccaagatgttctcc

SEQ ID NO: 1107848 - DNA, 20 bp, Homo sapiens
ctccaagatgttctcctgat

SEQ ID NO: 1107849 - DNA, 14 bp, Homo sapiens
ctccaagcagactc

SEQ ID NO: 1107850 - DNA, 24 bp, Homo sapiens
ctccaagcagactccagcccctgg

SEQ ID NO: 1107851 - DNA, 19 bp, Homo sapiens
ctccaagccccctggcagc

SEQ ID NO: 1107852 - DNA, 21 bp, Homo sapiens
ctccaagccccctggcagctg

SEQ ID NO: 1107853 - DNA, 12 bp, Homo sapiens
ctccaagccctt

SEQ ID NO: 1107854 - DNA, 15 bp, Homo sapiens
ctccaagcctgcctc

SEQ ID NO: 1107855 - DNA, 13 bp, Homo sapiens
ctccaagcctggc

SEQ ID NO: 1107856 - DNA, 18 bp, Homo sapiens
ctccaagcctggcaccca

SEQ ID NO: 1107857 - DNA, 19 bp, Homo sapiens
ctccaagcctggcacccac

SEQ ID NO: 1107858 - DNA, 14 bp, Homo sapiens
ctccaagctccatc

SEQ ID NO: 1107859 - DNA, 21 bp, Homo sapiens
ctccaaggaggggctgtaaaa

SEQ ID NO: 1107860 - DNA, 15 bp, Homo sapiens
ctccaagggacaggt

SEQ ID NO: 1107861 - DNA, 21 bp, Homo sapiens
ctccaagggacaggtgggcct

SEQ ID NO: 1107862 - DNA, 23 bp, Homo sapiens
ctccaagggagggtgcagccctc

SEQ ID NO: 1107863 - DNA, 23 bp, Homo sapiens
ctccaagggtttcgactggtcca

SEQ ID NO: 1107864 - DNA, 16 bp, Homo sapiens
ctccaaggtttataaa

SEQ ID NO: 1107865 - DNA, 15 bp, Homo sapiens
ctccaagtctctctg

SEQ ID NO: 1107866 - DNA, 16 bp, Homo sapiens
ctccaagtctctctgt

SEQ ID NO: 1107867 - DNA, 17 bp, Homo sapiens
ctccaagtctctctgtg

SEQ ID NO: 1107868 - DNA, 21 bp, Homo sapiens
ctccaagtctctctgtgaata

SEQ ID NO: 1107869 - DNA, 14 bp, Homo sapiens
ctccaagtgccaga

SEQ ID NO: 1107870 - DNA, 15 bp, Homo sapiens
ctccaagtgccagag

SEQ ID NO: 1107871 - DNA, 18 bp, Homo sapiens
ctccaagtgccagaggtg

SEQ ID NO: 1107872 - DNA, 22 bp, Homo sapiens
ctccaagtgccagaggtgggca

SEQ ID NO: 1107873 - DNA, 16 bp, Homo sapiens
ctccaataaagtgcct

SEQ ID NO: 1107874 - DNA, 22 bp, Homo sapiens
ctccaataaagtgccttctggg

SEQ ID NO: 1107875 - DNA, 17 bp, Homo sapiens
ctccaatatcagtgctc

SEQ ID NO: 1107876 - DNA, 19 bp, Homo sapiens
ctccaatgtctgctgagga

SEQ ID NO: 1107877 - DNA, 19 bp, Homo sapiens
ctccaattctgaaatactt

SEQ ID NO: 1107878 - DNA, 23 bp, Homo sapiens
ctccaattctgaaatacttttga

SEQ ID NO: 1107879 - DNA, 14 bp, Homo sapiens
ctccaattggtgct

SEQ ID NO: 1107880 - DNA, 17 bp, Homo sapiens
ctccaattggtgcttca

SEQ ID NO: 1107881 - DNA, 16 bp, Homo sapiens
ctccacaaagcaaagg

SEQ ID NO: 1107882 - DNA, 20 bp, Homo sapiens
ctccacaacagcctggggtt

SEQ ID NO: 1107883 - DNA, 13 bp, Homo sapiens
ctccacacattcc

SEQ ID NO: 1107884 - DNA, 15 bp, Homo sapiens
ctccacacattccag

SEQ ID NO: 1107885 - DNA, 17 bp, Homo sapiens
ctccacacattccagcc

SEQ ID NO: 1107886 - DNA, 20 bp, Homo sapiens
ctccacacattccagccagg

SEQ ID NO: 1107887 - DNA, 21 bp, Homo sapiens
ctccacacattccagccaggc

SEQ ID NO: 1107888 - DNA, 16 bp, Homo sapiens
ctccacagagaggagg

SEQ ID NO: 1107889 - DNA, 20 bp, Homo sapiens
ctccacagagaggaggggac

SEQ ID NO: 1107890 - DNA, 15 bp, Homo sapiens
ctccacagccgcagc

SEQ ID NO: 1107891 - DNA, 20 bp, Homo sapiens
ctccacagcgagggcagctg

SEQ ID NO: 1107892 - DNA, 15 bp, Homo sapiens
ctccacagctacctc

SEQ ID NO: 1107893 - DNA, 12 bp, Homo sapiens
ctccacagctgc

SEQ ID NO: 1107894 - DNA, 13 bp, Homo sapiens
ctccacagctgca

SEQ ID NO: 1107895 - DNA, 19 bp, Homo sapiens
ctccacagggcttgttttc

SEQ ID NO: 1107896 - DNA, 15 bp, Homo sapiens
ctccacagtccccca

SEQ ID NO: 1107897 - DNA, 22 bp, Homo sapiens
ctccacagtcccccacccacct

SEQ ID NO: 1107898 - DNA, 21 bp, Homo sapiens
ctccacagtgttgtgcccctt

SEQ ID NO: 1107899 - DNA, 20 bp, Homo sapiens
ctccacatatttcagtgagg

SEQ ID NO: 1107900 - DNA, 14 bp, Homo sapiens
ctccacatcccagc

SEQ ID NO: 1107901 - DNA, 18 bp, Homo sapiens
ctccacatcccagcagcc

SEQ ID NO: 1107902 - DNA, 19 bp, Homo sapiens
ctccacatcccagcagccc

SEQ ID NO: 1107903 - DNA, 15 bp, Homo sapiens
ctccacatcctccac

SEQ ID NO: 1107904 - DNA, 14 bp, Homo sapiens
ctccacatctgcct

SEQ ID NO: 1107905 - DNA, 15 bp, Homo sapiens
ctccacatctgcctt

SEQ ID NO: 1107906 - DNA, 15 bp, Homo sapiens
ctccacatgctgcct

SEQ ID NO: 1107907 - DNA, 18 bp, Homo sapiens
ctccacatgctgcctggc

SEQ ID NO: 1107908 - DNA, 20 bp, Homo sapiens
ctccacattaagtggctttt

SEQ ID NO: 1107909 - DNA, 21 bp, Homo sapiens
ctccaccacatctgccagacc

SEQ ID NO: 1107910 - DNA, 21 bp, Homo sapiens
ctccaccaccactggccacca

SEQ ID NO: 1107911 - DNA, 16 bp, Homo sapiens
ctccaccagcagcatg

SEQ ID NO: 1107912 - DNA, 17 bp, Homo sapiens
ctccaccagcctgctga

SEQ ID NO: 1107913 - DNA, 15 bp, Homo sapiens
ctccaccatcactca

SEQ ID NO: 1107914 - DNA, 16 bp, Homo sapiens
ctccaccatcactcac

SEQ ID NO: 1107915 - DNA, 20 bp, Homo sapiens
ctccaccatcccccaggtga

SEQ ID NO: 1107916 - DNA, 23 bp, Homo sapiens
ctccacccaaaccccttcccacg

SEQ ID NO: 1107917 - DNA, 16 bp, Homo sapiens
ctccacccactgtccg

SEQ ID NO: 1107918 - DNA, 11 bp, Homo sapiens
ctccacccagc

SEQ ID NO: 1107919 - DNA, 17 bp, Homo sapiens
ctccaccccacagaacc

SEQ ID NO: 1107920 - DNA, 13 bp, Homo sapiens
ctccaccccagga

SEQ ID NO: 1107921 - DNA, 14 bp, Homo sapiens
ctccaccccaggac

SEQ ID NO: 1107922 - DNA, 18 bp, Homo sapiens
ctccaccccccactcagt

SEQ ID NO: 1107923 - DNA, 21 bp, Homo sapiens
ctccaccccccactcagtgcc

SEQ ID NO: 1107924 - DNA, 23 bp, Homo sapiens
ctccacccccgccacggccaccc

SEQ ID NO: 1107925 - DNA, 23 bp, Homo sapiens
ctccacccgtcctccctcagcct

SEQ ID NO: 1107926 - DNA, 17 bp, Homo sapiens
ctccaccctcctctagc

SEQ ID NO: 1107927 - DNA, 19 bp, Homo sapiens
ctccaccctgcattttcct

SEQ ID NO: 1107928 - DNA, 14 bp, Homo sapiens
ctccaccctgtccc

SEQ ID NO: 1107929 - DNA, 16 bp, Homo sapiens
ctccaccctgttagtt

SEQ ID NO: 1107930 - DNA, 22 bp, Homo sapiens
ctccaccctgttagttttgtaa

SEQ ID NO: 1107931 - DNA, 13 bp, Homo sapiens
ctccacccttggc

SEQ ID NO: 1107932 - DNA, 17 bp, Homo sapiens
ctccacccttggcctgt

SEQ ID NO: 1107933 - DNA, 19 bp, Homo sapiens
ctccaccgaccaactgccc

SEQ ID NO: 1107934 - DNA, 15 bp, Homo sapiens
ctccaccgctgccta

SEQ ID NO: 1107935 - DNA, 18 bp, Homo sapiens
ctccacctacacccctgt

SEQ ID NO: 1107936 - DNA, 16 bp, Homo sapiens
ctccacctcagccttg

SEQ ID NO: 1107937 - DNA, 17 bp, Homo sapiens
ctccacctcagccttgg

SEQ ID NO: 1107938 - DNA, 22 bp, Homo sapiens
ctccacctctcacgggccctgc

SEQ ID NO: 1107939 - DNA, 20 bp, Homo sapiens
ctccacctctggtggctcct

SEQ ID NO: 1107940 - DNA, 20 bp, Homo sapiens
ctccatgggccaccgcccag

SEQ ID NO: 1107941 - DNA, 22 bp, Homo sapiens
ctccatgggccaccgcccagct

SEQ ID NO: 1107942 - DNA, 23 bp, Homo sapiens
ctccatgggccaccgcccagctc

SEQ ID NO: 1107943 - DNA, 23 bp, Homo sapiens
ctccatggggttcgagactccat

SEQ ID NO: 1107944 - DNA, 13 bp, Homo sapiens
ctccatggtcctg

SEQ ID NO: 1107945 - DNA, 14 bp, Homo sapiens
ctccatggtcctgt

SEQ ID NO: 1107946 - DNA, 16 bp, Homo sapiens
ctccatggtcctgtct

SEQ ID NO: 1107947 - DNA, 21 bp, Homo sapiens
ctccatgtagaataaatgaag

SEQ ID NO: 1107948 - DNA, 14 bp, Homo sapiens
ctccatgtgcatat

SEQ ID NO: 1107949 - DNA, 20 bp, Homo sapiens
ctccattaaagtctgaatca

SEQ ID NO: 1107950 - DNA, 24 bp, Homo sapiens
ctccattcccgtggaacgtttttc

SEQ ID NO: 1107951 - DNA, 21 bp, Homo sapiens
ctccattgggcacagtccaga

SEQ ID NO: 1107952 - DNA, 13 bp, Homo sapiens
ctccattgtgtga

SEQ ID NO: 1107953 - DNA, 19 bp, Homo sapiens
ctccattgtgtgatccagc

SEQ ID NO: 1107954 - DNA, 21 bp, Homo sapiens
ctccattgtgtgatccagccc

SEQ ID NO: 1107955 - DNA, 23 bp, Homo sapiens
ctccattgtgtgatccagccctg

SEQ ID NO: 1107956 - DNA, 22 bp, Homo sapiens
ctccatttataaccccagcctg

SEQ ID NO: 1107957 - DNA, 14 bp, Homo sapiens
ctccattttttctt

SEQ ID NO: 1107958 - DNA, 23 bp, Homo sapiens
ctcccaaagctcagacttgccag

SEQ ID NO: 1107959 - DNA, 16 bp, Homo sapiens
ctcccaaagtgctggg

SEQ ID NO: 1107960 - DNA, 18 bp, Homo sapiens
ctcccaaagtgctgggat

SEQ ID NO: 1107961 - DNA, 15 bp, Homo sapiens
ctcccaaatgagcca

SEQ ID NO: 1107962 - DNA, 15 bp, Homo sapiens
ctcccaaccaaccag

SEQ ID NO: 1107963 - DNA, 18 bp, Homo sapiens
ctcccaacccccctcctg

SEQ ID NO: 1107964 - DNA, 22 bp, Homo sapiens
ctcccaacccccctcctgctcc

SEQ ID NO: 1107965 - DNA, 17 bp, Homo sapiens
ctcccaacgagcctcct

SEQ ID NO: 1107966 - DNA, 22 bp, Homo sapiens
ctcccaagacttcattgtccct

SEQ ID NO: 1107967 - DNA, 20 bp, Homo sapiens
ctcccaagcgttcctggcct

SEQ ID NO: 1107968 - DNA, 22 bp, Homo sapiens
ctcccaagcgttcctggccttc

SEQ ID NO: 1107969 - DNA, 17 bp, Homo sapiens
ctcccaaggtcctctca

SEQ ID NO: 1107970 - DNA, 19 bp, Homo sapiens
ctcccaaggtcctctcagt

SEQ ID NO: 1107971 - DNA, 13 bp, Homo sapiens
ctcccaaggttcc

SEQ ID NO: 1107972 - DNA, 17 bp, Homo sapiens
ctcccaagtagctggga

SEQ ID NO: 1107973 - DNA, 23 bp, Homo sapiens
ctcccaagtagctgggaccacag

SEQ ID NO: 1107974 - DNA, 19 bp, Homo sapiens
ctcccaagtagctgggatt

SEQ ID NO: 1107975 - DNA, 19 bp, Homo sapiens
ctcccaagtttccatagca

SEQ ID NO: 1107976 - DNA, 13 bp, Homo sapiens
ctcccaatcagct

SEQ ID NO: 1107977 - DNA, 17 bp, Homo sapiens
ctcccaatcagcttttg

SEQ ID NO: 1107978 - DNA, 23 bp, Homo sapiens
ctcccaatcagcttttgttctag

SEQ ID NO: 1107979 - DNA, 15 bp, Homo sapiens
ctcccacaaaggaga

SEQ ID NO: 1107980 - DNA, 23 bp, Homo sapiens
ctcccacaatctgggactttcac

SEQ ID NO: 1107981 - DNA, 17 bp, Homo sapiens
ctcccacacccaccctt

SEQ ID NO: 1107982 - DNA, 18 bp, Homo sapiens
ctcccacacccacccttt

SEQ ID NO: 1107983 - DNA, 17 bp, Homo sapiens
ctcccacactgaaacca

SEQ ID NO: 1107984 - DNA, 15 bp, Homo sapiens
ctcccacactgctag

SEQ ID NO: 1107985 - DNA, 16 bp, Homo sapiens
ctcccacacttgtgcc

SEQ ID NO: 1107986 - DNA, 17 bp, Homo sapiens
ctcccacagagtgctgg

SEQ ID NO: 1107987 - DNA, 15 bp, Homo sapiens
ctcccacagcttcct

SEQ ID NO: 1107988 - DNA, 21 bp, Homo sapiens
ctcccacaggcccttcctctc

SEQ ID NO: 1107989 - DNA, 21 bp, Homo sapiens
ctcccacatgaggccatctca

SEQ ID NO: 1107990 - DNA, 22 bp, Homo sapiens
ctcccacatgggcccaggcctc

SEQ ID NO: 1107991 - DNA, 23 bp, Homo sapiens
ctcccacatgggcccaggcctca

SEQ ID NO: 1107992 - DNA, 19 bp, Homo sapiens
ctcccaccacagcaggtgt

SEQ ID NO: 1107993 - DNA, 14 bp, Homo sapiens
ctcccaccacccca

SEQ ID NO: 1107994 - DNA, 18 bp, Homo sapiens
ctcccaccagagccggga

SEQ ID NO: 1107995 - DNA, 23 bp, Homo sapiens
ctcccaccccacccccttcagtg

SEQ ID NO: 1107996 - DNA, 12 bp, Homo sapiens
ctcccaccccag

SEQ ID NO: 1107997 - DNA, 13 bp, Homo sapiens
ctcccaccccaga

SEQ ID NO: 1107998 - DNA, 20 bp, Homo sapiens
ctcccaccccagaaatcact

SEQ ID NO: 1107999 - DNA, 21 bp, Homo sapiens
ctcccaccccagaaatcactg

SEQ ID NO: 1108000 - DNA, 16 bp, Homo sapiens
ctcccacccccagccc

SEQ ID NO: 1108001 - DNA, 11 bp, Homo sapiens
ctcccaccccg

SEQ ID NO: 1108002 - DNA, 17 bp, Homo sapiens
ctcccaccccggcctcc

SEQ ID NO: 1108003 - DNA, 19 bp, Homo sapiens
ctcccaccccggcctccac

SEQ ID NO: 1108004 - DNA, 15 bp, Homo sapiens
ctcccaccccttggc

SEQ ID NO: 1108005 - DNA, 22 bp, Homo sapiens
ctcccaccccttggcccctcac

SEQ ID NO: 1108006 - DNA, 24 bp, Homo sapiens
ctcccaccccttggcccctcacat

SEQ ID NO: 1108007 - DNA, 18 bp, Homo sapiens
ctcccacccgatgctgct

SEQ ID NO: 1108008 - DNA, 23 bp, Homo sapiens
ctcccacccgatgctgctttccc

SEQ ID NO: 1108009 - DNA, 20 bp, Homo sapiens
ctcccacccggccacagctg

SEQ ID NO: 1108010 - DNA, 14 bp, Homo sapiens
ctcccaccctaagg

SEQ ID NO: 1108011 - DNA, 15 bp, Homo sapiens
ctcccaccctaaggg

SEQ ID NO: 1108012 - DNA, 20 bp, Homo sapiens
ctcccaccctaagggcagcc

SEQ ID NO: 1108013 - DNA, 12 bp, Homo sapiens
ctcccaccgccc

SEQ ID NO: 1108014 - DNA, 13 bp, Homo sapiens
ctcccaccgcccc

SEQ ID NO: 1108015 - DNA, 16 bp, Homo sapiens
ctcccacctagtgccc

SEQ ID NO: 1108016 - DNA, 18 bp, Homo sapiens
ctcccacctgtttctgga

SEQ ID NO: 1108017 - DNA, 21 bp, Homo sapiens
ctcccacctgtttctggaaga

SEQ ID NO: 1108018 - DNA, 15 bp, Homo sapiens
ctcccacctttaatc

SEQ ID NO: 1108019 - DNA, 18 bp, Homo sapiens
ctcccacggcacctcggg

SEQ ID NO: 1108020 - DNA, 13 bp, Homo sapiens
ctcccactcccat

SEQ ID NO: 1108021 - DNA, 16 bp, Homo sapiens
ctcccactcccatctc

SEQ ID NO: 1108022 - DNA, 14 bp, Homo sapiens
ctcccactgagttt

SEQ ID NO: 1108023 - DNA, 14 bp, Homo sapiens
ctcccactgcgggg

SEQ ID NO: 1108024 - DNA, 20 bp, Homo sapiens
ctcccactgggactcccagc

SEQ ID NO: 1108025 - DNA, 22 bp, Homo sapiens
ctcccactgggactcccagcag

SEQ ID NO: 1108026 - DNA, 13 bp, Homo sapiens
ctcccacttcctc

SEQ ID NO: 1108027 - DNA, 14 bp, Homo sapiens
ctcccacttcctcc

SEQ ID NO: 1108028 - DNA, 18 bp, Homo sapiens
ctcccacttcctcctacc

SEQ ID NO: 1108029 - DNA, 14 bp, Homo sapiens
ctcccactttctgt

SEQ ID NO: 1108030 - DNA, 20 bp, Homo sapiens
ctcccactttgctgttcctt

SEQ ID NO: 1108031 - DNA, 16 bp, Homo sapiens
ctcccactttgtctgt

SEQ ID NO: 1108032 - DNA, 21 bp, Homo sapiens
ctcccactttgtctgtacata

SEQ ID NO: 1108033 - DNA, 23 bp, Homo sapiens
ctcccagaaaaactggctctgat

SEQ ID NO: 1108034 - DNA, 18 bp, Homo sapiens
ctcccagaaacatctctg

SEQ ID NO: 1108035 - DNA, 13 bp, Homo sapiens
ctcccagaatccc

SEQ ID NO: 1108036 - DNA, 16 bp, Homo sapiens
ctcccagaatcccagc

SEQ ID NO: 1108037 - DNA, 21 bp, Homo sapiens
ctcccagaatcccagccggcc

SEQ ID NO: 1108038 - DNA, 18 bp, Homo sapiens
ctcccagacaggccctcc

SEQ ID NO: 1108039 - DNA, 17 bp, Homo sapiens
ctcccagaggtccagcc

SEQ ID NO: 1108040 - DNA, 23 bp, Homo sapiens
ctcccagaggtccagcccatctc

SEQ ID NO: 1108041 - DNA, 21 bp, Homo sapiens
ctcccagatcagtcagagccc

SEQ ID NO: 1108042 - DNA, 21 bp, Homo sapiens
ctcccagcaacacaagctgga

SEQ ID NO: 1108043 - DNA, 17 bp, Homo sapiens
ctcccagcaagacctca

SEQ ID NO: 1108044 - DNA, 15 bp, Homo sapiens
ctcccagcactgcct

SEQ ID NO: 1108045 - DNA, 17 bp, Homo sapiens
ctcccagcactgcctcc

SEQ ID NO: 1108046 - DNA, 16 bp, Homo sapiens
ctcccagcagagccca

SEQ ID NO: 1108047 - DNA, 19 bp, Homo sapiens
ctcccagcagagcccacca

SEQ ID NO: 1108048 - DNA, 21 bp, Homo sapiens
ctcccagcagagcccaccagc

SEQ ID NO: 1108049 - DNA, 19 bp, Homo sapiens
ctcccagcagccctaagga

SEQ ID NO: 1108050 - DNA, 11 bp, Homo sapiens
ctcccagccca

SEQ ID NO: 1108051 - DNA, 15 bp, Homo sapiens
ctcccagcccattgc

SEQ ID NO: 1108052 - DNA, 17 bp, Homo sapiens
ctcccagcccattgctg

SEQ ID NO: 1108053 - DNA, 19 bp, Homo sapiens
ctcccagcccattgctgcc

SEQ ID NO: 1108054 - DNA, 22 bp, Homo sapiens
ctcccagcccattgctgccaag

SEQ ID NO: 1108055 - DNA, 16 bp, Homo sapiens
ctcccagccctatgga

SEQ ID NO: 1108056 - DNA, 13 bp, Homo sapiens
ctcccagcctgct

SEQ ID NO: 1108057 - DNA, 16 bp, Homo sapiens
ctcccagcctgctgag

SEQ ID NO: 1108058 - DNA, 15 bp, Homo sapiens
ctcccagcggcctcc

SEQ ID NO: 1108059 - DNA, 14 bp, Homo sapiens
ctcccagctccttt

SEQ ID NO: 1108060 - DNA, 23 bp, Homo sapiens
ctcccagctctagacaaccctgc

SEQ ID NO: 1108061 - DNA, 17 bp, Homo sapiens
ctccctgctccacgaag

SEQ ID NO: 1108062 - DNA, 16 bp, Homo sapiens
ctccctgctcctcatg

SEQ ID NO: 1108063 - DNA, 22 bp, Homo sapiens
ctccctgctgtgccatgctggg

SEQ ID NO: 1108064 - DNA, 18 bp, Homo sapiens
ctccctgcttgcacactt

SEQ ID NO: 1108065 - DNA, 10 bp, Homo sapiens
ctccctggag

SEQ ID NO: 1108066 - DNA, 12 bp, Homo sapiens
ctccctggagcc

SEQ ID NO: 1108067 - DNA, 19 bp, Homo sapiens
ctccctggagccagactct

SEQ ID NO: 1108068 - DNA, 14 bp, Homo sapiens
ctccctggagccct

SEQ ID NO: 1108069 - DNA, 20 bp, Homo sapiens
ctccctggatctacctggag

SEQ ID NO: 1108070 - DNA, 17 bp, Homo sapiens
ctccctggcagacacaa

SEQ ID NO: 1108071 - DNA, 15 bp, Homo sapiens
ctccctggcctgttc

SEQ ID NO: 1108072 - DNA, 19 bp, Homo sapiens
ctccctggcctgttctgtt

SEQ ID NO: 1108073 - DNA, 21 bp, Homo sapiens
ctccctggcctgttctgtttt

SEQ ID NO: 1108074 - DNA, 14 bp, Homo sapiens
ctccctggccttgc

SEQ ID NO: 1108075 - DNA, 15 bp, Homo sapiens
ctccctggccttgcc

SEQ ID NO: 1108076 - DNA, 16 bp, Homo sapiens
ctccctggccttgccc

SEQ ID NO: 1108077 - DNA, 11 bp, Homo sapiens
ctccctggctc

SEQ ID NO: 1108078 - DNA, 12 bp, Homo sapiens
ctccctggctcc

SEQ ID NO: 1108079 - DNA, 13 bp, Homo sapiens
ctccctggctcct

SEQ ID NO: 1108080 - DNA, 15 bp, Homo sapiens
ctccctggctctcag

SEQ ID NO: 1108081 - DNA, 16 bp, Homo sapiens
ctccctggctctcaga

SEQ ID NO: 1108082 - DNA, 21 bp, Homo sapiens
ctccctggctgccctggccct

SEQ ID NO: 1108083 - DNA, 22 bp, Homo sapiens
ctccctgggacacagacccagg

SEQ ID NO: 1108084 - DNA, 16 bp, Homo sapiens
ctccctgggccacctc

SEQ ID NO: 1108085 - DNA, 18 bp, Homo sapiens
ctccctgggccacctcct

SEQ ID NO: 1108086 - DNA, 19 bp, Homo sapiens
ctccctgggccacctccta

SEQ ID NO: 1108087 - DNA, 20 bp, Homo sapiens
ctccctgggccacctcctac

SEQ ID NO: 1108088 - DNA, 21 bp, Homo sapiens
ctccctgggccacctcctacc

SEQ ID NO: 1108089 - DNA, 11 bp, Homo sapiens
ctccctgggtt

SEQ ID NO: 1108090 - DNA, 16 bp, Homo sapiens
ctccctggtcccctcc

SEQ ID NO: 1108091 - DNA, 17 bp, Homo sapiens
ctccctggtgcctctgt

SEQ ID NO: 1108092 - DNA, 19 bp, Homo sapiens
ctccctggtgcctctgtgc

SEQ ID NO: 1108093 - DNA, 15 bp, Homo sapiens
ctccctggttgcctc

SEQ ID NO: 1108094 - DNA, 17 bp, Homo sapiens
ctccctggttgcctctc

SEQ ID NO: 1108095 - DNA, 19 bp, Homo sapiens
ctccctggttgcctctctt

SEQ ID NO: 1108096 - DNA, 20 bp, Homo sapiens
ctccctggttgcctctcttg

SEQ ID NO: 1108097 - DNA, 19 bp, Homo sapiens
ctccctgtaacctcttcag

SEQ ID NO: 1108098 - DNA, 19 bp, Homo sapiens
ctccctgtagctctgcctc

SEQ ID NO: 1108099 - DNA, 17 bp, Homo sapiens
ctccctgtcacacactg

SEQ ID NO: 1108100 - DNA, 13 bp, Homo sapiens
ctccctgtcctcc

SEQ ID NO: 1108101 - DNA, 15 bp, Homo sapiens
ctccctgtcctcctc

SEQ ID NO: 1108102 - DNA, 18 bp, Homo sapiens
ctccctgtcctcctcgga

SEQ ID NO: 1108103 - DNA, 13 bp, Homo sapiens
ctccctgtctcca

SEQ ID NO: 1108104 - DNA, 19 bp, Homo sapiens
ctccctgtctccagctgcc

SEQ ID NO: 1108105 - DNA, 22 bp, Homo sapiens
ctccctgtctccagctgcctgg

SEQ ID NO: 1108106 - DNA, 15 bp, Homo sapiens
ctccctgtctccagg

SEQ ID NO: 1108107 - DNA, 19 bp, Homo sapiens
ctccctgtctccagggccc

SEQ ID NO: 1108108 - DNA, 21 bp, Homo sapiens
ctccctgtggggcaggagtgc

SEQ ID NO: 1108109 - DNA, 17 bp, Homo sapiens
ctccctgtgggggtggc

SEQ ID NO: 1108110 - DNA, 23 bp, Homo sapiens
ctccctgtgggggtggccatccc

SEQ ID NO: 1108111 - DNA, 24 bp, Homo sapiens
ctccctgtgggggtggccatccct

SEQ ID NO: 1108112 - DNA, 18 bp, Homo sapiens
ctccctgtgttacccagg

SEQ ID NO: 1108113 - DNA, 17 bp, Homo sapiens
ctccctgtgttctgggc

SEQ ID NO: 1108114 - DNA, 18 bp, Homo sapiens
ctccctgtgttctgggct

SEQ ID NO: 1108115 - DNA, 19 bp, Homo sapiens
ctcccttaccctcctctgc

SEQ ID NO: 1108116 - DNA, 23 bp, Homo sapiens
ctcccttaggcattatttaatgt

SEQ ID NO: 1108117 - DNA, 12 bp, Homo sapiens
ctcccttcaacc

SEQ ID NO: 1108118 - DNA, 21 bp, Homo sapiens
ctcccttcaaccattccccat

SEQ ID NO: 1108119 - DNA, 19 bp, Homo sapiens
ctcccttcacaggggtaca

SEQ ID NO: 1108120 - DNA, 11 bp, Homo sapiens
ctcccttccca

SEQ ID NO: 1108121 - DNA, 20 bp, Homo sapiens
ctcccttcccacctactgca

SEQ ID NO: 1108122 - DNA, 15 bp, Homo sapiens
ctcccttccctcctc

SEQ ID NO: 1108123 - DNA, 17 bp, Homo sapiens
ctcccttccgaccctct

SEQ ID NO: 1108124 - DNA, 15 bp, Homo sapiens
ctcccttccgtccat

SEQ ID NO: 1108125 - DNA, 17 bp, Homo sapiens
ctcccttccgtccatcc

SEQ ID NO: 1108126 - DNA, 19 bp, Homo sapiens
ctcccttcctctctcctta

SEQ ID NO: 1108127 - DNA, 17 bp, Homo sapiens
ctcccttcctgccactg

SEQ ID NO: 1108128 - DNA, 17 bp, Homo sapiens
ctcccttccttgggcag

SEQ ID NO: 1108129 - DNA, 20 bp, Homo sapiens
ctcccttccttttccctgct

SEQ ID NO: 1108130 - DNA, 21 bp, Homo sapiens
ctcccttctctacactcttgt

SEQ ID NO: 1108131 - DNA, 15 bp, Homo sapiens
ctcccttctgctact

SEQ ID NO: 1108132 - DNA, 13 bp, Homo sapiens
ctcccttctgtag

SEQ ID NO: 1108133 - DNA, 23 bp, Homo sapiens
ctcccttgactttgctcctcaca

SEQ ID NO: 1108134 - DNA, 14 bp, Homo sapiens
ctcccttgccccag

SEQ ID NO: 1108135 - DNA, 15 bp, Homo sapiens
ctcccttgccccagg

SEQ ID NO: 1108136 - DNA, 19 bp, Homo sapiens
ctcccttgccccaggccag

SEQ ID NO: 1108137 - DNA, 18 bp, Homo sapiens
ctcccttgctcagtgcct

SEQ ID NO: 1108138 - DNA, 23 bp, Homo sapiens
ctcccttgctcagtgcctcctgg

SEQ ID NO: 1108139 - DNA, 24 bp, Homo sapiens
ctcccttgctcagtgcctcctggc

SEQ ID NO: 1108140 - DNA, 14 bp, Homo sapiens
ctcccttgctggcc

SEQ ID NO: 1108141 - DNA, 22 bp, Homo sapiens
ctcccttggaaacctgccctgc

SEQ ID NO: 1108142 - DNA, 19 bp, Homo sapiens
ctcccttgggaaggacaca

SEQ ID NO: 1108143 - DNA, 18 bp, Homo sapiens
ctcccttgggctccctgt

SEQ ID NO: 1108144 - DNA, 14 bp, Homo sapiens
ctcccttgggctgg

SEQ ID NO: 1108145 - DNA, 17 bp, Homo sapiens
ctcccttgggttctgat

SEQ ID NO: 1108146 - DNA, 16 bp, Homo sapiens
ctcccttgtcctgctt

SEQ ID NO: 1108147 - DNA, 16 bp, Homo sapiens
ctccctttctctctcc

SEQ ID NO: 1108148 - DNA, 18 bp, Homo sapiens
ctccctttctctctcctc

SEQ ID NO: 1108149 - DNA, 18 bp, Homo sapiens
ctcccttttttttttaaa

SEQ ID NO: 1108150 - DNA, 15 bp, Homo sapiens
ctccgaagaaaagaa

SEQ ID NO: 1108151 - DNA, 15 bp, Homo sapiens
ctccgacctctctca

SEQ ID NO: 1108152 - DNA, 17 bp, Homo sapiens
ctccgacctctctcagc

SEQ ID NO: 1108153 - DNA, 21 bp, Homo sapiens
ctccgacctctctcagcccca

SEQ ID NO: 1108154 - DNA, 20 bp, Homo sapiens
ctccgacgctgcctctcatt

SEQ ID NO: 1108155 - DNA, 18 bp, Homo sapiens
ctccgacttcccctgggc

SEQ ID NO: 1108156 - DNA, 16 bp, Homo sapiens
ctccgagagggagaga

SEQ ID NO: 1108157 - DNA, 13 bp, Homo sapiens
ctccgagaggtgg

SEQ ID NO: 1108158 - DNA, 14 bp, Homo sapiens
ctccgaggactgga

SEQ ID NO: 1108159 - DNA, 15 bp, Homo sapiens
ctccgaggctccccg

SEQ ID NO: 1108160 - DNA, 16 bp, Homo sapiens
ctccgaggctccccgc

SEQ ID NO: 1108161 - DNA, 17 bp, Homo sapiens
ctccgagggcggccagg

SEQ ID NO: 1108162 - DNA, 18 bp, Homo sapiens
ctccgagggcggccaggg

SEQ ID NO: 1108163 - DNA, 15 bp, Homo sapiens
ctccgatccttcctc

SEQ ID NO: 1108164 - DNA, 20 bp, Homo sapiens
ctccgatgcctggcctgcca

SEQ ID NO: 1108165 - DNA, 13 bp, Homo sapiens
ctccgcaggggtt

SEQ ID NO: 1108166 - DNA, 15 bp, Homo sapiens
ctccgcaggggtttg

SEQ ID NO: 1108167 - DNA, 23 bp, Homo sapiens
ctccgcagtgcctgcaggggagc

SEQ ID NO: 1108168 - DNA, 14 bp, Homo sapiens
ctccgcagtgtctc

SEQ ID NO: 1108169 - DNA, 16 bp, Homo sapiens
ctccgcagtgtctcca

SEQ ID NO: 1108170 - DNA, 18 bp, Homo sapiens
ctccgcatcacctcacca

SEQ ID NO: 1108171 - DNA, 20 bp, Homo sapiens
ctccgcatcacctcaccaag

SEQ ID NO: 1108172 - DNA, 20 bp, Homo sapiens
ctccgcattggaagagcccg

SEQ ID NO: 1108173 - DNA, 13 bp, Homo sapiens
ctccgccagaccc

SEQ ID NO: 1108174 - DNA, 12 bp, Homo sapiens
ctccgccagcct

SEQ ID NO: 1108175 - DNA, 22 bp, Homo sapiens
ctccgccatggggtcggctcct

SEQ ID NO: 1108176 - DNA, 14 bp, Homo sapiens
ctccgcccttagtc

SEQ ID NO: 1108177 - DNA, 19 bp, Homo sapiens
ctccgcctgtgtccatctg

SEQ ID NO: 1108178 - DNA, 21 bp, Homo sapiens
ctccgccttcactccggtgtg

SEQ ID NO: 1108179 - DNA, 19 bp, Homo sapiens
ctccgcgccctccgacctc

SEQ ID NO: 1108180 - DNA, 19 bp, Homo sapiens
ctccgcgccgatgccaccg

SEQ ID NO: 1108181 - DNA, 20 bp, Homo sapiens
ctccgcgggctgactgggcc

SEQ ID NO: 1108182 - DNA, 15 bp, Homo sapiens
ctccgctcccaccgc

SEQ ID NO: 1108183 - DNA, 19 bp, Homo sapiens
ctcgacaaaggccacaggc

SEQ ID NO: 1108184 - DNA, 22 bp, Homo sapiens
ctcgacaaaggccacaggcagt

SEQ ID NO: 1108185 - DNA, 16 bp, Homo sapiens
ctcgactctgctgctc

SEQ ID NO: 1108186 - DNA, 18 bp, Homo sapiens
ctcgagaccatcctggcc

SEQ ID NO: 1108187 - DNA, 17 bp, Homo sapiens
ctcgagcccagatggaa

SEQ ID NO: 1108188 - DNA, 15 bp, Homo sapiens
ctcgagccccctgga

SEQ ID NO: 1108189 - DNA, 13 bp, Homo sapiens
ctcgagccctccc

SEQ ID NO: 1108190 - DNA, 18 bp, Homo sapiens
ctcgaggaactccaggac

SEQ ID NO: 1108191 - DNA, 14 bp, Homo sapiens
ctcgaggcaccggc

SEQ ID NO: 1108192 - DNA, 18 bp, Homo sapiens
ctcgaggcaccggcgctg

SEQ ID NO: 1108193 - DNA, 23 bp, Homo sapiens
ctcgaggcaccggcgctgcaggt

SEQ ID NO: 1108194 - DNA, 22 bp, Homo sapiens
ctcgaggcctacagaggaggcc

SEQ ID NO: 1108195 - DNA, 12 bp, Homo sapiens
ctcgaggcctgc

SEQ ID NO: 1108196 - DNA, 13 bp, Homo sapiens
ctcgaggcctgca

SEQ ID NO: 1108197 - DNA, 12 bp, Homo sapiens
ctcgaggctggt

SEQ ID NO: 1108198 - DNA, 15 bp, Homo sapiens
ctcgaggctggtggt

SEQ ID NO: 1108199 - DNA, 23 bp, Homo sapiens
ctcgaggctggtggttttcagag

SEQ ID NO: 1108200 - DNA, 18 bp, Homo sapiens
ctcgagggcagggaccac

SEQ ID NO: 1108201 - DNA, 16 bp, Homo sapiens
ctcgaggggtgggctg

SEQ ID NO: 1108202 - DNA, 23 bp, Homo sapiens
ctcgagggttgggttcatctgag

SEQ ID NO: 1108203 - DNA, 16 bp, Homo sapiens
ctcgagtcacattctg

SEQ ID NO: 1108204 - DNA, 20 bp, Homo sapiens
ctcgagtcacattctgctta

SEQ ID NO: 1108205 - DNA, 15 bp, Homo sapiens
ctcgatgactgtgaa

SEQ ID NO: 1108206 - DNA, 12 bp, Homo sapiens
ctcgatgcactg

SEQ ID NO: 1108207 - DNA, 13 bp, Homo sapiens
ctcgatgcactga

SEQ ID NO: 1108208 - DNA, 14 bp, Homo sapiens
ctcgatgcactgac

SEQ ID NO: 1108209 - DNA, 16 bp, Homo sapiens
ctcgatgcactgacct

SEQ ID NO: 1108210 - DNA, 17 bp, Homo sapiens
ctcgcaaccctgcctgt

SEQ ID NO: 1108211 - DNA, 11 bp, Homo sapiens
ctcgcacacag

SEQ ID NO: 1108212 - DNA, 15 bp, Homo sapiens
ctcgcacacagggct

SEQ ID NO: 1108213 - DNA, 16 bp, Homo sapiens
ctcgcacacagggctc

SEQ ID NO: 1108214 - DNA, 18 bp, Homo sapiens
ctcgcacacagggctcac

SEQ ID NO: 1108215 - DNA, 21 bp, Homo sapiens
ctcgcacacagggctcacagg

SEQ ID NO: 1108216 - DNA, 13 bp, Homo sapiens
ctcgcacaggccc

SEQ ID NO: 1108217 - DNA, 14 bp, Homo sapiens
ctcgcacctttcca

SEQ ID NO: 1108218 - DNA, 18 bp, Homo sapiens
ctcgcacttgcagaggag

SEQ ID NO: 1108219 - DNA, 20 bp, Homo sapiens
ctcgcacttgcagaggagcc

SEQ ID NO: 1108220 - DNA, 22 bp, Homo sapiens
ctcgcacttgcagaggagccca

SEQ ID NO: 1108221 - DNA, 17 bp, Homo sapiens
ctcgcagacctaagccc

SEQ ID NO: 1108222 - DNA, 17 bp, Homo sapiens
ctcgcagcacccacagc

SEQ ID NO: 1108223 - DNA, 14 bp, Homo sapiens
ctcgcagcccccgc

SEQ ID NO: 1108224 - DNA, 11 bp, Homo sapiens
ctcgcaggacc

SEQ ID NO: 1108225 - DNA, 12 bp, Homo sapiens
ctcgcaggacca

SEQ ID NO: 1108226 - DNA, 15 bp, Homo sapiens
ctcgcaggaccaagg

SEQ ID NO: 1108227 - DNA, 20 bp, Homo sapiens
ctcgcagggaatgcagcagg

SEQ ID NO: 1108228 - DNA, 18 bp, Homo sapiens
ctcgcataggacctttcc

SEQ ID NO: 1108229 - DNA, 16 bp, Homo sapiens
ctcgcatccagacagt

SEQ ID NO: 1108230 - DNA, 15 bp, Homo sapiens
ctcgcatcctatgct

SEQ ID NO: 1108231 - DNA, 17 bp, Homo sapiens
ctcgccacgctcagtgc

SEQ ID NO: 1108232 - DNA, 12 bp, Homo sapiens
ctcgccagcttg

SEQ ID NO: 1108233 - DNA, 21 bp, Homo sapiens
ctcgccatcaaggtccagtgg

SEQ ID NO: 1108234 - DNA, 19 bp, Homo sapiens
ctcgccatttcctcacgtg

SEQ ID NO: 1108235 - DNA, 23 bp, Homo sapiens
ctcgccatttcctcacgtgcagg

SEQ ID NO: 1108236 - DNA, 16 bp, Homo sapiens
ctcgcccagacaccat

SEQ ID NO: 1108237 - DNA, 12 bp, Homo sapiens
ctcgccccaccc

SEQ ID NO: 1108238 - DNA, 17 bp, Homo sapiens
ctcgccccatccctgct

SEQ ID NO: 1108239 - DNA, 13 bp, Homo sapiens
ctcgcccccacca

SEQ ID NO: 1108240 - DNA, 19 bp, Homo sapiens
ctcgcccccaccagtgtag

SEQ ID NO: 1108241 - DNA, 23 bp, Homo sapiens
ctcgcccccaggaacgctctcct

SEQ ID NO: 1108242 - DNA, 14 bp, Homo sapiens
ctcgcccctcccct

SEQ ID NO: 1108243 - DNA, 18 bp, Homo sapiens
ctcgcccctcccctcagc

SEQ ID NO: 1108244 - DNA, 20 bp, Homo sapiens
ctcgcccctcccctcagcct

SEQ ID NO: 1108245 - DNA, 23 bp, Homo sapiens
ctcgcccctcccctcagcctgcc

SEQ ID NO: 1108246 - DNA, 16 bp, Homo sapiens
ctcgcccgcccactgt

SEQ ID NO: 1108247 - DNA, 17 bp, Homo sapiens
ctcgccggatctgaggg

SEQ ID NO: 1108248 - DNA, 18 bp, Homo sapiens
ctcgccggatctgaggga

SEQ ID NO: 1108249 - DNA, 16 bp, Homo sapiens
ctcgcctaggcctgtg

SEQ ID NO: 1108250 - DNA, 17 bp, Homo sapiens
ctcgcctcactttccac

SEQ ID NO: 1108251 - DNA, 16 bp, Homo sapiens
ctcgcggccctcagta

SEQ ID NO: 1108252 - DNA, 19 bp, Homo sapiens
ctcgctgccagctctgtat

SEQ ID NO: 1108253 - DNA, 11 bp, Homo sapiens
ctcgctgccat

SEQ ID NO: 1108254 - DNA, 13 bp, Homo sapiens
ctcgctgccatca

SEQ ID NO: 1108255 - DNA, 15 bp, Homo sapiens
ctcgctgctgctact

SEQ ID NO: 1108256 - DNA, 15 bp, Homo sapiens
ctcgctgcttctgtg

SEQ ID NO: 1108257 - DNA, 15 bp, Homo sapiens
ctcgctggactctca

SEQ ID NO: 1108258 - DNA, 18 bp, Homo sapiens
ctcggaaccgctcaccta

SEQ ID NO: 1108259 - DNA, 20 bp, Homo sapiens
ctcggaaccgctcacctaga

SEQ ID NO: 1108260 - DNA, 13 bp, Homo sapiens
ctcggacccacca

SEQ ID NO: 1108261 - DNA, 14 bp, Homo sapiens
ctcggacccacccc

SEQ ID NO: 1108262 - DNA, 16 bp, Homo sapiens
ctcggacccaccccaa

SEQ ID NO: 1108263 - DNA, 17 bp, Homo sapiens
ctcggacccaccccaac

SEQ ID NO: 1108264 - DNA, 17 bp, Homo sapiens
ctcggagagcagcagca

SEQ ID NO: 1108265 - DNA, 16 bp, Homo sapiens
ctcggagcctcatccg

SEQ ID NO: 1108266 - DNA, 23 bp, Homo sapiens
ctcggagcctcatccgaggcagg

SEQ ID NO: 1108267 - DNA, 15 bp, Homo sapiens
ctcggagcctgtgtt

SEQ ID NO: 1108268 - DNA, 16 bp, Homo sapiens
ctcggagcctgtgtta

SEQ ID NO: 1108269 - DNA, 17 bp, Homo sapiens
ctcggagctggctgtgc

SEQ ID NO: 1108270 - DNA, 17 bp, Homo sapiens
ctcggagggattcccct

SEQ ID NO: 1108271 - DNA, 14 bp, Homo sapiens
ctcggcacacactg

SEQ ID NO: 1108272 - DNA, 21 bp, Homo sapiens
ctcggcacacactgtgcccca

SEQ ID NO: 1108273 - DNA, 15 bp, Homo sapiens
ctcggcaccaactaa

SEQ ID NO: 1108274 - DNA, 19 bp, Homo sapiens
ctcggcagaactctctgtc

SEQ ID NO: 1108275 - DNA, 13 bp, Homo sapiens
ctcggccactgtg

SEQ ID NO: 1108276 - DNA, 17 bp, Homo sapiens
ctcggccccctccatcg

SEQ ID NO: 1108277 - DNA, 15 bp, Homo sapiens
ctcggcccggagcag

SEQ ID NO: 1108278 - DNA, 17 bp, Homo sapiens
ctcggcccggagcagca

SEQ ID NO: 1108279 - DNA, 13 bp, Homo sapiens
ctcggccctgaac

SEQ ID NO: 1108280 - DNA, 19 bp, Homo sapiens
ctcggccctgaaccacgag

SEQ ID NO: 1108281 - DNA, 20 bp, Homo sapiens
ctcggccctgaaccacgagg

SEQ ID NO: 1108282 - DNA, 20 bp, Homo sapiens
ctcggccgaggcctgcgccc

SEQ ID NO: 1108283 - DNA, 21 bp, Homo sapiens
ctcggccgtcttcactcgccc

SEQ ID NO: 1108284 - DNA, 15 bp, Homo sapiens
ctcggcctcccaaag

SEQ ID NO: 1108285 - DNA, 21 bp, Homo sapiens
ctcggcctccgaggctccccg

SEQ ID NO: 1108286 - DNA, 23 bp, Homo sapiens
ctcggcgttagtccctagccgcg

SEQ ID NO: 1108287 - DNA, 13 bp, Homo sapiens
ctcggctctggag

SEQ ID NO: 1108288 - DNA, 16 bp, Homo sapiens
ctcggctggaagaaca

SEQ ID NO: 1108289 - DNA, 17 bp, Homo sapiens
ctcggctggaagaacat

SEQ ID NO: 1108290 - DNA, 17 bp, Homo sapiens
ctcggcttcttggacct

SEQ ID NO: 1108291 - DNA, 18 bp, Homo sapiens
ctcggcttgatcacagct

SEQ ID NO: 1108292 - DNA, 18 bp, Homo sapiens
ctcggcttggatcctggg

SEQ ID NO: 1108293 - DNA, 17 bp, Homo sapiens
ctcggcttgtgggctgg

SEQ ID NO: 1108294 - DNA, 19 bp, Homo sapiens
ctcgggaagggaggggaag

SEQ ID NO: 1108295 - DNA, 16 bp, Homo sapiens
ctcgggactagctgcc

SEQ ID NO: 1108296 - DNA, 13 bp, Homo sapiens
ctcgggagctgca

SEQ ID NO: 1108297 - DNA, 16 bp, Homo sapiens
ctcgggagctgcacac

SEQ ID NO: 1108298 - DNA, 21 bp, Homo sapiens
ctcgggagctgcacacacctg

SEQ ID NO: 1108299 - DNA, 19 bp, Homo sapiens
ctcgggaggctgagacagg

SEQ ID NO: 1108300 - DNA, 18 bp, Homo sapiens
ctcgggagtcctctagca

SEQ ID NO: 1108301 - DNA, 20 bp, Homo sapiens
ctcgggattagtacacactt

SEQ ID NO: 1108302 - DNA, 20 bp, Homo sapiens
ctcgggcccacctggccacc

SEQ ID NO: 1108303 - DNA, 18 bp, Homo sapiens
ctcgggctggagcctccg

SEQ ID NO: 1108304 - DNA, 18 bp, Homo sapiens
ctcggggacaccagagct

SEQ ID NO: 1108305 - DNA, 11 bp, Homo sapiens
ctcggggaggc

SEQ ID NO: 1108306 - DNA, 13 bp, Homo sapiens
ctctccaagggct

SEQ ID NO: 1108307 - DNA, 17 bp, Homo sapiens
ctctccaagggcttctg

SEQ ID NO: 1108308 - DNA, 13 bp, Homo sapiens
ctctccaagtctc

SEQ ID NO: 1108309 - DNA, 16 bp, Homo sapiens
ctctccaagtctctct

SEQ ID NO: 1108310 - DNA, 19 bp, Homo sapiens
ctctccaagtctctctgtg

SEQ ID NO: 1108311 - DNA, 22 bp, Homo sapiens
ctctccaagtctctctgtgaat

SEQ ID NO: 1108312 - DNA, 15 bp, Homo sapiens
ctctccaagtgccag

SEQ ID NO: 1108313 - DNA, 22 bp, Homo sapiens
ctctccaagtgccagaggtggg

SEQ ID NO: 1108314 - DNA, 20 bp, Homo sapiens
ctctccaccagccctactcc

SEQ ID NO: 1108315 - DNA, 15 bp, Homo sapiens
ctctccaccctcctc

SEQ ID NO: 1108316 - DNA, 10 bp, Homo sapiens
ctctccacct

SEQ ID NO: 1108317 - DNA, 16 bp, Homo sapiens
ctctccacctcagcct

SEQ ID NO: 1108318 - DNA, 17 bp, Homo sapiens
ctctccacctcagcctt

SEQ ID NO: 1108319 - DNA, 23 bp, Homo sapiens
ctctccacggtagcacttgacct

SEQ ID NO: 1108320 - DNA, 16 bp, Homo sapiens
ctctccactgccttcg

SEQ ID NO: 1108321 - DNA, 18 bp, Homo sapiens
ctctccactgctggacat

SEQ ID NO: 1108322 - DNA, 22 bp, Homo sapiens
ctctccactgctggacatgaga

SEQ ID NO: 1108323 - DNA, 14 bp, Homo sapiens
ctctccacttctgg

SEQ ID NO: 1108324 - DNA, 13 bp, Homo sapiens
ctctccagccatt

SEQ ID NO: 1108325 - DNA, 19 bp, Homo sapiens
ctctccagcggtccaaagt

SEQ ID NO: 1108326 - DNA, 14 bp, Homo sapiens
ctctccagctgact

SEQ ID NO: 1108327 - DNA, 19 bp, Homo sapiens
ctctccaggcacccttctt

SEQ ID NO: 1108328 - DNA, 15 bp, Homo sapiens
ctctccaggccaggt

SEQ ID NO: 1108329 - DNA, 16 bp, Homo sapiens
ctctccaggccaggtg

SEQ ID NO: 1108330 - DNA, 17 bp, Homo sapiens
ctctccaggcgccggcg

SEQ ID NO: 1108331 - DNA, 12 bp, Homo sapiens
ctctccagggtg

SEQ ID NO: 1108332 - DNA, 22 bp, Homo sapiens
ctctccagtttgcacctgtccc

SEQ ID NO: 1108333 - DNA, 15 bp, Homo sapiens
ctctccatatctcct

SEQ ID NO: 1108334 - DNA, 13 bp, Homo sapiens
ctctcccaactct

SEQ ID NO: 1108335 - DNA, 18 bp, Homo sapiens
ctctcccacagagtgctg

SEQ ID NO: 1108336 - DNA, 22 bp, Homo sapiens
ctctcccacagagtgctggact

SEQ ID NO: 1108337 - DNA, 15 bp, Homo sapiens
ctctcccaccccggc

SEQ ID NO: 1108338 - DNA, 12 bp, Homo sapiens
ctctcccacccg

SEQ ID NO: 1108339 - DNA, 21 bp, Homo sapiens
ctctcccacccggccacagct

SEQ ID NO: 1108340 - DNA, 23 bp, Homo sapiens
ctctcccacccggccacagctgc

SEQ ID NO: 1108341 - DNA, 19 bp, Homo sapiens
ctctcccaccctaagggca

SEQ ID NO: 1108342 - DNA, 13 bp, Homo sapiens
ctctcccacttcc

SEQ ID NO: 1108343 - DNA, 14 bp, Homo sapiens
ctctcccacttcct

SEQ ID NO: 1108344 - DNA, 18 bp, Homo sapiens
ctctcccacttcctccta

SEQ ID NO: 1108345 - DNA, 17 bp, Homo sapiens
ctctcccagtccatttc

SEQ ID NO: 1108346 - DNA, 22 bp, Homo sapiens
ctctcccagtgaactcctgcca

SEQ ID NO: 1108347 - DNA, 12 bp, Homo sapiens
ctctcccatccc

SEQ ID NO: 1108348 - DNA, 18 bp, Homo sapiens
ctctcccatccccctgcc

SEQ ID NO: 1108349 - DNA, 13 bp, Homo sapiens
ctctcccatcctg

SEQ ID NO: 1108350 - DNA, 14 bp, Homo sapiens
ctctcccatcctgg

SEQ ID NO: 1108351 - DNA, 17 bp, Homo sapiens
ctctcccatttcaggaa

SEQ ID NO: 1108352 - DNA, 22 bp, Homo sapiens
ctctccccaatccatgcttcac

SEQ ID NO: 1108353 - DNA, 19 bp, Homo sapiens
ctctccccacccctacccc

SEQ ID NO: 1108354 - DNA, 22 bp, Homo sapiens
ctctccccacccctacccctgg

SEQ ID NO: 1108355 - DNA, 16 bp, Homo sapiens
ctctccccaggtccag

SEQ ID NO: 1108356 - DNA, 20 bp, Homo sapiens
ctctccccaggtccagctct

SEQ ID NO: 1108357 - DNA, 13 bp, Homo sapiens
ctctccccagtgc

SEQ ID NO: 1108358 - DNA, 15 bp, Homo sapiens
ctctccccagtgcct

SEQ ID NO: 1108359 - DNA, 18 bp, Homo sapiens
ctctccccagtgcctgcc

SEQ ID NO: 1108360 - DNA, 17 bp, Homo sapiens
ctctcccccaaccccct

SEQ ID NO: 1108361 - DNA, 20 bp, Homo sapiens
ctctcccccaaccccctgca

SEQ ID NO: 1108362 - DNA, 16 bp, Homo sapiens
ctctccccctcctcca

SEQ ID NO: 1108363 - DNA, 18 bp, Homo sapiens
ctctcccccttcagctcc

SEQ ID NO: 1108364 - DNA, 17 bp, Homo sapiens
ctctccccgctctggat

SEQ ID NO: 1108365 - DNA, 18 bp, Homo sapiens
ctctccccggcaggcctg

SEQ ID NO: 1108366 - DNA, 22 bp, Homo sapiens
ctctccccggtaatgtcactgt

SEQ ID NO: 1108367 - DNA, 21 bp, Homo sapiens
ctctcccctcacatcctcctg

SEQ ID NO: 1108368 - DNA, 16 bp, Homo sapiens
ctctcccctccctctt

SEQ ID NO: 1108369 - DNA, 17 bp, Homo sapiens
ctctcccctccctcttc

SEQ ID NO: 1108370 - DNA, 16 bp, Homo sapiens
ctctcccctcccttgt

SEQ ID NO: 1108371 - DNA, 23 bp, Homo sapiens
ctctcccctctcgccccatccct

SEQ ID NO: 1108372 - DNA, 16 bp, Homo sapiens
ctctcccctctctgct

SEQ ID NO: 1108373 - DNA, 16 bp, Homo sapiens
ctctccccttggttct

SEQ ID NO: 1108374 - DNA, 14 bp, Homo sapiens
ctctcccggctgcc

SEQ ID NO: 1108375 - DNA, 18 bp, Homo sapiens
ctctcccggctgcctgcc

SEQ ID NO: 1108376 - DNA, 19 bp, Homo sapiens
ctctcccggctgcctgccg

SEQ ID NO: 1108377 - DNA, 19 bp, Homo sapiens
ctctcccggttcttccagt

SEQ ID NO: 1108378 - DNA, 15 bp, Homo sapiens
ctctcccgtcagggc

SEQ ID NO: 1108379 - DNA, 16 bp, Homo sapiens
ctctcccgtcagggcc

SEQ ID NO: 1108380 - DNA, 20 bp, Homo sapiens
ctctccctacctccctcctc

SEQ ID NO: 1108381 - DNA, 23 bp, Homo sapiens
ctctccctccctctctcatgaga

SEQ ID NO: 1108382 - DNA, 22 bp, Homo sapiens
ctctccctctggccctgccttc

SEQ ID NO: 1108383 - DNA, 14 bp, Homo sapiens
ctctccctctgtct

SEQ ID NO: 1108384 - DNA, 18 bp, Homo sapiens
ctctccctctgtcttttc

SEQ ID NO: 1108385 - DNA, 14 bp, Homo sapiens
ctctccctgccttt

SEQ ID NO: 1108386 - DNA, 13 bp, Homo sapiens
ctctccctgggtc

SEQ ID NO: 1108387 - DNA, 18 bp, Homo sapiens
ctctccctggtcccctcc

SEQ ID NO: 1108388 - DNA, 15 bp, Homo sapiens
ctctcccttcccttc

SEQ ID NO: 1108389 - DNA, 16 bp, Homo sapiens
ctctccgaaagaagac

SEQ ID NO: 1108390 - DNA, 22 bp, Homo sapiens
ctctccgaaagaagacacagaa

SEQ ID NO: 1108391 - DNA, 16 bp, Homo sapiens
ctctccgcgccctccg

SEQ ID NO: 1108392 - DNA, 15 bp, Homo sapiens
ctctccgcgcctacc

SEQ ID NO: 1108393 - DNA, 21 bp, Homo sapiens
ctctccgggcctttctctggc

SEQ ID NO: 1108394 - DNA, 15 bp, Homo sapiens
ctctccggtctctct

SEQ ID NO: 1108395 - DNA, 14 bp, Homo sapiens
ctctcctagcccct

SEQ ID NO: 1108396 - DNA, 17 bp, Homo sapiens
ctctcctcagtttacat

SEQ ID NO: 1108397 - DNA, 20 bp, Homo sapiens
ctctcctcatgttctgcttt

SEQ ID NO: 1108398 - DNA, 16 bp, Homo sapiens
ctctcctccaagacac

SEQ ID NO: 1108399 - DNA, 20 bp, Homo sapiens
ctctcctccaagacactgtg

SEQ ID NO: 1108400 - DNA, 15 bp, Homo sapiens
ctctcctcccagctg

SEQ ID NO: 1108401 - DNA, 16 bp, Homo sapiens
ctctcctcttgccact

SEQ ID NO: 1108402 - DNA, 17 bp, Homo sapiens
ctctcctcttgccactg

SEQ ID NO: 1108403 - DNA, 12 bp, Homo sapiens
ctctcctgaccc

SEQ ID NO: 1108404 - DNA, 21 bp, Homo sapiens
ctctcctgacttttaatgtca

SEQ ID NO: 1108405 - DNA, 18 bp, Homo sapiens
ctctcctgcccagatgcc

SEQ ID NO: 1108406 - DNA, 14 bp, Homo sapiens
ctctcctgccctct

SEQ ID NO: 1108407 - DNA, 20 bp, Homo sapiens
ctctcctggcctatccgctg

SEQ ID NO: 1108408 - DNA, 19 bp, Homo sapiens
ctctcctgggggtggcagg

SEQ ID NO: 1108409 - DNA, 10 bp, Homo sapiens
ctctcctggt

SEQ ID NO: 1108410 - DNA, 12 bp, Homo sapiens
ctctcctgtcca

SEQ ID NO: 1108411 - DNA, 12 bp, Homo sapiens
ctctcctgtcct

SEQ ID NO: 1108412 - DNA, 15 bp, Homo sapiens
ctctcctgtgtgctt

SEQ ID NO: 1108413 - DNA, 15 bp, Homo sapiens
ctctcctgtttggaa

SEQ ID NO: 1108414 - DNA, 15 bp, Homo sapiens
ctctccttcaaagaa

SEQ ID NO: 1108415 - DNA, 19 bp, Homo sapiens
ctctccttcccacaaaaga

SEQ ID NO: 1108416 - DNA, 16 bp, Homo sapiens
ctctccttcgtgtctc

SEQ ID NO: 1108417 - DNA, 20 bp, Homo sapiens
ctctccttctcctagctctg

SEQ ID NO: 1108418 - DNA, 16 bp, Homo sapiens
ctctccttggccacag

SEQ ID NO: 1108419 - DNA, 20 bp, Homo sapiens
ctctccttggccacagactg

SEQ ID NO: 1108420 - DNA, 16 bp, Homo sapiens
ctctccttgggctcct

SEQ ID NO: 1108421 - DNA, 17 bp, Homo sapiens
ctctccttgggctcctg

SEQ ID NO: 1108422 - DNA, 23 bp, Homo sapiens
ctctccttgggctcctggctgcc

SEQ ID NO: 1108423 - DNA, 16 bp, Homo sapiens
ctctcctttctttttc

SEQ ID NO: 1108424 - DNA, 21 bp, Homo sapiens
ctctcctttctttttcttctt

SEQ ID NO: 1108425 - DNA, 19 bp, Homo sapiens
ctctcctttgtgtggctgc

SEQ ID NO: 1108426 - DNA, 20 bp, Homo sapiens
ctctccttttccttaccata

SEQ ID NO: 1108427 - DNA, 16 bp, Homo sapiens
ctctccttttgaggct

SEQ ID NO: 1108428 - DNA, 20 bp, Homo sapiens
ctctgctgggaacctagcac

SEQ ID NO: 1108429 - DNA, 22 bp, Homo sapiens
ctctgctggggaagggttttct

SEQ ID NO: 1108430 - DNA, 12 bp, Homo sapiens
ctctgctgggtc

SEQ ID NO: 1108431 - DNA, 19 bp, Homo sapiens
ctctgcttacccttcacct

SEQ ID NO: 1108432 - DNA, 21 bp, Homo sapiens
ctctgcttaccgttcaagagg

SEQ ID NO: 1108433 - DNA, 18 bp, Homo sapiens
ctctgcttctcggggtcc

SEQ ID NO: 1108434 - DNA, 19 bp, Homo sapiens
ctctgcttctcggggtcca

SEQ ID NO: 1108435 - DNA, 23 bp, Homo sapiens
ctctgcttctcggggtccagtgc

SEQ ID NO: 1108436 - DNA, 13 bp, Homo sapiens
ctctgcttctctg

SEQ ID NO: 1108437 - DNA, 16 bp, Homo sapiens
ctctgcttctctgact

SEQ ID NO: 1108438 - DNA, 17 bp, Homo sapiens
ctctgcttctctgactt

SEQ ID NO: 1108439 - DNA, 18 bp, Homo sapiens
ctctgcttgcctggagac

SEQ ID NO: 1108440 - DNA, 14 bp, Homo sapiens
ctctgctttaaagt

SEQ ID NO: 1108441 - DNA, 15 bp, Homo sapiens
ctctgctttcctttt

SEQ ID NO: 1108442 - DNA, 22 bp, Homo sapiens
ctctgcttttagttcatatata

SEQ ID NO: 1108443 - DNA, 21 bp, Homo sapiens
ctctggaaaactcaggattct

SEQ ID NO: 1108444 - DNA, 21 bp, Homo sapiens
ctctggaaaatgtgacccaga

SEQ ID NO: 1108445 - DNA, 19 bp, Homo sapiens
ctctggaaagaggctctgg

SEQ ID NO: 1108446 - DNA, 13 bp, Homo sapiens
ctctggaaccccc

SEQ ID NO: 1108447 - DNA, 15 bp, Homo sapiens
ctctggaacccccca

SEQ ID NO: 1108448 - DNA, 18 bp, Homo sapiens
ctctggaaccccccaggc

SEQ ID NO: 1108449 - DNA, 12 bp, Homo sapiens
ctctggaacctg

SEQ ID NO: 1108450 - DNA, 20 bp, Homo sapiens
ctctggaataaagttgcaga

SEQ ID NO: 1108451 - DNA, 17 bp, Homo sapiens
ctctggaatcttcccca

SEQ ID NO: 1108452 - DNA, 17 bp, Homo sapiens
ctctggacacttgctca

SEQ ID NO: 1108453 - DNA, 15 bp, Homo sapiens
ctctggacagatgga

SEQ ID NO: 1108454 - DNA, 14 bp, Homo sapiens
ctctggacagcaga

SEQ ID NO: 1108455 - DNA, 18 bp, Homo sapiens
ctctggacagcagaagcc

SEQ ID NO: 1108456 - DNA, 20 bp, Homo sapiens
ctctggacagcagaagcctc

SEQ ID NO: 1108457 - DNA, 13 bp, Homo sapiens
ctctggacagcca

SEQ ID NO: 1108458 - DNA, 14 bp, Homo sapiens
ctctggacagccag

SEQ ID NO: 1108459 - DNA, 17 bp, Homo sapiens
ctctggacagccagtga

SEQ ID NO: 1108460 - DNA, 14 bp, Homo sapiens
ctctggaccagcct

SEQ ID NO: 1108461 - DNA, 19 bp, Homo sapiens
ctctggacctcaggagggc

SEQ ID NO: 1108462 - DNA, 23 bp, Homo sapiens
ctctggacctcaggagggcaggc

SEQ ID NO: 1108463 - DNA, 16 bp, Homo sapiens
ctctggacggcaggct

SEQ ID NO: 1108464 - DNA, 18 bp, Homo sapiens
ctctggacggcaggctca

SEQ ID NO: 1108465 - DNA, 16 bp, Homo sapiens
ctctggactggcctgt

SEQ ID NO: 1108466 - DNA, 13 bp, Homo sapiens
ctctggactggct

SEQ ID NO: 1108467 - DNA, 18 bp, Homo sapiens
ctctggagcagccaaggc

SEQ ID NO: 1108468 - DNA, 10 bp, Homo sapiens
ctctggagcc

SEQ ID NO: 1108469 - DNA, 19 bp, Homo sapiens
ctctggagccaagtccaga

SEQ ID NO: 1108470 - DNA, 12 bp, Homo sapiens
ctctggagcccc

SEQ ID NO: 1108471 - DNA, 15 bp, Homo sapiens
ctctggagcccctcc

SEQ ID NO: 1108472 - DNA, 13 bp, Homo sapiens
ctctggagcccta

SEQ ID NO: 1108473 - DNA, 16 bp, Homo sapiens
ctctggaggggagggg

SEQ ID NO: 1108474 - DNA, 14 bp, Homo sapiens
ctctggagtggcca

SEQ ID NO: 1108475 - DNA, 16 bp, Homo sapiens
ctctggagtggccact

SEQ ID NO: 1108476 - DNA, 16 bp, Homo sapiens
ctctggatcctgcact

SEQ ID NO: 1108477 - DNA, 15 bp, Homo sapiens
ctctggatgaaggca

SEQ ID NO: 1108478 - DNA, 21 bp, Homo sapiens
ctctggatgatggattccaca

SEQ ID NO: 1108479 - DNA, 15 bp, Homo sapiens
ctctggattcagcct

SEQ ID NO: 1108480 - DNA, 21 bp, Homo sapiens
ctctggattcagccttctttt

SEQ ID NO: 1108481 - DNA, 15 bp, Homo sapiens
ctctggcaaatgatg

SEQ ID NO: 1108482 - DNA, 11 bp, Homo sapiens
ctctggcacag

SEQ ID NO: 1108483 - DNA, 20 bp, Homo sapiens
ctctggcacagtgatgccgg

SEQ ID NO: 1108484 - DNA, 14 bp, Homo sapiens
ctctggcacttcca

SEQ ID NO: 1108485 - DNA, 17 bp, Homo sapiens
ctctggccaaatatgca

SEQ ID NO: 1108486 - DNA, 11 bp, Homo sapiens
ctctggccacc

SEQ ID NO: 1108487 - DNA, 18 bp, Homo sapiens
ctctggccaccctggccc

SEQ ID NO: 1108488 - DNA, 10 bp, Homo sapiens
ctctggccag

SEQ ID NO: 1108489 - DNA, 15 bp, Homo sapiens
ctctggccaggatgg

SEQ ID NO: 1108490 - DNA, 12 bp, Homo sapiens
ctctggcccaga

SEQ ID NO: 1108491 - DNA, 16 bp, Homo sapiens
ctctggccctcggtgg

SEQ ID NO: 1108492 - DNA, 14 bp, Homo sapiens
ctctggccctgcct

SEQ ID NO: 1108493 - DNA, 18 bp, Homo sapiens
ctctggccctgccttctt

SEQ ID NO: 1108494 - DNA, 16 bp, Homo sapiens
ctctggccctggccct

SEQ ID NO: 1108495 - DNA, 20 bp, Homo sapiens
ctctggccctggcccttact

SEQ ID NO: 1108496 - DNA, 11 bp, Homo sapiens
ctctggccctt

SEQ ID NO: 1108497 - DNA, 14 bp, Homo sapiens
ctctggcccttgga

SEQ ID NO: 1108498 - DNA, 17 bp, Homo sapiens
ctctggcccttggaata

SEQ ID NO: 1108499 - DNA, 18 bp, Homo sapiens
ctctggcctcagccgact

SEQ ID NO: 1108500 - DNA, 15 bp, Homo sapiens
ctctggcctcccacc

SEQ ID NO: 1108501 - DNA, 15 bp, Homo sapiens
ctctggcggcttcct

SEQ ID NO: 1108502 - DNA, 20 bp, Homo sapiens
ctctggcggcttcctgtcca

SEQ ID NO: 1108503 - DNA, 22 bp, Homo sapiens
ctctggcggcttcctgtccact

SEQ ID NO: 1108504 - DNA, 18 bp, Homo sapiens
ctctggcggtggccacag

SEQ ID NO: 1108505 - DNA, 23 bp, Homo sapiens
ctctggcggtggccacagcgtgc

SEQ ID NO: 1108506 - DNA, 14 bp, Homo sapiens
ctctggcgtgtggg

SEQ ID NO: 1108507 - DNA, 16 bp, Homo sapiens
ctctggctagaggcca

SEQ ID NO: 1108508 - DNA, 22 bp, Homo sapiens
ctctggctccagctggccggga

SEQ ID NO: 1108509 - DNA, 16 bp, Homo sapiens
ctctggctgaaccctg

SEQ ID NO: 1108510 - DNA, 19 bp, Homo sapiens
ctctggctgaaccctgtgc

SEQ ID NO: 1108511 - DNA, 22 bp, Homo sapiens
ctctggctgtctgtctgcagtg

SEQ ID NO: 1108512 - DNA, 18 bp, Homo sapiens
ctctggcttccaggtatc

SEQ ID NO: 1108513 - DNA, 23 bp, Homo sapiens
ctctggcttcccatagtggggcc

SEQ ID NO: 1108514 - DNA, 22 bp, Homo sapiens
ctctggcttccctaaactgcag

SEQ ID NO: 1108515 - DNA, 23 bp, Homo sapiens
ctctggcttctctcctcagactt

SEQ ID NO: 1108516 - DNA, 19 bp, Homo sapiens
ctctggcttgccccaggac

SEQ ID NO: 1108517 - DNA, 10 bp, Homo sapiens
ctctggcttt

SEQ ID NO: 1108518 - DNA, 13 bp, Homo sapiens
ctctgggaacctc

SEQ ID NO: 1108519 - DNA, 19 bp, Homo sapiens
ctctgggaacctcccagag

SEQ ID NO: 1108520 - DNA, 23 bp, Homo sapiens
ctctgggaacctcccagaggtcc

SEQ ID NO: 1108521 - DNA, 12 bp, Homo sapiens
ctctgggagaaa

SEQ ID NO: 1108522 - DNA, 17 bp, Homo sapiens
ctctgggagaggatttt

SEQ ID NO: 1108523 - DNA, 13 bp, Homo sapiens
ctctgggcacagt

SEQ ID NO: 1108524 - DNA, 22 bp, Homo sapiens
ctctgggcacgcctgctggccg

SEQ ID NO: 1108525 - DNA, 15 bp, Homo sapiens
ctctgggcagcctgc

SEQ ID NO: 1108526 - DNA, 19 bp, Homo sapiens
ctctgggcagcctgctttg

SEQ ID NO: 1108527 - DNA, 21 bp, Homo sapiens
ctctgggcagcctgctttggc

SEQ ID NO: 1108528 - DNA, 17 bp, Homo sapiens
ctctgggccacttggag

SEQ ID NO: 1108529 - DNA, 23 bp, Homo sapiens
ctctgggccatgccaggccagag

SEQ ID NO: 1108530 - DNA, 13 bp, Homo sapiens
ctctgggcctctt

SEQ ID NO: 1108531 - DNA, 13 bp, Homo sapiens
ctctgggcctggg

SEQ ID NO: 1108532 - DNA, 14 bp, Homo sapiens
ctctgggcctgtgt

SEQ ID NO: 1108533 - DNA, 15 bp, Homo sapiens
ctctgggcctgtgtg

SEQ ID NO: 1108534 - DNA, 21 bp, Homo sapiens
ctctgggcctttgtttccttg

SEQ ID NO: 1108535 - DNA, 16 bp, Homo sapiens
ctctgggctatggaca

SEQ ID NO: 1108536 - DNA, 14 bp, Homo sapiens
ctctgggctcaggg

SEQ ID NO: 1108537 - DNA, 18 bp, Homo sapiens
ctctgggctcagggctgg

SEQ ID NO: 1108538 - DNA, 20 bp, Homo sapiens
ctctgggctcagggctggag

SEQ ID NO: 1108539 - DNA, 12 bp, Homo sapiens
ctctgggctgag

SEQ ID NO: 1108540 - DNA, 13 bp, Homo sapiens
ctctgggctgagg

SEQ ID NO: 1108541 - DNA, 23 bp, Homo sapiens
ctctgggctgtaacgtggcactg

SEQ ID NO: 1108542 - DNA, 23 bp, Homo sapiens
ctctggggaagtcaggggagaag

SEQ ID NO: 1108543 - DNA, 19 bp, Homo sapiens
ctctggggacagcttcctc

SEQ ID NO: 1108544 - DNA, 23 bp, Homo sapiens
ctctggggacagcttcctcacac

SEQ ID NO: 1108545 - DNA, 13 bp, Homo sapiens
ctctggggaccct

SEQ ID NO: 1108546 - DNA, 15 bp, Homo sapiens
ctctggggatgggtg

SEQ ID NO: 1108547 - DNA, 18 bp, Homo sapiens
ctctggggatgggtgggg

SEQ ID NO: 1108548 - DNA, 18 bp, Homo sapiens
ctctggggatttctggga

SEQ ID NO: 1108549 - DNA, 19 bp, Homo sapiens
ctctggggatttctgggat

SEQ ID NO: 1108550 - DNA, 14 bp, Homo sapiens
ctctggggcagatc

SEQ ID NO: 1108551 - DNA, 16 bp, Homo sapiens
ctcttctgtgcccagg

SEQ ID NO: 1108552 - DNA, 19 bp, Homo sapiens
ctcttcttatacagataaa

SEQ ID NO: 1108553 - DNA, 15 bp, Homo sapiens
ctcttcttccccttt

SEQ ID NO: 1108554 - DNA, 20 bp, Homo sapiens
ctcttcttgaaattttaacc

SEQ ID NO: 1108555 - DNA, 17 bp, Homo sapiens
ctcttctttagaacagg

SEQ ID NO: 1108556 - DNA, 22 bp, Homo sapiens
ctcttctttatactgtaattta

SEQ ID NO: 1108557 - DNA, 21 bp, Homo sapiens
ctcttctttattgcactagga

SEQ ID NO: 1108558 - DNA, 15 bp, Homo sapiens
ctcttctttccattc

SEQ ID NO: 1108559 - DNA, 16 bp, Homo sapiens
ctcttcttttggcttc

SEQ ID NO: 1108560 - DNA, 12 bp, Homo sapiens
ctcttgaaacct

SEQ ID NO: 1108561 - DNA, 17 bp, Homo sapiens
ctcttgaaacctgttaa

SEQ ID NO: 1108562 - DNA, 18 bp, Homo sapiens
ctcttgaaatattcagaa

SEQ ID NO: 1108563 - DNA, 20 bp, Homo sapiens
ctcttgaaatattcagaaat

SEQ ID NO: 1108564 - DNA, 17 bp, Homo sapiens
ctcttgaaatgtagaat

SEQ ID NO: 1108565 - DNA, 18 bp, Homo sapiens
ctcttgaagtcacaccag

SEQ ID NO: 1108566 - DNA, 15 bp, Homo sapiens
ctcttgaccaggctg

SEQ ID NO: 1108567 - DNA, 13 bp, Homo sapiens
ctcttgaccctgc

SEQ ID NO: 1108568 - DNA, 21 bp, Homo sapiens
ctcttgaccctgcaccctcct

SEQ ID NO: 1108569 - DNA, 18 bp, Homo sapiens
ctcttgagcagtggctgg

SEQ ID NO: 1108570 - DNA, 21 bp, Homo sapiens
ctcttgagcatcaatcttgtt

SEQ ID NO: 1108571 - DNA, 14 bp, Homo sapiens
ctcttgagcctggg

SEQ ID NO: 1108572 - DNA, 17 bp, Homo sapiens
ctcttgagccttgaact

SEQ ID NO: 1108573 - DNA, 13 bp, Homo sapiens
ctcttgagctggc

SEQ ID NO: 1108574 - DNA, 15 bp, Homo sapiens
ctcttgagctggcct

SEQ ID NO: 1108575 - DNA, 17 bp, Homo sapiens
ctcttgaggaagcccag

SEQ ID NO: 1108576 - DNA, 18 bp, Homo sapiens
ctcttgaggaagcccagg

SEQ ID NO: 1108577 - DNA, 19 bp, Homo sapiens
ctcttgagttcctctgcag

SEQ ID NO: 1108578 - DNA, 16 bp, Homo sapiens
ctcttgattaagggct

SEQ ID NO: 1108579 - DNA, 21 bp, Homo sapiens
ctcttgattatccatattgag

SEQ ID NO: 1108580 - DNA, 15 bp, Homo sapiens
ctcttgattcctggt

SEQ ID NO: 1108581 - DNA, 16 bp, Homo sapiens
ctcttgattcctggtt

SEQ ID NO: 1108582 - DNA, 21 bp, Homo sapiens
ctcttgcacagtcactgctct

SEQ ID NO: 1108583 - DNA, 16 bp, Homo sapiens
ctcttgcaccaaatta

SEQ ID NO: 1108584 - DNA, 20 bp, Homo sapiens
ctcttgcaccaaattatctt

SEQ ID NO: 1108585 - DNA, 13 bp, Homo sapiens
ctcttgcacccgc

SEQ ID NO: 1108586 - DNA, 14 bp, Homo sapiens
ctcttgcaggctga

SEQ ID NO: 1108587 - DNA, 17 bp, Homo sapiens
ctcttgccactgcctct

SEQ ID NO: 1108588 - DNA, 18 bp, Homo sapiens
ctcttgccactgcctctt

SEQ ID NO: 1108589 - DNA, 18 bp, Homo sapiens
ctcttgccagcctccttg

SEQ ID NO: 1108590 - DNA, 13 bp, Homo sapiens
ctcttgccatcct

SEQ ID NO: 1108591 - DNA, 19 bp, Homo sapiens
ctcttgccatcctgatgga

SEQ ID NO: 1108592 - DNA, 20 bp, Homo sapiens
ctcttgcccatcctgactga

SEQ ID NO: 1108593 - DNA, 13 bp, Homo sapiens
ctcttgcccccca

SEQ ID NO: 1108594 - DNA, 20 bp, Homo sapiens
ctcttgccccccaccccagc

SEQ ID NO: 1108595 - DNA, 13 bp, Homo sapiens
ctcttgccccttg

SEQ ID NO: 1108596 - DNA, 24 bp, Homo sapiens
ctcttgccccttgtcctgaagccc

SEQ ID NO: 1108597 - DNA, 18 bp, Homo sapiens
ctcttgcccgtcggccct

SEQ ID NO: 1108598 - DNA, 20 bp, Homo sapiens
ctcttgcccgtcggccctgc

SEQ ID NO: 1108599 - DNA, 23 bp, Homo sapiens
ctcttgcccgtcggccctgcgtc

SEQ ID NO: 1108600 - DNA, 17 bp, Homo sapiens
ctcttgcccttccctgt

SEQ ID NO: 1108601 - DNA, 22 bp, Homo sapiens
ctcttgcccttccctgtccctc

SEQ ID NO: 1108602 - DNA, 13 bp, Homo sapiens
ctcttgcctctct

SEQ ID NO: 1108603 - DNA, 14 bp, Homo sapiens
ctcttgcgggcctg

SEQ ID NO: 1108604 - DNA, 19 bp, Homo sapiens
ctcttgctcaaaaatctgt

SEQ ID NO: 1108605 - DNA, 12 bp, Homo sapiens
ctcttgctcttt

SEQ ID NO: 1108606 - DNA, 13 bp, Homo sapiens
ctcttgctctttc

SEQ ID NO: 1108607 - DNA, 15 bp, Homo sapiens
ctcttgctctttcta

SEQ ID NO: 1108608 - DNA, 15 bp, Homo sapiens
ctcttgctgtctctg

SEQ ID NO: 1108609 - DNA, 18 bp, Homo sapiens
ctcttgctgtctctgctc

SEQ ID NO: 1108610 - DNA, 19 bp, Homo sapiens
ctcttgctgtctctgctcg

SEQ ID NO: 1108611 - DNA, 14 bp, Homo sapiens
ctcttgctttctat

SEQ ID NO: 1108612 - DNA, 12 bp, Homo sapiens
ctcttggacctc

SEQ ID NO: 1108613 - DNA, 17 bp, Homo sapiens
ctcttggacctctgctc

SEQ ID NO: 1108614 - DNA, 14 bp, Homo sapiens
ctcttggagaaaat

SEQ ID NO: 1108615 - DNA, 15 bp, Homo sapiens
ctcttggagaagtct

SEQ ID NO: 1108616 - DNA, 16 bp, Homo sapiens
ctcttggagcctcttt

SEQ ID NO: 1108617 - DNA, 17 bp, Homo sapiens
ctcttggagcctctttt

SEQ ID NO: 1108618 - DNA, 20 bp, Homo sapiens
ctcttggataccagctcagg

SEQ ID NO: 1108619 - DNA, 22 bp, Homo sapiens
ctcttggataccagctcagggg

SEQ ID NO: 1108620 - DNA, 15 bp, Homo sapiens
ctcttggattaagga

SEQ ID NO: 1108621 - DNA, 15 bp, Homo sapiens
ctcttggctgacccc

SEQ ID NO: 1108622 - DNA, 22 bp, Homo sapiens
ctcttggctgacccctctggtg

SEQ ID NO: 1108623 - DNA, 12 bp, Homo sapiens
ctcttggcttct

SEQ ID NO: 1108624 - DNA, 14 bp, Homo sapiens
ctcttggcttctca

SEQ ID NO: 1108625 - DNA, 21 bp, Homo sapiens
ctcttggcttctcagcccctt

SEQ ID NO: 1108626 - DNA, 21 bp, Homo sapiens
ctcttgggaactgaactcact

SEQ ID NO: 1108627 - DNA, 18 bp, Homo sapiens
ctcttgggcaggcagaga

SEQ ID NO: 1108628 - DNA, 15 bp, Homo sapiens
ctcttggtcccatgg

SEQ ID NO: 1108629 - DNA, 19 bp, Homo sapiens
ctcttggtccctggaagct

SEQ ID NO: 1108630 - DNA, 21 bp, Homo sapiens
ctcttggtgggtgtggccagc

SEQ ID NO: 1108631 - DNA, 22 bp, Homo sapiens
ctcttggtgtgattgcacagaa

SEQ ID NO: 1108632 - DNA, 22 bp, Homo sapiens
ctcttgtaaagactggttttct

SEQ ID NO: 1108633 - DNA, 17 bp, Homo sapiens
ctcttgtaaataaagcc

SEQ ID NO: 1108634 - DNA, 23 bp, Homo sapiens
ctcttgtaaataaagccctggga

SEQ ID NO: 1108635 - DNA, 21 bp, Homo sapiens
ctcttgtaagtcatctactta

SEQ ID NO: 1108636 - DNA, 12 bp, Homo sapiens
ctcttgtagaag

SEQ ID NO: 1108637 - DNA, 15 bp, Homo sapiens
ctcttgtatacttgt

SEQ ID NO: 1108638 - DNA, 14 bp, Homo sapiens
ctcttgtcccacgt

SEQ ID NO: 1108639 - DNA, 18 bp, Homo sapiens
ctcttgtcccacgtgtct

SEQ ID NO: 1108640 - DNA, 16 bp, Homo sapiens
ctcttgtccctttccc

SEQ ID NO: 1108641 - DNA, 18 bp, Homo sapiens
ctcttgtccctttcccta

SEQ ID NO: 1108642 - DNA, 20 bp, Homo sapiens
ctcttgtccctttccctacc

SEQ ID NO: 1108643 - DNA, 13 bp, Homo sapiens
ctcttgtcctggc

SEQ ID NO: 1108644 - DNA, 18 bp, Homo sapiens
ctcttgtcctggcccttc

SEQ ID NO: 1108645 - DNA, 20 bp, Homo sapiens
ctcttgtcctggcccttcag

SEQ ID NO: 1108646 - DNA, 23 bp, Homo sapiens
ctcttgtcctggcccttcagtct

SEQ ID NO: 1108647 - DNA, 12 bp, Homo sapiens
ctcttgtcctgt

SEQ ID NO: 1108648 - DNA, 20 bp, Homo sapiens
ctcttgtgacgtgcactgtg

SEQ ID NO: 1108649 - DNA, 14 bp, Homo sapiens
ctcttgtgatttct

SEQ ID NO: 1108650 - DNA, 17 bp, Homo sapiens
ctcttgtgatttcttta

SEQ ID NO: 1108651 - DNA, 14 bp, Homo sapiens
ctcttgtgatttgg

SEQ ID NO: 1108652 - DNA, 19 bp, Homo sapiens
ctcttgtgatttggttgca

SEQ ID NO: 1108653 - DNA, 20 bp, Homo sapiens
ctcttgtgcaaggtggcctt

SEQ ID NO: 1108654 - DNA, 16 bp, Homo sapiens
ctcttgtgttcgtgtt

SEQ ID NO: 1108655 - DNA, 13 bp, Homo sapiens
ctcttgttgcaga

SEQ ID NO: 1108656 - DNA, 15 bp, Homo sapiens
ctcttgtttcactcc

SEQ ID NO: 1108657 - DNA, 17 bp, Homo sapiens
ctcttgtttctgggtcc

SEQ ID NO: 1108658 - DNA, 21 bp, Homo sapiens
ctcttgtttctgggtccctgc

SEQ ID NO: 1108659 - DNA, 22 bp, Homo sapiens
ctcttgtttctgggtccctgct

SEQ ID NO: 1108660 - DNA, 16 bp, Homo sapiens
ctcttgtttctgtgcc

SEQ ID NO: 1108661 - DNA, 17 bp, Homo sapiens
ctctttaaaaactcact

SEQ ID NO: 1108662 - DNA, 18 bp, Homo sapiens
ctctttaaaaactcactt

SEQ ID NO: 1108663 - DNA, 13 bp, Homo sapiens
ctctttaaaatat

SEQ ID NO: 1108664 - DNA, 17 bp, Homo sapiens
ctctttaaatcaagtcc

SEQ ID NO: 1108665 - DNA, 17 bp, Homo sapiens
ctctttaacatacaaga

SEQ ID NO: 1108666 - DNA, 13 bp, Homo sapiens
ctctttaactgtg

SEQ ID NO: 1108667 - DNA, 21 bp, Homo sapiens
ctctttaagagttagtttctt

SEQ ID NO: 1108668 - DNA, 16 bp, Homo sapiens
ctctttaagttttgat

SEQ ID NO: 1108669 - DNA, 14 bp, Homo sapiens
ctctttaataaatt

SEQ ID NO: 1108670 - DNA, 17 bp, Homo sapiens
ctctttaatgctgtctt

SEQ ID NO: 1108671 - DNA, 18 bp, Homo sapiens
ctctttaatgctgtcttt

SEQ ID NO: 1108672 - DNA, 19 bp, Homo sapiens
ctctttaatgctgtctttg

SEQ ID NO: 1108673 - DNA, 15 bp, Homo sapiens
ctgaagcagcctctc

SEQ ID NO: 1108674 - DNA, 13 bp, Homo sapiens
ctgaagcatgttt

SEQ ID NO: 1108675 - DNA, 18 bp, Homo sapiens
ctgaagcatgtttcatgt

SEQ ID NO: 1108676 - DNA, 18 bp, Homo sapiens
ctgaagccacttggccca

SEQ ID NO: 1108677 - DNA, 19 bp, Homo sapiens
ctgaagccacttggcccag

SEQ ID NO: 1108678 - DNA, 12 bp, Homo sapiens
ctgaagccagat

SEQ ID NO: 1108679 - DNA, 15 bp, Homo sapiens
ctgaagccagatcca

SEQ ID NO: 1108680 - DNA, 12 bp, Homo sapiens
ctgaagcccccc

SEQ ID NO: 1108681 - DNA, 15 bp, Homo sapiens
ctgaagcctccgtgg

SEQ ID NO: 1108682 - DNA, 17 bp, Homo sapiens
ctgaagcctccgtggaa

SEQ ID NO: 1108683 - DNA, 17 bp, Homo sapiens
ctgaagcctctgccctg

SEQ ID NO: 1108684 - DNA, 21 bp, Homo sapiens
ctgaagcctctgccctgcctc

SEQ ID NO: 1108685 - DNA, 23 bp, Homo sapiens
ctgaagcctctgccctgcctccc

SEQ ID NO: 1108686 - DNA, 14 bp, Homo sapiens
ctgaagccttcttc

SEQ ID NO: 1108687 - DNA, 16 bp, Homo sapiens
ctgaagccttcttctg

SEQ ID NO: 1108688 - DNA, 21 bp, Homo sapiens
ctgaagccttcttctgccact

SEQ ID NO: 1108689 - DNA, 21 bp, Homo sapiens
ctgaagcgactctcctgtttg

SEQ ID NO: 1108690 - DNA, 22 bp, Homo sapiens
ctgaagctcgcatccagacagt

SEQ ID NO: 1108691 - DNA, 13 bp, Homo sapiens
ctgaagctgctgt

SEQ ID NO: 1108692 - DNA, 14 bp, Homo sapiens
ctgaagctggagca

SEQ ID NO: 1108693 - DNA, 17 bp, Homo sapiens
ctgaagctggagcagcg

SEQ ID NO: 1108694 - DNA, 18 bp, Homo sapiens
ctgaagctggagcagcgg

SEQ ID NO: 1108695 - DNA, 11 bp, Homo sapiens
ctgaaggaaaa

SEQ ID NO: 1108696 - DNA, 16 bp, Homo sapiens
ctgaaggaatagccag

SEQ ID NO: 1108697 - DNA, 18 bp, Homo sapiens
ctgaaggaatagccagag

SEQ ID NO: 1108698 - DNA, 19 bp, Homo sapiens
ctgaaggaatagccagaga

SEQ ID NO: 1108699 - DNA, 18 bp, Homo sapiens
ctgaaggacacttcctgc

SEQ ID NO: 1108700 - DNA, 19 bp, Homo sapiens
ctgaaggacacttcctgcc

SEQ ID NO: 1108701 - DNA, 13 bp, Homo sapiens
ctgaaggactgga

SEQ ID NO: 1108702 - DNA, 17 bp, Homo sapiens
ctgaaggctaaaaagca

SEQ ID NO: 1108703 - DNA, 22 bp, Homo sapiens
ctgaaggctaaaaagcaacagg

SEQ ID NO: 1108704 - DNA, 15 bp, Homo sapiens
ctgaagggaaggcaa

SEQ ID NO: 1108705 - DNA, 21 bp, Homo sapiens
ctgaagggaaggcaaaggcag

SEQ ID NO: 1108706 - DNA, 14 bp, Homo sapiens
ctgaaggggcacac

SEQ ID NO: 1108707 - DNA, 18 bp, Homo sapiens
ctgaaggggtgcacccac

SEQ ID NO: 1108708 - DNA, 20 bp, Homo sapiens
ctgaaggtattggcctgttc

SEQ ID NO: 1108709 - DNA, 20 bp, Homo sapiens
ctgaagtacttaaacttcca

SEQ ID NO: 1108710 - DNA, 19 bp, Homo sapiens
ctgaagtcacatcacagga

SEQ ID NO: 1108711 - DNA, 14 bp, Homo sapiens
ctgaagtcactgca

SEQ ID NO: 1108712 - DNA, 22 bp, Homo sapiens
ctgaagtccaaattgtttgtac

SEQ ID NO: 1108713 - DNA, 13 bp, Homo sapiens
ctgaagtctcttt

SEQ ID NO: 1108714 - DNA, 14 bp, Homo sapiens
ctgaagtgcatcca

SEQ ID NO: 1108715 - DNA, 17 bp, Homo sapiens
ctgaagtgcatccaaag

SEQ ID NO: 1108716 - DNA, 18 bp, Homo sapiens
ctgaagtggccctccctc

SEQ ID NO: 1108717 - DNA, 18 bp, Homo sapiens
ctgaagtgggaaaaaata

SEQ ID NO: 1108718 - DNA, 16 bp, Homo sapiens
ctgaagttaacagaga

SEQ ID NO: 1108719 - DNA, 23 bp, Homo sapiens
ctgaagttagaaataagaatggt

SEQ ID NO: 1108720 - DNA, 13 bp, Homo sapiens
ctgaagttctgag

SEQ ID NO: 1108721 - DNA, 18 bp, Homo sapiens
ctgaataaaaaagattct

SEQ ID NO: 1108722 - DNA, 20 bp, Homo sapiens
ctgaataaaaaagattctac

SEQ ID NO: 1108723 - DNA, 11 bp, Homo sapiens
ctgaataataa

SEQ ID NO: 1108724 - DNA, 21 bp, Homo sapiens
ctgaataatatcaaataaaat

SEQ ID NO: 1108725 - DNA, 16 bp, Homo sapiens
ctgaataatgctacca

SEQ ID NO: 1108726 - DNA, 13 bp, Homo sapiens
ctgaatacacagt

SEQ ID NO: 1108727 - DNA, 17 bp, Homo sapiens
ctgaatacacagtattc

SEQ ID NO: 1108728 - DNA, 21 bp, Homo sapiens
ctgaatacacagtattcagag

SEQ ID NO: 1108729 - DNA, 16 bp, Homo sapiens
ctgaatacattctgct

SEQ ID NO: 1108730 - DNA, 21 bp, Homo sapiens
ctgaataccactctgtaattg

SEQ ID NO: 1108731 - DNA, 15 bp, Homo sapiens
ctgaatagatatgaa

SEQ ID NO: 1108732 - DNA, 15 bp, Homo sapiens
ctgaatagcagaagg

SEQ ID NO: 1108733 - DNA, 17 bp, Homo sapiens
ctgaatatacagcaggt

SEQ ID NO: 1108734 - DNA, 18 bp, Homo sapiens
ctgaatatataaacactc

SEQ ID NO: 1108735 - DNA, 19 bp, Homo sapiens
ctgaatatctgttcacttt

SEQ ID NO: 1108736 - DNA, 21 bp, Homo sapiens
ctgaatattgccattatgctt

SEQ ID NO: 1108737 - DNA, 16 bp, Homo sapiens
ctgaatatttatattt

SEQ ID NO: 1108738 - DNA, 12 bp, Homo sapiens
ctgaatatttta

SEQ ID NO: 1108739 - DNA, 15 bp, Homo sapiens
ctgaatattttggaa

SEQ ID NO: 1108740 - DNA, 12 bp, Homo sapiens
ctgaatattttt

SEQ ID NO: 1108741 - DNA, 12 bp, Homo sapiens
ctgaatcactgt

SEQ ID NO: 1108742 - DNA, 20 bp, Homo sapiens
ctgaatcagccagtctcaga

SEQ ID NO: 1108743 - DNA, 16 bp, Homo sapiens
ctgaatcatgttaata

SEQ ID NO: 1108744 - DNA, 20 bp, Homo sapiens
ctgaatcctggtaattaaaa

SEQ ID NO: 1108745 - DNA, 16 bp, Homo sapiens
ctgaatctaaaataaa

SEQ ID NO: 1108746 - DNA, 17 bp, Homo sapiens
ctgaatctgctaccaaa

SEQ ID NO: 1108747 - DNA, 14 bp, Homo sapiens
ctgaatctgtacat

SEQ ID NO: 1108748 - DNA, 18 bp, Homo sapiens
ctgaatctgtgcaaacag

SEQ ID NO: 1108749 - DNA, 16 bp, Homo sapiens
ctgaatctgtgcctgc

SEQ ID NO: 1108750 - DNA, 22 bp, Homo sapiens
ctgaatcttttttttatataaa

SEQ ID NO: 1108751 - DNA, 16 bp, Homo sapiens
ctgaatgatcttgtgt

SEQ ID NO: 1108752 - DNA, 15 bp, Homo sapiens
ctgaatgcctcctgt

SEQ ID NO: 1108753 - DNA, 18 bp, Homo sapiens
ctgaatgcctcctgtggg

SEQ ID NO: 1108754 - DNA, 20 bp, Homo sapiens
ctgaatgcctcctgtgggga

SEQ ID NO: 1108755 - DNA, 13 bp, Homo sapiens
ctgaatgcttcta

SEQ ID NO: 1108756 - DNA, 18 bp, Homo sapiens
ctgaatgcttctaagtaa

SEQ ID NO: 1108757 - DNA, 20 bp, Homo sapiens
ctgaatgcttctaagtaaat

SEQ ID NO: 1108758 - DNA, 16 bp, Homo sapiens
ctgaatggactaagat

SEQ ID NO: 1108759 - DNA, 19 bp, Homo sapiens
ctgaatgggcaattccaga

SEQ ID NO: 1108760 - DNA, 19 bp, Homo sapiens
ctgaatggttttcaaaata

SEQ ID NO: 1108761 - DNA, 13 bp, Homo sapiens
ctgaatgtatgta

SEQ ID NO: 1108762 - DNA, 15 bp, Homo sapiens
ctgaatgtatgtaaa

SEQ ID NO: 1108763 - DNA, 13 bp, Homo sapiens
ctgaatgtgccta

SEQ ID NO: 1108764 - DNA, 11 bp, Homo sapiens
ctgaatgttct

SEQ ID NO: 1108765 - DNA, 14 bp, Homo sapiens
ctgaatgttctgac

SEQ ID NO: 1108766 - DNA, 16 bp, Homo sapiens
ctgaatgttctgacat

SEQ ID NO: 1108767 - DNA, 18 bp, Homo sapiens
ctgaatgttctgacatta

SEQ ID NO: 1108768 - DNA, 20 bp, Homo sapiens
ctgaatgttctgacattaac

SEQ ID NO: 1108769 - DNA, 22 bp, Homo sapiens
ctgaatgttctgacattaacag

SEQ ID NO: 1108770 - DNA, 18 bp, Homo sapiens
ctgaatgtttattccttg

SEQ ID NO: 1108771 - DNA, 19 bp, Homo sapiens
ctgaatgtttattccttga

SEQ ID NO: 1108772 - DNA, 20 bp, Homo sapiens
ctgaatgtttgtttcagtgc

SEQ ID NO: 1108773 - DNA, 17 bp, Homo sapiens
ctgaatgttttatttat

SEQ ID NO: 1108774 - DNA, 22 bp, Homo sapiens
ctgaattaaaagcccactgtgg

SEQ ID NO: 1108775 - DNA, 16 bp, Homo sapiens
ctgaattaaaatggtt

SEQ ID NO: 1108776 - DNA, 18 bp, Homo sapiens
ctgaattaaacatgaaag

SEQ ID NO: 1108777 - DNA, 22 bp, Homo sapiens
ctgaattacagtgaaattttgg

SEQ ID NO: 1108778 - DNA, 23 bp, Homo sapiens
ctgaattacagtgaaattttggt

SEQ ID NO: 1108779 - DNA, 17 bp, Homo sapiens
ctgaattatctatttca

SEQ ID NO: 1108780 - DNA, 23 bp, Homo sapiens
ctgaattcctttacaactaaata

SEQ ID NO: 1108781 - DNA, 23 bp, Homo sapiens
ctgaattctatttgctgggcttt

SEQ ID NO: 1108782 - DNA, 15 bp, Homo sapiens
ctgaatttcaggcat

SEQ ID NO: 1108783 - DNA, 13 bp, Homo sapiens
ctgaatttccttt

SEQ ID NO: 1108784 - DNA, 14 bp, Homo sapiens
ctgaatttcttttg

SEQ ID NO: 1108785 - DNA, 19 bp, Homo sapiens
ctgaatttgggcctcttgt

SEQ ID NO: 1108786 - DNA, 22 bp, Homo sapiens
ctgaatttgtaagcaacttgct

SEQ ID NO: 1108787 - DNA, 18 bp, Homo sapiens
ctgaattttaaatgttca

SEQ ID NO: 1108788 - DNA, 20 bp, Homo sapiens
ctgaattttaaatgttcaca

SEQ ID NO: 1108789 - DNA, 18 bp, Homo sapiens
ctgaatttttaaacaagt

SEQ ID NO: 1108790 - DNA, 20 bp, Homo sapiens
ctgaatttttttgtaataag

SEQ ID NO: 1108791 - DNA, 18 bp, Homo sapiens
ctgacaaaaagtttccat

SEQ ID NO: 1108792 - DNA, 22 bp, Homo sapiens
ctgacaaagtcatcccctctca

SEQ ID NO: 1108793 - DNA, 23 bp, Homo sapiens
ctgacaaagtcatcccctctcag

SEQ ID NO: 1108794 - DNA, 14 bp, Homo sapiens
ctgacaaattttaa

SEQ ID NO: 1108795 - DNA, 23 bp, Homo sapiens
ctgagaccacccccaaacacaaa

SEQ ID NO: 1108796 - DNA, 19 bp, Homo sapiens
ctgagaccagttgggagca

SEQ ID NO: 1108797 - DNA, 18 bp, Homo sapiens
ctgagacccttttctcag

SEQ ID NO: 1108798 - DNA, 17 bp, Homo sapiens
ctgagacgggcatcgca

SEQ ID NO: 1108799 - DNA, 18 bp, Homo sapiens
ctgagactaatcttattc

SEQ ID NO: 1108800 - DNA, 19 bp, Homo sapiens
ctgagactcacactctctg

SEQ ID NO: 1108801 - DNA, 22 bp, Homo sapiens
ctgagactcacactctctgcag

SEQ ID NO: 1108802 - DNA, 20 bp, Homo sapiens
ctgagactcacaggaaggag

SEQ ID NO: 1108803 - DNA, 13 bp, Homo sapiens
ctgagactccaga

SEQ ID NO: 1108804 - DNA, 14 bp, Homo sapiens
ctgagactccagaa

SEQ ID NO: 1108805 - DNA, 20 bp, Homo sapiens
ctgagactgggtaatttata

SEQ ID NO: 1108806 - DNA, 22 bp, Homo sapiens
ctgagactgggtaatttataaa

SEQ ID NO: 1108807 - DNA, 15 bp, Homo sapiens
ctgagacttgttctt

SEQ ID NO: 1108808 - DNA, 17 bp, Homo sapiens
ctgagacttgttcttgg

SEQ ID NO: 1108809 - DNA, 18 bp, Homo sapiens
ctgagagaattggctcaa

SEQ ID NO: 1108810 - DNA, 17 bp, Homo sapiens
ctgagagacccaaggag

SEQ ID NO: 1108811 - DNA, 19 bp, Homo sapiens
ctgagagacccaaggagga

SEQ ID NO: 1108812 - DNA, 20 bp, Homo sapiens
ctgagagacccaaggaggaa

SEQ ID NO: 1108813 - DNA, 16 bp, Homo sapiens
ctgagagaccctggcc

SEQ ID NO: 1108814 - DNA, 18 bp, Homo sapiens
ctgagagaccctggcctc

SEQ ID NO: 1108815 - DNA, 22 bp, Homo sapiens
ctgagagagaatagagctgcca

SEQ ID NO: 1108816 - DNA, 18 bp, Homo sapiens
ctgagagagtataaataa

SEQ ID NO: 1108817 - DNA, 19 bp, Homo sapiens
ctgagagatgcagaaatat

SEQ ID NO: 1108818 - DNA, 17 bp, Homo sapiens
ctgagagccccagctga

SEQ ID NO: 1108819 - DNA, 14 bp, Homo sapiens
ctgagagccctgct

SEQ ID NO: 1108820 - DNA, 19 bp, Homo sapiens
ctgagagccctgctgtggg

SEQ ID NO: 1108821 - DNA, 20 bp, Homo sapiens
ctgagagccctgctgtggga

SEQ ID NO: 1108822 - DNA, 13 bp, Homo sapiens
ctgagaggcaggc

SEQ ID NO: 1108823 - DNA, 14 bp, Homo sapiens
ctgagaggcctgga

SEQ ID NO: 1108824 - DNA, 14 bp, Homo sapiens
ctgagaggggaagc

SEQ ID NO: 1108825 - DNA, 17 bp, Homo sapiens
ctgagaggtaagaagta

SEQ ID NO: 1108826 - DNA, 19 bp, Homo sapiens
ctgagagtctgaaagacag

SEQ ID NO: 1108827 - DNA, 20 bp, Homo sapiens
ctgagagtctgaaagacaga

SEQ ID NO: 1108828 - DNA, 22 bp, Homo sapiens
ctgagagtgaaaccatgactgt

SEQ ID NO: 1108829 - DNA, 18 bp, Homo sapiens
ctgagagttggctcaggc

SEQ ID NO: 1108830 - DNA, 19 bp, Homo sapiens
ctgagagttggctcaggca

SEQ ID NO: 1108831 - DNA, 15 bp, Homo sapiens
ctgagagtttcctca

SEQ ID NO: 1108832 - DNA, 18 bp, Homo sapiens
ctgagatacttcccaaag

SEQ ID NO: 1108833 - DNA, 23 bp, Homo sapiens
ctgagatatgaacatattgttga

SEQ ID NO: 1108834 - DNA, 17 bp, Homo sapiens
ctgagatatggcattgc

SEQ ID NO: 1108835 - DNA, 20 bp, Homo sapiens
ctgagatatggcattgcact

SEQ ID NO: 1108836 - DNA, 14 bp, Homo sapiens
ctgagatcccctga

SEQ ID NO: 1108837 - DNA, 21 bp, Homo sapiens
ctgagatcccctgagccccag

SEQ ID NO: 1108838 - DNA, 17 bp, Homo sapiens
ctgagatgcaaatgtca

SEQ ID NO: 1108839 - DNA, 21 bp, Homo sapiens
ctgagatgcaaatgtcacagt

SEQ ID NO: 1108840 - DNA, 18 bp, Homo sapiens
ctgagatgctaatttatt

SEQ ID NO: 1108841 - DNA, 14 bp, Homo sapiens
ctgagatgctcact

SEQ ID NO: 1108842 - DNA, 19 bp, Homo sapiens
ctgagatgctcactttatt

SEQ ID NO: 1108843 - DNA, 23 bp, Homo sapiens
ctgagatggaacccttttggccc

SEQ ID NO: 1108844 - DNA, 17 bp, Homo sapiens
ctgagattgcagatgtg

SEQ ID NO: 1108845 - DNA, 14 bp, Homo sapiens
ctgagattgtgttt

SEQ ID NO: 1108846 - DNA, 23 bp, Homo sapiens
ctgagatttaaatgcaaccagaa

SEQ ID NO: 1108847 - DNA, 21 bp, Homo sapiens
ctgagcaaatgtggctcctgg

SEQ ID NO: 1108848 - DNA, 18 bp, Homo sapiens
ctgagcaacatctcggga

SEQ ID NO: 1108849 - DNA, 12 bp, Homo sapiens
ctgagcaagagc

SEQ ID NO: 1108850 - DNA, 16 bp, Homo sapiens
ctgagcaagagctggc

SEQ ID NO: 1108851 - DNA, 20 bp, Homo sapiens
ctgagcaagagctggcaaag

SEQ ID NO: 1108852 - DNA, 17 bp, Homo sapiens
ctgagcaataacttcta

SEQ ID NO: 1108853 - DNA, 23 bp, Homo sapiens
ctgagcaataacttctatgttgg

SEQ ID NO: 1108854 - DNA, 15 bp, Homo sapiens
ctgagcaatgtctgt

SEQ ID NO: 1108855 - DNA, 19 bp, Homo sapiens
ctgagcaatgtctgtgcta

SEQ ID NO: 1108856 - DNA, 20 bp, Homo sapiens
ctgagcacccagctctgtct

SEQ ID NO: 1108857 - DNA, 14 bp, Homo sapiens
ctgagcaccccctc

SEQ ID NO: 1108858 - DNA, 16 bp, Homo sapiens
ctgagcaccctctccg

SEQ ID NO: 1108859 - DNA, 14 bp, Homo sapiens
ctgagcaccctctg

SEQ ID NO: 1108860 - DNA, 12 bp, Homo sapiens
ctgagcactgtt

SEQ ID NO: 1108861 - DNA, 19 bp, Homo sapiens
ctgagcagaatactggtct

SEQ ID NO: 1108862 - DNA, 11 bp, Homo sapiens
ctgagcagccg

SEQ ID NO: 1108863 - DNA, 19 bp, Homo sapiens
ctgagcagccgccagctgg

SEQ ID NO: 1108864 - DNA, 14 bp, Homo sapiens
ctgagcagcctctg

SEQ ID NO: 1108865 - DNA, 16 bp, Homo sapiens
ctgagcagcctctgga

SEQ ID NO: 1108866 - DNA, 17 bp, Homo sapiens
ctgagcagcctctggac

SEQ ID NO: 1108867 - DNA, 18 bp, Homo sapiens
ctgagcaggacagccagc

SEQ ID NO: 1108868 - DNA, 17 bp, Homo sapiens
ctgagcaggctgtgggg

SEQ ID NO: 1108869 - DNA, 14 bp, Homo sapiens
ctgagcaggggcag

SEQ ID NO: 1108870 - DNA, 19 bp, Homo sapiens
ctgagcaggggcaggcgca

SEQ ID NO: 1108871 - DNA, 22 bp, Homo sapiens
ctgagcagtttcattgtgatca

SEQ ID NO: 1108872 - DNA, 20 bp, Homo sapiens
ctgagcatgatgggaatagg

SEQ ID NO: 1108873 - DNA, 21 bp, Homo sapiens
ctgagcatgatgggaataggg

SEQ ID NO: 1108874 - DNA, 14 bp, Homo sapiens
ctgagcatttgcac

SEQ ID NO: 1108875 - DNA, 16 bp, Homo sapiens
ctgagccaaggaggcc

SEQ ID NO: 1108876 - DNA, 16 bp, Homo sapiens
ctgagccaagggaggg

SEQ ID NO: 1108877 - DNA, 17 bp, Homo sapiens
ctgagccaagggaggga

SEQ ID NO: 1108878 - DNA, 20 bp, Homo sapiens
ctgagccaagggagggaagg

SEQ ID NO: 1108879 - DNA, 21 bp, Homo sapiens
ctgagccaagggagggaaggg

SEQ ID NO: 1108880 - DNA, 15 bp, Homo sapiens
ctgagccactcgcag

SEQ ID NO: 1108881 - DNA, 18 bp, Homo sapiens
ctgagccagtcccagggg

SEQ ID NO: 1108882 - DNA, 17 bp, Homo sapiens
ctgagccataccgacca

SEQ ID NO: 1108883 - DNA, 15 bp, Homo sapiens
ctgagcccaaccagg

SEQ ID NO: 1108884 - DNA, 18 bp, Homo sapiens
ctgagcccaaccaggccc

SEQ ID NO: 1108885 - DNA, 21 bp, Homo sapiens
ctgagcccaaccaggccctgc

SEQ ID NO: 1108886 - DNA, 16 bp, Homo sapiens
ctgagcccagagaagc

SEQ ID NO: 1108887 - DNA, 17 bp, Homo sapiens
ctgagcccagagaagct

SEQ ID NO: 1108888 - DNA, 15 bp, Homo sapiens
ctgagcccaggccgt

SEQ ID NO: 1108889 - DNA, 11 bp, Homo sapiens
ctgagcccata

SEQ ID NO: 1108890 - DNA, 23 bp, Homo sapiens
ctgagcccatacttttggctcct

SEQ ID NO: 1108891 - DNA, 19 bp, Homo sapiens
ctgagcccatgttctgccc

SEQ ID NO: 1108892 - DNA, 21 bp, Homo sapiens
ctgagccccagggtgcccaga

SEQ ID NO: 1108893 - DNA, 22 bp, Homo sapiens
ctgagcccccccaacactgtgc

SEQ ID NO: 1108894 - DNA, 20 bp, Homo sapiens
ctgagccccgccctcttcct

SEQ ID NO: 1108895 - DNA, 17 bp, Homo sapiens
ctgagcccctaccccac

SEQ ID NO: 1108896 - DNA, 22 bp, Homo sapiens
ctgagcccctgtctagagaggg

SEQ ID NO: 1108897 - DNA, 13 bp, Homo sapiens
ctgagccccttcc

SEQ ID NO: 1108898 - DNA, 14 bp, Homo sapiens
ctgagccccttcct

SEQ ID NO: 1108899 - DNA, 20 bp, Homo sapiens
ctgagccccttccttgctct

SEQ ID NO: 1108900 - DNA, 22 bp, Homo sapiens
ctgagcccgggctgcctgggct

SEQ ID NO: 1108901 - DNA, 23 bp, Homo sapiens
ctgagcccgggctgcctgggctg

SEQ ID NO: 1108902 - DNA, 21 bp, Homo sapiens
ctgagccctactccctgcaga

SEQ ID NO: 1108903 - DNA, 12 bp, Homo sapiens
ctgagccctctc

SEQ ID NO: 1108904 - DNA, 13 bp, Homo sapiens
ctgagccctctca

SEQ ID NO: 1108905 - DNA, 14 bp, Homo sapiens
ctgagccctctcac

SEQ ID NO: 1108906 - DNA, 18 bp, Homo sapiens
ctgagccctctcactcca

SEQ ID NO: 1108907 - DNA, 23 bp, Homo sapiens
ctgagccctctcactccagccaa

SEQ ID NO: 1108908 - DNA, 11 bp, Homo sapiens
ctgagccctgg

SEQ ID NO: 1108909 - DNA, 13 bp, Homo sapiens
ctgagccctggca

SEQ ID NO: 1108910 - DNA, 13 bp, Homo sapiens
ctgagccctggtg

SEQ ID NO: 1108911 - DNA, 22 bp, Homo sapiens
ctgagccctgtacccaccccag

SEQ ID NO: 1108912 - DNA, 23 bp, Homo sapiens
ctgagccctgtacccaccccagc

SEQ ID NO: 1108913 - DNA, 16 bp, Homo sapiens
ctgagccggccccagg

SEQ ID NO: 1108914 - DNA, 23 bp, Homo sapiens
ctgagccggccccaggctcgtgg

SEQ ID NO: 1108915 - DNA, 17 bp, Homo sapiens
ctgagcctacagatgaa

SEQ ID NO: 1108916 - DNA, 21 bp, Homo sapiens
ctgagtcctgtctctgcctgc

SEQ ID NO: 1108917 - DNA, 15 bp, Homo sapiens
ctgagtcctttgcta

SEQ ID NO: 1108918 - DNA, 20 bp, Homo sapiens
ctgagtcgtacagaaagctg

SEQ ID NO: 1108919 - DNA, 21 bp, Homo sapiens
ctgagtcgtacagaaagctgc

SEQ ID NO: 1108920 - DNA, 20 bp, Homo sapiens
ctgagtctagatacagaagc

SEQ ID NO: 1108921 - DNA, 22 bp, Homo sapiens
ctgagtctagatacagaagccc

SEQ ID NO: 1108922 - DNA, 13 bp, Homo sapiens
ctgagtctatgtt

SEQ ID NO: 1108923 - DNA, 19 bp, Homo sapiens
ctgagtctatgttcaaaga

SEQ ID NO: 1108924 - DNA, 20 bp, Homo sapiens
ctgagtctatgttcaaagac

SEQ ID NO: 1108925 - DNA, 13 bp, Homo sapiens
ctgagtctcctgt

SEQ ID NO: 1108926 - DNA, 18 bp, Homo sapiens
ctgagtctgagtcctgtc

SEQ ID NO: 1108927 - DNA, 18 bp, Homo sapiens
ctgagtctggacctccat

SEQ ID NO: 1108928 - DNA, 19 bp, Homo sapiens
ctgagtcttttcattgcta

SEQ ID NO: 1108929 - DNA, 17 bp, Homo sapiens
ctgagtgaacctgtata

SEQ ID NO: 1108930 - DNA, 17 bp, Homo sapiens
ctgagtgaattgtacct

SEQ ID NO: 1108931 - DNA, 19 bp, Homo sapiens
ctgagtgaccgggggctgc

SEQ ID NO: 1108932 - DNA, 11 bp, Homo sapiens
ctgagtgactc

SEQ ID NO: 1108933 - DNA, 21 bp, Homo sapiens
ctgagtgactctatatagctg

SEQ ID NO: 1108934 - DNA, 21 bp, Homo sapiens
ctgagtgactgtaggcaggga

SEQ ID NO: 1108935 - DNA, 13 bp, Homo sapiens
ctgagtgcagcca

SEQ ID NO: 1108936 - DNA, 23 bp, Homo sapiens
ctgagtgcgggctgaggccagag

SEQ ID NO: 1108937 - DNA, 14 bp, Homo sapiens
ctgagtgctgggca

SEQ ID NO: 1108938 - DNA, 22 bp, Homo sapiens
ctgagtgctgggcactgctcca

SEQ ID NO: 1108939 - DNA, 15 bp, Homo sapiens
ctgagtggccagcca

SEQ ID NO: 1108940 - DNA, 17 bp, Homo sapiens
ctgagtggccagccagt

SEQ ID NO: 1108941 - DNA, 13 bp, Homo sapiens
ctgagtgggaagc

SEQ ID NO: 1108942 - DNA, 17 bp, Homo sapiens
ctgagtgggaagcccat

SEQ ID NO: 1108943 - DNA, 21 bp, Homo sapiens
ctgagtgggaagcccatcctg

SEQ ID NO: 1108944 - DNA, 13 bp, Homo sapiens
ctgagtggtcact

SEQ ID NO: 1108945 - DNA, 14 bp, Homo sapiens
ctgagtggtgtttt

SEQ ID NO: 1108946 - DNA, 23 bp, Homo sapiens
ctgagtgtgggagtgcagagaaa

SEQ ID NO: 1108947 - DNA, 15 bp, Homo sapiens
ctgagtgtttggaaa

SEQ ID NO: 1108948 - DNA, 16 bp, Homo sapiens
ctgagttacttgtctg

SEQ ID NO: 1108949 - DNA, 20 bp, Homo sapiens
ctgagttacttgtctgaggc

SEQ ID NO: 1108950 - DNA, 21 bp, Homo sapiens
ctgagttacttgtctgaggcc

SEQ ID NO: 1108951 - DNA, 24 bp, Homo sapiens
ctgagttacttgtctgaggcctca

SEQ ID NO: 1108952 - DNA, 21 bp, Homo sapiens
ctgagttctgtgtattttcag

SEQ ID NO: 1108953 - DNA, 11 bp, Homo sapiens
ctgagttgcca

SEQ ID NO: 1108954 - DNA, 16 bp, Homo sapiens
ctgagttgccaagaca

SEQ ID NO: 1108955 - DNA, 18 bp, Homo sapiens
ctgagttgccaagacaaa

SEQ ID NO: 1108956 - DNA, 19 bp, Homo sapiens
ctgagttgggcagccagga

SEQ ID NO: 1108957 - DNA, 11 bp, Homo sapiens
ctgagttgttc

SEQ ID NO: 1108958 - DNA, 18 bp, Homo sapiens
ctgagtttaccatttgta

SEQ ID NO: 1108959 - DNA, 19 bp, Homo sapiens
ctgagtttaccatttgtaa

SEQ ID NO: 1108960 - DNA, 19 bp, Homo sapiens
ctgagtttcattctcctgc

SEQ ID NO: 1108961 - DNA, 14 bp, Homo sapiens
ctgagtttcccttc

SEQ ID NO: 1108962 - DNA, 22 bp, Homo sapiens
ctgagtttgggagagtggtgag

SEQ ID NO: 1108963 - DNA, 18 bp, Homo sapiens
ctgataaaagatggccat

SEQ ID NO: 1108964 - DNA, 12 bp, Homo sapiens
ctgataaaatac

SEQ ID NO: 1108965 - DNA, 18 bp, Homo sapiens
ctgataacttggggaggc

SEQ ID NO: 1108966 - DNA, 19 bp, Homo sapiens
ctgataacttggggaggca

SEQ ID NO: 1108967 - DNA, 16 bp, Homo sapiens
ctgataatcattttga

SEQ ID NO: 1108968 - DNA, 21 bp, Homo sapiens
ctgataattgtgtattttctt

SEQ ID NO: 1108969 - DNA, 17 bp, Homo sapiens
ctgataattttaaattc

SEQ ID NO: 1108970 - DNA, 14 bp, Homo sapiens
ctgataattttaca

SEQ ID NO: 1108971 - DNA, 18 bp, Homo sapiens
ctgatacataaaaattaa

SEQ ID NO: 1108972 - DNA, 18 bp, Homo sapiens
ctgatagaatgatgtttt

SEQ ID NO: 1108973 - DNA, 16 bp, Homo sapiens
ctgatagactttgtga

SEQ ID NO: 1108974 - DNA, 21 bp, Homo sapiens
ctgatagcttacactgaggac

SEQ ID NO: 1108975 - DNA, 13 bp, Homo sapiens
ctgataggagggg

SEQ ID NO: 1108976 - DNA, 14 bp, Homo sapiens
ctgataggaggggg

SEQ ID NO: 1108977 - DNA, 23 bp, Homo sapiens
ctgatagtcctttttccaatgtt

SEQ ID NO: 1108978 - DNA, 19 bp, Homo sapiens
ctgatattatggcaagtga

SEQ ID NO: 1108979 - DNA, 21 bp, Homo sapiens
ctgatattatttcttctctta

SEQ ID NO: 1108980 - DNA, 22 bp, Homo sapiens
ctgatattgccgcactagggga

SEQ ID NO: 1108981 - DNA, 17 bp, Homo sapiens
ctgatattttacctctt

SEQ ID NO: 1108982 - DNA, 23 bp, Homo sapiens
ctgatattttacctcttattgca

SEQ ID NO: 1108983 - DNA, 14 bp, Homo sapiens
ctgatattttctct

SEQ ID NO: 1108984 - DNA, 22 bp, Homo sapiens
ctgatcaagtcaccggagcttt

SEQ ID NO: 1108985 - DNA, 15 bp, Homo sapiens
ctgatcacccaatgc

SEQ ID NO: 1108986 - DNA, 15 bp, Homo sapiens
ctgatcacctgccct

SEQ ID NO: 1108987 - DNA, 20 bp, Homo sapiens
ctgatcactatgcattttaa

SEQ ID NO: 1108988 - DNA, 12 bp, Homo sapiens
ctgatcatgcat

SEQ ID NO: 1108989 - DNA, 14 bp, Homo sapiens
ctgatcatgcattg

SEQ ID NO: 1108990 - DNA, 23 bp, Homo sapiens
ctgatcatgtttatgagaaactg

SEQ ID NO: 1108991 - DNA, 22 bp, Homo sapiens
ctgatcattacatggctgtggt

SEQ ID NO: 1108992 - DNA, 15 bp, Homo sapiens
ctgatccagagcaca

SEQ ID NO: 1108993 - DNA, 14 bp, Homo sapiens
ctgatccagccttt

SEQ ID NO: 1108994 - DNA, 15 bp, Homo sapiens
ctgatccctccaccc

SEQ ID NO: 1108995 - DNA, 16 bp, Homo sapiens
ctgatccctccacccc

SEQ ID NO: 1108996 - DNA, 12 bp, Homo sapiens
ctgatccctcta

SEQ ID NO: 1108997 - DNA, 13 bp, Homo sapiens
ctgatccctctac

SEQ ID NO: 1108998 - DNA, 19 bp, Homo sapiens
ctgatccctgaacccctgg

SEQ ID NO: 1108999 - DNA, 22 bp, Homo sapiens
ctgatccggctgctcctccagc

SEQ ID NO: 1109000 - DNA, 19 bp, Homo sapiens
ctgatccgtccgaggctgc

SEQ ID NO: 1109001 - DNA, 16 bp, Homo sapiens
ctgatcctaagaattt

SEQ ID NO: 1109002 - DNA, 20 bp, Homo sapiens
ctgatcctaagaatttttca

SEQ ID NO: 1109003 - DNA, 15 bp, Homo sapiens
ctgatcgtagaaaat

SEQ ID NO: 1109004 - DNA, 18 bp, Homo sapiens
ctgatcgtctcggcccct

SEQ ID NO: 1109005 - DNA, 17 bp, Homo sapiens
ctgatcgtgctaaattt

SEQ ID NO: 1109006 - DNA, 14 bp, Homo sapiens
ctgatctagcactc

SEQ ID NO: 1109007 - DNA, 23 bp, Homo sapiens
ctgatctctactaccacaaggaa

SEQ ID NO: 1109008 - DNA, 15 bp, Homo sapiens
ctgatctctgacctc

SEQ ID NO: 1109009 - DNA, 17 bp, Homo sapiens
ctgatctctgacctctg

SEQ ID NO: 1109010 - DNA, 18 bp, Homo sapiens
ctgatctctgacctctgc

SEQ ID NO: 1109011 - DNA, 20 bp, Homo sapiens
ctgatctctgacctctgctg

SEQ ID NO: 1109012 - DNA, 16 bp, Homo sapiens
ctgatctcttcctgtt

SEQ ID NO: 1109013 - DNA, 20 bp, Homo sapiens
ctgatctgcggatctcagct

SEQ ID NO: 1109014 - DNA, 13 bp, Homo sapiens
ctgatctgtactt

SEQ ID NO: 1109015 - DNA, 21 bp, Homo sapiens
ctgatctgtactttgtgttta

SEQ ID NO: 1109016 - DNA, 16 bp, Homo sapiens
ctgatcttatgtgtta

SEQ ID NO: 1109017 - DNA, 16 bp, Homo sapiens
ctgatcttgtgctcag

SEQ ID NO: 1109018 - DNA, 18 bp, Homo sapiens
ctgatctttgtatattac

SEQ ID NO: 1109019 - DNA, 22 bp, Homo sapiens
ctgatgaaatctgctagaaagt

SEQ ID NO: 1109020 - DNA, 21 bp, Homo sapiens
ctgatgaactcttaatcaaat

SEQ ID NO: 1109021 - DNA, 23 bp, Homo sapiens
ctgatgagactccactcaggtgc

SEQ ID NO: 1109022 - DNA, 21 bp, Homo sapiens
ctgatgagcacatctctctgc

SEQ ID NO: 1109023 - DNA, 23 bp, Homo sapiens
ctgatgagcacatctctctgccc

SEQ ID NO: 1109024 - DNA, 19 bp, Homo sapiens
ctgatgagtttcactgtac

SEQ ID NO: 1109025 - DNA, 14 bp, Homo sapiens
ctgatgatcaaaac

SEQ ID NO: 1109026 - DNA, 19 bp, Homo sapiens
ctgatgatcaaaacctgtg

SEQ ID NO: 1109027 - DNA, 16 bp, Homo sapiens
ctgatgatccagaaca

SEQ ID NO: 1109028 - DNA, 17 bp, Homo sapiens
ctgatgatccagaacag

SEQ ID NO: 1109029 - DNA, 11 bp, Homo sapiens
ctgatgatgtc

SEQ ID NO: 1109030 - DNA, 22 bp, Homo sapiens
ctgatgatgtcttctggtgtca

SEQ ID NO: 1109031 - DNA, 18 bp, Homo sapiens
ctgatgcagcctgtggct

SEQ ID NO: 1109032 - DNA, 23 bp, Homo sapiens
ctgatgcatacggctatattggt

SEQ ID NO: 1109033 - DNA, 14 bp, Homo sapiens
ctgatgccatgttt

SEQ ID NO: 1109034 - DNA, 15 bp, Homo sapiens
ctgatgccccttccc

SEQ ID NO: 1109035 - DNA, 15 bp, Homo sapiens
ctgatgccctcttct

SEQ ID NO: 1109036 - DNA, 18 bp, Homo sapiens
ctgatgccctcttctcct

SEQ ID NO: 1109037 - DNA, 15 bp, Homo sapiens
ctgcactccagcctg

SEQ ID NO: 1109038 - DNA, 20 bp, Homo sapiens
ctgcactccagcctggggga

SEQ ID NO: 1109039 - DNA, 12 bp, Homo sapiens
ctgcactccatg

SEQ ID NO: 1109040 - DNA, 15 bp, Homo sapiens
ctgcactccatggcc

SEQ ID NO: 1109041 - DNA, 17 bp, Homo sapiens
ctgcactccatggccac

SEQ ID NO: 1109042 - DNA, 22 bp, Homo sapiens
ctgcactccatggccaccccgt

SEQ ID NO: 1109043 - DNA, 15 bp, Homo sapiens
ctgcactcccgacct

SEQ ID NO: 1109044 - DNA, 13 bp, Homo sapiens
ctgcactccctgg

SEQ ID NO: 1109045 - DNA, 21 bp, Homo sapiens
ctgcactccctggccttgccc

SEQ ID NO: 1109046 - DNA, 23 bp, Homo sapiens
ctgcactcctttatctgtaattg

SEQ ID NO: 1109047 - DNA, 12 bp, Homo sapiens
ctgcactgcagt

SEQ ID NO: 1109048 - DNA, 18 bp, Homo sapiens
ctgcactggagccacagg

SEQ ID NO: 1109049 - DNA, 14 bp, Homo sapiens
ctgcactgggaagg

SEQ ID NO: 1109050 - DNA, 16 bp, Homo sapiens
ctgcactgtgccccgc

SEQ ID NO: 1109051 - DNA, 19 bp, Homo sapiens
ctgcactgttgctgactac

SEQ ID NO: 1109052 - DNA, 15 bp, Homo sapiens
ctgcacttacttgct

SEQ ID NO: 1109053 - DNA, 15 bp, Homo sapiens
ctgcacttcagacac

SEQ ID NO: 1109054 - DNA, 14 bp, Homo sapiens
ctgcacttcctgtt

SEQ ID NO: 1109055 - DNA, 18 bp, Homo sapiens
ctgcactttcccccttcc

SEQ ID NO: 1109056 - DNA, 17 bp, Homo sapiens
ctgcagaaatttgcaac

SEQ ID NO: 1109057 - DNA, 13 bp, Homo sapiens
ctgcagaacccac

SEQ ID NO: 1109058 - DNA, 20 bp, Homo sapiens
ctgcagaacgtattggtcca

SEQ ID NO: 1109059 - DNA, 18 bp, Homo sapiens
ctgcagaactcctccaaa

SEQ ID NO: 1109060 - DNA, 15 bp, Homo sapiens
ctgcagaagcaaggg

SEQ ID NO: 1109061 - DNA, 14 bp, Homo sapiens
ctgcagaagccaga

SEQ ID NO: 1109062 - DNA, 16 bp, Homo sapiens
ctgcagaagccagaag

SEQ ID NO: 1109063 - DNA, 15 bp, Homo sapiens
ctgcagaaggaaaaa

SEQ ID NO: 1109064 - DNA, 20 bp, Homo sapiens
ctgcagaaggaaaaatgtgt

SEQ ID NO: 1109065 - DNA, 15 bp, Homo sapiens
ctgcagaatgggcca

SEQ ID NO: 1109066 - DNA, 19 bp, Homo sapiens
ctgcagacacctggactga

SEQ ID NO: 1109067 - DNA, 14 bp, Homo sapiens
ctgcagacaggctc

SEQ ID NO: 1109068 - DNA, 13 bp, Homo sapiens
ctgcagacattct

SEQ ID NO: 1109069 - DNA, 18 bp, Homo sapiens
ctgcagacattctcaaag

SEQ ID NO: 1109070 - DNA, 19 bp, Homo sapiens
ctgcagacattctcaaagc

SEQ ID NO: 1109071 - DNA, 21 bp, Homo sapiens
ctgcagacattctcaaagcct

SEQ ID NO: 1109072 - DNA, 15 bp, Homo sapiens
ctgcagaccacgccc

SEQ ID NO: 1109073 - DNA, 14 bp, Homo sapiens
ctgcagacctcact

SEQ ID NO: 1109074 - DNA, 20 bp, Homo sapiens
ctgcagacctcactgtcagg

SEQ ID NO: 1109075 - DNA, 22 bp, Homo sapiens
ctgcagacctcactgtcagggt

SEQ ID NO: 1109076 - DNA, 17 bp, Homo sapiens
ctgcagacctggttccc

SEQ ID NO: 1109077 - DNA, 17 bp, Homo sapiens
ctgcagacgggaatgcc

SEQ ID NO: 1109078 - DNA, 16 bp, Homo sapiens
ctgcagacttcccagc

SEQ ID NO: 1109079 - DNA, 17 bp, Homo sapiens
ctgcagacttcccagct

SEQ ID NO: 1109080 - DNA, 22 bp, Homo sapiens
ctgcagagaaacgcgctccttg

SEQ ID NO: 1109081 - DNA, 22 bp, Homo sapiens
ctgcagagaaacttaagcaaag

SEQ ID NO: 1109082 - DNA, 19 bp, Homo sapiens
ctgcagagactaatgttgg

SEQ ID NO: 1109083 - DNA, 14 bp, Homo sapiens
ctgcagagagaagc

SEQ ID NO: 1109084 - DNA, 11 bp, Homo sapiens
ctgcagagcaa

SEQ ID NO: 1109085 - DNA, 12 bp, Homo sapiens
ctgcagagcaat

SEQ ID NO: 1109086 - DNA, 16 bp, Homo sapiens
ctgcagagcaataaca

SEQ ID NO: 1109087 - DNA, 18 bp, Homo sapiens
ctgcagagcaataacact

SEQ ID NO: 1109088 - DNA, 15 bp, Homo sapiens
ctgcagagcaccttt

SEQ ID NO: 1109089 - DNA, 19 bp, Homo sapiens
ctgcagagcagcagcacct

SEQ ID NO: 1109090 - DNA, 19 bp, Homo sapiens
ctgcagagcccggccccac

SEQ ID NO: 1109091 - DNA, 17 bp, Homo sapiens
ctgcagagctgacccag

SEQ ID NO: 1109092 - DNA, 14 bp, Homo sapiens
ctgcagaggaccac

SEQ ID NO: 1109093 - DNA, 19 bp, Homo sapiens
ctgcagaggaccacagtgg

SEQ ID NO: 1109094 - DNA, 13 bp, Homo sapiens
ctgcagaggccag

SEQ ID NO: 1109095 - DNA, 21 bp, Homo sapiens
ctgcagaggccagaggccccc

SEQ ID NO: 1109096 - DNA, 19 bp, Homo sapiens
ctgcagaggggctttctgg

SEQ ID NO: 1109097 - DNA, 23 bp, Homo sapiens
ctgcagaggggctttctggagag

SEQ ID NO: 1109098 - DNA, 21 bp, Homo sapiens
ctgcagaggtctgtgctgagg

SEQ ID NO: 1109099 - DNA, 14 bp, Homo sapiens
ctgcagagtagtta

SEQ ID NO: 1109100 - DNA, 15 bp, Homo sapiens
ctgcagagttctcct

SEQ ID NO: 1109101 - DNA, 20 bp, Homo sapiens
ctgcagagttctcctggagg

SEQ ID NO: 1109102 - DNA, 20 bp, Homo sapiens
ctgcagatagcccaggagca

SEQ ID NO: 1109103 - DNA, 14 bp, Homo sapiens
ctgcagatctttgc

SEQ ID NO: 1109104 - DNA, 21 bp, Homo sapiens
ctgcagatggttgcaattgat

SEQ ID NO: 1109105 - DNA, 20 bp, Homo sapiens
ctgcagcaaacactccaccc

SEQ ID NO: 1109106 - DNA, 21 bp, Homo sapiens
ctgcagcacatgcgggctcgc

SEQ ID NO: 1109107 - DNA, 14 bp, Homo sapiens
ctgcagcacctcca

SEQ ID NO: 1109108 - DNA, 20 bp, Homo sapiens
ctgcagcacctccaggcctg

SEQ ID NO: 1109109 - DNA, 20 bp, Homo sapiens
ctgcagcacgcggccttgtc

SEQ ID NO: 1109110 - DNA, 20 bp, Homo sapiens
ctgcagcaggagtggtgcag

SEQ ID NO: 1109111 - DNA, 22 bp, Homo sapiens
ctgcagcagggcaggaagggga

SEQ ID NO: 1109112 - DNA, 17 bp, Homo sapiens
ctgcagcaggtgctggg

SEQ ID NO: 1109113 - DNA, 22 bp, Homo sapiens
ctgcagcaggtgctgggctgga

SEQ ID NO: 1109114 - DNA, 21 bp, Homo sapiens
ctgcagcatgttgctgaggag

SEQ ID NO: 1109115 - DNA, 12 bp, Homo sapiens
ctgcagccagct

SEQ ID NO: 1109116 - DNA, 22 bp, Homo sapiens
ctgcagccagctcacgtccagg

SEQ ID NO: 1109117 - DNA, 22 bp, Homo sapiens
ctgcagccatcccgcttagcct

SEQ ID NO: 1109118 - DNA, 23 bp, Homo sapiens
ctgcagccatcccgcttagcctg

SEQ ID NO: 1109119 - DNA, 17 bp, Homo sapiens
ctgcagccattcttcag

SEQ ID NO: 1109120 - DNA, 19 bp, Homo sapiens
ctgcagccattcttcaggt

SEQ ID NO: 1109121 - DNA, 13 bp, Homo sapiens
ctgcagcccagcc

SEQ ID NO: 1109122 - DNA, 23 bp, Homo sapiens
ctgcagccctcgggaccccactc

SEQ ID NO: 1109123 - DNA, 17 bp, Homo sapiens
ctgcagcccttgggcag

SEQ ID NO: 1109124 - DNA, 20 bp, Homo sapiens
ctgcagcccttgggcagttc

SEQ ID NO: 1109125 - DNA, 19 bp, Homo sapiens
ctgcagccggaggaggaga

SEQ ID NO: 1109126 - DNA, 16 bp, Homo sapiens
ctgcagccgtggtcca

SEQ ID NO: 1109127 - DNA, 15 bp, Homo sapiens
ctgcagcctcatact

SEQ ID NO: 1109128 - DNA, 17 bp, Homo sapiens
ctgcagcctcatactcc

SEQ ID NO: 1109129 - DNA, 17 bp, Homo sapiens
ctgcagcctctctggct

SEQ ID NO: 1109130 - DNA, 19 bp, Homo sapiens
ctgcagcctctctggctgg

SEQ ID NO: 1109131 - DNA, 14 bp, Homo sapiens
ctgcagcctgctgg

SEQ ID NO: 1109132 - DNA, 16 bp, Homo sapiens
ctgcagcctgctgggg

SEQ ID NO: 1109133 - DNA, 17 bp, Homo sapiens
ctgcagcctgctggggc

SEQ ID NO: 1109134 - DNA, 19 bp, Homo sapiens
ctgcagcctgggctccctc

SEQ ID NO: 1109135 - DNA, 18 bp, Homo sapiens
ctgcagcctgggtctgga

SEQ ID NO: 1109136 - DNA, 15 bp, Homo sapiens
ctgcagccttgtcct

SEQ ID NO: 1109137 - DNA, 19 bp, Homo sapiens
ctgcagccttttctggtcc

SEQ ID NO: 1109138 - DNA, 21 bp, Homo sapiens
ctgcagcgggcaaagagctcc

SEQ ID NO: 1109139 - DNA, 12 bp, Homo sapiens
ctgcagctgacc

SEQ ID NO: 1109140 - DNA, 14 bp, Homo sapiens
ctgcagctgacctc

SEQ ID NO: 1109141 - DNA, 17 bp, Homo sapiens
ctgcagctgatccatag

SEQ ID NO: 1109142 - DNA, 18 bp, Homo sapiens
ctgcagctgatccatagg

SEQ ID NO: 1109143 - DNA, 20 bp, Homo sapiens
ctgcagctgatccataggac

SEQ ID NO: 1109144 - DNA, 20 bp, Homo sapiens
ctgcagctgcaccagcaggt

SEQ ID NO: 1109145 - DNA, 11 bp, Homo sapiens
ctgcagctgcc

SEQ ID NO: 1109146 - DNA, 14 bp, Homo sapiens
ctgcagctggacag

SEQ ID NO: 1109147 - DNA, 12 bp, Homo sapiens
ctgcagctgggc

SEQ ID NO: 1109148 - DNA, 14 bp, Homo sapiens
ctgcagctgggccc

SEQ ID NO: 1109149 - DNA, 14 bp, Homo sapiens
ctgcagctgtgagt

SEQ ID NO: 1109150 - DNA, 12 bp, Homo sapiens
ctgcagctttgt

SEQ ID NO: 1109151 - DNA, 14 bp, Homo sapiens
ctgcaggaaaagca

SEQ ID NO: 1109152 - DNA, 23 bp, Homo sapiens
ctgcaggaacgagcactggccag

SEQ ID NO: 1109153 - DNA, 23 bp, Homo sapiens
ctgcaggacttgagaagacctca

SEQ ID NO: 1109154 - DNA, 15 bp, Homo sapiens
ctgcaggacttgcca

SEQ ID NO: 1109155 - DNA, 14 bp, Homo sapiens
ctgcaggagggcac

SEQ ID NO: 1109156 - DNA, 16 bp, Homo sapiens
ctgcaggagggcactg

SEQ ID NO: 1109157 - DNA, 17 bp, Homo sapiens
ctgcaggagtgtcctgc

SEQ ID NO: 1109158 - DNA, 17 bp, Homo sapiens
ctgcaggcacagaggag

SEQ ID NO: 1109159 - DNA, 13 bp, Homo sapiens
ctgccccaggccg

SEQ ID NO: 1109160 - DNA, 19 bp, Homo sapiens
ctgccccaggccggagccc

SEQ ID NO: 1109161 - DNA, 21 bp, Homo sapiens
ctgccccaggccggagcccag

SEQ ID NO: 1109162 - DNA, 13 bp, Homo sapiens
ctgccccaggcct

SEQ ID NO: 1109163 - DNA, 15 bp, Homo sapiens
ctgccccaggcctga

SEQ ID NO: 1109164 - DNA, 19 bp, Homo sapiens
ctgccccaggcctggacgg

SEQ ID NO: 1109165 - DNA, 14 bp, Homo sapiens
ctgccccaggggga

SEQ ID NO: 1109166 - DNA, 19 bp, Homo sapiens
ctgccccagtagtcagaag

SEQ ID NO: 1109167 - DNA, 12 bp, Homo sapiens
ctgcccccaagt

SEQ ID NO: 1109168 - DNA, 15 bp, Homo sapiens
ctgcccccagaaagc

SEQ ID NO: 1109169 - DNA, 19 bp, Homo sapiens
ctgcccccagaaagcctcc

SEQ ID NO: 1109170 - DNA, 15 bp, Homo sapiens
ctgcccccagcccaa

SEQ ID NO: 1109171 - DNA, 16 bp, Homo sapiens
ctgcccccagcccaaa

SEQ ID NO: 1109172 - DNA, 16 bp, Homo sapiens
ctgcccccagccccgg

SEQ ID NO: 1109173 - DNA, 23 bp, Homo sapiens
ctgcccccagctcttctccccag

SEQ ID NO: 1109174 - DNA, 14 bp, Homo sapiens
ctgcccccatctcc

SEQ ID NO: 1109175 - DNA, 21 bp, Homo sapiens
ctgcccccatctccccaggcc

SEQ ID NO: 1109176 - DNA, 21 bp, Homo sapiens
ctgccccccagcctctggcat

SEQ ID NO: 1109177 - DNA, 17 bp, Homo sapiens
ctgccccccagggctag

SEQ ID NO: 1109178 - DNA, 19 bp, Homo sapiens
ctgccccccagggctagtg

SEQ ID NO: 1109179 - DNA, 13 bp, Homo sapiens
ctgccccccgagg

SEQ ID NO: 1109180 - DNA, 21 bp, Homo sapiens
ctgccccccgaggctgctaga

SEQ ID NO: 1109181 - DNA, 11 bp, Homo sapiens
ctgccccccgc

SEQ ID NO: 1109182 - DNA, 20 bp, Homo sapiens
ctgcccccgcgggttctaga

SEQ ID NO: 1109183 - DNA, 22 bp, Homo sapiens
ctgcccccgcgggttctagacg

SEQ ID NO: 1109184 - DNA, 23 bp, Homo sapiens
ctgcccccgctcccgctcccagg

SEQ ID NO: 1109185 - DNA, 18 bp, Homo sapiens
ctgccccctatcttgtcc

SEQ ID NO: 1109186 - DNA, 21 bp, Homo sapiens
ctgccccctcccccatgggct

SEQ ID NO: 1109187 - DNA, 22 bp, Homo sapiens
ctgccccctcccccatgggctg

SEQ ID NO: 1109188 - DNA, 12 bp, Homo sapiens
ctgccccctgcc

SEQ ID NO: 1109189 - DNA, 22 bp, Homo sapiens
ctgccccctgggctggggcctc

SEQ ID NO: 1109190 - DNA, 13 bp, Homo sapiens
ctgccccctggtg

SEQ ID NO: 1109191 - DNA, 19 bp, Homo sapiens
ctgcccccttccccagccc

SEQ ID NO: 1109192 - DNA, 18 bp, Homo sapiens
ctgcccccttctcccaca

SEQ ID NO: 1109193 - DNA, 12 bp, Homo sapiens
ctgccccgcccc

SEQ ID NO: 1109194 - DNA, 16 bp, Homo sapiens
ctgccccgcccccagt

SEQ ID NO: 1109195 - DNA, 17 bp, Homo sapiens
ctgccccgccccccaga

SEQ ID NO: 1109196 - DNA, 19 bp, Homo sapiens
ctgccccgccccccagagc

SEQ ID NO: 1109197 - DNA, 20 bp, Homo sapiens
ctgccccgccccccagagcc

SEQ ID NO: 1109198 - DNA, 23 bp, Homo sapiens
ctgccccgccccccagagccagg

SEQ ID NO: 1109199 - DNA, 21 bp, Homo sapiens
ctgccccgggtgcctcagagc

SEQ ID NO: 1109200 - DNA, 19 bp, Homo sapiens
ctgccccgtcaccatctca

SEQ ID NO: 1109201 - DNA, 22 bp, Homo sapiens
ctgccccgtcggactgccccca

SEQ ID NO: 1109202 - DNA, 15 bp, Homo sapiens
ctgccccgttccctg

SEQ ID NO: 1109203 - DNA, 18 bp, Homo sapiens
ctgccccgttccctgtca

SEQ ID NO: 1109204 - DNA, 21 bp, Homo sapiens
ctgccccgttccctgtcagag

SEQ ID NO: 1109205 - DNA, 21 bp, Homo sapiens
ctgcccctaaagatgggagga

SEQ ID NO: 1109206 - DNA, 17 bp, Homo sapiens
ctgcccctaccctggac

SEQ ID NO: 1109207 - DNA, 21 bp, Homo sapiens
ctgcccctaccctggacttgc

SEQ ID NO: 1109208 - DNA, 22 bp, Homo sapiens
ctgcccctaggatgctgcagca

SEQ ID NO: 1109209 - DNA, 12 bp, Homo sapiens
ctgcccctcagg

SEQ ID NO: 1109210 - DNA, 16 bp, Homo sapiens
ctgcccctcagggggc

SEQ ID NO: 1109211 - DNA, 18 bp, Homo sapiens
ctgcccctcagggggcca

SEQ ID NO: 1109212 - DNA, 21 bp, Homo sapiens
ctgcccctcagggggccagct

SEQ ID NO: 1109213 - DNA, 19 bp, Homo sapiens
ctgcccctccccaaaagaa

SEQ ID NO: 1109214 - DNA, 13 bp, Homo sapiens
ctgcccctccccc

SEQ ID NO: 1109215 - DNA, 21 bp, Homo sapiens
ctgcccctccccgtccctgtc

SEQ ID NO: 1109216 - DNA, 22 bp, Homo sapiens
ctgcccctccccgtccctgtcc

SEQ ID NO: 1109217 - DNA, 23 bp, Homo sapiens
ctgcccctccccgtccctgtccc

SEQ ID NO: 1109218 - DNA, 16 bp, Homo sapiens
ctgcccctccctcagg

SEQ ID NO: 1109219 - DNA, 14 bp, Homo sapiens
ctgcccctcccttc

SEQ ID NO: 1109220 - DNA, 15 bp, Homo sapiens
ctgcccctcgcacac

SEQ ID NO: 1109221 - DNA, 23 bp, Homo sapiens
ctgcccctcgcacacagggctca

SEQ ID NO: 1109222 - DNA, 14 bp, Homo sapiens
ctgcccctctccga

SEQ ID NO: 1109223 - DNA, 15 bp, Homo sapiens
ctgcccctctgttct

SEQ ID NO: 1109224 - DNA, 19 bp, Homo sapiens
ctgcccctctgttctctcc

SEQ ID NO: 1109225 - DNA, 20 bp, Homo sapiens
ctgcccctctgttctctccc

SEQ ID NO: 1109226 - DNA, 12 bp, Homo sapiens
ctgcccctcttt

SEQ ID NO: 1109227 - DNA, 13 bp, Homo sapiens
ctgcccctctttc

SEQ ID NO: 1109228 - DNA, 15 bp, Homo sapiens
ctgcccctctttctc

SEQ ID NO: 1109229 - DNA, 16 bp, Homo sapiens
ctgcccctctttctct

SEQ ID NO: 1109230 - DNA, 23 bp, Homo sapiens
ctgcccctgtaaggtttcaatgc

SEQ ID NO: 1109231 - DNA, 12 bp, Homo sapiens
ctgcccctgtcc

SEQ ID NO: 1109232 - DNA, 16 bp, Homo sapiens
ctgccccttaacccca

SEQ ID NO: 1109233 - DNA, 12 bp, Homo sapiens
ctgccccttgca

SEQ ID NO: 1109234 - DNA, 14 bp, Homo sapiens
ctgccccttgcaag

SEQ ID NO: 1109235 - DNA, 19 bp, Homo sapiens
ctgccccttgcaagccata

SEQ ID NO: 1109236 - DNA, 13 bp, Homo sapiens
ctgccccttgggc

SEQ ID NO: 1109237 - DNA, 18 bp, Homo sapiens
ctgccccttgggcatcca

SEQ ID NO: 1109238 - DNA, 16 bp, Homo sapiens
ctgcccgagctggtgc

SEQ ID NO: 1109239 - DNA, 17 bp, Homo sapiens
ctgcccgagctggtgca

SEQ ID NO: 1109240 - DNA, 22 bp, Homo sapiens
ctgcccgccacatggtgtggcc

SEQ ID NO: 1109241 - DNA, 16 bp, Homo sapiens
ctgcccggcgcctgcc

SEQ ID NO: 1109242 - DNA, 17 bp, Homo sapiens
ctgcccggcgcctgccc

SEQ ID NO: 1109243 - DNA, 19 bp, Homo sapiens
ctgcccggcgcctgccctg

SEQ ID NO: 1109244 - DNA, 15 bp, Homo sapiens
ctgcccggggagctg

SEQ ID NO: 1109245 - DNA, 15 bp, Homo sapiens
ctgcccggggcagct

SEQ ID NO: 1109246 - DNA, 16 bp, Homo sapiens
ctgcccggggcagctg

SEQ ID NO: 1109247 - DNA, 20 bp, Homo sapiens
ctgcccggggcagctgccag

SEQ ID NO: 1109248 - DNA, 21 bp, Homo sapiens
ctgcccggggcagctgccaga

SEQ ID NO: 1109249 - DNA, 21 bp, Homo sapiens
ctgcccggtggtttgccatgt

SEQ ID NO: 1109250 - DNA, 17 bp, Homo sapiens
ctgcccggttgccatgg

SEQ ID NO: 1109251 - DNA, 15 bp, Homo sapiens
ctgcccgtcttcagc

SEQ ID NO: 1109252 - DNA, 16 bp, Homo sapiens
ctgccctaagccccca

SEQ ID NO: 1109253 - DNA, 17 bp, Homo sapiens
ctgccctaagcccccag

SEQ ID NO: 1109254 - DNA, 18 bp, Homo sapiens
ctgccctaagcccccagg

SEQ ID NO: 1109255 - DNA, 21 bp, Homo sapiens
ctgccctaagcccccagggcc

SEQ ID NO: 1109256 - DNA, 16 bp, Homo sapiens
ctgccctactcactct

SEQ ID NO: 1109257 - DNA, 15 bp, Homo sapiens
ctgccctagagcaca

SEQ ID NO: 1109258 - DNA, 19 bp, Homo sapiens
ctgccctagagcacactgt

SEQ ID NO: 1109259 - DNA, 12 bp, Homo sapiens
ctgccctagctg

SEQ ID NO: 1109260 - DNA, 13 bp, Homo sapiens
ctgccctagctga

SEQ ID NO: 1109261 - DNA, 16 bp, Homo sapiens
ctgccctatgggcctg

SEQ ID NO: 1109262 - DNA, 17 bp, Homo sapiens
ctgccctatgggcctgc

SEQ ID NO: 1109263 - DNA, 16 bp, Homo sapiens
ctgccctcaagagcaa

SEQ ID NO: 1109264 - DNA, 13 bp, Homo sapiens
ctgccctcactcc

SEQ ID NO: 1109265 - DNA, 19 bp, Homo sapiens
ctgccctcactccctctgc

SEQ ID NO: 1109266 - DNA, 12 bp, Homo sapiens
ctgccctcaggg

SEQ ID NO: 1109267 - DNA, 12 bp, Homo sapiens
ctgccctcatgg

SEQ ID NO: 1109268 - DNA, 19 bp, Homo sapiens
ctgccctcatggcccctct

SEQ ID NO: 1109269 - DNA, 21 bp, Homo sapiens
ctgccctcattactgggcctt

SEQ ID NO: 1109270 - DNA, 14 bp, Homo sapiens
ctgccctccatccc

SEQ ID NO: 1109271 - DNA, 14 bp, Homo sapiens
ctgccctcccatgt

SEQ ID NO: 1109272 - DNA, 17 bp, Homo sapiens
ctgccctccccagagca

SEQ ID NO: 1109273 - DNA, 20 bp, Homo sapiens
ctgccctcccctctctgcac

SEQ ID NO: 1109274 - DNA, 19 bp, Homo sapiens
ctgccctcccgcaccttcc

SEQ ID NO: 1109275 - DNA, 13 bp, Homo sapiens
ctgccctccctgt

SEQ ID NO: 1109276 - DNA, 14 bp, Homo sapiens
ctgccctccggagg

SEQ ID NO: 1109277 - DNA, 22 bp, Homo sapiens
ctgccctccggaggagcagcct

SEQ ID NO: 1109278 - DNA, 18 bp, Homo sapiens
ctgccctcgtggccagcc

SEQ ID NO: 1109279 - DNA, 19 bp, Homo sapiens
ctgccctcgtggccagccc

SEQ ID NO: 1109280 - DNA, 21 bp, Homo sapiens
ctgccctcgtggccagcccgg

SEQ ID NO: 1109281 - DNA, 10 bp, Homo sapiens
ctgccttcct

SEQ ID NO: 1109282 - DNA, 15 bp, Homo sapiens
ctgccttcctcctgg

SEQ ID NO: 1109283 - DNA, 16 bp, Homo sapiens
ctgccttcctcctggg

SEQ ID NO: 1109284 - DNA, 18 bp, Homo sapiens
ctgccttcctcctgggcc

SEQ ID NO: 1109285 - DNA, 21 bp, Homo sapiens
ctgccttcctcctgggccctc

SEQ ID NO: 1109286 - DNA, 14 bp, Homo sapiens
ctgccttcctcctt

SEQ ID NO: 1109287 - DNA, 22 bp, Homo sapiens
ctgccttcctctgaggacaggc

SEQ ID NO: 1109288 - DNA, 19 bp, Homo sapiens
ctgccttcgcaccttgctg

SEQ ID NO: 1109289 - DNA, 20 bp, Homo sapiens
ctgccttcgttaactgtgta

SEQ ID NO: 1109290 - DNA, 17 bp, Homo sapiens
ctgccttctaccctctg

SEQ ID NO: 1109291 - DNA, 19 bp, Homo sapiens
ctgccttgagtccccaggg

SEQ ID NO: 1109292 - DNA, 19 bp, Homo sapiens
ctgccttgccgctcccctt

SEQ ID NO: 1109293 - DNA, 19 bp, Homo sapiens
ctgccttgctgttcttgaa

SEQ ID NO: 1109294 - DNA, 19 bp, Homo sapiens
ctgccttggccccccaaag

SEQ ID NO: 1109295 - DNA, 18 bp, Homo sapiens
ctgccttggttctggcca

SEQ ID NO: 1109296 - DNA, 14 bp, Homo sapiens
ctgccttgtgtaca

SEQ ID NO: 1109297 - DNA, 18 bp, Homo sapiens
ctgccttgtttatagcca

SEQ ID NO: 1109298 - DNA, 22 bp, Homo sapiens
ctgccttgtttatagccacttg

SEQ ID NO: 1109299 - DNA, 17 bp, Homo sapiens
ctgcctttaagccaaag

SEQ ID NO: 1109300 - DNA, 18 bp, Homo sapiens
ctgcctttaagccaaaga

SEQ ID NO: 1109301 - DNA, 19 bp, Homo sapiens
ctgcctttatgatgctaag

SEQ ID NO: 1109302 - DNA, 11 bp, Homo sapiens
ctgcctttccc

SEQ ID NO: 1109303 - DNA, 15 bp, Homo sapiens
ctgcctttctgcctt

SEQ ID NO: 1109304 - DNA, 23 bp, Homo sapiens
ctgcctttgcagttggactctca

SEQ ID NO: 1109305 - DNA, 17 bp, Homo sapiens
ctgcctttgtccccaca

SEQ ID NO: 1109306 - DNA, 18 bp, Homo sapiens
ctgcctttgtccccacac

SEQ ID NO: 1109307 - DNA, 13 bp, Homo sapiens
ctgccttttctgg

SEQ ID NO: 1109308 - DNA, 21 bp, Homo sapiens
ctgccttttttcacagcccgg

SEQ ID NO: 1109309 - DNA, 20 bp, Homo sapiens
ctgcgaagaccctcttgccc

SEQ ID NO: 1109310 - DNA, 17 bp, Homo sapiens
ctgcgaaggggccctgg

SEQ ID NO: 1109311 - DNA, 16 bp, Homo sapiens
ctgcgactttctgcct

SEQ ID NO: 1109312 - DNA, 20 bp, Homo sapiens
ctgcgactttctgcctggag

SEQ ID NO: 1109313 - DNA, 12 bp, Homo sapiens
ctgcgagaccca

SEQ ID NO: 1109314 - DNA, 13 bp, Homo sapiens
ctgcgagacccaa

SEQ ID NO: 1109315 - DNA, 21 bp, Homo sapiens
ctgcgagggccgcccgctccc

SEQ ID NO: 1109316 - DNA, 20 bp, Homo sapiens
ctgcgatcttcagagcaggg

SEQ ID NO: 1109317 - DNA, 15 bp, Homo sapiens
ctgcgcacaggtggg

SEQ ID NO: 1109318 - DNA, 16 bp, Homo sapiens
ctgcgccactgccatc

SEQ ID NO: 1109319 - DNA, 16 bp, Homo sapiens
ctgcgccaggcagagc

SEQ ID NO: 1109320 - DNA, 23 bp, Homo sapiens
ctgcgccaggcagagctgagggc

SEQ ID NO: 1109321 - DNA, 14 bp, Homo sapiens
ctgcgcccagagct

SEQ ID NO: 1109322 - DNA, 15 bp, Homo sapiens
ctgcgcccagagctg

SEQ ID NO: 1109323 - DNA, 19 bp, Homo sapiens
ctgcgcccagagctggcct

SEQ ID NO: 1109324 - DNA, 15 bp, Homo sapiens
ctgcgcccagcctga

SEQ ID NO: 1109325 - DNA, 15 bp, Homo sapiens
ctgcgcccccagctt

SEQ ID NO: 1109326 - DNA, 17 bp, Homo sapiens
ctgcgcctccagaggtc

SEQ ID NO: 1109327 - DNA, 23 bp, Homo sapiens
ctgcgcctgcaggcagagctgga

SEQ ID NO: 1109328 - DNA, 16 bp, Homo sapiens
ctgcgcctgctgcctg

SEQ ID NO: 1109329 - DNA, 18 bp, Homo sapiens
ctgcgcctgctgcctgct

SEQ ID NO: 1109330 - DNA, 19 bp, Homo sapiens
ctgcgcggactcgccccca

SEQ ID NO: 1109331 - DNA, 20 bp, Homo sapiens
ctgcgcggactcgcccccag

SEQ ID NO: 1109332 - DNA, 16 bp, Homo sapiens
ctgcgcggatgtagca

SEQ ID NO: 1109333 - DNA, 13 bp, Homo sapiens
ctgcgctagcagc

SEQ ID NO: 1109334 - DNA, 19 bp, Homo sapiens
ctgcgcttcatctcatgag

SEQ ID NO: 1109335 - DNA, 17 bp, Homo sapiens
ctgcgcttccctgcagt

SEQ ID NO: 1109336 - DNA, 19 bp, Homo sapiens
ctgcgcttctgctggagga

SEQ ID NO: 1109337 - DNA, 17 bp, Homo sapiens
ctgcgcttgcttttctg

SEQ ID NO: 1109338 - DNA, 17 bp, Homo sapiens
ctgcggacaccgtggcc

SEQ ID NO: 1109339 - DNA, 14 bp, Homo sapiens
ctgcggcatcagat

SEQ ID NO: 1109340 - DNA, 19 bp, Homo sapiens
ctgcggctcagccttgcac

SEQ ID NO: 1109341 - DNA, 20 bp, Homo sapiens
ctgcggctcagccttgcaca

SEQ ID NO: 1109342 - DNA, 15 bp, Homo sapiens
ctgcgggaggctggg

SEQ ID NO: 1109343 - DNA, 16 bp, Homo sapiens
ctgcgggccacagggc

SEQ ID NO: 1109344 - DNA, 17 bp, Homo sapiens
ctgcgggccacagggca

SEQ ID NO: 1109345 - DNA, 13 bp, Homo sapiens
ctgcgggccaggg

SEQ ID NO: 1109346 - DNA, 18 bp, Homo sapiens
ctgcgggccagggtcctg

SEQ ID NO: 1109347 - DNA, 20 bp, Homo sapiens
ctgcgggctccctcctctgg

SEQ ID NO: 1109348 - DNA, 22 bp, Homo sapiens
ctgcgggctccctcctctggca

SEQ ID NO: 1109349 - DNA, 18 bp, Homo sapiens
ctgcggggagacagaagc

SEQ ID NO: 1109350 - DNA, 16 bp, Homo sapiens
ctgcgggtcctcagct

SEQ ID NO: 1109351 - DNA, 17 bp, Homo sapiens
ctgcgggtctgaaggaa

SEQ ID NO: 1109352 - DNA, 21 bp, Homo sapiens
ctgcgggtggggcttggggct

SEQ ID NO: 1109353 - DNA, 19 bp, Homo sapiens
ctgcggtgtttggcaatgc

SEQ ID NO: 1109354 - DNA, 21 bp, Homo sapiens
ctgcgtactccactggtctgt

SEQ ID NO: 1109355 - DNA, 22 bp, Homo sapiens
ctgcgtaggcgttggtgcgtcc

SEQ ID NO: 1109356 - DNA, 15 bp, Homo sapiens
ctgcgtccaccaggc

SEQ ID NO: 1109357 - DNA, 18 bp, Homo sapiens
ctgcgtccaccaggcctc

SEQ ID NO: 1109358 - DNA, 22 bp, Homo sapiens
ctgcgtccaccaggcctcactg

SEQ ID NO: 1109359 - DNA, 17 bp, Homo sapiens
ctgcgtccccactccct

SEQ ID NO: 1109360 - DNA, 17 bp, Homo sapiens
ctgcgtccctccgagct

SEQ ID NO: 1109361 - DNA, 13 bp, Homo sapiens
ctgcgtcctcctc

SEQ ID NO: 1109362 - DNA, 17 bp, Homo sapiens
ctgcgtcctcctcacct

SEQ ID NO: 1109363 - DNA, 14 bp, Homo sapiens
ctgcgtcggccctg

SEQ ID NO: 1109364 - DNA, 18 bp, Homo sapiens
ctgcgtcggtcctggtgc

SEQ ID NO: 1109365 - DNA, 20 bp, Homo sapiens
ctgcgtgccagtcaagaaga

SEQ ID NO: 1109366 - DNA, 17 bp, Homo sapiens
ctgcgttcagcccctga

SEQ ID NO: 1109367 - DNA, 15 bp, Homo sapiens
ctgcgttggagccac

SEQ ID NO: 1109368 - DNA, 16 bp, Homo sapiens
ctgcgttggagccact

SEQ ID NO: 1109369 - DNA, 17 bp, Homo sapiens
ctgcgttggagccactc

SEQ ID NO: 1109370 - DNA, 20 bp, Homo sapiens
ctgcgttttctccgggtcct

SEQ ID NO: 1109371 - DNA, 17 bp, Homo sapiens
ctgcgtttttttatagt

SEQ ID NO: 1109372 - DNA, 23 bp, Homo sapiens
ctgctaaataaaatttgttgcat

SEQ ID NO: 1109373 - DNA, 14 bp, Homo sapiens
ctgctaaatcctca

SEQ ID NO: 1109374 - DNA, 20 bp, Homo sapiens
ctgctaaattctatgttaaa

SEQ ID NO: 1109375 - DNA, 15 bp, Homo sapiens
ctgctaacctggaaa

SEQ ID NO: 1109376 - DNA, 16 bp, Homo sapiens
ctgctaacctggaaag

SEQ ID NO: 1109377 - DNA, 12 bp, Homo sapiens
ctgctaaggctg

SEQ ID NO: 1109378 - DNA, 20 bp, Homo sapiens
ctgctaaggctgctggcttc

SEQ ID NO: 1109379 - DNA, 21 bp, Homo sapiens
ctgctaatacctcttactttg

SEQ ID NO: 1109380 - DNA, 23 bp, Homo sapiens
ctgctaatgcaaattaaaacata

SEQ ID NO: 1109381 - DNA, 23 bp, Homo sapiens
ctgctacaaatactcttaggaag

SEQ ID NO: 1109382 - DNA, 14 bp, Homo sapiens
ctgctacaagtgtt

SEQ ID NO: 1109383 - DNA, 15 bp, Homo sapiens
ctgctacaatgtcct

SEQ ID NO: 1109384 - DNA, 15 bp, Homo sapiens
ctgctacagacctgg

SEQ ID NO: 1109385 - DNA, 12 bp, Homo sapiens
ctgctacagcaa

SEQ ID NO: 1109386 - DNA, 17 bp, Homo sapiens
ctgctacatcagactct

SEQ ID NO: 1109387 - DNA, 14 bp, Homo sapiens
ctgctaccagcgcc

SEQ ID NO: 1109388 - DNA, 13 bp, Homo sapiens
ctgctacctcact

SEQ ID NO: 1109389 - DNA, 14 bp, Homo sapiens
ctgctacctcactg

SEQ ID NO: 1109390 - DNA, 20 bp, Homo sapiens
ctgctacgttcctattgtca

SEQ ID NO: 1109391 - DNA, 17 bp, Homo sapiens
ctgctactggcaaaagg

SEQ ID NO: 1109392 - DNA, 16 bp, Homo sapiens
ctgctactgtcttact

SEQ ID NO: 1109393 - DNA, 15 bp, Homo sapiens
ctgctagagaagggg

SEQ ID NO: 1109394 - DNA, 13 bp, Homo sapiens
ctgctagagcaac

SEQ ID NO: 1109395 - DNA, 14 bp, Homo sapiens
ctgctagagcaacc

SEQ ID NO: 1109396 - DNA, 19 bp, Homo sapiens
ctgctagagcaacccctgt

SEQ ID NO: 1109397 - DNA, 23 bp, Homo sapiens
ctgctagagcaacccctgtaccc

SEQ ID NO: 1109398 - DNA, 22 bp, Homo sapiens
ctgctagagcagacaggcctgg

SEQ ID NO: 1109399 - DNA, 16 bp, Homo sapiens
ctgctagcaaatggca

SEQ ID NO: 1109400 - DNA, 15 bp, Homo sapiens
ctgctagctgtagaa

SEQ ID NO: 1109401 - DNA, 16 bp, Homo sapiens
ctgctagctgtagaaa

SEQ ID NO: 1109402 - DNA, 19 bp, Homo sapiens
ctgctagctgtagaaatgt

SEQ ID NO: 1109403 - DNA, 17 bp, Homo sapiens
ctgctggctgacctggg

SEQ ID NO: 1109404 - DNA, 14 bp, Homo sapiens
ctgctggcttcagg

SEQ ID NO: 1109405 - DNA, 15 bp, Homo sapiens
ctgctggcttcaggg

SEQ ID NO: 1109406 - DNA, 19 bp, Homo sapiens
ctgctggcttcagggaggg

SEQ ID NO: 1109407 - DNA, 17 bp, Homo sapiens
ctgctgggaaccccgca

SEQ ID NO: 1109408 - DNA, 19 bp, Homo sapiens
ctgctgggaaccccgcagc

SEQ ID NO: 1109409 - DNA, 21 bp, Homo sapiens
ctgctgggacgatcgcccagg

SEQ ID NO: 1109410 - DNA, 15 bp, Homo sapiens
ctgctgggagcctct

SEQ ID NO: 1109411 - DNA, 14 bp, Homo sapiens
ctgctgggatcctt

SEQ ID NO: 1109412 - DNA, 16 bp, Homo sapiens
ctgctgggcgtctgtt

SEQ ID NO: 1109413 - DNA, 19 bp, Homo sapiens
ctgctgggcgtctgttctt

SEQ ID NO: 1109414 - DNA, 15 bp, Homo sapiens
ctgctgggctaggtc

SEQ ID NO: 1109415 - DNA, 15 bp, Homo sapiens
ctgctgggctctcca

SEQ ID NO: 1109416 - DNA, 17 bp, Homo sapiens
ctgctgggctctccacc

SEQ ID NO: 1109417 - DNA, 19 bp, Homo sapiens
ctgctgggctctccacctc

SEQ ID NO: 1109418 - DNA, 23 bp, Homo sapiens
ctgctgggctctccacctcagcc

SEQ ID NO: 1109419 - DNA, 16 bp, Homo sapiens
ctgctgggctgagtga

SEQ ID NO: 1109420 - DNA, 16 bp, Homo sapiens
ctgctggggagacaaa

SEQ ID NO: 1109421 - DNA, 17 bp, Homo sapiens
ctgctggggatccccgc

SEQ ID NO: 1109422 - DNA, 21 bp, Homo sapiens
ctgctggggatccccgcctgg

SEQ ID NO: 1109423 - DNA, 12 bp, Homo sapiens
ctgctggggcat

SEQ ID NO: 1109424 - DNA, 14 bp, Homo sapiens
ctgctggggcatgt

SEQ ID NO: 1109425 - DNA, 17 bp, Homo sapiens
ctgctggggcatgtgtg

SEQ ID NO: 1109426 - DNA, 18 bp, Homo sapiens
ctgctggggcatgtgtgc

SEQ ID NO: 1109427 - DNA, 21 bp, Homo sapiens
ctgctggggcatgtgtgcctg

SEQ ID NO: 1109428 - DNA, 22 bp, Homo sapiens
ctgctggggcatgtgtgcctgt

SEQ ID NO: 1109429 - DNA, 23 bp, Homo sapiens
ctgctggggcatgtgtgcctgtg

SEQ ID NO: 1109430 - DNA, 11 bp, Homo sapiens
ctgctggggct

SEQ ID NO: 1109431 - DNA, 17 bp, Homo sapiens
ctgctggtatttctaat

SEQ ID NO: 1109432 - DNA, 17 bp, Homo sapiens
ctgctggtcttcaatta

SEQ ID NO: 1109433 - DNA, 15 bp, Homo sapiens
ctgctgtaaatacag

SEQ ID NO: 1109434 - DNA, 20 bp, Homo sapiens
ctgctgtaaatacaggaaga

SEQ ID NO: 1109435 - DNA, 19 bp, Homo sapiens
ctgctgtaactgctgagcc

SEQ ID NO: 1109436 - DNA, 15 bp, Homo sapiens
ctgctgtatttatag

SEQ ID NO: 1109437 - DNA, 22 bp, Homo sapiens
ctgctgtcaataaatgacaccc

SEQ ID NO: 1109438 - DNA, 18 bp, Homo sapiens
ctgctgtcctctccccct

SEQ ID NO: 1109439 - DNA, 19 bp, Homo sapiens
ctgctgtcctctccccctt

SEQ ID NO: 1109440 - DNA, 20 bp, Homo sapiens
ctgctgtcctctcccccttc

SEQ ID NO: 1109441 - DNA, 21 bp, Homo sapiens
ctgctgtcctctcccccttca

SEQ ID NO: 1109442 - DNA, 22 bp, Homo sapiens
ctgctgtcctctcccccttcag

SEQ ID NO: 1109443 - DNA, 23 bp, Homo sapiens
ctgctgtcctctcccccttcagc

SEQ ID NO: 1109444 - DNA, 20 bp, Homo sapiens
ctgctgtctcatcacataaa

SEQ ID NO: 1109445 - DNA, 23 bp, Homo sapiens
ctgctgtgaaccctggggcctga

SEQ ID NO: 1109446 - DNA, 21 bp, Homo sapiens
ctgctgtgagccgccaggaac

SEQ ID NO: 1109447 - DNA, 22 bp, Homo sapiens
ctgctgtgagtgcgcctcacca

SEQ ID NO: 1109448 - DNA, 21 bp, Homo sapiens
ctgctgtgatacgatgcttca

SEQ ID NO: 1109449 - DNA, 21 bp, Homo sapiens
ctgctgtgccatgctgggcca

SEQ ID NO: 1109450 - DNA, 16 bp, Homo sapiens
ctgctgtgcccagcct

SEQ ID NO: 1109451 - DNA, 12 bp, Homo sapiens
ctgctgtgctct

SEQ ID NO: 1109452 - DNA, 14 bp, Homo sapiens
ctgctgtgctctgg

SEQ ID NO: 1109453 - DNA, 19 bp, Homo sapiens
ctgctgtggccccctgtcc

SEQ ID NO: 1109454 - DNA, 19 bp, Homo sapiens
ctgctgtgggagagcgaag

SEQ ID NO: 1109455 - DNA, 11 bp, Homo sapiens
ctgctgtgggg

SEQ ID NO: 1109456 - DNA, 23 bp, Homo sapiens
ctgctgtgtgctttttttgtgtg

SEQ ID NO: 1109457 - DNA, 21 bp, Homo sapiens
ctgctgtgtggacggcgctgc

SEQ ID NO: 1109458 - DNA, 16 bp, Homo sapiens
ctgctgtgtgtgagca

SEQ ID NO: 1109459 - DNA, 18 bp, Homo sapiens
ctgctgtgttaagaggac

SEQ ID NO: 1109460 - DNA, 23 bp, Homo sapiens
ctgctgttatcaccatagttttg

SEQ ID NO: 1109461 - DNA, 14 bp, Homo sapiens
ctgctgttctcagg

SEQ ID NO: 1109462 - DNA, 15 bp, Homo sapiens
ctgctgttcttcact

SEQ ID NO: 1109463 - DNA, 16 bp, Homo sapiens
ctgctgttgccatagc

SEQ ID NO: 1109464 - DNA, 22 bp, Homo sapiens
ctgctgttggtcctctctctgt

SEQ ID NO: 1109465 - DNA, 23 bp, Homo sapiens
ctgctgttggtcctctctctgtg

SEQ ID NO: 1109466 - DNA, 14 bp, Homo sapiens
ctgcttacccttca

SEQ ID NO: 1109467 - DNA, 21 bp, Homo sapiens
ctgcttacctactttcttcag

SEQ ID NO: 1109468 - DNA, 20 bp, Homo sapiens
ctgcttagaatccaaacttg

SEQ ID NO: 1109469 - DNA, 22 bp, Homo sapiens
ctgcttagaatctgatgccttt

SEQ ID NO: 1109470 - DNA, 17 bp, Homo sapiens
ctgcttagctgccttga

SEQ ID NO: 1109471 - DNA, 14 bp, Homo sapiens
ctgcttaggaaacc

SEQ ID NO: 1109472 - DNA, 23 bp, Homo sapiens
ctgcttatcaataaacctgtttg

SEQ ID NO: 1109473 - DNA, 22 bp, Homo sapiens
ctgcttcaaagattatctgatt

SEQ ID NO: 1109474 - DNA, 19 bp, Homo sapiens
ctgcttcaaatatttccct

SEQ ID NO: 1109475 - DNA, 16 bp, Homo sapiens
ctgcttcattttggag

SEQ ID NO: 1109476 - DNA, 12 bp, Homo sapiens
ctgcttccagga

SEQ ID NO: 1109477 - DNA, 14 bp, Homo sapiens
ctgcttccatggct

SEQ ID NO: 1109478 - DNA, 19 bp, Homo sapiens
ctgcttccatggcttcctg

SEQ ID NO: 1109479 - DNA, 21 bp, Homo sapiens
ctgcttccatggcttcctgag

SEQ ID NO: 1109480 - DNA, 12 bp, Homo sapiens
ctgcttcccaga

SEQ ID NO: 1109481 - DNA, 11 bp, Homo sapiens
ctgcttcccat

SEQ ID NO: 1109482 - DNA, 12 bp, Homo sapiens
ctgcttcccatc

SEQ ID NO: 1109483 - DNA, 15 bp, Homo sapiens
ctgcttcccatccta

SEQ ID NO: 1109484 - DNA, 24 bp, Homo sapiens
ctgcttcccatcctaccctcgggc

SEQ ID NO: 1109485 - DNA, 18 bp, Homo sapiens
ctgcttcccctccctacc

SEQ ID NO: 1109486 - DNA, 16 bp, Homo sapiens
ctgcttccccttccta

SEQ ID NO: 1109487 - DNA, 14 bp, Homo sapiens
ctgcttccctctgc

SEQ ID NO: 1109488 - DNA, 18 bp, Homo sapiens
ctgcttccctctgcctgt

SEQ ID NO: 1109489 - DNA, 20 bp, Homo sapiens
ctgcttccctctgcctgtcc

SEQ ID NO: 1109490 - DNA, 15 bp, Homo sapiens
ctgcttcctcctgga

SEQ ID NO: 1109491 - DNA, 18 bp, Homo sapiens
ctgcttcctcctggaaat

SEQ ID NO: 1109492 - DNA, 12 bp, Homo sapiens
ctgcttcctgct

SEQ ID NO: 1109493 - DNA, 13 bp, Homo sapiens
ctgcttcctgctt

SEQ ID NO: 1109494 - DNA, 20 bp, Homo sapiens
ctgcttctagaaactctggc

SEQ ID NO: 1109495 - DNA, 22 bp, Homo sapiens
ctgcttctagaaactctggctc

SEQ ID NO: 1109496 - DNA, 16 bp, Homo sapiens
ctgcttctcatcccaa

SEQ ID NO: 1109497 - DNA, 19 bp, Homo sapiens
ctgcttctccatggccacc

SEQ ID NO: 1109498 - DNA, 13 bp, Homo sapiens
ctgcttctccccc

SEQ ID NO: 1109499 - DNA, 14 bp, Homo sapiens
ctgcttctcccccc

SEQ ID NO: 1109500 - DNA, 22 bp, Homo sapiens
ctgcttctccccccatcccagg

SEQ ID NO: 1109501 - DNA, 16 bp, Homo sapiens
ctgcttctcggccagc

SEQ ID NO: 1109502 - DNA, 17 bp, Homo sapiens
ctgcttctctgacttct

SEQ ID NO: 1109503 - DNA, 12 bp, Homo sapiens
ctgcttctgctc

SEQ ID NO: 1109504 - DNA, 17 bp, Homo sapiens
ctgcttctgctccagcc

SEQ ID NO: 1109505 - DNA, 20 bp, Homo sapiens
ctgcttctgctccagcccct

SEQ ID NO: 1109506 - DNA, 18 bp, Homo sapiens
ctgcttcttcccctctgc

SEQ ID NO: 1109507 - DNA, 23 bp, Homo sapiens
ctgcttcttggagctttggaata

SEQ ID NO: 1109508 - DNA, 23 bp, Homo sapiens
ctgcttgacctagctctttgggc

SEQ ID NO: 1109509 - DNA, 14 bp, Homo sapiens
ctgcttgaggaaaa

SEQ ID NO: 1109510 - DNA, 16 bp, Homo sapiens
ctgcttgaggaaaaca

SEQ ID NO: 1109511 - DNA, 18 bp, Homo sapiens
ctgcttgatgaagcaagg

SEQ ID NO: 1109512 - DNA, 20 bp, Homo sapiens
ctgcttgatttttgcctctt

SEQ ID NO: 1109513 - DNA, 19 bp, Homo sapiens
ctgcttgcacacttcccca

SEQ ID NO: 1109514 - DNA, 18 bp, Homo sapiens
ctgcttgccaaggcagag

SEQ ID NO: 1109515 - DNA, 19 bp, Homo sapiens
ctgcttgcccgctcccaca

SEQ ID NO: 1109516 - DNA, 23 bp, Homo sapiens
ctgcttggatgcgagcttggcct

SEQ ID NO: 1109517 - DNA, 16 bp, Homo sapiens
ctgcttggccagatgc

SEQ ID NO: 1109518 - DNA, 18 bp, Homo sapiens
ctgcttgtactaagccag

SEQ ID NO: 1109519 - DNA, 20 bp, Homo sapiens
ctgcttgtactaagccagga

SEQ ID NO: 1109520 - DNA, 22 bp, Homo sapiens
ctgcttgtactaagccaggagg

SEQ ID NO: 1109521 - DNA, 24 bp, Homo sapiens
ctgcttgtactaagccaggaggct

SEQ ID NO: 1109522 - DNA, 13 bp, Homo sapiens
ctgcttgtcctgc

SEQ ID NO: 1109523 - DNA, 22 bp, Homo sapiens
ctgcttgtcctgggcctgcccc

SEQ ID NO: 1109524 - DNA, 13 bp, Homo sapiens
ctggatattttca

SEQ ID NO: 1109525 - DNA, 23 bp, Homo sapiens
ctggatcaaagtaggcaggacca

SEQ ID NO: 1109526 - DNA, 14 bp, Homo sapiens
ctggatcagtaaaa

SEQ ID NO: 1109527 - DNA, 23 bp, Homo sapiens
ctggatcagtaaaattatactgt

SEQ ID NO: 1109528 - DNA, 20 bp, Homo sapiens
ctggatcagtcctttgatca

SEQ ID NO: 1109529 - DNA, 16 bp, Homo sapiens
ctggatccagcactgg

SEQ ID NO: 1109530 - DNA, 21 bp, Homo sapiens
ctggatccatcttgagccaca

SEQ ID NO: 1109531 - DNA, 23 bp, Homo sapiens
ctggatccctgcccttctcaaga

SEQ ID NO: 1109532 - DNA, 16 bp, Homo sapiens
ctggatcctcacacta

SEQ ID NO: 1109533 - DNA, 17 bp, Homo sapiens
ctggatctacctggagg

SEQ ID NO: 1109534 - DNA, 16 bp, Homo sapiens
ctggatctcctgctgc

SEQ ID NO: 1109535 - DNA, 19 bp, Homo sapiens
ctggatctcctgctgcctt

SEQ ID NO: 1109536 - DNA, 20 bp, Homo sapiens
ctggatctcttaagacagca

SEQ ID NO: 1109537 - DNA, 17 bp, Homo sapiens
ctggatctgaccctccc

SEQ ID NO: 1109538 - DNA, 20 bp, Homo sapiens
ctggatctgaccctcccagt

SEQ ID NO: 1109539 - DNA, 23 bp, Homo sapiens
ctggatcttgcctaaatcccaag

SEQ ID NO: 1109540 - DNA, 18 bp, Homo sapiens
ctggatgaggcacttctg

SEQ ID NO: 1109541 - DNA, 16 bp, Homo sapiens
ctggatgatactaata

SEQ ID NO: 1109542 - DNA, 18 bp, Homo sapiens
ctggatgatactaataaa

SEQ ID NO: 1109543 - DNA, 22 bp, Homo sapiens
ctggatgatactaataaactaa

SEQ ID NO: 1109544 - DNA, 20 bp, Homo sapiens
ctggatgatttcatcttctg

SEQ ID NO: 1109545 - DNA, 21 bp, Homo sapiens
ctggatgatttcatcttctgg

SEQ ID NO: 1109546 - DNA, 23 bp, Homo sapiens
ctggatgatttcatcttctggaa

SEQ ID NO: 1109547 - DNA, 22 bp, Homo sapiens
ctggatgcctcattatgtcaac

SEQ ID NO: 1109548 - DNA, 21 bp, Homo sapiens
ctggatggaacgggcatgggc

SEQ ID NO: 1109549 - DNA, 17 bp, Homo sapiens
ctggatggacagacacc

SEQ ID NO: 1109550 - DNA, 18 bp, Homo sapiens
ctggatggacagacacct

SEQ ID NO: 1109551 - DNA, 19 bp, Homo sapiens
ctggatggacagacacctc

SEQ ID NO: 1109552 - DNA, 22 bp, Homo sapiens
ctggatggacagacacctcccc

SEQ ID NO: 1109553 - DNA, 21 bp, Homo sapiens
ctggatggatttgaagcaaag

SEQ ID NO: 1109554 - DNA, 16 bp, Homo sapiens
ctggatggcaccagag

SEQ ID NO: 1109555 - DNA, 13 bp, Homo sapiens
ctggatggcccct

SEQ ID NO: 1109556 - DNA, 16 bp, Homo sapiens
ctggatggcccctcct

SEQ ID NO: 1109557 - DNA, 13 bp, Homo sapiens
ctggatgggactc

SEQ ID NO: 1109558 - DNA, 16 bp, Homo sapiens
ctggatgggaggagag

SEQ ID NO: 1109559 - DNA, 24 bp, Homo sapiens
ctggatgggaggagagccactggg

SEQ ID NO: 1109560 - DNA, 21 bp, Homo sapiens
ctggatgggcattgggctgac

SEQ ID NO: 1109561 - DNA, 22 bp, Homo sapiens
ctggatgggggtgcaggcagcc

SEQ ID NO: 1109562 - DNA, 17 bp, Homo sapiens
ctggatgtgtggggcat

SEQ ID NO: 1109563 - DNA, 19 bp, Homo sapiens
ctggattaatgttttgtac

SEQ ID NO: 1109564 - DNA, 21 bp, Homo sapiens
ctggattaatgttttgtacaa

SEQ ID NO: 1109565 - DNA, 19 bp, Homo sapiens
ctggattcacgccctcttg

SEQ ID NO: 1109566 - DNA, 14 bp, Homo sapiens
ctggattcagcctt

SEQ ID NO: 1109567 - DNA, 17 bp, Homo sapiens
ctggattcagccttctt

SEQ ID NO: 1109568 - DNA, 18 bp, Homo sapiens
ctggattcagccttcttt

SEQ ID NO: 1109569 - DNA, 17 bp, Homo sapiens
ctggattcattgtctct

SEQ ID NO: 1109570 - DNA, 19 bp, Homo sapiens
ctggattcatttcctgccc

SEQ ID NO: 1109571 - DNA, 12 bp, Homo sapiens
ctggattggcca

SEQ ID NO: 1109572 - DNA, 22 bp, Homo sapiens
ctggattgtgctttggttaata

SEQ ID NO: 1109573 - DNA, 16 bp, Homo sapiens
ctggattgtttttaaa

SEQ ID NO: 1109574 - DNA, 19 bp, Homo sapiens
ctggcaaaaggatctttgt

SEQ ID NO: 1109575 - DNA, 20 bp, Homo sapiens
ctggcaaaaggatctttgtg

SEQ ID NO: 1109576 - DNA, 22 bp, Homo sapiens
ctggcaaaccctcccagaaaca

SEQ ID NO: 1109577 - DNA, 20 bp, Homo sapiens
ctggcaaacttttctttctt

SEQ ID NO: 1109578 - DNA, 12 bp, Homo sapiens
ctggcaaagcag

SEQ ID NO: 1109579 - DNA, 23 bp, Homo sapiens
ctggcaagagcagatactgtctt

SEQ ID NO: 1109580 - DNA, 16 bp, Homo sapiens
ctggcaagcagggaaa

SEQ ID NO: 1109581 - DNA, 22 bp, Homo sapiens
ctggcaagcagggaaagctcca

SEQ ID NO: 1109582 - DNA, 18 bp, Homo sapiens
ctggcaaggcattcctca

SEQ ID NO: 1109583 - DNA, 17 bp, Homo sapiens
ctggcaagtcggggcct

SEQ ID NO: 1109584 - DNA, 19 bp, Homo sapiens
ctggcaatagtgtgttctg

SEQ ID NO: 1109585 - DNA, 18 bp, Homo sapiens
ctggcaattgtctattta

SEQ ID NO: 1109586 - DNA, 22 bp, Homo sapiens
ctggcaatttagcaaactgatg

SEQ ID NO: 1109587 - DNA, 22 bp, Homo sapiens
ctggcaccatggtgactgccac

SEQ ID NO: 1109588 - DNA, 23 bp, Homo sapiens
ctggcaccatggtgactgccaca

SEQ ID NO: 1109589 - DNA, 18 bp, Homo sapiens
ctggcacctgaaattaat

SEQ ID NO: 1109590 - DNA, 16 bp, Homo sapiens
ctggcacgccctactc

SEQ ID NO: 1109591 - DNA, 21 bp, Homo sapiens
ctggcacgccctactccactg

SEQ ID NO: 1109592 - DNA, 21 bp, Homo sapiens
ctggcacggtggctcaggcct

SEQ ID NO: 1109593 - DNA, 19 bp, Homo sapiens
ctggcacgtgacaggctcg

SEQ ID NO: 1109594 - DNA, 16 bp, Homo sapiens
ctggcactataatgta

SEQ ID NO: 1109595 - DNA, 19 bp, Homo sapiens
ctggcactgaattaatcat

SEQ ID NO: 1109596 - DNA, 20 bp, Homo sapiens
ctggcactgcgatcaggaag

SEQ ID NO: 1109597 - DNA, 18 bp, Homo sapiens
ctggcactgggaggcagg

SEQ ID NO: 1109598 - DNA, 18 bp, Homo sapiens
ctggcacttagcccaaga

SEQ ID NO: 1109599 - DNA, 16 bp, Homo sapiens
ctggcacttccattgg

SEQ ID NO: 1109600 - DNA, 23 bp, Homo sapiens
ctggcagaaagggaacagaaagg

SEQ ID NO: 1109601 - DNA, 13 bp, Homo sapiens
ctggcagaaggga

SEQ ID NO: 1109602 - DNA, 12 bp, Homo sapiens
ctggcagacaca

SEQ ID NO: 1109603 - DNA, 20 bp, Homo sapiens
ctggcagactcaaggggctg

SEQ ID NO: 1109604 - DNA, 21 bp, Homo sapiens
ctggcagactcaaggggctgg

SEQ ID NO: 1109605 - DNA, 15 bp, Homo sapiens
ctggcagagcacagc

SEQ ID NO: 1109606 - DNA, 18 bp, Homo sapiens
ctggcagagcacagccca

SEQ ID NO: 1109607 - DNA, 13 bp, Homo sapiens
ctggcagagcctc

SEQ ID NO: 1109608 - DNA, 15 bp, Homo sapiens
ctggcagagcctctg

SEQ ID NO: 1109609 - DNA, 16 bp, Homo sapiens
ctggcagagcctctga

SEQ ID NO: 1109610 - DNA, 17 bp, Homo sapiens
ctggcagagcctctgag

SEQ ID NO: 1109611 - DNA, 19 bp, Homo sapiens
ctggcagcacagcccaggg

SEQ ID NO: 1109612 - DNA, 16 bp, Homo sapiens
ctggcagcagcaggtg

SEQ ID NO: 1109613 - DNA, 19 bp, Homo sapiens
ctggcagccgtgccttcag

SEQ ID NO: 1109614 - DNA, 20 bp, Homo sapiens
ctggcagccgtgccttcagc

SEQ ID NO: 1109615 - DNA, 12 bp, Homo sapiens
ctggcagcctcc

SEQ ID NO: 1109616 - DNA, 14 bp, Homo sapiens
ctggcagcctccca

SEQ ID NO: 1109617 - DNA, 23 bp, Homo sapiens
ctggcagcctcccatccagggcc

SEQ ID NO: 1109618 - DNA, 19 bp, Homo sapiens
ctggcagctcctctccttg

SEQ ID NO: 1109619 - DNA, 20 bp, Homo sapiens
ctggcagctcctctccttgg

SEQ ID NO: 1109620 - DNA, 15 bp, Homo sapiens
ctggcagctgagagc

SEQ ID NO: 1109621 - DNA, 18 bp, Homo sapiens
ctggcagctgagagccct

SEQ ID NO: 1109622 - DNA, 14 bp, Homo sapiens
ctggcagctgcccc

SEQ ID NO: 1109623 - DNA, 15 bp, Homo sapiens
ctggcagctgcccct

SEQ ID NO: 1109624 - DNA, 16 bp, Homo sapiens
ctggcagctgcccctc

SEQ ID NO: 1109625 - DNA, 17 bp, Homo sapiens
ctggcagctgcccctcc

SEQ ID NO: 1109626 - DNA, 12 bp, Homo sapiens
ctggcagctgct

SEQ ID NO: 1109627 - DNA, 15 bp, Homo sapiens
ctggcagctgctgtg

SEQ ID NO: 1109628 - DNA, 16 bp, Homo sapiens
ctggcagctggaccat

SEQ ID NO: 1109629 - DNA, 23 bp, Homo sapiens
ctggcaggacacatcccggcctc

SEQ ID NO: 1109630 - DNA, 20 bp, Homo sapiens
ctggcaggacctgcctagca

SEQ ID NO: 1109631 - DNA, 20 bp, Homo sapiens
ctggcaggatgaccctgcga

SEQ ID NO: 1109632 - DNA, 13 bp, Homo sapiens
ctggcaggcttcc

SEQ ID NO: 1109633 - DNA, 12 bp, Homo sapiens
ctggcagggcca

SEQ ID NO: 1109634 - DNA, 14 bp, Homo sapiens
ctggcagggccacc

SEQ ID NO: 1109635 - DNA, 18 bp, Homo sapiens
ctggcagggccagggcaa

SEQ ID NO: 1109636 - DNA, 20 bp, Homo sapiens
ctggcagggctcacactcct

SEQ ID NO: 1109637 - DNA, 21 bp, Homo sapiens
ctggcagggctcacactcctg

SEQ ID NO: 1109638 - DNA, 18 bp, Homo sapiens
ctggcagggtgggatgga

SEQ ID NO: 1109639 - DNA, 21 bp, Homo sapiens
ctggcaggtgcagatgggctg

SEQ ID NO: 1109640 - DNA, 17 bp, Homo sapiens
ctggcagtgcaatgctt

SEQ ID NO: 1109641 - DNA, 22 bp, Homo sapiens
ctggcagtttatatttaactct

SEQ ID NO: 1109642 - DNA, 23 bp, Homo sapiens
ctggcatcaagaggtgggagggc

SEQ ID NO: 1109643 - DNA, 14 bp, Homo sapiens
ctggcatcaggtct

SEQ ID NO: 1109644 - DNA, 15 bp, Homo sapiens
ctggcatcaggtctg

SEQ ID NO: 1109645 - DNA, 16 bp, Homo sapiens
ctggcatcaggtctgg

SEQ ID NO: 1109646 - DNA, 18 bp, Homo sapiens
ctggcatcgcaccattct

SEQ ID NO: 1109647 - DNA, 20 bp, Homo sapiens
ctggcatcgcagcttcctgt

SEQ ID NO: 1109648 - DNA, 17 bp, Homo sapiens
ctggcatcgtggtgggg

SEQ ID NO: 1109649 - DNA, 18 bp, Homo sapiens
ctggcatctgacacaaaa

SEQ ID NO: 1109650 - DNA, 13 bp, Homo sapiens
ctggcatctgtgt

SEQ ID NO: 1109651 - DNA, 21 bp, Homo sapiens
ctggcatgacactctagtgac

SEQ ID NO: 1109652 - DNA, 17 bp, Homo sapiens
ctggcatgggacagggg

SEQ ID NO: 1109653 - DNA, 18 bp, Homo sapiens
ctggcatgtttcactcct

SEQ ID NO: 1109654 - DNA, 23 bp, Homo sapiens
ctggcatgtttcactcctgcttc

SEQ ID NO: 1109655 - DNA, 18 bp, Homo sapiens
ctggcatgttttctttgt

SEQ ID NO: 1109656 - DNA, 17 bp, Homo sapiens
ctggcattaagggcatt

SEQ ID NO: 1109657 - DNA, 18 bp, Homo sapiens
ctggcattagaattattt

SEQ ID NO: 1109658 - DNA, 19 bp, Homo sapiens
ctggcattatgtccactgt

SEQ ID NO: 1109659 - DNA, 21 bp, Homo sapiens
ctggcattatgtccactgtgt

SEQ ID NO: 1109660 - DNA, 19 bp, Homo sapiens
ctggcattgtccctgtgcc

SEQ ID NO: 1109661 - DNA, 20 bp, Homo sapiens
ctggccaaagagcctttcca

SEQ ID NO: 1109662 - DNA, 16 bp, Homo sapiens
ctggccaaatagcaaa

SEQ ID NO: 1109663 - DNA, 18 bp, Homo sapiens
ctggccaaatagcaaaga

SEQ ID NO: 1109664 - DNA, 14 bp, Homo sapiens
ctggccaaatatgc

SEQ ID NO: 1109665 - DNA, 17 bp, Homo sapiens
ctggccaaggtgtccag

SEQ ID NO: 1109666 - DNA, 18 bp, Homo sapiens
ctggccaaggtgtccagg

SEQ ID NO: 1109667 - DNA, 23 bp, Homo sapiens
ctggccaaggtgtccagggtcct

SEQ ID NO: 1109668 - DNA, 23 bp, Homo sapiens
ctggccacatcagccccacagga

SEQ ID NO: 1109669 - DNA, 16 bp, Homo sapiens
ctggccaccagccatc

SEQ ID NO: 1109670 - DNA, 14 bp, Homo sapiens
ctggccaccccaga

SEQ ID NO: 1109671 - DNA, 17 bp, Homo sapiens
ctggccacccctcccca

SEQ ID NO: 1109672 - DNA, 18 bp, Homo sapiens
ctggccacccctccccag

SEQ ID NO: 1109673 - DNA, 17 bp, Homo sapiens
ctggccaccctggcccg

SEQ ID NO: 1109674 - DNA, 16 bp, Homo sapiens
ctggccacctgaggtg

SEQ ID NO: 1109675 - DNA, 17 bp, Homo sapiens
ctggccacctgaggtgg

SEQ ID NO: 1109676 - DNA, 18 bp, Homo sapiens
ctggccacctgaggtggg

SEQ ID NO: 1109677 - DNA, 21 bp, Homo sapiens
ctggccacctgaggtgggccc

SEQ ID NO: 1109678 - DNA, 19 bp, Homo sapiens
ctggccaccttgtcctggc

SEQ ID NO: 1109679 - DNA, 19 bp, Homo sapiens
ctggccactaaagcttcag

SEQ ID NO: 1109680 - DNA, 21 bp, Homo sapiens
ctggccactaaagcttcagac

SEQ ID NO: 1109681 - DNA, 16 bp, Homo sapiens
ctggccactgtccctg

SEQ ID NO: 1109682 - DNA, 18 bp, Homo sapiens
ctggccactgtccctgtc

SEQ ID NO: 1109683 - DNA, 19 bp, Homo sapiens
ctggccactgtccctgtcc

SEQ ID NO: 1109684 - DNA, 13 bp, Homo sapiens
ctggccagacgct

SEQ ID NO: 1109685 - DNA, 14 bp, Homo sapiens
ctggccagacgctg

SEQ ID NO: 1109686 - DNA, 18 bp, Homo sapiens
ctggccagagagggccca

SEQ ID NO: 1109687 - DNA, 20 bp, Homo sapiens
ctggccagagagggcccagc

SEQ ID NO: 1109688 - DNA, 22 bp, Homo sapiens
ctggccagagagggcccagctg

SEQ ID NO: 1109689 - DNA, 23 bp, Homo sapiens
ctggccagagagggcccagctgt

SEQ ID NO: 1109690 - DNA, 12 bp, Homo sapiens
ctggccagcacc

SEQ ID NO: 1109691 - DNA, 16 bp, Homo sapiens
ctggccagcaccctct

SEQ ID NO: 1109692 - DNA, 23 bp, Homo sapiens
ctggccagccaatttcccggagc

SEQ ID NO: 1109693 - DNA, 13 bp, Homo sapiens
ctggccagctctg

SEQ ID NO: 1109694 - DNA, 14 bp, Homo sapiens
ctggccaggagcag

SEQ ID NO: 1109695 - DNA, 15 bp, Homo sapiens
ctggccaggagctct

SEQ ID NO: 1109696 - DNA, 23 bp, Homo sapiens
ctggccaggataatatatttgca

SEQ ID NO: 1109697 - DNA, 11 bp, Homo sapiens
ctggccaggca

SEQ ID NO: 1109698 - DNA, 13 bp, Homo sapiens
ctggccaggcaga

SEQ ID NO: 1109699 - DNA, 18 bp, Homo sapiens
ctggccagggccacgctc

SEQ ID NO: 1109700 - DNA, 16 bp, Homo sapiens
ctggccagtccaggct

SEQ ID NO: 1109701 - DNA, 18 bp, Homo sapiens
ctggccagtccaggctgc

SEQ ID NO: 1109702 - DNA, 22 bp, Homo sapiens
ctggccagtccaggctgccgtg

SEQ ID NO: 1109703 - DNA, 23 bp, Homo sapiens
ctggccagtccaggctgccgtgg

SEQ ID NO: 1109704 - DNA, 18 bp, Homo sapiens
ctggccagtcctggtcct

SEQ ID NO: 1109705 - DNA, 22 bp, Homo sapiens
ctggccagtcctggtcctggct

SEQ ID NO: 1109706 - DNA, 15 bp, Homo sapiens
ctggccagtgtcatt

SEQ ID NO: 1109707 - DNA, 18 bp, Homo sapiens
ctggccagtgtcatttta

SEQ ID NO: 1109708 - DNA, 20 bp, Homo sapiens
ctggccagtgtttaaaactt

SEQ ID NO: 1109709 - DNA, 16 bp, Homo sapiens
ctggccatactgtgtc

SEQ ID NO: 1109710 - DNA, 19 bp, Homo sapiens
ctggccatctccctcccca

SEQ ID NO: 1109711 - DNA, 23 bp, Homo sapiens
ctggccatggacgaatatgaatg

SEQ ID NO: 1109712 - DNA, 22 bp, Homo sapiens
ctggccatttgccaattttcct

SEQ ID NO: 1109713 - DNA, 17 bp, Homo sapiens
ctggccatttttctggg

SEQ ID NO: 1109714 - DNA, 13 bp, Homo sapiens
ctggcccactgca

SEQ ID NO: 1109715 - DNA, 15 bp, Homo sapiens
ctggcccactgcatc

SEQ ID NO: 1109716 - DNA, 19 bp, Homo sapiens
ctggcccagaaagcctctc

SEQ ID NO: 1109717 - DNA, 22 bp, Homo sapiens
ctggcccagaaagcctctctct

SEQ ID NO: 1109718 - DNA, 23 bp, Homo sapiens
ctggcccagaaagcctctctctc

SEQ ID NO: 1109719 - DNA, 23 bp, Homo sapiens
ctggcccagccaaaccctgtctg

SEQ ID NO: 1109720 - DNA, 21 bp, Homo sapiens
ctggcccagccaactgccccg

SEQ ID NO: 1109721 - DNA, 16 bp, Homo sapiens
ctggcccagccggcct

SEQ ID NO: 1109722 - DNA, 16 bp, Homo sapiens
ctggcccaggccttgc

SEQ ID NO: 1109723 - DNA, 18 bp, Homo sapiens
ctggcccaggccttgctg

SEQ ID NO: 1109724 - DNA, 21 bp, Homo sapiens
ctggcccaggccttgctgact

SEQ ID NO: 1109725 - DNA, 17 bp, Homo sapiens
ctggcccatctcagcct

SEQ ID NO: 1109726 - DNA, 18 bp, Homo sapiens
ctggcccatctcagcctc

SEQ ID NO: 1109727 - DNA, 21 bp, Homo sapiens
ctggcccatctcagcctcctg

SEQ ID NO: 1109728 - DNA, 23 bp, Homo sapiens
ctggccccagccctgctggggat

SEQ ID NO: 1109729 - DNA, 20 bp, Homo sapiens
ctggccccaggacctggctg

SEQ ID NO: 1109730 - DNA, 21 bp, Homo sapiens
ctggccccaggccccagacag

SEQ ID NO: 1109731 - DNA, 15 bp, Homo sapiens
ctggccccaggctgt

SEQ ID NO: 1109732 - DNA, 22 bp, Homo sapiens
ctggccccagtgcggttcctca

SEQ ID NO: 1109733 - DNA, 16 bp, Homo sapiens
ctggccccatgtctct

SEQ ID NO: 1109734 - DNA, 21 bp, Homo sapiens
ctggccccatgtctctcagaa

SEQ ID NO: 1109735 - DNA, 18 bp, Homo sapiens
ctggcccccaacctcagg

SEQ ID NO: 1109736 - DNA, 13 bp, Homo sapiens
ctggcccccagga

SEQ ID NO: 1109737 - DNA, 22 bp, Homo sapiens
ctggcccccaggattcccccag

SEQ ID NO: 1109738 - DNA, 23 bp, Homo sapiens
ctggcccccaggattcccccagc

SEQ ID NO: 1109739 - DNA, 14 bp, Homo sapiens
ctggccccgccgcc

SEQ ID NO: 1109740 - DNA, 20 bp, Homo sapiens
ctggccccgcctgcctgcca

SEQ ID NO: 1109741 - DNA, 21 bp, Homo sapiens
ctggccccgcctgcctgccac

SEQ ID NO: 1109742 - DNA, 21 bp, Homo sapiens
ctggccccggatcagagcagg

SEQ ID NO: 1109743 - DNA, 20 bp, Homo sapiens
ctggccccgggctctggcca

SEQ ID NO: 1109744 - DNA, 18 bp, Homo sapiens
ctggcccctcacccacca

SEQ ID NO: 1109745 - DNA, 20 bp, Homo sapiens
ctggcccctcacccaccatg

SEQ ID NO: 1109746 - DNA, 14 bp, Homo sapiens
ctggcccctcgcct

SEQ ID NO: 1109747 - DNA, 15 bp, Homo sapiens
ctggcccctcgcctg

SEQ ID NO: 1109748 - DNA, 19 bp, Homo sapiens
ctggcccctggcctgccgg

SEQ ID NO: 1109749 - DNA, 21 bp, Homo sapiens
ctggcccgtcatgttcctcaa

SEQ ID NO: 1109750 - DNA, 16 bp, Homo sapiens
ctggcccgtgacagac

SEQ ID NO: 1109751 - DNA, 14 bp, Homo sapiens
ctggccctccccac

SEQ ID NO: 1109752 - DNA, 18 bp, Homo sapiens
ctggccctccctccctag

SEQ ID NO: 1109753 - DNA, 21 bp, Homo sapiens
ctggccctccctccctagccc

SEQ ID NO: 1109754 - DNA, 18 bp, Homo sapiens
ctggccctcggtggctgc

SEQ ID NO: 1109755 - DNA, 22 bp, Homo sapiens
ctggccctcggtggctgcacag

SEQ ID NO: 1109756 - DNA, 20 bp, Homo sapiens
ctggccctgaggtgtggggg

SEQ ID NO: 1109757 - DNA, 14 bp, Homo sapiens
ctggccctgccttc

SEQ ID NO: 1109758 - DNA, 13 bp, Homo sapiens
ctggccctgcttc

SEQ ID NO: 1109759 - DNA, 22 bp, Homo sapiens
ctggccctgcttcctgcttgcc

SEQ ID NO: 1109760 - DNA, 21 bp, Homo sapiens
ctggccctgggagaatcgctc

SEQ ID NO: 1109761 - DNA, 12 bp, Homo sapiens
ctggccctgggg

SEQ ID NO: 1109762 - DNA, 18 bp, Homo sapiens
ctggcccttagagacccc

SEQ ID NO: 1109763 - DNA, 12 bp, Homo sapiens
ctggcccttcag

SEQ ID NO: 1109764 - DNA, 19 bp, Homo sapiens
ctgggatgctgacccagga

SEQ ID NO: 1109765 - DNA, 20 bp, Homo sapiens
ctgggatgctgacccaggaa

SEQ ID NO: 1109766 - DNA, 17 bp, Homo sapiens
ctgggatggaacctcag

SEQ ID NO: 1109767 - DNA, 18 bp, Homo sapiens
ctgggatggacaggaaag

SEQ ID NO: 1109768 - DNA, 17 bp, Homo sapiens
ctgggatgggaccaggg

SEQ ID NO: 1109769 - DNA, 17 bp, Homo sapiens
ctgggatgtagaacttc

SEQ ID NO: 1109770 - DNA, 21 bp, Homo sapiens
ctgggatgtgtagccttctcc

SEQ ID NO: 1109771 - DNA, 18 bp, Homo sapiens
ctgggatgtgtgctttcc

SEQ ID NO: 1109772 - DNA, 13 bp, Homo sapiens
ctgggattacagg

SEQ ID NO: 1109773 - DNA, 15 bp, Homo sapiens
ctgggattacaggca

SEQ ID NO: 1109774 - DNA, 21 bp, Homo sapiens
ctgggattctactttaagcac

SEQ ID NO: 1109775 - DNA, 22 bp, Homo sapiens
ctgggattctactttaagcact

SEQ ID NO: 1109776 - DNA, 23 bp, Homo sapiens
ctgggattctactttaagcacta

SEQ ID NO: 1109777 - DNA, 19 bp, Homo sapiens
ctgggattgtgggcatgag

SEQ ID NO: 1109778 - DNA, 19 bp, Homo sapiens
ctgggatttcttcgctgct

SEQ ID NO: 1109779 - DNA, 20 bp, Homo sapiens
ctgggatttcttcgctgctc

SEQ ID NO: 1109780 - DNA, 23 bp, Homo sapiens
ctgggatttcttcgctgctctag

SEQ ID NO: 1109781 - DNA, 16 bp, Homo sapiens
ctgggcaaagaggatc

SEQ ID NO: 1109782 - DNA, 22 bp, Homo sapiens
ctgggcaaagccacaaggctgg

SEQ ID NO: 1109783 - DNA, 22 bp, Homo sapiens
ctgggcaacactgcaggacagt

SEQ ID NO: 1109784 - DNA, 15 bp, Homo sapiens
ctgggcaacagagca

SEQ ID NO: 1109785 - DNA, 18 bp, Homo sapiens
ctgggcaacagagcaaga

SEQ ID NO: 1109786 - DNA, 19 bp, Homo sapiens
ctgggcaagagatgggaca

SEQ ID NO: 1109787 - DNA, 21 bp, Homo sapiens
ctgggcaagtggatggcccag

SEQ ID NO: 1109788 - DNA, 19 bp, Homo sapiens
ctgggcacagattgaagaa

SEQ ID NO: 1109789 - DNA, 14 bp, Homo sapiens
ctgggcacagtgct

SEQ ID NO: 1109790 - DNA, 15 bp, Homo sapiens
ctgggcacagtgctg

SEQ ID NO: 1109791 - DNA, 23 bp, Homo sapiens
ctgggcacagtgctgccccttgc

SEQ ID NO: 1109792 - DNA, 20 bp, Homo sapiens
ctgggcaccacctctgtggg

SEQ ID NO: 1109793 - DNA, 14 bp, Homo sapiens
ctgggcacccacct

SEQ ID NO: 1109794 - DNA, 20 bp, Homo sapiens
ctgggcacccacctccaccc

SEQ ID NO: 1109795 - DNA, 19 bp, Homo sapiens
ctgggcaccgtgtcctcct

SEQ ID NO: 1109796 - DNA, 21 bp, Homo sapiens
ctgggcaccgtgtcctcctct

SEQ ID NO: 1109797 - DNA, 13 bp, Homo sapiens
ctgggcacctgac

SEQ ID NO: 1109798 - DNA, 15 bp, Homo sapiens
ctgggcacctgactt

SEQ ID NO: 1109799 - DNA, 18 bp, Homo sapiens
ctgggcacctgcgcacag

SEQ ID NO: 1109800 - DNA, 17 bp, Homo sapiens
ctgggcacctggggagt

SEQ ID NO: 1109801 - DNA, 19 bp, Homo sapiens
ctgggcacgcctgctggcc

SEQ ID NO: 1109802 - DNA, 22 bp, Homo sapiens
ctgggcactgctccaagggaca

SEQ ID NO: 1109803 - DNA, 13 bp, Homo sapiens
ctgggcagacctt

SEQ ID NO: 1109804 - DNA, 17 bp, Homo sapiens
ctgggcagagcctgtcc

SEQ ID NO: 1109805 - DNA, 15 bp, Homo sapiens
ctgggcagcaaggct

SEQ ID NO: 1109806 - DNA, 17 bp, Homo sapiens
ctgggcagcaaggctgc

SEQ ID NO: 1109807 - DNA, 21 bp, Homo sapiens
ctgggcagcacctctggtcag

SEQ ID NO: 1109808 - DNA, 18 bp, Homo sapiens
ctgggcagccaggctgcc

SEQ ID NO: 1109809 - DNA, 15 bp, Homo sapiens
ctgggcagccccaca

SEQ ID NO: 1109810 - DNA, 20 bp, Homo sapiens
ctgggcagcccgctaggctc

SEQ ID NO: 1109811 - DNA, 13 bp, Homo sapiens
ctgggcagcctgc

SEQ ID NO: 1109812 - DNA, 16 bp, Homo sapiens
ctgggcagcctgcttt

SEQ ID NO: 1109813 - DNA, 13 bp, Homo sapiens
ctgggcagccttg

SEQ ID NO: 1109814 - DNA, 15 bp, Homo sapiens
ctgggcagccttggg

SEQ ID NO: 1109815 - DNA, 17 bp, Homo sapiens
ctgggcagctcctccct

SEQ ID NO: 1109816 - DNA, 21 bp, Homo sapiens
ctgggcagctcctccctgtgc

SEQ ID NO: 1109817 - DNA, 23 bp, Homo sapiens
ctgggcagctcctccctgtgccc

SEQ ID NO: 1109818 - DNA, 19 bp, Homo sapiens
ctgggcagcttctgttggc

SEQ ID NO: 1109819 - DNA, 21 bp, Homo sapiens
ctgggcagcttctgttggcag

SEQ ID NO: 1109820 - DNA, 20 bp, Homo sapiens
ctgggcaggcggtccccatc

SEQ ID NO: 1109821 - DNA, 22 bp, Homo sapiens
ctgggcagggcagggcagcctg

SEQ ID NO: 1109822 - DNA, 12 bp, Homo sapiens
ctgggcagggtg

SEQ ID NO: 1109823 - DNA, 13 bp, Homo sapiens
ctgggcagggtga

SEQ ID NO: 1109824 - DNA, 21 bp, Homo sapiens
ctgggcaggttcctggggccg

SEQ ID NO: 1109825 - DNA, 17 bp, Homo sapiens
ctgggcagtgagtgcca

SEQ ID NO: 1109826 - DNA, 18 bp, Homo sapiens
ctgggcagtgagtgccat

SEQ ID NO: 1109827 - DNA, 17 bp, Homo sapiens
ctgggcagtgccacagc

SEQ ID NO: 1109828 - DNA, 19 bp, Homo sapiens
ctgggcagtgccagccaat

SEQ ID NO: 1109829 - DNA, 13 bp, Homo sapiens
ctgggcagtgctc

SEQ ID NO: 1109830 - DNA, 20 bp, Homo sapiens
ctgggcatcccagcttgccc

SEQ ID NO: 1109831 - DNA, 21 bp, Homo sapiens
ctgggcatcccagcttgcccc

SEQ ID NO: 1109832 - DNA, 23 bp, Homo sapiens
ctgggcatcccagcttgcccccg

SEQ ID NO: 1109833 - DNA, 12 bp, Homo sapiens
ctgggcattttc

SEQ ID NO: 1109834 - DNA, 23 bp, Homo sapiens
ctgggcattttcctcctctgcct

SEQ ID NO: 1109835 - DNA, 19 bp, Homo sapiens
ctgggccaactcacctgag

SEQ ID NO: 1109836 - DNA, 21 bp, Homo sapiens
ctgggccacacctgagcgctg

SEQ ID NO: 1109837 - DNA, 14 bp, Homo sapiens
ctgggccacctcct

SEQ ID NO: 1109838 - DNA, 11 bp, Homo sapiens
ctgggccaggg

SEQ ID NO: 1109839 - DNA, 13 bp, Homo sapiens
ctgggccagggtc

SEQ ID NO: 1109840 - DNA, 20 bp, Homo sapiens
ctgggccagggtctgtgtga

SEQ ID NO: 1109841 - DNA, 22 bp, Homo sapiens
ctgggccagggtctgtgtgaat

SEQ ID NO: 1109842 - DNA, 16 bp, Homo sapiens
ctgggccatgcgaggg

SEQ ID NO: 1109843 - DNA, 18 bp, Homo sapiens
ctgggccatgtccaaaga

SEQ ID NO: 1109844 - DNA, 22 bp, Homo sapiens
ctgggccatgtccaaagaggct

SEQ ID NO: 1109845 - DNA, 15 bp, Homo sapiens
ctgggcccaaaggcc

SEQ ID NO: 1109846 - DNA, 17 bp, Homo sapiens
ctgggcccaaaggccca

SEQ ID NO: 1109847 - DNA, 20 bp, Homo sapiens
ctgggcccaaaggcccaggg

SEQ ID NO: 1109848 - DNA, 23 bp, Homo sapiens
ctgggcccaaaggcccagggagg

SEQ ID NO: 1109849 - DNA, 24 bp, Homo sapiens
ctgggcccaaaggcccagggaggc

SEQ ID NO: 1109850 - DNA, 14 bp, Homo sapiens
ctgggcccacagag

SEQ ID NO: 1109851 - DNA, 18 bp, Homo sapiens
ctgggcccacagagatgc

SEQ ID NO: 1109852 - DNA, 15 bp, Homo sapiens
ctgggcccacagagc

SEQ ID NO: 1109853 - DNA, 19 bp, Homo sapiens
ctgggcccacagagcctgg

SEQ ID NO: 1109854 - DNA, 16 bp, Homo sapiens
ctgggcccacccaggg

SEQ ID NO: 1109855 - DNA, 13 bp, Homo sapiens
ctgggcccaggca

SEQ ID NO: 1109856 - DNA, 17 bp, Homo sapiens
ctgggcccatctccctg

SEQ ID NO: 1109857 - DNA, 14 bp, Homo sapiens
ctgggccccaccac

SEQ ID NO: 1109858 - DNA, 16 bp, Homo sapiens
ctgggccccaccacct

SEQ ID NO: 1109859 - DNA, 15 bp, Homo sapiens
ctgggccccatgctc

SEQ ID NO: 1109860 - DNA, 17 bp, Homo sapiens
ctgggccccatgctctg

SEQ ID NO: 1109861 - DNA, 18 bp, Homo sapiens
ctgggccccatgctctgc

SEQ ID NO: 1109862 - DNA, 16 bp, Homo sapiens
ctgggcccctccacgc

SEQ ID NO: 1109863 - DNA, 13 bp, Homo sapiens
ctgggcccctggg

SEQ ID NO: 1109864 - DNA, 17 bp, Homo sapiens
ctgggcccctggggaca

SEQ ID NO: 1109865 - DNA, 23 bp, Homo sapiens
ctgggcccctggggacagagcca

SEQ ID NO: 1109866 - DNA, 12 bp, Homo sapiens
ctgggcccctgt

SEQ ID NO: 1109867 - DNA, 18 bp, Homo sapiens
ctgggcccctgtccccag

SEQ ID NO: 1109868 - DNA, 19 bp, Homo sapiens
ctgggcccggaagggcttt

SEQ ID NO: 1109869 - DNA, 14 bp, Homo sapiens
ctgggcccgggcag

SEQ ID NO: 1109870 - DNA, 17 bp, Homo sapiens
ctgggcccgggcaggcc

SEQ ID NO: 1109871 - DNA, 13 bp, Homo sapiens
ctgggccctctct

SEQ ID NO: 1109872 - DNA, 15 bp, Homo sapiens
ctgggccctctctgc

SEQ ID NO: 1109873 - DNA, 14 bp, Homo sapiens
ctgggccctctctt

SEQ ID NO: 1109874 - DNA, 18 bp, Homo sapiens
ctgggccctctttccctg

SEQ ID NO: 1109875 - DNA, 19 bp, Homo sapiens
ctgggccctctttccctgc

SEQ ID NO: 1109876 - DNA, 23 bp, Homo sapiens
ctgggccctggaggaattcagct

SEQ ID NO: 1109877 - DNA, 16 bp, Homo sapiens
ctgggccctgggctga

SEQ ID NO: 1109878 - DNA, 18 bp, Homo sapiens
ctgggcccttgtgctcct

SEQ ID NO: 1109879 - DNA, 15 bp, Homo sapiens
ctgggccgcaagggc

SEQ ID NO: 1109880 - DNA, 22 bp, Homo sapiens
ctgggccgcaagggcctggacg

SEQ ID NO: 1109881 - DNA, 15 bp, Homo sapiens
ctgggccgggcctgg

SEQ ID NO: 1109882 - DNA, 17 bp, Homo sapiens
ctgggccgggcctgggg

SEQ ID NO: 1109883 - DNA, 19 bp, Homo sapiens
ctgggccgggctgtagatc

SEQ ID NO: 1109884 - DNA, 21 bp, Homo sapiens
ctgggccgtggcacagctggg

SEQ ID NO: 1109885 - DNA, 20 bp, Homo sapiens
ctggtcactctgccctctgc

SEQ ID NO: 1109886 - DNA, 16 bp, Homo sapiens
ctggtcagagagacct

SEQ ID NO: 1109887 - DNA, 23 bp, Homo sapiens
ctggtcagagagacctcatcctg

SEQ ID NO: 1109888 - DNA, 12 bp, Homo sapiens
ctggtcagggca

SEQ ID NO: 1109889 - DNA, 13 bp, Homo sapiens
ctggtcagggcag

SEQ ID NO: 1109890 - DNA, 19 bp, Homo sapiens
ctggtcagggcagtggcca

SEQ ID NO: 1109891 - DNA, 17 bp, Homo sapiens
ctggtcaggtatttcag

SEQ ID NO: 1109892 - DNA, 18 bp, Homo sapiens
ctggtcagtctttgctca

SEQ ID NO: 1109893 - DNA, 20 bp, Homo sapiens
ctggtcagtctttgctcagt

SEQ ID NO: 1109894 - DNA, 21 bp, Homo sapiens
ctggtcatccttggtgctctt

SEQ ID NO: 1109895 - DNA, 24 bp, Homo sapiens
ctggtcatccttggtgctcttgct

SEQ ID NO: 1109896 - DNA, 15 bp, Homo sapiens
ctggtccaaaagatt

SEQ ID NO: 1109897 - DNA, 15 bp, Homo sapiens
ctggtccagctctga

SEQ ID NO: 1109898 - DNA, 16 bp, Homo sapiens
ctggtccagctctgac

SEQ ID NO: 1109899 - DNA, 17 bp, Homo sapiens
ctggtccagctctgaca

SEQ ID NO: 1109900 - DNA, 18 bp, Homo sapiens
ctggtccagctctgacat

SEQ ID NO: 1109901 - DNA, 21 bp, Homo sapiens
ctggtccagggaagctggccg

SEQ ID NO: 1109902 - DNA, 22 bp, Homo sapiens
ctggtccagggaagctggccga

SEQ ID NO: 1109903 - DNA, 14 bp, Homo sapiens
ctggtccagggcta

SEQ ID NO: 1109904 - DNA, 17 bp, Homo sapiens
ctggtccatgatggagt

SEQ ID NO: 1109905 - DNA, 17 bp, Homo sapiens
ctggtcccacgagggtg

SEQ ID NO: 1109906 - DNA, 20 bp, Homo sapiens
ctggtcccctcccccatccc

SEQ ID NO: 1109907 - DNA, 20 bp, Homo sapiens
ctggtcccggggccagcact

SEQ ID NO: 1109908 - DNA, 18 bp, Homo sapiens
ctggtccctcgtccacag

SEQ ID NO: 1109909 - DNA, 15 bp, Homo sapiens
ctggtccctgggagg

SEQ ID NO: 1109910 - DNA, 17 bp, Homo sapiens
ctggtcccttgcagcta

SEQ ID NO: 1109911 - DNA, 17 bp, Homo sapiens
ctggtcctccactttgc

SEQ ID NO: 1109912 - DNA, 20 bp, Homo sapiens
ctggtcctccactttgctgg

SEQ ID NO: 1109913 - DNA, 19 bp, Homo sapiens
ctggtcctggacacctccc

SEQ ID NO: 1109914 - DNA, 18 bp, Homo sapiens
ctggtcctggctgcactc

SEQ ID NO: 1109915 - DNA, 16 bp, Homo sapiens
ctggtccttccaggcc

SEQ ID NO: 1109916 - DNA, 14 bp, Homo sapiens
ctggtcgctcctgc

SEQ ID NO: 1109917 - DNA, 15 bp, Homo sapiens
ctggtcgctcctgcc

SEQ ID NO: 1109918 - DNA, 19 bp, Homo sapiens
ctggtctaatttattaatc

SEQ ID NO: 1109919 - DNA, 18 bp, Homo sapiens
ctggtctcaaactcctga

SEQ ID NO: 1109920 - DNA, 22 bp, Homo sapiens
ctggtctcaaactcctgacctc

SEQ ID NO: 1109921 - DNA, 21 bp, Homo sapiens
ctggtctcaaactcctgggct

SEQ ID NO: 1109922 - DNA, 20 bp, Homo sapiens
ctggtctcgaactcctgacc

SEQ ID NO: 1109923 - DNA, 22 bp, Homo sapiens
ctggtctgccaggggcttccca

SEQ ID NO: 1109924 - DNA, 13 bp, Homo sapiens
ctggtctggagtc

SEQ ID NO: 1109925 - DNA, 19 bp, Homo sapiens
ctggtctggagtcccaccc

SEQ ID NO: 1109926 - DNA, 20 bp, Homo sapiens
ctggtctggagtcccacccg

SEQ ID NO: 1109927 - DNA, 13 bp, Homo sapiens
ctggtctgtctgg

SEQ ID NO: 1109928 - DNA, 14 bp, Homo sapiens
ctggtctgtctgga

SEQ ID NO: 1109929 - DNA, 22 bp, Homo sapiens
ctggtctgtgaagagccggtgg

SEQ ID NO: 1109930 - DNA, 18 bp, Homo sapiens
ctggtcttaaactcctgg

SEQ ID NO: 1109931 - DNA, 16 bp, Homo sapiens
ctggtcttctttgggt

SEQ ID NO: 1109932 - DNA, 18 bp, Homo sapiens
ctggtcttgaactcctgg

SEQ ID NO: 1109933 - DNA, 19 bp, Homo sapiens
ctggtcttgttagaaaaca

SEQ ID NO: 1109934 - DNA, 13 bp, Homo sapiens
ctggtcttttctc

SEQ ID NO: 1109935 - DNA, 21 bp, Homo sapiens
ctggtgaacactgtgaccagg

SEQ ID NO: 1109936 - DNA, 15 bp, Homo sapiens
ctggtgaccagactt

SEQ ID NO: 1109937 - DNA, 18 bp, Homo sapiens
ctggtgacctcctgtcac

SEQ ID NO: 1109938 - DNA, 19 bp, Homo sapiens
ctggtgactttggggacag

SEQ ID NO: 1109939 - DNA, 21 bp, Homo sapiens
ctggtgactttggggacaggg

SEQ ID NO: 1109940 - DNA, 22 bp, Homo sapiens
ctggtgagacagtttactttgc

SEQ ID NO: 1109941 - DNA, 14 bp, Homo sapiens
ctggtgagaccccg

SEQ ID NO: 1109942 - DNA, 17 bp, Homo sapiens
ctggtgagaccccgcac

SEQ ID NO: 1109943 - DNA, 20 bp, Homo sapiens
ctggtgagaccccgcactgc

SEQ ID NO: 1109944 - DNA, 13 bp, Homo sapiens
ctggtgaggtggc

SEQ ID NO: 1109945 - DNA, 17 bp, Homo sapiens
ctggtgaggtggcccag

SEQ ID NO: 1109946 - DNA, 19 bp, Homo sapiens
ctggtgagtcttggcggca

SEQ ID NO: 1109947 - DNA, 20 bp, Homo sapiens
ctggtgagtcttggcggcag

SEQ ID NO: 1109948 - DNA, 21 bp, Homo sapiens
ctggtgataaaaataaagctg

SEQ ID NO: 1109949 - DNA, 17 bp, Homo sapiens
ctggtgcacgcctgagc

SEQ ID NO: 1109950 - DNA, 12 bp, Homo sapiens
ctggtgcagtgg

SEQ ID NO: 1109951 - DNA, 14 bp, Homo sapiens
ctggtgcattacag

SEQ ID NO: 1109952 - DNA, 20 bp, Homo sapiens
ctggtgccaaatagccccag

SEQ ID NO: 1109953 - DNA, 16 bp, Homo sapiens
ctggtgccaatttcaa

SEQ ID NO: 1109954 - DNA, 18 bp, Homo sapiens
ctggtgccaatttcaagt

SEQ ID NO: 1109955 - DNA, 20 bp, Homo sapiens
ctggtgccaatttcaagttc

SEQ ID NO: 1109956 - DNA, 14 bp, Homo sapiens
ctggtgccagcctt

SEQ ID NO: 1109957 - DNA, 14 bp, Homo sapiens
ctggtgcccacagc

SEQ ID NO: 1109958 - DNA, 16 bp, Homo sapiens
ctggtgcccatgaaga

SEQ ID NO: 1109959 - DNA, 15 bp, Homo sapiens
ctggtgccccacagc

SEQ ID NO: 1109960 - DNA, 14 bp, Homo sapiens
ctggtgccctgaga

SEQ ID NO: 1109961 - DNA, 21 bp, Homo sapiens
ctggtgccctggatgcccagg

SEQ ID NO: 1109962 - DNA, 14 bp, Homo sapiens
ctggtgcctctgtg

SEQ ID NO: 1109963 - DNA, 15 bp, Homo sapiens
ctggtgcggatggac

SEQ ID NO: 1109964 - DNA, 16 bp, Homo sapiens
ctggtgcggatggaca

SEQ ID NO: 1109965 - DNA, 20 bp, Homo sapiens
ctggtgctacttgcttgaag

SEQ ID NO: 1109966 - DNA, 19 bp, Homo sapiens
ctggtgctataggctggag

SEQ ID NO: 1109967 - DNA, 21 bp, Homo sapiens
ctggtgctataggctggagaa

SEQ ID NO: 1109968 - DNA, 12 bp, Homo sapiens
ctggtgctgcca

SEQ ID NO: 1109969 - DNA, 20 bp, Homo sapiens
ctggtgctgccacacttcag

SEQ ID NO: 1109970 - DNA, 22 bp, Homo sapiens
ctggtgctgccacacttcaggc

SEQ ID NO: 1109971 - DNA, 17 bp, Homo sapiens
ctggtgctgtggccagg

SEQ ID NO: 1109972 - DNA, 15 bp, Homo sapiens
ctggtggacagtcct

SEQ ID NO: 1109973 - DNA, 19 bp, Homo sapiens
ctggtggacagtcctggga

SEQ ID NO: 1109974 - DNA, 18 bp, Homo sapiens
ctggtggagaaagcactg

SEQ ID NO: 1109975 - DNA, 22 bp, Homo sapiens
ctggtggagaaagcactgacct

SEQ ID NO: 1109976 - DNA, 23 bp, Homo sapiens
ctggtggagaaagcactgacctg

SEQ ID NO: 1109977 - DNA, 22 bp, Homo sapiens
ctggtggaggagctgagggagg

SEQ ID NO: 1109978 - DNA, 15 bp, Homo sapiens
ctggtggattgttct

SEQ ID NO: 1109979 - DNA, 12 bp, Homo sapiens
ctggtggcacca

SEQ ID NO: 1109980 - DNA, 14 bp, Homo sapiens
ctggtggcaccaga

SEQ ID NO: 1109981 - DNA, 20 bp, Homo sapiens
ctggtggccccgtttctggt

SEQ ID NO: 1109982 - DNA, 19 bp, Homo sapiens
ctggtggcttaagtgagca

SEQ ID NO: 1109983 - DNA, 14 bp, Homo sapiens
ctggtgggggaagg

SEQ ID NO: 1109984 - DNA, 19 bp, Homo sapiens
ctggtgggggttctggcag

SEQ ID NO: 1109985 - DNA, 23 bp, Homo sapiens
ctggtgggggttctggcaggacc

SEQ ID NO: 1109986 - DNA, 23 bp, Homo sapiens
ctggtgggtcggccgccatagcc

SEQ ID NO: 1109987 - DNA, 21 bp, Homo sapiens
ctggtgggtggcccagagcct

SEQ ID NO: 1109988 - DNA, 19 bp, Homo sapiens
ctggtggtaccattattat

SEQ ID NO: 1109989 - DNA, 15 bp, Homo sapiens
ctggtggtcagccct

SEQ ID NO: 1109990 - DNA, 19 bp, Homo sapiens
ctggtggtcagccctagga

SEQ ID NO: 1109991 - DNA, 22 bp, Homo sapiens
ctggtggtctgttggcaggctg

SEQ ID NO: 1109992 - DNA, 18 bp, Homo sapiens
ctggtggtgcagccttcc

SEQ ID NO: 1109993 - DNA, 21 bp, Homo sapiens
ctggtggtgcagccttcccct

SEQ ID NO: 1109994 - DNA, 17 bp, Homo sapiens
ctggtggttaaggccag

SEQ ID NO: 1109995 - DNA, 19 bp, Homo sapiens
ctggtggttaaggccaggg

SEQ ID NO: 1109996 - DNA, 22 bp, Homo sapiens
ctggtggtttgatcatttctgc

SEQ ID NO: 1109997 - DNA, 18 bp, Homo sapiens
ctggtggttttcagagca

SEQ ID NO: 1109998 - DNA, 20 bp, Homo sapiens
ctggtggttttcagagcagg

SEQ ID NO: 1109999 - DNA, 22 bp, Homo sapiens
ctggtggttttcagagcaggag

SEQ ID NO: 1110000 - DNA, 23 bp, Homo sapiens
ctggtggttttcagagcaggagg

SEQ ID NO: 1110001 - DNA, 15 bp, Homo sapiens
ctggtgtaggaagtt

SEQ ID NO: 1110002 - DNA, 17 bp, Homo sapiens
ctggtgtcagcccctct

SEQ ID NO: 1110003 - DNA, 15 bp, Homo sapiens
ctggtgtcatggtga

SEQ ID NO: 1110004 - DNA, 16 bp, Homo sapiens
ctggtgtccagctgag

SEQ ID NO: 1110005 - DNA, 17 bp, Homo sapiens
ctggtgtcctgaccacc

SEQ ID NO: 1110006 - DNA, 15 bp, Homo sapiens
ctgtatatacaataa

SEQ ID NO: 1110007 - DNA, 16 bp, Homo sapiens
ctgtatatagcccagc

SEQ ID NO: 1110008 - DNA, 22 bp, Homo sapiens
ctgtatatgattctctgtggtt

SEQ ID NO: 1110009 - DNA, 13 bp, Homo sapiens
ctgtatatgtatt

SEQ ID NO: 1110010 - DNA, 14 bp, Homo sapiens
ctgtatatgtattc

SEQ ID NO: 1110011 - DNA, 21 bp, Homo sapiens
ctgtatatgtattcccttgta

SEQ ID NO: 1110012 - DNA, 15 bp, Homo sapiens
ctgtatatgttgtaa

SEQ ID NO: 1110013 - DNA, 14 bp, Homo sapiens
ctgtatattcagga

SEQ ID NO: 1110014 - DNA, 15 bp, Homo sapiens
ctgtatatttgtcat

SEQ ID NO: 1110015 - DNA, 22 bp, Homo sapiens
ctgtatatttgtcatgacagtg

SEQ ID NO: 1110016 - DNA, 23 bp, Homo sapiens
ctgtatatttgtgatagcacttt

SEQ ID NO: 1110017 - DNA, 23 bp, Homo sapiens
ctgtatccaggttccctcccaga

SEQ ID NO: 1110018 - DNA, 15 bp, Homo sapiens
ctgtatctatgcaaa

SEQ ID NO: 1110019 - DNA, 15 bp, Homo sapiens
ctgtatctgtaatta

SEQ ID NO: 1110020 - DNA, 23 bp, Homo sapiens
ctgtatctgtagtgagatagcat

SEQ ID NO: 1110021 - DNA, 13 bp, Homo sapiens
ctgtatctgtgct

SEQ ID NO: 1110022 - DNA, 21 bp, Homo sapiens
ctgtatgaaaaattggggagg

SEQ ID NO: 1110023 - DNA, 16 bp, Homo sapiens
ctgtatgaatgtgatt

SEQ ID NO: 1110024 - DNA, 18 bp, Homo sapiens
ctgtatgagacaggaaaa

SEQ ID NO: 1110025 - DNA, 15 bp, Homo sapiens
ctgtatgatttgttt

SEQ ID NO: 1110026 - DNA, 18 bp, Homo sapiens
ctgtatgatttgttttga

SEQ ID NO: 1110027 - DNA, 14 bp, Homo sapiens
ctgtatgcaaagtc

SEQ ID NO: 1110028 - DNA, 11 bp, Homo sapiens
ctgtatgcatc

SEQ ID NO: 1110029 - DNA, 15 bp, Homo sapiens
ctgtatgcatcagat

SEQ ID NO: 1110030 - DNA, 14 bp, Homo sapiens
ctgtatgccttctg

SEQ ID NO: 1110031 - DNA, 16 bp, Homo sapiens
ctgtatgctgatcatc

SEQ ID NO: 1110032 - DNA, 17 bp, Homo sapiens
ctgtatggcactctgta

SEQ ID NO: 1110033 - DNA, 12 bp, Homo sapiens
ctgtatggccca

SEQ ID NO: 1110034 - DNA, 15 bp, Homo sapiens
ctgtatggcccaggc

SEQ ID NO: 1110035 - DNA, 21 bp, Homo sapiens
ctgtatggcccaggcagcctc

SEQ ID NO: 1110036 - DNA, 16 bp, Homo sapiens
ctgtatgtgagctgta

SEQ ID NO: 1110037 - DNA, 23 bp, Homo sapiens
ctgtatgtgagctgtaaaaatgt

SEQ ID NO: 1110038 - DNA, 15 bp, Homo sapiens
ctgtatgttgtccaa

SEQ ID NO: 1110039 - DNA, 14 bp, Homo sapiens
ctgtattaagtgac

SEQ ID NO: 1110040 - DNA, 14 bp, Homo sapiens
ctgtattacagctt

SEQ ID NO: 1110041 - DNA, 23 bp, Homo sapiens
ctgtattactgaataatatcaaa

SEQ ID NO: 1110042 - DNA, 20 bp, Homo sapiens
ctgtattccgatacaaagtg

SEQ ID NO: 1110043 - DNA, 16 bp, Homo sapiens
ctgtattcgtgcattt

SEQ ID NO: 1110044 - DNA, 13 bp, Homo sapiens
ctgtattgccccc

SEQ ID NO: 1110045 - DNA, 15 bp, Homo sapiens
ctgtattgctcctcc

SEQ ID NO: 1110046 - DNA, 22 bp, Homo sapiens
ctgtattgctcctcccacttct

SEQ ID NO: 1110047 - DNA, 23 bp, Homo sapiens
ctgtatttacagacacacccagt

SEQ ID NO: 1110048 - DNA, 18 bp, Homo sapiens
ctgtatttatgtgtgagg

SEQ ID NO: 1110049 - DNA, 21 bp, Homo sapiens
ctgtatttcagtattttccag

SEQ ID NO: 1110050 - DNA, 15 bp, Homo sapiens
ctgtatttcatgtgg

SEQ ID NO: 1110051 - DNA, 18 bp, Homo sapiens
ctgtatttgaaataagaa

SEQ ID NO: 1110052 - DNA, 22 bp, Homo sapiens
ctgtatttgctgccagacactg

SEQ ID NO: 1110053 - DNA, 14 bp, Homo sapiens
ctgtatttgtatct

SEQ ID NO: 1110054 - DNA, 23 bp, Homo sapiens
ctgtatttgtatctctgaagcat

SEQ ID NO: 1110055 - DNA, 20 bp, Homo sapiens
ctgtattttaacactttgta

SEQ ID NO: 1110056 - DNA, 21 bp, Homo sapiens
ctgtattttatttagacaaga

SEQ ID NO: 1110057 - DNA, 19 bp, Homo sapiens
ctgtattttggctttctcc

SEQ ID NO: 1110058 - DNA, 16 bp, Homo sapiens
ctgtatttttttaact

SEQ ID NO: 1110059 - DNA, 17 bp, Homo sapiens
ctgtatttttttaacta

SEQ ID NO: 1110060 - DNA, 21 bp, Homo sapiens
ctgtcaaaacaagtttttctg

SEQ ID NO: 1110061 - DNA, 18 bp, Homo sapiens
ctgtcaaatgatgtgcaa

SEQ ID NO: 1110062 - DNA, 18 bp, Homo sapiens
ctgtcaaggccgagggcc

SEQ ID NO: 1110063 - DNA, 19 bp, Homo sapiens
ctgtcaaggctgcttagaa

SEQ ID NO: 1110064 - DNA, 19 bp, Homo sapiens
ctgtcaagttaacaaggaa

SEQ ID NO: 1110065 - DNA, 14 bp, Homo sapiens
ctgtcaataaatga

SEQ ID NO: 1110066 - DNA, 16 bp, Homo sapiens
ctgtcaataaatgaca

SEQ ID NO: 1110067 - DNA, 21 bp, Homo sapiens
ctgtcaataaatgacacccag

SEQ ID NO: 1110068 - DNA, 20 bp, Homo sapiens
ctgtcaatcacagtctcagt

SEQ ID NO: 1110069 - DNA, 22 bp, Homo sapiens
ctgtcaatgagagcataattta

SEQ ID NO: 1110070 - DNA, 23 bp, Homo sapiens
ctgtcaatttcattatcatcaag

SEQ ID NO: 1110071 - DNA, 18 bp, Homo sapiens
ctgtcaatttccctgact

SEQ ID NO: 1110072 - DNA, 16 bp, Homo sapiens
ctgtcacaataaatgg

SEQ ID NO: 1110073 - DNA, 23 bp, Homo sapiens
ctgtcacaataaatggccagtgc

SEQ ID NO: 1110074 - DNA, 17 bp, Homo sapiens
ctgtcacacactggacc

SEQ ID NO: 1110075 - DNA, 21 bp, Homo sapiens
ctgtcacacactggaccccac

SEQ ID NO: 1110076 - DNA, 21 bp, Homo sapiens
ctgtcacactggtgctgagtg

SEQ ID NO: 1110077 - DNA, 22 bp, Homo sapiens
ctgtcacactggtgctgagtga

SEQ ID NO: 1110078 - DNA, 13 bp, Homo sapiens
ctgtcacaggctg

SEQ ID NO: 1110079 - DNA, 19 bp, Homo sapiens
ctgtcacagtaaaaataaa

SEQ ID NO: 1110080 - DNA, 22 bp, Homo sapiens
ctgtcacagtaaaaataaaata

SEQ ID NO: 1110081 - DNA, 23 bp, Homo sapiens
ctgtcaccaagctcacagttcct

SEQ ID NO: 1110082 - DNA, 15 bp, Homo sapiens
ctgtcaccaaggaaa

SEQ ID NO: 1110083 - DNA, 23 bp, Homo sapiens
ctgtcaccaccctgctcatccac

SEQ ID NO: 1110084 - DNA, 12 bp, Homo sapiens
ctgtcacccagc

SEQ ID NO: 1110085 - DNA, 23 bp, Homo sapiens
ctgtcacccgtgtgaagatgaag

SEQ ID NO: 1110086 - DNA, 19 bp, Homo sapiens
ctgtcaccctccaccgagc

SEQ ID NO: 1110087 - DNA, 19 bp, Homo sapiens
ctgtcacctagaacgtgca

SEQ ID NO: 1110088 - DNA, 16 bp, Homo sapiens
ctgtcacctgctcaca

SEQ ID NO: 1110089 - DNA, 18 bp, Homo sapiens
ctgtcacctgctcacagg

SEQ ID NO: 1110090 - DNA, 23 bp, Homo sapiens
ctgtcacctgctcacagggatgc

SEQ ID NO: 1110091 - DNA, 18 bp, Homo sapiens
ctgtcacggggttccctc

SEQ ID NO: 1110092 - DNA, 20 bp, Homo sapiens
ctgtcacggggttccctcct

SEQ ID NO: 1110093 - DNA, 14 bp, Homo sapiens
ctgtcactcattgc

SEQ ID NO: 1110094 - DNA, 22 bp, Homo sapiens
ctgtcactcattgctgagcctc

SEQ ID NO: 1110095 - DNA, 23 bp, Homo sapiens
ctgtcactcattgctgagcctct

SEQ ID NO: 1110096 - DNA, 17 bp, Homo sapiens
ctgtcactgctctggac

SEQ ID NO: 1110097 - DNA, 18 bp, Homo sapiens
ctgtcactggcagagcac

SEQ ID NO: 1110098 - DNA, 21 bp, Homo sapiens
ctgtcactggcagagcacagc

SEQ ID NO: 1110099 - DNA, 21 bp, Homo sapiens
ctgtcactgttggacgtcagc

SEQ ID NO: 1110100 - DNA, 18 bp, Homo sapiens
ctgtcacttcttcacctc

SEQ ID NO: 1110101 - DNA, 12 bp, Homo sapiens
ctgtcactttgc

SEQ ID NO: 1110102 - DNA, 18 bp, Homo sapiens
ctgtcactttgctctggg

SEQ ID NO: 1110103 - DNA, 22 bp, Homo sapiens
ctgtcactttttttctttttct

SEQ ID NO: 1110104 - DNA, 21 bp, Homo sapiens
ctgtcagaagggggttgtggc

SEQ ID NO: 1110105 - DNA, 16 bp, Homo sapiens
ctgtcagatgagaaca

SEQ ID NO: 1110106 - DNA, 18 bp, Homo sapiens
ctgtcagatgagaacaaa

SEQ ID NO: 1110107 - DNA, 20 bp, Homo sapiens
ctgtcagatgagaacaaagc

SEQ ID NO: 1110108 - DNA, 16 bp, Homo sapiens
ctgtcagccagccgcc

SEQ ID NO: 1110109 - DNA, 19 bp, Homo sapiens
ctgtcagccagccgccctg

SEQ ID NO: 1110110 - DNA, 17 bp, Homo sapiens
ctgtcagcgcaggttta

SEQ ID NO: 1110111 - DNA, 18 bp, Homo sapiens
ctgtcagctgtgaaggct

SEQ ID NO: 1110112 - DNA, 18 bp, Homo sapiens
ctgtcaggaagaaatcac

SEQ ID NO: 1110113 - DNA, 20 bp, Homo sapiens
ctgtcagggccttggcccag

SEQ ID NO: 1110114 - DNA, 14 bp, Homo sapiens
ctgtcagtaaaact

SEQ ID NO: 1110115 - DNA, 15 bp, Homo sapiens
ctgtcagtcacagcc

SEQ ID NO: 1110116 - DNA, 17 bp, Homo sapiens
ctgtcagtcacagccac

SEQ ID NO: 1110117 - DNA, 15 bp, Homo sapiens
ctgtcagtgcagccc

SEQ ID NO: 1110118 - DNA, 16 bp, Homo sapiens
ctgtcagtttcccctc

SEQ ID NO: 1110119 - DNA, 18 bp, Homo sapiens
ctgtcagtttcccctctc

SEQ ID NO: 1110120 - DNA, 21 bp, Homo sapiens
ctgtcatagggattgtccctg

SEQ ID NO: 1110121 - DNA, 15 bp, Homo sapiens
ctgtcatcactccct

SEQ ID NO: 1110122 - DNA, 20 bp, Homo sapiens
ctgtcatcactccctggatg

SEQ ID NO: 1110123 - DNA, 15 bp, Homo sapiens
ctgtcatcctctgga

SEQ ID NO: 1110124 - DNA, 13 bp, Homo sapiens
ctgtcatctctct

SEQ ID NO: 1110125 - DNA, 17 bp, Homo sapiens
ctgtcatctctctgggg

SEQ ID NO: 1110126 - DNA, 14 bp, Homo sapiens
ctgtcatctgtgca

SEQ ID NO: 1110127 - DNA, 12 bp, Homo sapiens
ctgtctggggct

SEQ ID NO: 1110128 - DNA, 22 bp, Homo sapiens
ctgtctggtgaggtggcccagg

SEQ ID NO: 1110129 - DNA, 16 bp, Homo sapiens
ctgtctggtgccccta

SEQ ID NO: 1110130 - DNA, 17 bp, Homo sapiens
ctgtctggttttaacaa

SEQ ID NO: 1110131 - DNA, 19 bp, Homo sapiens
ctgtctgtcaccagctatc

SEQ ID NO: 1110132 - DNA, 12 bp, Homo sapiens
ctgtctgtccta

SEQ ID NO: 1110133 - DNA, 16 bp, Homo sapiens
ctgtctgtccttctga

SEQ ID NO: 1110134 - DNA, 14 bp, Homo sapiens
ctgtctgtcgccct

SEQ ID NO: 1110135 - DNA, 12 bp, Homo sapiens
ctgtctgtctcc

SEQ ID NO: 1110136 - DNA, 13 bp, Homo sapiens
ctgtctgtctctc

SEQ ID NO: 1110137 - DNA, 17 bp, Homo sapiens
ctgtctgtctgtgggct

SEQ ID NO: 1110138 - DNA, 12 bp, Homo sapiens
ctgtctgtgcca

SEQ ID NO: 1110139 - DNA, 13 bp, Homo sapiens
ctgtctgtgggct

SEQ ID NO: 1110140 - DNA, 18 bp, Homo sapiens
ctgtctgtgtgcatcatg

SEQ ID NO: 1110141 - DNA, 16 bp, Homo sapiens
ctgtctgttacactgg

SEQ ID NO: 1110142 - DNA, 19 bp, Homo sapiens
ctgtctgttgtattcattg

SEQ ID NO: 1110143 - DNA, 19 bp, Homo sapiens
ctgtcttaaactaaatgtg

SEQ ID NO: 1110144 - DNA, 21 bp, Homo sapiens
ctgtcttaaactaaatgtgca

SEQ ID NO: 1110145 - DNA, 21 bp, Homo sapiens
ctgtcttatagggtaaaaaaa

SEQ ID NO: 1110146 - DNA, 21 bp, Homo sapiens
ctgtcttatggtccagaaact

SEQ ID NO: 1110147 - DNA, 20 bp, Homo sapiens
ctgtcttcagcacattccac

SEQ ID NO: 1110148 - DNA, 16 bp, Homo sapiens
ctgtcttccactgtac

SEQ ID NO: 1110149 - DNA, 13 bp, Homo sapiens
ctgtcttcccctg

SEQ ID NO: 1110150 - DNA, 13 bp, Homo sapiens
ctgtcttcctcaa

SEQ ID NO: 1110151 - DNA, 20 bp, Homo sapiens
ctgtcttcctcaaaataaag

SEQ ID NO: 1110152 - DNA, 16 bp, Homo sapiens
ctgtcttctctccact

SEQ ID NO: 1110153 - DNA, 20 bp, Homo sapiens
ctgtcttctctccacttctg

SEQ ID NO: 1110154 - DNA, 14 bp, Homo sapiens
ctgtcttctgggca

SEQ ID NO: 1110155 - DNA, 19 bp, Homo sapiens
ctgtcttgatgactgctga

SEQ ID NO: 1110156 - DNA, 13 bp, Homo sapiens
ctgtcttgcccca

SEQ ID NO: 1110157 - DNA, 14 bp, Homo sapiens
ctgtcttgctcctg

SEQ ID NO: 1110158 - DNA, 16 bp, Homo sapiens
ctgtcttgctcctggg

SEQ ID NO: 1110159 - DNA, 16 bp, Homo sapiens
ctgtcttggcattaaa

SEQ ID NO: 1110160 - DNA, 16 bp, Homo sapiens
ctgtcttgttcatttt

SEQ ID NO: 1110161 - DNA, 18 bp, Homo sapiens
ctgtcttgtttcagtgag

SEQ ID NO: 1110162 - DNA, 16 bp, Homo sapiens
ctgtctttaattctgt

SEQ ID NO: 1110163 - DNA, 17 bp, Homo sapiens
ctgtctttattcttatt

SEQ ID NO: 1110164 - DNA, 15 bp, Homo sapiens
ctgtctttcagatac

SEQ ID NO: 1110165 - DNA, 11 bp, Homo sapiens
ctgtctttcca

SEQ ID NO: 1110166 - DNA, 13 bp, Homo sapiens
ctgtctttccact

SEQ ID NO: 1110167 - DNA, 23 bp, Homo sapiens
ctgtctttctgagcacactttag

SEQ ID NO: 1110168 - DNA, 16 bp, Homo sapiens
ctgtctttgcagggca

SEQ ID NO: 1110169 - DNA, 22 bp, Homo sapiens
ctgtctttgcagggcacagatg

SEQ ID NO: 1110170 - DNA, 22 bp, Homo sapiens
ctgtctttggataataggaatt

SEQ ID NO: 1110171 - DNA, 15 bp, Homo sapiens
ctgtctttgtggact

SEQ ID NO: 1110172 - DNA, 18 bp, Homo sapiens
ctgtctttgtggactgtg

SEQ ID NO: 1110173 - DNA, 14 bp, Homo sapiens
ctgtcttttctcct

SEQ ID NO: 1110174 - DNA, 16 bp, Homo sapiens
ctgtcttttctcctcc

SEQ ID NO: 1110175 - DNA, 15 bp, Homo sapiens
ctgtcttttgattct

SEQ ID NO: 1110176 - DNA, 23 bp, Homo sapiens
ctgtctttttcatttttttctct

SEQ ID NO: 1110177 - DNA, 19 bp, Homo sapiens
ctgtgaaaaaaaaaatgct

SEQ ID NO: 1110178 - DNA, 22 bp, Homo sapiens
ctgtgaaaatagtgtaagaact

SEQ ID NO: 1110179 - DNA, 23 bp, Homo sapiens
ctgtgaaactggcactgaattaa

SEQ ID NO: 1110180 - DNA, 15 bp, Homo sapiens
ctgtgaaatataatt

SEQ ID NO: 1110181 - DNA, 14 bp, Homo sapiens
ctgtgaaatatcat

SEQ ID NO: 1110182 - DNA, 23 bp, Homo sapiens
ctgtgaaatatcatcacgtatgt

SEQ ID NO: 1110183 - DNA, 16 bp, Homo sapiens
ctgtgaaatgctggca

SEQ ID NO: 1110184 - DNA, 18 bp, Homo sapiens
ctgtgaaatttacaaatc

SEQ ID NO: 1110185 - DNA, 19 bp, Homo sapiens
ctgtgaacagcttgctgtc

SEQ ID NO: 1110186 - DNA, 16 bp, Homo sapiens
ctgtgaacgatttaga

SEQ ID NO: 1110187 - DNA, 18 bp, Homo sapiens
ctgtgaacgatttagaaa

SEQ ID NO: 1110188 - DNA, 19 bp, Homo sapiens
ctgtgaactcaatctccag

SEQ ID NO: 1110189 - DNA, 14 bp, Homo sapiens
ctgtgaacttgggg

SEQ ID NO: 1110190 - DNA, 23 bp, Homo sapiens
ctgtgaagacccaggagagacag

SEQ ID NO: 1110191 - DNA, 15 bp, Homo sapiens
ctgtgaagagaacca

SEQ ID NO: 1110192 - DNA, 23 bp, Homo sapiens
ctgtgaagagccggtggtgcccg

SEQ ID NO: 1110193 - DNA, 24 bp, Homo sapiens
ctgtgaagtccttcacctcactga

SEQ ID NO: 1110194 - DNA, 13 bp, Homo sapiens
ctgtgaagtgtta

SEQ ID NO: 1110195 - DNA, 12 bp, Homo sapiens
ctgtgaatacaa

SEQ ID NO: 1110196 - DNA, 13 bp, Homo sapiens
ctgtgaatacaat

SEQ ID NO: 1110197 - DNA, 16 bp, Homo sapiens
ctgtgaatacaattaa

SEQ ID NO: 1110198 - DNA, 20 bp, Homo sapiens
ctgtgaatacaattaaaggt

SEQ ID NO: 1110199 - DNA, 15 bp, Homo sapiens
ctgtgaatcctggca

SEQ ID NO: 1110200 - DNA, 18 bp, Homo sapiens
ctgtgaatcctggcaaga

SEQ ID NO: 1110201 - DNA, 15 bp, Homo sapiens
ctgtgaatggaggca

SEQ ID NO: 1110202 - DNA, 22 bp, Homo sapiens
ctgtgaatggaggcagagacct

SEQ ID NO: 1110203 - DNA, 13 bp, Homo sapiens
ctgtgaattaagc

SEQ ID NO: 1110204 - DNA, 14 bp, Homo sapiens
ctgtgaattcagat

SEQ ID NO: 1110205 - DNA, 15 bp, Homo sapiens
ctgtgaattcagatt

SEQ ID NO: 1110206 - DNA, 23 bp, Homo sapiens
ctgtgaattgagctgcagaaacg

SEQ ID NO: 1110207 - DNA, 16 bp, Homo sapiens
ctgtgaatttcaaaaa

SEQ ID NO: 1110208 - DNA, 16 bp, Homo sapiens
ctgtgacaaaggatga

SEQ ID NO: 1110209 - DNA, 20 bp, Homo sapiens
ctgtgacatggtgcctgaga

SEQ ID NO: 1110210 - DNA, 23 bp, Homo sapiens
ctgtgacatggtgcctgagaggc

SEQ ID NO: 1110211 - DNA, 19 bp, Homo sapiens
ctgtgacattgctggtcat

SEQ ID NO: 1110212 - DNA, 13 bp, Homo sapiens
ctgtgacatttat

SEQ ID NO: 1110213 - DNA, 15 bp, Homo sapiens
ctgtgacatttatgt

SEQ ID NO: 1110214 - DNA, 12 bp, Homo sapiens
ctgtgacatttt

SEQ ID NO: 1110215 - DNA, 16 bp, Homo sapiens
ctgtgaccaatgtctt

SEQ ID NO: 1110216 - DNA, 23 bp, Homo sapiens
ctgtgaccagtctgacccttaca

SEQ ID NO: 1110217 - DNA, 14 bp, Homo sapiens
ctgtgaccccacct

SEQ ID NO: 1110218 - DNA, 16 bp, Homo sapiens
ctgtgacccccagctc

SEQ ID NO: 1110219 - DNA, 13 bp, Homo sapiens
ctgtgaccctctc

SEQ ID NO: 1110220 - DNA, 15 bp, Homo sapiens
ctgtgaccctctcac

SEQ ID NO: 1110221 - DNA, 16 bp, Homo sapiens
ctgtgaccctctcact

SEQ ID NO: 1110222 - DNA, 23 bp, Homo sapiens
ctgtgacctgatttcagaagaga

SEQ ID NO: 1110223 - DNA, 16 bp, Homo sapiens
ctgtgacctgccccgc

SEQ ID NO: 1110224 - DNA, 20 bp, Homo sapiens
ctgtgaccttgggaccaaag

SEQ ID NO: 1110225 - DNA, 14 bp, Homo sapiens
ctgtgactgatgtt

SEQ ID NO: 1110226 - DNA, 12 bp, Homo sapiens
ctgtgactggat

SEQ ID NO: 1110227 - DNA, 16 bp, Homo sapiens
ctgtgactggatcttc

SEQ ID NO: 1110228 - DNA, 22 bp, Homo sapiens
ctgtgactggatcttctatcat

SEQ ID NO: 1110229 - DNA, 22 bp, Homo sapiens
ctgtgacttcagctctgtttta

SEQ ID NO: 1110230 - DNA, 14 bp, Homo sapiens
ctgtgagaccccca

SEQ ID NO: 1110231 - DNA, 16 bp, Homo sapiens
ctgtgagacccccaca

SEQ ID NO: 1110232 - DNA, 17 bp, Homo sapiens
ctgtgagacccccacac

SEQ ID NO: 1110233 - DNA, 13 bp, Homo sapiens
ctgtgagatgtgt

SEQ ID NO: 1110234 - DNA, 15 bp, Homo sapiens
ctgtgagcaagaagt

SEQ ID NO: 1110235 - DNA, 16 bp, Homo sapiens
ctgtgagccatgcctc

SEQ ID NO: 1110236 - DNA, 17 bp, Homo sapiens
ctgtgagcccagctggg

SEQ ID NO: 1110237 - DNA, 17 bp, Homo sapiens
ctgtgaggcccctggac

SEQ ID NO: 1110238 - DNA, 14 bp, Homo sapiens
ctgtgagggagggg

SEQ ID NO: 1110239 - DNA, 15 bp, Homo sapiens
ctgtgaggggaaggc

SEQ ID NO: 1110240 - DNA, 17 bp, Homo sapiens
ctgtgagtgcgcctcac

SEQ ID NO: 1110241 - DNA, 18 bp, Homo sapiens
ctgtgagtgcgcctcacc

SEQ ID NO: 1110242 - DNA, 19 bp, Homo sapiens
ctgtgagtgtaagtgtgag

SEQ ID NO: 1110243 - DNA, 17 bp, Homo sapiens
ctgtgagttctccctgt

SEQ ID NO: 1110244 - DNA, 18 bp, Homo sapiens
ctgtgagttctccctgta

SEQ ID NO: 1110245 - DNA, 17 bp, Homo sapiens
ctgtgagtttaaagcaa

SEQ ID NO: 1110246 - DNA, 21 bp, Homo sapiens
ctgtgatacagaactcttaaa

SEQ ID NO: 1110247 - DNA, 16 bp, Homo sapiens
ctgtgatacatttctg

SEQ ID NO: 1110248 - DNA, 22 bp, Homo sapiens
ctgtgatatggcggcctgcagt

SEQ ID NO: 1110249 - DNA, 23 bp, Homo sapiens
ctgtgatcaatatttttatatca

SEQ ID NO: 1110250 - DNA, 16 bp, Homo sapiens
ctgtgttaactgttca

SEQ ID NO: 1110251 - DNA, 16 bp, Homo sapiens
ctgtgttactgctttg

SEQ ID NO: 1110252 - DNA, 19 bp, Homo sapiens
ctgtgttagtgtctgtcca

SEQ ID NO: 1110253 - DNA, 21 bp, Homo sapiens
ctgtgttcaatatttagaaaa

SEQ ID NO: 1110254 - DNA, 11 bp, Homo sapiens
ctgtgttcatt

SEQ ID NO: 1110255 - DNA, 23 bp, Homo sapiens
ctgtgttcatttggtgttcctgg

SEQ ID NO: 1110256 - DNA, 18 bp, Homo sapiens
ctgtgttcccagaggcag

SEQ ID NO: 1110257 - DNA, 15 bp, Homo sapiens
ctgtgttctgggctg

SEQ ID NO: 1110258 - DNA, 15 bp, Homo sapiens
ctgtgttcttgctga

SEQ ID NO: 1110259 - DNA, 17 bp, Homo sapiens
ctgtgttcttgctgagc

SEQ ID NO: 1110260 - DNA, 14 bp, Homo sapiens
ctgtgttgccaagc

SEQ ID NO: 1110261 - DNA, 19 bp, Homo sapiens
ctgtgttgccaagctccaa

SEQ ID NO: 1110262 - DNA, 13 bp, Homo sapiens
ctgtgttgccaca

SEQ ID NO: 1110263 - DNA, 15 bp, Homo sapiens
ctgtgttgtattaac

SEQ ID NO: 1110264 - DNA, 21 bp, Homo sapiens
ctgtgttgtattaacaaaagt

SEQ ID NO: 1110265 - DNA, 14 bp, Homo sapiens
ctgtgttgtctcta

SEQ ID NO: 1110266 - DNA, 16 bp, Homo sapiens
ctgtgtttaaaaagta

SEQ ID NO: 1110267 - DNA, 16 bp, Homo sapiens
ctgtgtttaatattac

SEQ ID NO: 1110268 - DNA, 16 bp, Homo sapiens
ctgtgtttatatggaa

SEQ ID NO: 1110269 - DNA, 22 bp, Homo sapiens
ctgtgtttatatggaagaaagt

SEQ ID NO: 1110270 - DNA, 19 bp, Homo sapiens
ctgtgtttccaaaggttcc

SEQ ID NO: 1110271 - DNA, 15 bp, Homo sapiens
ctgtgtttccatctc

SEQ ID NO: 1110272 - DNA, 23 bp, Homo sapiens
ctgtgtttccatctcaaagaagg

SEQ ID NO: 1110273 - DNA, 23 bp, Homo sapiens
ctgtgtttgcagcctgctctagt

SEQ ID NO: 1110274 - DNA, 14 bp, Homo sapiens
ctgtgtttgtcctg

SEQ ID NO: 1110275 - DNA, 15 bp, Homo sapiens
ctgtgtttgttccta

SEQ ID NO: 1110276 - DNA, 17 bp, Homo sapiens
ctgtgttttgaaagaat

SEQ ID NO: 1110277 - DNA, 22 bp, Homo sapiens
ctgtgttttgaaagaatagaac

SEQ ID NO: 1110278 - DNA, 22 bp, Homo sapiens
ctgtgttttgaatggtgttgta

SEQ ID NO: 1110279 - DNA, 17 bp, Homo sapiens
ctgtgtttttttctaaa

SEQ ID NO: 1110280 - DNA, 13 bp, Homo sapiens
ctgttaaaacaac

SEQ ID NO: 1110281 - DNA, 11 bp, Homo sapiens
ctgttaaactg

SEQ ID NO: 1110282 - DNA, 19 bp, Homo sapiens
ctgttaaactgttagcact

SEQ ID NO: 1110283 - DNA, 23 bp, Homo sapiens
ctgttaaatacaggaaacagttg

SEQ ID NO: 1110284 - DNA, 12 bp, Homo sapiens
ctgttaactgaa

SEQ ID NO: 1110285 - DNA, 13 bp, Homo sapiens
ctgttaactgaat

SEQ ID NO: 1110286 - DNA, 15 bp, Homo sapiens
ctgttaagaaaggat

SEQ ID NO: 1110287 - DNA, 14 bp, Homo sapiens
ctgttaatacacag

SEQ ID NO: 1110288 - DNA, 17 bp, Homo sapiens
ctgttacacgtgcctgt

SEQ ID NO: 1110289 - DNA, 18 bp, Homo sapiens
ctgttacactttttggaa

SEQ ID NO: 1110290 - DNA, 19 bp, Homo sapiens
ctgttaccatgtcactgtg

SEQ ID NO: 1110291 - DNA, 20 bp, Homo sapiens
ctgttaccatgtcactgtgg

SEQ ID NO: 1110292 - DNA, 18 bp, Homo sapiens
ctgttacccagagaatat

SEQ ID NO: 1110293 - DNA, 20 bp, Homo sapiens
ctgttaccccatcctccctc

SEQ ID NO: 1110294 - DNA, 21 bp, Homo sapiens
ctgttacctcaacaagaagaa

SEQ ID NO: 1110295 - DNA, 17 bp, Homo sapiens
ctgttactgtcttcagt

SEQ ID NO: 1110296 - DNA, 15 bp, Homo sapiens
ctgttacttacctaa

SEQ ID NO: 1110297 - DNA, 19 bp, Homo sapiens
ctgttacttgcttcagtgg

SEQ ID NO: 1110298 - DNA, 15 bp, Homo sapiens
ctgttagcagacagg

SEQ ID NO: 1110299 - DNA, 19 bp, Homo sapiens
ctgttagcagagtctgtct

SEQ ID NO: 1110300 - DNA, 20 bp, Homo sapiens
ctgttagcagagtctgtctc

SEQ ID NO: 1110301 - DNA, 23 bp, Homo sapiens
ctgttagctccctgtggggcagg

SEQ ID NO: 1110302 - DNA, 18 bp, Homo sapiens
ctgttaggtccattttct

SEQ ID NO: 1110303 - DNA, 16 bp, Homo sapiens
ctgttagttttgtaaa

SEQ ID NO: 1110304 - DNA, 18 bp, Homo sapiens
ctgttatcagctgggcag

SEQ ID NO: 1110305 - DNA, 13 bp, Homo sapiens
ctgttatgtatga

SEQ ID NO: 1110306 - DNA, 16 bp, Homo sapiens
ctgttattatatttga

SEQ ID NO: 1110307 - DNA, 20 bp, Homo sapiens
ctgttattatatttgacatg

SEQ ID NO: 1110308 - DNA, 13 bp, Homo sapiens
ctgttattatgaa

SEQ ID NO: 1110309 - DNA, 21 bp, Homo sapiens
ctgttatttatcaatttttcc

SEQ ID NO: 1110310 - DNA, 20 bp, Homo sapiens
ctgttcaaacccagtcttgt

SEQ ID NO: 1110311 - DNA, 23 bp, Homo sapiens
ctgttcaacaatcagtcatcatg

SEQ ID NO: 1110312 - DNA, 14 bp, Homo sapiens
ctgttcaagcaaaa

SEQ ID NO: 1110313 - DNA, 21 bp, Homo sapiens
ctgttcacaaactacctctgg

SEQ ID NO: 1110314 - DNA, 20 bp, Homo sapiens
ctgttcacagaaaaagcatg

SEQ ID NO: 1110315 - DNA, 12 bp, Homo sapiens
ctgttcacccac

SEQ ID NO: 1110316 - DNA, 16 bp, Homo sapiens
ctgttcactgcattca

SEQ ID NO: 1110317 - DNA, 22 bp, Homo sapiens
ctgttcagctactcccactccc

SEQ ID NO: 1110318 - DNA, 19 bp, Homo sapiens
ctgttcagctggttgaggt

SEQ ID NO: 1110319 - DNA, 12 bp, Homo sapiens
ctgttcagtact

SEQ ID NO: 1110320 - DNA, 14 bp, Homo sapiens
ctgttcagtgagat

SEQ ID NO: 1110321 - DNA, 16 bp, Homo sapiens
ctgttcagtgtcccgg

SEQ ID NO: 1110322 - DNA, 21 bp, Homo sapiens
ctgttcatcaccagtctgtaa

SEQ ID NO: 1110323 - DNA, 15 bp, Homo sapiens
ctgttcatgctccaa

SEQ ID NO: 1110324 - DNA, 12 bp, Homo sapiens
ctgttcattgta

SEQ ID NO: 1110325 - DNA, 14 bp, Homo sapiens
ctgttcattgtaag

SEQ ID NO: 1110326 - DNA, 11 bp, Homo sapiens
ctgttccaaat

SEQ ID NO: 1110327 - DNA, 12 bp, Homo sapiens
ctgttccagact

SEQ ID NO: 1110328 - DNA, 14 bp, Homo sapiens
ctgttccagactca

SEQ ID NO: 1110329 - DNA, 15 bp, Homo sapiens
ctgttccagattcct

SEQ ID NO: 1110330 - DNA, 14 bp, Homo sapiens
ctgttccaggccct

SEQ ID NO: 1110331 - DNA, 16 bp, Homo sapiens
ctgttccaggccctcc

SEQ ID NO: 1110332 - DNA, 20 bp, Homo sapiens
ctgttccaggccctccagtg

SEQ ID NO: 1110333 - DNA, 23 bp, Homo sapiens
ctgttcccaaggaagctccttcc

SEQ ID NO: 1110334 - DNA, 20 bp, Homo sapiens
ctgttcccatgtagccccct

SEQ ID NO: 1110335 - DNA, 18 bp, Homo sapiens
ctgttcccattcttgcat

SEQ ID NO: 1110336 - DNA, 12 bp, Homo sapiens
ctgttccccctg

SEQ ID NO: 1110337 - DNA, 15 bp, Homo sapiens
ctgttccccctgtgc

SEQ ID NO: 1110338 - DNA, 14 bp, Homo sapiens
ctgttcccctcact

SEQ ID NO: 1110339 - DNA, 15 bp, Homo sapiens
ctgttcccctcactg

SEQ ID NO: 1110340 - DNA, 16 bp, Homo sapiens
ctgttcccctctccct

SEQ ID NO: 1110341 - DNA, 21 bp, Homo sapiens
ctgttcccctctcccttccct

SEQ ID NO: 1110342 - DNA, 16 bp, Homo sapiens
ctgttccctcctggtc

SEQ ID NO: 1110343 - DNA, 21 bp, Homo sapiens
ctgttccctcctggtcctgga

SEQ ID NO: 1110344 - DNA, 19 bp, Homo sapiens
ctgttccctctgctcctgg

SEQ ID NO: 1110345 - DNA, 19 bp, Homo sapiens
ctgttccctctggcttccc

SEQ ID NO: 1110346 - DNA, 12 bp, Homo sapiens
ctgttccctgga

SEQ ID NO: 1110347 - DNA, 19 bp, Homo sapiens
ctgttccctgttctggtat

SEQ ID NO: 1110348 - DNA, 12 bp, Homo sapiens
ctgttcccttcc

SEQ ID NO: 1110349 - DNA, 15 bp, Homo sapiens
ctgttcccttcctca

SEQ ID NO: 1110350 - DNA, 17 bp, Homo sapiens
ctgttcccttcctcacc

SEQ ID NO: 1110351 - DNA, 17 bp, Homo sapiens
ctgttccctttgcctta

SEQ ID NO: 1110352 - DNA, 14 bp, Homo sapiens
ctgttcctcatgtt

SEQ ID NO: 1110353 - DNA, 20 bp, Homo sapiens
ctgttcctcccccataaaat

SEQ ID NO: 1110354 - DNA, 16 bp, Homo sapiens
ctgttcctgctccatg

SEQ ID NO: 1110355 - DNA, 11 bp, Homo sapiens
ctgttcctgtg

SEQ ID NO: 1110356 - DNA, 16 bp, Homo sapiens
ctgttcctgttcagta

SEQ ID NO: 1110357 - DNA, 24 bp, Homo sapiens
ctgttccttatttctctctcctgg

SEQ ID NO: 1110358 - DNA, 22 bp, Homo sapiens
ctgttcgctcctcccagatggc

SEQ ID NO: 1110359 - DNA, 12 bp, Homo sapiens
ctgttctagttt

SEQ ID NO: 1110360 - DNA, 16 bp, Homo sapiens
ctgttctcatttgatc

SEQ ID NO: 1110361 - DNA, 14 bp, Homo sapiens
ctgttctccctggg

SEQ ID NO: 1110362 - DNA, 18 bp, Homo sapiens
ctgttctcgaactcctga

SEQ ID NO: 1110363 - DNA, 22 bp, Homo sapiens
ctgttctcgaactcctgacctc

SEQ ID NO: 1110364 - DNA, 14 bp, Homo sapiens
ctgttctctgctga

SEQ ID NO: 1110365 - DNA, 21 bp, Homo sapiens
ctgttctcttgggaactgaac

SEQ ID NO: 1110366 - DNA, 14 bp, Homo sapiens
ctgttctgctccca

SEQ ID NO: 1110367 - DNA, 15 bp, Homo sapiens
ctgttctgtagcttt

SEQ ID NO: 1110368 - DNA, 17 bp, Homo sapiens
ctgttctgtagctttct

SEQ ID NO: 1110369 - DNA, 19 bp, Homo sapiens
ctgttctgtggttcctctg

SEQ ID NO: 1110370 - DNA, 13 bp, Homo sapiens
ctgttctgtgtct

SEQ ID NO: 1110371 - DNA, 15 bp, Homo sapiens
ctgttctgtgttgca

SEQ ID NO: 1110372 - DNA, 22 bp, Homo sapiens
ctgttctgtttggcacttgtat

SEQ ID NO: 1110373 - DNA, 16 bp, Homo sapiens
cttaaatcatttggtt

SEQ ID NO: 1110374 - DNA, 18 bp, Homo sapiens
cttaaatgcccccctccc

SEQ ID NO: 1110375 - DNA, 14 bp, Homo sapiens
cttaaatgctcata

SEQ ID NO: 1110376 - DNA, 20 bp, Homo sapiens
cttaaatgctcattttctgg

SEQ ID NO: 1110377 - DNA, 14 bp, Homo sapiens
cttaaatgtttata

SEQ ID NO: 1110378 - DNA, 16 bp, Homo sapiens
cttaaatgtttatact

SEQ ID NO: 1110379 - DNA, 12 bp, Homo sapiens
cttaaattaaac

SEQ ID NO: 1110380 - DNA, 13 bp, Homo sapiens
cttaaattatttt

SEQ ID NO: 1110381 - DNA, 16 bp, Homo sapiens
cttaaattcatttcta

SEQ ID NO: 1110382 - DNA, 20 bp, Homo sapiens
cttaaattcatttctagact

SEQ ID NO: 1110383 - DNA, 14 bp, Homo sapiens
cttaaattcctcaa

SEQ ID NO: 1110384 - DNA, 17 bp, Homo sapiens
cttaaatttcaaaccat

SEQ ID NO: 1110385 - DNA, 13 bp, Homo sapiens
cttaaatttctta

SEQ ID NO: 1110386 - DNA, 14 bp, Homo sapiens
cttaaatttcttat

SEQ ID NO: 1110387 - DNA, 20 bp, Homo sapiens
cttaaatttcttatgtgaca

SEQ ID NO: 1110388 - DNA, 23 bp, Homo sapiens
cttaaattttaactaaattttaa

SEQ ID NO: 1110389 - DNA, 16 bp, Homo sapiens
cttaaattttcttcct

SEQ ID NO: 1110390 - DNA, 17 bp, Homo sapiens
cttaaattttcttcctt

SEQ ID NO: 1110391 - DNA, 17 bp, Homo sapiens
cttaacacagccttcct

SEQ ID NO: 1110392 - DNA, 17 bp, Homo sapiens
cttaacatatttactaa

SEQ ID NO: 1110393 - DNA, 23 bp, Homo sapiens
cttaacatcatataaaaagcagc

SEQ ID NO: 1110394 - DNA, 14 bp, Homo sapiens
cttaacattctgta

SEQ ID NO: 1110395 - DNA, 17 bp, Homo sapiens
cttaacattctgtaaaa

SEQ ID NO: 1110396 - DNA, 12 bp, Homo sapiens
cttaaccatctt

SEQ ID NO: 1110397 - DNA, 13 bp, Homo sapiens
cttaacccaagga

SEQ ID NO: 1110398 - DNA, 21 bp, Homo sapiens
cttaaccccaaggactgaggg

SEQ ID NO: 1110399 - DNA, 21 bp, Homo sapiens
cttaacccctaagactgcctt

SEQ ID NO: 1110400 - DNA, 22 bp, Homo sapiens
cttaacccctaagactgccttc

SEQ ID NO: 1110401 - DNA, 13 bp, Homo sapiens
cttaacctttgct

SEQ ID NO: 1110402 - DNA, 20 bp, Homo sapiens
cttaacggaccaaagcaaga

SEQ ID NO: 1110403 - DNA, 16 bp, Homo sapiens
cttaacggctccagga

SEQ ID NO: 1110404 - DNA, 17 bp, Homo sapiens
cttaactataaggtgcc

SEQ ID NO: 1110405 - DNA, 12 bp, Homo sapiens
cttaactatgag

SEQ ID NO: 1110406 - DNA, 23 bp, Homo sapiens
cttaactattaaggccttttcca

SEQ ID NO: 1110407 - DNA, 20 bp, Homo sapiens
cttaactctaaccctgtgga

SEQ ID NO: 1110408 - DNA, 18 bp, Homo sapiens
cttaactggcctaaattt

SEQ ID NO: 1110409 - DNA, 19 bp, Homo sapiens
cttaactggcctaaatttc

SEQ ID NO: 1110410 - DNA, 20 bp, Homo sapiens
cttaactgtatttcagtatt

SEQ ID NO: 1110411 - DNA, 12 bp, Homo sapiens
cttaacttcaca

SEQ ID NO: 1110412 - DNA, 15 bp, Homo sapiens
cttaacttcacatat

SEQ ID NO: 1110413 - DNA, 16 bp, Homo sapiens
cttaacttcacatatt

SEQ ID NO: 1110414 - DNA, 17 bp, Homo sapiens
cttaacttcacatattg

SEQ ID NO: 1110415 - DNA, 17 bp, Homo sapiens
cttaagaacacaaagcg

SEQ ID NO: 1110416 - DNA, 20 bp, Homo sapiens
cttaagaactgcttcatgtg

SEQ ID NO: 1110417 - DNA, 14 bp, Homo sapiens
cttaagacactgtg

SEQ ID NO: 1110418 - DNA, 12 bp, Homo sapiens
cttaagacagag

SEQ ID NO: 1110419 - DNA, 18 bp, Homo sapiens
cttaagacagcatgtgtt

SEQ ID NO: 1110420 - DNA, 18 bp, Homo sapiens
cttaagagcttgatctgt

SEQ ID NO: 1110421 - DNA, 20 bp, Homo sapiens
cttaagagcttgatctgtga

SEQ ID NO: 1110422 - DNA, 21 bp, Homo sapiens
cttaagagcttgatctgtgat

SEQ ID NO: 1110423 - DNA, 22 bp, Homo sapiens
cttaagagtccaactcacttcc

SEQ ID NO: 1110424 - DNA, 20 bp, Homo sapiens
cttaagattaattttctctt

SEQ ID NO: 1110425 - DNA, 19 bp, Homo sapiens
cttaagcaaaggggacagc

SEQ ID NO: 1110426 - DNA, 22 bp, Homo sapiens
cttaagcaaaggggacagctgt

SEQ ID NO: 1110427 - DNA, 20 bp, Homo sapiens
cttaagcaaattttgtatta

SEQ ID NO: 1110428 - DNA, 21 bp, Homo sapiens
cttaagcagaacaaatgtgtt

SEQ ID NO: 1110429 - DNA, 20 bp, Homo sapiens
cttaagcagcatggaaaaat

SEQ ID NO: 1110430 - DNA, 22 bp, Homo sapiens
cttaagcagcatggaaaaatgg

SEQ ID NO: 1110431 - DNA, 16 bp, Homo sapiens
cttaagcaggtttgtt

SEQ ID NO: 1110432 - DNA, 14 bp, Homo sapiens
cttaagccactgcc

SEQ ID NO: 1110433 - DNA, 19 bp, Homo sapiens
cttaagccactgcctctcc

SEQ ID NO: 1110434 - DNA, 20 bp, Homo sapiens
cttaagccactgcctctccc

SEQ ID NO: 1110435 - DNA, 19 bp, Homo sapiens
cttaagccctttgctctgg

SEQ ID NO: 1110436 - DNA, 11 bp, Homo sapiens
cttaagctgat

SEQ ID NO: 1110437 - DNA, 18 bp, Homo sapiens
cttaaggaagtttgattt

SEQ ID NO: 1110438 - DNA, 16 bp, Homo sapiens
cttaaggcctaaggaa

SEQ ID NO: 1110439 - DNA, 20 bp, Homo sapiens
cttaaggggggcagggagtg

SEQ ID NO: 1110440 - DNA, 16 bp, Homo sapiens
cttaaggtctaactgt

SEQ ID NO: 1110441 - DNA, 17 bp, Homo sapiens
cttaaggtctaactgtg

SEQ ID NO: 1110442 - DNA, 22 bp, Homo sapiens
cttaagtaccaatgggaagcag

SEQ ID NO: 1110443 - DNA, 17 bp, Homo sapiens
cttaagtcagaacagca

SEQ ID NO: 1110444 - DNA, 18 bp, Homo sapiens
cttaagtcagaacagcag

SEQ ID NO: 1110445 - DNA, 19 bp, Homo sapiens
cttaagtctcgaatgtaat

SEQ ID NO: 1110446 - DNA, 14 bp, Homo sapiens
cttaagtgagcaga

SEQ ID NO: 1110447 - DNA, 16 bp, Homo sapiens
cttaagtgagcagaac

SEQ ID NO: 1110448 - DNA, 15 bp, Homo sapiens
cttaagtgcccacat

SEQ ID NO: 1110449 - DNA, 16 bp, Homo sapiens
cttaagtgctgcaatt

SEQ ID NO: 1110450 - DNA, 21 bp, Homo sapiens
cttaagttagttccactgaga

SEQ ID NO: 1110451 - DNA, 12 bp, Homo sapiens
cttaagttcttt

SEQ ID NO: 1110452 - DNA, 14 bp, Homo sapiens
cttaataaaagaac

SEQ ID NO: 1110453 - DNA, 17 bp, Homo sapiens
cttaataaaataaacta

SEQ ID NO: 1110454 - DNA, 18 bp, Homo sapiens
cttaataaagcttttcct

SEQ ID NO: 1110455 - DNA, 18 bp, Homo sapiens
cttaataaatatgtaata

SEQ ID NO: 1110456 - DNA, 12 bp, Homo sapiens
cttaataaattc

SEQ ID NO: 1110457 - DNA, 18 bp, Homo sapiens
cttaatactaccttgaaa

SEQ ID NO: 1110458 - DNA, 16 bp, Homo sapiens
cttaatagacttctct

SEQ ID NO: 1110459 - DNA, 20 bp, Homo sapiens
cttaatagacttctcttaca

SEQ ID NO: 1110460 - DNA, 12 bp, Homo sapiens
cttaatataaat

SEQ ID NO: 1110461 - DNA, 11 bp, Homo sapiens
cttaatatact

SEQ ID NO: 1110462 - DNA, 22 bp, Homo sapiens
cttaatatgtgctgaacattgt

SEQ ID NO: 1110463 - DNA, 18 bp, Homo sapiens
cttaatattgagaatcag

SEQ ID NO: 1110464 - DNA, 15 bp, Homo sapiens
cttaatatttcttca

SEQ ID NO: 1110465 - DNA, 15 bp, Homo sapiens
cttaatcaacagaag

SEQ ID NO: 1110466 - DNA, 14 bp, Homo sapiens
cttaatcactactg

SEQ ID NO: 1110467 - DNA, 14 bp, Homo sapiens
cttaatcattttca

SEQ ID NO: 1110468 - DNA, 21 bp, Homo sapiens
cttaatcctttaactctgcgg

SEQ ID NO: 1110469 - DNA, 17 bp, Homo sapiens
cttaatctaagaaacaa

SEQ ID NO: 1110470 - DNA, 17 bp, Homo sapiens
cttaatcttgctttctt

SEQ ID NO: 1110471 - DNA, 20 bp, Homo sapiens
cttaatcttgctttctttag

SEQ ID NO: 1110472 - DNA, 14 bp, Homo sapiens
cttaatctttgaaa

SEQ ID NO: 1110473 - DNA, 14 bp, Homo sapiens
cttaatgacaacac

SEQ ID NO: 1110474 - DNA, 19 bp, Homo sapiens
cttaatggaaggttggatc

SEQ ID NO: 1110475 - DNA, 20 bp, Homo sapiens
cttaatggctgataatttta

SEQ ID NO: 1110476 - DNA, 17 bp, Homo sapiens
cttaatgtaattcagga

SEQ ID NO: 1110477 - DNA, 16 bp, Homo sapiens
cttaatgtttattcct

SEQ ID NO: 1110478 - DNA, 22 bp, Homo sapiens
cttaattagacctaggcctcag

SEQ ID NO: 1110479 - DNA, 11 bp, Homo sapiens
cttaattatta

SEQ ID NO: 1110480 - DNA, 14 bp, Homo sapiens
cttaattattataa

SEQ ID NO: 1110481 - DNA, 20 bp, Homo sapiens
cttaattattataaaaatat

SEQ ID NO: 1110482 - DNA, 15 bp, Homo sapiens
cttaattctccttcc

SEQ ID NO: 1110483 - DNA, 17 bp, Homo sapiens
cttaattctccttccca

SEQ ID NO: 1110484 - DNA, 20 bp, Homo sapiens
cttaattcttagctcattct

SEQ ID NO: 1110485 - DNA, 14 bp, Homo sapiens
cttaattctttgtt

SEQ ID NO: 1110486 - DNA, 20 bp, Homo sapiens
cttaattctttgttctgttt

SEQ ID NO: 1110487 - DNA, 21 bp, Homo sapiens
cttaattgccagcaaataaat

SEQ ID NO: 1110488 - DNA, 23 bp, Homo sapiens
cttaatttaatgtattaatctgt

SEQ ID NO: 1110489 - DNA, 17 bp, Homo sapiens
cttaatttaattgcttt

SEQ ID NO: 1110490 - DNA, 15 bp, Homo sapiens
cttaatttattatta

SEQ ID NO: 1110491 - DNA, 16 bp, Homo sapiens
cttaatttattattaa

SEQ ID NO: 1110492 - DNA, 12 bp, Homo sapiens
cttaatttcctt

SEQ ID NO: 1110493 - DNA, 21 bp, Homo sapiens
cttaatttccttctgttaaga

SEQ ID NO: 1110494 - DNA, 13 bp, Homo sapiens
cttaatttccttt

SEQ ID NO: 1110495 - DNA, 16 bp, Homo sapiens
cttcaaatccatccag

SEQ ID NO: 1110496 - DNA, 18 bp, Homo sapiens
cttcaaattaaaacagct

SEQ ID NO: 1110497 - DNA, 18 bp, Homo sapiens
cttcaaattatagaaaca

SEQ ID NO: 1110498 - DNA, 18 bp, Homo sapiens
cttcaaattcaaggcctt

SEQ ID NO: 1110499 - DNA, 20 bp, Homo sapiens
cttcaacaattctaaaatga

SEQ ID NO: 1110500 - DNA, 23 bp, Homo sapiens
cttcaacagaccccctctagaaa

SEQ ID NO: 1110501 - DNA, 18 bp, Homo sapiens
cttcaacatcaatgttca

SEQ ID NO: 1110502 - DNA, 15 bp, Homo sapiens
cttcaactcctggct

SEQ ID NO: 1110503 - DNA, 17 bp, Homo sapiens
cttcaactgaccagcct

SEQ ID NO: 1110504 - DNA, 20 bp, Homo sapiens
cttcaactggttagtgtgaa

SEQ ID NO: 1110505 - DNA, 16 bp, Homo sapiens
cttcaacttttctctt

SEQ ID NO: 1110506 - DNA, 13 bp, Homo sapiens
cttcaagaggaaa

SEQ ID NO: 1110507 - DNA, 22 bp, Homo sapiens
cttcaagaggaaaggcgccccc

SEQ ID NO: 1110508 - DNA, 21 bp, Homo sapiens
cttcaagcatcctcagaagcc

SEQ ID NO: 1110509 - DNA, 22 bp, Homo sapiens
cttcaagcatggctattttata

SEQ ID NO: 1110510 - DNA, 12 bp, Homo sapiens
cttcaagctctc

SEQ ID NO: 1110511 - DNA, 17 bp, Homo sapiens
cttcaaggactgtttca

SEQ ID NO: 1110512 - DNA, 20 bp, Homo sapiens
cttcaaggactgtttcagtg

SEQ ID NO: 1110513 - DNA, 20 bp, Homo sapiens
cttcaaggatatactgcagc

SEQ ID NO: 1110514 - DNA, 14 bp, Homo sapiens
cttcaaggcctccc

SEQ ID NO: 1110515 - DNA, 16 bp, Homo sapiens
cttcaaggcttccact

SEQ ID NO: 1110516 - DNA, 17 bp, Homo sapiens
cttcaaggtggcagctg

SEQ ID NO: 1110517 - DNA, 20 bp, Homo sapiens
cttcaagttagctcaggagg

SEQ ID NO: 1110518 - DNA, 13 bp, Homo sapiens
cttcaagttgtaa

SEQ ID NO: 1110519 - DNA, 17 bp, Homo sapiens
cttcaatacttaaaaat

SEQ ID NO: 1110520 - DNA, 16 bp, Homo sapiens
cttcaatataagaagc

SEQ ID NO: 1110521 - DNA, 18 bp, Homo sapiens
cttcaatatgaatctata

SEQ ID NO: 1110522 - DNA, 21 bp, Homo sapiens
cttcaatcggcttgtgggtga

SEQ ID NO: 1110523 - DNA, 13 bp, Homo sapiens
cttcaatctctgt

SEQ ID NO: 1110524 - DNA, 16 bp, Homo sapiens
cttcaatgaaaaaatc

SEQ ID NO: 1110525 - DNA, 18 bp, Homo sapiens
cttcaatgaattaattca

SEQ ID NO: 1110526 - DNA, 20 bp, Homo sapiens
cttcaatgctagaaaatcga

SEQ ID NO: 1110527 - DNA, 18 bp, Homo sapiens
cttcaatgggctcttcca

SEQ ID NO: 1110528 - DNA, 19 bp, Homo sapiens
cttcaatgtgtcatttccg

SEQ ID NO: 1110529 - DNA, 10 bp, Homo sapiens
cttcaatttg

SEQ ID NO: 1110530 - DNA, 17 bp, Homo sapiens
cttcacaaagcccaagg

SEQ ID NO: 1110531 - DNA, 23 bp, Homo sapiens
cttcacaaatgtcattgtctact

SEQ ID NO: 1110532 - DNA, 21 bp, Homo sapiens
cttcacaatctgtcagttcta

SEQ ID NO: 1110533 - DNA, 15 bp, Homo sapiens
cttcacactgcaaga

SEQ ID NO: 1110534 - DNA, 20 bp, Homo sapiens
cttcacactgcaagagcctt

SEQ ID NO: 1110535 - DNA, 21 bp, Homo sapiens
cttcacactgcaagagccttg

SEQ ID NO: 1110536 - DNA, 23 bp, Homo sapiens
cttcacagccacacctggactga

SEQ ID NO: 1110537 - DNA, 20 bp, Homo sapiens
cttcacaggcagtgcatgtg

SEQ ID NO: 1110538 - DNA, 18 bp, Homo sapiens
cttcacagtagagccagc

SEQ ID NO: 1110539 - DNA, 20 bp, Homo sapiens
cttcacagtagagccagctt

SEQ ID NO: 1110540 - DNA, 13 bp, Homo sapiens
cttcacagtgcag

SEQ ID NO: 1110541 - DNA, 22 bp, Homo sapiens
cttcacataagctcagaatcca

SEQ ID NO: 1110542 - DNA, 22 bp, Homo sapiens
cttcacataggaagggatctga

SEQ ID NO: 1110543 - DNA, 23 bp, Homo sapiens
cttcacatattgatttccgttaa

SEQ ID NO: 1110544 - DNA, 17 bp, Homo sapiens
cttcacatcccattggg

SEQ ID NO: 1110545 - DNA, 23 bp, Homo sapiens
cttcacatttgtatgtgtgtaga

SEQ ID NO: 1110546 - DNA, 19 bp, Homo sapiens
cttcaccaagtgcaataga

SEQ ID NO: 1110547 - DNA, 13 bp, Homo sapiens
cttcaccaccccc

SEQ ID NO: 1110548 - DNA, 14 bp, Homo sapiens
cttcaccaccccct

SEQ ID NO: 1110549 - DNA, 19 bp, Homo sapiens
cttcaccaccccctgtccc

SEQ ID NO: 1110550 - DNA, 14 bp, Homo sapiens
cttcaccagtctgt

SEQ ID NO: 1110551 - DNA, 19 bp, Homo sapiens
cttcaccatggccttatga

SEQ ID NO: 1110552 - DNA, 24 bp, Homo sapiens
cttcacccagctaatctgtagggc

SEQ ID NO: 1110553 - DNA, 14 bp, Homo sapiens
cttcacccccaact

SEQ ID NO: 1110554 - DNA, 15 bp, Homo sapiens
cttcacccccaactt

SEQ ID NO: 1110555 - DNA, 15 bp, Homo sapiens
cttcaccccccactc

SEQ ID NO: 1110556 - DNA, 14 bp, Homo sapiens
cttcacccctgcac

SEQ ID NO: 1110557 - DNA, 16 bp, Homo sapiens
cttcacccctgcactt

SEQ ID NO: 1110558 - DNA, 24 bp, Homo sapiens
cttcaccctcaccccctcctggca

SEQ ID NO: 1110559 - DNA, 13 bp, Homo sapiens
cttcaccctgtca

SEQ ID NO: 1110560 - DNA, 14 bp, Homo sapiens
cttcaccctgtcaa

SEQ ID NO: 1110561 - DNA, 21 bp, Homo sapiens
cttcaccctgtcaagttaaca

SEQ ID NO: 1110562 - DNA, 20 bp, Homo sapiens
cttcacctaagtctctgtga

SEQ ID NO: 1110563 - DNA, 16 bp, Homo sapiens
cttcacctgttatgta

SEQ ID NO: 1110564 - DNA, 13 bp, Homo sapiens
cttcacctttcct

SEQ ID NO: 1110565 - DNA, 21 bp, Homo sapiens
cttcacctttcctctccctca

SEQ ID NO: 1110566 - DNA, 16 bp, Homo sapiens
cttcacctttggtgca

SEQ ID NO: 1110567 - DNA, 18 bp, Homo sapiens
cttcacgaagtgttgcat

SEQ ID NO: 1110568 - DNA, 19 bp, Homo sapiens
cttcacgaagtgttgcatg

SEQ ID NO: 1110569 - DNA, 15 bp, Homo sapiens
cttcacggaagagcc

SEQ ID NO: 1110570 - DNA, 14 bp, Homo sapiens
cttcactaccctga

SEQ ID NO: 1110571 - DNA, 12 bp, Homo sapiens
cttcactacttt

SEQ ID NO: 1110572 - DNA, 17 bp, Homo sapiens
cttcactcaaattttgg

SEQ ID NO: 1110573 - DNA, 13 bp, Homo sapiens
cttcactcttcac

SEQ ID NO: 1110574 - DNA, 14 bp, Homo sapiens
cttcactcttcact

SEQ ID NO: 1110575 - DNA, 24 bp, Homo sapiens
cttcactgccccacttctggcatg

SEQ ID NO: 1110576 - DNA, 17 bp, Homo sapiens
cttcactgtcatcttca

SEQ ID NO: 1110577 - DNA, 18 bp, Homo sapiens
cttcactgtcatcttcaa

SEQ ID NO: 1110578 - DNA, 17 bp, Homo sapiens
cttcactgtcctccaag

SEQ ID NO: 1110579 - DNA, 19 bp, Homo sapiens
cttcactgtgaggggaagg

SEQ ID NO: 1110580 - DNA, 12 bp, Homo sapiens
cttcactgttcc

SEQ ID NO: 1110581 - DNA, 14 bp, Homo sapiens
cttcactgttccct

SEQ ID NO: 1110582 - DNA, 20 bp, Homo sapiens
cttcactgttccctctggct

SEQ ID NO: 1110583 - DNA, 22 bp, Homo sapiens
cttcactgttccctctggcttc

SEQ ID NO: 1110584 - DNA, 16 bp, Homo sapiens
cttcactgttgaaaat

SEQ ID NO: 1110585 - DNA, 16 bp, Homo sapiens
cttcacttacaagaaa

SEQ ID NO: 1110586 - DNA, 21 bp, Homo sapiens
cttcacttacaagaaaggcct

SEQ ID NO: 1110587 - DNA, 16 bp, Homo sapiens
cttcacttctgaccac

SEQ ID NO: 1110588 - DNA, 21 bp, Homo sapiens
cttcacttctgaccacacttc

SEQ ID NO: 1110589 - DNA, 20 bp, Homo sapiens
cttcacttgagttggctgtg

SEQ ID NO: 1110590 - DNA, 21 bp, Homo sapiens
cttcactttgccttctggtta

SEQ ID NO: 1110591 - DNA, 18 bp, Homo sapiens
cttcagaactgcccttgc

SEQ ID NO: 1110592 - DNA, 23 bp, Homo sapiens
cttcagaactgcccttgctgccc

SEQ ID NO: 1110593 - DNA, 17 bp, Homo sapiens
cttcagaagctattttt

SEQ ID NO: 1110594 - DNA, 15 bp, Homo sapiens
cttcagaattagatg

SEQ ID NO: 1110595 - DNA, 20 bp, Homo sapiens
cttcagaattccatatcttg

SEQ ID NO: 1110596 - DNA, 20 bp, Homo sapiens
cttcagacacatgctatgtt

SEQ ID NO: 1110597 - DNA, 19 bp, Homo sapiens
cttcagacagagaggactg

SEQ ID NO: 1110598 - DNA, 20 bp, Homo sapiens
cttcagacagagaggactgt

SEQ ID NO: 1110599 - DNA, 13 bp, Homo sapiens
cttcagacccaga

SEQ ID NO: 1110600 - DNA, 17 bp, Homo sapiens
cttcagacccagagaag

SEQ ID NO: 1110601 - DNA, 15 bp, Homo sapiens
cttcagactttgctt

SEQ ID NO: 1110602 - DNA, 16 bp, Homo sapiens
cttcagagagctggta

SEQ ID NO: 1110603 - DNA, 12 bp, Homo sapiens
cttcagagcagg

SEQ ID NO: 1110604 - DNA, 11 bp, Homo sapiens
cttcagagctc

SEQ ID NO: 1110605 - DNA, 23 bp, Homo sapiens
cttcagaggccctcgctgccagc

SEQ ID NO: 1110606 - DNA, 13 bp, Homo sapiens
cttcagaggctga

SEQ ID NO: 1110607 - DNA, 23 bp, Homo sapiens
cttcagagtttgtcatatactgc

SEQ ID NO: 1110608 - DNA, 16 bp, Homo sapiens
cttcagagtttgtgtg

SEQ ID NO: 1110609 - DNA, 18 bp, Homo sapiens
cttcagatattattgctt

SEQ ID NO: 1110610 - DNA, 13 bp, Homo sapiens
cttcagatctgag

SEQ ID NO: 1110611 - DNA, 16 bp, Homo sapiens
cttcagatctgaggtt

SEQ ID NO: 1110612 - DNA, 13 bp, Homo sapiens
cttcagcaggaag

SEQ ID NO: 1110613 - DNA, 15 bp, Homo sapiens
cttcagcaggaaggg

SEQ ID NO: 1110614 - DNA, 13 bp, Homo sapiens
cttcagcccaggc

SEQ ID NO: 1110615 - DNA, 16 bp, Homo sapiens
cttcagcccaggcttt

SEQ ID NO: 1110616 - DNA, 17 bp, Homo sapiens
cttcagcccaggctttt

SEQ ID NO: 1110617 - DNA, 16 bp, Homo sapiens
cttcccccagcccatc

SEQ ID NO: 1110618 - DNA, 21 bp, Homo sapiens
cttcccccatcccctttcctc

SEQ ID NO: 1110619 - DNA, 22 bp, Homo sapiens
cttcccccatcccctttcctcc

SEQ ID NO: 1110620 - DNA, 16 bp, Homo sapiens
cttcccccatccctac

SEQ ID NO: 1110621 - DNA, 18 bp, Homo sapiens
cttcccccctctcctccc

SEQ ID NO: 1110622 - DNA, 21 bp, Homo sapiens
cttcccccctctcctcccagc

SEQ ID NO: 1110623 - DNA, 24 bp, Homo sapiens
cttcccccctctcctcccagctgc

SEQ ID NO: 1110624 - DNA, 16 bp, Homo sapiens
cttccccctttactat

SEQ ID NO: 1110625 - DNA, 16 bp, Homo sapiens
cttcccccttttttgt

SEQ ID NO: 1110626 - DNA, 17 bp, Homo sapiens
cttccccgtcccctgca

SEQ ID NO: 1110627 - DNA, 19 bp, Homo sapiens
cttccccgtcccctgcagc

SEQ ID NO: 1110628 - DNA, 12 bp, Homo sapiens
cttcccctagac

SEQ ID NO: 1110629 - DNA, 16 bp, Homo sapiens
cttcccctccaagacc

SEQ ID NO: 1110630 - DNA, 11 bp, Homo sapiens
cttcccctccc

SEQ ID NO: 1110631 - DNA, 19 bp, Homo sapiens
cttcccctcccccactcct

SEQ ID NO: 1110632 - DNA, 16 bp, Homo sapiens
cttcccctccctaccc

SEQ ID NO: 1110633 - DNA, 21 bp, Homo sapiens
cttcccctccctaccctcgga

SEQ ID NO: 1110634 - DNA, 20 bp, Homo sapiens
cttcccctccctggctccca

SEQ ID NO: 1110635 - DNA, 19 bp, Homo sapiens
cttcccctgcacctggcct

SEQ ID NO: 1110636 - DNA, 20 bp, Homo sapiens
cttcccctgcacctggcctg

SEQ ID NO: 1110637 - DNA, 14 bp, Homo sapiens
cttcccctgctgac

SEQ ID NO: 1110638 - DNA, 12 bp, Homo sapiens
cttccccttccc

SEQ ID NO: 1110639 - DNA, 13 bp, Homo sapiens
cttccccttcccc

SEQ ID NO: 1110640 - DNA, 14 bp, Homo sapiens
cttccccttcctaa

SEQ ID NO: 1110641 - DNA, 15 bp, Homo sapiens
cttccccttcctgtt

SEQ ID NO: 1110642 - DNA, 13 bp, Homo sapiens
cttccccttctgt

SEQ ID NO: 1110643 - DNA, 13 bp, Homo sapiens
cttccccttgcca

SEQ ID NO: 1110644 - DNA, 16 bp, Homo sapiens
cttccccttgcccagg

SEQ ID NO: 1110645 - DNA, 19 bp, Homo sapiens
cttccccttgcccagggct

SEQ ID NO: 1110646 - DNA, 14 bp, Homo sapiens
cttccccttgccct

SEQ ID NO: 1110647 - DNA, 23 bp, Homo sapiens
cttccccttgcccttgccctgac

SEQ ID NO: 1110648 - DNA, 16 bp, Homo sapiens
cttccccttttgcctg

SEQ ID NO: 1110649 - DNA, 19 bp, Homo sapiens
cttccccttttgcctggct

SEQ ID NO: 1110650 - DNA, 18 bp, Homo sapiens
cttcccgacccagccagc

SEQ ID NO: 1110651 - DNA, 23 bp, Homo sapiens
cttcccgacccagccagctgcag

SEQ ID NO: 1110652 - DNA, 16 bp, Homo sapiens
cttcccgctcagccct

SEQ ID NO: 1110653 - DNA, 19 bp, Homo sapiens
cttcccgggccagggctgc

SEQ ID NO: 1110654 - DNA, 14 bp, Homo sapiens
cttcccgtcccata

SEQ ID NO: 1110655 - DNA, 15 bp, Homo sapiens
cttcccgtcccatat

SEQ ID NO: 1110656 - DNA, 22 bp, Homo sapiens
cttcccgtcccatatcctgcct

SEQ ID NO: 1110657 - DNA, 15 bp, Homo sapiens
cttcccgtctcagaa

SEQ ID NO: 1110658 - DNA, 19 bp, Homo sapiens
cttcccgtgtgtatttcta

SEQ ID NO: 1110659 - DNA, 18 bp, Homo sapiens
cttccctaaactgcagcc

SEQ ID NO: 1110660 - DNA, 21 bp, Homo sapiens
cttccctaaactgcagcctct

SEQ ID NO: 1110661 - DNA, 22 bp, Homo sapiens
cttccctaaactgcagcctctc

SEQ ID NO: 1110662 - DNA, 15 bp, Homo sapiens
cttccctacctcagg

SEQ ID NO: 1110663 - DNA, 23 bp, Homo sapiens
cttccctagctttagaccctggg

SEQ ID NO: 1110664 - DNA, 18 bp, Homo sapiens
cttccctcactcttcctc

SEQ ID NO: 1110665 - DNA, 16 bp, Homo sapiens
cttccctcagatttcc

SEQ ID NO: 1110666 - DNA, 14 bp, Homo sapiens
cttccctcctccca

SEQ ID NO: 1110667 - DNA, 18 bp, Homo sapiens
cttccctcctcccatgtc

SEQ ID NO: 1110668 - DNA, 12 bp, Homo sapiens
cttccctcctgt

SEQ ID NO: 1110669 - DNA, 11 bp, Homo sapiens
cttccctctgc

SEQ ID NO: 1110670 - DNA, 13 bp, Homo sapiens
cttccctctgcct

SEQ ID NO: 1110671 - DNA, 15 bp, Homo sapiens
cttccctctgcctgt

SEQ ID NO: 1110672 - DNA, 16 bp, Homo sapiens
cttccctctgcctgtc

SEQ ID NO: 1110673 - DNA, 19 bp, Homo sapiens
cttccctctgggcacgcct

SEQ ID NO: 1110674 - DNA, 22 bp, Homo sapiens
cttccctctttcatctcctgag

SEQ ID NO: 1110675 - DNA, 13 bp, Homo sapiens
cttccctgactca

SEQ ID NO: 1110676 - DNA, 20 bp, Homo sapiens
cttccctgactcattctgaa

SEQ ID NO: 1110677 - DNA, 22 bp, Homo sapiens
cttccctgagtgcgggctgagg

SEQ ID NO: 1110678 - DNA, 13 bp, Homo sapiens
cttccctgatggc

SEQ ID NO: 1110679 - DNA, 19 bp, Homo sapiens
cttccctgatggcctttgg

SEQ ID NO: 1110680 - DNA, 20 bp, Homo sapiens
cttccctgatggcctttgga

SEQ ID NO: 1110681 - DNA, 21 bp, Homo sapiens
cttccctgattgacctgctcc

SEQ ID NO: 1110682 - DNA, 13 bp, Homo sapiens
cttccctgcacta

SEQ ID NO: 1110683 - DNA, 22 bp, Homo sapiens
cttccctgcagggcgcccctgg

SEQ ID NO: 1110684 - DNA, 11 bp, Homo sapiens
cttccctggcg

SEQ ID NO: 1110685 - DNA, 21 bp, Homo sapiens
cttccctggcggccccaactc

SEQ ID NO: 1110686 - DNA, 12 bp, Homo sapiens
cttccctggctt

SEQ ID NO: 1110687 - DNA, 15 bp, Homo sapiens
cttccctgggaaggc

SEQ ID NO: 1110688 - DNA, 19 bp, Homo sapiens
cttccctgggaaggctaag

SEQ ID NO: 1110689 - DNA, 14 bp, Homo sapiens
cttccctgggcctc

SEQ ID NO: 1110690 - DNA, 12 bp, Homo sapiens
cttccctgggct

SEQ ID NO: 1110691 - DNA, 13 bp, Homo sapiens
cttccctgggctg

SEQ ID NO: 1110692 - DNA, 16 bp, Homo sapiens
cttccctgggctgcca

SEQ ID NO: 1110693 - DNA, 18 bp, Homo sapiens
cttccctgggctgccacc

SEQ ID NO: 1110694 - DNA, 17 bp, Homo sapiens
cttccctggggagccct

SEQ ID NO: 1110695 - DNA, 19 bp, Homo sapiens
cttccctggggagccctca

SEQ ID NO: 1110696 - DNA, 13 bp, Homo sapiens
cttccctgtccct

SEQ ID NO: 1110697 - DNA, 14 bp, Homo sapiens
cttccctgtccctc

SEQ ID NO: 1110698 - DNA, 16 bp, Homo sapiens
cttccctgtccctcta

SEQ ID NO: 1110699 - DNA, 15 bp, Homo sapiens
cttcccttaactcca

SEQ ID NO: 1110700 - DNA, 17 bp, Homo sapiens
cttcccttaactccaag

SEQ ID NO: 1110701 - DNA, 18 bp, Homo sapiens
cttcccttaactccaaga

SEQ ID NO: 1110702 - DNA, 13 bp, Homo sapiens
cttcccttccctc

SEQ ID NO: 1110703 - DNA, 21 bp, Homo sapiens
cttcccttgagatgagtttct

SEQ ID NO: 1110704 - DNA, 22 bp, Homo sapiens
cttcccttgagatgagtttctg

SEQ ID NO: 1110705 - DNA, 12 bp, Homo sapiens
cttcccttgcca

SEQ ID NO: 1110706 - DNA, 14 bp, Homo sapiens
cttcccttgccact

SEQ ID NO: 1110707 - DNA, 16 bp, Homo sapiens
cttcccttgccacttt

SEQ ID NO: 1110708 - DNA, 22 bp, Homo sapiens
cttccgaaaaatcctcttcctc

SEQ ID NO: 1110709 - DNA, 18 bp, Homo sapiens
cttccgaccctctgggaa

SEQ ID NO: 1110710 - DNA, 21 bp, Homo sapiens
cttccgaccctctgggaacct

SEQ ID NO: 1110711 - DNA, 19 bp, Homo sapiens
cttccgagctgctttgtgg

SEQ ID NO: 1110712 - DNA, 22 bp, Homo sapiens
cttccgatggatgaatctccca

SEQ ID NO: 1110713 - DNA, 21 bp, Homo sapiens
cttccgcagcccctttcccca

SEQ ID NO: 1110714 - DNA, 15 bp, Homo sapiens
cttccgcagtgtggc

SEQ ID NO: 1110715 - DNA, 17 bp, Homo sapiens
cttccgcagtgtggcca

SEQ ID NO: 1110716 - DNA, 21 bp, Homo sapiens
cttccgcagtgtggccaggct

SEQ ID NO: 1110717 - DNA, 14 bp, Homo sapiens
cttccgcccctgcc

SEQ ID NO: 1110718 - DNA, 18 bp, Homo sapiens
cttccgcccctgcctgcc

SEQ ID NO: 1110719 - DNA, 22 bp, Homo sapiens
cttccgcccctgcctgccatgt

SEQ ID NO: 1110720 - DNA, 20 bp, Homo sapiens
cttccgcgcccagcgctcgc

SEQ ID NO: 1110721 - DNA, 14 bp, Homo sapiens
cttccgctccctgg

SEQ ID NO: 1110722 - DNA, 15 bp, Homo sapiens
cttccgctccctgga

SEQ ID NO: 1110723 - DNA, 14 bp, Homo sapiens
cttccgctctgagg

SEQ ID NO: 1110724 - DNA, 16 bp, Homo sapiens
cttccgctctgaggca

SEQ ID NO: 1110725 - DNA, 12 bp, Homo sapiens
cttccgctgagg

SEQ ID NO: 1110726 - DNA, 14 bp, Homo sapiens
cttccggagatgta

SEQ ID NO: 1110727 - DNA, 15 bp, Homo sapiens
cttccggagatgtag

SEQ ID NO: 1110728 - DNA, 14 bp, Homo sapiens
cttccgggagctgg

SEQ ID NO: 1110729 - DNA, 17 bp, Homo sapiens
cttccggggccatgggc

SEQ ID NO: 1110730 - DNA, 22 bp, Homo sapiens
cttccgggtctcgcagcctgaa

SEQ ID NO: 1110731 - DNA, 13 bp, Homo sapiens
cttccgtagtttg

SEQ ID NO: 1110732 - DNA, 22 bp, Homo sapiens
cttcctaaacccaatgacttcc

SEQ ID NO: 1110733 - DNA, 12 bp, Homo sapiens
cttcctaaatat

SEQ ID NO: 1110734 - DNA, 13 bp, Homo sapiens
cttcctaattcca

SEQ ID NO: 1110735 - DNA, 19 bp, Homo sapiens
cttcctaattccacagctg

SEQ ID NO: 1110736 - DNA, 21 bp, Homo sapiens
cttcctacaagagcagcctgt

SEQ ID NO: 1110737 - DNA, 19 bp, Homo sapiens
cttcctaccaagtcaaact

SEQ ID NO: 1110738 - DNA, 16 bp, Homo sapiens
cttcctaccctgcctc

SEQ ID NO: 1110739 - DNA, 17 bp, Homo sapiens
cttcctactcctcatag

SEQ ID NO: 1110740 - DNA, 23 bp, Homo sapiens
cttctaggcccattgtcctcctt

SEQ ID NO: 1110741 - DNA, 18 bp, Homo sapiens
cttctaggggtagctggt

SEQ ID NO: 1110742 - DNA, 19 bp, Homo sapiens
cttctaggggtagctggtg

SEQ ID NO: 1110743 - DNA, 16 bp, Homo sapiens
cttctagtcttggcca

SEQ ID NO: 1110744 - DNA, 16 bp, Homo sapiens
cttctagtttcccaca

SEQ ID NO: 1110745 - DNA, 20 bp, Homo sapiens
cttctataatatttcctttt

SEQ ID NO: 1110746 - DNA, 22 bp, Homo sapiens
cttctatcattccaattctaaa

SEQ ID NO: 1110747 - DNA, 23 bp, Homo sapiens
cttctatcattccaattctaaat

SEQ ID NO: 1110748 - DNA, 14 bp, Homo sapiens
cttctatgttggtt

SEQ ID NO: 1110749 - DNA, 16 bp, Homo sapiens
cttctattaatcaaga

SEQ ID NO: 1110750 - DNA, 18 bp, Homo sapiens
cttctattaatcaagaga

SEQ ID NO: 1110751 - DNA, 14 bp, Homo sapiens
cttctattggtctc

SEQ ID NO: 1110752 - DNA, 11 bp, Homo sapiens
cttctatttaa

SEQ ID NO: 1110753 - DNA, 19 bp, Homo sapiens
cttctatttttatcatgaa

SEQ ID NO: 1110754 - DNA, 17 bp, Homo sapiens
cttctcaaccttatcaa

SEQ ID NO: 1110755 - DNA, 19 bp, Homo sapiens
cttctcaaccttatcaagg

SEQ ID NO: 1110756 - DNA, 12 bp, Homo sapiens
cttctcaagtgc

SEQ ID NO: 1110757 - DNA, 14 bp, Homo sapiens
cttctcaagtgcct

SEQ ID NO: 1110758 - DNA, 17 bp, Homo sapiens
cttctcaagtgccttaa

SEQ ID NO: 1110759 - DNA, 18 bp, Homo sapiens
cttctcaagtgccttaat

SEQ ID NO: 1110760 - DNA, 16 bp, Homo sapiens
cttctcacctgctcca

SEQ ID NO: 1110761 - DNA, 14 bp, Homo sapiens
cttctcactgccat

SEQ ID NO: 1110762 - DNA, 13 bp, Homo sapiens
cttctcagaatct

SEQ ID NO: 1110763 - DNA, 13 bp, Homo sapiens
cttctcagcccct

SEQ ID NO: 1110764 - DNA, 17 bp, Homo sapiens
cttctcagctcttccat

SEQ ID NO: 1110765 - DNA, 15 bp, Homo sapiens
cttctcatagcatta

SEQ ID NO: 1110766 - DNA, 14 bp, Homo sapiens
cttctcatctttta

SEQ ID NO: 1110767 - DNA, 14 bp, Homo sapiens
cttctcatgatcca

SEQ ID NO: 1110768 - DNA, 18 bp, Homo sapiens
cttctccaacactgaagt

SEQ ID NO: 1110769 - DNA, 18 bp, Homo sapiens
cttctccaattctgaaat

SEQ ID NO: 1110770 - DNA, 21 bp, Homo sapiens
cttctccaccagcccctcaca

SEQ ID NO: 1110771 - DNA, 17 bp, Homo sapiens
cttctccacgtctttcc

SEQ ID NO: 1110772 - DNA, 21 bp, Homo sapiens
cttctccacgtctttcctgct

SEQ ID NO: 1110773 - DNA, 20 bp, Homo sapiens
cttctccaggtctcacgggc

SEQ ID NO: 1110774 - DNA, 14 bp, Homo sapiens
cttctccatccaca

SEQ ID NO: 1110775 - DNA, 16 bp, Homo sapiens
cttctccatccacatg

SEQ ID NO: 1110776 - DNA, 14 bp, Homo sapiens
cttctcccacactg

SEQ ID NO: 1110777 - DNA, 16 bp, Homo sapiens
cttctcccacatgagg

SEQ ID NO: 1110778 - DNA, 13 bp, Homo sapiens
cttctcccacccc

SEQ ID NO: 1110779 - DNA, 14 bp, Homo sapiens
cttctcccacccct

SEQ ID NO: 1110780 - DNA, 15 bp, Homo sapiens
cttctcccacccctt

SEQ ID NO: 1110781 - DNA, 18 bp, Homo sapiens
cttctcccaccccttggc

SEQ ID NO: 1110782 - DNA, 12 bp, Homo sapiens
cttctcccagaa

SEQ ID NO: 1110783 - DNA, 20 bp, Homo sapiens
cttctcccatctcttccttg

SEQ ID NO: 1110784 - DNA, 15 bp, Homo sapiens
cttctcccccacggt

SEQ ID NO: 1110785 - DNA, 20 bp, Homo sapiens
cttctcccccacggtatcct

SEQ ID NO: 1110786 - DNA, 20 bp, Homo sapiens
cttctccccccatcccaggg

SEQ ID NO: 1110787 - DNA, 13 bp, Homo sapiens
cttctcccccttg

SEQ ID NO: 1110788 - DNA, 16 bp, Homo sapiens
cttctcccccttgtct

SEQ ID NO: 1110789 - DNA, 22 bp, Homo sapiens
cttctcccccttgtcttccccc

SEQ ID NO: 1110790 - DNA, 16 bp, Homo sapiens
cttctccccgaggctg

SEQ ID NO: 1110791 - DNA, 20 bp, Homo sapiens
cttctccccgaggctgcccc

SEQ ID NO: 1110792 - DNA, 22 bp, Homo sapiens
cttctccccgaggctgccccag

SEQ ID NO: 1110793 - DNA, 19 bp, Homo sapiens
cttctcccctctcccaggg

SEQ ID NO: 1110794 - DNA, 20 bp, Homo sapiens
cttctccccttcctggacac

SEQ ID NO: 1110795 - DNA, 21 bp, Homo sapiens
cttctccccttcctggacaca

SEQ ID NO: 1110796 - DNA, 23 bp, Homo sapiens
cttctccccttcctggacacact

SEQ ID NO: 1110797 - DNA, 18 bp, Homo sapiens
cttctcccggccctcact

SEQ ID NO: 1110798 - DNA, 13 bp, Homo sapiens
cttctccctggat

SEQ ID NO: 1110799 - DNA, 12 bp, Homo sapiens
cttctccgccag

SEQ ID NO: 1110800 - DNA, 13 bp, Homo sapiens
cttctccgccagc

SEQ ID NO: 1110801 - DNA, 21 bp, Homo sapiens
cttctccgccagcctcctctg

SEQ ID NO: 1110802 - DNA, 23 bp, Homo sapiens
cttctccgccagcctcctctgga

SEQ ID NO: 1110803 - DNA, 15 bp, Homo sapiens
cttctcctatgtgta

SEQ ID NO: 1110804 - DNA, 16 bp, Homo sapiens
cttctcctatgtgtaa

SEQ ID NO: 1110805 - DNA, 22 bp, Homo sapiens
cttctcctatgtgtaaggtgaa

SEQ ID NO: 1110806 - DNA, 13 bp, Homo sapiens
cttctcctgctgc

SEQ ID NO: 1110807 - DNA, 20 bp, Homo sapiens
cttctcctgctgctcctgtt

SEQ ID NO: 1110808 - DNA, 21 bp, Homo sapiens
cttctccttagacactttgga

SEQ ID NO: 1110809 - DNA, 14 bp, Homo sapiens
cttctcctttcaca

SEQ ID NO: 1110810 - DNA, 22 bp, Homo sapiens
cttctcctttcacaaccttctg

SEQ ID NO: 1110811 - DNA, 14 bp, Homo sapiens
cttctcggccagcc

SEQ ID NO: 1110812 - DNA, 22 bp, Homo sapiens
cttctcggccagcccgtcctcc

SEQ ID NO: 1110813 - DNA, 15 bp, Homo sapiens
cttctctataaaaaa

SEQ ID NO: 1110814 - DNA, 18 bp, Homo sapiens
cttctctataaaaaatat

SEQ ID NO: 1110815 - DNA, 14 bp, Homo sapiens
cttctctatcctct

SEQ ID NO: 1110816 - DNA, 17 bp, Homo sapiens
cttctctatcctctctc

SEQ ID NO: 1110817 - DNA, 23 bp, Homo sapiens
cttctctcactgtgttactgctt

SEQ ID NO: 1110818 - DNA, 20 bp, Homo sapiens
cttctctcagacttacttta

SEQ ID NO: 1110819 - DNA, 18 bp, Homo sapiens
cttctctcagccagctgt

SEQ ID NO: 1110820 - DNA, 22 bp, Homo sapiens
cttctctccacatggaagccca

SEQ ID NO: 1110821 - DNA, 18 bp, Homo sapiens
cttctctccacttctggt

SEQ ID NO: 1110822 - DNA, 15 bp, Homo sapiens
cttctctccagctga

SEQ ID NO: 1110823 - DNA, 18 bp, Homo sapiens
cttctctccagctgacta

SEQ ID NO: 1110824 - DNA, 19 bp, Homo sapiens
cttctctccagctgactaa

SEQ ID NO: 1110825 - DNA, 21 bp, Homo sapiens
cttctctcctttctccctgca

SEQ ID NO: 1110826 - DNA, 15 bp, Homo sapiens
cttctctctccagaa

SEQ ID NO: 1110827 - DNA, 14 bp, Homo sapiens
cttctctctccagg

SEQ ID NO: 1110828 - DNA, 16 bp, Homo sapiens
cttctctctccagggt

SEQ ID NO: 1110829 - DNA, 23 bp, Homo sapiens
cttctctctccctgtcacacact

SEQ ID NO: 1110830 - DNA, 15 bp, Homo sapiens
cttctctctgttccc

SEQ ID NO: 1110831 - DNA, 21 bp, Homo sapiens
cttctctcttcaatctctgga

SEQ ID NO: 1110832 - DNA, 16 bp, Homo sapiens
cttctctgacttctgc

SEQ ID NO: 1110833 - DNA, 21 bp, Homo sapiens
cttctctgacttctgcctgga

SEQ ID NO: 1110834 - DNA, 22 bp, Homo sapiens
cttctctgacttctgcctggag

SEQ ID NO: 1110835 - DNA, 13 bp, Homo sapiens
cttctctgcagta

SEQ ID NO: 1110836 - DNA, 15 bp, Homo sapiens
cttctctgcagtaaa

SEQ ID NO: 1110837 - DNA, 14 bp, Homo sapiens
cttctctgctccac

SEQ ID NO: 1110838 - DNA, 19 bp, Homo sapiens
cttctctgctgcctctgtg

SEQ ID NO: 1110839 - DNA, 22 bp, Homo sapiens
cttctctgctgcctctgtggaa

SEQ ID NO: 1110840 - DNA, 23 bp, Homo sapiens
cttctctgctgcctctgtggaag

SEQ ID NO: 1110841 - DNA, 21 bp, Homo sapiens
cttctctggagccaagtccag

SEQ ID NO: 1110842 - DNA, 17 bp, Homo sapiens
cttctctgggtcccggg

SEQ ID NO: 1110843 - DNA, 15 bp, Homo sapiens
cttctctgtctctgt

SEQ ID NO: 1110844 - DNA, 16 bp, Homo sapiens
cttctcttaatttaat

SEQ ID NO: 1110845 - DNA, 21 bp, Homo sapiens
cttctcttacattttcgtcct

SEQ ID NO: 1110846 - DNA, 13 bp, Homo sapiens
cttctcttagatt

SEQ ID NO: 1110847 - DNA, 14 bp, Homo sapiens
cttctcttcctgta

SEQ ID NO: 1110848 - DNA, 17 bp, Homo sapiens
cttctcttgaaaagttc

SEQ ID NO: 1110849 - DNA, 18 bp, Homo sapiens
cttctcttggtgaaataa

SEQ ID NO: 1110850 - DNA, 22 bp, Homo sapiens
cttctcttgtgatttggttgca

SEQ ID NO: 1110851 - DNA, 14 bp, Homo sapiens
cttctcttttcctc

SEQ ID NO: 1110852 - DNA, 19 bp, Homo sapiens
cttctcttttcctcgcaga

SEQ ID NO: 1110853 - DNA, 21 bp, Homo sapiens
cttctgaaaacattcacttgt

SEQ ID NO: 1110854 - DNA, 23 bp, Homo sapiens
cttctgaaatgaaacaaataatc

SEQ ID NO: 1110855 - DNA, 22 bp, Homo sapiens
cttctgaactcaaactgaggaa

SEQ ID NO: 1110856 - DNA, 19 bp, Homo sapiens
cttctgaactccatacagc

SEQ ID NO: 1110857 - DNA, 23 bp, Homo sapiens
cttctgaactccatacagcctct

SEQ ID NO: 1110858 - DNA, 21 bp, Homo sapiens
cttctgaagactgagaacttt

SEQ ID NO: 1110859 - DNA, 21 bp, Homo sapiens
cttctgaagatggaaggcctt

SEQ ID NO: 1110860 - DNA, 21 bp, Homo sapiens
cttctgaagtgtgtccatcct

SEQ ID NO: 1110861 - DNA, 12 bp, Homo sapiens
cttgcaagccat

SEQ ID NO: 1110862 - DNA, 15 bp, Homo sapiens
cttgcaagccataac

SEQ ID NO: 1110863 - DNA, 18 bp, Homo sapiens
cttgcaagccataacgtg

SEQ ID NO: 1110864 - DNA, 23 bp, Homo sapiens
cttgcaagttaaggcttccccct

SEQ ID NO: 1110865 - DNA, 15 bp, Homo sapiens
cttgcaatagtttgc

SEQ ID NO: 1110866 - DNA, 13 bp, Homo sapiens
cttgcaatctaat

SEQ ID NO: 1110867 - DNA, 17 bp, Homo sapiens
cttgcaatcttctactt

SEQ ID NO: 1110868 - DNA, 16 bp, Homo sapiens
cttgcacacttcccca

SEQ ID NO: 1110869 - DNA, 17 bp, Homo sapiens
cttgcacacttccccat

SEQ ID NO: 1110870 - DNA, 15 bp, Homo sapiens
cttgcacagtcactg

SEQ ID NO: 1110871 - DNA, 23 bp, Homo sapiens
cttgcacagtcactgctcttcag

SEQ ID NO: 1110872 - DNA, 15 bp, Homo sapiens
cttgcaccaaattat

SEQ ID NO: 1110873 - DNA, 16 bp, Homo sapiens
cttgcacccctcactc

SEQ ID NO: 1110874 - DNA, 15 bp, Homo sapiens
cttgcacccgcctct

SEQ ID NO: 1110875 - DNA, 21 bp, Homo sapiens
cttgcaccttttcatgtacag

SEQ ID NO: 1110876 - DNA, 15 bp, Homo sapiens
cttgcactccttccc

SEQ ID NO: 1110877 - DNA, 13 bp, Homo sapiens
cttgcactgaata

SEQ ID NO: 1110878 - DNA, 19 bp, Homo sapiens
cttgcactggccttctgat

SEQ ID NO: 1110879 - DNA, 13 bp, Homo sapiens
cttgcagaggagc

SEQ ID NO: 1110880 - DNA, 18 bp, Homo sapiens
cttgcagatatctgcatg

SEQ ID NO: 1110881 - DNA, 19 bp, Homo sapiens
cttgcagatatctgcatgt

SEQ ID NO: 1110882 - DNA, 22 bp, Homo sapiens
cttgcagatcatctggggacct

SEQ ID NO: 1110883 - DNA, 23 bp, Homo sapiens
cttgcagattttcttaaggaatt

SEQ ID NO: 1110884 - DNA, 18 bp, Homo sapiens
cttgcagcactcacacag

SEQ ID NO: 1110885 - DNA, 23 bp, Homo sapiens
cttgcagcactcacacaggaccc

SEQ ID NO: 1110886 - DNA, 15 bp, Homo sapiens
cttgcagcagggctg

SEQ ID NO: 1110887 - DNA, 16 bp, Homo sapiens
cttgcagcctggtcac

SEQ ID NO: 1110888 - DNA, 23 bp, Homo sapiens
cttgcaggggtcccccctcaaga

SEQ ID NO: 1110889 - DNA, 17 bp, Homo sapiens
cttgcaggggtccctgc

SEQ ID NO: 1110890 - DNA, 17 bp, Homo sapiens
cttgcagtggcttttca

SEQ ID NO: 1110891 - DNA, 18 bp, Homo sapiens
cttgcagttcagcaccac

SEQ ID NO: 1110892 - DNA, 16 bp, Homo sapiens
cttgcagttttgtaag

SEQ ID NO: 1110893 - DNA, 20 bp, Homo sapiens
cttgcataggctcttaagca

SEQ ID NO: 1110894 - DNA, 17 bp, Homo sapiens
cttgcatcctatttggt

SEQ ID NO: 1110895 - DNA, 20 bp, Homo sapiens
cttgcatgaagagaagcaat

SEQ ID NO: 1110896 - DNA, 15 bp, Homo sapiens
cttgcatgtacttga

SEQ ID NO: 1110897 - DNA, 21 bp, Homo sapiens
cttgcatttttgcaggagcag

SEQ ID NO: 1110898 - DNA, 16 bp, Homo sapiens
cttgccaaaatgttgg

SEQ ID NO: 1110899 - DNA, 22 bp, Homo sapiens
cttgccaaaatgttggctgcgt

SEQ ID NO: 1110900 - DNA, 17 bp, Homo sapiens
cttgccaagaaaatgaa

SEQ ID NO: 1110901 - DNA, 19 bp, Homo sapiens
cttgccaaggcagaggcct

SEQ ID NO: 1110902 - DNA, 20 bp, Homo sapiens
cttgccaagggtccctgtgt

SEQ ID NO: 1110903 - DNA, 12 bp, Homo sapiens
cttgccacactc

SEQ ID NO: 1110904 - DNA, 20 bp, Homo sapiens
cttgccacccattcttcccg

SEQ ID NO: 1110905 - DNA, 16 bp, Homo sapiens
cttgccacccccagtt

SEQ ID NO: 1110906 - DNA, 15 bp, Homo sapiens
cttgccaccctctgg

SEQ ID NO: 1110907 - DNA, 17 bp, Homo sapiens
cttgccaccctctggga

SEQ ID NO: 1110908 - DNA, 19 bp, Homo sapiens
cttgccaccctctgggagt

SEQ ID NO: 1110909 - DNA, 14 bp, Homo sapiens
cttgccactgcctc

SEQ ID NO: 1110910 - DNA, 19 bp, Homo sapiens
cttgccagaaccaaattaa

SEQ ID NO: 1110911 - DNA, 16 bp, Homo sapiens
cttgccagacatgtgg

SEQ ID NO: 1110912 - DNA, 11 bp, Homo sapiens
cttgccagcct

SEQ ID NO: 1110913 - DNA, 16 bp, Homo sapiens
cttgccagcctccttg

SEQ ID NO: 1110914 - DNA, 14 bp, Homo sapiens
cttgccagggcagg

SEQ ID NO: 1110915 - DNA, 19 bp, Homo sapiens
cttgccagggcagggtctg

SEQ ID NO: 1110916 - DNA, 15 bp, Homo sapiens
cttgccatcagtgaa

SEQ ID NO: 1110917 - DNA, 17 bp, Homo sapiens
cttgccatcagtgaaaa

SEQ ID NO: 1110918 - DNA, 18 bp, Homo sapiens
cttgccatccattctgga

SEQ ID NO: 1110919 - DNA, 21 bp, Homo sapiens
cttgccatgcaggaagaggcc

SEQ ID NO: 1110920 - DNA, 17 bp, Homo sapiens
cttgccattgccaggag

SEQ ID NO: 1110921 - DNA, 20 bp, Homo sapiens
cttgcccactggccgctgag

SEQ ID NO: 1110922 - DNA, 19 bp, Homo sapiens
cttgcccagactacagggc

SEQ ID NO: 1110923 - DNA, 23 bp, Homo sapiens
cttgcccagagatgcctccaccg

SEQ ID NO: 1110924 - DNA, 13 bp, Homo sapiens
cttgcccagggct

SEQ ID NO: 1110925 - DNA, 18 bp, Homo sapiens
cttgcccagggctcagcc

SEQ ID NO: 1110926 - DNA, 21 bp, Homo sapiens
cttgcccagggctcagcctgg

SEQ ID NO: 1110927 - DNA, 14 bp, Homo sapiens
cttgcccatcctga

SEQ ID NO: 1110928 - DNA, 16 bp, Homo sapiens
cttgcccatcctgact

SEQ ID NO: 1110929 - DNA, 14 bp, Homo sapiens
cttgccccactcct

SEQ ID NO: 1110930 - DNA, 12 bp, Homo sapiens
cttgccccagga

SEQ ID NO: 1110931 - DNA, 13 bp, Homo sapiens
cttgccccaggac

SEQ ID NO: 1110932 - DNA, 19 bp, Homo sapiens
cttgccccaggactctggc

SEQ ID NO: 1110933 - DNA, 21 bp, Homo sapiens
cttgccccaggactctggcac

SEQ ID NO: 1110934 - DNA, 22 bp, Homo sapiens
cttgccccaggactctggcact

SEQ ID NO: 1110935 - DNA, 12 bp, Homo sapiens
cttgccccaggc

SEQ ID NO: 1110936 - DNA, 16 bp, Homo sapiens
cttgccccatcactgc

SEQ ID NO: 1110937 - DNA, 17 bp, Homo sapiens
cttgccccatcactgcg

SEQ ID NO: 1110938 - DNA, 18 bp, Homo sapiens
cttgcccccatccctcgg

SEQ ID NO: 1110939 - DNA, 20 bp, Homo sapiens
cttgccccccgccctcatgg

SEQ ID NO: 1110940 - DNA, 19 bp, Homo sapiens
cttgccccttgtcctgaag

SEQ ID NO: 1110941 - DNA, 20 bp, Homo sapiens
cttgcccgcacccctccctg

SEQ ID NO: 1110942 - DNA, 19 bp, Homo sapiens
cttgcccgccagcctcagt

SEQ ID NO: 1110943 - DNA, 17 bp, Homo sapiens
cttgcccgctcccacag

SEQ ID NO: 1110944 - DNA, 19 bp, Homo sapiens
cttgcccgctcccacagct

SEQ ID NO: 1110945 - DNA, 16 bp, Homo sapiens
cttgcccgtcggccct

SEQ ID NO: 1110946 - DNA, 18 bp, Homo sapiens
cttgcccgtcgtgtgctg

SEQ ID NO: 1110947 - DNA, 19 bp, Homo sapiens
cttgccctccgcctgggat

SEQ ID NO: 1110948 - DNA, 17 bp, Homo sapiens
cttgccctgacctccca

SEQ ID NO: 1110949 - DNA, 16 bp, Homo sapiens
cttgcccttccctgtc

SEQ ID NO: 1110950 - DNA, 17 bp, Homo sapiens
cttgcccttccctgtcc

SEQ ID NO: 1110951 - DNA, 15 bp, Homo sapiens
cttgcccttgccctg

SEQ ID NO: 1110952 - DNA, 12 bp, Homo sapiens
cttgcccttgga

SEQ ID NO: 1110953 - DNA, 14 bp, Homo sapiens
cttgcccttggagc

SEQ ID NO: 1110954 - DNA, 15 bp, Homo sapiens
cttgcccttggagct

SEQ ID NO: 1110955 - DNA, 18 bp, Homo sapiens
cttgcccttggagctgcc

SEQ ID NO: 1110956 - DNA, 15 bp, Homo sapiens
cttgccgagagaggc

SEQ ID NO: 1110957 - DNA, 23 bp, Homo sapiens
cttgccgagcctaatgaaaggga

SEQ ID NO: 1110958 - DNA, 17 bp, Homo sapiens
cttgccgcgcctggctt

SEQ ID NO: 1110959 - DNA, 18 bp, Homo sapiens
cttgccgcgtcgccctcc

SEQ ID NO: 1110960 - DNA, 17 bp, Homo sapiens
cttgccgctccccttgg

SEQ ID NO: 1110961 - DNA, 22 bp, Homo sapiens
cttgcctaaatttaatgctgcc

SEQ ID NO: 1110962 - DNA, 16 bp, Homo sapiens
cttgcctacttttctt

SEQ ID NO: 1110963 - DNA, 14 bp, Homo sapiens
cttgcctaggccaa

SEQ ID NO: 1110964 - DNA, 14 bp, Homo sapiens
cttgcctcctggaa

SEQ ID NO: 1110965 - DNA, 15 bp, Homo sapiens
cttgcctcctgtgta

SEQ ID NO: 1110966 - DNA, 15 bp, Homo sapiens
cttgcctctgcacac

SEQ ID NO: 1110967 - DNA, 18 bp, Homo sapiens
cttgcctgaacatccttc

SEQ ID NO: 1110968 - DNA, 20 bp, Homo sapiens
cttgcctgaacatccttcct

SEQ ID NO: 1110969 - DNA, 22 bp, Homo sapiens
cttgcctgaacatccttccttc

SEQ ID NO: 1110970 - DNA, 16 bp, Homo sapiens
cttgcctgcctcctag

SEQ ID NO: 1110971 - DNA, 17 bp, Homo sapiens
cttgcctgggctgggca

SEQ ID NO: 1110972 - DNA, 19 bp, Homo sapiens
cttgcctgggctgggcagc

SEQ ID NO: 1110973 - DNA, 17 bp, Homo sapiens
cttgcctggggtctgag

SEQ ID NO: 1110974 - DNA, 18 bp, Homo sapiens
cttgcctggggtctgagc

SEQ ID NO: 1110975 - DNA, 21 bp, Homo sapiens
cttgcctggggtctgagcatg

SEQ ID NO: 1110976 - DNA, 15 bp, Homo sapiens
cttgcctggtacagt

SEQ ID NO: 1110977 - DNA, 17 bp, Homo sapiens
cttgcctgtctaaagcc

SEQ ID NO: 1110978 - DNA, 19 bp, Homo sapiens
cttgcctgtctaaagcctt

SEQ ID NO: 1110979 - DNA, 17 bp, Homo sapiens
cttgcctgtctggctca

SEQ ID NO: 1110980 - DNA, 22 bp, Homo sapiens
cttgcctgtttcccaggcccac

SEQ ID NO: 1110981 - DNA, 23 bp, Homo sapiens
cttgccttaaacactcaccttct

SEQ ID NO: 1110982 - DNA, 20 bp, Homo sapiens
cttgccttattagagtgtct

SEQ ID NO: 1110983 - DNA, 14 bp, Homo sapiens
cttgggagcctgag

SEQ ID NO: 1110984 - DNA, 18 bp, Homo sapiens
cttgggagcctgaggcag

SEQ ID NO: 1110985 - DNA, 22 bp, Homo sapiens
cttgggagcctgaggcaggaga

SEQ ID NO: 1110986 - DNA, 15 bp, Homo sapiens
cttgggaggcttccc

SEQ ID NO: 1110987 - DNA, 19 bp, Homo sapiens
cttgggagtatgttgtcat

SEQ ID NO: 1110988 - DNA, 20 bp, Homo sapiens
cttgggagtatgttgtcata

SEQ ID NO: 1110989 - DNA, 23 bp, Homo sapiens
cttgggagtatgttgtcataaca

SEQ ID NO: 1110990 - DNA, 16 bp, Homo sapiens
cttgggagtcttgggt

SEQ ID NO: 1110991 - DNA, 14 bp, Homo sapiens
cttgggagttttga

SEQ ID NO: 1110992 - DNA, 20 bp, Homo sapiens
cttgggatagtgttctgctc

SEQ ID NO: 1110993 - DNA, 11 bp, Homo sapiens
cttgggcagaa

SEQ ID NO: 1110994 - DNA, 15 bp, Homo sapiens
cttgggcagagctgg

SEQ ID NO: 1110995 - DNA, 19 bp, Homo sapiens
cttgggcagagctggctct

SEQ ID NO: 1110996 - DNA, 22 bp, Homo sapiens
cttgggcagagctggctctgag

SEQ ID NO: 1110997 - DNA, 23 bp, Homo sapiens
cttgggcagagctggctctgagc

SEQ ID NO: 1110998 - DNA, 14 bp, Homo sapiens
cttgggcaggcaga

SEQ ID NO: 1110999 - DNA, 17 bp, Homo sapiens
cttgggcagtgccccag

SEQ ID NO: 1111000 - DNA, 20 bp, Homo sapiens
cttgggcatccacccagtgc

SEQ ID NO: 1111001 - DNA, 20 bp, Homo sapiens
cttgggccaaatccgctctc

SEQ ID NO: 1111002 - DNA, 18 bp, Homo sapiens
cttgggccactgtgaaga

SEQ ID NO: 1111003 - DNA, 14 bp, Homo sapiens
cttgggcccagctg

SEQ ID NO: 1111004 - DNA, 18 bp, Homo sapiens
cttgggcccagctgggct

SEQ ID NO: 1111005 - DNA, 20 bp, Homo sapiens
cttgggcccagctgggctct

SEQ ID NO: 1111006 - DNA, 21 bp, Homo sapiens
cttgggcccagctgggctctg

SEQ ID NO: 1111007 - DNA, 15 bp, Homo sapiens
cttgggcccttccct

SEQ ID NO: 1111008 - DNA, 19 bp, Homo sapiens
cttgggccctttgagtgca

SEQ ID NO: 1111009 - DNA, 21 bp, Homo sapiens
cttgggcgccgtgctgggcag

SEQ ID NO: 1111010 - DNA, 12 bp, Homo sapiens
cttgggcggctg

SEQ ID NO: 1111011 - DNA, 17 bp, Homo sapiens
cttgggctactggcagc

SEQ ID NO: 1111012 - DNA, 18 bp, Homo sapiens
cttgggctcctggctgcc

SEQ ID NO: 1111013 - DNA, 19 bp, Homo sapiens
cttgggctcctggctgcca

SEQ ID NO: 1111014 - DNA, 22 bp, Homo sapiens
cttgggctcctggctgccaggc

SEQ ID NO: 1111015 - DNA, 22 bp, Homo sapiens
cttgggctctctctagctcccc

SEQ ID NO: 1111016 - DNA, 22 bp, Homo sapiens
cttgggctgacccagcatctcc

SEQ ID NO: 1111017 - DNA, 15 bp, Homo sapiens
cttgggctgagtgca

SEQ ID NO: 1111018 - DNA, 18 bp, Homo sapiens
cttgggctgagtgcagcc

SEQ ID NO: 1111019 - DNA, 12 bp, Homo sapiens
cttgggctggga

SEQ ID NO: 1111020 - DNA, 22 bp, Homo sapiens
cttgggctgggacttcttaccc

SEQ ID NO: 1111021 - DNA, 19 bp, Homo sapiens
cttgggcttcttcctcctc

SEQ ID NO: 1111022 - DNA, 19 bp, Homo sapiens
cttggggaatgttgttttc

SEQ ID NO: 1111023 - DNA, 17 bp, Homo sapiens
cttggggaatttcctct

SEQ ID NO: 1111024 - DNA, 15 bp, Homo sapiens
cttggggacatctct

SEQ ID NO: 1111025 - DNA, 23 bp, Homo sapiens
cttggggagagggatttccctgc

SEQ ID NO: 1111026 - DNA, 22 bp, Homo sapiens
cttggggccactttcagagccc

SEQ ID NO: 1111027 - DNA, 17 bp, Homo sapiens
cttggggcctggcttgc

SEQ ID NO: 1111028 - DNA, 23 bp, Homo sapiens
cttggggcctggcttgctccagg

SEQ ID NO: 1111029 - DNA, 18 bp, Homo sapiens
cttggggccttccccctt

SEQ ID NO: 1111030 - DNA, 22 bp, Homo sapiens
cttggggccttcccccttgtgg

SEQ ID NO: 1111031 - DNA, 15 bp, Homo sapiens
cttggggctatttgt

SEQ ID NO: 1111032 - DNA, 14 bp, Homo sapiens
cttggggcttccta

SEQ ID NO: 1111033 - DNA, 21 bp, Homo sapiens
cttgggggaacgatgtgtctg

SEQ ID NO: 1111034 - DNA, 18 bp, Homo sapiens
cttgggggaggccacccc

SEQ ID NO: 1111035 - DNA, 15 bp, Homo sapiens
cttggggggctgagg

SEQ ID NO: 1111036 - DNA, 16 bp, Homo sapiens
cttgggggggctgcct

SEQ ID NO: 1111037 - DNA, 19 bp, Homo sapiens
cttgggggggctgcctttg

SEQ ID NO: 1111038 - DNA, 14 bp, Homo sapiens
cttgggggggtggc

SEQ ID NO: 1111039 - DNA, 18 bp, Homo sapiens
cttgggggggtggccgct

SEQ ID NO: 1111040 - DNA, 19 bp, Homo sapiens
cttgggggggtggccgctg

SEQ ID NO: 1111041 - DNA, 22 bp, Homo sapiens
cttggggggtttttactccagt

SEQ ID NO: 1111042 - DNA, 18 bp, Homo sapiens
cttgggggttcaggcccg

SEQ ID NO: 1111043 - DNA, 18 bp, Homo sapiens
cttgggggttcagggaac

SEQ ID NO: 1111044 - DNA, 23 bp, Homo sapiens
cttgggggttcagggaactgctt

SEQ ID NO: 1111045 - DNA, 21 bp, Homo sapiens
cttggggtactcttgatgtga

SEQ ID NO: 1111046 - DNA, 22 bp, Homo sapiens
cttggggtactcttgatgtgaa

SEQ ID NO: 1111047 - DNA, 15 bp, Homo sapiens
cttggggtcaagaaa

SEQ ID NO: 1111048 - DNA, 18 bp, Homo sapiens
cttggggtcccagggaag

SEQ ID NO: 1111049 - DNA, 12 bp, Homo sapiens
cttggggtgggg

SEQ ID NO: 1111050 - DNA, 16 bp, Homo sapiens
cttggggtgtggggtg

SEQ ID NO: 1111051 - DNA, 21 bp, Homo sapiens
cttggggttcataggggcagg

SEQ ID NO: 1111052 - DNA, 13 bp, Homo sapiens
cttgggtagggca

SEQ ID NO: 1111053 - DNA, 16 bp, Homo sapiens
cttgggtagggcagac

SEQ ID NO: 1111054 - DNA, 17 bp, Homo sapiens
cttgggtagggcagaca

SEQ ID NO: 1111055 - DNA, 14 bp, Homo sapiens
cttgggtctgccct

SEQ ID NO: 1111056 - DNA, 18 bp, Homo sapiens
cttgggtctgccctgccc

SEQ ID NO: 1111057 - DNA, 15 bp, Homo sapiens
cttgggtgaaaggtg

SEQ ID NO: 1111058 - DNA, 20 bp, Homo sapiens
cttgggtggccccctctcct

SEQ ID NO: 1111059 - DNA, 17 bp, Homo sapiens
cttgggtggttcctaag

SEQ ID NO: 1111060 - DNA, 21 bp, Homo sapiens
cttgggtggttcctaagggaa

SEQ ID NO: 1111061 - DNA, 18 bp, Homo sapiens
cttgggtgtattctctgt

SEQ ID NO: 1111062 - DNA, 15 bp, Homo sapiens
cttgggttgatctct

SEQ ID NO: 1111063 - DNA, 16 bp, Homo sapiens
cttgggttgatctctt

SEQ ID NO: 1111064 - DNA, 16 bp, Homo sapiens
cttggtaaaacattac

SEQ ID NO: 1111065 - DNA, 19 bp, Homo sapiens
cttggtaagatgactctga

SEQ ID NO: 1111066 - DNA, 17 bp, Homo sapiens
cttggtaagtgaattta

SEQ ID NO: 1111067 - DNA, 20 bp, Homo sapiens
cttggtagttctgtgcctcc

SEQ ID NO: 1111068 - DNA, 14 bp, Homo sapiens
cttggtcaaacttt

SEQ ID NO: 1111069 - DNA, 13 bp, Homo sapiens
cttggtccctggt

SEQ ID NO: 1111070 - DNA, 22 bp, Homo sapiens
cttggtctgttgcccaggctgg

SEQ ID NO: 1111071 - DNA, 17 bp, Homo sapiens
cttggtgaaataataaa

SEQ ID NO: 1111072 - DNA, 22 bp, Homo sapiens
cttggtgaatttttttttccta

SEQ ID NO: 1111073 - DNA, 17 bp, Homo sapiens
cttggtgacaaaattca

SEQ ID NO: 1111074 - DNA, 22 bp, Homo sapiens
cttggtgagtcttggttctaaa

SEQ ID NO: 1111075 - DNA, 18 bp, Homo sapiens
cttggtgcacagattgct

SEQ ID NO: 1111076 - DNA, 19 bp, Homo sapiens
cttggtgccttttgtgtga

SEQ ID NO: 1111077 - DNA, 15 bp, Homo sapiens
cttggtgctctgtgt

SEQ ID NO: 1111078 - DNA, 16 bp, Homo sapiens
cttggtggagcagcca

SEQ ID NO: 1111079 - DNA, 20 bp, Homo sapiens
cttggtggagcagccagagc

SEQ ID NO: 1111080 - DNA, 21 bp, Homo sapiens
cttggtggagcagccagagct

SEQ ID NO: 1111081 - DNA, 21 bp, Homo sapiens
cttggtggccccgacaggtct

SEQ ID NO: 1111082 - DNA, 19 bp, Homo sapiens
cttggtggctcacgcctgt

SEQ ID NO: 1111083 - DNA, 16 bp, Homo sapiens
cttggtggcttatggg

SEQ ID NO: 1111084 - DNA, 16 bp, Homo sapiens
cttggtggcttttcct

SEQ ID NO: 1111085 - DNA, 19 bp, Homo sapiens
cttggtggcttttccttga

SEQ ID NO: 1111086 - DNA, 16 bp, Homo sapiens
cttggtgtccacctgg

SEQ ID NO: 1111087 - DNA, 21 bp, Homo sapiens
cttggtgtctggtttctgtcc

SEQ ID NO: 1111088 - DNA, 23 bp, Homo sapiens
cttggtgtctggtttctgtcccc

SEQ ID NO: 1111089 - DNA, 19 bp, Homo sapiens
cttggtgtgattgcacaga

SEQ ID NO: 1111090 - DNA, 19 bp, Homo sapiens
cttggtgtttcccttcctc

SEQ ID NO: 1111091 - DNA, 20 bp, Homo sapiens
cttggtgtttcccttcctcg

SEQ ID NO: 1111092 - DNA, 23 bp, Homo sapiens
cttggtgtttcccttcctcggtg

SEQ ID NO: 1111093 - DNA, 17 bp, Homo sapiens
cttggtgttttgggact

SEQ ID NO: 1111094 - DNA, 22 bp, Homo sapiens
cttggttcaataaagcactgag

SEQ ID NO: 1111095 - DNA, 16 bp, Homo sapiens
cttggttcccccactg

SEQ ID NO: 1111096 - DNA, 17 bp, Homo sapiens
cttggttcccttgtgtg

SEQ ID NO: 1111097 - DNA, 14 bp, Homo sapiens
cttggttcctggga

SEQ ID NO: 1111098 - DNA, 16 bp, Homo sapiens
cttggttcctgggatg

SEQ ID NO: 1111099 - DNA, 17 bp, Homo sapiens
cttggttcctgtttgaa

SEQ ID NO: 1111100 - DNA, 18 bp, Homo sapiens
cttggttcctgtttgaaa

SEQ ID NO: 1111101 - DNA, 15 bp, Homo sapiens
cttggttctgcactg

SEQ ID NO: 1111102 - DNA, 14 bp, Homo sapiens
cttggttctggcca

SEQ ID NO: 1111103 - DNA, 13 bp, Homo sapiens
cttggttcttatt

SEQ ID NO: 1111104 - DNA, 17 bp, Homo sapiens
ctttaagatatccatct

SEQ ID NO: 1111105 - DNA, 15 bp, Homo sapiens
ctttaagccaaagaa

SEQ ID NO: 1111106 - DNA, 19 bp, Homo sapiens
ctttaagccaaagaaacaa

SEQ ID NO: 1111107 - DNA, 13 bp, Homo sapiens
ctttaagctcctt

SEQ ID NO: 1111108 - DNA, 11 bp, Homo sapiens
ctttaataaaa

SEQ ID NO: 1111109 - DNA, 15 bp, Homo sapiens
ctttaataaaacaac

SEQ ID NO: 1111110 - DNA, 23 bp, Homo sapiens
ctttaataacaaggagatttctt

SEQ ID NO: 1111111 - DNA, 19 bp, Homo sapiens
ctttaatattttgtaatat

SEQ ID NO: 1111112 - DNA, 15 bp, Homo sapiens
ctttaatgagaaaaa

SEQ ID NO: 1111113 - DNA, 21 bp, Homo sapiens
ctttaatgatatgcttgtaac

SEQ ID NO: 1111114 - DNA, 23 bp, Homo sapiens
ctttaatgcatctagattatgga

SEQ ID NO: 1111115 - DNA, 18 bp, Homo sapiens
ctttaatgctgtctttgt

SEQ ID NO: 1111116 - DNA, 21 bp, Homo sapiens
ctttaatgctgtctttgtgga

SEQ ID NO: 1111117 - DNA, 13 bp, Homo sapiens
ctttaatgttttt

SEQ ID NO: 1111118 - DNA, 21 bp, Homo sapiens
ctttaatgttttttgccacag

SEQ ID NO: 1111119 - DNA, 21 bp, Homo sapiens
ctttaattaattaagtatctg

SEQ ID NO: 1111120 - DNA, 19 bp, Homo sapiens
ctttaattaccaacctgtt

SEQ ID NO: 1111121 - DNA, 14 bp, Homo sapiens
ctttaattatatat

SEQ ID NO: 1111122 - DNA, 14 bp, Homo sapiens
ctttaattgaagaa

SEQ ID NO: 1111123 - DNA, 17 bp, Homo sapiens
ctttaattgaagaactg

SEQ ID NO: 1111124 - DNA, 15 bp, Homo sapiens
ctttaattgtataag

SEQ ID NO: 1111125 - DNA, 19 bp, Homo sapiens
ctttaattgtataagtcaa

SEQ ID NO: 1111126 - DNA, 16 bp, Homo sapiens
ctttaattttaactga

SEQ ID NO: 1111127 - DNA, 23 bp, Homo sapiens
ctttaatttttttaaccaaaggt

SEQ ID NO: 1111128 - DNA, 16 bp, Homo sapiens
ctttacaaaacaaact

SEQ ID NO: 1111129 - DNA, 18 bp, Homo sapiens
ctttacaaaacaaactca

SEQ ID NO: 1111130 - DNA, 13 bp, Homo sapiens
ctttacaaatatt

SEQ ID NO: 1111131 - DNA, 15 bp, Homo sapiens
ctttacaactaaata

SEQ ID NO: 1111132 - DNA, 15 bp, Homo sapiens
ctttacacaagaatc

SEQ ID NO: 1111133 - DNA, 21 bp, Homo sapiens
ctttacacattcggctccctg

SEQ ID NO: 1111134 - DNA, 15 bp, Homo sapiens
ctttacactcaggct

SEQ ID NO: 1111135 - DNA, 23 bp, Homo sapiens
ctttacagttagcagggatgttc

SEQ ID NO: 1111136 - DNA, 17 bp, Homo sapiens
ctttacatattcctttg

SEQ ID NO: 1111137 - DNA, 14 bp, Homo sapiens
ctttacatgcaatt

SEQ ID NO: 1111138 - DNA, 19 bp, Homo sapiens
ctttacatgcaatttatta

SEQ ID NO: 1111139 - DNA, 22 bp, Homo sapiens
ctttacatgctgtgctctttga

SEQ ID NO: 1111140 - DNA, 19 bp, Homo sapiens
ctttacatggtggtgatgt

SEQ ID NO: 1111141 - DNA, 13 bp, Homo sapiens
ctttaccaaaaac

SEQ ID NO: 1111142 - DNA, 18 bp, Homo sapiens
ctttaccaaaaaccatgt

SEQ ID NO: 1111143 - DNA, 23 bp, Homo sapiens
ctttaccaaaaccatccatccct

SEQ ID NO: 1111144 - DNA, 17 bp, Homo sapiens
ctttacccacctagaac

SEQ ID NO: 1111145 - DNA, 22 bp, Homo sapiens
ctttacctatggaagtggttct

SEQ ID NO: 1111146 - DNA, 13 bp, Homo sapiens
ctttacctgagac

SEQ ID NO: 1111147 - DNA, 16 bp, Homo sapiens
ctttacctgagaccag

SEQ ID NO: 1111148 - DNA, 22 bp, Homo sapiens
ctttaccttcctcaggtaacag

SEQ ID NO: 1111149 - DNA, 15 bp, Homo sapiens
ctttaccttctaaaa

SEQ ID NO: 1111150 - DNA, 14 bp, Homo sapiens
ctttaccttttcta

SEQ ID NO: 1111151 - DNA, 17 bp, Homo sapiens
ctttaccttttttatac

SEQ ID NO: 1111152 - DNA, 19 bp, Homo sapiens
ctttaccttttttatacat

SEQ ID NO: 1111153 - DNA, 20 bp, Homo sapiens
ctttaccttttttatacata

SEQ ID NO: 1111154 - DNA, 22 bp, Homo sapiens
ctttacgcccatctcaggacac

SEQ ID NO: 1111155 - DNA, 21 bp, Homo sapiens
ctttacgtactgtaactgctc

SEQ ID NO: 1111156 - DNA, 14 bp, Homo sapiens
ctttactactgtgg

SEQ ID NO: 1111157 - DNA, 16 bp, Homo sapiens
ctttactactgtggaa

SEQ ID NO: 1111158 - DNA, 19 bp, Homo sapiens
ctttactatcattctcagt

SEQ ID NO: 1111159 - DNA, 22 bp, Homo sapiens
ctttactattaaaatattttgg

SEQ ID NO: 1111160 - DNA, 13 bp, Homo sapiens
ctttactcccaag

SEQ ID NO: 1111161 - DNA, 12 bp, Homo sapiens
ctttactccctt

SEQ ID NO: 1111162 - DNA, 17 bp, Homo sapiens
ctttactcccttcctgg

SEQ ID NO: 1111163 - DNA, 21 bp, Homo sapiens
ctttactcccttcctggcctc

SEQ ID NO: 1111164 - DNA, 14 bp, Homo sapiens
ctttactctgggca

SEQ ID NO: 1111165 - DNA, 18 bp, Homo sapiens
ctttactctgtgtttaaa

SEQ ID NO: 1111166 - DNA, 13 bp, Homo sapiens
ctttactgcctga

SEQ ID NO: 1111167 - DNA, 20 bp, Homo sapiens
ctttactgtgcttatttttt

SEQ ID NO: 1111168 - DNA, 15 bp, Homo sapiens
ctttactgtttgtta

SEQ ID NO: 1111169 - DNA, 13 bp, Homo sapiens
ctttacttaaagt

SEQ ID NO: 1111170 - DNA, 15 bp, Homo sapiens
ctttacttgtggtgt

SEQ ID NO: 1111171 - DNA, 14 bp, Homo sapiens
ctttactttaaaat

SEQ ID NO: 1111172 - DNA, 16 bp, Homo sapiens
ctttactttcccttgc

SEQ ID NO: 1111173 - DNA, 17 bp, Homo sapiens
ctttactttcccttgct

SEQ ID NO: 1111174 - DNA, 15 bp, Homo sapiens
ctttacttttgctgt

SEQ ID NO: 1111175 - DNA, 22 bp, Homo sapiens
ctttagaaataaaccttaatat

SEQ ID NO: 1111176 - DNA, 16 bp, Homo sapiens
ctttagaaataaatgt

SEQ ID NO: 1111177 - DNA, 16 bp, Homo sapiens
ctttagaacaggagac

SEQ ID NO: 1111178 - DNA, 18 bp, Homo sapiens
ctttagaatgagagtgtg

SEQ ID NO: 1111179 - DNA, 22 bp, Homo sapiens
ctttagaatgagagtgtgaaat

SEQ ID NO: 1111180 - DNA, 18 bp, Homo sapiens
ctttagaatttttaccca

SEQ ID NO: 1111181 - DNA, 16 bp, Homo sapiens
ctttagacatttttgt

SEQ ID NO: 1111182 - DNA, 19 bp, Homo sapiens
ctttagacatttttgtgcc

SEQ ID NO: 1111183 - DNA, 22 bp, Homo sapiens
ctttagagaagtatacataagt

SEQ ID NO: 1111184 - DNA, 15 bp, Homo sapiens
ctttagatagccctg

SEQ ID NO: 1111185 - DNA, 21 bp, Homo sapiens
ctttagatagccctgtcctgg

SEQ ID NO: 1111186 - DNA, 23 bp, Homo sapiens
ctttagcatttttatgcagacag

SEQ ID NO: 1111187 - DNA, 16 bp, Homo sapiens
ctttagccaaaccctt

SEQ ID NO: 1111188 - DNA, 21 bp, Homo sapiens
ctttaggacataaagagagcc

SEQ ID NO: 1111189 - DNA, 15 bp, Homo sapiens
ctttaggagcagtgg

SEQ ID NO: 1111190 - DNA, 18 bp, Homo sapiens
ctttaggcagcagctttt

SEQ ID NO: 1111191 - DNA, 19 bp, Homo sapiens
ctttaggcagcctgccgcc

SEQ ID NO: 1111192 - DNA, 22 bp, Homo sapiens
ctttaggccatgggtggaaagt

SEQ ID NO: 1111193 - DNA, 14 bp, Homo sapiens
ctttaggctttcaa

SEQ ID NO: 1111194 - DNA, 13 bp, Homo sapiens
ctttagggcagct

SEQ ID NO: 1111195 - DNA, 22 bp, Homo sapiens
ctttagggctgttgctagggag

SEQ ID NO: 1111196 - DNA, 19 bp, Homo sapiens
ctttagggggtgggagggg

SEQ ID NO: 1111197 - DNA, 20 bp, Homo sapiens
ctttagggggtgggaggggg

SEQ ID NO: 1111198 - DNA, 16 bp, Homo sapiens
ctttagggttctgcct

SEQ ID NO: 1111199 - DNA, 14 bp, Homo sapiens
ctttaggtcaaact

SEQ ID NO: 1111200 - DNA, 13 bp, Homo sapiens
ctttagtataatt

SEQ ID NO: 1111201 - DNA, 21 bp, Homo sapiens
ctttagtccacggacccccag

SEQ ID NO: 1111202 - DNA, 18 bp, Homo sapiens
ctttagtgaaacataata

SEQ ID NO: 1111203 - DNA, 22 bp, Homo sapiens
ctttagtgccggctgtggagca

SEQ ID NO: 1111204 - DNA, 16 bp, Homo sapiens
ctttagtgctttgtga

SEQ ID NO: 1111205 - DNA, 13 bp, Homo sapiens
ctttagtgtacat

SEQ ID NO: 1111206 - DNA, 19 bp, Homo sapiens
ctttagtgttctgtttgaa

SEQ ID NO: 1111207 - DNA, 22 bp, Homo sapiens
ctttagttaccgagacatgaat

SEQ ID NO: 1111208 - DNA, 17 bp, Homo sapiens
ctttagttatattcact

SEQ ID NO: 1111209 - DNA, 23 bp, Homo sapiens
ctttagttttgattttggaaaga

SEQ ID NO: 1111210 - DNA, 15 bp, Homo sapiens
ctttataaaatgtat

SEQ ID NO: 1111211 - DNA, 21 bp, Homo sapiens
ctttataaatctttctctcac

SEQ ID NO: 1111212 - DNA, 13 bp, Homo sapiens
ctttataaatgta

SEQ ID NO: 1111213 - DNA, 19 bp, Homo sapiens
ctttatacacttctggctc

SEQ ID NO: 1111214 - DNA, 24 bp, Homo sapiens
ctttatacacttctggctcacagg

SEQ ID NO: 1111215 - DNA, 15 bp, Homo sapiens
ctttatacagatttt

SEQ ID NO: 1111216 - DNA, 20 bp, Homo sapiens
ctttatagaaggaatttgta

SEQ ID NO: 1111217 - DNA, 16 bp, Homo sapiens
ctttatatatggacat

SEQ ID NO: 1111218 - DNA, 18 bp, Homo sapiens
ctttatatcttgtttaca

SEQ ID NO: 1111219 - DNA, 15 bp, Homo sapiens
ctttatatttgctcc

SEQ ID NO: 1111220 - DNA, 21 bp, Homo sapiens
ctttatcaaaaaaagactcag

SEQ ID NO: 1111221 - DNA, 14 bp, Homo sapiens
ctttatcaatgtgt

SEQ ID NO: 1111222 - DNA, 20 bp, Homo sapiens
ctttatcaatgtgtctttct

SEQ ID NO: 1111223 - DNA, 18 bp, Homo sapiens
ctttatcattcctttcca

SEQ ID NO: 1111224 - DNA, 14 bp, Homo sapiens
ctttatctcagcca

SEQ ID NO: 1111225 - DNA, 16 bp, Homo sapiens
ctttctctcctggctc

SEQ ID NO: 1111226 - DNA, 17 bp, Homo sapiens
ctttctctcctttcttt

SEQ ID NO: 1111227 - DNA, 12 bp, Homo sapiens
ctttctctgagg

SEQ ID NO: 1111228 - DNA, 18 bp, Homo sapiens
ctttctctgccagtgaca

SEQ ID NO: 1111229 - DNA, 10 bp, Homo sapiens
ctttctctgg

SEQ ID NO: 1111230 - DNA, 20 bp, Homo sapiens
ctttctctggtggtcttcct

SEQ ID NO: 1111231 - DNA, 21 bp, Homo sapiens
ctttctctggtggtcttcctt

SEQ ID NO: 1111232 - DNA, 9 bp, Homo sapiens
ctttctctt

SEQ ID NO: 1111233 - DNA, 19 bp, Homo sapiens
ctttctcttccttttatat

SEQ ID NO: 1111234 - DNA, 17 bp, Homo sapiens
ctttctctttctctctt

SEQ ID NO: 1111235 - DNA, 14 bp, Homo sapiens
ctttctctttcttc

SEQ ID NO: 1111236 - DNA, 20 bp, Homo sapiens
ctttctcttttcctctacca

SEQ ID NO: 1111237 - DNA, 14 bp, Homo sapiens
ctttctgaaggaag

SEQ ID NO: 1111238 - DNA, 21 bp, Homo sapiens
ctttctgaaggaagagaagac

SEQ ID NO: 1111239 - DNA, 12 bp, Homo sapiens
ctttctgactgt

SEQ ID NO: 1111240 - DNA, 17 bp, Homo sapiens
ctttctgactgtccctg

SEQ ID NO: 1111241 - DNA, 22 bp, Homo sapiens
ctttctgatgacgcctgtctgt

SEQ ID NO: 1111242 - DNA, 16 bp, Homo sapiens
ctttctgcacacaaat

SEQ ID NO: 1111243 - DNA, 15 bp, Homo sapiens
ctttctgcagttttt

SEQ ID NO: 1111244 - DNA, 19 bp, Homo sapiens
ctttctgcagtttttcagg

SEQ ID NO: 1111245 - DNA, 18 bp, Homo sapiens
ctttctgccccccagggc

SEQ ID NO: 1111246 - DNA, 12 bp, Homo sapiens
ctttctgcctgg

SEQ ID NO: 1111247 - DNA, 14 bp, Homo sapiens
ctttctgccttagc

SEQ ID NO: 1111248 - DNA, 19 bp, Homo sapiens
ctttctgctggaagctgtc

SEQ ID NO: 1111249 - DNA, 11 bp, Homo sapiens
ctttctggccc

SEQ ID NO: 1111250 - DNA, 17 bp, Homo sapiens
ctttctggctatgcatt

SEQ ID NO: 1111251 - DNA, 13 bp, Homo sapiens
ctttctgggcttt

SEQ ID NO: 1111252 - DNA, 15 bp, Homo sapiens
ctttctgggctttct

SEQ ID NO: 1111253 - DNA, 22 bp, Homo sapiens
ctttctggggggatatttccta

SEQ ID NO: 1111254 - DNA, 20 bp, Homo sapiens
ctttctgtaaacagaataaa

SEQ ID NO: 1111255 - DNA, 13 bp, Homo sapiens
ctttctgtaaact

SEQ ID NO: 1111256 - DNA, 14 bp, Homo sapiens
ctttctgtagccta

SEQ ID NO: 1111257 - DNA, 18 bp, Homo sapiens
ctttctgtatatactttt

SEQ ID NO: 1111258 - DNA, 19 bp, Homo sapiens
ctttctgtatatacttttt

SEQ ID NO: 1111259 - DNA, 20 bp, Homo sapiens
ctttctgtatatactttttt

SEQ ID NO: 1111260 - DNA, 20 bp, Homo sapiens
ctttctgtgaagctaataca

SEQ ID NO: 1111261 - DNA, 12 bp, Homo sapiens
ctttctgttcca

SEQ ID NO: 1111262 - DNA, 16 bp, Homo sapiens
ctttctgttccaaatt

SEQ ID NO: 1111263 - DNA, 21 bp, Homo sapiens
ctttctgttccttcctccact

SEQ ID NO: 1111264 - DNA, 16 bp, Homo sapiens
ctttctgttgaaaagc

SEQ ID NO: 1111265 - DNA, 13 bp, Homo sapiens
ctttctgttgcca

SEQ ID NO: 1111266 - DNA, 22 bp, Homo sapiens
ctttctgttgccagtcagcaac

SEQ ID NO: 1111267 - DNA, 14 bp, Homo sapiens
ctttctgttgtcat

SEQ ID NO: 1111268 - DNA, 22 bp, Homo sapiens
ctttctgttgtcattgctgttg

SEQ ID NO: 1111269 - DNA, 16 bp, Homo sapiens
ctttcttcaccaagtg

SEQ ID NO: 1111270 - DNA, 22 bp, Homo sapiens
ctttcttcagttcagtagattt

SEQ ID NO: 1111271 - DNA, 15 bp, Homo sapiens
ctttcttccattcct

SEQ ID NO: 1111272 - DNA, 16 bp, Homo sapiens
ctttcttcctctgctg

SEQ ID NO: 1111273 - DNA, 14 bp, Homo sapiens
ctttcttcctgcat

SEQ ID NO: 1111274 - DNA, 12 bp, Homo sapiens
ctttcttccttt

SEQ ID NO: 1111275 - DNA, 13 bp, Homo sapiens
ctttcttctgccc

SEQ ID NO: 1111276 - DNA, 14 bp, Homo sapiens
ctttcttctgccct

SEQ ID NO: 1111277 - DNA, 11 bp, Homo sapiens
ctttcttctgt

SEQ ID NO: 1111278 - DNA, 14 bp, Homo sapiens
ctttcttctgtgtt

SEQ ID NO: 1111279 - DNA, 15 bp, Homo sapiens
ctttcttctttcctt

SEQ ID NO: 1111280 - DNA, 16 bp, Homo sapiens
ctttcttgctggctct

SEQ ID NO: 1111281 - DNA, 21 bp, Homo sapiens
ctttcttgctggctctgagaa

SEQ ID NO: 1111282 - DNA, 11 bp, Homo sapiens
ctttcttggga

SEQ ID NO: 1111283 - DNA, 13 bp, Homo sapiens
ctttcttgggata

SEQ ID NO: 1111284 - DNA, 13 bp, Homo sapiens
ctttcttgtcttt

SEQ ID NO: 1111285 - DNA, 13 bp, Homo sapiens
ctttctttcttaa

SEQ ID NO: 1111286 - DNA, 14 bp, Homo sapiens
ctttctttcttccc

SEQ ID NO: 1111287 - DNA, 23 bp, Homo sapiens
ctttctttgtttctttcttcctc

SEQ ID NO: 1111288 - DNA, 13 bp, Homo sapiens
ctttcttttaagc

SEQ ID NO: 1111289 - DNA, 11 bp, Homo sapiens
ctttcttttct

SEQ ID NO: 1111290 - DNA, 15 bp, Homo sapiens
ctttcttttgtatta

SEQ ID NO: 1111291 - DNA, 21 bp, Homo sapiens
ctttcttttgtattaaaaaaa

SEQ ID NO: 1111292 - DNA, 16 bp, Homo sapiens
ctttctttttctggaa

SEQ ID NO: 1111293 - DNA, 17 bp, Homo sapiens
ctttctttttctggaaa

SEQ ID NO: 1111294 - DNA, 17 bp, Homo sapiens
ctttgaaaacaattcag

SEQ ID NO: 1111295 - DNA, 14 bp, Homo sapiens
ctttgaaaactgaa

SEQ ID NO: 1111296 - DNA, 19 bp, Homo sapiens
ctttgaaaagttggaagga

SEQ ID NO: 1111297 - DNA, 19 bp, Homo sapiens
ctttgaaatagtctgtgtg

SEQ ID NO: 1111298 - DNA, 17 bp, Homo sapiens
ctttgaaatattaaaat

SEQ ID NO: 1111299 - DNA, 22 bp, Homo sapiens
ctttgaaatgtgtttctgtata

SEQ ID NO: 1111300 - DNA, 15 bp, Homo sapiens
ctttgaaattgttta

SEQ ID NO: 1111301 - DNA, 23 bp, Homo sapiens
ctttgaactgaaacttttctaaa

SEQ ID NO: 1111302 - DNA, 24 bp, Homo sapiens
ctttgaactgaaacttttctaaag

SEQ ID NO: 1111303 - DNA, 14 bp, Homo sapiens
ctttgaactttagt

SEQ ID NO: 1111304 - DNA, 22 bp, Homo sapiens
ctttgaagcatagctacaattt

SEQ ID NO: 1111305 - DNA, 23 bp, Homo sapiens
ctttgaagcatagctacaatttg

SEQ ID NO: 1111306 - DNA, 18 bp, Homo sapiens
ctttgaaggggcctcacc

SEQ ID NO: 1111307 - DNA, 21 bp, Homo sapiens
ctttgaagttagctttaactt

SEQ ID NO: 1111308 - DNA, 23 bp, Homo sapiens
ctttgaatatgtagtatctatat

SEQ ID NO: 1111309 - DNA, 13 bp, Homo sapiens
ctttgaatgcttt

SEQ ID NO: 1111310 - DNA, 23 bp, Homo sapiens
ctttgaatgctttttgaatgtta

SEQ ID NO: 1111311 - DNA, 17 bp, Homo sapiens
ctttgaatgttaatttt

SEQ ID NO: 1111312 - DNA, 19 bp, Homo sapiens
ctttgacaaaagtaaatgg

SEQ ID NO: 1111313 - DNA, 17 bp, Homo sapiens
ctttgacaattctgggt

SEQ ID NO: 1111314 - DNA, 18 bp, Homo sapiens
ctttgacaattgggagct

SEQ ID NO: 1111315 - DNA, 21 bp, Homo sapiens
ctttgacaattgggagctgcc

SEQ ID NO: 1111316 - DNA, 23 bp, Homo sapiens
ctttgacaattgggagctgccaa

SEQ ID NO: 1111317 - DNA, 22 bp, Homo sapiens
ctttgacacttttcatatcatt

SEQ ID NO: 1111318 - DNA, 20 bp, Homo sapiens
ctttgaccagatctttctct

SEQ ID NO: 1111319 - DNA, 21 bp, Homo sapiens
ctttgaccagatctttctctt

SEQ ID NO: 1111320 - DNA, 17 bp, Homo sapiens
ctttgacctcaacctgt

SEQ ID NO: 1111321 - DNA, 21 bp, Homo sapiens
ctttgacctcaacctgtgatg

SEQ ID NO: 1111322 - DNA, 21 bp, Homo sapiens
ctttgacctcaatggaggttt

SEQ ID NO: 1111323 - DNA, 17 bp, Homo sapiens
ctttgacctctgcagca

SEQ ID NO: 1111324 - DNA, 14 bp, Homo sapiens
ctttgaccttcccc

SEQ ID NO: 1111325 - DNA, 14 bp, Homo sapiens
ctttgactcacctg

SEQ ID NO: 1111326 - DNA, 22 bp, Homo sapiens
ctttgacttcagctgcctgaaa

SEQ ID NO: 1111327 - DNA, 18 bp, Homo sapiens
ctttgacttcttgcttca

SEQ ID NO: 1111328 - DNA, 17 bp, Homo sapiens
ctttgactttatctcct

SEQ ID NO: 1111329 - DNA, 22 bp, Homo sapiens
ctttgactttatctcctgctct

SEQ ID NO: 1111330 - DNA, 17 bp, Homo sapiens
ctttgactttttgcatt

SEQ ID NO: 1111331 - DNA, 15 bp, Homo sapiens
ctttgagaagccttc

SEQ ID NO: 1111332 - DNA, 17 bp, Homo sapiens
ctttgagaatgtgattc

SEQ ID NO: 1111333 - DNA, 15 bp, Homo sapiens
ctttgagagacgcca

SEQ ID NO: 1111334 - DNA, 22 bp, Homo sapiens
ctttgagagacgccactccctg

SEQ ID NO: 1111335 - DNA, 20 bp, Homo sapiens
ctttgagatgcttctggctc

SEQ ID NO: 1111336 - DNA, 13 bp, Homo sapiens
ctttgagcatttt

SEQ ID NO: 1111337 - DNA, 11 bp, Homo sapiens
ctttgagccca

SEQ ID NO: 1111338 - DNA, 13 bp, Homo sapiens
ctttgagcccatt

SEQ ID NO: 1111339 - DNA, 23 bp, Homo sapiens
ctttgagcccattcttctgggtg

SEQ ID NO: 1111340 - DNA, 19 bp, Homo sapiens
ctttgaggctctgtcactg

SEQ ID NO: 1111341 - DNA, 12 bp, Homo sapiens
ctttgaggtcta

SEQ ID NO: 1111342 - DNA, 16 bp, Homo sapiens
ctttgaggtctaaaca

SEQ ID NO: 1111343 - DNA, 13 bp, Homo sapiens
ctttgagtgatcc

SEQ ID NO: 1111344 - DNA, 16 bp, Homo sapiens
ctttgatccttctgag

SEQ ID NO: 1111345 - DNA, 21 bp, Homo sapiens
ctttgatccttctgagctcca

SEQ ID NO: 1111346 - DNA, 18 bp, Homo sapiens
ctttgatctacttgcctc

SEQ ID NO: 1111347 - DNA, 15 bp, Homo sapiens
ctttgatctctgctt

SEQ ID NO: 1111348 - DNA, 13 bp, Homo sapiens
cttttaaatctct

SEQ ID NO: 1111349 - DNA, 23 bp, Homo sapiens
cttttaaatctctgatatctttg

SEQ ID NO: 1111350 - DNA, 16 bp, Homo sapiens
cttttaaattagaaaa

SEQ ID NO: 1111351 - DNA, 17 bp, Homo sapiens
cttttaaattagaaaat

SEQ ID NO: 1111352 - DNA, 14 bp, Homo sapiens
cttttaacaccttt

SEQ ID NO: 1111353 - DNA, 15 bp, Homo sapiens
cttttaacttctttc

SEQ ID NO: 1111354 - DNA, 20 bp, Homo sapiens
cttttaagatgtgtcttcaa

SEQ ID NO: 1111355 - DNA, 23 bp, Homo sapiens
cttttaagcagacccataccttt

SEQ ID NO: 1111356 - DNA, 12 bp, Homo sapiens
cttttaagcagt

SEQ ID NO: 1111357 - DNA, 18 bp, Homo sapiens
cttttaagcatttgtata

SEQ ID NO: 1111358 - DNA, 14 bp, Homo sapiens
cttttaaggataaa

SEQ ID NO: 1111359 - DNA, 18 bp, Homo sapiens
cttttaaggataaatcat

SEQ ID NO: 1111360 - DNA, 22 bp, Homo sapiens
cttttaataaacttttttttga

SEQ ID NO: 1111361 - DNA, 22 bp, Homo sapiens
cttttaatccaatccactaaca

SEQ ID NO: 1111362 - DNA, 16 bp, Homo sapiens
cttttaatgaacaaat

SEQ ID NO: 1111363 - DNA, 18 bp, Homo sapiens
cttttaatgaacaaatgg

SEQ ID NO: 1111364 - DNA, 23 bp, Homo sapiens
cttttaatgcttcattcaatatt

SEQ ID NO: 1111365 - DNA, 15 bp, Homo sapiens
cttttaatggcattt

SEQ ID NO: 1111366 - DNA, 23 bp, Homo sapiens
cttttaatggcatttctctttaa

SEQ ID NO: 1111367 - DNA, 22 bp, Homo sapiens
cttttaattaaataaaagctgg

SEQ ID NO: 1111368 - DNA, 23 bp, Homo sapiens
cttttacaagtaacaaaaataaa

SEQ ID NO: 1111369 - DNA, 15 bp, Homo sapiens
cttttacagaatgca

SEQ ID NO: 1111370 - DNA, 17 bp, Homo sapiens
cttttacagaatgcatt

SEQ ID NO: 1111371 - DNA, 21 bp, Homo sapiens
cttttacagaatgcattaaaa

SEQ ID NO: 1111372 - DNA, 13 bp, Homo sapiens
cttttacattctg

SEQ ID NO: 1111373 - DNA, 14 bp, Homo sapiens
cttttaccactccc

SEQ ID NO: 1111374 - DNA, 15 bp, Homo sapiens
cttttaccctgtgtc

SEQ ID NO: 1111375 - DNA, 16 bp, Homo sapiens
cttttaccctgtgtca

SEQ ID NO: 1111376 - DNA, 22 bp, Homo sapiens
cttttaccgttggggcccttaa

SEQ ID NO: 1111377 - DNA, 15 bp, Homo sapiens
cttttactctgtgta

SEQ ID NO: 1111378 - DNA, 19 bp, Homo sapiens
cttttagaaatactgcaag

SEQ ID NO: 1111379 - DNA, 21 bp, Homo sapiens
cttttagaaatactgcaagaa

SEQ ID NO: 1111380 - DNA, 17 bp, Homo sapiens
cttttagacaactagat

SEQ ID NO: 1111381 - DNA, 18 bp, Homo sapiens
cttttaggccaaaaaaat

SEQ ID NO: 1111382 - DNA, 22 bp, Homo sapiens
cttttagggtaagaagtttgtg

SEQ ID NO: 1111383 - DNA, 16 bp, Homo sapiens
cttttaggttgttacc

SEQ ID NO: 1111384 - DNA, 15 bp, Homo sapiens
cttttagttcatata

SEQ ID NO: 1111385 - DNA, 21 bp, Homo sapiens
cttttagttgtatctcttttg

SEQ ID NO: 1111386 - DNA, 21 bp, Homo sapiens
cttttagttttagttgcagaa

SEQ ID NO: 1111387 - DNA, 13 bp, Homo sapiens
cttttataaactt

SEQ ID NO: 1111388 - DNA, 16 bp, Homo sapiens
cttttataaactttac

SEQ ID NO: 1111389 - DNA, 18 bp, Homo sapiens
cttttataaactttacct

SEQ ID NO: 1111390 - DNA, 19 bp, Homo sapiens
cttttataaactttacctt

SEQ ID NO: 1111391 - DNA, 14 bp, Homo sapiens
cttttataaatatt

SEQ ID NO: 1111392 - DNA, 15 bp, Homo sapiens
cttttataaattaaa

SEQ ID NO: 1111393 - DNA, 15 bp, Homo sapiens
cttttataaggaaac

SEQ ID NO: 1111394 - DNA, 14 bp, Homo sapiens
cttttataataaaa

SEQ ID NO: 1111395 - DNA, 12 bp, Homo sapiens
cttttataattc

SEQ ID NO: 1111396 - DNA, 18 bp, Homo sapiens
cttttatagctattactg

SEQ ID NO: 1111397 - DNA, 19 bp, Homo sapiens
cttttatagctattactgt

SEQ ID NO: 1111398 - DNA, 22 bp, Homo sapiens
cttttataggtgagaaaaaaac

SEQ ID NO: 1111399 - DNA, 20 bp, Homo sapiens
cttttatatggcccagcctt

SEQ ID NO: 1111400 - DNA, 16 bp, Homo sapiens
cttttatattctaata

SEQ ID NO: 1111401 - DNA, 13 bp, Homo sapiens
cttttatatttgt

SEQ ID NO: 1111402 - DNA, 13 bp, Homo sapiens
cttttatctattt

SEQ ID NO: 1111403 - DNA, 17 bp, Homo sapiens
cttttatctatttgaga

SEQ ID NO: 1111404 - DNA, 13 bp, Homo sapiens
cttttatctcaga

SEQ ID NO: 1111405 - DNA, 15 bp, Homo sapiens
cttttatctgcagaa

SEQ ID NO: 1111406 - DNA, 17 bp, Homo sapiens
cttttatgatgtatatt

SEQ ID NO: 1111407 - DNA, 13 bp, Homo sapiens
cttttatgtagca

SEQ ID NO: 1111408 - DNA, 23 bp, Homo sapiens
cttttattattattattgctgaa

SEQ ID NO: 1111409 - DNA, 16 bp, Homo sapiens
cttttattgtataaac

SEQ ID NO: 1111410 - DNA, 15 bp, Homo sapiens
cttttatttaacaaa

SEQ ID NO: 1111411 - DNA, 16 bp, Homo sapiens
cttttattttcattgt

SEQ ID NO: 1111412 - DNA, 15 bp, Homo sapiens
cttttattttttctt

SEQ ID NO: 1111413 - DNA, 21 bp, Homo sapiens
cttttattttttcttttgtaa

SEQ ID NO: 1111414 - DNA, 18 bp, Homo sapiens
cttttatttttttctaat

SEQ ID NO: 1111415 - DNA, 22 bp, Homo sapiens
cttttcaaatagggtctaactc

SEQ ID NO: 1111416 - DNA, 15 bp, Homo sapiens
cttttcaatgtgatt

SEQ ID NO: 1111417 - DNA, 18 bp, Homo sapiens
cttttcaatttgtcatgt

SEQ ID NO: 1111418 - DNA, 14 bp, Homo sapiens
cttttcacactgtc

SEQ ID NO: 1111419 - DNA, 12 bp, Homo sapiens
cttttcacattt

SEQ ID NO: 1111420 - DNA, 15 bp, Homo sapiens
cttttcacattttta

SEQ ID NO: 1111421 - DNA, 19 bp, Homo sapiens
cttttcacatttttaaaag

SEQ ID NO: 1111422 - DNA, 12 bp, Homo sapiens
cttttcactgct

SEQ ID NO: 1111423 - DNA, 20 bp, Homo sapiens
cttttcactgctggctgcct

SEQ ID NO: 1111424 - DNA, 22 bp, Homo sapiens
cttttcacttcgggctgtgtaa

SEQ ID NO: 1111425 - DNA, 23 bp, Homo sapiens
cttttcagaagatggtgaagaca

SEQ ID NO: 1111426 - DNA, 19 bp, Homo sapiens
cttttcagaagtgagcttt

SEQ ID NO: 1111427 - DNA, 13 bp, Homo sapiens
cttttcagccctt

SEQ ID NO: 1111428 - DNA, 18 bp, Homo sapiens
cttttcaggaagctctct

SEQ ID NO: 1111429 - DNA, 16 bp, Homo sapiens
cttttcagggctggct

SEQ ID NO: 1111430 - DNA, 20 bp, Homo sapiens
cttttcagggctggctcctg

SEQ ID NO: 1111431 - DNA, 14 bp, Homo sapiens
cttttcatatcatt

SEQ ID NO: 1111432 - DNA, 17 bp, Homo sapiens
cttttcatctgggaaag

SEQ ID NO: 1111433 - DNA, 16 bp, Homo sapiens
cttttcatgtacagca

SEQ ID NO: 1111434 - DNA, 18 bp, Homo sapiens
cttttcattagcagttgc

SEQ ID NO: 1111435 - DNA, 15 bp, Homo sapiens
cttttcattccctgt

SEQ ID NO: 1111436 - DNA, 16 bp, Homo sapiens
cttttccaagcccttt

SEQ ID NO: 1111437 - DNA, 17 bp, Homo sapiens
cttttccactccaagat

SEQ ID NO: 1111438 - DNA, 18 bp, Homo sapiens
cttttccactcctatgga

SEQ ID NO: 1111439 - DNA, 17 bp, Homo sapiens
cttttccagtctgtaca

SEQ ID NO: 1111440 - DNA, 18 bp, Homo sapiens
cttttcccaaaatgttga

SEQ ID NO: 1111441 - DNA, 20 bp, Homo sapiens
cttttcccaccttcaccttt

SEQ ID NO: 1111442 - DNA, 18 bp, Homo sapiens
cttttcccactgtttaag

SEQ ID NO: 1111443 - DNA, 19 bp, Homo sapiens
cttttcccccattaatcag

SEQ ID NO: 1111444 - DNA, 19 bp, Homo sapiens
cttttcccctacagaattt

SEQ ID NO: 1111445 - DNA, 14 bp, Homo sapiens
cttttcccctgtcc

SEQ ID NO: 1111446 - DNA, 21 bp, Homo sapiens
cttttcccctgttaaacagta

SEQ ID NO: 1111447 - DNA, 21 bp, Homo sapiens
cttttcccctttcctgtccca

SEQ ID NO: 1111448 - DNA, 22 bp, Homo sapiens
cttttcccctttcctgtcccac

SEQ ID NO: 1111449 - DNA, 12 bp, Homo sapiens
cttttccctctt

SEQ ID NO: 1111450 - DNA, 22 bp, Homo sapiens
cttttccctctttggctcccct

SEQ ID NO: 1111451 - DNA, 15 bp, Homo sapiens
cttttccctgcttcc

SEQ ID NO: 1111452 - DNA, 20 bp, Homo sapiens
cttttcctattttcagccca

SEQ ID NO: 1111453 - DNA, 20 bp, Homo sapiens
cttttcctcaagcaataatt

SEQ ID NO: 1111454 - DNA, 15 bp, Homo sapiens
cttttcctctctgtc

SEQ ID NO: 1111455 - DNA, 21 bp, Homo sapiens
cttttcctggacttaaagaaa

SEQ ID NO: 1111456 - DNA, 16 bp, Homo sapiens
cttttcctggcagctg

SEQ ID NO: 1111457 - DNA, 21 bp, Homo sapiens
cttttcctggcagctgctgtg

SEQ ID NO: 1111458 - DNA, 19 bp, Homo sapiens
cttttcctgggaatggaat

SEQ ID NO: 1111459 - DNA, 14 bp, Homo sapiens
cttttctaaagtgc

SEQ ID NO: 1111460 - DNA, 20 bp, Homo sapiens
cttttctaaccaagaggctg

SEQ ID NO: 1111461 - DNA, 21 bp, Homo sapiens
cttttctaaccaagaggctgg

SEQ ID NO: 1111462 - DNA, 19 bp, Homo sapiens
cttttctaagtggcgtgtg

SEQ ID NO: 1111463 - DNA, 21 bp, Homo sapiens
cttttctaagtggcgtgtgca

SEQ ID NO: 1111464 - DNA, 21 bp, Homo sapiens
cttttctaatcacagtgttgc

SEQ ID NO: 1111465 - DNA, 17 bp, Homo sapiens
cttttctagagacacat

SEQ ID NO: 1111466 - DNA, 21 bp, Homo sapiens
cttttctataagttgtaccaa

SEQ ID NO: 1111467 - DNA, 23 bp, Homo sapiens
cttttctataagttgtaccaaaa

SEQ ID NO: 1111468 - DNA, 22 bp, Homo sapiens
cttttctatgttgctattgtaa

SEQ ID NO: 1111469 - DNA, 16 bp, Homo sapiens
gaaaagaaaaaacaac

SEQ ID NO: 1111470 - DNA, 23 bp, Homo sapiens
gaaaagaaaaatgagcctggcaa

SEQ ID NO: 1111471 - DNA, 21 bp, Homo sapiens
gaaaagaaaacatttaacata

SEQ ID NO: 1111472 - DNA, 21 bp, Homo sapiens
gaaaagaaaatttttgtagta

SEQ ID NO: 1111473 - DNA, 15 bp, Homo sapiens
gaaaagaaggaaaga

SEQ ID NO: 1111474 - DNA, 19 bp, Homo sapiens
gaaaagaatacagaaagat

SEQ ID NO: 1111475 - DNA, 14 bp, Homo sapiens
gaaaagaatagaag

SEQ ID NO: 1111476 - DNA, 21 bp, Homo sapiens
gaaaagaatccctgcagcctg

SEQ ID NO: 1111477 - DNA, 11 bp, Homo sapiens
gaaaagaattt

SEQ ID NO: 1111478 - DNA, 15 bp, Homo sapiens
gaaaagaccagggct

SEQ ID NO: 1111479 - DNA, 18 bp, Homo sapiens
gaaaagacctacagacta

SEQ ID NO: 1111480 - DNA, 16 bp, Homo sapiens
gaaaagacggatggca

SEQ ID NO: 1111481 - DNA, 18 bp, Homo sapiens
gaaaagacggatggcagg

SEQ ID NO: 1111482 - DNA, 21 bp, Homo sapiens
gaaaagactcctcctgggggc

SEQ ID NO: 1111483 - DNA, 22 bp, Homo sapiens
gaaaagagacttctctgtaagt

SEQ ID NO: 1111484 - DNA, 13 bp, Homo sapiens
gaaaagataaaga

SEQ ID NO: 1111485 - DNA, 19 bp, Homo sapiens
gaaaagataaagaccagaa

SEQ ID NO: 1111486 - DNA, 22 bp, Homo sapiens
gaaaagatacgactttattttc

SEQ ID NO: 1111487 - DNA, 19 bp, Homo sapiens
gaaaagatgtagatttatt

SEQ ID NO: 1111488 - DNA, 17 bp, Homo sapiens
gaaaagattttaatcaa

SEQ ID NO: 1111489 - DNA, 16 bp, Homo sapiens
gaaaagcacctgccga

SEQ ID NO: 1111490 - DNA, 15 bp, Homo sapiens
gaaaagcagacattt

SEQ ID NO: 1111491 - DNA, 17 bp, Homo sapiens
gaaaagcagctctcccc

SEQ ID NO: 1111492 - DNA, 15 bp, Homo sapiens
gaaaagcccacaggc

SEQ ID NO: 1111493 - DNA, 22 bp, Homo sapiens
gaaaagctagtgtacctcctct

SEQ ID NO: 1111494 - DNA, 21 bp, Homo sapiens
gaaaagctgccatttcccttc

SEQ ID NO: 1111495 - DNA, 19 bp, Homo sapiens
gaaaaggatattatctacc

SEQ ID NO: 1111496 - DNA, 14 bp, Homo sapiens
gaaaaggatctaag

SEQ ID NO: 1111497 - DNA, 19 bp, Homo sapiens
gaaaaggatctaagggaag

SEQ ID NO: 1111498 - DNA, 19 bp, Homo sapiens
gaaaaggcaaaagactggt

SEQ ID NO: 1111499 - DNA, 21 bp, Homo sapiens
gaaaaggcaaaagactggttt

SEQ ID NO: 1111500 - DNA, 13 bp, Homo sapiens
gaaaagggaaaaa

SEQ ID NO: 1111501 - DNA, 14 bp, Homo sapiens
gaaaagggaaaaaa

SEQ ID NO: 1111502 - DNA, 15 bp, Homo sapiens
gaaaagggaaaaaag

SEQ ID NO: 1111503 - DNA, 19 bp, Homo sapiens
gaaaagggaagttgtgcct

SEQ ID NO: 1111504 - DNA, 18 bp, Homo sapiens
gaaaagggaatcattttt

SEQ ID NO: 1111505 - DNA, 14 bp, Homo sapiens
gaaaagggagaaaa

SEQ ID NO: 1111506 - DNA, 16 bp, Homo sapiens
gaaaagggagaaaaag

SEQ ID NO: 1111507 - DNA, 17 bp, Homo sapiens
gaaaagggcactcccaa

SEQ ID NO: 1111508 - DNA, 22 bp, Homo sapiens
gaaaagggcactcccaaccctg

SEQ ID NO: 1111509 - DNA, 16 bp, Homo sapiens
gaaaaggggagagaag

SEQ ID NO: 1111510 - DNA, 19 bp, Homo sapiens
gaaaaggttgaataatata

SEQ ID NO: 1111511 - DNA, 15 bp, Homo sapiens
gaaaaggttgttgtt

SEQ ID NO: 1111512 - DNA, 14 bp, Homo sapiens
gaaaagtaatgaag

SEQ ID NO: 1111513 - DNA, 13 bp, Homo sapiens
gaaaagtatgttc

SEQ ID NO: 1111514 - DNA, 16 bp, Homo sapiens
gaaaagtattctcaaa

SEQ ID NO: 1111515 - DNA, 13 bp, Homo sapiens
gaaaagtcaaact

SEQ ID NO: 1111516 - DNA, 14 bp, Homo sapiens
gaaaagtcaaactg

SEQ ID NO: 1111517 - DNA, 12 bp, Homo sapiens
gaaaagtgaagg

SEQ ID NO: 1111518 - DNA, 19 bp, Homo sapiens
gaaaagtgaatcttgctgt

SEQ ID NO: 1111519 - DNA, 19 bp, Homo sapiens
gaaaagtgcatatttatcc

SEQ ID NO: 1111520 - DNA, 11 bp, Homo sapiens
gaaaagtgcct

SEQ ID NO: 1111521 - DNA, 21 bp, Homo sapiens
gaaaagtgcctgagctgggga

SEQ ID NO: 1111522 - DNA, 15 bp, Homo sapiens
gaaaagtgggctgca

SEQ ID NO: 1111523 - DNA, 16 bp, Homo sapiens
gaaaagttcagggacc

SEQ ID NO: 1111524 - DNA, 20 bp, Homo sapiens
gaaaagttgcagatgtattg

SEQ ID NO: 1111525 - DNA, 18 bp, Homo sapiens
gaaaagttgctcttaaaa

SEQ ID NO: 1111526 - DNA, 14 bp, Homo sapiens
gaaaagttgtctta

SEQ ID NO: 1111527 - DNA, 14 bp, Homo sapiens
gaaaagtttataaa

SEQ ID NO: 1111528 - DNA, 18 bp, Homo sapiens
gaaaataaaaaaaagaaa

SEQ ID NO: 1111529 - DNA, 19 bp, Homo sapiens
gaaaataaaaaaaagaaaa

SEQ ID NO: 1111530 - DNA, 14 bp, Homo sapiens
gaaaataaaacaca

SEQ ID NO: 1111531 - DNA, 15 bp, Homo sapiens
gaaaataaaactaag

SEQ ID NO: 1111532 - DNA, 21 bp, Homo sapiens
gaaaataaatcttagtgttca

SEQ ID NO: 1111533 - DNA, 14 bp, Homo sapiens
gaaaataaatttaa

SEQ ID NO: 1111534 - DNA, 13 bp, Homo sapiens
gaaaataactgaa

SEQ ID NO: 1111535 - DNA, 18 bp, Homo sapiens
gaaaataactgaatttgg

SEQ ID NO: 1111536 - DNA, 17 bp, Homo sapiens
gaaaataattgttccaa

SEQ ID NO: 1111537 - DNA, 13 bp, Homo sapiens
gaaaatacaataa

SEQ ID NO: 1111538 - DNA, 14 bp, Homo sapiens
gaaaatacaataaa

SEQ ID NO: 1111539 - DNA, 15 bp, Homo sapiens
gaaaataccagtgtt

SEQ ID NO: 1111540 - DNA, 21 bp, Homo sapiens
gaaaatacctattttatatga

SEQ ID NO: 1111541 - DNA, 17 bp, Homo sapiens
gaaaatacgctcaggtg

SEQ ID NO: 1111542 - DNA, 17 bp, Homo sapiens
gaaaataggcaggaagc

SEQ ID NO: 1111543 - DNA, 19 bp, Homo sapiens
gaaaataggcaggaagccc

SEQ ID NO: 1111544 - DNA, 20 bp, Homo sapiens
gaaaatagtgtaagaactgt

SEQ ID NO: 1111545 - DNA, 16 bp, Homo sapiens
gaaaatagttcccttt

SEQ ID NO: 1111546 - DNA, 21 bp, Homo sapiens
gaaaatataaggactttttga

SEQ ID NO: 1111547 - DNA, 15 bp, Homo sapiens
gaaaatatatgtatt

SEQ ID NO: 1111548 - DNA, 20 bp, Homo sapiens
gaaaatatatgtatttttat

SEQ ID NO: 1111549 - DNA, 22 bp, Homo sapiens
gaaaatattgttttacaatagt

SEQ ID NO: 1111550 - DNA, 16 bp, Homo sapiens
gaaaatatttctatgt

SEQ ID NO: 1111551 - DNA, 17 bp, Homo sapiens
gaaaatattttgtctaa

SEQ ID NO: 1111552 - DNA, 19 bp, Homo sapiens
gaaaatattttgtctaaaa

SEQ ID NO: 1111553 - DNA, 21 bp, Homo sapiens
gaaaatattttgtctaaaatg

SEQ ID NO: 1111554 - DNA, 18 bp, Homo sapiens
gaaaatattttttatata

SEQ ID NO: 1111555 - DNA, 18 bp, Homo sapiens
gaaaatcactttgtctaa

SEQ ID NO: 1111556 - DNA, 16 bp, Homo sapiens
gaaaatcatcaagaag

SEQ ID NO: 1111557 - DNA, 16 bp, Homo sapiens
gaaaatccaggtcatg

SEQ ID NO: 1111558 - DNA, 13 bp, Homo sapiens
gaaaatcctctgg

SEQ ID NO: 1111559 - DNA, 15 bp, Homo sapiens
gaaaatcctctggct

SEQ ID NO: 1111560 - DNA, 22 bp, Homo sapiens
gaaaatccttttaaccatttta

SEQ ID NO: 1111561 - DNA, 21 bp, Homo sapiens
gaaaatctaatattaaaaata

SEQ ID NO: 1111562 - DNA, 21 bp, Homo sapiens
gaaaatctatatttgtcttcc

SEQ ID NO: 1111563 - DNA, 22 bp, Homo sapiens
gaaaatctatatttgtcttccg

SEQ ID NO: 1111564 - DNA, 23 bp, Homo sapiens
gaaaatctatatttgtcttccga

SEQ ID NO: 1111565 - DNA, 19 bp, Homo sapiens
gaaaatctttataaatgta

SEQ ID NO: 1111566 - DNA, 17 bp, Homo sapiens
gaaaatgaaatgcatat

SEQ ID NO: 1111567 - DNA, 20 bp, Homo sapiens
gaaaatgaatatctattaat

SEQ ID NO: 1111568 - DNA, 12 bp, Homo sapiens
gaaaatgaattt

SEQ ID NO: 1111569 - DNA, 23 bp, Homo sapiens
gaaaatgaattttgtatgctgaa

SEQ ID NO: 1111570 - DNA, 16 bp, Homo sapiens
gaaaatgaattttttc

SEQ ID NO: 1111571 - DNA, 14 bp, Homo sapiens
gaaaatgacttatt

SEQ ID NO: 1111572 - DNA, 18 bp, Homo sapiens
gaaaatgacttatttctg

SEQ ID NO: 1111573 - DNA, 23 bp, Homo sapiens
gaaaatgactttatttttctaag

SEQ ID NO: 1111574 - DNA, 22 bp, Homo sapiens
gaaaatgagccctggctcccac

SEQ ID NO: 1111575 - DNA, 19 bp, Homo sapiens
gaaaatgagtatttggtcc

SEQ ID NO: 1111576 - DNA, 20 bp, Homo sapiens
gaaaatgagtatttggtcca

SEQ ID NO: 1111577 - DNA, 16 bp, Homo sapiens
gaaaatgatctgagtc

SEQ ID NO: 1111578 - DNA, 23 bp, Homo sapiens
gaaaatgatgtgtacccaaacgt

SEQ ID NO: 1111579 - DNA, 13 bp, Homo sapiens
gaaaatgcatttt

SEQ ID NO: 1111580 - DNA, 15 bp, Homo sapiens
gaaaatgctggctga

SEQ ID NO: 1111581 - DNA, 19 bp, Homo sapiens
gaaaatggaagtggcaata

SEQ ID NO: 1111582 - DNA, 22 bp, Homo sapiens
gaaaatggaattgcttctgtgt

SEQ ID NO: 1111583 - DNA, 18 bp, Homo sapiens
gaaaatggccatgcagga

SEQ ID NO: 1111584 - DNA, 17 bp, Homo sapiens
gaaaatggctaataaac

SEQ ID NO: 1111585 - DNA, 23 bp, Homo sapiens
gaaaatggctaataaactgtatt

SEQ ID NO: 1111586 - DNA, 23 bp, Homo sapiens
gaaaatggctttctcagccaggc

SEQ ID NO: 1111587 - DNA, 11 bp, Homo sapiens
gaaaatgtaaa

SEQ ID NO: 1111588 - DNA, 13 bp, Homo sapiens
gaaaatgtaaatt

SEQ ID NO: 1111589 - DNA, 15 bp, Homo sapiens
gaaaatgtatccaag

SEQ ID NO: 1111590 - DNA, 18 bp, Homo sapiens
gaaaatgtatttcctgaa

SEQ ID NO: 1111591 - DNA, 21 bp, Homo sapiens
gaaatatagggttttttttaa

SEQ ID NO: 1111592 - DNA, 15 bp, Homo sapiens
gaaatatagtgcaat

SEQ ID NO: 1111593 - DNA, 16 bp, Homo sapiens
gaaatatagtgcaata

SEQ ID NO: 1111594 - DNA, 11 bp, Homo sapiens
gaaatatataa

SEQ ID NO: 1111595 - DNA, 23 bp, Homo sapiens
gaaatatatatgtgtgtgtatgt

SEQ ID NO: 1111596 - DNA, 13 bp, Homo sapiens
gaaatatatttgt

SEQ ID NO: 1111597 - DNA, 15 bp, Homo sapiens
gaaatatatttgtaa

SEQ ID NO: 1111598 - DNA, 23 bp, Homo sapiens
gaaatatcagttactcagccctg

SEQ ID NO: 1111599 - DNA, 15 bp, Homo sapiens
gaaatatcatcacgt

SEQ ID NO: 1111600 - DNA, 14 bp, Homo sapiens
gaaatatcatgtta

SEQ ID NO: 1111601 - DNA, 13 bp, Homo sapiens
gaaatatcattta

SEQ ID NO: 1111602 - DNA, 18 bp, Homo sapiens
gaaatatctgtgaaatat

SEQ ID NO: 1111603 - DNA, 19 bp, Homo sapiens
gaaatatgaaattccagca

SEQ ID NO: 1111604 - DNA, 15 bp, Homo sapiens
gaaatatgattttat

SEQ ID NO: 1111605 - DNA, 18 bp, Homo sapiens
gaaatatgcacaatagca

SEQ ID NO: 1111606 - DNA, 12 bp, Homo sapiens
gaaatatgcata

SEQ ID NO: 1111607 - DNA, 16 bp, Homo sapiens
gaaatattcagaaatt

SEQ ID NO: 1111608 - DNA, 18 bp, Homo sapiens
gaaatattgctgtatagc

SEQ ID NO: 1111609 - DNA, 19 bp, Homo sapiens
gaaatatttaagtatatag

SEQ ID NO: 1111610 - DNA, 19 bp, Homo sapiens
gaaatatttagcaaataat

SEQ ID NO: 1111611 - DNA, 20 bp, Homo sapiens
gaaatattttaaaatcagct

SEQ ID NO: 1111612 - DNA, 21 bp, Homo sapiens
gaaatattttttaatttaaag

SEQ ID NO: 1111613 - DNA, 14 bp, Homo sapiens
gaaatcaacttgtg

SEQ ID NO: 1111614 - DNA, 16 bp, Homo sapiens
gaaatcaatgcaagag

SEQ ID NO: 1111615 - DNA, 17 bp, Homo sapiens
gaaatcacaggggcggg

SEQ ID NO: 1111616 - DNA, 19 bp, Homo sapiens
gaaatcacaggggcggggc

SEQ ID NO: 1111617 - DNA, 22 bp, Homo sapiens
gaaatcacaggggcggggcagg

SEQ ID NO: 1111618 - DNA, 15 bp, Homo sapiens
gaaatcactgtgaaa

SEQ ID NO: 1111619 - DNA, 19 bp, Homo sapiens
gaaatcagcccccagcctt

SEQ ID NO: 1111620 - DNA, 21 bp, Homo sapiens
gaaatcaggtgttttaagact

SEQ ID NO: 1111621 - DNA, 20 bp, Homo sapiens
gaaatcagtaatatttatat

SEQ ID NO: 1111622 - DNA, 18 bp, Homo sapiens
gaaatccaaatttctcat

SEQ ID NO: 1111623 - DNA, 20 bp, Homo sapiens
gaaatccatatatatgaaat

SEQ ID NO: 1111624 - DNA, 16 bp, Homo sapiens
gaaatccattgtttaa

SEQ ID NO: 1111625 - DNA, 18 bp, Homo sapiens
gaaatccattgtttaaag

SEQ ID NO: 1111626 - DNA, 19 bp, Homo sapiens
gaaatccattgtttaaaga

SEQ ID NO: 1111627 - DNA, 21 bp, Homo sapiens
gaaatccattgtttaaagatg

SEQ ID NO: 1111628 - DNA, 22 bp, Homo sapiens
gaaatccccccttcagaacaga

SEQ ID NO: 1111629 - DNA, 23 bp, Homo sapiens
gaaatccctgtttaatatttaaa

SEQ ID NO: 1111630 - DNA, 17 bp, Homo sapiens
gaaatccggagaagctg

SEQ ID NO: 1111631 - DNA, 21 bp, Homo sapiens
gaaatcctagtttcctctcct

SEQ ID NO: 1111632 - DNA, 18 bp, Homo sapiens
gaaatcgagagtgtgctc

SEQ ID NO: 1111633 - DNA, 16 bp, Homo sapiens
gaaatcgttggaaaat

SEQ ID NO: 1111634 - DNA, 18 bp, Homo sapiens
gaaatctaggaaaattat

SEQ ID NO: 1111635 - DNA, 21 bp, Homo sapiens
gaaatctagttatttacagga

SEQ ID NO: 1111636 - DNA, 21 bp, Homo sapiens
gaaatctcagatacttatgaa

SEQ ID NO: 1111637 - DNA, 20 bp, Homo sapiens
gaaatctcctttagccatca

SEQ ID NO: 1111638 - DNA, 20 bp, Homo sapiens
gaaatctgtcaagagtagtt

SEQ ID NO: 1111639 - DNA, 15 bp, Homo sapiens
gaaatctttctttct

SEQ ID NO: 1111640 - DNA, 19 bp, Homo sapiens
gaaatgaaaacatgtaata

SEQ ID NO: 1111641 - DNA, 13 bp, Homo sapiens
gaaatgaaagaaa

SEQ ID NO: 1111642 - DNA, 22 bp, Homo sapiens
gaaatgaacaaaagattggagc

SEQ ID NO: 1111643 - DNA, 14 bp, Homo sapiens
gaaatgaataattt

SEQ ID NO: 1111644 - DNA, 19 bp, Homo sapiens
gaaatgaataatttcccaa

SEQ ID NO: 1111645 - DNA, 21 bp, Homo sapiens
gaaatgaggtctgtttaaagt

SEQ ID NO: 1111646 - DNA, 20 bp, Homo sapiens
gaaatgattcaaattgctgc

SEQ ID NO: 1111647 - DNA, 23 bp, Homo sapiens
gaaatgattcaaattgctgcttg

SEQ ID NO: 1111648 - DNA, 14 bp, Homo sapiens
gaaatgcaaaaatc

SEQ ID NO: 1111649 - DNA, 11 bp, Homo sapiens
gaaatgcagaa

SEQ ID NO: 1111650 - DNA, 19 bp, Homo sapiens
gaaatgcattttattcttt

SEQ ID NO: 1111651 - DNA, 18 bp, Homo sapiens
gaaatgcccccattctcc

SEQ ID NO: 1111652 - DNA, 20 bp, Homo sapiens
gaaatgctattgttgtgggc

SEQ ID NO: 1111653 - DNA, 14 bp, Homo sapiens
gaaatgctgcctgc

SEQ ID NO: 1111654 - DNA, 15 bp, Homo sapiens
gaaatgctgcctgcc

SEQ ID NO: 1111655 - DNA, 16 bp, Homo sapiens
gaaatgctgcctgcct

SEQ ID NO: 1111656 - DNA, 16 bp, Homo sapiens
gaaatgctgctggcca

SEQ ID NO: 1111657 - DNA, 19 bp, Homo sapiens
gaaatgctgggctgacggt

SEQ ID NO: 1111658 - DNA, 19 bp, Homo sapiens
gaaatgcttttatattcta

SEQ ID NO: 1111659 - DNA, 21 bp, Homo sapiens
gaaatggaggatctctaaaga

SEQ ID NO: 1111660 - DNA, 18 bp, Homo sapiens
gaaatggcgtctgctctg

SEQ ID NO: 1111661 - DNA, 22 bp, Homo sapiens
gaaatggcgtctgctctggtgg

SEQ ID NO: 1111662 - DNA, 17 bp, Homo sapiens
gaaatggctatgaacag

SEQ ID NO: 1111663 - DNA, 19 bp, Homo sapiens
gaaatgggacttaactcct

SEQ ID NO: 1111664 - DNA, 18 bp, Homo sapiens
gaaatgggcagttctccc

SEQ ID NO: 1111665 - DNA, 20 bp, Homo sapiens
gaaatgggcagttctcccag

SEQ ID NO: 1111666 - DNA, 21 bp, Homo sapiens
gaaatgggcatttattttata

SEQ ID NO: 1111667 - DNA, 16 bp, Homo sapiens
gaaatggtatgagctg

SEQ ID NO: 1111668 - DNA, 17 bp, Homo sapiens
gaaatggtatgagctga

SEQ ID NO: 1111669 - DNA, 15 bp, Homo sapiens
gaaatggtggaactg

SEQ ID NO: 1111670 - DNA, 21 bp, Homo sapiens
gaaatggtttcacttgctctt

SEQ ID NO: 1111671 - DNA, 23 bp, Homo sapiens
gaaatggtttcacttgctctttg

SEQ ID NO: 1111672 - DNA, 14 bp, Homo sapiens
gaaatgtaacatga

SEQ ID NO: 1111673 - DNA, 16 bp, Homo sapiens
gaaatgtacactacca

SEQ ID NO: 1111674 - DNA, 16 bp, Homo sapiens
gaaatgtaccttcttt

SEQ ID NO: 1111675 - DNA, 14 bp, Homo sapiens
gaaatgtagcactt

SEQ ID NO: 1111676 - DNA, 16 bp, Homo sapiens
gaaatgtatcctgata

SEQ ID NO: 1111677 - DNA, 13 bp, Homo sapiens
gaaatgtcaattt

SEQ ID NO: 1111678 - DNA, 14 bp, Homo sapiens
gaaatgtcctgcat

SEQ ID NO: 1111679 - DNA, 19 bp, Homo sapiens
gaaatgtcgatcaagagaa

SEQ ID NO: 1111680 - DNA, 15 bp, Homo sapiens
gaaatgtctctgctc

SEQ ID NO: 1111681 - DNA, 14 bp, Homo sapiens
gaaatgtctgctgg

SEQ ID NO: 1111682 - DNA, 13 bp, Homo sapiens
gaaatgtgagaaa

SEQ ID NO: 1111683 - DNA, 13 bp, Homo sapiens
gaaatgtgtttct

SEQ ID NO: 1111684 - DNA, 16 bp, Homo sapiens
gaaatgtgtttctgta

SEQ ID NO: 1111685 - DNA, 21 bp, Homo sapiens
gaaatgttaaaggttcacagg

SEQ ID NO: 1111686 - DNA, 20 bp, Homo sapiens
gaaatgttagtgccccgcac

SEQ ID NO: 1111687 - DNA, 22 bp, Homo sapiens
gaaatgttattttttaattatt

SEQ ID NO: 1111688 - DNA, 22 bp, Homo sapiens
gaaatgttctcatgaactaccc

SEQ ID NO: 1111689 - DNA, 20 bp, Homo sapiens
gaaatgttgagggcaagcca

SEQ ID NO: 1111690 - DNA, 14 bp, Homo sapiens
gaaatgttttgtaa

SEQ ID NO: 1111691 - DNA, 20 bp, Homo sapiens
gaaatgttttgtaaacattt

SEQ ID NO: 1111692 - DNA, 14 bp, Homo sapiens
gaaatgtttttaac

SEQ ID NO: 1111693 - DNA, 12 bp, Homo sapiens
gaaattaaaata

SEQ ID NO: 1111694 - DNA, 18 bp, Homo sapiens
gaaattaaagaaatgaaa

SEQ ID NO: 1111695 - DNA, 13 bp, Homo sapiens
gaaattaagaaga

SEQ ID NO: 1111696 - DNA, 20 bp, Homo sapiens
gaaattaatttgtgaatttg

SEQ ID NO: 1111697 - DNA, 21 bp, Homo sapiens
gaaattaatttgtgaatttgc

SEQ ID NO: 1111698 - DNA, 17 bp, Homo sapiens
gaaattacacccaaaga

SEQ ID NO: 1111699 - DNA, 19 bp, Homo sapiens
gaaattacctgtggatatt

SEQ ID NO: 1111700 - DNA, 23 bp, Homo sapiens
gaaattactgcccacttgtcaag

SEQ ID NO: 1111701 - DNA, 14 bp, Homo sapiens
gaaattactgtgta

SEQ ID NO: 1111702 - DNA, 19 bp, Homo sapiens
gaaattagctgtgtgaaat

SEQ ID NO: 1111703 - DNA, 13 bp, Homo sapiens
gaaattagggccc

SEQ ID NO: 1111704 - DNA, 19 bp, Homo sapiens
gaaattaggggttaaagca

SEQ ID NO: 1111705 - DNA, 18 bp, Homo sapiens
gaaattaggttgaaacat

SEQ ID NO: 1111706 - DNA, 13 bp, Homo sapiens
gaaattagtcttt

SEQ ID NO: 1111707 - DNA, 12 bp, Homo sapiens
gaaattatatat

SEQ ID NO: 1111708 - DNA, 21 bp, Homo sapiens
gaaattatgtatgtttacata

SEQ ID NO: 1111709 - DNA, 20 bp, Homo sapiens
gaaattattggttggtgtga

SEQ ID NO: 1111710 - DNA, 15 bp, Homo sapiens
gaaattatttaataa

SEQ ID NO: 1111711 - DNA, 13 bp, Homo sapiens
gaaattcaaaatg

SEQ ID NO: 1111712 - DNA, 18 bp, Homo sapiens
gaacgagcactggccaga

SEQ ID NO: 1111713 - DNA, 13 bp, Homo sapiens
gaacgcaccccac

SEQ ID NO: 1111714 - DNA, 15 bp, Homo sapiens
gaacgcagaagaaag

SEQ ID NO: 1111715 - DNA, 16 bp, Homo sapiens
gaacgcagaagaaagg

SEQ ID NO: 1111716 - DNA, 15 bp, Homo sapiens
gaacgccagtctccc

SEQ ID NO: 1111717 - DNA, 22 bp, Homo sapiens
gaacgccagtctcccaggcccc

SEQ ID NO: 1111718 - DNA, 17 bp, Homo sapiens
gaacgctgtgatgctgt

SEQ ID NO: 1111719 - DNA, 21 bp, Homo sapiens
gaacgctgtgatgctgtgtgc

SEQ ID NO: 1111720 - DNA, 22 bp, Homo sapiens
gaacgctgtgatgctgtgtgcc

SEQ ID NO: 1111721 - DNA, 12 bp, Homo sapiens
gaacgggcagcc

SEQ ID NO: 1111722 - DNA, 13 bp, Homo sapiens
gaacgggcagcca

SEQ ID NO: 1111723 - DNA, 14 bp, Homo sapiens
gaacgggcagccac

SEQ ID NO: 1111724 - DNA, 20 bp, Homo sapiens
gaacgggcagccacaggact

SEQ ID NO: 1111725 - DNA, 21 bp, Homo sapiens
gaacgggcagccacaggactg

SEQ ID NO: 1111726 - DNA, 18 bp, Homo sapiens
gaacggtgaaggtgacag

SEQ ID NO: 1111727 - DNA, 13 bp, Homo sapiens
gaacgtgcatcct

SEQ ID NO: 1111728 - DNA, 17 bp, Homo sapiens
gaacgtggctctgctgg

SEQ ID NO: 1111729 - DNA, 23 bp, Homo sapiens
gaacgtgggagttcagctgcttc

SEQ ID NO: 1111730 - DNA, 13 bp, Homo sapiens
gaacgtggtttgc

SEQ ID NO: 1111731 - DNA, 22 bp, Homo sapiens
gaacgtgtgtccaggctctggg

SEQ ID NO: 1111732 - DNA, 20 bp, Homo sapiens
gaacgttttcttctttccct

SEQ ID NO: 1111733 - DNA, 15 bp, Homo sapiens
gaactaaatttttca

SEQ ID NO: 1111734 - DNA, 19 bp, Homo sapiens
gaactaagttttgtgtgta

SEQ ID NO: 1111735 - DNA, 21 bp, Homo sapiens
gaactaagttttgtgtgtata

SEQ ID NO: 1111736 - DNA, 22 bp, Homo sapiens
gaactaagttttgtgtgtatat

SEQ ID NO: 1111737 - DNA, 15 bp, Homo sapiens
gaactaataaaagca

SEQ ID NO: 1111738 - DNA, 16 bp, Homo sapiens
gaactaataaatacat

SEQ ID NO: 1111739 - DNA, 17 bp, Homo sapiens
gaactaataaatacata

SEQ ID NO: 1111740 - DNA, 15 bp, Homo sapiens
gaactaatttatact

SEQ ID NO: 1111741 - DNA, 22 bp, Homo sapiens
gaactaccccacaacacgccta

SEQ ID NO: 1111742 - DNA, 24 bp, Homo sapiens
gaactacgtgacctctgcaagaca

SEQ ID NO: 1111743 - DNA, 12 bp, Homo sapiens
gaactactgtac

SEQ ID NO: 1111744 - DNA, 21 bp, Homo sapiens
gaactactttgaaaacaattc

SEQ ID NO: 1111745 - DNA, 18 bp, Homo sapiens
gaactagccaaaccagga

SEQ ID NO: 1111746 - DNA, 17 bp, Homo sapiens
gaactaggctgagcaat

SEQ ID NO: 1111747 - DNA, 21 bp, Homo sapiens
gaactagtctacttcttaaaa

SEQ ID NO: 1111748 - DNA, 15 bp, Homo sapiens
gaactatgaactaca

SEQ ID NO: 1111749 - DNA, 20 bp, Homo sapiens
gaactattccccagcagggt

SEQ ID NO: 1111750 - DNA, 19 bp, Homo sapiens
gaactattctgggggcccg

SEQ ID NO: 1111751 - DNA, 20 bp, Homo sapiens
gaactattgtgctcagagac

SEQ ID NO: 1111752 - DNA, 16 bp, Homo sapiens
gaactcaactttgaca

SEQ ID NO: 1111753 - DNA, 13 bp, Homo sapiens
gaactcactctgg

SEQ ID NO: 1111754 - DNA, 14 bp, Homo sapiens
gaactcactctggg

SEQ ID NO: 1111755 - DNA, 18 bp, Homo sapiens
gaactcactctgggctgt

SEQ ID NO: 1111756 - DNA, 16 bp, Homo sapiens
gaactcagaccacttg

SEQ ID NO: 1111757 - DNA, 19 bp, Homo sapiens
gaactcagcacattcggga

SEQ ID NO: 1111758 - DNA, 12 bp, Homo sapiens
gaactccactct

SEQ ID NO: 1111759 - DNA, 23 bp, Homo sapiens
gaactccaggccctcctctccca

SEQ ID NO: 1111760 - DNA, 18 bp, Homo sapiens
gaactccaggctttctgg

SEQ ID NO: 1111761 - DNA, 19 bp, Homo sapiens
gaactccatacagcctcta

SEQ ID NO: 1111762 - DNA, 17 bp, Homo sapiens
gaactcccagcaacaca

SEQ ID NO: 1111763 - DNA, 13 bp, Homo sapiens
gaactcctgccag

SEQ ID NO: 1111764 - DNA, 14 bp, Homo sapiens
gaactcctggcttt

SEQ ID NO: 1111765 - DNA, 17 bp, Homo sapiens
gaactccttattttgta

SEQ ID NO: 1111766 - DNA, 20 bp, Homo sapiens
gaactccttattttgtatta

SEQ ID NO: 1111767 - DNA, 23 bp, Homo sapiens
gaactcgcagggaatgcagcagg

SEQ ID NO: 1111768 - DNA, 17 bp, Homo sapiens
gaactctactcaaccca

SEQ ID NO: 1111769 - DNA, 16 bp, Homo sapiens
gaactctctgtcttct

SEQ ID NO: 1111770 - DNA, 20 bp, Homo sapiens
gaactctctgtcttctctcc

SEQ ID NO: 1111771 - DNA, 21 bp, Homo sapiens
gaactctctgtcttctctcca

SEQ ID NO: 1111772 - DNA, 16 bp, Homo sapiens
gaactctggcttccag

SEQ ID NO: 1111773 - DNA, 13 bp, Homo sapiens
gaactctggcttt

SEQ ID NO: 1111774 - DNA, 18 bp, Homo sapiens
gaactctgggctgccatg

SEQ ID NO: 1111775 - DNA, 18 bp, Homo sapiens
gaactctggtggcacagg

SEQ ID NO: 1111776 - DNA, 19 bp, Homo sapiens
gaactctggtggcacagga

SEQ ID NO: 1111777 - DNA, 13 bp, Homo sapiens
gaactctgttccc

SEQ ID NO: 1111778 - DNA, 16 bp, Homo sapiens
gaactctgttccccca

SEQ ID NO: 1111779 - DNA, 19 bp, Homo sapiens
gaactctgttcccccaccc

SEQ ID NO: 1111780 - DNA, 22 bp, Homo sapiens
gaactcttaggcacatcaatta

SEQ ID NO: 1111781 - DNA, 17 bp, Homo sapiens
gaactgaaacttttcta

SEQ ID NO: 1111782 - DNA, 23 bp, Homo sapiens
gaactgaacaccattgaaggctt

SEQ ID NO: 1111783 - DNA, 23 bp, Homo sapiens
gaactgaagccacttggcccaga

SEQ ID NO: 1111784 - DNA, 23 bp, Homo sapiens
gaactgaagtttccgcccccgcc

SEQ ID NO: 1111785 - DNA, 16 bp, Homo sapiens
gaactgacaaaggagc

SEQ ID NO: 1111786 - DNA, 22 bp, Homo sapiens
gaactgacaaaggagccttgat

SEQ ID NO: 1111787 - DNA, 22 bp, Homo sapiens
gaactgagaaggcaggcctccg

SEQ ID NO: 1111788 - DNA, 19 bp, Homo sapiens
gaactgagctcctctgggc

SEQ ID NO: 1111789 - DNA, 22 bp, Homo sapiens
gaactgaggagatgaccaggga

SEQ ID NO: 1111790 - DNA, 17 bp, Homo sapiens
gaactgaggccctgtga

SEQ ID NO: 1111791 - DNA, 15 bp, Homo sapiens
gaactgcaaagcttt

SEQ ID NO: 1111792 - DNA, 23 bp, Homo sapiens
gaactgcaaagctttggctgaga

SEQ ID NO: 1111793 - DNA, 16 bp, Homo sapiens
gaactgcagacctcac

SEQ ID NO: 1111794 - DNA, 17 bp, Homo sapiens
gaactgcagatagccca

SEQ ID NO: 1111795 - DNA, 18 bp, Homo sapiens
gaactgcagatagcccag

SEQ ID NO: 1111796 - DNA, 23 bp, Homo sapiens
gaactgcagatagcccaggagca

SEQ ID NO: 1111797 - DNA, 19 bp, Homo sapiens
gaactgcaggccctggcct

SEQ ID NO: 1111798 - DNA, 13 bp, Homo sapiens
gaactgcccccac

SEQ ID NO: 1111799 - DNA, 15 bp, Homo sapiens
gaactgcccccactg

SEQ ID NO: 1111800 - DNA, 17 bp, Homo sapiens
gaactgcctctttcctg

SEQ ID NO: 1111801 - DNA, 13 bp, Homo sapiens
gaactgcctgggc

SEQ ID NO: 1111802 - DNA, 14 bp, Homo sapiens
gaactgcctgggcc

SEQ ID NO: 1111803 - DNA, 17 bp, Homo sapiens
gaactgctctactttga

SEQ ID NO: 1111804 - DNA, 13 bp, Homo sapiens
gaactgcttcatg

SEQ ID NO: 1111805 - DNA, 18 bp, Homo sapiens
gaactgcttcatgtgaac

SEQ ID NO: 1111806 - DNA, 16 bp, Homo sapiens
gaactgcttgcccagg

SEQ ID NO: 1111807 - DNA, 14 bp, Homo sapiens
gaactgctttcaag

SEQ ID NO: 1111808 - DNA, 15 bp, Homo sapiens
gaactggacacaata

SEQ ID NO: 1111809 - DNA, 18 bp, Homo sapiens
gaactggcaattgtctat

SEQ ID NO: 1111810 - DNA, 15 bp, Homo sapiens
gaactggctgggccc

SEQ ID NO: 1111811 - DNA, 19 bp, Homo sapiens
gaactggctgggcccctgg

SEQ ID NO: 1111812 - DNA, 11 bp, Homo sapiens
gaactgggcac

SEQ ID NO: 1111813 - DNA, 17 bp, Homo sapiens
gaactgggctgggcctc

SEQ ID NO: 1111814 - DNA, 18 bp, Homo sapiens
gaactgggttctttggaa

SEQ ID NO: 1111815 - DNA, 22 bp, Homo sapiens
gaactgggttctttggaagcag

SEQ ID NO: 1111816 - DNA, 15 bp, Homo sapiens
gaactgtacattgtg

SEQ ID NO: 1111817 - DNA, 19 bp, Homo sapiens
gaactgtattctagtggct

SEQ ID NO: 1111818 - DNA, 13 bp, Homo sapiens
gaactgtccagag

SEQ ID NO: 1111819 - DNA, 16 bp, Homo sapiens
gaactgtccagagagc

SEQ ID NO: 1111820 - DNA, 22 bp, Homo sapiens
gaactgtccagagagcaactct

SEQ ID NO: 1111821 - DNA, 17 bp, Homo sapiens
gaactgtctgtgaacag

SEQ ID NO: 1111822 - DNA, 14 bp, Homo sapiens
gaactgtgccacaa

SEQ ID NO: 1111823 - DNA, 18 bp, Homo sapiens
gaactgtggtgccacatg

SEQ ID NO: 1111824 - DNA, 14 bp, Homo sapiens
gaactgttagatgc

SEQ ID NO: 1111825 - DNA, 15 bp, Homo sapiens
gaactgttagatgct

SEQ ID NO: 1111826 - DNA, 20 bp, Homo sapiens
gaactgttcacactgcagag

SEQ ID NO: 1111827 - DNA, 23 bp, Homo sapiens
gaactgttcacactgcagagact

SEQ ID NO: 1111828 - DNA, 19 bp, Homo sapiens
gaacttaagtctcgaatgt

SEQ ID NO: 1111829 - DNA, 20 bp, Homo sapiens
gaacttactgtagcctcaga

SEQ ID NO: 1111830 - DNA, 13 bp, Homo sapiens
gaacttatgtaca

SEQ ID NO: 1111831 - DNA, 22 bp, Homo sapiens
gaacttcaagaagtaagagcta

SEQ ID NO: 1111832 - DNA, 15 bp, Homo sapiens
gaacttcatgggcct

SEQ ID NO: 1111833 - DNA, 16 bp, Homo sapiens
gaagcatgtaggagaa

SEQ ID NO: 1111834 - DNA, 17 bp, Homo sapiens
gaagcattaacttctct

SEQ ID NO: 1111835 - DNA, 16 bp, Homo sapiens
gaagcattcagagagc

SEQ ID NO: 1111836 - DNA, 13 bp, Homo sapiens
gaagcattgtaaa

SEQ ID NO: 1111837 - DNA, 17 bp, Homo sapiens
gaagcattgtaaaataa

SEQ ID NO: 1111838 - DNA, 20 bp, Homo sapiens
gaagcattgtaaaataattc

SEQ ID NO: 1111839 - DNA, 19 bp, Homo sapiens
gaagcatttcaaagccctg

SEQ ID NO: 1111840 - DNA, 21 bp, Homo sapiens
gaagcatttcaaagccctgcc

SEQ ID NO: 1111841 - DNA, 13 bp, Homo sapiens
gaagcatttgttt

SEQ ID NO: 1111842 - DNA, 22 bp, Homo sapiens
gaagccaaagttttcaaactgc

SEQ ID NO: 1111843 - DNA, 22 bp, Homo sapiens
gaagccaagctccctggagccc

SEQ ID NO: 1111844 - DNA, 14 bp, Homo sapiens
gaagccaagggaaa

SEQ ID NO: 1111845 - DNA, 16 bp, Homo sapiens
gaagccaagggaaagg

SEQ ID NO: 1111846 - DNA, 19 bp, Homo sapiens
gaagccaagggaaaggggt

SEQ ID NO: 1111847 - DNA, 23 bp, Homo sapiens
gaagccaagtggggtgctgggag

SEQ ID NO: 1111848 - DNA, 17 bp, Homo sapiens
gaagccacctcaccaag

SEQ ID NO: 1111849 - DNA, 15 bp, Homo sapiens
gaagccacgctgtcc

SEQ ID NO: 1111850 - DNA, 13 bp, Homo sapiens
gaagccacttggc

SEQ ID NO: 1111851 - DNA, 18 bp, Homo sapiens
gaagccacttggcccaga

SEQ ID NO: 1111852 - DNA, 17 bp, Homo sapiens
gaagccaggtacaggag

SEQ ID NO: 1111853 - DNA, 22 bp, Homo sapiens
gaagccaggtacaggagaggca

SEQ ID NO: 1111854 - DNA, 16 bp, Homo sapiens
gaagccagtggagctg

SEQ ID NO: 1111855 - DNA, 20 bp, Homo sapiens
gaagccagtggagctggtct

SEQ ID NO: 1111856 - DNA, 17 bp, Homo sapiens
gaagccatagggggctg

SEQ ID NO: 1111857 - DNA, 23 bp, Homo sapiens
gaagccatatatgaccagaagcc

SEQ ID NO: 1111858 - DNA, 15 bp, Homo sapiens
gaagccatctttctt

SEQ ID NO: 1111859 - DNA, 23 bp, Homo sapiens
gaagccatgagttccagaaagta

SEQ ID NO: 1111860 - DNA, 22 bp, Homo sapiens
gaagccatgtggggttgctgaa

SEQ ID NO: 1111861 - DNA, 15 bp, Homo sapiens
gaagcccaagtgaaa

SEQ ID NO: 1111862 - DNA, 16 bp, Homo sapiens
gaagcccaagtgaaat

SEQ ID NO: 1111863 - DNA, 14 bp, Homo sapiens
gaagcccaataaac

SEQ ID NO: 1111864 - DNA, 19 bp, Homo sapiens
gaagcccaataaacctctt

SEQ ID NO: 1111865 - DNA, 19 bp, Homo sapiens
gaagcccagcccctactgc

SEQ ID NO: 1111866 - DNA, 19 bp, Homo sapiens
gaagcccatgtcttctgct

SEQ ID NO: 1111867 - DNA, 21 bp, Homo sapiens
gaagcccatgtcttctgctgt

SEQ ID NO: 1111868 - DNA, 20 bp, Homo sapiens
gaagcccccaccgtgggcag

SEQ ID NO: 1111869 - DNA, 16 bp, Homo sapiens
gaagccccgacacacg

SEQ ID NO: 1111870 - DNA, 14 bp, Homo sapiens
gaagcccctgggcc

SEQ ID NO: 1111871 - DNA, 21 bp, Homo sapiens
gaagcccctgtcgcccaccca

SEQ ID NO: 1111872 - DNA, 15 bp, Homo sapiens
gaagccccttggaga

SEQ ID NO: 1111873 - DNA, 18 bp, Homo sapiens
gaagccccttggagagag

SEQ ID NO: 1111874 - DNA, 11 bp, Homo sapiens
gaagccctcct

SEQ ID NO: 1111875 - DNA, 16 bp, Homo sapiens
gaagccctccttccac

SEQ ID NO: 1111876 - DNA, 13 bp, Homo sapiens
gaagccctggaga

SEQ ID NO: 1111877 - DNA, 19 bp, Homo sapiens
gaagccctggatttcagaa

SEQ ID NO: 1111878 - DNA, 13 bp, Homo sapiens
gaagccgactctg

SEQ ID NO: 1111879 - DNA, 21 bp, Homo sapiens
gaagccgactctggccctggc

SEQ ID NO: 1111880 - DNA, 22 bp, Homo sapiens
gaagccgactctggccctggcc

SEQ ID NO: 1111881 - DNA, 15 bp, Homo sapiens
gaagccggcggccca

SEQ ID NO: 1111882 - DNA, 20 bp, Homo sapiens
gaagccggcggcccaagccc

SEQ ID NO: 1111883 - DNA, 16 bp, Homo sapiens
gaagccgggaacagac

SEQ ID NO: 1111884 - DNA, 21 bp, Homo sapiens
gaagccggggtgtaacttcct

SEQ ID NO: 1111885 - DNA, 23 bp, Homo sapiens
gaagccggtgcctgggtggccat

SEQ ID NO: 1111886 - DNA, 17 bp, Homo sapiens
gaagccggtgtccctgg

SEQ ID NO: 1111887 - DNA, 18 bp, Homo sapiens
gaagccggtgtccctgga

SEQ ID NO: 1111888 - DNA, 23 bp, Homo sapiens
gaagccgtctgactccagagtct

SEQ ID NO: 1111889 - DNA, 14 bp, Homo sapiens
gaagcctccgtgga

SEQ ID NO: 1111890 - DNA, 15 bp, Homo sapiens
gaagcctctgccctg

SEQ ID NO: 1111891 - DNA, 21 bp, Homo sapiens
gaagcctctgccctgcctccc

SEQ ID NO: 1111892 - DNA, 12 bp, Homo sapiens
gaagcctctggc

SEQ ID NO: 1111893 - DNA, 14 bp, Homo sapiens
gaagcctctggcta

SEQ ID NO: 1111894 - DNA, 12 bp, Homo sapiens
gaagcctgaggc

SEQ ID NO: 1111895 - DNA, 15 bp, Homo sapiens
gaagcctgcaggagt

SEQ ID NO: 1111896 - DNA, 19 bp, Homo sapiens
gaagcctggactctgcccc

SEQ ID NO: 1111897 - DNA, 15 bp, Homo sapiens
gaagcctgtgccagc

SEQ ID NO: 1111898 - DNA, 20 bp, Homo sapiens
gaagcctgttttgttggaag

SEQ ID NO: 1111899 - DNA, 15 bp, Homo sapiens
gaagccttaagccat

SEQ ID NO: 1111900 - DNA, 19 bp, Homo sapiens
gaagccttaatttgcacag

SEQ ID NO: 1111901 - DNA, 20 bp, Homo sapiens
gaagccttaatttgcacagt

SEQ ID NO: 1111902 - DNA, 17 bp, Homo sapiens
gaagccttcagctccag

SEQ ID NO: 1111903 - DNA, 15 bp, Homo sapiens
gaagccttcttctgc

SEQ ID NO: 1111904 - DNA, 14 bp, Homo sapiens
gaagccttgctcat

SEQ ID NO: 1111905 - DNA, 20 bp, Homo sapiens
gaagccttggaaccagcccc

SEQ ID NO: 1111906 - DNA, 19 bp, Homo sapiens
gaagcctttggtgaattcc

SEQ ID NO: 1111907 - DNA, 16 bp, Homo sapiens
gaagcgactctcctgt

SEQ ID NO: 1111908 - DNA, 16 bp, Homo sapiens
gaagcgagcactgacc

SEQ ID NO: 1111909 - DNA, 17 bp, Homo sapiens
gaagcgcagcagcggga

SEQ ID NO: 1111910 - DNA, 17 bp, Homo sapiens
gaagcgccaggctggag

SEQ ID NO: 1111911 - DNA, 22 bp, Homo sapiens
gaagcgccgactccctgagtct

SEQ ID NO: 1111912 - DNA, 14 bp, Homo sapiens
gaagcggatttcca

SEQ ID NO: 1111913 - DNA, 17 bp, Homo sapiens
gaagcgtcgccccagtg

SEQ ID NO: 1111914 - DNA, 14 bp, Homo sapiens
gaagctaagctgca

SEQ ID NO: 1111915 - DNA, 20 bp, Homo sapiens
gaagctaataaaattcgctt

SEQ ID NO: 1111916 - DNA, 16 bp, Homo sapiens
gaagctaatgtcacaa

SEQ ID NO: 1111917 - DNA, 17 bp, Homo sapiens
gaagctaatttgcatta

SEQ ID NO: 1111918 - DNA, 21 bp, Homo sapiens
gaagctacccctcaaactgca

SEQ ID NO: 1111919 - DNA, 15 bp, Homo sapiens
gaagctactgtgtgt

SEQ ID NO: 1111920 - DNA, 18 bp, Homo sapiens
gaagctagacacatgaag

SEQ ID NO: 1111921 - DNA, 23 bp, Homo sapiens
gaagctagacacatgaaggtaaa

SEQ ID NO: 1111922 - DNA, 21 bp, Homo sapiens
gaagctatattagctgaaaca

SEQ ID NO: 1111923 - DNA, 12 bp, Homo sapiens
gaagctattttt

SEQ ID NO: 1111924 - DNA, 23 bp, Homo sapiens
gaagctatttttttaagctatca

SEQ ID NO: 1111925 - DNA, 20 bp, Homo sapiens
gaagctatttttttcagttt

SEQ ID NO: 1111926 - DNA, 19 bp, Homo sapiens
gaagctcacactgatgggc

SEQ ID NO: 1111927 - DNA, 19 bp, Homo sapiens
gaagctcagcccacccccc

SEQ ID NO: 1111928 - DNA, 13 bp, Homo sapiens
gaagctccactgt

SEQ ID NO: 1111929 - DNA, 14 bp, Homo sapiens
gaagctccactgtc

SEQ ID NO: 1111930 - DNA, 15 bp, Homo sapiens
gaagctccactgtca

SEQ ID NO: 1111931 - DNA, 14 bp, Homo sapiens
gaagctcccaggaa

SEQ ID NO: 1111932 - DNA, 15 bp, Homo sapiens
gaagctcccaggaac

SEQ ID NO: 1111933 - DNA, 15 bp, Homo sapiens
gaagctctgaagtca

SEQ ID NO: 1111934 - DNA, 23 bp, Homo sapiens
gaagctgaagtgcatccaaaggt

SEQ ID NO: 1111935 - DNA, 14 bp, Homo sapiens
gaagctgagctttt

SEQ ID NO: 1111936 - DNA, 21 bp, Homo sapiens
gaagctgatgctttgcttcaa

SEQ ID NO: 1111937 - DNA, 21 bp, Homo sapiens
gaagctgccacccctcttctg

SEQ ID NO: 1111938 - DNA, 14 bp, Homo sapiens
gaagctgctccagg

SEQ ID NO: 1111939 - DNA, 20 bp, Homo sapiens
gaagctgctccaggcctgca

SEQ ID NO: 1111940 - DNA, 10 bp, Homo sapiens
gaagctgctg

SEQ ID NO: 1111941 - DNA, 14 bp, Homo sapiens
gaagctgctgacca

SEQ ID NO: 1111942 - DNA, 16 bp, Homo sapiens
gaagctgctgaggccc

SEQ ID NO: 1111943 - DNA, 16 bp, Homo sapiens
gaagctgctgtgtcct

SEQ ID NO: 1111944 - DNA, 16 bp, Homo sapiens
gaagctggaagcctgc

SEQ ID NO: 1111945 - DNA, 13 bp, Homo sapiens
gaagctggagcag

SEQ ID NO: 1111946 - DNA, 19 bp, Homo sapiens
gaagctggagtgctgcttg

SEQ ID NO: 1111947 - DNA, 23 bp, Homo sapiens
gaagctgggcccaaaggcccagg

SEQ ID NO: 1111948 - DNA, 17 bp, Homo sapiens
gaagctgggctgtctct

SEQ ID NO: 1111949 - DNA, 21 bp, Homo sapiens
gaagctgtactcagagcagag

SEQ ID NO: 1111950 - DNA, 14 bp, Homo sapiens
gaagctgtcaggct

SEQ ID NO: 1111951 - DNA, 12 bp, Homo sapiens
gaagctgtgtcc

SEQ ID NO: 1111952 - DNA, 17 bp, Homo sapiens
gaagctgtgtccttgca

SEQ ID NO: 1111953 - DNA, 22 bp, Homo sapiens
gaagctgtgtccttgcacctgc

SEQ ID NO: 1111954 - DNA, 18 bp, Homo sapiens
gaagctgtttggaaaaga

SEQ ID NO: 1111955 - DNA, 22 bp, Homo sapiens
gaataggcagggggccctgccc

SEQ ID NO: 1111956 - DNA, 20 bp, Homo sapiens
gaataggcattaacacaaag

SEQ ID NO: 1111957 - DNA, 18 bp, Homo sapiens
gaatagggagacagggta

SEQ ID NO: 1111958 - DNA, 15 bp, Homo sapiens
gaataggtagtatca

SEQ ID NO: 1111959 - DNA, 22 bp, Homo sapiens
gaatagtgctgcaataaacata

SEQ ID NO: 1111960 - DNA, 15 bp, Homo sapiens
gaatagtggacatgg

SEQ ID NO: 1111961 - DNA, 14 bp, Homo sapiens
gaatagtgtcacca

SEQ ID NO: 1111962 - DNA, 16 bp, Homo sapiens
gaatagttgagcccca

SEQ ID NO: 1111963 - DNA, 22 bp, Homo sapiens
gaatataaaaactcctgggctt

SEQ ID NO: 1111964 - DNA, 19 bp, Homo sapiens
gaatataaatagctgaaaa

SEQ ID NO: 1111965 - DNA, 15 bp, Homo sapiens
gaatataacatgtaa

SEQ ID NO: 1111966 - DNA, 13 bp, Homo sapiens
gaatataattatc

SEQ ID NO: 1111967 - DNA, 19 bp, Homo sapiens
gaatataattgttttatct

SEQ ID NO: 1111968 - DNA, 18 bp, Homo sapiens
gaatataccttatttatt

SEQ ID NO: 1111969 - DNA, 14 bp, Homo sapiens
gaatatagttctgt

SEQ ID NO: 1111970 - DNA, 14 bp, Homo sapiens
gaatatataaacac

SEQ ID NO: 1111971 - DNA, 16 bp, Homo sapiens
gaatatatgcttttgg

SEQ ID NO: 1111972 - DNA, 15 bp, Homo sapiens
gaatatatggcagag

SEQ ID NO: 1111973 - DNA, 15 bp, Homo sapiens
gaatatatgtgtgcc

SEQ ID NO: 1111974 - DNA, 12 bp, Homo sapiens
gaatatattata

SEQ ID NO: 1111975 - DNA, 15 bp, Homo sapiens
gaatatcaatataat

SEQ ID NO: 1111976 - DNA, 16 bp, Homo sapiens
gaatatcattgatttt

SEQ ID NO: 1111977 - DNA, 14 bp, Homo sapiens
gaatatgacagctg

SEQ ID NO: 1111978 - DNA, 19 bp, Homo sapiens
gaatatgacggaagaacat

SEQ ID NO: 1111979 - DNA, 18 bp, Homo sapiens
gaatatggaacatatgca

SEQ ID NO: 1111980 - DNA, 22 bp, Homo sapiens
gaatatggaacatatgcacagg

SEQ ID NO: 1111981 - DNA, 18 bp, Homo sapiens
gaatatgggagaaatagt

SEQ ID NO: 1111982 - DNA, 20 bp, Homo sapiens
gaatatggttggagagccct

SEQ ID NO: 1111983 - DNA, 18 bp, Homo sapiens
gaatatgtagctcatcct

SEQ ID NO: 1111984 - DNA, 17 bp, Homo sapiens
gaatatgttaatgcaaa

SEQ ID NO: 1111985 - DNA, 21 bp, Homo sapiens
gaatattaaagctcttcattt

SEQ ID NO: 1111986 - DNA, 12 bp, Homo sapiens
gaatattagctt

SEQ ID NO: 1111987 - DNA, 11 bp, Homo sapiens
gaatattcagg

SEQ ID NO: 1111988 - DNA, 12 bp, Homo sapiens
gaatattgagca

SEQ ID NO: 1111989 - DNA, 14 bp, Homo sapiens
gaatattgcaaaat

SEQ ID NO: 1111990 - DNA, 21 bp, Homo sapiens
gaatattggtaattaaaagac

SEQ ID NO: 1111991 - DNA, 12 bp, Homo sapiens
gaatatttatta

SEQ ID NO: 1111992 - DNA, 18 bp, Homo sapiens
gaatatttattacctctg

SEQ ID NO: 1111993 - DNA, 12 bp, Homo sapiens
gaatatttgaat

SEQ ID NO: 1111994 - DNA, 13 bp, Homo sapiens
gaatatttgaata

SEQ ID NO: 1111995 - DNA, 15 bp, Homo sapiens
gaatatttgaataat

SEQ ID NO: 1111996 - DNA, 14 bp, Homo sapiens
gaatattttatcct

SEQ ID NO: 1111997 - DNA, 14 bp, Homo sapiens
gaatattttatctt

SEQ ID NO: 1111998 - DNA, 15 bp, Homo sapiens
gaatattttgatgca

SEQ ID NO: 1111999 - DNA, 15 bp, Homo sapiens
gaatattttggaaac

SEQ ID NO: 1112000 - DNA, 18 bp, Homo sapiens
gaatattttggaaactgc

SEQ ID NO: 1112001 - DNA, 19 bp, Homo sapiens
gaatatttttatatttcct

SEQ ID NO: 1112002 - DNA, 22 bp, Homo sapiens
gaatatttttatatttccttta

SEQ ID NO: 1112003 - DNA, 18 bp, Homo sapiens
gaatattttttgaaggtt

SEQ ID NO: 1112004 - DNA, 21 bp, Homo sapiens
gaatattttttgaaggtttca

SEQ ID NO: 1112005 - DNA, 21 bp, Homo sapiens
gaatcaaagtgattttagcaa

SEQ ID NO: 1112006 - DNA, 22 bp, Homo sapiens
gaatcaaatcttacaaaatcct

SEQ ID NO: 1112007 - DNA, 13 bp, Homo sapiens
gaatcaacagatg

SEQ ID NO: 1112008 - DNA, 20 bp, Homo sapiens
gaatcaagctagaaggccac

SEQ ID NO: 1112009 - DNA, 11 bp, Homo sapiens
gaatcaataat

SEQ ID NO: 1112010 - DNA, 13 bp, Homo sapiens
gaatcaatgaaaa

SEQ ID NO: 1112011 - DNA, 16 bp, Homo sapiens
gaatcacacaagtttg

SEQ ID NO: 1112012 - DNA, 14 bp, Homo sapiens
gaatcaccctccta

SEQ ID NO: 1112013 - DNA, 21 bp, Homo sapiens
gaatcactgttgagttctgat

SEQ ID NO: 1112014 - DNA, 18 bp, Homo sapiens
gaatcacttaagcctgga

SEQ ID NO: 1112015 - DNA, 15 bp, Homo sapiens
gaatcacttttctag

SEQ ID NO: 1112016 - DNA, 15 bp, Homo sapiens
gaatcagaaaagcta

SEQ ID NO: 1112017 - DNA, 22 bp, Homo sapiens
gaatcagaccctaccccaccac

SEQ ID NO: 1112018 - DNA, 19 bp, Homo sapiens
gaatcagacttcacactgc

SEQ ID NO: 1112019 - DNA, 19 bp, Homo sapiens
gaatcagatcatttcaaaa

SEQ ID NO: 1112020 - DNA, 12 bp, Homo sapiens
gaatcagctgga

SEQ ID NO: 1112021 - DNA, 23 bp, Homo sapiens
gaatcaggaatattttccaaaga

SEQ ID NO: 1112022 - DNA, 15 bp, Homo sapiens
gaatcaggttgcaaa

SEQ ID NO: 1112023 - DNA, 19 bp, Homo sapiens
gaatcagtataaacaaagt

SEQ ID NO: 1112024 - DNA, 21 bp, Homo sapiens
gaatcagtataaacaaagtta

SEQ ID NO: 1112025 - DNA, 17 bp, Homo sapiens
gaatcagtatttccttc

SEQ ID NO: 1112026 - DNA, 19 bp, Homo sapiens
gaatcagtatttccttcca

SEQ ID NO: 1112027 - DNA, 18 bp, Homo sapiens
gaatcatactgcctactg

SEQ ID NO: 1112028 - DNA, 20 bp, Homo sapiens
gaatcatacttaacatttca

SEQ ID NO: 1112029 - DNA, 16 bp, Homo sapiens
gaatcatgagcctgct

SEQ ID NO: 1112030 - DNA, 18 bp, Homo sapiens
gaatcatgagcctgctgg

SEQ ID NO: 1112031 - DNA, 20 bp, Homo sapiens
gaatcatgagcctgctggaa

SEQ ID NO: 1112032 - DNA, 17 bp, Homo sapiens
gaatcatgtcaggcctg

SEQ ID NO: 1112033 - DNA, 21 bp, Homo sapiens
gaatcatgtcaggcctgtgtg

SEQ ID NO: 1112034 - DNA, 23 bp, Homo sapiens
gaatcattaatttcaaaatttaa

SEQ ID NO: 1112035 - DNA, 21 bp, Homo sapiens
gaatcattccagtgctagaaa

SEQ ID NO: 1112036 - DNA, 13 bp, Homo sapiens
gaatcatttagca

SEQ ID NO: 1112037 - DNA, 24 bp, Homo sapiens
gaatcatttagcatgttgttgaaa

SEQ ID NO: 1112038 - DNA, 22 bp, Homo sapiens
gaatccaaaagacaaaaatcaa

SEQ ID NO: 1112039 - DNA, 13 bp, Homo sapiens
gaatccaaacttg

SEQ ID NO: 1112040 - DNA, 21 bp, Homo sapiens
gaatccaaatctgtcctctgt

SEQ ID NO: 1112041 - DNA, 22 bp, Homo sapiens
gaatccaaatctgtcctctgta

SEQ ID NO: 1112042 - DNA, 15 bp, Homo sapiens
gaatccaagcctcca

SEQ ID NO: 1112043 - DNA, 20 bp, Homo sapiens
gaatccaagcctccacagcg

SEQ ID NO: 1112044 - DNA, 16 bp, Homo sapiens
gaatccaagcgaggtc

SEQ ID NO: 1112045 - DNA, 21 bp, Homo sapiens
gaatccaagggttgagagcca

SEQ ID NO: 1112046 - DNA, 13 bp, Homo sapiens
gaatccagctccc

SEQ ID NO: 1112047 - DNA, 17 bp, Homo sapiens
gaatccagtttctttcc

SEQ ID NO: 1112048 - DNA, 14 bp, Homo sapiens
gaatccatgcttgg

SEQ ID NO: 1112049 - DNA, 19 bp, Homo sapiens
gaatcccaaatttgattga

SEQ ID NO: 1112050 - DNA, 17 bp, Homo sapiens
gaatcccactgtatgat

SEQ ID NO: 1112051 - DNA, 13 bp, Homo sapiens
gaatcccagccgg

SEQ ID NO: 1112052 - DNA, 16 bp, Homo sapiens
gaatcccatcaggctg

SEQ ID NO: 1112053 - DNA, 17 bp, Homo sapiens
gaatccccaagtgcctg

SEQ ID NO: 1112054 - DNA, 21 bp, Homo sapiens
gaatcccttaacagttgtatt

SEQ ID NO: 1112055 - DNA, 14 bp, Homo sapiens
gaatccgaagggaa

SEQ ID NO: 1112056 - DNA, 12 bp, Homo sapiens
gaatcctggcaa

SEQ ID NO: 1112057 - DNA, 17 bp, Homo sapiens
gaatcctggcagcccag

SEQ ID NO: 1112058 - DNA, 22 bp, Homo sapiens
gaatcctgtcgattagactgga

SEQ ID NO: 1112059 - DNA, 14 bp, Homo sapiens
gaatcctttgcctg

SEQ ID NO: 1112060 - DNA, 19 bp, Homo sapiens
gaatcctttggtgccaact

SEQ ID NO: 1112061 - DNA, 17 bp, Homo sapiens
gaatcgaagtgtttatg

SEQ ID NO: 1112062 - DNA, 20 bp, Homo sapiens
gaatcgaagtgtttatgtaa

SEQ ID NO: 1112063 - DNA, 16 bp, Homo sapiens
gaatcgaggaaccaga

SEQ ID NO: 1112064 - DNA, 19 bp, Homo sapiens
gaatcgaggaaccagagcc

SEQ ID NO: 1112065 - DNA, 21 bp, Homo sapiens
gaatcgatgggggatgcttca

SEQ ID NO: 1112066 - DNA, 15 bp, Homo sapiens
gaatcgcagctgtgg

SEQ ID NO: 1112067 - DNA, 16 bp, Homo sapiens
gaatcgctcctgcagc

SEQ ID NO: 1112068 - DNA, 16 bp, Homo sapiens
gaatctaagctgtttg

SEQ ID NO: 1112069 - DNA, 17 bp, Homo sapiens
gaatctaagctgtttgc

SEQ ID NO: 1112070 - DNA, 18 bp, Homo sapiens
gaatctaaggataatgaa

SEQ ID NO: 1112071 - DNA, 15 bp, Homo sapiens
gaatctagaagatgt

SEQ ID NO: 1112072 - DNA, 16 bp, Homo sapiens
gaatctagaagatgtg

SEQ ID NO: 1112073 - DNA, 21 bp, Homo sapiens
gaatctataagtagtaaatca

SEQ ID NO: 1112074 - DNA, 12 bp, Homo sapiens
gaatctatgcca

SEQ ID NO: 1112075 - DNA, 15 bp, Homo sapiens
gaatctatgccaaag

SEQ ID NO: 1112076 - DNA, 22 bp, Homo sapiens
gaatctatgccaaagatcactt

SEQ ID NO: 1112077 - DNA, 20 bp, Homo sapiens
gaattcttggttgaggaaac

SEQ ID NO: 1112078 - DNA, 17 bp, Homo sapiens
gaattctttctgttgaa

SEQ ID NO: 1112079 - DNA, 15 bp, Homo sapiens
gaattctttgcattc

SEQ ID NO: 1112080 - DNA, 16 bp, Homo sapiens
gaattctttgcattcc

SEQ ID NO: 1112081 - DNA, 18 bp, Homo sapiens
gaattctttgcattcctt

SEQ ID NO: 1112082 - DNA, 16 bp, Homo sapiens
gaattgaactctctgc

SEQ ID NO: 1112083 - DNA, 14 bp, Homo sapiens
gaattgaagcagga

SEQ ID NO: 1112084 - DNA, 17 bp, Homo sapiens
gaattgaccatctgctt

SEQ ID NO: 1112085 - DNA, 18 bp, Homo sapiens
gaattgaggggattaata

SEQ ID NO: 1112086 - DNA, 22 bp, Homo sapiens
gaattgaggggattaatatgaa

SEQ ID NO: 1112087 - DNA, 14 bp, Homo sapiens
gaattgagtaatgg

SEQ ID NO: 1112088 - DNA, 21 bp, Homo sapiens
gaattgatcattttcccccca

SEQ ID NO: 1112089 - DNA, 17 bp, Homo sapiens
gaattgatgatgcagtt

SEQ ID NO: 1112090 - DNA, 18 bp, Homo sapiens
gaattgatgatgcagttt

SEQ ID NO: 1112091 - DNA, 13 bp, Homo sapiens
gaattgatttgca

SEQ ID NO: 1112092 - DNA, 15 bp, Homo sapiens
gaattgccagtcttt

SEQ ID NO: 1112093 - DNA, 20 bp, Homo sapiens
gaattgcctgcagagagaag

SEQ ID NO: 1112094 - DNA, 22 bp, Homo sapiens
gaattgcctgcagagagaagcc

SEQ ID NO: 1112095 - DNA, 17 bp, Homo sapiens
gaattggcataatttgt

SEQ ID NO: 1112096 - DNA, 13 bp, Homo sapiens
gaattggggaggg

SEQ ID NO: 1112097 - DNA, 12 bp, Homo sapiens
gaattgggtccc

SEQ ID NO: 1112098 - DNA, 23 bp, Homo sapiens
gaattggtcttaatgttgaatgt

SEQ ID NO: 1112099 - DNA, 13 bp, Homo sapiens
gaattggtgtata

SEQ ID NO: 1112100 - DNA, 14 bp, Homo sapiens
gaattgtctctggg

SEQ ID NO: 1112101 - DNA, 22 bp, Homo sapiens
gaattgtctctgggctgaggaa

SEQ ID NO: 1112102 - DNA, 18 bp, Homo sapiens
gaattgtgtattgatgca

SEQ ID NO: 1112103 - DNA, 15 bp, Homo sapiens
gaattgtttatacac

SEQ ID NO: 1112104 - DNA, 20 bp, Homo sapiens
gaattgttttctttaaagat

SEQ ID NO: 1112105 - DNA, 22 bp, Homo sapiens
gaattgtttttgaatttaaata

SEQ ID NO: 1112106 - DNA, 18 bp, Homo sapiens
gaatttaaaaataagaaa

SEQ ID NO: 1112107 - DNA, 18 bp, Homo sapiens
gaatttaaaattaagtag

SEQ ID NO: 1112108 - DNA, 20 bp, Homo sapiens
gaatttaaatataattctgt

SEQ ID NO: 1112109 - DNA, 22 bp, Homo sapiens
gaatttaaatataattctgtaa

SEQ ID NO: 1112110 - DNA, 15 bp, Homo sapiens
gaatttaatggactg

SEQ ID NO: 1112111 - DNA, 20 bp, Homo sapiens
gaatttaatggactgtgaat

SEQ ID NO: 1112112 - DNA, 22 bp, Homo sapiens
gaatttaatggactgtgaattt

SEQ ID NO: 1112113 - DNA, 16 bp, Homo sapiens
gaatttactttcttca

SEQ ID NO: 1112114 - DNA, 19 bp, Homo sapiens
gaatttagtcacaccatct

SEQ ID NO: 1112115 - DNA, 15 bp, Homo sapiens
gaatttatctttacc

SEQ ID NO: 1112116 - DNA, 16 bp, Homo sapiens
gaatttatctttacca

SEQ ID NO: 1112117 - DNA, 19 bp, Homo sapiens
gaatttatctttaccaaaa

SEQ ID NO: 1112118 - DNA, 13 bp, Homo sapiens
gaatttattcaat

SEQ ID NO: 1112119 - DNA, 13 bp, Homo sapiens
gaatttattgata

SEQ ID NO: 1112120 - DNA, 12 bp, Homo sapiens
gaatttcacaag

SEQ ID NO: 1112121 - DNA, 21 bp, Homo sapiens
gaatttcaggcattttgttct

SEQ ID NO: 1112122 - DNA, 20 bp, Homo sapiens
gaatttcagtataaagatca

SEQ ID NO: 1112123 - DNA, 17 bp, Homo sapiens
gaatttcccacataccc

SEQ ID NO: 1112124 - DNA, 13 bp, Homo sapiens
gaatttcctctat

SEQ ID NO: 1112125 - DNA, 12 bp, Homo sapiens
gaatttctaaag

SEQ ID NO: 1112126 - DNA, 16 bp, Homo sapiens
gaatttctaaagtaaa

SEQ ID NO: 1112127 - DNA, 16 bp, Homo sapiens
gaatttctaaatgttg

SEQ ID NO: 1112128 - DNA, 22 bp, Homo sapiens
gaatttctagacagtattgcca

SEQ ID NO: 1112129 - DNA, 13 bp, Homo sapiens
gaatttcttaact

SEQ ID NO: 1112130 - DNA, 17 bp, Homo sapiens
gaatttcttaacttctt

SEQ ID NO: 1112131 - DNA, 19 bp, Homo sapiens
gaatttcttaacttcttgc

SEQ ID NO: 1112132 - DNA, 21 bp, Homo sapiens
gaatttcttcaactccctgcc

SEQ ID NO: 1112133 - DNA, 20 bp, Homo sapiens
gaatttcttcactgttgaaa

SEQ ID NO: 1112134 - DNA, 14 bp, Homo sapiens
gaatttgaatgaaa

SEQ ID NO: 1112135 - DNA, 16 bp, Homo sapiens
gaatttgaatgaaaaa

SEQ ID NO: 1112136 - DNA, 11 bp, Homo sapiens
gaatttgagaa

SEQ ID NO: 1112137 - DNA, 18 bp, Homo sapiens
gaatttgcatacttacct

SEQ ID NO: 1112138 - DNA, 20 bp, Homo sapiens
gaatttgcctgctgggattc

SEQ ID NO: 1112139 - DNA, 13 bp, Homo sapiens
gaatttggaaatc

SEQ ID NO: 1112140 - DNA, 14 bp, Homo sapiens
gaatttggaaatcc

SEQ ID NO: 1112141 - DNA, 21 bp, Homo sapiens
gaatttgggatactaaagtag

SEQ ID NO: 1112142 - DNA, 17 bp, Homo sapiens
gaatttgggatggaagc

SEQ ID NO: 1112143 - DNA, 17 bp, Homo sapiens
gaatttgtaacctcagc

SEQ ID NO: 1112144 - DNA, 19 bp, Homo sapiens
gaatttgtaacctcagctc

SEQ ID NO: 1112145 - DNA, 18 bp, Homo sapiens
gaatttgtacgtttatac

SEQ ID NO: 1112146 - DNA, 12 bp, Homo sapiens
gaatttgtactt

SEQ ID NO: 1112147 - DNA, 13 bp, Homo sapiens
gaatttgtacttc

SEQ ID NO: 1112148 - DNA, 14 bp, Homo sapiens
gaatttgtacttct

SEQ ID NO: 1112149 - DNA, 12 bp, Homo sapiens
gaattttaaagt

SEQ ID NO: 1112150 - DNA, 16 bp, Homo sapiens
gaattttaatgtgaag

SEQ ID NO: 1112151 - DNA, 14 bp, Homo sapiens
gaattttaggaact

SEQ ID NO: 1112152 - DNA, 13 bp, Homo sapiens
gaattttagtcct

SEQ ID NO: 1112153 - DNA, 12 bp, Homo sapiens
gaattttatatt

SEQ ID NO: 1112154 - DNA, 18 bp, Homo sapiens
gaattttattttgctgag

SEQ ID NO: 1112155 - DNA, 18 bp, Homo sapiens
gaattttcaaggccttca

SEQ ID NO: 1112156 - DNA, 20 bp, Homo sapiens
gaattttcaaggccttcagt

SEQ ID NO: 1112157 - DNA, 20 bp, Homo sapiens
gaattttgagtattccatga

SEQ ID NO: 1112158 - DNA, 21 bp, Homo sapiens
gaattttgcaaagatttaatc

SEQ ID NO: 1112159 - DNA, 13 bp, Homo sapiens
gaattttgtctca

SEQ ID NO: 1112160 - DNA, 17 bp, Homo sapiens
gaattttgttctctggg

SEQ ID NO: 1112161 - DNA, 23 bp, Homo sapiens
gaattttgtttttattttcaaga

SEQ ID NO: 1112162 - DNA, 22 bp, Homo sapiens
gaatttttcctatgctattgac

SEQ ID NO: 1112163 - DNA, 22 bp, Homo sapiens
gaatttttctgtacttcagtat

SEQ ID NO: 1112164 - DNA, 13 bp, Homo sapiens
gaatttttcttcc

SEQ ID NO: 1112165 - DNA, 15 bp, Homo sapiens
gaatttttgcctatc

SEQ ID NO: 1112166 - DNA, 21 bp, Homo sapiens
gaatttttgcctatctttaaa

SEQ ID NO: 1112167 - DNA, 17 bp, Homo sapiens
gaatttttttgtcttta

SEQ ID NO: 1112168 - DNA, 14 bp, Homo sapiens
gacaaaaaaaaaat

SEQ ID NO: 1112169 - DNA, 15 bp, Homo sapiens
gacaaaaacaagact

SEQ ID NO: 1112170 - DNA, 18 bp, Homo sapiens
gacaaaaacaagactgcc

SEQ ID NO: 1112171 - DNA, 21 bp, Homo sapiens
gacaaaaagccttgaagaaaa

SEQ ID NO: 1112172 - DNA, 22 bp, Homo sapiens
gacaaaaagtatattaaacaaa

SEQ ID NO: 1112173 - DNA, 16 bp, Homo sapiens
gacaaaaagtttccat

SEQ ID NO: 1112174 - DNA, 19 bp, Homo sapiens
gacaaaaataacactgttg

SEQ ID NO: 1112175 - DNA, 18 bp, Homo sapiens
gacaaaacgggttactaa

SEQ ID NO: 1112176 - DNA, 15 bp, Homo sapiens
gacaaaagtaaatgg

SEQ ID NO: 1112177 - DNA, 16 bp, Homo sapiens
gacaaaatgggaggag

SEQ ID NO: 1112178 - DNA, 18 bp, Homo sapiens
gacaaaatgggaggagga

SEQ ID NO: 1112179 - DNA, 21 bp, Homo sapiens
gacaaaatgggaggaggaaag

SEQ ID NO: 1112180 - DNA, 23 bp, Homo sapiens
gacaaaatgggaggaggaaagag

SEQ ID NO: 1112181 - DNA, 21 bp, Homo sapiens
gacaaaatggggcagaagaga

SEQ ID NO: 1112182 - DNA, 16 bp, Homo sapiens
gacaaaattaatacat

SEQ ID NO: 1112183 - DNA, 16 bp, Homo sapiens
gacaaacacctcccag

SEQ ID NO: 1112184 - DNA, 19 bp, Homo sapiens
gacaaacctagcttttaaa

SEQ ID NO: 1112185 - DNA, 23 bp, Homo sapiens
gacaaacctagcttttaaaaaat

SEQ ID NO: 1112186 - DNA, 18 bp, Homo sapiens
gacaaaccttatggaaaa

SEQ ID NO: 1112187 - DNA, 17 bp, Homo sapiens
gacaaactgccagtttt

SEQ ID NO: 1112188 - DNA, 19 bp, Homo sapiens
gacaaagaattccaaagca

SEQ ID NO: 1112189 - DNA, 21 bp, Homo sapiens
gacaaagacaaattctgtttc

SEQ ID NO: 1112190 - DNA, 14 bp, Homo sapiens
gacaaagactcctc

SEQ ID NO: 1112191 - DNA, 21 bp, Homo sapiens
gacaaagactcctctgggcct

SEQ ID NO: 1112192 - DNA, 20 bp, Homo sapiens
gacaaagaggcctttaacca

SEQ ID NO: 1112193 - DNA, 17 bp, Homo sapiens
gacaaagatggctcaga

SEQ ID NO: 1112194 - DNA, 15 bp, Homo sapiens
gacaaaggagccttg

SEQ ID NO: 1112195 - DNA, 16 bp, Homo sapiens
gacaaaggaggaattt

SEQ ID NO: 1112196 - DNA, 23 bp, Homo sapiens
gacaaaggaggaatttactttct

SEQ ID NO: 1112197 - DNA, 13 bp, Homo sapiens
gacaaaggcaagc

SEQ ID NO: 1112198 - DNA, 15 bp, Homo sapiens
gacaaaggccacagg

SEQ ID NO: 1112199 - DNA, 21 bp, Homo sapiens
gacagatacctccaaccctgc

SEQ ID NO: 1112200 - DNA, 14 bp, Homo sapiens
gacagatattttat

SEQ ID NO: 1112201 - DNA, 22 bp, Homo sapiens
gacagatattttatctattggc

SEQ ID NO: 1112202 - DNA, 20 bp, Homo sapiens
gacagatcaagctgtgagac

SEQ ID NO: 1112203 - DNA, 20 bp, Homo sapiens
gacagatcactcctggaggc

SEQ ID NO: 1112204 - DNA, 23 bp, Homo sapiens
gacagatcataggaagtggctgg

SEQ ID NO: 1112205 - DNA, 19 bp, Homo sapiens
gacagatgaatgccgtgga

SEQ ID NO: 1112206 - DNA, 21 bp, Homo sapiens
gacagatgccaacttcccaca

SEQ ID NO: 1112207 - DNA, 20 bp, Homo sapiens
gacagatgccccagagctgt

SEQ ID NO: 1112208 - DNA, 20 bp, Homo sapiens
gacagatggacactgccaag

SEQ ID NO: 1112209 - DNA, 18 bp, Homo sapiens
gacagatggacgcaggcc

SEQ ID NO: 1112210 - DNA, 18 bp, Homo sapiens
gacagatggcccaaggga

SEQ ID NO: 1112211 - DNA, 18 bp, Homo sapiens
gacagattcataaagtaa

SEQ ID NO: 1112212 - DNA, 18 bp, Homo sapiens
gacagattctgacattta

SEQ ID NO: 1112213 - DNA, 14 bp, Homo sapiens
gacagatttcagta

SEQ ID NO: 1112214 - DNA, 23 bp, Homo sapiens
gacagatttcagtaatgtcttca

SEQ ID NO: 1112215 - DNA, 16 bp, Homo sapiens
gacagcaagtgagcag

SEQ ID NO: 1112216 - DNA, 13 bp, Homo sapiens
gacagcagaagcc

SEQ ID NO: 1112217 - DNA, 16 bp, Homo sapiens
gacagcagaagcctcc

SEQ ID NO: 1112218 - DNA, 12 bp, Homo sapiens
gacagcagcctg

SEQ ID NO: 1112219 - DNA, 13 bp, Homo sapiens
gacagcagcctgt

SEQ ID NO: 1112220 - DNA, 16 bp, Homo sapiens
gacagcagcctgtatg

SEQ ID NO: 1112221 - DNA, 14 bp, Homo sapiens
gacagcagcctgtg

SEQ ID NO: 1112222 - DNA, 15 bp, Homo sapiens
gacagcagcctgtga

SEQ ID NO: 1112223 - DNA, 16 bp, Homo sapiens
gacagcagcctgtgag

SEQ ID NO: 1112224 - DNA, 17 bp, Homo sapiens
gacagcagcctgtgagg

SEQ ID NO: 1112225 - DNA, 15 bp, Homo sapiens
gacagcagctcaggc

SEQ ID NO: 1112226 - DNA, 12 bp, Homo sapiens
gacagcaggtgg

SEQ ID NO: 1112227 - DNA, 12 bp, Homo sapiens
gacagcatgaga

SEQ ID NO: 1112228 - DNA, 13 bp, Homo sapiens
gacagcatgcccc

SEQ ID NO: 1112229 - DNA, 15 bp, Homo sapiens
gacagcatgcccctt

SEQ ID NO: 1112230 - DNA, 22 bp, Homo sapiens
gacagcatgccccttggctgga

SEQ ID NO: 1112231 - DNA, 18 bp, Homo sapiens
gacagcatgtgccctcct

SEQ ID NO: 1112232 - DNA, 16 bp, Homo sapiens
gacagccagagctggg

SEQ ID NO: 1112233 - DNA, 18 bp, Homo sapiens
gacagcctgcagcaggaa

SEQ ID NO: 1112234 - DNA, 20 bp, Homo sapiens
gacagcctgtggcggtgcct

SEQ ID NO: 1112235 - DNA, 14 bp, Homo sapiens
gacagccttgccca

SEQ ID NO: 1112236 - DNA, 19 bp, Homo sapiens
gacagccttgggcctttca

SEQ ID NO: 1112237 - DNA, 15 bp, Homo sapiens
gacagcgatggcagg

SEQ ID NO: 1112238 - DNA, 24 bp, Homo sapiens
gacagcgatggcaggcctgaccca

SEQ ID NO: 1112239 - DNA, 22 bp, Homo sapiens
gacagctaccggaaggagggga

SEQ ID NO: 1112240 - DNA, 23 bp, Homo sapiens
gacagctaccggaaggaggggaa

SEQ ID NO: 1112241 - DNA, 11 bp, Homo sapiens
gacagctggct

SEQ ID NO: 1112242 - DNA, 14 bp, Homo sapiens
gacagctggctagc

SEQ ID NO: 1112243 - DNA, 17 bp, Homo sapiens
gacagctgtccctgtca

SEQ ID NO: 1112244 - DNA, 19 bp, Homo sapiens
gacagctgtccctgtcacc

SEQ ID NO: 1112245 - DNA, 12 bp, Homo sapiens
gacagcttcctc

SEQ ID NO: 1112246 - DNA, 13 bp, Homo sapiens
gacagcttcctca

SEQ ID NO: 1112247 - DNA, 20 bp, Homo sapiens
gacagcttcctcacacccct

SEQ ID NO: 1112248 - DNA, 13 bp, Homo sapiens
gacagcttctctg

SEQ ID NO: 1112249 - DNA, 15 bp, Homo sapiens
gacagcttctctgca

SEQ ID NO: 1112250 - DNA, 14 bp, Homo sapiens
gacagctttctggg

SEQ ID NO: 1112251 - DNA, 15 bp, Homo sapiens
gacagctttctggga

SEQ ID NO: 1112252 - DNA, 18 bp, Homo sapiens
gacagctttctgggatgt

SEQ ID NO: 1112253 - DNA, 20 bp, Homo sapiens
gacagctttctgggatgtca

SEQ ID NO: 1112254 - DNA, 14 bp, Homo sapiens
gacagctttgctcc

SEQ ID NO: 1112255 - DNA, 16 bp, Homo sapiens
gacagctttgctccgc

SEQ ID NO: 1112256 - DNA, 16 bp, Homo sapiens
gacagctttgctgctg

SEQ ID NO: 1112257 - DNA, 19 bp, Homo sapiens
gacaggaaagccctccccc

SEQ ID NO: 1112258 - DNA, 14 bp, Homo sapiens
gacaggacagtgct

SEQ ID NO: 1112259 - DNA, 22 bp, Homo sapiens
gacaggacagtgcttcagcctg

SEQ ID NO: 1112260 - DNA, 20 bp, Homo sapiens
gacaggacgggcttgggctt

SEQ ID NO: 1112261 - DNA, 12 bp, Homo sapiens
gacaggagaaat

SEQ ID NO: 1112262 - DNA, 22 bp, Homo sapiens
gacaggagagattatttacaag

SEQ ID NO: 1112263 - DNA, 17 bp, Homo sapiens
gacaggagatcagcagc

SEQ ID NO: 1112264 - DNA, 23 bp, Homo sapiens
gacaggagcctagcggagcccag

SEQ ID NO: 1112265 - DNA, 16 bp, Homo sapiens
gacaggagcctggtcc

SEQ ID NO: 1112266 - DNA, 17 bp, Homo sapiens
gacaggagcctggtcct

SEQ ID NO: 1112267 - DNA, 17 bp, Homo sapiens
gacaggagggcaagggc

SEQ ID NO: 1112268 - DNA, 22 bp, Homo sapiens
gacaggatctataggcagcttc

SEQ ID NO: 1112269 - DNA, 14 bp, Homo sapiens
gacaggcagcccag

SEQ ID NO: 1112270 - DNA, 16 bp, Homo sapiens
gacaggcagcccagca

SEQ ID NO: 1112271 - DNA, 21 bp, Homo sapiens
gacaggcagcctcctttgtgt

SEQ ID NO: 1112272 - DNA, 21 bp, Homo sapiens
gacaggcaggccagatggccc

SEQ ID NO: 1112273 - DNA, 18 bp, Homo sapiens
gacaggcagggagggctt

SEQ ID NO: 1112274 - DNA, 19 bp, Homo sapiens
gacaggccatgtgagccac

SEQ ID NO: 1112275 - DNA, 16 bp, Homo sapiens
gacaggcccgcttgct

SEQ ID NO: 1112276 - DNA, 15 bp, Homo sapiens
gacaggcgcctgcca

SEQ ID NO: 1112277 - DNA, 18 bp, Homo sapiens
gacaggctctagagagag

SEQ ID NO: 1112278 - DNA, 18 bp, Homo sapiens
gacaggctcttagcagct

SEQ ID NO: 1112279 - DNA, 13 bp, Homo sapiens
gacaggctggtgc

SEQ ID NO: 1112280 - DNA, 14 bp, Homo sapiens
gacaggctggtgct

SEQ ID NO: 1112281 - DNA, 19 bp, Homo sapiens
gacagggacccacttcaca

SEQ ID NO: 1112282 - DNA, 17 bp, Homo sapiens
gacagggagcagccccc

SEQ ID NO: 1112283 - DNA, 17 bp, Homo sapiens
gacagggagggggacct

SEQ ID NO: 1112284 - DNA, 16 bp, Homo sapiens
gacagggcaggcgggc

SEQ ID NO: 1112285 - DNA, 16 bp, Homo sapiens
gacagggccagggttg

SEQ ID NO: 1112286 - DNA, 16 bp, Homo sapiens
gacagggccagtgggg

SEQ ID NO: 1112287 - DNA, 21 bp, Homo sapiens
gacagggccagtggggcctgt

SEQ ID NO: 1112288 - DNA, 15 bp, Homo sapiens
gacagggcctggagc

SEQ ID NO: 1112289 - DNA, 15 bp, Homo sapiens
gacagggctgctccc

SEQ ID NO: 1112290 - DNA, 23 bp, Homo sapiens
gacagggggaagttcagaaggtg

SEQ ID NO: 1112291 - DNA, 15 bp, Homo sapiens
gacagggtaggaaag

SEQ ID NO: 1112292 - DNA, 17 bp, Homo sapiens
gacagggtctcactctg

SEQ ID NO: 1112293 - DNA, 18 bp, Homo sapiens
gacagggtctcactctgt

SEQ ID NO: 1112294 - DNA, 14 bp, Homo sapiens
gacagggtcttgct

SEQ ID NO: 1112295 - DNA, 22 bp, Homo sapiens
gacagggtcttgctctgtcccc

SEQ ID NO: 1112296 - DNA, 20 bp, Homo sapiens
gacagggtgctgatgggaag

SEQ ID NO: 1112297 - DNA, 22 bp, Homo sapiens
gacagggtgggcttcctgccct

SEQ ID NO: 1112298 - DNA, 20 bp, Homo sapiens
gacaggtctagactttctca

SEQ ID NO: 1112299 - DNA, 18 bp, Homo sapiens
gacaggtgatgctctggc

SEQ ID NO: 1112300 - DNA, 15 bp, Homo sapiens
gacaggtgggcctgg

SEQ ID NO: 1112301 - DNA, 16 bp, Homo sapiens
gacaggtgggcctggg

SEQ ID NO: 1112302 - DNA, 18 bp, Homo sapiens
gacaggtgggcctgggag

SEQ ID NO: 1112303 - DNA, 14 bp, Homo sapiens
gacaggtggggcct

SEQ ID NO: 1112304 - DNA, 16 bp, Homo sapiens
gacaggtggggcctca

SEQ ID NO: 1112305 - DNA, 17 bp, Homo sapiens
gacaggtggggcctcag

SEQ ID NO: 1112306 - DNA, 19 bp, Homo sapiens
gacaggtggggcctcagcc

SEQ ID NO: 1112307 - DNA, 21 bp, Homo sapiens
gacaggtggggcctcagcctg

SEQ ID NO: 1112308 - DNA, 23 bp, Homo sapiens
gacaggtggggcctcagcctggg

SEQ ID NO: 1112309 - DNA, 18 bp, Homo sapiens
gacaggtgtgagccactg

SEQ ID NO: 1112310 - DNA, 14 bp, Homo sapiens
gacagtatatgtca

SEQ ID NO: 1112311 - DNA, 21 bp, Homo sapiens
gacagtatcccacatccaact

SEQ ID NO: 1112312 - DNA, 22 bp, Homo sapiens
gacagtatgagtcaatgtgcag

SEQ ID NO: 1112313 - DNA, 22 bp, Homo sapiens
gacagtattaagggtaggatgt

SEQ ID NO: 1112314 - DNA, 18 bp, Homo sapiens
gacagtattgccacctct

SEQ ID NO: 1112315 - DNA, 21 bp, Homo sapiens
gacagtcatcatcagggcctg

SEQ ID NO: 1112316 - DNA, 22 bp, Homo sapiens
gacagtcatcatcagggcctgg

SEQ ID NO: 1112317 - DNA, 13 bp, Homo sapiens
gacagtccacagg

SEQ ID NO: 1112318 - DNA, 14 bp, Homo sapiens
gacagtccacaggg

SEQ ID NO: 1112319 - DNA, 18 bp, Homo sapiens
gacagtccacaggggcca

SEQ ID NO: 1112320 - DNA, 15 bp, Homo sapiens
gacagtcctccatcc

SEQ ID NO: 1112321 - DNA, 20 bp, Homo sapiens
gaccagcaacttgtcttttt

SEQ ID NO: 1112322 - DNA, 15 bp, Homo sapiens
gaccagcactcagcc

SEQ ID NO: 1112323 - DNA, 19 bp, Homo sapiens
gaccagcagacagagccag

SEQ ID NO: 1112324 - DNA, 16 bp, Homo sapiens
gaccagcagcgccttt

SEQ ID NO: 1112325 - DNA, 20 bp, Homo sapiens
gaccagcagcgcctttccca

SEQ ID NO: 1112326 - DNA, 17 bp, Homo sapiens
gaccagcaggctggcct

SEQ ID NO: 1112327 - DNA, 13 bp, Homo sapiens
gaccagcatctgg

SEQ ID NO: 1112328 - DNA, 18 bp, Homo sapiens
gaccagcatctggtcttg

SEQ ID NO: 1112329 - DNA, 13 bp, Homo sapiens
gaccagcccattg

SEQ ID NO: 1112330 - DNA, 19 bp, Homo sapiens
gaccagcccattggccgag

SEQ ID NO: 1112331 - DNA, 21 bp, Homo sapiens
gaccagcctggccatcatggc

SEQ ID NO: 1112332 - DNA, 23 bp, Homo sapiens
gaccagcctgttggacccgctct

SEQ ID NO: 1112333 - DNA, 19 bp, Homo sapiens
gaccagcggaaacaggtgt

SEQ ID NO: 1112334 - DNA, 19 bp, Homo sapiens
gaccagctgctccgaggac

SEQ ID NO: 1112335 - DNA, 21 bp, Homo sapiens
gaccagctgctccgaggaccc

SEQ ID NO: 1112336 - DNA, 14 bp, Homo sapiens
gaccagctggagtg

SEQ ID NO: 1112337 - DNA, 15 bp, Homo sapiens
gaccagctggcctgg

SEQ ID NO: 1112338 - DNA, 12 bp, Homo sapiens
gaccagctgggg

SEQ ID NO: 1112339 - DNA, 16 bp, Homo sapiens
gaccaggacaggacca

SEQ ID NO: 1112340 - DNA, 22 bp, Homo sapiens
gaccaggactatagcccaggtc

SEQ ID NO: 1112341 - DNA, 17 bp, Homo sapiens
gaccaggactccctcct

SEQ ID NO: 1112342 - DNA, 12 bp, Homo sapiens
gaccaggatcag

SEQ ID NO: 1112343 - DNA, 20 bp, Homo sapiens
gaccaggatcccaagcctcc

SEQ ID NO: 1112344 - DNA, 18 bp, Homo sapiens
gaccagggaagtgtgtgt

SEQ ID NO: 1112345 - DNA, 15 bp, Homo sapiens
gaccagggatgctgg

SEQ ID NO: 1112346 - DNA, 21 bp, Homo sapiens
gaccagggatgctgggctggg

SEQ ID NO: 1112347 - DNA, 17 bp, Homo sapiens
gaccagggccctgggca

SEQ ID NO: 1112348 - DNA, 11 bp, Homo sapiens
gaccagggctc

SEQ ID NO: 1112349 - DNA, 18 bp, Homo sapiens
gaccagggctccagcccc

SEQ ID NO: 1112350 - DNA, 19 bp, Homo sapiens
gaccagggtcttacctctc

SEQ ID NO: 1112351 - DNA, 23 bp, Homo sapiens
gaccagggtcttacctctctggg

SEQ ID NO: 1112352 - DNA, 22 bp, Homo sapiens
gaccaggtcttggagctgagcc

SEQ ID NO: 1112353 - DNA, 17 bp, Homo sapiens
gaccagtcaacctgggc

SEQ ID NO: 1112354 - DNA, 19 bp, Homo sapiens
gaccagtgggatgggctct

SEQ ID NO: 1112355 - DNA, 17 bp, Homo sapiens
gaccagttgggagcact

SEQ ID NO: 1112356 - DNA, 20 bp, Homo sapiens
gaccagttgggagcactgga

SEQ ID NO: 1112357 - DNA, 15 bp, Homo sapiens
gaccataatgttaca

SEQ ID NO: 1112358 - DNA, 13 bp, Homo sapiens
gaccatactaatt

SEQ ID NO: 1112359 - DNA, 12 bp, Homo sapiens
gaccatcctggc

SEQ ID NO: 1112360 - DNA, 14 bp, Homo sapiens
gaccatcctggccc

SEQ ID NO: 1112361 - DNA, 21 bp, Homo sapiens
gaccatcctggcccctccaga

SEQ ID NO: 1112362 - DNA, 14 bp, Homo sapiens
gaccatcctggcta

SEQ ID NO: 1112363 - DNA, 18 bp, Homo sapiens
gaccatcgtccagccctc

SEQ ID NO: 1112364 - DNA, 19 bp, Homo sapiens
gaccatcgtccagccctcc

SEQ ID NO: 1112365 - DNA, 18 bp, Homo sapiens
gaccatcgtccttcctct

SEQ ID NO: 1112366 - DNA, 13 bp, Homo sapiens
gaccatctctgta

SEQ ID NO: 1112367 - DNA, 21 bp, Homo sapiens
gaccatgaagtaaattatgta

SEQ ID NO: 1112368 - DNA, 17 bp, Homo sapiens
gaccatgcactatattt

SEQ ID NO: 1112369 - DNA, 21 bp, Homo sapiens
gaccatggacactacacccag

SEQ ID NO: 1112370 - DNA, 20 bp, Homo sapiens
gaccatggttttggctctcc

SEQ ID NO: 1112371 - DNA, 23 bp, Homo sapiens
gaccatggttttggctctcccac

SEQ ID NO: 1112372 - DNA, 17 bp, Homo sapiens
gaccatgttcattataa

SEQ ID NO: 1112373 - DNA, 13 bp, Homo sapiens
gaccattattcac

SEQ ID NO: 1112374 - DNA, 13 bp, Homo sapiens
gaccattcctgtc

SEQ ID NO: 1112375 - DNA, 12 bp, Homo sapiens
gaccattctgcc

SEQ ID NO: 1112376 - DNA, 20 bp, Homo sapiens
gaccattctgtgaccaaaat

SEQ ID NO: 1112377 - DNA, 22 bp, Homo sapiens
gaccattctgtgaccaaaatac

SEQ ID NO: 1112378 - DNA, 16 bp, Homo sapiens
gaccattgagtccctg

SEQ ID NO: 1112379 - DNA, 15 bp, Homo sapiens
gaccatttcaggggt

SEQ ID NO: 1112380 - DNA, 20 bp, Homo sapiens
gaccattttgttaaaatcta

SEQ ID NO: 1112381 - DNA, 11 bp, Homo sapiens
gacccaaagac

SEQ ID NO: 1112382 - DNA, 14 bp, Homo sapiens
gacccaaagcaaaa

SEQ ID NO: 1112383 - DNA, 14 bp, Homo sapiens
gacccaaagcagga

SEQ ID NO: 1112384 - DNA, 23 bp, Homo sapiens
gacccaaattataagggccctgc

SEQ ID NO: 1112385 - DNA, 17 bp, Homo sapiens
gacccaacagcagtgat

SEQ ID NO: 1112386 - DNA, 20 bp, Homo sapiens
gacccaactgggggcaaagg

SEQ ID NO: 1112387 - DNA, 14 bp, Homo sapiens
gacccaaggaggaa

SEQ ID NO: 1112388 - DNA, 19 bp, Homo sapiens
gacccaaggctcactgcag

SEQ ID NO: 1112389 - DNA, 15 bp, Homo sapiens
gacccaagtctgaac

SEQ ID NO: 1112390 - DNA, 18 bp, Homo sapiens
gacccaatgtaggagctg

SEQ ID NO: 1112391 - DNA, 23 bp, Homo sapiens
gacccacagactggttttgcaac

SEQ ID NO: 1112392 - DNA, 18 bp, Homo sapiens
gacccacccatcttcctg

SEQ ID NO: 1112393 - DNA, 20 bp, Homo sapiens
gacccacccatcttcctgct

SEQ ID NO: 1112394 - DNA, 12 bp, Homo sapiens
gacccaccccaa

SEQ ID NO: 1112395 - DNA, 16 bp, Homo sapiens
gacccaccccaactct

SEQ ID NO: 1112396 - DNA, 20 bp, Homo sapiens
gacccaccccaactctcccc

SEQ ID NO: 1112397 - DNA, 15 bp, Homo sapiens
gacccacccctgtgc

SEQ ID NO: 1112398 - DNA, 12 bp, Homo sapiens
gacccacctgga

SEQ ID NO: 1112399 - DNA, 18 bp, Homo sapiens
gacccacctggagcccgc

SEQ ID NO: 1112400 - DNA, 19 bp, Homo sapiens
gacccactggactcacctc

SEQ ID NO: 1112401 - DNA, 23 bp, Homo sapiens
gacccacttcacacacaggcaac

SEQ ID NO: 1112402 - DNA, 16 bp, Homo sapiens
gacccagaatggagcc

SEQ ID NO: 1112403 - DNA, 19 bp, Homo sapiens
gacccagaatggagcctgc

SEQ ID NO: 1112404 - DNA, 17 bp, Homo sapiens
gacccagacacatcgca

SEQ ID NO: 1112405 - DNA, 19 bp, Homo sapiens
gacccagagtggagtctga

SEQ ID NO: 1112406 - DNA, 15 bp, Homo sapiens
gacccagatcctcac

SEQ ID NO: 1112407 - DNA, 14 bp, Homo sapiens
gacccagcagcagc

SEQ ID NO: 1112408 - DNA, 22 bp, Homo sapiens
gacccagcatctcccagcaaga

SEQ ID NO: 1112409 - DNA, 14 bp, Homo sapiens
gacccagccagctg

SEQ ID NO: 1112410 - DNA, 16 bp, Homo sapiens
gacccagccagctgca

SEQ ID NO: 1112411 - DNA, 17 bp, Homo sapiens
gacccagccagctgcag

SEQ ID NO: 1112412 - DNA, 22 bp, Homo sapiens
gacccagccagctgcagggcac

SEQ ID NO: 1112413 - DNA, 17 bp, Homo sapiens
gacccagcccgcggcct

SEQ ID NO: 1112414 - DNA, 17 bp, Homo sapiens
gacccagccctcatccc

SEQ ID NO: 1112415 - DNA, 13 bp, Homo sapiens
gacccagcctgaa

SEQ ID NO: 1112416 - DNA, 16 bp, Homo sapiens
gacccagctactctgt

SEQ ID NO: 1112417 - DNA, 20 bp, Homo sapiens
gacccagctactctgtccag

SEQ ID NO: 1112418 - DNA, 17 bp, Homo sapiens
gacccagctcctctgag

SEQ ID NO: 1112419 - DNA, 18 bp, Homo sapiens
gacccagctcctctgagc

SEQ ID NO: 1112420 - DNA, 18 bp, Homo sapiens
gacccaggaatagtggac

SEQ ID NO: 1112421 - DNA, 13 bp, Homo sapiens
gacccaggacagg

SEQ ID NO: 1112422 - DNA, 12 bp, Homo sapiens
gacccaggccct

SEQ ID NO: 1112423 - DNA, 13 bp, Homo sapiens
gacccaggccgca

SEQ ID NO: 1112424 - DNA, 15 bp, Homo sapiens
gacccaggccgcagc

SEQ ID NO: 1112425 - DNA, 16 bp, Homo sapiens
gacccagggcctgact

SEQ ID NO: 1112426 - DNA, 17 bp, Homo sapiens
gacccagtcccacactg

SEQ ID NO: 1112427 - DNA, 16 bp, Homo sapiens
gacccagtccctgggg

SEQ ID NO: 1112428 - DNA, 15 bp, Homo sapiens
gacccagtgcactcc

SEQ ID NO: 1112429 - DNA, 17 bp, Homo sapiens
gacccatacctttccag

SEQ ID NO: 1112430 - DNA, 18 bp, Homo sapiens
gacccatagatcttctga

SEQ ID NO: 1112431 - DNA, 15 bp, Homo sapiens
gacccatgggggctg

SEQ ID NO: 1112432 - DNA, 22 bp, Homo sapiens
gacccattgcgatggccgctcc

SEQ ID NO: 1112433 - DNA, 23 bp, Homo sapiens
gaccccaaacaccttccagctcc

SEQ ID NO: 1112434 - DNA, 20 bp, Homo sapiens
gaccccaaagagcctggaga

SEQ ID NO: 1112435 - DNA, 16 bp, Homo sapiens
gaccccacatccttct

SEQ ID NO: 1112436 - DNA, 18 bp, Homo sapiens
gaccccacatccttctca

SEQ ID NO: 1112437 - DNA, 12 bp, Homo sapiens
gaccccacccaa

SEQ ID NO: 1112438 - DNA, 22 bp, Homo sapiens
gaccccacccaagcttggcagc

SEQ ID NO: 1112439 - DNA, 23 bp, Homo sapiens
gaccccacttatgctgctgtgaa

SEQ ID NO: 1112440 - DNA, 12 bp, Homo sapiens
gaccccagagga

SEQ ID NO: 1112441 - DNA, 12 bp, Homo sapiens
gaccccagggtg

SEQ ID NO: 1112442 - DNA, 15 bp, Homo sapiens
gaccccaggtcagcc

SEQ ID NO: 1112443 - DNA, 16 bp, Homo sapiens
gacgtgcactgacagc

SEQ ID NO: 1112444 - DNA, 22 bp, Homo sapiens
gacgtgcagacaggctggcatt

SEQ ID NO: 1112445 - DNA, 13 bp, Homo sapiens
gacgtgctggcct

SEQ ID NO: 1112446 - DNA, 17 bp, Homo sapiens
gacgtgggccctgcagg

SEQ ID NO: 1112447 - DNA, 19 bp, Homo sapiens
gacgtgggccctgcaggct

SEQ ID NO: 1112448 - DNA, 24 bp, Homo sapiens
gacgtggtgggactccagctcgtg

SEQ ID NO: 1112449 - DNA, 17 bp, Homo sapiens
gacgtgtacagcacaga

SEQ ID NO: 1112450 - DNA, 18 bp, Homo sapiens
gacgtgtacagcacagaa

SEQ ID NO: 1112451 - DNA, 14 bp, Homo sapiens
gacgttgcctgaga

SEQ ID NO: 1112452 - DNA, 18 bp, Homo sapiens
gacgttgttgtcattgtc

SEQ ID NO: 1112453 - DNA, 18 bp, Homo sapiens
gacgtttacaagcccccc

SEQ ID NO: 1112454 - DNA, 16 bp, Homo sapiens
gacgtttcttctttct

SEQ ID NO: 1112455 - DNA, 23 bp, Homo sapiens
gacgtttttgtgctgtgggcagc

SEQ ID NO: 1112456 - DNA, 20 bp, Homo sapiens
gactaaactttttttctgta

SEQ ID NO: 1112457 - DNA, 14 bp, Homo sapiens
gactaaagagagaa

SEQ ID NO: 1112458 - DNA, 13 bp, Homo sapiens
gactaacaagaat

SEQ ID NO: 1112459 - DNA, 23 bp, Homo sapiens
gactaaccatgtgttatgttttc

SEQ ID NO: 1112460 - DNA, 17 bp, Homo sapiens
gactaaccctgtggttg

SEQ ID NO: 1112461 - DNA, 16 bp, Homo sapiens
gactaactatgcaata

SEQ ID NO: 1112462 - DNA, 19 bp, Homo sapiens
gactaagaattttgtttta

SEQ ID NO: 1112463 - DNA, 16 bp, Homo sapiens
gactaagagaagttgt

SEQ ID NO: 1112464 - DNA, 22 bp, Homo sapiens
gactaagccctgtcgagacact

SEQ ID NO: 1112465 - DNA, 20 bp, Homo sapiens
gactaatcagatgatggcca

SEQ ID NO: 1112466 - DNA, 17 bp, Homo sapiens
gactaatgttggacaga

SEQ ID NO: 1112467 - DNA, 13 bp, Homo sapiens
gactaattaaaat

SEQ ID NO: 1112468 - DNA, 17 bp, Homo sapiens
gactaattaaaatctgg

SEQ ID NO: 1112469 - DNA, 18 bp, Homo sapiens
gactaattttacatgttt

SEQ ID NO: 1112470 - DNA, 22 bp, Homo sapiens
gactaattttttaaatatttga

SEQ ID NO: 1112471 - DNA, 15 bp, Homo sapiens
gactacaaaaatgaa

SEQ ID NO: 1112472 - DNA, 15 bp, Homo sapiens
gactacaaaatacaa

SEQ ID NO: 1112473 - DNA, 21 bp, Homo sapiens
gactacaaaatacaatcctgt

SEQ ID NO: 1112474 - DNA, 18 bp, Homo sapiens
gactacacccaagcctga

SEQ ID NO: 1112475 - DNA, 14 bp, Homo sapiens
gactacatttagag

SEQ ID NO: 1112476 - DNA, 21 bp, Homo sapiens
gactaccccagtcccagggaa

SEQ ID NO: 1112477 - DNA, 14 bp, Homo sapiens
gactacctcagaac

SEQ ID NO: 1112478 - DNA, 18 bp, Homo sapiens
gactactactctgccaat

SEQ ID NO: 1112479 - DNA, 17 bp, Homo sapiens
gactactcccccaggtg

SEQ ID NO: 1112480 - DNA, 14 bp, Homo sapiens
gactactgctcctg

SEQ ID NO: 1112481 - DNA, 15 bp, Homo sapiens
gactactgctcctgt

SEQ ID NO: 1112482 - DNA, 19 bp, Homo sapiens
gactactgctcctgtggca

SEQ ID NO: 1112483 - DNA, 18 bp, Homo sapiens
gactacttgggagcaccg

SEQ ID NO: 1112484 - DNA, 16 bp, Homo sapiens
gactagaattctagtg

SEQ ID NO: 1112485 - DNA, 18 bp, Homo sapiens
gactagagctttctttca

SEQ ID NO: 1112486 - DNA, 15 bp, Homo sapiens
gactagaggcaggga

SEQ ID NO: 1112487 - DNA, 16 bp, Homo sapiens
gactagaggcagggag

SEQ ID NO: 1112488 - DNA, 17 bp, Homo sapiens
gactagaggcagggagg

SEQ ID NO: 1112489 - DNA, 14 bp, Homo sapiens
gactagaggccagg

SEQ ID NO: 1112490 - DNA, 17 bp, Homo sapiens
gactagagggacctctc

SEQ ID NO: 1112491 - DNA, 19 bp, Homo sapiens
gactagcaggctactggga

SEQ ID NO: 1112492 - DNA, 14 bp, Homo sapiens
gactagctgccttc

SEQ ID NO: 1112493 - DNA, 15 bp, Homo sapiens
gactaggcatgtcag

SEQ ID NO: 1112494 - DNA, 21 bp, Homo sapiens
gactagggattcaggctgctt

SEQ ID NO: 1112495 - DNA, 22 bp, Homo sapiens
gactaggtattgtctactctga

SEQ ID NO: 1112496 - DNA, 15 bp, Homo sapiens
gactagtagatttct

SEQ ID NO: 1112497 - DNA, 22 bp, Homo sapiens
gactagttctcttgtcctgtga

SEQ ID NO: 1112498 - DNA, 17 bp, Homo sapiens
gactatagcccaggtcc

SEQ ID NO: 1112499 - DNA, 20 bp, Homo sapiens
gactatatagagatgttttt

SEQ ID NO: 1112500 - DNA, 23 bp, Homo sapiens
gactatcacacactttctcttca

SEQ ID NO: 1112501 - DNA, 13 bp, Homo sapiens
gactatcaggtaa

SEQ ID NO: 1112502 - DNA, 18 bp, Homo sapiens
gactatctgtctggtggc

SEQ ID NO: 1112503 - DNA, 17 bp, Homo sapiens
gactatcttactatttc

SEQ ID NO: 1112504 - DNA, 19 bp, Homo sapiens
gactatcttactatttcac

SEQ ID NO: 1112505 - DNA, 15 bp, Homo sapiens
gactatgaaaagcta

SEQ ID NO: 1112506 - DNA, 14 bp, Homo sapiens
gactatgtccagat

SEQ ID NO: 1112507 - DNA, 20 bp, Homo sapiens
gactcaagaagtgaagaatg

SEQ ID NO: 1112508 - DNA, 22 bp, Homo sapiens
gactcaagaggaatctgtttct

SEQ ID NO: 1112509 - DNA, 15 bp, Homo sapiens
gactcacaagaagac

SEQ ID NO: 1112510 - DNA, 17 bp, Homo sapiens
gactcacaagaagacca

SEQ ID NO: 1112511 - DNA, 23 bp, Homo sapiens
gactcacacctgaactgaacacc

SEQ ID NO: 1112512 - DNA, 18 bp, Homo sapiens
gactcacactctctgcag

SEQ ID NO: 1112513 - DNA, 23 bp, Homo sapiens
gactcacactctctgcagcccag

SEQ ID NO: 1112514 - DNA, 17 bp, Homo sapiens
gactcacctgttacttg

SEQ ID NO: 1112515 - DNA, 13 bp, Homo sapiens
gactcacttgcca

SEQ ID NO: 1112516 - DNA, 17 bp, Homo sapiens
gactcagcaccacattg

SEQ ID NO: 1112517 - DNA, 22 bp, Homo sapiens
gactcagcaccacattgcctca

SEQ ID NO: 1112518 - DNA, 15 bp, Homo sapiens
gactcagcagaggca

SEQ ID NO: 1112519 - DNA, 11 bp, Homo sapiens
gactcagccct

SEQ ID NO: 1112520 - DNA, 16 bp, Homo sapiens
gactcagccctgaggt

SEQ ID NO: 1112521 - DNA, 14 bp, Homo sapiens
gactcagccttcag

SEQ ID NO: 1112522 - DNA, 20 bp, Homo sapiens
gactcagccttcagacagag

SEQ ID NO: 1112523 - DNA, 12 bp, Homo sapiens
gactcagctctg

SEQ ID NO: 1112524 - DNA, 22 bp, Homo sapiens
gactcaggatccagtgacatga

SEQ ID NO: 1112525 - DNA, 22 bp, Homo sapiens
gactcagggaccggtgctgcag

SEQ ID NO: 1112526 - DNA, 20 bp, Homo sapiens
gactcagggccatgcctgcc

SEQ ID NO: 1112527 - DNA, 21 bp, Homo sapiens
gactcagggccatgcctgccc

SEQ ID NO: 1112528 - DNA, 17 bp, Homo sapiens
gactcagggccccagca

SEQ ID NO: 1112529 - DNA, 18 bp, Homo sapiens
gactcagggccccagcac

SEQ ID NO: 1112530 - DNA, 13 bp, Homo sapiens
gactcagggctcc

SEQ ID NO: 1112531 - DNA, 16 bp, Homo sapiens
gactcagggctcctgg

SEQ ID NO: 1112532 - DNA, 13 bp, Homo sapiens
gactcaggtctgt

SEQ ID NO: 1112533 - DNA, 15 bp, Homo sapiens
gactcaggttccaga

SEQ ID NO: 1112534 - DNA, 24 bp, Homo sapiens
gactcagtatgctttccctgagga

SEQ ID NO: 1112535 - DNA, 16 bp, Homo sapiens
gactcatggcagctgt

SEQ ID NO: 1112536 - DNA, 20 bp, Homo sapiens
gactcattccctagatcttt

SEQ ID NO: 1112537 - DNA, 19 bp, Homo sapiens
gactccagaatctgctgtt

SEQ ID NO: 1112538 - DNA, 14 bp, Homo sapiens
gactccagagtctg

SEQ ID NO: 1112539 - DNA, 15 bp, Homo sapiens
gactccagccagcgc

SEQ ID NO: 1112540 - DNA, 20 bp, Homo sapiens
gactccagccagcgcctccc

SEQ ID NO: 1112541 - DNA, 22 bp, Homo sapiens
gactccagccagcgcctccctc

SEQ ID NO: 1112542 - DNA, 13 bp, Homo sapiens
gactccagcccct

SEQ ID NO: 1112543 - DNA, 20 bp, Homo sapiens
gactccagcctgcctggcag

SEQ ID NO: 1112544 - DNA, 17 bp, Homo sapiens
gactccaggcagcagac

SEQ ID NO: 1112545 - DNA, 12 bp, Homo sapiens
gactccaggccc

SEQ ID NO: 1112546 - DNA, 16 bp, Homo sapiens
gactccatagctcctt

SEQ ID NO: 1112547 - DNA, 15 bp, Homo sapiens
gactcccaaccctgg

SEQ ID NO: 1112548 - DNA, 17 bp, Homo sapiens
gactcccagcagagccc

SEQ ID NO: 1112549 - DNA, 15 bp, Homo sapiens
gactcccgccccggg

SEQ ID NO: 1112550 - DNA, 17 bp, Homo sapiens
gactcccgggccacgcc

SEQ ID NO: 1112551 - DNA, 22 bp, Homo sapiens
gactcccgggccacgccccagc

SEQ ID NO: 1112552 - DNA, 20 bp, Homo sapiens
gactccctccccacccaaga

SEQ ID NO: 1112553 - DNA, 12 bp, Homo sapiens
gactccctcctc

SEQ ID NO: 1112554 - DNA, 16 bp, Homo sapiens
gactccctcctcacct

SEQ ID NO: 1112555 - DNA, 20 bp, Homo sapiens
gactccctcctcacctctgg

SEQ ID NO: 1112556 - DNA, 15 bp, Homo sapiens
gactccggaggactg

SEQ ID NO: 1112557 - DNA, 22 bp, Homo sapiens
gactccggccctcctaccctgc

SEQ ID NO: 1112558 - DNA, 18 bp, Homo sapiens
gactccggggccccactg

SEQ ID NO: 1112559 - DNA, 21 bp, Homo sapiens
gactcctcaaaccacttgcct

SEQ ID NO: 1112560 - DNA, 23 bp, Homo sapiens
gactcctcaaaccacttgcctgg

SEQ ID NO: 1112561 - DNA, 20 bp, Homo sapiens
gactcctcctgggggctggc

SEQ ID NO: 1112562 - DNA, 20 bp, Homo sapiens
gactcctctggctttcccag

SEQ ID NO: 1112563 - DNA, 13 bp, Homo sapiens
gactcctctgggc

SEQ ID NO: 1112564 - DNA, 18 bp, Homo sapiens
gactcctctgggcctggg

SEQ ID NO: 1112565 - DNA, 17 bp, Homo sapiens
gacttagatattaaaat

SEQ ID NO: 1112566 - DNA, 19 bp, Homo sapiens
gacttagatattaaaattt

SEQ ID NO: 1112567 - DNA, 19 bp, Homo sapiens
gacttagcgtcaagacatt

SEQ ID NO: 1112568 - DNA, 18 bp, Homo sapiens
gacttatagtacatgata

SEQ ID NO: 1112569 - DNA, 15 bp, Homo sapiens
gacttatttctgctc

SEQ ID NO: 1112570 - DNA, 19 bp, Homo sapiens
gacttatttctgctctgga

SEQ ID NO: 1112571 - DNA, 15 bp, Homo sapiens
gacttattttctctg

SEQ ID NO: 1112572 - DNA, 18 bp, Homo sapiens
gacttattttgtcttatt

SEQ ID NO: 1112573 - DNA, 21 bp, Homo sapiens
gacttattttgtcttattctt

SEQ ID NO: 1112574 - DNA, 22 bp, Homo sapiens
gacttattttgtcttattctta

SEQ ID NO: 1112575 - DNA, 22 bp, Homo sapiens
gacttcacgaagtgttgcatgg

SEQ ID NO: 1112576 - DNA, 11 bp, Homo sapiens
gacttcactgt

SEQ ID NO: 1112577 - DNA, 12 bp, Homo sapiens
gacttcactgta

SEQ ID NO: 1112578 - DNA, 16 bp, Homo sapiens
gacttcagctgcctga

SEQ ID NO: 1112579 - DNA, 21 bp, Homo sapiens
gacttcaggaacaagtaatgt

SEQ ID NO: 1112580 - DNA, 13 bp, Homo sapiens
gacttcagtatgt

SEQ ID NO: 1112581 - DNA, 17 bp, Homo sapiens
gacttccacaaacctgg

SEQ ID NO: 1112582 - DNA, 15 bp, Homo sapiens
gacttccatgcctta

SEQ ID NO: 1112583 - DNA, 17 bp, Homo sapiens
gacttcccactgttctg

SEQ ID NO: 1112584 - DNA, 12 bp, Homo sapiens
gacttccccatc

SEQ ID NO: 1112585 - DNA, 22 bp, Homo sapiens
gacttccctggtcaccaaggca

SEQ ID NO: 1112586 - DNA, 17 bp, Homo sapiens
gacttcctctctacccc

SEQ ID NO: 1112587 - DNA, 22 bp, Homo sapiens
gacttcctctctaccccccacc

SEQ ID NO: 1112588 - DNA, 18 bp, Homo sapiens
gacttcctggggccccgc

SEQ ID NO: 1112589 - DNA, 14 bp, Homo sapiens
gacttccttgagac

SEQ ID NO: 1112590 - DNA, 18 bp, Homo sapiens
gacttccttgctctccct

SEQ ID NO: 1112591 - DNA, 20 bp, Homo sapiens
gacttctattttttaaagac

SEQ ID NO: 1112592 - DNA, 22 bp, Homo sapiens
gacttctccaggtctcacgggc

SEQ ID NO: 1112593 - DNA, 12 bp, Homo sapiens
gacttctccccc

SEQ ID NO: 1112594 - DNA, 21 bp, Homo sapiens
gacttctcccccgccctgccc

SEQ ID NO: 1112595 - DNA, 15 bp, Homo sapiens
gacttctcccctgcc

SEQ ID NO: 1112596 - DNA, 13 bp, Homo sapiens
gacttctctgaat

SEQ ID NO: 1112597 - DNA, 13 bp, Homo sapiens
gacttctcttaca

SEQ ID NO: 1112598 - DNA, 16 bp, Homo sapiens
gacttctcttacattt

SEQ ID NO: 1112599 - DNA, 12 bp, Homo sapiens
gacttctgagat

SEQ ID NO: 1112600 - DNA, 13 bp, Homo sapiens
gacttctgcagct

SEQ ID NO: 1112601 - DNA, 15 bp, Homo sapiens
gacttctgcctggag

SEQ ID NO: 1112602 - DNA, 17 bp, Homo sapiens
gacttctgcctggagac

SEQ ID NO: 1112603 - DNA, 16 bp, Homo sapiens
gacttctggaaggctg

SEQ ID NO: 1112604 - DNA, 15 bp, Homo sapiens
gacttctggagatgg

SEQ ID NO: 1112605 - DNA, 21 bp, Homo sapiens
gacttctggttgtatttctat

SEQ ID NO: 1112606 - DNA, 20 bp, Homo sapiens
gacttcttggttttctctct

SEQ ID NO: 1112607 - DNA, 22 bp, Homo sapiens
gacttcttggttttctctctgg

SEQ ID NO: 1112608 - DNA, 19 bp, Homo sapiens
gacttctttactaacactg

SEQ ID NO: 1112609 - DNA, 22 bp, Homo sapiens
gacttctttcaaattgagagaa

SEQ ID NO: 1112610 - DNA, 13 bp, Homo sapiens
gacttgaaagcat

SEQ ID NO: 1112611 - DNA, 21 bp, Homo sapiens
gacttgaaagcatccatgtgt

SEQ ID NO: 1112612 - DNA, 13 bp, Homo sapiens
gacttgaaggagt

SEQ ID NO: 1112613 - DNA, 20 bp, Homo sapiens
gacttgaatattcctggact

SEQ ID NO: 1112614 - DNA, 15 bp, Homo sapiens
gacttgaatgctgcc

SEQ ID NO: 1112615 - DNA, 21 bp, Homo sapiens
gacttgagaagtctaattcac

SEQ ID NO: 1112616 - DNA, 16 bp, Homo sapiens
gacttgagccactcct

SEQ ID NO: 1112617 - DNA, 17 bp, Homo sapiens
gacttgcacagggattc

SEQ ID NO: 1112618 - DNA, 18 bp, Homo sapiens
gacttgcacagggattct

SEQ ID NO: 1112619 - DNA, 14 bp, Homo sapiens
gacttgctgtccag

SEQ ID NO: 1112620 - DNA, 19 bp, Homo sapiens
gacttgctgttttgttctg

SEQ ID NO: 1112621 - DNA, 18 bp, Homo sapiens
gacttggacatctctctg

SEQ ID NO: 1112622 - DNA, 19 bp, Homo sapiens
gacttggacatctctctgg

SEQ ID NO: 1112623 - DNA, 19 bp, Homo sapiens
gacttggagactcctggtc

SEQ ID NO: 1112624 - DNA, 20 bp, Homo sapiens
gacttggagagcaaaggccc

SEQ ID NO: 1112625 - DNA, 11 bp, Homo sapiens
gacttggctgt

SEQ ID NO: 1112626 - DNA, 18 bp, Homo sapiens
gacttggctgtccttccc

SEQ ID NO: 1112627 - DNA, 23 bp, Homo sapiens
gacttggtaagatgactctgaga

SEQ ID NO: 1112628 - DNA, 16 bp, Homo sapiens
gacttggtcaccagct

SEQ ID NO: 1112629 - DNA, 14 bp, Homo sapiens
gacttggtctgatt

SEQ ID NO: 1112630 - DNA, 20 bp, Homo sapiens
gacttgtaggaatctgcctt

SEQ ID NO: 1112631 - DNA, 22 bp, Homo sapiens
gacttgtaggaatctgccttcc

SEQ ID NO: 1112632 - DNA, 23 bp, Homo sapiens
gacttgtaggaatctgccttcca

SEQ ID NO: 1112633 - DNA, 22 bp, Homo sapiens
gacttgtatagcatgaaataaa

SEQ ID NO: 1112634 - DNA, 13 bp, Homo sapiens
gacttgtgtccca

SEQ ID NO: 1112635 - DNA, 22 bp, Homo sapiens
gacttgtttgtcttccattcca

SEQ ID NO: 1112636 - DNA, 15 bp, Homo sapiens
gacttgtttttgcac

SEQ ID NO: 1112637 - DNA, 16 bp, Homo sapiens
gacttgtttttgcaca

SEQ ID NO: 1112638 - DNA, 15 bp, Homo sapiens
gactttaaaagaaaa

SEQ ID NO: 1112639 - DNA, 15 bp, Homo sapiens
gactttaatttatgt

SEQ ID NO: 1112640 - DNA, 23 bp, Homo sapiens
gactttacaggaggttgtggatg

SEQ ID NO: 1112641 - DNA, 17 bp, Homo sapiens
gactttagaaataaatg

SEQ ID NO: 1112642 - DNA, 19 bp, Homo sapiens
gactttagaataatattgt

SEQ ID NO: 1112643 - DNA, 19 bp, Homo sapiens
gactttatcctgagtccct

SEQ ID NO: 1112644 - DNA, 21 bp, Homo sapiens
gactttatttttctaagtgta

SEQ ID NO: 1112645 - DNA, 16 bp, Homo sapiens
gactttcacaccatta

SEQ ID NO: 1112646 - DNA, 12 bp, Homo sapiens
gactttcaggta

SEQ ID NO: 1112647 - DNA, 14 bp, Homo sapiens
gactttcaggtact

SEQ ID NO: 1112648 - DNA, 15 bp, Homo sapiens
gactttccaccccct

SEQ ID NO: 1112649 - DNA, 16 bp, Homo sapiens
gactttccaccccctc

SEQ ID NO: 1112650 - DNA, 17 bp, Homo sapiens
gactttcccaaatgtat

SEQ ID NO: 1112651 - DNA, 13 bp, Homo sapiens
gactttctctaat

SEQ ID NO: 1112652 - DNA, 16 bp, Homo sapiens
gactttctctaataat

SEQ ID NO: 1112653 - DNA, 15 bp, Homo sapiens
gactttctgcctgga

SEQ ID NO: 1112654 - DNA, 17 bp, Homo sapiens
gactttgacaattactc

SEQ ID NO: 1112655 - DNA, 14 bp, Homo sapiens
gactttgagctgag

SEQ ID NO: 1112656 - DNA, 15 bp, Homo sapiens
gactttgatccttgg

SEQ ID NO: 1112657 - DNA, 19 bp, Homo sapiens
gactttgcccccttgccca

SEQ ID NO: 1112658 - DNA, 20 bp, Homo sapiens
gactttgctgcattttacac

SEQ ID NO: 1112659 - DNA, 13 bp, Homo sapiens
gactttgctgtta

SEQ ID NO: 1112660 - DNA, 15 bp, Homo sapiens
gactttgcttcccat

SEQ ID NO: 1112661 - DNA, 14 bp, Homo sapiens
gactttgcttgctt

SEQ ID NO: 1112662 - DNA, 15 bp, Homo sapiens
gactttgcttgcttt

SEQ ID NO: 1112663 - DNA, 17 bp, Homo sapiens
gactttgcttgctttga

SEQ ID NO: 1112664 - DNA, 20 bp, Homo sapiens
gactttgtgttcatttcatt

SEQ ID NO: 1112665 - DNA, 17 bp, Homo sapiens
gacttttatgtgagatt

SEQ ID NO: 1112666 - DNA, 22 bp, Homo sapiens
gacttttctgattaatatattt

SEQ ID NO: 1112667 - DNA, 12 bp, Homo sapiens
gacttttctgta

SEQ ID NO: 1112668 - DNA, 18 bp, Homo sapiens
gacttttctgtaattcag

SEQ ID NO: 1112669 - DNA, 17 bp, Homo sapiens
gacttttgttctcttct

SEQ ID NO: 1112670 - DNA, 18 bp, Homo sapiens
gacttttgttctcttctg

SEQ ID NO: 1112671 - DNA, 17 bp, Homo sapiens
gactttttagccagtga

SEQ ID NO: 1112672 - DNA, 19 bp, Homo sapiens
gactttttagccagtgact

SEQ ID NO: 1112673 - DNA, 14 bp, Homo sapiens
gacttttttaaact

SEQ ID NO: 1112674 - DNA, 18 bp, Homo sapiens
gacttttttttttctttt

SEQ ID NO: 1112675 - DNA, 13 bp, Homo sapiens
gagaaaaaaaacc

SEQ ID NO: 1112676 - DNA, 22 bp, Homo sapiens
gagaaaaaaaaccttgtaaaaa

SEQ ID NO: 1112677 - DNA, 15 bp, Homo sapiens
gagaaaaagaaatgc

SEQ ID NO: 1112678 - DNA, 16 bp, Homo sapiens
gagaaaaagaaatgca

SEQ ID NO: 1112679 - DNA, 21 bp, Homo sapiens
gagaaaaatattcaagtaaca

SEQ ID NO: 1112680 - DNA, 23 bp, Homo sapiens
gagaaaaatattcaagtaacact

SEQ ID NO: 1112681 - DNA, 10 bp, Homo sapiens
gagaaaagaa

SEQ ID NO: 1112682 - DNA, 19 bp, Homo sapiens
gagaaaagaaaaaaaaaga

SEQ ID NO: 1112683 - DNA, 19 bp, Homo sapiens
gagaaaagggaaaaaagaa

SEQ ID NO: 1112684 - DNA, 16 bp, Homo sapiens
gagaaaataaatttaa

SEQ ID NO: 1112685 - DNA, 19 bp, Homo sapiens
gagaaaatataataaaaga

SEQ ID NO: 1112686 - DNA, 17 bp, Homo sapiens
gagaaaatatatgtatt

SEQ ID NO: 1112687 - DNA, 16 bp, Homo sapiens
gagagaatagagctgc

SEQ ID NO: 1112688 - DNA, 17 bp, Homo sapiens
gagagaatagagctgcc

SEQ ID NO: 1112689 - DNA, 18 bp, Homo sapiens
gagagaatagagctgcca

SEQ ID NO: 1112690 - DNA, 19 bp, Homo sapiens
gagagaatagagctgccac

SEQ ID NO: 1112691 - DNA, 14 bp, Homo sapiens
gagagaatctgcct

SEQ ID NO: 1112692 - DNA, 13 bp, Homo sapiens
gagagacacagat

SEQ ID NO: 1112693 - DNA, 13 bp, Homo sapiens
gagagacaggcag

SEQ ID NO: 1112694 - DNA, 14 bp, Homo sapiens
gagagacaggcagc

SEQ ID NO: 1112695 - DNA, 14 bp, Homo sapiens
gagagaccctgcaa

SEQ ID NO: 1112696 - DNA, 15 bp, Homo sapiens
gagagacctcatcag

SEQ ID NO: 1112697 - DNA, 21 bp, Homo sapiens
gagagacgccactccctggga

SEQ ID NO: 1112698 - DNA, 14 bp, Homo sapiens
gagagactaacctt

SEQ ID NO: 1112699 - DNA, 17 bp, Homo sapiens
gagagactgaaagcagc

SEQ ID NO: 1112700 - DNA, 19 bp, Homo sapiens
gagagactgaaagcagcag

SEQ ID NO: 1112701 - DNA, 13 bp, Homo sapiens
gagagactgatgg

SEQ ID NO: 1112702 - DNA, 13 bp, Homo sapiens
gagagagaaaaaa

SEQ ID NO: 1112703 - DNA, 12 bp, Homo sapiens
gagagagactga

SEQ ID NO: 1112704 - DNA, 12 bp, Homo sapiens
gagagagaggac

SEQ ID NO: 1112705 - DNA, 15 bp, Homo sapiens
gagagagaggcagaa

SEQ ID NO: 1112706 - DNA, 18 bp, Homo sapiens
gagagaggaggcctggac

SEQ ID NO: 1112707 - DNA, 19 bp, Homo sapiens
gagagaggctgcctcagcc

SEQ ID NO: 1112708 - DNA, 19 bp, Homo sapiens
gagagaggttgaaaaacaa

SEQ ID NO: 1112709 - DNA, 16 bp, Homo sapiens
gagagcaaaggcccat

SEQ ID NO: 1112710 - DNA, 17 bp, Homo sapiens
gagagcactagaagtgg

SEQ ID NO: 1112711 - DNA, 22 bp, Homo sapiens
gagagcactagaagtggtttcc

SEQ ID NO: 1112712 - DNA, 15 bp, Homo sapiens
gagagcactgcctct

SEQ ID NO: 1112713 - DNA, 16 bp, Homo sapiens
gagagcactgcctcta

SEQ ID NO: 1112714 - DNA, 20 bp, Homo sapiens
gagagcactgcctctatgcc

SEQ ID NO: 1112715 - DNA, 23 bp, Homo sapiens
gagagcactgcctctatgccctg

SEQ ID NO: 1112716 - DNA, 20 bp, Homo sapiens
gagagcagcaggtgctgtgc

SEQ ID NO: 1112717 - DNA, 13 bp, Homo sapiens
gagagcagctccc

SEQ ID NO: 1112718 - DNA, 20 bp, Homo sapiens
gagagcagctccctttctca

SEQ ID NO: 1112719 - DNA, 11 bp, Homo sapiens
gagagcagctg

SEQ ID NO: 1112720 - DNA, 19 bp, Homo sapiens
gagagcagctggctctcca

SEQ ID NO: 1112721 - DNA, 13 bp, Homo sapiens
gagagcaggcagg

SEQ ID NO: 1112722 - DNA, 21 bp, Homo sapiens
gagagcaggctggcagctctc

SEQ ID NO: 1112723 - DNA, 23 bp, Homo sapiens
gagagcaggctggcagctctcca

SEQ ID NO: 1112724 - DNA, 18 bp, Homo sapiens
gagagcaggggagcttgg

SEQ ID NO: 1112725 - DNA, 18 bp, Homo sapiens
gagagccactgggcccct

SEQ ID NO: 1112726 - DNA, 19 bp, Homo sapiens
gagagccactgggcccctg

SEQ ID NO: 1112727 - DNA, 11 bp, Homo sapiens
gagagccagcc

SEQ ID NO: 1112728 - DNA, 14 bp, Homo sapiens
gagagccagccctc

SEQ ID NO: 1112729 - DNA, 12 bp, Homo sapiens
gagagccagctc

SEQ ID NO: 1112730 - DNA, 16 bp, Homo sapiens
gagagccaggatgccc

SEQ ID NO: 1112731 - DNA, 12 bp, Homo sapiens
gagagccaggct

SEQ ID NO: 1112732 - DNA, 11 bp, Homo sapiens
gagagcccagc

SEQ ID NO: 1112733 - DNA, 14 bp, Homo sapiens
gagagccccagctg

SEQ ID NO: 1112734 - DNA, 15 bp, Homo sapiens
gagagccccagctga

SEQ ID NO: 1112735 - DNA, 18 bp, Homo sapiens
gagagcccccaccagcag

SEQ ID NO: 1112736 - DNA, 14 bp, Homo sapiens
gagagccctgaggc

SEQ ID NO: 1112737 - DNA, 19 bp, Homo sapiens
gagagccctgaggcctaga

SEQ ID NO: 1112738 - DNA, 14 bp, Homo sapiens
gagagccctgctgt

SEQ ID NO: 1112739 - DNA, 16 bp, Homo sapiens
gagagccctgctgtgg

SEQ ID NO: 1112740 - DNA, 11 bp, Homo sapiens
gagagccctgg

SEQ ID NO: 1112741 - DNA, 17 bp, Homo sapiens
gagagccgtggtccctg

SEQ ID NO: 1112742 - DNA, 19 bp, Homo sapiens
gagagcctcttagtgattg

SEQ ID NO: 1112743 - DNA, 14 bp, Homo sapiens
gagagcctgctccc

SEQ ID NO: 1112744 - DNA, 17 bp, Homo sapiens
gagagcctgctccccca

SEQ ID NO: 1112745 - DNA, 22 bp, Homo sapiens
gagagcctgctcccccaccccc

SEQ ID NO: 1112746 - DNA, 13 bp, Homo sapiens
gagagcctgctgg

SEQ ID NO: 1112747 - DNA, 13 bp, Homo sapiens
gagagcctggtgc

SEQ ID NO: 1112748 - DNA, 21 bp, Homo sapiens
gagagctagcagcagggaggg

SEQ ID NO: 1112749 - DNA, 11 bp, Homo sapiens
gagagctgcct

SEQ ID NO: 1112750 - DNA, 12 bp, Homo sapiens
gagagctggtga

SEQ ID NO: 1112751 - DNA, 23 bp, Homo sapiens
gagagctggtgactttggggaca

SEQ ID NO: 1112752 - DNA, 20 bp, Homo sapiens
gagagctgtattaagtgact

SEQ ID NO: 1112753 - DNA, 21 bp, Homo sapiens
gagagctgtattaagtgactg

SEQ ID NO: 1112754 - DNA, 14 bp, Homo sapiens
gagagctttctgcc

SEQ ID NO: 1112755 - DNA, 15 bp, Homo sapiens
gagagctttctgcct

SEQ ID NO: 1112756 - DNA, 23 bp, Homo sapiens
gagagctttctgtccttttggca

SEQ ID NO: 1112757 - DNA, 22 bp, Homo sapiens
gagaggaaataacagagagaat

SEQ ID NO: 1112758 - DNA, 18 bp, Homo sapiens
gagaggaaggacccctca

SEQ ID NO: 1112759 - DNA, 19 bp, Homo sapiens
gagaggaatgcctgtgtga

SEQ ID NO: 1112760 - DNA, 12 bp, Homo sapiens
gagaggacagag

SEQ ID NO: 1112761 - DNA, 18 bp, Homo sapiens
gagaggacagcttgagcc

SEQ ID NO: 1112762 - DNA, 19 bp, Homo sapiens
gagaggacggccctgcctg

SEQ ID NO: 1112763 - DNA, 18 bp, Homo sapiens
gagaggagaaaaaaaaag

SEQ ID NO: 1112764 - DNA, 24 bp, Homo sapiens
gagaggagaaaaaaaaagtgaaaa

SEQ ID NO: 1112765 - DNA, 15 bp, Homo sapiens
gagaggagaaacaca

SEQ ID NO: 1112766 - DNA, 23 bp, Homo sapiens
gagaggagaacagtaggattgct

SEQ ID NO: 1112767 - DNA, 19 bp, Homo sapiens
gagaggagcacctgaaccc

SEQ ID NO: 1112768 - DNA, 14 bp, Homo sapiens
gagaggaggcctgg

SEQ ID NO: 1112769 - DNA, 15 bp, Homo sapiens
gagaggaggcctgga

SEQ ID NO: 1112770 - DNA, 12 bp, Homo sapiens
gagaggagggac

SEQ ID NO: 1112771 - DNA, 13 bp, Homo sapiens
gagaggagggttc

SEQ ID NO: 1112772 - DNA, 12 bp, Homo sapiens
gagaggatgaat

SEQ ID NO: 1112773 - DNA, 21 bp, Homo sapiens
gagaggatgaatgtatgtgca

SEQ ID NO: 1112774 - DNA, 14 bp, Homo sapiens
gagaggatgtgcaa

SEQ ID NO: 1112775 - DNA, 15 bp, Homo sapiens
gagaggcaatggcca

SEQ ID NO: 1112776 - DNA, 16 bp, Homo sapiens
gagaggcagagaaaga

SEQ ID NO: 1112777 - DNA, 13 bp, Homo sapiens
gagaggcagccag

SEQ ID NO: 1112778 - DNA, 15 bp, Homo sapiens
gagaggcagccagac

SEQ ID NO: 1112779 - DNA, 11 bp, Homo sapiens
gagaggcagct

SEQ ID NO: 1112780 - DNA, 12 bp, Homo sapiens
gagaggccatga

SEQ ID NO: 1112781 - DNA, 16 bp, Homo sapiens
gagaggccctctggag

SEQ ID NO: 1112782 - DNA, 12 bp, Homo sapiens
gagaggcctgct

SEQ ID NO: 1112783 - DNA, 14 bp, Homo sapiens
gagaggcctggggt

SEQ ID NO: 1112784 - DNA, 20 bp, Homo sapiens
gagaggcctggggtgggaca

SEQ ID NO: 1112785 - DNA, 15 bp, Homo sapiens
gagaggccttttgga

SEQ ID NO: 1112786 - DNA, 21 bp, Homo sapiens
gagaggcgagtcaccctcctc

SEQ ID NO: 1112787 - DNA, 13 bp, Homo sapiens
gagaggcggcctc

SEQ ID NO: 1112788 - DNA, 15 bp, Homo sapiens
gagaggcggcctcgt

SEQ ID NO: 1112789 - DNA, 14 bp, Homo sapiens
gagaggctctccgt

SEQ ID NO: 1112790 - DNA, 18 bp, Homo sapiens
gagaggctgtctggggcc

SEQ ID NO: 1112791 - DNA, 17 bp, Homo sapiens
gagagggacacatgccc

SEQ ID NO: 1112792 - DNA, 10 bp, Homo sapiens
gagagggaga

SEQ ID NO: 1112793 - DNA, 17 bp, Homo sapiens
gagagggatttccctgc

SEQ ID NO: 1112794 - DNA, 23 bp, Homo sapiens
gagagggatttccctgcagacct

SEQ ID NO: 1112795 - DNA, 17 bp, Homo sapiens
gagagggcccagctgta

SEQ ID NO: 1112796 - DNA, 19 bp, Homo sapiens
gagagggcccagctgtagc

SEQ ID NO: 1112797 - DNA, 17 bp, Homo sapiens
gagagggctagccctga

SEQ ID NO: 1112798 - DNA, 21 bp, Homo sapiens
gagagggctagccctgagccc

SEQ ID NO: 1112799 - DNA, 21 bp, Homo sapiens
gagagggctcgaggggtgggc

SEQ ID NO: 1112800 - DNA, 18 bp, Homo sapiens
gagagggctggtccttat

SEQ ID NO: 1112801 - DNA, 21 bp, Homo sapiens
gagagggctgttggacagctg

SEQ ID NO: 1112802 - DNA, 13 bp, Homo sapiens
gagaggggaagag

SEQ ID NO: 1112803 - DNA, 18 bp, Homo sapiens
gagaggggaagggccagt

SEQ ID NO: 1112804 - DNA, 21 bp, Homo sapiens
gagaggggaataatagaagaa

SEQ ID NO: 1112805 - DNA, 14 bp, Homo sapiens
gagaggggagagag

SEQ ID NO: 1112806 - DNA, 19 bp, Homo sapiens
gagaggggagggctcctgg

SEQ ID NO: 1112807 - DNA, 20 bp, Homo sapiens
gagaggggagggctcctggg

SEQ ID NO: 1112808 - DNA, 21 bp, Homo sapiens
gagaggggagggctcctgggg

SEQ ID NO: 1112809 - DNA, 13 bp, Homo sapiens
gagaggggcacag

SEQ ID NO: 1112810 - DNA, 14 bp, Homo sapiens
gagagggggccgga

SEQ ID NO: 1112811 - DNA, 22 bp, Homo sapiens
gagcagctaactccgagagcag

SEQ ID NO: 1112812 - DNA, 12 bp, Homo sapiens
gagcagctagct

SEQ ID NO: 1112813 - DNA, 19 bp, Homo sapiens
gagcagctattttaagcca

SEQ ID NO: 1112814 - DNA, 18 bp, Homo sapiens
gagcagctccctttctca

SEQ ID NO: 1112815 - DNA, 15 bp, Homo sapiens
gagcagctggctctc

SEQ ID NO: 1112816 - DNA, 16 bp, Homo sapiens
gagcagctggggtagg

SEQ ID NO: 1112817 - DNA, 17 bp, Homo sapiens
gagcagcttccttctgg

SEQ ID NO: 1112818 - DNA, 20 bp, Homo sapiens
gagcagcttcttgggctgag

SEQ ID NO: 1112819 - DNA, 22 bp, Homo sapiens
gagcagctttaaactcagggac

SEQ ID NO: 1112820 - DNA, 22 bp, Homo sapiens
gagcaggaagcattcagagagc

SEQ ID NO: 1112821 - DNA, 16 bp, Homo sapiens
gagcaggacagccagc

SEQ ID NO: 1112822 - DNA, 19 bp, Homo sapiens
gagcaggacagccagcagc

SEQ ID NO: 1112823 - DNA, 20 bp, Homo sapiens
gagcaggacctcccttccga

SEQ ID NO: 1112824 - DNA, 16 bp, Homo sapiens
gagcaggactccaggc

SEQ ID NO: 1112825 - DNA, 20 bp, Homo sapiens
gagcaggagccccgccacag

SEQ ID NO: 1112826 - DNA, 14 bp, Homo sapiens
gagcaggagcccct

SEQ ID NO: 1112827 - DNA, 23 bp, Homo sapiens
gagcaggcaggggcatctgtctg

SEQ ID NO: 1112828 - DNA, 20 bp, Homo sapiens
gagcaggctggcagctctcc

SEQ ID NO: 1112829 - DNA, 20 bp, Homo sapiens
gagcagggattaacctctgc

SEQ ID NO: 1112830 - DNA, 21 bp, Homo sapiens
gagcagggattaacctctgca

SEQ ID NO: 1112831 - DNA, 22 bp, Homo sapiens
gagcagggattaacctctgcac

SEQ ID NO: 1112832 - DNA, 17 bp, Homo sapiens
gagcaggggagcttggg

SEQ ID NO: 1112833 - DNA, 18 bp, Homo sapiens
gagcaggggagcttggga

SEQ ID NO: 1112834 - DNA, 19 bp, Homo sapiens
gagcaggggagcttgggac

SEQ ID NO: 1112835 - DNA, 13 bp, Homo sapiens
gagcaggggcagg

SEQ ID NO: 1112836 - DNA, 18 bp, Homo sapiens
gagcaggggcaggcgcag

SEQ ID NO: 1112837 - DNA, 16 bp, Homo sapiens
gagcagtatcatgaag

SEQ ID NO: 1112838 - DNA, 17 bp, Homo sapiens
gagcagtcagggtggga

SEQ ID NO: 1112839 - DNA, 16 bp, Homo sapiens
gagcagtcctgcctca

SEQ ID NO: 1112840 - DNA, 23 bp, Homo sapiens
gagcagtggctggtccagggcta

SEQ ID NO: 1112841 - DNA, 13 bp, Homo sapiens
gagcagtgggcag

SEQ ID NO: 1112842 - DNA, 23 bp, Homo sapiens
gagcagtgtcctgtgctttctgc

SEQ ID NO: 1112843 - DNA, 12 bp, Homo sapiens
gagcagtgtctt

SEQ ID NO: 1112844 - DNA, 17 bp, Homo sapiens
gagcagtgtcttccata

SEQ ID NO: 1112845 - DNA, 17 bp, Homo sapiens
gagcagttttcccctgg

SEQ ID NO: 1112846 - DNA, 18 bp, Homo sapiens
gagcagttttcccctggc

SEQ ID NO: 1112847 - DNA, 15 bp, Homo sapiens
gagcataaaacctaa

SEQ ID NO: 1112848 - DNA, 15 bp, Homo sapiens
gagcataatgctccc

SEQ ID NO: 1112849 - DNA, 20 bp, Homo sapiens
gagcataatttaaaaatata

SEQ ID NO: 1112850 - DNA, 21 bp, Homo sapiens
gagcatacatcttaaatcttt

SEQ ID NO: 1112851 - DNA, 14 bp, Homo sapiens
gagcatagaagcca

SEQ ID NO: 1112852 - DNA, 20 bp, Homo sapiens
gagcatagaagccacatcgt

SEQ ID NO: 1112853 - DNA, 14 bp, Homo sapiens
gagcatatactggt

SEQ ID NO: 1112854 - DNA, 19 bp, Homo sapiens
gagcatatctggtatatgt

SEQ ID NO: 1112855 - DNA, 22 bp, Homo sapiens
gagcatatctggtatatgtcat

SEQ ID NO: 1112856 - DNA, 23 bp, Homo sapiens
gagcatattttcttacttttatt

SEQ ID NO: 1112857 - DNA, 15 bp, Homo sapiens
gagcatcagccagtg

SEQ ID NO: 1112858 - DNA, 17 bp, Homo sapiens
gagcatccccctcctct

SEQ ID NO: 1112859 - DNA, 14 bp, Homo sapiens
gagcatcctgagcc

SEQ ID NO: 1112860 - DNA, 14 bp, Homo sapiens
gagcatcctgcaag

SEQ ID NO: 1112861 - DNA, 22 bp, Homo sapiens
gagcatctcttgaggccaggag

SEQ ID NO: 1112862 - DNA, 23 bp, Homo sapiens
gagcatctcttgaggccaggagt

SEQ ID NO: 1112863 - DNA, 13 bp, Homo sapiens
gagcatctgactc

SEQ ID NO: 1112864 - DNA, 18 bp, Homo sapiens
gagcatctgcaacaaaaa

SEQ ID NO: 1112865 - DNA, 20 bp, Homo sapiens
gagcatctgtttacctggca

SEQ ID NO: 1112866 - DNA, 17 bp, Homo sapiens
gagcatcttgccagcct

SEQ ID NO: 1112867 - DNA, 23 bp, Homo sapiens
gagcatgatgggaatagggagac

SEQ ID NO: 1112868 - DNA, 17 bp, Homo sapiens
gagcatgatttgaaaaa

SEQ ID NO: 1112869 - DNA, 16 bp, Homo sapiens
gagcatgcacagctgc

SEQ ID NO: 1112870 - DNA, 18 bp, Homo sapiens
gagcatgcacagctgctt

SEQ ID NO: 1112871 - DNA, 20 bp, Homo sapiens
gagcatgcacagctgcttgt

SEQ ID NO: 1112872 - DNA, 14 bp, Homo sapiens
gagcatgcacatgc

SEQ ID NO: 1112873 - DNA, 20 bp, Homo sapiens
gagcatgcggagccagcagg

SEQ ID NO: 1112874 - DNA, 19 bp, Homo sapiens
gagcatgtaaaagcggaaa

SEQ ID NO: 1112875 - DNA, 18 bp, Homo sapiens
gagcattaactaaatgct

SEQ ID NO: 1112876 - DNA, 18 bp, Homo sapiens
gagcattacgtgagccag

SEQ ID NO: 1112877 - DNA, 21 bp, Homo sapiens
gagcattacgtgagccaggta

SEQ ID NO: 1112878 - DNA, 13 bp, Homo sapiens
gagcattccagta

SEQ ID NO: 1112879 - DNA, 15 bp, Homo sapiens
gagcatttctcatca

SEQ ID NO: 1112880 - DNA, 19 bp, Homo sapiens
gagcatttctcatcagtag

SEQ ID NO: 1112881 - DNA, 20 bp, Homo sapiens
gagcattttgataccagaag

SEQ ID NO: 1112882 - DNA, 16 bp, Homo sapiens
gagcatttttaaggga

SEQ ID NO: 1112883 - DNA, 16 bp, Homo sapiens
gagccaaaagaggggg

SEQ ID NO: 1112884 - DNA, 20 bp, Homo sapiens
gagccaaattcatcctctta

SEQ ID NO: 1112885 - DNA, 14 bp, Homo sapiens
gagccaacctcggc

SEQ ID NO: 1112886 - DNA, 14 bp, Homo sapiens
gagccaactgattt

SEQ ID NO: 1112887 - DNA, 21 bp, Homo sapiens
gagccaagatcgcgccactgc

SEQ ID NO: 1112888 - DNA, 15 bp, Homo sapiens
gagccaagctgcaca

SEQ ID NO: 1112889 - DNA, 11 bp, Homo sapiens
gagccaaggcc

SEQ ID NO: 1112890 - DNA, 17 bp, Homo sapiens
gagccaagggagggaag

SEQ ID NO: 1112891 - DNA, 14 bp, Homo sapiens
gagccaagtccaga

SEQ ID NO: 1112892 - DNA, 16 bp, Homo sapiens
gagccaagtcctccct

SEQ ID NO: 1112893 - DNA, 13 bp, Homo sapiens
gagccacaggcag

SEQ ID NO: 1112894 - DNA, 15 bp, Homo sapiens
gagccacagtcactg

SEQ ID NO: 1112895 - DNA, 17 bp, Homo sapiens
gagccacagtcactgga

SEQ ID NO: 1112896 - DNA, 12 bp, Homo sapiens
gagccaccagtt

SEQ ID NO: 1112897 - DNA, 13 bp, Homo sapiens
gagccaccagttc

SEQ ID NO: 1112898 - DNA, 20 bp, Homo sapiens
gagccaccgtgcctggccag

SEQ ID NO: 1112899 - DNA, 21 bp, Homo sapiens
gagccaccgtgcctggccaga

SEQ ID NO: 1112900 - DNA, 12 bp, Homo sapiens
gagccacctgca

SEQ ID NO: 1112901 - DNA, 20 bp, Homo sapiens
gagccacctgcaagatggac

SEQ ID NO: 1112902 - DNA, 14 bp, Homo sapiens
gagccactcctctg

SEQ ID NO: 1112903 - DNA, 15 bp, Homo sapiens
gagccactcctctga

SEQ ID NO: 1112904 - DNA, 15 bp, Homo sapiens
gagccactccttcct

SEQ ID NO: 1112905 - DNA, 21 bp, Homo sapiens
gagccactccttccttcagga

SEQ ID NO: 1112906 - DNA, 16 bp, Homo sapiens
gagccactgggcccct

SEQ ID NO: 1112907 - DNA, 20 bp, Homo sapiens
gagccactgggcccctgtcc

SEQ ID NO: 1112908 - DNA, 23 bp, Homo sapiens
gagccactgggcccctgtcccca

SEQ ID NO: 1112909 - DNA, 16 bp, Homo sapiens
gagccagaaatgggca

SEQ ID NO: 1112910 - DNA, 18 bp, Homo sapiens
gagccagaaatgggcagt

SEQ ID NO: 1112911 - DNA, 15 bp, Homo sapiens
gagccagagagaaca

SEQ ID NO: 1112912 - DNA, 14 bp, Homo sapiens
gagccagccctccc

SEQ ID NO: 1112913 - DNA, 20 bp, Homo sapiens
gagccagccctccctgtcct

SEQ ID NO: 1112914 - DNA, 11 bp, Homo sapiens
gagccagcctg

SEQ ID NO: 1112915 - DNA, 13 bp, Homo sapiens
gagccagcctggg

SEQ ID NO: 1112916 - DNA, 20 bp, Homo sapiens
gagccagctgctttttgtga

SEQ ID NO: 1112917 - DNA, 15 bp, Homo sapiens
gagccaggagaagct

SEQ ID NO: 1112918 - DNA, 21 bp, Homo sapiens
gagccaggcctgggtctgtgt

SEQ ID NO: 1112919 - DNA, 12 bp, Homo sapiens
gagccagggctg

SEQ ID NO: 1112920 - DNA, 11 bp, Homo sapiens
gagccagggta

SEQ ID NO: 1112921 - DNA, 13 bp, Homo sapiens
gagccagggtgag

SEQ ID NO: 1112922 - DNA, 19 bp, Homo sapiens
gagccaggtaatgagggac

SEQ ID NO: 1112923 - DNA, 13 bp, Homo sapiens
gagccagtcccag

SEQ ID NO: 1112924 - DNA, 15 bp, Homo sapiens
gagccagtcccaggg

SEQ ID NO: 1112925 - DNA, 22 bp, Homo sapiens
gagccagtgggccagccacaga

SEQ ID NO: 1112926 - DNA, 19 bp, Homo sapiens
gagccagttgtcctatgga

SEQ ID NO: 1112927 - DNA, 14 bp, Homo sapiens
gagccatacataaa

SEQ ID NO: 1112928 - DNA, 23 bp, Homo sapiens
gagccataccgaccatcgtccag

SEQ ID NO: 1112929 - DNA, 19 bp, Homo sapiens
gagccatataagtttgaag

SEQ ID NO: 1112930 - DNA, 18 bp, Homo sapiens
gagccatcaccctcaccc

SEQ ID NO: 1112931 - DNA, 21 bp, Homo sapiens
gagccatcccttcggagccaa

SEQ ID NO: 1112932 - DNA, 16 bp, Homo sapiens
gagccatgaagcatta

SEQ ID NO: 1112933 - DNA, 18 bp, Homo sapiens
gagcttcttgtttccttg

SEQ ID NO: 1112934 - DNA, 13 bp, Homo sapiens
gagcttgaagatt

SEQ ID NO: 1112935 - DNA, 13 bp, Homo sapiens
gagcttgaggtgg

SEQ ID NO: 1112936 - DNA, 20 bp, Homo sapiens
gagcttgatctgtgatttct

SEQ ID NO: 1112937 - DNA, 13 bp, Homo sapiens
gagcttgctccag

SEQ ID NO: 1112938 - DNA, 21 bp, Homo sapiens
gagcttgctccagattctgat

SEQ ID NO: 1112939 - DNA, 14 bp, Homo sapiens
gagcttggccagaa

SEQ ID NO: 1112940 - DNA, 14 bp, Homo sapiens
gagcttggccttgg

SEQ ID NO: 1112941 - DNA, 17 bp, Homo sapiens
gagcttggccttgggcc

SEQ ID NO: 1112942 - DNA, 13 bp, Homo sapiens
gagcttgggaatg

SEQ ID NO: 1112943 - DNA, 20 bp, Homo sapiens
gagcttgggactcaggtctg

SEQ ID NO: 1112944 - DNA, 16 bp, Homo sapiens
gagcttgtgtcctgtc

SEQ ID NO: 1112945 - DNA, 22 bp, Homo sapiens
gagcttgtgtcctgtcctttct

SEQ ID NO: 1112946 - DNA, 15 bp, Homo sapiens
gagctttagacagca

SEQ ID NO: 1112947 - DNA, 19 bp, Homo sapiens
gagctttagacagcagagc

SEQ ID NO: 1112948 - DNA, 18 bp, Homo sapiens
gagctttcaaagaaggaa

SEQ ID NO: 1112949 - DNA, 21 bp, Homo sapiens
gagctttccatgttgctgcca

SEQ ID NO: 1112950 - DNA, 17 bp, Homo sapiens
gagctttctcaatgtct

SEQ ID NO: 1112951 - DNA, 20 bp, Homo sapiens
gagctttgaaaattcagtgg

SEQ ID NO: 1112952 - DNA, 13 bp, Homo sapiens
gagctttgctgct

SEQ ID NO: 1112953 - DNA, 14 bp, Homo sapiens
gagctttgctgcta

SEQ ID NO: 1112954 - DNA, 23 bp, Homo sapiens
gagctttggggacagttggcaga

SEQ ID NO: 1112955 - DNA, 20 bp, Homo sapiens
gagctttgtcacttgccaca

SEQ ID NO: 1112956 - DNA, 23 bp, Homo sapiens
gagctttgtctacttcaaaagtt

SEQ ID NO: 1112957 - DNA, 14 bp, Homo sapiens
gagctttgtgcttg

SEQ ID NO: 1112958 - DNA, 20 bp, Homo sapiens
gagcttttgagtgttcccaa

SEQ ID NO: 1112959 - DNA, 13 bp, Homo sapiens
gagcttttgatgc

SEQ ID NO: 1112960 - DNA, 20 bp, Homo sapiens
gagcttttgcatttcctgtg

SEQ ID NO: 1112961 - DNA, 22 bp, Homo sapiens
gagcttttgcatttcctgtgtt

SEQ ID NO: 1112962 - DNA, 16 bp, Homo sapiens
gaggaaaaaagaacca

SEQ ID NO: 1112963 - DNA, 14 bp, Homo sapiens
gaggaaaaaggtca

SEQ ID NO: 1112964 - DNA, 18 bp, Homo sapiens
gaggaaactactgccttt

SEQ ID NO: 1112965 - DNA, 22 bp, Homo sapiens
gaggaaactactgcctttagaa

SEQ ID NO: 1112966 - DNA, 17 bp, Homo sapiens
gaggaaactcacctgct

SEQ ID NO: 1112967 - DNA, 23 bp, Homo sapiens
gaggaaactcacctgctggcccc

SEQ ID NO: 1112968 - DNA, 22 bp, Homo sapiens
gaggaaaggattttaccaaagc

SEQ ID NO: 1112969 - DNA, 16 bp, Homo sapiens
gaggaaaggcgccccc

SEQ ID NO: 1112970 - DNA, 20 bp, Homo sapiens
gaggaaaggcgcccccgccc

SEQ ID NO: 1112971 - DNA, 16 bp, Homo sapiens
gaggaaagggcctggc

SEQ ID NO: 1112972 - DNA, 14 bp, Homo sapiens
gaggaaagggctgg

SEQ ID NO: 1112973 - DNA, 17 bp, Homo sapiens
gaggaaagggctggctc

SEQ ID NO: 1112974 - DNA, 18 bp, Homo sapiens
gaggaaatctgcagaggg

SEQ ID NO: 1112975 - DNA, 20 bp, Homo sapiens
gaggaacaagcatgtctctc

SEQ ID NO: 1112976 - DNA, 17 bp, Homo sapiens
gaggaacaggtggatgt

SEQ ID NO: 1112977 - DNA, 19 bp, Homo sapiens
gaggaacaggttcctgtgg

SEQ ID NO: 1112978 - DNA, 23 bp, Homo sapiens
gaggaacagtgtggtttgggaaa

SEQ ID NO: 1112979 - DNA, 17 bp, Homo sapiens
gaggaaccacatataac

SEQ ID NO: 1112980 - DNA, 20 bp, Homo sapiens
gaggaaccctgatctctcag

SEQ ID NO: 1112981 - DNA, 18 bp, Homo sapiens
gaggaacctctgatttat

SEQ ID NO: 1112982 - DNA, 23 bp, Homo sapiens
gaggaacgggcagccacaggact

SEQ ID NO: 1112983 - DNA, 15 bp, Homo sapiens
gaggaactccaggac

SEQ ID NO: 1112984 - DNA, 16 bp, Homo sapiens
gaggaactccaggacg

SEQ ID NO: 1112985 - DNA, 17 bp, Homo sapiens
gaggaactgtccagaga

SEQ ID NO: 1112986 - DNA, 22 bp, Homo sapiens
gaggaacttgctgctgtgcctg

SEQ ID NO: 1112987 - DNA, 14 bp, Homo sapiens
gaggaagagccacc

SEQ ID NO: 1112988 - DNA, 16 bp, Homo sapiens
gaggaagagccacctg

SEQ ID NO: 1112989 - DNA, 17 bp, Homo sapiens
gaggaagagccacctgc

SEQ ID NO: 1112990 - DNA, 18 bp, Homo sapiens
gaggaagagccacctgca

SEQ ID NO: 1112991 - DNA, 21 bp, Homo sapiens
gaggaagcagttggggccctc

SEQ ID NO: 1112992 - DNA, 22 bp, Homo sapiens
gaggaagctctcccttgtttac

SEQ ID NO: 1112993 - DNA, 12 bp, Homo sapiens
gaggaagcttgg

SEQ ID NO: 1112994 - DNA, 15 bp, Homo sapiens
gaggaaggacccctc

SEQ ID NO: 1112995 - DNA, 16 bp, Homo sapiens
gaggaaggacttccct

SEQ ID NO: 1112996 - DNA, 20 bp, Homo sapiens
gaggaaggcctttcttctgt

SEQ ID NO: 1112997 - DNA, 15 bp, Homo sapiens
gaggaaggctctgtc

SEQ ID NO: 1112998 - DNA, 14 bp, Homo sapiens
gaggaagggatggg

SEQ ID NO: 1112999 - DNA, 18 bp, Homo sapiens
gaggaagggatgggcccc

SEQ ID NO: 1113000 - DNA, 13 bp, Homo sapiens
gaggaaggggggt

SEQ ID NO: 1113001 - DNA, 18 bp, Homo sapiens
gaggaaggtgctgagctt

SEQ ID NO: 1113002 - DNA, 17 bp, Homo sapiens
gaggaagtggatctgct

SEQ ID NO: 1113003 - DNA, 21 bp, Homo sapiens
gaggaagtgtggaaaaatagc

SEQ ID NO: 1113004 - DNA, 17 bp, Homo sapiens
gaggaagttcagatctt

SEQ ID NO: 1113005 - DNA, 17 bp, Homo sapiens
gaggaagttggctgagc

SEQ ID NO: 1113006 - DNA, 21 bp, Homo sapiens
gaggaataattatttatttaa

SEQ ID NO: 1113007 - DNA, 23 bp, Homo sapiens
gaggaatagcaaaattcctgtgt

SEQ ID NO: 1113008 - DNA, 19 bp, Homo sapiens
gaggaatagttgagcccca

SEQ ID NO: 1113009 - DNA, 13 bp, Homo sapiens
gaggaatatcaat

SEQ ID NO: 1113010 - DNA, 15 bp, Homo sapiens
gaggaatcctggcag

SEQ ID NO: 1113011 - DNA, 19 bp, Homo sapiens
gaggaatctgtgggtctgg

SEQ ID NO: 1113012 - DNA, 21 bp, Homo sapiens
gaggaatctgtgggtctggga

SEQ ID NO: 1113013 - DNA, 22 bp, Homo sapiens
gaggaatctgtgggtctgggag

SEQ ID NO: 1113014 - DNA, 21 bp, Homo sapiens
gaggaatctgtttctctgctg

SEQ ID NO: 1113015 - DNA, 22 bp, Homo sapiens
gaggaatctgtttctctgctgt

SEQ ID NO: 1113016 - DNA, 17 bp, Homo sapiens
gaggaatgatgaagctt

SEQ ID NO: 1113017 - DNA, 13 bp, Homo sapiens
gaggaatgctccc

SEQ ID NO: 1113018 - DNA, 17 bp, Homo sapiens
gaggaatgctggactgg

SEQ ID NO: 1113019 - DNA, 18 bp, Homo sapiens
gaggaatgctggactgga

SEQ ID NO: 1113020 - DNA, 21 bp, Homo sapiens
gaggaatgtagggcctgcatg

SEQ ID NO: 1113021 - DNA, 14 bp, Homo sapiens
gaggaatgtatatg

SEQ ID NO: 1113022 - DNA, 17 bp, Homo sapiens
gaggaattcagctcagc

SEQ ID NO: 1113023 - DNA, 14 bp, Homo sapiens
gaggaatttcacct

SEQ ID NO: 1113024 - DNA, 13 bp, Homo sapiens
gaggacacaatgg

SEQ ID NO: 1113025 - DNA, 14 bp, Homo sapiens
gaggacacagcaca

SEQ ID NO: 1113026 - DNA, 21 bp, Homo sapiens
gaggacacagcacaagggcac

SEQ ID NO: 1113027 - DNA, 22 bp, Homo sapiens
gaggacagagggagacagggct

SEQ ID NO: 1113028 - DNA, 14 bp, Homo sapiens
gaggacagctctgg

SEQ ID NO: 1113029 - DNA, 19 bp, Homo sapiens
gaggacatcaaagtggtaa

SEQ ID NO: 1113030 - DNA, 18 bp, Homo sapiens
gaggacatgcgtgtgtca

SEQ ID NO: 1113031 - DNA, 21 bp, Homo sapiens
gaggacatgtttttgttttct

SEQ ID NO: 1113032 - DNA, 16 bp, Homo sapiens
gaggaccagggccctg

SEQ ID NO: 1113033 - DNA, 20 bp, Homo sapiens
gaggaccagggtggagctga

SEQ ID NO: 1113034 - DNA, 15 bp, Homo sapiens
gaggaccatgaaaca

SEQ ID NO: 1113035 - DNA, 14 bp, Homo sapiens
gaggaccccagggt

SEQ ID NO: 1113036 - DNA, 15 bp, Homo sapiens
gaggacccctgcctt

SEQ ID NO: 1113037 - DNA, 16 bp, Homo sapiens
gaggacccctgccttc

SEQ ID NO: 1113038 - DNA, 19 bp, Homo sapiens
gaggacccctgccttcctc

SEQ ID NO: 1113039 - DNA, 22 bp, Homo sapiens
gaggacccctgccttcctctga

SEQ ID NO: 1113040 - DNA, 23 bp, Homo sapiens
gaggacccctgccttcctctgag

SEQ ID NO: 1113041 - DNA, 16 bp, Homo sapiens
gaggaccgttctctgt

SEQ ID NO: 1113042 - DNA, 14 bp, Homo sapiens
gaggacctccctgt

SEQ ID NO: 1113043 - DNA, 19 bp, Homo sapiens
gaggacctggcgtgctcag

SEQ ID NO: 1113044 - DNA, 16 bp, Homo sapiens
gaggacctggggcaca

SEQ ID NO: 1113045 - DNA, 18 bp, Homo sapiens
gaggacctggggcacagt

SEQ ID NO: 1113046 - DNA, 22 bp, Homo sapiens
gaggacgcacgctcgctgccat

SEQ ID NO: 1113047 - DNA, 19 bp, Homo sapiens
gaggacggccctgcctgcc

SEQ ID NO: 1113048 - DNA, 23 bp, Homo sapiens
gaggacgtcatcggaggctgggc

SEQ ID NO: 1113049 - DNA, 20 bp, Homo sapiens
gaggactcggccactgtgtc

SEQ ID NO: 1113050 - DNA, 12 bp, Homo sapiens
gaggactgagcc

SEQ ID NO: 1113051 - DNA, 20 bp, Homo sapiens
gaggactgtagggagggcgg

SEQ ID NO: 1113052 - DNA, 13 bp, Homo sapiens
gaggacttcaagc

SEQ ID NO: 1113053 - DNA, 23 bp, Homo sapiens
gaggacttggagggtctgggggc

SEQ ID NO: 1113054 - DNA, 19 bp, Homo sapiens
gaggctgcctgctgtgctg

SEQ ID NO: 1113055 - DNA, 16 bp, Homo sapiens
gaggctgcttcccaga

SEQ ID NO: 1113056 - DNA, 15 bp, Homo sapiens
gaggctggagctggc

SEQ ID NO: 1113057 - DNA, 13 bp, Homo sapiens
gaggctggcacag

SEQ ID NO: 1113058 - DNA, 22 bp, Homo sapiens
gaggctgggaatggaggggcag

SEQ ID NO: 1113059 - DNA, 13 bp, Homo sapiens
gaggctgggaggt

SEQ ID NO: 1113060 - DNA, 16 bp, Homo sapiens
gaggctgggcccctgg

SEQ ID NO: 1113061 - DNA, 20 bp, Homo sapiens
gaggctggggccccatcttg

SEQ ID NO: 1113062 - DNA, 20 bp, Homo sapiens
gaggctgggggagagccgtg

SEQ ID NO: 1113063 - DNA, 23 bp, Homo sapiens
gaggctggtggttttcagagcag

SEQ ID NO: 1113064 - DNA, 21 bp, Homo sapiens
gaggctgtaactgagagaaag

SEQ ID NO: 1113065 - DNA, 13 bp, Homo sapiens
gaggctgtgctcc

SEQ ID NO: 1113066 - DNA, 21 bp, Homo sapiens
gaggctgtggagagaagtgag

SEQ ID NO: 1113067 - DNA, 23 bp, Homo sapiens
gaggctgtggtcacagcggaggt

SEQ ID NO: 1113068 - DNA, 12 bp, Homo sapiens
gaggctgtgtct

SEQ ID NO: 1113069 - DNA, 22 bp, Homo sapiens
gaggctgtgtgcctgggggagt

SEQ ID NO: 1113070 - DNA, 20 bp, Homo sapiens
gaggcttccagagagtcctc

SEQ ID NO: 1113071 - DNA, 22 bp, Homo sapiens
gaggcttccagagagtcctctg

SEQ ID NO: 1113072 - DNA, 13 bp, Homo sapiens
gaggcttccaggc

SEQ ID NO: 1113073 - DNA, 15 bp, Homo sapiens
gaggcttccaggctc

SEQ ID NO: 1113074 - DNA, 16 bp, Homo sapiens
gaggcttccaggctct

SEQ ID NO: 1113075 - DNA, 18 bp, Homo sapiens
gaggcttctccgccagcc

SEQ ID NO: 1113076 - DNA, 20 bp, Homo sapiens
gaggcttctccgccagcctc

SEQ ID NO: 1113077 - DNA, 16 bp, Homo sapiens
gaggcttcttcagatc

SEQ ID NO: 1113078 - DNA, 17 bp, Homo sapiens
gaggcttgtcagagctg

SEQ ID NO: 1113079 - DNA, 19 bp, Homo sapiens
gaggcttgtcagagctggg

SEQ ID NO: 1113080 - DNA, 15 bp, Homo sapiens
gaggctttggcccaa

SEQ ID NO: 1113081 - DNA, 16 bp, Homo sapiens
gaggctttgggtggct

SEQ ID NO: 1113082 - DNA, 17 bp, Homo sapiens
gagggaaaaagagctgg

SEQ ID NO: 1113083 - DNA, 15 bp, Homo sapiens
gagggaaaagggaag

SEQ ID NO: 1113084 - DNA, 18 bp, Homo sapiens
gagggaacagacaggaga

SEQ ID NO: 1113085 - DNA, 19 bp, Homo sapiens
gagggaacagacaggagaa

SEQ ID NO: 1113086 - DNA, 19 bp, Homo sapiens
gagggaaccaccagcgttc

SEQ ID NO: 1113087 - DNA, 14 bp, Homo sapiens
gagggaagaacatt

SEQ ID NO: 1113088 - DNA, 14 bp, Homo sapiens
gagggaagaccaga

SEQ ID NO: 1113089 - DNA, 15 bp, Homo sapiens
gagggaagagggaga

SEQ ID NO: 1113090 - DNA, 19 bp, Homo sapiens
gagggaagagtggaggtgg

SEQ ID NO: 1113091 - DNA, 22 bp, Homo sapiens
gagggaagggccaccctgctgc

SEQ ID NO: 1113092 - DNA, 14 bp, Homo sapiens
gagggaaggggatg

SEQ ID NO: 1113093 - DNA, 19 bp, Homo sapiens
gagggaaggggatggaggc

SEQ ID NO: 1113094 - DNA, 20 bp, Homo sapiens
gagggaagggtttctctatt

SEQ ID NO: 1113095 - DNA, 16 bp, Homo sapiens
gagggaagtcctggga

SEQ ID NO: 1113096 - DNA, 20 bp, Homo sapiens
gagggaagtcctgggaggat

SEQ ID NO: 1113097 - DNA, 14 bp, Homo sapiens
gagggaataaatca

SEQ ID NO: 1113098 - DNA, 23 bp, Homo sapiens
gagggacacatgcccctccccca

SEQ ID NO: 1113099 - DNA, 14 bp, Homo sapiens
gagggacagagccc

SEQ ID NO: 1113100 - DNA, 14 bp, Homo sapiens
gagggacagggcag

SEQ ID NO: 1113101 - DNA, 13 bp, Homo sapiens
gagggacagggtg

SEQ ID NO: 1113102 - DNA, 17 bp, Homo sapiens
gagggacatgctcacct

SEQ ID NO: 1113103 - DNA, 19 bp, Homo sapiens
gagggacatgctcacctct

SEQ ID NO: 1113104 - DNA, 21 bp, Homo sapiens
gagggaccatgtgtcacttgt

SEQ ID NO: 1113105 - DNA, 17 bp, Homo sapiens
gagggacctctcccagg

SEQ ID NO: 1113106 - DNA, 16 bp, Homo sapiens
gagggacgcctggggg

SEQ ID NO: 1113107 - DNA, 19 bp, Homo sapiens
gagggacgcggaggaggaa

SEQ ID NO: 1113108 - DNA, 19 bp, Homo sapiens
gagggacttggctgtcctt

SEQ ID NO: 1113109 - DNA, 21 bp, Homo sapiens
gagggacttttaatcagtgaa

SEQ ID NO: 1113110 - DNA, 13 bp, Homo sapiens
gagggagaagaag

SEQ ID NO: 1113111 - DNA, 14 bp, Homo sapiens
gagggagaagcatg

SEQ ID NO: 1113112 - DNA, 16 bp, Homo sapiens
gagggagactgtggta

SEQ ID NO: 1113113 - DNA, 13 bp, Homo sapiens
gagggagagggag

SEQ ID NO: 1113114 - DNA, 13 bp, Homo sapiens
gagggagccttgt

SEQ ID NO: 1113115 - DNA, 15 bp, Homo sapiens
gagggagctgctggc

SEQ ID NO: 1113116 - DNA, 13 bp, Homo sapiens
gagggaggaatcg

SEQ ID NO: 1113117 - DNA, 12 bp, Homo sapiens
gagggaggaggc

SEQ ID NO: 1113118 - DNA, 13 bp, Homo sapiens
gagggaggaggcc

SEQ ID NO: 1113119 - DNA, 20 bp, Homo sapiens
gagggaggcactagtcaccg

SEQ ID NO: 1113120 - DNA, 15 bp, Homo sapiens
gagggagggctgggc

SEQ ID NO: 1113121 - DNA, 17 bp, Homo sapiens
gagggaggggacagagg

SEQ ID NO: 1113122 - DNA, 19 bp, Homo sapiens
gagggagtcccagagccct

SEQ ID NO: 1113123 - DNA, 14 bp, Homo sapiens
gagggagtctcagg

SEQ ID NO: 1113124 - DNA, 13 bp, Homo sapiens
gagggagtgcaga

SEQ ID NO: 1113125 - DNA, 21 bp, Homo sapiens
gagggagtgcagaacacctgg

SEQ ID NO: 1113126 - DNA, 19 bp, Homo sapiens
gagggagtgttcaaaatac

SEQ ID NO: 1113127 - DNA, 21 bp, Homo sapiens
gagggagttttgtctgtctcc

SEQ ID NO: 1113128 - DNA, 22 bp, Homo sapiens
gagggataaccccaggcactgt

SEQ ID NO: 1113129 - DNA, 15 bp, Homo sapiens
gagggatcacagggc

SEQ ID NO: 1113130 - DNA, 23 bp, Homo sapiens
gagggatcacagggccccagaag

SEQ ID NO: 1113131 - DNA, 13 bp, Homo sapiens
gagggatgccccc

SEQ ID NO: 1113132 - DNA, 19 bp, Homo sapiens
gagggatgcccccaggcag

SEQ ID NO: 1113133 - DNA, 20 bp, Homo sapiens
gagggatgcccccaggcagc

SEQ ID NO: 1113134 - DNA, 14 bp, Homo sapiens
gagggatgcccgct

SEQ ID NO: 1113135 - DNA, 15 bp, Homo sapiens
gagggatgctggaac

SEQ ID NO: 1113136 - DNA, 20 bp, Homo sapiens
gagggatggagaaagaagtg

SEQ ID NO: 1113137 - DNA, 21 bp, Homo sapiens
gagggatggagaggcggcctc

SEQ ID NO: 1113138 - DNA, 14 bp, Homo sapiens
gagggatgggcctg

SEQ ID NO: 1113139 - DNA, 15 bp, Homo sapiens
gagggatgggcctgg

SEQ ID NO: 1113140 - DNA, 16 bp, Homo sapiens
gagggatgggcctggc

SEQ ID NO: 1113141 - DNA, 15 bp, Homo sapiens
gagggatttccctgc

SEQ ID NO: 1113142 - DNA, 21 bp, Homo sapiens
gagggatttccctgcagacct

SEQ ID NO: 1113143 - DNA, 19 bp, Homo sapiens
gagggattttagcctcttc

SEQ ID NO: 1113144 - DNA, 20 bp, Homo sapiens
gagggcaaagatggtggctg

SEQ ID NO: 1113145 - DNA, 17 bp, Homo sapiens
gagggcaacagggagca

SEQ ID NO: 1113146 - DNA, 18 bp, Homo sapiens
gagggcaagggccatgct

SEQ ID NO: 1113147 - DNA, 14 bp, Homo sapiens
gagggcacagcagg

SEQ ID NO: 1113148 - DNA, 18 bp, Homo sapiens
gagggcacatctccagaa

SEQ ID NO: 1113149 - DNA, 21 bp, Homo sapiens
gagggcacattaactccctcc

SEQ ID NO: 1113150 - DNA, 16 bp, Homo sapiens
gagggcactggagctg

SEQ ID NO: 1113151 - DNA, 12 bp, Homo sapiens
gagggcactggt

SEQ ID NO: 1113152 - DNA, 19 bp, Homo sapiens
gagggcacttcctccacag

SEQ ID NO: 1113153 - DNA, 18 bp, Homo sapiens
gagggcagactggggcat

SEQ ID NO: 1113154 - DNA, 11 bp, Homo sapiens
gagggcagagc

SEQ ID NO: 1113155 - DNA, 22 bp, Homo sapiens
gagggcagagccatgggcctgg

SEQ ID NO: 1113156 - DNA, 15 bp, Homo sapiens
gagggcagagggaga

SEQ ID NO: 1113157 - DNA, 19 bp, Homo sapiens
gagggcagcactgggaagc

SEQ ID NO: 1113158 - DNA, 16 bp, Homo sapiens
gagggcagcagggcta

SEQ ID NO: 1113159 - DNA, 19 bp, Homo sapiens
gagggcagcagggctaccc

SEQ ID NO: 1113160 - DNA, 15 bp, Homo sapiens
gagggcagctggccc

SEQ ID NO: 1113161 - DNA, 15 bp, Homo sapiens
gagggcaggctgagg

SEQ ID NO: 1113162 - DNA, 23 bp, Homo sapiens
gagggcagtgccctttgagatct

SEQ ID NO: 1113163 - DNA, 22 bp, Homo sapiens
gagggcatgggttggcagggtg

SEQ ID NO: 1113164 - DNA, 13 bp, Homo sapiens
gagggccacagcc

SEQ ID NO: 1113165 - DNA, 13 bp, Homo sapiens
gagggccagagct

SEQ ID NO: 1113166 - DNA, 14 bp, Homo sapiens
gagggccagcaggc

SEQ ID NO: 1113167 - DNA, 14 bp, Homo sapiens
gagggccaggcaga

SEQ ID NO: 1113168 - DNA, 16 bp, Homo sapiens
gagggccagggaggca

SEQ ID NO: 1113169 - DNA, 14 bp, Homo sapiens
gagggcccagagca

SEQ ID NO: 1113170 - DNA, 15 bp, Homo sapiens
gagggcccagagcag

SEQ ID NO: 1113171 - DNA, 16 bp, Homo sapiens
gagggcccagagcagg

SEQ ID NO: 1113172 - DNA, 18 bp, Homo sapiens
gagggcccagagcaggaa

SEQ ID NO: 1113173 - DNA, 12 bp, Homo sapiens
gagggcccagcc

SEQ ID NO: 1113174 - DNA, 15 bp, Homo sapiens
gagggcccagccagg

SEQ ID NO: 1113175 - DNA, 21 bp, Homo sapiens
gagggcccagccaggagcaga

SEQ ID NO: 1113176 - DNA, 18 bp, Homo sapiens
gagggcccagcccagagc

SEQ ID NO: 1113177 - DNA, 11 bp, Homo sapiens
gagtgtagtga

SEQ ID NO: 1113178 - DNA, 22 bp, Homo sapiens
gagtgtattttttaaaattgat

SEQ ID NO: 1113179 - DNA, 19 bp, Homo sapiens
gagtgtcctcttccctctc

SEQ ID NO: 1113180 - DNA, 19 bp, Homo sapiens
gagtgtcctgcccatgccc

SEQ ID NO: 1113181 - DNA, 18 bp, Homo sapiens
gagtgtcggatcctgtga

SEQ ID NO: 1113182 - DNA, 19 bp, Homo sapiens
gagtgtcggatcctgtgag

SEQ ID NO: 1113183 - DNA, 13 bp, Homo sapiens
gagtgtctttcca

SEQ ID NO: 1113184 - DNA, 15 bp, Homo sapiens
gagtgtctttccacg

SEQ ID NO: 1113185 - DNA, 21 bp, Homo sapiens
gagtgtctttccacggagcca

SEQ ID NO: 1113186 - DNA, 12 bp, Homo sapiens
gagtgtgacagg

SEQ ID NO: 1113187 - DNA, 15 bp, Homo sapiens
gagtgtgacagggcc

SEQ ID NO: 1113188 - DNA, 20 bp, Homo sapiens
gagtgtgaccaaaagttaca

SEQ ID NO: 1113189 - DNA, 12 bp, Homo sapiens
gagtgtgagaga

SEQ ID NO: 1113190 - DNA, 15 bp, Homo sapiens
gagtgtgagcagggc

SEQ ID NO: 1113191 - DNA, 18 bp, Homo sapiens
gagtgtgagccacctaag

SEQ ID NO: 1113192 - DNA, 13 bp, Homo sapiens
gagtgtgagggca

SEQ ID NO: 1113193 - DNA, 16 bp, Homo sapiens
gagtgtgagggcagca

SEQ ID NO: 1113194 - DNA, 17 bp, Homo sapiens
gagtgtgagggcagcac

SEQ ID NO: 1113195 - DNA, 21 bp, Homo sapiens
gagtgtgagtgtgagagatgg

SEQ ID NO: 1113196 - DNA, 13 bp, Homo sapiens
gagtgtgcagaca

SEQ ID NO: 1113197 - DNA, 16 bp, Homo sapiens
gagtgtggctcccctc

SEQ ID NO: 1113198 - DNA, 17 bp, Homo sapiens
gagtgtggctcccctct

SEQ ID NO: 1113199 - DNA, 18 bp, Homo sapiens
gagtgtgtatgtcagtgg

SEQ ID NO: 1113200 - DNA, 18 bp, Homo sapiens
gagtgtgtcagagcccag

SEQ ID NO: 1113201 - DNA, 19 bp, Homo sapiens
gagtgtgtcagagcccagg

SEQ ID NO: 1113202 - DNA, 13 bp, Homo sapiens
gagtgtgtctgct

SEQ ID NO: 1113203 - DNA, 14 bp, Homo sapiens
gagtgtgtctgctg

SEQ ID NO: 1113204 - DNA, 10 bp, Homo sapiens
gagtgtgtga

SEQ ID NO: 1113205 - DNA, 11 bp, Homo sapiens
gagtgtgtgca

SEQ ID NO: 1113206 - DNA, 15 bp, Homo sapiens
gagtgtgtgggcagg

SEQ ID NO: 1113207 - DNA, 18 bp, Homo sapiens
gagtgtgtgggcagggtt

SEQ ID NO: 1113208 - DNA, 14 bp, Homo sapiens
gagtgttcaaacta

SEQ ID NO: 1113209 - DNA, 22 bp, Homo sapiens
gagtgttcaaactactgtacat

SEQ ID NO: 1113210 - DNA, 19 bp, Homo sapiens
gagtgttccccttccactg

SEQ ID NO: 1113211 - DNA, 22 bp, Homo sapiens
gagtgttctgtgggcttggcct

SEQ ID NO: 1113212 - DNA, 18 bp, Homo sapiens
gagtgtttctaataaact

SEQ ID NO: 1113213 - DNA, 13 bp, Homo sapiens
gagttaaaatgca

SEQ ID NO: 1113214 - DNA, 13 bp, Homo sapiens
gagttacagttct

SEQ ID NO: 1113215 - DNA, 14 bp, Homo sapiens
gagttacagttctg

SEQ ID NO: 1113216 - DNA, 15 bp, Homo sapiens
gagttacagttctgt

SEQ ID NO: 1113217 - DNA, 16 bp, Homo sapiens
gagttacagttctgtg

SEQ ID NO: 1113218 - DNA, 21 bp, Homo sapiens
gagttagactcaagggggtga

SEQ ID NO: 1113219 - DNA, 17 bp, Homo sapiens
gagttagatattatttt

SEQ ID NO: 1113220 - DNA, 21 bp, Homo sapiens
gagttagcatgtatgaatgta

SEQ ID NO: 1113221 - DNA, 18 bp, Homo sapiens
gagttaggctattcacaa

SEQ ID NO: 1113222 - DNA, 14 bp, Homo sapiens
gagttatatgttca

SEQ ID NO: 1113223 - DNA, 16 bp, Homo sapiens
gagttatctaaaagaa

SEQ ID NO: 1113224 - DNA, 15 bp, Homo sapiens
gagttatcttcttta

SEQ ID NO: 1113225 - DNA, 17 bp, Homo sapiens
gagttatcttctttatt

SEQ ID NO: 1113226 - DNA, 18 bp, Homo sapiens
gagttatcttctttatta

SEQ ID NO: 1113227 - DNA, 23 bp, Homo sapiens
gagttatcttctttattattcct

SEQ ID NO: 1113228 - DNA, 22 bp, Homo sapiens
gagttattatctatggaaatgt

SEQ ID NO: 1113229 - DNA, 23 bp, Homo sapiens
gagttattttaattatcttttct

SEQ ID NO: 1113230 - DNA, 12 bp, Homo sapiens
gagttcaccttg

SEQ ID NO: 1113231 - DNA, 14 bp, Homo sapiens
gagttcaccttgga

SEQ ID NO: 1113232 - DNA, 19 bp, Homo sapiens
gagttcaccttggaagggc

SEQ ID NO: 1113233 - DNA, 23 bp, Homo sapiens
gagttcactgttgtacacagtct

SEQ ID NO: 1113234 - DNA, 16 bp, Homo sapiens
gagttcagctgcttct

SEQ ID NO: 1113235 - DNA, 14 bp, Homo sapiens
gagttcatccaggc

SEQ ID NO: 1113236 - DNA, 12 bp, Homo sapiens
gagttccagtca

SEQ ID NO: 1113237 - DNA, 12 bp, Homo sapiens
gagttcctctgc

SEQ ID NO: 1113238 - DNA, 13 bp, Homo sapiens
gagttccttctca

SEQ ID NO: 1113239 - DNA, 19 bp, Homo sapiens
gagttcgagaccagcctgg

SEQ ID NO: 1113240 - DNA, 20 bp, Homo sapiens
gagttcgagaccagcctggc

SEQ ID NO: 1113241 - DNA, 21 bp, Homo sapiens
gagttcttaaggattgtgata

SEQ ID NO: 1113242 - DNA, 23 bp, Homo sapiens
gagttctttgctgcccctgtctg

SEQ ID NO: 1113243 - DNA, 14 bp, Homo sapiens
gagttgactctgga

SEQ ID NO: 1113244 - DNA, 19 bp, Homo sapiens
gagttgatactacagtttg

SEQ ID NO: 1113245 - DNA, 20 bp, Homo sapiens
gagttgatgactttctgttt

SEQ ID NO: 1113246 - DNA, 15 bp, Homo sapiens
gagttgattcagctc

SEQ ID NO: 1113247 - DNA, 18 bp, Homo sapiens
gagttgattcagctctgc

SEQ ID NO: 1113248 - DNA, 21 bp, Homo sapiens
gagttgcatttgtaaaaatga

SEQ ID NO: 1113249 - DNA, 16 bp, Homo sapiens
gagttgccaagacaaa

SEQ ID NO: 1113250 - DNA, 18 bp, Homo sapiens
gagttgctgcaaacctga

SEQ ID NO: 1113251 - DNA, 19 bp, Homo sapiens
gagttgctttgccagagca

SEQ ID NO: 1113252 - DNA, 15 bp, Homo sapiens
gagttggaatcactg

SEQ ID NO: 1113253 - DNA, 17 bp, Homo sapiens
gagttggagtactatat

SEQ ID NO: 1113254 - DNA, 20 bp, Homo sapiens
gagttggcaaaatggggttt

SEQ ID NO: 1113255 - DNA, 13 bp, Homo sapiens
gagttggctgtgt

SEQ ID NO: 1113256 - DNA, 17 bp, Homo sapiens
gagttggggaaggcaag

SEQ ID NO: 1113257 - DNA, 21 bp, Homo sapiens
gagttgtcgtttttagctttg

SEQ ID NO: 1113258 - DNA, 19 bp, Homo sapiens
gagttgtgagccctctagg

SEQ ID NO: 1113259 - DNA, 16 bp, Homo sapiens
gagttgtggaaagcct

SEQ ID NO: 1113260 - DNA, 20 bp, Homo sapiens
gagttgttacatttttaagt

SEQ ID NO: 1113261 - DNA, 14 bp, Homo sapiens
gagttgttatgcca

SEQ ID NO: 1113262 - DNA, 18 bp, Homo sapiens
gagttgttgtttgccaag

SEQ ID NO: 1113263 - DNA, 13 bp, Homo sapiens
gagtttaaaagca

SEQ ID NO: 1113264 - DNA, 17 bp, Homo sapiens
gagtttaagaccagcct

SEQ ID NO: 1113265 - DNA, 19 bp, Homo sapiens
gagtttacagtttgtgttt

SEQ ID NO: 1113266 - DNA, 23 bp, Homo sapiens
gagtttaccatttgtaataaagt

SEQ ID NO: 1113267 - DNA, 20 bp, Homo sapiens
gagtttagggaacaatttgg

SEQ ID NO: 1113268 - DNA, 21 bp, Homo sapiens
gagtttatattctgaaaggaa

SEQ ID NO: 1113269 - DNA, 13 bp, Homo sapiens
gagtttattacaa

SEQ ID NO: 1113270 - DNA, 23 bp, Homo sapiens
gagtttattacaatgtatcttta

SEQ ID NO: 1113271 - DNA, 21 bp, Homo sapiens
gagtttcacttttgttgccca

SEQ ID NO: 1113272 - DNA, 12 bp, Homo sapiens
gagtttcccttc

SEQ ID NO: 1113273 - DNA, 14 bp, Homo sapiens
gagtttctctaaag

SEQ ID NO: 1113274 - DNA, 13 bp, Homo sapiens
gagtttctgtttg

SEQ ID NO: 1113275 - DNA, 15 bp, Homo sapiens
gagtttctgtttgat

SEQ ID NO: 1113276 - DNA, 21 bp, Homo sapiens
gagtttgagacaagccctggc

SEQ ID NO: 1113277 - DNA, 23 bp, Homo sapiens
gagtttgctggttgtaaatactt

SEQ ID NO: 1113278 - DNA, 20 bp, Homo sapiens
gagtttgctgttgaggtggc

SEQ ID NO: 1113279 - DNA, 21 bp, Homo sapiens
gagtttgggagagtggtgagt

SEQ ID NO: 1113280 - DNA, 16 bp, Homo sapiens
gagtttggtctggact

SEQ ID NO: 1113281 - DNA, 19 bp, Homo sapiens
gagtttggtctggactgac

SEQ ID NO: 1113282 - DNA, 15 bp, Homo sapiens
gagtttgtgtctgtt

SEQ ID NO: 1113283 - DNA, 18 bp, Homo sapiens
gagttttaacaatccatt

SEQ ID NO: 1113284 - DNA, 13 bp, Homo sapiens
gagttttgatttg

SEQ ID NO: 1113285 - DNA, 16 bp, Homo sapiens
gagttttggcagccag

SEQ ID NO: 1113286 - DNA, 15 bp, Homo sapiens
gagttttgtgtttgt

SEQ ID NO: 1113287 - DNA, 18 bp, Homo sapiens
gagtttttatggggctga

SEQ ID NO: 1113288 - DNA, 12 bp, Homo sapiens
gagtttttcctc

SEQ ID NO: 1113289 - DNA, 17 bp, Homo sapiens
gagtttttttgtcagat

SEQ ID NO: 1113290 - DNA, 19 bp, Homo sapiens
gataaaaaggaaggagaga

SEQ ID NO: 1113291 - DNA, 20 bp, Homo sapiens
gataaaaaggaaggagagat

SEQ ID NO: 1113292 - DNA, 21 bp, Homo sapiens
gataaaactgtgtaaaccaca

SEQ ID NO: 1113293 - DNA, 16 bp, Homo sapiens
gataaaaggtttcttt

SEQ ID NO: 1113294 - DNA, 16 bp, Homo sapiens
gataaaataaataatt

SEQ ID NO: 1113295 - DNA, 17 bp, Homo sapiens
gataaaataaataattt

SEQ ID NO: 1113296 - DNA, 13 bp, Homo sapiens
gataaaatatttt

SEQ ID NO: 1113297 - DNA, 16 bp, Homo sapiens
gataaacaacaaggtg

SEQ ID NO: 1113298 - DNA, 22 bp, Homo sapiens
gataaacacaaaatccattcca

SEQ ID NO: 1113299 - DNA, 16 bp, Homo sapiens
gatatttttatgtgca

SEQ ID NO: 1113300 - DNA, 15 bp, Homo sapiens
gatatttttccattt

SEQ ID NO: 1113301 - DNA, 14 bp, Homo sapiens
gatatttttgtact

SEQ ID NO: 1113302 - DNA, 15 bp, Homo sapiens
gatatttttgtactt

SEQ ID NO: 1113303 - DNA, 21 bp, Homo sapiens
gatatttttgtacttgatttg

SEQ ID NO: 1113304 - DNA, 15 bp, Homo sapiens
gatatttttttcttt

SEQ ID NO: 1113305 - DNA, 17 bp, Homo sapiens
gatatttttttcttttc

SEQ ID NO: 1113306 - DNA, 16 bp, Homo sapiens
gatcaaaaactatttg

SEQ ID NO: 1113307 - DNA, 21 bp, Homo sapiens
gatcaaaacctgtgccaggct

SEQ ID NO: 1113308 - DNA, 23 bp, Homo sapiens
gatcaaaacctgtgccaggctga

SEQ ID NO: 1113309 - DNA, 20 bp, Homo sapiens
gatcaaaaggttaataaagt

SEQ ID NO: 1113310 - DNA, 21 bp, Homo sapiens
gatcaaacctttctggcctgt

SEQ ID NO: 1113311 - DNA, 15 bp, Homo sapiens
gatcaaagatgaaaa

SEQ ID NO: 1113312 - DNA, 14 bp, Homo sapiens
gatcaaatacttta

SEQ ID NO: 1113313 - DNA, 19 bp, Homo sapiens
gatcaaatactttaaagga

SEQ ID NO: 1113314 - DNA, 15 bp, Homo sapiens
gatcaaatatagaaa

SEQ ID NO: 1113315 - DNA, 20 bp, Homo sapiens
gatcaagaaaaaaagggaga

SEQ ID NO: 1113316 - DNA, 20 bp, Homo sapiens
gatcaagaaatgtctctgct

SEQ ID NO: 1113317 - DNA, 14 bp, Homo sapiens
gatcaagagaatca

SEQ ID NO: 1113318 - DNA, 21 bp, Homo sapiens
gatcaagttgttgactgtgat

SEQ ID NO: 1113319 - DNA, 14 bp, Homo sapiens
gatcaataaaatgt

SEQ ID NO: 1113320 - DNA, 14 bp, Homo sapiens
gatcaatttctccc

SEQ ID NO: 1113321 - DNA, 17 bp, Homo sapiens
gatcacaagatggaatt

SEQ ID NO: 1113322 - DNA, 16 bp, Homo sapiens
gatcacaaggtcagga

SEQ ID NO: 1113323 - DNA, 21 bp, Homo sapiens
gatcacacagtgttagtgctg

SEQ ID NO: 1113324 - DNA, 13 bp, Homo sapiens
gatcacagaggct

SEQ ID NO: 1113325 - DNA, 19 bp, Homo sapiens
gatcacatcttaaattcat

SEQ ID NO: 1113326 - DNA, 23 bp, Homo sapiens
gatcacatttcaggacatttgga

SEQ ID NO: 1113327 - DNA, 15 bp, Homo sapiens
gatcaccagcccggc

SEQ ID NO: 1113328 - DNA, 22 bp, Homo sapiens
gatcaccagcccggcctgctcc

SEQ ID NO: 1113329 - DNA, 14 bp, Homo sapiens
gatcacctgaggtc

SEQ ID NO: 1113330 - DNA, 17 bp, Homo sapiens
gatcacgacgctgcaga

SEQ ID NO: 1113331 - DNA, 15 bp, Homo sapiens
gatcacgaggtcagg

SEQ ID NO: 1113332 - DNA, 24 bp, Homo sapiens
gatcacgccactgcactccagcct

SEQ ID NO: 1113333 - DNA, 20 bp, Homo sapiens
gatcactgactctgactcat

SEQ ID NO: 1113334 - DNA, 20 bp, Homo sapiens
gatcactgagccatcatttc

SEQ ID NO: 1113335 - DNA, 15 bp, Homo sapiens
gatcactgccacact

SEQ ID NO: 1113336 - DNA, 14 bp, Homo sapiens
gatcactggagccc

SEQ ID NO: 1113337 - DNA, 19 bp, Homo sapiens
gatcactggctggcctgag

SEQ ID NO: 1113338 - DNA, 21 bp, Homo sapiens
gatcactggctggcctgagca

SEQ ID NO: 1113339 - DNA, 22 bp, Homo sapiens
gatcactttctcagttttcata

SEQ ID NO: 1113340 - DNA, 15 bp, Homo sapiens
gatcagaaagtgaca

SEQ ID NO: 1113341 - DNA, 13 bp, Homo sapiens
gatcagaatccca

SEQ ID NO: 1113342 - DNA, 22 bp, Homo sapiens
gatcagaccttggatcagatga

SEQ ID NO: 1113343 - DNA, 17 bp, Homo sapiens
gatcagagcaggacctc

SEQ ID NO: 1113344 - DNA, 23 bp, Homo sapiens
gatcagagccgtggtcctttggg

SEQ ID NO: 1113345 - DNA, 15 bp, Homo sapiens
gatcagatgctgaat

SEQ ID NO: 1113346 - DNA, 23 bp, Homo sapiens
gatcagatgctgaattgagaata

SEQ ID NO: 1113347 - DNA, 21 bp, Homo sapiens
gatcagcagcgtgcacatctg

SEQ ID NO: 1113348 - DNA, 13 bp, Homo sapiens
gatcagcattgtg

SEQ ID NO: 1113349 - DNA, 15 bp, Homo sapiens
gatcagcattgtgac

SEQ ID NO: 1113350 - DNA, 12 bp, Homo sapiens
gatcagccatta

SEQ ID NO: 1113351 - DNA, 22 bp, Homo sapiens
gatcagccattaaaataaaaca

SEQ ID NO: 1113352 - DNA, 16 bp, Homo sapiens
gatcagccccaccctg

SEQ ID NO: 1113353 - DNA, 18 bp, Homo sapiens
gatcagccccgcctgtca

SEQ ID NO: 1113354 - DNA, 21 bp, Homo sapiens
gatcagcctccgccattccaa

SEQ ID NO: 1113355 - DNA, 15 bp, Homo sapiens
gatcagcctgggcaa

SEQ ID NO: 1113356 - DNA, 17 bp, Homo sapiens
gatcaggaaccagggcc

SEQ ID NO: 1113357 - DNA, 19 bp, Homo sapiens
gatcaggaaccagggcctc

SEQ ID NO: 1113358 - DNA, 11 bp, Homo sapiens
gatcaggagcc

SEQ ID NO: 1113359 - DNA, 17 bp, Homo sapiens
gatcagggaatccagct

SEQ ID NO: 1113360 - DNA, 18 bp, Homo sapiens
gatcagggaatccagctc

SEQ ID NO: 1113361 - DNA, 20 bp, Homo sapiens
gatcagggaatccagctccc

SEQ ID NO: 1113362 - DNA, 20 bp, Homo sapiens
gatcagtataattttttaaa

SEQ ID NO: 1113363 - DNA, 14 bp, Homo sapiens
gatcagttaactat

SEQ ID NO: 1113364 - DNA, 18 bp, Homo sapiens
gatcagttataagtagca

SEQ ID NO: 1113365 - DNA, 20 bp, Homo sapiens
gatcatagctcactgcagcc

SEQ ID NO: 1113366 - DNA, 22 bp, Homo sapiens
gatcatagctcactgcagcctc

SEQ ID NO: 1113367 - DNA, 21 bp, Homo sapiens
gatcataggaagtggctggtc

SEQ ID NO: 1113368 - DNA, 19 bp, Homo sapiens
gatcatatacgtgaaaatt

SEQ ID NO: 1113369 - DNA, 16 bp, Homo sapiens
gatcatccctttctcc

SEQ ID NO: 1113370 - DNA, 16 bp, Homo sapiens
gatcatcgccagaggt

SEQ ID NO: 1113371 - DNA, 19 bp, Homo sapiens
gatcatcgccagaggtgct

SEQ ID NO: 1113372 - DNA, 18 bp, Homo sapiens
gatcatctctgcaggttt

SEQ ID NO: 1113373 - DNA, 17 bp, Homo sapiens
gatcatgatagacttgt

SEQ ID NO: 1113374 - DNA, 14 bp, Homo sapiens
gatcatgcattgtt

SEQ ID NO: 1113375 - DNA, 15 bp, Homo sapiens
gatcatgcattgttg

SEQ ID NO: 1113376 - DNA, 21 bp, Homo sapiens
gatcatgtgtggaagttatta

SEQ ID NO: 1113377 - DNA, 19 bp, Homo sapiens
gatcattacatggctgtgg

SEQ ID NO: 1113378 - DNA, 14 bp, Homo sapiens
gatcattgaaatac

SEQ ID NO: 1113379 - DNA, 15 bp, Homo sapiens
gatcatttaaaaagc

SEQ ID NO: 1113380 - DNA, 17 bp, Homo sapiens
gatcatttaaaaagctc

SEQ ID NO: 1113381 - DNA, 14 bp, Homo sapiens
gatcattttccccc

SEQ ID NO: 1113382 - DNA, 15 bp, Homo sapiens
gatcattttcccccc

SEQ ID NO: 1113383 - DNA, 18 bp, Homo sapiens
gatcattttccccccact

SEQ ID NO: 1113384 - DNA, 21 bp, Homo sapiens
gatcatttttatatgaaataa

SEQ ID NO: 1113385 - DNA, 13 bp, Homo sapiens
gatcatttttcca

SEQ ID NO: 1113386 - DNA, 22 bp, Homo sapiens
gatccaaggcagggaaaggaaa

SEQ ID NO: 1113387 - DNA, 19 bp, Homo sapiens
gatccaaggggctagctgg

SEQ ID NO: 1113388 - DNA, 15 bp, Homo sapiens
gatccacacacagag

SEQ ID NO: 1113389 - DNA, 17 bp, Homo sapiens
gatccacacacagagga

SEQ ID NO: 1113390 - DNA, 19 bp, Homo sapiens
gatccacacacagaggaag

SEQ ID NO: 1113391 - DNA, 18 bp, Homo sapiens
gatccaccctcaaatgtc

SEQ ID NO: 1113392 - DNA, 21 bp, Homo sapiens
gatccaccctcaaatgtcaga

SEQ ID NO: 1113393 - DNA, 14 bp, Homo sapiens
gatccacctgtctc

SEQ ID NO: 1113394 - DNA, 19 bp, Homo sapiens
gatccacctgtctcagcct

SEQ ID NO: 1113395 - DNA, 19 bp, Homo sapiens
gatccacttcttggttcct

SEQ ID NO: 1113396 - DNA, 14 bp, Homo sapiens
gatccactttgggg

SEQ ID NO: 1113397 - DNA, 19 bp, Homo sapiens
gatccagagagcagctccc

SEQ ID NO: 1113398 - DNA, 21 bp, Homo sapiens
gatccagccctggttctggct

SEQ ID NO: 1113399 - DNA, 23 bp, Homo sapiens
gatccaggccggcttgccacacc

SEQ ID NO: 1113400 - DNA, 20 bp, Homo sapiens
gatccaggggaagccagtga

SEQ ID NO: 1113401 - DNA, 22 bp, Homo sapiens
gatccagtgacatgattctgaa

SEQ ID NO: 1113402 - DNA, 22 bp, Homo sapiens
gatccagttccagttcccatgg

SEQ ID NO: 1113403 - DNA, 19 bp, Homo sapiens
gatccatcttgagccacag

SEQ ID NO: 1113404 - DNA, 15 bp, Homo sapiens
gatcccacacaggct

SEQ ID NO: 1113405 - DNA, 13 bp, Homo sapiens
gatcccaccccct

SEQ ID NO: 1113406 - DNA, 15 bp, Homo sapiens
gatcccaccccctcc

SEQ ID NO: 1113407 - DNA, 17 bp, Homo sapiens
gatcccaccccctcctc

SEQ ID NO: 1113408 - DNA, 18 bp, Homo sapiens
gatcccacttcactgtga

SEQ ID NO: 1113409 - DNA, 21 bp, Homo sapiens
gatcccagacccattccttag

SEQ ID NO: 1113410 - DNA, 17 bp, Homo sapiens
gatcccagtcactcctc

SEQ ID NO: 1113411 - DNA, 21 bp, Homo sapiens
gatcccatgtcacctcagctg

SEQ ID NO: 1113412 - DNA, 18 bp, Homo sapiens
gatccccaagtgtgaaca

SEQ ID NO: 1113413 - DNA, 16 bp, Homo sapiens
gatccccgcctggcca

SEQ ID NO: 1113414 - DNA, 16 bp, Homo sapiens
gatccctaatgtgttt

SEQ ID NO: 1113415 - DNA, 20 bp, Homo sapiens
gatccctaatgtgtttcttt

SEQ ID NO: 1113416 - DNA, 12 bp, Homo sapiens
gatccctcatct

SEQ ID NO: 1113417 - DNA, 12 bp, Homo sapiens
gatccctccacc

SEQ ID NO: 1113418 - DNA, 23 bp, Homo sapiens
gatccctctacagagcttccctg

SEQ ID NO: 1113419 - DNA, 20 bp, Homo sapiens
gatccctgaacccctggcca

SEQ ID NO: 1113420 - DNA, 13 bp, Homo sapiens
gatgattcaagcc

SEQ ID NO: 1113421 - DNA, 18 bp, Homo sapiens
gatgatttcagaaggaga

SEQ ID NO: 1113422 - DNA, 18 bp, Homo sapiens
gatgatttcatcttctgg

SEQ ID NO: 1113423 - DNA, 19 bp, Homo sapiens
gatgatttcatcttctgga

SEQ ID NO: 1113424 - DNA, 20 bp, Homo sapiens
gatgatttcatcttctggaa

SEQ ID NO: 1113425 - DNA, 18 bp, Homo sapiens
gatgatttggtcagattg

SEQ ID NO: 1113426 - DNA, 21 bp, Homo sapiens
gatgattttcatttcatgaaa

SEQ ID NO: 1113427 - DNA, 14 bp, Homo sapiens
gatgcaaagaaaat

SEQ ID NO: 1113428 - DNA, 23 bp, Homo sapiens
gatgcaaatgcatggcaaatcct

SEQ ID NO: 1113429 - DNA, 17 bp, Homo sapiens
gatgcaaggaccaggac

SEQ ID NO: 1113430 - DNA, 19 bp, Homo sapiens
gatgcaaggaccaggactc

SEQ ID NO: 1113431 - DNA, 15 bp, Homo sapiens
gatgcaaggtagcat

SEQ ID NO: 1113432 - DNA, 15 bp, Homo sapiens
gatgcaaggtgctgg

SEQ ID NO: 1113433 - DNA, 20 bp, Homo sapiens
gatgcaatcttggctcactg

SEQ ID NO: 1113434 - DNA, 14 bp, Homo sapiens
gatgcacagagaag

SEQ ID NO: 1113435 - DNA, 15 bp, Homo sapiens
gatgcacagagaagc

SEQ ID NO: 1113436 - DNA, 17 bp, Homo sapiens
gatgcacagagaagctg

SEQ ID NO: 1113437 - DNA, 18 bp, Homo sapiens
gatgcacagagaagctgg

SEQ ID NO: 1113438 - DNA, 18 bp, Homo sapiens
gatgcacagtatcttttc

SEQ ID NO: 1113439 - DNA, 14 bp, Homo sapiens
gatgcacatttctg

SEQ ID NO: 1113440 - DNA, 17 bp, Homo sapiens
gatgcacatttctggat

SEQ ID NO: 1113441 - DNA, 20 bp, Homo sapiens
gatgcacatttctggattgt

SEQ ID NO: 1113442 - DNA, 23 bp, Homo sapiens
gatgcacgtggggcccactgctc

SEQ ID NO: 1113443 - DNA, 21 bp, Homo sapiens
gatgcagcctgtggcttggag

SEQ ID NO: 1113444 - DNA, 18 bp, Homo sapiens
gatgcagctactggaatg

SEQ ID NO: 1113445 - DNA, 15 bp, Homo sapiens
gatgcagcttatacg

SEQ ID NO: 1113446 - DNA, 14 bp, Homo sapiens
gatgcagggcagtc

SEQ ID NO: 1113447 - DNA, 14 bp, Homo sapiens
gatgcagtgcttcc

SEQ ID NO: 1113448 - DNA, 19 bp, Homo sapiens
gatgcatcacactcaagga

SEQ ID NO: 1113449 - DNA, 20 bp, Homo sapiens
gatgcatcacactcaaggac

SEQ ID NO: 1113450 - DNA, 18 bp, Homo sapiens
gatgcatcgggaaagaag

SEQ ID NO: 1113451 - DNA, 19 bp, Homo sapiens
gatgcatcgggaaagaaga

SEQ ID NO: 1113452 - DNA, 15 bp, Homo sapiens
gatgcatgatgccct

SEQ ID NO: 1113453 - DNA, 16 bp, Homo sapiens
gatgcatgtcttttaa

SEQ ID NO: 1113454 - DNA, 17 bp, Homo sapiens
gatgcatgtcttttaaa

SEQ ID NO: 1113455 - DNA, 18 bp, Homo sapiens
gatgcattaaaagaaaat

SEQ ID NO: 1113456 - DNA, 17 bp, Homo sapiens
gatgcatttaataaaga

SEQ ID NO: 1113457 - DNA, 18 bp, Homo sapiens
gatgcatttaataaagat

SEQ ID NO: 1113458 - DNA, 19 bp, Homo sapiens
gatgcatttaataaagatg

SEQ ID NO: 1113459 - DNA, 19 bp, Homo sapiens
gatgccaaaaaaaaataca

SEQ ID NO: 1113460 - DNA, 18 bp, Homo sapiens
gatgccaaaatgacttta

SEQ ID NO: 1113461 - DNA, 22 bp, Homo sapiens
gatgccaaagatgtttgaaaat

SEQ ID NO: 1113462 - DNA, 15 bp, Homo sapiens
gatgccaacctctgg

SEQ ID NO: 1113463 - DNA, 20 bp, Homo sapiens
gatgccaacttcccacacgg

SEQ ID NO: 1113464 - DNA, 22 bp, Homo sapiens
gatgccaacttcccacacggca

SEQ ID NO: 1113465 - DNA, 23 bp, Homo sapiens
gatgccaatttcctctccactgc

SEQ ID NO: 1113466 - DNA, 12 bp, Homo sapiens
gatgccacccta

SEQ ID NO: 1113467 - DNA, 15 bp, Homo sapiens
gatgccaccggcctg

SEQ ID NO: 1113468 - DNA, 22 bp, Homo sapiens
gatgccacgctttgctgctacc

SEQ ID NO: 1113469 - DNA, 12 bp, Homo sapiens
gatgccagaggg

SEQ ID NO: 1113470 - DNA, 13 bp, Homo sapiens
gatgccagagggc

SEQ ID NO: 1113471 - DNA, 15 bp, Homo sapiens
gatgccagagggcca

SEQ ID NO: 1113472 - DNA, 19 bp, Homo sapiens
gatgccagagggccagcag

SEQ ID NO: 1113473 - DNA, 20 bp, Homo sapiens
gatgccagagggccagcagg

SEQ ID NO: 1113474 - DNA, 14 bp, Homo sapiens
gatgccagcttctc

SEQ ID NO: 1113475 - DNA, 19 bp, Homo sapiens
gatgccagcttctctctcc

SEQ ID NO: 1113476 - DNA, 20 bp, Homo sapiens
gatgccagcttctctctcca

SEQ ID NO: 1113477 - DNA, 23 bp, Homo sapiens
gatgccagcttctctctccaggg

SEQ ID NO: 1113478 - DNA, 12 bp, Homo sapiens
gatgccatgttt

SEQ ID NO: 1113479 - DNA, 21 bp, Homo sapiens
gatgccattacagaaccaaat

SEQ ID NO: 1113480 - DNA, 18 bp, Homo sapiens
gatgcccagaggactccc

SEQ ID NO: 1113481 - DNA, 23 bp, Homo sapiens
gatgcccagagggcccaggcagg

SEQ ID NO: 1113482 - DNA, 14 bp, Homo sapiens
gatgcccccaggca

SEQ ID NO: 1113483 - DNA, 15 bp, Homo sapiens
gatgcccccaggcag

SEQ ID NO: 1113484 - DNA, 16 bp, Homo sapiens
gatgcccccaggcagc

SEQ ID NO: 1113485 - DNA, 23 bp, Homo sapiens
gatgccccctccaggagagagcc

SEQ ID NO: 1113486 - DNA, 17 bp, Homo sapiens
gatgccccgagcccagg

SEQ ID NO: 1113487 - DNA, 21 bp, Homo sapiens
gatgcccctgcagtttggccc

SEQ ID NO: 1113488 - DNA, 23 bp, Homo sapiens
gatgcccctgcagtttggccctg

SEQ ID NO: 1113489 - DNA, 22 bp, Homo sapiens
gatgccctcccctcagcgcagg

SEQ ID NO: 1113490 - DNA, 16 bp, Homo sapiens
gatgccctcttctcct

SEQ ID NO: 1113491 - DNA, 15 bp, Homo sapiens
gatgccctggaggtg

SEQ ID NO: 1113492 - DNA, 18 bp, Homo sapiens
gatgccgaggtaaaagtt

SEQ ID NO: 1113493 - DNA, 14 bp, Homo sapiens
gatgccgggcgcca

SEQ ID NO: 1113494 - DNA, 15 bp, Homo sapiens
gatgccgggcgccag

SEQ ID NO: 1113495 - DNA, 23 bp, Homo sapiens
gatgccgggcgccaggacagcag

SEQ ID NO: 1113496 - DNA, 15 bp, Homo sapiens
gatgccgtcctgctg

SEQ ID NO: 1113497 - DNA, 21 bp, Homo sapiens
gatgcctaaaaattcccttcc

SEQ ID NO: 1113498 - DNA, 13 bp, Homo sapiens
gatgcctccaccg

SEQ ID NO: 1113499 - DNA, 16 bp, Homo sapiens
gatgcctccaccgctg

SEQ ID NO: 1113500 - DNA, 17 bp, Homo sapiens
gatgcctccaccgctgc

SEQ ID NO: 1113501 - DNA, 20 bp, Homo sapiens
gatgcctgttaatttataat

SEQ ID NO: 1113502 - DNA, 13 bp, Homo sapiens
gatgccttgaggt

SEQ ID NO: 1113503 - DNA, 23 bp, Homo sapiens
gatgcctttgctgtttagcttcc

SEQ ID NO: 1113504 - DNA, 23 bp, Homo sapiens
gatgcggctttctctgcctctgg

SEQ ID NO: 1113505 - DNA, 19 bp, Homo sapiens
gatgcggggacaggctgga

SEQ ID NO: 1113506 - DNA, 21 bp, Homo sapiens
gatgcggtggctcacgcctgt

SEQ ID NO: 1113507 - DNA, 15 bp, Homo sapiens
gatgcgtattctgtg

SEQ ID NO: 1113508 - DNA, 16 bp, Homo sapiens
gatgcgtattctgtgg

SEQ ID NO: 1113509 - DNA, 14 bp, Homo sapiens
gatgctcaggcttg

SEQ ID NO: 1113510 - DNA, 21 bp, Homo sapiens
gatgctcaggcttgaaatgca

SEQ ID NO: 1113511 - DNA, 13 bp, Homo sapiens
gatgctccagcca

SEQ ID NO: 1113512 - DNA, 17 bp, Homo sapiens
gatgctccagccaaccc

SEQ ID NO: 1113513 - DNA, 12 bp, Homo sapiens
gatgctccaggg

SEQ ID NO: 1113514 - DNA, 16 bp, Homo sapiens
gatgctccagggcagc

SEQ ID NO: 1113515 - DNA, 13 bp, Homo sapiens
gatgctccctccc

SEQ ID NO: 1113516 - DNA, 20 bp, Homo sapiens
gatgctccctcccctgccct

SEQ ID NO: 1113517 - DNA, 15 bp, Homo sapiens
gatgctccgaggact

SEQ ID NO: 1113518 - DNA, 13 bp, Homo sapiens
gatgctccttggg

SEQ ID NO: 1113519 - DNA, 15 bp, Homo sapiens
gatgctcttctgtgg

SEQ ID NO: 1113520 - DNA, 18 bp, Homo sapiens
gatgctgacccaggaata

SEQ ID NO: 1113521 - DNA, 17 bp, Homo sapiens
gatgctgactgtactcc

SEQ ID NO: 1113522 - DNA, 12 bp, Homo sapiens
gatgctgagcca

SEQ ID NO: 1113523 - DNA, 13 bp, Homo sapiens
gatgctgagccat

SEQ ID NO: 1113524 - DNA, 16 bp, Homo sapiens
gatgctgagctgtgat

SEQ ID NO: 1113525 - DNA, 14 bp, Homo sapiens
gatgctgatggagc

SEQ ID NO: 1113526 - DNA, 14 bp, Homo sapiens
gatgctgcagcaga

SEQ ID NO: 1113527 - DNA, 23 bp, Homo sapiens
gatgctgccagggcgccatcgcc

SEQ ID NO: 1113528 - DNA, 12 bp, Homo sapiens
gatgctgcctga

SEQ ID NO: 1113529 - DNA, 15 bp, Homo sapiens
gatgctgctttcccc

SEQ ID NO: 1113530 - DNA, 16 bp, Homo sapiens
gatgctggagaggtta

SEQ ID NO: 1113531 - DNA, 23 bp, Homo sapiens
gatgctgggttggtgcacagtga

SEQ ID NO: 1113532 - DNA, 19 bp, Homo sapiens
gatgctgtaacttaaaata

SEQ ID NO: 1113533 - DNA, 20 bp, Homo sapiens
gatgctgtcactggcagagc

SEQ ID NO: 1113534 - DNA, 16 bp, Homo sapiens
gatgctgtcatgtgga

SEQ ID NO: 1113535 - DNA, 13 bp, Homo sapiens
gatgctgtttgac

SEQ ID NO: 1113536 - DNA, 14 bp, Homo sapiens
gatgctgtttgaca

SEQ ID NO: 1113537 - DNA, 19 bp, Homo sapiens
gatgcttcatgtgaacgtg

SEQ ID NO: 1113538 - DNA, 24 bp, Homo sapiens
gatgcttgcctagggcctggtcca

SEQ ID NO: 1113539 - DNA, 20 bp, Homo sapiens
gatgcttgtaacaagaaaac

SEQ ID NO: 1113540 - DNA, 23 bp, Homo sapiens
gatgctttgtttctttcatatga

SEQ ID NO: 1113541 - DNA, 21 bp, Homo sapiens
gatgcttttctgtctctgcct

SEQ ID NO: 1113542 - DNA, 23 bp, Homo sapiens
gatgttaatctcccagcccacct

SEQ ID NO: 1113543 - DNA, 17 bp, Homo sapiens
gatgttacaagtttgct

SEQ ID NO: 1113544 - DNA, 22 bp, Homo sapiens
gatgttacaagtttgctaaaag

SEQ ID NO: 1113545 - DNA, 23 bp, Homo sapiens
gatgttacatcacagtgtttgca

SEQ ID NO: 1113546 - DNA, 19 bp, Homo sapiens
gatgttagaaagtgctgat

SEQ ID NO: 1113547 - DNA, 22 bp, Homo sapiens
gatgttagcctgcaaacaacat

SEQ ID NO: 1113548 - DNA, 19 bp, Homo sapiens
gatgttatgaacagctgtg

SEQ ID NO: 1113549 - DNA, 15 bp, Homo sapiens
gatgttattactgtt

SEQ ID NO: 1113550 - DNA, 17 bp, Homo sapiens
gatgttccacctgccac

SEQ ID NO: 1113551 - DNA, 22 bp, Homo sapiens
gatgttctattttttgttttgt

SEQ ID NO: 1113552 - DNA, 18 bp, Homo sapiens
gatgttgaaatatgcata

SEQ ID NO: 1113553 - DNA, 14 bp, Homo sapiens
gatgttgaactttt

SEQ ID NO: 1113554 - DNA, 19 bp, Homo sapiens
gatgttgaactttttttaa

SEQ ID NO: 1113555 - DNA, 15 bp, Homo sapiens
gatgttgaggggagg

SEQ ID NO: 1113556 - DNA, 16 bp, Homo sapiens
gatgttgataatttca

SEQ ID NO: 1113557 - DNA, 20 bp, Homo sapiens
gatgttgcttctgaatcact

SEQ ID NO: 1113558 - DNA, 19 bp, Homo sapiens
gatgttgttgttgatggca

SEQ ID NO: 1113559 - DNA, 23 bp, Homo sapiens
gatgtttacaggtggacacacaa

SEQ ID NO: 1113560 - DNA, 23 bp, Homo sapiens
gatgtttacatggcgccctgcct

SEQ ID NO: 1113561 - DNA, 13 bp, Homo sapiens
gatgtttacattt

SEQ ID NO: 1113562 - DNA, 22 bp, Homo sapiens
gatgtttacatttttaaaggta

SEQ ID NO: 1113563 - DNA, 19 bp, Homo sapiens
gatgtttacctggtgctcg

SEQ ID NO: 1113564 - DNA, 19 bp, Homo sapiens
gatgtttccagacttcctt

SEQ ID NO: 1113565 - DNA, 18 bp, Homo sapiens
gatgtttcttttgtatgt

SEQ ID NO: 1113566 - DNA, 14 bp, Homo sapiens
gatgtttgcccaaa

SEQ ID NO: 1113567 - DNA, 18 bp, Homo sapiens
gatgtttgcccaaaattt

SEQ ID NO: 1113568 - DNA, 23 bp, Homo sapiens
gatgtttggaaaaaactctgaag

SEQ ID NO: 1113569 - DNA, 15 bp, Homo sapiens
gatgtttgtggcctc

SEQ ID NO: 1113570 - DNA, 21 bp, Homo sapiens
gatgttttacgcaaggaagga

SEQ ID NO: 1113571 - DNA, 21 bp, Homo sapiens
gatgttttacgtctgggagaa

SEQ ID NO: 1113572 - DNA, 13 bp, Homo sapiens
gatgttttgatat

SEQ ID NO: 1113573 - DNA, 15 bp, Homo sapiens
gatgttttgggggaa

SEQ ID NO: 1113574 - DNA, 20 bp, Homo sapiens
gatgtttttaaaagtttcaa

SEQ ID NO: 1113575 - DNA, 13 bp, Homo sapiens
gattaaaaatacc

SEQ ID NO: 1113576 - DNA, 14 bp, Homo sapiens
gattaaaaattata

SEQ ID NO: 1113577 - DNA, 13 bp, Homo sapiens
gattaaaatctct

SEQ ID NO: 1113578 - DNA, 20 bp, Homo sapiens
gattaaaatctcttgattat

SEQ ID NO: 1113579 - DNA, 16 bp, Homo sapiens
gattaaacgtgcagac

SEQ ID NO: 1113580 - DNA, 19 bp, Homo sapiens
gattaaatacatatggatg

SEQ ID NO: 1113581 - DNA, 17 bp, Homo sapiens
gattaaatatttgaaga

SEQ ID NO: 1113582 - DNA, 18 bp, Homo sapiens
gattaaccacttcagctg

SEQ ID NO: 1113583 - DNA, 19 bp, Homo sapiens
gattaaccacttcagctga

SEQ ID NO: 1113584 - DNA, 17 bp, Homo sapiens
gattaacttatttagag

SEQ ID NO: 1113585 - DNA, 22 bp, Homo sapiens
gattaagagatgggtttgacaa

SEQ ID NO: 1113586 - DNA, 13 bp, Homo sapiens
gattaagagccat

SEQ ID NO: 1113587 - DNA, 21 bp, Homo sapiens
gattaagattttactttaaca

SEQ ID NO: 1113588 - DNA, 15 bp, Homo sapiens
gattaataacctgcc

SEQ ID NO: 1113589 - DNA, 14 bp, Homo sapiens
gattaatatgaaaa

SEQ ID NO: 1113590 - DNA, 18 bp, Homo sapiens
gattaatatgaaaactta

SEQ ID NO: 1113591 - DNA, 13 bp, Homo sapiens
gattaatgtttct

SEQ ID NO: 1113592 - DNA, 14 bp, Homo sapiens
gattaatgttttca

SEQ ID NO: 1113593 - DNA, 16 bp, Homo sapiens
gattaatgttttgtac

SEQ ID NO: 1113594 - DNA, 21 bp, Homo sapiens
gattaatttctgccatttcat

SEQ ID NO: 1113595 - DNA, 16 bp, Homo sapiens
gattacaaataaacag

SEQ ID NO: 1113596 - DNA, 21 bp, Homo sapiens
gattacaaataaacagttgtt

SEQ ID NO: 1113597 - DNA, 22 bp, Homo sapiens
gattacaaataaacagttgtta

SEQ ID NO: 1113598 - DNA, 21 bp, Homo sapiens
gattacagacatgagccactg

SEQ ID NO: 1113599 - DNA, 13 bp, Homo sapiens
gattacagaggaa

SEQ ID NO: 1113600 - DNA, 23 bp, Homo sapiens
gattacaggcacctaccaccagg

SEQ ID NO: 1113601 - DNA, 14 bp, Homo sapiens
gattacataatctg

SEQ ID NO: 1113602 - DNA, 15 bp, Homo sapiens
gattacatagatcag

SEQ ID NO: 1113603 - DNA, 23 bp, Homo sapiens
gattacatagatcagccattaaa

SEQ ID NO: 1113604 - DNA, 15 bp, Homo sapiens
gattacattcagttg

SEQ ID NO: 1113605 - DNA, 13 bp, Homo sapiens
gattacctcctga

SEQ ID NO: 1113606 - DNA, 20 bp, Homo sapiens
gattacgtgtatgtttcttc

SEQ ID NO: 1113607 - DNA, 21 bp, Homo sapiens
gattacgtgtatgtttcttct

SEQ ID NO: 1113608 - DNA, 16 bp, Homo sapiens
gattactgatgtgata

SEQ ID NO: 1113609 - DNA, 22 bp, Homo sapiens
gattactgatgtgatattctgt

SEQ ID NO: 1113610 - DNA, 17 bp, Homo sapiens
gattactgtcaataaac

SEQ ID NO: 1113611 - DNA, 20 bp, Homo sapiens
gattactttaaaataaaaaa

SEQ ID NO: 1113612 - DNA, 22 bp, Homo sapiens
gattagaaattacctgtggata

SEQ ID NO: 1113613 - DNA, 19 bp, Homo sapiens
gattagactggacagcttg

SEQ ID NO: 1113614 - DNA, 20 bp, Homo sapiens
gattagactggacagcttgt

SEQ ID NO: 1113615 - DNA, 20 bp, Homo sapiens
gattagagggaggtgtttaa

SEQ ID NO: 1113616 - DNA, 13 bp, Homo sapiens
gattagataaaga

SEQ ID NO: 1113617 - DNA, 20 bp, Homo sapiens
gattaggagaaacacattct

SEQ ID NO: 1113618 - DNA, 19 bp, Homo sapiens
gattagtaaatatgtgaag

SEQ ID NO: 1113619 - DNA, 22 bp, Homo sapiens
gattagtattcaggcactgaga

SEQ ID NO: 1113620 - DNA, 15 bp, Homo sapiens
gattataaaaaatgt

SEQ ID NO: 1113621 - DNA, 23 bp, Homo sapiens
gattataaaaaatgtaacatcat

SEQ ID NO: 1113622 - DNA, 14 bp, Homo sapiens
gattataaatgttt

SEQ ID NO: 1113623 - DNA, 21 bp, Homo sapiens
gattatagttgtgggtgggag

SEQ ID NO: 1113624 - DNA, 21 bp, Homo sapiens
gattatataaagacctataaa

SEQ ID NO: 1113625 - DNA, 21 bp, Homo sapiens
gattatctctttgatctactt

SEQ ID NO: 1113626 - DNA, 22 bp, Homo sapiens
gattatctctttgatctacttg

SEQ ID NO: 1113627 - DNA, 12 bp, Homo sapiens
gattatcttcag

SEQ ID NO: 1113628 - DNA, 21 bp, Homo sapiens
gattatcttcagcccaggctt

SEQ ID NO: 1113629 - DNA, 17 bp, Homo sapiens
gattatggaaaaataaa

SEQ ID NO: 1113630 - DNA, 20 bp, Homo sapiens
gattatggaaaaataaaact

SEQ ID NO: 1113631 - DNA, 16 bp, Homo sapiens
gattattactaattct

SEQ ID NO: 1113632 - DNA, 18 bp, Homo sapiens
gattattactaattctat

SEQ ID NO: 1113633 - DNA, 20 bp, Homo sapiens
gattattagccaggtaatgt

SEQ ID NO: 1113634 - DNA, 12 bp, Homo sapiens
gattattataaa

SEQ ID NO: 1113635 - DNA, 16 bp, Homo sapiens
gattattatgtttatt

SEQ ID NO: 1113636 - DNA, 13 bp, Homo sapiens
gattattcagtgt

SEQ ID NO: 1113637 - DNA, 14 bp, Homo sapiens
gattattcagtgtc

SEQ ID NO: 1113638 - DNA, 15 bp, Homo sapiens
gattattcagtgtca

SEQ ID NO: 1113639 - DNA, 15 bp, Homo sapiens
gattattcatttaaa

SEQ ID NO: 1113640 - DNA, 20 bp, Homo sapiens
gattattcatttaaaatgat

SEQ ID NO: 1113641 - DNA, 19 bp, Homo sapiens
gattattctgattccactt

SEQ ID NO: 1113642 - DNA, 13 bp, Homo sapiens
gattattgaaata

SEQ ID NO: 1113643 - DNA, 22 bp, Homo sapiens
gattattgtgacttcactgtat

SEQ ID NO: 1113644 - DNA, 13 bp, Homo sapiens
gattatttacaag

SEQ ID NO: 1113645 - DNA, 22 bp, Homo sapiens
gattatttcactttagatgctg

SEQ ID NO: 1113646 - DNA, 23 bp, Homo sapiens
gattatttcactttagatgctga

SEQ ID NO: 1113647 - DNA, 14 bp, Homo sapiens
gattatttgcatgt

SEQ ID NO: 1113648 - DNA, 19 bp, Homo sapiens
gattatttgcatgttatgt

SEQ ID NO: 1113649 - DNA, 18 bp, Homo sapiens
gattatttgggagggaaa

SEQ ID NO: 1113650 - DNA, 18 bp, Homo sapiens
gattatttgtgcatttta

SEQ ID NO: 1113651 - DNA, 22 bp, Homo sapiens
gattattttttaaaaaggtaaa

SEQ ID NO: 1113652 - DNA, 23 bp, Homo sapiens
gattcaaaatatttaaaaatgtc

SEQ ID NO: 1113653 - DNA, 23 bp, Homo sapiens
gattcaaagtgttgtgttcctgg

SEQ ID NO: 1113654 - DNA, 18 bp, Homo sapiens
gattcaaatgttttaaag

SEQ ID NO: 1113655 - DNA, 18 bp, Homo sapiens
gattcaaattgctgcttg

SEQ ID NO: 1113656 - DNA, 17 bp, Homo sapiens
gattcaagccattccaa

SEQ ID NO: 1113657 - DNA, 13 bp, Homo sapiens
gattcaataatga

SEQ ID NO: 1113658 - DNA, 21 bp, Homo sapiens
gattcaatattgaatttttcc

SEQ ID NO: 1113659 - DNA, 16 bp, Homo sapiens
gattcaatctgtaaac

SEQ ID NO: 1113660 - DNA, 17 bp, Homo sapiens
gattcaattataattgt

SEQ ID NO: 1113661 - DNA, 18 bp, Homo sapiens
gattcaattataattgta

SEQ ID NO: 1113662 - DNA, 15 bp, Homo sapiens
gattcacatctcatt

SEQ ID NO: 1113663 - DNA, 23 bp, Homo sapiens
gcacttgtgattatttattattt

SEQ ID NO: 1113664 - DNA, 13 bp, Homo sapiens
gcactttaaaaca

SEQ ID NO: 1113665 - DNA, 19 bp, Homo sapiens
gcactttaaagaggctgtg

SEQ ID NO: 1113666 - DNA, 16 bp, Homo sapiens
gcactttaagctcctt

SEQ ID NO: 1113667 - DNA, 18 bp, Homo sapiens
gcactttaattgaagaac

SEQ ID NO: 1113668 - DNA, 16 bp, Homo sapiens
gcactttagacatttt

SEQ ID NO: 1113669 - DNA, 17 bp, Homo sapiens
gcactttcccccttccc

SEQ ID NO: 1113670 - DNA, 16 bp, Homo sapiens
gcactttctaatgttt

SEQ ID NO: 1113671 - DNA, 12 bp, Homo sapiens
gcactttgcact

SEQ ID NO: 1113672 - DNA, 14 bp, Homo sapiens
gcactttgcactta

SEQ ID NO: 1113673 - DNA, 14 bp, Homo sapiens
gcactttgggaggc

SEQ ID NO: 1113674 - DNA, 16 bp, Homo sapiens
gcactttgggaggcct

SEQ ID NO: 1113675 - DNA, 16 bp, Homo sapiens
gcactttgggaggctg

SEQ ID NO: 1113676 - DNA, 14 bp, Homo sapiens
gcactttgtaaatt

SEQ ID NO: 1113677 - DNA, 15 bp, Homo sapiens
gcactttgtaaattc

SEQ ID NO: 1113678 - DNA, 14 bp, Homo sapiens
gcactttgtttaga

SEQ ID NO: 1113679 - DNA, 18 bp, Homo sapiens
gcactttgtttagaaaaa

SEQ ID NO: 1113680 - DNA, 20 bp, Homo sapiens
gcactttgtttagaaaaaaa

SEQ ID NO: 1113681 - DNA, 14 bp, Homo sapiens
gcacttttaaaaaa

SEQ ID NO: 1113682 - DNA, 18 bp, Homo sapiens
gcacttttattttcattg

SEQ ID NO: 1113683 - DNA, 19 bp, Homo sapiens
gcacttttattttcattgt

SEQ ID NO: 1113684 - DNA, 16 bp, Homo sapiens
gcactttttaattcac

SEQ ID NO: 1113685 - DNA, 19 bp, Homo sapiens
gcagaaaaaggctgtgctg

SEQ ID NO: 1113686 - DNA, 21 bp, Homo sapiens
gcagaaaacccttgggccaga

SEQ ID NO: 1113687 - DNA, 17 bp, Homo sapiens
gcagaaaagcacctgcc

SEQ ID NO: 1113688 - DNA, 17 bp, Homo sapiens
gcagaaaagctcagagt

SEQ ID NO: 1113689 - DNA, 19 bp, Homo sapiens
gcagaaacctatctcaggg

SEQ ID NO: 1113690 - DNA, 20 bp, Homo sapiens
gcagaaagcaaaattatgtt

SEQ ID NO: 1113691 - DNA, 20 bp, Homo sapiens
gcagaaagtaagcatttcca

SEQ ID NO: 1113692 - DNA, 16 bp, Homo sapiens
gcagaaatcgagagtg

SEQ ID NO: 1113693 - DNA, 23 bp, Homo sapiens
gcagaaatcgagagtgtgctctc

SEQ ID NO: 1113694 - DNA, 12 bp, Homo sapiens
gcagaaatgatt

SEQ ID NO: 1113695 - DNA, 14 bp, Homo sapiens
gcagaacaaatgtg

SEQ ID NO: 1113696 - DNA, 18 bp, Homo sapiens
gcagaacaaatgtgtttt

SEQ ID NO: 1113697 - DNA, 22 bp, Homo sapiens
gcagaacaaatgtgtttttcta

SEQ ID NO: 1113698 - DNA, 12 bp, Homo sapiens
gcagaacacctg

SEQ ID NO: 1113699 - DNA, 21 bp, Homo sapiens
gcagaacctgcacacaggaca

SEQ ID NO: 1113700 - DNA, 23 bp, Homo sapiens
gcagaacctgcacacaggacagc

SEQ ID NO: 1113701 - DNA, 15 bp, Homo sapiens
gcagaacggaggagg

SEQ ID NO: 1113702 - DNA, 21 bp, Homo sapiens
gcagaacgtattggtccagct

SEQ ID NO: 1113703 - DNA, 18 bp, Homo sapiens
gcagaactctctgtcttc

SEQ ID NO: 1113704 - DNA, 14 bp, Homo sapiens
gcagaactgaagcc

SEQ ID NO: 1113705 - DNA, 17 bp, Homo sapiens
gcagaactgaagccact

SEQ ID NO: 1113706 - DNA, 16 bp, Homo sapiens
gcagaactgagctcct

SEQ ID NO: 1113707 - DNA, 12 bp, Homo sapiens
gcagaactgcca

SEQ ID NO: 1113708 - DNA, 21 bp, Homo sapiens
gcagaactgccattattttct

SEQ ID NO: 1113709 - DNA, 16 bp, Homo sapiens
gcagaagacaaaaaga

SEQ ID NO: 1113710 - DNA, 16 bp, Homo sapiens
gcagaagagaaaggac

SEQ ID NO: 1113711 - DNA, 19 bp, Homo sapiens
gcagaagccccacagcctg

SEQ ID NO: 1113712 - DNA, 13 bp, Homo sapiens
gcagaaggaaaaa

SEQ ID NO: 1113713 - DNA, 15 bp, Homo sapiens
gcagaaggaaaaatg

SEQ ID NO: 1113714 - DNA, 13 bp, Homo sapiens
gcagaagggaatt

SEQ ID NO: 1113715 - DNA, 13 bp, Homo sapiens
gcagaagggagaa

SEQ ID NO: 1113716 - DNA, 17 bp, Homo sapiens
gcagaagtaagcctcat

SEQ ID NO: 1113717 - DNA, 16 bp, Homo sapiens
gcagaagtcagcccga

SEQ ID NO: 1113718 - DNA, 14 bp, Homo sapiens
gcagaagtctggct

SEQ ID NO: 1113719 - DNA, 15 bp, Homo sapiens
gcagaagtctggctt

SEQ ID NO: 1113720 - DNA, 20 bp, Homo sapiens
gcagaagtgagcccccccct

SEQ ID NO: 1113721 - DNA, 15 bp, Homo sapiens
gcagaataatggaaa

SEQ ID NO: 1113722 - DNA, 16 bp, Homo sapiens
gcagaataatggaaac

SEQ ID NO: 1113723 - DNA, 15 bp, Homo sapiens
gcagaatactggtct

SEQ ID NO: 1113724 - DNA, 15 bp, Homo sapiens
gcagaatgaacccat

SEQ ID NO: 1113725 - DNA, 14 bp, Homo sapiens
gcagaatggaaaaa

SEQ ID NO: 1113726 - DNA, 18 bp, Homo sapiens
gcagaatggagaaagtaa

SEQ ID NO: 1113727 - DNA, 17 bp, Homo sapiens
gcagaatggaggcaggg

SEQ ID NO: 1113728 - DNA, 19 bp, Homo sapiens
gcagaatgttgtacttgaa

SEQ ID NO: 1113729 - DNA, 13 bp, Homo sapiens
gcagaatgttttt

SEQ ID NO: 1113730 - DNA, 13 bp, Homo sapiens
gcagaattcattc

SEQ ID NO: 1113731 - DNA, 12 bp, Homo sapiens
gcagaattttaa

SEQ ID NO: 1113732 - DNA, 19 bp, Homo sapiens
gcagaattttaatgtgaag

SEQ ID NO: 1113733 - DNA, 18 bp, Homo sapiens
gcagacaacaccttcctc

SEQ ID NO: 1113734 - DNA, 21 bp, Homo sapiens
gcagacacagggacttgaagt

SEQ ID NO: 1113735 - DNA, 22 bp, Homo sapiens
gcagacacagggacttgaagtt

SEQ ID NO: 1113736 - DNA, 22 bp, Homo sapiens
gcagacacattgtcatcagagg

SEQ ID NO: 1113737 - DNA, 17 bp, Homo sapiens
gcagacacctggactga

SEQ ID NO: 1113738 - DNA, 15 bp, Homo sapiens
gcagacagaaactgg

SEQ ID NO: 1113739 - DNA, 16 bp, Homo sapiens
gcagacagaaactgga

SEQ ID NO: 1113740 - DNA, 17 bp, Homo sapiens
gcagacagaaactggat

SEQ ID NO: 1113741 - DNA, 17 bp, Homo sapiens
gcagacagaagtctcct

SEQ ID NO: 1113742 - DNA, 20 bp, Homo sapiens
gcagacagaagtctcctcaa

SEQ ID NO: 1113743 - DNA, 16 bp, Homo sapiens
gcagacagagccagga

SEQ ID NO: 1113744 - DNA, 21 bp, Homo sapiens
gcagacagagccaggagaagc

SEQ ID NO: 1113745 - DNA, 23 bp, Homo sapiens
gcagacagagccaggagaagctc

SEQ ID NO: 1113746 - DNA, 21 bp, Homo sapiens
gcagacagcagctcaggcaca

SEQ ID NO: 1113747 - DNA, 20 bp, Homo sapiens
gcagacaggccatgtgagcc

SEQ ID NO: 1113748 - DNA, 20 bp, Homo sapiens
gcagacatagaagagccaag

SEQ ID NO: 1113749 - DNA, 16 bp, Homo sapiens
gcagacatctctggag

SEQ ID NO: 1113750 - DNA, 18 bp, Homo sapiens
gcagacatctctggagcc

SEQ ID NO: 1113751 - DNA, 19 bp, Homo sapiens
gcagacatctctggagcca

SEQ ID NO: 1113752 - DNA, 17 bp, Homo sapiens
gcagacattttaaaaaa

SEQ ID NO: 1113753 - DNA, 13 bp, Homo sapiens
gcagaccaccccg

SEQ ID NO: 1113754 - DNA, 17 bp, Homo sapiens
gcagaccaccccgcctg

SEQ ID NO: 1113755 - DNA, 20 bp, Homo sapiens
gcagaccacgcccgtcctgc

SEQ ID NO: 1113756 - DNA, 21 bp, Homo sapiens
gcagacccatacctttccagg

SEQ ID NO: 1113757 - DNA, 13 bp, Homo sapiens
gcagacctcatgc

SEQ ID NO: 1113758 - DNA, 14 bp, Homo sapiens
gcagacctcatgcc

SEQ ID NO: 1113759 - DNA, 21 bp, Homo sapiens
gcagacctgtcaccctgcagg

SEQ ID NO: 1113760 - DNA, 14 bp, Homo sapiens
gcagaccttactca

SEQ ID NO: 1113761 - DNA, 19 bp, Homo sapiens
gcagaccttactcagggga

SEQ ID NO: 1113762 - DNA, 17 bp, Homo sapiens
gcagaccttttttagga

SEQ ID NO: 1113763 - DNA, 20 bp, Homo sapiens
gcagacgggaatgcctaggt

SEQ ID NO: 1113764 - DNA, 18 bp, Homo sapiens
gcagacggtctgtgtgct

SEQ ID NO: 1113765 - DNA, 14 bp, Homo sapiens
gcagacgtccatca

SEQ ID NO: 1113766 - DNA, 19 bp, Homo sapiens
gcagacgtcgtacccagcc

SEQ ID NO: 1113767 - DNA, 18 bp, Homo sapiens
gcagactcagtttgtcag

SEQ ID NO: 1113768 - DNA, 22 bp, Homo sapiens
gcagactcctcagatctgaaca

SEQ ID NO: 1113769 - DNA, 17 bp, Homo sapiens
gcagactgcttggccag

SEQ ID NO: 1113770 - DNA, 21 bp, Homo sapiens
gcagactttcccaaatgtatt

SEQ ID NO: 1113771 - DNA, 22 bp, Homo sapiens
gcagactttcccaaatgtattg

SEQ ID NO: 1113772 - DNA, 15 bp, Homo sapiens
gcagagaaagaagag

SEQ ID NO: 1113773 - DNA, 14 bp, Homo sapiens
gcagagaagttcct

SEQ ID NO: 1113774 - DNA, 17 bp, Homo sapiens
gcagagaatctcttggg

SEQ ID NO: 1113775 - DNA, 22 bp, Homo sapiens
gcagagaatggctgggtcaggg

SEQ ID NO: 1113776 - DNA, 13 bp, Homo sapiens
gcagagacactaa

SEQ ID NO: 1113777 - DNA, 19 bp, Homo sapiens
gcagagagagccagacagc

SEQ ID NO: 1113778 - DNA, 22 bp, Homo sapiens
gcagagagcaggacaggagaca

SEQ ID NO: 1113779 - DNA, 18 bp, Homo sapiens
gcagagagccctgggtga

SEQ ID NO: 1113780 - DNA, 18 bp, Homo sapiens
gcagagagggatgggttc

SEQ ID NO: 1113781 - DNA, 15 bp, Homo sapiens
gcagagaggtggcca

SEQ ID NO: 1113782 - DNA, 22 bp, Homo sapiens
gcagagagtacagactgcagac

SEQ ID NO: 1113783 - DNA, 13 bp, Homo sapiens
gcagagcaataac

SEQ ID NO: 1113784 - DNA, 17 bp, Homo sapiens
gcagagcacagcccacg

SEQ ID NO: 1113785 - DNA, 21 bp, Homo sapiens
gcagccggagggaggcactag

SEQ ID NO: 1113786 - DNA, 22 bp, Homo sapiens
gcagccgtcccaggccaccccc

SEQ ID NO: 1113787 - DNA, 22 bp, Homo sapiens
gcagcctcatactcctgggctc

SEQ ID NO: 1113788 - DNA, 21 bp, Homo sapiens
gcagcctcattctgaggcctg

SEQ ID NO: 1113789 - DNA, 14 bp, Homo sapiens
gcagcctccagagc

SEQ ID NO: 1113790 - DNA, 18 bp, Homo sapiens
gcagcctccagagccagc

SEQ ID NO: 1113791 - DNA, 20 bp, Homo sapiens
gcagcctccagagccagcct

SEQ ID NO: 1113792 - DNA, 23 bp, Homo sapiens
gcagcctccagagccagcctggg

SEQ ID NO: 1113793 - DNA, 22 bp, Homo sapiens
gcagcctccagttgtagcaggt

SEQ ID NO: 1113794 - DNA, 22 bp, Homo sapiens
gcagcctccctctgacctgcag

SEQ ID NO: 1113795 - DNA, 14 bp, Homo sapiens
gcagcctcctcctg

SEQ ID NO: 1113796 - DNA, 15 bp, Homo sapiens
gcagcctcctcctga

SEQ ID NO: 1113797 - DNA, 18 bp, Homo sapiens
gcagcctcctcctgacca

SEQ ID NO: 1113798 - DNA, 12 bp, Homo sapiens
gcagcctccttt

SEQ ID NO: 1113799 - DNA, 17 bp, Homo sapiens
gcagcctcctttgtgtg

SEQ ID NO: 1113800 - DNA, 20 bp, Homo sapiens
gcagcctctcagtgccctcc

SEQ ID NO: 1113801 - DNA, 22 bp, Homo sapiens
gcagcctctcagtgccctccag

SEQ ID NO: 1113802 - DNA, 16 bp, Homo sapiens
gcagcctctccccagg

SEQ ID NO: 1113803 - DNA, 13 bp, Homo sapiens
gcagcctctgcct

SEQ ID NO: 1113804 - DNA, 18 bp, Homo sapiens
gcagcctctggacagcca

SEQ ID NO: 1113805 - DNA, 21 bp, Homo sapiens
gcagcctctggacagccagtg

SEQ ID NO: 1113806 - DNA, 13 bp, Homo sapiens
gcagcctgatggc

SEQ ID NO: 1113807 - DNA, 20 bp, Homo sapiens
gcagcctgatggccaagggg

SEQ ID NO: 1113808 - DNA, 21 bp, Homo sapiens
gcagcctgatggccaaggggg

SEQ ID NO: 1113809 - DNA, 12 bp, Homo sapiens
gcagcctgctgg

SEQ ID NO: 1113810 - DNA, 15 bp, Homo sapiens
gcagcctgctggggc

SEQ ID NO: 1113811 - DNA, 14 bp, Homo sapiens
gcagcctggaccct

SEQ ID NO: 1113812 - DNA, 19 bp, Homo sapiens
gcagcctggagacttccta

SEQ ID NO: 1113813 - DNA, 10 bp, Homo sapiens
gcagcctggg

SEQ ID NO: 1113814 - DNA, 17 bp, Homo sapiens
gcagcctggggctggcc

SEQ ID NO: 1113815 - DNA, 22 bp, Homo sapiens
gcagcctggtagaattgggaag

SEQ ID NO: 1113816 - DNA, 15 bp, Homo sapiens
gcagcctgtgaggga

SEQ ID NO: 1113817 - DNA, 19 bp, Homo sapiens
gcagcctgtgagggagtgc

SEQ ID NO: 1113818 - DNA, 12 bp, Homo sapiens
gcagcctgtggc

SEQ ID NO: 1113819 - DNA, 16 bp, Homo sapiens
gcagcctgtggcatct

SEQ ID NO: 1113820 - DNA, 15 bp, Homo sapiens
gcagccttcccctcc

SEQ ID NO: 1113821 - DNA, 18 bp, Homo sapiens
gcagccttgcgctgtccc

SEQ ID NO: 1113822 - DNA, 22 bp, Homo sapiens
gcagccttgcgctgtcccaggc

SEQ ID NO: 1113823 - DNA, 15 bp, Homo sapiens
gcagccttggggcat

SEQ ID NO: 1113824 - DNA, 21 bp, Homo sapiens
gcagccttgggggggctgcct

SEQ ID NO: 1113825 - DNA, 23 bp, Homo sapiens
gcagccttgggggggctgccttt

SEQ ID NO: 1113826 - DNA, 15 bp, Homo sapiens
gcagcctttccagcc

SEQ ID NO: 1113827 - DNA, 17 bp, Homo sapiens
gcagcctttgcctcccc

SEQ ID NO: 1113828 - DNA, 18 bp, Homo sapiens
gcagcctttgcctccccg

SEQ ID NO: 1113829 - DNA, 21 bp, Homo sapiens
gcagccttttctggtccctct

SEQ ID NO: 1113830 - DNA, 16 bp, Homo sapiens
gcagcgaccgccccct

SEQ ID NO: 1113831 - DNA, 17 bp, Homo sapiens
gcagcgaccgccccctc

SEQ ID NO: 1113832 - DNA, 22 bp, Homo sapiens
gcagcgaccgccccctcctcta

SEQ ID NO: 1113833 - DNA, 23 bp, Homo sapiens
gcagcgcacggtctggggaagag

SEQ ID NO: 1113834 - DNA, 19 bp, Homo sapiens
gcagcgcagggctggcacg

SEQ ID NO: 1113835 - DNA, 13 bp, Homo sapiens
gcagcgcccaggc

SEQ ID NO: 1113836 - DNA, 15 bp, Homo sapiens
gcagcgcccaggcct

SEQ ID NO: 1113837 - DNA, 19 bp, Homo sapiens
gcagcgcccaggcctgctg

SEQ ID NO: 1113838 - DNA, 13 bp, Homo sapiens
gcagcgcctccct

SEQ ID NO: 1113839 - DNA, 14 bp, Homo sapiens
gcagcggctctggt

SEQ ID NO: 1113840 - DNA, 17 bp, Homo sapiens
gcagcggctctggtcct

SEQ ID NO: 1113841 - DNA, 18 bp, Homo sapiens
gcagcggtgggaaggaaa

SEQ ID NO: 1113842 - DNA, 19 bp, Homo sapiens
gcagcggtgggaaggaaag

SEQ ID NO: 1113843 - DNA, 16 bp, Homo sapiens
gcagcgtgggctctgc

SEQ ID NO: 1113844 - DNA, 21 bp, Homo sapiens
gcagcgtgggctctgccaatg

SEQ ID NO: 1113845 - DNA, 14 bp, Homo sapiens
gcagctactggaat

SEQ ID NO: 1113846 - DNA, 19 bp, Homo sapiens
gcagctactgtaacttttt

SEQ ID NO: 1113847 - DNA, 16 bp, Homo sapiens
gcagctaggactgagg

SEQ ID NO: 1113848 - DNA, 18 bp, Homo sapiens
gcagctaggactgaggag

SEQ ID NO: 1113849 - DNA, 20 bp, Homo sapiens
gcagctaggactgaggagtg

SEQ ID NO: 1113850 - DNA, 19 bp, Homo sapiens
gcagctatgcgcaatgtgg

SEQ ID NO: 1113851 - DNA, 16 bp, Homo sapiens
gcagctatttcagcct

SEQ ID NO: 1113852 - DNA, 23 bp, Homo sapiens
gcagctcaagcagcgaccgcccc

SEQ ID NO: 1113853 - DNA, 16 bp, Homo sapiens
gcagctcacccctggg

SEQ ID NO: 1113854 - DNA, 21 bp, Homo sapiens
gcagctcacccctgggcaggc

SEQ ID NO: 1113855 - DNA, 22 bp, Homo sapiens
gcagctcacccctgggcaggcg

SEQ ID NO: 1113856 - DNA, 14 bp, Homo sapiens
gcagctccctcctg

SEQ ID NO: 1113857 - DNA, 18 bp, Homo sapiens
gcagctccctttctcagg

SEQ ID NO: 1113858 - DNA, 19 bp, Homo sapiens
gcagctccctttctcagga

SEQ ID NO: 1113859 - DNA, 12 bp, Homo sapiens
gcagctcctcag

SEQ ID NO: 1113860 - DNA, 17 bp, Homo sapiens
gcagctcctccctgtgc

SEQ ID NO: 1113861 - DNA, 19 bp, Homo sapiens
gcagctcctctccttgggc

SEQ ID NO: 1113862 - DNA, 14 bp, Homo sapiens
gcagctctccagtc

SEQ ID NO: 1113863 - DNA, 15 bp, Homo sapiens
gcagctctccagtca

SEQ ID NO: 1113864 - DNA, 14 bp, Homo sapiens
gcagctcttctgga

SEQ ID NO: 1113865 - DNA, 24 bp, Homo sapiens
gcagctcttctgggcagagcctgt

SEQ ID NO: 1113866 - DNA, 17 bp, Homo sapiens
gcagctcttgcccttcc

SEQ ID NO: 1113867 - DNA, 19 bp, Homo sapiens
gcagctcttgcccttccct

SEQ ID NO: 1113868 - DNA, 16 bp, Homo sapiens
gcagctgagagccctg

SEQ ID NO: 1113869 - DNA, 21 bp, Homo sapiens
gcagctgatgttggaagagaa

SEQ ID NO: 1113870 - DNA, 13 bp, Homo sapiens
gcagctgcccctc

SEQ ID NO: 1113871 - DNA, 20 bp, Homo sapiens
gcagctgcccctcctggagc

SEQ ID NO: 1113872 - DNA, 20 bp, Homo sapiens
gcagctgcctggccatgctg

SEQ ID NO: 1113873 - DNA, 14 bp, Homo sapiens
gcagctgcgggtct

SEQ ID NO: 1113874 - DNA, 17 bp, Homo sapiens
gcagctgcgggtctgaa

SEQ ID NO: 1113875 - DNA, 11 bp, Homo sapiens
gcagctgctgt

SEQ ID NO: 1113876 - DNA, 12 bp, Homo sapiens
gcagctgctgtg

SEQ ID NO: 1113877 - DNA, 23 bp, Homo sapiens
gcagctggaaaagggtcttggga

SEQ ID NO: 1113878 - DNA, 14 bp, Homo sapiens
gcagctggacagag

SEQ ID NO: 1113879 - DNA, 17 bp, Homo sapiens
gcagctggacagagggg

SEQ ID NO: 1113880 - DNA, 11 bp, Homo sapiens
gcagctggccc

SEQ ID NO: 1113881 - DNA, 13 bp, Homo sapiens
gcagctggctctc

SEQ ID NO: 1113882 - DNA, 12 bp, Homo sapiens
gcagctgggccc

SEQ ID NO: 1113883 - DNA, 17 bp, Homo sapiens
gcagctgggccccatgc

SEQ ID NO: 1113884 - DNA, 18 bp, Homo sapiens
gcagctgggcttggcctg

SEQ ID NO: 1113885 - DNA, 22 bp, Homo sapiens
gcagctgggcttggcctggaga

SEQ ID NO: 1113886 - DNA, 23 bp, Homo sapiens
gcagctgggcttggcctggagag

SEQ ID NO: 1113887 - DNA, 12 bp, Homo sapiens
gcagctggggta

SEQ ID NO: 1113888 - DNA, 14 bp, Homo sapiens
gcagctggtctttt

SEQ ID NO: 1113889 - DNA, 19 bp, Homo sapiens
gcagctggtcttttctcct

SEQ ID NO: 1113890 - DNA, 20 bp, Homo sapiens
gcagctgtcccctctccctg

SEQ ID NO: 1113891 - DNA, 14 bp, Homo sapiens
gcagctgtcctgaa

SEQ ID NO: 1113892 - DNA, 15 bp, Homo sapiens
gcagctgtcctgaac

SEQ ID NO: 1113893 - DNA, 11 bp, Homo sapiens
gcagctgtgat

SEQ ID NO: 1113894 - DNA, 14 bp, Homo sapiens
gcagctgtttctca

SEQ ID NO: 1113895 - DNA, 16 bp, Homo sapiens
gcagctgtttctcatg

SEQ ID NO: 1113896 - DNA, 19 bp, Homo sapiens
gcagctgttttcaaagccc

SEQ ID NO: 1113897 - DNA, 20 bp, Homo sapiens
gcagctgttttgttgacatt

SEQ ID NO: 1113898 - DNA, 15 bp, Homo sapiens
gcagcttagggccct

SEQ ID NO: 1113899 - DNA, 18 bp, Homo sapiens
gcagcttagggccctgga

SEQ ID NO: 1113900 - DNA, 19 bp, Homo sapiens
gcagcttagggccctggag

SEQ ID NO: 1113901 - DNA, 23 bp, Homo sapiens
gcagcttataatgggctctccgg

SEQ ID NO: 1113902 - DNA, 15 bp, Homo sapiens
gcagcttccttctgg

SEQ ID NO: 1113903 - DNA, 21 bp, Homo sapiens
gcagcttccttctgggactgg

SEQ ID NO: 1113904 - DNA, 14 bp, Homo sapiens
gcagcttcgaggac

SEQ ID NO: 1113905 - DNA, 17 bp, Homo sapiens
gcagcttcgaggacagg

SEQ ID NO: 1113906 - DNA, 21 bp, Homo sapiens
gcagcttcgaggacaggaaag

SEQ ID NO: 1113907 - DNA, 17 bp, Homo sapiens
gcagcttcggtgtgcag

SEQ ID NO: 1113908 - DNA, 13 bp, Homo sapiens
gcagcttcttggg

SEQ ID NO: 1113909 - DNA, 14 bp, Homo sapiens
gcagcttcttgggc

SEQ ID NO: 1113910 - DNA, 21 bp, Homo sapiens
gcagcttcttgggctgagtgc

SEQ ID NO: 1113911 - DNA, 24 bp, Homo sapiens
gcagcttcttgggctgagtgcagc

SEQ ID NO: 1113912 - DNA, 14 bp, Homo sapiens
gcagcttgccccgg

SEQ ID NO: 1113913 - DNA, 15 bp, Homo sapiens
gcagcttggggagag

SEQ ID NO: 1113914 - DNA, 23 bp, Homo sapiens
gcagctttactgccttcctcctt

SEQ ID NO: 1113915 - DNA, 14 bp, Homo sapiens
gcagctttatgttc

SEQ ID NO: 1113916 - DNA, 14 bp, Homo sapiens
gcagctttttctgt

SEQ ID NO: 1113917 - DNA, 17 bp, Homo sapiens
gcagctttttctgtgga

SEQ ID NO: 1113918 - DNA, 21 bp, Homo sapiens
gcaggaaacatttctgacacc

SEQ ID NO: 1113919 - DNA, 14 bp, Homo sapiens
gcaggaaagccaca

SEQ ID NO: 1113920 - DNA, 15 bp, Homo sapiens
gcaggaaagccacat

SEQ ID NO: 1113921 - DNA, 16 bp, Homo sapiens
gcaggaacaaacaggg

SEQ ID NO: 1113922 - DNA, 16 bp, Homo sapiens
gcaggaacatacagac

SEQ ID NO: 1113923 - DNA, 22 bp, Homo sapiens
gcaggaacgagcactggccaga

SEQ ID NO: 1113924 - DNA, 18 bp, Homo sapiens
gcaggaactgggctgggc

SEQ ID NO: 1113925 - DNA, 20 bp, Homo sapiens
gcaggaactgggctgggcct

SEQ ID NO: 1113926 - DNA, 13 bp, Homo sapiens
gcaggaagaggcc

SEQ ID NO: 1113927 - DNA, 16 bp, Homo sapiens
gcaggaagaggcccac

SEQ ID NO: 1113928 - DNA, 23 bp, Homo sapiens
gcaggaaggacaggaagctggca

SEQ ID NO: 1113929 - DNA, 18 bp, Homo sapiens
gcaggaaggaccccacat

SEQ ID NO: 1113930 - DNA, 23 bp, Homo sapiens
gcaggaaggactatgaaaagcta

SEQ ID NO: 1113931 - DNA, 16 bp, Homo sapiens
gcaggaagggaagcgt

SEQ ID NO: 1113932 - DNA, 16 bp, Homo sapiens
gcaggaagggtgggaa

SEQ ID NO: 1113933 - DNA, 19 bp, Homo sapiens
gcaggaatatatgtgtgcc

SEQ ID NO: 1113934 - DNA, 17 bp, Homo sapiens
gcaggaatgaaaacatt

SEQ ID NO: 1113935 - DNA, 17 bp, Homo sapiens
gcaggaatgggggtcag

SEQ ID NO: 1113936 - DNA, 19 bp, Homo sapiens
gcaggaatgggggtcagaa

SEQ ID NO: 1113937 - DNA, 14 bp, Homo sapiens
gcaggaattatgtc

SEQ ID NO: 1113938 - DNA, 18 bp, Homo sapiens
gcaggaattggtggcaga

SEQ ID NO: 1113939 - DNA, 19 bp, Homo sapiens
gcaggaattggtggcagat

SEQ ID NO: 1113940 - DNA, 15 bp, Homo sapiens
gcaggacaggagaca

SEQ ID NO: 1113941 - DNA, 20 bp, Homo sapiens
gcaggacctactaggagagg

SEQ ID NO: 1113942 - DNA, 16 bp, Homo sapiens
gcaggacctcagagtc

SEQ ID NO: 1113943 - DNA, 23 bp, Homo sapiens
gcaggacctcagagtccaggccc

SEQ ID NO: 1113944 - DNA, 22 bp, Homo sapiens
gcaggacctcccttccgaccct

SEQ ID NO: 1113945 - DNA, 12 bp, Homo sapiens
gcaggacctgcc

SEQ ID NO: 1113946 - DNA, 13 bp, Homo sapiens
gcaggacctgcct

SEQ ID NO: 1113947 - DNA, 14 bp, Homo sapiens
gcaggacctgccta

SEQ ID NO: 1113948 - DNA, 16 bp, Homo sapiens
gcaggacctgcctagc

SEQ ID NO: 1113949 - DNA, 17 bp, Homo sapiens
gcaggacctgcctagca

SEQ ID NO: 1113950 - DNA, 21 bp, Homo sapiens
gcaggacctgcctagcatggg

SEQ ID NO: 1113951 - DNA, 22 bp, Homo sapiens
gcaggacctgcctagcatgggg

SEQ ID NO: 1113952 - DNA, 17 bp, Homo sapiens
gcaggacctgtgctttg

SEQ ID NO: 1113953 - DNA, 20 bp, Homo sapiens
gcaggaccttcgggctgtgc

SEQ ID NO: 1113954 - DNA, 14 bp, Homo sapiens
gcaggactcctggc

SEQ ID NO: 1113955 - DNA, 15 bp, Homo sapiens
gcaggactcctggca

SEQ ID NO: 1113956 - DNA, 16 bp, Homo sapiens
gcaggactcctggcag

SEQ ID NO: 1113957 - DNA, 17 bp, Homo sapiens
gcaggactcctggcagg

SEQ ID NO: 1113958 - DNA, 20 bp, Homo sapiens
gcaggactcctggcagggcc

SEQ ID NO: 1113959 - DNA, 19 bp, Homo sapiens
gcaggactgcacagcgtcc

SEQ ID NO: 1113960 - DNA, 19 bp, Homo sapiens
gcaggacttgctaaagcac

SEQ ID NO: 1113961 - DNA, 23 bp, Homo sapiens
gcaggagaatcgcttgaacctgg

SEQ ID NO: 1113962 - DNA, 22 bp, Homo sapiens
gcaggagagactgagcagccgc

SEQ ID NO: 1113963 - DNA, 21 bp, Homo sapiens
gcaggagagtgtgtgggcagg

SEQ ID NO: 1113964 - DNA, 14 bp, Homo sapiens
gcaggagcagggcg

SEQ ID NO: 1113965 - DNA, 13 bp, Homo sapiens
gcaggagcctccc

SEQ ID NO: 1113966 - DNA, 14 bp, Homo sapiens
gcaggagcctccct

SEQ ID NO: 1113967 - DNA, 15 bp, Homo sapiens
gcaggagcctccctg

SEQ ID NO: 1113968 - DNA, 21 bp, Homo sapiens
gcaggaggccaataaaaagtt

SEQ ID NO: 1113969 - DNA, 22 bp, Homo sapiens
gcaggaggccaataaaaagttc

SEQ ID NO: 1113970 - DNA, 14 bp, Homo sapiens
gcaggaggcccctg

SEQ ID NO: 1113971 - DNA, 19 bp, Homo sapiens
gcaggaggcccctggccca

SEQ ID NO: 1113972 - DNA, 22 bp, Homo sapiens
gcaggaggcccctggcccagcg

SEQ ID NO: 1113973 - DNA, 12 bp, Homo sapiens
gcaggagggagg

SEQ ID NO: 1113974 - DNA, 15 bp, Homo sapiens
gcaggagggcactgg

SEQ ID NO: 1113975 - DNA, 23 bp, Homo sapiens
gcaggagggcactggagctggga

SEQ ID NO: 1113976 - DNA, 17 bp, Homo sapiens
gcaggaggggggctggg

SEQ ID NO: 1113977 - DNA, 20 bp, Homo sapiens
gcaggaggttctgggcctct

SEQ ID NO: 1113978 - DNA, 20 bp, Homo sapiens
gcaggagtctctgccaccca

SEQ ID NO: 1113979 - DNA, 12 bp, Homo sapiens
gcaggagtgcca

SEQ ID NO: 1113980 - DNA, 13 bp, Homo sapiens
gcaggagtggaag

SEQ ID NO: 1113981 - DNA, 15 bp, Homo sapiens
gcaggatcagatgac

SEQ ID NO: 1113982 - DNA, 17 bp, Homo sapiens
gcaggatccgctgccac

SEQ ID NO: 1113983 - DNA, 16 bp, Homo sapiens
gcaggatctcaagcca

SEQ ID NO: 1113984 - DNA, 17 bp, Homo sapiens
gcaggatctcaagccag

SEQ ID NO: 1113985 - DNA, 14 bp, Homo sapiens
gcaggatggccttt

SEQ ID NO: 1113986 - DNA, 21 bp, Homo sapiens
gcaggatggcctttccttccc

SEQ ID NO: 1113987 - DNA, 22 bp, Homo sapiens
gcaggatggcctttccttccct

SEQ ID NO: 1113988 - DNA, 14 bp, Homo sapiens
gcaggatgggctga

SEQ ID NO: 1113989 - DNA, 21 bp, Homo sapiens
gcaggatgttggcttggggca

SEQ ID NO: 1113990 - DNA, 19 bp, Homo sapiens
gcaggcaaaaaagggacag

SEQ ID NO: 1113991 - DNA, 14 bp, Homo sapiens
gcaggcaagccctt

SEQ ID NO: 1113992 - DNA, 16 bp, Homo sapiens
gcaggcaagcccttcg

SEQ ID NO: 1113993 - DNA, 17 bp, Homo sapiens
gcaggcacacagcagcc

SEQ ID NO: 1113994 - DNA, 16 bp, Homo sapiens
gcaggcaccgccacgt

SEQ ID NO: 1113995 - DNA, 22 bp, Homo sapiens
gcaggcaccgccacgtcccagc

SEQ ID NO: 1113996 - DNA, 14 bp, Homo sapiens
gcaggcaccgggct

SEQ ID NO: 1113997 - DNA, 15 bp, Homo sapiens
gcaggcaccgggctg

SEQ ID NO: 1113998 - DNA, 20 bp, Homo sapiens
gcaggcaccgggctggctgc

SEQ ID NO: 1113999 - DNA, 20 bp, Homo sapiens
gcaggcacggcccgcagcct

SEQ ID NO: 1114000 - DNA, 19 bp, Homo sapiens
gcaggcacgggtggtcccc

SEQ ID NO: 1114001 - DNA, 20 bp, Homo sapiens
gcaggcacgggtggtccccg

SEQ ID NO: 1114002 - DNA, 15 bp, Homo sapiens
gcaggcactgtggcc

SEQ ID NO: 1114003 - DNA, 12 bp, Homo sapiens
gcaggcagagag

SEQ ID NO: 1114004 - DNA, 22 bp, Homo sapiens
gcaggcagagagtacagactgc

SEQ ID NO: 1114005 - DNA, 13 bp, Homo sapiens
gcaggcagagctg

SEQ ID NO: 1114006 - DNA, 12 bp, Homo sapiens
gcaggcagagtg

SEQ ID NO: 1114007 - DNA, 13 bp, Homo sapiens
gcaggcagcgcca

SEQ ID NO: 1114008 - DNA, 12 bp, Homo sapiens
gcaggcaggcac

SEQ ID NO: 1114009 - DNA, 14 bp, Homo sapiens
gcaggcaggcactg

SEQ ID NO: 1114010 - DNA, 14 bp, Homo sapiens
gcaggcaggctggg

SEQ ID NO: 1114011 - DNA, 15 bp, Homo sapiens
gcaggcagggagaag

SEQ ID NO: 1114012 - DNA, 12 bp, Homo sapiens
gcaggcagggct

SEQ ID NO: 1114013 - DNA, 19 bp, Homo sapiens
gcaggcaggggcatctgtc

SEQ ID NO: 1114014 - DNA, 12 bp, Homo sapiens
gcaggcatgccg

SEQ ID NO: 1114015 - DNA, 15 bp, Homo sapiens
gcaggcattgaggaa

SEQ ID NO: 1114016 - DNA, 21 bp, Homo sapiens
gcaggcattgctttgccctgg

SEQ ID NO: 1114017 - DNA, 20 bp, Homo sapiens
gcaggccaaggccttctcct

SEQ ID NO: 1114018 - DNA, 23 bp, Homo sapiens
gcaggccaaggccttctcctccc

SEQ ID NO: 1114019 - DNA, 20 bp, Homo sapiens
gcaggccacccgggctgcct

SEQ ID NO: 1114020 - DNA, 18 bp, Homo sapiens
gcaggccagatggcccct

SEQ ID NO: 1114021 - DNA, 19 bp, Homo sapiens
gcaggccagcttcgtgctg

SEQ ID NO: 1114022 - DNA, 21 bp, Homo sapiens
gcaggccagcttcgtgctgga

SEQ ID NO: 1114023 - DNA, 16 bp, Homo sapiens
gcaggcccactcccca

SEQ ID NO: 1114024 - DNA, 22 bp, Homo sapiens
gcaggcccactccccagcccca

SEQ ID NO: 1114025 - DNA, 23 bp, Homo sapiens
gcaggcccactccccagccccag

SEQ ID NO: 1114026 - DNA, 11 bp, Homo sapiens
gcaggcccagc

SEQ ID NO: 1114027 - DNA, 14 bp, Homo sapiens
gcaggcccagcatg

SEQ ID NO: 1114028 - DNA, 14 bp, Homo sapiens
gcaggcccagtgac

SEQ ID NO: 1114029 - DNA, 19 bp, Homo sapiens
gcagtgcctcgaggcaccg

SEQ ID NO: 1114030 - DNA, 21 bp, Homo sapiens
gcagtgcctcgaggcaccggc

SEQ ID NO: 1114031 - DNA, 15 bp, Homo sapiens
gcagtgcctgataag

SEQ ID NO: 1114032 - DNA, 15 bp, Homo sapiens
gcagtgctcattcat

SEQ ID NO: 1114033 - DNA, 14 bp, Homo sapiens
gcagtggagaggga

SEQ ID NO: 1114034 - DNA, 14 bp, Homo sapiens
gcagtggccaagcc

SEQ ID NO: 1114035 - DNA, 17 bp, Homo sapiens
gcagtggccaagcctgc

SEQ ID NO: 1114036 - DNA, 19 bp, Homo sapiens
gcagtggccaagcctgctg

SEQ ID NO: 1114037 - DNA, 16 bp, Homo sapiens
gcagtggctcacgcct

SEQ ID NO: 1114038 - DNA, 18 bp, Homo sapiens
gcagtggctctcagagca

SEQ ID NO: 1114039 - DNA, 20 bp, Homo sapiens
gcagtggctggtccagggct

SEQ ID NO: 1114040 - DNA, 22 bp, Homo sapiens
gcagtggcttttcatggccctt

SEQ ID NO: 1114041 - DNA, 21 bp, Homo sapiens
gcagtggtggttttctgttct

SEQ ID NO: 1114042 - DNA, 17 bp, Homo sapiens
gcagtgtcccagggccc

SEQ ID NO: 1114043 - DNA, 18 bp, Homo sapiens
gcagtgtcccttttgcta

SEQ ID NO: 1114044 - DNA, 15 bp, Homo sapiens
gcagtgtctgtcagc

SEQ ID NO: 1114045 - DNA, 15 bp, Homo sapiens
gcagtgtcttccata

SEQ ID NO: 1114046 - DNA, 15 bp, Homo sapiens
gcagtgtgaggccag

SEQ ID NO: 1114047 - DNA, 22 bp, Homo sapiens
gcagtgtgctttgcattttctg

SEQ ID NO: 1114048 - DNA, 12 bp, Homo sapiens
gcagtgtggagt

SEQ ID NO: 1114049 - DNA, 16 bp, Homo sapiens
gcagtgtggccaggct

SEQ ID NO: 1114050 - DNA, 17 bp, Homo sapiens
gcagtgtggccaggctg

SEQ ID NO: 1114051 - DNA, 23 bp, Homo sapiens
gcagtgttacctgttagctccct

SEQ ID NO: 1114052 - DNA, 17 bp, Homo sapiens
gcagtgttttggttcag

SEQ ID NO: 1114053 - DNA, 16 bp, Homo sapiens
gcagttaatttatata

SEQ ID NO: 1114054 - DNA, 20 bp, Homo sapiens
gcagttaccacagcaactga

SEQ ID NO: 1114055 - DNA, 17 bp, Homo sapiens
gcagttagagcagcctc

SEQ ID NO: 1114056 - DNA, 14 bp, Homo sapiens
gcagttatagaaaa

SEQ ID NO: 1114057 - DNA, 18 bp, Homo sapiens
gcagttcaaatcctcacc

SEQ ID NO: 1114058 - DNA, 13 bp, Homo sapiens
gcagttcacctgc

SEQ ID NO: 1114059 - DNA, 15 bp, Homo sapiens
gcagttccatcaggt

SEQ ID NO: 1114060 - DNA, 19 bp, Homo sapiens
gcagttcccacattaaaga

SEQ ID NO: 1114061 - DNA, 21 bp, Homo sapiens
gcagttcccacattaaagaag

SEQ ID NO: 1114062 - DNA, 20 bp, Homo sapiens
gcagttcccccaacctcaga

SEQ ID NO: 1114063 - DNA, 12 bp, Homo sapiens
gcagttcctggc

SEQ ID NO: 1114064 - DNA, 18 bp, Homo sapiens
gcagttctactcaggctg

SEQ ID NO: 1114065 - DNA, 20 bp, Homo sapiens
gcagttctactcaggctggt

SEQ ID NO: 1114066 - DNA, 15 bp, Homo sapiens
gcagttctcactcct

SEQ ID NO: 1114067 - DNA, 22 bp, Homo sapiens
gcagttctcccagggagtgagc

SEQ ID NO: 1114068 - DNA, 22 bp, Homo sapiens
gcagttgaatgacaacagaagc

SEQ ID NO: 1114069 - DNA, 17 bp, Homo sapiens
gcagttgacagcaggtg

SEQ ID NO: 1114070 - DNA, 15 bp, Homo sapiens
gcagttgataagagg

SEQ ID NO: 1114071 - DNA, 14 bp, Homo sapiens
gcagttggccagag

SEQ ID NO: 1114072 - DNA, 22 bp, Homo sapiens
gcagttggccagagagcctggt

SEQ ID NO: 1114073 - DNA, 13 bp, Homo sapiens
gcagttggggccc

SEQ ID NO: 1114074 - DNA, 17 bp, Homo sapiens
gcagttggggccctctt

SEQ ID NO: 1114075 - DNA, 20 bp, Homo sapiens
gcagtttatcattcaagtgt

SEQ ID NO: 1114076 - DNA, 13 bp, Homo sapiens
gcagtttcctgga

SEQ ID NO: 1114077 - DNA, 13 bp, Homo sapiens
gcagtttcttgtg

SEQ ID NO: 1114078 - DNA, 17 bp, Homo sapiens
gcagtttcttttcacat

SEQ ID NO: 1114079 - DNA, 16 bp, Homo sapiens
gcagtttgcaaaaaat

SEQ ID NO: 1114080 - DNA, 18 bp, Homo sapiens
gcagtttggccctggagc

SEQ ID NO: 1114081 - DNA, 22 bp, Homo sapiens
gcagtttgggagacatggacca

SEQ ID NO: 1114082 - DNA, 15 bp, Homo sapiens
gcagttttccaggaa

SEQ ID NO: 1114083 - DNA, 15 bp, Homo sapiens
gcagttttcccctgg

SEQ ID NO: 1114084 - DNA, 12 bp, Homo sapiens
gcagtttttcag

SEQ ID NO: 1114085 - DNA, 11 bp, Homo sapiens
gcagttttttt

SEQ ID NO: 1114086 - DNA, 17 bp, Homo sapiens
gcagttttttttttctt

SEQ ID NO: 1114087 - DNA, 15 bp, Homo sapiens
gcataaaaattagcc

SEQ ID NO: 1114088 - DNA, 13 bp, Homo sapiens
gcataaaacctaa

SEQ ID NO: 1114089 - DNA, 14 bp, Homo sapiens
gcataaaagatcac

SEQ ID NO: 1114090 - DNA, 18 bp, Homo sapiens
gcataaaccaatgagctg

SEQ ID NO: 1114091 - DNA, 21 bp, Homo sapiens
gcataaagctcaaatgaaatg

SEQ ID NO: 1114092 - DNA, 17 bp, Homo sapiens
gcataaataaaactgaa

SEQ ID NO: 1114093 - DNA, 18 bp, Homo sapiens
gcataaataaaactgaat

SEQ ID NO: 1114094 - DNA, 15 bp, Homo sapiens
gcataactgtagctc

SEQ ID NO: 1114095 - DNA, 22 bp, Homo sapiens
gcataactgtagctcaagttta

SEQ ID NO: 1114096 - DNA, 23 bp, Homo sapiens
gcataagattaaaggaaggaaaa

SEQ ID NO: 1114097 - DNA, 22 bp, Homo sapiens
gcataagtcctctagtgaatgt

SEQ ID NO: 1114098 - DNA, 15 bp, Homo sapiens
gcataatatgaagcc

SEQ ID NO: 1114099 - DNA, 22 bp, Homo sapiens
gcataatgataaaataaataat

SEQ ID NO: 1114100 - DNA, 20 bp, Homo sapiens
gcataatttaaaaatatatt

SEQ ID NO: 1114101 - DNA, 15 bp, Homo sapiens
gcatacaaaatattt

SEQ ID NO: 1114102 - DNA, 12 bp, Homo sapiens
gcatacaataaa

SEQ ID NO: 1114103 - DNA, 16 bp, Homo sapiens
gcatacacacagcagt

SEQ ID NO: 1114104 - DNA, 17 bp, Homo sapiens
gcatacacacatgccct

SEQ ID NO: 1114105 - DNA, 13 bp, Homo sapiens
gcatacagttttc

SEQ ID NO: 1114106 - DNA, 22 bp, Homo sapiens
gcatacatacacacacacacat

SEQ ID NO: 1114107 - DNA, 23 bp, Homo sapiens
gcatacatacacacacacacata

SEQ ID NO: 1114108 - DNA, 17 bp, Homo sapiens
gcatacatttataatgt

SEQ ID NO: 1114109 - DNA, 23 bp, Homo sapiens
gcataccaggttttacacttgca

SEQ ID NO: 1114110 - DNA, 15 bp, Homo sapiens
gcatacgtacacatt

SEQ ID NO: 1114111 - DNA, 16 bp, Homo sapiens
gcatactgaaaatcca

SEQ ID NO: 1114112 - DNA, 22 bp, Homo sapiens
gcatactgagccaagtataatt

SEQ ID NO: 1114113 - DNA, 17 bp, Homo sapiens
gcatactgttgatacaa

SEQ ID NO: 1114114 - DNA, 14 bp, Homo sapiens
gcatactttgtaaa

SEQ ID NO: 1114115 - DNA, 16 bp, Homo sapiens
gcatactttgtaaata

SEQ ID NO: 1114116 - DNA, 13 bp, Homo sapiens
gcatactttttaa

SEQ ID NO: 1114117 - DNA, 22 bp, Homo sapiens
gcatagaggtaccagcaatatg

SEQ ID NO: 1114118 - DNA, 14 bp, Homo sapiens
gcatagcaaacaga

SEQ ID NO: 1114119 - DNA, 14 bp, Homo sapiens
gcatagcctgcctg

SEQ ID NO: 1114120 - DNA, 19 bp, Homo sapiens
gcatagcgtcctgccctgc

SEQ ID NO: 1114121 - DNA, 18 bp, Homo sapiens
gcatagctacaatttgtt

SEQ ID NO: 1114122 - DNA, 19 bp, Homo sapiens
gcataggacctttccacca

SEQ ID NO: 1114123 - DNA, 17 bp, Homo sapiens
gcataggaggggtctgg

SEQ ID NO: 1114124 - DNA, 17 bp, Homo sapiens
gcataggcctgggtgct

SEQ ID NO: 1114125 - DNA, 16 bp, Homo sapiens
gcataggggggagggt

SEQ ID NO: 1114126 - DNA, 20 bp, Homo sapiens
gcataggtctctttgctttc

SEQ ID NO: 1114127 - DNA, 17 bp, Homo sapiens
gcatagtactggcacaa

SEQ ID NO: 1114128 - DNA, 21 bp, Homo sapiens
gcatagtattccattgtgtga

SEQ ID NO: 1114129 - DNA, 22 bp, Homo sapiens
gcatagtattccattgtgtgag

SEQ ID NO: 1114130 - DNA, 15 bp, Homo sapiens
gcatagtctgttcct

SEQ ID NO: 1114131 - DNA, 18 bp, Homo sapiens
gcatataaaggttatgaa

SEQ ID NO: 1114132 - DNA, 20 bp, Homo sapiens
gcatataaaggttatgaaac

SEQ ID NO: 1114133 - DNA, 17 bp, Homo sapiens
gcatataatgaataaat

SEQ ID NO: 1114134 - DNA, 18 bp, Homo sapiens
gcatatccaccacctccc

SEQ ID NO: 1114135 - DNA, 16 bp, Homo sapiens
gcatatcctgagccat

SEQ ID NO: 1114136 - DNA, 21 bp, Homo sapiens
gcatatctggtatatgtcatt

SEQ ID NO: 1114137 - DNA, 22 bp, Homo sapiens
gcatatctggtatatgtcatta

SEQ ID NO: 1114138 - DNA, 13 bp, Homo sapiens
gcatatgcatgcc

SEQ ID NO: 1114139 - DNA, 18 bp, Homo sapiens
gcatatgcatgccaggct

SEQ ID NO: 1114140 - DNA, 12 bp, Homo sapiens
gcatatgttaaa

SEQ ID NO: 1114141 - DNA, 21 bp, Homo sapiens
gcatatgttgaatacttttta

SEQ ID NO: 1114142 - DNA, 22 bp, Homo sapiens
gcatatgtttccccatctctgt

SEQ ID NO: 1114143 - DNA, 15 bp, Homo sapiens
gcatattagttaatc

SEQ ID NO: 1114144 - DNA, 21 bp, Homo sapiens
gcatattcatggttgtttttt

SEQ ID NO: 1114145 - DNA, 22 bp, Homo sapiens
gcatattctattgtattatttg

SEQ ID NO: 1114146 - DNA, 14 bp, Homo sapiens
gcatattgactttt

SEQ ID NO: 1114147 - DNA, 21 bp, Homo sapiens
gcatatttattgcattgctgg

SEQ ID NO: 1114148 - DNA, 14 bp, Homo sapiens
gcatatttgtatag

SEQ ID NO: 1114149 - DNA, 13 bp, Homo sapiens
gcatattttctct

SEQ ID NO: 1114150 - DNA, 14 bp, Homo sapiens
gcatcaaccaggaa

SEQ ID NO: 1114151 - DNA, 23 bp, Homo sapiens
gcatgttcctccttttcttcacc

SEQ ID NO: 1114152 - DNA, 18 bp, Homo sapiens
gcatgttgagccaggcct

SEQ ID NO: 1114153 - DNA, 18 bp, Homo sapiens
gcatgttggggtttcctt

SEQ ID NO: 1114154 - DNA, 18 bp, Homo sapiens
gcatgtttcactcctgct

SEQ ID NO: 1114155 - DNA, 15 bp, Homo sapiens
gcatgtttcatgttt

SEQ ID NO: 1114156 - DNA, 20 bp, Homo sapiens
gcatgtttcatgttttgtga

SEQ ID NO: 1114157 - DNA, 18 bp, Homo sapiens
gcatgtttgaaatgaggt

SEQ ID NO: 1114158 - DNA, 14 bp, Homo sapiens
gcattaaaccacat

SEQ ID NO: 1114159 - DNA, 13 bp, Homo sapiens
gcattaaacctgt

SEQ ID NO: 1114160 - DNA, 15 bp, Homo sapiens
gcattaactaaatgc

SEQ ID NO: 1114161 - DNA, 18 bp, Homo sapiens
gcattaactaaatgctca

SEQ ID NO: 1114162 - DNA, 20 bp, Homo sapiens
gcattaactaaatgctcata

SEQ ID NO: 1114163 - DNA, 18 bp, Homo sapiens
gcattaactaatctattg

SEQ ID NO: 1114164 - DNA, 13 bp, Homo sapiens
gcattaagcacac

SEQ ID NO: 1114165 - DNA, 21 bp, Homo sapiens
gcattaagcacacacatctgg

SEQ ID NO: 1114166 - DNA, 23 bp, Homo sapiens
gcattaagtcagtggctttgcat

SEQ ID NO: 1114167 - DNA, 14 bp, Homo sapiens
gcattaatgtttct

SEQ ID NO: 1114168 - DNA, 16 bp, Homo sapiens
gcattagaaatagaca

SEQ ID NO: 1114169 - DNA, 21 bp, Homo sapiens
gcattagaaatagacagtata

SEQ ID NO: 1114170 - DNA, 22 bp, Homo sapiens
gcattaggcttttaagaaacac

SEQ ID NO: 1114171 - DNA, 19 bp, Homo sapiens
gcattatataccatttatc

SEQ ID NO: 1114172 - DNA, 22 bp, Homo sapiens
gcattatctagatactgtatca

SEQ ID NO: 1114173 - DNA, 19 bp, Homo sapiens
gcattatggtctaatgatt

SEQ ID NO: 1114174 - DNA, 15 bp, Homo sapiens
gcattatgtatttat

SEQ ID NO: 1114175 - DNA, 18 bp, Homo sapiens
gcattatgtatttataat

SEQ ID NO: 1114176 - DNA, 22 bp, Homo sapiens
gcattatgtccactgtgtatag

SEQ ID NO: 1114177 - DNA, 23 bp, Homo sapiens
gcattatgtccactgtgtataga

SEQ ID NO: 1114178 - DNA, 15 bp, Homo sapiens
gcattattgcattat

SEQ ID NO: 1114179 - DNA, 23 bp, Homo sapiens
gcattattggaatataattgttt

SEQ ID NO: 1114180 - DNA, 22 bp, Homo sapiens
gcattcaatttattcaagaaaa

SEQ ID NO: 1114181 - DNA, 19 bp, Homo sapiens
gcattcacatttagaaaag

SEQ ID NO: 1114182 - DNA, 14 bp, Homo sapiens
gcattcagcacaca

SEQ ID NO: 1114183 - DNA, 22 bp, Homo sapiens
gcattcatttttatagcaacaa

SEQ ID NO: 1114184 - DNA, 18 bp, Homo sapiens
gcattccagctctgcccc

SEQ ID NO: 1114185 - DNA, 15 bp, Homo sapiens
gcattccatgaccag

SEQ ID NO: 1114186 - DNA, 14 bp, Homo sapiens
gcattcccaccaac

SEQ ID NO: 1114187 - DNA, 22 bp, Homo sapiens
gcattccctacagcctagggca

SEQ ID NO: 1114188 - DNA, 18 bp, Homo sapiens
gcattcctgtgccctaga

SEQ ID NO: 1114189 - DNA, 22 bp, Homo sapiens
gcattcgttgtgttttttaaga

SEQ ID NO: 1114190 - DNA, 13 bp, Homo sapiens
gcattctagtact

SEQ ID NO: 1114191 - DNA, 16 bp, Homo sapiens
gcattctctcccatcc

SEQ ID NO: 1114192 - DNA, 17 bp, Homo sapiens
gcattctctcccatcct

SEQ ID NO: 1114193 - DNA, 23 bp, Homo sapiens
gcattctgaatcagaatctcgca

SEQ ID NO: 1114194 - DNA, 19 bp, Homo sapiens
gcattctgataggaggggg

SEQ ID NO: 1114195 - DNA, 21 bp, Homo sapiens
gcattctggcataatttttac

SEQ ID NO: 1114196 - DNA, 13 bp, Homo sapiens
gcattctttggta

SEQ ID NO: 1114197 - DNA, 20 bp, Homo sapiens
gcattcttttaaaagacaag

SEQ ID NO: 1114198 - DNA, 21 bp, Homo sapiens
gcattgaaagaagagatgaga

SEQ ID NO: 1114199 - DNA, 12 bp, Homo sapiens
gcattgaacaca

SEQ ID NO: 1114200 - DNA, 22 bp, Homo sapiens
gcattgaacacaaactgtaaat

SEQ ID NO: 1114201 - DNA, 23 bp, Homo sapiens
gcattgaattcctaaagctgctt

SEQ ID NO: 1114202 - DNA, 22 bp, Homo sapiens
gcattgaccgcgactaatttca

SEQ ID NO: 1114203 - DNA, 14 bp, Homo sapiens
gcattgactcagat

SEQ ID NO: 1114204 - DNA, 18 bp, Homo sapiens
gcattgataatcttcagg

SEQ ID NO: 1114205 - DNA, 13 bp, Homo sapiens
gcattgcatggac

SEQ ID NO: 1114206 - DNA, 16 bp, Homo sapiens
gcattgctagataaaa

SEQ ID NO: 1114207 - DNA, 18 bp, Homo sapiens
gcattgctagataaaagc

SEQ ID NO: 1114208 - DNA, 20 bp, Homo sapiens
gcattgggcattagtgtccc

SEQ ID NO: 1114209 - DNA, 10 bp, Homo sapiens
gcattgtaaa

SEQ ID NO: 1114210 - DNA, 12 bp, Homo sapiens
gcattgtaaata

SEQ ID NO: 1114211 - DNA, 20 bp, Homo sapiens
gcattgtatagatataatga

SEQ ID NO: 1114212 - DNA, 21 bp, Homo sapiens
gcattgtatagatataatgaa

SEQ ID NO: 1114213 - DNA, 19 bp, Homo sapiens
gcattgtatctgtctttcc

SEQ ID NO: 1114214 - DNA, 16 bp, Homo sapiens
gcattgtccctgtgcc

SEQ ID NO: 1114215 - DNA, 22 bp, Homo sapiens
gcattgttccacacatttaaaa

SEQ ID NO: 1114216 - DNA, 16 bp, Homo sapiens
gcattgtttcaaaata

SEQ ID NO: 1114217 - DNA, 16 bp, Homo sapiens
gcattgtttcaagact

SEQ ID NO: 1114218 - DNA, 20 bp, Homo sapiens
gcattgtttgcttattgttc

SEQ ID NO: 1114219 - DNA, 21 bp, Homo sapiens
gcattgtttgcttattgttcc

SEQ ID NO: 1114220 - DNA, 13 bp, Homo sapiens
gcatttaaaaaaa

SEQ ID NO: 1114221 - DNA, 15 bp, Homo sapiens
gcatttaaaagatac

SEQ ID NO: 1114222 - DNA, 16 bp, Homo sapiens
gcatttaaaagataca

SEQ ID NO: 1114223 - DNA, 18 bp, Homo sapiens
gcatttaaaagatacagt

SEQ ID NO: 1114224 - DNA, 22 bp, Homo sapiens
gcatttaaaagatacagttact

SEQ ID NO: 1114225 - DNA, 16 bp, Homo sapiens
gcatttaaactctgcc

SEQ ID NO: 1114226 - DNA, 16 bp, Homo sapiens
gcatttaacttacatt

SEQ ID NO: 1114227 - DNA, 16 bp, Homo sapiens
gcatttaaggagattg

SEQ ID NO: 1114228 - DNA, 14 bp, Homo sapiens
gcatttaataaaga

SEQ ID NO: 1114229 - DNA, 23 bp, Homo sapiens
gcatttaatggcagctagtgcct

SEQ ID NO: 1114230 - DNA, 23 bp, Homo sapiens
gcatttagttttatggcatgatt

SEQ ID NO: 1114231 - DNA, 19 bp, Homo sapiens
gcatttatggtcaacactt

SEQ ID NO: 1114232 - DNA, 16 bp, Homo sapiens
gcatttcaaagccctg

SEQ ID NO: 1114233 - DNA, 21 bp, Homo sapiens
gcatttcaaagccctgcctct

SEQ ID NO: 1114234 - DNA, 18 bp, Homo sapiens
gcatttcagcttgaacct

SEQ ID NO: 1114235 - DNA, 15 bp, Homo sapiens
gcatttcattatgct

SEQ ID NO: 1114236 - DNA, 12 bp, Homo sapiens
gcatttccaaac

SEQ ID NO: 1114237 - DNA, 22 bp, Homo sapiens
gcatttccaacaccacagacac

SEQ ID NO: 1114238 - DNA, 21 bp, Homo sapiens
gcatttcgggaagggcatgca

SEQ ID NO: 1114239 - DNA, 11 bp, Homo sapiens
gcatttctctt

SEQ ID NO: 1114240 - DNA, 15 bp, Homo sapiens
gcatttctcttctca

SEQ ID NO: 1114241 - DNA, 16 bp, Homo sapiens
gcatttctctttaaac

SEQ ID NO: 1114242 - DNA, 21 bp, Homo sapiens
gcatttcttgatgttgcttag

SEQ ID NO: 1114243 - DNA, 16 bp, Homo sapiens
gcatttgaaaattttg

SEQ ID NO: 1114244 - DNA, 17 bp, Homo sapiens
gcatttgaaaggtgtgc

SEQ ID NO: 1114245 - DNA, 17 bp, Homo sapiens
gcatttgaggggccagg

SEQ ID NO: 1114246 - DNA, 21 bp, Homo sapiens
gcatttgatctgttgcaagcc

SEQ ID NO: 1114247 - DNA, 12 bp, Homo sapiens
gcatttgcacct

SEQ ID NO: 1114248 - DNA, 15 bp, Homo sapiens
gcatttgcacctctg

SEQ ID NO: 1114249 - DNA, 13 bp, Homo sapiens
gcatttgctgaat

SEQ ID NO: 1114250 - DNA, 13 bp, Homo sapiens
gcatttgctggtt

SEQ ID NO: 1114251 - DNA, 16 bp, Homo sapiens
gcatttggaaccaaag

SEQ ID NO: 1114252 - DNA, 18 bp, Homo sapiens
gcatttggaaccaaagtc

SEQ ID NO: 1114253 - DNA, 16 bp, Homo sapiens
gcatttggattggggt

SEQ ID NO: 1114254 - DNA, 15 bp, Homo sapiens
gcatttggcactgag

SEQ ID NO: 1114255 - DNA, 16 bp, Homo sapiens
gcatttggtctcaggc

SEQ ID NO: 1114256 - DNA, 17 bp, Homo sapiens
gcatttggtctcaggca

SEQ ID NO: 1114257 - DNA, 22 bp, Homo sapiens
gcatttggtggtttcagaaatg

SEQ ID NO: 1114258 - DNA, 12 bp, Homo sapiens
gcatttgtattt

SEQ ID NO: 1114259 - DNA, 19 bp, Homo sapiens
gcatttgtattttgtgtga

SEQ ID NO: 1114260 - DNA, 12 bp, Homo sapiens
gcatttgtgaaa

SEQ ID NO: 1114261 - DNA, 13 bp, Homo sapiens
gcatttgtgaggc

SEQ ID NO: 1114262 - DNA, 21 bp, Homo sapiens
gcatttgtgctagaaattttc

SEQ ID NO: 1114263 - DNA, 20 bp, Homo sapiens
gcatttgtttatgtaatttc

SEQ ID NO: 1114264 - DNA, 16 bp, Homo sapiens
gcatttgtttgaactg

SEQ ID NO: 1114265 - DNA, 12 bp, Homo sapiens
gcattttaccat

SEQ ID NO: 1114266 - DNA, 18 bp, Homo sapiens
gcattttagaaactacaa

SEQ ID NO: 1114267 - DNA, 19 bp, Homo sapiens
gcattttagaaactacaaa

SEQ ID NO: 1114268 - DNA, 23 bp, Homo sapiens
gcattttagaaactacaaatata

SEQ ID NO: 1114269 - DNA, 12 bp, Homo sapiens
gcattttattga

SEQ ID NO: 1114270 - DNA, 14 bp, Homo sapiens
gcattttcccagat

SEQ ID NO: 1114271 - DNA, 13 bp, Homo sapiens
gcattttcctcct

SEQ ID NO: 1114272 - DNA, 18 bp, Homo sapiens
gcattttcctcctctgcc

SEQ ID NO: 1114273 - DNA, 16 bp, Homo sapiens
gccaccaccctcaggt

SEQ ID NO: 1114274 - DNA, 20 bp, Homo sapiens
gccaccaccctcaggtgcct

SEQ ID NO: 1114275 - DNA, 12 bp, Homo sapiens
gccaccacctct

SEQ ID NO: 1114276 - DNA, 14 bp, Homo sapiens
gccaccacctctgt

SEQ ID NO: 1114277 - DNA, 18 bp, Homo sapiens
gccaccacctttggctgg

SEQ ID NO: 1114278 - DNA, 14 bp, Homo sapiens
gccaccacgtccag

SEQ ID NO: 1114279 - DNA, 21 bp, Homo sapiens
gccaccacgtctgccaggccc

SEQ ID NO: 1114280 - DNA, 20 bp, Homo sapiens
gccaccacttccagagccag

SEQ ID NO: 1114281 - DNA, 21 bp, Homo sapiens
gccaccacttccagagccaga

SEQ ID NO: 1114282 - DNA, 12 bp, Homo sapiens
gccaccagcccc

SEQ ID NO: 1114283 - DNA, 19 bp, Homo sapiens
gccaccagctctgccgtct

SEQ ID NO: 1114284 - DNA, 17 bp, Homo sapiens
gccaccaggatggccct

SEQ ID NO: 1114285 - DNA, 12 bp, Homo sapiens
gccaccaggcca

SEQ ID NO: 1114286 - DNA, 20 bp, Homo sapiens
gccaccaggccacctcccca

SEQ ID NO: 1114287 - DNA, 13 bp, Homo sapiens
gccaccaggctgg

SEQ ID NO: 1114288 - DNA, 16 bp, Homo sapiens
gccaccaggctggcgc

SEQ ID NO: 1114289 - DNA, 18 bp, Homo sapiens
gccaccaggctggcgcag

SEQ ID NO: 1114290 - DNA, 14 bp, Homo sapiens
gccaccagggagct

SEQ ID NO: 1114291 - DNA, 20 bp, Homo sapiens
gccaccaggtgcctttcaaa

SEQ ID NO: 1114292 - DNA, 15 bp, Homo sapiens
gccaccagtggacct

SEQ ID NO: 1114293 - DNA, 23 bp, Homo sapiens
gccaccagtggacctagcctgga

SEQ ID NO: 1114294 - DNA, 15 bp, Homo sapiens
gccaccatccccacc

SEQ ID NO: 1114295 - DNA, 12 bp, Homo sapiens
gccaccatcctg

SEQ ID NO: 1114296 - DNA, 17 bp, Homo sapiens
gccaccatcctgcagcc

SEQ ID NO: 1114297 - DNA, 14 bp, Homo sapiens
gccaccatcctgct

SEQ ID NO: 1114298 - DNA, 15 bp, Homo sapiens
gccaccatcctgctg

SEQ ID NO: 1114299 - DNA, 22 bp, Homo sapiens
gccaccatgcctcactaatttt

SEQ ID NO: 1114300 - DNA, 22 bp, Homo sapiens
gccaccatgcttgcctgaagct

SEQ ID NO: 1114301 - DNA, 16 bp, Homo sapiens
gccaccatggccagcc

SEQ ID NO: 1114302 - DNA, 22 bp, Homo sapiens
gccacccaagcctgctggctgc

SEQ ID NO: 1114303 - DNA, 17 bp, Homo sapiens
gccacccacctccctgc

SEQ ID NO: 1114304 - DNA, 21 bp, Homo sapiens
gccaccccaaaccccagcccc

SEQ ID NO: 1114305 - DNA, 12 bp, Homo sapiens
gccaccccactt

SEQ ID NO: 1114306 - DNA, 19 bp, Homo sapiens
gccaccccatgagctcggg

SEQ ID NO: 1114307 - DNA, 19 bp, Homo sapiens
gccaccccatgtgccttta

SEQ ID NO: 1114308 - DNA, 14 bp, Homo sapiens
gccacccccaggtc

SEQ ID NO: 1114309 - DNA, 21 bp, Homo sapiens
gccacccccaggtcttcctgc

SEQ ID NO: 1114310 - DNA, 17 bp, Homo sapiens
gccacccccagttccta

SEQ ID NO: 1114311 - DNA, 14 bp, Homo sapiens
gccacccccatctt

SEQ ID NO: 1114312 - DNA, 22 bp, Homo sapiens
gccacccccatcttccacctgt

SEQ ID NO: 1114313 - DNA, 19 bp, Homo sapiens
gccacccccgcccccaccg

SEQ ID NO: 1114314 - DNA, 16 bp, Homo sapiens
gccaccccgagggctg

SEQ ID NO: 1114315 - DNA, 18 bp, Homo sapiens
gccaccccgggctctctg

SEQ ID NO: 1114316 - DNA, 16 bp, Homo sapiens
gccaccccgtgccacc

SEQ ID NO: 1114317 - DNA, 18 bp, Homo sapiens
gccacccctaaactccag

SEQ ID NO: 1114318 - DNA, 13 bp, Homo sapiens
gccacccctcccc

SEQ ID NO: 1114319 - DNA, 15 bp, Homo sapiens
gccacccctcttctg

SEQ ID NO: 1114320 - DNA, 13 bp, Homo sapiens
gccacccctgcca

SEQ ID NO: 1114321 - DNA, 20 bp, Homo sapiens
gccacccctgccactcaccc

SEQ ID NO: 1114322 - DNA, 21 bp, Homo sapiens
gccacccctgccactcaccct

SEQ ID NO: 1114323 - DNA, 17 bp, Homo sapiens
gccaccccttcctcccc

SEQ ID NO: 1114324 - DNA, 13 bp, Homo sapiens
gccacccgggctg

SEQ ID NO: 1114325 - DNA, 17 bp, Homo sapiens
gccacccgggctgcctg

SEQ ID NO: 1114326 - DNA, 21 bp, Homo sapiens
gccacccgtaggcagcctctc

SEQ ID NO: 1114327 - DNA, 21 bp, Homo sapiens
gccacccgttctgctggcctg

SEQ ID NO: 1114328 - DNA, 22 bp, Homo sapiens
gccacccgttctgctggcctgg

SEQ ID NO: 1114329 - DNA, 12 bp, Homo sapiens
gccaccctagcc

SEQ ID NO: 1114330 - DNA, 13 bp, Homo sapiens
gccaccctccacg

SEQ ID NO: 1114331 - DNA, 22 bp, Homo sapiens
gccaccctcctccctccaagcc

SEQ ID NO: 1114332 - DNA, 18 bp, Homo sapiens
gccaccctgaggcctctg

SEQ ID NO: 1114333 - DNA, 13 bp, Homo sapiens
gccaccctggccc

SEQ ID NO: 1114334 - DNA, 18 bp, Homo sapiens
gccacccttggcctgtcc

SEQ ID NO: 1114335 - DNA, 21 bp, Homo sapiens
gccaccgactgcccagccact

SEQ ID NO: 1114336 - DNA, 20 bp, Homo sapiens
gccaccggaggtcactccac

SEQ ID NO: 1114337 - DNA, 21 bp, Homo sapiens
gccaccggcctgtgggtctct

SEQ ID NO: 1114338 - DNA, 22 bp, Homo sapiens
gccaccggcctgtgggtctctg

SEQ ID NO: 1114339 - DNA, 15 bp, Homo sapiens
gccaccggggcaaga

SEQ ID NO: 1114340 - DNA, 16 bp, Homo sapiens
gccaccggggcaagag

SEQ ID NO: 1114341 - DNA, 19 bp, Homo sapiens
gccaccgggggtggctctg

SEQ ID NO: 1114342 - DNA, 13 bp, Homo sapiens
gccaccgtgcctg

SEQ ID NO: 1114343 - DNA, 18 bp, Homo sapiens
gccaccgtgcctggccag

SEQ ID NO: 1114344 - DNA, 19 bp, Homo sapiens
gccaccgtgcctggccaga

SEQ ID NO: 1114345 - DNA, 15 bp, Homo sapiens
gccacctatctcgtg

SEQ ID NO: 1114346 - DNA, 21 bp, Homo sapiens
gccacctatctcgtgggagag

SEQ ID NO: 1114347 - DNA, 12 bp, Homo sapiens
gccacctatgcc

SEQ ID NO: 1114348 - DNA, 15 bp, Homo sapiens
gccacctatgcctgt

SEQ ID NO: 1114349 - DNA, 15 bp, Homo sapiens
gccacctcagggcac

SEQ ID NO: 1114350 - DNA, 13 bp, Homo sapiens
gccacctccagaa

SEQ ID NO: 1114351 - DNA, 17 bp, Homo sapiens
gccacctcccctatcca

SEQ ID NO: 1114352 - DNA, 20 bp, Homo sapiens
gccacctccctgacccgtct

SEQ ID NO: 1114353 - DNA, 19 bp, Homo sapiens
gccacctccgccagacccc

SEQ ID NO: 1114354 - DNA, 13 bp, Homo sapiens
gccacctcctacc

SEQ ID NO: 1114355 - DNA, 14 bp, Homo sapiens
gccacctcctaccc

SEQ ID NO: 1114356 - DNA, 13 bp, Homo sapiens
gccacctcctccc

SEQ ID NO: 1114357 - DNA, 16 bp, Homo sapiens
gccacctcctccccct

SEQ ID NO: 1114358 - DNA, 18 bp, Homo sapiens
gccacctctccaagggct

SEQ ID NO: 1114359 - DNA, 13 bp, Homo sapiens
gccacctctctcc

SEQ ID NO: 1114360 - DNA, 18 bp, Homo sapiens
gccacctgaggtgggccc

SEQ ID NO: 1114361 - DNA, 11 bp, Homo sapiens
gccacctgcaa

SEQ ID NO: 1114362 - DNA, 17 bp, Homo sapiens
gccacctgcaagatgga

SEQ ID NO: 1114363 - DNA, 21 bp, Homo sapiens
gccacctgccacccccaggtc

SEQ ID NO: 1114364 - DNA, 13 bp, Homo sapiens
gccacctgccccc

SEQ ID NO: 1114365 - DNA, 14 bp, Homo sapiens
gccacctgccccct

SEQ ID NO: 1114366 - DNA, 11 bp, Homo sapiens
gccacctgcct

SEQ ID NO: 1114367 - DNA, 12 bp, Homo sapiens
gccacctgcctg

SEQ ID NO: 1114368 - DNA, 14 bp, Homo sapiens
gccacctgcctgcg

SEQ ID NO: 1114369 - DNA, 23 bp, Homo sapiens
gccacctgcctgcgtcttccgcc

SEQ ID NO: 1114370 - DNA, 20 bp, Homo sapiens
gccacctggcattccttctg

SEQ ID NO: 1114371 - DNA, 17 bp, Homo sapiens
gccacctgggaacacag

SEQ ID NO: 1114372 - DNA, 22 bp, Homo sapiens
gccacctgggaacacagttctg

SEQ ID NO: 1114373 - DNA, 19 bp, Homo sapiens
gccacctgtccggcccagt

SEQ ID NO: 1114374 - DNA, 20 bp, Homo sapiens
gccacctgtccggcccagtg

SEQ ID NO: 1114375 - DNA, 16 bp, Homo sapiens
gccaccttcccacccc

SEQ ID NO: 1114376 - DNA, 16 bp, Homo sapiens
gccaccttggaggagg

SEQ ID NO: 1114377 - DNA, 14 bp, Homo sapiens
gccaccttgttaca

SEQ ID NO: 1114378 - DNA, 12 bp, Homo sapiens
gccacctttgtg

SEQ ID NO: 1114379 - DNA, 17 bp, Homo sapiens
gccacgaacagcccgcc

SEQ ID NO: 1114380 - DNA, 21 bp, Homo sapiens
gccacgattggagaatacttt

SEQ ID NO: 1114381 - DNA, 13 bp, Homo sapiens
gccacgcaggcca

SEQ ID NO: 1114382 - DNA, 15 bp, Homo sapiens
gccacgcagtgcctg

SEQ ID NO: 1114383 - DNA, 13 bp, Homo sapiens
gccacgctcagtg

SEQ ID NO: 1114384 - DNA, 15 bp, Homo sapiens
gccacgctgtcctct

SEQ ID NO: 1114385 - DNA, 21 bp, Homo sapiens
gccacgctgtcctctcgagcc

SEQ ID NO: 1114386 - DNA, 22 bp, Homo sapiens
gccacgctgtcctctcgagccc

SEQ ID NO: 1114387 - DNA, 19 bp, Homo sapiens
gccacgctttgctgctacc

SEQ ID NO: 1114388 - DNA, 17 bp, Homo sapiens
gccacggagggaggcac

SEQ ID NO: 1114389 - DNA, 18 bp, Homo sapiens
gccacggagggaggcacc

SEQ ID NO: 1114390 - DNA, 19 bp, Homo sapiens
gccacgggggcagtgtgag

SEQ ID NO: 1114391 - DNA, 20 bp, Homo sapiens
gccacgtatagtcctagctg

SEQ ID NO: 1114392 - DNA, 15 bp, Homo sapiens
gccacgtcccacccc

SEQ ID NO: 1114393 - DNA, 18 bp, Homo sapiens
gccacgtcccaccccacc

SEQ ID NO: 1114394 - DNA, 18 bp, Homo sapiens
gccacgtcccagcatccc

SEQ ID NO: 1114395 - DNA, 23 bp, Homo sapiens
gccacgtcccgctgcctcctgct

SEQ ID NO: 1114396 - DNA, 17 bp, Homo sapiens
gccagctctgaggggag

SEQ ID NO: 1114397 - DNA, 19 bp, Homo sapiens
gccagctctgaggggaggc

SEQ ID NO: 1114398 - DNA, 20 bp, Homo sapiens
gccagctgccctatgggcct

SEQ ID NO: 1114399 - DNA, 11 bp, Homo sapiens
gccagctgctt

SEQ ID NO: 1114400 - DNA, 18 bp, Homo sapiens
gccagctggcctttgtaa

SEQ ID NO: 1114401 - DNA, 13 bp, Homo sapiens
gccagctggggag

SEQ ID NO: 1114402 - DNA, 20 bp, Homo sapiens
gccagcttaaacccatacaa

SEQ ID NO: 1114403 - DNA, 21 bp, Homo sapiens
gccagcttcgtgctggaggaa

SEQ ID NO: 1114404 - DNA, 14 bp, Homo sapiens
gccagcttctctct

SEQ ID NO: 1114405 - DNA, 15 bp, Homo sapiens
gccagcttctctctc

SEQ ID NO: 1114406 - DNA, 16 bp, Homo sapiens
gccagcttctctctcc

SEQ ID NO: 1114407 - DNA, 18 bp, Homo sapiens
gccagcttggggccacca

SEQ ID NO: 1114408 - DNA, 18 bp, Homo sapiens
gccagcttgttatttata

SEQ ID NO: 1114409 - DNA, 15 bp, Homo sapiens
gccagctttccctgc

SEQ ID NO: 1114410 - DNA, 19 bp, Homo sapiens
gccaggaagatcccccaga

SEQ ID NO: 1114411 - DNA, 17 bp, Homo sapiens
gccaggaagtacttcca

SEQ ID NO: 1114412 - DNA, 13 bp, Homo sapiens
gccaggaatattg

SEQ ID NO: 1114413 - DNA, 13 bp, Homo sapiens
gccaggacagcag

SEQ ID NO: 1114414 - DNA, 14 bp, Homo sapiens
gccaggacagcagc

SEQ ID NO: 1114415 - DNA, 16 bp, Homo sapiens
gccaggacagcagcac

SEQ ID NO: 1114416 - DNA, 14 bp, Homo sapiens
gccaggacaggccc

SEQ ID NO: 1114417 - DNA, 15 bp, Homo sapiens
gccaggacaggcccg

SEQ ID NO: 1114418 - DNA, 11 bp, Homo sapiens
gccaggaccag

SEQ ID NO: 1114419 - DNA, 14 bp, Homo sapiens
gccaggaccagcct

SEQ ID NO: 1114420 - DNA, 15 bp, Homo sapiens
gccaggaccagcctg

SEQ ID NO: 1114421 - DNA, 18 bp, Homo sapiens
gccaggacccgccagccc

SEQ ID NO: 1114422 - DNA, 20 bp, Homo sapiens
gccaggacccgcctgctccc

SEQ ID NO: 1114423 - DNA, 22 bp, Homo sapiens
gccaggacccgcctgctcccat

SEQ ID NO: 1114424 - DNA, 18 bp, Homo sapiens
gccaggaccctgacctcc

SEQ ID NO: 1114425 - DNA, 22 bp, Homo sapiens
gccaggacgtctggggtgtggg

SEQ ID NO: 1114426 - DNA, 15 bp, Homo sapiens
gccaggactccccag

SEQ ID NO: 1114427 - DNA, 19 bp, Homo sapiens
gccaggactccccaggcca

SEQ ID NO: 1114428 - DNA, 21 bp, Homo sapiens
gccaggactccccaggccagg

SEQ ID NO: 1114429 - DNA, 12 bp, Homo sapiens
gccaggactgtg

SEQ ID NO: 1114430 - DNA, 14 bp, Homo sapiens
gccaggagatggcc

SEQ ID NO: 1114431 - DNA, 15 bp, Homo sapiens
gccaggagcaaatgt

SEQ ID NO: 1114432 - DNA, 20 bp, Homo sapiens
gccaggagcaaatgtttctg

SEQ ID NO: 1114433 - DNA, 20 bp, Homo sapiens
gccaggagctcttcaggcct

SEQ ID NO: 1114434 - DNA, 19 bp, Homo sapiens
gccaggaggttggtgactg

SEQ ID NO: 1114435 - DNA, 20 bp, Homo sapiens
gccaggaggttggtgactga

SEQ ID NO: 1114436 - DNA, 19 bp, Homo sapiens
gccaggagtgcccccggga

SEQ ID NO: 1114437 - DNA, 17 bp, Homo sapiens
gccaggataaagcttcc

SEQ ID NO: 1114438 - DNA, 19 bp, Homo sapiens
gccaggatccccctctttg

SEQ ID NO: 1114439 - DNA, 21 bp, Homo sapiens
gccaggatccccctctttgca

SEQ ID NO: 1114440 - DNA, 14 bp, Homo sapiens
gccaggatgcccag

SEQ ID NO: 1114441 - DNA, 20 bp, Homo sapiens
gccaggatggaacacggcca

SEQ ID NO: 1114442 - DNA, 20 bp, Homo sapiens
gccaggcacacacagcccct

SEQ ID NO: 1114443 - DNA, 21 bp, Homo sapiens
gccaggcacctggcctgctgg

SEQ ID NO: 1114444 - DNA, 22 bp, Homo sapiens
gccaggcacctggcctgctggg

SEQ ID NO: 1114445 - DNA, 13 bp, Homo sapiens
gccaggcactgcc

SEQ ID NO: 1114446 - DNA, 18 bp, Homo sapiens
gccaggcagaatggctgc

SEQ ID NO: 1114447 - DNA, 21 bp, Homo sapiens
gccaggcagaatggctgcacg

SEQ ID NO: 1114448 - DNA, 14 bp, Homo sapiens
gccaggcagagctg

SEQ ID NO: 1114449 - DNA, 14 bp, Homo sapiens
gccaggcagaggtt

SEQ ID NO: 1114450 - DNA, 18 bp, Homo sapiens
gccaggcagatcctctgg

SEQ ID NO: 1114451 - DNA, 14 bp, Homo sapiens
gccaggcagatctg

SEQ ID NO: 1114452 - DNA, 12 bp, Homo sapiens
gccaggcaggcg

SEQ ID NO: 1114453 - DNA, 13 bp, Homo sapiens
gccaggcaggcga

SEQ ID NO: 1114454 - DNA, 14 bp, Homo sapiens
gccaggcaggcgat

SEQ ID NO: 1114455 - DNA, 15 bp, Homo sapiens
gccaggcaggggtgg

SEQ ID NO: 1114456 - DNA, 22 bp, Homo sapiens
gccaggccaacagcacctcccc

SEQ ID NO: 1114457 - DNA, 15 bp, Homo sapiens
gccaggccaccagga

SEQ ID NO: 1114458 - DNA, 12 bp, Homo sapiens
gccaggccagcc

SEQ ID NO: 1114459 - DNA, 14 bp, Homo sapiens
gccaggccagcctc

SEQ ID NO: 1114460 - DNA, 13 bp, Homo sapiens
gccaggccagctg

SEQ ID NO: 1114461 - DNA, 13 bp, Homo sapiens
gccaggcccaggc

SEQ ID NO: 1114462 - DNA, 15 bp, Homo sapiens
gccaggcccaggcca

SEQ ID NO: 1114463 - DNA, 17 bp, Homo sapiens
gccaggcccatctcagg

SEQ ID NO: 1114464 - DNA, 19 bp, Homo sapiens
gccaggcccatctcaggtg

SEQ ID NO: 1114465 - DNA, 21 bp, Homo sapiens
gccaggcccatctcaggtgcc

SEQ ID NO: 1114466 - DNA, 17 bp, Homo sapiens
gccaggcccggggctgg

SEQ ID NO: 1114467 - DNA, 13 bp, Homo sapiens
gccaggcctcgca

SEQ ID NO: 1114468 - DNA, 21 bp, Homo sapiens
gccaggcctcttggcagtcac

SEQ ID NO: 1114469 - DNA, 14 bp, Homo sapiens
gccaggcctgcaga

SEQ ID NO: 1114470 - DNA, 19 bp, Homo sapiens
gccaggcgagcctgactct

SEQ ID NO: 1114471 - DNA, 20 bp, Homo sapiens
gccaggcgagcctgactctg

SEQ ID NO: 1114472 - DNA, 22 bp, Homo sapiens
gccaggcggacaaagttcagtg

SEQ ID NO: 1114473 - DNA, 20 bp, Homo sapiens
gccaggcggccctggggagg

SEQ ID NO: 1114474 - DNA, 17 bp, Homo sapiens
gccaggcgttggtgcca

SEQ ID NO: 1114475 - DNA, 18 bp, Homo sapiens
gccaggcgttggtgccac

SEQ ID NO: 1114476 - DNA, 22 bp, Homo sapiens
gccaggctatggttgccacccc

SEQ ID NO: 1114477 - DNA, 16 bp, Homo sapiens
gccaggctctccgggc

SEQ ID NO: 1114478 - DNA, 19 bp, Homo sapiens
gccaggctgaccacagcac

SEQ ID NO: 1114479 - DNA, 14 bp, Homo sapiens
gccaggctgcctcg

SEQ ID NO: 1114480 - DNA, 21 bp, Homo sapiens
gccaggctgcctcggactcca

SEQ ID NO: 1114481 - DNA, 14 bp, Homo sapiens
gccaggctgctaac

SEQ ID NO: 1114482 - DNA, 21 bp, Homo sapiens
gccaggctgctaacctggaaa

SEQ ID NO: 1114483 - DNA, 13 bp, Homo sapiens
gccaggctggaga

SEQ ID NO: 1114484 - DNA, 20 bp, Homo sapiens
gccaggctggagtgcagtgg

SEQ ID NO: 1114485 - DNA, 14 bp, Homo sapiens
gccaggctgggcac

SEQ ID NO: 1114486 - DNA, 21 bp, Homo sapiens
gccaggctgggccgcaagggc

SEQ ID NO: 1114487 - DNA, 19 bp, Homo sapiens
gccaggcttgcctgggctg

SEQ ID NO: 1114488 - DNA, 17 bp, Homo sapiens
gccaggcttggatggaa

SEQ ID NO: 1114489 - DNA, 20 bp, Homo sapiens
gccagggaggcgcagggaca

SEQ ID NO: 1114490 - DNA, 20 bp, Homo sapiens
gccagggcaatgatgaatga

SEQ ID NO: 1114491 - DNA, 21 bp, Homo sapiens
gccagggcaatgccatcagcc

SEQ ID NO: 1114492 - DNA, 23 bp, Homo sapiens
gccagggcaatgccatcagcccc

SEQ ID NO: 1114493 - DNA, 15 bp, Homo sapiens
gccagggcagaggaa

SEQ ID NO: 1114494 - DNA, 16 bp, Homo sapiens
gccagggcagaggaat

SEQ ID NO: 1114495 - DNA, 16 bp, Homo sapiens
gccagggcagagtgag

SEQ ID NO: 1114496 - DNA, 12 bp, Homo sapiens
gccagggcagca

SEQ ID NO: 1114497 - DNA, 15 bp, Homo sapiens
gccagggccacgctc

SEQ ID NO: 1114498 - DNA, 12 bp, Homo sapiens
gccagggcccag

SEQ ID NO: 1114499 - DNA, 13 bp, Homo sapiens
gccagggcccaga

SEQ ID NO: 1114500 - DNA, 16 bp, Homo sapiens
gccagggcccaggcca

SEQ ID NO: 1114501 - DNA, 17 bp, Homo sapiens
gccagggcccaggccat

SEQ ID NO: 1114502 - DNA, 18 bp, Homo sapiens
gccagggcccaggccatg

SEQ ID NO: 1114503 - DNA, 15 bp, Homo sapiens
gccagggccctgcag

SEQ ID NO: 1114504 - DNA, 12 bp, Homo sapiens
gccagggcggcc

SEQ ID NO: 1114505 - DNA, 14 bp, Homo sapiens
gccagggcggccag

SEQ ID NO: 1114506 - DNA, 15 bp, Homo sapiens
gccagggcggccagg

SEQ ID NO: 1114507 - DNA, 17 bp, Homo sapiens
gccagggcggccaggga

SEQ ID NO: 1114508 - DNA, 21 bp, Homo sapiens
gccagggcggccagggaccca

SEQ ID NO: 1114509 - DNA, 12 bp, Homo sapiens
gccagggctgga

SEQ ID NO: 1114510 - DNA, 14 bp, Homo sapiens
gccagggctggaga

SEQ ID NO: 1114511 - DNA, 18 bp, Homo sapiens
gccagggctggatggaca

SEQ ID NO: 1114512 - DNA, 20 bp, Homo sapiens
gccagggctggatggacaga

SEQ ID NO: 1114513 - DNA, 21 bp, Homo sapiens
gccagggctggatggacagac

SEQ ID NO: 1114514 - DNA, 13 bp, Homo sapiens
gccagggctgggg

SEQ ID NO: 1114515 - DNA, 14 bp, Homo sapiens
gccagggctgggga

SEQ ID NO: 1114516 - DNA, 16 bp, Homo sapiens
gccagggctgtcctta

SEQ ID NO: 1114517 - DNA, 17 bp, Homo sapiens
gccagggcttccccatc

SEQ ID NO: 1114518 - DNA, 23 bp, Homo sapiens
gccagggcttccccatcagctcc

SEQ ID NO: 1114519 - DNA, 23 bp, Homo sapiens
gcccacccctcactccccaggga

SEQ ID NO: 1114520 - DNA, 16 bp, Homo sapiens
gcccacccgcccgagg

SEQ ID NO: 1114521 - DNA, 22 bp, Homo sapiens
gcccaccctaccagctcctcca

SEQ ID NO: 1114522 - DNA, 17 bp, Homo sapiens
gcccaccctcctgtacc

SEQ ID NO: 1114523 - DNA, 17 bp, Homo sapiens
gcccaccctctgcccag

SEQ ID NO: 1114524 - DNA, 10 bp, Homo sapiens
gcccaccctg

SEQ ID NO: 1114525 - DNA, 23 bp, Homo sapiens
gcccaccggatgctgtgcctggc

SEQ ID NO: 1114526 - DNA, 22 bp, Homo sapiens
gcccaccgtgggcagtgccacc

SEQ ID NO: 1114527 - DNA, 23 bp, Homo sapiens
gcccaccgtgggcagtgccaccc

SEQ ID NO: 1114528 - DNA, 16 bp, Homo sapiens
gcccacctcagcctcc

SEQ ID NO: 1114529 - DNA, 17 bp, Homo sapiens
gcccacctcgctcccct

SEQ ID NO: 1114530 - DNA, 18 bp, Homo sapiens
gcccacctcgctcccctc

SEQ ID NO: 1114531 - DNA, 21 bp, Homo sapiens
gcccacctcgctcccctctgg

SEQ ID NO: 1114532 - DNA, 23 bp, Homo sapiens
gcccacctctcttttcctctctg

SEQ ID NO: 1114533 - DNA, 9 bp, Homo sapiens
gcccacctg

SEQ ID NO: 1114534 - DNA, 10 bp, Homo sapiens
gcccacctga

SEQ ID NO: 1114535 - DNA, 13 bp, Homo sapiens
gcccacctgggct

SEQ ID NO: 1114536 - DNA, 19 bp, Homo sapiens
gcccacctgggctgggcgc

SEQ ID NO: 1114537 - DNA, 21 bp, Homo sapiens
gcccacctggggtctctctcc

SEQ ID NO: 1114538 - DNA, 18 bp, Homo sapiens
gcccaccttggaccctgg

SEQ ID NO: 1114539 - DNA, 15 bp, Homo sapiens
gcccacgaggagcag

SEQ ID NO: 1114540 - DNA, 17 bp, Homo sapiens
gcccacgatcccctccc

SEQ ID NO: 1114541 - DNA, 13 bp, Homo sapiens
gcccacgcagagg

SEQ ID NO: 1114542 - DNA, 15 bp, Homo sapiens
gcccacgccggcctc

SEQ ID NO: 1114543 - DNA, 23 bp, Homo sapiens
gcccacgccggcctctgctgccc

SEQ ID NO: 1114544 - DNA, 18 bp, Homo sapiens
gcccacgcgcttccctgg

SEQ ID NO: 1114545 - DNA, 21 bp, Homo sapiens
gcccacgtagggggctctggg

SEQ ID NO: 1114546 - DNA, 22 bp, Homo sapiens
gcccacgtagggggctctgggc

SEQ ID NO: 1114547 - DNA, 23 bp, Homo sapiens
gcccactagacccactggactca

SEQ ID NO: 1114548 - DNA, 12 bp, Homo sapiens
gcccactcccca

SEQ ID NO: 1114549 - DNA, 13 bp, Homo sapiens
gcccactccccag

SEQ ID NO: 1114550 - DNA, 14 bp, Homo sapiens
gcccactccctgcc

SEQ ID NO: 1114551 - DNA, 16 bp, Homo sapiens
gcccactccctgccta

SEQ ID NO: 1114552 - DNA, 16 bp, Homo sapiens
gcccactgcccacccc

SEQ ID NO: 1114553 - DNA, 21 bp, Homo sapiens
gcccactgctgcagtagggga

SEQ ID NO: 1114554 - DNA, 19 bp, Homo sapiens
gcccactggccgctgagcg

SEQ ID NO: 1114555 - DNA, 20 bp, Homo sapiens
gcccactggccgctgagcgc

SEQ ID NO: 1114556 - DNA, 21 bp, Homo sapiens
gcccactggccgctgagcgcc

SEQ ID NO: 1114557 - DNA, 22 bp, Homo sapiens
gcccactggccgctgagcgccc

SEQ ID NO: 1114558 - DNA, 14 bp, Homo sapiens
gcccactgtcctgg

SEQ ID NO: 1114559 - DNA, 23 bp, Homo sapiens
gcccactgtcctgggcgccctgg

SEQ ID NO: 1114560 - DNA, 19 bp, Homo sapiens
gcccacttacatttacaaa

SEQ ID NO: 1114561 - DNA, 21 bp, Homo sapiens
gcccacttagccgtccatggc

SEQ ID NO: 1114562 - DNA, 17 bp, Homo sapiens
gcccacttgattgagaa

SEQ ID NO: 1114563 - DNA, 22 bp, Homo sapiens
gcccacttgtcccactatctgg

SEQ ID NO: 1114564 - DNA, 17 bp, Homo sapiens
gcccagaaagcctctct

SEQ ID NO: 1114565 - DNA, 16 bp, Homo sapiens
gcccagaaagctgcgg

SEQ ID NO: 1114566 - DNA, 16 bp, Homo sapiens
gcccagaaccacagat

SEQ ID NO: 1114567 - DNA, 17 bp, Homo sapiens
gcccagaactgccccca

SEQ ID NO: 1114568 - DNA, 18 bp, Homo sapiens
gcccagaactgcccccac

SEQ ID NO: 1114569 - DNA, 19 bp, Homo sapiens
gcccagaactgcccccact

SEQ ID NO: 1114570 - DNA, 20 bp, Homo sapiens
gcccagaactgcccccactg

SEQ ID NO: 1114571 - DNA, 17 bp, Homo sapiens
gcccagaacttccctga

SEQ ID NO: 1114572 - DNA, 23 bp, Homo sapiens
gcccagaataagttattgcagtt

SEQ ID NO: 1114573 - DNA, 18 bp, Homo sapiens
gcccagacacagactggc

SEQ ID NO: 1114574 - DNA, 18 bp, Homo sapiens
gcccagacaccatgtgca

SEQ ID NO: 1114575 - DNA, 13 bp, Homo sapiens
gcccagactctga

SEQ ID NO: 1114576 - DNA, 15 bp, Homo sapiens
gcccagactctgagc

SEQ ID NO: 1114577 - DNA, 16 bp, Homo sapiens
gcccagactgatgagc

SEQ ID NO: 1114578 - DNA, 19 bp, Homo sapiens
gcccagactgatgagcaca

SEQ ID NO: 1114579 - DNA, 13 bp, Homo sapiens
gcccagagaacag

SEQ ID NO: 1114580 - DNA, 21 bp, Homo sapiens
gcccagagaagctggaagcct

SEQ ID NO: 1114581 - DNA, 19 bp, Homo sapiens
gcccagagacccaagctgc

SEQ ID NO: 1114582 - DNA, 12 bp, Homo sapiens
gcccagagactt

SEQ ID NO: 1114583 - DNA, 16 bp, Homo sapiens
gcccagagcaggaagc

SEQ ID NO: 1114584 - DNA, 14 bp, Homo sapiens
gcccagagccacct

SEQ ID NO: 1114585 - DNA, 16 bp, Homo sapiens
gcccagagccacctgg

SEQ ID NO: 1114586 - DNA, 15 bp, Homo sapiens
gcccagagcccttga

SEQ ID NO: 1114587 - DNA, 24 bp, Homo sapiens
gcccagagcccttgactgtacaga

SEQ ID NO: 1114588 - DNA, 16 bp, Homo sapiens
gcccagagctggcctc

SEQ ID NO: 1114589 - DNA, 21 bp, Homo sapiens
gcccagagctggcctccccca

SEQ ID NO: 1114590 - DNA, 16 bp, Homo sapiens
gcccagaggactccca

SEQ ID NO: 1114591 - DNA, 13 bp, Homo sapiens
gcccagagggccc

SEQ ID NO: 1114592 - DNA, 15 bp, Homo sapiens
gcccagagggcccag

SEQ ID NO: 1114593 - DNA, 20 bp, Homo sapiens
gcccagagggcccaggcagg

SEQ ID NO: 1114594 - DNA, 21 bp, Homo sapiens
gcccagagggcccaggcaggc

SEQ ID NO: 1114595 - DNA, 18 bp, Homo sapiens
gcccagagggtggcaaga

SEQ ID NO: 1114596 - DNA, 23 bp, Homo sapiens
gcccagagttgctgggagctgaa

SEQ ID NO: 1114597 - DNA, 17 bp, Homo sapiens
gcccagatcagctccta

SEQ ID NO: 1114598 - DNA, 16 bp, Homo sapiens
gcccagatccaaggcc

SEQ ID NO: 1114599 - DNA, 23 bp, Homo sapiens
gcccagattcccagaccttaaga

SEQ ID NO: 1114600 - DNA, 21 bp, Homo sapiens
gcccagcactgcttgaggaaa

SEQ ID NO: 1114601 - DNA, 14 bp, Homo sapiens
gcccagcaggagag

SEQ ID NO: 1114602 - DNA, 19 bp, Homo sapiens
gcccagcaggcaggcactg

SEQ ID NO: 1114603 - DNA, 12 bp, Homo sapiens
gcccagcaggcc

SEQ ID NO: 1114604 - DNA, 17 bp, Homo sapiens
gcccagcaggcccagca

SEQ ID NO: 1114605 - DNA, 21 bp, Homo sapiens
gcccagcaggcccagcatgca

SEQ ID NO: 1114606 - DNA, 17 bp, Homo sapiens
gcccagcatgcaggtgg

SEQ ID NO: 1114607 - DNA, 16 bp, Homo sapiens
gcccagcattgctggt

SEQ ID NO: 1114608 - DNA, 23 bp, Homo sapiens
gcccagccactccaagccccctg

SEQ ID NO: 1114609 - DNA, 13 bp, Homo sapiens
gcccagccagcca

SEQ ID NO: 1114610 - DNA, 16 bp, Homo sapiens
gcccagccagccaccc

SEQ ID NO: 1114611 - DNA, 22 bp, Homo sapiens
gcccagccagccacccctgcca

SEQ ID NO: 1114612 - DNA, 17 bp, Homo sapiens
gcccagccaggccaaca

SEQ ID NO: 1114613 - DNA, 16 bp, Homo sapiens
gcccagccaggcccca

SEQ ID NO: 1114614 - DNA, 20 bp, Homo sapiens
gcccagccattaccatggag

SEQ ID NO: 1114615 - DNA, 21 bp, Homo sapiens
gcccagccattaccatggaga

SEQ ID NO: 1114616 - DNA, 11 bp, Homo sapiens
gcccagcccag

SEQ ID NO: 1114617 - DNA, 12 bp, Homo sapiens
gcccagcccaga

SEQ ID NO: 1114618 - DNA, 17 bp, Homo sapiens
gcccagcccagagccac

SEQ ID NO: 1114619 - DNA, 18 bp, Homo sapiens
gcccagcccagagccacc

SEQ ID NO: 1114620 - DNA, 17 bp, Homo sapiens
gcccagccccactcctc

SEQ ID NO: 1114621 - DNA, 18 bp, Homo sapiens
gcccagccccactcctct

SEQ ID NO: 1114622 - DNA, 17 bp, Homo sapiens
gcccagcccctactgct

SEQ ID NO: 1114623 - DNA, 19 bp, Homo sapiens
gcccagcccctactgctgt

SEQ ID NO: 1114624 - DNA, 15 bp, Homo sapiens
gcccagcccctagaa

SEQ ID NO: 1114625 - DNA, 12 bp, Homo sapiens
gcccagccctcc

SEQ ID NO: 1114626 - DNA, 16 bp, Homo sapiens
gcccagccctccccat

SEQ ID NO: 1114627 - DNA, 19 bp, Homo sapiens
gcccagccctccttcaggg

SEQ ID NO: 1114628 - DNA, 13 bp, Homo sapiens
gcccagccggcct

SEQ ID NO: 1114629 - DNA, 19 bp, Homo sapiens
gcccagccggcctctctgg

SEQ ID NO: 1114630 - DNA, 14 bp, Homo sapiens
gcccagcctaggcc

SEQ ID NO: 1114631 - DNA, 11 bp, Homo sapiens
gcccagcctgc

SEQ ID NO: 1114632 - DNA, 13 bp, Homo sapiens
gcccagcctgccc

SEQ ID NO: 1114633 - DNA, 19 bp, Homo sapiens
gcccagcctgggagcccag

SEQ ID NO: 1114634 - DNA, 15 bp, Homo sapiens
gcccagcctgtcctg

SEQ ID NO: 1114635 - DNA, 14 bp, Homo sapiens
gcccagcgctcgcc

SEQ ID NO: 1114636 - DNA, 16 bp, Homo sapiens
gcccagcggcccctcc

SEQ ID NO: 1114637 - DNA, 17 bp, Homo sapiens
gcccagcggcccctccc

SEQ ID NO: 1114638 - DNA, 19 bp, Homo sapiens
gcccagcggcccctcccac

SEQ ID NO: 1114639 - DNA, 17 bp, Homo sapiens
gcccagctacattcctc

SEQ ID NO: 1114640 - DNA, 21 bp, Homo sapiens
gcccagctacattcctcagct

SEQ ID NO: 1114641 - DNA, 16 bp, Homo sapiens
gccccgttccctgtca

SEQ ID NO: 1114642 - DNA, 21 bp, Homo sapiens
gccccgttccctgtcagaggc

SEQ ID NO: 1114643 - DNA, 21 bp, Homo sapiens
gcccctaaagatgggaggaga

SEQ ID NO: 1114644 - DNA, 17 bp, Homo sapiens
gcccctaagccccgtcc

SEQ ID NO: 1114645 - DNA, 18 bp, Homo sapiens
gcccctaatcacatgtgc

SEQ ID NO: 1114646 - DNA, 16 bp, Homo sapiens
gcccctaccccacacc

SEQ ID NO: 1114647 - DNA, 21 bp, Homo sapiens
gcccctacccctgccctgctc

SEQ ID NO: 1114648 - DNA, 13 bp, Homo sapiens
gcccctactgctg

SEQ ID NO: 1114649 - DNA, 21 bp, Homo sapiens
gcccctagaaacccaagctcc

SEQ ID NO: 1114650 - DNA, 20 bp, Homo sapiens
gcccctagaatcagcctagg

SEQ ID NO: 1114651 - DNA, 19 bp, Homo sapiens
gcccctaggatgctgcagc

SEQ ID NO: 1114652 - DNA, 22 bp, Homo sapiens
gcccctaggatgctgcagcaga

SEQ ID NO: 1114653 - DNA, 20 bp, Homo sapiens
gcccctatgtagtccgtgct

SEQ ID NO: 1114654 - DNA, 14 bp, Homo sapiens
gcccctcacatcct

SEQ ID NO: 1114655 - DNA, 19 bp, Homo sapiens
gcccctcaccctctgtccc

SEQ ID NO: 1114656 - DNA, 20 bp, Homo sapiens
gcccctcaccctctgtcccc

SEQ ID NO: 1114657 - DNA, 14 bp, Homo sapiens
gcccctcacctggg

SEQ ID NO: 1114658 - DNA, 17 bp, Homo sapiens
gcccctcacctgggcac

SEQ ID NO: 1114659 - DNA, 17 bp, Homo sapiens
gcccctcacctgggcct

SEQ ID NO: 1114660 - DNA, 18 bp, Homo sapiens
gcccctcacctgggcctt

SEQ ID NO: 1114661 - DNA, 20 bp, Homo sapiens
gcccctcacctgggcctttc

SEQ ID NO: 1114662 - DNA, 16 bp, Homo sapiens
gcccctcactcctgcg

SEQ ID NO: 1114663 - DNA, 20 bp, Homo sapiens
gcccctcagagccctgccct

SEQ ID NO: 1114664 - DNA, 14 bp, Homo sapiens
gcccctcagccctt

SEQ ID NO: 1114665 - DNA, 22 bp, Homo sapiens
gcccctcagggggccagctggg

SEQ ID NO: 1114666 - DNA, 23 bp, Homo sapiens
gcccctcagggggccagctgggg

SEQ ID NO: 1114667 - DNA, 18 bp, Homo sapiens
gcccctccaaacctccag

SEQ ID NO: 1114668 - DNA, 20 bp, Homo sapiens
gcccctccaaacctccagcc

SEQ ID NO: 1114669 - DNA, 16 bp, Homo sapiens
gcccctccacgcctcc

SEQ ID NO: 1114670 - DNA, 17 bp, Homo sapiens
gcccctccacgcctcct

SEQ ID NO: 1114671 - DNA, 15 bp, Homo sapiens
gcccctcccaccaca

SEQ ID NO: 1114672 - DNA, 15 bp, Homo sapiens
gcccctccccagcca

SEQ ID NO: 1114673 - DNA, 12 bp, Homo sapiens
gcccctccccca

SEQ ID NO: 1114674 - DNA, 16 bp, Homo sapiens
gcccctcccccagctg

SEQ ID NO: 1114675 - DNA, 17 bp, Homo sapiens
gcccctcccccagctgc

SEQ ID NO: 1114676 - DNA, 22 bp, Homo sapiens
gcccctccccgtccctgtcccc

SEQ ID NO: 1114677 - DNA, 23 bp, Homo sapiens
gcccctccccgtccctgtccccc

SEQ ID NO: 1114678 - DNA, 20 bp, Homo sapiens
gcccctcccctcagagccca

SEQ ID NO: 1114679 - DNA, 16 bp, Homo sapiens
gcccctcccctcagcc

SEQ ID NO: 1114680 - DNA, 18 bp, Homo sapiens
gcccctcccctcagcctg

SEQ ID NO: 1114681 - DNA, 20 bp, Homo sapiens
gcccctcccctcagcctgcc

SEQ ID NO: 1114682 - DNA, 22 bp, Homo sapiens
gcccctcccctcagcctgccca

SEQ ID NO: 1114683 - DNA, 18 bp, Homo sapiens
gcccctccctcagggagc

SEQ ID NO: 1114684 - DNA, 19 bp, Homo sapiens
gcccctccctcagggagcg

SEQ ID NO: 1114685 - DNA, 19 bp, Homo sapiens
gcccctccctcccggctgc

SEQ ID NO: 1114686 - DNA, 18 bp, Homo sapiens
gcccctccctctgcccca

SEQ ID NO: 1114687 - DNA, 21 bp, Homo sapiens
gcccctcctccagcccctgtc

SEQ ID NO: 1114688 - DNA, 12 bp, Homo sapiens
gcccctcctccc

SEQ ID NO: 1114689 - DNA, 20 bp, Homo sapiens
gcccctcctcccccggctgg

SEQ ID NO: 1114690 - DNA, 12 bp, Homo sapiens
gcccctcctctg

SEQ ID NO: 1114691 - DNA, 15 bp, Homo sapiens
gcccctcctctgcca

SEQ ID NO: 1114692 - DNA, 16 bp, Homo sapiens
gcccctcctctgccac

SEQ ID NO: 1114693 - DNA, 20 bp, Homo sapiens
gcccctcctctgccacctcc

SEQ ID NO: 1114694 - DNA, 13 bp, Homo sapiens
gcccctccttgca

SEQ ID NO: 1114695 - DNA, 17 bp, Homo sapiens
gcccctccttgcaacca

SEQ ID NO: 1114696 - DNA, 20 bp, Homo sapiens
gcccctcgaggcctacagag

SEQ ID NO: 1114697 - DNA, 21 bp, Homo sapiens
gcccctcgaggcctacagagg

SEQ ID NO: 1114698 - DNA, 19 bp, Homo sapiens
gcccctcgcacacagggct

SEQ ID NO: 1114699 - DNA, 22 bp, Homo sapiens
gcccctcgcacacagggctcac

SEQ ID NO: 1114700 - DNA, 15 bp, Homo sapiens
gcccctcgcctgtgg

SEQ ID NO: 1114701 - DNA, 19 bp, Homo sapiens
gcccctcgttgcccagcac

SEQ ID NO: 1114702 - DNA, 22 bp, Homo sapiens
gcccctctactgttgcacagcc

SEQ ID NO: 1114703 - DNA, 14 bp, Homo sapiens
gcccctctcaccaa

SEQ ID NO: 1114704 - DNA, 19 bp, Homo sapiens
gcccctctcccctctctgc

SEQ ID NO: 1114705 - DNA, 21 bp, Homo sapiens
gcccctctcccgccagactgt

SEQ ID NO: 1114706 - DNA, 12 bp, Homo sapiens
gcccctctccga

SEQ ID NO: 1114707 - DNA, 13 bp, Homo sapiens
gcccctctctcac

SEQ ID NO: 1114708 - DNA, 12 bp, Homo sapiens
gcccctctgatt

SEQ ID NO: 1114709 - DNA, 11 bp, Homo sapiens
gcccctctgcc

SEQ ID NO: 1114710 - DNA, 15 bp, Homo sapiens
gcccctctgcccagc

SEQ ID NO: 1114711 - DNA, 18 bp, Homo sapiens
gcccctctgcccagcttg

SEQ ID NO: 1114712 - DNA, 22 bp, Homo sapiens
gcccctctggtcgctcctgccc

SEQ ID NO: 1114713 - DNA, 17 bp, Homo sapiens
gcccctctgttctctcc

SEQ ID NO: 1114714 - DNA, 16 bp, Homo sapiens
gcccctcttgcccccc

SEQ ID NO: 1114715 - DNA, 19 bp, Homo sapiens
gcccctcttgccccccacc

SEQ ID NO: 1114716 - DNA, 17 bp, Homo sapiens
gcccctcttggagaagt

SEQ ID NO: 1114717 - DNA, 23 bp, Homo sapiens
gcccctcttggagaagtctcagc

SEQ ID NO: 1114718 - DNA, 12 bp, Homo sapiens
gcccctctttct

SEQ ID NO: 1114719 - DNA, 14 bp, Homo sapiens
gcccctctttctct

SEQ ID NO: 1114720 - DNA, 16 bp, Homo sapiens
gcccctgaaagcctca

SEQ ID NO: 1114721 - DNA, 16 bp, Homo sapiens
gcccctgaacaagaat

SEQ ID NO: 1114722 - DNA, 12 bp, Homo sapiens
gcccctgaccct

SEQ ID NO: 1114723 - DNA, 22 bp, Homo sapiens
gcccctgagagtggtgccctgg

SEQ ID NO: 1114724 - DNA, 23 bp, Homo sapiens
gcccctgagcaatgtctgtgcta

SEQ ID NO: 1114725 - DNA, 22 bp, Homo sapiens
gcccctgagtccgcctgcgcct

SEQ ID NO: 1114726 - DNA, 14 bp, Homo sapiens
gcccctgatctctg

SEQ ID NO: 1114727 - DNA, 16 bp, Homo sapiens
gcccctgatctctgac

SEQ ID NO: 1114728 - DNA, 19 bp, Homo sapiens
gcccctgatctctgacctc

SEQ ID NO: 1114729 - DNA, 22 bp, Homo sapiens
gcccctgatctctgacctctgc

SEQ ID NO: 1114730 - DNA, 18 bp, Homo sapiens
gcccctgatgcagcctgt

SEQ ID NO: 1114731 - DNA, 21 bp, Homo sapiens
gcccctgatgcagcctgtggc

SEQ ID NO: 1114732 - DNA, 22 bp, Homo sapiens
gcccctgatgcagcctgtggct

SEQ ID NO: 1114733 - DNA, 16 bp, Homo sapiens
gcccctgcacaggcac

SEQ ID NO: 1114734 - DNA, 19 bp, Homo sapiens
gcccctgcagtttggccct

SEQ ID NO: 1114735 - DNA, 21 bp, Homo sapiens
gcccctgcagtttggccctgg

SEQ ID NO: 1114736 - DNA, 22 bp, Homo sapiens
gcccctgcagtttggccctgga

SEQ ID NO: 1114737 - DNA, 12 bp, Homo sapiens
gcccctgccccg

SEQ ID NO: 1114738 - DNA, 16 bp, Homo sapiens
gcccctgccccgtcac

SEQ ID NO: 1114739 - DNA, 20 bp, Homo sapiens
gcccctgccccgtcaccatc

SEQ ID NO: 1114740 - DNA, 13 bp, Homo sapiens
gcccctgcctgcc

SEQ ID NO: 1114741 - DNA, 21 bp, Homo sapiens
gcccctgcgtgggggccagtc

SEQ ID NO: 1114742 - DNA, 19 bp, Homo sapiens
gcccctgctgcctccccaa

SEQ ID NO: 1114743 - DNA, 18 bp, Homo sapiens
gcccctgctgtctctctg

SEQ ID NO: 1114744 - DNA, 20 bp, Homo sapiens
gcccctgctgtctctctggg

SEQ ID NO: 1114745 - DNA, 17 bp, Homo sapiens
gcccctggacccctggg

SEQ ID NO: 1114746 - DNA, 17 bp, Homo sapiens
gcccctggacctgggaa

SEQ ID NO: 1114747 - DNA, 15 bp, Homo sapiens
gcccctggcagcaca

SEQ ID NO: 1114748 - DNA, 23 bp, Homo sapiens
gcccctggcagcacagcccaggg

SEQ ID NO: 1114749 - DNA, 12 bp, Homo sapiens
gcccctggccca

SEQ ID NO: 1114750 - DNA, 13 bp, Homo sapiens
gcccctggcccag

SEQ ID NO: 1114751 - DNA, 15 bp, Homo sapiens
gcccctggcccagag

SEQ ID NO: 1114752 - DNA, 19 bp, Homo sapiens
gcccctggcccagcggccc

SEQ ID NO: 1114753 - DNA, 17 bp, Homo sapiens
gcccctggcccatctca

SEQ ID NO: 1114754 - DNA, 13 bp, Homo sapiens
gcccctggcccca

SEQ ID NO: 1114755 - DNA, 18 bp, Homo sapiens
gcccctggccccgcctgc

SEQ ID NO: 1114756 - DNA, 14 bp, Homo sapiens
gcccctggctggga

SEQ ID NO: 1114757 - DNA, 21 bp, Homo sapiens
gcccctgggaacaggccccac

SEQ ID NO: 1114758 - DNA, 13 bp, Homo sapiens
gcccctgggccct

SEQ ID NO: 1114759 - DNA, 16 bp, Homo sapiens
gcccctgggcccttgt

SEQ ID NO: 1114760 - DNA, 22 bp, Homo sapiens
gcccctgggcccttgtgctcct

SEQ ID NO: 1114761 - DNA, 18 bp, Homo sapiens
gcccctgggcttggcctg

SEQ ID NO: 1114762 - DNA, 14 bp, Homo sapiens
gccctcggcctccg

SEQ ID NO: 1114763 - DNA, 15 bp, Homo sapiens
gccctcggtcagcga

SEQ ID NO: 1114764 - DNA, 16 bp, Homo sapiens
gccctcggtggctgca

SEQ ID NO: 1114765 - DNA, 22 bp, Homo sapiens
gccctcgtgcctgggggagaga

SEQ ID NO: 1114766 - DNA, 16 bp, Homo sapiens
gccctcgtggccagcc

SEQ ID NO: 1114767 - DNA, 17 bp, Homo sapiens
gccctcgtggccagccc

SEQ ID NO: 1114768 - DNA, 14 bp, Homo sapiens
gccctctcactcca

SEQ ID NO: 1114769 - DNA, 16 bp, Homo sapiens
gccctctcactccagc

SEQ ID NO: 1114770 - DNA, 18 bp, Homo sapiens
gccctctcactccagcca

SEQ ID NO: 1114771 - DNA, 19 bp, Homo sapiens
gccctctcactccagccaa

SEQ ID NO: 1114772 - DNA, 21 bp, Homo sapiens
gccctctcactccagccaaag

SEQ ID NO: 1114773 - DNA, 22 bp, Homo sapiens
gccctctcactccagccaaaga

SEQ ID NO: 1114774 - DNA, 19 bp, Homo sapiens
gccctctccctgtgttctg

SEQ ID NO: 1114775 - DNA, 14 bp, Homo sapiens
gccctctcctcccc

SEQ ID NO: 1114776 - DNA, 14 bp, Homo sapiens
gccctctctctggg

SEQ ID NO: 1114777 - DNA, 11 bp, Homo sapiens
gccctctcttc

SEQ ID NO: 1114778 - DNA, 13 bp, Homo sapiens
gccctctgaaatt

SEQ ID NO: 1114779 - DNA, 21 bp, Homo sapiens
gccctctgaaattaaagaaat

SEQ ID NO: 1114780 - DNA, 23 bp, Homo sapiens
gccctctgaaattaaagaaatga

SEQ ID NO: 1114781 - DNA, 14 bp, Homo sapiens
gccctctgcctcct

SEQ ID NO: 1114782 - DNA, 15 bp, Homo sapiens
gccctctgcctcctc

SEQ ID NO: 1114783 - DNA, 14 bp, Homo sapiens
gccctctgcctgca

SEQ ID NO: 1114784 - DNA, 15 bp, Homo sapiens
gccctctgctcaggc

SEQ ID NO: 1114785 - DNA, 16 bp, Homo sapiens
gccctctgctcaggcc

SEQ ID NO: 1114786 - DNA, 18 bp, Homo sapiens
gccctctgctcaggcctc

SEQ ID NO: 1114787 - DNA, 14 bp, Homo sapiens
gccctctgctctgc

SEQ ID NO: 1114788 - DNA, 16 bp, Homo sapiens
gccctctgctctgcct

SEQ ID NO: 1114789 - DNA, 17 bp, Homo sapiens
gccctctgctctgcctg

SEQ ID NO: 1114790 - DNA, 19 bp, Homo sapiens
gccctctgctgctgcccgg

SEQ ID NO: 1114791 - DNA, 17 bp, Homo sapiens
gccctctggagtggcca

SEQ ID NO: 1114792 - DNA, 20 bp, Homo sapiens
gccctctggagtggccacta

SEQ ID NO: 1114793 - DNA, 19 bp, Homo sapiens
gccctctgggtccctcctc

SEQ ID NO: 1114794 - DNA, 20 bp, Homo sapiens
gccctctgggtccctcctct

SEQ ID NO: 1114795 - DNA, 20 bp, Homo sapiens
gccctctgtctgtcttctcc

SEQ ID NO: 1114796 - DNA, 15 bp, Homo sapiens
gccctctgtggcctg

SEQ ID NO: 1114797 - DNA, 17 bp, Homo sapiens
gccctcttaagatctga

SEQ ID NO: 1114798 - DNA, 14 bp, Homo sapiens
gccctcttcctgac

SEQ ID NO: 1114799 - DNA, 16 bp, Homo sapiens
gccctcttcctgacga

SEQ ID NO: 1114800 - DNA, 11 bp, Homo sapiens
gccctcttctc

SEQ ID NO: 1114801 - DNA, 16 bp, Homo sapiens
gccctcttctccttgc

SEQ ID NO: 1114802 - DNA, 23 bp, Homo sapiens
gccctcttctccttgccttgctt

SEQ ID NO: 1114803 - DNA, 12 bp, Homo sapiens
gccctcttctcg

SEQ ID NO: 1114804 - DNA, 12 bp, Homo sapiens
gccctcttgcca

SEQ ID NO: 1114805 - DNA, 21 bp, Homo sapiens
gccctcttgccagcctccttg

SEQ ID NO: 1114806 - DNA, 19 bp, Homo sapiens
gccctctttcatctgtaag

SEQ ID NO: 1114807 - DNA, 14 bp, Homo sapiens
gccctctttccctg

SEQ ID NO: 1114808 - DNA, 15 bp, Homo sapiens
gccctctttccctgc

SEQ ID NO: 1114809 - DNA, 16 bp, Homo sapiens
gccctctttccctgcg

SEQ ID NO: 1114810 - DNA, 21 bp, Homo sapiens
gccctgaaccacgaggctgcc

SEQ ID NO: 1114811 - DNA, 22 bp, Homo sapiens
gccctgaaccacgaggctgccc

SEQ ID NO: 1114812 - DNA, 16 bp, Homo sapiens
gccctgaatttcttct

SEQ ID NO: 1114813 - DNA, 14 bp, Homo sapiens
gccctgaccctgtg

SEQ ID NO: 1114814 - DNA, 13 bp, Homo sapiens
gccctgacctccc

SEQ ID NO: 1114815 - DNA, 16 bp, Homo sapiens
gccctgactcctctgg

SEQ ID NO: 1114816 - DNA, 17 bp, Homo sapiens
gccctgactcctctggc

SEQ ID NO: 1114817 - DNA, 18 bp, Homo sapiens
gccctgactcctggactc

SEQ ID NO: 1114818 - DNA, 20 bp, Homo sapiens
gccctgactgtcagggaggg

SEQ ID NO: 1114819 - DNA, 16 bp, Homo sapiens
gccctgagaagatcta

SEQ ID NO: 1114820 - DNA, 14 bp, Homo sapiens
gccctgagacagac

SEQ ID NO: 1114821 - DNA, 22 bp, Homo sapiens
gccctgagagagaatagagctg

SEQ ID NO: 1114822 - DNA, 13 bp, Homo sapiens
gccctgagcccgg

SEQ ID NO: 1114823 - DNA, 18 bp, Homo sapiens
gccctgaggacctctcag

SEQ ID NO: 1114824 - DNA, 14 bp, Homo sapiens
gccctgaggggctg

SEQ ID NO: 1114825 - DNA, 17 bp, Homo sapiens
gccctgaggggctgggc

SEQ ID NO: 1114826 - DNA, 20 bp, Homo sapiens
gccctgaggggctgggctgg

SEQ ID NO: 1114827 - DNA, 19 bp, Homo sapiens
gccctgaggggctggggag

SEQ ID NO: 1114828 - DNA, 13 bp, Homo sapiens
gccctgaggtgtg

SEQ ID NO: 1114829 - DNA, 21 bp, Homo sapiens
gccctgaggtgtgggggctgc

SEQ ID NO: 1114830 - DNA, 21 bp, Homo sapiens
gccctgagttttacccagact

SEQ ID NO: 1114831 - DNA, 21 bp, Homo sapiens
gccctgattaaaaaatctccc

SEQ ID NO: 1114832 - DNA, 15 bp, Homo sapiens
gccctgcaaaaatat

SEQ ID NO: 1114833 - DNA, 14 bp, Homo sapiens
gccctgcaaaagga

SEQ ID NO: 1114834 - DNA, 18 bp, Homo sapiens
gccctgcaaaaggactct

SEQ ID NO: 1114835 - DNA, 19 bp, Homo sapiens
gccctgcacagacctggag

SEQ ID NO: 1114836 - DNA, 13 bp, Homo sapiens
gccctgcagagca

SEQ ID NO: 1114837 - DNA, 18 bp, Homo sapiens
gccctgcagagcaataac

SEQ ID NO: 1114838 - DNA, 13 bp, Homo sapiens
gccctgcaggcac

SEQ ID NO: 1114839 - DNA, 16 bp, Homo sapiens
gccctgcaggcacaga

SEQ ID NO: 1114840 - DNA, 20 bp, Homo sapiens
gccctgcaggcacagaggag

SEQ ID NO: 1114841 - DNA, 21 bp, Homo sapiens
gccctgcaggcacagaggagg

SEQ ID NO: 1114842 - DNA, 18 bp, Homo sapiens
gccctgcatgctgcccag

SEQ ID NO: 1114843 - DNA, 14 bp, Homo sapiens
gccctgccacgtcc

SEQ ID NO: 1114844 - DNA, 23 bp, Homo sapiens
gccctgccacgtcccgctgcctc

SEQ ID NO: 1114845 - DNA, 19 bp, Homo sapiens
gccctgccactcactaggc

SEQ ID NO: 1114846 - DNA, 19 bp, Homo sapiens
gccctgccatcttcccagc

SEQ ID NO: 1114847 - DNA, 12 bp, Homo sapiens
gccctgccatta

SEQ ID NO: 1114848 - DNA, 20 bp, Homo sapiens
gccctgcccatactgagcct

SEQ ID NO: 1114849 - DNA, 11 bp, Homo sapiens
gccctgcccca

SEQ ID NO: 1114850 - DNA, 15 bp, Homo sapiens
gccctgccccacccc

SEQ ID NO: 1114851 - DNA, 13 bp, Homo sapiens
gccctgccccagc

SEQ ID NO: 1114852 - DNA, 15 bp, Homo sapiens
gccctgccccaggcc

SEQ ID NO: 1114853 - DNA, 17 bp, Homo sapiens
gccctgccccaggcctg

SEQ ID NO: 1114854 - DNA, 22 bp, Homo sapiens
gccctgccccctcgggggcctg

SEQ ID NO: 1114855 - DNA, 11 bp, Homo sapiens
gccctgcccct

SEQ ID NO: 1114856 - DNA, 12 bp, Homo sapiens
gccctgccccta

SEQ ID NO: 1114857 - DNA, 13 bp, Homo sapiens
gccctgcccctag

SEQ ID NO: 1114858 - DNA, 16 bp, Homo sapiens
gccctgcccggggagc

SEQ ID NO: 1114859 - DNA, 17 bp, Homo sapiens
gccctgcccggggagct

SEQ ID NO: 1114860 - DNA, 20 bp, Homo sapiens
gccctgcccggggagctgca

SEQ ID NO: 1114861 - DNA, 21 bp, Homo sapiens
gccctgcccggggagctgcag

SEQ ID NO: 1114862 - DNA, 23 bp, Homo sapiens
gccctgcccggggagctgcagag

SEQ ID NO: 1114863 - DNA, 10 bp, Homo sapiens
gccctgccct

SEQ ID NO: 1114864 - DNA, 14 bp, Homo sapiens
gccctgccctcagc

SEQ ID NO: 1114865 - DNA, 17 bp, Homo sapiens
gccctgccctggcaggg

SEQ ID NO: 1114866 - DNA, 16 bp, Homo sapiens
gccctgccctgtactg

SEQ ID NO: 1114867 - DNA, 17 bp, Homo sapiens
gccctgcccttcctcag

SEQ ID NO: 1114868 - DNA, 14 bp, Homo sapiens
gccctgcccttggc

SEQ ID NO: 1114869 - DNA, 15 bp, Homo sapiens
gccctgcccttggca

SEQ ID NO: 1114870 - DNA, 16 bp, Homo sapiens
gccctgcccttggcac

SEQ ID NO: 1114871 - DNA, 23 bp, Homo sapiens
gccctgccgggaccctgctcaca

SEQ ID NO: 1114872 - DNA, 11 bp, Homo sapiens
gccctgcctct

SEQ ID NO: 1114873 - DNA, 13 bp, Homo sapiens
gccctgcctctgt

SEQ ID NO: 1114874 - DNA, 15 bp, Homo sapiens
gccctgcctctgtgt

SEQ ID NO: 1114875 - DNA, 11 bp, Homo sapiens
gccctgcctga

SEQ ID NO: 1114876 - DNA, 13 bp, Homo sapiens
gccctgcctgaga

SEQ ID NO: 1114877 - DNA, 14 bp, Homo sapiens
gccctgcctgaggg

SEQ ID NO: 1114878 - DNA, 19 bp, Homo sapiens
gccctgcctgagggcccct

SEQ ID NO: 1114879 - DNA, 14 bp, Homo sapiens
gccctgcctgccca

SEQ ID NO: 1114880 - DNA, 15 bp, Homo sapiens
gccctgcctgcccac

SEQ ID NO: 1114881 - DNA, 17 bp, Homo sapiens
gccctgcctgcccactt

SEQ ID NO: 1114882 - DNA, 16 bp, Homo sapiens
gccctgcctgggcctt

SEQ ID NO: 1114883 - DNA, 13 bp, Homo sapiens
gccctgccttgcc

SEQ ID NO: 1114884 - DNA, 19 bp, Homo sapiens
gccctgccttgccgctccc

SEQ ID NO: 1114885 - DNA, 21 bp, Homo sapiens
gccgtggattgcacgtggcct

SEQ ID NO: 1114886 - DNA, 22 bp, Homo sapiens
gccgtggattgcacgtggcctc

SEQ ID NO: 1114887 - DNA, 15 bp, Homo sapiens
gccgtggcacagctg

SEQ ID NO: 1114888 - DNA, 20 bp, Homo sapiens
gccgtggccatcagggtggg

SEQ ID NO: 1114889 - DNA, 21 bp, Homo sapiens
gccgtggcttcccgctcagcc

SEQ ID NO: 1114890 - DNA, 15 bp, Homo sapiens
gccgtgggccgggag

SEQ ID NO: 1114891 - DNA, 20 bp, Homo sapiens
gccgtggggccgccgcctct

SEQ ID NO: 1114892 - DNA, 15 bp, Homo sapiens
gccgtggggctccgg

SEQ ID NO: 1114893 - DNA, 21 bp, Homo sapiens
gccgtggtccaaccaggagct

SEQ ID NO: 1114894 - DNA, 20 bp, Homo sapiens
gccgtgtaaccatggaccca

SEQ ID NO: 1114895 - DNA, 21 bp, Homo sapiens
gccgtgtctcagcctctgcca

SEQ ID NO: 1114896 - DNA, 22 bp, Homo sapiens
gccgtgtgagtgtgacagggcc

SEQ ID NO: 1114897 - DNA, 18 bp, Homo sapiens
gccgttactctccaacct

SEQ ID NO: 1114898 - DNA, 20 bp, Homo sapiens
gccgttactctccaacctgg

SEQ ID NO: 1114899 - DNA, 18 bp, Homo sapiens
gccgttgaagaggaaggg

SEQ ID NO: 1114900 - DNA, 14 bp, Homo sapiens
gccgttttcctcat

SEQ ID NO: 1114901 - DNA, 14 bp, Homo sapiens
gcctaaaaatgcaa

SEQ ID NO: 1114902 - DNA, 21 bp, Homo sapiens
gcctaaaaattcccttcctgt

SEQ ID NO: 1114903 - DNA, 23 bp, Homo sapiens
gcctaaaacgaatggtctttgct

SEQ ID NO: 1114904 - DNA, 22 bp, Homo sapiens
gcctaaaagtgggcttgattct

SEQ ID NO: 1114905 - DNA, 15 bp, Homo sapiens
gcctaaagggcaggg

SEQ ID NO: 1114906 - DNA, 16 bp, Homo sapiens
gcctaaagggcagggc

SEQ ID NO: 1114907 - DNA, 17 bp, Homo sapiens
gcctaaatttattaaat

SEQ ID NO: 1114908 - DNA, 24 bp, Homo sapiens
gcctaagaagttattttcttgttt

SEQ ID NO: 1114909 - DNA, 20 bp, Homo sapiens
gcctaagacatgtgaggagg

SEQ ID NO: 1114910 - DNA, 12 bp, Homo sapiens
gcctaaggccct

SEQ ID NO: 1114911 - DNA, 16 bp, Homo sapiens
gcctaagtggctgctg

SEQ ID NO: 1114912 - DNA, 17 bp, Homo sapiens
gcctaagtggctgctga

SEQ ID NO: 1114913 - DNA, 15 bp, Homo sapiens
gcctaatggagaaga

SEQ ID NO: 1114914 - DNA, 22 bp, Homo sapiens
gcctaattcctggcatgacact

SEQ ID NO: 1114915 - DNA, 21 bp, Homo sapiens
gcctacaaaacctcaaaccag

SEQ ID NO: 1114916 - DNA, 21 bp, Homo sapiens
gcctacagaagggcagtgact

SEQ ID NO: 1114917 - DNA, 18 bp, Homo sapiens
gcctacagaggaggcctc

SEQ ID NO: 1114918 - DNA, 14 bp, Homo sapiens
gcctacagatgaac

SEQ ID NO: 1114919 - DNA, 15 bp, Homo sapiens
gcctacagccaggtt

SEQ ID NO: 1114920 - DNA, 22 bp, Homo sapiens
gcctacagctttgatccctgac

SEQ ID NO: 1114921 - DNA, 19 bp, Homo sapiens
gcctacatgctttgtgaac

SEQ ID NO: 1114922 - DNA, 14 bp, Homo sapiens
gcctacattcttta

SEQ ID NO: 1114923 - DNA, 21 bp, Homo sapiens
gcctaccccgcagacaccttg

SEQ ID NO: 1114924 - DNA, 22 bp, Homo sapiens
gcctacctcaagttcttggacc

SEQ ID NO: 1114925 - DNA, 16 bp, Homo sapiens
gcctacttttctttat

SEQ ID NO: 1114926 - DNA, 18 bp, Homo sapiens
gcctagaaatatctttct

SEQ ID NO: 1114927 - DNA, 19 bp, Homo sapiens
gcctagaaatatctttctc

SEQ ID NO: 1114928 - DNA, 20 bp, Homo sapiens
gcctagaacatccctgggca

SEQ ID NO: 1114929 - DNA, 21 bp, Homo sapiens
gcctagaacatccctgggcaa

SEQ ID NO: 1114930 - DNA, 13 bp, Homo sapiens
gcctagaagctgg

SEQ ID NO: 1114931 - DNA, 20 bp, Homo sapiens
gcctagatccacacacagag

SEQ ID NO: 1114932 - DNA, 20 bp, Homo sapiens
gcctagatccacgtgtggcc

SEQ ID NO: 1114933 - DNA, 22 bp, Homo sapiens
gcctagcatggggtcagcccca

SEQ ID NO: 1114934 - DNA, 16 bp, Homo sapiens
gcctagccctcccccc

SEQ ID NO: 1114935 - DNA, 15 bp, Homo sapiens
gcctagccgacctca

SEQ ID NO: 1114936 - DNA, 17 bp, Homo sapiens
gcctagccgacctcagc

SEQ ID NO: 1114937 - DNA, 20 bp, Homo sapiens
gcctagccgacctcagcctt

SEQ ID NO: 1114938 - DNA, 16 bp, Homo sapiens
gcctagcggagcccag

SEQ ID NO: 1114939 - DNA, 17 bp, Homo sapiens
gcctagcggagcccagc

SEQ ID NO: 1114940 - DNA, 22 bp, Homo sapiens
gcctagcggagcccagcctggg

SEQ ID NO: 1114941 - DNA, 16 bp, Homo sapiens
gcctagctcctgccac

SEQ ID NO: 1114942 - DNA, 20 bp, Homo sapiens
gcctagctcctgccacatgg

SEQ ID NO: 1114943 - DNA, 17 bp, Homo sapiens
gcctaggaattcccagc

SEQ ID NO: 1114944 - DNA, 19 bp, Homo sapiens
gcctaggaccactcagccc

SEQ ID NO: 1114945 - DNA, 20 bp, Homo sapiens
gcctaggaccactcagcccc

SEQ ID NO: 1114946 - DNA, 21 bp, Homo sapiens
gcctaggaccactcagcccct

SEQ ID NO: 1114947 - DNA, 13 bp, Homo sapiens
gcctaggacgcca

SEQ ID NO: 1114948 - DNA, 21 bp, Homo sapiens
gcctaggacgccaacttctcc

SEQ ID NO: 1114949 - DNA, 17 bp, Homo sapiens
gcctaggaggctggcca

SEQ ID NO: 1114950 - DNA, 13 bp, Homo sapiens
gcctaggcctcag

SEQ ID NO: 1114951 - DNA, 20 bp, Homo sapiens
gcctaggcctcagccagaga

SEQ ID NO: 1114952 - DNA, 11 bp, Homo sapiens
gcctagggagc

SEQ ID NO: 1114953 - DNA, 20 bp, Homo sapiens
gcctagggagccgcaccttg

SEQ ID NO: 1114954 - DNA, 17 bp, Homo sapiens
gcctagggcctggtcca

SEQ ID NO: 1114955 - DNA, 21 bp, Homo sapiens
gcctaggggtggcgctcagac

SEQ ID NO: 1114956 - DNA, 22 bp, Homo sapiens
gcctaggtcccttcccgaccca

SEQ ID NO: 1114957 - DNA, 23 bp, Homo sapiens
gcctaggtcccttcccgacccag

SEQ ID NO: 1114958 - DNA, 19 bp, Homo sapiens
gcctagtggggtctccctc

SEQ ID NO: 1114959 - DNA, 23 bp, Homo sapiens
gcctagtggggtctccctctcct

SEQ ID NO: 1114960 - DNA, 19 bp, Homo sapiens
gcctataaaattaaatgcc

SEQ ID NO: 1114961 - DNA, 17 bp, Homo sapiens
gcctataatacttgcaa

SEQ ID NO: 1114962 - DNA, 17 bp, Homo sapiens
gcctatacgtttctgtg

SEQ ID NO: 1114963 - DNA, 15 bp, Homo sapiens
gcctatgatcccagc

SEQ ID NO: 1114964 - DNA, 15 bp, Homo sapiens
gcctattatattaaa

SEQ ID NO: 1114965 - DNA, 21 bp, Homo sapiens
gcctattatctgtcagctgca

SEQ ID NO: 1114966 - DNA, 22 bp, Homo sapiens
gcctattccaggaattcctctt
